United States Patent 7,655,785 (BIOINFORMATICALLY DETECTABLE GROUP OF NOVEL REGULATORY OLIGONUCLEOTIDES AND USES THEREOF) - sequence listing, part 10

SEQ ID NO: 363850 - RNA, 22 nt, Homo sapiens
uaucacccuuucauuguucuuc

SEQ ID NO: 363851 - RNA, 22 nt, Homo sapiens
uaucagcacaguggguucaugg

SEQ ID NO: 363852 - RNA, 22 nt, Homo sapiens
uaucagcagcaggggcugcaga

SEQ ID NO: 363853 - RNA, 22 nt, Homo sapiens
uaucaucauuggcaggugagaa

SEQ ID NO: 363854 - RNA, 22 nt, Homo sapiens
uaucucuguggguagugcugaa

SEQ ID NO: 363855 - RNA, 22 nt, Homo sapiens
uaugaagccaggauuuauuauu

SEQ ID NO: 363856 - RNA, 20 nt, Homo sapiens
uaugacacugucauaaaaau

SEQ ID NO: 363857 - RNA, 22 nt, Homo sapiens
uaugacucagaaggcacacaca

SEQ ID NO: 363858 - RNA, 22 nt, Homo sapiens
uaugacuguuugcucauucagg

SEQ ID NO: 363859 - RNA, 22 nt, Homo sapiens
uaugaucacuacagcagggaug

SEQ ID NO: 363860 - RNA, 22 nt, Homo sapiens
uaugcacacucucccaggaggg

SEQ ID NO: 363861 - RNA, 22 nt, Homo sapiens
uaugcacuauagcauauguggu

SEQ ID NO: 363862 - RNA, 22 nt, Homo sapiens
uaugcuuauaaacauuugucag

SEQ ID NO: 363863 - RNA, 22 nt, Homo sapiens
uauggcccuuaaguauugguug

SEQ ID NO: 363864 - RNA, 17 nt, Homo sapiens
uauggcuauguuuagau

SEQ ID NO: 363865 - RNA, 22 nt, Homo sapiens
uauggcuucuuauucuuucccg

SEQ ID NO: 363866 - RNA, 22 nt, Homo sapiens
uauggcuuucuacuugaguucu

SEQ ID NO: 363867 - RNA, 22 nt, Homo sapiens
uauggcuuuguucaacagccuc

SEQ ID NO: 363868 - RNA, 19 nt, Homo sapiens
uaugggauuuuuagggugu

SEQ ID NO: 363869 - RNA, 22 nt, Homo sapiens
uauggguuuauuucuggucuca

SEQ ID NO: 363870 - RNA, 22 nt, Homo sapiens
uaugguuuucucuuacguguug

SEQ ID NO: 363871 - RNA, 22 nt, Homo sapiens
uaugucuucuuuagagaaaugu

SEQ ID NO: 363872 - RNA, 20 nt, Homo sapiens
uauuacagaguaauggugga

SEQ ID NO: 363873 - RNA, 22 nt, Homo sapiens
uauuacugucaauaucacagaa

SEQ ID NO: 363874 - RNA, 22 nt, Homo sapiens
uauuaguuuucuguggauuaca

SEQ ID NO: 363875 - RNA, 22 nt, Homo sapiens
uauuccacaauaugauuuuuaa

SEQ ID NO: 363876 - RNA, 22 nt, Homo sapiens
uauugaauuugagcugucucuu

SEQ ID NO: 363877 - RNA, 17 nt, Homo sapiens
uauugaccuuuguaugu

SEQ ID NO: 363878 - RNA, 22 nt, Homo sapiens
uauugauuuucaguguucagcu

SEQ ID NO: 363879 - RNA, 20 nt, Homo sapiens
uauugccuaaauaccagaau

SEQ ID NO: 363880 - RNA, 22 nt, Homo sapiens
uauugcuggcacauaguagguc

SEQ ID NO: 363881 - RNA, 22 nt, Homo sapiens
uauuguccacuuugcacugugu

SEQ ID NO: 363882 - RNA, 22 nt, Homo sapiens
uauuguuaaagauguuaaugau

SEQ ID NO: 363883 - RNA, 22 nt, Homo sapiens
uauuucaguugcguuucccgag

SEQ ID NO: 363884 - RNA, 22 nt, Homo sapiens
uauuuggugaaugaaugcaugu

SEQ ID NO: 363885 - RNA, 22 nt, Homo sapiens
ucaaaaucucuuagcugugucu

SEQ ID NO: 363886 - RNA, 22 nt, Homo sapiens
ucaaagacacacaaggagaagg

SEQ ID NO: 363887 - RNA, 22 nt, Homo sapiens
ucaaagugacaaaguugcagca

SEQ ID NO: 363888 - RNA, 21 nt, Homo sapiens
ugcccaguggcuuggggucag

SEQ ID NO: 363889 - RNA, 23 nt, Homo sapiens
ugccuagaccaucagccugaggu

SEQ ID NO: 363890 - RNA, 22 nt, Homo sapiens
ugccuaggcccaguccucagaa

SEQ ID NO: 363891 - RNA, 22 nt, Homo sapiens
ugccuaggcuggaaugcaaugg

SEQ ID NO: 363892 - RNA, 22 nt, Homo sapiens
ugccuaguggaaggagagcaaa

SEQ ID NO: 363893 - RNA, 22 nt, Homo sapiens
ugccugcugucuaauauauucu

SEQ ID NO: 363894 - RNA, 22 nt, Homo sapiens
ugccuuauuccaacugagcucu

SEQ ID NO: 363895 - RNA, 16 nt, Homo sapiens
ugccuucuucuguauu

SEQ ID NO: 363896 - RNA, 21 nt, Homo sapiens
ugcuacugucacuuccuuugu

SEQ ID NO: 363897 - RNA, 22 nt, Homo sapiens
ugcuaucauugauuagugaugu

SEQ ID NO: 363898 - RNA, 18 nt, Homo sapiens
ugcuaugagauuauuuua

SEQ ID NO: 363899 - RNA, 22 nt, Homo sapiens
ugcucaccugcugcucaccucc

SEQ ID NO: 363900 - RNA, 22 nt, Homo sapiens
ugcugaguguuaccggacaccg

SEQ ID NO: 363901 - RNA, 21 nt, Homo sapiens
ugcugcacuucuuuugcugug

SEQ ID NO: 363902 - RNA, 19 nt, Homo sapiens
ugcugcauugugaccuugc

SEQ ID NO: 363903 - RNA, 22 nt, Homo sapiens
ugcugcuguuguuguuacuagc

SEQ ID NO: 363904 - RNA, 22 nt, Homo sapiens
ugcugguaguuuaugacuaauu

SEQ ID NO: 363905 - RNA, 22 nt, Homo sapiens
ugcugguauuuggaccagccug

SEQ ID NO: 363906 - RNA, 22 nt, Homo sapiens
ugcuggugauuaaauccugaag

SEQ ID NO: 363907 - RNA, 22 nt, Homo sapiens
ugcugguggucccauaugauua

SEQ ID NO: 363908 - RNA, 21 nt, Homo sapiens
ugcuuacugaauguuaauuuc

SEQ ID NO: 363909 - RNA, 22 nt, Homo sapiens
uggaaaauuaggggagguuaua

SEQ ID NO: 363910 - RNA, 22 nt, Homo sapiens
uggaaauaaaauagaguuugcc

SEQ ID NO: 363911 - RNA, 20 nt, Homo sapiens
uggaaauuaaccuuucaggu

SEQ ID NO: 363912 - RNA, 22 nt, Homo sapiens
uggaaauuaagucuuuccugag

SEQ ID NO: 363913 - RNA, 22 nt, Homo sapiens
uggaagacauugggugaagggu

SEQ ID NO: 363914 - RNA, 22 nt, Homo sapiens
uggaagacauuuuggaccuugg

SEQ ID NO: 363915 - RNA, 22 nt, Homo sapiens
uggaagauggaguuuuaucauu

SEQ ID NO: 363916 - RNA, 22 nt, Homo sapiens
uggaagccuagauucuuuucuu

SEQ ID NO: 363917 - RNA, 22 nt, Homo sapiens
uggaaggcuucauauguaaaga

SEQ ID NO: 363918 - RNA, 22 nt, Homo sapiens
uggaaguaaucaugagguagca

SEQ ID NO: 363919 - RNA, 22 nt, Homo sapiens
uggaagugaacaaccaaggcag

SEQ ID NO: 363920 - RNA, 22 nt, Homo sapiens
uggaaguuaaaugacucuuucu

SEQ ID NO: 363921 - RNA, 19 nt, Homo sapiens
uggaauggauuuaaaugug

SEQ ID NO: 363922 - RNA, 22 nt, Homo sapiens
uggaaugguuggugugauuuua

SEQ ID NO: 363923 - RNA, 22 nt, Homo sapiens
uggaaugugaauaacuuccuuc

SEQ ID NO: 363924 - RNA, 22 nt, Homo sapiens
uggacagagagaccggcauuuu

SEQ ID NO: 363925 - RNA, 21 nt, Homo sapiens
uggaccccuuucuuacaccgu

SEQ ID NO: 363926 - RNA, 22 nt, Homo sapiens
uggacuguaagugccuugagua

SEQ ID NO: 363927 - RNA, 22 nt, Homo sapiens
uggacuuuaauaaaagggaaau

SEQ ID NO: 363928 - RNA, 18 nt, Homo sapiens
uggagauaagaagaacuu

SEQ ID NO: 363929 - RNA, 22 nt, Homo sapiens
uggagauguuuaaaauccacug

SEQ ID NO: 363930 - RNA, 22 nt, Homo sapiens
uggagcaaaguugaggccaagc

SEQ ID NO: 363931 - RNA, 23 nt, Homo sapiens
uggaggacaagcauggauaguga

SEQ ID NO: 363932 - RNA, 22 nt, Homo sapiens
uggaggacugcagaacugaggc

SEQ ID NO: 363933 - RNA, 22 nt, Homo sapiens
uggagugaaaacacacuaaucu

SEQ ID NO: 363934 - RNA, 20 nt, Homo sapiens
uggagugaagguucuggacc

SEQ ID NO: 363935 - RNA, 22 nt, Homo sapiens
uggagugauaugguuauauggg

SEQ ID NO: 363936 - RNA, 22 nt, Homo sapiens
uggaguguaauuagccaucagu

SEQ ID NO: 363937 - RNA, 22 nt, Homo sapiens
uggauagaaauguacuguuuuc

SEQ ID NO: 363938 - RNA, 22 nt, Homo sapiens
uggauaguaauaaacauauagg

SEQ ID NO: 363939 - RNA, 22 nt, Homo sapiens
uggauagugauaagguagauga

SEQ ID NO: 363940 - RNA, 22 nt, Homo sapiens
uggauugaaagcuuuaauauug

SEQ ID NO: 363941 - RNA, 22 nt, Homo sapiens
uggcaaaaaaccgcaguugccu

SEQ ID NO: 363942 - RNA, 21 nt, Homo sapiens
uggcaaaaugggcaguggguu

SEQ ID NO: 363943 - RNA, 22 nt, Homo sapiens
uggcaaauagcaauaggagggu

SEQ ID NO: 363944 - RNA, 22 nt, Homo sapiens
uggcaaaugaaagaaagccagu

SEQ ID NO: 363945 - RNA, 22 nt, Homo sapiens
uggcaaauuccaaaguuaauuc

SEQ ID NO: 363946 - RNA, 22 nt, Homo sapiens
uggcaagaacgaaauguagggu

SEQ ID NO: 363947 - RNA, 22 nt, Homo sapiens
uggcaagagaacaacaucucuc

SEQ ID NO: 363948 - RNA, 22 nt, Homo sapiens
uggcaagagcaaaauguacagu

SEQ ID NO: 363949 - RNA, 22 nt, Homo sapiens
uggcaagaucacaauuacuuuu

SEQ ID NO: 363950 - RNA, 20 nt, Homo sapiens
uggcaccugacagauagcca

SEQ ID NO: 363951 - RNA, 22 nt, Homo sapiens
uggcaggugcacuggcuuugaa

SEQ ID NO: 363952 - RNA, 22 nt, Homo sapiens
uggcaguuuacaaaugccauga

SEQ ID NO: 363953 - RNA, 22 nt, Homo sapiens
uggcaguuuacagcuuuaggag

SEQ ID NO: 363954 - RNA, 22 nt, Homo sapiens
uggcaguuucauaugguucaac

SEQ ID NO: 363955 - RNA, 22 nt, Homo sapiens
uggcauauaaagauguguucaa

SEQ ID NO: 363956 - RNA, 22 nt, Homo sapiens
uggcauauaauauagaagacua

SEQ ID NO: 363957 - RNA, 22 nt, Homo sapiens
uggcaucuguucuacacauaaa

SEQ ID NO: 363958 - RNA, 22 nt, Homo sapiens
uggcauggaguggauggcccca

SEQ ID NO: 363959 - RNA, 22 nt, Homo sapiens
uggcauggggcagaacauuaca

SEQ ID NO: 363960 - RNA, 22 nt, Homo sapiens
uggcauuguccaauaaaauuuu

SEQ ID NO: 363961 - RNA, 22 nt, Homo sapiens
uggcauuuugugugaauuagaa

SEQ ID NO: 363962 - RNA, 22 nt, Homo sapiens
uggccuguaacccucucauagg

SEQ ID NO: 363963 - RNA, 22 nt, Homo sapiens
uggccuguaacgcugucucagc

SEQ ID NO: 363964 - RNA, 22 nt, Homo sapiens
uggcggagacauggacuucaga

SEQ ID NO: 363965 - RNA, 22 nt, Homo sapiens
uggcgggaaaguugggagaaga

SEQ ID NO: 363966 - RNA, 22 nt, Homo sapiens
uggcuacagaaaguacuaguga

SEQ ID NO: 363967 - RNA, 22 nt, Homo sapiens
uggcuacugaccugcuaggggg

SEQ ID NO: 363968 - RNA, 19 nt, Homo sapiens
uggcuagaggccaggcguu

SEQ ID NO: 363969 - RNA, 20 nt, Homo sapiens
uggcucuuugcugcuaaagu

SEQ ID NO: 363970 - RNA, 22 nt, Homo sapiens
uggcuguguccucucccaaauc

SEQ ID NO: 363971 - RNA, 20 nt, Homo sapiens
uggcuucuuaauugcaggca

SEQ ID NO: 363972 - RNA, 22 nt, Homo sapiens
uggcuuuucauccugggacauu

SEQ ID NO: 363973 - RNA, 22 nt, Homo sapiens
uggcuuuuccaggcauuacgau

SEQ ID NO: 363974 - RNA, 20 nt, Homo sapiens
ugggaacaugugguauaugg

SEQ ID NO: 363975 - RNA, 22 nt, Homo sapiens
ugggaagaugcugcuucuuccu

SEQ ID NO: 363976 - RNA, 22 nt, Homo sapiens
cagugguuuucaacccugguug

SEQ ID NO: 363977 - RNA, 21 nt, Homo sapiens
cauaaugcuacuuauuuuaug

SEQ ID NO: 363978 - RNA, 22 nt, Homo sapiens
cauacaugugcuugucuuaugc

SEQ ID NO: 363979 - RNA, 22 nt, Homo sapiens
cauaguacuugcauaguacuau

SEQ ID NO: 363980 - RNA, 22 nt, Homo sapiens
caucaaaguggagggaaggacc

SEQ ID NO: 363981 - RNA, 23 nt, Homo sapiens
caucacauagaggaaagaggaca

SEQ ID NO: 363982 - RNA, 22 nt, Homo sapiens
caucacaugcuuauuuuccuca

SEQ ID NO: 363983 - RNA, 20 nt, Homo sapiens
caucaccuggcaggauuugu

SEQ ID NO: 363984 - RNA, 22 nt, Homo sapiens
caucagcaauguaugaggguuc

SEQ ID NO: 363985 - RNA, 22 nt, Homo sapiens
caugcagcacacaugucugugc

SEQ ID NO: 363986 - RNA, 22 nt, Homo sapiens
caugcauagccauucauucguu

SEQ ID NO: 363987 - RNA, 22 nt, Homo sapiens
cauggcacagagaauguguucu

SEQ ID NO: 363988 - RNA, 22 nt, Homo sapiens
cauggcacaucuuuucugacua

SEQ ID NO: 363989 - RNA, 22 nt, Homo sapiens
cauggcuacugcagauguaggg

SEQ ID NO: 363990 - RNA, 22 nt, Homo sapiens
cauggcucuuguuuacucccag

SEQ ID NO: 363991 - RNA, 22 nt, Homo sapiens
cauggcuuuauuuucagcuucu

SEQ ID NO: 363992 - RNA, 22 nt, Homo sapiens
caugguacugccacagaagagu

SEQ ID NO: 363993 - RNA, 22 nt, Homo sapiens
cauggucaccuuccaaguuauu

SEQ ID NO: 363994 - RNA, 22 nt, Homo sapiens
cauguauagauuccauaguggu

SEQ ID NO: 363995 - RNA, 22 nt, Homo sapiens
caugucacuuccucucugaugg

SEQ ID NO: 363996 - RNA, 22 nt, Homo sapiens
caugucuuuuauucugugugau

SEQ ID NO: 363997 - RNA, 20 nt, Homo sapiens
cauuacacuccaaccugggu

SEQ ID NO: 363998 - RNA, 20 nt, Homo sapiens
cauuccacuuuccugucagu

SEQ ID NO: 363999 - RNA, 22 nt, Homo sapiens
cauugcaauccagccugggcaa

SEQ ID NO: 364000 - RNA, 22 nt, Homo sapiens
cauugcacuccagccuagccaa

SEQ ID NO: 364001 - RNA, 22 nt, Homo sapiens
cauugcacuccagccuuggcaa

SEQ ID NO: 364002 - RNA, 22 nt, Homo sapiens
cauugcacuccagcucugggcg

SEQ ID NO: 364003 - RNA, 22 nt, Homo sapiens
cauugcacuccagucugggcaa

SEQ ID NO: 364004 - RNA, 22 nt, Homo sapiens
cauugcacuccauccuuggcaa

SEQ ID NO: 364005 - RNA, 22 nt, Homo sapiens
cauugcacuccaucuugggcaa

SEQ ID NO: 364006 - RNA, 22 nt, Homo sapiens
cauugcacucuagucuggguga

SEQ ID NO: 364007 - RNA, 22 nt, Homo sapiens
cauugcagauccuucaaaugac

SEQ ID NO: 364008 - RNA, 22 nt, Homo sapiens
cauugcaguuuuugguguaucu

SEQ ID NO: 364009 - RNA, 22 nt, Homo sapiens
cauugcauuccagucugggcaa

SEQ ID NO: 364010 - RNA, 22 nt, Homo sapiens
cauugcccuccagccugggcaa

SEQ ID NO: 364011 - RNA, 22 nt, Homo sapiens
cauuguccuccuggggcuauuu

SEQ ID NO: 364012 - RNA, 22 nt, Homo sapiens
cauuuuacuuuccagacgugga

SEQ ID NO: 364013 - RNA, 22 nt, Homo sapiens
ccaaggaauacccucccuuuuu

SEQ ID NO: 364014 - RNA, 22 nt, Homo sapiens
ccaagugcuuaaaauuucauuu

SEQ ID NO: 364015 - RNA, 22 nt, Homo sapiens
ccacaguugaaauuuugacugu

SEQ ID NO: 364016 - RNA, 22 nt, Homo sapiens
ccagauguuuucauucagcaag

SEQ ID NO: 364017 - RNA, 23 nt, Homo sapiens
ccaguauuuauguaaggaagugu

SEQ ID NO: 364018 - RNA, 22 nt, Homo sapiens
ccagugauuguauggugaaggu

SEQ ID NO: 364019 - RNA, 18 nt, Homo sapiens
ccagugcaaggaaagccc

SEQ ID NO: 364020 - RNA, 22 nt, Homo sapiens
ccagugcauggaucccaggggg

SEQ ID NO: 364021 - RNA, 21 nt, Homo sapiens
ccaguguaaugauagcaggca

SEQ ID NO: 364022 - RNA, 22 nt, Homo sapiens
ccaguuuuuggcaaugaugaau

SEQ ID NO: 364023 - RNA, 22 nt, Homo sapiens
ccaucacaggccucagugggaa

SEQ ID NO: 364024 - RNA, 20 nt, Homo sapiens
ccaucaguccucucuuguuc

SEQ ID NO: 364025 - RNA, 22 nt, Homo sapiens
ccauggcaauggucagucuauu

SEQ ID NO: 364026 - RNA, 22 nt, Homo sapiens
cccagagacagaaugauaaacu

SEQ ID NO: 364027 - RNA, 22 nt, Homo sapiens
cccagugaagagaaccuuacga

SEQ ID NO: 364028 - RNA, 18 nt, Homo sapiens
cccagugacuuauggccu

SEQ ID NO: 364029 - RNA, 22 nt, Homo sapiens
cccagugguuacauaaggagua

SEQ ID NO: 364030 - RNA, 22 nt, Homo sapiens
cccagugugaacuuggcauuuu

SEQ ID NO: 364031 - RNA, 22 nt, Homo sapiens
cccagugugcugggugacagcu

SEQ ID NO: 364032 - RNA, 22 nt, Homo sapiens
cccaguuuugcuucucaugagg

SEQ ID NO: 364033 - RNA, 19 nt, Homo sapiens
ccccuguggauaccgaggg

SEQ ID NO: 364034 - RNA, 20 nt, Homo sapiens
cccuaagccagaugcugggg

SEQ ID NO: 364035 - RNA, 22 nt, Homo sapiens
cccugaagaaagccuaggacau

SEQ ID NO: 364036 - RNA, 22 nt, Homo sapiens
cccugagaaaacuuuguccuua

SEQ ID NO: 364037 - RNA, 22 nt, Homo sapiens
cccuggacauucaucauuaugu

SEQ ID NO: 364038 - RNA, 22 nt, Homo sapiens
cccuuagacuacuaauaugagc

SEQ ID NO: 364039 - RNA, 22 nt, Homo sapiens
cccuugcacuucagagcugcau

SEQ ID NO: 364040 - RNA, 20 nt, Homo sapiens
ccuaguguucuuaggcugca

SEQ ID NO: 364041 - RNA, 22 nt, Homo sapiens
ccucuuuguugagacuucacca

SEQ ID NO: 364042 - RNA, 22 nt, Homo sapiens
ccugagaucauacuguuaguaa

SEQ ID NO: 364043 - RNA, 22 nt, Homo sapiens
ccugcauaguucaccgcugaua

SEQ ID NO: 364044 - RNA, 22 nt, Homo sapiens
ccuggcacugggccccguggcu

SEQ ID NO: 364045 - RNA, 22 nt, Homo sapiens
ccuucuuuuguaaggcugaaua

SEQ ID NO: 364046 - RNA, 22 nt, Homo sapiens
cgaguagcacaaugugugugau

SEQ ID NO: 364047 - RNA, 22 nt, Homo sapiens
cggaaugaaaauguccuucagu

SEQ ID NO: 364048 - RNA, 22 nt, Homo sapiens
cguugcacuccagccugggcaa

SEQ ID NO: 364049 - RNA, 22 nt, Homo sapiens
cuaaagauagugacaugauuug

SEQ ID NO: 364050 - RNA, 22 nt, Homo sapiens
cuaaagugcugagauuauaggu

SEQ ID NO: 364051 - RNA, 22 nt, Homo sapiens
cuaaaugucucuacuaaguuua

SEQ ID NO: 364052 - RNA, 22 nt, Homo sapiens
cuaagauugucuuaguguguug

SEQ ID NO: 364053 - RNA, 22 nt, Homo sapiens
cuaaggcaguagccugaauaau

SEQ ID NO: 364054 - RNA, 22 nt, Homo sapiens
cuaagggaggaagcugugcagg

SEQ ID NO: 364055 - RNA, 22 nt, Homo sapiens
cuaagugaguauaauuuuaaga

SEQ ID NO: 364056 - RNA, 22 nt, Homo sapiens
cuaauucuggccaaagggauaa

SEQ ID NO: 364057 - RNA, 22 nt, Homo sapiens
cuacaguaugaaaccuuuacuc

SEQ ID NO: 364058 - RNA, 22 nt, Homo sapiens
cuacugcacaucaucugaguua

SEQ ID NO: 364059 - RNA, 22 nt, Homo sapiens
cuagcagacacuuccagagagu

SEQ ID NO: 364060 - RNA, 22 nt, Homo sapiens
cuagcagcaugagaauggacca

SEQ ID NO: 364061 - RNA, 22 nt, Homo sapiens
cuagcccugagauaaaugucau

SEQ ID NO: 364062 - RNA, 22 nt, Homo sapiens
cuagccuggagugcaguggugc

SEQ ID NO: 364063 - RNA, 22 nt, Homo sapiens
cuagcugcacuuccugcuacug

SEQ ID NO: 364064 - RNA, 22 nt, Homo sapiens
cuauaacagugugguuuggaga

SEQ ID NO: 364065 - RNA, 22 nt, Homo sapiens
ugggaagaagguuuacuugcca

SEQ ID NO: 364066 - RNA, 22 nt, Homo sapiens
ugggaagcugcugaacuacagu

SEQ ID NO: 364067 - RNA, 22 nt, Homo sapiens
ugggaauaugauacaggucuuu

SEQ ID NO: 364068 - RNA, 22 nt, Homo sapiens
ugggaucauuaugcauagugua

SEQ ID NO: 364069 - RNA, 22 nt, Homo sapiens
ugggaugaugcuugagaauauc

SEQ ID NO: 364070 - RNA, 22 nt, Homo sapiens
ugggcauggaguggccuuaugu

SEQ ID NO: 364071 - RNA, 22 nt, Homo sapiens
ugguaaaaugucauuuaccaga

SEQ ID NO: 364072 - RNA, 22 nt, Homo sapiens
ugguaagaucagaacuggaguc

SEQ ID NO: 364073 - RNA, 22 nt, Homo sapiens
ugguauuuaauauaugagaguu

SEQ ID NO: 364074 - RNA, 19 nt, Homo sapiens
uggucaguucugggagcug

SEQ ID NO: 364075 - RNA, 19 nt, Homo sapiens
uggucccccgcaaucucau

SEQ ID NO: 364076 - RNA, 22 nt, Homo sapiens
uggucuucuggccuccagaacc

SEQ ID NO: 364077 - RNA, 22 nt, Homo sapiens
uggugagaaaagaugucuuugu

SEQ ID NO: 364078 - RNA, 23 nt, Homo sapiens
ugguuuguaagagauggacugga

SEQ ID NO: 364079 - RNA, 18 nt, Homo sapiens
uguaaacuaccucaaccu

SEQ ID NO: 364080 - RNA, 22 nt, Homo sapiens
uguaaacuaugagcugauuauu

SEQ ID NO: 364081 - RNA, 20 nt, Homo sapiens
uguaacaaucuggauguugc

SEQ ID NO: 364082 - RNA, 22 nt, Homo sapiens
uguaaugaucaaaucagaguaa

SEQ ID NO: 364083 - RNA, 22 nt, Homo sapiens
uguacaaauuucugugguggug

SEQ ID NO: 364084 - RNA, 22 nt, Homo sapiens
uguagauauucuuucaguuuuu

SEQ ID NO: 364085 - RNA, 22 nt, Homo sapiens
uguagcacauuugaagagaagc

SEQ ID NO: 364086 - RNA, 22 nt, Homo sapiens
uguagucauuuggaguccagcu

SEQ ID NO: 364087 - RNA, 21 nt, Homo sapiens
uguauacauauguuaggugca

SEQ ID NO: 364088 - RNA, 22 nt, Homo sapiens
uguaugucuucuuuagauaagu

SEQ ID NO: 364089 - RNA, 22 nt, Homo sapiens
ugucaaugggaauuuguuuuag

SEQ ID NO: 364090 - RNA, 22 nt, Homo sapiens
ugucacaguuuguacuuuauag

SEQ ID NO: 364091 - RNA, 22 nt, Homo sapiens
ugucacauccaagaaggugcag

SEQ ID NO: 364092 - RNA, 22 nt, Homo sapiens
ugucaccuugcucauccucgga

SEQ ID NO: 364093 - RNA, 22 nt, Homo sapiens
ugucacugugaguuugacugcu

SEQ ID NO: 364094 - RNA, 22 nt, Homo sapiens
ugucacuuugccuucuggacuu

SEQ ID NO: 364095 - RNA, 22 nt, Homo sapiens
ugucagaaucugagacgacaac

SEQ ID NO: 364096 - RNA, 18 nt, Homo sapiens
ugucagaguggauuguaa

SEQ ID NO: 364097 - RNA, 22 nt, Homo sapiens
ugucaucauuugagagaagaaa

SEQ ID NO: 364098 - RNA, 22 nt, Homo sapiens
ugucaugaacucacauucuggg

SEQ ID NO: 364099 - RNA, 22 nt, Homo sapiens
ugucauggggaaaauaacagac

SEQ ID NO: 364100 - RNA, 22 nt, Homo sapiens
ugucauguauauaccacuucca

SEQ ID NO: 364101 - RNA, 22 nt, Homo sapiens
ugucauguggcuaacgauucau

SEQ ID NO: 364102 - RNA, 22 nt, Homo sapiens
uguccaguguuccucagaagaa

SEQ ID NO: 364103 - RNA, 19 nt, Homo sapiens
ugucccagccauagaggca

SEQ ID NO: 364104 - RNA, 19 nt, Homo sapiens
aaaguucuucccuuuggag

SEQ ID NO: 364105 - RNA, 15 nt, Homo sapiens
aaauaugucaguucu

SEQ ID NO: 364106 - RNA, 22 nt, Homo sapiens
aaauccaucucuuggggcauug

SEQ ID NO: 364107 - RNA, 22 nt, Homo sapiens
aaaugcagauuccuaggcccca

SEQ ID NO: 364108 - RNA, 22 nt, Homo sapiens
aaaugcaguugguggggauaug

SEQ ID NO: 364109 - RNA, 22 nt, Homo sapiens
aaaugcucucuacacguuucug

SEQ ID NO: 364110 - RNA, 22 nt, Homo sapiens
aaaugcuguuccaggaccuauc

SEQ ID NO: 364111 - RNA, 22 nt, Homo sapiens
aaaugcuuucuuggaccauuug

SEQ ID NO: 364112 - RNA, 22 nt, Homo sapiens
aaaugucauggaguguuucccc

SEQ ID NO: 364113 - RNA, 22 nt, Homo sapiens
aaauucauuucagcucugggua

SEQ ID NO: 364114 - RNA, 22 nt, Homo sapiens
aaauugcacaaguggugauuug

SEQ ID NO: 364115 - RNA, 23 nt, Homo sapiens
aaauuugccuauuauuccuaugg

SEQ ID NO: 364116 - RNA, 22 nt, Homo sapiens
aacaccaucccuuugaugcuuu

SEQ ID NO: 364117 - RNA, 22 nt, Homo sapiens
aacaccuugcagggauuaugac

SEQ ID NO: 364118 - RNA, 22 nt, Homo sapiens
aacacuguuuccagucaugauc

SEQ ID NO: 364119 - RNA, 22 nt, Homo sapiens
aacagauugcugagccccaccc

SEQ ID NO: 364120 - RNA, 22 nt, Homo sapiens
aacaggcuccuaggggugcacc

SEQ ID NO: 364121 - RNA, 22 nt, Homo sapiens
aacaguaucuaacgagugauga

SEQ ID NO: 364122 - RNA, 22 nt, Homo sapiens
aacagucuccaguuguauccau

SEQ ID NO: 364123 - RNA, 21 nt, Homo sapiens
aacagugcugaacagacaccu

SEQ ID NO: 364124 - RNA, 22 nt, Homo sapiens
aacagugcuucauucacacauu

SEQ ID NO: 364125 - RNA, 22 nt, Homo sapiens
aacauguuuagcagauaccugu

SEQ ID NO: 364126 - RNA, 22 nt, Homo sapiens
aaccugaagaaaauauuugcug

SEQ ID NO: 364127 - RNA, 22 nt, Homo sapiens
aacucacauucuuucuugguac

SEQ ID NO: 364128 - RNA, 22 nt, Homo sapiens
aacucugucuccuucaaguuca

SEQ ID NO: 364129 - RNA, 22 nt, Homo sapiens
aacuggcacuacaucaagagcu

SEQ ID NO: 364130 - RNA, 21 nt, Homo sapiens
aacuggugugagaugguaugu

SEQ ID NO: 364131 - RNA, 20 nt, Homo sapiens
aagacacuguccccacugga

SEQ ID NO: 364132 - RNA, 22 nt, Homo sapiens
aagagagcuaugugcauaauua

SEQ ID NO: 364133 - RNA, 20 nt, Homo sapiens
aagagcucaccagaauaucu

SEQ ID NO: 364134 - RNA, 22 nt, Homo sapiens
aagagguuuaacugacucacag

SEQ ID NO: 364135 - RNA, 22 nt, Homo sapiens
aagaguaguaguggcacucucu

SEQ ID NO: 364136 - RNA, 22 nt, Homo sapiens
aagaguuaguaaaauuuccucu

SEQ ID NO: 364137 - RNA, 22 nt, Homo sapiens
aagaugauguucuuuuucuuag

SEQ ID NO: 364138 - RNA, 22 nt, Homo sapiens
aagaugcagucauacuggagga

SEQ ID NO: 364139 - RNA, 22 nt, Homo sapiens
aagcaacacaucugccccgguu

SEQ ID NO: 364140 - RNA, 20 nt, Homo sapiens
aagcaagcauuugcaaucau

SEQ ID NO: 364141 - RNA, 22 nt, Homo sapiens
aagcacccagccucacgccugc

SEQ ID NO: 364142 - RNA, 20 nt, Homo sapiens
aagcagacauuuggaugaaa

SEQ ID NO: 364143 - RNA, 22 nt, Homo sapiens
aagcagauguguugaaaguacu

SEQ ID NO: 364144 - RNA, 23 nt, Homo sapiens
aagcaugcacagcuguuuguggu

SEQ ID NO: 364145 - RNA, 20 nt, Homo sapiens
aagcauggguuuuaggguca

SEQ ID NO: 364146 - RNA, 22 nt, Homo sapiens
aagcuacauuuuauuuauguca

SEQ ID NO: 364147 - RNA, 22 nt, Homo sapiens
aagcuacuuuggugguuccuua

SEQ ID NO: 364148 - RNA, 22 nt, Homo sapiens
aagcucuuguugaaucuuguca

SEQ ID NO: 364149 - RNA, 22 nt, Homo sapiens
aagcugcauuuucuagaugcuu

SEQ ID NO: 364150 - RNA, 22 nt, Homo sapiens
aagcugccaggcaugguggcug

SEQ ID NO: 364151 - RNA, 22 nt, Homo sapiens
aagcugccuugugaaggcauuc

SEQ ID NO: 364152 - RNA, 22 nt, Homo sapiens
aagcuggagugcaguggugcaa

SEQ ID NO: 364153 - RNA, 22 nt, Homo sapiens
aagcuggagugcaguggugcga

SEQ ID NO: 364154 - RNA, 22 nt, Homo sapiens
uguucaugaguucucauuuuua

SEQ ID NO: 364155 - RNA, 22 nt, Homo sapiens
uguugcacacacugaaauacac

SEQ ID NO: 364156 - RNA, 22 nt, Homo sapiens
uguugcacuccagccuagguga

SEQ ID NO: 364157 - RNA, 22 nt, Homo sapiens
uguuggacuuacuuggcagauu

SEQ ID NO: 364158 - RNA, 22 nt, Homo sapiens
uguuggcauugcugcugacccu

SEQ ID NO: 364159 - RNA, 18 nt, Homo sapiens
uguugguguucacucacu

SEQ ID NO: 364160 - RNA, 22 nt, Homo sapiens
uguuugcuguguggaguagcag

SEQ ID NO: 364161 - RNA, 22 nt, Homo sapiens
uguuuuggaguggacuuugcau

SEQ ID NO: 364162 - RNA, 22 nt, Homo sapiens
uuaaagcuggcguuacaguuug

SEQ ID NO: 364163 - RNA, 22 nt, Homo sapiens
uuaaagugaucauaaggauagu

SEQ ID NO: 364164 - RNA, 22 nt, Homo sapiens
uuaaaguguuuucaaaauguca

SEQ ID NO: 364165 - RNA, 22 nt, Homo sapiens
uuaacacugccauugauacugu

SEQ ID NO: 364166 - RNA, 22 nt, Homo sapiens
uuaagcaaagguaacaugagaa

SEQ ID NO: 364167 - RNA, 22 nt, Homo sapiens
uuaagcaguaguuaaggagagg

SEQ ID NO: 364168 - RNA, 22 nt, Homo sapiens
uuaagcaguggauuagaauuuu

SEQ ID NO: 364169 - RNA, 22 nt, Homo sapiens
uuaaggaaagcauuuaauucag

SEQ ID NO: 364170 - RNA, 22 nt, Homo sapiens
uuaaggcagugucuaugccagu

SEQ ID NO: 364171 - RNA, 22 nt, Homo sapiens
uuaaggcauucuuugucuucau

SEQ ID NO: 364172 - RNA, 22 nt, Homo sapiens
uuaaggcuccuguuggcuuuua

SEQ ID NO: 364173 - RNA, 22 nt, Homo sapiens
uuaaggcuuguacuuguuuucu

SEQ ID NO: 364174 - RNA, 22 nt, Homo sapiens
uuaagggaggagcuucaagaug

SEQ ID NO: 364175 - RNA, 22 nt, Homo sapiens
uuaaguaaucagagaagagaac

SEQ ID NO: 364176 - RNA, 22 nt, Homo sapiens
uuaaguagaugaaugugaaugu

SEQ ID NO: 364177 - RNA, 22 nt, Homo sapiens
uuaagugaauuaucuaacaugu

SEQ ID NO: 364178 - RNA, 22 nt, Homo sapiens
uuaagugguagguggugcccaa

SEQ ID NO: 364179 - RNA, 22 nt, Homo sapiens
uuaaugacaucauaggugaagu

SEQ ID NO: 364180 - RNA, 22 nt, Homo sapiens
uuaauguaauugauugauugac

SEQ ID NO: 364181 - RNA, 22 nt, Homo sapiens
uuaauucugucugcccucaucc

SEQ ID NO: 364182 - RNA, 22 nt, Homo sapiens
uuacaacugucuuacugguuau

SEQ ID NO: 364183 - RNA, 22 nt, Homo sapiens
uuacacaguaggucccuaguaa

SEQ ID NO: 364184 - RNA, 22 nt, Homo sapiens
uuacaguagaugaggguauaau

SEQ ID NO: 364185 - RNA, 22 nt, Homo sapiens
uuacaguguuuguucuguuacu

SEQ ID NO: 364186 - RNA, 22 nt, Homo sapiens
uuacauguuuauggggguacau

SEQ ID NO: 364187 - RNA, 22 nt, Homo sapiens
uuaccugagaaggugacauuug

SEQ ID NO: 364188 - RNA, 22 nt, Homo sapiens
uuacugcucuuuugucaugagu

SEQ ID NO: 364189 - RNA, 22 nt, Homo sapiens
uuagaacaguguuugccucgcu

SEQ ID NO: 364190 - RNA, 22 nt, Homo sapiens
guucaagcaauucugcugccuc

SEQ ID NO: 364191 - RNA, 20 nt, Homo sapiens
guucacagagguuaugauua

SEQ ID NO: 364192 - RNA, 17 nt, Homo sapiens
guucccaguggcauuug

SEQ ID NO: 364193 - RNA, 22 nt, Homo sapiens
guugaaaucaucacuuggcaug

SEQ ID NO: 364194 - RNA, 22 nt, Homo sapiens
guugaacaauagauucauauca

SEQ ID NO: 364195 - RNA, 18 nt, Homo sapiens
guugagcuuuuccuuuag

SEQ ID NO: 364196 - RNA, 22 nt, Homo sapiens
guugcaaaguaauugugguuuu

SEQ ID NO: 364197 - RNA, 22 nt, Homo sapiens
guugcccuuagcacuucagccu

SEQ ID NO: 364198 - RNA, 22 nt, Homo sapiens
guuguggcuugugauuaagcac

SEQ ID NO: 364199 - RNA, 22 nt, Homo sapiens
guuuacagucgacuugggaaua

SEQ ID NO: 364200 - RNA, 22 nt, Homo sapiens
guuugcacuccuaugagaaucu

SEQ ID NO: 364201 - RNA, 22 nt, Homo sapiens
guuuggcucuuguuucugucaa

SEQ ID NO: 364202 - RNA, 22 nt, Homo sapiens
guuuguaacucuagugacuaga

SEQ ID NO: 364203 - RNA, 22 nt, Homo sapiens
guuugugguuaaagccuuucau

SEQ ID NO: 364204 - RNA, 22 nt, Homo sapiens
uaaaagucaucacaacuggagu

SEQ ID NO: 364205 - RNA, 22 nt, Homo sapiens
uaaacugucuugcaguuacaug

SEQ ID NO: 364206 - RNA, 22 nt, Homo sapiens
uaaagauaaggcucgcuuggau

SEQ ID NO: 364207 - RNA, 16 nt, Homo sapiens
uaaagcuaaucacuuu

SEQ ID NO: 364208 - RNA, 22 nt, Homo sapiens
uaaagcuacagagcggaaaauu

SEQ ID NO: 364209 - RNA, 21 nt, Homo sapiens
uaaagcuagaaccuuagcuuu

SEQ ID NO: 364210 - RNA, 22 nt, Homo sapiens
uaaagcuagaauuguuccagca

SEQ ID NO: 364211 - RNA, 22 nt, Homo sapiens
uaaagcuagagcuggaguggca

SEQ ID NO: 364212 - RNA, 20 nt, Homo sapiens
uaaagcugcucagggggcuc

SEQ ID NO: 364213 - RNA, 22 nt, Homo sapiens
uaaagugaggauggcaguaggu

SEQ ID NO: 364214 - RNA, 22 nt, Homo sapiens
uaaaugcuugagaugauggaua

SEQ ID NO: 364215 - RNA, 22 nt, Homo sapiens
uaacaacauucuaacugacggc

SEQ ID NO: 364216 - RNA, 22 nt, Homo sapiens
uaacaccuugcucugucaauaa

SEQ ID NO: 364217 - RNA, 22 nt, Homo sapiens
uaacaccuuugauagcacuuuu

SEQ ID NO: 364218 - RNA, 22 nt, Homo sapiens
uaacauucacaugcugcaaaaa

SEQ ID NO: 364219 - RNA, 22 nt, Homo sapiens
uaacauugucuugcuuaguuuu

SEQ ID NO: 364220 - RNA, 22 nt, Homo sapiens
uaacccacgcagaauggacaag

SEQ ID NO: 364221 - RNA, 22 nt, Homo sapiens
uaacccuuacaacuacacucgu

SEQ ID NO: 364222 - RNA, 22 nt, Homo sapiens
uaacuacuucugcuucagagua

SEQ ID NO: 364223 - RNA, 18 nt, Homo sapiens
uaacugugggaacuaacu

SEQ ID NO: 364224 - RNA, 22 nt, Homo sapiens
uaacuucaucauaagucaagaa

SEQ ID NO: 364225 - RNA, 20 nt, Homo sapiens
uaagcauaguugucaggguc

SEQ ID NO: 364226 - RNA, 22 nt, Homo sapiens
uaaggcacuacuuuaggcuuuc

SEQ ID NO: 364227 - RNA, 22 nt, Homo sapiens
uaaggcuugcuucagucuugaa

SEQ ID NO: 364228 - RNA, 22 nt, Homo sapiens
uaagguauuuacauuucuguuu

SEQ ID NO: 364229 - RNA, 22 nt, Homo sapiens
uaaguaauugugguuuuugcca

SEQ ID NO: 364230 - RNA, 22 nt, Homo sapiens
uaaguauagguaacagaagcaa

SEQ ID NO: 364231 - RNA, 22 nt, Homo sapiens
uaaguauuaggccccaggcugg

SEQ ID NO: 364232 - RNA, 22 nt, Homo sapiens
uaaguauuuuaauuccuggcau

SEQ ID NO: 364233 - RNA, 20 nt, Homo sapiens
uaagugcauaggauauuucu

SEQ ID NO: 364234 - RNA, 22 nt, Homo sapiens
uaagugguguucauucuuuuga

SEQ ID NO: 364235 - RNA, 22 nt, Homo sapiens
uaaguuguugacauuaggggaa

SEQ ID NO: 364236 - RNA, 21 nt, Homo sapiens
uaauaaugucucagacaccua

SEQ ID NO: 364237 - RNA, 22 nt, Homo sapiens
uaauagcucggauaaacaugau

SEQ ID NO: 364238 - RNA, 22 nt, Homo sapiens
uaauauguuuugaaaucaggaa

SEQ ID NO: 364239 - RNA, 22 nt, Homo sapiens
uaaugcauacagaagguguuuu

SEQ ID NO: 364240 - RNA, 22 nt, Homo sapiens
uaaugcuugguuguuuggaaaa

SEQ ID NO: 364241 - RNA, 22 nt, Homo sapiens
uaauuggaucucaaaaaagugu

SEQ ID NO: 364242 - RNA, 22 nt, Homo sapiens
uacaaagcuuugaugugucuuu

SEQ ID NO: 364243 - RNA, 22 nt, Homo sapiens
uacaccaauuuaaucaaaagca

SEQ ID NO: 364244 - RNA, 22 nt, Homo sapiens
uacaccauuugauucuuuaagc

SEQ ID NO: 364245 - RNA, 18 nt, Homo sapiens
uacagaacuggaguagaa

SEQ ID NO: 364246 - RNA, 22 nt, Homo sapiens
uacagcacugugcauagugguu

SEQ ID NO: 364247 - RNA, 22 nt, Homo sapiens
uacaggcaccuggcuaauuuuu

SEQ ID NO: 364248 - RNA, 19 nt, Homo sapiens
uacaguacacaacaccuuu

SEQ ID NO: 364249 - RNA, 22 nt, Homo sapiens
uacagugcuugguaucuaguaa

SEQ ID NO: 364250 - RNA, 22 nt, Homo sapiens
uacaguggaaguuaaccccauu

SEQ ID NO: 364251 - RNA, 22 nt, Homo sapiens
uugguaaucccuagugucuaga

SEQ ID NO: 364252 - RNA, 22 nt, Homo sapiens
uuggucagcucaauggagaggg

SEQ ID NO: 364253 - RNA, 22 nt, Homo sapiens
uuggucaucucccuccuuuuag

SEQ ID NO: 364254 - RNA, 22 nt, Homo sapiens
uugguccucccaugcucaagag

SEQ ID NO: 364255 - RNA, 22 nt, Homo sapiens
uuguaaagaucauaugcuguuc

SEQ ID NO: 364256 - RNA, 22 nt, Homo sapiens
uuguaacaguucugcgagcagc

SEQ ID NO: 364257 - RNA, 22 nt, Homo sapiens
uuguaaucaacacaucauuggg

SEQ ID NO: 364258 - RNA, 22 nt, Homo sapiens
uuguacuccagccugggugaca

SEQ ID NO: 364259 - RNA, 22 nt, Homo sapiens
uuguauacucuauuuuagcagu

SEQ ID NO: 364260 - RNA, 21 nt, Homo sapiens
uuguaugguugaacuugauac

SEQ ID NO: 364261 - RNA, 22 nt, Homo sapiens
uugucacuauaaauaagcauuu

SEQ ID NO: 364262 - RNA, 22 nt, Homo sapiens
uugucacucuuccuaggguagg

SEQ ID NO: 364263 - RNA, 22 nt, Homo sapiens
uugucacugcacuccagucugg

SEQ ID NO: 364264 - RNA, 22 nt, Homo sapiens
uuguccauggacagcaccacag

SEQ ID NO: 364265 - RNA, 22 nt, Homo sapiens
uugugaaaaaccucucguggaa

SEQ ID NO: 364266 - RNA, 22 nt, Homo sapiens
uugugaauggugccacaauaaa

SEQ ID NO: 364267 - RNA, 22 nt, Homo sapiens
uugugaguggugccgcaauaaa

SEQ ID NO: 364268 - RNA, 22 nt, Homo sapiens
uugugaucauugucaaauagug

SEQ ID NO: 364269 - RNA, 22 nt, Homo sapiens
uuguuaugggguggcuugaaag

SEQ ID NO: 364270 - RNA, 17 nt, Homo sapiens
uuguucccauuaaaaag

SEQ ID NO: 364271 - RNA, 23 nt, Homo sapiens
uuguucccuuccacucagucucc

SEQ ID NO: 364272 - RNA, 22 nt, Homo sapiens
uuuaaagcuaaaauauguuuau

SEQ ID NO: 364273 - RNA, 22 nt, Homo sapiens
uuuaacauuggaugagaucguc

SEQ ID NO: 364274 - RNA, 22 nt, Homo sapiens
uuuaaguguuuguuccugaaaa

SEQ ID NO: 364275 - RNA, 18 nt, Homo sapiens
uuuacaguagaaggacuu

SEQ ID NO: 364276 - RNA, 22 nt, Homo sapiens
uuuacaguuuucuaggcuacca

SEQ ID NO: 364277 - RNA, 22 nt, Homo sapiens
uuuacccugaggaaucuauuuu

SEQ ID NO: 364278 - RNA, 21 nt, Homo sapiens
uuuacuguggacccauugcuu

SEQ ID NO: 364279 - RNA, 22 nt, Homo sapiens
uuuagcaaagcaauuuacacca

SEQ ID NO: 364280 - RNA, 22 nt, Homo sapiens
uuuagcacugugauugacaaaa

SEQ ID NO: 364281 - RNA, 22 nt, Homo sapiens
uuuagcagcaaagagccaugcu

SEQ ID NO: 364282 - RNA, 22 nt, Homo sapiens
uuuagcagcaaagagcuguguu

SEQ ID NO: 364283 - RNA, 22 nt, Homo sapiens
uuuaggcaugcaguucuauuua

SEQ ID NO: 364284 - RNA, 22 nt, Homo sapiens
uuuagguauuugguauagcagu

SEQ ID NO: 364285 - RNA, 22 nt, Homo sapiens
uuuauugcucuaaaguugccau

SEQ ID NO: 364286 - RNA, 22 nt, Homo sapiens
uuucaacaggucuggggugguc

SEQ ID NO: 364287 - RNA, 22 nt, Homo sapiens
uuucaggcagggagcuucagug

SEQ ID NO: 364288 - RNA, 23 nt, Homo sapiens
uuucaggcaggugaaagaccagc

SEQ ID NO: 364289 - RNA, 22 nt, Homo sapiens
uuucaguagagacacgguuuug

SEQ ID NO: 364290 - RNA, 22 nt, Homo sapiens
uuucauagaucaugcuuuugga

SEQ ID NO: 364291 - RNA, 22 nt, Homo sapiens
uuucauagccuuugucgucuga

SEQ ID NO: 364292 - RNA, 23 nt, Homo sapiens
uuucauggggauuuacucauucc

SEQ ID NO: 364293 - RNA, 19 nt, Homo sapiens
uuucauguuuuuggugaga

SEQ ID NO: 364294 - RNA, 18 nt, Homo sapiens
uuucauugagugugauau

SEQ ID NO: 364295 - RNA, 22 nt, Homo sapiens
uuuccagguggccaacauuuua

SEQ ID NO: 364296 - RNA, 22 nt, Homo sapiens
uuuccaguuguucuagaaagcu

SEQ ID NO: 364297 - RNA, 22 nt, Homo sapiens
uuucccauuguucugcucugug

SEQ ID NO: 364298 - RNA, 22 nt, Homo sapiens
uuucccugaaggcucugaaguc

SEQ ID NO: 364299 - RNA, 22 nt, Homo sapiens
uuucccuuuagcuuagugauuu

SEQ ID NO: 364300 - RNA, 17 nt, Homo sapiens
uuucucagcccucuucu

SEQ ID NO: 364301 - RNA, 21 nt, Homo sapiens
uuucugggggagcauggcagg

SEQ ID NO: 364302 - RNA, 22 nt, Homo sapiens
uuugaaguguggcacugaguuu

SEQ ID NO: 364303 - RNA, 22 nt, Homo sapiens
uuugaaugcaacaaaugcggga

SEQ ID NO: 364304 - RNA, 22 nt, Homo sapiens
uuugaauggaaguuuugugaaa

SEQ ID NO: 364305 - RNA, 22 nt, Homo sapiens
uuugcacuggagauucaauggg

SEQ ID NO: 364306 - RNA, 20 nt, Homo sapiens
uuugcagaaucuaagaagag

SEQ ID NO: 364307 - RNA, 22 nt, Homo sapiens
uuugcaguuuauuccuggggcu

SEQ ID NO: 364308 - RNA, 22 nt, Homo sapiens
uuugccacugcaggcuguuuaa

SEQ ID NO: 364309 - RNA, 22 nt, Homo sapiens
uuugccuuugugauauggucua

SEQ ID NO: 364310 - RNA, 22 nt, Homo sapiens
uuugcuuaaaucuuaaucagau

SEQ ID NO: 364311 - RNA, 22 nt, Homo sapiens
uuuggaaugugcacucagauug

SEQ ID NO: 364312 - RNA, 22 nt, Homo sapiens
uuuggcaaagaucaacauguua

SEQ ID NO: 364313 - RNA, 22 nt, Homo sapiens
uuuggcagaaaacaagaaucug

SEQ ID NO: 364314 - RNA, 22 nt, Homo sapiens
uuuggcaugggcuauuugcuuu

SEQ ID NO: 364315 - RNA, 22 nt, Homo sapiens
uuuggcauuagagagacuugca

SEQ ID NO: 364316 - RNA, 23 nt, Homo sapiens
uuuggcauuccagaaauuuucau

SEQ ID NO: 364317 - RNA, 22 nt, Homo sapiens
uuuggcuuugagaagcagugga

SEQ ID NO: 364318 - RNA, 22 nt, Homo sapiens
uuugggcuuuuaaucuagagca

SEQ ID NO: 364319 - RNA, 22 nt, Homo sapiens
uuuggucagcugcgggucagcu

SEQ ID NO: 364320 - RNA, 22 nt, Homo sapiens
uuugguccaguguucagguccu

SEQ ID NO: 364321 - RNA, 22 nt, Homo sapiens
uuuggucuuuuauuuaaagcag

SEQ ID NO: 364322 - RNA, 22 nt, Homo sapiens
uuuguacacgugggugaauugu

SEQ ID NO: 364323 - RNA, 22 nt, Homo sapiens
uuuguacacuguugguaggauu

SEQ ID NO: 364324 - RNA, 22 nt, Homo sapiens
uuuguacacuguuggugguuau

SEQ ID NO: 364325 - RNA, 22 nt, Homo sapiens
uuuguacucccuuuagauaaaa

SEQ ID NO: 364326 - RNA, 22 nt, Homo sapiens
uuugucacucuuggagguuguu

SEQ ID NO: 364327 - RNA, 22 nt, Homo sapiens
uuugucccuuugcaguggcaca

SEQ ID NO: 364328 - RNA, 22 nt, Homo sapiens
uuugugacacaaacacauauau

SEQ ID NO: 364329 - RNA, 22 nt, Homo sapiens
uuugugaggugauggauauguc

SEQ ID NO: 364330 - RNA, 22 nt, Homo sapiens
uuugugcuccucucaguaugug

SEQ ID NO: 364331 - RNA, 22 nt, Homo sapiens
uuugugcuccuguugagaaucu

SEQ ID NO: 364332 - RNA, 22 nt, Homo sapiens
uuuguggaaugcucauguguag

SEQ ID NO: 364333 - RNA, 21 nt, Homo sapiens
uuugugguuacugugugagcu

SEQ ID NO: 364334 - RNA, 22 nt, Homo sapiens
uuuguguggccuuggccuggca

SEQ ID NO: 364335 - RNA, 22 nt, Homo sapiens
uuuguucuucguuccugagcca

SEQ ID NO: 364336 - RNA, 22 nt, Homo sapiens
uuuuacacuucgguugugugca

SEQ ID NO: 364337 - RNA, 22 nt, Homo sapiens
uuuuacagaggagguugcugau

SEQ ID NO: 364338 - RNA, 22 nt, Homo sapiens
guaacacaugcugcucucuggu

SEQ ID NO: 364339 - RNA, 22 nt, Homo sapiens
guaacagucucaacaguggucu

SEQ ID NO: 364340 - RNA, 22 nt, Homo sapiens
guaacucugucacuuacuaguu

SEQ ID NO: 364341 - RNA, 22 nt, Homo sapiens
guaaggcuucuggucaacagca

SEQ ID NO: 364342 - RNA, 22 nt, Homo sapiens
guaaguauuaggugugagauuc

SEQ ID NO: 364343 - RNA, 22 nt, Homo sapiens
guaaucucagcuacuugggagu

SEQ ID NO: 364344 - RNA, 22 nt, Homo sapiens
guacaggugcaggaugggcagg

SEQ ID NO: 364345 - RNA, 22 nt, Homo sapiens
guacaguaguaaaagugaauga

SEQ ID NO: 364346 - RNA, 22 nt, Homo sapiens
guacaguggguguagggaccag

SEQ ID NO: 364347 - RNA, 22 nt, Homo sapiens
guacauagucacacauauacau

SEQ ID NO: 364348 - RNA, 22 nt, Homo sapiens
guacauggaaugaaauucaaaa

SEQ ID NO: 364349 - RNA, 22 nt, Homo sapiens
guacaugugcacagugugcagg

SEQ ID NO: 364350 - RNA, 22 nt, Homo sapiens
guagcagcaauuuacuccauac

SEQ ID NO: 364351 - RNA, 22 nt, Homo sapiens
guagugcaguuugagaaucagu

SEQ ID NO: 364352 - RNA, 22 nt, Homo sapiens
guauacaguugacccuugaacc

SEQ ID NO: 364353 - RNA, 22 nt, Homo sapiens
guauacaugucaaaacucacau

SEQ ID NO: 364354 - RNA, 21 nt, Homo sapiens
guauggcauugauuaguuacu

SEQ ID NO: 364355 - RNA, 22 nt, Homo sapiens
gucaagagaacuuucuaucacu

SEQ ID NO: 364356 - RNA, 22 nt, Homo sapiens
gucacagaaaaagauaugccaa

SEQ ID NO: 364357 - RNA, 22 nt, Homo sapiens
gucacagcuggcauugucugca

SEQ ID NO: 364358 - RNA, 22 nt, Homo sapiens
gucacugacaagagagaagaac

SEQ ID NO: 364359 - RNA, 22 nt, Homo sapiens
gucacugagcagaaggaagcga

SEQ ID NO: 364360 - RNA, 22 nt, Homo sapiens
gucacugugacggcaguuacau

SEQ ID NO: 364361 - RNA, 22 nt, Homo sapiens
uugagauggagucucacucuuu

SEQ ID NO: 364362 - RNA, 22 nt, Homo sapiens
uugagauggagucucacugugu

SEQ ID NO: 364363 - RNA, 22 nt, Homo sapiens
uugagauggagucucgcugugu

SEQ ID NO: 364364 - RNA, 22 nt, Homo sapiens
uugagauggagucuugcucuug

SEQ ID NO: 364365 - RNA, 22 nt, Homo sapiens
uugagauggagucuuguucucu

SEQ ID NO: 364366 - RNA, 22 nt, Homo sapiens
uugagauggagucuuguucuuu

SEQ ID NO: 364367 - RNA, 22 nt, Homo sapiens
uugagauggaguuucacucucg

SEQ ID NO: 364368 - RNA, 22 nt, Homo sapiens
uugagauggaguuucacucuug

SEQ ID NO: 364369 - RNA, 22 nt, Homo sapiens
uugagauggaguuuugcucuug

SEQ ID NO: 364370 - RNA, 22 nt, Homo sapiens
uugagcaaugucacugaggcuu

SEQ ID NO: 364371 - RNA, 22 nt, Homo sapiens
uugaggaggcagucuucccauu

SEQ ID NO: 364372 - RNA, 22 nt, Homo sapiens
uugaggaguacugauuagguau

SEQ ID NO: 364373 - RNA, 22 nt, Homo sapiens
uugaggccugauaacacacuga

SEQ ID NO: 364374 - RNA, 21 nt, Homo sapiens
uugagguaaaauccuauggga

SEQ ID NO: 364375 - RNA, 22 nt, Homo sapiens
uugagguguauuguacagcaca

SEQ ID NO: 364376 - RNA, 22 nt, Homo sapiens
uugagugaaugaaugauuaaau

SEQ ID NO: 364377 - RNA, 22 nt, Homo sapiens
uugauaacauucugcauccuau

SEQ ID NO: 364378 - RNA, 22 nt, Homo sapiens
uugauaauguuaacuuugguca

SEQ ID NO: 364379 - RNA, 22 nt, Homo sapiens
uugauaugaauggcuguuugug

SEQ ID NO: 364380 - RNA, 22 nt, Homo sapiens
uugauauucugagaagcugaag

SEQ ID NO: 364381 - RNA, 22 nt, Homo sapiens
uugaucuaugugucuguuuuua

SEQ ID NO: 364382 - RNA, 20 nt, Homo sapiens
uugauucccucuaaacucgc

SEQ ID NO: 364383 - RNA, 22 nt, Homo sapiens
uugcaaacaucuuguuucacau

SEQ ID NO: 364384 - RNA, 23 nt, Homo sapiens
uugcaaagccugaaacucuucag

SEQ ID NO: 364385 - RNA, 22 nt, Homo sapiens
uugcaacauguauucuggugau

SEQ ID NO: 364386 - RNA, 22 nt, Homo sapiens
uugcaagugccguaacuaccaa

SEQ ID NO: 364387 - RNA, 22 nt, Homo sapiens
uugcacauggcaggugcucaau

SEQ ID NO: 364388 - RNA, 22 nt, Homo sapiens
uugcacauuuuuucuggcagaa

SEQ ID NO: 364389 - RNA, 22 nt, Homo sapiens
uugcacuccagccugggugaca

SEQ ID NO: 364390 - RNA, 22 nt, Homo sapiens
uugcacucuagccugggugaca

SEQ ID NO: 364391 - RNA, 22 nt, Homo sapiens
uugcagagaaauuucugguuua

SEQ ID NO: 364392 - RNA, 20 nt, Homo sapiens
uugcagagcccaacccugga

SEQ ID NO: 364393 - RNA, 22 nt, Homo sapiens
uugcagagccccacacugggcu

SEQ ID NO: 364394 - RNA, 22 nt, Homo sapiens
uugcagagucaguuauuuugcc

SEQ ID NO: 364395 - RNA, 22 nt, Homo sapiens
uugcagugguuucacuggcaaa

SEQ ID NO: 364396 - RNA, 22 nt, Homo sapiens
uugcaucagcuccugauguacu

SEQ ID NO: 364397 - RNA, 22 nt, Homo sapiens
uugccuaggcuggaguucagug

SEQ ID NO: 364398 - RNA, 22 nt, Homo sapiens
uugcucaccugagaagaauaga

SEQ ID NO: 364399 - RNA, 22 nt, Homo sapiens
uuggaaaugguaaaggguuaau

SEQ ID NO: 364400 - RNA, 22 nt, Homo sapiens
uuggaaauguguuugcauucag

SEQ ID NO: 364401 - RNA, 22 nt, Homo sapiens
uuggaagacauucugucugcua

SEQ ID NO: 364402 - RNA, 22 nt, Homo sapiens
uuggaagauuacuuaguuuucu

SEQ ID NO: 364403 - RNA, 22 nt, Homo sapiens
uuggaaugcaacagaaggauaa

SEQ ID NO: 364404 - RNA, 22 nt, Homo sapiens
uuggaauguacucuagccuaug

SEQ ID NO: 364405 - RNA, 22 nt, Homo sapiens
uuggacagaugguuacauuuuu

SEQ ID NO: 364406 - RNA, 22 nt, Homo sapiens
uuggacuuuaagauagagaugu

SEQ ID NO: 364407 - RNA, 22 nt, Homo sapiens
uuggagagucacuaguuagugc

SEQ ID NO: 364408 - RNA, 22 nt, Homo sapiens
uuggagagugauauucagaugc

SEQ ID NO: 364409 - RNA, 22 nt, Homo sapiens
uuggauaguuuaugaaaaaugg

SEQ ID NO: 364410 - RNA, 22 nt, Homo sapiens
uuggauauucaguuuuuccauc

SEQ ID NO: 364411 - RNA, 22 nt, Homo sapiens
uuggauugugaaaguauucucu

SEQ ID NO: 364412 - RNA, 22 nt, Homo sapiens
uuggcaaauagguuuuauugca

SEQ ID NO: 364413 - RNA, 22 nt, Homo sapiens
uuggcaaaugucacaaaucagg

SEQ ID NO: 364414 - RNA, 22 nt, Homo sapiens
uuggcaauucagauucuuuuau

SEQ ID NO: 364415 - RNA, 22 nt, Homo sapiens
uuggcacuugauaauauucugg

SEQ ID NO: 364416 - RNA, 20 nt, Homo sapiens
uuggcagagucuuuagggua

SEQ ID NO: 364417 - RNA, 22 nt, Homo sapiens
uuggcagugcccgaugcugggg

SEQ ID NO: 364418 - RNA, 22 nt, Homo sapiens
uuggcauuguggauggaaucau

SEQ ID NO: 364419 - RNA, 22 nt, Homo sapiens
uuggccccuccaaaucucaugu

SEQ ID NO: 364420 - RNA, 22 nt, Homo sapiens
uugggcaauaggaagcaggugg

SEQ ID NO: 364421 - RNA, 22 nt, Homo sapiens
uuggggcacggccucuguugcc

SEQ ID NO: 364422 - RNA, 22 nt, Homo sapiens
uuggguagugaguuccuccagg

SEQ ID NO: 364423 - RNA, 22 nt, Homo sapiens
uuggguccucugguccuugguu

SEQ ID NO: 364424 - RNA, 22 nt, Homo sapiens
aucagugcagugggaacuagaa

SEQ ID NO: 364425 - RNA, 22 nt, Homo sapiens
aucauaucaucugcaaacaaag

SEQ ID NO: 364426 - RNA, 22 nt, Homo sapiens
aucauaucauuggugaacagug

SEQ ID NO: 364427 - RNA, 22 nt, Homo sapiens
aucauauccuagauauaacuuc

SEQ ID NO: 364428 - RNA, 22 nt, Homo sapiens
aucauuaguuguggaauucuug

SEQ ID NO: 364429 - RNA, 22 nt, Homo sapiens
auccauguggauaaauguguau

SEQ ID NO: 364430 - RNA, 22 nt, Homo sapiens
aucccaguucagccucugacac

SEQ ID NO: 364431 - RNA, 20 nt, Homo sapiens
aucccauuccugaagauacu

SEQ ID NO: 364432 - RNA, 22 nt, Homo sapiens
aucccgagacuuugcugaaguu

SEQ ID NO: 364433 - RNA, 22 nt, Homo sapiens
aucccugaggaauuucugcacu

SEQ ID NO: 364434 - RNA, 22 nt, Homo sapiens
aucccugugauccaaucacuuc

SEQ ID NO: 364435 - RNA, 22 nt, Homo sapiens
aucccuguguccagcaccugug

SEQ ID NO: 364436 - RNA, 21 nt, Homo sapiens
auccuucuuuuucaaccugug

SEQ ID NO: 364437 - RNA, 21 nt, Homo sapiens
aucgcacaauauaccccugua

SEQ ID NO: 364438 - RNA, 22 nt, Homo sapiens
aucgcaccauugcacuccagca

SEQ ID NO: 364439 - RNA, 22 nt, Homo sapiens
aucuagagacauaguaaagaau

SEQ ID NO: 364440 - RNA, 22 nt, Homo sapiens
aucucaguuaaugacccuaugc

SEQ ID NO: 364441 - RNA, 22 nt, Homo sapiens
aucugcaaauaaugaagauugg

SEQ ID NO: 364442 - RNA, 22 nt, Homo sapiens
aucugcauucccauguuuauug

SEQ ID NO: 364443 - RNA, 22 nt, Homo sapiens
aucuggcguuuacuuccuuccu

SEQ ID NO: 364444 - RNA, 22 nt, Homo sapiens
aucuggcuucuuuuaguccaca

SEQ ID NO: 364445 - RNA, 22 nt, Homo sapiens
aucuguguuuaaggucccagaa

SEQ ID NO: 364446 - RNA, 22 nt, Homo sapiens
aucuuguccugagguuuuauug

SEQ ID NO: 364447 - RNA, 22 nt, Homo sapiens
aucuuguguugaauggugcaga

SEQ ID NO: 364448 - RNA, 23 nt, Homo sapiens
augaaagcccuugcaaaugcugg

SEQ ID NO: 364449 - RNA, 22 nt, Homo sapiens
augaaaugcauguuaaguccgu

SEQ ID NO: 364450 - RNA, 22 nt, Homo sapiens
augaacucaucaucuagguuuu

SEQ ID NO: 364451 - RNA, 21 nt, Homo sapiens
augaacucaucauuuuuuaug

SEQ ID NO: 364452 - RNA, 22 nt, Homo sapiens
augaagagaaaguggaucuugg

SEQ ID NO: 364453 - RNA, 22 nt, Homo sapiens
augaagauguugccuuuuuaau

SEQ ID NO: 364454 - RNA, 22 nt, Homo sapiens
augaagucguuacuaccaauug

SEQ ID NO: 364455 - RNA, 22 nt, Homo sapiens
augaauacagcuaugcgugcau

SEQ ID NO: 364456 - RNA, 23 nt, Homo sapiens
augaauguaaagaaugugggaag

SEQ ID NO: 364457 - RNA, 22 nt, Homo sapiens
augaaugucuuauuuugagaaa

SEQ ID NO: 364458 - RNA, 22 nt, Homo sapiens
augacaagagccuucuuuccuu

SEQ ID NO: 364459 - RNA, 22 nt, Homo sapiens
augacaagaguguucagggaga

SEQ ID NO: 364460 - RNA, 22 nt, Homo sapiens
augacccugaccuaagccaauc

SEQ ID NO: 364461 - RNA, 22 nt, Homo sapiens
augacuaaaggguuuauguuga

SEQ ID NO: 364462 - RNA, 20 nt, Homo sapiens
augacuagaggacaugguaa

SEQ ID NO: 364463 - RNA, 22 nt, Homo sapiens
augacugagacuaacuuacuuu

SEQ ID NO: 364464 - RNA, 22 nt, Homo sapiens
augacugucuugcagaggcuau

SEQ ID NO: 364465 - RNA, 22 nt, Homo sapiens
augagaacugucaaugagagcu

SEQ ID NO: 364466 - RNA, 22 nt, Homo sapiens
augagaaugauucuguuauggu

SEQ ID NO: 364467 - RNA, 22 nt, Homo sapiens
augagacauuaaaguguguuug

SEQ ID NO: 364468 - RNA, 18 nt, Homo sapiens
augagagccgauuccugg

SEQ ID NO: 364469 - RNA, 22 nt, Homo sapiens
augagagugagagcagccccuu

SEQ ID NO: 364470 - RNA, 22 nt, Homo sapiens
augagauaggaacaaacuuaca

SEQ ID NO: 364471 - RNA, 21 nt, Homo sapiens
augagauguuagacuuuagac

SEQ ID NO: 364472 - RNA, 22 nt, Homo sapiens
augagauuauguaaagagacca

SEQ ID NO: 364473 - RNA, 22 nt, Homo sapiens
augagcugauuuccuuaccaua

SEQ ID NO: 364474 - RNA, 22 nt, Homo sapiens
augaggcuauaauuuuuaugua

SEQ ID NO: 364475 - RNA, 22 nt, Homo sapiens
augagggagggguggugccgca

SEQ ID NO: 364476 - RNA, 22 nt, Homo sapiens
augagguauccaagcccagaaa

SEQ ID NO: 364477 - RNA, 22 nt, Homo sapiens
augaguuccuuccuugccuagg

SEQ ID NO: 364478 - RNA, 22 nt, Homo sapiens
augauaaguuauuagaagaaga

SEQ ID NO: 364479 - RNA, 22 nt, Homo sapiens
augaucacaccacugcacucca

SEQ ID NO: 364480 - RNA, 22 nt, Homo sapiens
augaucaucugaaagcuuuuac

SEQ ID NO: 364481 - RNA, 22 nt, Homo sapiens
augaucauggaaguuuuccugu

SEQ ID NO: 364482 - RNA, 22 nt, Homo sapiens
augaucuagaguaggaaacaga

SEQ ID NO: 364483 - RNA, 22 nt, Homo sapiens
augaucuguuuggugaucuugu

SEQ ID NO: 364484 - RNA, 22 nt, Homo sapiens
augauggaggccgugauggacg

SEQ ID NO: 364485 - RNA, 22 nt, Homo sapiens
augauguguucuguguucccau

SEQ ID NO: 364486 - RNA, 22 nt, Homo sapiens
augcaaggaugguuagauauau

SEQ ID NO: 364487 - RNA, 19 nt, Homo sapiens
augcaaugucacaggcugc

SEQ ID NO: 364488 - RNA, 22 nt, Homo sapiens
augcagagucccagccccuagc

SEQ ID NO: 364489 - RNA, 22 nt, Homo sapiens
augcaugucaaauuuguagguu

SEQ ID NO: 364490 - RNA, 22 nt, Homo sapiens
augccaagagacaaagggaauc

SEQ ID NO: 364491 - RNA, 22 nt, Homo sapiens
augccaagaugagcacgcgucu

SEQ ID NO: 364492 - RNA, 22 nt, Homo sapiens
augccacagaaauaaccaaaau

SEQ ID NO: 364493 - RNA, 22 nt, Homo sapiens
augccaguguccagaguggguu

SEQ ID NO: 364494 - RNA, 22 nt, Homo sapiens
augccauugcacuccagccugg

SEQ ID NO: 364495 - RNA, 19 nt, Homo sapiens
augccucaguuuuguacuu

SEQ ID NO: 364496 - RNA, 22 nt, Homo sapiens
augccucugacaauuggauucu

SEQ ID NO: 364497 - RNA, 19 nt, Homo sapiens
augccuggagaugguuaua

SEQ ID NO: 364498 - RNA, 22 nt, Homo sapiens
augcuacugaccccuacuuaca

SEQ ID NO: 364499 - RNA, 22 nt, Homo sapiens
augcuacuggauuuguauaaau

SEQ ID NO: 364500 - RNA, 22 nt, Homo sapiens
auggaaacauaagaguauagau

SEQ ID NO: 364501 - RNA, 22 nt, Homo sapiens
auggaacauuauagauguaaaa

SEQ ID NO: 364502 - RNA, 22 nt, Homo sapiens
auggacauuaaagcgauguaga

SEQ ID NO: 364503 - RNA, 22 nt, Homo sapiens
auggagcaaaacagauuuggga

SEQ ID NO: 364504 - RNA, 22 nt, Homo sapiens
auggagguguggggagugaguu

SEQ ID NO: 364505 - RNA, 22 nt, Homo sapiens
auggaguguggaacugggaauc

SEQ ID NO: 364506 - RNA, 22 nt, Homo sapiens
auggaguguucugaauccuuug

SEQ ID NO: 364507 - RNA, 22 nt, Homo sapiens
auggaucauauucuugaggagg

SEQ ID NO: 364508 - RNA, 22 nt, Homo sapiens
auggcaaaaaaugcaauuacuu

SEQ ID NO: 364509 - RNA, 22 nt, Homo sapiens
auggcaauaauagcuaccauuu

SEQ ID NO: 364510 - RNA, 22 nt, Homo sapiens
ucacuuggugaacacauuaugu

SEQ ID NO: 364511 - RNA, 22 nt, Homo sapiens
ucagaacugaacaaaccagucu

SEQ ID NO: 364512 - RNA, 22 nt, Homo sapiens
ggaagccugcacucgggcaggg

SEQ ID NO: 364513 - RNA, 22 nt, Homo sapiens
ggaaguauaaacuuaguggagu

SEQ ID NO: 364514 - RNA, 22 nt, Homo sapiens
ggaagugcuguguggaagucug

SEQ ID NO: 364515 - RNA, 22 nt, Homo sapiens
ggaaugagaaauauuacacaau

SEQ ID NO: 364516 - RNA, 22 nt, Homo sapiens
ggaaugcuaaaauaggaugcug

SEQ ID NO: 364517 - RNA, 22 nt, Homo sapiens
ggaauguuaaagacuacacuga

SEQ ID NO: 364518 - RNA, 21 nt, Homo sapiens
ggaauuuagggaaugauuuag

SEQ ID NO: 364519 - RNA, 22 nt, Homo sapiens
ggacaagaucuuccaccauuca

SEQ ID NO: 364520 - RNA, 22 nt, Homo sapiens
ggacagaaaggguucaccaaac

SEQ ID NO: 364521 - RNA, 22 nt, Homo sapiens
ggagaguaauuagacugaaaga

SEQ ID NO: 364522 - RNA, 22 nt, Homo sapiens
ggagcugugauuugaguccaga

SEQ ID NO: 364523 - RNA, 22 nt, Homo sapiens
ggagggugagaucaauuuggga

SEQ ID NO: 364524 - RNA, 22 nt, Homo sapiens
ggaguaugaaacccacuccaau

SEQ ID NO: 364525 - RNA, 22 nt, Homo sapiens
ggagucugacuuauaggaaccu

SEQ ID NO: 364526 - RNA, 22 nt, Homo sapiens
ggagugucagaaacaguguccu

SEQ ID NO: 364527 - RNA, 22 nt, Homo sapiens
ggagugucugugcuggucaaag

SEQ ID NO: 364528 - RNA, 22 nt, Homo sapiens
ggagugugauuguucucuguua

SEQ ID NO: 364529 - RNA, 22 nt, Homo sapiens
ggaguguguaggagaaagguaa

SEQ ID NO: 364530 - RNA, 22 nt, Homo sapiens
ggaguguuccauuugucacauu

SEQ ID NO: 364531 - RNA, 22 nt, Homo sapiens
ggauacauuuuuccuccucuuc

SEQ ID NO: 364532 - RNA, 21 nt, Homo sapiens
ggauagaaaacuuggcuguau

SEQ ID NO: 364533 - RNA, 23 nt, Homo sapiens
ggauggaaaguuuugagggccac

SEQ ID NO: 364534 - RNA, 22 nt, Homo sapiens
ggcaaaauauugucugguauag

SEQ ID NO: 364535 - RNA, 22 nt, Homo sapiens
ggcaaaugaagauggagaggcu

SEQ ID NO: 364536 - RNA, 22 nt, Homo sapiens
ggcaacaaagacauuucaacau

SEQ ID NO: 364537 - RNA, 22 nt, Homo sapiens
ggcaacauggugaaacucuguc

SEQ ID NO: 364538 - RNA, 22 nt, Homo sapiens
ggcaagaacuucacucacuuuu

SEQ ID NO: 364539 - RNA, 22 nt, Homo sapiens
ggcaagaagagaguuuaaacau

SEQ ID NO: 364540 - RNA, 20 nt, Homo sapiens
ggcaagacccaaagugugug

SEQ ID NO: 364541 - RNA, 19 nt, Homo sapiens
ggcaagaguuguucugugu

SEQ ID NO: 364542 - RNA, 22 nt, Homo sapiens
ggcaagaucuuggcucacugaa

SEQ ID NO: 364543 - RNA, 22 nt, Homo sapiens
ggcaaggauuagauucuccccu

SEQ ID NO: 364544 - RNA, 22 nt, Homo sapiens
ggcaaggugaugaaugucuaca

SEQ ID NO: 364545 - RNA, 22 nt, Homo sapiens
ggcaagugggagggaguguuuc

SEQ ID NO: 364546 - RNA, 22 nt, Homo sapiens
ggcaagugucagcagcaacacc

SEQ ID NO: 364547 - RNA, 22 nt, Homo sapiens
ggcagcacaauuuucugaugga

SEQ ID NO: 364548 - RNA, 22 nt, Homo sapiens
ggcagcuguguccuucguaagg

SEQ ID NO: 364549 - RNA, 23 nt, Homo sapiens
ggcagguuggucuaggucuauuc

SEQ ID NO: 364550 - RNA, 22 nt, Homo sapiens
ggcaguguauuacuuaggguuc

SEQ ID NO: 364551 - RNA, 21 nt, Homo sapiens
ggcaugaauggaaaagugaga

SEQ ID NO: 364552 - RNA, 22 nt, Homo sapiens
ggccagaugcaguggcucacac

SEQ ID NO: 364553 - RNA, 22 nt, Homo sapiens
ggccagaugcgguggcucacac

SEQ ID NO: 364554 - RNA, 22 nt, Homo sapiens
ggcuagagacaaguugcugaga

SEQ ID NO: 364555 - RNA, 22 nt, Homo sapiens
ggcuagagagcucagggauaug

SEQ ID NO: 364556 - RNA, 22 nt, Homo sapiens
ggcuagaugcuagagauaucau

SEQ ID NO: 364557 - RNA, 22 nt, Homo sapiens
ggcucagugggguccugguucu

SEQ ID NO: 364558 - RNA, 22 nt, Homo sapiens
ggcuuuggucacacaggggcaa

SEQ ID NO: 364559 - RNA, 22 nt, Homo sapiens
gggaaauguaaagucauaagau

SEQ ID NO: 364560 - RNA, 22 nt, Homo sapiens
gggaacaugagaaugugaauga

SEQ ID NO: 364561 - RNA, 18 nt, Homo sapiens
gggaauauggggaguuga

SEQ ID NO: 364562 - RNA, 22 nt, Homo sapiens
gggaaugaagagaaccuuccca

SEQ ID NO: 364563 - RNA, 19 nt, Homo sapiens
gggaggaugcgucuucagg

SEQ ID NO: 364564 - RNA, 22 nt, Homo sapiens
gggaggucauuguaaggucuua

SEQ ID NO: 364565 - RNA, 22 nt, Homo sapiens
gggaugaaguugauguagaaag

SEQ ID NO: 364566 - RNA, 22 nt, Homo sapiens
ggggucauuaaauuccgcuggu

SEQ ID NO: 364567 - RNA, 22 nt, Homo sapiens
ggguaggcaagcggaugucaga

SEQ ID NO: 364568 - RNA, 22 nt, Homo sapiens
gguaggcacuggugggaagaga

SEQ ID NO: 364569 - RNA, 19 nt, Homo sapiens
ggucacagggguuacaagg

SEQ ID NO: 364570 - RNA, 22 nt, Homo sapiens
ggucagaaagacaggcauucag

SEQ ID NO: 364571 - RNA, 22 nt, Homo sapiens
ggucagugcauucuaaaggcaa

SEQ ID NO: 364572 - RNA, 22 nt, Homo sapiens
ggucaguguuaucaccgaagga

SEQ ID NO: 364573 - RNA, 22 nt, Homo sapiens
ggucaguuuucuccaggaucca

SEQ ID NO: 364574 - RNA, 19 nt, Homo sapiens
ggucauggagguuguguga

SEQ ID NO: 364575 - RNA, 22 nt, Homo sapiens
ggugacagugguuaaaauuugu

SEQ ID NO: 364576 - RNA, 22 nt, Homo sapiens
ggugagaaaaacauagucucag

SEQ ID NO: 364577 - RNA, 22 nt, Homo sapiens
gguguguaaauuacuuaucucu

SEQ ID NO: 364578 - RNA, 22 nt, Homo sapiens
guaaauguccccugugauauug

SEQ ID NO: 364579 - RNA, 22 nt, Homo sapiens
uuaggugguacacagccccagu

SEQ ID NO: 364580 - RNA, 22 nt, Homo sapiens
uuaguagcacagaguaucagca

SEQ ID NO: 364581 - RNA, 22 nt, Homo sapiens
uuagucaaguguacugugaaug

SEQ ID NO: 364582 - RNA, 22 nt, Homo sapiens
uuagugcugaguggaauguucu

SEQ ID NO: 364583 - RNA, 22 nt, Homo sapiens
uuauaguuuuucaccuggagaa

SEQ ID NO: 364584 - RNA, 22 nt, Homo sapiens
uuauauguuuguacuuaggccu

SEQ ID NO: 364585 - RNA, 21 nt, Homo sapiens
uuaucccagugucucugcagg

SEQ ID NO: 364586 - RNA, 22 nt, Homo sapiens
uuaucucaguguuuguaaacaa

SEQ ID NO: 364587 - RNA, 22 nt, Homo sapiens
uuaugaaguagguuaagagcag

SEQ ID NO: 364588 - RNA, 22 nt, Homo sapiens
uuauuauguuggugcaaaggua

SEQ ID NO: 364589 - RNA, 22 nt, Homo sapiens
uuauucauuaacagggaccaaa

SEQ ID NO: 364590 - RNA, 22 nt, Homo sapiens
uuauugcucauuugggcauucu

SEQ ID NO: 364591 - RNA, 22 nt, Homo sapiens
uucaaaaccucugcuuaagccc

SEQ ID NO: 364592 - RNA, 22 nt, Homo sapiens
uucaaaguaaaaauguguucac

SEQ ID NO: 364593 - RNA, 22 nt, Homo sapiens
uucaaaucuucguuuugccaua

SEQ ID NO: 364594 - RNA, 22 nt, Homo sapiens
uucaaauguucuuucaccaccc

SEQ ID NO: 364595 - RNA, 22 nt, Homo sapiens
uucaagauggccccagugagcc

SEQ ID NO: 364596 - RNA, 22 nt, Homo sapiens
uucaagucaaggaaagaggucu

SEQ ID NO: 364597 - RNA, 22 nt, Homo sapiens
uucaagucaauuuuugaaugac

SEQ ID NO: 364598 - RNA, 20 nt, Homo sapiens
uucaagugauucucaugccu

SEQ ID NO: 364599 - RNA, 22 nt, Homo sapiens
uucaaguguucaggagcuacag

SEQ ID NO: 364600 - RNA, 21 nt, Homo sapiens
caucaaauugucauggugggu

SEQ ID NO: 364601 - RNA, 22 nt, Homo sapiens
caucacaguacuaaucgucaua

SEQ ID NO: 364602 - RNA, 22 nt, Homo sapiens
caucacuuugccuccgucucua

SEQ ID NO: 364603 - RNA, 22 nt, Homo sapiens
caucagagugagauauaagauc

SEQ ID NO: 364604 - RNA, 22 nt, Homo sapiens
caucccauucgaggggcacagc

SEQ ID NO: 364605 - RNA, 22 nt, Homo sapiens
caugccacuguggacaaagaca

SEQ ID NO: 364606 - RNA, 22 nt, Homo sapiens
cauggcacauauauaucuaggu

SEQ ID NO: 364607 - RNA, 22 nt, Homo sapiens
cauggcacuguaugaaaugugc

SEQ ID NO: 364608 - RNA, 22 nt, Homo sapiens
cauggcucuuugcugcuaaagu

SEQ ID NO: 364609 - RNA, 22 nt, Homo sapiens
cauguaguagaaggagccagac

SEQ ID NO: 364610 - RNA, 22 nt, Homo sapiens
caugugcaugagcacauacgug

SEQ ID NO: 364611 - RNA, 22 nt, Homo sapiens
cauuacacuuguaagguuuuuc

SEQ ID NO: 364612 - RNA, 22 nt, Homo sapiens
cauuccacauguaggacaauuu

SEQ ID NO: 364613 - RNA, 19 nt, Homo sapiens
cauugcacuccacccuggg

SEQ ID NO: 364614 - RNA, 22 nt, Homo sapiens
cauugcacuccagcccuggcaa

SEQ ID NO: 364615 - RNA, 22 nt, Homo sapiens
cauugcacuccagccugaccaa

SEQ ID NO: 364616 - RNA, 22 nt, Homo sapiens
cauugcacuccagccugaguga

SEQ ID NO: 364617 - RNA, 22 nt, Homo sapiens
cauugcacuccagccuggcaac

SEQ ID NO: 364618 - RNA, 22 nt, Homo sapiens
cauugcacuccagccuggccaa

SEQ ID NO: 364619 - RNA, 20 nt, Homo sapiens
cauugcacuccagcuugggc

SEQ ID NO: 364620 - RNA, 16 nt, Homo sapiens
cauugcacucuagccu

SEQ ID NO: 364621 - RNA, 22 nt, Homo sapiens
cauugcaguggaguggggaaga

SEQ ID NO: 364622 - RNA, 22 nt, Homo sapiens
cauuuugguuaaauagguagcu

SEQ ID NO: 364623 - RNA, 22 nt, Homo sapiens
ccaaguguuuucauuguuccau

SEQ ID NO: 364624 - RNA, 22 nt, Homo sapiens
ccacaaccucaacagcaucuau

SEQ ID NO: 364625 - RNA, 22 nt, Homo sapiens
ugguaucauuuuaucugcucua

SEQ ID NO: 364626 - RNA, 22 nt, Homo sapiens
uggucaccuucuugcucugucu

SEQ ID NO: 364627 - RNA, 22 nt, Homo sapiens
uggucaguugaguccuugccaa

SEQ ID NO: 364628 - RNA, 22 nt, Homo sapiens
uggucaguugugccucaauucc

SEQ ID NO: 364629 - RNA, 22 nt, Homo sapiens
uggucaugaggugaggcuucuc

SEQ ID NO: 364630 - RNA, 22 nt, Homo sapiens
ugguccacuaacccucaguauc

SEQ ID NO: 364631 - RNA, 20 nt, Homo sapiens
ugguccccaccaaaucucau

SEQ ID NO: 364632 - RNA, 20 nt, Homo sapiens
ugguccccugagucuggcuu

SEQ ID NO: 364633 - RNA, 22 nt, Homo sapiens
uggucuccuuuguacccugggc

SEQ ID NO: 364634 - RNA, 22 nt, Homo sapiens
uggucuggagagucccgcccag

SEQ ID NO: 364635 - RNA, 22 nt, Homo sapiens
uggugcuuaaauaaggcuuuca

SEQ ID NO: 364636 - RNA, 22 nt, Homo sapiens
ugguguccugucucugcgcuug

SEQ ID NO: 364637 - RNA, 22 nt, Homo sapiens
ugguuagucuguguguauauau

SEQ ID NO: 364638 - RNA, 22 nt, Homo sapiens
ugguuaucacuuuccuuccauc

SEQ ID NO: 364639 - RNA, 22 nt, Homo sapiens
ugguuguuuuaaaugucgucug

SEQ ID NO: 364640 - RNA, 22 nt, Homo sapiens
uguaaacucaguauguuuuacu

SEQ ID NO: 364641 - RNA, 22 nt, Homo sapiens
uguaaaucuauuuuuaguguuu

SEQ ID NO: 364642 - RNA, 22 nt, Homo sapiens
uguaauaguaggcucacauuug

SEQ ID NO: 364643 - RNA, 20 nt, Homo sapiens
uguacacaguguacccacau

SEQ ID NO: 364644 - RNA, 22 nt, Homo sapiens
uguacaugggacaggaggagag

SEQ ID NO: 364645 - RNA, 22 nt, Homo sapiens
uguacuagaaauuaaggcaggg

SEQ ID NO: 364646 - RNA, 21 nt, Homo sapiens
uguagcagcaugauucauagu

SEQ ID NO: 364647 - RNA, 22 nt, Homo sapiens
uguagcagccauaaacacagug

SEQ ID NO: 364648 - RNA, 22 nt, Homo sapiens
uguaguuugaaagcucccucug

SEQ ID NO: 364649 - RNA, 21 nt, Homo sapiens
uguauacauggaagaaugguc

SEQ ID NO: 364650 - RNA, 22 nt, Homo sapiens
uguauagaucugauucaucucc

SEQ ID NO: 364651 - RNA, 22 nt, Homo sapiens
uguaugguuauuuguggauggu

SEQ ID NO: 364652 - RNA, 22 nt, Homo sapiens
uguauguugauguuauauucug

SEQ ID NO: 364653 - RNA, 19 nt, Homo sapiens
ugucaaaugucuccugggg

SEQ ID NO: 364654 - RNA, 21 nt, Homo sapiens
ugucaagugggaaaacaugua

SEQ ID NO: 364655 - RNA, 22 nt, Homo sapiens
ugucacugugcagucaugcauu

SEQ ID NO: 364656 - RNA, 22 nt, Homo sapiens
ugucaggaguuuuagaaucuua

SEQ ID NO: 364657 - RNA, 22 nt, Homo sapiens
ugucagggaggcucggccgcac

SEQ ID NO: 364658 - RNA, 22 nt, Homo sapiens
ugucaguuucccuccucuuccu

SEQ ID NO: 364659 - RNA, 22 nt, Homo sapiens
ugucaugaaauauguuuuucua

SEQ ID NO: 364660 - RNA, 22 nt, Homo sapiens
ugucauggcauuuguaaacugc

SEQ ID NO: 364661 - RNA, 22 nt, Homo sapiens
ugucauggugcucugggcccug

SEQ ID NO: 364662 - RNA, 22 nt, Homo sapiens
ugucauguaaagaguaaauggu

SEQ ID NO: 364663 - RNA, 22 nt, Homo sapiens
ugucauguagaaauuguccauu

SEQ ID NO: 364664 - RNA, 22 nt, Homo sapiens
ugucaugucuuuguguaucaau

SEQ ID NO: 364665 - RNA, 22 nt, Homo sapiens
ugucauguuucuacugaccaaa

SEQ ID NO: 364666 - RNA, 22 nt, Homo sapiens
ugucauuggacuucuuucaugg

SEQ ID NO: 364667 - RNA, 22 nt, Homo sapiens
ugucauuguggugcagauauaa

SEQ ID NO: 364668 - RNA, 22 nt, Homo sapiens
uguccaaauugaaucaucuggu

SEQ ID NO: 364669 - RNA, 22 nt, Homo sapiens
uguccugaagcuuuguuaugua

SEQ ID NO: 364670 - RNA, 22 nt, Homo sapiens
uguccuggugaugcccaaauuc

SEQ ID NO: 364671 - RNA, 22 nt, Homo sapiens
ugucucaguucccuucucugga

SEQ ID NO: 364672 - RNA, 22 nt, Homo sapiens
ugucucaguuucuguggguuag

SEQ ID NO: 364673 - RNA, 22 nt, Homo sapiens
ugucucccuucccauuaggaag

SEQ ID NO: 364674 - RNA, 22 nt, Homo sapiens
ugucuggaguccauagaagugu

SEQ ID NO: 364675 - RNA, 22 nt, Homo sapiens
ugucuuggacuugaaucucauu

SEQ ID NO: 364676 - RNA, 22 nt, Homo sapiens
ugugaaacauggauagaacugg

SEQ ID NO: 364677 - RNA, 22 nt, Homo sapiens
ugugaaaucagauagccuuuuu

SEQ ID NO: 364678 - RNA, 22 nt, Homo sapiens
ugugaacagcuccaaaugugga

SEQ ID NO: 364679 - RNA, 22 nt, Homo sapiens
ugugaaugaagaaugcuaaccu

SEQ ID NO: 364680 - RNA, 22 nt, Homo sapiens
ugugaaugauggagugucgaau

SEQ ID NO: 364681 - RNA, 22 nt, Homo sapiens
ugugacagguagguaauuuuug

SEQ ID NO: 364682 - RNA, 22 nt, Homo sapiens
ugugaccaaaaucaacauaccu

SEQ ID NO: 364683 - RNA, 22 nt, Homo sapiens
ugugacugguugucccacuuuc

SEQ ID NO: 364684 - RNA, 19 nt, Homo sapiens
ugugacugguugucucgcu

SEQ ID NO: 364685 - RNA, 22 nt, Homo sapiens
ugugagacugacagggcagggu

SEQ ID NO: 364686 - RNA, 22 nt, Homo sapiens
ugugagacugguucugaaccca

SEQ ID NO: 364687 - RNA, 22 nt, Homo sapiens
ugugaucaaccugcagggcugg

SEQ ID NO: 364688 - RNA, 22 nt, Homo sapiens
ugugaugaagaguccaagaaca

SEQ ID NO: 364689 - RNA, 22 nt, Homo sapiens
ugugcaaucagcuucauuacau

SEQ ID NO: 364690 - RNA, 22 nt, Homo sapiens
ugugcacaacaugcagguuugu

SEQ ID NO: 364691 - RNA, 22 nt, Homo sapiens
ugugcaguuuugagugaauuuc

SEQ ID NO: 364692 - RNA, 22 nt, Homo sapiens
ugugcauauaaguguguauaua

SEQ ID NO: 364693 - RNA, 22 nt, Homo sapiens
ugugcauaugucuuuauaguag

SEQ ID NO: 364694 - RNA, 22 nt, Homo sapiens
uggaaaacaugcacauuggauu

SEQ ID NO: 364695 - RNA, 21 nt, Homo sapiens
uggaaacuucuagcuuacgua

SEQ ID NO: 364696 - RNA, 20 nt, Homo sapiens
uggaaaguaagucaugauau

SEQ ID NO: 364697 - RNA, 22 nt, Homo sapiens
uggaaauuaacagggauugucc

SEQ ID NO: 364698 - RNA, 23 nt, Homo sapiens
uggaagacuccucucuuggcugc

SEQ ID NO: 364699 - RNA, 22 nt, Homo sapiens
uggaagaugggaccucaguuuu

SEQ ID NO: 364700 - RNA, 22 nt, Homo sapiens
uggaagauuacuuuuuguugaa

SEQ ID NO: 364701 - RNA, 22 nt, Homo sapiens
uggaaguagauagauuguguca

SEQ ID NO: 364702 - RNA, 22 nt, Homo sapiens
uggaagucuauggcauuugagu

SEQ ID NO: 364703 - RNA, 22 nt, Homo sapiens
uggaaucuuaggugaaggcuuu

SEQ ID NO: 364704 - RNA, 21 nt, Homo sapiens
uggaaugaauggccaacaugg

SEQ ID NO: 364705 - RNA, 22 nt, Homo sapiens
uggaaugguaucuuguuggggu

SEQ ID NO: 364706 - RNA, 22 nt, Homo sapiens
uggacaagauagguucuauauu

SEQ ID NO: 364707 - RNA, 22 nt, Homo sapiens
uggacagaaacauguuuucagu

SEQ ID NO: 364708 - RNA, 18 nt, Homo sapiens
uggacagugauuauccau

SEQ ID NO: 364709 - RNA, 20 nt, Homo sapiens
uggaccagagagguggggac

SEQ ID NO: 364710 - RNA, 21 nt, Homo sapiens
uggaccccuuccuuacaucau

SEQ ID NO: 364711 - RNA, 22 nt, Homo sapiens
uggacuagagggugggcgaggu

SEQ ID NO: 364712 - RNA, 22 nt, Homo sapiens
uggagagcaaagaauuuguuag

SEQ ID NO: 364713 - RNA, 22 nt, Homo sapiens
uggagagucauuuauaguauuu

SEQ ID NO: 364714 - RNA, 22 nt, Homo sapiens
uggagggcuagucauuucuuuu

SEQ ID NO: 364715 - RNA, 22 nt, Homo sapiens
uggaggucauuggaucaugggg

SEQ ID NO: 364716 - RNA, 19 nt, Homo sapiens
uggagucaucaugcugcua

SEQ ID NO: 364717 - RNA, 22 nt, Homo sapiens
uggagugagaacuucaaugaug

SEQ ID NO: 364718 - RNA, 22 nt, Homo sapiens
uggagugcaauggugagaucuu

SEQ ID NO: 364719 - RNA, 22 nt, Homo sapiens
uggaguguuggggcaggaucuc

SEQ ID NO: 364720 - RNA, 19 nt, Homo sapiens
uggaugacugucugggucu

SEQ ID NO: 364721 - RNA, 21 nt, Homo sapiens
uggauugagaaccccaggagg

SEQ ID NO: 364722 - RNA, 22 nt, Homo sapiens
uggauugugaagaccaugggaa

SEQ ID NO: 364723 - RNA, 22 nt, Homo sapiens
uggauuuuaauuauucugucau

SEQ ID NO: 364724 - RNA, 22 nt, Homo sapiens
uggcaaaauauuuugguuucug

SEQ ID NO: 364725 - RNA, 22 nt, Homo sapiens
uggcaaaauggaauauguuggg

SEQ ID NO: 364726 - RNA, 22 nt, Homo sapiens
uggcaacaucuggggacauguu

SEQ ID NO: 364727 - RNA, 21 nt, Homo sapiens
uggcaacauggauggauucug

SEQ ID NO: 364728 - RNA, 22 nt, Homo sapiens
uggcaagagggaugcaagguuu

SEQ ID NO: 364729 - RNA, 18 nt, Homo sapiens
uggcaagugccauacggu

SEQ ID NO: 364730 - RNA, 19 nt, Homo sapiens
uggcacauguauacauaug

SEQ ID NO: 364731 - RNA, 22 nt, Homo sapiens
uggcacuggagauacauuaaua

SEQ ID NO: 364732 - RNA, 22 nt, Homo sapiens
uggcagacaaauuugagcauau

SEQ ID NO: 364733 - RNA, 22 nt, Homo sapiens
uggcagauagaaaugugguuaa

SEQ ID NO: 364734 - RNA, 22 nt, Homo sapiens
uggcagauaggauacaggacua

SEQ ID NO: 364735 - RNA, 22 nt, Homo sapiens
uggcauaugguauuugauaucu

SEQ ID NO: 364736 - RNA, 20 nt, Homo sapiens
uggcaugaaauuuuccaagc

SEQ ID NO: 364737 - RNA, 22 nt, Homo sapiens
uggcauguuggguguugacucc

SEQ ID NO: 364738 - RNA, 22 nt, Homo sapiens
uggcauuuucucuguucuuaga

SEQ ID NO: 364739 - RNA, 22 nt, Homo sapiens
uggcucauuucuaaacccagcu

SEQ ID NO: 364740 - RNA, 22 nt, Homo sapiens
acaguguguguguucaccuaga

SEQ ID NO: 364741 - RNA, 22 nt, Homo sapiens
acauaguagacacugaaaauau

SEQ ID NO: 364742 - RNA, 22 nt, Homo sapiens
acaucauugggggcuacaggug

SEQ ID NO: 364743 - RNA, 18 nt, Homo sapiens
acaucccaugcuggggug

SEQ ID NO: 364744 - RNA, 22 nt, Homo sapiens
acaugagacuggguuuguaggg

SEQ ID NO: 364745 - RNA, 22 nt, Homo sapiens
acaugcauauguuggaagaaag

SEQ ID NO: 364746 - RNA, 21 nt, Homo sapiens
acauguacacauguaugcaca

SEQ ID NO: 364747 - RNA, 22 nt, Homo sapiens
acauucagcuguuguuucaaug

SEQ ID NO: 364748 - RNA, 18 nt, Homo sapiens
acauucagcuugaagaua

SEQ ID NO: 364749 - RNA, 22 nt, Homo sapiens
accacaggguaaaguuagauau

SEQ ID NO: 364750 - RNA, 22 nt, Homo sapiens
accaccacucccgcauucuaaa

SEQ ID NO: 364751 - RNA, 22 nt, Homo sapiens
accaguuuuuuauacaucuucu

SEQ ID NO: 364752 - RNA, 22 nt, Homo sapiens
acccacuagaugccaguggcac

SEQ ID NO: 364753 - RNA, 22 nt, Homo sapiens
acccaguagccagauguagcug

SEQ ID NO: 364754 - RNA, 17 nt, Homo sapiens
acccagucuuuuugcac

SEQ ID NO: 364755 - RNA, 21 nt, Homo sapiens
acccccacaccuccuuaguuc

SEQ ID NO: 364756 - RNA, 23 nt, Homo sapiens
accccuacaggcuuguguccugc

SEQ ID NO: 364757 - RNA, 22 nt, Homo sapiens
acccgggaggcaggagucauag

SEQ ID NO: 364758 - RNA, 21 nt, Homo sapiens
acccucuaguuuucaacaggc

SEQ ID NO: 364759 - RNA, 22 nt, Homo sapiens
acccuggagagugcuguaguaa

SEQ ID NO: 364760 - RNA, 22 nt, Homo sapiens
acccuguaggacuauucuaauc

SEQ ID NO: 364761 - RNA, 22 nt, Homo sapiens
acccugucaaaacggaccaauc

SEQ ID NO: 364762 - RNA, 22 nt, Homo sapiens
acccugucaaaauagaccaauc

SEQ ID NO: 364763 - RNA, 19 nt, Homo sapiens
acccuguccccaccuuuac

SEQ ID NO: 364764 - RNA, 22 nt, Homo sapiens
acccuguugguggaucagauug

SEQ ID NO: 364765 - RNA, 18 nt, Homo sapiens
acccuucagcacugggcc

SEQ ID NO: 364766 - RNA, 22 nt, Homo sapiens
accucagcccggggaaguugag

SEQ ID NO: 364767 - RNA, 22 nt, Homo sapiens
accuuguaucuguuaggauugc

SEQ ID NO: 364768 - RNA, 22 nt, Homo sapiens
acgugcaugcacacacaugcgc

SEQ ID NO: 364769 - RNA, 22 nt, Homo sapiens
acuaaggcacaauuuucucaua

SEQ ID NO: 364770 - RNA, 22 nt, Homo sapiens
acuacauaugacaucuucuuua

SEQ ID NO: 364771 - RNA, 22 nt, Homo sapiens
acuacuucuaaguuuuggaaga

SEQ ID NO: 364772 - RNA, 19 nt, Homo sapiens
acuaggccuacaaagcuau

SEQ ID NO: 364773 - RNA, 22 nt, Homo sapiens
acuaugagacgaaugcaucagu

SEQ ID NO: 364774 - RNA, 22 nt, Homo sapiens
acucauugcucauaccuuaucu

SEQ ID NO: 364775 - RNA, 22 nt, Homo sapiens
acuccauuuccagagcagcccc

SEQ ID NO: 364776 - RNA, 18 nt, Homo sapiens
acucuguauguggagugg

SEQ ID NO: 364777 - RNA, 22 nt, Homo sapiens
acugcacuccaaccuuggugac

SEQ ID NO: 364778 - RNA, 22 nt, Homo sapiens
acugcacuccagccuggacgaa

SEQ ID NO: 364779 - RNA, 22 nt, Homo sapiens
acugcacuccaguuugggcagc

SEQ ID NO: 364780 - RNA, 19 nt, Homo sapiens
acugcacuccuccuugggu

SEQ ID NO: 364781 - RNA, 22 nt, Homo sapiens
acugcacuucaaccucauugac

SEQ ID NO: 364782 - RNA, 22 nt, Homo sapiens
acugcauuugguaaagucaaga

SEQ ID NO: 364783 - RNA, 22 nt, Homo sapiens
acuggauguuagggauuuuauu

SEQ ID NO: 364784 - RNA, 22 nt, Homo sapiens
acuguacuccagccugggugac

SEQ ID NO: 364785 - RNA, 22 nt, Homo sapiens
acuguguguuugucuagcacag

SEQ ID NO: 364786 - RNA, 22 nt, Homo sapiens
acuuaguauggggcuuuugaga

SEQ ID NO: 364787 - RNA, 22 nt, Homo sapiens
acuuauuguggcugacccaaac

SEQ ID NO: 364788 - RNA, 22 nt, Homo sapiens
acuuuuugcaaccauuuggacc

SEQ ID NO: 364789 - RNA, 21 nt, Homo sapiens
agaaaaucuuaugggaaacau

SEQ ID NO: 364790 - RNA, 22 nt, Homo sapiens
agaaagcgcuucccuuugcugg

SEQ ID NO: 364791 - RNA, 22 nt, Homo sapiens
agaaaugcagcaugaggcggca

SEQ ID NO: 364792 - RNA, 22 nt, Homo sapiens
agaacccuuugaaauguguuug

SEQ ID NO: 364793 - RNA, 19 nt, Homo sapiens
agaaucuaaauuauuucug

SEQ ID NO: 364794 - RNA, 22 nt, Homo sapiens
agaaugugaccuuauuuggaga

SEQ ID NO: 364795 - RNA, 22 nt, Homo sapiens
agacaagauggcuugagguuca

SEQ ID NO: 364796 - RNA, 20 nt, Homo sapiens
agacagcugcagcccacauc

SEQ ID NO: 364797 - RNA, 22 nt, Homo sapiens
agacagcuggaguaucauagcu

SEQ ID NO: 364798 - RNA, 22 nt, Homo sapiens
agaccacuuuagagauuguuca

SEQ ID NO: 364799 - RNA, 21 nt, Homo sapiens
agagaacugaaacaugugacu

SEQ ID NO: 364800 - RNA, 22 nt, Homo sapiens
agagacauugcuccaacucacc

SEQ ID NO: 364801 - RNA, 22 nt, Homo sapiens
agagaccuguaaaguucaggca

SEQ ID NO: 364802 - RNA, 22 nt, Homo sapiens
agagauaauuagguuaaaugag

SEQ ID NO: 364803 - RNA, 22 nt, Homo sapiens
agagaucaacugaauuacugga

SEQ ID NO: 364804 - RNA, 22 nt, Homo sapiens
agagaucacugaaucacggggg

SEQ ID NO: 364805 - RNA, 20 nt, Homo sapiens
agagaucaguaauucaucaa

SEQ ID NO: 364806 - RNA, 22 nt, Homo sapiens
agagaucauuuuguuucaaauc

SEQ ID NO: 364807 - RNA, 22 nt, Homo sapiens
agagaugaagauggggcucccg

SEQ ID NO: 364808 - RNA, 20 nt, Homo sapiens
agagcaaagccgcaccccua

SEQ ID NO: 364809 - RNA, 22 nt, Homo sapiens
agagcaaugggugaauauuaaa

SEQ ID NO: 364810 - RNA, 22 nt, Homo sapiens
agagcacuguggguccaaauau

SEQ ID NO: 364811 - RNA, 22 nt, Homo sapiens
agagcuaguauuuacggagcau

SEQ ID NO: 364812 - RNA, 22 nt, Homo sapiens
agagguagaagauaggcuacag

SEQ ID NO: 364813 - RNA, 20 nt, Homo sapiens
agagguuuugauagguucug

SEQ ID NO: 364814 - RNA, 22 nt, Homo sapiens
agaguaguuucuauauucuuca

SEQ ID NO: 364815 - RNA, 22 nt, Homo sapiens
agagugcaaagguuggggcugg

SEQ ID NO: 364816 - RNA, 22 nt, Homo sapiens
agauacaucuaugugucugugu

SEQ ID NO: 364817 - RNA, 22 nt, Homo sapiens
agauauguuuaguuucaaaaug

SEQ ID NO: 364818 - RNA, 22 nt, Homo sapiens
agauauuuguuaggucugucag

SEQ ID NO: 364819 - RNA, 22 nt, Homo sapiens
agaucaauugcugauucgcucu

SEQ ID NO: 364820 - RNA, 22 nt, Homo sapiens
agaucauaugcaguaaugaacu

SEQ ID NO: 364821 - RNA, 22 nt, Homo sapiens
agaugccucauguucuagguuc

SEQ ID NO: 364822 - RNA, 22 nt, Homo sapiens
agaugguguuggcugaguguau

SEQ ID NO: 364823 - RNA, 22 nt, Homo sapiens
agauguuguucaucugauuguu

SEQ ID NO: 364824 - RNA, 22 nt, Homo sapiens
agcaacaucagcagcaggaaaa

SEQ ID NO: 364825 - RNA, 22 nt, Homo sapiens
agcacacuggguggcuuaaaca

SEQ ID NO: 364826 - RNA, 22 nt, Homo sapiens
agcacagugaaugguuuacuca

SEQ ID NO: 364827 - RNA, 22 nt, Homo sapiens
agcacauuaguaucuaagaaca

SEQ ID NO: 364828 - RNA, 22 nt, Homo sapiens
uuguagcaaauauauuuuggaa

SEQ ID NO: 364829 - RNA, 22 nt, Homo sapiens
uuguauguuucugugcacauga

SEQ ID NO: 364830 - RNA, 22 nt, Homo sapiens
uuguauugucuugaugaguuga

SEQ ID NO: 364831 - RNA, 22 nt, Homo sapiens
uugucacccuacauaacaggga

SEQ ID NO: 364832 - RNA, 22 nt, Homo sapiens
uugucccauggggucuuccuuu

SEQ ID NO: 364833 - RNA, 21 nt, Homo sapiens
uugucuagagaaauauaucuc

SEQ ID NO: 364834 - RNA, 22 nt, Homo sapiens
uugucucacuggaguuuaguaa

SEQ ID NO: 364835 - RNA, 22 nt, Homo sapiens
uugucuugcagcuuaggcauca

SEQ ID NO: 364836 - RNA, 22 nt, Homo sapiens
uugugaauggugccucaguaaa

SEQ ID NO: 364837 - RNA, 22 nt, Homo sapiens
uugugacacagcugggccuaua

SEQ ID NO: 364838 - RNA, 20 nt, Homo sapiens
uugugcauugggccauuggg

SEQ ID NO: 364839 - RNA, 22 nt, Homo sapiens
uugugccccuucucagucgggc

SEQ ID NO: 364840 - RNA, 22 nt, Homo sapiens
uugugcuucaucaccuagcaga

SEQ ID NO: 364841 - RNA, 22 nt, Homo sapiens
uugugggaggugauuagaucau

SEQ ID NO: 364842 - RNA, 22 nt, Homo sapiens
uugugguaggaguugccauguu

SEQ ID NO: 364843 - RNA, 22 nt, Homo sapiens
uuguguuugaugcugacacgca

SEQ ID NO: 364844 - RNA, 22 nt, Homo sapiens
uuguuauguuggucaguaaugu

SEQ ID NO: 364845 - RNA, 22 nt, Homo sapiens
uuguuuuggagaugagcuaaaa

SEQ ID NO: 364846 - RNA, 22 nt, Homo sapiens
uuuaaagcacggaguuuguggc

SEQ ID NO: 364847 - RNA, 20 nt, Homo sapiens
uuuaagacaugcugaauuga

SEQ ID NO: 364848 - RNA, 22 nt, Homo sapiens
uuuaaugcugcccagucauggg

SEQ ID NO: 364849 - RNA, 22 nt, Homo sapiens
uuuaucuguuuaaaacuguuca

SEQ ID NO: 364850 - RNA, 22 nt, Homo sapiens
uuuaugcuacauguguuggaaa

SEQ ID NO: 364851 - RNA, 22 nt, Homo sapiens
uuuaugucuguacaucgggcgg

SEQ ID NO: 364852 - RNA, 22 nt, Homo sapiens
uuuauguggagcacuugacaca

SEQ ID NO: 364853 - RNA, 22 nt, Homo sapiens
uuuauucggcuaggagcuucgg

SEQ ID NO: 364854 - RNA, 22 nt, Homo sapiens
uuucacagagggcuucuuucua

SEQ ID NO: 364855 - RNA, 22 nt, Homo sapiens
uuucacagcugucuuccgucuc

SEQ ID NO: 364856 - RNA, 22 nt, Homo sapiens
uuucacuagccagcccuuuauu

SEQ ID NO: 364857 - RNA, 18 nt, Homo sapiens
uuucaggguggacaugag

SEQ ID NO: 364858 - RNA, 22 nt, Homo sapiens
uuucaguguggcaggcauagcu

SEQ ID NO: 364859 - RNA, 22 nt, Homo sapiens
uuucauggaauauagucauuuu

SEQ ID NO: 364860 - RNA, 22 nt, Homo sapiens
uuucauggagaaucuucuuacu

SEQ ID NO: 364861 - RNA, 22 nt, Homo sapiens
uuuccaguuggaaagccuguuu

SEQ ID NO: 364862 - RNA, 22 nt, Homo sapiens
uuuccauguuggugaaaugagg

SEQ ID NO: 364863 - RNA, 21 nt, Homo sapiens
uuuccuggagcguauggcuuc

SEQ ID NO: 364864 - RNA, 22 nt, Homo sapiens
uuuccuguaggaaggaaauaga

SEQ ID NO: 364865 - RNA, 16 nt, Homo sapiens
uuucuauguuuuacua

SEQ ID NO: 364866 - RNA, 22 nt, Homo sapiens
uuucucaguguuucaggguagg

SEQ ID NO: 364867 - RNA, 22 nt, Homo sapiens
uuucugugguccucuugaaggu

SEQ ID NO: 364868 - RNA, 22 nt, Homo sapiens
uuucuuggagcucuuagggucg

SEQ ID NO: 364869 - RNA, 22 nt, Homo sapiens
uuugaaaguaauuugguuggug

SEQ ID NO: 364870 - RNA, 20 nt, Homo sapiens
uuugaauguaaagcauguca

SEQ ID NO: 364871 - RNA, 22 nt, Homo sapiens
uuugacuaccaggaauguucuu

SEQ ID NO: 364872 - RNA, 22 nt, Homo sapiens
uuugacuagaguguuuuacaac

SEQ ID NO: 364873 - RNA, 18 nt, Homo sapiens
uuugacugguguccuuau

SEQ ID NO: 364874 - RNA, 22 nt, Homo sapiens
uuugagcaggcuaaucaauaua

SEQ ID NO: 364875 - RNA, 22 nt, Homo sapiens
uuugagcuagagucucacucug

SEQ ID NO: 364876 - RNA, 22 nt, Homo sapiens
uuugagugugauaucgauugga

SEQ ID NO: 364877 - RNA, 22 nt, Homo sapiens
uuugaguuugaggugcugauga

SEQ ID NO: 364878 - RNA, 22 nt, Homo sapiens
uuugcacuuuaauauaauguga

SEQ ID NO: 364879 - RNA, 22 nt, Homo sapiens
uuugcacuuuuguaauaugguu

SEQ ID NO: 364880 - RNA, 22 nt, Homo sapiens
uuugcagagacuuguuaggaau

SEQ ID NO: 364881 - RNA, 22 nt, Homo sapiens
uuugccaauauuuuacugagga

SEQ ID NO: 364882 - RNA, 22 nt, Homo sapiens
uuugccaaugggaauuuuccua

SEQ ID NO: 364883 - RNA, 22 nt, Homo sapiens
uuugcuuguguaaaaaucugga

SEQ ID NO: 364884 - RNA, 22 nt, Homo sapiens
uuuggaagaugccacuguauca

SEQ ID NO: 364885 - RNA, 22 nt, Homo sapiens
uuuggcaacguuggaucccuca

SEQ ID NO: 364886 - RNA, 21 nt, Homo sapiens
uuuggcauuaugucaccagag

SEQ ID NO: 364887 - RNA, 22 nt, Homo sapiens
uuuggucacugccgccgccagc

SEQ ID NO: 364888 - RNA, 22 nt, Homo sapiens
uuuggucuuuuguaaguuaucu

SEQ ID NO: 364889 - RNA, 22 nt, Homo sapiens
uuugucacccugaauguaagau

SEQ ID NO: 364890 - RNA, 21 nt, Homo sapiens
uuuguccaccuguguucacca

SEQ ID NO: 364891 - RNA, 19 nt, Homo sapiens
uuuguccugcccuuucuca

SEQ ID NO: 364892 - RNA, 22 nt, Homo sapiens
uuugucuccuaagacucugugg

SEQ ID NO: 364893 - RNA, 23 nt, Homo sapiens
uuugugacacucuccaucuccag

SEQ ID NO: 364894 - RNA, 22 nt, Homo sapiens
uuugugacucauggucuagugc

SEQ ID NO: 364895 - RNA, 22 nt, Homo sapiens
uuugugacuugcuucucagaau

SEQ ID NO: 364896 - RNA, 22 nt, Homo sapiens
uuugugagguggauagauugca

SEQ ID NO: 364897 - RNA, 22 nt, Homo sapiens
uuugugauugcacacucaagau

SEQ ID NO: 364898 - RNA, 22 nt, Homo sapiens
uuugugcuaacuuuaacucuua

SEQ ID NO: 364899 - RNA, 18 nt, Homo sapiens
uuugugcuccacaaagga

SEQ ID NO: 364900 - RNA, 22 nt, Homo sapiens
uuugugcugcaauuaauuuccc

SEQ ID NO: 364901 - RNA, 22 nt, Homo sapiens
uuuguguccccacccaaaucuc

SEQ ID NO: 364902 - RNA, 22 nt, Homo sapiens
uuuuagcagccaugacaaagau

SEQ ID NO: 364903 - RNA, 22 nt, Homo sapiens
uuuuagcuuuucccaggacucc

SEQ ID NO: 364904 - RNA, 22 nt, Homo sapiens
uuuucaguggccauaguggaga

SEQ ID NO: 364905 - RNA, 22 nt, Homo sapiens
uuuugcacuguuuuaucugaca

SEQ ID NO: 364906 - RNA, 18 nt, Homo sapiens
uuuugcuuaacugcgcca

SEQ ID NO: 364907 - RNA, 22 nt, Homo sapiens
uuuuggacuucaauuugacacu

SEQ ID NO: 364908 - RNA, 22 nt, Homo sapiens
uuuuggacuugcuccccugucc

SEQ ID NO: 364909 - RNA, 17 nt, Homo sapiens
uuuuggauuagaaaucc

SEQ ID NO: 364910 - RNA, 22 nt, Homo sapiens
uuuuugaguaaauauaaauugu

SEQ ID NO: 364911 - RNA, 22 nt, Homo sapiens
uuuuuggauaaugguacaugua

SEQ ID NO: 364912 - RNA, 21 nt, Homo sapiens
uuuuugguggucauggauaga

SEQ ID NO: 364913 - RNA, 18 nt, Homo sapiens
aaaaagugcucaggccua

SEQ ID NO: 364914 - RNA, 22 nt, Homo sapiens
aaaagugguguuguuucuaaau

SEQ ID NO: 364915 - RNA, 22 nt, Homo sapiens
aaacagucuucuccugagggac

SEQ ID NO: 364916 - RNA, 22 nt, Homo sapiens
aaacccauauaccagcugugcu

SEQ ID NO: 364917 - RNA, 22 nt, Homo sapiens
aaacucuguagcagagacagau

SEQ ID NO: 364918 - RNA, 20 nt, Homo sapiens
aaacucugucuucuuuauca

SEQ ID NO: 364919 - RNA, 22 nt, Homo sapiens
aaacuugucuaauuauaagcau

SEQ ID NO: 364920 - RNA, 22 nt, Homo sapiens
aaagaagucagccuguccuuug

SEQ ID NO: 364921 - RNA, 22 nt, Homo sapiens
gagcacauguggagagucuggg

SEQ ID NO: 364922 - RNA, 22 nt, Homo sapiens
gagcaccagucccugucagugc

SEQ ID NO: 364923 - RNA, 22 nt, Homo sapiens
gagcaucauggggccaaagcgc

SEQ ID NO: 364924 - RNA, 22 nt, Homo sapiens
gagcuaguguaauauuuugggg

SEQ ID NO: 364925 - RNA, 22 nt, Homo sapiens
gagcuccuccccuuggcuuuca

SEQ ID NO: 364926 - RNA, 22 nt, Homo sapiens
gagcuuggguuaaaguugccuu

SEQ ID NO: 364927 - RNA, 22 nt, Homo sapiens
gaggaaguagcuacugucuuuc

SEQ ID NO: 364928 - RNA, 22 nt, Homo sapiens
gaggagauauucugcuggaugg

SEQ ID NO: 364929 - RNA, 22 nt, Homo sapiens
gaggcaauaugagggaggcuuc

SEQ ID NO: 364930 - RNA, 22 nt, Homo sapiens
gaggcaaugugcccggcccaca

SEQ ID NO: 364931 - RNA, 22 nt, Homo sapiens
gaggcauugaaauauugcuuau

SEQ ID NO: 364932 - RNA, 22 nt, Homo sapiens
gagguaagaaagucaguccuuc

SEQ ID NO: 364933 - RNA, 22 nt, Homo sapiens
gagguaagagaauaaacaguuu

SEQ ID NO: 364934 - RNA, 21 nt, Homo sapiens
gagguagggauuaaagaccuc

SEQ ID NO: 364935 - RNA, 22 nt, Homo sapiens
gaggucaggacauuuuugcuuu

SEQ ID NO: 364936 - RNA, 22 nt, Homo sapiens
gaggucaugucgggccccagga

SEQ ID NO: 364937 - RNA, 22 nt, Homo sapiens
gaggugguagguucacagcagc

SEQ ID NO: 364938 - RNA, 22 nt, Homo sapiens
gagguggugguggaggcauagc

SEQ ID NO: 364939 - RNA, 22 nt, Homo sapiens
gagguuuuagugagucccacug

SEQ ID NO: 364940 - RNA, 22 nt, Homo sapiens
gaguaacagcauaaauuuguga

SEQ ID NO: 364941 - RNA, 23 nt, Homo sapiens
gaguacauuaaaagcccagacug

SEQ ID NO: 364942 - RNA, 22 nt, Homo sapiens
gagugcaaagguccugaggugg

SEQ ID NO: 364943 - RNA, 22 nt, Homo sapiens
gagugcaauggcaugaucuggg

SEQ ID NO: 364944 - RNA, 22 nt, Homo sapiens
gaguucaaaucucagcucuguu

SEQ ID NO: 364945 - RNA, 22 nt, Homo sapiens
gauaaaguauuggguacuaugc

SEQ ID NO: 364946 - RNA, 21 nt, Homo sapiens
gauaugacauggguaaaacca

SEQ ID NO: 364947 - RNA, 22 nt, Homo sapiens
gauauguacagcucucuaggau

SEQ ID NO: 364948 - RNA, 22 nt, Homo sapiens
gauauguguaucuauguacaug

SEQ ID NO: 364949 - RNA, 22 nt, Homo sapiens
gaucacaugggagaaugagagu

SEQ ID NO: 364950 - RNA, 22 nt, Homo sapiens
gaucacauguguacucaaugug

SEQ ID NO: 364951 - RNA, 22 nt, Homo sapiens
gaucacauuguuucauacauau

SEQ ID NO: 364952 - RNA, 22 nt, Homo sapiens
gaucuguguuuguaugcauaag

SEQ ID NO: 364953 - RNA, 19 nt, Homo sapiens
gaucuguugaucaaugugu

SEQ ID NO: 364954 - RNA, 22 nt, Homo sapiens
gaucuguuguuuggaaguauca

SEQ ID NO: 364955 - RNA, 22 nt, Homo sapiens
gaugaaacaucuuuggaaacug

SEQ ID NO: 364956 - RNA, 22 nt, Homo sapiens
gaugacuaagaauuuuauaauu

SEQ ID NO: 364957 - RNA, 22 nt, Homo sapiens
gaugagaucauaaguguggagc

SEQ ID NO: 364958 - RNA, 22 nt, Homo sapiens
gaugagaugagcauuugaauug

SEQ ID NO: 364959 - RNA, 22 nt, Homo sapiens
gaugagguagaagacucagcaa

SEQ ID NO: 364960 - RNA, 22 nt, Homo sapiens
gaugcaguaagaaugcauagcg

SEQ ID NO: 364961 - RNA, 22 nt, Homo sapiens
gauggcagugcagccccuggcu

SEQ ID NO: 364962 - RNA, 22 nt, Homo sapiens
gaugguuuucaccugcaugcuu

SEQ ID NO: 364963 - RNA, 22 nt, Homo sapiens
gauuccacuuucugucucuaug

SEQ ID NO: 364964 - RNA, 22 nt, Homo sapiens
gauugguugaaaguagaauacu

SEQ ID NO: 364965 - RNA, 22 nt, Homo sapiens
gauuugagagaggguguuuaua

SEQ ID NO: 364966 - RNA, 22 nt, Homo sapiens
gauuuuuggggaagccucuuau

SEQ ID NO: 364967 - RNA, 21 nt, Homo sapiens
gcaaaguggcuaccuugcucc

SEQ ID NO: 364968 - RNA, 20 nt, Homo sapiens
gcaaaguuuagcucccacua

SEQ ID NO: 364969 - RNA, 22 nt, Homo sapiens
gcaaaugcuaugccauuuuaua

SEQ ID NO: 364970 - RNA, 20 nt, Homo sapiens
gcaacauggccagagugaau

SEQ ID NO: 364971 - RNA, 22 nt, Homo sapiens
gcaaugcugucugugcacagau

SEQ ID NO: 364972 - RNA, 22 nt, Homo sapiens
gcacaguaggugguaggacuuu

SEQ ID NO: 364973 - RNA, 22 nt, Homo sapiens
gcacgugcacccacaugcacgu

SEQ ID NO: 364974 - RNA, 17 nt, Homo sapiens
gcacuggcguaucccac

SEQ ID NO: 364975 - RNA, 22 nt, Homo sapiens
gcagagaaacaggucuaaggag

SEQ ID NO: 364976 - RNA, 22 nt, Homo sapiens
gcagcacauggcagaacauauu

SEQ ID NO: 364977 - RNA, 22 nt, Homo sapiens
gcagcaucaaaucacacaagau

SEQ ID NO: 364978 - RNA, 22 nt, Homo sapiens
gcaggaauuucucugcagaccc

SEQ ID NO: 364979 - RNA, 22 nt, Homo sapiens
gcaggcaugacauuucacucuu

SEQ ID NO: 364980 - RNA, 22 nt, Homo sapiens
gcaguacacuguugguaggaau

SEQ ID NO: 364981 - RNA, 22 nt, Homo sapiens
gcagucaucugaaggcuuaacu

SEQ ID NO: 364982 - RNA, 22 nt, Homo sapiens
gcagugcaugacgguauauaua

SEQ ID NO: 364983 - RNA, 22 nt, Homo sapiens
gcaguggugugugccagccuag

SEQ ID NO: 364984 - RNA, 20 nt, Homo sapiens
gcaguguucugaccugaauc

SEQ ID NO: 364985 - RNA, 22 nt, Homo sapiens
gcaguguugugauccaggucuu

SEQ ID NO: 364986 - RNA, 22 nt, Homo sapiens
gcaguucuguaguugaaauuua

SEQ ID NO: 364987 - RNA, 22 nt, Homo sapiens
gcauaugucuuuauagcagcau

SEQ ID NO: 364988 - RNA, 20 nt, Homo sapiens
gcauaugucuuuauggcagc

SEQ ID NO: 364989 - RNA, 22 nt, Homo sapiens
gcauggccuuuaaaugucacag

SEQ ID NO: 364990 - RNA, 22 nt, Homo sapiens
gccaacauggcgcuccauucuu

SEQ ID NO: 364991 - RNA, 22 nt, Homo sapiens
gccaagaagugucuaagcagga

SEQ ID NO: 364992 - RNA, 22 nt, Homo sapiens
gccaagauuuaauucaucaguu

SEQ ID NO: 364993 - RNA, 21 nt, Homo sapiens
gccaguguggcaauuuuucaa

SEQ ID NO: 364994 - RNA, 22 nt, Homo sapiens
gccauugcacuccgcccugggc

SEQ ID NO: 364995 - RNA, 22 nt, Homo sapiens
gccuagggacaaaccguccgac

SEQ ID NO: 364996 - RNA, 19 nt, Homo sapiens
gcggcacuggagacacagc

SEQ ID NO: 364997 - RNA, 22 nt, Homo sapiens
gcgguagcauagacugcaggac

SEQ ID NO: 364998 - RNA, 22 nt, Homo sapiens
gcucaaguaauggcaguuuugc

SEQ ID NO: 364999 - RNA, 22 nt, Homo sapiens
gcuccauuuuccauuucucuaa

SEQ ID NO: 365000 - RNA, 22 nt, Homo sapiens
gcugauguuggccucugggcuu

SEQ ID NO: 365001 - RNA, 22 nt, Homo sapiens
gcugcacuuuaaggcauccccu

SEQ ID NO: 365002 - RNA, 17 nt, Homo sapiens
gcugcauucauguagaa

SEQ ID NO: 365003 - RNA, 22 nt, Homo sapiens
gcugcguguagaguucucacug

SEQ ID NO: 365004 - RNA, 22 nt, Homo sapiens
gcuggcaagaugcugaugcaac

SEQ ID NO: 365005 - RNA, 22 nt, Homo sapiens
gcuggcaaguggccuacuuugu

SEQ ID NO: 365006 - RNA, 22 nt, Homo sapiens
gcuguugguaaaaaggacauga

SEQ ID NO: 365007 - RNA, 22 nt, Homo sapiens
gcuuguguucaaggaacaccua

SEQ ID NO: 365008 - RNA, 22 nt, Homo sapiens
gcuuugcaauggcauugaccau

SEQ ID NO: 365009 - RNA, 22 nt, Homo sapiens
gcuuuguuaaaacacagccaca

SEQ ID NO: 365010 - RNA, 23 nt, Homo sapiens
ggaaacauccagucuuucaccau

SEQ ID NO: 365011 - RNA, 22 nt, Homo sapiens
ggaaagauguaauauuaucuaa

SEQ ID NO: 365012 - RNA, 22 nt, Homo sapiens
ggaaauguaaacaauggggcua

SEQ ID NO: 365013 - RNA, 18 nt, Homo sapiens
ggaagccuauuuaguaac

SEQ ID NO: 365014 - RNA, 22 nt, Homo sapiens
ggaagccuggaaaaaauuguga

SEQ ID NO: 365015 - RNA, 17 nt, Homo sapiens
ggaagccuuugguuuaa

SEQ ID NO: 365016 - RNA, 22 nt, Homo sapiens
ggaaguuaauacagauagagua

SEQ ID NO: 365017 - RNA, 23 nt, Homo sapiens
ggaaugaaaccugguuaugauau

SEQ ID NO: 365018 - RNA, 17 nt, Homo sapiens
ggaaugaauuccagccc

SEQ ID NO: 365019 - RNA, 19 nt, Homo sapiens
ggaaugcuauucaaccuuu

SEQ ID NO: 365020 - RNA, 22 nt, Homo sapiens
ggaauggaacaaagucuugaaa

SEQ ID NO: 365021 - RNA, 22 nt, Homo sapiens
ggaauguuaaggcgcuguuggu

SEQ ID NO: 365022 - RNA, 22 nt, Homo sapiens
ggaauuaaggcaauugaaagcu

SEQ ID NO: 365023 - RNA, 22 nt, Homo sapiens
ggaauugcaucaaaugcaggua

SEQ ID NO: 365024 - RNA, 22 nt, Homo sapiens
ggacauuaacugcaagauagau

SEQ ID NO: 365025 - RNA, 22 nt, Homo sapiens
ggacuaggagcuaggaagaucu

SEQ ID NO: 365026 - RNA, 22 nt, Homo sapiens
augagacaguucccuuuaucuu

SEQ ID NO: 365027 - RNA, 22 nt, Homo sapiens
augagacuagaagagaauaaua

SEQ ID NO: 365028 - RNA, 22 nt, Homo sapiens
augagaugaggaauggcccucc

SEQ ID NO: 365029 - RNA, 22 nt, Homo sapiens
augagauuguuuguacuccaca

SEQ ID NO: 365030 - RNA, 19 nt, Homo sapiens
augagcaauaguuuuaauc

SEQ ID NO: 365031 - RNA, 22 nt, Homo sapiens
augagcagaagagauacacugu

SEQ ID NO: 365032 - RNA, 22 nt, Homo sapiens
augagcucauaaagagugauuu

SEQ ID NO: 365033 - RNA, 22 nt, Homo sapiens
augagcuguuuggaagacacuu

SEQ ID NO: 365034 - RNA, 22 nt, Homo sapiens
augaggagauauuaaauaccau

SEQ ID NO: 365035 - RNA, 22 nt, Homo sapiens
augaggcaggaaaggcguaucu

SEQ ID NO: 365036 - RNA, 22 nt, Homo sapiens
augagggcggacgcccuggaga

SEQ ID NO: 365037 - RNA, 23 nt, Homo sapiens
augagguaucugagcccagaaau

SEQ ID NO: 365038 - RNA, 22 nt, Homo sapiens
augagguguuuauuguauccug

SEQ ID NO: 365039 - RNA, 18 nt, Homo sapiens
augagucauuguggaaau

SEQ ID NO: 365040 - RNA, 22 nt, Homo sapiens
augagugugaccugccaagaga

SEQ ID NO: 365041 - RNA, 22 nt, Homo sapiens
augauagucuugagaagcauuu

SEQ ID NO: 365042 - RNA, 22 nt, Homo sapiens
augauaucuuguuuuucaugca

SEQ ID NO: 365043 - RNA, 22 nt, Homo sapiens
augauauguuuguagcuaucuc

SEQ ID NO: 365044 - RNA, 22 nt, Homo sapiens
augaucuguagaacuaguccuu

SEQ ID NO: 365045 - RNA, 22 nt, Homo sapiens
augaugucauuuuaauuucuaa

SEQ ID NO: 365046 - RNA, 22 nt, Homo sapiens
augauuagaacucauuuccagg

SEQ ID NO: 365047 - RNA, 22 nt, Homo sapiens
augcaaacagcuaucuggcugg

SEQ ID NO: 365048 - RNA, 22 nt, Homo sapiens
augcaaacaucugaagagacau

SEQ ID NO: 365049 - RNA, 20 nt, Homo sapiens
augcaaacccugcuuugugg

SEQ ID NO: 365050 - RNA, 22 nt, Homo sapiens
augcaaaucuuaaguaugugug

SEQ ID NO: 365051 - RNA, 22 nt, Homo sapiens
augcaacugcacuccagccugg

SEQ ID NO: 365052 - RNA, 22 nt, Homo sapiens
augcacaguccagcccaugugg

SEQ ID NO: 365053 - RNA, 22 nt, Homo sapiens
augcagagaaaucuaaaauaug

SEQ ID NO: 365054 - RNA, 22 nt, Homo sapiens
augcagguguuuugcacugagu

SEQ ID NO: 365055 - RNA, 22 nt, Homo sapiens
augcauagcaucugcaaauguu

SEQ ID NO: 365056 - RNA, 22 nt, Homo sapiens
agaaugucaguauuggcuaaaa

SEQ ID NO: 365057 - RNA, 20 nt, Homo sapiens
agacaguguggagauuccuu

SEQ ID NO: 365058 - RNA, 22 nt, Homo sapiens
agacaucauuugauggugggag

SEQ ID NO: 365059 - RNA, 20 nt, Homo sapiens
agacuagggagcagaaagcc

SEQ ID NO: 365060 - RNA, 19 nt, Homo sapiens
agagacucauuguagcauu

SEQ ID NO: 365061 - RNA, 22 nt, Homo sapiens
agagcaauguuaucagucucug

SEQ ID NO: 365062 - RNA, 22 nt, Homo sapiens
agagcacugcugcaggguucug

SEQ ID NO: 365063 - RNA, 22 nt, Homo sapiens
agagcuguguuuuaacuuuuua

SEQ ID NO: 365064 - RNA, 21 nt, Homo sapiens
agaggacugaccacagcccua

SEQ ID NO: 365065 - RNA, 22 nt, Homo sapiens
agagguuuaacuggcuuauggu

SEQ ID NO: 365066 - RNA, 22 nt, Homo sapiens
agagguuuugcccucgagauaa

SEQ ID NO: 365067 - RNA, 22 nt, Homo sapiens
agaguaguaggaugaauggacu

SEQ ID NO: 365068 - RNA, 22 nt, Homo sapiens
agagugaagcuuuuuauauucu

SEQ ID NO: 365069 - RNA, 22 nt, Homo sapiens
agaucacucagguuucucccug

SEQ ID NO: 365070 - RNA, 22 nt, Homo sapiens
agaugauguuuacugagcauca

SEQ ID NO: 365071 - RNA, 22 nt, Homo sapiens
agaugcuguuaucaacuguagc

SEQ ID NO: 365072 - RNA, 22 nt, Homo sapiens
agauggugauaaaugugguacc

SEQ ID NO: 365073 - RNA, 18 nt, Homo sapiens
agaugguguugcuucugu

SEQ ID NO: 365074 - RNA, 22 nt, Homo sapiens
agcaagaaugaacucucccaga

SEQ ID NO: 365075 - RNA, 22 nt, Homo sapiens
agcaagauccagucgcacagga

SEQ ID NO: 365076 - RNA, 22 nt, Homo sapiens
agcaagauugauggccugcagg

SEQ ID NO: 365077 - RNA, 22 nt, Homo sapiens
agcacauauauuucccaaaaca

SEQ ID NO: 365078 - RNA, 21 nt, Homo sapiens
agcagaguggcagcucuuuug

SEQ ID NO: 365079 - RNA, 22 nt, Homo sapiens
agcagauguuuagugagcgccu

SEQ ID NO: 365080 - RNA, 22 nt, Homo sapiens
agcagcaauuuuguaugguuua

SEQ ID NO: 365081 - RNA, 22 nt, Homo sapiens
agcagcauauuuuuauaaugua

SEQ ID NO: 365082 - RNA, 22 nt, Homo sapiens
agcagcaugaggggacuucugc

SEQ ID NO: 365083 - RNA, 22 nt, Homo sapiens
agcagcauggguauaaaucucc

SEQ ID NO: 365084 - RNA, 22 nt, Homo sapiens
agcagcauuaguggaaucuugu

SEQ ID NO: 365085 - RNA, 22 nt, Homo sapiens
agcagcauuccaaaaaucugcu

SEQ ID NO: 365086 - RNA, 22 nt, Homo sapiens
agcagcgacacccuguggugag

SEQ ID NO: 365087 - RNA, 22 nt, Homo sapiens
agcagcuuugcauggccuguga

SEQ ID NO: 365088 - RNA, 22 nt, Homo sapiens
agcaggacaauaugggaucagg

SEQ ID NO: 365089 - RNA, 22 nt, Homo sapiens
agcaggauuguuacaauaguaa

SEQ ID NO: 365090 - RNA, 22 nt, Homo sapiens
agcagguguccacaauguuugc

SEQ ID NO: 365091 - RNA, 22 nt, Homo sapiens
agcaucacacacuacagggaaa

SEQ ID NO: 365092 - RNA, 20 nt, Homo sapiens
agcauugguuagaacaguag

SEQ ID NO: 365093 - RNA, 22 nt, Homo sapiens
agccaguauuuugaguuggucu

SEQ ID NO: 365094 - RNA, 21 nt, Homo sapiens
agccaguguuccuuguggcuc

SEQ ID NO: 365095 - RNA, 22 nt, Homo sapiens
agccauacaacguaugcaugua

SEQ ID NO: 365096 - RNA, 23 nt, Homo sapiens
agcccugugacucgaacgaggag

SEQ ID NO: 365097 - RNA, 22 nt, Homo sapiens
agcccugugauuacuuuuauaa

SEQ ID NO: 365098 - RNA, 22 nt, Homo sapiens
agccgguguccacgaagaagag

SEQ ID NO: 365099 - RNA, 23 nt, Homo sapiens
agccuguugccuaggcagcucau

SEQ ID NO: 365100 - RNA, 22 nt, Homo sapiens
agcuaacauuuuuccucuucca

SEQ ID NO: 365101 - RNA, 22 nt, Homo sapiens
agcuaguguucaccagagguca

SEQ ID NO: 365102 - RNA, 22 nt, Homo sapiens
agcucacagccuagcacuguga

SEQ ID NO: 365103 - RNA, 22 nt, Homo sapiens
agcucauugcaaccuccgccuc

SEQ ID NO: 365104 - RNA, 22 nt, Homo sapiens
agcuccaugauaguaugucugu

SEQ ID NO: 365105 - RNA, 22 nt, Homo sapiens
agcugcacaaauggaugugagg

SEQ ID NO: 365106 - RNA, 22 nt, Homo sapiens
agcugccagucuuguaaggccu

SEQ ID NO: 365107 - RNA, 17 nt, Homo sapiens
agcuggaauuacgggag

SEQ ID NO: 365108 - RNA, 22 nt, Homo sapiens
aauggcaguagauggaugggua

SEQ ID NO: 365109 - RNA, 22 nt, Homo sapiens
aauggcuucuuauugugguuca

SEQ ID NO: 365110 - RNA, 22 nt, Homo sapiens
aauggcuuucagcuuuucccca

SEQ ID NO: 365111 - RNA, 22 nt, Homo sapiens
aauggcuuuuaauauccauaau

SEQ ID NO: 365112 - RNA, 22 nt, Homo sapiens
aauucacuucuuuuaggcaggg

SEQ ID NO: 365113 - RNA, 22 nt, Homo sapiens
aauuguacucccaucauuccua

SEQ ID NO: 365114 - RNA, 22 nt, Homo sapiens
aauugugcuuguaggccaggca

SEQ ID NO: 365115 - RNA, 22 nt, Homo sapiens
acaagcacaaaugcauagaugg

SEQ ID NO: 365116 - RNA, 22 nt, Homo sapiens
acacaguaagcacaguguagau

SEQ ID NO: 365117 - RNA, 22 nt, Homo sapiens
acacagucaaauccacuuggcu

SEQ ID NO: 365118 - RNA, 22 nt, Homo sapiens
acacaugugaaaaaaauguuac

SEQ ID NO: 365119 - RNA, 22 nt, Homo sapiens
acacaugugcguagacucuuua

SEQ ID NO: 365120 - RNA, 22 nt, Homo sapiens
acaccauugcauuccagccugg

SEQ ID NO: 365121 - RNA, 22 nt, Homo sapiens
acacuacuggguauauguguuu

SEQ ID NO: 365122 - RNA, 22 nt, Homo sapiens
acacucuaguguucuuaaucag

SEQ ID NO: 365123 - RNA, 22 nt, Homo sapiens
acacuggaggagagcuguugcu

SEQ ID NO: 365124 - RNA, 22 nt, Homo sapiens
acacuguacuuauguuuugcag

SEQ ID NO: 365125 - RNA, 22 nt, Homo sapiens
acacugucaugucucacaggca

SEQ ID NO: 365126 - RNA, 22 nt, Homo sapiens
acacugucugaugaaaguaguu

SEQ ID NO: 365127 - RNA, 23 nt, Homo sapiens
acacuugcugaguaaaucaaaua

SEQ ID NO: 365128 - RNA, 22 nt, Homo sapiens
acacuuucuagacaagggaaua

SEQ ID NO: 365129 - RNA, 22 nt, Homo sapiens
acacuuucuggagcugcacaua

SEQ ID NO: 365130 - RNA, 20 nt, Homo sapiens
acagcacugguuucaagcaa

SEQ ID NO: 365131 - RNA, 20 nt, Homo sapiens
acagcauagccuuuuaaagc

SEQ ID NO: 365132 - RNA, 22 nt, Homo sapiens
acaggagugggauuugaguccu

SEQ ID NO: 365133 - RNA, 22 nt, Homo sapiens
acaguagcgcaaucucggcuca

SEQ ID NO: 365134 - RNA, 22 nt, Homo sapiens
acaguagugggcuacagaauca

SEQ ID NO: 365135 - RNA, 23 nt, Homo sapiens
acagucuaguuugaagucaggua

SEQ ID NO: 365136 - RNA, 22 nt, Homo sapiens
acagucuggagaaugggugcuc

SEQ ID NO: 365137 - RNA, 22 nt, Homo sapiens
acagugcuguggucaugggucu

SEQ ID NO: 365138 - RNA, 22 nt, Homo sapiens
acaguggaauguaggguuugag

SEQ ID NO: 365139 - RNA, 18 nt, Homo sapiens
acagugucauggcucaau

SEQ ID NO: 365140 - RNA, 19 nt, Homo sapiens
acagugucucuauaaugau

SEQ ID NO: 365141 - RNA, 18 nt, Homo sapiens
acaguguguaaggguucu

SEQ ID NO: 365142 - RNA, 22 nt, Homo sapiens
acaguguuccuuuguugugacu

SEQ ID NO: 365143 - RNA, 22 nt, Homo sapiens
acaugcauggcaugcauuguac

SEQ ID NO: 365144 - RNA, 22 nt, Homo sapiens
acauggcacugcgggcuucuug

SEQ ID NO: 365145 - RNA, 22 nt, Homo sapiens
acaugguacugauuuacgaaau

SEQ ID NO: 365146 - RNA, 22 nt, Homo sapiens
acauguaauugauuuuguguua

SEQ ID NO: 365147 - RNA, 22 nt, Homo sapiens
acauugcagauguguuuaaugu

SEQ ID NO: 365148 - RNA, 22 nt, Homo sapiens
acauugcauauggcacccucuu

SEQ ID NO: 365149 - RNA, 22 nt, Homo sapiens
acauugcucuuaccaaguuugu

SEQ ID NO: 365150 - RNA, 22 nt, Homo sapiens
accauugcacuccagcccaggc

SEQ ID NO: 365151 - RNA, 22 nt, Homo sapiens
acccagaguuccuugucuuuca

SEQ ID NO: 365152 - RNA, 22 nt, Homo sapiens
acccaguagucauucaggagca

SEQ ID NO: 365153 - RNA, 22 nt, Homo sapiens
acccaguguucaacauucacau

SEQ ID NO: 365154 - RNA, 22 nt, Homo sapiens
acccaguguucagacuaccugu

SEQ ID NO: 365155 - RNA, 22 nt, Homo sapiens
acccaguguugggcagaacugu

SEQ ID NO: 365156 - RNA, 22 nt, Homo sapiens
acccgugcugaauauguaggug

SEQ ID NO: 365157 - RNA, 22 nt, Homo sapiens
acccuacauaguagauccuaca

SEQ ID NO: 365158 - RNA, 22 nt, Homo sapiens
acccugacacgauucuucacuu

SEQ ID NO: 365159 - RNA, 22 nt, Homo sapiens
acccuggaguaguaggaaucug

SEQ ID NO: 365160 - RNA, 22 nt, Homo sapiens
acccuguaacauacaagugguu

SEQ ID NO: 365161 - RNA, 22 nt, Homo sapiens
acccugucacucccaucaauuu

SEQ ID NO: 365162 - RNA, 22 nt, Homo sapiens
accgggcugagcgcaggccccg

SEQ ID NO: 365163 - RNA, 22 nt, Homo sapiens
accugagacuaggcauuuuaua

SEQ ID NO: 365164 - RNA, 22 nt, Homo sapiens
accugagauuacaggugcuggc

SEQ ID NO: 365165 - RNA, 22 nt, Homo sapiens
accuggacacuuugggcuccuc

SEQ ID NO: 365166 - RNA, 22 nt, Homo sapiens
accuguauaacaagugggaaau

SEQ ID NO: 365167 - RNA, 22 nt, Homo sapiens
acgugguaguacaguauuuuaa

SEQ ID NO: 365168 - RNA, 20 nt, Homo sapiens
acuaaaucucauuuuaugca

SEQ ID NO: 365169 - RNA, 22 nt, Homo sapiens
acuagguaguaaucugcagaga

SEQ ID NO: 365170 - RNA, 22 nt, Homo sapiens
acucacagcaaccuccgccucc

SEQ ID NO: 365171 - RNA, 22 nt, Homo sapiens
acucagagaacauucccagucu

SEQ ID NO: 365172 - RNA, 22 nt, Homo sapiens
acuccauuucauuuuagcucuu

SEQ ID NO: 365173 - RNA, 22 nt, Homo sapiens
acuccauuuggacucugggagg

SEQ ID NO: 365174 - RNA, 22 nt, Homo sapiens
acucuguauaaacauugcugua

SEQ ID NO: 365175 - RNA, 22 nt, Homo sapiens
acucuguugucuggccuuccug

SEQ ID NO: 365176 - RNA, 22 nt, Homo sapiens
acugaucaauguuaaggcuuau

SEQ ID NO: 365177 - RNA, 22 nt, Homo sapiens
acugcacuccagcccaggugac

SEQ ID NO: 365178 - RNA, 22 nt, Homo sapiens
acugcacuccagcccgggugac

SEQ ID NO: 365179 - RNA, 22 nt, Homo sapiens
acugcacuccagccugccgaca

SEQ ID NO: 365180 - RNA, 22 nt, Homo sapiens
acugcacuccagccugugagac

SEQ ID NO: 365181 - RNA, 18 nt, Homo sapiens
acugcacuccauccuagg

SEQ ID NO: 365182 - RNA, 22 nt, Homo sapiens
acugcacuccuccuugggugac

SEQ ID NO: 365183 - RNA, 20 nt, Homo sapiens
acugcacuucagccugcugg

SEQ ID NO: 365184 - RNA, 22 nt, Homo sapiens
acugcauuugucugucucaauu

SEQ ID NO: 365185 - RNA, 21 nt, Homo sapiens
acuggaccccuuccauacacc

SEQ ID NO: 365186 - RNA, 22 nt, Homo sapiens
acuggcuuaaggaugggccacu

SEQ ID NO: 365187 - RNA, 20 nt, Homo sapiens
acugggcuaccgaaguaagg

SEQ ID NO: 365188 - RNA, 22 nt, Homo sapiens
acuguacuacagccugggugac

SEQ ID NO: 365189 - RNA, 17 nt, Homo sapiens
acuuuuugaggaggcau

SEQ ID NO: 365190 - RNA, 20 nt, Homo sapiens
acuuuuugaugaggucguuu

SEQ ID NO: 365191 - RNA, 22 nt, Homo sapiens
acuuuuugaugaggucguuugu

SEQ ID NO: 365192 - RNA, 22 nt, Homo sapiens
agaaauguuuauucaaacccgu

SEQ ID NO: 365193 - RNA, 22 nt, Homo sapiens
agaaccaaucccacauggauac

SEQ ID NO: 365194 - RNA, 22 nt, Homo sapiens
agaauguauauucuguaguugu

SEQ ID NO: 365195 - RNA, 22 nt, Homo sapiens
ugaucucauuagcaccuuuagc

SEQ ID NO: 365196 - RNA, 22 nt, Homo sapiens
ugaucuuuuuaauguccauggg

SEQ ID NO: 365197 - RNA, 22 nt, Homo sapiens
ugaugacacugauuucuucaau

SEQ ID NO: 365198 - RNA, 22 nt, Homo sapiens
ugaugacccugcaguucucaag

SEQ ID NO: 365199 - RNA, 21 nt, Homo sapiens
ugaugcaauccgcuaggucgc

SEQ ID NO: 365200 - RNA, 22 nt, Homo sapiens
ugaugcuacuaccugggcugaa

SEQ ID NO: 365201 - RNA, 22 nt, Homo sapiens
ugaugcugaugccugccagaag

SEQ ID NO: 365202 - RNA, 22 nt, Homo sapiens
ugauggcauuuggaguugggac

SEQ ID NO: 365203 - RNA, 22 nt, Homo sapiens
ugauguaggacauuauuauuuc

SEQ ID NO: 365204 - RNA, 22 nt, Homo sapiens
ugauuuguuuagugccaaguuu

SEQ ID NO: 365205 - RNA, 22 nt, Homo sapiens
ugcaaagucgaaacugcaguuu

SEQ ID NO: 365206 - RNA, 22 nt, Homo sapiens
ugcaaaugucaaggguuagugu

SEQ ID NO: 365207 - RNA, 20 nt, Homo sapiens
cugcaaaugcugcugcugau

SEQ ID NO: 365208 - RNA, 22 nt, Homo sapiens
cugcaagaaucguaguauuuga

SEQ ID NO: 365209 - RNA, 22 nt, Homo sapiens
cugcaguaaacuuucccauuca

SEQ ID NO: 365210 - RNA, 22 nt, Homo sapiens
cugcaguaaccacuguaggugu

SEQ ID NO: 365211 - RNA, 22 nt, Homo sapiens
cugcagucaucugaagauuuug

SEQ ID NO: 365212 - RNA, 22 nt, Homo sapiens
cugcauaaucaucucucugcau

SEQ ID NO: 365213 - RNA, 22 nt, Homo sapiens
cugcauuggguuaugcauuuuu

SEQ ID NO: 365214 - RNA, 22 nt, Homo sapiens
cugcccuuucuauaugauguaa

SEQ ID NO: 365215 - RNA, 22 nt, Homo sapiens
cugccuaaagaaaaagacguug

SEQ ID NO: 365216 - RNA, 22 nt, Homo sapiens
cugccugagaaaauggagggca

SEQ ID NO: 365217 - RNA, 22 nt, Homo sapiens
cuggaauuacaggguugagcua

SEQ ID NO: 365218 - RNA, 22 nt, Homo sapiens
cuggacguugaggcugcaguga

SEQ ID NO: 365219 - RNA, 22 nt, Homo sapiens
cuggauggugagauaaagaaaa

SEQ ID NO: 365220 - RNA, 18 nt, Homo sapiens
cuggaugucgaguguguu

SEQ ID NO: 365221 - RNA, 19 nt, Homo sapiens
cuggcaaaugcuuuggcca

SEQ ID NO: 365222 - RNA, 22 nt, Homo sapiens
cuggcaagaggauaaaguccua

SEQ ID NO: 365223 - RNA, 22 nt, Homo sapiens
cuggcagucugccucuucacug

SEQ ID NO: 365224 - RNA, 22 nt, Homo sapiens
cuggcaucuaaauacuugaugu

SEQ ID NO: 365225 - RNA, 22 nt, Homo sapiens
cuggcugagugguaaguagagg

SEQ ID NO: 365226 - RNA, 22 nt, Homo sapiens
cugguuguuacaaagagccugg

SEQ ID NO: 365227 - RNA, 22 nt, Homo sapiens
cugguuguucuggaugggcagg

SEQ ID NO: 365228 - RNA, 22 nt, Homo sapiens
cuguagcuuuuauaugcuuagc

SEQ ID NO: 365229 - RNA, 22 nt, Homo sapiens
cugucacugggaggggcagcag

SEQ ID NO: 365230 - RNA, 22 nt, Homo sapiens
cugucaucauuucuaugugcca

SEQ ID NO: 365231 - RNA, 22 nt, Homo sapiens
cugucuggaguccuucgugugc

SEQ ID NO: 365232 - RNA, 22 nt, Homo sapiens
cugugaacaugggagaaauggc

SEQ ID NO: 365233 - RNA, 22 nt, Homo sapiens
cugugcauguaugcgugaguuc

SEQ ID NO: 365234 - RNA, 22 nt, Homo sapiens
cugugcuugagagaugacacag

SEQ ID NO: 365235 - RNA, 19 nt, Homo sapiens
cuguggucauuauuuugcu

SEQ ID NO: 365236 - RNA, 22 nt, Homo sapiens
cuguuagguuaaggaauggcaa

SEQ ID NO: 365237 - RNA, 20 nt, Homo sapiens
cuuaaugcagcauuucucag

SEQ ID NO: 365238 - RNA, 22 nt, Homo sapiens
cuuacagucuaucagccacaac

SEQ ID NO: 365239 - RNA, 18 nt, Homo sapiens
cuuagguagcucauucca

SEQ ID NO: 365240 - RNA, 19 nt, Homo sapiens
cuuaggugaccaguuccca

SEQ ID NO: 365241 - RNA, 20 nt, Homo sapiens
cuucacagaaguggaaucau

SEQ ID NO: 365242 - RNA, 22 nt, Homo sapiens
cuucaucugguuugugaacuuu

SEQ ID NO: 365243 - RNA, 22 nt, Homo sapiens
cuucucagugcucaucuuauuu

SEQ ID NO: 365244 - RNA, 22 nt, Homo sapiens
cuugaacaaagagauuccauua

SEQ ID NO: 365245 - RNA, 22 nt, Homo sapiens
cuugagcauauucuauauuaaa

SEQ ID NO: 365246 - RNA, 22 nt, Homo sapiens
cuugcagaggcccuggggagag

SEQ ID NO: 365247 - RNA, 19 nt, Homo sapiens
cuugccccauucauccucu

SEQ ID NO: 365248 - RNA, 22 nt, Homo sapiens
cuuggcacgugauagguguuga

SEQ ID NO: 365249 - RNA, 22 nt, Homo sapiens
cuuggcuucuuuauguggcuau

SEQ ID NO: 365250 - RNA, 22 nt, Homo sapiens
cuuguaccccugagucccauaa

SEQ ID NO: 365251 - RNA, 22 nt, Homo sapiens
cuugucuugcacacgguugcca

SEQ ID NO: 365252 - RNA, 21 nt, Homo sapiens
cuuuaugcuguguuagaaaag

SEQ ID NO: 365253 - RNA, 22 nt, Homo sapiens
cuuugcacaucucugcuuuccc

SEQ ID NO: 365254 - RNA, 21 nt, Homo sapiens
cuuugcacugcuccucagcuc

SEQ ID NO: 365255 - RNA, 22 nt, Homo sapiens
cuuuggauggaaccucucuuuc

SEQ ID NO: 365256 - RNA, 22 nt, Homo sapiens
cuuugguggagucuuuagguuc

SEQ ID NO: 365257 - RNA, 22 nt, Homo sapiens
cuuugguuaauaggauauggca

SEQ ID NO: 365258 - RNA, 23 nt, Homo sapiens
cuuuguacagcuugacuacuggg

SEQ ID NO: 365259 - RNA, 22 nt, Homo sapiens
cuuuguguaggugccucuggcu

SEQ ID NO: 365260 - RNA, 22 nt, Homo sapiens
cuuuguguggacauuucaggca

SEQ ID NO: 365261 - RNA, 22 nt, Homo sapiens
cuuuuacacugcuggugggaau

SEQ ID NO: 365262 - RNA, 20 nt, Homo sapiens
cuuuuagcagcagcaagaga

SEQ ID NO: 365263 - RNA, 22 nt, Homo sapiens
gaaagacuuucugcuguggaua

SEQ ID NO: 365264 - RNA, 22 nt, Homo sapiens
gaaagguaggaacagggugcag

SEQ ID NO: 365265 - RNA, 22 nt, Homo sapiens
gaaaugcucauuuuggauccuu

SEQ ID NO: 365266 - RNA, 22 nt, Homo sapiens
gaaaugucugagauguggcuca

SEQ ID NO: 365267 - RNA, 22 nt, Homo sapiens
gaacacaucuuugguuagagga

SEQ ID NO: 365268 - RNA, 22 nt, Homo sapiens
gaacuguuucuggugaaagagu

SEQ ID NO: 365269 - RNA, 22 nt, Homo sapiens
gaagaacuaggugagaucuaga

SEQ ID NO: 365270 - RNA, 22 nt, Homo sapiens
gaagauaucuaguaccauuguc

SEQ ID NO: 365271 - RNA, 22 nt, Homo sapiens
gaagauguugcuuaccuuggag

SEQ ID NO: 365272 - RNA, 22 nt, Homo sapiens
gaagcgaggugauuagcagaca

SEQ ID NO: 365273 - RNA, 22 nt, Homo sapiens
gaaggugcuuggugaaugcauu

SEQ ID NO: 365274 - RNA, 22 nt, Homo sapiens
gaaguaguaaaauuuauugcag

SEQ ID NO: 365275 - RNA, 22 nt, Homo sapiens
gaagugcuuuuggacuaacagu

SEQ ID NO: 365276 - RNA, 22 nt, Homo sapiens
gaauaaacuagagaggacugag

SEQ ID NO: 365277 - RNA, 22 nt, Homo sapiens
gaauacugacuauuucaucugg

SEQ ID NO: 365278 - RNA, 22 nt, Homo sapiens
gaauagugcugcaagaaacaua

SEQ ID NO: 365279 - RNA, 22 nt, Homo sapiens
gaauagugcugcaaugaacaua

SEQ ID NO: 365280 - RNA, 22 nt, Homo sapiens
uggacaugaagggcacaggagg

SEQ ID NO: 365281 - RNA, 21 nt, Homo sapiens
uggaccccuacuucucaccau

SEQ ID NO: 365282 - RNA, 22 nt, Homo sapiens
uggaccccugcucgggagcccu

SEQ ID NO: 365283 - RNA, 22 nt, Homo sapiens
uggacuguaauagagaacagaa

SEQ ID NO: 365284 - RNA, 22 nt, Homo sapiens
uggagacaaagauagaaaagca

SEQ ID NO: 365285 - RNA, 22 nt, Homo sapiens
uggagagugagggccuccuuaa

SEQ ID NO: 365286 - RNA, 22 nt, Homo sapiens
uggagcccuaaacuucuaauau

SEQ ID NO: 365287 - RNA, 22 nt, Homo sapiens
uggagguaggacgaagaacucu

SEQ ID NO: 365288 - RNA, 22 nt, Homo sapiens
uggagguagggccuaggaaucu

SEQ ID NO: 365289 - RNA, 20 nt, Homo sapiens
uggaggucaucugucacuac

SEQ ID NO: 365290 - RNA, 20 nt, Homo sapiens
uggagugcuguguugagaag

SEQ ID NO: 365291 - RNA, 22 nt, Homo sapiens
uggaguguguugcagaugaagg

SEQ ID NO: 365292 - RNA, 22 nt, Homo sapiens
uggauagaacuaagugcuuaga

SEQ ID NO: 365293 - RNA, 22 nt, Homo sapiens
uggaucaugcgaggccuccccu

SEQ ID NO: 365294 - RNA, 22 nt, Homo sapiens
uggaugacauccuuguaugcag

SEQ ID NO: 365295 - RNA, 22 nt, Homo sapiens
auggcacuaaugggaguuuacu

SEQ ID NO: 365296 - RNA, 22 nt, Homo sapiens
auggcagcugacacuuccgucu

SEQ ID NO: 365297 - RNA, 22 nt, Homo sapiens
auggcaguuuauucuaaaucaa

SEQ ID NO: 365298 - RNA, 22 nt, Homo sapiens
auggcaguuucacucugggauu

SEQ ID NO: 365299 - RNA, 22 nt, Homo sapiens
auggcaguuucagcuauaguuu

SEQ ID NO: 365300 - RNA, 22 nt, Homo sapiens
aaaguucuugcugaaggauuau

SEQ ID NO: 365301 - RNA, 21 nt, Homo sapiens
aaaugcacauuacugcuggug

SEQ ID NO: 365302 - RNA, 22 nt, Homo sapiens
aaaugcaucauuaggugauuuu

SEQ ID NO: 365303 - RNA, 22 nt, Homo sapiens
aaaugccucccauucuacugac

SEQ ID NO: 365304 - RNA, 23 nt, Homo sapiens
aaaugcucucaggugccaguaga

SEQ ID NO: 365305 - RNA, 22 nt, Homo sapiens
aaaugcucuuuaugaaguugga

SEQ ID NO: 365306 - RNA, 20 nt, Homo sapiens
aaaugcuguaauguuuggga

SEQ ID NO: 365307 - RNA, 22 nt, Homo sapiens
aaauggcuuugaggguaggaca

SEQ ID NO: 365308 - RNA, 21 nt, Homo sapiens
aaaugugcuuuaguacccuca

SEQ ID NO: 365309 - RNA, 22 nt, Homo sapiens
aaauugcaaugcgaggcagagg

SEQ ID NO: 365310 - RNA, 22 nt, Homo sapiens
aaauugcaguuaggaugauggu

SEQ ID NO: 365311 - RNA, 22 nt, Homo sapiens
aaauugcauugagcugcuuauu

SEQ ID NO: 365312 - RNA, 22 nt, Homo sapiens
aaauugcuuuugaagacuuagu

SEQ ID NO: 365313 - RNA, 22 nt, Homo sapiens
aacaccauucucuguaacaaga

SEQ ID NO: 365314 - RNA, 22 nt, Homo sapiens
aacaccauuuuucugcagccuu

SEQ ID NO: 365315 - RNA, 22 nt, Homo sapiens
aacacggcccgcagagcaagcu

SEQ ID NO: 365316 - RNA, 22 nt, Homo sapiens
aacacuggcugcucgaguucuc

SEQ ID NO: 365317 - RNA, 22 nt, Homo sapiens
aacagaauccucuuuuccuggg

SEQ ID NO: 365318 - RNA, 22 nt, Homo sapiens
aacagagcuggugacuccaggu

SEQ ID NO: 365319 - RNA, 22 nt, Homo sapiens
aacagugcauucagggauauau

SEQ ID NO: 365320 - RNA, 22 nt, Homo sapiens
aacagugccugucauuuaguag

SEQ ID NO: 365321 - RNA, 20 nt, Homo sapiens
aacaguguguaaguuuccuu

SEQ ID NO: 365322 - RNA, 22 nt, Homo sapiens
aacugccucugacauaggcagg

SEQ ID NO: 365323 - RNA, 22 nt, Homo sapiens
aacugcuguuuggguacuggug

SEQ ID NO: 365324 - RNA, 22 nt, Homo sapiens
aagaccuaugcaggaagaaaug

SEQ ID NO: 365325 - RNA, 22 nt, Homo sapiens
aagagcauuauuuaguaauuuc

SEQ ID NO: 365326 - RNA, 22 nt, Homo sapiens
aagagcucucuguagcauguga

SEQ ID NO: 365327 - RNA, 22 nt, Homo sapiens
aagaggccuaggaaucuguauu

SEQ ID NO: 365328 - RNA, 23 nt, Homo sapiens
aagagguaugacuaugaagugga

SEQ ID NO: 365329 - RNA, 22 nt, Homo sapiens
aagagugucuuugugcuggccc

SEQ ID NO: 365330 - RNA, 22 nt, Homo sapiens
aagauagcuaagcuucuucuaa

SEQ ID NO: 365331 - RNA, 19 nt, Homo sapiens
aagaugauguuugggcuaa

SEQ ID NO: 365332 - RNA, 22 nt, Homo sapiens
aagaugguauuucauuaguuuu

SEQ ID NO: 365333 - RNA, 22 nt, Homo sapiens
aagcacaauuucaccuucuugu

SEQ ID NO: 365334 - RNA, 21 nt, Homo sapiens
aagcacauugaguguguguga

SEQ ID NO: 365335 - RNA, 22 nt, Homo sapiens
aagcaccaauaggagauuuguc

SEQ ID NO: 365336 - RNA, 22 nt, Homo sapiens
aagcaggugugggaggaaaugg

SEQ ID NO: 365337 - RNA, 22 nt, Homo sapiens
aagcaugguuuccaggggucac

SEQ ID NO: 365338 - RNA, 22 nt, Homo sapiens
aagcuccauuucugccaugaga

SEQ ID NO: 365339 - RNA, 22 nt, Homo sapiens
aagcuggauuucgcauccuguu

SEQ ID NO: 365340 - RNA, 22 nt, Homo sapiens
aagcuggcauucaugagauuac

SEQ ID NO: 365341 - RNA, 22 nt, Homo sapiens
aagcuggcauucauucguucuu

SEQ ID NO: 365342 - RNA, 22 nt, Homo sapiens
aagcuggcuuucauugagugcu

SEQ ID NO: 365343 - RNA, 22 nt, Homo sapiens
aagcuguugguggaucuaccau

SEQ ID NO: 365344 - RNA, 23 nt, Homo sapiens
aaggacacugaacacuucccagc

SEQ ID NO: 365345 - RNA, 22 nt, Homo sapiens
aaggagcuuaagugacuuguac

SEQ ID NO: 365346 - RNA, 22 nt, Homo sapiens
aaggaguagacaacauggcgcc

SEQ ID NO: 365347 - RNA, 22 nt, Homo sapiens
aaggcaagagaaaauuucgagu

SEQ ID NO: 365348 - RNA, 22 nt, Homo sapiens
aaggcaguggcagaagauguca

SEQ ID NO: 365349 - RNA, 22 nt, Homo sapiens
aaggcaugcaguacguuucuau

SEQ ID NO: 365350 - RNA, 22 nt, Homo sapiens
aaggcaugcugaguccuaaaag

SEQ ID NO: 365351 - RNA, 20 nt, Homo sapiens
aaggcuuucgaguuccaggg

SEQ ID NO: 365352 - RNA, 22 nt, Homo sapiens
aagggaaugugguagcugguuu

SEQ ID NO: 365353 - RNA, 22 nt, Homo sapiens
aagggaauguuguggcugguuu

SEQ ID NO: 365354 - RNA, 22 nt, Homo sapiens
aagguacuggaaagaggaaugg

SEQ ID NO: 365355 - RNA, 22 nt, Homo sapiens
aagguauuucuaugggaauaga

SEQ ID NO: 365356 - RNA, 22 nt, Homo sapiens
aaggugcuguaagcauccaugu

SEQ ID NO: 365357 - RNA, 21 nt, Homo sapiens
aaggugguggugauugagaug

SEQ ID NO: 365358 - RNA, 22 nt, Homo sapiens
aagguucuugcuugcaugacug

SEQ ID NO: 365359 - RNA, 22 nt, Homo sapiens
aaguaaauauccgguaguccca

SEQ ID NO: 365360 - RNA, 22 nt, Homo sapiens
aaguaaaucuuaugucagggag

SEQ ID NO: 365361 - RNA, 22 nt, Homo sapiens
aaguaauggaguuauuuuauga

SEQ ID NO: 365362 - RNA, 19 nt, Homo sapiens
aaguaguugugacagaugc

SEQ ID NO: 365363 - RNA, 22 nt, Homo sapiens
aaguccccugacagaggggagg

SEQ ID NO: 365364 - RNA, 19 nt, Homo sapiens
aagugaaugcuuuguucac

SEQ ID NO: 365365 - RNA, 22 nt, Homo sapiens
aagugauguuauugggugacuc

SEQ ID NO: 365366 - RNA, 22 nt, Homo sapiens
aagugcauguauuaguguaguc

SEQ ID NO: 365367 - RNA, 22 nt, Homo sapiens
aagugcucuugaaacugccuua

SEQ ID NO: 365368 - RNA, 22 nt, Homo sapiens
aagugcuuaggauagugugugg

SEQ ID NO: 365369 - RNA, 22 nt, Homo sapiens
aagugcuucagaagacaauauu

SEQ ID NO: 365370 - RNA, 19 nt, Homo sapiens
aagugguuuaaacuuguau

SEQ ID NO: 365371 - RNA, 22 nt, Homo sapiens
aaguugguguaugagacagaag

SEQ ID NO: 365372 - RNA, 22 nt, Homo sapiens
aauagcuguccuuagaagugug

SEQ ID NO: 365373 - RNA, 22 nt, Homo sapiens
aauagugcugcaaaaacauacg

SEQ ID NO: 365374 - RNA, 22 nt, Homo sapiens
aauauagcuauguacaugucca

SEQ ID NO: 365375 - RNA, 22 nt, Homo sapiens
aauaucacaguuggguguacac

SEQ ID NO: 365376 - RNA, 22 nt, Homo sapiens
guggagacaaaggcugagugag

SEQ ID NO: 365377 - RNA, 22 nt, Homo sapiens
guggagcuguguggccuugggc

SEQ ID NO: 365378 - RNA, 22 nt, Homo sapiens
guggcaaggaaaugcugcucac

SEQ ID NO: 365379 - RNA, 22 nt, Homo sapiens
guggcaaguguuccaagaggcg

SEQ ID NO: 365380 - RNA, 22 nt, Homo sapiens
guggcaugaaagcaucugugau

SEQ ID NO: 365381 - RNA, 22 nt, Homo sapiens
guggcuagaaugaagguagcug

SEQ ID NO: 365382 - RNA, 22 nt, Homo sapiens
guggcuauucaccuuuaugaaa

SEQ ID NO: 365383 - RNA, 20 nt, Homo sapiens
gugggcaaauccuuuccucu

SEQ ID NO: 365384 - RNA, 22 nt, Homo sapiens
gugguacccucaggcccuuuuc

SEQ ID NO: 365385 - RNA, 19 nt, Homo sapiens
gugguauuaccuuuugauu

SEQ ID NO: 365386 - RNA, 22 nt, Homo sapiens
acugcacuccagccuaggcgac

SEQ ID NO: 365387 - RNA, 22 nt, Homo sapiens
acugcacuccagccucaugaca

SEQ ID NO: 365388 - RNA, 22 nt, Homo sapiens
acugcacuccagccucgcaaca

SEQ ID NO: 365389 - RNA, 22 nt, Homo sapiens
acugcacuccagccucggcaau

SEQ ID NO: 365390 - RNA, 22 nt, Homo sapiens
acugcacuccagccuggacgac

SEQ ID NO: 365391 - RNA, 22 nt, Homo sapiens
acugcacuccagccugugcgua

SEQ ID NO: 365392 - RNA, 22 nt, Homo sapiens
acugcacuccagccuucaggac

SEQ ID NO: 365393 - RNA, 22 nt, Homo sapiens
acugcacuccagcuugggugac

SEQ ID NO: 365394 - RNA, 22 nt, Homo sapiens
guggucagaaaucucaguggca

SEQ ID NO: 365395 - RNA, 21 nt, Homo sapiens
gugguucuagagaaacagaau

SEQ ID NO: 365396 - RNA, 22 nt, Homo sapiens
gugguuguuggaguggcaauuu

SEQ ID NO: 365397 - RNA, 22 nt, Homo sapiens
gugguuuuaauauucagucuag

SEQ ID NO: 365398 - RNA, 22 nt, Homo sapiens
gugguuuuaucccagaaauuaa

SEQ ID NO: 365399 - RNA, 22 nt, Homo sapiens
gugguuuuuuucugccuuauag

SEQ ID NO: 365400 - RNA, 22 nt, Homo sapiens
guguaaaacaauuagaggauuu

SEQ ID NO: 365401 - RNA, 22 nt, Homo sapiens
gugucaaggaugccugucaggc

SEQ ID NO: 365402 - RNA, 22 nt, Homo sapiens
gugucacagcuuccaucucggu

SEQ ID NO: 365403 - RNA, 22 nt, Homo sapiens
gugucuccuguggagcuaugua

SEQ ID NO: 365404 - RNA, 22 nt, Homo sapiens
gugugacagcuauagacaugau

SEQ ID NO: 365405 - RNA, 22 nt, Homo sapiens
gugugauggcgcacacagggug

SEQ ID NO: 365406 - RNA, 22 nt, Homo sapiens
gugugcaauuuugugggaggca

SEQ ID NO: 365407 - RNA, 22 nt, Homo sapiens
gugugguaggauugguuacuca

SEQ ID NO: 365408 - RNA, 22 nt, Homo sapiens
guguuaaucucaaguacucuca

SEQ ID NO: 365409 - RNA, 22 nt, Homo sapiens
guguuauugagaaauagggugu

SEQ ID NO: 365410 - RNA, 22 nt, Homo sapiens
guguucauggaauuugcaauug

SEQ ID NO: 365411 - RNA, 22 nt, Homo sapiens
guuacugucuuccugauugcuu

SEQ ID NO: 365412 - RNA, 22 nt, Homo sapiens
guuauguaucuugauugggugg

SEQ ID NO: 365413 - RNA, 22 nt, Homo sapiens
guuauguuaguuacaaggcuag

SEQ ID NO: 365414 - RNA, 22 nt, Homo sapiens
guuauguuauguuauguuaugu

SEQ ID NO: 365415 - RNA, 22 nt, Homo sapiens
guuauugcucucgaagacucuc

SEQ ID NO: 365416 - RNA, 22 nt, Homo sapiens
guucaucagggauacuggcuua

SEQ ID NO: 365417 - RNA, 20 nt, Homo sapiens
guucauguaauuaguucagg

SEQ ID NO: 365418 - RNA, 22 nt, Homo sapiens
guucccaguugaaaugauuagu

SEQ ID NO: 365419 - RNA, 20 nt, Homo sapiens
guucuugcucguguaucuuc

SEQ ID NO: 365420 - RNA, 22 nt, Homo sapiens
guugaaauccuaacccccuagu

SEQ ID NO: 365421 - RNA, 22 nt, Homo sapiens
guugccuaggcuggagugcagu

SEQ ID NO: 365422 - RNA, 22 nt, Homo sapiens
guugcucaggcuggagugcagu

SEQ ID NO: 365423 - RNA, 22 nt, Homo sapiens
guuguauaggcauggggagaau

SEQ ID NO: 365424 - RNA, 22 nt, Homo sapiens
guuuaggaaugagaauauuuag

SEQ ID NO: 365425 - RNA, 17 nt, Homo sapiens
guuuggguacuggguaa

SEQ ID NO: 365426 - RNA, 22 nt, Homo sapiens
uaaacugucuuuggagcuuugc

SEQ ID NO: 365427 - RNA, 22 nt, Homo sapiens
uaaagaugcugggaaggcuagg

SEQ ID NO: 365428 - RNA, 22 nt, Homo sapiens
uaaagcacaaguaaagaauacu

SEQ ID NO: 365429 - RNA, 22 nt, Homo sapiens
uaaagccauugucaaguuugua

SEQ ID NO: 365430 - RNA, 22 nt, Homo sapiens
uaaagccuagaacuuucagccc

SEQ ID NO: 365431 - RNA, 22 nt, Homo sapiens
uaaagcuaugagaacaccguag

SEQ ID NO: 365432 - RNA, 22 nt, Homo sapiens
uaaagcuauuauaguuauguuu

SEQ ID NO: 365433 - RNA, 18 nt, Homo sapiens
uaaaggcacuguguuguu

SEQ ID NO: 365434 - RNA, 22 nt, Homo sapiens
uaaaugacugucaguagaugaa

SEQ ID NO: 365435 - RNA, 22 nt, Homo sapiens
uaaaugcucuuuaaaagugcuu

SEQ ID NO: 365436 - RNA, 21 nt, Homo sapiens
uaaaugucauacaaagcaaug

SEQ ID NO: 365437 - RNA, 22 nt, Homo sapiens
uaacaguguauuuacuacuucc

SEQ ID NO: 365438 - RNA, 22 nt, Homo sapiens
uaacccagugucugugaugggu

SEQ ID NO: 365439 - RNA, 22 nt, Homo sapiens
uaacuaaagagaagucaauguc

SEQ ID NO: 365440 - RNA, 22 nt, Homo sapiens
uaacugcaaccuccgccucccg

SEQ ID NO: 365441 - RNA, 22 nt, Homo sapiens
uaagaauucuguccgguauacu

SEQ ID NO: 365442 - RNA, 22 nt, Homo sapiens
uaagacacuuaaaauguuacau

SEQ ID NO: 365443 - RNA, 22 nt, Homo sapiens
uaagacuuuuugggaauauaga

SEQ ID NO: 365444 - RNA, 22 nt, Homo sapiens
uaagagcuaggauuuuaaauca

SEQ ID NO: 365445 - RNA, 22 nt, Homo sapiens
uaagcaguaaaugaagucuugc

SEQ ID NO: 365446 - RNA, 22 nt, Homo sapiens
uaaggaaggcugugugcuuuua

SEQ ID NO: 365447 - RNA, 22 nt, Homo sapiens
uaaggaguagaauaguaaggca

SEQ ID NO: 365448 - RNA, 22 nt, Homo sapiens
uaaggcaaaccuuggcugcagu

SEQ ID NO: 365449 - RNA, 22 nt, Homo sapiens
uaaggcaaucagucaugguguu

SEQ ID NO: 365450 - RNA, 22 nt, Homo sapiens
uaaggcuuuuguucagcguggg

SEQ ID NO: 365451 - RNA, 22 nt, Homo sapiens
uaaguaaaugaaagguugauuu

SEQ ID NO: 365452 - RNA, 22 nt, Homo sapiens
uaaguaauugcagcaauuugcc

SEQ ID NO: 365453 - RNA, 22 nt, Homo sapiens
uaaguacaugcuagauggaaug

SEQ ID NO: 365454 - RNA, 22 nt, Homo sapiens
uaaguaguccugauuuaaccuu

SEQ ID NO: 365455 - RNA, 22 nt, Homo sapiens
uaaguagugugcauguauguau

SEQ ID NO: 365456 - RNA, 22 nt, Homo sapiens
uaaguaguuucuggauauucuc

SEQ ID NO: 365457 - RNA, 22 nt, Homo sapiens
uaaguaucaguuuagcuaugau

SEQ ID NO: 365458 - RNA, 22 nt, Homo sapiens
uaagugaauguuggcuacugaa

SEQ ID NO: 365459 - RNA, 22 nt, Homo sapiens
uaagugaauuucacuacugagu

SEQ ID NO: 365460 - RNA, 22 nt, Homo sapiens
uaagugaauuugacagguaaug

SEQ ID NO: 365461 - RNA, 22 nt, Homo sapiens
uaagugcaugauuacaugcaua

SEQ ID NO: 365462 - RNA, 20 nt, Homo sapiens
uaaguuguauuugucaugaa

SEQ ID NO: 365463 - RNA, 22 nt, Homo sapiens
uaauagcaguguuacuaggacu

SEQ ID NO: 365464 - RNA, 22 nt, Homo sapiens
uaauaguuucagaaguuguuuu

SEQ ID NO: 365465 - RNA, 22 nt, Homo sapiens
uaaucacagagguuuggccuca

SEQ ID NO: 365466 - RNA, 22 nt, Homo sapiens
uaaugcacauuuauuuuaccuu

SEQ ID NO: 365467 - RNA, 22 nt, Homo sapiens
uaaugcaucagugguaguucuu

SEQ ID NO: 365468 - RNA, 22 nt, Homo sapiens
uaaugugaauagugcuguaaug

SEQ ID NO: 365469 - RNA, 22 nt, Homo sapiens
uaauucuguauguaucagaguu

SEQ ID NO: 365470 - RNA, 22 nt, Homo sapiens
uaauugaaugcagacaccaggg

SEQ ID NO: 365471 - RNA, 22 nt, Homo sapiens
uacaaaucuagguuuguuacug

SEQ ID NO: 365472 - RNA, 22 nt, Homo sapiens
uacaaguauuuuuauuagugcc

SEQ ID NO: 365473 - RNA, 22 nt, Homo sapiens
uacaauagugacaaaucagcau

SEQ ID NO: 365474 - RNA, 22 nt, Homo sapiens
gaaucaauugaucuaugugucu

SEQ ID NO: 365475 - RNA, 22 nt, Homo sapiens
gaaucacaguuauuagagcagc

SEQ ID NO: 365476 - RNA, 22 nt, Homo sapiens
gaaugcagcagugacagggcug

SEQ ID NO: 365477 - RNA, 20 nt, Homo sapiens
gacaaaccuagaugguacag

SEQ ID NO: 365478 - RNA, 22 nt, Homo sapiens
gacaccugguguggaacuggag

SEQ ID NO: 365479 - RNA, 18 nt, Homo sapiens
gacaguguggugauuccu

SEQ ID NO: 365480 - RNA, 22 nt, Homo sapiens
gacaguuuggugaggaagacga

SEQ ID NO: 365481 - RNA, 21 nt, Homo sapiens
gaccacagcagggaaugucag

SEQ ID NO: 365482 - RNA, 21 nt, Homo sapiens
gaccuguaguaagcauucaca

SEQ ID NO: 365483 - RNA, 22 nt, Homo sapiens
gacuagggaccaugagcaaucc

SEQ ID NO: 365484 - RNA, 18 nt, Homo sapiens
gacuuggaguuuacagug

SEQ ID NO: 365485 - RNA, 22 nt, Homo sapiens
gagaacugacauuaucguguau

SEQ ID NO: 365486 - RNA, 21 nt, Homo sapiens
gagaaucuuuucagggcaaac

SEQ ID NO: 365487 - RNA, 22 nt, Homo sapiens
gagacugagucucgcucugccg

SEQ ID NO: 365488 - RNA, 21 nt, Homo sapiens
gagaggauucgccagccucuu

SEQ ID NO: 365489 - RNA, 22 nt, Homo sapiens
gagagugcuuuggguguaggcc

SEQ ID NO: 365490 - RNA, 22 nt, Homo sapiens
gagagugugucagaggcugcga

SEQ ID NO: 365491 - RNA, 22 nt, Homo sapiens
cacagugaaugucaucauugcc

SEQ ID NO: 365492 - RNA, 22 nt, Homo sapiens
cacauugcaggaaaguucauua

SEQ ID NO: 365493 - RNA, 22 nt, Homo sapiens
caccacauuccauugaucaggc

SEQ ID NO: 365494 - RNA, 22 nt, Homo sapiens
caccagcuggcauugaauaccu

SEQ ID NO: 365495 - RNA, 22 nt, Homo sapiens
caccagguggcugaggccauga

SEQ ID NO: 365496 - RNA, 19 nt, Homo sapiens
caccagugcaugcuacuau

SEQ ID NO: 365497 - RNA, 22 nt, Homo sapiens
caccaguuuuucagugauucaa

SEQ ID NO: 365498 - RNA, 19 nt, Homo sapiens
caccgccugcccccugcug

SEQ ID NO: 365499 - RNA, 22 nt, Homo sapiens
uaugaauuuuauccaggauaua

SEQ ID NO: 365500 - RNA, 23 nt, Homo sapiens
uaugacagaggaagggggagcug

SEQ ID NO: 365501 - RNA, 22 nt, Homo sapiens
uaugauuuuugggagaggucaa

SEQ ID NO: 365502 - RNA, 22 nt, Homo sapiens
uaugcacacguguccaugugca

SEQ ID NO: 365503 - RNA, 22 nt, Homo sapiens
uaugcacaugugccugggugug

SEQ ID NO: 365504 - RNA, 22 nt, Homo sapiens
uaugcccauuuaaauugaacaa

SEQ ID NO: 365505 - RNA, 22 nt, Homo sapiens
uauggaaaucuuaccuuauggu

SEQ ID NO: 365506 - RNA, 22 nt, Homo sapiens
uauggauuuuggaauauguggg

SEQ ID NO: 365507 - RNA, 22 nt, Homo sapiens
uauggcuuuguuaacauuuucu

SEQ ID NO: 365508 - RNA, 22 nt, Homo sapiens
uauggcuuuuauuauguuguag

SEQ ID NO: 365509 - RNA, 22 nt, Homo sapiens
uaugguuuuaagguuaaggacu

SEQ ID NO: 365510 - RNA, 22 nt, Homo sapiens
uaugucacuggacauaaguucu

SEQ ID NO: 365511 - RNA, 22 nt, Homo sapiens
uaugugcaaauuaauugcuaga

SEQ ID NO: 365512 - RNA, 22 nt, Homo sapiens
uauuacuugucugugucucaau

SEQ ID NO: 365513 - RNA, 22 nt, Homo sapiens
uauugaauuuuuaagcccuuug

SEQ ID NO: 365514 - RNA, 22 nt, Homo sapiens
uauugauuaauugugauuaggc

SEQ ID NO: 365515 - RNA, 22 nt, Homo sapiens
ucauggcuuuuauuauguugag

SEQ ID NO: 365516 - RNA, 23 nt, Homo sapiens
ucaugguagcaccaacaauaacu

SEQ ID NO: 365517 - RNA, 22 nt, Homo sapiens
ucaugucuuguuguauuuauuu

SEQ ID NO: 365518 - RNA, 22 nt, Homo sapiens
ucaugugagcacagagcaagau

SEQ ID NO: 365519 - RNA, 22 nt, Homo sapiens
ucauugcaaucucugccucccg

SEQ ID NO: 365520 - RNA, 22 nt, Homo sapiens
ucauuggauggaaugcucugua

SEQ ID NO: 365521 - RNA, 18 nt, Homo sapiens
ucauuggugagcaccucc

SEQ ID NO: 365522 - RNA, 22 nt, Homo sapiens
uccaauguaaucaucauugaau

SEQ ID NO: 365523 - RNA, 22 nt, Homo sapiens
uccacaguaaggacccugccuu

SEQ ID NO: 365524 - RNA, 22 nt, Homo sapiens
uccacaguggugaggugcagca

SEQ ID NO: 365525 - RNA, 19 nt, Homo sapiens
uccacagugguugaacuag

SEQ ID NO: 365526 - RNA, 22 nt, Homo sapiens
uccacagugguugaacuaguuu

SEQ ID NO: 365527 - RNA, 22 nt, Homo sapiens
uccaccgugggcugcggggcuc

SEQ ID NO: 365528 - RNA, 22 nt, Homo sapiens
uccagaguggugaugcuggggc

SEQ ID NO: 365529 - RNA, 18 nt, Homo sapiens
uccaguuuucccagcauc

SEQ ID NO: 365530 - RNA, 22 nt, Homo sapiens
uccaguuuucuuuccuagggcu

SEQ ID NO: 365531 - RNA, 19 nt, Homo sapiens
uccaugagcccacagugau

SEQ ID NO: 365532 - RNA, 22 nt, Homo sapiens
uccaugaguccauuagaaaaaa

SEQ ID NO: 365533 - RNA, 20 nt, Homo sapiens
ucccaguaggagaaggaagg

SEQ ID NO: 365534 - RNA, 17 nt, Homo sapiens
ucccauguuucuucuac

SEQ ID NO: 365535 - RNA, 19 nt, Homo sapiens
uccccaguuuuccguucag

SEQ ID NO: 365536 - RNA, 22 nt, Homo sapiens
ucccgaggacaucugggggcaa

SEQ ID NO: 365537 - RNA, 22 nt, Homo sapiens
ucccugaaucucagguucugua

SEQ ID NO: 365538 - RNA, 22 nt, Homo sapiens
ucccugaguaucuaauguguuu

SEQ ID NO: 365539 - RNA, 19 nt, Homo sapiens
ucccugagucuuagcuuga

SEQ ID NO: 365540 - RNA, 22 nt, Homo sapiens
ucccuggacagccuugccuggg

SEQ ID NO: 365541 - RNA, 22 nt, Homo sapiens
uccugagacugaggagcuuugg

SEQ ID NO: 365542 - RNA, 21 nt, Homo sapiens
uccugagagaggaguaacucu

SEQ ID NO: 365543 - RNA, 22 nt, Homo sapiens
uccugauacgguugcaguucuc

SEQ ID NO: 365544 - RNA, 22 nt, Homo sapiens
uccuugaaacaggaagaauuca

SEQ ID NO: 365545 - RNA, 22 nt, Homo sapiens
uccuugagucugaacuuuggau

SEQ ID NO: 365546 - RNA, 23 nt, Homo sapiens
uccuugguuggcgcccuaugugu

SEQ ID NO: 365547 - RNA, 22 nt, Homo sapiens
uccuuugguggagucuuuaggg

SEQ ID NO: 365548 - RNA, 22 nt, Homo sapiens
ucgcagcacgagcaugcaaggu

SEQ ID NO: 365549 - RNA, 20 nt, Homo sapiens
ucguugguagagagcagggc

SEQ ID NO: 365550 - RNA, 15 nt, Homo sapiens
ucuaguuuugaagac

SEQ ID NO: 365551 - RNA, 22 nt, Homo sapiens
ucuaucacagccccacacucuc

SEQ ID NO: 365552 - RNA, 22 nt, Homo sapiens
ucucacagaguugaacuuucuu

SEQ ID NO: 365553 - RNA, 22 nt, Homo sapiens
ucucacagaguugaauguuucu

SEQ ID NO: 365554 - RNA, 22 nt, Homo sapiens
ucucagcacagucagggcgccu

SEQ ID NO: 365555 - RNA, 22 nt, Homo sapiens
ucucagcggacaggccggccag

SEQ ID NO: 365556 - RNA, 22 nt, Homo sapiens
ucucagugaauguggaaaaagc

SEQ ID NO: 365557 - RNA, 21 nt, Homo sapiens
ucucauagaguuucacuuucu

SEQ ID NO: 365558 - RNA, 22 nt, Homo sapiens
ucucauggagguagagaguaaa

SEQ ID NO: 365559 - RNA, 23 nt, Homo sapiens
ucucauuccuugaaaauaaugac

SEQ ID NO: 365560 - RNA, 22 nt, Homo sapiens
ucucauuggucugagucaccug

SEQ ID NO: 365561 - RNA, 22 nt, Homo sapiens
ucuccauuguccagaugaggaa

SEQ ID NO: 365562 - RNA, 22 nt, Homo sapiens
ucuccauuuguaaggguuucuc

SEQ ID NO: 365563 - RNA, 17 nt, Homo sapiens
ucucccaucccuuucuc

SEQ ID NO: 365564 - RNA, 22 nt, Homo sapiens
ucucugguuuguggaaucuuag

SEQ ID NO: 365565 - RNA, 22 nt, Homo sapiens
ucugaaucguucccaugcagga

SEQ ID NO: 365566 - RNA, 22 nt, Homo sapiens
ucugacacuucugcagaauuga

SEQ ID NO: 365567 - RNA, 22 nt, Homo sapiens
ucugagacuguuucuaacaagc

SEQ ID NO: 365568 - RNA, 22 nt, Homo sapiens
ucugagaugagacuuugaauuu

SEQ ID NO: 365569 - RNA, 22 nt, Homo sapiens
ucugagcaauaaacaacauauu

SEQ ID NO: 365570 - RNA, 21 nt, Homo sapiens
ucugagucauucaguggccug

SEQ ID NO: 365571 - RNA, 23 nt, Homo sapiens
ucugauguuauaaaauucuuugg

SEQ ID NO: 365572 - RNA, 22 nt, Homo sapiens
ucugccacugucauugugugau

SEQ ID NO: 365573 - RNA, 22 nt, Homo sapiens
ucuggaauguaaaguuuauggg

SEQ ID NO: 365574 - RNA, 22 nt, Homo sapiens
ucuggcacucagaggccuugcu

SEQ ID NO: 365575 - RNA, 22 nt, Homo sapiens
ucuggcacugaugugggaugcu

SEQ ID NO: 365576 - RNA, 22 nt, Homo sapiens
ucuggcauuuucucugcuugca

SEQ ID NO: 365577 - RNA, 18 nt, Homo sapiens
ucuggcuucuuuguucca

SEQ ID NO: 365578 - RNA, 21 nt, Homo sapiens
ucuggcuuucauuccccuucu

SEQ ID NO: 365579 - RNA, 22 nt, Homo sapiens
ucugggguuuccacuuuuacuu

SEQ ID NO: 365580 - RNA, 22 nt, Homo sapiens
ugagaucagugaagaaguguuu

SEQ ID NO: 365581 - RNA, 22 nt, Homo sapiens
ugagaucaguuguuauaauucu

SEQ ID NO: 365582 - RNA, 20 nt, Homo sapiens
ugagauccacgugaaguaug

SEQ ID NO: 365583 - RNA, 22 nt, Homo sapiens
ugagaugaagugauguaaaaca

SEQ ID NO: 365584 - RNA, 22 nt, Homo sapiens
ugagaugaggucucacucuguu

SEQ ID NO: 365585 - RNA, 22 nt, Homo sapiens
ugagaugaggucucgcucuguc

SEQ ID NO: 365586 - RNA, 22 nt, Homo sapiens
ugagaugaguucucgcucuguc

SEQ ID NO: 365587 - RNA, 21 nt, Homo sapiens
ugagaugauccugcaugcaug

SEQ ID NO: 365588 - RNA, 22 nt, Homo sapiens
ugagaugcuccucuugcaaagc

SEQ ID NO: 365589 - RNA, 22 nt, Homo sapiens
ugagaugcucgccggccagcau

SEQ ID NO: 365590 - RNA, 22 nt, Homo sapiens
ugagauggaguuucgcccuugu

SEQ ID NO: 365591 - RNA, 22 nt, Homo sapiens
ugagauggaguuucgcuuuugu

SEQ ID NO: 365592 - RNA, 22 nt, Homo sapiens
ugagauguagauauggauuaga

SEQ ID NO: 365593 - RNA, 22 nt, Homo sapiens
ugagauguuccaaugacuauua

SEQ ID NO: 365594 - RNA, 22 nt, Homo sapiens
ugagauguuuguuucagugccu

SEQ ID NO: 365595 - RNA, 23 nt, Homo sapiens
ugagauuauaaucuuuuacuucu

SEQ ID NO: 365596 - RNA, 19 nt, Homo sapiens
ugagauuguaugaggagau

SEQ ID NO: 365597 - RNA, 22 nt, Homo sapiens
ugagcacagcgugugggagagc

SEQ ID NO: 365598 - RNA, 22 nt, Homo sapiens
ugagcacauuuacaucaguucc

SEQ ID NO: 365599 - RNA, 22 nt, Homo sapiens
ugagcagaaguuuugauuggcg

SEQ ID NO: 365600 - RNA, 22 nt, Homo sapiens
ugagcagaguuguuucuccuga

SEQ ID NO: 365601 - RNA, 22 nt, Homo sapiens
ugagcagugaguguggugcagg

SEQ ID NO: 365602 - RNA, 22 nt, Homo sapiens
ugagccauggcaccuugucuaa

SEQ ID NO: 365603 - RNA, 20 nt, Homo sapiens
ugagccccuggacucaagcg

SEQ ID NO: 365604 - RNA, 22 nt, Homo sapiens
ugagcuaggaucacaccugcau

SEQ ID NO: 365605 - RNA, 22 nt, Homo sapiens
ugagcugagaaaugcagcagcu

SEQ ID NO: 365606 - RNA, 22 nt, Homo sapiens
ugaggacugagaggcacugugg

SEQ ID NO: 365607 - RNA, 22 nt, Homo sapiens
ugaggaguguauuucauucgcu

SEQ ID NO: 365608 - RNA, 22 nt, Homo sapiens
ugaggcaggagaacggcuugaa

SEQ ID NO: 365609 - RNA, 22 nt, Homo sapiens
ugagguaagauguucauuuuuc

SEQ ID NO: 365610 - RNA, 22 nt, Homo sapiens
ugagguagguaccauuaucacu

SEQ ID NO: 365611 - RNA, 22 nt, Homo sapiens
ugagguaggugaagaaugcacg

SEQ ID NO: 365612 - RNA, 20 nt, Homo sapiens
ugaggucaggaguuacagac

SEQ ID NO: 365613 - RNA, 22 nt, Homo sapiens
ugaggucauguucugucagguu

SEQ ID NO: 365614 - RNA, 22 nt, Homo sapiens
ugaggucauucaugugggcgca

SEQ ID NO: 365615 - RNA, 22 nt, Homo sapiens
ugaggugaaguaauauucuaag

SEQ ID NO: 365616 - RNA, 22 nt, Homo sapiens
uuaaacugcuugaauuggguuu

SEQ ID NO: 365617 - RNA, 22 nt, Homo sapiens
uuaaagccauaccugagagagu

SEQ ID NO: 365618 - RNA, 22 nt, Homo sapiens
uuaaaggcauguacacuagagu

SEQ ID NO: 365619 - RNA, 22 nt, Homo sapiens
uuaaaguaauugaaauggccuu

SEQ ID NO: 365620 - RNA, 22 nt, Homo sapiens
uuaaaugcauagaauguguagu

SEQ ID NO: 365621 - RNA, 22 nt, Homo sapiens
uuaaaugcuagaauuuucuuug

SEQ ID NO: 365622 - RNA, 22 nt, Homo sapiens
uuaacagcacaugcugucccuu

SEQ ID NO: 365623 - RNA, 22 nt, Homo sapiens
uuaagaagugauuuuccucauu

SEQ ID NO: 365624 - RNA, 22 nt, Homo sapiens
uuaagacaccaaucauuggauu

SEQ ID NO: 365625 - RNA, 22 nt, Homo sapiens
uuaagccacucaagagauagag

SEQ ID NO: 365626 - RNA, 22 nt, Homo sapiens
uuaaggaaggagucuuaaaugg

SEQ ID NO: 365627 - RNA, 22 nt, Homo sapiens
uuaaggaguagugucugguauu

SEQ ID NO: 365628 - RNA, 22 nt, Homo sapiens
uuaagucacacuagacaacuga

SEQ ID NO: 365629 - RNA, 22 nt, Homo sapiens
uuaagugcucaguuacucaguu

SEQ ID NO: 365630 - RNA, 22 nt, Homo sapiens
uuaauacucuucuaaguagucc

SEQ ID NO: 365631 - RNA, 22 nt, Homo sapiens
uuaauagugacucauuuuccac

SEQ ID NO: 365632 - RNA, 22 nt, Homo sapiens
uuaaucacagugucuuccuuca

SEQ ID NO: 365633 - RNA, 22 nt, Homo sapiens
uuaauguaucuaucacaucaca

SEQ ID NO: 365634 - RNA, 22 nt, Homo sapiens
uuaauuguccaaguucaucucu

SEQ ID NO: 365635 - RNA, 19 nt, Homo sapiens
uuacacaaccuaguggggc

SEQ ID NO: 365636 - RNA, 22 nt, Homo sapiens
uuacagauggcacacucaaggg

SEQ ID NO: 365637 - RNA, 17 nt, Homo sapiens
uuacaggugcugagagu

SEQ ID NO: 365638 - RNA, 22 nt, Homo sapiens
uuacagucaaguuacauuucuc

SEQ ID NO: 365639 - RNA, 21 nt, Homo sapiens
uuacaguugguugugaggugg

SEQ ID NO: 365640 - RNA, 22 nt, Homo sapiens
uuacauugcuucaaauucagug

SEQ ID NO: 365641 - RNA, 22 nt, Homo sapiens
uuaccucagaccugcucugugu

SEQ ID NO: 365642 - RNA, 22 nt, Homo sapiens
uuaccuguguuuugggcccaga

SEQ ID NO: 365643 - RNA, 22 nt, Homo sapiens
uuacuacucucuaugaccaguu

SEQ ID NO: 365644 - RNA, 22 nt, Homo sapiens
uuacugcuagcugugugcucuu

SEQ ID NO: 365645 - RNA, 22 nt, Homo sapiens
uuagaaaguagaaaagcugguu

SEQ ID NO: 365646 - RNA, 22 nt, Homo sapiens
uuagaacagugcucaccacaaa

SEQ ID NO: 365647 - RNA, 22 nt, Homo sapiens
uuagaacuagaggaguuugagu

SEQ ID NO: 365648 - RNA, 22 nt, Homo sapiens
uuagacucauuuuggucaagga

SEQ ID NO: 365649 - RNA, 23 nt, Homo sapiens
uuagaucuuuaaggaaucuccac

SEQ ID NO: 365650 - RNA, 22 nt, Homo sapiens
uuagcaauugauucucauaagc

SEQ ID NO: 365651 - RNA, 22 nt, Homo sapiens
uuagcacauuuccagcacaugg

SEQ ID NO: 365652 - RNA, 22 nt, Homo sapiens
uuagcagcaucccuggccugua

SEQ ID NO: 365653 - RNA, 22 nt, Homo sapiens
uuagcagcaugaaaauggacug

SEQ ID NO: 365654 - RNA, 22 nt, Homo sapiens
uuagcagccuucaagcuccaag

SEQ ID NO: 365655 - RNA, 22 nt, Homo sapiens
uuagcagcucuggugacaaggu

SEQ ID NO: 365656 - RNA, 22 nt, Homo sapiens
uuaggacaauguucguuuuuug

SEQ ID NO: 365657 - RNA, 21 nt, Homo sapiens
uuaggcagugucagaggugag

SEQ ID NO: 365658 - RNA, 22 nt, Homo sapiens
uuaggcuuuauugaaaacaaua

SEQ ID NO: 365659 - RNA, 22 nt, Homo sapiens
uuagugcuuacgaugagcuaag

SEQ ID NO: 365660 - RNA, 22 nt, Homo sapiens
uuaguggaugcugaauaaagaa

SEQ ID NO: 365661 - RNA, 22 nt, Homo sapiens
uuauagguuucuacaggacuau

SEQ ID NO: 365662 - RNA, 22 nt, Homo sapiens
uuauauguuucuuagggacaga

SEQ ID NO: 365663 - RNA, 22 nt, Homo sapiens
uuaucagcagcaugaaaauaga

SEQ ID NO: 365664 - RNA, 22 nt, Homo sapiens
uuaugacauugacaguuuuuag

SEQ ID NO: 365665 - RNA, 17 nt, Homo sapiens
uuaugagacuucuuagc

SEQ ID NO: 365666 - RNA, 22 nt, Homo sapiens
uuauggccauucuuguaggagu

SEQ ID NO: 365667 - RNA, 22 nt, Homo sapiens
uuaugguuuucucucacgcagg

SEQ ID NO: 365668 - RNA, 22 nt, Homo sapiens
uuaugucauuuuuggauguuaa

SEQ ID NO: 365669 - RNA, 22 nt, Homo sapiens
uuauucagcaccugcuguguuc

SEQ ID NO: 365670 - RNA, 22 nt, Homo sapiens
uuauugcuaaaucaugaccaca

SEQ ID NO: 365671 - RNA, 22 nt, Homo sapiens
uuauuugguuauuguaauuggg

SEQ ID NO: 365672 - RNA, 22 nt, Homo sapiens
uuauuugguugcugacuuggaa

SEQ ID NO: 365673 - RNA, 23 nt, Homo sapiens
uucaaaggaugcuuuauggaauu

SEQ ID NO: 365674 - RNA, 22 nt, Homo sapiens
uucaaaguuggaggacaaacug

SEQ ID NO: 365675 - RNA, 22 nt, Homo sapiens
uucaagauggcaccagugagug

SEQ ID NO: 365676 - RNA, 22 nt, Homo sapiens
uucaaguaagaaagacaucagg

SEQ ID NO: 365677 - RNA, 22 nt, Homo sapiens
uucaaguaguucucaugccuca

SEQ ID NO: 365678 - RNA, 22 nt, Homo sapiens
uucaagugaacaaaaugaggag

SEQ ID NO: 365679 - RNA, 22 nt, Homo sapiens
uucaagugguucagaagucuga

SEQ ID NO: 365680 - RNA, 22 nt, Homo sapiens
uucacagacaacuggucccuua

SEQ ID NO: 365681 - RNA, 22 nt, Homo sapiens
uugagaugaaguuuugcucuuu

SEQ ID NO: 365682 - RNA, 22 nt, Homo sapiens
uugagauggagcuucacucuug

SEQ ID NO: 365683 - RNA, 22 nt, Homo sapiens
uugagauggagucucacucugc

SEQ ID NO: 365684 - RNA, 22 nt, Homo sapiens
uugagauggagucucgcucugu

SEQ ID NO: 365685 - RNA, 22 nt, Homo sapiens
uugagauggagucuugcucugu

SEQ ID NO: 365686 - RNA, 22 nt, Homo sapiens
uugagauggugccacuguacuc

SEQ ID NO: 365687 - RNA, 22 nt, Homo sapiens
uugagauguaagauguuaauau

SEQ ID NO: 365688 - RNA, 19 nt, Homo sapiens
uugagaugugaacucacac

SEQ ID NO: 365689 - RNA, 22 nt, Homo sapiens
uugagcaacauagugagacugu

SEQ ID NO: 365690 - RNA, 21 nt, Homo sapiens
uugagcaacuaggguuauagg

SEQ ID NO: 365691 - RNA, 22 nt, Homo sapiens
uugagcaaugaacgauucaggg

SEQ ID NO: 365692 - RNA, 22 nt, Homo sapiens
uugagcacaggaguuugagacc

SEQ ID NO: 365693 - RNA, 22 nt, Homo sapiens
uugagcacugucugugugcagu

SEQ ID NO: 365694 - RNA, 22 nt, Homo sapiens
uugagcccuggaggcagaggcu

SEQ ID NO: 365695 - RNA, 22 nt, Homo sapiens
uugagcccuggagguggaggcu

SEQ ID NO: 365696 - RNA, 22 nt, Homo sapiens
uugagcuaguugcaccagcagg

SEQ ID NO: 365697 - RNA, 22 nt, Homo sapiens
uugaggaaugucauuuguguuu

SEQ ID NO: 365698 - RNA, 22 nt, Homo sapiens
uugagggcugaauaccaaucag

SEQ ID NO: 365699 - RNA, 22 nt, Homo sapiens
uugagguagcuuugauggaggu

SEQ ID NO: 365700 - RNA, 22 nt, Homo sapiens
uugagguaguacuuauuauugg

SEQ ID NO: 365701 - RNA, 22 nt, Homo sapiens
uugagguauaaagguagguugu

SEQ ID NO: 365702 - RNA, 22 nt, Homo sapiens
uugaggugaagggcagagcagc

SEQ ID NO: 365703 - RNA, 22 nt, Homo sapiens
uugaggugaauuugcaggaugc

SEQ ID NO: 365704 - RNA, 22 nt, Homo sapiens
uugauagacacauauccaugug

SEQ ID NO: 365705 - RNA, 22 nt, Homo sapiens
uugauagguuuuauguauaguu

SEQ ID NO: 365706 - RNA, 22 nt, Homo sapiens
uugauaucugaugccuauggaa

SEQ ID NO: 365707 - RNA, 22 nt, Homo sapiens
uugauauguguauagcaugugg

SEQ ID NO: 365708 - RNA, 22 nt, Homo sapiens
uugauauuaaguacugaagugg

SEQ ID NO: 365709 - RNA, 22 nt, Homo sapiens
uugauauuacucaguaacagau

SEQ ID NO: 365710 - RNA, 22 nt, Homo sapiens
uugaucaaaucugagugagaau

SEQ ID NO: 365711 - RNA, 22 nt, Homo sapiens
uugguuccauuuuaccagcucu

SEQ ID NO: 365712 - RNA, 21 nt, Homo sapiens
uugguucccucugacaggucu

SEQ ID NO: 365713 - RNA, 22 nt, Homo sapiens
uugguuuccuuccugcuuaacu

SEQ ID NO: 365714 - RNA, 23 nt, Homo sapiens
uuguaacuggagaguaacauucc

SEQ ID NO: 365715 - RNA, 22 nt, Homo sapiens
uuguagcaaauguguaaacaaa

SEQ ID NO: 365716 - RNA, 22 nt, Homo sapiens
uuguaguagucucguucuuuua

SEQ ID NO: 365717 - RNA, 22 nt, Homo sapiens
uuguaguguuuauucugucaac

SEQ ID NO: 365718 - RNA, 22 nt, Homo sapiens
uuguauaguucuauguguuuug

SEQ ID NO: 365719 - RNA, 22 nt, Homo sapiens
uuguccucuccaaaucucaugu

SEQ ID NO: 365720 - RNA, 22 nt, Homo sapiens
uugucuagugaauacauuaaug

SEQ ID NO: 365721 - RNA, 19 nt, Homo sapiens
uugucuuagaguugucauu

SEQ ID NO: 365722 - RNA, 22 nt, Homo sapiens
uugugcacauguacccuagaac

SEQ ID NO: 365723 - RNA, 22 nt, Homo sapiens
uugugcaugaugcauacauggu

SEQ ID NO: 365724 - RNA, 22 nt, Homo sapiens
uugugccauucuucugccucag

SEQ ID NO: 365725 - RNA, 18 nt, Homo sapiens
uugugccugagaaggugg

SEQ ID NO: 365726 - RNA, 22 nt, Homo sapiens
uugugcuugauuugccuagcug

SEQ ID NO: 365727 - RNA, 18 nt, Homo sapiens
uuguggccccuacaaauu

SEQ ID NO: 365728 - RNA, 22 nt, Homo sapiens
uugugguuuuaucuaccuuugg

SEQ ID NO: 365729 - RNA, 22 nt, Homo sapiens
uuguguacuacaguaugccaca

SEQ ID NO: 365730 - RNA, 19 nt, Homo sapiens
uuguguccccacaaaauuc

SEQ ID NO: 365731 - RNA, 22 nt, Homo sapiens
uuguguccccacucaaauuaca

SEQ ID NO: 365732 - RNA, 22 nt, Homo sapiens
uuguguuuuuaguagggaaggg

SEQ ID NO: 365733 - RNA, 22 nt, Homo sapiens
uuguucaggagguuggggaugc

SEQ ID NO: 365734 - RNA, 22 nt, Homo sapiens
uuguuguggauuaaauuugcau

SEQ ID NO: 365735 - RNA, 22 nt, Homo sapiens
uuuaaagcaugacgagaagaag

SEQ ID NO: 365736 - RNA, 22 nt, Homo sapiens
uuuaaaguuagaaggaaagggc

SEQ ID NO: 365737 - RNA, 22 nt, Homo sapiens
uuuaaggcaugccuguacaugc

SEQ ID NO: 365738 - RNA, 22 nt, Homo sapiens
uuuaaugcaucccaaaauguag

SEQ ID NO: 365739 - RNA, 22 nt, Homo sapiens
uuuaauguuacaguauugguau

SEQ ID NO: 365740 - RNA, 22 nt, Homo sapiens
uuuacagucuuuugugugaguc

SEQ ID NO: 365741 - RNA, 22 nt, Homo sapiens
uuuaggcaauauauucaugucu

SEQ ID NO: 365742 - RNA, 22 nt, Homo sapiens
uuuagguaauauuaaguagcug

SEQ ID NO: 365743 - RNA, 22 nt, Homo sapiens
uuuauggagagauauuuauggu

SEQ ID NO: 365744 - RNA, 18 nt, Homo sapiens
uuucaagucuuaggugac

SEQ ID NO: 365745 - RNA, 22 nt, Homo sapiens
uuugugaaugucauaagcucca

SEQ ID NO: 365746 - RNA, 22 nt, Homo sapiens
uuuguggaaugcccuuauuuau

SEQ ID NO: 365747 - RNA, 23 nt, Homo sapiens
uuuguguccccacccaaaucuca

SEQ ID NO: 365748 - RNA, 22 nt, Homo sapiens
uuuuacacuguugguuggaaug

SEQ ID NO: 365749 - RNA, 20 nt, Homo sapiens
uuuuagcacuuguuauggug

SEQ ID NO: 365750 - RNA, 20 nt, Homo sapiens
uuuuagcuuuuauugaaagc

SEQ ID NO: 365751 - RNA, 22 nt, Homo sapiens
uuuuaguggaauauuuacaguu

SEQ ID NO: 365752 - RNA, 22 nt, Homo sapiens
uuuucaguuuuccagguagccg

SEQ ID NO: 365753 - RNA, 22 nt, Homo sapiens
uuuuccagugggacucccauua

SEQ ID NO: 365754 - RNA, 22 nt, Homo sapiens
uuuugcaggucaggggcagaga

SEQ ID NO: 365755 - RNA, 22 nt, Homo sapiens
uuuugcuuuuccucggucccac

SEQ ID NO: 365756 - RNA, 22 nt, Homo sapiens
uuuuggcuagaaauauaccucc

SEQ ID NO: 365757 - RNA, 22 nt, Homo sapiens
uuuuggcucuugguaggucaga

SEQ ID NO: 365758 - RNA, 22 nt, Homo sapiens
uuuuggcuuuuccucagcaagc

SEQ ID NO: 365759 - RNA, 21 nt, Homo sapiens
uuuuggucauucaggaagaaa

SEQ ID NO: 365760 - RNA, 22 nt, Homo sapiens
uuuugguguauuguauaaggua

SEQ ID NO: 365761 - RNA, 22 nt, Homo sapiens
uuuugguuguuggguaagagua

SEQ ID NO: 365762 - RNA, 22 nt, Homo sapiens
uuuuuggaggagguuagaucau

SEQ ID NO: 365763 - RNA, 22 nt, Homo sapiens
uuuuuuaguuagcugggcauga

SEQ ID NO: 365764 - RNA, 22 nt, Homo sapiens
uuuuuugguaauugaacaauga

SEQ ID NO: 365765 - RNA, 22 nt, Homo sapiens
ucauuagagaucuuggggaaaa

SEQ ID NO: 365766 - RNA, 22 nt, Homo sapiens
ucauucuuucuguggaggggcu

SEQ ID NO: 365767 - RNA, 22 nt, Homo sapiens
ucauugcacuucuuuaguugca

SEQ ID NO: 365768 - RNA, 22 nt, Homo sapiens
ucauuguccaacuucuuucagu

SEQ ID NO: 365769 - RNA, 22 nt, Homo sapiens
uccacaauggagaagaguauga

SEQ ID NO: 365770 - RNA, 22 nt, Homo sapiens
uccacagugguggaauuguuca

SEQ ID NO: 365771 - RNA, 17 nt, Homo sapiens
uccagauuucaauugaa

SEQ ID NO: 365772 - RNA, 22 nt, Homo sapiens
uccagcuuuuucuaauucugug

SEQ ID NO: 365773 - RNA, 22 nt, Homo sapiens
uccagugcauucagacacuugg

SEQ ID NO: 365774 - RNA, 20 nt, Homo sapiens
uccaguuuuggagacauucu

SEQ ID NO: 365775 - RNA, 22 nt, Homo sapiens
uccaguuuuguuaacauauggu

SEQ ID NO: 365776 - RNA, 22 nt, Homo sapiens
uccauagacauuuuaagguagu

SEQ ID NO: 365777 - RNA, 22 nt, Homo sapiens
uccaugugaaaucuaugaggac

SEQ ID NO: 365778 - RNA, 22 nt, Homo sapiens
uccauuuguucagcuucaggaa

SEQ ID NO: 365779 - RNA, 19 nt, Homo sapiens
ucccaagaugcucauacau

SEQ ID NO: 365780 - RNA, 16 nt, Homo sapiens
ucccaccauugcuugu

SEQ ID NO: 365781 - RNA, 22 nt, Homo sapiens
ucccagucuagagccggauugg

SEQ ID NO: 365782 - RNA, 22 nt, Homo sapiens
uccccgagcccaggcugugacu

SEQ ID NO: 365783 - RNA, 22 nt, Homo sapiens
uccccugagaacuugcuagaaa

SEQ ID NO: 365784 - RNA, 20 nt, Homo sapiens
ucccuaagagccuuuccuuc

SEQ ID NO: 365785 - RNA, 20 nt, Homo sapiens
ucccucaaacuuuuccacug

SEQ ID NO: 365786 - RNA, 18 nt, Homo sapiens
ucccucagaauuauagaa

SEQ ID NO: 365787 - RNA, 22 nt, Homo sapiens
ucccugacagucacagagcuac

SEQ ID NO: 365788 - RNA, 22 nt, Homo sapiens
ucccugagugauugaaaauaaa

SEQ ID NO: 365789 - RNA, 22 nt, Homo sapiens
ucccuggagcaagagaagaagg

SEQ ID NO: 365790 - RNA, 22 nt, Homo sapiens
ucccuguguuccuuuugaauug

SEQ ID NO: 365791 - RNA, 22 nt, Homo sapiens
ucccuuagccaaauccccagcc

SEQ ID NO: 365792 - RNA, 22 nt, Homo sapiens
uccucugaacuccagacccaua

SEQ ID NO: 365793 - RNA, 22 nt, Homo sapiens
uccuucaugcaucaauguaucc

SEQ ID NO: 365794 - RNA, 22 nt, Homo sapiens
uccuucauuugucaacucuagu

SEQ ID NO: 365795 - RNA, 22 nt, Homo sapiens
uccuuuggguagcuguucagau

SEQ ID NO: 365796 - RNA, 22 nt, Homo sapiens
uccuuugguuauaggcaccucu

SEQ ID NO: 365797 - RNA, 18 nt, Homo sapiens
uccuuuugggguaggaga

SEQ ID NO: 365798 - RNA, 22 nt, Homo sapiens
ucgcaccauugcacuccagcca

SEQ ID NO: 365799 - RNA, 23 nt, Homo sapiens
ucgcagcauucaauaccaggcag

SEQ ID NO: 365800 - RNA, 22 nt, Homo sapiens
ucggcucagugcaagcucugcc

SEQ ID NO: 365801 - RNA, 22 nt, Homo sapiens
ucgugcugugucaucuuguggc

SEQ ID NO: 365802 - RNA, 22 nt, Homo sapiens
ucuaaaacuagauugugaugau

SEQ ID NO: 365803 - RNA, 19 nt, Homo sapiens
ucuaaaucucuugauagac

SEQ ID NO: 365804 - RNA, 22 nt, Homo sapiens
ucucacagccauuucucccucu

SEQ ID NO: 365805 - RNA, 19 nt, Homo sapiens
ucucacagcucuacuaugu

SEQ ID NO: 365806 - RNA, 22 nt, Homo sapiens
ucucacauuucacagggauggg

SEQ ID NO: 365807 - RNA, 22 nt, Homo sapiens
ucucagcacaaacaaaauugcu

SEQ ID NO: 365808 - RNA, 22 nt, Homo sapiens
ucucagugaauugguuuugucu

SEQ ID NO: 365809 - RNA, 22 nt, Homo sapiens
ucucagugugguaaaaguuuuu

SEQ ID NO: 365810 - RNA, 22 nt, Homo sapiens
ucucauagaggcagagaguaaa

SEQ ID NO: 365811 - RNA, 22 nt, Homo sapiens
ucucauggagucaggagcagaa

SEQ ID NO: 365812 - RNA, 21 nt, Homo sapiens
ucucauuacugaugagccaga

SEQ ID NO: 365813 - RNA, 22 nt, Homo sapiens
ucuccauugaaauggacauaau

SEQ ID NO: 365814 - RNA, 22 nt, Homo sapiens
ucucccuaccugagccgagcca

SEQ ID NO: 365815 - RNA, 22 nt, Homo sapiens
ucuccggguggcggcgaaggga

SEQ ID NO: 365816 - RNA, 22 nt, Homo sapiens
ucucugagaaaaguuucuccca

SEQ ID NO: 365817 - RNA, 19 nt, Homo sapiens
ucucugguguuggagggga

SEQ ID NO: 365818 - RNA, 22 nt, Homo sapiens
ucucugguuuucaaagcaguau

SEQ ID NO: 365819 - RNA, 22 nt, Homo sapiens
ucucuguuuauuuuugguguau

SEQ ID NO: 365820 - RNA, 22 nt, Homo sapiens
ucucuuggugacuuaaaauguu

SEQ ID NO: 365821 - RNA, 22 nt, Homo sapiens
ucugagcaugcaucuugccugg

SEQ ID NO: 365822 - RNA, 22 nt, Homo sapiens
ucugagguuaaauuuuauaguu

SEQ ID NO: 365823 - RNA, 22 nt, Homo sapiens
ucugagguuacugcuuuguaga

SEQ ID NO: 365824 - RNA, 22 nt, Homo sapiens
ucugcaagucuaaacuagccau

SEQ ID NO: 365825 - RNA, 22 nt, Homo sapiens
ucugccuuuucaugugggaugg

SEQ ID NO: 365826 - RNA, 23 nt, Homo sapiens
ucuggaucauucguagugccagc

SEQ ID NO: 365827 - RNA, 20 nt, Homo sapiens
ucuggccccuccaaaucuca

SEQ ID NO: 365828 - RNA, 21 nt, Homo sapiens
ucuggccccuccaaaucucau

SEQ ID NO: 365829 - RNA, 22 nt, Homo sapiens
ucuggccccucccaaaucucau

SEQ ID NO: 365830 - RNA, 22 nt, Homo sapiens
ucuggcuccaaagucuauuuuu

SEQ ID NO: 365831 - RNA, 22 nt, Homo sapiens
ucuggcuugugaacugucuucu

SEQ ID NO: 365832 - RNA, 23 nt, Homo sapiens
ucuggcuuugggaugcucaaggg

SEQ ID NO: 365833 - RNA, 22 nt, Homo sapiens
ucuggguuuuuacaauguuuac

SEQ ID NO: 365834 - RNA, 22 nt, Homo sapiens
ucugguggugaugagagacagu

SEQ ID NO: 365835 - RNA, 22 nt, Homo sapiens
ucuggugugcucuggacuugca

SEQ ID NO: 365836 - RNA, 22 nt, Homo sapiens
ucugguguuacugagccuccca

SEQ ID NO: 365837 - RNA, 22 nt, Homo sapiens
ucugguuccugcauucauucaa

SEQ ID NO: 365838 - RNA, 22 nt, Homo sapiens
ucugucacugaaucccugucac

SEQ ID NO: 365839 - RNA, 22 nt, Homo sapiens
ucugucacugguggacgaucac

SEQ ID NO: 365840 - RNA, 22 nt, Homo sapiens
ucugucuugugguuugagugcc

SEQ ID NO: 365841 - RNA, 22 nt, Homo sapiens
ucugugaaugugaccuuauuug

SEQ ID NO: 365842 - RNA, 22 nt, Homo sapiens
ucugugcggucuguguuaugaa

SEQ ID NO: 365843 - RNA, 22 nt, Homo sapiens
ucugugcuugucauaugcuuug

SEQ ID NO: 365844 - RNA, 22 nt, Homo sapiens
ucugugguaagaaacgcauguc

SEQ ID NO: 365845 - RNA, 22 nt, Homo sapiens
ucuguggugggcuccacccagu

SEQ ID NO: 365846 - RNA, 18 nt, Homo sapiens
ucugugguguaaauacgu

SEQ ID NO: 365847 - RNA, 22 nt, Homo sapiens
ucugugguucaaaccagcaacu

SEQ ID NO: 365848 - RNA, 22 nt, Homo sapiens
ucugugguucuagcuacuuugg

SEQ ID NO: 365849 - RNA, 22 nt, Homo sapiens
ucuguguuugaucaagauugua

SEQ ID NO: 365850 - RNA, 22 nt, Homo sapiens
ucuuaguuggaaugggauaagg

SEQ ID NO: 365851 - RNA, 22 nt, Homo sapiens
ucuucaugcuugaaauaauagc

SEQ ID NO: 365852 - RNA, 20 nt, Homo sapiens
ucuugaacuuagucaacagg

SEQ ID NO: 365853 - RNA, 22 nt, Homo sapiens
ugagaucacgccacugcacucc

SEQ ID NO: 365854 - RNA, 22 nt, Homo sapiens
ugagaucaugccacugcacuuc

SEQ ID NO: 365855 - RNA, 22 nt, Homo sapiens
ugagaucuguaaagucugacau

SEQ ID NO: 365856 - RNA, 22 nt, Homo sapiens
ugagaugaaagcagaaagacuu

SEQ ID NO: 365857 - RNA, 22 nt, Homo sapiens
ugagaugaagcuagaagaaugg

SEQ ID NO: 365858 - RNA, 22 nt, Homo sapiens
ugagaugcauauucuggcuccu

SEQ ID NO: 365859 - RNA, 22 nt, Homo sapiens
ugagauggagucuugucgccua

SEQ ID NO: 365860 - RNA, 22 nt, Homo sapiens
ugagauggaguuucgcucuugu

SEQ ID NO: 365861 - RNA, 22 nt, Homo sapiens
ugagaugguaaauuuuuguugu

SEQ ID NO: 365862 - RNA, 22 nt, Homo sapiens
ugagauguggcuagagagguug

SEQ ID NO: 365863 - RNA, 22 nt, Homo sapiens
ugagauguguccagaucuaguu

SEQ ID NO: 365864 - RNA, 21 nt, Homo sapiens
ugagauuaaguuguuuagaag

SEQ ID NO: 365865 - RNA, 21 nt, Homo sapiens
ugagauuauauuaacauggua

SEQ ID NO: 365866 - RNA, 22 nt, Homo sapiens
ugagauuauauuucuuaacaga

SEQ ID NO: 365867 - RNA, 22 nt, Homo sapiens
ugagauuaucguaauguaucuc

SEQ ID NO: 365868 - RNA, 22 nt, Homo sapiens
ugagauucucugauuguagguc

SEQ ID NO: 365869 - RNA, 22 nt, Homo sapiens
ugagcaaaauuuuggacauaga

SEQ ID NO: 365870 - RNA, 22 nt, Homo sapiens
ugagcaauaaaguuacacaguu

SEQ ID NO: 365871 - RNA, 22 nt, Homo sapiens
ugagcacaggugcgcgguuacu

SEQ ID NO: 365872 - RNA, 22 nt, Homo sapiens
ugagcagagggagaaguaaauu

SEQ ID NO: 365873 - RNA, 22 nt, Homo sapiens
ugagccaugggguaaaugugau

SEQ ID NO: 365874 - RNA, 22 nt, Homo sapiens
ugagccaugguuagcuucucau

SEQ ID NO: 365875 - RNA, 22 nt, Homo sapiens
ugagcgaugggaggaagugaua

SEQ ID NO: 365876 - RNA, 22 nt, Homo sapiens
ugagcuaggauccugucacugu

SEQ ID NO: 365877 - RNA, 22 nt, Homo sapiens
ugagcuagggccuggaauaggg

SEQ ID NO: 365878 - RNA, 22 nt, Homo sapiens
ugagcucaugcauucuugagga

SEQ ID NO: 365879 - RNA, 20 nt, Homo sapiens
ugagcuuguaaacacuguuu

SEQ ID NO: 365880 - RNA, 22 nt, Homo sapiens
ugaggaguauguucuguagacc

SEQ ID NO: 365881 - RNA, 22 nt, Homo sapiens
ugaggcaagauacugauuucau

SEQ ID NO: 365882 - RNA, 22 nt, Homo sapiens
ugaggcaaggcugaaugaaggc

SEQ ID NO: 365883 - RNA, 22 nt, Homo sapiens
ugaggcuagucagaucagauga

SEQ ID NO: 365884 - RNA, 22 nt, Homo sapiens
ugagguaaaacaaggauuggau

SEQ ID NO: 365885 - RNA, 22 nt, Homo sapiens
ugagguaauagauaauauuuuu

SEQ ID NO: 365886 - RNA, 21 nt, Homo sapiens
ugaggucaugaugcugcuucc

SEQ ID NO: 365887 - RNA, 22 nt, Homo sapiens
ugagguuauuuguucaagaagu

SEQ ID NO: 365888 - RNA, 22 nt, Homo sapiens
ugagguuguccacuauaaucca

SEQ ID NO: 365889 - RNA, 22 nt, Homo sapiens
ugaguacugauuuaagauacac

SEQ ID NO: 365890 - RNA, 22 nt, Homo sapiens
ugaguagaacaucaagucauac

SEQ ID NO: 365891 - RNA, 23 nt, Homo sapiens
ugaguagguccacguaugugagu

SEQ ID NO: 365892 - RNA, 22 nt, Homo sapiens
ugaguagucuagaguggaaugu

SEQ ID NO: 365893 - RNA, 22 nt, Homo sapiens
ugagucuguucucacauugcua

SEQ ID NO: 365894 - RNA, 22 nt, Homo sapiens
ugagugaggcugggcagucccu

SEQ ID NO: 365895 - RNA, 22 nt, Homo sapiens
ugaguggagacuguguguagag

SEQ ID NO: 365896 - RNA, 22 nt, Homo sapiens
ugaguguccaaguaaggugaaa

SEQ ID NO: 365897 - RNA, 22 nt, Homo sapiens
ugaguuaggagaguguggcucu

SEQ ID NO: 365898 - RNA, 22 nt, Homo sapiens
ugaguucaauguuaaugaagca

SEQ ID NO: 365899 - RNA, 22 nt, Homo sapiens
ugaguucaauuguauuuuauua

SEQ ID NO: 365900 - RNA, 22 nt, Homo sapiens
ugaguuccuugugugaccuugc

SEQ ID NO: 365901 - RNA, 20 nt, Homo sapiens
ugaguuccuuguucagaagc

SEQ ID NO: 365902 - RNA, 22 nt, Homo sapiens
ugaguucuuccaccgggaccag

SEQ ID NO: 365903 - RNA, 22 nt, Homo sapiens
ugaguuguaggggucaccuggc

SEQ ID NO: 365904 - RNA, 23 nt, Homo sapiens
ugauaacagcauaugaagauucu

SEQ ID NO: 365905 - RNA, 22 nt, Homo sapiens
ugauaucugaucauccuugaua

SEQ ID NO: 365906 - RNA, 22 nt, Homo sapiens
ugauauguaugugaccuagaaa

SEQ ID NO: 365907 - RNA, 21 nt, Homo sapiens
ugaucacaugaaaaccaugca

SEQ ID NO: 365908 - RNA, 22 nt, Homo sapiens
ugaucuguccaccucagcuucc

SEQ ID NO: 365909 - RNA, 22 nt, Homo sapiens
ugaucuguguaacauaggaguc

SEQ ID NO: 365910 - RNA, 22 nt, Homo sapiens
ugaugaaguauaggaagggcuu

SEQ ID NO: 365911 - RNA, 22 nt, Homo sapiens
ugaugacauugucacagucuga

SEQ ID NO: 365912 - RNA, 22 nt, Homo sapiens
ugaugguuuuaaaaagaggagu

SEQ ID NO: 365913 - RNA, 22 nt, Homo sapiens
ugauguccaguucauagaaacu

SEQ ID NO: 365914 - RNA, 22 nt, Homo sapiens
ugaugucuugcaggcacgagau

SEQ ID NO: 365915 - RNA, 22 nt, Homo sapiens
ugcaaagaaauuuuggugacca

SEQ ID NO: 365916 - RNA, 22 nt, Homo sapiens
ugcaaauguuaggugucauuau

SEQ ID NO: 365917 - RNA, 22 nt, Homo sapiens
ugcaaauguuauuuugguuucu

SEQ ID NO: 365918 - RNA, 22 nt, Homo sapiens
ugcaagaaacauauuccacaag

SEQ ID NO: 365919 - RNA, 21 nt, Homo sapiens
ugcaagaaucaggaagcugcc

SEQ ID NO: 365920 - RNA, 22 nt, Homo sapiens
ugcaagacuaaaccuuccccuc

SEQ ID NO: 365921 - RNA, 22 nt, Homo sapiens
ugcaagcacacccagggauugu

SEQ ID NO: 365922 - RNA, 22 nt, Homo sapiens
ugcacaaccucacccccgcucu

SEQ ID NO: 365923 - RNA, 22 nt, Homo sapiens
ugcaccacacuccauccugggc

SEQ ID NO: 365924 - RNA, 22 nt, Homo sapiens
ugcaccauugcacuccagccug

SEQ ID NO: 365925 - RNA, 22 nt, Homo sapiens
ugcaccauugcauacuuaauua

SEQ ID NO: 365926 - RNA, 20 nt, Homo sapiens
ugcagauucaaccaacugug

SEQ ID NO: 365927 - RNA, 22 nt, Homo sapiens
ugcagauucguuuugaggggua

SEQ ID NO: 365928 - RNA, 20 nt, Homo sapiens
ugcagcacgggcccuuucca

SEQ ID NO: 365929 - RNA, 22 nt, Homo sapiens
ugcaggauguucaguaauuucc

SEQ ID NO: 365930 - RNA, 22 nt, Homo sapiens
ugcaggguccauugucccaagu

SEQ ID NO: 365931 - RNA, 22 nt, Homo sapiens
ugcaguacauucagcauccucu

SEQ ID NO: 365932 - RNA, 22 nt, Homo sapiens
ugcagugucaauaauaauuagu

SEQ ID NO: 365933 - RNA, 22 nt, Homo sapiens
ugcaguguucuuuagaggaaau

SEQ ID NO: 365934 - RNA, 22 nt, Homo sapiens
ugcaguuuaggaacugguaaca

SEQ ID NO: 365935 - RNA, 18 nt, Homo sapiens
ugcauacuaucugauuuu

SEQ ID NO: 365936 - RNA, 22 nt, Homo sapiens
ugcauauguugagaugcauauu

SEQ ID NO: 365937 - RNA, 21 nt, Homo sapiens
ugcauggagaacacugagggu

SEQ ID NO: 365938 - RNA, 22 nt, Homo sapiens
ugcauguucuuacucauacaug

SEQ ID NO: 365939 - RNA, 22 nt, Homo sapiens
ugcauuguuccgaauguguccu

SEQ ID NO: 365940 - RNA, 22 nt, Homo sapiens
ugccaguguuuuguugaagauu

SEQ ID NO: 365941 - RNA, 22 nt, Homo sapiens
ugugcacaaugugcagguuuga

SEQ ID NO: 365942 - RNA, 22 nt, Homo sapiens
ugugcacuggaccuugucuucu

SEQ ID NO: 365943 - RNA, 22 nt, Homo sapiens
ugugcaugacagcauacaaacg

SEQ ID NO: 365944 - RNA, 22 nt, Homo sapiens
ugugccacuccagcucuagcuu

SEQ ID NO: 365945 - RNA, 22 nt, Homo sapiens
ugugccacugcacucuggccug

SEQ ID NO: 365946 - RNA, 22 nt, Homo sapiens
ugugccuacugauagagccaag

SEQ ID NO: 365947 - RNA, 22 nt, Homo sapiens
uguggcaaauggucaggaagaa

SEQ ID NO: 365948 - RNA, 22 nt, Homo sapiens
uguggccccuagcuacuagaga

SEQ ID NO: 365949 - RNA, 17 nt, Homo sapiens
uguggcucuuaugcuga

SEQ ID NO: 365950 - RNA, 23 nt, Homo sapiens
ugugguauuauuccauuuauagg

SEQ ID NO: 365951 - RNA, 22 nt, Homo sapiens
uguggucaucacuugaagguaa

SEQ ID NO: 365952 - RNA, 22 nt, Homo sapiens
ugugguuuuauaaacgugaccu

SEQ ID NO: 365953 - RNA, 22 nt, Homo sapiens
uguguaauacucuaaugaugca

SEQ ID NO: 365954 - RNA, 22 nt, Homo sapiens
uguguacaucucuacacacaug

SEQ ID NO: 365955 - RNA, 22 nt, Homo sapiens
uguguauaucacugcaugagug

SEQ ID NO: 365956 - RNA, 22 nt, Homo sapiens
ugugucacugcacuccagccug

SEQ ID NO: 365957 - RNA, 22 nt, Homo sapiens
ugugucuugagagucucgagaa

SEQ ID NO: 365958 - RNA, 22 nt, Homo sapiens
uguguuugauaaguccauaguu

SEQ ID NO: 365959 - RNA, 22 nt, Homo sapiens
uguuaagaugucaauuuuccac

SEQ ID NO: 365960 - RNA, 22 nt, Homo sapiens
uguuagguuggugcaaaaguga

SEQ ID NO: 365961 - RNA, 22 nt, Homo sapiens
uguuaguuguucauguuaagag

SEQ ID NO: 365962 - RNA, 22 nt, Homo sapiens
uguucaauucccaccuaugagu

SEQ ID NO: 365963 - RNA, 20 nt, Homo sapiens
uguugcacucuagccugggu

SEQ ID NO: 365964 - RNA, 22 nt, Homo sapiens
uguugcacugguaauguacuga

SEQ ID NO: 365965 - RNA, 22 nt, Homo sapiens
uguugcauuugucaaggucaag

SEQ ID NO: 365966 - RNA, 22 nt, Homo sapiens
uguuuaguuaagacauagaauu

SEQ ID NO: 365967 - RNA, 22 nt, Homo sapiens
uguuuuguuagcacucugggaa

SEQ ID NO: 365968 - RNA, 22 nt, Homo sapiens
uuaaaguauaguuccucugguu

SEQ ID NO: 365969 - RNA, 22 nt, Homo sapiens
uuaaaguguuugcagacaggug

SEQ ID NO: 365970 - RNA, 22 nt, Homo sapiens
uuaaauacagcaugguguuucu

SEQ ID NO: 365971 - RNA, 22 nt, Homo sapiens
uuaaaugcucacauaaagguag

SEQ ID NO: 365972 - RNA, 21 nt, Homo sapiens
uuaacagacaagugucuuccc

SEQ ID NO: 365973 - RNA, 22 nt, Homo sapiens
uuaacagcacuacguggggauc

SEQ ID NO: 365974 - RNA, 23 nt, Homo sapiens
uuaagcaacggcugcuuuucaga

SEQ ID NO: 365975 - RNA, 22 nt, Homo sapiens
uuaagccaggugugguggcaca

SEQ ID NO: 365976 - RNA, 22 nt, Homo sapiens
uuaaggcagugcaucuggaguu

SEQ ID NO: 365977 - RNA, 22 nt, Homo sapiens
uuaaggguuuuagaauuuucca

SEQ ID NO: 365978 - RNA, 19 nt, Homo sapiens
uuaagguacuuagaugugu

SEQ ID NO: 365979 - RNA, 22 nt, Homo sapiens
uuaagguaugugggcauuuugu

SEQ ID NO: 365980 - RNA, 23 nt, Homo sapiens
uuaaggugaugucuuugugccuc

SEQ ID NO: 365981 - RNA, 22 nt, Homo sapiens
uuaaguuaggcuucagcagucu

SEQ ID NO: 365982 - RNA, 22 nt, Homo sapiens
uuaauacugcuuaacuuuagga

SEQ ID NO: 365983 - RNA, 22 nt, Homo sapiens
uuaaucucaggaguuugggacc

SEQ ID NO: 365984 - RNA, 22 nt, Homo sapiens
uuaaugaacuuuauuuuguaga

SEQ ID NO: 365985 - RNA, 21 nt, Homo sapiens
uuaaugcuaugcagaaaaucu

SEQ ID NO: 365986 - RNA, 22 nt, Homo sapiens
uuaaugugaaucaggaugcauu

SEQ ID NO: 365987 - RNA, 22 nt, Homo sapiens
uuacagauggauggcagcuggc

SEQ ID NO: 365988 - RNA, 22 nt, Homo sapiens
uuacaguaugaguaagaguucu

SEQ ID NO: 365989 - RNA, 22 nt, Homo sapiens
uuacaguauugcaaggacuagg

SEQ ID NO: 365990 - RNA, 22 nt, Homo sapiens
uuacaguggugaccuuguauug

SEQ ID NO: 365991 - RNA, 22 nt, Homo sapiens
uuacaucaucacauuaguuugc

SEQ ID NO: 365992 - RNA, 19 nt, Homo sapiens
uuacauccauugcauuuca

SEQ ID NO: 365993 - RNA, 22 nt, Homo sapiens
uuacaugucuugguaagguuag

SEQ ID NO: 365994 - RNA, 22 nt, Homo sapiens
uuacauguggugugaagaagag

SEQ ID NO: 365995 - RNA, 22 nt, Homo sapiens
uuaccagagaagacgaggggga

SEQ ID NO: 365996 - RNA, 20 nt, Homo sapiens
uuacuauguaguauuggcuc

SEQ ID NO: 365997 - RNA, 22 nt, Homo sapiens
uuacugcuuaagugauucaaca

SEQ ID NO: 365998 - RNA, 22 nt, Homo sapiens
uuacuguagugucauaucguau

SEQ ID NO: 365999 - RNA, 22 nt, Homo sapiens
uuagagcacugaucugcucuuu

SEQ ID NO: 366000 - RNA, 18 nt, Homo sapiens
uuagagugcauuacuuug

SEQ ID NO: 366001 - RNA, 22 nt, Homo sapiens
uuagcaauagccugcaucugca

SEQ ID NO: 366002 - RNA, 22 nt, Homo sapiens
uuagcacaguucauucauguua

SEQ ID NO: 366003 - RNA, 22 nt, Homo sapiens
uuagcacaucuuucuauguaag

SEQ ID NO: 366004 - RNA, 22 nt, Homo sapiens
uuagcaccacacacuuuagagg

SEQ ID NO: 366005 - RNA, 22 nt, Homo sapiens
uuagcagcaccccacucuacug

SEQ ID NO: 366006 - RNA, 22 nt, Homo sapiens
uuagcaguggauggguggagaa

SEQ ID NO: 366007 - RNA, 22 nt, Homo sapiens
uuagcccaucuugaggaaagua

SEQ ID NO: 366008 - RNA, 22 nt, Homo sapiens
uuaggcaaugcucucaaauuug

SEQ ID NO: 366009 - RNA, 22 nt, Homo sapiens
uuagguaggugcuuuuuucaca

SEQ ID NO: 366010 - RNA, 22 nt, Homo sapiens
uuagguauuuuguuaugucagc

SEQ ID NO: 366011 - RNA, 22 nt, Homo sapiens
uuaggucaucgcuguccuucag

SEQ ID NO: 366012 - RNA, 22 nt, Homo sapiens
uuaguaguagcugcaugucagu

SEQ ID NO: 366013 - RNA, 22 nt, Homo sapiens
uuagugaaugggugugauuugu

SEQ ID NO: 366014 - RNA, 20 nt, Homo sapiens
uuaguucauuuagaagguuu

SEQ ID NO: 366015 - RNA, 22 nt, Homo sapiens
uuaguuuaucagugguuucuga

SEQ ID NO: 366016 - RNA, 22 nt, Homo sapiens
uuauacacugugggaguguaaa

SEQ ID NO: 366017 - RNA, 18 nt, Homo sapiens
uuauaugcauguguagga

SEQ ID NO: 366018 - RNA, 22 nt, Homo sapiens
uuauauguuacucccucuagca

SEQ ID NO: 366019 - RNA, 22 nt, Homo sapiens
uuaucaaacccuaggagguggu

SEQ ID NO: 366020 - RNA, 22 nt, Homo sapiens
uuaucccacuuucuguuccugu

SEQ ID NO: 366021 - RNA, 22 nt, Homo sapiens
uuaugcaucuuccacacucauu

SEQ ID NO: 366022 - RNA, 22 nt, Homo sapiens
uuaugcuugugugaauuuuccc

SEQ ID NO: 366023 - RNA, 22 nt, Homo sapiens
uuauguaggcuauagcucugca

SEQ ID NO: 366024 - RNA, 22 nt, Homo sapiens
uuauguguuuaauguuucugaa

SEQ ID NO: 366025 - RNA, 22 nt, Homo sapiens
uuauuacuccuauuuuguagau

SEQ ID NO: 366026 - RNA, 22 nt, Homo sapiens
uuauuagagauauuugguuagg

SEQ ID NO: 366027 - RNA, 22 nt, Homo sapiens
uuauuagcacccuaccaugugg

SEQ ID NO: 366028 - RNA, 22 nt, Homo sapiens
uuauucauuaauugcuaagguu

SEQ ID NO: 366029 - RNA, 22 nt, Homo sapiens
aaggucauugugguuuuugcca

SEQ ID NO: 366030 - RNA, 22 nt, Homo sapiens
aaugcuaucuggaacauuguug

SEQ ID NO: 366031 - RNA, 22 nt, Homo sapiens
acuugacacuuauauuacucac

SEQ ID NO: 366032 - RNA, 22 nt, Homo sapiens
agucagugucuguaaggagaac

SEQ ID NO: 366033 - RNA, 22 nt, Homo sapiens
agugcaauggugccaucauagc

SEQ ID NO: 366034 - RNA, 22 nt, Homo sapiens
auagcagaacagugucucacug

SEQ ID NO: 366035 - RNA, 22 nt, Homo sapiens
augacaguaugacuccaaaagu

SEQ ID NO: 366036 - RNA, 22 nt, Homo sapiens
augagaacauaucaagugauug

SEQ ID NO: 366037 - RNA, 20 nt, Homo sapiens
augagcucaucuugaaaacc

SEQ ID NO: 366038 - RNA, 22 nt, Homo sapiens
augcaaacaucugaagagacau

SEQ ID NO: 366039 - RNA, 19 nt, Homo sapiens
auuuccuggagcuggucuc

SEQ ID NO: 366040 - RNA, 22 nt, Homo sapiens
cuguguaguacuagauugagca

SEQ ID NO: 366041 - RNA, 22 nt, Homo sapiens
gagcugaauugcugccauuugc

SEQ ID NO: 366042 - RNA, 17 nt, Homo sapiens
gcugcauucauguagaa

SEQ ID NO: 366043 - RNA, 19 nt, Homo sapiens
ggcucagucaacugacugu

SEQ ID NO: 366044 - RNA, 22 nt, Homo sapiens
gucauguuuaacuucuugagga

SEQ ID NO: 366045 - RNA, 17 nt, Homo sapiens
gugagguggguaguauc

SEQ ID NO: 366046 - RNA, 22 nt, Homo sapiens
gugagguguuaaccaaccugug

SEQ ID NO: 366047 - RNA, 22 nt, Homo sapiens
gugcuuauccccauucuggagg

SEQ ID NO: 366048 - RNA, 22 nt, Homo sapiens
guggcuauuguucccugguugc

SEQ ID NO: 366049 - RNA, 22 nt, Homo sapiens
aaguaaacauuuuguacaauaa

SEQ ID NO: 366050 - RNA, 22 nt, Homo sapiens
accaguguuuaccaaguagcau

SEQ ID NO: 366051 - RNA, 22 nt, Homo sapiens
agcaacauugagacugcaguug

SEQ ID NO: 366052 - RNA, 22 nt, Homo sapiens
agcaucauuugauguucccgag

SEQ ID NO: 366053 - RNA, 22 nt, Homo sapiens
cauauucacuuuacagagcugu

SEQ ID NO: 366054 - RNA, 22 nt, Homo sapiens
cugacugaggaucaguucauca

SEQ ID NO: 366055 - RNA, 22 nt, Homo sapiens
cugcauuagucuguuuaguguu

SEQ ID NO: 366056 - RNA, 22 nt, Homo sapiens
gaaaguaauuaacgauuguugc

SEQ ID NO: 366057 - RNA, 22 nt, Homo sapiens
gaaucacagauuaugaguaucu

SEQ ID NO: 366058 - RNA, 22 nt, Homo sapiens
gauuuguauuaaaagugugacg

SEQ ID NO: 366059 - RNA, 21 nt, Homo sapiens
gcaaguacuaucaucauuauc

SEQ ID NO: 366060 - RNA, 22 nt, Homo sapiens
gguaacaguggggcuaugcuua

SEQ ID NO: 366061 - RNA, 22 nt, Homo sapiens
gugcaauguuaauuacuugacu

SEQ ID NO: 366062 - RNA, 22 nt, Homo sapiens
gugcauauaaguuguuucuagu

SEQ ID NO: 366063 - RNA, 22 nt, Homo sapiens
ucacuuugacggccaacuucua

SEQ ID NO: 366064 - RNA, 22 nt, Homo sapiens
ucagugaauacauguacucaug

SEQ ID NO: 366065 - RNA, 22 nt, Homo sapiens
ugaaaaguuguugaaggcuuca

SEQ ID NO: 366066 - RNA, 22 nt, Homo sapiens
ugaagagucuaaaucugucuuc

SEQ ID NO: 366067 - RNA, 21 nt, Homo sapiens
ugaauauuuggguugugucca

SEQ ID NO: 366068 - RNA, 22 nt, Homo sapiens
ugacaacugauuaacuccuuua

SEQ ID NO: 366069 - RNA, 19 nt, Homo sapiens
ugacacuguuggugggagg

SEQ ID NO: 366070 - RNA, 22 nt, Homo sapiens
ugacagugugagacuuugucuc

SEQ ID NO: 366071 - RNA, 22 nt, Homo sapiens
ugagaacagauggcuuuauuau

SEQ ID NO: 366072 - RNA, 16 nt, Homo sapiens
ugagaacaugcagcau

SEQ ID NO: 366073 - RNA, 22 nt, Homo sapiens
ugagaacauggagaacccccca

SEQ ID NO: 366074 - RNA, 16 nt, Homo sapiens
ugagaacaugggguau

SEQ ID NO: 366075 - RNA, 20 nt, Homo sapiens
ugagaacaugugguauuugg

SEQ ID NO: 366076 - RNA, 22 nt, Homo sapiens
ugagaacauuccucuuccuggc

SEQ ID NO: 366077 - RNA, 22 nt, Homo sapiens
ugagcugagaucuuaccacugc

SEQ ID NO: 366078 - RNA, 22 nt, Homo sapiens
uggaaguuaaaugacucuuucu

SEQ ID NO: 366079 - RNA, 22 nt, Homo sapiens
uggcaagagcaaaauguacagu

SEQ ID NO: 366080 - RNA, 22 nt, Homo sapiens
uggcagauaggauacaggacua

SEQ ID NO: 366081 - RNA, 22 nt, Homo sapiens
aaaaggcuagcuaguaacagaa

SEQ ID NO: 366082 - RNA, 22 nt, Homo sapiens
aaacucuguagcagagacagau

SEQ ID NO: 366083 - RNA, 20 nt, Homo sapiens
aaacucugucuucuuuauca

SEQ ID NO: 366084 - RNA, 22 nt, Homo sapiens
aauagcauugaaucuaccaauu

SEQ ID NO: 366085 - RNA, 22 nt, Homo sapiens
agcaacaucagcagcaggaaaa

SEQ ID NO: 366086 - RNA, 22 nt, Homo sapiens
agcaagauccagucgcacagga

SEQ ID NO: 366087 - RNA, 21 nt, Homo sapiens
aggucaguaagaaugcagcac

SEQ ID NO: 366088 - RNA, 19 nt, Homo sapiens
agugcaauugccuuugugc

SEQ ID NO: 366089 - RNA, 22 nt, Homo sapiens
auaaagcuauuccucucuuuuu

SEQ ID NO: 366090 - RNA, 21 nt, Homo sapiens
auauggaacuggugacguguu

SEQ ID NO: 366091 - RNA, 20 nt, Homo sapiens
augagguguaugacacugaa

SEQ ID NO: 366092 - RNA, 22 nt, Homo sapiens
augccucugacaauuggauucu

SEQ ID NO: 366093 - RNA, 22 nt, Homo sapiens
auggcauggugaagucuuugga

SEQ ID NO: 366094 - RNA, 22 nt, Homo sapiens
cagauguaguauuuuagugaaa

SEQ ID NO: 366095 - RNA, 22 nt, Homo sapiens
cuguaacagaauaaauuuguuu

SEQ ID NO: 366096 - RNA, 22 nt, Homo sapiens
gaaugcaugaggggaucagaug

SEQ ID NO: 366097 - RNA, 22 nt, Homo sapiens
gagcugaaguuuccauuuguac

SEQ ID NO: 366098 - RNA, 22 nt, Homo sapiens
gaggucaggacauuuuugcuuu

SEQ ID NO: 366099 - RNA, 20 nt, Homo sapiens
guggaaguagaaacauaugu

SEQ ID NO: 366100 - RNA, 22 nt, Homo sapiens
uagcagaauaacuugccagccu

SEQ ID NO: 366101 - RNA, 22 nt, Homo sapiens
uaucacaguaucuagcacagug

SEQ ID NO: 366102 - RNA, 22 nt, Homo sapiens
uaucucagagaaucagauuuac

SEQ ID NO: 366103 - RNA, 22 nt, Homo sapiens
uauugcagauacccaggaaguu

SEQ ID NO: 366104 - RNA, 23 nt, Homo sapiens
ucagugaaggaacaacuaaauag

SEQ ID NO: 366105 - RNA, 22 nt, Homo sapiens
ucugugcuugucauaugcuuug

SEQ ID NO: 366106 - RNA, 22 nt, Homo sapiens
ugaagacucauacuugaaucag

SEQ ID NO: 366107 - RNA, 22 nt, Homo sapiens
ugacuugauacauguuuuugaa

SEQ ID NO: 366108 - RNA, 21 nt, Homo sapiens
ugagaacaacaggucaagcag

SEQ ID NO: 366109 - RNA, 22 nt, Homo sapiens
ugagaacaugugauauuuggug

SEQ ID NO: 366110 - RNA, 18 nt, Homo sapiens
ugagaacauguguacaca

SEQ ID NO: 366111 - RNA, 22 nt, Homo sapiens
ugagaugacgacacaccucagu

SEQ ID NO: 366112 - RNA, 22 nt, Homo sapiens
ugagcugagaaaugcagcagcu

SEQ ID NO: 366113 - RNA, 22 nt, Homo sapiens
ugagcugagacaauaaguuuuu

SEQ ID NO: 366114 - RNA, 20 nt, Homo sapiens
ugaggucugagaaagaauga

SEQ ID NO: 366115 - RNA, 22 nt, Homo sapiens
ugagugaacgcugagaccaaau

SEQ ID NO: 366116 - RNA, 22 nt, Homo sapiens
ugaugacacugauuucuucaau

SEQ ID NO: 366117 - RNA, 22 nt, Homo sapiens
ugcaaaguccucauucuuaccc

SEQ ID NO: 366118 - RNA, 23 nt, Homo sapiens
ugcauaguacccaauacuuuauc

SEQ ID NO: 366119 - RNA, 21 nt, Homo sapiens
ugcuauguuguccaggcuggc

SEQ ID NO: 366120 - RNA, 19 nt, Homo sapiens
ugcuuauccagagaaacuu

SEQ ID NO: 366121 - RNA, 22 nt, Homo sapiens
uggcagaugagccgcgcuccaa

SEQ ID NO: 366122 - RNA, 17 nt, Homo sapiens
uggcaugaggguguggg

SEQ ID NO: 366123 - RNA, 22 nt, Homo sapiens
uguaacaggaggaaaaugugaa

SEQ ID NO: 366124 - RNA, 22 nt, Homo sapiens
ugucauguuucuacugaccaaa

SEQ ID NO: 366125 - RNA, 19 nt, Homo sapiens
ugugaagaaaugcugcaag

SEQ ID NO: 366126 - RNA, 22 nt, Homo sapiens
uugcaagugccguaacuaccaa

SEQ ID NO: 366127 - RNA, 22 nt, Homo sapiens
uugcaaguggagcuuccagggc

SEQ ID NO: 366128 - RNA, 22 nt, Homo sapiens
uuggaacacauguuuuucuacc

SEQ ID NO: 366129 - RNA, 22 nt, Homo sapiens
uuguggcuuaucucauuuagcg

SEQ ID NO: 366130 - RNA, 22 nt, Homo sapiens
uuugcuucacuguuuggcaaaa

SEQ ID NO: 366131 - RNA, 22 nt, Homo sapiens
aaaugcaugaggugggaagaaa

SEQ ID NO: 366132 - RNA, 22 nt, Homo sapiens
aagagaacugacaguaccuggg

SEQ ID NO: 366133 - RNA, 22 nt, Homo sapiens
aagucauggaggaguaugugag

SEQ ID NO: 366134 - RNA, 22 nt, Homo sapiens
acacugcugaguaaauaauuuu

SEQ ID NO: 366135 - RNA, 22 nt, Homo sapiens
acaucauugggggcuacaggug

SEQ ID NO: 366136 - RNA, 22 nt, Homo sapiens
acaugcauauguuggaagaaag

SEQ ID NO: 366137 - RNA, 22 nt, Homo sapiens
acccaguguugggcagaacugu

SEQ ID NO: 366138 - RNA, 22 nt, Homo sapiens
aggcaugauuguauuuugcucu

SEQ ID NO: 366139 - RNA, 20 nt, Homo sapiens
aggcauguugguuugcgugu

SEQ ID NO: 366140 - RNA, 22 nt, Homo sapiens
agugcaaugauccggugcuggg

SEQ ID NO: 366141 - RNA, 22 nt, Homo sapiens
aguugcaagucuugaguaaaga

SEQ ID NO: 366142 - RNA, 22 nt, Homo sapiens
auaauaccugccacauuugaau

SEQ ID NO: 366143 - RNA, 22 nt, Homo sapiens
auacuccugucucagcugagau

SEQ ID NO: 366144 - RNA, 22 nt, Homo sapiens
aucagugagugguuagugaaug

SEQ ID NO: 366145 - RNA, 22 nt, Homo sapiens
auccaguuuuaggagauuucua

SEQ ID NO: 366146 - RNA, 23 nt, Homo sapiens
augacacuguccuugaccauuuc

SEQ ID NO: 366147 - RNA, 19 nt, Homo sapiens
augagaacagacuccauuu

SEQ ID NO: 366148 - RNA, 22 nt, Homo sapiens
augagaacugucaaugagagcu

SEQ ID NO: 366149 - RNA, 22 nt, Homo sapiens
caacacuguuuauuggauagcc

SEQ ID NO: 366150 - RNA, 22 nt, Homo sapiens
uggcaggugcacuggcuuugaa

SEQ ID NO: 366151 - RNA, 22 nt, Homo sapiens
uguagguguacauacaugguua

SEQ ID NO: 366152 - RNA, 22 nt, Homo sapiens
ugucauguagaaauuguccauu

SEQ ID NO: 366153 - RNA, 22 nt, Homo sapiens
ugucaugucuuuguguaucaau

SEQ ID NO: 366154 - RNA, 22 nt, Homo sapiens
ugucaugugagggaacuuguuc

SEQ ID NO: 366155 - RNA, 22 nt, Homo sapiens
ugugaagaugagaugacgcccu

SEQ ID NO: 366156 - RNA, 22 nt, Homo sapiens
uuagugcaaacucuucaaugcu

SEQ ID NO: 366157 - RNA, 19 nt, Homo sapiens
uucacguaggagaaagaag

SEQ ID NO: 366158 - RNA, 22 nt, Homo sapiens
uucuugcugaauugugcccuuc

SEQ ID NO: 366159 - RNA, 22 nt, Homo sapiens
uuuggaagaugccacuguauca

SEQ ID NO: 366160 - RNA, 22 nt, Homo sapiens
uuugugcuaaugcuagauuacu

SEQ ID NO: 366161 - RNA, 21 nt, Homo sapiens
gugucaugguugacuuuggca

SEQ ID NO: 366162 - RNA, 22 nt, Homo sapiens
uaaugugcuucucuaccauagg

SEQ ID NO: 366163 - RNA, 22 nt, Homo sapiens
uaccagugucagcuuccugugu

SEQ ID NO: 366164 - RNA, 22 nt, Homo sapiens
uauaagguuaggaaaaauuucu

SEQ ID NO: 366165 - RNA, 21 nt, Homo sapiens
ucagugcaauucuauggggaa

SEQ ID NO: 366166 - RNA, 22 nt, Homo sapiens
ucugugcauuacacuuuucuca

SEQ ID NO: 366167 - RNA, 22 nt, Homo sapiens
ugaauacuucguucaaagauaa

SEQ ID NO: 366168 - RNA, 18 nt, Homo sapiens
ugacauugagcugagaaa

SEQ ID NO: 366169 - RNA, 22 nt, Homo sapiens
ugacauugggagugaagugaag

SEQ ID NO: 366170 - RNA, 22 nt, Homo sapiens
ugagaacaugcacuugagguug

SEQ ID NO: 366171 - RNA, 16 nt, Homo sapiens
ugagaacaugugauau

SEQ ID NO: 366172 - RNA, 20 nt, Homo sapiens
ugagaacauguggcauuugg

SEQ ID NO: 366173 - RNA, 19 nt, Homo sapiens
ugagaacaugugguauuug

SEQ ID NO: 366174 - RNA, 22 nt, Homo sapiens
ugagaugagggcugcacucaaa

SEQ ID NO: 366175 - RNA, 22 nt, Homo sapiens
ugagcagugaguguggugcagg

SEQ ID NO: 366176 - RNA, 22 nt, Homo sapiens
ugagcugagaucacacuacugu

SEQ ID NO: 366177 - RNA, 22 nt, Homo sapiens
ugaguuguugcauucuuggugu

SEQ ID NO: 366178 - RNA, 22 nt, Homo sapiens
ugaugacauugucacagucuga

SEQ ID NO: 366179 - RNA, 19 nt, Homo sapiens
ugcaaagucuuuuccuauu

SEQ ID NO: 366180 - RNA, 19 nt, Homo sapiens
ugcaaauucuaaaaacuga

SEQ ID NO: 366181 - RNA, 22 nt, Homo sapiens
ugcaaguaauuccagcuacuga

SEQ ID NO: 366182 - RNA, 22 nt, Homo sapiens
ugcauaugcagcauuuaugauu

SEQ ID NO: 366183 - RNA, 18 nt, Homo sapiens
ugcauauguugaaccagc

SEQ ID NO: 366184 - RNA, 22 nt, Homo sapiens
uggaaaguaguucuaaucuaag

SEQ ID NO: 366185 - RNA, 22 nt, Homo sapiens
uggaagacaggcuguauuuuaa

SEQ ID NO: 366186 - RNA, 20 nt, Homo sapiens
uggaaguaagaauauaggug

SEQ ID NO: 366187 - RNA, 22 nt, Homo sapiens
uggcaaaugaagucagcuguac

SEQ ID NO: 366188 - RNA, 22 nt, Homo sapiens
uggcaauauccacaauuacuuu

SEQ ID NO: 366189 - RNA, 22 nt, Homo sapiens
uggcagaugcucuuggugccca

SEQ ID NO: 366190 - RNA, 22 nt, Homo sapiens
uggcagaugggugagcuggaga

SEQ ID NO: 366191 - RNA, 20 nt, Homo sapiens
uggcauguugguaugcaccc

SEQ ID NO: 366192 - RNA, 22 nt, Homo sapiens
ugguauguaugauuaacaugga

SEQ ID NO: 366193 - RNA, 22 nt, Homo sapiens
ugugcaaucagcuucauuacau

SEQ ID NO: 366194 - RNA, 22 nt, Homo sapiens
ugugcaauucgauggagcucau

SEQ ID NO: 366195 - RNA, 22 nt, Homo sapiens
uuauccugucaguaaauauuuu

SEQ ID NO: 366196 - RNA, 22 nt, Homo sapiens
aggcauguggcucuguucugac

SEQ ID NO: 366197 - RNA, 22 nt, Homo sapiens
aguaaauuucugugcuuucaua

SEQ ID NO: 366198 - RNA, 22 nt, Homo sapiens
agucagugcauaagaaugaagu

SEQ ID NO: 366199 - RNA, 20 nt, Homo sapiens
agugguuuucaaauaugucu

SEQ ID NO: 366200 - RNA, 21 nt, Homo sapiens
aguucacauggcuccuguguu

SEQ ID NO: 366201 - RNA, 20 nt, Homo sapiens
auagaagacuagugcagcag

SEQ ID NO: 366202 - RNA, 18 nt, Homo sapiens
augaagucaucacuuuua

SEQ ID NO: 366203 - RNA, 22 nt, Homo sapiens
augacauugaaaagcaagugga

SEQ ID NO: 366204 - RNA, 19 nt, Homo sapiens
augacauuuggggguggac

SEQ ID NO: 366205 - RNA, 22 nt, Homo sapiens
augaggugaguaaauaaaugaa

SEQ ID NO: 366206 - RNA, 21 nt, Homo sapiens
augagguguacuguggugaaa

SEQ ID NO: 366207 - RNA, 22 nt, Homo sapiens
augugcaaauuuccaaacucuu

SEQ ID NO: 366208 - RNA, 22 nt, Homo sapiens
caccaaccucaguagcaucugu

SEQ ID NO: 366209 - RNA, 21 nt, Homo sapiens
ccugaagaagugaccucugag

SEQ ID NO: 366210 - RNA, 22 nt, Homo sapiens
cuguccugcagagucagaauga

SEQ ID NO: 366211 - RNA, 22 nt, Homo sapiens
cuguuuguuuaggguacucaga

SEQ ID NO: 366212 - RNA, 22 nt, Homo sapiens
gaagauguugcuuaccuuggag

SEQ ID NO: 366213 - RNA, 22 nt, Homo sapiens
gagaacagagauaauuuuacuu

SEQ ID NO: 366214 - RNA, 22 nt, Homo sapiens
gagguagagacuauguauuaga

SEQ ID NO: 366215 - RNA, 22 nt, Homo sapiens
gcagaauugguuucuucuaagg

SEQ ID NO: 366216 - RNA, 22 nt, Homo sapiens
gggcagaugucuggacaccuca

SEQ ID NO: 366217 - RNA, 22 nt, Homo sapiens
guaaacuuccccucaugaauga

SEQ ID NO: 366218 - RNA, 22 nt, Homo sapiens
gugacaguggagacuuacuuca

SEQ ID NO: 366219 - RNA, 22 nt, Homo sapiens
gugcaaguguaauacagcuagg

SEQ ID NO: 366220 - RNA, 22 nt, Homo sapiens
gugugacagcuauagacaugau

SEQ ID NO: 366221 - RNA, 22 nt, Homo sapiens
uaagugcaugauuacaugcaua

SEQ ID NO: 366222 - RNA, 22 nt, Homo sapiens
uaugcacuauagcauauguggu

SEQ ID NO: 366223 - RNA, 22 nt, Homo sapiens
ugacaugaugagcaauaauggc

SEQ ID NO: 366224 - RNA, 22 nt, Homo sapiens
ugagaacagcagcuugggacac

SEQ ID NO: 366225 - RNA, 16 nt, Homo sapiens
ugagaacaugugacau

SEQ ID NO: 366226 - RNA, 17 nt, Homo sapiens
ugagaacaugugguauu

SEQ ID NO: 366227 - RNA, 22 nt, Homo sapiens
ugagcugagaucaugcuauugu

SEQ ID NO: 366228 - RNA, 22 nt, Homo sapiens
ugagcugagaucgugccauugu

SEQ ID NO: 366229 - RNA, 22 nt, Homo sapiens
ugagcugagauuaagcugcugc

SEQ ID NO: 366230 - RNA, 22 nt, Homo sapiens
ugagugaaggggcucuguugug

SEQ ID NO: 366231 - RNA, 22 nt, Homo sapiens
uggcagauagaaaugugguuaa

SEQ ID NO: 366232 - RNA, 22 nt, Homo sapiens
uggcagauggugacaccauuag

SEQ ID NO: 366233 - RNA, 19 nt, Homo sapiens
uggcaugaaugugaacuaa

SEQ ID NO: 366234 - RNA, 22 nt, Homo sapiens
uggcaugauguguucauugaaa

SEQ ID NO: 366235 - RNA, 17 nt, Homo sapiens
uuauugcuauaagcuga

SEQ ID NO: 366236 - RNA, 22 nt, Homo sapiens
uugcaaaguugccaaggaagga

SEQ ID NO: 366237 - RNA, 22 nt, Homo sapiens
uuguccuggagguucuugcaag

SEQ ID NO: 366238 - RNA, 22 nt, Homo sapiens
uugugcaaaguugugguuucug

SEQ ID NO: 366239 - RNA, 22 nt, Homo sapiens
uuuauccagccucuagcaaggu

SEQ ID NO: 366240 - RNA, 22 nt, Homo sapiens
uuugugcuccucucaguaugug

SEQ ID NO: 366241 - RNA, 21 nt, Homo sapiens
aaaugcacauuacugcuggug

SEQ ID NO: 366242 - RNA, 22 nt, Homo sapiens
aaauugcauugagcugcuuauu

SEQ ID NO: 366243 - RNA, 23 nt, Homo sapiens
aagagguaugacuaugaagugga

SEQ ID NO: 366244 - RNA, 22 nt, Homo sapiens
aagcuguugguggauguaccau

SEQ ID NO: 366245 - RNA, 22 nt, Homo sapiens
aaggcaagguggauaaugaagc

SEQ ID NO: 366246 - RNA, 22 nt, Homo sapiens
aagguaguuagaaaauauaacu

SEQ ID NO: 366247 - RNA, 19 nt, Homo sapiens
aaguacuugucuuuugaag

SEQ ID NO: 366248 - RNA, 19 nt, Homo sapiens
aauaaugccagaugucugu

SEQ ID NO: 366249 - RNA, 22 nt, Homo sapiens
aaucagagcccucugagcuuca

SEQ ID NO: 366250 - RNA, 22 nt, Homo sapiens
aaucucagagauaucugugucc

SEQ ID NO: 366251 - RNA, 22 nt, Homo sapiens
acacaguauaugacaaugcuuu

SEQ ID NO: 366252 - RNA, 22 nt, Homo sapiens
acacauacacauaugguguaua

SEQ ID NO: 366253 - RNA, 17 nt, Homo sapiens
acaugagacuggauucu

SEQ ID NO: 366254 - RNA, 19 nt, Homo sapiens
acccuguccccaccuuuac

SEQ ID NO: 366255 - RNA, 23 nt, Homo sapiens
accugauguuucuguggggagcc

SEQ ID NO: 366256 - RNA, 22 nt, Homo sapiens
accugugguuacagucugucuc

SEQ ID NO: 366257 - RNA, 23 nt, Homo sapiens
accugugguuauuuuacucuucc

SEQ ID NO: 366258 - RNA, 22 nt, Homo sapiens
acugcacucuagccuuggcaac

SEQ ID NO: 366259 - RNA, 22 nt, Homo sapiens
acuguacuccagccugggcaac

SEQ ID NO: 366260 - RNA, 22 nt, Homo sapiens
acuguacucuacccugggcaac

SEQ ID NO: 366261 - RNA, 23 nt, Homo sapiens
agaaaugucuauucagggucccu

SEQ ID NO: 366262 - RNA, 22 nt, Homo sapiens
agacacuguugaaaaggcccca

SEQ ID NO: 366263 - RNA, 22 nt, Homo sapiens
agagguaagcaguggcaagugc

SEQ ID NO: 366264 - RNA, 22 nt, Homo sapiens
agaguaguaggaugaauggacu

SEQ ID NO: 366265 - RNA, 22 nt, Homo sapiens
agaugauguuuacugagcauca

SEQ ID NO: 366266 - RNA, 20 nt, Homo sapiens
agcagccacagauuccucag

SEQ ID NO: 366267 - RNA, 17 nt, Homo sapiens
agcauguguuugagauu

SEQ ID NO: 366268 - RNA, 21 nt, Homo sapiens
agccaguguuccuuguggcuc

SEQ ID NO: 366269 - RNA, 22 nt, Homo sapiens
agcugcaauguuuaguauaaua

SEQ ID NO: 366270 - RNA, 19 nt, Homo sapiens
agcuguguugccugugaga

SEQ ID NO: 366271 - RNA, 22 nt, Homo sapiens
agcuguuguucucagaggcuuu

SEQ ID NO: 366272 - RNA, 19 nt, Homo sapiens
agcuuuggcuaacuuucuc

SEQ ID NO: 366273 - RNA, 22 nt, Homo sapiens
aggaaucuaagguaucagguua

SEQ ID NO: 366274 - RNA, 22 nt, Homo sapiens
aggcaaaugccagcaaucacac

SEQ ID NO: 366275 - RNA, 22 nt, Homo sapiens
aguaucaucuuguuggccaggc

SEQ ID NO: 366276 - RNA, 22 nt, Homo sapiens
aguggcacaauuuugacucccc

SEQ ID NO: 366277 - RNA, 19 nt, Homo sapiens
agugucauggucauuauuu

SEQ ID NO: 366278 - RNA, 22 nt, Homo sapiens
auaaggcugguauagacauuca

SEQ ID NO: 366279 - RNA, 22 nt, Homo sapiens
auauccaugccauagguuuuga

SEQ ID NO: 366280 - RNA, 22 nt, Homo sapiens
aucacagauauggguuuaaauc

SEQ ID NO: 366281 - RNA, 22 nt, Homo sapiens
augaggaagucaggcccagggg

SEQ ID NO: 366282 - RNA, 22 nt, Homo sapiens
augaggauagguuucuauuagg

SEQ ID NO: 366283 - RNA, 22 nt, Homo sapiens
augagggagggcaccugaccuu

SEQ ID NO: 366284 - RNA, 22 nt, Homo sapiens
augagguauccaagcccagaaa

SEQ ID NO: 366285 - RNA, 22 nt, Homo sapiens
augaguaugagaauacauuaag

SEQ ID NO: 366286 - RNA, 22 nt, Homo sapiens
augaucuguuuggugaucuugu

SEQ ID NO: 366287 - RNA, 22 nt, Homo sapiens
augcacauauguacugcccuau

SEQ ID NO: 366288 - RNA, 22 nt, Homo sapiens
augcacuguuuucuugaugaga

SEQ ID NO: 366289 - RNA, 22 nt, Homo sapiens
augcagagaaaucuaaaauaug

SEQ ID NO: 366290 - RNA, 22 nt, Homo sapiens
augccaagaugagcacgcgucu

SEQ ID NO: 366291 - RNA, 22 nt, Homo sapiens
augccacagaaauaaccaaaau

SEQ ID NO: 366292 - RNA, 22 nt, Homo sapiens
auggaacauuauagauguaaaa

SEQ ID NO: 366293 - RNA, 22 nt, Homo sapiens
auggagguguggggagugaguu

SEQ ID NO: 366294 - RNA, 19 nt, Homo sapiens
gccaccuggugcguguucu

SEQ ID NO: 366295 - RNA, 22 nt, Homo sapiens
gccauugcacuccagccuagcg

SEQ ID NO: 366296 - RNA, 22 nt, Homo sapiens
gccauugcacuccagccuaggu

SEQ ID NO: 366297 - RNA, 22 nt, Homo sapiens
gccauugcacuccagccucggc

SEQ ID NO: 366298 - RNA, 22 nt, Homo sapiens
gccauugcacucuagccuaggu

SEQ ID NO: 366299 - RNA, 22 nt, Homo sapiens
gcugcuuuugaugacaaaaaca

SEQ ID NO: 366300 - RNA, 22 nt, Homo sapiens
ggaauauaaaacuuuugacagg

SEQ ID NO: 366301 - RNA, 22 nt, Homo sapiens
ggaauggaacaaagucuugaaa

SEQ ID NO: 366302 - RNA, 21 nt, Homo sapiens
ggaauuuagggaaugauuuag

SEQ ID NO: 366303 - RNA, 22 nt, Homo sapiens
ggcaacauggugaaacucuguc

SEQ ID NO: 366304 - RNA, 22 nt, Homo sapiens
ggcaugaggccauaaaaguaag

SEQ ID NO: 366305 - RNA, 22 nt, Homo sapiens
ggcuagagacaaguugcugaga

SEQ ID NO: 366306 - RNA, 22 nt, Homo sapiens
ggcuuggaggaaugugagggcu

SEQ ID NO: 366307 - RNA, 22 nt, Homo sapiens
gggcaacauugaguacccugaa

SEQ ID NO: 366308 - RNA, 22 nt, Homo sapiens
ggucaggagaaugguaacugag

SEQ ID NO: 366309 - RNA, 22 nt, Homo sapiens
ggucauagagaauucaccagga

SEQ ID NO: 366310 - RNA, 22 nt, Homo sapiens
ggugagguaggaaaaguuagga

SEQ ID NO: 366311 - RNA, 22 nt, Homo sapiens
guaaucucaccuacuugggagg

SEQ ID NO: 366312 - RNA, 22 nt, Homo sapiens
guagcagucacauagcagauug

SEQ ID NO: 366313 - RNA, 22 nt, Homo sapiens
gugaaugaaugggugaauacau

SEQ ID NO: 366314 - RNA, 22 nt, Homo sapiens
gugagcacugaaagaaggcaag

SEQ ID NO: 366315 - RNA, 22 nt, Homo sapiens
gugcacuguagaacccuuuguu

SEQ ID NO: 366316 - RNA, 22 nt, Homo sapiens
guggaagauaguguguuaaugu

SEQ ID NO: 366317 - RNA, 20 nt, Homo sapiens
guggaaguagaaacauaugu

SEQ ID NO: 366318 - RNA, 22 nt, Homo sapiens
guggaagucuuugguauuggua

SEQ ID NO: 366319 - RNA, 22 nt, Homo sapiens
guggaaguguaaaagcucuugg

SEQ ID NO: 366320 - RNA, 22 nt, Homo sapiens
guggcaaguguuccaagaggcg

SEQ ID NO: 366321 - RNA, 22 nt, Homo sapiens
guggcagugugaggauccugcu

SEQ ID NO: 366322 - RNA, 22 nt, Homo sapiens
gugggguaggcaauuccuagug

SEQ ID NO: 366323 - RNA, 22 nt, Homo sapiens
gugguagaaaguaccaaacuag

SEQ ID NO: 366324 - RNA, 22 nt, Homo sapiens
gugguaggaaagugcaaaugua

SEQ ID NO: 366325 - RNA, 22 nt, Homo sapiens
gugguuuuuaaaguaccugugg

SEQ ID NO: 366326 - RNA, 22 nt, Homo sapiens
gugguuuuuagauuucuacagu

SEQ ID NO: 366327 - RNA, 22 nt, Homo sapiens
guguauguuguccauggaugcg

SEQ ID NO: 366328 - RNA, 22 nt, Homo sapiens
uaacagcucuacagcugcucuu

SEQ ID NO: 366329 - RNA, 22 nt, Homo sapiens
uaaggcuagcaagaugagaaua

SEQ ID NO: 366330 - RNA, 22 nt, Homo sapiens
uaauauguuuugaaaucaggaa

SEQ ID NO: 366331 - RNA, 22 nt, Homo sapiens
uaauucacauaaagcacuuaga

SEQ ID NO: 366332 - RNA, 22 nt, Homo sapiens
uacaacacugguucgacaugug

SEQ ID NO: 366333 - RNA, 22 nt, Homo sapiens
uacagucauaaugccuagugac

SEQ ID NO: 366334 - RNA, 22 nt, Homo sapiens
uacaguggcaugucaggugcuu

SEQ ID NO: 366335 - RNA, 19 nt, Homo sapiens
uacugcacuccagucuggg

SEQ ID NO: 366336 - RNA, 22 nt, Homo sapiens
uacuguacugcaguucugcaaa

SEQ ID NO: 366337 - RNA, 22 nt, Homo sapiens
uagagguauuaacaguagaaga

SEQ ID NO: 366338 - RNA, 22 nt, Homo sapiens
uagcacuauuuauugaaaagga

SEQ ID NO: 366339 - RNA, 22 nt, Homo sapiens
uagcagcuuuauugagguaaau

SEQ ID NO: 366340 - RNA, 22 nt, Homo sapiens
uagcugagacuacaguaggugc

SEQ ID NO: 366341 - RNA, 22 nt, Homo sapiens
uaguaaacaccucagguaauuc

SEQ ID NO: 366342 - RNA, 18 nt, Homo sapiens
uaucucauuucuuagguc

SEQ ID NO: 366343 - RNA, 22 nt, Homo sapiens
uaugaugcuguuuagaaucucu

SEQ ID NO: 366344 - RNA, 22 nt, Homo sapiens
uauggauguuaagguucacagc

SEQ ID NO: 366345 - RNA, 22 nt, Homo sapiens
ucaaaaucucuuagcugugucu

SEQ ID NO: 366346 - RNA, 22 nt, Homo sapiens
ucaaaguauucuucugagaacc

SEQ ID NO: 366347 - RNA, 22 nt, Homo sapiens
ucaaauuccaagucuagguagg

SEQ ID NO: 366348 - RNA, 20 nt, Homo sapiens
ucaaauucuuggccuccagc

SEQ ID NO: 366349 - RNA, 20 nt, Homo sapiens
ucaaggcacgaauaaaaguu

SEQ ID NO: 366350 - RNA, 20 nt, Homo sapiens
ucaaggcaggaacuguacau

SEQ ID NO: 366351 - RNA, 22 nt, Homo sapiens
ucacugaggucugagcuuuaug

SEQ ID NO: 366352 - RNA, 22 nt, Homo sapiens
ucacuuuguuuuuggauaaguu

SEQ ID NO: 366353 - RNA, 22 nt, Homo sapiens
ucaggguacuuguggccaaagu

SEQ ID NO: 366354 - RNA, 22 nt, Homo sapiens
ucaggugcagagaagaaauggg

SEQ ID NO: 366355 - RNA, 23 nt, Homo sapiens
ucagugaaggaacaacuaaauag

SEQ ID NO: 366356 - RNA, 22 nt, Homo sapiens
ucaucagaguuuacaagcucag

SEQ ID NO: 366357 - RNA, 22 nt, Homo sapiens
ucaugagacacacuggaaagga

SEQ ID NO: 366358 - RNA, 22 nt, Homo sapiens
ucauugcacuccagccugggug

SEQ ID NO: 366359 - RNA, 22 nt, Homo sapiens
uccacaauggcugaacuagauu

SEQ ID NO: 366360 - RNA, 22 nt, Homo sapiens
uccacaguaaggacccugccuu

SEQ ID NO: 366361 - RNA, 22 nt, Homo sapiens
uccaguggacagacauaccaug

SEQ ID NO: 366362 - RNA, 18 nt, Homo sapiens
uccauuuguaugggaugg

SEQ ID NO: 366363 - RNA, 22 nt, Homo sapiens
ucccgaggacaucugggggcaa

SEQ ID NO: 366364 - RNA, 22 nt, Homo sapiens
uccuguaaucccagcuaccaga

SEQ ID NO: 366365 - RNA, 22 nt, Homo sapiens
ucuaaaguacuacuacuguugg

SEQ ID NO: 366366 - RNA, 22 nt, Homo sapiens
ucuaaugcucugagaacagugc

SEQ ID NO: 366367 - RNA, 22 nt, Homo sapiens
ucucccauccaugaacuucugu

SEQ ID NO: 366368 - RNA, 22 nt, Homo sapiens
ucugacucuggagucucagguu

SEQ ID NO: 366369 - RNA, 22 nt, Homo sapiens
ucuggccuagaacaauuaauua

SEQ ID NO: 366370 - RNA, 22 nt, Homo sapiens
ucuugaacuucugcacacucag

SEQ ID NO: 366371 - RNA, 22 nt, Homo sapiens
ucuuggcauggcugaagauucc

SEQ ID NO: 366372 - RNA, 22 nt, Homo sapiens
ucuuugauaagauccagaagaa

SEQ ID NO: 366373 - RNA, 22 nt, Homo sapiens
ucuuugguagaagcuauuuuau

SEQ ID NO: 366374 - RNA, 22 nt, Homo sapiens
ugaaauggaaagaguguagacu

SEQ ID NO: 366375 - RNA, 22 nt, Homo sapiens
ugaacuaguaguuuacuugaug

SEQ ID NO: 366376 - RNA, 22 nt, Homo sapiens
ugaagacucaauuauuaugaac

SEQ ID NO: 366377 - RNA, 20 nt, Homo sapiens
ugaaggaggucauuuauacc

SEQ ID NO: 366378 - RNA, 22 nt, Homo sapiens
ugaagugaaugguaaguaugcc

SEQ ID NO: 366379 - RNA, 22 nt, Homo sapiens
ugaauacagcacacccaugggu

SEQ ID NO: 366380 - RNA, 22 nt, Homo sapiens
ugacaugaagucucccucuguu

SEQ ID NO: 366381 - RNA, 22 nt, Homo sapiens
ugagagacaguuucgucggagg

SEQ ID NO: 366382 - RNA, 21 nt, Homo sapiens
ugagaguaguguauuauucuc

SEQ ID NO: 366383 - RNA, 20 nt, Homo sapiens
ugagaucaggauuaaggcua

SEQ ID NO: 366384 - RNA, 22 nt, Homo sapiens
ugagcagagaagugcccugcgc

SEQ ID NO: 366385 - RNA, 18 nt, Homo sapiens
ugaggaaaggguuugcua

SEQ ID NO: 366386 - RNA, 22 nt, Homo sapiens
aaaagcuuagaugggcuuguau

SEQ ID NO: 366387 - RNA, 22 nt, Homo sapiens
aaaaguucuuugagccuugaca

SEQ ID NO: 366388 - RNA, 20 nt, Homo sapiens
aaacucugucuucuuuauca

SEQ ID NO: 366389 - RNA, 22 nt, Homo sapiens
aaagagaucuaugggcacuaug

SEQ ID NO: 366390 - RNA, 22 nt, Homo sapiens
aaagcacuggagucaucaucua

SEQ ID NO: 366391 - RNA, 22 nt, Homo sapiens
aaaugcaguugguggggauaug

SEQ ID NO: 366392 - RNA, 22 nt, Homo sapiens
aaauucauuucagcucugggua

SEQ ID NO: 366393 - RNA, 22 nt, Homo sapiens
aacagaccuagauaguauaguc

SEQ ID NO: 366394 - RNA, 21 nt, Homo sapiens
aacagugcuuaguagauguuc

SEQ ID NO: 366395 - RNA, 22 nt, Homo sapiens
aacauguuuagcagauaccugu

SEQ ID NO: 366396 - RNA, 22 nt, Homo sapiens
aacuggccuggcgugcagaggg

SEQ ID NO: 366397 - RNA, 22 nt, Homo sapiens
aagagguaggaaauggucauuu

SEQ ID NO: 366398 - RNA, 22 nt, Homo sapiens
aagcaggugugggaggaaaugg

SEQ ID NO: 366399 - RNA, 23 nt, Homo sapiens
aagugagcuccaauugggugaga

SEQ ID NO: 366400 - RNA, 22 nt, Homo sapiens
aauaucacaguggguguacacc

SEQ ID NO: 366401 - RNA, 22 nt, Homo sapiens
aaugugcacuuggagccuugcu

SEQ ID NO: 366402 - RNA, 22 nt, Homo sapiens
aauucacuucuuuuaggcaggg

SEQ ID NO: 366403 - RNA, 22 nt, Homo sapiens
aauucacuuguggcagauccuu

SEQ ID NO: 366404 - RNA, 22 nt, Homo sapiens
acacuugcuugcaauagccucc

SEQ ID NO: 366405 - RNA, 22 nt, Homo sapiens
acagaccuauuucaaucauuua

SEQ ID NO: 366406 - RNA, 22 nt, Homo sapiens
acagauagcacuaagggaucug

SEQ ID NO: 366407 - RNA, 20 nt, Homo sapiens
acagcauagccuuuuaaagc

SEQ ID NO: 366408 - RNA, 22 nt, Homo sapiens
accacuguuucaagaagcuugu

SEQ ID NO: 366409 - RNA, 22 nt, Homo sapiens
cuacaguuauguuuuaaaugug

SEQ ID NO: 366410 - RNA, 22 nt, Homo sapiens
cuagccuggagugcaguggugc

SEQ ID NO: 366411 - RNA, 22 nt, Homo sapiens
cuaucucaggcccaggcccuug

SEQ ID NO: 366412 - RNA, 19 nt, Homo sapiens
cucauggagaaggagaaua

SEQ ID NO: 366413 - RNA, 22 nt, Homo sapiens
cucauggauggucuggcagcca

SEQ ID NO: 366414 - RNA, 22 nt, Homo sapiens
cucugguggaagcagggggcaa

SEQ ID NO: 366415 - RNA, 22 nt, Homo sapiens
cugacagaugacugccacugua

SEQ ID NO: 366416 - RNA, 22 nt, Homo sapiens
cugagagaggagcuaaaacugc

SEQ ID NO: 366417 - RNA, 22 nt, Homo sapiens
cugagaucaugggucagguggu

SEQ ID NO: 366418 - RNA, 22 nt, Homo sapiens
cugaggguagaaggaucacuug

SEQ ID NO: 366419 - RNA, 19 nt, Homo sapiens
cugcacugagaaaaggagg

SEQ ID NO: 366420 - RNA, 22 nt, Homo sapiens
cugcacugagacccucuuugcu

SEQ ID NO: 366421 - RNA, 22 nt, Homo sapiens
cugccaguuugauucgggccac

SEQ ID NO: 366422 - RNA, 22 nt, Homo sapiens
cuggaggccugaacauaaaugg

SEQ ID NO: 366423 - RNA, 22 nt, Homo sapiens
cuggcaccauacacuguuguug

SEQ ID NO: 366424 - RNA, 22 nt, Homo sapiens
cuguugcaguuauggcugcagg

SEQ ID NO: 366425 - RNA, 22 nt, Homo sapiens
cuuagcaugucagcaccggguu

SEQ ID NO: 366426 - RNA, 22 nt, Homo sapiens
cuucuugcuguguccucacaug

SEQ ID NO: 366427 - RNA, 19 nt, Homo sapiens
cuugugccugaagcuuggg

SEQ ID NO: 366428 - RNA, 22 nt, Homo sapiens
cuuugguguauuuucagagacc

SEQ ID NO: 366429 - RNA, 22 nt, Homo sapiens
gaaagcuaaugacuuuggguga

SEQ ID NO: 366430 - RNA, 21 nt, Homo sapiens
gaaauacugccuuaggagcug

SEQ ID NO: 366431 - RNA, 22 nt, Homo sapiens
gaaugugcuguuggcugggcgu

SEQ ID NO: 366432 - RNA, 22 nt, Homo sapiens
gacauagcuagauaaccucaug

SEQ ID NO: 366433 - RNA, 22 nt, Homo sapiens
gacuggccauugauacagaggu

SEQ ID NO: 366434 - RNA, 22 nt, Homo sapiens
gacuuugguagaggaaaaaucu

SEQ ID NO: 366435 - RNA, 22 nt, Homo sapiens
gagagcaugugcuggcaucagu

SEQ ID NO: 366436 - RNA, 22 nt, Homo sapiens
gagcacugauuuauuuuugucu

SEQ ID NO: 366437 - RNA, 22 nt, Homo sapiens
gaguauauuugcacuguuaugu

SEQ ID NO: 366438 - RNA, 22 nt, Homo sapiens
gaucuguguuuguaugcauaag

SEQ ID NO: 366439 - RNA, 22 nt, Homo sapiens
auugcacuccagccuggggaac

SEQ ID NO: 366440 - RNA, 22 nt, Homo sapiens
auugcacuccagccugggggac

SEQ ID NO: 366441 - RNA, 22 nt, Homo sapiens
auugcacuccagccugggugac

SEQ ID NO: 366442 - RNA, 22 nt, Homo sapiens
auugcacuccagccuggugaca

SEQ ID NO: 366443 - RNA, 22 nt, Homo sapiens
auugcacuccagccuuggggau

SEQ ID NO: 366444 - RNA, 22 nt, Homo sapiens
auugcacuccagccuugugaca

SEQ ID NO: 366445 - RNA, 22 nt, Homo sapiens
auugcacuccagcuugggugac

SEQ ID NO: 366446 - RNA, 22 nt, Homo sapiens
auugcacucuagccugggugac

SEQ ID NO: 366447 - RNA, 22 nt, Homo sapiens
auugcagcccacccugggugau

SEQ ID NO: 366448 - RNA, 22 nt, Homo sapiens
auuguacuccagccugggugac

SEQ ID NO: 366449 - RNA, 22 nt, Homo sapiens
auuguacuuaagccugggugaa

SEQ ID NO: 366450 - RNA, 22 nt, Homo sapiens
caaaggcuuccacugcauccuu

SEQ ID NO: 366451 - RNA, 22 nt, Homo sapiens
cacagagugagacccugucucu

SEQ ID NO: 366452 - RNA, 22 nt, Homo sapiens
caccacagccauuauugucccc

SEQ ID NO: 366453 - RNA, 22 nt, Homo sapiens
cacuaccucuacaggcagcugg

SEQ ID NO: 366454 - RNA, 22 nt, Homo sapiens
cacugcacucuucuucugggca

SEQ ID NO: 366455 - RNA, 21 nt, Homo sapiens
cacugcacuugccuucugggu

SEQ ID NO: 366456 - RNA, 22 nt, Homo sapiens
cacuuugguucaccugaguuuc

SEQ ID NO: 366457 - RNA, 19 nt, Homo sapiens
caguaucauugcacauagu

SEQ ID NO: 366458 - RNA, 22 nt, Homo sapiens
cagugucugcauuuggaacuca

SEQ ID NO: 366459 - RNA, 22 nt, Homo sapiens
caucaaaguggagggaaggacc

SEQ ID NO: 366460 - RNA, 19 nt, Homo sapiens
caucacagagucuuccauu

SEQ ID NO: 366461 - RNA, 21 nt, Homo sapiens
caucacauuacucaaaguccu

SEQ ID NO: 366462 - RNA, 21 nt, Homo sapiens
cauccccugccauuguggucu

SEQ ID NO: 366463 - RNA, 22 nt, Homo sapiens
caugcacugaguccaccucugg

SEQ ID NO: 366464 - RNA, 22 nt, Homo sapiens
cauggcacugagcagguaugca

SEQ ID NO: 366465 - RNA, 19 nt, Homo sapiens
cauugcacuccacccuggg

SEQ ID NO: 366466 - RNA, 22 nt, Homo sapiens
cauugcacuccaccuuggguaa

SEQ ID NO: 366467 - RNA, 22 nt, Homo sapiens
cauugcacuccagccuugguga

SEQ ID NO: 366468 - RNA, 22 nt, Homo sapiens
cauugcacugcuucuugggugu

SEQ ID NO: 366469 - RNA, 22 nt, Homo sapiens
ccaaguguuuucauuguuccau

SEQ ID NO: 366470 - RNA, 22 nt, Homo sapiens
ccaguuuuucauuuauacuagu

SEQ ID NO: 366471 - RNA, 22 nt, Homo sapiens
ccaucacaggccucagugggaa

SEQ ID NO: 366472 - RNA, 22 nt, Homo sapiens
ccauugcacuucagccuaggug

SEQ ID NO: 366473 - RNA, 22 nt, Homo sapiens
cccucauucauucauccuaugu

SEQ ID NO: 366474 - RNA, 22 nt, Homo sapiens
cccuuagaauuuuguaguuauu

SEQ ID NO: 366475 - RNA, 22 nt, Homo sapiens
ccucauggagaacaucugcuag

SEQ ID NO: 366476 - RNA, 22 nt, Homo sapiens
ccucccuuuguugcaagggaaa

SEQ ID NO: 366477 - RNA, 22 nt, Homo sapiens
ccuggaucauugucauucccaa

SEQ ID NO: 366478 - RNA, 22 nt, Homo sapiens
ccuggcacugggccccguggcu

SEQ ID NO: 366479 - RNA, 22 nt, Homo sapiens
ccuuggcaauggcuggggcuga

SEQ ID NO: 366480 - RNA, 22 nt, Homo sapiens
cuaaaguauugagugguaaaga

SEQ ID NO: 366481 - RNA, 22 nt, Homo sapiens
cuaaagugcuuaaaaucucauu

SEQ ID NO: 366482 - RNA, 22 nt, Homo sapiens
cuacaguucuuaauuaaguagu

SEQ ID NO: 366483 - RNA, 22 nt, Homo sapiens
cucagucuaugauacuuugcua

SEQ ID NO: 366484 - RNA, 22 nt, Homo sapiens
cuccauagucuucgaagaauga

SEQ ID NO: 366485 - RNA, 22 nt, Homo sapiens
cuccauuuaucugaaauuuuau

SEQ ID NO: 366486 - RNA, 22 nt, Homo sapiens
cucugacagugguuagcacugu

SEQ ID NO: 366487 - RNA, 22 nt, Homo sapiens
cugaaucauugguuaugaguac

SEQ ID NO: 366488 - RNA, 22 nt, Homo sapiens
cugagguacugggggccaggau

SEQ ID NO: 366489 - RNA, 18 nt, Homo sapiens
cugccagugugcucuccg

SEQ ID NO: 366490 - RNA, 22 nt, Homo sapiens
cuggcacagugucagaaacaca

SEQ ID NO: 366491 - RNA, 22 nt, Homo sapiens
cugugaacaugggagaaauggc

SEQ ID NO: 366492 - RNA, 22 nt, Homo sapiens
cuuggcuugguaucaaauaacc

SEQ ID NO: 366493 - RNA, 22 nt, Homo sapiens
cuuggguugauugauaaugcca

SEQ ID NO: 366494 - RNA, 22 nt, Homo sapiens
cuuuggucaauugcugugggga

SEQ ID NO: 366495 - RNA, 22 nt, Homo sapiens
cuuuggugagggauaaauuuca

SEQ ID NO: 366496 - RNA, 20 nt, Homo sapiens
cuuuggugagucaacuccuu

SEQ ID NO: 366497 - RNA, 22 nt, Homo sapiens
cuuuggugauagauaccccaua

SEQ ID NO: 366498 - RNA, 22 nt, Homo sapiens
cuuugguggagucuuuagguuc

SEQ ID NO: 366499 - RNA, 22 nt, Homo sapiens
gaaagcugguauagauacauua

SEQ ID NO: 366500 - RNA, 22 nt, Homo sapiens
gaaauggaucagagcaagcuuu

SEQ ID NO: 366501 - RNA, 22 nt, Homo sapiens
gaacuguuucuggugaaagagu

SEQ ID NO: 366502 - RNA, 22 nt, Homo sapiens
gaagaucacacuguagaucuau

SEQ ID NO: 366503 - RNA, 22 nt, Homo sapiens
gaauagugcugcaauaaacaua

SEQ ID NO: 366504 - RNA, 22 nt, Homo sapiens
gaauagugcugcaaugaacaua

SEQ ID NO: 366505 - RNA, 22 nt, Homo sapiens
gaauggaacugacuauagcuga

SEQ ID NO: 366506 - RNA, 22 nt, Homo sapiens
gaauucugucgcuuacuagaug

SEQ ID NO: 366507 - RNA, 22 nt, Homo sapiens
gacugaggaagcgcucucuccu

SEQ ID NO: 366508 - RNA, 22 nt, Homo sapiens
gagaaccauuuggagaaaaagu

SEQ ID NO: 366509 - RNA, 22 nt, Homo sapiens
gagaacugagauaagugauauu

SEQ ID NO: 366510 - RNA, 22 nt, Homo sapiens
gagacugagucuugcuuuguca

SEQ ID NO: 366511 - RNA, 22 nt, Homo sapiens
gagaucaguuaaugaagugagc

SEQ ID NO: 366512 - RNA, 22 nt, Homo sapiens
gagguaugauugacauauaaaa

SEQ ID NO: 366513 - RNA, 23 nt, Homo sapiens
gaguacauuaaaagcccagacug

SEQ ID NO: 366514 - RNA, 22 nt, Homo sapiens
gauggcagugcagccccuggcu

SEQ ID NO: 366515 - RNA, 22 nt, Homo sapiens
gcacaggguuacauucuaaggu

SEQ ID NO: 366516 - RNA, 22 nt, Homo sapiens
gcagcacaugacuguauguaua

SEQ ID NO: 366517 - RNA, 22 nt, Homo sapiens
gcagguaguuucugacuuuuac

SEQ ID NO: 366518 - RNA, 22 nt, Homo sapiens
gcauauguuuggguguguauau

SEQ ID NO: 366519 - RNA, 22 nt, Homo sapiens
gccauugcacuacagccuaggc

SEQ ID NO: 366520 - RNA, 22 nt, Homo sapiens
gccauugcacuccagccuaggc

SEQ ID NO: 366521 - RNA, 22 nt, Homo sapiens
gccauugcacuccagccugagc

SEQ ID NO: 366522 - RNA, 22 nt, Homo sapiens
gccauugcacuccgcccugggc

SEQ ID NO: 366523 - RNA, 22 nt, Homo sapiens
gcugauguuggccucugggcuu

SEQ ID NO: 366524 - RNA, 22 nt, Homo sapiens
gcuggaauuaacauagaugugc

SEQ ID NO: 366525 - RNA, 22 nt, Homo sapiens
gcuuuggauaaaugucaguuua

SEQ ID NO: 366526 - RNA, 17 nt, Homo sapiens
ggaaugaauuccagccc

SEQ ID NO: 366527 - RNA, 22 nt, Homo sapiens
ggagaguaauuagacugaaaga

SEQ ID NO: 366528 - RNA, 22 nt, Homo sapiens
ggaggcuaguaaaaagguagaa

SEQ ID NO: 366529 - RNA, 22 nt, Homo sapiens
ggagggugagaucaauuuggga

SEQ ID NO: 366530 - RNA, 22 nt, Homo sapiens
ggagucugacuuauaggaaccu

SEQ ID NO: 366531 - RNA, 22 nt, Homo sapiens
ggcaaagagacaugcaucgggg

SEQ ID NO: 366532 - RNA, 22 nt, Homo sapiens
ggcacgguggcucacgccugua

SEQ ID NO: 366533 - RNA, 22 nt, Homo sapiens
ggcuagaauagggauagaccuu

SEQ ID NO: 366534 - RNA, 22 nt, Homo sapiens
aaagcacugaauaaauuugcuu

SEQ ID NO: 366535 - RNA, 22 nt, Homo sapiens
aacagcacacccgcugcuucca

SEQ ID NO: 366536 - RNA, 22 nt, Homo sapiens
aagagaacugacaguaccuggg

SEQ ID NO: 366537 - RNA, 22 nt, Homo sapiens
aagcuacauuuuauuuauguca

SEQ ID NO: 366538 - RNA, 22 nt, Homo sapiens
aagcuagugagacagugguacu

SEQ ID NO: 366539 - RNA, 22 nt, Homo sapiens
aagcucauugagaucuauggcu

SEQ ID NO: 366540 - RNA, 22 nt, Homo sapiens
aagcuccauuucugccaugaga

SEQ ID NO: 366541 - RNA, 22 nt, Homo sapiens
aagcuguauuguguugcuauaa

SEQ ID NO: 366542 - RNA, 22 nt, Homo sapiens
aaggaacuggaauauuuugaac

SEQ ID NO: 366543 - RNA, 23 nt, Homo sapiens
aaggacacugaacacuucccagc

SEQ ID NO: 366544 - RNA, 22 nt, Homo sapiens
aaggaguagaggaauagcaaug

SEQ ID NO: 366545 - RNA, 22 nt, Homo sapiens
aaucauauugucugccaagagg

SEQ ID NO: 366546 - RNA, 23 nt, Homo sapiens
aauugcacauuccuugcuggcag

SEQ ID NO: 366547 - RNA, 22 nt, Homo sapiens
acagcagugccccacucuacug

SEQ ID NO: 366548 - RNA, 19 nt, Homo sapiens
acauugcauuuguaggcuu

SEQ ID NO: 366549 - RNA, 22 nt, Homo sapiens
accaugcaguccaauaugcaca

SEQ ID NO: 366550 - RNA, 22 nt, Homo sapiens
accauugcacuccagccugggc

SEQ ID NO: 366551 - RNA, 17 nt, Homo sapiens
accccuaccucagaagc

SEQ ID NO: 366552 - RNA, 22 nt, Homo sapiens
acccugucaaaacggaccaauc

SEQ ID NO: 366553 - RNA, 22 nt, Homo sapiens
acccugucaaaauagaccaauc

SEQ ID NO: 366554 - RNA, 22 nt, Homo sapiens
acccugucauccacauggugcu

SEQ ID NO: 366555 - RNA, 22 nt, Homo sapiens
acuaugcuuuucuuagaauuaa

SEQ ID NO: 366556 - RNA, 22 nt, Homo sapiens
acugagccuuuaaaugacuuca

SEQ ID NO: 366557 - RNA, 22 nt, Homo sapiens
acugcaaugucgaauagagaug

SEQ ID NO: 366558 - RNA, 22 nt, Homo sapiens
acugcacuccagccucgcaaca

SEQ ID NO: 366559 - RNA, 20 nt, Homo sapiens
acuggcacugguaggugugg

SEQ ID NO: 366560 - RNA, 19 nt, Homo sapiens
acuuuggugauuagaggga

SEQ ID NO: 366561 - RNA, 22 nt, Homo sapiens
agaagaacauagggugacugaa

SEQ ID NO: 366562 - RNA, 22 nt, Homo sapiens
agacuguaaugcauaauuuacu

SEQ ID NO: 366563 - RNA, 22 nt, Homo sapiens
agagaacugauuggaguugggc

SEQ ID NO: 366564 - RNA, 22 nt, Homo sapiens
agagaucauuuuguuucaaauc

SEQ ID NO: 366565 - RNA, 22 nt, Homo sapiens
agagguagaagauaggcuacag

SEQ ID NO: 366566 - RNA, 22 nt, Homo sapiens
agaguaguuuauuaugcuaagg

SEQ ID NO: 366567 - RNA, 20 nt, Homo sapiens
agcauugguuagaacaguag

SEQ ID NO: 366568 - RNA, 20 nt, Homo sapiens
agccccauguaaaccacaug

SEQ ID NO: 366569 - RNA, 22 nt, Homo sapiens
agcuaguauuuucuuaaggauu

SEQ ID NO: 366570 - RNA, 18 nt, Homo sapiens
agcucaguguuugcuuac

SEQ ID NO: 366571 - RNA, 20 nt, Homo sapiens
agcugcagauauaaauccgc

SEQ ID NO: 366572 - RNA, 20 nt, Homo sapiens
agcuggguguguuggugcau

SEQ ID NO: 366573 - RNA, 22 nt, Homo sapiens
agcuguuguuuuaagauacuaa

SEQ ID NO: 366574 - RNA, 22 nt, Homo sapiens
agcuuguguuugucugccuggg

SEQ ID NO: 366575 - RNA, 22 nt, Homo sapiens
agcuuuggauaccugcuguucc

SEQ ID NO: 366576 - RNA, 22 nt, Homo sapiens
aggaagcuagcauuuguucagu

SEQ ID NO: 366577 - RNA, 22 nt, Homo sapiens
aggaauggaaacuuuugauggu

SEQ ID NO: 366578 - RNA, 18 nt, Homo sapiens
aggaaugguaauacuuca

SEQ ID NO: 366579 - RNA, 22 nt, Homo sapiens
aggcaacaugguaaaacccugu

SEQ ID NO: 366580 - RNA, 22 nt, Homo sapiens
agguccacuuacuacuccuguu

SEQ ID NO: 366581 - RNA, 22 nt, Homo sapiens
aggucccauguccucccugacc

SEQ ID NO: 366582 - RNA, 20 nt, Homo sapiens
agguucaaaucccaaucaug

SEQ ID NO: 366583 - RNA, 22 nt, Homo sapiens
agugaaaucugaagaaggucau

SEQ ID NO: 366584 - RNA, 19 nt, Homo sapiens
auaauuagcagugaggaca

SEQ ID NO: 366585 - RNA, 22 nt, Homo sapiens
auacugucucuugcuccugccc

SEQ ID NO: 366586 - RNA, 20 nt, Homo sapiens
aucaaagacuuagaggggga

SEQ ID NO: 366587 - RNA, 22 nt, Homo sapiens
aucacaauuguacguaggagcc

SEQ ID NO: 366588 - RNA, 22 nt, Homo sapiens
aucacagaguuaaaacuuucuu

SEQ ID NO: 366589 - RNA, 22 nt, Homo sapiens
aucacauggccagguaguaauc

SEQ ID NO: 366590 - RNA, 22 nt, Homo sapiens
auccaagagacugaugacuucc

SEQ ID NO: 366591 - RNA, 22 nt, Homo sapiens
aucgcgccauuguacuccagcc

SEQ ID NO: 366592 - RNA, 22 nt, Homo sapiens
aucuugcauuugcuaaaaugca

SEQ ID NO: 366593 - RNA, 22 nt, Homo sapiens
augaagugcaugauaguugguu

SEQ ID NO: 366594 - RNA, 22 nt, Homo sapiens
augagaugaggaauggcccucc

SEQ ID NO: 366595 - RNA, 22 nt, Homo sapiens
augaggaaggagccuuugucug

SEQ ID NO: 366596 - RNA, 22 nt, Homo sapiens
augagggcggacgcccuggaga

SEQ ID NO: 366597 - RNA, 22 nt, Homo sapiens
augaggugaggucaguaaggua

SEQ ID NO: 366598 - RNA, 22 nt, Homo sapiens
augcacuguuguuauuggauaa

SEQ ID NO: 366599 - RNA, 22 nt, Homo sapiens
augcagcugaggguaguggagc

SEQ ID NO: 366600 - RNA, 22 nt, Homo sapiens
auggaucuuucugcuuuugaau

SEQ ID NO: 366601 - RNA, 22 nt, Homo sapiens
auggcuagaaccuguauauuca

SEQ ID NO: 366602 - RNA, 22 nt, Homo sapiens
auggcuuucaggacguggcgag

SEQ ID NO: 366603 - RNA, 22 nt, Homo sapiens
auggcuuugggcugcucugccc

SEQ ID NO: 366604 - RNA, 22 nt, Homo sapiens
auggcuuuguguucagagcuga

SEQ ID NO: 366605 - RNA, 22 nt, Homo sapiens
auggcuuuugaccugguaggau

SEQ ID NO: 366606 - RNA, 22 nt, Homo sapiens
auggcuuuugcccuaaauggau

SEQ ID NO: 366607 - RNA, 22 nt, Homo sapiens
auguaacaguauuuggagaugu

SEQ ID NO: 366608 - RNA, 22 nt, Homo sapiens
auguaguaugaagaagaugcuu

SEQ ID NO: 366609 - RNA, 22 nt, Homo sapiens
auguccuaaucuccuguucuua

SEQ ID NO: 366610 - RNA, 22 nt, Homo sapiens
augugaacaucauagaaugcac

SEQ ID NO: 366611 - RNA, 20 nt, Homo sapiens
augugcuaauauuaauaugu

SEQ ID NO: 366612 - RNA, 22 nt, Homo sapiens
auguggugguagccaggacagg

SEQ ID NO: 366613 - RNA, 22 nt, Homo sapiens
auucuauaguccuaggauuggg

SEQ ID NO: 366614 - RNA, 18 nt, Homo sapiens
auugcacaccagccuggg

SEQ ID NO: 366615 - RNA, 22 nt, Homo sapiens
auugcacuccagccugggcuag

SEQ ID NO: 366616 - RNA, 22 nt, Homo sapiens
uugcacuguaauuuauuuaugu

SEQ ID NO: 366617 - RNA, 22 nt, Homo sapiens
uuggaaguguguauguauagcu

SEQ ID NO: 366618 - RNA, 19 nt, Homo sapiens
uuggaauuuuagaguuuga

SEQ ID NO: 366619 - RNA, 22 nt, Homo sapiens
uuggacaagauugcagagaauu

SEQ ID NO: 366620 - RNA, 22 nt, Homo sapiens
uuggagagagaggacucccggc

SEQ ID NO: 366621 - RNA, 22 nt, Homo sapiens
uuggaguguucugguccgggcu

SEQ ID NO: 366622 - RNA, 22 nt, Homo sapiens
uuggcuuuuaugcagcuuaggu

SEQ ID NO: 366623 - RNA, 22 nt, Homo sapiens
uugguuccauuuuaccagcucu

SEQ ID NO: 366624 - RNA, 22 nt, Homo sapiens
uuguaaucaacacaucauuggg

SEQ ID NO: 366625 - RNA, 18 nt, Homo sapiens
uugugccugagaaggugg

SEQ ID NO: 366626 - RNA, 22 nt, Homo sapiens
uuuuggacuugcuccccugucc

SEQ ID NO: 366627 - RNA, 22 nt, Homo sapiens
uuuugguaaugaacuuaggaag

SEQ ID NO: 366628 - RNA, 22 nt, Homo sapiens
aggugguuuugaugagcaggua

SEQ ID NO: 366629 - RNA, 22 nt, Homo sapiens
agguuguguuugugauuagaua

SEQ ID NO: 366630 - RNA, 22 nt, Homo sapiens
agugcacuccagccugggcaac

SEQ ID NO: 366631 - RNA, 22 nt, Homo sapiens
agugccacugcacucuagccug

SEQ ID NO: 366632 - RNA, 22 nt, Homo sapiens
aguggcuuuuuaguggcagaug

SEQ ID NO: 366633 - RNA, 22 nt, Homo sapiens
auacaguaucuucuggcaagca

SEQ ID NO: 366634 - RNA, 22 nt, Homo sapiens
auacaguguauguauaguacau

SEQ ID NO: 366635 - RNA, 22 nt, Homo sapiens
auacuguacugaaguacccauu

SEQ ID NO: 366636 - RNA, 22 nt, Homo sapiens
auagcagcaccccacuaccuca

SEQ ID NO: 366637 - RNA, 19 nt, Homo sapiens
auaguguaggaaaacagcu

SEQ ID NO: 366638 - RNA, 22 nt, Homo sapiens
auauaugcuaagugcuaauaaa

SEQ ID NO: 366639 - RNA, 22 nt, Homo sapiens
aucaagcuggcauauguaguuc

SEQ ID NO: 366640 - RNA, 22 nt, Homo sapiens
aucacagcccuccucuuggaug

SEQ ID NO: 366641 - RNA, 22 nt, Homo sapiens
aucacaggcaaaauuccuucuc

SEQ ID NO: 366642 - RNA, 22 nt, Homo sapiens
aucccuguaguaauauucuagc

SEQ ID NO: 366643 - RNA, 22 nt, Homo sapiens
aucccugugauccaaucacuuc

SEQ ID NO: 366644 - RNA, 22 nt, Homo sapiens
auccucugagaucuaggcagag

SEQ ID NO: 366645 - RNA, 22 nt, Homo sapiens
aucuucucuugaagggugggga

SEQ ID NO: 366646 - RNA, 22 nt, Homo sapiens
augaaugcuuuuggauguaucu

SEQ ID NO: 366647 - RNA, 22 nt, Homo sapiens
augagcagaugcuccugccucu

SEQ ID NO: 366648 - RNA, 22 nt, Homo sapiens
augauauggucacccuuaugaa

SEQ ID NO: 366649 - RNA, 22 nt, Homo sapiens
augaucuguagaacuaguccuu

SEQ ID NO: 366650 - RNA, 22 nt, Homo sapiens
augcacuguauaggaucuugcg

SEQ ID NO: 366651 - RNA, 22 nt, Homo sapiens
augcagagucccagccccuagc

SEQ ID NO: 366652 - RNA, 22 nt, Homo sapiens
auggaaagcuguuccuacacaa

SEQ ID NO: 366653 - RNA, 22 nt, Homo sapiens
auggaacauaacuauuugggga

SEQ ID NO: 366654 - RNA, 22 nt, Homo sapiens
auggaagucucuguuaaguuuc

SEQ ID NO: 366655 - RNA, 22 nt, Homo sapiens
auggaauggcacuuugaagauu

SEQ ID NO: 366656 - RNA, 22 nt, Homo sapiens
auggcacugaagcguauugaca

SEQ ID NO: 366657 - RNA, 22 nt, Homo sapiens
auguaguauuaaugagagauaa

SEQ ID NO: 366658 - RNA, 22 nt, Homo sapiens
auguggcuuuucaacuguguga

SEQ ID NO: 366659 - RNA, 22 nt, Homo sapiens
augugggaggacuuggcuguug

SEQ ID NO: 366660 - RNA, 22 nt, Homo sapiens
auugaacuguuggagagguuuu

SEQ ID NO: 366661 - RNA, 22 nt, Homo sapiens
auugaaucuaaaaugagucucu

SEQ ID NO: 366662 - RNA, 22 nt, Homo sapiens
auugcaccccagccugggugac

SEQ ID NO: 366663 - RNA, 22 nt, Homo sapiens
uccagaguggugaugcuggggc

SEQ ID NO: 366664 - RNA, 22 nt, Homo sapiens
uccaugugaaaucuaugaggac

SEQ ID NO: 366665 - RNA, 22 nt, Homo sapiens
ucgcagcucacuggagccucga

SEQ ID NO: 366666 - RNA, 22 nt, Homo sapiens
ucucauuggucugagucaccug

SEQ ID NO: 366667 - RNA, 22 nt, Homo sapiens
ucugacagugugaauauugacu

SEQ ID NO: 366668 - RNA, 22 nt, Homo sapiens
ucuggcacugaugugggaugcu

SEQ ID NO: 366669 - RNA, 22 nt, Homo sapiens
ucugguggugaugagagacagu

SEQ ID NO: 366670 - RNA, 22 nt, Homo sapiens
ucuucagucauauuggccugga

SEQ ID NO: 366671 - RNA, 22 nt, Homo sapiens
ucuuuggagacaaccccagucu

SEQ ID NO: 366672 - RNA, 22 nt, Homo sapiens
ugaacuguaagguauaggugau

SEQ ID NO: 366673 - RNA, 22 nt, Homo sapiens
ugaacuguugggggaaauucag

SEQ ID NO: 366674 - RNA, 22 nt, Homo sapiens
ugaaggacauaaggcagaguga

SEQ ID NO: 366675 - RNA, 22 nt, Homo sapiens
ugaaggaguauggauaagucgu

SEQ ID NO: 366676 - RNA, 22 nt, Homo sapiens
ugaaugcuaaaggaaaacagua

SEQ ID NO: 366677 - RNA, 22 nt, Homo sapiens
ugacagagaagcauugaguuca

SEQ ID NO: 366678 - RNA, 22 nt, Homo sapiens
ugacuaggaggcuggaggauga

SEQ ID NO: 366679 - RNA, 22 nt, Homo sapiens
ugagaccaacagauuccaguuc

SEQ ID NO: 366680 - RNA, 22 nt, Homo sapiens
ugagagacaguuuguuaaaauu

SEQ ID NO: 366681 - RNA, 22 nt, Homo sapiens
ugagagaugaacucugauaugu

SEQ ID NO: 366682 - RNA, 22 nt, Homo sapiens
ugagaucacgccacugcacucc

SEQ ID NO: 366683 - RNA, 22 nt, Homo sapiens
ugagaucacuaagagguaaugg

SEQ ID NO: 366684 - RNA, 22 nt, Homo sapiens
ugagaucagugaagaaguguuu

SEQ ID NO: 366685 - RNA, 22 nt, Homo sapiens
ugagaucaugccacugcacuuc

SEQ ID NO: 366686 - RNA, 22 nt, Homo sapiens
ugagcacagagccugggguggc

SEQ ID NO: 366687 - RNA, 22 nt, Homo sapiens
ugagguaagauguucauuuuuc

SEQ ID NO: 366688 - RNA, 22 nt, Homo sapiens
ugagguaaugcuguagcuguga

SEQ ID NO: 366689 - RNA, 22 nt, Homo sapiens
ugagguaggugaagaaugcacg

SEQ ID NO: 366690 - RNA, 22 nt, Homo sapiens
ugauggcauuuggaguugggac

SEQ ID NO: 366691 - RNA, 22 nt, Homo sapiens
ugcaagacacuguccugggcau

SEQ ID NO: 366692 - RNA, 22 nt, Homo sapiens
ugcaaucauuuggaggagaaga

SEQ ID NO: 366693 - RNA, 22 nt, Homo sapiens
ugcauguucuuacucauacaug

SEQ ID NO: 366694 - RNA, 22 nt, Homo sapiens
ugccaguuuuuacauuuccugu

SEQ ID NO: 366695 - RNA, 22 nt, Homo sapiens
ugccauugcacuccagccuggg

SEQ ID NO: 366696 - RNA, 22 nt, Homo sapiens
ugcuagaagaucacacacauca

SEQ ID NO: 366697 - RNA, 22 nt, Homo sapiens
ugcuggugauuaaauccugaag

SEQ ID NO: 366698 - RNA, 22 nt, Homo sapiens
ugcuuugguagaaaucuuuggu

SEQ ID NO: 366699 - RNA, 22 nt, Homo sapiens
uggaacugauauugauggaaaa

SEQ ID NO: 366700 - RNA, 22 nt, Homo sapiens
uggaaguaaccaugaauggaau

SEQ ID NO: 366701 - RNA, 20 nt, Homo sapiens
uggaaguaagaauauaggug

SEQ ID NO: 366702 - RNA, 22 nt, Homo sapiens
uggaaguagauagauuguguca

SEQ ID NO: 366703 - RNA, 22 nt, Homo sapiens
uggaaguauagauaauugaaag

SEQ ID NO: 366704 - RNA, 22 nt, Homo sapiens
uggaaucuuaggugaaggcuuu

SEQ ID NO: 366705 - RNA, 21 nt, Homo sapiens
uggaauguucugacuucaggg

SEQ ID NO: 366706 - RNA, 21 nt, Homo sapiens
uggaauuaauggagagguguu

SEQ ID NO: 366707 - RNA, 22 nt, Homo sapiens
uggagacaaagauagaaaagca

SEQ ID NO: 366708 - RNA, 22 nt, Homo sapiens
uggagguaggacgaagaacucu

SEQ ID NO: 366709 - RNA, 22 nt, Homo sapiens
uggaguguaauuagccaucagu

SEQ ID NO: 366710 - RNA, 22 nt, Homo sapiens
uggaguguuggggcaggaucuc

SEQ ID NO: 366711 - RNA, 22 nt, Homo sapiens
uggcaauguggaaugguccagg

SEQ ID NO: 366712 - RNA, 22 nt, Homo sapiens
uggccagagggcaauuagcugu

SEQ ID NO: 366713 - RNA, 22 nt, Homo sapiens
uggcuacagaaaguacuaguga

SEQ ID NO: 366714 - RNA, 22 nt, Homo sapiens
uggcucuguuuguuaacuagac

SEQ ID NO: 366715 - RNA, 22 nt, Homo sapiens
uggcuuuucauccugggacauu

SEQ ID NO: 366716 - RNA, 22 nt, Homo sapiens
ugguaagaucugugagccaggc

SEQ ID NO: 366717 - RNA, 20 nt, Homo sapiens
ugguaauguaagagaggaga

SEQ ID NO: 366718 - RNA, 22 nt, Homo sapiens
ugguggcuuuucguagguucac

SEQ ID NO: 366719 - RNA, 18 nt, Homo sapiens
ugucccuuugcuguucau

SEQ ID NO: 366720 - RNA, 22 nt, Homo sapiens
ugugaagaaagucauugguagc

SEQ ID NO: 366721 - RNA, 22 nt, Homo sapiens
uguugcacuccagccuagguga

SEQ ID NO: 366722 - RNA, 22 nt, Homo sapiens
uguugcacuccauccugggcga

SEQ ID NO: 366723 - RNA, 22 nt, Homo sapiens
uguugcacucuagccugggcaa

SEQ ID NO: 366724 - RNA, 22 nt, Homo sapiens
uguugcacugguaauguacuga

SEQ ID NO: 366725 - RNA, 22 nt, Homo sapiens
uuaaugcuuuugggauauuucu

SEQ ID NO: 366726 - RNA, 22 nt, Homo sapiens
uuacaagaugucuguccaacac

SEQ ID NO: 366727 - RNA, 22 nt, Homo sapiens
uuacagauggcacacucaaggg

SEQ ID NO: 366728 - RNA, 22 nt, Homo sapiens
uuaggcaggauaguuacauauu

SEQ ID NO: 366729 - RNA, 16 nt, Homo sapiens
uuaggcagugugauac

SEQ ID NO: 366730 - RNA, 22 nt, Homo sapiens
uuaggcaguuuauugauuuuca

SEQ ID NO: 366731 - RNA, 22 nt, Homo sapiens
uuagguuauuacugacaauaau

SEQ ID NO: 366732 - RNA, 22 nt, Homo sapiens
uuagugaaugggugugauuugu

SEQ ID NO: 366733 - RNA, 22 nt, Homo sapiens
uuagugcugaguggaauguucu

SEQ ID NO: 366734 - RNA, 22 nt, Homo sapiens
uuauuagguuaaccuauagcua

SEQ ID NO: 366735 - RNA, 22 nt, Homo sapiens
uuauucugucuuuggucucaau

SEQ ID NO: 366736 - RNA, 22 nt, Homo sapiens
uucaagauggcaccagugagug

SEQ ID NO: 366737 - RNA, 22 nt, Homo sapiens
uucacugcacuccagccugggu

SEQ ID NO: 366738 - RNA, 22 nt, Homo sapiens
uucacugcauuucagccugggc

SEQ ID NO: 366739 - RNA, 16 nt, Homo sapiens
uuccacagucgaggug

SEQ ID NO: 366740 - RNA, 22 nt, Homo sapiens
uucccaguaaacucuaucccuc

SEQ ID NO: 366741 - RNA, 22 nt, Homo sapiens
uucuaguacucccuggagcugg

SEQ ID NO: 366742 - RNA, 22 nt, Homo sapiens
uucuggcucaggucaacacuuc

SEQ ID NO: 366743 - RNA, 22 nt, Homo sapiens
uucuggcuuuuaaagaaauguu

SEQ ID NO: 366744 - RNA, 22 nt, Homo sapiens
uugaagguaauugguuuuauga

SEQ ID NO: 366745 - RNA, 22 nt, Homo sapiens
uugaaguauagaguuuaagaac

SEQ ID NO: 366746 - RNA, 22 nt, Homo sapiens
uugaaugaaauuggugugggga

SEQ ID NO: 366747 - RNA, 22 nt, Homo sapiens
uugaggaaugucauuuguguuu

SEQ ID NO: 366748 - RNA, 22 nt, Homo sapiens
uugagggaggccucaguuuaca

SEQ ID NO: 366749 - RNA, 22 nt, Homo sapiens
uugcacauguugaaccagcaaa

SEQ ID NO: 366750 - RNA, 22 nt, Homo sapiens
uugcacauuuuuucuggcagaa

SEQ ID NO: 366751 - RNA, 22 nt, Homo sapiens
uugcacuauaggaaaauguguc

SEQ ID NO: 366752 - RNA, 18 nt, Homo sapiens
uugcacuccugccugggu

SEQ ID NO: 366753 - RNA, 22 nt, Homo sapiens
uugcacugagauuuugcuuaca

SEQ ID NO: 366754 - RNA, 22 nt, Homo sapiens
aaaugcaccacucuggugcagg

SEQ ID NO: 366755 - RNA, 22 nt, Homo sapiens
aaaugcugcuuuggccucuucu

SEQ ID NO: 366756 - RNA, 22 nt, Homo sapiens
aagccacuguaccugucucuua

SEQ ID NO: 366757 - RNA, 22 nt, Homo sapiens
aagcuggauuucgcauccuguu

SEQ ID NO: 366758 - RNA, 22 nt, Homo sapiens
aaggcaacgugaguuguugauu

SEQ ID NO: 366759 - RNA, 20 nt, Homo sapiens
aagugaguguuaaacugaac

SEQ ID NO: 366760 - RNA, 22 nt, Homo sapiens
aaucacaguguucuugugaggg

SEQ ID NO: 366761 - RNA, 22 nt, Homo sapiens
aaugacccugauuggcaaguug

SEQ ID NO: 366762 - RNA, 22 nt, Homo sapiens
aaugcuguguuauuucaugacc

SEQ ID NO: 366763 - RNA, 22 nt, Homo sapiens
aauuacuucuacaccaaccuaa

SEQ ID NO: 366764 - RNA, 22 nt, Homo sapiens
aauugcacuacugcacucccac

SEQ ID NO: 366765 - RNA, 21 nt, Homo sapiens
acaaagcuggagggagacugc

SEQ ID NO: 366766 - RNA, 22 nt, Homo sapiens
acacaaugguaaguguuugugu

SEQ ID NO: 366767 - RNA, 22 nt, Homo sapiens
acagugcuucugauaugaugcc

SEQ ID NO: 366768 - RNA, 22 nt, Homo sapiens
acaugagacuggguuuguaggg

SEQ ID NO: 366769 - RNA, 22 nt, Homo sapiens
acccugucaaaauggaccaauc

SEQ ID NO: 366770 - RNA, 22 nt, Homo sapiens
acccugucagcuggccugggca

SEQ ID NO: 366771 - RNA, 22 nt, Homo sapiens
acugagacugagaauguuucuu

SEQ ID NO: 366772 - RNA, 22 nt, Homo sapiens
acugcacuccggccuggcaaca

SEQ ID NO: 366773 - RNA, 22 nt, Homo sapiens
agaagacuauucuggguugggc

SEQ ID NO: 366774 - RNA, 22 nt, Homo sapiens
agaauucugucauguuuauauu

SEQ ID NO: 366775 - RNA, 22 nt, Homo sapiens
agagauacauucugagaagugc

SEQ ID NO: 366776 - RNA, 22 nt, Homo sapiens
agagcaaugggugaauauuaaa

SEQ ID NO: 366777 - RNA, 22 nt, Homo sapiens
agcaccacauacuacagagaua

SEQ ID NO: 366778 - RNA, 22 nt, Homo sapiens
agcagauguuuagugagcgccu

SEQ ID NO: 366779 - RNA, 22 nt, Homo sapiens
agcaggacaauaugggaucagg

SEQ ID NO: 366780 - RNA, 22 nt, Homo sapiens
agccuguagugagcugugauug

SEQ ID NO: 366781 - RNA, 22 nt, Homo sapiens
agcuggaauuuaagguagauag

SEQ ID NO: 366782 - RNA, 21 nt, Homo sapiens
agcuuguguguaucacagugu

SEQ ID NO: 366783 - RNA, 21 nt, Homo sapiens
aggcaaaugaagcagccgcuc

SEQ ID NO: 366784 - RNA, 22 nt, Homo sapiens
aggcaugaaauacaugcauuga

SEQ ID NO: 366785 - RNA, 22 nt, Homo sapiens
aggcuuuuguuuuggucucagg

SEQ ID NO: 366786 - RNA, 22 nt, Homo sapiens
agguagcauagcgggaauauca

SEQ ID NO: 366787 - RNA, 21 nt, Homo sapiens
aggucaugaagauguucuaau

SEQ ID NO: 366788 - RNA, 22 nt, Homo sapiens
agcugccagucuuguaaggccu

SEQ ID NO: 366789 - RNA, 22 nt, Homo sapiens
aggaaauguuggucccauuucu

SEQ ID NO: 366790 - RNA, 22 nt, Homo sapiens
aggagguagggugugaaacagc

SEQ ID NO: 366791 - RNA, 22 nt, Homo sapiens
aggcuagacuuugagaauuuuu

SEQ ID NO: 366792 - RNA, 22 nt, Homo sapiens
agguauguauguaugggagaaa

SEQ ID NO: 366793 - RNA, 22 nt, Homo sapiens
aggugcaauggugguuuugugg

SEQ ID NO: 366794 - RNA, 22 nt, Homo sapiens
aggugcugagcagagaauccug

SEQ ID NO: 366795 - RNA, 22 nt, Homo sapiens
aguaaagcaucagcuagaugug

SEQ ID NO: 366796 - RNA, 17 nt, Homo sapiens
agugagaucauggcuua

SEQ ID NO: 366797 - RNA, 22 nt, Homo sapiens
agugcauuugcaucucaauaua

SEQ ID NO: 366798 - RNA, 22 nt, Homo sapiens
auaaauucauuuaagcuccuua

SEQ ID NO: 366799 - RNA, 22 nt, Homo sapiens
auacaagcaguccaacuccaua

SEQ ID NO: 366800 - RNA, 22 nt, Homo sapiens
auccacagugucaauguuguga

SEQ ID NO: 366801 - RNA, 22 nt, Homo sapiens
aucccuuucugauacuuucccu

SEQ ID NO: 366802 - RNA, 22 nt, Homo sapiens
aucugugguuguaugcauauua

SEQ ID NO: 366803 - RNA, 22 nt, Homo sapiens
augacuauugcacuuuccuggu

SEQ ID NO: 366804 - RNA, 19 nt, Homo sapiens
augagaacagacuccauuu

SEQ ID NO: 366805 - RNA, 22 nt, Homo sapiens
augagagcaacaccuucacuug

SEQ ID NO: 366806 - RNA, 22 nt, Homo sapiens
augagagugagagcagccccuu

SEQ ID NO: 366807 - RNA, 23 nt, Homo sapiens
augagguaucugagcccagaaau

SEQ ID NO: 366808 - RNA, 22 nt, Homo sapiens
augccaagagacaaagggaauc

SEQ ID NO: 366809 - RNA, 17 nt, Homo sapiens
auguaauccucaucucu

SEQ ID NO: 366810 - RNA, 21 nt, Homo sapiens
auguaaugaagaagccacugg

SEQ ID NO: 366811 - RNA, 22 nt, Homo sapiens
augugaacugaauuaauucaca

SEQ ID NO: 366812 - RNA, 22 nt, Homo sapiens
auucacuuuuauagacaggucu

SEQ ID NO: 366813 - RNA, 22 nt, Homo sapiens
auuccacagccgauaccaugac

SEQ ID NO: 366814 - RNA, 22 nt, Homo sapiens
auuccacaguuaacacagaccg

SEQ ID NO: 366815 - RNA, 22 nt, Homo sapiens
auuccacuuauaugagguaucu

SEQ ID NO: 366816 - RNA, 22 nt, Homo sapiens
auugcacuccagccuggaugac

SEQ ID NO: 366817 - RNA, 22 nt, Homo sapiens
auugcacuccagccuggcaaua

SEQ ID NO: 366818 - RNA, 21 nt, Homo sapiens
auugcacuccagccugggcga

SEQ ID NO: 366819 - RNA, 22 nt, Homo sapiens
auugcacuccauccuaggugac

SEQ ID NO: 366820 - RNA, 22 nt, Homo sapiens
auugcacuccggccugggugac

SEQ ID NO: 366821 - RNA, 18 nt, Homo sapiens
auugcacuccugccuggg

SEQ ID NO: 366822 - RNA, 22 nt, Homo sapiens
auuugucaauacacuucuucca

SEQ ID NO: 366823 - RNA, 22 nt, Homo sapiens
caagggguggaaaugguagugu

SEQ ID NO: 366824 - RNA, 22 nt, Homo sapiens
caaugcagcuuuuggagagaaa

SEQ ID NO: 366825 - RNA, 21 nt, Homo sapiens
caauggcacaaucucugcuca

SEQ ID NO: 366826 - RNA, 22 nt, Homo sapiens
caaugugcuuggggcacaugag

SEQ ID NO: 366827 - RNA, 22 nt, Homo sapiens
cacagugaacugguggguuuuu

SEQ ID NO: 366828 - RNA, 22 nt, Homo sapiens
caccaggugcccagcacggcca

SEQ ID NO: 366829 - RNA, 22 nt, Homo sapiens
cacugcacuccagcuugugggc

SEQ ID NO: 366830 - RNA, 22 nt, Homo sapiens
cacugcacuccagucccgucuc

SEQ ID NO: 366831 - RNA, 22 nt, Homo sapiens
cacuguggauggaacuauguga

SEQ ID NO: 366832 - RNA, 22 nt, Homo sapiens
cagagaucaugcaacugcucgc

SEQ ID NO: 366833 - RNA, 22 nt, Homo sapiens
cagauaguuguagauaugcagc

SEQ ID NO: 366834 - RNA, 20 nt, Homo sapiens
cagcuagugguaggagucgg

SEQ ID NO: 366835 - RNA, 22 nt, Homo sapiens
cagcuggugggagcuggguucc

SEQ ID NO: 366836 - RNA, 22 nt, Homo sapiens
cauggcacuggugggagugucu

SEQ ID NO: 366837 - RNA, 22 nt, Homo sapiens
cauugcacuccagccugaggga

SEQ ID NO: 366838 - RNA, 20 nt, Homo sapiens
cauugcacuccagcuugggc

SEQ ID NO: 366839 - RNA, 22 nt, Homo sapiens
ccaagccucaguuucccucugu

SEQ ID NO: 366840 - RNA, 22 nt, Homo sapiens
ccaaggcacugauucuguacuc

SEQ ID NO: 366841 - RNA, 22 nt, Homo sapiens
ccagccgggugcaguggcucac

SEQ ID NO: 366842 - RNA, 17 nt, Homo sapiens
ccaguuuucccucagug

SEQ ID NO: 366843 - RNA, 22 nt, Homo sapiens
ccauggcaauggucagucuauu

SEQ ID NO: 366844 - RNA, 21 nt, Homo sapiens
ccaugggacggaaugaauaca

SEQ ID NO: 366845 - RNA, 22 nt, Homo sapiens
ccauugcacuccauccugggca

SEQ ID NO: 366846 - RNA, 22 nt, Homo sapiens
cccagugguuacauaaggagua

SEQ ID NO: 366847 - RNA, 19 nt, Homo sapiens
cccuggcacauggaaaaug

SEQ ID NO: 366848 - RNA, 21 nt, Homo sapiens
ccugauguucacuuggccuuc

SEQ ID NO: 366849 - RNA, 22 nt, Homo sapiens
ccuggcacugagcaguguucua

SEQ ID NO: 366850 - RNA, 20 nt, Homo sapiens
cguugcacuccagccugggc

SEQ ID NO: 366851 - RNA, 22 nt, Homo sapiens
cuacagcagcccaguccccgaa

SEQ ID NO: 366852 - RNA, 22 nt, Homo sapiens
uugggcuugagggugcccaguc

SEQ ID NO: 366853 - RNA, 22 nt, Homo sapiens
uugguaccccugguguacuaau

SEQ ID NO: 366854 - RNA, 22 nt, Homo sapiens
uugugguugacuaaauuuguaa

SEQ ID NO: 366855 - RNA, 22 nt, Homo sapiens
uuguugcacugcuuuccuggcc

SEQ ID NO: 366856 - RNA, 22 nt, Homo sapiens
uuuauagucaggaacuugagga

SEQ ID NO: 366857 - RNA, 20 nt, Homo sapiens
uuucuccccuauaaaucuca

SEQ ID NO: 366858 - RNA, 20 nt, Homo sapiens
uuugaauguaaagcauguca

SEQ ID NO: 366859 - RNA, 22 nt, Homo sapiens
uuuuaguggaauauuuacaguu

SEQ ID NO: 366860 - RNA, 19 nt, Homo sapiens
uuuuccccuuucuuaagac

SEQ ID NO: 366861 - RNA, 22 nt, Homo sapiens
uuuuggacuucaauuugacacu

SEQ ID NO: 366862 - RNA, 22 nt, Homo sapiens
uuuuugaguaaauauaaauugu

SEQ ID NO: 366863 - RNA, 23 nt, Homo sapiens
auugcagucuugaacuccugggc

SEQ ID NO: 366864 - RNA, 22 nt, Homo sapiens
auugcuuuuacugggagcuuug

SEQ ID NO: 366865 - RNA, 22 nt, Homo sapiens
auuggacagcauuucuagacuu

SEQ ID NO: 366866 - RNA, 22 nt, Homo sapiens
cacaggccugucucuuucuaac

SEQ ID NO: 366867 - RNA, 23 nt, Homo sapiens
caccaguagaaugugugggaggg

SEQ ID NO: 366868 - RNA, 22 nt, Homo sapiens
cacugcacuccagucuggcgac

SEQ ID NO: 366869 - RNA, 21 nt, Homo sapiens
cacugcaucacaggacagcau

SEQ ID NO: 366870 - RNA, 22 nt, Homo sapiens
cagagguauugcaaaagccuag

SEQ ID NO: 366871 - RNA, 22 nt, Homo sapiens
cagcugaugucgaaugcacucu

SEQ ID NO: 366872 - RNA, 22 nt, Homo sapiens
cauagcacugagcucuacccuc

SEQ ID NO: 366873 - RNA, 22 nt, Homo sapiens
cauagcacugcacuucagccug

SEQ ID NO: 366874 - RNA, 22 nt, Homo sapiens
caucacagcaaguagggagugg

SEQ ID NO: 366875 - RNA, 22 nt, Homo sapiens
caucccauucgaggggcacagc

SEQ ID NO: 366876 - RNA, 22 nt, Homo sapiens
caugcauagccauucauucguu

SEQ ID NO: 366877 - RNA, 22 nt, Homo sapiens
caugccacugcacgccauccug

SEQ ID NO: 366878 - RNA, 22 nt, Homo sapiens
cauggcacuguaugaaaugugc

SEQ ID NO: 366879 - RNA, 22 nt, Homo sapiens
cauuacacuccagccuggguga

SEQ ID NO: 366880 - RNA, 22 nt, Homo sapiens
cauugcaguggaguggggaaga

SEQ ID NO: 366881 - RNA, 20 nt, Homo sapiens
cauugcccuccagccugggc

SEQ ID NO: 366882 - RNA, 23 nt, Homo sapiens
ccacacuguuuagaauggcauca

SEQ ID NO: 366883 - RNA, 22 nt, Homo sapiens
ccagaauucucauuggaaggaa

SEQ ID NO: 366884 - RNA, 22 nt, Homo sapiens
ccaguuuucaagauaaugguuu

SEQ ID NO: 366885 - RNA, 22 nt, Homo sapiens
ccauugcacuccagccuaggca

SEQ ID NO: 366886 - RNA, 22 nt, Homo sapiens
cccugaagaaagccuaggacau

SEQ ID NO: 366887 - RNA, 22 nt, Homo sapiens
cccugaagacuccaccgucaug

SEQ ID NO: 366888 - RNA, 22 nt, Homo sapiens
ccuaggcacugggguccagccc

SEQ ID NO: 366889 - RNA, 22 nt, Homo sapiens
cuaaaguagccaggacugcagg

SEQ ID NO: 366890 - RNA, 17 nt, Homo sapiens
cuaaggcaagagucugc

SEQ ID NO: 366891 - RNA, 22 nt, Homo sapiens
cuaggugauccacugcucucuu

SEQ ID NO: 366892 - RNA, 22 nt, Homo sapiens
cucacaguucuaaaggcaagaa

SEQ ID NO: 366893 - RNA, 17 nt, Homo sapiens
cucacugagaacagcua

SEQ ID NO: 366894 - RNA, 21 nt, Homo sapiens
cucucugcuuaugaauaguga

SEQ ID NO: 366895 - RNA, 22 nt, Homo sapiens
cucuuggguagauuuugcagag

SEQ ID NO: 366896 - RNA, 22 nt, Homo sapiens
cugagagaugagaccucucacu

SEQ ID NO: 366897 - RNA, 20 nt, Homo sapiens
cugagguugggguccuuccc

SEQ ID NO: 366898 - RNA, 22 nt, Homo sapiens
cuggccagagacauucauuaaa

SEQ ID NO: 366899 - RNA, 22 nt, Homo sapiens
cugggaugugacuguugccccc

SEQ ID NO: 366900 - RNA, 17 nt, Homo sapiens
cuucaaauaauuucccc

SEQ ID NO: 366901 - RNA, 20 nt, Homo sapiens
cuuccaguggccccaucuuu

SEQ ID NO: 366902 - RNA, 22 nt, Homo sapiens
cuugucacuguuggcuuuagaa

SEQ ID NO: 366903 - RNA, 18 nt, Homo sapiens
cuuugcagcuuccagagg

SEQ ID NO: 366904 - RNA, 23 nt, Homo sapiens
cuuuguccccacccaaaucucau

SEQ ID NO: 366905 - RNA, 22 nt, Homo sapiens
gaauagugcugcaagaaacaua

SEQ ID NO: 366906 - RNA, 22 nt, Homo sapiens
gaauagugcugcagcaaacaua

SEQ ID NO: 366907 - RNA, 22 nt, Homo sapiens
gaauagugcugcaguaaacaua

SEQ ID NO: 366908 - RNA, 22 nt, Homo sapiens
gaauagugcugcgauaaacaua

SEQ ID NO: 366909 - RNA, 22 nt, Homo sapiens
gacuggccuauaauggcgaauu

SEQ ID NO: 366910 - RNA, 23 nt, Homo sapiens
gagaccagcuucagaaagcacga

SEQ ID NO: 366911 - RNA, 22 nt, Homo sapiens
gagagugugucagaggcugcga

SEQ ID NO: 366912 - RNA, 22 nt, Homo sapiens
gagaugaaguuaaggaucuuua

SEQ ID NO: 366913 - RNA, 22 nt, Homo sapiens
gagaugguacacauacgauucu

SEQ ID NO: 366914 - RNA, 22 nt, Homo sapiens
gagcuaguagauuuuaaauauu

SEQ ID NO: 366915 - RNA, 22 nt, Homo sapiens
gauaaaucuuggcuagucuaag

SEQ ID NO: 366916 - RNA, 22 nt, Homo sapiens
gcagcacauggcagaacauauu

SEQ ID NO: 366917 - RNA, 22 nt, Homo sapiens
gccauugcacucuagccugagc

SEQ ID NO: 366918 - RNA, 22 nt, Homo sapiens
gcgcagugggcugugccaucca

SEQ ID NO: 366919 - RNA, 23 nt, Homo sapiens
gcuaggagagaugaaacacaggu

SEQ ID NO: 366920 - RNA, 22 nt, Homo sapiens
gcugagcuaugccauauaugcc

SEQ ID NO: 366921 - RNA, 22 nt, Homo sapiens
gcuguugguaaaaaggacauga

SEQ ID NO: 366922 - RNA, 22 nt, Homo sapiens
gcuuggugugcaagugguacua

SEQ ID NO: 366923 - RNA, 22 nt, Homo sapiens
gcuuugguucaaccaggcaauu

SEQ ID NO: 366924 - RNA, 22 nt, Homo sapiens
ggagucugauguucuaaggcag

SEQ ID NO: 366925 - RNA, 22 nt, Homo sapiens
ggagucugauuuuuauguugcu

SEQ ID NO: 366926 - RNA, 22 nt, Homo sapiens
ggaguguguaggagaaagguaa

SEQ ID NO: 366927 - RNA, 22 nt, Homo sapiens
ggcaaaugaagauggagaggcu

SEQ ID NO: 366928 - RNA, 23 nt, Homo sapiens
ggcacggaauucaaagaggcauu

SEQ ID NO: 366929 - RNA, 22 nt, Homo sapiens
ggcaugaugcgcacgccuguag

SEQ ID NO: 366930 - RNA, 22 nt, Homo sapiens
ggcgguguugauggcccccaca

SEQ ID NO: 366931 - RNA, 22 nt, Homo sapiens
ggcucaguuuccuccgucugcu

SEQ ID NO: 366932 - RNA, 22 nt, Homo sapiens
gggagcacaagaaauguuucau

SEQ ID NO: 366933 - RNA, 22 nt, Homo sapiens
gggaggucauuguaaggucuua

SEQ ID NO: 366934 - RNA, 19 nt, Homo sapiens
ggcucagucaacugacugu

SEQ ID NO: 366935 - RNA, 22 nt, Homo sapiens
ggcucaguugcaaaucaguuca

SEQ ID NO: 366936 - RNA, 22 nt, Homo sapiens
ggcuuuggucacacaggggcaa

SEQ ID NO: 366937 - RNA, 22 nt, Homo sapiens
gggaugaagcccuaggguuggu

SEQ ID NO: 366938 - RNA, 22 nt, Homo sapiens
gggauuguaauacugaguuggu

SEQ ID NO: 366939 - RNA, 22 nt, Homo sapiens
ggguaggcaagcggaugucaga

SEQ ID NO: 366940 - RNA, 22 nt, Homo sapiens
guaaguagcuuuagauauaaau

SEQ ID NO: 366941 - RNA, 22 nt, Homo sapiens
guaaucucagcuacucgggaga

SEQ ID NO: 366942 - RNA, 22 nt, Homo sapiens
guaaucucagcuacuugggagg

SEQ ID NO: 366943 - RNA, 22 nt, Homo sapiens
gucaagagaacuuucuaucacu

SEQ ID NO: 366944 - RNA, 22 nt, Homo sapiens
gucacugccugaggcugaugca

SEQ ID NO: 366945 - RNA, 22 nt, Homo sapiens
gucucacaggcaugaugccagc

SEQ ID NO: 366946 - RNA, 17 nt, Homo sapiens
gugaaaucaucauuuuu

SEQ ID NO: 366947 - RNA, 22 nt, Homo sapiens
gugcaaauguuauugagguuuu

SEQ ID NO: 366948 - RNA, 22 nt, Homo sapiens
gugcaguguuugcauggaauca

SEQ ID NO: 366949 - RNA, 22 nt, Homo sapiens
guggaaguuaagugacuuucug

SEQ ID NO: 366950 - RNA, 22 nt, Homo sapiens
guggacggagguugcagugagc

SEQ ID NO: 366951 - RNA, 22 nt, Homo sapiens
guggcaagaugacuacucacug

SEQ ID NO: 366952 - RNA, 22 nt, Homo sapiens
guggcagaacagguaggguucu

SEQ ID NO: 366953 - RNA, 22 nt, Homo sapiens
gugguuuuaauauucagucuag

SEQ ID NO: 366954 - RNA, 22 nt, Homo sapiens
gugguuuuacaaagagaaagau

SEQ ID NO: 366955 - RNA, 22 nt, Homo sapiens
gugguuuuaucccagaaauuaa

SEQ ID NO: 366956 - RNA, 22 nt, Homo sapiens
uaaagaugcugggaaggcuagg

SEQ ID NO: 366957 - RNA, 22 nt, Homo sapiens
uaaggaguagaauaguaaggca

SEQ ID NO: 366958 - RNA, 22 nt, Homo sapiens
uaaggcacauaggccuggaaac

SEQ ID NO: 366959 - RNA, 22 nt, Homo sapiens
uaaggcacccuucugaguagag

SEQ ID NO: 366960 - RNA, 22 nt, Homo sapiens
uaauauguauacagacagauac

SEQ ID NO: 366961 - RNA, 22 nt, Homo sapiens
uaauccuagcacuuuggaagac

SEQ ID NO: 366962 - RNA, 22 nt, Homo sapiens
uacaaguauuuuuauuagugcc

SEQ ID NO: 366963 - RNA, 22 nt, Homo sapiens
uagaaugaaacaagcugugccu

SEQ ID NO: 366964 - RNA, 23 nt, Homo sapiens
uagaauguuuuuccauguuucuu

SEQ ID NO: 366965 - RNA, 22 nt, Homo sapiens
uagagguagguguaugaacuag

SEQ ID NO: 366966 - RNA, 22 nt, Homo sapiens
uagcagcauuuuuguagaguau

SEQ ID NO: 366967 - RNA, 22 nt, Homo sapiens
uaugagagcugguagguagaga

SEQ ID NO: 366968 - RNA, 22 nt, Homo sapiens
uauucacuguaucauugauggg

SEQ ID NO: 366969 - RNA, 22 nt, Homo sapiens
ucaacagugggcacuguaaaug

SEQ ID NO: 366970 - RNA, 22 nt, Homo sapiens
ucaaggcacuagcugagcugca

SEQ ID NO: 366971 - RNA, 22 nt, Homo sapiens
ucaaggcaguggccuuccuucu

SEQ ID NO: 366972 - RNA, 22 nt, Homo sapiens
ucacagauaaauaaagaugauu

SEQ ID NO: 366973 - RNA, 22 nt, Homo sapiens
ucacagccuaguuuuauacauu

SEQ ID NO: 366974 - RNA, 22 nt, Homo sapiens
ucacauguguaugagcuuugau

SEQ ID NO: 366975 - RNA, 21 nt, Homo sapiens
ucaccuguugcgaugaagcug

SEQ ID NO: 366976 - RNA, 22 nt, Homo sapiens
ucacugagaaugauguuucuga

SEQ ID NO: 366977 - RNA, 22 nt, Homo sapiens
ucacuguguauguauaugcagg

SEQ ID NO: 366978 - RNA, 22 nt, Homo sapiens
ucacuuuguauagcgacuggcu

SEQ ID NO: 366979 - RNA, 22 nt, Homo sapiens
ucagggacgcuugacacaagcc

SEQ ID NO: 366980 - RNA, 22 nt, Homo sapiens
ucagugaauacauguacucaug

SEQ ID NO: 366981 - RNA, 23 nt, Homo sapiens
ucaugaggccauucaaauccauu

SEQ ID NO: 366982 - RNA, 22 nt, Homo sapiens
ucaugggagcccccaucaugag

SEQ ID NO: 366983 - RNA, 22 nt, Homo sapiens
ucauggggugagcuacaggcac

SEQ ID NO: 366984 - RNA, 22 nt, Homo sapiens
ucauguguugcacugaggaccu

SEQ ID NO: 366985 - RNA, 22 nt, Homo sapiens
uccaagaugcuggcagcuacag

SEQ ID NO: 366986 - RNA, 22 nt, Homo sapiens
gcaagaaugagaaggauuaauu

SEQ ID NO: 366987 - RNA, 22 nt, Homo sapiens
gcaugcacaugugaaaaaauga

SEQ ID NO: 366988 - RNA, 22 nt, Homo sapiens
gcaugcacuguauuuaaguauc

SEQ ID NO: 366989 - RNA, 22 nt, Homo sapiens
gccauugcacuccagccucggg

SEQ ID NO: 366990 - RNA, 22 nt, Homo sapiens
gccauugcacuccagcuugggc

SEQ ID NO: 366991 - RNA, 22 nt, Homo sapiens
ggaaagacuauuguaaaggaug

SEQ ID NO: 366992 - RNA, 20 nt, Homo sapiens
ggaauagucuacacucugac

SEQ ID NO: 366993 - RNA, 22 nt, Homo sapiens
ggagucugaacuggacaaugac

SEQ ID NO: 366994 - RNA, 22 nt, Homo sapiens
ggccagaugaucuaugaaggaa

SEQ ID NO: 366995 - RNA, 22 nt, Homo sapiens
ggccuguaaacuagagacccug

SEQ ID NO: 366996 - RNA, 22 nt, Homo sapiens
ggccuguaggguauugguaggg

SEQ ID NO: 366997 - RNA, 22 nt, Homo sapiens
ggcuagagagcucagggauaug

SEQ ID NO: 366998 - RNA, 22 nt, Homo sapiens
ggcucagugaucuguuucugua

SEQ ID NO: 366999 - RNA, 22 nt, Homo sapiens
ggcucagugggguccugguucu

SEQ ID NO: 367000 - RNA, 22 nt, Homo sapiens
gggaaugaagagaaccuuccca

SEQ ID NO: 367001 - RNA, 18 nt, Homo sapiens
gggcaaguugccuggcuu

SEQ ID NO: 367002 - RNA, 22 nt, Homo sapiens
ggucaacaucaucaugguaagu

SEQ ID NO: 367003 - RNA, 22 nt, Homo sapiens
gguggcaaaucugaguggcgcu

SEQ ID NO: 367004 - RNA, 22 nt, Homo sapiens
guaaucucagcuacucgggagg

SEQ ID NO: 367005 - RNA, 22 nt, Homo sapiens
guaaucucagcuacuugggagu

SEQ ID NO: 367006 - RNA, 22 nt, Homo sapiens
guaaucucagcuucuugggagg

SEQ ID NO: 367007 - RNA, 22 nt, Homo sapiens
guagaaaguuugcugucacaug

SEQ ID NO: 367008 - RNA, 22 nt, Homo sapiens
gucauguuuaacuucuugagga

SEQ ID NO: 367009 - RNA, 22 nt, Homo sapiens
gucauugcacuccagccuggac

SEQ ID NO: 367010 - RNA, 20 nt, Homo sapiens
guccauuugcugccauugcu

SEQ ID NO: 367011 - RNA, 22 nt, Homo sapiens
gucucccaaccccugugcccag

SEQ ID NO: 367012 - RNA, 22 nt, Homo sapiens
gugaaaugaaucuggaaauauu

SEQ ID NO: 367013 - RNA, 17 nt, Homo sapiens
gugagguggguaguauc

SEQ ID NO: 367014 - RNA, 22 nt, Homo sapiens
gugcacaugcgugcgcacauau

SEQ ID NO: 367015 - RNA, 22 nt, Homo sapiens
guggagucaucacucagagugg

SEQ ID NO: 367016 - RNA, 22 nt, Homo sapiens
gugggguagcaggcuccuaucu

SEQ ID NO: 367017 - RNA, 22 nt, Homo sapiens
guguugcacauucuguggaugu

SEQ ID NO: 367018 - RNA, 22 nt, Homo sapiens
guucaagcaauucugcugccuc

SEQ ID NO: 367019 - RNA, 22 nt, Homo sapiens
guugcacagucuuuccuggacu

SEQ ID NO: 367020 - RNA, 21 nt, Homo sapiens
uaaaacuguaacuuuguccug

SEQ ID NO: 367021 - RNA, 18 nt, Homo sapiens
uaaaggcacuguguuguu

SEQ ID NO: 367022 - RNA, 22 nt, Homo sapiens
uaacaccuuugauagcacuuuu

SEQ ID NO: 367023 - RNA, 18 nt, Homo sapiens
uaacagucucucaggauc

SEQ ID NO: 367024 - RNA, 22 nt, Homo sapiens
uaaggcacucuucugugugccu

SEQ ID NO: 367025 - RNA, 22 nt, Homo sapiens
uaauacuagugaauagcaggau

SEQ ID NO: 367026 - RNA, 22 nt, Homo sapiens
uaauagcaguguuacuaggacu

SEQ ID NO: 367027 - RNA, 22 nt, Homo sapiens
uaauccuggcacuuugggaggc

SEQ ID NO: 367028 - RNA, 22 nt, Homo sapiens
uaauugcaguucuguguuauau

SEQ ID NO: 367029 - RNA, 22 nt, Homo sapiens
uacaagcaggaaaugguauaug

SEQ ID NO: 367030 - RNA, 22 nt, Homo sapiens
uacaggauagacaauuuauuaa

SEQ ID NO: 367031 - RNA, 22 nt, Homo sapiens
uagaaugucagcuucuugaggg

SEQ ID NO: 367032 - RNA, 22 nt, Homo sapiens
uagcaagaugaauuugugcaaa

SEQ ID NO: 367033 - RNA, 22 nt, Homo sapiens
uagcccagugagguugauuugg

SEQ ID NO: 367034 - RNA, 22 nt, Homo sapiens
uagcuaguauuuugcugaggau

SEQ ID NO: 367035 - RNA, 22 nt, Homo sapiens
uagcuccagugggguuacugcu

SEQ ID NO: 367036 - RNA, 22 nt, Homo sapiens
uagguagguggaaaaguaauug

SEQ ID NO: 367037 - RNA, 22 nt, Homo sapiens
uaguagcaccucucaugagcuu

SEQ ID NO: 367038 - RNA, 22 nt, Homo sapiens
uaguuuaucuucuggauggaca

SEQ ID NO: 367039 - RNA, 20 nt, Homo sapiens
uaugaaacaguguagagcaa

SEQ ID NO: 367040 - RNA, 22 nt, Homo sapiens
ucaaggcacauuugacauuuuc

SEQ ID NO: 367041 - RNA, 22 nt, Homo sapiens
ucacaaguguauagacaugucc

SEQ ID NO: 367042 - RNA, 22 nt, Homo sapiens
ucacagacugagccaaauagag

SEQ ID NO: 367043 - RNA, 22 nt, Homo sapiens
ucacaucucagguuucuugaca

SEQ ID NO: 367044 - RNA, 22 nt, Homo sapiens
ucagaguagcugucugaggugc

SEQ ID NO: 367045 - RNA, 22 nt, Homo sapiens
ucagggacuuacaaaccagaag

SEQ ID NO: 367046 - RNA, 22 nt, Homo sapiens
ucaguggagccucacucugugg

SEQ ID NO: 367047 - RNA, 22 nt, Homo sapiens
ucccacugucuucucgugcucg

SEQ ID NO: 367048 - RNA, 22 nt, Homo sapiens
uccugagagcagacccucuaua

SEQ ID NO: 367049 - RNA, 22 nt, Homo sapiens
ucucaagaugguagaugggaau

SEQ ID NO: 367050 - RNA, 22 nt, Homo sapiens
ucucaugaagauagagaauaga

SEQ ID NO: 367051 - RNA, 22 nt, Homo sapiens
ucucaugaagguggagaguagg

SEQ ID NO: 367052 - RNA, 17 nt, Homo sapiens
ucucccaucccuuucuc

SEQ ID NO: 367053 - RNA, 22 nt, Homo sapiens
ucucccauccguacacggauug

SEQ ID NO: 367054 - RNA, 22 nt, Homo sapiens
ucugacacagugauuaguaaau

SEQ ID NO: 367055 - RNA, 22 nt, Homo sapiens
ucugaguggcagaaugagcuga

SEQ ID NO: 367056 - RNA, 22 nt, Homo sapiens
ucuggcacucagaggccuugcu

SEQ ID NO: 367057 - RNA, 22 nt, Homo sapiens
ucuguugguucuuugaggagga

SEQ ID NO: 367058 - RNA, 22 nt, Homo sapiens
ucuuaguuuagauuagcaauuc

SEQ ID NO: 367059 - RNA, 22 nt, Homo sapiens
ucuugcaguucccaaauucaca

SEQ ID NO: 367060 - RNA, 22 nt, Homo sapiens
ucuuuggaggcgaucuguuuga

SEQ ID NO: 367061 - RNA, 22 nt, Homo sapiens
ugaagcuaacuugauugugaug

SEQ ID NO: 367062 - RNA, 22 nt, Homo sapiens
ugacaagggaaaugcaaaaugu

SEQ ID NO: 367063 - RNA, 22 nt, Homo sapiens
ugacaugaaggcaccucugucc

SEQ ID NO: 367064 - RNA, 22 nt, Homo sapiens
ugacaugauguuccuacacugu

SEQ ID NO: 367065 - RNA, 19 nt, Homo sapiens
ugaccagggacagaaacca

SEQ ID NO: 367066 - RNA, 22 nt, Homo sapiens
ugacuaaaacugaguuucauua

SEQ ID NO: 367067 - RNA, 22 nt, Homo sapiens
ugagaacuaaugaagaauuuau

SEQ ID NO: 367068 - RNA, 22 nt, Homo sapiens
ugagaucaacugagucagagca

SEQ ID NO: 367069 - RNA, 22 nt, Homo sapiens
ugagaucaagguuaauauaauc

SEQ ID NO: 367070 - RNA, 22 nt, Homo sapiens
ugagaucagaaggauuucucug

SEQ ID NO: 367071 - RNA, 22 nt, Homo sapiens
ugagaucaugucauuugcacuc

SEQ ID NO: 367072 - RNA, 22 nt, Homo sapiens
ugagaucugauaggccuggguu

SEQ ID NO: 367073 - RNA, 22 nt, Homo sapiens
ugagaucuuuuguggcugagaa

SEQ ID NO: 367074 - RNA, 22 nt, Homo sapiens
ugagaugagggcugcacucaaa

SEQ ID NO: 367075 - RNA, 20 nt, Homo sapiens
ugagccccuggacucaagcg

SEQ ID NO: 367076 - RNA, 22 nt, Homo sapiens
ugagcugguacuaauauuauca

SEQ ID NO: 367077 - RNA, 22 nt, Homo sapiens
ugaggaguauguucuguagacc

SEQ ID NO: 367078 - RNA, 22 nt, Homo sapiens
auggcccccuguuugugaacau

SEQ ID NO: 367079 - RNA, 22 nt, Homo sapiens
auggcuagauuguaugguaguu

SEQ ID NO: 367080 - RNA, 22 nt, Homo sapiens
auggcuuuaagagugucugaau

SEQ ID NO: 367081 - RNA, 22 nt, Homo sapiens
auggcuuuggucucccagugau

SEQ ID NO: 367082 - RNA, 22 nt, Homo sapiens
auggcuuuuuucuugggcacuc

SEQ ID NO: 367083 - RNA, 22 nt, Homo sapiens
augguauggaaggucuggagga

SEQ ID NO: 367084 - RNA, 22 nt, Homo sapiens
auguaguagcagaaaauauuuu

SEQ ID NO: 367085 - RNA, 22 nt, Homo sapiens
augucaacauagacaguagagu

SEQ ID NO: 367086 - RNA, 22 nt, Homo sapiens
augucaaggugggugauaguuu

SEQ ID NO: 367087 - RNA, 22 nt, Homo sapiens
augucuggcagaagacuucuca

SEQ ID NO: 367088 - RNA, 22 nt, Homo sapiens
auguugcaguuuaauuauccua

SEQ ID NO: 367089 - RNA, 22 nt, Homo sapiens
auuagugaaugugaugucuuga

SEQ ID NO: 367090 - RNA, 19 nt, Homo sapiens
auugcacuccaaccugggu

SEQ ID NO: 367091 - RNA, 22 nt, Homo sapiens
auugcacuccagcccgggugac

SEQ ID NO: 367092 - RNA, 22 nt, Homo sapiens
auugcacuccagccucggugac

SEQ ID NO: 367093 - RNA, 22 nt, Homo sapiens
auugcacuccagccugggcgac

SEQ ID NO: 367094 - RNA, 22 nt, Homo sapiens
auugcacuccagccugggugag

SEQ ID NO: 367095 - RNA, 22 nt, Homo sapiens
auugcacucuaaccuaggugac

SEQ ID NO: 367096 - RNA, 22 nt, Homo sapiens
auuggcuuuugaaagucugcga

SEQ ID NO: 367097 - RNA, 22 nt, Homo sapiens
caccagguuggagugcaguggu

SEQ ID NO: 367098 - RNA, 22 nt, Homo sapiens
cacugcacuccagcuuugguga

SEQ ID NO: 367099 - RNA, 22 nt, Homo sapiens
cagaaguauugguaugcucugu

SEQ ID NO: 367100 - RNA, 22 nt, Homo sapiens
cagcuaguaauuuauugaagau

SEQ ID NO: 367101 - RNA, 18 nt, Homo sapiens
cagugcaauacaggagag

SEQ ID NO: 367102 - RNA, 22 nt, Homo sapiens
caguuguuuuaugacauaagau

SEQ ID NO: 367103 - RNA, 18 nt, Homo sapiens
cauagcacuucagcacau

SEQ ID NO: 367104 - RNA, 22 nt, Homo sapiens
caucgcacuccagccuggguaa

SEQ ID NO: 367105 - RNA, 22 nt, Homo sapiens
caugaaagugagaaacuccugg

SEQ ID NO: 367106 - RNA, 22 nt, Homo sapiens
cauggagcuaggcuugaucccu

SEQ ID NO: 367107 - RNA, 22 nt, Homo sapiens
cauggcuuuauuuucagcuucu

SEQ ID NO: 367108 - RNA, 22 nt, Homo sapiens
caugggacugucuuggcuauac

SEQ ID NO: 367109 - RNA, 22 nt, Homo sapiens
caugucuuuuaaacauucaacu

SEQ ID NO: 367110 - RNA, 20 nt, Homo sapiens
cauuccacuuuccugucagu

SEQ ID NO: 367111 - RNA, 22 nt, Homo sapiens
cauugcacuccagccugaguga

SEQ ID NO: 367112 - RNA, 20 nt, Homo sapiens
cauugcacuccagccugcug

SEQ ID NO: 367113 - RNA, 22 nt, Homo sapiens
cauugcacuccagcucugggcg

SEQ ID NO: 367114 - RNA, 22 nt, Homo sapiens
cauugcacucuagucuggguga

SEQ ID NO: 367115 - RNA, 22 nt, Homo sapiens
ccaccuguacuuaagucacuuu

SEQ ID NO: 367116 - RNA, 22 nt, Homo sapiens
ccaguuuucccagcaccauuaa

SEQ ID NO: 367117 - RNA, 22 nt, Homo sapiens
ccaguuuucucacuguugcagu

SEQ ID NO: 367118 - RNA, 22 nt, Homo sapiens
ccaguuuuuggcaaugaugaau

SEQ ID NO: 367119 - RNA, 22 nt, Homo sapiens
ccaucacacugugauuauuauc

SEQ ID NO: 367120 - RNA, 22 nt, Homo sapiens
ccauugcacuccagccucggca

SEQ ID NO: 367121 - RNA, 22 nt, Homo sapiens
ccauugcacucuggccuaggug

SEQ ID NO: 367122 - RNA, 22 nt, Homo sapiens
cccagagacagaaugauaaacu

SEQ ID NO: 367123 - RNA, 22 nt, Homo sapiens
cccugaagauacagaguuuggg

SEQ ID NO: 367124 - RNA, 22 nt, Homo sapiens
ccuuggcacuuugccacagugc

SEQ ID NO: 367125 - RNA, 22 nt, Homo sapiens
cgccugagcugaggaagcugca

SEQ ID NO: 367126 - RNA, 22 nt, Homo sapiens
cguugcacuccagccugggcaa

SEQ ID NO: 367127 - RNA, 22 nt, Homo sapiens
cuaagauugucuuaguguguug

SEQ ID NO: 367128 - RNA, 22 nt, Homo sapiens
cuauauacugccugcugauuag

SEQ ID NO: 367129 - RNA, 22 nt, Homo sapiens
cuauaugucuguuuugguacca

SEQ ID NO: 367130 - RNA, 22 nt, Homo sapiens
cuauggcuguaaggauaguaac

SEQ ID NO: 367131 - RNA, 22 nt, Homo sapiens
cucagcuacuugggaagcugag

SEQ ID NO: 367132 - RNA, 22 nt, Homo sapiens
cucauggaauacuucacagcca

SEQ ID NO: 367133 - RNA, 22 nt, Homo sapiens
cucccagugacccaggaacagg

SEQ ID NO: 367134 - RNA, 22 nt, Homo sapiens
cucucaguugucuaauuaguuu

SEQ ID NO: 367135 - RNA, 22 nt, Homo sapiens
cucugguuucgcaggaaauaga

SEQ ID NO: 367136 - RNA, 22 nt, Homo sapiens
cugagaucaagucuugcucugu

SEQ ID NO: 367137 - RNA, 22 nt, Homo sapiens
cugagcacugagauccucuagc

SEQ ID NO: 367138 - RNA, 22 nt, Homo sapiens
cugagguauuuaggugaaagaa

SEQ ID NO: 367139 - RNA, 19 nt, Homo sapiens
cugcaugagacaguugguu

SEQ ID NO: 367140 - RNA, 22 nt, Homo sapiens
cugccuagaucugaaccuggcu

SEQ ID NO: 367141 - RNA, 22 nt, Homo sapiens
cuggagcaaaggugacucuugu

SEQ ID NO: 367142 - RNA, 22 nt, Homo sapiens
cuggcgagacagcuccaucacu

SEQ ID NO: 367143 - RNA, 23 nt, Homo sapiens
cuguggugaggcccuagaaucug

SEQ ID NO: 367144 - RNA, 22 nt, Homo sapiens
cugugguguaacucuuggggcg

SEQ ID NO: 367145 - RNA, 22 nt, Homo sapiens
cuuuggauggaaccucucuuuc

SEQ ID NO: 367146 - RNA, 22 nt, Homo sapiens
cuuugggaccgcgguuuauacu

SEQ ID NO: 367147 - RNA, 22 nt, Homo sapiens
cuuuggucaauugcugcgggga

SEQ ID NO: 367148 - RNA, 22 nt, Homo sapiens
cuuuguguaggugccucuggcu

SEQ ID NO: 367149 - RNA, 22 nt, Homo sapiens
gaacccuggaggcggagguugc

SEQ ID NO: 367150 - RNA, 23 nt, Homo sapiens
gaaguaauaaauggauucuuaac

SEQ ID NO: 367151 - RNA, 22 nt, Homo sapiens
gacuuugguaaacucgguggca

SEQ ID NO: 367152 - RNA, 22 nt, Homo sapiens
gagaacaguguuguauuuuuuc

SEQ ID NO: 367153 - RNA, 22 nt, Homo sapiens
gagagguaguuuuuuggucguc

SEQ ID NO: 367154 - RNA, 22 nt, Homo sapiens
gagaucaauucauggcauaguu

SEQ ID NO: 367155 - RNA, 22 nt, Homo sapiens
gagauugucaugauuacauugu

SEQ ID NO: 367156 - RNA, 22 nt, Homo sapiens
gagcuagggucaugcuacugca

SEQ ID NO: 367157 - RNA, 21 nt, Homo sapiens
gagcuaggugaggcuguaaug

SEQ ID NO: 367158 - RNA, 22 nt, Homo sapiens
gagcugccuugccuaugcaaga

SEQ ID NO: 367159 - RNA, 22 nt, Homo sapiens
gaggaguagggcacaaagccuu

SEQ ID NO: 367160 - RNA, 22 nt, Homo sapiens
gaggaguauuuugucgaauguc

SEQ ID NO: 367161 - RNA, 22 nt, Homo sapiens
gagguaugugggcagacauuua

SEQ ID NO: 367162 - RNA, 22 nt, Homo sapiens
gaggugaaggucucaauaaaua

SEQ ID NO: 367163 - RNA, 22 nt, Homo sapiens
gagguggugguggaggcauagc

SEQ ID NO: 367164 - RNA, 22 nt, Homo sapiens
gaguucaaaucucagcucuguu

SEQ ID NO: 367165 - RNA, 22 nt, Homo sapiens
gauaaaguauuggguacuaugc

SEQ ID NO: 367166 - RNA, 22 nt, Homo sapiens
gcacaguguuacuugauauauu

SEQ ID NO: 367167 - RNA, 22 nt, Homo sapiens
gcacugagagaagccccaagua

SEQ ID NO: 367168 - RNA, 22 nt, Homo sapiens
gcaguguggguagagggcaaga

SEQ ID NO: 367169 - RNA, 22 nt, Homo sapiens
gcaucacagcuccugugcuggc

SEQ ID NO: 367170 - RNA, 22 nt, Homo sapiens
ugaggcaggagaacggcuugaa

SEQ ID NO: 367171 - RNA, 22 nt, Homo sapiens
ugagguaacaaacuaugaguua

SEQ ID NO: 367172 - RNA, 22 nt, Homo sapiens
ugaggucauucaugugggcgca

SEQ ID NO: 367173 - RNA, 22 nt, Homo sapiens
ugagugugaggaagaauuagaa

SEQ ID NO: 367174 - RNA, 22 nt, Homo sapiens
ugaguuaauuuuuguaucaugu

SEQ ID NO: 367175 - RNA, 22 nt, Homo sapiens
ugauggcauuucauguuuguaa

SEQ ID NO: 367176 - RNA, 22 nt, Homo sapiens
ugcauggaagggagggaaagag

SEQ ID NO: 367177 - RNA, 22 nt, Homo sapiens
ugccaaggagucagucccuaga

SEQ ID NO: 367178 - RNA, 20 nt, Homo sapiens
ugcugcacuuaagcaugggc

SEQ ID NO: 367179 - RNA, 22 nt, Homo sapiens
uggaagguaaguuuugagcauu

SEQ ID NO: 367180 - RNA, 22 nt, Homo sapiens
uggaaguaaucaugagguagca

SEQ ID NO: 367181 - RNA, 22 nt, Homo sapiens
uggacuagagggugggcgaggu

SEQ ID NO: 367182 - RNA, 22 nt, Homo sapiens
uggacugagauuucagcugcca

SEQ ID NO: 367183 - RNA, 22 nt, Homo sapiens
uggagagugauaaguaaaugga

SEQ ID NO: 367184 - RNA, 22 nt, Homo sapiens
uggaggacugcagaacugaggc

SEQ ID NO: 367185 - RNA, 22 nt, Homo sapiens
uggaguguaaauuaguucagcc

SEQ ID NO: 367186 - RNA, 22 nt, Homo sapiens
uggaguguagcggcaccuauua

SEQ ID NO: 367187 - RNA, 22 nt, Homo sapiens
uggauagauacuauccaggacu

SEQ ID NO: 367188 - RNA, 23 nt, Homo sapiens
uggccagaaacuucuuuucaucc

SEQ ID NO: 367189 - RNA, 22 nt, Homo sapiens
uggcccccucccaaaucucaua

SEQ ID NO: 367190 - RNA, 22 nt, Homo sapiens
uggcuaaguuaaucaaggagau

SEQ ID NO: 367191 - RNA, 22 nt, Homo sapiens
uggguaggaccagaaaugcacu

SEQ ID NO: 367192 - RNA, 20 nt, Homo sapiens
uggucaccuucaggagguuc

SEQ ID NO: 367193 - RNA, 20 nt, Homo sapiens
uggugguuuuaugugguuua

SEQ ID NO: 367194 - RNA, 22 nt, Homo sapiens
ugucaccauuuguaggugagga

SEQ ID NO: 367195 - RNA, 22 nt, Homo sapiens
ugucaucauuugagagaagaaa

SEQ ID NO: 367196 - RNA, 22 nt, Homo sapiens
ugucuaaagaauggcagacuca

SEQ ID NO: 367197 - RNA, 22 nt, Homo sapiens
ugugaacacagaggcuauggca

SEQ ID NO: 367198 - RNA, 22 nt, Homo sapiens
ugugaacugagcauuaacuaca

SEQ ID NO: 367199 - RNA, 22 nt, Homo sapiens
uguggcagugcuuuaugaaacc

SEQ ID NO: 367200 - RNA, 18 nt, Homo sapiens
uguggcuguuuuccaaua

SEQ ID NO: 367201 - RNA, 22 nt, Homo sapiens
ugugguagugcuuaccugcagu

SEQ ID NO: 367202 - RNA, 19 nt, Homo sapiens
uguugcacauaucaauaug

SEQ ID NO: 367203 - RNA, 22 nt, Homo sapiens
uguugcaccugccuugcuuuag

SEQ ID NO: 367204 - RNA, 22 nt, Homo sapiens
uguugcacuccagccugggcaa

SEQ ID NO: 367205 - RNA, 22 nt, Homo sapiens
uguugcacuccagccuggguga

SEQ ID NO: 367206 - RNA, 22 nt, Homo sapiens
uguugcauuugucaaggucaag

SEQ ID NO: 367207 - RNA, 22 nt, Homo sapiens
uuaaaugcucacauaaagguag

SEQ ID NO: 367208 - RNA, 22 nt, Homo sapiens
uuacagcagugccccacuccca

SEQ ID NO: 367209 - RNA, 21 nt, Homo sapiens
uuaggcagugucagaggugag

SEQ ID NO: 367210 - RNA, 22 nt, Homo sapiens
uuagggaggcucaggacaagag

SEQ ID NO: 367211 - RNA, 22 nt, Homo sapiens
uuauuagguuagugcaaaaguu

SEQ ID NO: 367212 - RNA, 22 nt, Homo sapiens
uuauuagguugguggaaaagua

SEQ ID NO: 367213 - RNA, 22 nt, Homo sapiens
uucaagugaacaaaaugaggag

SEQ ID NO: 367214 - RNA, 22 nt, Homo sapiens
uucacugcacuccagccugagc

SEQ ID NO: 367215 - RNA, 20 nt, Homo sapiens
uucaugggagcaaagaggcc

SEQ ID NO: 367216 - RNA, 22 nt, Homo sapiens
uuccagcugggggcaacucugc

SEQ ID NO: 367217 - RNA, 22 nt, Homo sapiens
uuccaguggacuacuucauccu

SEQ ID NO: 367218 - RNA, 22 nt, Homo sapiens
uucuggcucgauucucugaccg

SEQ ID NO: 367219 - RNA, 19 nt, Homo sapiens
uucugguguuuuaagccaa

SEQ ID NO: 367220 - RNA, 22 nt, Homo sapiens
uugaaguaguacuuuauuauag

SEQ ID NO: 367221 - RNA, 22 nt, Homo sapiens
uugacuuuuaggaggaaaauga

SEQ ID NO: 367222 - RNA, 22 nt, Homo sapiens
uugagagagaacauuuguuaca

SEQ ID NO: 367223 - RNA, 22 nt, Homo sapiens
uugaggacugcuaagcauuuga

SEQ ID NO: 367224 - RNA, 22 nt, Homo sapiens
uugagggaagccagaggucugc

SEQ ID NO: 367225 - RNA, 22 nt, Homo sapiens
uugaggugaauuugcaggaugc

SEQ ID NO: 367226 - RNA, 22 nt, Homo sapiens
uugcacagucuagcuccaccuu

SEQ ID NO: 367227 - RNA, 22 nt, Homo sapiens
uugcacagugcuuucuuugccc

SEQ ID NO: 367228 - RNA, 22 nt, Homo sapiens
uugcacuccagccugggugaca

SEQ ID NO: 367229 - RNA, 22 nt, Homo sapiens
uugcacucuagccugggugaca

SEQ ID NO: 367230 - RNA, 22 nt, Homo sapiens
uugcacuuccgccugggugaca

SEQ ID NO: 367231 - RNA, 22 nt, Homo sapiens
uugcagugguuucacuggcaaa

SEQ ID NO: 367232 - RNA, 22 nt, Homo sapiens
uugcagugugacgacuauauuu

SEQ ID NO: 367233 - RNA, 22 nt, Homo sapiens
uuggaaaguuguuguaguuauu

SEQ ID NO: 367234 - RNA, 22 nt, Homo sapiens
uuggaaauauguuaagugucau

SEQ ID NO: 367235 - RNA, 22 nt, Homo sapiens
uuggaacuguucguauugaaau

SEQ ID NO: 367236 - RNA, 23 nt, Homo sapiens
uuggaaugagaccuaagaguuuu

SEQ ID NO: 367237 - RNA, 22 nt, Homo sapiens
uuggaaugcaacagaaggauaa

SEQ ID NO: 367238 - RNA, 22 nt, Homo sapiens
uuggaauguauggcaucuugcg

SEQ ID NO: 367239 - RNA, 22 nt, Homo sapiens
uuggagagugauauucagaugc

SEQ ID NO: 367240 - RNA, 21 nt, Homo sapiens
uugguucccucugacaggucu

SEQ ID NO: 367241 - RNA, 22 nt, Homo sapiens
uugucaaacucauucuccaucc

SEQ ID NO: 367242 - RNA, 22 nt, Homo sapiens
uugugccugguacauggagaaa

SEQ ID NO: 367243 - RNA, 22 nt, Homo sapiens
uuucugggggugcugauggaaa

SEQ ID NO: 367244 - RNA, 18 nt, Homo sapiens
uuugccacuucccagaaa

SEQ ID NO: 367245 - RNA, 22 nt, Homo sapiens
uuugggcuuuuaaucuagagca

SEQ ID NO: 367246 - RNA, 22 nt, Homo sapiens
uuuuccagugggacucccauua

SEQ ID NO: 367247 - RNA, 20 nt, Homo sapiens
uuuuggacuaaaggcauccc

SEQ ID NO: 367248 - RNA, 22 nt, Homo sapiens
ugugaauggugcugccgugaag

SEQ ID NO: 367249 - RNA, 19 nt, Homo sapiens
uguugcacuccagcuuggg

SEQ ID NO: 367250 - RNA, 22 nt, Homo sapiens
uuaaaggcaugguuagacaugg

SEQ ID NO: 367251 - RNA, 22 nt, Homo sapiens
uuaaauacagcaugguguuucu

SEQ ID NO: 367252 - RNA, 22 nt, Homo sapiens
uuaaaugcacauacuugagaaa

SEQ ID NO: 367253 - RNA, 22 nt, Homo sapiens
uuaaggaguagugucugguauu

SEQ ID NO: 367254 - RNA, 22 nt, Homo sapiens
uuacagauggauggcagcuggc

SEQ ID NO: 367255 - RNA, 21 nt, Homo sapiens
uuagugcucaguuugacaaaa

SEQ ID NO: 367256 - RNA, 16 nt, Homo sapiens
uuauugcauucuucuc

SEQ ID NO: 367257 - RNA, 22 nt, Homo sapiens
uucaagaauuaaaguggcuuuu

SEQ ID NO: 367258 - RNA, 22 nt, Homo sapiens
uucaagauggccccagugagcc

SEQ ID NO: 367259 - RNA, 22 nt, Homo sapiens
uucaggguggagaguaugaggu

SEQ ID NO: 367260 - RNA, 22 nt, Homo sapiens
uucaucuggcaauucagagauu

SEQ ID NO: 367261 - RNA, 22 nt, Homo sapiens
uuccagagucaccuuucugucg

SEQ ID NO: 367262 - RNA, 22 nt, Homo sapiens
uuccaguguuugacucaccuuu

SEQ ID NO: 367263 - RNA, 22 nt, Homo sapiens
uucccagucaaacgaaggacuu

SEQ ID NO: 367264 - RNA, 22 nt, Homo sapiens
uucuaaacaucuuacaaugcau

SEQ ID NO: 367265 - RNA, 21 nt, Homo sapiens
uucucaggguguguccuaccc

SEQ ID NO: 367266 - RNA, 22 nt, Homo sapiens
uucuggcuaugggauacuaaau

SEQ ID NO: 367267 - RNA, 22 nt, Homo sapiens
uucuggcuuauaaacgugacuu

SEQ ID NO: 367268 - RNA, 18 nt, Homo sapiens
uucuuguguugauauuuu

SEQ ID NO: 367269 - RNA, 22 nt, Homo sapiens
uugaacugguaguuggaaaucu

SEQ ID NO: 367270 - RNA, 22 nt, Homo sapiens
uugaagguaggaugugcuauca

SEQ ID NO: 367271 - RNA, 22 nt, Homo sapiens
uugagcccuggaggcagaggcu

SEQ ID NO: 367272 - RNA, 22 nt, Homo sapiens
uugagcccuggagguggaggcu

SEQ ID NO: 367273 - RNA, 22 nt, Homo sapiens
uugaggaguacugauuagguau

SEQ ID NO: 367274 - RNA, 22 nt, Homo sapiens
uugagguggugucuugcucugu

SEQ ID NO: 367275 - RNA, 22 nt, Homo sapiens
uuggaaaaauccaccuugaucu

SEQ ID NO: 367276 - RNA, 22 nt, Homo sapiens
uuggagagucacuaguuagugc

SEQ ID NO: 367277 - RNA, 22 nt, Homo sapiens
uuggaugauaaagaagccuaag

SEQ ID NO: 367278 - RNA, 19 nt, Homo sapiens
uuguccccucuaaaucuca

SEQ ID NO: 367279 - RNA, 21 nt, Homo sapiens
uuuggcuucucugcugcagcc

SEQ ID NO: 367280 - RNA, 19 nt, Homo sapiens
uuuguccugcccuuucuca

SEQ ID NO: 367281 - RNA, 22 nt, Homo sapiens
ugagguaauagauaauauuuuu

SEQ ID NO: 367282 - RNA, 22 nt, Homo sapiens
ugagguaugacuuauuauucuu

SEQ ID NO: 367283 - RNA, 22 nt, Homo sapiens
ugagguugguauuacugucucu

SEQ ID NO: 367284 - RNA, 22 nt, Homo sapiens
ugaguauagaucaguucaagug

SEQ ID NO: 367285 - RNA, 19 nt, Homo sapiens
ugaguauauuguauucauu

SEQ ID NO: 367286 - RNA, 22 nt, Homo sapiens
ugagugaggcugggcagucccu

SEQ ID NO: 367287 - RNA, 22 nt, Homo sapiens
ugaguguccaccccuuucacag

SEQ ID NO: 367288 - RNA, 22 nt, Homo sapiens
ugauaauguuaggcuuuauuca

SEQ ID NO: 367289 - RNA, 22 nt, Homo sapiens
ugauaugaaguuagcuggcugu

SEQ ID NO: 367290 - RNA, 22 nt, Homo sapiens
ugaucugucacuuaucacauuu

SEQ ID NO: 367291 - RNA, 22 nt, Homo sapiens
ugcagcacuguucacaauagcc

SEQ ID NO: 367292 - RNA, 22 nt, Homo sapiens
ugcaguagugugaucuuggcuc

SEQ ID NO: 367293 - RNA, 21 nt, Homo sapiens
ugcauggagaacacugagggu

SEQ ID NO: 367294 - RNA, 19 nt, Homo sapiens
ugccaagaaagucagcuua

SEQ ID NO: 367295 - RNA, 22 nt, Homo sapiens
ugccugagccagguuuuaggag

SEQ ID NO: 367296 - RNA, 22 nt, Homo sapiens
ugccugagcccagcccuguagu

SEQ ID NO: 367297 - RNA, 21 nt, Homo sapiens
ugcuccauuuucuagccugaa

SEQ ID NO: 367298 - RNA, 22 nt, Homo sapiens
uggaacacaucuaaggaagcag

SEQ ID NO: 367299 - RNA, 22 nt, Homo sapiens
uggaagcaugcaaucugugggg

SEQ ID NO: 367300 - RNA, 22 nt, Homo sapiens
uggaagucuucauuauguauag

SEQ ID NO: 367301 - RNA, 20 nt, Homo sapiens
uggaaugcagccuccuucug

SEQ ID NO: 367302 - RNA, 20 nt, Homo sapiens
uggaccagagagguggggac

SEQ ID NO: 367303 - RNA, 22 nt, Homo sapiens
uggacuguaagugccuugagua

SEQ ID NO: 367304 - RNA, 22 nt, Homo sapiens
uggacuguaauagagaacagaa

SEQ ID NO: 367305 - RNA, 22 nt, Homo sapiens
uggagagucauuuauaguauuu

SEQ ID NO: 367306 - RNA, 22 nt, Homo sapiens
uggagguagacauugggaagag

SEQ ID NO: 367307 - RNA, 22 nt, Homo sapiens
uggagguaggugauauguagca

SEQ ID NO: 367308 - RNA, 22 nt, Homo sapiens
uggagucuugaugauuuucaaa

SEQ ID NO: 367309 - RNA, 22 nt, Homo sapiens
uggagugucaguuuccagaguu

SEQ ID NO: 367310 - RNA, 21 nt, Homo sapiens
uggcacuauucacaauagcaa

SEQ ID NO: 367311 - RNA, 22 nt, Homo sapiens
uggcuuuuguuauuuggaagcu

SEQ ID NO: 367312 - RNA, 19 nt, Homo sapiens
uggguaguuuucuggcugg

SEQ ID NO: 367313 - RNA, 21 nt, Homo sapiens
uggucaguuuucucacuagga

SEQ ID NO: 367314 - RNA, 22 nt, Homo sapiens
uguaaugaucaaaucagaguaa

SEQ ID NO: 367315 - RNA, 22 nt, Homo sapiens
uguccaaauugaaucaucuggu

SEQ ID NO: 367316 - RNA, 22 nt, Homo sapiens
uguugcacacacugaaauacac

SEQ ID NO: 367317 - RNA, 20 nt, Homo sapiens
uguugcacucuagccugggu

SEQ ID NO: 367318 - RNA, 22 nt, Homo sapiens
uuaaagcuggcguuacaguuug

SEQ ID NO: 367319 - RNA, 22 nt, Homo sapiens
uuaaaugcauagaauguguagu

SEQ ID NO: 367320 - RNA, 22 nt, Homo sapiens
uuaagugaauuaucuaacaugu

SEQ ID NO: 367321 - RNA, 22 nt, Homo sapiens
uuaaugcuuggggaguaguucu

SEQ ID NO: 367322 - RNA, 22 nt, Homo sapiens
uuacaccuguaauccagcacuu

SEQ ID NO: 367323 - RNA, 22 nt, Homo sapiens
uuaccaguggugcuguaaacuu

SEQ ID NO: 367324 - RNA, 23 nt, Homo sapiens
uucaaauguucucugguugucag

SEQ ID NO: 367325 - RNA, 22 nt, Homo sapiens
uucagggagaaggcaaacguug

SEQ ID NO: 367326 - RNA, 22 nt, Homo sapiens
uuccacagggauuugcauugau

SEQ ID NO: 367327 - RNA, 22 nt, Homo sapiens
uuccuggaggggaaguguccaa

SEQ ID NO: 367328 - RNA, 22 nt, Homo sapiens
uuccuucaugcuugaaggguau

SEQ ID NO: 367329 - RNA, 23 nt, Homo sapiens
uucuaucaggcccaggagcccug

SEQ ID NO: 367330 - RNA, 22 nt, Homo sapiens
uugaagguagaaguucucaauu

SEQ ID NO: 367331 - RNA, 22 nt, Homo sapiens
uugagagaaaaggccaugccuu

SEQ ID NO: 367332 - RNA, 22 nt, Homo sapiens
uugagauagaauaggaauggga

SEQ ID NO: 367333 - RNA, 22 nt, Homo sapiens
uugagggagccuguuagucccg

SEQ ID NO: 367334 - RNA, 22 nt, Homo sapiens
uugagggaggcagggcuugucu

SEQ ID NO: 367335 - RNA, 22 nt, Homo sapiens
uugauguugaggacauaaaccu

SEQ ID NO: 367336 - RNA, 22 nt, Homo sapiens
uugcacaguguguacagcacca

SEQ ID NO: 367337 - RNA, 22 nt, Homo sapiens
uugcaggcaugagccaccgugc

SEQ ID NO: 367338 - RNA, 22 nt, Homo sapiens
uuggaaagagguguuuaugacu

SEQ ID NO: 367339 - RNA, 22 nt, Homo sapiens
uuggagagaaaggcaguuccug

SEQ ID NO: 367340 - RNA, 22 nt, Homo sapiens
uuggauggucuuuauauaguau

SEQ ID NO: 367341 - RNA, 22 nt, Homo sapiens
guguccucgaguacacaucagg

SEQ ID NO: 367342 - RNA, 23 nt, Homo sapiens
guucaucagggauauuggccuga

SEQ ID NO: 367343 - RNA, 22 nt, Homo sapiens
guuuggauauuaggcaagagua

SEQ ID NO: 367344 - RNA, 22 nt, Homo sapiens
uaaagcuaucacauuggugauu

SEQ ID NO: 367345 - RNA, 22 nt, Homo sapiens
uaaagcuauuauaguuauguuu

SEQ ID NO: 367346 - RNA, 22 nt, Homo sapiens
uaaauggauaaaugaauaccua

SEQ ID NO: 367347 - RNA, 19 nt, Homo sapiens
uaagaugaagcugucuggg

SEQ ID NO: 367348 - RNA, 22 nt, Homo sapiens
uaagcucauuccagccaugucc

SEQ ID NO: 367349 - RNA, 22 nt, Homo sapiens
uaaggcacuacuuuaggcuuuc

SEQ ID NO: 367350 - RNA, 22 nt, Homo sapiens
uacaaguaauaagggaagaauu

SEQ ID NO: 367351 - RNA, 22 nt, Homo sapiens
uacugcagucagacuccugggc

SEQ ID NO: 367352 - RNA, 17 nt, Homo sapiens
uagcacagugccuggua

SEQ ID NO: 367353 - RNA, 22 nt, Homo sapiens
uagcaccaggguugacugaccu

SEQ ID NO: 367354 - RNA, 22 nt, Homo sapiens
uaggagugugaacccuaugaac

SEQ ID NO: 367355 - RNA, 22 nt, Homo sapiens
uaggcagccagcuguggauuga

SEQ ID NO: 367356 - RNA, 22 nt, Homo sapiens
uagugcuguaauucuaaugaaa

SEQ ID NO: 367357 - RNA, 22 nt, Homo sapiens
uaguugcauucaggauaugacg

SEQ ID NO: 367358 - RNA, 21 nt, Homo sapiens
uaucacauuggugauuaaguu

SEQ ID NO: 367359 - RNA, 22 nt, Homo sapiens
uaucauaguuuggacuuucauu

SEQ ID NO: 367360 - RNA, 22 nt, Homo sapiens
uaugaagccaggauuuauuauu

SEQ ID NO: 367361 - RNA, 19 nt, Homo sapiens
uaugcaacuuauagugcug

SEQ ID NO: 367362 - RNA, 22 nt, Homo sapiens
uauuaugcacuuuauaaaaauu

SEQ ID NO: 367363 - RNA, 20 nt, Homo sapiens
uauucacucuccagucuugc

SEQ ID NO: 367364 - RNA, 18 nt, Homo sapiens
uauuccucuuccucuauc

SEQ ID NO: 367365 - RNA, 22 nt, Homo sapiens
ucaacagugauggaaaguuaua

SEQ ID NO: 367366 - RNA, 21 nt, Homo sapiens
ucaacccuugcgucaccaagc

SEQ ID NO: 367367 - RNA, 22 nt, Homo sapiens
ucacagacauugaggggaccuu

SEQ ID NO: 367368 - RNA, 21 nt, Homo sapiens
ucacagccuaggaccugaaga

SEQ ID NO: 367369 - RNA, 20 nt, Homo sapiens
ucacugagugguccacagua

SEQ ID NO: 367370 - RNA, 22 nt, Homo sapiens
ucacuuugacggccaacuucua

SEQ ID NO: 367371 - RNA, 22 nt, Homo sapiens
ucacuuuggguacuauggaaau

SEQ ID NO: 367372 - RNA, 21 nt, Homo sapiens
ucagggaccugcuguacugau

SEQ ID NO: 367373 - RNA, 22 nt, Homo sapiens
ucaggugccuuggcuaauuguu

SEQ ID NO: 367374 - RNA, 22 nt, Homo sapiens
ucagucuuuuaccauuaaguau

SEQ ID NO: 367375 - RNA, 19 nt, Homo sapiens
uccccuguggauaccaaga

SEQ ID NO: 367376 - RNA, 22 nt, Homo sapiens
uccugagacucacaggcucccc

SEQ ID NO: 367377 - RNA, 22 nt, Homo sapiens
ucgugccacugcacuccagccu

SEQ ID NO: 367378 - RNA, 22 nt, Homo sapiens
ucuaguaaugagaggcaggaga

SEQ ID NO: 367379 - RNA, 22 nt, Homo sapiens
ucucaaguaacugggacaauaa

SEQ ID NO: 367380 - RNA, 21 nt, Homo sapiens
ucucauagaguuucacuuucu

SEQ ID NO: 367381 - RNA, 20 nt, Homo sapiens
ucucccaaacagcaggcccu

SEQ ID NO: 367382 - RNA, 22 nt, Homo sapiens
ucucugagaaaaguuucuccca

SEQ ID NO: 367383 - RNA, 22 nt, Homo sapiens
ucucuguuuagagccagcaauu

SEQ ID NO: 367384 - RNA, 22 nt, Homo sapiens
ucugacacuucugcagaauuga

SEQ ID NO: 367385 - RNA, 22 nt, Homo sapiens
ucuguguuugaucaagauugua

SEQ ID NO: 367386 - RNA, 20 nt, Homo sapiens
ucuugaacuuagucaacagg

SEQ ID NO: 367387 - RNA, 22 nt, Homo sapiens
ucuuuggauggaaauuggaguc

SEQ ID NO: 367388 - RNA, 22 nt, Homo sapiens
ugaaacugcagugggcuuggca

SEQ ID NO: 367389 - RNA, 22 nt, Homo sapiens
ugaaaugguuaugugaggagau

SEQ ID NO: 367390 - RNA, 22 nt, Homo sapiens
ugaaggacauucuaugguagau

SEQ ID NO: 367391 - RNA, 21 nt, Homo sapiens
ugaaugcuuuaaauauuagaa

SEQ ID NO: 367392 - RNA, 19 nt, Homo sapiens
ugacacuguuggugggagg

SEQ ID NO: 367393 - RNA, 22 nt, Homo sapiens
ugagaucaagauguuagggacu

SEQ ID NO: 367394 - RNA, 23 nt, Homo sapiens
ugagaucuacagaucucagaucu

SEQ ID NO: 367395 - RNA, 22 nt, Homo sapiens
ugagaugacgacacaccucagu

SEQ ID NO: 367396 - RNA, 22 nt, Homo sapiens
ugagaugaugggauaagagggc

SEQ ID NO: 367397 - RNA, 22 nt, Homo sapiens
ugagcacagcgugugggagagc

SEQ ID NO: 367398 - RNA, 22 nt, Homo sapiens
ugagcacauuuacaucaguucc

SEQ ID NO: 367399 - RNA, 22 nt, Homo sapiens
ugagcugagaucgugccauugu

SEQ ID NO: 367400 - RNA, 22 nt, Homo sapiens
ugaggcacucccuagcggggug

SEQ ID NO: 367401 - RNA, 22 nt, Homo sapiens
ugagguaaaacaaggauuggau

SEQ ID NO: 367402 - RNA, 22 nt, Homo sapiens
ugagguguuaacuuuacuuuua

SEQ ID NO: 367403 - RNA, 22 nt, Homo sapiens
ugagguuggggucagggcuagc

SEQ ID NO: 367404 - RNA, 22 nt, Homo sapiens
ugaguagagaauucagcuaagg

SEQ ID NO: 367405 - RNA, 22 nt, Homo sapiens
ugauaagugagauagcaaguga

SEQ ID NO: 367406 - RNA, 22 nt, Homo sapiens
ugcagcucaaauuccuaacaag

SEQ ID NO: 367407 - RNA, 22 nt, Homo sapiens
ugcagguacuugacaacuuggg

SEQ ID NO: 367408 - RNA, 22 nt, Homo sapiens
ugcagguaggcaguaucauuua

SEQ ID NO: 367409 - RNA, 22 nt, Homo sapiens
ugccuucuguuaaacgaggaug

SEQ ID NO: 367410 - RNA, 18 nt, Homo sapiens
ugcuaugagauuauuuua

SEQ ID NO: 367411 - RNA, 18 nt, Homo sapiens
ugcuccccugggugagca

SEQ ID NO: 367412 - RNA, 21 nt, Homo sapiens
ugcuuuggucauacuucuucc

SEQ ID NO: 367413 - RNA, 23 nt, Homo sapiens
uggaaguauggaggaggcagaau

SEQ ID NO: 367414 - RNA, 22 nt, Homo sapiens
uggaagucuauggcauuugagu

SEQ ID NO: 367415 - RNA, 19 nt, Homo sapiens
uggaaugaaauguuagggg

SEQ ID NO: 367416 - RNA, 22 nt, Homo sapiens
uggacuguaaauuggggacucu

SEQ ID NO: 367417 - RNA, 22 nt, Homo sapiens
uggacuguaauuuuauaggcau

SEQ ID NO: 367418 - RNA, 22 nt, Homo sapiens
uggagguagagaugggaucucc

SEQ ID NO: 367419 - RNA, 22 nt, Homo sapiens
uggagucuugcucuguugccca

SEQ ID NO: 367420 - RNA, 21 nt, Homo sapiens
uggauugagaaccccaggagg

SEQ ID NO: 367421 - RNA, 22 nt, Homo sapiens
uggcaaaugaaagaaagccagu

SEQ ID NO: 367422 - RNA, 22 nt, Homo sapiens
uggcaaaugaagucagcuguac

SEQ ID NO: 367423 - RNA, 22 nt, Homo sapiens
uggcaagaccccaucucuacaa

SEQ ID NO: 367424 - RNA, 22 nt, Homo sapiens
uggcaagugggaccuaguuaaa

SEQ ID NO: 367425 - RNA, 22 nt, Homo sapiens
uggcuaagaugcacacuucacu

SEQ ID NO: 367426 - RNA, 19 nt, Homo sapiens
uggcuagaggccaggcguu

SEQ ID NO: 367427 - RNA, 22 nt, Homo sapiens
uggcuuuguaagguuucauuuu

SEQ ID NO: 367428 - RNA, 22 nt, Homo sapiens
uggguccccuacucuuuccaca

SEQ ID NO: 367429 - RNA, 22 nt, Homo sapiens
ugguccuuuccauuggagacac

SEQ ID NO: 367430 - RNA, 22 nt, Homo sapiens
ugucaaaugcagugauauuuga

SEQ ID NO: 367431 - RNA, 22 nt, Homo sapiens
ugugaacagcuccaaaugugga

SEQ ID NO: 367432 - RNA, 22 nt, Homo sapiens
ugugaagauggacuaauauagu

SEQ ID NO: 367433 - RNA, 22 nt, Homo sapiens
gguggugguauuucagaaaaug

SEQ ID NO: 367434 - RNA, 22 nt, Homo sapiens
guaaucucagcuacuugggagc

SEQ ID NO: 367435 - RNA, 22 nt, Homo sapiens
guacaguuuagugcuuugagaa

SEQ ID NO: 367436 - RNA, 22 nt, Homo sapiens
guauacuucugaaaauagcuau

SEQ ID NO: 367437 - RNA, 22 nt, Homo sapiens
gucacagcuggcauugucugca

SEQ ID NO: 367438 - RNA, 22 nt, Homo sapiens
gucagggagucucuaucagugg

SEQ ID NO: 367439 - RNA, 22 nt, Homo sapiens
gugacagaguaagacccuguau

SEQ ID NO: 367440 - RNA, 22 nt, Homo sapiens
gugagggaugugaaaaagguca

SEQ ID NO: 367441 - RNA, 22 nt, Homo sapiens
gugcaaugagaaggggcucugg

SEQ ID NO: 367442 - RNA, 22 nt, Homo sapiens
guggaaaucucugugugacuua

SEQ ID NO: 367443 - RNA, 22 nt, Homo sapiens
guggaagugucuggggccaggg

SEQ ID NO: 367444 - RNA, 22 nt, Homo sapiens
guggaguacugagggucacuua

SEQ ID NO: 367445 - RNA, 22 nt, Homo sapiens
guggaucacuugagguuagaag

SEQ ID NO: 367446 - RNA, 22 nt, Homo sapiens
guggcuagaaugaagguagcug

SEQ ID NO: 367447 - RNA, 22 nt, Homo sapiens
guggcuuguaggggucaaggga

SEQ ID NO: 367448 - RNA, 22 nt, Homo sapiens
guggcuuuauuuagaagcaggg

SEQ ID NO: 367449 - RNA, 22 nt, Homo sapiens
gugguuuucaacuccaccugca

SEQ ID NO: 367450 - RNA, 22 nt, Homo sapiens
gugguuuuuuucugccuuauag

SEQ ID NO: 367451 - RNA, 22 nt, Homo sapiens
guguaugugagaaugcucaugu

SEQ ID NO: 367452 - RNA, 22 nt, Homo sapiens
guguccuaugaaacaggaucca

SEQ ID NO: 367453 - RNA, 22 nt, Homo sapiens
accccauuugcacugagcccuu

SEQ ID NO: 367454 - RNA, 22 nt, Homo sapiens
acccugucacucccaucaauuu

SEQ ID NO: 367455 - RNA, 22 nt, Homo sapiens
accuggcacuuagcaaaucuga

SEQ ID NO: 367456 - RNA, 22 nt, Homo sapiens
acucacagcaaccuccgccucc

SEQ ID NO: 367457 - RNA, 22 nt, Homo sapiens
acugcacuccacccuuggcagc

SEQ ID NO: 367458 - RNA, 22 nt, Homo sapiens
acugcacuccagccucggcaau

SEQ ID NO: 367459 - RNA, 22 nt, Homo sapiens
acugcacuccagccuuggcaac

SEQ ID NO: 367460 - RNA, 22 nt, Homo sapiens
acugcacugcagccuggccaac

SEQ ID NO: 367461 - RNA, 19 nt, Homo sapiens
acuguacuccagucugggc

SEQ ID NO: 367462 - RNA, 22 nt, Homo sapiens
acuuugguuaucauacuuucag

SEQ ID NO: 367463 - RNA, 22 nt, Homo sapiens
acuuugguuuauagaauuuagg

SEQ ID NO: 367464 - RNA, 22 nt, Homo sapiens
agaaccauuagagggagauauu

SEQ ID NO: 367465 - RNA, 22 nt, Homo sapiens
agacacugaaauguauugaaga

SEQ ID NO: 367466 - RNA, 22 nt, Homo sapiens
agagaacugauuggaugugggc

SEQ ID NO: 367467 - RNA, 22 nt, Homo sapiens
agagacauugcuccaacucacc

SEQ ID NO: 367468 - RNA, 22 nt, Homo sapiens
agagauaauuagguuaaaugag

SEQ ID NO: 367469 - RNA, 22 nt, Homo sapiens
agaggaguacuacuccaagucu

SEQ ID NO: 367470 - RNA, 22 nt, Homo sapiens
agaguauacaugugagugagau

SEQ ID NO: 367471 - RNA, 22 nt, Homo sapiens
agaucaauugcugauucgcucu

SEQ ID NO: 367472 - RNA, 22 nt, Homo sapiens
agaugauguuucuggcacauga

SEQ ID NO: 367473 - RNA, 22 nt, Homo sapiens
agcaauaugacauugcuacauc

SEQ ID NO: 367474 - RNA, 22 nt, Homo sapiens
agcagcauuccaaaaaucugcu

SEQ ID NO: 367475 - RNA, 22 nt, Homo sapiens
agcaucagugauuuuguugaag

SEQ ID NO: 367476 - RNA, 22 nt, Homo sapiens
agcuagcauucauaguuugagg

SEQ ID NO: 367477 - RNA, 22 nt, Homo sapiens
agcuaguauuuuguuaaggauu

SEQ ID NO: 367478 - RNA, 22 nt, Homo sapiens
agcuauauugaggaugccauuc

SEQ ID NO: 367479 - RNA, 22 nt, Homo sapiens
agcuccaugauaguaugucugu

SEQ ID NO: 367480 - RNA, 22 nt, Homo sapiens
uuauauguuucuguuuggaggc

SEQ ID NO: 367481 - RNA, 22 nt, Homo sapiens
uuauauguuucuuagggacaga

SEQ ID NO: 367482 - RNA, 22 nt, Homo sapiens
uuauugaguaaaaagaaugguu

SEQ ID NO: 367483 - RNA, 22 nt, Homo sapiens
uucaagcuacaguggcaggguu

SEQ ID NO: 367484 - RNA, 22 nt, Homo sapiens
uucacacugggccuacucugug

SEQ ID NO: 367485 - RNA, 22 nt, Homo sapiens
uucauagaggacauuacuggag

SEQ ID NO: 367486 - RNA, 22 nt, Homo sapiens
uucauaguaacaguaacuaugg

SEQ ID NO: 367487 - RNA, 22 nt, Homo sapiens
uuccauguaguugagcaguuuu

SEQ ID NO: 367488 - RNA, 22 nt, Homo sapiens
uuccuugaaacagucaagagaa

SEQ ID NO: 367489 - RNA, 22 nt, Homo sapiens
uucuagcaauggcagagugucu

SEQ ID NO: 367490 - RNA, 22 nt, Homo sapiens
uugaaaguaaacaucacaaaga

SEQ ID NO: 367491 - RNA, 22 nt, Homo sapiens
uugaaaguguucacaaugguau

SEQ ID NO: 367492 - RNA, 22 nt, Homo sapiens
uugaagugaagaacaauaucac

SEQ ID NO: 367493 - RNA, 22 nt, Homo sapiens
uugaaugaaauuggugugggga

SEQ ID NO: 367494 - RNA, 22 nt, Homo sapiens
uugagaguggaggcuauaucuu

SEQ ID NO: 367495 - RNA, 22 nt, Homo sapiens
uugagauccuuuugcucaucag

SEQ ID NO: 367496 - RNA, 22 nt, Homo sapiens
uugagauggagucucacucugc

SEQ ID NO: 367497 - RNA, 22 nt, Homo sapiens
uugagauggagucuugcacugu

SEQ ID NO: 367498 - RNA, 22 nt, Homo sapiens
uugagauggagucuugcgcugu

SEQ ID NO: 367499 - RNA, 22 nt, Homo sapiens
uugagauggagucuugcucuug

SEQ ID NO: 367500 - RNA, 22 nt, Homo sapiens
uugagauggugccacuguacuc

SEQ ID NO: 367501 - RNA, 22 nt, Homo sapiens
uugagcaauccuccugccaugu

SEQ ID NO: 367502 - RNA, 22 nt, Homo sapiens
uugaggacugcuaagcauuuga

SEQ ID NO: 367503 - RNA, 22 nt, Homo sapiens
uugagggagccuguuagucccg

SEQ ID NO: 367504 - RNA, 22 nt, Homo sapiens
uugagggaggccucaguuuaca

SEQ ID NO: 367505 - RNA, 22 nt, Homo sapiens
uugaguaguaagaagaugauag

SEQ ID NO: 367506 - RNA, 22 nt, Homo sapiens
uugaguauuugcagucugaaca

SEQ ID NO: 367507 - RNA, 22 nt, Homo sapiens
uugauaauguuaacuuugguca

SEQ ID NO: 367508 - RNA, 22 nt, Homo sapiens
uugauauguuguuagauucagu

SEQ ID NO: 367509 - RNA, 22 nt, Homo sapiens
uugcaaagaccucuucacuucc

SEQ ID NO: 367510 - RNA, 18 nt, Homo sapiens
uugcaaauucuucccugu

SEQ ID NO: 367511 - RNA, 22 nt, Homo sapiens
uugcaacauguauucuggugau

SEQ ID NO: 367512 - RNA, 22 nt, Homo sapiens
uugcacuucauguaggccaaag

SEQ ID NO: 367513 - RNA, 22 nt, Homo sapiens
uugcauaagugcauucugugau

SEQ ID NO: 367514 - RNA, 19 nt, Homo sapiens
uugcauauguugaaccagc

SEQ ID NO: 367515 - RNA, 22 nt, Homo sapiens
uugcauguacguacagagagag

SEQ ID NO: 367516 - RNA, 22 nt, Homo sapiens
uugcauugacacaugaagcuca

SEQ ID NO: 367517 - RNA, 22 nt, Homo sapiens
uugcgaugaagacaaaacaugc

SEQ ID NO: 367518 - RNA, 22 nt, Homo sapiens
uuggauggucuuuauauaguau

SEQ ID NO: 367519 - RNA, 22 nt, Homo sapiens
uuggcacugagcaagaacaggg

SEQ ID NO: 367520 - RNA, 22 nt, Homo sapiens
uugggauaaucacaaaguaaaa

SEQ ID NO: 367521 - RNA, 22 nt, Homo sapiens
uugguuaucaucauuucagcaa

SEQ ID NO: 367522 - RNA, 22 nt, Homo sapiens
uugucuccuagacgaccaggcg

SEQ ID NO: 367523 - RNA, 22 nt, Homo sapiens
uugugaauggugccucaguaaa

SEQ ID NO: 367524 - RNA, 22 nt, Homo sapiens
uugugaauggugcugcaguaaa

SEQ ID NO: 367525 - RNA, 22 nt, Homo sapiens
uugugcauaucagagguuugcu

SEQ ID NO: 367526 - RNA, 22 nt, Homo sapiens
uugugguuuuaucuaccuuugg

SEQ ID NO: 367527 - RNA, 22 nt, Homo sapiens
uuucaccguguuggccaggcug

SEQ ID NO: 367528 - RNA, 22 nt, Homo sapiens
uuucccuuacuuaaacuuacuc

SEQ ID NO: 367529 - RNA, 23 nt, Homo sapiens
uuucuugggcaugcuaugucagu

SEQ ID NO: 367530 - RNA, 22 nt, Homo sapiens
uuugagauaucuuccaucagua

SEQ ID NO: 367531 - RNA, 22 nt, Homo sapiens
uuugcuuguguaaaaaucugga

SEQ ID NO: 367532 - RNA, 22 nt, Homo sapiens
uuuggcuguuucuggacuaaga

SEQ ID NO: 367533 - RNA, 22 nt, Homo sapiens
uuuguaagaugcauagauugca

SEQ ID NO: 367534 - RNA, 22 nt, Homo sapiens
uuuguacuaugguuuuucacua

SEQ ID NO: 367535 - RNA, 22 nt, Homo sapiens
uuugucccuuugcaguggcaca

SEQ ID NO: 367536 - RNA, 22 nt, Homo sapiens
uuuugcauuggcugaggagugu

SEQ ID NO: 367537 - RNA, 22 nt, Homo sapiens
uuuugcucuugguaaugaaaga

SEQ ID NO: 367538 - RNA, 22 nt, Homo sapiens
uuuugcuugugaauagccacau

SEQ ID NO: 367539 - RNA, 22 nt, Homo sapiens
uuuugguaaugaacuuaggaag

SEQ ID NO: 367540 - RNA, 22 nt, Homo sapiens
uuuugguuguuggguaagagua

SEQ ID NO: 367541 - RNA, 22 nt, Homo sapiens
uggcaagagauaugugucuaua

SEQ ID NO: 367542 - RNA, 22 nt, Homo sapiens
uggcaugauccuagauucaaca

SEQ ID NO: 367543 - RNA, 22 nt, Homo sapiens
uggcuuuuccaggcauuacgau

SEQ ID NO: 367544 - RNA, 22 nt, Homo sapiens
ugggaaacauccagcacauacu

SEQ ID NO: 367545 - RNA, 22 nt, Homo sapiens
ugggaagauucuguguuuuucc

SEQ ID NO: 367546 - RNA, 22 nt, Homo sapiens
uggguaguuucuuacaacucug

SEQ ID NO: 367547 - RNA, 22 nt, Homo sapiens
ugguauguuuauaaguauagga

SEQ ID NO: 367548 - RNA, 21 nt, Homo sapiens
uguagcagcauaauuuauaau

SEQ ID NO: 367549 - RNA, 22 nt, Homo sapiens
uguagcagccauaaacacagug

SEQ ID NO: 367550 - RNA, 22 nt, Homo sapiens
uguauguuuaaggccaguggaa

SEQ ID NO: 367551 - RNA, 21 nt, Homo sapiens
ugucgugcaggaucuguggga

SEQ ID NO: 367552 - RNA, 22 nt, Homo sapiens
ugucugagacuguuuuacuuuc

SEQ ID NO: 367553 - RNA, 22 nt, Homo sapiens
ugugaacagcuccaaaugugga

SEQ ID NO: 367554 - RNA, 22 nt, Homo sapiens
ugugaagauguuucuuaauuga

SEQ ID NO: 367555 - RNA, 22 nt, Homo sapiens
ugugaugguuuggaagcuucuu

SEQ ID NO: 367556 - RNA, 22 nt, Homo sapiens
ugugauguggagggcagaucca

SEQ ID NO: 367557 - RNA, 22 nt, Homo sapiens
ugugcauaugucuuuauaguag

SEQ ID NO: 367558 - RNA, 22 nt, Homo sapiens
ugugccacugcacuccugggug

SEQ ID NO: 367559 - RNA, 22 nt, Homo sapiens
ugugcguguaagagaucuaggu

SEQ ID NO: 367560 - RNA, 22 nt, Homo sapiens
uguguuugauaaguccauaguu

SEQ ID NO: 367561 - RNA, 22 nt, Homo sapiens
uguugcuuaagccacccagucu

SEQ ID NO: 367562 - RNA, 22 nt, Homo sapiens
uuaaaggcaugguuagacaugg

SEQ ID NO: 367563 - RNA, 22 nt, Homo sapiens
uuaaaguaauugaaauggccuu

SEQ ID NO: 367564 - RNA, 22 nt, Homo sapiens
uuaaauacagcaugguguuucu

SEQ ID NO: 367565 - RNA, 22 nt, Homo sapiens
uuaaggcuuguacuuguuuucu

SEQ ID NO: 367566 - RNA, 22 nt, Homo sapiens
uuaauacucuucuaaguagucc

SEQ ID NO: 367567 - RNA, 22 nt, Homo sapiens
uuaauguaauugauugauugac

SEQ ID NO: 367568 - RNA, 22 nt, Homo sapiens
uuagaugguucaccaugaguag

SEQ ID NO: 367569 - RNA, 22 nt, Homo sapiens
uuauauguuuguacuuaggccu

SEQ ID NO: 367570 - RNA, 22 nt, Homo sapiens
uucaaaggauagauuaagauca

SEQ ID NO: 367571 - RNA, 22 nt, Homo sapiens
uucaaaggauuuagauuagcua

SEQ ID NO: 367572 - RNA, 23 nt, Homo sapiens
uucaaauguucucugguugucag

SEQ ID NO: 367573 - RNA, 23 nt, Homo sapiens
uucaccguguuggccaggcuggu

SEQ ID NO: 367574 - RNA, 22 nt, Homo sapiens
uucaccuugggucccacuugcu

SEQ ID NO: 367575 - RNA, 22 nt, Homo sapiens
uucacugugaacucauauucag

SEQ ID NO: 367576 - RNA, 22 nt, Homo sapiens
uucagaugcacacuguagucua

SEQ ID NO: 367577 - RNA, 22 nt, Homo sapiens
uucaggguggagaguaugaggu

SEQ ID NO: 367578 - RNA, 20 nt, Homo sapiens
uucaugggagcaaagaggcc

SEQ ID NO: 367579 - RNA, 22 nt, Homo sapiens
uucauggugguacaaaagcaau

SEQ ID NO: 367580 - RNA, 22 nt, Homo sapiens
uggauaguuuacugaagagugg

SEQ ID NO: 367581 - RNA, 21 nt, Homo sapiens
uggauugagaaccccaggagg

SEQ ID NO: 367582 - RNA, 22 nt, Homo sapiens
uggcaaaugaagucagcuguac

SEQ ID NO: 367583 - RNA, 21 nt, Homo sapiens
uggcaacauggauggauucug

SEQ ID NO: 367584 - RNA, 20 nt, Homo sapiens
uggcaccugacagauagcca

SEQ ID NO: 367585 - RNA, 21 nt, Homo sapiens
uggcacuauucacaauagcaa

SEQ ID NO: 367586 - RNA, 22 nt, Homo sapiens
uggcauauaaagauguguucaa

SEQ ID NO: 367587 - RNA, 22 nt, Homo sapiens
uggccagagggcaauuagcugu

SEQ ID NO: 367588 - RNA, 22 nt, Homo sapiens
uggcuaagaugcacacuucacu

SEQ ID NO: 367589 - RNA, 22 nt, Homo sapiens
uggcuagaccugcauaacagcu

SEQ ID NO: 367590 - RNA, 22 nt, Homo sapiens
ugggaacugaggugaaaagaca

SEQ ID NO: 367591 - RNA, 22 nt, Homo sapiens
ugguaugucuagauggggaagu

SEQ ID NO: 367592 - RNA, 22 nt, Homo sapiens
uguauguugggucaaaguacau

SEQ ID NO: 367593 - RNA, 18 nt, Homo sapiens
ugucccuuugcuguucau

SEQ ID NO: 367594 - RNA, 22 nt, Homo sapiens
ugugaagauggacuaauauagu

SEQ ID NO: 367595 - RNA, 18 nt, Homo sapiens
ugugacauugagcauguc

SEQ ID NO: 367596 - RNA, 22 nt, Homo sapiens
ugugcaaauguuaaacuaacuu

SEQ ID NO: 367597 - RNA, 22 nt, Homo sapiens
uguguuuuuauguaaaauggaa

SEQ ID NO: 367598 - RNA, 22 nt, Homo sapiens
uguuuguuugagauggagucuc

SEQ ID NO: 367599 - RNA, 21 nt, Homo sapiens
uguuuuugcuguguaucucuc

SEQ ID NO: 367600 - RNA, 20 nt, Homo sapiens
uuaaaucuagugcagacuca

SEQ ID NO: 367601 - RNA, 22 nt, Homo sapiens
uuaaggcuuucccuauguaaaa

SEQ ID NO: 367602 - RNA, 22 nt, Homo sapiens
uuaauguaucuaucacaucaca

SEQ ID NO: 367603 - RNA, 22 nt, Homo sapiens
uuacagcagugccccacuccca

SEQ ID NO: 367604 - RNA, 22 nt, Homo sapiens
uuacugcuagcugugugcucuu

SEQ ID NO: 367605 - RNA, 22 nt, Homo sapiens
uuacuugagauggggugucacu

SEQ ID NO: 367606 - RNA, 22 nt, Homo sapiens
uuagccccuuugagccucaacu

SEQ ID NO: 367607 - RNA, 22 nt, Homo sapiens
uuaugguuuuucugugagaugg

SEQ ID NO: 367608 - RNA, 22 nt, Homo sapiens
uuauuagagauauuugguuagg

SEQ ID NO: 367609 - RNA, 19 nt, Homo sapiens
uucacguaggagaaagaag

SEQ ID NO: 367610 - RNA, 22 nt, Homo sapiens
uucacugcauuucagccugggc

SEQ ID NO: 367611 - RNA, 18 nt, Homo sapiens
uucaguuuguaucugggg

SEQ ID NO: 367612 - RNA, 21 nt, Homo sapiens
uucaucagccagaaaucaagc

SEQ ID NO: 367613 - RNA, 22 nt, Homo sapiens
uucauugaaugauuuuuagaag

SEQ ID NO: 367614 - RNA, 22 nt, Homo sapiens
uuccaugugggcuugucaagua

SEQ ID NO: 367615 - RNA, 22 nt, Homo sapiens
uucucuguggauugggugagag

SEQ ID NO: 367616 - RNA, 22 nt, Homo sapiens
uucuguguuuaggucacggcua

SEQ ID NO: 367617 - RNA, 21 nt, Homo sapiens
uucuuugcucaguguuagagu

SEQ ID NO: 367618 - RNA, 22 nt, Homo sapiens
uugaaagacaucaccuacugcu

SEQ ID NO: 367619 - RNA, 22 nt, Homo sapiens
uugaaguguguauacauugugg

SEQ ID NO: 367620 - RNA, 21 nt, Homo sapiens
uugagacggagucucacucug

SEQ ID NO: 367621 - RNA, 22 nt, Homo sapiens
uugagagagaacauuuguuaca

SEQ ID NO: 367622 - RNA, 22 nt, Homo sapiens
uugagaugauggauaugcuaau

SEQ ID NO: 367623 - RNA, 22 nt, Homo sapiens
uugagauggaaucucgcuuugu

SEQ ID NO: 367624 - RNA, 22 nt, Homo sapiens
uugagauggagucucacuccuu

SEQ ID NO: 367625 - RNA, 22 nt, Homo sapiens
uugagauggagucucacucuug

SEQ ID NO: 367626 - RNA, 22 nt, Homo sapiens
uugagauggagucucacugugu

SEQ ID NO: 367627 - RNA, 22 nt, Homo sapiens
uugagauggagucucgcucugu

SEQ ID NO: 367628 - RNA, 22 nt, Homo sapiens
uugagauggagucucgcucuuu

SEQ ID NO: 367629 - RNA, 22 nt, Homo sapiens
uugagauggagucucguucugu

SEQ ID NO: 367630 - RNA, 22 nt, Homo sapiens
uugagauggagucuugcucucu

SEQ ID NO: 367631 - RNA, 22 nt, Homo sapiens
uugagauggagucuuguucucu

SEQ ID NO: 367632 - RNA, 22 nt, Homo sapiens
uugagauggaguguugcucugu

SEQ ID NO: 367633 - RNA, 22 nt, Homo sapiens
uugagauggaguuucaauauug

SEQ ID NO: 367634 - RNA, 22 nt, Homo sapiens
uugagauggaguuucacucucg

SEQ ID NO: 367635 - RNA, 22 nt, Homo sapiens
uugagauggaguuucacucuug

SEQ ID NO: 367636 - RNA, 19 nt, Homo sapiens
uugagaugugaacucacac

SEQ ID NO: 367637 - RNA, 22 nt, Homo sapiens
uugagauguggguuggugacuu

SEQ ID NO: 367638 - RNA, 22 nt, Homo sapiens
uugcacuuccgccugggugaca

SEQ ID NO: 367639 - RNA, 22 nt, Homo sapiens
uugcacuugcugaggagugauu

SEQ ID NO: 367640 - RNA, 22 nt, Homo sapiens
uugcauauguugaaccaagcgu

SEQ ID NO: 367641 - RNA, 23 nt, Homo sapiens
uugcauugcccuccauaguacuc

SEQ ID NO: 367642 - RNA, 22 nt, Homo sapiens
uugcuacuuggauguacaugug

SEQ ID NO: 367643 - RNA, 22 nt, Homo sapiens
uugcugagucuuucuagguugc

SEQ ID NO: 367644 - RNA, 22 nt, Homo sapiens
uugcuuuguuacugcaguuucc

SEQ ID NO: 367645 - RNA, 22 nt, Homo sapiens
uuggaagauuacuuaguuuucu

SEQ ID NO: 367646 - RNA, 22 nt, Homo sapiens
uuggaauguauggcaucuugcg

SEQ ID NO: 367647 - RNA, 22 nt, Homo sapiens
uuggacuaagaacuuaaaauaa

SEQ ID NO: 367648 - RNA, 22 nt, Homo sapiens
uuggagagugauauucagaugc

SEQ ID NO: 367649 - RNA, 22 nt, Homo sapiens
uuggagucaucucuguacugua

SEQ ID NO: 367650 - RNA, 22 nt, Homo sapiens
uuggcaaagugucuggcauuua

SEQ ID NO: 367651 - RNA, 21 nt, Homo sapiens
uuggcacucuucucuccuuau

SEQ ID NO: 367652 - RNA, 22 nt, Homo sapiens
uugguaaugggcugguauaacc

SEQ ID NO: 367653 - RNA, 23 nt, Homo sapiens
uuguaacuggagaguaacauucc

SEQ ID NO: 367654 - RNA, 22 nt, Homo sapiens
uugucaaugggugagugcagag

SEQ ID NO: 367655 - RNA, 22 nt, Homo sapiens
uugucuugcagcuuaggcauca

SEQ ID NO: 367656 - RNA, 22 nt, Homo sapiens
uugugaaugaugccgcaauaaa

SEQ ID NO: 367657 - RNA, 22 nt, Homo sapiens
uugugaaugaugucgcaauaaa

SEQ ID NO: 367658 - RNA, 22 nt, Homo sapiens
uugugaauggugccgcaauaaa

SEQ ID NO: 367659 - RNA, 22 nt, Homo sapiens
uugugcaaaguugugguuucug

SEQ ID NO: 367660 - RNA, 22 nt, Homo sapiens
uugugcaugaugcauacauggu

SEQ ID NO: 367661 - RNA, 22 nt, Homo sapiens
uugugcauguauauuaguucac

SEQ ID NO: 367662 - RNA, 21 nt, Homo sapiens
uugugccaaacccuggaggga

SEQ ID NO: 367663 - RNA, 22 nt, Homo sapiens
uugugcuugauuugccuagcug

SEQ ID NO: 367664 - RNA, 22 nt, Homo sapiens
uuucuauguugaccagucuaga

SEQ ID NO: 367665 - RNA, 22 nt, Homo sapiens
uuucuugguuguauuuagacuu

SEQ ID NO: 367666 - RNA, 22 nt, Homo sapiens
uuugaauggaaguuuugugaaa

SEQ ID NO: 367667 - RNA, 22 nt, Homo sapiens
uuugagaucuuuagaaucaggc

SEQ ID NO: 367668 - RNA, 22 nt, Homo sapiens
uuugagcaggcuaaucaauaua

SEQ ID NO: 367669 - RNA, 23 nt, Homo sapiens
uuugccacuuauuagcugggagg

SEQ ID NO: 367670 - RNA, 22 nt, Homo sapiens
uuugcuugaggucuagcuaccc

SEQ ID NO: 367671 - RNA, 22 nt, Homo sapiens
uuugggaaugguuugucuccca

SEQ ID NO: 367672 - RNA, 22 nt, Homo sapiens
uuuguaauccuauuccaaagga

SEQ ID NO: 367673 - RNA, 23 nt, Homo sapiens
uuuguacuaugucaguuuagaua

SEQ ID NO: 367674 - RNA, 22 nt, Homo sapiens
uuuguacuucauugguucuacu

SEQ ID NO: 367675 - RNA, 22 nt, Homo sapiens
uuuguagcucacucugagcuga

SEQ ID NO: 367676 - RNA, 22 nt, Homo sapiens
cuugccuuugucuucaaaggcu

SEQ ID NO: 367677 - RNA, 22 nt, Homo sapiens
gaagauucaaccaaaccagaac

SEQ ID NO: 367678 - RNA, 22 nt, Homo sapiens
gaaguaggugcuguuauuaucu

SEQ ID NO: 367679 - RNA, 22 nt, Homo sapiens
gaagugguaggauugcuuuuga

SEQ ID NO: 367680 - RNA, 22 nt, Homo sapiens
gaaugaauguuuauccuuagau

SEQ ID NO: 367681 - RNA, 22 nt, Homo sapiens
gagacggagucucgcucuguca

SEQ ID NO: 367682 - RNA, 22 nt, Homo sapiens
gagauggaguuucacuucgcuc

SEQ ID NO: 367683 - RNA, 22 nt, Homo sapiens
gaggagucagacugugcaaggu

SEQ ID NO: 367684 - RNA, 22 nt, Homo sapiens
gagguaugauugacauauaaaa

SEQ ID NO: 367685 - RNA, 22 nt, Homo sapiens
gauauguuagggggagaaguua

SEQ ID NO: 367686 - RNA, 19 nt, Homo sapiens
gauauguugagcacccuuu

SEQ ID NO: 367687 - RNA, 22 nt, Homo sapiens
gauauguuucuucaauaccuag

SEQ ID NO: 367688 - RNA, 22 nt, Homo sapiens
gaucugugugauuggaugcauu

SEQ ID NO: 367689 - RNA, 22 nt, Homo sapiens
gaucuguguuuguaugcauaag

SEQ ID NO: 367690 - RNA, 22 nt, Homo sapiens
gcaauguuacugaauguguuuu

SEQ ID NO: 367691 - RNA, 22 nt, Homo sapiens
gcacaggguuacauucuaaggu

SEQ ID NO: 367692 - RNA, 22 nt, Homo sapiens
gcacaguguuacuugauauauu

SEQ ID NO: 367693 - RNA, 22 nt, Homo sapiens
gcuuugcaauggcauugaccau

SEQ ID NO: 367694 - RNA, 22 nt, Homo sapiens
ggaagaauauuaggggauuucg

SEQ ID NO: 367695 - RNA, 22 nt, Homo sapiens
ggagugugauuguucucuguua

SEQ ID NO: 367696 - RNA, 22 nt, Homo sapiens
ggaguguguaggagaaagguaa

SEQ ID NO: 367697 - RNA, 22 nt, Homo sapiens
ggcaaaugaagauggagaggcu

SEQ ID NO: 367698 - RNA, 22 nt, Homo sapiens
ggcaugaggccauaaaaguaag

SEQ ID NO: 367699 - RNA, 22 nt, Homo sapiens
gggaagugugcagaguucucuu

SEQ ID NO: 367700 - RNA, 22 nt, Homo sapiens
gggaugaaguugauguagaaag

SEQ ID NO: 367701 - RNA, 22 nt, Homo sapiens
gggaugaauuagguauguuuau

SEQ ID NO: 367702 - RNA, 22 nt, Homo sapiens
ggucauagagaauucaccagga

SEQ ID NO: 367703 - RNA, 22 nt, Homo sapiens
guaaauguccugcuacagagug

SEQ ID NO: 367704 - RNA, 22 nt, Homo sapiens
guauuguacuacaagcucuuua

SEQ ID NO: 367705 - RNA, 22 nt, Homo sapiens
gucgguguuuccugagaacgaa

SEQ ID NO: 367706 - RNA, 22 nt, Homo sapiens
gucucccagccuacauauuucu

SEQ ID NO: 367707 - RNA, 22 nt, Homo sapiens
gucuggcaauggcagacuggca

SEQ ID NO: 367708 - RNA, 22 nt, Homo sapiens
gucugguuggaguaguuuucag

SEQ ID NO: 367709 - RNA, 22 nt, Homo sapiens
gugacacuggagcuggcacaau

SEQ ID NO: 367710 - RNA, 22 nt, Homo sapiens
gugacauuauuucagcuacaug

SEQ ID NO: 367711 - RNA, 22 nt, Homo sapiens
gugagauggagucuugcuuugu

SEQ ID NO: 367712 - RNA, 22 nt, Homo sapiens
gugagaugugacuucugccucu

SEQ ID NO: 367713 - RNA, 22 nt, Homo sapiens
gugagauuaccauuuaaaucag

SEQ ID NO: 367714 - RNA, 22 nt, Homo sapiens
gugcacaucgugcagguuuguu

SEQ ID NO: 367715 - RNA, 20 nt, Homo sapiens
gugugcauuucagauuuugg

SEQ ID NO: 367716 - RNA, 22 nt, Homo sapiens
guguugcacauucuguggaugu

SEQ ID NO: 367717 - RNA, 22 nt, Homo sapiens
uaagucuuuuuggaguuuauaa

SEQ ID NO: 367718 - RNA, 22 nt, Homo sapiens
uaauugcaguucuguguuauau

SEQ ID NO: 367719 - RNA, 22 nt, Homo sapiens
uacacaugugaguucuuuucua

SEQ ID NO: 367720 - RNA, 22 nt, Homo sapiens
uacaguagagaucagcaaacua

SEQ ID NO: 367721 - RNA, 22 nt, Homo sapiens
uacagucauaaugccuagugac

SEQ ID NO: 367722 - RNA, 22 nt, Homo sapiens
uacuguacugcaguucugcaaa

SEQ ID NO: 367723 - RNA, 22 nt, Homo sapiens
uggagucuugcucuguugccca

SEQ ID NO: 367724 - RNA, 22 nt, Homo sapiens
uggauagaacuaagugcuuaga

SEQ ID NO: 367725 - RNA, 22 nt, Homo sapiens
uggcaagugggaccuaguuaaa

SEQ ID NO: 367726 - RNA, 22 nt, Homo sapiens
uggcaccugacuccgagaugca

SEQ ID NO: 367727 - RNA, 22 nt, Homo sapiens
uggcauaugguauuugauaucu

SEQ ID NO: 367728 - RNA, 22 nt, Homo sapiens
uggccuguaacccucucauagg

SEQ ID NO: 367729 - RNA, 22 nt, Homo sapiens
ugggaucagcugggcucucugu

SEQ ID NO: 367730 - RNA, 22 nt, Homo sapiens
ugggcggagacgugcagccgcc

SEQ ID NO: 367731 - RNA, 22 nt, Homo sapiens
ugguaagaggcccugaguuugu

SEQ ID NO: 367732 - RNA, 22 nt, Homo sapiens
uggugagaaaagaugucuuugu

SEQ ID NO: 367733 - RNA, 22 nt, Homo sapiens
uguaaaucugguuaauuggaua

SEQ ID NO: 367734 - RNA, 22 nt, Homo sapiens
uguaauguuucaucauuauuaa

SEQ ID NO: 367735 - RNA, 22 nt, Homo sapiens
uguauguugauguuauauucug

SEQ ID NO: 367736 - RNA, 22 nt, Homo sapiens
uguauguuguaagacuuagacc

SEQ ID NO: 367737 - RNA, 22 nt, Homo sapiens
ugucacaguuuguacuuuauag

SEQ ID NO: 367738 - RNA, 19 nt, Homo sapiens
ugucaucaucuuuucuugc

SEQ ID NO: 367739 - RNA, 22 nt, Homo sapiens
ugucuaaagaauggcagacuca

SEQ ID NO: 367740 - RNA, 22 nt, Homo sapiens
ugugcuugaauuuaguagcuua

SEQ ID NO: 367741 - RNA, 22 nt, Homo sapiens
ugugggugguaaaauacaauga

SEQ ID NO: 367742 - RNA, 22 nt, Homo sapiens
ugugucuuuuaucacacaaugu

SEQ ID NO: 367743 - RNA, 22 nt, Homo sapiens
uguuaacauggucucagucugu

SEQ ID NO: 367744 - RNA, 22 nt, Homo sapiens
uuaaaggcauguacacuagagu

SEQ ID NO: 367745 - RNA, 22 nt, Homo sapiens
uuaacagucacuuagcucauuu

SEQ ID NO: 367746 - RNA, 22 nt, Homo sapiens
uuaaggcuuuaaguaaacacag

SEQ ID NO: 367747 - RNA, 22 nt, Homo sapiens
uuacagauggauggcagcuggc

SEQ ID NO: 367748 - RNA, 22 nt, Homo sapiens
uuagaucaacauggaacucuau

SEQ ID NO: 367749 - RNA, 22 nt, Homo sapiens
uuagucaaguguacugugaaug

SEQ ID NO: 367750 - RNA, 22 nt, Homo sapiens
uuauaacagagacuccugugcu

SEQ ID NO: 367751 - RNA, 18 nt, Homo sapiens
uuauacuccccaggcaau

SEQ ID NO: 367752 - RNA, 22 nt, Homo sapiens
uuauauguuagacauggugggu

SEQ ID NO: 367753 - RNA, 22 nt, Homo sapiens
uuaugucuuuuguguucagcua

SEQ ID NO: 367754 - RNA, 22 nt, Homo sapiens
uucaaaguaaaaauguguucac

SEQ ID NO: 367755 - RNA, 22 nt, Homo sapiens
uucacugcacuccagccugagc

SEQ ID NO: 367756 - RNA, 22 nt, Homo sapiens
uucacugcacuccagccugggu

SEQ ID NO: 367757 - RNA, 22 nt, Homo sapiens
uucagggagaaggcaaacguug

SEQ ID NO: 367758 - RNA, 21 nt, Homo sapiens
uucaucuggccguauuccagg

SEQ ID NO: 367759 - RNA, 22 nt, Homo sapiens
uuccauguaguugaacgguuuu

SEQ ID NO: 367760 - RNA, 22 nt, Homo sapiens
uuccauguugauacgugaaguu

SEQ ID NO: 367761 - RNA, 22 nt, Homo sapiens
uuccuucaugcuugaaggguau

SEQ ID NO: 367762 - RNA, 22 nt, Homo sapiens
uucuauugguaauauuuucugu

SEQ ID NO: 367763 - RNA, 22 nt, Homo sapiens
uucuucugguuaugaaauuuga

SEQ ID NO: 367764 - RNA, 22 nt, Homo sapiens
uugaaagucauuucuucuaagu

SEQ ID NO: 367765 - RNA, 22 nt, Homo sapiens
uugaaauguuuagaaguuugga

SEQ ID NO: 367766 - RNA, 22 nt, Homo sapiens
uugagauaggaacucacuaugc

SEQ ID NO: 367767 - RNA, 22 nt, Homo sapiens
uugagauggagccucacucugc

SEQ ID NO: 367768 - RNA, 22 nt, Homo sapiens
uugagauggagucucacgcauu

SEQ ID NO: 367769 - RNA, 22 nt, Homo sapiens
uugagauggagucucacucugu

SEQ ID NO: 367770 - RNA, 22 nt, Homo sapiens
uugagauggagucucacucuuc

SEQ ID NO: 367771 - RNA, 22 nt, Homo sapiens
uugagauggagucucacucuuu

SEQ ID NO: 367772 - RNA, 22 nt, Homo sapiens
uugagauggagucuugcucugu

SEQ ID NO: 367773 - RNA, 22 nt, Homo sapiens
uugagauggagucuuguucuuu

SEQ ID NO: 367774 - RNA, 22 nt, Homo sapiens
uugagauggaguuucacucugu

SEQ ID NO: 367775 - RNA, 22 nt, Homo sapiens
uugagauggaguuucgcucuug

SEQ ID NO: 367776 - RNA, 22 nt, Homo sapiens
uugagauggaguuucgcucuuu

SEQ ID NO: 367777 - RNA, 22 nt, Homo sapiens
uugagauggauagacauagcau

SEQ ID NO: 367778 - RNA, 22 nt, Homo sapiens
uugagauguaguuucacuccug

SEQ ID NO: 367779 - RNA, 22 nt, Homo sapiens
uugagauguggcaguuuaugag

SEQ ID NO: 367780 - RNA, 22 nt, Homo sapiens
uugagauuuuccucaaauauuu

SEQ ID NO: 367781 - RNA, 22 nt, Homo sapiens
uugaggaguacugauuagguau

SEQ ID NO: 367782 - RNA, 22 nt, Homo sapiens
uagagcaaugacucuggaaacc

SEQ ID NO: 367783 - RNA, 22 nt, Homo sapiens
uagaucaacuuugguaagagaa

SEQ ID NO: 367784 - RNA, 22 nt, Homo sapiens
uaguauguuuauagcauugagu

SEQ ID NO: 367785 - RNA, 22 nt, Homo sapiens
uagugaaugucacuggcuguug

SEQ ID NO: 367786 - RNA, 22 nt, Homo sapiens
uauacugucuuuguaugccuag

SEQ ID NO: 367787 - RNA, 22 nt, Homo sapiens
uauaugucugagacugggggau

SEQ ID NO: 367788 - RNA, 22 nt, Homo sapiens
uauauguucugugucccuuucg

SEQ ID NO: 367789 - RNA, 22 nt, Homo sapiens
uaucagaucccaauuucuggcc

SEQ ID NO: 367790 - RNA, 22 nt, Homo sapiens
uaucucuguggguagugcugaa

SEQ ID NO: 367791 - RNA, 22 nt, Homo sapiens
uaucucuuuucauguguaaaug

SEQ ID NO: 367792 - RNA, 23 nt, Homo sapiens
uaugacagaggaagggggagcug

SEQ ID NO: 367793 - RNA, 22 nt, Homo sapiens
uaugagagcugguagguagaga

SEQ ID NO: 367794 - RNA, 22 nt, Homo sapiens
uauggauguuaagguucacagc

SEQ ID NO: 367795 - RNA, 22 nt, Homo sapiens
uauggcacuaguacuggaaagc

SEQ ID NO: 367796 - RNA, 22 nt, Homo sapiens
uauggcuuuucacuuaaguccu

SEQ ID NO: 367797 - RNA, 22 nt, Homo sapiens
uaugguuuuaagguuaaggacu

SEQ ID NO: 367798 - RNA, 22 nt, Homo sapiens
uauguuaucaaaaagcuaagga

SEQ ID NO: 367799 - RNA, 22 nt, Homo sapiens
uauuacuugucugugucucaau

SEQ ID NO: 367800 - RNA, 22 nt, Homo sapiens
uauuccacuuacaugagguauc

SEQ ID NO: 367801 - RNA, 18 nt, Homo sapiens
uauugcuugguuuggaga

SEQ ID NO: 367802 - RNA, 22 nt, Homo sapiens
ucacagacauugaggggaccuu

SEQ ID NO: 367803 - RNA, 22 nt, Homo sapiens
ucacagacugagccaaauagag

SEQ ID NO: 367804 - RNA, 22 nt, Homo sapiens
ucacugcgcuucagccugggug

SEQ ID NO: 367805 - RNA, 22 nt, Homo sapiens
ucagaguagcugucugaggugc

SEQ ID NO: 367806 - RNA, 22 nt, Homo sapiens
ucagaucaugcuuaugauggga

SEQ ID NO: 367807 - RNA, 22 nt, Homo sapiens
ucagauguuugagaaguauacu

SEQ ID NO: 367808 - RNA, 22 nt, Homo sapiens
ucagggacgcuugacacaagcc

SEQ ID NO: 367809 - RNA, 22 nt, Homo sapiens
ucaggguacuuguggccaaagu

SEQ ID NO: 367810 - RNA, 22 nt, Homo sapiens
ucagugaauacauguacucaug

SEQ ID NO: 367811 - RNA, 22 nt, Homo sapiens
ucagugaauguuggccacuacu

SEQ ID NO: 367812 - RNA, 22 nt, Homo sapiens
ucauacaggccaccagggaagu

SEQ ID NO: 367813 - RNA, 21 nt, Homo sapiens
ucaucaagcuguagacaugau

SEQ ID NO: 367814 - RNA, 22 nt, Homo sapiens
ucauccauacaguuagcaaagg

SEQ ID NO: 367815 - RNA, 22 nt, Homo sapiens
uccaugugaaaaggucgugaua

SEQ ID NO: 367816 - RNA, 22 nt, Homo sapiens
uccaugugaaaucuaugaggac

SEQ ID NO: 367817 - RNA, 22 nt, Homo sapiens
ucccauugucucugaccuugcc

SEQ ID NO: 367818 - RNA, 22 nt, Homo sapiens
uccuugagucuuugcucagaug

SEQ ID NO: 367819 - RNA, 22 nt, Homo sapiens
ucucaugaagguggagaguagg

SEQ ID NO: 367820 - RNA, 22 nt, Homo sapiens
ucucauuggucugagucaccug

SEQ ID NO: 367821 - RNA, 19 nt, Homo sapiens
ucugacagccccagucaac

SEQ ID NO: 367822 - RNA, 23 nt, Homo sapiens
ucugauguuauaaaauucuuugg

SEQ ID NO: 367823 - RNA, 23 nt, Homo sapiens
ucuggaucauucguagugccagc

SEQ ID NO: 367824 - RNA, 22 nt, Homo sapiens
ucuggcaagagccgagggcagu

SEQ ID NO: 367825 - RNA, 22 nt, Homo sapiens
ucuggcaagauauccauugcuu

SEQ ID NO: 367826 - RNA, 22 nt, Homo sapiens
ucugguguuauucauguaguuu

SEQ ID NO: 367827 - RNA, 22 nt, Homo sapiens
ucugugcauuacacuuuucuca

SEQ ID NO: 367828 - RNA, 22 nt, Homo sapiens
ucugugcauuguaggauguuua

SEQ ID NO: 367829 - RNA, 22 nt, Homo sapiens
ucuguguugaucacacugggag

SEQ ID NO: 367830 - RNA, 22 nt, Homo sapiens
ucuguuguuguuuuaagagaca

SEQ ID NO: 367831 - RNA, 17 nt, Homo sapiens
ucuucuguuacuguggc

SEQ ID NO: 367832 - RNA, 22 nt, Homo sapiens
ucuugcauuuuuaaauagugcu

SEQ ID NO: 367833 - RNA, 22 nt, Homo sapiens
ucuugcuuguuguucccuucau

SEQ ID NO: 367834 - RNA, 22 nt, Homo sapiens
ucuugcuuuugcagagcuucuc

SEQ ID NO: 367835 - RNA, 22 nt, Homo sapiens
ucuugguuaggggaaauaggca

SEQ ID NO: 367836 - RNA, 19 nt, Homo sapiens
ucuuugcuuuucuaagagg

SEQ ID NO: 367837 - RNA, 22 nt, Homo sapiens
ucuuuugugagucagccucucc

SEQ ID NO: 367838 - RNA, 22 nt, Homo sapiens
ucuuuuugagucaguuucggua

SEQ ID NO: 367839 - RNA, 22 nt, Homo sapiens
ugaaacauacacucugaugggg

SEQ ID NO: 367840 - RNA, 22 nt, Homo sapiens
ugaaaugucuuuaggaggcuuc

SEQ ID NO: 367841 - RNA, 18 nt, Homo sapiens
ugaauaguguccccauga

SEQ ID NO: 367842 - RNA, 22 nt, Homo sapiens
ugaauauuugcuacucacucuu

SEQ ID NO: 367843 - RNA, 21 nt, Homo sapiens
ugacauguugguuugcugcac

SEQ ID NO: 367844 - RNA, 22 nt, Homo sapiens
ugacuacaaccuccaccucccg

SEQ ID NO: 367845 - RNA, 22 nt, Homo sapiens
ugagacggagucucgcucuguu

SEQ ID NO: 367846 - RNA, 22 nt, Homo sapiens
ugagaugacgacacaccucagu

SEQ ID NO: 367847 - RNA, 22 nt, Homo sapiens
ugagaugagggcugcacucaaa

SEQ ID NO: 367848 - RNA, 22 nt, Homo sapiens
ugagaugcuccucuugcaaagc

SEQ ID NO: 367849 - RNA, 22 nt, Homo sapiens
ugagauggaguuucgcucuugu

SEQ ID NO: 367850 - RNA, 22 nt, Homo sapiens
ugagaugguaaauuuuuguugu

SEQ ID NO: 367851 - RNA, 22 nt, Homo sapiens
ugagauguugcucugaaacaag

SEQ ID NO: 367852 - RNA, 22 nt, Homo sapiens
ugagauguuuguuucagugccu

SEQ ID NO: 367853 - RNA, 22 nt, Homo sapiens
ugagcagagggagaaguaaauu

SEQ ID NO: 367854 - RNA, 18 nt, Homo sapiens
ugaggaaaggguuugcua

SEQ ID NO: 367855 - RNA, 22 nt, Homo sapiens
ugagguaagauguucauuuuuc

SEQ ID NO: 367856 - RNA, 22 nt, Homo sapiens
ugagguaaugcuguagcuguga

SEQ ID NO: 367857 - RNA, 22 nt, Homo sapiens
ugaguagaacuccuggagaugu

SEQ ID NO: 367858 - RNA, 22 nt, Homo sapiens
ugaguauguuuagaaguaaagg

SEQ ID NO: 367859 - RNA, 22 nt, Homo sapiens
ugagucagucucacucugcugc

SEQ ID NO: 367860 - RNA, 22 nt, Homo sapiens
ugaguguccaccccuuucacag

SEQ ID NO: 367861 - RNA, 22 nt, Homo sapiens
ugaguuccuugugugaccuugc

SEQ ID NO: 367862 - RNA, 20 nt, Homo sapiens
ugaguuccuuguucagaagc

SEQ ID NO: 367863 - RNA, 22 nt, Homo sapiens
ugauauauugaaugaugaaaca

SEQ ID NO: 367864 - RNA, 22 nt, Homo sapiens
ugauauguaugugaccuagaaa

SEQ ID NO: 367865 - RNA, 22 nt, Homo sapiens
ugauauguguaaacaauguaua

SEQ ID NO: 367866 - RNA, 22 nt, Homo sapiens
ugauggcauuuggaguugggac

SEQ ID NO: 367867 - RNA, 18 nt, Homo sapiens
ugcaaacauguguguguu

SEQ ID NO: 367868 - RNA, 22 nt, Homo sapiens
ugcauacugggagguugggugu

SEQ ID NO: 367869 - RNA, 21 nt, Homo sapiens
ugcauaucucuaaugaccagu

SEQ ID NO: 367870 - RNA, 22 nt, Homo sapiens
ugcauauguugagaugcauauu

SEQ ID NO: 367871 - RNA, 19 nt, Homo sapiens
ugcauugucugggaaaugg

SEQ ID NO: 367872 - RNA, 22 nt, Homo sapiens
ugcauuguuccgaauguguccu

SEQ ID NO: 367873 - RNA, 21 nt, Homo sapiens
ugcauuguugcugagagcagg

SEQ ID NO: 367874 - RNA, 19 nt, Homo sapiens
ugccaagaaagucagcuua

SEQ ID NO: 367875 - RNA, 22 nt, Homo sapiens
ugccugagcccagcccuguagu

SEQ ID NO: 367876 - RNA, 22 nt, Homo sapiens
ugcugcauuggggauuaaguuu

SEQ ID NO: 367877 - RNA, 22 nt, Homo sapiens
ugcugguauuuggaccagccug

SEQ ID NO: 367878 - RNA, 23 nt, Homo sapiens
uggaacugaauuucuuagcauuu

SEQ ID NO: 367879 - RNA, 22 nt, Homo sapiens
uggagagucauuuauaguauuu

SEQ ID NO: 367880 - RNA, 22 nt, Homo sapiens
uggagguaggugauauguagca

SEQ ID NO: 367881 - RNA, 22 nt, Homo sapiens
aaacugucuggaugcuugugga

SEQ ID NO: 367882 - RNA, 22 nt, Homo sapiens
aaagaagucagccuguccuuug

SEQ ID NO: 367883 - RNA, 22 nt, Homo sapiens
aaagagaucuaugggcacuaug

SEQ ID NO: 367884 - RNA, 22 nt, Homo sapiens
aaagguaguacuucuagaaggg

SEQ ID NO: 367885 - RNA, 22 nt, Homo sapiens
aaauucauuucagcucugggua

SEQ ID NO: 367886 - RNA, 22 nt, Homo sapiens
aacacuguuuccagucaugauc

SEQ ID NO: 367887 - RNA, 22 nt, Homo sapiens
aacagcacacccgcugcuucca

SEQ ID NO: 367888 - RNA, 22 nt, Homo sapiens
aacauguuuagcagauaccugu

SEQ ID NO: 367889 - RNA, 22 nt, Homo sapiens
aagccacuguaccugucucuua

SEQ ID NO: 367890 - RNA, 22 nt, Homo sapiens
aaggcaagguggauaaugaagc

SEQ ID NO: 367891 - RNA, 22 nt, Homo sapiens
aaguaaauauccgguaguccca

SEQ ID NO: 367892 - RNA, 22 nt, Homo sapiens
aagugaauguuugguagcagug

SEQ ID NO: 367893 - RNA, 22 nt, Homo sapiens
aagugguagggucaggauugga

SEQ ID NO: 367894 - RNA, 22 nt, Homo sapiens
aaguuguuggaguuccauuguu

SEQ ID NO: 367895 - RNA, 22 nt, Homo sapiens
aauaaaguaggaggugaggaaa

SEQ ID NO: 367896 - RNA, 22 nt, Homo sapiens
aaucaccaugcacuacagccuu

SEQ ID NO: 367897 - RNA, 22 nt, Homo sapiens
aaugcaucuagaaaggugaauu

SEQ ID NO: 367898 - RNA, 22 nt, Homo sapiens
aauggguaguacugugguaaca

SEQ ID NO: 367899 - RNA, 23 nt, Homo sapiens
aauugcacauuccuugcuggcag

SEQ ID NO: 367900 - RNA, 23 nt, Homo sapiens
aauugcuuuugaggacuuaguug

SEQ ID NO: 367901 - RNA, 22 nt, Homo sapiens
acacuugcuugcaauagccucc

SEQ ID NO: 367902 - RNA, 22 nt, Homo sapiens
acuauacugaagcaaauuaaca

SEQ ID NO: 367903 - RNA, 22 nt, Homo sapiens
acucugucuaguuguaaaauuu

SEQ ID NO: 367904 - RNA, 22 nt, Homo sapiens
acugagccuuuaaaugacuuca

SEQ ID NO: 367905 - RNA, 22 nt, Homo sapiens
acuggcuuaaggaugggccacu

SEQ ID NO: 367906 - RNA, 22 nt, Homo sapiens
acuguguguuugucuagcacag

SEQ ID NO: 367907 - RNA, 22 nt, Homo sapiens
acuuuuguuauacagugugaua

SEQ ID NO: 367908 - RNA, 22 nt, Homo sapiens
agaaugauccuucucagaggca

SEQ ID NO: 367909 - RNA, 22 nt, Homo sapiens
agagacauugcuccaacucacc

SEQ ID NO: 367910 - RNA, 22 nt, Homo sapiens
agagcaaugggugaauauuaaa

SEQ ID NO: 367911 - RNA, 22 nt, Homo sapiens
agaguaguuuauuaugcuaagg

SEQ ID NO: 367912 - RNA, 22 nt, Homo sapiens
agaucauaugcaguaaugaacu

SEQ ID NO: 367913 - RNA, 22 nt, Homo sapiens
agaugauguuucuggcacauga

SEQ ID NO: 367914 - RNA, 22 nt, Homo sapiens
agauggguuuucacauguuggc

SEQ ID NO: 367915 - RNA, 22 nt, Homo sapiens
agcaagauugauggccugcagg

SEQ ID NO: 367916 - RNA, 21 nt, Homo sapiens
agcuaaauuggaaauuucugu

SEQ ID NO: 367917 - RNA, 22 nt, Homo sapiens
agcuauauugaggaugccauuc

SEQ ID NO: 367918 - RNA, 22 nt, Homo sapiens
agcuccaugauaguaugucugu

SEQ ID NO: 367919 - RNA, 22 nt, Homo sapiens
agcugccagucuuguaaggccu

SEQ ID NO: 367920 - RNA, 21 nt, Homo sapiens
aggaagacuaugaucaauugg

SEQ ID NO: 367921 - RNA, 22 nt, Homo sapiens
aggagguagggugugaaacagc

SEQ ID NO: 367922 - RNA, 22 nt, Homo sapiens
aggcuuauuaagauucccuuau

SEQ ID NO: 367923 - RNA, 22 nt, Homo sapiens
agguuguguuugugauuagaua

SEQ ID NO: 367924 - RNA, 22 nt, Homo sapiens
agguuuucagccccagccuagg

SEQ ID NO: 367925 - RNA, 22 nt, Homo sapiens
aguauuuguuggaauaccuguu

SEQ ID NO: 367926 - RNA, 22 nt, Homo sapiens
agugaaaugucaccuuuuagga

SEQ ID NO: 367927 - RNA, 22 nt, Homo sapiens
agugcauaugucuuuuuggaag

SEQ ID NO: 367928 - RNA, 22 nt, Homo sapiens
auaaaccuacauuuucacuucu

SEQ ID NO: 367929 - RNA, 22 nt, Homo sapiens
auaagucaauggaacagauuaa

SEQ ID NO: 367930 - RNA, 22 nt, Homo sapiens
auugcaaagcguagacucuaaa

SEQ ID NO: 367931 - RNA, 22 nt, Homo sapiens
auuugguuauggucauggacac

SEQ ID NO: 367932 - RNA, 22 nt, Homo sapiens
auuugucacuauguggcuaaua

SEQ ID NO: 367933 - RNA, 22 nt, Homo sapiens
caauggcaaugaaauagugaga

SEQ ID NO: 367934 - RNA, 22 nt, Homo sapiens
cagaugcaugaccugggcuugg

SEQ ID NO: 367935 - RNA, 22 nt, Homo sapiens
caugauauugcagaauguuggu

SEQ ID NO: 367936 - RNA, 22 nt, Homo sapiens
cauggcacugagcagguaugca

SEQ ID NO: 367937 - RNA, 22 nt, Homo sapiens
cauggcacuguaugaaaugugc

SEQ ID NO: 367938 - RNA, 22 nt, Homo sapiens
cauggcuacugcagauguaggg

SEQ ID NO: 367939 - RNA, 22 nt, Homo sapiens
cauugcuuuuggugguuuagac

SEQ ID NO: 367940 - RNA, 22 nt, Homo sapiens
ccaagccucaguuucccucugu

SEQ ID NO: 367941 - RNA, 22 nt, Homo sapiens
ccaucacaggccucagugggaa

SEQ ID NO: 367942 - RNA, 21 nt, Homo sapiens
ccaugggacggaaugaauaca

SEQ ID NO: 367943 - RNA, 22 nt, Homo sapiens
cccaguuuugcuucucaugagg

SEQ ID NO: 367944 - RNA, 22 nt, Homo sapiens
ccuaggcacugggguccagccc

SEQ ID NO: 367945 - RNA, 22 nt, Homo sapiens
ccucccuuuguugcaagggaaa

SEQ ID NO: 367946 - RNA, 22 nt, Homo sapiens
cuaaaugucucuacuaaguuua

SEQ ID NO: 367947 - RNA, 22 nt, Homo sapiens
cuaacuaugucucaggaugucc

SEQ ID NO: 367948 - RNA, 22 nt, Homo sapiens
cuauggcuguaaggauaguaac

SEQ ID NO: 367949 - RNA, 17 nt, Homo sapiens
cucacugagaacagcua

SEQ ID NO: 367950 - RNA, 22 nt, Homo sapiens
cucauggaauacuucacagcca

SEQ ID NO: 367951 - RNA, 22 nt, Homo sapiens
cuccauagucuucgaagaauga

SEQ ID NO: 367952 - RNA, 22 nt, Homo sapiens
cuccauguggcuaacuuuuaaa

SEQ ID NO: 367953 - RNA, 22 nt, Homo sapiens
cucugcuuaaugucccacuuga

SEQ ID NO: 367954 - RNA, 22 nt, Homo sapiens
cugaaaucagccaguuaguuuc

SEQ ID NO: 367955 - RNA, 22 nt, Homo sapiens
cugagagaugagaccucucacu

SEQ ID NO: 367956 - RNA, 22 nt, Homo sapiens
cugaggguagaaggaucacuug

SEQ ID NO: 367957 - RNA, 22 nt, Homo sapiens
cugagguacugggggccaggau

SEQ ID NO: 367958 - RNA, 22 nt, Homo sapiens
cugauacugaaagcuguugguu

SEQ ID NO: 367959 - RNA, 22 nt, Homo sapiens
cuggcgagacagcuccaucacu

SEQ ID NO: 367960 - RNA, 22 nt, Homo sapiens
cugucuguuucaaaagugguua

SEQ ID NO: 367961 - RNA, 22 nt, Homo sapiens
cugugcauaucuuggacugugu

SEQ ID NO: 367962 - RNA, 22 nt, Homo sapiens
cugugcauggauuuuaagauug

SEQ ID NO: 367963 - RNA, 22 nt, Homo sapiens
cuuacagucuaucagccacaac

SEQ ID NO: 367964 - RNA, 22 nt, Homo sapiens
cuugcagagcccauggauguca

SEQ ID NO: 367965 - RNA, 21 nt, Homo sapiens
cuugucuugcuuagaauagac

SEQ ID NO: 367966 - RNA, 22 nt, Homo sapiens
cuugugauugcacggcugccug

SEQ ID NO: 367967 - RNA, 17 nt, Homo sapiens
ucucccaucccuuucuc

SEQ ID NO: 367968 - RNA, 22 nt, Homo sapiens
ucucuguuuauuuuugguguau

SEQ ID NO: 367969 - RNA, 22 nt, Homo sapiens
ucugaguggcagaaugagcuga

SEQ ID NO: 367970 - RNA, 22 nt, Homo sapiens
ucugccuacugguuggaggaac

SEQ ID NO: 367971 - RNA, 22 nt, Homo sapiens
ucuggccuagaacaauuaauua

SEQ ID NO: 367972 - RNA, 18 nt, Homo sapiens
ucuggcuucuuuguucca

SEQ ID NO: 367973 - RNA, 22 nt, Homo sapiens
ucugugcauggcagaggaauga

SEQ ID NO: 367974 - RNA, 22 nt, Homo sapiens
ucugugcauuguaacaacuaaa

SEQ ID NO: 367975 - RNA, 22 nt, Homo sapiens
ucugugcugagaguugaaaguu

SEQ ID NO: 367976 - RNA, 22 nt, Homo sapiens
ucugugcuugucauaugcuuug

SEQ ID NO: 367977 - RNA, 22 nt, Homo sapiens
ucuucagucauauuggccugga

SEQ ID NO: 367978 - RNA, 20 nt, Homo sapiens
ucuugggaauguagccuagg

SEQ ID NO: 367979 - RNA, 22 nt, Homo sapiens
ucuuuuguaaaaugaggaggug

SEQ ID NO: 367980 - RNA, 22 nt, Homo sapiens
ucuuuuguucuauucaggccuu

SEQ ID NO: 367981 - RNA, 22 nt, Homo sapiens
ugaaaugaucaguuugguuacu

SEQ ID NO: 367982 - RNA, 22 nt, Homo sapiens
ugaagacucaauuauuaugaac

SEQ ID NO: 367983 - RNA, 22 nt, Homo sapiens
ugaauacagcacacccaugggu

SEQ ID NO: 367984 - RNA, 22 nt, Homo sapiens
ugaauguacacgcguacuuguu

SEQ ID NO: 367985 - RNA, 22 nt, Homo sapiens
ugacacauguagacaucuggug

SEQ ID NO: 367986 - RNA, 22 nt, Homo sapiens
ugacaguuuccagggcugucuc

SEQ ID NO: 367987 - RNA, 22 nt, Homo sapiens
ugacuagugcccuuugcugccu

SEQ ID NO: 367988 - RNA, 22 nt, Homo sapiens
ugacuugaacuucuaugucacc

SEQ ID NO: 367989 - RNA, 22 nt, Homo sapiens
ugagagacaguuucgucggagg

SEQ ID NO: 367990 - RNA, 22 nt, Homo sapiens
ugagaucaagguuaauauaauc

SEQ ID NO: 367991 - RNA, 22 nt, Homo sapiens
ugagaugaacuugauuguuuua

SEQ ID NO: 367992 - RNA, 22 nt, Homo sapiens
ugagaugagaaucaguucuaau

SEQ ID NO: 367993 - RNA, 22 nt, Homo sapiens
ugagaugaguucucgcucuguc

SEQ ID NO: 367994 - RNA, 22 nt, Homo sapiens
ugagaugauagauauguuaauu

SEQ ID NO: 367995 - RNA, 22 nt, Homo sapiens
ugagaugcauauucuggcuccu

SEQ ID NO: 367996 - RNA, 22 nt, Homo sapiens
ugagauggaguuucacuuuugu

SEQ ID NO: 367997 - RNA, 22 nt, Homo sapiens
ugagauggaguuucgcuuuugu

SEQ ID NO: 367998 - RNA, 22 nt, Homo sapiens
ugagauggaucuuggauuugaa

SEQ ID NO: 367999 - RNA, 22 nt, Homo sapiens
ugagauggcugaauucagaaua

SEQ ID NO: 368000 - RNA, 22 nt, Homo sapiens
ugagauggguucugguccccug

SEQ ID NO: 368001 - RNA, 23 nt, Homo sapiens
ugagcaauauucuacuauugagu

SEQ ID NO: 368002 - RNA, 20 nt, Homo sapiens
ugagccccuggacucaagcg

SEQ ID NO: 368003 - RNA, 22 nt, Homo sapiens
ugagcugagaaaugcagcagcu

SEQ ID NO: 368004 - RNA, 22 nt, Homo sapiens
ugaggaauguguguuaaagaua

SEQ ID NO: 368005 - RNA, 22 nt, Homo sapiens
ugaggcaaggcugaaugaaggc

SEQ ID NO: 368006 - RNA, 20 nt, Homo sapiens
ugaggucugagaaagaauga

SEQ ID NO: 368007 - RNA, 22 nt, Homo sapiens
ugaguuaauuuuuguaucaugu

SEQ ID NO: 368008 - RNA, 22 nt, Homo sapiens
ugauggcauuucauguuuguaa

SEQ ID NO: 368009 - RNA, 19 nt, Homo sapiens
ugcaaauucuaaaaacuga

SEQ ID NO: 368010 - RNA, 19 nt, Homo sapiens
ugcagcaauguaaaagaca

SEQ ID NO: 368011 - RNA, 22 nt, Homo sapiens
ugcauaucuucagccgggcacg

SEQ ID NO: 368012 - RNA, 22 nt, Homo sapiens
ugcauaucuucuuuugagaaau

SEQ ID NO: 368013 - RNA, 22 nt, Homo sapiens
ugcauccauucuagacucaucu

SEQ ID NO: 368014 - RNA, 21 nt, Homo sapiens
ugcauugucuugaguuuaaau

SEQ ID NO: 368015 - RNA, 22 nt, Homo sapiens
ugccaaggagucagucccuaga

SEQ ID NO: 368016 - RNA, 22 nt, Homo sapiens
ugccugagccagguuuuaggag

SEQ ID NO: 368017 - RNA, 22 nt, Homo sapiens
ugccuucuguuaaacgaggaug

SEQ ID NO: 368018 - RNA, 22 nt, Homo sapiens
ugcgccauugaacuccuccugg

SEQ ID NO: 368019 - RNA, 22 nt, Homo sapiens
ugcgccauugcacuccagccug

SEQ ID NO: 368020 - RNA, 22 nt, Homo sapiens
ugcgccauugcauuccagccug

SEQ ID NO: 368021 - RNA, 22 nt, Homo sapiens
ugcuggugauuaaauccugaag

SEQ ID NO: 368022 - RNA, 19 nt, Homo sapiens
ugcuuaguuuuauguguaa

SEQ ID NO: 368023 - RNA, 22 nt, Homo sapiens
ugcuugagacacauaugaauuu

SEQ ID NO: 368024 - RNA, 21 nt, Homo sapiens
uggaauuaauggagagguguu

SEQ ID NO: 368025 - RNA, 22 nt, Homo sapiens
uggagacaaagauagaaaagca

SEQ ID NO: 368026 - RNA, 22 nt, Homo sapiens
uggaugaagagaugguaguugc

SEQ ID NO: 368027 - RNA, 22 nt, Homo sapiens
uggcaacaucuggggacauguu

SEQ ID NO: 368028 - RNA, 18 nt, Homo sapiens
aaaaagugcucaggccua

SEQ ID NO: 368029 - RNA, 22 nt, Homo sapiens
aaagcacuggagucaucaucua

SEQ ID NO: 368030 - RNA, 22 nt, Homo sapiens
aaagugguuuuucagacuuuga

SEQ ID NO: 368031 - RNA, 22 nt, Homo sapiens
aaauggauuaaguucacuugcu

SEQ ID NO: 368032 - RNA, 22 nt, Homo sapiens
aaccuguaaccauaugaucagu

SEQ ID NO: 368033 - RNA, 22 nt, Homo sapiens
aacuaugucaaauaaaaugagg

SEQ ID NO: 368034 - RNA, 22 nt, Homo sapiens
aacucugucuccuucaaguuca

SEQ ID NO: 368035 - RNA, 22 nt, Homo sapiens
aagaguaguaguggcacucucu

SEQ ID NO: 368036 - RNA, 23 nt, Homo sapiens
aaggacacugaacacuucccagc

SEQ ID NO: 368037 - RNA, 22 nt, Homo sapiens
aauaaagcaggguccuugcacu

SEQ ID NO: 368038 - RNA, 22 nt, Homo sapiens
aauauguccuugaaauggugcu

SEQ ID NO: 368039 - RNA, 22 nt, Homo sapiens
aaugacagugcuaaagaacccu

SEQ ID NO: 368040 - RNA, 22 nt, Homo sapiens
aaugacccugauuggcaaguug

SEQ ID NO: 368041 - RNA, 22 nt, Homo sapiens
aauggcacuuuauaaauguuaa

SEQ ID NO: 368042 - RNA, 22 nt, Homo sapiens
aauggccacugaccuguguuga

SEQ ID NO: 368043 - RNA, 22 nt, Homo sapiens
auggcacuaaugggaguuuacu

SEQ ID NO: 368044 - RNA, 22 nt, Homo sapiens
auggcacuacugggaaugucuu

SEQ ID NO: 368045 - RNA, 22 nt, Homo sapiens
auggcacugaagcguauugaca

SEQ ID NO: 368046 - RNA, 22 nt, Homo sapiens
auggcuguuucugcaaugucua

SEQ ID NO: 368047 - RNA, 22 nt, Homo sapiens
auggcuuuuuaaaucauguugu

SEQ ID NO: 368048 - RNA, 22 nt, Homo sapiens
auguaacaguauuuggagaugu

SEQ ID NO: 368049 - RNA, 22 nt, Homo sapiens
augucaacauagacaguagagu

SEQ ID NO: 368050 - RNA, 22 nt, Homo sapiens
augucaaggugggugauaguuu

SEQ ID NO: 368051 - RNA, 22 nt, Homo sapiens
augucuagagugauacugaagc

SEQ ID NO: 368052 - RNA, 22 nt, Homo sapiens
augugcaugcuguucugccaga

SEQ ID NO: 368053 - RNA, 22 nt, Homo sapiens
augugcuaguaucaaacgagac

SEQ ID NO: 368054 - RNA, 22 nt, Homo sapiens
auguggugguagccaggacagg

SEQ ID NO: 368055 - RNA, 22 nt, Homo sapiens
auuaauguaauuaguaaaguug

SEQ ID NO: 368056 - RNA, 22 nt, Homo sapiens
auuauauguguaugugcauacc

SEQ ID NO: 368057 - RNA, 22 nt, Homo sapiens
auugaacuguuggagagguuuu

SEQ ID NO: 368058 - RNA, 22 nt, Homo sapiens
auugagucauuucaaauccaag

SEQ ID NO: 368059 - RNA, 22 nt, Homo sapiens
auuggcaagauagcauaugagg

SEQ ID NO: 368060 - RNA, 22 nt, Homo sapiens
auugugcuaaaguaauaaguca

SEQ ID NO: 368061 - RNA, 22 nt, Homo sapiens
auuuuuggauauagggaaggau

SEQ ID NO: 368062 - RNA, 22 nt, Homo sapiens
caaaagugguucuuauccuuuu

SEQ ID NO: 368063 - RNA, 22 nt, Homo sapiens
caacacuguuuauuggauagcc

SEQ ID NO: 368064 - RNA, 22 nt, Homo sapiens
caaugcagcuuuuggagagaaa

SEQ ID NO: 368065 - RNA, 22 nt, Homo sapiens
cagagguauugcaaaagccuag

SEQ ID NO: 368066 - RNA, 22 nt, Homo sapiens
cagcugaugucgaaugcacucu

SEQ ID NO: 368067 - RNA, 22 nt, Homo sapiens
caguacaauguugauuagaagu

SEQ ID NO: 368068 - RNA, 22 nt, Homo sapiens
cauagcacugagcucuacccuc

SEQ ID NO: 368069 - RNA, 22 nt, Homo sapiens
cauggccuuuggaaugugucua

SEQ ID NO: 368070 - RNA, 22 nt, Homo sapiens
cauuugcacugagacucagcuu

SEQ ID NO: 368071 - RNA, 22 nt, Homo sapiens
ccauggcaauggucagucuauu

SEQ ID NO: 368072 - RNA, 22 nt, Homo sapiens
cccugagaugugaauuucagag

SEQ ID NO: 368073 - RNA, 22 nt, Homo sapiens
ccuucauugcaucuuuaagaga

SEQ ID NO: 368074 - RNA, 21 nt, Homo sapiens
ccuugagaacaucaauuugcu

SEQ ID NO: 368075 - RNA, 22 nt, Homo sapiens
cuagauuguuuccauaaugaca

SEQ ID NO: 368076 - RNA, 22 nt, Homo sapiens
cuagcuccauauaaagcaggau

SEQ ID NO: 368077 - RNA, 22 nt, Homo sapiens
cucagguaguuccuuauagcaa

SEQ ID NO: 368078 - RNA, 19 nt, Homo sapiens
cucauggagaaggagaaua

SEQ ID NO: 368079 - RNA, 22 nt, Homo sapiens
cucucuguuugucuguuauugg

SEQ ID NO: 368080 - RNA, 22 nt, Homo sapiens
cucuuugaguuccuccuggugu

SEQ ID NO: 368081 - RNA, 22 nt, Homo sapiens
cucuuugaugugaaccgugguu

SEQ ID NO: 368082 - RNA, 22 nt, Homo sapiens
cugaaaugaauuauuuucuuuc

SEQ ID NO: 368083 - RNA, 22 nt, Homo sapiens
cugacagaugacugccacugua

SEQ ID NO: 368084 - RNA, 22 nt, Homo sapiens
cugacauggggauccaccuuag

SEQ ID NO: 368085 - RNA, 22 nt, Homo sapiens
cugagguauuuaggugaaagaa

SEQ ID NO: 368086 - RNA, 21 nt, Homo sapiens
cugcauccauuucugagugau

SEQ ID NO: 368087 - RNA, 19 nt, Homo sapiens
cugcaugagacaguugguu

SEQ ID NO: 368088 - RNA, 22 nt, Homo sapiens
cuggcaauaggcagugucccaa

SEQ ID NO: 368089 - RNA, 22 nt, Homo sapiens
cugguuguuacaaagagccugg

SEQ ID NO: 368090 - RNA, 22 nt, Homo sapiens
cugugauuauauaguuaaggua

SEQ ID NO: 368091 - RNA, 22 nt, Homo sapiens
cugugcaugcgcggagcugaaa

SEQ ID NO: 368092 - RNA, 22 nt, Homo sapiens
cugugcauguuguccaauucuu

SEQ ID NO: 368093 - RNA, 22 nt, Homo sapiens
cugugguuacguucuuugugcu

SEQ ID NO: 368094 - RNA, 22 nt, Homo sapiens
cuugagcauauucuauauuaaa

SEQ ID NO: 368095 - RNA, 22 nt, Homo sapiens
acugcacuccagccucaugaca

SEQ ID NO: 368096 - RNA, 22 nt, Homo sapiens
agaauguuuuagaccaauacaa

SEQ ID NO: 368097 - RNA, 22 nt, Homo sapiens
agagcaaugacaugcuaugugg

SEQ ID NO: 368098 - RNA, 22 nt, Homo sapiens
agagguaagcaguggcaagugc

SEQ ID NO: 368099 - RNA, 22 nt, Homo sapiens
agauauuuguuaggucugucag

SEQ ID NO: 368100 - RNA, 22 nt, Homo sapiens
agcacgaaaccaaauucuguga

SEQ ID NO: 368101 - RNA, 21 nt, Homo sapiens
agccaguguuccuuguggcuc

SEQ ID NO: 368102 - RNA, 20 nt, Homo sapiens
agccccauguaaaccacaug

SEQ ID NO: 368103 - RNA, 22 nt, Homo sapiens
agcuaaaucucauguugaauug

SEQ ID NO: 368104 - RNA, 20 nt, Homo sapiens
agcugguuuuaugaaucuuu

SEQ ID NO: 368105 - RNA, 22 nt, Homo sapiens
agcuugugauuuagagugagag

SEQ ID NO: 368106 - RNA, 21 nt, Homo sapiens
aggcaaaugaagcagccgcuc

SEQ ID NO: 368107 - RNA, 22 nt, Homo sapiens
agugcauugagacuugugaguu

SEQ ID NO: 368108 - RNA, 22 nt, Homo sapiens
aguggcacaauuuugacucccc

SEQ ID NO: 368109 - RNA, 22 nt, Homo sapiens
auacaugugccauguucgugug

SEQ ID NO: 368110 - RNA, 22 nt, Homo sapiens
auacauguucaagggcauauau

SEQ ID NO: 368111 - RNA, 22 nt, Homo sapiens
auacugccuuuagcaaaacagu

SEQ ID NO: 368112 - RNA, 22 nt, Homo sapiens
auacugucucuugcuccugccc

SEQ ID NO: 368113 - RNA, 22 nt, Homo sapiens
auagaauguauuaguaaauuug

SEQ ID NO: 368114 - RNA, 22 nt, Homo sapiens
auagucaaaucucauuaccccc

SEQ ID NO: 368115 - RNA, 22 nt, Homo sapiens
auauaugcacacgugugcauau

SEQ ID NO: 368116 - RNA, 22 nt, Homo sapiens
auauauguuuucugggaagaaa

SEQ ID NO: 368117 - RNA, 22 nt, Homo sapiens
auaucacaggaaaggaagauac

SEQ ID NO: 368118 - RNA, 22 nt, Homo sapiens
auaucagugucuuacuguuuuu

SEQ ID NO: 368119 - RNA, 22 nt, Homo sapiens
auaucccagugaugauugauag

SEQ ID NO: 368120 - RNA, 19 nt, Homo sapiens
aucaaacugcucuuugagg

SEQ ID NO: 368121 - RNA, 22 nt, Homo sapiens
aucacagauauggguuuaaauc

SEQ ID NO: 368122 - RNA, 22 nt, Homo sapiens
aucacauggccagguaguaauc

SEQ ID NO: 368123 - RNA, 22 nt, Homo sapiens
aucacuagaucauagguaaaca

SEQ ID NO: 368124 - RNA, 22 nt, Homo sapiens
aucuuguguugaauggugcaga

SEQ ID NO: 368125 - RNA, 22 nt, Homo sapiens
augaaaucuuuggcagaucuua

SEQ ID NO: 368126 - RNA, 22 nt, Homo sapiens
augaauacugcugcaaugaaca

SEQ ID NO: 368127 - RNA, 22 nt, Homo sapiens
augaaugcuuuuggauguaucu

SEQ ID NO: 368128 - RNA, 19 nt, Homo sapiens
augagaacagacuccauuu

SEQ ID NO: 368129 - RNA, 22 nt, Homo sapiens
augagauaaaccaucucuuaag

SEQ ID NO: 368130 - RNA, 22 nt, Homo sapiens
augagaugaggaauggcccucc

SEQ ID NO: 368131 - RNA, 22 nt, Homo sapiens
augagaugcaagauuagauggg

SEQ ID NO: 368132 - RNA, 22 nt, Homo sapiens
augaggaaggagccuuugucug

SEQ ID NO: 368133 - RNA, 22 nt, Homo sapiens
augagguauccaagcccagaaa

SEQ ID NO: 368134 - RNA, 22 nt, Homo sapiens
augauauggucacccuuaugaa

SEQ ID NO: 368135 - RNA, 22 nt, Homo sapiens
augauugugaauaugugguuuu

SEQ ID NO: 368136 - RNA, 22 nt, Homo sapiens
augcagagucccagccccuagc

SEQ ID NO: 368137 - RNA, 22 nt, Homo sapiens
augcauaugucuuuauaguggc

SEQ ID NO: 368138 - RNA, 22 nt, Homo sapiens
augcauauuuuaccuagaagag

SEQ ID NO: 368139 - RNA, 22 nt, Homo sapiens
augccaagagacaaagggaauc

SEQ ID NO: 368140 - RNA, 22 nt, Homo sapiens
augccacagaaauaaccaaaau

SEQ ID NO: 368141 - RNA, 22 nt, Homo sapiens
augccacuguccuccugccuag

SEQ ID NO: 368142 - RNA, 22 nt, Homo sapiens
augcuacuggacaauggugacu

SEQ ID NO: 368143 - RNA, 20 nt, Homo sapiens
auggaccuggauuaacagca

SEQ ID NO: 368144 - RNA, 22 nt, Homo sapiens
gucugugcauuaauacgugcug

SEQ ID NO: 368145 - RNA, 20 nt, Homo sapiens
gucuugcuccguugcccagg

SEQ ID NO: 368146 - RNA, 22 nt, Homo sapiens
gucuuugcauguauguucauga

SEQ ID NO: 368147 - RNA, 22 nt, Homo sapiens
gugaaucuguuuucuucuguuc

SEQ ID NO: 368148 - RNA, 22 nt, Homo sapiens
gugacaucagcuccagguauaa

SEQ ID NO: 368149 - RNA, 22 nt, Homo sapiens
gugagaugauggguauguuaau

SEQ ID NO: 368150 - RNA, 22 nt, Homo sapiens
gugagaugguaucucauugugg

SEQ ID NO: 368151 - RNA, 22 nt, Homo sapiens
gugcauaucugugguuggcuga

SEQ ID NO: 368152 - RNA, 22 nt, Homo sapiens
gugcauaugcaugugcaugcac

SEQ ID NO: 368153 - RNA, 22 nt, Homo sapiens
cuuugcaaaacauugagaccuc

SEQ ID NO: 368154 - RNA, 22 nt, Homo sapiens
cuuuugugauucuucaguugcu

SEQ ID NO: 368155 - RNA, 22 nt, Homo sapiens
cuuuuguggaucuucuguugcu

SEQ ID NO: 368156 - RNA, 20 nt, Homo sapiens
gacauagagacucucaaaaa

SEQ ID NO: 368157 - RNA, 22 nt, Homo sapiens
gaccuggugguccacccgccuu

SEQ ID NO: 368158 - RNA, 22 nt, Homo sapiens
gacugaggaagcgcucucuccu

SEQ ID NO: 368159 - RNA, 20 nt, Homo sapiens
gacuugagagugggagagua

SEQ ID NO: 368160 - RNA, 22 nt, Homo sapiens
gagaaccauuuggagaaaaagu

SEQ ID NO: 368161 - RNA, 22 nt, Homo sapiens
gagagcaugugcuggcaucagu

SEQ ID NO: 368162 - RNA, 22 nt, Homo sapiens
gagaugaaaucuugcucuguca

SEQ ID NO: 368163 - RNA, 20 nt, Homo sapiens
gagauguugaucagggcuau

SEQ ID NO: 368164 - RNA, 23 nt, Homo sapiens
gaguacauuaaaagcccagacug

SEQ ID NO: 368165 - RNA, 22 nt, Homo sapiens
gagucagugucuugcucuguca

SEQ ID NO: 368166 - RNA, 22 nt, Homo sapiens
gauauguucugagaaaugcauu

SEQ ID NO: 368167 - RNA, 22 nt, Homo sapiens
gauauguugaguagaguuuuug

SEQ ID NO: 368168 - RNA, 22 nt, Homo sapiens
gauggaguaauguaaucuugag

SEQ ID NO: 368169 - RNA, 22 nt, Homo sapiens
gauggcuacugauuaaauauag

SEQ ID NO: 368170 - RNA, 22 nt, Homo sapiens
gcaaaaaguagugcugguuagg

SEQ ID NO: 368171 - RNA, 23 nt, Homo sapiens
gcaaauaucguagagugucccug

SEQ ID NO: 368172 - RNA, 22 nt, Homo sapiens
gcacugggccacauuuauuuuc

SEQ ID NO: 368173 - RNA, 22 nt, Homo sapiens
gcagaucuucgcgguaaguguu

SEQ ID NO: 368174 - RNA, 20 nt, Homo sapiens
gcauaugucuuuauggcagc

SEQ ID NO: 368175 - RNA, 22 nt, Homo sapiens
gcauauguuuggguguguauau

SEQ ID NO: 368176 - RNA, 18 nt, Homo sapiens
gccaacauguaaacaggu

SEQ ID NO: 368177 - RNA, 22 nt, Homo sapiens
gcuaaaugcaugaggcgaugug

SEQ ID NO: 368178 - RNA, 22 nt, Homo sapiens
gcuagcauucaaaugugcagcc

SEQ ID NO: 368179 - RNA, 22 nt, Homo sapiens
ggaaagauguaauauuaucuaa

SEQ ID NO: 368180 - RNA, 22 nt, Homo sapiens
ggaaaguaacccauucucuuac

SEQ ID NO: 368181 - RNA, 22 nt, Homo sapiens
ggaagaauaaugggccuuagag

SEQ ID NO: 368182 - RNA, 22 nt, Homo sapiens
ggaauauaaaaagccccagaau

SEQ ID NO: 368183 - RNA, 22 nt, Homo sapiens
ggaauauaaaacuuuugacagg

SEQ ID NO: 368184 - RNA, 22 nt, Homo sapiens
ggaaugagaaauauuacacaau

SEQ ID NO: 368185 - RNA, 22 nt, Homo sapiens
ggaaugggauuugaagucuggc

SEQ ID NO: 368186 - RNA, 22 nt, Homo sapiens
ggaugcauuuuugguugucaca

SEQ ID NO: 368187 - RNA, 22 nt, Homo sapiens
ggcucaguuuccuccgucugcu

SEQ ID NO: 368188 - RNA, 22 nt, Homo sapiens
gggaaugaagagaaccuuccca

SEQ ID NO: 368189 - RNA, 22 nt, Homo sapiens
gggaugaagaagaauaguucgu

SEQ ID NO: 368190 - RNA, 22 nt, Homo sapiens
ggggaauguuaaagaauuugca

SEQ ID NO: 368191 - RNA, 22 nt, Homo sapiens
gguguguaaauuacuuaucucu

SEQ ID NO: 368192 - RNA, 22 nt, Homo sapiens
guacaguuuucaguguucacug

SEQ ID NO: 368193 - RNA, 22 nt, Homo sapiens
guauacuucugaaaauagcuau

SEQ ID NO: 368194 - RNA, 22 nt, Homo sapiens
guauuugauuauagcaugcuua

SEQ ID NO: 368195 - RNA, 22 nt, Homo sapiens
gucagugucuuugcagcucaga

SEQ ID NO: 368196 - RNA, 22 nt, Homo sapiens
gucucacaggcaugaugccagc

SEQ ID NO: 368197 - RNA, 22 nt, Homo sapiens
gucugguuuuuuauauccucac

SEQ ID NO: 368198 - RNA, 22 nt, Homo sapiens
gugaaugaaugggugaauacau

SEQ ID NO: 368199 - RNA, 22 nt, Homo sapiens
gugagcauaggaggcuucuguu

SEQ ID NO: 368200 - RNA, 22 nt, Homo sapiens
gugauguguuuguucuaucucu

SEQ ID NO: 368201 - RNA, 22 nt, Homo sapiens
gugauuauccacgucuuuguga

SEQ ID NO: 368202 - RNA, 22 nt, Homo sapiens
gugguaaaauggcauagagcua

SEQ ID NO: 368203 - RNA, 22 nt, Homo sapiens
gugguagaaaguaccaaacuag

SEQ ID NO: 368204 - RNA, 22 nt, Homo sapiens
gugugcacaaucuggcaugugc

SEQ ID NO: 368205 - RNA, 19 nt, Homo sapiens
gugugcauaucacagagca

SEQ ID NO: 368206 - RNA, 22 nt, Homo sapiens
gugugcauaugucuuuauagua

SEQ ID NO: 368207 - RNA, 22 nt, Homo sapiens
gugugcaugucuuuuuaguagg

SEQ ID NO: 368208 - RNA, 22 nt, Homo sapiens
gugugcucaucacaugcaauag

SEQ ID NO: 368209 - RNA, 22 nt, Homo sapiens
guucacaguuucuaaucccagc

SEQ ID NO: 368210 - RNA, 22 nt, Homo sapiens
guucaguuuugaaauguuaauu

SEQ ID NO: 368211 - RNA, 22 nt, Homo sapiens
guucucacuggacugugaaaau

SEQ ID NO: 368212 - RNA, 22 nt, Homo sapiens
guugaaauccuaacccccuagu

SEQ ID NO: 368213 - RNA, 21 nt, Homo sapiens
uaaaacuguaacuuuguccug

SEQ ID NO: 368214 - RNA, 18 nt, Homo sapiens
uaacagucucucaggauc

SEQ ID NO: 368215 - RNA, 22 nt, Homo sapiens
uaagacuuuuugggaauauaga

SEQ ID NO: 368216 - RNA, 22 nt, Homo sapiens
uaagccaccgugccuggccuaa

SEQ ID NO: 368217 - RNA, 22 nt, Homo sapiens
uaaggcacuacuuuaggcuuuc

SEQ ID NO: 368218 - RNA, 22 nt, Homo sapiens
uaaguacugucagaauuggacu

SEQ ID NO: 368219 - RNA, 22 nt, Homo sapiens
uaauagcaguguuacuaggacu

SEQ ID NO: 368220 - RNA, 22 nt, Homo sapiens
uacaguaggauuuucagggucu

SEQ ID NO: 368221 - RNA, 16 nt, Homo sapiens
uacauuuguuacaugg

SEQ ID NO: 368222 - RNA, 22 nt, Homo sapiens
uacugcaucgaaaugcuuuuau

SEQ ID NO: 368223 - RNA, 21 nt, Homo sapiens
uacuugagacagggucuugcu

SEQ ID NO: 368224 - RNA, 22 nt, Homo sapiens
uagaaugaaacaagcugugccu

SEQ ID NO: 368225 - RNA, 22 nt, Homo sapiens
uagagguauuaacaguagaaga

SEQ ID NO: 368226 - RNA, 22 nt, Homo sapiens
uagauuguaauaugcagaaugg

SEQ ID NO: 368227 - RNA, 22 nt, Homo sapiens
uagcagcuuuauugagguaaau

SEQ ID NO: 368228 - RNA, 22 nt, Homo sapiens
uauaguuuuuccugggaggaaa

SEQ ID NO: 368229 - RNA, 22 nt, Homo sapiens
uaucacaaacuuagcaguuuaa

SEQ ID NO: 368230 - RNA, 21 nt, Homo sapiens
uaucacauuggugauuaaguu

SEQ ID NO: 368231 - RNA, 22 nt, Homo sapiens
uauggcuauggcuguggcuaug

SEQ ID NO: 368232 - RNA, 22 nt, Homo sapiens
uauggcuaugggaacugggagu

SEQ ID NO: 368233 - RNA, 17 nt, Homo sapiens
uauggcuauguuuagau

SEQ ID NO: 368234 - RNA, 22 nt, Homo sapiens
uaugucuuuugcuugcaaauag

SEQ ID NO: 368235 - RNA, 22 nt, Homo sapiens
uaugugcacaugcccuggugac

SEQ ID NO: 368236 - RNA, 22 nt, Homo sapiens
uauugcuuuacucucuuauccu

SEQ ID NO: 368237 - RNA, 22 nt, Homo sapiens
uauuuggauagucuggaaaaaa

SEQ ID NO: 368238 - RNA, 22 nt, Homo sapiens
ucaaaguaaagccucaggaugg

SEQ ID NO: 368239 - RNA, 22 nt, Homo sapiens
ucaaauguuuguuuaaggcuua

SEQ ID NO: 368240 - RNA, 22 nt, Homo sapiens
ucaaggcacauuugacauuuuc

SEQ ID NO: 368241 - RNA, 20 nt, Homo sapiens
ucaaggcacgaauaaaaguu

SEQ ID NO: 368242 - RNA, 20 nt, Homo sapiens
ucaaggcaggaacuguacau

SEQ ID NO: 368243 - RNA, 21 nt, Homo sapiens
ucacaucguuuagcugugccu

SEQ ID NO: 368244 - RNA, 22 nt, Homo sapiens
ucacauuguuauguaaauguuu

SEQ ID NO: 368245 - RNA, 22 nt, Homo sapiens
ucacugcgaccuccaccucccg

SEQ ID NO: 368246 - RNA, 22 nt, Homo sapiens
ucacugcgaccuccaccuccug

SEQ ID NO: 368247 - RNA, 22 nt, Homo sapiens
ucacugcgaccucugccucccg

SEQ ID NO: 368248 - RNA, 22 nt, Homo sapiens
ucacugugguuuugaugugcau

SEQ ID NO: 368249 - RNA, 22 nt, Homo sapiens
ucacugugugucucuguaucug

SEQ ID NO: 368250 - RNA, 22 nt, Homo sapiens
ucagauguuucuuuaacgcaug

SEQ ID NO: 368251 - RNA, 23 nt, Homo sapiens
ucagugaaggaacaacuaaauag

SEQ ID NO: 368252 - RNA, 22 nt, Homo sapiens
ucauaaaguuguuuuaauggga

SEQ ID NO: 368253 - RNA, 22 nt, Homo sapiens
aaaggaccacauauaugguggc

SEQ ID NO: 368254 - RNA, 22 nt, Homo sapiens
aaagugcugagaguucuaacuu

SEQ ID NO: 368255 - RNA, 22 nt, Homo sapiens
aaaugcugcuuuggccucuucu

SEQ ID NO: 368256 - RNA, 22 nt, Homo sapiens
aacagaccuagauaguauaguc

SEQ ID NO: 368257 - RNA, 22 nt, Homo sapiens
aacuggccuggcgugcagaggg

SEQ ID NO: 368258 - RNA, 22 nt, Homo sapiens
aagagguaauaacaaagcuucu

SEQ ID NO: 368259 - RNA, 23 nt, Homo sapiens
aagagguaugacuaugaagugga

SEQ ID NO: 368260 - RNA, 22 nt, Homo sapiens
aagagguuguaccuaaaguguu

SEQ ID NO: 368261 - RNA, 22 nt, Homo sapiens
aagcaggugucugugucuguaa

SEQ ID NO: 368262 - RNA, 22 nt, Homo sapiens
aaguacuguuuaaauugcagaa

SEQ ID NO: 368263 - RNA, 22 nt, Homo sapiens
aaguugcuuuagguaagucaau

SEQ ID NO: 368264 - RNA, 22 nt, Homo sapiens
aauaaagucugaagugugcuua

SEQ ID NO: 368265 - RNA, 19 nt, Homo sapiens
aauaaugccagaugucugu

SEQ ID NO: 368266 - RNA, 22 nt, Homo sapiens
aauaaugucacaggggguuagc

SEQ ID NO: 368267 - RNA, 22 nt, Homo sapiens
aauggcuauuucaugugguagg

SEQ ID NO: 368268 - RNA, 22 nt, Homo sapiens
aaugucaugaguccaaccagaa

SEQ ID NO: 368269 - RNA, 22 nt, Homo sapiens
aauugcacuacugcacucccac

SEQ ID NO: 368270 - RNA, 22 nt, Homo sapiens
acacuggaggagagcuguugcu

SEQ ID NO: 368271 - RNA, 22 nt, Homo sapiens
acaucuguacaguggguguggu

SEQ ID NO: 368272 - RNA, 22 nt, Homo sapiens
acaugagacuggguuuguaggg

SEQ ID NO: 368273 - RNA, 22 nt, Homo sapiens
accaccauugcacugaacuuuc

SEQ ID NO: 368274 - RNA, 22 nt, Homo sapiens
accccauuugcacugagcccuu

SEQ ID NO: 368275 - RNA, 22 nt, Homo sapiens
accucagcccggggaaguugag

SEQ ID NO: 368276 - RNA, 22 nt, Homo sapiens
acugacaugaucaggcauguuc

SEQ ID NO: 368277 - RNA, 22 nt, Homo sapiens
uagagguagguguaugaacuag

SEQ ID NO: 368278 - RNA, 22 nt, Homo sapiens
uagauuauuccuuugaauggcc

SEQ ID NO: 368279 - RNA, 22 nt, Homo sapiens
uagcaccuuagcauuucuagug

SEQ ID NO: 368280 - RNA, 22 nt, Homo sapiens
uagcagaauaacuugccagccu

SEQ ID NO: 368281 - RNA, 22 nt, Homo sapiens
uagcagguguuccacaaauauu

SEQ ID NO: 368282 - RNA, 22 nt, Homo sapiens
uagcauaauuuguagaaaauca

SEQ ID NO: 368283 - RNA, 22 nt, Homo sapiens
uaggacuuuucuugagagugac

SEQ ID NO: 368284 - RNA, 22 nt, Homo sapiens
uauagcuugaaggaauggucau

SEQ ID NO: 368285 - RNA, 22 nt, Homo sapiens
uauaucacaugcacucauuuuc

SEQ ID NO: 368286 - RNA, 22 nt, Homo sapiens
uauaugucuuuguuauguugag

SEQ ID NO: 368287 - RNA, 22 nt, Homo sapiens
uaucaccacccugggaaacaua

SEQ ID NO: 368288 - RNA, 22 nt, Homo sapiens
uaucagaguuacacugaagacu

SEQ ID NO: 368289 - RNA, 23 nt, Homo sapiens
uaucucaaugcacagagaggaaa

SEQ ID NO: 368290 - RNA, 20 nt, Homo sapiens
uaugaaacaguguagagcaa

SEQ ID NO: 368291 - RNA, 22 nt, Homo sapiens
uaugucuucuuuagagaaaugu

SEQ ID NO: 368292 - RNA, 22 nt, Homo sapiens
uaugugcaaauuaauugcuaga

SEQ ID NO: 368293 - RNA, 22 nt, Homo sapiens
uauugcaauuggcagagugcua

SEQ ID NO: 368294 - RNA, 22 nt, Homo sapiens
uauugcuuaugaugcugaauua

SEQ ID NO: 368295 - RNA, 22 nt, Homo sapiens
uauuucaguugcguuucccgag

SEQ ID NO: 368296 - RNA, 22 nt, Homo sapiens
ucaaggcacuagcugagcugca

SEQ ID NO: 368297 - RNA, 22 nt, Homo sapiens
ucaaggcaguggccuuccuucu

SEQ ID NO: 368298 - RNA, 22 nt, Homo sapiens
ucaauguaucuccaagaauuga

SEQ ID NO: 368299 - RNA, 20 nt, Homo sapiens
ucacugagugguccacagua

SEQ ID NO: 368300 - RNA, 22 nt, Homo sapiens
ucacugcgaccuccgccucccg

SEQ ID NO: 368301 - RNA, 22 nt, Homo sapiens
ucagggacuuacaaaccagaag

SEQ ID NO: 368302 - RNA, 22 nt, Homo sapiens
ucauagaucaaguaauaagaca

SEQ ID NO: 368303 - RNA, 22 nt, Homo sapiens
ucauaugucauaguaugaucuu

SEQ ID NO: 368304 - RNA, 22 nt, Homo sapiens
ucaugucuuguuguauuuauuu

SEQ ID NO: 368305 - RNA, 22 nt, Homo sapiens
uccacaauggcugaacuagauu

SEQ ID NO: 368306 - RNA, 22 nt, Homo sapiens
uccaguguuauaauaugcgucu

SEQ ID NO: 368307 - RNA, 22 nt, Homo sapiens
uccaguguuucuuccacuauuu

SEQ ID NO: 368308 - RNA, 22 nt, Homo sapiens
ucccaguggucuugaaacaggg

SEQ ID NO: 368309 - RNA, 22 nt, Homo sapiens
ucccuuucuggaguuucccaag

SEQ ID NO: 368310 - RNA, 22 nt, Homo sapiens
uccugagacucacaggcucccc

SEQ ID NO: 368311 - RNA, 22 nt, Homo sapiens
uccuucaguccaguggguuuug

SEQ ID NO: 368312 - RNA, 22 nt, Homo sapiens
uccuucauuugucaacucuagu

SEQ ID NO: 368313 - RNA, 22 nt, Homo sapiens
ucucagugugguaaaaguuuuu

SEQ ID NO: 368314 - RNA, 22 nt, Homo sapiens
ucucccauccaugaacuucugu

SEQ ID NO: 368315 - RNA, 22 nt, Homo sapiens
uugcauaauaagagggauacgu

SEQ ID NO: 368316 - RNA, 22 nt, Homo sapiens
uugcauauguugaaccagccuu

SEQ ID NO: 368317 - RNA, 22 nt, Homo sapiens
uuggaaaaauccaccuugaucu

SEQ ID NO: 368318 - RNA, 22 nt, Homo sapiens
uuggcacugggaaaaugaccac

SEQ ID NO: 368319 - RNA, 22 nt, Homo sapiens
uuggcacuugauaauauucugg

SEQ ID NO: 368320 - RNA, 22 nt, Homo sapiens
uuggcauugaguuucaaaucau

SEQ ID NO: 368321 - RNA, 22 nt, Homo sapiens
uugggccacuuuaguuuccuua

SEQ ID NO: 368322 - RNA, 22 nt, Homo sapiens
uugguuauccugucgguaauuc

SEQ ID NO: 368323 - RNA, 22 nt, Homo sapiens
uuguagcuuuuuaaugugcugc

SEQ ID NO: 368324 - RNA, 22 nt, Homo sapiens
uugucaaacucauucuccaucc

SEQ ID NO: 368325 - RNA, 22 nt, Homo sapiens
uugucacuauaaauaagcauuu

SEQ ID NO: 368326 - RNA, 22 nt, Homo sapiens
uugugaagaugugaagcaagca

SEQ ID NO: 368327 - RNA, 20 nt, Homo sapiens
uugugcauugggccauuggg

SEQ ID NO: 368328 - RNA, 22 nt, Homo sapiens
uugugcuuuugagcugagauga

SEQ ID NO: 368329 - RNA, 22 nt, Homo sapiens
uuguguuuuuaguagggaaggg

SEQ ID NO: 368330 - RNA, 22 nt, Homo sapiens
uuuaauagcagggacuuccggg

SEQ ID NO: 368331 - RNA, 22 nt, Homo sapiens
uuuaggcaugcaguucuauuua

SEQ ID NO: 368332 - RNA, 22 nt, Homo sapiens
uuuauggagagauauuuauggu

SEQ ID NO: 368333 - RNA, 22 nt, Homo sapiens
uuucacuagccagcccuuuauu

SEQ ID NO: 368334 - RNA, 22 nt, Homo sapiens
uuugcauaauaagauuagggug

SEQ ID NO: 368335 - RNA, 22 nt, Homo sapiens
uuuggcuuugagaagcagugga

SEQ ID NO: 368336 - RNA, 22 nt, Homo sapiens
uuuguaauaccugaggcugggu

SEQ ID NO: 368337 - RNA, 22 nt, Homo sapiens
uuuguacuucauacaauaacuc

SEQ ID NO: 368338 - RNA, 22 nt, Homo sapiens
uuugucacccugaauguaagau

SEQ ID NO: 368339 - RNA, 22 nt, Homo sapiens
uuuugcaaauuccaguggccau

SEQ ID NO: 368340 - RNA, 22 nt, Homo sapiens
uuuugcaauauguuccugaaua

SEQ ID NO: 368341 - RNA, 19 nt, Homo sapiens
uuuuguacucugugacuug

SEQ ID NO: 368342 - RNA, 22 nt, Homo sapiens
auacaugugugagcgaagaugu

SEQ ID NO: 368343 - RNA, 22 nt, Homo sapiens
auagaucauugucauuuuagau

SEQ ID NO: 368344 - RNA, 22 nt, Homo sapiens
auagguauuuuuaaaugacugu

SEQ ID NO: 368345 - RNA, 22 nt, Homo sapiens
auauagcucuggcuggaugacu

SEQ ID NO: 368346 - RNA, 22 nt, Homo sapiens
auauguucucauucauaugugg

SEQ ID NO: 368347 - RNA, 22 nt, Homo sapiens
aucacuuucuauuucugugcca

SEQ ID NO: 368348 - RNA, 22 nt, Homo sapiens
auccagaugggcuuaauguaau

SEQ ID NO: 368349 - RNA, 22 nt, Homo sapiens
auccuagguuagagaacaaaac

SEQ ID NO: 368350 - RNA, 22 nt, Homo sapiens
aucugauggagagcguguggcu

SEQ ID NO: 368351 - RNA, 22 nt, Homo sapiens
aucugguguccucgugggaguc

SEQ ID NO: 368352 - RNA, 22 nt, Homo sapiens
aucugguguuuccuucacauug

SEQ ID NO: 368353 - RNA, 22 nt, Homo sapiens
aucuguguuuaaggucccagaa

SEQ ID NO: 368354 - RNA, 19 nt, Homo sapiens
augaacucaucauuucuca

SEQ ID NO: 368355 - RNA, 17 nt, Homo sapiens
augaacucaucauuuuu

SEQ ID NO: 368356 - RNA, 22 nt, Homo sapiens
aaaagugguguuguuucuaaau

SEQ ID NO: 368357 - RNA, 22 nt, Homo sapiens
aaaaugcugauauugggcccca

SEQ ID NO: 368358 - RNA, 22 nt, Homo sapiens
aaacucuguagcagagacagau

SEQ ID NO: 368359 - RNA, 22 nt, Homo sapiens
aaacugcuuuccaugguggcug

SEQ ID NO: 368360 - RNA, 22 nt, Homo sapiens
aaacugucuucugacaguuucc

SEQ ID NO: 368361 - RNA, 22 nt, Homo sapiens
aaagcacugaauaaauuugcuu

SEQ ID NO: 368362 - RNA, 22 nt, Homo sapiens
aaaguaguagcaguuucugcca

SEQ ID NO: 368363 - RNA, 22 nt, Homo sapiens
aaagucuagaggaucaugugug

SEQ ID NO: 368364 - RNA, 22 nt, Homo sapiens
aaagugaauguaucccguaagu

SEQ ID NO: 368365 - RNA, 22 nt, Homo sapiens
aacagaauccucuuuuccuggg

SEQ ID NO: 368366 - RNA, 22 nt, Homo sapiens
aaccuguggauuuugguaucug

SEQ ID NO: 368367 - RNA, 22 nt, Homo sapiens
aacuugcacuugauugagagcu

SEQ ID NO: 368368 - RNA, 22 nt, Homo sapiens
aagagguaggaaauggucauuu

SEQ ID NO: 368369 - RNA, 22 nt, Homo sapiens
aagcaggugugggaggaaaugg

SEQ ID NO: 368370 - RNA, 22 nt, Homo sapiens
aagcuccauuucugccaugaga

SEQ ID NO: 368371 - RNA, 22 nt, Homo sapiens
aagcuggauuucgcauccuguu

SEQ ID NO: 368372 - RNA, 22 nt, Homo sapiens
aaggcucuuucaacguaaauua

SEQ ID NO: 368373 - RNA, 22 nt, Homo sapiens
aaguaaacauuuuguacaauaa

SEQ ID NO: 368374 - RNA, 22 nt, Homo sapiens
aauaugucugcuaauuguuucu

SEQ ID NO: 368375 - RNA, 22 nt, Homo sapiens
aauccaugugcuuuaccauuuu

SEQ ID NO: 368376 - RNA, 22 nt, Homo sapiens
aaugacagccagauucuucucu

SEQ ID NO: 368377 - RNA, 22 nt, Homo sapiens
aaugaucaauguuugaggugau

SEQ ID NO: 368378 - RNA, 22 nt, Homo sapiens
aauggcauugguccuuuuggau

SEQ ID NO: 368379 - RNA, 18 nt, Homo sapiens
aaugggacuacaaagcca

SEQ ID NO: 368380 - RNA, 22 nt, Homo sapiens
aaugggacugacgccucccaga

SEQ ID NO: 368381 - RNA, 22 nt, Homo sapiens
aauuaguugaaagucugcuuuu

SEQ ID NO: 368382 - RNA, 22 nt, Homo sapiens
acaaaguguuuucugaaggccu

SEQ ID NO: 368383 - RNA, 22 nt, Homo sapiens
acacauacacauaugguguaua

SEQ ID NO: 368384 - RNA, 20 nt, Homo sapiens
acacugugcuaaggauuuuc

SEQ ID NO: 368385 - RNA, 22 nt, Homo sapiens
acagaaccauucacuccccugg

SEQ ID NO: 368386 - RNA, 22 nt, Homo sapiens
acaguggugcgaucucggcuca

SEQ ID NO: 368387 - RNA, 22 nt, Homo sapiens
acaguguuacuugauaguguau

SEQ ID NO: 368388 - RNA, 22 nt, Homo sapiens
acauccauuugcuuuauuugcu

SEQ ID NO: 368389 - RNA, 17 nt, Homo sapiens
accccuaccucagaagc

SEQ ID NO: 368390 - RNA, 22 nt, Homo sapiens
accuguagcagacuuaauauuu

SEQ ID NO: 368391 - RNA, 22 nt, Homo sapiens
acuauacuguaacuguauucag

SEQ ID NO: 368392 - RNA, 22 nt, Homo sapiens
acugaauguaaacacggagugu

SEQ ID NO: 368393 - RNA, 22 nt, Homo sapiens
augaaguguguguucaagucuu

SEQ ID NO: 368394 - RNA, 22 nt, Homo sapiens
augaauuuucugauguugggua

SEQ ID NO: 368395 - RNA, 22 nt, Homo sapiens
augagagcaacaccuucacuug

SEQ ID NO: 368396 - RNA, 22 nt, Homo sapiens
augagaugauaggcguucuaac

SEQ ID NO: 368397 - RNA, 21 nt, Homo sapiens
augagauguuagacuuuagac

SEQ ID NO: 368398 - RNA, 22 nt, Homo sapiens
augagggagggcaccugaccuu

SEQ ID NO: 368399 - RNA, 22 nt, Homo sapiens
augauaucuuguuuuucaugca

SEQ ID NO: 368400 - RNA, 22 nt, Homo sapiens
augcacuuggcaggaugauucc

SEQ ID NO: 368401 - RNA, 22 nt, Homo sapiens
augccacuucucuaagucaugu

SEQ ID NO: 368402 - RNA, 22 nt, Homo sapiens
auggaucuuucugcuuuugaau

SEQ ID NO: 368403 - RNA, 22 nt, Homo sapiens
auggcacuuuggacugcuagau

SEQ ID NO: 368404 - RNA, 21 nt, Homo sapiens
auguaaugaagaagccacugg

SEQ ID NO: 368405 - RNA, 22 nt, Homo sapiens
auguaugagaguuccagcugau

SEQ ID NO: 368406 - RNA, 22 nt, Homo sapiens
augugcauaugaagcacagaca

SEQ ID NO: 368407 - RNA, 20 nt, Homo sapiens
augugcuaauauuaauaugu

SEQ ID NO: 368408 - RNA, 23 nt, Homo sapiens
augugugcuuggagagcaggaug

SEQ ID NO: 368409 - RNA, 22 nt, Homo sapiens
augugugcuugugacacagccu

SEQ ID NO: 368410 - RNA, 22 nt, Homo sapiens
auuauuaguuguugaaugaagu

SEQ ID NO: 368411 - RNA, 22 nt, Homo sapiens
auuccacaguuaacacagaccg

SEQ ID NO: 368412 - RNA, 22 nt, Homo sapiens
auugcacuccagccuugugaca

SEQ ID NO: 368413 - RNA, 22 nt, Homo sapiens
auugcuuuuacugggagcuuug

SEQ ID NO: 368414 - RNA, 22 nt, Homo sapiens
auuggcaauguacauaucuugc

SEQ ID NO: 368415 - RNA, 22 nt, Homo sapiens
auuguaauuuuagagaaagugg

SEQ ID NO: 368416 - RNA, 21 nt, Homo sapiens
caauggcacaaucucugcuca

SEQ ID NO: 368417 - RNA, 22 nt, Homo sapiens
cacaggccugucucuuucuaac

SEQ ID NO: 368418 - RNA, 22 nt, Homo sapiens
cacucaguuugugguacuuugu

SEQ ID NO: 368419 - RNA, 22 nt, Homo sapiens
caguuguuuuaugacauaagau

SEQ ID NO: 368420 - RNA, 22 nt, Homo sapiens
cauacaugugcuugucuuaugc

SEQ ID NO: 368421 - RNA, 18 nt, Homo sapiens
cauagcacuucagcacau

SEQ ID NO: 368422 - RNA, 21 nt, Homo sapiens
caucacauuacucaaaguccu

SEQ ID NO: 368423 - RNA, 22 nt, Homo sapiens
caugaaagugagaaacuccugg

SEQ ID NO: 368424 - RNA, 22 nt, Homo sapiens
cauggcuuuauuuucagcuucu

SEQ ID NO: 368425 - RNA, 22 nt, Homo sapiens
ccaaguguuuucauuguuccau

SEQ ID NO: 368426 - RNA, 22 nt, Homo sapiens
ccaucacacugugauuauuauc

SEQ ID NO: 368427 - RNA, 17 nt, Homo sapiens
cccuaguagcugggacu

SEQ ID NO: 368428 - RNA, 22 nt, Homo sapiens
cccugaagaaagccuaggacau

SEQ ID NO: 368429 - RNA, 22 nt, Homo sapiens
ccugagaucauacuguuaguaa

SEQ ID NO: 368430 - RNA, 22 nt, Homo sapiens
cgccugagcugaggaagcugca

SEQ ID NO: 368431 - RNA, 22 nt, Homo sapiens
cuacagcagcccaguccccgaa

SEQ ID NO: 368432 - RNA, 22 nt, Homo sapiens
cuacugcacaucaucugaguua

SEQ ID NO: 368433 - RNA, 22 nt, Homo sapiens
cuagucacauuuucaucaaaua

SEQ ID NO: 368434 - RNA, 22 nt, Homo sapiens
cucacugcauuucaguuuuguu

SEQ ID NO: 368435 - RNA, 22 nt, Homo sapiens
cucauggauggucuggcagcca

SEQ ID NO: 368436 - RNA, 22 nt, Homo sapiens
cugaaauggaaugugugcacag

SEQ ID NO: 368437 - RNA, 22 nt, Homo sapiens
cugagagaggagcuaaaacugc

SEQ ID NO: 368438 - RNA, 19 nt, Homo sapiens
cugcacugagaaaaggagg

SEQ ID NO: 368439 - RNA, 22 nt, Homo sapiens
cuggagucugacugacacaagg

SEQ ID NO: 368440 - RNA, 18 nt, Homo sapiens
cuggaugucgaguguguu

SEQ ID NO: 368441 - RNA, 22 nt, Homo sapiens
cuguauguuucuaugaauguga

SEQ ID NO: 368442 - RNA, 17 nt, Homo sapiens
cugugaugaucuugucu

SEQ ID NO: 368443 - RNA, 22 nt, Homo sapiens
cugugcauaugacuuuauugga

SEQ ID NO: 368444 - RNA, 22 nt, Homo sapiens
cugugcauguaugcgugaguuc

SEQ ID NO: 368445 - RNA, 22 nt, Homo sapiens
cugugcauuggaugucucccug

SEQ ID NO: 368446 - RNA, 19 nt, Homo sapiens
cugugcauuucuguggaag

SEQ ID NO: 368447 - RNA, 22 nt, Homo sapiens
cuucuugcuguguccucacaug

SEQ ID NO: 368448 - RNA, 22 nt, Homo sapiens
cuugaauguaaauaauguacag

SEQ ID NO: 368449 - RNA, 22 nt, Homo sapiens
cuugcacuccacuguucuccug

SEQ ID NO: 368450 - RNA, 22 nt, Homo sapiens
cuuggcuucuuuauguggcuau

SEQ ID NO: 368451 - RNA, 22 nt, Homo sapiens
cuuugcaaauggccuuuccaag

SEQ ID NO: 368452 - RNA, 22 nt, Homo sapiens
cuuuguguaggugccucuggcu

SEQ ID NO: 368453 - RNA, 22 nt, Homo sapiens
gaaagugcugcaaggccaugca

SEQ ID NO: 368454 - RNA, 22 nt, Homo sapiens
gaaugauacuguuaacgaaaga

SEQ ID NO: 368455 - RNA, 22 nt, Homo sapiens
gagacggagucucgcucugucg

SEQ ID NO: 368456 - RNA, 22 nt, Homo sapiens
gagacggagucuugcucuguug

SEQ ID NO: 368457 - RNA, 22 nt, Homo sapiens
gagauaaauaggucacaguucu

SEQ ID NO: 368458 - RNA, 22 nt, Homo sapiens
gaguuccuuugagccugagagg

SEQ ID NO: 368459 - RNA, 22 nt, Homo sapiens
gaguugagagaguuguuauuuc

SEQ ID NO: 368460 - RNA, 22 nt, Homo sapiens
gauaaaucuuggcuagucuaag

SEQ ID NO: 368461 - RNA, 22 nt, Homo sapiens
gauacuggcuuuauagaaugau

SEQ ID NO: 368462 - RNA, 21 nt, Homo sapiens
gauaucuuuauucccaagagc

SEQ ID NO: 368463 - RNA, 22 nt, Homo sapiens
gauggcauuucuggaucugaca

SEQ ID NO: 368464 - RNA, 22 nt, Homo sapiens
gcagcacauggcagaacauauu

SEQ ID NO: 368465 - RNA, 20 nt, Homo sapiens
gcauaugucuuuauagcaga

SEQ ID NO: 368466 - RNA, 22 nt, Homo sapiens
gcuguguguuaucagaaauugc

SEQ ID NO: 368467 - RNA, 17 nt, Homo sapiens
ggaaugaauuccagccc

SEQ ID NO: 368468 - RNA, 21 nt, Homo sapiens
ggaauuuagggaaugauuuag

SEQ ID NO: 368469 - RNA, 22 nt, Homo sapiens
ggcaaaauauugucugguauag

SEQ ID NO: 368470 - RNA, 22 nt, Homo sapiens
ggcaaagagacaugcaucgggg

SEQ ID NO: 368471 - RNA, 22 nt, Homo sapiens
ggccagaugaucuaugaaggaa

SEQ ID NO: 368472 - RNA, 22 nt, Homo sapiens
gggaaaaugucuauugaaugaa

SEQ ID NO: 368473 - RNA, 22 nt, Homo sapiens
gggaauggaagacauuaugaug

SEQ ID NO: 368474 - RNA, 22 nt, Homo sapiens
gggaugaagcccuaggguuggu

SEQ ID NO: 368475 - RNA, 22 nt, Homo sapiens
ggucauggauaagauccagaag

SEQ ID NO: 368476 - RNA, 22 nt, Homo sapiens
guaaacuuccccucaugaauga

SEQ ID NO: 368477 - RNA, 22 nt, Homo sapiens
guacaugcauaguuuauuucug

SEQ ID NO: 368478 - RNA, 22 nt, Homo sapiens
guacaugcaugcaugggugugc

SEQ ID NO: 368479 - RNA, 22 nt, Homo sapiens
guagagagaaauacaaagcugu

SEQ ID NO: 368480 - RNA, 22 nt, Homo sapiens
gucauugaaguggaaucaucca

SEQ ID NO: 368481 - RNA, 22 nt, Homo sapiens
gucucccagccuacaucuuucu

SEQ ID NO: 368482 - RNA, 22 nt, Homo sapiens
gucucugguugcuuuuguacca

SEQ ID NO: 368483 - RNA, 22 nt, Homo sapiens
gugccacugcaccuggccuaag

SEQ ID NO: 368484 - RNA, 22 nt, Homo sapiens
gugguuuuaucccagaaauuaa

SEQ ID NO: 368485 - RNA, 22 nt, Homo sapiens
guguauguuguccauggaugcg

SEQ ID NO: 368486 - RNA, 22 nt, Homo sapiens
gugucacagcuuccaucucggu

SEQ ID NO: 368487 - RNA, 22 nt, Homo sapiens
guguccucgaguacacaucagg

SEQ ID NO: 368488 - RNA, 22 nt, Homo sapiens
guguuaaucucaaguacucuca

SEQ ID NO: 368489 - RNA, 22 nt, Homo sapiens
guguucauggaauuugcaauug

SEQ ID NO: 368490 - RNA, 20 nt, Homo sapiens
guucacagagguuaugauua

SEQ ID NO: 368491 - RNA, 22 nt, Homo sapiens
guuguggcuugugauuaagcac

SEQ ID NO: 368492 - RNA, 22 nt, Homo sapiens
uaacauagucauauacuugcuu

SEQ ID NO: 368493 - RNA, 22 nt, Homo sapiens
uaaggcacauaggccuggaaac

SEQ ID NO: 368494 - RNA, 22 nt, Homo sapiens
uaaggcacccuucugaguagag

SEQ ID NO: 368495 - RNA, 22 nt, Homo sapiens
uaaguacuuuacagacauuauc

SEQ ID NO: 368496 - RNA, 22 nt, Homo sapiens
uacaacacugguucgacaugug

SEQ ID NO: 368497 - RNA, 22 nt, Homo sapiens
uagauuaucccugauuugucca

SEQ ID NO: 368498 - RNA, 22 nt, Homo sapiens
uagcagaauauaccucuuacuu

SEQ ID NO: 368499 - RNA, 22 nt, Homo sapiens
uagcugcuguauguacacggau

SEQ ID NO: 368500 - RNA, 22 nt, Homo sapiens
uaguaucacaagguguacaccc

SEQ ID NO: 368501 - RNA, 22 nt, Homo sapiens
uagucaaaucugaaggaaauuu

SEQ ID NO: 368502 - RNA, 20 nt, Homo sapiens
uagucaugagauucuccaag

SEQ ID NO: 368503 - RNA, 22 nt, Homo sapiens
uagugcuguaauucuaaugaaa

SEQ ID NO: 368504 - RNA, 22 nt, Homo sapiens
uauaacacccacauauagucuu

SEQ ID NO: 368505 - RNA, 22 nt, Homo sapiens
uauaguguuuucaaaaguaugu

SEQ ID NO: 368506 - RNA, 22 nt, Homo sapiens
uauaugucuucuuguaauuggc

SEQ ID NO: 368507 - RNA, 23 nt, Homo sapiens
uauaugugucuaggagcuauggu

SEQ ID NO: 368508 - RNA, 22 nt, Homo sapiens
uauauguucuugcacuggaaag

SEQ ID NO: 368509 - RNA, 22 nt, Homo sapiens
uauauguuuucauaaggcuaga

SEQ ID NO: 368510 - RNA, 21 nt, Homo sapiens
uaucagagacauugagaggca

SEQ ID NO: 368511 - RNA, 22 nt, Homo sapiens
uaugaauuuuauccaggauaua

SEQ ID NO: 368512 - RNA, 22 nt, Homo sapiens
uaugaugcuguuuagaaucucu

SEQ ID NO: 368513 - RNA, 19 nt, Homo sapiens
uaugcaacuuauagugcug

SEQ ID NO: 368514 - RNA, 22 nt, Homo sapiens
uaugcacacguguccaugugca

SEQ ID NO: 368515 - RNA, 22 nt, Homo sapiens
uauggcuacuacgaauaaugcu

SEQ ID NO: 368516 - RNA, 22 nt, Homo sapiens
uauuccacuauuaguccagaug

SEQ ID NO: 368517 - RNA, 22 nt, Homo sapiens
uauuccauuugugaaaggaagu

SEQ ID NO: 368518 - RNA, 22 nt, Homo sapiens
uauuucaguugugcagguaguu

SEQ ID NO: 368519 - RNA, 22 nt, Homo sapiens
uauuucccuuaacuuuccugca

SEQ ID NO: 368520 - RNA, 22 nt, Homo sapiens
ucaaaucaucuuuuccaaagcu

SEQ ID NO: 368521 - RNA, 22 nt, Homo sapiens
ucaaauguucccuguacuggcc

SEQ ID NO: 368522 - RNA, 22 nt, Homo sapiens
ucacacucucaccaacauuugg

SEQ ID NO: 368523 - RNA, 22 nt, Homo sapiens
ucacagauaaauaaagaugauu

SEQ ID NO: 368524 - RNA, 22 nt, Homo sapiens
ucaucaguuuuuuauaugugau

SEQ ID NO: 368525 - RNA, 22 nt, Homo sapiens
ucaugagacacacuggaaagga

SEQ ID NO: 368526 - RNA, 23 nt, Homo sapiens
ucaugaggccauucaaauccauu

SEQ ID NO: 368527 - RNA, 22 nt, Homo sapiens
ucaugggagcccccaucaugag

SEQ ID NO: 368528 - RNA, 22 nt, Homo sapiens
uccuacaugcaguacauucaaa

SEQ ID NO: 368529 - RNA, 22 nt, Homo sapiens
uccuucaugcaucaauguaucc

SEQ ID NO: 368530 - RNA, 21 nt, Homo sapiens
ucucauagaguuucacuuucu

SEQ ID NO: 368531 - RNA, 20 nt, Homo sapiens
ucucccaaacagcaggcccu

SEQ ID NO: 368532 - RNA, 23 nt, Homo sapiens
ucugguguugucaaaugcugguu

SEQ ID NO: 368533 - RNA, 22 nt, Homo sapiens
ucuguacugccaaguuucuuua

SEQ ID NO: 368534 - RNA, 22 nt, Homo sapiens
ucugugcauuuucuuuuagacu

SEQ ID NO: 368535 - RNA, 22 nt, Homo sapiens
ucugugcggucuguguuaugaa

SEQ ID NO: 368536 - RNA, 22 nt, Homo sapiens
ucuguguugaugcucauuaauu

SEQ ID NO: 368537 - RNA, 23 nt, Homo sapiens
ucuugguuauagaaaaauaguug

SEQ ID NO: 368538 - RNA, 22 nt, Homo sapiens
ucuuuguguaggucaaucuggc

SEQ ID NO: 368539 - RNA, 22 nt, Homo sapiens
ugaaaguuauauugugaaauuc

SEQ ID NO: 368540 - RNA, 19 nt, Homo sapiens
ugaaugacaucuaaagucc

SEQ ID NO: 368541 - RNA, 20 nt, Homo sapiens
ugacaucagcaauguaauaa

SEQ ID NO: 368542 - RNA, 19 nt, Homo sapiens
ugacaugaaacccaagauc

SEQ ID NO: 368543 - RNA, 22 nt, Homo sapiens
ugacauugggagugaagugaag

SEQ ID NO: 368544 - RNA, 22 nt, Homo sapiens
ugacuagugugauguaguaaau

SEQ ID NO: 368545 - RNA, 22 nt, Homo sapiens
ugagaucaaggugggcccuggg

SEQ ID NO: 368546 - RNA, 22 nt, Homo sapiens
ugagaucacgccacugcacucc

SEQ ID NO: 368547 - RNA, 22 nt, Homo sapiens
ugagaucaguuguuauaauucu

SEQ ID NO: 368548 - RNA, 22 nt, Homo sapiens
ugagaucaugccacugcacuuc

SEQ ID NO: 368549 - RNA, 22 nt, Homo sapiens
ugagaucgagucucgcucuguc

SEQ ID NO: 368550 - RNA, 22 nt, Homo sapiens
ugagaucuuugcuguccucacc

SEQ ID NO: 368551 - RNA, 22 nt, Homo sapiens
ugagauggagucuugucgccua

SEQ ID NO: 368552 - RNA, 22 nt, Homo sapiens
ugagauggaguuucgcccuugu

SEQ ID NO: 368553 - RNA, 22 nt, Homo sapiens
ugagauggcuuuauugcugaau

SEQ ID NO: 368554 - RNA, 22 nt, Homo sapiens
ugagauggguaauuaaauggug

SEQ ID NO: 368555 - RNA, 22 nt, Homo sapiens
ugagaugugaagaucacaugaa

SEQ ID NO: 368556 - RNA, 22 nt, Homo sapiens
ugagguaggugaagaaugcacg

SEQ ID NO: 368557 - RNA, 22 nt, Homo sapiens
ugagucaauggaggcucagagc

SEQ ID NO: 368558 - RNA, 22 nt, Homo sapiens
ugagugugaggaagaauuagaa

SEQ ID NO: 368559 - RNA, 22 nt, Homo sapiens
ugaguuccuuucccaguccagu

SEQ ID NO: 368560 - RNA, 22 nt, Homo sapiens
ugauaauguuaggcuuuauuca

SEQ ID NO: 368561 - RNA, 22 nt, Homo sapiens
ugauaucugaauagauacacaa

SEQ ID NO: 368562 - RNA, 22 nt, Homo sapiens
ugauaucugaucauccuugaua

SEQ ID NO: 368563 - RNA, 22 nt, Homo sapiens
ugauauguggauucagcucaaa

SEQ ID NO: 368564 - RNA, 22 nt, Homo sapiens
ugaucaaagugcuggaauuaca

SEQ ID NO: 368565 - RNA, 22 nt, Homo sapiens
ugcaaauguuaggugucauuau

SEQ ID NO: 368566 - RNA, 22 nt, Homo sapiens
ugcauacuguaugcgugcauac

SEQ ID NO: 368567 - RNA, 22 nt, Homo sapiens
ugcauggaagggagggaaagag

SEQ ID NO: 368568 - RNA, 21 nt, Homo sapiens
ugcauuggagaauguuucuca

SEQ ID NO: 368569 - RNA, 22 nt, Homo sapiens
ugccuaguagaaggugaacaug

SEQ ID NO: 368570 - RNA, 22 nt, Homo sapiens
ugcgccauugaacuccaggcug

SEQ ID NO: 368571 - RNA, 22 nt, Homo sapiens
ugcgccauugcacuccagucuu

SEQ ID NO: 368572 - RNA, 22 nt, Homo sapiens
ugcgccauugcacucuagccug

SEQ ID NO: 368573 - RNA, 21 nt, Homo sapiens
ugcuauguuguccaggcuggc

SEQ ID NO: 368574 - RNA, 23 nt, Homo sapiens
ugcugagaccuagauccuaaaga

SEQ ID NO: 368575 - RNA, 22 nt, Homo sapiens
uuccacagggauuugcauugau

SEQ ID NO: 368576 - RNA, 22 nt, Homo sapiens
uucccuuugaaacuaaacuugc

SEQ ID NO: 368577 - RNA, 23 nt, Homo sapiens
uucuaucaggcccaggagcccug

SEQ ID NO: 368578 - RNA, 22 nt, Homo sapiens
uucucauggaacaucuguacug

SEQ ID NO: 368579 - RNA, 22 nt, Homo sapiens
uugaaagucuaggcuuacagua

SEQ ID NO: 368580 - RNA, 21 nt, Homo sapiens
uugaaugguuuuccuugggag

SEQ ID NO: 368581 - RNA, 22 nt, Homo sapiens
uugagaagugucuguucauguc

SEQ ID NO: 368582 - RNA, 22 nt, Homo sapiens
uugagaaucuuugcuaaaggaa

SEQ ID NO: 368583 - RNA, 22 nt, Homo sapiens
uugagagaaaaggccaugccuu

SEQ ID NO: 368584 - RNA, 22 nt, Homo sapiens
uugagauaucuuggccuuugca

SEQ ID NO: 368585 - RNA, 22 nt, Homo sapiens
uugagaugaagucuugcucucu

SEQ ID NO: 368586 - RNA, 22 nt, Homo sapiens
uugagaugaaguuuugcucuuu

SEQ ID NO: 368587 - RNA, 22 nt, Homo sapiens
uugagauggagcuucacucuug

SEQ ID NO: 368588 - RNA, 22 nt, Homo sapiens
uugagauggagucucgcacugu

SEQ ID NO: 368589 - RNA, 22 nt, Homo sapiens
uugagauggagucucgcugugu

SEQ ID NO: 368590 - RNA, 22 nt, Homo sapiens
uugagauggaguucauuuuugu

SEQ ID NO: 368591 - RNA, 22 nt, Homo sapiens
uugagauggaguuuugcucuug

SEQ ID NO: 368592 - RNA, 22 nt, Homo sapiens
uugagauguaagauguuaauau

SEQ ID NO: 368593 - RNA, 22 nt, Homo sapiens
uugagauguauguauauaaugu

SEQ ID NO: 368594 - RNA, 22 nt, Homo sapiens
uugagcaucauguuagcacuca

SEQ ID NO: 368595 - RNA, 22 nt, Homo sapiens
uugaggaaugucauuuguguuu

SEQ ID NO: 368596 - RNA, 22 nt, Homo sapiens
uugagggaagccagaggucugc

SEQ ID NO: 368597 - RNA, 22 nt, Homo sapiens
uugagggaggcagggcuugucu

SEQ ID NO: 368598 - RNA, 22 nt, Homo sapiens
uugaggucuuugagcaaacgca

SEQ ID NO: 368599 - RNA, 22 nt, Homo sapiens
uugauaugcuugucaguccauu

SEQ ID NO: 368600 - RNA, 19 nt, Homo sapiens
uugcauauguugaaccagg

SEQ ID NO: 368601 - RNA, 22 nt, Homo sapiens
uugcauauucucugaggcagga

SEQ ID NO: 368602 - RNA, 22 nt, Homo sapiens
uugcuagaugaaaaugguaccu

SEQ ID NO: 368603 - RNA, 22 nt, Homo sapiens
uugcuuaggcuggagugcagug

SEQ ID NO: 368604 - RNA, 22 nt, Homo sapiens
uuggaauuuuacuucuguaaga

SEQ ID NO: 368605 - RNA, 22 nt, Homo sapiens
uuggcaaauagguuuuauugca

SEQ ID NO: 368606 - RNA, 22 nt, Homo sapiens
uugggaauguccuaauaucucg

SEQ ID NO: 368607 - RNA, 22 nt, Homo sapiens
uuguaacaguuuauugacucga

SEQ ID NO: 368608 - RNA, 22 nt, Homo sapiens
uuguaauguuaggguguccaug

SEQ ID NO: 368609 - RNA, 22 nt, Homo sapiens
uuguagaucuucaguugcuaca

SEQ ID NO: 368610 - RNA, 22 nt, Homo sapiens
uuguauguuucugugcacauga

SEQ ID NO: 368611 - RNA, 22 nt, Homo sapiens
uugucauuuucagaguguuacg

SEQ ID NO: 368612 - RNA, 22 nt, Homo sapiens
uugugaagaaaccagaaaaguu

SEQ ID NO: 368613 - RNA, 22 nt, Homo sapiens
uuuaaaguuagaaggaaagggc

SEQ ID NO: 368614 - RNA, 22 nt, Homo sapiens
uuuaauguuacaguauugguau

SEQ ID NO: 368615 - RNA, 22 nt, Homo sapiens
uuucauagaucaugcuuuugga

SEQ ID NO: 368616 - RNA, 21 nt, Homo sapiens
uuucugggggagcauggcagg

SEQ ID NO: 368617 - RNA, 22 nt, Homo sapiens
uuucugggggugcugauggaaa

SEQ ID NO: 368618 - RNA, 18 nt, Homo sapiens
uuugccacuucccagaaa

SEQ ID NO: 368619 - RNA, 22 nt, Homo sapiens
uuugccuuugugauauggucua

SEQ ID NO: 368620 - RNA, 22 nt, Homo sapiens
uuugcuaaucaacacuggccug

SEQ ID NO: 368621 - RNA, 22 nt, Homo sapiens
uuugggaaugaguuuaucauuu

SEQ ID NO: 368622 - RNA, 22 nt, Homo sapiens
uuugguuauauauauacacucu

SEQ ID NO: 368623 - RNA, 23 nt, Homo sapiens
uuuugcaauaagucacuggaaua

SEQ ID NO: 368624 - RNA, 19 nt, Homo sapiens
uuuuggaaaugugaacagc

SEQ ID NO: 368625 - RNA, 22 nt, Homo sapiens
uuuuggacuucaauuugacacu

SEQ ID NO: 368626 - RNA, 22 nt, Homo sapiens
ucauacaguaguccucacuugu

SEQ ID NO: 368627 - RNA, 22 nt, Homo sapiens
ucaucagugcuugcaaauuauu

SEQ ID NO: 368628 - RNA, 22 nt, Homo sapiens
ucauguguugcacugaggaccu

SEQ ID NO: 368629 - RNA, 22 nt, Homo sapiens
uccauuugucuauguuucuguu

SEQ ID NO: 368630 - RNA, 22 nt, Homo sapiens
uccugagagcagacccucuaua

SEQ ID NO: 368631 - RNA, 18 nt, Homo sapiens
uccuuuugggguaggaga

SEQ ID NO: 368632 - RNA, 19 nt, Homo sapiens
ucgcgccauucuccugccu

SEQ ID NO: 368633 - RNA, 22 nt, Homo sapiens
ucgcgccauucuccugccucag

SEQ ID NO: 368634 - RNA, 22 nt, Homo sapiens
ucucaugaagauagagaauaga

SEQ ID NO: 368635 - RNA, 22 nt, Homo sapiens
ucucuggauaucuacuuauguu

SEQ ID NO: 368636 - RNA, 22 nt, Homo sapiens
ucugugguucaggcuggagugc

SEQ ID NO: 368637 - RNA, 22 nt, Homo sapiens
ucuugguugaaaauucauaaua

SEQ ID NO: 368638 - RNA, 22 nt, Homo sapiens
ugaaaugccuuuaaugaauuua

SEQ ID NO: 368639 - RNA, 22 nt, Homo sapiens
ugaaauguugggugauggaauc

SEQ ID NO: 368640 - RNA, 22 nt, Homo sapiens
ugaagacucaguuugagggaca

SEQ ID NO: 368641 - RNA, 22 nt, Homo sapiens
ugaagagucuaaaucugucuuc

SEQ ID NO: 368642 - RNA, 22 nt, Homo sapiens
ugaaggacauaaggcagaguga

SEQ ID NO: 368643 - RNA, 22 nt, Homo sapiens
ugaauauagacagggguagaga

SEQ ID NO: 368644 - RNA, 16 nt, Homo sapiens
ugaauguuuguggcug

SEQ ID NO: 368645 - RNA, 18 nt, Homo sapiens
ugacaucauuuagaaagg

SEQ ID NO: 368646 - RNA, 22 nt, Homo sapiens
ugacaugaugagcaauaauggc

SEQ ID NO: 368647 - RNA, 22 nt, Homo sapiens
ugacuaguuggauaaccuagga

SEQ ID NO: 368648 - RNA, 22 nt, Homo sapiens
ugacuugaguaacuggcucagg

SEQ ID NO: 368649 - RNA, 22 nt, Homo sapiens
ugagaaugaugauugguaaacc

SEQ ID NO: 368650 - RNA, 22 nt, Homo sapiens
ugagacggagucucgcucuguc

SEQ ID NO: 368651 - RNA, 22 nt, Homo sapiens
ugagacugaaauuaggaaacug

SEQ ID NO: 368652 - RNA, 22 nt, Homo sapiens
ugagacugaguuuugcucguug

SEQ ID NO: 368653 - RNA, 22 nt, Homo sapiens
ugagagaugaacucugauaugu

SEQ ID NO: 368654 - RNA, 22 nt, Homo sapiens
ugagaucacuaagagguaaugg

SEQ ID NO: 368655 - RNA, 22 nt, Homo sapiens
ugagaugaagugauguaaaaca

SEQ ID NO: 368656 - RNA, 22 nt, Homo sapiens
ugagaugaggucucgcucuguc

SEQ ID NO: 368657 - RNA, 22 nt, Homo sapiens
ugagaugaugggauaagagggc

SEQ ID NO: 368658 - RNA, 22 nt, Homo sapiens
ugagauguaaucucgcucuguc

SEQ ID NO: 368659 - RNA, 20 nt, Homo sapiens
ugagauuggugugguauaag

SEQ ID NO: 368660 - RNA, 22 nt, Homo sapiens
ugagauuguuagaucaaauggu

SEQ ID NO: 368661 - RNA, 22 nt, Homo sapiens
ugagcagagaagugcccugcgc

SEQ ID NO: 368662 - RNA, 22 nt, Homo sapiens
ugaggaaugaccccgugugguc

SEQ ID NO: 368663 - RNA, 22 nt, Homo sapiens
ugagguaaaacaaggauuggau

SEQ ID NO: 368664 - RNA, 22 nt, Homo sapiens
ugagguaacaaacuaugaguua

SEQ ID NO: 368665 - RNA, 22 nt, Homo sapiens
ugagguaauagauaauauuuuu

SEQ ID NO: 368666 - RNA, 22 nt, Homo sapiens
ugagguuggggucagggcuagc

SEQ ID NO: 368667 - RNA, 22 nt, Homo sapiens
ugaguagagaauucagcuaagg

SEQ ID NO: 368668 - RNA, 22 nt, Homo sapiens
ugagugaaugugaaggcuaggg

SEQ ID NO: 368669 - RNA, 22 nt, Homo sapiens
ugaguucuuuuacauuuugaau

SEQ ID NO: 368670 - RNA, 23 nt, Homo sapiens
ugauaacagcauaugaagauucu

SEQ ID NO: 368671 - RNA, 18 nt, Homo sapiens
ugauaucaaugauagcca

SEQ ID NO: 368672 - RNA, 22 nt, Homo sapiens
ugauaugaaguuagcuggcugu

SEQ ID NO: 368673 - RNA, 22 nt, Homo sapiens
ugauauggcuuggcuaugucac

SEQ ID NO: 368674 - RNA, 22 nt, Homo sapiens
ugauauguuagaaucuugcaag

SEQ ID NO: 368675 - RNA, 20 nt, Homo sapiens
ugauauuucuggaaguggag

SEQ ID NO: 368676 - RNA, 22 nt, Homo sapiens
ugcaagaaucagccuaucauua

SEQ ID NO: 368677 - RNA, 22 nt, Homo sapiens
ugcauaucuuguggaauaucuc

SEQ ID NO: 368678 - RNA, 22 nt, Homo sapiens
ugcauauguauacaugugccau

SEQ ID NO: 368679 - RNA, 21 nt, Homo sapiens
ugcauggagaacacugagggu

SEQ ID NO: 368680 - RNA, 22 nt, Homo sapiens
ugccuggagagcuccuacauau

SEQ ID NO: 368681 - RNA, 22 nt, Homo sapiens
ugcuaugucagccaggcugguc

SEQ ID NO: 368682 - RNA, 22 nt, Homo sapiens
uggacugagauuucagcugcca

SEQ ID NO: 368683 - RNA, 22 nt, Homo sapiens
uggagucuugaugauuuucaaa

SEQ ID NO: 368684 - RNA, 22 nt, Homo sapiens
uggauagaaauguacuguuuuc

SEQ ID NO: 368685 - RNA, 22 nt, Homo sapiens
uggcaaaauauuuugguuucug

SEQ ID NO: 368686 - RNA, 22 nt, Homo sapiens
uggcaaaugaaagaaagccagu

SEQ ID NO: 368687 - RNA, 18 nt, Homo sapiens
uggcaagugccauacggu

SEQ ID NO: 368688 - RNA, 22 nt, Homo sapiens
uggccuguaacgcugucucagc

SEQ ID NO: 368689 - RNA, 18 nt, Homo sapiens
uggcuacugaacuagaug

SEQ ID NO: 368690 - RNA, 22 nt, Homo sapiens
uggcuuuucauccugggacauu

SEQ ID NO: 368691 - RNA, 22 nt, Homo sapiens
uggcuuuuguuauuuggaagcu

SEQ ID NO: 368692 - RNA, 20 nt, Homo sapiens
ugguaauguaagagaggaga

SEQ ID NO: 368693 - RNA, 21 nt, Homo sapiens
uggucaguuuucucacuagga

SEQ ID NO: 368694 - RNA, 22 nt, Homo sapiens
ugguuccauauuaauuuuagga

SEQ ID NO: 368695 - RNA, 22 nt, Homo sapiens
uguaaaucuuucacaguugaug

SEQ ID NO: 368696 - RNA, 22 nt, Homo sapiens
uguaaugaucaaaucagaguaa

SEQ ID NO: 368697 - RNA, 22 nt, Homo sapiens
uguacuucaagauuaugguuua

SEQ ID NO: 368698 - RNA, 22 nt, Homo sapiens
uguagacaccaaagacagcaua

SEQ ID NO: 368699 - RNA, 21 nt, Homo sapiens
uguagcagcaugauuuauaau

SEQ ID NO: 368700 - RNA, 22 nt, Homo sapiens
uguauguuucuuaggccugaga

SEQ ID NO: 368701 - RNA, 22 nt, Homo sapiens
ugucaaacauuaugaugcucua

SEQ ID NO: 368702 - RNA, 21 nt, Homo sapiens
ugugaccucugucucugaguc

SEQ ID NO: 368703 - RNA, 18 nt, Homo sapiens
ugugauggauauguuaau

SEQ ID NO: 368704 - RNA, 22 nt, Homo sapiens
ugugcaguuuuagcguauuuua

SEQ ID NO: 368705 - RNA, 22 nt, Homo sapiens
ugugcaguuuugagugaauuuc

SEQ ID NO: 368706 - RNA, 22 nt, Homo sapiens
ugugcauagugugugcggggcg

SEQ ID NO: 368707 - RNA, 22 nt, Homo sapiens
ugugcauauaaguguguauaua

SEQ ID NO: 368708 - RNA, 22 nt, Homo sapiens
ugugccacuccaaccuggguga

SEQ ID NO: 368709 - RNA, 22 nt, Homo sapiens
ugugccacuccaggaggcuguu

SEQ ID NO: 368710 - RNA, 22 nt, Homo sapiens
ugugcgcaucggggccugcuuc

SEQ ID NO: 368711 - RNA, 22 nt, Homo sapiens
ugugcgugugccuguaagaauu

SEQ ID NO: 368712 - RNA, 22 nt, Homo sapiens
ugugcuauguuauucacauggg

SEQ ID NO: 368713 - RNA, 23 nt, Homo sapiens
ugugguauuauuccauuuauagg

SEQ ID NO: 368714 - RNA, 22 nt, Homo sapiens
uguguaaauauauacacacgug

SEQ ID NO: 368715 - RNA, 22 nt, Homo sapiens
ugugucacugaggguuagugua

SEQ ID NO: 368716 - RNA, 22 nt, Homo sapiens
uguugcauuugucaaggucaag

SEQ ID NO: 368717 - RNA, 22 nt, Homo sapiens
uguuucuacugucucuguagua

SEQ ID NO: 368718 - RNA, 22 nt, Homo sapiens
uuaaggcuccuguuggcuuuua

SEQ ID NO: 368719 - RNA, 22 nt, Homo sapiens
uuaaugaacuuuauuuuguaga

SEQ ID NO: 368720 - RNA, 22 nt, Homo sapiens
uuacuugagaugaguuggacaa

SEQ ID NO: 368721 - RNA, 20 nt, Homo sapiens
uuagaguaguaugauuuaua

SEQ ID NO: 368722 - RNA, 22 nt, Homo sapiens
uuagauuauugguguuuugcaa

SEQ ID NO: 368723 - RNA, 22 nt, Homo sapiens
uuaggcuuuauugaaaacaaua

SEQ ID NO: 368724 - RNA, 22 nt, Homo sapiens
uuauacucgucugaaugauucu

SEQ ID NO: 368725 - RNA, 22 nt, Homo sapiens
uuauauguuacucccucuagca

SEQ ID NO: 368726 - RNA, 22 nt, Homo sapiens
ugcuuuguugaaaaucauuugg

SEQ ID NO: 368727 - RNA, 22 nt, Homo sapiens
uggaagucauugagguguguua

SEQ ID NO: 368728 - RNA, 22 nt, Homo sapiens
uggaauuuagguugauaguaua

SEQ ID NO: 368729 - RNA, 22 nt, Homo sapiens
uggagguagacauugggaagag

SEQ ID NO: 368730 - RNA, 22 nt, Homo sapiens
uggagguaggacgaagaacucu

SEQ ID NO: 368731 - RNA, 22 nt, Homo sapiens
uggagugcaauggcaccaucuu

SEQ ID NO: 368732 - RNA, 22 nt, Homo sapiens
uggauagauacuauccaggacu

SEQ ID NO: 368733 - RNA, 22 nt, Homo sapiens
aauugguuaagauaagaucaua

SEQ ID NO: 368734 - RNA, 22 nt, Homo sapiens
acacaaugguaaguguuugugu

SEQ ID NO: 368735 - RNA, 22 nt, Homo sapiens
acaccuguggucccaguaacuu

SEQ ID NO: 368736 - RNA, 22 nt, Homo sapiens
acagaauucucagaacugggag

SEQ ID NO: 368737 - RNA, 22 nt, Homo sapiens
acagcagugccccacucuacug

SEQ ID NO: 368738 - RNA, 22 nt, Homo sapiens
acaguagcgcaaucucggcuca

SEQ ID NO: 368739 - RNA, 17 nt, Homo sapiens
acaugagacuggauucu

SEQ ID NO: 368740 - RNA, 22 nt, Homo sapiens
accgaguuagccaggauggucu

SEQ ID NO: 368741 - RNA, 22 nt, Homo sapiens
acuaugcuuuucuuagaauuaa

SEQ ID NO: 368742 - RNA, 22 nt, Homo sapiens
acuuugcuuagagggcauuaaa

SEQ ID NO: 368743 - RNA, 21 nt, Homo sapiens
agaaaaucuuaugggaaacau

SEQ ID NO: 368744 - RNA, 22 nt, Homo sapiens
agaaauguuuauucaaacccgu

SEQ ID NO: 368745 - RNA, 22 nt, Homo sapiens
agaaccauuagagggagauauu

SEQ ID NO: 368746 - RNA, 22 nt, Homo sapiens
agaagaacauagggugacugaa

SEQ ID NO: 368747 - RNA, 22 nt, Homo sapiens
agacuuagagagucuauucuau

SEQ ID NO: 368748 - RNA, 22 nt, Homo sapiens
agagguagaagauaggcuacag

SEQ ID NO: 368749 - RNA, 22 nt, Homo sapiens
agaguaguaggaugaauggacu

SEQ ID NO: 368750 - RNA, 22 nt, Homo sapiens
agauaugucugcuauuugcugu

SEQ ID NO: 368751 - RNA, 22 nt, Homo sapiens
agauauguuuaguuucaaaaug

SEQ ID NO: 368752 - RNA, 22 nt, Homo sapiens
agaugauguuuacugagcauca

SEQ ID NO: 368753 - RNA, 17 nt, Homo sapiens
agcauguguuugagauu

SEQ ID NO: 368754 - RNA, 20 nt, Homo sapiens
agcauugguuagaacaguag

SEQ ID NO: 368755 - RNA, 22 nt, Homo sapiens
aggaagcuagcauuuguucagu

SEQ ID NO: 368756 - RNA, 22 nt, Homo sapiens
aggagguugguaccaucuguuu

SEQ ID NO: 368757 - RNA, 22 nt, Homo sapiens
aggcaaaugccagcaaucacac

SEQ ID NO: 368758 - RNA, 22 nt, Homo sapiens
aggcaagaaugcuuguuucacc

SEQ ID NO: 368759 - RNA, 22 nt, Homo sapiens
agguauguauguaugggagaaa

SEQ ID NO: 368760 - RNA, 22 nt, Homo sapiens
agucaugggagagaugugaucg

SEQ ID NO: 368761 - RNA, 20 nt, Homo sapiens
agugguuuucaaauaugucu

SEQ ID NO: 368762 - RNA, 22 nt, Homo sapiens
auacaguaucuucuggcaagca

SEQ ID NO: 368763 - RNA, 21 nt, Homo sapiens
auacuugcauccuuggagaga

SEQ ID NO: 368764 - RNA, 22 nt, Homo sapiens
auagcagcaccccacuaccuca

SEQ ID NO: 368765 - RNA, 22 nt, Homo sapiens
auaguacuauugcaguguuaua

SEQ ID NO: 368766 - RNA, 22 nt, Homo sapiens
auaucccaguguguaaacacug

SEQ ID NO: 368767 - RNA, 22 nt, Homo sapiens
auaugcauguacccacacaggc

SEQ ID NO: 368768 - RNA, 22 nt, Homo sapiens
auauggcuaugugagcauacca

SEQ ID NO: 368769 - RNA, 20 nt, Homo sapiens
auaugguugugagugauuuu

SEQ ID NO: 368770 - RNA, 22 nt, Homo sapiens
auaugucuguuuagucuguaau

SEQ ID NO: 368771 - RNA, 18 nt, Homo sapiens
auauugccuucagacuag

SEQ ID NO: 368772 - RNA, 22 nt, Homo sapiens
aucacagaguuaaaacuuucuu

SEQ ID NO: 368773 - RNA, 22 nt, Homo sapiens
aucacuggccuuuuuaaaugcu

SEQ ID NO: 368774 - RNA, 22 nt, Homo sapiens
auccauguggauaaauguguau

SEQ ID NO: 368775 - RNA, 22 nt, Homo sapiens
aucccugugacgagcaucccua

SEQ ID NO: 368776 - RNA, 22 nt, Homo sapiens
auccucugagaucuaggcagag

SEQ ID NO: 368777 - RNA, 22 nt, Homo sapiens
aucugguguauuggugcugggu

SEQ ID NO: 368778 - RNA, 22 nt, Homo sapiens
augaaaugcauguuaaguccgu

SEQ ID NO: 368779 - RNA, 18 nt, Homo sapiens
augaagucaucacuuuua

SEQ ID NO: 368780 - RNA, 22 nt, Homo sapiens
augaauagaguuaauugaguac

SEQ ID NO: 368781 - RNA, 22 nt, Homo sapiens
augacagugagugagcucucac

SEQ ID NO: 368782 - RNA, 22 nt, Homo sapiens
augagcagaugcuccugccucu

SEQ ID NO: 368783 - RNA, 22 nt, Homo sapiens
augagcuaggacagaaugucag

SEQ ID NO: 368784 - RNA, 22 nt, Homo sapiens
augcauauuccugggccucacu

SEQ ID NO: 368785 - RNA, 22 nt, Homo sapiens
augccaagaugagcacgcgucu

SEQ ID NO: 368786 - RNA, 22 nt, Homo sapiens
augccacugcacuccaaccugg

SEQ ID NO: 368787 - RNA, 22 nt, Homo sapiens
augccacugcacucuagccugg

SEQ ID NO: 368788 - RNA, 22 nt, Homo sapiens
augccacugcacuucagccugc

SEQ ID NO: 368789 - RNA, 22 nt, Homo sapiens
augccacuguacucuagccuag

SEQ ID NO: 368790 - RNA, 22 nt, Homo sapiens
auggcacucaaucaaguugaga

SEQ ID NO: 368791 - RNA, 22 nt, Homo sapiens
auggcacuccagccugggcaac

SEQ ID NO: 368792 - RNA, 22 nt, Homo sapiens
auggcacugccuggcuucaugg

SEQ ID NO: 368793 - RNA, 22 nt, Homo sapiens
auggcaguuuauucuaaaucaa

SEQ ID NO: 368794 - RNA, 23 nt, Homo sapiens
auggcccuggugggagugucuuu

SEQ ID NO: 368795 - RNA, 22 nt, Homo sapiens
auguuguaguaugagucaaaau

SEQ ID NO: 368796 - RNA, 22 nt, Homo sapiens
auuccacuuacaugaaguaccu

SEQ ID NO: 368797 - RNA, 22 nt, Homo sapiens
auugagcaauuccuaugugcuu

SEQ ID NO: 368798 - RNA, 22 nt, Homo sapiens
auugagcacugacucugugcca

SEQ ID NO: 368799 - RNA, 22 nt, Homo sapiens
caaagcacuuggcuuggaagau

SEQ ID NO: 368800 - RNA, 22 nt, Homo sapiens
caaaggauucauuuccaggagu

SEQ ID NO: 368801 - RNA, 22 nt, Homo sapiens
caaaggcuuccacugcauccuu

SEQ ID NO: 368802 - RNA, 22 nt, Homo sapiens
caaaugacaucauuucauucaa

SEQ ID NO: 368803 - RNA, 22 nt, Homo sapiens
caaaugcuucuauggacugucu

SEQ ID NO: 368804 - RNA, 22 nt, Homo sapiens
caacugguuuuauacaguuuag

SEQ ID NO: 368805 - RNA, 22 nt, Homo sapiens
cacagugaacaauauccucugu

SEQ ID NO: 368806 - RNA, 22 nt, Homo sapiens
cacuguggauggaacuauguga

SEQ ID NO: 368807 - RNA, 22 nt, Homo sapiens
caguggaugaacaagaagugau

SEQ ID NO: 368808 - RNA, 22 nt, Homo sapiens
cagugucugcauuuggaacuca

SEQ ID NO: 368809 - RNA, 22 nt, Homo sapiens
cauagcacugcacuucagccug

SEQ ID NO: 368810 - RNA, 22 nt, Homo sapiens
caucccauucgaggggcacagc

SEQ ID NO: 368811 - RNA, 22 nt, Homo sapiens
cauggagcuaggcuugaucccu

SEQ ID NO: 368812 - RNA, 22 nt, Homo sapiens
caugggacugucuuggcuauac

SEQ ID NO: 368813 - RNA, 22 nt, Homo sapiens
ccaaggcacugauucuguacuc

SEQ ID NO: 368814 - RNA, 22 nt, Homo sapiens
ccaguguucuggaaggcugagu

SEQ ID NO: 368815 - RNA, 22 nt, Homo sapiens
cccucauucauucauccuaugu

SEQ ID NO: 368816 - RNA, 17 nt, Homo sapiens
cuaaggcaagagucugc

SEQ ID NO: 368817 - RNA, 22 nt, Homo sapiens
cuauaugucuguuuugguacca

SEQ ID NO: 368818 - RNA, 22 nt, Homo sapiens
cuauuacuuuuauugaacucag

SEQ ID NO: 368819 - RNA, 22 nt, Homo sapiens
cucauggagaacaucugcuagg

SEQ ID NO: 368820 - RNA, 22 nt, Homo sapiens
cucauggagaaccucugcuagg

SEQ ID NO: 368821 - RNA, 20 nt, Homo sapiens
cuccuucauuccuuuggacc

SEQ ID NO: 368822 - RNA, 22 nt, Homo sapiens
cucugacagugguuagcacugu

SEQ ID NO: 368823 - RNA, 22 nt, Homo sapiens
cucuggauauuccugucuaaaa

SEQ ID NO: 368824 - RNA, 21 nt, Homo sapiens
cucugguuugcauuggauuau

SEQ ID NO: 368825 - RNA, 22 nt, Homo sapiens
cugaauguccaggcagagguuu

SEQ ID NO: 368826 - RNA, 22 nt, Homo sapiens
cugacaugcagccacugcaccu

SEQ ID NO: 368827 - RNA, 22 nt, Homo sapiens
cugagauggagucucgcauugu

SEQ ID NO: 368828 - RNA, 22 nt, Homo sapiens
cugugcauucuuaaaucaggaa

SEQ ID NO: 368829 - RNA, 20 nt, Homo sapiens
cuugaagacuaugcugcuga

SEQ ID NO: 368830 - RNA, 22 nt, Homo sapiens
cuugcagaggcccuggggagag

SEQ ID NO: 368831 - RNA, 22 nt, Homo sapiens
cuugcauuuuggagaaugcuga

SEQ ID NO: 368832 - RNA, 22 nt, Homo sapiens
cuuggguaagucauuaaaauua

SEQ ID NO: 368833 - RNA, 22 nt, Homo sapiens
acuuuuugauggggagaacauu

SEQ ID NO: 368834 - RNA, 22 nt, Homo sapiens
agacagcuggaguaucauagcu

SEQ ID NO: 368835 - RNA, 22 nt, Homo sapiens
agagaacuggcuucaccauucu

SEQ ID NO: 368836 - RNA, 22 nt, Homo sapiens
agcagauguuuagugagcgccu

SEQ ID NO: 368837 - RNA, 22 nt, Homo sapiens
agccuauccaauaucagugaga

SEQ ID NO: 368838 - RNA, 18 nt, Homo sapiens
aggaaugguaauacuuca

SEQ ID NO: 368839 - RNA, 21 nt, Homo sapiens
aggucaugaagauguucuaau

SEQ ID NO: 368840 - RNA, 22 nt, Homo sapiens
aggugcugagcagagaauccug

SEQ ID NO: 368841 - RNA, 22 nt, Homo sapiens
aguauguuuugaaaccaagaag

SEQ ID NO: 368842 - RNA, 22 nt, Homo sapiens
agucacaugcauuuucuucaau

SEQ ID NO: 368843 - RNA, 22 nt, Homo sapiens
auaauagcugaucauuuagaag

SEQ ID NO: 368844 - RNA, 22 nt, Homo sapiens
auaauguuugauugagcagaua

SEQ ID NO: 368845 - RNA, 22 nt, Homo sapiens
auacaagcaguccaacuccaua

SEQ ID NO: 368846 - RNA, 22 nt, Homo sapiens
auacagcuaaaauauuaaguua

SEQ ID NO: 368847 - RNA, 22 nt, Homo sapiens
auacaguaaugucuuaggcugu

SEQ ID NO: 368848 - RNA, 22 nt, Homo sapiens
auacauguuucauguuggugug

SEQ ID NO: 368849 - RNA, 22 nt, Homo sapiens
auacuguacugaaguacccauu

SEQ ID NO: 368850 - RNA, 22 nt, Homo sapiens
auauccguacaguggaauauua

SEQ ID NO: 368851 - RNA, 22 nt, Homo sapiens
auauuguacugcuacugguucu

SEQ ID NO: 368852 - RNA, 22 nt, Homo sapiens
aucaaguaaucugaguaagagu

SEQ ID NO: 368853 - RNA, 22 nt, Homo sapiens
aucacagcccuccucuuggaug

SEQ ID NO: 368854 - RNA, 23 nt, Homo sapiens
aucagauaguuguagguaugugg

SEQ ID NO: 368855 - RNA, 22 nt, Homo sapiens
aucagcauucccaaaugaugug

SEQ ID NO: 368856 - RNA, 22 nt, Homo sapiens
aucauccagccccagaagggag

SEQ ID NO: 368857 - RNA, 22 nt, Homo sapiens
aucccuguaguaauauucuagc

SEQ ID NO: 368858 - RNA, 22 nt, Homo sapiens
auccuacaguccauucuuugug

SEQ ID NO: 368859 - RNA, 22 nt, Homo sapiens
aucugguguggcugugauccuc

SEQ ID NO: 368860 - RNA, 22 nt, Homo sapiens
aucugugguuguaugcauauua

SEQ ID NO: 368861 - RNA, 17 nt, Homo sapiens
augaagucaucauuuuu

SEQ ID NO: 368862 - RNA, 22 nt, Homo sapiens
augaagugcaugauaguugguu

SEQ ID NO: 368863 - RNA, 22 nt, Homo sapiens
augaaguuagcucauuucuuuu

SEQ ID NO: 368864 - RNA, 22 nt, Homo sapiens
augacguugugggcucucaagc

SEQ ID NO: 368865 - RNA, 22 nt, Homo sapiens
augagagugagagcagccccuu

SEQ ID NO: 368866 - RNA, 22 nt, Homo sapiens
augagaugaauaccgacgaugu

SEQ ID NO: 368867 - RNA, 22 nt, Homo sapiens
augaggaagucaggcccagggg

SEQ ID NO: 368868 - RNA, 22 nt, Homo sapiens
augagggcggacgcccuggaga

SEQ ID NO: 368869 - RNA, 23 nt, Homo sapiens
augagguaucugagcccagaaau

SEQ ID NO: 368870 - RNA, 22 nt, Homo sapiens
augauacuggcuucauagaaug

SEQ ID NO: 368871 - RNA, 22 nt, Homo sapiens
augauauggguugucaguugua

SEQ ID NO: 368872 - RNA, 18 nt, Homo sapiens
augcauauuuuaaguugu

SEQ ID NO: 368873 - RNA, 22 nt, Homo sapiens
augccacugcacuucagccugg

SEQ ID NO: 368874 - RNA, 22 nt, Homo sapiens
augccacugcgcucuagccugg

SEQ ID NO: 368875 - RNA, 22 nt, Homo sapiens
auggagaugaauaucaucuguu

SEQ ID NO: 368876 - RNA, 22 nt, Homo sapiens
auggaguuugaacaauuuccug

SEQ ID NO: 368877 - RNA, 22 nt, Homo sapiens
auggcacuaaguucaacacuua

SEQ ID NO: 368878 - RNA, 22 nt, Homo sapiens
auggcacugauggaaguaccuu

SEQ ID NO: 368879 - RNA, 22 nt, Homo sapiens
auggcacuguguauuuuucugu

SEQ ID NO: 368880 - RNA, 22 nt, Homo sapiens
auggcacuguguccugggguca

SEQ ID NO: 368881 - RNA, 22 nt, Homo sapiens
auggccauuacuaagaauguuu

SEQ ID NO: 368882 - RNA, 22 nt, Homo sapiens
auggcuagaaccuguauauuca

SEQ ID NO: 368883 - RNA, 22 nt, Homo sapiens
auggcuagauuguaugguaguu

SEQ ID NO: 368884 - RNA, 22 nt, Homo sapiens
auggcucuguuccaugugucuu

SEQ ID NO: 368885 - RNA, 22 nt, Homo sapiens
auggcugagugauuucaaacag

SEQ ID NO: 368886 - RNA, 22 nt, Homo sapiens
augggcuaguaaagacaaacuu

SEQ ID NO: 368887 - RNA, 22 nt, Homo sapiens
augguauggaaggucuggagga

SEQ ID NO: 368888 - RNA, 22 nt, Homo sapiens
augguuuauuuguaagcagagu

SEQ ID NO: 368889 - RNA, 22 nt, Homo sapiens
augguuuuacugcaaaauggga

SEQ ID NO: 368890 - RNA, 22 nt, Homo sapiens
augugggaggacuuggcuguug

SEQ ID NO: 368891 - RNA, 22 nt, Homo sapiens
augugugcuugauguaaaaagu

SEQ ID NO: 368892 - RNA, 20 nt, Homo sapiens
auguucuggaggacagaagc

SEQ ID NO: 368893 - RNA, 21 nt, Homo sapiens
auugagcacaugaaacauggc

SEQ ID NO: 368894 - RNA, 22 nt, Homo sapiens
auugaguaaaaaauagugaugu

SEQ ID NO: 368895 - RNA, 22 nt, Homo sapiens
auugaguaaaugaaaauugccu

SEQ ID NO: 368896 - RNA, 19 nt, Homo sapiens
gaaguguuuguucuccaug

SEQ ID NO: 368897 - RNA, 20 nt, Homo sapiens
gacauguugguuugcugcac

SEQ ID NO: 368898 - RNA, 22 nt, Homo sapiens
gagagguaguuuuuuggucguc

SEQ ID NO: 368899 - RNA, 22 nt, Homo sapiens
gagaugguacacauacgauucu

SEQ ID NO: 368900 - RNA, 22 nt, Homo sapiens
gagauggugugcuguuggaagu

SEQ ID NO: 368901 - RNA, 22 nt, Homo sapiens
gagauuuucagcuugacuggga

SEQ ID NO: 368902 - RNA, 22 nt, Homo sapiens
gagcaaaaguauguauugguua

SEQ ID NO: 368903 - RNA, 22 nt, Homo sapiens
gagguaugugggcagacauuua

SEQ ID NO: 368904 - RNA, 22 nt, Homo sapiens
gaggugaaggucucaauaaaua

SEQ ID NO: 368905 - RNA, 22 nt, Homo sapiens
gagguggugguggaggcauagc

SEQ ID NO: 368906 - RNA, 22 nt, Homo sapiens
gagugcauaugggccuguguca

SEQ ID NO: 368907 - RNA, 22 nt, Homo sapiens
gauauguucuuucacguuggug

SEQ ID NO: 368908 - RNA, 22 nt, Homo sapiens
gauauguuguuggauucgguua

SEQ ID NO: 368909 - RNA, 22 nt, Homo sapiens
gaugcaaauuaagcuugggaca

SEQ ID NO: 368910 - RNA, 22 nt, Homo sapiens
gauggcuauucuuaccauuucu

SEQ ID NO: 368911 - RNA, 22 nt, Homo sapiens
gauguguuuaucacccaguccu

SEQ ID NO: 368912 - RNA, 22 nt, Homo sapiens
gcagcacaugacuguauguaua

SEQ ID NO: 368913 - RNA, 22 nt, Homo sapiens
gccaacauggcgcuccauucuu

SEQ ID NO: 368914 - RNA, 22 nt, Homo sapiens
gcccuguugcccaggcuggagu

SEQ ID NO: 368915 - RNA, 22 nt, Homo sapiens
ggaaagaucagcuaaauguaag

SEQ ID NO: 368916 - RNA, 22 nt, Homo sapiens
ggaagagugaauuaucuugacu

SEQ ID NO: 368917 - RNA, 22 nt, Homo sapiens
ggaaugcagugagcauuagaua

SEQ ID NO: 368918 - RNA, 22 nt, Homo sapiens
ggagggugagaucaauuuggga

SEQ ID NO: 368919 - RNA, 22 nt, Homo sapiens
ggagucuugcuauguugccaag

SEQ ID NO: 368920 - RNA, 21 nt, Homo sapiens
ggcauugugcccuugcucuag

SEQ ID NO: 368921 - RNA, 22 nt, Homo sapiens
ggcucagugaucuguuucugua

SEQ ID NO: 368922 - RNA, 22 nt, Homo sapiens
gggaugauuaugguucacuaca

SEQ ID NO: 368923 - RNA, 22 nt, Homo sapiens
gguauguuuagaccauuuacau

SEQ ID NO: 368924 - RNA, 22 nt, Homo sapiens
guacaguuuagugcuuugagaa

SEQ ID NO: 368925 - RNA, 22 nt, Homo sapiens
guagcagaauaucagauaauuu

SEQ ID NO: 368926 - RNA, 22 nt, Homo sapiens
guaguuuaucagaaagaauagg

SEQ ID NO: 368927 - RNA, 22 nt, Homo sapiens
gucagauaauuugcauccaucu

SEQ ID NO: 368928 - RNA, 22 nt, Homo sapiens
gucauccaggcuggagugaagc

SEQ ID NO: 368929 - RNA, 22 nt, Homo sapiens
gucugguuccugggagauuucu

SEQ ID NO: 368930 - RNA, 22 nt, Homo sapiens
gugagaugaggucucacucugu

SEQ ID NO: 368931 - RNA, 22 nt, Homo sapiens
gugagauggaguuggugucuuu

SEQ ID NO: 368932 - RNA, 22 nt, Homo sapiens
gugagcauauuaguauugcacu

SEQ ID NO: 368933 - RNA, 22 nt, Homo sapiens
gugagggaugugaaaaagguca

SEQ ID NO: 368934 - RNA, 22 nt, Homo sapiens
gugauguguuucaacagcuccu

SEQ ID NO: 368935 - RNA, 22 nt, Homo sapiens
gugcacauuguuuaugucuguu

SEQ ID NO: 368936 - RNA, 22 nt, Homo sapiens
gugcauauaaguuguuucuagu

SEQ ID NO: 368937 - RNA, 22 nt, Homo sapiens
gugcauguccacuaguccauau

SEQ ID NO: 368938 - RNA, 22 nt, Homo sapiens
guggacguguguccccauggcu

SEQ ID NO: 368939 - RNA, 22 nt, Homo sapiens
guggagcuguguggccuugggc

SEQ ID NO: 368940 - RNA, 22 nt, Homo sapiens
guggagucaucacucagagugg

SEQ ID NO: 368941 - RNA, 22 nt, Homo sapiens
guggcuagaaugaagguagcug

SEQ ID NO: 368942 - RNA, 22 nt, Homo sapiens
guguaugugagaaugcucaugu

SEQ ID NO: 368943 - RNA, 22 nt, Homo sapiens
gugugcauggagggggcaguga

SEQ ID NO: 368944 - RNA, 21 nt, Homo sapiens
gugugcuugaauucagcuguc

SEQ ID NO: 368945 - RNA, 22 nt, Homo sapiens
gugugucuugaccaggaucgga

SEQ ID NO: 368946 - RNA, 22 nt, Homo sapiens
guucaucagggauauuggcuua

SEQ ID NO: 368947 - RNA, 22 nt, Homo sapiens
guugaaaucaucacuuggcaug

SEQ ID NO: 368948 - RNA, 22 nt, Homo sapiens
guugcaaaguaauugugguuuu

SEQ ID NO: 368949 - RNA, 22 nt, Homo sapiens
uaaaguguuuguuauuaaaggu

SEQ ID NO: 368950 - RNA, 22 nt, Homo sapiens
uaaaugacugucaguagaugaa

SEQ ID NO: 368951 - RNA, 22 nt, Homo sapiens
uaaggcacucuucugugugccu

SEQ ID NO: 368952 - RNA, 22 nt, Homo sapiens
uaaggcucuuguuauuuugagg

SEQ ID NO: 368953 - RNA, 22 nt, Homo sapiens
uaauauguuuugaaaucaggaa

SEQ ID NO: 368954 - RNA, 22 nt, Homo sapiens
uacaagcaggaaaugguauaug

SEQ ID NO: 368955 - RNA, 19 nt, Homo sapiens
uacaugcagcaggcacgca

SEQ ID NO: 368956 - RNA, 18 nt, Homo sapiens
uagaauauaggucauucu

SEQ ID NO: 368957 - RNA, 22 nt, Homo sapiens
uagagauaucaauuucauggug

SEQ ID NO: 368958 - RNA, 18 nt, Homo sapiens
ugcuccccugggugagca

SEQ ID NO: 368959 - RNA, 22 nt, Homo sapiens
uggaaucuacuaaagcaaaauc

SEQ ID NO: 368960 - RNA, 19 nt, Homo sapiens
uggcaugaaugugaacuaa

SEQ ID NO: 368961 - RNA, 22 nt, Homo sapiens
uggcauguauuuuguguauuaa

SEQ ID NO: 368962 - RNA, 22 nt, Homo sapiens
uggcauuuugugugaauuagaa

SEQ ID NO: 368963 - RNA, 22 nt, Homo sapiens
uggcauuuuguuuuagaauuag

SEQ ID NO: 368964 - RNA, 19 nt, Homo sapiens
uggucaguucugggagcug

SEQ ID NO: 368965 - RNA, 22 nt, Homo sapiens
uguagcagccauaaacacagug

SEQ ID NO: 368966 - RNA, 22 nt, Homo sapiens
uguauguugauguuauauucug

SEQ ID NO: 368967 - RNA, 19 nt, Homo sapiens
ugugaacaucacagagugu

SEQ ID NO: 368968 - RNA, 22 nt, Homo sapiens
ugugacagguagguaauuuuug

SEQ ID NO: 368969 - RNA, 19 nt, Homo sapiens
ugugagcauuagcauuuag

SEQ ID NO: 368970 - RNA, 22 nt, Homo sapiens
ugugcaaaaacaauugcgguuu

SEQ ID NO: 368971 - RNA, 22 nt, Homo sapiens
uguggcacuguguccagagaaa

SEQ ID NO: 368972 - RNA, 18 nt, Homo sapiens
uguggcuguuuuccaaua

SEQ ID NO: 368973 - RNA, 22 nt, Homo sapiens
uguguauaucacugcaugagug

SEQ ID NO: 368974 - RNA, 18 nt, Homo sapiens
uguugguguucacucacu

SEQ ID NO: 368975 - RNA, 22 nt, Homo sapiens
uuaagugcucaguuacucaguu

SEQ ID NO: 368976 - RNA, 20 nt, Homo sapiens
uuaagugcuuucugcuuaga

SEQ ID NO: 368977 - RNA, 22 nt, Homo sapiens
uuaauagugacucauuuuccac

SEQ ID NO: 368978 - RNA, 22 nt, Homo sapiens
uuaauccugccuuauuucagua

SEQ ID NO: 368979 - RNA, 22 nt, Homo sapiens
uuacaguagaugaggguauaau

SEQ ID NO: 368980 - RNA, 22 nt, Homo sapiens
uuacagucuuaggcagugcuuu

SEQ ID NO: 368981 - RNA, 22 nt, Homo sapiens
uuacaguguuuguucuguuacu

SEQ ID NO: 368982 - RNA, 22 nt, Homo sapiens
uuagcacaucuuucuauguaag

SEQ ID NO: 368983 - RNA, 21 nt, Homo sapiens
uuagugcucaguuugacaaaa

SEQ ID NO: 368984 - RNA, 22 nt, Homo sapiens
uucaaaggauuuagauuagcua

SEQ ID NO: 368985 - RNA, 22 nt, Homo sapiens
uucaagcugggcaaauaagggg

SEQ ID NO: 368986 - RNA, 22 nt, Homo sapiens
uucacaauuaaaugugguuauu

SEQ ID NO: 368987 - RNA, 22 nt, Homo sapiens
uucaguggacuuaguagugcuu

SEQ ID NO: 368988 - RNA, 22 nt, Homo sapiens
uucagugguuauuugugagauu

SEQ ID NO: 368989 - RNA, 22 nt, Homo sapiens
uucauacaguggcugcacucca

SEQ ID NO: 368990 - RNA, 22 nt, Homo sapiens
uuccuguagcgauuuuaguaau

SEQ ID NO: 368991 - RNA, 22 nt, Homo sapiens
uucuaaguaauuuugcaugccu

SEQ ID NO: 368992 - RNA, 21 nt, Homo sapiens
uucuacuccggcguuguuuuu

SEQ ID NO: 368993 - RNA, 22 nt, Homo sapiens
uugacagaccuuggucauaucc

SEQ ID NO: 368994 - RNA, 22 nt, Homo sapiens
uugagacugagucucgcccugu

SEQ ID NO: 368995 - RNA, 22 nt, Homo sapiens
uuggaaaaauccaccuugaucu

SEQ ID NO: 368996 - RNA, 22 nt, Homo sapiens
uuggcauugaguuucaaaucau

SEQ ID NO: 368997 - RNA, 22 nt, Homo sapiens
uuggcauugccaaacugucaac

SEQ ID NO: 368998 - RNA, 22 nt, Homo sapiens
uugguccacugugaaauuggga

SEQ ID NO: 368999 - RNA, 22 nt, Homo sapiens
uuuaaaguuagaaggaaagggc

SEQ ID NO: 369000 - RNA, 22 nt, Homo sapiens
uuuaagccaggugcaguggcuc

SEQ ID NO: 369001 - RNA, 22 nt, Homo sapiens
uuuacugugggguuucuuagag

SEQ ID NO: 369002 - RNA, 22 nt, Homo sapiens
uuuaugucuguacaucgggcgg

SEQ ID NO: 369003 - RNA, 20 nt, Homo sapiens
uuugcagaaucuaagaagag

SEQ ID NO: 369004 - RNA, 22 nt, Homo sapiens
uuuggcauauuuuaagcugguu

SEQ ID NO: 369005 - RNA, 20 nt, Homo sapiens
uuuugcacuccuacuaaggu

SEQ ID NO: 369006 - RNA, 22 nt, Homo sapiens
uuuuugugguauauugcaacaa

SEQ ID NO: 369007 - RNA, 22 nt, Homo sapiens
aaaguucuguugauagugcuga

SEQ ID NO: 369008 - RNA, 22 nt, Homo sapiens
aaagagaucuaugggcacuaug

SEQ ID NO: 369009 - RNA, 22 nt, Homo sapiens
aaagucuagaggaucaugugug

SEQ ID NO: 369010 - RNA, 22 nt, Homo sapiens
aaagugcaguacuucguauauu

SEQ ID NO: 369011 - RNA, 22 nt, Homo sapiens
aaauaacugucagguucuggaa

SEQ ID NO: 369012 - RNA, 22 nt, Homo sapiens
aaauugcaguuaggaugauggu

SEQ ID NO: 369013 - RNA, 21 nt, Homo sapiens
aacagugcuuaguagauguuc

SEQ ID NO: 369014 - RNA, 22 nt, Homo sapiens
aacuacaucucuuugaggcagg

SEQ ID NO: 369015 - RNA, 22 nt, Homo sapiens
aagagaugaagguccugacugu

SEQ ID NO: 369016 - RNA, 22 nt, Homo sapiens
aagagcauuauuuaguaauuuc

SEQ ID NO: 369017 - RNA, 21 nt, Homo sapiens
aagcaugguguaucuuuccau

SEQ ID NO: 369018 - RNA, 22 nt, Homo sapiens
uaugagcaaaaugaggguuagu

SEQ ID NO: 369019 - RNA, 18 nt, Homo sapiens
uauuccucuuccucuauc

SEQ ID NO: 369020 - RNA, 22 nt, Homo sapiens
uauugaauuuuuaagcccuuug

SEQ ID NO: 369021 - RNA, 22 nt, Homo sapiens
ucacagaugaggcgagaggcag

SEQ ID NO: 369022 - RNA, 22 nt, Homo sapiens
ucaccuggggcacagcugaaga

SEQ ID NO: 369023 - RNA, 22 nt, Homo sapiens
ucagaccauuucauuacagacu

SEQ ID NO: 369024 - RNA, 20 nt, Homo sapiens
ucagugcagauuguccaagu

SEQ ID NO: 369025 - RNA, 22 nt, Homo sapiens
ucagugcuuuuuguugucauca

SEQ ID NO: 369026 - RNA, 22 nt, Homo sapiens
ucauaucauuagaucuacugua

SEQ ID NO: 369027 - RNA, 22 nt, Homo sapiens
uccagugcauucagacacuugg

SEQ ID NO: 369028 - RNA, 22 nt, Homo sapiens
uccuacaugcaguacauucaaa

SEQ ID NO: 369029 - RNA, 22 nt, Homo sapiens
uccugagaauagaguugcaugu

SEQ ID NO: 369030 - RNA, 22 nt, Homo sapiens
ucugugaaugaacacuugaaaa

SEQ ID NO: 369031 - RNA, 22 nt, Homo sapiens
ugaaauuguuugcaaggauagg

SEQ ID NO: 369032 - RNA, 22 nt, Homo sapiens
ugaauacuucguucaaagauaa

SEQ ID NO: 369033 - RNA, 21 nt, Homo sapiens
ugaaugcuuuaaauauuagaa

SEQ ID NO: 369034 - RNA, 22 nt, Homo sapiens
ugacagugugagacuuugucuc

SEQ ID NO: 369035 - RNA, 22 nt, Homo sapiens
ugagaacucaugggucugcugg

SEQ ID NO: 369036 - RNA, 22 nt, Homo sapiens
ugagaauauuuuccaugucuca

SEQ ID NO: 369037 - RNA, 22 nt, Homo sapiens
ugagacgaagucuugcucuguu

SEQ ID NO: 369038 - RNA, 22 nt, Homo sapiens
ugagccauggcaccuugucuaa

SEQ ID NO: 369039 - RNA, 22 nt, Homo sapiens
ugaguaugaguucaggaaaggc

SEQ ID NO: 369040 - RNA, 22 nt, Homo sapiens
ugaguuagguguuuuaaauaua

SEQ ID NO: 369041 - RNA, 22 nt, Homo sapiens
ugaguucaauguuaaugaagca

SEQ ID NO: 369042 - RNA, 19 nt, Homo sapiens
ugcagcaauguaaaagaca

SEQ ID NO: 369043 - RNA, 22 nt, Homo sapiens
ugcagcauguaggcacguuauu

SEQ ID NO: 369044 - RNA, 22 nt, Homo sapiens
ugcauauucaaggcaggccauu

SEQ ID NO: 369045 - RNA, 22 nt, Homo sapiens
ugcauauucgaguuauuuuggg

SEQ ID NO: 369046 - RNA, 22 nt, Homo sapiens
ugccagaugcuggugugagggg

SEQ ID NO: 369047 - RNA, 22 nt, Homo sapiens
ugcccuuugucagaugaguagg

SEQ ID NO: 369048 - RNA, 23 nt, Homo sapiens
ugcugagaccuagauccuaaaga

SEQ ID NO: 369049 - RNA, 22 nt, Homo sapiens
ugcugcaaucucggcacuuugg

SEQ ID NO: 369050 - RNA, 22 nt, Homo sapiens
uggaaaauuaggggagguuaua

SEQ ID NO: 369051 - RNA, 22 nt, Homo sapiens
uggaccccuucuccuauuaaaa

SEQ ID NO: 369052 - RNA, 22 nt, Homo sapiens
uggcaacaucuggggacauguu

SEQ ID NO: 369053 - RNA, 22 nt, Homo sapiens
uggcagauagaaaugugguuaa

SEQ ID NO: 369054 - RNA, 23 nt, Homo sapiens
uggcauuuuaguuagcuucagug

SEQ ID NO: 369055 - RNA, 22 nt, Homo sapiens
ugggaacaugaagguuaaagag

SEQ ID NO: 369056 - RNA, 22 nt, Homo sapiens
ugggaagauucuguguuuuucc

SEQ ID NO: 369057 - RNA, 22 nt, Homo sapiens
ugggaugaauacaaugggauca

SEQ ID NO: 369058 - RNA, 22 nt, Homo sapiens
ugggcaagagagcaugacccug

SEQ ID NO: 369059 - RNA, 22 nt, Homo sapiens
aggcagaugagguccucagcug

SEQ ID NO: 369060 - RNA, 20 nt, Homo sapiens
agguaguuauacaaaugugu

SEQ ID NO: 369061 - RNA, 22 nt, Homo sapiens
agguauguaugucuguacagcg

SEQ ID NO: 369062 - RNA, 22 nt, Homo sapiens
agguccauuauuuucauucaug

SEQ ID NO: 369063 - RNA, 22 nt, Homo sapiens
agugcauuuguucugugucagg

SEQ ID NO: 369064 - RNA, 22 nt, Homo sapiens
agugggccccuagaggugaggu

SEQ ID NO: 369065 - RNA, 22 nt, Homo sapiens
auaaaugcuuccagucauuaaa

SEQ ID NO: 369066 - RNA, 22 nt, Homo sapiens
auaaauucauuuaagcuccuua

SEQ ID NO: 369067 - RNA, 22 nt, Homo sapiens
auaacauggaguuugucauuua

SEQ ID NO: 369068 - RNA, 22 nt, Homo sapiens
auaauacugggaagaugagcau

SEQ ID NO: 369069 - RNA, 22 nt, Homo sapiens
auacaguguauguauaguacau

SEQ ID NO: 369070 - RNA, 22 nt, Homo sapiens
auacaguguucugggaagaagu

SEQ ID NO: 369071 - RNA, 19 nt, Homo sapiens
auaguguaggaaaacagcu

SEQ ID NO: 369072 - RNA, 22 nt, Homo sapiens
auaucacaaacaagucuguacu

SEQ ID NO: 369073 - RNA, 22 nt, Homo sapiens
auaucccuguauaagugaaugu

SEQ ID NO: 369074 - RNA, 22 nt, Homo sapiens
aucacaauuguacguaggagcc

SEQ ID NO: 369075 - RNA, 22 nt, Homo sapiens
aucauccagccccagaagggag

SEQ ID NO: 369076 - RNA, 22 nt, Homo sapiens
aucauugugugaguugauggga

SEQ ID NO: 369077 - RNA, 22 nt, Homo sapiens
aucugcauucccauguuuauug

SEQ ID NO: 369078 - RNA, 22 nt, Homo sapiens
aucuggguccguucugcuucuc

SEQ ID NO: 369079 - RNA, 22 nt, Homo sapiens
augaaacuggcuaauuuuugua

SEQ ID NO: 369080 - RNA, 21 nt, Homo sapiens
augacccuggguguccuuucc

SEQ ID NO: 369081 - RNA, 22 nt, Homo sapiens
augacuuuucugaaaaccacca

SEQ ID NO: 369082 - RNA, 22 nt, Homo sapiens
augauacuggcuucauagaaug

SEQ ID NO: 369083 - RNA, 22 nt, Homo sapiens
augaucauggaaguuuuccugu

SEQ ID NO: 369084 - RNA, 22 nt, Homo sapiens
augcacuguauaggaucuugcg

SEQ ID NO: 369085 - RNA, 22 nt, Homo sapiens
auggaagcauaguauucuauug

SEQ ID NO: 369086 - RNA, 22 nt, Homo sapiens
auggcauugaagaguugucccu

SEQ ID NO: 369087 - RNA, 22 nt, Homo sapiens
auggcauuuuuagggcugggug

SEQ ID NO: 369088 - RNA, 22 nt, Homo sapiens
auguaugagaguuccagcugau

SEQ ID NO: 369089 - RNA, 22 nt, Homo sapiens
auuccaguuugugagaagcugu

SEQ ID NO: 369090 - RNA, 22 nt, Homo sapiens
auugcccauaaggauauuguca

SEQ ID NO: 369091 - RNA, 22 nt, Homo sapiens
auuggcaauccauauauuuucu

SEQ ID NO: 369092 - RNA, 22 nt, Homo sapiens
auuguacuccagccuaggcaac

SEQ ID NO: 369093 - RNA, 22 nt, Homo sapiens
auuguacucuagccucugggca

SEQ ID NO: 369094 - RNA, 22 nt, Homo sapiens
auugucacccgggcaguaagca

SEQ ID NO: 369095 - RNA, 20 nt, Homo sapiens
auuuggcauaguuuaagcaa

SEQ ID NO: 369096 - RNA, 22 nt, Homo sapiens
caaaggcuguuauaggccagga

SEQ ID NO: 369097 - RNA, 22 nt, Homo sapiens
caaaguaauugcuguuuugcca

SEQ ID NO: 369098 - RNA, 22 nt, Homo sapiens
caacugguuuuauacaguuuag

SEQ ID NO: 369099 - RNA, 17 nt, Homo sapiens
cacugggugcaagagga

SEQ ID NO: 369100 - RNA, 22 nt, Homo sapiens
cacugggugccauauguuugcu

SEQ ID NO: 369101 - RNA, 22 nt, Homo sapiens
caggaaugugaggguucccugc

SEQ ID NO: 369102 - RNA, 22 nt, Homo sapiens
caggcagucuggggguguaucc

SEQ ID NO: 369103 - RNA, 22 nt, Homo sapiens
caugcauuggucuauuauguga

SEQ ID NO: 369104 - RNA, 22 nt, Homo sapiens
ccagaguuucugauucagcagg

SEQ ID NO: 369105 - RNA, 22 nt, Homo sapiens
ccagauguuuucauucagcaag

SEQ ID NO: 369106 - RNA, 21 nt, Homo sapiens
ccugaagaagugaccucugag

SEQ ID NO: 369107 - RNA, 22 nt, Homo sapiens
ccuuuguuaguuugcugagaau

SEQ ID NO: 369108 - RNA, 22 nt, Homo sapiens
cuagauuauccaacuuauuagc

SEQ ID NO: 369109 - RNA, 22 nt, Homo sapiens
cuccauuuaguccuuuuagaag

SEQ ID NO: 369110 - RNA, 22 nt, Homo sapiens
cuccauuuggaacagauguccu

SEQ ID NO: 369111 - RNA, 22 nt, Homo sapiens
cugagacuggugauuuaugaag

SEQ ID NO: 369112 - RNA, 22 nt, Homo sapiens
aagguggugucagagagcuuau

SEQ ID NO: 369113 - RNA, 23 nt, Homo sapiens
aaguucaugcucaucuguuacac

SEQ ID NO: 369114 - RNA, 22 nt, Homo sapiens
aauaaagcuuugagcuuugcug

SEQ ID NO: 369115 - RNA, 21 nt, Homo sapiens
aaucacaguuguucugccuuc

SEQ ID NO: 369116 - RNA, 22 nt, Homo sapiens
aaugacagccagauucuucucu

SEQ ID NO: 369117 - RNA, 22 nt, Homo sapiens
aauggcaguagauggaugggua

SEQ ID NO: 369118 - RNA, 18 nt, Homo sapiens
acagugcuggcaugagau

SEQ ID NO: 369119 - RNA, 22 nt, Homo sapiens
acagugcuucugauaugaugcc

SEQ ID NO: 369120 - RNA, 22 nt, Homo sapiens
acagugcuuucaauguucagua

SEQ ID NO: 369121 - RNA, 19 nt, Homo sapiens
acagugcuuugucagaagc

SEQ ID NO: 369122 - RNA, 18 nt, Homo sapiens
acagugucauggcucaau

SEQ ID NO: 369123 - RNA, 17 nt, Homo sapiens
acagugucuaugaaaug

SEQ ID NO: 369124 - RNA, 22 nt, Homo sapiens
acaucaggcuugugaugauuac

SEQ ID NO: 369125 - RNA, 22 nt, Homo sapiens
accauugcacuccagcccaggc

SEQ ID NO: 369126 - RNA, 21 nt, Homo sapiens
acccucuaguuuucaacaggc

SEQ ID NO: 369127 - RNA, 22 nt, Homo sapiens
agaaccaaucccacauggauac

SEQ ID NO: 369128 - RNA, 22 nt, Homo sapiens
agaauacugucuauucauggua

SEQ ID NO: 369129 - RNA, 20 nt, Homo sapiens
agcagccacagauuccucag

SEQ ID NO: 369130 - RNA, 21 nt, Homo sapiens
agcagcuuugguugaagcaga

SEQ ID NO: 369131 - RNA, 22 nt, Homo sapiens
agcagugugaaaugauuuaagg

SEQ ID NO: 369132 - RNA, 20 nt, Homo sapiens
agcaucauugcaauuuguca

SEQ ID NO: 369133 - RNA, 21 nt, Homo sapiens
agccaguguuccuuguggcuc

SEQ ID NO: 369134 - RNA, 22 nt, Homo sapiens
agcgccacugcacuccagccug

SEQ ID NO: 369135 - RNA, 22 nt, Homo sapiens
agcuaugucugaugccugauua

SEQ ID NO: 369136 - RNA, 22 nt, Homo sapiens
agcucuauuagaagccgugggu

SEQ ID NO: 369137 - RNA, 22 nt, Homo sapiens
agcuuguagugauuugugguaa

SEQ ID NO: 369138 - RNA, 22 nt, Homo sapiens
aguccauuugaugaugauucca

SEQ ID NO: 369139 - RNA, 22 nt, Homo sapiens
agucugguguucucacacuagu

SEQ ID NO: 369140 - RNA, 22 nt, Homo sapiens
agugcaauaaggauguagaacu

SEQ ID NO: 369141 - RNA, 18 nt, Homo sapiens
auaaacucaucauuuuua

SEQ ID NO: 369142 - RNA, 22 nt, Homo sapiens
auaaaugcaaugguauuuuuga

SEQ ID NO: 369143 - RNA, 22 nt, Homo sapiens
auaaaugcuuagaucuguauau

SEQ ID NO: 369144 - RNA, 23 nt, Homo sapiens
auaaugcaaguggugguaaucug

SEQ ID NO: 369145 - RNA, 22 nt, Homo sapiens
auacaguauggagggcccagcu

SEQ ID NO: 369146 - RNA, 22 nt, Homo sapiens
auacagugaauacuuacagugu

SEQ ID NO: 369147 - RNA, 22 nt, Homo sapiens
auagaucauugucauuuuagau

SEQ ID NO: 369148 - RNA, 22 nt, Homo sapiens
auagcagugucccacuccuugg

SEQ ID NO: 369149 - RNA, 22 nt, Homo sapiens
auauagcaaugaaagagaugaa

SEQ ID NO: 369150 - RNA, 22 nt, Homo sapiens
auaucacagguguuuaccugau

SEQ ID NO: 369151 - RNA, 22 nt, Homo sapiens
auaugguuuuuggaagcauauc

SEQ ID NO: 369152 - RNA, 22 nt, Homo sapiens
aucagugagugguuagugaaug

SEQ ID NO: 369153 - RNA, 22 nt, Homo sapiens
aucauacuguuuugauuacugu

SEQ ID NO: 369154 - RNA, 22 nt, Homo sapiens
augaaaucuuuccugugaggau

SEQ ID NO: 369155 - RNA, 22 nt, Homo sapiens
augacccugaccuaagccaauc

SEQ ID NO: 369156 - RNA, 22 nt, Homo sapiens
augagaacauaucaagugauug

SEQ ID NO: 369157 - RNA, 22 nt, Homo sapiens
augagaccagcagaaaaccugu

SEQ ID NO: 369158 - RNA, 22 nt, Homo sapiens
augagcaucaccagaaucaaua

SEQ ID NO: 369159 - RNA, 22 nt, Homo sapiens
augagcuccucaaggucagaga

SEQ ID NO: 369160 - RNA, 22 nt, Homo sapiens
augaucaucugaaagcuuuuac

SEQ ID NO: 369161 - RNA, 22 nt, Homo sapiens
augaucuguuuggugaucuugu

SEQ ID NO: 369162 - RNA, 22 nt, Homo sapiens
auggaaaugaagggcuggcccu

SEQ ID NO: 369163 - RNA, 22 nt, Homo sapiens
auggaacauaacuauuugggga

SEQ ID NO: 369164 - RNA, 22 nt, Homo sapiens
auguaacacagugcggcugggc

SEQ ID NO: 369165 - RNA, 22 nt, Homo sapiens
auguccuggacccagacaaagc

SEQ ID NO: 369166 - RNA, 23 nt, Homo sapiens
augugugcuuggagagcaggaug

SEQ ID NO: 369167 - RNA, 22 nt, Homo sapiens
auuaagugaaugaaguuguucc

SEQ ID NO: 369168 - RNA, 22 nt, Homo sapiens
auuaagugcuugcagaagucca

SEQ ID NO: 369169 - RNA, 22 nt, Homo sapiens
uuuaaguguuuguuccugaaaa

SEQ ID NO: 369170 - RNA, 22 nt, Homo sapiens
uuuagcucauucaauuucaguc

SEQ ID NO: 369171 - RNA, 21 nt, Homo sapiens
uuuagguagcuuuucugggag

SEQ ID NO: 369172 - RNA, 22 nt, Homo sapiens
uuuagguauuugguauagcagu

SEQ ID NO: 369173 - RNA, 22 nt, Homo sapiens
uuuaguacugcuuuaugugugu

SEQ ID NO: 369174 - RNA, 23 nt, Homo sapiens
uuugccacuuauuagcugggagg

SEQ ID NO: 369175 - RNA, 22 nt, Homo sapiens
uuugggaaugaguuuaucauuu

SEQ ID NO: 369176 - RNA, 23 nt, Homo sapiens
uuuguaguagcaugauuuauaau

SEQ ID NO: 369177 - RNA, 22 nt, Homo sapiens
uuuguggaaugcucauguguag

SEQ ID NO: 369178 - RNA, 22 nt, Homo sapiens
uuugugugugauuauaaaaggu

SEQ ID NO: 369179 - RNA, 22 nt, Homo sapiens
uuuuaguggaauauuuacaguu

SEQ ID NO: 369180 - RNA, 22 nt, Homo sapiens
uuuugcacauugauuugguauc

SEQ ID NO: 369181 - RNA, 22 nt, Homo sapiens
uuuuugaguaaauauaaauugu

SEQ ID NO: 369182 - RNA, 23 nt, Homo sapiens
uuuuuguguuucauggaaauagg

SEQ ID NO: 369183 - RNA, 22 nt, Homo sapiens
cuuuguggggucuuuccucaaa

SEQ ID NO: 369184 - RNA, 22 nt, Homo sapiens
cuuuugugauuccucaguuacu

SEQ ID NO: 369185 - RNA, 22 nt, Homo sapiens
gaaagcugguauagauacauua

SEQ ID NO: 369186 - RNA, 22 nt, Homo sapiens
gaauuguacugcaaucagggga

SEQ ID NO: 369187 - RNA, 16 nt, Homo sapiens
gacaugaucuuguuua

SEQ ID NO: 369188 - RNA, 22 nt, Homo sapiens
gacugaguaagcagaagcaauu

SEQ ID NO: 369189 - RNA, 22 nt, Homo sapiens
gagacauguuugcuuaucugag

SEQ ID NO: 369190 - RNA, 22 nt, Homo sapiens
gagaugugugugauuauauaau

SEQ ID NO: 369191 - RNA, 22 nt, Homo sapiens
gagguauaauugacaagcaaaa

SEQ ID NO: 369192 - RNA, 22 nt, Homo sapiens
gagugcugagcccacuuccuug

SEQ ID NO: 369193 - RNA, 22 nt, Homo sapiens
gaugagaucauaaguguggagc

SEQ ID NO: 369194 - RNA, 22 nt, Homo sapiens
gcaaaauugagaagggaauaua

SEQ ID NO: 369195 - RNA, 22 nt, Homo sapiens
gcaaagaaugcagauuugccuc

SEQ ID NO: 369196 - RNA, 22 nt, Homo sapiens
gcagugugaucacagcuuacug

SEQ ID NO: 369197 - RNA, 22 nt, Homo sapiens
gcagugugauguuuuaaucuau

SEQ ID NO: 369198 - RNA, 22 nt, Homo sapiens
gccaaaaugcugggauuacagg

SEQ ID NO: 369199 - RNA, 22 nt, Homo sapiens
gccagugugaugugaucauggc

SEQ ID NO: 369200 - RNA, 22 nt, Homo sapiens
gcccugauacauucuucugccu

SEQ ID NO: 369201 - RNA, 22 nt, Homo sapiens
gcugauggugcaguucuagccu

SEQ ID NO: 369202 - RNA, 22 nt, Homo sapiens
ggagucugaacuggacaaugac

SEQ ID NO: 369203 - RNA, 22 nt, Homo sapiens
ggcaguuuggcaguuucauaaa

SEQ ID NO: 369204 - RNA, 22 nt, Homo sapiens
gggcagaugucuggacaccuca

SEQ ID NO: 369205 - RNA, 22 nt, Homo sapiens
ggguaggcaagcggaugucaga

SEQ ID NO: 369206 - RNA, 22 nt, Homo sapiens
gguauguaggucuacgguacaa

SEQ ID NO: 369207 - RNA, 22 nt, Homo sapiens
guaaauaccaguuucuggaaca

SEQ ID NO: 369208 - RNA, 22 nt, Homo sapiens
guaagugauagaauuaggauuc

SEQ ID NO: 369209 - RNA, 22 nt, Homo sapiens
guacacaacaugcagguuuguu

SEQ ID NO: 369210 - RNA, 22 nt, Homo sapiens
guagaaagcauuucagauuugc

SEQ ID NO: 369211 - RNA, 22 nt, Homo sapiens
guagcaucauuugcaauuucau

SEQ ID NO: 369212 - RNA, 22 nt, Homo sapiens
guaguuuaucagaaagaauagg

SEQ ID NO: 369213 - RNA, 22 nt, Homo sapiens
guauuuguugcagcagcacuau

SEQ ID NO: 369214 - RNA, 22 nt, Homo sapiens
gucacugacaagagagaagaac

SEQ ID NO: 369215 - RNA, 22 nt, Homo sapiens
gucacugagaagguuaguuugu

SEQ ID NO: 369216 - RNA, 22 nt, Homo sapiens
gucaguggagaaaaggacaugu

SEQ ID NO: 369217 - RNA, 22 nt, Homo sapiens
guccaguuguuuucugagguug

SEQ ID NO: 369218 - RNA, 22 nt, Homo sapiens
gucuagaacuucugaccuuagg

SEQ ID NO: 369219 - RNA, 22 nt, Homo sapiens
gugagaugauggguauguuaau

SEQ ID NO: 369220 - RNA, 20 nt, Homo sapiens
gugagguagaggguuaccug

SEQ ID NO: 369221 - RNA, 22 nt, Homo sapiens
gugcacaaaucuuaaauguaca

SEQ ID NO: 369222 - RNA, 22 nt, Homo sapiens
guggaaaauuauugcuguuuuu

SEQ ID NO: 369223 - RNA, 22 nt, Homo sapiens
gugguucuagagggacagaaug

SEQ ID NO: 369224 - RNA, 22 nt, Homo sapiens
guguaaaacaauuagaggauuu

SEQ ID NO: 369225 - RNA, 22 nt, Homo sapiens
guucacucuggagaauauugac

SEQ ID NO: 369226 - RNA, 22 nt, Homo sapiens
guugcucaggcugaagugcagu

SEQ ID NO: 369227 - RNA, 22 nt, Homo sapiens
guuggcuguuucccccaaguga

SEQ ID NO: 369228 - RNA, 22 nt, Homo sapiens
uaaagaugcugggaaggcuagg

SEQ ID NO: 369229 - RNA, 21 nt, Homo sapiens
uaaaggcuccaauuauacccc

SEQ ID NO: 369230 - RNA, 20 nt, Homo sapiens
uaaaugccucaugcuuuauu

SEQ ID NO: 369231 - RNA, 22 nt, Homo sapiens
uaacacagagcuccuaaucccu

SEQ ID NO: 369232 - RNA, 19 nt, Homo sapiens
uaacacaguuguguuugag

SEQ ID NO: 369233 - RNA, 22 nt, Homo sapiens
uaacagcauuugugucuaguag

SEQ ID NO: 369234 - RNA, 22 nt, Homo sapiens
uaacccacgcagaauggacaag

SEQ ID NO: 369235 - RNA, 22 nt, Homo sapiens
uaacccuuacaacuacacucgu

SEQ ID NO: 369236 - RNA, 22 nt, Homo sapiens
uaauagcucggauaaacaugau

SEQ ID NO: 369237 - RNA, 22 nt, Homo sapiens
uacaguaguaucuucauuuguu

SEQ ID NO: 369238 - RNA, 22 nt, Homo sapiens
uacagucuagaggagaaucagg

SEQ ID NO: 369239 - RNA, 23 nt, Homo sapiens
uagaauguuuuuccauguuucuu

SEQ ID NO: 369240 - RNA, 22 nt, Homo sapiens
uagacccauuacguaguuucca

SEQ ID NO: 369241 - RNA, 22 nt, Homo sapiens
uagauuaucauucauacaggga

SEQ ID NO: 369242 - RNA, 22 nt, Homo sapiens
uagcugcacuuacaagugagaa

SEQ ID NO: 369243 - RNA, 22 nt, Homo sapiens
uuacagugguugcuauugugaa

SEQ ID NO: 369244 - RNA, 22 nt, Homo sapiens
uuacuagaacauuuagggaacu

SEQ ID NO: 369245 - RNA, 22 nt, Homo sapiens
uuaucacauugacugauuugca

SEQ ID NO: 369246 - RNA, 22 nt, Homo sapiens
uucaaaguaaagggauggagac

SEQ ID NO: 369247 - RNA, 22 nt, Homo sapiens
uucaagauggcaccagugagug

SEQ ID NO: 369248 - RNA, 22 nt, Homo sapiens
uucaagucaauuuuugaaugac

SEQ ID NO: 369249 - RNA, 22 nt, Homo sapiens
uucaauacuguugauccuuaug

SEQ ID NO: 369250 - RNA, 22 nt, Homo sapiens
uucacagcuuaauaaggcucag

SEQ ID NO: 369251 - RNA, 22 nt, Homo sapiens
uucaguaaauguucuuacuaua

SEQ ID NO: 369252 - RNA, 22 nt, Homo sapiens
uucaguacacguguucucauuu

SEQ ID NO: 369253 - RNA, 20 nt, Homo sapiens
uucagugcagguaacaaucc

SEQ ID NO: 369254 - RNA, 18 nt, Homo sapiens
uucaucaguccucagcug

SEQ ID NO: 369255 - RNA, 22 nt, Homo sapiens
uucccuuucugaaaaucucauu

SEQ ID NO: 369256 - RNA, 21 nt, Homo sapiens
uucuauggucagaauucaaua

SEQ ID NO: 369257 - RNA, 22 nt, Homo sapiens
uucucagugaaguuuagaacau

SEQ ID NO: 369258 - RNA, 22 nt, Homo sapiens
uucuuagucaaguuguauuuca

SEQ ID NO: 369259 - RNA, 22 nt, Homo sapiens
uucuugcuguauccucacaugg

SEQ ID NO: 369260 - RNA, 22 nt, Homo sapiens
uugagacugaacauuuguguac

SEQ ID NO: 369261 - RNA, 22 nt, Homo sapiens
uugagcccuggagguggaggcu

SEQ ID NO: 369262 - RNA, 22 nt, Homo sapiens
uugagugaaugaaugauuaaau

SEQ ID NO: 369263 - RNA, 22 nt, Homo sapiens
uugcaagugccguaacuaccaa

SEQ ID NO: 369264 - RNA, 22 nt, Homo sapiens
uuggaauacuuguuaaagucca

SEQ ID NO: 369265 - RNA, 22 nt, Homo sapiens
uuggcauuuauucuaaggucaa

SEQ ID NO: 369266 - RNA, 22 nt, Homo sapiens
uuggcauuuuggacacccagga

SEQ ID NO: 369267 - RNA, 22 nt, Homo sapiens
uuggcauuuuuagucaugggaa

SEQ ID NO: 369268 - RNA, 23 nt, Homo sapiens
uugggcaaaucacugagggcaga

SEQ ID NO: 369269 - RNA, 23 nt, Homo sapiens
uuguaacuggagaguaacauucc

SEQ ID NO: 369270 - RNA, 22 nt, Homo sapiens
uugucacccucucuuggugucu

SEQ ID NO: 369271 - RNA, 22 nt, Homo sapiens
uuuaaggcaugccuguacaugc

SEQ ID NO: 369272 - RNA, 22 nt, Homo sapiens
cugaugaaguauuuguucugga

SEQ ID NO: 369273 - RNA, 22 nt, Homo sapiens
cugcuguuguuaacuuuuggag

SEQ ID NO: 369274 - RNA, 22 nt, Homo sapiens
cuggaaagaaucaggcuaaacu

SEQ ID NO: 369275 - RNA, 22 nt, Homo sapiens
cuucacuuuguuaaacuccaau

SEQ ID NO: 369276 - RNA, 22 nt, Homo sapiens
cuugagacauuguuuuccaagu

SEQ ID NO: 369277 - RNA, 22 nt, Homo sapiens
cuuuuacacuguuggcaggauu

SEQ ID NO: 369278 - RNA, 22 nt, Homo sapiens
cuuuuugcaaauacaacucuga

SEQ ID NO: 369279 - RNA, 22 nt, Homo sapiens
gaaagauuuccugagcuagaaa

SEQ ID NO: 369280 - RNA, 22 nt, Homo sapiens
gaagaacuaggugagaucuaga

SEQ ID NO: 369281 - RNA, 22 nt, Homo sapiens
gaagcauugauccacaggcgug

SEQ ID NO: 369282 - RNA, 22 nt, Homo sapiens
gaaugucuuauugcucguugua

SEQ ID NO: 369283 - RNA, 22 nt, Homo sapiens
gagaugguacacauacgauucu

SEQ ID NO: 369284 - RNA, 22 nt, Homo sapiens
gagaugugguucaaggguguuu

SEQ ID NO: 369285 - RNA, 22 nt, Homo sapiens
gagcuuguagugugaaugguau

SEQ ID NO: 369286 - RNA, 22 nt, Homo sapiens
gagcuuguggucuucguguuau

SEQ ID NO: 369287 - RNA, 22 nt, Homo sapiens
gaggcagucuguccauucucag

SEQ ID NO: 369288 - RNA, 22 nt, Homo sapiens
gaggugguagguucacagcagc

SEQ ID NO: 369289 - RNA, 22 nt, Homo sapiens
gagguggugguggaggcauagc

SEQ ID NO: 369290 - RNA, 22 nt, Homo sapiens
gagugcuguuagcccuggguuu

SEQ ID NO: 369291 - RNA, 22 nt, Homo sapiens
gauaacagauaaugucaguuau

SEQ ID NO: 369292 - RNA, 20 nt, Homo sapiens
gcaaauggaucccacaagcc

SEQ ID NO: 369293 - RNA, 22 nt, Homo sapiens
gcagcaucaaaucacacaagau

SEQ ID NO: 369294 - RNA, 22 nt, Homo sapiens
gcaguauuguugaaauguccau

SEQ ID NO: 369295 - RNA, 22 nt, Homo sapiens
gcagucacagggagauggugac

SEQ ID NO: 369296 - RNA, 22 nt, Homo sapiens
gcagugcuggagcccccgugug

SEQ ID NO: 369297 - RNA, 22 nt, Homo sapiens
gcuguguguuaucagaaauugc

SEQ ID NO: 369298 - RNA, 19 nt, Homo sapiens
ggaaaugucuauuaagauc

SEQ ID NO: 369299 - RNA, 22 nt, Homo sapiens
ggaaguuaauacagauagagua

SEQ ID NO: 369300 - RNA, 22 nt, Homo sapiens
ggagucugacuuauaggaaccu

SEQ ID NO: 369301 - RNA, 22 nt, Homo sapiens
ggcaagcucaggccucaggugu

SEQ ID NO: 369302 - RNA, 22 nt, Homo sapiens
ggcaaguucuaaugauuagaau

SEQ ID NO: 369303 - RNA, 22 nt, Homo sapiens
gggaaaaugucuauugaaugaa

SEQ ID NO: 369304 - RNA, 22 nt, Homo sapiens
gggaggucauuguaaggucuua

SEQ ID NO: 369305 - RNA, 22 nt, Homo sapiens
gguauguagcaaaagaggugcu

SEQ ID NO: 369306 - RNA, 22 nt, Homo sapiens
gguggugguauuucagaaaaug

SEQ ID NO: 369307 - RNA, 22 nt, Homo sapiens
guacaguacugaaugaauguau

SEQ ID NO: 369308 - RNA, 22 nt, Homo sapiens
guagaauguauacaguauacag

SEQ ID NO: 369309 - RNA, 22 nt, Homo sapiens
guaucauuggcauguaaccaga

SEQ ID NO: 369310 - RNA, 22 nt, Homo sapiens
gucacugagcaauagaaaguuu

SEQ ID NO: 369311 - RNA, 22 nt, Homo sapiens
gucacugagcagaaggaagcga

SEQ ID NO: 369312 - RNA, 22 nt, Homo sapiens
gucagcuuuuccuuacuuuagg

SEQ ID NO: 369313 - RNA, 22 nt, Homo sapiens
gucauugucaauugacaauugu

SEQ ID NO: 369314 - RNA, 22 nt, Homo sapiens
gucugcaugucauaugauagua

SEQ ID NO: 369315 - RNA, 22 nt, Homo sapiens
gucuuuguuuggucuguaucag

SEQ ID NO: 369316 - RNA, 22 nt, Homo sapiens
gugagguguuaaccaaccugug

SEQ ID NO: 369317 - RNA, 22 nt, Homo sapiens
gugaguggacgugaccaauaaa

SEQ ID NO: 369318 - RNA, 22 nt, Homo sapiens
gugaucaugauccugaagcauu

SEQ ID NO: 369319 - RNA, 21 nt, Homo sapiens
gugaucaugucacugcacucc

SEQ ID NO: 369320 - RNA, 23 nt, Homo sapiens
gugaucauuguuguggguugaau

SEQ ID NO: 369321 - RNA, 22 nt, Homo sapiens
gugccacaguguuaagggauuc

SEQ ID NO: 369322 - RNA, 22 nt, Homo sapiens
guggaaaaguaguugcgguuuu

SEQ ID NO: 369323 - RNA, 22 nt, Homo sapiens
guggcaugaaagcagauaccac

SEQ ID NO: 369324 - RNA, 22 nt, Homo sapiens
guggcaugaaagcaucugugau

SEQ ID NO: 369325 - RNA, 22 nt, Homo sapiens
gugggcaaagcuaguguguaga

SEQ ID NO: 369326 - RNA, 20 nt, Homo sapiens
gugggcaaauccuuuccucu

SEQ ID NO: 369327 - RNA, 22 nt, Homo sapiens
gugugauuguuaauuuuaggug

SEQ ID NO: 369328 - RNA, 22 nt, Homo sapiens
gugugcaacuuucauuaauauu

SEQ ID NO: 369329 - RNA, 20 nt, Homo sapiens
gugugcauuucagauuuugg

SEQ ID NO: 369330 - RNA, 22 nt, Homo sapiens
guguuauggagccaaacuacua

SEQ ID NO: 369331 - RNA, 22 nt, Homo sapiens
guucacaguuucuaaucccagc

SEQ ID NO: 369332 - RNA, 22 nt, Homo sapiens
guucaguuugcugaugcguuga

SEQ ID NO: 369333 - RNA, 22 nt, Homo sapiens
guuguggagucuucuguucugg

SEQ ID NO: 369334 - RNA, 22 nt, Homo sapiens
uaaaccuagcauuuugcauaug

SEQ ID NO: 369335 - RNA, 22 nt, Homo sapiens
uaaagagcuuuugaggugucau

SEQ ID NO: 369336 - RNA, 22 nt, Homo sapiens
uaaaguuauugccccucaguua

SEQ ID NO: 369337 - RNA, 16 nt, Homo sapiens
uaacacaguucccacc

SEQ ID NO: 369338 - RNA, 22 nt, Homo sapiens
uaacuaguagauggcugacaua

SEQ ID NO: 369339 - RNA, 22 nt, Homo sapiens
uaagacugccccagacagcaag

SEQ ID NO: 369340 - RNA, 22 nt, Homo sapiens
uaaggcuucuuggaauacugca

SEQ ID NO: 369341 - RNA, 22 nt, Homo sapiens
uaaguacuuuacagacauuauc

SEQ ID NO: 369342 - RNA, 20 nt, Homo sapiens
uaagugcauaggauauuucu

SEQ ID NO: 369343 - RNA, 22 nt, Homo sapiens
uaauacuagugaauagcaggau

SEQ ID NO: 369344 - RNA, 22 nt, Homo sapiens
uaauacuugucauaaaggcauu

SEQ ID NO: 369345 - RNA, 22 nt, Homo sapiens
uaauaguuggcacuggagaaag

SEQ ID NO: 369346 - RNA, 22 nt, Homo sapiens
uaaucucagcugagcugagauu

SEQ ID NO: 369347 - RNA, 22 nt, Homo sapiens
uacaaagcuuugaugugucuuu

SEQ ID NO: 369348 - RNA, 16 nt, Homo sapiens
uacaauguagaaaaca

SEQ ID NO: 369349 - RNA, 22 nt, Homo sapiens
uacagaguagaagauuugcaga

SEQ ID NO: 369350 - RNA, 22 nt, Homo sapiens
uacaucagccugaaagagcucg

SEQ ID NO: 369351 - RNA, 22 nt, Homo sapiens
uacuacuuucucuucugggaaa

SEQ ID NO: 369352 - RNA, 22 nt, Homo sapiens
uagaauguaacaguuaaaagca

SEQ ID NO: 369353 - RNA, 22 nt, Homo sapiens
uagaauguauaauauuuuacuu

SEQ ID NO: 369354 - RNA, 22 nt, Homo sapiens
uagaaugucagcuucuugaggg

SEQ ID NO: 369355 - RNA, 22 nt, Homo sapiens
uagagcuagggacucgcaaugu

SEQ ID NO: 369356 - RNA, 22 nt, Homo sapiens
uagaguacucugguaaguucuu

SEQ ID NO: 369357 - RNA, 22 nt, Homo sapiens
uagugcugagauugagaagccc

SEQ ID NO: 369358 - RNA, 22 nt, Homo sapiens
uauaucacaugcacucauuuuc

SEQ ID NO: 369359 - RNA, 22 nt, Homo sapiens
uaucacagauauuaugggccaa

SEQ ID NO: 369360 - RNA, 21 nt, Homo sapiens
uauccacuugcaacagagaag

SEQ ID NO: 369361 - RNA, 20 nt, Homo sapiens
uaugacacugucauaaaaau

SEQ ID NO: 369362 - RNA, 22 nt, Homo sapiens
uuuaauguuacaguauugguau

SEQ ID NO: 369363 - RNA, 18 nt, Homo sapiens
uuuacaguagaaggacuu

SEQ ID NO: 369364 - RNA, 22 nt, Homo sapiens
uuuacaguuuucuaggcuacca

SEQ ID NO: 369365 - RNA, 21 nt, Homo sapiens
uuuacuguggacccauugcuu

SEQ ID NO: 369366 - RNA, 22 nt, Homo sapiens
uuuagcaauucauuuugugucu

SEQ ID NO: 369367 - RNA, 22 nt, Homo sapiens
uuuagcacugugauugacaaaa

SEQ ID NO: 369368 - RNA, 19 nt, Homo sapiens
uuucacacucgccuacuuc

SEQ ID NO: 369369 - RNA, 22 nt, Homo sapiens
uuucauagaucaugcuuuugga

SEQ ID NO: 369370 - RNA, 22 nt, Homo sapiens
uuucccuuuagcuuagugauuu

SEQ ID NO: 369371 - RNA, 22 nt, Homo sapiens
uuugaguaggcuuauauuuugg

SEQ ID NO: 369372 - RNA, 22 nt, Homo sapiens
uuuggcaguuauuuacucagug

SEQ ID NO: 369373 - RNA, 22 nt, Homo sapiens
uuuggcuguuucuggacuaaga

SEQ ID NO: 369374 - RNA, 22 nt, Homo sapiens
uuuggcuuuuguaauaacugcc

SEQ ID NO: 369375 - RNA, 21 nt, Homo sapiens
uuuuugguggucauggauaga

SEQ ID NO: 369376 - RNA, 22 nt, Homo sapiens
aaguauuaagacuaagaggcuu

SEQ ID NO: 369377 - RNA, 22 nt, Homo sapiens
aaguauuagcuaauugugcuua

SEQ ID NO: 369378 - RNA, 20 nt, Homo sapiens
aagugcaucguugugucugc

SEQ ID NO: 369379 - RNA, 22 nt, Homo sapiens
aagugcuguaugggagccuagg

SEQ ID NO: 369380 - RNA, 22 nt, Homo sapiens
aaguugguguaugagacagaag

SEQ ID NO: 369381 - RNA, 22 nt, Homo sapiens
aaguuguuggaguuccauuguu

SEQ ID NO: 369382 - RNA, 21 nt, Homo sapiens
aauaaagcaaccuuaugccau

SEQ ID NO: 369383 - RNA, 22 nt, Homo sapiens
aaucacaggucuuggcugcaug

SEQ ID NO: 369384 - RNA, 22 nt, Homo sapiens
aaucagagcccucugagcuuca

SEQ ID NO: 369385 - RNA, 22 nt, Homo sapiens
aaugauauguuauguuuagguu

SEQ ID NO: 369386 - RNA, 22 nt, Homo sapiens
aauucacuucuuuuaggcaggg

SEQ ID NO: 369387 - RNA, 22 nt, Homo sapiens
aauucacuuguggcagauccuu

SEQ ID NO: 369388 - RNA, 22 nt, Homo sapiens
aauugaaucaugugggcagacu

SEQ ID NO: 369389 - RNA, 22 nt, Homo sapiens
aauugaaugauaugggacauuu

SEQ ID NO: 369390 - RNA, 22 nt, Homo sapiens
aauugaaugcagaugccaggga

SEQ ID NO: 369391 - RNA, 21 nt, Homo sapiens
acaaagcuggagggagacugc

SEQ ID NO: 369392 - RNA, 20 nt, Homo sapiens
acagcauagccuuuuaaagc

SEQ ID NO: 369393 - RNA, 22 nt, Homo sapiens
acagugcuguuguguuuucacg

SEQ ID NO: 369394 - RNA, 22 nt, Homo sapiens
acagugcuuggcacacaguaau

SEQ ID NO: 369395 - RNA, 22 nt, Homo sapiens
acagugcuuuuguuccucuccu

SEQ ID NO: 369396 - RNA, 19 nt, Homo sapiens
acagugucucuauaaugau

SEQ ID NO: 369397 - RNA, 18 nt, Homo sapiens
acaguguguaaggguucu

SEQ ID NO: 369398 - RNA, 22 nt, Homo sapiens
acaguguguguguucaccuaga

SEQ ID NO: 369399 - RNA, 22 nt, Homo sapiens
acugcacuccagccugugagac

SEQ ID NO: 369400 - RNA, 22 nt, Homo sapiens
acugcacuccagcuuuggugac

SEQ ID NO: 369401 - RNA, 22 nt, Homo sapiens
acugcacuccuccuugggugac

SEQ ID NO: 369402 - RNA, 20 nt, Homo sapiens
acugcauuuaguccucagga

SEQ ID NO: 369403 - RNA, 22 nt, Homo sapiens
acuucauucucuggaucagaau

SEQ ID NO: 369404 - RNA, 22 nt, Homo sapiens
agaauguaaacagaauagagga

SEQ ID NO: 369405 - RNA, 22 nt, Homo sapiens
agaugcuguuaucaacuguagc

SEQ ID NO: 369406 - RNA, 22 nt, Homo sapiens
agauucauccaaguuguugcau

SEQ ID NO: 369407 - RNA, 22 nt, Homo sapiens
agcaccaauaaucagaguucuu

SEQ ID NO: 369408 - RNA, 22 nt, Homo sapiens
agcagcauggguauaaaucucc

SEQ ID NO: 369409 - RNA, 23 nt, Homo sapiens
agccuguugccuaggcagcucau

SEQ ID NO: 369410 - RNA, 22 nt, Homo sapiens
agcugaguguuccaagagcgag

SEQ ID NO: 369411 - RNA, 22 nt, Homo sapiens
agcuguuuuugugggcauguga

SEQ ID NO: 369412 - RNA, 22 nt, Homo sapiens
agcuuguauuuguagccuguug

SEQ ID NO: 369413 - RNA, 22 nt, Homo sapiens
aaaagucuguagugaaagguga

SEQ ID NO: 369414 - RNA, 18 nt, Homo sapiens
aaacugcuuccuuggccu

SEQ ID NO: 369415 - RNA, 22 nt, Homo sapiens
aaacuugucuaauuauaagcau

SEQ ID NO: 369416 - RNA, 22 nt, Homo sapiens
aaagcagcaggugguuuucaau

SEQ ID NO: 369417 - RNA, 22 nt, Homo sapiens
aaagugcuaggauuaccugggg

SEQ ID NO: 369418 - RNA, 22 nt, Homo sapiens
aaaugcacgcuacccagcuaga

SEQ ID NO: 369419 - RNA, 22 nt, Homo sapiens
aacagugcuguuauaaauguac

SEQ ID NO: 369420 - RNA, 20 nt, Homo sapiens
aacaguguguaaguuuccuu

SEQ ID NO: 369421 - RNA, 22 nt, Homo sapiens
aagagcucucuguagcauguga

SEQ ID NO: 369422 - RNA, 22 nt, Homo sapiens
aagagguuuaacugacucacag

SEQ ID NO: 369423 - RNA, 20 nt, Homo sapiens
aagcauggguuuuaggguca

SEQ ID NO: 369424 - RNA, 22 nt, Homo sapiens
aagcugcauuuucuagaugcuu

SEQ ID NO: 369425 - RNA, 22 nt, Homo sapiens
uuucacuagccagcccuuuauu

SEQ ID NO: 369426 - RNA, 22 nt, Homo sapiens
uuucaucaagcacagaguagau

SEQ ID NO: 369427 - RNA, 22 nt, Homo sapiens
uuucugaggccucaccagaagc

SEQ ID NO: 369428 - RNA, 22 nt, Homo sapiens
uuuggcaauaaacuccccuaac

SEQ ID NO: 369429 - RNA, 18 nt, Homo sapiens
uuuggcuguucaugacuc

SEQ ID NO: 369430 - RNA, 22 nt, Homo sapiens
uuuggcuuuugugauacguaau

SEQ ID NO: 369431 - RNA, 22 nt, Homo sapiens
uuuguggaaugcccuuauuuau

SEQ ID NO: 369432 - RNA, 22 nt, Homo sapiens
uuuugcaccauccuaauaguau

SEQ ID NO: 369433 - RNA, 22 nt, Homo sapiens
uuuuugguugguaggcuauuaa

SEQ ID NO: 369434 - RNA, 22 nt, Homo sapiens
aguguuuuuacaagcacucugg

SEQ ID NO: 369435 - RNA, 22 nt, Homo sapiens
aguguuuuucaugggauacuuu

SEQ ID NO: 369436 - RNA, 22 nt, Homo sapiens
auaaaagcaggucuaggucagg

SEQ ID NO: 369437 - RNA, 22 nt, Homo sapiens
auaaacagcuuauccucuauuc

SEQ ID NO: 369438 - RNA, 22 nt, Homo sapiens
auaagucaauggaacagauuaa

SEQ ID NO: 369439 - RNA, 22 nt, Homo sapiens
auacaguaucuucuggcaagca

SEQ ID NO: 369440 - RNA, 20 nt, Homo sapiens
auaugguugugagugauuuu

SEQ ID NO: 369441 - RNA, 19 nt, Homo sapiens
aucaaacugcucuuugagg

SEQ ID NO: 369442 - RNA, 22 nt, Homo sapiens
aucagaaucucuugagaguguu

SEQ ID NO: 369443 - RNA, 22 nt, Homo sapiens
aucagugauugauuuaaagacg

SEQ ID NO: 369444 - RNA, 21 nt, Homo sapiens
auccuucuuuuucaaccugug

SEQ ID NO: 369445 - RNA, 22 nt, Homo sapiens
aucgcgccauuguacuccagcc

SEQ ID NO: 369446 - RNA, 22 nt, Homo sapiens
aucugcaaauaaugaagauugg

SEQ ID NO: 369447 - RNA, 22 nt, Homo sapiens
augaacacuccaauuguacucc

SEQ ID NO: 369448 - RNA, 22 nt, Homo sapiens
augacugagacuaacuuacuuu

SEQ ID NO: 369449 - RNA, 22 nt, Homo sapiens
augagacuagaagagaauaaua

SEQ ID NO: 369450 - RNA, 22 nt, Homo sapiens
augagauaggaacaaacuuaca

SEQ ID NO: 369451 - RNA, 22 nt, Homo sapiens
augaucauggaagugcacccau

SEQ ID NO: 369452 - RNA, 22 nt, Homo sapiens
augcaaaucuuaaguaugugug

SEQ ID NO: 369453 - RNA, 22 nt, Homo sapiens
augcagaucacauuuuucuguc

SEQ ID NO: 369454 - RNA, 22 nt, Homo sapiens
augcagguguuuugcacugagu

SEQ ID NO: 369455 - RNA, 22 nt, Homo sapiens
auggcacugauggaaguaccuu

SEQ ID NO: 369456 - RNA, 22 nt, Homo sapiens
auguccaugagcacauguauca

SEQ ID NO: 369457 - RNA, 22 nt, Homo sapiens
augugaacaucauagaaugcac

SEQ ID NO: 369458 - RNA, 22 nt, Homo sapiens
augugcuuaaaaaugcagagaa

SEQ ID NO: 369459 - RNA, 22 nt, Homo sapiens
auuaauguaauuaguaaaguug

SEQ ID NO: 369460 - RNA, 22 nt, Homo sapiens
auuauaguguauacuugaaauu

SEQ ID NO: 369461 - RNA, 22 nt, Homo sapiens
auucccuuagcugccucagccu

SEQ ID NO: 369462 - RNA, 22 nt, Homo sapiens
auugaacaugccauauguacca

SEQ ID NO: 369463 - RNA, 22 nt, Homo sapiens
auugaguaacaauuuuguucaa

SEQ ID NO: 369464 - RNA, 22 nt, Homo sapiens
auugcacuccagccccggggac

SEQ ID NO: 369465 - RNA, 22 nt, Homo sapiens
auugcacuccagcccgggugac

SEQ ID NO: 369466 - RNA, 22 nt, Homo sapiens
auugcacuccagccuggccaac

SEQ ID NO: 369467 - RNA, 22 nt, Homo sapiens
auugcacuccagccugggugag

SEQ ID NO: 369468 - RNA, 22 nt, Homo sapiens
auugcacucuagccugggugac

SEQ ID NO: 369469 - RNA, 22 nt, Homo sapiens
auugcaguuagaacagaagucu

SEQ ID NO: 369470 - RNA, 22 nt, Homo sapiens
auuguaauuuuagagaaagugg

SEQ ID NO: 369471 - RNA, 22 nt, Homo sapiens
auuugguaauauuuaaggacuu

SEQ ID NO: 369472 - RNA, 22 nt, Homo sapiens
auuugguuauggucauggacac

SEQ ID NO: 369473 - RNA, 22 nt, Homo sapiens
caaaggcuucugaaacugcaga

SEQ ID NO: 369474 - RNA, 22 nt, Homo sapiens
cacagugaacaauauccucugu

SEQ ID NO: 369475 - RNA, 22 nt, Homo sapiens
cacugggugagauccauguuua

SEQ ID NO: 369476 - RNA, 22 nt, Homo sapiens
caggcauuguauuguaaucccc

SEQ ID NO: 369477 - RNA, 19 nt, Homo sapiens
cagguagugugcugacaug

SEQ ID NO: 369478 - RNA, 22 nt, Homo sapiens
caguaguagccccuuagaugga

SEQ ID NO: 369479 - RNA, 19 nt, Homo sapiens
caucacagagucuuccauu

SEQ ID NO: 369480 - RNA, 22 nt, Homo sapiens
caugacacauguuuaccuaugu

SEQ ID NO: 369481 - RNA, 22 nt, Homo sapiens
ccaaaucucauguugaaaugug

SEQ ID NO: 369482 - RNA, 22 nt, Homo sapiens
ccaagugcuuaaaauuucauuu

SEQ ID NO: 369483 - RNA, 23 nt, Homo sapiens
ccacaaugguugaacuagauuac

SEQ ID NO: 369484 - RNA, 22 nt, Homo sapiens
ccagaguugccucagguuucug

SEQ ID NO: 369485 - RNA, 22 nt, Homo sapiens
ccagccgggugcaguggcucac

SEQ ID NO: 369486 - RNA, 23 nt, Homo sapiens
cccucagaagugcagggagagaa

SEQ ID NO: 369487 - RNA, 22 nt, Homo sapiens
cccugagcagccugaguuuccc

SEQ ID NO: 369488 - RNA, 22 nt, Homo sapiens
ccuucauugcaucuuuaagaga

SEQ ID NO: 369489 - RNA, 22 nt, Homo sapiens
cuaaagauagugacaugauuug

SEQ ID NO: 369490 - RNA, 22 nt, Homo sapiens
cuaaaguagccaggacugcagg

SEQ ID NO: 369491 - RNA, 18 nt, Homo sapiens
cuaauacuauucaacaag

SEQ ID NO: 369492 - RNA, 22 nt, Homo sapiens
cuacaguagagaggauguagaa

SEQ ID NO: 369493 - RNA, 22 nt, Homo sapiens
cuacaguaugaaaccuuuacuc

SEQ ID NO: 369494 - RNA, 18 nt, Homo sapiens
cuaugccacuuuauauca

SEQ ID NO: 369495 - RNA, 22 nt, Homo sapiens
cucagugguugauuuauuuauc

SEQ ID NO: 369496 - RNA, 22 nt, Homo sapiens
cugagcaaaaugaagacacgau

SEQ ID NO: 369497 - RNA, 22 nt, Homo sapiens
cuggauguaaaugaaacuacag

SEQ ID NO: 369498 - RNA, 22 nt, Homo sapiens
cugggcaaugcggcuggauaga

SEQ ID NO: 369499 - RNA, 22 nt, Homo sapiens
cuucaaaguuggcuaggagaca

SEQ ID NO: 369500 - RNA, 23 nt, Homo sapiens
cuugagacaaaugcgugugugca

SEQ ID NO: 369501 - RNA, 22 nt, Homo sapiens
cuuuugugauucuucaguuacu

SEQ ID NO: 369502 - RNA, 22 nt, Homo sapiens
cuuuugugauucuucaguugcu

SEQ ID NO: 369503 - RNA, 22 nt, Homo sapiens
gacacagugaagucucuacuug

SEQ ID NO: 369504 - RNA, 22 nt, Homo sapiens
gagacugagucuugcucugucg

SEQ ID NO: 369505 - RNA, 22 nt, Homo sapiens
gagcaucauucaacaaaagucu

SEQ ID NO: 369506 - RNA, 22 nt, Homo sapiens
gagcugaaguuuccauuuguac

SEQ ID NO: 369507 - RNA, 22 nt, Homo sapiens
gaggacauuaugcuaaguggaa

SEQ ID NO: 369508 - RNA, 22 nt, Homo sapiens
gaugccuauugcuaguccuaaa

SEQ ID NO: 369509 - RNA, 22 nt, Homo sapiens
gcaaaugcuaugccauuuuaua

SEQ ID NO: 369510 - RNA, 22 nt, Homo sapiens
gcacauauguaaauagcugccu

SEQ ID NO: 369511 - RNA, 22 nt, Homo sapiens
gcaucacagggagacaggccuc

SEQ ID NO: 369512 - RNA, 22 nt, Homo sapiens
gccaagaucugaauaauuaaga

SEQ ID NO: 369513 - RNA, 22 nt, Homo sapiens
gccaagauugguuuaauauucc

SEQ ID NO: 369514 - RNA, 22 nt, Homo sapiens
gccaguguguguuguucuccgc

SEQ ID NO: 369515 - RNA, 22 nt, Homo sapiens
gccaguguuuuauugagaauuu

SEQ ID NO: 369516 - RNA, 22 nt, Homo sapiens
gcuccauuuuccauuucucuaa

SEQ ID NO: 369517 - RNA, 17 nt, Homo sapiens
gcugcauucauguagaa

SEQ ID NO: 369518 - RNA, 22 nt, Homo sapiens
ggaauuaaggcaauugaaagcu

SEQ ID NO: 369519 - RNA, 22 nt, Homo sapiens
ggaguguuccauuugucacauu

SEQ ID NO: 369520 - RNA, 22 nt, Homo sapiens
ggaguucaucaggugaggggua

SEQ ID NO: 369521 - RNA, 22 nt, Homo sapiens
gggaugaagcccuaggguuggu

SEQ ID NO: 369522 - RNA, 22 nt, Homo sapiens
gggcaacauugaguacccugaa

SEQ ID NO: 369523 - RNA, 22 nt, Homo sapiens
guaacccuguaggccuaaagua

SEQ ID NO: 369524 - RNA, 22 nt, Homo sapiens
guacaguaguaaaagugaauga

SEQ ID NO: 369525 - RNA, 22 nt, Homo sapiens
auuagugaaugugaugucuuga

SEQ ID NO: 369526 - RNA, 22 nt, Homo sapiens
auucacagggggagaaggguau

SEQ ID NO: 369527 - RNA, 22 nt, Homo sapiens
auucaugggagcuacuuuaaaa

SEQ ID NO: 369528 - RNA, 22 nt, Homo sapiens
auugcacuccagccugggugac

SEQ ID NO: 369529 - RNA, 22 nt, Homo sapiens
auuuggcaauuuugaagaugcc

SEQ ID NO: 369530 - RNA, 22 nt, Homo sapiens
auuugucaauacacuucuucca

SEQ ID NO: 369531 - RNA, 22 nt, Homo sapiens
caaaguaauugugguuuugcca

SEQ ID NO: 369532 - RNA, 22 nt, Homo sapiens
caaagucuauucuacccuuacc

SEQ ID NO: 369533 - RNA, 22 nt, Homo sapiens
caaagucuucucauuaugucuu

SEQ ID NO: 369534 - RNA, 22 nt, Homo sapiens
caacacagugaaacccgucucu

SEQ ID NO: 369535 - RNA, 22 nt, Homo sapiens
caagugcucuaggauccugagu

SEQ ID NO: 369536 - RNA, 22 nt, Homo sapiens
caauugguguuuauggggaagu

SEQ ID NO: 369537 - RNA, 23 nt, Homo sapiens
caccaguauaauuagcuuuuaaa

SEQ ID NO: 369538 - RNA, 20 nt, Homo sapiens
cagagcaaagcaguccuggc

SEQ ID NO: 369539 - RNA, 22 nt, Homo sapiens
cagcuugugguauugcugguug

SEQ ID NO: 369540 - RNA, 20 nt, Homo sapiens
cauugcacuccagcuugggc

SEQ ID NO: 369541 - RNA, 22 nt, Homo sapiens
ccugcauugucaaggccaagcc

SEQ ID NO: 369542 - RNA, 22 nt, Homo sapiens
ccuucuuuuguaaggcugaaua

SEQ ID NO: 369543 - RNA, 22 nt, Homo sapiens
ccuuuuugaguugccagaguuc

SEQ ID NO: 369544 - RNA, 22 nt, Homo sapiens
cuaagugaguauaauuuuaaga

SEQ ID NO: 369545 - RNA, 22 nt, Homo sapiens
cuauggauuuacuguauagggu

SEQ ID NO: 369546 - RNA, 22 nt, Homo sapiens
cucaaagucaagggaaagcagg

SEQ ID NO: 369547 - RNA, 20 nt, Homo sapiens
cucacagacagcuucuuucu

SEQ ID NO: 369548 - RNA, 22 nt, Homo sapiens
cugacagaugacugccacugua

SEQ ID NO: 369549 - RNA, 22 nt, Homo sapiens
cugacucagacacauguauaug

SEQ ID NO: 369550 - RNA, 22 nt, Homo sapiens
cuggaaagaaacccuuaauucu

SEQ ID NO: 369551 - RNA, 22 nt, Homo sapiens
cuggaaagcaaagggugcauug

SEQ ID NO: 369552 - RNA, 22 nt, Homo sapiens
cuggaaagcaaguccauugcuc

SEQ ID NO: 369553 - RNA, 22 nt, Homo sapiens
cuggagauauuggaagaaagaa

SEQ ID NO: 369554 - RNA, 22 nt, Homo sapiens
cuuccauaguauuuuuacaaaa

SEQ ID NO: 369555 - RNA, 22 nt, Homo sapiens
cuugaauguaaauaauguacag

SEQ ID NO: 369556 - RNA, 22 nt, Homo sapiens
cuuucacacuguuggugggaau

SEQ ID NO: 369557 - RNA, 22 nt, Homo sapiens
cuuuccauuguuggagcauaaa

SEQ ID NO: 369558 - RNA, 22 nt, Homo sapiens
uagcuggaguuuuuguuauagg

SEQ ID NO: 369559 - RNA, 22 nt, Homo sapiens
uaguccauuuucaugcugcuau

SEQ ID NO: 369560 - RNA, 21 nt, Homo sapiens
uagugcugaggcaguauggga

SEQ ID NO: 369561 - RNA, 22 nt, Homo sapiens
uagugcugugauaaacauauau

SEQ ID NO: 369562 - RNA, 22 nt, Homo sapiens
uagugcugugauuaacauaaug

SEQ ID NO: 369563 - RNA, 22 nt, Homo sapiens
uaguucauuuuucuugcuuaga

SEQ ID NO: 369564 - RNA, 22 nt, Homo sapiens
uauaacacccacauauagucuu

SEQ ID NO: 369565 - RNA, 22 nt, Homo sapiens
uauacaugugccauguuggugu

SEQ ID NO: 369566 - RNA, 22 nt, Homo sapiens
uauacaugugggcaucaggaga

SEQ ID NO: 369567 - RNA, 22 nt, Homo sapiens
uauagcauuuugauccuguaga

SEQ ID NO: 369568 - RNA, 22 nt, Homo sapiens
uaucguaguguuggaaaacaag

SEQ ID NO: 369569 - RNA, 22 nt, Homo sapiens
uaucucagaguguacaagauua

SEQ ID NO: 369570 - RNA, 22 nt, Homo sapiens
uaucugcacauacacuuauagc

SEQ ID NO: 369571 - RNA, 22 nt, Homo sapiens
uaugacuuuggaaaaauuacuu

SEQ ID NO: 369572 - RNA, 22 nt, Homo sapiens
uaugacuuuugaauacagaugg

SEQ ID NO: 369573 - RNA, 22 nt, Homo sapiens
uaugagcacauauguaucuaug

SEQ ID NO: 369574 - RNA, 22 nt, Homo sapiens
uaugaucauuauguuauugcag

SEQ ID NO: 369575 - RNA, 17 nt, Homo sapiens
uauguaguacuuauaaa

SEQ ID NO: 369576 - RNA, 22 nt, Homo sapiens
uauuacuugucugugucucaau

SEQ ID NO: 369577 - RNA, 22 nt, Homo sapiens
uauugauuaauugugauuaggc

SEQ ID NO: 369578 - RNA, 22 nt, Homo sapiens
ucaaacacuccauaucgcgauu

SEQ ID NO: 369579 - RNA, 22 nt, Homo sapiens
ucaacagugggcacuguaaaug

SEQ ID NO: 369580 - RNA, 22 nt, Homo sapiens
ucacaauucucaauuugugaaa

SEQ ID NO: 369581 - RNA, 22 nt, Homo sapiens
ucacagauaaauaaagaugauu

SEQ ID NO: 369582 - RNA, 19 nt, Homo sapiens
ucaccaguacacaauacaa

SEQ ID NO: 369583 - RNA, 22 nt, Homo sapiens
ucacuaaagaaaauggcaugga

SEQ ID NO: 369584 - RNA, 20 nt, Homo sapiens
ucacuggguucuugaagucu

SEQ ID NO: 369585 - RNA, 20 nt, Homo sapiens
ucacugugaacuucuugagg

SEQ ID NO: 369586 - RNA, 22 nt, Homo sapiens
ucagaacugaacaaaccagucu

SEQ ID NO: 369587 - RNA, 22 nt, Homo sapiens
ucagaucacuggcgcuggcgga

SEQ ID NO: 369588 - RNA, 22 nt, Homo sapiens
ucagcaaugaccuaagcaaaua

SEQ ID NO: 369589 - RNA, 19 nt, Homo sapiens
ucaguagugcacauaagcc

SEQ ID NO: 369590 - RNA, 19 nt, Homo sapiens
ucagugcuauguaauguag

SEQ ID NO: 369591 - RNA, 22 nt, Homo sapiens
ucagugcuguaccaucuaagga

SEQ ID NO: 369592 - RNA, 22 nt, Homo sapiens
ucaguguugauggcugcugacu

SEQ ID NO: 369593 - RNA, 22 nt, Homo sapiens
ucaucaggaaacuuaugcagug

SEQ ID NO: 369594 - RNA, 22 nt, Homo sapiens
ucaucaggcucauucaagcuga

SEQ ID NO: 369595 - RNA, 22 nt, Homo sapiens
ucauuguccaacuucuuucagu

SEQ ID NO: 369596 - RNA, 22 nt, Homo sapiens
uccaguguuucuuccacuauuu

SEQ ID NO: 369597 - RNA, 22 nt, Homo sapiens
uccuuuggucaguauucuuuug

SEQ ID NO: 369598 - RNA, 22 nt, Homo sapiens
ucuaagacuaagggcuagcuuc

SEQ ID NO: 369599 - RNA, 21 nt, Homo sapiens
ucuaccuacugcucacaggcu

SEQ ID NO: 369600 - RNA, 22 nt, Homo sapiens
ucuaucacagugauguuccaga

SEQ ID NO: 369601 - RNA, 22 nt, Homo sapiens
ucucagugaauguggaaaaagc

SEQ ID NO: 369602 - RNA, 22 nt, Homo sapiens
ucucugagaccacuccaaacuc

SEQ ID NO: 369603 - RNA, 23 nt, Homo sapiens
ucugauguuauaaaauucuuugg

SEQ ID NO: 369604 - RNA, 22 nt, Homo sapiens
ucuugcaguucccaaauucaca

SEQ ID NO: 369605 - RNA, 22 nt, Homo sapiens
ucuuuguugcauaggcuuguuc

SEQ ID NO: 369606 - RNA, 22 nt, Homo sapiens
ucuuuguuuucugauccugaag

SEQ ID NO: 369607 - RNA, 22 nt, Homo sapiens
ugaaguaauguuuuauucuauu

SEQ ID NO: 369608 - RNA, 22 nt, Homo sapiens
ugacaugauuguauauuuagaa

SEQ ID NO: 369609 - RNA, 22 nt, Homo sapiens
ugagaacaugugauauuuggug

SEQ ID NO: 369610 - RNA, 22 nt, Homo sapiens
ugagaaugacugggcaugcugc

SEQ ID NO: 369611 - RNA, 22 nt, Homo sapiens
ugagagaugaacucugauaugu

SEQ ID NO: 369612 - RNA, 22 nt, Homo sapiens
ugagaucacgccacugcacucc

SEQ ID NO: 369613 - RNA, 22 nt, Homo sapiens
ugagaucaugccacugcacuuc

SEQ ID NO: 369614 - RNA, 22 nt, Homo sapiens
ugagccaugguuagcuucucau

SEQ ID NO: 369615 - RNA, 22 nt, Homo sapiens
ugaggugagggguuaggugcua

SEQ ID NO: 369616 - RNA, 22 nt, Homo sapiens
ugaguguguaugugcauacaca

SEQ ID NO: 369617 - RNA, 22 nt, Homo sapiens
ugaguucaugcuuguaguucua

SEQ ID NO: 369618 - RNA, 22 nt, Homo sapiens
ugaguucauggucauuugucac

SEQ ID NO: 369619 - RNA, 20 nt, Homo sapiens
ugauauuucuggaaguggag

SEQ ID NO: 369620 - RNA, 22 nt, Homo sapiens
ugaucuguguauauugaaccag

SEQ ID NO: 369621 - RNA, 22 nt, Homo sapiens
ugcaaaugucaaggguuagugu

SEQ ID NO: 369622 - RNA, 22 nt, Homo sapiens
ugccagaugcaguguucaacaa

SEQ ID NO: 369623 - RNA, 22 nt, Homo sapiens
ugccuucuguuaaacgaggaug

SEQ ID NO: 369624 - RNA, 22 nt, Homo sapiens
uggaauguuuaucaaaacagua

SEQ ID NO: 369625 - RNA, 22 nt, Homo sapiens
uggagugucaguuuccagaguu

SEQ ID NO: 369626 - RNA, 22 nt, Homo sapiens
uggcagaugagccgcgcuccaa

SEQ ID NO: 369627 - RNA, 22 nt, Homo sapiens
uggcagaugcucuuggugccca

SEQ ID NO: 369628 - RNA, 22 nt, Homo sapiens
uggcagaugggugagcuggaga

SEQ ID NO: 369629 - RNA, 22 nt, Homo sapiens
uggcagauggugacaccauuag

SEQ ID NO: 369630 - RNA, 23 nt, Homo sapiens
uggcauuuuuggcaaugccuucu

SEQ ID NO: 369631 - RNA, 22 nt, Homo sapiens
uggcucauuucuaaacccagcu

SEQ ID NO: 369632 - RNA, 20 nt, Homo sapiens
ugggaaauguccaggacaua

SEQ ID NO: 369633 - RNA, 20 nt, Homo sapiens
ugucaagaaacauuacuuau

SEQ ID NO: 369634 - RNA, 22 nt, Homo sapiens
ugucaguguaugagccccggau

SEQ ID NO: 369635 - RNA, 22 nt, Homo sapiens
uguccaaauugaaucaucuggu

SEQ ID NO: 369636 - RNA, 22 nt, Homo sapiens
uguccauuuuuaugcuuauggu

SEQ ID NO: 369637 - RNA, 22 nt, Homo sapiens
ugucuagaucugaauguaauug

SEQ ID NO: 369638 - RNA, 22 nt, Homo sapiens
ugugacaguguuacauuucaug

SEQ ID NO: 369639 - RNA, 22 nt, Homo sapiens
uguguaauaccuuugacuauau

SEQ ID NO: 369640 - RNA, 22 nt, Homo sapiens
uguuuuggagguccucacuaga

SEQ ID NO: 369641 - RNA, 22 nt, Homo sapiens
uuaaacugcuugaauuggguuu

SEQ ID NO: 369642 - RNA, 22 nt, Homo sapiens
uuaaagcuggcguuacaguuug

SEQ ID NO: 369643 - RNA, 22 nt, Homo sapiens
uuaagaagugauuuuccucauu

SEQ ID NO: 369644 - RNA, 22 nt, Homo sapiens
uuaauacucuucuaaguagucc

SEQ ID NO: 369645 - RNA, 22 nt, Homo sapiens
uuaaucacagcugaacucaaac

SEQ ID NO: 369646 - RNA, 22 nt, Homo sapiens
uuaaucacagugucuuccuuca

SEQ ID NO: 369647 - RNA, 22 nt, Homo sapiens
uuaauguaucuaucacaucaca

SEQ ID NO: 369648 - RNA, 22 nt, Homo sapiens
uuacagauggauggcagcuggc

SEQ ID NO: 369649 - RNA, 23 nt, Homo sapiens
uugggcaaaucacuaacgucucc

SEQ ID NO: 369650 - RNA, 22 nt, Homo sapiens
uugggcaaguggcaugaccaug

SEQ ID NO: 369651 - RNA, 22 nt, Homo sapiens
uuguacaggaguguaagcuuca

SEQ ID NO: 369652 - RNA, 22 nt, Homo sapiens
uugugcuuuugagcugagauga

SEQ ID NO: 369653 - RNA, 22 nt, Homo sapiens
uugugucaaauggcaauuagca

SEQ ID NO: 369654 - RNA, 22 nt, Homo sapiens
uuuaggcaauauauucaugucu

SEQ ID NO: 369655 - RNA, 22 nt, Homo sapiens
uauuugcacucccaucauggug

SEQ ID NO: 369656 - RNA, 22 nt, Homo sapiens
ucaaaguaaagccucaggaugg

SEQ ID NO: 369657 - RNA, 22 nt, Homo sapiens
ucaaagucuucucaaguaacau

SEQ ID NO: 369658 - RNA, 22 nt, Homo sapiens
ucaaaugcuguauuguaguaau

SEQ ID NO: 369659 - RNA, 22 nt, Homo sapiens
ucacaaagcuuggccugcuucu

SEQ ID NO: 369660 - RNA, 22 nt, Homo sapiens
ucacagacugagccaaauagag

SEQ ID NO: 369661 - RNA, 22 nt, Homo sapiens
ucaccaguaauaaagagccugc

SEQ ID NO: 369662 - RNA, 22 nt, Homo sapiens
ucacugaaaccacugccuccug

SEQ ID NO: 369663 - RNA, 22 nt, Homo sapiens
ucacugagaaugauguuucuga

SEQ ID NO: 369664 - RNA, 22 nt, Homo sapiens
ucagaucauuaagguagguuua

SEQ ID NO: 369665 - RNA, 22 nt, Homo sapiens
ucagauguuucuuuaacgcaug

SEQ ID NO: 369666 - RNA, 22 nt, Homo sapiens
ucagcaaugcugcacucuacug

SEQ ID NO: 369667 - RNA, 22 nt, Homo sapiens
ucagugcuuggcacagagagcu

SEQ ID NO: 369668 - RNA, 22 nt, Homo sapiens
ucagugucaucuggguuguuug

SEQ ID NO: 369669 - RNA, 22 nt, Homo sapiens
ucagugucugcauucuuauugu

SEQ ID NO: 369670 - RNA, 22 nt, Homo sapiens
ucaguguuuggaaucucaauuu

SEQ ID NO: 369671 - RNA, 22 nt, Homo sapiens
ucauacaguaguccucacuugu

SEQ ID NO: 369672 - RNA, 22 nt, Homo sapiens
ucccaguggucuugaaacaggg

SEQ ID NO: 369673 - RNA, 22 nt, Homo sapiens
uccccugauaccaaccaccaug

SEQ ID NO: 369674 - RNA, 23 nt, Homo sapiens
ucucauuccuugaaaauaaugac

SEQ ID NO: 369675 - RNA, 22 nt, Homo sapiens
ucucuguuugucuguuacuggu

SEQ ID NO: 369676 - RNA, 22 nt, Homo sapiens
ucuuaggugggccaucacccca

SEQ ID NO: 369677 - RNA, 22 nt, Homo sapiens
ucuugcuuguuguucccuucau

SEQ ID NO: 369678 - RNA, 22 nt, Homo sapiens
ugaagugaaugguaaguaugcc

SEQ ID NO: 369679 - RNA, 22 nt, Homo sapiens
ugacagcaucaggauuggagag

SEQ ID NO: 369680 - RNA, 22 nt, Homo sapiens
ugacuugaacuucuaugucacc

SEQ ID NO: 369681 - RNA, 17 nt, Homo sapiens
ugagaacaugugguauu

SEQ ID NO: 369682 - RNA, 19 nt, Homo sapiens
ugagaacaugugguauuug

SEQ ID NO: 369683 - RNA, 22 nt, Homo sapiens
ugagaacugccuguauuuaucu

SEQ ID NO: 369684 - RNA, 22 nt, Homo sapiens
ugagauggcugaauucagaaua

SEQ ID NO: 369685 - RNA, 18 nt, Homo sapiens
ugaguucauuagacuucc

SEQ ID NO: 369686 - RNA, 20 nt, Homo sapiens
ugaguuccuuguucagaagc

SEQ ID NO: 369687 - RNA, 22 nt, Homo sapiens
ugauggcauuuggaguugggac

SEQ ID NO: 369688 - RNA, 22 nt, Homo sapiens
ugcaaaugcugcuauuucucuu

SEQ ID NO: 369689 - RNA, 22 nt, Homo sapiens
ugcaaauguuaggugucauuau

SEQ ID NO: 369690 - RNA, 22 nt, Homo sapiens
ugcaaauguuaguaacaccacu

SEQ ID NO: 369691 - RNA, 22 nt, Homo sapiens
ugcaaauguuauuuugguuucu

SEQ ID NO: 369692 - RNA, 22 nt, Homo sapiens
ugcagguacuugacaacuuggg

SEQ ID NO: 369693 - RNA, 22 nt, Homo sapiens
ugcuggugauuaaauccugaag

SEQ ID NO: 369694 - RNA, 22 nt, Homo sapiens
uggaaaacaugcacauuggauu

SEQ ID NO: 369695 - RNA, 22 nt, Homo sapiens
uggaaugugaauaacuuccuuc

SEQ ID NO: 369696 - RNA, 21 nt, Homo sapiens
uggcaacauggauggauucug

SEQ ID NO: 369697 - RNA, 22 nt, Homo sapiens
uggcagauaggauacaggacua

SEQ ID NO: 369698 - RNA, 22 nt, Homo sapiens
uggcauuuucucuguucuuaga

SEQ ID NO: 369699 - RNA, 20 nt, Homo sapiens
ugggaacaugugguauaugg

SEQ ID NO: 369700 - RNA, 22 nt, Homo sapiens
uggugagaaaugagaugcuuuu

SEQ ID NO: 369701 - RNA, 22 nt, Homo sapiens
uguaaaucuuucacaguugaug

SEQ ID NO: 369702 - RNA, 21 nt, Homo sapiens
uguagcagcauaauuuauaau

SEQ ID NO: 369703 - RNA, 21 nt, Homo sapiens
uguagcagcaugauuuauaau

SEQ ID NO: 369704 - RNA, 22 nt, Homo sapiens
uguauuuguuguuaaauggaga

SEQ ID NO: 369705 - RNA, 22 nt, Homo sapiens
ugucaagaugguuugauguugu

SEQ ID NO: 369706 - RNA, 22 nt, Homo sapiens
ugucuguuugcgaaauugcuuc

SEQ ID NO: 369707 - RNA, 22 nt, Homo sapiens
ugugacucuggcacauggugag

SEQ ID NO: 369708 - RNA, 22 nt, Homo sapiens
ugugcaaaaguaauugcgguuu

SEQ ID NO: 369709 - RNA, 22 nt, Homo sapiens
uguggcugguggcaccuuuucc

SEQ ID NO: 369710 - RNA, 22 nt, Homo sapiens
ugugguuuuuuucuccaauagg

SEQ ID NO: 369711 - RNA, 22 nt, Homo sapiens
uguuucuacugucucuguagua

SEQ ID NO: 369712 - RNA, 21 nt, Homo sapiens
uguuuuugcuguguaucucuc

SEQ ID NO: 369713 - RNA, 22 nt, Homo sapiens
uuaauacugcuuaacuuuagga

SEQ ID NO: 369714 - RNA, 21 nt, Homo sapiens
uuaaugcuaugcagaaaaucu

SEQ ID NO: 369715 - RNA, 22 nt, Homo sapiens
uuacaguauugcaaggacuagg

SEQ ID NO: 369716 - RNA, 22 nt, Homo sapiens
uuaccugagaaggugacauuug

SEQ ID NO: 369717 - RNA, 22 nt, Homo sapiens
uuagcacaguucauucauguua

SEQ ID NO: 369718 - RNA, 22 nt, Homo sapiens
uuaguaucauccuucugcauuc

SEQ ID NO: 369719 - RNA, 22 nt, Homo sapiens
uuauugcuuaugauuagguguu

SEQ ID NO: 369720 - RNA, 22 nt, Homo sapiens
uucaacagugauggccuuugua

SEQ ID NO: 369721 - RNA, 22 nt, Homo sapiens
uucaacugcuucagccucccaa

SEQ ID NO: 369722 - RNA, 22 nt, Homo sapiens
uucaagauggccccagugagcc

SEQ ID NO: 369723 - RNA, 22 nt, Homo sapiens
uucacaaugccuuguugauggu

SEQ ID NO: 369724 - RNA, 22 nt, Homo sapiens
uucacacuagccacucugguag

SEQ ID NO: 369725 - RNA, 22 nt, Homo sapiens
uucacacugggccuacucugug

SEQ ID NO: 369726 - RNA, 22 nt, Homo sapiens
uucacagugugaucuaugggca

SEQ ID NO: 369727 - RNA, 22 nt, Homo sapiens
uucacugcacuccagccugagc

SEQ ID NO: 369728 - RNA, 22 nt, Homo sapiens
uucaguauugcaccuggagucc

SEQ ID NO: 369729 - RNA, 22 nt, Homo sapiens
uucaguggguggaugaauauga

SEQ ID NO: 369730 - RNA, 22 nt, Homo sapiens
uucauagugaaaaauucaaagu

SEQ ID NO: 369731 - RNA, 22 nt, Homo sapiens
uucaugugagucuguauuaacu

SEQ ID NO: 369732 - RNA, 22 nt, Homo sapiens
uucuacaggcuguucaagaagc

SEQ ID NO: 369733 - RNA, 22 nt, Homo sapiens
uucuagagagaagacuuaagcu

SEQ ID NO: 369734 - RNA, 22 nt, Homo sapiens
uucuuaguggcaccacuuuuuu

SEQ ID NO: 369735 - RNA, 18 nt, Homo sapiens
uucuuguguugauauuuu

SEQ ID NO: 369736 - RNA, 22 nt, Homo sapiens
uugaagugaagaacaauaucac

SEQ ID NO: 369737 - RNA, 22 nt, Homo sapiens
uugacauugcuguaguguccag

SEQ ID NO: 369738 - RNA, 22 nt, Homo sapiens
uugaguauuggacugguaucuu

SEQ ID NO: 369739 - RNA, 22 nt, Homo sapiens
uugcagcaacauggaugaaacu

SEQ ID NO: 369740 - RNA, 22 nt, Homo sapiens
uuggcaaagugucuggcauuua

SEQ ID NO: 369741 - RNA, 22 nt, Homo sapiens
uuggcaacauagugagaccccc

SEQ ID NO: 369742 - RNA, 20 nt, Homo sapiens
uuggcauuuagacaagaguu

SEQ ID NO: 369743 - RNA, 22 nt, Homo sapiens
uuggccauggagcacuuuucua

SEQ ID NO: 369744 - RNA, 22 nt, Homo sapiens
uuggcuguguuuauaugcugga

SEQ ID NO: 369745 - RNA, 22 nt, Homo sapiens
aaaugacuuuuuaugcagagua

SEQ ID NO: 369746 - RNA, 22 nt, Homo sapiens
aaaugcacaaagauuuugcacu

SEQ ID NO: 369747 - RNA, 22 nt, Homo sapiens
aaaugccucccauucuacugac

SEQ ID NO: 369748 - RNA, 22 nt, Homo sapiens
aacagucaauugcugaugaccu

SEQ ID NO: 369749 - RNA, 22 nt, Homo sapiens
aacagugccugucauuuaguag

SEQ ID NO: 369750 - RNA, 22 nt, Homo sapiens
aagcagauguguugaaaguacu

SEQ ID NO: 369751 - RNA, 22 nt, Homo sapiens
aagcaugguuuccaggggucac

SEQ ID NO: 369752 - RNA, 22 nt, Homo sapiens
aaguccaugaagucuugugggu

SEQ ID NO: 369753 - RNA, 22 nt, Homo sapiens
aagugcucuugaaacugccuua

SEQ ID NO: 369754 - RNA, 22 nt, Homo sapiens
aagugcuggccuacucaaucga

SEQ ID NO: 369755 - RNA, 22 nt, Homo sapiens
aagugcugggauuggccgggca

SEQ ID NO: 369756 - RNA, 22 nt, Homo sapiens
aagugcuguccuaccuuuggga

SEQ ID NO: 369757 - RNA, 22 nt, Homo sapiens
aagugguuuuuacaaagacaga

SEQ ID NO: 369758 - RNA, 22 nt, Homo sapiens
aauaaagcaggguccuugcacu

SEQ ID NO: 369759 - RNA, 22 nt, Homo sapiens
aaucacaguguucuugugaggg

SEQ ID NO: 369760 - RNA, 22 nt, Homo sapiens
aaucacaguuaguaagggagaa

SEQ ID NO: 369761 - RNA, 22 nt, Homo sapiens
aaucauauugucugccaagagg

SEQ ID NO: 369762 - RNA, 22 nt, Homo sapiens
aauggcagaugaaauugucauu

SEQ ID NO: 369763 - RNA, 22 nt, Homo sapiens
aauuaguugaaagucugcuuuu

SEQ ID NO: 369764 - RNA, 16 nt, Homo sapiens
acaaagcuggcuaucu

SEQ ID NO: 369765 - RNA, 22 nt, Homo sapiens
acaagacuucuuguauucuagu

SEQ ID NO: 369766 - RNA, 22 nt, Homo sapiens
acacaaugguaaguguuugugu

SEQ ID NO: 369767 - RNA, 23 nt, Homo sapiens
acacaguaaacuaaaagcuagcu

SEQ ID NO: 369768 - RNA, 22 nt, Homo sapiens
acacaugugaaaaaaauguuac

SEQ ID NO: 369769 - RNA, 22 nt, Homo sapiens
acacuguugacauuuuguagug

SEQ ID NO: 369770 - RNA, 18 nt, Homo sapiens
acagugcugucacugcuu

SEQ ID NO: 369771 - RNA, 22 nt, Homo sapiens
acagugcugucugcuuuggcua

SEQ ID NO: 369772 - RNA, 17 nt, Homo sapiens
acagugcuuugcuuucc

SEQ ID NO: 369773 - RNA, 21 nt, Homo sapiens
acaucagaguugugaagguag

SEQ ID NO: 369774 - RNA, 22 nt, Homo sapiens
acccauguaggugggauuacag

SEQ ID NO: 369775 - RNA, 22 nt, Homo sapiens
acugcacuccagcuugggugac

SEQ ID NO: 369776 - RNA, 22 nt, Homo sapiens
acugcacucuagcuugggugac

SEQ ID NO: 369777 - RNA, 22 nt, Homo sapiens
acugcauuugguaaagucaaga

SEQ ID NO: 369778 - RNA, 22 nt, Homo sapiens
acugcauuugucugucucaauu

SEQ ID NO: 369779 - RNA, 21 nt, Homo sapiens
acuuucuguggcaguccauuc

SEQ ID NO: 369780 - RNA, 22 nt, Homo sapiens
agaauguauauucuguaguugu

SEQ ID NO: 369781 - RNA, 22 nt, Homo sapiens
agaauguuuuagaccaauacaa

SEQ ID NO: 369782 - RNA, 23 nt, Homo sapiens
agcaaaugcucuagcacuccaac

SEQ ID NO: 369783 - RNA, 22 nt, Homo sapiens
agcagauguuuagugagcgccu

SEQ ID NO: 369784 - RNA, 22 nt, Homo sapiens
agcagcauuaguggaaucuugu

SEQ ID NO: 369785 - RNA, 22 nt, Homo sapiens
agcagcauuaugauauaucuua

SEQ ID NO: 369786 - RNA, 22 nt, Homo sapiens
agcugcaauguuuaguauaaua

SEQ ID NO: 369787 - RNA, 22 nt, Homo sapiens
agcugguaugaaaaucucccca

SEQ ID NO: 369788 - RNA, 22 nt, Homo sapiens
agcuguaguuuauucauguuaa

SEQ ID NO: 369789 - RNA, 22 nt, Homo sapiens
aggcaaaugccagcaaucacac

SEQ ID NO: 369790 - RNA, 22 nt, Homo sapiens
aggcaacaugguaaaacccugu

SEQ ID NO: 369791 - RNA, 22 nt, Homo sapiens
aggcagcuguuauauacugagu

SEQ ID NO: 369792 - RNA, 22 nt, Homo sapiens
agguacuugagauucugaacug

SEQ ID NO: 369793 - RNA, 22 nt, Homo sapiens
agguauauuggacagauguaaa

SEQ ID NO: 369794 - RNA, 22 nt, Homo sapiens
agucaagaaucucagcaucuuu

SEQ ID NO: 369795 - RNA, 22 nt, Homo sapiens
agugcuuaauagauguccagca

SEQ ID NO: 369796 - RNA, 22 nt, Homo sapiens
aguguuuuuaucaugaaagggu

SEQ ID NO: 369797 - RNA, 17 nt, Homo sapiens
auaaacucaucauuuuu

SEQ ID NO: 369798 - RNA, 22 nt, Homo sapiens
auaagugcuuguugaauaauag

SEQ ID NO: 369799 - RNA, 22 nt, Homo sapiens
auaauacuuuuauuuugaggaa

SEQ ID NO: 369800 - RNA, 22 nt, Homo sapiens
auaaucaugucugaaaccuuug

SEQ ID NO: 369801 - RNA, 22 nt, Homo sapiens
auacaguaaugucuuaggcugu

SEQ ID NO: 369802 - RNA, 22 nt, Homo sapiens
auagucaguagucucauaauga

SEQ ID NO: 369803 - RNA, 20 nt, Homo sapiens
aucaaagacuuagaggggga

SEQ ID NO: 369804 - RNA, 22 nt, Homo sapiens
aucacuuugcucuccagugugg

SEQ ID NO: 369805 - RNA, 22 nt, Homo sapiens
aucauugugcaucuucauucca

SEQ ID NO: 369806 - RNA, 22 nt, Homo sapiens
aucuaaaucucauaugggcaca

SEQ ID NO: 369807 - RNA, 22 nt, Homo sapiens
aucugcauuagggugaagaccu

SEQ ID NO: 369808 - RNA, 22 nt, Homo sapiens
augaaaacaugauuugccuguu

SEQ ID NO: 369809 - RNA, 22 nt, Homo sapiens
augaagagaaaguggaucuugg

SEQ ID NO: 369810 - RNA, 22 nt, Homo sapiens
augagacuguucuuccucauug

SEQ ID NO: 369811 - RNA, 22 nt, Homo sapiens
augggcaaauguuggaaauucc

SEQ ID NO: 369812 - RNA, 22 nt, Homo sapiens
auguaaacauuuggucuaaauu

SEQ ID NO: 369813 - RNA, 22 nt, Homo sapiens
augucaaggugaagaaagauca

SEQ ID NO: 369814 - RNA, 22 nt, Homo sapiens
auguccauggaaucuguagcaa

SEQ ID NO: 369815 - RNA, 22 nt, Homo sapiens
augugcaaaguuaagaucccag

SEQ ID NO: 369816 - RNA, 22 nt, Homo sapiens
augugcuugagggaaaucaguu

SEQ ID NO: 369817 - RNA, 22 nt, Homo sapiens
auuacuuugcaccaaccuaaua

SEQ ID NO: 369818 - RNA, 23 nt, Homo sapiens
auugaacacuuucauaugugagg

SEQ ID NO: 369819 - RNA, 22 nt, Homo sapiens
auugcacuccggccugggugac

SEQ ID NO: 369820 - RNA, 22 nt, Homo sapiens
auugucauuuucugagaaguaa

SEQ ID NO: 369821 - RNA, 22 nt, Homo sapiens
caaaggcuuccacugcauccuu

SEQ ID NO: 369822 - RNA, 22 nt, Homo sapiens
caaagucuucaguugauucuga

SEQ ID NO: 369823 - RNA, 22 nt, Homo sapiens
caaggaauucucaauagaguua

SEQ ID NO: 369824 - RNA, 21 nt, Homo sapiens
caauggcacaaucucugcuca

SEQ ID NO: 369825 - RNA, 22 nt, Homo sapiens
cacaaaguagauuagucuucca

SEQ ID NO: 369826 - RNA, 22 nt, Homo sapiens
cacagcuagucaaugguagaca

SEQ ID NO: 369827 - RNA, 22 nt, Homo sapiens
cacagugaaugucaucauugcc

SEQ ID NO: 369828 - RNA, 22 nt, Homo sapiens
caccagcuggcauugaauaccu

SEQ ID NO: 369829 - RNA, 22 nt, Homo sapiens
cacuggguuagaacaugcuccu

SEQ ID NO: 369830 - RNA, 21 nt, Homo sapiens
cacuggguucaggcuugugga

SEQ ID NO: 369831 - RNA, 22 nt, Homo sapiens
cagagaucaugcaacugcucgc

SEQ ID NO: 369832 - RNA, 22 nt, Homo sapiens
cagguacuucugggcugagcag

SEQ ID NO: 369833 - RNA, 22 nt, Homo sapiens
caggugcuuacuuaauagccau

SEQ ID NO: 369834 - RNA, 22 nt, Homo sapiens
cauacaugugcuugucuuaugc

SEQ ID NO: 369835 - RNA, 22 nt, Homo sapiens
cauugcacuccagcucugggcg

SEQ ID NO: 369836 - RNA, 22 nt, Homo sapiens
cauugcacuccagucugggcaa

SEQ ID NO: 369837 - RNA, 22 nt, Homo sapiens
cauugcacucuagucuggguga

SEQ ID NO: 369838 - RNA, 22 nt, Homo sapiens
cauugcacugcauucugggcaa

SEQ ID NO: 369839 - RNA, 22 nt, Homo sapiens
cauuuugcaguuucugucucca

SEQ ID NO: 369840 - RNA, 22 nt, Homo sapiens
ccagugcugugcaguguaugag

SEQ ID NO: 369841 - RNA, 21 nt, Homo sapiens
ccccugauacuuagucaagag

SEQ ID NO: 369842 - RNA, 22 nt, Homo sapiens
ccucacaaccuuuauugaagag

SEQ ID NO: 369843 - RNA, 20 nt, Homo sapiens
cuaaucaucccagaagaaau

SEQ ID NO: 369844 - RNA, 22 nt, Homo sapiens
cuaauccugugguagcacucaa

SEQ ID NO: 369845 - RNA, 22 nt, Homo sapiens
cucaguggauuagauaaugcac

SEQ ID NO: 369846 - RNA, 22 nt, Homo sapiens
cucuuuaguaagcaguugauga

SEQ ID NO: 369847 - RNA, 22 nt, Homo sapiens
cugacaagugaucacagcagca

SEQ ID NO: 369848 - RNA, 22 nt, Homo sapiens
cugagacuggguaauguauaaa

SEQ ID NO: 369849 - RNA, 22 nt, Homo sapiens
cugagcacugagauccucuagc

SEQ ID NO: 369850 - RNA, 22 nt, Homo sapiens
cugcauuugaugacguauggug

SEQ ID NO: 369851 - RNA, 22 nt, Homo sapiens
cuggaaaguagacaaucuaaaa

SEQ ID NO: 369852 - RNA, 22 nt, Homo sapiens
cuggauauguugcaacauuucc

SEQ ID NO: 369853 - RNA, 23 nt, Homo sapiens
cuguggauaugaguuguaaaugg

SEQ ID NO: 369854 - RNA, 22 nt, Homo sapiens
cuuuggcacuuccuaagugcca

SEQ ID NO: 369855 - RNA, 22 nt, Homo sapiens
cuuuuguggaucuucuguugcu

SEQ ID NO: 369856 - RNA, 22 nt, Homo sapiens
gaaaauccauccccagggagua

SEQ ID NO: 369857 - RNA, 18 nt, Homo sapiens
gaaaugccucuugcuuac

SEQ ID NO: 369858 - RNA, 20 nt, Homo sapiens
gaacugguguauguuuaacu

SEQ ID NO: 369859 - RNA, 22 nt, Homo sapiens
gacagugugauacuuagucuca

SEQ ID NO: 369860 - RNA, 22 nt, Homo sapiens
gacucagaacuaaggguguuuc

SEQ ID NO: 369861 - RNA, 22 nt, Homo sapiens
gagaaccauuuggagaaaaagu

SEQ ID NO: 369862 - RNA, 22 nt, Homo sapiens
gagacugagucucgcucugccg

SEQ ID NO: 369863 - RNA, 22 nt, Homo sapiens
gagacugagucuugcucuguca

SEQ ID NO: 369864 - RNA, 22 nt, Homo sapiens
gagacugagucuugcuuuguca

SEQ ID NO: 369865 - RNA, 22 nt, Homo sapiens
gagauauuauuucccuuucaca

SEQ ID NO: 369866 - RNA, 22 nt, Homo sapiens
gaguuccuuugagccugagagg

SEQ ID NO: 369867 - RNA, 22 nt, Homo sapiens
gcagguaguuucugacuuuuac

SEQ ID NO: 369868 - RNA, 22 nt, Homo sapiens
gcagugugugaggaauuugggu

SEQ ID NO: 369869 - RNA, 16 nt, Homo sapiens
gcaguguguuuaauag

SEQ ID NO: 369870 - RNA, 19 nt, Homo sapiens
gcuuagagacaaaacauug

SEQ ID NO: 369871 - RNA, 22 nt, Homo sapiens
ggaauguuaaagacuacacuga

SEQ ID NO: 369872 - RNA, 22 nt, Homo sapiens
ggacaaaguauuuucaaaugua

SEQ ID NO: 369873 - RNA, 22 nt, Homo sapiens
ggaguaaaagaguaggaggaau

SEQ ID NO: 369874 - RNA, 22 nt, Homo sapiens
ggcaaaaucgcaauuacuuuug

SEQ ID NO: 369875 - RNA, 22 nt, Homo sapiens
ggcaaaugaagauggagaggcu

SEQ ID NO: 369876 - RNA, 22 nt, Homo sapiens
ggcagcacaauuuucugaugga

SEQ ID NO: 369877 - RNA, 22 nt, Homo sapiens
guacaguauaguaauaggauuu

SEQ ID NO: 369878 - RNA, 22 nt, Homo sapiens
guacaguggguguagggaccag

SEQ ID NO: 369879 - RNA, 22 nt, Homo sapiens
guaucauugccuaaugcucuca

SEQ ID NO: 369880 - RNA, 22 nt, Homo sapiens
guaucccuugcuaucugaaucu

SEQ ID NO: 369881 - RNA, 22 nt, Homo sapiens
guccagagaagucauuacuuca

SEQ ID NO: 369882 - RNA, 22 nt, Homo sapiens
gugaaguuuuuugcugagaguc

SEQ ID NO: 369883 - RNA, 22 nt, Homo sapiens
gugaaucuguuuucuucuguuc

SEQ ID NO: 369884 - RNA, 22 nt, Homo sapiens
gugagacugaguuucgcucuug

SEQ ID NO: 369885 - RNA, 22 nt, Homo sapiens
gugagacugguucugaacccag

SEQ ID NO: 369886 - RNA, 22 nt, Homo sapiens
gugaggcacugcugcuuuccag

SEQ ID NO: 369887 - RNA, 22 nt, Homo sapiens
gugagguaauuagcucccuuag

SEQ ID NO: 369888 - RNA, 22 nt, Homo sapiens
gugaucauuguauugggguuau

SEQ ID NO: 369889 - RNA, 21 nt, Homo sapiens
gugcaaacaucauagaaugua

SEQ ID NO: 369890 - RNA, 22 nt, Homo sapiens
gugcaaguguaauacagcuagg

SEQ ID NO: 369891 - RNA, 22 nt, Homo sapiens
guggaaaacauaugcuuguuga

SEQ ID NO: 369892 - RNA, 22 nt, Homo sapiens
guggcauuucccaaaguauucu

SEQ ID NO: 369893 - RNA, 22 nt, Homo sapiens
gugguaguagaauuucggaaau

SEQ ID NO: 369894 - RNA, 22 nt, Homo sapiens
gugguucuagaauugaguaucc

SEQ ID NO: 369895 - RNA, 22 nt, Homo sapiens
guguaaaucaaucuguugucuu

SEQ ID NO: 369896 - RNA, 22 nt, Homo sapiens
guguaacaacagcacuccacug

SEQ ID NO: 369897 - RNA, 22 nt, Homo sapiens
guugcugagucccaucaccaga

SEQ ID NO: 369898 - RNA, 22 nt, Homo sapiens
uaaagcugaaaugauuaugaca

SEQ ID NO: 369899 - RNA, 22 nt, Homo sapiens
uaaaugcuuaauugaaugugga

SEQ ID NO: 369900 - RNA, 22 nt, Homo sapiens
uaacugcaaccucugccugcug

SEQ ID NO: 369901 - RNA, 22 nt, Homo sapiens
uaagacucuggacucuaauguu

SEQ ID NO: 369902 - RNA, 22 nt, Homo sapiens
uaagugcaacauaaguguuaaa

SEQ ID NO: 369903 - RNA, 22 nt, Homo sapiens
uaagugcaugauuacaugcaua

SEQ ID NO: 369904 - RNA, 23 nt, Homo sapiens
uaaguucaucucuaauaggugga

SEQ ID NO: 369905 - RNA, 18 nt, Homo sapiens
uaauaacugugaccuuga

SEQ ID NO: 369906 - RNA, 22 nt, Homo sapiens
uaauccuagcacuuuggaagac

SEQ ID NO: 369907 - RNA, 22 nt, Homo sapiens
uaauugaaugcagacaccaggg

SEQ ID NO: 369908 - RNA, 22 nt, Homo sapiens
uacaaaguaacaguuccuguau

SEQ ID NO: 369909 - RNA, 22 nt, Homo sapiens
uacaaccucugccucccaaguu

SEQ ID NO: 369910 - RNA, 22 nt, Homo sapiens
uacaguguuuugguauuccaca

SEQ ID NO: 369911 - RNA, 22 nt, Homo sapiens
uagaauguaaauuccaagggca

SEQ ID NO: 369912 - RNA, 22 nt, Homo sapiens
uagcagcaccccacucuacugg

SEQ ID NO: 369913 - RNA, 22 nt, Homo sapiens
uagcagcagugguguauuuaga

SEQ ID NO: 369914 - RNA, 19 nt, Homo sapiens
uagcagcaugauuuauaau

SEQ ID NO: 369915 - RNA, 22 nt, Homo sapiens
uagcagucaagauagucauuau

SEQ ID NO: 369916 - RNA, 22 nt, Homo sapiens
uagcagugugaaaacagacuaa

SEQ ID NO: 369917 - RNA, 22 nt, Homo sapiens
uaggacauugcccuuguggaga

SEQ ID NO: 369918 - RNA, 22 nt, Homo sapiens
uaggcaguguucucacuuguaa

SEQ ID NO: 369919 - RNA, 22 nt, Homo sapiens
uagugcuguaauucuaaugaaa

SEQ ID NO: 369920 - RNA, 22 nt, Homo sapiens
uagugcugugauauuuuuggcc

SEQ ID NO: 369921 - RNA, 22 nt, Homo sapiens
uauaugcacucagguguaugug

SEQ ID NO: 369922 - RNA, 22 nt, Homo sapiens
uauauguuuucauaaggcuaga

SEQ ID NO: 369923 - RNA, 22 nt, Homo sapiens
uaugucacuggacauaaguucu

SEQ ID NO: 369924 - RNA, 22 nt, Homo sapiens
cauugcacuccagccugcugac

SEQ ID NO: 369925 - RNA, 22 nt, Homo sapiens
ugguagugugagucuaaauugg

SEQ ID NO: 369926 - RNA, 18 nt, Homo sapiens
uguaaacuaccucaaccu

SEQ ID NO: 369927 - RNA, 20 nt, Homo sapiens
uguaacaaucuggauguugc

SEQ ID NO: 369928 - RNA, 21 nt, Homo sapiens
uguagcagcaugauucauagu

SEQ ID NO: 369929 - RNA, 22 nt, Homo sapiens
uguauauguuuguacauauguc

SEQ ID NO: 369930 - RNA, 22 nt, Homo sapiens
ugucaaaugcagugauauuuga

SEQ ID NO: 369931 - RNA, 20 nt, Homo sapiens
ugucaaggaauucccaaauc

SEQ ID NO: 369932 - RNA, 22 nt, Homo sapiens
ugucaucauuccaucagggcuu

SEQ ID NO: 369933 - RNA, 22 nt, Homo sapiens
ugugaacaaaauuuguugcaua

SEQ ID NO: 369934 - RNA, 22 nt, Homo sapiens
ugugaacauuuuguauauauua

SEQ ID NO: 369935 - RNA, 22 nt, Homo sapiens
ugugaucaugguauuaaucugc

SEQ ID NO: 369936 - RNA, 22 nt, Homo sapiens
ugugcaaauuagcacaacccga

SEQ ID NO: 369937 - RNA, 22 nt, Homo sapiens
ugugcaugacagcauacaaacg

SEQ ID NO: 369938 - RNA, 22 nt, Homo sapiens
uguguagagaaauauuacuuau

SEQ ID NO: 369939 - RNA, 22 nt, Homo sapiens
uguguuuuuauguaaaauggaa

SEQ ID NO: 369940 - RNA, 21 nt, Homo sapiens
uguuaacaugcagauuacugg

SEQ ID NO: 369941 - RNA, 22 nt, Homo sapiens
uuaaaagcuaucuccaagguca

SEQ ID NO: 369942 - RNA, 22 nt, Homo sapiens
uuaaguagaugaaugugaaugu

SEQ ID NO: 369943 - RNA, 22 nt, Homo sapiens
uuaaugacaucauaggugaagu

SEQ ID NO: 369944 - RNA, 22 nt, Homo sapiens
uuaauguaauugauugauugac

SEQ ID NO: 369945 - RNA, 22 nt, Homo sapiens
uuacaguaugaguaagaguucu

SEQ ID NO: 369946 - RNA, 19 nt, Homo sapiens
uuacagugugcccuuuuag

SEQ ID NO: 369947 - RNA, 19 nt, Homo sapiens
uuacauccauugcauuuca

SEQ ID NO: 369948 - RNA, 22 nt, Homo sapiens
uuacaugagacugucgcuaguu

SEQ ID NO: 369949 - RNA, 22 nt, Homo sapiens
uuaccuuuuuaagacagguuag

SEQ ID NO: 369950 - RNA, 22 nt, Homo sapiens
uuagcacuaauucguuggggca

SEQ ID NO: 369951 - RNA, 18 nt, Homo sapiens
uuauaugcauguguagga

SEQ ID NO: 369952 - RNA, 22 nt, Homo sapiens
uuaugcaucuuccacacucauu

SEQ ID NO: 369953 - RNA, 22 nt, Homo sapiens
uuauuagcacccuaccaugugg

SEQ ID NO: 369954 - RNA, 23 nt, Homo sapiens
uucaaaggaugcuuuauggaauu

SEQ ID NO: 369955 - RNA, 22 nt, Homo sapiens
uucagaugcacacuguagucua

SEQ ID NO: 369956 - RNA, 22 nt, Homo sapiens
uucaguggagaggcugaguggu

SEQ ID NO: 369957 - RNA, 22 nt, Homo sapiens
uuccuugagucuuuuuccugag

SEQ ID NO: 369958 - RNA, 22 nt, Homo sapiens
uucuacagugacugcagccaua

SEQ ID NO: 369959 - RNA, 17 nt, Homo sapiens
uucucaguucugaucuc

SEQ ID NO: 369960 - RNA, 22 nt, Homo sapiens
uugaucaucagcuuugucaucu

SEQ ID NO: 369961 - RNA, 22 nt, Homo sapiens
uugcagugugacgacuauauuu

SEQ ID NO: 369962 - RNA, 22 nt, Homo sapiens
uugcauuuucuaggagggcaaa

SEQ ID NO: 369963 - RNA, 22 nt, Homo sapiens
uuggcauuguggauggaaucau

SEQ ID NO: 369964 - RNA, 17 nt, Homo sapiens
uugggcaagguagguga

SEQ ID NO: 369965 - RNA, 22 nt, Homo sapiens
uugggcaauaggaagcaggugg

SEQ ID NO: 369966 - RNA, 22 nt, Homo sapiens
uugggucaguuccuugacuccu

SEQ ID NO: 369967 - RNA, 22 nt, Homo sapiens
uugguaaucccuagugucuaga

SEQ ID NO: 369968 - RNA, 22 nt, Homo sapiens
uuggucagcuagauuauucccu

SEQ ID NO: 369969 - RNA, 22 nt, Homo sapiens
uuguagcaaauguguaaacaaa

SEQ ID NO: 369970 - RNA, 22 nt, Homo sapiens
uuguccaagucccauuuguuga

SEQ ID NO: 369971 - RNA, 22 nt, Homo sapiens
uuguccauggacagcaccacag

SEQ ID NO: 369972 - RNA, 22 nt, Homo sapiens
uuuaaagcaugacgagaagaag

SEQ ID NO: 369973 - RNA, 22 nt, Homo sapiens
uuuaauacugcaucuuuacucu

SEQ ID NO: 369974 - RNA, 22 nt, Homo sapiens
aaaaggcuagcuaguaacagaa

SEQ ID NO: 369975 - RNA, 22 nt, Homo sapiens
aaaguaauugcaguuuuugcaa

SEQ ID NO: 369976 - RNA, 22 nt, Homo sapiens
aaauugcaaugcgaggcagagg

SEQ ID NO: 369977 - RNA, 21 nt, Homo sapiens
aagaaagcuggacuugccgcu

SEQ ID NO: 369978 - RNA, 22 nt, Homo sapiens
aagccacuguaccugucucuua

SEQ ID NO: 369979 - RNA, 19 nt, Homo sapiens
aaguaguugugacagaugc

SEQ ID NO: 369980 - RNA, 22 nt, Homo sapiens
aaguauuaugaguccuuguuuu

SEQ ID NO: 369981 - RNA, 22 nt, Homo sapiens
aagugcaaaucuguggcugaaa

SEQ ID NO: 369982 - RNA, 22 nt, Homo sapiens
aauaaagcauggcuacuccaua

SEQ ID NO: 369983 - RNA, 22 nt, Homo sapiens
aauacugaaaguauuuucaaau

SEQ ID NO: 369984 - RNA, 22 nt, Homo sapiens
aauagcuguccuuagaagugug

SEQ ID NO: 369985 - RNA, 22 nt, Homo sapiens
aaucugauguuaucagcuuaag

SEQ ID NO: 369986 - RNA, 22 nt, Homo sapiens
aaugacacugagcaucuuucau

SEQ ID NO: 369987 - RNA, 22 nt, Homo sapiens
aaugacagugcuaaagaacccu

SEQ ID NO: 369988 - RNA, 22 nt, Homo sapiens
aaugccuagugugugacaggug

SEQ ID NO: 369989 - RNA, 22 nt, Homo sapiens
acaaagcuagggaauccaucuu

SEQ ID NO: 369990 - RNA, 20 nt, Homo sapiens
acaaaugcauucugugacau

SEQ ID NO: 369991 - RNA, 22 nt, Homo sapiens
acagaacugggcuugcuuuugg

SEQ ID NO: 369992 - RNA, 22 nt, Homo sapiens
acagaucagagauauuuagguu

SEQ ID NO: 369993 - RNA, 22 nt, Homo sapiens
acagugcuguggucaugggucu

SEQ ID NO: 369994 - RNA, 22 nt, Homo sapiens
acaguguacaauagccuuuuaa

SEQ ID NO: 369995 - RNA, 18 nt, Homo sapiens
acagugucuuacaccugu

SEQ ID NO: 369996 - RNA, 22 nt, Homo sapiens
acaguguuacuugauaguguau

SEQ ID NO: 369997 - RNA, 17 nt, Homo sapiens
accagugcaugugcuuu

SEQ ID NO: 369998 - RNA, 22 nt, Homo sapiens
acugcacuccagcuuuggguga

SEQ ID NO: 369999 - RNA, 22 nt, Homo sapiens
acugcauuugucccuuuugaac

SEQ ID NO: 370000 - RNA, 22 nt, Homo sapiens
agagagcuugggguguuaaauu

SEQ ID NO: 370001 - RNA, 22 nt, Homo sapiens
agauauguuauugauguuaaug

SEQ ID NO: 370002 - RNA, 22 nt, Homo sapiens
agauguuguucaucugauuguu

SEQ ID NO: 370003 - RNA, 22 nt, Homo sapiens
agcagugucauuuucuggugag

SEQ ID NO: 370004 - RNA, 22 nt, Homo sapiens
agcaugauugggguugggcaca

SEQ ID NO: 370005 - RNA, 22 nt, Homo sapiens
agcuuguuuucccauaacuaga

SEQ ID NO: 370006 - RNA, 22 nt, Homo sapiens
aggagguagggugugaaacagc

SEQ ID NO: 370007 - RNA, 22 nt, Homo sapiens
aggagguugguaccaucuguuu

SEQ ID NO: 370008 - RNA, 22 nt, Homo sapiens
aguaaagccagaccuguuaauu

SEQ ID NO: 370009 - RNA, 22 nt, Homo sapiens
guauacaugucaaaacucacau

SEQ ID NO: 370010 - RNA, 22 nt, Homo sapiens
guauacuucugaaaauagcuau

SEQ ID NO: 370011 - RNA, 21 nt, Homo sapiens
guauggcauugauuaguuacu

SEQ ID NO: 370012 - RNA, 22 nt, Homo sapiens
gucaguggauacugucucuguc

SEQ ID NO: 370013 - RNA, 22 nt, Homo sapiens
gucauuguguggacauggagaa

SEQ ID NO: 370014 - RNA, 22 nt, Homo sapiens
gucucuugguuuagagcauuua

SEQ ID NO: 370015 - RNA, 22 nt, Homo sapiens
gucuugaaggcugaguaccugu

SEQ ID NO: 370016 - RNA, 22 nt, Homo sapiens
gugagacugguccugaacccag

SEQ ID NO: 370017 - RNA, 22 nt, Homo sapiens
gugagauccucucuuauauggg

SEQ ID NO: 370018 - RNA, 22 nt, Homo sapiens
gugagcauucaaggaaggagcu

SEQ ID NO: 370019 - RNA, 22 nt, Homo sapiens
gugggaugcaaguaaaauuguc

SEQ ID NO: 370020 - RNA, 22 nt, Homo sapiens
gugggcaagucacuucaguucu

SEQ ID NO: 370021 - RNA, 22 nt, Homo sapiens
gugguaggaaagugcaaaugua

SEQ ID NO: 370022 - RNA, 22 nt, Homo sapiens
guguggcaggugggggcucaga

SEQ ID NO: 370023 - RNA, 22 nt, Homo sapiens
uaacccuuaguaucuguggguu

SEQ ID NO: 370024 - RNA, 22 nt, Homo sapiens
uaauucacauaaagcacuuaga

SEQ ID NO: 370025 - RNA, 22 nt, Homo sapiens
uacaaagcuacucgagggcagg

SEQ ID NO: 370026 - RNA, 22 nt, Homo sapiens
uacaaagcuuucugcaaaucau

SEQ ID NO: 370027 - RNA, 22 nt, Homo sapiens
uacaccaauuuaaucaaaagca

SEQ ID NO: 370028 - RNA, 22 nt, Homo sapiens
uacagaguauccauuugaguuc

SEQ ID NO: 370029 - RNA, 22 nt, Homo sapiens
uacaggacuucucagaguuauu

SEQ ID NO: 370030 - RNA, 22 nt, Homo sapiens
uacaggauagacaauuuauuaa

SEQ ID NO: 370031 - RNA, 22 nt, Homo sapiens
uacagugcauagaggcaugaua

SEQ ID NO: 370032 - RNA, 22 nt, Homo sapiens
uacagugcuugguaucuaguaa

SEQ ID NO: 370033 - RNA, 22 nt, Homo sapiens
uacaguggaaguuaaccccauu

SEQ ID NO: 370034 - RNA, 22 nt, Homo sapiens
uacguuaucagguaugcaagag

SEQ ID NO: 370035 - RNA, 22 nt, Homo sapiens
uacucacauucuguuucuugcu

SEQ ID NO: 370036 - RNA, 22 nt, Homo sapiens
uagaauguaacuuccaugucau

SEQ ID NO: 370037 - RNA, 22 nt, Homo sapiens
uagacccauuguucagagagug

SEQ ID NO: 370038 - RNA, 22 nt, Homo sapiens
uagcacaucuucuuggccugca

SEQ ID NO: 370039 - RNA, 22 nt, Homo sapiens
uagcaccuuagcauuucuagug

SEQ ID NO: 370040 - RNA, 20 nt, Homo sapiens
uagcaggugucaggugauau

SEQ ID NO: 370041 - RNA, 22 nt, Homo sapiens
uagcauccuucucuaaacagga

SEQ ID NO: 370042 - RNA, 22 nt, Homo sapiens
uagucacacacucaacuuuuca

SEQ ID NO: 370043 - RNA, 18 nt, Homo sapiens
uagugcuguucucaugau

SEQ ID NO: 370044 - RNA, 22 nt, Homo sapiens
uauagcuuuuuagggaauuugg

SEQ ID NO: 370045 - RNA, 22 nt, Homo sapiens
uauaugcaacauaguguaugug

SEQ ID NO: 370046 - RNA, 22 nt, Homo sapiens
uaucacaaacuuagcaguuuaa

SEQ ID NO: 370047 - RNA, 23 nt, Homo sapiens
uaucacacuuucucugugccaca

SEQ ID NO: 370048 - RNA, 22 nt, Homo sapiens
uaucacaguaucuagcacagug

SEQ ID NO: 370049 - RNA, 22 nt, Homo sapiens
uaucagaguuacacugaagacu

SEQ ID NO: 370050 - RNA, 20 nt, Homo sapiens
uaugaaacaguguagagcaa

SEQ ID NO: 370051 - RNA, 22 nt, Homo sapiens
uaugucuucuuuagagaaaugu

SEQ ID NO: 370052 - RNA, 22 nt, Homo sapiens
uaugucuuuugcuugcaaauag

SEQ ID NO: 370053 - RNA, 20 nt, Homo sapiens
uauucacucuccagucuugc

SEQ ID NO: 370054 - RNA, 22 nt, Homo sapiens
uauucacuguaucauugauggg

SEQ ID NO: 370055 - RNA, 22 nt, Homo sapiens
uauugaauuugagcugucucuu

SEQ ID NO: 370056 - RNA, 22 nt, Homo sapiens
ucacaagcuccugccuuugcuu

SEQ ID NO: 370057 - RNA, 22 nt, Homo sapiens
ucacacugaauuugaagcaaug

SEQ ID NO: 370058 - RNA, 22 nt, Homo sapiens
ucacugaaaccgccuccaccuc

SEQ ID NO: 370059 - RNA, 22 nt, Homo sapiens
ucagaucauauucuucgcugcu

SEQ ID NO: 370060 - RNA, 22 nt, Homo sapiens
ucagauguuugagaaguauacu

SEQ ID NO: 370061 - RNA, 22 nt, Homo sapiens
ucagauguuuuguuuaucugcu

SEQ ID NO: 370062 - RNA, 23 nt, Homo sapiens
ucagugaaggaacaacuaaauag

SEQ ID NO: 370063 - RNA, 21 nt, Homo sapiens
ucagugcugugggcaaggugc

SEQ ID NO: 370064 - RNA, 22 nt, Homo sapiens
ucagugcuguuugcccucguuu

SEQ ID NO: 370065 - RNA, 22 nt, Homo sapiens
ucaguguuuuauccuccagagc

SEQ ID NO: 370066 - RNA, 22 nt, Homo sapiens
ucauauguaugugcaauuuugu

SEQ ID NO: 370067 - RNA, 22 nt, Homo sapiens
ucaucagguaugucagcggagu

SEQ ID NO: 370068 - RNA, 22 nt, Homo sapiens
uccagcuuuuucuaauucugug

SEQ ID NO: 370069 - RNA, 22 nt, Homo sapiens
ucguucuugucaguuuauaaag

SEQ ID NO: 370070 - RNA, 22 nt, Homo sapiens
ucuagaugaaguauaaaguagu

SEQ ID NO: 370071 - RNA, 22 nt, Homo sapiens
ucucuguuuauuuuugguguau

SEQ ID NO: 370072 - RNA, 22 nt, Homo sapiens
ucugagacuguuucuaacaagc

SEQ ID NO: 370073 - RNA, 22 nt, Homo sapiens
ucugagcaauaaacaacauauu

SEQ ID NO: 370074 - RNA, 22 nt, Homo sapiens
ucugugcauuuucuuuuagacu

SEQ ID NO: 370075 - RNA, 22 nt, Homo sapiens
ucuugucacugcauccccagcu

SEQ ID NO: 370076 - RNA, 22 nt, Homo sapiens
ucuuuguuagaacccucuccuu

SEQ ID NO: 370077 - RNA, 22 nt, Homo sapiens
ugaagacucaauuauuaugaac

SEQ ID NO: 370078 - RNA, 20 nt, Homo sapiens
ugaauguaauuacagaugua

SEQ ID NO: 370079 - RNA, 21 nt, Homo sapiens
ugacauuauuucaugucagua

SEQ ID NO: 370080 - RNA, 22 nt, Homo sapiens
ugagaacagauggcuuuauuau

SEQ ID NO: 370081 - RNA, 16 nt, Homo sapiens
ugagaacaugcagcau

SEQ ID NO: 370082 - RNA, 20 nt, Homo sapiens
ugagaacaugugguauuugg

SEQ ID NO: 370083 - RNA, 22 nt, Homo sapiens
ugagacaaaguuguuggauguu

SEQ ID NO: 370084 - RNA, 21 nt, Homo sapiens
ugagacaauccuggucaauau

SEQ ID NO: 370085 - RNA, 22 nt, Homo sapiens
ugagaucaaggugggcccuggg

SEQ ID NO: 370086 - RNA, 22 nt, Homo sapiens
ugagauguguccagaucuaguu

SEQ ID NO: 370087 - RNA, 20 nt, Homo sapiens
ugagccccuggacucaagcg

SEQ ID NO: 370088 - RNA, 22 nt, Homo sapiens
ugaguacuacuaguuacugcua

SEQ ID NO: 370089 - RNA, 22 nt, Homo sapiens
ugaguucaauuguauuuuauua

SEQ ID NO: 370090 - RNA, 22 nt, Homo sapiens
ugaguuuaucuaaagaccuggg

SEQ ID NO: 370091 - RNA, 22 nt, Homo sapiens
ugauauguaacuacuccuuaua

SEQ ID NO: 370092 - RNA, 20 nt, Homo sapiens
ugauauuuucugagcaggaa

SEQ ID NO: 370093 - RNA, 22 nt, Homo sapiens
ugaugcugaugccugccagaag

SEQ ID NO: 370094 - RNA, 22 nt, Homo sapiens
ugcaagaaucagccuaucauua

SEQ ID NO: 370095 - RNA, 21 nt, Homo sapiens
ugcaagaaucaggaagcugcc

SEQ ID NO: 370096 - RNA, 22 nt, Homo sapiens
ugcaagcacacccagggauugu

SEQ ID NO: 370097 - RNA, 22 nt, Homo sapiens
ugcaaguaauuccagcuacuga

SEQ ID NO: 370098 - RNA, 18 nt, Homo sapiens
ugcaccaguuuacacuuc

SEQ ID NO: 370099 - RNA, 22 nt, Homo sapiens
ugcagcacuguucacaauagcc

SEQ ID NO: 370100 - RNA, 22 nt, Homo sapiens
gagaugugugugauuauauaau

SEQ ID NO: 370101 - RNA, 22 nt, Homo sapiens
gagcacauguggagagucuggg

SEQ ID NO: 370102 - RNA, 22 nt, Homo sapiens
gaggaaguuuacaaagcaucug

SEQ ID NO: 370103 - RNA, 22 nt, Homo sapiens
gaguaaaugucaaguacuuagg

SEQ ID NO: 370104 - RNA, 22 nt, Homo sapiens
gaguuuguacuaauuuguugua

SEQ ID NO: 370105 - RNA, 22 nt, Homo sapiens
gaucugugugauuggaugcauu

SEQ ID NO: 370106 - RNA, 22 nt, Homo sapiens
gaugugaaaucauaguuucuag

SEQ ID NO: 370107 - RNA, 22 nt, Homo sapiens
gcaaaugcuaugccauuuuaua

SEQ ID NO: 370108 - RNA, 22 nt, Homo sapiens
gcaggaaucuugagaaggauuc

SEQ ID NO: 370109 - RNA, 22 nt, Homo sapiens
gcaguguucaaaucaugcccau

SEQ ID NO: 370110 - RNA, 20 nt, Homo sapiens
gcaguguucacuguauuccu

SEQ ID NO: 370111 - RNA, 22 nt, Homo sapiens
gccaagauuuaauucaucaguu

SEQ ID NO: 370112 - RNA, 22 nt, Homo sapiens
gccauggugucuuauuuuugug

SEQ ID NO: 370113 - RNA, 22 nt, Homo sapiens
gcccuguguuuggguaugguca

SEQ ID NO: 370114 - RNA, 22 nt, Homo sapiens
gcugcuguuauucaucagaacu

SEQ ID NO: 370115 - RNA, 22 nt, Homo sapiens
gcugucuggagucuguucaaug

SEQ ID NO: 370116 - RNA, 22 nt, Homo sapiens
gcuguguugugcccagcaucau

SEQ ID NO: 370117 - RNA, 22 nt, Homo sapiens
gcuguuugccgccaucgcagac

SEQ ID NO: 370118 - RNA, 22 nt, Homo sapiens
gcuuguguucaaggaacaccua

SEQ ID NO: 370119 - RNA, 19 nt, Homo sapiens
gcuuuguggggaaggagcc

SEQ ID NO: 370120 - RNA, 22 nt, Homo sapiens
ggaaucugaaccaugggaaugg

SEQ ID NO: 370121 - RNA, 22 nt, Homo sapiens
ggagaugauuaugaaucacuua

SEQ ID NO: 370122 - RNA, 22 nt, Homo sapiens
ggcaaggauguuuuucuggcaa

SEQ ID NO: 370123 - RNA, 22 nt, Homo sapiens
ggcaguguuauuauauuuuugg

SEQ ID NO: 370124 - RNA, 22 nt, Homo sapiens
ggccuguaggguauugguaggg

SEQ ID NO: 370125 - RNA, 22 nt, Homo sapiens
gggaacauggaaauucugcucu

SEQ ID NO: 370126 - RNA, 22 nt, Homo sapiens
gggauguaugauauauguuggu

SEQ ID NO: 370127 - RNA, 22 nt, Homo sapiens
gggauguuuuauacugagccug

SEQ ID NO: 370128 - RNA, 22 nt, Homo sapiens
ggucauggauguuuauaguaca

SEQ ID NO: 370129 - RNA, 22 nt, Homo sapiens
ggucuuggagaauuguccuggg

SEQ ID NO: 370130 - RNA, 22 nt, Homo sapiens
guagagagaaauacaaagcugu

SEQ ID NO: 370131 - RNA, 22 nt, Homo sapiens
guagcaccagugcucuucucaa

SEQ ID NO: 370132 - RNA, 22 nt, Homo sapiens
guagcagcaauuuacuccauac

SEQ ID NO: 370133 - RNA, 22 nt, Homo sapiens
guagcagcuacuaaguugcugu

SEQ ID NO: 370134 - RNA, 22 nt, Homo sapiens
guauuugguuauugcagccuga

SEQ ID NO: 370135 - RNA, 22 nt, Homo sapiens
gucaaaugcacagaaccauuaa

SEQ ID NO: 370136 - RNA, 22 nt, Homo sapiens
gucauguuuaacuucuugagga

SEQ ID NO: 370137 - RNA, 22 nt, Homo sapiens
gucuaugagucccugaauuuaa

SEQ ID NO: 370138 - RNA, 22 nt, Homo sapiens
gucucacagcuagcugcuuuau

SEQ ID NO: 370139 - RNA, 22 nt, Homo sapiens
gucugguuuuuuauauccucac

SEQ ID NO: 370140 - RNA, 22 nt, Homo sapiens
gucuguuugauccagaucaaaa

SEQ ID NO: 370141 - RNA, 22 nt, Homo sapiens
gugaaaagaugagcaccauaca

SEQ ID NO: 370142 - RNA, 22 nt, Homo sapiens
gugaccagaugggcaggggugu

SEQ ID NO: 370143 - RNA, 22 nt, Homo sapiens
gugagaugauggguauguuaau

SEQ ID NO: 370144 - RNA, 22 nt, Homo sapiens
gugagguaagaguugcuuugcu

SEQ ID NO: 370145 - RNA, 22 nt, Homo sapiens
gugauguguuucaacagcuccu

SEQ ID NO: 370146 - RNA, 22 nt, Homo sapiens
gugcacaacaugcagguuuguu

SEQ ID NO: 370147 - RNA, 22 nt, Homo sapiens
gugccuucuagcuaugguuggc

SEQ ID NO: 370148 - RNA, 22 nt, Homo sapiens
guggcaagaauguacaaaaggu

SEQ ID NO: 370149 - RNA, 22 nt, Homo sapiens
guggcaagaugacuacucacug

SEQ ID NO: 370150 - RNA, 22 nt, Homo sapiens
guggcagaaaagagaagcaaug

SEQ ID NO: 370151 - RNA, 22 nt, Homo sapiens
guggcagagucagagggaaaug

SEQ ID NO: 370152 - RNA, 22 nt, Homo sapiens
guggcaugaaagcaucugugau

SEQ ID NO: 370153 - RNA, 22 nt, Homo sapiens
gugguucuagagggacagaaug

SEQ ID NO: 370154 - RNA, 22 nt, Homo sapiens
gugucuccuguggagcuaugua

SEQ ID NO: 370155 - RNA, 22 nt, Homo sapiens
guguucaaacccaggucugucu

SEQ ID NO: 370156 - RNA, 22 nt, Homo sapiens
guuaaagacauccacauaggag

SEQ ID NO: 370157 - RNA, 22 nt, Homo sapiens
uaaacugcuugaaaugguguca

SEQ ID NO: 370158 - RNA, 18 nt, Homo sapiens
uaaauugcuucaccugag

SEQ ID NO: 370159 - RNA, 19 nt, Homo sapiens
uaacacaguuguguuugag

SEQ ID NO: 370160 - RNA, 22 nt, Homo sapiens
uaaggcuuaugguaaaguccug

SEQ ID NO: 370161 - RNA, 22 nt, Homo sapiens
uaaggcuugaucuuggugagau

SEQ ID NO: 370162 - RNA, 22 nt, Homo sapiens
uaaggcuugcuucagucuugaa

SEQ ID NO: 370163 - RNA, 22 nt, Homo sapiens
uaaggcuuugguagguuugguc

SEQ ID NO: 370164 - RNA, 22 nt, Homo sapiens
uaagggcaugcugcaugagagu

SEQ ID NO: 370165 - RNA, 22 nt, Homo sapiens
uaauacuagugaauagcaggau

SEQ ID NO: 370166 - RNA, 22 nt, Homo sapiens
uaaucucagcuacucaggaggc

SEQ ID NO: 370167 - RNA, 22 nt, Homo sapiens
uacaccaauuuaaucaaaagca

SEQ ID NO: 370168 - RNA, 22 nt, Homo sapiens
uacagaguagaagauuugcaga

SEQ ID NO: 370169 - RNA, 22 nt, Homo sapiens
uacaguguuuugguauuccaca

SEQ ID NO: 370170 - RNA, 21 nt, Homo sapiens
uacuggagauacagucugcaa

SEQ ID NO: 370171 - RNA, 22 nt, Homo sapiens
uagagguucuaagauucucaga

SEQ ID NO: 370172 - RNA, 19 nt, Homo sapiens
uagagguuuaagaaaagaa

SEQ ID NO: 370173 - RNA, 22 nt, Homo sapiens
uagcagcaucucuggcuucuac

SEQ ID NO: 370174 - RNA, 22 nt, Homo sapiens
uagcagguguuccacaaauauu

SEQ ID NO: 370175 - RNA, 22 nt, Homo sapiens
uagcugcccagcacgaaguugg

SEQ ID NO: 370176 - RNA, 19 nt, Homo sapiens
uagggcacgaggcagaguc

SEQ ID NO: 370177 - RNA, 22 nt, Homo sapiens
uaggucacugcucugugucuaa

SEQ ID NO: 370178 - RNA, 22 nt, Homo sapiens
uaguugcauuggcugcuaugcu

SEQ ID NO: 370179 - RNA, 22 nt, Homo sapiens
uauaugcaacauaguguaugug

SEQ ID NO: 370180 - RNA, 22 nt, Homo sapiens
uauaugcacucagguguaugug

SEQ ID NO: 370181 - RNA, 22 nt, Homo sapiens
uaucagagcugucagccuaccu

SEQ ID NO: 370182 - RNA, 20 nt, Homo sapiens
uaugaccugucuuuucucuc

SEQ ID NO: 370183 - RNA, 22 nt, Homo sapiens
uaugaccuuggacaaguuacuu

SEQ ID NO: 370184 - RNA, 22 nt, Homo sapiens
uaugacuuuggaaaaauuacuu

SEQ ID NO: 370185 - RNA, 22 nt, Homo sapiens
uaugcacacacguguuuaugug

SEQ ID NO: 370186 - RNA, 22 nt, Homo sapiens
uauuaugcacuuuauaaaaauu

SEQ ID NO: 370187 - RNA, 22 nt, Homo sapiens
uauucaucuuaagcuuuggcuu

SEQ ID NO: 370188 - RNA, 22 nt, Homo sapiens
uauugcaacagaagaaagaguc

SEQ ID NO: 370189 - RNA, 22 nt, Homo sapiens
uauugcaauuggggaaacuggg

SEQ ID NO: 370190 - RNA, 22 nt, Homo sapiens
uauugcagaaugugaguuggca

SEQ ID NO: 370191 - RNA, 22 nt, Homo sapiens
uauugcugaugcugaagggaag

SEQ ID NO: 370192 - RNA, 22 nt, Homo sapiens
uauuugguagcuauuuugcagu

SEQ ID NO: 370193 - RNA, 18 nt, Homo sapiens
ucaaauacuuugggcagu

SEQ ID NO: 370194 - RNA, 20 nt, Homo sapiens
ucacauccucucccaacaug

SEQ ID NO: 370195 - RNA, 22 nt, Homo sapiens
ucaccggcagacguggccugau

SEQ ID NO: 370196 - RNA, 22 nt, Homo sapiens
ucaccuugcacaguuguguggg

SEQ ID NO: 370197 - RNA, 22 nt, Homo sapiens
ucacugaaaccgccuccaccuc

SEQ ID NO: 370198 - RNA, 20 nt, Homo sapiens
cucaccagguguaggcugag

SEQ ID NO: 370199 - RNA, 22 nt, Homo sapiens
cucagagcacaguuuaugacag

SEQ ID NO: 370200 - RNA, 22 nt, Homo sapiens
cucagugaagggcaagaggcaa

SEQ ID NO: 370201 - RNA, 22 nt, Homo sapiens
cucccacccucauuuuuaggca

SEQ ID NO: 370202 - RNA, 22 nt, Homo sapiens
cucucaguugucuaauuaguuu

SEQ ID NO: 370203 - RNA, 22 nt, Homo sapiens
cugaaggcagguagaauagaga

SEQ ID NO: 370204 - RNA, 20 nt, Homo sapiens
cugaaugucaaggcagaggu

SEQ ID NO: 370205 - RNA, 22 nt, Homo sapiens
cugacauuguugaucacagcca

SEQ ID NO: 370206 - RNA, 22 nt, Homo sapiens
cugagcccauucuggggagaag

SEQ ID NO: 370207 - RNA, 22 nt, Homo sapiens
cugcauuugaugacguauggug

SEQ ID NO: 370208 - RNA, 22 nt, Homo sapiens
cugucaucauuucuaugugcca

SEQ ID NO: 370209 - RNA, 22 nt, Homo sapiens
cuugcagaggcccuggggagag

SEQ ID NO: 370210 - RNA, 19 nt, Homo sapiens
cuugccccauucauccucu

SEQ ID NO: 370211 - RNA, 22 nt, Homo sapiens
gaaagauuuccugagcuagaaa

SEQ ID NO: 370212 - RNA, 22 nt, Homo sapiens
gacauguuuacaguguugagag

SEQ ID NO: 370213 - RNA, 22 nt, Homo sapiens
gacauguuucucucuguuuacu

SEQ ID NO: 370214 - RNA, 22 nt, Homo sapiens
gaccugagagguacauguauuu

SEQ ID NO: 370215 - RNA, 22 nt, Homo sapiens
gacuggauagauaaaguuaguu

SEQ ID NO: 370216 - RNA, 22 nt, Homo sapiens
gagaacagagauaauuuuacuu

SEQ ID NO: 370217 - RNA, 22 nt, Homo sapiens
gagaacuaaugauguacuaggc

SEQ ID NO: 370218 - RNA, 22 nt, Homo sapiens
gagaacugagugugcuggcgga

SEQ ID NO: 370219 - RNA, 22 nt, Homo sapiens
gagacugaguuuugcucuuguu

SEQ ID NO: 370220 - RNA, 22 nt, Homo sapiens
gagagaguacuugauauaauuu

SEQ ID NO: 370221 - RNA, 22 nt, Homo sapiens
gagaugugguucaaggguguuu

SEQ ID NO: 370222 - RNA, 22 nt, Homo sapiens
gagauguuuguuucacugucac

SEQ ID NO: 370223 - RNA, 22 nt, Homo sapiens
gagcacccuuuguugauugcaa

SEQ ID NO: 370224 - RNA, 20 nt, Homo sapiens
gagcucaucuucuuuaccac

SEQ ID NO: 370225 - RNA, 22 nt, Homo sapiens
gagcugccuugccuaugcaaga

SEQ ID NO: 370226 - RNA, 22 nt, Homo sapiens
gaggcggugugaugucacaugc

SEQ ID NO: 370227 - RNA, 22 nt, Homo sapiens
gaggucaggacauuuuugcuuu

SEQ ID NO: 370228 - RNA, 22 nt, Homo sapiens
gaggucuuacauuuuaauauuu

SEQ ID NO: 370229 - RNA, 22 nt, Homo sapiens
gagugcaauggcgcgaucucgg

SEQ ID NO: 370230 - RNA, 22 nt, Homo sapiens
gagugcaauggugcuaucucgg

SEQ ID NO: 370231 - RNA, 22 nt, Homo sapiens
gauggaguaauguaaucuugag

SEQ ID NO: 370232 - RNA, 22 nt, Homo sapiens
gcaaaauugagaagggaauaua

SEQ ID NO: 370233 - RNA, 22 nt, Homo sapiens
gcaauacugacagcauuaguuu

SEQ ID NO: 370234 - RNA, 20 nt, Homo sapiens
gcagcaccauauuucuaaga

SEQ ID NO: 370235 - RNA, 22 nt, Homo sapiens
gcagcaguggcaguuaauauuu

SEQ ID NO: 370236 - RNA, 22 nt, Homo sapiens
gcaggaauuucucugcagaccc

SEQ ID NO: 370237 - RNA, 22 nt, Homo sapiens
gcaguggugugugccagccuag

SEQ ID NO: 370238 - RNA, 22 nt, Homo sapiens
gcaguguggguagagggcaaga

SEQ ID NO: 370239 - RNA, 22 nt, Homo sapiens
gccuagagacuugguaucuugc

SEQ ID NO: 370240 - RNA, 22 nt, Homo sapiens
gccugagaggauaugauccccu

SEQ ID NO: 370241 - RNA, 22 nt, Homo sapiens
gcugagcuaugccauauaugcc

SEQ ID NO: 370242 - RNA, 22 nt, Homo sapiens
gcugcuguuuaguuucuccugg

SEQ ID NO: 370243 - RNA, 22 nt, Homo sapiens
gcugcuguuucucuuucagcau

SEQ ID NO: 370244 - RNA, 22 nt, Homo sapiens
gcuggauguuucaauacaaaua

SEQ ID NO: 370245 - RNA, 22 nt, Homo sapiens
gcuuguguuuacuguaguuacu

SEQ ID NO: 370246 - RNA, 22 nt, Homo sapiens
gcuuguguuugcuccccagaau

SEQ ID NO: 370247 - RNA, 22 nt, Homo sapiens
ggaaagcuagguguggguguac

SEQ ID NO: 370248 - RNA, 22 nt, Homo sapiens
ggaagguaauuggcuaaugaga

SEQ ID NO: 370249 - RNA, 22 nt, Homo sapiens
ggacugagaggacuacagugua

SEQ ID NO: 370250 - RNA, 23 nt, Homo sapiens
ggaguguaaauuauuucaaccau

SEQ ID NO: 370251 - RNA, 22 nt, Homo sapiens
ggauggcauuucuuuagcuuuu

SEQ ID NO: 370252 - RNA, 22 nt, Homo sapiens
ggcaaggaggggcacuuucacu

SEQ ID NO: 370253 - RNA, 22 nt, Homo sapiens
ggcaaggauuagauucuccccu

SEQ ID NO: 370254 - RNA, 22 nt, Homo sapiens
ggcaaugaggcggaccagcagg

SEQ ID NO: 370255 - RNA, 22 nt, Homo sapiens
ggcaaugucagcuaaugaugga

SEQ ID NO: 370256 - RNA, 22 nt, Homo sapiens
ggcacaaugucagcucacugca

SEQ ID NO: 370257 - RNA, 22 nt, Homo sapiens
ggcacaauugcagcaauaaaca

SEQ ID NO: 370258 - RNA, 22 nt, Homo sapiens
ggcagcucaggccccgcgcuga

SEQ ID NO: 370259 - RNA, 22 nt, Homo sapiens
ggcagcuguguccuucguaagg

SEQ ID NO: 370260 - RNA, 22 nt, Homo sapiens
ggcaguguaauaauuuauuaau

SEQ ID NO: 370261 - RNA, 22 nt, Homo sapiens
ggucauggagcuuuacuuuaug

SEQ ID NO: 370262 - RNA, 22 nt, Homo sapiens
ggucugguguugaaauucuuca

SEQ ID NO: 370263 - RNA, 22 nt, Homo sapiens
guaacacaugcugcucucuggu

SEQ ID NO: 370264 - RNA, 19 nt, Homo sapiens
guauuugguaaacucucca

SEQ ID NO: 370265 - RNA, 22 nt, Homo sapiens
gucagcaucaccaugucuauga

SEQ ID NO: 370266 - RNA, 22 nt, Homo sapiens
gucaguggauacugucucuguc

SEQ ID NO: 370267 - RNA, 22 nt, Homo sapiens
gucauccaggcuggagugaagc

SEQ ID NO: 370268 - RNA, 22 nt, Homo sapiens
guccuggagaagcguggaccgg

SEQ ID NO: 370269 - RNA, 21 nt, Homo sapiens
gucugguguuuuaaugaggac

SEQ ID NO: 370270 - RNA, 22 nt, Homo sapiens
gucugguugacagcauguggcc

SEQ ID NO: 370271 - RNA, 22 nt, Homo sapiens
gucugguuggaguaguuuucag

SEQ ID NO: 370272 - RNA, 22 nt, Homo sapiens
gucugugguuccuaugucaccu

SEQ ID NO: 370273 - RNA, 22 nt, Homo sapiens
gugacagucaaagacaugacuu

SEQ ID NO: 370274 - RNA, 22 nt, Homo sapiens
gugacaucagcuccagguauaa

SEQ ID NO: 370275 - RNA, 22 nt, Homo sapiens
gugcacaacaugcaguuuuguu

SEQ ID NO: 370276 - RNA, 22 nt, Homo sapiens
gugcacaacgugcagguuuguu

SEQ ID NO: 370277 - RNA, 22 nt, Homo sapiens
gugggagugucccguuuuucca

SEQ ID NO: 370278 - RNA, 22 nt, Homo sapiens
gugugcauggagggggcaguga

SEQ ID NO: 370279 - RNA, 22 nt, Homo sapiens
guuauguuaaauuguuguaugc

SEQ ID NO: 370280 - RNA, 22 nt, Homo sapiens
guuauguuauguuauguuaugu

SEQ ID NO: 370281 - RNA, 22 nt, Homo sapiens
uaaggcuucuuggaauacugca

SEQ ID NO: 370282 - RNA, 22 nt, Homo sapiens
uaaggcuuuuguucagcguggg

SEQ ID NO: 370283 - RNA, 22 nt, Homo sapiens
uaaucucagcugagcugagauu

SEQ ID NO: 370284 - RNA, 22 nt, Homo sapiens
uacagccacauaauguaugauu

SEQ ID NO: 370285 - RNA, 22 nt, Homo sapiens
uacaggaaugucagguugcugu

SEQ ID NO: 370286 - RNA, 22 nt, Homo sapiens
uacagucuggaggccuguguug

SEQ ID NO: 370287 - RNA, 22 nt, Homo sapiens
uacaguggcaugucaggugcuu

SEQ ID NO: 370288 - RNA, 22 nt, Homo sapiens
uacccaguaacaaguauuuugg

SEQ ID NO: 370289 - RNA, 22 nt, Homo sapiens
uacucaauugcagucaccuggc

SEQ ID NO: 370290 - RNA, 22 nt, Homo sapiens
uacucaguagucuguugcuguc

SEQ ID NO: 370291 - RNA, 20 nt, Homo sapiens
uagcaggugucaggugauau

SEQ ID NO: 370292 - RNA, 22 nt, Homo sapiens
uaggcagccagcuguggauuga

SEQ ID NO: 370293 - RNA, 22 nt, Homo sapiens
uaucaagaugacaaacuuugcu

SEQ ID NO: 370294 - RNA, 22 nt, Homo sapiens
uaucacagcauugucuauaaua

SEQ ID NO: 370295 - RNA, 22 nt, Homo sapiens
uaugacauaguccuuaacccuc

SEQ ID NO: 370296 - RNA, 22 nt, Homo sapiens
uugagauggagcuucacucuug

SEQ ID NO: 370297 - RNA, 22 nt, Homo sapiens
uugagauggagucucacgcauu

SEQ ID NO: 370298 - RNA, 22 nt, Homo sapiens
uugagauggagucucacucugu

SEQ ID NO: 370299 - RNA, 22 nt, Homo sapiens
uugagauggagucucacucuuc

SEQ ID NO: 370300 - RNA, 22 nt, Homo sapiens
uugagauggagucucacucuuu

SEQ ID NO: 370301 - RNA, 22 nt, Homo sapiens
uugagauggagucucguucugu

SEQ ID NO: 370302 - RNA, 22 nt, Homo sapiens
uugagauggagucuugcacugu

SEQ ID NO: 370303 - RNA, 22 nt, Homo sapiens
uugagauggagucuugcucugu

SEQ ID NO: 370304 - RNA, 22 nt, Homo sapiens
uugagauggagucuugcucuug

SEQ ID NO: 370305 - RNA, 22 nt, Homo sapiens
uugagauggagucuuguucucu

SEQ ID NO: 370306 - RNA, 22 nt, Homo sapiens
uugagauggaguuucgcucuug

SEQ ID NO: 370307 - RNA, 22 nt, Homo sapiens
uugagauggaguuuugcucuug

SEQ ID NO: 370308 - RNA, 22 nt, Homo sapiens
uugagauguaagauguuaauau

SEQ ID NO: 370309 - RNA, 22 nt, Homo sapiens
uugagauguaguuucacuccug

SEQ ID NO: 370310 - RNA, 19 nt, Homo sapiens
uugagaugugaacucacac

SEQ ID NO: 370311 - RNA, 22 nt, Homo sapiens
uugauguugaggacauaaaccu

SEQ ID NO: 370312 - RNA, 22 nt, Homo sapiens
uugcauauguugaaccaagcgu

SEQ ID NO: 370313 - RNA, 19 nt, Homo sapiens
uugcauauguugaaccagc

SEQ ID NO: 370314 - RNA, 21 nt, Homo sapiens
uugccugacacuggaagaaau

SEQ ID NO: 370315 - RNA, 22 nt, Homo sapiens
uugccugagaagccaagaauaa

SEQ ID NO: 370316 - RNA, 22 nt, Homo sapiens
uugcuuaggcuggagugcagug

SEQ ID NO: 370317 - RNA, 22 nt, Homo sapiens
uuggaaaaauccaccuugaucu

SEQ ID NO: 370318 - RNA, 20 nt, Homo sapiens
uuggcagagucuuuagggua

SEQ ID NO: 370319 - RNA, 22 nt, Homo sapiens
uuggcauuguggauggaaucau

SEQ ID NO: 370320 - RNA, 21 nt, Homo sapiens
uuguagcagcauaaucccaga

SEQ ID NO: 370321 - RNA, 22 nt, Homo sapiens
uuguaguagcauuauuuauaau

SEQ ID NO: 370322 - RNA, 21 nt, Homo sapiens
uuguccccacccaaaucucau

SEQ ID NO: 370323 - RNA, 22 nt, Homo sapiens
uuguccccacccaaaugucauc

SEQ ID NO: 370324 - RNA, 22 nt, Homo sapiens
uuguugcacugcuuuccuggcc

SEQ ID NO: 370325 - RNA, 22 nt, Homo sapiens
uuuagcaauucauuuugugucu

SEQ ID NO: 370326 - RNA, 22 nt, Homo sapiens
uuuagguagucaaagguuaguc

SEQ ID NO: 370327 - RNA, 22 nt, Homo sapiens
uuuauugcucuaaaguugccau

SEQ ID NO: 370328 - RNA, 17 nt, Homo sapiens
uuucucagcccucuucu

SEQ ID NO: 370329 - RNA, 22 nt, Homo sapiens
uuucugguuaauuucuaagagc

SEQ ID NO: 370330 - RNA, 22 nt, Homo sapiens
uuugaggaaaggcauaaguagg

SEQ ID NO: 370331 - RNA, 22 nt, Homo sapiens
uuuggcagaugacccucaaguu

SEQ ID NO: 370332 - RNA, 22 nt, Homo sapiens
uuuggcuguuucuggacuaaga

SEQ ID NO: 370333 - RNA, 22 nt, Homo sapiens
uuuggguuaguuuuccaaucuu

SEQ ID NO: 370334 - RNA, 22 nt, Homo sapiens
uuuuacacuucgguugugugca

SEQ ID NO: 370335 - RNA, 22 nt, Homo sapiens
uuuuagcaaagagacugguggc

SEQ ID NO: 370336 - RNA, 22 nt, Homo sapiens
uuuuggcuagaaauauaccucc

SEQ ID NO: 370337 - RNA, 22 nt, Homo sapiens
acccaguguucaacauucacau

SEQ ID NO: 370338 - RNA, 22 nt, Homo sapiens
acccaguguucagacuaccugu

SEQ ID NO: 370339 - RNA, 22 nt, Homo sapiens
acccugucaaaacggaccaauc

SEQ ID NO: 370340 - RNA, 22 nt, Homo sapiens
acccugucaaaauagaccaauc

SEQ ID NO: 370341 - RNA, 22 nt, Homo sapiens
acccugucagcuggccugggca

SEQ ID NO: 370342 - RNA, 22 nt, Homo sapiens
acugagccuuuaaaugacuuca

SEQ ID NO: 370343 - RNA, 22 nt, Homo sapiens
agaauaauguccccccaaggga

SEQ ID NO: 370344 - RNA, 22 nt, Homo sapiens
agacuagagcagagcccucucu

SEQ ID NO: 370345 - RNA, 22 nt, Homo sapiens
agaucauaugcaguaaugaacu

SEQ ID NO: 370346 - RNA, 22 nt, Homo sapiens
agauggugauaaaugugguacc

SEQ ID NO: 370347 - RNA, 22 nt, Homo sapiens
agcacagccuuguguuuucuug

SEQ ID NO: 370348 - RNA, 22 nt, Homo sapiens
agcagcucaagacuuaaauuug

SEQ ID NO: 370349 - RNA, 22 nt, Homo sapiens
agcagcucaugccuuugggagg

SEQ ID NO: 370350 - RNA, 21 nt, Homo sapiens
agcagcuuugguugaagcaga

SEQ ID NO: 370351 - RNA, 16 nt, Homo sapiens
agcagguguuagguga

SEQ ID NO: 370352 - RNA, 22 nt, Homo sapiens
agccuguguugaauuauagaaa

SEQ ID NO: 370353 - RNA, 22 nt, Homo sapiens
agcugccagucuuguaaggccu

SEQ ID NO: 370354 - RNA, 22 nt, Homo sapiens
agcugguuuauuucuauauccu

SEQ ID NO: 370355 - RNA, 20 nt, Homo sapiens
agcuguuguuaaaaaggagg

SEQ ID NO: 370356 - RNA, 22 nt, Homo sapiens
agcuguuguuaauuaacucauu

SEQ ID NO: 370357 - RNA, 22 nt, Homo sapiens
agcuguuguuuuaagauacuaa

SEQ ID NO: 370358 - RNA, 22 nt, Homo sapiens
aggaauguuaguacuucuuagu

SEQ ID NO: 370359 - RNA, 22 nt, Homo sapiens
aggagaugaagcuuuaucuaaa

SEQ ID NO: 370360 - RNA, 22 nt, Homo sapiens
aggcaaugugagaguuuauuca

SEQ ID NO: 370361 - RNA, 22 nt, Homo sapiens
aggcagaugagguccucagcug

SEQ ID NO: 370362 - RNA, 22 nt, Homo sapiens
aggcuguguggauaauauuggg

SEQ ID NO: 370363 - RNA, 22 nt, Homo sapiens
aguaacacaccugcauggugug

SEQ ID NO: 370364 - RNA, 22 nt, Homo sapiens
agucaaggaggccuuucagaug

SEQ ID NO: 370365 - RNA, 22 nt, Homo sapiens
agucaugggagagaugugaucg

SEQ ID NO: 370366 - RNA, 22 nt, Homo sapiens
agucaugguaguaaauuuggac

SEQ ID NO: 370367 - RNA, 22 nt, Homo sapiens
agucugguguucucacacuagu

SEQ ID NO: 370368 - RNA, 22 nt, Homo sapiens
agugcaaagccgagguuucuug

SEQ ID NO: 370369 - RNA, 18 nt, Homo sapiens
aguuguuuuauccugccc

SEQ ID NO: 370370 - RNA, 22 nt, Homo sapiens
auacagugaauacuuacagugu

SEQ ID NO: 370371 - RNA, 22 nt, Homo sapiens
auagcacaugugcaaauggcug

SEQ ID NO: 370372 - RNA, 20 nt, Homo sapiens
auagcagcaugauuuauaau

SEQ ID NO: 370373 - RNA, 22 nt, Homo sapiens
auagcagcucacuuauuuaugg

SEQ ID NO: 370374 - RNA, 22 nt, Homo sapiens
auagcagcuugucagggcagac

SEQ ID NO: 370375 - RNA, 22 nt, Homo sapiens
auagcaucauuucuugaaaaga

SEQ ID NO: 370376 - RNA, 22 nt, Homo sapiens
auaugcacaguggaguacuauu

SEQ ID NO: 370377 - RNA, 20 nt, Homo sapiens
auaugcauguguuuucacuu

SEQ ID NO: 370378 - RNA, 22 nt, Homo sapiens
auauugguuaaauauuauguga

SEQ ID NO: 370379 - RNA, 22 nt, Homo sapiens
aucacagugaaaacagucaauu

SEQ ID NO: 370380 - RNA, 20 nt, Homo sapiens
aucaccacagcucguucaug

SEQ ID NO: 370381 - RNA, 19 nt, Homo sapiens
aucaccagucuuuccacug

SEQ ID NO: 370382 - RNA, 22 nt, Homo sapiens
aucaccuuucccuuucugaauc

SEQ ID NO: 370383 - RNA, 22 nt, Homo sapiens
aucucauggagguagagaguaa

SEQ ID NO: 370384 - RNA, 22 nt, Homo sapiens
aucuccaggugccagcugcgcc

SEQ ID NO: 370385 - RNA, 22 nt, Homo sapiens
augaccuuguccucagugucau

SEQ ID NO: 370386 - RNA, 22 nt, Homo sapiens
augacuaaaggguuuauguuga

SEQ ID NO: 370387 - RNA, 22 nt, Homo sapiens
ugggaagaagguuuacuugcca

SEQ ID NO: 370388 - RNA, 21 nt, Homo sapiens
uggucaguuuucucacuagga

SEQ ID NO: 370389 - RNA, 20 nt, Homo sapiens
ugguguuugaacagugaaug

SEQ ID NO: 370390 - RNA, 22 nt, Homo sapiens
uguagcagccauaaacacagug

SEQ ID NO: 370391 - RNA, 22 nt, Homo sapiens
ugucucaguuucuguggguuag

SEQ ID NO: 370392 - RNA, 22 nt, Homo sapiens
ugucuuggaugaggauuaacag

SEQ ID NO: 370393 - RNA, 22 nt, Homo sapiens
ugugaccaaaaucaacauaccu

SEQ ID NO: 370394 - RNA, 19 nt, Homo sapiens
ugugagcauuagcauuuag

SEQ ID NO: 370395 - RNA, 22 nt, Homo sapiens
ugugcuauguuauucacauggg

SEQ ID NO: 370396 - RNA, 22 nt, Homo sapiens
ugugucuuguuuuuucccaggc

SEQ ID NO: 370397 - RNA, 22 nt, Homo sapiens
uuaagugguagguggugcccaa

SEQ ID NO: 370398 - RNA, 22 nt, Homo sapiens
uuagcagccuucaagcuccaag

SEQ ID NO: 370399 - RNA, 22 nt, Homo sapiens
uuagcagcucuggugacaaggu

SEQ ID NO: 370400 - RNA, 22 nt, Homo sapiens
uuaggcucuuuaucaguuaacu

SEQ ID NO: 370401 - RNA, 22 nt, Homo sapiens
uuauaacagagacuccugugcu

SEQ ID NO: 370402 - RNA, 22 nt, Homo sapiens
uuauacacugugggaguguaaa

SEQ ID NO: 370403 - RNA, 22 nt, Homo sapiens
uuauucauuaauugcuaagguu

SEQ ID NO: 370404 - RNA, 22 nt, Homo sapiens
uucaaaaccucugcuuaagccc

SEQ ID NO: 370405 - RNA, 22 nt, Homo sapiens
uucaaaucuucguuuugccaua

SEQ ID NO: 370406 - RNA, 22 nt, Homo sapiens
uucaaaucuuuggcucccacua

SEQ ID NO: 370407 - RNA, 20 nt, Homo sapiens
uucaagugauucucaugccu

SEQ ID NO: 370408 - RNA, 19 nt, Homo sapiens
uucaaugcagcauugccac

SEQ ID NO: 370409 - RNA, 22 nt, Homo sapiens
uucacaguacucccuggaauua

SEQ ID NO: 370410 - RNA, 22 nt, Homo sapiens
uucaccggggaccccuggcugu

SEQ ID NO: 370411 - RNA, 20 nt, Homo sapiens
uucacugggcucucuguugg

SEQ ID NO: 370412 - RNA, 22 nt, Homo sapiens
uucagagugaggcucucggaac

SEQ ID NO: 370413 - RNA, 22 nt, Homo sapiens
uuccaggugggcgugggccugg

SEQ ID NO: 370414 - RNA, 22 nt, Homo sapiens
uuccaguggaguaaauggacaa

SEQ ID NO: 370415 - RNA, 22 nt, Homo sapiens
uuccuggaggggaaguguccaa

SEQ ID NO: 370416 - RNA, 22 nt, Homo sapiens
uuccuugguucagggaaggucc

SEQ ID NO: 370417 - RNA, 22 nt, Homo sapiens
uucuagagagaagacuuaagcu

SEQ ID NO: 370418 - RNA, 22 nt, Homo sapiens
uucucagcccccugacagucag

SEQ ID NO: 370419 - RNA, 22 nt, Homo sapiens
uucugccaaucaacccacaucc

SEQ ID NO: 370420 - RNA, 22 nt, Homo sapiens
uugaacuguaagggucugugug

SEQ ID NO: 370421 - RNA, 17 nt, Homo sapiens
uugaaugcauuacuugg

SEQ ID NO: 370422 - RNA, 21 nt, Homo sapiens
uugagacggagucucacucug

SEQ ID NO: 370423 - RNA, 22 nt, Homo sapiens
uugagaugaagucuugcucucu

SEQ ID NO: 370424 - RNA, 22 nt, Homo sapiens
uugagaugaaguuuugcucuuu

SEQ ID NO: 370425 - RNA, 22 nt, Homo sapiens
uugagauggagucucacucugc

SEQ ID NO: 370426 - RNA, 22 nt, Homo sapiens
uugagauggagucucacucuug

SEQ ID NO: 370427 - RNA, 22 nt, Homo sapiens
uugagauggagucucacugugu

SEQ ID NO: 370428 - RNA, 22 nt, Homo sapiens
uugagauggagucucgcacugu

SEQ ID NO: 370429 - RNA, 22 nt, Homo sapiens
uugagauggagucucgcucugu

SEQ ID NO: 370430 - RNA, 22 nt, Homo sapiens
uugagauggagucucgcucuuu

SEQ ID NO: 370431 - RNA, 22 nt, Homo sapiens
uugagauggagucuuguucuuu

SEQ ID NO: 370432 - RNA, 22 nt, Homo sapiens
uugagauggaguucauuuuugu

SEQ ID NO: 370433 - RNA, 22 nt, Homo sapiens
uugagauggaguuucacucucg

SEQ ID NO: 370434 - RNA, 22 nt, Homo sapiens
uugagauggaguuucacucuug

SEQ ID NO: 370435 - RNA, 22 nt, Homo sapiens
uugagauggaguuucgcucuuu

SEQ ID NO: 370436 - RNA, 22 nt, Homo sapiens
uugcacuuccgccugggugaca

SEQ ID NO: 370437 - RNA, 22 nt, Homo sapiens
uugcagagccccacacugggcu

SEQ ID NO: 370438 - RNA, 22 nt, Homo sapiens
uugcagagccccugcaaggguc

SEQ ID NO: 370439 - RNA, 22 nt, Homo sapiens
uugcauuuucuaggagggcaaa

SEQ ID NO: 370440 - RNA, 22 nt, Homo sapiens
uugcucaggcuagaguucagcu

SEQ ID NO: 370441 - RNA, 22 nt, Homo sapiens
uuggaaaccucugcagguguuu

SEQ ID NO: 370442 - RNA, 22 nt, Homo sapiens
uuggcaaguccccaccucucuc

SEQ ID NO: 370443 - RNA, 22 nt, Homo sapiens
uuggcagaguuaauuuguugag

SEQ ID NO: 370444 - RNA, 22 nt, Homo sapiens
uuggcagcacgcaguccagagg

SEQ ID NO: 370445 - RNA, 22 nt, Homo sapiens
uuggcccugcugaccauucccu

SEQ ID NO: 370446 - RNA, 22 nt, Homo sapiens
uugggcaauaggaagcaggugg

SEQ ID NO: 370447 - RNA, 22 nt, Homo sapiens
uuggggcacggccucuguugcc

SEQ ID NO: 370448 - RNA, 21 nt, Homo sapiens
uuggucuucucugugauucuu

SEQ ID NO: 370449 - RNA, 22 nt, Homo sapiens
uuguccccaucugcugccagaa

SEQ ID NO: 370450 - RNA, 23 nt, Homo sapiens
uuguccccuccaaagcucauguu

SEQ ID NO: 370451 - RNA, 22 nt, Homo sapiens
uugugcuuuugagcugagauga

SEQ ID NO: 370452 - RNA, 19 nt, Homo sapiens
uugugggaggacagagggg

SEQ ID NO: 370453 - RNA, 22 nt, Homo sapiens
uugugguaggcauguaagauga

SEQ ID NO: 370454 - RNA, 22 nt, Homo sapiens
uuuccagguggccaacauuuua

SEQ ID NO: 370455 - RNA, 22 nt, Homo sapiens
uuucucaguguuucaggguagg

SEQ ID NO: 370456 - RNA, 22 nt, Homo sapiens
uuucugugguccucuugaaggu

SEQ ID NO: 370457 - RNA, 22 nt, Homo sapiens
uuugggaaaugaaguugguaga

SEQ ID NO: 370458 - RNA, 22 nt, Homo sapiens
uuugggaaugaguuuaucauuu

SEQ ID NO: 370459 - RNA, 22 nt, Homo sapiens
uuugggaaugguuugucuccca

SEQ ID NO: 370460 - RNA, 22 nt, Homo sapiens
uuuuacacuguugguuggaaug

SEQ ID NO: 370461 - RNA, 22 nt, Homo sapiens
uuuugcaguuacagagagugag

SEQ ID NO: 370462 - RNA, 18 nt, Homo sapiens
uuuuugaggcacagggga

SEQ ID NO: 370463 - RNA, 22 nt, Homo sapiens
ugauaugaaguucaaaccaggu

SEQ ID NO: 370464 - RNA, 22 nt, Homo sapiens
ugauggcauuuggaguugggac

SEQ ID NO: 370465 - RNA, 22 nt, Homo sapiens
ugcagugugauuuucuggcuga

SEQ ID NO: 370466 - RNA, 21 nt, Homo sapiens
ugcagugugguugcccugcug

SEQ ID NO: 370467 - RNA, 22 nt, Homo sapiens
ugcauguucuuacucauacaug

SEQ ID NO: 370468 - RNA, 22 nt, Homo sapiens
ugccaguauuuuauuaagaauu

SEQ ID NO: 370469 - RNA, 20 nt, Homo sapiens
uggaaucugaagaucucagu

SEQ ID NO: 370470 - RNA, 22 nt, Homo sapiens
uggcaaagugugacgugggggu

SEQ ID NO: 370471 - RNA, 22 nt, Homo sapiens
uggcacuggagauacauuaaua

SEQ ID NO: 370472 - RNA, 19 nt, Homo sapiens
uggcacuugacguccggau

SEQ ID NO: 370473 - RNA, 22 nt, Homo sapiens
uggcagauggugacaccauuag

SEQ ID NO: 370474 - RNA, 22 nt, Homo sapiens
uggcaguuucacauggcucaac

SEQ ID NO: 370475 - RNA, 22 nt, Homo sapiens
uggcuaaguuaaucaaggagau

SEQ ID NO: 370476 - RNA, 22 nt, Homo sapiens
ugggcaguauggucauuuucgu

SEQ ID NO: 370477 - RNA, 22 nt, Homo sapiens
ugggcagugggacagcuuugug

SEQ ID NO: 370478 - RNA, 22 nt, Homo sapiens
ugguguccugucucugcgcuug

SEQ ID NO: 370479 - RNA, 22 nt, Homo sapiens
uguagacagcacguaguugagu

SEQ ID NO: 370480 - RNA, 21 nt, Homo sapiens
uguagcagcauaauuuauaau

SEQ ID NO: 370481 - RNA, 21 nt, Homo sapiens
uguagcagcaugauuuauaau

SEQ ID NO: 370482 - RNA, 20 nt, Homo sapiens
ugucauuaagcacugugcca

SEQ ID NO: 370483 - RNA, 22 nt, Homo sapiens
ugucucaguuacggcaauucca

SEQ ID NO: 370484 - RNA, 22 nt, Homo sapiens
ugucuuguagacaauguauagu

SEQ ID NO: 370485 - RNA, 22 nt, Homo sapiens
ugugacagcacagcaucucuuu

SEQ ID NO: 370486 - RNA, 22 nt, Homo sapiens
ugugccuucuaagaaggagucu

SEQ ID NO: 370487 - RNA, 22 nt, Homo sapiens
ugugcuaaaaugggacuucuaa

SEQ ID NO: 370488 - RNA, 22 nt, Homo sapiens
ugugcuugaaauucaguuuuga

SEQ ID NO: 370489 - RNA, 20 nt, Homo sapiens
uguggcacuguaucucucag

SEQ ID NO: 370490 - RNA, 22 nt, Homo sapiens
uguggcagugcuuuaugaaacc

SEQ ID NO: 370491 - RNA, 22 nt, Homo sapiens
uguguuuuuauguaaaauggaa

SEQ ID NO: 370492 - RNA, 22 nt, Homo sapiens
uguuugguggucucuucacaug

SEQ ID NO: 370493 - RNA, 19 nt, Homo sapiens
uuacacaaccuaguggggc

SEQ ID NO: 370494 - RNA, 22 nt, Homo sapiens
uuagcagcacaaaagcagacua

SEQ ID NO: 370495 - RNA, 22 nt, Homo sapiens
uuagcagcaccccacucuacug

SEQ ID NO: 370496 - RNA, 22 nt, Homo sapiens
uuagcagcaucccuggccugua

SEQ ID NO: 370497 - RNA, 22 nt, Homo sapiens
uuagcagcaugaaaauggacug

SEQ ID NO: 370498 - RNA, 20 nt, Homo sapiens
uuagcagcaugauuuauaau

SEQ ID NO: 370499 - RNA, 21 nt, Homo sapiens
uuagccuguaagcacuuugca

SEQ ID NO: 370500 - RNA, 23 nt, Homo sapiens
uuaguaaacucaaugacaccaca

SEQ ID NO: 370501 - RNA, 22 nt, Homo sapiens
uuauggcuauugaugacaauug

SEQ ID NO: 370502 - RNA, 16 nt, Homo sapiens
uuauugcauucuucuc

SEQ ID NO: 370503 - RNA, 22 nt, Homo sapiens
uuauuugguuauuguaauuggg

SEQ ID NO: 370504 - RNA, 22 nt, Homo sapiens
uucaagucaacaagcacuugag

SEQ ID NO: 370505 - RNA, 22 nt, Homo sapiens
uucaauuaauauuauacucuca

SEQ ID NO: 370506 - RNA, 22 nt, Homo sapiens
uuccaguauuugggcaagcgca

SEQ ID NO: 370507 - RNA, 22 nt, Homo sapiens
uuccuuguuuauuuacaggagg

SEQ ID NO: 370508 - RNA, 22 nt, Homo sapiens
uucuaaguaauuuugcaugccu

SEQ ID NO: 370509 - RNA, 22 nt, Homo sapiens
uucugagguuauauucucucaa

SEQ ID NO: 370510 - RNA, 22 nt, Homo sapiens
uucugcuugaucuaguguguug

SEQ ID NO: 370511 - RNA, 22 nt, Homo sapiens
uucugguuaauacuugcaaaaa

SEQ ID NO: 370512 - RNA, 22 nt, Homo sapiens
uugagacgaagucucacucuug

SEQ ID NO: 370513 - RNA, 22 nt, Homo sapiens
uugagaugauggauaugcuaau

SEQ ID NO: 370514 - RNA, 22 nt, Homo sapiens
uugagauggagucucgcugugu

SEQ ID NO: 370515 - RNA, 22 nt, Homo sapiens
uugagauguauguauauaaugu

SEQ ID NO: 370516 - RNA, 22 nt, Homo sapiens
uugagauguggcaguuuaugag

SEQ ID NO: 370517 - RNA, 22 nt, Homo sapiens
uugagggcugaauaccaaucag

SEQ ID NO: 370518 - RNA, 22 nt, Homo sapiens
uugcaaaucucuuguguuuggu

SEQ ID NO: 370519 - RNA, 22 nt, Homo sapiens
uuggcaagaauguaugccgauc

SEQ ID NO: 370520 - RNA, 22 nt, Homo sapiens
uuggcaaguuucugucagcaaa

SEQ ID NO: 370521 - RNA, 22 nt, Homo sapiens
uuggcagaaaaggucggggguu

SEQ ID NO: 370522 - RNA, 22 nt, Homo sapiens
uuggcagaauguuagaaacuua

SEQ ID NO: 370523 - RNA, 19 nt, Homo sapiens
uuggcagaguugcccccua

SEQ ID NO: 370524 - RNA, 22 nt, Homo sapiens
uuggcagcauuccagccaagca

SEQ ID NO: 370525 - RNA, 22 nt, Homo sapiens
uuggcagcuguggaaucugggc

SEQ ID NO: 370526 - RNA, 22 nt, Homo sapiens
uuggucaggcuagaguguggug

SEQ ID NO: 370527 - RNA, 20 nt, Homo sapiens
uuggugaccuacagaugugg

SEQ ID NO: 370528 - RNA, 22 nt, Homo sapiens
uugucucacuggaguuuaguaa

SEQ ID NO: 370529 - RNA, 22 nt, Homo sapiens
uugugggaggugauuagaucau

SEQ ID NO: 370530 - RNA, 22 nt, Homo sapiens
uugugguaggaugaagagauga

SEQ ID NO: 370531 - RNA, 22 nt, Homo sapiens
uuguguuugaugcugacacgca

SEQ ID NO: 370532 - RNA, 22 nt, Homo sapiens
uuuagcagcaaagagccaugcu

SEQ ID NO: 370533 - RNA, 22 nt, Homo sapiens
uuucauggacgcaaugccuuuu

SEQ ID NO: 370534 - RNA, 22 nt, Homo sapiens
uuugagaucuuuagaaucaggc

SEQ ID NO: 370535 - RNA, 22 nt, Homo sapiens
uuuggcagaaaacaagaaucug

SEQ ID NO: 370536 - RNA, 22 nt, Homo sapiens
uuuguguggccuuggccuggca

SEQ ID NO: 370537 - RNA, 22 nt, Homo sapiens
uuuguuugaagucgagacaacu

SEQ ID NO: 370538 - RNA, 19 nt, Homo sapiens
uuuuggaaaugugaacagc

SEQ ID NO: 370539 - RNA, 22 nt, Homo sapiens
uuuuggcacuuugucugauucu

SEQ ID NO: 370540 - RNA, 22 nt, Homo sapiens
ugcaaugugaaauaagcacauc

SEQ ID NO: 370541 - RNA, 20 nt, Homo sapiens
ugcaguguccucacuuguca

SEQ ID NO: 370542 - RNA, 22 nt, Homo sapiens
ugcauauguauacaugugccau

SEQ ID NO: 370543 - RNA, 19 nt, Homo sapiens
ugccauguagcacaugguc

SEQ ID NO: 370544 - RNA, 18 nt, Homo sapiens
ugccuacugggcucaagc

SEQ ID NO: 370545 - RNA, 22 nt, Homo sapiens
ugccugagccagguuuuaggag

SEQ ID NO: 370546 - RNA, 22 nt, Homo sapiens
ugcugguuuucaucaucagugg

SEQ ID NO: 370547 - RNA, 22 nt, Homo sapiens
uggaaaauuaggggagguuaua

SEQ ID NO: 370548 - RNA, 20 nt, Homo sapiens
uggaaucuaggcggagguuu

SEQ ID NO: 370549 - RNA, 21 nt, Homo sapiens
uggaaucuauuauuccaguuu

SEQ ID NO: 370550 - RNA, 22 nt, Homo sapiens
uggagguagacauugggaagag

SEQ ID NO: 370551 - RNA, 20 nt, Homo sapiens
uggagugcuguguugagaag

SEQ ID NO: 370552 - RNA, 22 nt, Homo sapiens
uggcaagcuuuaauugacucuu

SEQ ID NO: 370553 - RNA, 22 nt, Homo sapiens
uggcagauaggauacaggacua

SEQ ID NO: 370554 - RNA, 22 nt, Homo sapiens
uggcaguuucauaugguucaac

SEQ ID NO: 370555 - RNA, 22 nt, Homo sapiens
uggcauggaguggauggcccca

SEQ ID NO: 370556 - RNA, 22 nt, Homo sapiens
uggcaugucagguuucuggguu

SEQ ID NO: 370557 - RNA, 22 nt, Homo sapiens
auagugcuuuuuagaaccugga

SEQ ID NO: 370558 - RNA, 22 nt, Homo sapiens
auauaugcuaagugcuaauaaa

SEQ ID NO: 370559 - RNA, 22 nt, Homo sapiens
auaugcacgugcauacacacuu

SEQ ID NO: 370560 - RNA, 22 nt, Homo sapiens
auaugcacuauacacacguaua

SEQ ID NO: 370561 - RNA, 18 nt, Homo sapiens
auauugcauuggauggau

SEQ ID NO: 370562 - RNA, 22 nt, Homo sapiens
aucacaggcaaaauuccuucuc

SEQ ID NO: 370563 - RNA, 22 nt, Homo sapiens
aucacauggccagguaguaauc

SEQ ID NO: 370564 - RNA, 22 nt, Homo sapiens
aucccaguaaaaauggcuucua

SEQ ID NO: 370565 - RNA, 22 nt, Homo sapiens
auccucugagagaguuucauaa

SEQ ID NO: 370566 - RNA, 22 nt, Homo sapiens
aucucagcaacuaaagauccuu

SEQ ID NO: 370567 - RNA, 22 nt, Homo sapiens
aucuguagauucagcacaagcu

SEQ ID NO: 370568 - RNA, 22 nt, Homo sapiens
augaacagagccuugagaaccu

SEQ ID NO: 370569 - RNA, 22 nt, Homo sapiens
augacacugcagagauguccca

SEQ ID NO: 370570 - RNA, 22 nt, Homo sapiens
augaccuuggggaaccaugucu

SEQ ID NO: 370571 - RNA, 18 nt, Homo sapiens
augacucuggguguuccu

SEQ ID NO: 370572 - RNA, 22 nt, Homo sapiens
augacuuuucugaaaaccacca

SEQ ID NO: 370573 - RNA, 22 nt, Homo sapiens
augagcuguuuggaagacacuu

SEQ ID NO: 370574 - RNA, 22 nt, Homo sapiens
augagggcggacgcccuggaga

SEQ ID NO: 370575 - RNA, 20 nt, Homo sapiens
augagguguaugacacugaa

SEQ ID NO: 370576 - RNA, 22 nt, Homo sapiens
augcagcugaggguaguggagc

SEQ ID NO: 370577 - RNA, 22 nt, Homo sapiens
augccacuguuuaugucacuua

SEQ ID NO: 370578 - RNA, 22 nt, Homo sapiens
auggcaaaaaaugcaauuacuu

SEQ ID NO: 370579 - RNA, 22 nt, Homo sapiens
auggcagcugguuuuacccuag

SEQ ID NO: 370580 - RNA, 20 nt, Homo sapiens
auggcccugcugggaguguc

SEQ ID NO: 370581 - RNA, 23 nt, Homo sapiens
auggcccuggugggagugucuuu

SEQ ID NO: 370582 - RNA, 22 nt, Homo sapiens
auggcccuguguggagcugcug

SEQ ID NO: 370583 - RNA, 22 nt, Homo sapiens
auggucccuguuccaugcuccu

SEQ ID NO: 370584 - RNA, 22 nt, Homo sapiens
auguaguagcagaaaauauuuu

SEQ ID NO: 370585 - RNA, 22 nt, Homo sapiens
augugacagcaacccccagccc

SEQ ID NO: 370586 - RNA, 22 nt, Homo sapiens
augugggaggaauguguuucca

SEQ ID NO: 370587 - RNA, 22 nt, Homo sapiens
auguguauuaccucgauuguga

SEQ ID NO: 370588 - RNA, 20 nt, Homo sapiens
auguucuggaggacagaagc

SEQ ID NO: 370589 - RNA, 22 nt, Homo sapiens
auguugcuugaaggcauuuugu

SEQ ID NO: 370590 - RNA, 22 nt, Homo sapiens
auuuggcaauuuugaagaugcc

SEQ ID NO: 370591 - RNA, 22 nt, Homo sapiens
auuuggcauagaguaucauucu

SEQ ID NO: 370592 - RNA, 22 nt, Homo sapiens
caaaugaucugcuggccucagc

SEQ ID NO: 370593 - RNA, 22 nt, Homo sapiens
caacugcucacuccuggguuca

SEQ ID NO: 370594 - RNA, 22 nt, Homo sapiens
cacaccuacuagggccgugggc

SEQ ID NO: 370595 - RNA, 22 nt, Homo sapiens
cacagcuagucaaugguagaca

SEQ ID NO: 370596 - RNA, 22 nt, Homo sapiens
cacagucuugcaauauugagau

SEQ ID NO: 370597 - RNA, 22 nt, Homo sapiens
cacauguuugcuacauuuuucu

SEQ ID NO: 370598 - RNA, 22 nt, Homo sapiens
cagccggguggcuccuagggua

SEQ ID NO: 370599 - RNA, 22 nt, Homo sapiens
caguuacuugacacaaccaauu

SEQ ID NO: 370600 - RNA, 22 nt, Homo sapiens
cauacaugugcuugucuuaugc

SEQ ID NO: 370601 - RNA, 22 nt, Homo sapiens
caucacagcaaguagggagugg

SEQ ID NO: 370602 - RNA, 22 nt, Homo sapiens
cauugcagauccuucaaaugac

SEQ ID NO: 370603 - RNA, 22 nt, Homo sapiens
cauugcaguaagagugggcucu

SEQ ID NO: 370604 - RNA, 22 nt, Homo sapiens
cauuggugauuagugaaugaac

SEQ ID NO: 370605 - RNA, 18 nt, Homo sapiens
ccagugcaaggaaagccc

SEQ ID NO: 370606 - RNA, 21 nt, Homo sapiens
ccaguguaaugauagcaggca

SEQ ID NO: 370607 - RNA, 21 nt, Homo sapiens
ccauggcaaugguaaacugac

SEQ ID NO: 370608 - RNA, 22 nt, Homo sapiens
ccauggcaauggucagucuauu

SEQ ID NO: 370609 - RNA, 22 nt, Homo sapiens
cccagugguuacauaaggagua

SEQ ID NO: 370610 - RNA, 22 nt, Homo sapiens
cccugagaugugaauuucagag

SEQ ID NO: 370611 - RNA, 22 nt, Homo sapiens
cccugagcagccugaguuuccc

SEQ ID NO: 370612 - RNA, 22 nt, Homo sapiens
cccuuagaauuuuguaguuauu

SEQ ID NO: 370613 - RNA, 19 nt, Homo sapiens
ccugcuguucuuuugcacc

SEQ ID NO: 370614 - RNA, 22 nt, Homo sapiens
cuagagagaagcugugugaccu

SEQ ID NO: 370615 - RNA, 22 nt, Homo sapiens
cuagaguguaguuuucuuagga

SEQ ID NO: 370616 - RNA, 22 nt, Homo sapiens
cuauauacugccugcugauuag

SEQ ID NO: 370617 - RNA, 19 nt, Homo sapiens
cuauugcacauagcugaag

SEQ ID NO: 370618 - RNA, 22 nt, Homo sapiens
cuauuugguuggugaaaaaagu

SEQ ID NO: 370619 - RNA, 22 nt, Homo sapiens
cucacagugacacgaaccccca

SEQ ID NO: 370620 - RNA, 22 nt, Homo sapiens
cucauugcaaucuccaccuccc

SEQ ID NO: 370621 - RNA, 22 nt, Homo sapiens
cucugagccugagguuccuacu

SEQ ID NO: 370622 - RNA, 18 nt, Homo sapiens
cugagucauuccuggguc

SEQ ID NO: 370623 - RNA, 22 nt, Homo sapiens
cugaucuggaggugucugggga

SEQ ID NO: 370624 - RNA, 22 nt, Homo sapiens
cugcagaucuuggggcuugcca

SEQ ID NO: 370625 - RNA, 22 nt, Homo sapiens
cuggaagcacaacgcauuuauu

SEQ ID NO: 370626 - RNA, 22 nt, Homo sapiens
cuggagcaaaggugacucuugu

SEQ ID NO: 370627 - RNA, 22 nt, Homo sapiens
cuggaguaugauguuagcguug

SEQ ID NO: 370628 - RNA, 19 nt, Homo sapiens
cuguuguacuccaggcauu

SEQ ID NO: 370629 - RNA, 22 nt, Homo sapiens
cuucaagucuuuggauaauuag

SEQ ID NO: 370630 - RNA, 22 nt, Homo sapiens
cuucucagugcucaucuuauuu

SEQ ID NO: 370631 - RNA, 17 nt, Homo sapiens
cuuguugugguaguuug

SEQ ID NO: 370632 - RNA, 22 nt, Homo sapiens
cuuuacacauccuaaccagugu

SEQ ID NO: 370633 - RNA, 22 nt, Homo sapiens
cuuuggucaauugcugugggga

SEQ ID NO: 370634 - RNA, 23 nt, Homo sapiens
cuuuggucucugguugacuucag

SEQ ID NO: 370635 - RNA, 22 nt, Homo sapiens
cuuuugugauuccucaguuacu

SEQ ID NO: 370636 - RNA, 21 nt, Homo sapiens
gaaauacugccuuaggagcug

SEQ ID NO: 370637 - RNA, 22 nt, Homo sapiens
gaaggcacugugugccacccug

SEQ ID NO: 370638 - RNA, 22 nt, Homo sapiens
gaagugcuuuuggacuaacagu

SEQ ID NO: 370639 - RNA, 22 nt, Homo sapiens
gacauguuuucaagauuuauaa

SEQ ID NO: 370640 - RNA, 22 nt, Homo sapiens
gacauguuuucauguauuugga

SEQ ID NO: 370641 - RNA, 22 nt, Homo sapiens
gagaacagaagcauuccuaauu

SEQ ID NO: 370642 - RNA, 22 nt, Homo sapiens
gagagguaguuuuuuggucguc

SEQ ID NO: 370643 - RNA, 22 nt, Homo sapiens
gagagugcuuggcaucugcuga

SEQ ID NO: 370644 - RNA, 22 nt, Homo sapiens
gagagugcuuuggguguaggcc

SEQ ID NO: 370645 - RNA, 22 nt, Homo sapiens
gagauguuuuguuaucaaagga

SEQ ID NO: 370646 - RNA, 22 nt, Homo sapiens
gagcuguuuuucacuagaccaa

SEQ ID NO: 370647 - RNA, 22 nt, Homo sapiens
gaggaucucuugagcccagaag

SEQ ID NO: 370648 - RNA, 22 nt, Homo sapiens
gagugcaagguuuuucugagug

SEQ ID NO: 370649 - RNA, 22 nt, Homo sapiens
gaucugagaaagugucauaaca

SEQ ID NO: 370650 - RNA, 22 nt, Homo sapiens
gauggcagugcagccccuggcu

SEQ ID NO: 370651 - RNA, 22 nt, Homo sapiens
gauguagaaagagugggcugga

SEQ ID NO: 370652 - RNA, 22 nt, Homo sapiens
gcaaaugcuacaccauuuugua

SEQ ID NO: 370653 - RNA, 22 nt, Homo sapiens
gcaauguuacugaauguguuuu

SEQ ID NO: 370654 - RNA, 22 nt, Homo sapiens
gcacaguguuacuugauauauu

SEQ ID NO: 370655 - RNA, 22 nt, Homo sapiens
gcaccccuuaccgggcuggguu

SEQ ID NO: 370656 - RNA, 22 nt, Homo sapiens
gcaguguuggggccggaggcug

SEQ ID NO: 370657 - RNA, 22 nt, Homo sapiens
guaguuuaucagaaagaauagg

SEQ ID NO: 370658 - RNA, 22 nt, Homo sapiens
gucaggaccucgguggcauucu

SEQ ID NO: 370659 - RNA, 22 nt, Homo sapiens
gucuguuuggggaccuguggcc

SEQ ID NO: 370660 - RNA, 22 nt, Homo sapiens
gugaacuguuugaggaagagaa

SEQ ID NO: 370661 - RNA, 22 nt, Homo sapiens
gugacauuuuuacugaugagag

SEQ ID NO: 370662 - RNA, 22 nt, Homo sapiens
gugcacaaaucuuaaauguaca

SEQ ID NO: 370663 - RNA, 22 nt, Homo sapiens
gugcaugucuaugcgagucuaa

SEQ ID NO: 370664 - RNA, 22 nt, Homo sapiens
gugccacugcacuccggccugg

SEQ ID NO: 370665 - RNA, 22 nt, Homo sapiens
guggcaaggaaaugcugcucac

SEQ ID NO: 370666 - RNA, 22 nt, Homo sapiens
guggcagaacagguaggguucu

SEQ ID NO: 370667 - RNA, 22 nt, Homo sapiens
guggcauuucccaaaguauucu

SEQ ID NO: 370668 - RNA, 22 nt, Homo sapiens
gugggaagcuggaacucccucc

SEQ ID NO: 370669 - RNA, 22 nt, Homo sapiens
gugguagaaaguaccaaacuag

SEQ ID NO: 370670 - RNA, 22 nt, Homo sapiens
guguaaaucaaucuguugucuu

SEQ ID NO: 370671 - RNA, 22 nt, Homo sapiens
guguccucgaguacacaucagg

SEQ ID NO: 370672 - RNA, 21 nt, Homo sapiens
gugugcuugaauucagcuguc

SEQ ID NO: 370673 - RNA, 23 nt, Homo sapiens
gugugguaggcuauaccaucuag

SEQ ID NO: 370674 - RNA, 22 nt, Homo sapiens
guuauugcucucgaagacucuc

SEQ ID NO: 370675 - RNA, 22 nt, Homo sapiens
guuugcacuccuaugagaaucu

SEQ ID NO: 370676 - RNA, 22 nt, Homo sapiens
uaacaccuuugauagcacuuuu

SEQ ID NO: 370677 - RNA, 20 nt, Homo sapiens
uaagccacacagucuaaggu

SEQ ID NO: 370678 - RNA, 16 nt, Homo sapiens
uaagccccacgugcau

SEQ ID NO: 370679 - RNA, 22 nt, Homo sapiens
uaaggaacucugauaucuggaa

SEQ ID NO: 370680 - RNA, 22 nt, Homo sapiens
uaaggcuuugcuggacucaguc

SEQ ID NO: 370681 - RNA, 22 nt, Homo sapiens
uaaggcuuugucuuaggacuuu

SEQ ID NO: 370682 - RNA, 21 nt, Homo sapiens
uaauggcaugaucucggcuca

SEQ ID NO: 370683 - RNA, 20 nt, Homo sapiens
uacacguguagcauucucua

SEQ ID NO: 370684 - RNA, 22 nt, Homo sapiens
uacagucuagaggagaaucagg

SEQ ID NO: 370685 - RNA, 22 nt, Homo sapiens
uacaguggugugaucucagcuc

SEQ ID NO: 370686 - RNA, 22 nt, Homo sapiens
uagaagcuacucuucuuguggc

SEQ ID NO: 370687 - RNA, 22 nt, Homo sapiens
uagaguguaaaccacauaguga

SEQ ID NO: 370688 - RNA, 22 nt, Homo sapiens
uagauaguaaagccauuagcuu

SEQ ID NO: 370689 - RNA, 22 nt, Homo sapiens
uagaucauauucagugcuuacu

SEQ ID NO: 370690 - RNA, 22 nt, Homo sapiens
uagaucuuuaaaaggugcuaga

SEQ ID NO: 370691 - RNA, 22 nt, Homo sapiens
uagcaaaucaauggaauugaag

SEQ ID NO: 370692 - RNA, 22 nt, Homo sapiens
uaggaaguuuucuugcugggcc

SEQ ID NO: 370693 - RNA, 22 nt, Homo sapiens
uaggcaauggagauagaggaug

SEQ ID NO: 370694 - RNA, 22 nt, Homo sapiens
uaggucuuuuagcauaggagcu

SEQ ID NO: 370695 - RNA, 22 nt, Homo sapiens
uaggucuuuuaugaaauauauu

SEQ ID NO: 370696 - RNA, 22 nt, Homo sapiens
uaguagagauggggcacaugcc

SEQ ID NO: 370697 - RNA, 22 nt, Homo sapiens
uaguuuaucuucuggauggaca

SEQ ID NO: 370698 - RNA, 22 nt, Homo sapiens
uauaucacaugcacucauuuuc

SEQ ID NO: 370699 - RNA, 22 nt, Homo sapiens
uaucaagauggauaaggauaga

SEQ ID NO: 370700 - RNA, 21 nt, Homo sapiens
uaucacaguagaauaggaucu

SEQ ID NO: 370701 - RNA, 21 nt, Homo sapiens
uaucagagacauugagaggca

SEQ ID NO: 370702 - RNA, 23 nt, Homo sapiens
uaugccuguuucaaacaaacuuu

SEQ ID NO: 370703 - RNA, 22 nt, Homo sapiens
uauuaguuuucuguggauuaca

SEQ ID NO: 370704 - RNA, 22 nt, Homo sapiens
uauugcagugagauccaucugg

SEQ ID NO: 370705 - RNA, 22 nt, Homo sapiens
ucaaagugagcuccuucucacu

SEQ ID NO: 370706 - RNA, 22 nt, Homo sapiens
ucaaagugcuauggcucagguu

SEQ ID NO: 370707 - RNA, 22 nt, Homo sapiens
ucaaaucaucuuuuccaaagcu

SEQ ID NO: 370708 - RNA, 22 nt, Homo sapiens
ucaacagugggcacuguaaaug

SEQ ID NO: 370709 - RNA, 18 nt, Homo sapiens
ucaagcuauugucaugcc

SEQ ID NO: 370710 - RNA, 22 nt, Homo sapiens
ucaaggcaguggccuuccuucu

SEQ ID NO: 370711 - RNA, 21 nt, Homo sapiens
ucaccuguagcugcauguucu

SEQ ID NO: 370712 - RNA, 22 nt, Homo sapiens
ucacugaaaccacugccuccug

SEQ ID NO: 370713 - RNA, 22 nt, Homo sapiens
ucacugaaaccuccgccuucug

SEQ ID NO: 370714 - RNA, 22 nt, Homo sapiens
ucagggacgcuugacacaagcc

SEQ ID NO: 370715 - RNA, 22 nt, Homo sapiens
ucaguaccugagagugggcaga

SEQ ID NO: 370716 - RNA, 22 nt, Homo sapiens
ucagugccauugccauaugagu

SEQ ID NO: 370717 - RNA, 22 nt, Homo sapiens
ucagugccucaguuuuuaaaga

SEQ ID NO: 370718 - RNA, 22 nt, Homo sapiens
ucauacgucuccuugugccacc

SEQ ID NO: 370719 - RNA, 22 nt, Homo sapiens
ucauacuguugugaaacaaaac

SEQ ID NO: 370720 - RNA, 21 nt, Homo sapiens
uccagcuuugagaguuguggu

SEQ ID NO: 370721 - RNA, 19 nt, Homo sapiens
uccaugagcccacagugau

SEQ ID NO: 370722 - RNA, 22 nt, Homo sapiens
uccauggagacacauuuuauau

SEQ ID NO: 370723 - RNA, 22 nt, Homo sapiens
ucccauguagcuaggauuacag

SEQ ID NO: 370724 - RNA, 22 nt, Homo sapiens
ucccugaguaucuaauguguuu

SEQ ID NO: 370725 - RNA, 19 nt, Homo sapiens
ucccugagucuuagcuuga

SEQ ID NO: 370726 - RNA, 22 nt, Homo sapiens
ucccuggagcaagagaagaagg

SEQ ID NO: 370727 - RNA, 22 nt, Homo sapiens
ucuauugguaggggcugaggca

SEQ ID NO: 370728 - RNA, 22 nt, Homo sapiens
ucucugaaacucuugacauccu

SEQ ID NO: 370729 - RNA, 22 nt, Homo sapiens
ucugacucugugaugggcccaa

SEQ ID NO: 370730 - RNA, 20 nt, Homo sapiens
ucuggccccuccaaaucuca

SEQ ID NO: 370731 - RNA, 22 nt, Homo sapiens
ucugguguuacugagccuccca

SEQ ID NO: 370732 - RNA, 22 nt, Homo sapiens
ucugucuuguccucacccuaga

SEQ ID NO: 370733 - RNA, 19 nt, Homo sapiens
ucugugcuugucccccugu

SEQ ID NO: 370734 - RNA, 22 nt, Homo sapiens
ucuuugauaagauccagaagaa

SEQ ID NO: 370735 - RNA, 22 nt, Homo sapiens
ucuuugauuuuguuacuaagac

SEQ ID NO: 370736 - RNA, 22 nt, Homo sapiens
ucuuuggguagauauguagcug

SEQ ID NO: 370737 - RNA, 22 nt, Homo sapiens
ucuuuggguguauuucacagcc

SEQ ID NO: 370738 - RNA, 22 nt, Homo sapiens
ucuuugguaauggaugucugau

SEQ ID NO: 370739 - RNA, 22 nt, Homo sapiens
ucuuugguauugugaauagugu

SEQ ID NO: 370740 - RNA, 22 nt, Homo sapiens
ucuuuggucaucaugggaagca

SEQ ID NO: 370741 - RNA, 22 nt, Homo sapiens
ugaaggacauaaggcagaguga

SEQ ID NO: 370742 - RNA, 22 nt, Homo sapiens
ugaaggccgggcaugguggcuc

SEQ ID NO: 370743 - RNA, 20 nt, Homo sapiens
ugaauguaauuacagaugua

SEQ ID NO: 370744 - RNA, 22 nt, Homo sapiens
ugacuugaucauuacacauucu

SEQ ID NO: 370745 - RNA, 22 nt, Homo sapiens
ugagaagacaucuuugcuuugu

SEQ ID NO: 370746 - RNA, 22 nt, Homo sapiens
ugagaagugauauagaaguuaa

SEQ ID NO: 370747 - RNA, 22 nt, Homo sapiens
ugagacaaaguuguuggauguu

SEQ ID NO: 370748 - RNA, 21 nt, Homo sapiens
ugagacaauccuggucaauau

SEQ ID NO: 370749 - RNA, 22 nt, Homo sapiens
ugagagucacugaccugguaua

SEQ ID NO: 370750 - RNA, 22 nt, Homo sapiens
ugagaugaagucuugcucuguu

SEQ ID NO: 370751 - RNA, 22 nt, Homo sapiens
ugagcaucauucacaccuuggu

SEQ ID NO: 370752 - RNA, 22 nt, Homo sapiens
ugagcuguuugaagaagcauuu

SEQ ID NO: 370753 - RNA, 22 nt, Homo sapiens
ugaggacugagaggcacugugg

SEQ ID NO: 370754 - RNA, 22 nt, Homo sapiens
ugaguaauguugaucuuugaua

SEQ ID NO: 370755 - RNA, 22 nt, Homo sapiens
agugacaugggaucaaaucuga

SEQ ID NO: 370756 - RNA, 19 nt, Homo sapiens
aguggguguuuucuguuug

SEQ ID NO: 370757 - RNA, 22 nt, Homo sapiens
agugguuuuaaguagagcauac

SEQ ID NO: 370758 - RNA, 22 nt, Homo sapiens
auaaagcaagucucuggccuca

SEQ ID NO: 370759 - RNA, 22 nt, Homo sapiens
auacaguguauguauaguacau

SEQ ID NO: 370760 - RNA, 22 nt, Homo sapiens
auacaguugccauuucuugugc

SEQ ID NO: 370761 - RNA, 22 nt, Homo sapiens
auacuaugagauaauaaagacu

SEQ ID NO: 370762 - RNA, 20 nt, Homo sapiens
auagcagcaugauuuauagu

SEQ ID NO: 370763 - RNA, 22 nt, Homo sapiens
auaugcauacauguaugcagga

SEQ ID NO: 370764 - RNA, 22 nt, Homo sapiens
auauggcuuuuauuauguugag

SEQ ID NO: 370765 - RNA, 22 nt, Homo sapiens
auauuggucuucaagaccugug

SEQ ID NO: 370766 - RNA, 22 nt, Homo sapiens
auauuugguuaccugugggucu

SEQ ID NO: 370767 - RNA, 22 nt, Homo sapiens
aucaaguacuguacugaaagug

SEQ ID NO: 370768 - RNA, 22 nt, Homo sapiens
aucccagaaacucggguuucuc

SEQ ID NO: 370769 - RNA, 22 nt, Homo sapiens
aucccaguucagccucugacac

SEQ ID NO: 370770 - RNA, 22 nt, Homo sapiens
augaaaguguguggaaacuuga

SEQ ID NO: 370771 - RNA, 20 nt, Homo sapiens
augaaggcaggugugaguuu

SEQ ID NO: 370772 - RNA, 19 nt, Homo sapiens
augaccauuuccauaguau

SEQ ID NO: 370773 - RNA, 22 nt, Homo sapiens
augagcagaugcuccugccucu

SEQ ID NO: 370774 - RNA, 22 nt, Homo sapiens
augagcugauuuccuuaccaua

SEQ ID NO: 370775 - RNA, 22 nt, Homo sapiens
augcauaugucuuuauaguggc

SEQ ID NO: 370776 - RNA, 22 nt, Homo sapiens
augccacuguacucuagccuag

SEQ ID NO: 370777 - RNA, 22 nt, Homo sapiens
augccacuguccuccugccuag

SEQ ID NO: 370778 - RNA, 22 nt, Homo sapiens
auggaguguggaacugggaauc

SEQ ID NO: 370779 - RNA, 22 nt, Homo sapiens
auggauguucuagggaugugau

SEQ ID NO: 370780 - RNA, 22 nt, Homo sapiens
auggauuuuggggccagaggca

SEQ ID NO: 370781 - RNA, 22 nt, Homo sapiens
auggcaaaauguuccuaguggu

SEQ ID NO: 370782 - RNA, 22 nt, Homo sapiens
auggcaauguaagucagaaaaa

SEQ ID NO: 370783 - RNA, 18 nt, Homo sapiens
auggcagaacaauuuaca

SEQ ID NO: 370784 - RNA, 22 nt, Homo sapiens
auggcagaaucaagccgacagc

SEQ ID NO: 370785 - RNA, 22 nt, Homo sapiens
auggcagcccucuuuauccaug

SEQ ID NO: 370786 - RNA, 22 nt, Homo sapiens
auggcagcugacacuuccgucu

SEQ ID NO: 370787 - RNA, 22 nt, Homo sapiens
auggccuuuuuaucucaccaag

SEQ ID NO: 370788 - RNA, 22 nt, Homo sapiens
auggcucaguguguaucuauca

SEQ ID NO: 370789 - RNA, 18 nt, Homo sapiens
auggguguuggaaaauga

SEQ ID NO: 370790 - RNA, 22 nt, Homo sapiens
augguguccuguuuccccagga

SEQ ID NO: 370791 - RNA, 22 nt, Homo sapiens
auguaauguuaaauugcuaauu

SEQ ID NO: 370792 - RNA, 22 nt, Homo sapiens
augugacuugugaaaaguucag

SEQ ID NO: 370793 - RNA, 22 nt, Homo sapiens
auguuugguagugaauauggua

SEQ ID NO: 370794 - RNA, 22 nt, Homo sapiens
auugaacacagaguagcuuucc

SEQ ID NO: 370795 - RNA, 23 nt, Homo sapiens
auugaacacuuucauaugugagg

SEQ ID NO: 370796 - RNA, 22 nt, Homo sapiens
auugacacugauuuuucuuuaa

SEQ ID NO: 370797 - RNA, 22 nt, Homo sapiens
auugcaaucuccgccuccgggg

SEQ ID NO: 370798 - RNA, 20 nt, Homo sapiens
auugcagcaugauuuauaau

SEQ ID NO: 370799 - RNA, 22 nt, Homo sapiens
auuuggcagugaagggaucaca

SEQ ID NO: 370800 - RNA, 20 nt, Homo sapiens
auuuggcauaguuuaagcaa

SEQ ID NO: 370801 - RNA, 22 nt, Homo sapiens
cacaaugucuaagauguuucua

SEQ ID NO: 370802 - RNA, 22 nt, Homo sapiens
cacagagugagacccugucucu

SEQ ID NO: 370803 - RNA, 22 nt, Homo sapiens
cacaguguuacugguaugaagu

SEQ ID NO: 370804 - RNA, 22 nt, Homo sapiens
cacauguucaggagcacuuaga

SEQ ID NO: 370805 - RNA, 22 nt, Homo sapiens
cagcagguuuuuaucaguuaag

SEQ ID NO: 370806 - RNA, 22 nt, Homo sapiens
cagcuaguuuuugguuuacagu

SEQ ID NO: 370807 - RNA, 22 nt, Homo sapiens
cagcuguguuauaaacuaccau

SEQ ID NO: 370808 - RNA, 22 nt, Homo sapiens
caggaaugugaggguucccugc

SEQ ID NO: 370809 - RNA, 22 nt, Homo sapiens
cagugcaaagccucugcccaga

SEQ ID NO: 370810 - RNA, 22 nt, Homo sapiens
caucacacuuggauguaagaca

SEQ ID NO: 370811 - RNA, 22 nt, Homo sapiens
caucagcaauguaugaggguuc

SEQ ID NO: 370812 - RNA, 22 nt, Homo sapiens
cauugcaguggaguggggaaga

SEQ ID NO: 370813 - RNA, 22 nt, Homo sapiens
cauuuuacuuuccagacgugga

SEQ ID NO: 370814 - RNA, 20 nt, Homo sapiens
ccaguguuauuuauguucua

SEQ ID NO: 370815 - RNA, 19 nt, Homo sapiens
ccaguguugccagagcuga

SEQ ID NO: 370816 - RNA, 19 nt, Homo sapiens
ccauggcaaugaucugaug

SEQ ID NO: 370817 - RNA, 22 nt, Homo sapiens
cccagugugcugggugacagcu

SEQ ID NO: 370818 - RNA, 20 nt, Homo sapiens
ccccuggaguggggcugcuu

SEQ ID NO: 370819 - RNA, 22 nt, Homo sapiens
cccugagaugcuguuaaucugu

SEQ ID NO: 370820 - RNA, 22 nt, Homo sapiens
cccuggacacacacuuuuauuc

SEQ ID NO: 370821 - RNA, 22 nt, Homo sapiens
cccuggacauucaucauuaugu

SEQ ID NO: 370822 - RNA, 22 nt, Homo sapiens
cccugugaauauuaccuuauuu

SEQ ID NO: 370823 - RNA, 22 nt, Homo sapiens
ccuggcacugggccccguggcu

SEQ ID NO: 370824 - RNA, 16 nt, Homo sapiens
cuaaaaugucuacuug

SEQ ID NO: 370825 - RNA, 17 nt, Homo sapiens
cuaaggcaagagucugc

SEQ ID NO: 370826 - RNA, 22 nt, Homo sapiens
cucacagucucucccuaauuuu

SEQ ID NO: 370827 - RNA, 22 nt, Homo sapiens
cucacaguucuaaaggcaagaa

SEQ ID NO: 370828 - RNA, 22 nt, Homo sapiens
cucauuggcuacugaggcuugu

SEQ ID NO: 370829 - RNA, 22 nt, Homo sapiens
cugaccucugucaaagacaccc

SEQ ID NO: 370830 - RNA, 22 nt, Homo sapiens
cugagaguugaugaaauauggu

SEQ ID NO: 370831 - RNA, 22 nt, Homo sapiens
cugagcucauuucuuuugcuac

SEQ ID NO: 370832 - RNA, 22 nt, Homo sapiens
cuggaauguuccuaaagauuca

SEQ ID NO: 370833 - RNA, 22 nt, Homo sapiens
cuggagaucuugacauugaagu

SEQ ID NO: 370834 - RNA, 22 nt, Homo sapiens
cuggagucugacugacacaagg

SEQ ID NO: 370835 - RNA, 22 nt, Homo sapiens
cuggcaaaaagagggcaauaau

SEQ ID NO: 370836 - RNA, 22 nt, Homo sapiens
cuggcaaauaguagagccagga

SEQ ID NO: 370837 - RNA, 22 nt, Homo sapiens
cuggcaagaggauaaaguccua

SEQ ID NO: 370838 - RNA, 22 nt, Homo sapiens
cuggcaagagugaaccagcugu

SEQ ID NO: 370839 - RNA, 22 nt, Homo sapiens
cuggcagugcuuguuauccugg

SEQ ID NO: 370840 - RNA, 18 nt, Homo sapiens
cuuaacauugggaugaua

SEQ ID NO: 370841 - RNA, 22 nt, Homo sapiens
cuugcauuuuggagaaugcuga

SEQ ID NO: 370842 - RNA, 22 nt, Homo sapiens
cuuuggcaaugucauuuucaau

SEQ ID NO: 370843 - RNA, 22 nt, Homo sapiens
cuuuggcacuuccuaagugcca

SEQ ID NO: 370844 - RNA, 22 nt, Homo sapiens
cuuuggcauuagccuguauaga

SEQ ID NO: 370845 - RNA, 23 nt, Homo sapiens
cuuuugcaaugugaucuugccac

SEQ ID NO: 370846 - RNA, 18 nt, Homo sapiens
gaagaaguaggcauggca

SEQ ID NO: 370847 - RNA, 22 nt, Homo sapiens
gaccacauuccacacaggcuuu

SEQ ID NO: 370848 - RNA, 22 nt, Homo sapiens
gacugcagugcagcuguuaggc

SEQ ID NO: 370849 - RNA, 22 nt, Homo sapiens
gacuggagcuguaugugguuac

SEQ ID NO: 370850 - RNA, 22 nt, Homo sapiens
gagaacaguguuguauuuuuuc

SEQ ID NO: 370851 - RNA, 22 nt, Homo sapiens
gagaacugacauuaucguguau

SEQ ID NO: 370852 - RNA, 21 nt, Homo sapiens
gagaaucuuuucagggcaaac

SEQ ID NO: 370853 - RNA, 22 nt, Homo sapiens
gagacugagucuugcucugucg

SEQ ID NO: 370854 - RNA, 22 nt, Homo sapiens
caauggcaaugaaauagugaga

SEQ ID NO: 370855 - RNA, 22 nt, Homo sapiens
cacaguguucauagccaucagg

SEQ ID NO: 370856 - RNA, 22 nt, Homo sapiens
cacugcgaccuccaccucccgg

SEQ ID NO: 370857 - RNA, 22 nt, Homo sapiens
cagagaacauucagagcuguag

SEQ ID NO: 370858 - RNA, 22 nt, Homo sapiens
cagagguaagcaagucagcauu

SEQ ID NO: 370859 - RNA, 22 nt, Homo sapiens
cagcacauagcaguugcucagu

SEQ ID NO: 370860 - RNA, 20 nt, Homo sapiens
cagcacgcacaugagacugu

SEQ ID NO: 370861 - RNA, 22 nt, Homo sapiens
cagcaguuguuucggauuggga

SEQ ID NO: 370862 - RNA, 22 nt, Homo sapiens
cagccgggugagguggcuuguu

SEQ ID NO: 370863 - RNA, 20 nt, Homo sapiens
cagcuagugguaggagucgg

SEQ ID NO: 370864 - RNA, 22 nt, Homo sapiens
cagcugaugucgaaugcacucu

SEQ ID NO: 370865 - RNA, 23 nt, Homo sapiens
cagcuggugauuuuaaguugaag

SEQ ID NO: 370866 - RNA, 22 nt, Homo sapiens
cagcuguuguuaugucugcagg

SEQ ID NO: 370867 - RNA, 22 nt, Homo sapiens
caggcagucuggcucccaagug

SEQ ID NO: 370868 - RNA, 22 nt, Homo sapiens
caugaugcuagguauggaugaa

SEQ ID NO: 370869 - RNA, 22 nt, Homo sapiens
cauggcccugggcugggcgaac

SEQ ID NO: 370870 - RNA, 22 nt, Homo sapiens
cauggcuacugcagauguaggg

SEQ ID NO: 370871 - RNA, 22 nt, Homo sapiens
ccacaguugaaauuuugacugu

SEQ ID NO: 370872 - RNA, 22 nt, Homo sapiens
ccagccgggugcaguggcucac

SEQ ID NO: 370873 - RNA, 22 nt, Homo sapiens
ccagugauggcugccucauuug

SEQ ID NO: 370874 - RNA, 19 nt, Homo sapiens
ccaguguucugauugcacu

SEQ ID NO: 370875 - RNA, 22 nt, Homo sapiens
cccagagacagaaugauaaacu

SEQ ID NO: 370876 - RNA, 22 nt, Homo sapiens
cgcccuguagcuagcuagaggu

SEQ ID NO: 370877 - RNA, 22 nt, Homo sapiens
cggaaugaaaauguccuucagu

SEQ ID NO: 370878 - RNA, 22 nt, Homo sapiens
cuagaacuagaacugcuggggu

SEQ ID NO: 370879 - RNA, 22 nt, Homo sapiens
cuagaggcacagccuaggcacu

SEQ ID NO: 370880 - RNA, 22 nt, Homo sapiens
cuauaacagugugguuuggaga

SEQ ID NO: 370881 - RNA, 18 nt, Homo sapiens
cucacaguaacuuuuaag

SEQ ID NO: 370882 - RNA, 22 nt, Homo sapiens
cucacagucagaagggacuugc

SEQ ID NO: 370883 - RNA, 22 nt, Homo sapiens
cucauugcaaucucugccuccc

SEQ ID NO: 370884 - RNA, 22 nt, Homo sapiens
cucugagguuauucguaauauu

SEQ ID NO: 370885 - RNA, 22 nt, Homo sapiens
cucuuuggaugccuuaggguua

SEQ ID NO: 370886 - RNA, 22 nt, Homo sapiens
cugagagaggagcuaaaacugc

SEQ ID NO: 370887 - RNA, 22 nt, Homo sapiens
cugagagugguauguuuaagug

SEQ ID NO: 370888 - RNA, 22 nt, Homo sapiens
cugagauuaagauauugggagu

SEQ ID NO: 370889 - RNA, 22 nt, Homo sapiens
cugaggcacggcgaccuuaagu

SEQ ID NO: 370890 - RNA, 22 nt, Homo sapiens
cugaugaaguauuuguucugga

SEQ ID NO: 370891 - RNA, 17 nt, Homo sapiens
cuucaaauaauuucccc

SEQ ID NO: 370892 - RNA, 18 nt, Homo sapiens
cuucauugcuguuuugcu

SEQ ID NO: 370893 - RNA, 20 nt, Homo sapiens
cuuuggcaaugagaacaggg

SEQ ID NO: 370894 - RNA, 21 nt, Homo sapiens
cuuugguagaguuuuuagggu

SEQ ID NO: 370895 - RNA, 22 nt, Homo sapiens
cuuuggucaauugcugcgggga

SEQ ID NO: 370896 - RNA, 22 nt, Homo sapiens
cuuugugcccuucugcccauca

SEQ ID NO: 370897 - RNA, 22 nt, Homo sapiens
cuuuugugauucuucaguuacu

SEQ ID NO: 370898 - RNA, 22 nt, Homo sapiens
gaagguacgcuuaggaaaugau

SEQ ID NO: 370899 - RNA, 22 nt, Homo sapiens
gaauagugcugcaauaaacaua

SEQ ID NO: 370900 - RNA, 22 nt, Homo sapiens
gaauagugcugcaaugaacaua

SEQ ID NO: 370901 - RNA, 22 nt, Homo sapiens
gaauagugcugcgauaaacaua

SEQ ID NO: 370902 - RNA, 19 nt, Homo sapiens
gacuccagaguugugugcu

SEQ ID NO: 370903 - RNA, 22 nt, Homo sapiens
gagacugagucucgcucugccg

SEQ ID NO: 370904 - RNA, 22 nt, Homo sapiens
gagacugagucuugcucuguca

SEQ ID NO: 370905 - RNA, 22 nt, Homo sapiens
gagaugauuugccccauguauu

SEQ ID NO: 370906 - RNA, 22 nt, Homo sapiens
gagcuguugguuugaaagaauu

SEQ ID NO: 370907 - RNA, 22 nt, Homo sapiens
gaggaaguagcuacugucuuuc

SEQ ID NO: 370908 - RNA, 22 nt, Homo sapiens
gagggcacugcuuuccuuucaa

SEQ ID NO: 370909 - RNA, 22 nt, Homo sapiens
gagguggauacauuaaauaaug

SEQ ID NO: 370910 - RNA, 23 nt, Homo sapiens
gagugcaaugacaugaucucgga

SEQ ID NO: 370911 - RNA, 22 nt, Homo sapiens
gagugcaauggcagaucuccgc

SEQ ID NO: 370912 - RNA, 22 nt, Homo sapiens
gauauguaaaaauuauaucuga

SEQ ID NO: 370913 - RNA, 22 nt, Homo sapiens
gauggugucccaggcucaggcu

SEQ ID NO: 370914 - RNA, 22 nt, Homo sapiens
gauuccacuuacuuagcauucc

SEQ ID NO: 370915 - RNA, 22 nt, Homo sapiens
gcacaguggcucccgucuauaa

SEQ ID NO: 370916 - RNA, 17 nt, Homo sapiens
gcccuuugugccucuuc

SEQ ID NO: 370917 - RNA, 22 nt, Homo sapiens
gcucaugagacaagcaggagua

SEQ ID NO: 370918 - RNA, 22 nt, Homo sapiens
gcucugguuacaaaggcaaauu

SEQ ID NO: 370919 - RNA, 22 nt, Homo sapiens
gcucuuuugggguaauucugag

SEQ ID NO: 370920 - RNA, 22 nt, Homo sapiens
gcugcuguaccagaugugguua

SEQ ID NO: 370921 - RNA, 22 nt, Homo sapiens
gcugcuguggcagauuggauuc

SEQ ID NO: 370922 - RNA, 22 nt, Homo sapiens
gcugguguagagugcagaaagg

SEQ ID NO: 370923 - RNA, 22 nt, Homo sapiens
gcuguugugaacuauacaucua

SEQ ID NO: 370924 - RNA, 22 nt, Homo sapiens
gcuuguguucaagucacccuua

SEQ ID NO: 370925 - RNA, 23 nt, Homo sapiens
ggaaugaaaccugguuaugauau

SEQ ID NO: 370926 - RNA, 20 nt, Homo sapiens
ggaauguuaaucuccaugau

SEQ ID NO: 370927 - RNA, 22 nt, Homo sapiens
ggagcugugauuugaguccaga

SEQ ID NO: 370928 - RNA, 22 nt, Homo sapiens
ggagucugauguucuaaggcag

SEQ ID NO: 370929 - RNA, 22 nt, Homo sapiens
ggagugucagaaacaguguccu

SEQ ID NO: 370930 - RNA, 22 nt, Homo sapiens
ggaguuuaagucuugugcaucu

SEQ ID NO: 370931 - RNA, 17 nt, Homo sapiens
ggcaagaaguggaacuc

SEQ ID NO: 370932 - RNA, 22 nt, Homo sapiens
ggcagaauugcugaggaugcua

SEQ ID NO: 370933 - RNA, 22 nt, Homo sapiens
ggcagcauugccuuugcaguga

SEQ ID NO: 370934 - RNA, 22 nt, Homo sapiens
ggcagcgugcacuuucgccacu

SEQ ID NO: 370935 - RNA, 22 nt, Homo sapiens
ggcauguuuaguagaauguggu

SEQ ID NO: 370936 - RNA, 22 nt, Homo sapiens
gggcauguggacuuguauguuu

SEQ ID NO: 370937 - RNA, 22 nt, Homo sapiens
guaaaucucuguuuucauggac

SEQ ID NO: 370938 - RNA, 22 nt, Homo sapiens
guauuuggugaugccuccaaac

SEQ ID NO: 370939 - RNA, 22 nt, Homo sapiens
gucacugagcaauagaaaguuu

SEQ ID NO: 370940 - RNA, 22 nt, Homo sapiens
gucagcaaaguucuccugcaga

SEQ ID NO: 370941 - RNA, 19 nt, Homo sapiens
aaagguaguaaccucugau

SEQ ID NO: 370942 - RNA, 22 nt, Homo sapiens
aaaguggacuaagugaauauga

SEQ ID NO: 370943 - RNA, 22 nt, Homo sapiens
aaaugcagauucugcuuagguu

SEQ ID NO: 370944 - RNA, 19 nt, Homo sapiens
aacuggugugagaugguau

SEQ ID NO: 370945 - RNA, 22 nt, Homo sapiens
aagagguaggaaauggucauuu

SEQ ID NO: 370946 - RNA, 23 nt, Homo sapiens
aagagguaugacuaugaagugga

SEQ ID NO: 370947 - RNA, 22 nt, Homo sapiens
aagcaggugucugugucuguaa

SEQ ID NO: 370948 - RNA, 22 nt, Homo sapiens
aagccacuguaccugucucuua

SEQ ID NO: 370949 - RNA, 22 nt, Homo sapiens
aagcuggauuucgcauccuguu

SEQ ID NO: 370950 - RNA, 22 nt, Homo sapiens
aagcuguugguggauguaccau

SEQ ID NO: 370951 - RNA, 22 nt, Homo sapiens
aagguggaguugacaauuuuca

SEQ ID NO: 370952 - RNA, 22 nt, Homo sapiens
aagugccauguggaugggcccu

SEQ ID NO: 370953 - RNA, 22 nt, Homo sapiens
aagugguagggucaggauugga

SEQ ID NO: 370954 - RNA, 22 nt, Homo sapiens
aagugguguuugggagcuggac

SEQ ID NO: 370955 - RNA, 22 nt, Homo sapiens
aauucacuuguggcagauccuu

SEQ ID NO: 370956 - RNA, 20 nt, Homo sapiens
acaaaugcauucugugacau

SEQ ID NO: 370957 - RNA, 22 nt, Homo sapiens
acaguguuacuugauaguguau

SEQ ID NO: 370958 - RNA, 22 nt, Homo sapiens
acaguguuccuuuguugugacu

SEQ ID NO: 370959 - RNA, 21 nt, Homo sapiens
acaucagaguugugaagguag

SEQ ID NO: 370960 - RNA, 22 nt, Homo sapiens
acccauguaggugggauuacag

SEQ ID NO: 370961 - RNA, 22 nt, Homo sapiens
accccugugacggguauuugag

SEQ ID NO: 370962 - RNA, 22 nt, Homo sapiens
acccuggagagugcuguaguaa

SEQ ID NO: 370963 - RNA, 22 nt, Homo sapiens
accuggacacuuugggcuccuc

SEQ ID NO: 370964 - RNA, 23 nt, Homo sapiens
accugugguuauuuuacucuucc

SEQ ID NO: 370965 - RNA, 22 nt, Homo sapiens
acucacagcaaccuccgccucc

SEQ ID NO: 370966 - RNA, 22 nt, Homo sapiens
acucagagagaacugucauuug

SEQ ID NO: 370967 - RNA, 22 nt, Homo sapiens
acucagagugggccccuagaua

SEQ ID NO: 370968 - RNA, 22 nt, Homo sapiens
agaagaacauagggugacugaa

SEQ ID NO: 370969 - RNA, 22 nt, Homo sapiens
agacaguguguguauauauggu

SEQ ID NO: 370970 - RNA, 22 nt, Homo sapiens
agagagcuugggguguuaaauu

SEQ ID NO: 370971 - RNA, 22 nt, Homo sapiens
agagaucaauaugaaggaaaug

SEQ ID NO: 370972 - RNA, 23 nt, Homo sapiens
agagugcaauggugccaucucgg

SEQ ID NO: 370973 - RNA, 23 nt, Homo sapiens
agauggcauuucaguucuuuagg

SEQ ID NO: 370974 - RNA, 18 nt, Homo sapiens
agaugguguugcuucugu

SEQ ID NO: 370975 - RNA, 22 nt, Homo sapiens
agcaaccuugaauagcccuuuc

SEQ ID NO: 370976 - RNA, 22 nt, Homo sapiens
agcaggucuuaacuugugaggu

SEQ ID NO: 370977 - RNA, 22 nt, Homo sapiens
agcagguguccacaauguuugc

SEQ ID NO: 370978 - RNA, 22 nt, Homo sapiens
agcuauauugaggaugccauuc

SEQ ID NO: 370979 - RNA, 22 nt, Homo sapiens
agcugcacugguauaggagaaa

SEQ ID NO: 370980 - RNA, 22 nt, Homo sapiens
agcugcauuuacuuuugcacaa

SEQ ID NO: 370981 - RNA, 22 nt, Homo sapiens
agcuguuuuugugggcauguga

SEQ ID NO: 370982 - RNA, 19 nt, Homo sapiens
aggacuaaagacuagaagu

SEQ ID NO: 370983 - RNA, 22 nt, Homo sapiens
aggcaagcaucuugcucccuuc

SEQ ID NO: 370984 - RNA, 22 nt, Homo sapiens
aggcaagugggagacagcauuu

SEQ ID NO: 370985 - RNA, 22 nt, Homo sapiens
aggcagcuguuauauacugagu

SEQ ID NO: 370986 - RNA, 22 nt, Homo sapiens
aggcuuuauuacagggucucag

SEQ ID NO: 370987 - RNA, 22 nt, Homo sapiens
aguaaauuucugugcuuucaua

SEQ ID NO: 370988 - RNA, 22 nt, Homo sapiens
agugcauuugcaucucaauaua

SEQ ID NO: 370989 - RNA, 22 nt, Homo sapiens
aguggcacaauuuugacucccc

SEQ ID NO: 370990 - RNA, 22 nt, Homo sapiens
auaagaagugaaccagacgucu

SEQ ID NO: 370991 - RNA, 22 nt, Homo sapiens
auaagauaguggaagugggauu

SEQ ID NO: 370992 - RNA, 22 nt, Homo sapiens
auacccaguaguggaauugcua

SEQ ID NO: 370993 - RNA, 21 nt, Homo sapiens
auacuugagacuggguaauuu

SEQ ID NO: 370994 - RNA, 22 nt, Homo sapiens
auagggcacgagaugugagccu

SEQ ID NO: 370995 - RNA, 19 nt, Homo sapiens
auaguguaggaaaacagcu

SEQ ID NO: 370996 - RNA, 22 nt, Homo sapiens
auauuacagagaggaccuggga

SEQ ID NO: 370997 - RNA, 22 nt, Homo sapiens
auauucaagugaggauggcuaa

SEQ ID NO: 370998 - RNA, 22 nt, Homo sapiens
aucacagcuacuccucugucuu

SEQ ID NO: 370999 - RNA, 22 nt, Homo sapiens
aucaggcacacauuggaguuug

SEQ ID NO: 371000 - RNA, 22 nt, Homo sapiens
aucaucacaguuguguguaaug

SEQ ID NO: 371001 - RNA, 22 nt, Homo sapiens
auccauugcucaagagaaguca

SEQ ID NO: 371002 - RNA, 22 nt, Homo sapiens
auccucugagaucuaggcagag

SEQ ID NO: 371003 - RNA, 22 nt, Homo sapiens
aucugcaaauaaugaagauugg

SEQ ID NO: 371004 - RNA, 22 nt, Homo sapiens
aucuuguguugaauggugcaga

SEQ ID NO: 371005 - RNA, 22 nt, Homo sapiens
augacaguaugacuccaaaagu

SEQ ID NO: 371006 - RNA, 22 nt, Homo sapiens
augacuggauaauggacacaca

SEQ ID NO: 371007 - RNA, 22 nt, Homo sapiens
augagcagaagagauacacugu

SEQ ID NO: 371008 - RNA, 17 nt, Homo sapiens
augagcucaucauuuuu

SEQ ID NO: 371009 - RNA, 22 nt, Homo sapiens
augagguguuuauuguauccug

SEQ ID NO: 371010 - RNA, 22 nt, Homo sapiens
augcaagcacacaagaggaaau

SEQ ID NO: 371011 - RNA, 20 nt, Homo sapiens
augccacugagcagugguga

SEQ ID NO: 371012 - RNA, 22 nt, Homo sapiens
augcuacauucuacaauuaggc

SEQ ID NO: 371013 - RNA, 22 nt, Homo sapiens
auggcacagaguagaugcucaa

SEQ ID NO: 371014 - RNA, 22 nt, Homo sapiens
auggcagcaccccacucuacug

SEQ ID NO: 371015 - RNA, 22 nt, Homo sapiens
auggcaucgucaccuuuucagu

SEQ ID NO: 371016 - RNA, 22 nt, Homo sapiens
auggccuuguauaccuggcaaa

SEQ ID NO: 371017 - RNA, 22 nt, Homo sapiens
augggagugugguuagagaccu

SEQ ID NO: 371018 - RNA, 22 nt, Homo sapiens
auguaguagauauuuauggaaa

SEQ ID NO: 371019 - RNA, 22 nt, Homo sapiens
augucuuucauagagacccaga

SEQ ID NO: 371020 - RNA, 22 nt, Homo sapiens
augugggaggacuuggcuguug

SEQ ID NO: 371021 - RNA, 22 nt, Homo sapiens
auguuugguaagaauauuguua

SEQ ID NO: 371022 - RNA, 22 nt, Homo sapiens
auuaacaucuagaguuuuggug

SEQ ID NO: 371023 - RNA, 22 nt, Homo sapiens
auugaguaaaugaaaauugccu

SEQ ID NO: 371024 - RNA, 23 nt, Homo sapiens
auugcagaaucacagagguagug

SEQ ID NO: 371025 - RNA, 22 nt, Homo sapiens
auugcauugugaucuucccaga

SEQ ID NO: 371026 - RNA, 22 nt, Homo sapiens
auugcuuuuacugggagcuuug

SEQ ID NO: 371027 - RNA, 19 nt, Homo sapiens
auuugaucaucaggcacag

SEQ ID NO: 371028 - RNA, 22 nt, Homo sapiens
auuuggcaacguagggaggcau

SEQ ID NO: 371029 - RNA, 22 nt, Homo sapiens
auuuggguaaugagugcaaggg

SEQ ID NO: 371030 - RNA, 21 nt, Homo sapiens
auuugguguuagaaauaaauu

SEQ ID NO: 371031 - RNA, 22 nt, Homo sapiens
caaauacuuucauguugucuug

SEQ ID NO: 371032 - RNA, 22 nt, Homo sapiens
caagggguggaaaugguagugu

SEQ ID NO: 371033 - RNA, 22 nt, Homo sapiens
aaacccauauaccagcugugcu

SEQ ID NO: 371034 - RNA, 22 nt, Homo sapiens
aaacugcuuuccaugguggcug

SEQ ID NO: 371035 - RNA, 22 nt, Homo sapiens
aaagugcuuacuaaguugccaa

SEQ ID NO: 371036 - RNA, 22 nt, Homo sapiens
aaaugcagauuccuaggcccca

SEQ ID NO: 371037 - RNA, 22 nt, Homo sapiens
aaaugcagucuuuguucugggc

SEQ ID NO: 371038 - RNA, 22 nt, Homo sapiens
aaaugccucccauucuacugac

SEQ ID NO: 371039 - RNA, 22 nt, Homo sapiens
aaaugguguuaguagaucuuua

SEQ ID NO: 371040 - RNA, 22 nt, Homo sapiens
aacagcuaguaccaauccacua

SEQ ID NO: 371041 - RNA, 22 nt, Homo sapiens
aaccuacauucuuaacuguugc

SEQ ID NO: 371042 - RNA, 19 nt, Homo sapiens
aacuggugugagaugauau

SEQ ID NO: 371043 - RNA, 22 nt, Homo sapiens
aagagaugaagguccugacugu

SEQ ID NO: 371044 - RNA, 22 nt, Homo sapiens
aagaguaguaguggcacucucu

SEQ ID NO: 371045 - RNA, 22 nt, Homo sapiens
aagcacccagccucacgccugc

SEQ ID NO: 371046 - RNA, 22 nt, Homo sapiens
aagcaggugugggaggaaaugg

SEQ ID NO: 371047 - RNA, 22 nt, Homo sapiens
aagcugguuuuauaucugugag

SEQ ID NO: 371048 - RNA, 22 nt, Homo sapiens
aagcuguugguggaucuaccau

SEQ ID NO: 371049 - RNA, 22 nt, Homo sapiens
aaggagugugauucuucaguuu

SEQ ID NO: 371050 - RNA, 22 nt, Homo sapiens
aaggcauucucaaacuaguucu

SEQ ID NO: 371051 - RNA, 22 nt, Homo sapiens
aaggcuuuuugcugacguccuu

SEQ ID NO: 371052 - RNA, 22 nt, Homo sapiens
aauaagaaguggaagggaccgg

SEQ ID NO: 371053 - RNA, 19 nt, Homo sapiens
aauauugacaguggugucu

SEQ ID NO: 371054 - RNA, 22 nt, Homo sapiens
aaucaccaugcacuacagccuu

SEQ ID NO: 371055 - RNA, 22 nt, Homo sapiens
aaucugggguuguuuggggagu

SEQ ID NO: 371056 - RNA, 22 nt, Homo sapiens
aaugccacugugccugccaagg

SEQ ID NO: 371057 - RNA, 22 nt, Homo sapiens
aauggcaaauguuuucuguuga

SEQ ID NO: 371058 - RNA, 22 nt, Homo sapiens
aauggcagaugaaauugucauu

SEQ ID NO: 371059 - RNA, 22 nt, Homo sapiens
acacagugucuguguauuuaaa

SEQ ID NO: 371060 - RNA, 22 nt, Homo sapiens
acacaugugaaaaaaauguuac

SEQ ID NO: 371061 - RNA, 22 nt, Homo sapiens
acauaugaguacaugugccaug

SEQ ID NO: 371062 - RNA, 22 nt, Homo sapiens
acauggcacugcgggcuucuug

SEQ ID NO: 371063 - RNA, 22 nt, Homo sapiens
acccagaagucauucaggaaca

SEQ ID NO: 371064 - RNA, 22 nt, Homo sapiens
acccagaauucagucuuaggcc

SEQ ID NO: 371065 - RNA, 23 nt, Homo sapiens
ugcagcuacauguggccaugugc

SEQ ID NO: 371066 - RNA, 22 nt, Homo sapiens
ugcagguaggcaguaucauuua

SEQ ID NO: 371067 - RNA, 22 nt, Homo sapiens
ugccaacugguuucuuuuaguu

SEQ ID NO: 371068 - RNA, 22 nt, Homo sapiens
ugccuacucucugccaggaaug

SEQ ID NO: 371069 - RNA, 21 nt, Homo sapiens
ugcugcacuucuuuugcugug

SEQ ID NO: 371070 - RNA, 22 nt, Homo sapiens
uggaaaguaguucuaaucuaag

SEQ ID NO: 371071 - RNA, 22 nt, Homo sapiens
uggaaucuagagaaaugcaaac

SEQ ID NO: 371072 - RNA, 21 nt, Homo sapiens
uggaaucuauagaggcaguag

SEQ ID NO: 371073 - RNA, 22 nt, Homo sapiens
uggaguuugacaugccuuuggg

SEQ ID NO: 371074 - RNA, 20 nt, Homo sapiens
uggaguuugaguucuuggag

SEQ ID NO: 371075 - RNA, 19 nt, Homo sapiens
uggcaaugucagcagagau

SEQ ID NO: 371076 - RNA, 22 nt, Homo sapiens
uggccagagggcaauuagcugu

SEQ ID NO: 371077 - RNA, 22 nt, Homo sapiens
uggcuguuuauuucacaugggu

SEQ ID NO: 371078 - RNA, 20 nt, Homo sapiens
ugggaaauguccaggacaua

SEQ ID NO: 371079 - RNA, 20 nt, Homo sapiens
ugggaacaugugguauaugg

SEQ ID NO: 371080 - RNA, 18 nt, Homo sapiens
ugggaagaaauucuucuc

SEQ ID NO: 371081 - RNA, 22 nt, Homo sapiens
ugggaauaugauacaggucuuu

SEQ ID NO: 371082 - RNA, 21 nt, Homo sapiens
ugggccccuuccuuacaucau

SEQ ID NO: 371083 - RNA, 23 nt, Homo sapiens
ugguuuguaagagauggacugga

SEQ ID NO: 371084 - RNA, 22 nt, Homo sapiens
uguaaacucaguauguuuuacu

SEQ ID NO: 371085 - RNA, 22 nt, Homo sapiens
ugucaggaggguccagagaaaa

SEQ ID NO: 371086 - RNA, 22 nt, Homo sapiens
ugugaacagaauuagucaccua

SEQ ID NO: 371087 - RNA, 22 nt, Homo sapiens
ugugauggaguuucauggacug

SEQ ID NO: 371088 - RNA, 22 nt, Homo sapiens
ugugcaaucagcuucauuacau

SEQ ID NO: 371089 - RNA, 22 nt, Homo sapiens
ugugguuuuuuucuccaauagg

SEQ ID NO: 371090 - RNA, 22 nt, Homo sapiens
ugugucuugagagucucgagaa

SEQ ID NO: 371091 - RNA, 22 nt, Homo sapiens
uguuauguuguuugagaaaguc

SEQ ID NO: 371092 - RNA, 22 nt, Homo sapiens
uguucuugagccuuuagaccua

SEQ ID NO: 371093 - RNA, 22 nt, Homo sapiens
uuaaaguguuugcagacaggug

SEQ ID NO: 371094 - RNA, 22 nt, Homo sapiens
uuaauucugucugcccucaucc

SEQ ID NO: 371095 - RNA, 22 nt, Homo sapiens
uuacaaguggcaucucucugga

SEQ ID NO: 371096 - RNA, 22 nt, Homo sapiens
uuagcagcucuaauaacugcua

SEQ ID NO: 371097 - RNA, 22 nt, Homo sapiens
uuauugcuuuugugcaggugag

SEQ ID NO: 371098 - RNA, 22 nt, Homo sapiens
uucacagucacccuucuccaug

SEQ ID NO: 371099 - RNA, 22 nt, Homo sapiens
uucacaguguguacaccagggg

SEQ ID NO: 371100 - RNA, 22 nt, Homo sapiens
uucaguccauuuccuuggucac

SEQ ID NO: 371101 - RNA, 22 nt, Homo sapiens
uucauacaguggcugcacucca

SEQ ID NO: 371102 - RNA, 23 nt, Homo sapiens
uucaucagggauauuggccugaa

SEQ ID NO: 371103 - RNA, 21 nt, Homo sapiens
uucaucuggccguauuccagg

SEQ ID NO: 371104 - RNA, 22 nt, Homo sapiens
uucauggaauauugaccauuuu

SEQ ID NO: 371105 - RNA, 22 nt, Homo sapiens
uucauguagucaucauccugcu

SEQ ID NO: 371106 - RNA, 22 nt, Homo sapiens
uucaugucuuggcuguuagagu

SEQ ID NO: 371107 - RNA, 20 nt, Homo sapiens
uuccagcacauuagggaagc

SEQ ID NO: 371108 - RNA, 22 nt, Homo sapiens
uuccaguaauagcacagcauug

SEQ ID NO: 371109 - RNA, 21 nt, Homo sapiens
uuccagugagccuagaugccu

SEQ ID NO: 371110 - RNA, 22 nt, Homo sapiens
uuccagugggacgagaugugga

SEQ ID NO: 371111 - RNA, 22 nt, Homo sapiens
uuccuuguagcaaaugcgauga

SEQ ID NO: 371112 - RNA, 18 nt, Homo sapiens
uucuuguguugauauuuu

SEQ ID NO: 371113 - RNA, 22 nt, Homo sapiens
uugaaagaugaacuggauugga

SEQ ID NO: 371114 - RNA, 22 nt, Homo sapiens
uugaacugguaguuggaaaucu

SEQ ID NO: 371115 - RNA, 22 nt, Homo sapiens
uugaccccuucuaauagccuca

SEQ ID NO: 371116 - RNA, 22 nt, Homo sapiens
aaaagugguguuguuucuaaau

SEQ ID NO: 371117 - RNA, 22 nt, Homo sapiens
aaagaagucagccuguccuuug

SEQ ID NO: 371118 - RNA, 22 nt, Homo sapiens
aaagcacuggagucaucaucua

SEQ ID NO: 371119 - RNA, 22 nt, Homo sapiens
aaaggcuucggaucagaaggua

SEQ ID NO: 371120 - RNA, 22 nt, Homo sapiens
aaaugcacaaagauuuugcacu

SEQ ID NO: 371121 - RNA, 22 nt, Homo sapiens
aaaugcagcacucaagugggaa

SEQ ID NO: 371122 - RNA, 22 nt, Homo sapiens
aaaugcaguugguggggauaug

SEQ ID NO: 371123 - RNA, 22 nt, Homo sapiens
aagagugucuuugugcuggccc

SEQ ID NO: 371124 - RNA, 22 nt, Homo sapiens
aagcugccuugcugaggagaaa

SEQ ID NO: 371125 - RNA, 22 nt, Homo sapiens
aagcugccuugugaaggcauuc

SEQ ID NO: 371126 - RNA, 22 nt, Homo sapiens
aagugcuuuuuagauaugguuu

SEQ ID NO: 371127 - RNA, 22 nt, Homo sapiens
aauauguccuugaaauggugcu

SEQ ID NO: 371128 - RNA, 22 nt, Homo sapiens
aauggcaagagccacagaggcg

SEQ ID NO: 371129 - RNA, 17 nt, Homo sapiens
acaaauugccagcuagg

SEQ ID NO: 371130 - RNA, 18 nt, Homo sapiens
acagugucuuacaccugu

SEQ ID NO: 371131 - RNA, 22 nt, Homo sapiens
acccugucacucccaucaauuu

SEQ ID NO: 371132 - RNA, 22 nt, Homo sapiens
acccugucauccacauggugcu

SEQ ID NO: 371133 - RNA, 22 nt, Homo sapiens
accuucauuguugccaugucca

SEQ ID NO: 371134 - RNA, 22 nt, Homo sapiens
acuagagaugcauuuguaguuu

SEQ ID NO: 371135 - RNA, 22 nt, Homo sapiens
acucagagaacauucccagucu

SEQ ID NO: 371136 - RNA, 19 nt, Homo sapiens
acugagcuaccugggggca

SEQ ID NO: 371137 - RNA, 22 nt, Homo sapiens
acugcacugcagccuggccaac

SEQ ID NO: 371138 - RNA, 22 nt, Homo sapiens
agaaacauucucuugccuccuu

SEQ ID NO: 371139 - RNA, 22 nt, Homo sapiens
agagguagaagauaggcuacag

SEQ ID NO: 371140 - RNA, 22 nt, Homo sapiens
agagguguuaaagucucuuuua

SEQ ID NO: 371141 - RNA, 22 nt, Homo sapiens
agagugcaauggcaccaucucg

SEQ ID NO: 371142 - RNA, 22 nt, Homo sapiens
agauggugugcuaggaaaugua

SEQ ID NO: 371143 - RNA, 22 nt, Homo sapiens
agcaaaucuaugaauguauauu

SEQ ID NO: 371144 - RNA, 23 nt, Homo sapiens
agcaaaugcucuagcacuccaac

SEQ ID NO: 371145 - RNA, 22 nt, Homo sapiens
agcaccauuucucuaaagcacu

SEQ ID NO: 371146 - RNA, 22 nt, Homo sapiens
agcagcaugaggggacuucugc

SEQ ID NO: 371147 - RNA, 22 nt, Homo sapiens
agcagcuuugaucugaaugauu

SEQ ID NO: 371148 - RNA, 22 nt, Homo sapiens
agcaggacaauaugggaucagg

SEQ ID NO: 371149 - RNA, 22 nt, Homo sapiens
agcagguauucgggucaugggg

SEQ ID NO: 371150 - RNA, 22 nt, Homo sapiens
agcagguguggcuuauccugaa

SEQ ID NO: 371151 - RNA, 22 nt, Homo sapiens
agcagugucauuuucuggugag

SEQ ID NO: 371152 - RNA, 17 nt, Homo sapiens
agcauguguuugagauu

SEQ ID NO: 371153 - RNA, 22 nt, Homo sapiens
agcugauuuuaaguccuugucc

SEQ ID NO: 371154 - RNA, 22 nt, Homo sapiens
agcugcacaaauggaugugagg

SEQ ID NO: 371155 - RNA, 20 nt, Homo sapiens
agcugguuuuaugaaucuuu

SEQ ID NO: 371156 - RNA, 22 nt, Homo sapiens
agcuguuguucucagaggcuuu

SEQ ID NO: 371157 - RNA, 22 nt, Homo sapiens
aggcaguuucagugagagguga

SEQ ID NO: 371158 - RNA, 22 nt, Homo sapiens
aggccaguuuuuggagggaaac

SEQ ID NO: 371159 - RNA, 22 nt, Homo sapiens
agggcacuguagguccugccuc

SEQ ID NO: 371160 - RNA, 16 nt, Homo sapiens
aguaguuuuacagauu

SEQ ID NO: 371161 - RNA, 22 nt, Homo sapiens
agucacagugaccuugucugac

SEQ ID NO: 371162 - RNA, 22 nt, Homo sapiens
agugagcuggagaaaagaaacu

SEQ ID NO: 371163 - RNA, 22 nt, Homo sapiens
agugcauugcaucucugcuuca

SEQ ID NO: 371164 - RNA, 22 nt, Homo sapiens
agugguuugaucacagcucacu

SEQ ID NO: 371165 - RNA, 20 nt, Homo sapiens
agugguuuucaaauaugucu

SEQ ID NO: 371166 - RNA, 22 nt, Homo sapiens
auagcagcaccccacuaccuca

SEQ ID NO: 371167 - RNA, 22 nt, Homo sapiens
auagcagcaccucacucuacug

SEQ ID NO: 371168 - RNA, 22 nt, Homo sapiens
auagcagcagcuaguagugaua

SEQ ID NO: 371169 - RNA, 22 nt, Homo sapiens
auagcagcauauguaauguuga

SEQ ID NO: 371170 - RNA, 22 nt, Homo sapiens
gcaguguugugauccaggucuu

SEQ ID NO: 371171 - RNA, 22 nt, Homo sapiens
gcauggaaggcgcuuugugacu

SEQ ID NO: 371172 - RNA, 21 nt, Homo sapiens
gccaguguggcaauuuuucaa

SEQ ID NO: 371173 - RNA, 22 nt, Homo sapiens
gccaguguguguuguucuccgc

SEQ ID NO: 371174 - RNA, 22 nt, Homo sapiens
gccccgggugaugcagccguca

SEQ ID NO: 371175 - RNA, 22 nt, Homo sapiens
gccuagagaaguaaauauuauc

SEQ ID NO: 371176 - RNA, 22 nt, Homo sapiens
gccuagagaguuaucaggcugu

SEQ ID NO: 371177 - RNA, 22 nt, Homo sapiens
gcgguuuuaagugaguuucuua

SEQ ID NO: 371178 - RNA, 22 nt, Homo sapiens
gcugcacuuuaaggcauccccu

SEQ ID NO: 371179 - RNA, 17 nt, Homo sapiens
gcugcauucauguagaa

SEQ ID NO: 371180 - RNA, 22 nt, Homo sapiens
gcugcuuuugaugacaaaaaca

SEQ ID NO: 371181 - RNA, 22 nt, Homo sapiens
gcugguguucaggcccucaguc

SEQ ID NO: 371182 - RNA, 18 nt, Homo sapiens
gcuguugucagagcacau

SEQ ID NO: 371183 - RNA, 22 nt, Homo sapiens
gcuuguguauuaaaccuugcag

SEQ ID NO: 371184 - RNA, 22 nt, Homo sapiens
ggaagguaauugucagcucaua

SEQ ID NO: 371185 - RNA, 22 nt, Homo sapiens
ggagaguaauuagacugaaaga

SEQ ID NO: 371186 - RNA, 22 nt, Homo sapiens
ggagaugugccugcucugcucu

SEQ ID NO: 371187 - RNA, 22 nt, Homo sapiens
ggcaaaugaagauggagaggcu

SEQ ID NO: 371188 - RNA, 17 nt, Homo sapiens
ggcaggauccaggaucc

SEQ ID NO: 371189 - RNA, 22 nt, Homo sapiens
ggcucguguuuucuguccaguu

SEQ ID NO: 371190 - RNA, 22 nt, Homo sapiens
gggucauggaugugaagcuaga

SEQ ID NO: 371191 - RNA, 22 nt, Homo sapiens
ggugacugguuuaucuggcagu

SEQ ID NO: 371192 - RNA, 22 nt, Homo sapiens
guaaauaccaguuucuggaaca

SEQ ID NO: 371193 - RNA, 22 nt, Homo sapiens
guagcagccacacuugauaacu

SEQ ID NO: 371194 - RNA, 22 nt, Homo sapiens
guaggcacuggcucagcuuauc

SEQ ID NO: 371195 - RNA, 22 nt, Homo sapiens
guaguagcacgagcucugucuc

SEQ ID NO: 371196 - RNA, 22 nt, Homo sapiens
augccacugcacuccaaccugg

SEQ ID NO: 371197 - RNA, 22 nt, Homo sapiens
augccacugcacucuagccugg

SEQ ID NO: 371198 - RNA, 22 nt, Homo sapiens
augccacugcgcucuagccugg

SEQ ID NO: 371199 - RNA, 22 nt, Homo sapiens
auggagguguggggagugaguu

SEQ ID NO: 371200 - RNA, 22 nt, Homo sapiens
auggcaagaagagcaauuauuu

SEQ ID NO: 371201 - RNA, 22 nt, Homo sapiens
auggcagagucagaaagucagg

SEQ ID NO: 371202 - RNA, 22 nt, Homo sapiens
auggcccugcuaccacuuuucu

SEQ ID NO: 371203 - RNA, 21 nt, Homo sapiens
auggugagaaaguagugucaa

SEQ ID NO: 371204 - RNA, 22 nt, Homo sapiens
augucaacauagacaguagagu

SEQ ID NO: 371205 - RNA, 22 nt, Homo sapiens
auuaucacaguuuugcauaugg

SEQ ID NO: 371206 - RNA, 22 nt, Homo sapiens
auuccagguggcgccauucaca

SEQ ID NO: 371207 - RNA, 22 nt, Homo sapiens
auugcauuuucagguuggucug

SEQ ID NO: 371208 - RNA, 22 nt, Homo sapiens
auuuggcaguauaaugcuuugg

SEQ ID NO: 371209 - RNA, 22 nt, Homo sapiens
auuuggguuuuacaucaggcua

SEQ ID NO: 371210 - RNA, 22 nt, Homo sapiens
caaaagugguucuuauccuuuu

SEQ ID NO: 371211 - RNA, 22 nt, Homo sapiens
caaaguaauuacgguuuuggcc

SEQ ID NO: 371212 - RNA, 22 nt, Homo sapiens
caacucuguaggauccaggugg

SEQ ID NO: 371213 - RNA, 22 nt, Homo sapiens
cacaccuaccucauuauggaca

SEQ ID NO: 371214 - RNA, 22 nt, Homo sapiens
cacagcuaacaacuguuucuuc

SEQ ID NO: 371215 - RNA, 22 nt, Homo sapiens
cacaggaagaggcacggucccu

SEQ ID NO: 371216 - RNA, 22 nt, Homo sapiens
cacagucugggcuuguuuguac

SEQ ID NO: 371217 - RNA, 22 nt, Homo sapiens
cacugcauccuccaccuccugg

SEQ ID NO: 371218 - RNA, 22 nt, Homo sapiens
cacugcauucuccaccucccag

SEQ ID NO: 371219 - RNA, 22 nt, Homo sapiens
cagauggucuuaaggcagccuu

SEQ ID NO: 371220 - RNA, 22 nt, Homo sapiens
cagcuaguaauuuauugaagau

SEQ ID NO: 371221 - RNA, 22 nt, Homo sapiens
cagcuguuguuccagucuuuua

SEQ ID NO: 371222 - RNA, 22 nt, Homo sapiens
cagcuguuguugggguauagga

SEQ ID NO: 371223 - RNA, 22 nt, Homo sapiens
caggcuuuuccacacauggguu

SEQ ID NO: 371224 - RNA, 22 nt, Homo sapiens
cagguacaugcaugugugugca

SEQ ID NO: 371225 - RNA, 22 nt, Homo sapiens
caguuacuuuugcaccaaccua

SEQ ID NO: 371226 - RNA, 19 nt, Homo sapiens
caucccugagcugaagugg

SEQ ID NO: 371227 - RNA, 22 nt, Homo sapiens
caugcagcacacaugucugugc

SEQ ID NO: 371228 - RNA, 22 nt, Homo sapiens
caugccacugcacgccauccug

SEQ ID NO: 371229 - RNA, 22 nt, Homo sapiens
cauggcccuggguccauaggaa

SEQ ID NO: 371230 - RNA, 22 nt, Homo sapiens
cauuacacuuguaagguuuuuc

SEQ ID NO: 371231 - RNA, 22 nt, Homo sapiens
cauugcaguuuuugguguaucu

SEQ ID NO: 371232 - RNA, 22 nt, Homo sapiens
ccagcaccauuuauuaaauagg

SEQ ID NO: 371233 - RNA, 22 nt, Homo sapiens
ccagcaccauuuguugaauagg

SEQ ID NO: 371234 - RNA, 22 nt, Homo sapiens
ccaguguucuggaaggcugagu

SEQ ID NO: 371235 - RNA, 22 nt, Homo sapiens
ccauugaacaugaaggaaugug

SEQ ID NO: 371236 - RNA, 22 nt, Homo sapiens
ccccauguucucucugcagcuc

SEQ ID NO: 371237 - RNA, 22 nt, Homo sapiens
ccccauuugaacuccuucaacu

SEQ ID NO: 371238 - RNA, 17 nt, Homo sapiens
ccccugagcgaugcagu

SEQ ID NO: 371239 - RNA, 21 nt, Homo sapiens
ccccugauacuuagucaagag

SEQ ID NO: 371240 - RNA, 22 nt, Homo sapiens
ccugaugacacgggagauguac

SEQ ID NO: 371241 - RNA, 22 nt, Homo sapiens
ccuggaucauugucauucccaa

SEQ ID NO: 371242 - RNA, 22 nt, Homo sapiens
cuagcagcauaagaaucaccaa

SEQ ID NO: 371243 - RNA, 22 nt, Homo sapiens
cuagcagcaugagaauggacca

SEQ ID NO: 371244 - RNA, 22 nt, Homo sapiens
cuauguaccuggaacuguauua

SEQ ID NO: 371245 - RNA, 22 nt, Homo sapiens
uaugaccuuguccccucucgcc

SEQ ID NO: 371246 - RNA, 22 nt, Homo sapiens
uaugugguuaauaggaauuugu

SEQ ID NO: 371247 - RNA, 22 nt, Homo sapiens
uauugcagauacccaggaaguu

SEQ ID NO: 371248 - RNA, 22 nt, Homo sapiens
uauuguuuuucccaggagucua

SEQ ID NO: 371249 - RNA, 22 nt, Homo sapiens
uauuugguuauaugaguaaguu

SEQ ID NO: 371250 - RNA, 22 nt, Homo sapiens
ucaagcaauucgccugucucag

SEQ ID NO: 371251 - RNA, 18 nt, Homo sapiens
ucaagcaauugucaugcc

SEQ ID NO: 371252 - RNA, 22 nt, Homo sapiens
ucaaggacucagagagggauua

SEQ ID NO: 371253 - RNA, 22 nt, Homo sapiens
ucacagaggagaagaccuuuaa

SEQ ID NO: 371254 - RNA, 21 nt, Homo sapiens
ucacagccuaggaccugaaga

SEQ ID NO: 371255 - RNA, 22 nt, Homo sapiens
ucacagcuaaaaugaaaguagu

SEQ ID NO: 371256 - RNA, 22 nt, Homo sapiens
ucacaggguguuauuagaauua

SEQ ID NO: 371257 - RNA, 22 nt, Homo sapiens
ucacugcgaccuccaccuccug

SEQ ID NO: 371258 - RNA, 22 nt, Homo sapiens
ucagaguagaaacacuuccaua

SEQ ID NO: 371259 - RNA, 22 nt, Homo sapiens
ucagaguaguuccuggcagaaa

SEQ ID NO: 371260 - RNA, 22 nt, Homo sapiens
ucaguguuuggaaucucaauuu

SEQ ID NO: 371261 - RNA, 22 nt, Homo sapiens
ucauccauacaguuagcaaagg

SEQ ID NO: 371262 - RNA, 22 nt, Homo sapiens
ucauggcauuguuaaggguuuu

SEQ ID NO: 371263 - RNA, 22 nt, Homo sapiens
ucauugguugcguaauuugauu

SEQ ID NO: 371264 - RNA, 22 nt, Homo sapiens
uccacaguggugaggugcagca

SEQ ID NO: 371265 - RNA, 18 nt, Homo sapiens
uccaguuuucccagcauc

SEQ ID NO: 371266 - RNA, 22 nt, Homo sapiens
uccuacugucuucggggcacug

SEQ ID NO: 371267 - RNA, 21 nt, Homo sapiens
uccugagagaggaguaacucu

SEQ ID NO: 371268 - RNA, 22 nt, Homo sapiens
ucuaaggcaccuagagucauca

SEQ ID NO: 371269 - RNA, 22 nt, Homo sapiens
ucucauagaggcagagaguaaa

SEQ ID NO: 371270 - RNA, 21 nt, Homo sapiens
ucuggcccccucaaaucucau

SEQ ID NO: 371271 - RNA, 21 nt, Homo sapiens
ucuggccccuccaaaucucau

SEQ ID NO: 371272 - RNA, 21 nt, Homo sapiens
ucuggcuuucauuccccuucu

SEQ ID NO: 371273 - RNA, 22 nt, Homo sapiens
ucugguggugaugagagacagu

SEQ ID NO: 371274 - RNA, 22 nt, Homo sapiens
ucugucaaaucuuauguuguag

SEQ ID NO: 371275 - RNA, 22 nt, Homo sapiens
ucugucuugugguuugagugcc

SEQ ID NO: 371276 - RNA, 22 nt, Homo sapiens
ucuugggugaguuugugaauaa

SEQ ID NO: 371277 - RNA, 22 nt, Homo sapiens
ucuuugauguucugaaagaugg

SEQ ID NO: 371278 - RNA, 22 nt, Homo sapiens
ucuuugauuaugcagauggguu

SEQ ID NO: 371279 - RNA, 19 nt, Homo sapiens
ugacacuguuggugggagg

SEQ ID NO: 371280 - RNA, 18 nt, Homo sapiens
ugacagcacaugugggga

SEQ ID NO: 371281 - RNA, 22 nt, Homo sapiens
ugacaugaugagcaauaauggc

SEQ ID NO: 371282 - RNA, 22 nt, Homo sapiens
ugacuugaaguuaccauaugca

SEQ ID NO: 371283 - RNA, 17 nt, Homo sapiens
ugagaacaugugguauu

SEQ ID NO: 371284 - RNA, 22 nt, Homo sapiens
ugagaagacaucagcuuucgga

SEQ ID NO: 371285 - RNA, 22 nt, Homo sapiens
ugagacaaucucaucucaguga

SEQ ID NO: 371286 - RNA, 22 nt, Homo sapiens
ugagacugagucuugcucuauu

SEQ ID NO: 371287 - RNA, 22 nt, Homo sapiens
ugagaguagggguugggauugg

SEQ ID NO: 371288 - RNA, 22 nt, Homo sapiens
ugagaugaguucucgcucuguc

SEQ ID NO: 371289 - RNA, 22 nt, Homo sapiens
ugagaugaguugcuggcucuga

SEQ ID NO: 371290 - RNA, 22 nt, Homo sapiens
ugaguuuaucuaaagaccuggg

SEQ ID NO: 371291 - RNA, 22 nt, Homo sapiens
ugauguguuuuguaguucaacu

SEQ ID NO: 371292 - RNA, 22 nt, Homo sapiens
ugcaagaggagacuguacucag

SEQ ID NO: 371293 - RNA, 18 nt, Homo sapiens
aaacugcuuccuuggccu

SEQ ID NO: 371294 - RNA, 22 nt, Homo sapiens
aaagucuguuuugucagagacu

SEQ ID NO: 371295 - RNA, 22 nt, Homo sapiens
aaagugacuuagugccccauuu

SEQ ID NO: 371296 - RNA, 22 nt, Homo sapiens
aaagugcugggauuaggccagg

SEQ ID NO: 371297 - RNA, 22 nt, Homo sapiens
aacagucuccaguuguauccau

SEQ ID NO: 371298 - RNA, 21 nt, Homo sapiens
aacuggugugagaugguaugu

SEQ ID NO: 371299 - RNA, 22 nt, Homo sapiens
aagagguagcagucacaaaaga

SEQ ID NO: 371300 - RNA, 22 nt, Homo sapiens
aagagguuuaacugacucacag

SEQ ID NO: 371301 - RNA, 21 nt, Homo sapiens
aagcacauugaguguguguga

SEQ ID NO: 371302 - RNA, 22 nt, Homo sapiens
aagcacccuuugucuggacaug

SEQ ID NO: 371303 - RNA, 22 nt, Homo sapiens
aagcaggugaugagugggugug

SEQ ID NO: 371304 - RNA, 21 nt, Homo sapiens
aagcaugguguaucuuuccau

SEQ ID NO: 371305 - RNA, 22 nt, Homo sapiens
aagcugccaggcaugguggcug

SEQ ID NO: 371306 - RNA, 22 nt, Homo sapiens
aagcuguuguucauccugaauu

SEQ ID NO: 371307 - RNA, 20 nt, Homo sapiens
aaggcuuucgaguuccaggg

SEQ ID NO: 371308 - RNA, 20 nt, Homo sapiens
aagugcaucguugugucugc

SEQ ID NO: 371309 - RNA, 22 nt, Homo sapiens
aauacuuccaaaucuagucauu

SEQ ID NO: 371310 - RNA, 22 nt, Homo sapiens
aaucacacuugauguugagcaa

SEQ ID NO: 371311 - RNA, 22 nt, Homo sapiens
aaugugcacuuggagccuugcu

SEQ ID NO: 371312 - RNA, 22 nt, Homo sapiens
aauuggugaccaagggaaggac

SEQ ID NO: 371313 - RNA, 18 nt, Homo sapiens
acagugucauggcucaau

SEQ ID NO: 371314 - RNA, 22 nt, Homo sapiens
acccuggaggucuacagugcag

SEQ ID NO: 371315 - RNA, 22 nt, Homo sapiens
acccuggaguaguaggaaucug

SEQ ID NO: 371316 - RNA, 22 nt, Homo sapiens
acccuggauucguggccuugaa

SEQ ID NO: 371317 - RNA, 22 nt, Homo sapiens
acccugucaaaauggaccaauc

SEQ ID NO: 371318 - RNA, 19 nt, Homo sapiens
acccuguccccaccuuuac

SEQ ID NO: 371319 - RNA, 22 nt, Homo sapiens
acuauacugaagcaaauuaaca

SEQ ID NO: 371320 - RNA, 22 nt, Homo sapiens
acucagagauuagcacauguuu

SEQ ID NO: 371321 - RNA, 22 nt, Homo sapiens
acuggaguuuguucaagaaaua

SEQ ID NO: 371322 - RNA, 22 nt, Homo sapiens
acugguguaugggaggucccaa

SEQ ID NO: 371323 - RNA, 20 nt, Homo sapiens
agagaucaguaauucaucaa

SEQ ID NO: 371324 - RNA, 22 nt, Homo sapiens
agagguuuaauugauucacagu

SEQ ID NO: 371325 - RNA, 22 nt, Homo sapiens
agaguauagcaacuuaguaaaa

SEQ ID NO: 371326 - RNA, 22 nt, Homo sapiens
agaugguguuggcugaguguau

SEQ ID NO: 371327 - RNA, 22 nt, Homo sapiens
agaugguguuuucucaccagau

SEQ ID NO: 371328 - RNA, 22 nt, Homo sapiens
agauguuguucaucugauuguu

SEQ ID NO: 371329 - RNA, 22 nt, Homo sapiens
agcagcaucgggaaguuggcca

SEQ ID NO: 371330 - RNA, 22 nt, Homo sapiens
agcuguguugucugaagucaga

SEQ ID NO: 371331 - RNA, 22 nt, Homo sapiens
aggaaucuaagguaucagguua

SEQ ID NO: 371332 - RNA, 22 nt, Homo sapiens
aggaauggaaacuuuugauggu

SEQ ID NO: 371333 - RNA, 22 nt, Homo sapiens
aggaaugucaaugguaguuuaa

SEQ ID NO: 371334 - RNA, 22 nt, Homo sapiens
agggagcaaaguggucuuucuc

SEQ ID NO: 371335 - RNA, 20 nt, Homo sapiens
agguuauuauaauuagaaga

SEQ ID NO: 371336 - RNA, 22 nt, Homo sapiens
agucaguguguauugauggcac

SEQ ID NO: 371337 - RNA, 22 nt, Homo sapiens
agucauggaucacaguagccuc

SEQ ID NO: 371338 - RNA, 22 nt, Homo sapiens
agucauggcagaaggcaccucu

SEQ ID NO: 371339 - RNA, 22 nt, Homo sapiens
ucacugaaaccuccaccucucg

SEQ ID NO: 371340 - RNA, 22 nt, Homo sapiens
ucagcaccauguaacaauugau

SEQ ID NO: 371341 - RNA, 22 nt, Homo sapiens
ucaggcacuaguaagaaaaagg

SEQ ID NO: 371342 - RNA, 22 nt, Homo sapiens
ucaggucauuccaggagggcca

SEQ ID NO: 371343 - RNA, 22 nt, Homo sapiens
ucaguaaaugcuguucucuuuu

SEQ ID NO: 371344 - RNA, 22 nt, Homo sapiens
ucaguggauuuaaccugaauca

SEQ ID NO: 371345 - RNA, 22 nt, Homo sapiens
ucaguucauggaggugucugcu

SEQ ID NO: 371346 - RNA, 22 nt, Homo sapiens
uccagaguggugaugcuggggc

SEQ ID NO: 371347 - RNA, 22 nt, Homo sapiens
uccagguacucagggggcugag

SEQ ID NO: 371348 - RNA, 22 nt, Homo sapiens
ucccaguggucuugaaacaggg

SEQ ID NO: 371349 - RNA, 22 nt, Homo sapiens
uccccgaggcuggagugcagug

SEQ ID NO: 371350 - RNA, 19 nt, Homo sapiens
uccccuguggauaccaaga

SEQ ID NO: 371351 - RNA, 22 nt, Homo sapiens
ucccuagacuccugccuuucag

SEQ ID NO: 371352 - RNA, 22 nt, Homo sapiens
ucccuagagaagugauuuuuga

SEQ ID NO: 371353 - RNA, 22 nt, Homo sapiens
ucccugagcaaaguuuucugua

SEQ ID NO: 371354 - RNA, 22 nt, Homo sapiens
ucccuggacagccuugccuggg

SEQ ID NO: 371355 - RNA, 22 nt, Homo sapiens
ucgcagcacgagcaugcaaggu

SEQ ID NO: 371356 - RNA, 22 nt, Homo sapiens
ucgcagcucacuggagccucga

SEQ ID NO: 371357 - RNA, 22 nt, Homo sapiens
ucucacagaguugaauguuucu

SEQ ID NO: 371358 - RNA, 22 nt, Homo sapiens
ucucagagccuaggguuuuuca

SEQ ID NO: 371359 - RNA, 22 nt, Homo sapiens
ucucuagagagccugguguuca

SEQ ID NO: 371360 - RNA, 22 nt, Homo sapiens
ucugccuacugagcacacagug

SEQ ID NO: 371361 - RNA, 20 nt, Homo sapiens
ucuggccccucuaaaucuca

SEQ ID NO: 371362 - RNA, 22 nt, Homo sapiens
ucuggcuuauuucacuuagcau

SEQ ID NO: 371363 - RNA, 23 nt, Homo sapiens
ucuggcuuugggaugcucaaggg

SEQ ID NO: 371364 - RNA, 22 nt, Homo sapiens
ucuguuguuguuuuaagagaca

SEQ ID NO: 371365 - RNA, 22 nt, Homo sapiens
ugacaugaagaaaaacagauuu

SEQ ID NO: 371366 - RNA, 22 nt, Homo sapiens
ugagaacagauggcuuuauuau

SEQ ID NO: 371367 - RNA, 22 nt, Homo sapiens
ugagaacagcagcuugggacac

SEQ ID NO: 371368 - RNA, 22 nt, Homo sapiens
ugagaacaugugauauuuggug

SEQ ID NO: 371369 - RNA, 20 nt, Homo sapiens
ugagaacauguggcauuugg

SEQ ID NO: 371370 - RNA, 20 nt, Homo sapiens
ugagaacaugugguauuugg

SEQ ID NO: 371371 - RNA, 22 nt, Homo sapiens
ugagacggaguuucacucuugu

SEQ ID NO: 371372 - RNA, 22 nt, Homo sapiens
ugagacugagucucccucuguc

SEQ ID NO: 371373 - RNA, 21 nt, Homo sapiens
ugagaguaguguauuauucuc

SEQ ID NO: 371374 - RNA, 22 nt, Homo sapiens
ugagaguauaaauugaugcagc

SEQ ID NO: 371375 - RNA, 22 nt, Homo sapiens
ugagaucgagucucgcucuguc

SEQ ID NO: 371376 - RNA, 22 nt, Homo sapiens
ugagaugacgacacaccucagu

SEQ ID NO: 371377 - RNA, 22 nt, Homo sapiens
ugagaugagggcugcacucaaa

SEQ ID NO: 371378 - RNA, 22 nt, Homo sapiens
ugagaugaggucucacucuguu

SEQ ID NO: 371379 - RNA, 22 nt, Homo sapiens
ugagaugaggucucgcucuguc

SEQ ID NO: 371380 - RNA, 22 nt, Homo sapiens
ugagauuaucuguacauaggag

SEQ ID NO: 371381 - RNA, 22 nt, Homo sapiens
ugagcacuguacuuuaucaggu

SEQ ID NO: 371382 - RNA, 22 nt, Homo sapiens
ugagcccauuguccugguuuau

SEQ ID NO: 371383 - RNA, 17 nt, Homo sapiens
ugagggaugccugguuc

SEQ ID NO: 371384 - RNA, 22 nt, Homo sapiens
ugagggaugcguacccuaugcc

SEQ ID NO: 371385 - RNA, 22 nt, Homo sapiens
ugauggcauuucauguuuguaa

SEQ ID NO: 371386 - RNA, 20 nt, Homo sapiens
ugauguccaggcagagguuu

SEQ ID NO: 371387 - RNA, 22 nt, Homo sapiens
ugcagcucaaauuccuaacaag

SEQ ID NO: 371388 - RNA, 22 nt, Homo sapiens
ugcagcucagcugcggaguuuu

SEQ ID NO: 371389 - RNA, 22 nt, Homo sapiens
ugccugagcccagcccuguagu

SEQ ID NO: 371390 - RNA, 22 nt, Homo sapiens
ugccugcugucuaauauauucu

SEQ ID NO: 371391 - RNA, 22 nt, Homo sapiens
ugccuggagagcuccuacauau

SEQ ID NO: 371392 - RNA, 22 nt, Homo sapiens
ugcugcauuggggauuaaguuu

SEQ ID NO: 371393 - RNA, 22 nt, Homo sapiens
uggaaucuacuaaagcaaaauc

SEQ ID NO: 371394 - RNA, 22 nt, Homo sapiens
uggaaucuuaggugaaggcuuu

SEQ ID NO: 371395 - RNA, 22 nt, Homo sapiens
uggagauguuuaaaauccacug

SEQ ID NO: 371396 - RNA, 21 nt, Homo sapiens
uggcaaaaugggcaguggguu

SEQ ID NO: 371397 - RNA, 22 nt, Homo sapiens
uggcaagcaggacuaaagcacc

SEQ ID NO: 371398 - RNA, 22 nt, Homo sapiens
uggcagacaaauuugagcauau

SEQ ID NO: 371399 - RNA, 22 nt, Homo sapiens
uggcagaugcucuuggugccca

SEQ ID NO: 371400 - RNA, 22 nt, Homo sapiens
uggcagcugcuucaugggaugc

SEQ ID NO: 371401 - RNA, 22 nt, Homo sapiens
uggcaguuuuaugugguucaac

SEQ ID NO: 371402 - RNA, 22 nt, Homo sapiens
ugggaaauguagccuagcugug

SEQ ID NO: 371403 - RNA, 22 nt, Homo sapiens
ugguaagaucagaacuggaguc

SEQ ID NO: 371404 - RNA, 22 nt, Homo sapiens
ugguauuuaauauaugagaguu

SEQ ID NO: 371405 - RNA, 22 nt, Homo sapiens
uggugccgugguccuggggcca

SEQ ID NO: 371406 - RNA, 21 nt, Homo sapiens
uguagcagcaugauucauagu

SEQ ID NO: 371407 - RNA, 22 nt, Homo sapiens
ugucaugagucuccuccaucuu

SEQ ID NO: 371408 - RNA, 22 nt, Homo sapiens
ugucccaguuggguauugaauu

SEQ ID NO: 371409 - RNA, 22 nt, Homo sapiens
uguccugcagagguguuugccu

SEQ ID NO: 371410 - RNA, 22 nt, Homo sapiens
ugugcgcaucggggccugcuuc

SEQ ID NO: 371411 - RNA, 22 nt, Homo sapiens
ugugggaggugcuaauguaaau

SEQ ID NO: 371412 - RNA, 22 nt, Homo sapiens
ugugucuuuuaucacacaaugu

SEQ ID NO: 371413 - RNA, 22 nt, Homo sapiens
uguucuugaguugggaguacaa

SEQ ID NO: 371414 - RNA, 22 nt, Homo sapiens
uguuuuggaggccagaagucca

SEQ ID NO: 371415 - RNA, 22 nt, Homo sapiens
uuacaagaugucuguccaacac

SEQ ID NO: 371416 - RNA, 22 nt, Homo sapiens
uuagaaaguagaaaagcugguu

SEQ ID NO: 371417 - RNA, 22 nt, Homo sapiens
uuagcagcaugagaauggacua

SEQ ID NO: 371418 - RNA, 22 nt, Homo sapiens
uuaguagcacagaguaucagca

SEQ ID NO: 371419 - RNA, 22 nt, Homo sapiens
uuaucucagugaacugagugga

SEQ ID NO: 371420 - RNA, 22 nt, Homo sapiens
uuauucauuaacagggaccaaa

SEQ ID NO: 371421 - RNA, 22 nt, Homo sapiens
uuauugcacuccagccugggua

SEQ ID NO: 371422 - RNA, 22 nt, Homo sapiens
uuauuugguugcugacuuggaa

SEQ ID NO: 371423 - RNA, 22 nt, Homo sapiens
uucaagaauuaaaguggcuuuu

SEQ ID NO: 371424 - RNA, 22 nt, Homo sapiens
uucaaguaguucucaugccuca

SEQ ID NO: 371425 - RNA, 22 nt, Homo sapiens
uucaagucuuggcuuugccacc

SEQ ID NO: 371426 - RNA, 22 nt, Homo sapiens
uucacuggagcccaggaguugg

SEQ ID NO: 371427 - RNA, 22 nt, Homo sapiens
uucagaucaucccagcuccacu

SEQ ID NO: 371428 - RNA, 18 nt, Homo sapiens
uucaguuuguaucugggg

SEQ ID NO: 371429 - RNA, 19 nt, Homo sapiens
uucauacagugagagcagc

SEQ ID NO: 371430 - RNA, 22 nt, Homo sapiens
uucaucuggcaauucagagauu

SEQ ID NO: 371431 - RNA, 22 nt, Homo sapiens
uucaugcaucuguagugguuaa

SEQ ID NO: 371432 - RNA, 22 nt, Homo sapiens
uucccguacugguguugccuau

SEQ ID NO: 371433 - RNA, 22 nt, Homo sapiens
uucgcagcucaguucaacuagg

SEQ ID NO: 371434 - RNA, 21 nt, Homo sapiens
uucucagaggcaggggauaaa

SEQ ID NO: 371435 - RNA, 22 nt, Homo sapiens
uucucauggaacaucuguacug

SEQ ID NO: 371436 - RNA, 22 nt, Homo sapiens
uucugcacaucgaucacaagau

SEQ ID NO: 371437 - RNA, 22 nt, Homo sapiens
uucugugcuuguggaugaagug

SEQ ID NO: 371438 - RNA, 22 nt, Homo sapiens
uucugugguugaaaggagagau

SEQ ID NO: 371439 - RNA, 19 nt, Homo sapiens
uugaaggccgccuugcaga

SEQ ID NO: 371440 - RNA, 22 nt, Homo sapiens
uugaaguagaaagacgaaauuu

SEQ ID NO: 371441 - RNA, 22 nt, Homo sapiens
uugaaugaaaugaugucauuug

SEQ ID NO: 371442 - RNA, 22 nt, Homo sapiens
uugagacggagucucacucugu

SEQ ID NO: 371443 - RNA, 22 nt, Homo sapiens
uugagauggaaucucgcuuugu

SEQ ID NO: 371444 - RNA, 22 nt, Homo sapiens
uugagauggagccucacucugc

SEQ ID NO: 371445 - RNA, 22 nt, Homo sapiens
uugagauggagucucacuccuu

SEQ ID NO: 371446 - RNA, 22 nt, Homo sapiens
uugagauggagucuugcucucu

SEQ ID NO: 371447 - RNA, 22 nt, Homo sapiens
uugagauggaguguugcucugu

SEQ ID NO: 371448 - RNA, 22 nt, Homo sapiens
uugagauggaguuucaauauug

SEQ ID NO: 371449 - RNA, 22 nt, Homo sapiens
uugagauggaguuucacucugu

SEQ ID NO: 371450 - RNA, 22 nt, Homo sapiens
uugcaaaguugccaaggaagga

SEQ ID NO: 371451 - RNA, 19 nt, Homo sapiens
uugcauauguugaaccagg

SEQ ID NO: 371452 - RNA, 22 nt, Homo sapiens
uuggcaagaaccuucuuccaag

SEQ ID NO: 371453 - RNA, 22 nt, Homo sapiens
uuggcaagcuguuaauuauaaa

SEQ ID NO: 371454 - RNA, 22 nt, Homo sapiens
uuggcuucuggacuauugugca

SEQ ID NO: 371455 - RNA, 22 nt, Homo sapiens
uugggagugucucuggacugca

SEQ ID NO: 371456 - RNA, 22 nt, Homo sapiens
uuguauguuuguucuuucagau

SEQ ID NO: 371457 - RNA, 19 nt, Homo sapiens
uuguccccucuaaaucuca

SEQ ID NO: 371458 - RNA, 22 nt, Homo sapiens
uuguccccuuccaaaucucaug

SEQ ID NO: 371459 - RNA, 19 nt, Homo sapiens
uugucuuagaguugucauu

SEQ ID NO: 371460 - RNA, 22 nt, Homo sapiens
uugugcuucaucaccuagcaga

SEQ ID NO: 371461 - RNA, 22 nt, Homo sapiens
uugugcuugauuugccuagcug

SEQ ID NO: 371462 - RNA, 22 nt, Homo sapiens
uuguguuuuuaguagggaaggg

SEQ ID NO: 371463 - RNA, 22 nt, Homo sapiens
uuuaacauuggaugagaucguc

SEQ ID NO: 371464 - RNA, 23 nt, Homo sapiens
uuucacaguagcuggaucagccu

SEQ ID NO: 371465 - RNA, 22 nt, Homo sapiens
uuucagagucaucugcccaagu

SEQ ID NO: 371466 - RNA, 17 nt, Homo sapiens
uuucagaguggaagugu

SEQ ID NO: 371467 - RNA, 20 nt, Homo sapiens
uuucaguacuuucuacuggc

SEQ ID NO: 371468 - RNA, 22 nt, Homo sapiens
uuuggcaguuauuuacucagug

SEQ ID NO: 371469 - RNA, 22 nt, Homo sapiens
uuuguaauccuauuccaaagga

SEQ ID NO: 371470 - RNA, 21 nt, Homo sapiens
uuuguaguagcaugauuuaua

SEQ ID NO: 371471 - RNA, 22 nt, Homo sapiens
uuugucauagcagcaggaaugg

SEQ ID NO: 371472 - RNA, 22 nt, Homo sapiens
uuugugagguggauagauugca

SEQ ID NO: 371473 - RNA, 22 nt, Homo sapiens
uuuuacacaucaccgcucgugu

SEQ ID NO: 371474 - RNA, 22 nt, Homo sapiens
gucaggcaccgauacaguuuuu

SEQ ID NO: 371475 - RNA, 22 nt, Homo sapiens
guccaugagaugaauccacaca

SEQ ID NO: 371476 - RNA, 22 nt, Homo sapiens
gucugguuccugggagauuucu

SEQ ID NO: 371477 - RNA, 22 nt, Homo sapiens
gugagaugguaucucauugugg

SEQ ID NO: 371478 - RNA, 22 nt, Homo sapiens
gugcacaacgugcaggcuuguu

SEQ ID NO: 371479 - RNA, 22 nt, Homo sapiens
gugcacaacguguagguuuguu

SEQ ID NO: 371480 - RNA, 22 nt, Homo sapiens
gugcacaaucgugcauuccuug

SEQ ID NO: 371481 - RNA, 22 nt, Homo sapiens
gugcacaaugugcagguuuguu

SEQ ID NO: 371482 - RNA, 22 nt, Homo sapiens
gugcacuguagaacccuuuguu

SEQ ID NO: 371483 - RNA, 22 nt, Homo sapiens
gugccacaguguuaagggauuc

SEQ ID NO: 371484 - RNA, 22 nt, Homo sapiens
guggcaaguguuccaagaggcg

SEQ ID NO: 371485 - RNA, 22 nt, Homo sapiens
guggcagcacauauagguuguu

SEQ ID NO: 371486 - RNA, 22 nt, Homo sapiens
gugguagaaauguagaugcuag

SEQ ID NO: 371487 - RNA, 22 nt, Homo sapiens
gugguucuagaauugaguaucc

SEQ ID NO: 371488 - RNA, 22 nt, Homo sapiens
guguauguuguccauggaugcg

SEQ ID NO: 371489 - RNA, 21 nt, Homo sapiens
gugugcuugagugaugggauu

SEQ ID NO: 371490 - RNA, 22 nt, Homo sapiens
guuaagaaguguaacuuaaguu

SEQ ID NO: 371491 - RNA, 22 nt, Homo sapiens
guuguauaggcauggggagaau

SEQ ID NO: 371492 - RNA, 22 nt, Homo sapiens
uaaagcacuuuuuucugcaugg

SEQ ID NO: 371493 - RNA, 22 nt, Homo sapiens
uaaagcuuagauccaugguggc

SEQ ID NO: 371494 - RNA, 22 nt, Homo sapiens
uaaggcaaucagucaugguguu

SEQ ID NO: 371495 - RNA, 22 nt, Homo sapiens
uaagugguguucauucuuuuga

SEQ ID NO: 371496 - RNA, 22 nt, Homo sapiens
uacaaagugggaaacgaagguu

SEQ ID NO: 371497 - RNA, 22 nt, Homo sapiens
uacaaaucuagguuuguuacug

SEQ ID NO: 371498 - RNA, 22 nt, Homo sapiens
uacagcuaugugcaugcaugcu

SEQ ID NO: 371499 - RNA, 22 nt, Homo sapiens
uacaggcagguguucccugguu

SEQ ID NO: 371500 - RNA, 22 nt, Homo sapiens
uacauguauguguuuauggcug

SEQ ID NO: 371501 - RNA, 22 nt, Homo sapiens
uagauuaucucaccacucgagu

SEQ ID NO: 371502 - RNA, 22 nt, Homo sapiens
uagcacccucuccuaguccugc

SEQ ID NO: 371503 - RNA, 22 nt, Homo sapiens
uagcagcuuuauugagguaaau

SEQ ID NO: 371504 - RNA, 22 nt, Homo sapiens
uagcagguggugaccacauuuu

SEQ ID NO: 371505 - RNA, 22 nt, Homo sapiens
uagcuguuggugggaagucaga

SEQ ID NO: 371506 - RNA, 22 nt, Homo sapiens
uaggcuuuucugggaugugggc

SEQ ID NO: 371507 - RNA, 22 nt, Homo sapiens
uaggcuuuuggacccugucucu

SEQ ID NO: 371508 - RNA, 22 nt, Homo sapiens
uagucaaaucugaaggaaauuu

SEQ ID NO: 371509 - RNA, 22 nt, Homo sapiens
uaucaaguguuagggagaugug

SEQ ID NO: 371510 - RNA, 23 nt, Homo sapiens
uaucacacuuucucugugccaca

SEQ ID NO: 371511 - RNA, 22 nt, Homo sapiens
uaucacaggucaggaaccuugu

SEQ ID NO: 371512 - RNA, 22 nt, Homo sapiens
uaucacagugcuggaguauucc

SEQ ID NO: 371513 - RNA, 22 nt, Homo sapiens
uaucuacauguagguauguaug

SEQ ID NO: 371514 - RNA, 22 nt, Homo sapiens
uaugacuuuugaauacagaugg

SEQ ID NO: 371515 - RNA, 22 nt, Homo sapiens
uaugccuuuugguucaagcaac

SEQ ID NO: 371516 - RNA, 22 nt, Homo sapiens
uauggcaaugcauaggaaggaa

SEQ ID NO: 371517 - RNA, 22 nt, Homo sapiens
uauuccacuauuaguccagaug

SEQ ID NO: 371518 - RNA, 22 nt, Homo sapiens
uauuuguccccuccaaaaguca

SEQ ID NO: 371519 - RNA, 22 nt, Homo sapiens
ucaaguacugccuugcucuggc

SEQ ID NO: 371520 - RNA, 22 nt, Homo sapiens
ucacagccuaguuuuauacauu

SEQ ID NO: 371521 - RNA, 22 nt, Homo sapiens
ucacaugugacauauauauuug

SEQ ID NO: 371522 - RNA, 22 nt, Homo sapiens
ucacaugugcguuuuggcaugu

SEQ ID NO: 371523 - RNA, 20 nt, Homo sapiens
ucacccugacaucugcccag

SEQ ID NO: 371524 - RNA, 22 nt, Homo sapiens
ucacugcgaccuccaccucccg

SEQ ID NO: 371525 - RNA, 22 nt, Homo sapiens
ucagacacugcccuccaccugu

SEQ ID NO: 371526 - RNA, 22 nt, Homo sapiens
ucagaugaucugguaagaacuu

SEQ ID NO: 371527 - RNA, 22 nt, Homo sapiens
ucagcaaugaccuaagcaaaua

SEQ ID NO: 371528 - RNA, 22 nt, Homo sapiens
ucaggcaccuuccucuuaucug

SEQ ID NO: 371529 - RNA, 22 nt, Homo sapiens
ucaggcacucagcuuagagucu

SEQ ID NO: 371530 - RNA, 21 nt, Homo sapiens
ucaguuacugagagagaagug

SEQ ID NO: 371531 - RNA, 22 nt, Homo sapiens
ucauggcacugaugagaguuuc

SEQ ID NO: 371532 - RNA, 20 nt, Homo sapiens
ucccuaagagccuuuccuuc

SEQ ID NO: 371533 - RNA, 22 nt, Homo sapiens
ucccugagguccuggauuauug

SEQ ID NO: 371534 - RNA, 22 nt, Homo sapiens
ucccugagugauugaaaauaaa

SEQ ID NO: 371535 - RNA, 22 nt, Homo sapiens
uccucugaacuccagacccaua

SEQ ID NO: 371536 - RNA, 22 nt, Homo sapiens
ucgcagugcacucuuuuagcuu

SEQ ID NO: 371537 - RNA, 22 nt, Homo sapiens
ucucacacugaauguguguggg

SEQ ID NO: 371538 - RNA, 22 nt, Homo sapiens
ucuggccccucccaaaucucau

SEQ ID NO: 371539 - RNA, 22 nt, Homo sapiens
ucuggccccucucaaaucucau

SEQ ID NO: 371540 - RNA, 22 nt, Homo sapiens
ucugugcauuguaacaacuaaa

SEQ ID NO: 371541 - RNA, 22 nt, Homo sapiens
ucuucagucauauuggccugga

SEQ ID NO: 371542 - RNA, 22 nt, Homo sapiens
ucuucaugcuugaaauaauagc

SEQ ID NO: 371543 - RNA, 22 nt, Homo sapiens
ucuuuaguaauuucuguaaggc

SEQ ID NO: 371544 - RNA, 22 nt, Homo sapiens
ucuuugggauauucugaaaggg

SEQ ID NO: 371545 - RNA, 22 nt, Homo sapiens
ucuuugguaggaguaggaggcc

SEQ ID NO: 371546 - RNA, 22 nt, Homo sapiens
ucuuugguugcacugcaggugu

SEQ ID NO: 371547 - RNA, 22 nt, Homo sapiens
ucuuuuguaaaaugaggaggug

SEQ ID NO: 371548 - RNA, 22 nt, Homo sapiens
ugaaacugcagugggcuuggca

SEQ ID NO: 371549 - RNA, 22 nt, Homo sapiens
ugaaaugauuauaugguguuug

SEQ ID NO: 371550 - RNA, 22 nt, Homo sapiens
ugaaaugguuaugugaggagau

SEQ ID NO: 371551 - RNA, 23 nt, Homo sapiens
ugacauguaauucaguccagcag

SEQ ID NO: 371552 - RNA, 22 nt, Homo sapiens
ugagacggagucucacucuguu

SEQ ID NO: 371553 - RNA, 22 nt, Homo sapiens
ugagacggaguuucgcucuugu

SEQ ID NO: 371554 - RNA, 22 nt, Homo sapiens
ugagacugaguuuccaucuugu

SEQ ID NO: 371555 - RNA, 22 nt, Homo sapiens
ugagaugaaagcagaaagacuu

SEQ ID NO: 371556 - RNA, 22 nt, Homo sapiens
ugagaugaagucucacucuguc

SEQ ID NO: 371557 - RNA, 21 nt, Homo sapiens
ugagaugauccugcaugcaug

SEQ ID NO: 371558 - RNA, 21 nt, Homo sapiens
ugagauuauauuaacauggua

SEQ ID NO: 371559 - RNA, 22 nt, Homo sapiens
ugaggaaugaccccgugugguc

SEQ ID NO: 371560 - RNA, 22 nt, Homo sapiens
ugaggaucucuaggaauuuauc

SEQ ID NO: 371561 - RNA, 22 nt, Homo sapiens
ugagggaugccugguuuguuuu

SEQ ID NO: 371562 - RNA, 22 nt, Homo sapiens
ugaguaguauucuaugguaugu

SEQ ID NO: 371563 - RNA, 22 nt, Homo sapiens
ugaguaugaguucaggaaaggc

SEQ ID NO: 371564 - RNA, 22 nt, Homo sapiens
ugaguauguuuagaaguaaagg

SEQ ID NO: 371565 - RNA, 22 nt, Homo sapiens
ugagugccuggagggcagggac

SEQ ID NO: 371566 - RNA, 22 nt, Homo sapiens
ugauaugaaagggaaauaagug

SEQ ID NO: 371567 - RNA, 22 nt, Homo sapiens
ugauggcaauggcauucauuuu

SEQ ID NO: 371568 - RNA, 22 nt, Homo sapiens
ugauggcacagugaguuccagg

SEQ ID NO: 371569 - RNA, 22 nt, Homo sapiens
ugaugguguuaccaucuuuacu

SEQ ID NO: 371570 - RNA, 22 nt, Homo sapiens
ugcaagcacacccagggauugu

SEQ ID NO: 371571 - RNA, 22 nt, Homo sapiens
auacaugugugagcgaagaugu

SEQ ID NO: 371572 - RNA, 22 nt, Homo sapiens
auacuaugagauaauaaagacu

SEQ ID NO: 371573 - RNA, 22 nt, Homo sapiens
auagcauaucccacaugucaga

SEQ ID NO: 371574 - RNA, 22 nt, Homo sapiens
auaugcacaguggaguacuauu

SEQ ID NO: 371575 - RNA, 22 nt, Homo sapiens
aucaaguaaucugaguaagagu

SEQ ID NO: 371576 - RNA, 22 nt, Homo sapiens
aucagcagcaugaaaagcaacu

SEQ ID NO: 371577 - RNA, 22 nt, Homo sapiens
auccacagugucaauguuguga

SEQ ID NO: 371578 - RNA, 22 nt, Homo sapiens
aucuccaggugccagcugcgcc

SEQ ID NO: 371579 - RNA, 22 nt, Homo sapiens
aucuuuggucaucacagcuaga

SEQ ID NO: 371580 - RNA, 17 nt, Homo sapiens
augacuucuucagugug

SEQ ID NO: 371581 - RNA, 22 nt, Homo sapiens
augagaaucauuucagcuugua

SEQ ID NO: 371582 - RNA, 22 nt, Homo sapiens
augcaaacaucugaagagacau

SEQ ID NO: 371583 - RNA, 22 nt, Homo sapiens
augcacuguuguuauuggauaa

SEQ ID NO: 371584 - RNA, 22 nt, Homo sapiens
augcauauuuuaccuagaagag

SEQ ID NO: 371585 - RNA, 19 nt, Homo sapiens
augccuggagaugguuaua

SEQ ID NO: 371586 - RNA, 22 nt, Homo sapiens
augcuguuuuguagcucccucu

SEQ ID NO: 371587 - RNA, 22 nt, Homo sapiens
auggaacauuauagauguaaaa

SEQ ID NO: 371588 - RNA, 21 nt, Homo sapiens
auggacaugguuaggcuuugu

SEQ ID NO: 371589 - RNA, 22 nt, Homo sapiens
auggcccuguguggagcugcug

SEQ ID NO: 371590 - RNA, 22 nt, Homo sapiens
augugcaauguguacguagccc

SEQ ID NO: 371591 - RNA, 22 nt, Homo sapiens
augugcacaugcuuacauguga

SEQ ID NO: 371592 - RNA, 22 nt, Homo sapiens
augugggaggacuuggcuguug

SEQ ID NO: 371593 - RNA, 22 nt, Homo sapiens
auguugcaguuuaauuauccua

SEQ ID NO: 371594 - RNA, 22 nt, Homo sapiens
auuaaguugugccugaaaacuu

SEQ ID NO: 371595 - RNA, 23 nt, Homo sapiens
auugaacacuuucauaugugagg

SEQ ID NO: 371596 - RNA, 22 nt, Homo sapiens
auugcacaucugcacuacagcc

SEQ ID NO: 371597 - RNA, 22 nt, Homo sapiens
auuugguguuguuuggagccua

SEQ ID NO: 371598 - RNA, 22 nt, Homo sapiens
caaggugcugagacaggagccc

SEQ ID NO: 371599 - RNA, 21 nt, Homo sapiens
caagugaugcuucugcuuuaa

SEQ ID NO: 371600 - RNA, 22 nt, Homo sapiens
cacacugucuuucagaaugguu

SEQ ID NO: 371601 - RNA, 22 nt, Homo sapiens
cacagcuagucaaugguagaca

SEQ ID NO: 371602 - RNA, 19 nt, Homo sapiens
caccagugcaugcuacuau

SEQ ID NO: 371603 - RNA, 20 nt, Homo sapiens
cagugcauugcuucugauuu

SEQ ID NO: 371604 - RNA, 22 nt, Homo sapiens
cauaaugcuaagagcugccccu

SEQ ID NO: 371605 - RNA, 22 nt, Homo sapiens
caucacagcaaguagggagugg

SEQ ID NO: 371606 - RNA, 22 nt, Homo sapiens
caucacaugcuuauuuuccuca

SEQ ID NO: 371607 - RNA, 22 nt, Homo sapiens
caucagcaauguaugaggguuc

SEQ ID NO: 371608 - RNA, 22 nt, Homo sapiens
ucugugcauuguaacaacuaaa

SEQ ID NO: 371609 - RNA, 20 nt, Homo sapiens
ucuugggaauguagccuagg

SEQ ID NO: 371610 - RNA, 20 nt, Homo sapiens
ucuuucgguuaccaggcagu

SEQ ID NO: 371611 - RNA, 22 nt, Homo sapiens
ucuuuggguagauauguagcug

SEQ ID NO: 371612 - RNA, 22 nt, Homo sapiens
ucuuugguaugugcaugugcuu

SEQ ID NO: 371613 - RNA, 22 nt, Homo sapiens
ucuuuguguaggucaaucuggc

SEQ ID NO: 371614 - RNA, 22 nt, Homo sapiens
ugaaauuguuugcaaggauagg

SEQ ID NO: 371615 - RNA, 22 nt, Homo sapiens
ugaaugcaucuagaaauuuauu

SEQ ID NO: 371616 - RNA, 20 nt, Homo sapiens
ugaauguaauuacagaugua

SEQ ID NO: 371617 - RNA, 22 nt, Homo sapiens
ugacaagcucccucugcaccuu

SEQ ID NO: 371618 - RNA, 22 nt, Homo sapiens
ugacaggagauuaugugauguu

SEQ ID NO: 371619 - RNA, 23 nt, Homo sapiens
ugacagugcuugaaauugcucuu

SEQ ID NO: 371620 - RNA, 22 nt, Homo sapiens
ugacauggagguggaggaagau

SEQ ID NO: 371621 - RNA, 22 nt, Homo sapiens
ugagacggagucucgcucucua

SEQ ID NO: 371622 - RNA, 22 nt, Homo sapiens
ugagacggagucucgcuguguc

SEQ ID NO: 371623 - RNA, 22 nt, Homo sapiens
ugagacggaguuucacucuugu

SEQ ID NO: 371624 - RNA, 22 nt, Homo sapiens
ugagagaugaacuauucuugaa

SEQ ID NO: 371625 - RNA, 22 nt, Homo sapiens
ugagauaaucaugugauuucau

SEQ ID NO: 371626 - RNA, 18 nt, Homo sapiens
ugagauacuagaauaggu

SEQ ID NO: 371627 - RNA, 22 nt, Homo sapiens
ugagaucaacugagucagagca

SEQ ID NO: 371628 - RNA, 20 nt, Homo sapiens
ugagaucaggauuaaggcua

SEQ ID NO: 371629 - RNA, 22 nt, Homo sapiens
ugagaucagugaagaaguguuu

SEQ ID NO: 371630 - RNA, 22 nt, Homo sapiens
ugagauccaugcuauuugggcu

SEQ ID NO: 371631 - RNA, 19 nt, Homo sapiens
ugagaugaagacagggguu

SEQ ID NO: 371632 - RNA, 22 nt, Homo sapiens
ugagaugaucaaaguauaggcu

SEQ ID NO: 371633 - RNA, 22 nt, Homo sapiens
ugagaugauuuaauggagccca

SEQ ID NO: 371634 - RNA, 22 nt, Homo sapiens
ugagauggaguuucacuuuugu

SEQ ID NO: 371635 - RNA, 22 nt, Homo sapiens
ugagguguuugugcaccaucug

SEQ ID NO: 371636 - RNA, 22 nt, Homo sapiens
ugagugaggcugggcagucccu

SEQ ID NO: 371637 - RNA, 22 nt, Homo sapiens
ugaugacauugucacagucuga

SEQ ID NO: 371638 - RNA, 18 nt, Homo sapiens
ugcaaacauguguguguu

SEQ ID NO: 371639 - RNA, 21 nt, Homo sapiens
ugcagugugguugcccugcug

SEQ ID NO: 371640 - RNA, 22 nt, Homo sapiens
ugcauauguugagaugcauauu

SEQ ID NO: 371641 - RNA, 22 nt, Homo sapiens
ugcauuguauuguugacucgcc

SEQ ID NO: 371642 - RNA, 22 nt, Homo sapiens
ugcuagaagaucacacacauca

SEQ ID NO: 371643 - RNA, 21 nt, Homo sapiens
ugcuuacugaauguuaauuuc

SEQ ID NO: 371644 - RNA, 22 nt, Homo sapiens
uggaagacaaguguuagcaugg

SEQ ID NO: 371645 - RNA, 22 nt, Homo sapiens
uggaagacacauaccugauaac

SEQ ID NO: 371646 - RNA, 22 nt, Homo sapiens
uggaagucuucauuauguauag

SEQ ID NO: 371647 - RNA, 22 nt, Homo sapiens
uggacaagugcccuccaccuca

SEQ ID NO: 371648 - RNA, 22 nt, Homo sapiens
uggaccccugcucgggagcccu

SEQ ID NO: 371649 - RNA, 19 nt, Homo sapiens
uggaccccuuccuuacacc

SEQ ID NO: 371650 - RNA, 21 nt, Homo sapiens
uggaccccuuccuugcaccau

SEQ ID NO: 371651 - RNA, 21 nt, Homo sapiens
uggaccccuuucuuacaccgu

SEQ ID NO: 371652 - RNA, 22 nt, Homo sapiens
uggagguagacauugggaagag

SEQ ID NO: 371653 - RNA, 22 nt, Homo sapiens
uggagguaggacgaagaacucu

SEQ ID NO: 371654 - RNA, 22 nt, Homo sapiens
uggagguagggccuaggaaucu

SEQ ID NO: 371655 - RNA, 22 nt, Homo sapiens
uggagguaggugauauguagca

SEQ ID NO: 371656 - RNA, 22 nt, Homo sapiens
uggauggagaggcuugugaugc

SEQ ID NO: 371657 - RNA, 22 nt, Homo sapiens
uggcaaaaaucacaaguaccuu

SEQ ID NO: 371658 - RNA, 22 nt, Homo sapiens
uggcaagaaccacaauuacuuu

SEQ ID NO: 371659 - RNA, 20 nt, Homo sapiens
uggcaagauggcagaauaga

SEQ ID NO: 371660 - RNA, 22 nt, Homo sapiens
uggcauuguccaauaaaauuuu

SEQ ID NO: 371661 - RNA, 20 nt, Homo sapiens
uggcuucuuaauugcaggca

SEQ ID NO: 371662 - RNA, 20 nt, Homo sapiens
ugggaacaugugguauaugg

SEQ ID NO: 371663 - RNA, 22 nt, Homo sapiens
ugggaagaagguuuacuugcca

SEQ ID NO: 371664 - RNA, 22 nt, Homo sapiens
ugggaagagggagcgauuuugg

SEQ ID NO: 371665 - RNA, 22 nt, Homo sapiens
uggggugugagggagaaagaaa

SEQ ID NO: 371666 - RNA, 21 nt, Homo sapiens
uggguaguuuucaaggccccg

SEQ ID NO: 371667 - RNA, 22 nt, Homo sapiens
uggugagaaacuagauauuuuu

SEQ ID NO: 371668 - RNA, 22 nt, Homo sapiens
uggugagaaaugagaugcuuuu

SEQ ID NO: 371669 - RNA, 22 nt, Homo sapiens
uguacaaaacaagaugggggua

SEQ ID NO: 371670 - RNA, 22 nt, Homo sapiens
uguauguugggucaaaguacau

SEQ ID NO: 371671 - RNA, 22 nt, Homo sapiens
ugucaaauucuggguuaaaaca

SEQ ID NO: 371672 - RNA, 22 nt, Homo sapiens
ugucaugagucuccuccaucuu

SEQ ID NO: 371673 - RNA, 22 nt, Homo sapiens
ugucuuguagacugaaggcuuc

SEQ ID NO: 371674 - RNA, 22 nt, Homo sapiens
ugugacaaauuuaguggacugu

SEQ ID NO: 371675 - RNA, 22 nt, Homo sapiens
ugugcacauugugcagguugau

SEQ ID NO: 371676 - RNA, 22 nt, Homo sapiens
ugugccacuccaaccuggguga

SEQ ID NO: 371677 - RNA, 22 nt, Homo sapiens
ugugcuaauacauacagugcua

SEQ ID NO: 371678 - RNA, 22 nt, Homo sapiens
uguguacaucucuacacacaug

SEQ ID NO: 371679 - RNA, 22 nt, Homo sapiens
uuaaaaguauaggccuggcaua

SEQ ID NO: 371680 - RNA, 22 nt, Homo sapiens
uuacaaguggcaucucucugga

SEQ ID NO: 371681 - RNA, 22 nt, Homo sapiens
uuacagcagugccccacuccca

SEQ ID NO: 371682 - RNA, 22 nt, Homo sapiens
uuaccuguguuuugggcccaga

SEQ ID NO: 371683 - RNA, 21 nt, Homo sapiens
uuauaguggcaugauuuauaa

SEQ ID NO: 371684 - RNA, 22 nt, Homo sapiens
uucaauacuguugauccuuaug

SEQ ID NO: 371685 - RNA, 22 nt, Homo sapiens
uucagagugaggcucucggaac

SEQ ID NO: 371686 - RNA, 22 nt, Homo sapiens
uucaggguggagaguaugaggu

SEQ ID NO: 371687 - RNA, 20 nt, Homo sapiens
uucagugcagguaacaaucc

SEQ ID NO: 371688 - RNA, 17 nt, Homo sapiens
uucucaguucugaucuc

SEQ ID NO: 371689 - RNA, 22 nt, Homo sapiens
uucugugguagaaaucucaaau

SEQ ID NO: 371690 - RNA, 22 nt, Homo sapiens
aaacugcuuuccaugguggcug

SEQ ID NO: 371691 - RNA, 22 nt, Homo sapiens
aaagugcuuccuuuuugagggu

SEQ ID NO: 371692 - RNA, 22 nt, Homo sapiens
aaaugcauugagggaaaaggca

SEQ ID NO: 371693 - RNA, 22 nt, Homo sapiens
aacaguguuuuggguuuucugg

SEQ ID NO: 371694 - RNA, 22 nt, Homo sapiens
aagagugcucgugggacucagc

SEQ ID NO: 371695 - RNA, 22 nt, Homo sapiens
aagaugcagaagcccagauguu

SEQ ID NO: 371696 - RNA, 22 nt, Homo sapiens
aagaugcagucauacuggagua

SEQ ID NO: 371697 - RNA, 22 nt, Homo sapiens
aagcacccagccucacgccugc

SEQ ID NO: 371698 - RNA, 22 nt, Homo sapiens
aaggcaagagaaaauuucgagu

SEQ ID NO: 371699 - RNA, 22 nt, Homo sapiens
aaggcauggugacuauuuaggc

SEQ ID NO: 371700 - RNA, 22 nt, Homo sapiens
aaguauuagugaggauauggaa

SEQ ID NO: 371701 - RNA, 22 nt, Homo sapiens
aagugauguuauugggugacuc

SEQ ID NO: 371702 - RNA, 22 nt, Homo sapiens
aaguguaaguuaauguuuaggu

SEQ ID NO: 371703 - RNA, 22 nt, Homo sapiens
aauacagcacacagaugggucu

SEQ ID NO: 371704 - RNA, 22 nt, Homo sapiens
aauacugagaugugagguacua

SEQ ID NO: 371705 - RNA, 22 nt, Homo sapiens
aauccuguagauucuaauuccu

SEQ ID NO: 371706 - RNA, 22 nt, Homo sapiens
aaugaucaauguuugaggugau

SEQ ID NO: 371707 - RNA, 22 nt, Homo sapiens
aaugugcacuuggagccuugcu

SEQ ID NO: 371708 - RNA, 21 nt, Homo sapiens
acaaagcuggagggagacugc

SEQ ID NO: 371709 - RNA, 22 nt, Homo sapiens
acaaaguauggaauguuggugu

SEQ ID NO: 371710 - RNA, 22 nt, Homo sapiens
acacuggaggagagcuguugcu

SEQ ID NO: 371711 - RNA, 22 nt, Homo sapiens
acagguacacagaauauccaga

SEQ ID NO: 371712 - RNA, 18 nt, Homo sapiens
acagugcuggcaugagau

SEQ ID NO: 371713 - RNA, 17 nt, Homo sapiens
acagugcuuugcuuucc

SEQ ID NO: 371714 - RNA, 22 nt, Homo sapiens
acccuuagguuaaaguugaguc

SEQ ID NO: 371715 - RNA, 22 nt, Homo sapiens
acucauugcucauaccuuaucu

SEQ ID NO: 371716 - RNA, 22 nt, Homo sapiens
acugagaucuuuaaauaaauaa

SEQ ID NO: 371717 - RNA, 21 nt, Homo sapiens
acugcacuccaaccucaacag

SEQ ID NO: 371718 - RNA, 22 nt, Homo sapiens
agagaucaacugaauuacugga

SEQ ID NO: 371719 - RNA, 22 nt, Homo sapiens
agagguauuggaaggaguguca

SEQ ID NO: 371720 - RNA, 22 nt, Homo sapiens
agcagcuuugaucugaaugauu

SEQ ID NO: 371721 - RNA, 22 nt, Homo sapiens
agcugcacgugguaaauguaaa

SEQ ID NO: 371722 - RNA, 22 nt, Homo sapiens
agcugcauucguaucauauugu

SEQ ID NO: 371723 - RNA, 18 nt, Homo sapiens
aggaaugguaauacuuca

SEQ ID NO: 371724 - RNA, 22 nt, Homo sapiens
aggacacugauagucuuuggca

SEQ ID NO: 371725 - RNA, 22 nt, Homo sapiens
aggaggauugcuuucaucuuuu

SEQ ID NO: 371726 - RNA, 22 nt, Homo sapiens
aggagguagggugugaaacagc

SEQ ID NO: 371727 - RNA, 22 nt, Homo sapiens
aggcacacaacccuggaccuga

SEQ ID NO: 371728 - RNA, 22 nt, Homo sapiens
aggcaugguggcacauacaugu

SEQ ID NO: 371729 - RNA, 22 nt, Homo sapiens
agucaguggaguaaauguaauu

SEQ ID NO: 371730 - RNA, 22 nt, Homo sapiens
agugaaaucugaagaaggucau

SEQ ID NO: 371731 - RNA, 22 nt, Homo sapiens
agugcauaugucuuuuuggaag

SEQ ID NO: 371732 - RNA, 22 nt, Homo sapiens
aguggcuuuuuaguggcagaug

SEQ ID NO: 371733 - RNA, 22 nt, Homo sapiens
agugguuugaucacagcucacu

SEQ ID NO: 371734 - RNA, 22 nt, Homo sapiens
aguucaauggguuuucacucau

SEQ ID NO: 371735 - RNA, 22 nt, Homo sapiens
auacaagugccauguuggugug

SEQ ID NO: 371736 - RNA, 22 nt, Homo sapiens
auacagguauacaaugcauaau

SEQ ID NO: 371737 - RNA, 22 nt, Homo sapiens
auacagucuguuagauuuccuc

SEQ ID NO: 371738 - RNA, 22 nt, Homo sapiens
auacagugaauaucuggggcag

SEQ ID NO: 371739 - RNA, 22 nt, Homo sapiens
auacuagucaagaauguaugag

SEQ ID NO: 371740 - RNA, 22 nt, Homo sapiens
auagcaaugccccaauccuugg

SEQ ID NO: 371741 - RNA, 21 nt, Homo sapiens
ucagggaccugcuguacugau

SEQ ID NO: 371742 - RNA, 22 nt, Homo sapiens
ucagugguuaaaagauucuaga

SEQ ID NO: 371743 - RNA, 21 nt, Homo sapiens
ucaucagucaaagacaauggu

SEQ ID NO: 371744 - RNA, 22 nt, Homo sapiens
ucaugggagcccccaucaugag

SEQ ID NO: 371745 - RNA, 22 nt, Homo sapiens
ucauggggugcuuugcuagauu

SEQ ID NO: 371746 - RNA, 19 nt, Homo sapiens
uccccaguuuuccguucag

SEQ ID NO: 371747 - RNA, 22 nt, Homo sapiens
ucccuagacuccugccuuucag

SEQ ID NO: 371748 - RNA, 22 nt, Homo sapiens
ucccugaaaauuagcauuuuaa

SEQ ID NO: 371749 - RNA, 22 nt, Homo sapiens
uccuugagccucccagacucag

SEQ ID NO: 371750 - RNA, 17 nt, Homo sapiens
ucuaauaauaugcauuu

SEQ ID NO: 371751 - RNA, 22 nt, Homo sapiens
ucucauggcucacccugcauag

SEQ ID NO: 371752 - RNA, 22 nt, Homo sapiens
ucucauugauucuggggugaug

SEQ ID NO: 371753 - RNA, 22 nt, Homo sapiens
ucugagaugagacuuugaauuu

SEQ ID NO: 371754 - RNA, 22 nt, Homo sapiens
ucuggcacugaugugggaugcu

SEQ ID NO: 371755 - RNA, 22 nt, Homo sapiens
ucuggcuuuagcaugugggaag

SEQ ID NO: 371756 - RNA, 22 nt, Homo sapiens
ucugugcauuacacuuuucuca

SEQ ID NO: 371757 - RNA, 22 nt, Homo sapiens
ucuuugagugcccugagucccu

SEQ ID NO: 371758 - RNA, 22 nt, Homo sapiens
ucuuugguaauggaugucugau

SEQ ID NO: 371759 - RNA, 22 nt, Homo sapiens
ucuuugguuguuuagggugcau

SEQ ID NO: 371760 - RNA, 22 nt, Homo sapiens
ucuuuuggguauggagccauca

SEQ ID NO: 371761 - RNA, 22 nt, Homo sapiens
ugaaagguuuaauucugugaga

SEQ ID NO: 371762 - RNA, 22 nt, Homo sapiens
ugaagacauuuuugggugugua

SEQ ID NO: 371763 - RNA, 22 nt, Homo sapiens
ugacagguugauaggugcagca

SEQ ID NO: 371764 - RNA, 22 nt, Homo sapiens
ugacagugaauaagucucuuaa

SEQ ID NO: 371765 - RNA, 22 nt, Homo sapiens
ugacauggagggugcggcugca

SEQ ID NO: 371766 - RNA, 21 nt, Homo sapiens
ugacauguugguuugcugcac

SEQ ID NO: 371767 - RNA, 22 nt, Homo sapiens
ugacuagggcucuaaacagcuc

SEQ ID NO: 371768 - RNA, 21 nt, Homo sapiens
ugagaacaacaggucaagcag

SEQ ID NO: 371769 - RNA, 22 nt, Homo sapiens
ugagaagacaucuuugcuuugu

SEQ ID NO: 371770 - RNA, 22 nt, Homo sapiens
ugagaauauuugaagauguuag

SEQ ID NO: 371771 - RNA, 22 nt, Homo sapiens
ugagacaucucuccugagacag

SEQ ID NO: 371772 - RNA, 22 nt, Homo sapiens
ugagacggaguuucgcucuugu

SEQ ID NO: 371773 - RNA, 22 nt, Homo sapiens
ugagagcuuuuuugccugguga

SEQ ID NO: 371774 - RNA, 22 nt, Homo sapiens
ugagaggugaauggcaggcuca

SEQ ID NO: 371775 - RNA, 22 nt, Homo sapiens
ugagauaaagcauguacugugu

SEQ ID NO: 371776 - RNA, 22 nt, Homo sapiens
ugagauaauuuacuuguugagg

SEQ ID NO: 371777 - RNA, 22 nt, Homo sapiens
ugagaucuuugcuguccucacc

SEQ ID NO: 371778 - RNA, 22 nt, Homo sapiens
ugagauggaguuucgcccuugu

SEQ ID NO: 371779 - RNA, 22 nt, Homo sapiens
ugagcaucucuaaaaggagcaa

SEQ ID NO: 371780 - RNA, 22 nt, Homo sapiens
ugagccaugguuagcuucucau

SEQ ID NO: 371781 - RNA, 23 nt, Homo sapiens
ugaguagguccacguaugugagu

SEQ ID NO: 371782 - RNA, 22 nt, Homo sapiens
ugagugagguucuacucuguga

SEQ ID NO: 371783 - RNA, 22 nt, Homo sapiens
ugaucugucucggguuaucagu

SEQ ID NO: 371784 - RNA, 22 nt, Homo sapiens
ugcaagaaucagccuaucauua

SEQ ID NO: 371785 - RNA, 18 nt, Homo sapiens
ugcaauggagaugcagcc

SEQ ID NO: 371786 - RNA, 22 nt, Homo sapiens
ugcaccacugcuagccugggua

SEQ ID NO: 371787 - RNA, 22 nt, Homo sapiens
ugcagcacuguucacaauagcc

SEQ ID NO: 371788 - RNA, 22 nt, Homo sapiens
ugcaguacugucagacuucuua

SEQ ID NO: 371789 - RNA, 22 nt, Homo sapiens
ugcaguacuuugaaauauacug

SEQ ID NO: 371790 - RNA, 21 nt, Homo sapiens
ugcauggagaacacugagggu

SEQ ID NO: 371791 - RNA, 22 nt, Homo sapiens
ugcauguucuuacucauacaug

SEQ ID NO: 371792 - RNA, 22 nt, Homo sapiens
ugcauuguuuuugguucccagg

SEQ ID NO: 371793 - RNA, 22 nt, Homo sapiens
uggaagacucuagucucuugag

SEQ ID NO: 371794 - RNA, 23 nt, Homo sapiens
uggaaguauggaggaggcagaau

SEQ ID NO: 371795 - RNA, 22 nt, Homo sapiens
uggaauguuauggcuuuaaucu

SEQ ID NO: 371796 - RNA, 22 nt, Homo sapiens
uggacauguacauauguguaug

SEQ ID NO: 371797 - RNA, 22 nt, Homo sapiens
uggagguagagaugggaucucc

SEQ ID NO: 371798 - RNA, 22 nt, Homo sapiens
uggauauguuuauuacccugaa

SEQ ID NO: 371799 - RNA, 22 nt, Homo sapiens
uggcaagugggaccuaguuaaa

SEQ ID NO: 371800 - RNA, 20 nt, Homo sapiens
uggcaccugacagauagcca

SEQ ID NO: 371801 - RNA, 22 nt, Homo sapiens
uggcagacaaauuugagcauau

SEQ ID NO: 371802 - RNA, 22 nt, Homo sapiens
uggcgagaugcucgugugcaga

SEQ ID NO: 371803 - RNA, 22 nt, Homo sapiens
uggcuguuuauuucacgugggu

SEQ ID NO: 371804 - RNA, 22 nt, Homo sapiens
ugggaagaugcugcuucuuccu

SEQ ID NO: 371805 - RNA, 22 nt, Homo sapiens
uggguagauaucauaguugccc

SEQ ID NO: 371806 - RNA, 22 nt, Homo sapiens
uggguccccuacucuuuccaca

SEQ ID NO: 371807 - RNA, 22 nt, Homo sapiens
uggucauggaaauagaaugcac

SEQ ID NO: 371808 - RNA, 22 nt, Homo sapiens
uggugagaaaagaugucuuugu

SEQ ID NO: 371809 - RNA, 23 nt, Homo sapiens
uguaaaagcauuugucagccugg

SEQ ID NO: 371810 - RNA, 22 nt, Homo sapiens
uguacaaauuucugugguggug

SEQ ID NO: 371811 - RNA, 21 nt, Homo sapiens
uguauauguuuauacacacac

SEQ ID NO: 371812 - RNA, 22 nt, Homo sapiens
ugucaacauuuaucaaguuauu

SEQ ID NO: 371813 - RNA, 22 nt, Homo sapiens
ugucagcacaacucagguuccu

SEQ ID NO: 371814 - RNA, 22 nt, Homo sapiens
uguccaaauugaaucaucuggu

SEQ ID NO: 371815 - RNA, 19 nt, Homo sapiens
ugucccagccauagaggca

SEQ ID NO: 371816 - RNA, 22 nt, Homo sapiens
ugugaaauguuaucccgucgug

SEQ ID NO: 371817 - RNA, 22 nt, Homo sapiens
ugugcaaauguuaaacuaacuu

SEQ ID NO: 371818 - RNA, 22 nt, Homo sapiens
uguggaguguaugugacagaga

SEQ ID NO: 371819 - RNA, 22 nt, Homo sapiens
uuaaaguguuuucaaaauguca

SEQ ID NO: 371820 - RNA, 22 nt, Homo sapiens
uuaaggcuuuaaguaaacacag

SEQ ID NO: 371821 - RNA, 22 nt, Homo sapiens
uuaagucacacuagacaacuga

SEQ ID NO: 371822 - RNA, 22 nt, Homo sapiens
uuauaacagagacuccugugcu

SEQ ID NO: 371823 - RNA, 22 nt, Homo sapiens
aaaugucauggaguguuucccc

SEQ ID NO: 371824 - RNA, 21 nt, Homo sapiens
aaaugugcuuuaguacccuca

SEQ ID NO: 371825 - RNA, 22 nt, Homo sapiens
aacagucuccaguuguauccau

SEQ ID NO: 371826 - RNA, 22 nt, Homo sapiens
aacagugccugucauuuaguag

SEQ ID NO: 371827 - RNA, 22 nt, Homo sapiens
aacauugaacuuggcacaccca

SEQ ID NO: 371828 - RNA, 22 nt, Homo sapiens
aagcugguuuuauaucugugag

SEQ ID NO: 371829 - RNA, 22 nt, Homo sapiens
aaggagugugauucuucaguuu

SEQ ID NO: 371830 - RNA, 22 nt, Homo sapiens
aaggcaagaagagaaccaucgg

SEQ ID NO: 371831 - RNA, 22 nt, Homo sapiens
aagugguguuugggagcuggac

SEQ ID NO: 371832 - RNA, 22 nt, Homo sapiens
aauaaagcuuugagcuuugcug

SEQ ID NO: 371833 - RNA, 22 nt, Homo sapiens
aauaagcugagagaauucuaca

SEQ ID NO: 371834 - RNA, 22 nt, Homo sapiens
aauaauggcaccaaagcacaag

SEQ ID NO: 371835 - RNA, 22 nt, Homo sapiens
aaugcacauauauuuccuuauu

SEQ ID NO: 371836 - RNA, 22 nt, Homo sapiens
aauuaguugucgugagaguggu

SEQ ID NO: 371837 - RNA, 22 nt, Homo sapiens
acauacacuagggauguggugu

SEQ ID NO: 371838 - RNA, 22 nt, Homo sapiens
acauaguagacacugaaaauau

SEQ ID NO: 371839 - RNA, 22 nt, Homo sapiens
acccaguagucauucaggagca

SEQ ID NO: 371840 - RNA, 22 nt, Homo sapiens
acccuggagagugcuguaguaa

SEQ ID NO: 371841 - RNA, 22 nt, Homo sapiens
acugcacuccagccucgcaaca

SEQ ID NO: 371842 - RNA, 22 nt, Homo sapiens
acugcacuccagccugcccaac

SEQ ID NO: 371843 - RNA, 22 nt, Homo sapiens
acugcacuuauccuccaauguu

SEQ ID NO: 371844 - RNA, 22 nt, Homo sapiens
agaaagcgcuucccuuugcugg

SEQ ID NO: 371845 - RNA, 22 nt, Homo sapiens
agaagugcuggguucaggcugg

SEQ ID NO: 371846 - RNA, 22 nt, Homo sapiens
agaauguaacucuaugaaggca

SEQ ID NO: 371847 - RNA, 22 nt, Homo sapiens
agagauacauucugagaagugc

SEQ ID NO: 371848 - RNA, 22 nt, Homo sapiens
agcaacauugagacugcaguug

SEQ ID NO: 371849 - RNA, 22 nt, Homo sapiens
agcaagaugaaguugagcuagg

SEQ ID NO: 371850 - RNA, 21 nt, Homo sapiens
agcagaguggcagcucuuuug

SEQ ID NO: 371851 - RNA, 22 nt, Homo sapiens
agcaucacacacuacagggaaa

SEQ ID NO: 371852 - RNA, 22 nt, Homo sapiens
agcugcauuuacuuuugcacaa

SEQ ID NO: 371853 - RNA, 22 nt, Homo sapiens
agcuggauguggaugacccugu

SEQ ID NO: 371854 - RNA, 22 nt, Homo sapiens
agcuggauuguuuaccuggggc

SEQ ID NO: 371855 - RNA, 22 nt, Homo sapiens
agcuggucucaggugcccugcu

SEQ ID NO: 371856 - RNA, 22 nt, Homo sapiens
agcuguuguuuuaagauacuaa

SEQ ID NO: 371857 - RNA, 22 nt, Homo sapiens
aggagguagucugucccuuagc

SEQ ID NO: 371858 - RNA, 22 nt, Homo sapiens
agggaauguaaguuuuaugaga

SEQ ID NO: 371859 - RNA, 22 nt, Homo sapiens
aggucccauguccucccugacc

SEQ ID NO: 371860 - RNA, 22 nt, Homo sapiens
aggugcugagcagagaauccug

SEQ ID NO: 371861 - RNA, 22 nt, Homo sapiens
agguuguguuugugauuagaua

SEQ ID NO: 371862 - RNA, 22 nt, Homo sapiens
auaaacagcuuauccucuauuc

SEQ ID NO: 371863 - RNA, 22 nt, Homo sapiens
auaaaccuacauuuucacuucu

SEQ ID NO: 371864 - RNA, 22 nt, Homo sapiens
auacaugcauuugcacgagagu

SEQ ID NO: 371865 - RNA, 22 nt, Homo sapiens
auacaugugcaggucagguuac

SEQ ID NO: 371866 - RNA, 21 nt, Homo sapiens
uuugaucauuaaaagugaauc

SEQ ID NO: 371867 - RNA, 21 nt, Homo sapiens
uuuggcauuaugucaccagag

SEQ ID NO: 371868 - RNA, 22 nt, Homo sapiens
uuugguugccucuaugagccug

SEQ ID NO: 371869 - RNA, 22 nt, Homo sapiens
uuuuggacuucaauuugacacu

SEQ ID NO: 371870 - RNA, 22 nt, Homo sapiens
aaauugcaguuaggaugauggu

SEQ ID NO: 371871 - RNA, 22 nt, Homo sapiens
aacagugcauuccuguccauau

SEQ ID NO: 371872 - RNA, 22 nt, Homo sapiens
aacagugcuguuauaaauguac

SEQ ID NO: 371873 - RNA, 22 nt, Homo sapiens
aaccuacauucuuaacuguugc

SEQ ID NO: 371874 - RNA, 22 nt, Homo sapiens
aacucacauucuuucuugguac

SEQ ID NO: 371875 - RNA, 22 nt, Homo sapiens
aagaguuaguaaaauuuccucu

SEQ ID NO: 371876 - RNA, 22 nt, Homo sapiens
aagaugcagucauacuggagga

SEQ ID NO: 371877 - RNA, 23 nt, Homo sapiens
aaggacacugaacacuucccagc

SEQ ID NO: 371878 - RNA, 22 nt, Homo sapiens
aaggcuguucauuuagcacagu

SEQ ID NO: 371879 - RNA, 22 nt, Homo sapiens
aaguauuaugaguccuuguuuu

SEQ ID NO: 371880 - RNA, 20 nt, Homo sapiens
aagugcaucguugugucugc

SEQ ID NO: 371881 - RNA, 22 nt, Homo sapiens
aauauagcuauguacaugucca

SEQ ID NO: 371882 - RNA, 22 nt, Homo sapiens
aauaucacaguggguguacacc

SEQ ID NO: 371883 - RNA, 23 nt, Homo sapiens
aauaucacaguggguguacaccc

SEQ ID NO: 371884 - RNA, 21 nt, Homo sapiens
aaucacaguuguucugccuuc

SEQ ID NO: 371885 - RNA, 22 nt, Homo sapiens
aaugcuaucuggaacauuguug

SEQ ID NO: 371886 - RNA, 22 nt, Homo sapiens
aaugugcuucuggcugugguca

SEQ ID NO: 371887 - RNA, 22 nt, Homo sapiens
gcagcagugcccuggauggaaa

SEQ ID NO: 371888 - RNA, 22 nt, Homo sapiens
gcaggaaucuugagaaggauuc

SEQ ID NO: 371889 - RNA, 22 nt, Homo sapiens
gcaucacagggagacaggccuc

SEQ ID NO: 371890 - RNA, 22 nt, Homo sapiens
gcugagaucucuugccugaacu

SEQ ID NO: 371891 - RNA, 22 nt, Homo sapiens
ggaauguauuaaggcauugggc

SEQ ID NO: 371892 - RNA, 21 nt, Homo sapiens
ggauagaaaacuuggcuguau

SEQ ID NO: 371893 - RNA, 22 nt, Homo sapiens
ggcaaugaggcggaccagcagg

SEQ ID NO: 371894 - RNA, 22 nt, Homo sapiens
ggcaccauuuuacuccuucccu

SEQ ID NO: 371895 - RNA, 22 nt, Homo sapiens
ggcagcaugggugccuuuguga

SEQ ID NO: 371896 - RNA, 22 nt, Homo sapiens
ggcagcucaggccccgcgcuga

SEQ ID NO: 371897 - RNA, 22 nt, Homo sapiens
gggagguagguauuagcuuuuc

SEQ ID NO: 371898 - RNA, 23 nt, Homo sapiens
ggugaggaguacagagucuucau

SEQ ID NO: 371899 - RNA, 22 nt, Homo sapiens
guacaggcagcaaacaccauaa

SEQ ID NO: 371900 - RNA, 22 nt, Homo sapiens
guagcagucacauagcagauug

SEQ ID NO: 371901 - RNA, 22 nt, Homo sapiens
gucucccagccuacauauuucu

SEQ ID NO: 371902 - RNA, 22 nt, Homo sapiens
gucuuuggaaaaaaugucuguu

SEQ ID NO: 371903 - RNA, 22 nt, Homo sapiens
gucuuuggaaagacaaaguuca

SEQ ID NO: 371904 - RNA, 22 nt, Homo sapiens
gugaccagaugggcaggggugu

SEQ ID NO: 371905 - RNA, 22 nt, Homo sapiens
gugagauggagucuugcuuugu

SEQ ID NO: 371906 - RNA, 22 nt, Homo sapiens
gugagaugguaucucauugugg

SEQ ID NO: 371907 - RNA, 22 nt, Homo sapiens
gugaggaaggaaaccugcuagc

SEQ ID NO: 371908 - RNA, 22 nt, Homo sapiens
gugcacaaaucuuaaauguaca

SEQ ID NO: 371909 - RNA, 22 nt, Homo sapiens
gugcacuguagaacccuuuguu

SEQ ID NO: 371910 - RNA, 22 nt, Homo sapiens
gugcauguccacuaguccauau

SEQ ID NO: 371911 - RNA, 22 nt, Homo sapiens
gugccacaguguuaagggauuc

SEQ ID NO: 371912 - RNA, 22 nt, Homo sapiens
ugagacggagucuugcucuguc

SEQ ID NO: 371913 - RNA, 22 nt, Homo sapiens
ugagagcugcauucuugaaagc

SEQ ID NO: 371914 - RNA, 22 nt, Homo sapiens
ugagauaacuaaaaacauuuug

SEQ ID NO: 371915 - RNA, 21 nt, Homo sapiens
ugagauaauauguuucugaug

SEQ ID NO: 371916 - RNA, 22 nt, Homo sapiens
ugagaugaagcuagaagaaugg

SEQ ID NO: 371917 - RNA, 21 nt, Homo sapiens
ugagaugauccugcaugcaug

SEQ ID NO: 371918 - RNA, 22 nt, Homo sapiens
guagcaugcaauauuauagaga

SEQ ID NO: 371919 - RNA, 22 nt, Homo sapiens
guauacaugucaaaacucacau

SEQ ID NO: 371920 - RNA, 22 nt, Homo sapiens
guauagaucguagaccaauaaa

SEQ ID NO: 371921 - RNA, 22 nt, Homo sapiens
guauuugauuauagcaugcuua

SEQ ID NO: 371922 - RNA, 22 nt, Homo sapiens
gucucccagccuacaucuuucu

SEQ ID NO: 371923 - RNA, 22 nt, Homo sapiens
gucugugguuccuaugucaccu

SEQ ID NO: 371924 - RNA, 22 nt, Homo sapiens
gucuuuguuuugauuuaccaga

SEQ ID NO: 371925 - RNA, 22 nt, Homo sapiens
gugaaguuuuuugcugagaguc

SEQ ID NO: 371926 - RNA, 19 nt, Homo sapiens
caucccugagcugaagugg

SEQ ID NO: 371927 - RNA, 22 nt, Homo sapiens
caucgcacuccagccugggcaa

SEQ ID NO: 371928 - RNA, 22 nt, Homo sapiens
cauggcacugagcagguaugca

SEQ ID NO: 371929 - RNA, 22 nt, Homo sapiens
cauggcccuggguccauaggaa

SEQ ID NO: 371930 - RNA, 22 nt, Homo sapiens
cauguauagauuccauaguggu

SEQ ID NO: 371931 - RNA, 20 nt, Homo sapiens
cauugcccuccagccugggc

SEQ ID NO: 371932 - RNA, 22 nt, Homo sapiens
ccaagccucaguuucccucugu

SEQ ID NO: 371933 - RNA, 22 nt, Homo sapiens
ccagcaccauuuauuaaauagg

SEQ ID NO: 371934 - RNA, 22 nt, Homo sapiens
cccacaguggccucauauccuu

SEQ ID NO: 371935 - RNA, 22 nt, Homo sapiens
ccucauugcuaucccaggcuga

SEQ ID NO: 371936 - RNA, 22 nt, Homo sapiens
ccuccauuugugucaggaaguc

SEQ ID NO: 371937 - RNA, 22 nt, Homo sapiens
cuagacacugacguuccuccga

SEQ ID NO: 371938 - RNA, 22 nt, Homo sapiens
cuagaggcacagccuaggcacu

SEQ ID NO: 371939 - RNA, 22 nt, Homo sapiens
cuagcagacaugggcugaacca

SEQ ID NO: 371940 - RNA, 22 nt, Homo sapiens
cuauaugucuguuuugguacca

SEQ ID NO: 371941 - RNA, 22 nt, Homo sapiens
cucaaagucaagggaaagcagg

SEQ ID NO: 371942 - RNA, 22 nt, Homo sapiens
cucaaguacaugggauuacagg

SEQ ID NO: 371943 - RNA, 22 nt, Homo sapiens
cucagcaguggauuuaccacca

SEQ ID NO: 371944 - RNA, 22 nt, Homo sapiens
cucauggagauagagaauagaa

SEQ ID NO: 371945 - RNA, 22 nt, Homo sapiens
cucuuugaggugagcugcccau

SEQ ID NO: 371946 - RNA, 19 nt, Homo sapiens
cucuuuggugucucuucuu

SEQ ID NO: 371947 - RNA, 22 nt, Homo sapiens
cugagaucaugggucagguggu

SEQ ID NO: 371948 - RNA, 22 nt, Homo sapiens
cugagaucguggggcugcuguc

SEQ ID NO: 371949 - RNA, 22 nt, Homo sapiens
cugagaucugaaccaggagugu

SEQ ID NO: 371950 - RNA, 19 nt, Homo sapiens
cugcacugagaaaaggagg

SEQ ID NO: 371951 - RNA, 22 nt, Homo sapiens
cugcagguaggggcagcuuugg

SEQ ID NO: 371952 - RNA, 22 nt, Homo sapiens
cugcuguuguuaacuuuuggag

SEQ ID NO: 371953 - RNA, 22 nt, Homo sapiens
cuggagaucuugacauugaagu

SEQ ID NO: 371954 - RNA, 18 nt, Homo sapiens
cuggaugucgaguguguu

SEQ ID NO: 371955 - RNA, 22 nt, Homo sapiens
cugguuguuacaugcuugccag

SEQ ID NO: 371956 - RNA, 22 nt, Homo sapiens
cuuccaguggcagccgggcaug

SEQ ID NO: 371957 - RNA, 22 nt, Homo sapiens
cuuuuacacugcuggugggaau

SEQ ID NO: 371958 - RNA, 22 nt, Homo sapiens
gaaguaggugcuguuauuaucu

SEQ ID NO: 371959 - RNA, 20 nt, Homo sapiens
gacauguugguuugcugcac

SEQ ID NO: 371960 - RNA, 22 nt, Homo sapiens
gagaaguaaauuuauuugcaaa

SEQ ID NO: 371961 - RNA, 22 nt, Homo sapiens
gagacugagucucacucuguca

SEQ ID NO: 371962 - RNA, 22 nt, Homo sapiens
gagacugagucucgcucugccg

SEQ ID NO: 371963 - RNA, 22 nt, Homo sapiens
gagacugagucuugcucugucg

SEQ ID NO: 371964 - RNA, 22 nt, Homo sapiens
gagacugaguuuugcucuuguu

SEQ ID NO: 371965 - RNA, 22 nt, Homo sapiens
gagagcaugugcuggcaucagu

SEQ ID NO: 371966 - RNA, 22 nt, Homo sapiens
gagagguaguuuuuuggucguc

SEQ ID NO: 371967 - RNA, 22 nt, Homo sapiens
gagaucaguuaaugaagugagc

SEQ ID NO: 371968 - RNA, 22 nt, Homo sapiens
gagccauggagaaaacagcuau

SEQ ID NO: 371969 - RNA, 22 nt, Homo sapiens
gaggaaguagcuacugucuuuc

SEQ ID NO: 371970 - RNA, 22 nt, Homo sapiens
gaggcaaguggccaccgagucu

SEQ ID NO: 371971 - RNA, 22 nt, Homo sapiens
uucugugguugaaaggagagau

SEQ ID NO: 371972 - RNA, 22 nt, Homo sapiens
uucuuuggauaaaguuuuaugc

SEQ ID NO: 371973 - RNA, 22 nt, Homo sapiens
uugagaaucuuugcuaaaggaa

SEQ ID NO: 371974 - RNA, 20 nt, Homo sapiens
uugaggugugaggggcagag

SEQ ID NO: 371975 - RNA, 22 nt, Homo sapiens
uugauagacacauauccaugug

SEQ ID NO: 371976 - RNA, 22 nt, Homo sapiens
uugaucaauagaauacaacaga

SEQ ID NO: 371977 - RNA, 22 nt, Homo sapiens
uugcaggcaugagccaccgugc

SEQ ID NO: 371978 - RNA, 22 nt, Homo sapiens
uugcaguagucugaaagcaaua

SEQ ID NO: 371979 - RNA, 22 nt, Homo sapiens
uugcauaagugcauucugugau

SEQ ID NO: 371980 - RNA, 22 nt, Homo sapiens
uuggacugagaguuccaccauu

SEQ ID NO: 371981 - RNA, 22 nt, Homo sapiens
uuggacugggauggccgaggcu

SEQ ID NO: 371982 - RNA, 22 nt, Homo sapiens
uuggcaaaugucacaaaucagg

SEQ ID NO: 371983 - RNA, 22 nt, Homo sapiens
uuguaaacaucuguacauugcu

SEQ ID NO: 371984 - RNA, 23 nt, Homo sapiens
uuucacaguagcuggaucagccu

SEQ ID NO: 371985 - RNA, 22 nt, Homo sapiens
uuucaccguguuggccaggcug

SEQ ID NO: 371986 - RNA, 22 nt, Homo sapiens
uuucugcuugagagaauugcug

SEQ ID NO: 371987 - RNA, 22 nt, Homo sapiens
uuugaaccauuugaagaaugau

SEQ ID NO: 371988 - RNA, 22 nt, Homo sapiens
uuuggucacugccgccgccagc

SEQ ID NO: 371989 - RNA, 20 nt, Homo sapiens
uuuuggacuaaaggcauccc

SEQ ID NO: 371990 - RNA, 19 nt, Homo sapiens
aaaguacucugaugccucu

SEQ ID NO: 371991 - RNA, 22 nt, Homo sapiens
aaaugcaccacucuggugcagg

SEQ ID NO: 371992 - RNA, 22 nt, Homo sapiens
aaaugcaguugguggggauaug

SEQ ID NO: 371993 - RNA, 22 nt, Homo sapiens
aaaugguguuaguagaucuuua

SEQ ID NO: 371994 - RNA, 22 nt, Homo sapiens
aagcaaacaucagcuugguuaa

SEQ ID NO: 371995 - RNA, 22 nt, Homo sapiens
aagcacaauuucaccuucuugu

SEQ ID NO: 371996 - RNA, 22 nt, Homo sapiens
aagcuggauuucgcauccuguu

SEQ ID NO: 371997 - RNA, 22 nt, Homo sapiens
aaggcaagauacugguugcuga

SEQ ID NO: 371998 - RNA, 22 nt, Homo sapiens
aaggcaugcaaagaacauuuua

SEQ ID NO: 371999 - RNA, 22 nt, Homo sapiens
aagguacuggaaagaggaaugg

SEQ ID NO: 372000 - RNA, 20 nt, Homo sapiens
aauaacagccccagggaggu

SEQ ID NO: 372001 - RNA, 22 nt, Homo sapiens
aauacuuccaaaucuagucauu

SEQ ID NO: 372002 - RNA, 22 nt, Homo sapiens
aauaucacaggguguacacuca

SEQ ID NO: 372003 - RNA, 22 nt, Homo sapiens
aaugugcuguucagaggagucc

SEQ ID NO: 372004 - RNA, 22 nt, Homo sapiens
aaugugcuuugaaaagagcuga

SEQ ID NO: 372005 - RNA, 22 nt, Homo sapiens
acaagacuucuuguauucuagu

SEQ ID NO: 372006 - RNA, 22 nt, Homo sapiens
acaagcacaaaugcauagaugg

SEQ ID NO: 372007 - RNA, 19 nt, Homo sapiens
caguaucauugcacauagu

SEQ ID NO: 372008 - RNA, 22 nt, Homo sapiens
caucccugucgucaagucucug

SEQ ID NO: 372009 - RNA, 22 nt, Homo sapiens
cauggcccugggcugggcgaac

SEQ ID NO: 372010 - RNA, 22 nt, Homo sapiens
cauggcucuuguuuacucccag

SEQ ID NO: 372011 - RNA, 22 nt, Homo sapiens
caugugcaugcuuucuuaugug

SEQ ID NO: 372012 - RNA, 22 nt, Homo sapiens
cauugcccuccagccugggcaa

SEQ ID NO: 372013 - RNA, 22 nt, Homo sapiens
cccugaagaaagccuaggacau

SEQ ID NO: 372014 - RNA, 22 nt, Homo sapiens
cccugaagacuccaccgucaug

SEQ ID NO: 372015 - RNA, 21 nt, Homo sapiens
ccucuuugagggaagaaaggg

SEQ ID NO: 372016 - RNA, 22 nt, Homo sapiens
ccucuuuguugagacuucacca

SEQ ID NO: 372017 - RNA, 22 nt, Homo sapiens
ccuggcaagagacugaagauag

SEQ ID NO: 372018 - RNA, 18 nt, Homo sapiens
ccuuaguuauagagaguc

SEQ ID NO: 372019 - RNA, 22 nt, Homo sapiens
ccuuuuugaguugccagaguuc

SEQ ID NO: 372020 - RNA, 22 nt, Homo sapiens
cgcuggugucuaagcgacagcu

SEQ ID NO: 372021 - RNA, 22 nt, Homo sapiens
cucaaagugcuaagauuaggcu

SEQ ID NO: 372022 - RNA, 19 nt, Homo sapiens
cucauggagaaggagaaua

SEQ ID NO: 372023 - RNA, 22 nt, Homo sapiens
cucauuggcuacugaggcuugu

SEQ ID NO: 372024 - RNA, 22 nt, Homo sapiens
cugagaauguaaaugaagcuuu

SEQ ID NO: 372025 - RNA, 22 nt, Homo sapiens
cugagaucaagucuugcucugu

SEQ ID NO: 372026 - RNA, 22 nt, Homo sapiens
cugagaucuuauuagaaaugca

SEQ ID NO: 372027 - RNA, 22 nt, Homo sapiens
cugagcaaagaagugauaauga

SEQ ID NO: 372028 - RNA, 22 nt, Homo sapiens
cugagcaauauagugagaucuu

SEQ ID NO: 372029 - RNA, 18 nt, Homo sapiens
cugagcacugcuuuauga

SEQ ID NO: 372030 - RNA, 18 nt, Homo sapiens
cugagucauuccuggguc

SEQ ID NO: 372031 - RNA, 22 nt, Homo sapiens
cugcacugagacccucuuugcu

SEQ ID NO: 372032 - RNA, 19 nt, Homo sapiens
cugcaugagacaguugguu

SEQ ID NO: 372033 - RNA, 22 nt, Homo sapiens
cuggcaauaaauuuuuguguug

SEQ ID NO: 372034 - RNA, 22 nt, Homo sapiens
cuggcccaguucugcguuuugc

SEQ ID NO: 372035 - RNA, 22 nt, Homo sapiens
cugguuguuacaaagagccugg

SEQ ID NO: 372036 - RNA, 22 nt, Homo sapiens
cugguuguucuggaugggcagg

SEQ ID NO: 372037 - RNA, 23 nt, Homo sapiens
cuguacacauauacaucuaagua

SEQ ID NO: 372038 - RNA, 22 nt, Homo sapiens
cuguuugguaaggaugccucag

SEQ ID NO: 372039 - RNA, 18 nt, Homo sapiens
cuuugcagcuuccagagg

SEQ ID NO: 372040 - RNA, 18 nt, Homo sapiens
cuuugguccccgcacccu

SEQ ID NO: 372041 - RNA, 22 nt, Homo sapiens
cuuuuacacuguuggugggaau

SEQ ID NO: 372042 - RNA, 22 nt, Homo sapiens
gaaagguaggaacagggugcag

SEQ ID NO: 372043 - RNA, 22 nt, Homo sapiens
gaaauggaucagagcaagcuuu

SEQ ID NO: 372044 - RNA, 22 nt, Homo sapiens
gaaauguugauagugggcauug

SEQ ID NO: 372045 - RNA, 17 nt, Homo sapiens
gacauaggaaaaggaga

SEQ ID NO: 372046 - RNA, 22 nt, Homo sapiens
gagaucauguacuagaacaccu

SEQ ID NO: 372047 - RNA, 22 nt, Homo sapiens
gagaucauugugggccaagcug

SEQ ID NO: 372048 - RNA, 20 nt, Homo sapiens
gagcugguguacugccgggc

SEQ ID NO: 372049 - RNA, 22 nt, Homo sapiens
gagguacgaaauacacuguacu

SEQ ID NO: 372050 - RNA, 22 nt, Homo sapiens
gagguaugauugacauauaaaa

SEQ ID NO: 372051 - RNA, 22 nt, Homo sapiens
gagugcugagcccacuuccuug

SEQ ID NO: 372052 - RNA, 22 nt, Homo sapiens
gauaaaguauuggguacuaugc

SEQ ID NO: 372053 - RNA, 22 nt, Homo sapiens
gauaacagauaaugucaguuau

SEQ ID NO: 372054 - RNA, 22 nt, Homo sapiens
gaugagauguucucauggauug

SEQ ID NO: 372055 - RNA, 22 nt, Homo sapiens
gauggcacuuaagagcaagagc

SEQ ID NO: 372056 - RNA, 20 nt, Homo sapiens
gcaaauggaucccacaagcc

SEQ ID NO: 372057 - RNA, 19 nt, Homo sapiens
gcagagaugugguagcuug

SEQ ID NO: 372058 - RNA, 22 nt, Homo sapiens
gcuggcuuucuccugaucucag

SEQ ID NO: 372059 - RNA, 22 nt, Homo sapiens
gcugguauuacaggcaugagcc

SEQ ID NO: 372060 - RNA, 22 nt, Homo sapiens
ggaaagaucagcuaaauguaag

SEQ ID NO: 372061 - RNA, 22 nt, Homo sapiens
ggaaauguaaacaauggggcua

SEQ ID NO: 372062 - RNA, 22 nt, Homo sapiens
ggaaauguuggugucaugaguu

SEQ ID NO: 372063 - RNA, 23 nt, Homo sapiens
ggaaauguuuaagggguugggag

SEQ ID NO: 372064 - RNA, 22 nt, Homo sapiens
ggagguagucuuucccuuauca

SEQ ID NO: 372065 - RNA, 23 nt, Homo sapiens
ggaguguauuggcacgaucucag

SEQ ID NO: 372066 - RNA, 22 nt, Homo sapiens
ggauacaucuggacagccgaau

SEQ ID NO: 372067 - RNA, 22 nt, Homo sapiens
ggauugcuuaagaaguuucauu

SEQ ID NO: 372068 - RNA, 22 nt, Homo sapiens
ggcagaauugcugaggaugcua

SEQ ID NO: 372069 - RNA, 23 nt, Homo sapiens
ggcagguuggucuaggucuauuc

SEQ ID NO: 372070 - RNA, 22 nt, Homo sapiens
gggaagaaggagugguuuacuc

SEQ ID NO: 372071 - RNA, 22 nt, Homo sapiens
gggagguaggaguuauuauuuu

SEQ ID NO: 372072 - RNA, 20 nt, Homo sapiens
gggaugugagguacacucuu

SEQ ID NO: 372073 - RNA, 22 nt, Homo sapiens
ggguaggcaagcggaugucaga

SEQ ID NO: 372074 - RNA, 22 nt, Homo sapiens
ggugagaaaaacauagucucag

SEQ ID NO: 372075 - RNA, 22 nt, Homo sapiens
ggugcagcacaccaacauggca

SEQ ID NO: 372076 - RNA, 22 nt, Homo sapiens
gguggcaaaucugaguggcgcu

SEQ ID NO: 372077 - RNA, 22 nt, Homo sapiens
guacaggugcaggaugggcagg

SEQ ID NO: 372078 - RNA, 22 nt, Homo sapiens
guaccuguauguucauuucaca

SEQ ID NO: 372079 - RNA, 22 nt, Homo sapiens
acaccauugcauuccagccugg

SEQ ID NO: 372080 - RNA, 22 nt, Homo sapiens
acacuguuuuaguuauuauagc

SEQ ID NO: 372081 - RNA, 22 nt, Homo sapiens
acaguagugggcuacagaauca

SEQ ID NO: 372082 - RNA, 22 nt, Homo sapiens
acagugcuguggucaugggucu

SEQ ID NO: 372083 - RNA, 22 nt, Homo sapiens
acaugguacugauuuacgaaau

SEQ ID NO: 372084 - RNA, 22 nt, Homo sapiens
acccagaagucauucaggaaca

SEQ ID NO: 372085 - RNA, 22 nt, Homo sapiens
accuguauaacaagugggaaau

SEQ ID NO: 372086 - RNA, 22 nt, Homo sapiens
acgcagcacauucacagcuaug

SEQ ID NO: 372087 - RNA, 22 nt, Homo sapiens
acugcacuccagccucaugaca

SEQ ID NO: 372088 - RNA, 20 nt, Homo sapiens
acugcacuccagccuuccag

SEQ ID NO: 372089 - RNA, 20 nt, Homo sapiens
acugcacuccaggcugccca

SEQ ID NO: 372090 - RNA, 22 nt, Homo sapiens
acugcacugucaaccuccuggg

SEQ ID NO: 372091 - RNA, 22 nt, Homo sapiens
acugcacuguccuagaguccuc

SEQ ID NO: 372092 - RNA, 22 nt, Homo sapiens
acugcauaaauauguguaauau

SEQ ID NO: 372093 - RNA, 22 nt, Homo sapiens
acugcauuugucugucucaauu

SEQ ID NO: 372094 - RNA, 21 nt, Homo sapiens
acuggaccccuuccauacacc

SEQ ID NO: 372095 - RNA, 22 nt, Homo sapiens
agaaugauccuucucagaggca

SEQ ID NO: 372096 - RNA, 20 nt, Homo sapiens
agacaguguggagauuccuu

SEQ ID NO: 372097 - RNA, 22 nt, Homo sapiens
agagaacuggcuucaccauucu

SEQ ID NO: 372098 - RNA, 22 nt, Homo sapiens
agcaguacauaaaaagcauccu

SEQ ID NO: 372099 - RNA, 22 nt, Homo sapiens
agcauuacaugguacagagaag

SEQ ID NO: 372100 - RNA, 19 nt, Homo sapiens
agcuguguugccugugaga

SEQ ID NO: 372101 - RNA, 22 nt, Homo sapiens
agcuguuguucucagaggcuuu

SEQ ID NO: 372102 - RNA, 22 nt, Homo sapiens
aggaagguaaacuaacuugccu

SEQ ID NO: 372103 - RNA, 22 nt, Homo sapiens
aggaagugucuucuuuuaggca

SEQ ID NO: 372104 - RNA, 22 nt, Homo sapiens
aggaccccucaucagcaccagu

SEQ ID NO: 372105 - RNA, 22 nt, Homo sapiens
aggauacugguaugggcugaau

SEQ ID NO: 372106 - RNA, 22 nt, Homo sapiens
aggcagucucugccggcugagg

SEQ ID NO: 372107 - RNA, 22 nt, Homo sapiens
aguacacuguuaaaaagaagug

SEQ ID NO: 372108 - RNA, 21 nt, Homo sapiens
aguagcacugugucuuacaaa

SEQ ID NO: 372109 - RNA, 22 nt, Homo sapiens
agucagugucuguaaggagaac

SEQ ID NO: 372110 - RNA, 22 nt, Homo sapiens
agugaaaugucaccuuuuagga

SEQ ID NO: 372111 - RNA, 22 nt, Homo sapiens
aguguuuuuaucaugaaagggu

SEQ ID NO: 372112 - RNA, 22 nt, Homo sapiens
auaaacugucaguggagaguaa

SEQ ID NO: 372113 - RNA, 22 nt, Homo sapiens
auaauaguguuuagauuuggga

SEQ ID NO: 372114 - RNA, 22 nt, Homo sapiens
auaaucaugucugaaaccuuug

SEQ ID NO: 372115 - RNA, 22 nt, Homo sapiens
auaauugcuaagugaagauggu

SEQ ID NO: 372116 - RNA, 22 nt, Homo sapiens
auacaguaucuucuggcaagca

SEQ ID NO: 372117 - RNA, 22 nt, Homo sapiens
auacaugugccauguugguaug

SEQ ID NO: 372118 - RNA, 22 nt, Homo sapiens
auacauguucaagggcauauau

SEQ ID NO: 372119 - RNA, 22 nt, Homo sapiens
auagcagcuugucagggcagac

SEQ ID NO: 372120 - RNA, 22 nt, Homo sapiens
auauaugcuaagugcuaauaaa

SEQ ID NO: 372121 - RNA, 22 nt, Homo sapiens
auauggcauucagaacuguaua

SEQ ID NO: 372122 - RNA, 22 nt, Homo sapiens
auauguauuuuaacguguaagg

SEQ ID NO: 372123 - RNA, 22 nt, Homo sapiens
auaugucuauuauuagggcagg

SEQ ID NO: 372124 - RNA, 22 nt, Homo sapiens
auaugucuguuuagucuguaau

SEQ ID NO: 372125 - RNA, 22 nt, Homo sapiens
aucaagcuggcauauguaguuc

SEQ ID NO: 372126 - RNA, 23 nt, Homo sapiens
aucagauaguuguagguaugugg

SEQ ID NO: 372127 - RNA, 22 nt, Homo sapiens
aucagcagcaugaaaacaggcu

SEQ ID NO: 372128 - RNA, 22 nt, Homo sapiens
aucugcuccuggugaggguuuc

SEQ ID NO: 372129 - RNA, 22 nt, Homo sapiens
aucuuuggauacuugauauagu

SEQ ID NO: 372130 - RNA, 22 nt, Homo sapiens
aucuuuggcgggaauaucacag

SEQ ID NO: 372131 - RNA, 23 nt, Homo sapiens
augaaagcccuugcaaaugcugg

SEQ ID NO: 372132 - RNA, 22 nt, Homo sapiens
augaacagagccuugagaaccu

SEQ ID NO: 372133 - RNA, 22 nt, Homo sapiens
augacauuccacagccguagag

SEQ ID NO: 372134 - RNA, 18 nt, Homo sapiens
augagagccgauuccugg

SEQ ID NO: 372135 - RNA, 22 nt, Homo sapiens
augcaaacagcuaucuggcugg

SEQ ID NO: 372136 - RNA, 22 nt, Homo sapiens
augcaaacaucauagaguguac

SEQ ID NO: 372137 - RNA, 22 nt, Homo sapiens
augcacuguauaggaucuugcg

SEQ ID NO: 372138 - RNA, 22 nt, Homo sapiens
augcacuguuuucuugaugaga

SEQ ID NO: 372139 - RNA, 18 nt, Homo sapiens
augcauauuuuaaguugu

SEQ ID NO: 372140 - RNA, 22 nt, Homo sapiens
augccucugacaauuggauucu

SEQ ID NO: 372141 - RNA, 22 nt, Homo sapiens
auggaagcugauuagauaguac

SEQ ID NO: 372142 - RNA, 22 nt, Homo sapiens
auggcccaguuugcuaucccua

SEQ ID NO: 372143 - RNA, 21 nt, Homo sapiens
auggugagaaaguagugucaa

SEQ ID NO: 372144 - RNA, 18 nt, Homo sapiens
augugcaauuuuguauuu

SEQ ID NO: 372145 - RNA, 22 nt, Homo sapiens
augugcauaugaagcacagaca

SEQ ID NO: 372146 - RNA, 22 nt, Homo sapiens
auguggauaucuauaucuggau

SEQ ID NO: 372147 - RNA, 22 nt, Homo sapiens
auagccuguaggccuuaaggug

SEQ ID NO: 372148 - RNA, 22 nt, Homo sapiens
auaugcuaauuuuuagucgagc

SEQ ID NO: 372149 - RNA, 22 nt, Homo sapiens
aucaaagugaaauauuaguuau

SEQ ID NO: 372150 - RNA, 22 nt, Homo sapiens
aucacugugauuucuacugugc

SEQ ID NO: 372151 - RNA, 22 nt, Homo sapiens
aucagcaguguaaaaacggacu

SEQ ID NO: 372152 - RNA, 22 nt, Homo sapiens
aucagugcauguuuguugagcu

SEQ ID NO: 372153 - RNA, 22 nt, Homo sapiens
auccacauucauggaccagucc

SEQ ID NO: 372154 - RNA, 22 nt, Homo sapiens
auccccugcacggggugucauu

SEQ ID NO: 372155 - RNA, 22 nt, Homo sapiens
auccugagacuuugcugaaguu

SEQ ID NO: 372156 - RNA, 22 nt, Homo sapiens
aucuggcuccuuuugacaaugc

SEQ ID NO: 372157 - RNA, 22 nt, Homo sapiens
aucuuuggugcaugauacuuug

SEQ ID NO: 372158 - RNA, 22 nt, Homo sapiens
augaaaucuuuccugugaggau

SEQ ID NO: 372159 - RNA, 22 nt, Homo sapiens
augaccuuggggaaccaugucu

SEQ ID NO: 372160 - RNA, 22 nt, Homo sapiens
augagaucaaauuuaagcuguu

SEQ ID NO: 372161 - RNA, 16 nt, Homo sapiens
augagauccugucuca

SEQ ID NO: 372162 - RNA, 22 nt, Homo sapiens
augagaucugugaacaccuguc

SEQ ID NO: 372163 - RNA, 22 nt, Homo sapiens
augaggagguaugauuuucuga

SEQ ID NO: 372164 - RNA, 22 nt, Homo sapiens
augauacuguucuaagauuuuu

SEQ ID NO: 372165 - RNA, 22 nt, Homo sapiens
augcaugucaaauuuguagguu

SEQ ID NO: 372166 - RNA, 22 nt, Homo sapiens
auggaggacaaugucaccuuca

SEQ ID NO: 372167 - RNA, 22 nt, Homo sapiens
auggauauuuuuugaacauaga

SEQ ID NO: 372168 - RNA, 22 nt, Homo sapiens
augugcaaagcacuguucagca

SEQ ID NO: 372169 - RNA, 22 nt, Homo sapiens
augugcaaauuuccaaacucuu

SEQ ID NO: 372170 - RNA, 22 nt, Homo sapiens
augugcacaacgugcagguuug

SEQ ID NO: 372171 - RNA, 22 nt, Homo sapiens
auguuauguuaaugauaaugga

SEQ ID NO: 372172 - RNA, 18 nt, Homo sapiens
auguuauguuuguagaag

SEQ ID NO: 372173 - RNA, 23 nt, Homo sapiens
auugcagucuugaacuccugggc

SEQ ID NO: 372174 - RNA, 22 nt, Homo sapiens
auuggacagcauuucuagacuu

SEQ ID NO: 372175 - RNA, 22 nt, Homo sapiens
auuuggcagugaagggaucaca

SEQ ID NO: 372176 - RNA, 22 nt, Homo sapiens
caaaagugguucuuauccuuuu

SEQ ID NO: 372177 - RNA, 22 nt, Homo sapiens
caaagucuucaguugauucuga

SEQ ID NO: 372178 - RNA, 22 nt, Homo sapiens
caaagucuucucauuaugucuu

SEQ ID NO: 372179 - RNA, 22 nt, Homo sapiens
caaagugcuggccgggcgcagu

SEQ ID NO: 372180 - RNA, 22 nt, Homo sapiens
caaagugguuuauacaugauug

SEQ ID NO: 372181 - RNA, 22 nt, Homo sapiens
caacaguaaagcauuuuuaagu

SEQ ID NO: 372182 - RNA, 22 nt, Homo sapiens
cagccgggugagguggcuuguu

SEQ ID NO: 372183 - RNA, 22 nt, Homo sapiens
caggcacgcuugggagacacac

SEQ ID NO: 372184 - RNA, 22 nt, Homo sapiens
caggguccccuaccuuuugaug

SEQ ID NO: 372185 - RNA, 22 nt, Homo sapiens
cagugcaaagccucugcccaga

SEQ ID NO: 372186 - RNA, 22 nt, Homo sapiens
cagugcaaccuccaucucucgg

SEQ ID NO: 372187 - RNA, 23 nt, Homo sapiens
cagugcaugacuguauaugcaaa

SEQ ID NO: 372188 - RNA, 22 nt, Homo sapiens
caguggauuggauggauaaugc

SEQ ID NO: 372189 - RNA, 22 nt, Homo sapiens
ccacccuggagaauuugagguc

SEQ ID NO: 372190 - RNA, 22 nt, Homo sapiens
cccugagagcagggucuuucuc

SEQ ID NO: 372191 - RNA, 22 nt, Homo sapiens
ccuggaagaaaggugcuaaaua

SEQ ID NO: 372192 - RNA, 22 nt, Homo sapiens
cuaaaacuuucugagugcagca

SEQ ID NO: 372193 - RNA, 22 nt, Homo sapiens
cuacucuggagagugacaauca

SEQ ID NO: 372194 - RNA, 22 nt, Homo sapiens
cuaggcuuuucuuggauccagg

SEQ ID NO: 372195 - RNA, 21 nt, Homo sapiens
cucaaaguacugauauuacag

SEQ ID NO: 372196 - RNA, 22 nt, Homo sapiens
cucaaagugcugggacuggcug

SEQ ID NO: 372197 - RNA, 22 nt, Homo sapiens
cuccaggugucauccaccuccu

SEQ ID NO: 372198 - RNA, 23 nt, Homo sapiens
cucccugaacaugacacaccaga

SEQ ID NO: 372199 - RNA, 22 nt, Homo sapiens
cucucuguuugucuguuauugg

SEQ ID NO: 372200 - RNA, 22 nt, Homo sapiens
cucugguuaaggcugaacuaua

SEQ ID NO: 372201 - RNA, 22 nt, Homo sapiens
cucuuugaugugaaccgugguu

SEQ ID NO: 372202 - RNA, 22 nt, Homo sapiens
cugcauaaucaucucucugcau

SEQ ID NO: 372203 - RNA, 22 nt, Homo sapiens
cuggaaagaaacccuuaauucu

SEQ ID NO: 372204 - RNA, 22 nt, Homo sapiens
cuggugagaugucuuuccucuu

SEQ ID NO: 372205 - RNA, 22 nt, Homo sapiens
cuguaacagaauaaauuuguuu

SEQ ID NO: 372206 - RNA, 22 nt, Homo sapiens
cugugcacaucuggcggcccga

SEQ ID NO: 372207 - RNA, 22 nt, Homo sapiens
cugugcauuggaugucucccug

SEQ ID NO: 372208 - RNA, 19 nt, Homo sapiens
cugugcauuucuguggaag

SEQ ID NO: 372209 - RNA, 17 nt, Homo sapiens
cuucaaauaauuucccc

SEQ ID NO: 372210 - RNA, 22 nt, Homo sapiens
cuuccugaguccugggcucaca

SEQ ID NO: 372211 - RNA, 21 nt, Homo sapiens
cuuugcacugcuccucagcuc

SEQ ID NO: 372212 - RNA, 22 nt, Homo sapiens
cuuuuacacugguggugggaau

SEQ ID NO: 372213 - RNA, 22 nt, Homo sapiens
gaaaugcucagggguuuuccag

SEQ ID NO: 372214 - RNA, 22 nt, Homo sapiens
gaaauguuuuucaugugggcaa

SEQ ID NO: 372215 - RNA, 22 nt, Homo sapiens
gaacacaucuuugguuagagga

SEQ ID NO: 372216 - RNA, 22 nt, Homo sapiens
gaagaaguacaagacaaauuuu

SEQ ID NO: 372217 - RNA, 22 nt, Homo sapiens
gaaguaguaaaauuuauugcag

SEQ ID NO: 372218 - RNA, 17 nt, Homo sapiens
gaaguguuucuucauga

SEQ ID NO: 372219 - RNA, 20 nt, Homo sapiens
gaaugguuucgggguucuug

SEQ ID NO: 372220 - RNA, 22 nt, Homo sapiens
gagcaacaguggcagugguggg

SEQ ID NO: 372221 - RNA, 22 nt, Homo sapiens
gagcuacacugauucauuuguu

SEQ ID NO: 372222 - RNA, 22 nt, Homo sapiens
gagcuagaauauuuuguauagu

SEQ ID NO: 372223 - RNA, 22 nt, Homo sapiens
gaggaaguaauuuuaggccugu

SEQ ID NO: 372224 - RNA, 22 nt, Homo sapiens
gagguauagaacaccuuucaag

SEQ ID NO: 372225 - RNA, 22 nt, Homo sapiens
gagugcaauggcagaucuccgc

SEQ ID NO: 372226 - RNA, 22 nt, Homo sapiens
gagugcaauggugccaucucgg

SEQ ID NO: 372227 - RNA, 22 nt, Homo sapiens
gaguucauaucuaugagugugc

SEQ ID NO: 372228 - RNA, 22 nt, Homo sapiens
gauaaaucuuggcuagucuaag

SEQ ID NO: 372229 - RNA, 22 nt, Homo sapiens
ugagauggguucugguccccug

SEQ ID NO: 372230 - RNA, 22 nt, Homo sapiens
ugagaugguaaauuuuuguugu

SEQ ID NO: 372231 - RNA, 22 nt, Homo sapiens
ugagcaauaaaguuacacaguu

SEQ ID NO: 372232 - RNA, 22 nt, Homo sapiens
ugaguuccuuucccaguccagu

SEQ ID NO: 372233 - RNA, 22 nt, Homo sapiens
ugauauguguaaacaauguaua

SEQ ID NO: 372234 - RNA, 22 nt, Homo sapiens
ugauggcacagugaguuccagg

SEQ ID NO: 372235 - RNA, 22 nt, Homo sapiens
ugcaaccauuguuaagugugca

SEQ ID NO: 372236 - RNA, 22 nt, Homo sapiens
ugcaccacugcaccccagucug

SEQ ID NO: 372237 - RNA, 18 nt, Homo sapiens
ugcaccaguuuacacuuc

SEQ ID NO: 372238 - RNA, 22 nt, Homo sapiens
ugcagaaucccuucagauccga

SEQ ID NO: 372239 - RNA, 22 nt, Homo sapiens
ugcaguacauucagcauccucu

SEQ ID NO: 372240 - RNA, 22 nt, Homo sapiens
ugcagugugcuggggucuccau

SEQ ID NO: 372241 - RNA, 22 nt, Homo sapiens
ugccauagcaaugguaagcuga

SEQ ID NO: 372242 - RNA, 22 nt, Homo sapiens
ugccugcugucuaauauauucu

SEQ ID NO: 372243 - RNA, 20 nt, Homo sapiens
uggaaaguaagucaugauau

SEQ ID NO: 372244 - RNA, 22 nt, Homo sapiens
uggaaaguacugagguccaccu

SEQ ID NO: 372245 - RNA, 22 nt, Homo sapiens
uggaaauaaaauagaguuugcc

SEQ ID NO: 372246 - RNA, 23 nt, Homo sapiens
uggaagacuccucucuuggcugc

SEQ ID NO: 372247 - RNA, 22 nt, Homo sapiens
uggaaggucauuguucauuuga

SEQ ID NO: 372248 - RNA, 22 nt, Homo sapiens
uggaagugaacaaccaaggcag

SEQ ID NO: 372249 - RNA, 22 nt, Homo sapiens
uggaauguauaucguuuuuugu

SEQ ID NO: 372250 - RNA, 22 nt, Homo sapiens
uggacaugaagggcacaggagg

SEQ ID NO: 372251 - RNA, 21 nt, Homo sapiens
uggaccccuuccuuacaucau

SEQ ID NO: 372252 - RNA, 21 nt, Homo sapiens
uggagugcaacacuagguaua

SEQ ID NO: 372253 - RNA, 22 nt, Homo sapiens
uggaucaugcgaggccuccccu

SEQ ID NO: 372254 - RNA, 22 nt, Homo sapiens
uggcaagaacaacaauuacuuu

SEQ ID NO: 372255 - RNA, 22 nt, Homo sapiens
uggcaagaagagcaugagacca

SEQ ID NO: 372256 - RNA, 22 nt, Homo sapiens
uggcaagagcaaaauguacagu

SEQ ID NO: 372257 - RNA, 22 nt, Homo sapiens
uggcauauaauauagaagacua

SEQ ID NO: 372258 - RNA, 22 nt, Homo sapiens
uggcauggaguggauggcccca

SEQ ID NO: 372259 - RNA, 22 nt, Homo sapiens
uggcaugggguaguagcgcugg

SEQ ID NO: 372260 - RNA, 22 nt, Homo sapiens
ugggaagauucuguguuuuucc

SEQ ID NO: 372261 - RNA, 21 nt, Homo sapiens
ugggccccuuccuuacaucau

SEQ ID NO: 372262 - RNA, 22 nt, Homo sapiens
ugguaagaucugugagccaggc

SEQ ID NO: 372263 - RNA, 22 nt, Homo sapiens
uguaaaaagcccagccgcugag

SEQ ID NO: 372264 - RNA, 22 nt, Homo sapiens
uguaaaccauauauguauguag

SEQ ID NO: 372265 - RNA, 22 nt, Homo sapiens
uguaacaguaguuacuauucuu

SEQ ID NO: 372266 - RNA, 22 nt, Homo sapiens
uguacaugggacaggaggagag

SEQ ID NO: 372267 - RNA, 22 nt, Homo sapiens
uguaugucuucuuuagauaagu

SEQ ID NO: 372268 - RNA, 22 nt, Homo sapiens
ugucaugugagggaacuuguuc

SEQ ID NO: 372269 - RNA, 22 nt, Homo sapiens
ugugaaaucagauagccuuuuu

SEQ ID NO: 372270 - RNA, 22 nt, Homo sapiens
ugugaauggugcugccgugaag

SEQ ID NO: 372271 - RNA, 22 nt, Homo sapiens
ugugacacugaauggcagaacu

SEQ ID NO: 372272 - RNA, 23 nt, Homo sapiens
ugugacacuuccgucaguucauu

SEQ ID NO: 372273 - RNA, 22 nt, Homo sapiens
ugugacaguguuacauuucaug

SEQ ID NO: 372274 - RNA, 18 nt, Homo sapiens
ugugacauugagcauguc

SEQ ID NO: 372275 - RNA, 22 nt, Homo sapiens
ugugcaccucuucacacaggga

SEQ ID NO: 372276 - RNA, 22 nt, Homo sapiens
ugugcaguuuugagugaauuuc

SEQ ID NO: 372277 - RNA, 21 nt, Homo sapiens
uguggcaauggccucacagau

SEQ ID NO: 372278 - RNA, 22 nt, Homo sapiens
uguggccuuuguuucaguuggg

SEQ ID NO: 372279 - RNA, 18 nt, Homo sapiens
uguggcuguuuuccaaua

SEQ ID NO: 372280 - RNA, 22 nt, Homo sapiens
uguguaaauaugauagaggaau

SEQ ID NO: 372281 - RNA, 22 nt, Homo sapiens
uguuggacuuacuuggcagauu

SEQ ID NO: 372282 - RNA, 22 nt, Homo sapiens
uuaagugcucaguuacucaguu

SEQ ID NO: 372283 - RNA, 22 nt, Homo sapiens
uuacaacugucuuacugguuau

SEQ ID NO: 372284 - RNA, 22 nt, Homo sapiens
uuauaacucugcagccugguau

SEQ ID NO: 372285 - RNA, 22 nt, Homo sapiens
uucaaaguaaagggauggagac

SEQ ID NO: 372286 - RNA, 22 nt, Homo sapiens
uucaacagugauggccuuugua

SEQ ID NO: 372287 - RNA, 23 nt, Homo sapiens
uucaccguguuggccaggcuggu

SEQ ID NO: 372288 - RNA, 22 nt, Homo sapiens
uucaccuugggucccacuugcu

SEQ ID NO: 372289 - RNA, 22 nt, Homo sapiens
uucagagugguaugaagugaug

SEQ ID NO: 372290 - RNA, 22 nt, Homo sapiens
uucagcaggccaggcccugacu

SEQ ID NO: 372291 - RNA, 22 nt, Homo sapiens
uucagggcauuggaguuucuga

SEQ ID NO: 372292 - RNA, 19 nt, Homo sapiens
uucauacagugagagcagc

SEQ ID NO: 372293 - RNA, 19 nt, Homo sapiens
uuccugagaacaagggcuu

SEQ ID NO: 372294 - RNA, 22 nt, Homo sapiens
uugagauccuuuugcucaucag

SEQ ID NO: 372295 - RNA, 22 nt, Homo sapiens
uugcacauggcaggugcucaau

SEQ ID NO: 372296 - RNA, 22 nt, Homo sapiens
uugcuagaugaaaaugguaccu

SEQ ID NO: 372297 - RNA, 22 nt, Homo sapiens
uuggaaugcacacugagccugc

SEQ ID NO: 372298 - RNA, 22 nt, Homo sapiens
uuggagcacuggggcacugaca

SEQ ID NO: 372299 - RNA, 22 nt, Homo sapiens
uuggaugauaaagaagccuaag

SEQ ID NO: 372300 - RNA, 22 nt, Homo sapiens
uuggucaggcuagaguguggug

SEQ ID NO: 372301 - RNA, 22 nt, Homo sapiens
uuguaaagucugucucagucag

SEQ ID NO: 372302 - RNA, 22 nt, Homo sapiens
uuguauguuguuugucagagaa

SEQ ID NO: 372303 - RNA, 22 nt, Homo sapiens
uugugcacauguacccuagaac

SEQ ID NO: 372304 - RNA, 20 nt, Homo sapiens
uugugcauugggccauuggg

SEQ ID NO: 372305 - RNA, 19 nt, Homo sapiens
uuguguccccacaaaauuc

SEQ ID NO: 372306 - RNA, 22 nt, Homo sapiens
gugacacuggagcuggcacaau

SEQ ID NO: 372307 - RNA, 22 nt, Homo sapiens
gugcauacgucuuuauaguagc

SEQ ID NO: 372308 - RNA, 22 nt, Homo sapiens
gugcauaugcaugugcaugcac

SEQ ID NO: 372309 - RNA, 22 nt, Homo sapiens
gugguuguuggaguggcaauuu

SEQ ID NO: 372310 - RNA, 22 nt, Homo sapiens
guguaauacacacauauaugca

SEQ ID NO: 372311 - RNA, 22 nt, Homo sapiens
guguauauccuauuaguucugu

SEQ ID NO: 372312 - RNA, 22 nt, Homo sapiens
guguccucgaguacacaucagg

SEQ ID NO: 372313 - RNA, 22 nt, Homo sapiens
uaaagugaggauggcaguaggu

SEQ ID NO: 372314 - RNA, 22 nt, Homo sapiens
uaaaugcuuaauugaaugugga

SEQ ID NO: 372315 - RNA, 21 nt, Homo sapiens
uaaaugucauacaaagcaaug

SEQ ID NO: 372316 - RNA, 22 nt, Homo sapiens
uaauacugcugugcuugaguug

SEQ ID NO: 372317 - RNA, 22 nt, Homo sapiens
uacaaaguaacaguuccuguau

SEQ ID NO: 372318 - RNA, 22 nt, Homo sapiens
uacaaaucuagguuuguuacug

SEQ ID NO: 372319 - RNA, 22 nt, Homo sapiens
uacagccacauaauguaugauu

SEQ ID NO: 372320 - RNA, 22 nt, Homo sapiens
uacaggcaccuggcuaauuuuu

SEQ ID NO: 372321 - RNA, 22 nt, Homo sapiens
uacauguauccauuguuuuugg

SEQ ID NO: 372322 - RNA, 22 nt, Homo sapiens
uaccuguagacuacagcuucag

SEQ ID NO: 372323 - RNA, 22 nt, Homo sapiens
uacgccuguaauaucagcauuu

SEQ ID NO: 372324 - RNA, 22 nt, Homo sapiens
uagcacuauuuauugaaaagga

SEQ ID NO: 372325 - RNA, 22 nt, Homo sapiens
uaggcacuguguuuguaggagu

SEQ ID NO: 372326 - RNA, 22 nt, Homo sapiens
uauaugcacucagguguaugug

SEQ ID NO: 372327 - RNA, 22 nt, Homo sapiens
uaucacagcauugucuauaaua

SEQ ID NO: 372328 - RNA, 22 nt, Homo sapiens
uaucacaguugcauauuuaagg

SEQ ID NO: 372329 - RNA, 22 nt, Homo sapiens
uaucccaauguaauaucacaaa

SEQ ID NO: 372330 - RNA, 22 nt, Homo sapiens
uaugcuguuucugauuuaggga

SEQ ID NO: 372331 - RNA, 22 nt, Homo sapiens
uauguuaucaaaaagcuaagga

SEQ ID NO: 372332 - RNA, 22 nt, Homo sapiens
uauuacagaccauaucgccggg

SEQ ID NO: 372333 - RNA, 22 nt, Homo sapiens
uauuaugcacuuuauaaaaauu

SEQ ID NO: 372334 - RNA, 22 nt, Homo sapiens
uauugcagugagauccaucugg

SEQ ID NO: 372335 - RNA, 20 nt, Homo sapiens
uauuugguuauuuccauggu

SEQ ID NO: 372336 - RNA, 22 nt, Homo sapiens
uauuugguuggugcaaaaguaa

SEQ ID NO: 372337 - RNA, 22 nt, Homo sapiens
ucaaaguaaagccucaggaugg

SEQ ID NO: 372338 - RNA, 18 nt, Homo sapiens
ucacaaccacagugcugu

SEQ ID NO: 372339 - RNA, 17 nt, Homo sapiens
ucacaguguuaggauga

SEQ ID NO: 372340 - RNA, 22 nt, Homo sapiens
ucacugcgaccuccgccucccg

SEQ ID NO: 372341 - RNA, 19 nt, Homo sapiens
ucacuggacagcacacuca

SEQ ID NO: 372342 - RNA, 22 nt, Homo sapiens
ucacuggagauagcaaucuggu

SEQ ID NO: 372343 - RNA, 21 nt, Homo sapiens
ucagaagcucccagggaggac

SEQ ID NO: 372344 - RNA, 20 nt, Homo sapiens
ucagcagucuggagcagagg

SEQ ID NO: 372345 - RNA, 22 nt, Homo sapiens
ucagcagugccccacucuacug

SEQ ID NO: 372346 - RNA, 22 nt, Homo sapiens
ucagcagugugaaaauggacua

SEQ ID NO: 372347 - RNA, 22 nt, Homo sapiens
ucaguggauuauuaaagucacc

SEQ ID NO: 372348 - RNA, 22 nt, Homo sapiens
ucauacaggccaccagggaagu

SEQ ID NO: 372349 - RNA, 22 nt, Homo sapiens
ucauagaucaaguaauaagaca

SEQ ID NO: 372350 - RNA, 22 nt, Homo sapiens
ucaucaggcucauucaagcuga

SEQ ID NO: 372351 - RNA, 22 nt, Homo sapiens
ucaucaguuuuuuauaugugau

SEQ ID NO: 372352 - RNA, 22 nt, Homo sapiens
ucauuggauggaaugcucugua

SEQ ID NO: 372353 - RNA, 22 nt, Homo sapiens
uccccaguaggcaauuaacacc

SEQ ID NO: 372354 - RNA, 20 nt, Homo sapiens
ucccuaagagccuuuccuuc

SEQ ID NO: 372355 - RNA, 22 nt, Homo sapiens
ucccugaaaaauuggcuuaaca

SEQ ID NO: 372356 - RNA, 23 nt, Homo sapiens
ucgcagcauucaauaccaggcag

SEQ ID NO: 372357 - RNA, 22 nt, Homo sapiens
ucuauggauaaaaugcccucau

SEQ ID NO: 372358 - RNA, 22 nt, Homo sapiens
ucuauugguugaaauugcuuuu

SEQ ID NO: 372359 - RNA, 22 nt, Homo sapiens
ucucaaguggucgcaguuagau

SEQ ID NO: 372360 - RNA, 22 nt, Homo sapiens
ucucauggagucaggagcagaa

SEQ ID NO: 372361 - RNA, 22 nt, Homo sapiens
ucuugcauuuuuaaauagugcu

SEQ ID NO: 372362 - RNA, 19 nt, Homo sapiens
ucuuugaggcaucgcccuc

SEQ ID NO: 372363 - RNA, 22 nt, Homo sapiens
ucuuugaguuauugugcagacu

SEQ ID NO: 372364 - RNA, 22 nt, Homo sapiens
ucuuuggagacaaccccagucu

SEQ ID NO: 372365 - RNA, 22 nt, Homo sapiens
ucuuuggaggcgaucuguuuga

SEQ ID NO: 372366 - RNA, 22 nt, Homo sapiens
ucuuuggauggaaauuggaguc

SEQ ID NO: 372367 - RNA, 22 nt, Homo sapiens
ucuuugguucugugcagccuau

SEQ ID NO: 372368 - RNA, 22 nt, Homo sapiens
ugaaaugucuuuaggaggcuuc

SEQ ID NO: 372369 - RNA, 22 nt, Homo sapiens
ugacaggauggagaucgguauu

SEQ ID NO: 372370 - RNA, 22 nt, Homo sapiens
ugacauggaagauguucaugau

SEQ ID NO: 372371 - RNA, 22 nt, Homo sapiens
ugacauggaaguagguauacau

SEQ ID NO: 372372 - RNA, 22 nt, Homo sapiens
ugacauguauaucuuacgcuau

SEQ ID NO: 372373 - RNA, 22 nt, Homo sapiens
ugacauguauuagcucagugcu

SEQ ID NO: 372374 - RNA, 22 nt, Homo sapiens
ugacauguccaggugguccugu

SEQ ID NO: 372375 - RNA, 22 nt, Homo sapiens
ugacuucagacugaaaugauuc

SEQ ID NO: 372376 - RNA, 22 nt, Homo sapiens
ugagaacaugcacuugagguug

SEQ ID NO: 372377 - RNA, 22 nt, Homo sapiens
ugagacacugaauccggccuga

SEQ ID NO: 372378 - RNA, 22 nt, Homo sapiens
ugagacggagucucgcucuguc

SEQ ID NO: 372379 - RNA, 22 nt, Homo sapiens
ugagacggagucucgcucuguu

SEQ ID NO: 372380 - RNA, 22 nt, Homo sapiens
guggaagaccagacuuuccaac

SEQ ID NO: 372381 - RNA, 22 nt, Homo sapiens
guggaagauaguguguuaaugu

SEQ ID NO: 372382 - RNA, 22 nt, Homo sapiens
guggcaugaaagcaucugugau

SEQ ID NO: 372383 - RNA, 22 nt, Homo sapiens
guugggcccauagacugccagu

SEQ ID NO: 372384 - RNA, 22 nt, Homo sapiens
uaaacugcuugaggguaaguac

SEQ ID NO: 372385 - RNA, 22 nt, Homo sapiens
uaacaccuugcucugucaauaa

SEQ ID NO: 372386 - RNA, 22 nt, Homo sapiens
uaacaguauauuuaccaaaccu

SEQ ID NO: 372387 - RNA, 22 nt, Homo sapiens
uaagguauuuacauuucuguuu

SEQ ID NO: 372388 - RNA, 21 nt, Homo sapiens
uaauaaugucucagacaccua

SEQ ID NO: 372389 - RNA, 22 nt, Homo sapiens
uaaugcacauuuauuuuaccuu

SEQ ID NO: 372390 - RNA, 22 nt, Homo sapiens
uacaagcaggaaaugguauaug

SEQ ID NO: 372391 - RNA, 22 nt, Homo sapiens
uacagaguagaagauuugcaga

SEQ ID NO: 372392 - RNA, 22 nt, Homo sapiens
uacaguagagaucagcaaacua

SEQ ID NO: 372393 - RNA, 22 nt, Homo sapiens
uacagucuagaggagaaucagg

SEQ ID NO: 372394 - RNA, 22 nt, Homo sapiens
uacaugugccauguugguuugc

SEQ ID NO: 372395 - RNA, 22 nt, Homo sapiens
uaccagcauuucucuuuaagua

SEQ ID NO: 372396 - RNA, 22 nt, Homo sapiens
uaccauguauguuucuccauug

SEQ ID NO: 372397 - RNA, 22 nt, Homo sapiens
uacuccccuuguucugugagcu

SEQ ID NO: 372398 - RNA, 22 nt, Homo sapiens
uacugagagaggaauauugaaa

SEQ ID NO: 372399 - RNA, 21 nt, Homo sapiens
uacuggagauacagucugcaa

SEQ ID NO: 372400 - RNA, 22 nt, Homo sapiens
uagagcuaguugcucacugcuu

SEQ ID NO: 372401 - RNA, 22 nt, Homo sapiens
uagaucaacuuugguaagagaa

SEQ ID NO: 372402 - RNA, 22 nt, Homo sapiens
uagauuaucauucauacaggga

SEQ ID NO: 372403 - RNA, 22 nt, Homo sapiens
uaggaaguacaucucagaaucu

SEQ ID NO: 372404 - RNA, 22 nt, Homo sapiens
uaggacacagaccuggauggaa

SEQ ID NO: 372405 - RNA, 22 nt, Homo sapiens
uagggcuuuuccaagcugccac

SEQ ID NO: 372406 - RNA, 22 nt, Homo sapiens
uagguacuuaagaucucagcua

SEQ ID NO: 372407 - RNA, 22 nt, Homo sapiens
uagguagugugugcaugagagg

SEQ ID NO: 372408 - RNA, 22 nt, Homo sapiens
uagugcugugauuaacauaaug

SEQ ID NO: 372409 - RNA, 22 nt, Homo sapiens
uauaugcaacauaguguaugug

SEQ ID NO: 372410 - RNA, 20 nt, Homo sapiens
uaucacauggggagaaaccu

SEQ ID NO: 372411 - RNA, 22 nt, Homo sapiens
uaucagcagcaggggcugcaga

SEQ ID NO: 372412 - RNA, 22 nt, Homo sapiens
uaucagugaaucuuauuuugcc

SEQ ID NO: 372413 - RNA, 20 nt, Homo sapiens
uaugaaacaguguagagcaa

SEQ ID NO: 372414 - RNA, 22 nt, Homo sapiens
uauuucaguugcguuucccgag

SEQ ID NO: 372415 - RNA, 22 nt, Homo sapiens
uauuugauuaacaagagccuaa

SEQ ID NO: 372416 - RNA, 22 nt, Homo sapiens
uauuuggugaaugaaugcaugu

SEQ ID NO: 372417 - RNA, 22 nt, Homo sapiens
ucaaguagugacucgaguuauu

SEQ ID NO: 372418 - RNA, 22 nt, Homo sapiens
ucacuauagaaaacagugugga

SEQ ID NO: 372419 - RNA, 22 nt, Homo sapiens
ucagcaccauguaacaauugau

SEQ ID NO: 372420 - RNA, 21 nt, Homo sapiens
ucagugcaauucuauggggaa

SEQ ID NO: 372421 - RNA, 22 nt, Homo sapiens
ucaguggauuuaaccugaauca

SEQ ID NO: 372422 - RNA, 18 nt, Homo sapiens
ucauagaucaugacagug

SEQ ID NO: 372423 - RNA, 22 nt, Homo sapiens
ucaugugagcacagagcaagau

SEQ ID NO: 372424 - RNA, 22 nt, Homo sapiens
uccaugugaaaaggucgugaua

SEQ ID NO: 372425 - RNA, 22 nt, Homo sapiens
ucccugagcaaaguuuucugua

SEQ ID NO: 372426 - RNA, 22 nt, Homo sapiens
ucgcagcacgagcaugcaaggu

SEQ ID NO: 372427 - RNA, 22 nt, Homo sapiens
ucuaaaacuagauugugaugau

SEQ ID NO: 372428 - RNA, 22 nt, Homo sapiens
ucuacccugugagggacacagu

SEQ ID NO: 372429 - RNA, 20 nt, Homo sapiens
ucucauggagguagagaaua

SEQ ID NO: 372430 - RNA, 22 nt, Homo sapiens
ucucugaaacucuugacauccu

SEQ ID NO: 372431 - RNA, 22 nt, Homo sapiens
ucucuugguugaacaguuugga

SEQ ID NO: 372432 - RNA, 22 nt, Homo sapiens
ucugagaucaugucugugcugu

SEQ ID NO: 372433 - RNA, 22 nt, Homo sapiens
ucugcauauucuagggcaccaa

SEQ ID NO: 372434 - RNA, 22 nt, Homo sapiens
ucuggcaagagccgagggcagu

SEQ ID NO: 372435 - RNA, 22 nt, Homo sapiens
uuggaagauuacuuaguuuucu

SEQ ID NO: 372436 - RNA, 22 nt, Homo sapiens
uuggaauguacucuagccuaug

SEQ ID NO: 372437 - RNA, 22 nt, Homo sapiens
uuggagagugauauucagaugc

SEQ ID NO: 372438 - RNA, 22 nt, Homo sapiens
uuguaaagaucauaugcuguuc

SEQ ID NO: 372439 - RNA, 22 nt, Homo sapiens
uuguacuuuuaguagagacggg

SEQ ID NO: 372440 - RNA, 22 nt, Homo sapiens
uugugacacagcugggccuaua

SEQ ID NO: 372441 - RNA, 22 nt, Homo sapiens
uugugcaugaugcauacauggu

SEQ ID NO: 372442 - RNA, 22 nt, Homo sapiens
uuucccauuguucugcucugug

SEQ ID NO: 372443 - RNA, 22 nt, Homo sapiens
uuuguuugaagucgagacaacu

SEQ ID NO: 372444 - RNA, 22 nt, Homo sapiens
uuuuggacuugcuccccugucc

SEQ ID NO: 372445 - RNA, 22 nt, Homo sapiens
uggaagugucugugcccagcuc

SEQ ID NO: 372446 - RNA, 21 nt, Homo sapiens
uggaccccuacuucucaccau

SEQ ID NO: 372447 - RNA, 21 nt, Homo sapiens
uggaccccuuccagucaucau

SEQ ID NO: 372448 - RNA, 22 nt, Homo sapiens
uggaccccuucuccuauuaaaa

SEQ ID NO: 372449 - RNA, 21 nt, Homo sapiens
uggaugccuaggcagaaguuu

SEQ ID NO: 372450 - RNA, 22 nt, Homo sapiens
uggcaaaaaaacgcaauuacgu

SEQ ID NO: 372451 - RNA, 22 nt, Homo sapiens
uggcaccugacuccgagaugca

SEQ ID NO: 372452 - RNA, 18 nt, Homo sapiens
ugggaagaaauucuucuc

SEQ ID NO: 372453 - RNA, 22 nt, Homo sapiens
ugggagcauugcauuagaagcc

SEQ ID NO: 372454 - RNA, 22 nt, Homo sapiens
ugggugugaccgcucaaggggg

SEQ ID NO: 372455 - RNA, 22 nt, Homo sapiens
uggucaugaggugaggcuucuc

SEQ ID NO: 372456 - RNA, 22 nt, Homo sapiens
uguauuuguuguuaaauggaga

SEQ ID NO: 372457 - RNA, 22 nt, Homo sapiens
ugucaaagagacaucugcacuc

SEQ ID NO: 372458 - RNA, 20 nt, Homo sapiens
ugucaagaaacauuacuuau

SEQ ID NO: 372459 - RNA, 22 nt, Homo sapiens
ugucaggaggguccagagaaaa

SEQ ID NO: 372460 - RNA, 22 nt, Homo sapiens
ugucccugagccuggauuccug

SEQ ID NO: 372461 - RNA, 22 nt, Homo sapiens
ugucuugagagaggacaugacu

SEQ ID NO: 372462 - RNA, 22 nt, Homo sapiens
ugugacagcacgguucaacugc

SEQ ID NO: 372463 - RNA, 22 nt, Homo sapiens
ugugaucaugugugccuuaguc

SEQ ID NO: 372464 - RNA, 22 nt, Homo sapiens
ugugccacugcacucuggccug

SEQ ID NO: 372465 - RNA, 22 nt, Homo sapiens
uguggcaaauggucaggaagaa

SEQ ID NO: 372466 - RNA, 22 nt, Homo sapiens
uguggcuuuguaaccauggguc

SEQ ID NO: 372467 - RNA, 22 nt, Homo sapiens
uuaaguaaucagagaagagaac

SEQ ID NO: 372468 - RNA, 22 nt, Homo sapiens
uuacuauguuucaaagugucuc

SEQ ID NO: 372469 - RNA, 22 nt, Homo sapiens
uuauauguuacucccucuagca

SEQ ID NO: 372470 - RNA, 22 nt, Homo sapiens
uuaucagcagugcgaaaacaga

SEQ ID NO: 372471 - RNA, 22 nt, Homo sapiens
uucaaaguuggaggacaaacug

SEQ ID NO: 372472 - RNA, 23 nt, Homo sapiens
uucaacagguagacccucccugc

SEQ ID NO: 372473 - RNA, 22 nt, Homo sapiens
uucaagaauuaaaguggcuuuu

SEQ ID NO: 372474 - RNA, 22 nt, Homo sapiens
uucacagagagaacucaaacca

SEQ ID NO: 372475 - RNA, 22 nt, Homo sapiens
uucaccuggaguucaggauaag

SEQ ID NO: 372476 - RNA, 22 nt, Homo sapiens
uucagcaguggccaguggaaau

SEQ ID NO: 372477 - RNA, 22 nt, Homo sapiens
uucagcuacuuggaaacagcaa

SEQ ID NO: 372478 - RNA, 22 nt, Homo sapiens
uucaguagucuccauagaaccg

SEQ ID NO: 372479 - RNA, 22 nt, Homo sapiens
uucauacaguggcugcacucca

SEQ ID NO: 372480 - RNA, 22 nt, Homo sapiens
uucauggaguugagaaggcuaa

SEQ ID NO: 372481 - RNA, 22 nt, Homo sapiens
uucccugaaguguuacucuaga

SEQ ID NO: 372482 - RNA, 22 nt, Homo sapiens
uucccugagcaucuguugagcc

SEQ ID NO: 372483 - RNA, 22 nt, Homo sapiens
uuccuuaguuauuugguccccu

SEQ ID NO: 372484 - RNA, 22 nt, Homo sapiens
uugaaaguaaacaucacaaaga

SEQ ID NO: 372485 - RNA, 22 nt, Homo sapiens
uugaaguaguacuuuauuauag

SEQ ID NO: 372486 - RNA, 22 nt, Homo sapiens
uugacauaguuucugaaauaga

SEQ ID NO: 372487 - RNA, 22 nt, Homo sapiens
uugagaucaugcuacugcacuc

SEQ ID NO: 372488 - RNA, 22 nt, Homo sapiens
uugagaucuacuacuguaggag

SEQ ID NO: 372489 - RNA, 20 nt, Homo sapiens
uugagaucuguaucugguuu

SEQ ID NO: 372490 - RNA, 22 nt, Homo sapiens
uugagaucugugcuuuugcguu

SEQ ID NO: 372491 - RNA, 22 nt, Homo sapiens
uugagaucuuuuaggccuuugu

SEQ ID NO: 372492 - RNA, 22 nt, Homo sapiens
uugaguuugaguauucuaaagc

SEQ ID NO: 372493 - RNA, 22 nt, Homo sapiens
uugcacauguugaaccagcaaa

SEQ ID NO: 372494 - RNA, 22 nt, Homo sapiens
uugcacugagauuuugcuuaca

SEQ ID NO: 372495 - RNA, 22 nt, Homo sapiens
cagaucaucuugagcuuaggaa

SEQ ID NO: 372496 - RNA, 22 nt, Homo sapiens
cagcuguguuauaaacuaccau

SEQ ID NO: 372497 - RNA, 22 nt, Homo sapiens
caggaccucuugccuggaagcc

SEQ ID NO: 372498 - RNA, 22 nt, Homo sapiens
caggcagucuggggguguaucc

SEQ ID NO: 372499 - RNA, 22 nt, Homo sapiens
caguagcaugccucagaaugag

SEQ ID NO: 372500 - RNA, 22 nt, Homo sapiens
caguuacuugacacaaccaauu

SEQ ID NO: 372501 - RNA, 22 nt, Homo sapiens
cauacaguaggcacuauuugua

SEQ ID NO: 372502 - RNA, 22 nt, Homo sapiens
caucacaguacuaaucgucaua

SEQ ID NO: 372503 - RNA, 22 nt, Homo sapiens
caucgcacuccagcuugggcaa

SEQ ID NO: 372504 - RNA, 22 nt, Homo sapiens
caugcacugagagggucucggc

SEQ ID NO: 372505 - RNA, 23 nt, Homo sapiens
ccacacuguuuagaauggcauca

SEQ ID NO: 372506 - RNA, 22 nt, Homo sapiens
ccacuguuuaaauggcugagga

SEQ ID NO: 372507 - RNA, 22 nt, Homo sapiens
ccauugaacaugaaggaaugug

SEQ ID NO: 372508 - RNA, 22 nt, Homo sapiens
ccugagaucauacuguuaguaa

SEQ ID NO: 372509 - RNA, 22 nt, Homo sapiens
cuagcagcaugagaauggacca

SEQ ID NO: 372510 - RNA, 22 nt, Homo sapiens
cucaaagugcugggauuggcca

SEQ ID NO: 372511 - RNA, 22 nt, Homo sapiens
cucaguagaaaauacauggacu

SEQ ID NO: 372512 - RNA, 22 nt, Homo sapiens
cucaguguuaaggccaccucug

SEQ ID NO: 372513 - RNA, 22 nt, Homo sapiens
cucauugcaaucucugccuccc

SEQ ID NO: 372514 - RNA, 22 nt, Homo sapiens
cucucugagccccagacaccuu

SEQ ID NO: 372515 - RNA, 22 nt, Homo sapiens
cucuuuggaugccuuaggguua

SEQ ID NO: 372516 - RNA, 22 nt, Homo sapiens
cugaccauagacuacucugggc

SEQ ID NO: 372517 - RNA, 22 nt, Homo sapiens
cugacuaguuuuaaugcagauu

SEQ ID NO: 372518 - RNA, 22 nt, Homo sapiens
cugagaagaaacagguaaggac

SEQ ID NO: 372519 - RNA, 22 nt, Homo sapiens
cugagacacucuuaucugcaua

SEQ ID NO: 372520 - RNA, 22 nt, Homo sapiens
cugagcaaaguucuauuuaugg

SEQ ID NO: 372521 - RNA, 22 nt, Homo sapiens
cuggaaagcaaguccauugcuc

SEQ ID NO: 372522 - RNA, 22 nt, Homo sapiens
cuggagauauuggaagaaagaa

SEQ ID NO: 372523 - RNA, 22 nt, Homo sapiens
cugggauggaggagaauuagag

SEQ ID NO: 372524 - RNA, 22 nt, Homo sapiens
cugugcauaugacuuuauugga

SEQ ID NO: 372525 - RNA, 22 nt, Homo sapiens
cuuggacaccucaugcccaccu

SEQ ID NO: 372526 - RNA, 22 nt, Homo sapiens
cuuuggguauucucccuugggg

SEQ ID NO: 372527 - RNA, 22 nt, Homo sapiens
gaaagauuuccugagcuagaaa

SEQ ID NO: 372528 - RNA, 22 nt, Homo sapiens
gaagauucaaccaaaccagaac

SEQ ID NO: 372529 - RNA, 22 nt, Homo sapiens
gaagguauauucuguuaaugcu

SEQ ID NO: 372530 - RNA, 19 nt, Homo sapiens
gaaguguuguccuccagua

SEQ ID NO: 372531 - RNA, 17 nt, Homo sapiens
gaaguguuucagcagcu

SEQ ID NO: 372532 - RNA, 19 nt, Homo sapiens
gaaguguuuguucuccaug

SEQ ID NO: 372533 - RNA, 22 nt, Homo sapiens
gacagguuuucuguuucugaaa

SEQ ID NO: 372534 - RNA, 21 nt, Homo sapiens
gacauggcgauacuccgucuc

SEQ ID NO: 372535 - RNA, 22 nt, Homo sapiens
gacauguuuucaagauuuauaa

SEQ ID NO: 372536 - RNA, 23 nt, Homo sapiens
gagaccagcuucagaaagcacga

SEQ ID NO: 372537 - RNA, 22 nt, Homo sapiens
gagacugagucuugcccuguca

SEQ ID NO: 372538 - RNA, 22 nt, Homo sapiens
gagacugagucuugcucuguca

SEQ ID NO: 372539 - RNA, 22 nt, Homo sapiens
gagacugagucuugcuuuguca

SEQ ID NO: 372540 - RNA, 22 nt, Homo sapiens
gagauacacccagugcagaggc

SEQ ID NO: 372541 - RNA, 22 nt, Homo sapiens
gagguaugugggcagacauuua

SEQ ID NO: 372542 - RNA, 22 nt, Homo sapiens
gagugcaauggcgcgaucuggg

SEQ ID NO: 372543 - RNA, 22 nt, Homo sapiens
gagugcaauggugcuaucucgg

SEQ ID NO: 372544 - RNA, 22 nt, Homo sapiens
gaguuagguugucaaugucuua

SEQ ID NO: 372545 - RNA, 22 nt, Homo sapiens
gauauguacagcucucuaggau

SEQ ID NO: 372546 - RNA, 22 nt, Homo sapiens
gaucacaguuccucacgggcau

SEQ ID NO: 372547 - RNA, 22 nt, Homo sapiens
gaucacaugggagaaugagagu

SEQ ID NO: 372548 - RNA, 22 nt, Homo sapiens
gaucuguuucaauugucuuagu

SEQ ID NO: 372549 - RNA, 22 nt, Homo sapiens
gaugagguaggccugcuuugaa

SEQ ID NO: 372550 - RNA, 22 nt, Homo sapiens
gauggaguugucgccugggcug

SEQ ID NO: 372551 - RNA, 22 nt, Homo sapiens
gcacugagagaagccccaagua

SEQ ID NO: 372552 - RNA, 22 nt, Homo sapiens
gcacugggccacauuuauuuuc

SEQ ID NO: 372553 - RNA, 22 nt, Homo sapiens
auguguaaagcuuuucuuuguu

SEQ ID NO: 372554 - RNA, 22 nt, Homo sapiens
auguuauguucuucucuguaua

SEQ ID NO: 372555 - RNA, 22 nt, Homo sapiens
auuauaugucaucacagacacc

SEQ ID NO: 372556 - RNA, 21 nt, Homo sapiens
auuugguguuagaaauaaauu

SEQ ID NO: 372557 - RNA, 22 nt, Homo sapiens
caaaggcuuccacugcauccuu

SEQ ID NO: 372558 - RNA, 22 nt, Homo sapiens
caaaguaauugugguuuugcca

SEQ ID NO: 372559 - RNA, 22 nt, Homo sapiens
cacacugucuucauuacuguag

SEQ ID NO: 372560 - RNA, 21 nt, Homo sapiens
cacauggaggcagagagugua

SEQ ID NO: 372561 - RNA, 22 nt, Homo sapiens
caccagguggcugaggccauga

SEQ ID NO: 372562 - RNA, 17 nt, Homo sapiens
cacugggugcaagagga

SEQ ID NO: 372563 - RNA, 22 nt, Homo sapiens
cagacaugucuuguggccgugg

SEQ ID NO: 372564 - RNA, 22 nt, Homo sapiens
cagccggguggcuccuagggua

SEQ ID NO: 372565 - RNA, 22 nt, Homo sapiens
gaggcaauaugagggaggcuuc

SEQ ID NO: 372566 - RNA, 22 nt, Homo sapiens
gagguauggauaucuggagagg

SEQ ID NO: 372567 - RNA, 22 nt, Homo sapiens
gaguaaaugucaaguacuuagg

SEQ ID NO: 372568 - RNA, 23 nt, Homo sapiens
gagugcaaugacaugaucucgga

SEQ ID NO: 372569 - RNA, 22 nt, Homo sapiens
gagugcaauggcgcgaucucgg

SEQ ID NO: 372570 - RNA, 23 nt, Homo sapiens
gaguggagacucauugauuuccu

SEQ ID NO: 372571 - RNA, 22 nt, Homo sapiens
gauaaauccagauucugaugua

SEQ ID NO: 372572 - RNA, 22 nt, Homo sapiens
gauauguguaucuauguacaug

SEQ ID NO: 372573 - RNA, 22 nt, Homo sapiens
gauggcagugcagccccuggcu

SEQ ID NO: 372574 - RNA, 22 nt, Homo sapiens
gcaagaauggaacaggagagcc

SEQ ID NO: 372575 - RNA, 22 nt, Homo sapiens
gcacauggccacuaggaauaaa

SEQ ID NO: 372576 - RNA, 22 nt, Homo sapiens
gcacauggccccaucgugccga

SEQ ID NO: 372577 - RNA, 22 nt, Homo sapiens
gcagcaucaaaucacacaagau

SEQ ID NO: 372578 - RNA, 22 nt, Homo sapiens
gcagugcaugacgguauauaua

SEQ ID NO: 372579 - RNA, 22 nt, Homo sapiens
gcugcacuuuaaggcauccccu

SEQ ID NO: 372580 - RNA, 17 nt, Homo sapiens
gcugcauucauguagaa

SEQ ID NO: 372581 - RNA, 22 nt, Homo sapiens
gcuuuggauaaaugucaguuua

SEQ ID NO: 372582 - RNA, 22 nt, Homo sapiens
ggaagaauaaugggccuuagag

SEQ ID NO: 372583 - RNA, 18 nt, Homo sapiens
ggaagccuauuuaguaac

SEQ ID NO: 372584 - RNA, 22 nt, Homo sapiens
ggaagguaauuggguaaugaga

SEQ ID NO: 372585 - RNA, 22 nt, Homo sapiens
ggaagugugaguaggauuugga

SEQ ID NO: 372586 - RNA, 22 nt, Homo sapiens
ggaauguaguaauuugguuagu

SEQ ID NO: 372587 - RNA, 23 nt, Homo sapiens
ggaguguaaugacucgaucucgg

SEQ ID NO: 372588 - RNA, 22 nt, Homo sapiens
ggcaagauagauaucaguguca

SEQ ID NO: 372589 - RNA, 22 nt, Homo sapiens
ggcagcacaauuuucugaugga

SEQ ID NO: 372590 - RNA, 22 nt, Homo sapiens
gggaugaagaagaauaguucgu

SEQ ID NO: 372591 - RNA, 22 nt, Homo sapiens
guaaacuuccccucaugaauga

SEQ ID NO: 372592 - RNA, 18 nt, Homo sapiens
guaaauguaucuauugcc

SEQ ID NO: 372593 - RNA, 22 nt, Homo sapiens
guaugauacuguaacagugggu

SEQ ID NO: 372594 - RNA, 22 nt, Homo sapiens
gucccugcgauugugggauccu

SEQ ID NO: 372595 - RNA, 22 nt, Homo sapiens
gucugucuuuugucuuugaaau

SEQ ID NO: 372596 - RNA, 17 nt, Homo sapiens
gucuuugguugaguuua

SEQ ID NO: 372597 - RNA, 22 nt, Homo sapiens
gugaaagcaucugacugugcca

SEQ ID NO: 372598 - RNA, 21 nt, Homo sapiens
gugaggaguuacuggcuuuga

SEQ ID NO: 372599 - RNA, 22 nt, Homo sapiens
gugcaguuugaaaguagaaaca

SEQ ID NO: 372600 - RNA, 22 nt, Homo sapiens
gugcaugucugugacgacccug

SEQ ID NO: 372601 - RNA, 22 nt, Homo sapiens
gugcgggaggcgcgccuaggug

SEQ ID NO: 372602 - RNA, 22 nt, Homo sapiens
guggacaugaauuuuggaggca

SEQ ID NO: 372603 - RNA, 22 nt, Homo sapiens
gugggaagcuggaacucccucc

SEQ ID NO: 372604 - RNA, 22 nt, Homo sapiens
gugugcaacuuucauuaauauu

SEQ ID NO: 372605 - RNA, 22 nt, Homo sapiens
guuaugcagcaauugauaaucu

SEQ ID NO: 372606 - RNA, 22 nt, Homo sapiens
guuggugaccugaagagaguaa

SEQ ID NO: 372607 - RNA, 22 nt, Homo sapiens
uaacaggcaaggucacaccuug

SEQ ID NO: 372608 - RNA, 22 nt, Homo sapiens
uaaguaauugugguuucugcca

SEQ ID NO: 372609 - RNA, 20 nt, Homo sapiens
uaagugcuugaugaaugaac

SEQ ID NO: 372610 - RNA, 22 nt, Homo sapiens
uacaguguuuugguauuccaca

SEQ ID NO: 372611 - RNA, 22 nt, Homo sapiens
uacauaguaagcacuaugccaa

SEQ ID NO: 372612 - RNA, 22 nt, Homo sapiens
uacauaguaagcaucuccugug

SEQ ID NO: 372613 - RNA, 22 nt, Homo sapiens
uaccuguagcucuucuaggcug

SEQ ID NO: 372614 - RNA, 22 nt, Homo sapiens
uacucugcagagaugcauaaca

SEQ ID NO: 372615 - RNA, 22 nt, Homo sapiens
uacugcacuccaaccugagaga

SEQ ID NO: 372616 - RNA, 22 nt, Homo sapiens
uagcaguauggagcgaggccca

SEQ ID NO: 372617 - RNA, 17 nt, Homo sapiens
uagcucuauuucuagcc

SEQ ID NO: 372618 - RNA, 22 nt, Homo sapiens
uaggcuuuuggacccugucucu

SEQ ID NO: 372619 - RNA, 22 nt, Homo sapiens
uaggggcacacuucgguuagca

SEQ ID NO: 372620 - RNA, 22 nt, Homo sapiens
uagguauguauauacacacaca

SEQ ID NO: 372621 - RNA, 22 nt, Homo sapiens
uaguaggacaggauuucaguua

SEQ ID NO: 372622 - RNA, 22 nt, Homo sapiens
uauagcagccugaacaaaguaa

SEQ ID NO: 372623 - RNA, 22 nt, Homo sapiens
uauagcagugugagaacagacu

SEQ ID NO: 372624 - RNA, 22 nt, Homo sapiens
uaugacauaguccuuaacccuc

SEQ ID NO: 372625 - RNA, 22 nt, Homo sapiens
uauggccccuacaugugcaaaa

SEQ ID NO: 372626 - RNA, 22 nt, Homo sapiens
uauugcauguugagcaguaccu

SEQ ID NO: 372627 - RNA, 22 nt, Homo sapiens
uauuugauugacuuuagcagga

SEQ ID NO: 372628 - RNA, 19 nt, Homo sapiens
ucaauucugucaauggcuu

SEQ ID NO: 372629 - RNA, 22 nt, Homo sapiens
ucacaauucucaauuugugaaa

SEQ ID NO: 372630 - RNA, 22 nt, Homo sapiens
ucacagacugagccaaauagag

SEQ ID NO: 372631 - RNA, 18 nt, Homo sapiens
ucaccuugaugcuggguc

SEQ ID NO: 372632 - RNA, 22 nt, Homo sapiens
ucacuggaggagaggaagugga

SEQ ID NO: 372633 - RNA, 22 nt, Homo sapiens
ucacugggagaccaaagccauc

SEQ ID NO: 372634 - RNA, 22 nt, Homo sapiens
ucagagucuagaucacucacug

SEQ ID NO: 372635 - RNA, 22 nt, Homo sapiens
ucagauacuggugacaugaaug

SEQ ID NO: 372636 - RNA, 22 nt, Homo sapiens
ucaggcacuaguaagaaaaagg

SEQ ID NO: 372637 - RNA, 22 nt, Homo sapiens
ucaggcacucagcuuagagucu

SEQ ID NO: 372638 - RNA, 22 nt, Homo sapiens
ucaguggagcuacaauucuggg

SEQ ID NO: 372639 - RNA, 22 nt, Homo sapiens
ucaugugaggauaacaauagug

SEQ ID NO: 372640 - RNA, 22 nt, Homo sapiens
uccacugagcuagaccacuugg

SEQ ID NO: 372641 - RNA, 22 nt, Homo sapiens
ucccuuagccaaauccccagcc

SEQ ID NO: 372642 - RNA, 22 nt, Homo sapiens
uccuuugguuauaggcaccucu

SEQ ID NO: 372643 - RNA, 22 nt, Homo sapiens
ucuauguuuuugcuaguagugu

SEQ ID NO: 372644 - RNA, 22 nt, Homo sapiens
ucucagcacaaacaaaauugcu

SEQ ID NO: 372645 - RNA, 22 nt, Homo sapiens
ucucaguggugcuggcagggga

SEQ ID NO: 372646 - RNA, 22 nt, Homo sapiens
ucugguuccugcauucauucaa

SEQ ID NO: 372647 - RNA, 18 nt, Homo sapiens
aaacagugucucuuucug

SEQ ID NO: 372648 - RNA, 22 nt, Homo sapiens
aaagagaucuaugggcacuaug

SEQ ID NO: 372649 - RNA, 22 nt, Homo sapiens
aaaggcacacacuccuuguuau

SEQ ID NO: 372650 - RNA, 22 nt, Homo sapiens
aaagugcugggaucacacugaa

SEQ ID NO: 372651 - RNA, 22 nt, Homo sapiens
acaaagugccuccuuuuagagu

SEQ ID NO: 372652 - RNA, 22 nt, Homo sapiens
acacagugucuguguauuuaaa

SEQ ID NO: 372653 - RNA, 22 nt, Homo sapiens
acacuguuuuguggagaaugua

SEQ ID NO: 372654 - RNA, 22 nt, Homo sapiens
acauugcauauggcacccucuu

SEQ ID NO: 372655 - RNA, 22 nt, Homo sapiens
acccuggaggucuacagugcag

SEQ ID NO: 372656 - RNA, 22 nt, Homo sapiens
acccuggaguaguaggaaucug

SEQ ID NO: 372657 - RNA, 22 nt, Homo sapiens
acccuggauucguggccuugaa

SEQ ID NO: 372658 - RNA, 22 nt, Homo sapiens
acuacauaugacaucuucuuua

SEQ ID NO: 372659 - RNA, 22 nt, Homo sapiens
acugagacugagaauguuucuu

SEQ ID NO: 372660 - RNA, 22 nt, Homo sapiens
acugcacuccagccuccugaca

SEQ ID NO: 372661 - RNA, 20 nt, Homo sapiens
acuggcacugguaggugugg

SEQ ID NO: 372662 - RNA, 22 nt, Homo sapiens
agaaagugcuucccuuugguga

SEQ ID NO: 372663 - RNA, 22 nt, Homo sapiens
agaauguaaacagaauagagga

SEQ ID NO: 372664 - RNA, 22 nt, Homo sapiens
agacaguguguguauauauggu

SEQ ID NO: 372665 - RNA, 22 nt, Homo sapiens
agagguaagcaguggcaagugc

SEQ ID NO: 372666 - RNA, 23 nt, Homo sapiens
agagguuuaaucaggcaguugcu

SEQ ID NO: 372667 - RNA, 22 nt, Homo sapiens
agcaccaauaaucagaguucuu

SEQ ID NO: 372668 - RNA, 20 nt, Homo sapiens
agcaucacagagccgggugu

SEQ ID NO: 372669 - RNA, 16 nt, Homo sapiens
agccaccauuuacuug

SEQ ID NO: 372670 - RNA, 22 nt, Homo sapiens
agcuuuggauaccugcuguucc

SEQ ID NO: 372671 - RNA, 22 nt, Homo sapiens
aggaagugugcaauuaauuucu

SEQ ID NO: 372672 - RNA, 22 nt, Homo sapiens
aggagaauugguucuucuugau

SEQ ID NO: 372673 - RNA, 22 nt, Homo sapiens
aggagguagaacauugccauuu

SEQ ID NO: 372674 - RNA, 22 nt, Homo sapiens
aggagguaggaauugugcuagg

SEQ ID NO: 372675 - RNA, 22 nt, Homo sapiens
aggcaggugaaagauaguuuua

SEQ ID NO: 372676 - RNA, 22 nt, Homo sapiens
agggaagugugcuaugcauuua

SEQ ID NO: 372677 - RNA, 22 nt, Homo sapiens
agggagcaaaguggucuuucuc

SEQ ID NO: 372678 - RNA, 22 nt, Homo sapiens
aguacacuguugaacagaagug

SEQ ID NO: 372679 - RNA, 22 nt, Homo sapiens
aguauguagugcaaucagucag

SEQ ID NO: 372680 - RNA, 22 nt, Homo sapiens
aguauguuuugaaaccaagaag

SEQ ID NO: 372681 - RNA, 22 nt, Homo sapiens
agugguuuuaaguagagcauac

SEQ ID NO: 372682 - RNA, 22 nt, Homo sapiens
aguguuuuuaacaagaaagggu

SEQ ID NO: 372683 - RNA, 17 nt, Homo sapiens
auaaacucaucauuuuu

SEQ ID NO: 372684 - RNA, 22 nt, Homo sapiens
auaagugcuuguugaauaauag

SEQ ID NO: 372685 - RNA, 22 nt, Homo sapiens
auaauacugggaagaugagcau

SEQ ID NO: 372686 - RNA, 22 nt, Homo sapiens
auacacgugcagaacaugcagg

SEQ ID NO: 372687 - RNA, 19 nt, Homo sapiens
auacacguguauacauaca

SEQ ID NO: 372688 - RNA, 20 nt, Homo sapiens
auagaagacuagugcagcag

SEQ ID NO: 372689 - RNA, 22 nt, Homo sapiens
auagugcugcaauaaccauggg

SEQ ID NO: 372690 - RNA, 22 nt, Homo sapiens
auaucacaaacaagucuguacu

SEQ ID NO: 372691 - RNA, 22 nt, Homo sapiens
auaugcauguacccacacaggc

SEQ ID NO: 372692 - RNA, 21 nt, Homo sapiens
auauggaacuggugacguguu

SEQ ID NO: 372693 - RNA, 22 nt, Homo sapiens
aucaaaugcuggcagagugccu

SEQ ID NO: 372694 - RNA, 22 nt, Homo sapiens
aucacaggcaaaauuccuucuc

SEQ ID NO: 372695 - RNA, 22 nt, Homo sapiens
aucagcagcaugaaaacggacu

SEQ ID NO: 372696 - RNA, 21 nt, Homo sapiens
aucauaugcucacuccuagaa

SEQ ID NO: 372697 - RNA, 22 nt, Homo sapiens
aucccugugauccaaucacuuc

SEQ ID NO: 372698 - RNA, 22 nt, Homo sapiens
aucugcacaucuguguuuuugu

SEQ ID NO: 372699 - RNA, 22 nt, Homo sapiens
aucugugguuguaugcauauua

SEQ ID NO: 372700 - RNA, 22 nt, Homo sapiens
aucuuuggugaguucuuugguc

SEQ ID NO: 372701 - RNA, 22 nt, Homo sapiens
augaccuuguccucagugucau

SEQ ID NO: 372702 - RNA, 22 nt, Homo sapiens
augagaauguaaguuaaugaaa

SEQ ID NO: 372703 - RNA, 22 nt, Homo sapiens
augagguaauaaguccuuggaa

SEQ ID NO: 372704 - RNA, 22 nt, Homo sapiens
augaguugaagcuacaagaggc

SEQ ID NO: 372705 - RNA, 22 nt, Homo sapiens
augcaauucuagauugauagua

SEQ ID NO: 372706 - RNA, 22 nt, Homo sapiens
augcuguuuugaauucucuaga

SEQ ID NO: 372707 - RNA, 22 nt, Homo sapiens
auggaaggagaauggucuuuga

SEQ ID NO: 372708 - RNA, 22 nt, Homo sapiens
auggaagucucuguuaaguuuc

SEQ ID NO: 372709 - RNA, 22 nt, Homo sapiens
auggacauuaaagcgauguaga

SEQ ID NO: 372710 - RNA, 22 nt, Homo sapiens
auggagguguggggagugaguu

SEQ ID NO: 372711 - RNA, 18 nt, Homo sapiens
auggguguuggaaaauga

SEQ ID NO: 372712 - RNA, 22 nt, Homo sapiens
auggucccuguuccaugcuccu

SEQ ID NO: 372713 - RNA, 17 nt, Homo sapiens
auguauacauccaugua

SEQ ID NO: 372714 - RNA, 22 nt, Homo sapiens
augugaacaucauagaaugcac

SEQ ID NO: 372715 - RNA, 22 nt, Homo sapiens
augugcaauggugucaccacau

SEQ ID NO: 372716 - RNA, 22 nt, Homo sapiens
augugcacauucugguaaauau

SEQ ID NO: 372717 - RNA, 21 nt, Homo sapiens
augugcacuaugucauuuaau

SEQ ID NO: 372718 - RNA, 22 nt, Homo sapiens
augugcuaguaucaaacgagac

SEQ ID NO: 372719 - RNA, 20 nt, Homo sapiens
auucauggaggagcaauugg

SEQ ID NO: 372720 - RNA, 22 nt, Homo sapiens
auugaacacagaguagcuuucc

SEQ ID NO: 372721 - RNA, 22 nt, Homo sapiens
auuggugaccugcggcaguaug

SEQ ID NO: 372722 - RNA, 21 nt, Homo sapiens
auuugguggcugugugacacu

SEQ ID NO: 372723 - RNA, 22 nt, Homo sapiens
auuuugcauugcuguaaaggaa

SEQ ID NO: 372724 - RNA, 22 nt, Homo sapiens
caaaguaauugcuguuuugcca

SEQ ID NO: 372725 - RNA, 22 nt, Homo sapiens
caaagugcugggaugggccagg

SEQ ID NO: 372726 - RNA, 22 nt, Homo sapiens
caaguguuggcuuguauacaaa

SEQ ID NO: 372727 - RNA, 22 nt, Homo sapiens
cacaaaguagauuagucuucca

SEQ ID NO: 372728 - RNA, 22 nt, Homo sapiens
cacagcacaggcaugaguguca

SEQ ID NO: 372729 - RNA, 22 nt, Homo sapiens
cacauguucaggagcacuuaga

SEQ ID NO: 372730 - RNA, 22 nt, Homo sapiens
caccuguacauggcaguguccu

SEQ ID NO: 372731 - RNA, 21 nt, Homo sapiens
cacugcaucacaggacagcau

SEQ ID NO: 372732 - RNA, 22 nt, Homo sapiens
cacugcauggucuagcuggguu

SEQ ID NO: 372733 - RNA, 22 nt, Homo sapiens
cacugggugagauccauguuua

SEQ ID NO: 372734 - RNA, 22 nt, Homo sapiens
cacuggguuagaacaugcuccu

SEQ ID NO: 372735 - RNA, 22 nt, Homo sapiens
cagagugcauguuuagaugagu

SEQ ID NO: 372736 - RNA, 17 nt, Homo sapiens
ucuggcuuucacaccug

SEQ ID NO: 372737 - RNA, 22 nt, Homo sapiens
ucugguguuauucauguaguuu

SEQ ID NO: 372738 - RNA, 19 nt, Homo sapiens
ucugugcuugucccccugu

SEQ ID NO: 372739 - RNA, 22 nt, Homo sapiens
ucuuugauguucugaaagaugg

SEQ ID NO: 372740 - RNA, 22 nt, Homo sapiens
ucuuuguguucaggagccacgu

SEQ ID NO: 372741 - RNA, 22 nt, Homo sapiens
ucuuuugguuucuagaggccgc

SEQ ID NO: 372742 - RNA, 22 nt, Homo sapiens
ugaaauguaaguugucuagucu

SEQ ID NO: 372743 - RNA, 22 nt, Homo sapiens
ugacaguguccucauucccaac

SEQ ID NO: 372744 - RNA, 22 nt, Homo sapiens
ugacauggagagagaagccuuu

SEQ ID NO: 372745 - RNA, 22 nt, Homo sapiens
ugacauggugcucuuucaggca

SEQ ID NO: 372746 - RNA, 22 nt, Homo sapiens
ugacauguugcauuauauuucc

SEQ ID NO: 372747 - RNA, 22 nt, Homo sapiens
ugacugugcagcuccaucaggg

SEQ ID NO: 372748 - RNA, 22 nt, Homo sapiens
ugagacaaucucaucucaguga

SEQ ID NO: 372749 - RNA, 22 nt, Homo sapiens
ugagacggagucucacucuguu

SEQ ID NO: 372750 - RNA, 22 nt, Homo sapiens
ugagacggaguuuugcucuugu

SEQ ID NO: 372751 - RNA, 19 nt, Homo sapiens
ugagagcacaacugaacaa

SEQ ID NO: 372752 - RNA, 22 nt, Homo sapiens
ugagaucaagauguuagggacu

SEQ ID NO: 372753 - RNA, 22 nt, Homo sapiens
ugagauggaguuucgcucuugu

SEQ ID NO: 372754 - RNA, 22 nt, Homo sapiens
ugagauggaguuucgcuuuugu

SEQ ID NO: 372755 - RNA, 22 nt, Homo sapiens
ugagauggcuuuauugcugaau

SEQ ID NO: 372756 - RNA, 22 nt, Homo sapiens
ugagcucaguauuucauaaaca

SEQ ID NO: 372757 - RNA, 22 nt, Homo sapiens
ugaguaauguugaucuuugaua

SEQ ID NO: 372758 - RNA, 22 nt, Homo sapiens
ugauaagaaauuguucauguag

SEQ ID NO: 372759 - RNA, 22 nt, Homo sapiens
ugaucugucacuuaucacauuu

SEQ ID NO: 372760 - RNA, 22 nt, Homo sapiens
ugaucuguccaccucagcuucc

SEQ ID NO: 372761 - RNA, 22 nt, Homo sapiens
ugcaagaaucuuucaggcuagc

SEQ ID NO: 372762 - RNA, 22 nt, Homo sapiens
ugcaagcacacccagggauugu

SEQ ID NO: 372763 - RNA, 20 nt, Homo sapiens
ugcaguguccucacuuguca

SEQ ID NO: 372764 - RNA, 22 nt, Homo sapiens
ugcauacacaagcauacaugua

SEQ ID NO: 372765 - RNA, 20 nt, Homo sapiens
ugcugcacuuaagcaugggc

SEQ ID NO: 372766 - RNA, 22 nt, Homo sapiens
uuucagguauuuaagggccguu

SEQ ID NO: 372767 - RNA, 22 nt, Homo sapiens
uuucauagccuuugucgucuga

SEQ ID NO: 372768 - RNA, 22 nt, Homo sapiens
uuucccugaaggcucugaaguc

SEQ ID NO: 372769 - RNA, 22 nt, Homo sapiens
aaaguacucaguucaguuccgu

SEQ ID NO: 372770 - RNA, 22 nt, Homo sapiens
aaagucuagaggaucaugugug

SEQ ID NO: 372771 - RNA, 22 nt, Homo sapiens
aaagugauguccaggcuuucag

SEQ ID NO: 372772 - RNA, 22 nt, Homo sapiens
aaaugcaucauuaggugauuuu

SEQ ID NO: 372773 - RNA, 20 nt, Homo sapiens
aaaugcuguaauguuuggga

SEQ ID NO: 372774 - RNA, 22 nt, Homo sapiens
gaucuguguuuguaugcauaag

SEQ ID NO: 372775 - RNA, 22 nt, Homo sapiens
gauggcacuguagcaacacaaa

SEQ ID NO: 372776 - RNA, 22 nt, Homo sapiens
gcaagaaucugggaguaaaauu

SEQ ID NO: 372777 - RNA, 22 nt, Homo sapiens
gcacccugucaaaauggaccaa

SEQ ID NO: 372778 - RNA, 20 nt, Homo sapiens
gcagcaccauauuucuaaga

SEQ ID NO: 372779 - RNA, 22 nt, Homo sapiens
gcauggccuuuaaaugucacag

SEQ ID NO: 372780 - RNA, 22 nt, Homo sapiens
ggaaugggauuugaagucuggc

SEQ ID NO: 372781 - RNA, 22 nt, Homo sapiens
ggacagugaaugccacuccucc

SEQ ID NO: 372782 - RNA, 22 nt, Homo sapiens
ggaguguguaggagaaagguaa

SEQ ID NO: 372783 - RNA, 22 nt, Homo sapiens
ggcaaggugcuacagacaguga

SEQ ID NO: 372784 - RNA, 23 nt, Homo sapiens
ggcacggaauucaaagaggcauu

SEQ ID NO: 372785 - RNA, 22 nt, Homo sapiens
ggcagcgugcacuuucgccacu

SEQ ID NO: 372786 - RNA, 22 nt, Homo sapiens
ggcagguaaggagugggagccu

SEQ ID NO: 372787 - RNA, 21 nt, Homo sapiens
ggcauugugcccuugcucuag

SEQ ID NO: 372788 - RNA, 19 nt, Homo sapiens
gggaggaugcgucuucagg

SEQ ID NO: 372789 - RNA, 22 nt, Homo sapiens
gggagugucuaaccuguuaaca

SEQ ID NO: 372790 - RNA, 22 nt, Homo sapiens
gggagugugcacacaugguaua

SEQ ID NO: 372791 - RNA, 22 nt, Homo sapiens
gggaugaauuagguauguuuau

SEQ ID NO: 372792 - RNA, 22 nt, Homo sapiens
gguaaacauaagagagcugacu

SEQ ID NO: 372793 - RNA, 22 nt, Homo sapiens
gguaacaguggggcuaugcuua

SEQ ID NO: 372794 - RNA, 22 nt, Homo sapiens
guaaagacacaugcacacguau

SEQ ID NO: 372795 - RNA, 22 nt, Homo sapiens
guaacagucucaacaguggucu

SEQ ID NO: 372796 - RNA, 22 nt, Homo sapiens
guaaugcacucccaaagaucca

SEQ ID NO: 372797 - RNA, 17 nt, Homo sapiens
guacacuucuucuguga

SEQ ID NO: 372798 - RNA, 22 nt, Homo sapiens
guccaaagugggagaggugggg

SEQ ID NO: 372799 - RNA, 22 nt, Homo sapiens
gucuagaacuucugaccuuagg

SEQ ID NO: 372800 - RNA, 22 nt, Homo sapiens
gucuuccagccuccaucuuucu

SEQ ID NO: 372801 - RNA, 22 nt, Homo sapiens
gugaccucuguugcugucacua

SEQ ID NO: 372802 - RNA, 22 nt, Homo sapiens
gugagaggaggcagcuuuuaca

SEQ ID NO: 372803 - RNA, 22 nt, Homo sapiens
gugagauccucucuuauauggg

SEQ ID NO: 372804 - RNA, 22 nt, Homo sapiens
gugagaugaggucucacucugu

SEQ ID NO: 372805 - RNA, 22 nt, Homo sapiens
gugagaugugacuucugccucu

SEQ ID NO: 372806 - RNA, 22 nt, Homo sapiens
gugcaaacuccaggucucuuca

SEQ ID NO: 372807 - RNA, 22 nt, Homo sapiens
guggcaagaugacuacucacug

SEQ ID NO: 372808 - RNA, 22 nt, Homo sapiens
guguaaaucugcugugaacauu

SEQ ID NO: 372809 - RNA, 22 nt, Homo sapiens
guguaauaaucguggacuaugu

SEQ ID NO: 372810 - RNA, 21 nt, Homo sapiens
gugucacagacaugacagaug

SEQ ID NO: 372811 - RNA, 22 nt, Homo sapiens
gugugcaaauguguaccuacau

SEQ ID NO: 372812 - RNA, 22 nt, Homo sapiens
gugugcauaugucuuuauagua

SEQ ID NO: 372813 - RNA, 22 nt, Homo sapiens
gugugcaugucuuuuuaguagg

SEQ ID NO: 372814 - RNA, 20 nt, Homo sapiens
guucacaggcuuccuuucag

SEQ ID NO: 372815 - RNA, 20 nt, Homo sapiens
guucccuguaggugugcgga

SEQ ID NO: 372816 - RNA, 22 nt, Homo sapiens
uaaaccuagcauuuugcauaug

SEQ ID NO: 372817 - RNA, 22 nt, Homo sapiens
uaaacugcuugaaaugguguca

SEQ ID NO: 372818 - RNA, 22 nt, Homo sapiens
uaaagccuagaacuuucagccc

SEQ ID NO: 372819 - RNA, 22 nt, Homo sapiens
uaaauggauauugccaucuccu

SEQ ID NO: 372820 - RNA, 22 nt, Homo sapiens
uaaauugcauaaguacaaauga

SEQ ID NO: 372821 - RNA, 22 nt, Homo sapiens
uaacacccuucuccagguacau

SEQ ID NO: 372822 - RNA, 22 nt, Homo sapiens
uaagaauucuguccgguauacu

SEQ ID NO: 372823 - RNA, 23 nt, Homo sapiens
uaagacacuaacuuuaugcuuug

SEQ ID NO: 372824 - RNA, 22 nt, Homo sapiens
uaagacugccccagacagcaag

SEQ ID NO: 372825 - RNA, 20 nt, Homo sapiens
uaagugcuugagacuucuga

SEQ ID NO: 372826 - RNA, 22 nt, Homo sapiens
uaauacauucaaggugguaguu

SEQ ID NO: 372827 - RNA, 22 nt, Homo sapiens
uacaacacugguucgacaugug

SEQ ID NO: 372828 - RNA, 22 nt, Homo sapiens
uacaggcagguguucccugguu

SEQ ID NO: 372829 - RNA, 19 nt, Homo sapiens
uacccagaagcagcauugu

SEQ ID NO: 372830 - RNA, 22 nt, Homo sapiens
uacugcaucuacuuagagccag

SEQ ID NO: 372831 - RNA, 21 nt, Homo sapiens
uagcagcguuguugcaaaugu

SEQ ID NO: 372832 - RNA, 22 nt, Homo sapiens
uaggaaguuucuugauuacuua

SEQ ID NO: 372833 - RNA, 22 nt, Homo sapiens
uagggcuugugaucagguguag

SEQ ID NO: 372834 - RNA, 22 nt, Homo sapiens
uaguaacacauugaacgaucgc

SEQ ID NO: 372835 - RNA, 22 nt, Homo sapiens
uagugcaguggcuccaucucag

SEQ ID NO: 372836 - RNA, 22 nt, Homo sapiens
uagugcugugauaaacauauau

SEQ ID NO: 372837 - RNA, 22 nt, Homo sapiens
uauacagcaaguuacugugcug

SEQ ID NO: 372838 - RNA, 22 nt, Homo sapiens
uaucacccuuucauuguucuuc

SEQ ID NO: 372839 - RNA, 22 nt, Homo sapiens
uauggcauuauuuugauagaca

SEQ ID NO: 372840 - RNA, 22 nt, Homo sapiens
uauggcauuguuggugaugaua

SEQ ID NO: 372841 - RNA, 22 nt, Homo sapiens
uauggcccuuaaguauugguug

SEQ ID NO: 372842 - RNA, 20 nt, Homo sapiens
uauuacagaguaauggugga

SEQ ID NO: 372843 - RNA, 22 nt, Homo sapiens
uauugaacgugggauauugaag

SEQ ID NO: 372844 - RNA, 22 nt, Homo sapiens
uauugcagauacccaggaaguu

SEQ ID NO: 372845 - RNA, 22 nt, Homo sapiens
uauuuggauagucuggaaaaaa

SEQ ID NO: 372846 - RNA, 20 nt, Homo sapiens
ucaaaguaugcucugcacua

SEQ ID NO: 372847 - RNA, 16 nt, Homo sapiens
ucacaaacucuagcag

SEQ ID NO: 372848 - RNA, 22 nt, Homo sapiens
ucacaaagcuuggccugcuucu

SEQ ID NO: 372849 - RNA, 20 nt, Homo sapiens
ucacccugacaucugcccag

SEQ ID NO: 372850 - RNA, 22 nt, Homo sapiens
ucacgugguucauaaggcagaa

SEQ ID NO: 372851 - RNA, 22 nt, Homo sapiens
ucacugcgaccuccaccucccg

SEQ ID NO: 372852 - RNA, 22 nt, Homo sapiens
ucacugcgaccuccaccuccug

SEQ ID NO: 372853 - RNA, 22 nt, Homo sapiens
ucacugcgaccucugccucccg

SEQ ID NO: 372854 - RNA, 22 nt, Homo sapiens
ucagcagugagagaccucaccc

SEQ ID NO: 372855 - RNA, 22 nt, Homo sapiens
ucaggcaccuuccucuuaucug

SEQ ID NO: 372856 - RNA, 22 nt, Homo sapiens
uucaaauguucuuucaccaccc

SEQ ID NO: 372857 - RNA, 22 nt, Homo sapiens
uucaagcuauggugaucuuuuc

SEQ ID NO: 372858 - RNA, 22 nt, Homo sapiens
uucaagcugggcaaauaagggg

SEQ ID NO: 372859 - RNA, 22 nt, Homo sapiens
uucacagaaaaaggcgaugagg

SEQ ID NO: 372860 - RNA, 22 nt, Homo sapiens
uucacuggagcccaggaguugg

SEQ ID NO: 372861 - RNA, 21 nt, Homo sapiens
uucacuggucuauuucccuuu

SEQ ID NO: 372862 - RNA, 19 nt, Homo sapiens
uucagcagugucugcucuu

SEQ ID NO: 372863 - RNA, 21 nt, Homo sapiens
uucucaggguguguccuaccc

SEQ ID NO: 372864 - RNA, 22 nt, Homo sapiens
uucugcacaucgaucacaagau

SEQ ID NO: 372865 - RNA, 22 nt, Homo sapiens
uucugcuagucugucagaucuu

SEQ ID NO: 372866 - RNA, 22 nt, Homo sapiens
uucugugguuucauuuaccugu

SEQ ID NO: 372867 - RNA, 22 nt, Homo sapiens
uucuuuggaaacaguacuaauu

SEQ ID NO: 372868 - RNA, 22 nt, Homo sapiens
uucuuugguacaagggccgacc

SEQ ID NO: 372869 - RNA, 22 nt, Homo sapiens
uugaaguagaaagacgaaauuu

SEQ ID NO: 372870 - RNA, 23 nt, Homo sapiens
uugaauguuuccccucccaaauu

SEQ ID NO: 372871 - RNA, 22 nt, Homo sapiens
uugagaucuugauauguuugaa

SEQ ID NO: 372872 - RNA, 22 nt, Homo sapiens
uugcacuguaauuuauuuaugu

SEQ ID NO: 372873 - RNA, 22 nt, Homo sapiens
uugcagaucccacacucacccu

SEQ ID NO: 372874 - RNA, 22 nt, Homo sapiens
uugcauaauaagagggauacgu

SEQ ID NO: 372875 - RNA, 22 nt, Homo sapiens
uugcauguacguacagagagag

SEQ ID NO: 372876 - RNA, 22 nt, Homo sapiens
uuggaauguauggcaucuugcg

SEQ ID NO: 372877 - RNA, 22 nt, Homo sapiens
uuggagagaaaggcaguuccug

SEQ ID NO: 372878 - RNA, 22 nt, Homo sapiens
uuggauaguuuaugaaaaaugg

SEQ ID NO: 372879 - RNA, 22 nt, Homo sapiens
uuggcagaauguuagaaacuua

SEQ ID NO: 372880 - RNA, 22 nt, Homo sapiens
uuggucaggagccucccucuuu

SEQ ID NO: 372881 - RNA, 22 nt, Homo sapiens
uugguuaucaucauuucagcaa

SEQ ID NO: 372882 - RNA, 22 nt, Homo sapiens
uuguauguuucugugcacauga

SEQ ID NO: 372883 - RNA, 19 nt, Homo sapiens
uugugggaggacagagggg

SEQ ID NO: 372884 - RNA, 17 nt, Homo sapiens
uuguucccauuaaaaag

SEQ ID NO: 372885 - RNA, 22 nt, Homo sapiens
uuucuauguugaccagucuaga

SEQ ID NO: 372886 - RNA, 22 nt, Homo sapiens
uuuggacuucuagccuccagag

SEQ ID NO: 372887 - RNA, 22 nt, Homo sapiens
uuuggcauuagagagacuugca

SEQ ID NO: 372888 - RNA, 22 nt, Homo sapiens
uuuggucagcugcgggucagcu

SEQ ID NO: 372889 - RNA, 22 nt, Homo sapiens
uuugguugucacaacuggggga

SEQ ID NO: 372890 - RNA, 22 nt, Homo sapiens
uuuguucaccucaaggauggga

SEQ ID NO: 372891 - RNA, 18 nt, Homo sapiens
aaaaagugcucaggccua

SEQ ID NO: 372892 - RNA, 22 nt, Homo sapiens
aaaagucuguagugaaagguga

SEQ ID NO: 372893 - RNA, 22 nt, Homo sapiens
aaagucuguuacagcuauuucu

SEQ ID NO: 372894 - RNA, 22 nt, Homo sapiens
aaagugaauguaucccguaagu

SEQ ID NO: 372895 - RNA, 22 nt, Homo sapiens
aaagugauguccaggcuuucag

SEQ ID NO: 372896 - RNA, 22 nt, Homo sapiens
aaagugcugagucuaggcgggg

SEQ ID NO: 372897 - RNA, 22 nt, Homo sapiens
aaagugcugggauuggcugggc

SEQ ID NO: 372898 - RNA, 22 nt, Homo sapiens
aaagugcugggauuuuaggcau

SEQ ID NO: 372899 - RNA, 22 nt, Homo sapiens
aaaugccucccauucuacugac

SEQ ID NO: 372900 - RNA, 22 nt, Homo sapiens
aaauugcuuuugaagacuuagu

SEQ ID NO: 372901 - RNA, 22 nt, Homo sapiens
aacaccauucucuguaacaaga

SEQ ID NO: 372902 - RNA, 22 nt, Homo sapiens
aacacuaucugccuuacaggga

SEQ ID NO: 372903 - RNA, 22 nt, Homo sapiens
aacugguauuucccaugaauuu

SEQ ID NO: 372904 - RNA, 23 nt, Homo sapiens
aagagguaugacuaugaagugga

SEQ ID NO: 372905 - RNA, 22 nt, Homo sapiens
aagaguuaguaaaauuuccucu

SEQ ID NO: 372906 - RNA, 22 nt, Homo sapiens
aagcuacauuuuauuuauguca

SEQ ID NO: 372907 - RNA, 22 nt, Homo sapiens
aaguaaauauccgguaguccca

SEQ ID NO: 372908 - RNA, 21 nt, Homo sapiens
aauacucuagguuaagagagc

SEQ ID NO: 372909 - RNA, 22 nt, Homo sapiens
aaucacauugaaucugcuaccu

SEQ ID NO: 372910 - RNA, 22 nt, Homo sapiens
aauggcaagagccacagaggcg

SEQ ID NO: 372911 - RNA, 22 nt, Homo sapiens
aauugcaccaucuagaucaaga

SEQ ID NO: 372912 - RNA, 22 nt, Homo sapiens
aauugcacuacugcacucccac

SEQ ID NO: 372913 - RNA, 22 nt, Homo sapiens
aauugcacuggaaguaacugag

SEQ ID NO: 372914 - RNA, 22 nt, Homo sapiens
acaagacuucuuguauucuagu

SEQ ID NO: 372915 - RNA, 22 nt, Homo sapiens
acaccaugucuguuucugguuu

SEQ ID NO: 372916 - RNA, 22 nt, Homo sapiens
acccugucauccacauggugcu

SEQ ID NO: 372917 - RNA, 22 nt, Homo sapiens
accugagacuaggcauuuuaua

SEQ ID NO: 372918 - RNA, 22 nt, Homo sapiens
acugagacugagaauguuucuu

SEQ ID NO: 372919 - RNA, 18 nt, Homo sapiens
acugcacuccaccuuggg

SEQ ID NO: 372920 - RNA, 22 nt, Homo sapiens
acugcacuccagccuccugggu

SEQ ID NO: 372921 - RNA, 22 nt, Homo sapiens
acugcacuccagccuuggcaac

SEQ ID NO: 372922 - RNA, 22 nt, Homo sapiens
acugcacuccagccuuggccac

SEQ ID NO: 372923 - RNA, 22 nt, Homo sapiens
acugcacuccggccuggcaaca

SEQ ID NO: 372924 - RNA, 22 nt, Homo sapiens
acugcacucuagccuuggcaac

SEQ ID NO: 372925 - RNA, 22 nt, Homo sapiens
agcauuaguugugaagccuuua

SEQ ID NO: 372926 - RNA, 23 nt, Homo sapiens
aggaauggaaaaccaaguaucau

SEQ ID NO: 372927 - RNA, 22 nt, Homo sapiens
aggacacugauguaugcugugg

SEQ ID NO: 372928 - RNA, 22 nt, Homo sapiens
aggaucauugacuauuauaagg

SEQ ID NO: 372929 - RNA, 22 nt, Homo sapiens
aguaacaggauccaaagaaugu

SEQ ID NO: 372930 - RNA, 20 nt, Homo sapiens
aguauucacuuuuuucaugg

SEQ ID NO: 372931 - RNA, 22 nt, Homo sapiens
aguauugcuaauaagagauuug

SEQ ID NO: 372932 - RNA, 22 nt, Homo sapiens
aguggaauuaagaaacugaauu

SEQ ID NO: 372933 - RNA, 22 nt, Homo sapiens
aguggcaaugugauguccugaa

SEQ ID NO: 372934 - RNA, 22 nt, Homo sapiens
auaaaugccuguuguuuuaagc

SEQ ID NO: 372935 - RNA, 22 nt, Homo sapiens
auaacucuguuuuuuucaugca

SEQ ID NO: 372936 - RNA, 22 nt, Homo sapiens
auacaguugccauuucuugugc

SEQ ID NO: 372937 - RNA, 22 nt, Homo sapiens
auacuguacugaaguacccauu

SEQ ID NO: 372938 - RNA, 22 nt, Homo sapiens
auacuguuuuacaucauugccu

SEQ ID NO: 372939 - RNA, 22 nt, Homo sapiens
auaugcuuauuagcaagaaaua

SEQ ID NO: 372940 - RNA, 17 nt, Homo sapiens
auaugucugcuggggga

SEQ ID NO: 372941 - RNA, 22 nt, Homo sapiens
auaugucuuaguuaccuugggc

SEQ ID NO: 372942 - RNA, 22 nt, Homo sapiens
aucaaaguuucccagaaguugu

SEQ ID NO: 372943 - RNA, 22 nt, Homo sapiens
aucacuguaaguuuacacuuug

SEQ ID NO: 372944 - RNA, 22 nt, Homo sapiens
auccaucagacggcaggcguug

SEQ ID NO: 372945 - RNA, 22 nt, Homo sapiens
aucccagaaacucggguuucuc

SEQ ID NO: 372946 - RNA, 22 nt, Homo sapiens
agacacuguugaaaaggcccca

SEQ ID NO: 372947 - RNA, 22 nt, Homo sapiens
agagugaagcuuuuuauauucu

SEQ ID NO: 372948 - RNA, 22 nt, Homo sapiens
agcagguguccacaauguuugc

SEQ ID NO: 372949 - RNA, 22 nt, Homo sapiens
agcaguguggccuuagacccgg

SEQ ID NO: 372950 - RNA, 22 nt, Homo sapiens
agcgccacugcacuccagccug

SEQ ID NO: 372951 - RNA, 21 nt, Homo sapiens
aggauaguagauuaaauauuu

SEQ ID NO: 372952 - RNA, 22 nt, Homo sapiens
aggcaugauuguauuuugcucu

SEQ ID NO: 372953 - RNA, 22 nt, Homo sapiens
agucacagugaccuugucugac

SEQ ID NO: 372954 - RNA, 22 nt, Homo sapiens
agugccaaaucgagggcucuga

SEQ ID NO: 372955 - RNA, 22 nt, Homo sapiens
auaaagacacuuggcaugauuu

SEQ ID NO: 372956 - RNA, 22 nt, Homo sapiens
auaaaugcuuagaucuguauau

SEQ ID NO: 372957 - RNA, 19 nt, Homo sapiens
auacacguguauacauaca

SEQ ID NO: 372958 - RNA, 20 nt, Homo sapiens
auaugcagacacauacauac

SEQ ID NO: 372959 - RNA, 22 nt, Homo sapiens
auauguauuuuaacguguaagg

SEQ ID NO: 372960 - RNA, 22 nt, Homo sapiens
augagauaaaccaucucuuaag

SEQ ID NO: 372961 - RNA, 22 nt, Homo sapiens
auggcuauuccauaggcagagc

SEQ ID NO: 372962 - RNA, 22 nt, Homo sapiens
augguuuauuuguaagcagagu

SEQ ID NO: 372963 - RNA, 22 nt, Homo sapiens
auguagugugauuuucacuaga

SEQ ID NO: 372964 - RNA, 22 nt, Homo sapiens
auguauacaugcaggucacagg

SEQ ID NO: 372965 - RNA, 22 nt, Homo sapiens
auuaagugcuugccagugcugg

SEQ ID NO: 372966 - RNA, 22 nt, Homo sapiens
auuccauuuguuaucacacccg

SEQ ID NO: 372967 - RNA, 22 nt, Homo sapiens
auucccuuagcugccucagccu

SEQ ID NO: 372968 - RNA, 22 nt, Homo sapiens
auugcaaagcguagacucuaaa

SEQ ID NO: 372969 - RNA, 21 nt, Homo sapiens
auugcacaauauacccaugua

SEQ ID NO: 372970 - RNA, 18 nt, Homo sapiens
auugcacaccagccuggg

SEQ ID NO: 372971 - RNA, 22 nt, Homo sapiens
auugcacaccagucugggcaaa

SEQ ID NO: 372972 - RNA, 22 nt, Homo sapiens
auugcacaucugcacuacagcc

SEQ ID NO: 372973 - RNA, 22 nt, Homo sapiens
auugcagcccacccugggugau

SEQ ID NO: 372974 - RNA, 22 nt, Homo sapiens
auuuggguaaugagugcaaggg

SEQ ID NO: 372975 - RNA, 22 nt, Homo sapiens
caaaagugguucuuauccuuuu

SEQ ID NO: 372976 - RNA, 22 nt, Homo sapiens
caaagucuauucuacccuuacc

SEQ ID NO: 372977 - RNA, 22 nt, Homo sapiens
caagugcucuaggauccugagu

SEQ ID NO: 372978 - RNA, 22 nt, Homo sapiens
caagugcuugaugaaugaucaa

SEQ ID NO: 372979 - RNA, 22 nt, Homo sapiens
caauggcacgaucucgucucac

SEQ ID NO: 372980 - RNA, 22 nt, Homo sapiens
cacauugcaggaaaguucauua

SEQ ID NO: 372981 - RNA, 22 nt, Homo sapiens
cacugcacuccagucccgucuc

SEQ ID NO: 372982 - RNA, 22 nt, Homo sapiens
cagagguaagcaagucagcauu

SEQ ID NO: 372983 - RNA, 22 nt, Homo sapiens
cagccgggugagguggcuuguu

SEQ ID NO: 372984 - RNA, 21 nt, Homo sapiens
caugucacugcacucuagccu

SEQ ID NO: 372985 - RNA, 22 nt, Homo sapiens
caugucuuuuauucugugugau

SEQ ID NO: 372986 - RNA, 22 nt, Homo sapiens
cauugcacuccaccuuggguaa

SEQ ID NO: 372987 - RNA, 22 nt, Homo sapiens
cauugcacuccagccugcacga

SEQ ID NO: 372988 - RNA, 22 nt, Homo sapiens
cauugcacuccagcucugggcg

SEQ ID NO: 372989 - RNA, 22 nt, Homo sapiens
cauugcacucuaucccgguggg

SEQ ID NO: 372990 - RNA, 22 nt, Homo sapiens
cauugcacucugcauuccaguc

SEQ ID NO: 372991 - RNA, 22 nt, Homo sapiens
cauugcacugcauucugggcaa

SEQ ID NO: 372992 - RNA, 22 nt, Homo sapiens
ccauggcaauggucagucuauu

SEQ ID NO: 372993 - RNA, 17 nt, Homo sapiens
cccuaguagcugggacu

SEQ ID NO: 372994 - RNA, 22 nt, Homo sapiens
cccugagaaaacuuuguccuua

SEQ ID NO: 372995 - RNA, 22 nt, Homo sapiens
cccugagaugcuguuaaucugu

SEQ ID NO: 372996 - RNA, 22 nt, Homo sapiens
cccugagaugugaauuucagag

SEQ ID NO: 372997 - RNA, 22 nt, Homo sapiens
ccugagacuugagggggcuucu

SEQ ID NO: 372998 - RNA, 22 nt, Homo sapiens
ccugagaucauacuguuaguaa

SEQ ID NO: 372999 - RNA, 22 nt, Homo sapiens
ccuguguuaugguuucuaaugu

SEQ ID NO: 373000 - RNA, 18 nt, Homo sapiens
ccuuaguuauagagaguc

SEQ ID NO: 373001 - RNA, 22 nt, Homo sapiens
ccuuggcaauggcuggggcuga

SEQ ID NO: 373002 - RNA, 22 nt, Homo sapiens
cucauugcaaucuccaccuccc

SEQ ID NO: 373003 - RNA, 22 nt, Homo sapiens
cucccagagccaguuauaggcu

SEQ ID NO: 373004 - RNA, 22 nt, Homo sapiens
cucucaagaugcugggauuaca

SEQ ID NO: 373005 - RNA, 22 nt, Homo sapiens
cugcaguaaccacuguaggugu

SEQ ID NO: 373006 - RNA, 22 nt, Homo sapiens
cuggaauguuccuaaagauuca

SEQ ID NO: 373007 - RNA, 22 nt, Homo sapiens
cuggaguaugaaccauguauca

SEQ ID NO: 373008 - RNA, 22 nt, Homo sapiens
cuggugauugguuucauucagu

SEQ ID NO: 373009 - RNA, 22 nt, Homo sapiens
cuguaugugagaaauaauaagu

SEQ ID NO: 373010 - RNA, 22 nt, Homo sapiens
cuucaugucuucaauggggggg

SEQ ID NO: 373011 - RNA, 22 nt, Homo sapiens
cuugcacuccacuguucuccug

SEQ ID NO: 373012 - RNA, 22 nt, Homo sapiens
cuuugguguauuuucagagacc

SEQ ID NO: 373013 - RNA, 22 nt, Homo sapiens
gaaucacaguuauuagagcagc

SEQ ID NO: 373014 - RNA, 22 nt, Homo sapiens
gaaucacugugguaucccaugc

SEQ ID NO: 373015 - RNA, 22 nt, Homo sapiens
gacacugucuucugcucuuaaa

SEQ ID NO: 373016 - RNA, 21 nt, Homo sapiens
gacauggcgauacuccgucuc

SEQ ID NO: 373017 - RNA, 22 nt, Homo sapiens
gagacggagucucgcucuguca

SEQ ID NO: 373018 - RNA, 22 nt, Homo sapiens
gagagguaguuuuuuggucguc

SEQ ID NO: 373019 - RNA, 22 nt, Homo sapiens
gagauacuugguuucuguuucu

SEQ ID NO: 373020 - RNA, 22 nt, Homo sapiens
gagauauucugguuuacuaaau

SEQ ID NO: 373021 - RNA, 22 nt, Homo sapiens
gagguaucauuauguugcccag

SEQ ID NO: 373022 - RNA, 22 nt, Homo sapiens
gaguuagguugucaaugucuua

SEQ ID NO: 373023 - RNA, 22 nt, Homo sapiens
gauggcacuaagccauguagga

SEQ ID NO: 373024 - RNA, 22 nt, Homo sapiens
gauuuuccaguggcccugauca

SEQ ID NO: 373025 - RNA, 22 nt, Homo sapiens
gcagaauugguuucuucuaagg

SEQ ID NO: 373026 - RNA, 22 nt, Homo sapiens
gcaguggugugugccagccuag

SEQ ID NO: 373027 - RNA, 22 nt, Homo sapiens
gccugagaggauaugauccccu

SEQ ID NO: 373028 - RNA, 22 nt, Homo sapiens
gcugagaucucuugccugaacu

SEQ ID NO: 373029 - RNA, 23 nt, Homo sapiens
ggcaagaucucagcucacugcaa

SEQ ID NO: 373030 - RNA, 22 nt, Homo sapiens
ggcacuguggcucaagccugua

SEQ ID NO: 373031 - RNA, 22 nt, Homo sapiens
ggcagcaugggugccuuuguga

SEQ ID NO: 373032 - RNA, 22 nt, Homo sapiens
ggcagcauugccuuugcaguga

SEQ ID NO: 373033 - RNA, 22 nt, Homo sapiens
ggcuuggaggaaugugagggcu

SEQ ID NO: 373034 - RNA, 22 nt, Homo sapiens
gggaucaacuuauacuaaaauu

SEQ ID NO: 373035 - RNA, 22 nt, Homo sapiens
ggguucaaaucuuggcucuuac

SEQ ID NO: 373036 - RNA, 22 nt, Homo sapiens
guagugcaguuugagaaucagu

SEQ ID NO: 373037 - RNA, 22 nt, Homo sapiens
guauggguuuuguuucuucugg

SEQ ID NO: 373038 - RNA, 22 nt, Homo sapiens
guaugucuuuauagcagugugg

SEQ ID NO: 373039 - RNA, 22 nt, Homo sapiens
gucacuggcugucuuguaugau

SEQ ID NO: 373040 - RNA, 22 nt, Homo sapiens
gucaugucugcacauaguaaaa

SEQ ID NO: 373041 - RNA, 22 nt, Homo sapiens
gugaggcacugcugcuuuccag

SEQ ID NO: 373042 - RNA, 22 nt, Homo sapiens
gugagguacgugucaagaacca

SEQ ID NO: 373043 - RNA, 20 nt, Homo sapiens
gugagguagaggguuaccug

SEQ ID NO: 373044 - RNA, 17 nt, Homo sapiens
gugagguauccucaaaa

SEQ ID NO: 373045 - RNA, 22 nt, Homo sapiens
gugccacugcaccuggccuaag

SEQ ID NO: 373046 - RNA, 22 nt, Homo sapiens
guggaagaaaucagguuauuug

SEQ ID NO: 373047 - RNA, 22 nt, Homo sapiens
guggaagaccagacuuuccaac

SEQ ID NO: 373048 - RNA, 22 nt, Homo sapiens
guucaagugauagcugggauua

SEQ ID NO: 373049 - RNA, 21 nt, Homo sapiens
guucaagugauccuccugucu

SEQ ID NO: 373050 - RNA, 22 nt, Homo sapiens
guucaaguuuucucuugugggu

SEQ ID NO: 373051 - RNA, 22 nt, Homo sapiens
guuggcaaguggcugagcuggg

SEQ ID NO: 373052 - RNA, 22 nt, Homo sapiens
uaaaagucaucacaacuggagu

SEQ ID NO: 373053 - RNA, 22 nt, Homo sapiens
uaaacugucuugcaguuacaug

SEQ ID NO: 373054 - RNA, 22 nt, Homo sapiens
uaaagugaggauggcaguaggu

SEQ ID NO: 373055 - RNA, 22 nt, Homo sapiens
uaagguccuuaaauguguaacc

SEQ ID NO: 373056 - RNA, 22 nt, Homo sapiens
uaaguagaggaaucauuuugug

SEQ ID NO: 373057 - RNA, 20 nt, Homo sapiens
uaagugcuuuauauugauua

SEQ ID NO: 373058 - RNA, 22 nt, Homo sapiens
uaaucacagagguuuggccuca

SEQ ID NO: 373059 - RNA, 22 nt, Homo sapiens
uaauucacauaaagcacuuaga

SEQ ID NO: 373060 - RNA, 19 nt, Homo sapiens
uacauaguauuuaguggca

SEQ ID NO: 373061 - RNA, 22 nt, Homo sapiens
uagagguagguguaugaacuag

SEQ ID NO: 373062 - RNA, 22 nt, Homo sapiens
uagagguauaccaaaaaggcau

SEQ ID NO: 373063 - RNA, 22 nt, Homo sapiens
uagagguauguauaguauucuu

SEQ ID NO: 373064 - RNA, 22 nt, Homo sapiens
uagcagaauauaccucuuacuu

SEQ ID NO: 373065 - RNA, 22 nt, Homo sapiens
uagcagguguuccacaaauauu

SEQ ID NO: 373066 - RNA, 22 nt, Homo sapiens
uaggugaaugcuggaagaaaug

SEQ ID NO: 373067 - RNA, 22 nt, Homo sapiens
uaguuauggaguaauuuuaagc

SEQ ID NO: 373068 - RNA, 22 nt, Homo sapiens
uaucacagaggguauccuagag

SEQ ID NO: 373069 - RNA, 22 nt, Homo sapiens
uaucacagcauugucuauaaua

SEQ ID NO: 373070 - RNA, 22 nt, Homo sapiens
uaucaugucuguguguaccuag

SEQ ID NO: 373071 - RNA, 19 nt, Homo sapiens
uaugcuauuuauuagaagu

SEQ ID NO: 373072 - RNA, 22 nt, Homo sapiens
uaugucaugggguuuuugagau

SEQ ID NO: 373073 - RNA, 22 nt, Homo sapiens
uauugcacgccagccugagcaa

SEQ ID NO: 373074 - RNA, 22 nt, Homo sapiens
uauugcacuuuuccauaggagu

SEQ ID NO: 373075 - RNA, 22 nt, Homo sapiens
uauuguacauguuauagauuuu

SEQ ID NO: 373076 - RNA, 22 nt, Homo sapiens
ucacaugggugcaauauaauca

SEQ ID NO: 373077 - RNA, 22 nt, Homo sapiens
ucacugaaaccacugccuccug

SEQ ID NO: 373078 - RNA, 22 nt, Homo sapiens
ucacugagaaugauguuucuga

SEQ ID NO: 373079 - RNA, 21 nt, Homo sapiens
ucacugagcaucaugguuuca

SEQ ID NO: 373080 - RNA, 20 nt, Homo sapiens
ucacugugaacuucuugagg

SEQ ID NO: 373081 - RNA, 22 nt, Homo sapiens
ucacuguguauguauaugcagg

SEQ ID NO: 373082 - RNA, 23 nt, Homo sapiens
ucaguacuccacuuucaauagug

SEQ ID NO: 373083 - RNA, 22 nt, Homo sapiens
ucauacaguaguccucacuugu

SEQ ID NO: 373084 - RNA, 19 nt, Homo sapiens
ucauagucuaagaugagaa

SEQ ID NO: 373085 - RNA, 22 nt, Homo sapiens
ucaucaggcucauucaagcuga

SEQ ID NO: 373086 - RNA, 22 nt, Homo sapiens
ucauggcacugaugagaguuuc

SEQ ID NO: 373087 - RNA, 22 nt, Homo sapiens
ucaugucuuguuguauuuauuu

SEQ ID NO: 373088 - RNA, 22 nt, Homo sapiens
ucauucauucauccagcuugag

SEQ ID NO: 373089 - RNA, 22 nt, Homo sapiens
ucauugcaaucucugccucccg

SEQ ID NO: 373090 - RNA, 22 nt, Homo sapiens
ucccauguagcuaggauuacag

SEQ ID NO: 373091 - RNA, 22 nt, Homo sapiens
uccugagaauagaguugcaugu

SEQ ID NO: 373092 - RNA, 22 nt, Homo sapiens
ucggcucagugcaagcucugcc

SEQ ID NO: 373093 - RNA, 22 nt, Homo sapiens
ucucuguuugucuguuacuggu

SEQ ID NO: 373094 - RNA, 22 nt, Homo sapiens
ucugccuuuucaugugggaugg

SEQ ID NO: 373095 - RNA, 18 nt, Homo sapiens
ucuggcuucuuuguucca

SEQ ID NO: 373096 - RNA, 22 nt, Homo sapiens
ucugucuugugguuugagugcc

SEQ ID NO: 373097 - RNA, 22 nt, Homo sapiens
guaaucucagcuacuugggagu

SEQ ID NO: 373098 - RNA, 22 nt, Homo sapiens
guaaucucagcuucuugggagg

SEQ ID NO: 373099 - RNA, 22 nt, Homo sapiens
gucacauugaugcccauggugg

SEQ ID NO: 373100 - RNA, 22 nt, Homo sapiens
gucaggcaccgauacaguuuuu

SEQ ID NO: 373101 - RNA, 22 nt, Homo sapiens
gucagugugauaucugcagggg

SEQ ID NO: 373102 - RNA, 22 nt, Homo sapiens
gugaaaagaugagcaccauaca

SEQ ID NO: 373103 - RNA, 22 nt, Homo sapiens
gugcacauauggugcauaagug

SEQ ID NO: 373104 - RNA, 22 nt, Homo sapiens
gugcacaugguagguauugagu

SEQ ID NO: 373105 - RNA, 20 nt, Homo sapiens
guggaagauaaguagccuga

SEQ ID NO: 373106 - RNA, 22 nt, Homo sapiens
gugucccagugugcauacaggu

SEQ ID NO: 373107 - RNA, 22 nt, Homo sapiens
gugucuccugccuucaugcagc

SEQ ID NO: 373108 - RNA, 22 nt, Homo sapiens
uaaagcuuagauccaugguggc

SEQ ID NO: 373109 - RNA, 21 nt, Homo sapiens
uaaagcuuagcuauaguggcu

SEQ ID NO: 373110 - RNA, 18 nt, Homo sapiens
uaaauugcuucaccugag

SEQ ID NO: 373111 - RNA, 21 nt, Homo sapiens
uaacagcuccacuccauucuc

SEQ ID NO: 373112 - RNA, 22 nt, Homo sapiens
uaacaggcaaggucacaccuug

SEQ ID NO: 373113 - RNA, 22 nt, Homo sapiens
uaacauuguugauuauacuaag

SEQ ID NO: 373114 - RNA, 22 nt, Homo sapiens
uaagugaauguuggcuacugaa

SEQ ID NO: 373115 - RNA, 22 nt, Homo sapiens
uaagugaauuucacuacugagu

SEQ ID NO: 373116 - RNA, 22 nt, Homo sapiens
uaagugcuguguuguuaccuaa

SEQ ID NO: 373117 - RNA, 18 nt, Homo sapiens
uaagugcuuuaaacacau

SEQ ID NO: 373118 - RNA, 22 nt, Homo sapiens
uacagucacauuccugaccaua

SEQ ID NO: 373119 - RNA, 22 nt, Homo sapiens
uacucuuuagcuccuuaaggaa

SEQ ID NO: 373120 - RNA, 22 nt, Homo sapiens
uagacacugcauauuuuuuuaa

SEQ ID NO: 373121 - RNA, 22 nt, Homo sapiens
uagagguagagugacuucccca

SEQ ID NO: 373122 - RNA, 22 nt, Homo sapiens
uaggaaguuucuugauuacuua

SEQ ID NO: 373123 - RNA, 22 nt, Homo sapiens
uagucacacacucaacuuuuca

SEQ ID NO: 373124 - RNA, 22 nt, Homo sapiens
uauacugucuuuguaugccuag

SEQ ID NO: 373125 - RNA, 21 nt, Homo sapiens
uaucagagacauugagaggca

SEQ ID NO: 373126 - RNA, 22 nt, Homo sapiens
uaucagagcugucagccuaccu

SEQ ID NO: 373127 - RNA, 22 nt, Homo sapiens
uaucagcagagucauacuucaa

SEQ ID NO: 373128 - RNA, 22 nt, Homo sapiens
uaugucuucuuuagagaaaugu

SEQ ID NO: 373129 - RNA, 22 nt, Homo sapiens
uaugugcaaauuaauugcuaga

SEQ ID NO: 373130 - RNA, 22 nt, Homo sapiens
uauugcacuccagccuuggcaa

SEQ ID NO: 373131 - RNA, 22 nt, Homo sapiens
ucaagcaauucuccucucagcc

SEQ ID NO: 373132 - RNA, 22 nt, Homo sapiens
ucaagcaauucugcugccucag

SEQ ID NO: 373133 - RNA, 20 nt, Homo sapiens
ucaaggcacgaauaaaaguu

SEQ ID NO: 373134 - RNA, 18 nt, Homo sapiens
ucacaaccacagugcugu

SEQ ID NO: 373135 - RNA, 22 nt, Homo sapiens
ucacugaggucugagcuuuaug

SEQ ID NO: 373136 - RNA, 22 nt, Homo sapiens
ucacugugguuuugaugugcau

SEQ ID NO: 373137 - RNA, 22 nt, Homo sapiens
ucacugugugucucuguaucug

SEQ ID NO: 373138 - RNA, 22 nt, Homo sapiens
ucacuguugaugggcaugcagg

SEQ ID NO: 373139 - RNA, 22 nt, Homo sapiens
ucagacacugcccuccaccugu

SEQ ID NO: 373140 - RNA, 22 nt, Homo sapiens
ucaugugaggauaacaauagug

SEQ ID NO: 373141 - RNA, 22 nt, Homo sapiens
ucauucauuugcucacuccaca

SEQ ID NO: 373142 - RNA, 21 nt, Homo sapiens
uccugagagaggaguaacucu

SEQ ID NO: 373143 - RNA, 20 nt, Homo sapiens
uccugagauucccaguucuc

SEQ ID NO: 373144 - RNA, 17 nt, Homo sapiens
ucuaauaauaugcauuu

SEQ ID NO: 373145 - RNA, 22 nt, Homo sapiens
ucuaauguaaccugcaaauauu

SEQ ID NO: 373146 - RNA, 22 nt, Homo sapiens
ucuacagccaguucaggaagaa

SEQ ID NO: 373147 - RNA, 22 nt, Homo sapiens
ucuccauuguccagaugaggaa

SEQ ID NO: 373148 - RNA, 22 nt, Homo sapiens
ucugagaucaugucugugcugu

SEQ ID NO: 373149 - RNA, 22 nt, Homo sapiens
ucugagaugagacuuugaauuu

SEQ ID NO: 373150 - RNA, 22 nt, Homo sapiens
ucuggcuuauuucacuuagcau

SEQ ID NO: 373151 - RNA, 22 nt, Homo sapiens
ucuugcacaaauuauuuuaacu

SEQ ID NO: 373152 - RNA, 22 nt, Homo sapiens
ucuuuuggguauggagccauca

SEQ ID NO: 373153 - RNA, 22 nt, Homo sapiens
ugaaauuauucuuaccaaggug

SEQ ID NO: 373154 - RNA, 22 nt, Homo sapiens
ugaaauuguuugcaaggauagg

SEQ ID NO: 373155 - RNA, 19 nt, Homo sapiens
ugacaugaaacccaagauc

SEQ ID NO: 373156 - RNA, 22 nt, Homo sapiens
ugacauuacagucacuugcugu

SEQ ID NO: 373157 - RNA, 22 nt, Homo sapiens
ugagacggagucuugcucuguc

SEQ ID NO: 373158 - RNA, 22 nt, Homo sapiens
ugagauuauauuucuuaacaga

SEQ ID NO: 373159 - RNA, 22 nt, Homo sapiens
ugaggaacuagcuacccuaaua

SEQ ID NO: 373160 - RNA, 22 nt, Homo sapiens
ugcaaaugcugcuauuucucuu

SEQ ID NO: 373161 - RNA, 22 nt, Homo sapiens
aaucacacuugauguugagcaa

SEQ ID NO: 373162 - RNA, 17 nt, Homo sapiens
aaucagauuucugagga

SEQ ID NO: 373163 - RNA, 22 nt, Homo sapiens
aauggcaaauguuuucuguuga

SEQ ID NO: 373164 - RNA, 22 nt, Homo sapiens
aauugcacuaagcauaguccag

SEQ ID NO: 373165 - RNA, 22 nt, Homo sapiens
acacuggaguuaaaggugauuu

SEQ ID NO: 373166 - RNA, 22 nt, Homo sapiens
acauggcacugcgggcuucuug

SEQ ID NO: 373167 - RNA, 18 nt, Homo sapiens
acauucagcuugaagaua

SEQ ID NO: 373168 - RNA, 22 nt, Homo sapiens
acugcacuccaccuugggcaac

SEQ ID NO: 373169 - RNA, 22 nt, Homo sapiens
acugcacuccagccucggcaau

SEQ ID NO: 373170 - RNA, 19 nt, Homo sapiens
acugcacuccuccuugggu

SEQ ID NO: 373171 - RNA, 22 nt, Homo sapiens
agaacacugaguucagggucag

SEQ ID NO: 373172 - RNA, 22 nt, Homo sapiens
agaaccaaucccacauggauac

SEQ ID NO: 373173 - RNA, 22 nt, Homo sapiens
agaguacaggcaaguuagucau

SEQ ID NO: 373174 - RNA, 22 nt, Homo sapiens
agagugcuauagauuagauuuc

SEQ ID NO: 373175 - RNA, 22 nt, Homo sapiens
agaucauaugcaguaaugaacu

SEQ ID NO: 373176 - RNA, 22 nt, Homo sapiens
agcagagcaguggauuuuguga

SEQ ID NO: 373177 - RNA, 22 nt, Homo sapiens
agcagagcauauucauucgggg

SEQ ID NO: 373178 - RNA, 22 nt, Homo sapiens
agccuguguugaauuauagaaa

SEQ ID NO: 373179 - RNA, 22 nt, Homo sapiens
agcuggauguauguuaagugaa

SEQ ID NO: 373180 - RNA, 22 nt, Homo sapiens
agucacagguucuugggauuag

SEQ ID NO: 373181 - RNA, 22 nt, Homo sapiens
agugcaauaaggauguagaacu

SEQ ID NO: 373182 - RNA, 22 nt, Homo sapiens
aguggaaucuguuauacuaacu

SEQ ID NO: 373183 - RNA, 22 nt, Homo sapiens
auaagauaguggaagugggauu

SEQ ID NO: 373184 - RNA, 23 nt, Homo sapiens
auaagccuuuucuuucugcccca

SEQ ID NO: 373185 - RNA, 22 nt, Homo sapiens
auacacgguaggcacauauuua

SEQ ID NO: 373186 - RNA, 22 nt, Homo sapiens
auacuguauaggauuguagccu

SEQ ID NO: 373187 - RNA, 22 nt, Homo sapiens
auagcagaacagugucucacug

SEQ ID NO: 373188 - RNA, 22 nt, Homo sapiens
auaucacucccaauaucgcagg

SEQ ID NO: 373189 - RNA, 22 nt, Homo sapiens
auaugcauguacccacacaggc

SEQ ID NO: 373190 - RNA, 22 nt, Homo sapiens
auaugucuauuauuagggcagg

SEQ ID NO: 373191 - RNA, 22 nt, Homo sapiens
auaugucuguuuagucuguaau

SEQ ID NO: 373192 - RNA, 22 nt, Homo sapiens
auauuggccuaaaauucucuuu

SEQ ID NO: 373193 - RNA, 22 nt, Homo sapiens
aucaccuggaggugaucacuug

SEQ ID NO: 373194 - RNA, 20 nt, Homo sapiens
aucacuggagaaggaaaccu

SEQ ID NO: 373195 - RNA, 23 nt, Homo sapiens
aucacuguuaacaauuucuuccu

SEQ ID NO: 373196 - RNA, 22 nt, Homo sapiens
aucacuguuuugaugcucggac

SEQ ID NO: 373197 - RNA, 22 nt, Homo sapiens
auccacaugcaguuggaaacag

SEQ ID NO: 373198 - RNA, 22 nt, Homo sapiens
aucgcgccauuguacuccagcc

SEQ ID NO: 373199 - RNA, 22 nt, Homo sapiens
aucuuguguugaauggugcaga

SEQ ID NO: 373200 - RNA, 22 nt, Homo sapiens
augaaaagcauaaacgcugaag

SEQ ID NO: 373201 - RNA, 22 nt, Homo sapiens
augaaauugcuaucgcaguacu

SEQ ID NO: 373202 - RNA, 23 nt, Homo sapiens
augacacuccugugcgcacccug

SEQ ID NO: 373203 - RNA, 22 nt, Homo sapiens
augacauguauuuccaggauuu

SEQ ID NO: 373204 - RNA, 22 nt, Homo sapiens
augaccaaugggcagagcuaga

SEQ ID NO: 373205 - RNA, 22 nt, Homo sapiens
augacugucagggcagucauug

SEQ ID NO: 373206 - RNA, 22 nt, Homo sapiens
augagguaguagaaagucaggu

SEQ ID NO: 373207 - RNA, 22 nt, Homo sapiens
auggaagacuccucuuugggua

SEQ ID NO: 373208 - RNA, 22 nt, Homo sapiens
auggccgggugcgguggcucac

SEQ ID NO: 373209 - RNA, 20 nt, Homo sapiens
auguaauguaugauauguac

SEQ ID NO: 373210 - RNA, 20 nt, Homo sapiens
auugcagcaugauuuauaau

SEQ ID NO: 373211 - RNA, 22 nt, Homo sapiens
auuguaauuuuagagaaagugg

SEQ ID NO: 373212 - RNA, 22 nt, Homo sapiens
caaaagugauugcgguuuuugc

SEQ ID NO: 373213 - RNA, 21 nt, Homo sapiens
caauggcacaaucucugcuca

SEQ ID NO: 373214 - RNA, 22 nt, Homo sapiens
cacccuugcagggacagcuuug

SEQ ID NO: 373215 - RNA, 22 nt, Homo sapiens
cacugcgacguccgccucccgg

SEQ ID NO: 373216 - RNA, 22 nt, Homo sapiens
cagcuaaauuguuaaauccaag

SEQ ID NO: 373217 - RNA, 22 nt, Homo sapiens
caggugcauuggcugacaccug

SEQ ID NO: 373218 - RNA, 22 nt, Homo sapiens
caggugcuuacuuaauagccau

SEQ ID NO: 373219 - RNA, 21 nt, Homo sapiens
cauaaugcuacuuauuuuaug

SEQ ID NO: 373220 - RNA, 22 nt, Homo sapiens
caugacacuggcauguuucuuu

SEQ ID NO: 373221 - RNA, 22 nt, Homo sapiens
cauugcacuccagcccagguga

SEQ ID NO: 373222 - RNA, 22 nt, Homo sapiens
ugagacacuucccagaucccuu

SEQ ID NO: 373223 - RNA, 22 nt, Homo sapiens
ugagaucaugccacugcacuuc

SEQ ID NO: 373224 - RNA, 23 nt, Homo sapiens
ugagauuacccagaaagaguaua

SEQ ID NO: 373225 - RNA, 23 nt, Homo sapiens
ugagauuauaaucuuuuacuucu

SEQ ID NO: 373226 - RNA, 22 nt, Homo sapiens
ugagauuaucuugaucuugaaa

SEQ ID NO: 373227 - RNA, 22 nt, Homo sapiens
ugaugacauugucacagucuga

SEQ ID NO: 373228 - RNA, 22 nt, Homo sapiens
ugauugcacaccugcacucaag

SEQ ID NO: 373229 - RNA, 21 nt, Homo sapiens
ugcauauuggaacuuucucuc

SEQ ID NO: 373230 - RNA, 22 nt, Homo sapiens
ugcuaugucagccaggcugguc

SEQ ID NO: 373231 - RNA, 22 nt, Homo sapiens
uggaaguauagauaauugaaag

SEQ ID NO: 373232 - RNA, 19 nt, Homo sapiens
uggaaugaaauguuagggg

SEQ ID NO: 373233 - RNA, 22 nt, Homo sapiens
uggaguguguugcagaugaagg

SEQ ID NO: 373234 - RNA, 20 nt, Homo sapiens
uggugguuuuaugugguuua

SEQ ID NO: 373235 - RNA, 22 nt, Homo sapiens
ugucauucaggaaauucuaagu

SEQ ID NO: 373236 - RNA, 18 nt, Homo sapiens
ugugacauugagcauguc

SEQ ID NO: 373237 - RNA, 22 nt, Homo sapiens
ugugccacugcacuucagccug

SEQ ID NO: 373238 - RNA, 22 nt, Homo sapiens
ugugcucaucucagucaacugu

SEQ ID NO: 373239 - RNA, 22 nt, Homo sapiens
uuacaguugugagccaccaugc

SEQ ID NO: 373240 - RNA, 22 nt, Homo sapiens
uuacaugucuugguaagguuag

SEQ ID NO: 373241 - RNA, 22 nt, Homo sapiens
uuaccuuuuuaagacagguuag

SEQ ID NO: 373242 - RNA, 22 nt, Homo sapiens
uuacuguagugucauaucguau

SEQ ID NO: 373243 - RNA, 22 nt, Homo sapiens
uuaugucuuugagcaaugcugu

SEQ ID NO: 373244 - RNA, 22 nt, Homo sapiens
uuauuagagauauuugguuagg

SEQ ID NO: 373245 - RNA, 22 nt, Homo sapiens
uucacaguacucccuggaauua

SEQ ID NO: 373246 - RNA, 22 nt, Homo sapiens
uucacagucacccuucuccaug

SEQ ID NO: 373247 - RNA, 22 nt, Homo sapiens
uucacuguagccucagccucuu

SEQ ID NO: 373248 - RNA, 22 nt, Homo sapiens
uucacuguuaagcaguuaaacu

SEQ ID NO: 373249 - RNA, 22 nt, Homo sapiens
uucauagucacauucgaugucu

SEQ ID NO: 373250 - RNA, 22 nt, Homo sapiens
uucauguaauuccauaagguaa

SEQ ID NO: 373251 - RNA, 22 nt, Homo sapiens
uuccaguuauuauaccucuuaa

SEQ ID NO: 373252 - RNA, 22 nt, Homo sapiens
uuccaugugggcuugucaagua

SEQ ID NO: 373253 - RNA, 20 nt, Homo sapiens
uucuauggugaugaguccug

SEQ ID NO: 373254 - RNA, 22 nt, Homo sapiens
uugaaagcuaucucaaaucgcu

SEQ ID NO: 373255 - RNA, 22 nt, Homo sapiens
uugaaauguuuagaaguuugga

SEQ ID NO: 373256 - RNA, 22 nt, Homo sapiens
uugagacggagucuugcucuuu

SEQ ID NO: 373257 - RNA, 22 nt, Homo sapiens
uugagccaaggauugucuuucc

SEQ ID NO: 373258 - RNA, 22 nt, Homo sapiens
uugagcccuggagguggaggcu

SEQ ID NO: 373259 - RNA, 22 nt, Homo sapiens
uugaggaaugugauuucaaaua

SEQ ID NO: 373260 - RNA, 22 nt, Homo sapiens
uugaguuugaguauucuaaagc

SEQ ID NO: 373261 - RNA, 22 nt, Homo sapiens
uugauaguuuuaaaauuaaucu

SEQ ID NO: 373262 - RNA, 22 nt, Homo sapiens
uugcaaagaccucuucacuucc

SEQ ID NO: 373263 - RNA, 18 nt, Homo sapiens
uugcaaauucuucccugu

SEQ ID NO: 373264 - RNA, 22 nt, Homo sapiens
uugcacauggcuggggaggccu

SEQ ID NO: 373265 - RNA, 22 nt, Homo sapiens
uugcacauugauuuuguaucuu

SEQ ID NO: 373266 - RNA, 22 nt, Homo sapiens
uugccuaggcuggagugcagug

SEQ ID NO: 373267 - RNA, 22 nt, Homo sapiens
uugccuaggcuggaguucagug

SEQ ID NO: 373268 - RNA, 22 nt, Homo sapiens
uuggaagauuacuuaguuuucu

SEQ ID NO: 373269 - RNA, 22 nt, Homo sapiens
ucuucaugcuugaaauaauagc

SEQ ID NO: 373270 - RNA, 22 nt, Homo sapiens
ugaagugaagacucacagaagg

SEQ ID NO: 373271 - RNA, 22 nt, Homo sapiens
ugaaucauuucuugucuucagu

SEQ ID NO: 373272 - RNA, 19 nt, Homo sapiens
ugacacuguuggugggagg

SEQ ID NO: 373273 - RNA, 22 nt, Homo sapiens
ugacagagaagcauugaguuca

SEQ ID NO: 373274 - RNA, 22 nt, Homo sapiens
ugacucaguuucucagguagua

SEQ ID NO: 373275 - RNA, 22 nt, Homo sapiens
ugagacacugaauccggccuga

SEQ ID NO: 373276 - RNA, 22 nt, Homo sapiens
ugagauagggucucacucuguc

SEQ ID NO: 373277 - RNA, 22 nt, Homo sapiens
ugagaucacgccacugcacucc

SEQ ID NO: 373278 - RNA, 22 nt, Homo sapiens
ugagaugcauauucuggcuccu

SEQ ID NO: 373279 - RNA, 22 nt, Homo sapiens
ugagaugcuccucuugcaaagc

SEQ ID NO: 373280 - RNA, 22 nt, Homo sapiens
ugagauuaaucuuuaaguaaga

SEQ ID NO: 373281 - RNA, 17 nt, Homo sapiens
ugcaauuuaagcuagau

SEQ ID NO: 373282 - RNA, 19 nt, Homo sapiens
ugccauguagcacaugguc

SEQ ID NO: 373283 - RNA, 22 nt, Homo sapiens
uggaagccuagauucuuuucuu

SEQ ID NO: 373284 - RNA, 22 nt, Homo sapiens
uggaauuaauuaaaauauacug

SEQ ID NO: 373285 - RNA, 22 nt, Homo sapiens
uggagucuugaugauuuucaaa

SEQ ID NO: 373286 - RNA, 22 nt, Homo sapiens
uggagugcaauggcaccaucuu

SEQ ID NO: 373287 - RNA, 22 nt, Homo sapiens
uggauaguaauaaacauauagg

SEQ ID NO: 373288 - RNA, 22 nt, Homo sapiens
uggcaaaucagaggcauggaca

SEQ ID NO: 373289 - RNA, 22 nt, Homo sapiens
uggcaaaugaaagaaagccagu

SEQ ID NO: 373290 - RNA, 23 nt, Homo sapiens
uggcaagaauucuuaccgugugg

SEQ ID NO: 373291 - RNA, 22 nt, Homo sapiens
uggcaagaccccaucucuacaa

SEQ ID NO: 373292 - RNA, 19 nt, Homo sapiens
uggcacauguauacauaug

SEQ ID NO: 373293 - RNA, 22 nt, Homo sapiens
ugucacccuuuauccauuuccu

SEQ ID NO: 373294 - RNA, 21 nt, Homo sapiens
ugugaacauguuggguggcau

SEQ ID NO: 373295 - RNA, 22 nt, Homo sapiens
ugugaacauuuuguauauauua

SEQ ID NO: 373296 - RNA, 22 nt, Homo sapiens
ugugccacugcacucuggccug

SEQ ID NO: 373297 - RNA, 22 nt, Homo sapiens
ugugucuccugaaaauucacau

SEQ ID NO: 373298 - RNA, 22 nt, Homo sapiens
uuaagucacacuagacaacuga

SEQ ID NO: 373299 - RNA, 22 nt, Homo sapiens
uuaaucuguucucuguauucua

SEQ ID NO: 373300 - RNA, 22 nt, Homo sapiens
uuauuagguuaaccuauagcua

SEQ ID NO: 373301 - RNA, 22 nt, Homo sapiens
uuauucauuaacagggaccaaa

SEQ ID NO: 373302 - RNA, 22 nt, Homo sapiens
uuauucauuaauugcuaagguu

SEQ ID NO: 373303 - RNA, 16 nt, Homo sapiens
uuauugcauucuucuc

SEQ ID NO: 373304 - RNA, 22 nt, Homo sapiens
uucaagaauuaaaguggcuuuu

SEQ ID NO: 373305 - RNA, 22 nt, Homo sapiens
uucauaguuuauacugauauuu

SEQ ID NO: 373306 - RNA, 23 nt, Homo sapiens
uucaucagggauauuggccugaa

SEQ ID NO: 373307 - RNA, 22 nt, Homo sapiens
uucauguaauauuucacagcuu

SEQ ID NO: 373308 - RNA, 22 nt, Homo sapiens
uucuauguuugaaaaugccaaa

SEQ ID NO: 373309 - RNA, 22 nt, Homo sapiens
uucuggccuccauuuuucuccu

SEQ ID NO: 373310 - RNA, 22 nt, Homo sapiens
uugaaccauucuuuugauagag

SEQ ID NO: 373311 - RNA, 22 nt, Homo sapiens
uugcacauggcaggugcucaau

SEQ ID NO: 373312 - RNA, 22 nt, Homo sapiens
uugcacauguugaaccagcaaa

SEQ ID NO: 373313 - RNA, 22 nt, Homo sapiens
uugcacauugcaccuuuuguau

SEQ ID NO: 373314 - RNA, 22 nt, Homo sapiens
uugcauaagugcauucugugau

SEQ ID NO: 373315 - RNA, 22 nt, Homo sapiens
uugcaucagcaggcauaauugg

SEQ ID NO: 373316 - RNA, 22 nt, Homo sapiens
uuggaagacauucugucugcua

SEQ ID NO: 373317 - RNA, 22 nt, Homo sapiens
uuggaagagaagggagauaaac

SEQ ID NO: 373318 - RNA, 22 nt, Homo sapiens
uuggagugugcucauaacugcu

SEQ ID NO: 373319 - RNA, 22 nt, Homo sapiens
uuggcagcacgcaguccagagg

SEQ ID NO: 373320 - RNA, 22 nt, Homo sapiens
uuguaaacaucuguacauugcu

SEQ ID NO: 373321 - RNA, 22 nt, Homo sapiens
uugucaacaugaaacuguguuu

SEQ ID NO: 373322 - RNA, 22 nt, Homo sapiens
uugucccauggggucuuccuuu

SEQ ID NO: 373323 - RNA, 22 nt, Homo sapiens
uuucauggaggauuugcuucuu

SEQ ID NO: 373324 - RNA, 22 nt, Homo sapiens
uuucuauguugaccagucuaga

SEQ ID NO: 373325 - RNA, 18 nt, Homo sapiens
uuuggcuguucaugacuc

SEQ ID NO: 373326 - RNA, 22 nt, Homo sapiens
uuuugcacuguuuuaucugaca

SEQ ID NO: 373327 - RNA, 22 nt, Homo sapiens
aaaggcuucggaucagaaggua

SEQ ID NO: 373328 - RNA, 22 nt, Homo sapiens
aaagugcuaggauuaccugggg

SEQ ID NO: 373329 - RNA, 22 nt, Homo sapiens
aaagugcugggauuggccgggc

SEQ ID NO: 373330 - RNA, 22 nt, Homo sapiens
aaagugcuguagacugggcgca

SEQ ID NO: 373331 - RNA, 22 nt, Homo sapiens
aaagugcuuacuaaguugccaa

SEQ ID NO: 373332 - RNA, 22 nt, Homo sapiens
aaagugcuucucuuuggugggu

SEQ ID NO: 373333 - RNA, 22 nt, Homo sapiens
aaaguggugggauuccaggcau

SEQ ID NO: 373334 - RNA, 22 nt, Homo sapiens
aaauugcauugagcugcuuauu

SEQ ID NO: 373335 - RNA, 22 nt, Homo sapiens
aacagugcauuccuguccauau

SEQ ID NO: 373336 - RNA, 22 nt, Homo sapiens
aagagguagaagcuugccuucu

SEQ ID NO: 373337 - RNA, 22 nt, Homo sapiens
aaggugcuguaagcauccaugu

SEQ ID NO: 373338 - RNA, 17 nt, Homo sapiens
aaggugcuucgaccucc

SEQ ID NO: 373339 - RNA, 22 nt, Homo sapiens
aagugcuuaggauagugugugg

SEQ ID NO: 373340 - RNA, 22 nt, Homo sapiens
aagugcuucagaagacaauauu

SEQ ID NO: 373341 - RNA, 22 nt, Homo sapiens
aagugcuuccuuucagaggguu

SEQ ID NO: 373342 - RNA, 20 nt, Homo sapiens
aagugcuuccuuuuagaggg

SEQ ID NO: 373343 - RNA, 22 nt, Homo sapiens
aagugcuuuguacagggguuga

SEQ ID NO: 373344 - RNA, 22 nt, Homo sapiens
aagugcuuuuuagauaugguuu

SEQ ID NO: 373345 - RNA, 22 nt, Homo sapiens
acauucagcuguuguuucaaug

SEQ ID NO: 373346 - RNA, 22 nt, Homo sapiens
accaguuuuuuauacaucuucu

SEQ ID NO: 373347 - RNA, 22 nt, Homo sapiens
acccgcccagguguggccggga

SEQ ID NO: 373348 - RNA, 22 nt, Homo sapiens
acccugugaauauuuaaacuuc

SEQ ID NO: 373349 - RNA, 22 nt, Homo sapiens
accucagcccggggaaguugag

SEQ ID NO: 373350 - RNA, 22 nt, Homo sapiens
accugagauuacaggugcuggc

SEQ ID NO: 373351 - RNA, 22 nt, Homo sapiens
acugagaucuuuaaauaaauaa

SEQ ID NO: 373352 - RNA, 22 nt, Homo sapiens
acugcacuccacccuuggcagc

SEQ ID NO: 373353 - RNA, 22 nt, Homo sapiens
acugcacuccaguuugggcagc

SEQ ID NO: 373354 - RNA, 22 nt, Homo sapiens
acuggacuuaaugaugaauugu

SEQ ID NO: 373355 - RNA, 22 nt, Homo sapiens
agacacugaaauguauugaaga

SEQ ID NO: 373356 - RNA, 22 nt, Homo sapiens
cccuguguuuagcugaagguuu

SEQ ID NO: 373357 - RNA, 22 nt, Homo sapiens
ccuucuuuuguaaggcugaaua

SEQ ID NO: 373358 - RNA, 22 nt, Homo sapiens
aucccuugacguggagucucug

SEQ ID NO: 373359 - RNA, 22 nt, Homo sapiens
aucuggguccguucugcuucuc

SEQ ID NO: 373360 - RNA, 20 nt, Homo sapiens
augaagugaaguuagggaac

SEQ ID NO: 373361 - RNA, 22 nt, Homo sapiens
augagacauuaaaguguguuug

SEQ ID NO: 373362 - RNA, 22 nt, Homo sapiens
augaguaugagaauacauuaag

SEQ ID NO: 373363 - RNA, 22 nt, Homo sapiens
augauagucuugagaagcauuu

SEQ ID NO: 373364 - RNA, 22 nt, Homo sapiens
augcacauggcuaacuuuuuuc

SEQ ID NO: 373365 - RNA, 22 nt, Homo sapiens
auggaagaaacgauuuucugga

SEQ ID NO: 373366 - RNA, 22 nt, Homo sapiens
auggcacagaguagaugcucaa

SEQ ID NO: 373367 - RNA, 17 nt, Homo sapiens
augugaauguucaaaua

SEQ ID NO: 373368 - RNA, 22 nt, Homo sapiens
auuaucacaguuuugcauaugg

SEQ ID NO: 373369 - RNA, 22 nt, Homo sapiens
auucaaagugcauguucccacu

SEQ ID NO: 373370 - RNA, 22 nt, Homo sapiens
auugcacaaagagggaaacuga

SEQ ID NO: 373371 - RNA, 22 nt, Homo sapiens
auugcacacagaaucaggguaa

SEQ ID NO: 373372 - RNA, 22 nt, Homo sapiens
auuggcagaaaucuuuauagua

SEQ ID NO: 373373 - RNA, 22 nt, Homo sapiens
auugucacccgggcaguaagca

SEQ ID NO: 373374 - RNA, 22 nt, Homo sapiens
auugucccucuuaaucccagca

SEQ ID NO: 373375 - RNA, 22 nt, Homo sapiens
caaaggauucauuuccaggagu

SEQ ID NO: 373376 - RNA, 22 nt, Homo sapiens
caaagucuucucauuaugucuu

SEQ ID NO: 373377 - RNA, 22 nt, Homo sapiens
caacauccaccuccuggguuca

SEQ ID NO: 373378 - RNA, 22 nt, Homo sapiens
caagugcuacagagaaaucuuu

SEQ ID NO: 373379 - RNA, 22 nt, Homo sapiens
caagugcuuucuuggggauuua

SEQ ID NO: 373380 - RNA, 22 nt, Homo sapiens
cacuuugguucaccugaguuuc

SEQ ID NO: 373381 - RNA, 22 nt, Homo sapiens
cagucacagugacaggaugugg

SEQ ID NO: 373382 - RNA, 22 nt, Homo sapiens
cagugcuuguuauuguucuauu

SEQ ID NO: 373383 - RNA, 22 nt, Homo sapiens
cagugcuuuaucaaguccucca

SEQ ID NO: 373384 - RNA, 22 nt, Homo sapiens
cauugcacuccacuccugaaca

SEQ ID NO: 373385 - RNA, 22 nt, Homo sapiens
cauugcacuccagccuaggcaa

SEQ ID NO: 373386 - RNA, 22 nt, Homo sapiens
cauugcacuccagccugaccaa

SEQ ID NO: 373387 - RNA, 22 nt, Homo sapiens
cauugcacuccagccugaggga

SEQ ID NO: 373388 - RNA, 20 nt, Homo sapiens
cauugcacuccagccugcug

SEQ ID NO: 373389 - RNA, 22 nt, Homo sapiens
cauugcacuccagccuggcaac

SEQ ID NO: 373390 - RNA, 20 nt, Homo sapiens
cauugcacuccagcuugggc

SEQ ID NO: 373391 - RNA, 16 nt, Homo sapiens
cauugcacucuagccu

SEQ ID NO: 373392 - RNA, 22 nt, Homo sapiens
cauugcacugcuucuugggugu

SEQ ID NO: 373393 - RNA, 22 nt, Homo sapiens
ccaggguuccacgccuggcugu

SEQ ID NO: 373394 - RNA, 18 nt, Homo sapiens
ccauucaacagauuuguc

SEQ ID NO: 373395 - RNA, 22 nt, Homo sapiens
ccugagacgaauggagugaaca

SEQ ID NO: 373396 - RNA, 19 nt, Homo sapiens
cuauugcacauagcugaag

SEQ ID NO: 373397 - RNA, 22 nt, Homo sapiens
cucaaguacaugggauuacagg

SEQ ID NO: 373398 - RNA, 22 nt, Homo sapiens
cucacaugcucaccugguguuc

SEQ ID NO: 373399 - RNA, 22 nt, Homo sapiens
cucagcuacuugggaagcugag

SEQ ID NO: 373400 - RNA, 22 nt, Homo sapiens
cucauugcaaucucugccuccc

SEQ ID NO: 373401 - RNA, 22 nt, Homo sapiens
cuccuguagccccaucaucuuu

SEQ ID NO: 373402 - RNA, 22 nt, Homo sapiens
cugguuuguaaaguuccugaga

SEQ ID NO: 373403 - RNA, 22 nt, Homo sapiens
cugugcuugagagaugacacag

SEQ ID NO: 373404 - RNA, 20 nt, Homo sapiens
cuugccuagcccuuugccuc

SEQ ID NO: 373405 - RNA, 22 nt, Homo sapiens
gaagugcuuuuggacuaacagu

SEQ ID NO: 373406 - RNA, 22 nt, Homo sapiens
gagacugagucuugcucuguca

SEQ ID NO: 373407 - RNA, 22 nt, Homo sapiens
gagauauuauuucccuuucaca

SEQ ID NO: 373408 - RNA, 22 nt, Homo sapiens
gagauauuuagaaauguguucu

SEQ ID NO: 373409 - RNA, 22 nt, Homo sapiens
gagcaucaguggccucaucuca

SEQ ID NO: 373410 - RNA, 22 nt, Homo sapiens
gaggugaaggucucaauaaaua

SEQ ID NO: 373411 - RNA, 22 nt, Homo sapiens
gcaccaugguagaauaauggua

SEQ ID NO: 373412 - RNA, 22 nt, Homo sapiens
gcagcaucaaaucacacaagau

SEQ ID NO: 373413 - RNA, 22 nt, Homo sapiens
gcagucacagggagauggugac

SEQ ID NO: 373414 - RNA, 22 nt, Homo sapiens
gcuggguucagagugggcugcg

SEQ ID NO: 373415 - RNA, 22 nt, Homo sapiens
ggaucacuugagaccaggaguu

SEQ ID NO: 373416 - RNA, 22 nt, Homo sapiens
ggaucauaugauagcucaauuu

SEQ ID NO: 373417 - RNA, 22 nt, Homo sapiens
ggcacaaugucagcucacugca

SEQ ID NO: 373418 - RNA, 22 nt, Homo sapiens
ggccggguggccauggcugccc

SEQ ID NO: 373419 - RNA, 22 nt, Homo sapiens
gguggugguauuucagaaaaug

SEQ ID NO: 373420 - RNA, 22 nt, Homo sapiens
guaaucucagcuacucaggagg

SEQ ID NO: 373421 - RNA, 22 nt, Homo sapiens
guaaucucagcuacucgggagg

SEQ ID NO: 373422 - RNA, 22 nt, Homo sapiens
guauggaagucaguuuguuggc

SEQ ID NO: 373423 - RNA, 22 nt, Homo sapiens
gucacugucuacuguaauagcc

SEQ ID NO: 373424 - RNA, 20 nt, Homo sapiens
guccauuugcugccauugcu

SEQ ID NO: 373425 - RNA, 22 nt, Homo sapiens
gugagauacuagagauauagug

SEQ ID NO: 373426 - RNA, 22 nt, Homo sapiens
gugagauaucuagacuagggaa

SEQ ID NO: 373427 - RNA, 22 nt, Homo sapiens
gugcaaaucucugaguaucuuu

SEQ ID NO: 373428 - RNA, 22 nt, Homo sapiens
gugcaaugagaaggggcucugg

SEQ ID NO: 373429 - RNA, 22 nt, Homo sapiens
gugcacaucuguguuccagcua

SEQ ID NO: 373430 - RNA, 22 nt, Homo sapiens
gugccacugcacuccggccugg

SEQ ID NO: 373431 - RNA, 22 nt, Homo sapiens
guggaagauaguguguuaaugu

SEQ ID NO: 373432 - RNA, 22 nt, Homo sapiens
guggaaugauaucucauugugg

SEQ ID NO: 373433 - RNA, 22 nt, Homo sapiens
guguccucgaguacacaucagg

SEQ ID NO: 373434 - RNA, 22 nt, Homo sapiens
gugugauuguuaauuuuaggug

SEQ ID NO: 373435 - RNA, 22 nt, Homo sapiens
gugugcucaucacaugcaauag

SEQ ID NO: 373436 - RNA, 20 nt, Homo sapiens
guucauguaauuaguucagg

SEQ ID NO: 373437 - RNA, 22 nt, Homo sapiens
guugcucaggccggagugcagu

SEQ ID NO: 373438 - RNA, 22 nt, Homo sapiens
uaaagcuuggauuuaggcuaau

SEQ ID NO: 373439 - RNA, 22 nt, Homo sapiens
uaagugaaggaaguguguuuac

SEQ ID NO: 373440 - RNA, 20 nt, Homo sapiens
uaagugcauaggauauuucu

SEQ ID NO: 373441 - RNA, 22 nt, Homo sapiens
uaauccuagcacuuuggaagac

SEQ ID NO: 373442 - RNA, 22 nt, Homo sapiens
uacaaagcuuucugcaaaucau

SEQ ID NO: 373443 - RNA, 22 nt, Homo sapiens
uacagucauaaugccuagugac

SEQ ID NO: 373444 - RNA, 22 nt, Homo sapiens
uacgccuguaauaucagcauuu

SEQ ID NO: 373445 - RNA, 22 nt, Homo sapiens
uacuguacugcaguucugcaaa

SEQ ID NO: 373446 - RNA, 22 nt, Homo sapiens
uagaaagcaugaccuucagaua

SEQ ID NO: 373447 - RNA, 22 nt, Homo sapiens
uagacacuagauaugugacuga

SEQ ID NO: 373448 - RNA, 22 nt, Homo sapiens
uagagguaggucuucgagucuc

SEQ ID NO: 373449 - RNA, 22 nt, Homo sapiens
uagagguauuaacaguagaaga

SEQ ID NO: 373450 - RNA, 22 nt, Homo sapiens
uaucacuguuguuuguuuaagg

SEQ ID NO: 373451 - RNA, 22 nt, Homo sapiens
uauggcacuaguacuggaaagc

SEQ ID NO: 373452 - RNA, 22 nt, Homo sapiens
uaugucuggaguuacugagcug

SEQ ID NO: 373453 - RNA, 20 nt, Homo sapiens
uauucacucuccagucuugc

SEQ ID NO: 373454 - RNA, 22 nt, Homo sapiens
uauuccacaauaugauuuuuaa

SEQ ID NO: 373455 - RNA, 22 nt, Homo sapiens
uaagugcuugacuuugauguuu

SEQ ID NO: 373456 - RNA, 20 nt, Homo sapiens
uaagugcuugagacuucuga

SEQ ID NO: 373457 - RNA, 20 nt, Homo sapiens
uaagugcuugaugaaugaac

SEQ ID NO: 373458 - RNA, 22 nt, Homo sapiens
uacaaagugggaaacgaagguu

SEQ ID NO: 373459 - RNA, 22 nt, Homo sapiens
uacauacuucacagacuuuaaa

SEQ ID NO: 373460 - RNA, 19 nt, Homo sapiens
uacccagaagcagcauugu

SEQ ID NO: 373461 - RNA, 18 nt, Homo sapiens
uagaauauaggucauucu

SEQ ID NO: 373462 - RNA, 22 nt, Homo sapiens
uagaucauauacuugccaugac

SEQ ID NO: 373463 - RNA, 22 nt, Homo sapiens
uaggucaguuuuggcuuggcuu

SEQ ID NO: 373464 - RNA, 22 nt, Homo sapiens
uaucacaggucaggaaucuugc

SEQ ID NO: 373465 - RNA, 21 nt, Homo sapiens
uaucacaguagaauaggaucu

SEQ ID NO: 373466 - RNA, 22 nt, Homo sapiens
uaugaaagcuacuucucacaau

SEQ ID NO: 373467 - RNA, 22 nt, Homo sapiens
uaugacauaguccuuaacccuc

SEQ ID NO: 373468 - RNA, 22 nt, Homo sapiens
uaugcagacauuguuccaacca

SEQ ID NO: 373469 - RNA, 22 nt, Homo sapiens
uauggcaaugcauaggaaggaa

SEQ ID NO: 373470 - RNA, 22 nt, Homo sapiens
uaugucuauuauguagcaggaa

SEQ ID NO: 373471 - RNA, 22 nt, Homo sapiens
uaugucuuuugcuugcaaauag

SEQ ID NO: 373472 - RNA, 22 nt, Homo sapiens
uauuaguuuucuguggauuaca

SEQ ID NO: 373473 - RNA, 22 nt, Homo sapiens
uauugauuaauugugauuaggc

SEQ ID NO: 373474 - RNA, 22 nt, Homo sapiens
uauugcacaugaggagacauug

SEQ ID NO: 373475 - RNA, 23 nt, Homo sapiens
uauugcacuaugguaacccuuuu

SEQ ID NO: 373476 - RNA, 22 nt, Homo sapiens
uauugcacuccucaugcauuug

SEQ ID NO: 373477 - RNA, 22 nt, Homo sapiens
ucaaagugagcuccuucucacu

SEQ ID NO: 373478 - RNA, 22 nt, Homo sapiens
ucaagcaauucuccugccucag

SEQ ID NO: 373479 - RNA, 18 nt, Homo sapiens
ucacggggagcagcagcc

SEQ ID NO: 373480 - RNA, 22 nt, Homo sapiens
ucacuaaagaaaauggcaugga

SEQ ID NO: 373481 - RNA, 22 nt, Homo sapiens
ucacuagggagaaacugaggcu

SEQ ID NO: 373482 - RNA, 22 nt, Homo sapiens
ucacugcgaccucugccucccg

SEQ ID NO: 373483 - RNA, 22 nt, Homo sapiens
ucaggcaugcagcaaugcagug

SEQ ID NO: 373484 - RNA, 22 nt, Homo sapiens
ucaggcuuuucccagagugaug

SEQ ID NO: 373485 - RNA, 22 nt, Homo sapiens
ucagguccuuacugugcucccu

SEQ ID NO: 373486 - RNA, 22 nt, Homo sapiens
ucauagucuaagguucuuuugc

SEQ ID NO: 373487 - RNA, 21 nt, Homo sapiens
ucaucagucaaagacaauggu

SEQ ID NO: 373488 - RNA, 22 nt, Homo sapiens
ucauggcauuguuaaggguuuu

SEQ ID NO: 373489 - RNA, 22 nt, Homo sapiens
ucauugcauguuaauuaaacag

SEQ ID NO: 373490 - RNA, 19 nt, Homo sapiens
uccaccgcgugcaccucua

SEQ ID NO: 373491 - RNA, 22 nt, Homo sapiens
uccaguuuggaggcuugaugug

SEQ ID NO: 373492 - RNA, 22 nt, Homo sapiens
uccugagacucacaggcucccc

SEQ ID NO: 373493 - RNA, 22 nt, Homo sapiens
uccugagacugaggagcuuugg

SEQ ID NO: 373494 - RNA, 22 nt, Homo sapiens
uccugagagcagacccucuaua

SEQ ID NO: 373495 - RNA, 23 nt, Homo sapiens
ucgcagcauucaauaccaggcag

SEQ ID NO: 373496 - RNA, 19 nt, Homo sapiens
ucgcgccauucuccugccu

SEQ ID NO: 373497 - RNA, 22 nt, Homo sapiens
ucucaaccucccaaguagcugg

SEQ ID NO: 373498 - RNA, 23 nt, Homo sapiens
ucucauuccuugaaaauaaugac

SEQ ID NO: 373499 - RNA, 22 nt, Homo sapiens
ucugacacagugauuaguaaau

SEQ ID NO: 373500 - RNA, 22 nt, Homo sapiens
ucuggagugugaaguggauaug

SEQ ID NO: 373501 - RNA, 22 nt, Homo sapiens
ucuugggugaguuugugaauaa

SEQ ID NO: 373502 - RNA, 22 nt, Homo sapiens
ugaaaguuauauugugaaauuc

SEQ ID NO: 373503 - RNA, 22 nt, Homo sapiens
ugaaaucauguaguuauugcaa

SEQ ID NO: 373504 - RNA, 21 nt, Homo sapiens
ugaaaugcaugugcacauuaa

SEQ ID NO: 373505 - RNA, 20 nt, Homo sapiens
ugacaagugagaauuauggg

SEQ ID NO: 373506 - RNA, 22 nt, Homo sapiens
ugacaugauuguauauuuagaa

SEQ ID NO: 373507 - RNA, 22 nt, Homo sapiens
aaagugcugagacagacuggga

SEQ ID NO: 373508 - RNA, 22 nt, Homo sapiens
aaagugcugagauuguaggcau

SEQ ID NO: 373509 - RNA, 22 nt, Homo sapiens
aaaugcuuucuuggaccauuug

SEQ ID NO: 373510 - RNA, 22 nt, Homo sapiens
aacagugcuguuauaaauguac

SEQ ID NO: 373511 - RNA, 22 nt, Homo sapiens
aagacuguaauccaucuugagu

SEQ ID NO: 373512 - RNA, 22 nt, Homo sapiens
aagagguaauaacaaagcuucu

SEQ ID NO: 373513 - RNA, 22 nt, Homo sapiens
aagagguagcagucacaaaaga

SEQ ID NO: 373514 - RNA, 22 nt, Homo sapiens
aagagguagucugucccuuagc

SEQ ID NO: 373515 - RNA, 22 nt, Homo sapiens
aaguacuguuuaaauugcagaa

SEQ ID NO: 373516 - RNA, 22 nt, Homo sapiens
aaguagcuggaugcaguggcac

SEQ ID NO: 373517 - RNA, 22 nt, Homo sapiens
aagugcuuacagggaacaugau

SEQ ID NO: 373518 - RNA, 22 nt, Homo sapiens
aagugcuucuuuccucgagaag

SEQ ID NO: 373519 - RNA, 22 nt, Homo sapiens
aagugcuuuacacaugcaugau

SEQ ID NO: 373520 - RNA, 22 nt, Homo sapiens
aauaaagcauggcuacuccaua

SEQ ID NO: 373521 - RNA, 22 nt, Homo sapiens
cauugcacuccagccucggcaa

SEQ ID NO: 373522 - RNA, 22 nt, Homo sapiens
cauugcacuccagccugaguga

SEQ ID NO: 373523 - RNA, 22 nt, Homo sapiens
cauugcacuccagccugccugg

SEQ ID NO: 373524 - RNA, 22 nt, Homo sapiens
cauugcacuccagccugcugac

SEQ ID NO: 373525 - RNA, 22 nt, Homo sapiens
cauugcacuccagccuggccaa

SEQ ID NO: 373526 - RNA, 22 nt, Homo sapiens
cauugcacuccagcuugggcaa

SEQ ID NO: 373527 - RNA, 22 nt, Homo sapiens
cauugcacuccaucuugggcaa

SEQ ID NO: 373528 - RNA, 22 nt, Homo sapiens
ccaguguucuggaaggcugagu

SEQ ID NO: 373529 - RNA, 22 nt, Homo sapiens
cccagaguucuuaaauacugag

SEQ ID NO: 373530 - RNA, 22 nt, Homo sapiens
cccugaagauacagaguuuggg

SEQ ID NO: 373531 - RNA, 19 nt, Homo sapiens
cuaaguccccuugauuaga

SEQ ID NO: 373532 - RNA, 22 nt, Homo sapiens
cuaugagucugcagaucuauua

SEQ ID NO: 373533 - RNA, 22 nt, Homo sapiens
cucaaguaauccucccgccuug

SEQ ID NO: 373534 - RNA, 22 nt, Homo sapiens
cugagauggagucucgcauugu

SEQ ID NO: 373535 - RNA, 22 nt, Homo sapiens
cuggcaagaggauaaaguccua

SEQ ID NO: 373536 - RNA, 22 nt, Homo sapiens
cuguaauguaaugagacuacau

SEQ ID NO: 373537 - RNA, 22 nt, Homo sapiens
cugucucagccucuccaguagc

SEQ ID NO: 373538 - RNA, 22 nt, Homo sapiens
cuugcacucagaagauucaguu

SEQ ID NO: 373539 - RNA, 22 nt, Homo sapiens
cuugcacuugaaauuccaguuu

SEQ ID NO: 373540 - RNA, 22 nt, Homo sapiens
cuuucucagugagacccgagau

SEQ ID NO: 373541 - RNA, 23 nt, Homo sapiens
cuuuguccccacccaaaucucau

SEQ ID NO: 373542 - RNA, 22 nt, Homo sapiens
gaaagauuuccugagcuagaaa

SEQ ID NO: 373543 - RNA, 22 nt, Homo sapiens
gaacccuggaggcggagguugc

SEQ ID NO: 373544 - RNA, 19 nt, Homo sapiens
gacuccagaguugugugcu

SEQ ID NO: 373545 - RNA, 22 nt, Homo sapiens
gagacggagucucgcucugucg

SEQ ID NO: 373546 - RNA, 22 nt, Homo sapiens
gagacggagucuugcucuguug

SEQ ID NO: 373547 - RNA, 22 nt, Homo sapiens
gagagugcuuggcaucugcuga

SEQ ID NO: 373548 - RNA, 22 nt, Homo sapiens
gaugaggcuagagacaugugua

SEQ ID NO: 373549 - RNA, 22 nt, Homo sapiens
gccuagagaaguaaauauuauc

SEQ ID NO: 373550 - RNA, 22 nt, Homo sapiens
ggaaauguuuagcauccacuuu

SEQ ID NO: 373551 - RNA, 22 nt, Homo sapiens
ggagcugugauuugaguccaga

SEQ ID NO: 373552 - RNA, 22 nt, Homo sapiens
ggcaagaucuuggcucacugaa

SEQ ID NO: 373553 - RNA, 22 nt, Homo sapiens
ggucacauuggacuaucaaguu

SEQ ID NO: 373554 - RNA, 22 nt, Homo sapiens
guaaucucaccuacuugggagg

SEQ ID NO: 373555 - RNA, 22 nt, Homo sapiens
guaaucucagcuacuugggagc

SEQ ID NO: 373556 - RNA, 22 nt, Homo sapiens
ugcagagaaacauuuuguauuu

SEQ ID NO: 373557 - RNA, 18 nt, Homo sapiens
ugcauacuaucugauuuu

SEQ ID NO: 373558 - RNA, 22 nt, Homo sapiens
ugcauauucgaguuauuuuggg

SEQ ID NO: 373559 - RNA, 22 nt, Homo sapiens
ugcgccauugcacuccagccug

SEQ ID NO: 373560 - RNA, 22 nt, Homo sapiens
ugcgccauugcauuccagccug

SEQ ID NO: 373561 - RNA, 21 nt, Homo sapiens
ugcuauguuguccaggcuggc

SEQ ID NO: 373562 - RNA, 22 nt, Homo sapiens
uggaaugguaucuuguuggggu

SEQ ID NO: 373563 - RNA, 22 nt, Homo sapiens
uggaaugugaauaacuuccuuc

SEQ ID NO: 373564 - RNA, 21 nt, Homo sapiens
uggaauuaauggagagguguu

SEQ ID NO: 373565 - RNA, 22 nt, Homo sapiens
uggacauguacauauguguaug

SEQ ID NO: 373566 - RNA, 22 nt, Homo sapiens
uggcaagagauaugugucuaua

SEQ ID NO: 373567 - RNA, 22 nt, Homo sapiens
uggcaccauccaggugucucua

SEQ ID NO: 373568 - RNA, 22 nt, Homo sapiens
ugggagacuacauuuuuaacaa

SEQ ID NO: 373569 - RNA, 23 nt, Homo sapiens
uggguucauucuugaagucagug

SEQ ID NO: 373570 - RNA, 20 nt, Homo sapiens
uggucaccuucaggagguuc

SEQ ID NO: 373571 - RNA, 16 nt, Homo sapiens
uguauugcuaaaaaga

SEQ ID NO: 373572 - RNA, 22 nt, Homo sapiens
ugucacagagauuuugguaugu

SEQ ID NO: 373573 - RNA, 22 nt, Homo sapiens
ugucacaguuuguacuuuauag

SEQ ID NO: 373574 - RNA, 22 nt, Homo sapiens
ugugaacaaaauuuguugcaua

SEQ ID NO: 373575 - RNA, 22 nt, Homo sapiens
ugugaagaaagucauugguagc

SEQ ID NO: 373576 - RNA, 22 nt, Homo sapiens
ugugccacugcacucccgccug

SEQ ID NO: 373577 - RNA, 22 nt, Homo sapiens
ugugccacugcacuccugccug

SEQ ID NO: 373578 - RNA, 22 nt, Homo sapiens
uguguaauaccuuugacuauau

SEQ ID NO: 373579 - RNA, 19 nt, Homo sapiens
uguugcacauaucaauaug

SEQ ID NO: 373580 - RNA, 22 nt, Homo sapiens
uuaaaagcuaucuccaagguca

SEQ ID NO: 373581 - RNA, 22 nt, Homo sapiens
uuaacagucacuuagcucauuu

SEQ ID NO: 373582 - RNA, 22 nt, Homo sapiens
uuaaucaggccguuuccuaaga

SEQ ID NO: 373583 - RNA, 21 nt, Homo sapiens
uuacaauggcuccuugaaggu

SEQ ID NO: 373584 - RNA, 22 nt, Homo sapiens
uuacagauggauggcagcuggc

SEQ ID NO: 373585 - RNA, 22 nt, Homo sapiens
uuacugcucuuuugucaugagu

SEQ ID NO: 373586 - RNA, 22 nt, Homo sapiens
uuaugucuuuuguguucagcua

SEQ ID NO: 373587 - RNA, 22 nt, Homo sapiens
uuauuagguugguggaaaagua

SEQ ID NO: 373588 - RNA, 22 nt, Homo sapiens
uuauugcacuccagccugggua

SEQ ID NO: 373589 - RNA, 22 nt, Homo sapiens
uucaagcuauggugaucuuuuc

SEQ ID NO: 373590 - RNA, 22 nt, Homo sapiens
uucacagagagaacucaaacca

SEQ ID NO: 373591 - RNA, 22 nt, Homo sapiens
uucaguauugcaccuggagucc

SEQ ID NO: 373592 - RNA, 20 nt, Homo sapiens
uucaucaggauauuggucua

SEQ ID NO: 373593 - RNA, 22 nt, Homo sapiens
uucaucaguuauauuggccuga

SEQ ID NO: 373594 - RNA, 22 nt, Homo sapiens
uuccaguugugagcuauccggg

SEQ ID NO: 373595 - RNA, 20 nt, Homo sapiens
uuccuuaggcauuggaagaa

SEQ ID NO: 373596 - RNA, 22 nt, Homo sapiens
uucuaaguaauuuugcaugccu

SEQ ID NO: 373597 - RNA, 22 nt, Homo sapiens
uucuauggucacagaugcuuga

SEQ ID NO: 373598 - RNA, 22 nt, Homo sapiens
uucuccugguggacccuaaacg

SEQ ID NO: 373599 - RNA, 22 nt, Homo sapiens
uucucuguggauugggugagag

SEQ ID NO: 373600 - RNA, 22 nt, Homo sapiens
uugaaagcuaucagagauucca

SEQ ID NO: 373601 - RNA, 22 nt, Homo sapiens
uugaaggaggugcucacucucg

SEQ ID NO: 373602 - RNA, 22 nt, Homo sapiens
uugaagugaagaacaauaucac

SEQ ID NO: 373603 - RNA, 22 nt, Homo sapiens
uugaauagaaguguugaaagug

SEQ ID NO: 373604 - RNA, 22 nt, Homo sapiens
uugacuucagagcugauucaag

SEQ ID NO: 373605 - RNA, 22 nt, Homo sapiens
uugagcaauccuccugccaugu

SEQ ID NO: 373606 - RNA, 22 nt, Homo sapiens
uugagguaauaaacagccauuc

SEQ ID NO: 373607 - RNA, 22 nt, Homo sapiens
uugaugauguuucugccuugcc

SEQ ID NO: 373608 - RNA, 22 nt, Homo sapiens
uugcaaugugaugugauuugga

SEQ ID NO: 373609 - RNA, 22 nt, Homo sapiens
uugcacauugauuuuguauccu

SEQ ID NO: 373610 - RNA, 22 nt, Homo sapiens
uugcauagaccgaugucuugga

SEQ ID NO: 373611 - RNA, 22 nt, Homo sapiens
uuggcagcauuccagccaagca

SEQ ID NO: 373612 - RNA, 21 nt, Homo sapiens
uuggggaauggagagguuuuc

SEQ ID NO: 373613 - RNA, 22 nt, Homo sapiens
uuguaaaguucucucccgaaaa

SEQ ID NO: 373614 - RNA, 22 nt, Homo sapiens
uuguaacaugcuuucacuucag

SEQ ID NO: 373615 - RNA, 22 nt, Homo sapiens
uugucuccuagacgaccaggcg

SEQ ID NO: 373616 - RNA, 22 nt, Homo sapiens
uuuauggagagauauuuauggu

SEQ ID NO: 373617 - RNA, 18 nt, Homo sapiens
uuucaagucuuaggugac

SEQ ID NO: 373618 - RNA, 19 nt, Homo sapiens
uuucaauguaaggauggag

SEQ ID NO: 373619 - RNA, 18 nt, Homo sapiens
uuugguccuuuauaaaca

SEQ ID NO: 373620 - RNA, 22 nt, Homo sapiens
uuuuuggaggagguuagaucau

SEQ ID NO: 373621 - RNA, 22 nt, Homo sapiens
aaagugcugagaguucuaacuu

SEQ ID NO: 373622 - RNA, 22 nt, Homo sapiens
aaagugcugggaucacacugaa

SEQ ID NO: 373623 - RNA, 22 nt, Homo sapiens
aaagugcugggauuaggccagg

SEQ ID NO: 373624 - RNA, 22 nt, Homo sapiens
aaagugcuuccuuuuugagggu

SEQ ID NO: 373625 - RNA, 22 nt, Homo sapiens
aaaugcagucuuuguucugggc

SEQ ID NO: 373626 - RNA, 22 nt, Homo sapiens
aaaugcauaucaagauugcccu

SEQ ID NO: 373627 - RNA, 22 nt, Homo sapiens
aacagucaauugcugaugaccu

SEQ ID NO: 373628 - RNA, 20 nt, Homo sapiens
aagacacuguccccacugga

SEQ ID NO: 373629 - RNA, 22 nt, Homo sapiens
aagagguaggaaauggucauuu

SEQ ID NO: 373630 - RNA, 22 nt, Homo sapiens
aagugcaaauucccaggcucug

SEQ ID NO: 373631 - RNA, 22 nt, Homo sapiens
aagugcucuugaaacugccuua

SEQ ID NO: 373632 - RNA, 22 nt, Homo sapiens
aaguggaauguuuguggcacaa

SEQ ID NO: 373633 - RNA, 22 nt, Homo sapiens
aauaaagcagcuuuuugggacu

SEQ ID NO: 373634 - RNA, 22 nt, Homo sapiens
aauaaagucugaagugugcuua

SEQ ID NO: 373635 - RNA, 22 nt, Homo sapiens
aauacugugauaucgagcgauu

SEQ ID NO: 373636 - RNA, 22 nt, Homo sapiens
aaucacuuugcuacaaggcagu

SEQ ID NO: 373637 - RNA, 22 nt, Homo sapiens
aauuaguugucgugagaguggu

SEQ ID NO: 373638 - RNA, 23 nt, Homo sapiens
aauugcacauuccuugcuggcag

SEQ ID NO: 373639 - RNA, 22 nt, Homo sapiens
acaccuguggucccaguaacuu

SEQ ID NO: 373640 - RNA, 22 nt, Homo sapiens
acagucacaauuuguaccuuuu

SEQ ID NO: 373641 - RNA, 22 nt, Homo sapiens
acccagaguuccuugucuuuca

SEQ ID NO: 373642 - RNA, 22 nt, Homo sapiens
acccaguagccagauguagcug

SEQ ID NO: 373643 - RNA, 22 nt, Homo sapiens
accuggcacuuagcaaaucuga

SEQ ID NO: 373644 - RNA, 22 nt, Homo sapiens
acuccauuucauuuuagcucuu

SEQ ID NO: 373645 - RNA, 22 nt, Homo sapiens
acugcacuccagccuuggcggc

SEQ ID NO: 373646 - RNA, 22 nt, Homo sapiens
acugcacuucagccuuggcuac

SEQ ID NO: 373647 - RNA, 22 nt, Homo sapiens
acugcacuucagccuugggaaa

SEQ ID NO: 373648 - RNA, 22 nt, Homo sapiens
acuggcuuauuucacuuagcau

SEQ ID NO: 373649 - RNA, 22 nt, Homo sapiens
acuucauucucuggaucagaau

SEQ ID NO: 373650 - RNA, 18 nt, Homo sapiens
agagcacugaguuuuaga

SEQ ID NO: 373651 - RNA, 22 nt, Homo sapiens
agagugcaaagguuggggcugg

SEQ ID NO: 373652 - RNA, 22 nt, Homo sapiens
agauggguuuucacauguuggc

SEQ ID NO: 373653 - RNA, 22 nt, Homo sapiens
agaugguauuauagguuucugu

SEQ ID NO: 373654 - RNA, 21 nt, Homo sapiens
agcagcuuugguugaagcaga

SEQ ID NO: 373655 - RNA, 22 nt, Homo sapiens
agccauacaacguaugcaugua

SEQ ID NO: 373656 - RNA, 21 nt, Homo sapiens
agcuaaauuggaaauuucugu

SEQ ID NO: 373657 - RNA, 22 nt, Homo sapiens
agcucuuguuaguauuagcagu

SEQ ID NO: 373658 - RNA, 22 nt, Homo sapiens
agcuggucuacguguguaugag

SEQ ID NO: 373659 - RNA, 23 nt, Homo sapiens
aggcauuguacaguaauggaaaa

SEQ ID NO: 373660 - RNA, 22 nt, Homo sapiens
aggugaaugcucacauucuaau

SEQ ID NO: 373661 - RNA, 22 nt, Homo sapiens
aguacaauguugaguagaagug

SEQ ID NO: 373662 - RNA, 22 nt, Homo sapiens
agucacagccuuuuacuuuaga

SEQ ID NO: 373663 - RNA, 22 nt, Homo sapiens
aguccauuugaugaugauucca

SEQ ID NO: 373664 - RNA, 19 nt, Homo sapiens
auaaaugccuacaagggug

SEQ ID NO: 373665 - RNA, 22 nt, Homo sapiens
auaagugagugauucaguguua

SEQ ID NO: 373666 - RNA, 22 nt, Homo sapiens
auagugcagugaugaaccuagg

SEQ ID NO: 373667 - RNA, 22 nt, Homo sapiens
auaugcauacauguaugcagga

SEQ ID NO: 373668 - RNA, 18 nt, Homo sapiens
auauugcauuggauggau

SEQ ID NO: 373669 - RNA, 22 nt, Homo sapiens
aucaaaguaucucaauauggua

SEQ ID NO: 373670 - RNA, 22 nt, Homo sapiens
aucacugugauuucuacugugc

SEQ ID NO: 373671 - RNA, 22 nt, Homo sapiens
aucucuugccagucagaauggu

SEQ ID NO: 373672 - RNA, 22 nt, Homo sapiens
augacauugaugcucuggcugg

SEQ ID NO: 373673 - RNA, 22 nt, Homo sapiens
augagauucuuagagaagucug

SEQ ID NO: 373674 - RNA, 22 nt, Homo sapiens
auggaagaaaguuggguucuug

SEQ ID NO: 373675 - RNA, 22 nt, Homo sapiens
auggaagaauugucggggaugu

SEQ ID NO: 373676 - RNA, 22 nt, Homo sapiens
auguaauguuaaauugcuaauu

SEQ ID NO: 373677 - RNA, 22 nt, Homo sapiens
auuaagugcuugcagaagucca

SEQ ID NO: 373678 - RNA, 20 nt, Homo sapiens
auucaaguaugccuugagaa

SEQ ID NO: 373679 - RNA, 22 nt, Homo sapiens
auugcagcuugcagggugugua

SEQ ID NO: 373680 - RNA, 20 nt, Homo sapiens
auuguccuugauuacacaga

SEQ ID NO: 373681 - RNA, 22 nt, Homo sapiens
auuuggguuuuacaucaggcua

SEQ ID NO: 373682 - RNA, 22 nt, Homo sapiens
auuuguccugccuuuuccuccu

SEQ ID NO: 373683 - RNA, 22 nt, Homo sapiens
caagugaauaguugcucucaga

SEQ ID NO: 373684 - RNA, 22 nt, Homo sapiens
cacaaaguagauuagucuucca

SEQ ID NO: 373685 - RNA, 22 nt, Homo sapiens
cagagguauugcaaaagccuag

SEQ ID NO: 373686 - RNA, 22 nt, Homo sapiens
cagcagguuuuuaucaguuaag

SEQ ID NO: 373687 - RNA, 22 nt, Homo sapiens
caucacaugcuuauuuuccuca

SEQ ID NO: 373688 - RNA, 22 nt, Homo sapiens
caucagagugagauauaagauc

SEQ ID NO: 373689 - RNA, 22 nt, Homo sapiens
caugucuuuuaaacauucaacu

SEQ ID NO: 373690 - RNA, 22 nt, Homo sapiens
cauugcaacuucugccucccag

SEQ ID NO: 373691 - RNA, 22 nt, Homo sapiens
cauugcacacauuuaccuaugu

SEQ ID NO: 373692 - RNA, 19 nt, Homo sapiens
cauugcacuccacccuggg

SEQ ID NO: 373693 - RNA, 22 nt, Homo sapiens
cauugcacuccagcccuggcaa

SEQ ID NO: 373694 - RNA, 22 nt, Homo sapiens
cauugcacuccagccuagccaa

SEQ ID NO: 373695 - RNA, 22 nt, Homo sapiens
cauugcacuccagccuuggcaa

SEQ ID NO: 373696 - RNA, 22 nt, Homo sapiens
cauugcacuccagccuugguga

SEQ ID NO: 373697 - RNA, 22 nt, Homo sapiens
cauugcacuccagcuugggcga

SEQ ID NO: 373698 - RNA, 22 nt, Homo sapiens
cauugcacuccagucugggcaa

SEQ ID NO: 373699 - RNA, 22 nt, Homo sapiens
cauugcacuccaucccgggaaa

SEQ ID NO: 373700 - RNA, 22 nt, Homo sapiens
cauugcacuccauccuuggcaa

SEQ ID NO: 373701 - RNA, 22 nt, Homo sapiens
cauugcacucuagccucggcaa

SEQ ID NO: 373702 - RNA, 22 nt, Homo sapiens
cauugcacucuagucuggguga

SEQ ID NO: 373703 - RNA, 22 nt, Homo sapiens
cauugcacugcagcccgggcaa

SEQ ID NO: 373704 - RNA, 22 nt, Homo sapiens
cauugcacuuagacaacuuuug

SEQ ID NO: 373705 - RNA, 19 nt, Homo sapiens
ccauggcaaugaucugaug

SEQ ID NO: 373706 - RNA, 21 nt, Homo sapiens
ccauggcaaugguaaacugac

SEQ ID NO: 373707 - RNA, 22 nt, Homo sapiens
cccagagacagaaugauaaacu

SEQ ID NO: 373708 - RNA, 22 nt, Homo sapiens
cccaguuuugcuucucaugagg

SEQ ID NO: 373709 - RNA, 22 nt, Homo sapiens
cccugagagcagggucuuucuc

SEQ ID NO: 373710 - RNA, 22 nt, Homo sapiens
uauuccuuuugcauuuccacau

SEQ ID NO: 373711 - RNA, 20 nt, Homo sapiens
uauugcacuccagucugggc

SEQ ID NO: 373712 - RNA, 22 nt, Homo sapiens
uauugcucaugcauuuaauuuc

SEQ ID NO: 373713 - RNA, 22 nt, Homo sapiens
ucacacugaauuugaagcaaug

SEQ ID NO: 373714 - RNA, 22 nt, Homo sapiens
ucacaguucagcauggcugagg

SEQ ID NO: 373715 - RNA, 22 nt, Homo sapiens
ucacuuugacggccaacuucua

SEQ ID NO: 373716 - RNA, 22 nt, Homo sapiens
ucagacacugagcaaacgacua

SEQ ID NO: 373717 - RNA, 22 nt, Homo sapiens
ucagacacuguggccuuuggac

SEQ ID NO: 373718 - RNA, 22 nt, Homo sapiens
ucaggcaccuuccucuuaucug

SEQ ID NO: 373719 - RNA, 18 nt, Homo sapiens
ucagucacugccuggcuu

SEQ ID NO: 373720 - RNA, 22 nt, Homo sapiens
ucaguguuuggaaucucaauuu

SEQ ID NO: 373721 - RNA, 22 nt, Homo sapiens
ucaucagaguuuacaagcucag

SEQ ID NO: 373722 - RNA, 22 nt, Homo sapiens
ucaucagugcuugcaaauuauu

SEQ ID NO: 373723 - RNA, 20 nt, Homo sapiens
uccaguuuuggagacauucu

SEQ ID NO: 373724 - RNA, 22 nt, Homo sapiens
uccaguuuuguuaacauauggu

SEQ ID NO: 373725 - RNA, 22 nt, Homo sapiens
ucgcgccauucuccugccucag

SEQ ID NO: 373726 - RNA, 22 nt, Homo sapiens
ucuagccuaugaagcuugucca

SEQ ID NO: 373727 - RNA, 22 nt, Homo sapiens
ucuggcuugugaacugucuucu

SEQ ID NO: 373728 - RNA, 22 nt, Homo sapiens
ugaaguaauguuuuauucuauu

SEQ ID NO: 373729 - RNA, 22 nt, Homo sapiens
ugacaugaugagcaauaauggc

SEQ ID NO: 373730 - RNA, 18 nt, Homo sapiens
ugacuguccagguggacc

SEQ ID NO: 373731 - RNA, 22 nt, Homo sapiens
ugagacauauuauacugcuuuu

SEQ ID NO: 373732 - RNA, 22 nt, Homo sapiens
ugagacgaagucuugcucuguu

SEQ ID NO: 373733 - RNA, 22 nt, Homo sapiens
ugagauaauuuacuuguugagg

SEQ ID NO: 373734 - RNA, 22 nt, Homo sapiens
ugagauaggaucuugcucuguu

SEQ ID NO: 373735 - RNA, 22 nt, Homo sapiens
ugagaucacuaagagguaaugg

SEQ ID NO: 373736 - RNA, 22 nt, Homo sapiens
ugagauuguaucugcaaugugu

SEQ ID NO: 373737 - RNA, 22 nt, Homo sapiens
ugaguucuuuguagauucugug

SEQ ID NO: 373738 - RNA, 19 nt, Homo sapiens
ugcaaauucuaaaaacuga

SEQ ID NO: 373739 - RNA, 22 nt, Homo sapiens
ugcauccauucuagacucaucu

SEQ ID NO: 373740 - RNA, 22 nt, Homo sapiens
ugccuaguagaaggugaacaug

SEQ ID NO: 373741 - RNA, 22 nt, Homo sapiens
ugccuaguggaaggagagcaaa

SEQ ID NO: 373742 - RNA, 22 nt, Homo sapiens
uggcaagauuguuccgguuugg

SEQ ID NO: 373743 - RNA, 22 nt, Homo sapiens
uggucaccugaauuaugcaugu

SEQ ID NO: 373744 - RNA, 22 nt, Homo sapiens
uggucaccuucuugcucugucu

SEQ ID NO: 373745 - RNA, 22 nt, Homo sapiens
ugugaacacagaggcuauggca

SEQ ID NO: 373746 - RNA, 22 nt, Homo sapiens
ugugaagauggacuaauauagu

SEQ ID NO: 373747 - RNA, 20 nt, Homo sapiens
ugugauuauuuaguugcaug

SEQ ID NO: 373748 - RNA, 22 nt, Homo sapiens
ugugccacuccagcucuagcuu

SEQ ID NO: 373749 - RNA, 18 nt, Homo sapiens
uguugguguucacucacu

SEQ ID NO: 373750 - RNA, 22 nt, Homo sapiens
uuacuguauagaaucaucuuga

SEQ ID NO: 373751 - RNA, 22 nt, Homo sapiens
uuagucaaguguacugugaaug

SEQ ID NO: 373752 - RNA, 22 nt, Homo sapiens
uuauuagguuagugcaaaaguu

SEQ ID NO: 373753 - RNA, 23 nt, Homo sapiens
uucaccguguuggccaggcuggu

SEQ ID NO: 373754 - RNA, 22 nt, Homo sapiens
uucaguccauuuccuuggucac

SEQ ID NO: 373755 - RNA, 22 nt, Homo sapiens
uucauaguaacaguaacuaugg

SEQ ID NO: 373756 - RNA, 22 nt, Homo sapiens
uucauagucuaugcaaguaaga

SEQ ID NO: 373757 - RNA, 22 nt, Homo sapiens
uucauaguucuuuuagucauua

SEQ ID NO: 373758 - RNA, 22 nt, Homo sapiens
uucaucaguugagcugguugcu

SEQ ID NO: 373759 - RNA, 22 nt, Homo sapiens
uucauggaacaaguggguucaa

SEQ ID NO: 373760 - RNA, 22 nt, Homo sapiens
uucauggaauauugaccauuuu

SEQ ID NO: 373761 - RNA, 22 nt, Homo sapiens
uucaugucuuggcuguuagagu

SEQ ID NO: 373762 - RNA, 20 nt, Homo sapiens
uuccagcacauuagggaagc

SEQ ID NO: 373763 - RNA, 22 nt, Homo sapiens
uuccaguguguucauccucaga

SEQ ID NO: 373764 - RNA, 22 nt, Homo sapiens
uucuggccccucccaaucucau

SEQ ID NO: 373765 - RNA, 18 nt, Homo sapiens
uucuuguguugauauuuu

SEQ ID NO: 373766 - RNA, 22 nt, Homo sapiens
uugaaguagaaagacgaaauuu

SEQ ID NO: 373767 - RNA, 22 nt, Homo sapiens
uugaauagaagguuuuuuguuc

SEQ ID NO: 373768 - RNA, 18 nt, Homo sapiens
uugaauaguguccaaucu

SEQ ID NO: 373769 - RNA, 22 nt, Homo sapiens
uugagacggaguuuugcucuug

SEQ ID NO: 373770 - RNA, 22 nt, Homo sapiens
uugagauaggagcuguuguucu

SEQ ID NO: 373771 - RNA, 22 nt, Homo sapiens
uugagauuuuccucaaauauuu

SEQ ID NO: 373772 - RNA, 22 nt, Homo sapiens
uugaggaaugucauuuguguuu

SEQ ID NO: 373773 - RNA, 22 nt, Homo sapiens
uugcacauuuuuucuggcagaa

SEQ ID NO: 373774 - RNA, 22 nt, Homo sapiens
uugccuaggcuggagugcagua

SEQ ID NO: 373775 - RNA, 22 nt, Homo sapiens
uugccuaggcuggauugcagug

SEQ ID NO: 373776 - RNA, 22 nt, Homo sapiens
uuggaagacaaugcugauucuc

SEQ ID NO: 373777 - RNA, 22 nt, Homo sapiens
uuggcaacauagugagaccccc

SEQ ID NO: 373778 - RNA, 22 nt, Homo sapiens
uuggcaaguccccaccucucuc

SEQ ID NO: 373779 - RNA, 22 nt, Homo sapiens
uuggcagcuguggaaucugggc

SEQ ID NO: 373780 - RNA, 22 nt, Homo sapiens
uuggccagugucuuuuuuuccu

SEQ ID NO: 373781 - RNA, 22 nt, Homo sapiens
uuguaaucaacacaucauuggg

SEQ ID NO: 373782 - RNA, 22 nt, Homo sapiens
uuguacuuuuaguagagacggg

SEQ ID NO: 373783 - RNA, 22 nt, Homo sapiens
uugugaucauugucaaauagug

SEQ ID NO: 373784 - RNA, 22 nt, Homo sapiens
uuucaagugcugucuuagcugu

SEQ ID NO: 373785 - RNA, 22 nt, Homo sapiens
uuugguaguuuguugggaccca

SEQ ID NO: 373786 - RNA, 22 nt, Homo sapiens
uuuguccccgcccagaucucau

SEQ ID NO: 373787 - RNA, 22 nt, Homo sapiens
uuugucccucucaccaacgggg

SEQ ID NO: 373788 - RNA, 22 nt, Homo sapiens
uuugucccuuugcaguggcaca

SEQ ID NO: 373789 - RNA, 22 nt, Homo sapiens
uuuugcaccauccuaauaguau

SEQ ID NO: 373790 - RNA, 22 nt, Homo sapiens
cuaugucuuucauauuuugggg

SEQ ID NO: 373791 - RNA, 22 nt, Homo sapiens
cucacugucaacauguauuugg

SEQ ID NO: 373792 - RNA, 22 nt, Homo sapiens
cuccauuuggaacagauguccu

SEQ ID NO: 373793 - RNA, 22 nt, Homo sapiens
cugccacugacaccucaaggac

SEQ ID NO: 373794 - RNA, 22 nt, Homo sapiens
cuggaagaaaaucacgccaucu

SEQ ID NO: 373795 - RNA, 22 nt, Homo sapiens
cuggccagagacauucauuaaa

SEQ ID NO: 373796 - RNA, 18 nt, Homo sapiens
cuuaacauugggaugaua

SEQ ID NO: 373797 - RNA, 22 nt, Homo sapiens
cuucaaguguggccaccugacc

SEQ ID NO: 373798 - RNA, 21 nt, Homo sapiens
gaccacagcagggaaugucag

SEQ ID NO: 373799 - RNA, 23 nt, Homo sapiens
gagaccagcuucagaaagcacga

SEQ ID NO: 373800 - RNA, 22 nt, Homo sapiens
gagacugagucuugcucugucg

SEQ ID NO: 373801 - RNA, 21 nt, Homo sapiens
gagguaccucauguaagugga

SEQ ID NO: 373802 - RNA, 22 nt, Homo sapiens
gauggcacuuaagagcaagagc

SEQ ID NO: 373803 - RNA, 22 nt, Homo sapiens
gcacauauguaaauagcugccu

SEQ ID NO: 373804 - RNA, 22 nt, Homo sapiens
gcagagaaacaggucuaaggag

SEQ ID NO: 373805 - RNA, 22 nt, Homo sapiens
gcaggcaugacauuucacucuu

SEQ ID NO: 373806 - RNA, 22 nt, Homo sapiens
gcauggccuuuaaaugucacag

SEQ ID NO: 373807 - RNA, 22 nt, Homo sapiens
gcugcacuuuaaggcauccccu

SEQ ID NO: 373808 - RNA, 22 nt, Homo sapiens
gcuggaauuaacauagaugugc

SEQ ID NO: 373809 - RNA, 23 nt, Homo sapiens
ggaguguaaugacucgaucucgg

SEQ ID NO: 373810 - RNA, 23 nt, Homo sapiens
ggaguguauuggcacgaucucag

SEQ ID NO: 373811 - RNA, 19 nt, Homo sapiens
ggucacagggguuacaagg

SEQ ID NO: 373812 - RNA, 22 nt, Homo sapiens
guaaucucagcuacucgggaga

SEQ ID NO: 373813 - RNA, 22 nt, Homo sapiens
guaaucucagcuacuugggagg

SEQ ID NO: 373814 - RNA, 22 nt, Homo sapiens
guaugucuugucuauggcugcu

SEQ ID NO: 373815 - RNA, 22 nt, Homo sapiens
gucacuguggagaagaaagugg

SEQ ID NO: 373816 - RNA, 22 nt, Homo sapiens
gucaucaggacgggucaucugc

SEQ ID NO: 373817 - RNA, 22 nt, Homo sapiens
gucuggcuuaucucacuuacca

SEQ ID NO: 373818 - RNA, 22 nt, Homo sapiens
gugcaaauuccagcucaacucc

SEQ ID NO: 373819 - RNA, 22 nt, Homo sapiens
gugcacauuguuuaugucuguu

SEQ ID NO: 373820 - RNA, 22 nt, Homo sapiens
guggaauggaaugauuguguau

SEQ ID NO: 373821 - RNA, 22 nt, Homo sapiens
guggacaugaauuuuggaggca

SEQ ID NO: 373822 - RNA, 22 nt, Homo sapiens
gugggcucguucguguuagaca

SEQ ID NO: 373823 - RNA, 22 nt, Homo sapiens
gugucucagcccagaccuauuu

SEQ ID NO: 373824 - RNA, 22 nt, Homo sapiens
guucaagugauucuacugccuc

SEQ ID NO: 373825 - RNA, 20 nt, Homo sapiens
guucacaggcuuccuuucag

SEQ ID NO: 373826 - RNA, 22 nt, Homo sapiens
guugcucaggcuggagugcagu

SEQ ID NO: 373827 - RNA, 22 nt, Homo sapiens
uaacagcucuacagcugcucuu

SEQ ID NO: 373828 - RNA, 22 nt, Homo sapiens
uaacauagucauauacuugcuu

SEQ ID NO: 373829 - RNA, 22 nt, Homo sapiens
uaaguaaaugaaagguugauuu

SEQ ID NO: 373830 - RNA, 23 nt, Homo sapiens
uaagucacacagauuaauuuauu

SEQ ID NO: 373831 - RNA, 22 nt, Homo sapiens
uaagucacuccagguuaaagug

SEQ ID NO: 373832 - RNA, 22 nt, Homo sapiens
uaagugaauauggacaguuagc

SEQ ID NO: 373833 - RNA, 22 nt, Homo sapiens
uaagugaauuugacagguaaug

SEQ ID NO: 373834 - RNA, 22 nt, Homo sapiens
uuggccauaugacuugcuuugg

SEQ ID NO: 373835 - RNA, 22 nt, Homo sapiens
uugucacccuacauaacaggga

SEQ ID NO: 373836 - RNA, 22 nt, Homo sapiens
uuguguacuacaguaugccaca

SEQ ID NO: 373837 - RNA, 22 nt, Homo sapiens
uuuaaagcaugacgagaagaag

SEQ ID NO: 373838 - RNA, 22 nt, Homo sapiens
uuuaucuguuuaaaacuguuca

SEQ ID NO: 373839 - RNA, 22 nt, Homo sapiens
uuugcuauagugaauagugcug

SEQ ID NO: 373840 - RNA, 17 nt, Homo sapiens
uuuuggauuagaaaucc

SEQ ID NO: 373841 - RNA, 22 nt, Homo sapiens
uuuuuggauaaugguacaugua

SEQ ID NO: 373842 - RNA, 22 nt, Homo sapiens
aaaugacuuuuuaugcagagua

SEQ ID NO: 373843 - RNA, 22 nt, Homo sapiens
aaugacugugauauuuuucuuc

SEQ ID NO: 373844 - RNA, 22 nt, Homo sapiens
acauggcacugcgggcuucuug

SEQ ID NO: 373845 - RNA, 22 nt, Homo sapiens
acugcacuccaaccuguugggc

SEQ ID NO: 373846 - RNA, 18 nt, Homo sapiens
acugcacuccaccuuggg

SEQ ID NO: 373847 - RNA, 22 nt, Homo sapiens
acugcacuccagcccgggugac

SEQ ID NO: 373848 - RNA, 22 nt, Homo sapiens
acugcacuccagccuccugaca

SEQ ID NO: 373849 - RNA, 22 nt, Homo sapiens
acugcacuccagccucggugac

SEQ ID NO: 373850 - RNA, 22 nt, Homo sapiens
acugcacuccagccugagccug

SEQ ID NO: 373851 - RNA, 22 nt, Homo sapiens
acugcacuccagccugcugaca

SEQ ID NO: 373852 - RNA, 22 nt, Homo sapiens
acugcacuccagccugcuggca

SEQ ID NO: 373853 - RNA, 22 nt, Homo sapiens
acugcacuccagccugugcgua

SEQ ID NO: 373854 - RNA, 22 nt, Homo sapiens
acugcacuccagccuguugaca

SEQ ID NO: 373855 - RNA, 22 nt, Homo sapiens
acugcacuccagccuucggaca

SEQ ID NO: 373856 - RNA, 22 nt, Homo sapiens
acugcacuccagccuugcgaca

SEQ ID NO: 373857 - RNA, 22 nt, Homo sapiens
acugcacuccagccuuggcggc

SEQ ID NO: 373858 - RNA, 22 nt, Homo sapiens
acugcacuccagcuugggugac

SEQ ID NO: 373859 - RNA, 22 nt, Homo sapiens
acugcacuccagcuuuggguga

SEQ ID NO: 373860 - RNA, 20 nt, Homo sapiens
acugcacuccaggcugccca

SEQ ID NO: 373861 - RNA, 20 nt, Homo sapiens
acugcacuccagucucuggg

SEQ ID NO: 373862 - RNA, 22 nt, Homo sapiens
acugcacucuagccccugcgac

SEQ ID NO: 373863 - RNA, 22 nt, Homo sapiens
acugcacuucaaccucauugac

SEQ ID NO: 373864 - RNA, 22 nt, Homo sapiens
acugcacuucagccuguugaca

SEQ ID NO: 373865 - RNA, 22 nt, Homo sapiens
acugcacuucagccuuggcuac

SEQ ID NO: 373866 - RNA, 22 nt, Homo sapiens
acugcacuucagccuugggaaa

SEQ ID NO: 373867 - RNA, 22 nt, Homo sapiens
auugcacuccagcuuaggcgac

SEQ ID NO: 373868 - RNA, 22 nt, Homo sapiens
cuagguagcuuuucugucaugu

SEQ ID NO: 373869 - RNA, 22 nt, Homo sapiens
gcacauggccacuaggaauaaa

SEQ ID NO: 373870 - RNA, 22 nt, Homo sapiens
gucuuuguuuggucuguaucag

SEQ ID NO: 373871 - RNA, 22 nt, Homo sapiens
uagguagguggaaaaguaauug

SEQ ID NO: 373872 - RNA, 22 nt, Homo sapiens
uaggucuuuuagcauaggagcu

SEQ ID NO: 373873 - RNA, 22 nt, Homo sapiens
ugaaaugaucaguuugguuacu

SEQ ID NO: 373874 - RNA, 22 nt, Homo sapiens
ugacuggaacuuuagugagucu

SEQ ID NO: 373875 - RNA, 18 nt, Homo sapiens
uuagguaggucuuugugu

SEQ ID NO: 373876 - RNA, 22 nt, Homo sapiens
uugcaaacaucuuguuucacau

SEQ ID NO: 373877 - RNA, 22 nt, Homo sapiens
uuuguagcucacucugagcuga

SEQ ID NO: 373878 - RNA, 22 nt, Homo sapiens
aaggagcagagagcccuguuuc

SEQ ID NO: 373879 - RNA, 22 nt, Homo sapiens
aaggagcaguggacggguccua

SEQ ID NO: 373880 - RNA, 19 nt, Homo sapiens
aauauugacaguggugucu

SEQ ID NO: 373881 - RNA, 22 nt, Homo sapiens
acugcacuccagcccaggugac

SEQ ID NO: 373882 - RNA, 22 nt, Homo sapiens
acugcacuccagccuccugggu

SEQ ID NO: 373883 - RNA, 22 nt, Homo sapiens
acugcacuccagccucgugaca

SEQ ID NO: 373884 - RNA, 22 nt, Homo sapiens
acugcacuccagccugccgaca

SEQ ID NO: 373885 - RNA, 22 nt, Homo sapiens
acugcacuccagccugcuggau

SEQ ID NO: 373886 - RNA, 22 nt, Homo sapiens
acugcacuccagccuggaccac

SEQ ID NO: 373887 - RNA, 22 nt, Homo sapiens
acugcacuccagccuggacgaa

SEQ ID NO: 373888 - RNA, 22 nt, Homo sapiens
acugcacuccagccuucgugac

SEQ ID NO: 373889 - RNA, 22 nt, Homo sapiens
acugcacuccagccuugugaca

SEQ ID NO: 373890 - RNA, 22 nt, Homo sapiens
acugcacuccaucuuagguggc

SEQ ID NO: 373891 - RNA, 22 nt, Homo sapiens
acugcacuccggccucgugaca

SEQ ID NO: 373892 - RNA, 22 nt, Homo sapiens
acugcacucuagcauggguaau

SEQ ID NO: 373893 - RNA, 20 nt, Homo sapiens
acugcacuucagccugcugg

SEQ ID NO: 373894 - RNA, 22 nt, Homo sapiens
acugcacuccaaccuuggugac

SEQ ID NO: 373895 - RNA, 20 nt, Homo sapiens
acugcacuccaaccuuugug

SEQ ID NO: 373896 - RNA, 22 nt, Homo sapiens
acugcacuccagacucugucuc

SEQ ID NO: 373897 - RNA, 22 nt, Homo sapiens
acugcacuccagccucggggac

SEQ ID NO: 373898 - RNA, 22 nt, Homo sapiens
acugcacuccagccucguggac

SEQ ID NO: 373899 - RNA, 22 nt, Homo sapiens
acugcacuccagccugaugaaa

SEQ ID NO: 373900 - RNA, 22 nt, Homo sapiens
acugcacuccagccugcugggu

SEQ ID NO: 373901 - RNA, 22 nt, Homo sapiens
acugcacuccagccugugagac

SEQ ID NO: 373902 - RNA, 22 nt, Homo sapiens
acugcacuccagccuuagugac

SEQ ID NO: 373903 - RNA, 22 nt, Homo sapiens
acugcacuccagccuugauggc

SEQ ID NO: 373904 - RNA, 22 nt, Homo sapiens
acugcacuccagccuuggagac

SEQ ID NO: 373905 - RNA, 22 nt, Homo sapiens
acugcacuccagccuuggccac

SEQ ID NO: 373906 - RNA, 22 nt, Homo sapiens
acugcacuccagccuuugcgau

SEQ ID NO: 373907 - RNA, 22 nt, Homo sapiens
acugcacuccagcuuuggugac

SEQ ID NO: 373908 - RNA, 22 nt, Homo sapiens
acugcacuccaguuccgggcaa

SEQ ID NO: 373909 - RNA, 22 nt, Homo sapiens
acugcacucccgcccgggugac

SEQ ID NO: 373910 - RNA, 22 nt, Homo sapiens
acugcacuccggccuggcaaca

SEQ ID NO: 373911 - RNA, 22 nt, Homo sapiens
acugcacuccuccuugggugac

SEQ ID NO: 373912 - RNA, 22 nt, Homo sapiens
acugcacucuagccuuggcaac

SEQ ID NO: 373913 - RNA, 22 nt, Homo sapiens
acugcacucuagcuugggugac

SEQ ID NO: 373914 - RNA, 22 nt, Homo sapiens
acugcacugucaaccuccuggg

SEQ ID NO: 373915 - RNA, 22 nt, Homo sapiens
acugcacuguccuagaguccuc

SEQ ID NO: 373916 - RNA, 22 nt, Homo sapiens
acugcacuucagccuuggggac

SEQ ID NO: 373917 - RNA, 22 nt, Homo sapiens
agaaagugcuucccuuugguga

SEQ ID NO: 373918 - RNA, 21 nt, Homo sapiens
aggagcauucaugacgagguu

SEQ ID NO: 373919 - RNA, 21 nt, Homo sapiens
aggagcauucucuugcuuugu

SEQ ID NO: 373920 - RNA, 20 nt, Homo sapiens
aggagcauuuacauuggcuc

SEQ ID NO: 373921 - RNA, 22 nt, Homo sapiens
agguagguugagaugggcauca

SEQ ID NO: 373922 - RNA, 22 nt, Homo sapiens
auggcaagaagagcaauuauuu

SEQ ID NO: 373923 - RNA, 22 nt, Homo sapiens
caaggaauucucaauagaguua

SEQ ID NO: 373924 - RNA, 22 nt, Homo sapiens
gucuuuguuauuaugaaucaac

SEQ ID NO: 373925 - RNA, 21 nt, Homo sapiens
acugcacuccaaccucaacag

SEQ ID NO: 373926 - RNA, 19 nt, Homo sapiens
acugcacuccaaccuccug

SEQ ID NO: 373927 - RNA, 22 nt, Homo sapiens
acugcacuccacccuuggcagc

SEQ ID NO: 373928 - RNA, 22 nt, Homo sapiens
acugcacuccaccuugggcaac

SEQ ID NO: 373929 - RNA, 22 nt, Homo sapiens
acugcacuccagccuaggcgac

SEQ ID NO: 373930 - RNA, 22 nt, Homo sapiens
acugcacuccagccucaugaca

SEQ ID NO: 373931 - RNA, 22 nt, Homo sapiens
acugcacuccagccucccgucu

SEQ ID NO: 373932 - RNA, 22 nt, Homo sapiens
acugcacuccagccucgcaaca

SEQ ID NO: 373933 - RNA, 22 nt, Homo sapiens
acugcacuccagccucggcaau

SEQ ID NO: 373934 - RNA, 22 nt, Homo sapiens
acugcacuccagccugcccaac

SEQ ID NO: 373935 - RNA, 22 nt, Homo sapiens
acugcacuccagccuggacgac

SEQ ID NO: 373936 - RNA, 22 nt, Homo sapiens
acugcacuccagccuggcggac

SEQ ID NO: 373937 - RNA, 22 nt, Homo sapiens
acugcacuccagccuucaggac

SEQ ID NO: 373938 - RNA, 20 nt, Homo sapiens
acugcacuccagccuuccag

SEQ ID NO: 373939 - RNA, 22 nt, Homo sapiens
acugcacuccagccuugagagc

SEQ ID NO: 373940 - RNA, 22 nt, Homo sapiens
acugcacuccagccuuggcaac

SEQ ID NO: 373941 - RNA, 22 nt, Homo sapiens
acugcacuccagcuccagggug

SEQ ID NO: 373942 - RNA, 22 nt, Homo sapiens
acugcacuccaguuugggcagc

SEQ ID NO: 373943 - RNA, 18 nt, Homo sapiens
acugcacuccauccuagg

SEQ ID NO: 373944 - RNA, 19 nt, Homo sapiens
acugcacuccuccuugggu

SEQ ID NO: 373945 - RNA, 22 nt, Homo sapiens
acugcacugcagccuggccaac

SEQ ID NO: 373946 - RNA, 22 nt, Homo sapiens
acugcacuuauccuccaauguu

SEQ ID NO: 373947 - RNA, 22 nt, Homo sapiens
acugcacuucagccuugugaca

SEQ ID NO: 373948 - RNA, 18 nt, Homo sapiens
aggagcauagugcuauga

SEQ ID NO: 373949 - RNA, 22 nt, Homo sapiens
ggcaaggaggggcacuuucacu

SEQ ID NO: 373950 - RNA, 22 nt, Homo sapiens
ggcaaggauguuuuucuggcaa

SEQ ID NO: 373951 - RNA, 22 nt, Homo sapiens
uagguaggaaguguuguuuuua

SEQ ID NO: 373952 - RNA, 22 nt, Homo sapiens
uagguaggauagucuuuauuuu

SEQ ID NO: 373953 - RNA, 22 nt, Homo sapiens
uaggucuuuuaugaaauauauu

SEQ ID NO: 373954 - RNA, 22 nt, Homo sapiens
ugaaaugauuauaugguguuug

SEQ ID NO: 373955 - RNA, 22 nt, Homo sapiens
uuaaaaguauaggccuggcaua

SEQ ID NO: 373956 - RNA, 22 nt, Homo sapiens
uugacuguaagauggcuauuac

SEQ ID NO: 373957 - RNA, 23 nt, Homo sapiens
uugacuguggguacaaugugaua

SEQ ID NO: 373958 - RNA, 23 nt, Homo sapiens
uuuaguccccuaugagcuggugu

SEQ ID NO: 373959 - RNA, 21 nt, Homo sapiens
aggagcauuguugugguggag

SEQ ID NO: 373960 - RNA, 22 nt, Homo sapiens
auggaaggagaggaaugaauga

SEQ ID NO: 373961 - RNA, 17 nt, Homo sapiens
ggaaugaauuccagccc

SEQ ID NO: 373962 - RNA, 23 nt, Homo sapiens
ggacuguaagggauauaaagguu

SEQ ID NO: 373963 - RNA, 22 nt, Homo sapiens
ggcaaggauuagauucuccccu

SEQ ID NO: 373964 - RNA, 22 nt, Homo sapiens
gucuuuguuuugauuuaccaga

SEQ ID NO: 373965 - RNA, 20 nt, Homo sapiens
uaggagcaaugagaguagaa

SEQ ID NO: 373966 - RNA, 22 nt, Homo sapiens
uaggccuuuuuaugucaauauc

SEQ ID NO: 373967 - RNA, 22 nt, Homo sapiens
uagguaggacguaguccuuuug

SEQ ID NO: 373968 - RNA, 22 nt, Homo sapiens
uagguaggugucauaauccaug

SEQ ID NO: 373969 - RNA, 22 nt, Homo sapiens
uuaguccacuggaacuguuaua

SEQ ID NO: 373970 - RNA, 22 nt, Homo sapiens
uuuguagcuacaaagugagaug

SEQ ID NO: 373971 - RNA, 22 nt, Homo sapiens
gugaaaagaugagcaccauaca

SEQ ID NO: 373972 - RNA, 22 nt, Homo sapiens
uaugacugagacuuaaauugug

SEQ ID NO: 373973 - RNA, 22 nt, Homo sapiens
ucugagguuacugcuuuguaga

SEQ ID NO: 373974 - RNA, 22 nt, Homo sapiens
ugauaauguuaggcuuuauuca

SEQ ID NO: 373975 - RNA, 22 nt, Homo sapiens
uuauuagcacccuaccaugugg

SEQ ID NO: 373976 - RNA, 22 nt, Homo sapiens
uugacugugguaauggaagcug

SEQ ID NO: 373977 - RNA, 22 nt, Homo sapiens
uuuaguccucugaaaaucuaua

SEQ ID NO: 373978 - RNA, 18 nt, Homo sapiens
aaaaagugcucaggccua

SEQ ID NO: 373979 - RNA, 22 nt, Homo sapiens
aaagcacugaauaaauuugcuu

SEQ ID NO: 373980 - RNA, 19 nt, Homo sapiens
aaaguacucugaugccucu

SEQ ID NO: 373981 - RNA, 17 nt, Homo sapiens
aaaguccuuugcuaucu

SEQ ID NO: 373982 - RNA, 22 nt, Homo sapiens
aaagugauguccaggcuuucag

SEQ ID NO: 373983 - RNA, 22 nt, Homo sapiens
aaagugcaguacuucguauauu

SEQ ID NO: 373984 - RNA, 22 nt, Homo sapiens
aaagugcugggauuggcugggc

SEQ ID NO: 373985 - RNA, 22 nt, Homo sapiens
aaagugcuuacuaaguugccaa

SEQ ID NO: 373986 - RNA, 22 nt, Homo sapiens
aaauccauuuguucagcuaugc

SEQ ID NO: 373987 - RNA, 22 nt, Homo sapiens
aaaugcaccacucuggugcagg

SEQ ID NO: 373988 - RNA, 22 nt, Homo sapiens
aaaugcucuuuaugaaguugga

SEQ ID NO: 373989 - RNA, 22 nt, Homo sapiens
aaauugcacaaguggugauuug

SEQ ID NO: 373990 - RNA, 22 nt, Homo sapiens
aacagaauccucuuuuccuggg

SEQ ID NO: 373991 - RNA, 22 nt, Homo sapiens
aacagucuccaguuguauccau

SEQ ID NO: 373992 - RNA, 22 nt, Homo sapiens
aacugcacauauuuguaugggu

SEQ ID NO: 373993 - RNA, 22 nt, Homo sapiens
aagaugcagucauacuggagua

SEQ ID NO: 373994 - RNA, 21 nt, Homo sapiens
aagcaugguguaucuuuccau

SEQ ID NO: 373995 - RNA, 22 nt, Homo sapiens
aagccagugugacaggaaacuu

SEQ ID NO: 373996 - RNA, 22 nt, Homo sapiens
aagcugcauuuucuagaugcuu

SEQ ID NO: 373997 - RNA, 22 nt, Homo sapiens
aagcuggagugcaguggugcga

SEQ ID NO: 373998 - RNA, 23 nt, Homo sapiens
aaggacacugaacacuucccagc

SEQ ID NO: 373999 - RNA, 22 nt, Homo sapiens
aaggcucuuucaacguaaauua

SEQ ID NO: 374000 - RNA, 20 nt, Homo sapiens
aaggcuuucgaguuccaggg

SEQ ID NO: 374001 - RNA, 22 nt, Homo sapiens
aagguauuucuaugggaauaga

SEQ ID NO: 374002 - RNA, 22 nt, Homo sapiens
aaguacuguuuaaauugcagaa

SEQ ID NO: 374003 - RNA, 19 nt, Homo sapiens
aaguacuugucuuuugaag

SEQ ID NO: 374004 - RNA, 22 nt, Homo sapiens
aagucacugagacuuguggcug

SEQ ID NO: 374005 - RNA, 22 nt, Homo sapiens
aagucaguuugggagaagcuau

SEQ ID NO: 374006 - RNA, 20 nt, Homo sapiens
aagugcaucguugugucugc

SEQ ID NO: 374007 - RNA, 22 nt, Homo sapiens
aagugcuucagaagacaauauu

SEQ ID NO: 374008 - RNA, 22 nt, Homo sapiens
aauaaagcagcuuuuugggacu

SEQ ID NO: 374009 - RNA, 22 nt, Homo sapiens
aauaaagcaggguccuugcacu

SEQ ID NO: 374010 - RNA, 22 nt, Homo sapiens
aauaaagcuuugagcuuugcug

SEQ ID NO: 374011 - RNA, 20 nt, Homo sapiens
aauaacagccccagggaggu

SEQ ID NO: 374012 - RNA, 22 nt, Homo sapiens
aauacugagaugugagguacua

SEQ ID NO: 374013 - RNA, 22 nt, Homo sapiens
aaucuguagaaggugcacauuc

SEQ ID NO: 374014 - RNA, 22 nt, Homo sapiens
aaugcacauauauuuccuuauu

SEQ ID NO: 374015 - RNA, 22 nt, Homo sapiens
aaugccacugugccugccaagg

SEQ ID NO: 374016 - RNA, 19 nt, Homo sapiens
aauggcuuuuccuguuccc

SEQ ID NO: 374017 - RNA, 22 nt, Homo sapiens
aaugguguuuccguuaagcuga

SEQ ID NO: 374018 - RNA, 22 nt, Homo sapiens
aaugguuuuaucagcguccaaa

SEQ ID NO: 374019 - RNA, 22 nt, Homo sapiens
aaugugcacuuggagccuugcu

SEQ ID NO: 374020 - RNA, 22 nt, Homo sapiens
acacaugugcguagacucuuua

SEQ ID NO: 374021 - RNA, 22 nt, Homo sapiens
acacugucaugucucacaggca

SEQ ID NO: 374022 - RNA, 22 nt, Homo sapiens
acacugucucuugcugaccaug

SEQ ID NO: 374023 - RNA, 19 nt, Homo sapiens
acagcugguuuugguuucu

SEQ ID NO: 374024 - RNA, 22 nt, Homo sapiens
acagucacaauuuguaccuuuu

SEQ ID NO: 374025 - RNA, 22 nt, Homo sapiens
acaucacuguuugauugauuga

SEQ ID NO: 374026 - RNA, 22 nt, Homo sapiens
acaucccaugccuggguacucc

SEQ ID NO: 374027 - RNA, 22 nt, Homo sapiens
acaugcauauguuggaagaaag

SEQ ID NO: 374028 - RNA, 22 nt, Homo sapiens
acauguaauugauuuuguguua

SEQ ID NO: 374029 - RNA, 22 nt, Homo sapiens
acccaguagccagauguagcug

SEQ ID NO: 374030 - RNA, 17 nt, Homo sapiens
accccuaccucagaagc

SEQ ID NO: 374031 - RNA, 22 nt, Homo sapiens
acccgcccagguguggccggga

SEQ ID NO: 374032 - RNA, 22 nt, Homo sapiens
acccucagaccaguuucccugg

SEQ ID NO: 374033 - RNA, 22 nt, Homo sapiens
accucagcccggggaaguugag

SEQ ID NO: 374034 - RNA, 22 nt, Homo sapiens
accugagauuacaggugcuggc

SEQ ID NO: 374035 - RNA, 22 nt, Homo sapiens
acgugccuuguuguucauauga

SEQ ID NO: 374036 - RNA, 22 nt, Homo sapiens
acuauacuguaacuguauucag

SEQ ID NO: 374037 - RNA, 22 nt, Homo sapiens
acugaauguaaacacggagugu

SEQ ID NO: 374038 - RNA, 22 nt, Homo sapiens
acugcaaugucgaauagagaug

SEQ ID NO: 374039 - RNA, 21 nt, Homo sapiens
acugcacuccaaccucaacag

SEQ ID NO: 374040 - RNA, 22 nt, Homo sapiens
acugcacuccacccuuggcagc

SEQ ID NO: 374041 - RNA, 22 nt, Homo sapiens
acugcacuccagcccgggugac

SEQ ID NO: 374042 - RNA, 22 nt, Homo sapiens
acugcacuccagccuaggcgac

SEQ ID NO: 374043 - RNA, 22 nt, Homo sapiens
acugcacuccagccucgcaaca

SEQ ID NO: 374044 - RNA, 22 nt, Homo sapiens
acugcacuccagccucggcaau

SEQ ID NO: 374045 - RNA, 22 nt, Homo sapiens
acugcacuccagccucggugac

SEQ ID NO: 374046 - RNA, 22 nt, Homo sapiens
acugcacuccagccugagccug

SEQ ID NO: 374047 - RNA, 22 nt, Homo sapiens
acugcacuccagccugcugggu

SEQ ID NO: 374048 - RNA, 22 nt, Homo sapiens
acugcacuccagccuggcggac

SEQ ID NO: 374049 - RNA, 22 nt, Homo sapiens
acugcacuccagccuugagagc

SEQ ID NO: 374050 - RNA, 22 nt, Homo sapiens
acugcacuccagccuuggcaac

SEQ ID NO: 374051 - RNA, 22 nt, Homo sapiens
acugcacuccagccuuugcgau

SEQ ID NO: 374052 - RNA, 22 nt, Homo sapiens
acugcacuccagcuuuggguga

SEQ ID NO: 374053 - RNA, 22 nt, Homo sapiens
acugcacuccagcuuuggugac

SEQ ID NO: 374054 - RNA, 22 nt, Homo sapiens
acugcacuccaguuugggcagc

SEQ ID NO: 374055 - RNA, 22 nt, Homo sapiens
acugcacuccggccuggcaaca

SEQ ID NO: 374056 - RNA, 19 nt, Homo sapiens
acugcacuccuccuugggu

SEQ ID NO: 374057 - RNA, 22 nt, Homo sapiens
acugcacuccuccuugggugac

SEQ ID NO: 374058 - RNA, 22 nt, Homo sapiens
acugcacucuagcauggguaau

SEQ ID NO: 374059 - RNA, 22 nt, Homo sapiens
acugcacugucaaccuccuggg

SEQ ID NO: 374060 - RNA, 22 nt, Homo sapiens
acugcacuucagccuuggcuac

SEQ ID NO: 374061 - RNA, 22 nt, Homo sapiens
acugccuaaugacuuauguuuu

SEQ ID NO: 374062 - RNA, 22 nt, Homo sapiens
gagcucauuguugcuaaagaga

SEQ ID NO: 374063 - RNA, 22 nt, Homo sapiens
gagggcacugcuuuccuuucaa

SEQ ID NO: 374064 - RNA, 22 nt, Homo sapiens
gagguagaauguuuuucagcug

SEQ ID NO: 374065 - RNA, 23 nt, Homo sapiens
gaguggagacucauugauuuccu

SEQ ID NO: 374066 - RNA, 18 nt, Homo sapiens
gauaacaguggacuaugc

SEQ ID NO: 374067 - RNA, 22 nt, Homo sapiens
gauauguuagggggagaaguua

SEQ ID NO: 374068 - RNA, 22 nt, Homo sapiens
gaucacaguuccucacgggcau

SEQ ID NO: 374069 - RNA, 22 nt, Homo sapiens
gaucacauuguuucauacauau

SEQ ID NO: 374070 - RNA, 22 nt, Homo sapiens
gaugauguuggaaacuuggugc

SEQ ID NO: 374071 - RNA, 22 nt, Homo sapiens
gauuagugacguugagcacugu

SEQ ID NO: 374072 - RNA, 22 nt, Homo sapiens
gauugguugaaaguagaauacu

SEQ ID NO: 374073 - RNA, 21 nt, Homo sapiens
gcaaaggaauugccuaagcuu

SEQ ID NO: 374074 - RNA, 21 nt, Homo sapiens
gcaaaguggcuaccuugcucc

SEQ ID NO: 374075 - RNA, 22 nt, Homo sapiens
gcaaaguguuuuccaacuuggu

SEQ ID NO: 374076 - RNA, 17 nt, Homo sapiens
gcacuggcguaucccac

SEQ ID NO: 374077 - RNA, 22 nt, Homo sapiens
gcagaauugacucuguuuuuuc

SEQ ID NO: 374078 - RNA, 22 nt, Homo sapiens
gcauggccuuuaaaugucacag

SEQ ID NO: 374079 - RNA, 22 nt, Homo sapiens
gcucaugagacaagcaggagua

SEQ ID NO: 374080 - RNA, 22 nt, Homo sapiens
gcugauguugaccuugaucacc

SEQ ID NO: 374081 - RNA, 22 nt, Homo sapiens
gcugauguuggccucugggcuu

SEQ ID NO: 374082 - RNA, 22 nt, Homo sapiens
gcugauguuuucagguaauucu

SEQ ID NO: 374083 - RNA, 19 nt, Homo sapiens
gcuuuguggggaaggagcc

SEQ ID NO: 374084 - RNA, 21 nt, Homo sapiens
uggcuguuuucaugcuagaac

SEQ ID NO: 374085 - RNA, 20 nt, Homo sapiens
ugggaacaugugguauaugg

SEQ ID NO: 374086 - RNA, 22 nt, Homo sapiens
ugggaagaagguuuacuugcca

SEQ ID NO: 374087 - RNA, 22 nt, Homo sapiens
ugggaagcugcauuuuaacaag

SEQ ID NO: 374088 - RNA, 22 nt, Homo sapiens
ugggaagcugcugaacuacagu

SEQ ID NO: 374089 - RNA, 22 nt, Homo sapiens
ugggagacuacauuuuuaacaa

SEQ ID NO: 374090 - RNA, 22 nt, Homo sapiens
ugggauccaugugguuuaagca

SEQ ID NO: 374091 - RNA, 22 nt, Homo sapiens
uggguagagaaucaggaucuua

SEQ ID NO: 374092 - RNA, 22 nt, Homo sapiens
uggguagaugaauccauuccaa

SEQ ID NO: 374093 - RNA, 22 nt, Homo sapiens
uggucaugaggugaggcuucuc

SEQ ID NO: 374094 - RNA, 15 nt, Homo sapiens
uggugguguugagac

SEQ ID NO: 374095 - RNA, 20 nt, Homo sapiens
uggugguuuuaugugguuua

SEQ ID NO: 374096 - RNA, 22 nt, Homo sapiens
ugguguuugagaagcugauguc

SEQ ID NO: 374097 - RNA, 22 nt, Homo sapiens
uguaaaaagcccagccgcugag

SEQ ID NO: 374098 - RNA, 20 nt, Homo sapiens
uguaacaaucuggauguugc

SEQ ID NO: 374099 - RNA, 22 nt, Homo sapiens
uguacaugggacaggaggagag

SEQ ID NO: 374100 - RNA, 22 nt, Homo sapiens
uguauguugggucaaaguacau

SEQ ID NO: 374101 - RNA, 22 nt, Homo sapiens
uguauguuguaagacuuagacc

SEQ ID NO: 374102 - RNA, 22 nt, Homo sapiens
ugucaacauuuaucaaguuauu

SEQ ID NO: 374103 - RNA, 22 nt, Homo sapiens
ugucaaugggaauuuguuuuag

SEQ ID NO: 374104 - RNA, 22 nt, Homo sapiens
ugucacagagauuuugguaugu

SEQ ID NO: 374105 - RNA, 23 nt, Homo sapiens
gagaccagcuucagaaagcacga

SEQ ID NO: 374106 - RNA, 22 nt, Homo sapiens
gagauacacccagugcagaggc

SEQ ID NO: 374107 - RNA, 22 nt, Homo sapiens
gagaucacuguuuauauucucu

SEQ ID NO: 374108 - RNA, 22 nt, Homo sapiens
gagcuagguuuugaauccagac

SEQ ID NO: 374109 - RNA, 22 nt, Homo sapiens
gagcucauuaaaaauguagaau

SEQ ID NO: 374110 - RNA, 22 nt, Homo sapiens
gagcugaucuuuucugauucca

SEQ ID NO: 374111 - RNA, 22 nt, Homo sapiens
gagcugccuugccuaugcaaga

SEQ ID NO: 374112 - RNA, 22 nt, Homo sapiens
gagcugguccuuuaaggaugca

SEQ ID NO: 374113 - RNA, 22 nt, Homo sapiens
gagcuguugguuugaaagaauu

SEQ ID NO: 374114 - RNA, 22 nt, Homo sapiens
gagcuguuuuucacuagaccaa

SEQ ID NO: 374115 - RNA, 22 nt, Homo sapiens
gagcuuggguuaaaguugccuu

SEQ ID NO: 374116 - RNA, 22 nt, Homo sapiens
gaggagucagacugugcaaggu

SEQ ID NO: 374117 - RNA, 22 nt, Homo sapiens
gagguaggaggauugcuuaagg

SEQ ID NO: 374118 - RNA, 22 nt, Homo sapiens
gagguagguuugguuacaaaag

SEQ ID NO: 374119 - RNA, 23 nt, Homo sapiens
gaguacauuaaaagcccagacug

SEQ ID NO: 374120 - RNA, 21 nt, Homo sapiens
gaguggcuuuuguuucaccag

SEQ ID NO: 374121 - RNA, 22 nt, Homo sapiens
gaucugugugauuggaugcauu

SEQ ID NO: 374122 - RNA, 22 nt, Homo sapiens
gcaaaguguuuuuaggaagucu

SEQ ID NO: 374123 - RNA, 22 nt, Homo sapiens
gcaaaugcuaugccauuuuaua

SEQ ID NO: 374124 - RNA, 22 nt, Homo sapiens
gcaaggacucccugggucauuc

SEQ ID NO: 374125 - RNA, 23 nt, Homo sapiens
gcagcaaugucacagggguccgg

SEQ ID NO: 374126 - RNA, 22 nt, Homo sapiens
gcagcacauggcagaacauauu

SEQ ID NO: 374127 - RNA, 22 nt, Homo sapiens
gcaguguggguagagggcaaga

SEQ ID NO: 374128 - RNA, 22 nt, Homo sapiens
gccagauuguccaguuuuuuau

SEQ ID NO: 374129 - RNA, 22 nt, Homo sapiens
uugagauggaguucauuuuugu

SEQ ID NO: 374130 - RNA, 22 nt, Homo sapiens
uugagauggaguuucacucugu

SEQ ID NO: 374131 - RNA, 22 nt, Homo sapiens
uugagauggaguuucacucuug

SEQ ID NO: 374132 - RNA, 22 nt, Homo sapiens
uugagcucaucuucagggguga

SEQ ID NO: 374133 - RNA, 22 nt, Homo sapiens
uugaggaggcagucuguccguu

SEQ ID NO: 374134 - RNA, 22 nt, Homo sapiens
uugagggcugaauaccaaucag

SEQ ID NO: 374135 - RNA, 22 nt, Homo sapiens
uugagguaguacuuauuauugg

SEQ ID NO: 374136 - RNA, 20 nt, Homo sapiens
uugaggugugaggggcagag

SEQ ID NO: 374137 - RNA, 22 nt, Homo sapiens
uugagugaaggcuguguucuug

SEQ ID NO: 374138 - RNA, 20 nt, Homo sapiens
uugauucccucuaaacucgc

SEQ ID NO: 374139 - RNA, 22 nt, Homo sapiens
uugcaaagaccucuucacuucc

SEQ ID NO: 374140 - RNA, 22 nt, Homo sapiens
uugcaaaucucuuguguuuggu

SEQ ID NO: 374141 - RNA, 22 nt, Homo sapiens
uugcaaggugcagcuuaugcaa

SEQ ID NO: 374142 - RNA, 22 nt, Homo sapiens
uugcacugagauuuugcuuaca

SEQ ID NO: 374143 - RNA, 22 nt, Homo sapiens
uugcacuguaauuuauuuaugu

SEQ ID NO: 374144 - RNA, 22 nt, Homo sapiens
uugcagagucaguuauuuugcc

SEQ ID NO: 374145 - RNA, 23 nt, Homo sapiens
uugcauagacauccucauagauu

SEQ ID NO: 374146 - RNA, 22 nt, Homo sapiens
uugcaugguuuuuaucugaaau

SEQ ID NO: 374147 - RNA, 22 nt, Homo sapiens
uugcucaggcuagaguucagcu

SEQ ID NO: 374148 - RNA, 22 nt, Homo sapiens
uugcuucuuucgucuggcccca

SEQ ID NO: 374149 - RNA, 22 nt, Homo sapiens
uuggaaacaccuggugagguua

SEQ ID NO: 374150 - RNA, 22 nt, Homo sapiens
uuggaacacauguuuuucuacc

SEQ ID NO: 374151 - RNA, 22 nt, Homo sapiens
uuggagagugauauucagaugc

SEQ ID NO: 374152 - RNA, 22 nt, Homo sapiens
uuggcaaguuucugucagcaaa

SEQ ID NO: 374153 - RNA, 22 nt, Homo sapiens
uuggccuccuggucauauccag

SEQ ID NO: 374154 - RNA, 22 nt, Homo sapiens
uuggcucugcgucucgcggacg

SEQ ID NO: 374155 - RNA, 22 nt, Homo sapiens
uugggaauguccuaauaucucg

SEQ ID NO: 374156 - RNA, 22 nt, Homo sapiens
uugucacugcacuccagucugg

SEQ ID NO: 374157 - RNA, 22 nt, Homo sapiens
uugucccauggggucuuccuuu

SEQ ID NO: 374158 - RNA, 22 nt, Homo sapiens
uugugaaaaaccucucguggaa

SEQ ID NO: 374159 - RNA, 22 nt, Homo sapiens
uugugagggagcuaagaugagu

SEQ ID NO: 374160 - RNA, 20 nt, Homo sapiens
uugugcauugggccauuggg

SEQ ID NO: 374161 - RNA, 22 nt, Homo sapiens
uugugcuuaaugaguguaaggu

SEQ ID NO: 374162 - RNA, 22 nt, Homo sapiens
uugugcuugauuugccuagcug

SEQ ID NO: 374163 - RNA, 23 nt, Homo sapiens
uugugucccuacccaaaucucau

SEQ ID NO: 374164 - RNA, 23 nt, Homo sapiens
uuguucccuuccacucagucucc

SEQ ID NO: 374165 - RNA, 22 nt, Homo sapiens
uuguuuuggagaugagcuaaaa

SEQ ID NO: 374166 - RNA, 22 nt, Homo sapiens
uuuaaagcuaaaauauguuuau

SEQ ID NO: 374167 - RNA, 22 nt, Homo sapiens
uuuaaagcuccaagcaugucug

SEQ ID NO: 374168 - RNA, 22 nt, Homo sapiens
uuuaauguuacaguauugguau

SEQ ID NO: 374169 - RNA, 22 nt, Homo sapiens
uuuacagucucauagguggaag

SEQ ID NO: 374170 - RNA, 22 nt, Homo sapiens
uuuagcagcaaagagcuguguu

SEQ ID NO: 374171 - RNA, 19 nt, Homo sapiens
uuucaauguaaggauggag

SEQ ID NO: 374172 - RNA, 22 nt, Homo sapiens
uuucauagaucaugcuuuugga

SEQ ID NO: 374173 - RNA, 22 nt, Homo sapiens
uuuccagguggccaacauuuua

SEQ ID NO: 374174 - RNA, 22 nt, Homo sapiens
uuuccaguuguucuagaaagcu

SEQ ID NO: 374175 - RNA, 22 nt, Homo sapiens
uuuccauguuggugaaaugagg

SEQ ID NO: 374176 - RNA, 22 nt, Homo sapiens
uuucugugguccucuugaaggu

SEQ ID NO: 374177 - RNA, 22 nt, Homo sapiens
uuugacuuuuagaauaugaguu

SEQ ID NO: 374178 - RNA, 23 nt, Homo sapiens
uuugagugugauaaacacuguca

SEQ ID NO: 374179 - RNA, 22 nt, Homo sapiens
uuugaguuugaggugcugauga

SEQ ID NO: 374180 - RNA, 22 nt, Homo sapiens
uuugcagagucuuucgcugggc

SEQ ID NO: 374181 - RNA, 22 nt, Homo sapiens
uuugcagugucagcuucugugu

SEQ ID NO: 374182 - RNA, 22 nt, Homo sapiens
uuugcaucuuagaaaguucucc

SEQ ID NO: 374183 - RNA, 22 nt, Homo sapiens
uuuggcccccagcucaggacau

SEQ ID NO: 374184 - RNA, 22 nt, Homo sapiens
uuuggcuuaagauugacugcaa

SEQ ID NO: 374185 - RNA, 22 nt, Homo sapiens
uuuggcuuugagaagcagugga

SEQ ID NO: 374186 - RNA, 22 nt, Homo sapiens
uuuggcuuuuguaauaacugcc

SEQ ID NO: 374187 - RNA, 22 nt, Homo sapiens
uuugguaguuuguugggaccca

SEQ ID NO: 374188 - RNA, 22 nt, Homo sapiens
ucuaaggcaccuagagucauca

SEQ ID NO: 374189 - RNA, 21 nt, Homo sapiens
ucuaccuacugcucacaggcu

SEQ ID NO: 374190 - RNA, 22 nt, Homo sapiens
ucucaagaugguagaugggaau

SEQ ID NO: 374191 - RNA, 22 nt, Homo sapiens
ucucagugaauguggaaaaagc

SEQ ID NO: 374192 - RNA, 22 nt, Homo sapiens
ucucauggcucacccugcauag

SEQ ID NO: 374193 - RNA, 22 nt, Homo sapiens
ucucugguuaugucauuaagca

SEQ ID NO: 374194 - RNA, 22 nt, Homo sapiens
ucugagacuguuucuaacaagc

SEQ ID NO: 374195 - RNA, 22 nt, Homo sapiens
ucugagaucaugucugugcugu

SEQ ID NO: 374196 - RNA, 22 nt, Homo sapiens
ucuggcaagagccgagggcagu

SEQ ID NO: 374197 - RNA, 22 nt, Homo sapiens
ucuggccuagaacaauuaauua

SEQ ID NO: 374198 - RNA, 22 nt, Homo sapiens
ucuggcuuuagcaugugggaag

SEQ ID NO: 374199 - RNA, 22 nt, Homo sapiens
ucugucacugguggacgaucac

SEQ ID NO: 374200 - RNA, 22 nt, Homo sapiens
ucuuugguaauggaugucugau

SEQ ID NO: 374201 - RNA, 22 nt, Homo sapiens
ucuuugguaugugcaugugcuu

SEQ ID NO: 374202 - RNA, 22 nt, Homo sapiens
ucuuugguauugugaauagugu

SEQ ID NO: 374203 - RNA, 22 nt, Homo sapiens
ucuuuggucagaaagauuacac

SEQ ID NO: 374204 - RNA, 22 nt, Homo sapiens
ucuuugguuagguuuaguugau

SEQ ID NO: 374205 - RNA, 22 nt, Homo sapiens
ucuuugguucuguuuauguaau

SEQ ID NO: 374206 - RNA, 22 nt, Homo sapiens
ucuuugguuguuuagggugcau

SEQ ID NO: 374207 - RNA, 22 nt, Homo sapiens
aaaaggcuagcuaguaacagaa

SEQ ID NO: 374208 - RNA, 22 nt, Homo sapiens
aaagagaucuaugggcacuaug

SEQ ID NO: 374209 - RNA, 22 nt, Homo sapiens
aaagcuaagguagcauuggaga

SEQ ID NO: 374210 - RNA, 22 nt, Homo sapiens
aaagucacuggagaaggaauau

SEQ ID NO: 374211 - RNA, 22 nt, Homo sapiens
aaagugcugagauuguaggcau

SEQ ID NO: 374212 - RNA, 22 nt, Homo sapiens
aaagugcugagucuaggcgggg

SEQ ID NO: 374213 - RNA, 19 nt, Homo sapiens
aaaguguuuuaaagaggau

SEQ ID NO: 374214 - RNA, 22 nt, Homo sapiens
aaauaacugucagguucuggaa

SEQ ID NO: 374215 - RNA, 22 nt, Homo sapiens
aaaugccucccauucuacugac

SEQ ID NO: 374216 - RNA, 22 nt, Homo sapiens
aaauugcaaugcgaggcagagg

SEQ ID NO: 374217 - RNA, 22 nt, Homo sapiens
aacacuguuuccagucaugauc

SEQ ID NO: 374218 - RNA, 22 nt, Homo sapiens
aacaguguuuuggguuuucugg

SEQ ID NO: 374219 - RNA, 22 nt, Homo sapiens
aacucacauucuuucuugguac

SEQ ID NO: 374220 - RNA, 22 nt, Homo sapiens
aagaggccuaggaaucuguauu

SEQ ID NO: 374221 - RNA, 22 nt, Homo sapiens
aagaugcagucauacuggagga

SEQ ID NO: 374222 - RNA, 22 nt, Homo sapiens
aagcuggcauucaugagauuac

SEQ ID NO: 374223 - RNA, 22 nt, Homo sapiens
aaggcuuuuugcugacguccuu

SEQ ID NO: 374224 - RNA, 20 nt, Homo sapiens
aagugaguguuaaacugaac

SEQ ID NO: 374225 - RNA, 22 nt, Homo sapiens
aagugcucuugaaacugccuua

SEQ ID NO: 374226 - RNA, 22 nt, Homo sapiens
aagugcuuuacacaugcaugau

SEQ ID NO: 374227 - RNA, 22 nt, Homo sapiens
aagugcuuuguacagggguuga

SEQ ID NO: 374228 - RNA, 22 nt, Homo sapiens
aaucacuuugcuacaaggcagu

SEQ ID NO: 374229 - RNA, 17 nt, Homo sapiens
aaucagauuucugagga

SEQ ID NO: 374230 - RNA, 22 nt, Homo sapiens
aauccaugugcuuuaccauuuu

SEQ ID NO: 374231 - RNA, 22 nt, Homo sapiens
aauuaguugucgugagaguggu

SEQ ID NO: 374232 - RNA, 22 nt, Homo sapiens
acaaaguguuuucugaaggccu

SEQ ID NO: 374233 - RNA, 22 nt, Homo sapiens
acacuggguaacauaucuguua

SEQ ID NO: 374234 - RNA, 22 nt, Homo sapiens
acacuguacuuauguuuugcag

SEQ ID NO: 374235 - RNA, 22 nt, Homo sapiens
acacugucugaugaaaguaguu

SEQ ID NO: 374236 - RNA, 20 nt, Homo sapiens
acagcauagccuuuuaaagc

SEQ ID NO: 374237 - RNA, 22 nt, Homo sapiens
acaguacucugcucuuuugauu

SEQ ID NO: 374238 - RNA, 22 nt, Homo sapiens
acaguacuguuguuugcugcca

SEQ ID NO: 374239 - RNA, 18 nt, Homo sapiens
acaucccaugcuggggug

SEQ ID NO: 374240 - RNA, 22 nt, Homo sapiens
acaucuguacaguggguguggu

SEQ ID NO: 374241 - RNA, 22 nt, Homo sapiens
acaugcauccaugugaagagac

SEQ ID NO: 374242 - RNA, 22 nt, Homo sapiens
acaugguacugauuuacgaaau

SEQ ID NO: 374243 - RNA, 22 nt, Homo sapiens
acccagaagucauucaggaaca

SEQ ID NO: 374244 - RNA, 22 nt, Homo sapiens
acccuguugucagaauguggau

SEQ ID NO: 374245 - RNA, 22 nt, Homo sapiens
accugagacuaggcauuuuaua

SEQ ID NO: 374246 - RNA, 22 nt, Homo sapiens
accugcacagccgaacauagac

SEQ ID NO: 374247 - RNA, 22 nt, Homo sapiens
accugggugcugaugggcuuua

SEQ ID NO: 374248 - RNA, 22 nt, Homo sapiens
acucacagcaaccuccgccucc

SEQ ID NO: 374249 - RNA, 22 nt, Homo sapiens
acugagacugagaauguuucuu

SEQ ID NO: 374250 - RNA, 22 nt, Homo sapiens
acugaucaauguuaaggcuuau

SEQ ID NO: 374251 - RNA, 22 nt, Homo sapiens
acugcacuccaaccuuggugac

SEQ ID NO: 374252 - RNA, 20 nt, Homo sapiens
acugcacuccaaccuuugug

SEQ ID NO: 374253 - RNA, 22 nt, Homo sapiens
acugcacuccagcccaggugac

SEQ ID NO: 374254 - RNA, 22 nt, Homo sapiens
acugcacuccagccucgugaca

SEQ ID NO: 374255 - RNA, 22 nt, Homo sapiens
acugcacuccagccucguggac

SEQ ID NO: 374256 - RNA, 22 nt, Homo sapiens
acugcacuccagccugaugaaa

SEQ ID NO: 374257 - RNA, 22 nt, Homo sapiens
acugcacuccagccugccgaca

SEQ ID NO: 374258 - RNA, 22 nt, Homo sapiens
acugcacuccagccuggacgaa

SEQ ID NO: 374259 - RNA, 22 nt, Homo sapiens
acugcacuccagccugugcgua

SEQ ID NO: 374260 - RNA, 22 nt, Homo sapiens
acugcacuccagccuguugaca

SEQ ID NO: 374261 - RNA, 22 nt, Homo sapiens
acugcacuccagccuucaggac

SEQ ID NO: 374262 - RNA, 22 nt, Homo sapiens
acugcacuccagccuucggaca

SEQ ID NO: 374263 - RNA, 22 nt, Homo sapiens
acugcacuccagccuugcgaca

SEQ ID NO: 374264 - RNA, 22 nt, Homo sapiens
acugcacuccagccuuggcggc

SEQ ID NO: 374265 - RNA, 22 nt, Homo sapiens
acugcacuccagcuccagggug

SEQ ID NO: 374266 - RNA, 22 nt, Homo sapiens
acugcacuccagcuugggugac

SEQ ID NO: 374267 - RNA, 20 nt, Homo sapiens
acugcacuccagucucuggg

SEQ ID NO: 374268 - RNA, 22 nt, Homo sapiens
acugcacuccaucuuagguggc

SEQ ID NO: 374269 - RNA, 22 nt, Homo sapiens
acugcacucccgcccgggugac

SEQ ID NO: 374270 - RNA, 22 nt, Homo sapiens
acugcacucuagccuuggcaac

SEQ ID NO: 374271 - RNA, 22 nt, Homo sapiens
acugcacuucagccuuggggac

SEQ ID NO: 374272 - RNA, 22 nt, Homo sapiens
acugcauuugguaaagucaaga

SEQ ID NO: 374273 - RNA, 22 nt, Homo sapiens
acuggacuuaaugaugaauugu

SEQ ID NO: 374274 - RNA, 20 nt, Homo sapiens
acugggcuaccgaaguaagg

SEQ ID NO: 374275 - RNA, 22 nt, Homo sapiens
acuggguuaauuugaagguuga

SEQ ID NO: 374276 - RNA, 19 nt, Homo sapiens
agaaucuaaauuauuucug

SEQ ID NO: 374277 - RNA, 22 nt, Homo sapiens
agacacugaaauguauugaaga

SEQ ID NO: 374278 - RNA, 22 nt, Homo sapiens
agagagcuugggguguuaaauu

SEQ ID NO: 374279 - RNA, 22 nt, Homo sapiens
agaguaguaggaugaauggacu

SEQ ID NO: 374280 - RNA, 20 nt, Homo sapiens
agagugcugucuguccugag

SEQ ID NO: 374281 - RNA, 22 nt, Homo sapiens
agcacagccuuguguuuucuug

SEQ ID NO: 374282 - RNA, 22 nt, Homo sapiens
agcagauguuuagugagcgccu

SEQ ID NO: 374283 - RNA, 22 nt, Homo sapiens
agcagcaauuuuguaugguuua

SEQ ID NO: 374284 - RNA, 22 nt, Homo sapiens
agcagcaucgggaaguuggcca

SEQ ID NO: 374285 - RNA, 22 nt, Homo sapiens
agcagcauuaguggaaucuugu

SEQ ID NO: 374286 - RNA, 22 nt, Homo sapiens
gaggcggugugaugucacaugc

SEQ ID NO: 374287 - RNA, 22 nt, Homo sapiens
gagguagagaguuuugauucug

SEQ ID NO: 374288 - RNA, 22 nt, Homo sapiens
gagguagggucccacuauguug

SEQ ID NO: 374289 - RNA, 22 nt, Homo sapiens
gagguauagaacaccuuucaag

SEQ ID NO: 374290 - RNA, 22 nt, Homo sapiens
gaggucauguggcaggcagcca

SEQ ID NO: 374291 - RNA, 22 nt, Homo sapiens
gaggucauucugugguacccag

SEQ ID NO: 374292 - RNA, 22 nt, Homo sapiens
gaguuuguacuaauuuguugua

SEQ ID NO: 374293 - RNA, 21 nt, Homo sapiens
gauaugacauggguaaaacca

SEQ ID NO: 374294 - RNA, 22 nt, Homo sapiens
gaucugagaaagugucauaaca

SEQ ID NO: 374295 - RNA, 22 nt, Homo sapiens
gauggaguugucgccugggcug

SEQ ID NO: 374296 - RNA, 22 nt, Homo sapiens
gauggguuuuuugaagacagca

SEQ ID NO: 374297 - RNA, 22 nt, Homo sapiens
gaugguuuuuuaagaagagccu

SEQ ID NO: 374298 - RNA, 22 nt, Homo sapiens
gauguagaaagagugggcugga

SEQ ID NO: 374299 - RNA, 22 nt, Homo sapiens
gcaagaaucugggaguaaaauu

SEQ ID NO: 374300 - RNA, 22 nt, Homo sapiens
gcaagaaugagaaggauuaauu

SEQ ID NO: 374301 - RNA, 22 nt, Homo sapiens
gcacaggguuacauucuaaggu

SEQ ID NO: 374302 - RNA, 22 nt, Homo sapiens
gcagagaaacaggucuaaggag

SEQ ID NO: 374303 - RNA, 22 nt, Homo sapiens
gcaucacagcuccugugcuggc

SEQ ID NO: 374304 - RNA, 20 nt, Homo sapiens
gccacaguuaagcuucugcc

SEQ ID NO: 374305 - RNA, 22 nt, Homo sapiens
gccuagggacaaaccguccgac

SEQ ID NO: 374306 - RNA, 22 nt, Homo sapiens
gcgcagugggcugugccaucca

SEQ ID NO: 374307 - RNA, 22 nt, Homo sapiens
gcugacagugguuauacuuaga

SEQ ID NO: 374308 - RNA, 22 nt, Homo sapiens
ggaaagcuagguguggguguac

SEQ ID NO: 374309 - RNA, 22 nt, Homo sapiens
ggaaauguaaacaauggggcua

SEQ ID NO: 374310 - RNA, 19 nt, Homo sapiens
ggaaaugucuauuaagauc

SEQ ID NO: 374311 - RNA, 22 nt, Homo sapiens
ggaagccugcacucgggcaggg

SEQ ID NO: 374312 - RNA, 22 nt, Homo sapiens
ggacugagaggacuacagugua

SEQ ID NO: 374313 - RNA, 22 nt, Homo sapiens
ggagucugauguucuaaggcag

SEQ ID NO: 374314 - RNA, 23 nt, Homo sapiens
ggaguguaaauuauuucaaccau

SEQ ID NO: 374315 - RNA, 22 nt, Homo sapiens
ggaguucaucaggugaggggua

SEQ ID NO: 374316 - RNA, 22 nt, Homo sapiens
ggcaagauagauaucaguguca

SEQ ID NO: 374317 - RNA, 22 nt, Homo sapiens
ggcaagaucuuggcucacugaa

SEQ ID NO: 374318 - RNA, 22 nt, Homo sapiens
ggcaaugucagcuaaugaugga

SEQ ID NO: 374319 - RNA, 22 nt, Homo sapiens
ggcacuguugccggccugaauu

SEQ ID NO: 374320 - RNA, 22 nt, Homo sapiens
ggcuagaauagggauagaccuu

SEQ ID NO: 374321 - RNA, 22 nt, Homo sapiens
gggaggucauuguaaggucuua

SEQ ID NO: 374322 - RNA, 22 nt, Homo sapiens
gggauguaugauauauguuggu

SEQ ID NO: 374323 - RNA, 16 nt, Homo sapiens
gggcaugugaagccua

SEQ ID NO: 374324 - RNA, 22 nt, Homo sapiens
gguauguagcaaaagaggugcu

SEQ ID NO: 374325 - RNA, 22 nt, Homo sapiens
ggucugguguugaaauucuuca

SEQ ID NO: 374326 - RNA, 22 nt, Homo sapiens
guaauaacuguggaaaaagguu

SEQ ID NO: 374327 - RNA, 22 nt, Homo sapiens
guaaucucagcuacucgggaga

SEQ ID NO: 374328 - RNA, 22 nt, Homo sapiens
guaaucucagcuacuugggagc

SEQ ID NO: 374329 - RNA, 22 nt, Homo sapiens
guagaaaguuugcugucacaug

SEQ ID NO: 374330 - RNA, 22 nt, Homo sapiens
guaugugacuggaacaguagga

SEQ ID NO: 374331 - RNA, 22 nt, Homo sapiens
guauuaguuuccuguugcugcu

SEQ ID NO: 374332 - RNA, 19 nt, Homo sapiens
gucaaagucgguauucaaa

SEQ ID NO: 374333 - RNA, 22 nt, Homo sapiens
gucaaagugauuguaauuaggu

SEQ ID NO: 374334 - RNA, 22 nt, Homo sapiens
gucagugugauaucugcagggg

SEQ ID NO: 374335 - RNA, 22 nt, Homo sapiens
guccaagacuaggaguuggcag

SEQ ID NO: 374336 - RNA, 22 nt, Homo sapiens
guccaguacucuuuccugaaaa

SEQ ID NO: 374337 - RNA, 22 nt, Homo sapiens
gucucccaaccccugugcccag

SEQ ID NO: 374338 - RNA, 22 nt, Homo sapiens
gucugguuccugggagauuucu

SEQ ID NO: 374339 - RNA, 22 nt, Homo sapiens
gucuguuuggggaccuguggcc

SEQ ID NO: 374340 - RNA, 22 nt, Homo sapiens
gugaaaugaaucuggaaauauu

SEQ ID NO: 374341 - RNA, 15 nt, Homo sapiens
gugaaauguuucaga

SEQ ID NO: 374342 - RNA, 22 nt, Homo sapiens
gugaacagaaccugggaucgaa

SEQ ID NO: 374343 - RNA, 22 nt, Homo sapiens
gugaauguuuucuuacauggua

SEQ ID NO: 374344 - RNA, 22 nt, Homo sapiens
gugaauugagagaacuguguua

SEQ ID NO: 374345 - RNA, 22 nt, Homo sapiens
gugaccucuguugcugucacua

SEQ ID NO: 374346 - RNA, 22 nt, Homo sapiens
gugagaggaggcagcuuuuaca

SEQ ID NO: 374347 - RNA, 22 nt, Homo sapiens
gugagcuaagcaaauaugagcc

SEQ ID NO: 374348 - RNA, 22 nt, Homo sapiens
gugauuauuaugcacugcaugc

SEQ ID NO: 374349 - RNA, 22 nt, Homo sapiens
gugcaaaucucugaguaucuuu

SEQ ID NO: 374350 - RNA, 22 nt, Homo sapiens
gugcacaacaugcaguuuuguu

SEQ ID NO: 374351 - RNA, 22 nt, Homo sapiens
gugcacaacgugcagguuuguu

SEQ ID NO: 374352 - RNA, 22 nt, Homo sapiens
gugcacuguagaacccuuuguu

SEQ ID NO: 374353 - RNA, 20 nt, Homo sapiens
guggaagauaaguagccuga

SEQ ID NO: 374354 - RNA, 22 nt, Homo sapiens
guggacaugaauuuuggaggca

SEQ ID NO: 374355 - RNA, 22 nt, Homo sapiens
guggacguguguccccauggcu

SEQ ID NO: 374356 - RNA, 22 nt, Homo sapiens
guggagcuguguggccuugggc

SEQ ID NO: 374357 - RNA, 22 nt, Homo sapiens
guggcacgaugaucugggcuca

SEQ ID NO: 374358 - RNA, 22 nt, Homo sapiens
guggcagugugaggauccugcu

SEQ ID NO: 374359 - RNA, 22 nt, Homo sapiens
guguaaaacaauuagaggauuu

SEQ ID NO: 374360 - RNA, 22 nt, Homo sapiens
guguaaaucaaucuguugucuu

SEQ ID NO: 374361 - RNA, 22 nt, Homo sapiens
guguaaaugagugcugaaggag

SEQ ID NO: 374362 - RNA, 22 nt, Homo sapiens
gugucuccuguggagcuaugua

SEQ ID NO: 374363 - RNA, 22 nt, Homo sapiens
gugugcaauuuugugggaggca

SEQ ID NO: 374364 - RNA, 22 nt, Homo sapiens
guguuugguugauagagccacu

SEQ ID NO: 374365 - RNA, 22 nt, Homo sapiens
guucacagugguugccuuccag

SEQ ID NO: 374366 - RNA, 22 nt, Homo sapiens
guucaguuugcugaugcguuga

SEQ ID NO: 374367 - RNA, 18 nt, Homo sapiens
guugagcuuuuccuuuag

SEQ ID NO: 374368 - RNA, 22 nt, Homo sapiens
guugugcuuaagccuauugauu

SEQ ID NO: 374369 - RNA, 22 nt, Homo sapiens
guuguggagucuucuguucugg

SEQ ID NO: 374370 - RNA, 17 nt, Homo sapiens
guuuggguacuggguaa

SEQ ID NO: 374371 - RNA, 21 nt, Homo sapiens
uaaagcuagaaccuuagcuuu

SEQ ID NO: 374372 - RNA, 20 nt, Homo sapiens
uaaaugccucaugcuuuauu

SEQ ID NO: 374373 - RNA, 18 nt, Homo sapiens
uaaauugcuucaccugag

SEQ ID NO: 374374 - RNA, 23 nt, Homo sapiens
uaacauguuuuuaagggaagcuu

SEQ ID NO: 374375 - RNA, 22 nt, Homo sapiens
uaacuauagagaauguugagua

SEQ ID NO: 374376 - RNA, 22 nt, Homo sapiens
ucuccauuguccagaugaggaa

SEQ ID NO: 374377 - RNA, 22 nt, Homo sapiens
ucucuugguugaacaguuugga

SEQ ID NO: 374378 - RNA, 22 nt, Homo sapiens
ucugacaaugaacaaucuauag

SEQ ID NO: 374379 - RNA, 21 nt, Homo sapiens
ucuggcuuucauuccccuucu

SEQ ID NO: 374380 - RNA, 22 nt, Homo sapiens
ucugucacugaaucccugucac

SEQ ID NO: 374381 - RNA, 22 nt, Homo sapiens
ucugucuuguccucacccuaga

SEQ ID NO: 374382 - RNA, 22 nt, Homo sapiens
ucugugcauuguaggauguuua

SEQ ID NO: 374383 - RNA, 17 nt, Homo sapiens
ucuucuguuacuguggc

SEQ ID NO: 374384 - RNA, 20 nt, Homo sapiens
ucuugggaauguagccuagg

SEQ ID NO: 374385 - RNA, 22 nt, Homo sapiens
ucuugguugaaaauucauaaua

SEQ ID NO: 374386 - RNA, 19 nt, Homo sapiens
ucuuugguacgugcuuuga

SEQ ID NO: 374387 - RNA, 22 nt, Homo sapiens
ucuuugguaggaguaggaggcc

SEQ ID NO: 374388 - RNA, 21 nt, Homo sapiens
ucuuuggucaccaguuuucau

SEQ ID NO: 374389 - RNA, 22 nt, Homo sapiens
ucuuuggucaucaugggaagca

SEQ ID NO: 374390 - RNA, 22 nt, Homo sapiens
ucuuuggugaauggucauccag

SEQ ID NO: 374391 - RNA, 22 nt, Homo sapiens
ugaaauggaaagaguguagacu

SEQ ID NO: 374392 - RNA, 22 nt, Homo sapiens
ugaaauggugcggucugcagca

SEQ ID NO: 374393 - RNA, 22 nt, Homo sapiens
ugaaauguuaaacaaguggcuc

SEQ ID NO: 374394 - RNA, 20 nt, Homo sapiens
ugacaagugagaauuauggg

SEQ ID NO: 374395 - RNA, 19 nt, Homo sapiens
ugacacuguuggugggagg

SEQ ID NO: 374396 - RNA, 22 nt, Homo sapiens
ugacaucugcuugugcccagga

SEQ ID NO: 374397 - RNA, 22 nt, Homo sapiens
ugaccacugucuaagauaggug

SEQ ID NO: 374398 - RNA, 22 nt, Homo sapiens
ugacuauaggauaacaugcauu

SEQ ID NO: 374399 - RNA, 22 nt, Homo sapiens
ugacuucauuuuuggccaugag

SEQ ID NO: 374400 - RNA, 22 nt, Homo sapiens
ugagaacauggagaacccccca

SEQ ID NO: 374401 - RNA, 22 nt, Homo sapiens
ugagaacugcagggagcugcau

SEQ ID NO: 374402 - RNA, 22 nt, Homo sapiens
ugagaaugaugauugguaaacc

SEQ ID NO: 374403 - RNA, 22 nt, Homo sapiens
ugagaaugcagaaucucgugca

SEQ ID NO: 374404 - RNA, 22 nt, Homo sapiens
ugagacaaaguuguuggauguu

SEQ ID NO: 374405 - RNA, 23 nt, Homo sapiens
ugagacauuggaaaguuaggcag

SEQ ID NO: 374406 - RNA, 22 nt, Homo sapiens
ugagacggaguuucacucuugu

SEQ ID NO: 374407 - RNA, 22 nt, Homo sapiens
ugagacugagucucccucuguc

SEQ ID NO: 374408 - RNA, 22 nt, Homo sapiens
ugagacugagucuugcucuauu

SEQ ID NO: 374409 - RNA, 22 nt, Homo sapiens
ugagacugagucuugcucuugu

SEQ ID NO: 374410 - RNA, 22 nt, Homo sapiens
ugagacugaguuucacuuuugu

SEQ ID NO: 374411 - RNA, 22 nt, Homo sapiens
ugagacugaguuuccaucuugu

SEQ ID NO: 374412 - RNA, 22 nt, Homo sapiens
ugagacugaguuucgcucuugu

SEQ ID NO: 374413 - RNA, 22 nt, Homo sapiens
ugagacugguuaauugauaaag

SEQ ID NO: 374414 - RNA, 22 nt, Homo sapiens
ugagaggugaauggcaggcuca

SEQ ID NO: 374415 - RNA, 22 nt, Homo sapiens
ugagaucagaaggauuucucug

SEQ ID NO: 374416 - RNA, 22 nt, Homo sapiens
ugagaucaugucauuugcacuc

SEQ ID NO: 374417 - RNA, 22 nt, Homo sapiens
ugagauuaucguaauguaucuc

SEQ ID NO: 374418 - RNA, 22 nt, Homo sapiens
ugagcugguacuaauauuauca

SEQ ID NO: 374419 - RNA, 22 nt, Homo sapiens
ugaggugcagcaauccucaugu

SEQ ID NO: 374420 - RNA, 22 nt, Homo sapiens
ugagguuauuuguucaagaagu

SEQ ID NO: 374421 - RNA, 22 nt, Homo sapiens
ugagguuggguaauuuaugaag

SEQ ID NO: 374422 - RNA, 22 nt, Homo sapiens
ugagguuguccacuauaaucca

SEQ ID NO: 374423 - RNA, 22 nt, Homo sapiens
ugaguauguuuagaaguaaagg

SEQ ID NO: 374424 - RNA, 22 nt, Homo sapiens
ugagucuguuccaaagaaauaa

SEQ ID NO: 374425 - RNA, 22 nt, Homo sapiens
ugaguuagguaauaauaaauau

SEQ ID NO: 374426 - RNA, 17 nt, Homo sapiens
ugauaagugugagguga

SEQ ID NO: 374427 - RNA, 22 nt, Homo sapiens
ugauaugcuuugaacucucugg

SEQ ID NO: 374428 - RNA, 23 nt, Homo sapiens
ugauguccacuuagggucuaggu

SEQ ID NO: 374429 - RNA, 20 nt, Homo sapiens
ugauuaguccacuuggcucu

SEQ ID NO: 374430 - RNA, 22 nt, Homo sapiens
ugcaaauuauugggccccaacu

SEQ ID NO: 374431 - RNA, 22 nt, Homo sapiens
ugcaaugucuucugaggggagc

SEQ ID NO: 374432 - RNA, 22 nt, Homo sapiens
ugcagcacaguagguuugcaau

SEQ ID NO: 374433 - RNA, 22 nt, Homo sapiens
ugcagcacugaacuucugggcu

SEQ ID NO: 374434 - RNA, 18 nt, Homo sapiens
ugcauacuaucugauuuu

SEQ ID NO: 374435 - RNA, 22 nt, Homo sapiens
ugcauaugcagcauuuaugauu

SEQ ID NO: 374436 - RNA, 18 nt, Homo sapiens
ugcauauguugaaccagc

SEQ ID NO: 374437 - RNA, 22 nt, Homo sapiens
ugcauauguugagaugcauauu

SEQ ID NO: 374438 - RNA, 22 nt, Homo sapiens
ugccaacugguuucuuuuaguu

SEQ ID NO: 374439 - RNA, 22 nt, Homo sapiens
ugccuaggcuggagugcagugg

SEQ ID NO: 374440 - RNA, 22 nt, Homo sapiens
ugccuaguagaaggugaacaug

SEQ ID NO: 374441 - RNA, 22 nt, Homo sapiens
ugcugcuguuaucauuuuacca

SEQ ID NO: 374442 - RNA, 22 nt, Homo sapiens
ugcugguuuaaaaugcaaauuc

SEQ ID NO: 374443 - RNA, 22 nt, Homo sapiens
ugcugguuuucaucaucagugg

SEQ ID NO: 374444 - RNA, 22 nt, Homo sapiens
ugcuuugguagaaaucuuuggu

SEQ ID NO: 374445 - RNA, 22 nt, Homo sapiens
uggaaacuuauguucuucugug

SEQ ID NO: 374446 - RNA, 23 nt, Homo sapiens
uggaagacuccucucuuggcugc

SEQ ID NO: 374447 - RNA, 22 nt, Homo sapiens
uggaaucuacuaaagcaaaauc

SEQ ID NO: 374448 - RNA, 20 nt, Homo sapiens
uggaaucuaggcggagguuu

SEQ ID NO: 374449 - RNA, 22 nt, Homo sapiens
uggaaucuuaggugaaggcuuu

SEQ ID NO: 374450 - RNA, 22 nt, Homo sapiens
uggaauggagagagggugcacg

SEQ ID NO: 374451 - RNA, 22 nt, Homo sapiens
uggaaugucagcuacaagaggg

SEQ ID NO: 374452 - RNA, 22 nt, Homo sapiens
uggaauuaauuaaaauauacug

SEQ ID NO: 374453 - RNA, 22 nt, Homo sapiens
uggacuguaagugccuugagua

SEQ ID NO: 374454 - RNA, 22 nt, Homo sapiens
uggagugauaugguuauauggg

SEQ ID NO: 374455 - RNA, 22 nt, Homo sapiens
uggcaacaucuggggacauguu

SEQ ID NO: 374456 - RNA, 21 nt, Homo sapiens
uggcaacauggauggauucug

SEQ ID NO: 374457 - RNA, 22 nt, Homo sapiens
uggcacaaugacccuugugggc

SEQ ID NO: 374458 - RNA, 22 nt, Homo sapiens
uggcaccauccaggugucucua

SEQ ID NO: 374459 - RNA, 22 nt, Homo sapiens
uggcagcugcuucaugggaugc

SEQ ID NO: 374460 - RNA, 22 nt, Homo sapiens
uggccuguaacgcugucucagc

SEQ ID NO: 374461 - RNA, 20 nt, Homo sapiens
ugggaaauguccaggacaua

SEQ ID NO: 374462 - RNA, 22 nt, Homo sapiens
ugggaugauguuaaacguacuc

SEQ ID NO: 374463 - RNA, 19 nt, Homo sapiens
uggguagugaugagacaua

SEQ ID NO: 374464 - RNA, 22 nt, Homo sapiens
uggucauggggcagcugacacu

SEQ ID NO: 374465 - RNA, 22 nt, Homo sapiens
uggucguggagucccuggcuuc

SEQ ID NO: 374466 - RNA, 20 nt, Homo sapiens
uuucaguacuuucuacuggc

SEQ ID NO: 374467 - RNA, 22 nt, Homo sapiens
uuucauguuuuucugugaggca

SEQ ID NO: 374468 - RNA, 22 nt, Homo sapiens
uuugacuaccaggaauguucuu

SEQ ID NO: 374469 - RNA, 22 nt, Homo sapiens
uuugaggaaaggcauaaguagg

SEQ ID NO: 374470 - RNA, 23 nt, Homo sapiens
uuugcacuugcuccuucuauggc

SEQ ID NO: 374471 - RNA, 22 nt, Homo sapiens
uuuggcaacguuggaucccuca

SEQ ID NO: 374472 - RNA, 22 nt, Homo sapiens
uuuggcaugggcuauuugcuuu

SEQ ID NO: 374473 - RNA, 22 nt, Homo sapiens
uuuggcauuuaaauaugcaugg

SEQ ID NO: 374474 - RNA, 22 nt, Homo sapiens
uuugggaaugguuugucuccca

SEQ ID NO: 374475 - RNA, 22 nt, Homo sapiens
uuugugagguggauagauugca

SEQ ID NO: 374476 - RNA, 22 nt, Homo sapiens
uuugugcuccugugagaaucua

SEQ ID NO: 374477 - RNA, 22 nt, Homo sapiens
uuuguucuucguuccugagcca

SEQ ID NO: 374478 - RNA, 22 nt, Homo sapiens
uuuuauguuuguucccugccaa

SEQ ID NO: 374479 - RNA, 22 nt, Homo sapiens
uuuugguuguuggguaagagua

SEQ ID NO: 374480 - RNA, 22 nt, Homo sapiens
uuuuugguugguaggcuauuaa

SEQ ID NO: 374481 - RNA, 22 nt, Homo sapiens
agagcaccauuuagcaagguga

SEQ ID NO: 374482 - RNA, 22 nt, Homo sapiens
agagguuuugcccucgagauaa

SEQ ID NO: 374483 - RNA, 22 nt, Homo sapiens
agauggguuuucacauguuggc

SEQ ID NO: 374484 - RNA, 22 nt, Homo sapiens
agcaagauugauggccugcagg

SEQ ID NO: 374485 - RNA, 22 nt, Homo sapiens
agcagcauuccaaaaaucugcu

SEQ ID NO: 374486 - RNA, 22 nt, Homo sapiens
agccauacaacguaugcaugua

SEQ ID NO: 374487 - RNA, 23 nt, Homo sapiens
agccuguugccuaggcagcucau

SEQ ID NO: 374488 - RNA, 22 nt, Homo sapiens
agcucacagccuagcacuguga

SEQ ID NO: 374489 - RNA, 20 nt, Homo sapiens
agcuccauuccugaaggcug

SEQ ID NO: 374490 - RNA, 22 nt, Homo sapiens
agcugguucuuugccuuguaga

SEQ ID NO: 374491 - RNA, 21 nt, Homo sapiens
agcugguuucuucuuacuccu

SEQ ID NO: 374492 - RNA, 20 nt, Homo sapiens
agcugguuuuaugaaucuuu

SEQ ID NO: 374493 - RNA, 22 nt, Homo sapiens
agcuguuguuaauuaacucauu

SEQ ID NO: 374494 - RNA, 22 nt, Homo sapiens
aggaagacugaaauugcuguuc

SEQ ID NO: 374495 - RNA, 19 nt, Homo sapiens
aggacuaaagacuagaagu

SEQ ID NO: 374496 - RNA, 21 nt, Homo sapiens
aggcaagguguuauuauugaa

SEQ ID NO: 374497 - RNA, 22 nt, Homo sapiens
agggagcaaaguggucuuucuc

SEQ ID NO: 374498 - RNA, 22 nt, Homo sapiens
aggugcugacaggauagguuuc

SEQ ID NO: 374499 - RNA, 22 nt, Homo sapiens
aggugcuugagggaagaaauua

SEQ ID NO: 374500 - RNA, 23 nt, Homo sapiens
agguuaugauuauagagcgagga

SEQ ID NO: 374501 - RNA, 22 nt, Homo sapiens
aaaagucuguagugaaagguga

SEQ ID NO: 374502 - RNA, 22 nt, Homo sapiens
aaaaguucuuugagccuugaca

SEQ ID NO: 374503 - RNA, 22 nt, Homo sapiens
aaaccaccauuacuuuugcacc

SEQ ID NO: 374504 - RNA, 22 nt, Homo sapiens
uuggaagacaaugcugauucuc

SEQ ID NO: 374505 - RNA, 22 nt, Homo sapiens
uuggaauuuuaaaauaggcaac

SEQ ID NO: 374506 - RNA, 22 nt, Homo sapiens
uuggacaagauugcagagaauu

SEQ ID NO: 374507 - RNA, 22 nt, Homo sapiens
uuggcaacauagugagaccccc

SEQ ID NO: 374508 - RNA, 22 nt, Homo sapiens
uuggcaagaauguaugccgauc

SEQ ID NO: 374509 - RNA, 21 nt, Homo sapiens
uuggccuggaggccugaaugu

SEQ ID NO: 374510 - RNA, 22 nt, Homo sapiens
uugggauggaaauuuguacccc

SEQ ID NO: 374511 - RNA, 22 nt, Homo sapiens
uuggguaguauagaagcaacaa

SEQ ID NO: 374512 - RNA, 22 nt, Homo sapiens
uugguuaucaucauuucagcaa

SEQ ID NO: 374513 - RNA, 22 nt, Homo sapiens
uugguuccauuuuaccagcucu

SEQ ID NO: 374514 - RNA, 22 nt, Homo sapiens
uugguucucuuuauaugcugga

SEQ ID NO: 374515 - RNA, 22 nt, Homo sapiens
uuguaaacaucuguacauugcu

SEQ ID NO: 374516 - RNA, 22 nt, Homo sapiens
uuguacaggaguguaagcuuca

SEQ ID NO: 374517 - RNA, 22 nt, Homo sapiens
uugugcuuguaacuacauucag

SEQ ID NO: 374518 - RNA, 22 nt, Homo sapiens
uugugggaggugauuagaucau

SEQ ID NO: 374519 - RNA, 22 nt, Homo sapiens
uugugguagugaaugagucuca

SEQ ID NO: 374520 - RNA, 22 nt, Homo sapiens
uugugguuuucagcuuauauau

SEQ ID NO: 374521 - RNA, 19 nt, Homo sapiens
uuguguccccacaaaauuc

SEQ ID NO: 374522 - RNA, 22 nt, Homo sapiens
uuguguuugaugcugacacgca

SEQ ID NO: 374523 - RNA, 22 nt, Homo sapiens
uuguguuuuuaguagggaaggg

SEQ ID NO: 374524 - RNA, 22 nt, Homo sapiens
uuuaaagcaugacgagaagaag

SEQ ID NO: 374525 - RNA, 22 nt, Homo sapiens
uuuaaugcgucucugaguuuug

SEQ ID NO: 374526 - RNA, 22 nt, Homo sapiens
uuuacagucuuuugugugaguc

SEQ ID NO: 374527 - RNA, 22 nt, Homo sapiens
uuugagaaugcuaccagagaag

SEQ ID NO: 374528 - RNA, 22 nt, Homo sapiens
uuugagaucuuuagaaucaggc

SEQ ID NO: 374529 - RNA, 22 nt, Homo sapiens
uuugagcuagagucucacucug

SEQ ID NO: 374530 - RNA, 22 nt, Homo sapiens
ucugucuuugccuaaguuuguc

SEQ ID NO: 374531 - RNA, 22 nt, Homo sapiens
ucugugcauggcagaggaauga

SEQ ID NO: 374532 - RNA, 19 nt, Homo sapiens
ucugugcuugucccccugu

SEQ ID NO: 374533 - RNA, 18 nt, Homo sapiens
ucugugguguaaauacgu

SEQ ID NO: 374534 - RNA, 22 nt, Homo sapiens
ucugugguuguugcauggaaug

SEQ ID NO: 374535 - RNA, 22 nt, Homo sapiens
ucuguguugaugcucauuaauu

SEQ ID NO: 374536 - RNA, 22 nt, Homo sapiens
ucuucagucauauuggccugga

SEQ ID NO: 374537 - RNA, 22 nt, Homo sapiens
ucuugccacuucauccccuuuc

SEQ ID NO: 374538 - RNA, 22 nt, Homo sapiens
ucuuggguuguuggcuucuccu

SEQ ID NO: 374539 - RNA, 22 nt, Homo sapiens
ucuuggguuugccuugcugcug

SEQ ID NO: 374540 - RNA, 22 nt, Homo sapiens
ucuuugagugcccugagucccu

SEQ ID NO: 374541 - RNA, 22 nt, Homo sapiens
ucuuugauaagauccagaagaa

SEQ ID NO: 374542 - RNA, 22 nt, Homo sapiens
ucuuugauuaugcagauggguu

SEQ ID NO: 374543 - RNA, 19 nt, Homo sapiens
ucuuugcuuuucuaagagg

SEQ ID NO: 374544 - RNA, 22 nt, Homo sapiens
ucuuuggcugugaagaauaaug

SEQ ID NO: 374545 - RNA, 22 nt, Homo sapiens
ucuuugguagaagcuauuuuau

SEQ ID NO: 374546 - RNA, 22 nt, Homo sapiens
ucuuuggucuacuuucauaugu

SEQ ID NO: 374547 - RNA, 22 nt, Homo sapiens
ucuuugguugcacugcaggugu

SEQ ID NO: 374548 - RNA, 22 nt, Homo sapiens
aaacugaucugaaggccaggcu

SEQ ID NO: 374549 - RNA, 22 nt, Homo sapiens
aaacuugucuaauuauaagcau

SEQ ID NO: 374550 - RNA, 23 nt, Homo sapiens
aaagacuagucaggugcaguggu

SEQ ID NO: 374551 - RNA, 22 nt, Homo sapiens
aaagaguucagguagauuucaa

SEQ ID NO: 374552 - RNA, 22 nt, Homo sapiens
aaagcagcaggugguuuucaau

SEQ ID NO: 374553 - RNA, 22 nt, Homo sapiens
aaagucuagaggaucaugugug

SEQ ID NO: 374554 - RNA, 22 nt, Homo sapiens
aaagugcugggauuuuaggcau

SEQ ID NO: 374555 - RNA, 22 nt, Homo sapiens
aaagugcuguagacugggcgca

SEQ ID NO: 374556 - RNA, 22 nt, Homo sapiens
aaagugcuuccuuuuugagggu

SEQ ID NO: 374557 - RNA, 22 nt, Homo sapiens
aaaugcauaucaagauugcccu

SEQ ID NO: 374558 - RNA, 22 nt, Homo sapiens
aaaugcuucuauguggcauguu

SEQ ID NO: 374559 - RNA, 22 nt, Homo sapiens
aacagcauaguacccgugauaa

SEQ ID NO: 374560 - RNA, 22 nt, Homo sapiens
aacaucaaccaugaggguugga

SEQ ID NO: 374561 - RNA, 22 nt, Homo sapiens
aacccugacacaagcagaauuu

SEQ ID NO: 374562 - RNA, 22 nt, Homo sapiens
aacuggccuggcgugcagaggg

SEQ ID NO: 374563 - RNA, 22 nt, Homo sapiens
aagagguaggaaauggucauuu

SEQ ID NO: 374564 - RNA, 22 nt, Homo sapiens
aagcaccaauaggagauuuguc

SEQ ID NO: 374565 - RNA, 22 nt, Homo sapiens
aagcuggauuuaguguggagca

SEQ ID NO: 374566 - RNA, 22 nt, Homo sapiens
aagcuguuguucauccugaauu

SEQ ID NO: 374567 - RNA, 22 nt, Homo sapiens
aaggagcuuaagugacuuguac

SEQ ID NO: 374568 - RNA, 22 nt, Homo sapiens
aaggaguaucuguuuucucacc

SEQ ID NO: 374569 - RNA, 22 nt, Homo sapiens
aaggcaagagaaaauuucgagu

SEQ ID NO: 374570 - RNA, 22 nt, Homo sapiens
aaggcaauuuguugugaggauu

SEQ ID NO: 374571 - RNA, 22 nt, Homo sapiens
aaggcagugugcacauaacacu

SEQ ID NO: 374572 - RNA, 22 nt, Homo sapiens
aagguggugucagagagcuuau

SEQ ID NO: 374573 - RNA, 22 nt, Homo sapiens
aagugacuagacuaugaaaccu

SEQ ID NO: 374574 - RNA, 22 nt, Homo sapiens
aagugcuuccuuucagaggguu

SEQ ID NO: 374575 - RNA, 20 nt, Homo sapiens
aagugcuuccuuuuagaggg

SEQ ID NO: 374576 - RNA, 22 nt, Homo sapiens
aagugcuuuuuagauaugguuu

SEQ ID NO: 374577 - RNA, 21 nt, Homo sapiens
aauaaagcaaccuuaugccau

SEQ ID NO: 374578 - RNA, 22 nt, Homo sapiens
aauaaagucugaagugugcuua

SEQ ID NO: 374579 - RNA, 22 nt, Homo sapiens
aauaagcugagagaauucuaca

SEQ ID NO: 374580 - RNA, 22 nt, Homo sapiens
aauaucacaguggguguacacc

SEQ ID NO: 374581 - RNA, 22 nt, Homo sapiens
aaucaacauuguuuuaagucaa

SEQ ID NO: 374582 - RNA, 22 nt, Homo sapiens
aaucacacuugauguugagcaa

SEQ ID NO: 374583 - RNA, 22 nt, Homo sapiens
aaucacaggucuuggcugcaug

SEQ ID NO: 374584 - RNA, 22 nt, Homo sapiens
aauggcuucuuauugugguuca

SEQ ID NO: 374585 - RNA, 22 nt, Homo sapiens
aauggguaguacugugguaaca

SEQ ID NO: 374586 - RNA, 22 nt, Homo sapiens
aauguguuuugaaaucaggaag

SEQ ID NO: 374587 - RNA, 22 nt, Homo sapiens
aauuaggcuagaauguuauuaa

SEQ ID NO: 374588 - RNA, 22 nt, Homo sapiens
aauuggugaccaagggaaggac

SEQ ID NO: 374589 - RNA, 22 nt, Homo sapiens
aauugguuaagauaagaucaua

SEQ ID NO: 374590 - RNA, 21 nt, Homo sapiens
acaaagcuggagggagacugc

SEQ ID NO: 374591 - RNA, 20 nt, Homo sapiens
acaaaugcauucugugacau

SEQ ID NO: 374592 - RNA, 22 nt, Homo sapiens
acacauuagcaagugcuguuau

SEQ ID NO: 374593 - RNA, 22 nt, Homo sapiens
acacuauugagguuuguuugca

SEQ ID NO: 374594 - RNA, 22 nt, Homo sapiens
acacuguagcugagggcaugcg

SEQ ID NO: 374595 - RNA, 20 nt, Homo sapiens
acacugugcuaaggauuuuc

SEQ ID NO: 374596 - RNA, 21 nt, Homo sapiens
acaguacuugagaucuuuuga

SEQ ID NO: 374597 - RNA, 22 nt, Homo sapiens
acaguacuuuuggauuugugaa

SEQ ID NO: 374598 - RNA, 23 nt, Homo sapiens
acagucuaguuugaagucaggua

SEQ ID NO: 374599 - RNA, 22 nt, Homo sapiens
acaugcauggcaugcauuguac

SEQ ID NO: 374600 - RNA, 22 nt, Homo sapiens
acauggcuuaugaauuuggaga

SEQ ID NO: 374601 - RNA, 22 nt, Homo sapiens
accaguuuuuuauacaucuucu

SEQ ID NO: 374602 - RNA, 22 nt, Homo sapiens
acccugucauccacauggugcu

SEQ ID NO: 374603 - RNA, 22 nt, Homo sapiens
accuggguguauguucaguuug

SEQ ID NO: 374604 - RNA, 19 nt, Homo sapiens
acugcacuccaaccuccug

SEQ ID NO: 374605 - RNA, 22 nt, Homo sapiens
acugcacuccaaccuguugggc

SEQ ID NO: 374606 - RNA, 22 nt, Homo sapiens
acugcacuccaccuugggcaac

SEQ ID NO: 374607 - RNA, 22 nt, Homo sapiens
acugcacuccagacucugucuc

SEQ ID NO: 374608 - RNA, 22 nt, Homo sapiens
acugcacuccagccugcugaca

SEQ ID NO: 374609 - RNA, 22 nt, Homo sapiens
acugcacuccagccugcuggau

SEQ ID NO: 374610 - RNA, 22 nt, Homo sapiens
acugcacuccagccugcuggca

SEQ ID NO: 374611 - RNA, 22 nt, Homo sapiens
acugcacuccagccuggaccac

SEQ ID NO: 374612 - RNA, 22 nt, Homo sapiens
acugcacuccagccuuagugac

SEQ ID NO: 374613 - RNA, 20 nt, Homo sapiens
acugcacuccagccuuccag

SEQ ID NO: 374614 - RNA, 22 nt, Homo sapiens
acugcacuccagccuucgugac

SEQ ID NO: 374615 - RNA, 22 nt, Homo sapiens
acugcacuccagccuuggagac

SEQ ID NO: 374616 - RNA, 22 nt, Homo sapiens
acugcacuccagccuugugaca

SEQ ID NO: 374617 - RNA, 22 nt, Homo sapiens
acugcacuccaguuccgggcaa

SEQ ID NO: 374618 - RNA, 18 nt, Homo sapiens
acugcacuccauccuagg

SEQ ID NO: 374619 - RNA, 22 nt, Homo sapiens
acugcacuccggccucgugaca

SEQ ID NO: 374620 - RNA, 22 nt, Homo sapiens
acugcacucuagccccugcgac

SEQ ID NO: 374621 - RNA, 22 nt, Homo sapiens
acugcacuuauccuccaauguu

SEQ ID NO: 374622 - RNA, 22 nt, Homo sapiens
acugcacuucagccuguugaca

SEQ ID NO: 374623 - RNA, 22 nt, Homo sapiens
acugcacuucagccuugugaca

SEQ ID NO: 374624 - RNA, 22 nt, Homo sapiens
agaaauguuuacucacccccuu

SEQ ID NO: 374625 - RNA, 22 nt, Homo sapiens
agaauaauguccccccaaggga

SEQ ID NO: 374626 - RNA, 22 nt, Homo sapiens
agacacuguugaaaaggcccca

SEQ ID NO: 374627 - RNA, 18 nt, Homo sapiens
agagcacugaguuuuaga

SEQ ID NO: 374628 - RNA, 22 nt, Homo sapiens
agagcacuguggguccaaauau

SEQ ID NO: 374629 - RNA, 22 nt, Homo sapiens
agaguaguuucuauauucuuca

SEQ ID NO: 374630 - RNA, 22 nt, Homo sapiens
agagugcuauagauuagauuuc

SEQ ID NO: 374631 - RNA, 22 nt, Homo sapiens
agauacaucuaugugucugugu

SEQ ID NO: 374632 - RNA, 22 nt, Homo sapiens
agaucauaugcaguaaugaacu

SEQ ID NO: 374633 - RNA, 22 nt, Homo sapiens
agauguuguucaucugauuguu

SEQ ID NO: 374634 - RNA, 22 nt, Homo sapiens
agcaagauccagucgcacagga

SEQ ID NO: 374635 - RNA, 22 nt, Homo sapiens
agcacagugguuaaguuucuua

SEQ ID NO: 374636 - RNA, 22 nt, Homo sapiens
agcagcaugcaaauggacuaau

SEQ ID NO: 374637 - RNA, 22 nt, Homo sapiens
uaaguacaugcuagauggaaug

SEQ ID NO: 374638 - RNA, 22 nt, Homo sapiens
uaagugaaggaaguguguuuac

SEQ ID NO: 374639 - RNA, 22 nt, Homo sapiens
uaagugcuugacuuugauguuu

SEQ ID NO: 374640 - RNA, 20 nt, Homo sapiens
uaagugcuugaugaaugaac

SEQ ID NO: 374641 - RNA, 20 nt, Homo sapiens
uaagugcuuuauauugauua

SEQ ID NO: 374642 - RNA, 22 nt, Homo sapiens
uaaugcaucaugguuggcaaac

SEQ ID NO: 374643 - RNA, 20 nt, Homo sapiens
uacacguaugagcacaugug

SEQ ID NO: 374644 - RNA, 22 nt, Homo sapiens
uacagccacauaauguaugauu

SEQ ID NO: 374645 - RNA, 22 nt, Homo sapiens
uacauacuguaugguucuguuu

SEQ ID NO: 374646 - RNA, 16 nt, Homo sapiens
uacauuuguuacaugg

SEQ ID NO: 374647 - RNA, 22 nt, Homo sapiens
uacugcacuggaggccucagau

SEQ ID NO: 374648 - RNA, 21 nt, Homo sapiens
uacuggagauacagucugcaa

SEQ ID NO: 374649 - RNA, 22 nt, Homo sapiens
uacuguacugcaguucugcaaa

SEQ ID NO: 374650 - RNA, 18 nt, Homo sapiens
uagcagacaucauugggg

SEQ ID NO: 374651 - RNA, 22 nt, Homo sapiens
uagcagacuauuuugugauaau

SEQ ID NO: 374652 - RNA, 22 nt, Homo sapiens
uagcagcauaaauggacuaaga

SEQ ID NO: 374653 - RNA, 22 nt, Homo sapiens
uagcagcauuuuuguagaguau

SEQ ID NO: 374654 - RNA, 22 nt, Homo sapiens
uagccucacaaagugcuuaaga

SEQ ID NO: 374655 - RNA, 22 nt, Homo sapiens
uagcugcuguauguacacggau

SEQ ID NO: 374656 - RNA, 22 nt, Homo sapiens
uaggucuuuuaugaaauauauu

SEQ ID NO: 374657 - RNA, 22 nt, Homo sapiens
uaggugcacaguaaauauaugu

SEQ ID NO: 374658 - RNA, 22 nt, Homo sapiens
uaguucauuuuucuugcuuaga

SEQ ID NO: 374659 - RNA, 22 nt, Homo sapiens
uauacagcaaguuacugugcug

SEQ ID NO: 374660 - RNA, 22 nt, Homo sapiens
uaucacagugcuggaguauucc

SEQ ID NO: 374661 - RNA, 22 nt, Homo sapiens
uaucacaguugcauauuuaagg

SEQ ID NO: 374662 - RNA, 22 nt, Homo sapiens
uaucagaguuacacugaagacu

SEQ ID NO: 374663 - RNA, 23 nt, Homo sapiens
uaucucaaugcacagagaggaaa

SEQ ID NO: 374664 - RNA, 22 nt, Homo sapiens
uaugaggaguauaacccgguga

SEQ ID NO: 374665 - RNA, 22 nt, Homo sapiens
uaugcacacacguguuuaugug

SEQ ID NO: 374666 - RNA, 22 nt, Homo sapiens
uaugcacaugcaugcuugaaua

SEQ ID NO: 374667 - RNA, 21 nt, Homo sapiens
uauggcuuagucaguguuucc

SEQ ID NO: 374668 - RNA, 20 nt, Homo sapiens
uauucacucuccagucuugc

SEQ ID NO: 374669 - RNA, 22 nt, Homo sapiens
uauugcuaaauucuuuuccuag

SEQ ID NO: 374670 - RNA, 22 nt, Homo sapiens
ucaaaaccucagagaguagagc

SEQ ID NO: 374671 - RNA, 22 nt, Homo sapiens
ucaaaguauucuucugagaacc

SEQ ID NO: 374672 - RNA, 22 nt, Homo sapiens
ucacacucucaccaacauuugg

SEQ ID NO: 374673 - RNA, 22 nt, Homo sapiens
ucacacugaauuugaagcaaug

SEQ ID NO: 374674 - RNA, 19 nt, Homo sapiens
ucacacuguggcuucuuua

SEQ ID NO: 374675 - RNA, 22 nt, Homo sapiens
ucacacuguuuugauuauuaua

SEQ ID NO: 374676 - RNA, 22 nt, Homo sapiens
ucacagucacugucacguugaa

SEQ ID NO: 374677 - RNA, 22 nt, Homo sapiens
ucacagucggugacuucuugcu

SEQ ID NO: 374678 - RNA, 22 nt, Homo sapiens
ucacagucuccucuagggaggg

SEQ ID NO: 374679 - RNA, 23 nt, Homo sapiens
ucacaguggcugcuuaauuguga

SEQ ID NO: 374680 - RNA, 22 nt, Homo sapiens
ucacauggcagagaagaagcuc

SEQ ID NO: 374681 - RNA, 22 nt, Homo sapiens
ucacucagaccuggugauaugc

SEQ ID NO: 374682 - RNA, 21 nt, Homo sapiens
ucacugagcaucaugguuuca

SEQ ID NO: 374683 - RNA, 22 nt, Homo sapiens
ucacugaggucugagcuuuaug

SEQ ID NO: 374684 - RNA, 21 nt, Homo sapiens
ucacugagguuaaauaggguu

SEQ ID NO: 374685 - RNA, 20 nt, Homo sapiens
ucacugagugguccacagua

SEQ ID NO: 374686 - RNA, 22 nt, Homo sapiens
ucacugggagcauuugagccuu

SEQ ID NO: 374687 - RNA, 20 nt, Homo sapiens
ucacugugaacuucuugagg

SEQ ID NO: 374688 - RNA, 22 nt, Homo sapiens
ucacuguggaacucaaaaagcu

SEQ ID NO: 374689 - RNA, 22 nt, Homo sapiens
ucagacacugagcaaacgacua

SEQ ID NO: 374690 - RNA, 22 nt, Homo sapiens
ucagaugauucuguuguugugu

SEQ ID NO: 374691 - RNA, 23 nt, Homo sapiens
ucagugucuggauccugcucagu

SEQ ID NO: 374692 - RNA, 22 nt, Homo sapiens
ucauucauuugcucacuccaca

SEQ ID NO: 374693 - RNA, 18 nt, Homo sapiens
uccaguuuucccagcauc

SEQ ID NO: 374694 - RNA, 22 nt, Homo sapiens
uccauaguacuagaaacugacc

SEQ ID NO: 374695 - RNA, 22 nt, Homo sapiens
uccaugaggcuacaguaaucuc

SEQ ID NO: 374696 - RNA, 22 nt, Homo sapiens
ucccuagacuccugccuuucag

SEQ ID NO: 374697 - RNA, 20 nt, Homo sapiens
uccugagauucccaguucuc

SEQ ID NO: 374698 - RNA, 22 nt, Homo sapiens
uccuucaguccaguggguuuug

SEQ ID NO: 374699 - RNA, 22 nt, Homo sapiens
ucgcugggaagacugaaguguc

SEQ ID NO: 374700 - RNA, 22 nt, Homo sapiens
ucguggccugugaguccucccc

SEQ ID NO: 374701 - RNA, 17 nt, Homo sapiens
ucuaauaauaugcauuu

SEQ ID NO: 374702 - RNA, 22 nt, Homo sapiens
ucucauggagucaggagcagaa

SEQ ID NO: 374703 - RNA, 21 nt, Homo sapiens
ucucucaaccaggaagugggc

SEQ ID NO: 374704 - RNA, 22 nt, Homo sapiens
ucucugaaacucuugacauccu

SEQ ID NO: 374705 - RNA, 23 nt, Homo sapiens
ucuggaucauucguagugccagc

SEQ ID NO: 374706 - RNA, 22 nt, Homo sapiens
ucuggcaagauauccauugcuu

SEQ ID NO: 374707 - RNA, 22 nt, Homo sapiens
ucuggccuacaaguaauuuuau

SEQ ID NO: 374708 - RNA, 22 nt, Homo sapiens
ucuggccuacaucauuuuuccg

SEQ ID NO: 374709 - RNA, 22 nt, Homo sapiens
ucuggcuccaaagucuauuuuu

SEQ ID NO: 374710 - RNA, 23 nt, Homo sapiens
ucugguguugucaaaugcugguu

SEQ ID NO: 374711 - RNA, 22 nt, Homo sapiens
ucugucuugugguuugagugcc

SEQ ID NO: 374712 - RNA, 22 nt, Homo sapiens
uguuuugguugucccuggccag

SEQ ID NO: 374713 - RNA, 22 nt, Homo sapiens
uuaaaguaauugaaauggccuu

SEQ ID NO: 374714 - RNA, 22 nt, Homo sapiens
uuaaagugcuguuuuugccggg

SEQ ID NO: 374715 - RNA, 22 nt, Homo sapiens
uuaagacaccaaucauuggauu

SEQ ID NO: 374716 - RNA, 22 nt, Homo sapiens
uuaaggcuuguacuuguuuucu

SEQ ID NO: 374717 - RNA, 23 nt, Homo sapiens
uuaaggugaugucuuugugccuc

SEQ ID NO: 374718 - RNA, 22 nt, Homo sapiens
uuaaucaggccguuuccuaaga

SEQ ID NO: 374719 - RNA, 22 nt, Homo sapiens
uuaaugaacuuuauuuuguaga

SEQ ID NO: 374720 - RNA, 18 nt, Homo sapiens
uuagagugcauuacuuug

SEQ ID NO: 374721 - RNA, 22 nt, Homo sapiens
uuagcagcaugaaaauggacug

SEQ ID NO: 374722 - RNA, 22 nt, Homo sapiens
uuagguagucucugucagaggg

SEQ ID NO: 374723 - RNA, 22 nt, Homo sapiens
uucacagccgcaccccaucacu

SEQ ID NO: 374724 - RNA, 22 nt, Homo sapiens
uucacaguguuucucacgguua

SEQ ID NO: 374725 - RNA, 22 nt, Homo sapiens
uucagguaauuaugguuugucu

SEQ ID NO: 374726 - RNA, 22 nt, Homo sapiens
uucagguacuauaggcuguugg

SEQ ID NO: 374727 - RNA, 22 nt, Homo sapiens
uucagguaguuuaacuguucca

SEQ ID NO: 374728 - RNA, 22 nt, Homo sapiens
cuuuugugauuccucaguuacu

SEQ ID NO: 374729 - RNA, 22 nt, Homo sapiens
cuuuuugcugcagcaauacugg

SEQ ID NO: 374730 - RNA, 22 nt, Homo sapiens
gaaaauccauccccagggagua

SEQ ID NO: 374731 - RNA, 22 nt, Homo sapiens
gaaagcugguauagauacauua

SEQ ID NO: 374732 - RNA, 22 nt, Homo sapiens
gaaaguaauuaacgauuguugc

SEQ ID NO: 374733 - RNA, 22 nt, Homo sapiens
gaaauggaucagagcaagcuuu

SEQ ID NO: 374734 - RNA, 22 nt, Homo sapiens
gaagcagcauucugguuuuugg

SEQ ID NO: 374735 - RNA, 22 nt, Homo sapiens
gaaggagcuuaucugccauuuc

SEQ ID NO: 374736 - RNA, 22 nt, Homo sapiens
gaaucacaguuauuagagcagc

SEQ ID NO: 374737 - RNA, 22 nt, Homo sapiens
gaaucauuggguugauucaaga

SEQ ID NO: 374738 - RNA, 22 nt, Homo sapiens
gugccuucuagcuaugguuggc

SEQ ID NO: 374739 - RNA, 22 nt, Homo sapiens
guggagucaucacucagagugg

SEQ ID NO: 374740 - RNA, 22 nt, Homo sapiens
gugugcucaucacaugcaauag

SEQ ID NO: 374741 - RNA, 22 nt, Homo sapiens
guucaguuuugaaauguuaauu

SEQ ID NO: 374742 - RNA, 22 nt, Homo sapiens
guuggguaauggggcgcaccgu

SEQ ID NO: 374743 - RNA, 21 nt, Homo sapiens
uaaaacuguaacuuuguccug

SEQ ID NO: 374744 - RNA, 22 nt, Homo sapiens
uaaagcugaaaugauuaugaca

SEQ ID NO: 374745 - RNA, 22 nt, Homo sapiens
uaaaugcuuaauugaaugugga

SEQ ID NO: 374746 - RNA, 22 nt, Homo sapiens
uaacagucuccucaagguguug

SEQ ID NO: 374747 - RNA, 20 nt, Homo sapiens
uaacuguggcuucuuuuggc

SEQ ID NO: 374748 - RNA, 16 nt, Homo sapiens
uaagccccacgugcau

SEQ ID NO: 374749 - RNA, 22 nt, Homo sapiens
uaaggcuucuuggaauacugca

SEQ ID NO: 374750 - RNA, 22 nt, Homo sapiens
uaaggcuuugucuuaggacuuu

SEQ ID NO: 374751 - RNA, 22 nt, Homo sapiens
uaaggcuuuuguucagcguggg

SEQ ID NO: 374752 - RNA, 22 nt, Homo sapiens
aguaucacaggcaaaacagaau

SEQ ID NO: 374753 - RNA, 22 nt, Homo sapiens
agucugguguucucacacuagu

SEQ ID NO: 374754 - RNA, 22 nt, Homo sapiens
agugguguugccuguugaccua

SEQ ID NO: 374755 - RNA, 22 nt, Homo sapiens
agugguuugaucacagcucacu

SEQ ID NO: 374756 - RNA, 22 nt, Homo sapiens
aguguuuuuacaagcacucugg

SEQ ID NO: 374757 - RNA, 22 nt, Homo sapiens
auaaacagcuuauccucuauuc

SEQ ID NO: 374758 - RNA, 22 nt, Homo sapiens
auaaagccaugagcuugagaug

SEQ ID NO: 374759 - RNA, 22 nt, Homo sapiens
auaagaucauuugcuaagaggg

SEQ ID NO: 374760 - RNA, 22 nt, Homo sapiens
auacuguuuuacaucauugccu

SEQ ID NO: 374761 - RNA, 22 nt, Homo sapiens
auagaauguuugcgccagguga

SEQ ID NO: 374762 - RNA, 22 nt, Homo sapiens
auagaggacugaggugaucuuu

SEQ ID NO: 374763 - RNA, 22 nt, Homo sapiens
auagcaaugccccauucccagu

SEQ ID NO: 374764 - RNA, 22 nt, Homo sapiens
auagcagcagcuaguagugaua

SEQ ID NO: 374765 - RNA, 22 nt, Homo sapiens
auagcaucauuucuugaaaaga

SEQ ID NO: 374766 - RNA, 22 nt, Homo sapiens
auauaccuaggcuacaugguuu

SEQ ID NO: 374767 - RNA, 22 nt, Homo sapiens
auauaugcacacgugugcauau

SEQ ID NO: 374768 - RNA, 22 nt, Homo sapiens
auaugcacaguggaguacuauu

SEQ ID NO: 374769 - RNA, 22 nt, Homo sapiens
auaugcuuauuagcaagaaaua

SEQ ID NO: 374770 - RNA, 22 nt, Homo sapiens
aucaaagccaugcucaguuuuc

SEQ ID NO: 374771 - RNA, 22 nt, Homo sapiens
aucaaagugaaauauuaguuau

SEQ ID NO: 374772 - RNA, 22 nt, Homo sapiens
aucaaaguuucccagaaguugu

SEQ ID NO: 374773 - RNA, 22 nt, Homo sapiens
aucacagaacuuugagcagaga

SEQ ID NO: 374774 - RNA, 22 nt, Homo sapiens
aucacaggcaaaauuccuucuc

SEQ ID NO: 374775 - RNA, 20 nt, Homo sapiens
aucacuggagaaggaaaccu

SEQ ID NO: 374776 - RNA, 22 nt, Homo sapiens
aucagaaucucuugagaguguu

SEQ ID NO: 374777 - RNA, 22 nt, Homo sapiens
aucagauaccuguugggaaaug

SEQ ID NO: 374778 - RNA, 22 nt, Homo sapiens
aucagauggcuaaaacagaaga

SEQ ID NO: 374779 - RNA, 22 nt, Homo sapiens
aucauccugucaggagcuguga

SEQ ID NO: 374780 - RNA, 22 nt, Homo sapiens
auccacaugcaguuggaaacag

SEQ ID NO: 374781 - RNA, 22 nt, Homo sapiens
auccccugcacggggugucauu

SEQ ID NO: 374782 - RNA, 22 nt, Homo sapiens
aucuuguguugaauggugcaga

SEQ ID NO: 374783 - RNA, 22 nt, Homo sapiens
augaaaguguguggaaacuuga

SEQ ID NO: 374784 - RNA, 23 nt, Homo sapiens
augaacucaucauuuuuuauggc

SEQ ID NO: 374785 - RNA, 22 nt, Homo sapiens
augaagauguugccuuuuuaau

SEQ ID NO: 374786 - RNA, 22 nt, Homo sapiens
augacuaaaggguuuauguuga

SEQ ID NO: 374787 - RNA, 22 nt, Homo sapiens
augacuauugcacuuuccuggu

SEQ ID NO: 374788 - RNA, 22 nt, Homo sapiens
augaggaaggagccuuugucug

SEQ ID NO: 374789 - RNA, 22 nt, Homo sapiens
augaggaagucaggcccagggg

SEQ ID NO: 374790 - RNA, 22 nt, Homo sapiens
augaggugcagaggaaaugagu

SEQ ID NO: 374791 - RNA, 22 nt, Homo sapiens
augauacuggcuucauagaaug

SEQ ID NO: 374792 - RNA, 22 nt, Homo sapiens
augcacuguauaggaucuugcg

SEQ ID NO: 374793 - RNA, 22 nt, Homo sapiens
augcagaucacauuuuucuguc

SEQ ID NO: 374794 - RNA, 22 nt, Homo sapiens
augcauauuccugggccucacu

SEQ ID NO: 374795 - RNA, 18 nt, Homo sapiens
augcauauuuuaaguugu

SEQ ID NO: 374796 - RNA, 22 nt, Homo sapiens
augcauggcagagucaggguac

SEQ ID NO: 374797 - RNA, 22 nt, Homo sapiens
augccacuucucuaagucaugu

SEQ ID NO: 374798 - RNA, 21 nt, Homo sapiens
auggaaagacugccucuucaa

SEQ ID NO: 374799 - RNA, 22 nt, Homo sapiens
auggaaugguugggucauaagg

SEQ ID NO: 374800 - RNA, 22 nt, Homo sapiens
auggacagacacuggccuucug

SEQ ID NO: 374801 - RNA, 22 nt, Homo sapiens
auggcacagaguagaugcucaa

SEQ ID NO: 374802 - RNA, 22 nt, Homo sapiens
auggccgggugcgguggcucac

SEQ ID NO: 374803 - RNA, 22 nt, Homo sapiens
auggcucuuauuauuugaggua

SEQ ID NO: 374804 - RNA, 22 nt, Homo sapiens
augguuugugcuccuauaagaa

SEQ ID NO: 374805 - RNA, 22 nt, Homo sapiens
augucaacauagacaguagagu

SEQ ID NO: 374806 - RNA, 22 nt, Homo sapiens
augugcaaauuuccaaacucuu

SEQ ID NO: 374807 - RNA, 22 nt, Homo sapiens
augugcuugagggaaaucaguu

SEQ ID NO: 374808 - RNA, 22 nt, Homo sapiens
auguuaacaucuuaguuuucau

SEQ ID NO: 374809 - RNA, 22 nt, Homo sapiens
auuacaugucuauccaugaaca

SEQ ID NO: 374810 - RNA, 20 nt, Homo sapiens
auugaacucaguauucugaa

SEQ ID NO: 374811 - RNA, 22 nt, Homo sapiens
auugagcuuuuuaaaauauagu

SEQ ID NO: 374812 - RNA, 22 nt, Homo sapiens
auugcacaucugcacuacagcc

SEQ ID NO: 374813 - RNA, 22 nt, Homo sapiens
auugcccaggcuggagugcagu

SEQ ID NO: 374814 - RNA, 22 nt, Homo sapiens
auuugacacugagagccucagu

SEQ ID NO: 374815 - RNA, 22 nt, Homo sapiens
auuugucaauacacuucuucca

SEQ ID NO: 374816 - RNA, 22 nt, Homo sapiens
caaaagugauugcgguuuuugc

SEQ ID NO: 374817 - RNA, 22 nt, Homo sapiens
caaaggauucauuuccaggagu

SEQ ID NO: 374818 - RNA, 22 nt, Homo sapiens
caaaggcuguuauaggccagga

SEQ ID NO: 374819 - RNA, 22 nt, Homo sapiens
caaagugcugggacuggccggg

SEQ ID NO: 374820 - RNA, 22 nt, Homo sapiens
caaagugcugggaugggccagg

SEQ ID NO: 374821 - RNA, 22 nt, Homo sapiens
caacacuguuuauuggauagcc

SEQ ID NO: 374822 - RNA, 22 nt, Homo sapiens
caaggugcugagacaggagccc

SEQ ID NO: 374823 - RNA, 22 nt, Homo sapiens
caagugcucuaggauccugagu

SEQ ID NO: 374824 - RNA, 22 nt, Homo sapiens
caaucugucuuuuagggggcca

SEQ ID NO: 374825 - RNA, 22 nt, Homo sapiens
cacauguucaggagcacuuaga

SEQ ID NO: 374826 - RNA, 22 nt, Homo sapiens
cacauguuuuagcauggcuguu

SEQ ID NO: 374827 - RNA, 19 nt, Homo sapiens
caccagugcaugcuacuau

SEQ ID NO: 374828 - RNA, 22 nt, Homo sapiens
cacugcacuccagucccgucuc

SEQ ID NO: 374829 - RNA, 22 nt, Homo sapiens
cacugcacucuucuucugggca

SEQ ID NO: 374830 - RNA, 22 nt, Homo sapiens
cacugggccaucacuuaauauu

SEQ ID NO: 374831 - RNA, 22 nt, Homo sapiens
cacuggguuagaacaugcuccu

SEQ ID NO: 374832 - RNA, 21 nt, Homo sapiens
cacuggguucaggcuugugga

SEQ ID NO: 374833 - RNA, 22 nt, Homo sapiens
cagacaugucuuguggccgugg

SEQ ID NO: 374834 - RNA, 22 nt, Homo sapiens
cagagcacuaaagguaaaaggc

SEQ ID NO: 374835 - RNA, 22 nt, Homo sapiens
cagagguaagcaagucagcauu

SEQ ID NO: 374836 - RNA, 22 nt, Homo sapiens
cagcaagucucuaagaguucau

SEQ ID NO: 374837 - RNA, 22 nt, Homo sapiens
cagcagguuuuuaucaguuaag

SEQ ID NO: 374838 - RNA, 22 nt, Homo sapiens
cagccgggugagguggcuuguu

SEQ ID NO: 374839 - RNA, 22 nt, Homo sapiens
cagcugcuuuggaaaauauuuu

SEQ ID NO: 374840 - RNA, 22 nt, Homo sapiens
caggcuuuuccacacauggguu

SEQ ID NO: 374841 - RNA, 22 nt, Homo sapiens
cagguacaugcaugugugugca

SEQ ID NO: 374842 - RNA, 22 nt, Homo sapiens
agcuagcauucauaguuugagg

SEQ ID NO: 374843 - RNA, 22 nt, Homo sapiens
agcuccauuguaaucaccuggu

SEQ ID NO: 374844 - RNA, 22 nt, Homo sapiens
agcuccuuugcuuuuuccagga

SEQ ID NO: 374845 - RNA, 22 nt, Homo sapiens
agcugcauucguaucauauugu

SEQ ID NO: 374846 - RNA, 22 nt, Homo sapiens
agcugcauuuacuuuugcacaa

SEQ ID NO: 374847 - RNA, 22 nt, Homo sapiens
agcugccagucuuguaaggccu

SEQ ID NO: 374848 - RNA, 22 nt, Homo sapiens
agcuggcuguagcugcaagucu

SEQ ID NO: 374849 - RNA, 22 nt, Homo sapiens
agcuggcuguggagaaaccccu

SEQ ID NO: 374850 - RNA, 22 nt, Homo sapiens
agcuggucuacguguguaugag

SEQ ID NO: 374851 - RNA, 22 nt, Homo sapiens
agcugguuuauuucuauauccu

SEQ ID NO: 374852 - RNA, 22 nt, Homo sapiens
aggacacugauguaugcugugg

SEQ ID NO: 374853 - RNA, 22 nt, Homo sapiens
aggagguagggugugaaacagc

SEQ ID NO: 374854 - RNA, 22 nt, Homo sapiens
aggcaaugugagaguuuauuca

SEQ ID NO: 374855 - RNA, 22 nt, Homo sapiens
aggcacacaacccuggaccuga

SEQ ID NO: 374856 - RNA, 22 nt, Homo sapiens
aggcaggugaaagauaguuuua

SEQ ID NO: 374857 - RNA, 22 nt, Homo sapiens
agggcacuguagguccugccuc

SEQ ID NO: 374858 - RNA, 22 nt, Homo sapiens
aggugguuuugaugagcaggua

SEQ ID NO: 374859 - RNA, 22 nt, Homo sapiens
agucacagccuuuuacuuuaga

SEQ ID NO: 374860 - RNA, 22 nt, Homo sapiens
agucacagguucuugggauuag

SEQ ID NO: 374861 - RNA, 22 nt, Homo sapiens
agucagugucuguaaggagaac

SEQ ID NO: 374862 - RNA, 22 nt, Homo sapiens
aguccagguuuuguaauggcaa

SEQ ID NO: 374863 - RNA, 22 nt, Homo sapiens
agugaaaucugaagaaggucau

SEQ ID NO: 374864 - RNA, 22 nt, Homo sapiens
agugacaugggaucaaaucuga

SEQ ID NO: 374865 - RNA, 17 nt, Homo sapiens
agugagaucauggcuua

SEQ ID NO: 374866 - RNA, 22 nt, Homo sapiens
agugcaguggcauggucauaac

SEQ ID NO: 374867 - RNA, 22 nt, Homo sapiens
agugccacugcacucuagccug

SEQ ID NO: 374868 - RNA, 22 nt, Homo sapiens
agugccuauugauggaaagaua

SEQ ID NO: 374869 - RNA, 22 nt, Homo sapiens
aguggcaaugugauguccugaa

SEQ ID NO: 374870 - RNA, 22 nt, Homo sapiens
agugggccccuagaggugaggu

SEQ ID NO: 374871 - RNA, 19 nt, Homo sapiens
aguggguguuuucuguuug

SEQ ID NO: 374872 - RNA, 22 nt, Homo sapiens
agugguuuuaaguagagcauac

SEQ ID NO: 374873 - RNA, 22 nt, Homo sapiens
auaauaccugccacauuugaau

SEQ ID NO: 374874 - RNA, 22 nt, Homo sapiens
auaauugcaacacagggcuuug

SEQ ID NO: 374875 - RNA, 19 nt, Homo sapiens
auacacguguauacauaca

SEQ ID NO: 374876 - RNA, 22 nt, Homo sapiens
auacaguugccauuucuugugc

SEQ ID NO: 374877 - RNA, 22 nt, Homo sapiens
auacuaugagauaauaaagacu

SEQ ID NO: 374878 - RNA, 15 nt, Homo sapiens
auagaaugaaaggga

SEQ ID NO: 374879 - RNA, 22 nt, Homo sapiens
auagcacauggcauccucucuu

SEQ ID NO: 374880 - RNA, 20 nt, Homo sapiens
auagcagcaugauuuauaau

SEQ ID NO: 374881 - RNA, 22 nt, Homo sapiens
auaugcacgugcauacacacuu

SEQ ID NO: 374882 - RNA, 22 nt, Homo sapiens
auauuacagagaggaccuggga

SEQ ID NO: 374883 - RNA, 20 nt, Homo sapiens
aucaaagacuuagaggggga

SEQ ID NO: 374884 - RNA, 22 nt, Homo sapiens
aucacugggauggaacugcuga

SEQ ID NO: 374885 - RNA, 22 nt, Homo sapiens
aucacuggucaugagagaagua

SEQ ID NO: 374886 - RNA, 22 nt, Homo sapiens
aucagaaucucuagaggacugu

SEQ ID NO: 374887 - RNA, 22 nt, Homo sapiens
aucagaaucucuagugggacca

SEQ ID NO: 374888 - RNA, 22 nt, Homo sapiens
aucagauguuuguauaggagua

SEQ ID NO: 374889 - RNA, 22 nt, Homo sapiens
auccugagacuuuucugaaguu

SEQ ID NO: 374890 - RNA, 22 nt, Homo sapiens
aucuguagauucagcacaagcu

SEQ ID NO: 374891 - RNA, 21 nt, Homo sapiens
aucugugagaccuuggggguu

SEQ ID NO: 374892 - RNA, 22 nt, Homo sapiens
aucuuuggauacuugauauagu

SEQ ID NO: 374893 - RNA, 22 nt, Homo sapiens
augaaaugcauguuaaguccgu

SEQ ID NO: 374894 - RNA, 22 nt, Homo sapiens
augaaauguaugagucuggguu

SEQ ID NO: 374895 - RNA, 22 nt, Homo sapiens
augaacucaucauuuuuuaugg

SEQ ID NO: 374896 - RNA, 22 nt, Homo sapiens
augacauugaaaagcaagugga

SEQ ID NO: 374897 - RNA, 22 nt, Homo sapiens
augacugucagggcagucauug

SEQ ID NO: 374898 - RNA, 22 nt, Homo sapiens
augagacaguucccuuuaucuu

SEQ ID NO: 374899 - RNA, 22 nt, Homo sapiens
augagacauuaaaguguguuug

SEQ ID NO: 374900 - RNA, 22 nt, Homo sapiens
augaggcaggaaaggcguaucu

SEQ ID NO: 374901 - RNA, 22 nt, Homo sapiens
augaguaguugcuaaauauuga

SEQ ID NO: 374902 - RNA, 22 nt, Homo sapiens
augauguccacagggguguuca

SEQ ID NO: 374903 - RNA, 22 nt, Homo sapiens
augcaaaucuuaaguaugugug

SEQ ID NO: 374904 - RNA, 22 nt, Homo sapiens
augcaaggaugguuagauauau

SEQ ID NO: 374905 - RNA, 22 nt, Homo sapiens
augcacuguuuucuugaugaga

SEQ ID NO: 374906 - RNA, 22 nt, Homo sapiens
augcauggucugaagucaaccu

SEQ ID NO: 374907 - RNA, 22 nt, Homo sapiens
augccacugcacuucagcuugg

SEQ ID NO: 374908 - RNA, 22 nt, Homo sapiens
augcccauuuguuuucugaaag

SEQ ID NO: 374909 - RNA, 22 nt, Homo sapiens
auggaaagcuguuccuacacaa

SEQ ID NO: 374910 - RNA, 22 nt, Homo sapiens
auggaauguauagucauguagg

SEQ ID NO: 374911 - RNA, 22 nt, Homo sapiens
auggacagaaaaaaauagaugu

SEQ ID NO: 374912 - RNA, 22 nt, Homo sapiens
auggaggaggaagcugaaacaa

SEQ ID NO: 374913 - RNA, 22 nt, Homo sapiens
auggauguucuagggaugugau

SEQ ID NO: 374914 - RNA, 22 nt, Homo sapiens
auggcacagacucuuggucaag

SEQ ID NO: 374915 - RNA, 22 nt, Homo sapiens
auggcucuggauagaaugcagg

SEQ ID NO: 374916 - RNA, 22 nt, Homo sapiens
auggcuuuuccugucuugcaug

SEQ ID NO: 374917 - RNA, 22 nt, Homo sapiens
auggcuuuuuaaaucauguugu

SEQ ID NO: 374918 - RNA, 22 nt, Homo sapiens
augucaaggugaagaaagauca

SEQ ID NO: 374919 - RNA, 22 nt, Homo sapiens
augugcaagaucauuaaagcuc

SEQ ID NO: 374920 - RNA, 21 nt, Homo sapiens
augugcacuaugucauuuaau

SEQ ID NO: 374921 - RNA, 22 nt, Homo sapiens
augugcuuaaaaaugcagagaa

SEQ ID NO: 374922 - RNA, 22 nt, Homo sapiens
augugcuuuuuaaacagaugcu

SEQ ID NO: 374923 - RNA, 22 nt, Homo sapiens
augugggaggaauguguuucca

SEQ ID NO: 374924 - RNA, 19 nt, Homo sapiens
augugguuagcaugacugc

SEQ ID NO: 374925 - RNA, 20 nt, Homo sapiens
auguucuggaggacagaagc

SEQ ID NO: 374926 - RNA, 22 nt, Homo sapiens
auuauaugucaucacagacacc

SEQ ID NO: 374927 - RNA, 22 nt, Homo sapiens
auucacuguggguccuuuggau

SEQ ID NO: 374928 - RNA, 22 nt, Homo sapiens
auugcacucugaucugcacucc

SEQ ID NO: 374929 - RNA, 22 nt, Homo sapiens
auugugcuaaaguaauaaguca

SEQ ID NO: 374930 - RNA, 22 nt, Homo sapiens
auuguucuuacaugcugucauc

SEQ ID NO: 374931 - RNA, 20 nt, Homo sapiens
auuugcauuauggagcaccc

SEQ ID NO: 374932 - RNA, 22 nt, Homo sapiens
caaagucuucaguugauucuga

SEQ ID NO: 374933 - RNA, 22 nt, Homo sapiens
caaagugcuggccgggcgcagu

SEQ ID NO: 374934 - RNA, 22 nt, Homo sapiens
caaauccucaccucaucaugaa

SEQ ID NO: 374935 - RNA, 22 nt, Homo sapiens
caacaguaaagcauuuuuaagu

SEQ ID NO: 374936 - RNA, 19 nt, Homo sapiens
caacccugcagagaaagga

SEQ ID NO: 374937 - RNA, 22 nt, Homo sapiens
caaggaauucucaauagaguua

SEQ ID NO: 374938 - RNA, 22 nt, Homo sapiens
caagugcuacagagaaaucuuu

SEQ ID NO: 374939 - RNA, 21 nt, Homo sapiens
caaugacacuguagcugugcu

SEQ ID NO: 374940 - RNA, 22 nt, Homo sapiens
caauggcaaugaaauagugaga

SEQ ID NO: 374941 - RNA, 22 nt, Homo sapiens
cacagagugagacccugucucu

SEQ ID NO: 374942 - RNA, 22 nt, Homo sapiens
cacagggcuaacauuuuugccc

SEQ ID NO: 374943 - RNA, 22 nt, Homo sapiens
cacccuaucagauguccagaga

SEQ ID NO: 374944 - RNA, 22 nt, Homo sapiens
caccgagguuggagugcagugg

SEQ ID NO: 374945 - RNA, 22 nt, Homo sapiens
cacugcacuccagcuuugguga

SEQ ID NO: 374946 - RNA, 22 nt, Homo sapiens
cacugcauuacucaugagcaug

SEQ ID NO: 374947 - RNA, 22 nt, Homo sapiens
cacuguggauggaacuauguga

SEQ ID NO: 374948 - RNA, 22 nt, Homo sapiens
cagaaguauugguaugcucugu

SEQ ID NO: 374949 - RNA, 22 nt, Homo sapiens
cagauggucuuaaggcagccuu

SEQ ID NO: 374950 - RNA, 22 nt, Homo sapiens
caggaccucuugccuggaagcc

SEQ ID NO: 374951 - RNA, 22 nt, Homo sapiens
caggugcuuacuuaauagccau

SEQ ID NO: 374952 - RNA, 22 nt, Homo sapiens
cagucacagugacaggaugugg

SEQ ID NO: 374953 - RNA, 20 nt, Homo sapiens
cagugcacuuucccacuggu

SEQ ID NO: 374954 - RNA, 22 nt, Homo sapiens
cagugcuuguuauuguucuauu

SEQ ID NO: 374955 - RNA, 21 nt, Homo sapiens
cauaaugcuacuuauuuuaug

SEQ ID NO: 374956 - RNA, 23 nt, Homo sapiens
caucacagagccuuccuugacuc

SEQ ID NO: 374957 - RNA, 22 nt, Homo sapiens
caucacaguacuaaucgucaua

SEQ ID NO: 374958 - RNA, 21 nt, Homo sapiens
caucacauuacucaaaguccu

SEQ ID NO: 374959 - RNA, 22 nt, Homo sapiens
caugccacugcacuccaaccug

SEQ ID NO: 374960 - RNA, 22 nt, Homo sapiens
cauggcucuuguuuacucccag

SEQ ID NO: 374961 - RNA, 22 nt, Homo sapiens
cauggcuuuaagcaacaccaag

SEQ ID NO: 374962 - RNA, 22 nt, Homo sapiens
cauugcacuccagccugcacga

SEQ ID NO: 374963 - RNA, 22 nt, Homo sapiens
cauugcaguggaguggggaaga

SEQ ID NO: 374964 - RNA, 22 nt, Homo sapiens
ccaaguguucucauuguucaau

SEQ ID NO: 374965 - RNA, 22 nt, Homo sapiens
ccaggguuccacgccuggcugu

SEQ ID NO: 374966 - RNA, 22 nt, Homo sapiens
ccaguauugaacacaaugaaag

SEQ ID NO: 374967 - RNA, 22 nt, Homo sapiens
ccaguguucuggaaggcugagu

SEQ ID NO: 374968 - RNA, 22 nt, Homo sapiens
ccauggcuucugcauucuguca

SEQ ID NO: 374969 - RNA, 21 nt, Homo sapiens
ccaugggacggaaugaauaca

SEQ ID NO: 374970 - RNA, 22 nt, Homo sapiens
cccaguguguuguggauauuua

SEQ ID NO: 374971 - RNA, 20 nt, Homo sapiens
ccccaguuuuucuauuagcu

SEQ ID NO: 374972 - RNA, 22 nt, Homo sapiens
ccucacaaccuuuauugaagag

SEQ ID NO: 374973 - RNA, 22 nt, Homo sapiens
ccugagacgaauggagugaaca

SEQ ID NO: 374974 - RNA, 22 nt, Homo sapiens
ccugagaucauacuguuaguaa

SEQ ID NO: 374975 - RNA, 22 nt, Homo sapiens
ccugucuugauuaaauuacuua

SEQ ID NO: 374976 - RNA, 19 nt, Homo sapiens
ccuuugguuuccaugacau

SEQ ID NO: 374977 - RNA, 22 nt, Homo sapiens
cgugaggaaaacagaggguguu

SEQ ID NO: 374978 - RNA, 18 nt, Homo sapiens
cuaagacacuuggcagag

SEQ ID NO: 374979 - RNA, 22 nt, Homo sapiens
cuaagugaacugucacugagaa

SEQ ID NO: 374980 - RNA, 22 nt, Homo sapiens
cuacucuggagagugacaauca

SEQ ID NO: 374981 - RNA, 22 nt, Homo sapiens
cuauggguuauaauucauuagu

SEQ ID NO: 374982 - RNA, 22 nt, Homo sapiens
cucaaaguacuuugguuauugu

SEQ ID NO: 374983 - RNA, 22 nt, Homo sapiens
cucaaagucaagggaaagcagg

SEQ ID NO: 374984 - RNA, 22 nt, Homo sapiens
cucaaagugcugggacuggcug

SEQ ID NO: 374985 - RNA, 22 nt, Homo sapiens
cucaaagugcugggauuggcca

SEQ ID NO: 374986 - RNA, 19 nt, Homo sapiens
cucaaagugguauuuggag

SEQ ID NO: 374987 - RNA, 18 nt, Homo sapiens
cucaaccucaugcagggc

SEQ ID NO: 374988 - RNA, 20 nt, Homo sapiens
cucacagacagcuucuuucu

SEQ ID NO: 374989 - RNA, 22 nt, Homo sapiens
cucacaugcucaccugguguuc

SEQ ID NO: 374990 - RNA, 22 nt, Homo sapiens
cuccacgugaaugccaaguauu

SEQ ID NO: 374991 - RNA, 22 nt, Homo sapiens
cuccgggugcgucggcgcccug

SEQ ID NO: 374992 - RNA, 22 nt, Homo sapiens
cucucuguuugucuguuauugg

SEQ ID NO: 374993 - RNA, 22 nt, Homo sapiens
cucuuggguagauuuugcagag

SEQ ID NO: 374994 - RNA, 22 nt, Homo sapiens
cugaaaguuauucaggggcaag

SEQ ID NO: 374995 - RNA, 22 nt, Homo sapiens
cugaaauggaaugugugcacag

SEQ ID NO: 374996 - RNA, 22 nt, Homo sapiens
cugaaauguccaucgacugaug

SEQ ID NO: 374997 - RNA, 22 nt, Homo sapiens
cugagagaggagcuaaaacugc

SEQ ID NO: 374998 - RNA, 22 nt, Homo sapiens
cugaggucugaauccagguauc

SEQ ID NO: 374999 - RNA, 22 nt, Homo sapiens
cugaugaaguauuuguucugga

SEQ ID NO: 375000 - RNA, 22 nt, Homo sapiens
cugauuguagagccccagggcu

SEQ ID NO: 375001 - RNA, 22 nt, Homo sapiens
cugccacugacaccucaaggac

SEQ ID NO: 375002 - RNA, 22 nt, Homo sapiens
cuggcucugggcuaaagaaaua

SEQ ID NO: 375003 - RNA, 22 nt, Homo sapiens
cugggaugauguaaauaggcua

SEQ ID NO: 375004 - RNA, 22 nt, Homo sapiens
cugggaugugacuguugccccc

SEQ ID NO: 375005 - RNA, 22 nt, Homo sapiens
cugucacugggaggggcagcag

SEQ ID NO: 375006 - RNA, 22 nt, Homo sapiens
cugugaucuuuuuucauguggu

SEQ ID NO: 375007 - RNA, 19 nt, Homo sapiens
cuguggucauuauuuugcu

SEQ ID NO: 375008 - RNA, 18 nt, Homo sapiens
cuuagguagcucauucca

SEQ ID NO: 375009 - RNA, 18 nt, Homo sapiens
cuucauugcuguuuugcu

SEQ ID NO: 375010 - RNA, 22 nt, Homo sapiens
cuugaacaaagagauuccauua

SEQ ID NO: 375011 - RNA, 22 nt, Homo sapiens
cuuucacacuguuggugggaau

SEQ ID NO: 375012 - RNA, 22 nt, Homo sapiens
cuuugcguugaacaaagccaua

SEQ ID NO: 375013 - RNA, 19 nt, Homo sapiens
acuuuggugauuagaggga

SEQ ID NO: 375014 - RNA, 22 nt, Homo sapiens
acuuugguuaucauacuuucag

SEQ ID NO: 375015 - RNA, 23 nt, Homo sapiens
agaaaugucuauucagggucccu

SEQ ID NO: 375016 - RNA, 22 nt, Homo sapiens
agagguagaagauaggcuacag

SEQ ID NO: 375017 - RNA, 22 nt, Homo sapiens
agagguauacauuugagagcca

SEQ ID NO: 375018 - RNA, 20 nt, Homo sapiens
agagguuuugauagguucug

SEQ ID NO: 375019 - RNA, 22 nt, Homo sapiens
agaguaguuuauuaugcuaagg

SEQ ID NO: 375020 - RNA, 22 nt, Homo sapiens
agagucacaugaggcccuucau

SEQ ID NO: 375021 - RNA, 21 nt, Homo sapiens
agagucaucucuaucuguacc

SEQ ID NO: 375022 - RNA, 22 nt, Homo sapiens
agcaaaucuaugaauguauauu

SEQ ID NO: 375023 - RNA, 22 nt, Homo sapiens
agcagcacaucccuuucuggcc

SEQ ID NO: 375024 - RNA, 22 nt, Homo sapiens
agcagcaugaggggacuucugc

SEQ ID NO: 375025 - RNA, 22 nt, Homo sapiens
agcagcauuaugauauaucuua

SEQ ID NO: 375026 - RNA, 22 nt, Homo sapiens
agcagguguccacaauguuugc

SEQ ID NO: 375027 - RNA, 22 nt, Homo sapiens
agcaucacacacuacagggaaa

SEQ ID NO: 375028 - RNA, 18 nt, Homo sapiens
agcaucacugaucauccu

SEQ ID NO: 375029 - RNA, 20 nt, Homo sapiens
agcaucauugcaauuuguca

SEQ ID NO: 375030 - RNA, 22 nt, Homo sapiens
agcccagagacuguguaaauuu

SEQ ID NO: 375031 - RNA, 17 nt, Homo sapiens
agccccauuagcuaguu

SEQ ID NO: 375032 - RNA, 23 nt, Homo sapiens
agcuagagaggcuggggauacag

SEQ ID NO: 375033 - RNA, 22 nt, Homo sapiens
agcuccaucuucagggguucag

SEQ ID NO: 375034 - RNA, 22 nt, Homo sapiens
agcugcaauguuuaguauaaua

SEQ ID NO: 375035 - RNA, 22 nt, Homo sapiens
agcuggacuugauaaaugaaua

SEQ ID NO: 375036 - RNA, 22 nt, Homo sapiens
agcugguuuaauaugcugucug

SEQ ID NO: 375037 - RNA, 21 nt, Homo sapiens
agcugguuuccacagugugcu

SEQ ID NO: 375038 - RNA, 22 nt, Homo sapiens
aggaagcuagcauuuguucagu

SEQ ID NO: 375039 - RNA, 22 nt, Homo sapiens
aggaaucuaagguaucagguua

SEQ ID NO: 375040 - RNA, 20 nt, Homo sapiens
cagucauagacaucagaguc

SEQ ID NO: 375041 - RNA, 22 nt, Homo sapiens
cagugcuuuaucaaguccucca

SEQ ID NO: 375042 - RNA, 22 nt, Homo sapiens
caugacacuggcauguuucuuu

SEQ ID NO: 375043 - RNA, 22 nt, Homo sapiens
cauggccuuuggaaugugucua

SEQ ID NO: 375044 - RNA, 22 nt, Homo sapiens
cauggcucuuugcugcuaaagu

SEQ ID NO: 375045 - RNA, 22 nt, Homo sapiens
caugguguuaggcacugggaau

SEQ ID NO: 375046 - RNA, 22 nt, Homo sapiens
caugucuuuuauucugugugau

SEQ ID NO: 375047 - RNA, 22 nt, Homo sapiens
caugugcaugcuuucuuaugug

SEQ ID NO: 375048 - RNA, 22 nt, Homo sapiens
cauugcacuccagccuuggcaa

SEQ ID NO: 375049 - RNA, 22 nt, Homo sapiens
cauugcaguaagagugggcucu

SEQ ID NO: 375050 - RNA, 22 nt, Homo sapiens
cauugcauuccagucugggcaa

SEQ ID NO: 375051 - RNA, 22 nt, Homo sapiens
ccaagccucaguuucccucugu

SEQ ID NO: 375052 - RNA, 19 nt, Homo sapiens
ccauggcaaugaucugaug

SEQ ID NO: 375053 - RNA, 22 nt, Homo sapiens
ccauuucacucuuccugaagga

SEQ ID NO: 375054 - RNA, 22 nt, Homo sapiens
cccagugguuacauaaggagua

SEQ ID NO: 375055 - RNA, 22 nt, Homo sapiens
cccaguuuugcuucucaugagg

SEQ ID NO: 375056 - RNA, 23 nt, Homo sapiens
cccucagaagugcagggagagaa

SEQ ID NO: 375057 - RNA, 22 nt, Homo sapiens
cccugaagauacagaguuuggg

SEQ ID NO: 375058 - RNA, 22 nt, Homo sapiens
cccuguguuuagcugaagguuu

SEQ ID NO: 375059 - RNA, 22 nt, Homo sapiens
ccucccuuuguugcaagggaaa

SEQ ID NO: 375060 - RNA, 22 nt, Homo sapiens
ccuggguuacaggugugagcca

SEQ ID NO: 375061 - RNA, 22 nt, Homo sapiens
ccugguguuuugauggucgggu

SEQ ID NO: 375062 - RNA, 22 nt, Homo sapiens
ccuucauccuccagcaggcuag

SEQ ID NO: 375063 - RNA, 22 nt, Homo sapiens
ccuuggcacuuugccacagugc

SEQ ID NO: 375064 - RNA, 22 nt, Homo sapiens
cgaggaguaucuuugugguguu

SEQ ID NO: 375065 - RNA, 16 nt, Homo sapiens
cuaaaaugucuacuug

SEQ ID NO: 375066 - RNA, 22 nt, Homo sapiens
cuaagugaguauaauuuuaaga

SEQ ID NO: 375067 - RNA, 22 nt, Homo sapiens
cuagcagacaggcugggagcag

SEQ ID NO: 375068 - RNA, 22 nt, Homo sapiens
cuauggcagccacggccuggag

SEQ ID NO: 375069 - RNA, 22 nt, Homo sapiens
cucaaagugcuaagauuaggcu

SEQ ID NO: 375070 - RNA, 22 nt, Homo sapiens
cucaccuugugauccacccgcc

SEQ ID NO: 375071 - RNA, 22 nt, Homo sapiens
cucaccuugugauccuccugcc

SEQ ID NO: 375072 - RNA, 22 nt, Homo sapiens
cuccauagucuucgaagaauga

SEQ ID NO: 375073 - RNA, 23 nt, Homo sapiens
cuccaugagccguccagggccug

SEQ ID NO: 375074 - RNA, 22 nt, Homo sapiens
cucccagagccaguuauaggcu

SEQ ID NO: 375075 - RNA, 22 nt, Homo sapiens
cucugguggaagcagggggcaa

SEQ ID NO: 375076 - RNA, 22 nt, Homo sapiens
cucuuuuguuuagcugagaggg

SEQ ID NO: 375077 - RNA, 22 nt, Homo sapiens
cugcauaaucaucucucugcau

SEQ ID NO: 375078 - RNA, 22 nt, Homo sapiens
cugccuagaucugaaccuggcu

SEQ ID NO: 375079 - RNA, 22 nt, Homo sapiens
cugccugagaaaauggagggca

SEQ ID NO: 375080 - RNA, 22 nt, Homo sapiens
cuggaaaguagacaaucuaaaa

SEQ ID NO: 375081 - RNA, 22 nt, Homo sapiens
cuggagcaaaggugacucuugu

SEQ ID NO: 375082 - RNA, 22 nt, Homo sapiens
cuguaugugagaaauaauaagu

SEQ ID NO: 375083 - RNA, 22 nt, Homo sapiens
cuuaaagcgaauauugguggua

SEQ ID NO: 375084 - RNA, 22 nt, Homo sapiens
cuucacuggagucccuggauuc

SEQ ID NO: 375085 - RNA, 22 nt, Homo sapiens
cuugacacugcaguuuuccugg

SEQ ID NO: 375086 - RNA, 22 nt, Homo sapiens
cuugagcuugagauccuuucug

SEQ ID NO: 375087 - RNA, 22 nt, Homo sapiens
cuuuggagaaaaguucuugggc

SEQ ID NO: 375088 - RNA, 22 nt, Homo sapiens
cuuuggccauagcuaaaugauu

SEQ ID NO: 375089 - RNA, 22 nt, Homo sapiens
cuuuuguggaucuucuguugcu

SEQ ID NO: 375090 - RNA, 22 nt, Homo sapiens
gaaagguaggaacagggugcag

SEQ ID NO: 375091 - RNA, 23 nt, Homo sapiens
gaaaugucuuagugaaauugcuu

SEQ ID NO: 375092 - RNA, 22 nt, Homo sapiens
gaacccuggaggcggagguugc

SEQ ID NO: 375093 - RNA, 22 nt, Homo sapiens
gaacugggguuggguugcgaua

SEQ ID NO: 375094 - RNA, 22 nt, Homo sapiens
gaacuguuucuggugaaagagu

SEQ ID NO: 375095 - RNA, 18 nt, Homo sapiens
gaagaaguaggcauggca

SEQ ID NO: 375096 - RNA, 22 nt, Homo sapiens
gaagagacagguucccacaaaa

SEQ ID NO: 375097 - RNA, 22 nt, Homo sapiens
gaaggcacugugugccacccug

SEQ ID NO: 375098 - RNA, 22 nt, Homo sapiens
gaagguacgcuuaggaaaugau

SEQ ID NO: 375099 - RNA, 22 nt, Homo sapiens
gaagugcuuuuggacuaacagu

SEQ ID NO: 375100 - RNA, 22 nt, Homo sapiens
gaaugucuuauugcucguugua

SEQ ID NO: 375101 - RNA, 22 nt, Homo sapiens
gacagugagaugucaugugaaa

SEQ ID NO: 375102 - RNA, 16 nt, Homo sapiens
gacugggcugaggaau

SEQ ID NO: 375103 - RNA, 22 nt, Homo sapiens
gagacauguuugcuuaucugag

SEQ ID NO: 375104 - RNA, 22 nt, Homo sapiens
gagauguuuuguuaucaaagga

SEQ ID NO: 375105 - RNA, 22 nt, Homo sapiens
gagcaucaauggcaugugggaa

SEQ ID NO: 375106 - RNA, 22 nt, Homo sapiens
gagcccauuucacuuguccagc

SEQ ID NO: 375107 - RNA, 20 nt, Homo sapiens
ggaagagugacacaagguau

SEQ ID NO: 375108 - RNA, 22 nt, Homo sapiens
ggaagccuggaaaaaauuguga

SEQ ID NO: 375109 - RNA, 22 nt, Homo sapiens
ggaaucugaaccaugggaaugg

SEQ ID NO: 375110 - RNA, 20 nt, Homo sapiens
ggagguguugauuuuucuuu

SEQ ID NO: 375111 - RNA, 23 nt, Homo sapiens
ggauggaaaguuuugagggccac

SEQ ID NO: 375112 - RNA, 22 nt, Homo sapiens
ggcaagaggagauucugcuccc

SEQ ID NO: 375113 - RNA, 19 nt, Homo sapiens
ggcaagaguuguucugugu

SEQ ID NO: 375114 - RNA, 23 nt, Homo sapiens
ggcaagaucucagcucacugcaa

SEQ ID NO: 375115 - RNA, 22 nt, Homo sapiens
ggcaaggugaugaaugucuaca

SEQ ID NO: 375116 - RNA, 22 nt, Homo sapiens
ggcacugugaugugagggggua

SEQ ID NO: 375117 - RNA, 22 nt, Homo sapiens
ggcaguggaagugccaguuucu

SEQ ID NO: 375118 - RNA, 18 nt, Homo sapiens
ggcugguguuuuaguaua

SEQ ID NO: 375119 - RNA, 22 nt, Homo sapiens
gggauguuuuauacugagccug

SEQ ID NO: 375120 - RNA, 22 nt, Homo sapiens
gggcaugauggugcacacaugu

SEQ ID NO: 375121 - RNA, 22 nt, Homo sapiens
ggggaauguuaaagaauuugca

SEQ ID NO: 375122 - RNA, 22 nt, Homo sapiens
ggguucccuucuggcucagggu

SEQ ID NO: 375123 - RNA, 22 nt, Homo sapiens
ggugacugguuuaucuggcagu

SEQ ID NO: 375124 - RNA, 22 nt, Homo sapiens
ggugagguaggaaaaguuagga

SEQ ID NO: 375125 - RNA, 22 nt, Homo sapiens
ggugcagcacaccaacauggca

SEQ ID NO: 375126 - RNA, 22 nt, Homo sapiens
gguggcaaaucugaguggcgcu

SEQ ID NO: 375127 - RNA, 22 nt, Homo sapiens
gguguguaaauuacuuaucucu

SEQ ID NO: 375128 - RNA, 22 nt, Homo sapiens
guaacacaugcugcucucuggu

SEQ ID NO: 375129 - RNA, 22 nt, Homo sapiens
guagcagcuacuaaguugcugu

SEQ ID NO: 375130 - RNA, 22 nt, Homo sapiens
guaguggcaugaucuuggcuca

SEQ ID NO: 375131 - RNA, 22 nt, Homo sapiens
guaguuuaucagaaagaauagg

SEQ ID NO: 375132 - RNA, 22 nt, Homo sapiens
guaugcaagugauaugacauau

SEQ ID NO: 375133 - RNA, 22 nt, Homo sapiens
gucacaguguuuguucauccca

SEQ ID NO: 375134 - RNA, 22 nt, Homo sapiens
gucacuggcugucuuguaugau

SEQ ID NO: 375135 - RNA, 22 nt, Homo sapiens
gucagcaucaccaugucuauga

SEQ ID NO: 375136 - RNA, 22 nt, Homo sapiens
gucauaugcucggaaaauguua

SEQ ID NO: 375137 - RNA, 22 nt, Homo sapiens
gucaugggguacuacacauggg

SEQ ID NO: 375138 - RNA, 22 nt, Homo sapiens
guccaaagugggagaggugggg

SEQ ID NO: 375139 - RNA, 22 nt, Homo sapiens
gucguggagcucacagugugcc

SEQ ID NO: 375140 - RNA, 22 nt, Homo sapiens
gucucccagccuacauauuucu

SEQ ID NO: 375141 - RNA, 22 nt, Homo sapiens
gucuccgagccguguggagccg

SEQ ID NO: 375142 - RNA, 22 nt, Homo sapiens
gucuccggcuguccuuugaggu

SEQ ID NO: 375143 - RNA, 22 nt, Homo sapiens
gucucuugguuuagagcauuua

SEQ ID NO: 375144 - RNA, 22 nt, Homo sapiens
gucuggagacuugggucaucaa

SEQ ID NO: 375145 - RNA, 22 nt, Homo sapiens
gucuggcaauggcagacuggca

SEQ ID NO: 375146 - RNA, 22 nt, Homo sapiens
gucugguugacagcauguggcc

SEQ ID NO: 375147 - RNA, 22 nt, Homo sapiens
gucugguuggaguaguuuucag

SEQ ID NO: 375148 - RNA, 22 nt, Homo sapiens
gucugugguuccuaugucaccu

SEQ ID NO: 375149 - RNA, 22 nt, Homo sapiens
gucuuuggaaaaaaugucuguu

SEQ ID NO: 375150 - RNA, 22 nt, Homo sapiens
gucuuuggaaagacaaaguuca

SEQ ID NO: 375151 - RNA, 22 nt, Homo sapiens
gugaaaagaugagcaccauaca

SEQ ID NO: 375152 - RNA, 22 nt, Homo sapiens
gugacacuggagcuggcacaau

SEQ ID NO: 375153 - RNA, 20 nt, Homo sapiens
gugagaacaugugguauuug

SEQ ID NO: 375154 - RNA, 22 nt, Homo sapiens
gugagauggagucuugcuuugu

SEQ ID NO: 375155 - RNA, 22 nt, Homo sapiens
gugagauuaccauuuaaaucag

SEQ ID NO: 375156 - RNA, 22 nt, Homo sapiens
gugagcaguguccuugggggca

SEQ ID NO: 375157 - RNA, 22 nt, Homo sapiens
gugaggcacugcugcuuuccag

SEQ ID NO: 375158 - RNA, 22 nt, Homo sapiens
gugaugacauucagagaugaag

SEQ ID NO: 375159 - RNA, 22 nt, Homo sapiens
gugauguguuucaacagcuccu

SEQ ID NO: 375160 - RNA, 22 nt, Homo sapiens
gugauuauccacgucuuuguga

SEQ ID NO: 375161 - RNA, 21 nt, Homo sapiens
gugcaaacaucauagaaugua

SEQ ID NO: 375162 - RNA, 22 nt, Homo sapiens
gugcaaauguuauugagguuuu

SEQ ID NO: 375163 - RNA, 22 nt, Homo sapiens
gugcaaccaucaccacugacuc

SEQ ID NO: 375164 - RNA, 22 nt, Homo sapiens
gugcaagagugacugcaguuuu

SEQ ID NO: 375165 - RNA, 22 nt, Homo sapiens
gugcacaacaugcagguuuguu

SEQ ID NO: 375166 - RNA, 22 nt, Homo sapiens
gugcacaacgugcaggcuuguu

SEQ ID NO: 375167 - RNA, 22 nt, Homo sapiens
gugcacaaucgugcauuccuug

SEQ ID NO: 375168 - RNA, 22 nt, Homo sapiens
gugcacaaugugcagguuuguu

SEQ ID NO: 375169 - RNA, 23 nt, Homo sapiens
gugccuucugagccuagucucca

SEQ ID NO: 375170 - RNA, 22 nt, Homo sapiens
guggagacaaaggcugagugag

SEQ ID NO: 375171 - RNA, 18 nt, Homo sapiens
guggagugucuuccugga

SEQ ID NO: 375172 - RNA, 22 nt, Homo sapiens
guggcagaaaagagaagcaaug

SEQ ID NO: 375173 - RNA, 21 nt, Homo sapiens
guggccuuuggagcaugucag

SEQ ID NO: 375174 - RNA, 22 nt, Homo sapiens
guggguaaaucucuguucgagg

SEQ ID NO: 375175 - RNA, 22 nt, Homo sapiens
guggguaaaucucuguuugagg

SEQ ID NO: 375176 - RNA, 22 nt, Homo sapiens
uuugguguauaaaaaugcuagu

SEQ ID NO: 375177 - RNA, 22 nt, Homo sapiens
uuugucacccugaauguaagau

SEQ ID NO: 375178 - RNA, 22 nt, Homo sapiens
uuuguccccgcccagaucucau

SEQ ID NO: 375179 - RNA, 22 nt, Homo sapiens
uuugucccuuugcaguggcaca

SEQ ID NO: 375180 - RNA, 22 nt, Homo sapiens
uuugugcuccuaugagaaucua

SEQ ID NO: 375181 - RNA, 22 nt, Homo sapiens
uuugugugugauuauaaaaggu

SEQ ID NO: 375182 - RNA, 22 nt, Homo sapiens
uuuuacagaggagguugcugau

SEQ ID NO: 375183 - RNA, 22 nt, Homo sapiens
uuuugcaccauccuaauaguau

SEQ ID NO: 375184 - RNA, 22 nt, Homo sapiens
uuuugguaaugaacuuaggaag

SEQ ID NO: 375185 - RNA, 22 nt, Homo sapiens
uuuugguucaauuaauuugcua

SEQ ID NO: 375186 - RNA, 22 nt, Homo sapiens
ugaggguauagccagcccuuag

SEQ ID NO: 375187 - RNA, 22 nt, Homo sapiens
ugagguugaaggacauuuuuau

SEQ ID NO: 375188 - RNA, 22 nt, Homo sapiens
ugagugaaagaagcacuaagga

SEQ ID NO: 375189 - RNA, 22 nt, Homo sapiens
ugagugccuggagggcagggac

SEQ ID NO: 375190 - RNA, 22 nt, Homo sapiens
ugaguuccuuucccaguccagu

SEQ ID NO: 375191 - RNA, 22 nt, Homo sapiens
ugauauauugaaugaugaaaca

SEQ ID NO: 375192 - RNA, 22 nt, Homo sapiens
ugauaugaaguucaaaccaggu

SEQ ID NO: 375193 - RNA, 22 nt, Homo sapiens
ugaugcuaccuaaagcaaccau

SEQ ID NO: 375194 - RNA, 22 nt, Homo sapiens
ugaugcugaugccugccagaag

SEQ ID NO: 375195 - RNA, 22 nt, Homo sapiens
ugcaaucauuuggaggagaaga

SEQ ID NO: 375196 - RNA, 17 nt, Homo sapiens
ugcagcacacugauggg

SEQ ID NO: 375197 - RNA, 22 nt, Homo sapiens
ugcauacacaagcauacaugua

SEQ ID NO: 375198 - RNA, 22 nt, Homo sapiens
ugcauaugucuuuauaguagca

SEQ ID NO: 375199 - RNA, 22 nt, Homo sapiens
ugcauccauucuagacucaucu

SEQ ID NO: 375200 - RNA, 22 nt, Homo sapiens
ugccuuuguucuggaaugggaa

SEQ ID NO: 375201 - RNA, 21 nt, Homo sapiens
ugcuuuggucauacuucuucc

SEQ ID NO: 375202 - RNA, 22 nt, Homo sapiens
uggaagacaggcuguauuuuaa

SEQ ID NO: 375203 - RNA, 22 nt, Homo sapiens
uggaagacucuagucucuugag

SEQ ID NO: 375204 - RNA, 21 nt, Homo sapiens
uggaaucuauuauuccaguuu

SEQ ID NO: 375205 - RNA, 22 nt, Homo sapiens
uggaaugguuggugugauuuua

SEQ ID NO: 375206 - RNA, 20 nt, Homo sapiens
uggaccagagagguggggac

SEQ ID NO: 375207 - RNA, 20 nt, Homo sapiens
uggaguuugaguucuuggag

SEQ ID NO: 375208 - RNA, 22 nt, Homo sapiens
uggcagugggagauauuuuauu

SEQ ID NO: 375209 - RNA, 22 nt, Homo sapiens
uggccagugucggaggccagga

SEQ ID NO: 375210 - RNA, 22 nt, Homo sapiens
uggccuguaacccucucauagg

SEQ ID NO: 375211 - RNA, 22 nt, Homo sapiens
uggcuguguccucucccaaauc

SEQ ID NO: 375212 - RNA, 22 nt, Homo sapiens
uggcuguuuauuucacgugggu

SEQ ID NO: 375213 - RNA, 22 nt, Homo sapiens
ugggcaaauugugagggaggua

SEQ ID NO: 375214 - RNA, 22 nt, Homo sapiens
uggguagauaucauaguugccc

SEQ ID NO: 375215 - RNA, 22 nt, Homo sapiens
ugguauuuaauauaugagaguu

SEQ ID NO: 375216 - RNA, 23 nt, Homo sapiens
uggucccguguucuggcuuuagg

SEQ ID NO: 375217 - RNA, 22 nt, Homo sapiens
ugguggcuuuucguagguucac

SEQ ID NO: 375218 - RNA, 20 nt, Homo sapiens
uggugucuuggaaagagcuc

SEQ ID NO: 375219 - RNA, 23 nt, Homo sapiens
ugguuuguaagagauggacugga

SEQ ID NO: 375220 - RNA, 22 nt, Homo sapiens
uguaauaguaggcucacauuug

SEQ ID NO: 375221 - RNA, 22 nt, Homo sapiens
uguaugaguuguuuauaaauuu

SEQ ID NO: 375222 - RNA, 22 nt, Homo sapiens
ugucaaagagacaucugcacuc

SEQ ID NO: 375223 - RNA, 22 nt, Homo sapiens
ugucacaguuuguacuuuauag

SEQ ID NO: 375224 - RNA, 22 nt, Homo sapiens
ugucaccauuuguaggugagga

SEQ ID NO: 375225 - RNA, 22 nt, Homo sapiens
ugucaucauuccaucagggcuu

SEQ ID NO: 375226 - RNA, 22 nt, Homo sapiens
ugucaucauuugagagaagaaa

SEQ ID NO: 375227 - RNA, 22 nt, Homo sapiens
ugucaucuagguauuaagcccc

SEQ ID NO: 375228 - RNA, 16 nt, Homo sapiens
uguccaaauaaauaca

SEQ ID NO: 375229 - RNA, 22 nt, Homo sapiens
uguccaaauugaaucaucuggu

SEQ ID NO: 375230 - RNA, 22 nt, Homo sapiens
ugugcaaauguuaaacuaacuu

SEQ ID NO: 375231 - RNA, 22 nt, Homo sapiens
ugugccuacugauagagccaag

SEQ ID NO: 375232 - RNA, 22 nt, Homo sapiens
ugugccuucuaagaaggagucu

SEQ ID NO: 375233 - RNA, 22 nt, Homo sapiens
ugugcuugaaauucaguuuuga

SEQ ID NO: 375234 - RNA, 22 nt, Homo sapiens
uguggcaaagucuugugaauau

SEQ ID NO: 375235 - RNA, 22 nt, Homo sapiens
ugugucuugagagucucgagaa

SEQ ID NO: 375236 - RNA, 22 nt, Homo sapiens
uguuaagauguguuuuguggcu

SEQ ID NO: 375237 - RNA, 18 nt, Homo sapiens
uguugguguucacucacu

SEQ ID NO: 375238 - RNA, 22 nt, Homo sapiens
uguuuuggaggccagaagucca

SEQ ID NO: 375239 - RNA, 22 nt, Homo sapiens
uuaaggcuuuaaguaaacacag

SEQ ID NO: 375240 - RNA, 22 nt, Homo sapiens
uuaagucacacuagacaacuga

SEQ ID NO: 375241 - RNA, 22 nt, Homo sapiens
uuaauguaucuaucacaucaca

SEQ ID NO: 375242 - RNA, 17 nt, Homo sapiens
uuacaggugcugagagu

SEQ ID NO: 375243 - RNA, 22 nt, Homo sapiens
uuacagguggagaaguaaggcu

SEQ ID NO: 375244 - RNA, 21 nt, Homo sapiens
uuaggcagugucagaggugag

SEQ ID NO: 375245 - RNA, 22 nt, Homo sapiens
uuaggcaguuuauugauuuuca

SEQ ID NO: 375246 - RNA, 22 nt, Homo sapiens
uuauggauuuauauucuguagu

SEQ ID NO: 375247 - RNA, 22 nt, Homo sapiens
uuauguaaaucaaucuggaauc

SEQ ID NO: 375248 - RNA, 22 nt, Homo sapiens
uuauugcuuuugugcaggugag

SEQ ID NO: 375249 - RNA, 22 nt, Homo sapiens
uuauuugguugcugacuuggaa

SEQ ID NO: 375250 - RNA, 22 nt, Homo sapiens
uucaaaguguugguuuugggcu

SEQ ID NO: 375251 - RNA, 22 nt, Homo sapiens
uucaaaguuggaggacaaacug

SEQ ID NO: 375252 - RNA, 22 nt, Homo sapiens
uucaaaucuuuggcucccacua

SEQ ID NO: 375253 - RNA, 22 nt, Homo sapiens
uucaaauguucuuucaccaccc

SEQ ID NO: 375254 - RNA, 21 nt, Homo sapiens
uucacaagggaaguagggggc

SEQ ID NO: 375255 - RNA, 22 nt, Homo sapiens
uucacaguguguacaccagggg

SEQ ID NO: 375256 - RNA, 22 nt, Homo sapiens
uucagcuacuuggaaacagcaa

SEQ ID NO: 375257 - RNA, 22 nt, Homo sapiens
uucauagugaaaaauucaaagu

SEQ ID NO: 375258 - RNA, 22 nt, Homo sapiens
uucaucaguugagcugguugcu

SEQ ID NO: 375259 - RNA, 22 nt, Homo sapiens
uucaucuggcaauucagagauu

SEQ ID NO: 375260 - RNA, 22 nt, Homo sapiens
uuccugcacuugcuugccuaug

SEQ ID NO: 375261 - RNA, 22 nt, Homo sapiens
uuccugucuuccaagagagauu

SEQ ID NO: 375262 - RNA, 22 nt, Homo sapiens
uuccuuaguuauuugguccccu

SEQ ID NO: 375263 - RNA, 22 nt, Homo sapiens
uucuccugguggacccuaaacg

SEQ ID NO: 375264 - RNA, 22 nt, Homo sapiens
uucugagguuauauucucucaa

SEQ ID NO: 375265 - RNA, 19 nt, Homo sapiens
uugaaggccgccuugcaga

SEQ ID NO: 375266 - RNA, 22 nt, Homo sapiens
uugacagagaaaagugugacuu

SEQ ID NO: 375267 - RNA, 22 nt, Homo sapiens
uugacauaaucauuucacagug

SEQ ID NO: 375268 - RNA, 22 nt, Homo sapiens
uugacauauguguguccacaua

SEQ ID NO: 375269 - RNA, 22 nt, Homo sapiens
uugacauauuugugcuuaagaa

SEQ ID NO: 375270 - RNA, 22 nt, Homo sapiens
uugacuuuuaggaggaaaauga

SEQ ID NO: 375271 - RNA, 22 nt, Homo sapiens
uugagauggagccucacucugc

SEQ ID NO: 375272 - RNA, 22 nt, Homo sapiens
uugagauggagcuucacucuug

SEQ ID NO: 375273 - RNA, 22 nt, Homo sapiens
uugagauggagucucgcugugu

SEQ ID NO: 375274 - RNA, 22 nt, Homo sapiens
uugagauggagucucguucugu

SEQ ID NO: 375275 - RNA, 22 nt, Homo sapiens
uugagauggagucuuguucucu

SEQ ID NO: 375276 - RNA, 22 nt, Homo sapiens
gugucccagugugcauacaggu

SEQ ID NO: 375277 - RNA, 22 nt, Homo sapiens
gugugacagcuauagacaugau

SEQ ID NO: 375278 - RNA, 22 nt, Homo sapiens
guguucauggaauuugcaauug

SEQ ID NO: 375279 - RNA, 22 nt, Homo sapiens
guguuugauugcaaauaaucua

SEQ ID NO: 375280 - RNA, 22 nt, Homo sapiens
guucaguuuuaaagggaaauug

SEQ ID NO: 375281 - RNA, 22 nt, Homo sapiens
guucuggagauaaagccaaggu

SEQ ID NO: 375282 - RNA, 22 nt, Homo sapiens
guugcaaaguaauugugguuuu

SEQ ID NO: 375283 - RNA, 22 nt, Homo sapiens
guuugcacuccuaugagaaucu

SEQ ID NO: 375284 - RNA, 22 nt, Homo sapiens
uaaagcuaucacauuggugauu

SEQ ID NO: 375285 - RNA, 20 nt, Homo sapiens
uaaagcugcucagggggcuc

SEQ ID NO: 375286 - RNA, 21 nt, Homo sapiens
uaaaugucauacaaagcaaug

SEQ ID NO: 375287 - RNA, 22 nt, Homo sapiens
uaacaggcaaggucacaccuug

SEQ ID NO: 375288 - RNA, 22 nt, Homo sapiens
uaacugucucaggccaugggcg

SEQ ID NO: 375289 - RNA, 22 nt, Homo sapiens
uaagacacuuaaaauguuacau

SEQ ID NO: 375290 - RNA, 22 nt, Homo sapiens
uaagcaguguggauccaccuug

SEQ ID NO: 375291 - RNA, 21 nt, Homo sapiens
uaagcuaaacauucaguuaac

SEQ ID NO: 375292 - RNA, 22 nt, Homo sapiens
uaaggcuuaugguaaaguccug

SEQ ID NO: 375293 - RNA, 22 nt, Homo sapiens
uaaggcuuugcuggacucaguc

SEQ ID NO: 375294 - RNA, 22 nt, Homo sapiens
uaaggcuuugguagguuugguc

SEQ ID NO: 375295 - RNA, 22 nt, Homo sapiens
uaaguacuuuacagacauuauc

SEQ ID NO: 375296 - RNA, 22 nt, Homo sapiens
uaagugaauuucacuacugagu

SEQ ID NO: 375297 - RNA, 22 nt, Homo sapiens
uaagugcuguguuguuaccuaa

SEQ ID NO: 375298 - RNA, 18 nt, Homo sapiens
uaagugcuuuaaacacau

SEQ ID NO: 375299 - RNA, 21 nt, Homo sapiens
uaauaaugucucagacaccua

SEQ ID NO: 375300 - RNA, 22 nt, Homo sapiens
uaauagcaguguuacuaggacu

SEQ ID NO: 375301 - RNA, 22 nt, Homo sapiens
uaaucucagcugagcugagauu

SEQ ID NO: 375302 - RNA, 22 nt, Homo sapiens
uaaugugaauagugcuguaaug

SEQ ID NO: 375303 - RNA, 22 nt, Homo sapiens
uaauucacauaaagcacuuaga

SEQ ID NO: 375304 - RNA, 16 nt, Homo sapiens
uacaauguagaaaaca

SEQ ID NO: 375305 - RNA, 22 nt, Homo sapiens
uacaggcaccuggcuaauuuuu

SEQ ID NO: 375306 - RNA, 22 nt, Homo sapiens
uacagugcuuuuugguggagaa

SEQ ID NO: 375307 - RNA, 19 nt, Homo sapiens
uacaugcagcaggcacgca

SEQ ID NO: 375308 - RNA, 22 nt, Homo sapiens
uacucuuuagcuccuuaaggaa

SEQ ID NO: 375309 - RNA, 22 nt, Homo sapiens
uacugagagaggaauauugaaa

SEQ ID NO: 375310 - RNA, 18 nt, Homo sapiens
uagaauauaggucauucu

SEQ ID NO: 375311 - RNA, 22 nt, Homo sapiens
uagacacugcauauuuuuuuaa

SEQ ID NO: 375312 - RNA, 20 nt, Homo sapiens
uagacagcuagauuagauag

SEQ ID NO: 375313 - RNA, 22 nt, Homo sapiens
uagcaaaucaauggaauugaag

SEQ ID NO: 375314 - RNA, 22 nt, Homo sapiens
uagcugcacuuacaagugagaa

SEQ ID NO: 375315 - RNA, 22 nt, Homo sapiens
uaggcuuuuggacccugucucu

SEQ ID NO: 375316 - RNA, 22 nt, Homo sapiens
uaggucaguuuuggcuuggcuu

SEQ ID NO: 375317 - RNA, 22 nt, Homo sapiens
uaggucuuuuagcauaggagcu

SEQ ID NO: 375318 - RNA, 20 nt, Homo sapiens
uauaacaguuuggacccagu

SEQ ID NO: 375319 - RNA, 22 nt, Homo sapiens
uaucacagaggguauccuagag

SEQ ID NO: 375320 - RNA, 22 nt, Homo sapiens
uaugaaagcuacuucucacaau

SEQ ID NO: 375321 - RNA, 22 nt, Homo sapiens
uaugagagcugguagguagaga

SEQ ID NO: 375322 - RNA, 22 nt, Homo sapiens
uauggaaaucuuaccuuauggu

SEQ ID NO: 375323 - RNA, 22 nt, Homo sapiens
uauggauuuuuuugacaagagc

SEQ ID NO: 375324 - RNA, 22 nt, Homo sapiens
uauggcuucuauaaggaagcuu

SEQ ID NO: 375325 - RNA, 22 nt, Homo sapiens
uauggcuuuguuaacauuuucu

SEQ ID NO: 375326 - RNA, 22 nt, Homo sapiens
uauggguuucagagggugauag

SEQ ID NO: 375327 - RNA, 22 nt, Homo sapiens
uauggguuuuugucuguuuacu

SEQ ID NO: 375328 - RNA, 22 nt, Homo sapiens
uaugguuuuaagguuaaggacu

SEQ ID NO: 375329 - RNA, 22 nt, Homo sapiens
uauugcagauacccaggaaguu

SEQ ID NO: 375330 - RNA, 22 nt, Homo sapiens
uauugcauauuauucuaguggc

SEQ ID NO: 375331 - RNA, 22 nt, Homo sapiens
uauugcauuugagguugguuga

SEQ ID NO: 375332 - RNA, 22 nt, Homo sapiens
uauugcuggauguauuacaugu

SEQ ID NO: 375333 - RNA, 22 nt, Homo sapiens
uauuucaguugcguuucccgag

SEQ ID NO: 375334 - RNA, 22 nt, Homo sapiens
ucaaacauccccaccagggacu

SEQ ID NO: 375335 - RNA, 20 nt, Homo sapiens
ucaaaguaugcucugcacua

SEQ ID NO: 375336 - RNA, 22 nt, Homo sapiens
ucaaagugacaaaguugcagca

SEQ ID NO: 375337 - RNA, 22 nt, Homo sapiens
ucaaagugcuauggcucagguu

SEQ ID NO: 375338 - RNA, 22 nt, Homo sapiens
ucacaaagcuuggccugcuucu

SEQ ID NO: 375339 - RNA, 22 nt, Homo sapiens
ucacaauguaaaugaggguugg

SEQ ID NO: 375340 - RNA, 22 nt, Homo sapiens
ucacacugaaacuaggguguga

SEQ ID NO: 375341 - RNA, 22 nt, Homo sapiens
ucacacugucuugguuacucuu

SEQ ID NO: 375342 - RNA, 22 nt, Homo sapiens
ucacaguccuguuuaggagagg

SEQ ID NO: 375343 - RNA, 22 nt, Homo sapiens
ucacagucugcgugaugagaca

SEQ ID NO: 375344 - RNA, 22 nt, Homo sapiens
ucaccaccuuccaggaccacug

SEQ ID NO: 375345 - RNA, 22 nt, Homo sapiens
ucacugagcacaggagaugugc

SEQ ID NO: 375346 - RNA, 22 nt, Homo sapiens
ucacugggagaccaaagccauc

SEQ ID NO: 375347 - RNA, 22 nt, Homo sapiens
ucacuuugacggccaacuucua

SEQ ID NO: 375348 - RNA, 22 nt, Homo sapiens
ucagacacugcccuccaccugu

SEQ ID NO: 375349 - RNA, 22 nt, Homo sapiens
ucagaugaucugguaagaacuu

SEQ ID NO: 375350 - RNA, 22 nt, Homo sapiens
ucagguccuuacugugcucccu

SEQ ID NO: 375351 - RNA, 22 nt, Homo sapiens
ucagugggcuauguaauuaacu

SEQ ID NO: 375352 - RNA, 22 nt, Homo sapiens
ucauacaguaguccucacuugu

SEQ ID NO: 375353 - RNA, 22 nt, Homo sapiens
ucauauugguuaaaauaguggg

SEQ ID NO: 375354 - RNA, 22 nt, Homo sapiens
ucaucagguaugucagcggagu

SEQ ID NO: 375355 - RNA, 23 nt, Homo sapiens
ucaugaggccauucaaauccauu

SEQ ID NO: 375356 - RNA, 20 nt, Homo sapiens
ucaugccacugcgcuccagc

SEQ ID NO: 375357 - RNA, 22 nt, Homo sapiens
ucauggggugagcuacaggcac

SEQ ID NO: 375358 - RNA, 22 nt, Homo sapiens
uccacguggucuaucuguccuu

SEQ ID NO: 375359 - RNA, 22 nt, Homo sapiens
uccaguuuggaggcuugaugug

SEQ ID NO: 375360 - RNA, 22 nt, Homo sapiens
uccaguuuuguuaacauauggu

SEQ ID NO: 375361 - RNA, 22 nt, Homo sapiens
uccaugaguccauuagaaaaaa

SEQ ID NO: 375362 - RNA, 18 nt, Homo sapiens
ucccucagaauuauagaa

SEQ ID NO: 375363 - RNA, 22 nt, Homo sapiens
uccugagaauagaguugcaugu

SEQ ID NO: 375364 - RNA, 19 nt, Homo sapiens
ucgcgccauucuccugccu

SEQ ID NO: 375365 - RNA, 23 nt, Homo sapiens
ucgguccccuuggcugcccucgg

SEQ ID NO: 375366 - RNA, 20 nt, Homo sapiens
uucaucaggauauuggucua

SEQ ID NO: 375367 - RNA, 22 nt, Homo sapiens
uuccacaaugguugaacuagcu

SEQ ID NO: 375368 - RNA, 22 nt, Homo sapiens
uuccagugggacgagaugugga

SEQ ID NO: 375369 - RNA, 22 nt, Homo sapiens
uuccaugagaugcaucaaagcu

SEQ ID NO: 375370 - RNA, 22 nt, Homo sapiens
uuccuggaggggaaguguccaa

SEQ ID NO: 375371 - RNA, 22 nt, Homo sapiens
uucuaaacaucuuacaaugcau

SEQ ID NO: 375372 - RNA, 22 nt, Homo sapiens
uucucgcuuuuuccaccuguau

SEQ ID NO: 375373 - RNA, 23 nt, Homo sapiens
uucugccacugaaaaugccucag

SEQ ID NO: 375374 - RNA, 22 nt, Homo sapiens
uucugugcugaaucaaagacug

SEQ ID NO: 375375 - RNA, 22 nt, Homo sapiens
uucugugcuuguggaugaagug

SEQ ID NO: 375376 - RNA, 22 nt, Homo sapiens
uugaagagaaccgcggcuuauu

SEQ ID NO: 375377 - RNA, 18 nt, Homo sapiens
uugaaugcgucccagaga

SEQ ID NO: 375378 - RNA, 22 nt, Homo sapiens
uugacaaggagccauugcaucu

SEQ ID NO: 375379 - RNA, 22 nt, Homo sapiens
uugacaaggagugggguugaga

SEQ ID NO: 375380 - RNA, 22 nt, Homo sapiens
uugacuucagagcugauucaag

SEQ ID NO: 375381 - RNA, 22 nt, Homo sapiens
uugagauggagucucacucugc

SEQ ID NO: 375382 - RNA, 22 nt, Homo sapiens
uugagauggagucucacucugu

SEQ ID NO: 375383 - RNA, 22 nt, Homo sapiens
uugagauggagucucacucuug

SEQ ID NO: 375384 - RNA, 22 nt, Homo sapiens
uugagauggagucuugcacugu

SEQ ID NO: 375385 - RNA, 22 nt, Homo sapiens
uugagauggaguuucacucucg

SEQ ID NO: 375386 - RNA, 22 nt, Homo sapiens
uugagauguggcaguuuaugag

SEQ ID NO: 375387 - RNA, 22 nt, Homo sapiens
uugagcccuggagguggaggcu

SEQ ID NO: 375388 - RNA, 22 nt, Homo sapiens
uugagggagcacagauucuuau

SEQ ID NO: 375389 - RNA, 22 nt, Homo sapiens
uugagguaauaaacagccauuc

SEQ ID NO: 375390 - RNA, 22 nt, Homo sapiens
uugauguccaucucuagguaaa

SEQ ID NO: 375391 - RNA, 23 nt, Homo sapiens
uugcaaagccugaaacucuucag

SEQ ID NO: 375392 - RNA, 22 nt, Homo sapiens
uugcaugggagcugggugaagc

SEQ ID NO: 375393 - RNA, 22 nt, Homo sapiens
uugcaugucauaacugauggaa

SEQ ID NO: 375394 - RNA, 22 nt, Homo sapiens
uugcgcuuuuccuauguugccc

SEQ ID NO: 375395 - RNA, 22 nt, Homo sapiens
uuggaaaaauccaccuugaucu

SEQ ID NO: 375396 - RNA, 22 nt, Homo sapiens
uuggagcccuaacucucaguac

SEQ ID NO: 375397 - RNA, 22 nt, Homo sapiens
uuggauuuuaacaaacuaggug

SEQ ID NO: 375398 - RNA, 22 nt, Homo sapiens
uuggcaaagaggaaugccacuu

SEQ ID NO: 375399 - RNA, 22 nt, Homo sapiens
uuggcaagaaccuucuuccaag

SEQ ID NO: 375400 - RNA, 22 nt, Homo sapiens
uuggcaaguccccaccucucuc

SEQ ID NO: 375401 - RNA, 22 nt, Homo sapiens
uuggcaauucagauucuuuuau

SEQ ID NO: 375402 - RNA, 22 nt, Homo sapiens
uuggccccuccaaaucucaugu

SEQ ID NO: 375403 - RNA, 22 nt, Homo sapiens
uuggccccuuucauccacagcu

SEQ ID NO: 375404 - RNA, 22 nt, Homo sapiens
uugggaaugcuaaaccucuauu

SEQ ID NO: 375405 - RNA, 22 nt, Homo sapiens
uuggguagugaguuccuccagg

SEQ ID NO: 375406 - RNA, 22 nt, Homo sapiens
uugguuauccugucgguaauuc

SEQ ID NO: 375407 - RNA, 22 nt, Homo sapiens
uuguauaggcucaguaagaauc

SEQ ID NO: 375408 - RNA, 22 nt, Homo sapiens
uuguaugucuucauuugaaaaa

SEQ ID NO: 375409 - RNA, 22 nt, Homo sapiens
uuguauguugaaugaugguaua

SEQ ID NO: 375410 - RNA, 22 nt, Homo sapiens
uugucuugcagcuuaggcauca

SEQ ID NO: 375411 - RNA, 22 nt, Homo sapiens
uugugcuucaucaccuagcaga

SEQ ID NO: 375412 - RNA, 22 nt, Homo sapiens
uugugcuuuuuaaauagcuucc

SEQ ID NO: 375413 - RNA, 22 nt, Homo sapiens
uuuaaaguuagaaggaaagggc

SEQ ID NO: 375414 - RNA, 22 nt, Homo sapiens
uuuaaugcaucccaaaauguag

SEQ ID NO: 375415 - RNA, 22 nt, Homo sapiens
uuucauagccuucuaaugaguu

SEQ ID NO: 375416 - RNA, 22 nt, Homo sapiens
uuucauagccuuugucgucuga

SEQ ID NO: 375417 - RNA, 22 nt, Homo sapiens
uuucauaguuugcauagggcau

SEQ ID NO: 375418 - RNA, 22 nt, Homo sapiens
uuucuacagggcuugccaggua

SEQ ID NO: 375419 - RNA, 22 nt, Homo sapiens
uuucugcuugagagaauugcug

SEQ ID NO: 375420 - RNA, 22 nt, Homo sapiens
uuugaagcuaaggugcuugguu

SEQ ID NO: 375421 - RNA, 22 nt, Homo sapiens
uuugcaguuuauuccuggggcu

SEQ ID NO: 375422 - RNA, 19 nt, Homo sapiens
uuugcauagugagaauaua

SEQ ID NO: 375423 - RNA, 22 nt, Homo sapiens
uuugcaucuuuugcuuccugga

SEQ ID NO: 375424 - RNA, 22 nt, Homo sapiens
uuugccacugcaggcuguuuaa

SEQ ID NO: 375425 - RNA, 22 nt, Homo sapiens
uuuggaaugugcacucagauug

SEQ ID NO: 375426 - RNA, 22 nt, Homo sapiens
uuuggcccugagggauggcaua

SEQ ID NO: 375427 - RNA, 21 nt, Homo sapiens
uuuggcuucucugcugcagcc

SEQ ID NO: 375428 - RNA, 22 nt, Homo sapiens
uuugggaaaugaaguugguaga

SEQ ID NO: 375429 - RNA, 22 nt, Homo sapiens
uuugggaaugaguuuaucauuu

SEQ ID NO: 375430 - RNA, 22 nt, Homo sapiens
uuugggccaugcuucccgguca

SEQ ID NO: 375431 - RNA, 22 nt, Homo sapiens
uuugguaauguuucauugcaga

SEQ ID NO: 375432 - RNA, 22 nt, Homo sapiens
uuugguguauauguaaacuaug

SEQ ID NO: 375433 - RNA, 22 nt, Homo sapiens
uuugucacucuuggagguuguu

SEQ ID NO: 375434 - RNA, 22 nt, Homo sapiens
uuugucccucucaccaacgggg

SEQ ID NO: 375435 - RNA, 18 nt, Homo sapiens
uuugugcuccacaaagga

SEQ ID NO: 375436 - RNA, 22 nt, Homo sapiens
uuuguguggccuuggccuggca

SEQ ID NO: 375437 - RNA, 16 nt, Homo sapiens
uuugugugugacgaga

SEQ ID NO: 375438 - RNA, 22 nt, Homo sapiens
uuuugcaguuacagagagugag

SEQ ID NO: 375439 - RNA, 22 nt, Homo sapiens
uuuuugagguauaguguggcua

SEQ ID NO: 375440 - RNA, 22 nt, Homo sapiens
uuuuugaguaaauauaaauugu

SEQ ID NO: 375441 - RNA, 20 nt, Homo sapiens
aagagcucaccagaauaucu

SEQ ID NO: 375442 - RNA, 22 nt, Homo sapiens
aagcaucacauaauggaucaug

SEQ ID NO: 375443 - RNA, 22 nt, Homo sapiens
aagcaucauuuggaauuugaga

SEQ ID NO: 375444 - RNA, 22 nt, Homo sapiens
aagcuaccauuuguauauaaag

SEQ ID NO: 375445 - RNA, 22 nt, Homo sapiens
aagcuggagugcaguggugcaa

SEQ ID NO: 375446 - RNA, 22 nt, Homo sapiens
aagguacuggaaagaggaaugg

SEQ ID NO: 375447 - RNA, 22 nt, Homo sapiens
aaggugcuguaagcauccaugu

SEQ ID NO: 375448 - RNA, 17 nt, Homo sapiens
aaggugcuucgaccucc

SEQ ID NO: 375449 - RNA, 22 nt, Homo sapiens
aaggugguuuucucuuggaguc

SEQ ID NO: 375450 - RNA, 22 nt, Homo sapiens
aaguagcuggaugcaguggcac

SEQ ID NO: 375451 - RNA, 22 nt, Homo sapiens
aagugccauguggaugggcccu

SEQ ID NO: 375452 - RNA, 22 nt, Homo sapiens
aagugcuuacagggaacaugau

SEQ ID NO: 375453 - RNA, 22 nt, Homo sapiens
aagugcuuaggauagugugugg

SEQ ID NO: 375454 - RNA, 22 nt, Homo sapiens
aagugcuucuuuccucgagaag

SEQ ID NO: 375455 - RNA, 17 nt, Homo sapiens
aaguggcuuguucacca

SEQ ID NO: 375456 - RNA, 22 nt, Homo sapiens
aauaaagccugucucuuuagag

SEQ ID NO: 375457 - RNA, 22 nt, Homo sapiens
aauacugaaaguauuuucaaau

SEQ ID NO: 375458 - RNA, 22 nt, Homo sapiens
aauaucacaguuggguguacac

SEQ ID NO: 375459 - RNA, 22 nt, Homo sapiens
aaucagagcccucugagcuuca

SEQ ID NO: 375460 - RNA, 22 nt, Homo sapiens
aaucccuuuguccagucucuuu

SEQ ID NO: 375461 - RNA, 22 nt, Homo sapiens
aaugacacugagcaucuuucau

SEQ ID NO: 375462 - RNA, 22 nt, Homo sapiens
aaugcaagauguuaauuauagg

SEQ ID NO: 375463 - RNA, 22 nt, Homo sapiens
aauggagcugaguggccuuggg

SEQ ID NO: 375464 - RNA, 22 nt, Homo sapiens
aauggcaaauguuuucuguuga

SEQ ID NO: 375465 - RNA, 22 nt, Homo sapiens
aauggcaagagccacagaggcg

SEQ ID NO: 375466 - RNA, 21 nt, Homo sapiens
aaugguguugccaacaaggug

SEQ ID NO: 375467 - RNA, 22 nt, Homo sapiens
aaugucaugaguccaaccagaa

SEQ ID NO: 375468 - RNA, 22 nt, Homo sapiens
acaaagcgcuucucuuuagagu

SEQ ID NO: 375469 - RNA, 22 nt, Homo sapiens
acaaagcuagggaauccaucuu

SEQ ID NO: 375470 - RNA, 22 nt, Homo sapiens
acaaagugccuccuuuuagagu

SEQ ID NO: 375471 - RNA, 22 nt, Homo sapiens
acaccuguggucccaguaacuu

SEQ ID NO: 375472 - RNA, 22 nt, Homo sapiens
acacugcugaguaaauaauuuu

SEQ ID NO: 375473 - RNA, 20 nt, Homo sapiens
acacuggaguaucaaggccc

SEQ ID NO: 375474 - RNA, 22 nt, Homo sapiens
acacuggaguuaaaggugauuu

SEQ ID NO: 375475 - RNA, 22 nt, Homo sapiens
acacuguaacucuuugagggca

SEQ ID NO: 375476 - RNA, 22 nt, Homo sapiens
acacuguauccuucuguccuuu

SEQ ID NO: 375477 - RNA, 22 nt, Homo sapiens
acacuuucuggagcugcacaua

SEQ ID NO: 375478 - RNA, 18 nt, Homo sapiens
acagugcuggcaugagau

SEQ ID NO: 375479 - RNA, 22 nt, Homo sapiens
acagugcuguuguguuuucacg

SEQ ID NO: 375480 - RNA, 22 nt, Homo sapiens
acagugcuucugauaugaugcc

SEQ ID NO: 375481 - RNA, 19 nt, Homo sapiens
acauggauuuugugcaaac

SEQ ID NO: 375482 - RNA, 22 nt, Homo sapiens
acauggcacugcgggcuucuug

SEQ ID NO: 375483 - RNA, 22 nt, Homo sapiens
acccagaauucagucuuaggcc

SEQ ID NO: 375484 - RNA, 21 nt, Homo sapiens
acccccacaccuccuuaguuc

SEQ ID NO: 375485 - RNA, 21 nt, Homo sapiens
acccucuaguuuucaacaggc

SEQ ID NO: 375486 - RNA, 18 nt, Homo sapiens
acccuucagcacugggcc

SEQ ID NO: 375487 - RNA, 18 nt, Homo sapiens
acugcacuccaccuuggg

SEQ ID NO: 375488 - RNA, 22 nt, Homo sapiens
acugcacuccagccucaugaca

SEQ ID NO: 375489 - RNA, 22 nt, Homo sapiens
acugcacuccagccucccgucu

SEQ ID NO: 375490 - RNA, 22 nt, Homo sapiens
acugcacuccagccuccugaca

SEQ ID NO: 375491 - RNA, 22 nt, Homo sapiens
acugcacuccagccuccugggu

SEQ ID NO: 375492 - RNA, 22 nt, Homo sapiens
acugcacuccagccucggggac

SEQ ID NO: 375493 - RNA, 22 nt, Homo sapiens
acugcacuccagccugcccaac

SEQ ID NO: 375494 - RNA, 22 nt, Homo sapiens
acugcacuccagccuggacgac

SEQ ID NO: 375495 - RNA, 22 nt, Homo sapiens
acugcacuccagccugugagac

SEQ ID NO: 375496 - RNA, 22 nt, Homo sapiens
acugcacuccagccuugauggc

SEQ ID NO: 375497 - RNA, 22 nt, Homo sapiens
acugcacuccagccuuggccac

SEQ ID NO: 375498 - RNA, 20 nt, Homo sapiens
acugcacuccaggcugccca

SEQ ID NO: 375499 - RNA, 22 nt, Homo sapiens
acugcacucuagcuugggugac

SEQ ID NO: 375500 - RNA, 22 nt, Homo sapiens
acugcacugcagccuggccaac

SEQ ID NO: 375501 - RNA, 22 nt, Homo sapiens
acugcacuguccuagaguccuc

SEQ ID NO: 375502 - RNA, 22 nt, Homo sapiens
acugcacuucaaccucauugac

SEQ ID NO: 375503 - RNA, 20 nt, Homo sapiens
acugcacuucagccugcugg

SEQ ID NO: 375504 - RNA, 22 nt, Homo sapiens
acugcacuucagccuugggaaa

SEQ ID NO: 375505 - RNA, 22 nt, Homo sapiens
acuuugguuuauagaauuuagg

SEQ ID NO: 375506 - RNA, 22 nt, Homo sapiens
agaaauguuuauucaaacccgu

SEQ ID NO: 375507 - RNA, 22 nt, Homo sapiens
agaacacugaguucagggucag

SEQ ID NO: 375508 - RNA, 22 nt, Homo sapiens
agaaccaaucccacauggauac

SEQ ID NO: 375509 - RNA, 22 nt, Homo sapiens
agaaugucaguauuggcuaaaa

SEQ ID NO: 375510 - RNA, 22 nt, Homo sapiens
agacagcugguagcacuuccug

SEQ ID NO: 375511 - RNA, 22 nt, Homo sapiens
agacaguauuggcaaagugugu

SEQ ID NO: 375512 - RNA, 22 nt, Homo sapiens
agagacauugcuccaacucacc

SEQ ID NO: 375513 - RNA, 22 nt, Homo sapiens
cagguacauuuuaaagggcuca

SEQ ID NO: 375514 - RNA, 22 nt, Homo sapiens
caugccacuguggacaaagaca

SEQ ID NO: 375515 - RNA, 22 nt, Homo sapiens
cauggcccugggcugggcgaac

SEQ ID NO: 375516 - RNA, 21 nt, Homo sapiens
caugucacugcacucuagccu

SEQ ID NO: 375517 - RNA, 22 nt, Homo sapiens
cauugcacuccauccuuggcaa

SEQ ID NO: 375518 - RNA, 22 nt, Homo sapiens
cauugcaugccagccugggcaa

SEQ ID NO: 375519 - RNA, 22 nt, Homo sapiens
cauuggugauuagugaaugaac

SEQ ID NO: 375520 - RNA, 20 nt, Homo sapiens
ccagcaucauuagauucugg

SEQ ID NO: 375521 - RNA, 21 nt, Homo sapiens
ccaguguaaugauagcaggca

SEQ ID NO: 375522 - RNA, 22 nt, Homo sapiens
ccaguuuucaagauaaugguuu

SEQ ID NO: 375523 - RNA, 21 nt, Homo sapiens
ccauggcaaugguaaacugac

SEQ ID NO: 375524 - RNA, 22 nt, Homo sapiens
cccagaguucuuaaauacugag

SEQ ID NO: 375525 - RNA, 22 nt, Homo sapiens
ccccauuugaacuccuucaacu

SEQ ID NO: 375526 - RNA, 22 nt, Homo sapiens
ccuuggcaauggcuggggcuga

SEQ ID NO: 375527 - RNA, 22 nt, Homo sapiens
cggcaguggguaagccaagcuu

SEQ ID NO: 375528 - RNA, 21 nt, Homo sapiens
cuacccuguauuagagaaaga

SEQ ID NO: 375529 - RNA, 22 nt, Homo sapiens
cuagcagcaugagaauggacca

SEQ ID NO: 375530 - RNA, 21 nt, Homo sapiens
cucaaaguacugauauuacag

SEQ ID NO: 375531 - RNA, 22 nt, Homo sapiens
cucaaaguguggucuguggguu

SEQ ID NO: 375532 - RNA, 22 nt, Homo sapiens
cucaccuugugauccacccacc

SEQ ID NO: 375533 - RNA, 22 nt, Homo sapiens
cucacugcauuucaguuuuguu

SEQ ID NO: 375534 - RNA, 22 nt, Homo sapiens
cucaguuuugccuuguuuaagg

SEQ ID NO: 375535 - RNA, 22 nt, Homo sapiens
cuccacugagcaggugggaggc

SEQ ID NO: 375536 - RNA, 22 nt, Homo sapiens
cuccuggugauuggagugugaa

SEQ ID NO: 375537 - RNA, 22 nt, Homo sapiens
cuccuugauuagaguauagagu

SEQ ID NO: 375538 - RNA, 22 nt, Homo sapiens
cugaaagguauacgcuuguuau

SEQ ID NO: 375539 - RNA, 22 nt, Homo sapiens
cugaaggcagguagaauagaga

SEQ ID NO: 375540 - RNA, 22 nt, Homo sapiens
cugagacuggugauuuaugaag

SEQ ID NO: 375541 - RNA, 22 nt, Homo sapiens
cugagcacugagauccucuagc

SEQ ID NO: 375542 - RNA, 20 nt, Homo sapiens
cugaggugggagaaucgcuu

SEQ ID NO: 375543 - RNA, 22 nt, Homo sapiens
cugauugugcagagguguaauu

SEQ ID NO: 375544 - RNA, 20 nt, Homo sapiens
cugcacauccacucuacuuc

SEQ ID NO: 375545 - RNA, 19 nt, Homo sapiens
cugcacugagaaaaggagg

SEQ ID NO: 375546 - RNA, 22 nt, Homo sapiens
cugcacugagacccucuuugcu

SEQ ID NO: 375547 - RNA, 22 nt, Homo sapiens
cugcauuagucuguuuaguguu

SEQ ID NO: 375548 - RNA, 22 nt, Homo sapiens
cuggaaagcaaagggugcauug

SEQ ID NO: 375549 - RNA, 22 nt, Homo sapiens
cuggaguaugaaccauguauca

SEQ ID NO: 375550 - RNA, 22 nt, Homo sapiens
cuggcaagaggauaaaguccua

SEQ ID NO: 375551 - RNA, 22 nt, Homo sapiens
cuggccagagacauucauuaaa

SEQ ID NO: 375552 - RNA, 22 nt, Homo sapiens
cugucacuggggcacauguccc

SEQ ID NO: 375553 - RNA, 22 nt, Homo sapiens
cugugcaaagcgcucucggggu

SEQ ID NO: 375554 - RNA, 18 nt, Homo sapiens
cuuaacauugggaugaua

SEQ ID NO: 375555 - RNA, 22 nt, Homo sapiens
cuucaccaguuuggcagucuca

SEQ ID NO: 375556 - RNA, 22 nt, Homo sapiens
cuugcacauuacagaucugcau

SEQ ID NO: 375557 - RNA, 22 nt, Homo sapiens
cuugcacucagaagauucaguu

SEQ ID NO: 375558 - RNA, 22 nt, Homo sapiens
cuuggcuccgacuccccuccaa

SEQ ID NO: 375559 - RNA, 22 nt, Homo sapiens
cuuuacaguuggacucacgagg

SEQ ID NO: 375560 - RNA, 22 nt, Homo sapiens
cuuuggcauuagccuguauaga

SEQ ID NO: 375561 - RNA, 20 nt, Homo sapiens
cuuuggugagucaacuccuu

SEQ ID NO: 375562 - RNA, 22 nt, Homo sapiens
cuuugguguauuuucagagacc

SEQ ID NO: 375563 - RNA, 23 nt, Homo sapiens
cuuuguccccacccaaaucucau

SEQ ID NO: 375564 - RNA, 22 nt, Homo sapiens
gaaaguguugagauuacaggca

SEQ ID NO: 375565 - RNA, 22 nt, Homo sapiens
gaaaugucugagauguggcuca

SEQ ID NO: 375566 - RNA, 22 nt, Homo sapiens
gaacuuucuacauuaccucuuu

SEQ ID NO: 375567 - RNA, 22 nt, Homo sapiens
gaagcauugauccacaggcgug

SEQ ID NO: 375568 - RNA, 22 nt, Homo sapiens
gaaucaauugaucuaugugucu

SEQ ID NO: 375569 - RNA, 22 nt, Homo sapiens
gaaucacugugguaucccaugc

SEQ ID NO: 375570 - RNA, 22 nt, Homo sapiens
gacacuggguguuuguuggcgu

SEQ ID NO: 375571 - RNA, 22 nt, Homo sapiens
gacacugucuucugcucuuaaa

SEQ ID NO: 375572 - RNA, 22 nt, Homo sapiens
gacaguuuggugaggaagacga

SEQ ID NO: 375573 - RNA, 20 nt, Homo sapiens
gacauguugguuugcugcac

SEQ ID NO: 375574 - RNA, 22 nt, Homo sapiens
gacauguuucucucuguuuacu

SEQ ID NO: 375575 - RNA, 22 nt, Homo sapiens
gacauguuuucaagauuuauaa

SEQ ID NO: 375576 - RNA, 20 nt, Homo sapiens
gacauguuuuguggccuaac

SEQ ID NO: 375577 - RNA, 22 nt, Homo sapiens
gacuuugguagaggaaaaaucu

SEQ ID NO: 375578 - RNA, 21 nt, Homo sapiens
gagaaucuuuucagggcaaac

SEQ ID NO: 375579 - RNA, 22 nt, Homo sapiens
gagaaugaacagacugccucuu

SEQ ID NO: 375580 - RNA, 22 nt, Homo sapiens
gagaaugaugauuuccaauuuc

SEQ ID NO: 375581 - RNA, 22 nt, Homo sapiens
agcagcauggguauaaaucucc

SEQ ID NO: 375582 - RNA, 22 nt, Homo sapiens
agcaguguggccuuagacccgg

SEQ ID NO: 375583 - RNA, 22 nt, Homo sapiens
agcaucacaugggcugcuuggg

SEQ ID NO: 375584 - RNA, 22 nt, Homo sapiens
agccaagacucuguuccccuug

SEQ ID NO: 375585 - RNA, 22 nt, Homo sapiens
agccuguguugaauuauagaaa

SEQ ID NO: 375586 - RNA, 22 nt, Homo sapiens
agccuucauucugacaguagga

SEQ ID NO: 375587 - RNA, 22 nt, Homo sapiens
agcgccacugcacuccagccug

SEQ ID NO: 375588 - RNA, 19 nt, Homo sapiens
ugucccagccauagaggca

SEQ ID NO: 375589 - RNA, 22 nt, Homo sapiens
ugucccaguuggguauugaauu

SEQ ID NO: 375590 - RNA, 22 nt, Homo sapiens
ugucuuuguuaguuguccuagu

SEQ ID NO: 375591 - RNA, 22 nt, Homo sapiens
ugugaaacacgaaagucuaaaa

SEQ ID NO: 375592 - RNA, 21 nt, Homo sapiens
ugugaaaucuaggcagagguu

SEQ ID NO: 375593 - RNA, 19 nt, Homo sapiens
ugugaagaaaugcugcaag

SEQ ID NO: 375594 - RNA, 22 nt, Homo sapiens
ugugaagauggacuaauauagu

SEQ ID NO: 375595 - RNA, 19 nt, Homo sapiens
ugugacugggccagccuag

SEQ ID NO: 375596 - RNA, 22 nt, Homo sapiens
ugugagacugacagggcagggu

SEQ ID NO: 375597 - RNA, 16 nt, Homo sapiens
ugugaucuuuuuucuu

SEQ ID NO: 375598 - RNA, 23 nt, Homo sapiens
ugugcacauuuacauauauacac

SEQ ID NO: 375599 - RNA, 22 nt, Homo sapiens
ugugccacuccagcucuagcuu

SEQ ID NO: 375600 - RNA, 22 nt, Homo sapiens
ugugccacugcacuccugggug

SEQ ID NO: 375601 - RNA, 22 nt, Homo sapiens
ugugccacugcacucuggccug

SEQ ID NO: 375602 - RNA, 22 nt, Homo sapiens
ugugcuauguuauucacauggg

SEQ ID NO: 375603 - RNA, 22 nt, Homo sapiens
ugugguuuuaguaaaacuaugu

SEQ ID NO: 375604 - RNA, 22 nt, Homo sapiens
ugugguuuuauaaacgugaccu

SEQ ID NO: 375605 - RNA, 22 nt, Homo sapiens
uguuacagcagaauugaaagag

SEQ ID NO: 375606 - RNA, 22 nt, Homo sapiens
uguucuggagaggcaggccaca

SEQ ID NO: 375607 - RNA, 22 nt, Homo sapiens
uguuugcuuaacguggagccag

SEQ ID NO: 375608 - RNA, 22 nt, Homo sapiens
uuaaagugaucauaaggauagu

SEQ ID NO: 375609 - RNA, 22 nt, Homo sapiens
uuaaaguguuugcagacaggug

SEQ ID NO: 375610 - RNA, 22 nt, Homo sapiens
uuaaauacagcaugguguuucu

SEQ ID NO: 375611 - RNA, 22 nt, Homo sapiens
uuaaaugcuagaauuuucuuug

SEQ ID NO: 375612 - RNA, 21 nt, Homo sapiens
uuaacagacaagugucuuccc

SEQ ID NO: 375613 - RNA, 22 nt, Homo sapiens
uuaaggcuccuguuggcuuuua

SEQ ID NO: 375614 - RNA, 22 nt, Homo sapiens
uuaaggcuuucccuauguaaaa

SEQ ID NO: 375615 - RNA, 21 nt, Homo sapiens
uuacaauggcuccuugaaggu

SEQ ID NO: 375616 - RNA, 22 nt, Homo sapiens
uuacagugguugcuauugugaa

SEQ ID NO: 375617 - RNA, 22 nt, Homo sapiens
uuagaucaacauggaacucuau

SEQ ID NO: 375618 - RNA, 18 nt, Homo sapiens
uuauacuccccaggcaau

SEQ ID NO: 375619 - RNA, 22 nt, Homo sapiens
uuauacucgucugaaugauucu

SEQ ID NO: 375620 - RNA, 18 nt, Homo sapiens
uuauaugcauguguagga

SEQ ID NO: 375621 - RNA, 22 nt, Homo sapiens
uuauuugguuauuguaauuggg

SEQ ID NO: 375622 - RNA, 22 nt, Homo sapiens
uucaaaguaaaaauguguucac

SEQ ID NO: 375623 - RNA, 22 nt, Homo sapiens
uucaaaguaaagggauggagac

SEQ ID NO: 375624 - RNA, 22 nt, Homo sapiens
uucaagaauuaaaguggcuuuu

SEQ ID NO: 375625 - RNA, 22 nt, Homo sapiens
uucaaguaagaaagacaucagg

SEQ ID NO: 375626 - RNA, 22 nt, Homo sapiens
uucaauacuguugauccuuaug

SEQ ID NO: 375627 - RNA, 22 nt, Homo sapiens
uucacacugggccuacucugug

SEQ ID NO: 375628 - RNA, 22 nt, Homo sapiens
uucacagagagaacucaaacca

SEQ ID NO: 375629 - RNA, 22 nt, Homo sapiens
uucacagcuuaauaaggcucag

SEQ ID NO: 375630 - RNA, 22 nt, Homo sapiens
uucagcacaguguggaucauuc

SEQ ID NO: 375631 - RNA, 22 nt, Homo sapiens
uucaguauugcaccuggagucc

SEQ ID NO: 375632 - RNA, 23 nt, Homo sapiens
uucaucagggauauuggccugaa

SEQ ID NO: 375633 - RNA, 22 nt, Homo sapiens
uucaucaguuauauuggccuga

SEQ ID NO: 375634 - RNA, 22 nt, Homo sapiens
uuccacaggguugaacuaguuu

SEQ ID NO: 375635 - RNA, 21 nt, Homo sapiens
uuccagugagccuagaugccu

SEQ ID NO: 375636 - RNA, 22 nt, Homo sapiens
uuccaguggaguaaauggacaa

SEQ ID NO: 375637 - RNA, 22 nt, Homo sapiens
uuccaguguuugacucaccuuu

SEQ ID NO: 375638 - RNA, 22 nt, Homo sapiens
uuccugagccuuguaucuagua

SEQ ID NO: 375639 - RNA, 22 nt, Homo sapiens
uuccugaggccuccccagaagc

SEQ ID NO: 375640 - RNA, 22 nt, Homo sapiens
uucugguuaauacuugcaaaaa

SEQ ID NO: 375641 - RNA, 22 nt, Homo sapiens
uucugugguugaaaggagagau

SEQ ID NO: 375642 - RNA, 22 nt, Homo sapiens
uucuuugcaugaucucaaaguc

SEQ ID NO: 375643 - RNA, 22 nt, Homo sapiens
uugaaauguguaagcuccgaaa

SEQ ID NO: 375644 - RNA, 22 nt, Homo sapiens
uugaaauguuuagaaguuugga

SEQ ID NO: 375645 - RNA, 22 nt, Homo sapiens
uugaaguagaaagacgaaauuu

SEQ ID NO: 375646 - RNA, 22 nt, Homo sapiens
uugaauagugacuuugauucug

SEQ ID NO: 375647 - RNA, 22 nt, Homo sapiens
uugaaugaaaugaugucauuug

SEQ ID NO: 375648 - RNA, 22 nt, Homo sapiens
uugagauggagucucacucuuu

SEQ ID NO: 375649 - RNA, 19 nt, Homo sapiens
uugagaugugaacucacac

SEQ ID NO: 375650 - RNA, 22 nt, Homo sapiens
uugagugaaugaaugauuaaau

SEQ ID NO: 375651 - RNA, 22 nt, Homo sapiens
uugcaagaaaugcagauucuca

SEQ ID NO: 375652 - RNA, 20 nt, Homo sapiens
uugcagagcccaacccugga

SEQ ID NO: 375653 - RNA, 22 nt, Homo sapiens
uugcuuuguuacugcaguuucc

SEQ ID NO: 375654 - RNA, 22 nt, Homo sapiens
uuggaaacauuuaugguaacag

SEQ ID NO: 375655 - RNA, 22 nt, Homo sapiens
uuggaaaugguaaaggguuaau

SEQ ID NO: 375656 - RNA, 22 nt, Homo sapiens
uuugagcuugacucagcuggag

SEQ ID NO: 375657 - RNA, 22 nt, Homo sapiens
uuugccuuugugauauggucua

SEQ ID NO: 375658 - RNA, 18 nt, Homo sapiens
uuuggcuguucaugacuc

SEQ ID NO: 375659 - RNA, 22 nt, Homo sapiens
uuugguuauauauauacacucu

SEQ ID NO: 375660 - RNA, 22 nt, Homo sapiens
uuuguagcucacucugagcuga

SEQ ID NO: 375661 - RNA, 22 nt, Homo sapiens
uuuuagcagccaugacaaagau

SEQ ID NO: 375662 - RNA, 22 nt, Homo sapiens
uuuugguauacacaaggguccu

SEQ ID NO: 375663 - RNA, 22 nt, Homo sapiens
uuuuugagaauuggugaaacac

SEQ ID NO: 375664 - RNA, 22 nt, Homo sapiens
uuuuugaguagcuggagagcag

SEQ ID NO: 375665 - RNA, 22 nt, Homo sapiens
ucuuugguuucugucucuguaa

SEQ ID NO: 375666 - RNA, 22 nt, Homo sapiens
ucuuuugguuucuagaggccgc

SEQ ID NO: 375667 - RNA, 22 nt, Homo sapiens
ugaaaugauuauaugguguuug

SEQ ID NO: 375668 - RNA, 22 nt, Homo sapiens
ugaauauguuucuaaaagugca

SEQ ID NO: 375669 - RNA, 22 nt, Homo sapiens
ugaccuguuugaaauugccaau

SEQ ID NO: 375670 - RNA, 22 nt, Homo sapiens
ugacuauaucucuguauaaacu

SEQ ID NO: 375671 - RNA, 22 nt, Homo sapiens
ugacuggagaccucaguagggu

SEQ ID NO: 375672 - RNA, 22 nt, Homo sapiens
ugacuggagucuugcucugucg

SEQ ID NO: 375673 - RNA, 22 nt, Homo sapiens
ugagaacaugcacuugagguug

SEQ ID NO: 375674 - RNA, 22 nt, Homo sapiens
ugagaaugacugggcaugcugc

SEQ ID NO: 375675 - RNA, 22 nt, Homo sapiens
ugagaauguagggcucucccag

SEQ ID NO: 375676 - RNA, 22 nt, Homo sapiens
ugagacacugaauccggccuga

SEQ ID NO: 375677 - RNA, 22 nt, Homo sapiens
ugagacauacuuacaggggaug

SEQ ID NO: 375678 - RNA, 22 nt, Homo sapiens
ugagaccaacagauuccaguuc

SEQ ID NO: 375679 - RNA, 22 nt, Homo sapiens
ugagacggagucucgcucucua

SEQ ID NO: 375680 - RNA, 22 nt, Homo sapiens
ugagacugaguuuugccuuugu

SEQ ID NO: 375681 - RNA, 22 nt, Homo sapiens
ugagacugaguuuugcucguug

SEQ ID NO: 375682 - RNA, 22 nt, Homo sapiens
ugagauaaugcaugugaagauc

SEQ ID NO: 375683 - RNA, 22 nt, Homo sapiens
ugagauagaaaacauaggagaa

SEQ ID NO: 375684 - RNA, 22 nt, Homo sapiens
ugagauagcauaagggacagaa

SEQ ID NO: 375685 - RNA, 22 nt, Homo sapiens
ugagauaguuguagauguacau

SEQ ID NO: 375686 - RNA, 19 nt, Homo sapiens
ugagaucuuuacuggguuu

SEQ ID NO: 375687 - RNA, 22 nt, Homo sapiens
ugagcacauuuacaucaguucc

SEQ ID NO: 375688 - RNA, 22 nt, Homo sapiens
ugagcagaguuguuucuccuga

SEQ ID NO: 375689 - RNA, 22 nt, Homo sapiens
ugagcugagaaaugcagcagcu

SEQ ID NO: 375690 - RNA, 22 nt, Homo sapiens
ugaggaaugaccccgugugguc

SEQ ID NO: 375691 - RNA, 22 nt, Homo sapiens
ugaggaauguguguuaaagaua

SEQ ID NO: 375692 - RNA, 22 nt, Homo sapiens
ugagguagaaugauucuaauau

SEQ ID NO: 375693 - RNA, 22 nt, Homo sapiens
ugaguaugaguucaggaaaggc

SEQ ID NO: 375694 - RNA, 22 nt, Homo sapiens
ugaguuccuugugugaccuugc

SEQ ID NO: 375695 - RNA, 20 nt, Homo sapiens
ugaguuccuuguucagaagc

SEQ ID NO: 375696 - RNA, 21 nt, Homo sapiens
ugaugcaauccgcuaggucgc

SEQ ID NO: 375697 - RNA, 22 nt, Homo sapiens
ugauuagagcccaagcuuugaa

SEQ ID NO: 375698 - RNA, 22 nt, Homo sapiens
ugcaaaucuuguguaguuguga

SEQ ID NO: 375699 - RNA, 22 nt, Homo sapiens
ugcaaaugcugcuauuucucuu

SEQ ID NO: 375700 - RNA, 19 nt, Homo sapiens
ugcaaauucuaaaaacuga

SEQ ID NO: 375701 - RNA, 22 nt, Homo sapiens
ugcaagaugagauuuuggaugg

SEQ ID NO: 375702 - RNA, 22 nt, Homo sapiens
ugcaagaugauuucaauugaua

SEQ ID NO: 375703 - RNA, 22 nt, Homo sapiens
ugcagagaaacauuuuguauuu

SEQ ID NO: 375704 - RNA, 20 nt, Homo sapiens
ugcagcacgggcccuuucca

SEQ ID NO: 375705 - RNA, 22 nt, Homo sapiens
ugcagcucaaauuccuaacaag

SEQ ID NO: 375706 - RNA, 22 nt, Homo sapiens
ugcauaugucuuuauagcagca

SEQ ID NO: 375707 - RNA, 22 nt, Homo sapiens
ugcauauguucaaaguauucug

SEQ ID NO: 375708 - RNA, 22 nt, Homo sapiens
ugcauauguugaaccaggcuug

SEQ ID NO: 375709 - RNA, 22 nt, Homo sapiens
ugccaacaugccuggcuguuuu

SEQ ID NO: 375710 - RNA, 22 nt, Homo sapiens
ugccaggaugaggucaauguuu

SEQ ID NO: 375711 - RNA, 22 nt, Homo sapiens
ugccuacagaaggggcucagca

SEQ ID NO: 375712 - RNA, 22 nt, Homo sapiens
ugccuaggcccaguccucagaa

SEQ ID NO: 375713 - RNA, 22 nt, Homo sapiens
ugccuaggcuggaaugcagugg

SEQ ID NO: 375714 - RNA, 22 nt, Homo sapiens
ugcgccauugcauuccagccug

SEQ ID NO: 375715 - RNA, 21 nt, Homo sapiens
ugcuccauuuucuagccugaa

SEQ ID NO: 375716 - RNA, 22 nt, Homo sapiens
ugcugcacaguucuuaagauua

SEQ ID NO: 375717 - RNA, 20 nt, Homo sapiens
ugcugcacuuaagcaugggc

SEQ ID NO: 375718 - RNA, 19 nt, Homo sapiens
ugcugcauugugaccuugc

SEQ ID NO: 375719 - RNA, 22 nt, Homo sapiens
ugcugcuguuguuguuacuagc

SEQ ID NO: 375720 - RNA, 22 nt, Homo sapiens
ugcuguuguuugaugaaguaau

SEQ ID NO: 375721 - RNA, 22 nt, Homo sapiens
uggaaucuagagaaaugcaaac

SEQ ID NO: 375722 - RNA, 21 nt, Homo sapiens
uggaaucuauagaggcaguag

SEQ ID NO: 375723 - RNA, 20 nt, Homo sapiens
uggaaucugaagaucucagu

SEQ ID NO: 375724 - RNA, 22 nt, Homo sapiens
uggaaugucuauguuuuugauu

SEQ ID NO: 375725 - RNA, 22 nt, Homo sapiens
uggaauguuuaucaaaacagua

SEQ ID NO: 375726 - RNA, 22 nt, Homo sapiens
uggacuguaauagagaacagaa

SEQ ID NO: 375727 - RNA, 22 nt, Homo sapiens
uggagucuugaugauuuucaaa

SEQ ID NO: 375728 - RNA, 22 nt, Homo sapiens
uggagucuugcucuguugccca

SEQ ID NO: 375729 - RNA, 22 nt, Homo sapiens
uggaguguaaauuaguucagcc

SEQ ID NO: 375730 - RNA, 22 nt, Homo sapiens
uggaguuugacaugccuuuggg

SEQ ID NO: 375731 - RNA, 22 nt, Homo sapiens
uggcaagaccccaucucuacaa

SEQ ID NO: 375732 - RNA, 22 nt, Homo sapiens
uggcaagagauaugugucuaua

SEQ ID NO: 375733 - RNA, 22 nt, Homo sapiens
uggcaagauuguuccgguuugg

SEQ ID NO: 375734 - RNA, 22 nt, Homo sapiens
uggcacuggagauacauuaaua

SEQ ID NO: 375735 - RNA, 20 nt, Homo sapiens
uggcucuuugcugcuaaagu

SEQ ID NO: 375736 - RNA, 22 nt, Homo sapiens
gccagugugaugugaucauggc

SEQ ID NO: 375737 - RNA, 22 nt, Homo sapiens
gccuagagaguuaucaggcugu

SEQ ID NO: 375738 - RNA, 22 nt, Homo sapiens
gcuuguguuugcuccccagaau

SEQ ID NO: 375739 - RNA, 22 nt, Homo sapiens
gcuuugguucaaccaggcaauu

SEQ ID NO: 375740 - RNA, 22 nt, Homo sapiens
ggaaauguuggugucaugaguu

SEQ ID NO: 375741 - RNA, 23 nt, Homo sapiens
ggaaauguuuaagggguugggag

SEQ ID NO: 375742 - RNA, 22 nt, Homo sapiens
ggaaauguuuagcauccacuuu

SEQ ID NO: 375743 - RNA, 18 nt, Homo sapiens
ggaagccuauuuaguaac

SEQ ID NO: 375744 - RNA, 22 nt, Homo sapiens
ggcaaagaugaccauuacuuuu

SEQ ID NO: 375745 - RNA, 22 nt, Homo sapiens
ggcaaggaggggcacuuucacu

SEQ ID NO: 375746 - RNA, 22 nt, Homo sapiens
ggcaaggauguuuuucuggcaa

SEQ ID NO: 375747 - RNA, 22 nt, Homo sapiens
ggcacuguggcucaagccugua

SEQ ID NO: 375748 - RNA, 22 nt, Homo sapiens
ggcagcuguguccuucguaagg

SEQ ID NO: 375749 - RNA, 22 nt, Homo sapiens
ggcugguuuucaguuacugagu

SEQ ID NO: 375750 - RNA, 18 nt, Homo sapiens
gggcaaguugccuggcuu

SEQ ID NO: 375751 - RNA, 22 nt, Homo sapiens
gggcuagaauccgcgucucuug

SEQ ID NO: 375752 - RNA, 19 nt, Homo sapiens
ggucauggagguuguguga

SEQ ID NO: 375753 - RNA, 22 nt, Homo sapiens
ggucuuggagaauuguccuggg

SEQ ID NO: 375754 - RNA, 22 nt, Homo sapiens
guaagugauagaauuaggauuc

SEQ ID NO: 375755 - RNA, 22 nt, Homo sapiens
guaaucucaccuacuugggagg

SEQ ID NO: 375756 - RNA, 22 nt, Homo sapiens
guaaucucagcuacucaggagg

SEQ ID NO: 375757 - RNA, 22 nt, Homo sapiens
guaaucucagcuacucgggagg

SEQ ID NO: 375758 - RNA, 22 nt, Homo sapiens
guaaucucagcuacuugggagu

SEQ ID NO: 375759 - RNA, 22 nt, Homo sapiens
guaaucucagcuucuugggagg

SEQ ID NO: 375760 - RNA, 22 nt, Homo sapiens
guauccugaaguucucagcacu

SEQ ID NO: 375761 - RNA, 22 nt, Homo sapiens
guaugaaaaucggagauugggu

SEQ ID NO: 375762 - RNA, 22 nt, Homo sapiens
gucaaagucuauuggcuaauuc

SEQ ID NO: 375763 - RNA, 22 nt, Homo sapiens
gucacagaggcuaagaccccac

SEQ ID NO: 375764 - RNA, 22 nt, Homo sapiens
gucacaguggccagugauguuc

SEQ ID NO: 375765 - RNA, 22 nt, Homo sapiens
gucacauugaugcccauggugg

SEQ ID NO: 375766 - RNA, 22 nt, Homo sapiens
gucagugauugauuuaaagacg

SEQ ID NO: 375767 - RNA, 22 nt, Homo sapiens
gucagugcauguaaacauaaaa

SEQ ID NO: 375768 - RNA, 22 nt, Homo sapiens
gucagugcuuuaguucaggaug

SEQ ID NO: 375769 - RNA, 22 nt, Homo sapiens
gucauucauucagcaagcacug

SEQ ID NO: 375770 - RNA, 22 nt, Homo sapiens
gucccagagauauugugucuuu

SEQ ID NO: 375771 - RNA, 22 nt, Homo sapiens
gucccaguggaaccuccaagcu

SEQ ID NO: 375772 - RNA, 22 nt, Homo sapiens
gucguggagucucuggcuugua

SEQ ID NO: 375773 - RNA, 22 nt, Homo sapiens
gucucuuguuaucauuucugag

SEQ ID NO: 375774 - RNA, 22 nt, Homo sapiens
gugaaauguguagaggaucugg

SEQ ID NO: 375775 - RNA, 22 nt, Homo sapiens
gugaacuguuugaggaagagaa

SEQ ID NO: 375776 - RNA, 22 nt, Homo sapiens
gugaccagaugggcaggggugu

SEQ ID NO: 375777 - RNA, 22 nt, Homo sapiens
gugagaugguaucucauugugg

SEQ ID NO: 375778 - RNA, 21 nt, Homo sapiens
gugaggaguuacuggcuuuga

SEQ ID NO: 375779 - RNA, 22 nt, Homo sapiens
gugaucuucauggaaggugaaa

SEQ ID NO: 375780 - RNA, 22 nt, Homo sapiens
gugaucuuucaggcuugaccau

SEQ ID NO: 375781 - RNA, 22 nt, Homo sapiens
gugcaaacuccaggucucuuca

SEQ ID NO: 375782 - RNA, 22 nt, Homo sapiens
gugcacaaaucuuaaauguaca

SEQ ID NO: 375783 - RNA, 22 nt, Homo sapiens
gugcacaacguguagguuuguu

SEQ ID NO: 375784 - RNA, 22 nt, Homo sapiens
guggaaagaacacaaaauuagg

SEQ ID NO: 375785 - RNA, 22 nt, Homo sapiens
guggaaugauaucucauugugg

SEQ ID NO: 375786 - RNA, 22 nt, Homo sapiens
guggaauggaaugauuguguau

SEQ ID NO: 375787 - RNA, 22 nt, Homo sapiens
guggcaaguguuccaagaggcg

SEQ ID NO: 375788 - RNA, 22 nt, Homo sapiens
guguaaaucugcugugaacauu

SEQ ID NO: 375789 - RNA, 22 nt, Homo sapiens
guguccucgaguacacaucagg

SEQ ID NO: 375790 - RNA, 22 nt, Homo sapiens
gugucucagcccagaccuauuu

SEQ ID NO: 375791 - RNA, 22 nt, Homo sapiens
gugucuccugccuucaugcagc

SEQ ID NO: 375792 - RNA, 21 nt, Homo sapiens
gugugcuugagugaugggauu

SEQ ID NO: 375793 - RNA, 22 nt, Homo sapiens
guguuauggagccaaacuacua

SEQ ID NO: 375794 - RNA, 22 nt, Homo sapiens
guuaagaaguguaacuuaaguu

SEQ ID NO: 375795 - RNA, 22 nt, Homo sapiens
guuacagucuuguguaagguua

SEQ ID NO: 375796 - RNA, 22 nt, Homo sapiens
guuggcaaguggcugagcuggg

SEQ ID NO: 375797 - RNA, 22 nt, Homo sapiens
guuuacagucgacuugggaaua

SEQ ID NO: 375798 - RNA, 22 nt, Homo sapiens
uaaaagucaucacaacuggagu

SEQ ID NO: 375799 - RNA, 22 nt, Homo sapiens
uaaagcacaaguaaagaauacu

SEQ ID NO: 375800 - RNA, 22 nt, Homo sapiens
uaaagccauugucaaguuugua

SEQ ID NO: 375801 - RNA, 22 nt, Homo sapiens
uaaagcgaggucuccuacaaga

SEQ ID NO: 375802 - RNA, 22 nt, Homo sapiens
uaacaacauucuaacugacggc

SEQ ID NO: 375803 - RNA, 22 nt, Homo sapiens
uaacaggcuacucuugcauugc

SEQ ID NO: 375804 - RNA, 22 nt, Homo sapiens
uaacuacuucugcuucagagua

SEQ ID NO: 375805 - RNA, 22 nt, Homo sapiens
uaacuaguggaauuugauuuca

SEQ ID NO: 375806 - RNA, 22 nt, Homo sapiens
uaaguauuaugugcugcauuuu

SEQ ID NO: 375807 - RNA, 22 nt, Homo sapiens
uaagugaauguuggcuacugaa

SEQ ID NO: 375808 - RNA, 22 nt, Homo sapiens
uaauaauguuaggcuuacucaa

SEQ ID NO: 375809 - RNA, 22 nt, Homo sapiens
uacaacacugguucgacaugug

SEQ ID NO: 375810 - RNA, 22 nt, Homo sapiens
uacaguggugugaucucagcuc

SEQ ID NO: 375811 - RNA, 22 nt, Homo sapiens
uacauacuucacagacuuuaaa

SEQ ID NO: 375812 - RNA, 22 nt, Homo sapiens
uaccaaaguuucggccucuguu

SEQ ID NO: 375813 - RNA, 19 nt, Homo sapiens
uacccagaagcagcauugu

SEQ ID NO: 375814 - RNA, 22 nt, Homo sapiens
uacgccuguaauaucagcauuu

SEQ ID NO: 375815 - RNA, 22 nt, Homo sapiens
uacugcaguugcagcuugagga

SEQ ID NO: 375816 - RNA, 22 nt, Homo sapiens
uacuuuguagagugugagaauu

SEQ ID NO: 375817 - RNA, 22 nt, Homo sapiens
uagaaagcaugaccuucagaua

SEQ ID NO: 375818 - RNA, 22 nt, Homo sapiens
uagaaugaaacaagcugugccu

SEQ ID NO: 375819 - RNA, 22 nt, Homo sapiens
uagacacuagauaugugacuga

SEQ ID NO: 375820 - RNA, 22 nt, Homo sapiens
uagaccaauuggcauauaguaa

SEQ ID NO: 375821 - RNA, 22 nt, Homo sapiens
uagaggaaugaauuuggccaga

SEQ ID NO: 375822 - RNA, 22 nt, Homo sapiens
uagcacaucccuaaaaugcugu

SEQ ID NO: 375823 - RNA, 19 nt, Homo sapiens
uagcagcaugauuuauaau

SEQ ID NO: 375824 - RNA, 22 nt, Homo sapiens
uagcccagugagguugauuugg

SEQ ID NO: 375825 - RNA, 22 nt, Homo sapiens
uagcugagacuacaguaggugc

SEQ ID NO: 375826 - RNA, 22 nt, Homo sapiens
uagcugcaaaauauagacuucu

SEQ ID NO: 375827 - RNA, 22 nt, Homo sapiens
uagcugcugcuaggcuaaggau

SEQ ID NO: 375828 - RNA, 22 nt, Homo sapiens
uagcuucuccauagcuccaugu

SEQ ID NO: 375829 - RNA, 23 nt, Homo sapiens
uagcuucucccagaccugcuccc

SEQ ID NO: 375830 - RNA, 22 nt, Homo sapiens
uaggagcacagcagcauguggg

SEQ ID NO: 375831 - RNA, 22 nt, Homo sapiens
uaggcuuuucugggaugugggc

SEQ ID NO: 375832 - RNA, 19 nt, Homo sapiens
uagggcacgaggcagaguc

SEQ ID NO: 375833 - RNA, 22 nt, Homo sapiens
uaucacagcgggguguacaccc

SEQ ID NO: 375834 - RNA, 21 nt, Homo sapiens
uaucagagacauugagaggca

SEQ ID NO: 375835 - RNA, 22 nt, Homo sapiens
uaucucuuuucauguguaaaug

SEQ ID NO: 375836 - RNA, 22 nt, Homo sapiens
uauggcacuaguacuggaaagc

SEQ ID NO: 375837 - RNA, 22 nt, Homo sapiens
uauggcuuucuacuugaguucu

SEQ ID NO: 375838 - RNA, 22 nt, Homo sapiens
uauggcuuuuauuauguuguag

SEQ ID NO: 375839 - RNA, 22 nt, Homo sapiens
uaugucuucuuuagagaaaugu

SEQ ID NO: 375840 - RNA, 20 nt, Homo sapiens
uauuacagaguaauggugga

SEQ ID NO: 375841 - RNA, 22 nt, Homo sapiens
ucaaagugagcuccuucucacu

SEQ ID NO: 375842 - RNA, 22 nt, Homo sapiens
ucaaaugcacguagagaaaaua

SEQ ID NO: 375843 - RNA, 22 nt, Homo sapiens
ucaacauugcugucaggcaucu

SEQ ID NO: 375844 - RNA, 21 nt, Homo sapiens
ucaacccuugcgucaccaagc

SEQ ID NO: 375845 - RNA, 18 nt, Homo sapiens
ucacaaccacagugcugu

SEQ ID NO: 375846 - RNA, 22 nt, Homo sapiens
ucacacugcaucuguuggaauu

SEQ ID NO: 375847 - RNA, 22 nt, Homo sapiens
ucacagacauugaggggaccuu

SEQ ID NO: 375848 - RNA, 21 nt, Homo sapiens
ucacagccuaggaccugaaga

SEQ ID NO: 375849 - RNA, 19 nt, Homo sapiens
ucacaggguugacuugagg

SEQ ID NO: 375850 - RNA, 20 nt, Homo sapiens
ucacagucacacauaauccu

SEQ ID NO: 375851 - RNA, 22 nt, Homo sapiens
ucacagugcaggaucaguuaau

SEQ ID NO: 375852 - RNA, 22 nt, Homo sapiens
ucacaguugauugaaacacagc

SEQ ID NO: 375853 - RNA, 22 nt, Homo sapiens
ucacccuguguuuugcguuugc

SEQ ID NO: 375854 - RNA, 22 nt, Homo sapiens
ucaccuugcacaguuguguggg

SEQ ID NO: 375855 - RNA, 22 nt, Homo sapiens
ucacuaaagaaaauggcaugga

SEQ ID NO: 375856 - RNA, 22 nt, Homo sapiens
ucacugugagaguuuauccugu

SEQ ID NO: 375857 - RNA, 22 nt, Homo sapiens
ucacuguguauguauaugcagg

SEQ ID NO: 375858 - RNA, 22 nt, Homo sapiens
ucagacacuguggccuuuggac

SEQ ID NO: 375859 - RNA, 22 nt, Homo sapiens
ucagaugaugucccuguucuaa

SEQ ID NO: 375860 - RNA, 22 nt, Homo sapiens
ucagaugauuccguugacgaga

SEQ ID NO: 375861 - RNA, 22 nt, Homo sapiens
ucagcaaugaccuaagcaaaua

SEQ ID NO: 375862 - RNA, 22 nt, Homo sapiens
ucagcaaugcugcacucuacug

SEQ ID NO: 375863 - RNA, 22 nt, Homo sapiens
ucaggcaccuuccucuuaucug

SEQ ID NO: 375864 - RNA, 21 nt, Homo sapiens
ucaggcuuuuugagugccaau

SEQ ID NO: 375865 - RNA, 22 nt, Homo sapiens
ucaggugcagagaagaaauggg

SEQ ID NO: 375866 - RNA, 22 nt, Homo sapiens
ucaguagagacaggauuucacc

SEQ ID NO: 375867 - RNA, 22 nt, Homo sapiens
ucaguaguaaauggauuuggaa

SEQ ID NO: 375868 - RNA, 18 nt, Homo sapiens
ucagucacugccuggcuu

SEQ ID NO: 375869 - RNA, 22 nt, Homo sapiens
ucagugccauugccauaugagu

SEQ ID NO: 375870 - RNA, 22 nt, Homo sapiens
ucagugccucaguuuuuaaaga

SEQ ID NO: 375871 - RNA, 22 nt, Homo sapiens
ucaguggagagcuuccaggauu

SEQ ID NO: 375872 - RNA, 22 nt, Homo sapiens
ucaucagaguuuacaagcucag

SEQ ID NO: 375873 - RNA, 22 nt, Homo sapiens
ucaucaggcucauucaagcuga

SEQ ID NO: 375874 - RNA, 19 nt, Homo sapiens
ucauggcuuuuucagcugu

SEQ ID NO: 375875 - RNA, 18 nt, Homo sapiens
uccacgugcuuuccagau

SEQ ID NO: 375876 - RNA, 22 nt, Homo sapiens
uccaguguuccucagucacccc

SEQ ID NO: 375877 - RNA, 22 nt, Homo sapiens
uccugagagcagacccucuaua

SEQ ID NO: 375878 - RNA, 22 nt, Homo sapiens
uccuugguugauccugugcaga

SEQ ID NO: 375879 - RNA, 22 nt, Homo sapiens
uccuuuaguuaauaaagacaag

SEQ ID NO: 375880 - RNA, 23 nt, Homo sapiens
ucgcagcauucaauaccaggcag

SEQ ID NO: 375881 - RNA, 22 nt, Homo sapiens
ucuaauguaaccugcaaauauu

SEQ ID NO: 375882 - RNA, 22 nt, Homo sapiens
ucucacacugaauguguguggg

SEQ ID NO: 375883 - RNA, 22 nt, Homo sapiens
ucuggccuccuaugagaaucga

SEQ ID NO: 375884 - RNA, 19 nt, Homo sapiens
ucugucacuggggguauuc

SEQ ID NO: 375885 - RNA, 22 nt, Homo sapiens
ucugugguucuagcuacuuugg

SEQ ID NO: 375886 - RNA, 22 nt, Homo sapiens
ucuugcuuguuguucccuucau

SEQ ID NO: 375887 - RNA, 22 nt, Homo sapiens
ucuuuaguaauuucuguaaggc

SEQ ID NO: 375888 - RNA, 22 nt, Homo sapiens
ucuuugauguucugaaagaugg

SEQ ID NO: 375889 - RNA, 22 nt, Homo sapiens
ucuuugauuuuguuacuaagac

SEQ ID NO: 375890 - RNA, 22 nt, Homo sapiens
ucuuugguauuuguggggaauu

SEQ ID NO: 375891 - RNA, 22 nt, Homo sapiens
ucuuugguucugugcagccuau

SEQ ID NO: 375892 - RNA, 22 nt, Homo sapiens
ugaaacugcagugggcuuggca

SEQ ID NO: 375893 - RNA, 22 nt, Homo sapiens
ugaaauggaagaagucccuuuu

SEQ ID NO: 375894 - RNA, 22 nt, Homo sapiens
ugaaaugguuaugugaggagau

SEQ ID NO: 375895 - RNA, 22 nt, Homo sapiens
ugaaauguugggugauggaauc

SEQ ID NO: 375896 - RNA, 22 nt, Homo sapiens
ugaagacauuuuugggugugua

SEQ ID NO: 375897 - RNA, 22 nt, Homo sapiens
ugaagcuaacuugauugugaug

SEQ ID NO: 375898 - RNA, 20 nt, Homo sapiens
ugaaggaggucauuuauacc

SEQ ID NO: 375899 - RNA, 22 nt, Homo sapiens
ugaauauagacagggguagaga

SEQ ID NO: 375900 - RNA, 21 nt, Homo sapiens
ugaauauuuggguugugucca

SEQ ID NO: 375901 - RNA, 19 nt, Homo sapiens
ugaaugacaucuaaagucc

SEQ ID NO: 375902 - RNA, 23 nt, Homo sapiens
ugacagaccuucuggaagaaguc

SEQ ID NO: 375903 - RNA, 22 nt, Homo sapiens
ugacuacaggucaggaagcugu

SEQ ID NO: 375904 - RNA, 22 nt, Homo sapiens
ugacuggaacuuuagugagucu

SEQ ID NO: 375905 - RNA, 19 nt, Homo sapiens
ugagaacaugugguauuug

SEQ ID NO: 375906 - RNA, 22 nt, Homo sapiens
ugagaacauuccucuuccuggc

SEQ ID NO: 375907 - RNA, 22 nt, Homo sapiens
ugagaacugguagcacuuguga

SEQ ID NO: 375908 - RNA, 22 nt, Homo sapiens
ugagaaugaugauuuccaguuu

SEQ ID NO: 375909 - RNA, 22 nt, Homo sapiens
ugagacugagucucgcucuauu

SEQ ID NO: 375910 - RNA, 22 nt, Homo sapiens
ugagacugagucucgcucuugu

SEQ ID NO: 375911 - RNA, 22 nt, Homo sapiens
ugagacugaguuucucucuugu

SEQ ID NO: 375912 - RNA, 22 nt, Homo sapiens
ugagacugaguuuugcucuugu

SEQ ID NO: 375913 - RNA, 22 nt, Homo sapiens
ugaggaacuagcuacccuaaua

SEQ ID NO: 375914 - RNA, 22 nt, Homo sapiens
ugaggaguauguucuguagacc

SEQ ID NO: 375915 - RNA, 22 nt, Homo sapiens
ugaggagugaacuauuucugau

SEQ ID NO: 375916 - RNA, 22 nt, Homo sapiens
ugaggagugagaaauugguuuc

SEQ ID NO: 375917 - RNA, 22 nt, Homo sapiens
ugaggaguguauuucauucgcu

SEQ ID NO: 375918 - RNA, 22 nt, Homo sapiens
ugaggcuagucagaucagauga

SEQ ID NO: 375919 - RNA, 22 nt, Homo sapiens
aggaauggaaacuuuugauggu

SEQ ID NO: 375920 - RNA, 21 nt, Homo sapiens
aggcaaaugaagcagccgcuc

SEQ ID NO: 375921 - RNA, 22 nt, Homo sapiens
aggcagcuguuauauacugagu

SEQ ID NO: 375922 - RNA, 23 nt, Homo sapiens
agggcacuauagauguuauucua

SEQ ID NO: 375923 - RNA, 22 nt, Homo sapiens
agguagaguguuuuguucuucu

SEQ ID NO: 375924 - RNA, 22 nt, Homo sapiens
aguacaucuggcuggauagaua

SEQ ID NO: 375925 - RNA, 22 nt, Homo sapiens
agucacagugaccuugucugac

SEQ ID NO: 375926 - RNA, 22 nt, Homo sapiens
agugcaguggcucaaaaugccu

SEQ ID NO: 375927 - RNA, 22 nt, Homo sapiens
aguggcacaauuuugacucccc

SEQ ID NO: 375928 - RNA, 22 nt, Homo sapiens
aguggugucugaguggccaggg

SEQ ID NO: 375929 - RNA, 22 nt, Homo sapiens
auaacaggaaauacagggcuuu

SEQ ID NO: 375930 - RNA, 22 nt, Homo sapiens
auaauagcugaucauuuagaag

SEQ ID NO: 375931 - RNA, 22 nt, Homo sapiens
auaauugcuaagugaagauggu

SEQ ID NO: 375932 - RNA, 20 nt, Homo sapiens
auagaagacuagugcagcag

SEQ ID NO: 375933 - RNA, 23 nt, Homo sapiens
auagagcuaggaugcagacagau

SEQ ID NO: 375934 - RNA, 20 nt, Homo sapiens
auagcagcaugauuuauagu

SEQ ID NO: 375935 - RNA, 22 nt, Homo sapiens
auagcugcucaggcuuuccuca

SEQ ID NO: 375936 - RNA, 22 nt, Homo sapiens
auauguucucauucauaugugg

SEQ ID NO: 375937 - RNA, 22 nt, Homo sapiens
auauucacagguaucagagauu

SEQ ID NO: 375938 - RNA, 22 nt, Homo sapiens
auauucacuauaugcagaacca

SEQ ID NO: 375939 - RNA, 22 nt, Homo sapiens
aucaaaguaggcauauguuuuu

SEQ ID NO: 375940 - RNA, 22 nt, Homo sapiens
aucaaaguaucucaauauggua

SEQ ID NO: 375941 - RNA, 22 nt, Homo sapiens
aucacaauuguacguaggagcc

SEQ ID NO: 375942 - RNA, 22 nt, Homo sapiens
aucacagaguuaaaacuuucuu

SEQ ID NO: 375943 - RNA, 22 nt, Homo sapiens
aucagcauucccaaaugaugug

SEQ ID NO: 375944 - RNA, 22 nt, Homo sapiens
aucauacuguuuugauuacugu

SEQ ID NO: 375945 - RNA, 22 nt, Homo sapiens
aucauauccuagauauaacuuc

SEQ ID NO: 375946 - RNA, 22 nt, Homo sapiens
auccaucagacggcaggcguug

SEQ ID NO: 375947 - RNA, 22 nt, Homo sapiens
aucccagaaacucggguuucuc

SEQ ID NO: 375948 - RNA, 22 nt, Homo sapiens
aucgcgccauuguacuccagcc

SEQ ID NO: 375949 - RNA, 22 nt, Homo sapiens
aucucauggagguagagaguaa

SEQ ID NO: 375950 - RNA, 22 nt, Homo sapiens
aucucuugccagucagaauggu

SEQ ID NO: 375951 - RNA, 22 nt, Homo sapiens
aucuuuggcgggaauaucacag

SEQ ID NO: 375952 - RNA, 22 nt, Homo sapiens
augaaaagcauaaacgcugaag

SEQ ID NO: 375953 - RNA, 22 nt, Homo sapiens
augaaagguauguuuucuguga

SEQ ID NO: 375954 - RNA, 22 nt, Homo sapiens
augaagacaucgucugggauua

SEQ ID NO: 375955 - RNA, 20 nt, Homo sapiens
augaaggcaggugugaguuu

SEQ ID NO: 375956 - RNA, 22 nt, Homo sapiens
augaaguuagcucauuucuuuu

SEQ ID NO: 375957 - RNA, 23 nt, Homo sapiens
augacacuccugugcgcacccug

SEQ ID NO: 375958 - RNA, 22 nt, Homo sapiens
augacugucuugcagaggcuau

SEQ ID NO: 375959 - RNA, 22 nt, Homo sapiens
augagauaggaacaaacuuaca

SEQ ID NO: 375960 - RNA, 22 nt, Homo sapiens
augagcagaugcuccugccucu

SEQ ID NO: 375961 - RNA, 22 nt, Homo sapiens
augagcugauuuccuuaccaua

SEQ ID NO: 375962 - RNA, 22 nt, Homo sapiens
augaggagauauuaaauaccau

SEQ ID NO: 375963 - RNA, 22 nt, Homo sapiens
augaggagguaugauuuucuga

SEQ ID NO: 375964 - RNA, 22 nt, Homo sapiens
augagggcggacgcccuggaga

SEQ ID NO: 375965 - RNA, 21 nt, Homo sapiens
augagguguacuguggugaaa

SEQ ID NO: 375966 - RNA, 22 nt, Homo sapiens
augcacauggcuaacuuuuuuc

SEQ ID NO: 375967 - RNA, 22 nt, Homo sapiens
augcacuguuguuauuggauaa

SEQ ID NO: 375968 - RNA, 22 nt, Homo sapiens
augcacuuggcaggaugauucc

SEQ ID NO: 375969 - RNA, 19 nt, Homo sapiens
augccacagugaggucaga

SEQ ID NO: 375970 - RNA, 22 nt, Homo sapiens
auggaaacauaagaguauagau

SEQ ID NO: 375971 - RNA, 22 nt, Homo sapiens
auggaaaugaagggcuggcccu

SEQ ID NO: 375972 - RNA, 22 nt, Homo sapiens
auggauuuuggggccagaggca

SEQ ID NO: 375973 - RNA, 22 nt, Homo sapiens
auggcacugccuggcuucaugg

SEQ ID NO: 375974 - RNA, 22 nt, Homo sapiens
auggccuuguauaccuggcaaa

SEQ ID NO: 375975 - RNA, 22 nt, Homo sapiens
auggcugagugauuucaaacag

SEQ ID NO: 375976 - RNA, 22 nt, Homo sapiens
augguugguuaaaucuguguau

SEQ ID NO: 375977 - RNA, 22 nt, Homo sapiens
auguaaacagaugugcagcuug

SEQ ID NO: 375978 - RNA, 22 nt, Homo sapiens
auguaacacagugcggcugggc

SEQ ID NO: 375979 - RNA, 22 nt, Homo sapiens
augugcuuuuggugagagauuu

SEQ ID NO: 375980 - RNA, 22 nt, Homo sapiens
augugggaggacuuggcuguug

SEQ ID NO: 375981 - RNA, 22 nt, Homo sapiens
auuauugacucauagaaaggau

SEQ ID NO: 375982 - RNA, 22 nt, Homo sapiens
auucacagcuuuaaaaggcgug

SEQ ID NO: 375983 - RNA, 22 nt, Homo sapiens
auuccacagccgauaccaugac

SEQ ID NO: 375984 - RNA, 22 nt, Homo sapiens
auugaguaaaugaaaauugccu

SEQ ID NO: 375985 - RNA, 22 nt, Homo sapiens
auugcagcccacccugggugau

SEQ ID NO: 375986 - RNA, 22 nt, Homo sapiens
auugucccucuuaaucccagca

SEQ ID NO: 375987 - RNA, 22 nt, Homo sapiens
auuuuugguugguaggcuauua

SEQ ID NO: 375988 - RNA, 22 nt, Homo sapiens
caaaggcuucugaaacugcaga

SEQ ID NO: 375989 - RNA, 22 nt, Homo sapiens
caaagugcuggaauuggccggg

SEQ ID NO: 375990 - RNA, 22 nt, Homo sapiens
caaauacuuucauguugucuug

SEQ ID NO: 375991 - RNA, 22 nt, Homo sapiens
caaaugaucugcuggccucagc

SEQ ID NO: 375992 - RNA, 22 nt, Homo sapiens
caacacagugaaacccgucucu

SEQ ID NO: 375993 - RNA, 22 nt, Homo sapiens
caacauccaccuccuggguuca

SEQ ID NO: 375994 - RNA, 22 nt, Homo sapiens
caagagagcugaugguuuuaaa

SEQ ID NO: 375995 - RNA, 22 nt, Homo sapiens
caagugcuugaugaaugaucaa

SEQ ID NO: 375996 - RNA, 21 nt, Homo sapiens
caauggcacaaucucugcuca

SEQ ID NO: 375997 - RNA, 22 nt, Homo sapiens
caaugguccccauuggcaggaa

SEQ ID NO: 375998 - RNA, 22 nt, Homo sapiens
caccacagccauuauugucccc

SEQ ID NO: 375999 - RNA, 22 nt, Homo sapiens
caccaguuuuucagugauucaa

SEQ ID NO: 376000 - RNA, 22 nt, Homo sapiens
caccccuaccugagucaggagu

SEQ ID NO: 376001 - RNA, 22 nt, Homo sapiens
cacugcacuccagccuaagagg

SEQ ID NO: 376002 - RNA, 22 nt, Homo sapiens
cacuuugguucaccugaguuuc

SEQ ID NO: 376003 - RNA, 22 nt, Homo sapiens
cagagguauugcaaaagccuag

SEQ ID NO: 376004 - RNA, 20 nt, Homo sapiens
cagcaaccugcucucuuccu

SEQ ID NO: 376005 - RNA, 22 nt, Homo sapiens
cagcuaaauuguuaaauccaag

SEQ ID NO: 376006 - RNA, 22 nt, Homo sapiens
caggcagucuggcucccaagug

SEQ ID NO: 376007 - RNA, 22 nt, Homo sapiens
cagggcauuggcugguaccugg

SEQ ID NO: 376008 - RNA, 22 nt, Homo sapiens
ucuuuuggguauggagccauca

SEQ ID NO: 376009 - RNA, 22 nt, Homo sapiens
ucuuuuguaaaaugaggaggug

SEQ ID NO: 376010 - RNA, 22 nt, Homo sapiens
ugaaauguaaguugucuagucu

SEQ ID NO: 376011 - RNA, 22 nt, Homo sapiens
ugaaaugucuuuaggaggcuuc

SEQ ID NO: 376012 - RNA, 22 nt, Homo sapiens
ugaaauguguuaucugggccug

SEQ ID NO: 376013 - RNA, 22 nt, Homo sapiens
ugaacagagaaacacuggccau

SEQ ID NO: 376014 - RNA, 20 nt, Homo sapiens
ugaacugguuacuuucuguc

SEQ ID NO: 376015 - RNA, 22 nt, Homo sapiens
ugaaggccgggcaugguggcuc

SEQ ID NO: 376016 - RNA, 22 nt, Homo sapiens
ugacugugcagcuccaucaggg

SEQ ID NO: 376017 - RNA, 20 nt, Homo sapiens
ugagaacauguggcauuugg

SEQ ID NO: 376018 - RNA, 21 nt, Homo sapiens
ugagacaauccuggucaauau

SEQ ID NO: 376019 - RNA, 22 nt, Homo sapiens
ugagacacuucccagaucccuu

SEQ ID NO: 376020 - RNA, 22 nt, Homo sapiens
ugagacauauuauacugcuuuu

SEQ ID NO: 376021 - RNA, 22 nt, Homo sapiens
ugagacugguaauguguagggc

SEQ ID NO: 376022 - RNA, 22 nt, Homo sapiens
ugagagcugguuguuuaaagga

SEQ ID NO: 376023 - RNA, 22 nt, Homo sapiens
ugaggauaguguugaaggcagg

SEQ ID NO: 376024 - RNA, 22 nt, Homo sapiens
ugagguagguaccauuaucacu

SEQ ID NO: 376025 - RNA, 22 nt, Homo sapiens
ugagguugguauuacugucucu

SEQ ID NO: 376026 - RNA, 22 nt, Homo sapiens
ugauaacauuucuucugguaca

SEQ ID NO: 376027 - RNA, 22 nt, Homo sapiens
ugauaggucuguuuugaaaagg

SEQ ID NO: 376028 - RNA, 22 nt, Homo sapiens
ugauaugaaagggaaauaagug

SEQ ID NO: 376029 - RNA, 22 nt, Homo sapiens
ugauauuuuugauccuuaaguu

SEQ ID NO: 376030 - RNA, 22 nt, Homo sapiens
ugcaaaguccucauucuuaccc

SEQ ID NO: 376031 - RNA, 23 nt, Homo sapiens
ugcagcacacugaugggucuuga

SEQ ID NO: 376032 - RNA, 19 nt, Homo sapiens
ugcauaggguuacauacuc

SEQ ID NO: 376033 - RNA, 22 nt, Homo sapiens
ugcauauguauacaugugccau

SEQ ID NO: 376034 - RNA, 22 nt, Homo sapiens
ugcauauguugaaccagccuug

SEQ ID NO: 376035 - RNA, 22 nt, Homo sapiens
ugcauauucgaguuauuuuggg

SEQ ID NO: 376036 - RNA, 22 nt, Homo sapiens
ugcauauucuaggauuuuguau

SEQ ID NO: 376037 - RNA, 19 nt, Homo sapiens
ugcauugucugggaaaugg

SEQ ID NO: 376038 - RNA, 19 nt, Homo sapiens
ugccaagaaagucagcuua

SEQ ID NO: 376039 - RNA, 22 nt, Homo sapiens
ugccaugaagagaggaagcagu

SEQ ID NO: 376040 - RNA, 22 nt, Homo sapiens
ugcgccauugcacuccagccug

SEQ ID NO: 376041 - RNA, 22 nt, Homo sapiens
uggaaauuaagucuuuccugag

SEQ ID NO: 376042 - RNA, 22 nt, Homo sapiens
uggaaugguaucuuguuggggu

SEQ ID NO: 376043 - RNA, 22 nt, Homo sapiens
uggacugagauuucagcugcca

SEQ ID NO: 376044 - RNA, 22 nt, Homo sapiens
uggauggucagaggguuucugu

SEQ ID NO: 376045 - RNA, 23 nt, Homo sapiens
uggcaagaauucuuaccgugugg

SEQ ID NO: 376046 - RNA, 22 nt, Homo sapiens
uggcaagagggaugcaagguuu

SEQ ID NO: 376047 - RNA, 22 nt, Homo sapiens
uggcaugauccuagauucaaca

SEQ ID NO: 376048 - RNA, 22 nt, Homo sapiens
uggcucuguuuguuaacuagac

SEQ ID NO: 376049 - RNA, 22 nt, Homo sapiens
ugggaaauguagccuagcugug

SEQ ID NO: 376050 - RNA, 22 nt, Homo sapiens
ugggaauaugauacaggucuuu

SEQ ID NO: 376051 - RNA, 22 nt, Homo sapiens
ugggaaugaaauuacauagcuu

SEQ ID NO: 376052 - RNA, 22 nt, Homo sapiens
ugggaugaauacaaugggauca

SEQ ID NO: 376053 - RNA, 22 nt, Homo sapiens
ugggaugaugaaaaggcuuucu

SEQ ID NO: 376054 - RNA, 22 nt, Homo sapiens
ugggcaagagagcaugacccug

SEQ ID NO: 376055 - RNA, 22 nt, Homo sapiens
ugggccgcugcaggaugguccc

SEQ ID NO: 376056 - RNA, 22 nt, Homo sapiens
uggguagagcacugggggcgag

SEQ ID NO: 376057 - RNA, 22 nt, Homo sapiens
uggguccccuacucuuuccaca

SEQ ID NO: 376058 - RNA, 22 nt, Homo sapiens
ugguaaaaugucauuuaccaga

SEQ ID NO: 376059 - RNA, 22 nt, Homo sapiens
uggugccgugguccuggggcca

SEQ ID NO: 376060 - RNA, 22 nt, Homo sapiens
uguaacaguaguuacuauucuu

SEQ ID NO: 376061 - RNA, 22 nt, Homo sapiens
uguaaugaucaaaucagaguaa

SEQ ID NO: 376062 - RNA, 22 nt, Homo sapiens
uguacaaauuucugugguggug

SEQ ID NO: 376063 - RNA, 22 nt, Homo sapiens
uguagacagcacguaguugagu

SEQ ID NO: 376064 - RNA, 16 nt, Homo sapiens
uguauugcuaaaaaga

SEQ ID NO: 376065 - RNA, 22 nt, Homo sapiens
uguauugcuugaagagugaauu

SEQ ID NO: 376066 - RNA, 22 nt, Homo sapiens
uguccaaaucagagguaccaaa

SEQ ID NO: 376067 - RNA, 20 nt, Homo sapiens
ugucccaaccccauggguuc

SEQ ID NO: 376068 - RNA, 16 nt, Homo sapiens
ugucuguuugggcaca

SEQ ID NO: 376069 - RNA, 22 nt, Homo sapiens
ugugacaguguuacauuucaug

SEQ ID NO: 376070 - RNA, 22 nt, Homo sapiens
ugugcaguuuuagcguauuuua

SEQ ID NO: 376071 - RNA, 22 nt, Homo sapiens
ugugccacugcacucccgccug

SEQ ID NO: 376072 - RNA, 22 nt, Homo sapiens
ugugccacugcacuccugccug

SEQ ID NO: 376073 - RNA, 22 nt, Homo sapiens
ugugccacugcacucugggcaa

SEQ ID NO: 376074 - RNA, 22 nt, Homo sapiens
ugugcucaucucagucaacugu

SEQ ID NO: 376075 - RNA, 22 nt, Homo sapiens
uguggcugguggcaccuuuucc

SEQ ID NO: 376076 - RNA, 18 nt, Homo sapiens
uguggcuguuuuccaaua

SEQ ID NO: 376077 - RNA, 22 nt, Homo sapiens
ugugggaggugcuaauguaaau

SEQ ID NO: 376078 - RNA, 22 nt, Homo sapiens
ugugucuuguuuuuucccaggc

SEQ ID NO: 376079 - RNA, 22 nt, Homo sapiens
ugugucuuuuaucacacaaugu

SEQ ID NO: 376080 - RNA, 22 nt, Homo sapiens
uguguuuuuauguaaaauggaa

SEQ ID NO: 376081 - RNA, 22 nt, Homo sapiens
aaacugccuuccuuguaggugc

SEQ ID NO: 376082 - RNA, 22 nt, Homo sapiens
aaaggcuucggaucagaaggua

SEQ ID NO: 376083 - RNA, 22 nt, Homo sapiens
aaagugcaguauuugggcagaa

SEQ ID NO: 376084 - RNA, 22 nt, Homo sapiens
aaagugcaguauuugggcagga

SEQ ID NO: 376085 - RNA, 22 nt, Homo sapiens
aaagugccugacucauaguuag

SEQ ID NO: 376086 - RNA, 22 nt, Homo sapiens
aaagugcuaggauuaccugggg

SEQ ID NO: 376087 - RNA, 22 nt, Homo sapiens
aaagugcugagacagacuggga

SEQ ID NO: 376088 - RNA, 22 nt, Homo sapiens
aaagugcugagaguucuaacuu

SEQ ID NO: 376089 - RNA, 22 nt, Homo sapiens
aaagugcugggaucacacugaa

SEQ ID NO: 376090 - RNA, 22 nt, Homo sapiens
aaagugcugggauuaggccagg

SEQ ID NO: 376091 - RNA, 22 nt, Homo sapiens
aaagugcugggauuggccgggc

SEQ ID NO: 376092 - RNA, 22 nt, Homo sapiens
aaagugcuucucuuuggugggu

SEQ ID NO: 376093 - RNA, 22 nt, Homo sapiens
aaaguggugggauuccaggcau

SEQ ID NO: 376094 - RNA, 22 nt, Homo sapiens
aaaugcacaaagauuuugcacu

SEQ ID NO: 376095 - RNA, 22 nt, Homo sapiens
aaaugcacagaaaggaugugga

SEQ ID NO: 376096 - RNA, 22 nt, Homo sapiens
aacaggcuccuaggggugcacc

SEQ ID NO: 376097 - RNA, 22 nt, Homo sapiens
aacauguuuagcagauaccugu

SEQ ID NO: 376098 - RNA, 22 nt, Homo sapiens
aacccugagucaugagucuaga

SEQ ID NO: 376099 - RNA, 21 nt, Homo sapiens
aacuggugugagaugguaugu

SEQ ID NO: 376100 - RNA, 20 nt, Homo sapiens
aagacacuguccccacugga

SEQ ID NO: 376101 - RNA, 22 nt, Homo sapiens
aagacuguaauccaucuugagu

SEQ ID NO: 376102 - RNA, 22 nt, Homo sapiens
gaauucugucgcuuacuagaug

SEQ ID NO: 376103 - RNA, 21 nt, Homo sapiens
gacauggcgauacuccgucuc

SEQ ID NO: 376104 - RNA, 22 nt, Homo sapiens
gacauguuuuuuaagguuuaug

SEQ ID NO: 376105 - RNA, 22 nt, Homo sapiens
gacucuguagacaaucacaucu

SEQ ID NO: 376106 - RNA, 22 nt, Homo sapiens
gacuggccuauaauggcgaauu

SEQ ID NO: 376107 - RNA, 22 nt, Homo sapiens
gagauuaauacacaucaaaugc

SEQ ID NO: 376108 - RNA, 22 nt, Homo sapiens
gaggagauauucugcuggaugg

SEQ ID NO: 376109 - RNA, 22 nt, Homo sapiens
gaggaguagggcacaaagccuu

SEQ ID NO: 376110 - RNA, 22 nt, Homo sapiens
gagguaggggccuuaaagaugc

SEQ ID NO: 376111 - RNA, 22 nt, Homo sapiens
gaggucaggacauuuuugcuuu

SEQ ID NO: 376112 - RNA, 22 nt, Homo sapiens
gaggucaugucgggccccagga

SEQ ID NO: 376113 - RNA, 22 nt, Homo sapiens
gaggucuuacauuuuaauauuu

SEQ ID NO: 376114 - RNA, 22 nt, Homo sapiens
gaguuuguaaacuauucacuaa

SEQ ID NO: 376115 - RNA, 22 nt, Homo sapiens
gauaacagauaaugucaguuau

SEQ ID NO: 376116 - RNA, 17 nt, Homo sapiens
gaucacagucgucuccu

SEQ ID NO: 376117 - RNA, 22 nt, Homo sapiens
gaugaggcuagagacaugugua

SEQ ID NO: 376118 - RNA, 22 nt, Homo sapiens
gaugcaguaagaaugcauagcg

SEQ ID NO: 376119 - RNA, 22 nt, Homo sapiens
gauggcacuaagccauguagga

SEQ ID NO: 376120 - RNA, 22 nt, Homo sapiens
gauggcacuuaagagcaagagc

SEQ ID NO: 376121 - RNA, 22 nt, Homo sapiens
gauguguuuguuucuggaggag

SEQ ID NO: 376122 - RNA, 22 nt, Homo sapiens
gcaaaugcuacaccauuuugua

SEQ ID NO: 376123 - RNA, 22 nt, Homo sapiens
gcacugggccacauuuauuuuc

SEQ ID NO: 376124 - RNA, 20 nt, Homo sapiens
gcagcaccauauuucuaaga

SEQ ID NO: 376125 - RNA, 22 nt, Homo sapiens
gcaguguucugggcaggaagaa

SEQ ID NO: 376126 - RNA, 22 nt, Homo sapiens
gcccagcguucagggaggggcu

SEQ ID NO: 376127 - RNA, 22 nt, Homo sapiens
gccccgggugaugcagccguca

SEQ ID NO: 376128 - RNA, 22 nt, Homo sapiens
gccgagagauuuggaaugggga

SEQ ID NO: 376129 - RNA, 19 nt, Homo sapiens
gcucaccuugcugcuccag

SEQ ID NO: 376130 - RNA, 22 nt, Homo sapiens
gcucaguuuccucagcugcaaa

SEQ ID NO: 376131 - RNA, 22 nt, Homo sapiens
gcugcacuuuaaggcauccccu

SEQ ID NO: 376132 - RNA, 22 nt, Homo sapiens
gcugcuguaccagaugugguua

SEQ ID NO: 376133 - RNA, 22 nt, Homo sapiens
gcugcuguuuaguuucuccugg

SEQ ID NO: 376134 - RNA, 22 nt, Homo sapiens
gcugcuuuugaugacaaaaaca

SEQ ID NO: 376135 - RNA, 22 nt, Homo sapiens
gcuggcuuucuccugaucucag

SEQ ID NO: 376136 - RNA, 22 nt, Homo sapiens
gcugguguugugaaucaggccg

SEQ ID NO: 376137 - RNA, 22 nt, Homo sapiens
gcuuggugugcaagugguacua

SEQ ID NO: 376138 - RNA, 22 nt, Homo sapiens
gcuuguguucaagucacccuua

SEQ ID NO: 376139 - RNA, 17 nt, Homo sapiens
ggaagccuuugguuuaa

SEQ ID NO: 376140 - RNA, 22 nt, Homo sapiens
ggaaugggauuugaagucuggc

SEQ ID NO: 376141 - RNA, 22 nt, Homo sapiens
ggacagugaaugccacuccucc

SEQ ID NO: 376142 - RNA, 22 nt, Homo sapiens
ggagaugaaaugagcuacuuaa

SEQ ID NO: 376143 - RNA, 22 nt, Homo sapiens
ggagcugugauuugaguccaga

SEQ ID NO: 376144 - RNA, 22 nt, Homo sapiens
ggaucacuugagaccaggaguu

SEQ ID NO: 376145 - RNA, 22 nt, Homo sapiens
ggcaaaugaagauggagaggcu

SEQ ID NO: 376146 - RNA, 19 nt, Homo sapiens
ggcaauacuuucuuguugg

SEQ ID NO: 376147 - RNA, 22 nt, Homo sapiens
ggcaccacagacgccaggcgug

SEQ ID NO: 376148 - RNA, 19 nt, Homo sapiens
ggcacugugugagugagga

SEQ ID NO: 376149 - RNA, 22 nt, Homo sapiens
ggcaguguuauuauauuuuugg

SEQ ID NO: 376150 - RNA, 22 nt, Homo sapiens
ggccggguggccauggcugccc

SEQ ID NO: 376151 - RNA, 22 nt, Homo sapiens
ggcucguguuuucuguccaguu

SEQ ID NO: 376152 - RNA, 22 nt, Homo sapiens
ggcuuuggucacacaggggcaa

SEQ ID NO: 376153 - RNA, 20 nt, Homo sapiens
gggaaugcaaauucucaucc

SEQ ID NO: 376154 - RNA, 23 nt, Homo sapiens
gggcuagaugagagcuuccuggg

SEQ ID NO: 376155 - RNA, 22 nt, Homo sapiens
gguaaacauacugcugucuucu

SEQ ID NO: 376156 - RNA, 22 nt, Homo sapiens
ggucaacaucaucaugguaagu

SEQ ID NO: 376157 - RNA, 22 nt, Homo sapiens
ggucauggagcuuuacuuuaug

SEQ ID NO: 376158 - RNA, 22 nt, Homo sapiens
ggucauggauugucuuuucuug

SEQ ID NO: 376159 - RNA, 22 nt, Homo sapiens
ggucccccuccacucucgcaaa

SEQ ID NO: 376160 - RNA, 22 nt, Homo sapiens
ggugaguggugcuuaaguucag

SEQ ID NO: 376161 - RNA, 22 nt, Homo sapiens
gguggugguauuucagaaaaug

SEQ ID NO: 376162 - RNA, 22 nt, Homo sapiens
guaaucucagcuacuugggagg

SEQ ID NO: 376163 - RNA, 22 nt, Homo sapiens
guacaggugcaggaugggcagg

SEQ ID NO: 376164 - RNA, 22 nt, Homo sapiens
guacauggaaugaaauucaaaa

SEQ ID NO: 376165 - RNA, 22 nt, Homo sapiens
guagcagccacacuugauaacu

SEQ ID NO: 376166 - RNA, 22 nt, Homo sapiens
gucacaggaaacuaauaugcgc

SEQ ID NO: 376167 - RNA, 22 nt, Homo sapiens
gucagugucuuugcagcucaga

SEQ ID NO: 376168 - RNA, 22 nt, Homo sapiens
gucauguuuaacuucuugagga

SEQ ID NO: 376169 - RNA, 22 nt, Homo sapiens
gucccugcgauugugggauccu

SEQ ID NO: 376170 - RNA, 22 nt, Homo sapiens
gucucccagccuacaucuuucu

SEQ ID NO: 376171 - RNA, 22 nt, Homo sapiens
gucugguuuuuuauauccucac

SEQ ID NO: 376172 - RNA, 22 nt, Homo sapiens
gucuuggagaacucagcuuggc

SEQ ID NO: 376173 - RNA, 22 nt, Homo sapiens
gugaaaugaaacgcuaugucuu

SEQ ID NO: 376174 - RNA, 22 nt, Homo sapiens
gugagguagagcaugugaaaga

SEQ ID NO: 376175 - RNA, 22 nt, Homo sapiens
gugauuuaguagaugcuaguua

SEQ ID NO: 376176 - RNA, 22 nt, Homo sapiens
gugcaaauuccagcucaacucc

SEQ ID NO: 376177 - RNA, 22 nt, Homo sapiens
gugcaagagugauugcaguuuu

SEQ ID NO: 376178 - RNA, 22 nt, Homo sapiens
gugcaguuugaaaguagaaaca

SEQ ID NO: 376179 - RNA, 22 nt, Homo sapiens
gugccacugcaccuggccuaag

SEQ ID NO: 376180 - RNA, 22 nt, Homo sapiens
gugccacugcacuccggccugg

SEQ ID NO: 376181 - RNA, 22 nt, Homo sapiens
agcugguuuauuucucacaaca

SEQ ID NO: 376182 - RNA, 22 nt, Homo sapiens
aggaagguaaacuaacuugccu

SEQ ID NO: 376183 - RNA, 22 nt, Homo sapiens
aggaccccucaucagcaccagu

SEQ ID NO: 376184 - RNA, 21 nt, Homo sapiens
aggcaagacuuuuagguuugu

SEQ ID NO: 376185 - RNA, 22 nt, Homo sapiens
aggcaguuucagugagagguga

SEQ ID NO: 376186 - RNA, 22 nt, Homo sapiens
aggcaugguggcacauacaugu

SEQ ID NO: 376187 - RNA, 22 nt, Homo sapiens
aggcugguauuuacaaaagcuc

SEQ ID NO: 376188 - RNA, 22 nt, Homo sapiens
aggcuuuauuacagggucucag

SEQ ID NO: 376189 - RNA, 22 nt, Homo sapiens
aggugguuuuaggcagagacau

SEQ ID NO: 376190 - RNA, 22 nt, Homo sapiens
aguaaagcuacucacugugggc

SEQ ID NO: 376191 - RNA, 22 nt, Homo sapiens
aguaagauggcaacucuccaca

SEQ ID NO: 376192 - RNA, 22 nt, Homo sapiens
agucacaugccagcacacccag

SEQ ID NO: 376193 - RNA, 22 nt, Homo sapiens
agucagugcauaagaaugaagu

SEQ ID NO: 376194 - RNA, 22 nt, Homo sapiens
agugcaguggugccaucauaac

SEQ ID NO: 376195 - RNA, 23 nt, Homo sapiens
aguggucuccugggcccagcugu

SEQ ID NO: 376196 - RNA, 22 nt, Homo sapiens
aguguuuuucaugggauacuuu

SEQ ID NO: 376197 - RNA, 22 nt, Homo sapiens
aguuggcacugagcugugauug

SEQ ID NO: 376198 - RNA, 22 nt, Homo sapiens
aguuuuugcugauagcaugcuu

SEQ ID NO: 376199 - RNA, 22 nt, Homo sapiens
auaaagcaagucucuggccuca

SEQ ID NO: 376200 - RNA, 22 nt, Homo sapiens
auaagugagugauucaguguua

SEQ ID NO: 376201 - RNA, 22 nt, Homo sapiens
auacaguaaugucuuaggcugu

SEQ ID NO: 376202 - RNA, 22 nt, Homo sapiens
auagaauguauuaguaaauuug

SEQ ID NO: 376203 - RNA, 19 nt, Homo sapiens
auaguguaggaaaacagcu

SEQ ID NO: 376204 - RNA, 22 nt, Homo sapiens
auaucacagguguuuaccugau

SEQ ID NO: 376205 - RNA, 22 nt, Homo sapiens
auaugcacuauacacacguaua

SEQ ID NO: 376206 - RNA, 22 nt, Homo sapiens
auaugcauacauguaugcagga

SEQ ID NO: 376207 - RNA, 22 nt, Homo sapiens
auaugcauguacccacacaggc

SEQ ID NO: 376208 - RNA, 22 nt, Homo sapiens
auauuggucuucaagaccugug

SEQ ID NO: 376209 - RNA, 22 nt, Homo sapiens
auauugguuaaauauuauguga

SEQ ID NO: 376210 - RNA, 22 nt, Homo sapiens
aucaaagugaauuaaugagaau

SEQ ID NO: 376211 - RNA, 22 nt, Homo sapiens
aucacagauauggguuuaaauc

SEQ ID NO: 376212 - RNA, 22 nt, Homo sapiens
aucagcagcaugaaaacaggcu

SEQ ID NO: 376213 - RNA, 22 nt, Homo sapiens
aucccaguucagccucugacac

SEQ ID NO: 376214 - RNA, 22 nt, Homo sapiens
aucccuugacguggagucucug

SEQ ID NO: 376215 - RNA, 22 nt, Homo sapiens
auccugagacuuugcugaaguu

SEQ ID NO: 376216 - RNA, 22 nt, Homo sapiens
auccugaugacacagugcugca

SEQ ID NO: 376217 - RNA, 21 nt, Homo sapiens
auccuucuuuuucaaccugug

SEQ ID NO: 376218 - RNA, 22 nt, Homo sapiens
aucugauggagagcguguggcu

SEQ ID NO: 376219 - RNA, 22 nt, Homo sapiens
aucugcacaucuguguuuuugu

SEQ ID NO: 376220 - RNA, 22 nt, Homo sapiens
aucugggguuggcaaaguuugg

SEQ ID NO: 376221 - RNA, 22 nt, Homo sapiens
aucugugaaugaaguuauuuug

SEQ ID NO: 376222 - RNA, 22 nt, Homo sapiens
aucuuuggugaguucuuugguc

SEQ ID NO: 376223 - RNA, 22 nt, Homo sapiens
aucuuuggugcaugauacuuug

SEQ ID NO: 376224 - RNA, 22 nt, Homo sapiens
augaaagguugucuuaagccau

SEQ ID NO: 376225 - RNA, 22 nt, Homo sapiens
augaaagugauaaaugucucua

SEQ ID NO: 376226 - RNA, 22 nt, Homo sapiens
augaacucaucauuuuuauggc

SEQ ID NO: 376227 - RNA, 22 nt, Homo sapiens
augacauguauuuccaggauuu

SEQ ID NO: 376228 - RNA, 22 nt, Homo sapiens
augaccauuucaauugauaugg

SEQ ID NO: 376229 - RNA, 22 nt, Homo sapiens
augacguugugggcucucaagc

SEQ ID NO: 376230 - RNA, 22 nt, Homo sapiens
augacuggaacggcacuuuaca

SEQ ID NO: 376231 - RNA, 22 nt, Homo sapiens
augagacuguucuuccucauug

SEQ ID NO: 376232 - RNA, 22 nt, Homo sapiens
augagauucuuagagaagucug

SEQ ID NO: 376233 - RNA, 22 nt, Homo sapiens
augagcagaagagauacacugu

SEQ ID NO: 376234 - RNA, 22 nt, Homo sapiens
augagcuguuuggaagacacuu

SEQ ID NO: 376235 - RNA, 22 nt, Homo sapiens
augagucacuuauuauuggggu

SEQ ID NO: 376236 - RNA, 22 nt, Homo sapiens
augaugucauuuuaauuucuaa

SEQ ID NO: 376237 - RNA, 22 nt, Homo sapiens
augcaaacaucugaagagacau

SEQ ID NO: 376238 - RNA, 22 nt, Homo sapiens
augcauggagucuuucacaagu

SEQ ID NO: 376239 - RNA, 22 nt, Homo sapiens
augccacugcauaagguuuuca

SEQ ID NO: 376240 - RNA, 22 nt, Homo sapiens
auggccuuucuggcacauuucc

SEQ ID NO: 376241 - RNA, 22 nt, Homo sapiens
auggcucuguuccaugugucuu

SEQ ID NO: 376242 - RNA, 22 nt, Homo sapiens
auggcucuguuuuuuaugcucu

SEQ ID NO: 376243 - RNA, 22 nt, Homo sapiens
auggcucuuauuauuuugaggu

SEQ ID NO: 376244 - RNA, 22 nt, Homo sapiens
auggcuugugacccaugcuuca

SEQ ID NO: 376245 - RNA, 22 nt, Homo sapiens
auggcuuuuauuguguugaggu

SEQ ID NO: 376246 - RNA, 22 nt, Homo sapiens
augggagugugguuagagaccu

SEQ ID NO: 376247 - RNA, 22 nt, Homo sapiens
augggcuaguaaagacaaacuu

SEQ ID NO: 376248 - RNA, 22 nt, Homo sapiens
augggugaguaugaguugacuu

SEQ ID NO: 376249 - RNA, 22 nt, Homo sapiens
auguagauaucaagaggcauau

SEQ ID NO: 376250 - RNA, 22 nt, Homo sapiens
augugcaauggugucaccacau

SEQ ID NO: 376251 - RNA, 22 nt, Homo sapiens
augugcacaugcuuacauguga

SEQ ID NO: 376252 - RNA, 22 nt, Homo sapiens
augugcuuauagguguauguuu

SEQ ID NO: 376253 - RNA, 22 nt, Homo sapiens
auguguauuaccucgauuguga

SEQ ID NO: 376254 - RNA, 22 nt, Homo sapiens
auuaacaucuagaguuuuggug

SEQ ID NO: 376255 - RNA, 22 nt, Homo sapiens
auuaaucaggcaaugcuugcua

SEQ ID NO: 376256 - RNA, 22 nt, Homo sapiens
auuauguuguauuuccuugcag

SEQ ID NO: 376257 - RNA, 22 nt, Homo sapiens
auucaaagugcauguucccacu

SEQ ID NO: 376258 - RNA, 22 nt, Homo sapiens
auugcacaaagagggaaacuga

SEQ ID NO: 376259 - RNA, 22 nt, Homo sapiens
auugcacacagaaucaggguaa

SEQ ID NO: 376260 - RNA, 22 nt, Homo sapiens
auugcacuggggguuagaauuu

SEQ ID NO: 376261 - RNA, 22 nt, Homo sapiens
auugcagcuugcagggugugua

SEQ ID NO: 376262 - RNA, 22 nt, Homo sapiens
auugcucaaaucaguacuugag

SEQ ID NO: 376263 - RNA, 22 nt, Homo sapiens
auuguucuuguguccuuuuccu

SEQ ID NO: 376264 - RNA, 22 nt, Homo sapiens
auuuagcaauggagguagugua

SEQ ID NO: 376265 - RNA, 19 nt, Homo sapiens
auuugaucaucaggcacag

SEQ ID NO: 376266 - RNA, 22 nt, Homo sapiens
auuuggccuuuguaugcaguau

SEQ ID NO: 376267 - RNA, 22 nt, Homo sapiens
caaaagugguucuuauccuuuu

SEQ ID NO: 376268 - RNA, 22 nt, Homo sapiens
caaaggcuuccacugcauccuu

SEQ ID NO: 376269 - RNA, 22 nt, Homo sapiens
caaagugcugaaagaggccagg

SEQ ID NO: 376270 - RNA, 22 nt, Homo sapiens
caaaugcuucuauggacugucu

SEQ ID NO: 376271 - RNA, 22 nt, Homo sapiens
caagaggcuguguauaaagcca

SEQ ID NO: 376272 - RNA, 22 nt, Homo sapiens
caagaucauuuaugcuaaaauu

SEQ ID NO: 376273 - RNA, 22 nt, Homo sapiens
caagggguggaaaugguagugu

SEQ ID NO: 376274 - RNA, 22 nt, Homo sapiens
caagugcuuucuuggggauuua

SEQ ID NO: 376275 - RNA, 22 nt, Homo sapiens
caaugcauuauucucccacuuc

SEQ ID NO: 376276 - RNA, 22 nt, Homo sapiens
caauggcacgaucucgucucac

SEQ ID NO: 376277 - RNA, 22 nt, Homo sapiens
cacacugucuucaauggguggu

SEQ ID NO: 376278 - RNA, 22 nt, Homo sapiens
cacaggccugucucuuucuaac

SEQ ID NO: 376279 - RNA, 22 nt, Homo sapiens
cacauguuugcuacauuuuucu

SEQ ID NO: 376280 - RNA, 22 nt, Homo sapiens
cacauugaauuucugaugacaa

SEQ ID NO: 376281 - RNA, 22 nt, Homo sapiens
cacugaaugugagguuggggag

SEQ ID NO: 376282 - RNA, 22 nt, Homo sapiens
cacugcaguaaauugcgucggu

SEQ ID NO: 376283 - RNA, 22 nt, Homo sapiens
cagacagugucccgagucccug

SEQ ID NO: 376284 - RNA, 22 nt, Homo sapiens
cagagagcuugcccuuguauau

SEQ ID NO: 376285 - RNA, 20 nt, Homo sapiens
cagcacgcacaugagacugu

SEQ ID NO: 376286 - RNA, 22 nt, Homo sapiens
caggcagucuggggguguaucc

SEQ ID NO: 376287 - RNA, 22 nt, Homo sapiens
cagggaauguuauuuaauagca

SEQ ID NO: 376288 - RNA, 22 nt, Homo sapiens
cagugcaaccuccaucucucgg

SEQ ID NO: 376289 - RNA, 23 nt, Homo sapiens
cagugguguuagagaaaucuuuu

SEQ ID NO: 376290 - RNA, 22 nt, Homo sapiens
cagugucugcauuuggaacuca

SEQ ID NO: 376291 - RNA, 22 nt, Homo sapiens
cauaaaucuuguugaauagcac

SEQ ID NO: 376292 - RNA, 22 nt, Homo sapiens
cauauucacuuuacagagcugu

SEQ ID NO: 376293 - RNA, 21 nt, Homo sapiens
cauccccugccauuguggucu

SEQ ID NO: 376294 - RNA, 22 nt, Homo sapiens
caucccugucgucaagucucug

SEQ ID NO: 376295 - RNA, 22 nt, Homo sapiens
caugccacugcacgccauccug

SEQ ID NO: 376296 - RNA, 19 nt, Homo sapiens
caugccacugcacuugagu

SEQ ID NO: 376297 - RNA, 22 nt, Homo sapiens
cauggcuuuauuuucagcuucu

SEQ ID NO: 376298 - RNA, 22 nt, Homo sapiens
cauggcuuuuauaacaagaaau

SEQ ID NO: 376299 - RNA, 22 nt, Homo sapiens
caugucuuuuaaacauucaacu

SEQ ID NO: 376300 - RNA, 19 nt, Homo sapiens
caugugcacuacuggcuuc

SEQ ID NO: 376301 - RNA, 22 nt, Homo sapiens
cauugcagauccuucaaaugac

SEQ ID NO: 376302 - RNA, 22 nt, Homo sapiens
cauugcaguuuuugguguaucu

SEQ ID NO: 376303 - RNA, 23 nt, Homo sapiens
ccacacuguuuagaauggcauca

SEQ ID NO: 376304 - RNA, 22 nt, Homo sapiens
ccacccuuccauucuuccucuu

SEQ ID NO: 376305 - RNA, 22 nt, Homo sapiens
ccacugugguaucugauacugg

SEQ ID NO: 376306 - RNA, 22 nt, Homo sapiens
ccauggcaauggucagucuauu

SEQ ID NO: 376307 - RNA, 22 nt, Homo sapiens
ccauggcuauucuguaaggguu

SEQ ID NO: 376308 - RNA, 22 nt, Homo sapiens
ccccauguucucucugcagcuc

SEQ ID NO: 376309 - RNA, 22 nt, Homo sapiens
cccucgagaaaccaucugcuga

SEQ ID NO: 376310 - RNA, 19 nt, Homo sapiens
cccuggcacauggaaaaug

SEQ ID NO: 376311 - RNA, 21 nt, Homo sapiens
ccuugagaacaucaauuugcu

SEQ ID NO: 376312 - RNA, 22 nt, Homo sapiens
ccuuuuuguaguggaaguagga

SEQ ID NO: 376313 - RNA, 22 nt, Homo sapiens
cuauauacugccugcugauuag

SEQ ID NO: 376314 - RNA, 22 nt, Homo sapiens
cuaugagucugcagaucuauua

SEQ ID NO: 376315 - RNA, 22 nt, Homo sapiens
cuauggugauagaaaucagaau

SEQ ID NO: 376316 - RNA, 19 nt, Homo sapiens
cucauggagaaggagaaua

SEQ ID NO: 376317 - RNA, 22 nt, Homo sapiens
cuccauuuggaacagauguccu

SEQ ID NO: 376318 - RNA, 22 nt, Homo sapiens
cucugagguuauucguaauauu

SEQ ID NO: 376319 - RNA, 22 nt, Homo sapiens
cucugauggagauauacaagga

SEQ ID NO: 376320 - RNA, 22 nt, Homo sapiens
cucuuuuguuccuaguuugauc

SEQ ID NO: 376321 - RNA, 22 nt, Homo sapiens
cugaaaugaauuauuuucuuuc

SEQ ID NO: 376322 - RNA, 22 nt, Homo sapiens
cugagacacucuuaucugcaua

SEQ ID NO: 376323 - RNA, 22 nt, Homo sapiens
cugaggugggagaaucacauaa

SEQ ID NO: 376324 - RNA, 22 nt, Homo sapiens
cugaucuggaggugucugggga

SEQ ID NO: 376325 - RNA, 22 nt, Homo sapiens
cuggacguugaggcugcaguga

SEQ ID NO: 376326 - RNA, 20 nt, Homo sapiens
cuggaugucgaggcagaggu

SEQ ID NO: 376327 - RNA, 22 nt, Homo sapiens
cuggcucugagguguuuagggc

SEQ ID NO: 376328 - RNA, 22 nt, Homo sapiens
cuggcucuguuagaagaaccag

SEQ ID NO: 376329 - RNA, 22 nt, Homo sapiens
cugggcaaugcggcuggauaga

SEQ ID NO: 376330 - RNA, 22 nt, Homo sapiens
cugucacaguuuuggaggccag

SEQ ID NO: 376331 - RNA, 22 nt, Homo sapiens
cugucaucauuucuaugugcca

SEQ ID NO: 376332 - RNA, 22 nt, Homo sapiens
cugucuguuucaaaagugguua

SEQ ID NO: 376333 - RNA, 22 nt, Homo sapiens
cuguucaggaggcauuuggugg

SEQ ID NO: 376334 - RNA, 22 nt, Homo sapiens
cuucaaaguuggcuaggagaca

SEQ ID NO: 376335 - RNA, 22 nt, Homo sapiens
cuucaaguguggccaccugacc

SEQ ID NO: 376336 - RNA, 22 nt, Homo sapiens
cuucaguucuguaaggacagca

SEQ ID NO: 376337 - RNA, 21 nt, Homo sapiens
cuucuuggggcagggcagggu

SEQ ID NO: 376338 - RNA, 19 nt, Homo sapiens
cuugccccauucauccucu

SEQ ID NO: 376339 - RNA, 22 nt, Homo sapiens
cuuguucuccuaagaugaaugc

SEQ ID NO: 376340 - RNA, 22 nt, Homo sapiens
cuuugcaaaacauugagaccuc

SEQ ID NO: 376341 - RNA, 22 nt, Homo sapiens
cuuuguguaggugccucuggcu

SEQ ID NO: 376342 - RNA, 22 nt, Homo sapiens
cuuuguguggacauuucaggca

SEQ ID NO: 376343 - RNA, 22 nt, Homo sapiens
cuuugugugggccaagggcugg

SEQ ID NO: 376344 - RNA, 22 nt, Homo sapiens
cuuuugugauucuucaguuacu

SEQ ID NO: 376345 - RNA, 22 nt, Homo sapiens
cuuuuugcaaauacaacucuga

SEQ ID NO: 376346 - RNA, 22 nt, Homo sapiens
gaaacugcauuucuaacaagcu

SEQ ID NO: 376347 - RNA, 22 nt, Homo sapiens
gaaauguugauagugggcauug

SEQ ID NO: 376348 - RNA, 22 nt, Homo sapiens
gaauaaacuagagaggacugag

SEQ ID NO: 376349 - RNA, 22 nt, Homo sapiens
gacacagugaagucucuacuug

SEQ ID NO: 376350 - RNA, 22 nt, Homo sapiens
gacaguuucucaggcuuccuua

SEQ ID NO: 376351 - RNA, 22 nt, Homo sapiens
gacaucauuaugagauuuaaac

SEQ ID NO: 376352 - RNA, 22 nt, Homo sapiens
gacauguuuacaguguugagag

SEQ ID NO: 376353 - RNA, 22 nt, Homo sapiens
gacauguuuucauguauuugga

SEQ ID NO: 376354 - RNA, 22 nt, Homo sapiens
gacuaaugaaagagugugauau

SEQ ID NO: 376355 - RNA, 19 nt, Homo sapiens
gacuccagaguugugugcu

SEQ ID NO: 376356 - RNA, 22 nt, Homo sapiens
gacuggccauugauacagaggu

SEQ ID NO: 376357 - RNA, 22 nt, Homo sapiens
gagaacuaaugguuugauaagg

SEQ ID NO: 376358 - RNA, 22 nt, Homo sapiens
gagaugguguuccacugccagu

SEQ ID NO: 376359 - RNA, 22 nt, Homo sapiens
gagauuaacauuugaggagcug

SEQ ID NO: 376360 - RNA, 22 nt, Homo sapiens
gagcagacaugaggaccgcugg

SEQ ID NO: 376361 - RNA, 22 nt, Homo sapiens
uaagacacauguguucccaggc

SEQ ID NO: 376362 - RNA, 23 nt, Homo sapiens
uaagacacuaacuuuaugcuuug

SEQ ID NO: 376363 - RNA, 22 nt, Homo sapiens
uaagaugaaggcucaccuagaa

SEQ ID NO: 376364 - RNA, 22 nt, Homo sapiens
uaaggcucuuguuauuuugagg

SEQ ID NO: 376365 - RNA, 22 nt, Homo sapiens
uaaggcuugaucuuggugagau

SEQ ID NO: 376366 - RNA, 22 nt, Homo sapiens
uaaggcuugcuucagucuugaa

SEQ ID NO: 376367 - RNA, 22 nt, Homo sapiens
uaaguacugucagaauuggacu

SEQ ID NO: 376368 - RNA, 22 nt, Homo sapiens
uaaguaucaguuuagcuaugau

SEQ ID NO: 376369 - RNA, 22 nt, Homo sapiens
uaagugaauauggacaguuagc

SEQ ID NO: 376370 - RNA, 20 nt, Homo sapiens
uaagugcuugagacuucuga

SEQ ID NO: 376371 - RNA, 18 nt, Homo sapiens
uaauaacugugaccuuga

SEQ ID NO: 376372 - RNA, 22 nt, Homo sapiens
uaauacauucaaggugguaguu

SEQ ID NO: 376373 - RNA, 21 nt, Homo sapiens
uacacuacugguggaaaugca

SEQ ID NO: 376374 - RNA, 22 nt, Homo sapiens
uacaggaaugucagguugcugu

SEQ ID NO: 376375 - RNA, 22 nt, Homo sapiens
uacagugcuugguaucuaguaa

SEQ ID NO: 376376 - RNA, 22 nt, Homo sapiens
uacauccauccugcugggcagu

SEQ ID NO: 376377 - RNA, 22 nt, Homo sapiens
uaccacagucauuacacuugua

SEQ ID NO: 376378 - RNA, 22 nt, Homo sapiens
uagaauggaaggcauguuugcc

SEQ ID NO: 376379 - RNA, 22 nt, Homo sapiens
uagauucauuuuagcaaaaguu

SEQ ID NO: 376380 - RNA, 22 nt, Homo sapiens
uagcagcaaagcaggaucugcu

SEQ ID NO: 376381 - RNA, 22 nt, Homo sapiens
uagcagcaccccacucuacugg

SEQ ID NO: 376382 - RNA, 20 nt, Homo sapiens
uagcagcagacagagggagg

SEQ ID NO: 376383 - RNA, 22 nt, Homo sapiens
uagcagcagugguguauuuaga

SEQ ID NO: 376384 - RNA, 22 nt, Homo sapiens
uagcagcaucucuggcuucuac

SEQ ID NO: 376385 - RNA, 22 nt, Homo sapiens
uagcagguguuccacaaauauu

SEQ ID NO: 376386 - RNA, 21 nt, Homo sapiens
uagcugcacccaggccuccuu

SEQ ID NO: 376387 - RNA, 22 nt, Homo sapiens
uagcugcauccugugcacucaa

SEQ ID NO: 376388 - RNA, 22 nt, Homo sapiens
uagggcaaggaacaguuaaaaa

SEQ ID NO: 376389 - RNA, 20 nt, Homo sapiens
uauagcaauuuuuuucuccu

SEQ ID NO: 376390 - RNA, 22 nt, Homo sapiens
uauagcagccugaacaaaguaa

SEQ ID NO: 376391 - RNA, 22 nt, Homo sapiens
uaucacagcauugucuauaaua

SEQ ID NO: 376392 - RNA, 22 nt, Homo sapiens
uaucacaggucaggaaucuugc

SEQ ID NO: 376393 - RNA, 20 nt, Homo sapiens
uaucacaguucaggaacucu

SEQ ID NO: 376394 - RNA, 22 nt, Homo sapiens
uaucucaguguacaggaugaua

SEQ ID NO: 376395 - RNA, 22 nt, Homo sapiens
uauggcaaugcauaggaaggaa

SEQ ID NO: 376396 - RNA, 22 nt, Homo sapiens
uauggguuuauuucuggucuca

SEQ ID NO: 376397 - RNA, 22 nt, Homo sapiens
uaugucuuuugcuugcaaauag

SEQ ID NO: 376398 - RNA, 22 nt, Homo sapiens
uaugugcaaauuaauugcuaga

SEQ ID NO: 376399 - RNA, 22 nt, Homo sapiens
uaugugguuaauaggaauuugu

SEQ ID NO: 376400 - RNA, 22 nt, Homo sapiens
uauuacauccauaggcucugcu

SEQ ID NO: 376401 - RNA, 22 nt, Homo sapiens
uauugcagaaugugaguuggca

SEQ ID NO: 376402 - RNA, 22 nt, Homo sapiens
uauugcagugagauccaucugg

SEQ ID NO: 376403 - RNA, 22 nt, Homo sapiens
uauugcuggcucugucuucauu

SEQ ID NO: 376404 - RNA, 22 nt, Homo sapiens
uauuucaguugugcagguaguu

SEQ ID NO: 376405 - RNA, 22 nt, Homo sapiens
ucaaacugcuugaggccauuua

SEQ ID NO: 376406 - RNA, 22 nt, Homo sapiens
ucaaacugucagguugaccaga

SEQ ID NO: 376407 - RNA, 21 nt, Homo sapiens
ucaaaguguucuuuuguugaa

SEQ ID NO: 376408 - RNA, 22 nt, Homo sapiens
ucaaaugauucuccugccucag

SEQ ID NO: 376409 - RNA, 17 nt, Homo sapiens
ucaaaugcucccaguga

SEQ ID NO: 376410 - RNA, 22 nt, Homo sapiens
ucaaaugcucuuugcagagagg

SEQ ID NO: 376411 - RNA, 22 nt, Homo sapiens
ucaaaugcuguauuguaguaau

SEQ ID NO: 376412 - RNA, 22 nt, Homo sapiens
ucacacgugaacucaucacaga

SEQ ID NO: 376413 - RNA, 22 nt, Homo sapiens
ucacagacugagccaaauagag

SEQ ID NO: 376414 - RNA, 22 nt, Homo sapiens
ucacagauaaauaaagaugauu

SEQ ID NO: 376415 - RNA, 22 nt, Homo sapiens
ucacagccuaguuuuauacauu

SEQ ID NO: 376416 - RNA, 22 nt, Homo sapiens
ucacaggguguuauuagaauua

SEQ ID NO: 376417 - RNA, 22 nt, Homo sapiens
ucacaguaaauccagaagaaau

SEQ ID NO: 376418 - RNA, 22 nt, Homo sapiens
ucacaguaucaugggggacaga

SEQ ID NO: 376419 - RNA, 22 nt, Homo sapiens
ucacagucaaaguaaucauaga

SEQ ID NO: 376420 - RNA, 23 nt, Homo sapiens
ucacaguuacuuuugcaucaacc

SEQ ID NO: 376421 - RNA, 22 nt, Homo sapiens
ucacaugaagauuuuaguauac

SEQ ID NO: 376422 - RNA, 18 nt, Homo sapiens
ucacauggccgagagaga

SEQ ID NO: 376423 - RNA, 22 nt, Homo sapiens
ucacauguguaugagcuuugau

SEQ ID NO: 376424 - RNA, 22 nt, Homo sapiens
ucaccggcagacguggccugau

SEQ ID NO: 376425 - RNA, 22 nt, Homo sapiens
ucacuagggagaaacugaggcu

SEQ ID NO: 376426 - RNA, 22 nt, Homo sapiens
ucacuggacagaaauaaaggug

SEQ ID NO: 376427 - RNA, 22 nt, Homo sapiens
ucacugugguuuugaugugcau

SEQ ID NO: 376428 - RNA, 22 nt, Homo sapiens
ucacugugugucucuguaucug

SEQ ID NO: 376429 - RNA, 18 nt, Homo sapiens
ucacugugugucuugggu

SEQ ID NO: 376430 - RNA, 22 nt, Homo sapiens
ucagaccauuucauuacagacu

SEQ ID NO: 376431 - RNA, 22 nt, Homo sapiens
ucagauacuggugacaugaaug

SEQ ID NO: 376432 - RNA, 22 nt, Homo sapiens
ucagcgggaguggaaagucaga

SEQ ID NO: 376433 - RNA, 20 nt, Homo sapiens
ucaggcuccgcauuaacuua

SEQ ID NO: 376434 - RNA, 22 nt, Homo sapiens
ucaggucauuccaggagggcca

SEQ ID NO: 376435 - RNA, 22 nt, Homo sapiens
ucagucuuuuaccauuaaguau

SEQ ID NO: 376436 - RNA, 23 nt, Homo sapiens
ucagugaaggaacaacuaaauag

SEQ ID NO: 376437 - RNA, 22 nt, Homo sapiens
ucaucaggaaacuuaugcagug

SEQ ID NO: 376438 - RNA, 22 nt, Homo sapiens
ucauggcacugaugagaguuuc

SEQ ID NO: 376439 - RNA, 22 nt, Homo sapiens
ucauggcauuguuaaggguuuu

SEQ ID NO: 376440 - RNA, 22 nt, Homo sapiens
ucauucauucauccagcuugag

SEQ ID NO: 376441 - RNA, 22 nt, Homo sapiens
ucauugguugcguaauuugauu

SEQ ID NO: 376442 - RNA, 22 nt, Homo sapiens
uccagugugcaggcaaguuuga

SEQ ID NO: 376443 - RNA, 20 nt, Homo sapiens
uccaguuuuggagacauucu

SEQ ID NO: 376444 - RNA, 22 nt, Homo sapiens
uccauagacauuuuaagguagu

SEQ ID NO: 376445 - RNA, 19 nt, Homo sapiens
ucccaagaugcucauacau

SEQ ID NO: 376446 - RNA, 22 nt, Homo sapiens
ucccaguuuuucugaauaguca

SEQ ID NO: 376447 - RNA, 20 nt, Homo sapiens
ucccucaaacuuuuccacug

SEQ ID NO: 376448 - RNA, 22 nt, Homo sapiens
uccugcauucauccugguguug

SEQ ID NO: 376449 - RNA, 22 nt, Homo sapiens
ucgcgccauucuccugccucag

SEQ ID NO: 376450 - RNA, 22 nt, Homo sapiens
ucuauugguaggggcugaggca

SEQ ID NO: 376451 - RNA, 22 nt, Homo sapiens
ugguucaguugcacaggcuguu

SEQ ID NO: 376452 - RNA, 21 nt, Homo sapiens
uguauacauauguuaggugca

SEQ ID NO: 376453 - RNA, 22 nt, Homo sapiens
uguauuuguuguuaaauggaga

SEQ ID NO: 376454 - RNA, 18 nt, Homo sapiens
ugucacuggauaaugguc

SEQ ID NO: 376455 - RNA, 22 nt, Homo sapiens
ugucacugugaguuugacugcu

SEQ ID NO: 376456 - RNA, 22 nt, Homo sapiens
ugucacugugcagucaugcauu

SEQ ID NO: 376457 - RNA, 22 nt, Homo sapiens
ugucaucuagguuuuaagccuu

SEQ ID NO: 376458 - RNA, 22 nt, Homo sapiens
ugucaugguguuaauuuuccug

SEQ ID NO: 376459 - RNA, 22 nt, Homo sapiens
ugugaaacauggauagaacugg

SEQ ID NO: 376460 - RNA, 18 nt, Homo sapiens
ugugacauugagcauguc

SEQ ID NO: 376461 - RNA, 22 nt, Homo sapiens
ugugagacugguucugaaccca

SEQ ID NO: 376462 - RNA, 20 nt, Homo sapiens
ugugagacugguuuugaacu

SEQ ID NO: 376463 - RNA, 17 nt, Homo sapiens
ugugaucaucacccuug

SEQ ID NO: 376464 - RNA, 22 nt, Homo sapiens
ugugccacuccaaccuggguga

SEQ ID NO: 376465 - RNA, 22 nt, Homo sapiens
ugugccacugcacuucagccug

SEQ ID NO: 376466 - RNA, 22 nt, Homo sapiens
ugugguuuuuuucuccaauagg

SEQ ID NO: 376467 - RNA, 22 nt, Homo sapiens
ugugucuccugaaaauucacau

SEQ ID NO: 376468 - RNA, 21 nt, Homo sapiens
uguuaacaugcagauuacugg

SEQ ID NO: 376469 - RNA, 22 nt, Homo sapiens
uguucuugagccuuuagaccua

SEQ ID NO: 376470 - RNA, 22 nt, Homo sapiens
uguucuugaguugggaguacaa

SEQ ID NO: 376471 - RNA, 22 nt, Homo sapiens
uguuuuggaguggacuuugcau

SEQ ID NO: 376472 - RNA, 22 nt, Homo sapiens
uuaaaugcacauacuugagaaa

SEQ ID NO: 376473 - RNA, 22 nt, Homo sapiens
uuaacagucacuuagcucauuu

SEQ ID NO: 376474 - RNA, 22 nt, Homo sapiens
uuaaggcagugcaucuggaguu

SEQ ID NO: 376475 - RNA, 22 nt, Homo sapiens
uuaaucugucuaugauuuuggu

SEQ ID NO: 376476 - RNA, 21 nt, Homo sapiens
uuaaugcuaugcagaaaaucu

SEQ ID NO: 376477 - RNA, 22 nt, Homo sapiens
uuacacaguugguaggggcaga

SEQ ID NO: 376478 - RNA, 22 nt, Homo sapiens
uuacagauggauggcagcuggc

SEQ ID NO: 376479 - RNA, 19 nt, Homo sapiens
uuacauccauugcauuuca

SEQ ID NO: 376480 - RNA, 22 nt, Homo sapiens
uuaccuuuuuaagacagguuag

SEQ ID NO: 376481 - RNA, 22 nt, Homo sapiens
uuagcagcaugagaauggacua

SEQ ID NO: 376482 - RNA, 22 nt, Homo sapiens
uuagcaguggauggguggagaa

SEQ ID NO: 376483 - RNA, 22 nt, Homo sapiens
uuagggaggcucaggacaagag

SEQ ID NO: 376484 - RNA, 22 nt, Homo sapiens
uucaauuaauauuauacucuca

SEQ ID NO: 376485 - RNA, 22 nt, Homo sapiens
uucacagacaacuggucccuua

SEQ ID NO: 376486 - RNA, 20 nt, Homo sapiens
uucacaggcagcuucuuucu

SEQ ID NO: 376487 - RNA, 22 nt, Homo sapiens
uucaccagggaagucucaacuc

SEQ ID NO: 376488 - RNA, 22 nt, Homo sapiens
uucagggacuuuagacaagaga

SEQ ID NO: 376489 - RNA, 22 nt, Homo sapiens
uuccacaauggcugaacuaguu

SEQ ID NO: 376490 - RNA, 22 nt, Homo sapiens
uuccacaaugguugaacuaauu

SEQ ID NO: 376491 - RNA, 22 nt, Homo sapiens
uuccacaaugguugaacuaguu

SEQ ID NO: 376492 - RNA, 20 nt, Homo sapiens
uuccagcacauuagggaagc

SEQ ID NO: 376493 - RNA, 22 nt, Homo sapiens
uuccaguggacuacuucauccu

SEQ ID NO: 376494 - RNA, 22 nt, Homo sapiens
uuccaguguguucauccucaga

SEQ ID NO: 376495 - RNA, 22 nt, Homo sapiens
uuccuagagauuagcaagcugc

SEQ ID NO: 376496 - RNA, 22 nt, Homo sapiens
uuccugagaucagaauucaaau

SEQ ID NO: 376497 - RNA, 22 nt, Homo sapiens
uucuuuggaaacaguacuaauu

SEQ ID NO: 376498 - RNA, 22 nt, Homo sapiens
uugaaagcuaucucaaaucgcu

SEQ ID NO: 376499 - RNA, 22 nt, Homo sapiens
uugaacugguaguuggaaaucu

SEQ ID NO: 376500 - RNA, 22 nt, Homo sapiens
uugaacuguaagggucugugug

SEQ ID NO: 376501 - RNA, 22 nt, Homo sapiens
uugaaggaggugcucacucucg

SEQ ID NO: 376502 - RNA, 22 nt, Homo sapiens
uugaagugaagaacaauaucac

SEQ ID NO: 376503 - RNA, 22 nt, Homo sapiens
uugacauaguuucugaaauaga

SEQ ID NO: 376504 - RNA, 22 nt, Homo sapiens
uugagagaaaaaauuuauuggu

SEQ ID NO: 376505 - RNA, 22 nt, Homo sapiens
uugagauggagucucacucuuc

SEQ ID NO: 376506 - RNA, 22 nt, Homo sapiens
uugagauggagucucacugugu

SEQ ID NO: 376507 - RNA, 22 nt, Homo sapiens
uugagauggagucuuguucuuu

SEQ ID NO: 376508 - RNA, 22 nt, Homo sapiens
uugagauguaagauguuaauau

SEQ ID NO: 376509 - RNA, 22 nt, Homo sapiens
uugaggaggcagucucuccauu

SEQ ID NO: 376510 - RNA, 22 nt, Homo sapiens
uugaggaggcagucugcccauu

SEQ ID NO: 376511 - RNA, 22 nt, Homo sapiens
uugaggaggcagucuucccauu

SEQ ID NO: 376512 - RNA, 22 nt, Homo sapiens
uugcaaaguuugccuccuguag

SEQ ID NO: 376513 - RNA, 22 nt, Homo sapiens
uugcaacauuguaaguuuauau

SEQ ID NO: 376514 - RNA, 22 nt, Homo sapiens
uugcaaugugaugugauuugga

SEQ ID NO: 376515 - RNA, 22 nt, Homo sapiens
uugcaugggagcugggugaggc

SEQ ID NO: 376516 - RNA, 22 nt, Homo sapiens
uugcaugguggaacuuggagcu

SEQ ID NO: 376517 - RNA, 22 nt, Homo sapiens
uugcauuuucuaggagggcaaa

SEQ ID NO: 376518 - RNA, 22 nt, Homo sapiens
uugccaacauggugaacuccca

SEQ ID NO: 376519 - RNA, 22 nt, Homo sapiens
uuggaaauguguuugcauucag

SEQ ID NO: 376520 - RNA, 22 nt, Homo sapiens
uuggccccucccaaauuucaug

SEQ ID NO: 376521 - RNA, 22 nt, Homo sapiens
uuggccgugucauuugcuuuga

SEQ ID NO: 376522 - RNA, 23 nt, Homo sapiens
uuggccuccuugugucuagggcu

SEQ ID NO: 376523 - RNA, 22 nt, Homo sapiens
uuggcucuggcugggcuccagc

SEQ ID NO: 376524 - RNA, 22 nt, Homo sapiens
uugggacuggaaggaguaaggg

SEQ ID NO: 376525 - RNA, 23 nt, Homo sapiens
uugggcaaaucacuaacgucucc

SEQ ID NO: 376526 - RNA, 22 nt, Homo sapiens
uugguaaucccuagugucuaga

SEQ ID NO: 376527 - RNA, 22 nt, Homo sapiens
uugucacuauaaauaagcauuu

SEQ ID NO: 376528 - RNA, 22 nt, Homo sapiens
uugucacucuuccuaggguagg

SEQ ID NO: 376529 - RNA, 22 nt, Homo sapiens
uuguccaagucccauuuguuga

SEQ ID NO: 376530 - RNA, 22 nt, Homo sapiens
uugucuccuagacgaccaggcg

SEQ ID NO: 376531 - RNA, 22 nt, Homo sapiens
uugugccccuucucagucgggc

SEQ ID NO: 376532 - RNA, 22 nt, Homo sapiens
uugugcuuuugagcugagauga

SEQ ID NO: 376533 - RNA, 18 nt, Homo sapiens
uuguggccccuacaaauu

SEQ ID NO: 376534 - RNA, 19 nt, Homo sapiens
uugugggaggacagagggg

SEQ ID NO: 376535 - RNA, 22 nt, Homo sapiens
uugugguuuuuaaaacuaggug

SEQ ID NO: 376536 - RNA, 22 nt, Homo sapiens
uuuaaagcacggaguuuguggc

SEQ ID NO: 376537 - RNA, 22 nt, Homo sapiens
uuuaaggcaugccuguacaugc

SEQ ID NO: 376538 - RNA, 22 nt, Homo sapiens
uuuagcagcaaagagccaugcu

SEQ ID NO: 376539 - RNA, 18 nt, Homo sapiens
uuucaagucuuaggugac

SEQ ID NO: 376540 - RNA, 22 nt, Homo sapiens
uuucagagucaucugcccaagu

SEQ ID NO: 376541 - RNA, 22 nt, Homo sapiens
uuauaaacaugaagauuugggg

SEQ ID NO: 376542 - RNA, 22 nt, Homo sapiens
uucccugugggcuggugcucca

SEQ ID NO: 376543 - RNA, 20 nt, Homo sapiens
uucuugaguuaacaaguuac

SEQ ID NO: 376544 - RNA, 22 nt, Homo sapiens
uuuaaaguuagaaggaaagggc

SEQ ID NO: 376545 - RNA, 22 nt, Homo sapiens
uuucccugaaggcucugaaguc

SEQ ID NO: 376546 - RNA, 22 nt, Homo sapiens
uuugucauagcagcaggaaugg

SEQ ID NO: 376547 - RNA, 22 nt, Homo sapiens
uuuguggaaugcucauguguag

SEQ ID NO: 376548 - RNA, 22 nt, Homo sapiens
aaauugcaguuaggaugauggu

SEQ ID NO: 376549 - RNA, 22 nt, Homo sapiens
aaggcaacgugaguuguugauu

SEQ ID NO: 376550 - RNA, 22 nt, Homo sapiens
aagguauuucuaugggaauaga

SEQ ID NO: 376551 - RNA, 19 nt, Homo sapiens
aaguaguugugacagaugc

SEQ ID NO: 376552 - RNA, 22 nt, Homo sapiens
acaguagaaaacaauggauuug

SEQ ID NO: 376553 - RNA, 22 nt, Homo sapiens
accauugcacuccagccugggc

SEQ ID NO: 376554 - RNA, 22 nt, Homo sapiens
agcuguuguucucagaggcuuu

SEQ ID NO: 376555 - RNA, 22 nt, Homo sapiens
agucagauuggcauuuguuggg

SEQ ID NO: 376556 - RNA, 22 nt, Homo sapiens
auaugcacuauacacacguaua

SEQ ID NO: 376557 - RNA, 22 nt, Homo sapiens
aucgcaccauugcacuccagca

SEQ ID NO: 376558 - RNA, 22 nt, Homo sapiens
augugcuaguaucaaacgagac

SEQ ID NO: 376559 - RNA, 22 nt, Homo sapiens
auugcagaaaugacagagcgcc

SEQ ID NO: 376560 - RNA, 23 nt, Homo sapiens
auugcagaaucacagagguagug

SEQ ID NO: 376561 - RNA, 22 nt, Homo sapiens
cuaaaacuuucugagugcagca

SEQ ID NO: 376562 - RNA, 22 nt, Homo sapiens
cucagcuacuugggaagcugag

SEQ ID NO: 376563 - RNA, 22 nt, Homo sapiens
cucaggcacucugauuccagug

SEQ ID NO: 376564 - RNA, 21 nt, Homo sapiens
cucauauugcuuuuccauggu

SEQ ID NO: 376565 - RNA, 22 nt, Homo sapiens
cugcagaucuuggggcuugcca

SEQ ID NO: 376566 - RNA, 21 nt, Homo sapiens
cugcauccauuucugagugau

SEQ ID NO: 376567 - RNA, 22 nt, Homo sapiens
cuggcuaagugcuugagugugc

SEQ ID NO: 376568 - RNA, 22 nt, Homo sapiens
cuugaauguaaauaauguacag

SEQ ID NO: 376569 - RNA, 22 nt, Homo sapiens
gaggcagucuguccauucucag

SEQ ID NO: 376570 - RNA, 22 nt, Homo sapiens
gaguagaacugguuaucuaaua

SEQ ID NO: 376571 - RNA, 22 nt, Homo sapiens
gcagugugugaggaauuugggu

SEQ ID NO: 376572 - RNA, 22 nt, Homo sapiens
gcugagguucaagaagguuaaa

SEQ ID NO: 376573 - RNA, 23 nt, Homo sapiens
ggaaauguuuaagggguugggag

SEQ ID NO: 376574 - RNA, 22 nt, Homo sapiens
ggagucugauguucuaaggcag

SEQ ID NO: 376575 - RNA, 22 nt, Homo sapiens
ggaucacuugagaccaggaguu

SEQ ID NO: 376576 - RNA, 22 nt, Homo sapiens
ggcaguguaauaauuuauuaau

SEQ ID NO: 376577 - RNA, 22 nt, Homo sapiens
ggcuagagacaaguugcugaga

SEQ ID NO: 376578 - RNA, 22 nt, Homo sapiens
ggguaggcaagcggaugucaga

SEQ ID NO: 376579 - RNA, 22 nt, Homo sapiens
guagaugcauggauuuacuucu

SEQ ID NO: 376580 - RNA, 22 nt, Homo sapiens
gucagguaccugaaagcagcca

SEQ ID NO: 376581 - RNA, 22 nt, Homo sapiens
gugagguauacugggaucacua

SEQ ID NO: 376582 - RNA, 22 nt, Homo sapiens
guggaaaucucugugugacuua

SEQ ID NO: 376583 - RNA, 22 nt, Homo sapiens
uaaguaucaguuuagcuaugau

SEQ ID NO: 376584 - RNA, 22 nt, Homo sapiens
uagggcauuuagaggcuauuaa

SEQ ID NO: 376585 - RNA, 22 nt, Homo sapiens
uaggucaguuuuggcuuggcuu

SEQ ID NO: 376586 - RNA, 22 nt, Homo sapiens
uauugcagugagauccaucugg

SEQ ID NO: 376587 - RNA, 22 nt, Homo sapiens
ucacugcgaccucugccucccg

SEQ ID NO: 376588 - RNA, 22 nt, Homo sapiens
ucgcaccauugcacuccagcca

SEQ ID NO: 376589 - RNA, 22 nt, Homo sapiens
ucugagguuaaauuuuauaguu

SEQ ID NO: 376590 - RNA, 22 nt, Homo sapiens
ugaagugaagacucacagaagg

SEQ ID NO: 376591 - RNA, 22 nt, Homo sapiens
ugaaugcauggggccaagaagg

SEQ ID NO: 376592 - RNA, 19 nt, Homo sapiens
ugacaugaaacccaagauc

SEQ ID NO: 376593 - RNA, 22 nt, Homo sapiens
ugagaucaagguuaauauaauc

SEQ ID NO: 376594 - RNA, 22 nt, Homo sapiens
ugagaucaguuguuauaauucu

SEQ ID NO: 376595 - RNA, 22 nt, Homo sapiens
ugagaugaagcuagaagaaugg

SEQ ID NO: 376596 - RNA, 21 nt, Homo sapiens
ugagaugauccugcaugcaug

SEQ ID NO: 376597 - RNA, 22 nt, Homo sapiens
ugagccaaguucacaccauugc

SEQ ID NO: 376598 - RNA, 21 nt, Homo sapiens
uggaccccuuccagucaucau

SEQ ID NO: 376599 - RNA, 22 nt, Homo sapiens
ugguaucuaagaugcacguugu

SEQ ID NO: 376600 - RNA, 22 nt, Homo sapiens
uguaagugugcaauucagugau

SEQ ID NO: 376601 - RNA, 22 nt, Homo sapiens
ugugaagauggacuaauauagu

SEQ ID NO: 376602 - RNA, 22 nt, Homo sapiens
uguguauaucacugcaugagug

SEQ ID NO: 376603 - RNA, 22 nt, Homo sapiens
uuaauguaauugauugauugac

SEQ ID NO: 376604 - RNA, 22 nt, Homo sapiens
aaacuugucuaauuauaagcau

SEQ ID NO: 376605 - RNA, 22 nt, Homo sapiens
aaaugacuuuuuaugcagagua

SEQ ID NO: 376606 - RNA, 22 nt, Homo sapiens
aagacuguaauccaucuugagu

SEQ ID NO: 376607 - RNA, 22 nt, Homo sapiens
aagagcgcugauaacauguuug

SEQ ID NO: 376608 - RNA, 22 nt, Homo sapiens
aagcaucacauaauggaucaug

SEQ ID NO: 376609 - RNA, 22 nt, Homo sapiens
aaggauuguaacaccaagguua

SEQ ID NO: 376610 - RNA, 22 nt, Homo sapiens
aagucaugaagaggaaaggaca

SEQ ID NO: 376611 - RNA, 22 nt, Homo sapiens
acaccauugcauuccagccugg

SEQ ID NO: 376612 - RNA, 22 nt, Homo sapiens
agagguuuugcccucgagauaa

SEQ ID NO: 376613 - RNA, 20 nt, Homo sapiens
agguagauagaugauagaua

SEQ ID NO: 376614 - RNA, 22 nt, Homo sapiens
agucaguguguauugauggcac

SEQ ID NO: 376615 - RNA, 22 nt, Homo sapiens
auaaaguagaggugaggugcau

SEQ ID NO: 376616 - RNA, 22 nt, Homo sapiens
auagcaagaugauugauccauu

SEQ ID NO: 376617 - RNA, 22 nt, Homo sapiens
auagcaauuugggaaucagacu

SEQ ID NO: 376618 - RNA, 22 nt, Homo sapiens
auauugguuaaauauuauguga

SEQ ID NO: 376619 - RNA, 22 nt, Homo sapiens
augaucacaccacugcacucca

SEQ ID NO: 376620 - RNA, 20 nt, Homo sapiens
auuagacuugccuuauccuu

SEQ ID NO: 376621 - RNA, 22 nt, Homo sapiens
auuauuagucggccagcuguua

SEQ ID NO: 376622 - RNA, 22 nt, Homo sapiens
auugcacuccagccuggcaaua

SEQ ID NO: 376623 - RNA, 22 nt, Homo sapiens
auuugucacuuaacagccauua

SEQ ID NO: 376624 - RNA, 22 nt, Homo sapiens
cacuuugguucaccugaguuuc

SEQ ID NO: 376625 - RNA, 22 nt, Homo sapiens
cagguaguguguagcacagcag

SEQ ID NO: 376626 - RNA, 22 nt, Homo sapiens
cauugcaguuuuugguguaucu

SEQ ID NO: 376627 - RNA, 22 nt, Homo sapiens
ccaaaguauuuucacugauauc

SEQ ID NO: 376628 - RNA, 21 nt, Homo sapiens
cccugguguuuggaguuugag

SEQ ID NO: 376629 - RNA, 22 nt, Homo sapiens
cugagcaagucauuuuguuaaa

SEQ ID NO: 376630 - RNA, 22 nt, Homo sapiens
gaaugaauguuuauccuuagau

SEQ ID NO: 376631 - RNA, 22 nt, Homo sapiens
gaaugauacuguuaacgaaaga

SEQ ID NO: 376632 - RNA, 22 nt, Homo sapiens
gagagaguacuugauauaauuu

SEQ ID NO: 376633 - RNA, 22 nt, Homo sapiens
gagcaaugagcugccugcugag

SEQ ID NO: 376634 - RNA, 22 nt, Homo sapiens
gagguagagacuauguauuaga

SEQ ID NO: 376635 - RNA, 22 nt, Homo sapiens
gagguagguacaauugccacca

SEQ ID NO: 376636 - RNA, 22 nt, Homo sapiens
gcagugugauguuuuaaucuau

SEQ ID NO: 376637 - RNA, 19 nt, Homo sapiens
gcaucauuaguugcuuuuc

SEQ ID NO: 376638 - RNA, 22 nt, Homo sapiens
gcugauguuggccucugggcuu

SEQ ID NO: 376639 - RNA, 18 nt, Homo sapiens
ggaagccuauuuaguaac

SEQ ID NO: 376640 - RNA, 22 nt, Homo sapiens
ggaauguuaaggcgcuguuggu

SEQ ID NO: 376641 - RNA, 22 nt, Homo sapiens
ggcaacaaagacauuucaacau

SEQ ID NO: 376642 - RNA, 22 nt, Homo sapiens
ggcaugaugcgcacgccuguag

SEQ ID NO: 376643 - RNA, 22 nt, Homo sapiens
gucuugaaggcugaguaccugu

SEQ ID NO: 376644 - RNA, 22 nt, Homo sapiens
gugaaugaaugggugaauacau

SEQ ID NO: 376645 - RNA, 22 nt, Homo sapiens
guggaaagaacacaaaauuagg

SEQ ID NO: 376646 - RNA, 20 nt, Homo sapiens
guucccuguaggugugcgga

SEQ ID NO: 376647 - RNA, 22 nt, Homo sapiens
guugacuaggagcuacuacuac

SEQ ID NO: 376648 - RNA, 22 nt, Homo sapiens
guuguggagucuucuguucugg

SEQ ID NO: 376649 - RNA, 22 nt, Homo sapiens
uaacaguguauuuacuacuucc

SEQ ID NO: 376650 - RNA, 22 nt, Homo sapiens
uaaguaauugcagcaauuugcc

SEQ ID NO: 376651 - RNA, 19 nt, Homo sapiens
uaaguagaugacugaugcu

SEQ ID NO: 376652 - RNA, 22 nt, Homo sapiens
uagaacauuccaggugauguug

SEQ ID NO: 376653 - RNA, 21 nt, Homo sapiens
uagagcaacacacgcccucuc

SEQ ID NO: 376654 - RNA, 22 nt, Homo sapiens
uagauucaucuguuccuuuuga

SEQ ID NO: 376655 - RNA, 22 nt, Homo sapiens
uaucugguuauugcugcugauu

SEQ ID NO: 376656 - RNA, 22 nt, Homo sapiens
uaugaugcuguuuagaaucucu

SEQ ID NO: 376657 - RNA, 22 nt, Homo sapiens
uauuccauuugugaaaggaagu

SEQ ID NO: 376658 - RNA, 22 nt, Homo sapiens
ucauugcauuccagcccaagca

SEQ ID NO: 376659 - RNA, 22 nt, Homo sapiens
ugaaggcaggagggagaaaagu

SEQ ID NO: 376660 - RNA, 22 nt, Homo sapiens
ugaaugcaucuagaaauuuauu

SEQ ID NO: 376661 - RNA, 22 nt, Homo sapiens
ugacagaggucuuuuaauagcu

SEQ ID NO: 376662 - RNA, 22 nt, Homo sapiens
ugacuucagacugaaaugauuc

SEQ ID NO: 376663 - RNA, 22 nt, Homo sapiens
ugagaucaacugagucagagca

SEQ ID NO: 376664 - RNA, 22 nt, Homo sapiens
ugagaucaaggugggcccuggg

SEQ ID NO: 376665 - RNA, 22 nt, Homo sapiens
ugagaucagugaagaaguguuu

SEQ ID NO: 376666 - RNA, 22 nt, Homo sapiens
ugagcaauaaaguuacacaguu

SEQ ID NO: 376667 - RNA, 22 nt, Homo sapiens
ugauaacauuucuucugguaca

SEQ ID NO: 376668 - RNA, 22 nt, Homo sapiens
ugaucaaagugcuggaauuaca

SEQ ID NO: 376669 - RNA, 22 nt, Homo sapiens
ugcugcaaacaugagaggaagu

SEQ ID NO: 376670 - RNA, 21 nt, Homo sapiens
uggaaugaauggccaacaugg

SEQ ID NO: 376671 - RNA, 18 nt, Homo sapiens
uggaauguuuggguuaau

SEQ ID NO: 376672 - RNA, 22 nt, Homo sapiens
uggcuacugacugaugauuaua

SEQ ID NO: 376673 - RNA, 22 nt, Homo sapiens
ugggcaagugacuuggcuucuc

SEQ ID NO: 376674 - RNA, 22 nt, Homo sapiens
ugguaaaaugucauuuaccaga

SEQ ID NO: 376675 - RNA, 22 nt, Homo sapiens
ugguaagaggcccugaguuugu

SEQ ID NO: 376676 - RNA, 22 nt, Homo sapiens
ugugauaguuggcuaaagcagu

SEQ ID NO: 376677 - RNA, 22 nt, Homo sapiens
ugugguagugcuuaccugcagu

SEQ ID NO: 376678 - RNA, 19 nt, Homo sapiens
uuaaguaguuagagggucu

SEQ ID NO: 376679 - RNA, 22 nt, Homo sapiens
uucacuguagccucagccucuu

SEQ ID NO: 376680 - RNA, 22 nt, Homo sapiens
uucaguccauuuccuuggucac

SEQ ID NO: 376681 - RNA, 22 nt, Homo sapiens
uucagugucauuaacacaguag

SEQ ID NO: 376682 - RNA, 22 nt, Homo sapiens
uuccuuguagcaaaugcgauga

SEQ ID NO: 376683 - RNA, 22 nt, Homo sapiens
uugagaugauggauaugcuaau

SEQ ID NO: 376684 - RNA, 22 nt, Homo sapiens
uugauagaucagggauuugauu

SEQ ID NO: 376685 - RNA, 22 nt, Homo sapiens
uugcacuccggccuggguaaca

SEQ ID NO: 376686 - RNA, 22 nt, Homo sapiens
uugcagugguuucacuggcaaa

SEQ ID NO: 376687 - RNA, 22 nt, Homo sapiens
uuggaauuuuaaaauaggcaac

SEQ ID NO: 376688 - RNA, 22 nt, Homo sapiens
uuugagcaugcagauugccagg

SEQ ID NO: 376689 - RNA, 22 nt, Homo sapiens
aaggucauugugguuuuugcca

SEQ ID NO: 376690 - RNA, 22 nt, Homo sapiens
aauuguacucccauaauucccu

SEQ ID NO: 376691 - RNA, 22 nt, Homo sapiens
aauuguacucccaucauuccua

SEQ ID NO: 376692 - RNA, 19 nt, Homo sapiens
acauugcauuuguaggcuu

SEQ ID NO: 376693 - RNA, 21 nt, Homo sapiens
aggagauguuuguccuuuuag

SEQ ID NO: 376694 - RNA, 22 nt, Homo sapiens
aggcaugauuguauuuugcucu

SEQ ID NO: 376695 - RNA, 22 nt, Homo sapiens
agguagugugaugcuccuguuu

SEQ ID NO: 376696 - RNA, 22 nt, Homo sapiens
agugcaguggcauggucauaac

SEQ ID NO: 376697 - RNA, 22 nt, Homo sapiens
auaaagcaagucucuggccuca

SEQ ID NO: 376698 - RNA, 22 nt, Homo sapiens
auacagucuguuagauuuccuc

SEQ ID NO: 376699 - RNA, 22 nt, Homo sapiens
auaugcacaguggaguacuauu

SEQ ID NO: 376700 - RNA, 22 nt, Homo sapiens
auaugccacugaacuguaccca

SEQ ID NO: 376701 - RNA, 22 nt, Homo sapiens
augacugucuugcagaggcuau

SEQ ID NO: 376702 - RNA, 22 nt, Homo sapiens
augaggcaggaaaggcguaucu

SEQ ID NO: 376703 - RNA, 22 nt, Homo sapiens
augcagugugcaacagauuaag

SEQ ID NO: 376704 - RNA, 22 nt, Homo sapiens
auuauaugucaucacagacacc

SEQ ID NO: 376705 - RNA, 22 nt, Homo sapiens
auucccuguagaauaaggaugg

SEQ ID NO: 376706 - RNA, 22 nt, Homo sapiens
auugaauuugguuugcuaagaa

SEQ ID NO: 376707 - RNA, 22 nt, Homo sapiens
auugcagauucgcuuuguguug

SEQ ID NO: 376708 - RNA, 22 nt, Homo sapiens
caauugcacucuuagguguaca

SEQ ID NO: 376709 - RNA, 22 nt, Homo sapiens
cagcuggugggagcuggguucc

SEQ ID NO: 376710 - RNA, 22 nt, Homo sapiens
cagugcaaccuccaucucucgg

SEQ ID NO: 376711 - RNA, 22 nt, Homo sapiens
cauugcagauccuucaaaugac

SEQ ID NO: 376712 - RNA, 22 nt, Homo sapiens
ccccaguguguaaaggccuugc

SEQ ID NO: 376713 - RNA, 22 nt, Homo sapiens
ccuucuuuuguaaggcugaaua

SEQ ID NO: 376714 - RNA, 22 nt, Homo sapiens
cugagcaaaguucuauuuaugg

SEQ ID NO: 376715 - RNA, 22 nt, Homo sapiens
cugagguaggcccugagaauau

SEQ ID NO: 376716 - RNA, 22 nt, Homo sapiens
cuguaaaguucucauuguagcc

SEQ ID NO: 376717 - RNA, 22 nt, Homo sapiens
cugugcuaggcaaugugguaga

SEQ ID NO: 376718 - RNA, 22 nt, Homo sapiens
gagaacauacggcauuugguuu

SEQ ID NO: 376719 - RNA, 22 nt, Homo sapiens
gagaacauuaauaguuaauuuu

SEQ ID NO: 376720 - RNA, 22 nt, Homo sapiens
gaggucaggacauuuuugcuuu

SEQ ID NO: 376721 - RNA, 22 nt, Homo sapiens
gauauugacuuauucuauguuu

SEQ ID NO: 376722 - RNA, 22 nt, Homo sapiens
gcaagagguaucuuauuuuccc

SEQ ID NO: 376723 - RNA, 22 nt, Homo sapiens
gcagguaguuucugacuuuuac

SEQ ID NO: 376724 - RNA, 22 nt, Homo sapiens
ggaaauguaaacaauggggcua

SEQ ID NO: 376725 - RNA, 22 nt, Homo sapiens
ggaggcuaguaaaaagguagaa

SEQ ID NO: 376726 - RNA, 22 nt, Homo sapiens
ggcaagaagagaguuuaaacau

SEQ ID NO: 376727 - RNA, 22 nt, Homo sapiens
ggcaaggugcuacagacaguga

SEQ ID NO: 376728 - RNA, 22 nt, Homo sapiens
gucagcaucaccaugucuauga

SEQ ID NO: 376729 - RNA, 22 nt, Homo sapiens
gucuuuguuauuaugaaucaac

SEQ ID NO: 376730 - RNA, 22 nt, Homo sapiens
guggaaaauuauugcuguuuuu

SEQ ID NO: 376731 - RNA, 22 nt, Homo sapiens
guggaagaccagacuuuccaac

SEQ ID NO: 376732 - RNA, 22 nt, Homo sapiens
guggaucacuugagguuagaag

SEQ ID NO: 376733 - RNA, 22 nt, Homo sapiens
guggguaaaucucuguucgagg

SEQ ID NO: 376734 - RNA, 22 nt, Homo sapiens
gugguuuuaauauucagucuag

SEQ ID NO: 376735 - RNA, 22 nt, Homo sapiens
uaaacugucuuuggagcuuugc

SEQ ID NO: 376736 - RNA, 22 nt, Homo sapiens
uaacuacuucugcuucagagua

SEQ ID NO: 376737 - RNA, 22 nt, Homo sapiens
uaagguauuuacauuucuguuu

SEQ ID NO: 376738 - RNA, 22 nt, Homo sapiens
uaaguaauugugguuuuugcca

SEQ ID NO: 376739 - RNA, 22 nt, Homo sapiens
uaaguagaggaaucauuuugug

SEQ ID NO: 376740 - RNA, 22 nt, Homo sapiens
uaaguauuaugugcugcauuuu

SEQ ID NO: 376741 - RNA, 22 nt, Homo sapiens
uacaguggugugaucucagcuc

SEQ ID NO: 376742 - RNA, 22 nt, Homo sapiens
uacugcacuccacccuggguga

SEQ ID NO: 376743 - RNA, 22 nt, Homo sapiens
uacugcagucagacuccugggc

SEQ ID NO: 376744 - RNA, 22 nt, Homo sapiens
uagagcaaugacucuggaaacc

SEQ ID NO: 376745 - RNA, 22 nt, Homo sapiens
uagaucacucaggcaauaaaag

SEQ ID NO: 376746 - RNA, 22 nt, Homo sapiens
uaugccuuuuggcucaagaaac

SEQ ID NO: 376747 - RNA, 22 nt, Homo sapiens
uauugcagauacccaggaaguu

SEQ ID NO: 376748 - RNA, 22 nt, Homo sapiens
ucaaugcaugugacaaagagua

SEQ ID NO: 376749 - RNA, 23 nt, Homo sapiens
ucagguaguuucagaggaccuug

SEQ ID NO: 376750 - RNA, 19 nt, Homo sapiens
ucccugagucuuagcuuga

SEQ ID NO: 376751 - RNA, 22 nt, Homo sapiens
ucuggcaagauauccauugcuu

SEQ ID NO: 376752 - RNA, 22 nt, Homo sapiens
ugagaucacuaagagguaaugg

SEQ ID NO: 376753 - RNA, 22 nt, Homo sapiens
ugagaucaugccacugcacuuc

SEQ ID NO: 376754 - RNA, 22 nt, Homo sapiens
ugagaugauuuaauggagccca

SEQ ID NO: 376755 - RNA, 22 nt, Homo sapiens
ugagauuaaucuuuaaguaaga

SEQ ID NO: 376756 - RNA, 22 nt, Homo sapiens
ugauagaucugggcaaaguaaa

SEQ ID NO: 376757 - RNA, 22 nt, Homo sapiens
ugcagugugaaagagccugaca

SEQ ID NO: 376758 - RNA, 22 nt, Homo sapiens
uggaagacaggcuguauuuuaa

SEQ ID NO: 376759 - RNA, 22 nt, Homo sapiens
uggaccccugcucgggagcccu

SEQ ID NO: 376760 - RNA, 22 nt, Homo sapiens
uggauaguucuucuacuagagu

SEQ ID NO: 376761 - RNA, 19 nt, Homo sapiens
uggcaugaaugugaacuaa

SEQ ID NO: 376762 - RNA, 23 nt, Homo sapiens
uggguucccuaagcgcaugcugc

SEQ ID NO: 376763 - RNA, 22 nt, Homo sapiens
uguggaaauuguuguauuuaau

SEQ ID NO: 376764 - RNA, 22 nt, Homo sapiens
uuaaggcauucuuugucuucau

SEQ ID NO: 376765 - RNA, 22 nt, Homo sapiens
uuagcaauugauucucauaagc

SEQ ID NO: 376766 - RNA, 22 nt, Homo sapiens
uucccugugggaguaggaaagu

SEQ ID NO: 376767 - RNA, 22 nt, Homo sapiens
uuccguguaguugagcaguuuu

SEQ ID NO: 376768 - RNA, 22 nt, Homo sapiens
uugaauaguggugaaaguuuga

SEQ ID NO: 376769 - RNA, 22 nt, Homo sapiens
uugagcaauccuccugccaugu

SEQ ID NO: 376770 - RNA, 22 nt, Homo sapiens
uugagcccuggaggcagaggcu

SEQ ID NO: 376771 - RNA, 22 nt, Homo sapiens
uugaucaucagcuuugucaucu

SEQ ID NO: 376772 - RNA, 22 nt, Homo sapiens
uugcaaggugcagcuuaugcaa

SEQ ID NO: 376773 - RNA, 22 nt, Homo sapiens
uugcagagaaauuucugguuua

SEQ ID NO: 376774 - RNA, 22 nt, Homo sapiens
uugcagugugacgacuauauuu

SEQ ID NO: 376775 - RNA, 22 nt, Homo sapiens
uugucccauggggucuuccuuu

SEQ ID NO: 376776 - RNA, 22 nt, Homo sapiens
uuuagcaaagcaauuuacacca

SEQ ID NO: 376777 - RNA, 19 nt, Homo sapiens
uuucccugcagaccuacua

SEQ ID NO: 376778 - RNA, 22 nt, Homo sapiens
uuuguacucccuuuagauaaaa

SEQ ID NO: 376779 - RNA, 22 nt, Homo sapiens
uuuguggaaugcccuuauuuau

SEQ ID NO: 376780 - RNA, 22 nt, Homo sapiens
aaaugcacagaaaggaugugga

SEQ ID NO: 376781 - RNA, 22 nt, Homo sapiens
aaaugcaccacucuggugcagg

SEQ ID NO: 376782 - RNA, 22 nt, Homo sapiens
aaauugcacaaguggugauuug

SEQ ID NO: 376783 - RNA, 22 nt, Homo sapiens
aaguauuagcuaauugugcuua

SEQ ID NO: 376784 - RNA, 22 nt, Homo sapiens
aauugcaccaucuagaucaaga

SEQ ID NO: 376785 - RNA, 20 nt, Homo sapiens
acaguagaagggauuucaaa

SEQ ID NO: 376786 - RNA, 22 nt, Homo sapiens
accuggguguauguucaguuug

SEQ ID NO: 376787 - RNA, 22 nt, Homo sapiens
acugcacucuagcauggguaau

SEQ ID NO: 376788 - RNA, 22 nt, Homo sapiens
agagaucaauaugaaggaaaug

SEQ ID NO: 376789 - RNA, 22 nt, Homo sapiens
agagaugauuaacauuuuggua

SEQ ID NO: 376790 - RNA, 22 nt, Homo sapiens
agagcaaugggugaauauuaaa

SEQ ID NO: 376791 - RNA, 22 nt, Homo sapiens
agaugccuaugaagagaaauua

SEQ ID NO: 376792 - RNA, 22 nt, Homo sapiens
agcaagacauggcuuccaaaug

SEQ ID NO: 376793 - RNA, 22 nt, Homo sapiens
aggcaagaaugcuuguuucacc

SEQ ID NO: 376794 - RNA, 22 nt, Homo sapiens
aggcaugaaauacaugcauuga

SEQ ID NO: 376795 - RNA, 22 nt, Homo sapiens
auaauugcuaagugaagauggu

SEQ ID NO: 376796 - RNA, 22 nt, Homo sapiens
auaucagugucuuacuguuuuu

SEQ ID NO: 376797 - RNA, 22 nt, Homo sapiens
auauuagcacuaaugucacgau

SEQ ID NO: 376798 - RNA, 18 nt, Homo sapiens
auauugcauuggauggau

SEQ ID NO: 376799 - RNA, 22 nt, Homo sapiens
auugcacacagaaucaggguaa

SEQ ID NO: 376800 - RNA, 23 nt, Homo sapiens
auugcagucuugaacuccugggc

SEQ ID NO: 376801 - RNA, 22 nt, Homo sapiens
cagacaugucuuguggccgugg

SEQ ID NO: 376802 - RNA, 22 nt, Homo sapiens
cagagcaaugcuuuugcuuuga

SEQ ID NO: 376803 - RNA, 22 nt, Homo sapiens
cagcuguuguuccagucuuuua

SEQ ID NO: 376804 - RNA, 22 nt, Homo sapiens
caggaaugugaggguucccugc

SEQ ID NO: 376805 - RNA, 22 nt, Homo sapiens
caguggaugauguuuucugugg

SEQ ID NO: 376806 - RNA, 22 nt, Homo sapiens
cauuggugauuagugaaugaac

SEQ ID NO: 376807 - RNA, 22 nt, Homo sapiens
ccagccgggugcaguggcucac

SEQ ID NO: 376808 - RNA, 22 nt, Homo sapiens
cccuguguuuagcugaagguuu

SEQ ID NO: 376809 - RNA, 22 nt, Homo sapiens
cugagguuaggaguuugagacc

SEQ ID NO: 376810 - RNA, 22 nt, Homo sapiens
cuuaaguaguuguggaaugaau

SEQ ID NO: 376811 - RNA, 22 nt, Homo sapiens
cuuucugaggagaauagagaac

SEQ ID NO: 376812 - RNA, 23 nt, Homo sapiens
gaaguauagcaugcacauggaaa

SEQ ID NO: 376813 - RNA, 22 nt, Homo sapiens
gagaacauuuaagccacucagg

SEQ ID NO: 376814 - RNA, 21 nt, Homo sapiens
gagguagggauuaaagaccuc

SEQ ID NO: 376815 - RNA, 22 nt, Homo sapiens
gauuuguauuaaaagugugacg

SEQ ID NO: 376816 - RNA, 22 nt, Homo sapiens
ggagaugugccugcucugcucu

SEQ ID NO: 376817 - RNA, 22 nt, Homo sapiens
ggaucacagccagcucccagaa

SEQ ID NO: 376818 - RNA, 22 nt, Homo sapiens
guauaugccucaguuauagcac

SEQ ID NO: 376819 - RNA, 22 nt, Homo sapiens
gucaggcaccgauacaguuuuu

SEQ ID NO: 376820 - RNA, 22 nt, Homo sapiens
guggaucacuugaggucaagag

SEQ ID NO: 376821 - RNA, 22 nt, Homo sapiens
gugggaagcuggaacucccucc

SEQ ID NO: 376822 - RNA, 23 nt, Homo sapiens
uaacauugcaugauuaccugcau

SEQ ID NO: 376823 - RNA, 22 nt, Homo sapiens
uaaguaauugugguuucugcca

SEQ ID NO: 376824 - RNA, 22 nt, Homo sapiens
uaaguaauuuguauuuuaccca

SEQ ID NO: 376825 - RNA, 22 nt, Homo sapiens
uaaguauuuuaauuccuggcau

SEQ ID NO: 376826 - RNA, 22 nt, Homo sapiens
uacugcacuccagccuggguga

SEQ ID NO: 376827 - RNA, 22 nt, Homo sapiens
uacugcacucuagccuggguga

SEQ ID NO: 376828 - RNA, 22 nt, Homo sapiens
uacugcaguugcagcuugagga

SEQ ID NO: 376829 - RNA, 22 nt, Homo sapiens
uagcaagaugaauuugugcaaa

SEQ ID NO: 376830 - RNA, 22 nt, Homo sapiens
uaugccuuuugguucaagcaac

SEQ ID NO: 376831 - RNA, 21 nt, Homo sapiens
ucaucagucaaagacaauggu

SEQ ID NO: 376832 - RNA, 22 nt, Homo sapiens
ucauuguccaacuucuuucagu

SEQ ID NO: 376833 - RNA, 22 nt, Homo sapiens
ugacugucuagauagagcuugg

SEQ ID NO: 376834 - RNA, 22 nt, Homo sapiens
ugagaucacgccacugcacucc

SEQ ID NO: 376835 - RNA, 18 nt, Homo sapiens
ugagaucagcaucaaggg

SEQ ID NO: 376836 - RNA, 22 nt, Homo sapiens
ugagaugagggcugcacucaaa

SEQ ID NO: 376837 - RNA, 23 nt, Homo sapiens
ugagauuacccagaaagaguaua

SEQ ID NO: 376838 - RNA, 22 nt, Homo sapiens
ugagauuauauuucuuaacaga

SEQ ID NO: 376839 - RNA, 22 nt, Homo sapiens
ugagguaacagaagcgagcauu

SEQ ID NO: 376840 - RNA, 22 nt, Homo sapiens
uggaacugauauugauggaaaa

SEQ ID NO: 376841 - RNA, 22 nt, Homo sapiens
uggauaguuuacugaagagugg

SEQ ID NO: 376842 - RNA, 22 nt, Homo sapiens
ugucccugagccuggauuccug

SEQ ID NO: 376843 - RNA, 22 nt, Homo sapiens
uuacaguaugaguaagaguucu

SEQ ID NO: 376844 - RNA, 22 nt, Homo sapiens
uuagaugaagucacagaaccca

SEQ ID NO: 376845 - RNA, 22 nt, Homo sapiens
uucccuguaucuucugccaugu

SEQ ID NO: 376846 - RNA, 22 nt, Homo sapiens
uuccgcuguaguuguugguacc

SEQ ID NO: 376847 - RNA, 22 nt, Homo sapiens
uugaagugaagaacaauaucac

SEQ ID NO: 376848 - RNA, 22 nt, Homo sapiens
uugagauggauagacauagcau

SEQ ID NO: 376849 - RNA, 22 nt, Homo sapiens
uugagcaccaugccuggccaug

SEQ ID NO: 376850 - RNA, 22 nt, Homo sapiens
uugucacugcacuccagucugg

SEQ ID NO: 376851 - RNA, 22 nt, Homo sapiens
uugucuagugaauacauuaaug

SEQ ID NO: 376852 - RNA, 23 nt, Homo sapiens
uuucuugggcaugcuaugucagu

SEQ ID NO: 376853 - RNA, 22 nt, Homo sapiens
uuuguacuucauacaauaacuc

SEQ ID NO: 376854 - RNA, 22 nt, Homo sapiens
aaagugcugagaguucuaacuu

SEQ ID NO: 376855 - RNA, 22 nt, Homo sapiens
aaagugcugggaucacacugaa

SEQ ID NO: 376856 - RNA, 22 nt, Homo sapiens
aagagaugaagguccugacugu

SEQ ID NO: 376857 - RNA, 22 nt, Homo sapiens
aagaugguauuucauuaguuuu

SEQ ID NO: 376858 - RNA, 22 nt, Homo sapiens
aaggcagucacuaaauagugag

SEQ ID NO: 376859 - RNA, 22 nt, Homo sapiens
aaggcagugugcacauaacacu

SEQ ID NO: 376860 - RNA, 22 nt, Homo sapiens
aagugcaaauucccaggcucug

SEQ ID NO: 376861 - RNA, 22 nt, Homo sapiens
aagugcacuguaagugcaggau

SEQ ID NO: 376862 - RNA, 22 nt, Homo sapiens
aauaaguugagaugaggucaua

SEQ ID NO: 376863 - RNA, 22 nt, Homo sapiens
aaugccacugugccugccaagg

SEQ ID NO: 376864 - RNA, 22 nt, Homo sapiens
acaaagcuagggaauccaucuu

SEQ ID NO: 376865 - RNA, 22 nt, Homo sapiens
acacagugucuguguauuuaaa

SEQ ID NO: 376866 - RNA, 22 nt, Homo sapiens
acacaguguuuauugugguuag

SEQ ID NO: 376867 - RNA, 22 nt, Homo sapiens
acacaugugaaaaaaauguuac

SEQ ID NO: 376868 - RNA, 22 nt, Homo sapiens
acagauagcacuaagggaucug

SEQ ID NO: 376869 - RNA, 22 nt, Homo sapiens
acaggagugggauuugaguccu

SEQ ID NO: 376870 - RNA, 22 nt, Homo sapiens
acagugcuuggcacacaguaau

SEQ ID NO: 376871 - RNA, 19 nt, Homo sapiens
acagugcuuugucagaagc

SEQ ID NO: 376872 - RNA, 22 nt, Homo sapiens
gugacauuuuuacugaugagag

SEQ ID NO: 376873 - RNA, 22 nt, Homo sapiens
gugagguugaaaauaauggaaa

SEQ ID NO: 376874 - RNA, 22 nt, Homo sapiens
gugaucaugauccugaagcauu

SEQ ID NO: 376875 - RNA, 22 nt, Homo sapiens
gugaucuuucaggcuugaccau

SEQ ID NO: 376876 - RNA, 22 nt, Homo sapiens
gugaugguaguuuguauuucug

SEQ ID NO: 376877 - RNA, 22 nt, Homo sapiens
gugggguaggcaauuccuagug

SEQ ID NO: 376878 - RNA, 22 nt, Homo sapiens
gugguuuuaauauucagucuag

SEQ ID NO: 376879 - RNA, 22 nt, Homo sapiens
gugguuuucaacuccaccugca

SEQ ID NO: 376880 - RNA, 18 nt, Homo sapiens
guguauggauggaggcca

SEQ ID NO: 376881 - RNA, 20 nt, Homo sapiens
guuaaggcagcauuacucuu

SEQ ID NO: 376882 - RNA, 22 nt, Homo sapiens
uaaagugaggauggcaguaggu

SEQ ID NO: 376883 - RNA, 22 nt, Homo sapiens
uaagcucauuccagccaugucc

SEQ ID NO: 376884 - RNA, 22 nt, Homo sapiens
uaagugaauauggacaguuagc

SEQ ID NO: 376885 - RNA, 22 nt, Homo sapiens
uaagugcaugauuacaugcaua

SEQ ID NO: 376886 - RNA, 22 nt, Homo sapiens
uacuccccuuguucugugagcu

SEQ ID NO: 376887 - RNA, 19 nt, Homo sapiens
uacugcacuccagucuggg

SEQ ID NO: 376888 - RNA, 22 nt, Homo sapiens
uagagagcuguuugaaagcagg

SEQ ID NO: 376889 - RNA, 17 nt, Homo sapiens
uagcacagugccuggua

SEQ ID NO: 376890 - RNA, 22 nt, Homo sapiens
uagcaccucuuuggccuuucgu

SEQ ID NO: 376891 - RNA, 22 nt, Homo sapiens
uagcaccuuagcauuucuagug

SEQ ID NO: 376892 - RNA, 22 nt, Homo sapiens
uaggcacugagaauaugaggau

SEQ ID NO: 376893 - RNA, 22 nt, Homo sapiens
uaggcaguggagaaauaaacag

SEQ ID NO: 376894 - RNA, 22 nt, Homo sapiens
uaggcaguguucucacuuguaa

SEQ ID NO: 376895 - RNA, 22 nt, Homo sapiens
uaucccaguggauguaccccau

SEQ ID NO: 376896 - RNA, 22 nt, Homo sapiens
uaucugcaucccauuuuuauca

SEQ ID NO: 376897 - RNA, 22 nt, Homo sapiens
uaugcacacucucccaggaggg

SEQ ID NO: 376898 - RNA, 22 nt, Homo sapiens
uaugugcuuuguuaaacagaug

SEQ ID NO: 376899 - RNA, 22 nt, Homo sapiens
uauugcuuaugaugcugaauua

SEQ ID NO: 376900 - RNA, 18 nt, Homo sapiens
uauugcuugguuuggaga

SEQ ID NO: 376901 - RNA, 22 nt, Homo sapiens
uauugcuuuugauucaaggcag

SEQ ID NO: 376902 - RNA, 22 nt, Homo sapiens
ucacagaggagaagaccuuuaa

SEQ ID NO: 376903 - RNA, 19 nt, Homo sapiens
ucacaggguugacuugagg

SEQ ID NO: 376904 - RNA, 22 nt, Homo sapiens
ucacaugugaagauugggagua

SEQ ID NO: 376905 - RNA, 22 nt, Homo sapiens
ucaccaccuuccaggaccacug

SEQ ID NO: 376906 - RNA, 22 nt, Homo sapiens
ucaccuggagaagauggaucau

SEQ ID NO: 376907 - RNA, 19 nt, Homo sapiens
ucaccuugcccugcacaca

SEQ ID NO: 376908 - RNA, 18 nt, Homo sapiens
ucaccuugugagagagag

SEQ ID NO: 376909 - RNA, 22 nt, Homo sapiens
ucaggucauuccaggagggcca

SEQ ID NO: 376910 - RNA, 22 nt, Homo sapiens
ucagugcaggaaucucuagcca

SEQ ID NO: 376911 - RNA, 22 nt, Homo sapiens
ucaucagaguuuacaagcucag

SEQ ID NO: 376912 - RNA, 22 nt, Homo sapiens
ucaucaggaaacuuaugcagug

SEQ ID NO: 376913 - RNA, 23 nt, Homo sapiens
ucccaagauggaccagaccaagg

SEQ ID NO: 376914 - RNA, 22 nt, Homo sapiens
ucccuguguuccuuuugaauug

SEQ ID NO: 376915 - RNA, 22 nt, Homo sapiens
ucucagcacagucagggcgccu

SEQ ID NO: 376916 - RNA, 22 nt, Homo sapiens
ucucaguggcuuccucacuuuu

SEQ ID NO: 376917 - RNA, 22 nt, Homo sapiens
ucucuuggugacuuaaaauguu

SEQ ID NO: 376918 - RNA, 22 nt, Homo sapiens
ucugagcaauagauguggauau

SEQ ID NO: 376919 - RNA, 22 nt, Homo sapiens
ucuuggguggauucauucuuuc

SEQ ID NO: 376920 - RNA, 18 nt, Homo sapiens
ucuuuggcugaacuguag

SEQ ID NO: 376921 - RNA, 22 nt, Homo sapiens
ugaauauguuaaauaauguucu

SEQ ID NO: 376922 - RNA, 22 nt, Homo sapiens
ugaaugguuuuuagagaacaau

SEQ ID NO: 376923 - RNA, 22 nt, Homo sapiens
ugacuagcagagugagaaacuc

SEQ ID NO: 376924 - RNA, 22 nt, Homo sapiens
ugagaagacaucuuugcuuugu

SEQ ID NO: 376925 - RNA, 22 nt, Homo sapiens
ugagaauauuugaagauguuag

SEQ ID NO: 376926 - RNA, 22 nt, Homo sapiens
ugagaugaagucucacucuguc

SEQ ID NO: 376927 - RNA, 22 nt, Homo sapiens
ugagaugaagucuugcucuguu

SEQ ID NO: 376928 - RNA, 22 nt, Homo sapiens
ugagaugacgacacaccucagu

SEQ ID NO: 376929 - RNA, 22 nt, Homo sapiens
ugagaugaggucucgcucuguc

SEQ ID NO: 376930 - RNA, 22 nt, Homo sapiens
ugagaugagucucgcucuguca

SEQ ID NO: 376931 - RNA, 22 nt, Homo sapiens
ugagaugaguugcgcucugucg

SEQ ID NO: 376932 - RNA, 22 nt, Homo sapiens
ugagcaaaauuuuggacauaga

SEQ ID NO: 376933 - RNA, 22 nt, Homo sapiens
ugagcuaggucuugcucuguca

SEQ ID NO: 376934 - RNA, 22 nt, Homo sapiens
ugagcugagauuaagcugcugc

SEQ ID NO: 376935 - RNA, 22 nt, Homo sapiens
ugagguacaacauggacugaag

SEQ ID NO: 376936 - RNA, 22 nt, Homo sapiens
ugagguuauuuguucaagaagu

SEQ ID NO: 376937 - RNA, 22 nt, Homo sapiens
ugauaguguccugugccacauu

SEQ ID NO: 376938 - RNA, 21 nt, Homo sapiens
ugcagugugguugcccugcug

SEQ ID NO: 376939 - RNA, 22 nt, Homo sapiens
ugccaucauuaauauuaggcau

SEQ ID NO: 376940 - RNA, 22 nt, Homo sapiens
ugccaugucauagguuaagccu

SEQ ID NO: 376941 - RNA, 22 nt, Homo sapiens
ugccauugcacuccagccuggg

SEQ ID NO: 376942 - RNA, 23 nt, Homo sapiens
ugcuccccucauggaugaauaaa

SEQ ID NO: 376943 - RNA, 22 nt, Homo sapiens
ugcugcauuggggauuaaguuu

SEQ ID NO: 376944 - RNA, 22 nt, Homo sapiens
uggagguagagaugggaucucc

SEQ ID NO: 376945 - RNA, 22 nt, Homo sapiens
uggagugaaaacacacuaaucu

SEQ ID NO: 376946 - RNA, 22 nt, Homo sapiens
uggagugagaacuucaaugaug

SEQ ID NO: 376947 - RNA, 22 nt, Homo sapiens
uggcaugugugaagugcccagc

SEQ ID NO: 376948 - RNA, 22 nt, Homo sapiens
uggcucuuucuagacuuaauua

SEQ ID NO: 376949 - RNA, 20 nt, Homo sapiens
uggcucuuugcugcuaaagu

SEQ ID NO: 376950 - RNA, 22 nt, Homo sapiens
uggcuuucuggggcuucuguuc

SEQ ID NO: 376951 - RNA, 22 nt, Homo sapiens
ugggaagcugcugaacuacagu

SEQ ID NO: 376952 - RNA, 22 nt, Homo sapiens
ugggaugaugaaaaggcuuucu

SEQ ID NO: 376953 - RNA, 22 nt, Homo sapiens
uggguaguguaaagcacuccag

SEQ ID NO: 376954 - RNA, 22 nt, Homo sapiens
uggucaugaggugaggcuucuc

SEQ ID NO: 376955 - RNA, 22 nt, Homo sapiens
ugucucaguuacggcaauucca

SEQ ID NO: 376956 - RNA, 20 nt, Homo sapiens
ugugauuauuuaguugcaug

SEQ ID NO: 376957 - RNA, 22 nt, Homo sapiens
uguggcuuuacagcaugguuca

SEQ ID NO: 376958 - RNA, 22 nt, Homo sapiens
ugugucuugagagucucgagaa

SEQ ID NO: 376959 - RNA, 22 nt, Homo sapiens
ugugucuuguuuuuucccaggc

SEQ ID NO: 376960 - RNA, 22 nt, Homo sapiens
acugcacuccagccuggacgaa

SEQ ID NO: 376961 - RNA, 22 nt, Homo sapiens
agacagcugggaaauggagugu

SEQ ID NO: 376962 - RNA, 21 nt, Homo sapiens
agagaacugaaacaugugacu

SEQ ID NO: 376963 - RNA, 22 nt, Homo sapiens
agagagguggguggagccccca

SEQ ID NO: 376964 - RNA, 22 nt, Homo sapiens
agagguaagcaguggcaagugc

SEQ ID NO: 376965 - RNA, 22 nt, Homo sapiens
agagugcuaaggaaguaauuua

SEQ ID NO: 376966 - RNA, 22 nt, Homo sapiens
agauggugugcuaggaaaugua

SEQ ID NO: 376967 - RNA, 22 nt, Homo sapiens
agcagcuuugaucugaaugauu

SEQ ID NO: 376968 - RNA, 22 nt, Homo sapiens
agcaggucuuaacuugugaggu

SEQ ID NO: 376969 - RNA, 20 nt, Homo sapiens
agcuugguuuggaugaucac

SEQ ID NO: 376970 - RNA, 22 nt, Homo sapiens
aggaagcuagcauuuguucagu

SEQ ID NO: 376971 - RNA, 22 nt, Homo sapiens
aggcuagaaucuuccaucuugg

SEQ ID NO: 376972 - RNA, 22 nt, Homo sapiens
agggagcaaaguggucuuucuc

SEQ ID NO: 376973 - RNA, 22 nt, Homo sapiens
agguagaguguuuuguucuucu

SEQ ID NO: 376974 - RNA, 22 nt, Homo sapiens
aggugacugguuuaucuggcag

SEQ ID NO: 376975 - RNA, 22 nt, Homo sapiens
aguauuaggugaguguauuuca

SEQ ID NO: 376976 - RNA, 22 nt, Homo sapiens
agugcacuccagccugggcaac

SEQ ID NO: 376977 - RNA, 19 nt, Homo sapiens
aguggguguuuucuguuug

SEQ ID NO: 376978 - RNA, 21 nt, Homo sapiens
aguucacauggcuccuguguu

SEQ ID NO: 376979 - RNA, 22 nt, Homo sapiens
auaagugagugauucaguguua

SEQ ID NO: 376980 - RNA, 22 nt, Homo sapiens
aucacagagucacgggcaacuu

SEQ ID NO: 376981 - RNA, 22 nt, Homo sapiens
aucccgagacuuugcugaaguu

SEQ ID NO: 376982 - RNA, 22 nt, Homo sapiens
aucugcaaauaaugaagauugg

SEQ ID NO: 376983 - RNA, 22 nt, Homo sapiens
augaccauuucaauugauaugg

SEQ ID NO: 376984 - RNA, 22 nt, Homo sapiens
augagcagaagagauacacugu

SEQ ID NO: 376985 - RNA, 22 nt, Homo sapiens
augaucacuguggaaauucagc

SEQ ID NO: 376986 - RNA, 22 nt, Homo sapiens
augcagugugcaacagauuaag

SEQ ID NO: 376987 - RNA, 22 nt, Homo sapiens
augccucugacaauuggauucu

SEQ ID NO: 376988 - RNA, 22 nt, Homo sapiens
auggaggaggaagcugaaacaa

SEQ ID NO: 376989 - RNA, 22 nt, Homo sapiens
auggcaauaauagcuaccauuu

SEQ ID NO: 376990 - RNA, 22 nt, Homo sapiens
auggcaauaugaugcacuguuu

SEQ ID NO: 376991 - RNA, 22 nt, Homo sapiens
auggcacuccagccugggcaac

SEQ ID NO: 376992 - RNA, 22 nt, Homo sapiens
auggcuuguuaugcauuaguac

SEQ ID NO: 376993 - RNA, 22 nt, Homo sapiens
augugacugauguaaucagaca

SEQ ID NO: 376994 - RNA, 23 nt, Homo sapiens
augugguuuuagguguugaacug

SEQ ID NO: 376995 - RNA, 22 nt, Homo sapiens
auuaagugaaugaaguuguucc

SEQ ID NO: 376996 - RNA, 22 nt, Homo sapiens
auugcuuaagucccuguauuag

SEQ ID NO: 376997 - RNA, 22 nt, Homo sapiens
caacacagugaaacccgucucu

SEQ ID NO: 376998 - RNA, 22 nt, Homo sapiens
caagagagcugaugguuuuaaa

SEQ ID NO: 376999 - RNA, 22 nt, Homo sapiens
caaggcacagccccuacuuccu

SEQ ID NO: 377000 - RNA, 22 nt, Homo sapiens
cacaguguuccagcuauuugaa

SEQ ID NO: 377001 - RNA, 18 nt, Homo sapiens
cacugagcccuucacucu

SEQ ID NO: 377002 - RNA, 22 nt, Homo sapiens
cagcucuuguuaaaacuaacua

SEQ ID NO: 377003 - RNA, 22 nt, Homo sapiens
caggcagucuggggguguaucc

SEQ ID NO: 377004 - RNA, 18 nt, Homo sapiens
cagugcaauacaggagag

SEQ ID NO: 377005 - RNA, 22 nt, Homo sapiens
cauaaagauggaggaggccagg

SEQ ID NO: 377006 - RNA, 22 nt, Homo sapiens
caucagagugagauauaagauc

SEQ ID NO: 377007 - RNA, 22 nt, Homo sapiens
caugccacugcacgccauccug

SEQ ID NO: 377008 - RNA, 22 nt, Homo sapiens
cccugaagaaagccuaggacau

SEQ ID NO: 377009 - RNA, 22 nt, Homo sapiens
cccuguguuuagcugaagguuu

SEQ ID NO: 377010 - RNA, 22 nt, Homo sapiens
cuaggugcaugagccguacagu

SEQ ID NO: 377011 - RNA, 22 nt, Homo sapiens
cuccaggugucauccaccuccu

SEQ ID NO: 377012 - RNA, 19 nt, Homo sapiens
cucuuuggugucucuucuu

SEQ ID NO: 377013 - RNA, 22 nt, Homo sapiens
cugggcaaugcggcuggauaga

SEQ ID NO: 377014 - RNA, 22 nt, Homo sapiens
uucuccugguggacccuaaacg

SEQ ID NO: 377015 - RNA, 22 nt, Homo sapiens
uugaaugaaaugaugucauuug

SEQ ID NO: 377016 - RNA, 22 nt, Homo sapiens
uugaaugaauggaaagaagggu

SEQ ID NO: 377017 - RNA, 22 nt, Homo sapiens
uugacacuuuguaagaaagggg

SEQ ID NO: 377018 - RNA, 22 nt, Homo sapiens
uugagaaucuuucgaauguucu

SEQ ID NO: 377019 - RNA, 22 nt, Homo sapiens
uugagguuggaggccuugccug

SEQ ID NO: 377020 - RNA, 22 nt, Homo sapiens
uugcuccucugccaggaccugu

SEQ ID NO: 377021 - RNA, 22 nt, Homo sapiens
uuggcaauugcuaugauuugaa

SEQ ID NO: 377022 - RNA, 22 nt, Homo sapiens
uuggcagaauguuagaaacuua

SEQ ID NO: 377023 - RNA, 22 nt, Homo sapiens
uuggccuccuggucauauccag

SEQ ID NO: 377024 - RNA, 22 nt, Homo sapiens
uugguccucccaugcucaagag

SEQ ID NO: 377025 - RNA, 22 nt, Homo sapiens
uuggucuucuaauguaccuguu

SEQ ID NO: 377026 - RNA, 22 nt, Homo sapiens
uugugguugacuaaauuuguaa

SEQ ID NO: 377027 - RNA, 22 nt, Homo sapiens
uugugguuuuagcacuguggau

SEQ ID NO: 377028 - RNA, 22 nt, Homo sapiens
uugugguuuuaucuaccuuugg

SEQ ID NO: 377029 - RNA, 22 nt, Homo sapiens
uuucaagugcugucuuagcugu

SEQ ID NO: 377030 - RNA, 22 nt, Homo sapiens
uuucaggcagggagcuucagug

SEQ ID NO: 377031 - RNA, 22 nt, Homo sapiens
uuuccacauggacuuaccuucg

SEQ ID NO: 377032 - RNA, 22 nt, Homo sapiens
uuucccuuuagcuuagugauuu

SEQ ID NO: 377033 - RNA, 22 nt, Homo sapiens
uuugcaucuuagaaaguucucc

SEQ ID NO: 377034 - RNA, 22 nt, Homo sapiens
uuuggcaauaaacuccccuaac

SEQ ID NO: 377035 - RNA, 18 nt, Homo sapiens
uuuggcuguucaugacuc

SEQ ID NO: 377036 - RNA, 22 nt, Homo sapiens
uuuggucuuuuguaaguuaucu

SEQ ID NO: 377037 - RNA, 22 nt, Homo sapiens
guuugugcuccuaugagaaccu

SEQ ID NO: 377038 - RNA, 18 nt, Homo sapiens
uaagaugcagccuauucc

SEQ ID NO: 377039 - RNA, 22 nt, Homo sapiens
uaaguauuaggccccaggcugg

SEQ ID NO: 377040 - RNA, 22 nt, Homo sapiens
uaauaugugguugcuugggcac

SEQ ID NO: 377041 - RNA, 22 nt, Homo sapiens
uacaaagcuuugaugugucuuu

SEQ ID NO: 377042 - RNA, 22 nt, Homo sapiens
uacaccugcacucuagccuggg

SEQ ID NO: 377043 - RNA, 18 nt, Homo sapiens
uagaauauaggucauucu

SEQ ID NO: 377044 - RNA, 19 nt, Homo sapiens
uagcacagggucccagacu

SEQ ID NO: 377045 - RNA, 22 nt, Homo sapiens
uagcaccugugcacaccaggca

SEQ ID NO: 377046 - RNA, 22 nt, Homo sapiens
uaucaagauggauaaggauaga

SEQ ID NO: 377047 - RNA, 22 nt, Homo sapiens
uauggcugcuuucacacuacaa

SEQ ID NO: 377048 - RNA, 22 nt, Homo sapiens
uauugcuuuuaacccaaucucu

SEQ ID NO: 377049 - RNA, 22 nt, Homo sapiens
ucaaagacacacaaggagaagg

SEQ ID NO: 377050 - RNA, 22 nt, Homo sapiens
ucaaggcacauuugacauuuuc

SEQ ID NO: 377051 - RNA, 20 nt, Homo sapiens
ucaaggcaggaacuguacau

SEQ ID NO: 377052 - RNA, 22 nt, Homo sapiens
ucaccucgugaucugcccacuu

SEQ ID NO: 377053 - RNA, 18 nt, Homo sapiens
ucaccuugaugcuggguc

SEQ ID NO: 377054 - RNA, 22 nt, Homo sapiens
ucacuugguggcaaaguuuaug

SEQ ID NO: 377055 - RNA, 22 nt, Homo sapiens
ucagagucuagaucacucacug

SEQ ID NO: 377056 - RNA, 22 nt, Homo sapiens
ucagcaucacgugggcucccgu

SEQ ID NO: 377057 - RNA, 22 nt, Homo sapiens
ucaucaggcucauucaagcuga

SEQ ID NO: 377058 - RNA, 22 nt, Homo sapiens
ucaucagguaugucagcggagu

SEQ ID NO: 377059 - RNA, 22 nt, Homo sapiens
ucaucaguuuuuuauaugugau

SEQ ID NO: 377060 - RNA, 22 nt, Homo sapiens
ucauguguugcacugaggaccu

SEQ ID NO: 377061 - RNA, 22 nt, Homo sapiens
uccacaguggugaggugcagca

SEQ ID NO: 377062 - RNA, 22 nt, Homo sapiens
uccacagugguugaacuaguuu

SEQ ID NO: 377063 - RNA, 18 nt, Homo sapiens
uccaguuuucccagcauc

SEQ ID NO: 377064 - RNA, 19 nt, Homo sapiens
uccaugagcccacagugau

SEQ ID NO: 377065 - RNA, 22 nt, Homo sapiens
ucccagugaaaccccaccuuca

SEQ ID NO: 377066 - RNA, 22 nt, Homo sapiens
uccccugagaacuugcuagaaa

SEQ ID NO: 377067 - RNA, 22 nt, Homo sapiens
ucgagcaauugucaugucucag

SEQ ID NO: 377068 - RNA, 22 nt, Homo sapiens
ucucagagccuaggguuuuuca

SEQ ID NO: 377069 - RNA, 22 nt, Homo sapiens
ucugccacugucauugugugau

SEQ ID NO: 377070 - RNA, 22 nt, Homo sapiens
ucugggguuagucaaagguaug

SEQ ID NO: 377071 - RNA, 22 nt, Homo sapiens
ugaauauguuaauuagcaucau

SEQ ID NO: 377072 - RNA, 22 nt, Homo sapiens
ugacaaguaaacagucagcacc

SEQ ID NO: 377073 - RNA, 22 nt, Homo sapiens
ugacagcugaggcccagaguac

SEQ ID NO: 377074 - RNA, 22 nt, Homo sapiens
ugacuggaacuuuagugagucu

SEQ ID NO: 377075 - RNA, 22 nt, Homo sapiens
ugagacaucucuccugagacag

SEQ ID NO: 377076 - RNA, 22 nt, Homo sapiens
ugagaugagagaaugcuugccu

SEQ ID NO: 377077 - RNA, 22 nt, Homo sapiens
ugagaugaggucucacucuguu

SEQ ID NO: 377078 - RNA, 21 nt, Homo sapiens
ugagaugauccugcaugcaug

SEQ ID NO: 377079 - RNA, 22 nt, Homo sapiens
ugagauggaguuucgcucuugu

SEQ ID NO: 377080 - RNA, 22 nt, Homo sapiens
ugagauggcuuuauugcugaau

SEQ ID NO: 377081 - RNA, 22 nt, Homo sapiens
ugagcaagaaauagaaacagau

SEQ ID NO: 377082 - RNA, 22 nt, Homo sapiens
ugagcagagaagugcccugcgc

SEQ ID NO: 377083 - RNA, 22 nt, Homo sapiens
ugagcagaguuguuucuccuga

SEQ ID NO: 377084 - RNA, 22 nt, Homo sapiens
ugagccaugggguaaaugugau

SEQ ID NO: 377085 - RNA, 22 nt, Homo sapiens
ugagcuaggaucacaccugcau

SEQ ID NO: 377086 - RNA, 22 nt, Homo sapiens
ugagcugagaaaugcagcagcu

SEQ ID NO: 377087 - RNA, 20 nt, Homo sapiens
agcuggguguguuggugcau

SEQ ID NO: 377088 - RNA, 22 nt, Homo sapiens
aggaggauugcuuucaucuuuu

SEQ ID NO: 377089 - RNA, 22 nt, Homo sapiens
aggccaguuuuuggagggaaac

SEQ ID NO: 377090 - RNA, 22 nt, Homo sapiens
aggugcugagcagagaauccug

SEQ ID NO: 377091 - RNA, 22 nt, Homo sapiens
aggugguguuggguuccagccc

SEQ ID NO: 377092 - RNA, 22 nt, Homo sapiens
aguaaagccagaccuguuaauu

SEQ ID NO: 377093 - RNA, 22 nt, Homo sapiens
aguggauguuguggccugggag

SEQ ID NO: 377094 - RNA, 22 nt, Homo sapiens
aguggcuuuuuaguggcagaug

SEQ ID NO: 377095 - RNA, 22 nt, Homo sapiens
aguuagcaaaacucccaaaggu

SEQ ID NO: 377096 - RNA, 19 nt, Homo sapiens
auaagugaaucacgggggc

SEQ ID NO: 377097 - RNA, 22 nt, Homo sapiens
auaaucaugucugaaaccuuug

SEQ ID NO: 377098 - RNA, 22 nt, Homo sapiens
auagacacugaaaucccugcca

SEQ ID NO: 377099 - RNA, 21 nt, Homo sapiens
auagcacaucagauuuuauua

SEQ ID NO: 377100 - RNA, 22 nt, Homo sapiens
auagcacauggcauccucucuu

SEQ ID NO: 377101 - RNA, 22 nt, Homo sapiens
auaugacuuuccucuacuuccu

SEQ ID NO: 377102 - RNA, 22 nt, Homo sapiens
auaugcacgugcauacacacuu

SEQ ID NO: 377103 - RNA, 22 nt, Homo sapiens
aucacauggccuagccuaaccu

SEQ ID NO: 377104 - RNA, 22 nt, Homo sapiens
aucaccugagcaguauacacug

SEQ ID NO: 377105 - RNA, 22 nt, Homo sapiens
aucccagaaacucggguuucuc

SEQ ID NO: 377106 - RNA, 23 nt, Homo sapiens
augacacuccugugcgcacccug

SEQ ID NO: 377107 - RNA, 22 nt, Homo sapiens
auggcaaugcgauggugacuga

SEQ ID NO: 377108 - RNA, 22 nt, Homo sapiens
auggccuuucuggcacauuucc

SEQ ID NO: 377109 - RNA, 22 nt, Homo sapiens
auggcuuugggcugcucugccc

SEQ ID NO: 377110 - RNA, 22 nt, Homo sapiens
augggaaaaucagaaggccugg

SEQ ID NO: 377111 - RNA, 22 nt, Homo sapiens
augugacuugugaaaaguucag

SEQ ID NO: 377112 - RNA, 22 nt, Homo sapiens
auguuugguaagaauauuguua

SEQ ID NO: 377113 - RNA, 22 nt, Homo sapiens
auuaagugcuugcagaagucca

SEQ ID NO: 377114 - RNA, 22 nt, Homo sapiens
auugugcuaaaguaauaaguca

SEQ ID NO: 377115 - RNA, 22 nt, Homo sapiens
auuguucuuacaugcugucauc

SEQ ID NO: 377116 - RNA, 22 nt, Homo sapiens
auuucacuucgcaugguguccg

SEQ ID NO: 377117 - RNA, 22 nt, Homo sapiens
cacaaugucuaagauguuucua

SEQ ID NO: 377118 - RNA, 22 nt, Homo sapiens
cacaguguuacugguaugaagu

SEQ ID NO: 377119 - RNA, 20 nt, Homo sapiens
cagggcaaugaggagguaaa

SEQ ID NO: 377120 - RNA, 22 nt, Homo sapiens
cagggcauuggcugguaccugg

SEQ ID NO: 377121 - RNA, 20 nt, Homo sapiens
cagugcaccuggcguguuga

SEQ ID NO: 377122 - RNA, 22 nt, Homo sapiens
cagugcauguggcacucuccag

SEQ ID NO: 377123 - RNA, 22 nt, Homo sapiens
cauacaguaggcacuauuugua

SEQ ID NO: 377124 - RNA, 22 nt, Homo sapiens
cauagcacacauuuaccuaugu

SEQ ID NO: 377125 - RNA, 22 nt, Homo sapiens
caucacagcaaguagggagugg

SEQ ID NO: 377126 - RNA, 22 nt, Homo sapiens
caugaugcuagguauggaugaa

SEQ ID NO: 377127 - RNA, 22 nt, Homo sapiens
ccagaauucucauuggaaggaa

SEQ ID NO: 377128 - RNA, 18 nt, Homo sapiens
ccagugcaaggaaagccc

SEQ ID NO: 377129 - RNA, 22 nt, Homo sapiens
ccccagguuucaauaaagccca

SEQ ID NO: 377130 - RNA, 22 nt, Homo sapiens
cuaagugaacugucacugagaa

SEQ ID NO: 377131 - RNA, 22 nt, Homo sapiens
cuagcacauuuaucuuuauaca

SEQ ID NO: 377132 - RNA, 22 nt, Homo sapiens
cuaggcacugauaguuguauuu

SEQ ID NO: 377133 - RNA, 22 nt, Homo sapiens
cucaccuugugauccaccggcc

SEQ ID NO: 377134 - RNA, 22 nt, Homo sapiens
cugacaugcagccacugcaccu

SEQ ID NO: 377135 - RNA, 22 nt, Homo sapiens
cuggacguugaggcugcaguga

SEQ ID NO: 377136 - RNA, 22 nt, Homo sapiens
cuggaguuugaggcugcaguga

SEQ ID NO: 377137 - RNA, 22 nt, Homo sapiens
cuggcaauaggcagugucccaa

SEQ ID NO: 377138 - RNA, 22 nt, Homo sapiens
cugugguugagcuuugccauga

SEQ ID NO: 377139 - RNA, 22 nt, Homo sapiens
aaaggcacugaucuuauccagu

SEQ ID NO: 377140 - RNA, 22 nt, Homo sapiens
aacagagcuggugacuccaggu

SEQ ID NO: 377141 - RNA, 20 nt, Homo sapiens
aacagcacugucugaagcuu

SEQ ID NO: 377142 - RNA, 19 nt, Homo sapiens
aacuggugugagaugauau

SEQ ID NO: 377143 - RNA, 22 nt, Homo sapiens
aagagagcuaugugcauaauua

SEQ ID NO: 377144 - RNA, 22 nt, Homo sapiens
aagaugauguucuuuuucuuag

SEQ ID NO: 377145 - RNA, 22 nt, Homo sapiens
aagcacccagccucacgccugc

SEQ ID NO: 377146 - RNA, 22 nt, Homo sapiens
aaggcaagagaaaauuucgagu

SEQ ID NO: 377147 - RNA, 22 nt, Homo sapiens
aaggcaguggcagaagauguca

SEQ ID NO: 377148 - RNA, 23 nt, Homo sapiens
aagguaagcuagaaagauguaga

SEQ ID NO: 377149 - RNA, 20 nt, Homo sapiens
aagugcuauuucuuuugugg

SEQ ID NO: 377150 - RNA, 22 nt, Homo sapiens
aaugcacuccagccugggcgac

SEQ ID NO: 377151 - RNA, 22 nt, Homo sapiens
aauuaguuggcugccuaugauu

SEQ ID NO: 377152 - RNA, 22 nt, Homo sapiens
acacaugugcguagacucuuua

SEQ ID NO: 377153 - RNA, 22 nt, Homo sapiens
acacugucugaugaaaguaguu

SEQ ID NO: 377154 - RNA, 22 nt, Homo sapiens
acacuuucuagacaagggaaua

SEQ ID NO: 377155 - RNA, 22 nt, Homo sapiens
acagugcuguuguguuuucacg

SEQ ID NO: 377156 - RNA, 17 nt, Homo sapiens
acagugucuaugaaaug

SEQ ID NO: 377157 - RNA, 18 nt, Homo sapiens
acagugucuuacaccugu

SEQ ID NO: 377158 - RNA, 22 nt, Homo sapiens
acaucaggcuugugaugauuac

SEQ ID NO: 377159 - RNA, 22 nt, Homo sapiens
acccagaguuccuugucuuuca

SEQ ID NO: 377160 - RNA, 22 nt, Homo sapiens
acugcacuccagccugugcgua

SEQ ID NO: 377161 - RNA, 22 nt, Homo sapiens
acugcacuccagccuuggcaac

SEQ ID NO: 377162 - RNA, 22 nt, Homo sapiens
acugcacucuagccuuggcaac

SEQ ID NO: 377163 - RNA, 22 nt, Homo sapiens
agaauguaaacagaauagagga

SEQ ID NO: 377164 - RNA, 22 nt, Homo sapiens
agacuagagggaaaugaguugg

SEQ ID NO: 377165 - RNA, 22 nt, Homo sapiens
agaugauguuucuggcacauga

SEQ ID NO: 377166 - RNA, 22 nt, Homo sapiens
agcaagaugaaguugagcuagg

SEQ ID NO: 377167 - RNA, 22 nt, Homo sapiens
agcaccauugcacuccagccug

SEQ ID NO: 377168 - RNA, 22 nt, Homo sapiens
agcaccguucaaacccagguua

SEQ ID NO: 377169 - RNA, 22 nt, Homo sapiens
agcagagcauauucauucgggg

SEQ ID NO: 377170 - RNA, 22 nt, Homo sapiens
agcccagagacuguguaaauuu

SEQ ID NO: 377171 - RNA, 20 nt, Homo sapiens
agcuccauuccugaaggcug

SEQ ID NO: 377172 - RNA, 22 nt, Homo sapiens
aggcagcuguuauauacugagu

SEQ ID NO: 377173 - RNA, 23 nt, Homo sapiens
aggccaguuuuuccugcuugcug

SEQ ID NO: 377174 - RNA, 22 nt, Homo sapiens
agggcaagacuuguuaagaaca

SEQ ID NO: 377175 - RNA, 22 nt, Homo sapiens
aguacacuguugaacagaagug

SEQ ID NO: 377176 - RNA, 20 nt, Homo sapiens
aguauucacuuuuuucaugg

SEQ ID NO: 377177 - RNA, 22 nt, Homo sapiens
agugucaggagacagguagcug

SEQ ID NO: 377178 - RNA, 22 nt, Homo sapiens
auaauguuugauugagcagaua

SEQ ID NO: 377179 - RNA, 18 nt, Homo sapiens
auacaagcagcagagauu

SEQ ID NO: 377180 - RNA, 22 nt, Homo sapiens
auacacauuccugggccucacc

SEQ ID NO: 377181 - RNA, 22 nt, Homo sapiens
auagcacaugugcaaauggcug

SEQ ID NO: 377182 - RNA, 20 nt, Homo sapiens
aucaaagacuuagaggggga

SEQ ID NO: 377183 - RNA, 22 nt, Homo sapiens
aucaccagaugcuucaagcaga

SEQ ID NO: 377184 - RNA, 20 nt, Homo sapiens
aucagagacuaggauugcca

SEQ ID NO: 377185 - RNA, 22 nt, Homo sapiens
aucuacagccagucugguuugu

SEQ ID NO: 377186 - RNA, 22 nt, Homo sapiens
aucugcacaucuguguuuuugu

SEQ ID NO: 377187 - RNA, 22 nt, Homo sapiens
aucugugaaugaaguuauuuug

SEQ ID NO: 377188 - RNA, 22 nt, Homo sapiens
aucuuguguugaauggugcaga

SEQ ID NO: 377189 - RNA, 22 nt, Homo sapiens
augaaaagcauaaacgcugaag

SEQ ID NO: 377190 - RNA, 22 nt, Homo sapiens
augaacucaucauuuuuugugg

SEQ ID NO: 377191 - RNA, 22 nt, Homo sapiens
augagaaugauucuguuauggu

SEQ ID NO: 377192 - RNA, 22 nt, Homo sapiens
augagcagaugcuccugccucu

SEQ ID NO: 377193 - RNA, 22 nt, Homo sapiens
augcaaacaucauagaguguac

SEQ ID NO: 377194 - RNA, 22 nt, Homo sapiens
augcacaucagcuccagggacc

SEQ ID NO: 377195 - RNA, 20 nt, Homo sapiens
augccacugagcagugguga

SEQ ID NO: 377196 - RNA, 22 nt, Homo sapiens
auggaggacaaugucaccuuca

SEQ ID NO: 377197 - RNA, 22 nt, Homo sapiens
auggcaaugcgaugaugacuga

SEQ ID NO: 377198 - RNA, 22 nt, Homo sapiens
auggcaauguaagucagaaaaa

SEQ ID NO: 377199 - RNA, 22 nt, Homo sapiens
auggcccaguuugcuaucccua

SEQ ID NO: 377200 - RNA, 22 nt, Homo sapiens
auguagauaucaagaggcauau

SEQ ID NO: 377201 - RNA, 22 nt, Homo sapiens
auguauggaguuuaggggaugg

SEQ ID NO: 377202 - RNA, 22 nt, Homo sapiens
augugcuuaaaaaugcagagaa

SEQ ID NO: 377203 - RNA, 22 nt, Homo sapiens
auuaagugcuugccagugcugg

SEQ ID NO: 377204 - RNA, 21 nt, Homo sapiens
auugagcacaugaaacauggc

SEQ ID NO: 377205 - RNA, 22 nt, Homo sapiens
auugcucuuagaaauauuucuu

SEQ ID NO: 377206 - RNA, 20 nt, Homo sapiens
auuugcauuauggagcaccc

SEQ ID NO: 377207 - RNA, 22 nt, Homo sapiens
caaaggcuucugaaacugcaga

SEQ ID NO: 377208 - RNA, 22 nt, Homo sapiens
cacccuaucagauguccagaga

SEQ ID NO: 377209 - RNA, 22 nt, Homo sapiens
caccuugugauccacccgccuu

SEQ ID NO: 377210 - RNA, 22 nt, Homo sapiens
cacugcauuacucaugagcaug

SEQ ID NO: 377211 - RNA, 20 nt, Homo sapiens
cagcaaccugcucucuuccu

SEQ ID NO: 377212 - RNA, 22 nt, Homo sapiens
caggaccucuugccuggaagcc

SEQ ID NO: 377213 - RNA, 22 nt, Homo sapiens
aaaggcacacacuccuuguuau

SEQ ID NO: 377214 - RNA, 22 nt, Homo sapiens
aaaggcacugugacuuuauagg

SEQ ID NO: 377215 - RNA, 22 nt, Homo sapiens
aacagugcauucagggauauau

SEQ ID NO: 377216 - RNA, 22 nt, Homo sapiens
aacugcuguuuggguacuggug

SEQ ID NO: 377217 - RNA, 22 nt, Homo sapiens
aaggcacugaacuuaaauucug

SEQ ID NO: 377218 - RNA, 22 nt, Homo sapiens
aagggaauguuguagcugguuu

SEQ ID NO: 377219 - RNA, 22 nt, Homo sapiens
aaucagcacacugugcuuucca

SEQ ID NO: 377220 - RNA, 22 nt, Homo sapiens
aaucugucaguuuuguguuaau

SEQ ID NO: 377221 - RNA, 22 nt, Homo sapiens
aaugcacauauauuuccuuauu

SEQ ID NO: 377222 - RNA, 22 nt, Homo sapiens
acagaccuauuucaaucauuua

SEQ ID NO: 377223 - RNA, 17 nt, Homo sapiens
acccagucuuuuugcac

SEQ ID NO: 377224 - RNA, 22 nt, Homo sapiens
acccuugaguguguuucaggca

SEQ ID NO: 377225 - RNA, 22 nt, Homo sapiens
acucagagaacauucccagucu

SEQ ID NO: 377226 - RNA, 22 nt, Homo sapiens
acugacaugaucaggcauguuc

SEQ ID NO: 377227 - RNA, 22 nt, Homo sapiens
acugcacuccacccuuggcagc

SEQ ID NO: 377228 - RNA, 22 nt, Homo sapiens
acugcacuccagccucggcaau

SEQ ID NO: 377229 - RNA, 22 nt, Homo sapiens
acugcacuccagccuggacgac

SEQ ID NO: 377230 - RNA, 22 nt, Homo sapiens
acugcacuccagccuuggcggc

SEQ ID NO: 377231 - RNA, 22 nt, Homo sapiens
acugcacuccggccuggcaaca

SEQ ID NO: 377232 - RNA, 22 nt, Homo sapiens
acuuuuguuauacagugugaua

SEQ ID NO: 377233 - RNA, 17 nt, Homo sapiens
acuuuuugaggaggcau

SEQ ID NO: 377234 - RNA, 22 nt, Homo sapiens
agaauguaacucuaugaaggca

SEQ ID NO: 377235 - RNA, 22 nt, Homo sapiens
agacagcuggaguaucauagcu

SEQ ID NO: 377236 - RNA, 20 nt, Homo sapiens
agagugcugucuguccugag

SEQ ID NO: 377237 - RNA, 22 nt, Homo sapiens
agcacagugaaugguuuacuca

SEQ ID NO: 377238 - RNA, 23 nt, Homo sapiens
agcaccaccccaggucacaagug

SEQ ID NO: 377239 - RNA, 22 nt, Homo sapiens
agcaccauuguacuccagccug

SEQ ID NO: 377240 - RNA, 22 nt, Homo sapiens
agcagagcaguggauuuuguga

SEQ ID NO: 377241 - RNA, 18 nt, Homo sapiens
agcaucacugaucauccu

SEQ ID NO: 377242 - RNA, 22 nt, Homo sapiens
cuuccauauucuaggacaggcu

SEQ ID NO: 377243 - RNA, 22 nt, Homo sapiens
cuucuguuaguucugauaacuu

SEQ ID NO: 377244 - RNA, 22 nt, Homo sapiens
cuugcacauuacagaucugcau

SEQ ID NO: 377245 - RNA, 22 nt, Homo sapiens
cuugucuugcacacgguugcca

SEQ ID NO: 377246 - RNA, 21 nt, Homo sapiens
cuuuaugcuguguuagaaaag

SEQ ID NO: 377247 - RNA, 22 nt, Homo sapiens
gacccucuagagggaagcgcuu

SEQ ID NO: 377248 - RNA, 22 nt, Homo sapiens
gacuagaaauuauuuagugagc

SEQ ID NO: 377249 - RNA, 22 nt, Homo sapiens
gacuuugguaaacucgguggca

SEQ ID NO: 377250 - RNA, 22 nt, Homo sapiens
gagaagugcgucguuugaugau

SEQ ID NO: 377251 - RNA, 22 nt, Homo sapiens
gagcacauguggagagucuggg

SEQ ID NO: 377252 - RNA, 22 nt, Homo sapiens
gagcuccuccccuuggcuuuca

SEQ ID NO: 377253 - RNA, 22 nt, Homo sapiens
gagcuuggguuaaaguugccuu

SEQ ID NO: 377254 - RNA, 22 nt, Homo sapiens
gaggacauuaugcuaaguggaa

SEQ ID NO: 377255 - RNA, 22 nt, Homo sapiens
gagguugggaugagggauacag

SEQ ID NO: 377256 - RNA, 22 nt, Homo sapiens
gaguuagguugucaaugucuua

SEQ ID NO: 377257 - RNA, 21 nt, Homo sapiens
gauaaguuggcagccagcacc

SEQ ID NO: 377258 - RNA, 22 nt, Homo sapiens
gaugaggcuagagacaugugua

SEQ ID NO: 377259 - RNA, 22 nt, Homo sapiens
gaugguuuucaccugcaugcuu

SEQ ID NO: 377260 - RNA, 22 nt, Homo sapiens
gcaucacagggagacaggccuc

SEQ ID NO: 377261 - RNA, 22 nt, Homo sapiens
gccaguguguguuguucuccgc

SEQ ID NO: 377262 - RNA, 22 nt, Homo sapiens
gccaguguuuuauugagaauuu

SEQ ID NO: 377263 - RNA, 22 nt, Homo sapiens
gcccagauguuuggggucaugg

SEQ ID NO: 377264 - RNA, 22 nt, Homo sapiens
gcuaaaucuguaaaaugaggag

SEQ ID NO: 377265 - RNA, 22 nt, Homo sapiens
gcuugguccccacccaaaucgc

SEQ ID NO: 377266 - RNA, 22 nt, Homo sapiens
ggacuaggagcuaggaagaucu

SEQ ID NO: 377267 - RNA, 22 nt, Homo sapiens
ggagugugauucaguauaauau

SEQ ID NO: 377268 - RNA, 22 nt, Homo sapiens
ggcauugugauccaccagccuu

SEQ ID NO: 377269 - RNA, 22 nt, Homo sapiens
ggcucaguuuccuccgucugcu

SEQ ID NO: 377270 - RNA, 22 nt, Homo sapiens
gggcauugugggcagagggcag

SEQ ID NO: 377271 - RNA, 22 nt, Homo sapiens
gguggcuuuuugugauggcuga

SEQ ID NO: 377272 - RNA, 22 nt, Homo sapiens
ggugucuuguuuaauacucauu

SEQ ID NO: 377273 - RNA, 22 nt, Homo sapiens
guagagguagauucuguuuuga

SEQ ID NO: 377274 - RNA, 22 nt, Homo sapiens
gucccugcgauugugggauccu

SEQ ID NO: 377275 - RNA, 19 nt, Homo sapiens
cuugccccauucauccucu

SEQ ID NO: 377276 - RNA, 22 nt, Homo sapiens
gaaggugcuuggugaaugcauu

SEQ ID NO: 377277 - RNA, 22 nt, Homo sapiens
gacaccugguguggaacuggag

SEQ ID NO: 377278 - RNA, 22 nt, Homo sapiens
gagcaacaguggcagugguggg

SEQ ID NO: 377279 - RNA, 22 nt, Homo sapiens
gaggcagucugacccuuagcag

SEQ ID NO: 377280 - RNA, 22 nt, Homo sapiens
gaggcagucuguccauucucag

SEQ ID NO: 377281 - RNA, 22 nt, Homo sapiens
gaggcaguguguccguucucgg

SEQ ID NO: 377282 - RNA, 22 nt, Homo sapiens
gagguaaguaagaauggcaagc

SEQ ID NO: 377283 - RNA, 22 nt, Homo sapiens
gauggcucugcaggugagggua

SEQ ID NO: 377284 - RNA, 22 nt, Homo sapiens
gauguguuuaucacccaguccu

SEQ ID NO: 377285 - RNA, 22 nt, Homo sapiens
gcacaggguuacauucuaaggu

SEQ ID NO: 377286 - RNA, 22 nt, Homo sapiens
gccagugugaugugaucauggc

SEQ ID NO: 377287 - RNA, 21 nt, Homo sapiens
gccaguguggcaauuuuucaa

SEQ ID NO: 377288 - RNA, 23 nt, Homo sapiens
gcuaggagagaugaaacacaggu

SEQ ID NO: 377289 - RNA, 22 nt, Homo sapiens
ggaaggucaaagggaaagcaga

SEQ ID NO: 377290 - RNA, 22 nt, Homo sapiens
ggagcucaucuagcauagaggu

SEQ ID NO: 377291 - RNA, 21 nt, Homo sapiens
ggcaagagaauacaacauaaa

SEQ ID NO: 377292 - RNA, 22 nt, Homo sapiens
ggcacaaugucagcucacugca

SEQ ID NO: 377293 - RNA, 22 nt, Homo sapiens
ggcaguuucucaggcaggggua

SEQ ID NO: 377294 - RNA, 22 nt, Homo sapiens
ggcucagugggguccugguucu

SEQ ID NO: 377295 - RNA, 22 nt, Homo sapiens
gggauuguaauacugaguuggu

SEQ ID NO: 377296 - RNA, 22 nt, Homo sapiens
gguaggcacuggugggaagaga

SEQ ID NO: 377297 - RNA, 22 nt, Homo sapiens
guaacugguuuucuucccucuc

SEQ ID NO: 377298 - RNA, 22 nt, Homo sapiens
guaagugauagaauuaggauuc

SEQ ID NO: 377299 - RNA, 22 nt, Homo sapiens
gucagaaucucagaugacaacg

SEQ ID NO: 377300 - RNA, 22 nt, Homo sapiens
guccaaagugggagaggugggg

SEQ ID NO: 377301 - RNA, 22 nt, Homo sapiens
gucuuggcaugugcagcuggga

SEQ ID NO: 377302 - RNA, 22 nt, Homo sapiens
gugaaugaaugggugaauacau

SEQ ID NO: 377303 - RNA, 22 nt, Homo sapiens
gugaccauuugacauauccuug

SEQ ID NO: 377304 - RNA, 22 nt, Homo sapiens
gugagcaguguccuugggggca

SEQ ID NO: 377305 - RNA, 22 nt, Homo sapiens
gugggguagcaggcuccuaucu

SEQ ID NO: 377306 - RNA, 22 nt, Homo sapiens
gugguuuuuagauuucuacagu

SEQ ID NO: 377307 - RNA, 22 nt, Homo sapiens
guugagcaaacagcuuaacagu

SEQ ID NO: 377308 - RNA, 22 nt, Homo sapiens
guugagcaagcuuuggagccua

SEQ ID NO: 377309 - RNA, 18 nt, Homo sapiens
acagugucauggcucaau

SEQ ID NO: 377310 - RNA, 21 nt, Homo sapiens
acaucagaguugugaagguag

SEQ ID NO: 377311 - RNA, 18 nt, Homo sapiens
acaucccaugcuggggug

SEQ ID NO: 377312 - RNA, 22 nt, Homo sapiens
acucagagugggccccuagaua

SEQ ID NO: 377313 - RNA, 22 nt, Homo sapiens
acugcacuccagccuaggcgac

SEQ ID NO: 377314 - RNA, 22 nt, Homo sapiens
acugcacuccagccugagccug

SEQ ID NO: 377315 - RNA, 22 nt, Homo sapiens
acugcacuccagccugccgaca

SEQ ID NO: 377316 - RNA, 22 nt, Homo sapiens
acugcacuccagccuggaccac

SEQ ID NO: 377317 - RNA, 22 nt, Homo sapiens
acugcacuccagccuggcggac

SEQ ID NO: 377318 - RNA, 22 nt, Homo sapiens
acugcacuccagccuugcgaca

SEQ ID NO: 377319 - RNA, 22 nt, Homo sapiens
acugcacugcagccuggccaac

SEQ ID NO: 377320 - RNA, 22 nt, Homo sapiens
caggcagucuggcucccaagug

SEQ ID NO: 377321 - RNA, 22 nt, Homo sapiens
caugccacugcacuccaaccug

SEQ ID NO: 377322 - RNA, 22 nt, Homo sapiens
cauggcacaucuuuucugacua

SEQ ID NO: 377323 - RNA, 22 nt, Homo sapiens
ccacacugucuuggugggaaac

SEQ ID NO: 377324 - RNA, 22 nt, Homo sapiens
ccagugucugacagacacggcg

SEQ ID NO: 377325 - RNA, 21 nt, Homo sapiens
ccugaguacaacccacuccac

SEQ ID NO: 377326 - RNA, 22 nt, Homo sapiens
ccuucacaggcacugguucaga

SEQ ID NO: 377327 - RNA, 22 nt, Homo sapiens
ccuucauucauuaauuuagccc

SEQ ID NO: 377328 - RNA, 22 nt, Homo sapiens
cgcuggugucuaagcgacagcu

SEQ ID NO: 377329 - RNA, 22 nt, Homo sapiens
cuaaggaaggacugaaaggaca

SEQ ID NO: 377330 - RNA, 22 nt, Homo sapiens
cuaagugaguauaauuuuaaga

SEQ ID NO: 377331 - RNA, 22 nt, Homo sapiens
cuacacaugcaggcucccugcc

SEQ ID NO: 377332 - RNA, 22 nt, Homo sapiens
cuacugauuaaaagaacagguc

SEQ ID NO: 377333 - RNA, 22 nt, Homo sapiens
cuagacacugacguuccuccga

SEQ ID NO: 377334 - RNA, 21 nt, Homo sapiens
cuaggaccaguucuguaauuc

SEQ ID NO: 377335 - RNA, 22 nt, Homo sapiens
cucagagcacaguuuaugacag

SEQ ID NO: 377336 - RNA, 22 nt, Homo sapiens
cucugauggagauauacaagga

SEQ ID NO: 377337 - RNA, 22 nt, Homo sapiens
cugacuaguuuuaaugcagauu

SEQ ID NO: 377338 - RNA, 22 nt, Homo sapiens
cugccaguuugauucgggccac

SEQ ID NO: 377339 - RNA, 22 nt, Homo sapiens
cuggcucuguuagaagaaccag

SEQ ID NO: 377340 - RNA, 23 nt, Homo sapiens
cuguggugaggcccuagaaucug

SEQ ID NO: 377341 - RNA, 22 nt, Homo sapiens
cuugggcagugugcauguguau

SEQ ID NO: 377342 - RNA, 21 nt, Homo sapiens
cuugucuugcuuagaauagac

SEQ ID NO: 377343 - RNA, 22 nt, Homo sapiens
gaaaguaauuaacgauuguugc

SEQ ID NO: 377344 - RNA, 20 nt, Homo sapiens
gaaugguuucgggguucuug

SEQ ID NO: 377345 - RNA, 22 nt, Homo sapiens
gacagagcaagacccuauuuaa

SEQ ID NO: 377346 - RNA, 22 nt, Homo sapiens
gaccacauuccacacaggcuuu

SEQ ID NO: 377347 - RNA, 22 nt, Homo sapiens
gagagugaaguuugcuaccugu

SEQ ID NO: 377348 - RNA, 22 nt, Homo sapiens
gagaugauuugccccauguauu

SEQ ID NO: 377349 - RNA, 22 nt, Homo sapiens
gaggcacucuguacaaaucugc

SEQ ID NO: 377350 - RNA, 22 nt, Homo sapiens
gaggcuagauggggaugugucc

SEQ ID NO: 377351 - RNA, 22 nt, Homo sapiens
gaguuuguacuaauuuguugua

SEQ ID NO: 377352 - RNA, 22 nt, Homo sapiens
gaugacagugaguaaccccaac

SEQ ID NO: 377353 - RNA, 22 nt, Homo sapiens
gauuagaacagaagucagauua

SEQ ID NO: 377354 - RNA, 22 nt, Homo sapiens
gcagaauugguuucuucuaagg

SEQ ID NO: 377355 - RNA, 19 nt, Homo sapiens
gcagagaugugguagcuug

SEQ ID NO: 377356 - RNA, 20 nt, Homo sapiens
gcagcaccauauuucuaaga

SEQ ID NO: 377357 - RNA, 20 nt, Homo sapiens
gccacaguuaagcuucugcc

SEQ ID NO: 377358 - RNA, 22 nt, Homo sapiens
gccccugagacuugccucgggc

SEQ ID NO: 377359 - RNA, 22 nt, Homo sapiens
gcuggguucagagugggcugcg

SEQ ID NO: 377360 - RNA, 22 nt, Homo sapiens
ggaaagacuauuguaaaggaug

SEQ ID NO: 377361 - RNA, 22 nt, Homo sapiens
ggaaugcuaaaauaggaugcug

SEQ ID NO: 377362 - RNA, 22 nt, Homo sapiens
ggacuagggacauggggagcug

SEQ ID NO: 377363 - RNA, 22 nt, Homo sapiens
ggagggugagaucaauuuggga

SEQ ID NO: 377364 - RNA, 22 nt, Homo sapiens
ggauugcuuaagaaguuucauu

SEQ ID NO: 377365 - RNA, 22 nt, Homo sapiens
ggcaagugggagggaguguuuc

SEQ ID NO: 377366 - RNA, 22 nt, Homo sapiens
ggcaagugucagcagcaacacc

SEQ ID NO: 377367 - RNA, 22 nt, Homo sapiens
ggcauguauucuuauuauuccu

SEQ ID NO: 377368 - RNA, 22 nt, Homo sapiens
ggccggguggccauggcugccc

SEQ ID NO: 377369 - RNA, 22 nt, Homo sapiens
ggcuagagagcucagggauaug

SEQ ID NO: 377370 - RNA, 22 nt, Homo sapiens
gggcaaaacuguacugccaagg

SEQ ID NO: 377371 - RNA, 22 nt, Homo sapiens
gggcauguggacuuguauguuu

SEQ ID NO: 377372 - RNA, 22 nt, Homo sapiens
ggggaguguggacaucacccug

SEQ ID NO: 377373 - RNA, 22 nt, Homo sapiens
ggugagcacagaaugcccugag

SEQ ID NO: 377374 - RNA, 22 nt, Homo sapiens
guauaaguugacucaaucuuug

SEQ ID NO: 377375 - RNA, 22 nt, Homo sapiens
gucccagagauauugugucuuu

SEQ ID NO: 377376 - RNA, 22 nt, Homo sapiens
gugacacuggagcuggcacaau

SEQ ID NO: 377377 - RNA, 19 nt, Homo sapiens
gugagcaaugcauugcacu

SEQ ID NO: 377378 - RNA, 22 nt, Homo sapiens
guggcacgaugaucugggcuca

SEQ ID NO: 377379 - RNA, 22 nt, Homo sapiens
gugugauuauuucaauugaugc

SEQ ID NO: 377380 - RNA, 22 nt, Homo sapiens
guguuugguugauagagccacu

SEQ ID NO: 377381 - RNA, 22 nt, Homo sapiens
guuggcuguuucccccaaguga

SEQ ID NO: 377382 - RNA, 22 nt, Homo sapiens
uaagugaauuucacuacugagu

SEQ ID NO: 377383 - RNA, 22 nt, Homo sapiens
uaagugaauuugacagguaaug

SEQ ID NO: 377384 - RNA, 22 nt, Homo sapiens
uacaucagccugaaagagcucg

SEQ ID NO: 377385 - RNA, 20 nt, Homo sapiens
uagagagauauggggguucc

SEQ ID NO: 377386 - RNA, 22 nt, Homo sapiens
uagcugagacuacaguaggugc

SEQ ID NO: 377387 - RNA, 22 nt, Homo sapiens
uaggcacuguguuuguaggagu

SEQ ID NO: 377388 - RNA, 21 nt, Homo sapiens
uaucccagucacaucuaccca

SEQ ID NO: 377389 - RNA, 22 nt, Homo sapiens
uaugcacaugugccugggugug

SEQ ID NO: 377390 - RNA, 22 nt, Homo sapiens
ucaccuggagccuucacauucu

SEQ ID NO: 377391 - RNA, 22 nt, Homo sapiens
ucaccuugcacaguuguguggg

SEQ ID NO: 377392 - RNA, 18 nt, Homo sapiens
ucaccuugcuuuuagaac

SEQ ID NO: 377393 - RNA, 22 nt, Homo sapiens
ucaggcaccuuccucuuaucug

SEQ ID NO: 377394 - RNA, 22 nt, Homo sapiens
ucaguggagccucacucugugg

SEQ ID NO: 377395 - RNA, 22 nt, Homo sapiens
ucaucagaaucccuuagggaug

SEQ ID NO: 377396 - RNA, 19 nt, Homo sapiens
ucaugugcauacauuuggg

SEQ ID NO: 377397 - RNA, 22 nt, Homo sapiens
uccacagugguugaacuaguaa

SEQ ID NO: 377398 - RNA, 19 nt, Homo sapiens
uccaccgcgugcaccucua

SEQ ID NO: 377399 - RNA, 22 nt, Homo sapiens
uccaugagaauaguuaggcucu

SEQ ID NO: 377400 - RNA, 22 nt, Homo sapiens
ucccagaaacgcauauguucau

SEQ ID NO: 377401 - RNA, 22 nt, Homo sapiens
ucccaguuuuucugaauaguca

SEQ ID NO: 377402 - RNA, 22 nt, Homo sapiens
uccccggaugacggccgcuuca

SEQ ID NO: 377403 - RNA, 22 nt, Homo sapiens
uccccugagaccccucagcacu

SEQ ID NO: 377404 - RNA, 19 nt, Homo sapiens
ucuaaaucucuugauagac

SEQ ID NO: 377405 - RNA, 22 nt, Homo sapiens
gcaugcacaugugaaaaaauga

SEQ ID NO: 377406 - RNA, 22 nt, Homo sapiens
gccuuuggugacaggcaugugu

SEQ ID NO: 377407 - RNA, 22 nt, Homo sapiens
gcugcuguaccagaugugguua

SEQ ID NO: 377408 - RNA, 19 nt, Homo sapiens
gcuucuugaggacgaugac

SEQ ID NO: 377409 - RNA, 21 nt, Homo sapiens
ggaauuuagggaaugauuuag

SEQ ID NO: 377410 - RNA, 22 nt, Homo sapiens
ggacugagaggacuacagugua

SEQ ID NO: 377411 - RNA, 22 nt, Homo sapiens
ggaucacuugagaccaggaguu

SEQ ID NO: 377412 - RNA, 22 nt, Homo sapiens
ggcaaagagacaugcaucgggg

SEQ ID NO: 377413 - RNA, 22 nt, Homo sapiens
ggcccugauacaaguaaggucu

SEQ ID NO: 377414 - RNA, 22 nt, Homo sapiens
ggggcaaaaugccacgagucuc

SEQ ID NO: 377415 - RNA, 19 nt, Homo sapiens
ggucagcaaagucuagcug

SEQ ID NO: 377416 - RNA, 22 nt, Homo sapiens
guacacauacauauaugugugu

SEQ ID NO: 377417 - RNA, 22 nt, Homo sapiens
guaugacacaggaagcuuaacc

SEQ ID NO: 377418 - RNA, 22 nt, Homo sapiens
gucagagcacugaguugugggc

SEQ ID NO: 377419 - RNA, 22 nt, Homo sapiens
gugagcagagaucgcgugauug

SEQ ID NO: 377420 - RNA, 20 nt, Homo sapiens
gugagucauuaguaaccaaa

SEQ ID NO: 377421 - RNA, 22 nt, Homo sapiens
gugaugguccagggaaucucuu

SEQ ID NO: 377422 - RNA, 22 nt, Homo sapiens
guggcagaaaagagaagcaaug

SEQ ID NO: 377423 - RNA, 20 nt, Homo sapiens
gugggcaaauccuuuccucu

SEQ ID NO: 377424 - RNA, 22 nt, Homo sapiens
gugguguuugagcugccaggga

SEQ ID NO: 377425 - RNA, 22 nt, Homo sapiens
gugguuuuacaaagagaaagau

SEQ ID NO: 377426 - RNA, 22 nt, Homo sapiens
gugguuuuaucccagaaauuaa

SEQ ID NO: 377427 - RNA, 22 nt, Homo sapiens
gugguuuuuaaaguaccugugg

SEQ ID NO: 377428 - RNA, 22 nt, Homo sapiens
gugguuuuuuucugccuuauag

SEQ ID NO: 377429 - RNA, 23 nt, Homo sapiens
guuaagugaauguguacucuauu

SEQ ID NO: 377430 - RNA, 22 nt, Homo sapiens
guucagcaggggcuucaauggu

SEQ ID NO: 377431 - RNA, 20 nt, Homo sapiens
guucccuguaggugugcgga

SEQ ID NO: 377432 - RNA, 22 nt, Homo sapiens
guuuggcucuuguuucugucaa

SEQ ID NO: 377433 - RNA, 22 nt, Homo sapiens
uaagaugaaggcucaccuagaa

SEQ ID NO: 377434 - RNA, 22 nt, Homo sapiens
uaagugaauguuggcuacugaa

SEQ ID NO: 377435 - RNA, 20 nt, Homo sapiens
uaagugcauaggauauuucu

SEQ ID NO: 377436 - RNA, 22 nt, Homo sapiens
uaaugugaauagugcuguaaug

SEQ ID NO: 377437 - RNA, 22 nt, Homo sapiens
uagaacaauugcuggauccgaa

SEQ ID NO: 377438 - RNA, 22 nt, Homo sapiens
uagcacaucuucuuggccugca

SEQ ID NO: 377439 - RNA, 22 nt, Homo sapiens
uagcagcuuuauugagguaaau

SEQ ID NO: 377440 - RNA, 22 nt, Homo sapiens
uagcuggaguuuuuguuauagg

SEQ ID NO: 377441 - RNA, 22 nt, Homo sapiens
uaggcaguuuuccuuucacagu

SEQ ID NO: 377442 - RNA, 22 nt, Homo sapiens
uauucaagccaaauucaagcca

SEQ ID NO: 377443 - RNA, 22 nt, Homo sapiens
ucaaaaucucuuagcugugucu

SEQ ID NO: 377444 - RNA, 22 nt, Homo sapiens
ucaaagugacaaaguugcagca

SEQ ID NO: 377445 - RNA, 22 nt, Homo sapiens
ucacaggguguuauuagaauua

SEQ ID NO: 377446 - RNA, 22 nt, Homo sapiens
ucagagcaaagacacuuuauca

SEQ ID NO: 377447 - RNA, 22 nt, Homo sapiens
ucagaugcauccauaccccacu

SEQ ID NO: 377448 - RNA, 20 nt, Homo sapiens
ucaggcuccgcauuaacuua

SEQ ID NO: 377449 - RNA, 22 nt, Homo sapiens
ucauacaguaguccucacuugu

SEQ ID NO: 377450 - RNA, 21 nt, Homo sapiens
ucaucaagcuguagacaugau

SEQ ID NO: 377451 - RNA, 22 nt, Homo sapiens
ucucuuggcggaaguugcagug

SEQ ID NO: 377452 - RNA, 22 nt, Homo sapiens
ucucuugguugaacaguuugga

SEQ ID NO: 377453 - RNA, 22 nt, Homo sapiens
ucuggcacugaugugggaugcu

SEQ ID NO: 377454 - RNA, 22 nt, Homo sapiens
ucugguggugaugagagacagu

SEQ ID NO: 377455 - RNA, 22 nt, Homo sapiens
ucugugguuguugcauggaaug

SEQ ID NO: 377456 - RNA, 22 nt, Homo sapiens
ugaacacuggauaaggagucag

SEQ ID NO: 377457 - RNA, 22 nt, Homo sapiens
ugaauauguuucuaaaagugca

SEQ ID NO: 377458 - RNA, 22 nt, Homo sapiens
ugaaugguaauuuaguaggcac

SEQ ID NO: 377459 - RNA, 22 nt, Homo sapiens
ugacagugaacagguuaccacu

SEQ ID NO: 377460 - RNA, 22 nt, Homo sapiens
ugacaugaagucucccucuguu

SEQ ID NO: 377461 - RNA, 22 nt, Homo sapiens
ugacaugauguuccuacacugu

SEQ ID NO: 377462 - RNA, 22 nt, Homo sapiens
ugacaugauuguauauuuagaa

SEQ ID NO: 377463 - RNA, 22 nt, Homo sapiens
ugacucuagagcugccuguggc

SEQ ID NO: 377464 - RNA, 22 nt, Homo sapiens
ugagaacagauggcuuuauuau

SEQ ID NO: 377465 - RNA, 22 nt, Homo sapiens
ugagaagaugaacuccuugguc

SEQ ID NO: 377466 - RNA, 22 nt, Homo sapiens
ugagacauacuuacaggggaug

SEQ ID NO: 377467 - RNA, 22 nt, Homo sapiens
ugagacgaagucucguucugua

SEQ ID NO: 377468 - RNA, 22 nt, Homo sapiens
ugagaugaguucucgcucuguc

SEQ ID NO: 377469 - RNA, 22 nt, Homo sapiens
ugagaugaguugcuggcucuga

SEQ ID NO: 377470 - RNA, 22 nt, Homo sapiens
ugaggagugagaaauugguuuc

SEQ ID NO: 377471 - RNA, 22 nt, Homo sapiens
ugagguaugacuuauuauucuu

SEQ ID NO: 377472 - RNA, 22 nt, Homo sapiens
ugauaugacagcucugcugcca

SEQ ID NO: 377473 - RNA, 22 nt, Homo sapiens
ugcaaauguuaggugucauuau

SEQ ID NO: 377474 - RNA, 22 nt, Homo sapiens
ugcagaaucccuucagauccga

SEQ ID NO: 377475 - RNA, 22 nt, Homo sapiens
ugcauauguauacaugugccau

SEQ ID NO: 377476 - RNA, 22 nt, Homo sapiens
ugcauggaagggagggaaagag

SEQ ID NO: 377477 - RNA, 22 nt, Homo sapiens
ugccaugaagagaggaagcagu

SEQ ID NO: 377478 - RNA, 22 nt, Homo sapiens
ugccaugaaguaauggcaaaaa

SEQ ID NO: 377479 - RNA, 18 nt, Homo sapiens
ugcuccccugggugagca

SEQ ID NO: 377480 - RNA, 22 nt, Homo sapiens
uggcaaagugugacgugggggu

SEQ ID NO: 377481 - RNA, 22 nt, Homo sapiens
uggcauguagucugggaccugg

SEQ ID NO: 377482 - RNA, 22 nt, Homo sapiens
uggcauguguuugaaugaguau

SEQ ID NO: 377483 - RNA, 22 nt, Homo sapiens
gagcuacacugauucauuuguu

SEQ ID NO: 377484 - RNA, 22 nt, Homo sapiens
gagcuagcauuuagacaucugg

SEQ ID NO: 377485 - RNA, 22 nt, Homo sapiens
gaggcagucugucccuuagcag

SEQ ID NO: 377486 - RNA, 22 nt, Homo sapiens
gauaaagauagcaauagggaca

SEQ ID NO: 377487 - RNA, 22 nt, Homo sapiens
gaucucaguggauacugugaug

SEQ ID NO: 377488 - RNA, 22 nt, Homo sapiens
gaugccuauugcuaguccuaaa

SEQ ID NO: 377489 - RNA, 22 nt, Homo sapiens
gcacagaugaggagaggucuca

SEQ ID NO: 377490 - RNA, 22 nt, Homo sapiens
gcagaauugacucuguuuuuuc

SEQ ID NO: 377491 - RNA, 22 nt, Homo sapiens
gcagagaaacaggucuaaggag

SEQ ID NO: 377492 - RNA, 22 nt, Homo sapiens
aaaccacagugugcugcugggg

SEQ ID NO: 377493 - RNA, 22 nt, Homo sapiens
aaagggcacugugcuuuggcaa

SEQ ID NO: 377494 - RNA, 22 nt, Homo sapiens
aacaguguuuuggguuuucugg

SEQ ID NO: 377495 - RNA, 22 nt, Homo sapiens
aacuacaucucuuugaggcagg

SEQ ID NO: 377496 - RNA, 23 nt, Homo sapiens
aagagguaugacuaugaagugga

SEQ ID NO: 377497 - RNA, 20 nt, Homo sapiens
aagcaagcauuugcaaucau

SEQ ID NO: 377498 - RNA, 22 nt, Homo sapiens
aaggcaugcugaguccuaaaag

SEQ ID NO: 377499 - RNA, 22 nt, Homo sapiens
aagggaaugugguagcugguuu

SEQ ID NO: 377500 - RNA, 22 nt, Homo sapiens
aagguacuggaaagaggaaugg

SEQ ID NO: 377501 - RNA, 22 nt, Homo sapiens
aaggugcucucuuauguagaaa

SEQ ID NO: 377502 - RNA, 22 nt, Homo sapiens
aaguaguuaggaacauucucuc

SEQ ID NO: 377503 - RNA, 22 nt, Homo sapiens
aagugcaaaucuguggcugaaa

SEQ ID NO: 377504 - RNA, 22 nt, Homo sapiens
aagugucagaguugcuaaugac

SEQ ID NO: 377505 - RNA, 22 nt, Homo sapiens
aaugacacugagcaucuuucau

SEQ ID NO: 377506 - RNA, 22 nt, Homo sapiens
aauuaguaaccuaauuccaucu

SEQ ID NO: 377507 - RNA, 22 nt, Homo sapiens
acacucuaguguucuuaaucag

SEQ ID NO: 377508 - RNA, 22 nt, Homo sapiens
acagaauucucagaacugggag

SEQ ID NO: 377509 - RNA, 22 nt, Homo sapiens
acagagcaaugagcuacggucu

SEQ ID NO: 377510 - RNA, 22 nt, Homo sapiens
acauaaagaagcaggacauugu

SEQ ID NO: 377511 - RNA, 20 nt, Homo sapiens
acuaaaucucauuuuaugca

SEQ ID NO: 377512 - RNA, 22 nt, Homo sapiens
acucagagagaacugucauuug

SEQ ID NO: 377513 - RNA, 22 nt, Homo sapiens
acucagagauuagcacauguuu

SEQ ID NO: 377514 - RNA, 23 nt, Homo sapiens
acugagcaauguuuacauacuug

SEQ ID NO: 377515 - RNA, 22 nt, Homo sapiens
ugauaugaaguuagcuggcugu

SEQ ID NO: 377516 - RNA, 22 nt, Homo sapiens
ugauaugaaucaaucacucuuc

SEQ ID NO: 377517 - RNA, 22 nt, Homo sapiens
ugcaaaguccucauucuuaccc

SEQ ID NO: 377518 - RNA, 22 nt, Homo sapiens
ugcaaaugcugcuauuucucuu

SEQ ID NO: 377519 - RNA, 22 nt, Homo sapiens
ugcacugucuugucgcauagca

SEQ ID NO: 377520 - RNA, 22 nt, Homo sapiens
ugcagagaaacauuuuguauuu

SEQ ID NO: 377521 - RNA, 22 nt, Homo sapiens
ugcagugugcuggggucuccau

SEQ ID NO: 377522 - RNA, 22 nt, Homo sapiens
ugcuagaagaucacacacauca

SEQ ID NO: 377523 - RNA, 21 nt, Homo sapiens
ugcugcacuucuuuugcugug

SEQ ID NO: 377524 - RNA, 22 nt, Homo sapiens
uggagaacugaugucuccaaga

SEQ ID NO: 377525 - RNA, 22 nt, Homo sapiens
uggcagugggagauauuuuauu

SEQ ID NO: 377526 - RNA, 22 nt, Homo sapiens
uggcaugucagguuucuggguu

SEQ ID NO: 377527 - RNA, 20 nt, Homo sapiens
uggcauguugguaugcaccc

SEQ ID NO: 377528 - RNA, 22 nt, Homo sapiens
uggccagugucuauugguuucc

SEQ ID NO: 377529 - RNA, 22 nt, Homo sapiens
uggccaguguuuuuccugggcu

SEQ ID NO: 377530 - RNA, 22 nt, Homo sapiens
uggccaguuuuuaauugggucu

SEQ ID NO: 377531 - RNA, 22 nt, Homo sapiens
uggccuguaacccucucauagg

SEQ ID NO: 377532 - RNA, 22 nt, Homo sapiens
ugggagugugcacaauuucagc

SEQ ID NO: 377533 - RNA, 22 nt, Homo sapiens
ugggcaaaacuaagagcugugg

SEQ ID NO: 377534 - RNA, 22 nt, Homo sapiens
ugggcaaaugcuuuuuagucaa

SEQ ID NO: 377535 - RNA, 22 nt, Homo sapiens
ugguucaguugcacaggcuguu

SEQ ID NO: 377536 - RNA, 22 nt, Homo sapiens
ugucucagugauuggcuuucug

SEQ ID NO: 377537 - RNA, 22 nt, Homo sapiens
ugucucaguuucuguggguuag

SEQ ID NO: 377538 - RNA, 22 nt, Homo sapiens
ugucuuggagaauccuggguuu

SEQ ID NO: 377539 - RNA, 22 nt, Homo sapiens
ugugucuugaauuuuguaugua

SEQ ID NO: 377540 - RNA, 16 nt, Homo sapiens
ugugucuugggcccug

SEQ ID NO: 377541 - RNA, 22 nt, Homo sapiens
ugugucuuuuaucacacaaugu

SEQ ID NO: 377542 - RNA, 22 nt, Homo sapiens
uuaaguuaggcuucagcagucu

SEQ ID NO: 377543 - RNA, 22 nt, Homo sapiens
uuaaguuguagcuacaaauaca

SEQ ID NO: 377544 - RNA, 21 nt, Homo sapiens
uuaggcagugucagaggugag

SEQ ID NO: 377545 - RNA, 22 nt, Homo sapiens
uuagggcaggcaugagagaacu

SEQ ID NO: 377546 - RNA, 22 nt, Homo sapiens
uucaagugguucagaagucuga

SEQ ID NO: 377547 - RNA, 22 nt, Homo sapiens
uucagagcauugguuuuuugaa

SEQ ID NO: 377548 - RNA, 22 nt, Homo sapiens
uuccauaggcuagaucaaccag

SEQ ID NO: 377549 - RNA, 22 nt, Homo sapiens
uuccauagucauagugcugaug

SEQ ID NO: 377550 - RNA, 22 nt, Homo sapiens
uucccagagccugggagugagg

SEQ ID NO: 377551 - RNA, 22 nt, Homo sapiens
agagcaccauuuagcaagguga

SEQ ID NO: 377552 - RNA, 22 nt, Homo sapiens
agagguuuaacuggcuuauggu

SEQ ID NO: 377553 - RNA, 22 nt, Homo sapiens
agagguuuugcacugguucuuu

SEQ ID NO: 377554 - RNA, 20 nt, Homo sapiens
agagugcuggacugaggagc

SEQ ID NO: 377555 - RNA, 22 nt, Homo sapiens
agaugauguuuacugagcauca

SEQ ID NO: 377556 - RNA, 22 nt, Homo sapiens
agcaaaucuaugaauguauauu

SEQ ID NO: 377557 - RNA, 22 nt, Homo sapiens
agcacagugguuaaguuucuua

SEQ ID NO: 377558 - RNA, 22 nt, Homo sapiens
agcaccacauacuacagagaua

SEQ ID NO: 377559 - RNA, 22 nt, Homo sapiens
agcaucagugauuuuguugaag

SEQ ID NO: 377560 - RNA, 22 nt, Homo sapiens
agcgccauugcacuccagccuu

SEQ ID NO: 377561 - RNA, 22 nt, Homo sapiens
agcugcacaaauggaugugagg

SEQ ID NO: 377562 - RNA, 22 nt, Homo sapiens
agcuuguguuuuucuaaguauc

SEQ ID NO: 377563 - RNA, 22 nt, Homo sapiens
aggagguugguaccaucuguuu

SEQ ID NO: 377564 - RNA, 22 nt, Homo sapiens
aggcauguggcucuguucugac

SEQ ID NO: 377565 - RNA, 22 nt, Homo sapiens
aggcauguugcuucgggcuuug

SEQ ID NO: 377566 - RNA, 19 nt, Homo sapiens
aggcauugugcucaucugu

SEQ ID NO: 377567 - RNA, 22 nt, Homo sapiens
aggugcugacaggauagguuuc

SEQ ID NO: 377568 - RNA, 22 nt, Homo sapiens
auaagugcuuguugaauaauag

SEQ ID NO: 377569 - RNA, 22 nt, Homo sapiens
auagcacacuauagcuucaaac

SEQ ID NO: 377570 - RNA, 22 nt, Homo sapiens
auagugcagugaugaaccuagg

SEQ ID NO: 377571 - RNA, 22 nt, Homo sapiens
auaugcacuauacacacguaua

SEQ ID NO: 377572 - RNA, 22 nt, Homo sapiens
aucacagaacuuugagcagaga

SEQ ID NO: 377573 - RNA, 20 nt, Homo sapiens
aucagagccggugaaagggc

SEQ ID NO: 377574 - RNA, 22 nt, Homo sapiens
aucagagccugugugcccugaa

SEQ ID NO: 377575 - RNA, 22 nt, Homo sapiens
aucccaguaaaaauggcuucua

SEQ ID NO: 377576 - RNA, 21 nt, Homo sapiens
aucugugagaccuuggggguu

SEQ ID NO: 377577 - RNA, 22 nt, Homo sapiens
aucuguguuuaaggucccagaa

SEQ ID NO: 377578 - RNA, 22 nt, Homo sapiens
augaauuuucugauguugggua

SEQ ID NO: 377579 - RNA, 22 nt, Homo sapiens
augacaguaugacuccaaaagu

SEQ ID NO: 377580 - RNA, 22 nt, Homo sapiens
augagacaguucccuuuaucuu

SEQ ID NO: 377581 - RNA, 22 nt, Homo sapiens
augagggaagcucacgugucca

SEQ ID NO: 377582 - RNA, 22 nt, Homo sapiens
auggacagacacuggccuucug

SEQ ID NO: 377583 - RNA, 22 nt, Homo sapiens
auggcucuggauagaaugcagg

SEQ ID NO: 377584 - RNA, 22 nt, Homo sapiens
augguaguagaugugugguuuu

SEQ ID NO: 377585 - RNA, 22 nt, Homo sapiens
augguuuauuuguaagcagagu

SEQ ID NO: 377586 - RNA, 22 nt, Homo sapiens
augguuuuacugcaaaauggga

SEQ ID NO: 377587 - RNA, 18 nt, Homo sapiens
auugagcaugacagaccu

SEQ ID NO: 377588 - RNA, 22 nt, Homo sapiens
auugcacaucugcacuacagcc

SEQ ID NO: 377589 - RNA, 22 nt, Homo sapiens
auuugggaaugugcauuauacu

SEQ ID NO: 377590 - RNA, 19 nt, Homo sapiens
caccagugcaugcuacuau

SEQ ID NO: 377591 - RNA, 22 nt, Homo sapiens
cacugcacuccagcuugugggc

SEQ ID NO: 377592 - RNA, 22 nt, Homo sapiens
cagauacuggaguccugaaguu

SEQ ID NO: 377593 - RNA, 22 nt, Homo sapiens
cagauggucuuaaggcagccuu

SEQ ID NO: 377594 - RNA, 22 nt, Homo sapiens
caggcagugggagacaaaacug

SEQ ID NO: 377595 - RNA, 22 nt, Homo sapiens
caggcauuguccaugcugaagg

SEQ ID NO: 377596 - RNA, 22 nt, Homo sapiens
cagugcuuuaucaaguccucca

SEQ ID NO: 377597 - RNA, 22 nt, Homo sapiens
cauagcacacguauaccuaugu

SEQ ID NO: 377598 - RNA, 19 nt, Homo sapiens
caucacagagucuuccauu

SEQ ID NO: 377599 - RNA, 19 nt, Homo sapiens
caugccacugcacuugagu

SEQ ID NO: 377600 - RNA, 22 nt, Homo sapiens
cauggcccugggcugggcgaac

SEQ ID NO: 377601 - RNA, 22 nt, Homo sapiens
cauggcucuuguuuacucccag

SEQ ID NO: 377602 - RNA, 22 nt, Homo sapiens
ccacaguugaaauuuugacugu

SEQ ID NO: 377603 - RNA, 22 nt, Homo sapiens
ccacccuggagaauuugagguc

SEQ ID NO: 377604 - RNA, 22 nt, Homo sapiens
ccaguuuuucauuuauacuagu

SEQ ID NO: 377605 - RNA, 22 nt, Homo sapiens
cccagugguuacauaaggagua

SEQ ID NO: 377606 - RNA, 22 nt, Homo sapiens
ccccagugguugcaacagcaga

SEQ ID NO: 377607 - RNA, 20 nt, Homo sapiens
cccuaagccagaugcugggg

SEQ ID NO: 377608 - RNA, 22 nt, Homo sapiens
cggcaguggguaagccaagcuu

SEQ ID NO: 377609 - RNA, 22 nt, Homo sapiens
cuagaagcauauucagaacaga

SEQ ID NO: 377610 - RNA, 22 nt, Homo sapiens
cuagcacauaguuauucacuca

SEQ ID NO: 377611 - RNA, 22 nt, Homo sapiens
cugagcaaaaugaagacacgau

SEQ ID NO: 377612 - RNA, 20 nt, Homo sapiens
cugaggugggagaaucgcuu

SEQ ID NO: 377613 - RNA, 22 nt, Homo sapiens
cugaugguuuuacacaagggca

SEQ ID NO: 377614 - RNA, 22 nt, Homo sapiens
cugauguagguggucugugauc

SEQ ID NO: 377615 - RNA, 20 nt, Homo sapiens
cugcuccccuacaaaucuca

SEQ ID NO: 377616 - RNA, 22 nt, Homo sapiens
cuggcaauaaauuuuuguguug

SEQ ID NO: 377617 - RNA, 22 nt, Homo sapiens
cugugaagaaagucauugguag

SEQ ID NO: 377618 - RNA, 22 nt, Homo sapiens
cugugcuugauuauaugagugu

SEQ ID NO: 377619 - RNA, 22 nt, Homo sapiens
cuugacaucugucaguuccuca

SEQ ID NO: 377620 - RNA, 22 nt, Homo sapiens
cuugagcaaacaaaggugguag

SEQ ID NO: 377621 - RNA, 22 nt, Homo sapiens
gaaaugcucauuuuggauccuu

SEQ ID NO: 377622 - RNA, 22 nt, Homo sapiens
gaagugcaguggcacagucaug

SEQ ID NO: 377623 - RNA, 22 nt, Homo sapiens
gaaugaauguuuauccuuagau

SEQ ID NO: 377624 - RNA, 22 nt, Homo sapiens
gagauugucaugauuacauugu

SEQ ID NO: 377625 - RNA, 18 nt, Homo sapiens
gagcaccuuuuuugcaga

SEQ ID NO: 377626 - RNA, 22 nt, Homo sapiens
ucucauggcucacccugcauag

SEQ ID NO: 377627 - RNA, 22 nt, Homo sapiens
ucucuggauaucuacuuauguu

SEQ ID NO: 377628 - RNA, 22 nt, Homo sapiens
ucugagcaauaaacaacauauu

SEQ ID NO: 377629 - RNA, 23 nt, Homo sapiens
ucugauguuauaaaauucuuugg

SEQ ID NO: 377630 - RNA, 22 nt, Homo sapiens
ucuguguuuagacccaggguag

SEQ ID NO: 377631 - RNA, 22 nt, Homo sapiens
ugaacagcacguuuauucagaa

SEQ ID NO: 377632 - RNA, 18 nt, Homo sapiens
ugacauugagcugagaaa

SEQ ID NO: 377633 - RNA, 22 nt, Homo sapiens
ugacauugggagugaagugaag

SEQ ID NO: 377634 - RNA, 22 nt, Homo sapiens
ugagaagacaucagcuuucgga

SEQ ID NO: 377635 - RNA, 22 nt, Homo sapiens
ugagaaugaugauuuccaguuu

SEQ ID NO: 377636 - RNA, 22 nt, Homo sapiens
ugagacaucugagauuuuaagc

SEQ ID NO: 377637 - RNA, 22 nt, Homo sapiens
ugagagcugguuguuuaaagga

SEQ ID NO: 377638 - RNA, 22 nt, Homo sapiens
ugagauggagucuugucgccua

SEQ ID NO: 377639 - RNA, 22 nt, Homo sapiens
ugagcacuguacuuuaucaggu

SEQ ID NO: 377640 - RNA, 22 nt, Homo sapiens
ugaguauguaggaugugucuua

SEQ ID NO: 377641 - RNA, 22 nt, Homo sapiens
ugaguuccuugugugaccuugc

SEQ ID NO: 377642 - RNA, 22 nt, Homo sapiens
ugaguuuaucuaaagaccuggg

SEQ ID NO: 377643 - RNA, 21 nt, Homo sapiens
ugaucacaugaaaaccaugca

SEQ ID NO: 377644 - RNA, 22 nt, Homo sapiens
ugaugcugaguggcuauuugaa

SEQ ID NO: 377645 - RNA, 22 nt, Homo sapiens
ugaugucuugagauggagcuua

SEQ ID NO: 377646 - RNA, 22 nt, Homo sapiens
ugauguugacuguaggcagaga

SEQ ID NO: 377647 - RNA, 22 nt, Homo sapiens
ugcaccacugcacuccacccug

SEQ ID NO: 377648 - RNA, 22 nt, Homo sapiens
ugccaugaagaucccugaaaug

SEQ ID NO: 377649 - RNA, 19 nt, Homo sapiens
ugccauguaacaggaaaau

SEQ ID NO: 377650 - RNA, 18 nt, Homo sapiens
ugcuaugagauuauuuua

SEQ ID NO: 377651 - RNA, 20 nt, Homo sapiens
ugcugcacuuaagcaugggc

SEQ ID NO: 377652 - RNA, 22 nt, Homo sapiens
ugcuggugauuaaauccugaag

SEQ ID NO: 377653 - RNA, 22 nt, Homo sapiens
uggaugacauccuuguaugcag

SEQ ID NO: 377654 - RNA, 22 nt, Homo sapiens
uggcaugauguguucauugaaa

SEQ ID NO: 377655 - RNA, 22 nt, Homo sapiens
uggcauguuggguguugacucc

SEQ ID NO: 377656 - RNA, 22 nt, Homo sapiens
uggucagaugcugaguggaucu

SEQ ID NO: 377657 - RNA, 21 nt, Homo sapiens
uguagcagcauaauuuauaau

SEQ ID NO: 377658 - RNA, 19 nt, Homo sapiens
ugugagcauuagcauuuag

SEQ ID NO: 377659 - RNA, 21 nt, Homo sapiens
uguggcaauggccucacagau

SEQ ID NO: 377660 - RNA, 22 nt, Homo sapiens
uguggcuuuguaaccauggguc

SEQ ID NO: 377661 - RNA, 22 nt, Homo sapiens
uuaagcugaauuuaagcuucgg

SEQ ID NO: 377662 - RNA, 20 nt, Homo sapiens
uuaagugcuuucugcuuaga

SEQ ID NO: 377663 - RNA, 23 nt, Homo sapiens
uuaagugcuuuucugaaacucuu

SEQ ID NO: 377664 - RNA, 22 nt, Homo sapiens
uuagcacauuuccagcacaugg

SEQ ID NO: 377665 - RNA, 22 nt, Homo sapiens
uuagcagcacaaaagcagacua

SEQ ID NO: 377666 - RNA, 22 nt, Homo sapiens
uuagcagcucuggugacaaggu

SEQ ID NO: 377667 - RNA, 22 nt, Homo sapiens
uucaagucaacaagcacuugag

SEQ ID NO: 377668 - RNA, 22 nt, Homo sapiens
uucaagucaauuuuugaaugac

SEQ ID NO: 377669 - RNA, 22 nt, Homo sapiens
uucuaaguaauuuugcaugccu

SEQ ID NO: 377670 - RNA, 22 nt, Homo sapiens
uucugcacaucgaucacaagau

SEQ ID NO: 377671 - RNA, 23 nt, Homo sapiens
uugaggcauguaccaucaauauc

SEQ ID NO: 377672 - RNA, 22 nt, Homo sapiens
uugcaugucugcuucuccuccu

SEQ ID NO: 377673 - RNA, 22 nt, Homo sapiens
uugggauggaacuuuucaguga

SEQ ID NO: 377674 - RNA, 22 nt, Homo sapiens
uugguccccuucaaccagcugu

SEQ ID NO: 377675 - RNA, 22 nt, Homo sapiens
uuuacaguuuucuaggcuacca

SEQ ID NO: 377676 - RNA, 22 nt, Homo sapiens
uuucaguguggcaggcauagcu

SEQ ID NO: 377677 - RNA, 22 nt, Homo sapiens
uuucauaguuugcauagggcau

SEQ ID NO: 377678 - RNA, 22 nt, Homo sapiens
uuugacuguggagucgaugcuu

SEQ ID NO: 377679 - RNA, 22 nt, Homo sapiens
uuuggcuuaagauugacugcaa

SEQ ID NO: 377680 - RNA, 22 nt, Homo sapiens
uuuuggcuagaaauauaccucc

SEQ ID NO: 377681 - RNA, 18 nt, Homo sapiens
uguuugguucugcgccuc

SEQ ID NO: 377682 - RNA, 22 nt, Homo sapiens
uuaaaugcuagaauuuucuuug

SEQ ID NO: 377683 - RNA, 22 nt, Homo sapiens
uuaagugcucaguuacucaguu

SEQ ID NO: 377684 - RNA, 22 nt, Homo sapiens
uuaccacagugccugucuaaug

SEQ ID NO: 377685 - RNA, 20 nt, Homo sapiens
uuagcagcaugauuuauaau

SEQ ID NO: 377686 - RNA, 16 nt, Homo sapiens
uuaggcagugugauac

SEQ ID NO: 377687 - RNA, 22 nt, Homo sapiens
uuaggcaguuuauugauuuuca

SEQ ID NO: 377688 - RNA, 22 nt, Homo sapiens
uuaugucuuuuguguucagcua

SEQ ID NO: 377689 - RNA, 22 nt, Homo sapiens
uucacugcaugaaaaggacagc

SEQ ID NO: 377690 - RNA, 22 nt, Homo sapiens
uucucaaggagccuucguaacu

SEQ ID NO: 377691 - RNA, 22 nt, Homo sapiens
uucucauggaacaucuguacug

SEQ ID NO: 377692 - RNA, 22 nt, Homo sapiens
uucugccaaucaacccacaucc

SEQ ID NO: 377693 - RNA, 22 nt, Homo sapiens
uucuguguuuaggucacggcua

SEQ ID NO: 377694 - RNA, 22 nt, Homo sapiens
uugaaguagguaccguucaauu

SEQ ID NO: 377695 - RNA, 22 nt, Homo sapiens
uugagaaucuuugcuaaaggaa

SEQ ID NO: 377696 - RNA, 22 nt, Homo sapiens
uugagcacauguguuaaggggu

SEQ ID NO: 377697 - RNA, 22 nt, Homo sapiens
uuggcaaucaauucugacgucu

SEQ ID NO: 377698 - RNA, 22 nt, Homo sapiens
uuggcccugcugaccauucccu

SEQ ID NO: 377699 - RNA, 22 nt, Homo sapiens
uuggcuucuggacuauugugca

SEQ ID NO: 377700 - RNA, 21 nt, Homo sapiens
uuggggaauggagagguuuuc

SEQ ID NO: 377701 - RNA, 22 nt, Homo sapiens
uuguccauggacagcaccacag

SEQ ID NO: 377702 - RNA, 22 nt, Homo sapiens
uugugguuuucagcuuauauau

SEQ ID NO: 377703 - RNA, 22 nt, Homo sapiens
uuucaggcaagggugacccuga

SEQ ID NO: 377704 - RNA, 16 nt, Homo sapiens
uuucccuuugguguuu

SEQ ID NO: 377705 - RNA, 22 nt, Homo sapiens
uuuggcuguuucuggacuaaga

SEQ ID NO: 377706 - RNA, 21 nt, Homo sapiens
uguagcagcaugauuuauaau

SEQ ID NO: 377707 - RNA, 22 nt, Homo sapiens
uguaugguuauuuguggauggu

SEQ ID NO: 377708 - RNA, 23 nt, Homo sapiens
ugucaucaagaugaggucacacu

SEQ ID NO: 377709 - RNA, 22 nt, Homo sapiens
ugucccugagccuggauuccug

SEQ ID NO: 377710 - RNA, 22 nt, Homo sapiens
ugucucaguucccuucucugga

SEQ ID NO: 377711 - RNA, 22 nt, Homo sapiens
ugugcuuguaaaggccagagca

SEQ ID NO: 377712 - RNA, 22 nt, Homo sapiens
ugugucuugcuggugccugcau

SEQ ID NO: 377713 - RNA, 22 nt, Homo sapiens
ugugucuuguuuauagcuuucu

SEQ ID NO: 377714 - RNA, 22 nt, Homo sapiens
uguucaugaguucucauuuuua

SEQ ID NO: 377715 - RNA, 22 nt, Homo sapiens
uuaaaguguuugcagacaggug

SEQ ID NO: 377716 - RNA, 22 nt, Homo sapiens
uuaagugaauuaucuaacaugu

SEQ ID NO: 377717 - RNA, 21 nt, Homo sapiens
uuaagugcuuuguaugcacua

SEQ ID NO: 377718 - RNA, 22 nt, Homo sapiens
uuagcagccuucaagcuccaag

SEQ ID NO: 377719 - RNA, 22 nt, Homo sapiens
uucacaugguugccuuuugauc

SEQ ID NO: 377720 - RNA, 22 nt, Homo sapiens
uucacuguagccucagccucuu

SEQ ID NO: 377721 - RNA, 22 nt, Homo sapiens
uucaucagcuguagaugucaug

SEQ ID NO: 377722 - RNA, 22 nt, Homo sapiens
uugaaugaaauuggugugggga

SEQ ID NO: 377723 - RNA, 22 nt, Homo sapiens
uugacauaaucauuucacagug

SEQ ID NO: 377724 - RNA, 22 nt, Homo sapiens
uugagcaccaugccuggccaug

SEQ ID NO: 377725 - RNA, 22 nt, Homo sapiens
uugaggcaaugaggagaagcug

SEQ ID NO: 377726 - RNA, 22 nt, Homo sapiens
uugagggaaacauucacaucau

SEQ ID NO: 377727 - RNA, 22 nt, Homo sapiens
uugcacucuccagccucggcaa

SEQ ID NO: 377728 - RNA, 22 nt, Homo sapiens
uuggcaauauuuacugaaguug

SEQ ID NO: 377729 - RNA, 22 nt, Homo sapiens
uuggcaauucagauucuuuuau

SEQ ID NO: 377730 - RNA, 21 nt, Homo sapiens
uuggucuucucugugauucuu

SEQ ID NO: 377731 - RNA, 22 nt, Homo sapiens
uuuaaguguuuguuccugaaaa

SEQ ID NO: 377732 - RNA, 18 nt, Homo sapiens
uuuacaguagaaggacuu

SEQ ID NO: 377733 - RNA, 22 nt, Homo sapiens
uuuacagucucauagguggaag

SEQ ID NO: 377734 - RNA, 22 nt, Homo sapiens
uuugcuugaggucuagcuaccc

SEQ ID NO: 377735 - RNA, 22 nt, Homo sapiens
uuuuggcucuugguaggucaga

SEQ ID NO: 377736 - RNA, 22 nt, Homo sapiens
uggcuuuuauuauguugaggua

SEQ ID NO: 377737 - RNA, 22 nt, Homo sapiens
ugggaacaugaagguuaaagag

SEQ ID NO: 377738 - RNA, 22 nt, Homo sapiens
ugggcaaauugugagggaggua

SEQ ID NO: 377739 - RNA, 21 nt, Homo sapiens
ugggccccuuccuuacaucau

SEQ ID NO: 377740 - RNA, 22 nt, Homo sapiens
uggggugugagggagaaagaaa

SEQ ID NO: 377741 - RNA, 22 nt, Homo sapiens
uggucuucuggccuccagaacc

SEQ ID NO: 377742 - RNA, 22 nt, Homo sapiens
aauuaguuggcugggugcggug

SEQ ID NO: 377743 - RNA, 22 nt, Homo sapiens
agaaugugaccuuauuuggaga

SEQ ID NO: 377744 - RNA, 22 nt, Homo sapiens
agaauguuuuagaccaauacaa

SEQ ID NO: 377745 - RNA, 22 nt, Homo sapiens
agagaugauuaacauuuuggua

SEQ ID NO: 377746 - RNA, 22 nt, Homo sapiens
aggugguuuuaggcagagacau

SEQ ID NO: 377747 - RNA, 22 nt, Homo sapiens
aggugguuuugaugagcaggua

SEQ ID NO: 377748 - RNA, 22 nt, Homo sapiens
auaaauaguaguugugguggcc

SEQ ID NO: 377749 - RNA, 22 nt, Homo sapiens
auagcagacauuucaaggcagg

SEQ ID NO: 377750 - RNA, 22 nt, Homo sapiens
aucccuguaguaauauucuagc

SEQ ID NO: 377751 - RNA, 22 nt, Homo sapiens
aucgcacuccauccugggcaac

SEQ ID NO: 377752 - RNA, 22 nt, Homo sapiens
augaggcacugcgcccuacuga

SEQ ID NO: 377753 - RNA, 22 nt, Homo sapiens
auugcacuccagccugagcaaa

SEQ ID NO: 377754 - RNA, 22 nt, Homo sapiens
auugcacuccagccugggcaac

SEQ ID NO: 377755 - RNA, 22 nt, Homo sapiens
auugcacuccagccugggcagc

SEQ ID NO: 377756 - RNA, 22 nt, Homo sapiens
auugcacuccagccugggcgac

SEQ ID NO: 377757 - RNA, 22 nt, Homo sapiens
auugcacuccagccugggcuag

SEQ ID NO: 377758 - RNA, 22 nt, Homo sapiens
auugcacuccagucugggcaac

SEQ ID NO: 377759 - RNA, 22 nt, Homo sapiens
cagagagcuugcccuuguauau

SEQ ID NO: 377760 - RNA, 22 nt, Homo sapiens
caucacuuuuccuuuuacagau

SEQ ID NO: 377761 - RNA, 22 nt, Homo sapiens
cauugcacuccagccucggcaa

SEQ ID NO: 377762 - RNA, 22 nt, Homo sapiens
cauugcacuccagccugccugg

SEQ ID NO: 377763 - RNA, 22 nt, Homo sapiens
ccugucuugaagagauccuccu

SEQ ID NO: 377764 - RNA, 22 nt, Homo sapiens
ggagaugaaaugagcuacuuaa

SEQ ID NO: 377765 - RNA, 22 nt, Homo sapiens
gggcaacauugaguacccugaa

SEQ ID NO: 377766 - RNA, 22 nt, Homo sapiens
guaaucucagcuacucaggagg

SEQ ID NO: 377767 - RNA, 19 nt, Homo sapiens
gugguauuaccuuuugauu

SEQ ID NO: 377768 - RNA, 22 nt, Homo sapiens
uaagacuguguaauuuaugaag

SEQ ID NO: 377769 - RNA, 22 nt, Homo sapiens
uaaucucagcuacucaggaggc

SEQ ID NO: 377770 - RNA, 22 nt, Homo sapiens
uaucacuuugauaguuuaaaug

SEQ ID NO: 377771 - RNA, 22 nt, Homo sapiens
ucugucuuguccucacccuaga

SEQ ID NO: 377772 - RNA, 22 nt, Homo sapiens
ucugucuuugucaggaccagag

SEQ ID NO: 377773 - RNA, 22 nt, Homo sapiens
ugagaugaagucucacucuguc

SEQ ID NO: 377774 - RNA, 22 nt, Homo sapiens
ugagaugagaaucaguucuaau

SEQ ID NO: 377775 - RNA, 22 nt, Homo sapiens
ugagaugagucucgcucuguca

SEQ ID NO: 377776 - RNA, 22 nt, Homo sapiens
ugagaugaguugcgcucugucg

SEQ ID NO: 377777 - RNA, 22 nt, Homo sapiens
ugagaugaucaaaguauaggcu

SEQ ID NO: 377778 - RNA, 22 nt, Homo sapiens
ugagcaagaucuuuauaauuag

SEQ ID NO: 377779 - RNA, 22 nt, Homo sapiens
ugagccaugggguaaaugugau

SEQ ID NO: 377780 - RNA, 22 nt, Homo sapiens
uugagcaccaugccuggccaug

SEQ ID NO: 377781 - RNA, 16 nt, Homo sapiens
uugaggcaugucucag

SEQ ID NO: 377782 - RNA, 20 nt, Homo sapiens
uugaggucaggaguuuggga

SEQ ID NO: 377783 - RNA, 22 nt, Homo sapiens
uuggagugugcucauaacugcu

SEQ ID NO: 377784 - RNA, 22 nt, Homo sapiens
aaagagaucuaugggcacuaug

SEQ ID NO: 377785 - RNA, 22 nt, Homo sapiens
aagacuguaauccaucuugagu

SEQ ID NO: 377786 - RNA, 22 nt, Homo sapiens
agagaugaagauggggcucccg

SEQ ID NO: 377787 - RNA, 22 nt, Homo sapiens
agaugauguuuacugagcauca

SEQ ID NO: 377788 - RNA, 22 nt, Homo sapiens
aggcaugaaauacaugcauuga

SEQ ID NO: 377789 - RNA, 22 nt, Homo sapiens
augacugucagggcagucauug

SEQ ID NO: 377790 - RNA, 22 nt, Homo sapiens
augaggcaggaaaggcguaucu

SEQ ID NO: 377791 - RNA, 22 nt, Homo sapiens
auggcacuccagccugggcaac

SEQ ID NO: 377792 - RNA, 22 nt, Homo sapiens
augucuuucauagagacccaga

SEQ ID NO: 377793 - RNA, 22 nt, Homo sapiens
auugaguaaaaaauagugaugu

SEQ ID NO: 377794 - RNA, 19 nt, Homo sapiens
auugcacuccaaccugggu

SEQ ID NO: 377795 - RNA, 22 nt, Homo sapiens
auugcacuccagccuggcaaua

SEQ ID NO: 377796 - RNA, 22 nt, Homo sapiens
auugcacuccagccuggccaac

SEQ ID NO: 377797 - RNA, 18 nt, Homo sapiens
auugcacuccugccuggg

SEQ ID NO: 377798 - RNA, 22 nt, Homo sapiens
auugcacugcagccugggcaac

SEQ ID NO: 377799 - RNA, 22 nt, Homo sapiens
auuguacuccagccugggcaaa

SEQ ID NO: 377800 - RNA, 22 nt, Homo sapiens
auuguacuccagccugggcagc

SEQ ID NO: 377801 - RNA, 22 nt, Homo sapiens
caucgcacuccagccugggcaa

SEQ ID NO: 377802 - RNA, 22 nt, Homo sapiens
cauugcacuccagccuagccaa

SEQ ID NO: 377803 - RNA, 20 nt, Homo sapiens
cauugcacuccagccugcug

SEQ ID NO: 377804 - RNA, 22 nt, Homo sapiens
cauugcacuccagucugggcaa

SEQ ID NO: 377805 - RNA, 22 nt, Homo sapiens
cauugcacuccaucuugggcaa

SEQ ID NO: 377806 - RNA, 22 nt, Homo sapiens
cauugcacugcagcccgggcaa

SEQ ID NO: 377807 - RNA, 22 nt, Homo sapiens
cauugcaugccagccugggcaa

SEQ ID NO: 377808 - RNA, 22 nt, Homo sapiens
ccugucuugauuaaauuacuua

SEQ ID NO: 377809 - RNA, 22 nt, Homo sapiens
cguugcacuccagccugggcaa

SEQ ID NO: 377810 - RNA, 22 nt, Homo sapiens
cugaggcacggcgaccuuaagu

SEQ ID NO: 377811 - RNA, 22 nt, Homo sapiens
cuggcacagugucagaaacaca

SEQ ID NO: 377812 - RNA, 22 nt, Homo sapiens
ggaaagaucagcuaaauguaag

SEQ ID NO: 377813 - RNA, 22 nt, Homo sapiens
uaagacuguuggcaauuuuugc

SEQ ID NO: 377814 - RNA, 19 nt, Homo sapiens
uaucacuucccuggaaaca

SEQ ID NO: 377815 - RNA, 22 nt, Homo sapiens
ucauugcacuccagccugggug

SEQ ID NO: 377816 - RNA, 22 nt, Homo sapiens
uccuguaaucccagcuaccaga

SEQ ID NO: 377817 - RNA, 22 nt, Homo sapiens
ucugucuuugccuaaguuuguc

SEQ ID NO: 377818 - RNA, 22 nt, Homo sapiens
ugagaugaaagcagaaagacuu

SEQ ID NO: 377819 - RNA, 19 nt, Homo sapiens
ugagaugaagacagggguu

SEQ ID NO: 377820 - RNA, 22 nt, Homo sapiens
ugagaugaggucucacucuguu

SEQ ID NO: 377821 - RNA, 22 nt, Homo sapiens
ugagaugaguugcuggcucuga

SEQ ID NO: 377822 - RNA, 22 nt, Homo sapiens
ugagaugauaucuuauuguaau

SEQ ID NO: 377823 - RNA, 21 nt, Homo sapiens
ugagaugauccugcaugcaug

SEQ ID NO: 377824 - RNA, 22 nt, Homo sapiens
ugagaugaugggauaagagggc

SEQ ID NO: 377825 - RNA, 19 nt, Homo sapiens
ugcagcaauguaaaagaca

SEQ ID NO: 377826 - RNA, 22 nt, Homo sapiens
uggcucauuucuaaacccagcu

SEQ ID NO: 377827 - RNA, 22 nt, Homo sapiens
uggugagaaaagaugucuuugu

SEQ ID NO: 377828 - RNA, 22 nt, Homo sapiens
ugugucacugcacuccagccug

SEQ ID NO: 377829 - RNA, 22 nt, Homo sapiens
uuaagggaggagcuucaagaug

SEQ ID NO: 377830 - RNA, 23 nt, Homo sapiens
uuaguaaacucaaugacaccaca

SEQ ID NO: 377831 - RNA, 22 nt, Homo sapiens
uucagcuacuugggaggcugaa

SEQ ID NO: 377832 - RNA, 22 nt, Homo sapiens
uugaggcaaugaggagaagcug

SEQ ID NO: 377833 - RNA, 22 nt, Homo sapiens
uugcacauguugaaccagcaaa

SEQ ID NO: 377834 - RNA, 22 nt, Homo sapiens
uugcacuccggccuggguaaca

SEQ ID NO: 377835 - RNA, 22 nt, Homo sapiens
uugcauauucucugaggcagga

SEQ ID NO: 377836 - RNA, 20 nt, Homo sapiens
aaacucugucuucuuuauca

SEQ ID NO: 377837 - RNA, 22 nt, Homo sapiens
aaauaguagcugaaugagggaa

SEQ ID NO: 377838 - RNA, 22 nt, Homo sapiens
aagagaugaagguccugacugu

SEQ ID NO: 377839 - RNA, 22 nt, Homo sapiens
aaguaaacauuuuguacaauaa

SEQ ID NO: 377840 - RNA, 22 nt, Homo sapiens
aaucacuuugcuacaaggcagu

SEQ ID NO: 377841 - RNA, 22 nt, Homo sapiens
aaucacuuuggcaccaaccuaa

SEQ ID NO: 377842 - RNA, 22 nt, Homo sapiens
aggcaagagugacuacgugaaa

SEQ ID NO: 377843 - RNA, 22 nt, Homo sapiens
aucccuagaaaaaucagcacau

SEQ ID NO: 377844 - RNA, 22 nt, Homo sapiens
aucccugugauccaaucacuuc

SEQ ID NO: 377845 - RNA, 17 nt, Homo sapiens
auguaauccucaucucu

SEQ ID NO: 377846 - RNA, 21 nt, Homo sapiens
auugcacuccagccugggcga

SEQ ID NO: 377847 - RNA, 19 nt, Homo sapiens
cauugcacuccacccuggg

SEQ ID NO: 377848 - RNA, 22 nt, Homo sapiens
cauugcacuccagccuggccaa

SEQ ID NO: 377849 - RNA, 22 nt, Homo sapiens
cauugcacuccagccuuggcaa

SEQ ID NO: 377850 - RNA, 20 nt, Homo sapiens
cauugcacuccagcuugggc

SEQ ID NO: 377851 - RNA, 22 nt, Homo sapiens
cauugcacuccagcuugggcaa

SEQ ID NO: 377852 - RNA, 22 nt, Homo sapiens
cauugcacuccauccuuggcaa

SEQ ID NO: 377853 - RNA, 22 nt, Homo sapiens
cauugcacucuagccucggcaa

SEQ ID NO: 377854 - RNA, 22 nt, Homo sapiens
cauugcacugcauucugggcaa

SEQ ID NO: 377855 - RNA, 20 nt, Homo sapiens
cguugcacuccagccugggc

SEQ ID NO: 377856 - RNA, 22 nt, Homo sapiens
gaaagauuuccugagcuagaaa

SEQ ID NO: 377857 - RNA, 22 nt, Homo sapiens
gaggcaagaguaguuaaguuag

SEQ ID NO: 377858 - RNA, 22 nt, Homo sapiens
gcauaaagcuaauaagacgaag

SEQ ID NO: 377859 - RNA, 22 nt, Homo sapiens
ggaucacuugagaccaggaguu

SEQ ID NO: 377860 - RNA, 22 nt, Homo sapiens
gugagccaugauuuuaccacug

SEQ ID NO: 377861 - RNA, 22 nt, Homo sapiens
gugaggcacugcugcuuuccag

SEQ ID NO: 377862 - RNA, 22 nt, Homo sapiens
uaagacugccccagacagcaag

SEQ ID NO: 377863 - RNA, 22 nt, Homo sapiens
uagcauaauuuguagaaaauca

SEQ ID NO: 377864 - RNA, 22 nt, Homo sapiens
ugagaugaacuugauuguuuua

SEQ ID NO: 377865 - RNA, 22 nt, Homo sapiens
ugagaugaagcuagaagaaugg

SEQ ID NO: 377866 - RNA, 22 nt, Homo sapiens
ugagaugacgacacaccucagu

SEQ ID NO: 377867 - RNA, 22 nt, Homo sapiens
ugagaugagggaagccuaggca

SEQ ID NO: 377868 - RNA, 22 nt, Homo sapiens
ugagaugaggucucgcucuguc

SEQ ID NO: 377869 - RNA, 22 nt, Homo sapiens
ugagaugaguucucgcucuguc

SEQ ID NO: 377870 - RNA, 22 nt, Homo sapiens
ugagguagaggugaacuugacc

SEQ ID NO: 377871 - RNA, 22 nt, Homo sapiens
ugccauugcacuccagccuggg

SEQ ID NO: 377872 - RNA, 22 nt, Homo sapiens
uuaaggaaggagucuuaaaugg

SEQ ID NO: 377873 - RNA, 22 nt, Homo sapiens
uuauugcacuccagccugggua

SEQ ID NO: 377874 - RNA, 22 nt, Homo sapiens
uuccagcugggggcaacucugc

SEQ ID NO: 377875 - RNA, 23 nt, Homo sapiens
uugaggcauguaccaucaauauc

SEQ ID NO: 377876 - RNA, 18 nt, Homo sapiens
uugcacuccugccugggu

SEQ ID NO: 377877 - RNA, 22 nt, Homo sapiens
uugcacucuccagccucggcaa

SEQ ID NO: 377878 - RNA, 22 nt, Homo sapiens
uugcauauguugaaccaagcgu

SEQ ID NO: 377879 - RNA, 22 nt, Homo sapiens
uuguaaucaacacaucauuggg

SEQ ID NO: 377880 - RNA, 22 nt, Homo sapiens
uuugaaccauuugaagaaugau

SEQ ID NO: 377881 - RNA, 22 nt, Homo sapiens
acccuguaggacuauucuaauc

SEQ ID NO: 377882 - RNA, 22 nt, Homo sapiens
agcaagaugaaguugagcuagg

SEQ ID NO: 377883 - RNA, 22 nt, Homo sapiens
agugcacuccagccugggcaac

SEQ ID NO: 377884 - RNA, 22 nt, Homo sapiens
auagcagaagaagggacaauuc

SEQ ID NO: 377885 - RNA, 18 nt, Homo sapiens
auugcacaccagccuggg

SEQ ID NO: 377886 - RNA, 22 nt, Homo sapiens
auugcacaccagucugggcaaa

SEQ ID NO: 377887 - RNA, 22 nt, Homo sapiens
auugcacuccacccugggcaac

SEQ ID NO: 377888 - RNA, 22 nt, Homo sapiens
auugcacuccagccuaggcaac

SEQ ID NO: 377889 - RNA, 22 nt, Homo sapiens
auugcacuccagccuggggaac

SEQ ID NO: 377890 - RNA, 22 nt, Homo sapiens
auugcacuccagccuugggcaa

SEQ ID NO: 377891 - RNA, 22 nt, Homo sapiens
auugcacuccauccugggcaau

SEQ ID NO: 377892 - RNA, 22 nt, Homo sapiens
auuguacuccagccugggcaag

SEQ ID NO: 377893 - RNA, 22 nt, Homo sapiens
caucacuuugccuccgucucua

SEQ ID NO: 377894 - RNA, 22 nt, Homo sapiens
caugcacugaguccaccucugg

SEQ ID NO: 377895 - RNA, 22 nt, Homo sapiens
cauugcaauccagccugggcaa

SEQ ID NO: 377896 - RNA, 22 nt, Homo sapiens
cauugcacuccagccuaggcaa

SEQ ID NO: 377897 - RNA, 22 nt, Homo sapiens
cauugcacuccagccugaggga

SEQ ID NO: 377898 - RNA, 22 nt, Homo sapiens
cauugcacuccagccuggcaac

SEQ ID NO: 377899 - RNA, 22 nt, Homo sapiens
cauugcacuccagcucugggcg

SEQ ID NO: 377900 - RNA, 22 nt, Homo sapiens
cauugcacuccagcuugggcga

SEQ ID NO: 377901 - RNA, 20 nt, Homo sapiens
cauugcccuccagccugggc

SEQ ID NO: 377902 - RNA, 22 nt, Homo sapiens
cauugcccuccagccugggcaa

SEQ ID NO: 377903 - RNA, 22 nt, Homo sapiens
gaucacuuugaugccaggaacu

SEQ ID NO: 377904 - RNA, 22 nt, Homo sapiens
ggagaugauuaugaaucacuua

SEQ ID NO: 377905 - RNA, 22 nt, Homo sapiens
ggcaacaugccgaaaccacguc

SEQ ID NO: 377906 - RNA, 22 nt, Homo sapiens
ggcaacauggugaaacucuguc

SEQ ID NO: 377907 - RNA, 18 nt, Homo sapiens
guaaauguaucuauugcc

SEQ ID NO: 377908 - RNA, 22 nt, Homo sapiens
guagcagaauaucagauaauuu

SEQ ID NO: 377909 - RNA, 22 nt, Homo sapiens
gucauugcacuccagccuggac

SEQ ID NO: 377910 - RNA, 22 nt, Homo sapiens
uagcaggaaaggggucagaucu

SEQ ID NO: 377911 - RNA, 22 nt, Homo sapiens
ucugucuugugguuugagugcc

SEQ ID NO: 377912 - RNA, 22 nt, Homo sapiens
ugaaggcaggagggagaaaagu

SEQ ID NO: 377913 - RNA, 22 nt, Homo sapiens
ugagaugaagucuugcucuguu

SEQ ID NO: 377914 - RNA, 22 nt, Homo sapiens
ugagaugaagugauguaaaaca

SEQ ID NO: 377915 - RNA, 22 nt, Homo sapiens
ugagaugagagaaugcuugccu

SEQ ID NO: 377916 - RNA, 22 nt, Homo sapiens
ugagaugagggcugcacucaaa

SEQ ID NO: 377917 - RNA, 22 nt, Homo sapiens
ugagaugauagauauguuaauu

SEQ ID NO: 377918 - RNA, 22 nt, Homo sapiens
ugagaugauuuaauggagccca

SEQ ID NO: 377919 - RNA, 22 nt, Homo sapiens
uuaauagugacucauuuuccac

SEQ ID NO: 377920 - RNA, 22 nt, Homo sapiens
uugagccaaggauugucuuucc

SEQ ID NO: 377921 - RNA, 22 nt, Homo sapiens
uugaggucagagguucgagacc

SEQ ID NO: 377922 - RNA, 15 nt, Homo sapiens
aaaaugcaacaacau

SEQ ID NO: 377923 - RNA, 14 nt, Homo sapiens
aaacagcucugugu

SEQ ID NO: 377924 - RNA, 12 nt, Homo sapiens
aaauuaaacccu

SEQ ID NO: 377925 - RNA, 13 nt, Homo sapiens
aaccaaccucccc

SEQ ID NO: 377926 - RNA, 20 nt, Homo sapiens
aaccuccccgcagagcuccc

SEQ ID NO: 377927 - RNA, 11 nt, Homo sapiens
aacucaauauu

SEQ ID NO: 377928 - RNA, 13 nt, Homo sapiens
aacuccagcuccc

SEQ ID NO: 377929 - RNA, 19 nt, Homo sapiens
aagagugagacuccgucuc

SEQ ID NO: 377930 - RNA, 16 nt, Homo sapiens
aagcaucacuugggau

SEQ ID NO: 377931 - RNA, 22 nt, Homo sapiens
aaggacaccuccuuccucaguc

SEQ ID NO: 377932 - RNA, 14 nt, Homo sapiens
aaggagguagcucc

SEQ ID NO: 377933 - RNA, 14 nt, Homo sapiens
aauaaaagcacuua

SEQ ID NO: 377934 - RNA, 23 nt, Homo sapiens
aauaaguuuuccuuuuguuuucc

SEQ ID NO: 377935 - RNA, 15 nt, Homo sapiens
aauggggugcaugaa

SEQ ID NO: 377936 - RNA, 12 nt, Homo sapiens
aauuaacacugc

SEQ ID NO: 377937 - RNA, 22 nt, Homo sapiens
aauucugagcuggcccuuucca

SEQ ID NO: 377938 - RNA, 17 nt, Homo sapiens
acaacauguauaauauu

SEQ ID NO: 377939 - RNA, 17 nt, Homo sapiens
acaauggcuuacuccag

SEQ ID NO: 377940 - RNA, 12 nt, Homo sapiens
acacaaggucau

SEQ ID NO: 377941 - RNA, 22 nt, Homo sapiens
acacagagcgccucaccugcau

SEQ ID NO: 377942 - RNA, 11 nt, Homo sapiens
acacagugcug

SEQ ID NO: 377943 - RNA, 17 nt, Homo sapiens
acaugcagcucugauga

SEQ ID NO: 377944 - RNA, 10 nt, Homo sapiens
acaugugcuu

SEQ ID NO: 377945 - RNA, 23 nt, Homo sapiens
accacuuuucaguucaguggcau

SEQ ID NO: 377946 - RNA, 22 nt, Homo sapiens
accagguagaacacaaggucau

SEQ ID NO: 377947 - RNA, 14 nt, Homo sapiens
acccacccaugcac

SEQ ID NO: 377948 - RNA, 18 nt, Homo sapiens
acuacaauuuaaagcaaa

SEQ ID NO: 377949 - RNA, 16 nt, Homo sapiens
acugucuugaagacaa

SEQ ID NO: 377950 - RNA, 18 nt, Homo sapiens
acuuuucaguucaguggc

SEQ ID NO: 377951 - RNA, 16 nt, Homo sapiens
agaacacaaggucauu

SEQ ID NO: 377952 - RNA, 16 nt, Homo sapiens
agaaggacaccuccuu

SEQ ID NO: 377953 - RNA, 22 nt, Homo sapiens
agaaggggacagcgccaccucu

SEQ ID NO: 377954 - RNA, 23 nt, Homo sapiens
agaaggggacagcgccaccucuu

SEQ ID NO: 377955 - RNA, 15 nt, Homo sapiens
agauggccgggacau

SEQ ID NO: 377956 - RNA, 23 nt, Homo sapiens
agauggccgggacaugcagcucu

SEQ ID NO: 377957 - RNA, 20 nt, Homo sapiens
agauugcgccacugcacucc

SEQ ID NO: 377958 - RNA, 24 nt, Homo sapiens
agauugcgccacugcacuccaguc

SEQ ID NO: 377959 - RNA, 16 nt, Homo sapiens
agcacugccugccaag

SEQ ID NO: 377960 - RNA, 14 nt, Homo sapiens
agcagguggcagaa

SEQ ID NO: 377961 - RNA, 21 nt, Homo sapiens
agcaucacuugggauuaauau

SEQ ID NO: 377962 - RNA, 18 nt, Homo sapiens
agcauuaugauguggguc

SEQ ID NO: 377963 - RNA, 19 nt, Homo sapiens
agccaauaaaucaacucca

SEQ ID NO: 377964 - RNA, 20 nt, Homo sapiens
agccaggagugcggacacca

SEQ ID NO: 377965 - RNA, 18 nt, Homo sapiens
agcuccacuuucagugaa

SEQ ID NO: 377966 - RNA, 13 nt, Homo sapiens
aggagacagcagc

SEQ ID NO: 377967 - RNA, 17 nt, Homo sapiens
aggucauagcagugcuu

SEQ ID NO: 377968 - RNA, 18 nt, Homo sapiens
agugagacuccgucucaa

SEQ ID NO: 377969 - RNA, 19 nt, Homo sapiens
agugcugagaaggacaccu

SEQ ID NO: 377970 - RNA, 22 nt, Homo sapiens
agugcugagaaggacaccuccu

SEQ ID NO: 377971 - RNA, 19 nt, Homo sapiens
aguggcauucacaucucau

SEQ ID NO: 377972 - RNA, 23 nt, Homo sapiens
auaacauaaauuuaucaucucga

SEQ ID NO: 377973 - RNA, 22 nt, Homo sapiens
auaguauugugcauagagccac

SEQ ID NO: 377974 - RNA, 16 nt, Homo sapiens
auauggcagugucuuu

SEQ ID NO: 377975 - RNA, 21 nt, Homo sapiens
augaagguuucugaaaauuaa

SEQ ID NO: 377976 - RNA, 15 nt, Homo sapiens
augcaacaacaugua

SEQ ID NO: 377977 - RNA, 21 nt, Homo sapiens
augguuugcaaggaagccaca

SEQ ID NO: 377978 - RNA, 19 nt, Homo sapiens
augugggucaaggaauuaa

SEQ ID NO: 377979 - RNA, 24 nt, Homo sapiens
augugguuaaugccauggacagaa

SEQ ID NO: 377980 - RNA, 22 nt, Homo sapiens
auguucccagcucagugccaaa

SEQ ID NO: 377981 - RNA, 13 nt, Homo sapiens
auucacaucucau

SEQ ID NO: 377982 - RNA, 20 nt, Homo sapiens
auucuuacaaacaugugguu

SEQ ID NO: 377983 - RNA, 16 nt, Homo sapiens
auugcgccacugcacu

SEQ ID NO: 377984 - RNA, 12 nt, Homo sapiens
caacaacaugua

SEQ ID NO: 377985 - RNA, 20 nt, Homo sapiens
caaccuccccgcagagcucc

SEQ ID NO: 377986 - RNA, 12 nt, Homo sapiens
caacuccagcuc

SEQ ID NO: 377987 - RNA, 14 nt, Homo sapiens
caagagccccaaag

SEQ ID NO: 377988 - RNA, 16 nt, Homo sapiens
caaggaugacacugcc

SEQ ID NO: 377989 - RNA, 18 nt, Homo sapiens
caaugugacuaccgugcc

SEQ ID NO: 377990 - RNA, 19 nt, Homo sapiens
caauucuuacaaacaugug

SEQ ID NO: 377991 - RNA, 14 nt, Homo sapiens
caccagccaucaug

SEQ ID NO: 377992 - RNA, 13 nt, Homo sapiens
caccggugccaaa

SEQ ID NO: 377993 - RNA, 15 nt, Homo sapiens
cacugccugccaagc

SEQ ID NO: 377994 - RNA, 13 nt, Homo sapiens
cagaacacugucu

SEQ ID NO: 377995 - RNA, 22 nt, Homo sapiens
cagaacacugucuugaagacaa

SEQ ID NO: 377996 - RNA, 20 nt, Homo sapiens
cagagaaaauaaaagcacuu

SEQ ID NO: 377997 - RNA, 14 nt, Homo sapiens
cagagcucccuucc

SEQ ID NO: 377998 - RNA, 17 nt, Homo sapiens
cagauggccgggacaug

SEQ ID NO: 377999 - RNA, 16 nt, Homo sapiens
cagcacugccugccaa

SEQ ID NO: 378000 - RNA, 18 nt, Homo sapiens
cagcagcacccacccaug

SEQ ID NO: 378001 - RNA, 12 nt, Homo sapiens
cagcagcucagc

SEQ ID NO: 378002 - RNA, 14 nt, Homo sapiens
cagccuacacugcc

SEQ ID NO: 378003 - RNA, 20 nt, Homo sapiens
cagccuccccccgcugggga

SEQ ID NO: 378004 - RNA, 20 nt, Homo sapiens
cagguagaacacaaggucau

SEQ ID NO: 378005 - RNA, 19 nt, Homo sapiens
cagugcuggccacacagca

SEQ ID NO: 378006 - RNA, 19 nt, Homo sapiens
caguggcauucacaucuca

SEQ ID NO: 378007 - RNA, 16 nt, Homo sapiens
cagugguaccagcuca

SEQ ID NO: 378008 - RNA, 20 nt, Homo sapiens
caguuucuccuuuauugcuc

SEQ ID NO: 378009 - RNA, 14 nt, Homo sapiens
caucucgaccacuu

SEQ ID NO: 378010 - RNA, 14 nt, Homo sapiens
caucucucuuuaau

SEQ ID NO: 378011 - RNA, 12 nt, Homo sapiens
caucugcuccuc

SEQ ID NO: 378012 - RNA, 13 nt, Homo sapiens
ccaaagaucccac

SEQ ID NO: 378013 - RNA, 18 nt, Homo sapiens
ccaaggaugacacugcca

SEQ ID NO: 378014 - RNA, 21 nt, Homo sapiens
ccacagccccuggcacugcag

SEQ ID NO: 378015 - RNA, 10 nt, Homo sapiens
ccacauaaca

SEQ ID NO: 378016 - RNA, 18 nt, Homo sapiens
ccagcacucaaccaaccu

SEQ ID NO: 378017 - RNA, 20 nt, Homo sapiens
ccagccaucaugugccugga

SEQ ID NO: 378018 - RNA, 23 nt, Homo sapiens
ccagccaucaugugccuggaaau

SEQ ID NO: 378019 - RNA, 18 nt, Homo sapiens
ccagcggcugggugguga

SEQ ID NO: 378020 - RNA, 22 nt, Homo sapiens
ccagugcuggccacacagcagc

SEQ ID NO: 378021 - RNA, 13 nt, Homo sapiens
ccaucugcuccuc

SEQ ID NO: 378022 - RNA, 19 nt, Homo sapiens
cccacuucucuacucugga

SEQ ID NO: 378023 - RNA, 20 nt, Homo sapiens
cccacuucucuacucuggaa

SEQ ID NO: 378024 - RNA, 18 nt, Homo sapiens
cccagccccgcccgccug

SEQ ID NO: 378025 - RNA, 14 nt, Homo sapiens
ccagcucagugcca

SEQ ID NO: 378026 - RNA, 16 nt, Homo sapiens
ccagugggacccacag

SEQ ID NO: 378027 - RNA, 15 nt, Homo sapiens
ccaugaaaaugcaac

SEQ ID NO: 378028 - RNA, 17 nt, Homo sapiens
ccaugaaaaugcaacaa

SEQ ID NO: 378029 - RNA, 13 nt, Homo sapiens
cccaccggugcca

SEQ ID NO: 378030 - RNA, 19 nt, Homo sapiens
cccugaggguggucagcca

SEQ ID NO: 378031 - RNA, 14 nt, Homo sapiens
ccgcagagcucccu

SEQ ID NO: 378032 - RNA, 19 nt, Homo sapiens
ccgccagccuacacugcca

SEQ ID NO: 378033 - RNA, 22 nt, Homo sapiens
ccgcccagugggacccacaguc

SEQ ID NO: 378034 - RNA, 14 nt, Homo sapiens
ccuacacugccagc

SEQ ID NO: 378035 - RNA, 15 nt, Homo sapiens
ccucugcuugccagc

SEQ ID NO: 378036 - RNA, 17 nt, Homo sapiens
ccucuuucuacagccua

SEQ ID NO: 378037 - RNA, 20 nt, Homo sapiens
ccuggaucucacaagcacuu

SEQ ID NO: 378038 - RNA, 23 nt, Homo sapiens
ccuguaaucccagcuacauggga

SEQ ID NO: 378039 - RNA, 17 nt, Homo sapiens
ccuuuuauuucuuaaac

SEQ ID NO: 378040 - RNA, 17 nt, Homo sapiens
ccuuuuguuuuccacuc

SEQ ID NO: 378041 - RNA, 15 nt, Homo sapiens
uguuucuggggacac

SEQ ID NO: 378042 - RNA, 22 nt, Homo sapiens
uguuucuggggacaccagccau

SEQ ID NO: 378043 - RNA, 18 nt, Homo sapiens
uuaaggagguagcuccca

SEQ ID NO: 378044 - RNA, 21 nt, Homo sapiens
uuaaggagguagcucccagca

SEQ ID NO: 378045 - RNA, 15 nt, Homo sapiens
uuagccagugaugcu

SEQ ID NO: 378046 - RNA, 20 nt, Homo sapiens
uuaucaucucgaccacuuuu

SEQ ID NO: 378047 - RNA, 16 nt, Homo sapiens
uuccuuuuguuuucca

SEQ ID NO: 378048 - RNA, 17 nt, Homo sapiens
uucgauggcauccugca

SEQ ID NO: 378049 - RNA, 16 nt, Homo sapiens
uucuuacaaacaugug

SEQ ID NO: 378050 - RNA, 15 nt, Homo sapiens
uugacagaacacugu

SEQ ID NO: 378051 - RNA, 16 nt, Homo sapiens
uugauaguauugugca

SEQ ID NO: 378052 - RNA, 13 nt, Homo sapiens
uuggggcuuuuac

SEQ ID NO: 378053 - RNA, 15 nt, Homo sapiens
uuguauugcauauau

SEQ ID NO: 378054 - RNA, 16 nt, Homo sapiens
uuuaauuugauaguau

SEQ ID NO: 378055 - RNA, 12 nt, Homo sapiens
uuuaucaucucg

SEQ ID NO: 378056 - RNA, 12 nt, Homo sapiens
uuuuacaccagu

SEQ ID NO: 378057 - RNA, 14 nt, Homo sapiens
aaacaaaacaaaac

SEQ ID NO: 378058 - RNA, 13 nt, Homo sapiens
aaacacagugcug

SEQ ID NO: 378059 - RNA, 23 nt, Homo sapiens
aaacaugugguuaaugccaugga

SEQ ID NO: 378060 - RNA, 18 nt, Homo sapiens
aaauaaguuuuccuuuug

SEQ ID NO: 378061 - RNA, 12 nt, Homo sapiens
aacacagugcug

SEQ ID NO: 378062 - RNA, 19 nt, Homo sapiens
aacaugugguuaaugccau

SEQ ID NO: 378063 - RNA, 19 nt, Homo sapiens
aacccugccccacuucucu

SEQ ID NO: 378064 - RNA, 18 nt, Homo sapiens
aacuagcuuggaaacugg

SEQ ID NO: 378065 - RNA, 16 nt, Homo sapiens
aacuggaugaggucau

SEQ ID NO: 378066 - RNA, 16 nt, Homo sapiens
aagacagagcugggau

SEQ ID NO: 378067 - RNA, 15 nt, Homo sapiens
aagagccccaaagau

SEQ ID NO: 378068 - RNA, 20 nt, Homo sapiens
aagccacagcuggugguauc

SEQ ID NO: 378069 - RNA, 15 nt, Homo sapiens
aaggaagccacagcu

SEQ ID NO: 378070 - RNA, 13 nt, Homo sapiens
aauaaaagcacuu

SEQ ID NO: 378071 - RNA, 14 nt, Homo sapiens
aauauaaacacuau

SEQ ID NO: 378072 - RNA, 14 nt, Homo sapiens
aaugguuugaauau

SEQ ID NO: 378073 - RNA, 14 nt, Homo sapiens
acaaaaaaaccaca

SEQ ID NO: 378074 - RNA, 14 nt, Homo sapiens
acaaacaugugguu

SEQ ID NO: 378075 - RNA, 13 nt, Homo sapiens
acaaauguaugau

SEQ ID NO: 378076 - RNA, 16 nt, Homo sapiens
acaccagguagaacac

SEQ ID NO: 378077 - RNA, 15 nt, Homo sapiens
acacuaauacaccag

SEQ ID NO: 378078 - RNA, 14 nt, Homo sapiens
acagaacacugucu

SEQ ID NO: 378079 - RNA, 19 nt, Homo sapiens
acagccaggcggcuggaau

SEQ ID NO: 378080 - RNA, 12 nt, Homo sapiens
accggugccaaa

SEQ ID NO: 378081 - RNA, 21 nt, Homo sapiens
accuucuaggaagcuccaguu

SEQ ID NO: 378082 - RNA, 20 nt, Homo sapiens
acucgaagcccuuccagugg

SEQ ID NO: 378083 - RNA, 22 nt, Homo sapiens
acugucuugaagacaauggcuu

SEQ ID NO: 378084 - RNA, 19 nt, Homo sapiens
agaagacuauauuguacac

SEQ ID NO: 378085 - RNA, 12 nt, Homo sapiens
agaaggggacag

SEQ ID NO: 378086 - RNA, 21 nt, Homo sapiens
agacaauggcuuacuccagga

SEQ ID NO: 378087 - RNA, 19 nt, Homo sapiens
agagaggugggcagcagcu

SEQ ID NO: 378088 - RNA, 19 nt, Homo sapiens
agaggugggcagcagcuca

SEQ ID NO: 378089 - RNA, 20 nt, Homo sapiens
agagugagacuccgucucaa

SEQ ID NO: 378090 - RNA, 19 nt, Homo sapiens
agauggccgggacaugcag

SEQ ID NO: 378091 - RNA, 17 nt, Homo sapiens
agauugcgccacugcac

SEQ ID NO: 378092 - RNA, 12 nt, Homo sapiens
agcacucaacca

SEQ ID NO: 378093 - RNA, 22 nt, Homo sapiens
agcacuuucccucuuggugccu

SEQ ID NO: 378094 - RNA, 19 nt, Homo sapiens
agccaucaugugccuggaa

SEQ ID NO: 378095 - RNA, 14 nt, Homo sapiens
agcucagugccaaa

SEQ ID NO: 378096 - RNA, 20 nt, Homo sapiens
agcugagauugcgccacugc

SEQ ID NO: 378097 - RNA, 23 nt, Homo sapiens
agcugagauugcgccacugcacu

SEQ ID NO: 378098 - RNA, 20 nt, Homo sapiens
agcuggugguaucugaguug

SEQ ID NO: 378099 - RNA, 18 nt, Homo sapiens
aggagacccacagguaug

SEQ ID NO: 378100 - RNA, 22 nt, Homo sapiens
aggagguagcucccagcacuca

SEQ ID NO: 378101 - RNA, 16 nt, Homo sapiens
aggcaugagaaucacu

SEQ ID NO: 378102 - RNA, 20 nt, Homo sapiens
aggcaugagaaucacuugaa

SEQ ID NO: 378103 - RNA, 10 nt, Homo sapiens
aggcugcaaa

SEQ ID NO: 378104 - RNA, 13 nt, Homo sapiens
aggggcccagugc

SEQ ID NO: 378105 - RNA, 20 nt, Homo sapiens
agucacgagcccgcucugca

SEQ ID NO: 378106 - RNA, 20 nt, Homo sapiens
agugaaagcaucacuuggga

SEQ ID NO: 378107 - RNA, 21 nt, Homo sapiens
agugcuugauugcguggaauu

SEQ ID NO: 378108 - RNA, 16 nt, Homo sapiens
aguggcauucacaucu

SEQ ID NO: 378109 - RNA, 18 nt, Homo sapiens
aguggcauucacaucuca

SEQ ID NO: 378110 - RNA, 19 nt, Homo sapiens
agugggacccacagucaca

SEQ ID NO: 378111 - RNA, 23 nt, Homo sapiens
aguucaguggcauucacaucuca

SEQ ID NO: 378112 - RNA, 20 nt, Homo sapiens
aguuuuccuuuuguuuucca

SEQ ID NO: 378113 - RNA, 15 nt, Homo sapiens
auagagccacguaug

SEQ ID NO: 378114 - RNA, 14 nt, Homo sapiens
auaguauugugcau

SEQ ID NO: 378115 - RNA, 13 nt, Homo sapiens
augaucuuuucaa

SEQ ID NO: 378116 - RNA, 16 nt, Homo sapiens
augcaacaacauguau

SEQ ID NO: 378117 - RNA, 18 nt, Homo sapiens
augcaacaacauguauaa

SEQ ID NO: 378118 - RNA, 11 nt, Homo sapiens
auucacaucuc

SEQ ID NO: 378119 - RNA, 15 nt, Homo sapiens
auucacaucucaugu

SEQ ID NO: 378120 - RNA, 18 nt, Homo sapiens
caaaaauacucacauggc

SEQ ID NO: 378121 - RNA, 15 nt, Homo sapiens
caagagccccaaaga

SEQ ID NO: 378122 - RNA, 16 nt, Homo sapiens
caagagccccaaagau

SEQ ID NO: 378123 - RNA, 15 nt, Homo sapiens
caaggggcccagugc

SEQ ID NO: 378124 - RNA, 15 nt, Homo sapiens
caaggucauuugcua

SEQ ID NO: 378125 - RNA, 22 nt, Homo sapiens
caaugguuugcaaggaagccac

SEQ ID NO: 378126 - RNA, 22 nt, Homo sapiens
caccuccuuccucaguccugga

SEQ ID NO: 378127 - RNA, 20 nt, Homo sapiens
caccucuuucuacagccuaa

SEQ ID NO: 378128 - RNA, 16 nt, Homo sapiens
cacugccagccgccac

SEQ ID NO: 378129 - RNA, 17 nt, Homo sapiens
cacugccagucacgagc

SEQ ID NO: 378130 - RNA, 16 nt, Homo sapiens
cagaacacugucuuga

SEQ ID NO: 378131 - RNA, 20 nt, Homo sapiens
cagagaaggcuuccuccagc

SEQ ID NO: 378132 - RNA, 18 nt, Homo sapiens
cagagcgccucaccugca

SEQ ID NO: 378133 - RNA, 18 nt, Homo sapiens
cagccaggcggcuggaau

SEQ ID NO: 378134 - RNA, 15 nt, Homo sapiens
cagccaucaugugcc

SEQ ID NO: 378135 - RNA, 19 nt, Homo sapiens
cagccaucaugugccugga

SEQ ID NO: 378136 - RNA, 16 nt, Homo sapiens
cagccccgcccgccug

SEQ ID NO: 378137 - RNA, 24 nt, Homo sapiens
cagcgccaccucuugucagugcuc

SEQ ID NO: 378138 - RNA, 14 nt, Homo sapiens
cagcucagugccaa

SEQ ID NO: 378139 - RNA, 15 nt, Homo sapiens
cagcucagugccaaa

SEQ ID NO: 378140 - RNA, 22 nt, Homo sapiens
cagguggccucccuccagagac

SEQ ID NO: 378141 - RNA, 15 nt, Homo sapiens
cagucucucaaagac

SEQ ID NO: 378142 - RNA, 18 nt, Homo sapiens
caguggcauucacaucuc

SEQ ID NO: 378143 - RNA, 17 nt, Homo sapiens
cagugggacccacaguc

SEQ ID NO: 378144 - RNA, 18 nt, Homo sapiens
cagugggacccacaguca

SEQ ID NO: 378145 - RNA, 16 nt, Homo sapiens
caguuccuuucaaugg

SEQ ID NO: 378146 - RNA, 18 nt, Homo sapiens
cauaaaagccgcccagug

SEQ ID NO: 378147 - RNA, 19 nt, Homo sapiens
cauaaauuuaucaucucga

SEQ ID NO: 378148 - RNA, 23 nt, Homo sapiens
cauaacauaaauuuaucaucucg

SEQ ID NO: 378149 - RNA, 19 nt, Homo sapiens
cauguucccagcucagugc

SEQ ID NO: 378150 - RNA, 14 nt, Homo sapiens
ccaaauuacgugua

SEQ ID NO: 378151 - RNA, 20 nt, Homo sapiens
ccaaauuacguguacuacaa

SEQ ID NO: 378152 - RNA, 19 nt, Homo sapiens
ccacaagagccccaaagau

SEQ ID NO: 378153 - RNA, 20 nt, Homo sapiens
ccacaagagccccaaagauc

SEQ ID NO: 378154 - RNA, 18 nt, Homo sapiens
ccagccuacacugccagc

SEQ ID NO: 378155 - RNA, 15 nt, Homo sapiens
ccagcucagugccaa

SEQ ID NO: 378156 - RNA, 16 nt, Homo sapiens
ccagcucagugccaaa

SEQ ID NO: 378157 - RNA, 13 nt, Homo sapiens
cccacagguauga

SEQ ID NO: 378158 - RNA, 23 nt, Homo sapiens
cccagccccuguggagggggugc

SEQ ID NO: 378159 - RNA, 13 nt, Homo sapiens
ccccucagugcuc

SEQ ID NO: 378160 - RNA, 21 nt, Homo sapiens
ccauggacagaagaaggcagc

SEQ ID NO: 378161 - RNA, 21 nt, Homo sapiens
cccagauggccgggacaugca

SEQ ID NO: 378162 - RNA, 22 nt, Homo sapiens
ccccacuucucuacucuggaag

SEQ ID NO: 378163 - RNA, 20 nt, Homo sapiens
cccugaggguggucagccaa

SEQ ID NO: 378164 - RNA, 16 nt, Homo sapiens
cccugccccacuucuc

SEQ ID NO: 378165 - RNA, 22 nt, Homo sapiens
ccggcucccaccggugccaaac

SEQ ID NO: 378166 - RNA, 19 nt, Homo sapiens
ccgggagccucuccuugcc

SEQ ID NO: 378167 - RNA, 12 nt, Homo sapiens
ccgucucaaaaa

SEQ ID NO: 378168 - RNA, 20 nt, Homo sapiens
ccguuccgugggaugccaua

SEQ ID NO: 378169 - RNA, 21 nt, Homo sapiens
ccucaguuuccugaccuauga

SEQ ID NO: 378170 - RNA, 16 nt, Homo sapiens
ccugcagugggccauc

SEQ ID NO: 378171 - RNA, 17 nt, Homo sapiens
ccuggccccugggccug

SEQ ID NO: 378172 - RNA, 16 nt, Homo sapiens
cgcuguuccacaguga

SEQ ID NO: 378173 - RNA, 18 nt, Homo sapiens
cgucucaaaaacaaaaca

SEQ ID NO: 378174 - RNA, 22 nt, Homo sapiens
cuauuuuuauuuguuugugcau

SEQ ID NO: 378175 - RNA, 19 nt, Homo sapiens
cucagcuucauuuccguga

SEQ ID NO: 378176 - RNA, 22 nt, Homo sapiens
cucaggacacuaauacaccagg

SEQ ID NO: 378177 - RNA, 14 nt, Homo sapiens
cucagugccaaaga

SEQ ID NO: 378178 - RNA, 18 nt, Homo sapiens
cugagcgagcacaccuuc

SEQ ID NO: 378179 - RNA, 12 nt, Homo sapiens
cugcacagggau

SEQ ID NO: 378180 - RNA, 16 nt, Homo sapiens
cugccaaggaugacac

SEQ ID NO: 378181 - RNA, 20 nt, Homo sapiens
cuggagucccuucugagcga

SEQ ID NO: 378182 - RNA, 19 nt, Homo sapiens
cuggaucucacaagcacuu

SEQ ID NO: 378183 - RNA, 20 nt, Homo sapiens
cuggaucucacaagcacuuu

SEQ ID NO: 378184 - RNA, 23 nt, Homo sapiens
cugggguacaaggggcccagugc

SEQ ID NO: 378185 - RNA, 16 nt, Homo sapiens
cuggugaccuacuaaa

SEQ ID NO: 378186 - RNA, 23 nt, Homo sapiens
cugucacaucagcuccacuuuca

SEQ ID NO: 378187 - RNA, 18 nt, Homo sapiens
cuguguuucuggggacac

SEQ ID NO: 378188 - RNA, 15 nt, Homo sapiens
cuguuccacagugac

SEQ ID NO: 378189 - RNA, 22 nt, Homo sapiens
cuuccugacccuccgcugcaga

SEQ ID NO: 378190 - RNA, 17 nt, Homo sapiens
cuucugagcgagcacac

SEQ ID NO: 378191 - RNA, 14 nt, Homo sapiens
cuuguguuuuuaac

SEQ ID NO: 378192 - RNA, 14 nt, Homo sapiens
cuuucuacagccua

SEQ ID NO: 378193 - RNA, 14 nt, Homo sapiens
cuuuuacaccaguu

SEQ ID NO: 378194 - RNA, 18 nt, Homo sapiens
gaaacuggaugaggucau

SEQ ID NO: 378195 - RNA, 15 nt, Homo sapiens
gaaucacuugaacuc

SEQ ID NO: 378196 - RNA, 13 nt, Homo sapiens
gacagaacacugu

SEQ ID NO: 378197 - RNA, 21 nt, Homo sapiens
gacaugcagcucugaugagag

SEQ ID NO: 378198 - RNA, 21 nt, Homo sapiens
gaccacuuuucaguucagugg

SEQ ID NO: 378199 - RNA, 15 nt, Homo sapiens
gaccuacuaaaaaua

SEQ ID NO: 378200 - RNA, 13 nt, Homo sapiens
gaccuucuaggaa

SEQ ID NO: 378201 - RNA, 18 nt, Homo sapiens
gacuugacagaacacugu

SEQ ID NO: 378202 - RNA, 19 nt, Homo sapiens
gagaaaauaaaagcacuua

SEQ ID NO: 378203 - RNA, 24 nt, Homo sapiens
gagagugcugagaaggacaccucc

SEQ ID NO: 378204 - RNA, 22 nt, Homo sapiens
gagauugcgccacugcacucca

SEQ ID NO: 378205 - RNA, 16 nt, Homo sapiens
gagcgccucaccugca

SEQ ID NO: 378206 - RNA, 23 nt, Homo sapiens
gaugccagccggguaccucaguu

SEQ ID NO: 378207 - RNA, 15 nt, Homo sapiens
gauguuucugucaca

SEQ ID NO: 378208 - RNA, 22 nt, Homo sapiens
gauucccuccucgucagucucu

SEQ ID NO: 378209 - RNA, 15 nt, Homo sapiens
gcacugccugccaag

SEQ ID NO: 378210 - RNA, 16 nt, Homo sapiens
gcagcagcucagccuc

SEQ ID NO: 378211 - RNA, 15 nt, Homo sapiens
gcagugagcugagau

SEQ ID NO: 378212 - RNA, 15 nt, Homo sapiens
gcauucacaucucau

SEQ ID NO: 378213 - RNA, 13 nt, Homo sapiens
gccaaacccagcc

SEQ ID NO: 378214 - RNA, 14 nt, Homo sapiens
gccaaggaugacac

SEQ ID NO: 378215 - RNA, 21 nt, Homo sapiens
gccacagccccuggcacugca

SEQ ID NO: 378216 - RNA, 13 nt, Homo sapiens
gccacugcacucc

SEQ ID NO: 378217 - RNA, 16 nt, Homo sapiens
gccagccuacacugcc

SEQ ID NO: 378218 - RNA, 21 nt, Homo sapiens
gccauaaaagccgcccagugg

SEQ ID NO: 378219 - RNA, 20 nt, Homo sapiens
gccccaaagaucccacggga

SEQ ID NO: 378220 - RNA, 22 nt, Homo sapiens
gcucacucccugggaaaggggu

SEQ ID NO: 378221 - RNA, 14 nt, Homo sapiens
gcucagugccaaag

SEQ ID NO: 378222 - RNA, 23 nt, Homo sapiens
gcucuguguuucuggggacacca

SEQ ID NO: 378223 - RNA, 20 nt, Homo sapiens
gcugagauugcgccacugca

SEQ ID NO: 378224 - RNA, 15 nt, Homo sapiens
gcuggccacacagca

SEQ ID NO: 378225 - RNA, 17 nt, Homo sapiens
gcuggccacacagcagc

SEQ ID NO: 378226 - RNA, 21 nt, Homo sapiens
gcugggauguuucugucacau

SEQ ID NO: 378227 - RNA, 23 nt, Homo sapiens
gcuugauugcguggaauugugcu

SEQ ID NO: 378228 - RNA, 21 nt, Homo sapiens
ggaaguuuuguggaggagcuc

SEQ ID NO: 378229 - RNA, 18 nt, Homo sapiens
ggagcccgucaggccaca

SEQ ID NO: 378230 - RNA, 15 nt, Homo sapiens
ggagccugaggcaug

SEQ ID NO: 378231 - RNA, 22 nt, Homo sapiens
ggagguagcucccagcacucaa

SEQ ID NO: 378232 - RNA, 19 nt, Homo sapiens
ggagguggagguugcagug

SEQ ID NO: 378233 - RNA, 20 nt, Homo sapiens
ggagguggagguugcaguga

SEQ ID NO: 378234 - RNA, 22 nt, Homo sapiens
ggagguugcagugagcugagau

SEQ ID NO: 378235 - RNA, 18 nt, Homo sapiens
ggaucaagaaggggacag

SEQ ID NO: 378236 - RNA, 22 nt, Homo sapiens
ggaucaagaaggggacagcgcc

SEQ ID NO: 378237 - RNA, 16 nt, Homo sapiens
ggcagucauacugggg

SEQ ID NO: 378238 - RNA, 15 nt, Homo sapiens
ggccccggcucccac

SEQ ID NO: 378239 - RNA, 13 nt, Homo sapiens
ggcugggugguga

SEQ ID NO: 378240 - RNA, 13 nt, Homo sapiens
gggacaccagcca

SEQ ID NO: 378241 - RNA, 16 nt, Homo sapiens
gggcagugaguccucu

SEQ ID NO: 378242 - RNA, 12 nt, Homo sapiens
gggcccagugcu

SEQ ID NO: 378243 - RNA, 22 nt, Homo sapiens
ggguugucaagagagagucaaa

SEQ ID NO: 378244 - RNA, 17 nt, Homo sapiens
gguggagguugcaguga

SEQ ID NO: 378245 - RNA, 13 nt, Homo sapiens
gguugcagugagc

SEQ ID NO: 378246 - RNA, 15 nt, Homo sapiens
guaaacagcucugug

SEQ ID NO: 378247 - RNA, 20 nt, Homo sapiens
guaaucccagcuacauggga

SEQ ID NO: 378248 - RNA, 20 nt, Homo sapiens
gucucucaaagaccccaugg

SEQ ID NO: 378249 - RNA, 20 nt, Homo sapiens
gugaaagcaucacuugggau

SEQ ID NO: 378250 - RNA, 18 nt, Homo sapiens
gugcauagagccacguau

SEQ ID NO: 378251 - RNA, 19 nt, Homo sapiens
gugcucggcuguaaacagc

SEQ ID NO: 378252 - RNA, 15 nt, Homo sapiens
guggaauugugcuga

SEQ ID NO: 378253 - RNA, 22 nt, Homo sapiens
guggcagaauggggugcaugaa

SEQ ID NO: 378254 - RNA, 12 nt, Homo sapiens
gugggugccugu

SEQ ID NO: 378255 - RNA, 21 nt, Homo sapiens
guucccagcucagugccaaag

SEQ ID NO: 378256 - RNA, 14 nt, Homo sapiens
guuguauugcauau

SEQ ID NO: 378257 - RNA, 21 nt, Homo sapiens
guuucuuggucucagcuucau

SEQ ID NO: 378258 - RNA, 11 nt, Homo sapiens
uaaaagcacuu

SEQ ID NO: 378259 - RNA, 12 nt, Homo sapiens
uaaaagcacuua

SEQ ID NO: 378260 - RNA, 15 nt, Homo sapiens
uaaauuuaucaucuc

SEQ ID NO: 378261 - RNA, 22 nt, Homo sapiens
uaaguuuuccuuuuguuuucca

SEQ ID NO: 378262 - RNA, 12 nt, Homo sapiens
uacaaacaugug

SEQ ID NO: 378263 - RNA, 15 nt, Homo sapiens
uaccagcucacuccc

SEQ ID NO: 378264 - RNA, 15 nt, Homo sapiens
uauuuguuugugcau

SEQ ID NO: 378265 - RNA, 16 nt, Homo sapiens
ucaaaaauacucacau

SEQ ID NO: 378266 - RNA, 13 nt, Homo sapiens
ucacaagcacuuu

SEQ ID NO: 378267 - RNA, 22 nt, Homo sapiens
uccagccaauaaaucaacucca

SEQ ID NO: 378268 - RNA, 17 nt, Homo sapiens
uccagugguaccagcuc

SEQ ID NO: 378269 - RNA, 15 nt, Homo sapiens
ucccaccggugccaa

SEQ ID NO: 378270 - RNA, 16 nt, Homo sapiens
ucccaccggugccaaa

SEQ ID NO: 378271 - RNA, 22 nt, Homo sapiens
ucccguuccgugggaugccaua

SEQ ID NO: 378272 - RNA, 18 nt, Homo sapiens
uccuuuuguuuuccacuc

SEQ ID NO: 378273 - RNA, 14 nt, Homo sapiens
ucuucucucggggc

SEQ ID NO: 378274 - RNA, 17 nt, Homo sapiens
ugaauauaaacacuaua

SEQ ID NO: 378275 - RNA, 16 nt, Homo sapiens
ugacacugccagucac

SEQ ID NO: 378276 - RNA, 20 nt, Homo sapiens
uguaugauuacaucaaggcu

SEQ ID NO: 378277 - RNA, 12 nt, Homo sapiens
ugucagugcucg

SEQ ID NO: 378278 - RNA, 19 nt, Homo sapiens
ugugguggugggugccugu

SEQ ID NO: 378279 - RNA, 22 nt, Homo sapiens
ugugguuaaugccauggacaga

SEQ ID NO: 378280 - RNA, 17 nt, Homo sapiens
uguguuucuggggacac

SEQ ID NO: 378281 - RNA, 18 nt, Homo sapiens
uguuucuggggacaccag

SEQ ID NO: 378282 - RNA, 18 nt, Homo sapiens
uuaauuugauaguauugu

SEQ ID NO: 378283 - RNA, 18 nt, Homo sapiens
uuauagccgaaaugaucu

SEQ ID NO: 378284 - RNA, 16 nt, Homo sapiens
uuccucaguccuggaa

SEQ ID NO: 378285 - RNA, 18 nt, Homo sapiens
uuccuuuuguuuuccacu

SEQ ID NO: 378286 - RNA, 16 nt, Homo sapiens
uucgauggcauccugc

SEQ ID NO: 378287 - RNA, 16 nt, Homo sapiens
uugaauauaaacacua

SEQ ID NO: 378288 - RNA, 20 nt, Homo sapiens
uugauugcguggaauugugc

SEQ ID NO: 378289 - RNA, 19 nt, Homo sapiens
uugcgccacugcacuccag

SEQ ID NO: 378290 - RNA, 12 nt, Homo sapiens
uuggucucagcu

SEQ ID NO: 378291 - RNA, 18 nt, Homo sapiens
uugucaagagagagucaa

SEQ ID NO: 378292 - RNA, 16 nt, Homo sapiens
uuucugucacaucagc

SEQ ID NO: 378293 - RNA, 17 nt, Homo sapiens
uuugcagcugugccaua

SEQ ID NO: 378294 - RNA, 16 nt, Homo sapiens
ccccacuucucuacuc

SEQ ID NO: 378295 - RNA, 20 nt, Homo sapiens
ccccagauggccgggacaug

SEQ ID NO: 378296 - RNA, 13 nt, Homo sapiens
cccgcccucggga

SEQ ID NO: 378297 - RNA, 12 nt, Homo sapiens
cccgcucugcac

SEQ ID NO: 378298 - RNA, 21 nt, Homo sapiens
ccggcucccaccggugccaaa

SEQ ID NO: 378299 - RNA, 23 nt, Homo sapiens
ccugccccacuucucuacucugg

SEQ ID NO: 378300 - RNA, 14 nt, Homo sapiens
ccugcggccgucac

SEQ ID NO: 378301 - RNA, 20 nt, Homo sapiens
ccuggaaauuaaacccugcc

SEQ ID NO: 378302 - RNA, 19 nt, Homo sapiens
ccuggaagccggccggcug

SEQ ID NO: 378303 - RNA, 19 nt, Homo sapiens
ccuggugaccuacuaaaaa

SEQ ID NO: 378304 - RNA, 21 nt, Homo sapiens
ccuguaaucccagcuacaugg

SEQ ID NO: 378305 - RNA, 18 nt, Homo sapiens
ccuuccucaguccuggaa

SEQ ID NO: 378306 - RNA, 21 nt, Homo sapiens
cgccaccucuugucagugcuc

SEQ ID NO: 378307 - RNA, 17 nt, Homo sapiens
cggcucccaccggugcc

SEQ ID NO: 378308 - RNA, 19 nt, Homo sapiens
cggcucccaccggugccaa

SEQ ID NO: 378309 - RNA, 21 nt, Homo sapiens
cggggcgaccccucagugcuc

SEQ ID NO: 378310 - RNA, 23 nt, Homo sapiens
cggugccaaacccagccccugcg

SEQ ID NO: 378311 - RNA, 11 nt, Homo sapiens
cgucagucucu

SEQ ID NO: 378312 - RNA, 19 nt, Homo sapiens
cuaaagguuguauugcaua

SEQ ID NO: 378313 - RNA, 23 nt, Homo sapiens
cucagcccucgggccgggcacca

SEQ ID NO: 378314 - RNA, 19 nt, Homo sapiens
cuccagucuggucggcaag

SEQ ID NO: 378315 - RNA, 16 nt, Homo sapiens
cucccaccggugccaa

SEQ ID NO: 378316 - RNA, 17 nt, Homo sapiens
cucgaagcccuuccagu

SEQ ID NO: 378317 - RNA, 13 nt, Homo sapiens
cucuacucuggaa

SEQ ID NO: 378318 - RNA, 20 nt, Homo sapiens
cucugaugagagagugcuga

SEQ ID NO: 378319 - RNA, 12 nt, Homo sapiens
cucugcuugcca

SEQ ID NO: 378320 - RNA, 22 nt, Homo sapiens
cucuguguuucuggggacacca

SEQ ID NO: 378321 - RNA, 15 nt, Homo sapiens
cugagaaggacaccu

SEQ ID NO: 378322 - RNA, 16 nt, Homo sapiens
cugagaaggacaccuc

SEQ ID NO: 378323 - RNA, 22 nt, Homo sapiens
cugagauugcgccacugcacuc

SEQ ID NO: 378324 - RNA, 23 nt, Homo sapiens
cugagucccguggggccccggcu

SEQ ID NO: 378325 - RNA, 18 nt, Homo sapiens
cugaugagagagugcuga

SEQ ID NO: 378326 - RNA, 21 nt, Homo sapiens
cugaugagagagugcugagaa

SEQ ID NO: 378327 - RNA, 15 nt, Homo sapiens
cugccagucacgagc

SEQ ID NO: 378328 - RNA, 20 nt, Homo sapiens
cuggcagagaaggcuuccuc

SEQ ID NO: 378329 - RNA, 21 nt, Homo sapiens
cugggaucaagaaggggacag

SEQ ID NO: 378330 - RNA, 13 nt, Homo sapiens
cuggggacaccag

SEQ ID NO: 378331 - RNA, 13 nt, Homo sapiens
cuuccugacccuc

SEQ ID NO: 378332 - RNA, 21 nt, Homo sapiens
cuucgauggcauccugcagug

SEQ ID NO: 378333 - RNA, 18 nt, Homo sapiens
cuugaagacaauggcuua

SEQ ID NO: 378334 - RNA, 14 nt, Homo sapiens
cuuuauugcuccug

SEQ ID NO: 378335 - RNA, 17 nt, Homo sapiens
gaaaauaaaagcacuua

SEQ ID NO: 378336 - RNA, 15 nt, Homo sapiens
gaaaauuaacacugc

SEQ ID NO: 378337 - RNA, 19 nt, Homo sapiens
gaaacuggaugaggucaua

SEQ ID NO: 378338 - RNA, 16 nt, Homo sapiens
gaacucgaagcccuuc

SEQ ID NO: 378339 - RNA, 19 nt, Homo sapiens
gaagacuauauuguacaca

SEQ ID NO: 378340 - RNA, 20 nt, Homo sapiens
gacaauggcuuacuccagga

SEQ ID NO: 378341 - RNA, 23 nt, Homo sapiens
gacaccagccaucaugugccugg

SEQ ID NO: 378342 - RNA, 16 nt, Homo sapiens
gacagcgccaccucuu

SEQ ID NO: 378343 - RNA, 17 nt, Homo sapiens
gaccccaugguccaucc

SEQ ID NO: 378344 - RNA, 14 nt, Homo sapiens
gacgcacagcacug

SEQ ID NO: 378345 - RNA, 20 nt, Homo sapiens
gacuccgucucaaaaacaaa

SEQ ID NO: 378346 - RNA, 13 nt, Homo sapiens
gagacuccgucuc

SEQ ID NO: 378347 - RNA, 20 nt, Homo sapiens
gagaggugggcagcagcuca

SEQ ID NO: 378348 - RNA, 18 nt, Homo sapiens
gagccccaaagaucccac

SEQ ID NO: 378349 - RNA, 16 nt, Homo sapiens
gagccugaggcaugag

SEQ ID NO: 378350 - RNA, 12 nt, Homo sapiens
gagugcugagaa

SEQ ID NO: 378351 - RNA, 17 nt, Homo sapiens
gaucucacaagcacuuu

SEQ ID NO: 378352 - RNA, 16 nt, Homo sapiens
gaugagagagugcuga

SEQ ID NO: 378353 - RNA, 22 nt, Homo sapiens
gcacacgggccucugcuugcca

SEQ ID NO: 378354 - RNA, 16 nt, Homo sapiens
gcacucaaccaaccuc

SEQ ID NO: 378355 - RNA, 14 nt, Homo sapiens
gcauccugcagugg

SEQ ID NO: 378356 - RNA, 17 nt, Homo sapiens
gcaugaagguuucugaa

SEQ ID NO: 378357 - RNA, 17 nt, Homo sapiens
gcaugagaaucacuuga

SEQ ID NO: 378358 - RNA, 18 nt, Homo sapiens
gccaaggaugacacugcc

SEQ ID NO: 378359 - RNA, 14 nt, Homo sapiens
gccacacagcagcg

SEQ ID NO: 378360 - RNA, 21 nt, Homo sapiens
gccacagcuggugguaucuga

SEQ ID NO: 378361 - RNA, 14 nt, Homo sapiens
gccaucaugugccu

SEQ ID NO: 378362 - RNA, 18 nt, Homo sapiens
gccaucaugugccuggaa

SEQ ID NO: 378363 - RNA, 14 nt, Homo sapiens
gccgagccccagga

SEQ ID NO: 378364 - RNA, 13 nt, Homo sapiens
gccgggacaugca

SEQ ID NO: 378365 - RNA, 13 nt, Homo sapiens
gccuacacugcca

SEQ ID NO: 378366 - RNA, 16 nt, Homo sapiens
gccugaggcaugagaa

SEQ ID NO: 378367 - RNA, 13 nt, Homo sapiens
gcgagcacaccuu

SEQ ID NO: 378368 - RNA, 15 nt, Homo sapiens
gcgcuguuccacagu

SEQ ID NO: 378369 - RNA, 14 nt, Homo sapiens
gcugagaaggacac

SEQ ID NO: 378370 - RNA, 14 nt, Homo sapiens
gcuggggagcgaaa

SEQ ID NO: 378371 - RNA, 17 nt, Homo sapiens
ggaaacuggaugagguc

SEQ ID NO: 378372 - RNA, 19 nt, Homo sapiens
ggaaacuggaugaggucau

SEQ ID NO: 378373 - RNA, 21 nt, Homo sapiens
ggacagcgccaccucuuguca

SEQ ID NO: 378374 - RNA, 17 nt, Homo sapiens
ggagguagcucccagca

SEQ ID NO: 378375 - RNA, 14 nt, Homo sapiens
ggagguugcaguga

SEQ ID NO: 378376 - RNA, 20 nt, Homo sapiens
ggcauccugcagugggccau

SEQ ID NO: 378377 - RNA, 16 nt, Homo sapiens
ggcauucacaucucau

SEQ ID NO: 378378 - RNA, 14 nt, Homo sapiens
ggccacacagcagc

SEQ ID NO: 378379 - RNA, 19 nt, Homo sapiens
gggagccucuccuugccug

SEQ ID NO: 378380 - RNA, 17 nt, Homo sapiens
gggauguuucugucaca

SEQ ID NO: 378381 - RNA, 20 nt, Homo sapiens
ggggcccagugcuggccaca

SEQ ID NO: 378382 - RNA, 19 nt, Homo sapiens
gguacaaggggcccagugc

SEQ ID NO: 378383 - RNA, 18 nt, Homo sapiens
guccccaugauucccucc

SEQ ID NO: 378384 - RNA, 23 nt, Homo sapiens
gugcucggcagucauacuggggu

SEQ ID NO: 378385 - RNA, 22 nt, Homo sapiens
gugcucggcuguaaacagcucu

SEQ ID NO: 378386 - RNA, 16 nt, Homo sapiens
gugcuggccacacagc

SEQ ID NO: 378387 - RNA, 17 nt, Homo sapiens
guggcauucacaucuca

SEQ ID NO: 378388 - RNA, 22 nt, Homo sapiens
gugggacccacagucacacaga

SEQ ID NO: 378389 - RNA, 12 nt, Homo sapiens
gugguaccagcu

SEQ ID NO: 378390 - RNA, 17 nt, Homo sapiens
guguugacaugugcuuu

SEQ ID NO: 378391 - RNA, 14 nt, Homo sapiens
guuucuggggacac

SEQ ID NO: 378392 - RNA, 23 nt, Homo sapiens
uaaaagccgcccagugggaccca

SEQ ID NO: 378393 - RNA, 23 nt, Homo sapiens
uaacauaaauuuaucaucucgac

SEQ ID NO: 378394 - RNA, 12 nt, Homo sapiens
uaccagcucacu

SEQ ID NO: 378395 - RNA, 15 nt, Homo sapiens
uagcuuggaaacugg

SEQ ID NO: 378396 - RNA, 14 nt, Homo sapiens
uaucugaguugacu

SEQ ID NO: 378397 - RNA, 19 nt, Homo sapiens
uauggcagugucuuuccac

SEQ ID NO: 378398 - RNA, 13 nt, Homo sapiens
uauugugcauaga

SEQ ID NO: 378399 - RNA, 21 nt, Homo sapiens
ucacaugaaggagacagcagc

SEQ ID NO: 378400 - RNA, 19 nt, Homo sapiens
ucaguggcauucacaucuc

SEQ ID NO: 378401 - RNA, 20 nt, Homo sapiens
ucaguggcauucacaucuca

SEQ ID NO: 378402 - RNA, 23 nt, Homo sapiens
uccagagacucgaguccccauga

SEQ ID NO: 378403 - RNA, 23 nt, Homo sapiens
uccagugguaccagcucacuccc

SEQ ID NO: 378404 - RNA, 17 nt, Homo sapiens
ucccagcucagugccaa

SEQ ID NO: 378405 - RNA, 17 nt, Homo sapiens
uccuguacgaaccccuc

SEQ ID NO: 378406 - RNA, 14 nt, Homo sapiens
ucucacaagcacuu

SEQ ID NO: 378407 - RNA, 19 nt, Homo sapiens
ucugaaaauuaacacugcu

SEQ ID NO: 378408 - RNA, 16 nt, Homo sapiens
ugaaaauuaacacugc

SEQ ID NO: 378409 - RNA, 16 nt, Homo sapiens
ugaaggagacagcagc

SEQ ID NO: 378410 - RNA, 16 nt, Homo sapiens
cgcacagcacugccug

SEQ ID NO: 378411 - RNA, 16 nt, Homo sapiens
cgccuggccccugggc

SEQ ID NO: 378412 - RNA, 21 nt, Homo sapiens
cggaugucccaucugcuccuc

SEQ ID NO: 378413 - RNA, 21 nt, Homo sapiens
cguagccaucuccguggccaa

SEQ ID NO: 378414 - RNA, 17 nt, Homo sapiens
cgucagucucucaaaga

SEQ ID NO: 378415 - RNA, 20 nt, Homo sapiens
cguggaauugugcugaguug

SEQ ID NO: 378416 - RNA, 17 nt, Homo sapiens
cguguacuacaauuuaa

SEQ ID NO: 378417 - RNA, 21 nt, Homo sapiens
cuaacuuuuuugcuauccagc

SEQ ID NO: 378418 - RNA, 13 nt, Homo sapiens
cuaccgugccagc

SEQ ID NO: 378419 - RNA, 16 nt, Homo sapiens
cuauauggcagugucu

SEQ ID NO: 378420 - RNA, 17 nt, Homo sapiens
cuauauuguacacaccu

SEQ ID NO: 378421 - RNA, 23 nt, Homo sapiens
cuauuuuuauuuguuugugcauu

SEQ ID NO: 378422 - RNA, 14 nt, Homo sapiens
cucacaagcacuuu

SEQ ID NO: 378423 - RNA, 22 nt, Homo sapiens
cucugcacagggaugaccugga

SEQ ID NO: 378424 - RNA, 13 nt, Homo sapiens
cucuuggugccuc

SEQ ID NO: 378425 - RNA, 23 nt, Homo sapiens
cugcagugggccauccagagcau

SEQ ID NO: 378426 - RNA, 22 nt, Homo sapiens
cugccaagcgagaaugcaggcc

SEQ ID NO: 378427 - RNA, 23 nt, Homo sapiens
cugccccacuucucuacucugga

SEQ ID NO: 378428 - RNA, 14 nt, Homo sapiens
cuggggacaccagc

SEQ ID NO: 378429 - RNA, 18 nt, Homo sapiens
cuggggacaccagccauc

SEQ ID NO: 378430 - RNA, 15 nt, Homo sapiens
cuggguggugaagga

SEQ ID NO: 378431 - RNA, 13 nt, Homo sapiens
cuguuccacagug

SEQ ID NO: 378432 - RNA, 14 nt, Homo sapiens
cuuacaaacaugug

SEQ ID NO: 378433 - RNA, 14 nt, Homo sapiens
cuucauuuccguga

SEQ ID NO: 378434 - RNA, 22 nt, Homo sapiens
cuuccagugguaccagcucacu

SEQ ID NO: 378435 - RNA, 16 nt, Homo sapiens
cuucgauggcauccug

SEQ ID NO: 378436 - RNA, 21 nt, Homo sapiens
cuucucucggggcgaccccuc

SEQ ID NO: 378437 - RNA, 19 nt, Homo sapiens
cuugccuggugaccuacua

SEQ ID NO: 378438 - RNA, 18 nt, Homo sapiens
gaaagacagagcugggau

SEQ ID NO: 378439 - RNA, 18 nt, Homo sapiens
gaaagcaucacuugggau

SEQ ID NO: 378440 - RNA, 23 nt, Homo sapiens
gaagacaauggcuuacuccagga

SEQ ID NO: 378441 - RNA, 19 nt, Homo sapiens
gaauggggugcaugaaggu

SEQ ID NO: 378442 - RNA, 23 nt, Homo sapiens
gaauuaaguuagggaauggcaca

SEQ ID NO: 378443 - RNA, 20 nt, Homo sapiens
gaccccaccgccaccgugug

SEQ ID NO: 378444 - RNA, 22 nt, Homo sapiens
gaccuucuaggaagcuccaguu

SEQ ID NO: 378445 - RNA, 19 nt, Homo sapiens
gagaaggacaccuccuucc

SEQ ID NO: 378446 - RNA, 16 nt, Homo sapiens
gagagagugcugagaa

SEQ ID NO: 378447 - RNA, 16 nt, Homo sapiens
gagccacguauguuuu

SEQ ID NO: 378448 - RNA, 21 nt, Homo sapiens
gagcccgcucugcacagggau

SEQ ID NO: 378449 - RNA, 18 nt, Homo sapiens
gagcccgucaggccacag

SEQ ID NO: 378450 - RNA, 16 nt, Homo sapiens
gagcugggauguuucu

SEQ ID NO: 378451 - RNA, 21 nt, Homo sapiens
gaggcauuugcagcugugcca

SEQ ID NO: 378452 - RNA, 18 nt, Homo sapiens
gaggugggcagcagcuca

SEQ ID NO: 378453 - RNA, 19 nt, Homo sapiens
gagugagacuccgucucaa

SEQ ID NO: 378454 - RNA, 16 nt, Homo sapiens
gaucucacaagcacuu

SEQ ID NO: 378455 - RNA, 21 nt, Homo sapiens
gaugaggucauagcagugcuu

SEQ ID NO: 378456 - RNA, 15 nt, Homo sapiens
gcauauauacauaua

SEQ ID NO: 378457 - RNA, 18 nt, Homo sapiens
gcaugagaaucacuugaa

SEQ ID NO: 378458 - RNA, 17 nt, Homo sapiens
gcccucagcccucgggc

SEQ ID NO: 378459 - RNA, 17 nt, Homo sapiens
gcgaccccucagugcuc

SEQ ID NO: 378460 - RNA, 14 nt, Homo sapiens
gcggacaccauguu

SEQ ID NO: 378461 - RNA, 19 nt, Homo sapiens
gcguaacccucgcccuguc

SEQ ID NO: 378462 - RNA, 14 nt, Homo sapiens
gcucccagcacuca

SEQ ID NO: 378463 - RNA, 22 nt, Homo sapiens
gcucugcacagggaugaccugg

SEQ ID NO: 378464 - RNA, 23 nt, Homo sapiens
gcuuggaaacuggaugaggucau

SEQ ID NO: 378465 - RNA, 20 nt, Homo sapiens
ggaaacuggaugaggucaua

SEQ ID NO: 378466 - RNA, 20 nt, Homo sapiens
ggagaggggagagggacgca

SEQ ID NO: 378467 - RNA, 23 nt, Homo sapiens
ggagccucuccuugccuggugac

SEQ ID NO: 378468 - RNA, 17 nt, Homo sapiens
ggaucucacaagcacuu

SEQ ID NO: 378469 - RNA, 21 nt, Homo sapiens
ggaugccauaaaagccgccca

SEQ ID NO: 378470 - RNA, 15 nt, Homo sapiens
ggcaccgagaacucg

SEQ ID NO: 378471 - RNA, 17 nt, Homo sapiens
ggccccugggccugcca

SEQ ID NO: 378472 - RNA, 14 nt, Homo sapiens
ggcccguccggcgg

SEQ ID NO: 378473 - RNA, 19 nt, Homo sapiens
ggcgcuguuccacagugac

SEQ ID NO: 378474 - RNA, 22 nt, Homo sapiens
ggcuuccuccagcggcugggug

SEQ ID NO: 378475 - RNA, 22 nt, Homo sapiens
gggacagcgccaccucuuguca

SEQ ID NO: 378476 - RNA, 12 nt, Homo sapiens
gggacaugcagc

SEQ ID NO: 378477 - RNA, 23 nt, Homo sapiens
gggccugccaaggaugacacugc

SEQ ID NO: 378478 - RNA, 21 nt, Homo sapiens
gggcgcuguuccacagugacu

SEQ ID NO: 378479 - RNA, 17 nt, Homo sapiens
ggggcuuuuacaccagu

SEQ ID NO: 378480 - RNA, 19 nt, Homo sapiens
ggguacaaggggcccagug

SEQ ID NO: 378481 - RNA, 11 nt, Homo sapiens
gggugccugua

SEQ ID NO: 378482 - RNA, 11 nt, Homo sapiens
ggucauuugcu

SEQ ID NO: 378483 - RNA, 16 nt, Homo sapiens
gucccaucugcuccuc

SEQ ID NO: 378484 - RNA, 17 nt, Homo sapiens
gugagacuccgucucaa

SEQ ID NO: 378485 - RNA, 15 nt, Homo sapiens
gugcucggcagucau

SEQ ID NO: 378486 - RNA, 13 nt, Homo sapiens
gugcuggccacac

SEQ ID NO: 378487 - RNA, 15 nt, Homo sapiens
gugggcagcagcuca

SEQ ID NO: 378488 - RNA, 15 nt, Homo sapiens
gugguaccagcucac

SEQ ID NO: 378489 - RNA, 15 nt, Homo sapiens
guguuucuggggaca

SEQ ID NO: 378490 - RNA, 16 nt, Homo sapiens
guguuucuggggacac

SEQ ID NO: 378491 - RNA, 13 nt, Homo sapiens
guucaguggcauu

SEQ ID NO: 378492 - RNA, 19 nt, Homo sapiens
guuggaugcggaacccaaa

SEQ ID NO: 378493 - RNA, 21 nt, Homo sapiens
guuucuggggacaccagccau

SEQ ID NO: 378494 - RNA, 16 nt, Homo sapiens
uaaaagccgcccagug

SEQ ID NO: 378495 - RNA, 14 nt, Homo sapiens
uaaacaaauguaug

SEQ ID NO: 378496 - RNA, 18 nt, Homo sapiens
uaaacaaauguaugauua

SEQ ID NO: 378497 - RNA, 14 nt, Homo sapiens
uaaauaaguuuucc

SEQ ID NO: 378498 - RNA, 16 nt, Homo sapiens
uaaauuuaucaucucg

SEQ ID NO: 378499 - RNA, 19 nt, Homo sapiens
uaaguuagggaauggcaca

SEQ ID NO: 378500 - RNA, 21 nt, Homo sapiens
uaauuugauaguauugugcau

SEQ ID NO: 378501 - RNA, 17 nt, Homo sapiens
uacuccaggagacccac

SEQ ID NO: 378502 - RNA, 13 nt, Homo sapiens
ucaaaaauacuca

SEQ ID NO: 378503 - RNA, 20 nt, Homo sapiens
ucaaaaauacucacauggcu

SEQ ID NO: 378504 - RNA, 22 nt, Homo sapiens
ucacaugaaggagacagcagca

SEQ ID NO: 378505 - RNA, 17 nt, Homo sapiens
ucaccccgccagccuac

SEQ ID NO: 378506 - RNA, 16 nt, Homo sapiens
ucacuugaacucggga

SEQ ID NO: 378507 - RNA, 21 nt, Homo sapiens
ucaggacacuaauacaccagg

SEQ ID NO: 378508 - RNA, 13 nt, Homo sapiens
ucaguccuggaag

SEQ ID NO: 378509 - RNA, 19 nt, Homo sapiens
ucagugcucggcagucaua

SEQ ID NO: 378510 - RNA, 22 nt, Homo sapiens
uccacagugacugggcccuguc

SEQ ID NO: 378511 - RNA, 18 nt, Homo sapiens
ucccagcucagugccaaa

SEQ ID NO: 378512 - RNA, 22 nt, Homo sapiens
ucccccacaagagccccaaaga

SEQ ID NO: 378513 - RNA, 16 nt, Homo sapiens
uccuuuuguuuuccac

SEQ ID NO: 378514 - RNA, 15 nt, Homo sapiens
ucuggggacaccagc

SEQ ID NO: 378515 - RNA, 12 nt, Homo sapiens
ucuuggugccuc

SEQ ID NO: 378516 - RNA, 21 nt, Homo sapiens
ugaguugguguugacaugugc

SEQ ID NO: 378517 - RNA, 14 nt, Homo sapiens
ugcaacaacaugua

SEQ ID NO: 378518 - RNA, 15 nt, Homo sapiens
ugcagcugugccaua

SEQ ID NO: 378519 - RNA, 19 nt, Homo sapiens
ugccuggaaauuaaacccu

SEQ ID NO: 378520 - RNA, 21 nt, Homo sapiens
ugcucggcuguaaacagcucu

SEQ ID NO: 378521 - RNA, 18 nt, Homo sapiens
uggaaauuaaacccugcc

SEQ ID NO: 378522 - RNA, 13 nt, Homo sapiens
uggaauugugcug

SEQ ID NO: 378523 - RNA, 18 nt, Homo sapiens
uggaucucacaagcacuu

SEQ ID NO: 378524 - RNA, 13 nt, Homo sapiens
ugguaccagcuca

SEQ ID NO: 378525 - RNA, 14 nt, Homo sapiens
ugguaccagcucac

SEQ ID NO: 378526 - RNA, 17 nt, Homo sapiens
ugaaggagacagcagca

SEQ ID NO: 378527 - RNA, 14 nt, Homo sapiens
ugacaugugcuuug

SEQ ID NO: 378528 - RNA, 15 nt, Homo sapiens
ugacuaccgugccag

SEQ ID NO: 378529 - RNA, 19 nt, Homo sapiens
ugacuugacagaacacugu

SEQ ID NO: 378530 - RNA, 13 nt, Homo sapiens
ugcaacaacaugu

SEQ ID NO: 378531 - RNA, 21 nt, Homo sapiens
ugcgccacugcacuccagucu

SEQ ID NO: 378532 - RNA, 20 nt, Homo sapiens
ugggaucaagaaggggacag

SEQ ID NO: 378533 - RNA, 15 nt, Homo sapiens
ugggcagcagcucag

SEQ ID NO: 378534 - RNA, 18 nt, Homo sapiens
uggggcuuuuacaccagu

SEQ ID NO: 378535 - RNA, 17 nt, Homo sapiens
uguaaucccagcuacau

SEQ ID NO: 378536 - RNA, 12 nt, Homo sapiens
ugugccuggaaa

SEQ ID NO: 378537 - RNA, 22 nt, Homo sapiens
ugugcugaguugguguugacau

SEQ ID NO: 378538 - RNA, 19 nt, Homo sapiens
ugugguuaaugccauggac

SEQ ID NO: 378539 - RNA, 21 nt, Homo sapiens
uguguuucuggggacaccagc

SEQ ID NO: 378540 - RNA, 14 nt, Homo sapiens
uguugacaugugcu

SEQ ID NO: 378541 - RNA, 11 nt, Homo sapiens
aaaagcacuua

SEQ ID NO: 378542 - RNA, 22 nt, Homo sapiens
aaacacuauauggcagugucuu

SEQ ID NO: 378543 - RNA, 14 nt, Homo sapiens
aaauaaaagcacuu

SEQ ID NO: 378544 - RNA, 17 nt, Homo sapiens
aaaugcaacaacaugua

SEQ ID NO: 378545 - RNA, 15 nt, Homo sapiens
aaauuaaacccugcc

SEQ ID NO: 378546 - RNA, 20 nt, Homo sapiens
aacauaaauuuaucaucucg

SEQ ID NO: 378547 - RNA, 21 nt, Homo sapiens
aacaugugguuaaugccaugg

SEQ ID NO: 378548 - RNA, 23 nt, Homo sapiens
aacccucgcccugucccucccac

SEQ ID NO: 378549 - RNA, 20 nt, Homo sapiens
aacucaauauuuuccaugaa

SEQ ID NO: 378550 - RNA, 17 nt, Homo sapiens
aagacuauauuguacac

SEQ ID NO: 378551 - RNA, 20 nt, Homo sapiens
aagagugagacuccgucuca

SEQ ID NO: 378552 - RNA, 21 nt, Homo sapiens
aagagugagacuccgucucaa

SEQ ID NO: 378553 - RNA, 14 nt, Homo sapiens
aagccggccggcug

SEQ ID NO: 378554 - RNA, 12 nt, Homo sapiens
aaggacaccucc

SEQ ID NO: 378555 - RNA, 22 nt, Homo sapiens
aaguuagggaauggcacagccc

SEQ ID NO: 378556 - RNA, 22 nt, Homo sapiens
aaguuuuccuuuuguuuuccac

SEQ ID NO: 378557 - RNA, 15 nt, Homo sapiens
aauauuuuccaugaa

SEQ ID NO: 378558 - RNA, 17 nt, Homo sapiens
aauucaucucucuuuaa

SEQ ID NO: 378559 - RNA, 18 nt, Homo sapiens
aauucuuacaaacaugug

SEQ ID NO: 378560 - RNA, 19 nt, Homo sapiens
aauucuuacaaacaugugg

SEQ ID NO: 378561 - RNA, 14 nt, Homo sapiens
aauuuaucaucucg

SEQ ID NO: 378562 - RNA, 12 nt, Homo sapiens
acaaacaugugg

SEQ ID NO: 378563 - RNA, 17 nt, Homo sapiens
acacuaauacaccaggu

SEQ ID NO: 378564 - RNA, 19 nt, Homo sapiens
acagagcgccucaccugca

SEQ ID NO: 378565 - RNA, 22 nt, Homo sapiens
acagcagcacccacccaugcac

SEQ ID NO: 378566 - RNA, 17 nt, Homo sapiens
acagcucuguguuucug

SEQ ID NO: 378567 - RNA, 15 nt, Homo sapiens
accacauaacauaaa

SEQ ID NO: 378568 - RNA, 23 nt, Homo sapiens
accccagauggccgggacaugca

SEQ ID NO: 378569 - RNA, 21 nt, Homo sapiens
acucuggaaguccccgggagc

SEQ ID NO: 378570 - RNA, 14 nt, Homo sapiens
acugcacuccaguc

SEQ ID NO: 378571 - RNA, 21 nt, Homo sapiens
acugucuugaagacaauggcu

SEQ ID NO: 378572 - RNA, 14 nt, Homo sapiens
agaaggacaccucc

SEQ ID NO: 378573 - RNA, 23 nt, Homo sapiens
agagcugggauguuucugucaca

SEQ ID NO: 378574 - RNA, 18 nt, Homo sapiens
agccccaggagcccguca

SEQ ID NO: 378575 - RNA, 16 nt, Homo sapiens
agccccgcccgccugg

SEQ ID NO: 378576 - RNA, 14 nt, Homo sapiens
agccggccggcugg

SEQ ID NO: 378577 - RNA, 21 nt, Homo sapiens
agccucuccuugccuggugac

SEQ ID NO: 378578 - RNA, 19 nt, Homo sapiens
agcggcuggguggugaagg

SEQ ID NO: 378579 - RNA, 21 nt, Homo sapiens
agcugagauugcgccacugca

SEQ ID NO: 378580 - RNA, 19 nt, Homo sapiens
agcuucauuuccgugaagg

SEQ ID NO: 378581 - RNA, 14 nt, Homo sapiens
agcuuggaaacugg

SEQ ID NO: 378582 - RNA, 14 nt, Homo sapiens
aggaagcuccaguu

SEQ ID NO: 378583 - RNA, 15 nt, Homo sapiens
aggagacccacaggu

SEQ ID NO: 378584 - RNA, 13 nt, Homo sapiens
aggaugacacugc

SEQ ID NO: 378585 - RNA, 16 nt, Homo sapiens
aggaugacacugccag

SEQ ID NO: 378586 - RNA, 15 nt, Homo sapiens
agggacgcacagcac

SEQ ID NO: 378587 - RNA, 15 nt, Homo sapiens
agggaugaccuggag

SEQ ID NO: 378588 - RNA, 11 nt, Homo sapiens
aguccuggaag

SEQ ID NO: 378589 - RNA, 15 nt, Homo sapiens
agugguaccagcuca

SEQ ID NO: 378590 - RNA, 15 nt, Homo sapiens
aguugacuugacaga

SEQ ID NO: 378591 - RNA, 22 nt, Homo sapiens
aguugacuugacagaacacugu

SEQ ID NO: 378592 - RNA, 16 nt, Homo sapiens
auaaaucaacuccagc

SEQ ID NO: 378593 - RNA, 19 nt, Homo sapiens
auaaaucaacuccagcucc

SEQ ID NO: 378594 - RNA, 15 nt, Homo sapiens
auauaaacacuauau

SEQ ID NO: 378595 - RNA, 22 nt, Homo sapiens
aucacaugaaggagacagcagc

SEQ ID NO: 378596 - RNA, 20 nt, Homo sapiens
aucaucucgaccacuuuuca

SEQ ID NO: 378597 - RNA, 13 nt, Homo sapiens
aucaugugccugg

SEQ ID NO: 378598 - RNA, 15 nt, Homo sapiens
aucucacaagcacuu

SEQ ID NO: 378599 - RNA, 16 nt, Homo sapiens
aucucacaagcacuuu

SEQ ID NO: 378600 - RNA, 20 nt, Homo sapiens
aucugaguugacuugacaga

SEQ ID NO: 378601 - RNA, 19 nt, Homo sapiens
aucugcuccucccauuccc

SEQ ID NO: 378602 - RNA, 22 nt, Homo sapiens
augaggucauagcagugcuuga

SEQ ID NO: 378603 - RNA, 21 nt, Homo sapiens
augauucccuccucgucaguc

SEQ ID NO: 378604 - RNA, 13 nt, Homo sapiens
augcagcucugau

SEQ ID NO: 378605 - RNA, 13 nt, Homo sapiens
auggcauccugca

SEQ ID NO: 378606 - RNA, 13 nt, Homo sapiens
augugccuggaaa

SEQ ID NO: 378607 - RNA, 17 nt, Homo sapiens
auguuuuagccagugau

SEQ ID NO: 378608 - RNA, 20 nt, Homo sapiens
auuaauauggggaugcagca

SEQ ID NO: 378609 - RNA, 19 nt, Homo sapiens
auucaucucucuuuaauau

SEQ ID NO: 378610 - RNA, 18 nt, Homo sapiens
auucuaacuuuuuugcua

SEQ ID NO: 378611 - RNA, 14 nt, Homo sapiens
auuuaucaucucga

SEQ ID NO: 378612 - RNA, 15 nt, Homo sapiens
auuugauaguauugu

SEQ ID NO: 378613 - RNA, 20 nt, Homo sapiens
auuuguuaaugguuugaaua

SEQ ID NO: 378614 - RNA, 14 nt, Homo sapiens
auuuguuugugcau

SEQ ID NO: 378615 - RNA, 14 nt, Homo sapiens
auuuuaauuugaua

SEQ ID NO: 378616 - RNA, 14 nt, Homo sapiens
caagaaggggacag

SEQ ID NO: 378617 - RNA, 18 nt, Homo sapiens
caagagugagacuccguc

SEQ ID NO: 378618 - RNA, 15 nt, Homo sapiens
caauaaaucaacucc

SEQ ID NO: 378619 - RNA, 16 nt, Homo sapiens
caauggcuuacuccag

SEQ ID NO: 378620 - RNA, 12 nt, Homo sapiens
cacaagcacuuu

SEQ ID NO: 378621 - RNA, 22 nt, Homo sapiens
cacaccuuauauuuacguauga

SEQ ID NO: 378622 - RNA, 20 nt, Homo sapiens
caccaccucuuucuacagcc

SEQ ID NO: 378623 - RNA, 17 nt, Homo sapiens
caccagccaucaugugc

SEQ ID NO: 378624 - RNA, 18 nt, Homo sapiens
caccucuugucagugcuc

SEQ ID NO: 378625 - RNA, 18 nt, Homo sapiens
cagagaaggcuuccucca

SEQ ID NO: 378626 - RNA, 15 nt, Homo sapiens
cagccuacacugcca

SEQ ID NO: 378627 - RNA, 13 nt, Homo sapiens
cagcgccaccucu

SEQ ID NO: 378628 - RNA, 13 nt, Homo sapiens
cagcucugaugag

SEQ ID NO: 378629 - RNA, 20 nt, Homo sapiens
cagcucuguguuucugggga

SEQ ID NO: 378630 - RNA, 21 nt, Homo sapiens
cagcuucauuuccgugaaggg

SEQ ID NO: 378631 - RNA, 21 nt, Homo sapiens
cagguagaacacaaggucauu

SEQ ID NO: 378632 - RNA, 20 nt, Homo sapiens
cagugagcugagauugcgcc

SEQ ID NO: 378633 - RNA, 17 nt, Homo sapiens
cagugcucggcuguaaa

SEQ ID NO: 378634 - RNA, 23 nt, Homo sapiens
cagugcucggcuguaaacagcuc

SEQ ID NO: 378635 - RNA, 23 nt, Homo sapiens
caguggcauucacaucucaugua

SEQ ID NO: 378636 - RNA, 17 nt, Homo sapiens
cagugucuuuccaccuu

SEQ ID NO: 378637 - RNA, 23 nt, Homo sapiens
caguuucuccuuuauugcuccug

SEQ ID NO: 378638 - RNA, 17 nt, Homo sapiens
caugguccauccccuga

SEQ ID NO: 378639 - RNA, 12 nt, Homo sapiens
cauucacaucuc

SEQ ID NO: 378640 - RNA, 21 nt, Homo sapiens
ccaaggaugacacugccaguc

SEQ ID NO: 378641 - RNA, 16 nt, Homo sapiens
ccagccuacacugcca

SEQ ID NO: 378642 - RNA, 14 nt, Homo sapiens
ugagcuggcccuuu

SEQ ID NO: 378643 - RNA, 14 nt, Homo sapiens
ugcagugggccauc

SEQ ID NO: 378644 - RNA, 19 nt, Homo sapiens
ugcauagagccacguaugu

SEQ ID NO: 378645 - RNA, 13 nt, Homo sapiens
ugcauauauacau

SEQ ID NO: 378646 - RNA, 18 nt, Homo sapiens
ugccaaagaggggucacc

SEQ ID NO: 378647 - RNA, 21 nt, Homo sapiens
ugccauaaaagccgcccagug

SEQ ID NO: 378648 - RNA, 15 nt, Homo sapiens
ugcugagaaggacac

SEQ ID NO: 378649 - RNA, 16 nt, Homo sapiens
ugcuggccacacagca

SEQ ID NO: 378650 - RNA, 17 nt, Homo sapiens
uggcauucacaucucau

SEQ ID NO: 378651 - RNA, 16 nt, Homo sapiens
uggccacacagcagcg

SEQ ID NO: 378652 - RNA, 15 nt, Homo sapiens
uggccccugggccug

SEQ ID NO: 378653 - RNA, 22 nt, Homo sapiens
uggggacaccagccaucaugug

SEQ ID NO: 378654 - RNA, 17 nt, Homo sapiens
ugguggugggugccugu

SEQ ID NO: 378655 - RNA, 17 nt, Homo sapiens
ugugacuaccgugccag

SEQ ID NO: 378656 - RNA, 18 nt, Homo sapiens
uguggaggagcucaggac

SEQ ID NO: 378657 - RNA, 17 nt, Homo sapiens
uuaaacaaauguaugau

SEQ ID NO: 378658 - RNA, 20 nt, Homo sapiens
uuaaacccugccccacuucu

SEQ ID NO: 378659 - RNA, 21 nt, Homo sapiens
uuaaacccugccccacuucuc

SEQ ID NO: 378660 - RNA, 21 nt, Homo sapiens
uucaaaaauacucacauggcu

SEQ ID NO: 378661 - RNA, 14 nt, Homo sapiens
uucauuuccgugaa

SEQ ID NO: 378662 - RNA, 16 nt, Homo sapiens
uuccaugaaaaugcaa

SEQ ID NO: 378663 - RNA, 21 nt, Homo sapiens
uucccagcucagugccaaaga

SEQ ID NO: 378664 - RNA, 14 nt, Homo sapiens
uuccccuccugacc

SEQ ID NO: 378665 - RNA, 16 nt, Homo sapiens
uucuaggaagcuccag

SEQ ID NO: 378666 - RNA, 17 nt, Homo sapiens
uucuaggaagcuccagu

SEQ ID NO: 378667 - RNA, 21 nt, Homo sapiens
uucuuaaacaaauguaugauu

SEQ ID NO: 378668 - RNA, 13 nt, Homo sapiens
uucuuacaaacau

SEQ ID NO: 378669 - RNA, 16 nt, Homo sapiens
uugacagaacacuguc

SEQ ID NO: 378670 - RNA, 12 nt, Homo sapiens
uuguuuuccacu

SEQ ID NO: 378671 - RNA, 12 nt, Homo sapiens
uuuacaccaguu

SEQ ID NO: 378672 - RNA, 17 nt, Homo sapiens
uuucuggggacaccagc

SEQ ID NO: 378673 - RNA, 13 nt, Homo sapiens
cuaacuagcuugg

SEQ ID NO: 378674 - RNA, 11 nt, Homo sapiens
cuauccagcua

SEQ ID NO: 378675 - RNA, 14 nt, Homo sapiens
cucaaagaccccau

SEQ ID NO: 378676 - RNA, 13 nt, Homo sapiens
cucacaagcacuu

SEQ ID NO: 378677 - RNA, 17 nt, Homo sapiens
cuccuuuauugcuccug

SEQ ID NO: 378678 - RNA, 21 nt, Homo sapiens
cucggggcgaccccucagugc

SEQ ID NO: 378679 - RNA, 14 nt, Homo sapiens
cucuccuugccugg

SEQ ID NO: 378680 - RNA, 21 nt, Homo sapiens
cucuccuugccuggugaccua

SEQ ID NO: 378681 - RNA, 17 nt, Homo sapiens
cugaaaauuaacacugc

SEQ ID NO: 378682 - RNA, 17 nt, Homo sapiens
cugagcgagcacaccuu

SEQ ID NO: 378683 - RNA, 19 nt, Homo sapiens
cugccccacuucucuacuc

SEQ ID NO: 378684 - RNA, 16 nt, Homo sapiens
cugcuccucccauucc

SEQ ID NO: 378685 - RNA, 19 nt, Homo sapiens
cuggcucuucucucggggc

SEQ ID NO: 378686 - RNA, 20 nt, Homo sapiens
cugggaucaagaaggggaca

SEQ ID NO: 378687 - RNA, 15 nt, Homo sapiens
cuggggacaccagcc

SEQ ID NO: 378688 - RNA, 23 nt, Homo sapiens
cugggggcgcuguuccacaguga

SEQ ID NO: 378689 - RNA, 18 nt, Homo sapiens
cuuacaaacaugugguua

SEQ ID NO: 378690 - RNA, 17 nt, Homo sapiens
cuugacagaacacuguc

SEQ ID NO: 378691 - RNA, 21 nt, Homo sapiens
cuugucagugcucggcuguaa

SEQ ID NO: 378692 - RNA, 16 nt, Homo sapiens
gaaaauaaaagcacuu

SEQ ID NO: 378693 - RNA, 14 nt, Homo sapiens
gaaaauuaacacug

SEQ ID NO: 378694 - RNA, 14 nt, Homo sapiens
gaacacaaggucau

SEQ ID NO: 378695 - RNA, 15 nt, Homo sapiens
gaacacaaggucauu

SEQ ID NO: 378696 - RNA, 23 nt, Homo sapiens
gaacucgaagcccuuccaguggu

SEQ ID NO: 378697 - RNA, 17 nt, Homo sapiens
gaagacuauauuguaca

SEQ ID NO: 378698 - RNA, 19 nt, Homo sapiens
gaagccggccggcugggau

SEQ ID NO: 378699 - RNA, 17 nt, Homo sapiens
gaauauaaacacuauau

SEQ ID NO: 378700 - RNA, 14 nt, Homo sapiens
gacagagcugggau

SEQ ID NO: 378701 - RNA, 16 nt, Homo sapiens
gacaugcagcucugau

SEQ ID NO: 378702 - RNA, 19 nt, Homo sapiens
gaccccaugguccaucccc

SEQ ID NO: 378703 - RNA, 17 nt, Homo sapiens
gacucgaguccccauga

SEQ ID NO: 378704 - RNA, 20 nt, Homo sapiens
gacuugacagaacacugucu

SEQ ID NO: 378705 - RNA, 17 nt, Homo sapiens
gagaaucacuugaacuc

SEQ ID NO: 378706 - RNA, 20 nt, Homo sapiens
gagauugcgccacugcacuc

SEQ ID NO: 378707 - RNA, 21 nt, Homo sapiens
gagauugcgccacugcacucc

SEQ ID NO: 378708 - RNA, 15 nt, Homo sapiens
gagccucuccuugcc

SEQ ID NO: 378709 - RNA, 20 nt, Homo sapiens
gagguagcucccagcacuca

SEQ ID NO: 378710 - RNA, 19 nt, Homo sapiens
gagguggagguugcaguga

SEQ ID NO: 378711 - RNA, 20 nt, Homo sapiens
gagguggagguugcagugag

SEQ ID NO: 378712 - RNA, 19 nt, Homo sapiens
gaggugggcagcagcucag

SEQ ID NO: 378713 - RNA, 18 nt, Homo sapiens
gagugagacuccgucuca

SEQ ID NO: 378714 - RNA, 17 nt, Homo sapiens
gauggccgggacaugca

SEQ ID NO: 378715 - RNA, 22 nt, Homo sapiens
gcaauucuaacuuuuuugcuau

SEQ ID NO: 378716 - RNA, 14 nt, Homo sapiens
gcauucacaucuca

SEQ ID NO: 378717 - RNA, 21 nt, Homo sapiens
gccacguauguuuuuguguau

SEQ ID NO: 378718 - RNA, 21 nt, Homo sapiens
gccagcagcgggggcggccca

SEQ ID NO: 378719 - RNA, 22 nt, Homo sapiens
gccagccggguaccucaguuuc

SEQ ID NO: 378720 - RNA, 19 nt, Homo sapiens
gccaggagugcggacacca

SEQ ID NO: 378721 - RNA, 19 nt, Homo sapiens
gccaucaugugccuggaaa

SEQ ID NO: 378722 - RNA, 22 nt, Homo sapiens
gccccacuucucuacucuggaa

SEQ ID NO: 378723 - RNA, 19 nt, Homo sapiens
gcccucgggccgggcacca

SEQ ID NO: 378724 - RNA, 21 nt, Homo sapiens
gccugccaaggaugacacugc

SEQ ID NO: 378725 - RNA, 20 nt, Homo sapiens
gccuggaaauuaaacccugc

SEQ ID NO: 378726 - RNA, 21 nt, Homo sapiens
gccuggaucucacaagcacuu

SEQ ID NO: 378727 - RNA, 22 nt, Homo sapiens
gccuggaucucacaagcacuuu

SEQ ID NO: 378728 - RNA, 22 nt, Homo sapiens
gcuccacuuucagugaaagcau

SEQ ID NO: 378729 - RNA, 19 nt, Homo sapiens
gcucccaccggugccaaac

SEQ ID NO: 378730 - RNA, 18 nt, Homo sapiens
gcugaguugguguugaca

SEQ ID NO: 378731 - RNA, 14 nt, Homo sapiens
gcuuguguuuuuaa

SEQ ID NO: 378732 - RNA, 13 nt, Homo sapiens
ggaauucaucucu

SEQ ID NO: 378733 - RNA, 18 nt, Homo sapiens
ggacacuaauacaccagg

SEQ ID NO: 378734 - RNA, 16 nt, Homo sapiens
ggacagcgccaccucu

SEQ ID NO: 378735 - RNA, 13 nt, Homo sapiens
ggaugaggucaua

SEQ ID NO: 378736 - RNA, 13 nt, Homo sapiens
ggcagcagcucag

SEQ ID NO: 378737 - RNA, 15 nt, Homo sapiens
ggcgaccccucagug

SEQ ID NO: 378738 - RNA, 19 nt, Homo sapiens
ggcucccaccggugccaaa

SEQ ID NO: 378739 - RNA, 16 nt, Homo sapiens
gggagccucuccuugc

SEQ ID NO: 378740 - RNA, 20 nt, Homo sapiens
gggagguggagguugcagug

SEQ ID NO: 378741 - RNA, 16 nt, Homo sapiens
gggcuuuuacaccagu

SEQ ID NO: 378742 - RNA, 20 nt, Homo sapiens
gggugcgagagaggugggca

SEQ ID NO: 378743 - RNA, 17 nt, Homo sapiens
ggugcaugaagguuucu

SEQ ID NO: 378744 - RNA, 19 nt, Homo sapiens
ggugcaugaagguuucuga

SEQ ID NO: 378745 - RNA, 13 nt, Homo sapiens
gguguugacaugu

SEQ ID NO: 378746 - RNA, 13 nt, Homo sapiens
guauugugcauag

SEQ ID NO: 378747 - RNA, 21 nt, Homo sapiens
gugacuaccgugccagcagcg

SEQ ID NO: 378748 - RNA, 22 nt, Homo sapiens
gugccuggaaauuaaacccugc

SEQ ID NO: 378749 - RNA, 22 nt, Homo sapiens
gugccuguaaucccagcuacau

SEQ ID NO: 378750 - RNA, 15 nt, Homo sapiens
gugcucggcuguaaa

SEQ ID NO: 378751 - RNA, 17 nt, Homo sapiens
guggagguugcagugag

SEQ ID NO: 378752 - RNA, 18 nt, Homo sapiens
guggcauucacaucucau

SEQ ID NO: 378753 - RNA, 22 nt, Homo sapiens
guggcauucacaucucauguaa

SEQ ID NO: 378754 - RNA, 11 nt, Homo sapiens
guuaaugccau

SEQ ID NO: 378755 - RNA, 14 nt, Homo sapiens
guuaaugguuugaa

SEQ ID NO: 378756 - RNA, 19 nt, Homo sapiens
guuccacagugacugggcc

SEQ ID NO: 378757 - RNA, 18 nt, Homo sapiens
guuucuggggacaccagc

SEQ ID NO: 378758 - RNA, 18 nt, Homo sapiens
guuuuccuuuuguuuucc

SEQ ID NO: 378759 - RNA, 19 nt, Homo sapiens
guuuuguggaggagcucag

SEQ ID NO: 378760 - RNA, 23 nt, Homo sapiens
uaaacaaauguaugauuacauca

SEQ ID NO: 378761 - RNA, 22 nt, Homo sapiens
uaacauaaauuuaucaucucga

SEQ ID NO: 378762 - RNA, 17 nt, Homo sapiens
uaacucaauauuuucca

SEQ ID NO: 378763 - RNA, 23 nt, Homo sapiens
uaaguuuuccuuuuguuuuccac

SEQ ID NO: 378764 - RNA, 19 nt, Homo sapiens
uaauauggggaugcagcau

SEQ ID NO: 378765 - RNA, 16 nt, Homo sapiens
uacaaggggcccagug

SEQ ID NO: 378766 - RNA, 16 nt, Homo sapiens
uagccgaaaugaucuu

SEQ ID NO: 378767 - RNA, 14 nt, Homo sapiens
uauuuuccaugaaa

SEQ ID NO: 378768 - RNA, 21 nt, Homo sapiens
ucagccuccccccgcugggga

SEQ ID NO: 378769 - RNA, 12 nt, Homo sapiens
ucaugugccugg

SEQ ID NO: 378770 - RNA, 18 nt, Homo sapiens
uccccgcagagcucccuu

SEQ ID NO: 378771 - RNA, 18 nt, Homo sapiens
ucccuauucguagccauc

SEQ ID NO: 378772 - RNA, 12 nt, Homo sapiens
ucccuuccugac

SEQ ID NO: 378773 - RNA, 21 nt, Homo sapiens
uccucgucagucucucaaaga

SEQ ID NO: 378774 - RNA, 19 nt, Homo sapiens
uccuuccucaguccuggaa

SEQ ID NO: 378775 - RNA, 14 nt, Homo sapiens
uccuuuuguuuucc

SEQ ID NO: 378776 - RNA, 15 nt, Homo sapiens
uccuuuuguuuucca

SEQ ID NO: 378777 - RNA, 19 nt, Homo sapiens
ucgaccacuuuucaguuca

SEQ ID NO: 378778 - RNA, 17 nt, Homo sapiens
ucucaaagaccccaugg

SEQ ID NO: 378779 - RNA, 15 nt, Homo sapiens
ucucacaagcacuuu

SEQ ID NO: 378780 - RNA, 18 nt, Homo sapiens
ucugaaaauuaacacugc

SEQ ID NO: 378781 - RNA, 16 nt, Homo sapiens
ucuuucuacagccuaa

SEQ ID NO: 378782 - RNA, 14 nt, Homo sapiens
ugacagaacacugu

SEQ ID NO: 378783 - RNA, 15 nt, Homo sapiens
ugacagaacacuguc

SEQ ID NO: 378784 - RNA, 12 nt, Homo sapiens
ugacaugugcuu

SEQ ID NO: 378785 - RNA, 21 nt, Homo sapiens
cccgccagccuacacugccag

SEQ ID NO: 378786 - RNA, 16 nt, Homo sapiens
cccuauucguagccau

SEQ ID NO: 378787 - RNA, 23 nt, Homo sapiens
cccugaggguggucagccaaggc

SEQ ID NO: 378788 - RNA, 12 nt, Homo sapiens
cccuuuccagcc

SEQ ID NO: 378789 - RNA, 18 nt, Homo sapiens
ccugcauccucuccccca

SEQ ID NO: 378790 - RNA, 15 nt, Homo sapiens
ccuguacgaaccccu

SEQ ID NO: 378791 - RNA, 17 nt, Homo sapiens
ccuuaaggagguagcuc

SEQ ID NO: 378792 - RNA, 11 nt, Homo sapiens
ccuuccagugg

SEQ ID NO: 378793 - RNA, 15 nt, Homo sapiens
ccuuuauugcuccug

SEQ ID NO: 378794 - RNA, 16 nt, Homo sapiens
ccuuuuguuuuccacu

SEQ ID NO: 378795 - RNA, 17 nt, Homo sapiens
cgaagcccuuccagugg

SEQ ID NO: 378796 - RNA, 16 nt, Homo sapiens
cgaccccucagugcuc

SEQ ID NO: 378797 - RNA, 15 nt, Homo sapiens
cgagagaggugggca

SEQ ID NO: 378798 - RNA, 16 nt, Homo sapiens
cuaaagguuguauugc

SEQ ID NO: 378799 - RNA, 17 nt, Homo sapiens
aaaaauacucacauggc

SEQ ID NO: 378800 - RNA, 18 nt, Homo sapiens
aaaaugcaacaacaugua

SEQ ID NO: 378801 - RNA, 20 nt, Homo sapiens
aaacaugugguuaaugccau

SEQ ID NO: 378802 - RNA, 14 nt, Homo sapiens
aaagccgcccagug

SEQ ID NO: 378803 - RNA, 15 nt, Homo sapiens
aaauaaaagcacuua

SEQ ID NO: 378804 - RNA, 16 nt, Homo sapiens
aacauaaauuuaucau

SEQ ID NO: 378805 - RNA, 18 nt, Homo sapiens
aacccugccccacuucuc

SEQ ID NO: 378806 - RNA, 19 nt, Homo sapiens
aacucaauauuuuccauga

SEQ ID NO: 378807 - RNA, 13 nt, Homo sapiens
aagacaauggcuu

SEQ ID NO: 378808 - RNA, 15 nt, Homo sapiens
aaggaugacacugcc

SEQ ID NO: 378809 - RNA, 20 nt, Homo sapiens
aaggggacagcgccaccucu

SEQ ID NO: 378810 - RNA, 21 nt, Homo sapiens
aaguuuuguggaggagcucag

SEQ ID NO: 378811 - RNA, 20 nt, Homo sapiens
aauaaaucaacuccagcucc

SEQ ID NO: 378812 - RNA, 23 nt, Homo sapiens
aauauuuuccaugaaaaugcaac

SEQ ID NO: 378813 - RNA, 16 nt, Homo sapiens
aaugcaacaacaugua

SEQ ID NO: 378814 - RNA, 17 nt, Homo sapiens
aauggggugcaugaagg

SEQ ID NO: 378815 - RNA, 14 nt, Homo sapiens
aauuaaacccugcc

SEQ ID NO: 378816 - RNA, 15 nt, Homo sapiens
acaaggggcccagug

SEQ ID NO: 378817 - RNA, 16 nt, Homo sapiens
acaaggggcccagugc

SEQ ID NO: 378818 - RNA, 15 nt, Homo sapiens
acacugucuugaaga

SEQ ID NO: 378819 - RNA, 21 nt, Homo sapiens
acagaacacugucuugaagac

SEQ ID NO: 378820 - RNA, 19 nt, Homo sapiens
acagccccuggcacugcag

SEQ ID NO: 378821 - RNA, 21 nt, Homo sapiens
acauaaauuuaucaucucgac

SEQ ID NO: 378822 - RNA, 21 nt, Homo sapiens
accaaccuccccgcagagcuc

SEQ ID NO: 378823 - RNA, 14 nt, Homo sapiens
accccucagugcuc

SEQ ID NO: 378824 - RNA, 15 nt, Homo sapiens
accucuugucagugc

SEQ ID NO: 378825 - RNA, 16 nt, Homo sapiens
acguuuauagccgaaa

SEQ ID NO: 378826 - RNA, 16 nt, Homo sapiens
acucgaguccccauga

SEQ ID NO: 378827 - RNA, 17 nt, Homo sapiens
acucgaguccccaugau

SEQ ID NO: 378828 - RNA, 15 nt, Homo sapiens
acuggaugaggucau

SEQ ID NO: 378829 - RNA, 17 nt, Homo sapiens
acuugacagaacacugu

SEQ ID NO: 378830 - RNA, 17 nt, Homo sapiens
agaaaauaaaagcacuu

SEQ ID NO: 378831 - RNA, 21 nt, Homo sapiens
agaaggcuuccuccagcggcu

SEQ ID NO: 378832 - RNA, 19 nt, Homo sapiens
agagaaggcuuccuccagc

SEQ ID NO: 378833 - RNA, 13 nt, Homo sapiens
agagagaccccac

SEQ ID NO: 378834 - RNA, 19 nt, Homo sapiens
agagugagacuccgucuca

SEQ ID NO: 378835 - RNA, 14 nt, Homo sapiens
agccggguaccuca

SEQ ID NO: 378836 - RNA, 14 nt, Homo sapiens
agcucagccucccc

SEQ ID NO: 378837 - RNA, 16 nt, Homo sapiens
agcuggugguaucuga

SEQ ID NO: 378838 - RNA, 22 nt, Homo sapiens
agcuuggaaacuggaugagguc

SEQ ID NO: 378839 - RNA, 17 nt, Homo sapiens
aggaauuaaguuaggga

SEQ ID NO: 378840 - RNA, 15 nt, Homo sapiens
aggagcccgucaggc

SEQ ID NO: 378841 - RNA, 21 nt, Homo sapiens
aggagguagcucccagcacuc

SEQ ID NO: 378842 - RNA, 20 nt, Homo sapiens
agggaauggcacagcccaaa

SEQ ID NO: 378843 - RNA, 14 nt, Homo sapiens
agguagcucccagc

SEQ ID NO: 378844 - RNA, 17 nt, Homo sapiens
aggugggcagcagcuca

SEQ ID NO: 378845 - RNA, 18 nt, Homo sapiens
aguagauaugaggcauuu

SEQ ID NO: 378846 - RNA, 12 nt, Homo sapiens
aguauugugcau

SEQ ID NO: 378847 - RNA, 14 nt, Homo sapiens
aguccauauuucaa

SEQ ID NO: 378848 - RNA, 22 nt, Homo sapiens
agucccuucugagcgagcacac

SEQ ID NO: 378849 - RNA, 12 nt, Homo sapiens
agugccaaagag

SEQ ID NO: 378850 - RNA, 10 nt, Homo sapiens
aguucagugg

SEQ ID NO: 378851 - RNA, 16 nt, Homo sapiens
aguuccuuucaauggu

SEQ ID NO: 378852 - RNA, 13 nt, Homo sapiens
auaaaagcacuua

SEQ ID NO: 378853 - RNA, 18 nt, Homo sapiens
auaaaagccgcccagugg

SEQ ID NO: 378854 - RNA, 18 nt, Homo sapiens
auaaauuuaucaucucga

SEQ ID NO: 378855 - RNA, 22 nt, Homo sapiens
auaaguuuuccuuuuguuuucc

SEQ ID NO: 378856 - RNA, 15 nt, Homo sapiens
auaguauugugcaua

SEQ ID NO: 378857 - RNA, 12 nt, Homo sapiens
augagaaucacu

SEQ ID NO: 378858 - RNA, 18 nt, Homo sapiens
augaugugggucaaggaa

SEQ ID NO: 378859 - RNA, 17 nt, Homo sapiens
augcaacaacauguaua

SEQ ID NO: 378860 - RNA, 22 nt, Homo sapiens
auggcacagcccaaagaaggaa

SEQ ID NO: 378861 - RNA, 22 nt, Homo sapiens
auguuucugucacaucagcucc

SEQ ID NO: 378862 - RNA, 15 nt, Homo sapiens
auucccuccucguca

SEQ ID NO: 378863 - RNA, 14 nt, Homo sapiens
caaagaccccaugg

SEQ ID NO: 378864 - RNA, 16 nt, Homo sapiens
caaagaggggucacca

SEQ ID NO: 378865 - RNA, 23 nt, Homo sapiens
caaccuccccgcagagcucccuu

SEQ ID NO: 378866 - RNA, 20 nt, Homo sapiens
caagagugagacuccgucuc

SEQ ID NO: 378867 - RNA, 16 nt, Homo sapiens
caauaaaucaacucca

SEQ ID NO: 378868 - RNA, 18 nt, Homo sapiens
caauaaaucaacuccagc

SEQ ID NO: 378869 - RNA, 20 nt, Homo sapiens
caauucuaacuuuuuugcua

SEQ ID NO: 378870 - RNA, 10 nt, Homo sapiens
cacagcacug

SEQ ID NO: 378871 - RNA, 17 nt, Homo sapiens
cacagcacugccugcca

SEQ ID NO: 378872 - RNA, 20 nt, Homo sapiens
cacagggaugaccuggaguc

SEQ ID NO: 378873 - RNA, 16 nt, Homo sapiens
caccaguuccuuucaa

SEQ ID NO: 378874 - RNA, 16 nt, Homo sapiens
caccauguucccagcu

SEQ ID NO: 378875 - RNA, 17 nt, Homo sapiens
cacuucucuacucugga

SEQ ID NO: 378876 - RNA, 18 nt, Homo sapiens
cacuucucuacucuggaa

SEQ ID NO: 378877 - RNA, 21 nt, Homo sapiens
cagagaaaauaaaagcacuua

SEQ ID NO: 378878 - RNA, 21 nt, Homo sapiens
cagagacucgaguccccauga

SEQ ID NO: 378879 - RNA, 15 nt, Homo sapiens
cagcacugccugcca

SEQ ID NO: 378880 - RNA, 14 nt, Homo sapiens
cagccggguaccuc

SEQ ID NO: 378881 - RNA, 14 nt, Homo sapiens
cagcgccaccucuu

SEQ ID NO: 378882 - RNA, 18 nt, Homo sapiens
cagcucagugccaaagag

SEQ ID NO: 378883 - RNA, 17 nt, Homo sapiens
cagcuucauuuccguga

SEQ ID NO: 378884 - RNA, 18 nt, Homo sapiens
cagugacugggcccuguc

SEQ ID NO: 378885 - RNA, 20 nt, Homo sapiens
caguggcauucacaucucau

SEQ ID NO: 378886 - RNA, 20 nt, Homo sapiens
cagugggacccacagucaca

SEQ ID NO: 378887 - RNA, 22 nt, Homo sapiens
cagugggacccacagucacaca

SEQ ID NO: 378888 - RNA, 21 nt, Homo sapiens
caguucaguggcauucacauc

SEQ ID NO: 378889 - RNA, 15 nt, Homo sapiens
cauagcagugcuuga

SEQ ID NO: 378890 - RNA, 16 nt, Homo sapiens
caucaugugccuggaa

SEQ ID NO: 378891 - RNA, 20 nt, Homo sapiens
cauguucccagcucagugcc

SEQ ID NO: 378892 - RNA, 14 nt, Homo sapiens
cauucacaucucau

SEQ ID NO: 378893 - RNA, 19 nt, Homo sapiens
ccaagcucggaucacauga

SEQ ID NO: 378894 - RNA, 22 nt, Homo sapiens
ccaaugugacuaccgugccagc

SEQ ID NO: 378895 - RNA, 15 nt, Homo sapiens
ccaccggugccaaac

SEQ ID NO: 378896 - RNA, 20 nt, Homo sapiens
ccagauggccgggacaugca

SEQ ID NO: 378897 - RNA, 18 nt, Homo sapiens
ccaggagugcggacacca

SEQ ID NO: 378898 - RNA, 13 nt, Homo sapiens
ccagggcagugag

SEQ ID NO: 378899 - RNA, 22 nt, Homo sapiens
ccagucacgagcccgcucugca

SEQ ID NO: 378900 - RNA, 19 nt, Homo sapiens
ccagugguaccagcucacu

SEQ ID NO: 378901 - RNA, 23 nt, Homo sapiens
ccaugaaaaugcaacaacaugua

SEQ ID NO: 378902 - RNA, 20 nt, Homo sapiens
ugagaaggacaccuccuucc

SEQ ID NO: 378903 - RNA, 18 nt, Homo sapiens
ugagaaucacuugaacuc

SEQ ID NO: 378904 - RNA, 15 nt, Homo sapiens
ugagacuccgucuca

SEQ ID NO: 378905 - RNA, 20 nt, Homo sapiens
ugaggcaugagaaucacuug

SEQ ID NO: 378906 - RNA, 19 nt, Homo sapiens
ugccaaggaugacacugcc

SEQ ID NO: 378907 - RNA, 22 nt, Homo sapiens
ugccagccgccaccggggcaca

SEQ ID NO: 378908 - RNA, 22 nt, Homo sapiens
ugccuggaucucacaagcacuu

SEQ ID NO: 378909 - RNA, 22 nt, Homo sapiens
ugcuaacuagcuuggaaacugg

SEQ ID NO: 378910 - RNA, 20 nt, Homo sapiens
ugcucggcuguaaacagcuc

SEQ ID NO: 378911 - RNA, 18 nt, Homo sapiens
ugcuggccacacagcagc

SEQ ID NO: 378912 - RNA, 14 nt, Homo sapiens
ugcuugccagccag

SEQ ID NO: 378913 - RNA, 21 nt, Homo sapiens
uggaagccggccggcugggau

SEQ ID NO: 378914 - RNA, 14 nt, Homo sapiens
uggagguugcagug

SEQ ID NO: 378915 - RNA, 19 nt, Homo sapiens
uggaucucacaagcacuuu

SEQ ID NO: 378916 - RNA, 16 nt, Homo sapiens
uggcauucacaucuca

SEQ ID NO: 378917 - RNA, 14 nt, Homo sapiens
uggcuuacuccagg

SEQ ID NO: 378918 - RNA, 17 nt, Homo sapiens
uggugggugccuguaau

SEQ ID NO: 378919 - RNA, 17 nt, Homo sapiens
ugguguugacaugugcu

SEQ ID NO: 378920 - RNA, 13 nt, Homo sapiens
uguaaacagcucu

SEQ ID NO: 378921 - RNA, 22 nt, Homo sapiens
ugugacuaccgugccagcagcg

SEQ ID NO: 378922 - RNA, 22 nt, Homo sapiens
uguucccagcucagugccaaag

SEQ ID NO: 378923 - RNA, 13 nt, Homo sapiens
uguugacaugugc

SEQ ID NO: 378924 - RNA, 15 nt, Homo sapiens
uucucuacucuggaa

SEQ ID NO: 378925 - RNA, 17 nt, Homo sapiens
uugacuugacagaacac

SEQ ID NO: 378926 - RNA, 13 nt, Homo sapiens
uuguuuuccacuc

SEQ ID NO: 378927 - RNA, 19 nt, Homo sapiens
uuucagugaaagcaucacu

SEQ ID NO: 378928 - RNA, 22 nt, Homo sapiens
uuucugucacaucagcuccacu

SEQ ID NO: 378929 - RNA, 19 nt, Homo sapiens
uuucuuggucucagcuuca

SEQ ID NO: 378930 - RNA, 16 nt, Homo sapiens
acaggaccccagcucu

SEQ ID NO: 378931 - RNA, 12 nt, Homo sapiens
acagggccagug

SEQ ID NO: 378932 - RNA, 14 nt, Homo sapiens
augucaagagucgc

SEQ ID NO: 378933 - RNA, 19 nt, Homo sapiens
caguuugguguguccuccg

SEQ ID NO: 378934 - RNA, 18 nt, Homo sapiens
cccaggggccggccagug

SEQ ID NO: 378935 - RNA, 16 nt, Homo sapiens
ccugcaggaccucgug

SEQ ID NO: 378936 - RNA, 19 nt, Homo sapiens
cucugcgucgguccuggug

SEQ ID NO: 378937 - RNA, 18 nt, Homo sapiens
cugagccuggucccacga

SEQ ID NO: 378938 - RNA, 13 nt, Homo sapiens
cuggcucccaugu

SEQ ID NO: 378939 - RNA, 14 nt, Homo sapiens
gagucgcugugcca

SEQ ID NO: 378940 - RNA, 18 nt, Homo sapiens
gcccuggaugcccaggaa

SEQ ID NO: 378941 - RNA, 21 nt, Homo sapiens
gccuggucccacgagggugcc

SEQ ID NO: 378942 - RNA, 15 nt, Homo sapiens
ggccgggcagggugu

SEQ ID NO: 378943 - RNA, 17 nt, Homo sapiens
uccccugacagggccag

SEQ ID NO: 378944 - RNA, 22 nt, Homo sapiens
uccccugacagggccagugcag

SEQ ID NO: 378945 - RNA, 16 nt, Homo sapiens
uguccccugacagggc

SEQ ID NO: 378946 - RNA, 16 nt, Homo sapiens
agagucgcugugccac

SEQ ID NO: 378947 - RNA, 21 nt, Homo sapiens
agggaggcaggggaggggugc

SEQ ID NO: 378948 - RNA, 18 nt, Homo sapiens
caggggccggccaguggc

SEQ ID NO: 378949 - RNA, 16 nt, Homo sapiens
caugccuccucaggag

SEQ ID NO: 378950 - RNA, 13 nt, Homo sapiens
ccacgagggugcc

SEQ ID NO: 378951 - RNA, 13 nt, Homo sapiens
cccacgagggugc

SEQ ID NO: 378952 - RNA, 18 nt, Homo sapiens
cccugacagggccagugc

SEQ ID NO: 378953 - RNA, 21 nt, Homo sapiens
cccugacagggccagugcagu

SEQ ID NO: 378954 - RNA, 13 nt, Homo sapiens
cggguugggucac

SEQ ID NO: 378955 - RNA, 19 nt, Homo sapiens
cugacagggccagugcagu

SEQ ID NO: 378956 - RNA, 15 nt, Homo sapiens
cuggaugcccaggaa

SEQ ID NO: 378957 - RNA, 13 nt, Homo sapiens
gagccugguccca

SEQ ID NO: 378958 - RNA, 16 nt, Homo sapiens
gagucgcugugccaca

SEQ ID NO: 378959 - RNA, 14 nt, Homo sapiens
gcaggggaggggug

SEQ ID NO: 378960 - RNA, 19 nt, Homo sapiens
gcccuggaugcccaggaau

SEQ ID NO: 378961 - RNA, 14 nt, Homo sapiens
gccuuaccaggaga

SEQ ID NO: 378962 - RNA, 18 nt, Homo sapiens
gcucugcgucgguccugg

SEQ ID NO: 378963 - RNA, 12 nt, Homo sapiens
ggccaguggccu

SEQ ID NO: 378964 - RNA, 17 nt, Homo sapiens
ggcucccaugucaagag

SEQ ID NO: 378965 - RNA, 13 nt, Homo sapiens
gggaggcagggga

SEQ ID NO: 378966 - RNA, 12 nt, Homo sapiens
gggccaugccuc

SEQ ID NO: 378967 - RNA, 14 nt, Homo sapiens
gggccggccagugg

SEQ ID NO: 378968 - RNA, 23 nt, Homo sapiens
gguccugcagccugcaggaccuc

SEQ ID NO: 378969 - RNA, 21 nt, Homo sapiens
ucauuugacuaagagucucca

SEQ ID NO: 378970 - RNA, 15 nt, Homo sapiens
ucccacgagggugcc

SEQ ID NO: 378971 - RNA, 14 nt, Homo sapiens
uggggccaugccuc

SEQ ID NO: 378972 - RNA, 19 nt, Homo sapiens
uguccccugacagggccag

SEQ ID NO: 378973 - RNA, 22 nt, Homo sapiens
aagcccaggggccggccagugg

SEQ ID NO: 378974 - RNA, 13 nt, Homo sapiens
accucgugccacc

SEQ ID NO: 378975 - RNA, 20 nt, Homo sapiens
agcccaggggccggccagug

SEQ ID NO: 378976 - RNA, 23 nt, Homo sapiens
aggggugcggcggucccagcucc

SEQ ID NO: 378977 - RNA, 22 nt, Homo sapiens
auugguuuuccaaucauuugac

SEQ ID NO: 378978 - RNA, 19 nt, Homo sapiens
auuuauggccgggcagggu

SEQ ID NO: 378979 - RNA, 16 nt, Homo sapiens
caccccgagggcugag

SEQ ID NO: 378980 - RNA, 12 nt, Homo sapiens
cagggccagugc

SEQ ID NO: 378981 - RNA, 23 nt, Homo sapiens
ccacgggcccggguugggucacc

SEQ ID NO: 378982 - RNA, 17 nt, Homo sapiens
cccacgagggugccgug

SEQ ID NO: 378983 - RNA, 19 nt, Homo sapiens
cccaggggccggccagugg

SEQ ID NO: 378984 - RNA, 22 nt, Homo sapiens
ccccaggagggaggcaggggag

SEQ ID NO: 378985 - RNA, 16 nt, Homo sapiens
ccugacagggccagug

SEQ ID NO: 378986 - RNA, 20 nt, Homo sapiens
ccugacagggccagugcagu

SEQ ID NO: 378987 - RNA, 16 nt, Homo sapiens
cgucgguccuggugcc

SEQ ID NO: 378988 - RNA, 15 nt, Homo sapiens
cugacagggccagug

SEQ ID NO: 378989 - RNA, 16 nt, Homo sapiens
cugacagggccagugc

SEQ ID NO: 378990 - RNA, 20 nt, Homo sapiens
gccgggcaggguguggggcc

SEQ ID NO: 378991 - RNA, 17 nt, Homo sapiens
gcugagccuggucccac

SEQ ID NO: 378992 - RNA, 24 nt, Homo sapiens
ggcucccaugucaagagucgcugu

SEQ ID NO: 378993 - RNA, 16 nt, Homo sapiens
ggucccacgagggugc

SEQ ID NO: 378994 - RNA, 13 nt, Homo sapiens
gguccuggugccc

SEQ ID NO: 378995 - RNA, 15 nt, Homo sapiens
gugcggcggucccag

SEQ ID NO: 378996 - RNA, 13 nt, Homo sapiens
ucgcugugccaca

SEQ ID NO: 378997 - RNA, 14 nt, Homo sapiens
ugacagggccagug

SEQ ID NO: 378998 - RNA, 15 nt, Homo sapiens
ugacagggccagugc

SEQ ID NO: 378999 - RNA, 19 nt, Homo sapiens
ugcaggaccucgugccacc

SEQ ID NO: 379000 - RNA, 14 nt, Homo sapiens
uggccgggcagggu

SEQ ID NO: 379001 - RNA, 14 nt, Homo sapiens
ugucaagagucgcu

SEQ ID NO: 379002 - RNA, 17 nt, Homo sapiens
acagggccagugcaguu

SEQ ID NO: 379003 - RNA, 17 nt, Homo sapiens
agagucgcugugccaca

SEQ ID NO: 379004 - RNA, 21 nt, Homo sapiens
agccuggucccacgagggugc

SEQ ID NO: 379005 - RNA, 16 nt, Homo sapiens
aggggccggccagugg

SEQ ID NO: 379006 - RNA, 15 nt, Homo sapiens
agucgcugugccaca

SEQ ID NO: 379007 - RNA, 20 nt, Homo sapiens
agugcaguuugguguguccu

SEQ ID NO: 379008 - RNA, 15 nt, Homo sapiens
aucauuugacuaaga

SEQ ID NO: 379009 - RNA, 17 nt, Homo sapiens
auuugacuaagagucuc

SEQ ID NO: 379010 - RNA, 14 nt, Homo sapiens
caggggaggggugc

SEQ ID NO: 379011 - RNA, 16 nt, Homo sapiens
ccacgagggugccgug

SEQ ID NO: 379012 - RNA, 17 nt, Homo sapiens
ccaggggccggccagug

SEQ ID NO: 379013 - RNA, 21 nt, Homo sapiens
cgggcaggguguggggccaug

SEQ ID NO: 379014 - RNA, 19 nt, Homo sapiens
cugcagccugcaggaccuc

SEQ ID NO: 379015 - RNA, 17 nt, Homo sapiens
gacagggccagugcagu

SEQ ID NO: 379016 - RNA, 18 nt, Homo sapiens
gacagggccagugcaguu

SEQ ID NO: 379017 - RNA, 18 nt, Homo sapiens
gccaugccuccucaggag

SEQ ID NO: 379018 - RNA, 17 nt, Homo sapiens
gccugcaggaccucgug

SEQ ID NO: 379019 - RNA, 15 nt, Homo sapiens
gcgucgguccuggug

SEQ ID NO: 379020 - RNA, 13 nt, Homo sapiens
ggaccucgugcca

SEQ ID NO: 379021 - RNA, 15 nt, Homo sapiens
ggaccucgugccacc

SEQ ID NO: 379022 - RNA, 22 nt, Homo sapiens
ggcuggagugugaggguccugc

SEQ ID NO: 379023 - RNA, 13 nt, Homo sapiens
gggccagugcagu

SEQ ID NO: 379024 - RNA, 23 nt, Homo sapiens
guguccccugacagggccagugc

SEQ ID NO: 379025 - RNA, 14 nt, Homo sapiens
guguggggccaugc

SEQ ID NO: 379026 - RNA, 20 nt, Homo sapiens
uccccugacagggccagugc

SEQ ID NO: 379027 - RNA, 14 nt, Homo sapiens
ucgguccuggugcc

SEQ ID NO: 379028 - RNA, 15 nt, Homo sapiens
ugacuaagagucucc

SEQ ID NO: 379029 - RNA, 21 nt, Homo sapiens
uguccccugacagggccagug

SEQ ID NO: 379030 - RNA, 15 nt, Homo sapiens
aaaacaaaacaaaca

SEQ ID NO: 379031 - RNA, 20 nt, Homo sapiens
aaaagacugguuuguuugcu

SEQ ID NO: 379032 - RNA, 21 nt, Homo sapiens
aaaagacugguuuguuugcuu

SEQ ID NO: 379033 - RNA, 21 nt, Homo sapiens
aaaagcuuuucuuuccuuuug

SEQ ID NO: 379034 - RNA, 15 nt, Homo sapiens
aaaaguaaaccacaa

SEQ ID NO: 379035 - RNA, 14 nt, Homo sapiens
aaaaguauauauuc

SEQ ID NO: 379036 - RNA, 14 nt, Homo sapiens
aaaaucaacaugac

SEQ ID NO: 379037 - RNA, 22 nt, Homo sapiens
aaaauccuauaucuguuuguau

SEQ ID NO: 379038 - RNA, 12 nt, Homo sapiens
aaaaugcaauau

SEQ ID NO: 379039 - RNA, 22 nt, Homo sapiens
aaaaugcaucauuaauaccuaa

SEQ ID NO: 379040 - RNA, 17 nt, Homo sapiens
aaaaugcuucacuguac

SEQ ID NO: 379041 - RNA, 15 nt, Homo sapiens
aaaauugcacuuuua

SEQ ID NO: 379042 - RNA, 19 nt, Homo sapiens
aaacaaaaaaaagaaccuu

SEQ ID NO: 379043 - RNA, 19 nt, Homo sapiens
aaacacccuccuggcacaa

SEQ ID NO: 379044 - RNA, 21 nt, Homo sapiens
aaacagauuacuagaaauauu

SEQ ID NO: 379045 - RNA, 17 nt, Homo sapiens
aaacuaaggagugacua

SEQ ID NO: 379046 - RNA, 13 nt, Homo sapiens
aaacucagugcaa

SEQ ID NO: 379047 - RNA, 15 nt, Homo sapiens
aaagaaagaauaugu

SEQ ID NO: 379048 - RNA, 22 nt, Homo sapiens
aaagacauuuguucucccaaaa

SEQ ID NO: 379049 - RNA, 15 nt, Homo sapiens
aaagaccuucucccu

SEQ ID NO: 379050 - RNA, 13 nt, Homo sapiens
aaagacugucaaa

SEQ ID NO: 379051 - RNA, 22 nt, Homo sapiens
aaagcaauuauauuguccuccc

SEQ ID NO: 379052 - RNA, 15 nt, Homo sapiens
aaagcaugggaaaaa

SEQ ID NO: 379053 - RNA, 13 nt, Homo sapiens
aaaggaugaucaa

SEQ ID NO: 379054 - RNA, 17 nt, Homo sapiens
aaaguaaaaauuuugac

SEQ ID NO: 379055 - RNA, 11 nt, Homo sapiens
aaaguauauau

SEQ ID NO: 379056 - RNA, 13 nt, Homo sapiens
aaauuauuugcag

SEQ ID NO: 379057 - RNA, 20 nt, Homo sapiens
aaauugcacuuuuaaaccuc

SEQ ID NO: 379058 - RNA, 15 nt, Homo sapiens
aacaaacuacaugua

SEQ ID NO: 379059 - RNA, 23 nt, Homo sapiens
aacaaacuacauguaauccauca

SEQ ID NO: 379060 - RNA, 16 nt, Homo sapiens
aacaauaaaguuugcu

SEQ ID NO: 379061 - RNA, 21 nt, Homo sapiens
aacaauacaugcugcuaauuc

SEQ ID NO: 379062 - RNA, 20 nt, Homo sapiens
aacacuguuggcacuuauag

SEQ ID NO: 379063 - RNA, 17 nt, Homo sapiens
aacaucuuuuacauucu

SEQ ID NO: 379064 - RNA, 23 nt, Homo sapiens
aacaugacauccagagaugacua

SEQ ID NO: 379065 - RNA, 15 nt, Homo sapiens
aacauggguuuccuu

SEQ ID NO: 379066 - RNA, 15 nt, Homo sapiens
aacauuucauuguac

SEQ ID NO: 379067 - RNA, 23 nt, Homo sapiens
aaccauguugguugcacuuugua

SEQ ID NO: 379068 - RNA, 14 nt, Homo sapiens
aacccuugcuugca

SEQ ID NO: 379069 - RNA, 21 nt, Homo sapiens
aacucagguuuuggcauuaaa

SEQ ID NO: 379070 - RNA, 15 nt, Homo sapiens
aacuugcuacuuauc

SEQ ID NO: 379071 - RNA, 21 nt, Homo sapiens
aagaaagucuaucuaaugaca

SEQ ID NO: 379072 - RNA, 22 nt, Homo sapiens
aagaaauaauuuuauuccagac

SEQ ID NO: 379073 - RNA, 16 nt, Homo sapiens
aagaauaauugaacaa

SEQ ID NO: 379074 - RNA, 21 nt, Homo sapiens
aagaauagccuagauaugaau

SEQ ID NO: 379075 - RNA, 17 nt, Homo sapiens
aagacaaagcaaagcca

SEQ ID NO: 379076 - RNA, 21 nt, Homo sapiens
aagacacauugacuccuuucc

SEQ ID NO: 379077 - RNA, 15 nt, Homo sapiens
aagacuccucugggc

SEQ ID NO: 379078 - RNA, 21 nt, Homo sapiens
aagacuccucugggccugggg

SEQ ID NO: 379079 - RNA, 23 nt, Homo sapiens
aagacugucaaaugaacuuuuac

SEQ ID NO: 379080 - RNA, 20 nt, Homo sapiens
aagacuucacugcagccuuu

SEQ ID NO: 379081 - RNA, 14 nt, Homo sapiens
aguagugucuuccu

SEQ ID NO: 379082 - RNA, 20 nt, Homo sapiens
agucucaugcaagacuucac

SEQ ID NO: 379083 - RNA, 17 nt, Homo sapiens
agugccaauauuucuga

SEQ ID NO: 379084 - RNA, 17 nt, Homo sapiens
agugccucagugcugca

SEQ ID NO: 379085 - RNA, 18 nt, Homo sapiens
aguguagggcaacaauac

SEQ ID NO: 379086 - RNA, 22 nt, Homo sapiens
aguguccuggacccuggccuaa

SEQ ID NO: 379087 - RNA, 23 nt, Homo sapiens
aguguugcccaggcuggucucaa

SEQ ID NO: 379088 - RNA, 21 nt, Homo sapiens
aguuccagauuguucugucca

SEQ ID NO: 379089 - RNA, 16 nt, Homo sapiens
aguucugacacugugu

SEQ ID NO: 379090 - RNA, 19 nt, Homo sapiens
aguuguucgccgcguggaa

SEQ ID NO: 379091 - RNA, 20 nt, Homo sapiens
aguuuaauuaucugcauuua

SEQ ID NO: 379092 - RNA, 16 nt, Homo sapiens
aguuuacaaucagcca

SEQ ID NO: 379093 - RNA, 15 nt, Homo sapiens
acagaaaacucccaa

SEQ ID NO: 379094 - RNA, 14 nt, Homo sapiens
acagaagggcucuu

SEQ ID NO: 379095 - RNA, 23 nt, Homo sapiens
acagccucccacccccaucucuc

SEQ ID NO: 379096 - RNA, 14 nt, Homo sapiens
acaguguugcccag

SEQ ID NO: 379097 - RNA, 22 nt, Homo sapiens
acaucuggccuugaaaccaccu

SEQ ID NO: 379098 - RNA, 13 nt, Homo sapiens
acaugacuggugg

SEQ ID NO: 379099 - RNA, 18 nt, Homo sapiens
acaugcugcuaauucaaa

SEQ ID NO: 379100 - RNA, 16 nt, Homo sapiens
acauucagcugagguu

SEQ ID NO: 379101 - RNA, 17 nt, Homo sapiens
accacagguucaugcca

SEQ ID NO: 379102 - RNA, 22 nt, Homo sapiens
accauauauugagguucauugg

SEQ ID NO: 379103 - RNA, 12 nt, Homo sapiens
accccacagacu

SEQ ID NO: 379104 - RNA, 21 nt, Homo sapiens
acccccacuucaugcccacug

SEQ ID NO: 379105 - RNA, 14 nt, Homo sapiens
acccccagcauuac

SEQ ID NO: 379106 - RNA, 22 nt, Homo sapiens
accuauggcccagccacugcag

SEQ ID NO: 379107 - RNA, 15 nt, Homo sapiens
accugaccucugcaa

SEQ ID NO: 379108 - RNA, 18 nt, Homo sapiens
accuguccauaaaguaau

SEQ ID NO: 379109 - RNA, 19 nt, Homo sapiens
acgaucccccaaguguccu

SEQ ID NO: 379110 - RNA, 18 nt, Homo sapiens
acuaccaaaugagcauua

SEQ ID NO: 379111 - RNA, 16 nt, Homo sapiens
acuagugcaauuccaa

SEQ ID NO: 379112 - RNA, 14 nt, Homo sapiens
acucagaggaccca

SEQ ID NO: 379113 - RNA, 15 nt, Homo sapiens
acugaguccaugaaa

SEQ ID NO: 379114 - RNA, 17 nt, Homo sapiens
acugauucccucuccca

SEQ ID NO: 379115 - RNA, 15 nt, Homo sapiens
acugccgaugcccaa

SEQ ID NO: 379116 - RNA, 14 nt, Homo sapiens
acuguacuucccaa

SEQ ID NO: 379117 - RNA, 12 nt, Homo sapiens
acugugcauuac

SEQ ID NO: 379118 - RNA, 17 nt, Homo sapiens
acuucccaauugccaca

SEQ ID NO: 379119 - RNA, 21 nt, Homo sapiens
acuugcaccugguacugcaca

SEQ ID NO: 379120 - RNA, 15 nt, Homo sapiens
acuugcuacuuauca

SEQ ID NO: 379121 - RNA, 18 nt, Homo sapiens
acuuucuuucuguaggug

SEQ ID NO: 379122 - RNA, 21 nt, Homo sapiens
agaaaacucccaauacaaaga

SEQ ID NO: 379123 - RNA, 12 nt, Homo sapiens
agaaaaugcauu

SEQ ID NO: 379124 - RNA, 21 nt, Homo sapiens
agaaacaguauuuucuuccca

SEQ ID NO: 379125 - RNA, 16 nt, Homo sapiens
agaaagagaaugaacu

SEQ ID NO: 379126 - RNA, 20 nt, Homo sapiens
agaaagucuaucuaaugaca

SEQ ID NO: 379127 - RNA, 14 nt, Homo sapiens
agaaauauuuaacu

SEQ ID NO: 379128 - RNA, 18 nt, Homo sapiens
agaaauuuuacugacaga

SEQ ID NO: 379129 - RNA, 14 nt, Homo sapiens
agaauuaaaacuga

SEQ ID NO: 379130 - RNA, 20 nt, Homo sapiens
agacugggucucgcuuuguu

SEQ ID NO: 379131 - RNA, 20 nt, Homo sapiens
agagaugacuauuacuuuuc

SEQ ID NO: 379132 - RNA, 16 nt, Homo sapiens
agauacauucacauuc

SEQ ID NO: 379133 - RNA, 17 nt, Homo sapiens
agauauauguguauaca

SEQ ID NO: 379134 - RNA, 22 nt, Homo sapiens
agcauuacgaucccccaagugu

SEQ ID NO: 379135 - RNA, 18 nt, Homo sapiens
agcauuagcuacuuuuca

SEQ ID NO: 379136 - RNA, 16 nt, Homo sapiens
agcuucuagacacucc

SEQ ID NO: 379137 - RNA, 13 nt, Homo sapiens
aggaaacaugcag

SEQ ID NO: 379138 - RNA, 17 nt, Homo sapiens
aggaaugacuuacuuuc

SEQ ID NO: 379139 - RNA, 18 nt, Homo sapiens
aggaauguguccaagaca

SEQ ID NO: 379140 - RNA, 16 nt, Homo sapiens
aggagaaaaugcauua

SEQ ID NO: 379141 - RNA, 19 nt, Homo sapiens
aggagaacguuugguacaa

SEQ ID NO: 379142 - RNA, 23 nt, Homo sapiens
aggaugaucaaaaauaaugcauc

SEQ ID NO: 379143 - RNA, 20 nt, Homo sapiens
aggauuguuucucggcacca

SEQ ID NO: 379144 - RNA, 15 nt, Homo sapiens
aggcccaaagcacuu

SEQ ID NO: 379145 - RNA, 19 nt, Homo sapiens
aggcuuaaggagaggagaa

SEQ ID NO: 379146 - RNA, 21 nt, Homo sapiens
agggaagcugucccucacugu

SEQ ID NO: 379147 - RNA, 15 nt, Homo sapiens
agggauagcgcuguu

SEQ ID NO: 379148 - RNA, 15 nt, Homo sapiens
agggccugcaugggg

SEQ ID NO: 379149 - RNA, 17 nt, Homo sapiens
aggggaggagagagggu

SEQ ID NO: 379150 - RNA, 17 nt, Homo sapiens
agguucgggauucccug

SEQ ID NO: 379151 - RNA, 20 nt, Homo sapiens
aguaauuuugugaaagaagg

SEQ ID NO: 379152 - RNA, 20 nt, Homo sapiens
agugccaauauuucugauau

SEQ ID NO: 379153 - RNA, 12 nt, Homo sapiens
agugcugcaauu

SEQ ID NO: 379154 - RNA, 17 nt, Homo sapiens
agugcugggauuacaau

SEQ ID NO: 379155 - RNA, 14 nt, Homo sapiens
aguguauuagucau

SEQ ID NO: 379156 - RNA, 16 nt, Homo sapiens
aguguccuaugcaaua

SEQ ID NO: 379157 - RNA, 21 nt, Homo sapiens
agugucucuugacuggcucaa

SEQ ID NO: 379158 - RNA, 22 nt, Homo sapiens
aguguugugcacuucaugucau

SEQ ID NO: 379159 - RNA, 12 nt, Homo sapiens
aguuaaggguua

SEQ ID NO: 379160 - RNA, 14 nt, Homo sapiens
auaaaaagugaacu

SEQ ID NO: 379161 - RNA, 15 nt, Homo sapiens
auaaaagaucuugca

SEQ ID NO: 379162 - RNA, 21 nt, Homo sapiens
auaaaauguuuaaucucugcu

SEQ ID NO: 379163 - RNA, 14 nt, Homo sapiens
auaaaauugcacuu

SEQ ID NO: 379164 - RNA, 19 nt, Homo sapiens
auaacacuguuggcacuua

SEQ ID NO: 379165 - RNA, 21 nt, Homo sapiens
auaauaaaaagcuucagggaa

SEQ ID NO: 379166 - RNA, 15 nt, Homo sapiens
auaauuguugauauu

SEQ ID NO: 379167 - RNA, 15 nt, Homo sapiens
auacaauauauagcu

SEQ ID NO: 379168 - RNA, 18 nt, Homo sapiens
auacaugcugcuaauuca

SEQ ID NO: 379169 - RNA, 21 nt, Homo sapiens
auagagcaaaaucaacaugac

SEQ ID NO: 379170 - RNA, 15 nt, Homo sapiens
auagaggaacuugaa

SEQ ID NO: 379171 - RNA, 21 nt, Homo sapiens
auagccuagauaugaauauau

SEQ ID NO: 379172 - RNA, 23 nt, Homo sapiens
auauaauuuugaaaaguaaaaau

SEQ ID NO: 379173 - RNA, 18 nt, Homo sapiens
auauauggcauuugcaga

SEQ ID NO: 379174 - RNA, 13 nt, Homo sapiens
auaucgaucucuu

SEQ ID NO: 379175 - RNA, 20 nt, Homo sapiens
auaugaugaucuggauccac

SEQ ID NO: 379176 - RNA, 15 nt, Homo sapiens
auauuaccuaaugaa

SEQ ID NO: 379177 - RNA, 17 nt, Homo sapiens
auauuaguugcuuuguu

SEQ ID NO: 379178 - RNA, 12 nt, Homo sapiens
aucaacaugacu

SEQ ID NO: 379179 - RNA, 21 nt, Homo sapiens
aucaauaguguccuaugcaau

SEQ ID NO: 379180 - RNA, 19 nt, Homo sapiens
aucacuaaauaaacacgau

SEQ ID NO: 379181 - RNA, 17 nt, Homo sapiens
aucacuagccaugauaa

SEQ ID NO: 379182 - RNA, 22 nt, Homo sapiens
cauuuaaauaucugaacauuua

SEQ ID NO: 379183 - RNA, 20 nt, Homo sapiens
cauuuagcgaacaaccacag

SEQ ID NO: 379184 - RNA, 16 nt, Homo sapiens
cauuucaaaaugcuuc

SEQ ID NO: 379185 - RNA, 18 nt, Homo sapiens
cauuucuguauacuguaa

SEQ ID NO: 379186 - RNA, 16 nt, Homo sapiens
ccaacuacacaccccc

SEQ ID NO: 379187 - RNA, 16 nt, Homo sapiens
ccaagaaaauaucacu

SEQ ID NO: 379188 - RNA, 17 nt, Homo sapiens
ccaagaaaauaucacug

SEQ ID NO: 379189 - RNA, 22 nt, Homo sapiens
uccaauagaaagaaacuaaaca

SEQ ID NO: 379190 - RNA, 21 nt, Homo sapiens
uccaaugccacauacuugcag

SEQ ID NO: 379191 - RNA, 15 nt, Homo sapiens
uccagagaugacuau

SEQ ID NO: 379192 - RNA, 14 nt, Homo sapiens
uccagcaguacaau

SEQ ID NO: 379193 - RNA, 23 nt, Homo sapiens
uccagcuggaagggucaacaucu

SEQ ID NO: 379194 - RNA, 15 nt, Homo sapiens
uccaugaaaauacca

SEQ ID NO: 379195 - RNA, 22 nt, Homo sapiens
uccaugccucuggaggccucug

SEQ ID NO: 379196 - RNA, 15 nt, Homo sapiens
uccauuugcuuuguc

SEQ ID NO: 379197 - RNA, 22 nt, Homo sapiens
uccccaaaagaaaccaugacaa

SEQ ID NO: 379198 - RNA, 18 nt, Homo sapiens
ucccucacuguugaauuu

SEQ ID NO: 379199 - RNA, 23 nt, Homo sapiens
uccuaggucaugaaggacacucu

SEQ ID NO: 379200 - RNA, 21 nt, Homo sapiens
uccuggacccuggccuaaaga

SEQ ID NO: 379201 - RNA, 22 nt, Homo sapiens
ucuaauuagagaacuggaggaa

SEQ ID NO: 379202 - RNA, 13 nt, Homo sapiens
ucuacacauauau

SEQ ID NO: 379203 - RNA, 19 nt, Homo sapiens
ucuagaaucauacuuaaca

SEQ ID NO: 379204 - RNA, 19 nt, Homo sapiens
ucucaugcaagacuucacu

SEQ ID NO: 379205 - RNA, 13 nt, Homo sapiens
ucugaacuuccaa

SEQ ID NO: 379206 - RNA, 20 nt, Homo sapiens
ucugcaagaauuaaaacuga

SEQ ID NO: 379207 - RNA, 21 nt, Homo sapiens
ucugcaagcacaucugcauuu

SEQ ID NO: 379208 - RNA, 22 nt, Homo sapiens
ucugcagauagugccucugcaa

SEQ ID NO: 379209 - RNA, 15 nt, Homo sapiens
ucuuaaaaugcaaua

SEQ ID NO: 379210 - RNA, 17 nt, Homo sapiens
ucuuagaguuuacaguu

SEQ ID NO: 379211 - RNA, 15 nt, Homo sapiens
ucuugacuggcucaa

SEQ ID NO: 379212 - RNA, 15 nt, Homo sapiens
ugaaaaauauugcua

SEQ ID NO: 379213 - RNA, 22 nt, Homo sapiens
ugaaaacugugcaauguauuaa

SEQ ID NO: 379214 - RNA, 19 nt, Homo sapiens
ugaaauaauguacaucugg

SEQ ID NO: 379215 - RNA, 23 nt, Homo sapiens
ugaacuguuuggucgagucuuug

SEQ ID NO: 379216 - RNA, 13 nt, Homo sapiens
ugaaggacacucu

SEQ ID NO: 379217 - RNA, 15 nt, Homo sapiens
ugaaguauuucucac

SEQ ID NO: 379218 - RNA, 15 nt, Homo sapiens
ugaauggguucucag

SEQ ID NO: 379219 - RNA, 14 nt, Homo sapiens
ugacaaagacuccu

SEQ ID NO: 379220 - RNA, 23 nt, Homo sapiens
ugagaaaaauagagcaaaaucaa

SEQ ID NO: 379221 - RNA, 19 nt, Homo sapiens
ugaggacugaagcuggggc

SEQ ID NO: 379222 - RNA, 13 nt, Homo sapiens
ugaguguguuugu

SEQ ID NO: 379223 - RNA, 18 nt, Homo sapiens
ugcaauaggugugcguca

SEQ ID NO: 379224 - RNA, 14 nt, Homo sapiens
ugcacuagugcaau

SEQ ID NO: 379225 - RNA, 21 nt, Homo sapiens
ugcagggugaagcaccaggga

SEQ ID NO: 379226 - RNA, 19 nt, Homo sapiens
ugcauuacaaaguuaauau

SEQ ID NO: 379227 - RNA, 17 nt, Homo sapiens
ugccauagucaaagaga

SEQ ID NO: 379228 - RNA, 17 nt, Homo sapiens
ugcccaggcuggucuca

SEQ ID NO: 379229 - RNA, 17 nt, Homo sapiens
ugccucagugcugcaau

SEQ ID NO: 379230 - RNA, 19 nt, Homo sapiens
ugccucugcaaacuaagga

SEQ ID NO: 379231 - RNA, 15 nt, Homo sapiens
ugccuuccuguuuaa

SEQ ID NO: 379232 - RNA, 15 nt, Homo sapiens
ugcuaauucaaagcu

SEQ ID NO: 379233 - RNA, 19 nt, Homo sapiens
ugcuacaguuuuuccuaaa

SEQ ID NO: 379234 - RNA, 13 nt, Homo sapiens
ugcuggcauuugc

SEQ ID NO: 379235 - RNA, 22 nt, Homo sapiens
ugcuggcauuugcaccuaccuc

SEQ ID NO: 379236 - RNA, 16 nt, Homo sapiens
ugcuuacaaaguauau

SEQ ID NO: 379237 - RNA, 16 nt, Homo sapiens
ugcuuuuuuucaggga

SEQ ID NO: 379238 - RNA, 16 nt, Homo sapiens
uggaaaaaugauuuaa

SEQ ID NO: 379239 - RNA, 20 nt, Homo sapiens
uggaagaaggaaacaccgag

SEQ ID NO: 379240 - RNA, 15 nt, Homo sapiens
uggaaguccagaaca

SEQ ID NO: 379241 - RNA, 16 nt, Homo sapiens
uggaggccucuggccc

SEQ ID NO: 379242 - RNA, 22 nt, Homo sapiens
uggauagauaauuuuauuugaa

SEQ ID NO: 379243 - RNA, 19 nt, Homo sapiens
uggcccccuauuuugccau

SEQ ID NO: 379244 - RNA, 14 nt, Homo sapiens
uggccugcacuggu

SEQ ID NO: 379245 - RNA, 19 nt, Homo sapiens
uggggugcauccuccucag

SEQ ID NO: 379246 - RNA, 23 nt, Homo sapiens
uggguuggggacccccucaggau

SEQ ID NO: 379247 - RNA, 14 nt, Homo sapiens
ugguacaaggaaua

SEQ ID NO: 379248 - RNA, 21 nt, Homo sapiens
uggucccaaguaguagugucu

SEQ ID NO: 379249 - RNA, 13 nt, Homo sapiens
uggugcucauuua

SEQ ID NO: 379250 - RNA, 14 nt, Homo sapiens
uggugcucauuuaa

SEQ ID NO: 379251 - RNA, 23 nt, Homo sapiens
uguagaucagggauagcgcuguu

SEQ ID NO: 379252 - RNA, 18 nt, Homo sapiens
ugucagaaacucgaugaa

SEQ ID NO: 379253 - RNA, 16 nt, Homo sapiens
ugucaggcuacaaggu

SEQ ID NO: 379254 - RNA, 20 nt, Homo sapiens
ugucccggggcuccacugaa

SEQ ID NO: 379255 - RNA, 13 nt, Homo sapiens
uguccgucccgcu

SEQ ID NO: 379256 - RNA, 14 nt, Homo sapiens
ugucugacaaccuc

SEQ ID NO: 379257 - RNA, 15 nt, Homo sapiens
ugugcacccagaaga

SEQ ID NO: 379258 - RNA, 14 nt, Homo sapiens
ugugcuacacuugc

SEQ ID NO: 379259 - RNA, 19 nt, Homo sapiens
uguguuuuaaaaaaacuga

SEQ ID NO: 379260 - RNA, 17 nt, Homo sapiens
uguuccaggauguggaa

SEQ ID NO: 379261 - RNA, 21 nt, Homo sapiens
uguuguuccaggauguggaau

SEQ ID NO: 379262 - RNA, 15 nt, Homo sapiens
uuaaaaaaacugaag

SEQ ID NO: 379263 - RNA, 15 nt, Homo sapiens
uuaaaaaauaccauu

SEQ ID NO: 379264 - RNA, 20 nt, Homo sapiens
uuaaaagagacaaacuguaa

SEQ ID NO: 379265 - RNA, 21 nt, Homo sapiens
uuaaaaucuggcaaaguuaua

SEQ ID NO: 379266 - RNA, 19 nt, Homo sapiens
uuaaaauucagugagauau

SEQ ID NO: 379267 - RNA, 19 nt, Homo sapiens
uuaaauuuugaaaacugug

SEQ ID NO: 379268 - RNA, 20 nt, Homo sapiens
uuacaaucagccacauucua

SEQ ID NO: 379269 - RNA, 19 nt, Homo sapiens
uuacaaucgagacugcaau

SEQ ID NO: 379270 - RNA, 13 nt, Homo sapiens
uuacaauugugag

SEQ ID NO: 379271 - RNA, 17 nt, Homo sapiens
uuacauacuauucuuac

SEQ ID NO: 379272 - RNA, 15 nt, Homo sapiens
uuacauccucugaua

SEQ ID NO: 379273 - RNA, 16 nt, Homo sapiens
uuacaugcagaguauu

SEQ ID NO: 379274 - RNA, 23 nt, Homo sapiens
uuacuaaguggacuggugucaua

SEQ ID NO: 379275 - RNA, 23 nt, Homo sapiens
uuacuuuucuguuuaguuuuaca

SEQ ID NO: 379276 - RNA, 20 nt, Homo sapiens
uuaggaaaggaugaucaaaa

SEQ ID NO: 379277 - RNA, 22 nt, Homo sapiens
uuauaaaaauauaaauuguaca

SEQ ID NO: 379278 - RNA, 17 nt, Homo sapiens
uuauagguuuccacugc

SEQ ID NO: 379279 - RNA, 14 nt, Homo sapiens
uuauauuaaucucu

SEQ ID NO: 379280 - RNA, 19 nt, Homo sapiens
uuauuacauggggucuaga

SEQ ID NO: 379281 - RNA, 11 nt, Homo sapiens
aaaaaaacuga

SEQ ID NO: 379282 - RNA, 12 nt, Homo sapiens
aaaaaauaccau

SEQ ID NO: 379283 - RNA, 18 nt, Homo sapiens
aaaagagacaaacuguaa

SEQ ID NO: 379284 - RNA, 15 nt, Homo sapiens
aaaagauuauauauc

SEQ ID NO: 379285 - RNA, 22 nt, Homo sapiens
aaaaggauguuacaaguuugcu

SEQ ID NO: 379286 - RNA, 23 nt, Homo sapiens
aaaaggauguuacaaguuugcua

SEQ ID NO: 379287 - RNA, 15 nt, Homo sapiens
aaaauguaaugauca

SEQ ID NO: 379288 - RNA, 15 nt, Homo sapiens
aaaauugaguuucag

SEQ ID NO: 379289 - RNA, 23 nt, Homo sapiens
aaacauuguuuuuguugucuuua

SEQ ID NO: 379290 - RNA, 15 nt, Homo sapiens
aaacccccagcauua

SEQ ID NO: 379291 - RNA, 23 nt, Homo sapiens
aaagaaucccacccccacuucau

SEQ ID NO: 379292 - RNA, 12 nt, Homo sapiens
aaagacugucaa

SEQ ID NO: 379293 - RNA, 22 nt, Homo sapiens
aaagagaauggaaaaaugauuu

SEQ ID NO: 379294 - RNA, 17 nt, Homo sapiens
aaagcaugggaaaaaga

SEQ ID NO: 379295 - RNA, 13 nt, Homo sapiens
aaagcuucaggga

SEQ ID NO: 379296 - RNA, 14 nt, Homo sapiens
aaagcuucagggaa

SEQ ID NO: 379297 - RNA, 22 nt, Homo sapiens
aaaguauauguuaaaaagugag

SEQ ID NO: 379298 - RNA, 22 nt, Homo sapiens
aaaguccacauuagaucagaua

SEQ ID NO: 379299 - RNA, 19 nt, Homo sapiens
aaagucuaucuaaugacau

SEQ ID NO: 379300 - RNA, 13 nt, Homo sapiens
aaagugaugacau

SEQ ID NO: 379301 - RNA, 21 nt, Homo sapiens
aaauaaugcauccagcaguac

SEQ ID NO: 379302 - RNA, 13 nt, Homo sapiens
aaaucaacaugac

SEQ ID NO: 379303 - RNA, 15 nt, Homo sapiens
aaaucagcaugacaa

SEQ ID NO: 379304 - RNA, 13 nt, Homo sapiens
aaaucccaagugu

SEQ ID NO: 379305 - RNA, 23 nt, Homo sapiens
aaauuuaagaaaacaaguauaua

SEQ ID NO: 379306 - RNA, 13 nt, Homo sapiens
aaauuuuacacac

SEQ ID NO: 379307 - RNA, 18 nt, Homo sapiens
aaauuuuacugacagaaa

SEQ ID NO: 379308 - RNA, 16 nt, Homo sapiens
aaauuuugaaaacugu

SEQ ID NO: 379309 - RNA, 21 nt, Homo sapiens
aaauuuuuuaaaagagacaaa

SEQ ID NO: 379310 - RNA, 19 nt, Homo sapiens
aacaaaaauguaaugauca

SEQ ID NO: 379311 - RNA, 20 nt, Homo sapiens
aacaaaaauguaaugaucau

SEQ ID NO: 379312 - RNA, 15 nt, Homo sapiens
aacaacuugcuacuu

SEQ ID NO: 379313 - RNA, 14 nt, Homo sapiens
aacagauauuguca

SEQ ID NO: 379314 - RNA, 15 nt, Homo sapiens
aacagauuacuagaa

SEQ ID NO: 379315 - RNA, 14 nt, Homo sapiens
aaccagcucugaac

SEQ ID NO: 379316 - RNA, 19 nt, Homo sapiens
aaccauguugguugcacuu

SEQ ID NO: 379317 - RNA, 18 nt, Homo sapiens
aacccguugggucccuug

SEQ ID NO: 379318 - RNA, 13 nt, Homo sapiens
aaccugugucuua

SEQ ID NO: 379319 - RNA, 22 nt, Homo sapiens
aacuacacacccccaagccaca

SEQ ID NO: 379320 - RNA, 16 nt, Homo sapiens
aacuacauguaaucca

SEQ ID NO: 379321 - RNA, 14 nt, Homo sapiens
aacuugacccccuu

SEQ ID NO: 379322 - RNA, 16 nt, Homo sapiens
aacuugcuacuuauca

SEQ ID NO: 379323 - RNA, 22 nt, Homo sapiens
aagaaaauuuugggguaaaaag

SEQ ID NO: 379324 - RNA, 17 nt, Homo sapiens
aagaaacuaaacagaaa

SEQ ID NO: 379325 - RNA, 15 nt, Homo sapiens
aagacuucacugcag

SEQ ID NO: 379326 - RNA, 13 nt, Homo sapiens
aagagaaugaacu

SEQ ID NO: 379327 - RNA, 14 nt, Homo sapiens
aagagcugugggca

SEQ ID NO: 379328 - RNA, 15 nt, Homo sapiens
aagauuauauaucau

SEQ ID NO: 379329 - RNA, 22 nt, Homo sapiens
aagauucucuauuggcucccuu

SEQ ID NO: 379330 - RNA, 22 nt, Homo sapiens
aagcaucccgcuggugccuccc

SEQ ID NO: 379331 - RNA, 16 nt, Homo sapiens
aagcauguacuguacu

SEQ ID NO: 379332 - RNA, 15 nt, Homo sapiens
aaguaaaccacaaaa

SEQ ID NO: 379333 - RNA, 16 nt, Homo sapiens
aaguaguagugucuuc

SEQ ID NO: 379334 - RNA, 14 nt, Homo sapiens
aaguauuacaacca

SEQ ID NO: 379335 - RNA, 17 nt, Homo sapiens
aagucuaaauaaaugaa

SEQ ID NO: 379336 - RNA, 14 nt, Homo sapiens
aagucuagaaucau

SEQ ID NO: 379337 - RNA, 15 nt, Homo sapiens
aagucuagaaucaua

SEQ ID NO: 379338 - RNA, 17 nt, Homo sapiens
aauaaaauuauuugcag

SEQ ID NO: 379339 - RNA, 20 nt, Homo sapiens
aauaagaagggggagugaaa

SEQ ID NO: 379340 - RNA, 21 nt, Homo sapiens
aauaauuuuauuccagacagu

SEQ ID NO: 379341 - RNA, 18 nt, Homo sapiens
aauaucugagaaguguau

SEQ ID NO: 379342 - RNA, 16 nt, Homo sapiens
aauauuuuuacaugca

SEQ ID NO: 379343 - RNA, 16 nt, Homo sapiens
aaucaagaugagauau

SEQ ID NO: 379344 - RNA, 19 nt, Homo sapiens
cuugcugcaaacccaugaa

SEQ ID NO: 379345 - RNA, 20 nt, Homo sapiens
cuuggcuucuuaaaaacugu

SEQ ID NO: 379346 - RNA, 18 nt, Homo sapiens
cuuugaucuguuugucaa

SEQ ID NO: 379347 - RNA, 11 nt, Homo sapiens
cuuuguugccc

SEQ ID NO: 379348 - RNA, 12 nt, Homo sapiens
cuuuuauuacau

SEQ ID NO: 379349 - RNA, 20 nt, Homo sapiens
cuuuucuuuguaucauucau

SEQ ID NO: 379350 - RNA, 16 nt, Homo sapiens
cuuuuguuuugcuuac

SEQ ID NO: 379351 - RNA, 12 nt, Homo sapiens
cuuuuucaugua

SEQ ID NO: 379352 - RNA, 17 nt, Homo sapiens
cuuuuuuguacuuuucu

SEQ ID NO: 379353 - RNA, 14 nt, Homo sapiens
cagugccucagugc

SEQ ID NO: 379354 - RNA, 19 nt, Homo sapiens
cagugccucagugcugcaa

SEQ ID NO: 379355 - RNA, 20 nt, Homo sapiens
caucacuagccaugauaacu

SEQ ID NO: 379356 - RNA, 15 nt, Homo sapiens
cauccagagaugacu

SEQ ID NO: 379357 - RNA, 23 nt, Homo sapiens
caucucucccuccccugccauuu

SEQ ID NO: 379358 - RNA, 18 nt, Homo sapiens
caugaaggacacucugca

SEQ ID NO: 379359 - RNA, 15 nt, Homo sapiens
caugcagcucuucaa

SEQ ID NO: 379360 - RNA, 20 nt, Homo sapiens
cauuaagaauaauugaacaa

SEQ ID NO: 379361 - RNA, 20 nt, Homo sapiens
cauuaauaccuaaacuguau

SEQ ID NO: 379362 - RNA, 16 nt, Homo sapiens
cauuagcuacuuuuca

SEQ ID NO: 379363 - RNA, 13 nt, Homo sapiens
cauucuagguagg

SEQ ID NO: 379364 - RNA, 13 nt, Homo sapiens
cauuugcaccuac

SEQ ID NO: 379365 - RNA, 16 nt, Homo sapiens
cauuugcaccuaccuc

SEQ ID NO: 379366 - RNA, 21 nt, Homo sapiens
cauuuuaugagaguuuggaau

SEQ ID NO: 379367 - RNA, 21 nt, Homo sapiens
ccaaauccaaggaaacaugca

SEQ ID NO: 379368 - RNA, 14 nt, Homo sapiens
ccaagccacaggga

SEQ ID NO: 379369 - RNA, 21 nt, Homo sapiens
ccagagaugacuauuacuuuu

SEQ ID NO: 379370 - RNA, 20 nt, Homo sapiens
ccaggcaucacugauucccu

SEQ ID NO: 379371 - RNA, 23 nt, Homo sapiens
ccaggcugguauuuaucugcaag

SEQ ID NO: 379372 - RNA, 19 nt, Homo sapiens
ccaugauaacugcaauuuu

SEQ ID NO: 379373 - RNA, 13 nt, Homo sapiens
cccaauacaaaga

SEQ ID NO: 379374 - RNA, 15 nt, Homo sapiens
cccacccccacuuca

SEQ ID NO: 379375 - RNA, 15 nt, Homo sapiens
cccagagguggcccu

SEQ ID NO: 379376 - RNA, 22 nt, Homo sapiens
cccagagugcugggauuacaau

SEQ ID NO: 379377 - RNA, 20 nt, Homo sapiens
cccagccaaacccugucuga

SEQ ID NO: 379378 - RNA, 18 nt, Homo sapiens
cccagccccuccacguga

SEQ ID NO: 379379 - RNA, 17 nt, Homo sapiens
cccauaucugugaaaug

SEQ ID NO: 379380 - RNA, 23 nt, Homo sapiens
cccauaucugugaaaugcuggca

SEQ ID NO: 379381 - RNA, 19 nt, Homo sapiens
ccccaccugaccucugcaa

SEQ ID NO: 379382 - RNA, 12 nt, Homo sapiens
cccccuugaggg

SEQ ID NO: 379383 - RNA, 17 nt, Homo sapiens
cccggggcuccacugaa

SEQ ID NO: 379384 - RNA, 14 nt, Homo sapiens
cccuccacccacua

SEQ ID NO: 379385 - RNA, 15 nt, Homo sapiens
cccuccccugccauu

SEQ ID NO: 379386 - RNA, 15 nt, Homo sapiens
cccucucccacccaa

SEQ ID NO: 379387 - RNA, 15 nt, Homo sapiens
cccuggccuaaagaa

SEQ ID NO: 379388 - RNA, 17 nt, Homo sapiens
cccuugcugcaaaccca

SEQ ID NO: 379389 - RNA, 15 nt, Homo sapiens
ccgagcuacaaagca

SEQ ID NO: 379390 - RNA, 18 nt, Homo sapiens
ccgggacugggggcggga

SEQ ID NO: 379391 - RNA, 18 nt, Homo sapiens
ccuaaugugaucauauga

SEQ ID NO: 379392 - RNA, 21 nt, Homo sapiens
ccuaccucacagagugcauug

SEQ ID NO: 379393 - RNA, 16 nt, Homo sapiens
ccuauggcccagccac

SEQ ID NO: 379394 - RNA, 21 nt, Homo sapiens
ccuauggcccagccacugcag

SEQ ID NO: 379395 - RNA, 23 nt, Homo sapiens
ccucacagagugcauugugaggg

SEQ ID NO: 379396 - RNA, 15 nt, Homo sapiens
ccucagugcugcaau

SEQ ID NO: 379397 - RNA, 14 nt, Homo sapiens
ccucugcagcacuu

SEQ ID NO: 379398 - RNA, 14 nt, Homo sapiens
ccugaccucugcaa

SEQ ID NO: 379399 - RNA, 13 nt, Homo sapiens
ccuugaaugccau

SEQ ID NO: 379400 - RNA, 14 nt, Homo sapiens
ccuugaaugccaua

SEQ ID NO: 379401 - RNA, 21 nt, Homo sapiens
ccuugcugcaaacccaugaag

SEQ ID NO: 379402 - RNA, 14 nt, Homo sapiens
ccuugggguggugc

SEQ ID NO: 379403 - RNA, 17 nt, Homo sapiens
cgaggaaaaacaaaaca

SEQ ID NO: 379404 - RNA, 12 nt, Homo sapiens
cgggauucccug

SEQ ID NO: 379405 - RNA, 21 nt, Homo sapiens
cgguuucuccccggacacucg

SEQ ID NO: 379406 - RNA, 22 nt, Homo sapiens
cgucgaaagaaagaauauguaa

SEQ ID NO: 379407 - RNA, 20 nt, Homo sapiens
cuaaacugcuguuaauugau

SEQ ID NO: 379408 - RNA, 16 nt, Homo sapiens
cuaaaguauguuuuca

SEQ ID NO: 379409 - RNA, 13 nt, Homo sapiens
cuaaauaaaugaa

SEQ ID NO: 379410 - RNA, 12 nt, Homo sapiens
cuaaauguauuc

SEQ ID NO: 379411 - RNA, 22 nt, Homo sapiens
cuaaguacccuugggguggugc

SEQ ID NO: 379412 - RNA, 17 nt, Homo sapiens
cuaauguuauuucuuaa

SEQ ID NO: 379413 - RNA, 22 nt, Homo sapiens
cuaauuagagaacuggaggaac

SEQ ID NO: 379414 - RNA, 19 nt, Homo sapiens
cuacacacccccaagccac

SEQ ID NO: 379415 - RNA, 16 nt, Homo sapiens
cuacacugggugcuga

SEQ ID NO: 379416 - RNA, 19 nt, Homo sapiens
cuacaguuuuuaacucuac

SEQ ID NO: 379417 - RNA, 16 nt, Homo sapiens
cuacuuguaaaggugc

SEQ ID NO: 379418 - RNA, 15 nt, Homo sapiens
cuacuugucauauca

SEQ ID NO: 379419 - RNA, 23 nt, Homo sapiens
cuagaaucauacuuaacauuuca

SEQ ID NO: 379420 - RNA, 22 nt, Homo sapiens
cuagaggacacuaggagacugg

SEQ ID NO: 379421 - RNA, 15 nt, Homo sapiens
cuagguaggggccca

SEQ ID NO: 379422 - RNA, 14 nt, Homo sapiens
cucacaguguugcc

SEQ ID NO: 379423 - RNA, 12 nt, Homo sapiens
cucaugcaagac

SEQ ID NO: 379424 - RNA, 17 nt, Homo sapiens
cuccacccacuagguga

SEQ ID NO: 379425 - RNA, 17 nt, Homo sapiens
cuccacuguuucaugag

SEQ ID NO: 379426 - RNA, 18 nt, Homo sapiens
cucggcaccagugccuca

SEQ ID NO: 379427 - RNA, 22 nt, Homo sapiens
cucggcaccagugccucagugc

SEQ ID NO: 379428 - RNA, 18 nt, Homo sapiens
cucucccacccaaggaga

SEQ ID NO: 379429 - RNA, 13 nt, Homo sapiens
cucugaacuucca

SEQ ID NO: 379430 - RNA, 19 nt, Homo sapiens
cucuggaggccucuggccc

SEQ ID NO: 379431 - RNA, 14 nt, Homo sapiens
cucuucaacaugac

SEQ ID NO: 379432 - RNA, 15 nt, Homo sapiens
cucuucaacaugaca

SEQ ID NO: 379433 - RNA, 18 nt, Homo sapiens
cugaaacaugugccccug

SEQ ID NO: 379434 - RNA, 16 nt, Homo sapiens
cugaaccgacuuuucu

SEQ ID NO: 379435 - RNA, 20 nt, Homo sapiens
cugacagaaaugcaaucucc

SEQ ID NO: 379436 - RNA, 15 nt, Homo sapiens
cugaguccaugaaaa

SEQ ID NO: 379437 - RNA, 23 nt, Homo sapiens
cugauauaacaaacuacauguaa

SEQ ID NO: 379438 - RNA, 16 nt, Homo sapiens
cugcaagcacaucugc

SEQ ID NO: 379439 - RNA, 20 nt, Homo sapiens
cugcaauuuuaauugauuau

SEQ ID NO: 379440 - RNA, 16 nt, Homo sapiens
cugccaaaacaaugcc

SEQ ID NO: 379441 - RNA, 18 nt, Homo sapiens
cugcuuuuuuucagggaa

SEQ ID NO: 379442 - RNA, 20 nt, Homo sapiens
cuggaguggaguggcgugau

SEQ ID NO: 379443 - RNA, 23 nt, Homo sapiens
cugggucucgcuuuguugcccag

SEQ ID NO: 379444 - RNA, 18 nt, Homo sapiens
cugguauuuaucugcaag

SEQ ID NO: 379445 - RNA, 20 nt, Homo sapiens
gggucucgcuuuguugccca

SEQ ID NO: 379446 - RNA, 17 nt, Homo sapiens
ggguggugcugggucau

SEQ ID NO: 379447 - RNA, 20 nt, Homo sapiens
ggugaaccuuaguaccuaaa

SEQ ID NO: 379448 - RNA, 23 nt, Homo sapiens
guaauuaguguugugcacuucau

SEQ ID NO: 379449 - RNA, 22 nt, Homo sapiens
guacaauaaaaguaaaccacaa

SEQ ID NO: 379450 - RNA, 12 nt, Homo sapiens
guacaucuggcc

SEQ ID NO: 379451 - RNA, 13 nt, Homo sapiens
guaggacauacca

SEQ ID NO: 379452 - RNA, 17 nt, Homo sapiens
guaggggcccacuucac

SEQ ID NO: 379453 - RNA, 16 nt, Homo sapiens
ucaacaugacuggugg

SEQ ID NO: 379454 - RNA, 21 nt, Homo sapiens
ucaauaguguccuaugcaaua

SEQ ID NO: 379455 - RNA, 18 nt, Homo sapiens
ucaauguuucacuacucu

SEQ ID NO: 379456 - RNA, 14 nt, Homo sapiens
ucaauuucucaaua

SEQ ID NO: 379457 - RNA, 18 nt, Homo sapiens
ucacagagugcauuguga

SEQ ID NO: 379458 - RNA, 20 nt, Homo sapiens
ucacaggacucugcagauag

SEQ ID NO: 379459 - RNA, 19 nt, Homo sapiens
ucacauugcacucaucaua

SEQ ID NO: 379460 - RNA, 22 nt, Homo sapiens
ucacuagccaugauaacugcaa

SEQ ID NO: 379461 - RNA, 17 nt, Homo sapiens
ucagaauuuagacugaa

SEQ ID NO: 379462 - RNA, 20 nt, Homo sapiens
ucagacauuuauauauugga

SEQ ID NO: 379463 - RNA, 15 nt, Homo sapiens
ucagugcugcaauug

SEQ ID NO: 379464 - RNA, 16 nt, Homo sapiens
ucaugaaggacacucu

SEQ ID NO: 379465 - RNA, 16 nt, Homo sapiens
ucaugaucaagauaua

SEQ ID NO: 379466 - RNA, 23 nt, Homo sapiens
ucauguaaguuuaauuaucugca

SEQ ID NO: 379467 - RNA, 19 nt, Homo sapiens
uccaaaaccuaaagaggaa

SEQ ID NO: 379468 - RNA, 15 nt, Homo sapiens
uccaaaccaguuuau

SEQ ID NO: 379469 - RNA, 13 nt, Homo sapiens
uccaccugucuca

SEQ ID NO: 379470 - RNA, 19 nt, Homo sapiens
uccacgugauuuccaguga

SEQ ID NO: 379471 - RNA, 13 nt, Homo sapiens
uccacuguuucau

SEQ ID NO: 379472 - RNA, 19 nt, Homo sapiens
uccacuucuuguuccccac

SEQ ID NO: 379473 - RNA, 23 nt, Homo sapiens
uccacuucuuguuccccacugac

SEQ ID NO: 379474 - RNA, 16 nt, Homo sapiens
ucccacccccacuuca

SEQ ID NO: 379475 - RNA, 16 nt, Homo sapiens
ucccagugagccucug

SEQ ID NO: 379476 - RNA, 14 nt, Homo sapiens
uccccggacacucg

SEQ ID NO: 379477 - RNA, 16 nt, Homo sapiens
ucccgccucccgccac

SEQ ID NO: 379478 - RNA, 16 nt, Homo sapiens
ucccuccccugccauu

SEQ ID NO: 379479 - RNA, 17 nt, Homo sapiens
ucccuuuuuauauccca

SEQ ID NO: 379480 - RNA, 22 nt, Homo sapiens
uccgcuggauggggagucucau

SEQ ID NO: 379481 - RNA, 16 nt, Homo sapiens
uccuacuuauugccau

SEQ ID NO: 379482 - RNA, 19 nt, Homo sapiens
uccugugguuuuauuacaa

SEQ ID NO: 379483 - RNA, 13 nt, Homo sapiens
uccuguguggaag

SEQ ID NO: 379484 - RNA, 15 nt, Homo sapiens
ucgagacugcaaugu

SEQ ID NO: 379485 - RNA, 16 nt, Homo sapiens
ucgcccacaaacugau

SEQ ID NO: 379486 - RNA, 20 nt, Homo sapiens
ucgcccacaaacugauuucu

SEQ ID NO: 379487 - RNA, 13 nt, Homo sapiens
ucuagaacuugac

SEQ ID NO: 379488 - RNA, 22 nt, Homo sapiens
ucuagguaggggcccacuucac

SEQ ID NO: 379489 - RNA, 21 nt, Homo sapiens
ucuauuuacauaaaaugggug

SEQ ID NO: 379490 - RNA, 19 nt, Homo sapiens
ucuccacuucuuguucccc

SEQ ID NO: 379491 - RNA, 19 nt, Homo sapiens
ucucccuccccugccauuu

SEQ ID NO: 379492 - RNA, 16 nt, Homo sapiens
ucugauauaacaaacu

SEQ ID NO: 379493 - RNA, 17 nt, Homo sapiens
ucugcagauagugccuc

SEQ ID NO: 379494 - RNA, 14 nt, Homo sapiens
ucuuaaaaacugug

SEQ ID NO: 379495 - RNA, 16 nt, Homo sapiens
ucuuaaaaugcaauau

SEQ ID NO: 379496 - RNA, 18 nt, Homo sapiens
ucuuaaaauuagugagau

SEQ ID NO: 379497 - RNA, 19 nt, Homo sapiens
ucuuaaaauucagugagau

SEQ ID NO: 379498 - RNA, 18 nt, Homo sapiens
ucuuuccuuuugcaacaa

SEQ ID NO: 379499 - RNA, 14 nt, Homo sapiens
ucuuuguauugaca

SEQ ID NO: 379500 - RNA, 16 nt, Homo sapiens
ucuuuuacauucugca

SEQ ID NO: 379501 - RNA, 16 nt, Homo sapiens
ugaaaucagcaugaca

SEQ ID NO: 379502 - RNA, 15 nt, Homo sapiens
ugaaaugcuggcauu

SEQ ID NO: 379503 - RNA, 16 nt, Homo sapiens
ugaaaugcuggcauuu

SEQ ID NO: 379504 - RNA, 18 nt, Homo sapiens
ugaaaugcuggcauuugc

SEQ ID NO: 379505 - RNA, 16 nt, Homo sapiens
ugaaggagaaaaugca

SEQ ID NO: 379506 - RNA, 19 nt, Homo sapiens
ugaauguguugauuugaga

SEQ ID NO: 379507 - RNA, 23 nt, Homo sapiens
ugacaugccuauaugagaagaau

SEQ ID NO: 379508 - RNA, 22 nt, Homo sapiens
ugacggcugcucgaagaacaau

SEQ ID NO: 379509 - RNA, 14 nt, Homo sapiens
ugacuggcucaaga

SEQ ID NO: 379510 - RNA, 19 nt, Homo sapiens
ugagaguuuucuaaaguau

SEQ ID NO: 379511 - RNA, 22 nt, Homo sapiens
ugagcagguaucaacuagggga

SEQ ID NO: 379512 - RNA, 16 nt, Homo sapiens
ugagcauuagcuacuu

SEQ ID NO: 379513 - RNA, 15 nt, Homo sapiens
ugaggguuaaugaaa

SEQ ID NO: 379514 - RNA, 14 nt, Homo sapiens
ugauuuccagugag

SEQ ID NO: 379515 - RNA, 17 nt, Homo sapiens
ugcaagaauuaaaacug

SEQ ID NO: 379516 - RNA, 19 nt, Homo sapiens
ugcaagcacaucugcauuu

SEQ ID NO: 379517 - RNA, 15 nt, Homo sapiens
ugcacuagugcaauu

SEQ ID NO: 379518 - RNA, 17 nt, Homo sapiens
ugcacuuuuaaaccucu

SEQ ID NO: 379519 - RNA, 18 nt, Homo sapiens
ugcagccuuucacaggac

SEQ ID NO: 379520 - RNA, 23 nt, Homo sapiens
ugcagcuugugcugagccugccc

SEQ ID NO: 379521 - RNA, 19 nt, Homo sapiens
ugcaguagugcaguucacc

SEQ ID NO: 379522 - RNA, 19 nt, Homo sapiens
ugcaucauuaauaccuaaa

SEQ ID NO: 379523 - RNA, 18 nt, Homo sapiens
ugcauccagcaguacaau

SEQ ID NO: 379524 - RNA, 22 nt, Homo sapiens
ugccaacagcuggccaguaauu

SEQ ID NO: 379525 - RNA, 15 nt, Homo sapiens
ugccacauacuugca

SEQ ID NO: 379526 - RNA, 20 nt, Homo sapiens
ugccaccauggccagccaac

SEQ ID NO: 379527 - RNA, 15 nt, Homo sapiens
ugccuccugccuccc

SEQ ID NO: 379528 - RNA, 15 nt, Homo sapiens
ugcggagacccugag

SEQ ID NO: 379529 - RNA, 17 nt, Homo sapiens
ugcuaauucaaagcucu

SEQ ID NO: 379530 - RNA, 19 nt, Homo sapiens
ugcugaaacucagugcaaa

SEQ ID NO: 379531 - RNA, 20 nt, Homo sapiens
ugcugcaaacccaugaagcu

SEQ ID NO: 379532 - RNA, 12 nt, Homo sapiens
ugcuuguucccu

SEQ ID NO: 379533 - RNA, 17 nt, Homo sapiens
ugcuuuuguccuguuau

SEQ ID NO: 379534 - RNA, 12 nt, Homo sapiens
uggaagggucaa

SEQ ID NO: 379535 - RNA, 21 nt, Homo sapiens
uggaauuauuguagacaugcc

SEQ ID NO: 379536 - RNA, 19 nt, Homo sapiens
uggagacaauaaacagcug

SEQ ID NO: 379537 - RNA, 12 nt, Homo sapiens
uggaucagaggu

SEQ ID NO: 379538 - RNA, 13 nt, Homo sapiens
uggcccagccaaa

SEQ ID NO: 379539 - RNA, 17 nt, Homo sapiens
uggccuugaaaccaccu

SEQ ID NO: 379540 - RNA, 19 nt, Homo sapiens
uggggaguaggacauacca

SEQ ID NO: 379541 - RNA, 23 nt, Homo sapiens
uggggcccauggggucucugcau

SEQ ID NO: 379542 - RNA, 20 nt, Homo sapiens
uggggucucugcaucuucag

SEQ ID NO: 379543 - RNA, 12 nt, Homo sapiens
ugguacaaggaa

SEQ ID NO: 379544 - RNA, 22 nt, Homo sapiens
ugguacugcacauuuuguacaa

SEQ ID NO: 379545 - RNA, 13 nt, Homo sapiens
uguaaagcuuuaa

SEQ ID NO: 379546 - RNA, 22 nt, Homo sapiens
uguauaaugguguuacuaaagu

SEQ ID NO: 379547 - RNA, 15 nt, Homo sapiens
uguaucuacaguaau

SEQ ID NO: 379548 - RNA, 22 nt, Homo sapiens
uguauuuuccuaaugugaucau

SEQ ID NO: 379549 - RNA, 17 nt, Homo sapiens
uguccuugaaugccaua

SEQ ID NO: 379550 - RNA, 16 nt, Homo sapiens
ugucugacaaccucuu

SEQ ID NO: 379551 - RNA, 16 nt, Homo sapiens
ugugagccaccacguc

SEQ ID NO: 379552 - RNA, 23 nt, Homo sapiens
ugugcaccuauggcccagccacu

SEQ ID NO: 379553 - RNA, 21 nt, Homo sapiens
guauauauucuacacauauau

SEQ ID NO: 379554 - RNA, 20 nt, Homo sapiens
guauugcuguccuugaaugc

SEQ ID NO: 379555 - RNA, 19 nt, Homo sapiens
gucagaaacucgaugaaug

SEQ ID NO: 379556 - RNA, 15 nt, Homo sapiens
gucagaguucugcuc

SEQ ID NO: 379557 - RNA, 17 nt, Homo sapiens
gucagaguucugcucua

SEQ ID NO: 379558 - RNA, 14 nt, Homo sapiens
gucauuacuucuga

SEQ ID NO: 379559 - RNA, 13 nt, Homo sapiens
guccaguuuccaa

SEQ ID NO: 379560 - RNA, 20 nt, Homo sapiens
guccuggacccuggccuaaa

SEQ ID NO: 379561 - RNA, 19 nt, Homo sapiens
gucugaagccugcaggucc

SEQ ID NO: 379562 - RNA, 14 nt, Homo sapiens
gucuuugaacccuu

SEQ ID NO: 379563 - RNA, 17 nt, Homo sapiens
gugaaccuuaguaccua

SEQ ID NO: 379564 - RNA, 19 nt, Homo sapiens
gugaagucgagcacucuaa

SEQ ID NO: 379565 - RNA, 13 nt, Homo sapiens
gugccucagugcu

SEQ ID NO: 379566 - RNA, 21 nt, Homo sapiens
gugccucugcaaacuaaggag

SEQ ID NO: 379567 - RNA, 14 nt, Homo sapiens
guggaagaaggaaa

SEQ ID NO: 379568 - RNA, 21 nt, Homo sapiens
guguauucuuaaaaugcaaua

SEQ ID NO: 379569 - RNA, 16 nt, Homo sapiens
gugucauaaacuuucu

SEQ ID NO: 379570 - RNA, 14 nt, Homo sapiens
guuccccacugaca

SEQ ID NO: 379571 - RNA, 18 nt, Homo sapiens
guuggccugcacuggugu

SEQ ID NO: 379572 - RNA, 18 nt, Homo sapiens
guuuaaaaaaaguauaua

SEQ ID NO: 379573 - RNA, 12 nt, Homo sapiens
uaaaaaaacuga

SEQ ID NO: 379574 - RNA, 21 nt, Homo sapiens
uaaaaaggaaauuagucuuuu

SEQ ID NO: 379575 - RNA, 23 nt, Homo sapiens
uaaaaagugaacuuuuguaauuu

SEQ ID NO: 379576 - RNA, 21 nt, Homo sapiens
uaaaagaauaaaauugcacuu

SEQ ID NO: 379577 - RNA, 12 nt, Homo sapiens
uaaaaugcaaua

SEQ ID NO: 379578 - RNA, 15 nt, Homo sapiens
uaaaauugcacuuuu

SEQ ID NO: 379579 - RNA, 19 nt, Homo sapiens
uaaagcucugaacaaaagc

SEQ ID NO: 379580 - RNA, 23 nt, Homo sapiens
uaaaguauguuuucaauguuuca

SEQ ID NO: 379581 - RNA, 15 nt, Homo sapiens
uaaaguuugcuuuca

SEQ ID NO: 379582 - RNA, 13 nt, Homo sapiens
uaaauaaacagau

SEQ ID NO: 379583 - RNA, 14 nt, Homo sapiens
uaaaucccaagugu

SEQ ID NO: 379584 - RNA, 16 nt, Homo sapiens
uaaaucccaagugucu

SEQ ID NO: 379585 - RNA, 19 nt, Homo sapiens
uaacaaacuacauguaauc

SEQ ID NO: 379586 - RNA, 20 nt, Homo sapiens
uaacauuccuaaaaugcuuc

SEQ ID NO: 379587 - RNA, 12 nt, Homo sapiens
uaaccucuggcc

SEQ ID NO: 379588 - RNA, 12 nt, Homo sapiens
uaacugcaauuu

SEQ ID NO: 379589 - RNA, 20 nt, Homo sapiens
uaacuucaaggcccauaucu

SEQ ID NO: 379590 - RNA, 20 nt, Homo sapiens
uaaggagaggagaaacugag

SEQ ID NO: 379591 - RNA, 20 nt, Homo sapiens
uaauaaaaagcuucagggaa

SEQ ID NO: 379592 - RNA, 21 nt, Homo sapiens
uaauaucugagaaguguauau

SEQ ID NO: 379593 - RNA, 14 nt, Homo sapiens
uaauguacaucugg

SEQ ID NO: 379594 - RNA, 21 nt, Homo sapiens
uaauuugugcuacaguuuuuc

SEQ ID NO: 379595 - RNA, 16 nt, Homo sapiens
uaauuuuauuccagac

SEQ ID NO: 379596 - RNA, 19 nt, Homo sapiens
uaauuuugugaaagaagga

SEQ ID NO: 379597 - RNA, 14 nt, Homo sapiens
uacaaguauuacaa

SEQ ID NO: 379598 - RNA, 13 nt, Homo sapiens
uacauguaaucca

SEQ ID NO: 379599 - RNA, 16 nt, Homo sapiens
uacauguaauccauca

SEQ ID NO: 379600 - RNA, 19 nt, Homo sapiens
uaccucacagagugcauug

SEQ ID NO: 379601 - RNA, 18 nt, Homo sapiens
uaccuccuguguggaaga

SEQ ID NO: 379602 - RNA, 17 nt, Homo sapiens
uacgaucccccaagugu

SEQ ID NO: 379603 - RNA, 15 nt, Homo sapiens
uacuuaacauuucau

SEQ ID NO: 379604 - RNA, 18 nt, Homo sapiens
uacuuaacauuucauugu

SEQ ID NO: 379605 - RNA, 21 nt, Homo sapiens
uacuucccaauugccacauuu

SEQ ID NO: 379606 - RNA, 20 nt, Homo sapiens
uagacuguuucacauugcac

SEQ ID NO: 379607 - RNA, 19 nt, Homo sapiens
uagccaugauaacugcaau

SEQ ID NO: 379608 - RNA, 12 nt, Homo sapiens
uagcuguuucaa

SEQ ID NO: 379609 - RNA, 21 nt, Homo sapiens
uagcuguuucaaaugugcauu

SEQ ID NO: 379610 - RNA, 21 nt, Homo sapiens
uaggagacugguuaggacaaa

SEQ ID NO: 379611 - RNA, 13 nt, Homo sapiens
uaggucaugaagg

SEQ ID NO: 379612 - RNA, 19 nt, Homo sapiens
uagguuuccacugccaaaa

SEQ ID NO: 379613 - RNA, 17 nt, Homo sapiens
uagugcaauuccaagaa

SEQ ID NO: 379614 - RNA, 24 nt, Homo sapiens
uaguucuuaaaauuagugagauua

SEQ ID NO: 379615 - RNA, 21 nt, Homo sapiens
uauaaaagaauaaaauugcac

SEQ ID NO: 379616 - RNA, 21 nt, Homo sapiens
uauaaaaggauguuacaaguu

SEQ ID NO: 379617 - RNA, 15 nt, Homo sapiens
uauaacaaacuacau

SEQ ID NO: 379618 - RNA, 21 nt, Homo sapiens
uauaauaaaaagcuucaggga

SEQ ID NO: 379619 - RNA, 18 nt, Homo sapiens
uauagaagaaaauuuugg

SEQ ID NO: 379620 - RNA, 14 nt, Homo sapiens
uauagguuuccacu

SEQ ID NO: 379621 - RNA, 21 nt, Homo sapiens
uauaucauaaaguaugccuuc

SEQ ID NO: 379622 - RNA, 19 nt, Homo sapiens
uauauuguauuaagggcau

SEQ ID NO: 379623 - RNA, 11 nt, Homo sapiens
uaucugugaaa

SEQ ID NO: 379624 - RNA, 13 nt, Homo sapiens
uaugaaaacucau

SEQ ID NO: 379625 - RNA, 12 nt, Homo sapiens
uaugaucagagc

SEQ ID NO: 379626 - RNA, 18 nt, Homo sapiens
uaugcucagggucaauuu

SEQ ID NO: 379627 - RNA, 19 nt, Homo sapiens
uauggcccagccacugcag

SEQ ID NO: 379628 - RNA, 17 nt, Homo sapiens
uauuagcaacugugcua

SEQ ID NO: 379629 - RNA, 18 nt, Homo sapiens
uauuagcagggauucucu

SEQ ID NO: 379630 - RNA, 16 nt, Homo sapiens
uauuccagacagucac

SEQ ID NO: 379631 - RNA, 20 nt, Homo sapiens
uauuccagacagucacaaau

SEQ ID NO: 379632 - RNA, 19 nt, Homo sapiens
uauucuuaaaaugcaauau

SEQ ID NO: 379633 - RNA, 16 nt, Homo sapiens
uauugcauaauuuaua

SEQ ID NO: 379634 - RNA, 17 nt, Homo sapiens
uauuuuaagacgugaau

SEQ ID NO: 379635 - RNA, 14 nt, Homo sapiens
ucaaaugaacuuuu

SEQ ID NO: 379636 - RNA, 16 nt, Homo sapiens
ucaaauuauaaucuca

SEQ ID NO: 379637 - RNA, 21 nt, Homo sapiens
ucaaggcccauaucugugaaa

SEQ ID NO: 379638 - RNA, 15 nt, Homo sapiens
ucacagagugcauug

SEQ ID NO: 379639 - RNA, 16 nt, Homo sapiens
ucacccaccccaugga

SEQ ID NO: 379640 - RNA, 23 nt, Homo sapiens
ucacuaaauaaacacgauuuuau

SEQ ID NO: 379641 - RNA, 15 nt, Homo sapiens
ucacuauuacuugaa

SEQ ID NO: 379642 - RNA, 21 nt, Homo sapiens
ucacugcagccuuucacagga

SEQ ID NO: 379643 - RNA, 15 nt, Homo sapiens
ucagagcuugaacac

SEQ ID NO: 379644 - RNA, 16 nt, Homo sapiens
ucaggcuacaagguag

SEQ ID NO: 379645 - RNA, 18 nt, Homo sapiens
ucagggaagcugccaaag

SEQ ID NO: 379646 - RNA, 17 nt, Homo sapiens
ucagugaagucuagaau

SEQ ID NO: 379647 - RNA, 16 nt, Homo sapiens
agugcaguagugcagu

SEQ ID NO: 379648 - RNA, 18 nt, Homo sapiens
agugccaauauuucugau

SEQ ID NO: 379649 - RNA, 18 nt, Homo sapiens
agugucucuugacuggcu

SEQ ID NO: 379650 - RNA, 12 nt, Homo sapiens
aguguugcccag

SEQ ID NO: 379651 - RNA, 22 nt, Homo sapiens
aguguugcccaggcuggucuca

SEQ ID NO: 379652 - RNA, 21 nt, Homo sapiens
aguguugugcacuucauguca

SEQ ID NO: 379653 - RNA, 16 nt, Homo sapiens
aguuaaagaagacauu

SEQ ID NO: 379654 - RNA, 18 nt, Homo sapiens
aguuauaauaacugaacu

SEQ ID NO: 379655 - RNA, 22 nt, Homo sapiens
aguucaccaugagggaagaaua

SEQ ID NO: 379656 - RNA, 21 nt, Homo sapiens
aguuuggaauuauuguagaca

SEQ ID NO: 379657 - RNA, 19 nt, Homo sapiens
auacagagguaacuaucaa

SEQ ID NO: 379658 - RNA, 13 nt, Homo sapiens
auacaugcugcua

SEQ ID NO: 379659 - RNA, 23 nt, Homo sapiens
cacagagugcauugugaggguua

SEQ ID NO: 379660 - RNA, 19 nt, Homo sapiens
cacagggaagcauguacug

SEQ ID NO: 379661 - RNA, 18 nt, Homo sapiens
cacauuuuaaauaaagac

SEQ ID NO: 379662 - RNA, 23 nt, Homo sapiens
caccagugccucagugcugcaau

SEQ ID NO: 379663 - RNA, 16 nt, Homo sapiens
cacccuggaggauuuc

SEQ ID NO: 379664 - RNA, 21 nt, Homo sapiens
cacccuuccccuccuucuccc

SEQ ID NO: 379665 - RNA, 20 nt, Homo sapiens
caccuauggcccagccacug

SEQ ID NO: 379666 - RNA, 15 nt, Homo sapiens
caccugggccaagga

SEQ ID NO: 379667 - RNA, 12 nt, Homo sapiens
cacucugcaggg

SEQ ID NO: 379668 - RNA, 15 nt, Homo sapiens
cacucugcaggguga

SEQ ID NO: 379669 - RNA, 14 nt, Homo sapiens
auaccuaaacugua

SEQ ID NO: 379670 - RNA, 16 nt, Homo sapiens
auagaggaacuugaaa

SEQ ID NO: 379671 - RNA, 11 nt, Homo sapiens
auagugccucu

SEQ ID NO: 379672 - RNA, 20 nt, Homo sapiens
auauaaaauguuuaaucucu

SEQ ID NO: 379673 - RNA, 17 nt, Homo sapiens
auauauggcauuugcag

SEQ ID NO: 379674 - RNA, 19 nt, Homo sapiens
auaucugagaaguguauau

SEQ ID NO: 379675 - RNA, 11 nt, Homo sapiens
auauugcuaaa

SEQ ID NO: 379676 - RNA, 11 nt, Homo sapiens
aucaacaugac

SEQ ID NO: 379677 - RNA, 13 nt, Homo sapiens
aucaacaugacug

SEQ ID NO: 379678 - RNA, 14 nt, Homo sapiens
aucagcaugacaaa

SEQ ID NO: 379679 - RNA, 19 nt, Homo sapiens
aucaguguauuagucauaa

SEQ ID NO: 379680 - RNA, 17 nt, Homo sapiens
auccaaagaacuaugua

SEQ ID NO: 379681 - RNA, 17 nt, Homo sapiens
auccagcaguacaauaa

SEQ ID NO: 379682 - RNA, 22 nt, Homo sapiens
auccaggcccggugaggccaag

SEQ ID NO: 379683 - RNA, 16 nt, Homo sapiens
aucucaccccauccca

SEQ ID NO: 379684 - RNA, 20 nt, Homo sapiens
aucucuaaacugcuguuaau

SEQ ID NO: 379685 - RNA, 13 nt, Homo sapiens
aucugaacauuua

SEQ ID NO: 379686 - RNA, 15 nt, Homo sapiens
aucugaacauuuacu

SEQ ID NO: 379687 - RNA, 18 nt, Homo sapiens
aucugcauuuucacccca

SEQ ID NO: 379688 - RNA, 13 nt, Homo sapiens
augaaaauaccau

SEQ ID NO: 379689 - RNA, 15 nt, Homo sapiens
augaaagugaugaca

SEQ ID NO: 379690 - RNA, 22 nt, Homo sapiens
augacggcugcucgaagaacaa

SEQ ID NO: 379691 - RNA, 17 nt, Homo sapiens
augaucaagauauaugu

SEQ ID NO: 379692 - RNA, 17 nt, Homo sapiens
augaucuggauccacca

SEQ ID NO: 379693 - RNA, 23 nt, Homo sapiens
augcauccagcaguacaauaaaa

SEQ ID NO: 379694 - RNA, 14 nt, Homo sapiens
augcucagggucaa

SEQ ID NO: 379695 - RNA, 15 nt, Homo sapiens
augcugcuaauucaa

SEQ ID NO: 379696 - RNA, 19 nt, Homo sapiens
augggcgcaggcccaguga

SEQ ID NO: 379697 - RNA, 20 nt, Homo sapiens
augggcgcaggcccagugac

SEQ ID NO: 379698 - RNA, 19 nt, Homo sapiens
auguacaucuggccuugaa

SEQ ID NO: 379699 - RNA, 21 nt, Homo sapiens
augugaucauaugaggaccuu

SEQ ID NO: 379700 - RNA, 23 nt, Homo sapiens
auuaauaacgucuuuuuauaucu

SEQ ID NO: 379701 - RNA, 13 nt, Homo sapiens
auuacauacuauu

SEQ ID NO: 379702 - RNA, 19 nt, Homo sapiens
auuacgaucccccaagugu

SEQ ID NO: 379703 - RNA, 20 nt, Homo sapiens
auuacuagaaauauuuaacu

SEQ ID NO: 379704 - RNA, 13 nt, Homo sapiens
auucaaagcucua

SEQ ID NO: 379705 - RNA, 11 nt, Homo sapiens
auuccaaggaa

SEQ ID NO: 379706 - RNA, 16 nt, Homo sapiens
auucuuguuggcuuuu

SEQ ID NO: 379707 - RNA, 22 nt, Homo sapiens
auugaaggagaaaaugcauuau

SEQ ID NO: 379708 - RNA, 15 nt, Homo sapiens
auugacuccuuucca

SEQ ID NO: 379709 - RNA, 16 nt, Homo sapiens
auugacuccuuuccaa

SEQ ID NO: 379710 - RNA, 13 nt, Homo sapiens
auugcacucauca

SEQ ID NO: 379711 - RNA, 23 nt, Homo sapiens
auugcauacaacugugcauuaca

SEQ ID NO: 379712 - RNA, 14 nt, Homo sapiens
auugccauguggac

SEQ ID NO: 379713 - RNA, 16 nt, Homo sapiens
auuggcagccaaggaa

SEQ ID NO: 379714 - RNA, 18 nt, Homo sapiens
auuguacaaguauuacaa

SEQ ID NO: 379715 - RNA, 16 nt, Homo sapiens
auugucagaguucugc

SEQ ID NO: 379716 - RNA, 20 nt, Homo sapiens
auugucagaguucugcucua

SEQ ID NO: 379717 - RNA, 22 nt, Homo sapiens
auuucauccuugaauccuaugu

SEQ ID NO: 379718 - RNA, 21 nt, Homo sapiens
auuucugauauaacaaacuac

SEQ ID NO: 379719 - RNA, 12 nt, Homo sapiens
auuugccaacag

SEQ ID NO: 379720 - RNA, 23 nt, Homo sapiens
auuuguucucccaaaacagauua

SEQ ID NO: 379721 - RNA, 13 nt, Homo sapiens
auuuugcauuaga

SEQ ID NO: 379722 - RNA, 19 nt, Homo sapiens
auuuuuacaugcagaguau

SEQ ID NO: 379723 - RNA, 16 nt, Homo sapiens
auuuuuuaaacuguag

SEQ ID NO: 379724 - RNA, 12 nt, Homo sapiens
caaaaauguaau

SEQ ID NO: 379725 - RNA, 13 nt, Homo sapiens
caaaaauguaaug

SEQ ID NO: 379726 - RNA, 16 nt, Homo sapiens
caaaaucaacaugacu

SEQ ID NO: 379727 - RNA, 16 nt, Homo sapiens
caaacuacauguaauc

SEQ ID NO: 379728 - RNA, 21 nt, Homo sapiens
caaagccgcggggacaccggg

SEQ ID NO: 379729 - RNA, 23 nt, Homo sapiens
caaagccgcggggacaccgggaa

SEQ ID NO: 379730 - RNA, 13 nt, Homo sapiens
caacaauacaugc

SEQ ID NO: 379731 - RNA, 19 nt, Homo sapiens
caagauuuuuucauuucaa

SEQ ID NO: 379732 - RNA, 16 nt, Homo sapiens
caagcuccaaauccaa

SEQ ID NO: 379733 - RNA, 19 nt, Homo sapiens
caaggcccauaucugugaa

SEQ ID NO: 379734 - RNA, 22 nt, Homo sapiens
caaggcccauaucugugaaaug

SEQ ID NO: 379735 - RNA, 21 nt, Homo sapiens
caaguaguagugucuuccuag

SEQ ID NO: 379736 - RNA, 16 nt, Homo sapiens
caaguauauaauuuac

SEQ ID NO: 379737 - RNA, 20 nt, Homo sapiens
caaguauuacaaccauauau

SEQ ID NO: 379738 - RNA, 16 nt, Homo sapiens
caauacaugcugcuaa

SEQ ID NO: 379739 - RNA, 19 nt, Homo sapiens
caauaguguccuaugcaau

SEQ ID NO: 379740 - RNA, 11 nt, Homo sapiens
cacagacuccg

SEQ ID NO: 379741 - RNA, 12 nt, Homo sapiens
cacauaaaggua

SEQ ID NO: 379742 - RNA, 13 nt, Homo sapiens
cacaucugcauuu

SEQ ID NO: 379743 - RNA, 20 nt, Homo sapiens
cacauuuugcauuagacaga

SEQ ID NO: 379744 - RNA, 23 nt, Homo sapiens
cacauuuugcauuagacagauga

SEQ ID NO: 379745 - RNA, 17 nt, Homo sapiens
cacccuccuggcacaac

SEQ ID NO: 379746 - RNA, 20 nt, Homo sapiens
cacccugucucaguaccucc

SEQ ID NO: 379747 - RNA, 16 nt, Homo sapiens
caccugaccucugcaa

SEQ ID NO: 379748 - RNA, 22 nt, Homo sapiens
cacuagccaugauaacugcaau

SEQ ID NO: 379749 - RNA, 16 nt, Homo sapiens
cacugccgaugcccaa

SEQ ID NO: 379750 - RNA, 17 nt, Homo sapiens
cacugccgaugcccaau

SEQ ID NO: 379751 - RNA, 18 nt, Homo sapiens
cacugccgaugcccaauc

SEQ ID NO: 379752 - RNA, 18 nt, Homo sapiens
cagagaaagaaaaggcaa

SEQ ID NO: 379753 - RNA, 12 nt, Homo sapiens
cagauagugccu

SEQ ID NO: 379754 - RNA, 18 nt, Homo sapiens
cagauuacuagaaauauu

SEQ ID NO: 379755 - RNA, 15 nt, Homo sapiens
cagcacagcccaggg

SEQ ID NO: 379756 - RNA, 12 nt, Homo sapiens
cagccacauggg

SEQ ID NO: 379757 - RNA, 13 nt, Homo sapiens
cagccacauucua

SEQ ID NO: 379758 - RNA, 15 nt, Homo sapiens
cagcccccacagccc

SEQ ID NO: 379759 - RNA, 17 nt, Homo sapiens
cagcucucucuccugga

SEQ ID NO: 379760 - RNA, 16 nt, Homo sapiens
cagcucuucaacauga

SEQ ID NO: 379761 - RNA, 21 nt, Homo sapiens
cuauggcccagccacugcagc

SEQ ID NO: 379762 - RNA, 15 nt, Homo sapiens
cuauguuucaucuug

SEQ ID NO: 379763 - RNA, 19 nt, Homo sapiens
cucacagagugcauuguga

SEQ ID NO: 379764 - RNA, 20 nt, Homo sapiens
cucacagagugcauugugag

SEQ ID NO: 379765 - RNA, 17 nt, Homo sapiens
cucacuguugaauuuuc

SEQ ID NO: 379766 - RNA, 23 nt, Homo sapiens
cucaggauuguuucucggcacca

SEQ ID NO: 379767 - RNA, 23 nt, Homo sapiens
cucaugcaagacuucacugcagc

SEQ ID NO: 379768 - RNA, 13 nt, Homo sapiens
cucauuucaauuu

SEQ ID NO: 379769 - RNA, 23 nt, Homo sapiens
cuccaaauccaaggaaacaugca

SEQ ID NO: 379770 - RNA, 16 nt, Homo sapiens
cucccaaaacagauua

SEQ ID NO: 379771 - RNA, 16 nt, Homo sapiens
cuccuggcacaacgcu

SEQ ID NO: 379772 - RNA, 15 nt, Homo sapiens
cuccuuuccaauaga

SEQ ID NO: 379773 - RNA, 16 nt, Homo sapiens
cucgagcaguccugcc

SEQ ID NO: 379774 - RNA, 23 nt, Homo sapiens
cucuaaauaaacagauacauuca

SEQ ID NO: 379775 - RNA, 20 nt, Homo sapiens
cucuaauuagagaacuggag

SEQ ID NO: 379776 - RNA, 16 nt, Homo sapiens
cucuaguuauauugaa

SEQ ID NO: 379777 - RNA, 19 nt, Homo sapiens
cucugcagauagugccucu

SEQ ID NO: 379778 - RNA, 19 nt, Homo sapiens
cucuugacuggcucaagaa

SEQ ID NO: 379779 - RNA, 18 nt, Homo sapiens
cucuuguauaugaugauc

SEQ ID NO: 379780 - RNA, 23 nt, Homo sapiens
cugaaacaugugccccugccaag

SEQ ID NO: 379781 - RNA, 19 nt, Homo sapiens
cugaaacgagaagugcccu

SEQ ID NO: 379782 - RNA, 21 nt, Homo sapiens
cugaaacgagaagugcccuua

SEQ ID NO: 379783 - RNA, 17 nt, Homo sapiens
cugacagaaaugcaauc

SEQ ID NO: 379784 - RNA, 14 nt, Homo sapiens
cugauccuugcacg

SEQ ID NO: 379785 - RNA, 22 nt, Homo sapiens
cugauuaccuccuguguggaag

SEQ ID NO: 379786 - RNA, 16 nt, Homo sapiens
cugcaaacccaugaag

SEQ ID NO: 379787 - RNA, 19 nt, Homo sapiens
cugcaagaauuaaaacuga

SEQ ID NO: 379788 - RNA, 20 nt, Homo sapiens
cugcaagagggggcauugau

SEQ ID NO: 379789 - RNA, 17 nt, Homo sapiens
cugcaauuuuaauugau

SEQ ID NO: 379790 - RNA, 20 nt, Homo sapiens
cugcacauuuuguacaaaga

SEQ ID NO: 379791 - RNA, 20 nt, Homo sapiens
cugcagcuuggagaacuccg

SEQ ID NO: 379792 - RNA, 18 nt, Homo sapiens
cugccccuccccaaaaga

SEQ ID NO: 379793 - RNA, 15 nt, Homo sapiens
cugccgaauauagaa

SEQ ID NO: 379794 - RNA, 20 nt, Homo sapiens
cugcucgaagaacaauguca

SEQ ID NO: 379795 - RNA, 19 nt, Homo sapiens
cuggacccuggccuaaaga

SEQ ID NO: 379796 - RNA, 20 nt, Homo sapiens
cuggauggggagucucaugc

SEQ ID NO: 379797 - RNA, 14 nt, Homo sapiens
cuggcccagccaaa

SEQ ID NO: 379798 - RNA, 13 nt, Homo sapiens
cuggcuuugcaag

SEQ ID NO: 379799 - RNA, 22 nt, Homo sapiens
cugggauuacaauugugagcca

SEQ ID NO: 379800 - RNA, 21 nt, Homo sapiens
cugggucucgcuuuguugccc

SEQ ID NO: 379801 - RNA, 15 nt, Homo sapiens
cuggucucaaacucc

SEQ ID NO: 379802 - RNA, 13 nt, Homo sapiens
cugguuagguaga

SEQ ID NO: 379803 - RNA, 20 nt, Homo sapiens
cuguaaucagcucuccuggc

SEQ ID NO: 379804 - RNA, 15 nt, Homo sapiens
cuguccaguuuccaa

SEQ ID NO: 379805 - RNA, 18 nt, Homo sapiens
cuguccaguuuccaaagg

SEQ ID NO: 379806 - RNA, 18 nt, Homo sapiens
cuguccuaggucaugaag

SEQ ID NO: 379807 - RNA, 14 nt, Homo sapiens
cugucugacaaccu

SEQ ID NO: 379808 - RNA, 17 nt, Homo sapiens
cugugaauuucaaaaaa

SEQ ID NO: 379809 - RNA, 22 nt, Homo sapiens
cugugggcaaaagaguguaaaa

SEQ ID NO: 379810 - RNA, 23 nt, Homo sapiens
cugugucuuauagguuuccacug

SEQ ID NO: 379811 - RNA, 17 nt, Homo sapiens
cuguuuaguuuuacacu

SEQ ID NO: 379812 - RNA, 17 nt, Homo sapiens
cuguuucaugagcccaa

SEQ ID NO: 379813 - RNA, 12 nt, Homo sapiens
cuguuugucaau

SEQ ID NO: 379814 - RNA, 14 nt, Homo sapiens
cuuaaaaugcaaua

SEQ ID NO: 379815 - RNA, 20 nt, Homo sapiens
cuuaaaauuagugagauuaa

SEQ ID NO: 379816 - RNA, 19 nt, Homo sapiens
cuuauagaggaacuugaaa

SEQ ID NO: 379817 - RNA, 21 nt, Homo sapiens
cuucaacaugacauccagaga

SEQ ID NO: 379818 - RNA, 18 nt, Homo sapiens
cuucacugcagccuuuca

SEQ ID NO: 379819 - RNA, 19 nt, Homo sapiens
cuucuaccuuaaaauguaa

SEQ ID NO: 379820 - RNA, 20 nt, Homo sapiens
cuucugcuuuuuuucaggga

SEQ ID NO: 379821 - RNA, 12 nt, Homo sapiens
cuugaaugccau

SEQ ID NO: 379822 - RNA, 18 nt, Homo sapiens
cuugcaguuaaggguuag

SEQ ID NO: 379823 - RNA, 16 nt, Homo sapiens
cuuguuccaaugccac

SEQ ID NO: 379824 - RNA, 22 nt, Homo sapiens
cuuuaaaauaaaauaauuuuau

SEQ ID NO: 379825 - RNA, 16 nt, Homo sapiens
cuuuaaucacuuaaca

SEQ ID NO: 379826 - RNA, 22 nt, Homo sapiens
cuuuaaucacuuaacauuccua

SEQ ID NO: 379827 - RNA, 17 nt, Homo sapiens
cuuugagacugggucuc

SEQ ID NO: 379828 - RNA, 19 nt, Homo sapiens
cuuuguagacuguuucaca

SEQ ID NO: 379829 - RNA, 17 nt, Homo sapiens
cuuugucccggggcucc

SEQ ID NO: 379830 - RNA, 23 nt, Homo sapiens
cuuugucccggggcuccacugaa

SEQ ID NO: 379831 - RNA, 21 nt, Homo sapiens
cuuuuacagaaugcauuaaaa

SEQ ID NO: 379832 - RNA, 18 nt, Homo sapiens
gaaaacccccagcauuac

SEQ ID NO: 379833 - RNA, 14 nt, Homo sapiens
gaaacaugugcccc

SEQ ID NO: 379834 - RNA, 12 nt, Homo sapiens
gaaaccaugaca

SEQ ID NO: 379835 - RNA, 16 nt, Homo sapiens
gaaacucagugcaaaa

SEQ ID NO: 379836 - RNA, 15 nt, Homo sapiens
gaaaucagcaugaca

SEQ ID NO: 379837 - RNA, 20 nt, Homo sapiens
gaaauucaaccugugucuua

SEQ ID NO: 379838 - RNA, 16 nt, Homo sapiens
gaagaaggaaacaccg

SEQ ID NO: 379839 - RNA, 21 nt, Homo sapiens
gaagcuggcccucagcucccu

SEQ ID NO: 379840 - RNA, 23 nt, Homo sapiens
gaauauauggcauuugcagauuu

SEQ ID NO: 379841 - RNA, 20 nt, Homo sapiens
gaaucauacuuaacauuuca

SEQ ID NO: 379842 - RNA, 21 nt, Homo sapiens
gaaucauacuuaacauuucau

SEQ ID NO: 379843 - RNA, 15 nt, Homo sapiens
gacaugcccaaaacu

SEQ ID NO: 379844 - RNA, 13 nt, Homo sapiens
gacauuugccaac

SEQ ID NO: 379845 - RNA, 21 nt, Homo sapiens
gacggcugcucgaagaacaau

SEQ ID NO: 379846 - RNA, 11 nt, Homo sapiens
gacugauuacc

SEQ ID NO: 379847 - RNA, 13 nt, Homo sapiens
gacuggcucaaga

SEQ ID NO: 379848 - RNA, 19 nt, Homo sapiens
gacuucacugcagccuuuc

SEQ ID NO: 379849 - RNA, 15 nt, Homo sapiens
gagaccacacauuuu

SEQ ID NO: 379850 - RNA, 15 nt, Homo sapiens
gagaccaggagggag

SEQ ID NO: 379851 - RNA, 17 nt, Homo sapiens
gagcaguccugccucag

SEQ ID NO: 379852 - RNA, 21 nt, Homo sapiens
gagucucaugcaagacuucac

SEQ ID NO: 379853 - RNA, 23 nt, Homo sapiens
gauacuccgcugucggcacauuc

SEQ ID NO: 379854 - RNA, 21 nt, Homo sapiens
gaugaucuggauccaccaaga

SEQ ID NO: 379855 - RNA, 13 nt, Homo sapiens
gauuccacuuuua

SEQ ID NO: 379856 - RNA, 17 nt, Homo sapiens
gcaagacuucacugcag

SEQ ID NO: 379857 - RNA, 23 nt, Homo sapiens
gcaagacuucacugcagccuuuc

SEQ ID NO: 379858 - RNA, 23 nt, Homo sapiens
gcaccuauggcccagccacugca

SEQ ID NO: 379859 - RNA, 12 nt, Homo sapiens
gcagcacaggag

SEQ ID NO: 379860 - RNA, 14 nt, Homo sapiens
gcaggcccagugac

SEQ ID NO: 379861 - RNA, 20 nt, Homo sapiens
uagguaggggcccacuucac

SEQ ID NO: 379862 - RNA, 16 nt, Homo sapiens
uagugcaguucaccau

SEQ ID NO: 379863 - RNA, 22 nt, Homo sapiens
uaguguugugcacuucauguca

SEQ ID NO: 379864 - RNA, 19 nt, Homo sapiens
uauaaauuguacauuuugu

SEQ ID NO: 379865 - RNA, 21 nt, Homo sapiens
uauaacaaacuacauguaauc

SEQ ID NO: 379866 - RNA, 14 nt, Homo sapiens
uauaauaacugaac

SEQ ID NO: 379867 - RNA, 11 nt, Homo sapiens
uauaauuuuga

SEQ ID NO: 379868 - RNA, 17 nt, Homo sapiens
uauauaauuuacuuugu

SEQ ID NO: 379869 - RNA, 16 nt, Homo sapiens
uauauuggaagcugcu

SEQ ID NO: 379870 - RNA, 22 nt, Homo sapiens
uaucugugaaaugcuggcauuu

SEQ ID NO: 379871 - RNA, 21 nt, Homo sapiens
uaugagaguuuggaauuauug

SEQ ID NO: 379872 - RNA, 14 nt, Homo sapiens
uauggcauuugcag

SEQ ID NO: 379873 - RNA, 15 nt, Homo sapiens
uauuaagauuuccaa

SEQ ID NO: 379874 - RNA, 18 nt, Homo sapiens
uauuagcaacugugcuac

SEQ ID NO: 379875 - RNA, 15 nt, Homo sapiens
uauucugauuccacu

SEQ ID NO: 379876 - RNA, 17 nt, Homo sapiens
uauucugauuccacuuu

SEQ ID NO: 379877 - RNA, 15 nt, Homo sapiens
uauuuaucugcaagg

SEQ ID NO: 379878 - RNA, 15 nt, Homo sapiens
uauuuuaagacguga

SEQ ID NO: 379879 - RNA, 23 nt, Homo sapiens
ucaaagcucuauuaagauuucca

SEQ ID NO: 379880 - RNA, 17 nt, Homo sapiens
ucaaaugugcauuuugu

SEQ ID NO: 379881 - RNA, 15 nt, Homo sapiens
ucaauuaaagaaaua

SEQ ID NO: 379882 - RNA, 16 nt, Homo sapiens
ucacagagugcauugu

SEQ ID NO: 379883 - RNA, 16 nt, Homo sapiens
ucacaguguugcccag

SEQ ID NO: 379884 - RNA, 14 nt, Homo sapiens
ucacauauaaaagu

SEQ ID NO: 379885 - RNA, 21 nt, Homo sapiens
ucacccaccccauggagacaa

SEQ ID NO: 379886 - RNA, 21 nt, Homo sapiens
ucaccccagcccccacagccc

SEQ ID NO: 379887 - RNA, 13 nt, Homo sapiens
ucagaaacaguau

SEQ ID NO: 379888 - RNA, 14 nt, Homo sapiens
ucagagcuugaaca

SEQ ID NO: 379889 - RNA, 15 nt, Homo sapiens
ucagaucugugagca

SEQ ID NO: 379890 - RNA, 12 nt, Homo sapiens
ucagcaugacaa

SEQ ID NO: 379891 - RNA, 20 nt, Homo sapiens
ucagcugagguucauuacaa

SEQ ID NO: 379892 - RNA, 15 nt, Homo sapiens
ucaucuaacugauga

SEQ ID NO: 379893 - RNA, 23 nt, Homo sapiens
ucaugccaccauggccagccaac

SEQ ID NO: 379894 - RNA, 20 nt, Homo sapiens
ucauuaagaauaauugaaca

SEQ ID NO: 379895 - RNA, 22 nt, Homo sapiens
ucauuacaaucgagacugcaau

SEQ ID NO: 379896 - RNA, 18 nt, Homo sapiens
ucauugggaagauucucu

SEQ ID NO: 379897 - RNA, 13 nt, Homo sapiens
uccaagugccaau

SEQ ID NO: 379898 - RNA, 20 nt, Homo sapiens
uccaaugccacauacuugca

SEQ ID NO: 379899 - RNA, 15 nt, Homo sapiens
uccaguuuccaaagg

SEQ ID NO: 379900 - RNA, 23 nt, Homo sapiens
uccauaaaguaauuuugugaaag

SEQ ID NO: 379901 - RNA, 20 nt, Homo sapiens
uccauuuaagacacauugac

SEQ ID NO: 379902 - RNA, 17 nt, Homo sapiens
ucccacccccaucucuc

SEQ ID NO: 379903 - RNA, 13 nt, Homo sapiens
uccgaguguuugc

SEQ ID NO: 379904 - RNA, 20 nt, Homo sapiens
uccgcugucggcacauucag

SEQ ID NO: 379905 - RNA, 20 nt, Homo sapiens
uccuacuuauugccaugugg

SEQ ID NO: 379906 - RNA, 17 nt, Homo sapiens
uccuaggucaugaagga

SEQ ID NO: 379907 - RNA, 20 nt, Homo sapiens
uccuaugcucugggugaaua

SEQ ID NO: 379908 - RNA, 16 nt, Homo sapiens
ucgcuuuguugcccag

SEQ ID NO: 379909 - RNA, 16 nt, Homo sapiens
ucggcaccagugccuc

SEQ ID NO: 379910 - RNA, 16 nt, Homo sapiens
ucuaaacugcuguuaa

SEQ ID NO: 379911 - RNA, 14 nt, Homo sapiens
ucuacuugucauau

SEQ ID NO: 379912 - RNA, 15 nt, Homo sapiens
ucuaucuaaugacau

SEQ ID NO: 379913 - RNA, 18 nt, Homo sapiens
ucucagcgagguguaaag

SEQ ID NO: 379914 - RNA, 23 nt, Homo sapiens
ucucccuguuggucgguggguug

SEQ ID NO: 379915 - RNA, 12 nt, Homo sapiens
ucucgcuuuguu

SEQ ID NO: 379916 - RNA, 15 nt, Homo sapiens
ucugcaaacuaagga

SEQ ID NO: 379917 - RNA, 23 nt, Homo sapiens
ucugcagauagugccucugcaaa

SEQ ID NO: 379918 - RNA, 19 nt, Homo sapiens
ucugcagggugaagcacca

SEQ ID NO: 379919 - RNA, 15 nt, Homo sapiens
ucugcgccucuccac

SEQ ID NO: 379920 - RNA, 20 nt, Homo sapiens
ucuggccuugaaaccaccuu

SEQ ID NO: 379921 - RNA, 13 nt, Homo sapiens
ucuuaaaaacugu

SEQ ID NO: 379922 - RNA, 15 nt, Homo sapiens
ucuucaacaugacau

SEQ ID NO: 379923 - RNA, 16 nt, Homo sapiens
ucuuccuaguauauua

SEQ ID NO: 379924 - RNA, 20 nt, Homo sapiens
ucuuugaacccuugcuugca

SEQ ID NO: 379925 - RNA, 16 nt, Homo sapiens
ugaaaaauauugcuaa

SEQ ID NO: 379926 - RNA, 19 nt, Homo sapiens
ugaaaugcuggcauuugca

SEQ ID NO: 379927 - RNA, 12 nt, Homo sapiens
ugaacuguggaa

SEQ ID NO: 379928 - RNA, 15 nt, Homo sapiens
ugaauagagccugau

SEQ ID NO: 379929 - RNA, 14 nt, Homo sapiens
ugacagaaaugcaa

SEQ ID NO: 379930 - RNA, 12 nt, Homo sapiens
ugacagccuccc

SEQ ID NO: 379931 - RNA, 13 nt, Homo sapiens
ugagcagguauca

SEQ ID NO: 379932 - RNA, 20 nt, Homo sapiens
ugauuucucuacuugucaua

SEQ ID NO: 379933 - RNA, 19 nt, Homo sapiens
ugcaagaauuaaaacugag

SEQ ID NO: 379934 - RNA, 17 nt, Homo sapiens
ugcaagacuucacugca

SEQ ID NO: 379935 - RNA, 15 nt, Homo sapiens
ugcaagcacaucugc

SEQ ID NO: 379936 - RNA, 19 nt, Homo sapiens
ugcaauaaaauuauuugca

SEQ ID NO: 379937 - RNA, 12 nt, Homo sapiens
ugcaauguauua

SEQ ID NO: 379938 - RNA, 12 nt, Homo sapiens
ugcaaugugauc

SEQ ID NO: 379939 - RNA, 13 nt, Homo sapiens
ugcaauuccaaga

SEQ ID NO: 379940 - RNA, 20 nt, Homo sapiens
ugcagauagugccucugcaa

SEQ ID NO: 379941 - RNA, 17 nt, Homo sapiens
ugcagccuuugccuccc

SEQ ID NO: 379942 - RNA, 21 nt, Homo sapiens
ugcccacugccgaugcccaau

SEQ ID NO: 379943 - RNA, 20 nt, Homo sapiens
ugcccaggcuggaguggagu

SEQ ID NO: 379944 - RNA, 12 nt, Homo sapiens
ugccucugcaaa

SEQ ID NO: 379945 - RNA, 14 nt, Homo sapiens
ugcgaacagcaaac

SEQ ID NO: 379946 - RNA, 18 nt, Homo sapiens
ugcuaaaagugcauuuaa

SEQ ID NO: 379947 - RNA, 15 nt, Homo sapiens
ugcuggcauuugcac

SEQ ID NO: 379948 - RNA, 13 nt, Homo sapiens
ugcuuacaaagua

SEQ ID NO: 379949 - RNA, 17 nt, Homo sapiens
ugcuuuuuuucagggaa

SEQ ID NO: 379950 - RNA, 18 nt, Homo sapiens
uggccuugaaaccaccuu

SEQ ID NO: 379951 - RNA, 16 nt, Homo sapiens
ugggaucgcauugcau

SEQ ID NO: 379952 - RNA, 17 nt, Homo sapiens
ugggaucgcauugcaua

SEQ ID NO: 379953 - RNA, 15 nt, Homo sapiens
uggggagucucaugc

SEQ ID NO: 379954 - RNA, 12 nt, Homo sapiens
uguaaugaucau

SEQ ID NO: 379955 - RNA, 15 nt, Homo sapiens
uguacaaagauaugc

SEQ ID NO: 379956 - RNA, 16 nt, Homo sapiens
ugucccaaguccugcu

SEQ ID NO: 379957 - RNA, 21 nt, Homo sapiens
ugucucuugacuggcucaaga

SEQ ID NO: 379958 - RNA, 14 nt, Homo sapiens
uguguccaagacac

SEQ ID NO: 379959 - RNA, 22 nt, Homo sapiens
uguguguauucuuaaaaugcaa

SEQ ID NO: 379960 - RNA, 17 nt, Homo sapiens
uguuguacauacagagg

SEQ ID NO: 379961 - RNA, 19 nt, Homo sapiens
uguuugggaagguggguga

SEQ ID NO: 379962 - RNA, 19 nt, Homo sapiens
uguuuuaaaaaaacugaag

SEQ ID NO: 379963 - RNA, 22 nt, Homo sapiens
ucaauuuauaacguucucaguc

SEQ ID NO: 379964 - RNA, 18 nt, Homo sapiens
ucacuacucucuacucug

SEQ ID NO: 379965 - RNA, 23 nt, Homo sapiens
ucacuagccaugauaacugcaau

SEQ ID NO: 379966 - RNA, 16 nt, Homo sapiens
ucagaacaacuugcua

SEQ ID NO: 379967 - RNA, 14 nt, Homo sapiens
ucagccacauucua

SEQ ID NO: 379968 - RNA, 23 nt, Homo sapiens
ucaggcgauccaccugucucagc

SEQ ID NO: 379969 - RNA, 17 nt, Homo sapiens
ucauagaaugaaaguau

SEQ ID NO: 379970 - RNA, 16 nt, Homo sapiens
ucaugcaagacuucac

SEQ ID NO: 379971 - RNA, 21 nt, Homo sapiens
ucaugcaagacuucacugcag

SEQ ID NO: 379972 - RNA, 20 nt, Homo sapiens
uccacgugauuuccagugag

SEQ ID NO: 379973 - RNA, 11 nt, Homo sapiens
uccacuuuuau

SEQ ID NO: 379974 - RNA, 13 nt, Homo sapiens
uccagacagucac

SEQ ID NO: 379975 - RNA, 14 nt, Homo sapiens
uccaggauguggaa

SEQ ID NO: 379976 - RNA, 21 nt, Homo sapiens
uccaucacuagccaugauaac

SEQ ID NO: 379977 - RNA, 17 nt, Homo sapiens
ucccacccccacuucau

SEQ ID NO: 379978 - RNA, 18 nt, Homo sapiens
ucccacccccaucucucc

SEQ ID NO: 379979 - RNA, 16 nt, Homo sapiens
ucccauucuauguguc

SEQ ID NO: 379980 - RNA, 18 nt, Homo sapiens
ucccggggcuccacugaa

SEQ ID NO: 379981 - RNA, 23 nt, Homo sapiens
ucccuuuuuauaucccauuuuua

SEQ ID NO: 379982 - RNA, 20 nt, Homo sapiens
uccuauaucuguuuguauau

SEQ ID NO: 379983 - RNA, 13 nt, Homo sapiens
uccuaugcaauaa

SEQ ID NO: 379984 - RNA, 23 nt, Homo sapiens
uccucagcccccaggccagguga

SEQ ID NO: 379985 - RNA, 19 nt, Homo sapiens
uccuguguggaagaaggaa

SEQ ID NO: 379986 - RNA, 20 nt, Homo sapiens
uccuuauugaaaaaucagug

SEQ ID NO: 379987 - RNA, 20 nt, Homo sapiens
ucuaucuaaugacaugccua

SEQ ID NO: 379988 - RNA, 18 nt, Homo sapiens
ucucacaguguugcccag

SEQ ID NO: 379989 - RNA, 18 nt, Homo sapiens
ucucgcuuuguugcccag

SEQ ID NO: 379990 - RNA, 18 nt, Homo sapiens
ucucuaaacugcuguuaa

SEQ ID NO: 379991 - RNA, 12 nt, Homo sapiens
ucugaacuucca

SEQ ID NO: 379992 - RNA, 18 nt, Homo sapiens
ucugcuuuuuuucaggga

SEQ ID NO: 379993 - RNA, 14 nt, Homo sapiens
ucuguuccauaguu

SEQ ID NO: 379994 - RNA, 20 nt, Homo sapiens
ucuuagaguuuacaguuugu

SEQ ID NO: 379995 - RNA, 13 nt, Homo sapiens
ucuucaacaugac

SEQ ID NO: 379996 - RNA, 15 nt, Homo sapiens
ucuuggcuucuuaaa

SEQ ID NO: 379997 - RNA, 17 nt, Homo sapiens
ucuuguuccccacugac

SEQ ID NO: 379998 - RNA, 15 nt, Homo sapiens
ucuuuuaaaguauuu

SEQ ID NO: 379999 - RNA, 15 nt, Homo sapiens
ucuuuuaggaucaga

SEQ ID NO: 380000 - RNA, 17 nt, Homo sapiens
ugaaaaauauugcuaaa

SEQ ID NO: 380001 - RNA, 16 nt, Homo sapiens
ugaaagaaggagcaag

SEQ ID NO: 380002 - RNA, 21 nt, Homo sapiens
ugaacagcaggaugcccuguu

SEQ ID NO: 380003 - RNA, 22 nt, Homo sapiens
ugaacuuuccaaaaccuaaaga

SEQ ID NO: 380004 - RNA, 17 nt, Homo sapiens
ugaaggagaaaaugcau

SEQ ID NO: 380005 - RNA, 12 nt, Homo sapiens
ugacaaccucuu

SEQ ID NO: 380006 - RNA, 14 nt, Homo sapiens
ugaccucugcaaga

SEQ ID NO: 380007 - RNA, 23 nt, Homo sapiens
ugaguaaacugaggcccaaagca

SEQ ID NO: 380008 - RNA, 13 nt, Homo sapiens
ugauacaucaucg

SEQ ID NO: 380009 - RNA, 18 nt, Homo sapiens
ugauuaaaaucuggcaaa

SEQ ID NO: 380010 - RNA, 13 nt, Homo sapiens
ugcaaacuaagga

SEQ ID NO: 380011 - RNA, 17 nt, Homo sapiens
ugcaaugugaucuaugu

SEQ ID NO: 380012 - RNA, 14 nt, Homo sapiens
ugcaauuccaagaa

SEQ ID NO: 380013 - RNA, 19 nt, Homo sapiens
ugcacauuuuguacaaaga

SEQ ID NO: 380014 - RNA, 11 nt, Homo sapiens
ugcacuuuuaa

SEQ ID NO: 380015 - RNA, 18 nt, Homo sapiens
ugcacuuuuaaaccucuc

SEQ ID NO: 380016 - RNA, 17 nt, Homo sapiens
ugcagauagugccucug

SEQ ID NO: 380017 - RNA, 20 nt, Homo sapiens
ugcagcucuucaacaugaca

SEQ ID NO: 380018 - RNA, 22 nt, Homo sapiens
ugcauaccuucgggguacaagu

SEQ ID NO: 380019 - RNA, 16 nt, Homo sapiens
ugcauugugaggguua

SEQ ID NO: 380020 - RNA, 14 nt, Homo sapiens
ugccaaaacaaugc

SEQ ID NO: 380021 - RNA, 20 nt, Homo sapiens
ugccacauuuuaaauaaaga

SEQ ID NO: 380022 - RNA, 16 nt, Homo sapiens
ugcuaaaagugcauuu

SEQ ID NO: 380023 - RNA, 18 nt, Homo sapiens
ugcuaauucaaagcucua

SEQ ID NO: 380024 - RNA, 16 nt, Homo sapiens
ugcuccaggcaucacu

SEQ ID NO: 380025 - RNA, 18 nt, Homo sapiens
ugcugaaacucagugcaa

SEQ ID NO: 380026 - RNA, 17 nt, Homo sapiens
ugcugcaaacccaugaa

SEQ ID NO: 380027 - RNA, 14 nt, Homo sapiens
ugcuggcauuugca

SEQ ID NO: 380028 - RNA, 17 nt, Homo sapiens
ugcuuucagaugcaguu

SEQ ID NO: 380029 - RNA, 17 nt, Homo sapiens
uggaucagaggucaucc

SEQ ID NO: 380030 - RNA, 14 nt, Homo sapiens
uggcccuuggaaua

SEQ ID NO: 380031 - RNA, 13 nt, Homo sapiens
uggccuaaagaau

SEQ ID NO: 380032 - RNA, 14 nt, Homo sapiens
ugggcccuagagga

SEQ ID NO: 380033 - RNA, 17 nt, Homo sapiens
uggggacccccucagga

SEQ ID NO: 380034 - RNA, 22 nt, Homo sapiens
uggguuggggacccccucagga

SEQ ID NO: 380035 - RNA, 20 nt, Homo sapiens
uggguuuugggucuuugaac

SEQ ID NO: 380036 - RNA, 21 nt, Homo sapiens
uguacaaguauuacaaccaua

SEQ ID NO: 380037 - RNA, 21 nt, Homo sapiens
uguacuuuucugguuccaaac

SEQ ID NO: 380038 - RNA, 20 nt, Homo sapiens
uguagagauggggucucaca

SEQ ID NO: 380039 - RNA, 13 nt, Homo sapiens
uguagaucaggga

SEQ ID NO: 380040 - RNA, 16 nt, Homo sapiens
uguauaaaaaggaaau

SEQ ID NO: 380041 - RNA, 13 nt, Homo sapiens
uguauaauggugu

SEQ ID NO: 380042 - RNA, 22 nt, Homo sapiens
uguccccggcggggugccugcu

SEQ ID NO: 380043 - RNA, 16 nt, Homo sapiens
ugucccucacuguuga

SEQ ID NO: 380044 - RNA, 14 nt, Homo sapiens
uguccuaugcaaua

SEQ ID NO: 380045 - RNA, 14 nt, Homo sapiens
ugucucagccuccc

SEQ ID NO: 380046 - RNA, 22 nt, Homo sapiens
ugucuuauagguuuccacugcc

SEQ ID NO: 380047 - RNA, 23 nt, Homo sapiens
ugugaaauucaaccugugucuua

SEQ ID NO: 380048 - RNA, 22 nt, Homo sapiens
uguguuauauuccaaggaaaau

SEQ ID NO: 380049 - RNA, 20 nt, Homo sapiens
uguuacaaguuugcuaaaag

SEQ ID NO: 380050 - RNA, 21 nt, Homo sapiens
uguuacuaaagucacauauaa

SEQ ID NO: 380051 - RNA, 14 nt, Homo sapiens
uguuccccacugac

SEQ ID NO: 380052 - RNA, 23 nt, Homo sapiens
uguuucucggcaccagugccuca

SEQ ID NO: 380053 - RNA, 20 nt, Homo sapiens
uuaaaaaaaguauauauucu

SEQ ID NO: 380054 - RNA, 20 nt, Homo sapiens
uuaaaacugaguccaugaaa

SEQ ID NO: 380055 - RNA, 18 nt, Homo sapiens
uuaaaccucucuucuacc

SEQ ID NO: 380056 - RNA, 14 nt, Homo sapiens
uuaaaucuagacau

SEQ ID NO: 380057 - RNA, 21 nt, Homo sapiens
uuaaucucugcugaaacucag

SEQ ID NO: 380058 - RNA, 14 nt, Homo sapiens
uuaauggacuguga

SEQ ID NO: 380059 - RNA, 16 nt, Homo sapiens
uuacaaguuugcuaaa

SEQ ID NO: 380060 - RNA, 20 nt, Homo sapiens
uuacgaucccccaagugucc

SEQ ID NO: 380061 - RNA, 20 nt, Homo sapiens
uuagcagggauucucucauc

SEQ ID NO: 380062 - RNA, 20 nt, Homo sapiens
uuagccuugcucaggugcaa

SEQ ID NO: 380063 - RNA, 20 nt, Homo sapiens
uuaguuuacaaucagccaca

SEQ ID NO: 380064 - RNA, 20 nt, Homo sapiens
aauaauuuuauuccagacag

SEQ ID NO: 380065 - RNA, 22 nt, Homo sapiens
aauacaauccgagcuacaaagc

SEQ ID NO: 380066 - RNA, 14 nt, Homo sapiens
aauagcaugcaaaa

SEQ ID NO: 380067 - RNA, 14 nt, Homo sapiens
aauauaaauuguac

SEQ ID NO: 380068 - RNA, 18 nt, Homo sapiens
aauaucacuguaaugagu

SEQ ID NO: 380069 - RNA, 16 nt, Homo sapiens
aaucagccacauucua

SEQ ID NO: 380070 - RNA, 19 nt, Homo sapiens
aauccaaggaaacaugcag

SEQ ID NO: 380071 - RNA, 23 nt, Homo sapiens
aauccaggcccggugaggccaag

SEQ ID NO: 380072 - RNA, 15 nt, Homo sapiens
aaucccaagugucuc

SEQ ID NO: 380073 - RNA, 17 nt, Homo sapiens
aaugcaaauuucuauaa

SEQ ID NO: 380074 - RNA, 17 nt, Homo sapiens
aaugccacauacuugca

SEQ ID NO: 380075 - RNA, 16 nt, Homo sapiens
aaugcuggcauuugca

SEQ ID NO: 380076 - RNA, 13 nt, Homo sapiens
aauguuucacuac

SEQ ID NO: 380077 - RNA, 19 nt, Homo sapiens
aauuaucugcauuuaucuu

SEQ ID NO: 380078 - RNA, 22 nt, Homo sapiens
aauuaugaaaacucaugaucaa

SEQ ID NO: 380079 - RNA, 15 nt, Homo sapiens
aauucagugagauau

SEQ ID NO: 380080 - RNA, 18 nt, Homo sapiens
aauuuaauggacugugaa

SEQ ID NO: 380081 - RNA, 13 nt, Homo sapiens
aauuuuaauugau

SEQ ID NO: 380082 - RNA, 20 nt, Homo sapiens
aauuuuauuccagacaguca

SEQ ID NO: 380083 - RNA, 14 nt, Homo sapiens
aauuuugcauuuca

SEQ ID NO: 380084 - RNA, 21 nt, Homo sapiens
acaagucaguuucuacacugg

SEQ ID NO: 380085 - RNA, 17 nt, Homo sapiens
acaauacaugcugcuaa

SEQ ID NO: 380086 - RNA, 19 nt, Homo sapiens
acacucgccuacuaaguac

SEQ ID NO: 380087 - RNA, 14 nt, Homo sapiens
acagcugucauaua

SEQ ID NO: 380088 - RNA, 13 nt, Homo sapiens
acaggacucugca

SEQ ID NO: 380089 - RNA, 23 nt, Homo sapiens
acaguuuuuaacucuacugugua

SEQ ID NO: 380090 - RNA, 21 nt, Homo sapiens
acaugcugagguuuugaauaa

SEQ ID NO: 380091 - RNA, 20 nt, Homo sapiens
acauucugcaagcacaucug

SEQ ID NO: 380092 - RNA, 15 nt, Homo sapiens
accaaaugagcauua

SEQ ID NO: 380093 - RNA, 11 nt, Homo sapiens
accaugacaaa

SEQ ID NO: 380094 - RNA, 16 nt, Homo sapiens
acccacagcccugaaa

SEQ ID NO: 380095 - RNA, 13 nt, Homo sapiens
acccaugaagcug

SEQ ID NO: 380096 - RNA, 20 nt, Homo sapiens
accccaccugaccucugcaa

SEQ ID NO: 380097 - RNA, 13 nt, Homo sapiens
acccccagcauua

SEQ ID NO: 380098 - RNA, 20 nt, Homo sapiens
accgaguuugcuaaauugag

SEQ ID NO: 380099 - RNA, 23 nt, Homo sapiens
accuaaaaggaaaucucacccca

SEQ ID NO: 380100 - RNA, 13 nt, Homo sapiens
accuaaacuguau

SEQ ID NO: 380101 - RNA, 14 nt, Homo sapiens
accuuaaaauguaa

SEQ ID NO: 380102 - RNA, 22 nt, Homo sapiens
acgguuucuccccggacacucg

SEQ ID NO: 380103 - RNA, 17 nt, Homo sapiens
acgugauuuccagugag

SEQ ID NO: 380104 - RNA, 19 nt, Homo sapiens
acuacucucuacucuguua

SEQ ID NO: 380105 - RNA, 11 nt, Homo sapiens
acuagugcaau

SEQ ID NO: 380106 - RNA, 14 nt, Homo sapiens
acugauuaccuccu

SEQ ID NO: 380107 - RNA, 22 nt, Homo sapiens
acugauuaccuccuguguggaa

SEQ ID NO: 380108 - RNA, 20 nt, Homo sapiens
acuguaaugagucagugaag

SEQ ID NO: 380109 - RNA, 13 nt, Homo sapiens
acuucaugcccac

SEQ ID NO: 380110 - RNA, 14 nt, Homo sapiens
acuugucauaucac

SEQ ID NO: 380111 - RNA, 15 nt, Homo sapiens
acuuguuuuaugcuc

SEQ ID NO: 380112 - RNA, 17 nt, Homo sapiens
agaaaacaaguauauaa

SEQ ID NO: 380113 - RNA, 18 nt, Homo sapiens
agaaaacucccaauacaa

SEQ ID NO: 380114 - RNA, 14 nt, Homo sapiens
agaaaccaugacaa

SEQ ID NO: 380115 - RNA, 21 nt, Homo sapiens
agaaagucuaucuaaugacau

SEQ ID NO: 380116 - RNA, 19 nt, Homo sapiens
agaauaauugaacaauaaa

SEQ ID NO: 380117 - RNA, 15 nt, Homo sapiens
agacccacagcccug

SEQ ID NO: 380118 - RNA, 17 nt, Homo sapiens
agacccacagcccugaa

SEQ ID NO: 380119 - RNA, 22 nt, Homo sapiens
agacucagaggacccaccuggg

SEQ ID NO: 380120 - RNA, 17 nt, Homo sapiens
agagaccacacauuuua

SEQ ID NO: 380121 - RNA, 15 nt, Homo sapiens
agagguaacuaucaa

SEQ ID NO: 380122 - RNA, 15 nt, Homo sapiens
agagguggcccuccc

SEQ ID NO: 380123 - RNA, 20 nt, Homo sapiens
agauauauguguauacauac

SEQ ID NO: 380124 - RNA, 17 nt, Homo sapiens
agaucugugagcacguu

SEQ ID NO: 380125 - RNA, 22 nt, Homo sapiens
agcaacucagguuuuggcauua

SEQ ID NO: 380126 - RNA, 14 nt, Homo sapiens
agcaacugugcuac

SEQ ID NO: 380127 - RNA, 21 nt, Homo sapiens
agcacaccuacagagcaccug

SEQ ID NO: 380128 - RNA, 19 nt, Homo sapiens
agcacaggaggcuccguga

SEQ ID NO: 380129 - RNA, 15 nt, Homo sapiens
agcauguacuguacu

SEQ ID NO: 380130 - RNA, 15 nt, Homo sapiens
agcauuacgaucccc

SEQ ID NO: 380131 - RNA, 15 nt, Homo sapiens
agccacugcagcaca

SEQ ID NO: 380132 - RNA, 20 nt, Homo sapiens
agccacugcagcacaggagg

SEQ ID NO: 380133 - RNA, 17 nt, Homo sapiens
agcccuugguuccuccc

SEQ ID NO: 380134 - RNA, 16 nt, Homo sapiens
agccgcggggacaccg

SEQ ID NO: 380135 - RNA, 18 nt, Homo sapiens
agccuugcucaggugcaa

SEQ ID NO: 380136 - RNA, 14 nt, Homo sapiens
agccuuucacagga

SEQ ID NO: 380137 - RNA, 21 nt, Homo sapiens
agccuuucacaggacucugca

SEQ ID NO: 380138 - RNA, 15 nt, Homo sapiens
agcucugaacaaaag

SEQ ID NO: 380139 - RNA, 17 nt, Homo sapiens
agcucuucaacaugaca

SEQ ID NO: 380140 - RNA, 19 nt, Homo sapiens
agcugucccucacuguuga

SEQ ID NO: 380141 - RNA, 21 nt, Homo sapiens
aggaauagucgcgcaagcauc

SEQ ID NO: 380142 - RNA, 18 nt, Homo sapiens
aggaauauaagaaaagua

SEQ ID NO: 380143 - RNA, 12 nt, Homo sapiens
aggagacugggc

SEQ ID NO: 380144 - RNA, 21 nt, Homo sapiens
aggagacugguuaggacaaaa

SEQ ID NO: 380145 - RNA, 21 nt, Homo sapiens
aggaggcuccgugagcccuug

SEQ ID NO: 380146 - RNA, 12 nt, Homo sapiens
aggcccagugac

SEQ ID NO: 380147 - RNA, 15 nt, Homo sapiens
aggcgauccaccugu

SEQ ID NO: 380148 - RNA, 19 nt, Homo sapiens
aggcgauccaccugucuca

SEQ ID NO: 380149 - RNA, 19 nt, Homo sapiens
agggagaaguugagcaggu

SEQ ID NO: 380150 - RNA, 19 nt, Homo sapiens
agguaggggcccacuucac

SEQ ID NO: 380151 - RNA, 17 nt, Homo sapiens
aguccaugaaaauacca

SEQ ID NO: 380152 - RNA, 13 nt, Homo sapiens
aagaucuugcaga

SEQ ID NO: 380153 - RNA, 22 nt, Homo sapiens
aagaugauggaaacgcacuuac

SEQ ID NO: 380154 - RNA, 17 nt, Homo sapiens
aagcacaccuacagagc

SEQ ID NO: 380155 - RNA, 13 nt, Homo sapiens
aagcacaucugca

SEQ ID NO: 380156 - RNA, 21 nt, Homo sapiens
aagcugucccucacuguugaa

SEQ ID NO: 380157 - RNA, 20 nt, Homo sapiens
aaggaauguguccaagacac

SEQ ID NO: 380158 - RNA, 14 nt, Homo sapiens
aaggacuccaaagc

SEQ ID NO: 380159 - RNA, 15 nt, Homo sapiens
aagguuucccaguga

SEQ ID NO: 380160 - RNA, 17 nt, Homo sapiens
aagguuuuuacugugag

SEQ ID NO: 380161 - RNA, 13 nt, Homo sapiens
aaguaagucuuuu

SEQ ID NO: 380162 - RNA, 18 nt, Homo sapiens
aaguauauauucuacaca

SEQ ID NO: 380163 - RNA, 13 nt, Homo sapiens
aaguguccuggac

SEQ ID NO: 380164 - RNA, 18 nt, Homo sapiens
aauaaaguuugcuuucag

SEQ ID NO: 380165 - RNA, 13 nt, Homo sapiens
aauaaccucuggc

SEQ ID NO: 380166 - RNA, 20 nt, Homo sapiens
cucaugcaagacuucacugc

SEQ ID NO: 380167 - RNA, 15 nt, Homo sapiens
cuccaaauccaagga

SEQ ID NO: 380168 - RNA, 21 nt, Homo sapiens
cuccacgugauuuccagugag

SEQ ID NO: 380169 - RNA, 17 nt, Homo sapiens
cucgcuuuguugcccag

SEQ ID NO: 380170 - RNA, 14 nt, Homo sapiens
cucugaacaaaagc

SEQ ID NO: 380171 - RNA, 22 nt, Homo sapiens
cucugcagauagugccucugca

SEQ ID NO: 380172 - RNA, 14 nt, Homo sapiens
cucuguggguggga

SEQ ID NO: 380173 - RNA, 19 nt, Homo sapiens
cucuucaacaugacaucca

SEQ ID NO: 380174 - RNA, 17 nt, Homo sapiens
cugaaacaugugccccu

SEQ ID NO: 380175 - RNA, 14 nt, Homo sapiens
cugacagaaaugca

SEQ ID NO: 380176 - RNA, 22 nt, Homo sapiens
cugauauaacaaacuacaugua

SEQ ID NO: 380177 - RNA, 15 nt, Homo sapiens
cugauccuugcacgc

SEQ ID NO: 380178 - RNA, 16 nt, Homo sapiens
cugcagauagugccuc

SEQ ID NO: 380179 - RNA, 19 nt, Homo sapiens
cugcagcacaggaggcucc

SEQ ID NO: 380180 - RNA, 21 nt, Homo sapiens
cugcagcacuucacuaccaaa

SEQ ID NO: 380181 - RNA, 15 nt, Homo sapiens
cugcagccacauggg

SEQ ID NO: 380182 - RNA, 17 nt, Homo sapiens
cugcuuuuuuucaggga

SEQ ID NO: 380183 - RNA, 23 nt, Homo sapiens
cuggcacaacgcucuacccugca

SEQ ID NO: 380184 - RNA, 23 nt, Homo sapiens
cuggucucaaacuccugggcuca

SEQ ID NO: 380185 - RNA, 17 nt, Homo sapiens
cugguuagguagaggga

SEQ ID NO: 380186 - RNA, 16 nt, Homo sapiens
cuguagaucagggaua

SEQ ID NO: 380187 - RNA, 22 nt, Homo sapiens
cuguccuugaaugccauaguca

SEQ ID NO: 380188 - RNA, 14 nt, Homo sapiens
cugucucagccucc

SEQ ID NO: 380189 - RNA, 21 nt, Homo sapiens
cugugaaaugcuggcauuugc

SEQ ID NO: 380190 - RNA, 14 nt, Homo sapiens
cugugaauuucaaa

SEQ ID NO: 380191 - RNA, 17 nt, Homo sapiens
cugugcauuacaaaguu

SEQ ID NO: 380192 - RNA, 18 nt, Homo sapiens
cuguuucaugagcccaaa

SEQ ID NO: 380193 - RNA, 19 nt, Homo sapiens
cuguuuguauauuugcaaa

SEQ ID NO: 380194 - RNA, 19 nt, Homo sapiens
cuuaaaauucagugagaua

SEQ ID NO: 380195 - RNA, 16 nt, Homo sapiens
cuuaacauuccuaaaa

SEQ ID NO: 380196 - RNA, 23 nt, Homo sapiens
cuuaacauuccuaaaaugcuuca

SEQ ID NO: 380197 - RNA, 15 nt, Homo sapiens
cuuauagguuuccac

SEQ ID NO: 380198 - RNA, 23 nt, Homo sapiens
cuucacuaccaaaugagcauuag

SEQ ID NO: 380199 - RNA, 17 nt, Homo sapiens
cuucccaauugccacau

SEQ ID NO: 380200 - RNA, 21 nt, Homo sapiens
cuucuaccccaccugaccucu

SEQ ID NO: 380201 - RNA, 20 nt, Homo sapiens
cuucuagacacuccuugaaa

SEQ ID NO: 380202 - RNA, 18 nt, Homo sapiens
cuugacccccuugagggu

SEQ ID NO: 380203 - RNA, 20 nt, Homo sapiens
cuuguaaaggugcugcacug

SEQ ID NO: 380204 - RNA, 16 nt, Homo sapiens
cuuguuccccacugac

SEQ ID NO: 380205 - RNA, 13 nt, Homo sapiens
cuuuaaaaggcaa

SEQ ID NO: 380206 - RNA, 14 nt, Homo sapiens
cuuuauaucugucu

SEQ ID NO: 380207 - RNA, 21 nt, Homo sapiens
cuuucacaggacucugcagau

SEQ ID NO: 380208 - RNA, 20 nt, Homo sapiens
cuuuccaaaaccuaaagagg

SEQ ID NO: 380209 - RNA, 14 nt, Homo sapiens
cuuuguaucauuca

SEQ ID NO: 380210 - RNA, 13 nt, Homo sapiens
cuuuuacauucug

SEQ ID NO: 380211 - RNA, 15 nt, Homo sapiens
cuuuugcaacaagac

SEQ ID NO: 380212 - RNA, 17 nt, Homo sapiens
cuuuuuaaaaaauacca

SEQ ID NO: 380213 - RNA, 15 nt, Homo sapiens
gaaaacugugcaaug

SEQ ID NO: 380214 - RNA, 15 nt, Homo sapiens
gaaacaugugccccu

SEQ ID NO: 380215 - RNA, 19 nt, Homo sapiens
gaaaccuugaaagacauuu

SEQ ID NO: 380216 - RNA, 17 nt, Homo sapiens
gaaacgagaagugcccu

SEQ ID NO: 380217 - RNA, 18 nt, Homo sapiens
gaaacgagaagugcccuu

SEQ ID NO: 380218 - RNA, 15 nt, Homo sapiens
gaaagugaugacaua

SEQ ID NO: 380219 - RNA, 21 nt, Homo sapiens
gaagcauguacuguacuuccc

SEQ ID NO: 380220 - RNA, 19 nt, Homo sapiens
gaagggcucuuucucucug

SEQ ID NO: 380221 - RNA, 15 nt, Homo sapiens
gaaguccagaacaag

SEQ ID NO: 380222 - RNA, 19 nt, Homo sapiens
gaauaaaauugcacuuuua

SEQ ID NO: 380223 - RNA, 15 nt, Homo sapiens
gaaugacuuacuuuc

SEQ ID NO: 380224 - RNA, 20 nt, Homo sapiens
gaaugcaagugaacuuggga

SEQ ID NO: 380225 - RNA, 21 nt, Homo sapiens
gaauggagaaaguaagucuuu

SEQ ID NO: 380226 - RNA, 20 nt, Homo sapiens
gaauuauuguagacaugccc

SEQ ID NO: 380227 - RNA, 14 nt, Homo sapiens
gaccucugcaagag

SEQ ID NO: 380228 - RNA, 18 nt, Homo sapiens
gacuccuuuccaauagaa

SEQ ID NO: 380229 - RNA, 20 nt, Homo sapiens
gacucugcagauagugccuc

SEQ ID NO: 380230 - RNA, 15 nt, Homo sapiens
gacuucacugcagcc

SEQ ID NO: 380231 - RNA, 19 nt, Homo sapiens
gacuuccauuugcuuuguc

SEQ ID NO: 380232 - RNA, 14 nt, Homo sapiens
gagacccacagccc

SEQ ID NO: 380233 - RNA, 18 nt, Homo sapiens
gagcaaaaucaacaugac

SEQ ID NO: 380234 - RNA, 20 nt, Homo sapiens
gagccaccacguccagcugg

SEQ ID NO: 380235 - RNA, 19 nt, Homo sapiens
gaggaaggcccaggggugg

SEQ ID NO: 380236 - RNA, 16 nt, Homo sapiens
gaggauuucaucucuu

SEQ ID NO: 380237 - RNA, 17 nt, Homo sapiens
gagggaaggggacagau

SEQ ID NO: 380238 - RNA, 19 nt, Homo sapiens
gagugcauugugaggguua

SEQ ID NO: 380239 - RNA, 21 nt, Homo sapiens
gaguguguuugugugcaugaa

SEQ ID NO: 380240 - RNA, 19 nt, Homo sapiens
gauacaucaucgggaaaaa

SEQ ID NO: 380241 - RNA, 12 nt, Homo sapiens
gauagugccucu

SEQ ID NO: 380242 - RNA, 21 nt, Homo sapiens
gauccaccugucucagccucc

SEQ ID NO: 380243 - RNA, 14 nt, Homo sapiens
gaucccccaagugu

SEQ ID NO: 380244 - RNA, 23 nt, Homo sapiens
gauuaaaaucuggcaaaguuaua

SEQ ID NO: 380245 - RNA, 12 nt, Homo sapiens
gauuauucugau

SEQ ID NO: 380246 - RNA, 20 nt, Homo sapiens
gauuuaauuuuuuaaacugu

SEQ ID NO: 380247 - RNA, 16 nt, Homo sapiens
gcaaacccaugaagcu

SEQ ID NO: 380248 - RNA, 20 nt, Homo sapiens
gcaacucaaagaugauggaa

SEQ ID NO: 380249 - RNA, 15 nt, Homo sapiens
gcaagcacaucugca

SEQ ID NO: 380250 - RNA, 17 nt, Homo sapiens
gcaagugaacuugggag

SEQ ID NO: 380251 - RNA, 13 nt, Homo sapiens
gcaccuaccucac

SEQ ID NO: 380252 - RNA, 15 nt, Homo sapiens
gcagaaacagcauau

SEQ ID NO: 380253 - RNA, 18 nt, Homo sapiens
gcagauagugccucugca

SEQ ID NO: 380254 - RNA, 22 nt, Homo sapiens
gcagcacaggaggcuccgugag

SEQ ID NO: 380255 - RNA, 18 nt, Homo sapiens
gcagccuuucacaggacu

SEQ ID NO: 380256 - RNA, 22 nt, Homo sapiens
gcaucacugauucccucuccca

SEQ ID NO: 380257 - RNA, 12 nt, Homo sapiens
gccacuaaguac

SEQ ID NO: 380258 - RNA, 14 nt, Homo sapiens
gcccauaucuguga

SEQ ID NO: 380259 - RNA, 23 nt, Homo sapiens
gcccccaggccaggugaggucca

SEQ ID NO: 380260 - RNA, 15 nt, Homo sapiens
gccccugccaaggcc

SEQ ID NO: 380261 - RNA, 16 nt, Homo sapiens
gcccucagacauuuau

SEQ ID NO: 380262 - RNA, 13 nt, Homo sapiens
gccuagauaugaa

SEQ ID NO: 380263 - RNA, 19 nt, Homo sapiens
gccucccacccccaucucu

SEQ ID NO: 380264 - RNA, 19 nt, Homo sapiens
gcgaacauaaaugucugua

SEQ ID NO: 380265 - RNA, 16 nt, Homo sapiens
gcgcaggcccagugac

SEQ ID NO: 380266 - RNA, 14 nt, Homo sapiens
gcggggugcagaag

SEQ ID NO: 380267 - RNA, 12 nt, Homo sapiens
uuauugcauaau

SEQ ID NO: 380268 - RNA, 18 nt, Homo sapiens
uuauuugcaggucuuuaa

SEQ ID NO: 380269 - RNA, 16 nt, Homo sapiens
uucacauugcacucau

SEQ ID NO: 380270 - RNA, 22 nt, Homo sapiens
uuccauaguuaaagaagacauu

SEQ ID NO: 380271 - RNA, 21 nt, Homo sapiens
uuccauuuuaaaaugcaucau

SEQ ID NO: 380272 - RNA, 16 nt, Homo sapiens
uuccuaaugugaucau

SEQ ID NO: 380273 - RNA, 19 nt, Homo sapiens
uucuaaagcucugaacaaa

SEQ ID NO: 380274 - RNA, 16 nt, Homo sapiens
uucuaugugucaucaa

SEQ ID NO: 380275 - RNA, 17 nt, Homo sapiens
uucuguccaguuuccaa

SEQ ID NO: 380276 - RNA, 15 nt, Homo sapiens
uucuuaaaauucagu

SEQ ID NO: 380277 - RNA, 15 nt, Homo sapiens
uucuuacuaaucuga

SEQ ID NO: 380278 - RNA, 18 nt, Homo sapiens
uugaaaaauauugcuaaa

SEQ ID NO: 380279 - RNA, 15 nt, Homo sapiens
uugaaaacugugcaa

SEQ ID NO: 380280 - RNA, 23 nt, Homo sapiens
uugauuauucugauuccacuuuu

SEQ ID NO: 380281 - RNA, 20 nt, Homo sapiens
uugcaacaagacaaagcaaa

SEQ ID NO: 380282 - RNA, 20 nt, Homo sapiens
uugcccaggcuggucucaaa

SEQ ID NO: 380283 - RNA, 21 nt, Homo sapiens
uuggcuucuuaaaaacugugu

SEQ ID NO: 380284 - RNA, 20 nt, Homo sapiens
uugggucccuugcugcaaac

SEQ ID NO: 380285 - RNA, 14 nt, Homo sapiens
uuguacaaguauua

SEQ ID NO: 380286 - RNA, 22 nt, Homo sapiens
uuguagagauggggucucacag

SEQ ID NO: 380287 - RNA, 21 nt, Homo sapiens
uugucaauagcaugcaaaaaa

SEQ ID NO: 380288 - RNA, 19 nt, Homo sapiens
uugucagaguucugcucua

SEQ ID NO: 380289 - RNA, 15 nt, Homo sapiens
uugugagccaccacg

SEQ ID NO: 380290 - RNA, 12 nt, Homo sapiens
uuguuucuuaau

SEQ ID NO: 380291 - RNA, 21 nt, Homo sapiens
uuguuuuuaagcuucuagaca

SEQ ID NO: 380292 - RNA, 16 nt, Homo sapiens
uuuaaaaaaacugaag

SEQ ID NO: 380293 - RNA, 14 nt, Homo sapiens
uuuaaaaaauacca

SEQ ID NO: 380294 - RNA, 22 nt, Homo sapiens
uuuaagaaaacaaguauauaau

SEQ ID NO: 380295 - RNA, 19 nt, Homo sapiens
uuuaagguuuuuacuguga

SEQ ID NO: 380296 - RNA, 20 nt, Homo sapiens
uuuaauuuuuuaaacuguag

SEQ ID NO: 380297 - RNA, 23 nt, Homo sapiens
uuuacaauaaaacuuugcugcca

SEQ ID NO: 380298 - RNA, 14 nt, Homo sapiens
uuuacauucugcaa

SEQ ID NO: 380299 - RNA, 23 nt, Homo sapiens
uuuauaaaagaauaaaauugcac

SEQ ID NO: 380300 - RNA, 23 nt, Homo sapiens
uuuauaauaaaaagcuucaggga

SEQ ID NO: 380301 - RNA, 12 nt, Homo sapiens
uuuauuuccaca

SEQ ID NO: 380302 - RNA, 12 nt, Homo sapiens
uuucacuacucu

SEQ ID NO: 380303 - RNA, 23 nt, Homo sapiens
uuucuaaagcucugaacaaaagc

SEQ ID NO: 380304 - RNA, 17 nt, Homo sapiens
uuucuaccaucucacgg

SEQ ID NO: 380305 - RNA, 17 nt, Homo sapiens
uuuggguuuugggucuu

SEQ ID NO: 380306 - RNA, 18 nt, Homo sapiens
uuuuauuuccacauaaag

SEQ ID NO: 380307 - RNA, 14 nt, Homo sapiens
uuuuccuaugcucu

SEQ ID NO: 380308 - RNA, 11 nt, Homo sapiens
uuuuuccaaau

SEQ ID NO: 380309 - RNA, 11 nt, Homo sapiens
aaaaacugaag

SEQ ID NO: 380310 - RNA, 11 nt, Homo sapiens
aaaaauaccau

SEQ ID NO: 380311 - RNA, 15 nt, Homo sapiens
aaaaauauugcuaaa

SEQ ID NO: 380312 - RNA, 18 nt, Homo sapiens
aaaaauuuugcauuucau

SEQ ID NO: 380313 - RNA, 22 nt, Homo sapiens
aaaagcuuuuguuuugcuuaca

SEQ ID NO: 380314 - RNA, 15 nt, Homo sapiens
aaaaugcuucacugu

SEQ ID NO: 380315 - RNA, 13 nt, Homo sapiens
aaaaugcuuuguu

SEQ ID NO: 380316 - RNA, 23 nt, Homo sapiens
aaacaaguauauaauuuacuuug

SEQ ID NO: 380317 - RNA, 12 nt, Homo sapiens
aaaccaugacaa

SEQ ID NO: 380318 - RNA, 23 nt, Homo sapiens
aaacuuucuccauuuaagacaca

SEQ ID NO: 380319 - RNA, 19 nt, Homo sapiens
aaagacauuuguucuccca

SEQ ID NO: 380320 - RNA, 18 nt, Homo sapiens
aaagagacaaacuguaaa

SEQ ID NO: 380321 - RNA, 19 nt, Homo sapiens
aaagaggaaaagugcaaug

SEQ ID NO: 380322 - RNA, 19 nt, Homo sapiens
aaagauaugcuaagcagua

SEQ ID NO: 380323 - RNA, 15 nt, Homo sapiens
aaagaugauggaaac

SEQ ID NO: 380324 - RNA, 17 nt, Homo sapiens
aaagcucugaacaaaag

SEQ ID NO: 380325 - RNA, 22 nt, Homo sapiens
aaaguaugccuuccuguuuaaa

SEQ ID NO: 380326 - RNA, 12 nt, Homo sapiens
aaauaaagacaa

SEQ ID NO: 380327 - RNA, 17 nt, Homo sapiens
aaaugaaguauuucuca

SEQ ID NO: 380328 - RNA, 15 nt, Homo sapiens
aaauuuugcauuuca

SEQ ID NO: 380329 - RNA, 19 nt, Homo sapiens
aacaaaagcuuuucuuucc

SEQ ID NO: 380330 - RNA, 17 nt, Homo sapiens
aacaagacaaagcaaag

SEQ ID NO: 380331 - RNA, 18 nt, Homo sapiens
aacaugacauccagagau

SEQ ID NO: 380332 - RNA, 22 nt, Homo sapiens
aacauuguuuuuguugucuuua

SEQ ID NO: 380333 - RNA, 16 nt, Homo sapiens
aaccauguugguugca

SEQ ID NO: 380334 - RNA, 13 nt, Homo sapiens
aaccgacuuuucu

SEQ ID NO: 380335 - RNA, 18 nt, Homo sapiens
aaccucucuucuaccuua

SEQ ID NO: 380336 - RNA, 16 nt, Homo sapiens
aacgucuuuuuauauc

SEQ ID NO: 380337 - RNA, 24 nt, Homo sapiens
aacucaugaucaagauauaugugu

SEQ ID NO: 380338 - RNA, 15 nt, Homo sapiens
aagaaaauaucacug

SEQ ID NO: 380339 - RNA, 19 nt, Homo sapiens
aagaauaauugaacaauaa

SEQ ID NO: 380340 - RNA, 16 nt, Homo sapiens
aagaauuuaauggacu

SEQ ID NO: 380341 - RNA, 13 nt, Homo sapiens
aagacaaagcaaa

SEQ ID NO: 380342 - RNA, 13 nt, Homo sapiens
aagacacauugac

SEQ ID NO: 380343 - RNA, 18 nt, Homo sapiens
aagauauauguguauaca

SEQ ID NO: 380344 - RNA, 15 nt, Homo sapiens
aagcauguacuguac

SEQ ID NO: 380345 - RNA, 22 nt, Homo sapiens
aagcgcuguugcccgcccucca

SEQ ID NO: 380346 - RNA, 17 nt, Homo sapiens
aagcucuauuaagauuu

SEQ ID NO: 380347 - RNA, 14 nt, Homo sapiens
aaggagaaaaugca

SEQ ID NO: 380348 - RNA, 20 nt, Homo sapiens
aaggaucaccccagccccca

SEQ ID NO: 380349 - RNA, 18 nt, Homo sapiens
aaggcccauaucugugaa

SEQ ID NO: 380350 - RNA, 17 nt, Homo sapiens
aaguauauauucuacac

SEQ ID NO: 380351 - RNA, 14 nt, Homo sapiens
aaguaugccuuccu

SEQ ID NO: 380352 - RNA, 14 nt, Homo sapiens
aagugucucuugac

SEQ ID NO: 380353 - RNA, 18 nt, Homo sapiens
aaguucuuaguguugguu

SEQ ID NO: 380354 - RNA, 11 nt, Homo sapiens
aauaaaaagcu

SEQ ID NO: 380355 - RNA, 16 nt, Homo sapiens
aauaaaaagugaacuu

SEQ ID NO: 380356 - RNA, 20 nt, Homo sapiens
aauaacgucuuuuuauaucu

SEQ ID NO: 380357 - RNA, 19 nt, Homo sapiens
aauacaugcugcuaauuca

SEQ ID NO: 380358 - RNA, 20 nt, Homo sapiens
aauacaugcugcuaauucaa

SEQ ID NO: 380359 - RNA, 20 nt, Homo sapiens
aauaccauaggaagacauaa

SEQ ID NO: 380360 - RNA, 17 nt, Homo sapiens
aauagccuagauaugaa

SEQ ID NO: 380361 - RNA, 19 nt, Homo sapiens
aauauaaaagaucuugcag

SEQ ID NO: 380362 - RNA, 15 nt, Homo sapiens
aauauauagcuggca

SEQ ID NO: 380363 - RNA, 14 nt, Homo sapiens
augcaagacuucac

SEQ ID NO: 380364 - RNA, 17 nt, Homo sapiens
augccaccacacguguu

SEQ ID NO: 380365 - RNA, 22 nt, Homo sapiens
augccucuggaggccucuggcc

SEQ ID NO: 380366 - RNA, 23 nt, Homo sapiens
augccucuggaggccucuggccc

SEQ ID NO: 380367 - RNA, 15 nt, Homo sapiens
auggcccagccacug

SEQ ID NO: 380368 - RNA, 17 nt, Homo sapiens
auggcccagccacugca

SEQ ID NO: 380369 - RNA, 20 nt, Homo sapiens
auguaaugaucauaagucua

SEQ ID NO: 380370 - RNA, 19 nt, Homo sapiens
auguauuuuccuaauguga

SEQ ID NO: 380371 - RNA, 21 nt, Homo sapiens
auguauuuuccuaaugugauc

SEQ ID NO: 380372 - RNA, 16 nt, Homo sapiens
auguguccaagacaca

SEQ ID NO: 380373 - RNA, 23 nt, Homo sapiens
auguuuacuaaguggacuggugu

SEQ ID NO: 380374 - RNA, 12 nt, Homo sapiens
auuaaaacugag

SEQ ID NO: 380375 - RNA, 19 nt, Homo sapiens
auuaauaccuaaacuguau

SEQ ID NO: 380376 - RNA, 18 nt, Homo sapiens
auuaggaacaguaaaauc

SEQ ID NO: 380377 - RNA, 15 nt, Homo sapiens
auuaguugcuuuguu

SEQ ID NO: 380378 - RNA, 22 nt, Homo sapiens
auuauaaucucauuucaauuua

SEQ ID NO: 380379 - RNA, 19 nt, Homo sapiens
auucaaccugugucuuaua

SEQ ID NO: 380380 - RNA, 21 nt, Homo sapiens
auucucucaucuaacugauga

SEQ ID NO: 380381 - RNA, 16 nt, Homo sapiens
auucuuaaaaugcaau

SEQ ID NO: 380382 - RNA, 17 nt, Homo sapiens
auucuuaaaaugcaaua

SEQ ID NO: 380383 - RNA, 16 nt, Homo sapiens
auucuuuuaaugccac

SEQ ID NO: 380384 - RNA, 20 nt, Homo sapiens
auugagggcuaaaucccaag

SEQ ID NO: 380385 - RNA, 14 nt, Homo sapiens
auugauuauucuga

SEQ ID NO: 380386 - RNA, 19 nt, Homo sapiens
auugcacuuuuaaaccucu

SEQ ID NO: 380387 - RNA, 15 nt, Homo sapiens
auugugagccaccac

SEQ ID NO: 380388 - RNA, 19 nt, Homo sapiens
auuuaacuaugaacugaag

SEQ ID NO: 380389 - RNA, 15 nt, Homo sapiens
auuuacauguuuaua

SEQ ID NO: 380390 - RNA, 23 nt, Homo sapiens
auuuauauaaaauguuuaaucuc

SEQ ID NO: 380391 - RNA, 16 nt, Homo sapiens
auuucuguauacugua

SEQ ID NO: 380392 - RNA, 20 nt, Homo sapiens
auuuguauaaugguguuacu

SEQ ID NO: 380393 - RNA, 16 nt, Homo sapiens
auuuuauuccagacag

SEQ ID NO: 380394 - RNA, 19 nt, Homo sapiens
auuuuguaaaauauuaugu

SEQ ID NO: 380395 - RNA, 21 nt, Homo sapiens
auuuugugaaagaaggagcaa

SEQ ID NO: 380396 - RNA, 16 nt, Homo sapiens
auuuuuuauuuccaca

SEQ ID NO: 380397 - RNA, 19 nt, Homo sapiens
caaaaauguaaugaucaua

SEQ ID NO: 380398 - RNA, 18 nt, Homo sapiens
caaaagaaaccaugacaa

SEQ ID NO: 380399 - RNA, 14 nt, Homo sapiens
caaacuacauguaa

SEQ ID NO: 380400 - RNA, 12 nt, Homo sapiens
caaacuguaaaa

SEQ ID NO: 380401 - RNA, 19 nt, Homo sapiens
caaacuguaaaaaaugugu

SEQ ID NO: 380402 - RNA, 18 nt, Homo sapiens
caaagaacuauguaaaca

SEQ ID NO: 380403 - RNA, 21 nt, Homo sapiens
caaauuauaaucucauuucaa

SEQ ID NO: 380404 - RNA, 23 nt, Homo sapiens
caacugugcuacacuugcaccug

SEQ ID NO: 380405 - RNA, 14 nt, Homo sapiens
caaggaaacaugca

SEQ ID NO: 380406 - RNA, 16 nt, Homo sapiens
caagguuucccaguga

SEQ ID NO: 380407 - RNA, 17 nt, Homo sapiens
caagguuucccagugag

SEQ ID NO: 380408 - RNA, 18 nt, Homo sapiens
caagugcaguagugcagu

SEQ ID NO: 380409 - RNA, 21 nt, Homo sapiens
caaguuuuuuaauuaagcaga

SEQ ID NO: 380410 - RNA, 18 nt, Homo sapiens
caauaaaauuauuugcag

SEQ ID NO: 380411 - RNA, 15 nt, Homo sapiens
caauacaugcugcua

SEQ ID NO: 380412 - RNA, 18 nt, Homo sapiens
caauacaugcugcuaauu

SEQ ID NO: 380413 - RNA, 14 nt, Homo sapiens
caauagcaugcaaa

SEQ ID NO: 380414 - RNA, 20 nt, Homo sapiens
caauaguguccuaugcaaua

SEQ ID NO: 380415 - RNA, 17 nt, Homo sapiens
caaucgagacugcaaug

SEQ ID NO: 380416 - RNA, 22 nt, Homo sapiens
caaugccacauacuugcagcuc

SEQ ID NO: 380417 - RNA, 20 nt, Homo sapiens
caaugucagaaacucgauga

SEQ ID NO: 380418 - RNA, 23 nt, Homo sapiens
caauuuuaauugauuauucugau

SEQ ID NO: 380419 - RNA, 21 nt, Homo sapiens
cacacccccaagccacaggga

SEQ ID NO: 380420 - RNA, 14 nt, Homo sapiens
cacagagugcauug

SEQ ID NO: 380421 - RNA, 17 nt, Homo sapiens
cacaggaggcuccguga

SEQ ID NO: 380422 - RNA, 16 nt, Homo sapiens
cacagguucaugccac

SEQ ID NO: 380423 - RNA, 16 nt, Homo sapiens
cacauacuugcagcuc

SEQ ID NO: 380424 - RNA, 23 nt, Homo sapiens
cacauugacuccuuuccaauaga

SEQ ID NO: 380425 - RNA, 21 nt, Homo sapiens
caccagugccucagugcugca

SEQ ID NO: 380426 - RNA, 19 nt, Homo sapiens
cacccagcagaaauacaau

SEQ ID NO: 380427 - RNA, 15 nt, Homo sapiens
caccccacagacucc

SEQ ID NO: 380428 - RNA, 17 nt, Homo sapiens
caccugaccucugcaag

SEQ ID NO: 380429 - RNA, 23 nt, Homo sapiens
caccugccccgucccccuagaga

SEQ ID NO: 380430 - RNA, 22 nt, Homo sapiens
cacugauucccucucccaccca

SEQ ID NO: 380431 - RNA, 22 nt, Homo sapiens
cagagaaagaaaaggcaaaaga

SEQ ID NO: 380432 - RNA, 18 nt, Homo sapiens
cagauagugccucugcaa

SEQ ID NO: 380433 - RNA, 14 nt, Homo sapiens
cagauuacuagaaa

SEQ ID NO: 380434 - RNA, 12 nt, Homo sapiens
cagccacugcag

SEQ ID NO: 380435 - RNA, 17 nt, Homo sapiens
cagccccaauccagaga

SEQ ID NO: 380436 - RNA, 19 nt, Homo sapiens
cagcccccaggccagguga

SEQ ID NO: 380437 - RNA, 16 nt, Homo sapiens
cagccccuccacguga

SEQ ID NO: 380438 - RNA, 20 nt, Homo sapiens
caggacuuccauuugcuuug

SEQ ID NO: 380439 - RNA, 23 nt, Homo sapiens
caggauauggcuuaggaaugacu

SEQ ID NO: 380440 - RNA, 21 nt, Homo sapiens
caggcugguauuuaucugcaa

SEQ ID NO: 380441 - RNA, 15 nt, Homo sapiens
caggucuuuaaauca

SEQ ID NO: 380442 - RNA, 16 nt, Homo sapiens
cauaaagguauuuaga

SEQ ID NO: 380443 - RNA, 23 nt, Homo sapiens
caucauuaauaccuaaacuguau

SEQ ID NO: 380444 - RNA, 12 nt, Homo sapiens
caugaaggacac

SEQ ID NO: 380445 - RNA, 19 nt, Homo sapiens
caugaaggacacucugcag

SEQ ID NO: 380446 - RNA, 16 nt, Homo sapiens
caugaucaagauauau

SEQ ID NO: 380447 - RNA, 14 nt, Homo sapiens
caugcaagacuuca

SEQ ID NO: 380448 - RNA, 23 nt, Homo sapiens
caugcgaacauaaaugucuguau

SEQ ID NO: 380449 - RNA, 22 nt, Homo sapiens
caugguucauuuucugaugccc

SEQ ID NO: 380450 - RNA, 18 nt, Homo sapiens
caugucauuaaucaauuu

SEQ ID NO: 380451 - RNA, 18 nt, Homo sapiens
cauuaauaccuaaacugu

SEQ ID NO: 380452 - RNA, 18 nt, Homo sapiens
cauucugcaagcacaucu

SEQ ID NO: 380453 - RNA, 17 nt, Homo sapiens
cauucuuguuggcuuuu

SEQ ID NO: 380454 - RNA, 15 nt, Homo sapiens
cauugugaggguuaa

SEQ ID NO: 380455 - RNA, 21 nt, Homo sapiens
gggcaacaauacaugcugcua

SEQ ID NO: 380456 - RNA, 16 nt, Homo sapiens
gggcgcaggcccagug

SEQ ID NO: 380457 - RNA, 14 nt, Homo sapiens
gggcuucaggucuc

SEQ ID NO: 380458 - RNA, 20 nt, Homo sapiens
gggucucacaguguugccca

SEQ ID NO: 380459 - RNA, 16 nt, Homo sapiens
gggucuuugaacccuu

SEQ ID NO: 380460 - RNA, 21 nt, Homo sapiens
ggguuaguuuacaaucagcca

SEQ ID NO: 380461 - RNA, 21 nt, Homo sapiens
gguaaaaaggagaauuuuucc

SEQ ID NO: 380462 - RNA, 13 nt, Homo sapiens
uauguuauugcau

SEQ ID NO: 380463 - RNA, 23 nt, Homo sapiens
uauuaagauuuccaagugccaau

SEQ ID NO: 380464 - RNA, 15 nt, Homo sapiens
uauuaccuaaugaaa

SEQ ID NO: 380465 - RNA, 20 nt, Homo sapiens
uauuagcaacugugcuacac

SEQ ID NO: 380466 - RNA, 15 nt, Homo sapiens
uauuauuugauaucu

SEQ ID NO: 380467 - RNA, 15 nt, Homo sapiens
uauucuuacuaaucu

SEQ ID NO: 380468 - RNA, 19 nt, Homo sapiens
ucaacaucuuuuacauucu

SEQ ID NO: 380469 - RNA, 20 nt, Homo sapiens
ucaacaucuuuuacauucug

SEQ ID NO: 380470 - RNA, 21 nt, Homo sapiens
ucaacaugacauccagagaug

SEQ ID NO: 380471 - RNA, 15 nt, Homo sapiens
cuguuucacauugca

SEQ ID NO: 380472 - RNA, 12 nt, Homo sapiens
cuguuucaugag

SEQ ID NO: 380473 - RNA, 12 nt, Homo sapiens
cuuaaaaacugu

SEQ ID NO: 380474 - RNA, 13 nt, Homo sapiens
cuuaaaaacugug

SEQ ID NO: 380475 - RNA, 15 nt, Homo sapiens
cuuaaaaugcaauau

SEQ ID NO: 380476 - RNA, 19 nt, Homo sapiens
cuuaacauuucauuguaca

SEQ ID NO: 380477 - RNA, 21 nt, Homo sapiens
cuuauagguuuccacugccaa

SEQ ID NO: 380478 - RNA, 19 nt, Homo sapiens
cuuauuuguauaauggugu

SEQ ID NO: 380479 - RNA, 14 nt, Homo sapiens
cuucaacaugacau

SEQ ID NO: 380480 - RNA, 18 nt, Homo sapiens
cuucaacaugacauccag

SEQ ID NO: 380481 - RNA, 22 nt, Homo sapiens
cuucaaggcccauaucugugaa

SEQ ID NO: 380482 - RNA, 15 nt, Homo sapiens
cuucacuaccaaaug

SEQ ID NO: 380483 - RNA, 11 nt, Homo sapiens
cuuccauuugc

SEQ ID NO: 380484 - RNA, 19 nt, Homo sapiens
cuuccuuagccuugcucag

SEQ ID NO: 380485 - RNA, 13 nt, Homo sapiens
cuucuuguucccc

SEQ ID NO: 380486 - RNA, 21 nt, Homo sapiens
cuugaaugccauagucaaaga

SEQ ID NO: 380487 - RNA, 16 nt, Homo sapiens
cuugacuggcucaaga

SEQ ID NO: 380488 - RNA, 16 nt, Homo sapiens
cuugcuugcaauaggu

SEQ ID NO: 380489 - RNA, 22 nt, Homo sapiens
cuuggcuuacugcagccuuugc

SEQ ID NO: 380490 - RNA, 23 nt, Homo sapiens
cuuguuccccacugacagccucc

SEQ ID NO: 380491 - RNA, 16 nt, Homo sapiens
cuuguuuuaugcucag

SEQ ID NO: 380492 - RNA, 15 nt, Homo sapiens
cuuucuaccaucuca

SEQ ID NO: 380493 - RNA, 19 nt, Homo sapiens
cuuuguaucauucaucuuc

SEQ ID NO: 380494 - RNA, 13 nt, Homo sapiens
cuuuuucuuugag

SEQ ID NO: 380495 - RNA, 17 nt, Homo sapiens
gaaaaaucaguguauua

SEQ ID NO: 380496 - RNA, 18 nt, Homo sapiens
gaaacaccgagucucugu

SEQ ID NO: 380497 - RNA, 15 nt, Homo sapiens
gaaagaaaaggcaaa

SEQ ID NO: 380498 - RNA, 21 nt, Homo sapiens
gaaagagaaugaacuguggaa

SEQ ID NO: 380499 - RNA, 21 nt, Homo sapiens
gaacauuccucugcagcacuu

SEQ ID NO: 380500 - RNA, 15 nt, Homo sapiens
gaacauuuacuacag

SEQ ID NO: 380501 - RNA, 21 nt, Homo sapiens
gaacuguuuggucgagucuuu

SEQ ID NO: 380502 - RNA, 22 nt, Homo sapiens
gaagaauuuaauggacugugaa

SEQ ID NO: 380503 - RNA, 11 nt, Homo sapiens
gaagcauguac

SEQ ID NO: 380504 - RNA, 13 nt, Homo sapiens
gaagcuuauagag

SEQ ID NO: 380505 - RNA, 18 nt, Homo sapiens
gaaggagcaagagaacau

SEQ ID NO: 380506 - RNA, 21 nt, Homo sapiens
gaauaaaauuaggaacaguaa

SEQ ID NO: 380507 - RNA, 15 nt, Homo sapiens
gaauaaaauugcacu

SEQ ID NO: 380508 - RNA, 17 nt, Homo sapiens
gaauaaaauugcacuuu

SEQ ID NO: 380509 - RNA, 23 nt, Homo sapiens
gaaucaagguaagcucaggauau

SEQ ID NO: 380510 - RNA, 15 nt, Homo sapiens
gaaugaacuguggaa

SEQ ID NO: 380511 - RNA, 19 nt, Homo sapiens
gaauuuucucuaacuucaa

SEQ ID NO: 380512 - RNA, 20 nt, Homo sapiens
gaauuuucucuaacuucaag

SEQ ID NO: 380513 - RNA, 23 nt, Homo sapiens
gacuccucugggccuggggugca

SEQ ID NO: 380514 - RNA, 12 nt, Homo sapiens
gagaagugcccu

SEQ ID NO: 380515 - RNA, 14 nt, Homo sapiens
gagaagugcccuua

SEQ ID NO: 380516 - RNA, 17 nt, Homo sapiens
gagacugguuaggacaa

SEQ ID NO: 380517 - RNA, 21 nt, Homo sapiens
gagcacguuggcgaggaaaaa

SEQ ID NO: 380518 - RNA, 20 nt, Homo sapiens
gagcucuggcuuugcaaggg

SEQ ID NO: 380519 - RNA, 14 nt, Homo sapiens
gaggagacugggca

SEQ ID NO: 380520 - RNA, 19 nt, Homo sapiens
gaguccaugaaaauaccau

SEQ ID NO: 380521 - RNA, 14 nt, Homo sapiens
gagucucuguauaa

SEQ ID NO: 380522 - RNA, 17 nt, Homo sapiens
gaguugucaagucucug

SEQ ID NO: 380523 - RNA, 21 nt, Homo sapiens
gauauauguguauacauacau

SEQ ID NO: 380524 - RNA, 17 nt, Homo sapiens
gaucuauguuucaucuu

SEQ ID NO: 380525 - RNA, 13 nt, Homo sapiens
gauuauauaucau

SEQ ID NO: 380526 - RNA, 22 nt, Homo sapiens
gauucucucaucuaacugauga

SEQ ID NO: 380527 - RNA, 16 nt, Homo sapiens
gcaauugagggcuaaa

SEQ ID NO: 380528 - RNA, 14 nt, Homo sapiens
gcaccagugccuca

SEQ ID NO: 380529 - RNA, 22 nt, Homo sapiens
gcacccaggacuuccauuugcu

SEQ ID NO: 380530 - RNA, 12 nt, Homo sapiens
gcaccuaccuca

SEQ ID NO: 380531 - RNA, 21 nt, Homo sapiens
gcacuugccugcugcuuggag

SEQ ID NO: 380532 - RNA, 23 nt, Homo sapiens
gcagaucuuuuugugaaauucaa

SEQ ID NO: 380533 - RNA, 16 nt, Homo sapiens
gcagccuuucacagga

SEQ ID NO: 380534 - RNA, 23 nt, Homo sapiens
gcaucauuaauaccuaaacugua

SEQ ID NO: 380535 - RNA, 13 nt, Homo sapiens
gcauguacuguac

SEQ ID NO: 380536 - RNA, 18 nt, Homo sapiens
gccaauauuucugauaua

SEQ ID NO: 380537 - RNA, 23 nt, Homo sapiens
gccccacccaccccacagacucc

SEQ ID NO: 380538 - RNA, 15 nt, Homo sapiens
gcccucagacauuua

SEQ ID NO: 380539 - RNA, 13 nt, Homo sapiens
gccgaugcccaau

SEQ ID NO: 380540 - RNA, 16 nt, Homo sapiens
gcgccucuccacuguu

SEQ ID NO: 380541 - RNA, 15 nt, Homo sapiens
gcuacacuugcaccu

SEQ ID NO: 380542 - RNA, 13 nt, Homo sapiens
gcuccaaauccaa

SEQ ID NO: 380543 - RNA, 13 nt, Homo sapiens
gcugagguuuuga

SEQ ID NO: 380544 - RNA, 23 nt, Homo sapiens
gcuuaaggagaggagaaacugag

SEQ ID NO: 380545 - RNA, 22 nt, Homo sapiens
gcuucuuaaaaacuguguauca

SEQ ID NO: 380546 - RNA, 19 nt, Homo sapiens
gcuuugcggaauugcauac

SEQ ID NO: 380547 - RNA, 14 nt, Homo sapiens
ggaaacgcacuuac

SEQ ID NO: 380548 - RNA, 16 nt, Homo sapiens
ggaagcauguacugua

SEQ ID NO: 380549 - RNA, 18 nt, Homo sapiens
ggacccuggccuaaagaa

SEQ ID NO: 380550 - RNA, 16 nt, Homo sapiens
ggagucucaugcaaga

SEQ ID NO: 380551 - RNA, 18 nt, Homo sapiens
ggagucucaugcaagacu

SEQ ID NO: 380552 - RNA, 19 nt, Homo sapiens
ggauggggagucucaugca

SEQ ID NO: 380553 - RNA, 14 nt, Homo sapiens
ggcaccgggcucca

SEQ ID NO: 380554 - RNA, 16 nt, Homo sapiens
ggcagcacagcccagg

SEQ ID NO: 380555 - RNA, 20 nt, Homo sapiens
ggcauuugcaccuaccucac

SEQ ID NO: 380556 - RNA, 19 nt, Homo sapiens
ggccaagguuucccaguga

SEQ ID NO: 380557 - RNA, 14 nt, Homo sapiens
ggccccaacuacac

SEQ ID NO: 380558 - RNA, 20 nt, Homo sapiens
ggccgcugccccugaguucu

SEQ ID NO: 380559 - RNA, 17 nt, Homo sapiens
ggcuaaaucccaagugu

SEQ ID NO: 380560 - RNA, 16 nt, Homo sapiens
gggauagcgcuguuga

SEQ ID NO: 380561 - RNA, 18 nt, Homo sapiens
gggccucgacgucccuug

SEQ ID NO: 380562 - RNA, 19 nt, Homo sapiens
gggucucacaguguugccc

SEQ ID NO: 380563 - RNA, 17 nt, Homo sapiens
aucacuguaaugaguca

SEQ ID NO: 380564 - RNA, 15 nt, Homo sapiens
auccccucucugugg

SEQ ID NO: 380565 - RNA, 14 nt, Homo sapiens
auccuauaucuguu

SEQ ID NO: 380566 - RNA, 12 nt, Homo sapiens
aucuauaucucu

SEQ ID NO: 380567 - RNA, 23 nt, Homo sapiens
aucucccuagccugcuuuugucc

SEQ ID NO: 380568 - RNA, 22 nt, Homo sapiens
aucucucccuccccugccauuu

SEQ ID NO: 380569 - RNA, 19 nt, Homo sapiens
aucugucuuuuauuuaaca

SEQ ID NO: 380570 - RNA, 15 nt, Homo sapiens
augagggaagaauaa

SEQ ID NO: 380571 - RNA, 16 nt, Homo sapiens
augauaacugcaauuu

SEQ ID NO: 380572 - RNA, 19 nt, Homo sapiens
augaucaaaaauaaugcau

SEQ ID NO: 380573 - RNA, 23 nt, Homo sapiens
augauuuaauuuuuuaaacugua

SEQ ID NO: 380574 - RNA, 18 nt, Homo sapiens
auaaaagaucuugcagaa

SEQ ID NO: 380575 - RNA, 15 nt, Homo sapiens
auaaaauuauuugca

SEQ ID NO: 380576 - RNA, 20 nt, Homo sapiens
auaaaugaaguauuucucac

SEQ ID NO: 380577 - RNA, 17 nt, Homo sapiens
auaacguucucaguccu

SEQ ID NO: 380578 - RNA, 22 nt, Homo sapiens
auaauuuuccuuuuucauguaa

SEQ ID NO: 380579 - RNA, 23 nt, Homo sapiens
auacauguaucugguuugucagg

SEQ ID NO: 380580 - RNA, 18 nt, Homo sapiens
auacauuuuauugucaga

SEQ ID NO: 380581 - RNA, 17 nt, Homo sapiens
auacuaauguuauuucu

SEQ ID NO: 380582 - RNA, 12 nt, Homo sapiens
auagguuuccac

SEQ ID NO: 380583 - RNA, 14 nt, Homo sapiens
auauauccauacau

SEQ ID NO: 380584 - RNA, 19 nt, Homo sapiens
auauauguguauacauaca

SEQ ID NO: 380585 - RNA, 14 nt, Homo sapiens
auaucgaucucuua

SEQ ID NO: 380586 - RNA, 12 nt, Homo sapiens
auauugcuaaaa

SEQ ID NO: 380587 - RNA, 21 nt, Homo sapiens
aucaaggcaggagaugcagca

SEQ ID NO: 380588 - RNA, 18 nt, Homo sapiens
aucauuaaaauauauguu

SEQ ID NO: 380589 - RNA, 14 nt, Homo sapiens
aucauuaagaauaa

SEQ ID NO: 380590 - RNA, 12 nt, Homo sapiens
aucauucaucuu

SEQ ID NO: 380591 - RNA, 17 nt, Homo sapiens
auccaaggaaacaugca

SEQ ID NO: 380592 - RNA, 22 nt, Homo sapiens
auccaucacuagccaugauaac

SEQ ID NO: 380593 - RNA, 18 nt, Homo sapiens
aucccaagugucucuuga

SEQ ID NO: 380594 - RNA, 13 nt, Homo sapiens
auccuccucagcc

SEQ ID NO: 380595 - RNA, 18 nt, Homo sapiens
aucuaaauguauucugca

SEQ ID NO: 380596 - RNA, 23 nt, Homo sapiens
aucuaaugacaugccuauaugag

SEQ ID NO: 380597 - RNA, 15 nt, Homo sapiens
aucuacaguaaugaa

SEQ ID NO: 380598 - RNA, 16 nt, Homo sapiens
aucucuuauuuuacaa

SEQ ID NO: 380599 - RNA, 20 nt, Homo sapiens
augaagaaucacgauuucau

SEQ ID NO: 380600 - RNA, 14 nt, Homo sapiens
augaaggacacucu

SEQ ID NO: 380601 - RNA, 11 nt, Homo sapiens
augacauauuu

SEQ ID NO: 380602 - RNA, 11 nt, Homo sapiens
augacuggugg

SEQ ID NO: 380603 - RNA, 13 nt, Homo sapiens
augacuuacuuuc

SEQ ID NO: 380604 - RNA, 15 nt, Homo sapiens
augacuuacuuuccu

SEQ ID NO: 380605 - RNA, 12 nt, Homo sapiens
augaugaucugg

SEQ ID NO: 380606 - RNA, 20 nt, Homo sapiens
augcaagacuucacugcagc

SEQ ID NO: 380607 - RNA, 21 nt, Homo sapiens
augcccaauccaggcccggug

SEQ ID NO: 380608 - RNA, 12 nt, Homo sapiens
augccucuggag

SEQ ID NO: 380609 - RNA, 23 nt, Homo sapiens
augcuggcauuugcaccuaccuc

SEQ ID NO: 380610 - RNA, 13 nt, Homo sapiens
auggccagccaac

SEQ ID NO: 380611 - RNA, 19 nt, Homo sapiens
auggcccagccacugcagc

SEQ ID NO: 380612 - RNA, 18 nt, Homo sapiens
auggggagucucaugcaa

SEQ ID NO: 380613 - RNA, 23 nt, Homo sapiens
augucuguauuucauucuuguug

SEQ ID NO: 380614 - RNA, 20 nt, Homo sapiens
auguuguuccaggaugugga

SEQ ID NO: 380615 - RNA, 20 nt, Homo sapiens
auuacaaucgagacugcaau

SEQ ID NO: 380616 - RNA, 14 nt, Homo sapiens
auuacaauugugag

SEQ ID NO: 380617 - RNA, 13 nt, Homo sapiens
auuaccuaaugaa

SEQ ID NO: 380618 - RNA, 19 nt, Homo sapiens
auuaccuccuguguggaag

SEQ ID NO: 380619 - RNA, 17 nt, Homo sapiens
auuauaaucucauuuca

SEQ ID NO: 380620 - RNA, 14 nt, Homo sapiens
auucagugagauau

SEQ ID NO: 380621 - RNA, 18 nt, Homo sapiens
auuccacuuuuauucauu

SEQ ID NO: 380622 - RNA, 14 nt, Homo sapiens
auucuacacauaua

SEQ ID NO: 380623 - RNA, 21 nt, Homo sapiens
auucuacacauauauguauau

SEQ ID NO: 380624 - RNA, 15 nt, Homo sapiens
auucuuuuaaugcca

SEQ ID NO: 380625 - RNA, 19 nt, Homo sapiens
auugucagaguucugcucu

SEQ ID NO: 380626 - RNA, 21 nt, Homo sapiens
auuuaauuuuuuaaacuguag

SEQ ID NO: 380627 - RNA, 15 nt, Homo sapiens
auuucauccuugaau

SEQ ID NO: 380628 - RNA, 12 nt, Homo sapiens
auuucaucucuu

SEQ ID NO: 380629 - RNA, 12 nt, Homo sapiens
auuuccagugag

SEQ ID NO: 380630 - RNA, 16 nt, Homo sapiens
auuucucuacuuguca

SEQ ID NO: 380631 - RNA, 17 nt, Homo sapiens
auuucucuacuugucau

SEQ ID NO: 380632 - RNA, 16 nt, Homo sapiens
auuuuaagaaagagaa

SEQ ID NO: 380633 - RNA, 13 nt, Homo sapiens
auuuuaauuaucu

SEQ ID NO: 380634 - RNA, 20 nt, Homo sapiens
auuuuaauugauuauucuga

SEQ ID NO: 380635 - RNA, 14 nt, Homo sapiens
auuuugcauuucau

SEQ ID NO: 380636 - RNA, 16 nt, Homo sapiens
auuuugccauuuagcg

SEQ ID NO: 380637 - RNA, 19 nt, Homo sapiens
auuuuuuuuguaacuucaa

SEQ ID NO: 380638 - RNA, 23 nt, Homo sapiens
caaaaaauguaauuaacuguaaa

SEQ ID NO: 380639 - RNA, 18 nt, Homo sapiens
caaaaauguaaugaucau

SEQ ID NO: 380640 - RNA, 19 nt, Homo sapiens
caaaacagauuacuagaaa

SEQ ID NO: 380641 - RNA, 19 nt, Homo sapiens
caaaaucaacaugacuggu

SEQ ID NO: 380642 - RNA, 15 nt, Homo sapiens
caaacuacauguaau

SEQ ID NO: 380643 - RNA, 13 nt, Homo sapiens
caaagcaaagcca

SEQ ID NO: 380644 - RNA, 12 nt, Homo sapiens
caaauccaagga

SEQ ID NO: 380645 - RNA, 19 nt, Homo sapiens
caaauccaaggaaacaugc

SEQ ID NO: 380646 - RNA, 20 nt, Homo sapiens
caacucagguuuuggcauua

SEQ ID NO: 380647 - RNA, 17 nt, Homo sapiens
caagaauuagggcccca

SEQ ID NO: 380648 - RNA, 16 nt, Homo sapiens
caagacuucacugcag

SEQ ID NO: 380649 - RNA, 17 nt, Homo sapiens
caaguauuacaaccaua

SEQ ID NO: 380650 - RNA, 16 nt, Homo sapiens
caagugcaguagugca

SEQ ID NO: 380651 - RNA, 22 nt, Homo sapiens
caagugcaguagugcaguucac

SEQ ID NO: 380652 - RNA, 16 nt, Homo sapiens
caauacaaagaugacu

SEQ ID NO: 380653 - RNA, 17 nt, Homo sapiens
caauacaugcugcuaau

SEQ ID NO: 380654 - RNA, 21 nt, Homo sapiens
caauacaugcugcuaauucaa

SEQ ID NO: 380655 - RNA, 16 nt, Homo sapiens
caauauuucugauaua

SEQ ID NO: 380656 - RNA, 17 nt, Homo sapiens
caaucagccacauucua

SEQ ID NO: 380657 - RNA, 21 nt, Homo sapiens
caaugccacauacuugcagcu

SEQ ID NO: 380658 - RNA, 15 nt, Homo sapiens
caauuaaagaaauaa

SEQ ID NO: 380659 - RNA, 20 nt, Homo sapiens
caauugagggcuaaauccca

SEQ ID NO: 380660 - RNA, 20 nt, Homo sapiens
cacaaauuucucuguuccau

SEQ ID NO: 380661 - RNA, 20 nt, Homo sapiens
cacaagugcaguagugcagu

SEQ ID NO: 380662 - RNA, 19 nt, Homo sapiens
cacaauuacauacuauucu

SEQ ID NO: 380663 - RNA, 17 nt, Homo sapiens
cacacauuuuaugagag

SEQ ID NO: 380664 - RNA, 20 nt, Homo sapiens
cacacccuggaggauuucau

SEQ ID NO: 380665 - RNA, 14 nt, Homo sapiens
cagcugagguucau

SEQ ID NO: 380666 - RNA, 18 nt, Homo sapiens
cagcugagguucauuaca

SEQ ID NO: 380667 - RNA, 20 nt, Homo sapiens
caggcccggugaggccaagg

SEQ ID NO: 380668 - RNA, 20 nt, Homo sapiens
caggcugguauuuaucugca

SEQ ID NO: 380669 - RNA, 19 nt, Homo sapiens
cagggaacaagcccaaagc

SEQ ID NO: 380670 - RNA, 19 nt, Homo sapiens
cagggaagcugucccucac

SEQ ID NO: 380671 - RNA, 17 nt, Homo sapiens
cagguagcauagcucug

SEQ ID NO: 380672 - RNA, 19 nt, Homo sapiens
caguccugccucagccucc

SEQ ID NO: 380673 - RNA, 16 nt, Homo sapiens
cagugacaaagacucc

SEQ ID NO: 380674 - RNA, 13 nt, Homo sapiens
cacuguuucauga

SEQ ID NO: 380675 - RNA, 21 nt, Homo sapiens
cacuucuuguuccccacugac

SEQ ID NO: 380676 - RNA, 11 nt, Homo sapiens
cagaaaugcaa

SEQ ID NO: 380677 - RNA, 22 nt, Homo sapiens
cagacagucacaaauuucucug

SEQ ID NO: 380678 - RNA, 14 nt, Homo sapiens
cagagcuugaacac

SEQ ID NO: 380679 - RNA, 15 nt, Homo sapiens
cagaguucugcucua

SEQ ID NO: 380680 - RNA, 18 nt, Homo sapiens
cagccaaacccugucuga

SEQ ID NO: 380681 - RNA, 15 nt, Homo sapiens
cagccaacuuuugca

SEQ ID NO: 380682 - RNA, 21 nt, Homo sapiens
cagcuggaagggucaacaucu

SEQ ID NO: 380683 - RNA, 13 nt, Homo sapiens
caggcccagugac

SEQ ID NO: 380684 - RNA, 13 nt, Homo sapiens
caggcuggucuca

SEQ ID NO: 380685 - RNA, 20 nt, Homo sapiens
caggucuuuaaaucauuuua

SEQ ID NO: 380686 - RNA, 22 nt, Homo sapiens
cagguucaugccaccauggcca

SEQ ID NO: 380687 - RNA, 19 nt, Homo sapiens
cagugaagucuagaaucau

SEQ ID NO: 380688 - RNA, 19 nt, Homo sapiens
caguguuccccccauagag

SEQ ID NO: 380689 - RNA, 19 nt, Homo sapiens
cauaagucuaaauaaauga

SEQ ID NO: 380690 - RNA, 21 nt, Homo sapiens
cauacagagguaacuaucaau

SEQ ID NO: 380691 - RNA, 17 nt, Homo sapiens
cauacuuaacauuucau

SEQ ID NO: 380692 - RNA, 20 nt, Homo sapiens
cauagcccucagacauuuau

SEQ ID NO: 380693 - RNA, 22 nt, Homo sapiens
caucaauaguguccuaugcaau

SEQ ID NO: 380694 - RNA, 23 nt, Homo sapiens
caucaauaguguccuaugcaaua

SEQ ID NO: 380695 - RNA, 17 nt, Homo sapiens
caucacugauucccucu

SEQ ID NO: 380696 - RNA, 14 nt, Homo sapiens
caucucuuguauau

SEQ ID NO: 380697 - RNA, 21 nt, Homo sapiens
caugacauccagagaugacua

SEQ ID NO: 380698 - RNA, 18 nt, Homo sapiens
caugcaagacuucacugc

SEQ ID NO: 380699 - RNA, 21 nt, Homo sapiens
caugcaagacuucacugcagc

SEQ ID NO: 380700 - RNA, 14 nt, Homo sapiens
caugcccacugccg

SEQ ID NO: 380701 - RNA, 22 nt, Homo sapiens
caugcugcuaauucaaagcucu

SEQ ID NO: 380702 - RNA, 21 nt, Homo sapiens
caugggcgcaggcccagugac

SEQ ID NO: 380703 - RNA, 20 nt, Homo sapiens
cauggguuuccuuauugaaa

SEQ ID NO: 380704 - RNA, 16 nt, Homo sapiens
cauguugguugcacuu

SEQ ID NO: 380705 - RNA, 21 nt, Homo sapiens
cauugaaaucagcaugacaaa

SEQ ID NO: 380706 - RNA, 18 nt, Homo sapiens
cauuucaugcuaucagaa

SEQ ID NO: 380707 - RNA, 15 nt, Homo sapiens
cauuugcaccuaccu

SEQ ID NO: 380708 - RNA, 13 nt, Homo sapiens
cauuuugcauuag

SEQ ID NO: 380709 - RNA, 21 nt, Homo sapiens
cauuuugcauuagacagauga

SEQ ID NO: 380710 - RNA, 16 nt, Homo sapiens
cauuuuguacaaagau

SEQ ID NO: 380711 - RNA, 22 nt, Homo sapiens
ccaaggaauguguccaagacac

SEQ ID NO: 380712 - RNA, 15 nt, Homo sapiens
ccaaggacuccaaag

SEQ ID NO: 380713 - RNA, 17 nt, Homo sapiens
ccaagguuucccaguga

SEQ ID NO: 380714 - RNA, 19 nt, Homo sapiens
ccaauacaaagaugacugg

SEQ ID NO: 380715 - RNA, 22 nt, Homo sapiens
ccacacccuggaggauuucauc

SEQ ID NO: 380716 - RNA, 13 nt, Homo sapiens
ccaccugucucag

SEQ ID NO: 380717 - RNA, 15 nt, Homo sapiens
ccacuguuucaugag

SEQ ID NO: 380718 - RNA, 13 nt, Homo sapiens
ccagagaugacua

SEQ ID NO: 380719 - RNA, 13 nt, Homo sapiens
ccagccacugcag

SEQ ID NO: 380720 - RNA, 13 nt, Homo sapiens
ccagugacaaaga

SEQ ID NO: 380721 - RNA, 19 nt, Homo sapiens
ccagugccucagugcugca

SEQ ID NO: 380722 - RNA, 19 nt, Homo sapiens
ccauaauuaugaaaacuca

SEQ ID NO: 380723 - RNA, 16 nt, Homo sapiens
ccauaucugugaaaug

SEQ ID NO: 380724 - RNA, 20 nt, Homo sapiens
ccauuuuaaaaugcaucauu

SEQ ID NO: 380725 - RNA, 15 nt, Homo sapiens
cccaaagcacuugcu

SEQ ID NO: 380726 - RNA, 15 nt, Homo sapiens
cccaaguccugcucc

SEQ ID NO: 380727 - RNA, 18 nt, Homo sapiens
cccaccugaccucugcaa

SEQ ID NO: 380728 - RNA, 14 nt, Homo sapiens
cccauaucugugaa

SEQ ID NO: 380729 - RNA, 11 nt, Homo sapiens
ccccacugaca

SEQ ID NO: 380730 - RNA, 13 nt, Homo sapiens
ccccucaggauug

SEQ ID NO: 380731 - RNA, 20 nt, Homo sapiens
cccgaaaacccccagcauua

SEQ ID NO: 380732 - RNA, 18 nt, Homo sapiens
cccgccacccugucucag

SEQ ID NO: 380733 - RNA, 15 nt, Homo sapiens
cccucaggauuguuu

SEQ ID NO: 380734 - RNA, 22 nt, Homo sapiens
cccuccacgugauuuccaguga

SEQ ID NO: 380735 - RNA, 23 nt, Homo sapiens
cccuccacgugauuuccagugag

SEQ ID NO: 380736 - RNA, 16 nt, Homo sapiens
cccucucuguggcucc

SEQ ID NO: 380737 - RNA, 12 nt, Homo sapiens
ccgcguggaaug

SEQ ID NO: 380738 - RNA, 13 nt, Homo sapiens
ccuaaaaugcuuc

SEQ ID NO: 380739 - RNA, 16 nt, Homo sapiens
ccuaaaaugcuucacu

SEQ ID NO: 380740 - RNA, 14 nt, Homo sapiens
ccuaaagaauccca

SEQ ID NO: 380741 - RNA, 20 nt, Homo sapiens
ccuaaagaggaaaagugcaa

SEQ ID NO: 380742 - RNA, 19 nt, Homo sapiens
ccuaaugaaagugaugaca

SEQ ID NO: 380743 - RNA, 23 nt, Homo sapiens
ccuaaugaaagugaugacauauu

SEQ ID NO: 380744 - RNA, 14 nt, Homo sapiens
ccuagauaugaaua

SEQ ID NO: 380745 - RNA, 14 nt, Homo sapiens
ccuaggucaugaag

SEQ ID NO: 380746 - RNA, 23 nt, Homo sapiens
ccucugcgccucuccacuguuuc

SEQ ID NO: 380747 - RNA, 18 nt, Homo sapiens
ccugcuccuuucugccca

SEQ ID NO: 380748 - RNA, 15 nt, Homo sapiens
ccugcuguccguccc

SEQ ID NO: 380749 - RNA, 15 nt, Homo sapiens
ccuuccucagcucag

SEQ ID NO: 380750 - RNA, 14 nt, Homo sapiens
cgaguguuugccag

SEQ ID NO: 380751 - RNA, 12 nt, Homo sapiens
cgcccccugaaa

SEQ ID NO: 380752 - RNA, 15 nt, Homo sapiens
cggcaccagugccuc

SEQ ID NO: 380753 - RNA, 14 nt, Homo sapiens
cgggaagugcagcg

SEQ ID NO: 380754 - RNA, 20 nt, Homo sapiens
cguccagcuggaagggucaa

SEQ ID NO: 380755 - RNA, 17 nt, Homo sapiens
cuaaugugaucauauga

SEQ ID NO: 380756 - RNA, 18 nt, Homo sapiens
cuaauguuauuucuuaaa

SEQ ID NO: 380757 - RNA, 20 nt, Homo sapiens
cuacacacccccaagccaca

SEQ ID NO: 380758 - RNA, 11 nt, Homo sapiens
cuacacauaua

SEQ ID NO: 380759 - RNA, 12 nt, Homo sapiens
cuacacauauau

SEQ ID NO: 380760 - RNA, 17 nt, Homo sapiens
cuacuuguaaaggugcu

SEQ ID NO: 380761 - RNA, 16 nt, Homo sapiens
cuacuugucauaucac

SEQ ID NO: 380762 - RNA, 21 nt, Homo sapiens
cuagacauucuuuuaaugcca

SEQ ID NO: 380763 - RNA, 17 nt, Homo sapiens
cuagguaggggcccacu

SEQ ID NO: 380764 - RNA, 15 nt, Homo sapiens
cuaggucaugaagga

SEQ ID NO: 380765 - RNA, 17 nt, Homo sapiens
cuauaauaaguuuugau

SEQ ID NO: 380766 - RNA, 23 nt, Homo sapiens
gcaucacugauucccucucccac

SEQ ID NO: 380767 - RNA, 20 nt, Homo sapiens
gcaugaaagagaaagacuga

SEQ ID NO: 380768 - RNA, 18 nt, Homo sapiens
gcaugcaaaaaaugcuuu

SEQ ID NO: 380769 - RNA, 22 nt, Homo sapiens
gcaugggcgcaggcccagugac

SEQ ID NO: 380770 - RNA, 13 nt, Homo sapiens
gcauuagcuacuu

SEQ ID NO: 380771 - RNA, 19 nt, Homo sapiens
gccacacaagugcaguagu

SEQ ID NO: 380772 - RNA, 18 nt, Homo sapiens
gccacugcagcacaggag

SEQ ID NO: 380773 - RNA, 13 nt, Homo sapiens
gcccaaacacccu

SEQ ID NO: 380774 - RNA, 20 nt, Homo sapiens
gcccacugccgaugcccaau

SEQ ID NO: 380775 - RNA, 22 nt, Homo sapiens
gcccacuucaccguacuaacca

SEQ ID NO: 380776 - RNA, 20 nt, Homo sapiens
gcccaggcuggaguggagug

SEQ ID NO: 380777 - RNA, 19 nt, Homo sapiens
gcccagugacaaagacucc

SEQ ID NO: 380778 - RNA, 18 nt, Homo sapiens
gcccauaucugugaaaug

SEQ ID NO: 380779 - RNA, 18 nt, Homo sapiens
gcccccucccugcuccca

SEQ ID NO: 380780 - RNA, 22 nt, Homo sapiens
gcccggugaggccaagguuucc

SEQ ID NO: 380781 - RNA, 14 nt, Homo sapiens
gccuaaagaauccc

SEQ ID NO: 380782 - RNA, 21 nt, Homo sapiens
gcuacuuuucagaauugaagg

SEQ ID NO: 380783 - RNA, 17 nt, Homo sapiens
gcuaucagaaacaguau

SEQ ID NO: 380784 - RNA, 20 nt, Homo sapiens
gcucagcagguugaaugggu

SEQ ID NO: 380785 - RNA, 11 nt, Homo sapiens
gcuccacugaa

SEQ ID NO: 380786 - RNA, 13 nt, Homo sapiens
gcuccacugaaca

SEQ ID NO: 380787 - RNA, 18 nt, Homo sapiens
gcuccaggcaucacugau

SEQ ID NO: 380788 - RNA, 16 nt, Homo sapiens
gcuccgugagcccuug

SEQ ID NO: 380789 - RNA, 16 nt, Homo sapiens
gcucuacccugcagcu

SEQ ID NO: 380790 - RNA, 17 nt, Homo sapiens
gcucuacccugcagcuu

SEQ ID NO: 380791 - RNA, 21 nt, Homo sapiens
gcugcaaacccaugaagcugg

SEQ ID NO: 380792 - RNA, 14 nt, Homo sapiens
gcuuaguucuugaa

SEQ ID NO: 380793 - RNA, 19 nt, Homo sapiens
gcuuauagaggaacuugaa

SEQ ID NO: 380794 - RNA, 14 nt, Homo sapiens
gcuuggagugcccc

SEQ ID NO: 380795 - RNA, 14 nt, Homo sapiens
gcuuuguugcccag

SEQ ID NO: 380796 - RNA, 23 nt, Homo sapiens
ggaagcauguacuguacuuccca

SEQ ID NO: 380797 - RNA, 14 nt, Homo sapiens
ggacccccucagga

SEQ ID NO: 380798 - RNA, 16 nt, Homo sapiens
ggauugccacuaagua

SEQ ID NO: 380799 - RNA, 15 nt, Homo sapiens
ggcccagccacugca

SEQ ID NO: 380800 - RNA, 16 nt, Homo sapiens
ggcccauaucugugaa

SEQ ID NO: 380801 - RNA, 19 nt, Homo sapiens
ggcuggaguggaguggcgu

SEQ ID NO: 380802 - RNA, 23 nt, Homo sapiens
ggcuuaaggagaggagaaacuga

SEQ ID NO: 380803 - RNA, 17 nt, Homo sapiens
gggaauguuguuccagg

SEQ ID NO: 380804 - RNA, 13 nt, Homo sapiens
gggcccauggggu

SEQ ID NO: 380805 - RNA, 18 nt, Homo sapiens
gggccuguagaucaggga

SEQ ID NO: 380806 - RNA, 20 nt, Homo sapiens
gggcuaaaucccaagugucu

SEQ ID NO: 380807 - RNA, 15 nt, Homo sapiens
gggcuauugggcccu

SEQ ID NO: 380808 - RNA, 19 nt, Homo sapiens
gggucucgcuuuguugccc

SEQ ID NO: 380809 - RNA, 20 nt, Homo sapiens
ggucucgcuuuguugcccag

SEQ ID NO: 380810 - RNA, 17 nt, Homo sapiens
gguguuacuaaagucac

SEQ ID NO: 380811 - RNA, 20 nt, Homo sapiens
gguuggggacccccucagga

SEQ ID NO: 380812 - RNA, 15 nt, Homo sapiens
guaaacuaaggauaa

SEQ ID NO: 380813 - RNA, 20 nt, Homo sapiens
guaaacugaggcccaaagca

SEQ ID NO: 380814 - RNA, 16 nt, Homo sapiens
guauacauacauguau

SEQ ID NO: 380815 - RNA, 17 nt, Homo sapiens
guauucuuaaaaugcaa

SEQ ID NO: 380816 - RNA, 19 nt, Homo sapiens
guauucuuaaaaugcaaua

SEQ ID NO: 380817 - RNA, 21 nt, Homo sapiens
gucaacaucuuuuacauucug

SEQ ID NO: 380818 - RNA, 13 nt, Homo sapiens
gucagaguucugc

SEQ ID NO: 380819 - RNA, 23 nt, Homo sapiens
gucaucaauaguguccuaugcaa

SEQ ID NO: 380820 - RNA, 17 nt, Homo sapiens
gucaugaaggacacucu

SEQ ID NO: 380821 - RNA, 17 nt, Homo sapiens
guccugccucagccucc

SEQ ID NO: 380822 - RNA, 17 nt, Homo sapiens
gucucacaguguugccc

SEQ ID NO: 380823 - RNA, 14 nt, Homo sapiens
gucucaguaccucc

SEQ ID NO: 380824 - RNA, 17 nt, Homo sapiens
gucucgcuuuguugccc

SEQ ID NO: 380825 - RNA, 20 nt, Homo sapiens
gugaaaugcuggcauuugca

SEQ ID NO: 380826 - RNA, 17 nt, Homo sapiens
gugccaauauuucugau

SEQ ID NO: 380827 - RNA, 20 nt, Homo sapiens
gugcucgcccacaaacugau

SEQ ID NO: 380828 - RNA, 13 nt, Homo sapiens
guucugacacugu

SEQ ID NO: 380829 - RNA, 13 nt, Homo sapiens
guugcacuuugua

SEQ ID NO: 380830 - RNA, 12 nt, Homo sapiens
guuggcacuuau

SEQ ID NO: 380831 - RNA, 22 nt, Homo sapiens
guuucucggcaccagugccuca

SEQ ID NO: 380832 - RNA, 20 nt, Homo sapiens
uaaaaaggaaauuagucuuu

SEQ ID NO: 380833 - RNA, 19 nt, Homo sapiens
uaaaagagacaaacuguaa

SEQ ID NO: 380834 - RNA, 17 nt, Homo sapiens
uaaaagaucuugcagaa

SEQ ID NO: 380835 - RNA, 13 nt, Homo sapiens
uaaaagugcauuu

SEQ ID NO: 380836 - RNA, 15 nt, Homo sapiens
uaaaaucuggcaaag

SEQ ID NO: 380837 - RNA, 16 nt, Homo sapiens
uaaaaugcuucacugu

SEQ ID NO: 380838 - RNA, 19 nt, Homo sapiens
uaaaauuaggaacaguaaa

SEQ ID NO: 380839 - RNA, 14 nt, Homo sapiens
uaaaauugcacuuu

SEQ ID NO: 380840 - RNA, 17 nt, Homo sapiens
uaaaggugcugcacugg

SEQ ID NO: 380841 - RNA, 20 nt, Homo sapiens
uaaaguauguuauugcauaa

SEQ ID NO: 380842 - RNA, 18 nt, Homo sapiens
uaacacuguuggcacuua

SEQ ID NO: 380843 - RNA, 13 nt, Homo sapiens
uaacuaucaauau

SEQ ID NO: 380844 - RNA, 17 nt, Homo sapiens
uaacuguaaacuuggaa

SEQ ID NO: 380845 - RNA, 18 nt, Homo sapiens
uaagauuuccaagugcca

SEQ ID NO: 380846 - RNA, 20 nt, Homo sapiens
uaaggguuaguuuacaauca

SEQ ID NO: 380847 - RNA, 19 nt, Homo sapiens
uaaguuuaauuaucugcau

SEQ ID NO: 380848 - RNA, 22 nt, Homo sapiens
uaaugaaauaauguacaucugg

SEQ ID NO: 380849 - RNA, 13 nt, Homo sapiens
uaaugaagaauca

SEQ ID NO: 380850 - RNA, 22 nt, Homo sapiens
uaaugaagaaucacgauuucau

SEQ ID NO: 380851 - RNA, 14 nt, Homo sapiens
uaaugacaugccua

SEQ ID NO: 380852 - RNA, 17 nt, Homo sapiens
uaauuagagaacuggag

SEQ ID NO: 380853 - RNA, 22 nt, Homo sapiens
uacaacugugcauuacaaaguu

SEQ ID NO: 380854 - RNA, 19 nt, Homo sapiens
uacaaucagccacauucua

SEQ ID NO: 380855 - RNA, 20 nt, Homo sapiens
uacaaucagccacauucuag

SEQ ID NO: 380856 - RNA, 19 nt, Homo sapiens
uacaaucgagacugcaaug

SEQ ID NO: 380857 - RNA, 16 nt, Homo sapiens
uacagagcaccuguag

SEQ ID NO: 380858 - RNA, 15 nt, Homo sapiens
uacauacagagguaa

SEQ ID NO: 380859 - RNA, 14 nt, Homo sapiens
uacauccucugaua

SEQ ID NO: 380860 - RNA, 19 nt, Homo sapiens
uacauuuuguaaaauauua

SEQ ID NO: 380861 - RNA, 17 nt, Homo sapiens
uaccuaaacuguaucau

SEQ ID NO: 380862 - RNA, 22 nt, Homo sapiens
uaccuuaaaauguaaaacaaaa

SEQ ID NO: 380863 - RNA, 20 nt, Homo sapiens
uacugcacauuuuguacaaa

SEQ ID NO: 380864 - RNA, 12 nt, Homo sapiens
uacuugucauau

SEQ ID NO: 380865 - RNA, 14 nt, Homo sapiens
uagaaagaaacuaa

SEQ ID NO: 380866 - RNA, 16 nt, Homo sapiens
uagggcaacaauacau

SEQ ID NO: 380867 - RNA, 14 nt, Homo sapiens
uuaaaagagacaaa

SEQ ID NO: 380868 - RNA, 22 nt, Homo sapiens
uuaaaauauauguucugcaaga

SEQ ID NO: 380869 - RNA, 14 nt, Homo sapiens
uuaaauaucugaac

SEQ ID NO: 380870 - RNA, 18 nt, Homo sapiens
uuaagaauaauugaacaa

SEQ ID NO: 380871 - RNA, 21 nt, Homo sapiens
uuaaggagaggagaaacugag

SEQ ID NO: 380872 - RNA, 16 nt, Homo sapiens
uuaaucucuaguaaaa

SEQ ID NO: 380873 - RNA, 19 nt, Homo sapiens
uuacaaucagccacauucu

SEQ ID NO: 380874 - RNA, 18 nt, Homo sapiens
uuacaaucgagacugcaa

SEQ ID NO: 380875 - RNA, 23 nt, Homo sapiens
uuacaaucgagacugcaauguga

SEQ ID NO: 380876 - RNA, 14 nt, Homo sapiens
uuacauacuauucu

SEQ ID NO: 380877 - RNA, 13 nt, Homo sapiens
uuagacagaugac

SEQ ID NO: 380878 - RNA, 15 nt, Homo sapiens
uuauaauaacugaac

SEQ ID NO: 380879 - RNA, 14 nt, Homo sapiens
uuauagguuuccac

SEQ ID NO: 380880 - RNA, 15 nt, Homo sapiens
uuauauuuacuuuaa

SEQ ID NO: 380881 - RNA, 17 nt, Homo sapiens
uuauuacauggggucua

SEQ ID NO: 380882 - RNA, 14 nt, Homo sapiens
uuauucugauucca

SEQ ID NO: 380883 - RNA, 16 nt, Homo sapiens
uuauucugauuccacu

SEQ ID NO: 380884 - RNA, 17 nt, Homo sapiens
uucacugcagccuuuca

SEQ ID NO: 380885 - RNA, 15 nt, Homo sapiens
uucaugcccacugcc

SEQ ID NO: 380886 - RNA, 16 nt, Homo sapiens
uucccaauugccacau

SEQ ID NO: 380887 - RNA, 17 nt, Homo sapiens
uucuagguaggggccca

SEQ ID NO: 380888 - RNA, 13 nt, Homo sapiens
uucugguuccaaa

SEQ ID NO: 380889 - RNA, 21 nt, Homo sapiens
uugaaaaucaagaugagauau

SEQ ID NO: 380890 - RNA, 15 nt, Homo sapiens
uugacuggcucaaga

SEQ ID NO: 380891 - RNA, 18 nt, Homo sapiens
uugauuaaaaucuggcaa

SEQ ID NO: 380892 - RNA, 14 nt, Homo sapiens
uugccaacagguag

SEQ ID NO: 380893 - RNA, 20 nt, Homo sapiens
uugcugcaaacccaugaagc

SEQ ID NO: 380894 - RNA, 17 nt, Homo sapiens
uugcuuucagaugcagu

SEQ ID NO: 380895 - RNA, 17 nt, Homo sapiens
uuguuccaaugccacau

SEQ ID NO: 380896 - RNA, 16 nt, Homo sapiens
uuguuccccacugaca

SEQ ID NO: 380897 - RNA, 23 nt, Homo sapiens
uuguucgccgcguggaaugugag

SEQ ID NO: 380898 - RNA, 14 nt, Homo sapiens
uuguugucuuuaug

SEQ ID NO: 380899 - RNA, 21 nt, Homo sapiens
uuguuuuaugcucagggucaa

SEQ ID NO: 380900 - RNA, 15 nt, Homo sapiens
uuuaaaaaaaguaua

SEQ ID NO: 380901 - RNA, 22 nt, Homo sapiens
uuuaaaagagacaaacuguaaa

SEQ ID NO: 380902 - RNA, 21 nt, Homo sapiens
uuuaaaguauguuauugcaua

SEQ ID NO: 380903 - RNA, 15 nt, Homo sapiens
uuuaaauaaagacaa

SEQ ID NO: 380904 - RNA, 16 nt, Homo sapiens
uuuaaauaucugaaca

SEQ ID NO: 380905 - RNA, 20 nt, Homo sapiens
uuuaauaucugagaagugua

SEQ ID NO: 380906 - RNA, 16 nt, Homo sapiens
uuuaauugauuauucu

SEQ ID NO: 380907 - RNA, 19 nt, Homo sapiens
uuuaguuuuacacuaggaa

SEQ ID NO: 380908 - RNA, 16 nt, Homo sapiens
uuuauaucuggaauga

SEQ ID NO: 380909 - RNA, 16 nt, Homo sapiens
uuuauuccagacaguc

SEQ ID NO: 380910 - RNA, 22 nt, Homo sapiens
uuucacaggacucugcagauag

SEQ ID NO: 380911 - RNA, 21 nt, Homo sapiens
uuucagaauugaaggagaaaa

SEQ ID NO: 380912 - RNA, 12 nt, Homo sapiens
uuucauucuugu

SEQ ID NO: 380913 - RNA, 19 nt, Homo sapiens
uuuccaaagggcaguaaag

SEQ ID NO: 380914 - RNA, 22 nt, Homo sapiens
uuucuaaagcucugaacaaaag

SEQ ID NO: 380915 - RNA, 15 nt, Homo sapiens
uuugcauguuuugua

SEQ ID NO: 380916 - RNA, 22 nt, Homo sapiens
uuugucccggggcuccacugaa

SEQ ID NO: 380917 - RNA, 17 nt, Homo sapiens
uuuguucucccaaaaca

SEQ ID NO: 380918 - RNA, 12 nt, Homo sapiens
uuuguugcccag

SEQ ID NO: 380919 - RNA, 15 nt, Homo sapiens
uuuuaaaaugcauca

SEQ ID NO: 380920 - RNA, 17 nt, Homo sapiens
uuuuacaugcagaguau

SEQ ID NO: 380921 - RNA, 13 nt, Homo sapiens
uuuucaccccacc

SEQ ID NO: 380922 - RNA, 14 nt, Homo sapiens
uucuacacauauau

SEQ ID NO: 380923 - RNA, 17 nt, Homo sapiens
uucuccccggacacucg

SEQ ID NO: 380924 - RNA, 19 nt, Homo sapiens
uucugcuuuuuuucaggga

SEQ ID NO: 380925 - RNA, 22 nt, Homo sapiens
uucuucuuuaaucacuuaacau

SEQ ID NO: 380926 - RNA, 18 nt, Homo sapiens
uugaaugccauagucaaa

SEQ ID NO: 380927 - RNA, 19 nt, Homo sapiens
uugacagcugucauauaau

SEQ ID NO: 380928 - RNA, 20 nt, Homo sapiens
uugacuccuuuccaauagaa

SEQ ID NO: 380929 - RNA, 22 nt, Homo sapiens
uuggcacuuauagguaacguga

SEQ ID NO: 380930 - RNA, 21 nt, Homo sapiens
uugguacaaucgacauccuag

SEQ ID NO: 380931 - RNA, 18 nt, Homo sapiens
uuguacaaagauaugcua

SEQ ID NO: 380932 - RNA, 14 nt, Homo sapiens
uuguagacaugccc

SEQ ID NO: 380933 - RNA, 19 nt, Homo sapiens
uuguagagauggggucuca

SEQ ID NO: 380934 - RNA, 19 nt, Homo sapiens
uuguucgccgcguggaaug

SEQ ID NO: 380935 - RNA, 16 nt, Homo sapiens
uuguucucccaaaaca

SEQ ID NO: 380936 - RNA, 18 nt, Homo sapiens
uuguuuuuaagcuucuag

SEQ ID NO: 380937 - RNA, 15 nt, Homo sapiens
uuuaauaucugagaa

SEQ ID NO: 380938 - RNA, 21 nt, Homo sapiens
uuucacuacucucuacucugu

SEQ ID NO: 380939 - RNA, 15 nt, Homo sapiens
uuucaugagcccaaa

SEQ ID NO: 380940 - RNA, 15 nt, Homo sapiens
uuuccacugccaaaa

SEQ ID NO: 380941 - RNA, 21 nt, Homo sapiens
uuuccuugggagaacuaagua

SEQ ID NO: 380942 - RNA, 21 nt, Homo sapiens
uuucuaaagcucugaacaaaa

SEQ ID NO: 380943 - RNA, 22 nt, Homo sapiens
uuucucggcaccagugccucag

SEQ ID NO: 380944 - RNA, 16 nt, Homo sapiens
uuucuuuguaucauuc

SEQ ID NO: 380945 - RNA, 20 nt, Homo sapiens
uuugaaaaauauugcuaaaa

SEQ ID NO: 380946 - RNA, 18 nt, Homo sapiens
uuugcaacaagacaaagc

SEQ ID NO: 380947 - RNA, 15 nt, Homo sapiens
uuugcuuacaaagua

SEQ ID NO: 380948 - RNA, 23 nt, Homo sapiens
uuuuacaauaaaacuuugcugcc

SEQ ID NO: 380949 - RNA, 23 nt, Homo sapiens
uuuucagggaagcugccaaagaa

SEQ ID NO: 380950 - RNA, 17 nt, Homo sapiens
uuuuccuauuuacaugu

SEQ ID NO: 380951 - RNA, 17 nt, Homo sapiens
uuuuuacaugcagagua

SEQ ID NO: 380952 - RNA, 14 nt, Homo sapiens
uuuuuccuaaaaga

SEQ ID NO: 380953 - RNA, 15 nt, Homo sapiens
aagugaugacauauu

SEQ ID NO: 380954 - RNA, 19 nt, Homo sapiens
aagugucucuugacuggcu

SEQ ID NO: 380955 - RNA, 18 nt, Homo sapiens
aaguuauaauaacugaac

SEQ ID NO: 380956 - RNA, 15 nt, Homo sapiens
aauaaauuucgcaau

SEQ ID NO: 380957 - RNA, 17 nt, Homo sapiens
aauaaugcuuugagaag

SEQ ID NO: 380958 - RNA, 14 nt, Homo sapiens
aauaauguacaucu

SEQ ID NO: 380959 - RNA, 16 nt, Homo sapiens
aauaauguacaucugg

SEQ ID NO: 380960 - RNA, 18 nt, Homo sapiens
aauaguguccuaugcaau

SEQ ID NO: 380961 - RNA, 20 nt, Homo sapiens
aauaguguccuaugcaauaa

SEQ ID NO: 380962 - RNA, 20 nt, Homo sapiens
aauauaagaaaaguaaugaa

SEQ ID NO: 380963 - RNA, 18 nt, Homo sapiens
aauauauggcauuugcag

SEQ ID NO: 380964 - RNA, 22 nt, Homo sapiens
aauaucugagaaguguauauag

SEQ ID NO: 380965 - RNA, 21 nt, Homo sapiens
aaucacuuaacauuccuaaaa

SEQ ID NO: 380966 - RNA, 15 nt, Homo sapiens
aaucauacuuaacau

SEQ ID NO: 380967 - RNA, 23 nt, Homo sapiens
aauccaucacuagccaugauaac

SEQ ID NO: 380968 - RNA, 13 nt, Homo sapiens
aaucucauuucaa

SEQ ID NO: 380969 - RNA, 16 nt, Homo sapiens
aaugacuuacuuuccu

SEQ ID NO: 380970 - RNA, 21 nt, Homo sapiens
aaugcauccagcaguacaaua

SEQ ID NO: 380971 - RNA, 15 nt, Homo sapiens
aauuaucugcauuua

SEQ ID NO: 380972 - RNA, 16 nt, Homo sapiens
aauuaucugcauuuau

SEQ ID NO: 380973 - RNA, 20 nt, Homo sapiens
aauugagggcuaaaucccaa

SEQ ID NO: 380974 - RNA, 13 nt, Homo sapiens
aauugauuauucu

SEQ ID NO: 380975 - RNA, 23 nt, Homo sapiens
aauuuuugaaaaauauugcuaaa

SEQ ID NO: 380976 - RNA, 17 nt, Homo sapiens
aauuuuuuaaacuguag

SEQ ID NO: 380977 - RNA, 16 nt, Homo sapiens
acaaacuacauguaau

SEQ ID NO: 380978 - RNA, 22 nt, Homo sapiens
acaaagacuccucugggccugg

SEQ ID NO: 380979 - RNA, 13 nt, Homo sapiens
acaaagaugacug

SEQ ID NO: 380980 - RNA, 18 nt, Homo sapiens
acaacgcucuacccugca

SEQ ID NO: 380981 - RNA, 20 nt, Homo sapiens
acaauccgagcuacaaagca

SEQ ID NO: 380982 - RNA, 17 nt, Homo sapiens
acacccccaagccacag

SEQ ID NO: 380983 - RNA, 18 nt, Homo sapiens
acacucgccuacuaagua

SEQ ID NO: 380984 - RNA, 20 nt, Homo sapiens
acagacagggagaaguugag

SEQ ID NO: 380985 - RNA, 10 nt, Homo sapiens
acagacuccg

SEQ ID NO: 380986 - RNA, 17 nt, Homo sapiens
acagagugcauugugag

SEQ ID NO: 380987 - RNA, 18 nt, Homo sapiens
acagcaggaugcccuguu

SEQ ID NO: 380988 - RNA, 17 nt, Homo sapiens
acaggacucugcagaua

SEQ ID NO: 380989 - RNA, 19 nt, Homo sapiens
acaguaaugaaauguuuac

SEQ ID NO: 380990 - RNA, 17 nt, Homo sapiens
acaucuuuuacauucug

SEQ ID NO: 380991 - RNA, 23 nt, Homo sapiens
acauucugcaagcacaucugcau

SEQ ID NO: 380992 - RNA, 24 nt, Homo sapiens
acauuucauuguacaaguauuaca

SEQ ID NO: 380993 - RNA, 18 nt, Homo sapiens
accagcucugaacuucca

SEQ ID NO: 380994 - RNA, 17 nt, Homo sapiens
accaugagggaagaaua

SEQ ID NO: 380995 - RNA, 20 nt, Homo sapiens
acccaggacuuccauuugcu

SEQ ID NO: 380996 - RNA, 20 nt, Homo sapiens
accccagcccccacagcccu

SEQ ID NO: 380997 - RNA, 15 nt, Homo sapiens
accuacagagcaccu

SEQ ID NO: 380998 - RNA, 17 nt, Homo sapiens
accuccuguguggaaga

SEQ ID NO: 380999 - RNA, 16 nt, Homo sapiens
accugaccucugcaag

SEQ ID NO: 381000 - RNA, 23 nt, Homo sapiens
accugugucuuauagguuuccac

SEQ ID NO: 381001 - RNA, 15 nt, Homo sapiens
accuuccucagcuca

SEQ ID NO: 381002 - RNA, 16 nt, Homo sapiens
acgaucccccaagugu

SEQ ID NO: 381003 - RNA, 16 nt, Homo sapiens
acgugauuuccaguga

SEQ ID NO: 381004 - RNA, 19 nt, Homo sapiens
acuacacacccccaagcca

SEQ ID NO: 381005 - RNA, 20 nt, Homo sapiens
acuaccaaaugagcauuagc

SEQ ID NO: 381006 - RNA, 20 nt, Homo sapiens
acuaugaacugaaggcagca

SEQ ID NO: 381007 - RNA, 15 nt, Homo sapiens
acuccucuucaccca

SEQ ID NO: 381008 - RNA, 13 nt, Homo sapiens
acucugcagggug

SEQ ID NO: 381009 - RNA, 21 nt, Homo sapiens
acugcagccuuucacaggacu

SEQ ID NO: 381010 - RNA, 17 nt, Homo sapiens
acuggucccaaguagua

SEQ ID NO: 381011 - RNA, 16 nt, Homo sapiens
acuucacuaccaaaug

SEQ ID NO: 381012 - RNA, 21 nt, Homo sapiens
acuucacugcagccuuucaca

SEQ ID NO: 381013 - RNA, 13 nt, Homo sapiens
acuuccauuugcu

SEQ ID NO: 381014 - RNA, 14 nt, Homo sapiens
acuuccauuugcuu

SEQ ID NO: 381015 - RNA, 18 nt, Homo sapiens
acuucccaauugccacau

SEQ ID NO: 381016 - RNA, 22 nt, Homo sapiens
acuugcaccugguacugcacau

SEQ ID NO: 381017 - RNA, 21 nt, Homo sapiens
acuuuuacagaaugcauuaaa

SEQ ID NO: 381018 - RNA, 17 nt, Homo sapiens
acuuuucugguuccaaa

SEQ ID NO: 381019 - RNA, 13 nt, Homo sapiens
agaaaccaugaca

SEQ ID NO: 381020 - RNA, 12 nt, Homo sapiens
agaaacugagaa

SEQ ID NO: 381021 - RNA, 15 nt, Homo sapiens
agaaaguaagucuuu

SEQ ID NO: 381022 - RNA, 23 nt, Homo sapiens
agaaauaauuuuauuccagacag

SEQ ID NO: 381023 - RNA, 22 nt, Homo sapiens
agaacauuccucugcagcacuu

SEQ ID NO: 381024 - RNA, 14 nt, Homo sapiens
agaacuugaccccc

SEQ ID NO: 381025 - RNA, 19 nt, Homo sapiens
agaagaauguuuaauagaa

SEQ ID NO: 381026 - RNA, 14 nt, Homo sapiens
agaagugcccuuaa

SEQ ID NO: 381027 - RNA, 16 nt, Homo sapiens
agaaucacgauuucau

SEQ ID NO: 381028 - RNA, 20 nt, Homo sapiens
agaaucauacuuaacauuuc

SEQ ID NO: 381029 - RNA, 14 nt, Homo sapiens
agacaaagcaaagc

SEQ ID NO: 381030 - RNA, 14 nt, Homo sapiens
agacccacagcccu

SEQ ID NO: 381031 - RNA, 18 nt, Homo sapiens
agacccacagcccugaaa

SEQ ID NO: 381032 - RNA, 15 nt, Homo sapiens
agacuccggccugua

SEQ ID NO: 381033 - RNA, 16 nt, Homo sapiens
agacugguuaggacaa

SEQ ID NO: 381034 - RNA, 21 nt, Homo sapiens
agaguuuggaauuauuguaga

SEQ ID NO: 381035 - RNA, 17 nt, Homo sapiens
agauagugccucugcaa

SEQ ID NO: 381036 - RNA, 22 nt, Homo sapiens
agauauugucagaguucugcuc

SEQ ID NO: 381037 - RNA, 22 nt, Homo sapiens
agauuguucuguccaguuucca

SEQ ID NO: 381038 - RNA, 21 nt, Homo sapiens
agauuuuuuuuguaacuucaa

SEQ ID NO: 381039 - RNA, 17 nt, Homo sapiens
agcagaaacagcauauu

SEQ ID NO: 381040 - RNA, 14 nt, Homo sapiens
agccaacuuuugca

SEQ ID NO: 381041 - RNA, 12 nt, Homo sapiens
agccacaccgcu

SEQ ID NO: 381042 - RNA, 13 nt, Homo sapiens
agcccuucuaccc

SEQ ID NO: 381043 - RNA, 16 nt, Homo sapiens
agcccuucuaccccac

SEQ ID NO: 381044 - RNA, 23 nt, Homo sapiens
agccuguugggaucgcauugcau

SEQ ID NO: 381045 - RNA, 14 nt, Homo sapiens
agccuuugccuccc

SEQ ID NO: 381046 - RNA, 20 nt, Homo sapiens
agcuauuagcaacugugcua

SEQ ID NO: 381047 - RNA, 16 nt, Homo sapiens
agcucugaacaaaagc

SEQ ID NO: 381048 - RNA, 23 nt, Homo sapiens
agcuggaagggucaacaucuuuu

SEQ ID NO: 381049 - RNA, 19 nt, Homo sapiens
aggaauacaauauauagcu

SEQ ID NO: 381050 - RNA, 21 nt, Homo sapiens
aggacuuccauuugcuuuguc

SEQ ID NO: 381051 - RNA, 19 nt, Homo sapiens
aggagacugguuaggacaa

SEQ ID NO: 381052 - RNA, 11 nt, Homo sapiens
aggccagguga

SEQ ID NO: 381053 - RNA, 19 nt, Homo sapiens
aggcccagugacaaagacu

SEQ ID NO: 381054 - RNA, 18 nt, Homo sapiens
agggaagcugucccucac

SEQ ID NO: 381055 - RNA, 18 nt, Homo sapiens
agggauagcgcuguugau

SEQ ID NO: 381056 - RNA, 19 nt, Homo sapiens
agggcuaaaucccaagugu

SEQ ID NO: 381057 - RNA, 12 nt, Homo sapiens
aggucucugugg

SEQ ID NO: 381058 - RNA, 22 nt, Homo sapiens
aggugaacagcaggaugcccug

SEQ ID NO: 381059 - RNA, 20 nt, Homo sapiens
aggugaagucgagcacucua

SEQ ID NO: 381060 - RNA, 21 nt, Homo sapiens
agguuuugaauaaaaagugaa

SEQ ID NO: 381061 - RNA, 15 nt, Homo sapiens
agguuuuuacuguga

SEQ ID NO: 381062 - RNA, 16 nt, Homo sapiens
aguaaaauccaaagaa

SEQ ID NO: 381063 - RNA, 21 nt, Homo sapiens
aguccugcuccuuucugccca

SEQ ID NO: 381064 - RNA, 22 nt, Homo sapiens
aguggucaccuuccucagcuca

SEQ ID NO: 381065 - RNA, 14 nt, Homo sapiens
aguguccuaugcaa

SEQ ID NO: 381066 - RNA, 17 nt, Homo sapiens
aguuauaauaacugaac

SEQ ID NO: 381067 - RNA, 20 nt, Homo sapiens
aguuccagauuguucugucc

SEQ ID NO: 381068 - RNA, 17 nt, Homo sapiens
auaaaaguaaaccacaa

SEQ ID NO: 381069 - RNA, 16 nt, Homo sapiens
auaaacagauacauuc

SEQ ID NO: 381070 - RNA, 14 nt, Homo sapiens
auaaccucuggccc

SEQ ID NO: 381071 - RNA, 14 nt, Homo sapiens
auaacugaacuguu

SEQ ID NO: 381072 - RNA, 17 nt, Homo sapiens
auaauaaaaagcuucag

SEQ ID NO: 381073 - RNA, 15 nt, Homo sapiens
auaaucucauuucaa

SEQ ID NO: 381074 - RNA, 15 nt, Homo sapiens
auaaugcauccagca

SEQ ID NO: 381075 - RNA, 17 nt, Homo sapiens
auaauuuacuuuguaga

SEQ ID NO: 381076 - RNA, 16 nt, Homo sapiens
auacuuaacauuucau

SEQ ID NO: 381077 - RNA, 18 nt, Homo sapiens
auagcccucagacauuua

SEQ ID NO: 381078 - RNA, 18 nt, Homo sapiens
auaguguccuaugcaaua

SEQ ID NO: 381079 - RNA, 20 nt, Homo sapiens
auauauggcauuugcagauu

SEQ ID NO: 381080 - RNA, 20 nt, Homo sapiens
auauauguguauacauacau

SEQ ID NO: 381081 - RNA, 15 nt, Homo sapiens
auauuuaacuaugaa

SEQ ID NO: 381082 - RNA, 23 nt, Homo sapiens
auauuuuaagaaagagaaugaac

SEQ ID NO: 381083 - RNA, 17 nt, Homo sapiens
aucaacuaggggaggag

SEQ ID NO: 381084 - RNA, 12 nt, Homo sapiens
aucaagauauau

SEQ ID NO: 381085 - RNA, 18 nt, Homo sapiens
aucaagauauauguguau

SEQ ID NO: 381086 - RNA, 22 nt, Homo sapiens
aucaauaguguccuaugcaaua

SEQ ID NO: 381087 - RNA, 23 nt, Homo sapiens
aucacuagccaugauaacugcaa

SEQ ID NO: 381088 - RNA, 21 nt, Homo sapiens
aucacugauucccucucccac

SEQ ID NO: 381089 - RNA, 15 nt, Homo sapiens
aucagccacauucua

SEQ ID NO: 381090 - RNA, 18 nt, Homo sapiens
aucccacccccacuucau

SEQ ID NO: 381091 - RNA, 19 nt, Homo sapiens
aucccccaaguguccugga

SEQ ID NO: 381092 - RNA, 14 nt, Homo sapiens
aucgagacugcaau

SEQ ID NO: 381093 - RNA, 16 nt, Homo sapiens
aucguuagaggagcaa

SEQ ID NO: 381094 - RNA, 21 nt, Homo sapiens
aucuaaaaauuuugcauuuca

SEQ ID NO: 381095 - RNA, 17 nt, Homo sapiens
aucucuuauuuuacaau

SEQ ID NO: 381096 - RNA, 23 nt, Homo sapiens
aucucuuguauaugaugaucugg

SEQ ID NO: 381097 - RNA, 18 nt, Homo sapiens
augaaaacucaugaucaa

SEQ ID NO: 381098 - RNA, 16 nt, Homo sapiens
augaaagugaugacau

SEQ ID NO: 381099 - RNA, 20 nt, Homo sapiens
augagcauuagcuacuuuuc

SEQ ID NO: 381100 - RNA, 19 nt, Homo sapiens
augcaaaaaaugcuuuguu

SEQ ID NO: 381101 - RNA, 15 nt, Homo sapiens
augcaagacuucacu

SEQ ID NO: 381102 - RNA, 19 nt, Homo sapiens
augcaagacuucacugcag

SEQ ID NO: 381103 - RNA, 21 nt, Homo sapiens
augcaauaaaauuauuugcag

SEQ ID NO: 381104 - RNA, 20 nt, Homo sapiens
augcagcucuucaacaugac

SEQ ID NO: 381105 - RNA, 13 nt, Homo sapiens
augcaucauuaau

SEQ ID NO: 381106 - RNA, 20 nt, Homo sapiens
augcauccagcaguacaaua

SEQ ID NO: 381107 - RNA, 18 nt, Homo sapiens
augcaugcgaacauaaau

SEQ ID NO: 381108 - RNA, 12 nt, Homo sapiens
augcccacugcc

SEQ ID NO: 381109 - RNA, 15 nt, Homo sapiens
augcuggcauuugca

SEQ ID NO: 381110 - RNA, 19 nt, Homo sapiens
auggcuuaggaaugacuua

SEQ ID NO: 381111 - RNA, 22 nt, Homo sapiens
auguauaucuauaucucuaaac

SEQ ID NO: 381112 - RNA, 17 nt, Homo sapiens
auguauauguauaucua

SEQ ID NO: 381113 - RNA, 15 nt, Homo sapiens
auguggaaugcagcc

SEQ ID NO: 381114 - RNA, 17 nt, Homo sapiens
auuaaauuguuccauuu

SEQ ID NO: 381115 - RNA, 22 nt, Homo sapiens
auuaaucucuaguaaaacauug

SEQ ID NO: 381116 - RNA, 13 nt, Homo sapiens
auuacaaaugcaa

SEQ ID NO: 381117 - RNA, 15 nt, Homo sapiens
auuacaaccauauau

SEQ ID NO: 381118 - RNA, 18 nt, Homo sapiens
auuacauggggucuagaa

SEQ ID NO: 381119 - RNA, 18 nt, Homo sapiens
auuauaaucucauuucaa

SEQ ID NO: 381120 - RNA, 13 nt, Homo sapiens
auuaucugcauuu

SEQ ID NO: 381121 - RNA, 11 nt, Homo sapiens
auuauucugau

SEQ ID NO: 381122 - RNA, 21 nt, Homo sapiens
auuauucugauuccacuuuua

SEQ ID NO: 381123 - RNA, 22 nt, Homo sapiens
auuauucugcugaagauucagu

SEQ ID NO: 381124 - RNA, 17 nt, Homo sapiens
auuauuguagacaugcc

SEQ ID NO: 381125 - RNA, 18 nt, Homo sapiens
auuauuguagacaugccc

SEQ ID NO: 381126 - RNA, 17 nt, Homo sapiens
auucaauuaaagaaaua

SEQ ID NO: 381127 - RNA, 17 nt, Homo sapiens
auuccuaaaaugcuuca

SEQ ID NO: 381128 - RNA, 19 nt, Homo sapiens
auucucucaucuaacugau

SEQ ID NO: 381129 - RNA, 17 nt, Homo sapiens
auuguuaugaaaauccu

SEQ ID NO: 381130 - RNA, 20 nt, Homo sapiens
auuguuuuuguugucuuuau

SEQ ID NO: 381131 - RNA, 16 nt, Homo sapiens
auuuaaggauuauucu

SEQ ID NO: 381132 - RNA, 18 nt, Homo sapiens
auuuauaacguucucagu

SEQ ID NO: 381133 - RNA, 13 nt, Homo sapiens
auuuaucugcaag

SEQ ID NO: 381134 - RNA, 14 nt, Homo sapiens
auuucucuacuugu

SEQ ID NO: 381135 - RNA, 22 nt, Homo sapiens
auuucucuacuugucauaucac

SEQ ID NO: 381136 - RNA, 17 nt, Homo sapiens
auuucuuaaaauucagu

SEQ ID NO: 381137 - RNA, 18 nt, Homo sapiens
auuuuaaauaaagacaaa

SEQ ID NO: 381138 - RNA, 14 nt, Homo sapiens
auuuuaauuaucuu

SEQ ID NO: 381139 - RNA, 19 nt, Homo sapiens
auuuuauugucagaauuua

SEQ ID NO: 381140 - RNA, 19 nt, Homo sapiens
auuuugaaaacugugcaau

SEQ ID NO: 381141 - RNA, 12 nt, Homo sapiens
auuuugcauuag

SEQ ID NO: 381142 - RNA, 19 nt, Homo sapiens
caaaauaaaagaaauauga

SEQ ID NO: 381143 - RNA, 15 nt, Homo sapiens
caaaaucaacaugac

SEQ ID NO: 381144 - RNA, 18 nt, Homo sapiens
caaaaucaacaugacugg

SEQ ID NO: 381145 - RNA, 14 nt, Homo sapiens
caaagaugacuggu

SEQ ID NO: 381146 - RNA, 21 nt, Homo sapiens
caaagcacuugcuuacauccu

SEQ ID NO: 381147 - RNA, 17 nt, Homo sapiens
caacaauacaugcugcu

SEQ ID NO: 381148 - RNA, 19 nt, Homo sapiens
caacaauacaugcugcuaa

SEQ ID NO: 381149 - RNA, 18 nt, Homo sapiens
caacaugacauccagaga

SEQ ID NO: 381150 - RNA, 12 nt, Homo sapiens
caacugugcuac

SEQ ID NO: 381151 - RNA, 13 nt, Homo sapiens
caagaaaauauca

SEQ ID NO: 381152 - RNA, 22 nt, Homo sapiens
caaggccggagacccacagccc

SEQ ID NO: 381153 - RNA, 17 nt, Homo sapiens
caagugucucuugacug

SEQ ID NO: 381154 - RNA, 14 nt, Homo sapiens
caaguuugcuaaaa

SEQ ID NO: 381155 - RNA, 15 nt, Homo sapiens
caauagcaugcaaaa

SEQ ID NO: 381156 - RNA, 21 nt, Homo sapiens
caauagcaugcaaaaaaugcu

SEQ ID NO: 381157 - RNA, 18 nt, Homo sapiens
caaucgagacugcaaugu

SEQ ID NO: 381158 - RNA, 22 nt, Homo sapiens
cacaaauuucucuguuccauag

SEQ ID NO: 381159 - RNA, 22 nt, Homo sapiens
cacacaagugcaguagugcagu

SEQ ID NO: 381160 - RNA, 14 nt, Homo sapiens
cacaggacucugca

SEQ ID NO: 381161 - RNA, 19 nt, Homo sapiens
caccaugagggaagaauaa

SEQ ID NO: 381162 - RNA, 23 nt, Homo sapiens
cacccaccccacagacuccggcc

SEQ ID NO: 381163 - RNA, 17 nt, Homo sapiens
cacccccacuucaugcc

SEQ ID NO: 381164 - RNA, 21 nt, Homo sapiens
cacccuggaggauuucaucuc

SEQ ID NO: 381165 - RNA, 18 nt, Homo sapiens
cacgugauuuccagugag

SEQ ID NO: 381166 - RNA, 16 nt, Homo sapiens
cacuagugcaauucca

SEQ ID NO: 381167 - RNA, 17 nt, Homo sapiens
cacucgccuacuaagua

SEQ ID NO: 381168 - RNA, 22 nt, Homo sapiens
cacuguuucaugagcccaaaca

SEQ ID NO: 381169 - RNA, 16 nt, Homo sapiens
cacuucacuaccaaau

SEQ ID NO: 381170 - RNA, 17 nt, Homo sapiens
cagaacaagaagcuuau

SEQ ID NO: 381171 - RNA, 18 nt, Homo sapiens
cagagaagcgcuguugcc

SEQ ID NO: 381172 - RNA, 21 nt, Homo sapiens
cagagcuugaacacaggcuua

SEQ ID NO: 381173 - RNA, 15 nt, Homo sapiens
cagaggucaucccuu

SEQ ID NO: 381174 - RNA, 18 nt, Homo sapiens
cagaucuuuuugugaaau

SEQ ID NO: 381175 - RNA, 18 nt, Homo sapiens
cagccccaauccagagaa

SEQ ID NO: 381176 - RNA, 23 nt, Homo sapiens
cagccuuucacaggacucugcag

SEQ ID NO: 381177 - RNA, 19 nt, Homo sapiens
cagcuggaagggucaacau

SEQ ID NO: 381178 - RNA, 15 nt, Homo sapiens
caggaggcuccguga

SEQ ID NO: 381179 - RNA, 22 nt, Homo sapiens
caggauuguuucucggcaccag

SEQ ID NO: 381180 - RNA, 20 nt, Homo sapiens
caggcgauccaccugucuca

SEQ ID NO: 381181 - RNA, 17 nt, Homo sapiens
caggucucugugggugg

SEQ ID NO: 381182 - RNA, 11 nt, Homo sapiens
caguguugccc

SEQ ID NO: 381183 - RNA, 19 nt, Homo sapiens
cauaaaguaugccuuccug

SEQ ID NO: 381184 - RNA, 24 nt, Homo sapiens
cauaauuaugaaaacucaugauca

SEQ ID NO: 381185 - RNA, 15 nt, Homo sapiens
cauacuuaacauuuc

SEQ ID NO: 381186 - RNA, 12 nt, Homo sapiens
caucaauagugu

SEQ ID NO: 381187 - RNA, 20 nt, Homo sapiens
caucauauuuuguugugcac

SEQ ID NO: 381188 - RNA, 16 nt, Homo sapiens
cauccagcaguacaau

SEQ ID NO: 381189 - RNA, 22 nt, Homo sapiens
caucccuuccuccucuccugga

SEQ ID NO: 381190 - RNA, 22 nt, Homo sapiens
cauccucugauagcuguuucaa

SEQ ID NO: 381191 - RNA, 18 nt, Homo sapiens
caucuuuuacauucugca

SEQ ID NO: 381192 - RNA, 15 nt, Homo sapiens
caugauaacugcaau

SEQ ID NO: 381193 - RNA, 21 nt, Homo sapiens
caugcagcucuucaacaugac

SEQ ID NO: 381194 - RNA, 20 nt, Homo sapiens
cauugaaaucagcaugacaa

SEQ ID NO: 381195 - RNA, 18 nt, Homo sapiens
cauuuaagacacauugac

SEQ ID NO: 381196 - RNA, 14 nt, Homo sapiens
cauuugcuuugucc

SEQ ID NO: 381197 - RNA, 14 nt, Homo sapiens
cauuuucaccccac

SEQ ID NO: 381198 - RNA, 13 nt, Homo sapiens
cauuuuguggaau

SEQ ID NO: 381199 - RNA, 12 nt, Homo sapiens
ccaaacacccuc

SEQ ID NO: 381200 - RNA, 22 nt, Homo sapiens
ccaaagcacuugcuuacauccu

SEQ ID NO: 381201 - RNA, 13 nt, Homo sapiens
ccaacuuuugcau

SEQ ID NO: 381202 - RNA, 16 nt, Homo sapiens
ccaagcuccaaaucca

SEQ ID NO: 381203 - RNA, 15 nt, Homo sapiens
ccaaguguccuggac

SEQ ID NO: 381204 - RNA, 12 nt, Homo sapiens
ccacaaacugau

SEQ ID NO: 381205 - RNA, 22 nt, Homo sapiens
ccacguccagcuggaaggguca

SEQ ID NO: 381206 - RNA, 19 nt, Homo sapiens
ccacgugauuuccagugag

SEQ ID NO: 381207 - RNA, 14 nt, Homo sapiens
ccagagaugacuau

SEQ ID NO: 381208 - RNA, 15 nt, Homo sapiens
ccagcaguacaauaa

SEQ ID NO: 381209 - RNA, 20 nt, Homo sapiens
ccagccacugcagcacagga

SEQ ID NO: 381210 - RNA, 11 nt, Homo sapiens
ccaguuuccaa

SEQ ID NO: 381211 - RNA, 17 nt, Homo sapiens
cccaaggagguggcugu

SEQ ID NO: 381212 - RNA, 14 nt, Homo sapiens
cccaauugccacau

SEQ ID NO: 381213 - RNA, 14 nt, Homo sapiens
cccagccugcucag

SEQ ID NO: 381214 - RNA, 23 nt, Homo sapiens
cccaggcugguauuuaucugcaa

SEQ ID NO: 381215 - RNA, 17 nt, Homo sapiens
cccagggggcggggugc

SEQ ID NO: 381216 - RNA, 15 nt, Homo sapiens
cccauaucugugaaa

SEQ ID NO: 381217 - RNA, 22 nt, Homo sapiens
cccaucccacacccuggaggau

SEQ ID NO: 381218 - RNA, 20 nt, Homo sapiens
cccauucuaugugucaucaa

SEQ ID NO: 381219 - RNA, 14 nt, Homo sapiens
cccccaaguguccu

SEQ ID NO: 381220 - RNA, 17 nt, Homo sapiens
cccccggagcagggguc

SEQ ID NO: 381221 - RNA, 18 nt, Homo sapiens
cccuccacccacuaggug

SEQ ID NO: 381222 - RNA, 12 nt, Homo sapiens
cccuggugggcc

SEQ ID NO: 381223 - RNA, 18 nt, Homo sapiens
cccuuaaggaucacccca

SEQ ID NO: 381224 - RNA, 12 nt, Homo sapiens
ccgcugccccug

SEQ ID NO: 381225 - RNA, 22 nt, Homo sapiens
ccgugcucgcccacaaacugau

SEQ ID NO: 381226 - RNA, 18 nt, Homo sapiens
ccuaaaaggaaaucucac

SEQ ID NO: 381227 - RNA, 12 nt, Homo sapiens
ccuaaacuguau

SEQ ID NO: 381228 - RNA, 16 nt, Homo sapiens
ccuaaacuguaucaua

SEQ ID NO: 381229 - RNA, 21 nt, Homo sapiens
ccuaaugaaagugaugacaua

SEQ ID NO: 381230 - RNA, 23 nt, Homo sapiens
ccuagauaugaauauauggcauu

SEQ ID NO: 381231 - RNA, 16 nt, Homo sapiens
ccuagccccacccaga

SEQ ID NO: 381232 - RNA, 20 nt, Homo sapiens
ccucacagagugcauuguga

SEQ ID NO: 381233 - RNA, 20 nt, Homo sapiens
ccugaaacgagaagugcccu

SEQ ID NO: 381234 - RNA, 16 nt, Homo sapiens
ccugcagccacauggg

SEQ ID NO: 381235 - RNA, 23 nt, Homo sapiens
ccugugucuuauagguuuccacu

SEQ ID NO: 381236 - RNA, 17 nt, Homo sapiens
ccuguuuaaaaaaagua

SEQ ID NO: 381237 - RNA, 20 nt, Homo sapiens
ccuguuuaaaaaaaguauau

SEQ ID NO: 381238 - RNA, 18 nt, Homo sapiens
ccuugggagaacuaagua

SEQ ID NO: 381239 - RNA, 20 nt, Homo sapiens
cggagcaggggucugagcca

SEQ ID NO: 381240 - RNA, 19 nt, Homo sapiens
cggcaccagugccucagug

SEQ ID NO: 381241 - RNA, 15 nt, Homo sapiens
cggggcuccacugaa

SEQ ID NO: 381242 - RNA, 16 nt, Homo sapiens
cuaaagucacauauaa

SEQ ID NO: 381243 - RNA, 20 nt, Homo sapiens
cuaaaucccaagugucucuu

SEQ ID NO: 381244 - RNA, 17 nt, Homo sapiens
cuaacuucaaggcccau

SEQ ID NO: 381245 - RNA, 23 nt, Homo sapiens
cuaccccaccugaccucugcaag

SEQ ID NO: 381246 - RNA, 15 nt, Homo sapiens
cuacuuguaaaggug

SEQ ID NO: 381247 - RNA, 20 nt, Homo sapiens
cuacuuguaaaggugcugca

SEQ ID NO: 381248 - RNA, 19 nt, Homo sapiens
cuacuuuugaaaaucaaga

SEQ ID NO: 381249 - RNA, 12 nt, Homo sapiens
cuagacacuccu

SEQ ID NO: 381250 - RNA, 20 nt, Homo sapiens
cuauaauaaguuuugauaua

SEQ ID NO: 381251 - RNA, 20 nt, Homo sapiens
cuauggcccagccacugcag

SEQ ID NO: 381252 - RNA, 16 nt, Homo sapiens
cucaauaguucuuaaa

SEQ ID NO: 381253 - RNA, 14 nt, Homo sapiens
cucacagagugcau

SEQ ID NO: 381254 - RNA, 21 nt, Homo sapiens
cucacagagugcauugugagg

SEQ ID NO: 381255 - RNA, 17 nt, Homo sapiens
cucagcucccugacccc

SEQ ID NO: 381256 - RNA, 22 nt, Homo sapiens
aaaagacugguuuguuugcuua

SEQ ID NO: 381257 - RNA, 14 nt, Homo sapiens
aaaagcuucaggga

SEQ ID NO: 381258 - RNA, 18 nt, Homo sapiens
aaaagcuucagggaacaa

SEQ ID NO: 381259 - RNA, 19 nt, Homo sapiens
aaaagcuuuuguuuugcuu

SEQ ID NO: 381260 - RNA, 14 nt, Homo sapiens
aaaaguuaaacuac

SEQ ID NO: 381261 - RNA, 11 nt, Homo sapiens
aaaaugcaaua

SEQ ID NO: 381262 - RNA, 22 nt, Homo sapiens
aaaauuuugggguaaaaaggag

SEQ ID NO: 381263 - RNA, 16 nt, Homo sapiens
aaacagauuacuagaa

SEQ ID NO: 381264 - RNA, 17 nt, Homo sapiens
aaacaugugccccugcc

SEQ ID NO: 381265 - RNA, 13 nt, Homo sapiens
aaaccaugacaaa

SEQ ID NO: 381266 - RNA, 18 nt, Homo sapiens
aaaccuugaaagacauuu

SEQ ID NO: 381267 - RNA, 12 nt, Homo sapiens
aaacuaaacaga

SEQ ID NO: 381268 - RNA, 18 nt, Homo sapiens
aaacuccugggcucaggc

SEQ ID NO: 381269 - RNA, 17 nt, Homo sapiens
aaagacugauuaccucc

SEQ ID NO: 381270 - RNA, 19 nt, Homo sapiens
aaagacugucaaaugaacu

SEQ ID NO: 381271 - RNA, 20 nt, Homo sapiens
aaagcucuauuaagauuucc

SEQ ID NO: 381272 - RNA, 14 nt, Homo sapiens
aaaguaaaccacaa

SEQ ID NO: 381273 - RNA, 21 nt, Homo sapiens
aaaguauguuuucaauguuuc

SEQ ID NO: 381274 - RNA, 20 nt, Homo sapiens
aaaguuauauuuacuuuaaa

SEQ ID NO: 381275 - RNA, 23 nt, Homo sapiens
aaaguuguucgccgcguggaaug

SEQ ID NO: 381276 - RNA, 21 nt, Homo sapiens
aaauaaacagauacauucaca

SEQ ID NO: 381277 - RNA, 22 nt, Homo sapiens
aaauaaacagauacauucacau

SEQ ID NO: 381278 - RNA, 17 nt, Homo sapiens
aaauauuuuuaacaugg

SEQ ID NO: 381279 - RNA, 16 nt, Homo sapiens
aaaucagcaugacaaa

SEQ ID NO: 381280 - RNA, 18 nt, Homo sapiens
aaauccaaggaaacaugc

SEQ ID NO: 381281 - RNA, 16 nt, Homo sapiens
aaaugucuguauuuca

SEQ ID NO: 381282 - RNA, 22 nt, Homo sapiens
aacaaguauauaauuuacuuug

SEQ ID NO: 381283 - RNA, 20 nt, Homo sapiens
aacacaaugccaacagcugg

SEQ ID NO: 381284 - RNA, 14 nt, Homo sapiens
aacagauacauuca

SEQ ID NO: 381285 - RNA, 18 nt, Homo sapiens
aacaucuuuuacauucug

SEQ ID NO: 381286 - RNA, 18 nt, Homo sapiens
aaccauguugguugcacu

SEQ ID NO: 381287 - RNA, 12 nt, Homo sapiens
aacccugucuga

SEQ ID NO: 381288 - RNA, 18 nt, Homo sapiens
aaccgacuuuucuaaagc

SEQ ID NO: 381289 - RNA, 18 nt, Homo sapiens
aaccuguccauaaaguaa

SEQ ID NO: 381290 - RNA, 12 nt, Homo sapiens
aacuacauguaa

SEQ ID NO: 381291 - RNA, 21 nt, Homo sapiens
aacugaugaguaaacugaggc

SEQ ID NO: 381292 - RNA, 15 nt, Homo sapiens
aacuuuaaaaggcaa

SEQ ID NO: 381293 - RNA, 23 nt, Homo sapiens
aagaaacuaaacagaaaacuccc

SEQ ID NO: 381294 - RNA, 20 nt, Homo sapiens
aagaagacauuugccaacag

SEQ ID NO: 381295 - RNA, 17 nt, Homo sapiens
aagaauaaaauugcacu

SEQ ID NO: 381296 - RNA, 21 nt, Homo sapiens
aagaauaaaauugcacuuuua

SEQ ID NO: 381297 - RNA, 21 nt, Homo sapiens
aagaaucccacccccacuuca

SEQ ID NO: 381298 - RNA, 23 nt, Homo sapiens
aagaauguuuaauagaaaauuaa

SEQ ID NO: 381299 - RNA, 11 nt, Homo sapiens
aagacugucaa

SEQ ID NO: 381300 - RNA, 19 nt, Homo sapiens
aagacugucaaaugaacuu

SEQ ID NO: 381301 - RNA, 22 nt, Homo sapiens
aagacugucaaaugaacuuuua

SEQ ID NO: 381302 - RNA, 14 nt, Homo sapiens
aagacuucacugca

SEQ ID NO: 381303 - RNA, 22 nt, Homo sapiens
aagagaaugaacuguggaauuu

SEQ ID NO: 381304 - RNA, 15 nt, Homo sapiens
aagauauauguguau

SEQ ID NO: 381305 - RNA, 19 nt, Homo sapiens
aagaugauggaaacgcacu

SEQ ID NO: 381306 - RNA, 16 nt, Homo sapiens
aagauuuuuucauuuc

SEQ ID NO: 381307 - RNA, 22 nt, Homo sapiens
aagauuuuuuuuguaacuucaa

SEQ ID NO: 381308 - RNA, 19 nt, Homo sapiens
aagcacuugcuuacauccu

SEQ ID NO: 381309 - RNA, 21 nt, Homo sapiens
aagcauguacuguacuuccca

SEQ ID NO: 381310 - RNA, 21 nt, Homo sapiens
aagccacagggaagcauguac

SEQ ID NO: 381311 - RNA, 12 nt, Homo sapiens
aagcuucaggga

SEQ ID NO: 381312 - RNA, 15 nt, Homo sapiens
aaggaaaucucaccc

SEQ ID NO: 381313 - RNA, 14 nt, Homo sapiens
aaggaauacaauau

SEQ ID NO: 381314 - RNA, 15 nt, Homo sapiens
aaggagaaaaugcau

SEQ ID NO: 381315 - RNA, 18 nt, Homo sapiens
aaggcaggagaugcagca

SEQ ID NO: 381316 - RNA, 13 nt, Homo sapiens
aagguacacuggu

SEQ ID NO: 381317 - RNA, 12 nt, Homo sapiens
aagucacauaua

SEQ ID NO: 381318 - RNA, 23 nt, Homo sapiens
aagucuaaauaaaugaaguauuu

SEQ ID NO: 381319 - RNA, 12 nt, Homo sapiens
aagugaacuuuu

SEQ ID NO: 381320 - RNA, 20 nt, Homo sapiens
aaucaagguaagcucaggau

SEQ ID NO: 381321 - RNA, 17 nt, Homo sapiens
aaucgacauccuagccc

SEQ ID NO: 381322 - RNA, 18 nt, Homo sapiens
aaucucaccccaucccac

SEQ ID NO: 381323 - RNA, 14 nt, Homo sapiens
aaugacuuacuuuc

SEQ ID NO: 381324 - RNA, 17 nt, Homo sapiens
aaugcuggcauuugcac

SEQ ID NO: 381325 - RNA, 20 nt, Homo sapiens
aaugucuguauuucauucuu

SEQ ID NO: 381326 - RNA, 12 nt, Homo sapiens
aauuaaaacuga

SEQ ID NO: 381327 - RNA, 13 nt, Homo sapiens
aauuacauacuau

SEQ ID NO: 381328 - RNA, 16 nt, Homo sapiens
aauuacauacuauucu

SEQ ID NO: 381329 - RNA, 19 nt, Homo sapiens
aauuauuguagacaugccc

SEQ ID NO: 381330 - RNA, 21 nt, Homo sapiens
aauugauuauucugauuccac

SEQ ID NO: 381331 - RNA, 21 nt, Homo sapiens
acaaaaauguaaugaucauaa

SEQ ID NO: 381332 - RNA, 17 nt, Homo sapiens
acaacugugcauuacaa

SEQ ID NO: 381333 - RNA, 14 nt, Homo sapiens
aaucagcaugacaa

SEQ ID NO: 381334 - RNA, 15 nt, Homo sapiens
aaucagccacauucu

SEQ ID NO: 381335 - RNA, 19 nt, Homo sapiens
aauccagagaagcgcuguu

SEQ ID NO: 381336 - RNA, 21 nt, Homo sapiens
aaucccaagugucucuugacu

SEQ ID NO: 381337 - RNA, 23 nt, Homo sapiens
aaucccacccccacuucaugccc

SEQ ID NO: 381338 - RNA, 23 nt, Homo sapiens
aaucuaaaaauuuugcauuucau

SEQ ID NO: 381339 - RNA, 19 nt, Homo sapiens
aaucuagacauucuuuuaa

SEQ ID NO: 381340 - RNA, 23 nt, Homo sapiens
aaucuuggcuucuuaaaaacugu

SEQ ID NO: 381341 - RNA, 16 nt, Homo sapiens
aaugaucauaagucua

SEQ ID NO: 381342 - RNA, 18 nt, Homo sapiens
aaugccacauacuugcag

SEQ ID NO: 381343 - RNA, 16 nt, Homo sapiens
aaugugaucauaugag

SEQ ID NO: 381344 - RNA, 13 nt, Homo sapiens
aauguuuaaucuc

SEQ ID NO: 381345 - RNA, 15 nt, Homo sapiens
aauuaaaucuagaca

SEQ ID NO: 381346 - RNA, 20 nt, Homo sapiens
aauuaguguugugcacuuca

SEQ ID NO: 381347 - RNA, 18 nt, Homo sapiens
aauuauaaucucauuuca

SEQ ID NO: 381348 - RNA, 17 nt, Homo sapiens
aauuauauuguccuccc

SEQ ID NO: 381349 - RNA, 18 nt, Homo sapiens
aauugaguuucagaauaa

SEQ ID NO: 381350 - RNA, 20 nt, Homo sapiens
aauugcacuuuuaaaccucu

SEQ ID NO: 381351 - RNA, 22 nt, Homo sapiens
aauugcauacaacugugcauua

SEQ ID NO: 381352 - RNA, 15 nt, Homo sapiens
acaaaacaaacaaaa

SEQ ID NO: 381353 - RNA, 15 nt, Homo sapiens
acaaagauaugcuaa

SEQ ID NO: 381354 - RNA, 21 nt, Homo sapiens
acaaagcaaagccacauuuug

SEQ ID NO: 381355 - RNA, 14 nt, Homo sapiens
acaaguuugcuaaa

SEQ ID NO: 381356 - RNA, 19 nt, Homo sapiens
acaauaaaguuugcuuuca

SEQ ID NO: 381357 - RNA, 19 nt, Homo sapiens
acacauugacuccuuucca

SEQ ID NO: 381358 - RNA, 13 nt, Homo sapiens
acagagugcauug

SEQ ID NO: 381359 - RNA, 21 nt, Homo sapiens
acagccucccacccccaucuc

SEQ ID NO: 381360 - RNA, 23 nt, Homo sapiens
acauaaaugucuguauuucauuc

SEQ ID NO: 381361 - RNA, 20 nt, Homo sapiens
acauacagagguaacuauca

SEQ ID NO: 381362 - RNA, 18 nt, Homo sapiens
acauacuauucuuacuaa

SEQ ID NO: 381363 - RNA, 14 nt, Homo sapiens
acauauauguauau

SEQ ID NO: 381364 - RNA, 15 nt, Homo sapiens
acaucugcauuuuca

SEQ ID NO: 381365 - RNA, 13 nt, Homo sapiens
acaucuuuuacau

SEQ ID NO: 381366 - RNA, 19 nt, Homo sapiens
acaucuuuuacauucugca

SEQ ID NO: 381367 - RNA, 19 nt, Homo sapiens
acaugcccaaaacuuaucc

SEQ ID NO: 381368 - RNA, 20 nt, Homo sapiens
acauuccucugcagcacuuc

SEQ ID NO: 381369 - RNA, 15 nt, Homo sapiens
acauuuugcauuaga

SEQ ID NO: 381370 - RNA, 23 nt, Homo sapiens
acauuuugcauuagacagaugac

SEQ ID NO: 381371 - RNA, 23 nt, Homo sapiens
acauuuuguacaaagauaugcua

SEQ ID NO: 381372 - RNA, 19 nt, Homo sapiens
accagcucugaacuuccaa

SEQ ID NO: 381373 - RNA, 21 nt, Homo sapiens
accccaccugaccucugcaag

SEQ ID NO: 381374 - RNA, 23 nt, Homo sapiens
accuauggcccagccacugcagc

SEQ ID NO: 381375 - RNA, 16 nt, Homo sapiens
accuugaaagacauuu

SEQ ID NO: 381376 - RNA, 23 nt, Homo sapiens
acgguuucuccccggacacucgc

SEQ ID NO: 381377 - RNA, 20 nt, Homo sapiens
acuaaacagaaaacucccaa

SEQ ID NO: 381378 - RNA, 20 nt, Homo sapiens
acuaggugaacagcaggaug

SEQ ID NO: 381379 - RNA, 21 nt, Homo sapiens
acucaagaagcacaccuacag

SEQ ID NO: 381380 - RNA, 15 nt, Homo sapiens
acucaugaucaagau

SEQ ID NO: 381381 - RNA, 20 nt, Homo sapiens
acugccgaugcccaauccag

SEQ ID NO: 381382 - RNA, 20 nt, Homo sapiens
acuggucccaagguguaaag

SEQ ID NO: 381383 - RNA, 17 nt, Homo sapiens
acuuauugccaugugga

SEQ ID NO: 381384 - RNA, 12 nt, Homo sapiens
agaaaacaagua

SEQ ID NO: 381385 - RNA, 19 nt, Homo sapiens
agaagacauuugccaacag

SEQ ID NO: 381386 - RNA, 20 nt, Homo sapiens
agaagcacccaggacuucca

SEQ ID NO: 381387 - RNA, 18 nt, Homo sapiens
agacugggcaccccugcc

SEQ ID NO: 381388 - RNA, 21 nt, Homo sapiens
agacugggucucgcuuuguug

SEQ ID NO: 381389 - RNA, 19 nt, Homo sapiens
agacuguuucacauugcac

SEQ ID NO: 381390 - RNA, 11 nt, Homo sapiens
agagacucaga

SEQ ID NO: 381391 - RNA, 20 nt, Homo sapiens
agagauggggucucacagug

SEQ ID NO: 381392 - RNA, 15 nt, Homo sapiens
agaguucugcucuag

SEQ ID NO: 381393 - RNA, 12 nt, Homo sapiens
agauagugccuc

SEQ ID NO: 381394 - RNA, 16 nt, Homo sapiens
agauagugccucugca

SEQ ID NO: 381395 - RNA, 19 nt, Homo sapiens
agauauauagauauauauc

SEQ ID NO: 381396 - RNA, 20 nt, Homo sapiens
agaucagggauagcgcuguu

SEQ ID NO: 381397 - RNA, 21 nt, Homo sapiens
agauggggucucacaguguug

SEQ ID NO: 381398 - RNA, 22 nt, Homo sapiens
agauguaagaaauguucuugca

SEQ ID NO: 381399 - RNA, 23 nt, Homo sapiens
agauuauauaucauaaaguaugc

SEQ ID NO: 381400 - RNA, 23 nt, Homo sapiens
agauuguucuguccaguuuccaa

SEQ ID NO: 381401 - RNA, 18 nt, Homo sapiens
agcaaaaucaacaugacu

SEQ ID NO: 381402 - RNA, 14 nt, Homo sapiens
agcauguacuguac

SEQ ID NO: 381403 - RNA, 23 nt, Homo sapiens
agccaacuuuugcauguuuugua

SEQ ID NO: 381404 - RNA, 17 nt, Homo sapiens
agccacauuuugcauua

SEQ ID NO: 381405 - RNA, 21 nt, Homo sapiens
agccugcuuuuguccuguuau

SEQ ID NO: 381406 - RNA, 22 nt, Homo sapiens
agcuggaagggucaacaucuuu

SEQ ID NO: 381407 - RNA, 19 nt, Homo sapiens
agcuguuucaaaugugcau

SEQ ID NO: 381408 - RNA, 16 nt, Homo sapiens
aggaaaggaugaucaa

SEQ ID NO: 381409 - RNA, 21 nt, Homo sapiens
aggaaccacauauaacacuua

SEQ ID NO: 381410 - RNA, 16 nt, Homo sapiens
aggacuuccauuugcu

SEQ ID NO: 381411 - RNA, 13 nt, Homo sapiens
aggagaaacugag

SEQ ID NO: 381412 - RNA, 16 nt, Homo sapiens
aggagguggcuguuaa

SEQ ID NO: 381413 - RNA, 16 nt, Homo sapiens
aggagugacuaggugg

SEQ ID NO: 381414 - RNA, 22 nt, Homo sapiens
aggcgauccaccugucucagcc

SEQ ID NO: 381415 - RNA, 22 nt, Homo sapiens
agggaagcugucccucacuguu

SEQ ID NO: 381416 - RNA, 23 nt, Homo sapiens
agggcaacaauacaugcugcuaa

SEQ ID NO: 381417 - RNA, 18 nt, Homo sapiens
agggucuccaguguuccc

SEQ ID NO: 381418 - RNA, 23 nt, Homo sapiens
aggucaugaaggacacucugcag

SEQ ID NO: 381419 - RNA, 12 nt, Homo sapiens
aguaaaccacaa

SEQ ID NO: 381420 - RNA, 20 nt, Homo sapiens
ccaaggccggagacccacag

SEQ ID NO: 381421 - RNA, 16 nt, Homo sapiens
ccaagugccaauauuu

SEQ ID NO: 381422 - RNA, 16 nt, Homo sapiens
ccaagugucucuugac

SEQ ID NO: 381423 - RNA, 22 nt, Homo sapiens
ccacaauuacauacuauucuua

SEQ ID NO: 381424 - RNA, 20 nt, Homo sapiens
ccaccaucaaaggaauauaa

SEQ ID NO: 381425 - RNA, 18 nt, Homo sapiens
ccaccugaccucugcaag

SEQ ID NO: 381426 - RNA, 14 nt, Homo sapiens
ccagccacugcagc

SEQ ID NO: 381427 - RNA, 15 nt, Homo sapiens
ccagccacugcagca

SEQ ID NO: 381428 - RNA, 16 nt, Homo sapiens
ccaggcuggucucaaa

SEQ ID NO: 381429 - RNA, 23 nt, Homo sapiens
ccaugaagcuggcccucagcucc

SEQ ID NO: 381430 - RNA, 21 nt, Homo sapiens
ccauuuagcgaacaaccacag

SEQ ID NO: 381431 - RNA, 21 nt, Homo sapiens
cccaagauuuuuucauuucaa

SEQ ID NO: 381432 - RNA, 12 nt, Homo sapiens
cccaagccacag

SEQ ID NO: 381433 - RNA, 22 nt, Homo sapiens
cccacacccuggaggauuucau

SEQ ID NO: 381434 - RNA, 18 nt, Homo sapiens
cccagaagaagauggcug

SEQ ID NO: 381435 - RNA, 17 nt, Homo sapiens
ccccacccaccccacag

SEQ ID NO: 381436 - RNA, 18 nt, Homo sapiens
ccccagcauuacgauccc

SEQ ID NO: 381437 - RNA, 15 nt, Homo sapiens
ccccuggcagcacag

SEQ ID NO: 381438 - RNA, 12 nt, Homo sapiens
cccgaaaacccc

SEQ ID NO: 381439 - RNA, 14 nt, Homo sapiens
cccggcggggugcc

SEQ ID NO: 381440 - RNA, 15 nt, Homo sapiens
cccucacuguugaau

SEQ ID NO: 381441 - RNA, 21 nt, Homo sapiens
cccuggaauaaauuucgcaau

SEQ ID NO: 381442 - RNA, 12 nt, Homo sapiens
cccuugcugcaa

SEQ ID NO: 381443 - RNA, 21 nt, Homo sapiens
ccgagcuacaaagcaugggaa

SEQ ID NO: 381444 - RNA, 16 nt, Homo sapiens
ccggggcuccacugaa

SEQ ID NO: 381445 - RNA, 12 nt, Homo sapiens
ccuaugcaauaa

SEQ ID NO: 381446 - RNA, 19 nt, Homo sapiens
ccuaugcucugggugaaua

SEQ ID NO: 381447 - RNA, 19 nt, Homo sapiens
ccucugcgccucuccacug

SEQ ID NO: 381448 - RNA, 21 nt, Homo sapiens
ccucuucacccaccccaugga

SEQ ID NO: 381449 - RNA, 18 nt, Homo sapiens
ccugaaacaugugccccu

SEQ ID NO: 381450 - RNA, 18 nt, Homo sapiens
ccugaguucugacacugu

SEQ ID NO: 381451 - RNA, 23 nt, Homo sapiens
ccugcccaguuggaggagacugg

SEQ ID NO: 381452 - RNA, 18 nt, Homo sapiens
ccugccccuccccaaaag

SEQ ID NO: 381453 - RNA, 14 nt, Homo sapiens
ccuggccuaaagaa

SEQ ID NO: 381454 - RNA, 15 nt, Homo sapiens
ccuguccauaaagua

SEQ ID NO: 381455 - RNA, 18 nt, Homo sapiens
ccuuaaggaucaccccag

SEQ ID NO: 381456 - RNA, 20 nt, Homo sapiens
ccuugguuccuccccgaaaa

SEQ ID NO: 381457 - RNA, 13 nt, Homo sapiens
ccuuuccaauaga

SEQ ID NO: 381458 - RNA, 22 nt, Homo sapiens
ccuuucugcccagccugcucag

SEQ ID NO: 381459 - RNA, 22 nt, Homo sapiens
ccuuuugcaacaagacaaagca

SEQ ID NO: 381460 - RNA, 20 nt, Homo sapiens
cgaugaauguguugauuuga

SEQ ID NO: 381461 - RNA, 14 nt, Homo sapiens
cgcaggcccaguga

SEQ ID NO: 381462 - RNA, 22 nt, Homo sapiens
cgcuuucauguuacuguugcag

SEQ ID NO: 381463 - RNA, 15 nt, Homo sapiens
cgcuuuguugcccag

SEQ ID NO: 381464 - RNA, 16 nt, Homo sapiens
cgugauuuccagugag

SEQ ID NO: 381465 - RNA, 17 nt, Homo sapiens
cuaaaaggaaaucucac

SEQ ID NO: 381466 - RNA, 19 nt, Homo sapiens
cuaaaaugcuucacuguac

SEQ ID NO: 381467 - RNA, 11 nt, Homo sapiens
cuaaacuguau

SEQ ID NO: 381468 - RNA, 15 nt, Homo sapiens
cuaaagucacauaua

SEQ ID NO: 381469 - RNA, 21 nt, Homo sapiens
cuaaagucacauauaaaaguu

SEQ ID NO: 381470 - RNA, 18 nt, Homo sapiens
cuaaugaaagugaugaca

SEQ ID NO: 381471 - RNA, 16 nt, Homo sapiens
cuacaguaaugaaaug

SEQ ID NO: 381472 - RNA, 20 nt, Homo sapiens
cuaccaucucacggugggga

SEQ ID NO: 381473 - RNA, 22 nt, Homo sapiens
cuagaaucauacuuaacauuuc

SEQ ID NO: 381474 - RNA, 22 nt, Homo sapiens
cuagccaugauaacugcaauuu

SEQ ID NO: 381475 - RNA, 19 nt, Homo sapiens
cuauuuuaagacgugaaug

SEQ ID NO: 381476 - RNA, 14 nt, Homo sapiens
cucaguaccucccc

SEQ ID NO: 381477 - RNA, 21 nt, Homo sapiens
cucaugcaagacuucacugca

SEQ ID NO: 381478 - RNA, 22 nt, Homo sapiens
cucaugcaagacuucacugcag

SEQ ID NO: 381479 - RNA, 17 nt, Homo sapiens
cuccaggcaucacugau

SEQ ID NO: 381480 - RNA, 13 nt, Homo sapiens
cuccugggcucag

SEQ ID NO: 381481 - RNA, 20 nt, Homo sapiens
cucgguggcugcacagaagg

SEQ ID NO: 381482 - RNA, 12 nt, Homo sapiens
cucuaacuucaa

SEQ ID NO: 381483 - RNA, 19 nt, Homo sapiens
cucuacuugucauaucacu

SEQ ID NO: 381484 - RNA, 18 nt, Homo sapiens
cucuccacuguuucauga

SEQ ID NO: 381485 - RNA, 14 nt, Homo sapiens
cucucuguggcucc

SEQ ID NO: 381486 - RNA, 14 nt, Homo sapiens
cucugauagcuguu

SEQ ID NO: 381487 - RNA, 16 nt, Homo sapiens
cucuugacuggcucaa

SEQ ID NO: 381488 - RNA, 17 nt, Homo sapiens
cucuuguauaugaugau

SEQ ID NO: 381489 - RNA, 21 nt, Homo sapiens
cucuuguauaugaugaucugg

SEQ ID NO: 381490 - RNA, 19 nt, Homo sapiens
cugagguuuugaauaaaaa

SEQ ID NO: 381491 - RNA, 15 nt, Homo sapiens
cugauuccacuuuua

SEQ ID NO: 381492 - RNA, 22 nt, Homo sapiens
cugcagcuuggagaacuccgcu

SEQ ID NO: 381493 - RNA, 15 nt, Homo sapiens
cugcagguccgggga

SEQ ID NO: 381494 - RNA, 15 nt, Homo sapiens
cugccuccugccucc

SEQ ID NO: 381495 - RNA, 19 nt, Homo sapiens
cuggaggaaccacauauaa

SEQ ID NO: 381496 - RNA, 19 nt, Homo sapiens
cuggauggggagucucaug

SEQ ID NO: 381497 - RNA, 19 nt, Homo sapiens
cuggcauuugcaccuaccu

SEQ ID NO: 381498 - RNA, 21 nt, Homo sapiens
cuggggugcauccuccucagc

SEQ ID NO: 381499 - RNA, 17 nt, Homo sapiens
cuguccuugaaugccau

SEQ ID NO: 381500 - RNA, 17 nt, Homo sapiens
cugucuuuuauuuaaca

SEQ ID NO: 381501 - RNA, 16 nt, Homo sapiens
cugugcacccagaaga

SEQ ID NO: 381502 - RNA, 17 nt, Homo sapiens
cuguguaauauaaaaga

SEQ ID NO: 381503 - RNA, 16 nt, Homo sapiens
cuguguaucauuaaaa

SEQ ID NO: 381504 - RNA, 18 nt, Homo sapiens
cuuaaaauuagugagauu

SEQ ID NO: 381505 - RNA, 13 nt, Homo sapiens
cuuaacauuucau

SEQ ID NO: 381506 - RNA, 12 nt, Homo sapiens
cuuccauuugcu

SEQ ID NO: 381507 - RNA, 13 nt, Homo sapiens
cuugaaugccaua

SEQ ID NO: 381508 - RNA, 18 nt, Homo sapiens
cuugaaugccauagucaa

SEQ ID NO: 381509 - RNA, 20 nt, Homo sapiens
cuugagggugcuuguucccu

SEQ ID NO: 381510 - RNA, 17 nt, Homo sapiens
cuugcaguuaaggguua

SEQ ID NO: 381511 - RNA, 15 nt, Homo sapiens
cuguaaacuuggaau

SEQ ID NO: 381512 - RNA, 18 nt, Homo sapiens
cuguagcaauuggauaga

SEQ ID NO: 381513 - RNA, 21 nt, Homo sapiens
cuguauaaucuauuuacauaa

SEQ ID NO: 381514 - RNA, 14 nt, Homo sapiens
cuguauuucauucu

SEQ ID NO: 381515 - RNA, 18 nt, Homo sapiens
cugucauauaauuuugaa

SEQ ID NO: 381516 - RNA, 22 nt, Homo sapiens
cugugaaaugcuggcauuugca

SEQ ID NO: 381517 - RNA, 24 nt, Homo sapiens
cuguguguuugggaagguggguga

SEQ ID NO: 381518 - RNA, 17 nt, Homo sapiens
cuguuccauaguuaaag

SEQ ID NO: 381519 - RNA, 21 nt, Homo sapiens
gaaaacucaugaucaagauau

SEQ ID NO: 381520 - RNA, 16 nt, Homo sapiens
gaaaacucccaauaca

SEQ ID NO: 381521 - RNA, 20 nt, Homo sapiens
gaaaacucccaauacaaaga

SEQ ID NO: 381522 - RNA, 12 nt, Homo sapiens
gaaaaugcauua

SEQ ID NO: 381523 - RNA, 13 nt, Homo sapiens
gaaaaugcauuau

SEQ ID NO: 381524 - RNA, 20 nt, Homo sapiens
gaaaccuguccauaaaguaa

SEQ ID NO: 381525 - RNA, 17 nt, Homo sapiens
gaacagcaggaugcccu

SEQ ID NO: 381526 - RNA, 21 nt, Homo sapiens
gaaccauguugguugcacuuu

SEQ ID NO: 381527 - RNA, 20 nt, Homo sapiens
gaacugaaggcagcauguau

SEQ ID NO: 381528 - RNA, 12 nt, Homo sapiens
gaaggagaaaau

SEQ ID NO: 381529 - RNA, 14 nt, Homo sapiens
gaauaaaauugcac

SEQ ID NO: 381530 - RNA, 12 nt, Homo sapiens
gaaugucucagc

SEQ ID NO: 381531 - RNA, 22 nt, Homo sapiens
gaauuagggccccaacuacaca

SEQ ID NO: 381532 - RNA, 22 nt, Homo sapiens
gaauuauuguagacaugcccaa

SEQ ID NO: 381533 - RNA, 22 nt, Homo sapiens
gaauugaaggagaaaaugcauu

SEQ ID NO: 381534 - RNA, 15 nt, Homo sapiens
gacagaaaugcaauc

SEQ ID NO: 381535 - RNA, 23 nt, Homo sapiens
gacauaaaacuuuaaaaggcaac

SEQ ID NO: 381536 - RNA, 22 nt, Homo sapiens
gaccuuuauaucugucuuuuau

SEQ ID NO: 381537 - RNA, 23 nt, Homo sapiens
gacgguuucuccccggacacucg

SEQ ID NO: 381538 - RNA, 11 nt, Homo sapiens
gacuggcucaa

SEQ ID NO: 381539 - RNA, 17 nt, Homo sapiens
gacugguuaggacaaaa

SEQ ID NO: 381540 - RNA, 23 nt, Homo sapiens
gacuuacuuuccugugguuuuau

SEQ ID NO: 381541 - RNA, 20 nt, Homo sapiens
gacuuguuuuaugcucaggg

SEQ ID NO: 381542 - RNA, 19 nt, Homo sapiens
gagaaguugagcagguauc

SEQ ID NO: 381543 - RNA, 13 nt, Homo sapiens
gagacugcaaugu

SEQ ID NO: 381544 - RNA, 13 nt, Homo sapiens
gagacugggucuc

SEQ ID NO: 381545 - RNA, 14 nt, Homo sapiens
gaggagaaacugag

SEQ ID NO: 381546 - RNA, 21 nt, Homo sapiens
gaggccaagguuucccaguga

SEQ ID NO: 381547 - RNA, 14 nt, Homo sapiens
gauaacugcaauuu

SEQ ID NO: 381548 - RNA, 20 nt, Homo sapiens
gauauauguguauacauaca

SEQ ID NO: 381549 - RNA, 20 nt, Homo sapiens
gaucagagcuugaacacagg

SEQ ID NO: 381550 - RNA, 16 nt, Homo sapiens
gaugacuauuacuuuu

SEQ ID NO: 381551 - RNA, 22 nt, Homo sapiens
gauuguucuguccaguuuccaa

SEQ ID NO: 381552 - RNA, 22 nt, Homo sapiens
gauuuaauuuuuuaaacuguag

SEQ ID NO: 381553 - RNA, 13 nt, Homo sapiens
gauuuccagugag

SEQ ID NO: 381554 - RNA, 23 nt, Homo sapiens
gauuucucuacuugucauaucac

SEQ ID NO: 381555 - RNA, 19 nt, Homo sapiens
gauuugaggacugaagcug

SEQ ID NO: 381556 - RNA, 17 nt, Homo sapiens
gcaaaaucaacaugacu

SEQ ID NO: 381557 - RNA, 20 nt, Homo sapiens
gcaaauuucuauaaauuuaa

SEQ ID NO: 381558 - RNA, 16 nt, Homo sapiens
gcaagacuucacugca

SEQ ID NO: 381559 - RNA, 21 nt, Homo sapiens
gcaauugagggcuaaauccca

SEQ ID NO: 381560 - RNA, 22 nt, Homo sapiens
gcacaucugcauuuucacccca

SEQ ID NO: 381561 - RNA, 18 nt, Homo sapiens
gcaccagugccucagugc

SEQ ID NO: 381562 - RNA, 24 nt, Homo sapiens
gcaccagugccucagugcugcaau

SEQ ID NO: 381563 - RNA, 18 nt, Homo sapiens
gcaccccugccuccugcc

SEQ ID NO: 381564 - RNA, 12 nt, Homo sapiens
gcaggaugcccu

SEQ ID NO: 381565 - RNA, 19 nt, Homo sapiens
gcaguccugccucagccuc

SEQ ID NO: 381566 - RNA, 17 nt, Homo sapiens
gcaucauuaauaccuaa

SEQ ID NO: 381567 - RNA, 18 nt, Homo sapiens
gccacuaaguacagcuga

SEQ ID NO: 381568 - RNA, 17 nt, Homo sapiens
gccacugcagcacagga

SEQ ID NO: 381569 - RNA, 22 nt, Homo sapiens
gccaugauaacugcaauuuuaa

SEQ ID NO: 381570 - RNA, 22 nt, Homo sapiens
gccauuuuggguuuugggucuu

SEQ ID NO: 381571 - RNA, 18 nt, Homo sapiens
gcccacugccgaugccca

SEQ ID NO: 381572 - RNA, 14 nt, Homo sapiens
gcccagccacugca

SEQ ID NO: 381573 - RNA, 15 nt, Homo sapiens
gcccagccacugcag

SEQ ID NO: 381574 - RNA, 23 nt, Homo sapiens
gcccagggguggggcccaugggg

SEQ ID NO: 381575 - RNA, 20 nt, Homo sapiens
gcccaguuggaggagacugg

SEQ ID NO: 381576 - RNA, 23 nt, Homo sapiens
gccccugaguucugacacugugu

SEQ ID NO: 381577 - RNA, 13 nt, Homo sapiens
gcccuucuacccc

SEQ ID NO: 381578 - RNA, 14 nt, Homo sapiens
gccgggacuggggg

SEQ ID NO: 381579 - RNA, 22 nt, Homo sapiens
gccgugcucgcccacaaacuga

SEQ ID NO: 381580 - RNA, 22 nt, Homo sapiens
gccuagauaugaauauauggca

SEQ ID NO: 381581 - RNA, 21 nt, Homo sapiens
gccucuccacuguuucaugag

SEQ ID NO: 381582 - RNA, 18 nt, Homo sapiens
gccucugcaaacuaagga

SEQ ID NO: 381583 - RNA, 16 nt, Homo sapiens
gccuugaaaccaccuu

SEQ ID NO: 381584 - RNA, 14 nt, Homo sapiens
gccuuucacaggac

SEQ ID NO: 381585 - RNA, 14 nt, Homo sapiens
gcgaacaaccacag

SEQ ID NO: 381586 - RNA, 13 nt, Homo sapiens
gcgagguguaaag

SEQ ID NO: 381587 - RNA, 22 nt, Homo sapiens
gcgauccaccugucucagccuc

SEQ ID NO: 381588 - RNA, 18 nt, Homo sapiens
gcuaaaucccaagugucu

SEQ ID NO: 381589 - RNA, 13 nt, Homo sapiens
gcucaggugcaag

SEQ ID NO: 381590 - RNA, 15 nt, Homo sapiens
gcucgagcaguccug

SEQ ID NO: 381591 - RNA, 17 nt, Homo sapiens
gcucgcccacaaacuga

SEQ ID NO: 381592 - RNA, 16 nt, Homo sapiens
gcucuauuaagauuuc

SEQ ID NO: 381593 - RNA, 22 nt, Homo sapiens
gcugcaaaauuaaaucuagaca

SEQ ID NO: 381594 - RNA, 18 nt, Homo sapiens
gcugcaaacccaugaagc

SEQ ID NO: 381595 - RNA, 19 nt, Homo sapiens
gcugguauuuaucugcaag

SEQ ID NO: 381596 - RNA, 21 nt, Homo sapiens
gcugguauuuaucugcaaggu

SEQ ID NO: 381597 - RNA, 14 nt, Homo sapiens
gcuuguuccaaugc

SEQ ID NO: 381598 - RNA, 14 nt, Homo sapiens
ggaaauuagucuuu

SEQ ID NO: 381599 - RNA, 11 nt, Homo sapiens
ggaagggucaa

SEQ ID NO: 381600 - RNA, 17 nt, Homo sapiens
ggaauguguccaagaca

SEQ ID NO: 381601 - RNA, 15 nt, Homo sapiens
ggacuuccauuugcu

SEQ ID NO: 381602 - RNA, 20 nt, Homo sapiens
ggaggcuccgugagcccuug

SEQ ID NO: 381603 - RNA, 15 nt, Homo sapiens
ggagguggcuguuaa

SEQ ID NO: 381604 - RNA, 16 nt, Homo sapiens
ggaguaggacauacca

SEQ ID NO: 381605 - RNA, 17 nt, Homo sapiens
ggcccacuucaccguac

SEQ ID NO: 381606 - RNA, 20 nt, Homo sapiens
ggcccagccacugcagcaca

SEQ ID NO: 381607 - RNA, 21 nt, Homo sapiens
ggcccagugacaaagacuccu

SEQ ID NO: 381608 - RNA, 13 nt, Homo sapiens
ggccugggcgggg

SEQ ID NO: 381609 - RNA, 12 nt, Homo sapiens
ggcgugaucuug

SEQ ID NO: 381610 - RNA, 11 nt, Homo sapiens
gggacuggggg

SEQ ID NO: 381611 - RNA, 19 nt, Homo sapiens
gggauucccuggugggccu

SEQ ID NO: 381612 - RNA, 16 nt, Homo sapiens
guaaaauccaaagaac

SEQ ID NO: 381613 - RNA, 19 nt, Homo sapiens
guaauuuugugaaagaagg

SEQ ID NO: 381614 - RNA, 22 nt, Homo sapiens
guagagggaguugucaagucuc

SEQ ID NO: 381615 - RNA, 14 nt, Homo sapiens
guaguagugucuuc

SEQ ID NO: 381616 - RNA, 19 nt, Homo sapiens
guauaaugguguuacuaaa

SEQ ID NO: 381617 - RNA, 15 nt, Homo sapiens
guauguuauugcaua

SEQ ID NO: 381618 - RNA, 15 nt, Homo sapiens
gucaauagcaugcaa

SEQ ID NO: 381619 - RNA, 20 nt, Homo sapiens
gucccggggcuccacugaac

SEQ ID NO: 381620 - RNA, 17 nt, Homo sapiens
guccuaggucaugaagg

SEQ ID NO: 381621 - RNA, 20 nt, Homo sapiens
guccuaggucaugaaggaca

SEQ ID NO: 381622 - RNA, 13 nt, Homo sapiens
guccuaugcaaua

SEQ ID NO: 381623 - RNA, 17 nt, Homo sapiens
gucgucaaguugcagau

SEQ ID NO: 381624 - RNA, 24 nt, Homo sapiens
gucucaugcaagacuucacugcag

SEQ ID NO: 381625 - RNA, 18 nt, Homo sapiens
gucucuugacuggcucaa

SEQ ID NO: 381626 - RNA, 15 nt, Homo sapiens
gucugggguaaaauu

SEQ ID NO: 381627 - RNA, 19 nt, Homo sapiens
gugaaaugcuggcauuugc

SEQ ID NO: 381628 - RNA, 17 nt, Homo sapiens
gugcagaagaauccgag

SEQ ID NO: 381629 - RNA, 18 nt, Homo sapiens
gugccaauauuucugaua

SEQ ID NO: 381630 - RNA, 21 nt, Homo sapiens
gugccucagugcugcaauuga

SEQ ID NO: 381631 - RNA, 15 nt, Homo sapiens
guguccuaugcaaua

SEQ ID NO: 381632 - RNA, 19 nt, Homo sapiens
guguguuugugugcaugaa

SEQ ID NO: 381633 - RNA, 17 nt, Homo sapiens
guuaaacuacuuguaaa

SEQ ID NO: 381634 - RNA, 15 nt, Homo sapiens
guuauuuuaauuauc

SEQ ID NO: 381635 - RNA, 16 nt, Homo sapiens
guuccaggauguggaa

SEQ ID NO: 381636 - RNA, 22 nt, Homo sapiens
guucuauaauaaguuuugauau

SEQ ID NO: 381637 - RNA, 20 nt, Homo sapiens
guuggggacccccucaggau

SEQ ID NO: 381638 - RNA, 19 nt, Homo sapiens
guuguucgccgcguggaau

SEQ ID NO: 381639 - RNA, 16 nt, Homo sapiens
guuuaaaaaaaguaua

SEQ ID NO: 381640 - RNA, 17 nt, Homo sapiens
guuuaaaaaaaguauau

SEQ ID NO: 381641 - RNA, 13 nt, Homo sapiens
guuucccagugag

SEQ ID NO: 381642 - RNA, 21 nt, Homo sapiens
guuucucggcaccagugccuc

SEQ ID NO: 381643 - RNA, 23 nt, Homo sapiens
guuuuguagagauggggucucac

SEQ ID NO: 381644 - RNA, 22 nt, Homo sapiens
uaaaaauauaaauuguacauuu

SEQ ID NO: 381645 - RNA, 14 nt, Homo sapiens
uaaaagaucuugca

SEQ ID NO: 381646 - RNA, 15 nt, Homo sapiens
uaaaagugcauuuaa

SEQ ID NO: 381647 - RNA, 17 nt, Homo sapiens
uaaaauuagugagauua

SEQ ID NO: 381648 - RNA, 20 nt, Homo sapiens
uaaacuuggaaucaagguaa

SEQ ID NO: 381649 - RNA, 21 nt, Homo sapiens
uaaagaaauaauuuuauucca

SEQ ID NO: 381650 - RNA, 18 nt, Homo sapiens
uaaaguaauuuugugaaa

SEQ ID NO: 381651 - RNA, 19 nt, Homo sapiens
uaaaguauguuauugcaua

SEQ ID NO: 381652 - RNA, 15 nt, Homo sapiens
uaaaucccaaguguc

SEQ ID NO: 381653 - RNA, 21 nt, Homo sapiens
uaacauuccuaaaaugcuuca

SEQ ID NO: 381654 - RNA, 13 nt, Homo sapiens
uaacuucaaauau

SEQ ID NO: 381655 - RNA, 16 nt, Homo sapiens
uaagaauaauugaaca

SEQ ID NO: 381656 - RNA, 21 nt, Homo sapiens
uaagaauaauugaacaauaaa

SEQ ID NO: 381657 - RNA, 13 nt, Homo sapiens
uaagacacauuga

SEQ ID NO: 381658 - RNA, 14 nt, Homo sapiens
uaagacacauugac

SEQ ID NO: 381659 - RNA, 18 nt, Homo sapiens
uaagcuucuagacacucc

SEQ ID NO: 381660 - RNA, 21 nt, Homo sapiens
uaaggcuuguuccaaugccac

SEQ ID NO: 381661 - RNA, 15 nt, Homo sapiens
uaaguggacuggugu

SEQ ID NO: 381662 - RNA, 20 nt, Homo sapiens
uaaguggacuggugucauaa

SEQ ID NO: 381663 - RNA, 23 nt, Homo sapiens
uaauaaguuuugauauaaucuug

SEQ ID NO: 381664 - RNA, 17 nt, Homo sapiens
uaauaccuaaacuguau

SEQ ID NO: 381665 - RNA, 17 nt, Homo sapiens
uaauccaucacuagcca

SEQ ID NO: 381666 - RNA, 20 nt, Homo sapiens
uaauuaacuguaaacuugga

SEQ ID NO: 381667 - RNA, 16 nt, Homo sapiens
uacaaagauaugcuaa

SEQ ID NO: 381668 - RNA, 13 nt, Homo sapiens
uacaaguuugcua

SEQ ID NO: 381669 - RNA, 21 nt, Homo sapiens
uacaauaaaacuuugcugcca

SEQ ID NO: 381670 - RNA, 20 nt, Homo sapiens
uacaaucgagacugcaaugu

SEQ ID NO: 381671 - RNA, 11 nt, Homo sapiens
uacaauuguga

SEQ ID NO: 381672 - RNA, 12 nt, Homo sapiens
uacaauugugag

SEQ ID NO: 381673 - RNA, 15 nt, Homo sapiens
uacagaaugcauuaa

SEQ ID NO: 381674 - RNA, 21 nt, Homo sapiens
uacauguuuauauuaaucucu

SEQ ID NO: 381675 - RNA, 20 nt, Homo sapiens
uacauucugcaagcacaucu

SEQ ID NO: 381676 - RNA, 22 nt, Homo sapiens
uacauucugcaagcacaucugc

SEQ ID NO: 381677 - RNA, 16 nt, Homo sapiens
uaccuaaugaaaguga

SEQ ID NO: 381678 - RNA, 23 nt, Homo sapiens
uaccucacagagugcauugugag

SEQ ID NO: 381679 - RNA, 18 nt, Homo sapiens
uacgaucccccaaguguc

SEQ ID NO: 381680 - RNA, 18 nt, Homo sapiens
uacuaaagucacauauaa

SEQ ID NO: 381681 - RNA, 19 nt, Homo sapiens
uacuauucuuacuaaucug

SEQ ID NO: 381682 - RNA, 14 nt, Homo sapiens
uacuuaacauuuca

SEQ ID NO: 381683 - RNA, 16 nt, Homo sapiens
uacuucccaauugcca

SEQ ID NO: 381684 - RNA, 14 nt, Homo sapiens
uacuugucauauca

SEQ ID NO: 381685 - RNA, 21 nt, Homo sapiens
uacuugucauaucacuaaaua

SEQ ID NO: 381686 - RNA, 21 nt, Homo sapiens
uagacuguuucacauugcacu

SEQ ID NO: 381687 - RNA, 22 nt, Homo sapiens
uagagauggggucucacagugu

SEQ ID NO: 381688 - RNA, 18 nt, Homo sapiens
uaggaacaguaaaaucca

SEQ ID NO: 381689 - RNA, 15 nt, Homo sapiens
uaggaagacauaaaa

SEQ ID NO: 381690 - RNA, 14 nt, Homo sapiens
uaggucaugaagga

SEQ ID NO: 381691 - RNA, 13 nt, Homo sapiens
uaguagugucuuc

SEQ ID NO: 381692 - RNA, 14 nt, Homo sapiens
uagugcaauuccaa

SEQ ID NO: 381693 - RNA, 17 nt, Homo sapiens
uauaauaaaaagcuuca

SEQ ID NO: 381694 - RNA, 15 nt, Homo sapiens
uauacauacauguau

SEQ ID NO: 381695 - RNA, 17 nt, Homo sapiens
uauauaguuugugguaa

SEQ ID NO: 381696 - RNA, 19 nt, Homo sapiens
uauauauucuacacauaua

SEQ ID NO: 381697 - RNA, 18 nt, Homo sapiens
uauauguguauacauaca

SEQ ID NO: 381698 - RNA, 23 nt, Homo sapiens
uaugaacugaaggcagcauguau

SEQ ID NO: 381699 - RNA, 15 nt, Homo sapiens
uaugaggaccuuuau

SEQ ID NO: 381700 - RNA, 20 nt, Homo sapiens
uaugaucagagcuugaacac

SEQ ID NO: 381701 - RNA, 22 nt, Homo sapiens
uaugcucagggucaauuucuuu

SEQ ID NO: 381702 - RNA, 17 nt, Homo sapiens
uaugcucugggugaaua

SEQ ID NO: 381703 - RNA, 19 nt, Homo sapiens
ucagugaagucuagaauca

SEQ ID NO: 381704 - RNA, 23 nt, Homo sapiens
ucauacuuaacauuucauuguac

SEQ ID NO: 381705 - RNA, 17 nt, Homo sapiens
ucauagcccucagacau

SEQ ID NO: 381706 - RNA, 22 nt, Homo sapiens
ucaugcaagacuucacugcagc

SEQ ID NO: 381707 - RNA, 18 nt, Homo sapiens
ucauuaaucaauuucuca

SEQ ID NO: 381708 - RNA, 17 nt, Homo sapiens
ucauuguacaaguauua

SEQ ID NO: 381709 - RNA, 20 nt, Homo sapiens
ugugcaugaaagagaaagac

SEQ ID NO: 381710 - RNA, 14 nt, Homo sapiens
uguguauacauaca

SEQ ID NO: 381711 - RNA, 22 nt, Homo sapiens
uguuauuucuuaaaauucagug

SEQ ID NO: 381712 - RNA, 18 nt, Homo sapiens
uguuauuuuuuauuucca

SEQ ID NO: 381713 - RNA, 15 nt, Homo sapiens
uguuccccccauaga

SEQ ID NO: 381714 - RNA, 21 nt, Homo sapiens
uguucuguccaguuuccaaag

SEQ ID NO: 381715 - RNA, 21 nt, Homo sapiens
uguugcccaggcuggucucaa

SEQ ID NO: 381716 - RNA, 15 nt, Homo sapiens
uguuucacauugcac

SEQ ID NO: 381717 - RNA, 22 nt, Homo sapiens
uguuuucaauguuucacuacuc

SEQ ID NO: 381718 - RNA, 14 nt, Homo sapiens
uuaaaaaaacugaa

SEQ ID NO: 381719 - RNA, 11 nt, Homo sapiens
uuaaacuguag

SEQ ID NO: 381720 - RNA, 11 nt, Homo sapiens
uuaaaguauuu

SEQ ID NO: 381721 - RNA, 11 nt, Homo sapiens
uuaacuaugaa

SEQ ID NO: 381722 - RNA, 17 nt, Homo sapiens
uuaacuaugaacugaag

SEQ ID NO: 381723 - RNA, 23 nt, Homo sapiens
uuaagaaagagaaugaacugugg

SEQ ID NO: 381724 - RNA, 18 nt, Homo sapiens
uuacuaaagucacauaua

SEQ ID NO: 381725 - RNA, 19 nt, Homo sapiens
uuaguguuugaaauugaau

SEQ ID NO: 381726 - RNA, 23 nt, Homo sapiens
uuauaaaagaauaaaauugcacu

SEQ ID NO: 381727 - RNA, 15 nt, Homo sapiens
uuauagguuuccacu

SEQ ID NO: 381728 - RNA, 21 nt, Homo sapiens
uuaucugcaagguuguaguca

SEQ ID NO: 381729 - RNA, 16 nt, Homo sapiens
uuauugaaaaaucagu

SEQ ID NO: 381730 - RNA, 11 nt, Homo sapiens
uuauuuccaca

SEQ ID NO: 381731 - RNA, 18 nt, Homo sapiens
uucaacaugacauccaga

SEQ ID NO: 381732 - RNA, 13 nt, Homo sapiens
uucacauugcacu

SEQ ID NO: 381733 - RNA, 20 nt, Homo sapiens
uucaccaugagggaagaaua

SEQ ID NO: 381734 - RNA, 11 nt, Homo sapiens
uucaucucuug

SEQ ID NO: 381735 - RNA, 23 nt, Homo sapiens
uuccaagaaaauaucacuguaau

SEQ ID NO: 381736 - RNA, 19 nt, Homo sapiens
uuccauaguuaaagaagac

SEQ ID NO: 381737 - RNA, 21 nt, Homo sapiens
uuccuaaaagagaauggaaaa

SEQ ID NO: 381738 - RNA, 13 nt, Homo sapiens
uucuagacacucc

SEQ ID NO: 381739 - RNA, 20 nt, Homo sapiens
uugaaggagaaaaugcauua

SEQ ID NO: 381740 - RNA, 21 nt, Homo sapiens
uugaaggagaaaaugcauuau

SEQ ID NO: 381741 - RNA, 16 nt, Homo sapiens
uugacuggcucaagaa

SEQ ID NO: 381742 - RNA, 20 nt, Homo sapiens
uugauacaucaucgggaaaa

SEQ ID NO: 381743 - RNA, 19 nt, Homo sapiens
uugauuuaauaucugagaa

SEQ ID NO: 381744 - RNA, 14 nt, Homo sapiens
uugcacucaucaua

SEQ ID NO: 381745 - RNA, 16 nt, Homo sapiens
uugcauuucaugcuau

SEQ ID NO: 381746 - RNA, 13 nt, Homo sapiens
uugccauguggac

SEQ ID NO: 381747 - RNA, 22 nt, Homo sapiens
uugccauuuagcgaacaaccac

SEQ ID NO: 381748 - RNA, 21 nt, Homo sapiens
uugcugcaaacccaugaagcu

SEQ ID NO: 381749 - RNA, 21 nt, Homo sapiens
uugcuuuugaaggaauacaau

SEQ ID NO: 381750 - RNA, 18 nt, Homo sapiens
uuggcuuuuguuacccac

SEQ ID NO: 381751 - RNA, 13 nt, Homo sapiens
uugggucuuugaa

SEQ ID NO: 381752 - RNA, 16 nt, Homo sapiens
uuguaacuucaaauau

SEQ ID NO: 381753 - RNA, 21 nt, Homo sapiens
uuguagagauggggucucaca

SEQ ID NO: 381754 - RNA, 23 nt, Homo sapiens
uugugaaagaaggagcaagagaa

SEQ ID NO: 381755 - RNA, 18 nt, Homo sapiens
uugugcacuucaugucau

SEQ ID NO: 381756 - RNA, 22 nt, Homo sapiens
uuguucgccgcguggaauguga

SEQ ID NO: 381757 - RNA, 14 nt, Homo sapiens
uuguugcugucaag

SEQ ID NO: 381758 - RNA, 16 nt, Homo sapiens
uuguugcugucaagau

SEQ ID NO: 381759 - RNA, 21 nt, Homo sapiens
uuuaaaagagacaaacuguaa

SEQ ID NO: 381760 - RNA, 11 nt, Homo sapiens
uuuaaacugua

SEQ ID NO: 381761 - RNA, 20 nt, Homo sapiens
uuuaaaguauguuauugcau

SEQ ID NO: 381762 - RNA, 16 nt, Homo sapiens
uuuaaauaaagacaaa

SEQ ID NO: 381763 - RNA, 22 nt, Homo sapiens
uuuaaggagauugggagacaau

SEQ ID NO: 381764 - RNA, 12 nt, Homo sapiens
uuuaauuaucuu

SEQ ID NO: 381765 - RNA, 14 nt, Homo sapiens
uuuauauauuggaa

SEQ ID NO: 381766 - RNA, 16 nt, Homo sapiens
uuucaaaaugcuucaa

SEQ ID NO: 381767 - RNA, 19 nt, Homo sapiens
uuucaaauuauaaucucau

SEQ ID NO: 381768 - RNA, 14 nt, Homo sapiens
uuucauucuuguug

SEQ ID NO: 381769 - RNA, 21 nt, Homo sapiens
uuuccacauaaagguauuuag

SEQ ID NO: 381770 - RNA, 21 nt, Homo sapiens
uuuccacugccaaaacaaugc

SEQ ID NO: 381771 - RNA, 19 nt, Homo sapiens
uuuccagugaguguaaaua

SEQ ID NO: 381772 - RNA, 19 nt, Homo sapiens
uuucuaaagcucugaacaa

SEQ ID NO: 381773 - RNA, 20 nt, Homo sapiens
uuucucggcaccagugccuc

SEQ ID NO: 381774 - RNA, 21 nt, Homo sapiens
uuucuuaauauuuuuacaugc

SEQ ID NO: 381775 - RNA, 21 nt, Homo sapiens
uuugaaaaauauugcuaaaag

SEQ ID NO: 381776 - RNA, 14 nt, Homo sapiens
uuugaaaaguaaaa

SEQ ID NO: 381777 - RNA, 19 nt, Homo sapiens
uuugaacccuugcuugcaa

SEQ ID NO: 381778 - RNA, 22 nt, Homo sapiens
uuuuaaaguauguuauugcaua

SEQ ID NO: 381779 - RNA, 12 nt, Homo sapiens
uuuuaauugauu

SEQ ID NO: 381780 - RNA, 15 nt, Homo sapiens
uuuuacacacugaaa

SEQ ID NO: 381781 - RNA, 19 nt, Homo sapiens
uuuuaggaaaggaugauca

SEQ ID NO: 381782 - RNA, 20 nt, Homo sapiens
uuuucaaauuauaaucucau

SEQ ID NO: 381783 - RNA, 22 nt, Homo sapiens
uuuuucuuugagacugggucuc

SEQ ID NO: 381784 - RNA, 21 nt, Homo sapiens
uuuuuguacuuuucugguucc

SEQ ID NO: 381785 - RNA, 15 nt, Homo sapiens
uuauucugauuccac

SEQ ID NO: 381786 - RNA, 16 nt, Homo sapiens
uuauucugugguucua

SEQ ID NO: 381787 - RNA, 12 nt, Homo sapiens
uucaacaugaca

SEQ ID NO: 381788 - RNA, 14 nt, Homo sapiens
uuccaagugccaau

SEQ ID NO: 381789 - RNA, 16 nt, Homo sapiens
uuccagacagucacaa

SEQ ID NO: 381790 - RNA, 12 nt, Homo sapiens
uuccccacugac

SEQ ID NO: 381791 - RNA, 20 nt, Homo sapiens
uuccuaaaagagaauggaaa

SEQ ID NO: 381792 - RNA, 20 nt, Homo sapiens
uucgaaaccuguccauaaag

SEQ ID NO: 381793 - RNA, 20 nt, Homo sapiens
gcuaaaucccaagugucucu

SEQ ID NO: 381794 - RNA, 18 nt, Homo sapiens
gcucuacccugcagcuug

SEQ ID NO: 381795 - RNA, 17 nt, Homo sapiens
gcugcuuggagugcccc

SEQ ID NO: 381796 - RNA, 18 nt, Homo sapiens
gcuggauggggagucuca

SEQ ID NO: 381797 - RNA, 15 nt, Homo sapiens
gcuggcccagccaaa

SEQ ID NO: 381798 - RNA, 15 nt, Homo sapiens
gcuucuagacacucc

SEQ ID NO: 381799 - RNA, 17 nt, Homo sapiens
gcuuuuguuuugcuuac

SEQ ID NO: 381800 - RNA, 16 nt, Homo sapiens
ggaagcugucccucac

SEQ ID NO: 381801 - RNA, 18 nt, Homo sapiens
ggaaugacuuacuuuccu

SEQ ID NO: 381802 - RNA, 15 nt, Homo sapiens
ggaauugcauacaac

SEQ ID NO: 381803 - RNA, 22 nt, Homo sapiens
ggacuggugucauaaacuuucu

SEQ ID NO: 381804 - RNA, 23 nt, Homo sapiens
ggcaacaauacaugcugcuaauu

SEQ ID NO: 381805 - RNA, 11 nt, Homo sapiens
ggcauuugcag

SEQ ID NO: 381806 - RNA, 22 nt, Homo sapiens
ggccaggugagguccaccggcc

SEQ ID NO: 381807 - RNA, 18 nt, Homo sapiens
ggcccagccacugcagca

SEQ ID NO: 381808 - RNA, 15 nt, Homo sapiens
ggccugcacuggugu

SEQ ID NO: 381809 - RNA, 19 nt, Homo sapiens
ggcgagcucuggcuuugca

SEQ ID NO: 381810 - RNA, 16 nt, Homo sapiens
ggcuccgcaugguuca

SEQ ID NO: 381811 - RNA, 21 nt, Homo sapiens
ggcugcucgaagaacaauguc

SEQ ID NO: 381812 - RNA, 19 nt, Homo sapiens
ggcugguauuuaucugcaa

SEQ ID NO: 381813 - RNA, 20 nt, Homo sapiens
gggaguaggacauaccagcu

SEQ ID NO: 381814 - RNA, 13 nt, Homo sapiens
gggucaacaucuu

SEQ ID NO: 381815 - RNA, 21 nt, Homo sapiens
gggucucgcuuuguugcccag

SEQ ID NO: 381816 - RNA, 20 nt, Homo sapiens
ggucucacaguguugcccag

SEQ ID NO: 381817 - RNA, 23 nt, Homo sapiens
ggugaacagcaggaugcccuguu

SEQ ID NO: 381818 - RNA, 19 nt, Homo sapiens
guauuauaauuguugauau

SEQ ID NO: 381819 - RNA, 16 nt, Homo sapiens
guccuugaaugccaua

SEQ ID NO: 381820 - RNA, 22 nt, Homo sapiens
gucuaaauaaaugaaguauuuc

SEQ ID NO: 381821 - RNA, 17 nt, Homo sapiens
gucuaucuaaugacaug

SEQ ID NO: 381822 - RNA, 13 nt, Homo sapiens
gucucgcuuuguu

SEQ ID NO: 381823 - RNA, 14 nt, Homo sapiens
gugaaaugcuggca

SEQ ID NO: 381824 - RNA, 15 nt, Homo sapiens
gugauuuccagugag

SEQ ID NO: 381825 - RNA, 17 nt, Homo sapiens
gugcuacacuugcaccu

SEQ ID NO: 381826 - RNA, 20 nt, Homo sapiens
guggggaccgggcucugaca

SEQ ID NO: 381827 - RNA, 18 nt, Homo sapiens
guguauuagucauaaaac

SEQ ID NO: 381828 - RNA, 18 nt, Homo sapiens
guuaaggguuaguuuaca

SEQ ID NO: 381829 - RNA, 17 nt, Homo sapiens
guuacaaguuugcuaaa

SEQ ID NO: 381830 - RNA, 19 nt, Homo sapiens
guuacuaaagucacauaua

SEQ ID NO: 381831 - RNA, 18 nt, Homo sapiens
guuauuucuuaaaauuca

SEQ ID NO: 381832 - RNA, 13 nt, Homo sapiens
guuccccacugac

SEQ ID NO: 381833 - RNA, 20 nt, Homo sapiens
guuccccacugacagccucc

SEQ ID NO: 381834 - RNA, 21 nt, Homo sapiens
guucgccgcguggaaugugag

SEQ ID NO: 381835 - RNA, 20 nt, Homo sapiens
guuuacaguuuguguuuuaa

SEQ ID NO: 381836 - RNA, 16 nt, Homo sapiens
guuucaugagcccaaa

SEQ ID NO: 381837 - RNA, 13 nt, Homo sapiens
guuuucuaaagua

SEQ ID NO: 381838 - RNA, 13 nt, Homo sapiens
guuuuuacuguga

SEQ ID NO: 381839 - RNA, 17 nt, Homo sapiens
uaaaaagcuucagggaa

SEQ ID NO: 381840 - RNA, 19 nt, Homo sapiens
uaaaaauauaaauuguaca

SEQ ID NO: 381841 - RNA, 22 nt, Homo sapiens
uaaaagaauaaaauugcacuuu

SEQ ID NO: 381842 - RNA, 23 nt, Homo sapiens
uaaaaggauguuacaaguuugcu

SEQ ID NO: 381843 - RNA, 16 nt, Homo sapiens
uaaaauauuauuugau

SEQ ID NO: 381844 - RNA, 18 nt, Homo sapiens
uaaaaugcuucacuguac

SEQ ID NO: 381845 - RNA, 18 nt, Homo sapiens
uaaaauuaggaacaguaa

SEQ ID NO: 381846 - RNA, 15 nt, Homo sapiens
uaaacuacuuguaaa

SEQ ID NO: 381847 - RNA, 18 nt, Homo sapiens
uaaagaagacauuugcca

SEQ ID NO: 381848 - RNA, 19 nt, Homo sapiens
uaaauaaccucuggcccuu

SEQ ID NO: 381849 - RNA, 21 nt, Homo sapiens
uaaauuuugaaaacugugcaa

SEQ ID NO: 381850 - RNA, 17 nt, Homo sapiens
uaacauuucauuguaca

SEQ ID NO: 381851 - RNA, 12 nt, Homo sapiens
uaacucuacugu

SEQ ID NO: 381852 - RNA, 17 nt, Homo sapiens
uaagaaacacaaugcca

SEQ ID NO: 381853 - RNA, 22 nt, Homo sapiens
uaaguuuaauuaucugcauuua

SEQ ID NO: 381854 - RNA, 16 nt, Homo sapiens
uaaucugagaguuuuc

SEQ ID NO: 381855 - RNA, 21 nt, Homo sapiens
uaauugauuauucugauucca

SEQ ID NO: 381856 - RNA, 18 nt, Homo sapiens
uaauuuuuuaaacuguag

SEQ ID NO: 381857 - RNA, 14 nt, Homo sapiens
uacaaguuugcuaa

SEQ ID NO: 381858 - RNA, 18 nt, Homo sapiens
uacaaguuugcuaaaaga

SEQ ID NO: 381859 - RNA, 18 nt, Homo sapiens
uacaaucgagacugcaau

SEQ ID NO: 381860 - RNA, 13 nt, Homo sapiens
uacaauugugagc

SEQ ID NO: 381861 - RNA, 18 nt, Homo sapiens
uacacuaggaaacguguu

SEQ ID NO: 381862 - RNA, 11 nt, Homo sapiens
uacaucuggcc

SEQ ID NO: 381863 - RNA, 15 nt, Homo sapiens
uacauguaauccauc

SEQ ID NO: 381864 - RNA, 16 nt, Homo sapiens
uaccaaaugagcauua

SEQ ID NO: 381865 - RNA, 14 nt, Homo sapiens
uaccuaaacuguau

SEQ ID NO: 381866 - RNA, 17 nt, Homo sapiens
uaccuccuguguggaag

SEQ ID NO: 381867 - RNA, 16 nt, Homo sapiens
uacuuguaaaggugcu

SEQ ID NO: 381868 - RNA, 20 nt, Homo sapiens
uacuuuucagaauugaagga

SEQ ID NO: 381869 - RNA, 14 nt, Homo sapiens
uagacuguuucaca

SEQ ID NO: 381870 - RNA, 19 nt, Homo sapiens
uagacuguuucacauugca

SEQ ID NO: 381871 - RNA, 12 nt, Homo sapiens
uagaggagcaac

SEQ ID NO: 381872 - RNA, 17 nt, Homo sapiens
uagaguuuacaguuugu

SEQ ID NO: 381873 - RNA, 19 nt, Homo sapiens
uagcagggauucucucauc

SEQ ID NO: 381874 - RNA, 22 nt, Homo sapiens
uagcuguuucaaaugugcauuu

SEQ ID NO: 381875 - RNA, 23 nt, Homo sapiens
uagggcaacaauacaugcugcua

SEQ ID NO: 381876 - RNA, 16 nt, Homo sapiens
uaguguccuaugcaau

SEQ ID NO: 381877 - RNA, 13 nt, Homo sapiens
uaguuauauugaa

SEQ ID NO: 381878 - RNA, 19 nt, Homo sapiens
uauagguuuccacugccaa

SEQ ID NO: 381879 - RNA, 14 nt, Homo sapiens
uauaucgaucucuu

SEQ ID NO: 381880 - RNA, 19 nt, Homo sapiens
uauauggcauuugcagauu

SEQ ID NO: 381881 - RNA, 13 nt, Homo sapiens
uaucgaucucuua

SEQ ID NO: 381882 - RNA, 22 nt, Homo sapiens
uaugcaauaaaauuauuugcag

SEQ ID NO: 381883 - RNA, 19 nt, Homo sapiens
uauguauauguauaucuau

SEQ ID NO: 381884 - RNA, 17 nt, Homo sapiens
uauucuuaaaaugcaau

SEQ ID NO: 381885 - RNA, 17 nt, Homo sapiens
uauucuuacuaaucuga

SEQ ID NO: 381886 - RNA, 20 nt, Homo sapiens
uauuuaacuaugaacugaag

SEQ ID NO: 381887 - RNA, 17 nt, Homo sapiens
uauuuguauaauggugu

SEQ ID NO: 381888 - RNA, 16 nt, Homo sapiens
uauuuuuguacguuau

SEQ ID NO: 381889 - RNA, 13 nt, Homo sapiens
ucaaaaugcuuca

SEQ ID NO: 381890 - RNA, 13 nt, Homo sapiens
ucaaaugugcauu

SEQ ID NO: 381891 - RNA, 19 nt, Homo sapiens
ucaagauauauguguauac

SEQ ID NO: 381892 - RNA, 19 nt, Homo sapiens
ucaauaguguccuaugcaa

SEQ ID NO: 381893 - RNA, 20 nt, Homo sapiens
ucaauaguguccuaugcaau

SEQ ID NO: 381894 - RNA, 15 nt, Homo sapiens
acuagauugcaugcu

SEQ ID NO: 381895 - RNA, 21 nt, Homo sapiens
acuaguauuucauguugcaca

SEQ ID NO: 381896 - RNA, 18 nt, Homo sapiens
acuauggcucuacuuuca

SEQ ID NO: 381897 - RNA, 19 nt, Homo sapiens
acuauggcucuacuuucag

SEQ ID NO: 381898 - RNA, 15 nt, Homo sapiens
acuauguaacaugua

SEQ ID NO: 381899 - RNA, 16 nt, Homo sapiens
acuauuaaaacagcca

SEQ ID NO: 381900 - RNA, 13 nt, Homo sapiens
acuauuuucauuc

SEQ ID NO: 381901 - RNA, 19 nt, Homo sapiens
acucaagccaagcagccaa

SEQ ID NO: 381902 - RNA, 17 nt, Homo sapiens
acucaaggaauuugcau

SEQ ID NO: 381903 - RNA, 16 nt, Homo sapiens
acucacaauuccaaac

SEQ ID NO: 381904 - RNA, 20 nt, Homo sapiens
acucacauccugaccuugca

SEQ ID NO: 381905 - RNA, 12 nt, Homo sapiens
acucacccaagc

SEQ ID NO: 381906 - RNA, 18 nt, Homo sapiens
acuccaggcugucuuuca

SEQ ID NO: 381907 - RNA, 12 nt, Homo sapiens
acuccaugagaa

SEQ ID NO: 381908 - RNA, 19 nt, Homo sapiens
acucccaagucuacagagu

SEQ ID NO: 381909 - RNA, 12 nt, Homo sapiens
acuccccugcac

SEQ ID NO: 381910 - RNA, 17 nt, Homo sapiens
acuccuccuaguacuaa

SEQ ID NO: 381911 - RNA, 19 nt, Homo sapiens
acuccucuguccaggcacu

SEQ ID NO: 381912 - RNA, 18 nt, Homo sapiens
acucuaccagacugugua

SEQ ID NO: 381913 - RNA, 17 nt, Homo sapiens
acucuccuggacugccu

SEQ ID NO: 381914 - RNA, 14 nt, Homo sapiens
acucucugaagaug

SEQ ID NO: 381915 - RNA, 15 nt, Homo sapiens
acucugagaucuaag

SEQ ID NO: 381916 - RNA, 17 nt, Homo sapiens
acucugagaucuaagga

SEQ ID NO: 381917 - RNA, 22 nt, Homo sapiens
acucugcucgccuuagcacuac

SEQ ID NO: 381918 - RNA, 19 nt, Homo sapiens
acucuuguuuucaguuuca

SEQ ID NO: 381919 - RNA, 20 nt, Homo sapiens
acugaaaaaucuaagugaua

SEQ ID NO: 381920 - RNA, 19 nt, Homo sapiens
acugaaggacacagcagug

SEQ ID NO: 381921 - RNA, 17 nt, Homo sapiens
acugaaguuucacauga

SEQ ID NO: 381922 - RNA, 15 nt, Homo sapiens
acugaauuaaugaca

SEQ ID NO: 381923 - RNA, 15 nt, Homo sapiens
acugaccagccucca

SEQ ID NO: 381924 - RNA, 16 nt, Homo sapiens
acugaccagccuccau

SEQ ID NO: 381925 - RNA, 15 nt, Homo sapiens
acugacuuucucagc

SEQ ID NO: 381926 - RNA, 17 nt, Homo sapiens
acugagcaaagcauuga

SEQ ID NO: 381927 - RNA, 23 nt, Homo sapiens
acugaggaacucacaauuccaaa

SEQ ID NO: 381928 - RNA, 20 nt, Homo sapiens
acugauuuuuagcuuuacaa

SEQ ID NO: 381929 - RNA, 14 nt, Homo sapiens
acugcaagcacugc

SEQ ID NO: 381930 - RNA, 22 nt, Homo sapiens
acugcagggaaaauuauuugca

SEQ ID NO: 381931 - RNA, 14 nt, Homo sapiens
acugcagucagcau

SEQ ID NO: 381932 - RNA, 22 nt, Homo sapiens
acugcagucagcaugaauccag

SEQ ID NO: 381933 - RNA, 21 nt, Homo sapiens
acugccaucaagaugagagaa

SEQ ID NO: 381934 - RNA, 15 nt, Homo sapiens
acugccaugccagcu

SEQ ID NO: 381935 - RNA, 15 nt, Homo sapiens
acugcugcuucuuaa

SEQ ID NO: 381936 - RNA, 22 nt, Homo sapiens
acuggcacaguuuucugagaaa

SEQ ID NO: 381937 - RNA, 13 nt, Homo sapiens
acugggcuucuag

SEQ ID NO: 381938 - RNA, 19 nt, Homo sapiens
acugguagaaaggcaguuc

SEQ ID NO: 381939 - RNA, 17 nt, Homo sapiens
acugguuguugccaaac

SEQ ID NO: 381940 - RNA, 19 nt, Homo sapiens
acuguggagguacacucuu

SEQ ID NO: 381941 - RNA, 17 nt, Homo sapiens
acuuaaaaaaaugacag

SEQ ID NO: 381942 - RNA, 23 nt, Homo sapiens
acuuaagguuaccuuuguuccca

SEQ ID NO: 381943 - RNA, 19 nt, Homo sapiens
acuuacccacgugcuguuc

SEQ ID NO: 381944 - RNA, 22 nt, Homo sapiens
acuuagaaauugcauuuccuga

SEQ ID NO: 381945 - RNA, 23 nt, Homo sapiens
acuuagaaauugcauuuccugac

SEQ ID NO: 381946 - RNA, 21 nt, Homo sapiens
acuuagguggcaagcugugac

SEQ ID NO: 381947 - RNA, 16 nt, Homo sapiens
acuuagguguggggga

SEQ ID NO: 381948 - RNA, 15 nt, Homo sapiens
acuuauaucaucagc

SEQ ID NO: 381949 - RNA, 13 nt, Homo sapiens
acuucaagugacc

SEQ ID NO: 381950 - RNA, 18 nt, Homo sapiens
acuucacuuuaauucuca

SEQ ID NO: 381951 - RNA, 13 nt, Homo sapiens
acuuccaccagcc

SEQ ID NO: 381952 - RNA, 14 nt, Homo sapiens
acuuccauuugcuu

SEQ ID NO: 381953 - RNA, 14 nt, Homo sapiens
acuucccagugaau

SEQ ID NO: 381954 - RNA, 11 nt, Homo sapiens
acuucccugaa

SEQ ID NO: 381955 - RNA, 21 nt, Homo sapiens
acuucuaaaugaagugcaaau

SEQ ID NO: 381956 - RNA, 22 nt, Homo sapiens
acuucuaaguaaaaccacagca

SEQ ID NO: 381957 - RNA, 16 nt, Homo sapiens
acuucuccaggucuca

SEQ ID NO: 381958 - RNA, 17 nt, Homo sapiens
acuucucuauuaucuca

SEQ ID NO: 381959 - RNA, 16 nt, Homo sapiens
acuucucucaggaucc

SEQ ID NO: 381960 - RNA, 19 nt, Homo sapiens
acuucugaaaccucugggu

SEQ ID NO: 381961 - RNA, 16 nt, Homo sapiens
acuucuggcagggaag

SEQ ID NO: 381962 - RNA, 21 nt, Homo sapiens
acuucugucuucacaacagau

SEQ ID NO: 381963 - RNA, 23 nt, Homo sapiens
acuucuuaaaaguugugauucca

SEQ ID NO: 381964 - RNA, 13 nt, Homo sapiens
acuugagcaccgu

SEQ ID NO: 381965 - RNA, 17 nt, Homo sapiens
acuugauguguuaucuc

SEQ ID NO: 381966 - RNA, 11 nt, Homo sapiens
acuugcacaaa

SEQ ID NO: 381967 - RNA, 15 nt, Homo sapiens
acuugcacaaaauca

SEQ ID NO: 381968 - RNA, 21 nt, Homo sapiens
acuugcacaaaaucacacagc

SEQ ID NO: 381969 - RNA, 18 nt, Homo sapiens
acuugcacgcccaugugu

SEQ ID NO: 381970 - RNA, 17 nt, Homo sapiens
acuugcugcaguaugaa

SEQ ID NO: 381971 - RNA, 13 nt, Homo sapiens
acuugggaacuag

SEQ ID NO: 381972 - RNA, 14 nt, Homo sapiens
acuuuaacugacuu

SEQ ID NO: 381973 - RNA, 16 nt, Homo sapiens
acuuuaacugacuuaa

SEQ ID NO: 381974 - RNA, 14 nt, Homo sapiens
acuuuaagauguuu

SEQ ID NO: 381975 - RNA, 18 nt, Homo sapiens
acuuuacaugacacagcu

SEQ ID NO: 381976 - RNA, 20 nt, Homo sapiens
acuuucagguacuaaauacc

SEQ ID NO: 381977 - RNA, 13 nt, Homo sapiens
acuuugaagacca

SEQ ID NO: 381978 - RNA, 18 nt, Homo sapiens
acuuugaguuagugccau

SEQ ID NO: 381979 - RNA, 17 nt, Homo sapiens
acuuugggaggccaagg

SEQ ID NO: 381980 - RNA, 17 nt, Homo sapiens
acuuuuaaguugcugau

SEQ ID NO: 381981 - RNA, 13 nt, Homo sapiens
agaaaaauuaauu

SEQ ID NO: 381982 - RNA, 18 nt, Homo sapiens
agaaaagugaaugcucaa

SEQ ID NO: 381983 - RNA, 23 nt, Homo sapiens
agaaacagcuucucaauuucuac

SEQ ID NO: 381984 - RNA, 20 nt, Homo sapiens
agaaaccuuauuguaccucu

SEQ ID NO: 381985 - RNA, 21 nt, Homo sapiens
agaaaccuuauuguaccucuc

SEQ ID NO: 381986 - RNA, 19 nt, Homo sapiens
agaaacuguagucucagga

SEQ ID NO: 381987 - RNA, 23 nt, Homo sapiens
agaaagacuauucaaacagucuc

SEQ ID NO: 381988 - RNA, 21 nt, Homo sapiens
agaaagcaaaugugaccugug

SEQ ID NO: 381989 - RNA, 15 nt, Homo sapiens
agaaagcucaucuca

SEQ ID NO: 381990 - RNA, 12 nt, Homo sapiens
agaaaggcauga

SEQ ID NO: 381991 - RNA, 20 nt, Homo sapiens
agaaauaauaugcauuguca

SEQ ID NO: 381992 - RNA, 14 nt, Homo sapiens
agaaauuagcugug

SEQ ID NO: 381993 - RNA, 22 nt, Homo sapiens
agaaauugcauuuccugacaga

SEQ ID NO: 381994 - RNA, 17 nt, Homo sapiens
agaacaguaacugccau

SEQ ID NO: 381995 - RNA, 19 nt, Homo sapiens
agaacaguaacugccauca

SEQ ID NO: 381996 - RNA, 21 nt, Homo sapiens
agaacgagaccugugugccag

SEQ ID NO: 381997 - RNA, 21 nt, Homo sapiens
agaacuaagaugaucaucucc

SEQ ID NO: 381998 - RNA, 16 nt, Homo sapiens
agaacugcagucagca

SEQ ID NO: 381999 - RNA, 19 nt, Homo sapiens
agaacugcuugaacccagg

SEQ ID NO: 382000 - RNA, 16 nt, Homo sapiens
agaacuggacucagga

SEQ ID NO: 382001 - RNA, 22 nt, Homo sapiens
agaagauaugugaagaaaaaug

SEQ ID NO: 382002 - RNA, 23 nt, Homo sapiens
agaagccucacugcaagcacugc

SEQ ID NO: 382003 - RNA, 20 nt, Homo sapiens
agaagcugagcaccagggga

SEQ ID NO: 382004 - RNA, 20 nt, Homo sapiens
agaagggagggagagaauuu

SEQ ID NO: 382005 - RNA, 22 nt, Homo sapiens
agaagugaaaaucuacacucca

SEQ ID NO: 382006 - RNA, 18 nt, Homo sapiens
agaaugaauaauaauuau

SEQ ID NO: 382007 - RNA, 11 nt, Homo sapiens
agaauggagcu

SEQ ID NO: 382008 - RNA, 15 nt, Homo sapiens
agaauuaacacauga

SEQ ID NO: 382009 - RNA, 21 nt, Homo sapiens
agaauuauaauuaguuccuca

SEQ ID NO: 382010 - RNA, 23 nt, Homo sapiens
agaauucugcuaccucacugggg

SEQ ID NO: 382011 - RNA, 16 nt, Homo sapiens
agaauugagucuucca

SEQ ID NO: 382012 - RNA, 19 nt, Homo sapiens
agacaaaaucuuaaaugcc

SEQ ID NO: 382013 - RNA, 17 nt, Homo sapiens
agacaaaguaauuccuc

SEQ ID NO: 382014 - RNA, 20 nt, Homo sapiens
agacacaacuauuuuuccaa

SEQ ID NO: 382015 - RNA, 22 nt, Homo sapiens
agacacugaaaaaucuaaguga

SEQ ID NO: 382016 - RNA, 16 nt, Homo sapiens
agacaggacccuggga

SEQ ID NO: 382017 - RNA, 17 nt, Homo sapiens
agacaggacccugggac

SEQ ID NO: 382018 - RNA, 17 nt, Homo sapiens
agacauccugagcagug

SEQ ID NO: 382019 - RNA, 13 nt, Homo sapiens
agacaugaauaug

SEQ ID NO: 382020 - RNA, 16 nt, Homo sapiens
agacauguaucacugu

SEQ ID NO: 382021 - RNA, 17 nt, Homo sapiens
agacaugugacauuuau

SEQ ID NO: 382022 - RNA, 13 nt, Homo sapiens
agaccacaaauag

SEQ ID NO: 382023 - RNA, 15 nt, Homo sapiens
agaccacuguuauca

SEQ ID NO: 382024 - RNA, 17 nt, Homo sapiens
agaccagcuuugcagug

SEQ ID NO: 382025 - RNA, 23 nt, Homo sapiens
agaccaguccuguuugcagggaa

SEQ ID NO: 382026 - RNA, 15 nt, Homo sapiens
agaccauaauguuac

SEQ ID NO: 382027 - RNA, 16 nt, Homo sapiens
agaccauaauguuaca

SEQ ID NO: 382028 - RNA, 16 nt, Homo sapiens
agaccuaggauuucau

SEQ ID NO: 382029 - RNA, 17 nt, Homo sapiens
agaccugugugccaggg

SEQ ID NO: 382030 - RNA, 20 nt, Homo sapiens
agacgcagacaugugcacuu

SEQ ID NO: 382031 - RNA, 20 nt, Homo sapiens
agacucagggccccagcacu

SEQ ID NO: 382032 - RNA, 17 nt, Homo sapiens
agacuccgucucaagga

SEQ ID NO: 382033 - RNA, 15 nt, Homo sapiens
agacucugucucagu

SEQ ID NO: 382034 - RNA, 13 nt, Homo sapiens
agacugagcucaa

SEQ ID NO: 382035 - RNA, 16 nt, Homo sapiens
agacugagcucaaggu

SEQ ID NO: 382036 - RNA, 13 nt, Homo sapiens
agugccagcuuuc

SEQ ID NO: 382037 - RNA, 17 nt, Homo sapiens
agugccucuuucaucca

SEQ ID NO: 382038 - RNA, 13 nt, Homo sapiens
agugccugcugaa

SEQ ID NO: 382039 - RNA, 14 nt, Homo sapiens
agugccuuaccucc

SEQ ID NO: 382040 - RNA, 16 nt, Homo sapiens
aguggcccccacagaa

SEQ ID NO: 382041 - RNA, 13 nt, Homo sapiens
aguggugccaaac

SEQ ID NO: 382042 - RNA, 15 nt, Homo sapiens
aguggugcuccaagg

SEQ ID NO: 382043 - RNA, 18 nt, Homo sapiens
aguguagggcaacaauac

SEQ ID NO: 382044 - RNA, 15 nt, Homo sapiens
aguguagguaucauu

SEQ ID NO: 382045 - RNA, 21 nt, Homo sapiens
aguguaugcacgugugcacac

SEQ ID NO: 382046 - RNA, 16 nt, Homo sapiens
agugucugugugcaag

SEQ ID NO: 382047 - RNA, 12 nt, Homo sapiens
aguguggcccag

SEQ ID NO: 382048 - RNA, 14 nt, Homo sapiens
aguguguaugugcg

SEQ ID NO: 382049 - RNA, 20 nt, Homo sapiens
agugugugcaaguaugugag

SEQ ID NO: 382050 - RNA, 17 nt, Homo sapiens
aguguuaucagucauaa

SEQ ID NO: 382051 - RNA, 16 nt, Homo sapiens
aguguuccccuuccac

SEQ ID NO: 382052 - RNA, 20 nt, Homo sapiens
aguguuccccuuccacugag

SEQ ID NO: 382053 - RNA, 12 nt, Homo sapiens
aguguugcccag

SEQ ID NO: 382054 - RNA, 12 nt, Homo sapiens
aguguugcuugg

SEQ ID NO: 382055 - RNA, 19 nt, Homo sapiens
aguuaaggauuguuuuaaa

SEQ ID NO: 382056 - RNA, 12 nt, Homo sapiens
aguuaaggguua

SEQ ID NO: 382057 - RNA, 23 nt, Homo sapiens
aguuaugaaaaauaagucacuua

SEQ ID NO: 382058 - RNA, 16 nt, Homo sapiens
aguucaugucgcaaca

SEQ ID NO: 382059 - RNA, 23 nt, Homo sapiens
aguuccugcuacaacuucagcag

SEQ ID NO: 382060 - RNA, 15 nt, Homo sapiens
aguuccuucagcuuc

SEQ ID NO: 382061 - RNA, 18 nt, Homo sapiens
aguuccuugaucuguaua

SEQ ID NO: 382062 - RNA, 20 nt, Homo sapiens
aguugaucuacaaaggccau

SEQ ID NO: 382063 - RNA, 12 nt, Homo sapiens
aguugcacuugg

SEQ ID NO: 382064 - RNA, 23 nt, Homo sapiens
aguuuauagaccagaaccagagc

SEQ ID NO: 382065 - RNA, 15 nt, Homo sapiens
aguuucacaugagcu

SEQ ID NO: 382066 - RNA, 14 nt, Homo sapiens
aguuucaucaguca

SEQ ID NO: 382067 - RNA, 17 nt, Homo sapiens
aguuuccucaggcugcu

SEQ ID NO: 382068 - RNA, 21 nt, Homo sapiens
aguuucucagcucccaaggcu

SEQ ID NO: 382069 - RNA, 18 nt, Homo sapiens
aguuugcaguuaugcaga

SEQ ID NO: 382070 - RNA, 19 nt, Homo sapiens
aguuugguccuggggacca

SEQ ID NO: 382071 - RNA, 14 nt, Homo sapiens
aguuuuaaacuggu

SEQ ID NO: 382072 - RNA, 21 nt, Homo sapiens
auaaaaauauuguguugugaa

SEQ ID NO: 382073 - RNA, 16 nt, Homo sapiens
auaaaauuagcuugag

SEQ ID NO: 382074 - RNA, 14 nt, Homo sapiens
auaaaauugcacuu

SEQ ID NO: 382075 - RNA, 16 nt, Homo sapiens
auaaacaugucugccc

SEQ ID NO: 382076 - RNA, 22 nt, Homo sapiens
auaaacugauuuaucuauuuaa

SEQ ID NO: 382077 - RNA, 18 nt, Homo sapiens
auaaauauuuuugccaua

SEQ ID NO: 382078 - RNA, 17 nt, Homo sapiens
auaaauguacauuaauu

SEQ ID NO: 382079 - RNA, 19 nt, Homo sapiens
auaacaagugggugaaugu

SEQ ID NO: 382080 - RNA, 18 nt, Homo sapiens
auaacuaguguugcuugg

SEQ ID NO: 382081 - RNA, 14 nt, Homo sapiens
auaacuuauaucau

SEQ ID NO: 382082 - RNA, 21 nt, Homo sapiens
auaacuuauaucaucagcaua

SEQ ID NO: 382083 - RNA, 23 nt, Homo sapiens
auaagcaaagggagcacuggguu

SEQ ID NO: 382084 - RNA, 19 nt, Homo sapiens
auaagcagaagcacauaug

SEQ ID NO: 382085 - RNA, 19 nt, Homo sapiens
auaaggaucagaacagcag

SEQ ID NO: 382086 - RNA, 21 nt, Homo sapiens
auaagggaggaauauagaaug

SEQ ID NO: 382087 - RNA, 17 nt, Homo sapiens
auaauacaguaucucag

SEQ ID NO: 382088 - RNA, 15 nt, Homo sapiens
auaaugacucagaau

SEQ ID NO: 382089 - RNA, 19 nt, Homo sapiens
auaaugguugacuggguuu

SEQ ID NO: 382090 - RNA, 16 nt, Homo sapiens
auacaagaaagcaaug

SEQ ID NO: 382091 - RNA, 16 nt, Homo sapiens
auacaauuagccaggu

SEQ ID NO: 382092 - RNA, 16 nt, Homo sapiens
auacacagaugaaggu

SEQ ID NO: 382093 - RNA, 23 nt, Homo sapiens
auacacguuacugaucuuacuca

SEQ ID NO: 382094 - RNA, 22 nt, Homo sapiens
auacacugaaguuaacagagac

SEQ ID NO: 382095 - RNA, 16 nt, Homo sapiens
auacaggcuagggaug

SEQ ID NO: 382096 - RNA, 18 nt, Homo sapiens
auacaguacaggcagcac

SEQ ID NO: 382097 - RNA, 15 nt, Homo sapiens
auacaguaucucagg

SEQ ID NO: 382098 - RNA, 17 nt, Homo sapiens
auacauaaguuuaggau

SEQ ID NO: 382099 - RNA, 15 nt, Homo sapiens
auacauuugauaaag

SEQ ID NO: 382100 - RNA, 23 nt, Homo sapiens
auaccgcugcauaguauuccauu

SEQ ID NO: 382101 - RNA, 19 nt, Homo sapiens
auaccuucuuaaguuuuca

SEQ ID NO: 382102 - RNA, 20 nt, Homo sapiens
auacguuugaaauaguugau

SEQ ID NO: 382103 - RNA, 21 nt, Homo sapiens
auacugcucaucauuccuuga

SEQ ID NO: 382104 - RNA, 22 nt, Homo sapiens
auacuguaggcacacuuugcac

SEQ ID NO: 382105 - RNA, 15 nt, Homo sapiens
auagaaacuugcuua

SEQ ID NO: 382106 - RNA, 12 nt, Homo sapiens
auagaaagccaa

SEQ ID NO: 382107 - RNA, 19 nt, Homo sapiens
auagaagaugaaucauuga

SEQ ID NO: 382108 - RNA, 21 nt, Homo sapiens
auagaagaugggaaaaccaug

SEQ ID NO: 382109 - RNA, 12 nt, Homo sapiens
auagaauuaaca

SEQ ID NO: 382110 - RNA, 22 nt, Homo sapiens
auagagggucuaagauucaucc

SEQ ID NO: 382111 - RNA, 23 nt, Homo sapiens
auagaucagcaaaccggggccua

SEQ ID NO: 382112 - RNA, 20 nt, Homo sapiens
auagauggucacgcaccugg

SEQ ID NO: 382113 - RNA, 17 nt, Homo sapiens
auagcagcuuauucaca

SEQ ID NO: 382114 - RNA, 15 nt, Homo sapiens
auagccaaucaucua

SEQ ID NO: 382115 - RNA, 13 nt, Homo sapiens
auagcccagacac

SEQ ID NO: 382116 - RNA, 20 nt, Homo sapiens
auaggugcuacaaaaacaca

SEQ ID NO: 382117 - RNA, 13 nt, Homo sapiens
auaguacuggcau

SEQ ID NO: 382118 - RNA, 19 nt, Homo sapiens
auaguacuggcaugguacg

SEQ ID NO: 382119 - RNA, 23 nt, Homo sapiens
auagugauugauagaguguuauc

SEQ ID NO: 382120 - RNA, 20 nt, Homo sapiens
auauaacaagugggugaaug

SEQ ID NO: 382121 - RNA, 12 nt, Homo sapiens
auauaacugccu

SEQ ID NO: 382122 - RNA, 18 nt, Homo sapiens
auauacuauuuucauucu

SEQ ID NO: 382123 - RNA, 20 nt, Homo sapiens
auauauauuuuugugcacau

SEQ ID NO: 382124 - RNA, 14 nt, Homo sapiens
auaucaaaagcaaa

SEQ ID NO: 382125 - RNA, 17 nt, Homo sapiens
auaucaaaagcaaauaa

SEQ ID NO: 382126 - RNA, 15 nt, Homo sapiens
auaucaucagcauac

SEQ ID NO: 382127 - RNA, 13 nt, Homo sapiens
auaucaugcucca

SEQ ID NO: 382128 - RNA, 17 nt, Homo sapiens
auauccaacaugugcuc

SEQ ID NO: 382129 - RNA, 22 nt, Homo sapiens
auauccaacaugugcucaggga

SEQ ID NO: 382130 - RNA, 16 nt, Homo sapiens
auaucccuaugcugcc

SEQ ID NO: 382131 - RNA, 15 nt, Homo sapiens
auaugaaacauuuaa

SEQ ID NO: 382132 - RNA, 20 nt, Homo sapiens
auaugcuuauacacuuacac

SEQ ID NO: 382133 - RNA, 16 nt, Homo sapiens
auaugcuuuacaaucu

SEQ ID NO: 382134 - RNA, 14 nt, Homo sapiens
auauguaccaugua

SEQ ID NO: 382135 - RNA, 23 nt, Homo sapiens
auaugugggugucagucagggac

SEQ ID NO: 382136 - RNA, 18 nt, Homo sapiens
auauucauuucaaaggga

SEQ ID NO: 382137 - RNA, 17 nt, Homo sapiens
auauucugcaacacugu

SEQ ID NO: 382138 - RNA, 18 nt, Homo sapiens
auauucugguuacugugg

SEQ ID NO: 382139 - RNA, 19 nt, Homo sapiens
auauugcagcuuauauuca

SEQ ID NO: 382140 - RNA, 20 nt, Homo sapiens
auauugcagcuuauauucau

SEQ ID NO: 382141 - RNA, 11 nt, Homo sapiens
auauugcccag

SEQ ID NO: 382142 - RNA, 20 nt, Homo sapiens
auauuuauuuaacuauucau

SEQ ID NO: 382143 - RNA, 18 nt, Homo sapiens
auauuugaagcaucacau

SEQ ID NO: 382144 - RNA, 22 nt, Homo sapiens
auauuuguaugauccuaaugaa

SEQ ID NO: 382145 - RNA, 13 nt, Homo sapiens
aucaaaagaaaga

SEQ ID NO: 382146 - RNA, 22 nt, Homo sapiens
aucaaaugugacauuauaugca

SEQ ID NO: 382147 - RNA, 12 nt, Homo sapiens
aucaaauuucac

SEQ ID NO: 382148 - RNA, 13 nt, Homo sapiens
aucaacagcauuu

SEQ ID NO: 382149 - RNA, 14 nt, Homo sapiens
aucaaguccuacaa

SEQ ID NO: 382150 - RNA, 23 nt, Homo sapiens
aucacaccguccuccacgccauu

SEQ ID NO: 382151 - RNA, 18 nt, Homo sapiens
aucaccuuaggcagggaa

SEQ ID NO: 382152 - RNA, 17 nt, Homo sapiens
aucacuagccaugauaa

SEQ ID NO: 382153 - RNA, 22 nt, Homo sapiens
aucagaccauaauguuacauua

SEQ ID NO: 382154 - RNA, 13 nt, Homo sapiens
aucagcauuaguc

SEQ ID NO: 382155 - RNA, 15 nt, Homo sapiens
aucagccacauucua

SEQ ID NO: 382156 - RNA, 18 nt, Homo sapiens
aucagccugucucuucca

SEQ ID NO: 382157 - RNA, 19 nt, Homo sapiens
aucagccugucucuuccau

SEQ ID NO: 382158 - RNA, 21 nt, Homo sapiens
aucaggcuauguauggaauac

SEQ ID NO: 382159 - RNA, 15 nt, Homo sapiens
aucagggacaggaug

SEQ ID NO: 382160 - RNA, 19 nt, Homo sapiens
aucagugaauaaaccauca

SEQ ID NO: 382161 - RNA, 16 nt, Homo sapiens
aucauaaaacuugaug

SEQ ID NO: 382162 - RNA, 14 nt, Homo sapiens
aucauccuuuccag

SEQ ID NO: 382163 - RNA, 16 nt, Homo sapiens
auccaagaaucaguga

SEQ ID NO: 382164 - RNA, 18 nt, Homo sapiens
auccaagaaucagugaag

SEQ ID NO: 382165 - RNA, 19 nt, Homo sapiens
auccaggcgugguggcaca

SEQ ID NO: 382166 - RNA, 22 nt, Homo sapiens
auccaucacuagccaugauaac

SEQ ID NO: 382167 - RNA, 23 nt, Homo sapiens
aucccagcuggccuguaauccca

SEQ ID NO: 382168 - RNA, 21 nt, Homo sapiens
aucccaugauguagugccucu

SEQ ID NO: 382169 - RNA, 15 nt, Homo sapiens
aucccauguauuuau

SEQ ID NO: 382170 - RNA, 22 nt, Homo sapiens
auccccuaagcagaccacugau

SEQ ID NO: 382171 - RNA, 19 nt, Homo sapiens
auccccuccguggcaucac

SEQ ID NO: 382172 - RNA, 17 nt, Homo sapiens
auccccuuggcugugag

SEQ ID NO: 382173 - RNA, 14 nt, Homo sapiens
aucccuacauguau

SEQ ID NO: 382174 - RNA, 14 nt, Homo sapiens
aucccucaccugua

SEQ ID NO: 382175 - RNA, 13 nt, Homo sapiens
auccgaaguauga

SEQ ID NO: 382176 - RNA, 23 nt, Homo sapiens
auccuaucagccugucucuucca

SEQ ID NO: 382177 - RNA, 11 nt, Homo sapiens
auccuauuuau

SEQ ID NO: 382178 - RNA, 20 nt, Homo sapiens
caagccuagcccuucucuca

SEQ ID NO: 382179 - RNA, 15 nt, Homo sapiens
caagccucaugucca

SEQ ID NO: 382180 - RNA, 17 nt, Homo sapiens
caagcugggagcacagg

SEQ ID NO: 382181 - RNA, 20 nt, Homo sapiens
caagcugugacuucuccagg

SEQ ID NO: 382182 - RNA, 16 nt, Homo sapiens
caagcuucaguuuccu

SEQ ID NO: 382183 - RNA, 18 nt, Homo sapiens
caaggagaaaaaaggcag

SEQ ID NO: 382184 - RNA, 16 nt, Homo sapiens
caaggcuggcagugac

SEQ ID NO: 382185 - RNA, 20 nt, Homo sapiens
caaggggaugcucugugcag

SEQ ID NO: 382186 - RNA, 16 nt, Homo sapiens
caaggguuuguugaac

SEQ ID NO: 382187 - RNA, 19 nt, Homo sapiens
caaguauguugagaguugc

SEQ ID NO: 382188 - RNA, 18 nt, Homo sapiens
caagucaagugaaaaagg

SEQ ID NO: 382189 - RNA, 12 nt, Homo sapiens
caaguccaagca

SEQ ID NO: 382190 - RNA, 12 nt, Homo sapiens
caagugaagguu

SEQ ID NO: 382191 - RNA, 14 nt, Homo sapiens
caagugacaucucu

SEQ ID NO: 382192 - RNA, 15 nt, Homo sapiens
caagugccuuagcaa

SEQ ID NO: 382193 - RNA, 20 nt, Homo sapiens
caaguguaugcacgugugca

SEQ ID NO: 382194 - RNA, 21 nt, Homo sapiens
caaguguaugcacgugugcac

SEQ ID NO: 382195 - RNA, 21 nt, Homo sapiens
caagugucucaguccaccuga

SEQ ID NO: 382196 - RNA, 24 nt, Homo sapiens
caaguguguaugugcgugugugca

SEQ ID NO: 382197 - RNA, 20 nt, Homo sapiens
caagugugugcacaugugug

SEQ ID NO: 382198 - RNA, 13 nt, Homo sapiens
caagugugugcau

SEQ ID NO: 382199 - RNA, 17 nt, Homo sapiens
caaguuccgucagucca

SEQ ID NO: 382200 - RNA, 20 nt, Homo sapiens
caaguuggcuucuaaucaaa

SEQ ID NO: 382201 - RNA, 17 nt, Homo sapiens
caaguuucaucagucaa

SEQ ID NO: 382202 - RNA, 15 nt, Homo sapiens
caauaaauuuugcca

SEQ ID NO: 382203 - RNA, 15 nt, Homo sapiens
caauacaugcugcua

SEQ ID NO: 382204 - RNA, 18 nt, Homo sapiens
caauauccaaaccaaaua

SEQ ID NO: 382205 - RNA, 16 nt, Homo sapiens
caauauuaacauaaga

SEQ ID NO: 382206 - RNA, 16 nt, Homo sapiens
caauauuucugauaua

SEQ ID NO: 382207 - RNA, 17 nt, Homo sapiens
caaucaugaaauaugca

SEQ ID NO: 382208 - RNA, 18 nt, Homo sapiens
caauccgaaguaugaggg

SEQ ID NO: 382209 - RNA, 15 nt, Homo sapiens
caaucuaaccacauc

SEQ ID NO: 382210 - RNA, 18 nt, Homo sapiens
caaucucugauucuguca

SEQ ID NO: 382211 - RNA, 21 nt, Homo sapiens
caaugaaagcauggcugagaa

SEQ ID NO: 382212 - RNA, 14 nt, Homo sapiens
caaugaaaugcucu

SEQ ID NO: 382213 - RNA, 11 nt, Homo sapiens
caaugccagua

SEQ ID NO: 382214 - RNA, 21 nt, Homo sapiens
caauggggauguuguguuucu

SEQ ID NO: 382215 - RNA, 15 nt, Homo sapiens
caauguucaucccau

SEQ ID NO: 382216 - RNA, 16 nt, Homo sapiens
caauuagccaggugug

SEQ ID NO: 382217 - RNA, 12 nt, Homo sapiens
caauugucugcc

SEQ ID NO: 382218 - RNA, 23 nt, Homo sapiens
caauuuacuugccauuacucaau

SEQ ID NO: 382219 - RNA, 21 nt, Homo sapiens
caauuuccggccaacaguuaa

SEQ ID NO: 382220 - RNA, 18 nt, Homo sapiens
caauuugccauuguuucu

SEQ ID NO: 382221 - RNA, 17 nt, Homo sapiens
caauuuuaaaucugaga

SEQ ID NO: 382222 - RNA, 16 nt, Homo sapiens
cacaaaacaaaugcca

SEQ ID NO: 382223 - RNA, 18 nt, Homo sapiens
cacaaaauaaccaauccu

SEQ ID NO: 382224 - RNA, 13 nt, Homo sapiens
cacaaaaucacac

SEQ ID NO: 382225 - RNA, 17 nt, Homo sapiens
cacaaacccccacucca

SEQ ID NO: 382226 - RNA, 14 nt, Homo sapiens
cacaaaucuuaacu

SEQ ID NO: 382227 - RNA, 20 nt, Homo sapiens
cacaaaugguagcauacuuu

SEQ ID NO: 382228 - RNA, 13 nt, Homo sapiens
cacacaaaccagu

SEQ ID NO: 382229 - RNA, 21 nt, Homo sapiens
cacacacccagcuugugccug

SEQ ID NO: 382230 - RNA, 23 nt, Homo sapiens
cacacauacacacacacaagcuu

SEQ ID NO: 382231 - RNA, 20 nt, Homo sapiens
cacacccuggaggauuucau

SEQ ID NO: 382232 - RNA, 21 nt, Homo sapiens
cacacgucuggcuucacagau

SEQ ID NO: 382233 - RNA, 15 nt, Homo sapiens
cacacucacagaugu

SEQ ID NO: 382234 - RNA, 21 nt, Homo sapiens
cacacuguagcauuacagugg

SEQ ID NO: 382235 - RNA, 20 nt, Homo sapiens
cacagaaagacugagcucaa

SEQ ID NO: 382236 - RNA, 21 nt, Homo sapiens
cacagaacuauguacuuuaaa

SEQ ID NO: 382237 - RNA, 21 nt, Homo sapiens
cacagagauaauucuagcuuu

SEQ ID NO: 382238 - RNA, 16 nt, Homo sapiens
cacagaugugugauuc

SEQ ID NO: 382239 - RNA, 21 nt, Homo sapiens
cacagcagccccugcacaaag

SEQ ID NO: 382240 - RNA, 19 nt, Homo sapiens
cacagcaggagggacaaug

SEQ ID NO: 382241 - RNA, 17 nt, Homo sapiens
cacagccuccccugcca

SEQ ID NO: 382242 - RNA, 14 nt, Homo sapiens
cacagcuuuuuacc

SEQ ID NO: 382243 - RNA, 22 nt, Homo sapiens
cacaggcagcauuuagcacaua

SEQ ID NO: 382244 - RNA, 22 nt, Homo sapiens
cacaggccucucuucacacacu

SEQ ID NO: 382245 - RNA, 16 nt, Homo sapiens
cacagucacauuccaa

SEQ ID NO: 382246 - RNA, 17 nt, Homo sapiens
cacauacuacacauuca

SEQ ID NO: 382247 - RNA, 17 nt, Homo sapiens
cacaugucaguaccuuc

SEQ ID NO: 382248 - RNA, 21 nt, Homo sapiens
cacauuccaagccucaugucc

SEQ ID NO: 382249 - RNA, 17 nt, Homo sapiens
cacauugagucuaucaa

SEQ ID NO: 382250 - RNA, 15 nt, Homo sapiens
cacauugugccuuuu

SEQ ID NO: 382251 - RNA, 20 nt, Homo sapiens
cacauuuacaaaauuacaca

SEQ ID NO: 382252 - RNA, 19 nt, Homo sapiens
caccaauauuucucagaca

SEQ ID NO: 382253 - RNA, 21 nt, Homo sapiens
caccaauauuucucagacauc

SEQ ID NO: 382254 - RNA, 16 nt, Homo sapiens
caccaccuucccagcu

SEQ ID NO: 382255 - RNA, 23 nt, Homo sapiens
caccacuaacaugcccuguucag

SEQ ID NO: 382256 - RNA, 13 nt, Homo sapiens
caccagcagccug

SEQ ID NO: 382257 - RNA, 19 nt, Homo sapiens
caccaggaggcggcagugc

SEQ ID NO: 382258 - RNA, 18 nt, Homo sapiens
caccauuuuccugccuca

SEQ ID NO: 382259 - RNA, 24 nt, Homo sapiens
caccccagugcacccacucugcuu

SEQ ID NO: 382260 - RNA, 16 nt, Homo sapiens
cacccuucucauucca

SEQ ID NO: 382261 - RNA, 18 nt, Homo sapiens
caccuauaaaacagguca

SEQ ID NO: 382262 - RNA, 22 nt, Homo sapiens
caccuauuuaagagggaacuua

SEQ ID NO: 382263 - RNA, 23 nt, Homo sapiens
caccucacacuccuccaaggcac

SEQ ID NO: 382264 - RNA, 15 nt, Homo sapiens
caccuccuacgucaa

SEQ ID NO: 382265 - RNA, 20 nt, Homo sapiens
caccucugugaccucaggca

SEQ ID NO: 382266 - RNA, 16 nt, Homo sapiens
caccugaaugugucug

SEQ ID NO: 382267 - RNA, 16 nt, Homo sapiens
caccugaccaaucaga

SEQ ID NO: 382268 - RNA, 23 nt, Homo sapiens
caccugguuccggaauccugucc

SEQ ID NO: 382269 - RNA, 22 nt, Homo sapiens
caccuguagucccagcuacuca

SEQ ID NO: 382270 - RNA, 14 nt, Homo sapiens
caccuucuucagcc

SEQ ID NO: 382271 - RNA, 23 nt, Homo sapiens
cacgagcaaagugaagacacugg

SEQ ID NO: 382272 - RNA, 13 nt, Homo sapiens
cacgccugcaaac

SEQ ID NO: 382273 - RNA, 20 nt, Homo sapiens
cacggaagggcucuuucaca

SEQ ID NO: 382274 - RNA, 17 nt, Homo sapiens
cacggcucucaccagug

SEQ ID NO: 382275 - RNA, 12 nt, Homo sapiens
cacgucugcuaa

SEQ ID NO: 382276 - RNA, 13 nt, Homo sapiens
cacuaagccaaga

SEQ ID NO: 382277 - RNA, 11 nt, Homo sapiens
cacuaauuccu

SEQ ID NO: 382278 - RNA, 15 nt, Homo sapiens
cacuacgugacugug

SEQ ID NO: 382279 - RNA, 14 nt, Homo sapiens
cacuauuacuggga

SEQ ID NO: 382280 - RNA, 17 nt, Homo sapiens
cacucaagccaagcagc

SEQ ID NO: 382281 - RNA, 22 nt, Homo sapiens
cacucugcucgccuuagcacua

SEQ ID NO: 382282 - RNA, 20 nt, Homo sapiens
cacucuuauagaaaguucaa

SEQ ID NO: 382283 - RNA, 22 nt, Homo sapiens
cacugaaaugcuagcugcaagu

SEQ ID NO: 382284 - RNA, 17 nt, Homo sapiens
cacugaggaccagccau

SEQ ID NO: 382285 - RNA, 15 nt, Homo sapiens
cacugccugcuggaa

SEQ ID NO: 382286 - RNA, 14 nt, Homo sapiens
cacugcucauuugg

SEQ ID NO: 382287 - RNA, 15 nt, Homo sapiens
cacuguauguuuacu

SEQ ID NO: 382288 - RNA, 16 nt, Homo sapiens
cacugucacccuccac

SEQ ID NO: 382289 - RNA, 15 nt, Homo sapiens
cacugugaaaccccc

SEQ ID NO: 382290 - RNA, 17 nt, Homo sapiens
cacuucaggguucuccu

SEQ ID NO: 382291 - RNA, 14 nt, Homo sapiens
cacuuccaccagcc

SEQ ID NO: 382292 - RNA, 16 nt, Homo sapiens
cacuugaagaugcugc

SEQ ID NO: 382293 - RNA, 19 nt, Homo sapiens
cacuugaaggaagaagucu

SEQ ID NO: 382294 - RNA, 18 nt, Homo sapiens
cacuugcacgcccaugug

SEQ ID NO: 382295 - RNA, 21 nt, Homo sapiens
cacuugugcaguguugacagu

SEQ ID NO: 382296 - RNA, 16 nt, Homo sapiens
cagaaaaacucuggga

SEQ ID NO: 382297 - RNA, 20 nt, Homo sapiens
cagaaagccugggugacauu

SEQ ID NO: 382298 - RNA, 16 nt, Homo sapiens
cagaaagcucaucuca

SEQ ID NO: 382299 - RNA, 15 nt, Homo sapiens
cagaaccagagcuca

SEQ ID NO: 382300 - RNA, 14 nt, Homo sapiens
cagaacucuuucaa

SEQ ID NO: 382301 - RNA, 23 nt, Homo sapiens
cagaacugcuugaacccaggagg

SEQ ID NO: 382302 - RNA, 20 nt, Homo sapiens
cagaacuggaccaucuccaa

SEQ ID NO: 382303 - RNA, 18 nt, Homo sapiens
cagaacuggacucaggau

SEQ ID NO: 382304 - RNA, 20 nt, Homo sapiens
cagaacuuaaggauggagcc

SEQ ID NO: 382305 - RNA, 15 nt, Homo sapiens
cagaagaaugggaau

SEQ ID NO: 382306 - RNA, 14 nt, Homo sapiens
cagaagaucugaaa

SEQ ID NO: 382307 - RNA, 21 nt, Homo sapiens
cagaagcacauaugaacugga

SEQ ID NO: 382308 - RNA, 14 nt, Homo sapiens
cagaagcauuucac

SEQ ID NO: 382309 - RNA, 16 nt, Homo sapiens
cagaaggcaaacccau

SEQ ID NO: 382310 - RNA, 21 nt, Homo sapiens
cagaaguuugagaucagccug

SEQ ID NO: 382311 - RNA, 14 nt, Homo sapiens
cagaauauacuaaa

SEQ ID NO: 382312 - RNA, 19 nt, Homo sapiens
cagaauauugcuuugguca

SEQ ID NO: 382313 - RNA, 17 nt, Homo sapiens
cagaaucuguuaccaga

SEQ ID NO: 382314 - RNA, 13 nt, Homo sapiens
cagaauucuucag

SEQ ID NO: 382315 - RNA, 19 nt, Homo sapiens
cagacacacacacacacaa

SEQ ID NO: 382316 - RNA, 17 nt, Homo sapiens
cagacgguucaccagcc

SEQ ID NO: 382317 - RNA, 17 nt, Homo sapiens
cagacucacauccugac

SEQ ID NO: 382318 - RNA, 19 nt, Homo sapiens
cagacucagacuccauuug

SEQ ID NO: 382319 - RNA, 15 nt, Homo sapiens
ggucagugguccaca

SEQ ID NO: 382320 - RNA, 16 nt, Homo sapiens
gguccaccccauguca

SEQ ID NO: 382321 - RNA, 22 nt, Homo sapiens
gguccagcuugcucuucagugg

SEQ ID NO: 382322 - RNA, 22 nt, Homo sapiens
gguccuugcaccccucacucug

SEQ ID NO: 382323 - RNA, 15 nt, Homo sapiens
ggucuguagggauuu

SEQ ID NO: 382324 - RNA, 23 nt, Homo sapiens
ggucuguuguaggguugccagau

SEQ ID NO: 382325 - RNA, 14 nt, Homo sapiens
ggugacguagaauu

SEQ ID NO: 382326 - RNA, 20 nt, Homo sapiens
ggugcuaucgcaccacugug

SEQ ID NO: 382327 - RNA, 13 nt, Homo sapiens
gguggagggccac

SEQ ID NO: 382328 - RNA, 17 nt, Homo sapiens
ggugucagucagggaca

SEQ ID NO: 382329 - RNA, 14 nt, Homo sapiens
gguuaaauuugaau

SEQ ID NO: 382330 - RNA, 19 nt, Homo sapiens
gguuaauaaguuucacuga

SEQ ID NO: 382331 - RNA, 13 nt, Homo sapiens
gguugcagugagc

SEQ ID NO: 382332 - RNA, 22 nt, Homo sapiens
gguuggaaaacaguauuuucca

SEQ ID NO: 382333 - RNA, 13 nt, Homo sapiens
gguuggcaaaaua

SEQ ID NO: 382334 - RNA, 20 nt, Homo sapiens
guaaaauauagcuguacaaa

SEQ ID NO: 382335 - RNA, 14 nt, Homo sapiens
guaaacugugcacc

SEQ ID NO: 382336 - RNA, 21 nt, Homo sapiens
guaaagaaauauauaugauau

SEQ ID NO: 382337 - RNA, 19 nt, Homo sapiens
guaaaggcuauacuugucu

SEQ ID NO: 382338 - RNA, 16 nt, Homo sapiens
guaaauaguauuugag

SEQ ID NO: 382339 - RNA, 20 nt, Homo sapiens
guaaaugcuagguuaauucc

SEQ ID NO: 382340 - RNA, 15 nt, Homo sapiens
guaaauguccugcua

SEQ ID NO: 382341 - RNA, 13 nt, Homo sapiens
guaacaacugugg

SEQ ID NO: 382342 - RNA, 16 nt, Homo sapiens
guaacauccuuucuau

SEQ ID NO: 382343 - RNA, 17 nt, Homo sapiens
guaagcuuuaagcgcaa

SEQ ID NO: 382344 - RNA, 15 nt, Homo sapiens
guaaggugagggaau

SEQ ID NO: 382345 - RNA, 23 nt, Homo sapiens
guaauucuaaaugaauguuuaca

SEQ ID NO: 382346 - RNA, 17 nt, Homo sapiens
guacagguaaggugagg

SEQ ID NO: 382347 - RNA, 12 nt, Homo sapiens
guacaucuggcc

SEQ ID NO: 382348 - RNA, 13 nt, Homo sapiens
guacaucuuugga

SEQ ID NO: 382349 - RNA, 18 nt, Homo sapiens
guaccagcagcuggaauc

SEQ ID NO: 382350 - RNA, 13 nt, Homo sapiens
guaccugugcacg

SEQ ID NO: 382351 - RNA, 18 nt, Homo sapiens
guacguggagagggauga

SEQ ID NO: 382352 - RNA, 15 nt, Homo sapiens
guacuuagcagcuau

SEQ ID NO: 382353 - RNA, 18 nt, Homo sapiens
guagaaauaauaugcauu

SEQ ID NO: 382354 - RNA, 22 nt, Homo sapiens
guagaacagauaaucagugugu

SEQ ID NO: 382355 - RNA, 13 nt, Homo sapiens
guagaacuuggau

SEQ ID NO: 382356 - RNA, 20 nt, Homo sapiens
guaguggaauuaacaggaaa

SEQ ID NO: 382357 - RNA, 22 nt, Homo sapiens
guaguuaggaaauaaaaccuuu

SEQ ID NO: 382358 - RNA, 17 nt, Homo sapiens
guauacccucuguuucc

SEQ ID NO: 382359 - RNA, 15 nt, Homo sapiens
guauaguacuggcau

SEQ ID NO: 382360 - RNA, 10 nt, Homo sapiens
guauaugcac

SEQ ID NO: 382361 - RNA, 13 nt, Homo sapiens
guauaugcugaug

SEQ ID NO: 382362 - RNA, 20 nt, Homo sapiens
guaucucuuuugaauccaug

SEQ ID NO: 382363 - RNA, 15 nt, Homo sapiens
guaugaaugcagugg

SEQ ID NO: 382364 - RNA, 23 nt, Homo sapiens
guaugaggucuaggaacauacuu

SEQ ID NO: 382365 - RNA, 18 nt, Homo sapiens
guaugugcgugugugcaa

SEQ ID NO: 382366 - RNA, 14 nt, Homo sapiens
guauguguguauau

SEQ ID NO: 382367 - RNA, 23 nt, Homo sapiens
guauguuugggagacugcugagu

SEQ ID NO: 382368 - RNA, 22 nt, Homo sapiens
guauuaauguguuaagugcagg

SEQ ID NO: 382369 - RNA, 12 nt, Homo sapiens
guauuagucaca

SEQ ID NO: 382370 - RNA, 20 nt, Homo sapiens
guauuuuguuuuugucuuaa

SEQ ID NO: 382371 - RNA, 14 nt, Homo sapiens
gucaaaaggugccu

SEQ ID NO: 382372 - RNA, 22 nt, Homo sapiens
gucaaaguaaaacuugcugccu

SEQ ID NO: 382373 - RNA, 22 nt, Homo sapiens
gucaacccaauaguuguugauu

SEQ ID NO: 382374 - RNA, 22 nt, Homo sapiens
gucaaggauggaugcagaucca

SEQ ID NO: 382375 - RNA, 18 nt, Homo sapiens
gucacauuguaacugaac

SEQ ID NO: 382376 - RNA, 22 nt, Homo sapiens
gucacgcuuucaugaauucugu

SEQ ID NO: 382377 - RNA, 23 nt, Homo sapiens
gucacgcuuucaugaauucuguc

SEQ ID NO: 382378 - RNA, 22 nt, Homo sapiens
gucacucaccacuacaucacuu

SEQ ID NO: 382379 - RNA, 16 nt, Homo sapiens
gucagaguugugcaca

SEQ ID NO: 382380 - RNA, 20 nt, Homo sapiens
gucaguccaggaugcuaaca

SEQ ID NO: 382381 - RNA, 21 nt, Homo sapiens
gucaucucucacacauuccag

SEQ ID NO: 382382 - RNA, 24 nt, Homo sapiens
gucauggcaccaaagccaccagac

SEQ ID NO: 382383 - RNA, 22 nt, Homo sapiens
guccaagugugugugcgugugu

SEQ ID NO: 382384 - RNA, 19 nt, Homo sapiens
guccaugugugugcaagug

SEQ ID NO: 382385 - RNA, 17 nt, Homo sapiens
guccauuguccaauccu

SEQ ID NO: 382386 - RNA, 15 nt, Homo sapiens
gucccagcuacucag

SEQ ID NO: 382387 - RNA, 19 nt, Homo sapiens
gucccauggacacuccagu

SEQ ID NO: 382388 - RNA, 14 nt, Homo sapiens
guccccaccuggga

SEQ ID NO: 382389 - RNA, 16 nt, Homo sapiens
guccccuccacuguca

SEQ ID NO: 382390 - RNA, 18 nt, Homo sapiens
gucccugucaccaagcuc

SEQ ID NO: 382391 - RNA, 24 nt, Homo sapiens
guccucacaucuuucacacuucca

SEQ ID NO: 382392 - RNA, 20 nt, Homo sapiens
guccucaccccuguccucac

SEQ ID NO: 382393 - RNA, 19 nt, Homo sapiens
guccucacugcucccugaa

SEQ ID NO: 382394 - RNA, 14 nt, Homo sapiens
guccuggggaccau

SEQ ID NO: 382395 - RNA, 15 nt, Homo sapiens
guccuguacauugug

SEQ ID NO: 382396 - RNA, 20 nt, Homo sapiens
guccuuagccccaucugcca

SEQ ID NO: 382397 - RNA, 13 nt, Homo sapiens
gucucagugcuuu

SEQ ID NO: 382398 - RNA, 20 nt, Homo sapiens
gucucauaugauugugcaca

SEQ ID NO: 382399 - RNA, 14 nt, Homo sapiens
gucucuggcgugug

SEQ ID NO: 382400 - RNA, 18 nt, Homo sapiens
gucugccagccagcagcc

SEQ ID NO: 382401 - RNA, 19 nt, Homo sapiens
gucuggaggggcauggcca

SEQ ID NO: 382402 - RNA, 16 nt, Homo sapiens
gucugggcacagucag

SEQ ID NO: 382403 - RNA, 20 nt, Homo sapiens
gucugugugaugaacuuucu

SEQ ID NO: 382404 - RNA, 16 nt, Homo sapiens
gucugugugcaagugu

SEQ ID NO: 382405 - RNA, 14 nt, Homo sapiens
gucuucaagcagau

SEQ ID NO: 382406 - RNA, 17 nt, Homo sapiens
gucuucagggaagguca

SEQ ID NO: 382407 - RNA, 12 nt, Homo sapiens
gucuucauuaag

SEQ ID NO: 382408 - RNA, 21 nt, Homo sapiens
gucuuccugaguggugccaaa

SEQ ID NO: 382409 - RNA, 22 nt, Homo sapiens
gucuuccugaguggugccaaac

SEQ ID NO: 382410 - RNA, 16 nt, Homo sapiens
gucuucuuuugauaua

SEQ ID NO: 382411 - RNA, 15 nt, Homo sapiens
gucuuuacagaauca

SEQ ID NO: 382412 - RNA, 15 nt, Homo sapiens
gugaaaguacauuug

SEQ ID NO: 382413 - RNA, 20 nt, Homo sapiens
gugaaaugcuggcauuugca

SEQ ID NO: 382414 - RNA, 14 nt, Homo sapiens
gugaacacaucagc

SEQ ID NO: 382415 - RNA, 17 nt, Homo sapiens
gugaagaaaaauguauu

SEQ ID NO: 382416 - RNA, 16 nt, Homo sapiens
gugaauaaaccaucau

SEQ ID NO: 382417 - RNA, 14 nt, Homo sapiens
gugaaucagacccu

SEQ ID NO: 382418 - RNA, 13 nt, Homo sapiens
gugacacauugua

SEQ ID NO: 382419 - RNA, 21 nt, Homo sapiens
gugacagacaggcucuuagca

SEQ ID NO: 382420 - RNA, 14 nt, Homo sapiens
gugacgaacugccc

SEQ ID NO: 382421 - RNA, 19 nt, Homo sapiens
gugacucagaugucucugg

SEQ ID NO: 382422 - RNA, 17 nt, Homo sapiens
gugacuguggcacacgc

SEQ ID NO: 382423 - RNA, 21 nt, Homo sapiens
gugacuugaacuagauugcau

SEQ ID NO: 382424 - RNA, 20 nt, Homo sapiens
gugagaacuacucagggaau

SEQ ID NO: 382425 - RNA, 12 nt, Homo sapiens
gugagacccagc

SEQ ID NO: 382426 - RNA, 16 nt, Homo sapiens
gugagcaaagggcuca

SEQ ID NO: 382427 - RNA, 22 nt, Homo sapiens
gugaguagcugcauuccuagaa

SEQ ID NO: 382428 - RNA, 15 nt, Homo sapiens
gugagugugugcaag

SEQ ID NO: 382429 - RNA, 16 nt, Homo sapiens
gugagugugugcaagu

SEQ ID NO: 382430 - RNA, 22 nt, Homo sapiens
gugaguuuaccuuguauacugu

SEQ ID NO: 382431 - RNA, 23 nt, Homo sapiens
gugaugccucccuguugaagcuc

SEQ ID NO: 382432 - RNA, 14 nt, Homo sapiens
gugcaaugaaugau

SEQ ID NO: 382433 - RNA, 18 nt, Homo sapiens
gugcaccacuucaaguga

SEQ ID NO: 382434 - RNA, 20 nt, Homo sapiens
gugcaguggcccccacagaa

SEQ ID NO: 382435 - RNA, 12 nt, Homo sapiens
gugcaugugcac

SEQ ID NO: 382436 - RNA, 13 nt, Homo sapiens
gugcaugugcacu

SEQ ID NO: 382437 - RNA, 17 nt, Homo sapiens
gugccaauauuucugau

SEQ ID NO: 382438 - RNA, 15 nt, Homo sapiens
gugccagcaaugaca

SEQ ID NO: 382439 - RNA, 20 nt, Homo sapiens
gugcccuuggaggccagcca

SEQ ID NO: 382440 - RNA, 15 nt, Homo sapiens
gugccuggacauuug

SEQ ID NO: 382441 - RNA, 18 nt, Homo sapiens
gugcgugcaugugcacuu

SEQ ID NO: 382442 - RNA, 20 nt, Homo sapiens
gugcuaucgcaccacugugu

SEQ ID NO: 382443 - RNA, 18 nt, Homo sapiens
gugcuuguaaaaagucaa

SEQ ID NO: 382444 - RNA, 15 nt, Homo sapiens
guggcacaagcaaaa

SEQ ID NO: 382445 - RNA, 14 nt, Homo sapiens
guggcacuuaccca

SEQ ID NO: 382446 - RNA, 16 nt, Homo sapiens
guggcagauuuaguga

SEQ ID NO: 382447 - RNA, 18 nt, Homo sapiens
guggcccagggaagccaa

SEQ ID NO: 382448 - RNA, 15 nt, Homo sapiens
guggccccaacacaa

SEQ ID NO: 382449 - RNA, 20 nt, Homo sapiens
gugggcucccugacugggag

SEQ ID NO: 382450 - RNA, 17 nt, Homo sapiens
gugguccuuugggguga

SEQ ID NO: 382451 - RNA, 16 nt, Homo sapiens
gugguuaacaucucag

SEQ ID NO: 382452 - RNA, 23 nt, Homo sapiens
guguaucggaugcuuuuguucag

SEQ ID NO: 382453 - RNA, 13 nt, Homo sapiens
guguaugcacgug

SEQ ID NO: 382454 - RNA, 23 nt, Homo sapiens
guguauuuaaccuugaaggguuc

SEQ ID NO: 382455 - RNA, 16 nt, Homo sapiens
gugucagucagggaca

SEQ ID NO: 382456 - RNA, 19 nt, Homo sapiens
gugucgggaugucaugucc

SEQ ID NO: 382457 - RNA, 13 nt, Homo sapiens
gugugcgugcaug

SEQ ID NO: 382458 - RNA, 19 nt, Homo sapiens
gugugggggaagcaccaua

SEQ ID NO: 382459 - RNA, 23 nt, Homo sapiens
guguguccaugugugugcaagug

SEQ ID NO: 382460 - RNA, 13 nt, Homo sapiens
gugugugcaugug

SEQ ID NO: 382461 - RNA, 21 nt, Homo sapiens
ucauucucugucucauccauc

SEQ ID NO: 382462 - RNA, 18 nt, Homo sapiens
ucauucuuauuucaugaa

SEQ ID NO: 382463 - RNA, 22 nt, Homo sapiens
ucauuggaccuguucaaaaagg

SEQ ID NO: 382464 - RNA, 14 nt, Homo sapiens
ucauuucaaaggga

SEQ ID NO: 382465 - RNA, 17 nt, Homo sapiens
ucauuuuauaugucaaa

SEQ ID NO: 382466 - RNA, 17 nt, Homo sapiens
uccaaaggaaucuccag

SEQ ID NO: 382467 - RNA, 16 nt, Homo sapiens
uccaaaugaaugaccu

SEQ ID NO: 382468 - RNA, 16 nt, Homo sapiens
uccaaaugcccagcuu

SEQ ID NO: 382469 - RNA, 19 nt, Homo sapiens
uccaacagugagucuguca

SEQ ID NO: 382470 - RNA, 14 nt, Homo sapiens
uccaacaugugcuc

SEQ ID NO: 382471 - RNA, 15 nt, Homo sapiens
uccaacaugugcuca

SEQ ID NO: 382472 - RNA, 20 nt, Homo sapiens
uccaacaugugcucagggaa

SEQ ID NO: 382473 - RNA, 16 nt, Homo sapiens
uccaaccccaacucca

SEQ ID NO: 382474 - RNA, 20 nt, Homo sapiens
uccaacguggggcagcacag

SEQ ID NO: 382475 - RNA, 22 nt, Homo sapiens
uccaagcauaccaacacgagca

SEQ ID NO: 382476 - RNA, 23 nt, Homo sapiens
uccaagccugaccacgcuuucua

SEQ ID NO: 382477 - RNA, 20 nt, Homo sapiens
uccaauauucgcugugucag

SEQ ID NO: 382478 - RNA, 12 nt, Homo sapiens
uccaauugaacu

SEQ ID NO: 382479 - RNA, 20 nt, Homo sapiens
uccaauugaacuuucacaua

SEQ ID NO: 382480 - RNA, 16 nt, Homo sapiens
uccacacccucuccca

SEQ ID NO: 382481 - RNA, 14 nt, Homo sapiens
uccaccccauguca

SEQ ID NO: 382482 - RNA, 17 nt, Homo sapiens
uccacgucaacagaauu

SEQ ID NO: 382483 - RNA, 19 nt, Homo sapiens
uccacguucugcucaucau

SEQ ID NO: 382484 - RNA, 19 nt, Homo sapiens
uccacuggaaaaguguaau

SEQ ID NO: 382485 - RNA, 14 nt, Homo sapiens
uccagaccauucag

SEQ ID NO: 382486 - RNA, 17 nt, Homo sapiens
uccaggaagagcugugu

SEQ ID NO: 382487 - RNA, 16 nt, Homo sapiens
uccaggagaaggccaa

SEQ ID NO: 382488 - RNA, 22 nt, Homo sapiens
uccaggccgagaugugcaacac

SEQ ID NO: 382489 - RNA, 15 nt, Homo sapiens
uccaggcgaugugca

SEQ ID NO: 382490 - RNA, 16 nt, Homo sapiens
uccaggcgaugugcaa

SEQ ID NO: 382491 - RNA, 23 nt, Homo sapiens
uccaggcgugguggcacacaccu

SEQ ID NO: 382492 - RNA, 16 nt, Homo sapiens
uccaggcuggggccau

SEQ ID NO: 382493 - RNA, 14 nt, Homo sapiens
uccagggaugccau

SEQ ID NO: 382494 - RNA, 20 nt, Homo sapiens
uccagugccagcaaugacau

SEQ ID NO: 382495 - RNA, 21 nt, Homo sapiens
uccaucacuagccaugauaac

SEQ ID NO: 382496 - RNA, 15 nt, Homo sapiens
uccaucuccacucca

SEQ ID NO: 382497 - RNA, 16 nt, Homo sapiens
uccaugcugccuccag

SEQ ID NO: 382498 - RNA, 23 nt, Homo sapiens
uccauguaggaaaguaaaaugga

SEQ ID NO: 382499 - RNA, 22 nt, Homo sapiens
uccaugucgccucugcauucag

SEQ ID NO: 382500 - RNA, 18 nt, Homo sapiens
uccaugugugugcaagug

SEQ ID NO: 382501 - RNA, 15 nt, Homo sapiens
uccauguuuguaaaa

SEQ ID NO: 382502 - RNA, 17 nt, Homo sapiens
ucccacccccaucucuc

SEQ ID NO: 382503 - RNA, 18 nt, Homo sapiens
ucccacccccaucucucc

SEQ ID NO: 382504 - RNA, 13 nt, Homo sapiens
ucccacucaagcc

SEQ ID NO: 382505 - RNA, 20 nt, Homo sapiens
ucccacugcucccccaacac

SEQ ID NO: 382506 - RNA, 23 nt, Homo sapiens
ucccagaaauuagaaaccuuaau

SEQ ID NO: 382507 - RNA, 23 nt, Homo sapiens
ucccagcacuuugggaggccaag

SEQ ID NO: 382508 - RNA, 17 nt, Homo sapiens
ucccagcuacucaggag

SEQ ID NO: 382509 - RNA, 15 nt, Homo sapiens
ucccagcuacuuggg

SEQ ID NO: 382510 - RNA, 20 nt, Homo sapiens
ucccauccccuggacuggga

SEQ ID NO: 382511 - RNA, 16 nt, Homo sapiens
ucccaugcugaccugu

SEQ ID NO: 382512 - RNA, 22 nt, Homo sapiens
ucccauguaccagcagcuggaa

SEQ ID NO: 382513 - RNA, 18 nt, Homo sapiens
uccccacugccugcugga

SEQ ID NO: 382514 - RNA, 13 nt, Homo sapiens
uccccagccucuu

SEQ ID NO: 382515 - RNA, 19 nt, Homo sapiens
uccccaucuggguccuugc

SEQ ID NO: 382516 - RNA, 12 nt, Homo sapiens
ucccccacugau

SEQ ID NO: 382517 - RNA, 17 nt, Homo sapiens
ucccccagccucaaguc

SEQ ID NO: 382518 - RNA, 22 nt, Homo sapiens
ucccccuggggcuucuccugac

SEQ ID NO: 382519 - RNA, 22 nt, Homo sapiens
uccccuccacugucacauugua

SEQ ID NO: 382520 - RNA, 13 nt, Homo sapiens
uccccucggagaa

SEQ ID NO: 382521 - RNA, 20 nt, Homo sapiens
uccccuggggagucugggca

SEQ ID NO: 382522 - RNA, 22 nt, Homo sapiens
uccccuggggagucugggcaca

SEQ ID NO: 382523 - RNA, 20 nt, Homo sapiens
ucccgaguagcugggauuac

SEQ ID NO: 382524 - RNA, 18 nt, Homo sapiens
ucccggggcuccacugaa

SEQ ID NO: 382525 - RNA, 17 nt, Homo sapiens
ucccucaaagcacacgu

SEQ ID NO: 382526 - RNA, 23 nt, Homo sapiens
ucccucacagcacuaguauuuca

SEQ ID NO: 382527 - RNA, 16 nt, Homo sapiens
ucccuccccugccauu

SEQ ID NO: 382528 - RNA, 14 nt, Homo sapiens
ucccugaagccagc

SEQ ID NO: 382529 - RNA, 21 nt, Homo sapiens
ucccugccugugacuuucaag

SEQ ID NO: 382530 - RNA, 19 nt, Homo sapiens
ucccugggggaagcccugg

SEQ ID NO: 382531 - RNA, 21 nt, Homo sapiens
ucccuguccuccucggaucac

SEQ ID NO: 382532 - RNA, 18 nt, Homo sapiens
ucccuuacccuccuccag

SEQ ID NO: 382533 - RNA, 18 nt, Homo sapiens
ucccuuuccuacucucag

SEQ ID NO: 382534 - RNA, 22 nt, Homo sapiens
ucccuuucugugugaagaucac

SEQ ID NO: 382535 - RNA, 18 nt, Homo sapiens
ucccuuugaaaugaauau

SEQ ID NO: 382536 - RNA, 17 nt, Homo sapiens
ucccuuuguaugggagc

SEQ ID NO: 382537 - RNA, 15 nt, Homo sapiens
uccggaauccugucc

SEQ ID NO: 382538 - RNA, 18 nt, Homo sapiens
uccggaauccuguccuca

SEQ ID NO: 382539 - RNA, 16 nt, Homo sapiens
uccguaguucccugaa

SEQ ID NO: 382540 - RNA, 20 nt, Homo sapiens
uccgucaguccaagucuucu

SEQ ID NO: 382541 - RNA, 20 nt, Homo sapiens
uccuaacaaguagcacccug

SEQ ID NO: 382542 - RNA, 15 nt, Homo sapiens
uccuaauaugcuuua

SEQ ID NO: 382543 - RNA, 13 nt, Homo sapiens
uccuagcacuuug

SEQ ID NO: 382544 - RNA, 17 nt, Homo sapiens
uccuaggaaggggacug

SEQ ID NO: 382545 - RNA, 17 nt, Homo sapiens
uccucacgccacaaauc

SEQ ID NO: 382546 - RNA, 11 nt, Homo sapiens
uccucacuccc

SEQ ID NO: 382547 - RNA, 21 nt, Homo sapiens
uccucauuagcauuuugcuaa

SEQ ID NO: 382548 - RNA, 22 nt, Homo sapiens
uccuccacaauaaggucaaugc

SEQ ID NO: 382549 - RNA, 14 nt, Homo sapiens
uccuccagaccauu

SEQ ID NO: 382550 - RNA, 19 nt, Homo sapiens
uccuccugcccaccuguca

SEQ ID NO: 382551 - RNA, 19 nt, Homo sapiens
uccuccuuugcucuuggga

SEQ ID NO: 382552 - RNA, 14 nt, Homo sapiens
uccucggguaccaa

SEQ ID NO: 382553 - RNA, 13 nt, Homo sapiens
uccucuccacugc

SEQ ID NO: 382554 - RNA, 19 nt, Homo sapiens
uccucuguccaggcacugc

SEQ ID NO: 382555 - RNA, 16 nt, Homo sapiens
uccucugugaccaaug

SEQ ID NO: 382556 - RNA, 16 nt, Homo sapiens
uccucuuucaaccuca

SEQ ID NO: 382557 - RNA, 20 nt, Homo sapiens
uccugcagccuccuccugac

SEQ ID NO: 382558 - RNA, 18 nt, Homo sapiens
uccugccaggauuaaaag

SEQ ID NO: 382559 - RNA, 16 nt, Homo sapiens
uccugccccaugcugc

SEQ ID NO: 382560 - RNA, 18 nt, Homo sapiens
uccugccuguagcaguga

SEQ ID NO: 382561 - RNA, 15 nt, Homo sapiens
uccugcggcaucaga

SEQ ID NO: 382562 - RNA, 17 nt, Homo sapiens
uccugcugcuucugcaa

SEQ ID NO: 382563 - RNA, 14 nt, Homo sapiens
uccuggaugggaca

SEQ ID NO: 382564 - RNA, 22 nt, Homo sapiens
uccuguacauugugggauguuc

SEQ ID NO: 382565 - RNA, 21 nt, Homo sapiens
uccuguuguuauggaaacugu

SEQ ID NO: 382566 - RNA, 18 nt, Homo sapiens
uccuuaaagguagucaag

SEQ ID NO: 382567 - RNA, 23 nt, Homo sapiens
uccuuaauaacaacagaucugca

SEQ ID NO: 382568 - RNA, 16 nt, Homo sapiens
uccuuagagacaucaa

SEQ ID NO: 382569 - RNA, 19 nt, Homo sapiens
uccuuagcuuagaccucag

SEQ ID NO: 382570 - RNA, 22 nt, Homo sapiens
uccuuccugccaccugcugcug

SEQ ID NO: 382571 - RNA, 23 nt, Homo sapiens
uccuugaccagcagaucccagcu

SEQ ID NO: 382572 - RNA, 20 nt, Homo sapiens
uccuuguauuuaaauauuaa

SEQ ID NO: 382573 - RNA, 20 nt, Homo sapiens
uccuugugguuuaugucauc

SEQ ID NO: 382574 - RNA, 14 nt, Homo sapiens
uccuuuaaacauac

SEQ ID NO: 382575 - RNA, 22 nt, Homo sapiens
uccuuuccccagcccagggugg

SEQ ID NO: 382576 - RNA, 21 nt, Homo sapiens
ucgagccacaaccgaccagau

SEQ ID NO: 382577 - RNA, 15 nt, Homo sapiens
ucgaggggcucucag

SEQ ID NO: 382578 - RNA, 17 nt, Homo sapiens
ucgaguuuuaaacuggu

SEQ ID NO: 382579 - RNA, 15 nt, Homo sapiens
ucgccuuagcacuac

SEQ ID NO: 382580 - RNA, 13 nt, Homo sapiens
ucggcacccugca

SEQ ID NO: 382581 - RNA, 15 nt, Homo sapiens
ucggggaacuccugg

SEQ ID NO: 382582 - RNA, 12 nt, Homo sapiens
ucggugugcacc

SEQ ID NO: 382583 - RNA, 19 nt, Homo sapiens
ucgugcggaggauccugua

SEQ ID NO: 382584 - RNA, 15 nt, Homo sapiens
ucgugcuaaacgcac

SEQ ID NO: 382585 - RNA, 24 nt, Homo sapiens
ucuaaauuugaauguuaagcagau

SEQ ID NO: 382586 - RNA, 14 nt, Homo sapiens
ucuaagggaccuca

SEQ ID NO: 382587 - RNA, 16 nt, Homo sapiens
ucuaaguaaaaccaca

SEQ ID NO: 382588 - RNA, 14 nt, Homo sapiens
ucuaagucuuucca

SEQ ID NO: 382589 - RNA, 12 nt, Homo sapiens
ucuaagugauau

SEQ ID NO: 382590 - RNA, 19 nt, Homo sapiens
ucuacagagugauagccuu

SEQ ID NO: 382591 - RNA, 22 nt, Homo sapiens
ucuaccugaccaacaguuccuu

SEQ ID NO: 382592 - RNA, 14 nt, Homo sapiens
ucuacgccagggga

SEQ ID NO: 382593 - RNA, 15 nt, Homo sapiens
ucuacuaacaaucag

SEQ ID NO: 382594 - RNA, 16 nt, Homo sapiens
ucuacuacaugugacu

SEQ ID NO: 382595 - RNA, 20 nt, Homo sapiens
ucuacuacaugugacuggca

SEQ ID NO: 382596 - RNA, 16 nt, Homo sapiens
ucuacuucugcccuug

SEQ ID NO: 382597 - RNA, 20 nt, Homo sapiens
ucuagaaccaggcaacuugg

SEQ ID NO: 382598 - RNA, 16 nt, Homo sapiens
ucuagauuaagauaug

SEQ ID NO: 382599 - RNA, 17 nt, Homo sapiens
ucuagugaaugaaucuc

SEQ ID NO: 382600 - RNA, 19 nt, Homo sapiens
ucuaugaaauaucaugcuc

SEQ ID NO: 382601 - RNA, 20 nt, Homo sapiens
ucuauugaaaaaucaccaca

SEQ ID NO: 382602 - RNA, 20 nt, Homo sapiens
ugugacuucuccaggucuca

SEQ ID NO: 382603 - RNA, 17 nt, Homo sapiens
ugugagaauaaacuaga

SEQ ID NO: 382604 - RNA, 19 nt, Homo sapiens
ugugauauuuuuacuugca

SEQ ID NO: 382605 - RNA, 18 nt, Homo sapiens
ugugaucuaucaauaguc

SEQ ID NO: 382606 - RNA, 13 nt, Homo sapiens
ugugcaacacuca

SEQ ID NO: 382607 - RNA, 22 nt, Homo sapiens
ugugcaagugugugcaugugug

SEQ ID NO: 382608 - RNA, 15 nt, Homo sapiens
ugugcaccuuuacac

SEQ ID NO: 382609 - RNA, 15 nt, Homo sapiens
ugugcagaaccuccu

SEQ ID NO: 382610 - RNA, 20 nt, Homo sapiens
ugugcagguuuugaaaaugu

SEQ ID NO: 382611 - RNA, 21 nt, Homo sapiens
ugugcaguggcccccacagaa

SEQ ID NO: 382612 - RNA, 21 nt, Homo sapiens
ugugcaguguugacaguucau

SEQ ID NO: 382613 - RNA, 17 nt, Homo sapiens
ugugcgugcaugugcac

SEQ ID NO: 382614 - RNA, 19 nt, Homo sapiens
ugugcguguguccaugugu

SEQ ID NO: 382615 - RNA, 15 nt, Homo sapiens
ugugcgugugugcaa

SEQ ID NO: 382616 - RNA, 16 nt, Homo sapiens
ugugcgugugugcaag

SEQ ID NO: 382617 - RNA, 13 nt, Homo sapiens
ugugcucagggaa

SEQ ID NO: 382618 - RNA, 23 nt, Homo sapiens
uguggaauauaaagauggcugac

SEQ ID NO: 382619 - RNA, 17 nt, Homo sapiens
uguggaugauaaaacac

SEQ ID NO: 382620 - RNA, 18 nt, Homo sapiens
uguggaugauaaaacaca

SEQ ID NO: 382621 - RNA, 15 nt, Homo sapiens
uguggcccaagacaa

SEQ ID NO: 382622 - RNA, 20 nt, Homo sapiens
uguggccuucggacaacuca

SEQ ID NO: 382623 - RNA, 17 nt, Homo sapiens
uguggcggcguaauccc

SEQ ID NO: 382624 - RNA, 16 nt, Homo sapiens
uguggcucacgugugu

SEQ ID NO: 382625 - RNA, 17 nt, Homo sapiens
uguggcucacgugugug

SEQ ID NO: 382626 - RNA, 18 nt, Homo sapiens
uguggggugggcacauug

SEQ ID NO: 382627 - RNA, 14 nt, Homo sapiens
ugugggugggacca

SEQ ID NO: 382628 - RNA, 13 nt, Homo sapiens
uguggucaauccg

SEQ ID NO: 382629 - RNA, 14 nt, Homo sapiens
uguggucacaggaa

SEQ ID NO: 382630 - RNA, 17 nt, Homo sapiens
ugugguuaacaucucag

SEQ ID NO: 382631 - RNA, 20 nt, Homo sapiens
ugugguuaacaucucagaaa

SEQ ID NO: 382632 - RNA, 15 nt, Homo sapiens
ugugguuuaugucau

SEQ ID NO: 382633 - RNA, 20 nt, Homo sapiens
ugugguuuaugucaucauac

SEQ ID NO: 382634 - RNA, 20 nt, Homo sapiens
uguguacuuuuggguucaca

SEQ ID NO: 382635 - RNA, 22 nt, Homo sapiens
uguguagcuuuguucauugcau

SEQ ID NO: 382636 - RNA, 17 nt, Homo sapiens
uguguauucuagugaau

SEQ ID NO: 382637 - RNA, 13 nt, Homo sapiens
uguguccaugugu

SEQ ID NO: 382638 - RNA, 18 nt, Homo sapiens
ugugucccccucugucca

SEQ ID NO: 382639 - RNA, 19 nt, Homo sapiens
ugugucccccucuguccag

SEQ ID NO: 382640 - RNA, 13 nt, Homo sapiens
ugugugaagauca

SEQ ID NO: 382641 - RNA, 15 nt, Homo sapiens
ugugugaguguacca

SEQ ID NO: 382642 - RNA, 12 nt, Homo sapiens
ugugugaucugu

SEQ ID NO: 382643 - RNA, 20 nt, Homo sapiens
ugugugcaagugugugcaca

SEQ ID NO: 382644 - RNA, 15 nt, Homo sapiens
ugugugcaugugugc

SEQ ID NO: 382645 - RNA, 17 nt, Homo sapiens
ugugugcgugugcgugc

SEQ ID NO: 382646 - RNA, 16 nt, Homo sapiens
ugugugugcguguguc

SEQ ID NO: 382647 - RNA, 13 nt, Homo sapiens
ugugugugugcaa

SEQ ID NO: 382648 - RNA, 15 nt, Homo sapiens
uguguuaagugcagg

SEQ ID NO: 382649 - RNA, 14 nt, Homo sapiens
uguguuaucucuua

SEQ ID NO: 382650 - RNA, 16 nt, Homo sapiens
uguguuucuguucacc

SEQ ID NO: 382651 - RNA, 13 nt, Homo sapiens
uguuaagugcagg

SEQ ID NO: 382652 - RNA, 20 nt, Homo sapiens
uguuaccugaaaacacugug

SEQ ID NO: 382653 - RNA, 16 nt, Homo sapiens
uguuagcauaauguga

SEQ ID NO: 382654 - RNA, 14 nt, Homo sapiens
uguuaucagucaua

SEQ ID NO: 382655 - RNA, 17 nt, Homo sapiens
uguucagggcugugauc

SEQ ID NO: 382656 - RNA, 16 nt, Homo sapiens
uguucccccugugcag

SEQ ID NO: 382657 - RNA, 15 nt, Homo sapiens
uguucccuauuuugc

SEQ ID NO: 382658 - RNA, 23 nt, Homo sapiens
uguucccuauuuugccaguggga

SEQ ID NO: 382659 - RNA, 18 nt, Homo sapiens
uguuccuuauauuuacuc

SEQ ID NO: 382660 - RNA, 21 nt, Homo sapiens
uguugcccaggcuggucucaa

SEQ ID NO: 382661 - RNA, 15 nt, Homo sapiens
uguuuauacagcuca

SEQ ID NO: 382662 - RNA, 14 nt, Homo sapiens
uguuuauuccugau

SEQ ID NO: 382663 - RNA, 19 nt, Homo sapiens
uguuucuuuuguauguaaa

SEQ ID NO: 382664 - RNA, 13 nt, Homo sapiens
uguuuuagcuccu

SEQ ID NO: 382665 - RNA, 22 nt, Homo sapiens
uguuuuagcuccuugacuccuu

SEQ ID NO: 382666 - RNA, 13 nt, Homo sapiens
uguuuuuaagcug

SEQ ID NO: 382667 - RNA, 19 nt, Homo sapiens
uuaaaaaaaaauacugaug

SEQ ID NO: 382668 - RNA, 13 nt, Homo sapiens
uuaaaaaaucuca

SEQ ID NO: 382669 - RNA, 19 nt, Homo sapiens
uuaaaaagauguauguucc

SEQ ID NO: 382670 - RNA, 21 nt, Homo sapiens
uuaaacaaaauagaagcugua

SEQ ID NO: 382671 - RNA, 14 nt, Homo sapiens
uuaaaccauguaaa

SEQ ID NO: 382672 - RNA, 21 nt, Homo sapiens
uuaaacccuauugguaaagaa

SEQ ID NO: 382673 - RNA, 13 nt, Homo sapiens
uuaaacucaggga

SEQ ID NO: 382674 - RNA, 18 nt, Homo sapiens
uuaaacuuaccugggcau

SEQ ID NO: 382675 - RNA, 20 nt, Homo sapiens
uuaaagcuuauuaaaacuca

SEQ ID NO: 382676 - RNA, 15 nt, Homo sapiens
uuaaauaaaccucaa

SEQ ID NO: 382677 - RNA, 19 nt, Homo sapiens
uuaaauaaaucauuaauac

SEQ ID NO: 382678 - RNA, 22 nt, Homo sapiens
uuaagagaauauuuuaaguauu

SEQ ID NO: 382679 - RNA, 22 nt, Homo sapiens
uuaagagggaacuuagcagaga

SEQ ID NO: 382680 - RNA, 15 nt, Homo sapiens
uuaagaguuacuuaa

SEQ ID NO: 382681 - RNA, 15 nt, Homo sapiens
uuaagccagcacuca

SEQ ID NO: 382682 - RNA, 17 nt, Homo sapiens
uuaagcuuaugucagac

SEQ ID NO: 382683 - RNA, 17 nt, Homo sapiens
uuaaguugauggugaug

SEQ ID NO: 382684 - RNA, 22 nt, Homo sapiens
uuaauauuuaaacagcaguguu

SEQ ID NO: 382685 - RNA, 19 nt, Homo sapiens
uuaauguguuaagugcagg

SEQ ID NO: 382686 - RNA, 13 nt, Homo sapiens
uuacaauugugag

SEQ ID NO: 382687 - RNA, 18 nt, Homo sapiens
uuacaauuuacaaagugu

SEQ ID NO: 382688 - RNA, 19 nt, Homo sapiens
uuacacaaaacaaaugcca

SEQ ID NO: 382689 - RNA, 15 nt, Homo sapiens
uuacaggcacaaaau

SEQ ID NO: 382690 - RNA, 19 nt, Homo sapiens
uuaccaacuuucuguaaac

SEQ ID NO: 382691 - RNA, 20 nt, Homo sapiens
uuacuacaugugggagcuuu

SEQ ID NO: 382692 - RNA, 16 nt, Homo sapiens
uuacuaucaugucaaa

SEQ ID NO: 382693 - RNA, 20 nt, Homo sapiens
uuacugagcuucucugugaa

SEQ ID NO: 382694 - RNA, 17 nt, Homo sapiens
uuacugaucuuacucac

SEQ ID NO: 382695 - RNA, 19 nt, Homo sapiens
uuacugguagaaaggcagu

SEQ ID NO: 382696 - RNA, 14 nt, Homo sapiens
uuacuuuuucauuc

SEQ ID NO: 382697 - RNA, 19 nt, Homo sapiens
uuagaaaaaccaccaccau

SEQ ID NO: 382698 - RNA, 21 nt, Homo sapiens
uuagaaaaauccuacaaggcu

SEQ ID NO: 382699 - RNA, 21 nt, Homo sapiens
uuagaaugggaucacgaggaa

SEQ ID NO: 382700 - RNA, 15 nt, Homo sapiens
uuagacccugcauuu

SEQ ID NO: 382701 - RNA, 19 nt, Homo sapiens
uuagacuucugcuuuccac

SEQ ID NO: 382702 - RNA, 15 nt, Homo sapiens
uuagcaaauacauau

SEQ ID NO: 382703 - RNA, 14 nt, Homo sapiens
uuagcacacucaca

SEQ ID NO: 382704 - RNA, 14 nt, Homo sapiens
uuagcauaauguga

SEQ ID NO: 382705 - RNA, 23 nt, Homo sapiens
uuagcauuccuauugacaacucu

SEQ ID NO: 382706 - RNA, 15 nt, Homo sapiens
uuagcauuuugcuaa

SEQ ID NO: 382707 - RNA, 15 nt, Homo sapiens
uuagcccaaaaccaa

SEQ ID NO: 382708 - RNA, 12 nt, Homo sapiens
uuagcuuuacaa

SEQ ID NO: 382709 - RNA, 16 nt, Homo sapiens
uuaguaauuucuugcu

SEQ ID NO: 382710 - RNA, 24 nt, Homo sapiens
uuauaaaagaugcauuaucuauga

SEQ ID NO: 382711 - RNA, 23 nt, Homo sapiens
uuauaagagugccguaacaacug

SEQ ID NO: 382712 - RNA, 13 nt, Homo sapiens
uuauacauuugau

SEQ ID NO: 382713 - RNA, 19 nt, Homo sapiens
uuauacuguggcuaugcaa

SEQ ID NO: 382714 - RNA, 21 nt, Homo sapiens
uuauacuucucuauuaucuca

SEQ ID NO: 382715 - RNA, 21 nt, Homo sapiens
uuauagaauauuuauuaccuc

SEQ ID NO: 382716 - RNA, 20 nt, Homo sapiens
uuauagaccagaaccagagc

SEQ ID NO: 382717 - RNA, 18 nt, Homo sapiens
uuauauagguugugcaaa

SEQ ID NO: 382718 - RNA, 18 nt, Homo sapiens
uuaucaccgugggcuccc

SEQ ID NO: 382719 - RNA, 13 nt, Homo sapiens
uuaucuauggcac

SEQ ID NO: 382720 - RNA, 12 nt, Homo sapiens
uuaucugugcaa

SEQ ID NO: 382721 - RNA, 17 nt, Homo sapiens
uuaugccuucacuuuac

SEQ ID NO: 382722 - RNA, 15 nt, Homo sapiens
uuaugucaucauaca

SEQ ID NO: 382723 - RNA, 19 nt, Homo sapiens
uuaugucaucauacaugac

SEQ ID NO: 382724 - RNA, 21 nt, Homo sapiens
uuaugucuauuuaagccucau

SEQ ID NO: 382725 - RNA, 14 nt, Homo sapiens
uuauguuagcauug

SEQ ID NO: 382726 - RNA, 19 nt, Homo sapiens
uuauuaauaaacauucuau

SEQ ID NO: 382727 - RNA, 16 nt, Homo sapiens
uuauuaccauuagcau

SEQ ID NO: 382728 - RNA, 15 nt, Homo sapiens
uuauucccuuucaca

SEQ ID NO: 382729 - RNA, 15 nt, Homo sapiens
uuauucugauuccac

SEQ ID NO: 382730 - RNA, 23 nt, Homo sapiens
uuauugccuggagugugaacugu

SEQ ID NO: 382731 - RNA, 13 nt, Homo sapiens
uuauuuccacuua

SEQ ID NO: 382732 - RNA, 21 nt, Homo sapiens
uuauuuccacuuauaaaggaa

SEQ ID NO: 382733 - RNA, 16 nt, Homo sapiens
uuauuuugaaaauaau

SEQ ID NO: 382734 - RNA, 16 nt, Homo sapiens
uucaagccuuagauaa

SEQ ID NO: 382735 - RNA, 13 nt, Homo sapiens
uucaaguguacag

SEQ ID NO: 382736 - RNA, 16 nt, Homo sapiens
uucacagaugugugau

SEQ ID NO: 382737 - RNA, 12 nt, Homo sapiens
uucacaguguga

SEQ ID NO: 382738 - RNA, 19 nt, Homo sapiens
uucacaugagcuauuucca

SEQ ID NO: 382739 - RNA, 13 nt, Homo sapiens
uucaccuugggau

SEQ ID NO: 382740 - RNA, 12 nt, Homo sapiens
uucacuuuacaa

SEQ ID NO: 382741 - RNA, 14 nt, Homo sapiens
uucagcaguaccua

SEQ ID NO: 382742 - RNA, 20 nt, Homo sapiens
uucagccuagccgaccucag

SEQ ID NO: 382743 - RNA, 16 nt, Homo sapiens
uucagccugaaagagg

SEQ ID NO: 382744 - RNA, 14 nt, Homo sapiens
uucagcucugcaag

SEQ ID NO: 382745 - RNA, 20 nt, Homo sapiens
aacuuggagccccagugcca

SEQ ID NO: 382746 - RNA, 19 nt, Homo sapiens
aacuuuccucgccugacaa

SEQ ID NO: 382747 - RNA, 23 nt, Homo sapiens
aacuuugacaaccaugagaccac

SEQ ID NO: 382748 - RNA, 13 nt, Homo sapiens
aacuuuguauuaa

SEQ ID NO: 382749 - RNA, 20 nt, Homo sapiens
aacuuuguuuagcccaaaac

SEQ ID NO: 382750 - RNA, 23 nt, Homo sapiens
aacuuuguuuagcccaaaaccaa

SEQ ID NO: 382751 - RNA, 22 nt, Homo sapiens
aagaaaaagucauccaaucuaa

SEQ ID NO: 382752 - RNA, 18 nt, Homo sapiens
aagaaauauauacuugag

SEQ ID NO: 382753 - RNA, 20 nt, Homo sapiens
aagaacaguaacugccauca

SEQ ID NO: 382754 - RNA, 15 nt, Homo sapiens
aagaagccacagacc

SEQ ID NO: 382755 - RNA, 15 nt, Homo sapiens
aagaagcucucuccu

SEQ ID NO: 382756 - RNA, 17 nt, Homo sapiens
aagaauaaaauugcacu

SEQ ID NO: 382757 - RNA, 13 nt, Homo sapiens
aagaauacagaaa

SEQ ID NO: 382758 - RNA, 15 nt, Homo sapiens
aagacaaaugcugcg

SEQ ID NO: 382759 - RNA, 23 nt, Homo sapiens
aagacaggacccugggaccacag

SEQ ID NO: 382760 - RNA, 20 nt, Homo sapiens
aagacauaaauuacuuuuuc

SEQ ID NO: 382761 - RNA, 16 nt, Homo sapiens
aagacauccugagcag

SEQ ID NO: 382762 - RNA, 15 nt, Homo sapiens
aagacauucuuccaa

SEQ ID NO: 382763 - RNA, 15 nt, Homo sapiens
aagaccagcuuugca

SEQ ID NO: 382764 - RNA, 16 nt, Homo sapiens
aagaccagcuuugcag

SEQ ID NO: 382765 - RNA, 22 nt, Homo sapiens
aagacucuacccauauuacaga

SEQ ID NO: 382766 - RNA, 22 nt, Homo sapiens
aagacuucaguauguugucaaa

SEQ ID NO: 382767 - RNA, 12 nt, Homo sapiens
aagaggcuggau

SEQ ID NO: 382768 - RNA, 12 nt, Homo sapiens
aagaggggaaaa

SEQ ID NO: 382769 - RNA, 13 nt, Homo sapiens
aagaguaguaaua

SEQ ID NO: 382770 - RNA, 14 nt, Homo sapiens
aagaguaguaauag

SEQ ID NO: 382771 - RNA, 18 nt, Homo sapiens
aagagucauauugcccag

SEQ ID NO: 382772 - RNA, 17 nt, Homo sapiens
aagauacagaacucuuu

SEQ ID NO: 382773 - RNA, 18 nt, Homo sapiens
aagauccgagucuaccca

SEQ ID NO: 382774 - RNA, 18 nt, Homo sapiens
aagaugagagaacuggag

SEQ ID NO: 382775 - RNA, 14 nt, Homo sapiens
aagaugaucaucuc

SEQ ID NO: 382776 - RNA, 15 nt, Homo sapiens
aagaugcagcaaaau

SEQ ID NO: 382777 - RNA, 19 nt, Homo sapiens
aagaugcagcaaaauguga

SEQ ID NO: 382778 - RNA, 21 nt, Homo sapiens
aagaugccagugaaacuucaa

SEQ ID NO: 382779 - RNA, 22 nt, Homo sapiens
aagaugcugacauccagguggg

SEQ ID NO: 382780 - RNA, 23 nt, Homo sapiens
aagauguagaggagaaacuggaa

SEQ ID NO: 382781 - RNA, 13 nt, Homo sapiens
aagauugauacuu

SEQ ID NO: 382782 - RNA, 15 nt, Homo sapiens
aagauuuucagaaaa

SEQ ID NO: 382783 - RNA, 14 nt, Homo sapiens
aagcaaaaucauuu

SEQ ID NO: 382784 - RNA, 18 nt, Homo sapiens
aagcaacccaaauguuca

SEQ ID NO: 382785 - RNA, 13 nt, Homo sapiens
aagcaauugucug

SEQ ID NO: 382786 - RNA, 19 nt, Homo sapiens
aagcacuacauaaacugac

SEQ ID NO: 382787 - RNA, 23 nt, Homo sapiens
aagcacuguuggagcuacugcaa

SEQ ID NO: 382788 - RNA, 22 nt, Homo sapiens
aagcagaaauacauauuuccaa

SEQ ID NO: 382789 - RNA, 17 nt, Homo sapiens
aagcagaacagugauua

SEQ ID NO: 382790 - RNA, 20 nt, Homo sapiens
aagcagaacagugauuacca

SEQ ID NO: 382791 - RNA, 15 nt, Homo sapiens
aagcagaagcacaua

SEQ ID NO: 382792 - RNA, 18 nt, Homo sapiens
aagcagaugcaaagaggc

SEQ ID NO: 382793 - RNA, 19 nt, Homo sapiens
aagcaggacuaaaugucua

SEQ ID NO: 382794 - RNA, 24 nt, Homo sapiens
aagcaucucagccuaccaugagaa

SEQ ID NO: 382795 - RNA, 15 nt, Homo sapiens
aagcauuucaccuuu

SEQ ID NO: 382796 - RNA, 22 nt, Homo sapiens
aagcauuuuacaagaucuugca

SEQ ID NO: 382797 - RNA, 13 nt, Homo sapiens
aagccccagugag

SEQ ID NO: 382798 - RNA, 15 nt, Homo sapiens
aagcccuuuacuuga

SEQ ID NO: 382799 - RNA, 18 nt, Homo sapiens
aagccucagccauucacu

SEQ ID NO: 382800 - RNA, 14 nt, Homo sapiens
aagccucaugucca

SEQ ID NO: 382801 - RNA, 16 nt, Homo sapiens
aagccugggugacauu

SEQ ID NO: 382802 - RNA, 12 nt, Homo sapiens
aagccugugaaa

SEQ ID NO: 382803 - RNA, 17 nt, Homo sapiens
aagccuuuggcucuucu

SEQ ID NO: 382804 - RNA, 15 nt, Homo sapiens
aagcuaaaaugauuu

SEQ ID NO: 382805 - RNA, 20 nt, Homo sapiens
aagcuaaaauuagaugaacu

SEQ ID NO: 382806 - RNA, 17 nt, Homo sapiens
aagcuaguggcuucaaa

SEQ ID NO: 382807 - RNA, 13 nt, Homo sapiens
aagcucaucucag

SEQ ID NO: 382808 - RNA, 15 nt, Homo sapiens
aagcuccacugucac

SEQ ID NO: 382809 - RNA, 20 nt, Homo sapiens
aagcucuggugacaccagcc

SEQ ID NO: 382810 - RNA, 21 nt, Homo sapiens
aagcucuggugacaccagccu

SEQ ID NO: 382811 - RNA, 12 nt, Homo sapiens
aagcugccucaa

SEQ ID NO: 382812 - RNA, 22 nt, Homo sapiens
aagcugguaaacuauuugucuu

SEQ ID NO: 382813 - RNA, 21 nt, Homo sapiens
aagcugucccucacuguugaa

SEQ ID NO: 382814 - RNA, 17 nt, Homo sapiens
aaggaagacaaugugaa

SEQ ID NO: 382815 - RNA, 18 nt, Homo sapiens
aaggacuccacccauccu

SEQ ID NO: 382816 - RNA, 16 nt, Homo sapiens
aaggagccccauuccu

SEQ ID NO: 382817 - RNA, 17 nt, Homo sapiens
aaggauaugcaguaugc

SEQ ID NO: 382818 - RNA, 18 nt, Homo sapiens
aaggauggagccagcucu

SEQ ID NO: 382819 - RNA, 15 nt, Homo sapiens
aaggcaccuauaaaa

SEQ ID NO: 382820 - RNA, 16 nt, Homo sapiens
aaggcgugagucuuca

SEQ ID NO: 382821 - RNA, 20 nt, Homo sapiens
aagggccagcuggaggugaa

SEQ ID NO: 382822 - RNA, 14 nt, Homo sapiens
aaggggugggccac

SEQ ID NO: 382823 - RNA, 22 nt, Homo sapiens
aaggguaccuugaacacugggg

SEQ ID NO: 382824 - RNA, 18 nt, Homo sapiens
aaggguucaccaggucag

SEQ ID NO: 382825 - RNA, 15 nt, Homo sapiens
aagguacuuaaagcu

SEQ ID NO: 382826 - RNA, 14 nt, Homo sapiens
aagguggucacugu

SEQ ID NO: 382827 - RNA, 20 nt, Homo sapiens
aagguucucagguguugcca

SEQ ID NO: 382828 - RNA, 22 nt, Homo sapiens
aagguugcugaggcucugaccc

SEQ ID NO: 382829 - RNA, 12 nt, Homo sapiens
aaguaaaaccac

SEQ ID NO: 382830 - RNA, 15 nt, Homo sapiens
aaguaaaaccacagc

SEQ ID NO: 382831 - RNA, 17 nt, Homo sapiens
aaguaaguuugauuuca

SEQ ID NO: 382832 - RNA, 19 nt, Homo sapiens
aaguacuagcuuacuuuug

SEQ ID NO: 382833 - RNA, 14 nt, Homo sapiens
aaguagaauccuaa

SEQ ID NO: 382834 - RNA, 22 nt, Homo sapiens
aaguagacuucauuuuuccuaa

SEQ ID NO: 382835 - RNA, 12 nt, Homo sapiens
aaguauccuuca

SEQ ID NO: 382836 - RNA, 19 nt, Homo sapiens
aaguauuauuuauuugaau

SEQ ID NO: 382837 - RNA, 23 nt, Homo sapiens
aagucacugcacagugcaucuca

SEQ ID NO: 382838 - RNA, 19 nt, Homo sapiens
aaguccuacaagcuaaaau

SEQ ID NO: 382839 - RNA, 15 nt, Homo sapiens
aaguccuugcucccg

SEQ ID NO: 382840 - RNA, 16 nt, Homo sapiens
aagucuucagggaagg

SEQ ID NO: 382841 - RNA, 14 nt, Homo sapiens
aagugacucucaca

SEQ ID NO: 382842 - RNA, 20 nt, Homo sapiens
aagugagacccugucucaaa

SEQ ID NO: 382843 - RNA, 22 nt, Homo sapiens
aagugauaucccccagccucaa

SEQ ID NO: 382844 - RNA, 16 nt, Homo sapiens
aagugcaaauuugaua

SEQ ID NO: 382845 - RNA, 21 nt, Homo sapiens
aaguguaugcacgugugcaca

SEQ ID NO: 382846 - RNA, 15 nt, Homo sapiens
aagugugugaucugu

SEQ ID NO: 382847 - RNA, 22 nt, Homo sapiens
aaguuauacuguggcuaugcaa

SEQ ID NO: 382848 - RNA, 18 nt, Homo sapiens
aaguuccaguguucucuc

SEQ ID NO: 382849 - RNA, 22 nt, Homo sapiens
aaguucccuacuuccugugacu

SEQ ID NO: 382850 - RNA, 15 nt, Homo sapiens
aaguucugacuugac

SEQ ID NO: 382851 - RNA, 20 nt, Homo sapiens
aaguugcugaugaacucuua

SEQ ID NO: 382852 - RNA, 17 nt, Homo sapiens
aaguuucaucagucaau

SEQ ID NO: 382853 - RNA, 22 nt, Homo sapiens
aaguuucaucagucaaugagga

SEQ ID NO: 382854 - RNA, 20 nt, Homo sapiens
aaguuuuucagaaagcauua

SEQ ID NO: 382855 - RNA, 13 nt, Homo sapiens
aauaaaaacugac

SEQ ID NO: 382856 - RNA, 14 nt, Homo sapiens
aauaaaaacugacu

SEQ ID NO: 382857 - RNA, 18 nt, Homo sapiens
aauaaaguucuguacuca

SEQ ID NO: 382858 - RNA, 19 nt, Homo sapiens
aauaacaacagaucugcag

SEQ ID NO: 382859 - RNA, 13 nt, Homo sapiens
aauaagcugccuu

SEQ ID NO: 382860 - RNA, 15 nt, Homo sapiens
aauaauaaaucuggu

SEQ ID NO: 382861 - RNA, 14 nt, Homo sapiens
aauaauacacuaau

SEQ ID NO: 382862 - RNA, 20 nt, Homo sapiens
aauaauacaguaucucaggg

SEQ ID NO: 382863 - RNA, 20 nt, Homo sapiens
aauaauccagaaaaacugug

SEQ ID NO: 382864 - RNA, 21 nt, Homo sapiens
aauacagacuacuucuucccc

SEQ ID NO: 382865 - RNA, 15 nt, Homo sapiens
aauacaugcaucuca

SEQ ID NO: 382866 - RNA, 18 nt, Homo sapiens
aauaccaaaauuauuuca

SEQ ID NO: 382867 - RNA, 22 nt, Homo sapiens
aauacugaaggacacagcagug

SEQ ID NO: 382868 - RNA, 20 nt, Homo sapiens
aauacugauguuccuaguga

SEQ ID NO: 382869 - RNA, 16 nt, Homo sapiens
aauauaaaaguaaaua

SEQ ID NO: 382870 - RNA, 15 nt, Homo sapiens
aauaucaguuacuca

SEQ ID NO: 382871 - RNA, 15 nt, Homo sapiens
aauaucaugcuccau

SEQ ID NO: 382872 - RNA, 17 nt, Homo sapiens
aauauccaaaccaaaua

SEQ ID NO: 382873 - RNA, 16 nt, Homo sapiens
aauaucccuacaugua

SEQ ID NO: 382874 - RNA, 18 nt, Homo sapiens
aauaugagauaaugcagu

SEQ ID NO: 382875 - RNA, 19 nt, Homo sapiens
aauaugagauaaugcaguc

SEQ ID NO: 382876 - RNA, 18 nt, Homo sapiens
auaagagugccguaacaa

SEQ ID NO: 382877 - RNA, 19 nt, Homo sapiens
auaagauggaagcuuccag

SEQ ID NO: 382878 - RNA, 15 nt, Homo sapiens
auaagugcaugacau

SEQ ID NO: 382879 - RNA, 23 nt, Homo sapiens
auaauauuaaggaagacaaugug

SEQ ID NO: 382880 - RNA, 21 nt, Homo sapiens
auaaucauucuuauuucauga

SEQ ID NO: 382881 - RNA, 22 nt, Homo sapiens
auaaucauucuuauuucaugaa

SEQ ID NO: 382882 - RNA, 14 nt, Homo sapiens
auaaugcuaaagaa

SEQ ID NO: 382883 - RNA, 17 nt, Homo sapiens
auaaugcuguugccuca

SEQ ID NO: 382884 - RNA, 18 nt, Homo sapiens
auaaugguugacuggguu

SEQ ID NO: 382885 - RNA, 15 nt, Homo sapiens
auaauuaguuccuca

SEQ ID NO: 382886 - RNA, 21 nt, Homo sapiens
auacaagaggcucccucuuga

SEQ ID NO: 382887 - RNA, 18 nt, Homo sapiens
auacaauuagccaggugu

SEQ ID NO: 382888 - RNA, 13 nt, Homo sapiens
auacacuuacacu

SEQ ID NO: 382889 - RNA, 16 nt, Homo sapiens
auacaguaucucaggg

SEQ ID NO: 382890 - RNA, 16 nt, Homo sapiens
auacaugacucagcau

SEQ ID NO: 382891 - RNA, 18 nt, Homo sapiens
auacaugcuuuuuaauga

SEQ ID NO: 382892 - RNA, 20 nt, Homo sapiens
auacauggaaacgcaaauga

SEQ ID NO: 382893 - RNA, 21 nt, Homo sapiens
auaccucaacccccauuucua

SEQ ID NO: 382894 - RNA, 17 nt, Homo sapiens
auaccuuuauugugauc

SEQ ID NO: 382895 - RNA, 18 nt, Homo sapiens
auaccuuuauugugaucu

SEQ ID NO: 382896 - RNA, 14 nt, Homo sapiens
auacugaaggacac

SEQ ID NO: 382897 - RNA, 21 nt, Homo sapiens
auacugcagggccaggacuga

SEQ ID NO: 382898 - RNA, 13 nt, Homo sapiens
auacuuuacaaag

SEQ ID NO: 382899 - RNA, 17 nt, Homo sapiens
auagaaacuugcuuauc

SEQ ID NO: 382900 - RNA, 20 nt, Homo sapiens
auagagaucauccuuuccag

SEQ ID NO: 382901 - RNA, 18 nt, Homo sapiens
auagaggggggcugccug

SEQ ID NO: 382902 - RNA, 15 nt, Homo sapiens
auagaguauaugcac

SEQ ID NO: 382903 - RNA, 17 nt, Homo sapiens
auagcagcagugcaugg

SEQ ID NO: 382904 - RNA, 18 nt, Homo sapiens
auagcaguugaaacaaga

SEQ ID NO: 382905 - RNA, 23 nt, Homo sapiens
auagcaguugaaacaagaagcca

SEQ ID NO: 382906 - RNA, 23 nt, Homo sapiens
auagccaccccagaaauggugaa

SEQ ID NO: 382907 - RNA, 22 nt, Homo sapiens
auaggcugacuuuugcagaugg

SEQ ID NO: 382908 - RNA, 23 nt, Homo sapiens
auaguacagguaaggugagggaa

SEQ ID NO: 382909 - RNA, 11 nt, Homo sapiens
auaguacuggc

SEQ ID NO: 382910 - RNA, 15 nt, Homo sapiens
auaguuguaccgcaa

SEQ ID NO: 382911 - RNA, 13 nt, Homo sapiens
auauaacugccuu

SEQ ID NO: 382912 - RNA, 12 nt, Homo sapiens
auauacaaauag

SEQ ID NO: 382913 - RNA, 12 nt, Homo sapiens
auauaccaagcu

SEQ ID NO: 382914 - RNA, 12 nt, Homo sapiens
auauacuaugag

SEQ ID NO: 382915 - RNA, 23 nt, Homo sapiens
auauaugauauauaaaugugauu

SEQ ID NO: 382916 - RNA, 19 nt, Homo sapiens
auauauuccgcacucaagg

SEQ ID NO: 382917 - RNA, 16 nt, Homo sapiens
auaucaucagcauacc

SEQ ID NO: 382918 - RNA, 18 nt, Homo sapiens
auaucaucagcauaccuu

SEQ ID NO: 382919 - RNA, 21 nt, Homo sapiens
auaucaucagcauaccuuuau

SEQ ID NO: 382920 - RNA, 14 nt, Homo sapiens
auaucaugcuccau

SEQ ID NO: 382921 - RNA, 16 nt, Homo sapiens
auauccaaaccaaaua

SEQ ID NO: 382922 - RNA, 21 nt, Homo sapiens
auaucccuacauguauugcac

SEQ ID NO: 382923 - RNA, 19 nt, Homo sapiens
auauccuuucuaacaaaaa

SEQ ID NO: 382924 - RNA, 14 nt, Homo sapiens
auaucgaucucuua

SEQ ID NO: 382925 - RNA, 18 nt, Homo sapiens
auaugaacuggaccugca

SEQ ID NO: 382926 - RNA, 22 nt, Homo sapiens
auaugagcuuccuucugugaaa

SEQ ID NO: 382927 - RNA, 16 nt, Homo sapiens
auaugauuaguaaaga

SEQ ID NO: 382928 - RNA, 14 nt, Homo sapiens
auaugauugugcac

SEQ ID NO: 382929 - RNA, 14 nt, Homo sapiens
auaugcaaagcacu

SEQ ID NO: 382930 - RNA, 21 nt, Homo sapiens
auaugcacaauagcaguugaa

SEQ ID NO: 382931 - RNA, 19 nt, Homo sapiens
auauguaaauagugcagaa

SEQ ID NO: 382932 - RNA, 16 nt, Homo sapiens
auauguucaacuggag

SEQ ID NO: 382933 - RNA, 22 nt, Homo sapiens
auauguugaugaaaaauagcaa

SEQ ID NO: 382934 - RNA, 23 nt, Homo sapiens
auauguugaugaaaaauagcaac

SEQ ID NO: 382935 - RNA, 13 nt, Homo sapiens
auauucauuugga

SEQ ID NO: 382936 - RNA, 13 nt, Homo sapiens
auauuccugcauu

SEQ ID NO: 382937 - RNA, 20 nt, Homo sapiens
auauuguggcacaagcaaaa

SEQ ID NO: 382938 - RNA, 16 nt, Homo sapiens
auauuuauaacucauc

SEQ ID NO: 382939 - RNA, 18 nt, Homo sapiens
auauuuaugucuauuuaa

SEQ ID NO: 382940 - RNA, 22 nt, Homo sapiens
auauuuguaucacaaaucuuaa

SEQ ID NO: 382941 - RNA, 15 nt, Homo sapiens
auauuuucaccauuu

SEQ ID NO: 382942 - RNA, 14 nt, Homo sapiens
auauuuuugccaua

SEQ ID NO: 382943 - RNA, 19 nt, Homo sapiens
auauuuuugccauaaugac

SEQ ID NO: 382944 - RNA, 15 nt, Homo sapiens
auauuuuugugcaca

SEQ ID NO: 382945 - RNA, 16 nt, Homo sapiens
aucaacgaguacuuca

SEQ ID NO: 382946 - RNA, 20 nt, Homo sapiens
aucaauguucaucauguauc

SEQ ID NO: 382947 - RNA, 19 nt, Homo sapiens
aucaauuauagaaagccaa

SEQ ID NO: 382948 - RNA, 17 nt, Homo sapiens
aucaauuuguaauugcu

SEQ ID NO: 382949 - RNA, 23 nt, Homo sapiens
aucacacgucuggcuucacagau

SEQ ID NO: 382950 - RNA, 14 nt, Homo sapiens
aucaccaaggcuga

SEQ ID NO: 382951 - RNA, 23 nt, Homo sapiens
aucacccuuaccaugugccugau

SEQ ID NO: 382952 - RNA, 17 nt, Homo sapiens
aucacgccugugcagug

SEQ ID NO: 382953 - RNA, 23 nt, Homo sapiens
aucacuugaacccgggaggcaga

SEQ ID NO: 382954 - RNA, 20 nt, Homo sapiens
aucagaacuggaccaucucc

SEQ ID NO: 382955 - RNA, 16 nt, Homo sapiens
aucagaacuguuggca

SEQ ID NO: 382956 - RNA, 21 nt, Homo sapiens
aucagccugggcaaugugaua

SEQ ID NO: 382957 - RNA, 18 nt, Homo sapiens
aucagcgccgcaccagcc

SEQ ID NO: 382958 - RNA, 15 nt, Homo sapiens
aucaggacccagagg

SEQ ID NO: 382959 - RNA, 17 nt, Homo sapiens
aucagggaggucauuuu

SEQ ID NO: 382960 - RNA, 12 nt, Homo sapiens
aucaggucuccc

SEQ ID NO: 382961 - RNA, 15 nt, Homo sapiens
aucagucaaugagga

SEQ ID NO: 382962 - RNA, 16 nt, Homo sapiens
aucagucauaacuaaa

SEQ ID NO: 382963 - RNA, 23 nt, Homo sapiens
aucauauaauaaauguacauuaa

SEQ ID NO: 382964 - RNA, 16 nt, Homo sapiens
aucaucaucauucuca

SEQ ID NO: 382965 - RNA, 13 nt, Homo sapiens
aucaucauucuca

SEQ ID NO: 382966 - RNA, 13 nt, Homo sapiens
aucaucuccaguu

SEQ ID NO: 382967 - RNA, 18 nt, Homo sapiens
aucaucuccugccuuccu

SEQ ID NO: 382968 - RNA, 20 nt, Homo sapiens
aucaugccccuguacuccag

SEQ ID NO: 382969 - RNA, 13 nt, Homo sapiens
aucauguacccca

SEQ ID NO: 382970 - RNA, 20 nt, Homo sapiens
aucauguccccaaaccugca

SEQ ID NO: 382971 - RNA, 14 nt, Homo sapiens
aucauuccuugaga

SEQ ID NO: 382972 - RNA, 16 nt, Homo sapiens
aucauucucauucuca

SEQ ID NO: 382973 - RNA, 17 nt, Homo sapiens
aucauucucugucucau

SEQ ID NO: 382974 - RNA, 23 nt, Homo sapiens
auccaagcgaggucaacagagaa

SEQ ID NO: 382975 - RNA, 12 nt, Homo sapiens
auccacauggga

SEQ ID NO: 382976 - RNA, 18 nt, Homo sapiens
auccagccuccugcuaac

SEQ ID NO: 382977 - RNA, 23 nt, Homo sapiens
auccauuccucagggacagagac

SEQ ID NO: 382978 - RNA, 19 nt, Homo sapiens
auccccuggacugggaggu

SEQ ID NO: 382979 - RNA, 15 nt, Homo sapiens
aucccucaccuguag

SEQ ID NO: 382980 - RNA, 15 nt, Homo sapiens
aucccugauuccugu

SEQ ID NO: 382981 - RNA, 19 nt, Homo sapiens
auccgaaguaugagggaaa

SEQ ID NO: 382982 - RNA, 17 nt, Homo sapiens
auccguaguucccugaa

SEQ ID NO: 382983 - RNA, 16 nt, Homo sapiens
auccuaaauaauguua

SEQ ID NO: 382984 - RNA, 14 nt, Homo sapiens
auccuaaucaucca

SEQ ID NO: 382985 - RNA, 14 nt, Homo sapiens
auccuaggcauuug

SEQ ID NO: 382986 - RNA, 15 nt, Homo sapiens
auccuaggcauuugc

SEQ ID NO: 382987 - RNA, 23 nt, Homo sapiens
auuaaaacucauuuuuguuuuca

SEQ ID NO: 382988 - RNA, 14 nt, Homo sapiens
auuaaaagccauga

SEQ ID NO: 382989 - RNA, 16 nt, Homo sapiens
auuaacauaagaaaag

SEQ ID NO: 382990 - RNA, 17 nt, Homo sapiens
auuaagcccucuuccau

SEQ ID NO: 382991 - RNA, 20 nt, Homo sapiens
auuaauguguuaagugcagg

SEQ ID NO: 382992 - RNA, 17 nt, Homo sapiens
auuaccucugauaccuc

SEQ ID NO: 382993 - RNA, 20 nt, Homo sapiens
auuacuuuuucauucuuuua

SEQ ID NO: 382994 - RNA, 17 nt, Homo sapiens
auuagaaggcaaguuuc

SEQ ID NO: 382995 - RNA, 16 nt, Homo sapiens
auuagaugaacucaac

SEQ ID NO: 382996 - RNA, 18 nt, Homo sapiens
auuagcauuuugcuaaau

SEQ ID NO: 382997 - RNA, 17 nt, Homo sapiens
auuagccaaguguggua

SEQ ID NO: 382998 - RNA, 19 nt, Homo sapiens
auuagccuaugugcaugca

SEQ ID NO: 382999 - RNA, 18 nt, Homo sapiens
auuaucuaugauaugcua

SEQ ID NO: 383000 - RNA, 15 nt, Homo sapiens
auuauucccauucua

SEQ ID NO: 383001 - RNA, 21 nt, Homo sapiens
auuauucccauucuacauacu

SEQ ID NO: 383002 - RNA, 21 nt, Homo sapiens
auuauucugauuccacuuuua

SEQ ID NO: 383003 - RNA, 15 nt, Homo sapiens
auuauuucaauguga

SEQ ID NO: 383004 - RNA, 13 nt, Homo sapiens
auucaaguguaca

SEQ ID NO: 383005 - RNA, 22 nt, Homo sapiens
auucaccuuccagugucucgga

SEQ ID NO: 383006 - RNA, 16 nt, Homo sapiens
auucagagagcagcuu

SEQ ID NO: 383007 - RNA, 14 nt, Homo sapiens
auucagcucugcaa

SEQ ID NO: 383008 - RNA, 17 nt, Homo sapiens
auucagcucugcaagaa

SEQ ID NO: 383009 - RNA, 21 nt, Homo sapiens
auucagucucuucuaagcaaa

SEQ ID NO: 383010 - RNA, 22 nt, Homo sapiens
auucagucucuucuaagcaaaa

SEQ ID NO: 383011 - RNA, 22 nt, Homo sapiens
auucaugccagggacugacaaa

SEQ ID NO: 383012 - RNA, 20 nt, Homo sapiens
auucauuuaaaaugauuaga

SEQ ID NO: 383013 - RNA, 13 nt, Homo sapiens
auucccauucuac

SEQ ID NO: 383014 - RNA, 14 nt, Homo sapiens
auuccuacaaagau

SEQ ID NO: 383015 - RNA, 20 nt, Homo sapiens
auuccuuagcuuagaccuca

SEQ ID NO: 383016 - RNA, 13 nt, Homo sapiens
auuccuugauuca

SEQ ID NO: 383017 - RNA, 19 nt, Homo sapiens
auuccuuggcaugccuucc

SEQ ID NO: 383018 - RNA, 21 nt, Homo sapiens
auuccuuggcaugccuuccag

SEQ ID NO: 383019 - RNA, 23 nt, Homo sapiens
auuccuuggcaugccuuccagca

SEQ ID NO: 383020 - RNA, 21 nt, Homo sapiens
auucuacuuuaagcacuacau

SEQ ID NO: 383021 - RNA, 13 nt, Homo sapiens
auucuaguacuug

SEQ ID NO: 383022 - RNA, 21 nt, Homo sapiens
auucucaugugauccuuuuau

SEQ ID NO: 383023 - RNA, 13 nt, Homo sapiens
auucucauucuca

SEQ ID NO: 383024 - RNA, 19 nt, Homo sapiens
auucucugucucauccauc

SEQ ID NO: 383025 - RNA, 18 nt, Homo sapiens
auucugauuacacaaaac

SEQ ID NO: 383026 - RNA, 22 nt, Homo sapiens
auucuggaaaagcaaaacugua

SEQ ID NO: 383027 - RNA, 18 nt, Homo sapiens
auucuucaaccucauuga

SEQ ID NO: 383028 - RNA, 23 nt, Homo sapiens
auucuucaaccucauugacaaga

SEQ ID NO: 383029 - RNA, 23 nt, Homo sapiens
ccaacguggggcagcacagagag

SEQ ID NO: 383030 - RNA, 21 nt, Homo sapiens
ccaacuuccuguugauguuca

SEQ ID NO: 383031 - RNA, 13 nt, Homo sapiens
ccaacuuuugcau

SEQ ID NO: 383032 - RNA, 20 nt, Homo sapiens
ccaagacucugaaaucucag

SEQ ID NO: 383033 - RNA, 18 nt, Homo sapiens
ccaagcacagugccugca

SEQ ID NO: 383034 - RNA, 12 nt, Homo sapiens
ccaauagcuuua

SEQ ID NO: 383035 - RNA, 16 nt, Homo sapiens
ccaauauuuaccagac

SEQ ID NO: 383036 - RNA, 17 nt, Homo sapiens
ccaauccuggacaugaa

SEQ ID NO: 383037 - RNA, 19 nt, Homo sapiens
ccaauguccaaaaggcuag

SEQ ID NO: 383038 - RNA, 18 nt, Homo sapiens
ccacaaguccuuguucca

SEQ ID NO: 383039 - RNA, 21 nt, Homo sapiens
ccacaauagcagacaguguuu

SEQ ID NO: 383040 - RNA, 22 nt, Homo sapiens
ccacacccuggaggauuucauc

SEQ ID NO: 383041 - RNA, 22 nt, Homo sapiens
ccacaucaauauugucauuccu

SEQ ID NO: 383042 - RNA, 23 nt, Homo sapiens
ccacauccuccacguucugcuca

SEQ ID NO: 383043 - RNA, 16 nt, Homo sapiens
ccaccacuucuuuuau

SEQ ID NO: 383044 - RNA, 15 nt, Homo sapiens
ccaccaucaccagac

SEQ ID NO: 383045 - RNA, 16 nt, Homo sapiens
ccacccaaaagucaaa

SEQ ID NO: 383046 - RNA, 17 nt, Homo sapiens
ccaccccuaaagagaua

SEQ ID NO: 383047 - RNA, 13 nt, Homo sapiens
ccaccugucucag

SEQ ID NO: 383048 - RNA, 22 nt, Homo sapiens
ccacguccagcuggaaggguca

SEQ ID NO: 383049 - RNA, 18 nt, Homo sapiens
ccacugcagaagacagua

SEQ ID NO: 383050 - RNA, 22 nt, Homo sapiens
ccacuggucuguagggauuuuu

SEQ ID NO: 383051 - RNA, 15 nt, Homo sapiens
ccacuguguauuuaa

SEQ ID NO: 383052 - RNA, 17 nt, Homo sapiens
ccagaagcugagcacca

SEQ ID NO: 383053 - RNA, 13 nt, Homo sapiens
ccagaccuuuuau

SEQ ID NO: 383054 - RNA, 17 nt, Homo sapiens
ccagacugucucaaaua

SEQ ID NO: 383055 - RNA, 20 nt, Homo sapiens
ccagagcugggaggcauggc

SEQ ID NO: 383056 - RNA, 14 nt, Homo sapiens
ccagaggacaaagc

SEQ ID NO: 383057 - RNA, 20 nt, Homo sapiens
ccagaggauugcugccccau

SEQ ID NO: 383058 - RNA, 22 nt, Homo sapiens
ccagauugacgacaagugcuga

SEQ ID NO: 383059 - RNA, 17 nt, Homo sapiens
ccagcacccugcaaaau

SEQ ID NO: 383060 - RNA, 22 nt, Homo sapiens
ccagccaagagggcugcaaaag

SEQ ID NO: 383061 - RNA, 18 nt, Homo sapiens
ccagcgugugacuacucc

SEQ ID NO: 383062 - RNA, 14 nt, Homo sapiens
ccagcuuaucucag

SEQ ID NO: 383063 - RNA, 14 nt, Homo sapiens
ccagcuuugcagug

SEQ ID NO: 383064 - RNA, 16 nt, Homo sapiens
ccaggaaccucagggc

SEQ ID NO: 383065 - RNA, 17 nt, Homo sapiens
ccaggaagccgugcccu

SEQ ID NO: 383066 - RNA, 12 nt, Homo sapiens
ccaggaccaguc

SEQ ID NO: 383067 - RNA, 20 nt, Homo sapiens
ccaggaggcggcagugcaac

SEQ ID NO: 383068 - RNA, 18 nt, Homo sapiens
ccaggcaacuugggaacu

SEQ ID NO: 383069 - RNA, 14 nt, Homo sapiens
ccaggcagauccca

SEQ ID NO: 383070 - RNA, 15 nt, Homo sapiens
ccaggccccaggaag

SEQ ID NO: 383071 - RNA, 18 nt, Homo sapiens
ccaggccgagaugugcaa

SEQ ID NO: 383072 - RNA, 16 nt, Homo sapiens
ccaggcgaugugcaag

SEQ ID NO: 383073 - RNA, 18 nt, Homo sapiens
ccaggcgaugugcaagug

SEQ ID NO: 383074 - RNA, 17 nt, Homo sapiens
ccaggcuggagugcagu

SEQ ID NO: 383075 - RNA, 18 nt, Homo sapiens
ccaggcuggagugcagua

SEQ ID NO: 383076 - RNA, 17 nt, Homo sapiens
ccagggaagugcucuga

SEQ ID NO: 383077 - RNA, 10 nt, Homo sapiens
ccaggggaug

SEQ ID NO: 383078 - RNA, 23 nt, Homo sapiens
ccagguguggcggcguaauccca

SEQ ID NO: 383079 - RNA, 16 nt, Homo sapiens
ccaguaauugguccga

SEQ ID NO: 383080 - RNA, 20 nt, Homo sapiens
ccaguccuguuugcagggaa

SEQ ID NO: 383081 - RNA, 22 nt, Homo sapiens
ccaguguccccuccacugucac

SEQ ID NO: 383082 - RNA, 19 nt, Homo sapiens
ccauagcaagauugcuuaa

SEQ ID NO: 383083 - RNA, 20 nt, Homo sapiens
ccauagcaagauugcuuaaa

SEQ ID NO: 383084 - RNA, 22 nt, Homo sapiens
ccauagucgugccuguuugcuu

SEQ ID NO: 383085 - RNA, 16 nt, Homo sapiens
ccauaucugugaaaug

SEQ ID NO: 383086 - RNA, 18 nt, Homo sapiens
ccauccccuggacuggga

SEQ ID NO: 383087 - RNA, 13 nt, Homo sapiens
ccauccuauuuaa

SEQ ID NO: 383088 - RNA, 14 nt, Homo sapiens
ccaucucuacuaaa

SEQ ID NO: 383089 - RNA, 19 nt, Homo sapiens
ccaugauaacugcaauuuu

SEQ ID NO: 383090 - RNA, 16 nt, Homo sapiens
ccaugcugauaaacug

SEQ ID NO: 383091 - RNA, 20 nt, Homo sapiens
ccaugcugcccgcuucucac

SEQ ID NO: 383092 - RNA, 18 nt, Homo sapiens
ccaugcuuuguagguguc

SEQ ID NO: 383093 - RNA, 13 nt, Homo sapiens
ccauggggcagca

SEQ ID NO: 383094 - RNA, 21 nt, Homo sapiens
ccaugggguccuaccaauaga

SEQ ID NO: 383095 - RNA, 13 nt, Homo sapiens
ccaugguuuuacu

SEQ ID NO: 383096 - RNA, 16 nt, Homo sapiens
ccauguacaugaagaa

SEQ ID NO: 383097 - RNA, 20 nt, Homo sapiens
ccaugucagcaaaaagcaaa

SEQ ID NO: 383098 - RNA, 19 nt, Homo sapiens
ccaugucgccucugcauuc

SEQ ID NO: 383099 - RNA, 19 nt, Homo sapiens
ccaugugugagugugugca

SEQ ID NO: 383100 - RNA, 17 nt, Homo sapiens
cccuucacauacccucc

SEQ ID NO: 383101 - RNA, 15 nt, Homo sapiens
cccuuggcugugagg

SEQ ID NO: 383102 - RNA, 19 nt, Homo sapiens
ccgaaaaggauaugcagua

SEQ ID NO: 383103 - RNA, 15 nt, Homo sapiens
ccgaagaaggguccu

SEQ ID NO: 383104 - RNA, 22 nt, Homo sapiens
ccgaaggugcuggaggugggag

SEQ ID NO: 383105 - RNA, 12 nt, Homo sapiens
ccgagugcaaug

SEQ ID NO: 383106 - RNA, 19 nt, Homo sapiens
ccgcaaaagacaagucuuu

SEQ ID NO: 383107 - RNA, 16 nt, Homo sapiens
ccggggcuccacugaa

SEQ ID NO: 383108 - RNA, 20 nt, Homo sapiens
ccgggugcucagggcugaca

SEQ ID NO: 383109 - RNA, 12 nt, Homo sapiens
ccguaacaacug

SEQ ID NO: 383110 - RNA, 18 nt, Homo sapiens
ccguaacaacugugguca

SEQ ID NO: 383111 - RNA, 17 nt, Homo sapiens
ccgucgaggggcucuca

SEQ ID NO: 383112 - RNA, 23 nt, Homo sapiens
ccgugaacuugugagaacacagc

SEQ ID NO: 383113 - RNA, 23 nt, Homo sapiens
ccguuucauuuagucaugugacc

SEQ ID NO: 383114 - RNA, 18 nt, Homo sapiens
ccuaaaaggaaaucucac

SEQ ID NO: 383115 - RNA, 22 nt, Homo sapiens
ccuaaaucaaguuggcuucuaa

SEQ ID NO: 383116 - RNA, 15 nt, Homo sapiens
ccuaaccucauuccc

SEQ ID NO: 383117 - RNA, 17 nt, Homo sapiens
ccuaacuggcuuacuuc

SEQ ID NO: 383118 - RNA, 17 nt, Homo sapiens
ccuaagacuuauguauu

SEQ ID NO: 383119 - RNA, 15 nt, Homo sapiens
ccuacagauagucaa

SEQ ID NO: 383120 - RNA, 23 nt, Homo sapiens
ccuacuguucggacaaaaaaagu

SEQ ID NO: 383121 - RNA, 17 nt, Homo sapiens
ccuagcuccacacccuc

SEQ ID NO: 383122 - RNA, 21 nt, Homo sapiens
ccuaucagccugucucuucca

SEQ ID NO: 383123 - RNA, 22 nt, Homo sapiens
ccuaucagccugucucuuccau

SEQ ID NO: 383124 - RNA, 23 nt, Homo sapiens
ccucacagagugcauugugaggg

SEQ ID NO: 383125 - RNA, 11 nt, Homo sapiens
ccucacaucuu

SEQ ID NO: 383126 - RNA, 17 nt, Homo sapiens
ccucacaucuuucacac

SEQ ID NO: 383127 - RNA, 17 nt, Homo sapiens
ccucaggcaggugggau

SEQ ID NO: 383128 - RNA, 17 nt, Homo sapiens
ccucaguuuuaucauuu

SEQ ID NO: 383129 - RNA, 20 nt, Homo sapiens
ccucaguuuuaucauuuuca

SEQ ID NO: 383130 - RNA, 16 nt, Homo sapiens
ccucaugcuguuucac

SEQ ID NO: 383131 - RNA, 20 nt, Homo sapiens
ccucauuaccuugugcuaau

SEQ ID NO: 383132 - RNA, 19 nt, Homo sapiens
ccucauuagcauuuugcua

SEQ ID NO: 383133 - RNA, 19 nt, Homo sapiens
ccuccacagcuaccucuuc

SEQ ID NO: 383134 - RNA, 16 nt, Homo sapiens
ccuccaccccccagaa

SEQ ID NO: 383135 - RNA, 16 nt, Homo sapiens
ccuccagaauggagcu

SEQ ID NO: 383136 - RNA, 14 nt, Homo sapiens
ccucccucauucca

SEQ ID NO: 383137 - RNA, 15 nt, Homo sapiens
ccucccuggucccuu

SEQ ID NO: 383138 - RNA, 14 nt, Homo sapiens
ccuccuccugacca

SEQ ID NO: 383139 - RNA, 14 nt, Homo sapiens
ccucgcugccagcu

SEQ ID NO: 383140 - RNA, 13 nt, Homo sapiens
ccucgggacauca

SEQ ID NO: 383141 - RNA, 21 nt, Homo sapiens
ccucgggcgagucacugccuc

SEQ ID NO: 383142 - RNA, 18 nt, Homo sapiens
ccucuccccacugcucau

SEQ ID NO: 383143 - RNA, 21 nt, Homo sapiens
ccucugacuuaagcugccuca

SEQ ID NO: 383144 - RNA, 17 nt, Homo sapiens
ccucugcacuacugaca

SEQ ID NO: 383145 - RNA, 13 nt, Homo sapiens
ccucuggacaaag

SEQ ID NO: 383146 - RNA, 19 nt, Homo sapiens
ccucuuaaagcugccugua

SEQ ID NO: 383147 - RNA, 18 nt, Homo sapiens
ccucuuuucucugugcuu

SEQ ID NO: 383148 - RNA, 16 nt, Homo sapiens
ccucuuuuucuagucu

SEQ ID NO: 383149 - RNA, 16 nt, Homo sapiens
ccugaaccuuccaucu

SEQ ID NO: 383150 - RNA, 18 nt, Homo sapiens
ccugacagaaggacucag

SEQ ID NO: 383151 - RNA, 15 nt, Homo sapiens
ccugagagggaaccc

SEQ ID NO: 383152 - RNA, 15 nt, Homo sapiens
ccugaggguccccac

SEQ ID NO: 383153 - RNA, 15 nt, Homo sapiens
ccugagguuugccag

SEQ ID NO: 383154 - RNA, 20 nt, Homo sapiens
ccugagguuugccagcauuu

SEQ ID NO: 383155 - RNA, 22 nt, Homo sapiens
ccugagguuugccagcauuuag

SEQ ID NO: 383156 - RNA, 19 nt, Homo sapiens
ccugauacaggcauggcag

SEQ ID NO: 383157 - RNA, 21 nt, Homo sapiens
ccugaucagagccgugguccu

SEQ ID NO: 383158 - RNA, 17 nt, Homo sapiens
ccugcaaaaggacucuc

SEQ ID NO: 383159 - RNA, 14 nt, Homo sapiens
ccugcaaacgcugc

SEQ ID NO: 383160 - RNA, 13 nt, Homo sapiens
ccugcaggugcug

SEQ ID NO: 383161 - RNA, 19 nt, Homo sapiens
ccugcagucaucuugacca

SEQ ID NO: 383162 - RNA, 17 nt, Homo sapiens
ccugcccguaaacacgc

SEQ ID NO: 383163 - RNA, 19 nt, Homo sapiens
ccugcggaguugugcacgu

SEQ ID NO: 383164 - RNA, 18 nt, Homo sapiens
ccugcucuccucuugcca

SEQ ID NO: 383165 - RNA, 18 nt, Homo sapiens
ccugcugagggaccagcc

SEQ ID NO: 383166 - RNA, 23 nt, Homo sapiens
ccugcugagggaccagccaagag

SEQ ID NO: 383167 - RNA, 18 nt, Homo sapiens
ccuggcaagugggugaaa

SEQ ID NO: 383168 - RNA, 21 nt, Homo sapiens
ccuggcuggcauggaggguga

SEQ ID NO: 383169 - RNA, 14 nt, Homo sapiens
ccugggcaauguga

SEQ ID NO: 383170 - RNA, 15 nt, Homo sapiens
ccugggcaaugugau

SEQ ID NO: 383171 - RNA, 17 nt, Homo sapiens
ccugggcaauuccgcau

SEQ ID NO: 383172 - RNA, 16 nt, Homo sapiens
ccugggcccuuccuau

SEQ ID NO: 383173 - RNA, 18 nt, Homo sapiens
ccuggggagccagggcua

SEQ ID NO: 383174 - RNA, 19 nt, Homo sapiens
ccuggggcuucuccugacc

SEQ ID NO: 383175 - RNA, 17 nt, Homo sapiens
ccuggguaacuagggaa

SEQ ID NO: 383176 - RNA, 13 nt, Homo sapiens
cggugagcauugu

SEQ ID NO: 383177 - RNA, 17 nt, Homo sapiens
cguaaacacgccugcaa

SEQ ID NO: 383178 - RNA, 18 nt, Homo sapiens
cguagcuuucccaaauaa

SEQ ID NO: 383179 - RNA, 16 nt, Homo sapiens
cguaguccgcuuucuc

SEQ ID NO: 383180 - RNA, 13 nt, Homo sapiens
cguccuacuguau

SEQ ID NO: 383181 - RNA, 23 nt, Homo sapiens
cgucgaggggcucucagcucagc

SEQ ID NO: 383182 - RNA, 19 nt, Homo sapiens
cgucuucuguauacugugg

SEQ ID NO: 383183 - RNA, 16 nt, Homo sapiens
cgugaaaaugcuguau

SEQ ID NO: 383184 - RNA, 17 nt, Homo sapiens
cgugccuguuugcuuag

SEQ ID NO: 383185 - RNA, 19 nt, Homo sapiens
cguggcuaagaguguccua

SEQ ID NO: 383186 - RNA, 13 nt, Homo sapiens
cgugggcucccug

SEQ ID NO: 383187 - RNA, 19 nt, Homo sapiens
cgugguccccaacagcgac

SEQ ID NO: 383188 - RNA, 16 nt, Homo sapiens
cgugugcgugcaugug

SEQ ID NO: 383189 - RNA, 19 nt, Homo sapiens
cgugugcgugcaugugcac

SEQ ID NO: 383190 - RNA, 22 nt, Homo sapiens
cgugugcgugcaugugcacuug

SEQ ID NO: 383191 - RNA, 17 nt, Homo sapiens
cgugugugcaagugucu

SEQ ID NO: 383192 - RNA, 17 nt, Homo sapiens
cguuuggaacaaucuaa

SEQ ID NO: 383193 - RNA, 15 nt, Homo sapiens
cuaaaaaugcaacuu

SEQ ID NO: 383194 - RNA, 15 nt, Homo sapiens
cuaaaauuagaugaa

SEQ ID NO: 383195 - RNA, 22 nt, Homo sapiens
cuaaaauuguaucaaaugugac

SEQ ID NO: 383196 - RNA, 22 nt, Homo sapiens
cuaaagaagguuucagaaagaa

SEQ ID NO: 383197 - RNA, 15 nt, Homo sapiens
cuaaagcaauaugca

SEQ ID NO: 383198 - RNA, 18 nt, Homo sapiens
cuaaauccuuuacuguua

SEQ ID NO: 383199 - RNA, 15 nt, Homo sapiens
cuaaaugaagugcaa

SEQ ID NO: 383200 - RNA, 12 nt, Homo sapiens
cuaaccacauca

SEQ ID NO: 383201 - RNA, 15 nt, Homo sapiens
cuaacuccagugaag

SEQ ID NO: 383202 - RNA, 15 nt, Homo sapiens
cuaagauaguaacaa

SEQ ID NO: 383203 - RNA, 22 nt, Homo sapiens
cuaagcaaaauugcuaaagaga

SEQ ID NO: 383204 - RNA, 17 nt, Homo sapiens
cuaagcagaccacugau

SEQ ID NO: 383205 - RNA, 18 nt, Homo sapiens
cuaaguaaaaccacagca

SEQ ID NO: 383206 - RNA, 14 nt, Homo sapiens
cuaauaguuuuauu

SEQ ID NO: 383207 - RNA, 14 nt, Homo sapiens
cuaauauggcaaaa

SEQ ID NO: 383208 - RNA, 14 nt, Homo sapiens
cuaaucaccaaagg

SEQ ID NO: 383209 - RNA, 17 nt, Homo sapiens
cuaaucagcauucucac

SEQ ID NO: 383210 - RNA, 18 nt, Homo sapiens
cuaaucauccaaugcuca

SEQ ID NO: 383211 - RNA, 23 nt, Homo sapiens
cuaauuaaaaaacacaucuggcc

SEQ ID NO: 383212 - RNA, 17 nt, Homo sapiens
cuaauuagagcagauga

SEQ ID NO: 383213 - RNA, 13 nt, Homo sapiens
cuacaauuugcca

SEQ ID NO: 383214 - RNA, 14 nt, Homo sapiens
cuacaauuugccau

SEQ ID NO: 383215 - RNA, 22 nt, Homo sapiens
cuacagacaccaaguuccguca

SEQ ID NO: 383216 - RNA, 22 nt, Homo sapiens
cuacagagcuucccugacucau

SEQ ID NO: 383217 - RNA, 21 nt, Homo sapiens
cuacaugccucagugaaggac

SEQ ID NO: 383218 - RNA, 16 nt, Homo sapiens
cuacauguauugcaca

SEQ ID NO: 383219 - RNA, 14 nt, Homo sapiens
cuacuacagcgcca

SEQ ID NO: 383220 - RNA, 16 nt, Homo sapiens
cuacuacaugugacug

SEQ ID NO: 383221 - RNA, 14 nt, Homo sapiens
cuacuagagucuga

SEQ ID NO: 383222 - RNA, 22 nt, Homo sapiens
cuacuagagucugaacagcugu

SEQ ID NO: 383223 - RNA, 23 nt, Homo sapiens
cuacucaggaggcugaggcagaa

SEQ ID NO: 383224 - RNA, 20 nt, Homo sapiens
cuacucuagggaaaaaccag

SEQ ID NO: 383225 - RNA, 18 nt, Homo sapiens
cuacuucugcccuugcca

SEQ ID NO: 383226 - RNA, 19 nt, Homo sapiens
cuacuugggaggcugaggc

SEQ ID NO: 383227 - RNA, 17 nt, Homo sapiens
cuagauacaugcuuuuu

SEQ ID NO: 383228 - RNA, 16 nt, Homo sapiens
cuagauuuaugaauac

SEQ ID NO: 383229 - RNA, 20 nt, Homo sapiens
cuagcaacccuaacaguaag

SEQ ID NO: 383230 - RNA, 12 nt, Homo sapiens
cuagcaucucau

SEQ ID NO: 383231 - RNA, 19 nt, Homo sapiens
cuagcuagaaauaugauuu

SEQ ID NO: 383232 - RNA, 21 nt, Homo sapiens
cuaggaguagaaaaugguccu

SEQ ID NO: 383233 - RNA, 16 nt, Homo sapiens
cuaggaguauccucau

SEQ ID NO: 383234 - RNA, 15 nt, Homo sapiens
cuagguaggggccca

SEQ ID NO: 383235 - RNA, 13 nt, Homo sapiens
cuagucuacuuga

SEQ ID NO: 383236 - RNA, 15 nt, Homo sapiens
cuagucugcuagcca

SEQ ID NO: 383237 - RNA, 14 nt, Homo sapiens
cuaguguugcuugg

SEQ ID NO: 383238 - RNA, 21 nt, Homo sapiens
cuaguuuuugacuugcuccua

SEQ ID NO: 383239 - RNA, 16 nt, Homo sapiens
cuauaacuauguugau

SEQ ID NO: 383240 - RNA, 20 nt, Homo sapiens
cuauaacuauguugauaaaa

SEQ ID NO: 383241 - RNA, 18 nt, Homo sapiens
cuauaguccagcuuuguu

SEQ ID NO: 383242 - RNA, 20 nt, Homo sapiens
cuaucagccugucucuucca

SEQ ID NO: 383243 - RNA, 15 nt, Homo sapiens
cuaucgcaccacugu

SEQ ID NO: 383244 - RNA, 18 nt, Homo sapiens
cuaugaaaauuauaucuc

SEQ ID NO: 383245 - RNA, 13 nt, Homo sapiens
cuaugaaauauca

SEQ ID NO: 383246 - RNA, 16 nt, Homo sapiens
cuaugaggcaaccaca

SEQ ID NO: 383247 - RNA, 16 nt, Homo sapiens
cuauggcacccaugca

SEQ ID NO: 383248 - RNA, 13 nt, Homo sapiens
cuauguacuuuaa

SEQ ID NO: 383249 - RNA, 20 nt, Homo sapiens
cuaugucacccaaugcauau

SEQ ID NO: 383250 - RNA, 22 nt, Homo sapiens
cuauguuuuuguucaaagccag

SEQ ID NO: 383251 - RNA, 19 nt, Homo sapiens
cuauuaaaucuugcaacug

SEQ ID NO: 383252 - RNA, 12 nt, Homo sapiens
cuauuaucucaa

SEQ ID NO: 383253 - RNA, 16 nt, Homo sapiens
cuauucugauuacaca

SEQ ID NO: 383254 - RNA, 14 nt, Homo sapiens
cuauugccugagag

SEQ ID NO: 383255 - RNA, 17 nt, Homo sapiens
cuauugccugagagcac

SEQ ID NO: 383256 - RNA, 17 nt, Homo sapiens
cuauuuccauuccagaa

SEQ ID NO: 383257 - RNA, 22 nt, Homo sapiens
cuauuuccuucuccuccugucu

SEQ ID NO: 383258 - RNA, 22 nt, Homo sapiens
cuccuugggaggccccacuggg

SEQ ID NO: 383259 - RNA, 13 nt, Homo sapiens
cuccuuugcuuag

SEQ ID NO: 383260 - RNA, 14 nt, Homo sapiens
cucgccgucuguga

SEQ ID NO: 383261 - RNA, 20 nt, Homo sapiens
cucgggcgagucacugccuc

SEQ ID NO: 383262 - RNA, 13 nt, Homo sapiens
cucguggucccca

SEQ ID NO: 383263 - RNA, 14 nt, Homo sapiens
cucuacucuaggga

SEQ ID NO: 383264 - RNA, 20 nt, Homo sapiens
cucuaugaaaauuauaucuc

SEQ ID NO: 383265 - RNA, 21 nt, Homo sapiens
cucuauuuguaauugaacuua

SEQ ID NO: 383266 - RNA, 23 nt, Homo sapiens
cucucaggaucaagaaaguguug

SEQ ID NO: 383267 - RNA, 18 nt, Homo sapiens
cucucagugaacugugag

SEQ ID NO: 383268 - RNA, 19 nt, Homo sapiens
cucucaugggguccaaguu

SEQ ID NO: 383269 - RNA, 13 nt, Homo sapiens
cucugaaaaccaa

SEQ ID NO: 383270 - RNA, 17 nt, Homo sapiens
cucugaaaccaguguua

SEQ ID NO: 383271 - RNA, 19 nt, Homo sapiens
cucugaaaucucagaauuc

SEQ ID NO: 383272 - RNA, 20 nt, Homo sapiens
cucugagcaaauguggcucc

SEQ ID NO: 383273 - RNA, 23 nt, Homo sapiens
cucugaguaucuccucgcaagcu

SEQ ID NO: 383274 - RNA, 22 nt, Homo sapiens
cucugcacaagcugcacccuca

SEQ ID NO: 383275 - RNA, 21 nt, Homo sapiens
cucugccaaaggaugugauau

SEQ ID NO: 383276 - RNA, 13 nt, Homo sapiens
cucugccaccaga

SEQ ID NO: 383277 - RNA, 11 nt, Homo sapiens
cucugccagug

SEQ ID NO: 383278 - RNA, 14 nt, Homo sapiens
cucugcugaaggaa

SEQ ID NO: 383279 - RNA, 20 nt, Homo sapiens
cucugcugucuaaccuguga

SEQ ID NO: 383280 - RNA, 16 nt, Homo sapiens
cucuggcucucauggg

SEQ ID NO: 383281 - RNA, 22 nt, Homo sapiens
cucuggcucucaugggguccaa

SEQ ID NO: 383282 - RNA, 16 nt, Homo sapiens
cucugggccaagucaa

SEQ ID NO: 383283 - RNA, 21 nt, Homo sapiens
cucugggccaagucaaagaca

SEQ ID NO: 383284 - RNA, 17 nt, Homo sapiens
cucuuaaucaaauagca

SEQ ID NO: 383285 - RNA, 14 nt, Homo sapiens
cucuuacugcaaau

SEQ ID NO: 383286 - RNA, 16 nt, Homo sapiens
cucuuagaaaaaccac

SEQ ID NO: 383287 - RNA, 12 nt, Homo sapiens
cucuuagcacac

SEQ ID NO: 383288 - RNA, 15 nt, Homo sapiens
cucuuagcacacuca

SEQ ID NO: 383289 - RNA, 19 nt, Homo sapiens
cucuuauagaaaguucaaa

SEQ ID NO: 383290 - RNA, 19 nt, Homo sapiens
cucuucaaauaaacauguc

SEQ ID NO: 383291 - RNA, 20 nt, Homo sapiens
cucuucuaaucagagcgcaa

SEQ ID NO: 383292 - RNA, 23 nt, Homo sapiens
cucuucuccaccucccacaaagg

SEQ ID NO: 383293 - RNA, 14 nt, Homo sapiens
cucuucuccacugg

SEQ ID NO: 383294 - RNA, 13 nt, Homo sapiens
cucuugcugccac

SEQ ID NO: 383295 - RNA, 17 nt, Homo sapiens
cucuuguauaugaugau

SEQ ID NO: 383296 - RNA, 19 nt, Homo sapiens
cucuuuugaauccaugcuu

SEQ ID NO: 383297 - RNA, 15 nt, Homo sapiens
cucuuuuucuagucu

SEQ ID NO: 383298 - RNA, 19 nt, Homo sapiens
cugaaaaccaauguucucu

SEQ ID NO: 383299 - RNA, 23 nt, Homo sapiens
cugaaaccucugggucaucucuc

SEQ ID NO: 383300 - RNA, 15 nt, Homo sapiens
cugaaagaagacauc

SEQ ID NO: 383301 - RNA, 23 nt, Homo sapiens
cugaaauuuuaauugaacuaaca

SEQ ID NO: 383302 - RNA, 15 nt, Homo sapiens
cugaaccuuccaucu

SEQ ID NO: 383303 - RNA, 19 nt, Homo sapiens
cugaaggagccccauuccu

SEQ ID NO: 383304 - RNA, 17 nt, Homo sapiens
cugaaguaagcaaagac

SEQ ID NO: 383305 - RNA, 14 nt, Homo sapiens
cugaaguuucacau

SEQ ID NO: 383306 - RNA, 20 nt, Homo sapiens
cugaaguuucacaugagcua

SEQ ID NO: 383307 - RNA, 23 nt, Homo sapiens
cugaauagcagaagguugcaccu

SEQ ID NO: 383308 - RNA, 11 nt, Homo sapiens
cugaauaugaa

SEQ ID NO: 383309 - RNA, 17 nt, Homo sapiens
cugaaucgagaugucca

SEQ ID NO: 383310 - RNA, 15 nt, Homo sapiens
cugacaguaaaucuc

SEQ ID NO: 383311 - RNA, 15 nt, Homo sapiens
cugaccuccacagcu

SEQ ID NO: 383312 - RNA, 22 nt, Homo sapiens
cugacuccuuagagacaucaaa

SEQ ID NO: 383313 - RNA, 18 nt, Homo sapiens
cugacuuuugcagaugga

SEQ ID NO: 383314 - RNA, 16 nt, Homo sapiens
cugagcaaagcauuga

SEQ ID NO: 383315 - RNA, 22 nt, Homo sapiens
cugagcagugaaugauucagug

SEQ ID NO: 383316 - RNA, 15 nt, Homo sapiens
cugagcgacagugag

SEQ ID NO: 383317 - RNA, 17 nt, Homo sapiens
cugagcucgguggaccc

SEQ ID NO: 383318 - RNA, 22 nt, Homo sapiens
cugaggaagcacagcagcaucu

SEQ ID NO: 383319 - RNA, 22 nt, Homo sapiens
cugagugcaccacuucaaguga

SEQ ID NO: 383320 - RNA, 18 nt, Homo sapiens
cugagugggggaucacag

SEQ ID NO: 383321 - RNA, 14 nt, Homo sapiens
cugaguggugccaa

SEQ ID NO: 383322 - RNA, 21 nt, Homo sapiens
cugaucagucuaagaugggug

SEQ ID NO: 383323 - RNA, 14 nt, Homo sapiens
cugauggaccagga

SEQ ID NO: 383324 - RNA, 19 nt, Homo sapiens
cugauggagcucagaauuc

SEQ ID NO: 383325 - RNA, 15 nt, Homo sapiens
cugauuacacaaaac

SEQ ID NO: 383326 - RNA, 16 nt, Homo sapiens
cugauuacacaaaaca

SEQ ID NO: 383327 - RNA, 22 nt, Homo sapiens
cugauucugucaaugucuugaa

SEQ ID NO: 383328 - RNA, 16 nt, Homo sapiens
cugauuuuuagcuuua

SEQ ID NO: 383329 - RNA, 17 nt, Homo sapiens
cugauuuuuagcuuuac

SEQ ID NO: 383330 - RNA, 14 nt, Homo sapiens
cugcaacucaagga

SEQ ID NO: 383331 - RNA, 17 nt, Homo sapiens
cugcaagugacaucucu

SEQ ID NO: 383332 - RNA, 18 nt, Homo sapiens
cugcacagugcaucucag

SEQ ID NO: 383333 - RNA, 14 nt, Homo sapiens
cugcacuacugaca

SEQ ID NO: 383334 - RNA, 21 nt, Homo sapiens
cugcagcuuuguuuguuguca

SEQ ID NO: 383335 - RNA, 14 nt, Homo sapiens
cugcaggugcugcu

SEQ ID NO: 383336 - RNA, 20 nt, Homo sapiens
cugcagucaucuugaccaag

SEQ ID NO: 383337 - RNA, 23 nt, Homo sapiens
cugcaucgagucaaaacucaaau

SEQ ID NO: 383338 - RNA, 22 nt, Homo sapiens
cugcauuuauagcauacgguau

SEQ ID NO: 383339 - RNA, 15 nt, Homo sapiens
cugccaugccagcuu

SEQ ID NO: 383340 - RNA, 16 nt, Homo sapiens
cugcccaccucuccaa

SEQ ID NO: 383341 - RNA, 16 nt, Homo sapiens
cugccccugagcccau

SEQ ID NO: 383342 - RNA, 18 nt, Homo sapiens
cugccuaaguggcugcug

SEQ ID NO: 383343 - RNA, 15 nt, Homo sapiens
cugccuccucuucaa

SEQ ID NO: 383344 - RNA, 20 nt, Homo sapiens
cugccugccgguaaacacgc

SEQ ID NO: 383345 - RNA, 16 nt, Homo sapiens
caaacuacauguaauc

SEQ ID NO: 383346 - RNA, 23 nt, Homo sapiens
caaacuaccuuccaguuccucau

SEQ ID NO: 383347 - RNA, 11 nt, Homo sapiens
caaacugccuu

SEQ ID NO: 383348 - RNA, 19 nt, Homo sapiens
caaagaagaguuaagaaga

SEQ ID NO: 383349 - RNA, 13 nt, Homo sapiens
caaagacauucug

SEQ ID NO: 383350 - RNA, 21 nt, Homo sapiens
caaagcaaguuucaucaguca

SEQ ID NO: 383351 - RNA, 14 nt, Homo sapiens
caaagcagcugcag

SEQ ID NO: 383352 - RNA, 18 nt, Homo sapiens
caaaggacuccacccauc

SEQ ID NO: 383353 - RNA, 18 nt, Homo sapiens
caaaggagggucaggaag

SEQ ID NO: 383354 - RNA, 14 nt, Homo sapiens
caaaggauacugua

SEQ ID NO: 383355 - RNA, 14 nt, Homo sapiens
caaaggaugugaua

SEQ ID NO: 383356 - RNA, 21 nt, Homo sapiens
caaaggaugugauauauaagu

SEQ ID NO: 383357 - RNA, 14 nt, Homo sapiens
caaauaaaaaccca

SEQ ID NO: 383358 - RNA, 14 nt, Homo sapiens
caaauaaacauguc

SEQ ID NO: 383359 - RNA, 16 nt, Homo sapiens
caaauaaacaugucug

SEQ ID NO: 383360 - RNA, 14 nt, Homo sapiens
caaauaaauggagu

SEQ ID NO: 383361 - RNA, 15 nt, Homo sapiens
caaauaugcaaagca

SEQ ID NO: 383362 - RNA, 18 nt, Homo sapiens
caaauccuucaucauguc

SEQ ID NO: 383363 - RNA, 14 nt, Homo sapiens
caaaugacaaaaag

SEQ ID NO: 383364 - RNA, 12 nt, Homo sapiens
caaaugcuauau

SEQ ID NO: 383365 - RNA, 13 nt, Homo sapiens
caaauguauuuca

SEQ ID NO: 383366 - RNA, 22 nt, Homo sapiens
caaauucauuuuuuucacugga

SEQ ID NO: 383367 - RNA, 23 nt, Homo sapiens
caaauucauuuuuuucacuggag

SEQ ID NO: 383368 - RNA, 19 nt, Homo sapiens
caacaaacuucaaggguuu

SEQ ID NO: 383369 - RNA, 20 nt, Homo sapiens
caacaauacaggcuagggau

SEQ ID NO: 383370 - RNA, 13 nt, Homo sapiens
caacaauacaugc

SEQ ID NO: 383371 - RNA, 19 nt, Homo sapiens
caacaauacaugcugcuaa

SEQ ID NO: 383372 - RNA, 18 nt, Homo sapiens
caacagaaucagaucuga

SEQ ID NO: 383373 - RNA, 15 nt, Homo sapiens
caacagcacgugcag

SEQ ID NO: 383374 - RNA, 11 nt, Homo sapiens
caacagcauuu

SEQ ID NO: 383375 - RNA, 20 nt, Homo sapiens
caacaggagcugggauccua

SEQ ID NO: 383376 - RNA, 12 nt, Homo sapiens
caacaguuccuu

SEQ ID NO: 383377 - RNA, 14 nt, Homo sapiens
caacaucccauugc

SEQ ID NO: 383378 - RNA, 17 nt, Homo sapiens
caacaugugcucaggga

SEQ ID NO: 383379 - RNA, 18 nt, Homo sapiens
caacaugugcucagggaa

SEQ ID NO: 383380 - RNA, 18 nt, Homo sapiens
caacauugcuugugccac

SEQ ID NO: 383381 - RNA, 19 nt, Homo sapiens
caaccacaggcagcauuua

SEQ ID NO: 383382 - RNA, 19 nt, Homo sapiens
caacccaaauguucaucaa

SEQ ID NO: 383383 - RNA, 12 nt, Homo sapiens
caaccccaacuc

SEQ ID NO: 383384 - RNA, 19 nt, Homo sapiens
caaccgaguggcugucauc

SEQ ID NO: 383385 - RNA, 13 nt, Homo sapiens
caaccuaugguau

SEQ ID NO: 383386 - RNA, 12 nt, Homo sapiens
caaccucaguga

SEQ ID NO: 383387 - RNA, 19 nt, Homo sapiens
caaccucauugacaagaac

SEQ ID NO: 383388 - RNA, 20 nt, Homo sapiens
caaccugcucuccucuugcc

SEQ ID NO: 383389 - RNA, 15 nt, Homo sapiens
caacuacugugauca

SEQ ID NO: 383390 - RNA, 13 nt, Homo sapiens
caacucaucuuag

SEQ ID NO: 383391 - RNA, 15 nt, Homo sapiens
caacucuuugagaaa

SEQ ID NO: 383392 - RNA, 10 nt, Homo sapiens
caacugacca

SEQ ID NO: 383393 - RNA, 15 nt, Homo sapiens
caacuuccuguugau

SEQ ID NO: 383394 - RNA, 21 nt, Homo sapiens
caacuucuacuucugcccuug

SEQ ID NO: 383395 - RNA, 12 nt, Homo sapiens
caacuuugacaa

SEQ ID NO: 383396 - RNA, 15 nt, Homo sapiens
caagaaaacaacuuc

SEQ ID NO: 383397 - RNA, 23 nt, Homo sapiens
caagaaaacaacuucaauaucca

SEQ ID NO: 383398 - RNA, 17 nt, Homo sapiens
caagaagucaaaguaaa

SEQ ID NO: 383399 - RNA, 21 nt, Homo sapiens
caagaguuuauuuccaaauaa

SEQ ID NO: 383400 - RNA, 15 nt, Homo sapiens
caagaucuguaaugu

SEQ ID NO: 383401 - RNA, 15 nt, Homo sapiens
caagcagcaggaaac

SEQ ID NO: 383402 - RNA, 20 nt, Homo sapiens
caagcauuucuagcagugau

SEQ ID NO: 383403 - RNA, 21 nt, Homo sapiens
caagccuagcccuucucucau

SEQ ID NO: 383404 - RNA, 22 nt, Homo sapiens
caagcuaaaauuagaugaacuc

SEQ ID NO: 383405 - RNA, 20 nt, Homo sapiens
caagcuuggcuguagaagga

SEQ ID NO: 383406 - RNA, 21 nt, Homo sapiens
caaggauggaugcagauccag

SEQ ID NO: 383407 - RNA, 19 nt, Homo sapiens
caaggcccauaucugugaa

SEQ ID NO: 383408 - RNA, 14 nt, Homo sapiens
caaggcugcaguga

SEQ ID NO: 383409 - RNA, 19 nt, Homo sapiens
caaggcugggggaagaagc

SEQ ID NO: 383410 - RNA, 21 nt, Homo sapiens
caaggcugucgccugcaccuu

SEQ ID NO: 383411 - RNA, 14 nt, Homo sapiens
caagggaaucugua

SEQ ID NO: 383412 - RNA, 21 nt, Homo sapiens
caagggaauucggugugcacc

SEQ ID NO: 383413 - RNA, 14 nt, Homo sapiens
caagggaugucuca

SEQ ID NO: 383414 - RNA, 20 nt, Homo sapiens
caagggcuccccacugccua

SEQ ID NO: 383415 - RNA, 12 nt, Homo sapiens
caagucaccucc

SEQ ID NO: 383416 - RNA, 18 nt, Homo sapiens
caaguccaagcauaccaa

SEQ ID NO: 383417 - RNA, 22 nt, Homo sapiens
caagugaagaaaagugaaugcu

SEQ ID NO: 383418 - RNA, 18 nt, Homo sapiens
caagugucugugugcaag

SEQ ID NO: 383419 - RNA, 13 nt, Homo sapiens
caagugugugcac

SEQ ID NO: 383420 - RNA, 16 nt, Homo sapiens
caagugugugcacaug

SEQ ID NO: 383421 - RNA, 16 nt, Homo sapiens
caaguuguggugcuga

SEQ ID NO: 383422 - RNA, 16 nt, Homo sapiens
caaguuucaucaguca

SEQ ID NO: 383423 - RNA, 21 nt, Homo sapiens
caaguuuuucagaaagcauua

SEQ ID NO: 383424 - RNA, 17 nt, Homo sapiens
caauaaauaaucuguac

SEQ ID NO: 383425 - RNA, 13 nt, Homo sapiens
caauaagcaucaa

SEQ ID NO: 383426 - RNA, 14 nt, Homo sapiens
caauaauuucaggu

SEQ ID NO: 383427 - RNA, 16 nt, Homo sapiens
caauacaugcugcuaa

SEQ ID NO: 383428 - RNA, 15 nt, Homo sapiens
caauacuaaauguac

SEQ ID NO: 383429 - RNA, 10 nt, Homo sapiens
caauagucaa

SEQ ID NO: 383430 - RNA, 14 nt, Homo sapiens
caucagccugugua

SEQ ID NO: 383431 - RNA, 20 nt, Homo sapiens
caucagcuugcccuguuaaa

SEQ ID NO: 383432 - RNA, 16 nt, Homo sapiens
caucauacaugacuca

SEQ ID NO: 383433 - RNA, 19 nt, Homo sapiens
caucaucuccugccuuccu

SEQ ID NO: 383434 - RNA, 13 nt, Homo sapiens
caucauuccuuga

SEQ ID NO: 383435 - RNA, 19 nt, Homo sapiens
caucauuggaaaugaaacu

SEQ ID NO: 383436 - RNA, 17 nt, Homo sapiens
cauccaaugcucaagaa

SEQ ID NO: 383437 - RNA, 22 nt, Homo sapiens
cauccaggugggaggugucaga

SEQ ID NO: 383438 - RNA, 16 nt, Homo sapiens
caucccacugcucccc

SEQ ID NO: 383439 - RNA, 19 nt, Homo sapiens
cauccugaccuugcacaaa

SEQ ID NO: 383440 - RNA, 20 nt, Homo sapiens
cauccuucuuucuaguucag

SEQ ID NO: 383441 - RNA, 18 nt, Homo sapiens
caucuaguaggugcuuga

SEQ ID NO: 383442 - RNA, 21 nt, Homo sapiens
caucuauugccugagagcaca

SEQ ID NO: 383443 - RNA, 19 nt, Homo sapiens
caucucaggccucccucaa

SEQ ID NO: 383444 - RNA, 13 nt, Homo sapiens
caucugcuuacaa

SEQ ID NO: 383445 - RNA, 14 nt, Homo sapiens
caucuuccaacuca

SEQ ID NO: 383446 - RNA, 18 nt, Homo sapiens
caucuuuuacauucugca

SEQ ID NO: 383447 - RNA, 14 nt, Homo sapiens
caugaauccagucc

SEQ ID NO: 383448 - RNA, 15 nt, Homo sapiens
caugacacagcuuua

SEQ ID NO: 383449 - RNA, 20 nt, Homo sapiens
caugacucagcauaccugcu

SEQ ID NO: 383450 - RNA, 19 nt, Homo sapiens
caugagaccacuguuauca

SEQ ID NO: 383451 - RNA, 17 nt, Homo sapiens
caugaucaucacaauca

SEQ ID NO: 383452 - RNA, 22 nt, Homo sapiens
caugaucccuguguugucucua

SEQ ID NO: 383453 - RNA, 23 nt, Homo sapiens
cauggaacucauuccugccuguc

SEQ ID NO: 383454 - RNA, 17 nt, Homo sapiens
cauggacacuccagugc

SEQ ID NO: 383455 - RNA, 21 nt, Homo sapiens
cauggacacuccagugccagc

SEQ ID NO: 383456 - RNA, 15 nt, Homo sapiens
cauggagaaacccug

SEQ ID NO: 383457 - RNA, 19 nt, Homo sapiens
cauggcaccuuuugcacau

SEQ ID NO: 383458 - RNA, 23 nt, Homo sapiens
cauggcaccuuuugcacauaaca

SEQ ID NO: 383459 - RNA, 22 nt, Homo sapiens
cauggcuuaguuuucauacaca

SEQ ID NO: 383460 - RNA, 17 nt, Homo sapiens
cauggggguaauaagag

SEQ ID NO: 383461 - RNA, 16 nt, Homo sapiens
cauguaaacugugcac

SEQ ID NO: 383462 - RNA, 21 nt, Homo sapiens
cauguccugcugcuucugcaa

SEQ ID NO: 383463 - RNA, 16 nt, Homo sapiens
caugucgccucugcau

SEQ ID NO: 383464 - RNA, 19 nt, Homo sapiens
caugugacuggcaguauua

SEQ ID NO: 383465 - RNA, 14 nt, Homo sapiens
caugugcacuugaa

SEQ ID NO: 383466 - RNA, 15 nt, Homo sapiens
caugugcucagggaa

SEQ ID NO: 383467 - RNA, 19 nt, Homo sapiens
cauguggaagcacuuuaag

SEQ ID NO: 383468 - RNA, 19 nt, Homo sapiens
caugugugagugugugcaa

SEQ ID NO: 383469 - RNA, 21 nt, Homo sapiens
caugugugagugugugcaagu

SEQ ID NO: 383470 - RNA, 17 nt, Homo sapiens
caugugugcgagugugu

SEQ ID NO: 383471 - RNA, 20 nt, Homo sapiens
caugugugcgagugugugca

SEQ ID NO: 383472 - RNA, 23 nt, Homo sapiens
caugugugcgagugugugcaugu

SEQ ID NO: 383473 - RNA, 20 nt, Homo sapiens
caugugugcgugugcgugca

SEQ ID NO: 383474 - RNA, 15 nt, Homo sapiens
caugugugugcaagu

SEQ ID NO: 383475 - RNA, 22 nt, Homo sapiens
caugugugugcaagugugugca

SEQ ID NO: 383476 - RNA, 16 nt, Homo sapiens
cauguuccuucaagau

SEQ ID NO: 383477 - RNA, 16 nt, Homo sapiens
cauuaauauuugcuga

SEQ ID NO: 383478 - RNA, 16 nt, Homo sapiens
cauuagucacuuugaa

SEQ ID NO: 383479 - RNA, 13 nt, Homo sapiens
cauuaucuaugau

SEQ ID NO: 383480 - RNA, 19 nt, Homo sapiens
cauucacccagacagcucc

SEQ ID NO: 383481 - RNA, 14 nt, Homo sapiens
cauuccaccuuccc

SEQ ID NO: 383482 - RNA, 13 nt, Homo sapiens
cauucuagguagg

SEQ ID NO: 383483 - RNA, 12 nt, Homo sapiens
cauucucugucu

SEQ ID NO: 383484 - RNA, 15 nt, Homo sapiens
cauucucuuguuauu

SEQ ID NO: 383485 - RNA, 14 nt, Homo sapiens
cauucugacaucuu

SEQ ID NO: 383486 - RNA, 11 nt, Homo sapiens
cauucugacca

SEQ ID NO: 383487 - RNA, 18 nt, Homo sapiens
cauucugcaagcacaucu

SEQ ID NO: 383488 - RNA, 16 nt, Homo sapiens
ccccugggacugcugc

SEQ ID NO: 383489 - RNA, 18 nt, Homo sapiens
ccccugggacugcugcuu

SEQ ID NO: 383490 - RNA, 22 nt, Homo sapiens
ccccuguagagugggagcugag

SEQ ID NO: 383491 - RNA, 14 nt, Homo sapiens
ccccuuggcuguga

SEQ ID NO: 383492 - RNA, 17 nt, Homo sapiens
cccggggcuccacugaa

SEQ ID NO: 383493 - RNA, 22 nt, Homo sapiens
cccggggcuggcggcuacucag

SEQ ID NO: 383494 - RNA, 16 nt, Homo sapiens
cccgguguaugccaag

SEQ ID NO: 383495 - RNA, 17 nt, Homo sapiens
cccuagucuuuuaaaca

SEQ ID NO: 383496 - RNA, 23 nt, Homo sapiens
cccucaacaccucugcacaagcu

SEQ ID NO: 383497 - RNA, 15 nt, Homo sapiens
cccuccguggcauca

SEQ ID NO: 383498 - RNA, 18 nt, Homo sapiens
cccuccguggcaucaccu

SEQ ID NO: 383499 - RNA, 17 nt, Homo sapiens
cccugaaaacccagaga

SEQ ID NO: 383500 - RNA, 19 nt, Homo sapiens
cccugauuguguauauuca

SEQ ID NO: 383501 - RNA, 17 nt, Homo sapiens
cccugcaaaaugagacc

SEQ ID NO: 383502 - RNA, 21 nt, Homo sapiens
cccuggaaggugcuguuaucc

SEQ ID NO: 383503 - RNA, 14 nt, Homo sapiens
cccugggaccacag

SEQ ID NO: 383504 - RNA, 21 nt, Homo sapiens
cccuggggcuucuccugaccc

SEQ ID NO: 383505 - RNA, 14 nt, Homo sapiens
cccuguaugauucc

SEQ ID NO: 383506 - RNA, 21 nt, Homo sapiens
cccuugugcgugggugaagcc

SEQ ID NO: 383507 - RNA, 19 nt, Homo sapiens
cccuuuccuacucucagga

SEQ ID NO: 383508 - RNA, 20 nt, Homo sapiens
cccuuucugugugaagauca

SEQ ID NO: 383509 - RNA, 19 nt, Homo sapiens
cccuuugaugauuaauuca

SEQ ID NO: 383510 - RNA, 13 nt, Homo sapiens
ccgaaaucagaag

SEQ ID NO: 383511 - RNA, 16 nt, Homo sapiens
ccgaaguaugagggaa

SEQ ID NO: 383512 - RNA, 22 nt, Homo sapiens
ccgagcuuugaaaauucagugg

SEQ ID NO: 383513 - RNA, 15 nt, Homo sapiens
ccgagucucuucucc

SEQ ID NO: 383514 - RNA, 13 nt, Homo sapiens
ccgagugcaauga

SEQ ID NO: 383515 - RNA, 12 nt, Homo sapiens
ccgauucaccug

SEQ ID NO: 383516 - RNA, 23 nt, Homo sapiens
ccgcaacaguuuuuuaugcuaau

SEQ ID NO: 383517 - RNA, 19 nt, Homo sapiens
ccgucaauaggcaaagggg

SEQ ID NO: 383518 - RNA, 22 nt, Homo sapiens
ccguccucaccccuguccucac

SEQ ID NO: 383519 - RNA, 12 nt, Homo sapiens
ccgucucaagga

SEQ ID NO: 383520 - RNA, 18 nt, Homo sapiens
ccguggcuaagagugucc

SEQ ID NO: 383521 - RNA, 14 nt, Homo sapiens
ccuaaaaacacaga

SEQ ID NO: 383522 - RNA, 21 nt, Homo sapiens
ccuaaaaguuacuuaccacag

SEQ ID NO: 383523 - RNA, 19 nt, Homo sapiens
ccuaacaggauuagacagu

SEQ ID NO: 383524 - RNA, 18 nt, Homo sapiens
ccuacaccucuugaaaau

SEQ ID NO: 383525 - RNA, 12 nt, Homo sapiens
ccuacauguauu

SEQ ID NO: 383526 - RNA, 21 nt, Homo sapiens
ccuacauguauugcacauugu

SEQ ID NO: 383527 - RNA, 17 nt, Homo sapiens
ccuacugcaucgaguca

SEQ ID NO: 383528 - RNA, 20 nt, Homo sapiens
ccuagacugacccugaucag

SEQ ID NO: 383529 - RNA, 15 nt, Homo sapiens
ccuagccgaccucag

SEQ ID NO: 383530 - RNA, 19 nt, Homo sapiens
ccuagccucgcucuuggca

SEQ ID NO: 383531 - RNA, 15 nt, Homo sapiens
ccuaggcauuugcug

SEQ ID NO: 383532 - RNA, 23 nt, Homo sapiens
ccuagucuacuugaggcugcaau

SEQ ID NO: 383533 - RNA, 23 nt, Homo sapiens
ccuauguuuuuguucaaagccag

SEQ ID NO: 383534 - RNA, 23 nt, Homo sapiens
ccucagggacagagacaccugca

SEQ ID NO: 383535 - RNA, 10 nt, Homo sapiens
ccucagggcu

SEQ ID NO: 383536 - RNA, 18 nt, Homo sapiens
ccucaucccgagcaccuc

SEQ ID NO: 383537 - RNA, 15 nt, Homo sapiens
ccucaugcuguuuca

SEQ ID NO: 383538 - RNA, 13 nt, Homo sapiens
ccucauuagcauu

SEQ ID NO: 383539 - RNA, 20 nt, Homo sapiens
ccuccaagcuccaucuccac

SEQ ID NO: 383540 - RNA, 13 nt, Homo sapiens
ccuccacgccauu

SEQ ID NO: 383541 - RNA, 16 nt, Homo sapiens
ccuccacgccauuucc

SEQ ID NO: 383542 - RNA, 16 nt, Homo sapiens
ccuccauacucaggac

SEQ ID NO: 383543 - RNA, 20 nt, Homo sapiens
ccucccaaagugcuaguauu

SEQ ID NO: 383544 - RNA, 16 nt, Homo sapiens
ccucccaccucuguga

SEQ ID NO: 383545 - RNA, 15 nt, Homo sapiens
ccucccucaccaaca

SEQ ID NO: 383546 - RNA, 15 nt, Homo sapiens
ccucuacaauuugcc

SEQ ID NO: 383547 - RNA, 16 nt, Homo sapiens
ccucuccgcaguuccu

SEQ ID NO: 383548 - RNA, 16 nt, Homo sapiens
ccucucuuauagaaua

SEQ ID NO: 383549 - RNA, 12 nt, Homo sapiens
ccucugccucaa

SEQ ID NO: 383550 - RNA, 15 nt, Homo sapiens
ccucugccugcauuc

SEQ ID NO: 383551 - RNA, 22 nt, Homo sapiens
ccucugcggaccccagcuguga

SEQ ID NO: 383552 - RNA, 13 nt, Homo sapiens
ccucuggcucuca

SEQ ID NO: 383553 - RNA, 18 nt, Homo sapiens
ccucugggccaagucaaa

SEQ ID NO: 383554 - RNA, 23 nt, Homo sapiens
ccucuuaaaaaauaaaaacugac

SEQ ID NO: 383555 - RNA, 21 nt, Homo sapiens
ccucuucucuacucuagggaa

SEQ ID NO: 383556 - RNA, 21 nt, Homo sapiens
ccugaaguaagcaaagacuuu

SEQ ID NO: 383557 - RNA, 22 nt, Homo sapiens
ccugaaguaagcaaagacuuuc

SEQ ID NO: 383558 - RNA, 23 nt, Homo sapiens
ccugaaugugucugcgucccugu

SEQ ID NO: 383559 - RNA, 22 nt, Homo sapiens
ccugaccucaggugauccaccc

SEQ ID NO: 383560 - RNA, 23 nt, Homo sapiens
ccugaguggugccaaacaaaaag

SEQ ID NO: 383561 - RNA, 13 nt, Homo sapiens
ccugcaauuccac

SEQ ID NO: 383562 - RNA, 14 nt, Homo sapiens
ccugcaccugugca

SEQ ID NO: 383563 - RNA, 20 nt, Homo sapiens
ccugcagccuccuccugacc

SEQ ID NO: 383564 - RNA, 16 nt, Homo sapiens
ccugcauucacccaga

SEQ ID NO: 383565 - RNA, 19 nt, Homo sapiens
ccugcccagaucccagaag

SEQ ID NO: 383566 - RNA, 14 nt, Homo sapiens
ccugcccuagcucc

SEQ ID NO: 383567 - RNA, 16 nt, Homo sapiens
ccugcccuagcuccac

SEQ ID NO: 383568 - RNA, 13 nt, Homo sapiens
ccugccuggucac

SEQ ID NO: 383569 - RNA, 20 nt, Homo sapiens
ccugccuguagcagugagaa

SEQ ID NO: 383570 - RNA, 15 nt, Homo sapiens
ccuggaaggugcugu

SEQ ID NO: 383571 - RNA, 13 nt, Homo sapiens
ccuggacugggag

SEQ ID NO: 383572 - RNA, 20 nt, Homo sapiens
ccuggacugggagguagaua

SEQ ID NO: 383573 - RNA, 12 nt, Homo sapiens
ccuggcaagaau

SEQ ID NO: 383574 - RNA, 15 nt, Homo sapiens
ccugggauguccaca

SEQ ID NO: 383575 - RNA, 18 nt, Homo sapiens
ccugggccccaccaccua

SEQ ID NO: 383576 - RNA, 19 nt, Homo sapiens
ccugggcgacagagccaga

SEQ ID NO: 383577 - RNA, 12 nt, Homo sapiens
ccuggggaccau

SEQ ID NO: 383578 - RNA, 18 nt, Homo sapiens
ccuggguaacuagggaag

SEQ ID NO: 383579 - RNA, 12 nt, Homo sapiens
aagcacuugugg

SEQ ID NO: 383580 - RNA, 15 nt, Homo sapiens
aagcagaccacugau

SEQ ID NO: 383581 - RNA, 21 nt, Homo sapiens
aagcagaugcaaagaggcaag

SEQ ID NO: 383582 - RNA, 17 nt, Homo sapiens
aagcagauuuaacaauu

SEQ ID NO: 383583 - RNA, 15 nt, Homo sapiens
aagcagcucaaaggc

SEQ ID NO: 383584 - RNA, 22 nt, Homo sapiens
aagcagggacuugaacccauau

SEQ ID NO: 383585 - RNA, 20 nt, Homo sapiens
aagcauaaaaauuagccaag

SEQ ID NO: 383586 - RNA, 11 nt, Homo sapiens
aagcauuguaa

SEQ ID NO: 383587 - RNA, 16 nt, Homo sapiens
aagcauuuuacaagau

SEQ ID NO: 383588 - RNA, 23 nt, Homo sapiens
aagcauuuuacaagaucuugcau

SEQ ID NO: 383589 - RNA, 13 nt, Homo sapiens
aagccagcacuca

SEQ ID NO: 383590 - RNA, 20 nt, Homo sapiens
aagccagcacucacaccacu

SEQ ID NO: 383591 - RNA, 15 nt, Homo sapiens
aagccccacuugaag

SEQ ID NO: 383592 - RNA, 14 nt, Homo sapiens
aagccccugcccau

SEQ ID NO: 383593 - RNA, 15 nt, Homo sapiens
aagccuaagaaucuu

SEQ ID NO: 383594 - RNA, 12 nt, Homo sapiens
aagcgugaaggc

SEQ ID NO: 383595 - RNA, 18 nt, Homo sapiens
aagcuaaaaugauuuuau

SEQ ID NO: 383596 - RNA, 22 nt, Homo sapiens
aagcuaaaauuagaugaacuca

SEQ ID NO: 383597 - RNA, 22 nt, Homo sapiens
aagcuaaauccuuuacuguuag

SEQ ID NO: 383598 - RNA, 22 nt, Homo sapiens
aagcuccuguccucccaucccc

SEQ ID NO: 383599 - RNA, 13 nt, Homo sapiens
aagcucuucuaaa

SEQ ID NO: 383600 - RNA, 13 nt, Homo sapiens
aagcugcuuuaaa

SEQ ID NO: 383601 - RNA, 14 nt, Homo sapiens
aagcugcuuuagaa

SEQ ID NO: 383602 - RNA, 14 nt, Homo sapiens
aagcugggagcaca

SEQ ID NO: 383603 - RNA, 23 nt, Homo sapiens
aagcuguguccuugcaccugcau

SEQ ID NO: 383604 - RNA, 22 nt, Homo sapiens
aagcuuucauguaaacugugca

SEQ ID NO: 383605 - RNA, 15 nt, Homo sapiens
aaggaaaucucaccc

SEQ ID NO: 383606 - RNA, 19 nt, Homo sapiens
aaggaagcuccacugucac

SEQ ID NO: 383607 - RNA, 21 nt, Homo sapiens
aaggacggccuucaacugaaa

SEQ ID NO: 383608 - RNA, 11 nt, Homo sapiens
aaggacucuca

SEQ ID NO: 383609 - RNA, 15 nt, Homo sapiens
aaggacuuugcagcc

SEQ ID NO: 383610 - RNA, 22 nt, Homo sapiens
aaggagcccuuaucugugcuca

SEQ ID NO: 383611 - RNA, 17 nt, Homo sapiens
aaggaguccuugcauca

SEQ ID NO: 383612 - RNA, 14 nt, Homo sapiens
aaggauugugauau

SEQ ID NO: 383613 - RNA, 23 nt, Homo sapiens
aaggcaccuauaaaacaggucaa

SEQ ID NO: 383614 - RNA, 18 nt, Homo sapiens
aaggcggcuacaugccuc

SEQ ID NO: 383615 - RNA, 24 nt, Homo sapiens
aaggcgugagucuucaucuuaggg

SEQ ID NO: 383616 - RNA, 16 nt, Homo sapiens
aagggaaaagcccaug

SEQ ID NO: 383617 - RNA, 16 nt, Homo sapiens
aagggaucuuccuugg

SEQ ID NO: 383618 - RNA, 14 nt, Homo sapiens
aagggauggcaaga

SEQ ID NO: 383619 - RNA, 21 nt, Homo sapiens
aagggcaaaauucccagggaa

SEQ ID NO: 383620 - RNA, 22 nt, Homo sapiens
aagggccagcuggaggugaaga

SEQ ID NO: 383621 - RNA, 14 nt, Homo sapiens
aagggugucuuccu

SEQ ID NO: 383622 - RNA, 15 nt, Homo sapiens
aaggucucugaacuc

SEQ ID NO: 383623 - RNA, 17 nt, Homo sapiens
aaggugaaccaugucag

SEQ ID NO: 383624 - RNA, 17 nt, Homo sapiens
aagguuuuuacugugag

SEQ ID NO: 383625 - RNA, 20 nt, Homo sapiens
aaguaaaacuugcugccuga

SEQ ID NO: 383626 - RNA, 15 nt, Homo sapiens
aaguaaggcaugguu

SEQ ID NO: 383627 - RNA, 20 nt, Homo sapiens
aaguaauuccucucacuaaa

SEQ ID NO: 383628 - RNA, 22 nt, Homo sapiens
aaguaauuccucucacuaaacu

SEQ ID NO: 383629 - RNA, 17 nt, Homo sapiens
aaguagcacccuggauu

SEQ ID NO: 383630 - RNA, 16 nt, Homo sapiens
cgcaaugugacuuaau

SEQ ID NO: 383631 - RNA, 16 nt, Homo sapiens
cgcaccacuguguauu

SEQ ID NO: 383632 - RNA, 20 nt, Homo sapiens
cgccuccccuuugugacuuc

SEQ ID NO: 383633 - RNA, 16 nt, Homo sapiens
cgccugacaaccacug

SEQ ID NO: 383634 - RNA, 13 nt, Homo sapiens
cgccugagcucac

SEQ ID NO: 383635 - RNA, 11 nt, Homo sapiens
cgccugcaaac

SEQ ID NO: 383636 - RNA, 22 nt, Homo sapiens
cgcugagcgaggagaugcuccu

SEQ ID NO: 383637 - RNA, 13 nt, Homo sapiens
cggaaguuuucaa

SEQ ID NO: 383638 - RNA, 21 nt, Homo sapiens
cgggccuggagaacuagagaa

SEQ ID NO: 383639 - RNA, 21 nt, Homo sapiens
cgggcgaggucugauggagcu

SEQ ID NO: 383640 - RNA, 18 nt, Homo sapiens
cgggcugggagcucugca

SEQ ID NO: 383641 - RNA, 20 nt, Homo sapiens
cgguaaacacgccugcaaac

SEQ ID NO: 383642 - RNA, 16 nt, Homo sapiens
cguaagggaucuuccu

SEQ ID NO: 383643 - RNA, 22 nt, Homo sapiens
cguaguggaauuaacaggaaau

SEQ ID NO: 383644 - RNA, 20 nt, Homo sapiens
cgucaguccaagucuucuca

SEQ ID NO: 383645 - RNA, 16 nt, Homo sapiens
cgucaugcuuguguua

SEQ ID NO: 383646 - RNA, 23 nt, Homo sapiens
cgucuuccugaguggugccaaac

SEQ ID NO: 383647 - RNA, 15 nt, Homo sapiens
cgugacuguggcaca

SEQ ID NO: 383648 - RNA, 23 nt, Homo sapiens
cgugggacaucuaguaggugcuu

SEQ ID NO: 383649 - RNA, 21 nt, Homo sapiens
cgugggucuucagggggccag

SEQ ID NO: 383650 - RNA, 15 nt, Homo sapiens
cgugguggcacacac

SEQ ID NO: 383651 - RNA, 15 nt, Homo sapiens
cguguguccaugugu

SEQ ID NO: 383652 - RNA, 12 nt, Homo sapiens
cguuuaaucaca

SEQ ID NO: 383653 - RNA, 14 nt, Homo sapiens
cguuugaaucacag

SEQ ID NO: 383654 - RNA, 23 nt, Homo sapiens
cguuuugugugguggcaccuccu

SEQ ID NO: 383655 - RNA, 20 nt, Homo sapiens
cuaaaaacacagacauucug

SEQ ID NO: 383656 - RNA, 14 nt, Homo sapiens
cuaaaaauacaauu

SEQ ID NO: 383657 - RNA, 17 nt, Homo sapiens
cuaaaaaucaugagauc

SEQ ID NO: 383658 - RNA, 17 nt, Homo sapiens
cuaaaaggaaaucucac

SEQ ID NO: 383659 - RNA, 22 nt, Homo sapiens
cuaaaaugauuuuaucugugaa

SEQ ID NO: 383660 - RNA, 23 nt, Homo sapiens
cuaaaaugauuuuaucugugaau

SEQ ID NO: 383661 - RNA, 20 nt, Homo sapiens
cuaaauaauguuaucugugu

SEQ ID NO: 383662 - RNA, 21 nt, Homo sapiens
cuaaauaauguuaucugugua

SEQ ID NO: 383663 - RNA, 22 nt, Homo sapiens
cuaaauagaaauaaaugauccc

SEQ ID NO: 383664 - RNA, 15 nt, Homo sapiens
cuaaaucucuaauau

SEQ ID NO: 383665 - RNA, 18 nt, Homo sapiens
cuaaaugaauguuuacac

SEQ ID NO: 383666 - RNA, 11 nt, Homo sapiens
cuaaauuugaa

SEQ ID NO: 383667 - RNA, 22 nt, Homo sapiens
cuaacaaguagcacccuggauu

SEQ ID NO: 383668 - RNA, 23 nt, Homo sapiens
cuaacacccagucuguuccccau

SEQ ID NO: 383669 - RNA, 16 nt, Homo sapiens
cuaaccagccugguca

SEQ ID NO: 383670 - RNA, 17 nt, Homo sapiens
cuaacuucaaggcccau

SEQ ID NO: 383671 - RNA, 20 nt, Homo sapiens
cuaauaaaaaacaccuucua

SEQ ID NO: 383672 - RNA, 22 nt, Homo sapiens
cuaauagagugguacagcacug

SEQ ID NO: 383673 - RNA, 21 nt, Homo sapiens
cuaauccucuuuuucuagucu

SEQ ID NO: 383674 - RNA, 14 nt, Homo sapiens
cuacaaaggccaug

SEQ ID NO: 383675 - RNA, 19 nt, Homo sapiens
cuacaaggcuggcagugac

SEQ ID NO: 383676 - RNA, 21 nt, Homo sapiens
cuacaauauuaacauaagaaa

SEQ ID NO: 383677 - RNA, 12 nt, Homo sapiens
cuacacacaaac

SEQ ID NO: 383678 - RNA, 14 nt, Homo sapiens
cuacauaaguaauu

SEQ ID NO: 383679 - RNA, 13 nt, Homo sapiens
cuaccaucaggga

SEQ ID NO: 383680 - RNA, 15 nt, Homo sapiens
cuaccaucagggaca

SEQ ID NO: 383681 - RNA, 20 nt, Homo sapiens
cuaccccaaaguuugcucaa

SEQ ID NO: 383682 - RNA, 22 nt, Homo sapiens
cuacccuuccucaccacuuccc

SEQ ID NO: 383683 - RNA, 22 nt, Homo sapiens
cuaccuugguucccccacugau

SEQ ID NO: 383684 - RNA, 22 nt, Homo sapiens
cuacgccugcauguaaacacgc

SEQ ID NO: 383685 - RNA, 19 nt, Homo sapiens
cuacgugacuguggcacac

SEQ ID NO: 383686 - RNA, 23 nt, Homo sapiens
cuacuaaaaauacaauuagccag

SEQ ID NO: 383687 - RNA, 12 nt, Homo sapiens
cuacucagggaa

SEQ ID NO: 383688 - RNA, 19 nt, Homo sapiens
cuacucccucaaagcacac

SEQ ID NO: 383689 - RNA, 19 nt, Homo sapiens
cuacuuccugugacuucag

SEQ ID NO: 383690 - RNA, 15 nt, Homo sapiens
cuacuuuaagcacua

SEQ ID NO: 383691 - RNA, 17 nt, Homo sapiens
cuacuuuagagucuucu

SEQ ID NO: 383692 - RNA, 19 nt, Homo sapiens
cuagagaaggacccggagg

SEQ ID NO: 383693 - RNA, 23 nt, Homo sapiens
cuagagauauggcagcgaaagga

SEQ ID NO: 383694 - RNA, 18 nt, Homo sapiens
cuagagccgugaugccuc

SEQ ID NO: 383695 - RNA, 14 nt, Homo sapiens
cuagaguguuguug

SEQ ID NO: 383696 - RNA, 20 nt, Homo sapiens
cuagaugugcaaaugcaagc

SEQ ID NO: 383697 - RNA, 15 nt, Homo sapiens
cuagauuuaugaaua

SEQ ID NO: 383698 - RNA, 21 nt, Homo sapiens
cuagcaucucaugagugccaa

SEQ ID NO: 383699 - RNA, 15 nt, Homo sapiens
cuagcuggauuuccu

SEQ ID NO: 383700 - RNA, 21 nt, Homo sapiens
cuagcugggaaggugaccaca

SEQ ID NO: 383701 - RNA, 14 nt, Homo sapiens
cuaggaguagaaaa

SEQ ID NO: 383702 - RNA, 16 nt, Homo sapiens
cuagggccaagcccag

SEQ ID NO: 383703 - RNA, 23 nt, Homo sapiens
cuagguucuaaaaauugugauca

SEQ ID NO: 383704 - RNA, 19 nt, Homo sapiens
cuagucugcuagccaggau

SEQ ID NO: 383705 - RNA, 22 nt, Homo sapiens
cuagugaaagaggcagcuugaa

SEQ ID NO: 383706 - RNA, 23 nt, Homo sapiens
cuauacaaacuacagaguuuaug

SEQ ID NO: 383707 - RNA, 18 nt, Homo sapiens
cuauauacuauaugauuc

SEQ ID NO: 383708 - RNA, 18 nt, Homo sapiens
cuauauuuagauuguuaa

SEQ ID NO: 383709 - RNA, 21 nt, Homo sapiens
cuaugaaauaucaugcuccau

SEQ ID NO: 383710 - RNA, 20 nt, Homo sapiens
cuauggcacccaugcaccuu

SEQ ID NO: 383711 - RNA, 18 nt, Homo sapiens
cuauggcucuacuuucag

SEQ ID NO: 383712 - RNA, 20 nt, Homo sapiens
cuaugugggugggaccacag

SEQ ID NO: 383713 - RNA, 21 nt, Homo sapiens
cuaugugggugggaccacaga

SEQ ID NO: 383714 - RNA, 22 nt, Homo sapiens
cuauguucuaagaagugaaaau

SEQ ID NO: 383715 - RNA, 22 nt, Homo sapiens
cuauuaguaguuaauucuguca

SEQ ID NO: 383716 - RNA, 15 nt, Homo sapiens
cuauucugauuacac

SEQ ID NO: 383717 - RNA, 19 nt, Homo sapiens
cuauugaaaaaucaccaca

SEQ ID NO: 383718 - RNA, 19 nt, Homo sapiens
cuauuugcacuguagccuc

SEQ ID NO: 383719 - RNA, 18 nt, Homo sapiens
cucaaaacugcacuguca

SEQ ID NO: 383720 - RNA, 22 nt, Homo sapiens
cucaaaauaccaugccauuuaa

SEQ ID NO: 383721 - RNA, 11 nt, Homo sapiens
cucaaacugcc

SEQ ID NO: 383722 - RNA, 22 nt, Homo sapiens
cucaaagacaauguuauuuucc

SEQ ID NO: 383723 - RNA, 16 nt, Homo sapiens
cucaagaugaaggcaa

SEQ ID NO: 383724 - RNA, 15 nt, Homo sapiens
cucaagauucaguag

SEQ ID NO: 383725 - RNA, 16 nt, Homo sapiens
cucaaggaaaggccug

SEQ ID NO: 383726 - RNA, 16 nt, Homo sapiens
cucaagggaugucuca

SEQ ID NO: 383727 - RNA, 21 nt, Homo sapiens
aauguacaacuuuuuaccuag

SEQ ID NO: 383728 - RNA, 21 nt, Homo sapiens
aauguauuuaaccagucuucu

SEQ ID NO: 383729 - RNA, 17 nt, Homo sapiens
aaugucuagguccccac

SEQ ID NO: 383730 - RNA, 15 nt, Homo sapiens
aaugugacgaacugc

SEQ ID NO: 383731 - RNA, 12 nt, Homo sapiens
aaugugauugca

SEQ ID NO: 383732 - RNA, 21 nt, Homo sapiens
aaugugcagcucccauuuggc

SEQ ID NO: 383733 - RNA, 17 nt, Homo sapiens
aauguggauucuuccca

SEQ ID NO: 383734 - RNA, 13 nt, Homo sapiens
aauguucauccca

SEQ ID NO: 383735 - RNA, 13 nt, Homo sapiens
aauguuguucucu

SEQ ID NO: 383736 - RNA, 22 nt, Homo sapiens
aauguuuagcaaauacauauuu

SEQ ID NO: 383737 - RNA, 19 nt, Homo sapiens
aauuaaaauccucaaucca

SEQ ID NO: 383738 - RNA, 13 nt, Homo sapiens
aauuagaugaacu

SEQ ID NO: 383739 - RNA, 14 nt, Homo sapiens
aauuagaugaacuc

SEQ ID NO: 383740 - RNA, 13 nt, Homo sapiens
aauuccucuggga

SEQ ID NO: 383741 - RNA, 21 nt, Homo sapiens
aauucuagagucucuguuacu

SEQ ID NO: 383742 - RNA, 20 nt, Homo sapiens
aauucugucauuucaaagac

SEQ ID NO: 383743 - RNA, 16 nt, Homo sapiens
aauugacccacaagaa

SEQ ID NO: 383744 - RNA, 17 nt, Homo sapiens
aauugugaucagaccau

SEQ ID NO: 383745 - RNA, 19 nt, Homo sapiens
aauuuagaaauauaauuga

SEQ ID NO: 383746 - RNA, 20 nt, Homo sapiens
aauuuauuucaaaaagggaa

SEQ ID NO: 383747 - RNA, 15 nt, Homo sapiens
aauuucacugaugua

SEQ ID NO: 383748 - RNA, 16 nt, Homo sapiens
aauuucauaccuauca

SEQ ID NO: 383749 - RNA, 22 nt, Homo sapiens
acaaaaaucacaaggcauucaa

SEQ ID NO: 383750 - RNA, 22 nt, Homo sapiens
acaaaacugacaguaaaucuca

SEQ ID NO: 383751 - RNA, 16 nt, Homo sapiens
acaaacuacauguaau

SEQ ID NO: 383752 - RNA, 19 nt, Homo sapiens
acaaagaguagacauuucu

SEQ ID NO: 383753 - RNA, 24 nt, Homo sapiens
acaaaggagagcuagcagcaggga

SEQ ID NO: 383754 - RNA, 21 nt, Homo sapiens
acaaaucuaugccacucagaa

SEQ ID NO: 383755 - RNA, 16 nt, Homo sapiens
acaaauuauguuacau

SEQ ID NO: 383756 - RNA, 17 nt, Homo sapiens
acaaauugcuugaaaga

SEQ ID NO: 383757 - RNA, 19 nt, Homo sapiens
acaaauuuacagagacaga

SEQ ID NO: 383758 - RNA, 19 nt, Homo sapiens
acaaccaauuccaaguuuu

SEQ ID NO: 383759 - RNA, 17 nt, Homo sapiens
acaacucagucccuaaa

SEQ ID NO: 383760 - RNA, 17 nt, Homo sapiens
acaacuguggucaaucc

SEQ ID NO: 383761 - RNA, 16 nt, Homo sapiens
acaacuucagcaguac

SEQ ID NO: 383762 - RNA, 12 nt, Homo sapiens
acaagaagccac

SEQ ID NO: 383763 - RNA, 18 nt, Homo sapiens
acaagaucuguaauguua

SEQ ID NO: 383764 - RNA, 11 nt, Homo sapiens
acaagauuccc

SEQ ID NO: 383765 - RNA, 17 nt, Homo sapiens
acaauacaggcuaggga

SEQ ID NO: 383766 - RNA, 18 nt, Homo sapiens
acaaucaugaaauaugca

SEQ ID NO: 383767 - RNA, 14 nt, Homo sapiens
acaauccuguggau

SEQ ID NO: 383768 - RNA, 15 nt, Homo sapiens
acacaaauuuguaaa

SEQ ID NO: 383769 - RNA, 14 nt, Homo sapiens
acacagacccgcug

SEQ ID NO: 383770 - RNA, 22 nt, Homo sapiens
acacagcaagggugaugggaaa

SEQ ID NO: 383771 - RNA, 19 nt, Homo sapiens
cucccugaaguaagcaaag

SEQ ID NO: 383772 - RNA, 14 nt, Homo sapiens
cucccuuacccucc

SEQ ID NO: 383773 - RNA, 18 nt, Homo sapiens
cuccguuuggcagugcaa

SEQ ID NO: 383774 - RNA, 20 nt, Homo sapiens
cuccuccagggccacgugcc

SEQ ID NO: 383775 - RNA, 22 nt, Homo sapiens
cuccucuuucaaccucagugau

SEQ ID NO: 383776 - RNA, 18 nt, Homo sapiens
cuccugcccaccugucaa

SEQ ID NO: 383777 - RNA, 15 nt, Homo sapiens
cuccugcccaggaga

SEQ ID NO: 383778 - RNA, 14 nt, Homo sapiens
cuccugccuacuca

SEQ ID NO: 383779 - RNA, 19 nt, Homo sapiens
cuccuggacugccuugaau

SEQ ID NO: 383780 - RNA, 21 nt, Homo sapiens
cuccugggcucaagcagucua

SEQ ID NO: 383781 - RNA, 13 nt, Homo sapiens
cuccugggcucag

SEQ ID NO: 383782 - RNA, 14 nt, Homo sapiens
cuccugugcaacuu

SEQ ID NO: 383783 - RNA, 19 nt, Homo sapiens
cuccuuucuuucuaacucc

SEQ ID NO: 383784 - RNA, 16 nt, Homo sapiens
cucgagcaguccugcc

SEQ ID NO: 383785 - RNA, 21 nt, Homo sapiens
cucggagaagagcuguucaca

SEQ ID NO: 383786 - RNA, 12 nt, Homo sapiens
cucuaacuucaa

SEQ ID NO: 383787 - RNA, 16 nt, Homo sapiens
cucuaagggaccucaa

SEQ ID NO: 383788 - RNA, 12 nt, Homo sapiens
cucuacaaaaag

SEQ ID NO: 383789 - RNA, 16 nt, Homo sapiens
cucuacuacaugugac

SEQ ID NO: 383790 - RNA, 21 nt, Homo sapiens
cucuauagacucuaggacaua

SEQ ID NO: 383791 - RNA, 21 nt, Homo sapiens
cucucagucucugagcaguga

SEQ ID NO: 383792 - RNA, 18 nt, Homo sapiens
cucucccaggacccauca

SEQ ID NO: 383793 - RNA, 18 nt, Homo sapiens
cucuccccacugcucauu

SEQ ID NO: 383794 - RNA, 18 nt, Homo sapiens
cucugacuuaagcugccu

SEQ ID NO: 383795 - RNA, 14 nt, Homo sapiens
cucugagaucuaag

SEQ ID NO: 383796 - RNA, 15 nt, Homo sapiens
cucugagcugugcag

SEQ ID NO: 383797 - RNA, 21 nt, Homo sapiens
cucugagguuuccgaaaucag

SEQ ID NO: 383798 - RNA, 21 nt, Homo sapiens
cucugcaaugggcacugggau

SEQ ID NO: 383799 - RNA, 17 nt, Homo sapiens
cucugcagcccucagau

SEQ ID NO: 383800 - RNA, 20 nt, Homo sapiens
cucugcauuaucugagguca

SEQ ID NO: 383801 - RNA, 15 nt, Homo sapiens
cucugcauucuagua

SEQ ID NO: 383802 - RNA, 20 nt, Homo sapiens
cucugccaaaggaugugaua

SEQ ID NO: 383803 - RNA, 13 nt, Homo sapiens
cucugccagugac

SEQ ID NO: 383804 - RNA, 21 nt, Homo sapiens
cucuggacacagccccaugua

SEQ ID NO: 383805 - RNA, 22 nt, Homo sapiens
cucugggccaagucaaagacau

SEQ ID NO: 383806 - RNA, 18 nt, Homo sapiens
cucugguaaaugaucacu

SEQ ID NO: 383807 - RNA, 16 nt, Homo sapiens
cucuggugacaccagc

SEQ ID NO: 383808 - RNA, 21 nt, Homo sapiens
cucugugaacgauuuagaaag

SEQ ID NO: 383809 - RNA, 14 nt, Homo sapiens
cucugugaccaaug

SEQ ID NO: 383810 - RNA, 18 nt, Homo sapiens
cucuguuuucaugcuauu

SEQ ID NO: 383811 - RNA, 17 nt, Homo sapiens
cucuuauccaacaucaa

SEQ ID NO: 383812 - RNA, 23 nt, Homo sapiens
cucuucuaaaaaaugauacacac

SEQ ID NO: 383813 - RNA, 19 nt, Homo sapiens
cucuugaaaauagaacaac

SEQ ID NO: 383814 - RNA, 18 nt, Homo sapiens
cucuuuugaauccaugcu

SEQ ID NO: 383815 - RNA, 19 nt, Homo sapiens
cugaaaagacucaguguuc

SEQ ID NO: 383816 - RNA, 18 nt, Homo sapiens
cugaaaaucgaguuuuuc

SEQ ID NO: 383817 - RNA, 13 nt, Homo sapiens
cugaaaauucugu

SEQ ID NO: 383818 - RNA, 17 nt, Homo sapiens
cugaaauaaaauucauu

SEQ ID NO: 383819 - RNA, 12 nt, Homo sapiens
cugaacagugga

SEQ ID NO: 383820 - RNA, 15 nt, Homo sapiens
cugaagaacaguaac

SEQ ID NO: 383821 - RNA, 16 nt, Homo sapiens
cugaaguaagcaaaga

SEQ ID NO: 383822 - RNA, 23 nt, Homo sapiens
cugaauccauaaaggcauaccuu

SEQ ID NO: 383823 - RNA, 20 nt, Homo sapiens
cugaauguauugaacuugga

SEQ ID NO: 383824 - RNA, 14 nt, Homo sapiens
cugaccuugcacaa

SEQ ID NO: 383825 - RNA, 18 nt, Homo sapiens
cugagaaagacuauucaa

SEQ ID NO: 383826 - RNA, 16 nt, Homo sapiens
cugagagacaggacua

SEQ ID NO: 383827 - RNA, 18 nt, Homo sapiens
cugagagacaggacuagc

SEQ ID NO: 383828 - RNA, 18 nt, Homo sapiens
cugagaugugaacacauc

SEQ ID NO: 383829 - RNA, 13 nt, Homo sapiens
cugagcaggauuu

SEQ ID NO: 383830 - RNA, 17 nt, Homo sapiens
cugaggcagacagcagc

SEQ ID NO: 383831 - RNA, 21 nt, Homo sapiens
cugaggguccccaccugggac

SEQ ID NO: 383832 - RNA, 20 nt, Homo sapiens
cugaggugggaggaucucuu

SEQ ID NO: 383833 - RNA, 16 nt, Homo sapiens
cugaguggugccaaac

SEQ ID NO: 383834 - RNA, 19 nt, Homo sapiens
cugaguuauuuugcuaaac

SEQ ID NO: 383835 - RNA, 20 nt, Homo sapiens
cugauaaccacuccuaauau

SEQ ID NO: 383836 - RNA, 23 nt, Homo sapiens
cugauauaacaaacuacauguaa

SEQ ID NO: 383837 - RNA, 18 nt, Homo sapiens
cugaugaaggcaugccua

SEQ ID NO: 383838 - RNA, 13 nt, Homo sapiens
cugaugcaagcaa

SEQ ID NO: 383839 - RNA, 19 nt, Homo sapiens
cugauuuuuagcuuuacaa

SEQ ID NO: 383840 - RNA, 22 nt, Homo sapiens
cugcaaaggcaccugaaugugu

SEQ ID NO: 383841 - RNA, 16 nt, Homo sapiens
cugcaagcacaucugc

SEQ ID NO: 383842 - RNA, 18 nt, Homo sapiens
cugcaaugggcacuggga

SEQ ID NO: 383843 - RNA, 20 nt, Homo sapiens
cugcaauuuuaauugauuau

SEQ ID NO: 383844 - RNA, 21 nt, Homo sapiens
cugcacaaagcccuuccaugu

SEQ ID NO: 383845 - RNA, 21 nt, Homo sapiens
cugcaccuucgccagggagca

SEQ ID NO: 383846 - RNA, 20 nt, Homo sapiens
cugcagaagacaguauggca

SEQ ID NO: 383847 - RNA, 22 nt, Homo sapiens
cugcauacucauuaggauggcu

SEQ ID NO: 383848 - RNA, 23 nt, Homo sapiens
cugcauguaaacacgccugcaaa

SEQ ID NO: 383849 - RNA, 13 nt, Homo sapiens
cugccacauucua

SEQ ID NO: 383850 - RNA, 14 nt, Homo sapiens
cugcccaccuguca

SEQ ID NO: 383851 - RNA, 20 nt, Homo sapiens
cugcccaccugucaaacaaa

SEQ ID NO: 383852 - RNA, 15 nt, Homo sapiens
cugcccagugcacac

SEQ ID NO: 383853 - RNA, 20 nt, Homo sapiens
cugccccaaacaaauaugca

SEQ ID NO: 383854 - RNA, 19 nt, Homo sapiens
cugccccaggccugaaaga

SEQ ID NO: 383855 - RNA, 13 nt, Homo sapiens
cugccccaugcug

SEQ ID NO: 383856 - RNA, 21 nt, Homo sapiens
cugccccuggcucugaccgaa

SEQ ID NO: 383857 - RNA, 23 nt, Homo sapiens
cugcccguaaacacgccugcaaa

SEQ ID NO: 383858 - RNA, 16 nt, Homo sapiens
cugcccuagagcacac

SEQ ID NO: 383859 - RNA, 23 nt, Homo sapiens
cugccgguaaacacgccugcaaa

SEQ ID NO: 383860 - RNA, 20 nt, Homo sapiens
cugccugcccguaaacacgc

SEQ ID NO: 383861 - RNA, 16 nt, Homo sapiens
cugcuauaacuaugac

SEQ ID NO: 383862 - RNA, 19 nt, Homo sapiens
cugcucgccuuagcacuac

SEQ ID NO: 383863 - RNA, 23 nt, Homo sapiens
cugcuggcagaaagcaaauguga

SEQ ID NO: 383864 - RNA, 23 nt, Homo sapiens
cugcuugaacccaggagguggag

SEQ ID NO: 383865 - RNA, 14 nt, Homo sapiens
cuggaaggugcugu

SEQ ID NO: 383866 - RNA, 15 nt, Homo sapiens
cuggaauucuaacaa

SEQ ID NO: 383867 - RNA, 14 nt, Homo sapiens
cuggaccagugguc

SEQ ID NO: 383868 - RNA, 13 nt, Homo sapiens
cuggacucaggau

SEQ ID NO: 383869 - RNA, 12 nt, Homo sapiens
cuggacugggag

SEQ ID NO: 383870 - RNA, 17 nt, Homo sapiens
cuggaggaguuccuuga

SEQ ID NO: 383871 - RNA, 13 nt, Homo sapiens
cuggagucgggac

SEQ ID NO: 383872 - RNA, 12 nt, Homo sapiens
cuggagugcagu

SEQ ID NO: 383873 - RNA, 13 nt, Homo sapiens
cuggauccaucag

SEQ ID NO: 383874 - RNA, 18 nt, Homo sapiens
cuggauggagcccaggcg

SEQ ID NO: 383875 - RNA, 15 nt, Homo sapiens
cuggcacaguuuucu

SEQ ID NO: 383876 - RNA, 17 nt, Homo sapiens
accagccugcacuacuc

SEQ ID NO: 383877 - RNA, 22 nt, Homo sapiens
accagccugcacuacucccuca

SEQ ID NO: 383878 - RNA, 12 nt, Homo sapiens
accagggacuga

SEQ ID NO: 383879 - RNA, 14 nt, Homo sapiens
accaggucagggag

SEQ ID NO: 383880 - RNA, 15 nt, Homo sapiens
accaguaauugugaa

SEQ ID NO: 383881 - RNA, 23 nt, Homo sapiens
accaguguccccuccacugucac

SEQ ID NO: 383882 - RNA, 11 nt, Homo sapiens
accauaaugua

SEQ ID NO: 383883 - RNA, 13 nt, Homo sapiens
accaucuuggcca

SEQ ID NO: 383884 - RNA, 16 nt, Homo sapiens
accaugaaauauccag

SEQ ID NO: 383885 - RNA, 19 nt, Homo sapiens
accaugagaccacuguuau

SEQ ID NO: 383886 - RNA, 13 nt, Homo sapiens
accauucaggaca

SEQ ID NO: 383887 - RNA, 19 nt, Homo sapiens
accauucaggacacaggga

SEQ ID NO: 383888 - RNA, 17 nt, Homo sapiens
acccacaaaaguacaau

SEQ ID NO: 383889 - RNA, 18 nt, Homo sapiens
acccacgugcuguuccac

SEQ ID NO: 383890 - RNA, 15 nt, Homo sapiens
acccagcaacuccaa

SEQ ID NO: 383891 - RNA, 17 nt, Homo sapiens
acccagggccugcagga

SEQ ID NO: 383892 - RNA, 22 nt, Homo sapiens
acccagucagaguugugcacau

SEQ ID NO: 383893 - RNA, 13 nt, Homo sapiens
acccagugccagg

SEQ ID NO: 383894 - RNA, 16 nt, Homo sapiens
acccaguuagcucuca

SEQ ID NO: 383895 - RNA, 12 nt, Homo sapiens
acccaucugcac

SEQ ID NO: 383896 - RNA, 13 nt, Homo sapiens
accccaccacuuc

SEQ ID NO: 383897 - RNA, 19 nt, Homo sapiens
accccuccccuaaugccug

SEQ ID NO: 383898 - RNA, 18 nt, Homo sapiens
accccuccuuccuugacc

SEQ ID NO: 383899 - RNA, 22 nt, Homo sapiens
accccugcuccccugagcugaa

SEQ ID NO: 383900 - RNA, 19 nt, Homo sapiens
acccucuccccacugcuca

SEQ ID NO: 383901 - RNA, 19 nt, Homo sapiens
acccugccuuaucuugcac

SEQ ID NO: 383902 - RNA, 19 nt, Homo sapiens
acccugucuaaaaaacaua

SEQ ID NO: 383903 - RNA, 12 nt, Homo sapiens
acccuucugccu

SEQ ID NO: 383904 - RNA, 17 nt, Homo sapiens
acccuugaaaagacauc

SEQ ID NO: 383905 - RNA, 15 nt, Homo sapiens
acccuugauuauacu

SEQ ID NO: 383906 - RNA, 23 nt, Homo sapiens
acccuugcgcuuuugcuggucac

SEQ ID NO: 383907 - RNA, 15 nt, Homo sapiens
accgaggaccggcug

SEQ ID NO: 383908 - RNA, 21 nt, Homo sapiens
accgagucucuucuccacugg

SEQ ID NO: 383909 - RNA, 13 nt, Homo sapiens
accgagugcaaug

SEQ ID NO: 383910 - RNA, 23 nt, Homo sapiens
accggggccuacuagagucugaa

SEQ ID NO: 383911 - RNA, 20 nt, Homo sapiens
accgucaauaggcaaagggg

SEQ ID NO: 383912 - RNA, 16 nt, Homo sapiens
accuaaaccaccagug

SEQ ID NO: 383913 - RNA, 16 nt, Homo sapiens
uacaacuucagcagua

SEQ ID NO: 383914 - RNA, 23 nt, Homo sapiens
uacaagacaggacccugggacca

SEQ ID NO: 383915 - RNA, 21 nt, Homo sapiens
uacaauaaaacuuugcugcca

SEQ ID NO: 383916 - RNA, 23 nt, Homo sapiens
uacaauaacauaauuuguacaua

SEQ ID NO: 383917 - RNA, 19 nt, Homo sapiens
uacaauuguaaaacugagg

SEQ ID NO: 383918 - RNA, 13 nt, Homo sapiens
uacaauugugagc

SEQ ID NO: 383919 - RNA, 13 nt, Homo sapiens
uacaauuugccau

SEQ ID NO: 383920 - RNA, 14 nt, Homo sapiens
uacagauagucaaa

SEQ ID NO: 383921 - RNA, 17 nt, Homo sapiens
uacagcagugucaucag

SEQ ID NO: 383922 - RNA, 22 nt, Homo sapiens
uacagcuaaucagcauucucac

SEQ ID NO: 383923 - RNA, 19 nt, Homo sapiens
uacaggccauacuuuacaa

SEQ ID NO: 383924 - RNA, 12 nt, Homo sapiens
uacaguguuauu

SEQ ID NO: 383925 - RNA, 13 nt, Homo sapiens
uacauaaguaauu

SEQ ID NO: 383926 - RNA, 23 nt, Homo sapiens
uacauacaggccauacuuuacaa

SEQ ID NO: 383927 - RNA, 13 nt, Homo sapiens
uacauaugugcug

SEQ ID NO: 383928 - RNA, 19 nt, Homo sapiens
uacaugccucagugaagga

SEQ ID NO: 383929 - RNA, 14 nt, Homo sapiens
uaccaaguauuuau

SEQ ID NO: 383930 - RNA, 20 nt, Homo sapiens
uaccagacgguucaccagcc

SEQ ID NO: 383931 - RNA, 18 nt, Homo sapiens
uacccacgugcuguucca

SEQ ID NO: 383932 - RNA, 18 nt, Homo sapiens
uacccuguaacaugcaau

SEQ ID NO: 383933 - RNA, 21 nt, Homo sapiens
uaccuagcaaagcuccugccu

SEQ ID NO: 383934 - RNA, 18 nt, Homo sapiens
uaccuaguacaaggcaac

SEQ ID NO: 383935 - RNA, 14 nt, Homo sapiens
uaccucacuggggu

SEQ ID NO: 383936 - RNA, 21 nt, Homo sapiens
uaccugaaaacacugugcaca

SEQ ID NO: 383937 - RNA, 13 nt, Homo sapiens
uaccugggcauuc

SEQ ID NO: 383938 - RNA, 21 nt, Homo sapiens
uaccuugguucccccacugau

SEQ ID NO: 383939 - RNA, 15 nt, Homo sapiens
uacguuaccaggcag

SEQ ID NO: 383940 - RNA, 12 nt, Homo sapiens
uacuauaugauu

SEQ ID NO: 383941 - RNA, 15 nt, Homo sapiens
uacuaucaugucaaa

SEQ ID NO: 383942 - RNA, 16 nt, Homo sapiens
uacuauuuucauucuc

SEQ ID NO: 383943 - RNA, 23 nt, Homo sapiens
uacucaaggaauuugcauuuagu

SEQ ID NO: 383944 - RNA, 15 nt, Homo sapiens
uacucauucagggau

SEQ ID NO: 383945 - RNA, 22 nt, Homo sapiens
uacucauucagggauagcacug

SEQ ID NO: 383946 - RNA, 22 nt, Homo sapiens
uacuccaguauaugcugaugga

SEQ ID NO: 383947 - RNA, 23 nt, Homo sapiens
uacugcagcuuuguuuguuguca

SEQ ID NO: 383948 - RNA, 21 nt, Homo sapiens
uacugggguuuuucuaagaaa

SEQ ID NO: 383949 - RNA, 15 nt, Homo sapiens
uacuuaaagcuucua

SEQ ID NO: 383950 - RNA, 17 nt, Homo sapiens
uacuuauucuagauuac

SEQ ID NO: 383951 - RNA, 22 nt, Homo sapiens
uacuucaacacuucauguauug

SEQ ID NO: 383952 - RNA, 16 nt, Homo sapiens
uacuucaagaucugaa

SEQ ID NO: 383953 - RNA, 12 nt, Homo sapiens
uacuucucacca

SEQ ID NO: 383954 - RNA, 12 nt, Homo sapiens
uacuuuaccucc

SEQ ID NO: 383955 - RNA, 15 nt, Homo sapiens
uacuuuaccuccuau

SEQ ID NO: 383956 - RNA, 21 nt, Homo sapiens
uacuuugaagucauaccaaug

SEQ ID NO: 383957 - RNA, 21 nt, Homo sapiens
uacuuuugcccuuugauuaaa

SEQ ID NO: 383958 - RNA, 12 nt, Homo sapiens
uagaaaaaccac

SEQ ID NO: 383959 - RNA, 14 nt, Homo sapiens
uagaaaguucaaaa

SEQ ID NO: 383960 - RNA, 17 nt, Homo sapiens
uagaaauugaaguuuca

SEQ ID NO: 383961 - RNA, 21 nt, Homo sapiens
uagaagcaaaugacaaaaagc

SEQ ID NO: 383962 - RNA, 22 nt, Homo sapiens
uagaagccacuauuacugggac

SEQ ID NO: 383963 - RNA, 20 nt, Homo sapiens
uagaauauuuauuaccucug

SEQ ID NO: 383964 - RNA, 16 nt, Homo sapiens
uagaauuaacacauga

SEQ ID NO: 383965 - RNA, 17 nt, Homo sapiens
uagaauugagucuucca

SEQ ID NO: 383966 - RNA, 20 nt, Homo sapiens
uagaauuugggggaaaauuu

SEQ ID NO: 383967 - RNA, 21 nt, Homo sapiens
uagacccugcauuuauagcau

SEQ ID NO: 383968 - RNA, 14 nt, Homo sapiens
uagacuaaggccau

SEQ ID NO: 383969 - RNA, 22 nt, Homo sapiens
uagaguccaacguggggcagca

SEQ ID NO: 383970 - RNA, 16 nt, Homo sapiens
uagagucucuguuacu

SEQ ID NO: 383971 - RNA, 13 nt, Homo sapiens
uagaguguuauca

SEQ ID NO: 383972 - RNA, 23 nt, Homo sapiens
uagauuuuagacccuauugcugc

SEQ ID NO: 383973 - RNA, 18 nt, Homo sapiens
uagcauacgguaugauau

SEQ ID NO: 383974 - RNA, 15 nt, Homo sapiens
uagcaucucaugagu

SEQ ID NO: 383975 - RNA, 15 nt, Homo sapiens
uagccaaguguggua

SEQ ID NO: 383976 - RNA, 23 nt, Homo sapiens
uagcccaucccugccuggucaca

SEQ ID NO: 383977 - RNA, 17 nt, Homo sapiens
uagccucgcucuuggca

SEQ ID NO: 383978 - RNA, 14 nt, Homo sapiens
uagcucacaccuga

SEQ ID NO: 383979 - RNA, 23 nt, Homo sapiens
uagcuuuaaaaccugugugccau

SEQ ID NO: 383980 - RNA, 22 nt, Homo sapiens
uagcuuuagggcaauauugcca

SEQ ID NO: 383981 - RNA, 14 nt, Homo sapiens
uaggaaaauuucac

SEQ ID NO: 383982 - RNA, 23 nt, Homo sapiens
uaggaaagaccauuuuuccucca

SEQ ID NO: 383983 - RNA, 21 nt, Homo sapiens
uaggcauuugcugaauacaga

SEQ ID NO: 383984 - RNA, 22 nt, Homo sapiens
uaggccuggggacggcuuuuac

SEQ ID NO: 383985 - RNA, 14 nt, Homo sapiens
uaggugucucauag

SEQ ID NO: 383986 - RNA, 21 nt, Homo sapiens
uaguaagaaaacaucacugaa

SEQ ID NO: 383987 - RNA, 20 nt, Homo sapiens
uaguaguuaauucugucacu

SEQ ID NO: 383988 - RNA, 23 nt, Homo sapiens
uaguaguuaauucugucacucac

SEQ ID NO: 383989 - RNA, 15 nt, Homo sapiens
uaguaugaaugcagu

SEQ ID NO: 383990 - RNA, 16 nt, Homo sapiens
uagucaugcuaauuau

SEQ ID NO: 383991 - RNA, 17 nt, Homo sapiens
uagucauuucauggguu

SEQ ID NO: 383992 - RNA, 17 nt, Homo sapiens
uagucgaacaauucaua

SEQ ID NO: 383993 - RNA, 21 nt, Homo sapiens
uagugacuugugucccaugau

SEQ ID NO: 383994 - RNA, 14 nt, Homo sapiens
uagugguuacccag

SEQ ID NO: 383995 - RNA, 14 nt, Homo sapiens
uaguucagcugccc

SEQ ID NO: 383996 - RNA, 23 nt, Homo sapiens
uaguugaucuacaaaggccaugg

SEQ ID NO: 383997 - RNA, 19 nt, Homo sapiens
uaguuguaccgcaauguga

SEQ ID NO: 383998 - RNA, 17 nt, Homo sapiens
uaguuuggauuacuuaa

SEQ ID NO: 383999 - RNA, 15 nt, Homo sapiens
uauaacaaacuacau

SEQ ID NO: 384000 - RNA, 21 nt, Homo sapiens
uauaacaaacuacauguaauc

SEQ ID NO: 384001 - RNA, 14 nt, Homo sapiens
uauaacgucaugug

SEQ ID NO: 384002 - RNA, 16 nt, Homo sapiens
uauaacuauguugaua

SEQ ID NO: 384003 - RNA, 13 nt, Homo sapiens
uauaagacuacua

SEQ ID NO: 384004 - RNA, 20 nt, Homo sapiens
uauaagcagaagcacauaug

SEQ ID NO: 384005 - RNA, 14 nt, Homo sapiens
uauaaugguugacu

SEQ ID NO: 384006 - RNA, 21 nt, Homo sapiens
uauacacuauuugugagcaaa

SEQ ID NO: 384007 - RNA, 23 nt, Homo sapiens
uauacacuuacacuuuaugcaca

SEQ ID NO: 384008 - RNA, 14 nt, Homo sapiens
uauacagcucagcu

SEQ ID NO: 384009 - RNA, 12 nt, Homo sapiens
uauacauuugau

SEQ ID NO: 384010 - RNA, 17 nt, Homo sapiens
uauaccugggcauacua

SEQ ID NO: 384011 - RNA, 18 nt, Homo sapiens
uauaccugggcauacuaa

SEQ ID NO: 384012 - RNA, 15 nt, Homo sapiens
uauacuguaggcaca

SEQ ID NO: 384013 - RNA, 21 nt, Homo sapiens
uauagaaggguaccuugaaca

SEQ ID NO: 384014 - RNA, 14 nt, Homo sapiens
uauagacucuagga

SEQ ID NO: 384015 - RNA, 21 nt, Homo sapiens
uauaguuuauugacaauaauu

SEQ ID NO: 384016 - RNA, 13 nt, Homo sapiens
uauauaccaagcu

SEQ ID NO: 384017 - RNA, 17 nt, Homo sapiens
uauauagguugugcaaa

SEQ ID NO: 384018 - RNA, 20 nt, Homo sapiens
uauauauugguaacauccuu

SEQ ID NO: 384019 - RNA, 20 nt, Homo sapiens
uauauauuuuugugcacauu

SEQ ID NO: 384020 - RNA, 20 nt, Homo sapiens
uauaucaauuuccucauauc

SEQ ID NO: 384021 - RNA, 24 nt, Homo sapiens
uauauguuuugugggaacagaugu

SEQ ID NO: 384022 - RNA, 19 nt, Homo sapiens
uauauuccgcacucaagga

SEQ ID NO: 384023 - RNA, 19 nt, Homo sapiens
uauauuugaaguggagcca

SEQ ID NO: 384024 - RNA, 15 nt, Homo sapiens
uauauuuuugugcac

SEQ ID NO: 384025 - RNA, 14 nt, Homo sapiens
uaucaacagcauuu

SEQ ID NO: 384026 - RNA, 13 nt, Homo sapiens
uaucaauagucaa

SEQ ID NO: 384027 - RNA, 17 nt, Homo sapiens
uaucaccgugggcuccc

SEQ ID NO: 384028 - RNA, 15 nt, Homo sapiens
uauccaaaccaaaua

SEQ ID NO: 384029 - RNA, 21 nt, Homo sapiens
uauccaacaugugcucaggga

SEQ ID NO: 384030 - RNA, 13 nt, Homo sapiens
uaucgaucucuua

SEQ ID NO: 384031 - RNA, 23 nt, Homo sapiens
uaucuaaacuggauucacagcuc

SEQ ID NO: 384032 - RNA, 24 nt, Homo sapiens
uaucucagcaucagaaugagaaag

SEQ ID NO: 384033 - RNA, 11 nt, Homo sapiens
uaucugugaaa

SEQ ID NO: 384034 - RNA, 20 nt, Homo sapiens
uaugaagugacucucacaag

SEQ ID NO: 384035 - RNA, 12 nt, Homo sapiens
uaugaaugcagu

SEQ ID NO: 384036 - RNA, 12 nt, Homo sapiens
uaugagggaaaa

SEQ ID NO: 384037 - RNA, 13 nt, Homo sapiens
uaugaggugggau

SEQ ID NO: 384038 - RNA, 15 nt, Homo sapiens
uaugauauugcagcu

SEQ ID NO: 384039 - RNA, 19 nt, Homo sapiens
uaugauugugcacauacuu

SEQ ID NO: 384040 - RNA, 16 nt, Homo sapiens
uaugcacgugugcaca

SEQ ID NO: 384041 - RNA, 12 nt, Homo sapiens
uaugccacucag

SEQ ID NO: 384042 - RNA, 21 nt, Homo sapiens
uaugccauggaggcacuaaca

SEQ ID NO: 384043 - RNA, 14 nt, Homo sapiens
uaugccuucacuuu

SEQ ID NO: 384044 - RNA, 16 nt, Homo sapiens
uauggcacccaugcac

SEQ ID NO: 384045 - RNA, 16 nt, Homo sapiens
uaugggcgugaaccac

SEQ ID NO: 384046 - RNA, 21 nt, Homo sapiens
uaugggcuuuguuaucuucca

SEQ ID NO: 384047 - RNA, 15 nt, Homo sapiens
uaugggggcacugag

SEQ ID NO: 384048 - RNA, 16 nt, Homo sapiens
uauguaaaguauguaa

SEQ ID NO: 384049 - RNA, 13 nt, Homo sapiens
uaugucugcugaa

SEQ ID NO: 384050 - RNA, 15 nt, Homo sapiens
uaugugcgugugugc

SEQ ID NO: 384051 - RNA, 16 nt, Homo sapiens
uaugugcgugugugca

SEQ ID NO: 384052 - RNA, 20 nt, Homo sapiens
uaugugggugggaccacaga

SEQ ID NO: 384053 - RNA, 15 nt, Homo sapiens
uauguucuaagaagu

SEQ ID NO: 384054 - RNA, 17 nt, Homo sapiens
uauguugcccagugugu

SEQ ID NO: 384055 - RNA, 10 nt, Homo sapiens
uccaccagcc

SEQ ID NO: 384056 - RNA, 17 nt, Homo sapiens
uccaccagccugcacua

SEQ ID NO: 384057 - RNA, 11 nt, Homo sapiens
uccaccccagu

SEQ ID NO: 384058 - RNA, 13 nt, Homo sapiens
uccaccugucuca

SEQ ID NO: 384059 - RNA, 15 nt, Homo sapiens
uccaccuucccucau

SEQ ID NO: 384060 - RNA, 22 nt, Homo sapiens
uccaccuuuaaacacggggcuu

SEQ ID NO: 384061 - RNA, 23 nt, Homo sapiens
uccacggagccacuccucugacu

SEQ ID NO: 384062 - RNA, 24 nt, Homo sapiens
uccagacaaaccagaagcaacaga

SEQ ID NO: 384063 - RNA, 17 nt, Homo sapiens
uccagaccauucaggac

SEQ ID NO: 384064 - RNA, 18 nt, Homo sapiens
uccagaccauucaggaca

SEQ ID NO: 384065 - RNA, 15 nt, Homo sapiens
uccagauauuucaca

SEQ ID NO: 384066 - RNA, 17 nt, Homo sapiens
uccagauccuucaaaga

SEQ ID NO: 384067 - RNA, 21 nt, Homo sapiens
uccagccugggcaacacagcg

SEQ ID NO: 384068 - RNA, 23 nt, Homo sapiens
uccagcuggaagggucaacaucu

SEQ ID NO: 384069 - RNA, 20 nt, Homo sapiens
uccaggccgagaugugcaac

SEQ ID NO: 384070 - RNA, 17 nt, Homo sapiens
uccaguauucuugucaa

SEQ ID NO: 384071 - RNA, 19 nt, Homo sapiens
uccagugccagcaaugaca

SEQ ID NO: 384072 - RNA, 18 nt, Homo sapiens
uccaucgcugucaucuca

SEQ ID NO: 384073 - RNA, 15 nt, Homo sapiens
uccaugugugugcaa

SEQ ID NO: 384074 - RNA, 17 nt, Homo sapiens
uccaugugugugcaagu

SEQ ID NO: 384075 - RNA, 14 nt, Homo sapiens
uccauuccagaaua

SEQ ID NO: 384076 - RNA, 18 nt, Homo sapiens
uccauuugugugugugca

SEQ ID NO: 384077 - RNA, 20 nt, Homo sapiens
uccauuugugugugugcaag

SEQ ID NO: 384078 - RNA, 20 nt, Homo sapiens
ucccaaaaucauaagauauu

SEQ ID NO: 384079 - RNA, 13 nt, Homo sapiens
ucccacaggacau

SEQ ID NO: 384080 - RNA, 20 nt, Homo sapiens
ucccacucccggccugucau

SEQ ID NO: 384081 - RNA, 13 nt, Homo sapiens
ucccagcuacuca

SEQ ID NO: 384082 - RNA, 17 nt, Homo sapiens
ucccagcucacgucaca

SEQ ID NO: 384083 - RNA, 19 nt, Homo sapiens
ucccaggcuggagugcagu

SEQ ID NO: 384084 - RNA, 16 nt, Homo sapiens
ucccauggacacucca

SEQ ID NO: 384085 - RNA, 15 nt, Homo sapiens
ucccauguaccagca

SEQ ID NO: 384086 - RNA, 15 nt, Homo sapiens
ucccauucuugcaug

SEQ ID NO: 384087 - RNA, 21 nt, Homo sapiens
uccccagcccaggguggacuu

SEQ ID NO: 384088 - RNA, 18 nt, Homo sapiens
uccccaggggaaaaugaa

SEQ ID NO: 384089 - RNA, 15 nt, Homo sapiens
ucccccgccacuccu

SEQ ID NO: 384090 - RNA, 16 nt, Homo sapiens
ucccccgccacuccug

SEQ ID NO: 384091 - RNA, 18 nt, Homo sapiens
uccccgaaggugcuggag

SEQ ID NO: 384092 - RNA, 20 nt, Homo sapiens
uccccuccguggcaucaccu

SEQ ID NO: 384093 - RNA, 12 nt, Homo sapiens
uccccugcugaa

SEQ ID NO: 384094 - RNA, 21 nt, Homo sapiens
uccccuggggagucugggcac

SEQ ID NO: 384095 - RNA, 15 nt, Homo sapiens
uccccuuccacugag

SEQ ID NO: 384096 - RNA, 12 nt, Homo sapiens
ucccuaccuccu

SEQ ID NO: 384097 - RNA, 19 nt, Homo sapiens
ucccuaucucgaacaugga

SEQ ID NO: 384098 - RNA, 21 nt, Homo sapiens
ucccucaaagcacacgucaug

SEQ ID NO: 384099 - RNA, 23 nt, Homo sapiens
ucccucacaccgcgucuggugac

SEQ ID NO: 384100 - RNA, 19 nt, Homo sapiens
ucccucacagcaaagcaac

SEQ ID NO: 384101 - RNA, 17 nt, Homo sapiens
ucccucaugcuguuuca

SEQ ID NO: 384102 - RNA, 22 nt, Homo sapiens
ucccucuugacguggcacuuac

SEQ ID NO: 384103 - RNA, 16 nt, Homo sapiens
ucccuucccauaagcu

SEQ ID NO: 384104 - RNA, 17 nt, Homo sapiens
uccgcuuucucuugcug

SEQ ID NO: 384105 - RNA, 21 nt, Homo sapiens
uccgcuuucucuugcugccac

SEQ ID NO: 384106 - RNA, 21 nt, Homo sapiens
uccguagaugagaagcugccu

SEQ ID NO: 384107 - RNA, 18 nt, Homo sapiens
uccuaaaaguguaagaaa

SEQ ID NO: 384108 - RNA, 19 nt, Homo sapiens
uccuaaaguagacuucauu

SEQ ID NO: 384109 - RNA, 22 nt, Homo sapiens
uccuaacaggauuagacaguca

SEQ ID NO: 384110 - RNA, 14 nt, Homo sapiens
uccuaagggcucac

SEQ ID NO: 384111 - RNA, 22 nt, Homo sapiens
uccuaauaugcuuuacaaucug

SEQ ID NO: 384112 - RNA, 19 nt, Homo sapiens
uccuaauauuuugauucau

SEQ ID NO: 384113 - RNA, 19 nt, Homo sapiens
uccuaaugaaugcauaaaa

SEQ ID NO: 384114 - RNA, 17 nt, Homo sapiens
uccuacagauagucaaa

SEQ ID NO: 384115 - RNA, 15 nt, Homo sapiens
uccuacauuaauuau

SEQ ID NO: 384116 - RNA, 18 nt, Homo sapiens
uccuaggcauuugcugaa

SEQ ID NO: 384117 - RNA, 18 nt, Homo sapiens
uccuagucuacuugaggc

SEQ ID NO: 384118 - RNA, 12 nt, Homo sapiens
uccuauguguaa

SEQ ID NO: 384119 - RNA, 22 nt, Homo sapiens
uccuauuuauaagagugccgua

SEQ ID NO: 384120 - RNA, 20 nt, Homo sapiens
uccuauuucuuauagucaau

SEQ ID NO: 384121 - RNA, 14 nt, Homo sapiens
uccucaauccagcu

SEQ ID NO: 384122 - RNA, 23 nt, Homo sapiens
uccucacaucuuucacacuucca

SEQ ID NO: 384123 - RNA, 14 nt, Homo sapiens
uccucaccacuucc

SEQ ID NO: 384124 - RNA, 16 nt, Homo sapiens
uccucuccacugccuu

SEQ ID NO: 384125 - RNA, 18 nt, Homo sapiens
uccucuccacugccuucg

SEQ ID NO: 384126 - RNA, 23 nt, Homo sapiens
uccucugccucccauucugacca

SEQ ID NO: 384127 - RNA, 19 nt, Homo sapiens
uccugacagaaggacucag

SEQ ID NO: 384128 - RNA, 21 nt, Homo sapiens
uccuguugagaugggggacug

SEQ ID NO: 384129 - RNA, 23 nt, Homo sapiens
uccuguuggacacccagugccag

SEQ ID NO: 384130 - RNA, 17 nt, Homo sapiens
uccuuaauaacaacaga

SEQ ID NO: 384131 - RNA, 13 nt, Homo sapiens
uccuuaaugcaga

SEQ ID NO: 384132 - RNA, 13 nt, Homo sapiens
uccuucagccuga

SEQ ID NO: 384133 - RNA, 18 nt, Homo sapiens
uccuucaugaucaucaca

SEQ ID NO: 384134 - RNA, 18 nt, Homo sapiens
uccuuccugucuuccugc

SEQ ID NO: 384135 - RNA, 14 nt, Homo sapiens
uccuuccuucccug

SEQ ID NO: 384136 - RNA, 12 nt, Homo sapiens
uccuugcacacu

SEQ ID NO: 384137 - RNA, 21 nt, Homo sapiens
uccuuggaagagaaugucuga

SEQ ID NO: 384138 - RNA, 15 nt, Homo sapiens
uccuuggauguaguc

SEQ ID NO: 384139 - RNA, 22 nt, Homo sapiens
uccuugggaggccccacugggg

SEQ ID NO: 384140 - RNA, 15 nt, Homo sapiens
uccuuuacuaaucca

SEQ ID NO: 384141 - RNA, 22 nt, Homo sapiens
uccuuuacuaauccaacccaug

SEQ ID NO: 384142 - RNA, 17 nt, Homo sapiens
ucgaacauggaacucau

SEQ ID NO: 384143 - RNA, 15 nt, Homo sapiens
ucgaacuuuuuccaa

SEQ ID NO: 384144 - RNA, 16 nt, Homo sapiens
ucgagaccaaccugac

SEQ ID NO: 384145 - RNA, 17 nt, Homo sapiens
ucgagguagguggauca

SEQ ID NO: 384146 - RNA, 23 nt, Homo sapiens
ucgccuccucuacaauuugccau

SEQ ID NO: 384147 - RNA, 17 nt, Homo sapiens
ucgcgccacuaagccaa

SEQ ID NO: 384148 - RNA, 11 nt, Homo sapiens
ucgggacauca

SEQ ID NO: 384149 - RNA, 15 nt, Homo sapiens
ucgggacuaacccag

SEQ ID NO: 384150 - RNA, 22 nt, Homo sapiens
ucggggaacuccuggaaauauc

SEQ ID NO: 384151 - RNA, 14 nt, Homo sapiens
ucuaaaggcuugau

SEQ ID NO: 384152 - RNA, 17 nt, Homo sapiens
ucuaaaugaagugcaaa

SEQ ID NO: 384153 - RNA, 19 nt, Homo sapiens
ucuaaaugaagugcaaauu

SEQ ID NO: 384154 - RNA, 23 nt, Homo sapiens
ucuaaauuugaauguuaagcaga

SEQ ID NO: 384155 - RNA, 22 nt, Homo sapiens
ucuaaauuuugucuuuaacuca

SEQ ID NO: 384156 - RNA, 17 nt, Homo sapiens
ucuaacuccagugaagu

SEQ ID NO: 384157 - RNA, 19 nt, Homo sapiens
ucuaaguaaaaccacagca

SEQ ID NO: 384158 - RNA, 13 nt, Homo sapiens
ucuaagugauaua

SEQ ID NO: 384159 - RNA, 20 nt, Homo sapiens
ucuaauaaaaaacaccuucu

SEQ ID NO: 384160 - RNA, 22 nt, Homo sapiens
ucuaaucuuuuaauguauuugu

SEQ ID NO: 384161 - RNA, 14 nt, Homo sapiens
ucuaauuucugaaa

SEQ ID NO: 384162 - RNA, 19 nt, Homo sapiens
ucuacagagcuucccugac

SEQ ID NO: 384163 - RNA, 17 nt, Homo sapiens
ucuacauaaguaauuca

SEQ ID NO: 384164 - RNA, 15 nt, Homo sapiens
ucuacauacuaugga

SEQ ID NO: 384165 - RNA, 16 nt, Homo sapiens
ucuacauacuauggaa

SEQ ID NO: 384166 - RNA, 15 nt, Homo sapiens
ucuaggaacauacuu

SEQ ID NO: 384167 - RNA, 19 nt, Homo sapiens
ucuagucaggggaaaagac

SEQ ID NO: 384168 - RNA, 13 nt, Homo sapiens
ucuagugaaugaa

SEQ ID NO: 384169 - RNA, 21 nt, Homo sapiens
ucuagugaaugaaucucaaga

SEQ ID NO: 384170 - RNA, 16 nt, Homo sapiens
ucuaguucagcugccc

SEQ ID NO: 384171 - RNA, 13 nt, Homo sapiens
ucuauagcagauu

SEQ ID NO: 384172 - RNA, 20 nt, Homo sapiens
ucuauggcacccaugcaccu

SEQ ID NO: 384173 - RNA, 18 nt, Homo sapiens
ucuaugguugacauugua

SEQ ID NO: 384174 - RNA, 18 nt, Homo sapiens
ucuauuaaaucuugcaac

SEQ ID NO: 384175 - RNA, 13 nt, Homo sapiens
ucuauuaucucaa

SEQ ID NO: 384176 - RNA, 21 nt, Homo sapiens
ucuauugagugaacagaauug

SEQ ID NO: 384177 - RNA, 22 nt, Homo sapiens
ucuauugcuggcaaagacagaa

SEQ ID NO: 384178 - RNA, 19 nt, Homo sapiens
ucuauuucuccuccauggg

SEQ ID NO: 384179 - RNA, 22 nt, Homo sapiens
ucucaaaaccgaguugccagcu

SEQ ID NO: 384180 - RNA, 14 nt, Homo sapiens
ucucacuugucuca

SEQ ID NO: 384181 - RNA, 13 nt, Homo sapiens
ucucagcacuugg

SEQ ID NO: 384182 - RNA, 21 nt, Homo sapiens
ucucagccuaccaugagaaua

SEQ ID NO: 384183 - RNA, 20 nt, Homo sapiens
ucucaggaccaaagcuuuca

SEQ ID NO: 384184 - RNA, 23 nt, Homo sapiens
ucucaguccaccugagcugccau

SEQ ID NO: 384185 - RNA, 16 nt, Homo sapiens
ucucagugcuuuccaa

SEQ ID NO: 384186 - RNA, 17 nt, Homo sapiens
ucucauagguugccaau

SEQ ID NO: 384187 - RNA, 21 nt, Homo sapiens
ucucaugagugccaagcaaaa

SEQ ID NO: 384188 - RNA, 19 nt, Homo sapiens
ucuccacuucuuguucccc

SEQ ID NO: 384189 - RNA, 16 nt, Homo sapiens
ucuccagaaagcucau

SEQ ID NO: 384190 - RNA, 13 nt, Homo sapiens
ucuccaggucuca

SEQ ID NO: 384191 - RNA, 17 nt, Homo sapiens
ucuccaguggaagggaa

SEQ ID NO: 384192 - RNA, 22 nt, Homo sapiens
ucuccauguuugauguaucuga

SEQ ID NO: 384193 - RNA, 23 nt, Homo sapiens
ucucccuguuggucgguggguug

SEQ ID NO: 384194 - RNA, 16 nt, Homo sapiens
ucuccuguccaaccua

SEQ ID NO: 384195 - RNA, 18 nt, Homo sapiens
ucuccuuugcaggcucau

SEQ ID NO: 384196 - RNA, 13 nt, Homo sapiens
aggaccagagcua

SEQ ID NO: 384197 - RNA, 16 nt, Homo sapiens
aggacccugggaccac

SEQ ID NO: 384198 - RNA, 17 nt, Homo sapiens
aggacguugaggacuuu

SEQ ID NO: 384199 - RNA, 17 nt, Homo sapiens
aggacuguugacaucca

SEQ ID NO: 384200 - RNA, 19 nt, Homo sapiens
aggagaaacuggaacucuc

SEQ ID NO: 384201 - RNA, 20 nt, Homo sapiens
aggagagaaagugggugaga

SEQ ID NO: 384202 - RNA, 20 nt, Homo sapiens
aggagcccuuaucugugcuc

SEQ ID NO: 384203 - RNA, 13 nt, Homo sapiens
aggaguuccuuga

SEQ ID NO: 384204 - RNA, 18 nt, Homo sapiens
aggaguuugagaccaacc

SEQ ID NO: 384205 - RNA, 18 nt, Homo sapiens
aggauccccucucuuccu

SEQ ID NO: 384206 - RNA, 17 nt, Homo sapiens
ucucuguuuuguaagcu

SEQ ID NO: 384207 - RNA, 16 nt, Homo sapiens
ucucuucuaagcaaaa

SEQ ID NO: 384208 - RNA, 18 nt, Homo sapiens
ucucuugcacucaaagcu

SEQ ID NO: 384209 - RNA, 13 nt, Homo sapiens
ucugaacauuucu

SEQ ID NO: 384210 - RNA, 12 nt, Homo sapiens
ucugacacugaa

SEQ ID NO: 384211 - RNA, 23 nt, Homo sapiens
ucugacuuaagcugccucaagga

SEQ ID NO: 384212 - RNA, 19 nt, Homo sapiens
ucugagaaagacuauucaa

SEQ ID NO: 384213 - RNA, 23 nt, Homo sapiens
ucugagcagugaaugauucagug

SEQ ID NO: 384214 - RNA, 20 nt, Homo sapiens
ucugaguaagaaacagaauc

SEQ ID NO: 384215 - RNA, 13 nt, Homo sapiens
ucugauaccucaa

SEQ ID NO: 384216 - RNA, 16 nt, Homo sapiens
ucugauauaacaaacu

SEQ ID NO: 384217 - RNA, 21 nt, Homo sapiens
ucugaugcaagcaagaaacac

SEQ ID NO: 384218 - RNA, 16 nt, Homo sapiens
ucugauuacacaaaac

SEQ ID NO: 384219 - RNA, 19 nt, Homo sapiens
ucugcaaaggcaccugaau

SEQ ID NO: 384220 - RNA, 20 nt, Homo sapiens
ucugcaaugggcacugggau

SEQ ID NO: 384221 - RNA, 23 nt, Homo sapiens
ucugcaccccccugggcugagag

SEQ ID NO: 384222 - RNA, 21 nt, Homo sapiens
ucugcauuaucugaggucaca

SEQ ID NO: 384223 - RNA, 18 nt, Homo sapiens
ucugcccugcccuagcuc

SEQ ID NO: 384224 - RNA, 20 nt, Homo sapiens
ucugccugaaccuuccaucu

SEQ ID NO: 384225 - RNA, 20 nt, Homo sapiens
ucugcgugucaccugugcuu

SEQ ID NO: 384226 - RNA, 14 nt, Homo sapiens
ucugcucaucauuc

SEQ ID NO: 384227 - RNA, 21 nt, Homo sapiens
ucugcuggcagaaagcaaaug

SEQ ID NO: 384228 - RNA, 12 nt, Homo sapiens
ucugcugucuaa

SEQ ID NO: 384229 - RNA, 19 nt, Homo sapiens
ucugcuuacaauucccugc

SEQ ID NO: 384230 - RNA, 14 nt, Homo sapiens
ucuggaaaagcagc

SEQ ID NO: 384231 - RNA, 18 nt, Homo sapiens
ucugggucaucucucaca

SEQ ID NO: 384232 - RNA, 20 nt, Homo sapiens
ucugucccucacagcacuag

SEQ ID NO: 384233 - RNA, 21 nt, Homo sapiens
ucuguguagcaagcuauucaa

SEQ ID NO: 384234 - RNA, 15 nt, Homo sapiens
ucuguuaaucaugua

SEQ ID NO: 384235 - RNA, 17 nt, Homo sapiens
ucuguuccccauggcca

SEQ ID NO: 384236 - RNA, 13 nt, Homo sapiens
ucuuaaccccagu

SEQ ID NO: 384237 - RNA, 13 nt, Homo sapiens
ucuuaacuugaag

SEQ ID NO: 384238 - RNA, 22 nt, Homo sapiens
ucuuaauuauuguacauuuaua

SEQ ID NO: 384239 - RNA, 15 nt, Homo sapiens
ucuuacauuagcagu

SEQ ID NO: 384240 - RNA, 21 nt, Homo sapiens
ucuuauccaacaucaacaucu

SEQ ID NO: 384241 - RNA, 14 nt, Homo sapiens
ucuuauuuccucaa

SEQ ID NO: 384242 - RNA, 22 nt, Homo sapiens
ucuucaaccucauugacaagaa

SEQ ID NO: 384243 - RNA, 13 nt, Homo sapiens
ucuucacaacaga

SEQ ID NO: 384244 - RNA, 18 nt, Homo sapiens
ucuucacaacagauuauu

SEQ ID NO: 384245 - RNA, 21 nt, Homo sapiens
ucuucauuaagcccucuucca

SEQ ID NO: 384246 - RNA, 15 nt, Homo sapiens
ucuuccaggggacuc

SEQ ID NO: 384247 - RNA, 23 nt, Homo sapiens
ucuuccaucccaggacaccacac

SEQ ID NO: 384248 - RNA, 23 nt, Homo sapiens
ucuucccuguaugauuccuugau

SEQ ID NO: 384249 - RNA, 14 nt, Homo sapiens
ucuucuccacugga

SEQ ID NO: 384250 - RNA, 16 nt, Homo sapiens
ucuugagcaguggcug

SEQ ID NO: 384251 - RNA, 13 nt, Homo sapiens
ucuugcaccccaa

SEQ ID NO: 384252 - RNA, 19 nt, Homo sapiens
ucuugggaagaccagcuuu

SEQ ID NO: 384253 - RNA, 17 nt, Homo sapiens
ucuugucauugccagcu

SEQ ID NO: 384254 - RNA, 19 nt, Homo sapiens
ucuugugagggacugagau

SEQ ID NO: 384255 - RNA, 13 nt, Homo sapiens
ucuugugcuggau

SEQ ID NO: 384256 - RNA, 17 nt, Homo sapiens
ucuuguuccccacugac

SEQ ID NO: 384257 - RNA, 22 nt, Homo sapiens
ucuuguuucaauuccaccugca

SEQ ID NO: 384258 - RNA, 20 nt, Homo sapiens
ucuuuaaaaguauccagaga

SEQ ID NO: 384259 - RNA, 19 nt, Homo sapiens
ucuuuaacuuaauugcuau

SEQ ID NO: 384260 - RNA, 23 nt, Homo sapiens
ucuuucacacuuccaccagccug

SEQ ID NO: 384261 - RNA, 14 nt, Homo sapiens
ucuuucccaauuca

SEQ ID NO: 384262 - RNA, 23 nt, Homo sapiens
ucuuuccuggacuuaacucuaau

SEQ ID NO: 384263 - RNA, 20 nt, Homo sapiens
ucuuucuaacuccagugaag

SEQ ID NO: 384264 - RNA, 18 nt, Homo sapiens
ucuuucuaaugugugaau

SEQ ID NO: 384265 - RNA, 15 nt, Homo sapiens
ucuuuucaaccuacu

SEQ ID NO: 384266 - RNA, 21 nt, Homo sapiens
ucuuuucuggaauguaaucaa

SEQ ID NO: 384267 - RNA, 20 nt, Homo sapiens
ucuuuuuaauaaaaaggcac

SEQ ID NO: 384268 - RNA, 14 nt, Homo sapiens
ugaaaaaucuaagu

SEQ ID NO: 384269 - RNA, 12 nt, Homo sapiens
ugaaaaaugccu

SEQ ID NO: 384270 - RNA, 22 nt, Homo sapiens
ugaaaaauucucagucaguaau

SEQ ID NO: 384271 - RNA, 24 nt, Homo sapiens
ugaaaacaauucuuauugacucau

SEQ ID NO: 384272 - RNA, 22 nt, Homo sapiens
ugaaaacucacagaacuaugua

SEQ ID NO: 384273 - RNA, 21 nt, Homo sapiens
ugaaaaucuacacuccaguga

SEQ ID NO: 384274 - RNA, 21 nt, Homo sapiens
ugaaacacucaguuguucaau

SEQ ID NO: 384275 - RNA, 22 nt, Homo sapiens
ugaaacccccacccuucugccu

SEQ ID NO: 384276 - RNA, 23 nt, Homo sapiens
ugaaacugagaugugaacacauc

SEQ ID NO: 384277 - RNA, 23 nt, Homo sapiens
ugaaauaagccagacaucaacag

SEQ ID NO: 384278 - RNA, 13 nt, Homo sapiens
ugaaaucuaugaa

SEQ ID NO: 384279 - RNA, 18 nt, Homo sapiens
ugaaaugcuggcauuugc

SEQ ID NO: 384280 - RNA, 14 nt, Homo sapiens
ugaacacaucagcu

SEQ ID NO: 384281 - RNA, 23 nt, Homo sapiens
ugaacacucuacuacaugugacu

SEQ ID NO: 384282 - RNA, 13 nt, Homo sapiens
ugaacacuggggg

SEQ ID NO: 384283 - RNA, 11 nt, Homo sapiens
ugaacagaauu

SEQ ID NO: 384284 - RNA, 16 nt, Homo sapiens
ugaaccuuccaucucg

SEQ ID NO: 384285 - RNA, 19 nt, Homo sapiens
ugaaccuuccaucucgcca

SEQ ID NO: 384286 - RNA, 17 nt, Homo sapiens
ugaacugaaguuucaca

SEQ ID NO: 384287 - RNA, 16 nt, Homo sapiens
ugaacuuucacauagc

SEQ ID NO: 384288 - RNA, 19 nt, Homo sapiens
ugaagaagagaaugugaca

SEQ ID NO: 384289 - RNA, 16 nt, Homo sapiens
ugaagaagauauguga

SEQ ID NO: 384290 - RNA, 17 nt, Homo sapiens
ugaagaagauaugugaa

SEQ ID NO: 384291 - RNA, 21 nt, Homo sapiens
ugaagaugccagugaaacuuc

SEQ ID NO: 384292 - RNA, 15 nt, Homo sapiens
ugaaguauuucucac

SEQ ID NO: 384293 - RNA, 21 nt, Homo sapiens
ugaagugaaugaaacacucag

SEQ ID NO: 384294 - RNA, 22 nt, Homo sapiens
ugaagugcaaauuugauacaua

SEQ ID NO: 384295 - RNA, 15 nt, Homo sapiens
ugaaguuucacauga

SEQ ID NO: 384296 - RNA, 24 nt, Homo sapiens
ugaaguuucagagcuacacaaaca

SEQ ID NO: 384297 - RNA, 23 nt, Homo sapiens
ugaauaugauuaguaaagaaaug

SEQ ID NO: 384298 - RNA, 11 nt, Homo sapiens
ugaaucuacaa

SEQ ID NO: 384299 - RNA, 15 nt, Homo sapiens
ugaaucucuaaucaa

SEQ ID NO: 384300 - RNA, 12 nt, Homo sapiens
ugaaugaugcuu

SEQ ID NO: 384301 - RNA, 14 nt, Homo sapiens
ugaaugcaaaguag

SEQ ID NO: 384302 - RNA, 21 nt, Homo sapiens
ugaauggacucaaacugccuu

SEQ ID NO: 384303 - RNA, 18 nt, Homo sapiens
ugaauguugugauguauu

SEQ ID NO: 384304 - RNA, 17 nt, Homo sapiens
ugaauuggaccauccua

SEQ ID NO: 384305 - RNA, 11 nt, Homo sapiens
ugacaaaaagc

SEQ ID NO: 384306 - RNA, 15 nt, Homo sapiens
ugacaccugcugaga

SEQ ID NO: 384307 - RNA, 13 nt, Homo sapiens
ugacauaauuuca

SEQ ID NO: 384308 - RNA, 18 nt, Homo sapiens
ugacaucaccacaguuua

SEQ ID NO: 384309 - RNA, 18 nt, Homo sapiens
ugacauccccacccuugg

SEQ ID NO: 384310 - RNA, 19 nt, Homo sapiens
ugacaucucuuugauguca

SEQ ID NO: 384311 - RNA, 15 nt, Homo sapiens
ugacauguggggcca

SEQ ID NO: 384312 - RNA, 14 nt, Homo sapiens
ugacauuauaugca

SEQ ID NO: 384313 - RNA, 17 nt, Homo sapiens
ugacauuauaugcacua

SEQ ID NO: 384314 - RNA, 22 nt, Homo sapiens
ugacauuugggagacaugugac

SEQ ID NO: 384315 - RNA, 18 nt, Homo sapiens
ugaccacauccaccuuua

SEQ ID NO: 384316 - RNA, 21 nt, Homo sapiens
ugaccagcagaucccagcuca

SEQ ID NO: 384317 - RNA, 22 nt, Homo sapiens
ugacccagucagaguugugcac

SEQ ID NO: 384318 - RNA, 22 nt, Homo sapiens
ugacgacaagugcugaacagug

SEQ ID NO: 384319 - RNA, 18 nt, Homo sapiens
ugacguggcacuuaccca

SEQ ID NO: 384320 - RNA, 17 nt, Homo sapiens
ugacuauggcuaccaaa

SEQ ID NO: 384321 - RNA, 19 nt, Homo sapiens
ugacuauggcuaccaaaaa

SEQ ID NO: 384322 - RNA, 14 nt, Homo sapiens
ugacucuccagaaa

SEQ ID NO: 384323 - RNA, 15 nt, Homo sapiens
ugacuuaaguggcau

SEQ ID NO: 384324 - RNA, 16 nt, Homo sapiens
ugacuugugucccaug

SEQ ID NO: 384325 - RNA, 18 nt, Homo sapiens
ugagaacuacucagggaa

SEQ ID NO: 384326 - RNA, 18 nt, Homo sapiens
ugagacagcucugcauac

SEQ ID NO: 384327 - RNA, 17 nt, Homo sapiens
ugagacggagucuugcu

SEQ ID NO: 384328 - RNA, 14 nt, Homo sapiens
ugagagacccaagg

SEQ ID NO: 384329 - RNA, 21 nt, Homo sapiens
ugagcacucccaagucuacag

SEQ ID NO: 384330 - RNA, 21 nt, Homo sapiens
ugagcauuguggcugucagca

SEQ ID NO: 384331 - RNA, 22 nt, Homo sapiens
ugagccccugggacugcugcuu

SEQ ID NO: 384332 - RNA, 21 nt, Homo sapiens
ugaggaaaggccagcuggcag

SEQ ID NO: 384333 - RNA, 16 nt, Homo sapiens
ugaggaagugaacauu

SEQ ID NO: 384334 - RNA, 15 nt, Homo sapiens
ugaggacauguggaa

SEQ ID NO: 384335 - RNA, 23 nt, Homo sapiens
ugaggaucggagggcgcuauguc

SEQ ID NO: 384336 - RNA, 18 nt, Homo sapiens
ugaggaugcagagucagc

SEQ ID NO: 384337 - RNA, 21 nt, Homo sapiens
uggauuccaaccccaacucca

SEQ ID NO: 384338 - RNA, 15 nt, Homo sapiens
uggauugcacguggc

SEQ ID NO: 384339 - RNA, 11 nt, Homo sapiens
uggcaaagaca

SEQ ID NO: 384340 - RNA, 18 nt, Homo sapiens
uggcaacaacaaagccaa

SEQ ID NO: 384341 - RNA, 15 nt, Homo sapiens
uggcaaggugacauu

SEQ ID NO: 384342 - RNA, 19 nt, Homo sapiens
uggcacaguuuucugagaa

SEQ ID NO: 384343 - RNA, 12 nt, Homo sapiens
uggcaccagcag

SEQ ID NO: 384344 - RNA, 15 nt, Homo sapiens
uggcacccaugcacc

SEQ ID NO: 384345 - RNA, 16 nt, Homo sapiens
uggcacccaugcaccu

SEQ ID NO: 384346 - RNA, 12 nt, Homo sapiens
uggcacugcugu

SEQ ID NO: 384347 - RNA, 20 nt, Homo sapiens
uggcccagcuccccaagaaa

SEQ ID NO: 384348 - RNA, 17 nt, Homo sapiens
uggcccagggaagccaa

SEQ ID NO: 384349 - RNA, 19 nt, Homo sapiens
uggcccagggaagccaaaa

SEQ ID NO: 384350 - RNA, 14 nt, Homo sapiens
uggccugcacuggu

SEQ ID NO: 384351 - RNA, 23 nt, Homo sapiens
uggccuuccccagccucuucuag

SEQ ID NO: 384352 - RNA, 18 nt, Homo sapiens
uggccuugaaaccaccuu

SEQ ID NO: 384353 - RNA, 20 nt, Homo sapiens
uggcguggagaaguggugcu

SEQ ID NO: 384354 - RNA, 19 nt, Homo sapiens
uggcuagugguggguacuc

SEQ ID NO: 384355 - RNA, 13 nt, Homo sapiens
uggcuaugcaaca

SEQ ID NO: 384356 - RNA, 13 nt, Homo sapiens
uggcucucauggg

SEQ ID NO: 384357 - RNA, 20 nt, Homo sapiens
uggcuguagaaggagacaga

SEQ ID NO: 384358 - RNA, 21 nt, Homo sapiens
uggcuuaauguuuauuccuga

SEQ ID NO: 384359 - RNA, 23 nt, Homo sapiens
uggcuuacuacaugugggagcuu

SEQ ID NO: 384360 - RNA, 15 nt, Homo sapiens
uggcuucuuacugaa

SEQ ID NO: 384361 - RNA, 19 nt, Homo sapiens
ugggaacaugcgugugacc

SEQ ID NO: 384362 - RNA, 13 nt, Homo sapiens
ugggaacuccuaa

SEQ ID NO: 384363 - RNA, 20 nt, Homo sapiens
ugggaacugugccuuugagu

SEQ ID NO: 384364 - RNA, 16 nt, Homo sapiens
ugggacaaaggacauu

SEQ ID NO: 384365 - RNA, 16 nt, Homo sapiens
ugggaccacagacuca

SEQ ID NO: 384366 - RNA, 13 nt, Homo sapiens
ugggaccacagag

SEQ ID NO: 384367 - RNA, 14 nt, Homo sapiens
ugggagugagggau

SEQ ID NO: 384368 - RNA, 18 nt, Homo sapiens
ugggaucugugcccagag

SEQ ID NO: 384369 - RNA, 18 nt, Homo sapiens
ugggaugaugccucauga

SEQ ID NO: 384370 - RNA, 16 nt, Homo sapiens
ugggauguccacagau

SEQ ID NO: 384371 - RNA, 15 nt, Homo sapiens
ugggauguucagcac

SEQ ID NO: 384372 - RNA, 21 nt, Homo sapiens
ugggcaccuuccuaauaugcu

SEQ ID NO: 384373 - RNA, 13 nt, Homo sapiens
ugggcacugggau

SEQ ID NO: 384374 - RNA, 13 nt, Homo sapiens
ugggcagcuguua

SEQ ID NO: 384375 - RNA, 16 nt, Homo sapiens
ugggcaggaagugaag

SEQ ID NO: 384376 - RNA, 18 nt, Homo sapiens
ugggccaagucaaagaca

SEQ ID NO: 384377 - RNA, 19 nt, Homo sapiens
ugggccaagucaaagacau

SEQ ID NO: 384378 - RNA, 16 nt, Homo sapiens
ugggccccaccaccua

SEQ ID NO: 384379 - RNA, 15 nt, Homo sapiens
ugggcgacagagcca

SEQ ID NO: 384380 - RNA, 20 nt, Homo sapiens
ugggcuccuggggcaauggg

SEQ ID NO: 384381 - RNA, 11 nt, Homo sapiens
ugggcuucuag

SEQ ID NO: 384382 - RNA, 13 nt, Homo sapiens
ugggcuucuagaa

SEQ ID NO: 384383 - RNA, 22 nt, Homo sapiens
uggggacagagcagaacuuuca

SEQ ID NO: 384384 - RNA, 22 nt, Homo sapiens
uggggagaaaagacaugaauau

SEQ ID NO: 384385 - RNA, 16 nt, Homo sapiens
uggggauaugauuuaa

SEQ ID NO: 384386 - RNA, 15 nt, Homo sapiens
ugggggaucuguugu

SEQ ID NO: 384387 - RNA, 16 nt, Homo sapiens
uggggugggcacauug

SEQ ID NO: 384388 - RNA, 16 nt, Homo sapiens
ugggguuucaccaucu

SEQ ID NO: 384389 - RNA, 17 nt, Homo sapiens
ugggguuucaccaucuu

SEQ ID NO: 384390 - RNA, 20 nt, Homo sapiens
ugggugacagagcaagugag

SEQ ID NO: 384391 - RNA, 20 nt, Homo sapiens
uggguggggcugcuccucca

SEQ ID NO: 384392 - RNA, 23 nt, Homo sapiens
uggguucacagaagcacagcacc

SEQ ID NO: 384393 - RNA, 20 nt, Homo sapiens
uggguuuugggucuuugaac

SEQ ID NO: 384394 - RNA, 14 nt, Homo sapiens
ugguaaaauacuuc

SEQ ID NO: 384395 - RNA, 20 nt, Homo sapiens
ugguaacuguuaaauugcug

SEQ ID NO: 384396 - RNA, 19 nt, Homo sapiens
ugguaauaaguacugugua

SEQ ID NO: 384397 - RNA, 17 nt, Homo sapiens
ugguaggauaucuuggc

SEQ ID NO: 384398 - RNA, 19 nt, Homo sapiens
uggucaauccgaaguauga

SEQ ID NO: 384399 - RNA, 14 nt, Homo sapiens
uggucagauuugaa

SEQ ID NO: 384400 - RNA, 20 nt, Homo sapiens
ugguccuuagccccaucugc

SEQ ID NO: 384401 - RNA, 16 nt, Homo sapiens
uggucuccaguggaag

SEQ ID NO: 384402 - RNA, 21 nt, Homo sapiens
uggugagaacuacucagggaa

SEQ ID NO: 384403 - RNA, 17 nt, Homo sapiens
ugguuaagacuacugaa

SEQ ID NO: 384404 - RNA, 14 nt, Homo sapiens
ugguuacaguuuga

SEQ ID NO: 384405 - RNA, 17 nt, Homo sapiens
ugguugaguucagguag

SEQ ID NO: 384406 - RNA, 13 nt, Homo sapiens
ugguuuaugucau

SEQ ID NO: 384407 - RNA, 16 nt, Homo sapiens
ugguuuaugucaucau

SEQ ID NO: 384408 - RNA, 22 nt, Homo sapiens
uguaaaaugugaagugaaugaa

SEQ ID NO: 384409 - RNA, 19 nt, Homo sapiens
uguaaacauaauucuugua

SEQ ID NO: 384410 - RNA, 15 nt, Homo sapiens
uguaaacugugcacc

SEQ ID NO: 384411 - RNA, 20 nt, Homo sapiens
uguaaauacuguuuuuaaca

SEQ ID NO: 384412 - RNA, 14 nt, Homo sapiens
uguaacccgcucau

SEQ ID NO: 384413 - RNA, 14 nt, Homo sapiens
uguaagaaacacac

SEQ ID NO: 384414 - RNA, 17 nt, Homo sapiens
uguaaugucaccaccuu

SEQ ID NO: 384415 - RNA, 19 nt, Homo sapiens
uguacccuuccuacagaua

SEQ ID NO: 384416 - RNA, 14 nt, Homo sapiens
uguaccugugcacg

SEQ ID NO: 384417 - RNA, 15 nt, Homo sapiens
uguaccugugcacgu

SEQ ID NO: 384418 - RNA, 15 nt, Homo sapiens
uguacuugccuuauu

SEQ ID NO: 384419 - RNA, 19 nt, Homo sapiens
uguaggcagucauggcacc

SEQ ID NO: 384420 - RNA, 16 nt, Homo sapiens
uguaggguaaggugcc

SEQ ID NO: 384421 - RNA, 13 nt, Homo sapiens
uguagucucagga

SEQ ID NO: 384422 - RNA, 16 nt, Homo sapiens
uguauacuguaggcac

SEQ ID NO: 384423 - RNA, 15 nt, Homo sapiens
uguaucaaaugugac

SEQ ID NO: 384424 - RNA, 18 nt, Homo sapiens
uguaucaaaugugacauu

SEQ ID NO: 384425 - RNA, 22 nt, Homo sapiens
uguaugugcgugugugcaagug

SEQ ID NO: 384426 - RNA, 22 nt, Homo sapiens
uguauguuuacauaucaccuca

SEQ ID NO: 384427 - RNA, 16 nt, Homo sapiens
uguauucuucaaccuc

SEQ ID NO: 384428 - RNA, 15 nt, Homo sapiens
uguauuuaacugccu

SEQ ID NO: 384429 - RNA, 22 nt, Homo sapiens
uguauuuauccaauaaauguga

SEQ ID NO: 384430 - RNA, 15 nt, Homo sapiens
ugucacagggccaac

SEQ ID NO: 384431 - RNA, 13 nt, Homo sapiens
ugucagcaaaaag

SEQ ID NO: 384432 - RNA, 14 nt, Homo sapiens
ugucagucagggac

SEQ ID NO: 384433 - RNA, 17 nt, Homo sapiens
ugucaucagccugugua

SEQ ID NO: 384434 - RNA, 11 nt, Homo sapiens
ugucaucucag

SEQ ID NO: 384435 - RNA, 21 nt, Homo sapiens
ugucaucucagcuggaucucc

SEQ ID NO: 384436 - RNA, 15 nt, Homo sapiens
ugucauuucaaagac

SEQ ID NO: 384437 - RNA, 16 nt, Homo sapiens
uguccacagaugccuc

SEQ ID NO: 384438 - RNA, 17 nt, Homo sapiens
uguccaggcacugagau

SEQ ID NO: 384439 - RNA, 21 nt, Homo sapiens
ugucccaaguugcuaagugaa

SEQ ID NO: 384440 - RNA, 15 nt, Homo sapiens
uguccccuccacugu

SEQ ID NO: 384441 - RNA, 19 nt, Homo sapiens
uguccccuccacugucaca

SEQ ID NO: 384442 - RNA, 16 nt, Homo sapiens
ugucugacaaccucuu

SEQ ID NO: 384443 - RNA, 13 nt, Homo sapiens
ugucugugugcaa

SEQ ID NO: 384444 - RNA, 18 nt, Homo sapiens
ugucuucauagcagauuu

SEQ ID NO: 384445 - RNA, 13 nt, Homo sapiens
ugucuucucaggc

SEQ ID NO: 384446 - RNA, 18 nt, Homo sapiens
ugucuuuaacucauaaaa

SEQ ID NO: 384447 - RNA, 21 nt, Homo sapiens
ugugaaaggaagcuccacugu

SEQ ID NO: 384448 - RNA, 20 nt, Homo sapiens
ugugaaaguuacaaauugcu

SEQ ID NO: 384449 - RNA, 21 nt, Homo sapiens
ugugaagugaaugaaacacuc

SEQ ID NO: 384450 - RNA, 21 nt, Homo sapiens
ugugacuuaaugccacuaaau

SEQ ID NO: 384451 - RNA, 16 nt, Homo sapiens
ugugagccaccacguc

SEQ ID NO: 384452 - RNA, 18 nt, Homo sapiens
ugugagugugugcaagua

SEQ ID NO: 384453 - RNA, 13 nt, Homo sapiens
ugugauaaaaccc

SEQ ID NO: 384454 - RNA, 22 nt, Homo sapiens
ugugauauguaccuaacgaagu

SEQ ID NO: 384455 - RNA, 20 nt, Homo sapiens
ugugaucuaucaauagucaa

SEQ ID NO: 384456 - RNA, 11 nt, Homo sapiens
ugugcacauuu

SEQ ID NO: 384457 - RNA, 23 nt, Homo sapiens
ugugcacuugcacgcccaugugu

SEQ ID NO: 384458 - RNA, 18 nt, Homo sapiens
ugugcaugugugugcuca

SEQ ID NO: 384459 - RNA, 18 nt, Homo sapiens
ugugcucagagaccccuc

SEQ ID NO: 384460 - RNA, 19 nt, Homo sapiens
uguggcccagggaagccaa

SEQ ID NO: 384461 - RNA, 16 nt, Homo sapiens
ugugggcaggaaguga

SEQ ID NO: 384462 - RNA, 18 nt, Homo sapiens
ugugggugggaccacaga

SEQ ID NO: 384463 - RNA, 19 nt, Homo sapiens
ugugggugucagucaggga

SEQ ID NO: 384464 - RNA, 16 nt, Homo sapiens
uguguauauaguauga

SEQ ID NO: 384465 - RNA, 23 nt, Homo sapiens
uguguauauaguaugaaugcagu

SEQ ID NO: 384466 - RNA, 21 nt, Homo sapiens
uguguauucauugaagucaga

SEQ ID NO: 384467 - RNA, 12 nt, Homo sapiens
ugugucagcaua

SEQ ID NO: 384468 - RNA, 17 nt, Homo sapiens
uguguccaugugugugc

SEQ ID NO: 384469 - RNA, 23 nt, Homo sapiens
ugugugaaaggaagcuccacugu

SEQ ID NO: 384470 - RNA, 21 nt, Homo sapiens
ugugugagugugugcaaguau

SEQ ID NO: 384471 - RNA, 18 nt, Homo sapiens
ugugugaucugugggcac

SEQ ID NO: 384472 - RNA, 23 nt, Homo sapiens
ugugugcaagugugugcaugugu

SEQ ID NO: 384473 - RNA, 19 nt, Homo sapiens
ugugugcacaugugugcgu

SEQ ID NO: 384474 - RNA, 19 nt, Homo sapiens
uguguuucagccauguauu

SEQ ID NO: 384475 - RNA, 19 nt, Homo sapiens
uguguuuuguuuuguauca

SEQ ID NO: 384476 - RNA, 13 nt, Homo sapiens
uguuaaaauaacu

SEQ ID NO: 384477 - RNA, 18 nt, Homo sapiens
uguuaaauugcuguguau

SEQ ID NO: 384478 - RNA, 21 nt, Homo sapiens
uguuaacauggacaugaucuu

SEQ ID NO: 384479 - RNA, 14 nt, Homo sapiens
uucuacaaaauccu

SEQ ID NO: 384480 - RNA, 17 nt, Homo sapiens
uucuaggccaagcauuu

SEQ ID NO: 384481 - RNA, 17 nt, Homo sapiens
uucuagguaggggccca

SEQ ID NO: 384482 - RNA, 22 nt, Homo sapiens
uucuaugguugacauuguauau

SEQ ID NO: 384483 - RNA, 20 nt, Homo sapiens
uucuauugaaaaaucaccac

SEQ ID NO: 384484 - RNA, 15 nt, Homo sapiens
uucuauuuauuuacu

SEQ ID NO: 384485 - RNA, 20 nt, Homo sapiens
uucucacuccuaccugguaa

SEQ ID NO: 384486 - RNA, 22 nt, Homo sapiens
uucucagaaucuacccaaagga

SEQ ID NO: 384487 - RNA, 17 nt, Homo sapiens
uucucagguguugccaa

SEQ ID NO: 384488 - RNA, 13 nt, Homo sapiens
uucuccuccaugg

SEQ ID NO: 384489 - RNA, 20 nt, Homo sapiens
uucucucaccuccuaaagua

SEQ ID NO: 384490 - RNA, 17 nt, Homo sapiens
uucugagaaagacuauu

SEQ ID NO: 384491 - RNA, 23 nt, Homo sapiens
uucugucagcagugaaacuuaua

SEQ ID NO: 384492 - RNA, 21 nt, Homo sapiens
uucugucccucacagcacuag

SEQ ID NO: 384493 - RNA, 20 nt, Homo sapiens
uucuguccgagcuuugaaaa

SEQ ID NO: 384494 - RNA, 12 nt, Homo sapiens
uucuguggcuca

SEQ ID NO: 384495 - RNA, 22 nt, Homo sapiens
uucuuaaaaguugugauuccag

SEQ ID NO: 384496 - RNA, 16 nt, Homo sapiens
uucuuacucacacaca

SEQ ID NO: 384497 - RNA, 17 nt, Homo sapiens
uucuuauguugcccagu

SEQ ID NO: 384498 - RNA, 13 nt, Homo sapiens
uucuucaaccuca

SEQ ID NO: 384499 - RNA, 17 nt, Homo sapiens
uucuucacucaaucucu

SEQ ID NO: 384500 - RNA, 16 nt, Homo sapiens
uucuucuguauguuag

SEQ ID NO: 384501 - RNA, 13 nt, Homo sapiens
uucuugcagauca

SEQ ID NO: 384502 - RNA, 18 nt, Homo sapiens
uucuuuuucguuggugua

SEQ ID NO: 384503 - RNA, 13 nt, Homo sapiens
uugaaaagacauc

SEQ ID NO: 384504 - RNA, 21 nt, Homo sapiens
aggaugaaagugaccauguuu

SEQ ID NO: 384505 - RNA, 15 nt, Homo sapiens
aggaugagcauuuag

SEQ ID NO: 384506 - RNA, 21 nt, Homo sapiens
aggaugagcauuuagggcaag

SEQ ID NO: 384507 - RNA, 16 nt, Homo sapiens
aggaugggaaggaggg

SEQ ID NO: 384508 - RNA, 13 nt, Homo sapiens
aggaugugauaua

SEQ ID NO: 384509 - RNA, 17 nt, Homo sapiens
aggauucauguggaaua

SEQ ID NO: 384510 - RNA, 13 nt, Homo sapiens
aggcaaagacagg

SEQ ID NO: 384511 - RNA, 12 nt, Homo sapiens
aggcaagcacuu

SEQ ID NO: 384512 - RNA, 20 nt, Homo sapiens
aggcacuagccuuuggcucu

SEQ ID NO: 384513 - RNA, 13 nt, Homo sapiens
aggcaugaaauga

SEQ ID NO: 384514 - RNA, 18 nt, Homo sapiens
aggcauuuucaucuuucc

SEQ ID NO: 384515 - RNA, 22 nt, Homo sapiens
aggcccuuccucuccacugccu

SEQ ID NO: 384516 - RNA, 16 nt, Homo sapiens
aggccgagaagcaaga

SEQ ID NO: 384517 - RNA, 24 nt, Homo sapiens
aggccgagaugugcaacacucagg

SEQ ID NO: 384518 - RNA, 20 nt, Homo sapiens
aggccgggcgcgguggcuca

SEQ ID NO: 384519 - RNA, 12 nt, Homo sapiens
aggccugccugu

SEQ ID NO: 384520 - RNA, 21 nt, Homo sapiens
aggccuugaggacgucuucua

SEQ ID NO: 384521 - RNA, 19 nt, Homo sapiens
aggcgauccaccugucuca

SEQ ID NO: 384522 - RNA, 13 nt, Homo sapiens
aggcgaugugcaa

SEQ ID NO: 384523 - RNA, 21 nt, Homo sapiens
aggcgccccuucccccuccaa

SEQ ID NO: 384524 - RNA, 17 nt, Homo sapiens
aggcggcuacaugccuc

SEQ ID NO: 384525 - RNA, 20 nt, Homo sapiens
aggcggguggaucacuugag

SEQ ID NO: 384526 - RNA, 14 nt, Homo sapiens
aggcguucuucgag

SEQ ID NO: 384527 - RNA, 22 nt, Homo sapiens
aggcucugcccugcccuagcuc

SEQ ID NO: 384528 - RNA, 20 nt, Homo sapiens
aggcucuuagcagcuuccag

SEQ ID NO: 384529 - RNA, 15 nt, Homo sapiens
aggcugacuaagaau

SEQ ID NO: 384530 - RNA, 15 nt, Homo sapiens
aggcugacuuuugca

SEQ ID NO: 384531 - RNA, 18 nt, Homo sapiens
aggcugcuggacacgucg

SEQ ID NO: 384532 - RNA, 16 nt, Homo sapiens
aggcuguccuguacau

SEQ ID NO: 384533 - RNA, 16 nt, Homo sapiens
aggcugucgccugcac

SEQ ID NO: 384534 - RNA, 18 nt, Homo sapiens
aggcuuaaucacaccguc

SEQ ID NO: 384535 - RNA, 18 nt, Homo sapiens
agggaagccccacuugaa

SEQ ID NO: 384536 - RNA, 19 nt, Homo sapiens
agggaagccccacuugaag

SEQ ID NO: 384537 - RNA, 21 nt, Homo sapiens
agggaagcugucccucacugu

SEQ ID NO: 384538 - RNA, 22 nt, Homo sapiens
agggaauucagugggaccaaug

SEQ ID NO: 384539 - RNA, 14 nt, Homo sapiens
agggacccacuuca

SEQ ID NO: 384540 - RNA, 17 nt, Homo sapiens
agggaccccugcccuug

SEQ ID NO: 384541 - RNA, 21 nt, Homo sapiens
agggaccccugcccuuguccc

SEQ ID NO: 384542 - RNA, 18 nt, Homo sapiens
agggagcaccuggugagu

SEQ ID NO: 384543 - RNA, 17 nt, Homo sapiens
agggauagcacugagca

SEQ ID NO: 384544 - RNA, 18 nt, Homo sapiens
agggcacugcugcugccu

SEQ ID NO: 384545 - RNA, 13 nt, Homo sapiens
aggggcucuggag

SEQ ID NO: 384546 - RNA, 21 nt, Homo sapiens
agggggacuagccccugugga

SEQ ID NO: 384547 - RNA, 16 nt, Homo sapiens
aggguaccuugaacac

SEQ ID NO: 384548 - RNA, 13 nt, Homo sapiens
agggugucuuccu

SEQ ID NO: 384549 - RNA, 14 nt, Homo sapiens
aggguuacaaaucu

SEQ ID NO: 384550 - RNA, 21 nt, Homo sapiens
aggguucaccaggucagggag

SEQ ID NO: 384551 - RNA, 16 nt, Homo sapiens
agguaaggugagggaa

SEQ ID NO: 384552 - RNA, 20 nt, Homo sapiens
agguagccagggggacuagc

SEQ ID NO: 384553 - RNA, 22 nt, Homo sapiens
agguaucauuuucugcauuuaa

SEQ ID NO: 384554 - RNA, 16 nt, Homo sapiens
agguaucuacuuuaga

SEQ ID NO: 384555 - RNA, 22 nt, Homo sapiens
agguaugggacaggugccaggu

SEQ ID NO: 384556 - RNA, 18 nt, Homo sapiens
aggucagcuugcugcccu

SEQ ID NO: 384557 - RNA, 18 nt, Homo sapiens
aggucuaggaacauacuu

SEQ ID NO: 384558 - RNA, 21 nt, Homo sapiens
aggucucacgggcaugggcac

SEQ ID NO: 384559 - RNA, 13 nt, Homo sapiens
aggugacugggaa

SEQ ID NO: 384560 - RNA, 24 nt, Homo sapiens
agguggcaagcugugacuucucca

SEQ ID NO: 384561 - RNA, 15 nt, Homo sapiens
agguggccacuccag

SEQ ID NO: 384562 - RNA, 16 nt, Homo sapiens
agguggggacucugga

SEQ ID NO: 384563 - RNA, 21 nt, Homo sapiens
agguuacccuguaacaugcaa

SEQ ID NO: 384564 - RNA, 19 nt, Homo sapiens
agguucucagguguugcca

SEQ ID NO: 384565 - RNA, 22 nt, Homo sapiens
agguucuuuuuuuuuucaggaa

SEQ ID NO: 384566 - RNA, 14 nt, Homo sapiens
agguuggcaaaaag

SEQ ID NO: 384567 - RNA, 17 nt, Homo sapiens
agguugugggcauugau

SEQ ID NO: 384568 - RNA, 15 nt, Homo sapiens
agguuuuuacuguga

SEQ ID NO: 384569 - RNA, 15 nt, Homo sapiens
aguaacauguguuaa

SEQ ID NO: 384570 - RNA, 14 nt, Homo sapiens
aguacuggcauggu

SEQ ID NO: 384571 - RNA, 17 nt, Homo sapiens
aguacuggcaugguacg

SEQ ID NO: 384572 - RNA, 21 nt, Homo sapiens
aguagacuucauuuuuccuaa

SEQ ID NO: 384573 - RNA, 13 nt, Homo sapiens
aguaggugcuuga

SEQ ID NO: 384574 - RNA, 23 nt, Homo sapiens
aguaguugggauuaccaguagau

SEQ ID NO: 384575 - RNA, 19 nt, Homo sapiens
aguaucugggaacugugcc

SEQ ID NO: 384576 - RNA, 15 nt, Homo sapiens
aguauuguggcugca

SEQ ID NO: 384577 - RNA, 17 nt, Homo sapiens
agucaaaaggugccugu

SEQ ID NO: 384578 - RNA, 21 nt, Homo sapiens
agucaaccugccugacauuug

SEQ ID NO: 384579 - RNA, 21 nt, Homo sapiens
agucauuugcugagcauguac

SEQ ID NO: 384580 - RNA, 18 nt, Homo sapiens
aguccaccugagcugcca

SEQ ID NO: 384581 - RNA, 17 nt, Homo sapiens
aguccuacaagcuaaaa

SEQ ID NO: 384582 - RNA, 22 nt, Homo sapiens
aguccuuuacuaauccaaccca

SEQ ID NO: 384583 - RNA, 19 nt, Homo sapiens
aguccuuucuaaguauuuu

SEQ ID NO: 384584 - RNA, 15 nt, Homo sapiens
agucgaacaauucau

SEQ ID NO: 384585 - RNA, 23 nt, Homo sapiens
agucgugccuguuugcuuagcau

SEQ ID NO: 384586 - RNA, 20 nt, Homo sapiens
agucucuucuaagcaaaauu

SEQ ID NO: 384587 - RNA, 13 nt, Homo sapiens
agucugcaaaaug

SEQ ID NO: 384588 - RNA, 14 nt, Homo sapiens
agucuucaagcaga

SEQ ID NO: 384589 - RNA, 22 nt, Homo sapiens
agucuucauaauuucuucacuc

SEQ ID NO: 384590 - RNA, 18 nt, Homo sapiens
agucuugcucuguugccc

SEQ ID NO: 384591 - RNA, 21 nt, Homo sapiens
agugaaaagucucccuuucca

SEQ ID NO: 384592 - RNA, 19 nt, Homo sapiens
agugaacacucuacuacau

SEQ ID NO: 384593 - RNA, 16 nt, Homo sapiens
agugaagaugccagug

SEQ ID NO: 384594 - RNA, 20 nt, Homo sapiens
agugacagcuugaguggguu

SEQ ID NO: 384595 - RNA, 21 nt, Homo sapiens
agugacaucucuuugauguca

SEQ ID NO: 384596 - RNA, 21 nt, Homo sapiens
agugaccgaaagguuauguua

SEQ ID NO: 384597 - RNA, 15 nt, Homo sapiens
agugagggucagaga

SEQ ID NO: 384598 - RNA, 22 nt, Homo sapiens
agugauaucccccagccucaag

SEQ ID NO: 384599 - RNA, 12 nt, Homo sapiens
agugauggagcu

SEQ ID NO: 384600 - RNA, 14 nt, Homo sapiens
agugcaucucagcc

SEQ ID NO: 384601 - RNA, 16 nt, Homo sapiens
agugccguaacaacug

SEQ ID NO: 384602 - RNA, 21 nt, Homo sapiens
agugccguaacaacugugguc

SEQ ID NO: 384603 - RNA, 15 nt, Homo sapiens
agugggggaucacag

SEQ ID NO: 384604 - RNA, 14 nt, Homo sapiens
aguggggucagggc

SEQ ID NO: 384605 - RNA, 20 nt, Homo sapiens
agugggugccccccuugcca

SEQ ID NO: 384606 - RNA, 23 nt, Homo sapiens
aguguauuuuauguguggcccaa

SEQ ID NO: 384607 - RNA, 20 nt, Homo sapiens
aguguccccuccacugucac

SEQ ID NO: 384608 - RNA, 13 nt, Homo sapiens
agugucucagucc

SEQ ID NO: 384609 - RNA, 16 nt, Homo sapiens
aguguguccaagugug

SEQ ID NO: 384610 - RNA, 15 nt, Homo sapiens
agugugugcacaugu

SEQ ID NO: 384611 - RNA, 13 nt, Homo sapiens
agugugugcaugu

SEQ ID NO: 384612 - RNA, 13 nt, Homo sapiens
agugugugugcgu

SEQ ID NO: 384613 - RNA, 16 nt, Homo sapiens
aguguguuuccuucag

SEQ ID NO: 384614 - RNA, 19 nt, Homo sapiens
aguguuccccaucuggguc

SEQ ID NO: 384615 - RNA, 23 nt, Homo sapiens
aguguuccccuuccacugagggc

SEQ ID NO: 384616 - RNA, 22 nt, Homo sapiens
aguguugcccaggcuggucuca

SEQ ID NO: 384617 - RNA, 23 nt, Homo sapiens
aguguugcccaggcuggucucaa

SEQ ID NO: 384618 - RNA, 21 nt, Homo sapiens
aguuaaauagaguauaugcac

SEQ ID NO: 384619 - RNA, 22 nt, Homo sapiens
aguuagguagcuuuagggcaau

SEQ ID NO: 384620 - RNA, 16 nt, Homo sapiens
uuuguaauauggaaug

SEQ ID NO: 384621 - RNA, 14 nt, Homo sapiens
uuuguuuuaaauac

SEQ ID NO: 384622 - RNA, 22 nt, Homo sapiens
uuuuaaaguauguuauugcaua

SEQ ID NO: 384623 - RNA, 12 nt, Homo sapiens
uuuuaauugauu

SEQ ID NO: 384624 - RNA, 14 nt, Homo sapiens
uuuuagcuuuacaa

SEQ ID NO: 384625 - RNA, 20 nt, Homo sapiens
uuuuagucauuauagauccc

SEQ ID NO: 384626 - RNA, 20 nt, Homo sapiens
uuuuauaaaauuaagcaaug

SEQ ID NO: 384627 - RNA, 12 nt, Homo sapiens
uuuuauauguca

SEQ ID NO: 384628 - RNA, 23 nt, Homo sapiens
uuuuauguguggcccaagacaau

SEQ ID NO: 384629 - RNA, 23 nt, Homo sapiens
uuuucaauguuagccacagugua

SEQ ID NO: 384630 - RNA, 10 nt, Homo sapiens
uuuucacugc

SEQ ID NO: 384631 - RNA, 21 nt, Homo sapiens
uuuucacugcuggcugccuua

SEQ ID NO: 384632 - RNA, 15 nt, Homo sapiens
uuuucagaccccagc

SEQ ID NO: 384633 - RNA, 17 nt, Homo sapiens
uuuucaggaauacauuu

SEQ ID NO: 384634 - RNA, 14 nt, Homo sapiens
uuuucauuaucuca

SEQ ID NO: 384635 - RNA, 22 nt, Homo sapiens
uuuuccacaagauucccagaga

SEQ ID NO: 384636 - RNA, 15 nt, Homo sapiens
uuuugaaaccaugaa

SEQ ID NO: 384637 - RNA, 17 nt, Homo sapiens
uuuugaaauuaaccucu

SEQ ID NO: 384638 - RNA, 19 nt, Homo sapiens
uuuugcuggucacugccau

SEQ ID NO: 384639 - RNA, 20 nt, Homo sapiens
uuuugcuggucacugccaug

SEQ ID NO: 384640 - RNA, 16 nt, Homo sapiens
uuuuggaauuaugucu

SEQ ID NO: 384641 - RNA, 22 nt, Homo sapiens
uuuuggaggguccuccacaaua

SEQ ID NO: 384642 - RNA, 18 nt, Homo sapiens
uuuuguuccacaaguuaa

SEQ ID NO: 384643 - RNA, 18 nt, Homo sapiens
uuuuuaaaaaacugcuga

SEQ ID NO: 384644 - RNA, 22 nt, Homo sapiens
uuuuuaaguuauuuuuacauuc

SEQ ID NO: 384645 - RNA, 11 nt, Homo sapiens
uuuuucaugau

SEQ ID NO: 384646 - RNA, 13 nt, Homo sapiens
uuuuuuauuggaa

SEQ ID NO: 384647 - RNA, 18 nt, Homo sapiens
aaaaacuaacacccaguc

SEQ ID NO: 384648 - RNA, 12 nt, Homo sapiens
aaaaacuuccau

SEQ ID NO: 384649 - RNA, 23 nt, Homo sapiens
aaaaaguccuugauuuagcacua

SEQ ID NO: 384650 - RNA, 19 nt, Homo sapiens
aaaaauagacuuaaaucuc

SEQ ID NO: 384651 - RNA, 15 nt, Homo sapiens
aaaaaucagugaaua

SEQ ID NO: 384652 - RNA, 21 nt, Homo sapiens
aaaaaucaugagauccuuuaa

SEQ ID NO: 384653 - RNA, 14 nt, Homo sapiens
aaaacacagacauu

SEQ ID NO: 384654 - RNA, 11 nt, Homo sapiens
aaaacacugug

SEQ ID NO: 384655 - RNA, 15 nt, Homo sapiens
aaaacacugugcaca

SEQ ID NO: 384656 - RNA, 18 nt, Homo sapiens
aaaacauuaagaaaauca

SEQ ID NO: 384657 - RNA, 22 nt, Homo sapiens
aaaacccuugauuauacucugu

SEQ ID NO: 384658 - RNA, 17 nt, Homo sapiens
aaaacgugcauggauau

SEQ ID NO: 384659 - RNA, 19 nt, Homo sapiens
aaaacugaaaaucuaauau

SEQ ID NO: 384660 - RNA, 14 nt, Homo sapiens
aaaacuugcugccu

SEQ ID NO: 384661 - RNA, 18 nt, Homo sapiens
aaaacuuuaaucccacuu

SEQ ID NO: 384662 - RNA, 18 nt, Homo sapiens
aaaagaaccgagcaauuu

SEQ ID NO: 384663 - RNA, 19 nt, Homo sapiens
aaaagagauggccugagaa

SEQ ID NO: 384664 - RNA, 16 nt, Homo sapiens
aaaagccuuuuccaga

SEQ ID NO: 384665 - RNA, 20 nt, Homo sapiens
aaaagcuuauucaucuguuu

SEQ ID NO: 384666 - RNA, 20 nt, Homo sapiens
aaaaggacucucaggaccaa

SEQ ID NO: 384667 - RNA, 23 nt, Homo sapiens
aaaaggauaugcaguaugcuuaa

SEQ ID NO: 384668 - RNA, 14 nt, Homo sapiens
aaaagucuucacuc

SEQ ID NO: 384669 - RNA, 17 nt, Homo sapiens
aaaauacaugcaucuca

SEQ ID NO: 384670 - RNA, 14 nt, Homo sapiens
aaaauauagcugua

SEQ ID NO: 384671 - RNA, 22 nt, Homo sapiens
aaaauauuuguaucacaaaucu

SEQ ID NO: 384672 - RNA, 21 nt, Homo sapiens
aaaaucauuuuauaugucaaa

SEQ ID NO: 384673 - RNA, 14 nt, Homo sapiens
acagcugcagagac

SEQ ID NO: 384674 - RNA, 20 nt, Homo sapiens
acagcuuccccucucuccuc

SEQ ID NO: 384675 - RNA, 17 nt, Homo sapiens
acaggaaaucaugaggg

SEQ ID NO: 384676 - RNA, 17 nt, Homo sapiens
acaggaaggaaagcgca

SEQ ID NO: 384677 - RNA, 16 nt, Homo sapiens
acaggcccuuccucuc

SEQ ID NO: 384678 - RNA, 22 nt, Homo sapiens
acaggcccuuccucuccacugc

SEQ ID NO: 384679 - RNA, 24 nt, Homo sapiens
acagggucugcucuuucucugcca

SEQ ID NO: 384680 - RNA, 14 nt, Homo sapiens
acaguaaaucucac

SEQ ID NO: 384681 - RNA, 22 nt, Homo sapiens
acaguauggcagcuuuccucaa

SEQ ID NO: 384682 - RNA, 13 nt, Homo sapiens
acagucucaggaa

SEQ ID NO: 384683 - RNA, 20 nt, Homo sapiens
acagucucaggaaaucaaau

SEQ ID NO: 384684 - RNA, 18 nt, Homo sapiens
acagucuuccauuugcaa

SEQ ID NO: 384685 - RNA, 13 nt, Homo sapiens
acagugccugcau

SEQ ID NO: 384686 - RNA, 22 nt, Homo sapiens
acaguggaggaagagggacaga

SEQ ID NO: 384687 - RNA, 15 nt, Homo sapiens
aaucagagagcucac

SEQ ID NO: 384688 - RNA, 20 nt, Homo sapiens
aaucagagagcucacuaaaa

SEQ ID NO: 384689 - RNA, 14 nt, Homo sapiens
aaucagaugcagcu

SEQ ID NO: 384690 - RNA, 14 nt, Homo sapiens
aaucagcauucuca

SEQ ID NO: 384691 - RNA, 21 nt, Homo sapiens
aaucaugaaauaugcaucuca

SEQ ID NO: 384692 - RNA, 20 nt, Homo sapiens
aauccaacccaugaugagcu

SEQ ID NO: 384693 - RNA, 12 nt, Homo sapiens
aaucccagcugg

SEQ ID NO: 384694 - RNA, 14 nt, Homo sapiens
aaucccuccuucau

SEQ ID NO: 384695 - RNA, 17 nt, Homo sapiens
aauccuaaauaauguua

SEQ ID NO: 384696 - RNA, 20 nt, Homo sapiens
aauccuguccucagcuucuu

SEQ ID NO: 384697 - RNA, 14 nt, Homo sapiens
aauccuuccaugaa

SEQ ID NO: 384698 - RNA, 18 nt, Homo sapiens
aauccuuuaaacauacaa

SEQ ID NO: 384699 - RNA, 15 nt, Homo sapiens
aauccuuuacuguua

SEQ ID NO: 384700 - RNA, 16 nt, Homo sapiens
aaucuaaccacaucaa

SEQ ID NO: 384701 - RNA, 21 nt, Homo sapiens
cugccuucaccuccucuuuca

SEQ ID NO: 384702 - RNA, 14 nt, Homo sapiens
cugccuuguguaca

SEQ ID NO: 384703 - RNA, 17 nt, Homo sapiens
cugccuuuucaucuaau

SEQ ID NO: 384704 - RNA, 17 nt, Homo sapiens
cugcuaccucacugggg

SEQ ID NO: 384705 - RNA, 13 nt, Homo sapiens
cugcucaaguuga

SEQ ID NO: 384706 - RNA, 22 nt, Homo sapiens
cugcucuuucucugccagugac

SEQ ID NO: 384707 - RNA, 23 nt, Homo sapiens
cugcucuuucucugccagugaca

SEQ ID NO: 384708 - RNA, 18 nt, Homo sapiens
cugcugagugcaccacuu

SEQ ID NO: 384709 - RNA, 17 nt, Homo sapiens
cugcuuuggaaaucaca

SEQ ID NO: 384710 - RNA, 17 nt, Homo sapiens
cugcuuuuuaaguguua

SEQ ID NO: 384711 - RNA, 16 nt, Homo sapiens
cuggaagcauggagca

SEQ ID NO: 384712 - RNA, 23 nt, Homo sapiens
cuggaagcauguaggagaaucca

SEQ ID NO: 384713 - RNA, 15 nt, Homo sapiens
cuggaaucacauucu

SEQ ID NO: 384714 - RNA, 17 nt, Homo sapiens
cuggaaucacauucuua

SEQ ID NO: 384715 - RNA, 19 nt, Homo sapiens
cuggacucaggaugcccag

SEQ ID NO: 384716 - RNA, 21 nt, Homo sapiens
cuggcaaugaaaaauucucag

SEQ ID NO: 384717 - RNA, 19 nt, Homo sapiens
cuggcagccgugccuucag

SEQ ID NO: 384718 - RNA, 14 nt, Homo sapiens
cuggcccagccaaa

SEQ ID NO: 384719 - RNA, 22 nt, Homo sapiens
cuggccucagccgacugcacag

SEQ ID NO: 384720 - RNA, 15 nt, Homo sapiens
cuggcuucagccucc

SEQ ID NO: 384721 - RNA, 22 nt, Homo sapiens
cugggaagacgccugagcucac

SEQ ID NO: 384722 - RNA, 13 nt, Homo sapiens
cugggaccacaga

SEQ ID NO: 384723 - RNA, 19 nt, Homo sapiens
cugggacugugcucagaga

SEQ ID NO: 384724 - RNA, 15 nt, Homo sapiens
cugggagcacaggca

SEQ ID NO: 384725 - RNA, 20 nt, Homo sapiens
cugggagcacaggcacugca

SEQ ID NO: 384726 - RNA, 22 nt, Homo sapiens
cugggauguccacagaugccuc

SEQ ID NO: 384727 - RNA, 22 nt, Homo sapiens
cugggauuacaauugugagcca

SEQ ID NO: 384728 - RNA, 19 nt, Homo sapiens
cugggcaacacagcgagac

SEQ ID NO: 384729 - RNA, 14 nt, Homo sapiens
cugggcacagucag

SEQ ID NO: 384730 - RNA, 19 nt, Homo sapiens
cugggccaagucaaagaca

SEQ ID NO: 384731 - RNA, 22 nt, Homo sapiens
cugggcccucucugcucugcgu

SEQ ID NO: 384732 - RNA, 14 nt, Homo sapiens
cugggccuucucac

SEQ ID NO: 384733 - RNA, 18 nt, Homo sapiens
cugggcucccuugugcgu

SEQ ID NO: 384734 - RNA, 15 nt, Homo sapiens
cugggcuugucugua

SEQ ID NO: 384735 - RNA, 15 nt, Homo sapiens
cuggggaucuaggga

SEQ ID NO: 384736 - RNA, 22 nt, Homo sapiens
cugggggaggggacauugaaca

SEQ ID NO: 384737 - RNA, 20 nt, Homo sapiens
cuggguccaccccaugucac

SEQ ID NO: 384738 - RNA, 21 nt, Homo sapiens
cugggucucgcuuuguugccc

SEQ ID NO: 384739 - RNA, 12 nt, Homo sapiens
cugggugcuccc

SEQ ID NO: 384740 - RNA, 19 nt, Homo sapiens
cuggguggccucgggacac

SEQ ID NO: 384741 - RNA, 17 nt, Homo sapiens
cuggguuucucuguaua

SEQ ID NO: 384742 - RNA, 22 nt, Homo sapiens
cugguaauauugacuuguauau

SEQ ID NO: 384743 - RNA, 16 nt, Homo sapiens
cugguagaaaggcagu

SEQ ID NO: 384744 - RNA, 12 nt, Homo sapiens
cugguuuuaaca

SEQ ID NO: 384745 - RNA, 17 nt, Homo sapiens
cuguaaucccagcacuu

SEQ ID NO: 384746 - RNA, 23 nt, Homo sapiens
cuguauaguuaggauagcauuuu

SEQ ID NO: 384747 - RNA, 19 nt, Homo sapiens
cuguauauacaauaacaua

SEQ ID NO: 384748 - RNA, 18 nt, Homo sapiens
cugucaucagccugugua

SEQ ID NO: 384749 - RNA, 17 nt, Homo sapiens
cuguccuugcacacucc

SEQ ID NO: 384750 - RNA, 15 nt, Homo sapiens
cugucgucuuagcaa

SEQ ID NO: 384751 - RNA, 23 nt, Homo sapiens
cugucucaaauaaauaaauauga

SEQ ID NO: 384752 - RNA, 14 nt, Homo sapiens
cugucucagccucc

SEQ ID NO: 384753 - RNA, 19 nt, Homo sapiens
cugucuccucuucaaauaa

SEQ ID NO: 384754 - RNA, 15 nt, Homo sapiens
cugucuuucacugaa

SEQ ID NO: 384755 - RNA, 22 nt, Homo sapiens
cugugcaguggcccccacagaa

SEQ ID NO: 384756 - RNA, 22 nt, Homo sapiens
cugugccucggcuuuucucagc

SEQ ID NO: 384757 - RNA, 15 nt, Homo sapiens
cuguggcugcuagca

SEQ ID NO: 384758 - RNA, 21 nt, Homo sapiens
cuguggcugcuagcacuugga

SEQ ID NO: 384759 - RNA, 21 nt, Homo sapiens
cuguguacagaauucugcuac

SEQ ID NO: 384760 - RNA, 19 nt, Homo sapiens
cuguguccuugcaccugca

SEQ ID NO: 384761 - RNA, 16 nt, Homo sapiens
cugugugcaagugugu

SEQ ID NO: 384762 - RNA, 19 nt, Homo sapiens
cugugugcaagugugugca

SEQ ID NO: 384763 - RNA, 22 nt, Homo sapiens
cugugugcaagugugugcacau

SEQ ID NO: 384764 - RNA, 13 nt, Homo sapiens
cuguuaccagagg

SEQ ID NO: 384765 - RNA, 22 nt, Homo sapiens
cuguuacugcuugggcuauacc

SEQ ID NO: 384766 - RNA, 22 nt, Homo sapiens
cuguuauuaccauuagcauucu

SEQ ID NO: 384767 - RNA, 18 nt, Homo sapiens
cuguucugucucauauga

SEQ ID NO: 384768 - RNA, 13 nt, Homo sapiens
cuguugaagcucu

SEQ ID NO: 384769 - RNA, 21 nt, Homo sapiens
cuguugaagcucuggugacac

SEQ ID NO: 384770 - RNA, 14 nt, Homo sapiens
cuguugaugccguu

SEQ ID NO: 384771 - RNA, 20 nt, Homo sapiens
cuuaaacagcagauuucaga

SEQ ID NO: 384772 - RNA, 23 nt, Homo sapiens
cuuaaaccgccaaggcuggggga

SEQ ID NO: 384773 - RNA, 21 nt, Homo sapiens
cuuaaaggcaccaucuaauag

SEQ ID NO: 384774 - RNA, 13 nt, Homo sapiens
cuuaaccccagua

SEQ ID NO: 384775 - RNA, 16 nt, Homo sapiens
cuuaaugguagcaacu

SEQ ID NO: 384776 - RNA, 20 nt, Homo sapiens
cuuacacuuuaugcacaaaa

SEQ ID NO: 384777 - RNA, 15 nt, Homo sapiens
cuuaccaacuuucug

SEQ ID NO: 384778 - RNA, 19 nt, Homo sapiens
cuuacccacgugcuguucc

SEQ ID NO: 384779 - RNA, 13 nt, Homo sapiens
cuuagcacacuca

SEQ ID NO: 384780 - RNA, 21 nt, Homo sapiens
cuuaguuacucauucagggau

SEQ ID NO: 384781 - RNA, 16 nt, Homo sapiens
cuuauaaaaaucuuaa

SEQ ID NO: 384782 - RNA, 15 nt, Homo sapiens
cuuauacauuugaua

SEQ ID NO: 384783 - RNA, 18 nt, Homo sapiens
cuuauagaaaguucaaaa

SEQ ID NO: 384784 - RNA, 23 nt, Homo sapiens
cuuauccaacucucgacuuuucc

SEQ ID NO: 384785 - RNA, 19 nt, Homo sapiens
cuuaugaaagaaagcuuua

SEQ ID NO: 384786 - RNA, 21 nt, Homo sapiens
cuucaacugaccagccuccau

SEQ ID NO: 384787 - RNA, 14 nt, Homo sapiens
cuucaagcagggaa

SEQ ID NO: 384788 - RNA, 15 nt, Homo sapiens
cuucaagcagggaag

SEQ ID NO: 384789 - RNA, 17 nt, Homo sapiens
cuucacucaaucucuga

SEQ ID NO: 384790 - RNA, 22 nt, Homo sapiens
cuucagccuagccgaccucagc

SEQ ID NO: 384791 - RNA, 22 nt, Homo sapiens
cuucauccucugagugugacca

SEQ ID NO: 384792 - RNA, 16 nt, Homo sapiens
cuucauuuuuccuaac

SEQ ID NO: 384793 - RNA, 16 nt, Homo sapiens
cuuccauuugugugug

SEQ ID NO: 384794 - RNA, 16 nt, Homo sapiens
cuucccucacaccgcg

SEQ ID NO: 384795 - RNA, 19 nt, Homo sapiens
cuucccugguaccuagcaa

SEQ ID NO: 384796 - RNA, 17 nt, Homo sapiens
cuuccugaguggugcca

SEQ ID NO: 384797 - RNA, 16 nt, Homo sapiens
cuucggacuauuuucc

SEQ ID NO: 384798 - RNA, 22 nt, Homo sapiens
cuucguuuacuaugccuguguc

SEQ ID NO: 384799 - RNA, 20 nt, Homo sapiens
cuucuagggagacaacagcc

SEQ ID NO: 384800 - RNA, 19 nt, Homo sapiens
cuucuaugguugacauugu

SEQ ID NO: 384801 - RNA, 14 nt, Homo sapiens
cuucuccacuggau

SEQ ID NO: 384802 - RNA, 12 nt, Homo sapiens
cuucuccugacc

SEQ ID NO: 384803 - RNA, 16 nt, Homo sapiens
cuucugcccuugccaa

SEQ ID NO: 384804 - RNA, 13 nt, Homo sapiens
cuucuguaaaggu

SEQ ID NO: 384805 - RNA, 22 nt, Homo sapiens
cuucugucccucacagcacuag

SEQ ID NO: 384806 - RNA, 22 nt, Homo sapiens
cuucuuaauauaacugccuuaa

SEQ ID NO: 384807 - RNA, 21 nt, Homo sapiens
cuucuuggucucagugucaau

SEQ ID NO: 384808 - RNA, 14 nt, Homo sapiens
cuugaacacagucu

SEQ ID NO: 384809 - RNA, 14 nt, Homo sapiens
cuugaacacugggg

SEQ ID NO: 384810 - RNA, 18 nt, Homo sapiens
cuugacccccuugagggu

SEQ ID NO: 384811 - RNA, 20 nt, Homo sapiens
cuugaguuuagugaucugaa

SEQ ID NO: 384812 - RNA, 15 nt, Homo sapiens
cuugauaugaccugu

SEQ ID NO: 384813 - RNA, 13 nt, Homo sapiens
cuugauauuuucc

SEQ ID NO: 384814 - RNA, 16 nt, Homo sapiens
cuugauauuuuccaaa

SEQ ID NO: 384815 - RNA, 18 nt, Homo sapiens
cuugauggagauauuuac

SEQ ID NO: 384816 - RNA, 18 nt, Homo sapiens
cuugccccuguuaccuaa

SEQ ID NO: 384817 - RNA, 18 nt, Homo sapiens
cuugcggucccuucuuac

SEQ ID NO: 384818 - RNA, 16 nt, Homo sapiens
cuugcuggacggggac

SEQ ID NO: 384819 - RNA, 19 nt, Homo sapiens
cuuggaggccagccaguga

SEQ ID NO: 384820 - RNA, 21 nt, Homo sapiens
cuuggaggccagccagugacc

SEQ ID NO: 384821 - RNA, 18 nt, Homo sapiens
cuugggagaccuguaauc

SEQ ID NO: 384822 - RNA, 19 nt, Homo sapiens
cuugggaggcugaggcaga

SEQ ID NO: 384823 - RNA, 18 nt, Homo sapiens
cuuguaauucuaaaugaa

SEQ ID NO: 384824 - RNA, 15 nt, Homo sapiens
cuugucauugccagc

SEQ ID NO: 384825 - RNA, 16 nt, Homo sapiens
cuugugagaacacagc

SEQ ID NO: 384826 - RNA, 17 nt, Homo sapiens
cuugugagggacugaga

SEQ ID NO: 384827 - RNA, 18 nt, Homo sapiens
cuugugguuuaugucauc

SEQ ID NO: 384828 - RNA, 16 nt, Homo sapiens
cuuguguccacuguga

SEQ ID NO: 384829 - RNA, 23 nt, Homo sapiens
cuuguuucacacuagucacauuc

SEQ ID NO: 384830 - RNA, 14 nt, Homo sapiens
cuuuaacugacuua

SEQ ID NO: 384831 - RNA, 12 nt, Homo sapiens
cuuuaagcacua

SEQ ID NO: 384832 - RNA, 15 nt, Homo sapiens
cuuuacaugacacag

SEQ ID NO: 384833 - RNA, 18 nt, Homo sapiens
cuuuacuguuagucauuu

SEQ ID NO: 384834 - RNA, 11 nt, Homo sapiens
cuuuacuugac

SEQ ID NO: 384835 - RNA, 16 nt, Homo sapiens
cuuuagucugcaaaau

SEQ ID NO: 384836 - RNA, 14 nt, Homo sapiens
cuuuauugugaucu

SEQ ID NO: 384837 - RNA, 14 nt, Homo sapiens
cuuucaaauccuuc

SEQ ID NO: 384838 - RNA, 14 nt, Homo sapiens
cuuucacacuucca

SEQ ID NO: 384839 - RNA, 15 nt, Homo sapiens
cuuucaggaccuuuu

SEQ ID NO: 384840 - RNA, 24 nt, Homo sapiens
cuuucaggccacauggcuaaagaa

SEQ ID NO: 384841 - RNA, 15 nt, Homo sapiens
cuuuccugcaacuca

SEQ ID NO: 384842 - RNA, 22 nt, Homo sapiens
cuuucuauugaaaaaucaccac

SEQ ID NO: 384843 - RNA, 18 nt, Homo sapiens
cuuucucugccagugaca

SEQ ID NO: 384844 - RNA, 22 nt, Homo sapiens
cuuucucugccagugacagaca

SEQ ID NO: 384845 - RNA, 18 nt, Homo sapiens
cuuucugcuaucaaagag

SEQ ID NO: 384846 - RNA, 19 nt, Homo sapiens
cuuucugcuaucaaagagg

SEQ ID NO: 384847 - RNA, 16 nt, Homo sapiens
cuuucuugaagaacaa

SEQ ID NO: 384848 - RNA, 17 nt, Homo sapiens
cuuugaagaccaguccu

SEQ ID NO: 384849 - RNA, 22 nt, Homo sapiens
cuuugaagugacuucacagaga

SEQ ID NO: 384850 - RNA, 13 nt, Homo sapiens
cuuugaaugacaa

SEQ ID NO: 384851 - RNA, 13 nt, Homo sapiens
cuuugaauguggc

SEQ ID NO: 384852 - RNA, 16 nt, Homo sapiens
cuuugagugacugggu

SEQ ID NO: 384853 - RNA, 18 nt, Homo sapiens
cuuugaugucauauggaa

SEQ ID NO: 384854 - RNA, 14 nt, Homo sapiens
cuuugccacacaca

SEQ ID NO: 384855 - RNA, 18 nt, Homo sapiens
cuuugcucuuucuugacu

SEQ ID NO: 384856 - RNA, 15 nt, Homo sapiens
cuuuggaaaucacac

SEQ ID NO: 384857 - RNA, 18 nt, Homo sapiens
cuuuggucauaugagcuu

SEQ ID NO: 384858 - RNA, 17 nt, Homo sapiens
cuuugucccggggcucc

SEQ ID NO: 384859 - RNA, 11 nt, Homo sapiens
cuuuguugccc

SEQ ID NO: 384860 - RNA, 21 nt, Homo sapiens
cuuuguuuagcccaaaaccaa

SEQ ID NO: 384861 - RNA, 13 nt, Homo sapiens
cuuuuacauucug

SEQ ID NO: 384862 - RNA, 19 nt, Homo sapiens
cuuuuauccacuuaccuag

SEQ ID NO: 384863 - RNA, 20 nt, Homo sapiens
cuuuuaugagacccauuccu

SEQ ID NO: 384864 - RNA, 14 nt, Homo sapiens
cuuuuaugccuuca

SEQ ID NO: 384865 - RNA, 12 nt, Homo sapiens
cuuuuauuacau

SEQ ID NO: 384866 - RNA, 15 nt, Homo sapiens
cuuuuauuacugggg

SEQ ID NO: 384867 - RNA, 21 nt, Homo sapiens
cuuuuccccggucccuugaga

SEQ ID NO: 384868 - RNA, 21 nt, Homo sapiens
cuuuuccuuggucuccagugg

SEQ ID NO: 384869 - RNA, 19 nt, Homo sapiens
cuuuugcauaagugcauga

SEQ ID NO: 384870 - RNA, 16 nt, Homo sapiens
cuuuugguaugugaca

SEQ ID NO: 384871 - RNA, 13 nt, Homo sapiens
cuuuuucauucuu

SEQ ID NO: 384872 - RNA, 13 nt, Homo sapiens
cuuuuucuuugag

SEQ ID NO: 384873 - RNA, 21 nt, Homo sapiens
cuuuuuucacggaaguuuuca

SEQ ID NO: 384874 - RNA, 14 nt, Homo sapiens
gaaaaacauuauuu

SEQ ID NO: 384875 - RNA, 19 nt, Homo sapiens
gaaaaaccaccaccaucac

SEQ ID NO: 384876 - RNA, 13 nt, Homo sapiens
gaaaaacuuccau

SEQ ID NO: 384877 - RNA, 15 nt, Homo sapiens
gaaaaacuuccauga

SEQ ID NO: 384878 - RNA, 15 nt, Homo sapiens
gaaaaagucauccaa

SEQ ID NO: 384879 - RNA, 19 nt, Homo sapiens
gaaaaaucuaagugauaua

SEQ ID NO: 384880 - RNA, 15 nt, Homo sapiens
gaaaaauguguaauu

SEQ ID NO: 384881 - RNA, 20 nt, Homo sapiens
gaaaaauuaauuuacuagaa

SEQ ID NO: 384882 - RNA, 19 nt, Homo sapiens
gaaaacacugugcacaucu

SEQ ID NO: 384883 - RNA, 15 nt, Homo sapiens
gaaaacugagacuca

SEQ ID NO: 384884 - RNA, 15 nt, Homo sapiens
gaaaacugcaacuug

SEQ ID NO: 384885 - RNA, 19 nt, Homo sapiens
gaaaacuuagagagguaca

SEQ ID NO: 384886 - RNA, 20 nt, Homo sapiens
gaaaagagaaggaaagugau

SEQ ID NO: 384887 - RNA, 20 nt, Homo sapiens
gaaaagcccaugaucuucaa

SEQ ID NO: 384888 - RNA, 14 nt, Homo sapiens
gaaaauagaacaac

SEQ ID NO: 384889 - RNA, 12 nt, Homo sapiens
gaaaaugaaucu

SEQ ID NO: 384890 - RNA, 14 nt, Homo sapiens
gaaaauuauaucuc

SEQ ID NO: 384891 - RNA, 21 nt, Homo sapiens
gaaaauucuguagguucugug

SEQ ID NO: 384892 - RNA, 13 nt, Homo sapiens
gaaacaacucuuu

SEQ ID NO: 384893 - RNA, 18 nt, Homo sapiens
gaaacuguagucucagga

SEQ ID NO: 384894 - RNA, 22 nt, Homo sapiens
gaaacuguagucucaggaccua

SEQ ID NO: 384895 - RNA, 22 nt, Homo sapiens
gaaagaaaaucaggcuggccaa

SEQ ID NO: 384896 - RNA, 14 nt, Homo sapiens
gaaagaagugggga

SEQ ID NO: 384897 - RNA, 14 nt, Homo sapiens
gaaagaggaaugaa

SEQ ID NO: 384898 - RNA, 14 nt, Homo sapiens
gaaagauggaacuu

SEQ ID NO: 384899 - RNA, 23 nt, Homo sapiens
gaaagcaucauuauuugcagaga

SEQ ID NO: 384900 - RNA, 15 nt, Homo sapiens
gaaagccucagccau

SEQ ID NO: 384901 - RNA, 20 nt, Homo sapiens
gaaagccucagccauucacu

SEQ ID NO: 384902 - RNA, 17 nt, Homo sapiens
gaaaggaagcuccacug

SEQ ID NO: 384903 - RNA, 20 nt, Homo sapiens
gaaaggaagcuccacuguca

SEQ ID NO: 384904 - RNA, 12 nt, Homo sapiens
gaaagugauauc

SEQ ID NO: 384905 - RNA, 20 nt, Homo sapiens
gaaauagaagcaaaugacaa

SEQ ID NO: 384906 - RNA, 19 nt, Homo sapiens
gaaauauccagaacauacu

SEQ ID NO: 384907 - RNA, 13 nt, Homo sapiens
gaaaucuaugaaa

SEQ ID NO: 384908 - RNA, 19 nt, Homo sapiens
gaaaucuaugaaauaucau

SEQ ID NO: 384909 - RNA, 19 nt, Homo sapiens
gaacaaguuguuucauuga

SEQ ID NO: 384910 - RNA, 20 nt, Homo sapiens
gaacacagccgauucaccug

SEQ ID NO: 384911 - RNA, 20 nt, Homo sapiens
gaacacugggggaggggaca

SEQ ID NO: 384912 - RNA, 18 nt, Homo sapiens
gaacaucccugccagcuc

SEQ ID NO: 384913 - RNA, 16 nt, Homo sapiens
gaaccacgucugcuaa

SEQ ID NO: 384914 - RNA, 17 nt, Homo sapiens
gaaccagagcucagaga

SEQ ID NO: 384915 - RNA, 18 nt, Homo sapiens
gaaccaggcaacuuggga

SEQ ID NO: 384916 - RNA, 23 nt, Homo sapiens
gaaccaucauuggaaaugaaacu

SEQ ID NO: 384917 - RNA, 22 nt, Homo sapiens
gaacccuuggagccaauggaga

SEQ ID NO: 384918 - RNA, 21 nt, Homo sapiens
gaaccgagcaauuuucugcua

SEQ ID NO: 384919 - RNA, 16 nt, Homo sapiens
gaaccugaugcugacu

SEQ ID NO: 384920 - RNA, 16 nt, Homo sapiens
gaaccuguccuugcac

SEQ ID NO: 384921 - RNA, 14 nt, Homo sapiens
gaaccuuccaucuc

SEQ ID NO: 384922 - RNA, 16 nt, Homo sapiens
gaaccuuccaucucgc

SEQ ID NO: 384923 - RNA, 13 nt, Homo sapiens
gaacggggagaaa

SEQ ID NO: 384924 - RNA, 15 nt, Homo sapiens
gaacucacaauucca

SEQ ID NO: 384925 - RNA, 22 nt, Homo sapiens
gaacucauuccugccugucucc

SEQ ID NO: 384926 - RNA, 17 nt, Homo sapiens
gaacuggaccaucucca

SEQ ID NO: 384927 - RNA, 19 nt, Homo sapiens
gaacuugugagaacacagc

SEQ ID NO: 384928 - RNA, 13 nt, Homo sapiens
gaacuuuuuccaa

SEQ ID NO: 384929 - RNA, 19 nt, Homo sapiens
gaagaacaguaacugccau

SEQ ID NO: 384930 - RNA, 20 nt, Homo sapiens
gaagaacaguaacugccauc

SEQ ID NO: 384931 - RNA, 23 nt, Homo sapiens
gaagaagauaugugaagaaaaau

SEQ ID NO: 384932 - RNA, 20 nt, Homo sapiens
gaagaagucuaagagugaag

SEQ ID NO: 384933 - RNA, 23 nt, Homo sapiens
gaagacauccugagcagugccag

SEQ ID NO: 384934 - RNA, 11 nt, Homo sapiens
gaagaccagcu

SEQ ID NO: 384935 - RNA, 16 nt, Homo sapiens
gaagaccugcugaggg

SEQ ID NO: 384936 - RNA, 17 nt, Homo sapiens
gaagagaaugugacagg

SEQ ID NO: 384937 - RNA, 14 nt, Homo sapiens
gaagagauccuucu

SEQ ID NO: 384938 - RNA, 21 nt, Homo sapiens
gaagagccugcaggugcugcu

SEQ ID NO: 384939 - RNA, 22 nt, Homo sapiens
gaagagcuguguggccuggcaa

SEQ ID NO: 384940 - RNA, 14 nt, Homo sapiens
gaagagcuuggaaa

SEQ ID NO: 384941 - RNA, 19 nt, Homo sapiens
gaagaguuaagaagaaaau

SEQ ID NO: 384942 - RNA, 21 nt, Homo sapiens
gaagauggauugguguaaaag

SEQ ID NO: 384943 - RNA, 21 nt, Homo sapiens
gaagaugggaaaaccauggua

SEQ ID NO: 384944 - RNA, 14 nt, Homo sapiens
gaagcaacccaaau

SEQ ID NO: 384945 - RNA, 20 nt, Homo sapiens
gaagccacuauuacugggac

SEQ ID NO: 384946 - RNA, 14 nt, Homo sapiens
gaagccccacuuga

SEQ ID NO: 384947 - RNA, 17 nt, Homo sapiens
gaagccuauguaugcca

SEQ ID NO: 384948 - RNA, 13 nt, Homo sapiens
gaagcuccacugu

SEQ ID NO: 384949 - RNA, 14 nt, Homo sapiens
gaagcuccacuguc

SEQ ID NO: 384950 - RNA, 13 nt, Homo sapiens
gaagcugcuccgu

SEQ ID NO: 384951 - RNA, 15 nt, Homo sapiens
gaagcuuccauucca

SEQ ID NO: 384952 - RNA, 15 nt, Homo sapiens
gaagggacauauuca

SEQ ID NO: 384953 - RNA, 23 nt, Homo sapiens
gaaggguaccuugaacacugggg

SEQ ID NO: 384954 - RNA, 22 nt, Homo sapiens
gaaggguucaccaggucaggga

SEQ ID NO: 384955 - RNA, 18 nt, Homo sapiens
gaagguggggauugccca

SEQ ID NO: 384956 - RNA, 13 nt, Homo sapiens
gaagguugcaccu

SEQ ID NO: 384957 - RNA, 17 nt, Homo sapiens
gaaguaggugugacuug

SEQ ID NO: 384958 - RNA, 20 nt, Homo sapiens
gaaguaggugugacuugaac

SEQ ID NO: 384959 - RNA, 21 nt, Homo sapiens
gaaguauccuucagccugaaa

SEQ ID NO: 384960 - RNA, 15 nt, Homo sapiens
gaaguaugagggaaa

SEQ ID NO: 384961 - RNA, 13 nt, Homo sapiens
gaagugugugauc

SEQ ID NO: 384962 - RNA, 16 nt, Homo sapiens
gaagugugugaucugu

SEQ ID NO: 384963 - RNA, 18 nt, Homo sapiens
gaauaaaauuagcuugag

SEQ ID NO: 384964 - RNA, 19 nt, Homo sapiens
gaauaaaauugcacuuuua

SEQ ID NO: 384965 - RNA, 18 nt, Homo sapiens
gaauaaauaaauguaucu

SEQ ID NO: 384966 - RNA, 18 nt, Homo sapiens
gaauaauacaguaucuca

SEQ ID NO: 384967 - RNA, 14 nt, Homo sapiens
gaauaauaccuaag

SEQ ID NO: 384968 - RNA, 13 nt, Homo sapiens
gaauaauccagaa

SEQ ID NO: 384969 - RNA, 19 nt, Homo sapiens
gaauagcuuugaauguggc

SEQ ID NO: 384970 - RNA, 14 nt, Homo sapiens
gaauauacauuguc

SEQ ID NO: 384971 - RNA, 16 nt, Homo sapiens
gaauaugauuaguaaa

SEQ ID NO: 384972 - RNA, 20 nt, Homo sapiens
gaaucuucacaaaacacuuc

SEQ ID NO: 384973 - RNA, 19 nt, Homo sapiens
gaaugcaaaguagcaauuu

SEQ ID NO: 384974 - RNA, 14 nt, Homo sapiens
gaaugcagggacaa

SEQ ID NO: 384975 - RNA, 16 nt, Homo sapiens
gaaugcaguggggaca

SEQ ID NO: 384976 - RNA, 17 nt, Homo sapiens
gaauggagcuggcccuc

SEQ ID NO: 384977 - RNA, 16 nt, Homo sapiens
gaauggguuugcuaga

SEQ ID NO: 384978 - RNA, 16 nt, Homo sapiens
gaauguagcagauccc

SEQ ID NO: 384979 - RNA, 17 nt, Homo sapiens
gaauguagcagaucccc

SEQ ID NO: 384980 - RNA, 18 nt, Homo sapiens
gaauguuugucucauccc

SEQ ID NO: 384981 - RNA, 19 nt, Homo sapiens
gaauguuugucucauccca

SEQ ID NO: 384982 - RNA, 12 nt, Homo sapiens
gaauuugagugc

SEQ ID NO: 384983 - RNA, 18 nt, Homo sapiens
gaauuugaguuggaucau

SEQ ID NO: 384984 - RNA, 23 nt, Homo sapiens
gacaaaaagccuuuuccagaaga

SEQ ID NO: 384985 - RNA, 17 nt, Homo sapiens
gacaaaaauucaacuca

SEQ ID NO: 384986 - RNA, 22 nt, Homo sapiens
gacaaaucuaugccacucagaa

SEQ ID NO: 384987 - RNA, 14 nt, Homo sapiens
gacacaugugccgg

SEQ ID NO: 384988 - RNA, 16 nt, Homo sapiens
gacacgcaacuggcuc

SEQ ID NO: 384989 - RNA, 17 nt, Homo sapiens
gacacguccaccccagu

SEQ ID NO: 384990 - RNA, 20 nt, Homo sapiens
gacacuauuuaucugugcaa

SEQ ID NO: 384991 - RNA, 16 nt, Homo sapiens
gacacugaaaaaucua

SEQ ID NO: 384992 - RNA, 17 nt, Homo sapiens
gacagacaggcucuuag

SEQ ID NO: 384993 - RNA, 15 nt, Homo sapiens
gacagagcaagugag

SEQ ID NO: 384994 - RNA, 17 nt, Homo sapiens
gacagaugaaugccgug

SEQ ID NO: 384995 - RNA, 21 nt, Homo sapiens
gacagauuccaggcgaugugc

SEQ ID NO: 384996 - RNA, 15 nt, Homo sapiens
gacaguaaaucucac

SEQ ID NO: 384997 - RNA, 14 nt, Homo sapiens
gacagugaacauuc

SEQ ID NO: 384998 - RNA, 19 nt, Homo sapiens
gacauccccacccuuggag

SEQ ID NO: 384999 - RNA, 16 nt, Homo sapiens
gacaucgguucauauu

SEQ ID NO: 385000 - RNA, 14 nt, Homo sapiens
gacaucucaggggc

SEQ ID NO: 385001 - RNA, 14 nt, Homo sapiens
gacaugugacauuu

SEQ ID NO: 385002 - RNA, 15 nt, Homo sapiens
gacauguggggccag

SEQ ID NO: 385003 - RNA, 21 nt, Homo sapiens
gacauuugggagacaugugac

SEQ ID NO: 385004 - RNA, 16 nt, Homo sapiens
gaccacagacucacau

SEQ ID NO: 385005 - RNA, 19 nt, Homo sapiens
gaccacagagggcaggaac

SEQ ID NO: 385006 - RNA, 13 nt, Homo sapiens
gaccagcuuugca

SEQ ID NO: 385007 - RNA, 18 nt, Homo sapiens
gaccagcuuugcagugac

SEQ ID NO: 385008 - RNA, 16 nt, Homo sapiens
gaccauccuauuuaac

SEQ ID NO: 385009 - RNA, 23 nt, Homo sapiens
gacccacggagcccuuaugacau

SEQ ID NO: 385010 - RNA, 18 nt, Homo sapiens
gacccagggaugacaugu

SEQ ID NO: 385011 - RNA, 17 nt, Homo sapiens
gaccccccuauugcugc

SEQ ID NO: 385012 - RNA, 18 nt, Homo sapiens
gaccccuguucccaugcu

SEQ ID NO: 385013 - RNA, 17 nt, Homo sapiens
gacccucguggccuucc

SEQ ID NO: 385014 - RNA, 13 nt, Homo sapiens
gacccugggacca

SEQ ID NO: 385015 - RNA, 19 nt, Homo sapiens
gaccuacuguucggacaaa

SEQ ID NO: 385016 - RNA, 15 nt, Homo sapiens
gaccuaggauuucau

SEQ ID NO: 385017 - RNA, 22 nt, Homo sapiens
gaccucaggugauccacccacc

SEQ ID NO: 385018 - RNA, 11 nt, Homo sapiens
gaccuguguuu

SEQ ID NO: 385019 - RNA, 16 nt, Homo sapiens
gaccuguucaaaaagg

SEQ ID NO: 385020 - RNA, 14 nt, Homo sapiens
gacgaaccuugaaa

SEQ ID NO: 385021 - RNA, 14 nt, Homo sapiens
gacgucuucuaggg

SEQ ID NO: 385022 - RNA, 16 nt, Homo sapiens
gacuaagaaucccuaa

SEQ ID NO: 385023 - RNA, 13 nt, Homo sapiens
gacuacuauacaa

SEQ ID NO: 385024 - RNA, 18 nt, Homo sapiens
gacuagugacacauugua

SEQ ID NO: 385025 - RNA, 22 nt, Homo sapiens
gacuaugucacccaaugcauau

SEQ ID NO: 385026 - RNA, 16 nt, Homo sapiens
gacucaagugucucag

SEQ ID NO: 385027 - RNA, 19 nt, Homo sapiens
gacucagggccccagcacu

SEQ ID NO: 385028 - RNA, 21 nt, Homo sapiens
gacucauuuuaaaaaauggaa

SEQ ID NO: 385029 - RNA, 16 nt, Homo sapiens
gacuccgucucaagga

SEQ ID NO: 385030 - RNA, 20 nt, Homo sapiens
gacucuaccagacuguguau

SEQ ID NO: 385031 - RNA, 16 nt, Homo sapiens
gacucuaggugcccuu

SEQ ID NO: 385032 - RNA, 19 nt, Homo sapiens
gacucuccagaaagcucau

SEQ ID NO: 385033 - RNA, 17 nt, Homo sapiens
gacucuuuggacacuca

SEQ ID NO: 385034 - RNA, 21 nt, Homo sapiens
gacugacccugaucagucuaa

SEQ ID NO: 385035 - RNA, 22 nt, Homo sapiens
gacugagagacaggacuagcug

SEQ ID NO: 385036 - RNA, 12 nt, Homo sapiens
gacugagcucaa

SEQ ID NO: 385037 - RNA, 15 nt, Homo sapiens
gacugagcucaaggu

SEQ ID NO: 385038 - RNA, 18 nt, Homo sapiens
gacuguucuuuuacaaga

SEQ ID NO: 385039 - RNA, 17 nt, Homo sapiens
gacuucauuuuuccuaa

SEQ ID NO: 385040 - RNA, 20 nt, Homo sapiens
gacuucugucuucacaacag

SEQ ID NO: 385041 - RNA, 12 nt, Homo sapiens
gacuugaaccca

SEQ ID NO: 385042 - RNA, 23 nt, Homo sapiens
gagaaaaaauauuuuccugccag

SEQ ID NO: 385043 - RNA, 15 nt, Homo sapiens
gagaaacuguagucu

SEQ ID NO: 385044 - RNA, 15 nt, Homo sapiens
gagaaagacuauuca

SEQ ID NO: 385045 - RNA, 18 nt, Homo sapiens
gagaaauuccuugauuca

SEQ ID NO: 385046 - RNA, 15 nt, Homo sapiens
gagaaggaaagugau

SEQ ID NO: 385047 - RNA, 21 nt, Homo sapiens
gagaauaaacuagacucugaa

SEQ ID NO: 385048 - RNA, 18 nt, Homo sapiens
gagaauugcuugaaccug

SEQ ID NO: 385049 - RNA, 22 nt, Homo sapiens
gagacagaaagcagaacaguga

SEQ ID NO: 385050 - RNA, 24 nt, Homo sapiens
gagacaggguuuggcugugucuaa

SEQ ID NO: 385051 - RNA, 19 nt, Homo sapiens
gagacaugagcauggcuga

SEQ ID NO: 385052 - RNA, 11 nt, Homo sapiens
gagacauguga

SEQ ID NO: 385053 - RNA, 15 nt, Homo sapiens
gagacaugugacauu

SEQ ID NO: 385054 - RNA, 14 nt, Homo sapiens
gagaccguccucac

SEQ ID NO: 385055 - RNA, 15 nt, Homo sapiens
gagaccguccucacc

SEQ ID NO: 385056 - RNA, 20 nt, Homo sapiens
gagacucaccucugccucaa

SEQ ID NO: 385057 - RNA, 14 nt, Homo sapiens
gagagaaagccagg

SEQ ID NO: 385058 - RNA, 13 nt, Homo sapiens
gagagacccaagg

SEQ ID NO: 385059 - RNA, 22 nt, Homo sapiens
gagagcucgcuuugagugacug

SEQ ID NO: 385060 - RNA, 16 nt, Homo sapiens
gagaguggcuccuccc

SEQ ID NO: 385061 - RNA, 17 nt, Homo sapiens
gagaucauccuuuccag

SEQ ID NO: 385062 - RNA, 20 nt, Homo sapiens
gagauggaaguugcagugag

SEQ ID NO: 385063 - RNA, 15 nt, Homo sapiens
gagcagaacuuucac

SEQ ID NO: 385064 - RNA, 16 nt, Homo sapiens
gagcaggaagcauuca

SEQ ID NO: 385065 - RNA, 16 nt, Homo sapiens
gagcaggcuacuguca

SEQ ID NO: 385066 - RNA, 13 nt, Homo sapiens
gagccaaggguuc

SEQ ID NO: 385067 - RNA, 23 nt, Homo sapiens
gagccaauugauuucaacagaau

SEQ ID NO: 385068 - RNA, 14 nt, Homo sapiens
gagcccccuugaca

SEQ ID NO: 385069 - RNA, 17 nt, Homo sapiens
gagccccgcagaccucc

SEQ ID NO: 385070 - RNA, 17 nt, Homo sapiens
gagccgggucugccucu

SEQ ID NO: 385071 - RNA, 14 nt, Homo sapiens
gagccucgggacau

SEQ ID NO: 385072 - RNA, 12 nt, Homo sapiens
gagccuggacaa

SEQ ID NO: 385073 - RNA, 16 nt, Homo sapiens
gagccuggcaagaaug

SEQ ID NO: 385074 - RNA, 12 nt, Homo sapiens
gagcgacaguga

SEQ ID NO: 385075 - RNA, 13 nt, Homo sapiens
gagcgacagugag

SEQ ID NO: 385076 - RNA, 23 nt, Homo sapiens
gaggaggcaauugggauggcgcu

SEQ ID NO: 385077 - RNA, 16 nt, Homo sapiens
gaggauuucaucucuu

SEQ ID NO: 385078 - RNA, 20 nt, Homo sapiens
gaggcaggaggaucacuuga

SEQ ID NO: 385079 - RNA, 12 nt, Homo sapiens
gaggcagggaag

SEQ ID NO: 385080 - RNA, 18 nt, Homo sapiens
gaggccaaggagggugga

SEQ ID NO: 385081 - RNA, 18 nt, Homo sapiens
gaggccaggcagauccca

SEQ ID NO: 385082 - RNA, 17 nt, Homo sapiens
gaggccuggacuuuccu

SEQ ID NO: 385083 - RNA, 22 nt, Homo sapiens
gaggccuggacuuuccugcaac

SEQ ID NO: 385084 - RNA, 19 nt, Homo sapiens
gaggcggguggaucacuug

SEQ ID NO: 385085 - RNA, 13 nt, Homo sapiens
gagggaagccuga

SEQ ID NO: 385086 - RNA, 16 nt, Homo sapiens
gagggcagucgauaga

SEQ ID NO: 385087 - RNA, 17 nt, Homo sapiens
gagggcccacuucaggg

SEQ ID NO: 385088 - RNA, 17 nt, Homo sapiens
gagguacugagagugaa

SEQ ID NO: 385089 - RNA, 20 nt, Homo sapiens
gagguggagguugcagugag

SEQ ID NO: 385090 - RNA, 17 nt, Homo sapiens
gagguuugccagcauuu

SEQ ID NO: 385091 - RNA, 13 nt, Homo sapiens
gagucgggacuaa

SEQ ID NO: 385092 - RNA, 17 nt, Homo sapiens
gagucgggacuaaccca

SEQ ID NO: 385093 - RNA, 18 nt, Homo sapiens
gagucucuucuccacugg

SEQ ID NO: 385094 - RNA, 15 nt, Homo sapiens
gagugcaaugaauga

SEQ ID NO: 385095 - RNA, 19 nt, Homo sapiens
gagugcauugugaggguua

SEQ ID NO: 385096 - RNA, 18 nt, Homo sapiens
gagugggguggggagcau

SEQ ID NO: 385097 - RNA, 14 nt, Homo sapiens
gagugugugcaagu

SEQ ID NO: 385098 - RNA, 17 nt, Homo sapiens
gagugugugcaugugug

SEQ ID NO: 385099 - RNA, 21 nt, Homo sapiens
gaguguuccccuuccacugag

SEQ ID NO: 385100 - RNA, 16 nt, Homo sapiens
gaguuaguuugaguua

SEQ ID NO: 385101 - RNA, 21 nt, Homo sapiens
gaguugauucagcucugcaag

SEQ ID NO: 385102 - RNA, 17 nt, Homo sapiens
gaguugucaagucucug

SEQ ID NO: 385103 - RNA, 19 nt, Homo sapiens
gauaaugcuguugccucau

SEQ ID NO: 385104 - RNA, 23 nt, Homo sapiens
gauacacugaaguuaacagagac

SEQ ID NO: 385105 - RNA, 21 nt, Homo sapiens
gauaccucaacccccauuucu

SEQ ID NO: 385106 - RNA, 17 nt, Homo sapiens
gauaguggggucagggc

SEQ ID NO: 385107 - RNA, 22 nt, Homo sapiens
gauauauaaguguacauaugug

SEQ ID NO: 385108 - RNA, 17 nt, Homo sapiens
gauaucaaaagcaaaua

SEQ ID NO: 385109 - RNA, 21 nt, Homo sapiens
gauaucaugccccuguacucc

SEQ ID NO: 385110 - RNA, 17 nt, Homo sapiens
gauaucccuaugcugcc

SEQ ID NO: 385111 - RNA, 13 nt, Homo sapiens
gauaugugccagg

SEQ ID NO: 385112 - RNA, 17 nt, Homo sapiens
gauauguucaacuggag

SEQ ID NO: 385113 - RNA, 13 nt, Homo sapiens
gauauugcagcuu

SEQ ID NO: 385114 - RNA, 13 nt, Homo sapiens
gaucauauuucac

SEQ ID NO: 385115 - RNA, 15 nt, Homo sapiens
gauccacuucucuca

SEQ ID NO: 385116 - RNA, 15 nt, Homo sapiens
gaucccguguugcca

SEQ ID NO: 385117 - RNA, 19 nt, Homo sapiens
gauccuguauugugcccgg

SEQ ID NO: 385118 - RNA, 15 nt, Homo sapiens
gauccuucaaagagu

SEQ ID NO: 385119 - RNA, 22 nt, Homo sapiens
gaucucugcuuuggaaaucaca

SEQ ID NO: 385120 - RNA, 16 nt, Homo sapiens
gaucuuaaagcauucc

SEQ ID NO: 385121 - RNA, 20 nt, Homo sapiens
gaucuuaaagcauuccccaa

SEQ ID NO: 385122 - RNA, 18 nt, Homo sapiens
gaugaaaaugaaucuuca

SEQ ID NO: 385123 - RNA, 19 nt, Homo sapiens
gaugaaaaugaaucuucac

SEQ ID NO: 385124 - RNA, 12 nt, Homo sapiens
gaugaagcuucc

SEQ ID NO: 385125 - RNA, 23 nt, Homo sapiens
gaugaccccuccccuaaugccug

SEQ ID NO: 385126 - RNA, 12 nt, Homo sapiens
gaugagcauuua

SEQ ID NO: 385127 - RNA, 16 nt, Homo sapiens
gaugagccgcugugag

SEQ ID NO: 385128 - RNA, 13 nt, Homo sapiens
gaugauaaaacac

SEQ ID NO: 385129 - RNA, 16 nt, Homo sapiens
gaugauaaaacacaaa

SEQ ID NO: 385130 - RNA, 13 nt, Homo sapiens
gaugaucuacuca

SEQ ID NO: 385131 - RNA, 21 nt, Homo sapiens
gaugaucuggauccaccaaga

SEQ ID NO: 385132 - RNA, 15 nt, Homo sapiens
gaugcagauccagag

SEQ ID NO: 385133 - RNA, 16 nt, Homo sapiens
gaugccagggacccac

SEQ ID NO: 385134 - RNA, 15 nt, Homo sapiens
gauggaagcuuccag

SEQ ID NO: 385135 - RNA, 18 nt, Homo sapiens
gauggaaguugcagugag

SEQ ID NO: 385136 - RNA, 17 nt, Homo sapiens
gauggaauaacucugug

SEQ ID NO: 385137 - RNA, 24 nt, Homo sapiens
gauggagcugcguuuccugugcau

SEQ ID NO: 385138 - RNA, 20 nt, Homo sapiens
gcaacuggcucaaagacaau

SEQ ID NO: 385139 - RNA, 13 nt, Homo sapiens
gcaaggagaaaaa

SEQ ID NO: 385140 - RNA, 19 nt, Homo sapiens
gcaaggagaccaccaacag

SEQ ID NO: 385141 - RNA, 21 nt, Homo sapiens
gcaaguaugugagugugucca

SEQ ID NO: 385142 - RNA, 15 nt, Homo sapiens
gcaagugugugcaca

SEQ ID NO: 385143 - RNA, 21 nt, Homo sapiens
gcaagugugugcacaugugug

SEQ ID NO: 385144 - RNA, 17 nt, Homo sapiens
gcaauacagacuacuuc

SEQ ID NO: 385145 - RNA, 23 nt, Homo sapiens
gcaaucaaguccuacaagcuaaa

SEQ ID NO: 385146 - RNA, 15 nt, Homo sapiens
gcaaugacaucucag

SEQ ID NO: 385147 - RNA, 15 nt, Homo sapiens
gcaaugugacuuaau

SEQ ID NO: 385148 - RNA, 20 nt, Homo sapiens
gcaaugugcccccagacgca

SEQ ID NO: 385149 - RNA, 19 nt, Homo sapiens
gcaauugggauggcgcuag

SEQ ID NO: 385150 - RNA, 22 nt, Homo sapiens
gcacaauuuuaauucaaaagau

SEQ ID NO: 385151 - RNA, 18 nt, Homo sapiens
gcacacagcugcagagac

SEQ ID NO: 385152 - RNA, 22 nt, Homo sapiens
gcacacaggaaggaaagcgcag

SEQ ID NO: 385153 - RNA, 18 nt, Homo sapiens
gcacacuccccugcacug

SEQ ID NO: 385154 - RNA, 18 nt, Homo sapiens
gcacagagagggggccac

SEQ ID NO: 385155 - RNA, 17 nt, Homo sapiens
gcacagggucucuacca

SEQ ID NO: 385156 - RNA, 21 nt, Homo sapiens
gcacauuuccccagaccugag

SEQ ID NO: 385157 - RNA, 15 nt, Homo sapiens
gcaccacuguguauu

SEQ ID NO: 385158 - RNA, 21 nt, Homo sapiens
gcacccuguaucacagacugg

SEQ ID NO: 385159 - RNA, 12 nt, Homo sapiens
gcaccuaccuca

SEQ ID NO: 385160 - RNA, 15 nt, Homo sapiens
gcaccuuuugcacau

SEQ ID NO: 385161 - RNA, 19 nt, Homo sapiens
gcacuacauaaacugacuu

SEQ ID NO: 385162 - RNA, 20 nt, Homo sapiens
gcacuaccacgccaagcuaa

SEQ ID NO: 385163 - RNA, 13 nt, Homo sapiens
gcacucccaaguc

SEQ ID NO: 385164 - RNA, 17 nt, Homo sapiens
uaaaauaagaaugauuu

SEQ ID NO: 385165 - RNA, 19 nt, Homo sapiens
uaaaauauuccugcauuug

SEQ ID NO: 385166 - RNA, 22 nt, Homo sapiens
uaaaaugcuaauuaggcaaaga

SEQ ID NO: 385167 - RNA, 20 nt, Homo sapiens
uaaaauguugaaaagucaaa

SEQ ID NO: 385168 - RNA, 18 nt, Homo sapiens
uaaaauuagaugaacuca

SEQ ID NO: 385169 - RNA, 18 nt, Homo sapiens
uaaaauuaugccauagca

SEQ ID NO: 385170 - RNA, 20 nt, Homo sapiens
uaaaauuuuuugugauuuca

SEQ ID NO: 385171 - RNA, 22 nt, Homo sapiens
uaaaauuuuuugugauuucaau

SEQ ID NO: 385172 - RNA, 16 nt, Homo sapiens
uaaacacgccugcaaa

SEQ ID NO: 385173 - RNA, 18 nt, Homo sapiens
uaaacacggggcuugcaa

SEQ ID NO: 385174 - RNA, 15 nt, Homo sapiens
uaaacaguagugaua

SEQ ID NO: 385175 - RNA, 21 nt, Homo sapiens
uaaacaguagugauaguugua

SEQ ID NO: 385176 - RNA, 16 nt, Homo sapiens
uaaaccucaaaauguc

SEQ ID NO: 385177 - RNA, 14 nt, Homo sapiens
uaaacuucagggau

SEQ ID NO: 385178 - RNA, 22 nt, Homo sapiens
uaaagaaaaagucauccaaucu

SEQ ID NO: 385179 - RNA, 16 nt, Homo sapiens
uaaagaugaucuacuc

SEQ ID NO: 385180 - RNA, 14 nt, Homo sapiens
uaaagcauuuuaca

SEQ ID NO: 385181 - RNA, 14 nt, Homo sapiens
uaaagcuauuuccu

SEQ ID NO: 385182 - RNA, 18 nt, Homo sapiens
uaaagcucaucagcuauc

SEQ ID NO: 385183 - RNA, 16 nt, Homo sapiens
uaaagcugaaaacugc

SEQ ID NO: 385184 - RNA, 18 nt, Homo sapiens
uaaaggcucgauuuugua

SEQ ID NO: 385185 - RNA, 23 nt, Homo sapiens
uaaaggcuugauauuuuccaaau

SEQ ID NO: 385186 - RNA, 22 nt, Homo sapiens
uaaagggagauaacaaucugua

SEQ ID NO: 385187 - RNA, 18 nt, Homo sapiens
uaaaguaugguauugaaa

SEQ ID NO: 385188 - RNA, 19 nt, Homo sapiens
uaaaguauguuauugcaua

SEQ ID NO: 385189 - RNA, 20 nt, Homo sapiens
uaaaguauguuauugcauaa

SEQ ID NO: 385190 - RNA, 15 nt, Homo sapiens
uaaagucacagaauu

SEQ ID NO: 385191 - RNA, 15 nt, Homo sapiens
uaaauaaaucauuaa

SEQ ID NO: 385192 - RNA, 15 nt, Homo sapiens
uaaauaacaaaucuc

SEQ ID NO: 385193 - RNA, 20 nt, Homo sapiens
uaaauauauauaaaccuaaa

SEQ ID NO: 385194 - RNA, 13 nt, Homo sapiens
uaaauccuuccau

SEQ ID NO: 385195 - RNA, 15 nt, Homo sapiens
uaaaucuugcaacug

SEQ ID NO: 385196 - RNA, 15 nt, Homo sapiens
uaaaugaucacucca

SEQ ID NO: 385197 - RNA, 19 nt, Homo sapiens
uaaaugccaggccuggcaa

SEQ ID NO: 385198 - RNA, 18 nt, Homo sapiens
uaaauggauaaguagaau

SEQ ID NO: 385199 - RNA, 20 nt, Homo sapiens
uaaauguaucuuauucacau

SEQ ID NO: 385200 - RNA, 15 nt, Homo sapiens
uaaauguucuaauaa

SEQ ID NO: 385201 - RNA, 19 nt, Homo sapiens
uaaauugcuccuugacauu

SEQ ID NO: 385202 - RNA, 17 nt, Homo sapiens
uaaauuugguucuaggc

SEQ ID NO: 385203 - RNA, 17 nt, Homo sapiens
uaaauuuugaguucuac

SEQ ID NO: 385204 - RNA, 13 nt, Homo sapiens
uaacaacuguggu

SEQ ID NO: 385205 - RNA, 14 nt, Homo sapiens
uaacaaguggguga

SEQ ID NO: 385206 - RNA, 14 nt, Homo sapiens
uaacaccaugauua

SEQ ID NO: 385207 - RNA, 22 nt, Homo sapiens
uaacagaaagccugggugacau

SEQ ID NO: 385208 - RNA, 19 nt, Homo sapiens
uaacaguucacuuuuuaca

SEQ ID NO: 385209 - RNA, 22 nt, Homo sapiens
uaacaucuaaaaauagacuuaa

SEQ ID NO: 385210 - RNA, 20 nt, Homo sapiens
uaacaugcccuguucagcua

SEQ ID NO: 385211 - RNA, 22 nt, Homo sapiens
uaaccgucaauaggcaaagggg

SEQ ID NO: 385212 - RNA, 14 nt, Homo sapiens
uaaccucugcacua

SEQ ID NO: 385213 - RNA, 18 nt, Homo sapiens
uaacgaaugguacuacaa

SEQ ID NO: 385214 - RNA, 16 nt, Homo sapiens
uaacuccagugaagua

SEQ ID NO: 385215 - RNA, 12 nt, Homo sapiens
uaacugcaauuu

SEQ ID NO: 385216 - RNA, 13 nt, Homo sapiens
uaacuuauaucau

SEQ ID NO: 385217 - RNA, 17 nt, Homo sapiens
uaacuuauaucaucagc

SEQ ID NO: 385218 - RNA, 20 nt, Homo sapiens
uaacuucaaggcccauaucu

SEQ ID NO: 385219 - RNA, 21 nt, Homo sapiens
uaacuuggagccccagugcca

SEQ ID NO: 385220 - RNA, 17 nt, Homo sapiens
uaagaaaacaucacuga

SEQ ID NO: 385221 - RNA, 15 nt, Homo sapiens
uaagaaacacacuga

SEQ ID NO: 385222 - RNA, 17 nt, Homo sapiens
uaagacauaaauuacuu

SEQ ID NO: 385223 - RNA, 14 nt, Homo sapiens
uaagacuacuauac

SEQ ID NO: 385224 - RNA, 22 nt, Homo sapiens
uaagagugccguaacaacugug

SEQ ID NO: 385225 - RNA, 18 nt, Homo sapiens
uaagaugaucaucuccag

SEQ ID NO: 385226 - RNA, 22 nt, Homo sapiens
uaagauguguuaggaaugucaa

SEQ ID NO: 385227 - RNA, 18 nt, Homo sapiens
uaagauuuccaagugcca

SEQ ID NO: 385228 - RNA, 15 nt, Homo sapiens
uaagcaaagacuuuc

SEQ ID NO: 385229 - RNA, 17 nt, Homo sapiens
uaagccaagggccucuu

SEQ ID NO: 385230 - RNA, 16 nt, Homo sapiens
uaagggaaacugccag

SEQ ID NO: 385231 - RNA, 20 nt, Homo sapiens
uaagguacuuaaagcuucua

SEQ ID NO: 385232 - RNA, 15 nt, Homo sapiens
uaaggucaaugccag

SEQ ID NO: 385233 - RNA, 20 nt, Homo sapiens
uaaggucacauugugccuuu

SEQ ID NO: 385234 - RNA, 13 nt, Homo sapiens
uaaggugagggaa

SEQ ID NO: 385235 - RNA, 13 nt, Homo sapiens
uaaguaaaaccac

SEQ ID NO: 385236 - RNA, 15 nt, Homo sapiens
uaaguaaugaugucg

SEQ ID NO: 385237 - RNA, 15 nt, Homo sapiens
uaaguuacuucacuu

SEQ ID NO: 385238 - RNA, 13 nt, Homo sapiens
uaauaacugugaa

SEQ ID NO: 385239 - RNA, 18 nt, Homo sapiens
uaauacuccuaagacuua

SEQ ID NO: 385240 - RNA, 19 nt, Homo sapiens
uaauagcuuuuauuguaua

SEQ ID NO: 385241 - RNA, 22 nt, Homo sapiens
uaauauauguauaugcaauaua

SEQ ID NO: 385242 - RNA, 13 nt, Homo sapiens
uaauauggcaaaa

SEQ ID NO: 385243 - RNA, 22 nt, Homo sapiens
uaaucagggaggucauuuuggu

SEQ ID NO: 385244 - RNA, 10 nt, Homo sapiens
uaaucccagc

SEQ ID NO: 385245 - RNA, 14 nt, Homo sapiens
uaaugguguuuuaa

SEQ ID NO: 385246 - RNA, 15 nt, Homo sapiens
uaaugucaccaccuu

SEQ ID NO: 385247 - RNA, 18 nt, Homo sapiens
uaauguguuaagugcagg

SEQ ID NO: 385248 - RNA, 20 nt, Homo sapiens
uaauguuaauucagcacuga

SEQ ID NO: 385249 - RNA, 13 nt, Homo sapiens
uaauguuacauua

SEQ ID NO: 385250 - RNA, 15 nt, Homo sapiens
uaauguuauuuccac

SEQ ID NO: 385251 - RNA, 16 nt, Homo sapiens
uaauuaguaacaugug

SEQ ID NO: 385252 - RNA, 14 nt, Homo sapiens
uaauuaguuccuca

SEQ ID NO: 385253 - RNA, 23 nt, Homo sapiens
uaauucuagagucucuguuacug

SEQ ID NO: 385254 - RNA, 16 nt, Homo sapiens
uaauucuagcuuugag

SEQ ID NO: 385255 - RNA, 14 nt, Homo sapiens
uaauucugucacuc

SEQ ID NO: 385256 - RNA, 19 nt, Homo sapiens
uaauugaucaaauucauuu

SEQ ID NO: 385257 - RNA, 21 nt, Homo sapiens
uaauuucugaaaugugcagcu

SEQ ID NO: 385258 - RNA, 15 nt, Homo sapiens
uacaaaaacacagca

SEQ ID NO: 385259 - RNA, 23 nt, Homo sapiens
uacaacuuuuuaccuaguacaag

SEQ ID NO: 385260 - RNA, 14 nt, Homo sapiens
uacaagaaagcaau

SEQ ID NO: 385261 - RNA, 13 nt, Homo sapiens
uacaaguguauau

SEQ ID NO: 385262 - RNA, 17 nt, Homo sapiens
uacaaucugcacuuuaa

SEQ ID NO: 385263 - RNA, 16 nt, Homo sapiens
uacaauguucauccca

SEQ ID NO: 385264 - RNA, 15 nt, Homo sapiens
uacaauuagccaggu

SEQ ID NO: 385265 - RNA, 12 nt, Homo sapiens
uacaauugugag

SEQ ID NO: 385266 - RNA, 18 nt, Homo sapiens
uacacacuuuuuaagaaa

SEQ ID NO: 385267 - RNA, 15 nt, Homo sapiens
uacagagaaccugga

SEQ ID NO: 385268 - RNA, 19 nt, Homo sapiens
uacagaguuuaugauuuaa

SEQ ID NO: 385269 - RNA, 13 nt, Homo sapiens
uacagaugggcaa

SEQ ID NO: 385270 - RNA, 16 nt, Homo sapiens
uacaguaucucagggc

SEQ ID NO: 385271 - RNA, 22 nt, Homo sapiens
uacaguauuguggcugcacuug

SEQ ID NO: 385272 - RNA, 20 nt, Homo sapiens
uacaguuugagacuuccaaa

SEQ ID NO: 385273 - RNA, 16 nt, Homo sapiens
uacauacuauggaauu

SEQ ID NO: 385274 - RNA, 15 nt, Homo sapiens
uacauaugugaauau

SEQ ID NO: 385275 - RNA, 18 nt, Homo sapiens
uacaucaaugguguguua

SEQ ID NO: 385276 - RNA, 19 nt, Homo sapiens
uacaucaaugguguguuaa

SEQ ID NO: 385277 - RNA, 11 nt, Homo sapiens
uacaucuggcc

SEQ ID NO: 385278 - RNA, 20 nt, Homo sapiens
uacaugacucagcauaccug

SEQ ID NO: 385279 - RNA, 14 nt, Homo sapiens
uacaugcaauuuau

SEQ ID NO: 385280 - RNA, 15 nt, Homo sapiens
uacauguaauccauc

SEQ ID NO: 385281 - RNA, 15 nt, Homo sapiens
uacauuaauuaccuu

SEQ ID NO: 385282 - RNA, 16 nt, Homo sapiens
uaccaaaauuauuuca

SEQ ID NO: 385283 - RNA, 13 nt, Homo sapiens
uaccaaucauuuu

SEQ ID NO: 385284 - RNA, 15 nt, Homo sapiens
uaccacagacuguac

SEQ ID NO: 385285 - RNA, 16 nt, Homo sapiens
uaccagcagcuggaau

SEQ ID NO: 385286 - RNA, 21 nt, Homo sapiens
uaccaguauaauugaguuuuc

SEQ ID NO: 385287 - RNA, 15 nt, Homo sapiens
uaccaucugcaucca

SEQ ID NO: 385288 - RNA, 23 nt, Homo sapiens
uaccccaccacgauguggcccug

SEQ ID NO: 385289 - RNA, 18 nt, Homo sapiens
uacccuuccucaccacuu

SEQ ID NO: 385290 - RNA, 13 nt, Homo sapiens
uaccggcaauuuc

SEQ ID NO: 385291 - RNA, 19 nt, Homo sapiens
uaccuaguagucauuucau

SEQ ID NO: 385292 - RNA, 23 nt, Homo sapiens
uaccucacagagugcauugugag

SEQ ID NO: 385293 - RNA, 20 nt, Homo sapiens
uaccuccuccucuggacaaa

SEQ ID NO: 385294 - RNA, 15 nt, Homo sapiens
uaccucgaguuuuaa

SEQ ID NO: 385295 - RNA, 20 nt, Homo sapiens
uaccugaaauaaaauucauu

SEQ ID NO: 385296 - RNA, 18 nt, Homo sapiens
uaccugaccaacaguucc

SEQ ID NO: 385297 - RNA, 21 nt, Homo sapiens
uaccugcccccaauccaugaa

SEQ ID NO: 385298 - RNA, 21 nt, Homo sapiens
uaccugggcauucuuguuuca

SEQ ID NO: 385299 - RNA, 22 nt, Homo sapiens
uaccuuaaaauguaaaacaaaa

SEQ ID NO: 385300 - RNA, 23 nt, Homo sapiens
uaccuuuguaacggcucuuagca

SEQ ID NO: 385301 - RNA, 13 nt, Homo sapiens
uacgccaggggaa

SEQ ID NO: 385302 - RNA, 19 nt, Homo sapiens
uacguuugaaauaguugau

SEQ ID NO: 385303 - RNA, 14 nt, Homo sapiens
uacuaucaugucaa

SEQ ID NO: 385304 - RNA, 15 nt, Homo sapiens
uacucauacauguua

SEQ ID NO: 385305 - RNA, 14 nt, Homo sapiens
uacucuccaaccug

SEQ ID NO: 385306 - RNA, 19 nt, Homo sapiens
uacugauaaccacuccuaa

SEQ ID NO: 385307 - RNA, 17 nt, Homo sapiens
uacugggacugugcuca

SEQ ID NO: 385308 - RNA, 21 nt, Homo sapiens
uacugggacugugcucagaga

SEQ ID NO: 385309 - RNA, 21 nt, Homo sapiens
uacuguaggcacacuuugcac

SEQ ID NO: 385310 - RNA, 14 nt, Homo sapiens
ccagccuggccaac

SEQ ID NO: 385311 - RNA, 20 nt, Homo sapiens
ccagccugggugacagagca

SEQ ID NO: 385312 - RNA, 21 nt, Homo sapiens
ccagcuacuugggaggcugag

SEQ ID NO: 385313 - RNA, 17 nt, Homo sapiens
ccagcucccauguacca

SEQ ID NO: 385314 - RNA, 16 nt, Homo sapiens
ccagcuccccaagaaa

SEQ ID NO: 385315 - RNA, 24 nt, Homo sapiens
ccagcuggaguucaugucgcaaca

SEQ ID NO: 385316 - RNA, 14 nt, Homo sapiens
ccagcuggccugua

SEQ ID NO: 385317 - RNA, 19 nt, Homo sapiens
ccaggaggcggcagugcaa

SEQ ID NO: 385318 - RNA, 21 nt, Homo sapiens
ccaggaggcggcagugcaaca

SEQ ID NO: 385319 - RNA, 17 nt, Homo sapiens
ccaggcaggugccugga

SEQ ID NO: 385320 - RNA, 17 nt, Homo sapiens
ccaggccaguaagggaa

SEQ ID NO: 385321 - RNA, 20 nt, Homo sapiens
ccaggccgagaugugcaaca

SEQ ID NO: 385322 - RNA, 15 nt, Homo sapiens
ccaggcgaugugcaa

SEQ ID NO: 385323 - RNA, 16 nt, Homo sapiens
ccaggcuggucucaaa

SEQ ID NO: 385324 - RNA, 18 nt, Homo sapiens
ccagggaugacauguccc

SEQ ID NO: 385325 - RNA, 21 nt, Homo sapiens
ccagggccugagccaagcuag

SEQ ID NO: 385326 - RNA, 14 nt, Homo sapiens
ccaggggcugccuc

SEQ ID NO: 385327 - RNA, 15 nt, Homo sapiens
ccaggucucacgggc

SEQ ID NO: 385328 - RNA, 19 nt, Homo sapiens
ccaguccagauauuucaca

SEQ ID NO: 385329 - RNA, 20 nt, Homo sapiens
ccaguccagauauuucacau

SEQ ID NO: 385330 - RNA, 19 nt, Homo sapiens
ccagugagacagcucugca

SEQ ID NO: 385331 - RNA, 19 nt, Homo sapiens
ccagugagauuacagagga

SEQ ID NO: 385332 - RNA, 20 nt, Homo sapiens
ccaguguguuucugaucuga

SEQ ID NO: 385333 - RNA, 13 nt, Homo sapiens
ccauaauguuaca

SEQ ID NO: 385334 - RNA, 14 nt, Homo sapiens
ccauaauguuacau

SEQ ID NO: 385335 - RNA, 18 nt, Homo sapiens
ccauagcagcagugcaug

SEQ ID NO: 385336 - RNA, 18 nt, Homo sapiens
ccauagccaccccagaaa

SEQ ID NO: 385337 - RNA, 18 nt, Homo sapiens
ccauaugaccucaugcau

SEQ ID NO: 385338 - RNA, 23 nt, Homo sapiens
ccaucagcuuaggggcugcugac

SEQ ID NO: 385339 - RNA, 22 nt, Homo sapiens
ccaucauucaugcuacugccaa

SEQ ID NO: 385340 - RNA, 19 nt, Homo sapiens
ccauccaucugcuuacaau

SEQ ID NO: 385341 - RNA, 23 nt, Homo sapiens
ccaucccagcugaaauacugagg

SEQ ID NO: 385342 - RNA, 19 nt, Homo sapiens
ccaucucuacaaaaagcau

SEQ ID NO: 385343 - RNA, 11 nt, Homo sapiens
ccaugagacac

SEQ ID NO: 385344 - RNA, 13 nt, Homo sapiens
ccauggaggcaca

SEQ ID NO: 385345 - RNA, 17 nt, Homo sapiens
ccauguauuuaucucua

SEQ ID NO: 385346 - RNA, 21 nt, Homo sapiens
ccaugucuuuggacaaccaug

SEQ ID NO: 385347 - RNA, 16 nt, Homo sapiens
ccaugugugagugugu

SEQ ID NO: 385348 - RNA, 20 nt, Homo sapiens
ccaugugugagugugugcaa

SEQ ID NO: 385349 - RNA, 21 nt, Homo sapiens
ccaugugugagugugugcaag

SEQ ID NO: 385350 - RNA, 22 nt, Homo sapiens
ccaugugugagugugugcaagu

SEQ ID NO: 385351 - RNA, 16 nt, Homo sapiens
ccaugugugugcaagu

SEQ ID NO: 385352 - RNA, 23 nt, Homo sapiens
cccaacagcacuuagguuuuccu

SEQ ID NO: 385353 - RNA, 21 nt, Homo sapiens
uuaugccuucacuuuacaaau

SEQ ID NO: 385354 - RNA, 16 nt, Homo sapiens
uuaugcuaagugaaau

SEQ ID NO: 385355 - RNA, 23 nt, Homo sapiens
uuauguauuugaaaacucacaga

SEQ ID NO: 385356 - RNA, 17 nt, Homo sapiens
uuauuacauggggucua

SEQ ID NO: 385357 - RNA, 19 nt, Homo sapiens
uuauuacauggggucuaga

SEQ ID NO: 385358 - RNA, 15 nt, Homo sapiens
uuauuaccucugaua

SEQ ID NO: 385359 - RNA, 19 nt, Homo sapiens
uuauuagagugucuuucca

SEQ ID NO: 385360 - RNA, 14 nt, Homo sapiens
uuauucugauucca

SEQ ID NO: 385361 - RNA, 15 nt, Homo sapiens
uuauuuaacuauuca

SEQ ID NO: 385362 - RNA, 21 nt, Homo sapiens
uuauuuggauaucaaaagcaa

SEQ ID NO: 385363 - RNA, 24 nt, Homo sapiens
uucaaacagaacugcagucagcau

SEQ ID NO: 385364 - RNA, 22 nt, Homo sapiens
uucaaagagucauauugcccag

SEQ ID NO: 385365 - RNA, 15 nt, Homo sapiens
uucaaccuacuuuca

SEQ ID NO: 385366 - RNA, 18 nt, Homo sapiens
uucacacuuccaccagcc

SEQ ID NO: 385367 - RNA, 12 nt, Homo sapiens
uucacagugugu

SEQ ID NO: 385368 - RNA, 16 nt, Homo sapiens
uucacaucuaaccuca

SEQ ID NO: 385369 - RNA, 16 nt, Homo sapiens
uucacaugagcuauuu

SEQ ID NO: 385370 - RNA, 23 nt, Homo sapiens
uucaccaauauuucucagacauc

SEQ ID NO: 385371 - RNA, 14 nt, Homo sapiens
uucacucaaucucu

SEQ ID NO: 385372 - RNA, 16 nt, Homo sapiens
uucacucccaaccuga

SEQ ID NO: 385373 - RNA, 14 nt, Homo sapiens
uucacuuuacaaau

SEQ ID NO: 385374 - RNA, 15 nt, Homo sapiens
uucacuuuugacaaa

SEQ ID NO: 385375 - RNA, 21 nt, Homo sapiens
uucacuuuuuacagugcuauu

SEQ ID NO: 385376 - RNA, 13 nt, Homo sapiens
uucagaaagaagu

SEQ ID NO: 385377 - RNA, 22 nt, Homo sapiens
uucagcacugucccuugccuca

SEQ ID NO: 385378 - RNA, 14 nt, Homo sapiens
uucagccaccucuc

SEQ ID NO: 385379 - RNA, 14 nt, Homo sapiens
uucagccaggagau

SEQ ID NO: 385380 - RNA, 13 nt, Homo sapiens
uucagcucuacag

SEQ ID NO: 385381 - RNA, 20 nt, Homo sapiens
uucaggacacagggaaauca

SEQ ID NO: 385382 - RNA, 17 nt, Homo sapiens
uucagggauagcacuga

SEQ ID NO: 385383 - RNA, 23 nt, Homo sapiens
uucagggggccaggugcacagac

SEQ ID NO: 385384 - RNA, 18 nt, Homo sapiens
uucagguauguguguaua

SEQ ID NO: 385385 - RNA, 17 nt, Homo sapiens
uucagugcuguacuuga

SEQ ID NO: 385386 - RNA, 18 nt, Homo sapiens
uucagugcuguacuugau

SEQ ID NO: 385387 - RNA, 13 nt, Homo sapiens
uucagugcuucuu

SEQ ID NO: 385388 - RNA, 23 nt, Homo sapiens
uucauacugaagaugcagcaaaa

SEQ ID NO: 385389 - RNA, 18 nt, Homo sapiens
uucauauauuuguaugau

SEQ ID NO: 385390 - RNA, 20 nt, Homo sapiens
uucauauauuuguaugaucc

SEQ ID NO: 385391 - RNA, 20 nt, Homo sapiens
uucauauguaccauguacau

SEQ ID NO: 385392 - RNA, 18 nt, Homo sapiens
uucaucuauuucugagaa

SEQ ID NO: 385393 - RNA, 15 nt, Homo sapiens
uucaugaucaucaca

SEQ ID NO: 385394 - RNA, 21 nt, Homo sapiens
uucauuaucucaaaacugcac

SEQ ID NO: 385395 - RNA, 14 nt, Homo sapiens
uucauugcauuuau

SEQ ID NO: 385396 - RNA, 18 nt, Homo sapiens
uucauuuaaaaugauuag

SEQ ID NO: 385397 - RNA, 18 nt, Homo sapiens
uucauuuagucaugugac

SEQ ID NO: 385398 - RNA, 23 nt, Homo sapiens
uucauuucagauaaacaacaaau

SEQ ID NO: 385399 - RNA, 14 nt, Homo sapiens
uuccaaaugaauga

SEQ ID NO: 385400 - RNA, 14 nt, Homo sapiens
uuccagaagaucug

SEQ ID NO: 385401 - RNA, 12 nt, Homo sapiens
uuccagauagca

SEQ ID NO: 385402 - RNA, 13 nt, Homo sapiens
uuccagauauuca

SEQ ID NO: 385403 - RNA, 18 nt, Homo sapiens
uuccaggcgaugugcaag

SEQ ID NO: 385404 - RNA, 14 nt, Homo sapiens
uuccaggugcccag

SEQ ID NO: 385405 - RNA, 15 nt, Homo sapiens
uuccauuccaagccu

SEQ ID NO: 385406 - RNA, 18 nt, Homo sapiens
uuccauuucgccccucau

SEQ ID NO: 385407 - RNA, 23 nt, Homo sapiens
uucccaucacuggagcaccaggc

SEQ ID NO: 385408 - RNA, 19 nt, Homo sapiens
uucccggcgucccuaccuc

SEQ ID NO: 385409 - RNA, 20 nt, Homo sapiens
uucccuauuuugccaguggg

SEQ ID NO: 385410 - RNA, 22 nt, Homo sapiens
uucccuguguauucuagugaau

SEQ ID NO: 385411 - RNA, 17 nt, Homo sapiens
uucccuuucacuggcau

SEQ ID NO: 385412 - RNA, 19 nt, Homo sapiens
uuccuaauaugcuuuacaa

SEQ ID NO: 385413 - RNA, 21 nt, Homo sapiens
uuccuagggaugugugagaau

SEQ ID NO: 385414 - RNA, 18 nt, Homo sapiens
uuccucauuagcauuuug

SEQ ID NO: 385415 - RNA, 23 nt, Homo sapiens
uuccucauuagcauuuugcuaaa

SEQ ID NO: 385416 - RNA, 18 nt, Homo sapiens
uuccucgccugacaacca

SEQ ID NO: 385417 - RNA, 23 nt, Homo sapiens
uuccuguugauguucagaaugga

SEQ ID NO: 385418 - RNA, 11 nt, Homo sapiens
uuccuugagaa

SEQ ID NO: 385419 - RNA, 21 nt, Homo sapiens
uuccuugauggagauauuuac

SEQ ID NO: 385420 - RNA, 16 nt, Homo sapiens
uuccuugggaugaucu

SEQ ID NO: 385421 - RNA, 18 nt, Homo sapiens
uuccuuuccuaaaagugu

SEQ ID NO: 385422 - RNA, 20 nt, Homo sapiens
uuccuuuuaaaacacuucca

SEQ ID NO: 385423 - RNA, 17 nt, Homo sapiens
uucuaaaggcuugauau

SEQ ID NO: 385424 - RNA, 23 nt, Homo sapiens
uucuaaaugaauguuuacacucu

SEQ ID NO: 385425 - RNA, 19 nt, Homo sapiens
uucuaaguaaaaccacagc

SEQ ID NO: 385426 - RNA, 19 nt, Homo sapiens
uucuacauacuauggaauu

SEQ ID NO: 385427 - RNA, 16 nt, Homo sapiens
uucucacuccaccacc

SEQ ID NO: 385428 - RNA, 21 nt, Homo sapiens
uucucagguguugccaaauau

SEQ ID NO: 385429 - RNA, 17 nt, Homo sapiens
uucuccuccugucuuua

SEQ ID NO: 385430 - RNA, 22 nt, Homo sapiens
uucucugggccuucucaccaca

SEQ ID NO: 385431 - RNA, 14 nt, Homo sapiens
uucucugguaauau

SEQ ID NO: 385432 - RNA, 22 nt, Homo sapiens
uucucuugagaggguggaauau

SEQ ID NO: 385433 - RNA, 14 nt, Homo sapiens
uucugaaaugugca

SEQ ID NO: 385434 - RNA, 22 nt, Homo sapiens
uucugcagauaaacaguaguga

SEQ ID NO: 385435 - RNA, 19 nt, Homo sapiens
uucugcauuuaaccgucaa

SEQ ID NO: 385436 - RNA, 23 nt, Homo sapiens
uucugccuaucuucuuucacaua

SEQ ID NO: 385437 - RNA, 19 nt, Homo sapiens
uucugcuaccucacugggg

SEQ ID NO: 385438 - RNA, 16 nt, Homo sapiens
uucuggaaaagcaaaa

SEQ ID NO: 385439 - RNA, 18 nt, Homo sapiens
uucugguuuguaaggugg

SEQ ID NO: 385440 - RNA, 15 nt, Homo sapiens
uucuguacucaaaug

SEQ ID NO: 385441 - RNA, 16 nt, Homo sapiens
uucugucucauaugau

SEQ ID NO: 385442 - RNA, 22 nt, Homo sapiens
uucuuaaccccaguaagccacu

SEQ ID NO: 385443 - RNA, 13 nt, Homo sapiens
uucuuaagacaug

SEQ ID NO: 385444 - RNA, 14 nt, Homo sapiens
uucuuauaauauua

SEQ ID NO: 385445 - RNA, 11 nt, Homo sapiens
uucuuccaaaa

SEQ ID NO: 385446 - RNA, 18 nt, Homo sapiens
uucuuugacuuaaugucu

SEQ ID NO: 385447 - RNA, 12 nt, Homo sapiens
uugaacuuggaa

SEQ ID NO: 385448 - RNA, 21 nt, Homo sapiens
uugaaguuuuagcggucaauu

SEQ ID NO: 385449 - RNA, 18 nt, Homo sapiens
uugaauaaagccugcuuu

SEQ ID NO: 385450 - RNA, 21 nt, Homo sapiens
uugaauaaagccugcuuuuua

SEQ ID NO: 385451 - RNA, 23 nt, Homo sapiens
cuucagcucacacaugagaucua

SEQ ID NO: 385452 - RNA, 21 nt, Homo sapiens
cuucaguauguugucaaagag

SEQ ID NO: 385453 - RNA, 22 nt, Homo sapiens
cuucaguauuuuuaaauuguaa

SEQ ID NO: 385454 - RNA, 20 nt, Homo sapiens
cuucauaauuucuucacuca

SEQ ID NO: 385455 - RNA, 21 nt, Homo sapiens
cuucaugaucaucacaaucau

SEQ ID NO: 385456 - RNA, 11 nt, Homo sapiens
cuuccauuugc

SEQ ID NO: 385457 - RNA, 13 nt, Homo sapiens
cuuccccuugccc

SEQ ID NO: 385458 - RNA, 20 nt, Homo sapiens
cuuccuaauaugcuuuacaa

SEQ ID NO: 385459 - RNA, 14 nt, Homo sapiens
cuuccucaccacuu

SEQ ID NO: 385460 - RNA, 20 nt, Homo sapiens
cuuccugaguggugccaaac

SEQ ID NO: 385461 - RNA, 17 nt, Homo sapiens
cuuccuggcuucuuacu

SEQ ID NO: 385462 - RNA, 16 nt, Homo sapiens
cuuccugugacuucag

SEQ ID NO: 385463 - RNA, 20 nt, Homo sapiens
cuuccuugggaugaucuuga

SEQ ID NO: 385464 - RNA, 23 nt, Homo sapiens
cuucgauacaccgggccuggaga

SEQ ID NO: 385465 - RNA, 14 nt, Homo sapiens
cuucuaaucaaagc

SEQ ID NO: 385466 - RNA, 13 nt, Homo sapiens
cuucuagaaccag

SEQ ID NO: 385467 - RNA, 20 nt, Homo sapiens
cuucuaugguugacauugua

SEQ ID NO: 385468 - RNA, 21 nt, Homo sapiens
cuucucacccuaugugggugg

SEQ ID NO: 385469 - RNA, 12 nt, Homo sapiens
cuucucauuucu

SEQ ID NO: 385470 - RNA, 18 nt, Homo sapiens
cuucucuucacagucaca

SEQ ID NO: 385471 - RNA, 14 nt, Homo sapiens
cuucugcaaaaaac

SEQ ID NO: 385472 - RNA, 16 nt, Homo sapiens
cuucuucaccauuugg

SEQ ID NO: 385473 - RNA, 15 nt, Homo sapiens
cuucuuggucucagu

SEQ ID NO: 385474 - RNA, 13 nt, Homo sapiens
cuucuuguucccc

SEQ ID NO: 385475 - RNA, 19 nt, Homo sapiens
cuucuuuuauaacuagucc

SEQ ID NO: 385476 - RNA, 14 nt, Homo sapiens
cuucuuuuccaauu

SEQ ID NO: 385477 - RNA, 21 nt, Homo sapiens
cuugaaaagacaucaagcaca

SEQ ID NO: 385478 - RNA, 23 nt, Homo sapiens
cuugaaaagacaucaagcacaga

SEQ ID NO: 385479 - RNA, 15 nt, Homo sapiens
cuugaaaucaagggc

SEQ ID NO: 385480 - RNA, 19 nt, Homo sapiens
cuugaauuccugaccucag

SEQ ID NO: 385481 - RNA, 23 nt, Homo sapiens
cuugaccaagcaggaagcucaga

SEQ ID NO: 385482 - RNA, 16 nt, Homo sapiens
cuugaccagcagaucc

SEQ ID NO: 385483 - RNA, 14 nt, Homo sapiens
cuugacggcauugc

SEQ ID NO: 385484 - RNA, 14 nt, Homo sapiens
cuugacguggcacu

SEQ ID NO: 385485 - RNA, 21 nt, Homo sapiens
cuugacuuuagucugcaaaau

SEQ ID NO: 385486 - RNA, 19 nt, Homo sapiens
cuugagacaaaucuaugcc

SEQ ID NO: 385487 - RNA, 16 nt, Homo sapiens
cuugauccacuucucu

SEQ ID NO: 385488 - RNA, 12 nt, Homo sapiens
cuugcacaaaca

SEQ ID NO: 385489 - RNA, 20 nt, Homo sapiens
cuugcccagagaugccucca

SEQ ID NO: 385490 - RNA, 18 nt, Homo sapiens
cuugcugccaaaagccuu

SEQ ID NO: 385491 - RNA, 16 nt, Homo sapiens
cuugcugcugagugca

SEQ ID NO: 385492 - RNA, 23 nt, Homo sapiens
cuugcuggacggggacuggggau

SEQ ID NO: 385493 - RNA, 19 nt, Homo sapiens
cuuggaggcugucuucuca

SEQ ID NO: 385494 - RNA, 22 nt, Homo sapiens
cuuggaggcugucuucucaggc

SEQ ID NO: 385495 - RNA, 23 nt, Homo sapiens
cuuggaggcugucuucucaggcu

SEQ ID NO: 385496 - RNA, 15 nt, Homo sapiens
cuuggcagcaccugu

SEQ ID NO: 385497 - RNA, 15 nt, Homo sapiens
cuugugucccaugau

SEQ ID NO: 385498 - RNA, 14 nt, Homo sapiens
cuuguucacacucu

SEQ ID NO: 385499 - RNA, 20 nt, Homo sapiens
cuuuaaaaguauccagagau

SEQ ID NO: 385500 - RNA, 13 nt, Homo sapiens
cuuuaaacucagg

SEQ ID NO: 385501 - RNA, 15 nt, Homo sapiens
cuuuaaacucaggga

SEQ ID NO: 385502 - RNA, 20 nt, Homo sapiens
cuuuaaagggauggcaagau

SEQ ID NO: 385503 - RNA, 15 nt, Homo sapiens
cuuuaaauccuucca

SEQ ID NO: 385504 - RNA, 23 nt, Homo sapiens
cuuuaagcgcaacauuucuuggu

SEQ ID NO: 385505 - RNA, 19 nt, Homo sapiens
cuuuaauucucaugugauc

SEQ ID NO: 385506 - RNA, 20 nt, Homo sapiens
cuuuaauucucaugugaucc

SEQ ID NO: 385507 - RNA, 20 nt, Homo sapiens
cuuuacaaucugcacuuuaa

SEQ ID NO: 385508 - RNA, 21 nt, Homo sapiens
cuuuacaaucugcacuuuaac

SEQ ID NO: 385509 - RNA, 19 nt, Homo sapiens
cuuuacuguuagucauuug

SEQ ID NO: 385510 - RNA, 13 nt, Homo sapiens
cuuuagaaugaga

SEQ ID NO: 385511 - RNA, 19 nt, Homo sapiens
cuuuagagaaguauacaua

SEQ ID NO: 385512 - RNA, 21 nt, Homo sapiens
cuuucaggccacauggcuaaa

SEQ ID NO: 385513 - RNA, 20 nt, Homo sapiens
cuuucauccacuagugcaaa

SEQ ID NO: 385514 - RNA, 20 nt, Homo sapiens
cuuuccucgccugacaacca

SEQ ID NO: 385515 - RNA, 21 nt, Homo sapiens
cuuuccuggacuuaacucuaa

SEQ ID NO: 385516 - RNA, 14 nt, Homo sapiens
cuuugaaugacaaa

SEQ ID NO: 385517 - RNA, 13 nt, Homo sapiens
cuuuggacacuca

SEQ ID NO: 385518 - RNA, 17 nt, Homo sapiens
cuuuguaugcacuuugu

SEQ ID NO: 385519 - RNA, 14 nt, Homo sapiens
gcagggacuugaac

SEQ ID NO: 385520 - RNA, 14 nt, Homo sapiens
gcagggcugacucu

SEQ ID NO: 385521 - RNA, 17 nt, Homo sapiens
gcagugcaacaacccca

SEQ ID NO: 385522 - RNA, 22 nt, Homo sapiens
gcagugcaugggcgcuggucua

SEQ ID NO: 385523 - RNA, 21 nt, Homo sapiens
gcaguuugguccuggggacca

SEQ ID NO: 385524 - RNA, 19 nt, Homo sapiens
gcauagaguucagacuuuu

SEQ ID NO: 385525 - RNA, 20 nt, Homo sapiens
gcauaggcugacuuuugcag

SEQ ID NO: 385526 - RNA, 21 nt, Homo sapiens
gcauauccaccaccucccuca

SEQ ID NO: 385527 - RNA, 18 nt, Homo sapiens
gcauaugaggaugcagag

SEQ ID NO: 385528 - RNA, 15 nt, Homo sapiens
gcaucaaauauuugu

SEQ ID NO: 385529 - RNA, 21 nt, Homo sapiens
gcaucaauuuuucuuauuuca

SEQ ID NO: 385530 - RNA, 15 nt, Homo sapiens
gcaucauuaguacau

SEQ ID NO: 385531 - RNA, 22 nt, Homo sapiens
gcaucauuauuugcagagacag

SEQ ID NO: 385532 - RNA, 17 nt, Homo sapiens
gcaugaauccaguccag

SEQ ID NO: 385533 - RNA, 22 nt, Homo sapiens
gcaugacggcucaugccuguaa

SEQ ID NO: 385534 - RNA, 20 nt, Homo sapiens
gcaugugugcgagugugugc

SEQ ID NO: 385535 - RNA, 12 nt, Homo sapiens
gcauucacccag

SEQ ID NO: 385536 - RNA, 20 nt, Homo sapiens
gcauuuuacaagaucuugca

SEQ ID NO: 385537 - RNA, 13 nt, Homo sapiens
gccaaaagccuuu

SEQ ID NO: 385538 - RNA, 22 nt, Homo sapiens
gccaaagaccaaauuccuuggc

SEQ ID NO: 385539 - RNA, 20 nt, Homo sapiens
gccaaauguuccauaugugg

SEQ ID NO: 385540 - RNA, 16 nt, Homo sapiens
gccaagagaauauccg

SEQ ID NO: 385541 - RNA, 19 nt, Homo sapiens
gccaagagggcugcaaaag

SEQ ID NO: 385542 - RNA, 11 nt, Homo sapiens
gccaagccagu

SEQ ID NO: 385543 - RNA, 18 nt, Homo sapiens
gccaauauuucugauaua

SEQ ID NO: 385544 - RNA, 19 nt, Homo sapiens
gccacaaaacugacaguaa

SEQ ID NO: 385545 - RNA, 16 nt, Homo sapiens
gccacacggcucucac

SEQ ID NO: 385546 - RNA, 22 nt, Homo sapiens
gccacacugugggacucuucuu

SEQ ID NO: 385547 - RNA, 11 nt, Homo sapiens
gccacauggga

SEQ ID NO: 385548 - RNA, 13 nt, Homo sapiens
gccaccccagaaa

SEQ ID NO: 385549 - RNA, 14 nt, Homo sapiens
gccaccugcugcug

SEQ ID NO: 385550 - RNA, 16 nt, Homo sapiens
gccaccugcugcugcu

SEQ ID NO: 385551 - RNA, 16 nt, Homo sapiens
gccacuauuacuggga

SEQ ID NO: 385552 - RNA, 18 nt, Homo sapiens
gccagcaaugacaucuca

SEQ ID NO: 385553 - RNA, 13 nt, Homo sapiens
gccaggcagaucc

SEQ ID NO: 385554 - RNA, 15 nt, Homo sapiens
gccaggcagauccca

SEQ ID NO: 385555 - RNA, 20 nt, Homo sapiens
gccaggcaggugccuggaca

SEQ ID NO: 385556 - RNA, 19 nt, Homo sapiens
gccaggguaguaagaauua

SEQ ID NO: 385557 - RNA, 19 nt, Homo sapiens
gccauaauuacuaugucau

SEQ ID NO: 385558 - RNA, 22 nt, Homo sapiens
gccauaugaaugucaguaguuu

SEQ ID NO: 385559 - RNA, 22 nt, Homo sapiens
gccaugauaacugcaauuuuaa

SEQ ID NO: 385560 - RNA, 15 nt, Homo sapiens
gccauucacugcccc

SEQ ID NO: 385561 - RNA, 23 nt, Homo sapiens
gcccacugaggaaugaugaagcu

SEQ ID NO: 385562 - RNA, 13 nt, Homo sapiens
gcccacuucaggg

SEQ ID NO: 385563 - RNA, 13 nt, Homo sapiens
gcccagcccagcu

SEQ ID NO: 385564 - RNA, 18 nt, Homo sapiens
gcccagcucaugcacauc

SEQ ID NO: 385565 - RNA, 17 nt, Homo sapiens
gcccaggccugccuguu

SEQ ID NO: 385566 - RNA, 15 nt, Homo sapiens
gcccauccaucugcu

SEQ ID NO: 385567 - RNA, 22 nt, Homo sapiens
gccccaugcugcccgcuucuca

SEQ ID NO: 385568 - RNA, 17 nt, Homo sapiens
gcccccaggcugcugga

SEQ ID NO: 385569 - RNA, 18 nt, Homo sapiens
gcccccauuguggucaca

SEQ ID NO: 385570 - RNA, 22 nt, Homo sapiens
gccccucccagaacacacucca

SEQ ID NO: 385571 - RNA, 20 nt, Homo sapiens
gcccugaauccauaaaggca

SEQ ID NO: 385572 - RNA, 14 nt, Homo sapiens
gcccuggauccauc

SEQ ID NO: 385573 - RNA, 18 nt, Homo sapiens
gcccuuccucuccacugc

SEQ ID NO: 385574 - RNA, 16 nt, Homo sapiens
gccgagaugugcaaca

SEQ ID NO: 385575 - RNA, 19 nt, Homo sapiens
gccgcauucccugagucac

SEQ ID NO: 385576 - RNA, 23 nt, Homo sapiens
gccgucaucgcgccacuaagcca

SEQ ID NO: 385577 - RNA, 20 nt, Homo sapiens
gccgugauuuucauugcugg

SEQ ID NO: 385578 - RNA, 17 nt, Homo sapiens
gccuaaaaaugcaacuu

SEQ ID NO: 385579 - RNA, 15 nt, Homo sapiens
gccuaaaaguuacuu

SEQ ID NO: 385580 - RNA, 13 nt, Homo sapiens
gccucaaugccag

SEQ ID NO: 385581 - RNA, 14 nt, Homo sapiens
gccuccaugcugcc

SEQ ID NO: 385582 - RNA, 19 nt, Homo sapiens
gccucccacccccaucucu

SEQ ID NO: 385583 - RNA, 21 nt, Homo sapiens
gccuccucucucaaacugggg

SEQ ID NO: 385584 - RNA, 19 nt, Homo sapiens
gccucugaccccuccucac

SEQ ID NO: 385585 - RNA, 19 nt, Homo sapiens
gccugaaccuuccaucucg

SEQ ID NO: 385586 - RNA, 22 nt, Homo sapiens
gccugaucagcgccgcaccagc

SEQ ID NO: 385587 - RNA, 16 nt, Homo sapiens
gccugauccagccucu

SEQ ID NO: 385588 - RNA, 21 nt, Homo sapiens
gccugcaauuucauaugcugu

SEQ ID NO: 385589 - RNA, 12 nt, Homo sapiens
gccugcaggacc

SEQ ID NO: 385590 - RNA, 20 nt, Homo sapiens
gccugcauguaaacacgccu

SEQ ID NO: 385591 - RNA, 17 nt, Homo sapiens
gccuggacuuuccugca

SEQ ID NO: 385592 - RNA, 20 nt, Homo sapiens
gccuggcagccgugccuuca

SEQ ID NO: 385593 - RNA, 21 nt, Homo sapiens
gccugggcucccuugugcgug

SEQ ID NO: 385594 - RNA, 14 nt, Homo sapiens
gccuguaaucccag

SEQ ID NO: 385595 - RNA, 21 nt, Homo sapiens
gccuguaaucccagcacuuug

SEQ ID NO: 385596 - RNA, 19 nt, Homo sapiens
gccuguaaucccagcuacu

SEQ ID NO: 385597 - RNA, 14 nt, Homo sapiens
gccuuaucuugcac

SEQ ID NO: 385598 - RNA, 15 nt, Homo sapiens
gccuuggcuucaggg

SEQ ID NO: 385599 - RNA, 22 nt, Homo sapiens
gccuugugcgguuguguucuca

SEQ ID NO: 385600 - RNA, 13 nt, Homo sapiens
gccuuucucccag

SEQ ID NO: 385601 - RNA, 14 nt, Homo sapiens
gccuuuuguguuuu

SEQ ID NO: 385602 - RNA, 15 nt, Homo sapiens
gcgaaaccccaucuc

SEQ ID NO: 385603 - RNA, 22 nt, Homo sapiens
gcgcaagccuguaaucccagcu

SEQ ID NO: 385604 - RNA, 17 nt, Homo sapiens
gcgccacuaagccaaga

SEQ ID NO: 385605 - RNA, 22 nt, Homo sapiens
gcgccagccugucccauggaca

SEQ ID NO: 385606 - RNA, 19 nt, Homo sapiens
gcggaccccagcugugagc

SEQ ID NO: 385607 - RNA, 14 nt, Homo sapiens
gcggaguugugcac

SEQ ID NO: 385608 - RNA, 21 nt, Homo sapiens
gcggcgccuccuucuaccacu

SEQ ID NO: 385609 - RNA, 13 nt, Homo sapiens
gcggcuggcagcc

SEQ ID NO: 385610 - RNA, 15 nt, Homo sapiens
gcggucaauuugccu

SEQ ID NO: 385611 - RNA, 16 nt, Homo sapiens
gcguaguccgcuuucu

SEQ ID NO: 385612 - RNA, 13 nt, Homo sapiens
gcgugguggcaca

SEQ ID NO: 385613 - RNA, 14 nt, Homo sapiens
gcgugugugcaagu

SEQ ID NO: 385614 - RNA, 15 nt, Homo sapiens
gcguuuccugugcau

SEQ ID NO: 385615 - RNA, 21 nt, Homo sapiens
gcuaacuuggagccccagugc

SEQ ID NO: 385616 - RNA, 20 nt, Homo sapiens
gcuagugacuugugucccau

SEQ ID NO: 385617 - RNA, 13 nt, Homo sapiens
gcuauaggugcua

SEQ ID NO: 385618 - RNA, 15 nt, Homo sapiens
gcuauuuccauucca

SEQ ID NO: 385619 - RNA, 17 nt, Homo sapiens
gcucacgucacacuugg

SEQ ID NO: 385620 - RNA, 14 nt, Homo sapiens
gcucaggacucaga

SEQ ID NO: 385621 - RNA, 15 nt, Homo sapiens
gcucaggggcgugug

SEQ ID NO: 385622 - RNA, 16 nt, Homo sapiens
gcucauagaucagcaa

SEQ ID NO: 385623 - RNA, 18 nt, Homo sapiens
gcucauauuguucccuau

SEQ ID NO: 385624 - RNA, 13 nt, Homo sapiens
gcucaucauucuc

SEQ ID NO: 385625 - RNA, 15 nt, Homo sapiens
gcucaucauucucug

SEQ ID NO: 385626 - RNA, 11 nt, Homo sapiens
gcuccacugaa

SEQ ID NO: 385627 - RNA, 13 nt, Homo sapiens
gcuccacugucac

SEQ ID NO: 385628 - RNA, 21 nt, Homo sapiens
gcuccagugacugaggggccu

SEQ ID NO: 385629 - RNA, 21 nt, Homo sapiens
gcuccaucgcugucaucucag

SEQ ID NO: 385630 - RNA, 16 nt, Homo sapiens
gcucccugaagccagc

SEQ ID NO: 385631 - RNA, 21 nt, Homo sapiens
gcuccgugcuuguuugcucac

SEQ ID NO: 385632 - RNA, 15 nt, Homo sapiens
gcuccuggggcaaug

SEQ ID NO: 385633 - RNA, 15 nt, Homo sapiens
gcuccugucugccag

SEQ ID NO: 385634 - RNA, 17 nt, Homo sapiens
gcuccuuccugucuucc

SEQ ID NO: 385635 - RNA, 15 nt, Homo sapiens
gcucgagcaguccug

SEQ ID NO: 385636 - RNA, 12 nt, Homo sapiens
gcucucagcuca

SEQ ID NO: 385637 - RNA, 17 nt, Homo sapiens
gcucugaccgaaacagc

SEQ ID NO: 385638 - RNA, 22 nt, Homo sapiens
gcucugcccugcccuagcucca

SEQ ID NO: 385639 - RNA, 19 nt, Homo sapiens
gcucuggugacaccagccu

SEQ ID NO: 385640 - RNA, 14 nt, Homo sapiens
gcucuuucacagcu

SEQ ID NO: 385641 - RNA, 12 nt, Homo sapiens
gcugaacacugg

SEQ ID NO: 385642 - RNA, 18 nt, Homo sapiens
gcugacuguacuccuccc

SEQ ID NO: 385643 - RNA, 14 nt, Homo sapiens
gcugagagacccaa

SEQ ID NO: 385644 - RNA, 19 nt, Homo sapiens
gcugagugcaccacuucaa

SEQ ID NO: 385645 - RNA, 18 nt, Homo sapiens
gcugccagcucuguauca

SEQ ID NO: 385646 - RNA, 16 nt, Homo sapiens
gcugccucuaccugac

SEQ ID NO: 385647 - RNA, 14 nt, Homo sapiens
gcugcugaccucca

SEQ ID NO: 385648 - RNA, 11 nt, Homo sapiens
gcugcugcuaa

SEQ ID NO: 385649 - RNA, 12 nt, Homo sapiens
gcuggaauucua

SEQ ID NO: 385650 - RNA, 19 nt, Homo sapiens
gcuggaauucuaacaaguc

SEQ ID NO: 385651 - RNA, 19 nt, Homo sapiens
gcuggaguucaugucgcaa

SEQ ID NO: 385652 - RNA, 16 nt, Homo sapiens
gcuggcagaaagcaaa

SEQ ID NO: 385653 - RNA, 17 nt, Homo sapiens
gcuguauuuaauggcau

SEQ ID NO: 385654 - RNA, 13 nt, Homo sapiens
gcugucaucucag

SEQ ID NO: 385655 - RNA, 19 nt, Homo sapiens
gcugugaggccccuggaca

SEQ ID NO: 385656 - RNA, 20 nt, Homo sapiens
gcugugaucggccuggggaa

SEQ ID NO: 385657 - RNA, 13 nt, Homo sapiens
gcuuacaaauguc

SEQ ID NO: 385658 - RNA, 16 nt, Homo sapiens
gcuuacaaaugucuag

SEQ ID NO: 385659 - RNA, 21 nt, Homo sapiens
gcuuauacacuuacacuuuau

SEQ ID NO: 385660 - RNA, 15 nt, Homo sapiens
gcuucaaaccccagg

SEQ ID NO: 385661 - RNA, 19 nt, Homo sapiens
gcuucacagaugugugauu

SEQ ID NO: 385662 - RNA, 19 nt, Homo sapiens
caauauugccaugguuuua

SEQ ID NO: 385663 - RNA, 23 nt, Homo sapiens
caauauugucauuccuguauuca

SEQ ID NO: 385664 - RNA, 15 nt, Homo sapiens
caaucagagagcuca

SEQ ID NO: 385665 - RNA, 16 nt, Homo sapiens
caaucagagagcucac

SEQ ID NO: 385666 - RNA, 13 nt, Homo sapiens
caauccuauguuu

SEQ ID NO: 385667 - RNA, 12 nt, Homo sapiens
caauccugugga

SEQ ID NO: 385668 - RNA, 14 nt, Homo sapiens
caaugacaucucag

SEQ ID NO: 385669 - RNA, 15 nt, Homo sapiens
caaugacaucucagg

SEQ ID NO: 385670 - RNA, 23 nt, Homo sapiens
caaugcuauaacuauguugauaa

SEQ ID NO: 385671 - RNA, 16 nt, Homo sapiens
caaugggcacugggau

SEQ ID NO: 385672 - RNA, 15 nt, Homo sapiens
caauguagcugucuc

SEQ ID NO: 385673 - RNA, 14 nt, Homo sapiens
caauuccgcauuua

SEQ ID NO: 385674 - RNA, 13 nt, Homo sapiens
caauuccucuggg

SEQ ID NO: 385675 - RNA, 21 nt, Homo sapiens
caauugucugccucagccucc

SEQ ID NO: 385676 - RNA, 13 nt, Homo sapiens
caauuugccuuuu

SEQ ID NO: 385677 - RNA, 19 nt, Homo sapiens
caauuuguaauugcuuaca

SEQ ID NO: 385678 - RNA, 20 nt, Homo sapiens
cacaaaauguaggguuauaa

SEQ ID NO: 385679 - RNA, 14 nt, Homo sapiens
cacaaaugguagca

SEQ ID NO: 385680 - RNA, 20 nt, Homo sapiens
cacaagcuuuuuuacacaaa

SEQ ID NO: 385681 - RNA, 20 nt, Homo sapiens
cacaauuuuaauucaaaaga

SEQ ID NO: 385682 - RNA, 15 nt, Homo sapiens
cacacacaccacaca

SEQ ID NO: 385683 - RNA, 17 nt, Homo sapiens
cacaccuagcaucucau

SEQ ID NO: 385684 - RNA, 19 nt, Homo sapiens
cacagaaagacugagcuca

SEQ ID NO: 385685 - RNA, 23 nt, Homo sapiens
cacagagugcauugugaggguua

SEQ ID NO: 385686 - RNA, 23 nt, Homo sapiens
cacagcugagagacuuuuaauca

SEQ ID NO: 385687 - RNA, 14 nt, Homo sapiens
cacagggacuugaa

SEQ ID NO: 385688 - RNA, 16 nt, Homo sapiens
cacagguucaugccac

SEQ ID NO: 385689 - RNA, 18 nt, Homo sapiens
cacaguuggcuggaugaa

SEQ ID NO: 385690 - RNA, 12 nt, Homo sapiens
cacauagcacag

SEQ ID NO: 385691 - RNA, 20 nt, Homo sapiens
cacauccucugucuauuuga

SEQ ID NO: 385692 - RNA, 17 nt, Homo sapiens
cacauccugaccuugca

SEQ ID NO: 385693 - RNA, 20 nt, Homo sapiens
cacauccugaccuugcacaa

SEQ ID NO: 385694 - RNA, 13 nt, Homo sapiens
cacaucugcauuu

SEQ ID NO: 385695 - RNA, 18 nt, Homo sapiens
cacauggaacgcuuucau

SEQ ID NO: 385696 - RNA, 14 nt, Homo sapiens
cacauuugauucug

SEQ ID NO: 385697 - RNA, 13 nt, Homo sapiens
caccaaagcuggc

SEQ ID NO: 385698 - RNA, 14 nt, Homo sapiens
caccacagagccuc

SEQ ID NO: 385699 - RNA, 13 nt, Homo sapiens
caccaccccagcu

SEQ ID NO: 385700 - RNA, 22 nt, Homo sapiens
caccaggaggcggcagugcaac

SEQ ID NO: 385701 - RNA, 18 nt, Homo sapiens
caccaucaccagacaggu

SEQ ID NO: 385702 - RNA, 18 nt, Homo sapiens
caccauccugcagccucc

SEQ ID NO: 385703 - RNA, 23 nt, Homo sapiens
caccauggcaccuuuugcacaua

SEQ ID NO: 385704 - RNA, 14 nt, Homo sapiens
cacccaaaagucaa

SEQ ID NO: 385705 - RNA, 14 nt, Homo sapiens
cacccaaugcauau

SEQ ID NO: 385706 - RNA, 23 nt, Homo sapiens
caccccccagaaccuguccuugc

SEQ ID NO: 385707 - RNA, 16 nt, Homo sapiens
caccccucacucuggc

SEQ ID NO: 385708 - RNA, 16 nt, Homo sapiens
caccccuguccucacu

SEQ ID NO: 385709 - RNA, 18 nt, Homo sapiens
cacccuccaccucuucac

SEQ ID NO: 385710 - RNA, 15 nt, Homo sapiens
cacccugaaagcccu

SEQ ID NO: 385711 - RNA, 16 nt, Homo sapiens
cacccuggaggauuuc

SEQ ID NO: 385712 - RNA, 21 nt, Homo sapiens
cacccuuccccuccuucuccc

SEQ ID NO: 385713 - RNA, 23 nt, Homo sapiens
cacccuuugugguuacaguuuga

SEQ ID NO: 385714 - RNA, 15 nt, Homo sapiens
caccuagcaucucau

SEQ ID NO: 385715 - RNA, 23 nt, Homo sapiens
caccuagcaucucaugagugcca

SEQ ID NO: 385716 - RNA, 12 nt, Homo sapiens
caccuagccucg

SEQ ID NO: 385717 - RNA, 13 nt, Homo sapiens
caccucugcacaa

SEQ ID NO: 385718 - RNA, 17 nt, Homo sapiens
caccugaaugugucugc

SEQ ID NO: 385719 - RNA, 13 nt, Homo sapiens
caccugagcagga

SEQ ID NO: 385720 - RNA, 15 nt, Homo sapiens
caccuggguguuaca

SEQ ID NO: 385721 - RNA, 14 nt, Homo sapiens
caccuguaauccca

SEQ ID NO: 385722 - RNA, 14 nt, Homo sapiens
caccuuccaaagga

SEQ ID NO: 385723 - RNA, 14 nt, Homo sapiens
caccuucguuuacu

SEQ ID NO: 385724 - RNA, 19 nt, Homo sapiens
cacgacugcccggcagggu

SEQ ID NO: 385725 - RNA, 21 nt, Homo sapiens
cacgaucucggcucacugcac

SEQ ID NO: 385726 - RNA, 22 nt, Homo sapiens
cacguaguagggucaggccacg

SEQ ID NO: 385727 - RNA, 18 nt, Homo sapiens
cacgugugcacacacacc

SEQ ID NO: 385728 - RNA, 13 nt, Homo sapiens
cacguguggaccc

SEQ ID NO: 385729 - RNA, 20 nt, Homo sapiens
cacuacgugacuguggcaca

SEQ ID NO: 385730 - RNA, 21 nt, Homo sapiens
cacuacucccucaaagcacac

SEQ ID NO: 385731 - RNA, 19 nt, Homo sapiens
cacuauuuaucugugcaaa

SEQ ID NO: 385732 - RNA, 17 nt, Homo sapiens
cacucacagauguuuga

SEQ ID NO: 385733 - RNA, 17 nt, Homo sapiens
cacucagaaucuccuuc

SEQ ID NO: 385734 - RNA, 22 nt, Homo sapiens
cacucagauggaaccgcaggaa

SEQ ID NO: 385735 - RNA, 21 nt, Homo sapiens
cacuccaggauauugacaaga

SEQ ID NO: 385736 - RNA, 14 nt, Homo sapiens
cacuccagugccag

SEQ ID NO: 385737 - RNA, 21 nt, Homo sapiens
cacucccuugguggcaagagc

SEQ ID NO: 385738 - RNA, 17 nt, Homo sapiens
cacucuauuaaaucuug

SEQ ID NO: 385739 - RNA, 22 nt, Homo sapiens
cacugaaaaaucuaagugauau

SEQ ID NO: 385740 - RNA, 13 nt, Homo sapiens
cacugaaaugcua

SEQ ID NO: 385741 - RNA, 15 nt, Homo sapiens
cacugagcaaagcau

SEQ ID NO: 385742 - RNA, 21 nt, Homo sapiens
cacugaggaacucacaauucc

SEQ ID NO: 385743 - RNA, 15 nt, Homo sapiens
cacugauaaaaccau

SEQ ID NO: 385744 - RNA, 15 nt, Homo sapiens
cacugcaagcacugc

SEQ ID NO: 385745 - RNA, 16 nt, Homo sapiens
cacugcagaagacagu

SEQ ID NO: 385746 - RNA, 18 nt, Homo sapiens
cacugccauggaggcaca

SEQ ID NO: 385747 - RNA, 16 nt, Homo sapiens
cacuggaguccagucu

SEQ ID NO: 385748 - RNA, 23 nt, Homo sapiens
cacugggaugagccgcugugagc

SEQ ID NO: 385749 - RNA, 22 nt, Homo sapiens
cacugggcuucuagaaccaggc

SEQ ID NO: 385750 - RNA, 16 nt, Homo sapiens
cacuguccaguauucu

SEQ ID NO: 385751 - RNA, 18 nt, Homo sapiens
cacugucccuugccucaa

SEQ ID NO: 385752 - RNA, 18 nt, Homo sapiens
cacuuacacuuuaugcac

SEQ ID NO: 385753 - RNA, 17 nt, Homo sapiens
cacuuacccacgugcug

SEQ ID NO: 385754 - RNA, 22 nt, Homo sapiens
cacuuacccacgugcuguucca

SEQ ID NO: 385755 - RNA, 18 nt, Homo sapiens
cacuuagcuaucagaaga

SEQ ID NO: 385756 - RNA, 21 nt, Homo sapiens
cacuucuuguuccccacugac

SEQ ID NO: 385757 - RNA, 12 nt, Homo sapiens
cacuugaacccg

SEQ ID NO: 385758 - RNA, 20 nt, Homo sapiens
cacuugccccuguuaccuaa

SEQ ID NO: 385759 - RNA, 14 nt, Homo sapiens
gccgguaaacacgc

SEQ ID NO: 385760 - RNA, 21 nt, Homo sapiens
gccguacucuuuggggcagcu

SEQ ID NO: 385761 - RNA, 23 nt, Homo sapiens
gccguaguggaauuaacaggaaa

SEQ ID NO: 385762 - RNA, 12 nt, Homo sapiens
gccguggcugcg

SEQ ID NO: 385763 - RNA, 18 nt, Homo sapiens
gccucagccauucacugc

SEQ ID NO: 385764 - RNA, 16 nt, Homo sapiens
gccucagccuccugag

SEQ ID NO: 385765 - RNA, 23 nt, Homo sapiens
gccucauauuuaaagacagggaa

SEQ ID NO: 385766 - RNA, 21 nt, Homo sapiens
gccuccaccccccagaaccug

SEQ ID NO: 385767 - RNA, 23 nt, Homo sapiens
gccuccaccccccagaaccuguc

SEQ ID NO: 385768 - RNA, 18 nt, Homo sapiens
gccuccaccgcugccuaa

SEQ ID NO: 385769 - RNA, 23 nt, Homo sapiens
gccucucuacaagcagcaggaaa

SEQ ID NO: 385770 - RNA, 17 nt, Homo sapiens
gccucugccugcauucu

SEQ ID NO: 385771 - RNA, 14 nt, Homo sapiens
gccucuguggcacu

SEQ ID NO: 385772 - RNA, 19 nt, Homo sapiens
gccucuuccucccucauuc

SEQ ID NO: 385773 - RNA, 14 nt, Homo sapiens
gccucuuucaucca

SEQ ID NO: 385774 - RNA, 14 nt, Homo sapiens
gccugaaccuucca

SEQ ID NO: 385775 - RNA, 15 nt, Homo sapiens
gccugaaccuuccau

SEQ ID NO: 385776 - RNA, 13 nt, Homo sapiens
gccugacaaccac

SEQ ID NO: 385777 - RNA, 13 nt, Homo sapiens
gccugcauucugc

SEQ ID NO: 385778 - RNA, 18 nt, Homo sapiens
gccugcccguaaacacgc

SEQ ID NO: 385779 - RNA, 20 nt, Homo sapiens
gccugcccguaaacacgccu

SEQ ID NO: 385780 - RNA, 14 nt, Homo sapiens
gccugccucuucuc

SEQ ID NO: 385781 - RNA, 20 nt, Homo sapiens
gccugcggaguugugcacgu

SEQ ID NO: 385782 - RNA, 19 nt, Homo sapiens
gccuggcaagugggugaaa

SEQ ID NO: 385783 - RNA, 20 nt, Homo sapiens
gccuggccaacauggugaaa

SEQ ID NO: 385784 - RNA, 16 nt, Homo sapiens
gccugggugacauuug

SEQ ID NO: 385785 - RNA, 16 nt, Homo sapiens
gccuggucguuuucaa

SEQ ID NO: 385786 - RNA, 17 nt, Homo sapiens
gccugucuccuuugcag

SEQ ID NO: 385787 - RNA, 18 nt, Homo sapiens
gccugugguuaacaucuc

SEQ ID NO: 385788 - RNA, 18 nt, Homo sapiens
gggaaaauaccccaucau

SEQ ID NO: 385789 - RNA, 21 nt, Homo sapiens
gggaaccaugaagacaggaug

SEQ ID NO: 385790 - RNA, 14 nt, Homo sapiens
gggaagaugagcau

SEQ ID NO: 385791 - RNA, 20 nt, Homo sapiens
gggacagagcagaacuuuca

SEQ ID NO: 385792 - RNA, 15 nt, Homo sapiens
gggacagagccaugc

SEQ ID NO: 385793 - RNA, 21 nt, Homo sapiens
gggacagagccaugcugggaa

SEQ ID NO: 385794 - RNA, 16 nt, Homo sapiens
gggaccacagacucac

SEQ ID NO: 385795 - RNA, 19 nt, Homo sapiens
gggagaaaaaaagggaucu

SEQ ID NO: 385796 - RNA, 18 nt, Homo sapiens
gggagauggaucaaucaa

SEQ ID NO: 385797 - RNA, 20 nt, Homo sapiens
gggagcggaaagcagcucaa

SEQ ID NO: 385798 - RNA, 20 nt, Homo sapiens
gggaggcagagguugcagug

SEQ ID NO: 385799 - RNA, 17 nt, Homo sapiens
gggauuggggaagacug

SEQ ID NO: 385800 - RNA, 21 nt, Homo sapiens
gggcaacaauacaugcugcua

SEQ ID NO: 385801 - RNA, 22 nt, Homo sapiens
gggcacucccuugguggcaaga

SEQ ID NO: 385802 - RNA, 14 nt, Homo sapiens
gggcagucauuauc

SEQ ID NO: 385803 - RNA, 15 nt, Homo sapiens
gggccccaccaccua

SEQ ID NO: 385804 - RNA, 12 nt, Homo sapiens
gggcgcgguggc

SEQ ID NO: 385805 - RNA, 12 nt, Homo sapiens
gggcucagcaaa

SEQ ID NO: 385806 - RNA, 11 nt, Homo sapiens
gggcugugauc

SEQ ID NO: 385807 - RNA, 19 nt, Homo sapiens
gggcuucuagaaccaggca

SEQ ID NO: 385808 - RNA, 12 nt, Homo sapiens
ggggcagcacag

SEQ ID NO: 385809 - RNA, 13 nt, Homo sapiens
ggggcagcacaga

SEQ ID NO: 385810 - RNA, 23 nt, Homo sapiens
ggggcugggcugggcgcgguggu

SEQ ID NO: 385811 - RNA, 10 nt, Homo sapiens
ggggcuuccu

SEQ ID NO: 385812 - RNA, 18 nt, Homo sapiens
ggguccuccacaauaagg

SEQ ID NO: 385813 - RNA, 19 nt, Homo sapiens
gggucucgcuuuguugccc

SEQ ID NO: 385814 - RNA, 21 nt, Homo sapiens
gggucucgcuuuguugcccag

SEQ ID NO: 385815 - RNA, 16 nt, Homo sapiens
gggucuuugaacccuu

SEQ ID NO: 385816 - RNA, 16 nt, Homo sapiens
ggguggaucaccugag

SEQ ID NO: 385817 - RNA, 12 nt, Homo sapiens
gggugggaccac

SEQ ID NO: 385818 - RNA, 14 nt, Homo sapiens
ggguuacuuucaca

SEQ ID NO: 385819 - RNA, 22 nt, Homo sapiens
ggguucaagcaauugucugccu

SEQ ID NO: 385820 - RNA, 15 nt, Homo sapiens
gguaaaaguuacuua

SEQ ID NO: 385821 - RNA, 19 nt, Homo sapiens
gguaauaaguacuguguac

SEQ ID NO: 385822 - RNA, 15 nt, Homo sapiens
gguacuacaaccaau

SEQ ID NO: 385823 - RNA, 14 nt, Homo sapiens
gguagaaaggcagu

SEQ ID NO: 385824 - RNA, 20 nt, Homo sapiens
gguauaaugguugacugggu

SEQ ID NO: 385825 - RNA, 21 nt, Homo sapiens
gguaucauuuucugcauuuaa

SEQ ID NO: 385826 - RNA, 14 nt, Homo sapiens
ggucaagcccagga

SEQ ID NO: 385827 - RNA, 21 nt, Homo sapiens
ggucaucucucacacauucca

SEQ ID NO: 385828 - RNA, 24 nt, Homo sapiens
ggucuaggaacauacuucagcuca

SEQ ID NO: 385829 - RNA, 23 nt, Homo sapiens
ggucugcucuuucucugccagug

SEQ ID NO: 385830 - RNA, 20 nt, Homo sapiens
ggugaaccuuaguaccuaaa

SEQ ID NO: 385831 - RNA, 14 nt, Homo sapiens
ggugacagagcaag

SEQ ID NO: 385832 - RNA, 19 nt, Homo sapiens
ggugacguagaauugaguc

SEQ ID NO: 385833 - RNA, 17 nt, Homo sapiens
gguggagguugcaguga

SEQ ID NO: 385834 - RNA, 23 nt, Homo sapiens
gguggcagaaucuguuaccagag

SEQ ID NO: 385835 - RNA, 18 nt, Homo sapiens
ggugggaccacagacuca

SEQ ID NO: 385836 - RNA, 19 nt, Homo sapiens
ggugggccuccucugucca

SEQ ID NO: 385837 - RNA, 17 nt, Homo sapiens
gguggugggaaccauga

SEQ ID NO: 385838 - RNA, 14 nt, Homo sapiens
ggugugaccacugc

SEQ ID NO: 385839 - RNA, 17 nt, Homo sapiens
gguuaccuuuguuccca

SEQ ID NO: 385840 - RNA, 20 nt, Homo sapiens
gguuaggauuuaacagucau

SEQ ID NO: 385841 - RNA, 19 nt, Homo sapiens
gguucucagguguugccaa

SEQ ID NO: 385842 - RNA, 15 nt, Homo sapiens
gguuuccuuccuugg

SEQ ID NO: 385843 - RNA, 12 nt, Homo sapiens
guaaaacaugcu

SEQ ID NO: 385844 - RNA, 14 nt, Homo sapiens
guaaaaucuuggca

SEQ ID NO: 385845 - RNA, 12 nt, Homo sapiens
guaaacaaugaa

SEQ ID NO: 385846 - RNA, 18 nt, Homo sapiens
guaaacacgccugcaaac

SEQ ID NO: 385847 - RNA, 13 nt, Homo sapiens
guaaaugugcauu

SEQ ID NO: 385848 - RNA, 15 nt, Homo sapiens
guaaauguuuagguu

SEQ ID NO: 385849 - RNA, 18 nt, Homo sapiens
guaacaacuguggucaau

SEQ ID NO: 385850 - RNA, 18 nt, Homo sapiens
guaacaugcaauuuugca

SEQ ID NO: 385851 - RNA, 16 nt, Homo sapiens
guaaccaaauguuggc

SEQ ID NO: 385852 - RNA, 21 nt, Homo sapiens
guaaccaggucguccaagcaa

SEQ ID NO: 385853 - RNA, 20 nt, Homo sapiens
guaacccgcucaucacugga

SEQ ID NO: 385854 - RNA, 21 nt, Homo sapiens
guaacccgcucaucacuggau

SEQ ID NO: 385855 - RNA, 16 nt, Homo sapiens
guaacuccaccaaccc

SEQ ID NO: 385856 - RNA, 15 nt, Homo sapiens
guaauaacugugaag

SEQ ID NO: 385857 - RNA, 16 nt, Homo sapiens
guacaacguguccuca

SEQ ID NO: 385858 - RNA, 23 nt, Homo sapiens
guacaagcuggcggccugcagcg

SEQ ID NO: 385859 - RNA, 18 nt, Homo sapiens
guacaaggcaacauauag

SEQ ID NO: 385860 - RNA, 16 nt, Homo sapiens
guaccgcaaugugacu

SEQ ID NO: 385861 - RNA, 14 nt, Homo sapiens
guaccucucuuaua

SEQ ID NO: 385862 - RNA, 21 nt, Homo sapiens
guacuaauacagacuauguca

SEQ ID NO: 385863 - RNA, 21 nt, Homo sapiens
guacuuagcagcuaucucuca

SEQ ID NO: 385864 - RNA, 22 nt, Homo sapiens
guagagggaguugucaagucuc

SEQ ID NO: 385865 - RNA, 18 nt, Homo sapiens
guagagguuuuguuguuu

SEQ ID NO: 385866 - RNA, 21 nt, Homo sapiens
guagcagauccccagccucug

SEQ ID NO: 385867 - RNA, 15 nt, Homo sapiens
guagcuagccugaga

SEQ ID NO: 385868 - RNA, 19 nt, Homo sapiens
guagcugucuccucuucaa

SEQ ID NO: 385869 - RNA, 13 nt, Homo sapiens
guaggacauacca

SEQ ID NO: 385870 - RNA, 13 nt, Homo sapiens
guaggugucucau

SEQ ID NO: 385871 - RNA, 15 nt, Homo sapiens
guauaaacuaucagu

SEQ ID NO: 385872 - RNA, 18 nt, Homo sapiens
guauaaugguugacuggg

SEQ ID NO: 385873 - RNA, 19 nt, Homo sapiens
guauaaugguugacugggu

SEQ ID NO: 385874 - RNA, 15 nt, Homo sapiens
guauauacaauaaca

SEQ ID NO: 385875 - RNA, 15 nt, Homo sapiens
guaucaaaugugaca

SEQ ID NO: 385876 - RNA, 21 nt, Homo sapiens
guaucaaaugugacauuauau

SEQ ID NO: 385877 - RNA, 24 nt, Homo sapiens
guaucacagacuggcaacaagaag

SEQ ID NO: 385878 - RNA, 23 nt, Homo sapiens
guauccagagauacuacaauauu

SEQ ID NO: 385879 - RNA, 14 nt, Homo sapiens
guaugaaugcagug

SEQ ID NO: 385880 - RNA, 23 nt, Homo sapiens
guaugauccuaaugaaugcauaa

SEQ ID NO: 385881 - RNA, 18 nt, Homo sapiens
guauggaauacaguguua

SEQ ID NO: 385882 - RNA, 22 nt, Homo sapiens
guauggucuuggcagcaccugu

SEQ ID NO: 385883 - RNA, 15 nt, Homo sapiens
guauguuauugcaua

SEQ ID NO: 385884 - RNA, 17 nt, Homo sapiens
guauuaagugugcuuau

SEQ ID NO: 385885 - RNA, 19 nt, Homo sapiens
guauuaggugucauuucca

SEQ ID NO: 385886 - RNA, 20 nt, Homo sapiens
guauuaggugucauuuccau

SEQ ID NO: 385887 - RNA, 17 nt, Homo sapiens
gucaaagugaugaauau

SEQ ID NO: 385888 - RNA, 17 nt, Homo sapiens
gucaauaggcaaagggg

SEQ ID NO: 385889 - RNA, 18 nt, Homo sapiens
gucaauccccucauucag

SEQ ID NO: 385890 - RNA, 18 nt, Homo sapiens
gucaauccgaaguaugag

SEQ ID NO: 385891 - RNA, 21 nt, Homo sapiens
gucacagggccaacuugaggg

SEQ ID NO: 385892 - RNA, 14 nt, Homo sapiens
gucacgcaccuggg

SEQ ID NO: 385893 - RNA, 22 nt, Homo sapiens
gucacuacgugacuguggcaca

SEQ ID NO: 385894 - RNA, 17 nt, Homo sapiens
gucagaguucugcucua

SEQ ID NO: 385895 - RNA, 13 nt, Homo sapiens
gucaggacuguga

SEQ ID NO: 385896 - RNA, 20 nt, Homo sapiens
gucaucgcgccacuaagcca

SEQ ID NO: 385897 - RNA, 19 nt, Homo sapiens
gucauuucaaagacucuca

SEQ ID NO: 385898 - RNA, 21 nt, Homo sapiens
guccaagugugugugcgugug

SEQ ID NO: 385899 - RNA, 15 nt, Homo sapiens
guccagaauucacuu

SEQ ID NO: 385900 - RNA, 17 nt, Homo sapiens
guccagauauuucacau

SEQ ID NO: 385901 - RNA, 17 nt, Homo sapiens
guccagggcuagugacu

SEQ ID NO: 385902 - RNA, 14 nt, Homo sapiens
guccaguauucuac

SEQ ID NO: 385903 - RNA, 18 nt, Homo sapiens
guccagucucuucugcug

SEQ ID NO: 385904 - RNA, 17 nt, Homo sapiens
gucccucacagcacuag

SEQ ID NO: 385905 - RNA, 22 nt, Homo sapiens
gucccuguuagcauaaugugag

SEQ ID NO: 385906 - RNA, 17 nt, Homo sapiens
gucccuugcugugagca

SEQ ID NO: 385907 - RNA, 13 nt, Homo sapiens
guccgagcuuuga

SEQ ID NO: 385908 - RNA, 15 nt, Homo sapiens
guccgaucuuugacu

SEQ ID NO: 385909 - RNA, 19 nt, Homo sapiens
guccuggaaucacauucuu

SEQ ID NO: 385910 - RNA, 14 nt, Homo sapiens
auucuucucucuca

SEQ ID NO: 385911 - RNA, 19 nt, Homo sapiens
auucuuguauauuauggaa

SEQ ID NO: 385912 - RNA, 19 nt, Homo sapiens
auucuuguuuuaagugccu

SEQ ID NO: 385913 - RNA, 15 nt, Homo sapiens
auucuuuuguaauau

SEQ ID NO: 385914 - RNA, 19 nt, Homo sapiens
auugacgacaagugcugaa

SEQ ID NO: 385915 - RNA, 17 nt, Homo sapiens
auugacuaucaaacuga

SEQ ID NO: 385916 - RNA, 13 nt, Homo sapiens
auugacucauaca

SEQ ID NO: 385917 - RNA, 14 nt, Homo sapiens
auugagagugauuc

SEQ ID NO: 385918 - RNA, 16 nt, Homo sapiens
auugagucuuccaggg

SEQ ID NO: 385919 - RNA, 16 nt, Homo sapiens
auugaguuuucagugg

SEQ ID NO: 385920 - RNA, 18 nt, Homo sapiens
auugauagaguguuauca

SEQ ID NO: 385921 - RNA, 18 nt, Homo sapiens
auugauuucaacagaauc

SEQ ID NO: 385922 - RNA, 19 nt, Homo sapiens
auugcacuuuuaaaccucu

SEQ ID NO: 385923 - RNA, 18 nt, Homo sapiens
auugcuaaucaccaaagg

SEQ ID NO: 385924 - RNA, 18 nt, Homo sapiens
auuggaaauuuguuauaa

SEQ ID NO: 385925 - RNA, 15 nt, Homo sapiens
auuggaccuguucaa

SEQ ID NO: 385926 - RNA, 13 nt, Homo sapiens
auuguauaagauu

SEQ ID NO: 385927 - RNA, 20 nt, Homo sapiens
auugucagaguucugcucua

SEQ ID NO: 385928 - RNA, 17 nt, Homo sapiens
auuguccucuuugacua

SEQ ID NO: 385929 - RNA, 18 nt, Homo sapiens
auugugauauuuuuacuu

SEQ ID NO: 385930 - RNA, 19 nt, Homo sapiens
auugugcacauacuugaga

SEQ ID NO: 385931 - RNA, 20 nt, Homo sapiens
auugugccccugcacuccag

SEQ ID NO: 385932 - RNA, 11 nt, Homo sapiens
auugugcucaa

SEQ ID NO: 385933 - RNA, 20 nt, Homo sapiens
auuguguuuugagguuuccu

SEQ ID NO: 385934 - RNA, 16 nt, Homo sapiens
auuguuaaaauaacua

SEQ ID NO: 385935 - RNA, 18 nt, Homo sapiens
auuuaaaagcaucucagc

SEQ ID NO: 385936 - RNA, 21 nt, Homo sapiens
auuuaauaaaugugccuucau

SEQ ID NO: 385937 - RNA, 17 nt, Homo sapiens
auuuacaacaaacaccu

SEQ ID NO: 385938 - RNA, 20 nt, Homo sapiens
auuuacauacucugcuuaga

SEQ ID NO: 385939 - RNA, 21 nt, Homo sapiens
auuuacugaaguuauuuauua

SEQ ID NO: 385940 - RNA, 23 nt, Homo sapiens
auuuaucugugcaaauccuugau

SEQ ID NO: 385941 - RNA, 14 nt, Homo sapiens
auuuauuaccucug

SEQ ID NO: 385942 - RNA, 17 nt, Homo sapiens
auuuauuaccucugaua

SEQ ID NO: 385943 - RNA, 15 nt, Homo sapiens
auuuauuuaagcuua

SEQ ID NO: 385944 - RNA, 13 nt, Homo sapiens
auuuauuuaugua

SEQ ID NO: 385945 - RNA, 21 nt, Homo sapiens
auuucacuugaccccugccca

SEQ ID NO: 385946 - RNA, 19 nt, Homo sapiens
auuucagaucauauuucac

SEQ ID NO: 385947 - RNA, 20 nt, Homo sapiens
auuucagaucauauuucaca

SEQ ID NO: 385948 - RNA, 20 nt, Homo sapiens
auuucauaccuaucaucuua

SEQ ID NO: 385949 - RNA, 20 nt, Homo sapiens
auuucaugauuucauuucaa

SEQ ID NO: 385950 - RNA, 17 nt, Homo sapiens
auuuccuuuuccuucaa

SEQ ID NO: 385951 - RNA, 13 nt, Homo sapiens
auuucucucugac

SEQ ID NO: 385952 - RNA, 11 nt, Homo sapiens
auuucuuugcc

SEQ ID NO: 385953 - RNA, 19 nt, Homo sapiens
auuugaagcaucacauaaa

SEQ ID NO: 385954 - RNA, 13 nt, Homo sapiens
auuugagugcucu

SEQ ID NO: 385955 - RNA, 21 nt, Homo sapiens
auuugcaagggaaaagucucu

SEQ ID NO: 385956 - RNA, 19 nt, Homo sapiens
auuugcauaacaauuccuc

SEQ ID NO: 385957 - RNA, 16 nt, Homo sapiens
auuugcugaauacaga

SEQ ID NO: 385958 - RNA, 20 nt, Homo sapiens
auuuguaauugaacuuaucc

SEQ ID NO: 385959 - RNA, 21 nt, Homo sapiens
auuuuaaugaagaaaguggaa

SEQ ID NO: 385960 - RNA, 13 nt, Homo sapiens
auuuuaauuaucu

SEQ ID NO: 385961 - RNA, 12 nt, Homo sapiens
auuuuauuaaau

SEQ ID NO: 385962 - RNA, 20 nt, Homo sapiens
auuuucagaaaauauuaugu

SEQ ID NO: 385963 - RNA, 15 nt, Homo sapiens
auuuucugcauuuaa

SEQ ID NO: 385964 - RNA, 18 nt, Homo sapiens
auuuugaaaucaugaaga

SEQ ID NO: 385965 - RNA, 20 nt, Homo sapiens
auuuugaguucuacauaagu

SEQ ID NO: 385966 - RNA, 19 nt, Homo sapiens
auuuuguuuuugucuuaaa

SEQ ID NO: 385967 - RNA, 21 nt, Homo sapiens
auuuuguuuuugucuuaaaaa

SEQ ID NO: 385968 - RNA, 19 nt, Homo sapiens
auuuuugaauacaggcaua

SEQ ID NO: 385969 - RNA, 14 nt, Homo sapiens
auuuuugugcacau

SEQ ID NO: 385970 - RNA, 21 nt, Homo sapiens
auuuuuuacagcugccugcag

SEQ ID NO: 385971 - RNA, 20 nt, Homo sapiens
auuuuuuaguauaaguacau

SEQ ID NO: 385972 - RNA, 20 nt, Homo sapiens
caaaaaaaaccuucagugaa

SEQ ID NO: 385973 - RNA, 15 nt, Homo sapiens
caaaacgugcaugga

SEQ ID NO: 385974 - RNA, 19 nt, Homo sapiens
caaaagcacuuugugcugu

SEQ ID NO: 385975 - RNA, 18 nt, Homo sapiens
caaaaguuucuuacucaa

SEQ ID NO: 385976 - RNA, 22 nt, Homo sapiens
caaaaguuucuuacucaaggaa

SEQ ID NO: 385977 - RNA, 16 nt, Homo sapiens
caaaaucacacagcca

SEQ ID NO: 385978 - RNA, 17 nt, Homo sapiens
caaaauuacacaguuaa

SEQ ID NO: 385979 - RNA, 17 nt, Homo sapiens
caaaauuuaugcaaauc

SEQ ID NO: 385980 - RNA, 22 nt, Homo sapiens
caaacagccccucuggacacag

SEQ ID NO: 385981 - RNA, 17 nt, Homo sapiens
caaaccgagugcaauga

SEQ ID NO: 385982 - RNA, 19 nt, Homo sapiens
caaacguuuugaacuaaua

SEQ ID NO: 385983 - RNA, 14 nt, Homo sapiens
caaacuaccuucca

SEQ ID NO: 385984 - RNA, 22 nt, Homo sapiens
caaacugccuauauugauaaaa

SEQ ID NO: 385985 - RNA, 21 nt, Homo sapiens
caaacugccuuggcuucaggg

SEQ ID NO: 385986 - RNA, 21 nt, Homo sapiens
caaacuggggccucccugguc

SEQ ID NO: 385987 - RNA, 21 nt, Homo sapiens
caaagcaggggaguaugcaaa

SEQ ID NO: 385988 - RNA, 23 nt, Homo sapiens
caaagccuccuccagccgccaug

SEQ ID NO: 385989 - RNA, 22 nt, Homo sapiens
caaagcugaugacaacuuccca

SEQ ID NO: 385990 - RNA, 19 nt, Homo sapiens
uaaagagagaugaaccaca

SEQ ID NO: 385991 - RNA, 18 nt, Homo sapiens
uaaagaugaucuacucag

SEQ ID NO: 385992 - RNA, 18 nt, Homo sapiens
uaaagcaauaugcauuua

SEQ ID NO: 385993 - RNA, 21 nt, Homo sapiens
uaaagccaacacccugucuaa

SEQ ID NO: 385994 - RNA, 12 nt, Homo sapiens
uaaaggccucuu

SEQ ID NO: 385995 - RNA, 16 nt, Homo sapiens
uaaagucacagaauua

SEQ ID NO: 385996 - RNA, 15 nt, Homo sapiens
uaaaguguuugccuc

SEQ ID NO: 385997 - RNA, 19 nt, Homo sapiens
uaaauaauguuaucugugu

SEQ ID NO: 385998 - RNA, 22 nt, Homo sapiens
uaaauaguauuugagaguucua

SEQ ID NO: 385999 - RNA, 23 nt, Homo sapiens
uaaauaguauuugagaguucuaa

SEQ ID NO: 386000 - RNA, 14 nt, Homo sapiens
uaaauagugcagaa

SEQ ID NO: 386001 - RNA, 21 nt, Homo sapiens
uaaauaugccuaaaauacuua

SEQ ID NO: 386002 - RNA, 18 nt, Homo sapiens
uaaaucaaauauauguca

SEQ ID NO: 386003 - RNA, 16 nt, Homo sapiens
uaaauccaugcaccua

SEQ ID NO: 386004 - RNA, 19 nt, Homo sapiens
uaaauguaucuuauucaca

SEQ ID NO: 386005 - RNA, 20 nt, Homo sapiens
uaaauguggagaaacuguag

SEQ ID NO: 386006 - RNA, 19 nt, Homo sapiens
uaaauuacuuuuucauucu

SEQ ID NO: 386007 - RNA, 20 nt, Homo sapiens
uaaauuacuuuuucauucuu

SEQ ID NO: 386008 - RNA, 13 nt, Homo sapiens
uaaauuauaucaa

SEQ ID NO: 386009 - RNA, 15 nt, Homo sapiens
uaaauuucaucucag

SEQ ID NO: 386010 - RNA, 19 nt, Homo sapiens
uaacaaacuacauguaauc

SEQ ID NO: 386011 - RNA, 14 nt, Homo sapiens
uaacaaacucugag

SEQ ID NO: 386012 - RNA, 14 nt, Homo sapiens
uaacaacuaugauu

SEQ ID NO: 386013 - RNA, 11 nt, Homo sapiens
uaacaaugaag

SEQ ID NO: 386014 - RNA, 18 nt, Homo sapiens
uaacaggauauuuaauga

SEQ ID NO: 386015 - RNA, 16 nt, Homo sapiens
uaacaggauuagacag

SEQ ID NO: 386016 - RNA, 15 nt, Homo sapiens
uaacagucauuuaaa

SEQ ID NO: 386017 - RNA, 17 nt, Homo sapiens
uaacaugcaauuuugca

SEQ ID NO: 386018 - RNA, 18 nt, Homo sapiens
uaaccucugcacuacuga

SEQ ID NO: 386019 - RNA, 13 nt, Homo sapiens
uaacuuguuucca

SEQ ID NO: 386020 - RNA, 14 nt, Homo sapiens
uaacuuguuuccaa

SEQ ID NO: 386021 - RNA, 16 nt, Homo sapiens
uaacuuucucuaugaa

SEQ ID NO: 386022 - RNA, 19 nt, Homo sapiens
uaacuuuuuaaaacacaac

SEQ ID NO: 386023 - RNA, 14 nt, Homo sapiens
uaagaaaacuaaga

SEQ ID NO: 386024 - RNA, 24 nt, Homo sapiens
uaagaguggaaccaacacuaacau

SEQ ID NO: 386025 - RNA, 15 nt, Homo sapiens
uaagauuagaaugaa

SEQ ID NO: 386026 - RNA, 15 nt, Homo sapiens
uaagccacugccaca

SEQ ID NO: 386027 - RNA, 20 nt, Homo sapiens
uaaggguuaguuuacaauca

SEQ ID NO: 386028 - RNA, 22 nt, Homo sapiens
uaaguagggacuucugucuuca

SEQ ID NO: 386029 - RNA, 17 nt, Homo sapiens
uaagucaaccugccuga

SEQ ID NO: 386030 - RNA, 13 nt, Homo sapiens
uaaguuucacuga

SEQ ID NO: 386031 - RNA, 20 nt, Homo sapiens
uaauaacaacagaucugcag

SEQ ID NO: 386032 - RNA, 21 nt, Homo sapiens
uaauaacugugaaguuuacau

SEQ ID NO: 386033 - RNA, 13 nt, Homo sapiens
uaauaauugauca

SEQ ID NO: 386034 - RNA, 20 nt, Homo sapiens
uaauacugaaggacacagca

SEQ ID NO: 386035 - RNA, 15 nt, Homo sapiens
uaauauaacugccuu

SEQ ID NO: 386036 - RNA, 13 nt, Homo sapiens
uaauauacuuuaa

SEQ ID NO: 386037 - RNA, 16 nt, Homo sapiens
uaauauugacuuguau

SEQ ID NO: 386038 - RNA, 21 nt, Homo sapiens
uaaucagacaaaguaauuccu

SEQ ID NO: 386039 - RNA, 15 nt, Homo sapiens
uaaucccagcacuuu

SEQ ID NO: 386040 - RNA, 20 nt, Homo sapiens
uaaucccagcuacuugggag

SEQ ID NO: 386041 - RNA, 22 nt, Homo sapiens
uaaucuggacuccucuguccag

SEQ ID NO: 386042 - RNA, 19 nt, Homo sapiens
uaaucuuccauacuucuuc

SEQ ID NO: 386043 - RNA, 13 nt, Homo sapiens
uaaugaaugcaua

SEQ ID NO: 386044 - RNA, 22 nt, Homo sapiens
uaaugagauaaugugauauuau

SEQ ID NO: 386045 - RNA, 23 nt, Homo sapiens
uaaugaugucguuugaaucacag

SEQ ID NO: 386046 - RNA, 20 nt, Homo sapiens
uaaugauugacguacuuagc

SEQ ID NO: 386047 - RNA, 17 nt, Homo sapiens
uaaugcuguugccucau

SEQ ID NO: 386048 - RNA, 19 nt, Homo sapiens
uaauguauuuguuugcaau

SEQ ID NO: 386049 - RNA, 21 nt, Homo sapiens
uaauguauuuguuugcaauuu

SEQ ID NO: 386050 - RNA, 22 nt, Homo sapiens
uaauguuguaauucaugccagg

SEQ ID NO: 386051 - RNA, 16 nt, Homo sapiens
uaauucaaaagaucaa

SEQ ID NO: 386052 - RNA, 21 nt, Homo sapiens
uaauugauuauucugauucca

SEQ ID NO: 386053 - RNA, 14 nt, Homo sapiens
uaauuuaaugcaug

SEQ ID NO: 386054 - RNA, 15 nt, Homo sapiens
uacaaaaaacaacaa

SEQ ID NO: 386055 - RNA, 14 nt, Homo sapiens
uacaaaguauuugc

SEQ ID NO: 386056 - RNA, 15 nt, Homo sapiens
uacaaccaauuccaa

SEQ ID NO: 386057 - RNA, 19 nt, Homo sapiens
uacaaucagccacauucua

SEQ ID NO: 386058 - RNA, 20 nt, Homo sapiens
uacaaucagccacauucuag

SEQ ID NO: 386059 - RNA, 18 nt, Homo sapiens
uacaauuguaaaacugag

SEQ ID NO: 386060 - RNA, 16 nt, Homo sapiens
uacacagaugaaggug

SEQ ID NO: 386061 - RNA, 20 nt, Homo sapiens
uacagaaucaaaugcaauuu

SEQ ID NO: 386062 - RNA, 18 nt, Homo sapiens
uacagauagucaaaccau

SEQ ID NO: 386063 - RNA, 20 nt, Homo sapiens
uacaggcauagaguucagac

SEQ ID NO: 386064 - RNA, 22 nt, Homo sapiens
uacaguaggagcccagcucuga

SEQ ID NO: 386065 - RNA, 18 nt, Homo sapiens
uacagucuuccauuugca

SEQ ID NO: 386066 - RNA, 15 nt, Homo sapiens
uacaugaauugcauu

SEQ ID NO: 386067 - RNA, 16 nt, Homo sapiens
uacauguaauccauca

SEQ ID NO: 386068 - RNA, 14 nt, Homo sapiens
uacauguauugcac

SEQ ID NO: 386069 - RNA, 16 nt, Homo sapiens
uacauguauugcacau

SEQ ID NO: 386070 - RNA, 20 nt, Homo sapiens
uacauucugcaagcacaucu

SEQ ID NO: 386071 - RNA, 14 nt, Homo sapiens
uaccaaucauuuua

SEQ ID NO: 386072 - RNA, 12 nt, Homo sapiens
uaccacacagcc

SEQ ID NO: 386073 - RNA, 22 nt, Homo sapiens
uaccaggccgccccagccucug

SEQ ID NO: 386074 - RNA, 15 nt, Homo sapiens
uacccagggccugca

SEQ ID NO: 386075 - RNA, 13 nt, Homo sapiens
uaccccaccacga

SEQ ID NO: 386076 - RNA, 15 nt, Homo sapiens
uaccuaucaucuuaa

SEQ ID NO: 386077 - RNA, 19 nt, Homo sapiens
uaccucacagagugcauug

SEQ ID NO: 386078 - RNA, 14 nt, Homo sapiens
uaccuccugagaaa

SEQ ID NO: 386079 - RNA, 17 nt, Homo sapiens
uaccucugauaccucaa

SEQ ID NO: 386080 - RNA, 17 nt, Homo sapiens
uaccuugaacacugggg

SEQ ID NO: 386081 - RNA, 17 nt, Homo sapiens
uaccuugagccaguaau

SEQ ID NO: 386082 - RNA, 20 nt, Homo sapiens
uacgcuccaucgcugucauc

SEQ ID NO: 386083 - RNA, 17 nt, Homo sapiens
uacgugacuguggcaca

SEQ ID NO: 386084 - RNA, 15 nt, Homo sapiens
uacuacacauucaau

SEQ ID NO: 386085 - RNA, 20 nt, Homo sapiens
uacucuaucagagaaaaaca

SEQ ID NO: 386086 - RNA, 23 nt, Homo sapiens
uacugcaaaugcuauauugcacu

SEQ ID NO: 386087 - RNA, 14 nt, Homo sapiens
uacuggcaauuugu

SEQ ID NO: 386088 - RNA, 17 nt, Homo sapiens
uacuuagcagcuaucuc

SEQ ID NO: 386089 - RNA, 23 nt, Homo sapiens
uacuugagugguguguguuauca

SEQ ID NO: 386090 - RNA, 20 nt, Homo sapiens
uacuuucucuagggagaaaa

SEQ ID NO: 386091 - RNA, 16 nt, Homo sapiens
uagaaagcaggggcua

SEQ ID NO: 386092 - RNA, 16 nt, Homo sapiens
uagaaauaauaugcau

SEQ ID NO: 386093 - RNA, 17 nt, Homo sapiens
uagaacagauaaucagu

SEQ ID NO: 386094 - RNA, 13 nt, Homo sapiens
uagaaccaggcaa

SEQ ID NO: 386095 - RNA, 18 nt, Homo sapiens
uagaacuauuaaaacagc

SEQ ID NO: 386096 - RNA, 19 nt, Homo sapiens
uagaacucagagccagauc

SEQ ID NO: 386097 - RNA, 21 nt, Homo sapiens
uagaagcuguaguagcccuuu

SEQ ID NO: 386098 - RNA, 16 nt, Homo sapiens
uagaauagauauccac

SEQ ID NO: 386099 - RNA, 23 nt, Homo sapiens
uagaauauuuauuaccucugaua

SEQ ID NO: 386100 - RNA, 13 nt, Homo sapiens
uagaauuuauuca

SEQ ID NO: 386101 - RNA, 20 nt, Homo sapiens
uagaccagaaccagagcuca

SEQ ID NO: 386102 - RNA, 23 nt, Homo sapiens
uagacccgaggaaacucagaguc

SEQ ID NO: 386103 - RNA, 17 nt, Homo sapiens
uagacuucugcuuucca

SEQ ID NO: 386104 - RNA, 19 nt, Homo sapiens
uagacuucugcuuuccaca

SEQ ID NO: 386105 - RNA, 19 nt, Homo sapiens
uagacuuucuuaucacuua

SEQ ID NO: 386106 - RNA, 18 nt, Homo sapiens
uagagauuaccuccugag

SEQ ID NO: 386107 - RNA, 21 nt, Homo sapiens
uagaggggcucugggagacuu

SEQ ID NO: 386108 - RNA, 14 nt, Homo sapiens
uagaguauaugcac

SEQ ID NO: 386109 - RNA, 15 nt, Homo sapiens
uagaguucagacuuu

SEQ ID NO: 386110 - RNA, 16 nt, Homo sapiens
uagaguucagacuuuu

SEQ ID NO: 386111 - RNA, 14 nt, Homo sapiens
uagauuaaacaaac

SEQ ID NO: 386112 - RNA, 15 nt, Homo sapiens
uagauuaaacaaaca

SEQ ID NO: 386113 - RNA, 17 nt, Homo sapiens
uagcacuauuuacauac

SEQ ID NO: 386114 - RNA, 22 nt, Homo sapiens
uagcagcagggagggcuucugc

SEQ ID NO: 386115 - RNA, 16 nt, Homo sapiens
uagcagcagugcaugg

SEQ ID NO: 386116 - RNA, 16 nt, Homo sapiens
uagccaggauccacaa

SEQ ID NO: 386117 - RNA, 15 nt, Homo sapiens
uagccagggggacua

SEQ ID NO: 386118 - RNA, 19 nt, Homo sapiens
uagccaugauaacugcaau

SEQ ID NO: 386119 - RNA, 22 nt, Homo sapiens
uagcccacaguucuccauuuca

SEQ ID NO: 386120 - RNA, 14 nt, Homo sapiens
uagcccacucugcu

SEQ ID NO: 386121 - RNA, 14 nt, Homo sapiens
uagccgaccucagc

SEQ ID NO: 386122 - RNA, 22 nt, Homo sapiens
uagccugccucuucucuacucu

SEQ ID NO: 386123 - RNA, 13 nt, Homo sapiens
uagcggucaauuu

SEQ ID NO: 386124 - RNA, 16 nt, Homo sapiens
uagcuuagaccucagc

SEQ ID NO: 386125 - RNA, 20 nt, Homo sapiens
uagcuuguauaguguaaaau

SEQ ID NO: 386126 - RNA, 16 nt, Homo sapiens
uagcuuuagggcaaua

SEQ ID NO: 386127 - RNA, 20 nt, Homo sapiens
uagcuuucccaaauaaacuc

SEQ ID NO: 386128 - RNA, 20 nt, Homo sapiens
uaggagggcuggcaacuuag

SEQ ID NO: 386129 - RNA, 15 nt, Homo sapiens
uaggauaucuuggcu

SEQ ID NO: 386130 - RNA, 14 nt, Homo sapiens
uaggcauuugcuga

SEQ ID NO: 386131 - RNA, 14 nt, Homo sapiens
uagggaaaaaccag

SEQ ID NO: 386132 - RNA, 13 nt, Homo sapiens
uagggagacaaca

SEQ ID NO: 386133 - RNA, 14 nt, Homo sapiens
uagggaucccucau

SEQ ID NO: 386134 - RNA, 24 nt, Homo sapiens
uagggauuuuuggcuacacacaaa

SEQ ID NO: 386135 - RNA, 16 nt, Homo sapiens
uagggcaacaauacau

SEQ ID NO: 386136 - RNA, 23 nt, Homo sapiens
agaagccucugggucaguggucc

SEQ ID NO: 386137 - RNA, 23 nt, Homo sapiens
agaagcuaaauccuuuacuguua

SEQ ID NO: 386138 - RNA, 17 nt, Homo sapiens
agaagguuuacucugug

SEQ ID NO: 386139 - RNA, 20 nt, Homo sapiens
agaauauacuaaauuaacuu

SEQ ID NO: 386140 - RNA, 13 nt, Homo sapiens
agaauaucuggga

SEQ ID NO: 386141 - RNA, 13 nt, Homo sapiens
agaaucaaaugca

SEQ ID NO: 386142 - RNA, 13 nt, Homo sapiens
agaaucacuugaa

SEQ ID NO: 386143 - RNA, 14 nt, Homo sapiens
agaaucacuugaac

SEQ ID NO: 386144 - RNA, 16 nt, Homo sapiens
agaaucacuugaaccc

SEQ ID NO: 386145 - RNA, 21 nt, Homo sapiens
agaaucccuaagccuagcugg

SEQ ID NO: 386146 - RNA, 15 nt, Homo sapiens
agaauggaaggugga

SEQ ID NO: 386147 - RNA, 19 nt, Homo sapiens
agaauugcuugaacccagg

SEQ ID NO: 386148 - RNA, 18 nt, Homo sapiens
agaauuugagugcucuga

SEQ ID NO: 386149 - RNA, 22 nt, Homo sapiens
agacaaugugaaaagaaaaaug

SEQ ID NO: 386150 - RNA, 18 nt, Homo sapiens
agacaccaaguuccguca

SEQ ID NO: 386151 - RNA, 14 nt, Homo sapiens
agacagaaagcaga

SEQ ID NO: 386152 - RNA, 22 nt, Homo sapiens
agacagaaagcagaacagugau

SEQ ID NO: 386153 - RNA, 18 nt, Homo sapiens
agacaggguuuggcugug

SEQ ID NO: 386154 - RNA, 16 nt, Homo sapiens
agacauaaauuacuuu

SEQ ID NO: 386155 - RNA, 14 nt, Homo sapiens
agacauccauguuu

SEQ ID NO: 386156 - RNA, 15 nt, Homo sapiens
agacaugugcacuug

SEQ ID NO: 386157 - RNA, 19 nt, Homo sapiens
agacauucuuccaaaaaga

SEQ ID NO: 386158 - RNA, 21 nt, Homo sapiens
agaccacaaaaauugacucaa

SEQ ID NO: 386159 - RNA, 14 nt, Homo sapiens
agaccacugauaaa

SEQ ID NO: 386160 - RNA, 23 nt, Homo sapiens
agacccuugacaccugcugagaa

SEQ ID NO: 386161 - RNA, 16 nt, Homo sapiens
agaccugugugccagg

SEQ ID NO: 386162 - RNA, 17 nt, Homo sapiens
agaccuuuggagcaaag

SEQ ID NO: 386163 - RNA, 15 nt, Homo sapiens
agacuaugucaccca

SEQ ID NO: 386164 - RNA, 17 nt, Homo sapiens
agacucacauccugacc

SEQ ID NO: 386165 - RNA, 13 nt, Homo sapiens
agacuccaugaga

SEQ ID NO: 386166 - RNA, 14 nt, Homo sapiens
agacuccgucucaa

SEQ ID NO: 386167 - RNA, 15 nt, Homo sapiens
agacuccugugcaac

SEQ ID NO: 386168 - RNA, 14 nt, Homo sapiens
agacucugucucag

SEQ ID NO: 386169 - RNA, 13 nt, Homo sapiens
agacuucccugaa

SEQ ID NO: 386170 - RNA, 14 nt, Homo sapiens
agagaacaacuacu

SEQ ID NO: 386171 - RNA, 20 nt, Homo sapiens
agagaagauagcagggcaug

SEQ ID NO: 386172 - RNA, 23 nt, Homo sapiens
agagacagaaagcagaacaguga

SEQ ID NO: 386173 - RNA, 18 nt, Homo sapiens
agagacaggacuagcugg

SEQ ID NO: 386174 - RNA, 19 nt, Homo sapiens
agagagcaacucugagauc

SEQ ID NO: 386175 - RNA, 16 nt, Homo sapiens
agagauggccugagaa

SEQ ID NO: 386176 - RNA, 23 nt, Homo sapiens
agagcagcuuuaaacucagggac

SEQ ID NO: 386177 - RNA, 17 nt, Homo sapiens
agagcaggaagcauuca

SEQ ID NO: 386178 - RNA, 14 nt, Homo sapiens
agagcuucccugac

SEQ ID NO: 386179 - RNA, 14 nt, Homo sapiens
agaggaacugucca

SEQ ID NO: 386180 - RNA, 21 nt, Homo sapiens
agaggaaugaaguacucauac

SEQ ID NO: 386181 - RNA, 18 nt, Homo sapiens
aguuggaagugugugauc

SEQ ID NO: 386182 - RNA, 12 nt, Homo sapiens
aguugugcacau

SEQ ID NO: 386183 - RNA, 16 nt, Homo sapiens
aguuuacaaucagcca

SEQ ID NO: 386184 - RNA, 15 nt, Homo sapiens
aguuuauugacaaua

SEQ ID NO: 386185 - RNA, 17 nt, Homo sapiens
aguuuauugacaauaau

SEQ ID NO: 386186 - RNA, 15 nt, Homo sapiens
aguuucaucagucaa

SEQ ID NO: 386187 - RNA, 14 nt, Homo sapiens
aguuucccuaucuc

SEQ ID NO: 386188 - RNA, 19 nt, Homo sapiens
aguuugagaccaaccuggg

SEQ ID NO: 386189 - RNA, 16 nt, Homo sapiens
aguuugagaccagccu

SEQ ID NO: 386190 - RNA, 17 nt, Homo sapiens
aguuuuugauagcuuua

SEQ ID NO: 386191 - RNA, 14 nt, Homo sapiens
auaaaaaacauaau

SEQ ID NO: 386192 - RNA, 12 nt, Homo sapiens
auaaaaacccaa

SEQ ID NO: 386193 - RNA, 16 nt, Homo sapiens
auaaaaacccaauuca

SEQ ID NO: 386194 - RNA, 13 nt, Homo sapiens
auaaaacuuuccu

SEQ ID NO: 386195 - RNA, 15 nt, Homo sapiens
auaaaaucagaguug

SEQ ID NO: 386196 - RNA, 21 nt, Homo sapiens
auaaaauguugaaaagucaaa

SEQ ID NO: 386197 - RNA, 14 nt, Homo sapiens
auaaaauuagcuug

SEQ ID NO: 386198 - RNA, 20 nt, Homo sapiens
auaaaauuaugccauagcaa

SEQ ID NO: 386199 - RNA, 18 nt, Homo sapiens
auaaacaguagugauagu

SEQ ID NO: 386200 - RNA, 17 nt, Homo sapiens
auaaacguccuacugua

SEQ ID NO: 386201 - RNA, 15 nt, Homo sapiens
auaaacuucagggau

SEQ ID NO: 386202 - RNA, 22 nt, Homo sapiens
auaaagcacccuguaucacaga

SEQ ID NO: 386203 - RNA, 17 nt, Homo sapiens
auaaaguuggugacaga

SEQ ID NO: 386204 - RNA, 14 nt, Homo sapiens
auaaauuugguucu

SEQ ID NO: 386205 - RNA, 14 nt, Homo sapiens
auaaccacuccuaa

SEQ ID NO: 386206 - RNA, 18 nt, Homo sapiens
auaagauggaagcuucca

SEQ ID NO: 386207 - RNA, 20 nt, Homo sapiens
auaagcuauagacccgagga

SEQ ID NO: 386208 - RNA, 13 nt, Homo sapiens
auaaguacauuau

SEQ ID NO: 386209 - RNA, 14 nt, Homo sapiens
auaaguagaauuaa

SEQ ID NO: 386210 - RNA, 16 nt, Homo sapiens
auaaguuaacuuccaa

SEQ ID NO: 386211 - RNA, 23 nt, Homo sapiens
auaauacauugaauuagaaacau

SEQ ID NO: 386212 - RNA, 16 nt, Homo sapiens
auaaucagugugucua

SEQ ID NO: 386213 - RNA, 18 nt, Homo sapiens
auaaugcuguugccucau

SEQ ID NO: 386214 - RNA, 16 nt, Homo sapiens
auaauguuacauuauu

SEQ ID NO: 386215 - RNA, 21 nt, Homo sapiens
auaauguuacauuauuaucaa

SEQ ID NO: 386216 - RNA, 22 nt, Homo sapiens
auaauguuaucuguguagcaag

SEQ ID NO: 386217 - RNA, 21 nt, Homo sapiens
auaauuaaauuuugaguucua

SEQ ID NO: 386218 - RNA, 20 nt, Homo sapiens
auacaaacuacagaguuuau

SEQ ID NO: 386219 - RNA, 19 nt, Homo sapiens
auacaagaaagcaaugcca

SEQ ID NO: 386220 - RNA, 15 nt, Homo sapiens
auacacuuacacuuu

SEQ ID NO: 386221 - RNA, 22 nt, Homo sapiens
auacagcccucccccagcaguu

SEQ ID NO: 386222 - RNA, 16 nt, Homo sapiens
auacagcucagcuuuu

SEQ ID NO: 386223 - RNA, 14 nt, Homo sapiens
auacaguaucucag

SEQ ID NO: 386224 - RNA, 13 nt, Homo sapiens
auaccaagcuugu

SEQ ID NO: 386225 - RNA, 14 nt, Homo sapiens
auaccacagcuuuu

SEQ ID NO: 386226 - RNA, 14 nt, Homo sapiens
auaccuaucaucuu

SEQ ID NO: 386227 - RNA, 14 nt, Homo sapiens
auacgguaugauau

SEQ ID NO: 386228 - RNA, 17 nt, Homo sapiens
auacuauuuucauucuc

SEQ ID NO: 386229 - RNA, 13 nt, Homo sapiens
auacuuuacaugg

SEQ ID NO: 386230 - RNA, 14 nt, Homo sapiens
auagaaaacugaaa

SEQ ID NO: 386231 - RNA, 14 nt, Homo sapiens
auagaaaguucaaa

SEQ ID NO: 386232 - RNA, 18 nt, Homo sapiens
auagaacucagagccaga

SEQ ID NO: 386233 - RNA, 19 nt, Homo sapiens
auagaagcaaaugacaaaa

SEQ ID NO: 386234 - RNA, 17 nt, Homo sapiens
auagaauuaacacauga

SEQ ID NO: 386235 - RNA, 15 nt, Homo sapiens
auagacccgaggaaa

SEQ ID NO: 386236 - RNA, 21 nt, Homo sapiens
auagagugguacagcacuguu

SEQ ID NO: 386237 - RNA, 15 nt, Homo sapiens
auagcagcagugcau

SEQ ID NO: 386238 - RNA, 21 nt, Homo sapiens
auagcagcuuauucacaagac

SEQ ID NO: 386239 - RNA, 13 nt, Homo sapiens
auaggcaaagggg

SEQ ID NO: 386240 - RNA, 19 nt, Homo sapiens
auaggugcuacaaaaacac

SEQ ID NO: 386241 - RNA, 17 nt, Homo sapiens
auaguggggucagggcu

SEQ ID NO: 386242 - RNA, 21 nt, Homo sapiens
auauacuauuuucauucucuu

SEQ ID NO: 386243 - RNA, 14 nt, Homo sapiens
auauacucacuuuc

SEQ ID NO: 386244 - RNA, 17 nt, Homo sapiens
auauaguaugaaugcag

SEQ ID NO: 386245 - RNA, 20 nt, Homo sapiens
auaucaguuuuuacuuucuc

SEQ ID NO: 386246 - RNA, 13 nt, Homo sapiens
auaucaucagcau

SEQ ID NO: 386247 - RNA, 14 nt, Homo sapiens
auaucaucagcaua

SEQ ID NO: 386248 - RNA, 16 nt, Homo sapiens
auaucccuacauguau

SEQ ID NO: 386249 - RNA, 21 nt, Homo sapiens
auaucugggauucuacuuuaa

SEQ ID NO: 386250 - RNA, 17 nt, Homo sapiens
auaugaaugucaguagu

SEQ ID NO: 386251 - RNA, 19 nt, Homo sapiens
auaugagacguuuuuggaa

SEQ ID NO: 386252 - RNA, 20 nt, Homo sapiens
auaugauauauaaaugugau

SEQ ID NO: 386253 - RNA, 16 nt, Homo sapiens
auaugauauguaaaca

SEQ ID NO: 386254 - RNA, 20 nt, Homo sapiens
auaugaugaucuggauccac

SEQ ID NO: 386255 - RNA, 15 nt, Homo sapiens
auaugauugugcaca

SEQ ID NO: 386256 - RNA, 11 nt, Homo sapiens
auaugcaauau

SEQ ID NO: 386257 - RNA, 18 nt, Homo sapiens
auaugcuaauauauguau

SEQ ID NO: 386258 - RNA, 20 nt, Homo sapiens
auaugucucaggucccugca

SEQ ID NO: 386259 - RNA, 20 nt, Homo sapiens
auaugugaagaaaaauguau

SEQ ID NO: 386260 - RNA, 17 nt, Homo sapiens
auauuaaaauauggcua

SEQ ID NO: 386261 - RNA, 21 nt, Homo sapiens
auauuaaggaagacaauguga

SEQ ID NO: 386262 - RNA, 13 nt, Homo sapiens
auauucauuucaa

SEQ ID NO: 386263 - RNA, 21 nt, Homo sapiens
auauuccugcauuugugaaau

SEQ ID NO: 386264 - RNA, 22 nt, Homo sapiens
auauucuuuaaauuucaucuca

SEQ ID NO: 386265 - RNA, 16 nt, Homo sapiens
auauugcuucuucucc

SEQ ID NO: 386266 - RNA, 17 nt, Homo sapiens
auauuuaccagaccaca

SEQ ID NO: 386267 - RNA, 19 nt, Homo sapiens
auauuuauuuaacuauuca

SEQ ID NO: 386268 - RNA, 19 nt, Homo sapiens
auauuuuaaaaucugucac

SEQ ID NO: 386269 - RNA, 16 nt, Homo sapiens
auauuuugcauaguac

SEQ ID NO: 386270 - RNA, 17 nt, Homo sapiens
auauuuuugugcacauu

SEQ ID NO: 386271 - RNA, 14 nt, Homo sapiens
aucaaaacucuccu

SEQ ID NO: 386272 - RNA, 18 nt, Homo sapiens
aucaaaagcuuauucauc

SEQ ID NO: 386273 - RNA, 12 nt, Homo sapiens
aucaauguuucu

SEQ ID NO: 386274 - RNA, 20 nt, Homo sapiens
aucaccgugggcucccugac

SEQ ID NO: 386275 - RNA, 17 nt, Homo sapiens
aucagaaggacauggug

SEQ ID NO: 386276 - RNA, 16 nt, Homo sapiens
aucagaccauaauguu

SEQ ID NO: 386277 - RNA, 17 nt, Homo sapiens
aucagacuccugugcaa

SEQ ID NO: 386278 - RNA, 18 nt, Homo sapiens
aucagacuccugugcaac

SEQ ID NO: 386279 - RNA, 21 nt, Homo sapiens
uggcuaagcaaaaugugauau

SEQ ID NO: 386280 - RNA, 18 nt, Homo sapiens
uggcuacacacaaaccag

SEQ ID NO: 386281 - RNA, 19 nt, Homo sapiens
uggcuacacacaaaccagu

SEQ ID NO: 386282 - RNA, 15 nt, Homo sapiens
uggcucuacuuucag

SEQ ID NO: 386283 - RNA, 22 nt, Homo sapiens
uggcucuggagacagccccaga

SEQ ID NO: 386284 - RNA, 15 nt, Homo sapiens
uggcugcuagcacuu

SEQ ID NO: 386285 - RNA, 13 nt, Homo sapiens
uggcuucagggga

SEQ ID NO: 386286 - RNA, 11 nt, Homo sapiens
uggcuucuuac

SEQ ID NO: 386287 - RNA, 16 nt, Homo sapiens
uggcuuucuggcugcu

SEQ ID NO: 386288 - RNA, 14 nt, Homo sapiens
ugggaaagcauugu

SEQ ID NO: 386289 - RNA, 22 nt, Homo sapiens
ugggaaggguccaucucagaga

SEQ ID NO: 386290 - RNA, 15 nt, Homo sapiens
ugggaaggugaccac

SEQ ID NO: 386291 - RNA, 14 nt, Homo sapiens
ugggacccuugaga

SEQ ID NO: 386292 - RNA, 23 nt, Homo sapiens
ugggaccucaguuuuaucauuuu

SEQ ID NO: 386293 - RNA, 17 nt, Homo sapiens
ugggaggcuguggagcc

SEQ ID NO: 386294 - RNA, 21 nt, Homo sapiens
ugggagguggagguugcagug

SEQ ID NO: 386295 - RNA, 20 nt, Homo sapiens
ugggauccuaagggcucacc

SEQ ID NO: 386296 - RNA, 21 nt, Homo sapiens
ugggauguccacagaugccuc

SEQ ID NO: 386297 - RNA, 18 nt, Homo sapiens
ugggcaacacagcgagac

SEQ ID NO: 386298 - RNA, 21 nt, Homo sapiens
ugggcagcuguuagaguccaa

SEQ ID NO: 386299 - RNA, 18 nt, Homo sapiens
ugggcauucuuguuucaa

SEQ ID NO: 386300 - RNA, 16 nt, Homo sapiens
ugggcccuuugagugc

SEQ ID NO: 386301 - RNA, 14 nt, Homo sapiens
uggggaagacugug

SEQ ID NO: 386302 - RNA, 16 nt, Homo sapiens
uggggaagcuucuuaa

SEQ ID NO: 386303 - RNA, 16 nt, Homo sapiens
uggggaaguguuccag

SEQ ID NO: 386304 - RNA, 15 nt, Homo sapiens
uggggagaaaagaca

SEQ ID NO: 386305 - RNA, 14 nt, Homo sapiens
uggggagucaggga

SEQ ID NO: 386306 - RNA, 15 nt, Homo sapiens
uggggagucagggac

SEQ ID NO: 386307 - RNA, 21 nt, Homo sapiens
uggggaucuagggaauucagu

SEQ ID NO: 386308 - RNA, 17 nt, Homo sapiens
uggggaugguccacugu

SEQ ID NO: 386309 - RNA, 16 nt, Homo sapiens
uggggcaggcagugau

SEQ ID NO: 386310 - RNA, 22 nt, Homo sapiens
ugggggcagggcaugacuuugu

SEQ ID NO: 386311 - RNA, 14 nt, Homo sapiens
uggguccaggggau

SEQ ID NO: 386312 - RNA, 18 nt, Homo sapiens
ugggucuucagggggcca

SEQ ID NO: 386313 - RNA, 21 nt, Homo sapiens
ugggucuucccuguaugauuc

SEQ ID NO: 386314 - RNA, 19 nt, Homo sapiens
uggguuggaaaacaguauu

SEQ ID NO: 386315 - RNA, 23 nt, Homo sapiens
ugguaacuuuuuuuuaaagcuca

SEQ ID NO: 386316 - RNA, 20 nt, Homo sapiens
ugguaauauugacuuguaua

SEQ ID NO: 386317 - RNA, 21 nt, Homo sapiens
ugguauaaacguccuacugua

SEQ ID NO: 386318 - RNA, 14 nt, Homo sapiens
ugguccgaucuuug

SEQ ID NO: 386319 - RNA, 19 nt, Homo sapiens
ugguccuggggaccauuca

SEQ ID NO: 386320 - RNA, 20 nt, Homo sapiens
uggucguuuucaacagaauu

SEQ ID NO: 386321 - RNA, 12 nt, Homo sapiens
uggucucagugu

SEQ ID NO: 386322 - RNA, 21 nt, Homo sapiens
uggucuccaguggaagggaaa

SEQ ID NO: 386323 - RNA, 23 nt, Homo sapiens
uggucuucagccucuuucugucc

SEQ ID NO: 386324 - RNA, 18 nt, Homo sapiens
uggugacccagucagagu

SEQ ID NO: 386325 - RNA, 15 nt, Homo sapiens
ugguggagggccaca

SEQ ID NO: 386326 - RNA, 12 nt, Homo sapiens
ugguggccucug

SEQ ID NO: 386327 - RNA, 15 nt, Homo sapiens
ugguugagguuucaa

SEQ ID NO: 386328 - RNA, 20 nt, Homo sapiens
ugguugaguguugcucucua

SEQ ID NO: 386329 - RNA, 20 nt, Homo sapiens
uguaaaaugugaagugaaug

SEQ ID NO: 386330 - RNA, 15 nt, Homo sapiens
uguaaagcaggugcc

SEQ ID NO: 386331 - RNA, 21 nt, Homo sapiens
uguaacuauaguccagcuuug

SEQ ID NO: 386332 - RNA, 19 nt, Homo sapiens
uguaagaaacacacugagg

SEQ ID NO: 386333 - RNA, 16 nt, Homo sapiens
uguaagaaagcauaga

SEQ ID NO: 386334 - RNA, 14 nt, Homo sapiens
uguaaucauauaau

SEQ ID NO: 386335 - RNA, 18 nt, Homo sapiens
uguaaucccagcacuuug

SEQ ID NO: 386336 - RNA, 17 nt, Homo sapiens
uguuugucagauaugau

SEQ ID NO: 386337 - RNA, 12 nt, Homo sapiens
uguuugugauug

SEQ ID NO: 386338 - RNA, 19 nt, Homo sapiens
uguuuuuuuuuuccacuua

SEQ ID NO: 386339 - RNA, 20 nt, Homo sapiens
uuaaaaaaaaauacugaugu

SEQ ID NO: 386340 - RNA, 19 nt, Homo sapiens
uuaaaaaauaaaaacugac

SEQ ID NO: 386341 - RNA, 18 nt, Homo sapiens
uuaaaaucugucacguag

SEQ ID NO: 386342 - RNA, 20 nt, Homo sapiens
uuaaacacggggcuugcaac

SEQ ID NO: 386343 - RNA, 21 nt, Homo sapiens
uuaaacacggggcuugcaacu

SEQ ID NO: 386344 - RNA, 24 nt, Homo sapiens
uuaaacauuugagagcuaacuaua

SEQ ID NO: 386345 - RNA, 16 nt, Homo sapiens
uuaaagguaaaacaug

SEQ ID NO: 386346 - RNA, 12 nt, Homo sapiens
uuaaauaguaaa

SEQ ID NO: 386347 - RNA, 19 nt, Homo sapiens
uuaaauuauuuuuguucau

SEQ ID NO: 386348 - RNA, 16 nt, Homo sapiens
uuaaauuguaaaugaa

SEQ ID NO: 386349 - RNA, 23 nt, Homo sapiens
uuaacaaauuauguuacaucugu

SEQ ID NO: 386350 - RNA, 20 nt, Homo sapiens
uuaagaauguucuuauguug

SEQ ID NO: 386351 - RNA, 20 nt, Homo sapiens
uuaagcagauggaaugcugu

SEQ ID NO: 386352 - RNA, 15 nt, Homo sapiens
uuaaggauugugaua

SEQ ID NO: 386353 - RNA, 16 nt, Homo sapiens
uuaaguugauggugau

SEQ ID NO: 386354 - RNA, 19 nt, Homo sapiens
uuaaguugauggugaugaa

SEQ ID NO: 386355 - RNA, 20 nt, Homo sapiens
uuaaguugauggugaugaaa

SEQ ID NO: 386356 - RNA, 21 nt, Homo sapiens
uuaauaguuuugauccuaaau

SEQ ID NO: 386357 - RNA, 17 nt, Homo sapiens
uuaauauauacuaugag

SEQ ID NO: 386358 - RNA, 20 nt, Homo sapiens
uuaaucacaccguccuccac

SEQ ID NO: 386359 - RNA, 11 nt, Homo sapiens
uuaaucaccaa

SEQ ID NO: 386360 - RNA, 15 nt, Homo sapiens
uuaaugacagagcca

SEQ ID NO: 386361 - RNA, 19 nt, Homo sapiens
uuaaugccacaaaacugac

SEQ ID NO: 386362 - RNA, 18 nt, Homo sapiens
uuaauuauuguacauuua

SEQ ID NO: 386363 - RNA, 17 nt, Homo sapiens
uuaauucucaugugauc

SEQ ID NO: 386364 - RNA, 15 nt, Homo sapiens
uuacaaaguguguau

SEQ ID NO: 386365 - RNA, 15 nt, Homo sapiens
uuacaagaucuugca

SEQ ID NO: 386366 - RNA, 19 nt, Homo sapiens
uuacaaucagccacauucu

SEQ ID NO: 386367 - RNA, 19 nt, Homo sapiens
uuacaauuguaaaacugag

SEQ ID NO: 386368 - RNA, 13 nt, Homo sapiens
uuacacaaaacaa

SEQ ID NO: 386369 - RNA, 23 nt, Homo sapiens
uuacaguaggagcccagcucuga

SEQ ID NO: 386370 - RNA, 19 nt, Homo sapiens
uuacaguuuaucuauggca

SEQ ID NO: 386371 - RNA, 15 nt, Homo sapiens
uuacauuuccaaaug

SEQ ID NO: 386372 - RNA, 22 nt, Homo sapiens
uuacauuuccaaaugaaugacc

SEQ ID NO: 386373 - RNA, 17 nt, Homo sapiens
uuacauuugaaaucuau

SEQ ID NO: 386374 - RNA, 19 nt, Homo sapiens
uuacauuugaaaucuauga

SEQ ID NO: 386375 - RNA, 22 nt, Homo sapiens
uuaccagacgguucaccagccu

SEQ ID NO: 386376 - RNA, 22 nt, Homo sapiens
uuacccacgugcuguuccaccu

SEQ ID NO: 386377 - RNA, 19 nt, Homo sapiens
uuaccuaguagucauuuca

SEQ ID NO: 386378 - RNA, 14 nt, Homo sapiens
uuaccuccuaucag

SEQ ID NO: 386379 - RNA, 22 nt, Homo sapiens
uuaccugggcauucuuguuuca

SEQ ID NO: 386380 - RNA, 23 nt, Homo sapiens
uuacucaaggaauuugcauuuag

SEQ ID NO: 386381 - RNA, 15 nt, Homo sapiens
uuacuuaaaggaaua

SEQ ID NO: 386382 - RNA, 16 nt, Homo sapiens
uuacuugcauugaaua

SEQ ID NO: 386383 - RNA, 13 nt, Homo sapiens
uuagaaaaaccac

SEQ ID NO: 386384 - RNA, 18 nt, Homo sapiens
uuagaaacagcuucucaa

SEQ ID NO: 386385 - RNA, 15 nt, Homo sapiens
uuagaaauugcauuu

SEQ ID NO: 386386 - RNA, 14 nt, Homo sapiens
uuagagacaucaaa

SEQ ID NO: 386387 - RNA, 20 nt, Homo sapiens
uuagauuguuaaaauaacua

SEQ ID NO: 386388 - RNA, 18 nt, Homo sapiens
uuagcacuauuuacauac

SEQ ID NO: 386389 - RNA, 17 nt, Homo sapiens
uuagcuuagaccucagc

SEQ ID NO: 386390 - RNA, 23 nt, Homo sapiens
uuaggauuuaacagucauuuaaa

SEQ ID NO: 386391 - RNA, 22 nt, Homo sapiens
uuagggcaucgcuccuccucac

SEQ ID NO: 386392 - RNA, 19 nt, Homo sapiens
uuagugguuacccaguuag

SEQ ID NO: 386393 - RNA, 20 nt, Homo sapiens
uuaguuuacaaucagccaca

SEQ ID NO: 386394 - RNA, 17 nt, Homo sapiens
uuauaaaagaugcauua

SEQ ID NO: 386395 - RNA, 23 nt, Homo sapiens
uuauagaguguacuuaacuauuc

SEQ ID NO: 386396 - RNA, 19 nt, Homo sapiens
uuauauauuuauaacucau

SEQ ID NO: 386397 - RNA, 13 nt, Homo sapiens
uuauaucaucagc

SEQ ID NO: 386398 - RNA, 13 nt, Homo sapiens
uuaucugugcaaa

SEQ ID NO: 386399 - RNA, 15 nt, Homo sapiens
uuaucuugucucugg

SEQ ID NO: 386400 - RNA, 19 nt, Homo sapiens
uuggcuucucauacgucca

SEQ ID NO: 386401 - RNA, 18 nt, Homo sapiens
uuggcuuguuuggagcau

SEQ ID NO: 386402 - RNA, 16 nt, Homo sapiens
uugggaggcugaggca

SEQ ID NO: 386403 - RNA, 16 nt, Homo sapiens
uugguccuggggacca

SEQ ID NO: 386404 - RNA, 13 nt, Homo sapiens
uuguaauugcuua

SEQ ID NO: 386405 - RNA, 18 nt, Homo sapiens
uuguacaccaauauucau

SEQ ID NO: 386406 - RNA, 22 nt, Homo sapiens
uuguagagauggggucucacag

SEQ ID NO: 386407 - RNA, 16 nt, Homo sapiens
uuguauauuauggaag

SEQ ID NO: 386408 - RNA, 22 nt, Homo sapiens
uuguauguuaaguuacuucacu

SEQ ID NO: 386409 - RNA, 18 nt, Homo sapiens
uugugaucuaucaauagu

SEQ ID NO: 386410 - RNA, 20 nt, Homo sapiens
uugugguuuaugucaucaua

SEQ ID NO: 386411 - RNA, 16 nt, Homo sapiens
uuguguccacugugac

SEQ ID NO: 386412 - RNA, 16 nt, Homo sapiens
uugugugguggcaccu

SEQ ID NO: 386413 - RNA, 15 nt, Homo sapiens
uuguucagaugcuuc

SEQ ID NO: 386414 - RNA, 18 nt, Homo sapiens
uuguucagggcugugauc

SEQ ID NO: 386415 - RNA, 19 nt, Homo sapiens
uuguuccgugucuggccag

SEQ ID NO: 386416 - RNA, 21 nt, Homo sapiens
uuguucguauuuagaauggga

SEQ ID NO: 386417 - RNA, 17 nt, Homo sapiens
uuguucuuggccaaaga

SEQ ID NO: 386418 - RNA, 18 nt, Homo sapiens
uuguuuucauuaucucaa

SEQ ID NO: 386419 - RNA, 15 nt, Homo sapiens
uuuaaaaaaucucaa

SEQ ID NO: 386420 - RNA, 18 nt, Homo sapiens
uuuaaaauacacacucaa

SEQ ID NO: 386421 - RNA, 21 nt, Homo sapiens
uuuaaacacggggcuugcaac

SEQ ID NO: 386422 - RNA, 20 nt, Homo sapiens
uuuaaaguauguuauugcau

SEQ ID NO: 386423 - RNA, 12 nt, Homo sapiens
uuuaaaucugag

SEQ ID NO: 386424 - RNA, 21 nt, Homo sapiens
uuuaacuagaauuuauucaau

SEQ ID NO: 386425 - RNA, 16 nt, Homo sapiens
uuuaaucaccaaggcu

SEQ ID NO: 386426 - RNA, 12 nt, Homo sapiens
uuuaauuaucuu

SEQ ID NO: 386427 - RNA, 17 nt, Homo sapiens
uuuacaaguguauauca

SEQ ID NO: 386428 - RNA, 13 nt, Homo sapiens
uuuacagcugccu

SEQ ID NO: 386429 - RNA, 20 nt, Homo sapiens
uuuacauaucaccucauggc

SEQ ID NO: 386430 - RNA, 17 nt, Homo sapiens
uuuagaacuguauguca

SEQ ID NO: 386431 - RNA, 18 nt, Homo sapiens
uuuagacccugcauuuau

SEQ ID NO: 386432 - RNA, 13 nt, Homo sapiens
uuuagauuguuaa

SEQ ID NO: 386433 - RNA, 23 nt, Homo sapiens
uuuauagauggucacgcaccugg

SEQ ID NO: 386434 - RNA, 18 nt, Homo sapiens
uuuauauuuuuauagaca

SEQ ID NO: 386435 - RNA, 13 nt, Homo sapiens
uuuauuaccucug

SEQ ID NO: 386436 - RNA, 16 nt, Homo sapiens
uuuauuaccucugaua

SEQ ID NO: 386437 - RNA, 15 nt, Homo sapiens
uuuauugugaucuau

SEQ ID NO: 386438 - RNA, 15 nt, Homo sapiens
uuuauuuaacuauuc

SEQ ID NO: 386439 - RNA, 16 nt, Homo sapiens
uuucaaaaccuuuuga

SEQ ID NO: 386440 - RNA, 18 nt, Homo sapiens
uuucaaauuggagcuuca

SEQ ID NO: 386441 - RNA, 14 nt, Homo sapiens
uuucacauaugugu

SEQ ID NO: 386442 - RNA, 13 nt, Homo sapiens
uuucaccauuuga

SEQ ID NO: 386443 - RNA, 15 nt, Homo sapiens
uuucagaaaauauua

SEQ ID NO: 386444 - RNA, 17 nt, Homo sapiens
uuucagauaaacaacaa

SEQ ID NO: 386445 - RNA, 20 nt, Homo sapiens
uuucaugcuauuucacucua

SEQ ID NO: 386446 - RNA, 12 nt, Homo sapiens
uuucauugcugg

SEQ ID NO: 386447 - RNA, 12 nt, Homo sapiens
uuuccagccuuc

SEQ ID NO: 386448 - RNA, 15 nt, Homo sapiens
uuuccgaaaucagaa

SEQ ID NO: 386449 - RNA, 15 nt, Homo sapiens
uuuccugcggcauca

SEQ ID NO: 386450 - RNA, 20 nt, Homo sapiens
uuuccuggacuuaacucuaa

SEQ ID NO: 386451 - RNA, 20 nt, Homo sapiens
uuuccuucggguuggcaaaa

SEQ ID NO: 386452 - RNA, 20 nt, Homo sapiens
uuuccuuguccugccaggau

SEQ ID NO: 386453 - RNA, 18 nt, Homo sapiens
uuucuaacuccagugaag

SEQ ID NO: 386454 - RNA, 17 nt, Homo sapiens
uuucucuagggagaaaa

SEQ ID NO: 386455 - RNA, 16 nt, Homo sapiens
uuucucugccagugac

SEQ ID NO: 386456 - RNA, 23 nt, Homo sapiens
uuucucuggccccaagggcaaaa

SEQ ID NO: 386457 - RNA, 22 nt, Homo sapiens
uuucugagaaagacuauucaaa

SEQ ID NO: 386458 - RNA, 22 nt, Homo sapiens
uuucugcuaaaaaguccuugau

SEQ ID NO: 386459 - RNA, 23 nt, Homo sapiens
uuucuucccgaaccccaaggagg

SEQ ID NO: 386460 - RNA, 17 nt, Homo sapiens
uuucuugcagaucaaau

SEQ ID NO: 386461 - RNA, 18 nt, Homo sapiens
uuucuuucuaacuccagu

SEQ ID NO: 386462 - RNA, 18 nt, Homo sapiens
uuugaagcaucacauaaa

SEQ ID NO: 386463 - RNA, 14 nt, Homo sapiens
uuugacaaccauga

SEQ ID NO: 386464 - RNA, 16 nt, Homo sapiens
uuugagguuuccuuca

SEQ ID NO: 386465 - RNA, 15 nt, Homo sapiens
uuugaguugaauuua

SEQ ID NO: 386466 - RNA, 19 nt, Homo sapiens
uuugauacaagaaagcaau

SEQ ID NO: 386467 - RNA, 21 nt, Homo sapiens
uuugcaauggcuauauggcaa

SEQ ID NO: 386468 - RNA, 19 nt, Homo sapiens
uuugcauaagugcaugaca

SEQ ID NO: 386469 - RNA, 23 nt, Homo sapiens
uuugccauauuuucaccauuuga

SEQ ID NO: 386470 - RNA, 19 nt, Homo sapiens
uuugcuaaaugugaaugau

SEQ ID NO: 386471 - RNA, 19 nt, Homo sapiens
uuuggagacacaacuauuu

SEQ ID NO: 386472 - RNA, 11 nt, Homo sapiens
uuugggagaca

SEQ ID NO: 386473 - RNA, 22 nt, Homo sapiens
uuuggguucacagaagcacagc

SEQ ID NO: 386474 - RNA, 16 nt, Homo sapiens
uuugguuaaacccaug

SEQ ID NO: 386475 - RNA, 14 nt, Homo sapiens
uuuguaauugcuua

SEQ ID NO: 386476 - RNA, 14 nt, Homo sapiens
uuugugugcgucac

SEQ ID NO: 386477 - RNA, 14 nt, Homo sapiens
uuugugugugugca

SEQ ID NO: 386478 - RNA, 16 nt, Homo sapiens
uuugugugugugcaag

SEQ ID NO: 386479 - RNA, 12 nt, Homo sapiens
uuuguugcccag

SEQ ID NO: 386480 - RNA, 17 nt, Homo sapiens
uuuuaacaacuaugauu

SEQ ID NO: 386481 - RNA, 15 nt, Homo sapiens
uuuuaagugccuuua

SEQ ID NO: 386482 - RNA, 12 nt, Homo sapiens
uuuuaauggugu

SEQ ID NO: 386483 - RNA, 19 nt, Homo sapiens
uuuuagacccuauugcugc

SEQ ID NO: 386484 - RNA, 15 nt, Homo sapiens
uuuuaugaucuuggc

SEQ ID NO: 386485 - RNA, 13 nt, Homo sapiens
uuuucaccccacc

SEQ ID NO: 386486 - RNA, 12 nt, Homo sapiens
uuuucacuugua

SEQ ID NO: 386487 - RNA, 16 nt, Homo sapiens
uuuucuaaacuuuaau

SEQ ID NO: 386488 - RNA, 15 nt, Homo sapiens
uuuucucugugcuuc

SEQ ID NO: 386489 - RNA, 14 nt, Homo sapiens
uuuugauagcuuua

SEQ ID NO: 386490 - RNA, 18 nt, Homo sapiens
uuuugcacacuuugccau

SEQ ID NO: 386491 - RNA, 17 nt, Homo sapiens
uuuugccauaaugacuc

SEQ ID NO: 386492 - RNA, 21 nt, Homo sapiens
uuuuggaauuaugucugcuga

SEQ ID NO: 386493 - RNA, 22 nt, Homo sapiens
uuuugguuugcagaugacaaaa

SEQ ID NO: 386494 - RNA, 21 nt, Homo sapiens
uuuugugauuucaauguagcu

SEQ ID NO: 386495 - RNA, 19 nt, Homo sapiens
uuuuuaguagagauggggu

SEQ ID NO: 386496 - RNA, 23 nt, Homo sapiens
uuuuucagaaagcauuacauuuc

SEQ ID NO: 386497 - RNA, 16 nt, Homo sapiens
uuuuucuaagguucuc

SEQ ID NO: 386498 - RNA, 22 nt, Homo sapiens
uuuuucuuugagacugggucuc

SEQ ID NO: 386499 - RNA, 21 nt, Homo sapiens
uuuuuggcuacacacaaacca

SEQ ID NO: 386500 - RNA, 14 nt, Homo sapiens
uuuuuuacacaaau

SEQ ID NO: 386501 - RNA, 13 nt, Homo sapiens
uuuuuucaccaau

SEQ ID NO: 386502 - RNA, 13 nt, Homo sapiens
cagacugucucaa

SEQ ID NO: 386503 - RNA, 17 nt, Homo sapiens
cagacugucucaaauaa

SEQ ID NO: 386504 - RNA, 20 nt, Homo sapiens
cagagaauucucuuauccaa

SEQ ID NO: 386505 - RNA, 22 nt, Homo sapiens
cagagacgcagacaugugcacu

SEQ ID NO: 386506 - RNA, 16 nt, Homo sapiens
cagagaggacuguuga

SEQ ID NO: 386507 - RNA, 17 nt, Homo sapiens
cagagagggacugacac

SEQ ID NO: 386508 - RNA, 15 nt, Homo sapiens
cagagagggggccac

SEQ ID NO: 386509 - RNA, 21 nt, Homo sapiens
cagagauaagggugucuuccu

SEQ ID NO: 386510 - RNA, 13 nt, Homo sapiens
cagagcaagugag

SEQ ID NO: 386511 - RNA, 20 nt, Homo sapiens
cagagcgcaagcugggagca

SEQ ID NO: 386512 - RNA, 15 nt, Homo sapiens
cagagcuucccugac

SEQ ID NO: 386513 - RNA, 11 nt, Homo sapiens
cagagcuucuu

SEQ ID NO: 386514 - RNA, 23 nt, Homo sapiens
cagaggagcggccagaagaucua

SEQ ID NO: 386515 - RNA, 17 nt, Homo sapiens
cagaggcuuaaucacac

SEQ ID NO: 386516 - RNA, 16 nt, Homo sapiens
cagagggaaacacagc

SEQ ID NO: 386517 - RNA, 14 nt, Homo sapiens
cagagugaacacuc

SEQ ID NO: 386518 - RNA, 22 nt, Homo sapiens
cagagugagacccagcccucau

SEQ ID NO: 386519 - RNA, 14 nt, Homo sapiens
cagaguuguugcuu

SEQ ID NO: 386520 - RNA, 12 nt, Homo sapiens
cagauauuucac

SEQ ID NO: 386521 - RNA, 17 nt, Homo sapiens
cagaucauauuucacaa

SEQ ID NO: 386522 - RNA, 15 nt, Homo sapiens
cagaucccacuugca

SEQ ID NO: 386523 - RNA, 11 nt, Homo sapiens
cagaugacaaa

SEQ ID NO: 386524 - RNA, 12 nt, Homo sapiens
cagaugcaauac

SEQ ID NO: 386525 - RNA, 21 nt, Homo sapiens
cagauuccaggcgaugugcaa

SEQ ID NO: 386526 - RNA, 22 nt, Homo sapiens
cagauuccaggcgaugugcaag

SEQ ID NO: 386527 - RNA, 13 nt, Homo sapiens
cagcaaaauguga

SEQ ID NO: 386528 - RNA, 14 nt, Homo sapiens
cagcaaaaugugaa

SEQ ID NO: 386529 - RNA, 18 nt, Homo sapiens
cagcaaaauuuaugcaaa

SEQ ID NO: 386530 - RNA, 13 nt, Homo sapiens
cagcaaagcaaca

SEQ ID NO: 386531 - RNA, 17 nt, Homo sapiens
cagcaaugacaucucag

SEQ ID NO: 386532 - RNA, 19 nt, Homo sapiens
cagcacccagcaacuccaa

SEQ ID NO: 386533 - RNA, 16 nt, Homo sapiens
cagcagaucccagcuc

SEQ ID NO: 386534 - RNA, 22 nt, Homo sapiens
cagcagaucccagcucacguca

SEQ ID NO: 386535 - RNA, 22 nt, Homo sapiens
cagcagcuucucuccacugaaa

SEQ ID NO: 386536 - RNA, 22 nt, Homo sapiens
cagcauaccuuuauugugaucu

SEQ ID NO: 386537 - RNA, 18 nt, Homo sapiens
cagccaaacccugucuga

SEQ ID NO: 386538 - RNA, 12 nt, Homo sapiens
cagccaccucuc

SEQ ID NO: 386539 - RNA, 19 nt, Homo sapiens
cagccagugaccugaggaa

SEQ ID NO: 386540 - RNA, 12 nt, Homo sapiens
cagccauguauu

SEQ ID NO: 386541 - RNA, 15 nt, Homo sapiens
cagcccagcuggugg

SEQ ID NO: 386542 - RNA, 14 nt, Homo sapiens
cagccuccugcuaa

SEQ ID NO: 386543 - RNA, 22 nt, Homo sapiens
cagccucugaaaaccaauguuc

SEQ ID NO: 386544 - RNA, 18 nt, Homo sapiens
cagccuggauguuuuuuc

SEQ ID NO: 386545 - RNA, 22 nt, Homo sapiens
cagccuggcgaaaccccaucuc

SEQ ID NO: 386546 - RNA, 20 nt, Homo sapiens
cagccugggcaacacagcga

SEQ ID NO: 386547 - RNA, 20 nt, Homo sapiens
cagccugggugacagagcaa

SEQ ID NO: 386548 - RNA, 17 nt, Homo sapiens
cagccugucucuuccau

SEQ ID NO: 386549 - RNA, 17 nt, Homo sapiens
cagcgaaugaaugcugu

SEQ ID NO: 386550 - RNA, 18 nt, Homo sapiens
cagcgagacuccgucuca

SEQ ID NO: 386551 - RNA, 21 nt, Homo sapiens
cagcuaccucuucuauggacu

SEQ ID NO: 386552 - RNA, 11 nt, Homo sapiens
cagcucaaagg

SEQ ID NO: 386553 - RNA, 20 nt, Homo sapiens
cagcucaaaggcacagugaa

SEQ ID NO: 386554 - RNA, 17 nt, Homo sapiens
cagcuccccaagaaagc

SEQ ID NO: 386555 - RNA, 19 nt, Homo sapiens
cagcuggaaucugaaggcg

SEQ ID NO: 386556 - RNA, 15 nt, Homo sapiens
cagcuggaucuccau

SEQ ID NO: 386557 - RNA, 20 nt, Homo sapiens
cagcuugaguggguucucug

SEQ ID NO: 386558 - RNA, 16 nt, Homo sapiens
cagcuugcucuucagu

SEQ ID NO: 386559 - RNA, 14 nt, Homo sapiens
caggaaaucaaaua

SEQ ID NO: 386560 - RNA, 22 nt, Homo sapiens
caggaaccuccuccacaccagc

SEQ ID NO: 386561 - RNA, 14 nt, Homo sapiens
caggaacuugcaca

SEQ ID NO: 386562 - RNA, 23 nt, Homo sapiens
caggaacuugcacaaaaucacac

SEQ ID NO: 386563 - RNA, 17 nt, Homo sapiens
caggaagcauucagaga

SEQ ID NO: 386564 - RNA, 16 nt, Homo sapiens
caggaagccgugcccu

SEQ ID NO: 386565 - RNA, 18 nt, Homo sapiens
caggaagucuucagggaa

SEQ ID NO: 386566 - RNA, 22 nt, Homo sapiens
caggacacagggaaaucagggu

SEQ ID NO: 386567 - RNA, 17 nt, Homo sapiens
caggaggugcuaucgca

SEQ ID NO: 386568 - RNA, 20 nt, Homo sapiens
caggagguggagguugcagu

SEQ ID NO: 386569 - RNA, 23 nt, Homo sapiens
caggaguuggaagugugugaucu

SEQ ID NO: 386570 - RNA, 17 nt, Homo sapiens
caggauaagagggauua

SEQ ID NO: 386571 - RNA, 16 nt, Homo sapiens
caggauauugacaaga

SEQ ID NO: 386572 - RNA, 23 nt, Homo sapiens
caggaucugaguuauuuugcuaa

SEQ ID NO: 386573 - RNA, 16 nt, Homo sapiens
caggauuaaaagccau

SEQ ID NO: 386574 - RNA, 23 nt, Homo sapiens
caggcacgaacccaccugcugag

SEQ ID NO: 386575 - RNA, 12 nt, Homo sapiens
caggcacugaga

SEQ ID NO: 386576 - RNA, 15 nt, Homo sapiens
caggcacugcugccc

SEQ ID NO: 386577 - RNA, 18 nt, Homo sapiens
caggcagcgauggucuca

SEQ ID NO: 386578 - RNA, 15 nt, Homo sapiens
caggccacauggcua

SEQ ID NO: 386579 - RNA, 15 nt, Homo sapiens
caggccauacuuuac

SEQ ID NO: 386580 - RNA, 17 nt, Homo sapiens
caggccauacuuuacaa

SEQ ID NO: 386581 - RNA, 21 nt, Homo sapiens
caggcccuuccucuccacugc

SEQ ID NO: 386582 - RNA, 22 nt, Homo sapiens
caggccgccccagccucugagc

SEQ ID NO: 386583 - RNA, 16 nt, Homo sapiens
caggccucucuucaca

SEQ ID NO: 386584 - RNA, 15 nt, Homo sapiens
caggcgugguggcac

SEQ ID NO: 386585 - RNA, 13 nt, Homo sapiens
caggcucuucucc

SEQ ID NO: 386586 - RNA, 19 nt, Homo sapiens
cagggaagcugucccucac

SEQ ID NO: 386587 - RNA, 11 nt, Homo sapiens
cagggacccac

SEQ ID NO: 386588 - RNA, 13 nt, Homo sapiens
cagggccaacuug

SEQ ID NO: 386589 - RNA, 20 nt, Homo sapiens
cagggcccugagcucggugg

SEQ ID NO: 386590 - RNA, 18 nt, Homo sapiens
caggggaguguucagggc

SEQ ID NO: 386591 - RNA, 16 nt, Homo sapiens
cagggucugcucuuuc

SEQ ID NO: 386592 - RNA, 17 nt, Homo sapiens
cagggugccuguccagg

SEQ ID NO: 386593 - RNA, 13 nt, Homo sapiens
caggguuuuuaga

SEQ ID NO: 386594 - RNA, 17 nt, Homo sapiens
cagguaaggugagggaa

SEQ ID NO: 386595 - RNA, 16 nt, Homo sapiens
caggugauccacccac

SEQ ID NO: 386596 - RNA, 11 nt, Homo sapiens
caggugcacag

SEQ ID NO: 386597 - RNA, 19 nt, Homo sapiens
caggugccaguuauggcua

SEQ ID NO: 386598 - RNA, 16 nt, Homo sapiens
cagguguuuauacagc

SEQ ID NO: 386599 - RNA, 22 nt, Homo sapiens
cagguucaugccaccauggcca

SEQ ID NO: 386600 - RNA, 21 nt, Homo sapiens
caguaaacuuuggcuuauaaa

SEQ ID NO: 386601 - RNA, 17 nt, Homo sapiens
caguaacgcgucuuccu

SEQ ID NO: 386602 - RNA, 14 nt, Homo sapiens
caguaccuccugcc

SEQ ID NO: 386603 - RNA, 20 nt, Homo sapiens
caguaccuccugccccaugc

SEQ ID NO: 386604 - RNA, 18 nt, Homo sapiens
caguagaaauaauaugca

SEQ ID NO: 386605 - RNA, 14 nt, Homo sapiens
cagucaucuugacc

SEQ ID NO: 386606 - RNA, 21 nt, Homo sapiens
caguccaccugagcugccauc

SEQ ID NO: 386607 - RNA, 19 nt, Homo sapiens
cagucccuaaaaacacaga

SEQ ID NO: 386608 - RNA, 14 nt, Homo sapiens
caguccuguuugca

SEQ ID NO: 386609 - RNA, 22 nt, Homo sapiens
cagucucggguggcuagucaga

SEQ ID NO: 386610 - RNA, 18 nt, Homo sapiens
cagucucuucuaagcaaa

SEQ ID NO: 386611 - RNA, 14 nt, Homo sapiens
cagucuuccauuug

SEQ ID NO: 386612 - RNA, 16 nt, Homo sapiens
cagugaccagucacug

SEQ ID NO: 386613 - RNA, 19 nt, Homo sapiens
cagugaccagucacugacc

SEQ ID NO: 386614 - RNA, 22 nt, Homo sapiens
cagugacugaggggccuggcuc

SEQ ID NO: 386615 - RNA, 20 nt, Homo sapiens
cagugagccaagauugcgcc

SEQ ID NO: 386616 - RNA, 20 nt, Homo sapiens
cagugagcugauaucaugcc

SEQ ID NO: 386617 - RNA, 20 nt, Homo sapiens
cagugaugcuggaugcuccu

SEQ ID NO: 386618 - RNA, 21 nt, Homo sapiens
cagugaugcuggaugcuccuu

SEQ ID NO: 386619 - RNA, 17 nt, Homo sapiens
cagugcacccacucugc

SEQ ID NO: 386620 - RNA, 15 nt, Homo sapiens
cagugccaagcacag

SEQ ID NO: 386621 - RNA, 12 nt, Homo sapiens
cagugcucccuc

SEQ ID NO: 386622 - RNA, 22 nt, Homo sapiens
cagugcuguacuugaugacaga

SEQ ID NO: 386623 - RNA, 21 nt, Homo sapiens
caguggaagggaaaagcccau

SEQ ID NO: 386624 - RNA, 21 nt, Homo sapiens
cagugggaccaaugaaagcau

SEQ ID NO: 386625 - RNA, 19 nt, Homo sapiens
caguguguuucugaucuga

SEQ ID NO: 386626 - RNA, 20 nt, Homo sapiens
caguguuaaaugugaugaau

SEQ ID NO: 386627 - RNA, 17 nt, Homo sapiens
caguuaaugccacaaaa

SEQ ID NO: 386628 - RNA, 20 nt, Homo sapiens
caguuacccccaaccugacc

SEQ ID NO: 386629 - RNA, 13 nt, Homo sapiens
caguuccaaugag

SEQ ID NO: 386630 - RNA, 22 nt, Homo sapiens
caguucuuuucaaccuacuuuc

SEQ ID NO: 386631 - RNA, 21 nt, Homo sapiens
caguugaaugacaacagaagc

SEQ ID NO: 386632 - RNA, 15 nt, Homo sapiens
caguuucccuaucuc

SEQ ID NO: 386633 - RNA, 21 nt, Homo sapiens
cauaaaaagccugcaauuuca

SEQ ID NO: 386634 - RNA, 22 nt, Homo sapiens
cauaaaaagccugcaauuucau

SEQ ID NO: 386635 - RNA, 16 nt, Homo sapiens
cauaaacuucagggau

SEQ ID NO: 386636 - RNA, 13 nt, Homo sapiens
cauaaauuacuuu

SEQ ID NO: 386637 - RNA, 14 nt, Homo sapiens
cauaacaugcuuua

SEQ ID NO: 386638 - RNA, 18 nt, Homo sapiens
cauaagugcaugacauau

SEQ ID NO: 386639 - RNA, 21 nt, Homo sapiens
cauaauguuacauuauuauca

SEQ ID NO: 386640 - RNA, 14 nt, Homo sapiens
cauacacagccugg

SEQ ID NO: 386641 - RNA, 12 nt, Homo sapiens
cauacaggccau

SEQ ID NO: 386642 - RNA, 17 nt, Homo sapiens
cauacucugcuuagaau

SEQ ID NO: 386643 - RNA, 20 nt, Homo sapiens
cauagagaucauccuuucca

SEQ ID NO: 386644 - RNA, 15 nt, Homo sapiens
ccagugaccagucac

SEQ ID NO: 386645 - RNA, 16 nt, Homo sapiens
ccagugccaagcacag

SEQ ID NO: 386646 - RNA, 11 nt, Homo sapiens
ccagugccagg

SEQ ID NO: 386647 - RNA, 23 nt, Homo sapiens
ccaguguccccuccacugucaca

SEQ ID NO: 386648 - RNA, 17 nt, Homo sapiens
ccauagaggugagggaa

SEQ ID NO: 386649 - RNA, 17 nt, Homo sapiens
ccauagcagcagugcau

SEQ ID NO: 386650 - RNA, 20 nt, Homo sapiens
ccauagucaaauuuguaaau

SEQ ID NO: 386651 - RNA, 14 nt, Homo sapiens
ccauaugugggugu

SEQ ID NO: 386652 - RNA, 20 nt, Homo sapiens
ccauauuuucaccauuugau

SEQ ID NO: 386653 - RNA, 12 nt, Homo sapiens
ccaucaccagac

SEQ ID NO: 386654 - RNA, 14 nt, Homo sapiens
ccaucaccagacag

SEQ ID NO: 386655 - RNA, 12 nt, Homo sapiens
ccaucacuggag

SEQ ID NO: 386656 - RNA, 14 nt, Homo sapiens
ccauccccuggacu

SEQ ID NO: 386657 - RNA, 23 nt, Homo sapiens
ccaucccucgugguccccaacag

SEQ ID NO: 386658 - RNA, 22 nt, Homo sapiens
ccauccuauuuaacuggcuuca

SEQ ID NO: 386659 - RNA, 15 nt, Homo sapiens
ccaucuaugucccuu

SEQ ID NO: 386660 - RNA, 13 nt, Homo sapiens
ccaucugcuuaca

SEQ ID NO: 386661 - RNA, 18 nt, Homo sapiens
ccaucugcuuacaauucc

SEQ ID NO: 386662 - RNA, 19 nt, Homo sapiens
ccaucugcuuacaauuccc

SEQ ID NO: 386663 - RNA, 19 nt, Homo sapiens
ccaugaaccaagaccauug

SEQ ID NO: 386664 - RNA, 16 nt, Homo sapiens
ccaugcugaccugugu

SEQ ID NO: 386665 - RNA, 14 nt, Homo sapiens
ccauggacacucca

SEQ ID NO: 386666 - RNA, 22 nt, Homo sapiens
ccauggacacuccagugccagc

SEQ ID NO: 386667 - RNA, 17 nt, Homo sapiens
ccauggacccaauauuu

SEQ ID NO: 386668 - RNA, 23 nt, Homo sapiens
ccaugggaaggguccaucucaga

SEQ ID NO: 386669 - RNA, 16 nt, Homo sapiens
ccauggggaagggaua

SEQ ID NO: 386670 - RNA, 16 nt, Homo sapiens
ccauggugugaucguc

SEQ ID NO: 386671 - RNA, 16 nt, Homo sapiens
ccauguaccagcagcu

SEQ ID NO: 386672 - RNA, 14 nt, Homo sapiens
ccaugugugugcaa

SEQ ID NO: 386673 - RNA, 15 nt, Homo sapiens
ccaugugugugcaag

SEQ ID NO: 386674 - RNA, 20 nt, Homo sapiens
ccaugugugugcaagugugu

SEQ ID NO: 386675 - RNA, 23 nt, Homo sapiens
ccaugugugugcaagugugugca

SEQ ID NO: 386676 - RNA, 22 nt, Homo sapiens
ccauucauacccacacacccag

SEQ ID NO: 386677 - RNA, 13 nt, Homo sapiens
ccauugagacuau

SEQ ID NO: 386678 - RNA, 21 nt, Homo sapiens
ccauuuggcaaugccaucauc

SEQ ID NO: 386679 - RNA, 15 nt, Homo sapiens
cccaaaacgugcaug

SEQ ID NO: 386680 - RNA, 22 nt, Homo sapiens
cccaacacaaacccccacucca

SEQ ID NO: 386681 - RNA, 21 nt, Homo sapiens
cccaacucuccuggacugccu

SEQ ID NO: 386682 - RNA, 16 nt, Homo sapiens
cccaagccugcaguca

SEQ ID NO: 386683 - RNA, 17 nt, Homo sapiens
cccaaguuguggugcug

SEQ ID NO: 386684 - RNA, 17 nt, Homo sapiens
cccaauauuuaccagac

SEQ ID NO: 386685 - RNA, 16 nt, Homo sapiens
cccaauucacaucuaa

SEQ ID NO: 386686 - RNA, 16 nt, Homo sapiens
cccaauuuacuugcca

SEQ ID NO: 386687 - RNA, 17 nt, Homo sapiens
cccaauuuacuugccau

SEQ ID NO: 386688 - RNA, 19 nt, Homo sapiens
cccacacccucccuuaccc

SEQ ID NO: 386689 - RNA, 17 nt, Homo sapiens
cccacagguguguuucc

SEQ ID NO: 386690 - RNA, 19 nt, Homo sapiens
cccaccugucaaacaaagc

SEQ ID NO: 386691 - RNA, 22 nt, Homo sapiens
cccacgagggucaggacuguga

SEQ ID NO: 386692 - RNA, 13 nt, Homo sapiens
cccacugagauuu

SEQ ID NO: 386693 - RNA, 14 nt, Homo sapiens
cccagaauagcuuu

SEQ ID NO: 386694 - RNA, 12 nt, Homo sapiens
cccagacagcuc

SEQ ID NO: 386695 - RNA, 16 nt, Homo sapiens
cccagaccugagcucc

SEQ ID NO: 386696 - RNA, 12 nt, Homo sapiens
cccagagcagga

SEQ ID NO: 386697 - RNA, 20 nt, Homo sapiens
cccagagcaggaagcauuca

SEQ ID NO: 386698 - RNA, 22 nt, Homo sapiens
cccagagugcugggauuacaau

SEQ ID NO: 386699 - RNA, 21 nt, Homo sapiens
cccagauagcuggcugggugg

SEQ ID NO: 386700 - RNA, 21 nt, Homo sapiens
cccagcacuuugggaggccaa

SEQ ID NO: 386701 - RNA, 15 nt, Homo sapiens
cccagcccagggugg

SEQ ID NO: 386702 - RNA, 16 nt, Homo sapiens
cccagcuacucaggag

SEQ ID NO: 386703 - RNA, 20 nt, Homo sapiens
cccagcuacucaggagguug

SEQ ID NO: 386704 - RNA, 17 nt, Homo sapiens
cccagcuccccaagaaa

SEQ ID NO: 386705 - RNA, 23 nt, Homo sapiens
cccaggaggucgaccccaaagcc

SEQ ID NO: 386706 - RNA, 23 nt, Homo sapiens
cccaggagguggagguugcagug

SEQ ID NO: 386707 - RNA, 18 nt, Homo sapiens
cccagguggcugacccag

SEQ ID NO: 386708 - RNA, 10 nt, Homo sapiens
cccagugugu

SEQ ID NO: 386709 - RNA, 23 nt, Homo sapiens
cccaguuaaauuuucauuucaga

SEQ ID NO: 386710 - RNA, 16 nt, Homo sapiens
cccaguuagcucucaa

SEQ ID NO: 386711 - RNA, 17 nt, Homo sapiens
cccauaucugugaaaug

SEQ ID NO: 386712 - RNA, 23 nt, Homo sapiens
cccauaucugugaaaugcuggca

SEQ ID NO: 386713 - RNA, 22 nt, Homo sapiens
cccauccaucugcuuacaauuc

SEQ ID NO: 386714 - RNA, 12 nt, Homo sapiens
cccaugagauuc

SEQ ID NO: 386715 - RNA, 22 nt, Homo sapiens
cccaugugugagugugugcaag

SEQ ID NO: 386716 - RNA, 12 nt, Homo sapiens
cccauucuugca

SEQ ID NO: 386717 - RNA, 22 nt, Homo sapiens
cccauuugcuuacuuugcauuu

SEQ ID NO: 386718 - RNA, 14 nt, Homo sapiens
ccccaauccaugaa

SEQ ID NO: 386719 - RNA, 23 nt, Homo sapiens
ccccacgagggucaggacuguga

SEQ ID NO: 386720 - RNA, 15 nt, Homo sapiens
ccccagcaguugaau

SEQ ID NO: 386721 - RNA, 16 nt, Homo sapiens
ccccagcccacaggug

SEQ ID NO: 386722 - RNA, 22 nt, Homo sapiens
cccccauuguggucacaggaag

SEQ ID NO: 386723 - RNA, 23 nt, Homo sapiens
cccccgugaggaugucacucaga

SEQ ID NO: 386724 - RNA, 14 nt, Homo sapiens
cccccugggcugag

SEQ ID NO: 386725 - RNA, 12 nt, Homo sapiens
cccccugugcag

SEQ ID NO: 386726 - RNA, 17 nt, Homo sapiens
ccccuccucacuggcca

SEQ ID NO: 386727 - RNA, 23 nt, Homo sapiens
ccccuggggcuucuccugaccca

SEQ ID NO: 386728 - RNA, 13 nt, Homo sapiens
cccgcaaugugcc

SEQ ID NO: 386729 - RNA, 16 nt, Homo sapiens
cccuauccacccagcc

SEQ ID NO: 386730 - RNA, 23 nt, Homo sapiens
cccuaucucgaacauggaacuca

SEQ ID NO: 386731 - RNA, 17 nt, Homo sapiens
cccucaaagugagggga

SEQ ID NO: 386732 - RNA, 18 nt, Homo sapiens
cccucaacaccucugcac

SEQ ID NO: 386733 - RNA, 14 nt, Homo sapiens
cccugcacaaagcc

SEQ ID NO: 386734 - RNA, 18 nt, Homo sapiens
cccugcagggccaagcac

SEQ ID NO: 386735 - RNA, 20 nt, Homo sapiens
cccuggggagucugggcaca

SEQ ID NO: 386736 - RNA, 22 nt, Homo sapiens
cccugucccucccaccucugug

SEQ ID NO: 386737 - RNA, 14 nt, Homo sapiens
cccugucucaaaaa

SEQ ID NO: 386738 - RNA, 13 nt, Homo sapiens
cccuguggaugag

SEQ ID NO: 386739 - RNA, 18 nt, Homo sapiens
cccuuacagccucugacu

SEQ ID NO: 386740 - RNA, 16 nt, Homo sapiens
cccuuggagccaaugg

SEQ ID NO: 386741 - RNA, 21 nt, Homo sapiens
cccuuggaggcugucuucuca

SEQ ID NO: 386742 - RNA, 11 nt, Homo sapiens
cccuuucacaa

SEQ ID NO: 386743 - RNA, 18 nt, Homo sapiens
cccuuuccagauauucaa

SEQ ID NO: 386744 - RNA, 18 nt, Homo sapiens
cccuuucuugaagaacaa

SEQ ID NO: 386745 - RNA, 20 nt, Homo sapiens
ccgaaaaggauaugcaguau

SEQ ID NO: 386746 - RNA, 17 nt, Homo sapiens
ccgagugcaaugaauga

SEQ ID NO: 386747 - RNA, 22 nt, Homo sapiens
ccgcaaugugacuuaaugccac

SEQ ID NO: 386748 - RNA, 18 nt, Homo sapiens
ccgcauuuggauuggaug

SEQ ID NO: 386749 - RNA, 23 nt, Homo sapiens
ccggcgaaauaaaaucagaguug

SEQ ID NO: 386750 - RNA, 19 nt, Homo sapiens
ccgugaggaugucacucag

SEQ ID NO: 386751 - RNA, 19 nt, Homo sapiens
ccuaaauaauguuaucugu

SEQ ID NO: 386752 - RNA, 16 nt, Homo sapiens
ccuaagacgucccuuu

SEQ ID NO: 386753 - RNA, 16 nt, Homo sapiens
ccuaauaugcuuuaca

SEQ ID NO: 386754 - RNA, 18 nt, Homo sapiens
ccuaaugaaugcauaaaa

SEQ ID NO: 386755 - RNA, 21 nt, Homo sapiens
ccuacaaggcuggcagugaca

SEQ ID NO: 386756 - RNA, 23 nt, Homo sapiens
ccuacaaggcuggcagugacaga

SEQ ID NO: 386757 - RNA, 16 nt, Homo sapiens
ccuacaccucuugaaa

SEQ ID NO: 386758 - RNA, 15 nt, Homo sapiens
ccuacugaaugcucu

SEQ ID NO: 386759 - RNA, 15 nt, Homo sapiens
ccuagagcacacugu

SEQ ID NO: 386760 - RNA, 23 nt, Homo sapiens
ccuagcaaggcaugauguuaacc

SEQ ID NO: 386761 - RNA, 20 nt, Homo sapiens
ccuagcacuuugggaggcca

SEQ ID NO: 386762 - RNA, 16 nt, Homo sapiens
ccuagcccuucucuca

SEQ ID NO: 386763 - RNA, 17 nt, Homo sapiens
ccuagcccuucucucau

SEQ ID NO: 386764 - RNA, 22 nt, Homo sapiens
ccuagcugggaaggugaccaca

SEQ ID NO: 386765 - RNA, 17 nt, Homo sapiens
ccuaggaguauccucau

SEQ ID NO: 386766 - RNA, 17 nt, Homo sapiens
ccuaggcauuugcugaa

SEQ ID NO: 386767 - RNA, 20 nt, Homo sapiens
ccuagucuuuuaaacaguuu

SEQ ID NO: 386768 - RNA, 14 nt, Homo sapiens
ccuauguaugccau

SEQ ID NO: 386769 - RNA, 18 nt, Homo sapiens
ccuaugugggugggacca

SEQ ID NO: 386770 - RNA, 11 nt, Homo sapiens
ccuauuugcac

SEQ ID NO: 386771 - RNA, 13 nt, Homo sapiens
ccucaaagcacac

SEQ ID NO: 386772 - RNA, 17 nt, Homo sapiens
ccucaaagcacacguca

SEQ ID NO: 386773 - RNA, 20 nt, Homo sapiens
ccucacagagugcauuguga

SEQ ID NO: 386774 - RNA, 14 nt, Homo sapiens
ccucacaucuuuca

SEQ ID NO: 386775 - RNA, 21 nt, Homo sapiens
ccucacaucuuucacacuucc

SEQ ID NO: 386776 - RNA, 16 nt, Homo sapiens
ccucagucccaacucc

SEQ ID NO: 386777 - RNA, 13 nt, Homo sapiens
ccucaugcaucuc

SEQ ID NO: 386778 - RNA, 20 nt, Homo sapiens
ccucauuagcauuuugcuaa

SEQ ID NO: 386779 - RNA, 17 nt, Homo sapiens
ccucauuuaucccucaa

SEQ ID NO: 386780 - RNA, 19 nt, Homo sapiens
ccucauuugggguagcuag

SEQ ID NO: 386781 - RNA, 11 nt, Homo sapiens
ccuccccaugg

SEQ ID NO: 386782 - RNA, 17 nt, Homo sapiens
ccucccuucucuucaca

SEQ ID NO: 386783 - RNA, 16 nt, Homo sapiens
ccuccucacuggccau

SEQ ID NO: 386784 - RNA, 18 nt, Homo sapiens
ccuccugaagccacagca

SEQ ID NO: 386785 - RNA, 22 nt, Homo sapiens
ccuccugcuaacuccuagcuga

SEQ ID NO: 386786 - RNA, 15 nt, Homo sapiens
cugauaauaauugau

SEQ ID NO: 386787 - RNA, 12 nt, Homo sapiens
cugauaccucaa

SEQ ID NO: 386788 - RNA, 22 nt, Homo sapiens
cugauauaacaaacuacaugua

SEQ ID NO: 386789 - RNA, 13 nt, Homo sapiens
cugaucugaugca

SEQ ID NO: 386790 - RNA, 19 nt, Homo sapiens
cugaucuuauucuguggug

SEQ ID NO: 386791 - RNA, 14 nt, Homo sapiens
cugaugacaacuuc

SEQ ID NO: 386792 - RNA, 15 nt, Homo sapiens
cugauuccacuuuua

SEQ ID NO: 386793 - RNA, 15 nt, Homo sapiens
cugcaaacgcugccu

SEQ ID NO: 386794 - RNA, 14 nt, Homo sapiens
cugcaagcacugca

SEQ ID NO: 386795 - RNA, 17 nt, Homo sapiens
cugcaauuuuaauugau

SEQ ID NO: 386796 - RNA, 20 nt, Homo sapiens
cugcacuggaguccagucuc

SEQ ID NO: 386797 - RNA, 23 nt, Homo sapiens
cugcaggagagaaugcccaguga

SEQ ID NO: 386798 - RNA, 15 nt, Homo sapiens
cugcaggcagggcug

SEQ ID NO: 386799 - RNA, 16 nt, Homo sapiens
cugcauguaaacacgc

SEQ ID NO: 386800 - RNA, 15 nt, Homo sapiens
cugcauucacccaga

SEQ ID NO: 386801 - RNA, 16 nt, Homo sapiens
cugcauuccuagaaau

SEQ ID NO: 386802 - RNA, 18 nt, Homo sapiens
cugccaaaggaugugaua

SEQ ID NO: 386803 - RNA, 18 nt, Homo sapiens
cugccauuucugagauca

SEQ ID NO: 386804 - RNA, 21 nt, Homo sapiens
cugcccugggauguccacaga

SEQ ID NO: 386805 - RNA, 16 nt, Homo sapiens
cugcccuugucccacu

SEQ ID NO: 386806 - RNA, 22 nt, Homo sapiens
cugccuaagugcagccccgugg

SEQ ID NO: 386807 - RNA, 20 nt, Homo sapiens
cugccuauuaguaguuaauu

SEQ ID NO: 386808 - RNA, 23 nt, Homo sapiens
cugccuccagaauggucuuucua

SEQ ID NO: 386809 - RNA, 19 nt, Homo sapiens
cugccugcggaccagauga

SEQ ID NO: 386810 - RNA, 18 nt, Homo sapiens
cugccuuaucuugcaccc

SEQ ID NO: 386811 - RNA, 13 nt, Homo sapiens
cugcgacugauga

SEQ ID NO: 386812 - RNA, 20 nt, Homo sapiens
cugcggcacccuugcgcuuu

SEQ ID NO: 386813 - RNA, 15 nt, Homo sapiens
cugcuacaacuucag

SEQ ID NO: 386814 - RNA, 12 nt, Homo sapiens
cugcuaccucac

SEQ ID NO: 386815 - RNA, 18 nt, Homo sapiens
cugcucccugaagccagc

SEQ ID NO: 386816 - RNA, 23 nt, Homo sapiens
cugcuccgugcuuguuugcucac

SEQ ID NO: 386817 - RNA, 18 nt, Homo sapiens
cugcugaaacaacaaaua

SEQ ID NO: 386818 - RNA, 11 nt, Homo sapiens
cugcugaauaa

SEQ ID NO: 386819 - RNA, 14 nt, Homo sapiens
cugcugaccuccac

SEQ ID NO: 386820 - RNA, 19 nt, Homo sapiens
cugcugagugcaccacuuc

SEQ ID NO: 386821 - RNA, 15 nt, Homo sapiens
cugcugcugcuaauc

SEQ ID NO: 386822 - RNA, 19 nt, Homo sapiens
cugcuggggaucuagggaa

SEQ ID NO: 386823 - RNA, 17 nt, Homo sapiens
cugcuugaacccaggag

SEQ ID NO: 386824 - RNA, 13 nt, Homo sapiens
cugcuuguguuaa

SEQ ID NO: 386825 - RNA, 11 nt, Homo sapiens
cugcuuuccac

SEQ ID NO: 386826 - RNA, 16 nt, Homo sapiens
cuggaaagaaaacaca

SEQ ID NO: 386827 - RNA, 20 nt, Homo sapiens
cuggaauguaaucaauguuu

SEQ ID NO: 386828 - RNA, 21 nt, Homo sapiens
cuggaccugcccugggccaca

SEQ ID NO: 386829 - RNA, 18 nt, Homo sapiens
cuggacggggacugggga

SEQ ID NO: 386830 - RNA, 12 nt, Homo sapiens
cuggacuuuccu

SEQ ID NO: 386831 - RNA, 20 nt, Homo sapiens
cuggagaacuagagaaggac

SEQ ID NO: 386832 - RNA, 21 nt, Homo sapiens
cuggagucgggacuaacccag

SEQ ID NO: 386833 - RNA, 20 nt, Homo sapiens
cuggaguggaguggcgugau

SEQ ID NO: 386834 - RNA, 15 nt, Homo sapiens
cuggcaagaaugugu

SEQ ID NO: 386835 - RNA, 22 nt, Homo sapiens
cuggcagaaagcaaaugugacc

SEQ ID NO: 386836 - RNA, 19 nt, Homo sapiens
cuggcauuugcaccuaccu

SEQ ID NO: 386837 - RNA, 19 nt, Homo sapiens
cuggccagccuacaauggg

SEQ ID NO: 386838 - RNA, 15 nt, Homo sapiens
cuggcucaaagacaa

SEQ ID NO: 386839 - RNA, 20 nt, Homo sapiens
cuggcuucacagauguguga

SEQ ID NO: 386840 - RNA, 15 nt, Homo sapiens
cugggacugcugcuu

SEQ ID NO: 386841 - RNA, 15 nt, Homo sapiens
cugggagacuuugaa

SEQ ID NO: 386842 - RNA, 14 nt, Homo sapiens
cugggcaacacagc

SEQ ID NO: 386843 - RNA, 22 nt, Homo sapiens
cugggcauauccaccaccuccc

SEQ ID NO: 386844 - RNA, 15 nt, Homo sapiens
cugggccccaccacc

SEQ ID NO: 386845 - RNA, 12 nt, Homo sapiens
cugggcucucca

SEQ ID NO: 386846 - RNA, 14 nt, Homo sapiens
cuggggcaauggga

SEQ ID NO: 386847 - RNA, 14 nt, Homo sapiens
cugggucagugguc

SEQ ID NO: 386848 - RNA, 23 nt, Homo sapiens
cugggucucgcuuuguugcccag

SEQ ID NO: 386849 - RNA, 20 nt, Homo sapiens
cugguaauuuaagauuccag

SEQ ID NO: 386850 - RNA, 15 nt, Homo sapiens
cuggugacaccagcc

SEQ ID NO: 386851 - RNA, 19 nt, Homo sapiens
cugguggcccgacagccug

SEQ ID NO: 386852 - RNA, 21 nt, Homo sapiens
cugguuguugccaaacagcca

SEQ ID NO: 386853 - RNA, 23 nt, Homo sapiens
cuguaaagguuuuuggaauuaug

SEQ ID NO: 386854 - RNA, 15 nt, Homo sapiens
cuguaacaugcaauu

SEQ ID NO: 386855 - RNA, 14 nt, Homo sapiens
cuguaaccucuuca

SEQ ID NO: 386856 - RNA, 16 nt, Homo sapiens
cuguaaggcauuuuca

SEQ ID NO: 386857 - RNA, 18 nt, Homo sapiens
cuguaaucccagcuacuu

SEQ ID NO: 386858 - RNA, 16 nt, Homo sapiens
cuguaccacacagcca

SEQ ID NO: 386859 - RNA, 18 nt, Homo sapiens
cuguaccugugcacguug

SEQ ID NO: 386860 - RNA, 22 nt, Homo sapiens
cuguacuccagccugggugaca

SEQ ID NO: 386861 - RNA, 18 nt, Homo sapiens
cuguagcauuacaguggg

SEQ ID NO: 386862 - RNA, 14 nt, Homo sapiens
cuguagucccagcu

SEQ ID NO: 386863 - RNA, 16 nt, Homo sapiens
cuguaugauuccuuga

SEQ ID NO: 386864 - RNA, 16 nt, Homo sapiens
cuguauuaagccacuu

SEQ ID NO: 386865 - RNA, 19 nt, Homo sapiens
cugucacguagaacuugga

SEQ ID NO: 386866 - RNA, 19 nt, Homo sapiens
cugucccucacagcacuag

SEQ ID NO: 386867 - RNA, 14 nt, Homo sapiens
cuguccuugcacac

SEQ ID NO: 386868 - RNA, 22 nt, Homo sapiens
cugucucaaaaccgaguugcca

SEQ ID NO: 386869 - RNA, 22 nt, Homo sapiens
cugucucuacuaaaaauacaau

SEQ ID NO: 386870 - RNA, 14 nt, Homo sapiens
cugucugacaaccu

SEQ ID NO: 386871 - RNA, 23 nt, Homo sapiens
cugucuuagagugggaccaacuu

SEQ ID NO: 386872 - RNA, 14 nt, Homo sapiens
cugucuucucaggc

SEQ ID NO: 386873 - RNA, 21 nt, Homo sapiens
cugugaaaguacauuuggaga

SEQ ID NO: 386874 - RNA, 21 nt, Homo sapiens
cugugaaaugcuggcauuugc

SEQ ID NO: 386875 - RNA, 15 nt, Homo sapiens
cugugaccucaggca

SEQ ID NO: 386876 - RNA, 22 nt, Homo sapiens
cugugaggccccuggacaagca

SEQ ID NO: 386877 - RNA, 22 nt, Homo sapiens
cugugcagguggggagacuggg

SEQ ID NO: 386878 - RNA, 17 nt, Homo sapiens
cugugccucugccuguc

SEQ ID NO: 386879 - RNA, 18 nt, Homo sapiens
cuguggaugauaaaacac

SEQ ID NO: 386880 - RNA, 16 nt, Homo sapiens
cuguggcggugccugg

SEQ ID NO: 386881 - RNA, 17 nt, Homo sapiens
cugugguuaacaucuca

SEQ ID NO: 386882 - RNA, 13 nt, Homo sapiens
cuguuagagucca

SEQ ID NO: 386883 - RNA, 13 nt, Homo sapiens
cuguucaaaaagg

SEQ ID NO: 386884 - RNA, 17 nt, Homo sapiens
cuguucagcugguugag

SEQ ID NO: 386885 - RNA, 20 nt, Homo sapiens
cuguuguaggguugccagau

SEQ ID NO: 386886 - RNA, 19 nt, Homo sapiens
cuguuuccauagggugaca

SEQ ID NO: 386887 - RNA, 20 nt, Homo sapiens
cuguuucccuuucacuggca

SEQ ID NO: 386888 - RNA, 19 nt, Homo sapiens
cuuaagacuuuugggacau

SEQ ID NO: 386889 - RNA, 23 nt, Homo sapiens
cuuaaguuguggagagugcaaca

SEQ ID NO: 386890 - RNA, 17 nt, Homo sapiens
cuuaauaacaacagauc

SEQ ID NO: 386891 - RNA, 19 nt, Homo sapiens
cuuaaugucuuuaaaagua

SEQ ID NO: 386892 - RNA, 20 nt, Homo sapiens
cuuacauuugaaaucuauga

SEQ ID NO: 386893 - RNA, 16 nt, Homo sapiens
cuuaccucacagugau

SEQ ID NO: 386894 - RNA, 14 nt, Homo sapiens
cuuagaaaaaccac

SEQ ID NO: 386895 - RNA, 19 nt, Homo sapiens
cuuagaauuugggggaaaa

SEQ ID NO: 386896 - RNA, 19 nt, Homo sapiens
cuuagcagcuaucucucag

SEQ ID NO: 386897 - RNA, 13 nt, Homo sapiens
cuuagcauguccc

SEQ ID NO: 386898 - RNA, 11 nt, Homo sapiens
cuuagcucaca

SEQ ID NO: 386899 - RNA, 14 nt, Homo sapiens
cuuaggcagggaag

SEQ ID NO: 386900 - RNA, 17 nt, Homo sapiens
cuuauaucaucagcaua

SEQ ID NO: 386901 - RNA, 18 nt, Homo sapiens
cuuauauucauccaugcc

SEQ ID NO: 386902 - RNA, 14 nt, Homo sapiens
cuuauccaacucuc

SEQ ID NO: 386903 - RNA, 22 nt, Homo sapiens
cuucaagaucauguaccccaau

SEQ ID NO: 386904 - RNA, 22 nt, Homo sapiens
cuucaaggcccauaucugugaa

SEQ ID NO: 386905 - RNA, 19 nt, Homo sapiens
cuucaaucucuugcacuca

SEQ ID NO: 386906 - RNA, 23 nt, Homo sapiens
cuucacagaugugugauucacag

SEQ ID NO: 386907 - RNA, 15 nt, Homo sapiens
cuucacucaaucucu

SEQ ID NO: 386908 - RNA, 14 nt, Homo sapiens
cuucagguggaaaa

SEQ ID NO: 386909 - RNA, 16 nt, Homo sapiens
cuucagugggagaaaa

SEQ ID NO: 386910 - RNA, 21 nt, Homo sapiens
cuucauccucugagugugacc

SEQ ID NO: 386911 - RNA, 21 nt, Homo sapiens
cuuccaacucaaacucuuaaa

SEQ ID NO: 386912 - RNA, 21 nt, Homo sapiens
cuuccaauuuacauacucugc

SEQ ID NO: 386913 - RNA, 23 nt, Homo sapiens
cuuccacaccuagcaucucauga

SEQ ID NO: 386914 - RNA, 14 nt, Homo sapiens
cuuccacugagggc

SEQ ID NO: 386915 - RNA, 18 nt, Homo sapiens
cuuccagauugacgacaa

SEQ ID NO: 386916 - RNA, 19 nt, Homo sapiens
cuucccgaaccccaaggag

SEQ ID NO: 386917 - RNA, 20 nt, Homo sapiens
cuucccggcgucccuaccuc

SEQ ID NO: 386918 - RNA, 21 nt, Homo sapiens
cuucccuggcuuguaacucca

SEQ ID NO: 386919 - RNA, 20 nt, Homo sapiens
cuucccuuucugcuuguguu

SEQ ID NO: 386920 - RNA, 16 nt, Homo sapiens
cuuccguaacccaacu

SEQ ID NO: 386921 - RNA, 16 nt, Homo sapiens
cuuccuacccuuccuc

SEQ ID NO: 386922 - RNA, 19 nt, Homo sapiens
cuuccugaguggugccaaa

SEQ ID NO: 386923 - RNA, 15 nt, Homo sapiens
cuuccuugaccagca

SEQ ID NO: 386924 - RNA, 15 nt, Homo sapiens
cuucgaggcccagcg

SEQ ID NO: 386925 - RNA, 14 nt, Homo sapiens
cuucggacaacuca

SEQ ID NO: 386926 - RNA, 20 nt, Homo sapiens
cuucuaaaugaagugcaaau

SEQ ID NO: 386927 - RNA, 17 nt, Homo sapiens
cuucuaaucaaagcuuu

SEQ ID NO: 386928 - RNA, 22 nt, Homo sapiens
gaagcuguguccuugcaccugc

SEQ ID NO: 386929 - RNA, 14 nt, Homo sapiens
gaaggaaaaugaua

SEQ ID NO: 386930 - RNA, 23 nt, Homo sapiens
gaaggaggcuggcuuguccccuc

SEQ ID NO: 386931 - RNA, 13 nt, Homo sapiens
gaaggcaugccua

SEQ ID NO: 386932 - RNA, 20 nt, Homo sapiens
gaagggaaaagcccaugauc

SEQ ID NO: 386933 - RNA, 12 nt, Homo sapiens
gaaggugcuguu

SEQ ID NO: 386934 - RNA, 20 nt, Homo sapiens
gaagguucuacgccagggga

SEQ ID NO: 386935 - RNA, 22 nt, Homo sapiens
gaaguaugagggaaaaugagua

SEQ ID NO: 386936 - RNA, 16 nt, Homo sapiens
gaagucacugcacagu

SEQ ID NO: 386937 - RNA, 14 nt, Homo sapiens
gaagugacucucac

SEQ ID NO: 386938 - RNA, 20 nt, Homo sapiens
gaaguugcagugagcugaua

SEQ ID NO: 386939 - RNA, 14 nt, Homo sapiens
gaauaaaauugcac

SEQ ID NO: 386940 - RNA, 21 nt, Homo sapiens
gaauaaaccaucaucuugcca

SEQ ID NO: 386941 - RNA, 11 nt, Homo sapiens
gaauaaagccu

SEQ ID NO: 386942 - RNA, 15 nt, Homo sapiens
gaauaaaugucuugc

SEQ ID NO: 386943 - RNA, 17 nt, Homo sapiens
gaauaaauugcuccuug

SEQ ID NO: 386944 - RNA, 12 nt, Homo sapiens
gaauaagucaug

SEQ ID NO: 386945 - RNA, 16 nt, Homo sapiens
gaauaaugaauggacu

SEQ ID NO: 386946 - RNA, 15 nt, Homo sapiens
gaauagaugcugacu

SEQ ID NO: 386947 - RNA, 14 nt, Homo sapiens
gaauaugaacggug

SEQ ID NO: 386948 - RNA, 16 nt, Homo sapiens
gaaucaaaugcaauuu

SEQ ID NO: 386949 - RNA, 23 nt, Homo sapiens
gaaucagugaagaugccagugaa

SEQ ID NO: 386950 - RNA, 23 nt, Homo sapiens
gaauccaguccagauauuucaca

SEQ ID NO: 386951 - RNA, 19 nt, Homo sapiens
gaaucuacaaaaaacaaca

SEQ ID NO: 386952 - RNA, 18 nt, Homo sapiens
gaaugaacaaauugaacu

SEQ ID NO: 386953 - RNA, 15 nt, Homo sapiens
gaaugacaacagaag

SEQ ID NO: 386954 - RNA, 11 nt, Homo sapiens
gaaugcagugg

SEQ ID NO: 386955 - RNA, 17 nt, Homo sapiens
gaauggauuuaucagaa

SEQ ID NO: 386956 - RNA, 15 nt, Homo sapiens
gaaugugauauuuga

SEQ ID NO: 386957 - RNA, 15 nt, Homo sapiens
gaauguuaagcagau

SEQ ID NO: 386958 - RNA, 17 nt, Homo sapiens
gaauguuuacacucuuu

SEQ ID NO: 386959 - RNA, 15 nt, Homo sapiens
gaauuaacacaugau

SEQ ID NO: 386960 - RNA, 15 nt, Homo sapiens
gaauuaacaggaaau

SEQ ID NO: 386961 - RNA, 20 nt, Homo sapiens
gaauuauaauuaguuccuca

SEQ ID NO: 386962 - RNA, 17 nt, Homo sapiens
gacaaaccgagugcaau

SEQ ID NO: 386963 - RNA, 18 nt, Homo sapiens
gacaacagcccugucuca

SEQ ID NO: 386964 - RNA, 20 nt, Homo sapiens
gacaaucaugaaauaugcau

SEQ ID NO: 386965 - RNA, 18 nt, Homo sapiens
gacacaacuauuuuucca

SEQ ID NO: 386966 - RNA, 16 nt, Homo sapiens
gacacagcagugguau

SEQ ID NO: 386967 - RNA, 15 nt, Homo sapiens
gacacccagugccag

SEQ ID NO: 386968 - RNA, 15 nt, Homo sapiens
gacagaggaugagcu

SEQ ID NO: 386969 - RNA, 23 nt, Homo sapiens
gacagauuccaggcgaugugcaa

SEQ ID NO: 386970 - RNA, 19 nt, Homo sapiens
gacaggaggaaucauguca

SEQ ID NO: 386971 - RNA, 18 nt, Homo sapiens
gacaggauaagagggauu

SEQ ID NO: 386972 - RNA, 17 nt, Homo sapiens
gacaguguuuucuggga

SEQ ID NO: 386973 - RNA, 20 nt, Homo sapiens
gacaguuacccccaaccuga

SEQ ID NO: 386974 - RNA, 17 nt, Homo sapiens
gacaucaagcacagaag

SEQ ID NO: 386975 - RNA, 18 nt, Homo sapiens
gacaucgguucauauuaa

SEQ ID NO: 386976 - RNA, 24 nt, Homo sapiens
gacaucgguucauauuaagacaua

SEQ ID NO: 386977 - RNA, 13 nt, Homo sapiens
gacaucucagggg

SEQ ID NO: 386978 - RNA, 22 nt, Homo sapiens
gacauuugggagacaugugaca

SEQ ID NO: 386979 - RNA, 19 nt, Homo sapiens
gaccaaugucuugaugcau

SEQ ID NO: 386980 - RNA, 21 nt, Homo sapiens
gaccacgcuuucuagcuguug

SEQ ID NO: 386981 - RNA, 22 nt, Homo sapiens
gaccacucugucuuguguuucc

SEQ ID NO: 386982 - RNA, 17 nt, Homo sapiens
gaccacuguuaucaaaa

SEQ ID NO: 386983 - RNA, 14 nt, Homo sapiens
gaccagaaccagag

SEQ ID NO: 386984 - RNA, 22 nt, Homo sapiens
gaccagaaccagagcucagaga

SEQ ID NO: 386985 - RNA, 24 nt, Homo sapiens
gaccagucacugacccugugcaga

SEQ ID NO: 386986 - RNA, 17 nt, Homo sapiens
gaccaguccuguuugca

SEQ ID NO: 386987 - RNA, 15 nt, Homo sapiens
gaccagucugacccu

SEQ ID NO: 386988 - RNA, 17 nt, Homo sapiens
gaccauucaggacacag

SEQ ID NO: 386989 - RNA, 15 nt, Homo sapiens
gaccauucauaccca

SEQ ID NO: 386990 - RNA, 23 nt, Homo sapiens
gacccagucagaguugugcacau

SEQ ID NO: 386991 - RNA, 19 nt, Homo sapiens
gaccccagaggauugcugc

SEQ ID NO: 386992 - RNA, 14 nt, Homo sapiens
gaccccuccucacu

SEQ ID NO: 386993 - RNA, 20 nt, Homo sapiens
gaccccuccucacuggccau

SEQ ID NO: 386994 - RNA, 20 nt, Homo sapiens
gacccggaggggccuggcag

SEQ ID NO: 386995 - RNA, 15 nt, Homo sapiens
gacccugggaccaca

SEQ ID NO: 386996 - RNA, 21 nt, Homo sapiens
gaccucaaaggugauugugcc

SEQ ID NO: 386997 - RNA, 14 nt, Homo sapiens
gaccucagccugug

SEQ ID NO: 386998 - RNA, 12 nt, Homo sapiens
gaccuugcacaa

SEQ ID NO: 386999 - RNA, 14 nt, Homo sapiens
gacgacaagugcug

SEQ ID NO: 387000 - RNA, 15 nt, Homo sapiens
gacggaugauuggau

SEQ ID NO: 387001 - RNA, 21 nt, Homo sapiens
gacgggacccugagccugugu

SEQ ID NO: 387002 - RNA, 15 nt, Homo sapiens
gacgguucaccagcc

SEQ ID NO: 387003 - RNA, 15 nt, Homo sapiens
gacguaaucuccaca

SEQ ID NO: 387004 - RNA, 17 nt, Homo sapiens
gacuacuccaagggaau

SEQ ID NO: 387005 - RNA, 17 nt, Homo sapiens
gacuauggcuaccaaaa

SEQ ID NO: 387006 - RNA, 20 nt, Homo sapiens
gacuauggcucuacuuucag

SEQ ID NO: 387007 - RNA, 12 nt, Homo sapiens
gacucacauccu

SEQ ID NO: 387008 - RNA, 18 nt, Homo sapiens
gacucaggaugcccaggg

SEQ ID NO: 387009 - RNA, 22 nt, Homo sapiens
gacucaguuuucuugcagauca

SEQ ID NO: 387010 - RNA, 13 nt, Homo sapiens
gacuccaguuaaa

SEQ ID NO: 387011 - RNA, 22 nt, Homo sapiens
gacuccuuagagacaucaaaau

SEQ ID NO: 387012 - RNA, 15 nt, Homo sapiens
gacugagcagacugg

SEQ ID NO: 387013 - RNA, 20 nt, Homo sapiens
gacuggguuuugugauugcc

SEQ ID NO: 387014 - RNA, 18 nt, Homo sapiens
gacugguuguugccaaac

SEQ ID NO: 387015 - RNA, 20 nt, Homo sapiens
gacuguggcugcuagcacuu

SEQ ID NO: 387016 - RNA, 13 nt, Homo sapiens
gacuucacacugc

SEQ ID NO: 387017 - RNA, 22 nt, Homo sapiens
gagaaaauaaagaccuugcuua

SEQ ID NO: 387018 - RNA, 20 nt, Homo sapiens
gagaaaccuuauuguaccuc

SEQ ID NO: 387019 - RNA, 19 nt, Homo sapiens
gagaaacuguagucucagg

SEQ ID NO: 387020 - RNA, 23 nt, Homo sapiens
gagaaagagcacuuaagagaaua

SEQ ID NO: 387021 - RNA, 20 nt, Homo sapiens
gagaaaggggauguauccau

SEQ ID NO: 387022 - RNA, 20 nt, Homo sapiens
gagaacuccuaggguggcug

SEQ ID NO: 387023 - RNA, 23 nt, Homo sapiens
gagaagaauuuucagaccccagc

SEQ ID NO: 387024 - RNA, 22 nt, Homo sapiens
gagaagagcuguucacagccag

SEQ ID NO: 387025 - RNA, 13 nt, Homo sapiens
gagacaugugaca

SEQ ID NO: 387026 - RNA, 16 nt, Homo sapiens
gagacaugugacauuu

SEQ ID NO: 387027 - RNA, 23 nt, Homo sapiens
gagacucagggccccagcacuaa

SEQ ID NO: 387028 - RNA, 18 nt, Homo sapiens
gagacuccgucucaagga

SEQ ID NO: 387029 - RNA, 13 nt, Homo sapiens
gagacugggucuc

SEQ ID NO: 387030 - RNA, 20 nt, Homo sapiens
gagacuuugacucuccagaa

SEQ ID NO: 387031 - RNA, 21 nt, Homo sapiens
gagagaacaacuacugugauc

SEQ ID NO: 387032 - RNA, 16 nt, Homo sapiens
gagagcaaaugcuauu

SEQ ID NO: 387033 - RNA, 11 nt, Homo sapiens
gagagcucacu

SEQ ID NO: 387034 - RNA, 23 nt, Homo sapiens
gagaggagaaggagggagacaug

SEQ ID NO: 387035 - RNA, 17 nt, Homo sapiens
gagauccuuuaaauccu

SEQ ID NO: 387036 - RNA, 17 nt, Homo sapiens
gagauggaggaaaguga

SEQ ID NO: 387037 - RNA, 21 nt, Homo sapiens
gagaugggagaaucacuugaa

SEQ ID NO: 387038 - RNA, 22 nt, Homo sapiens
gagcaagacucugucucaaaaa

SEQ ID NO: 387039 - RNA, 21 nt, Homo sapiens
gagcacuggguugacuuucag

SEQ ID NO: 387040 - RNA, 17 nt, Homo sapiens
gagcaggaagcauucag

SEQ ID NO: 387041 - RNA, 20 nt, Homo sapiens
gagcaggcuacugucagcuc

SEQ ID NO: 387042 - RNA, 18 nt, Homo sapiens
gagcagggauuaaccucu

SEQ ID NO: 387043 - RNA, 17 nt, Homo sapiens
gagcaguggcuggucca

SEQ ID NO: 387044 - RNA, 17 nt, Homo sapiens
gagcaugggacuguucu

SEQ ID NO: 387045 - RNA, 17 nt, Homo sapiens
gagccagccuugcagua

SEQ ID NO: 387046 - RNA, 21 nt, Homo sapiens
gagccccugggacugcugcuu

SEQ ID NO: 387047 - RNA, 21 nt, Homo sapiens
gagccgagauugcaccacugc

SEQ ID NO: 387048 - RNA, 14 nt, Homo sapiens
gagccgcugugagc

SEQ ID NO: 387049 - RNA, 11 nt, Homo sapiens
gagcugugcag

SEQ ID NO: 387050 - RNA, 20 nt, Homo sapiens
gagcuguuuucccugaccuc

SEQ ID NO: 387051 - RNA, 20 nt, Homo sapiens
gagcuuuugguaugugacau

SEQ ID NO: 387052 - RNA, 20 nt, Homo sapiens
gaggaaaaauaaagacaaau

SEQ ID NO: 387053 - RNA, 16 nt, Homo sapiens
gaggaaaggccagcug

SEQ ID NO: 387054 - RNA, 20 nt, Homo sapiens
gaggaaaggccagcuggcag

SEQ ID NO: 387055 - RNA, 18 nt, Homo sapiens
gaggaacuguccagagag

SEQ ID NO: 387056 - RNA, 23 nt, Homo sapiens
gaggaauuucuugauuaauguug

SEQ ID NO: 387057 - RNA, 17 nt, Homo sapiens
gaggacgucuucuaggg

SEQ ID NO: 387058 - RNA, 18 nt, Homo sapiens
gaggagggcgugacucac

SEQ ID NO: 387059 - RNA, 20 nt, Homo sapiens
gaggcaagagaauugcuuga

SEQ ID NO: 387060 - RNA, 17 nt, Homo sapiens
gaggcagaacugcuuga

SEQ ID NO: 387061 - RNA, 20 nt, Homo sapiens
gaggcagagguugcagugag

SEQ ID NO: 387062 - RNA, 18 nt, Homo sapiens
gaggccagccagugaccu

SEQ ID NO: 387063 - RNA, 15 nt, Homo sapiens
gaggccucgacccac

SEQ ID NO: 387064 - RNA, 18 nt, Homo sapiens
gaggcucccucuugacgu

SEQ ID NO: 387065 - RNA, 16 nt, Homo sapiens
gaggcugaggcaagag

SEQ ID NO: 387066 - RNA, 18 nt, Homo sapiens
gaggcugaggcgggugga

SEQ ID NO: 387067 - RNA, 12 nt, Homo sapiens
gaggcuggccaa

SEQ ID NO: 387068 - RNA, 23 nt, Homo sapiens
gaggguuguucuccuagacugac

SEQ ID NO: 387069 - RNA, 17 nt, Homo sapiens
gaggugagggaagccug

SEQ ID NO: 387070 - RNA, 19 nt, Homo sapiens
gagguggagguugcaguga

SEQ ID NO: 387071 - RNA, 21 nt, Homo sapiens
gaguaucugggaacugugccu

SEQ ID NO: 387072 - RNA, 22 nt, Homo sapiens
gagucaauccccucauucagga

SEQ ID NO: 387073 - RNA, 12 nt, Homo sapiens
gagucacugccu

SEQ ID NO: 387074 - RNA, 17 nt, Homo sapiens
gagucagcagaacuggg

SEQ ID NO: 387075 - RNA, 17 nt, Homo sapiens
gagucucuucuccacug

SEQ ID NO: 387076 - RNA, 15 nt, Homo sapiens
gagucugaacagcug

SEQ ID NO: 387077 - RNA, 20 nt, Homo sapiens
gagucuugcucuguugccca

SEQ ID NO: 387078 - RNA, 23 nt, Homo sapiens
gagugcccagaacuggacucagg

SEQ ID NO: 387079 - RNA, 11 nt, Homo sapiens
gaguggugcca

SEQ ID NO: 387080 - RNA, 12 nt, Homo sapiens
gaguguacuuaa

SEQ ID NO: 387081 - RNA, 23 nt, Homo sapiens
gagugucuuuccacggagccacu

SEQ ID NO: 387082 - RNA, 13 nt, Homo sapiens
gagugugugcaag

SEQ ID NO: 387083 - RNA, 15 nt, Homo sapiens
gauaaacauuuaacu

SEQ ID NO: 387084 - RNA, 17 nt, Homo sapiens
gauaacuugagcaccgu

SEQ ID NO: 387085 - RNA, 18 nt, Homo sapiens
gauacuguaacacuuuac

SEQ ID NO: 387086 - RNA, 12 nt, Homo sapiens
gauagcuuuauu

SEQ ID NO: 387087 - RNA, 15 nt, Homo sapiens
gauaguaacaaugaa

SEQ ID NO: 387088 - RNA, 20 nt, Homo sapiens
gauauacuauuuucauucuc

SEQ ID NO: 387089 - RNA, 16 nt, Homo sapiens
gauaucaaaagcaaau

SEQ ID NO: 387090 - RNA, 15 nt, Homo sapiens
gauaucaugccccug

SEQ ID NO: 387091 - RNA, 23 nt, Homo sapiens
gaucacagccucugaaaaccaau

SEQ ID NO: 387092 - RNA, 19 nt, Homo sapiens
gaucagccugggcaaugug

SEQ ID NO: 387093 - RNA, 14 nt, Homo sapiens
gauccgagucuacc

SEQ ID NO: 387094 - RNA, 20 nt, Homo sapiens
gauccuucaaagagucauau

SEQ ID NO: 387095 - RNA, 21 nt, Homo sapiens
gaucuaaggaugucacagggc

SEQ ID NO: 387096 - RNA, 20 nt, Homo sapiens
gaugaaauuuucuagacuuu

SEQ ID NO: 387097 - RNA, 21 nt, Homo sapiens
gaugaagauucuccugugcua

SEQ ID NO: 387098 - RNA, 17 nt, Homo sapiens
gaugaggcuggccaagc

SEQ ID NO: 387099 - RNA, 22 nt, Homo sapiens
gaugaucuuuaaaauacacacu

SEQ ID NO: 387100 - RNA, 20 nt, Homo sapiens
gaugauggucuucagccucu

SEQ ID NO: 387101 - RNA, 16 nt, Homo sapiens
gaugcagagucagcag

SEQ ID NO: 387102 - RNA, 19 nt, Homo sapiens
gauggagauauuuacauga

SEQ ID NO: 387103 - RNA, 9 nt, Homo sapiens
gauggagcu

SEQ ID NO: 387104 - RNA, 20 nt, Homo sapiens
gaugggagaaucacuugaac

SEQ ID NO: 387105 - RNA, 23 nt, Homo sapiens
gaugucucacauccucugucuau

SEQ ID NO: 387106 - RNA, 20 nt, Homo sapiens
gauuaaacaaacaaacaauu

SEQ ID NO: 387107 - RNA, 14 nt, Homo sapiens
gauuaaccucugca

SEQ ID NO: 387108 - RNA, 17 nt, Homo sapiens
gauuacaccagccucgu

SEQ ID NO: 387109 - RNA, 21 nt, Homo sapiens
gauuaccuaguagucauuuca

SEQ ID NO: 387110 - RNA, 14 nt, Homo sapiens
gauuagacagucaa

SEQ ID NO: 387111 - RNA, 13 nt, Homo sapiens
gauuauucagugu

SEQ ID NO: 387112 - RNA, 12 nt, Homo sapiens
gauuauucugau

SEQ ID NO: 387113 - RNA, 14 nt, Homo sapiens
gauucaaaucuaug

SEQ ID NO: 387114 - RNA, 21 nt, Homo sapiens
gauucacaaugaaaugcucuc

SEQ ID NO: 387115 - RNA, 14 nt, Homo sapiens
gauucacaguguga

SEQ ID NO: 387116 - RNA, 13 nt, Homo sapiens
gauuccacuuuua

SEQ ID NO: 387117 - RNA, 19 nt, Homo sapiens
gauuccaggcgaugugcaa

SEQ ID NO: 387118 - RNA, 23 nt, Homo sapiens
gauuccaggcgaugugcaagugu

SEQ ID NO: 387119 - RNA, 21 nt, Homo sapiens
gauucuaugaggcaaccacag

SEQ ID NO: 387120 - RNA, 20 nt, Homo sapiens
gauugcacguggccucuuga

SEQ ID NO: 387121 - RNA, 23 nt, Homo sapiens
gauugcccauccaucugcuuaca

SEQ ID NO: 387122 - RNA, 20 nt, Homo sapiens
gauugugccccugcacucca

SEQ ID NO: 387123 - RNA, 15 nt, Homo sapiens
gauuucacagugugu

SEQ ID NO: 387124 - RNA, 17 nt, Homo sapiens
gauuuuuagcuuuacaa

SEQ ID NO: 387125 - RNA, 18 nt, Homo sapiens
gcaaaauugauguguuua

SEQ ID NO: 387126 - RNA, 16 nt, Homo sapiens
gcaaagacuuuccucu

SEQ ID NO: 387127 - RNA, 18 nt, Homo sapiens
gcaaagggagcacugggu

SEQ ID NO: 387128 - RNA, 19 nt, Homo sapiens
gcaaaguucccuacuuccu

SEQ ID NO: 387129 - RNA, 14 nt, Homo sapiens
gcaaaugaguauuu

SEQ ID NO: 387130 - RNA, 16 nt, Homo sapiens
gcaacucugagaucua

SEQ ID NO: 387131 - RNA, 15 nt, Homo sapiens
gcaacuuagcucaca

SEQ ID NO: 387132 - RNA, 18 nt, Homo sapiens
gcaagaagucaaaguaaa

SEQ ID NO: 387133 - RNA, 16 nt, Homo sapiens
gcaaggaaacuaugua

SEQ ID NO: 387134 - RNA, 23 nt, Homo sapiens
gcaaggaaacuauguaacaugua

SEQ ID NO: 387135 - RNA, 21 nt, Homo sapiens
gcaaggacggccuucaacuga

SEQ ID NO: 387136 - RNA, 22 nt, Homo sapiens
gcaaggacugcagggacugcca

SEQ ID NO: 387137 - RNA, 13 nt, Homo sapiens
gcaagugugugca

SEQ ID NO: 387138 - RNA, 18 nt, Homo sapiens
gcaagugugugcaugugu

SEQ ID NO: 387139 - RNA, 15 nt, Homo sapiens
gcaaguuaaagaaaa

SEQ ID NO: 387140 - RNA, 22 nt, Homo sapiens
gcaaugccaaucuucaguauuu

SEQ ID NO: 387141 - RNA, 16 nt, Homo sapiens
gcaauuucacugaugu

SEQ ID NO: 387142 - RNA, 23 nt, Homo sapiens
gcacacacaccacacauacacac

SEQ ID NO: 387143 - RNA, 12 nt, Homo sapiens
gcacacaggaag

SEQ ID NO: 387144 - RNA, 15 nt, Homo sapiens
gcacacccacucagc

SEQ ID NO: 387145 - RNA, 17 nt, Homo sapiens
gcacagcacccauggga

SEQ ID NO: 387146 - RNA, 13 nt, Homo sapiens
gcacauaacaugc

SEQ ID NO: 387147 - RNA, 12 nt, Homo sapiens
gcacaugugugc

SEQ ID NO: 387148 - RNA, 15 nt, Homo sapiens
gcacaugugugcgug

SEQ ID NO: 387149 - RNA, 20 nt, Homo sapiens
gcaccacugcacuccagccu

SEQ ID NO: 387150 - RNA, 12 nt, Homo sapiens
gcacccuggauu

SEQ ID NO: 387151 - RNA, 14 nt, Homo sapiens
gcaccgucauggcu

SEQ ID NO: 387152 - RNA, 18 nt, Homo sapiens
gcaccuuaccaacuuucu

SEQ ID NO: 387153 - RNA, 14 nt, Homo sapiens
gcacgcccaugugu

SEQ ID NO: 387154 - RNA, 19 nt, Homo sapiens
gcacgggcccgugacaucc

SEQ ID NO: 387155 - RNA, 23 nt, Homo sapiens
gcacguaguagggucaggccacg

SEQ ID NO: 387156 - RNA, 22 nt, Homo sapiens
gcacguggccucuugagcagug

SEQ ID NO: 387157 - RNA, 18 nt, Homo sapiens
gcacucaaagcuuguuaa

SEQ ID NO: 387158 - RNA, 13 nt, Homo sapiens
gcacucuauguuc

SEQ ID NO: 387159 - RNA, 16 nt, Homo sapiens
gcacugcugugcugug

SEQ ID NO: 387160 - RNA, 12 nt, Homo sapiens
gcagaacaguga

SEQ ID NO: 387161 - RNA, 22 nt, Homo sapiens
gcagaacugcuugaacccagga

SEQ ID NO: 387162 - RNA, 21 nt, Homo sapiens
gcagaagaauugaacccagga

SEQ ID NO: 387163 - RNA, 14 nt, Homo sapiens
gcagaagacaguau

SEQ ID NO: 387164 - RNA, 21 nt, Homo sapiens
gcagaaucuguuaccagagga

SEQ ID NO: 387165 - RNA, 17 nt, Homo sapiens
gcagaauugagagugau

SEQ ID NO: 387166 - RNA, 18 nt, Homo sapiens
gcagaauugagagugauu

SEQ ID NO: 387167 - RNA, 22 nt, Homo sapiens
gcagacaggaggaaucauguca

SEQ ID NO: 387168 - RNA, 14 nt, Homo sapiens
gcagaccacugaua

SEQ ID NO: 387169 - RNA, 21 nt, Homo sapiens
gcagagcuugaacacagucuc

SEQ ID NO: 387170 - RNA, 13 nt, Homo sapiens
gcagauccagagg

SEQ ID NO: 387171 - RNA, 18 nt, Homo sapiens
gcagauccagagguuucu

SEQ ID NO: 387172 - RNA, 20 nt, Homo sapiens
gcagcaucucugaacauuuc

SEQ ID NO: 387173 - RNA, 20 nt, Homo sapiens
gcagcccggcgccaccaucc

SEQ ID NO: 387174 - RNA, 16 nt, Homo sapiens
gcagccuccuccugac

SEQ ID NO: 387175 - RNA, 20 nt, Homo sapiens
gcagcuuagacuaaggccau

SEQ ID NO: 387176 - RNA, 14 nt, Homo sapiens
gcagcuuauucaca

SEQ ID NO: 387177 - RNA, 17 nt, Homo sapiens
gcagcuugaaacugaga

SEQ ID NO: 387178 - RNA, 19 nt, Homo sapiens
gcaggaaacauagaacuca

SEQ ID NO: 387179 - RNA, 23 nt, Homo sapiens
gcaggaagcauucagagagcagc

SEQ ID NO: 387180 - RNA, 12 nt, Homo sapiens
gcaggaccucag

SEQ ID NO: 387181 - RNA, 18 nt, Homo sapiens
gcaggacuaaaugucuag

SEQ ID NO: 387182 - RNA, 18 nt, Homo sapiens
gcaggcccccaggugcca

SEQ ID NO: 387183 - RNA, 17 nt, Homo sapiens
gcagguggaucacugga

SEQ ID NO: 387184 - RNA, 20 nt, Homo sapiens
gcagguggggagacugggcu

SEQ ID NO: 387185 - RNA, 19 nt, Homo sapiens
gcaguagaaauaauaugca

SEQ ID NO: 387186 - RNA, 23 nt, Homo sapiens
gcagucaucuugaccaagcagga

SEQ ID NO: 387187 - RNA, 19 nt, Homo sapiens
gcaguccugccucagccuc

SEQ ID NO: 387188 - RNA, 15 nt, Homo sapiens
gcagugacagaacua

SEQ ID NO: 387189 - RNA, 14 nt, Homo sapiens
gcagugagugagcc

SEQ ID NO: 387190 - RNA, 12 nt, Homo sapiens
gcagugcaacaa

SEQ ID NO: 387191 - RNA, 19 nt, Homo sapiens
gcaguugaaaagacuccaa

SEQ ID NO: 387192 - RNA, 22 nt, Homo sapiens
gcaguugaaacaagaagccaca

SEQ ID NO: 387193 - RNA, 21 nt, Homo sapiens
gcauaaguuucugggaccuca

SEQ ID NO: 387194 - RNA, 20 nt, Homo sapiens
gcauaccuuuauugugaucu

SEQ ID NO: 387195 - RNA, 18 nt, Homo sapiens
gcauagaguucagacuuu

SEQ ID NO: 387196 - RNA, 15 nt, Homo sapiens
gcaucaaugcugagu

SEQ ID NO: 387197 - RNA, 13 nt, Homo sapiens
gcaucacccagcu

SEQ ID NO: 387198 - RNA, 21 nt, Homo sapiens
gcaucaccuuaggcagggaag

SEQ ID NO: 387199 - RNA, 23 nt, Homo sapiens
gcaucagcugcugaaacaacaaa

SEQ ID NO: 387200 - RNA, 13 nt, Homo sapiens
gcaucucagccua

SEQ ID NO: 387201 - RNA, 17 nt, Homo sapiens
gcaucucugaacauuuc

SEQ ID NO: 387202 - RNA, 17 nt, Homo sapiens
gcaugccaaauguucca

SEQ ID NO: 387203 - RNA, 21 nt, Homo sapiens
gcauuaaaaaaaaaaucaaug

SEQ ID NO: 387204 - RNA, 15 nt, Homo sapiens
gcauuaaacauuuga

SEQ ID NO: 387205 - RNA, 13 nt, Homo sapiens
gcauucaagugua

SEQ ID NO: 387206 - RNA, 17 nt, Homo sapiens
gcauucaaguguacagu

SEQ ID NO: 387207 - RNA, 17 nt, Homo sapiens
gcauuccuagaaauuga

SEQ ID NO: 387208 - RNA, 22 nt, Homo sapiens
gcauugaauauauuauaaucuu

SEQ ID NO: 387209 - RNA, 16 nt, Homo sapiens
gcauugagcaaagggg

SEQ ID NO: 387210 - RNA, 20 nt, Homo sapiens
gccaagaucgcgccacugca

SEQ ID NO: 387211 - RNA, 14 nt, Homo sapiens
guguugaccacaga

SEQ ID NO: 387212 - RNA, 22 nt, Homo sapiens
guguuugugauuguuugcucug

SEQ ID NO: 387213 - RNA, 17 nt, Homo sapiens
guguuuuuuuacauacg

SEQ ID NO: 387214 - RNA, 22 nt, Homo sapiens
guuaauuuuuccuauauugcau

SEQ ID NO: 387215 - RNA, 22 nt, Homo sapiens
guuacaguuugagacuuccaaa

SEQ ID NO: 387216 - RNA, 22 nt, Homo sapiens
guuaccugaaaacacugugcac

SEQ ID NO: 387217 - RNA, 17 nt, Homo sapiens
guuacuuaccacagacu

SEQ ID NO: 387218 - RNA, 22 nt, Homo sapiens
guuagaagcaaugaauguauau

SEQ ID NO: 387219 - RNA, 23 nt, Homo sapiens
guuaggaaaauuucacauuaaua

SEQ ID NO: 387220 - RNA, 15 nt, Homo sapiens
guuaggauagcauuu

SEQ ID NO: 387221 - RNA, 19 nt, Homo sapiens
guuaucuguguagcaagcu

SEQ ID NO: 387222 - RNA, 17 nt, Homo sapiens
guuaucuuccacuggaa

SEQ ID NO: 387223 - RNA, 12 nt, Homo sapiens
guucaaagccag

SEQ ID NO: 387224 - RNA, 23 nt, Homo sapiens
guucaccuugggaugaugccuca

SEQ ID NO: 387225 - RNA, 14 nt, Homo sapiens
guucagaugcuucu

SEQ ID NO: 387226 - RNA, 16 nt, Homo sapiens
guucagggcugugauc

SEQ ID NO: 387227 - RNA, 21 nt, Homo sapiens
guucaucagacuccugugcaa

SEQ ID NO: 387228 - RNA, 14 nt, Homo sapiens
guucccccugugca

SEQ ID NO: 387229 - RNA, 16 nt, Homo sapiens
guucgagaccaaccug

SEQ ID NO: 387230 - RNA, 18 nt, Homo sapiens
guucuacauaaguaauuc

SEQ ID NO: 387231 - RNA, 19 nt, Homo sapiens
guucucagguguugccaaa

SEQ ID NO: 387232 - RNA, 17 nt, Homo sapiens
guucuucuuaaagucaa

SEQ ID NO: 387233 - RNA, 16 nt, Homo sapiens
guugaagcucugguga

SEQ ID NO: 387234 - RNA, 21 nt, Homo sapiens
guuggacaaaccgagugcaau

SEQ ID NO: 387235 - RNA, 15 nt, Homo sapiens
guuguauaaccaaua

SEQ ID NO: 387236 - RNA, 19 nt, Homo sapiens
guuguggagagugcaacag

SEQ ID NO: 387237 - RNA, 24 nt, Homo sapiens
guuguuuucagacucagacuccau

SEQ ID NO: 387238 - RNA, 18 nt, Homo sapiens
guuuaaugggcacagggu

SEQ ID NO: 387239 - RNA, 23 nt, Homo sapiens
guuuacauuguaaauaguauuug

SEQ ID NO: 387240 - RNA, 18 nt, Homo sapiens
guuuagccaaaggauaag

SEQ ID NO: 387241 - RNA, 23 nt, Homo sapiens
guuuagccaaaggauaagugucc

SEQ ID NO: 387242 - RNA, 14 nt, Homo sapiens
guuuagugaucuga

SEQ ID NO: 387243 - RNA, 19 nt, Homo sapiens
guuucaccauguuagccag

SEQ ID NO: 387244 - RNA, 14 nt, Homo sapiens
guuucccuaucucg

SEQ ID NO: 387245 - RNA, 16 nt, Homo sapiens
guuucccuuucacugg

SEQ ID NO: 387246 - RNA, 20 nt, Homo sapiens
guuucuagcuagaaauauga

SEQ ID NO: 387247 - RNA, 16 nt, Homo sapiens
guuucuggcagccagu

SEQ ID NO: 387248 - RNA, 13 nt, Homo sapiens
guuucuguucacc

SEQ ID NO: 387249 - RNA, 15 nt, Homo sapiens
guuucuugugggcua

SEQ ID NO: 387250 - RNA, 23 nt, Homo sapiens
guuuuaccaucugcauccagccu

SEQ ID NO: 387251 - RNA, 21 nt, Homo sapiens
guuuuagcggucaauuugccu

SEQ ID NO: 387252 - RNA, 23 nt, Homo sapiens
guuuucuuucuaaugagauauua

SEQ ID NO: 387253 - RNA, 23 nt, Homo sapiens
guuuuuggaauuaugucugcuga

SEQ ID NO: 387254 - RNA, 13 nt, Homo sapiens
uaaaaaauggaac

SEQ ID NO: 387255 - RNA, 23 nt, Homo sapiens
uaaaaagcgggcacgggcccgug

SEQ ID NO: 387256 - RNA, 14 nt, Homo sapiens
uaaaaaugcaacuu

SEQ ID NO: 387257 - RNA, 15 nt, Homo sapiens
uaaaaauugugauca

SEQ ID NO: 387258 - RNA, 23 nt, Homo sapiens
uaaaaauugugaucagaccauaa

SEQ ID NO: 387259 - RNA, 17 nt, Homo sapiens
uaaaacaugcuggugaa

SEQ ID NO: 387260 - RNA, 20 nt, Homo sapiens
uaaaacaugcuggugaacca

SEQ ID NO: 387261 - RNA, 20 nt, Homo sapiens
uaaaacccacaaaaguacaa

SEQ ID NO: 387262 - RNA, 17 nt, Homo sapiens
uaaaacuacacaucccu

SEQ ID NO: 387263 - RNA, 21 nt, Homo sapiens
uaaaacugauuuuuagcuuua

SEQ ID NO: 387264 - RNA, 22 nt, Homo sapiens
uaaaagaauaaaauugcacuuu

SEQ ID NO: 387265 - RNA, 13 nt, Homo sapiens
uaaaaguuacuua

SEQ ID NO: 387266 - RNA, 20 nt, Homo sapiens
uaaaaguuacuuaccacaga

SEQ ID NO: 387267 - RNA, 17 nt, Homo sapiens
uaaaauaaaaugcagac

SEQ ID NO: 387268 - RNA, 20 nt, Homo sapiens
uaaaauaacuuauaucauca

SEQ ID NO: 387269 - RNA, 16 nt, Homo sapiens
uaaaauacacacucaa

SEQ ID NO: 387270 - RNA, 19 nt, Homo sapiens
uaaaauauagcuguacaaa

SEQ ID NO: 387271 - RNA, 16 nt, Homo sapiens
uaaaaucccuccuuca

SEQ ID NO: 387272 - RNA, 21 nt, Homo sapiens
uaaaaugauuuuaucugugaa

SEQ ID NO: 387273 - RNA, 18 nt, Homo sapiens
uaaaaugugaagugaaug

SEQ ID NO: 387274 - RNA, 14 nt, Homo sapiens
uaaacacgccugca

SEQ ID NO: 387275 - RNA, 22 nt, Homo sapiens
uaaacauuuaacuuguuuccaa

SEQ ID NO: 387276 - RNA, 21 nt, Homo sapiens
uaaacauuugagagcuaacua

SEQ ID NO: 387277 - RNA, 17 nt, Homo sapiens
uaaaccaucaucuugcc

SEQ ID NO: 387278 - RNA, 21 nt, Homo sapiens
uaaacucagggacagagccau

SEQ ID NO: 387279 - RNA, 14 nt, Homo sapiens
uaaacugauuuauc

SEQ ID NO: 387280 - RNA, 21 nt, Homo sapiens
uaaagcacccuguaucacaga

SEQ ID NO: 387281 - RNA, 21 nt, Homo sapiens
uaaaguauuauuuauuugaau

SEQ ID NO: 387282 - RNA, 19 nt, Homo sapiens
uaaauaaaccucaaaaugu

SEQ ID NO: 387283 - RNA, 21 nt, Homo sapiens
uaaauaaauguaucuuauuca

SEQ ID NO: 387284 - RNA, 12 nt, Homo sapiens
uaaauacuguuu

SEQ ID NO: 387285 - RNA, 18 nt, Homo sapiens
uaaauaguuuaugauucc

SEQ ID NO: 387286 - RNA, 13 nt, Homo sapiens
uaaauaugagaua

SEQ ID NO: 387287 - RNA, 22 nt, Homo sapiens
uaaauauuuauuuaacuauuca

SEQ ID NO: 387288 - RNA, 14 nt, Homo sapiens
uaaaucaaugcuau

SEQ ID NO: 387289 - RNA, 20 nt, Homo sapiens
uaaaucuguuauuuugcuau

SEQ ID NO: 387290 - RNA, 16 nt, Homo sapiens
uaaaugaagugcaaau

SEQ ID NO: 387291 - RNA, 21 nt, Homo sapiens
uaaaugcugucaacuaugaua

SEQ ID NO: 387292 - RNA, 14 nt, Homo sapiens
uaaauguaucuuau

SEQ ID NO: 387293 - RNA, 12 nt, Homo sapiens
uaaaugugaaug

SEQ ID NO: 387294 - RNA, 11 nt, Homo sapiens
uaaaugugcag

SEQ ID NO: 387295 - RNA, 18 nt, Homo sapiens
uaaauuacccaguuuaga

SEQ ID NO: 387296 - RNA, 20 nt, Homo sapiens
uaacaaguagcacccuggau

SEQ ID NO: 387297 - RNA, 19 nt, Homo sapiens
uaacacaaguccugugaau

SEQ ID NO: 387298 - RNA, 23 nt, Homo sapiens
uaacagaaagccugggugacauu

SEQ ID NO: 387299 - RNA, 15 nt, Homo sapiens
uaacagaccacugua

SEQ ID NO: 387300 - RNA, 23 nt, Homo sapiens
uaacagaccacuguauguuuacu

SEQ ID NO: 387301 - RNA, 18 nt, Homo sapiens
uaacaggucuccucuuaa

SEQ ID NO: 387302 - RNA, 14 nt, Homo sapiens
uaacaguucacuuu

SEQ ID NO: 387303 - RNA, 22 nt, Homo sapiens
uaacauaauuuguacauaugua

SEQ ID NO: 387304 - RNA, 12 nt, Homo sapiens
uaacaugcuuua

SEQ ID NO: 387305 - RNA, 20 nt, Homo sapiens
uaacccgcucaucacuggau

SEQ ID NO: 387306 - RNA, 14 nt, Homo sapiens
uaacgcgucuuccu

SEQ ID NO: 387307 - RNA, 14 nt, Homo sapiens
uaacgucaugugca

SEQ ID NO: 387308 - RNA, 22 nt, Homo sapiens
uaacuaguccuuuacuaaucca

SEQ ID NO: 387309 - RNA, 18 nt, Homo sapiens
uaacuaugaccaugcuga

SEQ ID NO: 387310 - RNA, 14 nt, Homo sapiens
uaacuauguugaua

SEQ ID NO: 387311 - RNA, 13 nt, Homo sapiens
uaacuauucauaa

SEQ ID NO: 387312 - RNA, 19 nt, Homo sapiens
uaacuccuagcugacucag

SEQ ID NO: 387313 - RNA, 21 nt, Homo sapiens
uaacugaaggagaaggugccc

SEQ ID NO: 387314 - RNA, 17 nt, Homo sapiens
uaacugccuuguguaca

SEQ ID NO: 387315 - RNA, 14 nt, Homo sapiens
uaacugugaaguuu

SEQ ID NO: 387316 - RNA, 16 nt, Homo sapiens
uaacuuagguggcaag

SEQ ID NO: 387317 - RNA, 19 nt, Homo sapiens
uaacuugcugcaguaugaa

SEQ ID NO: 387318 - RNA, 12 nt, Homo sapiens
uaagaaaaucau

SEQ ID NO: 387319 - RNA, 15 nt, Homo sapiens
uaagagaacaaugug

SEQ ID NO: 387320 - RNA, 19 nt, Homo sapiens
uaagagugccguaacaacu

SEQ ID NO: 387321 - RNA, 13 nt, Homo sapiens
uaagaguuacuua

SEQ ID NO: 387322 - RNA, 13 nt, Homo sapiens
uaagaugaucauc

SEQ ID NO: 387323 - RNA, 17 nt, Homo sapiens
uaagaugaucaucucca

SEQ ID NO: 387324 - RNA, 14 nt, Homo sapiens
uaagauucauccau

SEQ ID NO: 387325 - RNA, 20 nt, Homo sapiens
uaagcaaaaugugauaugua

SEQ ID NO: 387326 - RNA, 19 nt, Homo sapiens
uaagcagaagcacauauga

SEQ ID NO: 387327 - RNA, 16 nt, Homo sapiens
uaagguaccuuucaca

SEQ ID NO: 387328 - RNA, 14 nt, Homo sapiens
uaaguaaaaccaca

SEQ ID NO: 387329 - RNA, 19 nt, Homo sapiens
uaagugaaauaagccagac

SEQ ID NO: 387330 - RNA, 11 nt, Homo sapiens
uaagugauaua

SEQ ID NO: 387331 - RNA, 18 nt, Homo sapiens
uaauaaauauuuuugcca

SEQ ID NO: 387332 - RNA, 21 nt, Homo sapiens
uaauaagcaaagggagcacug

SEQ ID NO: 387333 - RNA, 14 nt, Homo sapiens
uaauaaguacugug

SEQ ID NO: 387334 - RNA, 18 nt, Homo sapiens
uaauaaguuucacugacu

SEQ ID NO: 387335 - RNA, 15 nt, Homo sapiens
uaauacagggcauuu

SEQ ID NO: 387336 - RNA, 14 nt, Homo sapiens
uaauauaacugccu

SEQ ID NO: 387337 - RNA, 12 nt, Homo sapiens
uaauauacuuua

SEQ ID NO: 387338 - RNA, 18 nt, Homo sapiens
uaauaucccuacauguau

SEQ ID NO: 387339 - RNA, 13 nt, Homo sapiens
uaauaugcuuuac

SEQ ID NO: 387340 - RNA, 17 nt, Homo sapiens
uaauccaucacuagcca

SEQ ID NO: 387341 - RNA, 13 nt, Homo sapiens
uaaucccagcacu

SEQ ID NO: 387342 - RNA, 14 nt, Homo sapiens
uaaucccagcacuu

SEQ ID NO: 387343 - RNA, 14 nt, Homo sapiens
uaaucuaugaauuc

SEQ ID NO: 387344 - RNA, 16 nt, Homo sapiens
uaaucuggacuccucu

SEQ ID NO: 387345 - RNA, 21 nt, Homo sapiens
uaaucuuaaauuuauuagaua

SEQ ID NO: 387346 - RNA, 23 nt, Homo sapiens
uaaucuucagggcacugcugcug

SEQ ID NO: 387347 - RNA, 22 nt, Homo sapiens
uaaugaaauaauguacaucugg

SEQ ID NO: 387348 - RNA, 14 nt, Homo sapiens
uaaugagauauuaa

SEQ ID NO: 387349 - RNA, 23 nt, Homo sapiens
uaaugucuuuaaaaguauccaga

SEQ ID NO: 387350 - RNA, 23 nt, Homo sapiens
uaauuaaauuuugaguucuacau

SEQ ID NO: 387351 - RNA, 14 nt, Homo sapiens
uaauuacuauguca

SEQ ID NO: 387352 - RNA, 20 nt, Homo sapiens
ucuauugagugaacagaauu

SEQ ID NO: 387353 - RNA, 14 nt, Homo sapiens
ucucacaagaugga

SEQ ID NO: 387354 - RNA, 22 nt, Homo sapiens
ucucacaagauggaaaucacau

SEQ ID NO: 387355 - RNA, 18 nt, Homo sapiens
ucucacaguguugcccag

SEQ ID NO: 387356 - RNA, 23 nt, Homo sapiens
ucucaccccugcuauaacuauga

SEQ ID NO: 387357 - RNA, 23 nt, Homo sapiens
ucucacgggcaugggcacucccu

SEQ ID NO: 387358 - RNA, 12 nt, Homo sapiens
ucucagcacuug

SEQ ID NO: 387359 - RNA, 16 nt, Homo sapiens
ucucagccuaccauga

SEQ ID NO: 387360 - RNA, 14 nt, Homo sapiens
ucucagccucugaa

SEQ ID NO: 387361 - RNA, 23 nt, Homo sapiens
ucucaggaaaucaaauaugcaaa

SEQ ID NO: 387362 - RNA, 21 nt, Homo sapiens
ucucaggggccagaggaacug

SEQ ID NO: 387363 - RNA, 15 nt, Homo sapiens
ucucagguguugcca

SEQ ID NO: 387364 - RNA, 16 nt, Homo sapiens
ucucagguguugccaa

SEQ ID NO: 387365 - RNA, 12 nt, Homo sapiens
ucucauaugauu

SEQ ID NO: 387366 - RNA, 13 nt, Homo sapiens
ucucauccaucau

SEQ ID NO: 387367 - RNA, 21 nt, Homo sapiens
ucucauuuuuaucccauugag

SEQ ID NO: 387368 - RNA, 20 nt, Homo sapiens
ucuccagaaagcucaucuca

SEQ ID NO: 387369 - RNA, 21 nt, Homo sapiens
ucucccaggccaggcuccuuc

SEQ ID NO: 387370 - RNA, 19 nt, Homo sapiens
ucucccuccccugccauuu

SEQ ID NO: 387371 - RNA, 12 nt, Homo sapiens
ucucgcuuuguu

SEQ ID NO: 387372 - RNA, 18 nt, Homo sapiens
ucucgcuuuguugcccag

SEQ ID NO: 387373 - RNA, 13 nt, Homo sapiens
ucucucacaugga

SEQ ID NO: 387374 - RNA, 20 nt, Homo sapiens
ucucuccugauagucuuuca

SEQ ID NO: 387375 - RNA, 14 nt, Homo sapiens
ucucucuucuccac

SEQ ID NO: 387376 - RNA, 17 nt, Homo sapiens
ucucucuugcuuacaaa

SEQ ID NO: 387377 - RNA, 19 nt, Homo sapiens
ucucucuugcuuacaaaug

SEQ ID NO: 387378 - RNA, 15 nt, Homo sapiens
ucucugagcagugaa

SEQ ID NO: 387379 - RNA, 21 nt, Homo sapiens
ucucugcuuuggaaaucacac

SEQ ID NO: 387380 - RNA, 14 nt, Homo sapiens
ucucuuacugcaaa

SEQ ID NO: 387381 - RNA, 15 nt, Homo sapiens
ucucuuccuacccuu

SEQ ID NO: 387382 - RNA, 21 nt, Homo sapiens
ucugaagcagaugcaaagagg

SEQ ID NO: 387383 - RNA, 15 nt, Homo sapiens
ucugaagucacugca

SEQ ID NO: 387384 - RNA, 22 nt, Homo sapiens
ucugaaucgagauguccauagu

SEQ ID NO: 387385 - RNA, 17 nt, Homo sapiens
ucugacucagggcuccu

SEQ ID NO: 387386 - RNA, 17 nt, Homo sapiens
ucugagaaggugagaua

SEQ ID NO: 387387 - RNA, 14 nt, Homo sapiens
ucugagcugugcag

SEQ ID NO: 387388 - RNA, 12 nt, Homo sapiens
ucugauuacaca

SEQ ID NO: 387389 - RNA, 20 nt, Homo sapiens
ucugccggcccuggggcuag

SEQ ID NO: 387390 - RNA, 16 nt, Homo sapiens
ucugccgugugcccuc

SEQ ID NO: 387391 - RNA, 20 nt, Homo sapiens
ucugcucgccuuagcacuac

SEQ ID NO: 387392 - RNA, 14 nt, Homo sapiens
ucuggaaaagcaaa

SEQ ID NO: 387393 - RNA, 11 nt, Homo sapiens
ucuggacaaag

SEQ ID NO: 387394 - RNA, 20 nt, Homo sapiens
ucuggcaacccuagucugcu

SEQ ID NO: 387395 - RNA, 12 nt, Homo sapiens
ucuggcucucau

SEQ ID NO: 387396 - RNA, 16 nt, Homo sapiens
ucugggaagauuucua

SEQ ID NO: 387397 - RNA, 17 nt, Homo sapiens
ucuggugcuuucuguca

SEQ ID NO: 387398 - RNA, 20 nt, Homo sapiens
ucugguuuuaacaauuuccu

SEQ ID NO: 387399 - RNA, 13 nt, Homo sapiens
ucuguagggauuu

SEQ ID NO: 387400 - RNA, 23 nt, Homo sapiens
ucuguauuuccccaacauguaau

SEQ ID NO: 387401 - RNA, 15 nt, Homo sapiens
ucugucaaugucuug

SEQ ID NO: 387402 - RNA, 19 nt, Homo sapiens
ucugucacuuaauugcuac

SEQ ID NO: 387403 - RNA, 18 nt, Homo sapiens
ucuguccguuuacuccaa

SEQ ID NO: 387404 - RNA, 17 nt, Homo sapiens
ucuguggcacucagaua

SEQ ID NO: 387405 - RNA, 21 nt, Homo sapiens
ucuguuuauaaacauuguaua

SEQ ID NO: 387406 - RNA, 16 nt, Homo sapiens
ucuuaaguagggacuu

SEQ ID NO: 387407 - RNA, 22 nt, Homo sapiens
ucuuacauaauuuuuuauucaa

SEQ ID NO: 387408 - RNA, 22 nt, Homo sapiens
ucuuacuuugaguuagugccau

SEQ ID NO: 387409 - RNA, 18 nt, Homo sapiens
ucuuagcacacucacaga

SEQ ID NO: 387410 - RNA, 16 nt, Homo sapiens
ucuuagucgagccaag

SEQ ID NO: 387411 - RNA, 20 nt, Homo sapiens
ucuuauuucauuucuuugag

SEQ ID NO: 387412 - RNA, 17 nt, Homo sapiens
ucuucacaaaacacuuc

SEQ ID NO: 387413 - RNA, 24 nt, Homo sapiens
ucuucaccauuuggcaaugccauc

SEQ ID NO: 387414 - RNA, 18 nt, Homo sapiens
ucuucaccccccacucac

SEQ ID NO: 387415 - RNA, 11 nt, Homo sapiens
ucuucagccac

SEQ ID NO: 387416 - RNA, 17 nt, Homo sapiens
ucuucagggcacugcug

SEQ ID NO: 387417 - RNA, 16 nt, Homo sapiens
ucuucauaauuucuuc

SEQ ID NO: 387418 - RNA, 13 nt, Homo sapiens
ucuuccugcauuc

SEQ ID NO: 387419 - RNA, 13 nt, Homo sapiens
ucuucuccacugg

SEQ ID NO: 387420 - RNA, 13 nt, Homo sapiens
ucuucucuacucu

SEQ ID NO: 387421 - RNA, 14 nt, Homo sapiens
ucuucucuacucua

SEQ ID NO: 387422 - RNA, 23 nt, Homo sapiens
ucuugaaaauagaacaacuugca

SEQ ID NO: 387423 - RNA, 13 nt, Homo sapiens
ucuugaaagcugu

SEQ ID NO: 387424 - RNA, 13 nt, Homo sapiens
ucuugcagaucaa

SEQ ID NO: 387425 - RNA, 21 nt, Homo sapiens
ucuugcuauggggagaaaaga

SEQ ID NO: 387426 - RNA, 20 nt, Homo sapiens
ucuuggccaaagaccaaauu

SEQ ID NO: 387427 - RNA, 15 nt, Homo sapiens
ucuuggcuuugccac

SEQ ID NO: 387428 - RNA, 16 nt, Homo sapiens
ucuuguguuaccugaa

SEQ ID NO: 387429 - RNA, 18 nt, Homo sapiens
ucuuguuuuaagugccuu

SEQ ID NO: 387430 - RNA, 22 nt, Homo sapiens
ucuuguuuuuuuuuuccacuua

SEQ ID NO: 387431 - RNA, 18 nt, Homo sapiens
ucuuuaaauuucaucuca

SEQ ID NO: 387432 - RNA, 13 nt, Homo sapiens
ucuuuauaauucu

SEQ ID NO: 387433 - RNA, 15 nt, Homo sapiens
ucuuucacacuucca

SEQ ID NO: 387434 - RNA, 17 nt, Homo sapiens
ucuuucccaauucacau

SEQ ID NO: 387435 - RNA, 22 nt, Homo sapiens
ucuuucucugccagugacagac

SEQ ID NO: 387436 - RNA, 20 nt, Homo sapiens
ucuuugaacccuugcuugca

SEQ ID NO: 387437 - RNA, 17 nt, Homo sapiens
ugaaaaauaagucacuu

SEQ ID NO: 387438 - RNA, 13 nt, Homo sapiens
ugaaaaaugccuc

SEQ ID NO: 387439 - RNA, 14 nt, Homo sapiens
ugaaaaauguauau

SEQ ID NO: 387440 - RNA, 17 nt, Homo sapiens
ugaaaacacugugcaca

SEQ ID NO: 387441 - RNA, 23 nt, Homo sapiens
ugaaaacuuagagagguacaagu

SEQ ID NO: 387442 - RNA, 19 nt, Homo sapiens
ugaaaaugguccaggagaa

SEQ ID NO: 387443 - RNA, 20 nt, Homo sapiens
ugaaacaggagagaaagggg

SEQ ID NO: 387444 - RNA, 22 nt, Homo sapiens
ugaaacccuggaccaguggucu

SEQ ID NO: 387445 - RNA, 23 nt, Homo sapiens
ugaaacuuguuuauuauguacaa

SEQ ID NO: 387446 - RNA, 18 nt, Homo sapiens
ugaaagcagggacuugaa

SEQ ID NO: 387447 - RNA, 21 nt, Homo sapiens
ugaaauaagccagacaucaac

SEQ ID NO: 387448 - RNA, 16 nt, Homo sapiens
ugaaauaucaugcucc

SEQ ID NO: 387449 - RNA, 12 nt, Homo sapiens
ugaaauaugcau

SEQ ID NO: 387450 - RNA, 16 nt, Homo sapiens
ugaaaugcuggcauuu

SEQ ID NO: 387451 - RNA, 19 nt, Homo sapiens
ugaaaugcuggcauuugca

SEQ ID NO: 387452 - RNA, 16 nt, Homo sapiens
ugaaauuuuaauugaa

SEQ ID NO: 387453 - RNA, 18 nt, Homo sapiens
ugaacaugugaaguuaua

SEQ ID NO: 387454 - RNA, 17 nt, Homo sapiens
ugaacggugagcauugu

SEQ ID NO: 387455 - RNA, 18 nt, Homo sapiens
ugaacuccugggcucaag

SEQ ID NO: 387456 - RNA, 18 nt, Homo sapiens
ugaacucuucaaucucuu

SEQ ID NO: 387457 - RNA, 18 nt, Homo sapiens
ugaacugaaguuucacau

SEQ ID NO: 387458 - RNA, 14 nt, Homo sapiens
ugaacuguauuuau

SEQ ID NO: 387459 - RNA, 21 nt, Homo sapiens
ugaacuuggaaagaaaugccc

SEQ ID NO: 387460 - RNA, 18 nt, Homo sapiens
ugaagaacaguaacugcc

SEQ ID NO: 387461 - RNA, 23 nt, Homo sapiens
ugaagaagagacucuuugcauau

SEQ ID NO: 387462 - RNA, 20 nt, Homo sapiens
ugaagacccuggaguucaaa

SEQ ID NO: 387463 - RNA, 19 nt, Homo sapiens
ugaaggaguccuugcauca

SEQ ID NO: 387464 - RNA, 14 nt, Homo sapiens
ugaaggcuguccuu

SEQ ID NO: 387465 - RNA, 23 nt, Homo sapiens
ugaaggguucaccaggucaggga

SEQ ID NO: 387466 - RNA, 13 nt, Homo sapiens
ugaaguagaaucc

SEQ ID NO: 387467 - RNA, 16 nt, Homo sapiens
ugaaguaggugugacu

SEQ ID NO: 387468 - RNA, 20 nt, Homo sapiens
ugaaguaggugugacuugaa

SEQ ID NO: 387469 - RNA, 23 nt, Homo sapiens
ugaagucaugcguuuaaucacau

SEQ ID NO: 387470 - RNA, 19 nt, Homo sapiens
ugaagucccagauacuugg

SEQ ID NO: 387471 - RNA, 12 nt, Homo sapiens
ugaagugcaaau

SEQ ID NO: 387472 - RNA, 22 nt, Homo sapiens
ugaauaaaccaucaucuugcca

SEQ ID NO: 387473 - RNA, 22 nt, Homo sapiens
ugaauaauacaguaucucaggg

SEQ ID NO: 387474 - RNA, 14 nt, Homo sapiens
ugaauacaggcaua

SEQ ID NO: 387475 - RNA, 14 nt, Homo sapiens
ugaaucacaguaua

SEQ ID NO: 387476 - RNA, 22 nt, Homo sapiens
ugaaucacaguauacgcuccau

SEQ ID NO: 387477 - RNA, 14 nt, Homo sapiens
ugaaugcagggaca

SEQ ID NO: 387478 - RNA, 20 nt, Homo sapiens
ugaaugccguggauugcacg

SEQ ID NO: 387479 - RNA, 14 nt, Homo sapiens
ugaauggacucaaa

SEQ ID NO: 387480 - RNA, 18 nt, Homo sapiens
ugaauucugucauuucaa

SEQ ID NO: 387481 - RNA, 20 nt, Homo sapiens
ugacaaccgaguggcuguca

SEQ ID NO: 387482 - RNA, 15 nt, Homo sapiens
ugacaauaauuucag

SEQ ID NO: 387483 - RNA, 20 nt, Homo sapiens
ugacaccagccuuucuccca

SEQ ID NO: 387484 - RNA, 19 nt, Homo sapiens
ugacaccauuuuccugccu

SEQ ID NO: 387485 - RNA, 16 nt, Homo sapiens
ugacaguaaaucucac

SEQ ID NO: 387486 - RNA, 17 nt, Homo sapiens
ugacaguaaaucucaca

SEQ ID NO: 387487 - RNA, 20 nt, Homo sapiens
ugacaguaaaucucacaaau

SEQ ID NO: 387488 - RNA, 18 nt, Homo sapiens
ugacaucagcaauacaga

SEQ ID NO: 387489 - RNA, 18 nt, Homo sapiens
ugacauccaagcuuccuu

SEQ ID NO: 387490 - RNA, 14 nt, Homo sapiens
ugacaucucagggg

SEQ ID NO: 387491 - RNA, 20 nt, Homo sapiens
ugacauuuauauauugaauu

SEQ ID NO: 387492 - RNA, 14 nt, Homo sapiens
ugaccaacaguucc

SEQ ID NO: 387493 - RNA, 15 nt, Homo sapiens
ugaccaagcaggaag

SEQ ID NO: 387494 - RNA, 17 nt, Homo sapiens
uucagugggaccaauga

SEQ ID NO: 387495 - RNA, 14 nt, Homo sapiens
uucaucuaauguga

SEQ ID NO: 387496 - RNA, 20 nt, Homo sapiens
uucaucucaggccucccuca

SEQ ID NO: 387497 - RNA, 11 nt, Homo sapiens
uucaucucuug

SEQ ID NO: 387498 - RNA, 15 nt, Homo sapiens
uucauguaacuagaa

SEQ ID NO: 387499 - RNA, 18 nt, Homo sapiens
uucauuaauacagggcau

SEQ ID NO: 387500 - RNA, 20 nt, Homo sapiens
uucauuuaggaugcuuucau

SEQ ID NO: 387501 - RNA, 13 nt, Homo sapiens
uuccaaacauaca

SEQ ID NO: 387502 - RNA, 20 nt, Homo sapiens
uuccaauuuacauacucugc

SEQ ID NO: 387503 - RNA, 12 nt, Homo sapiens
uuccacugcugc

SEQ ID NO: 387504 - RNA, 18 nt, Homo sapiens
uuccagauccuucaaaga

SEQ ID NO: 387505 - RNA, 22 nt, Homo sapiens
uuccagcaugaggaacuagcca

SEQ ID NO: 387506 - RNA, 17 nt, Homo sapiens
uuccaggcgaugugcaa

SEQ ID NO: 387507 - RNA, 17 nt, Homo sapiens
uuccaucauguccccaa

SEQ ID NO: 387508 - RNA, 19 nt, Homo sapiens
uuccauuugugugugugca

SEQ ID NO: 387509 - RNA, 22 nt, Homo sapiens
uuccauuugugugugugcaagu

SEQ ID NO: 387510 - RNA, 18 nt, Homo sapiens
uucccaaauuucauaccu

SEQ ID NO: 387511 - RNA, 16 nt, Homo sapiens
uucccacaggacauuu

SEQ ID NO: 387512 - RNA, 17 nt, Homo sapiens
uucccacaggacauuuc

SEQ ID NO: 387513 - RNA, 21 nt, Homo sapiens
uuccccuugcccagggcucag

SEQ ID NO: 387514 - RNA, 17 nt, Homo sapiens
uucccuacaguugaaaa

SEQ ID NO: 387515 - RNA, 19 nt, Homo sapiens
uucccuacuuccugugacu

SEQ ID NO: 387516 - RNA, 21 nt, Homo sapiens
uucccuaucucgaacauggaa

SEQ ID NO: 387517 - RNA, 21 nt, Homo sapiens
uucccuauuuugccaguggga

SEQ ID NO: 387518 - RNA, 14 nt, Homo sapiens
uucccucacaccgc

SEQ ID NO: 387519 - RNA, 22 nt, Homo sapiens
uucccugaauguauugaacuug

SEQ ID NO: 387520 - RNA, 18 nt, Homo sapiens
uucccugaccucccucua

SEQ ID NO: 387521 - RNA, 16 nt, Homo sapiens
uuccuaauaugcuuua

SEQ ID NO: 387522 - RNA, 14 nt, Homo sapiens
uuccucgccugaca

SEQ ID NO: 387523 - RNA, 19 nt, Homo sapiens
uuccugaguggugccaaac

SEQ ID NO: 387524 - RNA, 11 nt, Homo sapiens
uuccugccacc

SEQ ID NO: 387525 - RNA, 22 nt, Homo sapiens
uuccugccugcggaccagauga

SEQ ID NO: 387526 - RNA, 17 nt, Homo sapiens
uuccuugaucuguauau

SEQ ID NO: 387527 - RNA, 17 nt, Homo sapiens
uuccuugggaugaucuu

SEQ ID NO: 387528 - RNA, 19 nt, Homo sapiens
uuccuuuccccagcccagg

SEQ ID NO: 387529 - RNA, 18 nt, Homo sapiens
uuccuuugaagaggaaaa

SEQ ID NO: 387530 - RNA, 16 nt, Homo sapiens
uuccuuuguugcacaa

SEQ ID NO: 387531 - RNA, 21 nt, Homo sapiens
uuccuuuuaaaacacuuccau

SEQ ID NO: 387532 - RNA, 23 nt, Homo sapiens
uucgauacaccgggccuggagaa

SEQ ID NO: 387533 - RNA, 21 nt, Homo sapiens
uucgcaccuaccaucagggac

SEQ ID NO: 387534 - RNA, 15 nt, Homo sapiens
uucggguuggcaaaa

SEQ ID NO: 387535 - RNA, 16 nt, Homo sapiens
uucuaacuccagugaa

SEQ ID NO: 387536 - RNA, 17 nt, Homo sapiens
uucuaagcaaaauugcu

SEQ ID NO: 387537 - RNA, 19 nt, Homo sapiens
uucucacacacauacauac

SEQ ID NO: 387538 - RNA, 16 nt, Homo sapiens
uucucagcuggaugau

SEQ ID NO: 387539 - RNA, 19 nt, Homo sapiens
uucucagguguugccaaau

SEQ ID NO: 387540 - RNA, 20 nt, Homo sapiens
uucucauuucuguagccuga

SEQ ID NO: 387541 - RNA, 11 nt, Homo sapiens
uucuccacugg

SEQ ID NO: 387542 - RNA, 14 nt, Homo sapiens
uucuccagacaaac

SEQ ID NO: 387543 - RNA, 11 nt, Homo sapiens
uucuccugacc

SEQ ID NO: 387544 - RNA, 18 nt, Homo sapiens
uucucucuuauuccacuu

SEQ ID NO: 387545 - RNA, 15 nt, Homo sapiens
uucucugccagugac

SEQ ID NO: 387546 - RNA, 19 nt, Homo sapiens
uucucugguaauauugacu

SEQ ID NO: 387547 - RNA, 22 nt, Homo sapiens
uucucuucacagucacauucca

SEQ ID NO: 387548 - RNA, 23 nt, Homo sapiens
uucugacuugacuuuagucugca

SEQ ID NO: 387549 - RNA, 23 nt, Homo sapiens
uucugccaggcccccaagccugc

SEQ ID NO: 387550 - RNA, 14 nt, Homo sapiens
uucuggaauguaau

SEQ ID NO: 387551 - RNA, 17 nt, Homo sapiens
uucugucacucaccacu

SEQ ID NO: 387552 - RNA, 21 nt, Homo sapiens
uucuguucugucucauaugau

SEQ ID NO: 387553 - RNA, 17 nt, Homo sapiens
uucuuaaagaguucuua

SEQ ID NO: 387554 - RNA, 14 nt, Homo sapiens
uucuuaggccacau

SEQ ID NO: 387555 - RNA, 19 nt, Homo sapiens
uucuucggacuauuuucca

SEQ ID NO: 387556 - RNA, 20 nt, Homo sapiens
uugaaaaaaaacccuugauu

SEQ ID NO: 387557 - RNA, 15 nt, Homo sapiens
uugaaacugagaugu

SEQ ID NO: 387558 - RNA, 23 nt, Homo sapiens
uugaaauaauaaaucugguagaa

SEQ ID NO: 387559 - RNA, 18 nt, Homo sapiens
uugaagugacuucacaga

SEQ ID NO: 387560 - RNA, 15 nt, Homo sapiens
uugaaugcagggaca

SEQ ID NO: 387561 - RNA, 22 nt, Homo sapiens
uugaauuaauaucccuacaugu

SEQ ID NO: 387562 - RNA, 17 nt, Homo sapiens
uugacaaccaugagacc

SEQ ID NO: 387563 - RNA, 20 nt, Homo sapiens
uugacacuuaaaaaugguuu

SEQ ID NO: 387564 - RNA, 12 nt, Homo sapiens
uugaccacagag

SEQ ID NO: 387565 - RNA, 18 nt, Homo sapiens
uugacguggcacuuaccc

SEQ ID NO: 387566 - RNA, 20 nt, Homo sapiens
uugagcaguggcugguccag

SEQ ID NO: 387567 - RNA, 19 nt, Homo sapiens
uugagcuuaagaauuuuga

SEQ ID NO: 387568 - RNA, 18 nt, Homo sapiens
uugaggcaggaccauaca

SEQ ID NO: 387569 - RNA, 15 nt, Homo sapiens
uugagggguggaccc

SEQ ID NO: 387570 - RNA, 20 nt, Homo sapiens
uugaguccagaaguuugaga

SEQ ID NO: 387571 - RNA, 12 nt, Homo sapiens
uugagucuucca

SEQ ID NO: 387572 - RNA, 19 nt, Homo sapiens
uugauauuuuccaaaugga

SEQ ID NO: 387573 - RNA, 19 nt, Homo sapiens
uugaugauuaauucaccuu

SEQ ID NO: 387574 - RNA, 13 nt, Homo sapiens
uugauuaccuagu

SEQ ID NO: 387575 - RNA, 23 nt, Homo sapiens
uugauuauucugauuccacuuuu

SEQ ID NO: 387576 - RNA, 22 nt, Homo sapiens
uugauucacaaugaaaugcucu

SEQ ID NO: 387577 - RNA, 14 nt, Homo sapiens
uugcaacuuagcuc

SEQ ID NO: 387578 - RNA, 19 nt, Homo sapiens
uugcacaaaaucacacagc

SEQ ID NO: 387579 - RNA, 22 nt, Homo sapiens
uugcaccccaaagcuuuccugc

SEQ ID NO: 387580 - RNA, 14 nt, Homo sapiens
uugcagaugacaaa

SEQ ID NO: 387581 - RNA, 15 nt, Homo sapiens
uugcagaugacaaaa

SEQ ID NO: 387582 - RNA, 16 nt, Homo sapiens
uugcagaugacaaaaa

SEQ ID NO: 387583 - RNA, 15 nt, Homo sapiens
uugccauaaagucaa

SEQ ID NO: 387584 - RNA, 19 nt, Homo sapiens
uugccauuaaacuuaccug

SEQ ID NO: 387585 - RNA, 19 nt, Homo sapiens
uugccauuacucaauugau

SEQ ID NO: 387586 - RNA, 20 nt, Homo sapiens
uugcccaggcuggucucaaa

SEQ ID NO: 387587 - RNA, 13 nt, Homo sapiens
uugcccagugugu

SEQ ID NO: 387588 - RNA, 19 nt, Homo sapiens
uugccucaaugccaguaac

SEQ ID NO: 387589 - RNA, 14 nt, Homo sapiens
uugcuccuugacau

SEQ ID NO: 387590 - RNA, 15 nt, Homo sapiens
uugcugcccuaggcu

SEQ ID NO: 387591 - RNA, 16 nt, Homo sapiens
uugcuggcaaagacag

SEQ ID NO: 387592 - RNA, 21 nt, Homo sapiens
uugcugucauaagaaugaaua

SEQ ID NO: 387593 - RNA, 13 nt, Homo sapiens
uugcuuaugaaag

SEQ ID NO: 387594 - RNA, 17 nt, Homo sapiens
uugcuucaaaccccagg

SEQ ID NO: 387595 - RNA, 18 nt, Homo sapiens
uuggaaaaagccugugaa

SEQ ID NO: 387596 - RNA, 23 nt, Homo sapiens
uuggacaaucaugaaauaugcau

SEQ ID NO: 387597 - RNA, 23 nt, Homo sapiens
uuggagaaacccuugaaaagaca

SEQ ID NO: 387598 - RNA, 20 nt, Homo sapiens
uuggauaucaaaagcaaaua

SEQ ID NO: 387599 - RNA, 19 nt, Homo sapiens
uuggauggagacuccauga

SEQ ID NO: 387600 - RNA, 18 nt, Homo sapiens
uuggauuauucauuuaaa

SEQ ID NO: 387601 - RNA, 15 nt, Homo sapiens
uuggcaugccuucca

SEQ ID NO: 387602 - RNA, 22 nt, Homo sapiens
uuggcuacacacaaaccaguau

SEQ ID NO: 387603 - RNA, 11 nt, Homo sapiens
uuggcugugag

SEQ ID NO: 387604 - RNA, 15 nt, Homo sapiens
uugggaacugcaaua

SEQ ID NO: 387605 - RNA, 13 nt, Homo sapiens
uugggaagacaug

SEQ ID NO: 387606 - RNA, 16 nt, Homo sapiens
uugggagacaugugac

SEQ ID NO: 387607 - RNA, 13 nt, Homo sapiens
uugggucuuugaa

SEQ ID NO: 387608 - RNA, 19 nt, Homo sapiens
uugguuugcagaugacaaa

SEQ ID NO: 387609 - RNA, 18 nt, Homo sapiens
uuguaaaauggugugacc

SEQ ID NO: 387610 - RNA, 16 nt, Homo sapiens
uuguaccgcaauguga

SEQ ID NO: 387611 - RNA, 17 nt, Homo sapiens
uuguaccgcaaugugac

SEQ ID NO: 387612 - RNA, 17 nt, Homo sapiens
uugucccacucaagcca

SEQ ID NO: 387613 - RNA, 20 nt, Homo sapiens
uugucucuagagcagggauu

SEQ ID NO: 387614 - RNA, 14 nt, Homo sapiens
uugucuuguucacc

SEQ ID NO: 387615 - RNA, 21 nt, Homo sapiens
uugugcuggauggagcccagg

SEQ ID NO: 387616 - RNA, 15 nt, Homo sapiens
uugugugaguguacc

SEQ ID NO: 387617 - RNA, 14 nt, Homo sapiens
uuguguuucuguuc

SEQ ID NO: 387618 - RNA, 15 nt, Homo sapiens
uuguuuuagcuccuu

SEQ ID NO: 387619 - RNA, 21 nt, Homo sapiens
uuguuuuaugcucagggucaa

SEQ ID NO: 387620 - RNA, 21 nt, Homo sapiens
uuuaaaaaaaaauacugaugu

SEQ ID NO: 387621 - RNA, 20 nt, Homo sapiens
uuuaaaaccugugugccauu

SEQ ID NO: 387622 - RNA, 14 nt, Homo sapiens
uuuaaaaucuguca

SEQ ID NO: 387623 - RNA, 14 nt, Homo sapiens
uuuaaacaguuuag

SEQ ID NO: 387624 - RNA, 15 nt, Homo sapiens
uuuaaacucagggac

SEQ ID NO: 387625 - RNA, 15 nt, Homo sapiens
uuuaaauccuuccau

SEQ ID NO: 387626 - RNA, 13 nt, Homo sapiens
uuuaaauguuacu

SEQ ID NO: 387627 - RNA, 15 nt, Homo sapiens
uuuaacaacuaugau

SEQ ID NO: 387628 - RNA, 19 nt, Homo sapiens
uuuaacuuaagggagaaaa

SEQ ID NO: 387629 - RNA, 17 nt, Homo sapiens
uuuaagcgcaacauuuc

SEQ ID NO: 387630 - RNA, 19 nt, Homo sapiens
uuuaagguuuuuacuguga

SEQ ID NO: 387631 - RNA, 14 nt, Homo sapiens
uuuaaucacauucg

SEQ ID NO: 387632 - RNA, 16 nt, Homo sapiens
uuuaaucccacuugcc

SEQ ID NO: 387633 - RNA, 16 nt, Homo sapiens
uuuaaugauaaguaaa

SEQ ID NO: 387634 - RNA, 17 nt, Homo sapiens
uuuaaugggcacagggu

SEQ ID NO: 387635 - RNA, 20 nt, Homo sapiens
uuuaauucucaugugauccu

SEQ ID NO: 387636 - RNA, 20 nt, Homo sapiens
cauauccaacaugugcucag

SEQ ID NO: 387637 - RNA, 15 nt, Homo sapiens
cauauccaccaccuc

SEQ ID NO: 387638 - RNA, 11 nt, Homo sapiens
cauaugaacug

SEQ ID NO: 387639 - RNA, 14 nt, Homo sapiens
cauaugaccucaug

SEQ ID NO: 387640 - RNA, 15 nt, Homo sapiens
cauaugauugugcac

SEQ ID NO: 387641 - RNA, 18 nt, Homo sapiens
cauaugauugugcacaua

SEQ ID NO: 387642 - RNA, 17 nt, Homo sapiens
cauauguaccauguaca

SEQ ID NO: 387643 - RNA, 20 nt, Homo sapiens
cauaugugaauauggacuca

SEQ ID NO: 387644 - RNA, 23 nt, Homo sapiens
cauauucuuuaaauuucaucuca

SEQ ID NO: 387645 - RNA, 18 nt, Homo sapiens
caucacgccugugcagug

SEQ ID NO: 387646 - RNA, 20 nt, Homo sapiens
caucacuagccaugauaacu

SEQ ID NO: 387647 - RNA, 14 nt, Homo sapiens
caucagcauaccuu

SEQ ID NO: 387648 - RNA, 12 nt, Homo sapiens
caucagggacag

SEQ ID NO: 387649 - RNA, 17 nt, Homo sapiens
caucagugcucccucac

SEQ ID NO: 387650 - RNA, 13 nt, Homo sapiens
caucauaguacag

SEQ ID NO: 387651 - RNA, 21 nt, Homo sapiens
caucaugucaguuccaaugag

SEQ ID NO: 387652 - RNA, 17 nt, Homo sapiens
caucauucucugucuca

SEQ ID NO: 387653 - RNA, 14 nt, Homo sapiens
cauccaagcuuccu

SEQ ID NO: 387654 - RNA, 16 nt, Homo sapiens
cauccaucaucaugug

SEQ ID NO: 387655 - RNA, 17 nt, Homo sapiens
cauccuccacaauagca

SEQ ID NO: 387656 - RNA, 17 nt, Homo sapiens
cauccugaccuugcaca

SEQ ID NO: 387657 - RNA, 15 nt, Homo sapiens
caucucaggggccag

SEQ ID NO: 387658 - RNA, 13 nt, Homo sapiens
caucucuacaaaa

SEQ ID NO: 387659 - RNA, 12 nt, Homo sapiens
caucugcuuaca

SEQ ID NO: 387660 - RNA, 22 nt, Homo sapiens
caucuggccuaauguuccagau

SEQ ID NO: 387661 - RNA, 15 nt, Homo sapiens
caucuucuccaucug

SEQ ID NO: 387662 - RNA, 21 nt, Homo sapiens
caucuugaccaagcaggaagc

SEQ ID NO: 387663 - RNA, 14 nt, Homo sapiens
caugaaauaugcau

SEQ ID NO: 387664 - RNA, 16 nt, Homo sapiens
caugaagauucuuucc

SEQ ID NO: 387665 - RNA, 20 nt, Homo sapiens
caugacggcucaugccugua

SEQ ID NO: 387666 - RNA, 20 nt, Homo sapiens
caugacucguauaugucuca

SEQ ID NO: 387667 - RNA, 18 nt, Homo sapiens
caugagaccacuguuauc

SEQ ID NO: 387668 - RNA, 17 nt, Homo sapiens
caugagaucuaggugag

SEQ ID NO: 387669 - RNA, 19 nt, Homo sapiens
caugagauucauucaguua

SEQ ID NO: 387670 - RNA, 15 nt, Homo sapiens
caugaggaacuagcc

SEQ ID NO: 387671 - RNA, 22 nt, Homo sapiens
caugagggugacguagaauuga

SEQ ID NO: 387672 - RNA, 15 nt, Homo sapiens
caugauaacugcaau

SEQ ID NO: 387673 - RNA, 19 nt, Homo sapiens
caugauguuaaccagaaua

SEQ ID NO: 387674 - RNA, 16 nt, Homo sapiens
caugcauaaaugcgau

SEQ ID NO: 387675 - RNA, 16 nt, Homo sapiens
caugcauguuugguua

SEQ ID NO: 387676 - RNA, 16 nt, Homo sapiens
caugccaaauguucca

SEQ ID NO: 387677 - RNA, 17 nt, Homo sapiens
caugcccuguaccugug

SEQ ID NO: 387678 - RNA, 14 nt, Homo sapiens
caugccucagugaa

SEQ ID NO: 387679 - RNA, 22 nt, Homo sapiens
caugccuguaaucccagcacuu

SEQ ID NO: 387680 - RNA, 22 nt, Homo sapiens
caugcugcuaauucaaagcucu

SEQ ID NO: 387681 - RNA, 23 nt, Homo sapiens
caugcuuuagauuauauauuccg

SEQ ID NO: 387682 - RNA, 15 nt, Homo sapiens
cauggauaacacauu

SEQ ID NO: 387683 - RNA, 19 nt, Homo sapiens
cauggcacucuauguucua

SEQ ID NO: 387684 - RNA, 17 nt, Homo sapiens
cauguaaacugugcacc

SEQ ID NO: 387685 - RNA, 13 nt, Homo sapiens
caugugacauuua

SEQ ID NO: 387686 - RNA, 21 nt, Homo sapiens
caugugacauuuauauauuga

SEQ ID NO: 387687 - RNA, 17 nt, Homo sapiens
caugugccgggccauug

SEQ ID NO: 387688 - RNA, 16 nt, Homo sapiens
cauguggaagcacuuu

SEQ ID NO: 387689 - RNA, 19 nt, Homo sapiens
cauguggugggacagggac

SEQ ID NO: 387690 - RNA, 18 nt, Homo sapiens
caugugugagugugugca

SEQ ID NO: 387691 - RNA, 20 nt, Homo sapiens
caugugugagugugugcaag

SEQ ID NO: 387692 - RNA, 12 nt, Homo sapiens
caugugugugca

SEQ ID NO: 387693 - RNA, 15 nt, Homo sapiens
cauuaaacuuaccug

SEQ ID NO: 387694 - RNA, 20 nt, Homo sapiens
cauuaccagacgguucacca

SEQ ID NO: 387695 - RNA, 19 nt, Homo sapiens
cauuaccgcguuguaaaau

SEQ ID NO: 387696 - RNA, 20 nt, Homo sapiens
cauuagcauucugguuuuga

SEQ ID NO: 387697 - RNA, 23 nt, Homo sapiens
cauuagcauucugguuuugacau

SEQ ID NO: 387698 - RNA, 20 nt, Homo sapiens
cauuagccuaugugcaugca

SEQ ID NO: 387699 - RNA, 23 nt, Homo sapiens
cauuaguuguuagugauggagcu

SEQ ID NO: 387700 - RNA, 17 nt, Homo sapiens
cauucacuugcauuucu

SEQ ID NO: 387701 - RNA, 17 nt, Homo sapiens
cauucagggauagcacu

SEQ ID NO: 387702 - RNA, 19 nt, Homo sapiens
cauucagggauagcacuga

SEQ ID NO: 387703 - RNA, 19 nt, Homo sapiens
cauucaguuaaaaauccag

SEQ ID NO: 387704 - RNA, 22 nt, Homo sapiens
cauuccaggaccagaagcauuu

SEQ ID NO: 387705 - RNA, 19 nt, Homo sapiens
cauucuuuuaaaagacaag

SEQ ID NO: 387706 - RNA, 19 nt, Homo sapiens
cauuggaccuguucaaaaa

SEQ ID NO: 387707 - RNA, 15 nt, Homo sapiens
cauugugaggguuaa

SEQ ID NO: 387708 - RNA, 12 nt, Homo sapiens
cauuuagcacau

SEQ ID NO: 387709 - RNA, 16 nt, Homo sapiens
cauuuagcacauacua

SEQ ID NO: 387710 - RNA, 15 nt, Homo sapiens
cauuuagucauguga

SEQ ID NO: 387711 - RNA, 16 nt, Homo sapiens
cauuuagucaugugac

SEQ ID NO: 387712 - RNA, 20 nt, Homo sapiens
cauuuauuauuucaauguga

SEQ ID NO: 387713 - RNA, 21 nt, Homo sapiens
cauuucuauuuauuuacugag

SEQ ID NO: 387714 - RNA, 22 nt, Homo sapiens
cauuucuauuucuccuccaugg

SEQ ID NO: 387715 - RNA, 23 nt, Homo sapiens
cauuugcuuacuuugcauuugug

SEQ ID NO: 387716 - RNA, 16 nt, Homo sapiens
cauuuggcaaugccau

SEQ ID NO: 387717 - RNA, 15 nt, Homo sapiens
cauuuuaagaguuac

SEQ ID NO: 387718 - RNA, 23 nt, Homo sapiens
cauuuuuuucacuggaguuacau

SEQ ID NO: 387719 - RNA, 19 nt, Homo sapiens
ccaaagaaauguaagggaa

SEQ ID NO: 387720 - RNA, 15 nt, Homo sapiens
ccaaagcagcugcag

SEQ ID NO: 387721 - RNA, 13 nt, Homo sapiens
ccaaagugcugcg

SEQ ID NO: 387722 - RNA, 13 nt, Homo sapiens
ccaaauguuccau

SEQ ID NO: 387723 - RNA, 19 nt, Homo sapiens
ccaaauuucauaccuauca

SEQ ID NO: 387724 - RNA, 16 nt, Homo sapiens
ccaacagcgacauagc

SEQ ID NO: 387725 - RNA, 14 nt, Homo sapiens
ccaacaugugcuca

SEQ ID NO: 387726 - RNA, 18 nt, Homo sapiens
ccaacucucgacuuuucc

SEQ ID NO: 387727 - RNA, 22 nt, Homo sapiens
ccaacuugagggcccagagcag

SEQ ID NO: 387728 - RNA, 21 nt, Homo sapiens
ccaagcacagugccugcaugu

SEQ ID NO: 387729 - RNA, 22 nt, Homo sapiens
ccaagcaggaaaugaaaauguc

SEQ ID NO: 387730 - RNA, 13 nt, Homo sapiens
ccaagccugacca

SEQ ID NO: 387731 - RNA, 19 nt, Homo sapiens
ccaaggaggaaaaacagac

SEQ ID NO: 387732 - RNA, 15 nt, Homo sapiens
ccaagucaugugcau

SEQ ID NO: 387733 - RNA, 16 nt, Homo sapiens
ccaagugccaauauuu

SEQ ID NO: 387734 - RNA, 17 nt, Homo sapiens
ccaagugugugugcgug

SEQ ID NO: 387735 - RNA, 17 nt, Homo sapiens
ccaauauuuaccagacc

SEQ ID NO: 387736 - RNA, 19 nt, Homo sapiens
ccaauauuucucagacauc

SEQ ID NO: 387737 - RNA, 14 nt, Homo sapiens
ccaaucucauggag

SEQ ID NO: 387738 - RNA, 16 nt, Homo sapiens
ccaauuccaaguuuua

SEQ ID NO: 387739 - RNA, 14 nt, Homo sapiens
ccaauuuacauacu

SEQ ID NO: 387740 - RNA, 15 nt, Homo sapiens
ccaauuuacuugcca

SEQ ID NO: 387741 - RNA, 16 nt, Homo sapiens
ccacaaccgaccagau

SEQ ID NO: 387742 - RNA, 17 nt, Homo sapiens
ccacaagcacacaggaa

SEQ ID NO: 387743 - RNA, 20 nt, Homo sapiens
ccacagaccuaggauuucau

SEQ ID NO: 387744 - RNA, 12 nt, Homo sapiens
ccacagccaugg

SEQ ID NO: 387745 - RNA, 21 nt, Homo sapiens
ccacauccuccacguucugcu

SEQ ID NO: 387746 - RNA, 18 nt, Homo sapiens
ccaccagccugcacuacu

SEQ ID NO: 387747 - RNA, 17 nt, Homo sapiens
ccaccugggcauaucca

SEQ ID NO: 387748 - RNA, 12 nt, Homo sapiens
ccaccuucuuca

SEQ ID NO: 387749 - RNA, 22 nt, Homo sapiens
ccacgagcuguuuacuagggau

SEQ ID NO: 387750 - RNA, 21 nt, Homo sapiens
ccagaaccuguccuugcacac

SEQ ID NO: 387751 - RNA, 13 nt, Homo sapiens
ccagacagcuccc

SEQ ID NO: 387752 - RNA, 22 nt, Homo sapiens
ccagacagcucccucugccuga

SEQ ID NO: 387753 - RNA, 14 nt, Homo sapiens
ccagacuggcacag

SEQ ID NO: 387754 - RNA, 15 nt, Homo sapiens
ccagacugucucaaa

SEQ ID NO: 387755 - RNA, 16 nt, Homo sapiens
ccagagcuacugacua

SEQ ID NO: 387756 - RNA, 18 nt, Homo sapiens
ccagaggcuuaaucacac

SEQ ID NO: 387757 - RNA, 19 nt, Homo sapiens
ccagauagcagggcaugaa

SEQ ID NO: 387758 - RNA, 14 nt, Homo sapiens
ccagaucagguaua

SEQ ID NO: 387759 - RNA, 13 nt, Homo sapiens
ccagaugccaggg

SEQ ID NO: 387760 - RNA, 13 nt, Homo sapiens
ccagcaacuccaa

SEQ ID NO: 387761 - RNA, 15 nt, Homo sapiens
ccagcacccugcaaa

SEQ ID NO: 387762 - RNA, 17 nt, Homo sapiens
ccagcacucacaccacu

SEQ ID NO: 387763 - RNA, 19 nt, Homo sapiens
ccagcagaucccagcucac

SEQ ID NO: 387764 - RNA, 17 nt, Homo sapiens
ccagccgaaaagcuuuu

SEQ ID NO: 387765 - RNA, 16 nt, Homo sapiens
ccagccuccaugcugc

SEQ ID NO: 387766 - RNA, 20 nt, Homo sapiens
ccagccuucugucagcagug

SEQ ID NO: 387767 - RNA, 15 nt, Homo sapiens
ccagcuacucaggag

SEQ ID NO: 387768 - RNA, 18 nt, Homo sapiens
ccagcucacgucacacuu

SEQ ID NO: 387769 - RNA, 22 nt, Homo sapiens
ccagcucuucuccccaggugug

SEQ ID NO: 387770 - RNA, 20 nt, Homo sapiens
ccagcuggccuguaauccca

SEQ ID NO: 387771 - RNA, 17 nt, Homo sapiens
ccagcuuugcagugaca

SEQ ID NO: 387772 - RNA, 22 nt, Homo sapiens
ccaggagguggagguugcagug

SEQ ID NO: 387773 - RNA, 14 nt, Homo sapiens
ccaggcacugcugc

SEQ ID NO: 387774 - RNA, 22 nt, Homo sapiens
ccaggcccggggcuggcggcua

SEQ ID NO: 387775 - RNA, 15 nt, Homo sapiens
ccagggaagugcucu

SEQ ID NO: 387776 - RNA, 20 nt, Homo sapiens
ccaggucguccaagcaaaaa

SEQ ID NO: 387777 - RNA, 18 nt, Homo sapiens
ccaguaagccacugccac

SEQ ID NO: 387778 - RNA, 16 nt, Homo sapiens
ccuccugggcccucuc

SEQ ID NO: 387779 - RNA, 18 nt, Homo sapiens
ccuccuuccuugaccagc

SEQ ID NO: 387780 - RNA, 23 nt, Homo sapiens
ccucgacacgcaacuggcucaaa

SEQ ID NO: 387781 - RNA, 15 nt, Homo sapiens
ccucgcuggacucuc

SEQ ID NO: 387782 - RNA, 19 nt, Homo sapiens
ccucggcuuuucucagcug

SEQ ID NO: 387783 - RNA, 18 nt, Homo sapiens
ccucgggacaucaaaaac

SEQ ID NO: 387784 - RNA, 16 nt, Homo sapiens
ccucuacaauuugcca

SEQ ID NO: 387785 - RNA, 12 nt, Homo sapiens
ccucugacucag

SEQ ID NO: 387786 - RNA, 23 nt, Homo sapiens
ccucugccaaaggaugugauaua

SEQ ID NO: 387787 - RNA, 15 nt, Homo sapiens
ccucuggacacagcc

SEQ ID NO: 387788 - RNA, 17 nt, Homo sapiens
ccucugggucagugguc

SEQ ID NO: 387789 - RNA, 18 nt, Homo sapiens
ccucugggucaguggucc

SEQ ID NO: 387790 - RNA, 14 nt, Homo sapiens
ccucuguccaggca

SEQ ID NO: 387791 - RNA, 18 nt, Homo sapiens
ccucuguccaggcacuga

SEQ ID NO: 387792 - RNA, 17 nt, Homo sapiens
ccucuuagaaaaaccac

SEQ ID NO: 387793 - RNA, 12 nt, Homo sapiens
ccucuuccauca

SEQ ID NO: 387794 - RNA, 22 nt, Homo sapiens
ccucuugacguggcacuuaccc

SEQ ID NO: 387795 - RNA, 13 nt, Homo sapiens
ccucuuucaucca

SEQ ID NO: 387796 - RNA, 24 nt, Homo sapiens
ccucuuugugugcgucacugugaa

SEQ ID NO: 387797 - RNA, 17 nt, Homo sapiens
ccugagcagugccagcu

SEQ ID NO: 387798 - RNA, 17 nt, Homo sapiens
ccugaguggugccaaac

SEQ ID NO: 387799 - RNA, 15 nt, Homo sapiens
ccugcaagucagucc

SEQ ID NO: 387800 - RNA, 22 nt, Homo sapiens
ccugcagccuccuccugaccac

SEQ ID NO: 387801 - RNA, 15 nt, Homo sapiens
ccugcaggugcugcu

SEQ ID NO: 387802 - RNA, 20 nt, Homo sapiens
ccugccaccuggggcaguca

SEQ ID NO: 387803 - RNA, 21 nt, Homo sapiens
ccugccaggauuaaaagccau

SEQ ID NO: 387804 - RNA, 16 nt, Homo sapiens
ccugcccugcugccgc

SEQ ID NO: 387805 - RNA, 20 nt, Homo sapiens
ccugcccugggauguccaca

SEQ ID NO: 387806 - RNA, 23 nt, Homo sapiens
ccugcugcaggggcucuggagag

SEQ ID NO: 387807 - RNA, 17 nt, Homo sapiens
ccugcugcuucugcaaa

SEQ ID NO: 387808 - RNA, 22 nt, Homo sapiens
ccuggaaauaucaguuacucag

SEQ ID NO: 387809 - RNA, 21 nt, Homo sapiens
ccuggacugccuugaauaucc

SEQ ID NO: 387810 - RNA, 16 nt, Homo sapiens
ccuggcucugcaaugg

SEQ ID NO: 387811 - RNA, 17 nt, Homo sapiens
ccuggcucugcaauggg

SEQ ID NO: 387812 - RNA, 13 nt, Homo sapiens
ccugggaccacag

SEQ ID NO: 387813 - RNA, 14 nt, Homo sapiens
ccugggaccacaga

SEQ ID NO: 387814 - RNA, 22 nt, Homo sapiens
ccugggcauacuaauaaaguau

SEQ ID NO: 387815 - RNA, 16 nt, Homo sapiens
ccugggggugccagga

SEQ ID NO: 387816 - RNA, 17 nt, Homo sapiens
ccuggucaacaugguga

SEQ ID NO: 387817 - RNA, 13 nt, Homo sapiens
ccugucccaugga

SEQ ID NO: 387818 - RNA, 19 nt, Homo sapiens
ccugucccauggacacucc

SEQ ID NO: 387819 - RNA, 12 nt, Homo sapiens
ccuguggaugag

SEQ ID NO: 387820 - RNA, 18 nt, Homo sapiens
ccuguuuucgcaccuacc

SEQ ID NO: 387821 - RNA, 23 nt, Homo sapiens
ccuuagauguucuaagucuuucc

SEQ ID NO: 387822 - RNA, 20 nt, Homo sapiens
ccuuauuagagugucuuucc

SEQ ID NO: 387823 - RNA, 14 nt, Homo sapiens
ccuuauuguaccuc

SEQ ID NO: 387824 - RNA, 14 nt, Homo sapiens
ccuucacuuuacaa

SEQ ID NO: 387825 - RNA, 17 nt, Homo sapiens
ccuucaugaucaucaca

SEQ ID NO: 387826 - RNA, 19 nt, Homo sapiens
ccuuccacggauccaugua

SEQ ID NO: 387827 - RNA, 12 nt, Homo sapiens
ccuuccacugag

SEQ ID NO: 387828 - RNA, 21 nt, Homo sapiens
ccuuccagcacccugcaaaau

SEQ ID NO: 387829 - RNA, 20 nt, Homo sapiens
ccuuccccagccucuucuag

SEQ ID NO: 387830 - RNA, 16 nt, Homo sapiens
ccuuccuugaccagca

SEQ ID NO: 387831 - RNA, 15 nt, Homo sapiens
ccuucuccagacaaa

SEQ ID NO: 387832 - RNA, 15 nt, Homo sapiens
ccuugaaaagacauc

SEQ ID NO: 387833 - RNA, 23 nt, Homo sapiens
ccuugaauauccccucccaguca

SEQ ID NO: 387834 - RNA, 14 nt, Homo sapiens
ccuugcccagagau

SEQ ID NO: 387835 - RNA, 21 nt, Homo sapiens
ccuugggaugaugccucauga

SEQ ID NO: 387836 - RNA, 18 nt, Homo sapiens
ccuuguguccacugugac

SEQ ID NO: 387837 - RNA, 14 nt, Homo sapiens
ccuuuacuaaucca

SEQ ID NO: 387838 - RNA, 13 nt, Homo sapiens
ccuuuauugugau

SEQ ID NO: 387839 - RNA, 15 nt, Homo sapiens
ccuuugaaaugaaua

SEQ ID NO: 387840 - RNA, 21 nt, Homo sapiens
ccuuugcucuugggaagacca

SEQ ID NO: 387841 - RNA, 16 nt, Homo sapiens
ccuuuguugcacaaau

SEQ ID NO: 387842 - RNA, 14 nt, Homo sapiens
ccuuuuaaaacacu

SEQ ID NO: 387843 - RNA, 22 nt, Homo sapiens
ccuuuucugcuucaauaucuaa

SEQ ID NO: 387844 - RNA, 17 nt, Homo sapiens
cgaaaaggauaugcagu

SEQ ID NO: 387845 - RNA, 16 nt, Homo sapiens
cgaacaauucauauau

SEQ ID NO: 387846 - RNA, 16 nt, Homo sapiens
cgaaggugcuggaggu

SEQ ID NO: 387847 - RNA, 18 nt, Homo sapiens
cgaggggcucucagcuca

SEQ ID NO: 387848 - RNA, 18 nt, Homo sapiens
cgaguugccagcucccau

SEQ ID NO: 387849 - RNA, 16 nt, Homo sapiens
cgaguuuuaaacuggu

SEQ ID NO: 387850 - RNA, 12 nt, Homo sapiens
cgcaacauuucu

SEQ ID NO: 387851 - RNA, 14 nt, Homo sapiens
cgcaacuggcucaa

SEQ ID NO: 387852 - RNA, 18 nt, Homo sapiens
cgcagauguccuugaugc

SEQ ID NO: 387853 - RNA, 15 nt, Homo sapiens
cgccaacgagcagug

SEQ ID NO: 387854 - RNA, 13 nt, Homo sapiens
cgccacucgcuuc

SEQ ID NO: 387855 - RNA, 21 nt, Homo sapiens
cgcccaugugugagugugugc

SEQ ID NO: 387856 - RNA, 12 nt, Homo sapiens
cggaaguuuuca

SEQ ID NO: 387857 - RNA, 20 nt, Homo sapiens
cggagaagagcuguucacag

SEQ ID NO: 387858 - RNA, 17 nt, Homo sapiens
cggagucuugcucuguu

SEQ ID NO: 387859 - RNA, 17 nt, Homo sapiens
cggcaacggcaaccccc

SEQ ID NO: 387860 - RNA, 20 nt, Homo sapiens
cggcaguucugggugcuccc

SEQ ID NO: 387861 - RNA, 14 nt, Homo sapiens
cggcgccaccaucc

SEQ ID NO: 387862 - RNA, 21 nt, Homo sapiens
cggcugagucaugaucucccu

SEQ ID NO: 387863 - RNA, 19 nt, Homo sapiens
cggugguucacgccuguaa

SEQ ID NO: 387864 - RNA, 16 nt, Homo sapiens
cgguucaccagccucu

SEQ ID NO: 387865 - RNA, 20 nt, Homo sapiens
cguccagcuggaagggucaa

SEQ ID NO: 387866 - RNA, 17 nt, Homo sapiens
cgucccuccacguucac

SEQ ID NO: 387867 - RNA, 23 nt, Homo sapiens
cgucccuguuagcauaaugugag

SEQ ID NO: 387868 - RNA, 17 nt, Homo sapiens
cgucuaagucaugagcu

SEQ ID NO: 387869 - RNA, 17 nt, Homo sapiens
cgucuccgaagauuugg

SEQ ID NO: 387870 - RNA, 20 nt, Homo sapiens
cgucucuacuaaaaauacaa

SEQ ID NO: 387871 - RNA, 22 nt, Homo sapiens
cgucuuagcaagaaguaaaaug

SEQ ID NO: 387872 - RNA, 15 nt, Homo sapiens
cgucuucuguauacu

SEQ ID NO: 387873 - RNA, 16 nt, Homo sapiens
cgugacuguggcacac

SEQ ID NO: 387874 - RNA, 15 nt, Homo sapiens
cgugaggaugggaag

SEQ ID NO: 387875 - RNA, 15 nt, Homo sapiens
cgugauccaccugcc

SEQ ID NO: 387876 - RNA, 13 nt, Homo sapiens
cgugcaugugcac

SEQ ID NO: 387877 - RNA, 20 nt, Homo sapiens
cgugccccgccuccccgaaa

SEQ ID NO: 387878 - RNA, 12 nt, Homo sapiens
cgugugugcaag

SEQ ID NO: 387879 - RNA, 13 nt, Homo sapiens
cuaaaaaucauga

SEQ ID NO: 387880 - RNA, 14 nt, Homo sapiens
cuaaaaccaucaua

SEQ ID NO: 387881 - RNA, 21 nt, Homo sapiens
cuaaaaguuacuuaccacaga

SEQ ID NO: 387882 - RNA, 19 nt, Homo sapiens
cuaaaauuagaugaacuca

SEQ ID NO: 387883 - RNA, 20 nt, Homo sapiens
cuaaagagagaugaaccaca

SEQ ID NO: 387884 - RNA, 13 nt, Homo sapiens
cuaaauaaaugaa

SEQ ID NO: 387885 - RNA, 21 nt, Homo sapiens
cuaacaggauuagacagucaa

SEQ ID NO: 387886 - RNA, 16 nt, Homo sapiens
cuaacaucuaaaaaua

SEQ ID NO: 387887 - RNA, 13 nt, Homo sapiens
cuaaccugugacc

SEQ ID NO: 387888 - RNA, 13 nt, Homo sapiens
cuaacuccaguga

SEQ ID NO: 387889 - RNA, 19 nt, Homo sapiens
cuaagaaauaugcacaaua

SEQ ID NO: 387890 - RNA, 16 nt, Homo sapiens
cuaagagaacaaugug

SEQ ID NO: 387891 - RNA, 15 nt, Homo sapiens
cuaagagugaaguag

SEQ ID NO: 387892 - RNA, 15 nt, Homo sapiens
cuaagcagaccacug

SEQ ID NO: 387893 - RNA, 22 nt, Homo sapiens
cuaaguaaaaccacagcaguug

SEQ ID NO: 387894 - RNA, 16 nt, Homo sapiens
cuaaucagcauucuca

SEQ ID NO: 387895 - RNA, 18 nt, Homo sapiens
cuaauuccuguguagcuu

SEQ ID NO: 387896 - RNA, 22 nt, Homo sapiens
cuaauuucugaaaugugcagcu

SEQ ID NO: 387897 - RNA, 15 nt, Homo sapiens
cuacaaaaaacaaca

SEQ ID NO: 387898 - RNA, 14 nt, Homo sapiens
cuacacacaaacca

SEQ ID NO: 387899 - RNA, 21 nt, Homo sapiens
cuacagcgccaacgagcagug

SEQ ID NO: 387900 - RNA, 11 nt, Homo sapiens
cuacaugccuc

SEQ ID NO: 387901 - RNA, 18 nt, Homo sapiens
cuacauguauugcacauu

SEQ ID NO: 387902 - RNA, 16 nt, Homo sapiens
cuaccagacuguguau

SEQ ID NO: 387903 - RNA, 14 nt, Homo sapiens
cuaccaucagggac

SEQ ID NO: 387904 - RNA, 23 nt, Homo sapiens
cuaccgagucucuucuccacugg

SEQ ID NO: 387905 - RNA, 22 nt, Homo sapiens
cuacgucaaacaugaagugugu

SEQ ID NO: 387906 - RNA, 12 nt, Homo sapiens
cuacuugaggcu

SEQ ID NO: 387907 - RNA, 20 nt, Homo sapiens
cuacuugggaggcugaggca

SEQ ID NO: 387908 - RNA, 12 nt, Homo sapiens
cuagacuuucug

SEQ ID NO: 387909 - RNA, 17 nt, Homo sapiens
cuagaugauugauuacc

SEQ ID NO: 387910 - RNA, 20 nt, Homo sapiens
cuagaugauugauuaccaag

SEQ ID NO: 387911 - RNA, 20 nt, Homo sapiens
cuagcacuuugggaggccaa

SEQ ID NO: 387912 - RNA, 17 nt, Homo sapiens
cuagcaucucaugagug

SEQ ID NO: 387913 - RNA, 22 nt, Homo sapiens
cuagcaucucaugagugccaag

SEQ ID NO: 387914 - RNA, 16 nt, Homo sapiens
cuagcuaauguaauaa

SEQ ID NO: 387915 - RNA, 17 nt, Homo sapiens
cuagcugcaagugacau

SEQ ID NO: 387916 - RNA, 19 nt, Homo sapiens
cuaggagcugggaggaaaa

SEQ ID NO: 387917 - RNA, 17 nt, Homo sapiens
cuaggcauuugcugaau

SEQ ID NO: 387918 - RNA, 21 nt, Homo sapiens
cuaggccacuccuccaaagga

SEQ ID NO: 387919 - RNA, 14 nt, Homo sapiens
cuagggaucccuca

SEQ ID NO: 387920 - RNA, 15 nt, Homo sapiens
cuagggaucccucau

SEQ ID NO: 387921 - RNA, 16 nt, Homo sapiens
cuaguagucauuucau

SEQ ID NO: 387922 - RNA, 20 nt, Homo sapiens
cuauaaagguugacaauaaa

SEQ ID NO: 387923 - RNA, 23 nt, Homo sapiens
cuauaggugcuacaaaaacacag

SEQ ID NO: 387924 - RNA, 17 nt, Homo sapiens
cuauauacuauaugauu

SEQ ID NO: 387925 - RNA, 17 nt, Homo sapiens
cuauccugggcauccuu

SEQ ID NO: 387926 - RNA, 14 nt, Homo sapiens
cuaucgcaccacug

SEQ ID NO: 387927 - RNA, 20 nt, Homo sapiens
cuaugaaauaucaugcucca

SEQ ID NO: 387928 - RNA, 17 nt, Homo sapiens
cuauggcucuacuuuca

SEQ ID NO: 387929 - RNA, 17 nt, Homo sapiens
cuaugggagcagcuuuu

SEQ ID NO: 387930 - RNA, 15 nt, Homo sapiens
cuaugggggcacuga

SEQ ID NO: 387931 - RNA, 13 nt, Homo sapiens
cuaugugcaugca

SEQ ID NO: 387932 - RNA, 14 nt, Homo sapiens
cuaugugcaugcag

SEQ ID NO: 387933 - RNA, 21 nt, Homo sapiens
cuaugugcaugcagcaucuaa

SEQ ID NO: 387934 - RNA, 13 nt, Homo sapiens
cuauguugauaaa

SEQ ID NO: 387935 - RNA, 18 nt, Homo sapiens
cuauucaggagaguagaa

SEQ ID NO: 387936 - RNA, 17 nt, Homo sapiens
cuauucugauuacacaa

SEQ ID NO: 387937 - RNA, 18 nt, Homo sapiens
cuauugcuggcaaagaca

SEQ ID NO: 387938 - RNA, 15 nt, Homo sapiens
cuauuuuauucccuu

SEQ ID NO: 387939 - RNA, 13 nt, Homo sapiens
cucaaaacuuaac

SEQ ID NO: 387940 - RNA, 19 nt, Homo sapiens
cucaaacucuuaaaaccca

SEQ ID NO: 387941 - RNA, 23 nt, Homo sapiens
cucaagcagucuacccaccucag

SEQ ID NO: 387942 - RNA, 21 nt, Homo sapiens
cucaagccaagcagccaagcu

SEQ ID NO: 387943 - RNA, 12 nt, Homo sapiens
cucaaucucuga

SEQ ID NO: 387944 - RNA, 15 nt, Homo sapiens
cucacacaugagauc

SEQ ID NO: 387945 - RNA, 18 nt, Homo sapiens
cucacagaagaauaugac

SEQ ID NO: 387946 - RNA, 14 nt, Homo sapiens
cucacagagugcau

SEQ ID NO: 387947 - RNA, 18 nt, Homo sapiens
cucacauccucugucuau

SEQ ID NO: 387948 - RNA, 13 nt, Homo sapiens
cucacgccacaaa

SEQ ID NO: 387949 - RNA, 17 nt, Homo sapiens
cucacuaaaaugcuaau

SEQ ID NO: 387950 - RNA, 17 nt, Homo sapiens
cucacugcaagcacugc

SEQ ID NO: 387951 - RNA, 23 nt, Homo sapiens
cucagaauauugcuuuggucaua

SEQ ID NO: 387952 - RNA, 16 nt, Homo sapiens
cucagauuauuuuucc

SEQ ID NO: 387953 - RNA, 12 nt, Homo sapiens
cucagcauaccu

SEQ ID NO: 387954 - RNA, 22 nt, Homo sapiens
cucagcuggaugauggucuuca

SEQ ID NO: 387955 - RNA, 18 nt, Homo sapiens
cucaggccucucuacaag

SEQ ID NO: 387956 - RNA, 23 nt, Homo sapiens
cucaggccucucuacaagcagca

SEQ ID NO: 387957 - RNA, 16 nt, Homo sapiens
cucaggcuggugggag

SEQ ID NO: 387958 - RNA, 17 nt, Homo sapiens
cucagggacagagccau

SEQ ID NO: 387959 - RNA, 13 nt, Homo sapiens
cucaggucagggu

SEQ ID NO: 387960 - RNA, 22 nt, Homo sapiens
cucaguaagaagagcuuggaaa

SEQ ID NO: 387961 - RNA, 18 nt, Homo sapiens
cucagucucugagcagug

SEQ ID NO: 387962 - RNA, 18 nt, Homo sapiens
cucaguuucccuaucucg

SEQ ID NO: 387963 - RNA, 17 nt, Homo sapiens
cucauaugauugugcac

SEQ ID NO: 387964 - RNA, 22 nt, Homo sapiens
cucaucauaaaauaaaguauau

SEQ ID NO: 387965 - RNA, 17 nt, Homo sapiens
cucaucccgagcaccuc

SEQ ID NO: 387966 - RNA, 22 nt, Homo sapiens
cucaucuuagguuggcaaaaag

SEQ ID NO: 387967 - RNA, 12 nt, Homo sapiens
cucaugcuguuu

SEQ ID NO: 387968 - RNA, 18 nt, Homo sapiens
cucauuaccuugugcuaa

SEQ ID NO: 387969 - RNA, 16 nt, Homo sapiens
cucauuccaccuuccc

SEQ ID NO: 387970 - RNA, 18 nt, Homo sapiens
cucauugacaagaacuga

SEQ ID NO: 387971 - RNA, 23 nt, Homo sapiens
cucauugacaagaacugaaacca

SEQ ID NO: 387972 - RNA, 21 nt, Homo sapiens
cucauuggacccuuccauggu

SEQ ID NO: 387973 - RNA, 22 nt, Homo sapiens
cucauuguuuauuaacaaauua

SEQ ID NO: 387974 - RNA, 23 nt, Homo sapiens
cucauuuuuguuuucauuaucuc

SEQ ID NO: 387975 - RNA, 20 nt, Homo sapiens
cuccaagguagaauuugcaa

SEQ ID NO: 387976 - RNA, 23 nt, Homo sapiens
cuccacaauagcagacaguguuu

SEQ ID NO: 387977 - RNA, 18 nt, Homo sapiens
cuccaccaacccaucaga

SEQ ID NO: 387978 - RNA, 13 nt, Homo sapiens
cuccacugucaca

SEQ ID NO: 387979 - RNA, 13 nt, Homo sapiens
cuccacugucacc

SEQ ID NO: 387980 - RNA, 23 nt, Homo sapiens
cuccagaauggucuuucuaaugu

SEQ ID NO: 387981 - RNA, 20 nt, Homo sapiens
cuccaggccgagaugugcaa

SEQ ID NO: 387982 - RNA, 22 nt, Homo sapiens
cuccaggcugucuuucacugaa

SEQ ID NO: 387983 - RNA, 13 nt, Homo sapiens
cuccagugccagc

SEQ ID NO: 387984 - RNA, 17 nt, Homo sapiens
cuccaguggaagggaaa

SEQ ID NO: 387985 - RNA, 20 nt, Homo sapiens
cuccaguuuauagaccagaa

SEQ ID NO: 387986 - RNA, 14 nt, Homo sapiens
cuccauguuugaug

SEQ ID NO: 387987 - RNA, 16 nt, Homo sapiens
cuccauuucacuugac

SEQ ID NO: 387988 - RNA, 21 nt, Homo sapiens
cucccauccccuggacuggga

SEQ ID NO: 387989 - RNA, 12 nt, Homo sapiens
cuccccaacagc

SEQ ID NO: 387990 - RNA, 12 nt, Homo sapiens
cuccccauuugc

SEQ ID NO: 387991 - RNA, 14 nt, Homo sapiens
cuccccccacugca

SEQ ID NO: 387992 - RNA, 17 nt, Homo sapiens
cucccccugccagugcc

SEQ ID NO: 387993 - RNA, 14 nt, Homo sapiens
cucccuguccuccu

SEQ ID NO: 387994 - RNA, 13 nt, Homo sapiens
cuccucgcaagcu

SEQ ID NO: 387995 - RNA, 15 nt, Homo sapiens
cuccugaagccacag

SEQ ID NO: 387996 - RNA, 20 nt, Homo sapiens
cuccugaguaguugggauua

SEQ ID NO: 387997 - RNA, 18 nt, Homo sapiens
cuccugccccaugcugcc

SEQ ID NO: 387998 - RNA, 15 nt, Homo sapiens
cuccuguucgccucc

SEQ ID NO: 387999 - RNA, 16 nt, Homo sapiens
cuccuuagagacauca

SEQ ID NO: 388000 - RNA, 23 nt, Homo sapiens
cuccuuccugucuuccugcauuc

SEQ ID NO: 388001 - RNA, 19 nt, Homo sapiens
cuccuugggaggccccacu

SEQ ID NO: 388002 - RNA, 14 nt, Homo sapiens
cuccuuugcaggcu

SEQ ID NO: 388003 - RNA, 17 nt, Homo sapiens
cucgcuuuguugcccag

SEQ ID NO: 388004 - RNA, 11 nt, Homo sapiens
cucguccuccc

SEQ ID NO: 388005 - RNA, 13 nt, Homo sapiens
cucuacaaaaagc

SEQ ID NO: 388006 - RNA, 22 nt, Homo sapiens
cucuacccucuuagaaaaacca

SEQ ID NO: 388007 - RNA, 20 nt, Homo sapiens
cucuacuaaaaauacaaaaa

SEQ ID NO: 388008 - RNA, 20 nt, Homo sapiens
cucuacuaaaaauacaaaau

SEQ ID NO: 388009 - RNA, 21 nt, Homo sapiens
cucuacucuagggaaaaacca

SEQ ID NO: 388010 - RNA, 18 nt, Homo sapiens
cucuaguuuccagaggcu

SEQ ID NO: 388011 - RNA, 14 nt, Homo sapiens
cucucaccuccuaa

SEQ ID NO: 388012 - RNA, 17 nt, Homo sapiens
cucucagugaacuguga

SEQ ID NO: 388013 - RNA, 13 nt, Homo sapiens
cucuccacugaaa

SEQ ID NO: 388014 - RNA, 17 nt, Homo sapiens
cucuccccugauuacac

SEQ ID NO: 388015 - RNA, 18 nt, Homo sapiens
cucuccccugauuacacc

SEQ ID NO: 388016 - RNA, 14 nt, Homo sapiens
cucucuccugucca

SEQ ID NO: 388017 - RNA, 15 nt, Homo sapiens
cucucucuugcuuac

SEQ ID NO: 388018 - RNA, 14 nt, Homo sapiens
cucugaaaccagug

SEQ ID NO: 388019 - RNA, 18 nt, Homo sapiens
cucugacucagggcuccu

SEQ ID NO: 388020 - RNA, 23 nt, Homo sapiens
cucugcaaugggcacugggauga

SEQ ID NO: 388021 - RNA, 13 nt, Homo sapiens
cucugcacaagcu

SEQ ID NO: 388022 - RNA, 16 nt, Homo sapiens
cucugcacuacugaca

SEQ ID NO: 388023 - RNA, 17 nt, Homo sapiens
cucugcacuacugacau

SEQ ID NO: 388024 - RNA, 20 nt, Homo sapiens
cucugcagcccucagauuau

SEQ ID NO: 388025 - RNA, 15 nt, Homo sapiens
cucuggacacagccc

SEQ ID NO: 388026 - RNA, 17 nt, Homo sapiens
cucugggccaagucaaa

SEQ ID NO: 388027 - RNA, 22 nt, Homo sapiens
cucugguaaaugaucacuccag

SEQ ID NO: 388028 - RNA, 15 nt, Homo sapiens
cucugguaauauuga

SEQ ID NO: 388029 - RNA, 10 nt, Homo sapiens
cucuguccag

SEQ ID NO: 388030 - RNA, 18 nt, Homo sapiens
cucugugggcuccaugua

SEQ ID NO: 388031 - RNA, 19 nt, Homo sapiens
cucuguuucccuuucacug

SEQ ID NO: 388032 - RNA, 21 nt, Homo sapiens
cucuucaacugaccagccucc

SEQ ID NO: 388033 - RNA, 14 nt, Homo sapiens
cucuucacagucac

SEQ ID NO: 388034 - RNA, 12 nt, Homo sapiens
cucuuccaucau

SEQ ID NO: 388035 - RNA, 19 nt, Homo sapiens
cucuuccuacccuuccuca

SEQ ID NO: 388036 - RNA, 22 nt, Homo sapiens
cucuugacguggcacuuaccca

SEQ ID NO: 388037 - RNA, 21 nt, Homo sapiens
cucuugagccugggaggucaa

SEQ ID NO: 388038 - RNA, 13 nt, Homo sapiens
cucuugcacucaa

SEQ ID NO: 388039 - RNA, 16 nt, Homo sapiens
cucuugggaagaccag

SEQ ID NO: 388040 - RNA, 18 nt, Homo sapiens
cucuuguauaugaugauc

SEQ ID NO: 388041 - RNA, 13 nt, Homo sapiens
cucuuucuugacu

SEQ ID NO: 388042 - RNA, 17 nt, Homo sapiens
cucuuuugaauccaugc

SEQ ID NO: 388043 - RNA, 15 nt, Homo sapiens
cugaaaaucuaauau

SEQ ID NO: 388044 - RNA, 24 nt, Homo sapiens
cugaaaccucugggucaucucuca

SEQ ID NO: 388045 - RNA, 19 nt, Homo sapiens
cugaaaugcuagcugcaag

SEQ ID NO: 388046 - RNA, 23 nt, Homo sapiens
cugaacauaggaaaauagaaacu

SEQ ID NO: 388047 - RNA, 16 nt, Homo sapiens
cugaaccuuccaucuc

SEQ ID NO: 388048 - RNA, 18 nt, Homo sapiens
cugacagaaggacucagg

SEQ ID NO: 388049 - RNA, 19 nt, Homo sapiens
cugaccucaggugauccac

SEQ ID NO: 388050 - RNA, 17 nt, Homo sapiens
cugaccucgugauccac

SEQ ID NO: 388051 - RNA, 16 nt, Homo sapiens
cugacuguacuccucc

SEQ ID NO: 388052 - RNA, 18 nt, Homo sapiens
cugacuuaaguggcauua

SEQ ID NO: 388053 - RNA, 22 nt, Homo sapiens
cugagagacccaaggaggaaaa

SEQ ID NO: 388054 - RNA, 22 nt, Homo sapiens
cugagcaaagcauugagcaaag

SEQ ID NO: 388055 - RNA, 17 nt, Homo sapiens
cugagcagugccagcuu

SEQ ID NO: 388056 - RNA, 16 nt, Homo sapiens
cugagcgaugacucaa

SEQ ID NO: 388057 - RNA, 13 nt, Homo sapiens
cugaggaccagcc

SEQ ID NO: 388058 - RNA, 22 nt, Homo sapiens
cugaggcaagagaauugcuuga

SEQ ID NO: 388059 - RNA, 14 nt, Homo sapiens
cugaggcagggaag

SEQ ID NO: 388060 - RNA, 19 nt, Homo sapiens
cugagguuugccagcauuu

SEQ ID NO: 388061 - RNA, 18 nt, Homo sapiens
cugaguaguugggauuac

SEQ ID NO: 388062 - RNA, 15 nt, Homo sapiens
cuucucauacgucca

SEQ ID NO: 388063 - RNA, 14 nt, Homo sapiens
cuucuccaugagac

SEQ ID NO: 388064 - RNA, 17 nt, Homo sapiens
cuucucuucacagucac

SEQ ID NO: 388065 - RNA, 22 nt, Homo sapiens
cuucugcuggcagaaagcaaau

SEQ ID NO: 388066 - RNA, 13 nt, Homo sapiens
cuucugcuucuca

SEQ ID NO: 388067 - RNA, 21 nt, Homo sapiens
cuucugucccucacagcacua

SEQ ID NO: 388068 - RNA, 21 nt, Homo sapiens
cuucuuaauauaacugccuua

SEQ ID NO: 388069 - RNA, 19 nt, Homo sapiens
cuucuuggucucaguguca

SEQ ID NO: 388070 - RNA, 20 nt, Homo sapiens
cuucuuuuuuuuugagaugg

SEQ ID NO: 388071 - RNA, 15 nt, Homo sapiens
cuugaaaagacauca

SEQ ID NO: 388072 - RNA, 16 nt, Homo sapiens
cuugaaacugagaugu

SEQ ID NO: 388073 - RNA, 22 nt, Homo sapiens
cuugaaagaaaauaugcaucua

SEQ ID NO: 388074 - RNA, 15 nt, Homo sapiens
cuugaaugcagggac

SEQ ID NO: 388075 - RNA, 24 nt, Homo sapiens
cuugaccagcagaucccagcucac

SEQ ID NO: 388076 - RNA, 20 nt, Homo sapiens
cuugagacaaaucuaugcca

SEQ ID NO: 388077 - RNA, 22 nt, Homo sapiens
cuugagaggguggaauauccaa

SEQ ID NO: 388078 - RNA, 15 nt, Homo sapiens
cuugagccaguaauu

SEQ ID NO: 388079 - RNA, 18 nt, Homo sapiens
cuugaggaaaacaagcau

SEQ ID NO: 388080 - RNA, 16 nt, Homo sapiens
cuugaggcaacucauc

SEQ ID NO: 388081 - RNA, 18 nt, Homo sapiens
cuugaggcugcaaucaca

SEQ ID NO: 388082 - RNA, 20 nt, Homo sapiens
cuugagggugcuuguucccu

SEQ ID NO: 388083 - RNA, 13 nt, Homo sapiens
cuugaucuguaua

SEQ ID NO: 388084 - RNA, 18 nt, Homo sapiens
cuugaucuguauauacaa

SEQ ID NO: 388085 - RNA, 12 nt, Homo sapiens
cuugauucacaa

SEQ ID NO: 388086 - RNA, 15 nt, Homo sapiens
cuugauucacaauga

SEQ ID NO: 388087 - RNA, 17 nt, Homo sapiens
cuugcacgcccaugugu

SEQ ID NO: 388088 - RNA, 20 nt, Homo sapiens
cuugcacgcccaugugugag

SEQ ID NO: 388089 - RNA, 17 nt, Homo sapiens
cuugcaguuaaggguua

SEQ ID NO: 388090 - RNA, 12 nt, Homo sapiens
cuugccagacau

SEQ ID NO: 388091 - RNA, 22 nt, Homo sapiens
cuugccccuguuaccuaauuag

SEQ ID NO: 388092 - RNA, 19 nt, Homo sapiens
cuugcugccacauucuaaa

SEQ ID NO: 388093 - RNA, 12 nt, Homo sapiens
cuugcugugagc

SEQ ID NO: 388094 - RNA, 19 nt, Homo sapiens
cuuggacuauuauaauuua

SEQ ID NO: 388095 - RNA, 20 nt, Homo sapiens
cuuggagacaaaaucuuaaa

SEQ ID NO: 388096 - RNA, 16 nt, Homo sapiens
cuuggagccccagugc

SEQ ID NO: 388097 - RNA, 22 nt, Homo sapiens
cuuggcuuacugcagccuuugc

SEQ ID NO: 388098 - RNA, 16 nt, Homo sapiens
cuugggaugaugccuc

SEQ ID NO: 388099 - RNA, 21 nt, Homo sapiens
cuugggaugaugccucaugau

SEQ ID NO: 388100 - RNA, 13 nt, Homo sapiens
cuugggcucccug

SEQ ID NO: 388101 - RNA, 20 nt, Homo sapiens
cuuggggcaggcagugaugc

SEQ ID NO: 388102 - RNA, 16 nt, Homo sapiens
cuugucucacuugugc

SEQ ID NO: 388103 - RNA, 16 nt, Homo sapiens
cuugucugucuaguua

SEQ ID NO: 388104 - RNA, 19 nt, Homo sapiens
cuugugguuuaugucauca

SEQ ID NO: 388105 - RNA, 17 nt, Homo sapiens
cuuguguccacugugac

SEQ ID NO: 388106 - RNA, 16 nt, Homo sapiens
cuuguuccccacugac

SEQ ID NO: 388107 - RNA, 23 nt, Homo sapiens
cuuguuccccacugacagccucc

SEQ ID NO: 388108 - RNA, 22 nt, Homo sapiens
cuuuaaacacggggcuugcaac

SEQ ID NO: 388109 - RNA, 16 nt, Homo sapiens
cuuuaaacucagggac

SEQ ID NO: 388110 - RNA, 19 nt, Homo sapiens
cuuuaaagccugccucuuc

SEQ ID NO: 388111 - RNA, 18 nt, Homo sapiens
cuuuaaauuucaucucag

SEQ ID NO: 388112 - RNA, 15 nt, Homo sapiens
cuuuaacucauaaaa

SEQ ID NO: 388113 - RNA, 18 nt, Homo sapiens
cuuuaagcgcaacauuuc

SEQ ID NO: 388114 - RNA, 22 nt, Homo sapiens
cuuuaauaguuuugauccuaaa

SEQ ID NO: 388115 - RNA, 11 nt, Homo sapiens
cuuuaauuuca

SEQ ID NO: 388116 - RNA, 13 nt, Homo sapiens
cuuuagucugcaa

SEQ ID NO: 388117 - RNA, 14 nt, Homo sapiens
cuuuaucaccagag

SEQ ID NO: 388118 - RNA, 15 nt, Homo sapiens
cuuuauugugaucua

SEQ ID NO: 388119 - RNA, 20 nt, Homo sapiens
cuuucacacuuccaccagcc

SEQ ID NO: 388120 - RNA, 17 nt, Homo sapiens
cuuucacauagcacaga

SEQ ID NO: 388121 - RNA, 18 nt, Homo sapiens
cuuucaccccagggccug

SEQ ID NO: 388122 - RNA, 21 nt, Homo sapiens
cuuucauccacuagugcaaau

SEQ ID NO: 388123 - RNA, 14 nt, Homo sapiens
cuuuccuacucuca

SEQ ID NO: 388124 - RNA, 16 nt, Homo sapiens
cuuuccucgccugaca

SEQ ID NO: 388125 - RNA, 21 nt, Homo sapiens
cuuucucccaggccaggcucc

SEQ ID NO: 388126 - RNA, 20 nt, Homo sapiens
cuuucucugccagugacaga

SEQ ID NO: 388127 - RNA, 22 nt, Homo sapiens
cuuucuuacauuagcaguuugc

SEQ ID NO: 388128 - RNA, 11 nt, Homo sapiens
cuuucuucccu

SEQ ID NO: 388129 - RNA, 17 nt, Homo sapiens
cuuugacgggguuuucc

SEQ ID NO: 388130 - RNA, 17 nt, Homo sapiens
cuuugagacugggucuc

SEQ ID NO: 388131 - RNA, 19 nt, Homo sapiens
cuuuguaacggcucuuagc

SEQ ID NO: 388132 - RNA, 18 nt, Homo sapiens
cuuuuaaaacacuuccau

SEQ ID NO: 388133 - RNA, 21 nt, Homo sapiens
cuuuuaaacccuauugguaaa

SEQ ID NO: 388134 - RNA, 13 nt, Homo sapiens
cuuuuaaguugcu

SEQ ID NO: 388135 - RNA, 23 nt, Homo sapiens
cuuuuaaguugcugaugaacucu

SEQ ID NO: 388136 - RNA, 13 nt, Homo sapiens
cuuuuauaacuag

SEQ ID NO: 388137 - RNA, 17 nt, Homo sapiens
cuuuuccuuggucucca

SEQ ID NO: 388138 - RNA, 19 nt, Homo sapiens
cuuuucucagcuggaugau

SEQ ID NO: 388139 - RNA, 13 nt, Homo sapiens
cuuuugaggggcu

SEQ ID NO: 388140 - RNA, 14 nt, Homo sapiens
cuuuuucuguccca

SEQ ID NO: 388141 - RNA, 13 nt, Homo sapiens
cuuuuucuuugaa

SEQ ID NO: 388142 - RNA, 23 nt, Homo sapiens
cuuuuugguuugcagaugacaaa

SEQ ID NO: 388143 - RNA, 12 nt, Homo sapiens
gaaaacaauucu

SEQ ID NO: 388144 - RNA, 16 nt, Homo sapiens
gaaaacacugugcaca

SEQ ID NO: 388145 - RNA, 16 nt, Homo sapiens
gaaaacugagacucag

SEQ ID NO: 388146 - RNA, 14 nt, Homo sapiens
gaaaaggauaugca

SEQ ID NO: 388147 - RNA, 16 nt, Homo sapiens
gaaaaguacauuuaau

SEQ ID NO: 388148 - RNA, 12 nt, Homo sapiens
gaaaaucauauu

SEQ ID NO: 388149 - RNA, 21 nt, Homo sapiens
gaaaaugcuguauuagucaca

SEQ ID NO: 388150 - RNA, 14 nt, Homo sapiens
gaaaauuauuugca

SEQ ID NO: 388151 - RNA, 23 nt, Homo sapiens
gaaaauuguauguuaaguuacuu

SEQ ID NO: 388152 - RNA, 22 nt, Homo sapiens
gaaacaacaauuucuacuuuga

SEQ ID NO: 388153 - RNA, 23 nt, Homo sapiens
gaaacaacaauuucuacuuugaa

SEQ ID NO: 388154 - RNA, 19 nt, Homo sapiens
gaaaccccaucucuacuaa

SEQ ID NO: 388155 - RNA, 18 nt, Homo sapiens
gaaacccgacagagggaa

SEQ ID NO: 388156 - RNA, 20 nt, Homo sapiens
gaaaccuuauuguaccucuc

SEQ ID NO: 388157 - RNA, 16 nt, Homo sapiens
gaaacuugcuuaucaa

SEQ ID NO: 388158 - RNA, 12 nt, Homo sapiens
gaaagaagacau

SEQ ID NO: 388159 - RNA, 18 nt, Homo sapiens
gaaagacuauucaaacag

SEQ ID NO: 388160 - RNA, 19 nt, Homo sapiens
gaaagaguccuauuugcac

SEQ ID NO: 388161 - RNA, 22 nt, Homo sapiens
gaaagccgggcaugacggcuca

SEQ ID NO: 388162 - RNA, 13 nt, Homo sapiens
gaaagccugagaa

SEQ ID NO: 388163 - RNA, 17 nt, Homo sapiens
gaaaguaagugguagcu

SEQ ID NO: 388164 - RNA, 16 nt, Homo sapiens
gaaaguacauuuggag

SEQ ID NO: 388165 - RNA, 14 nt, Homo sapiens
gaaaguucaaaaag

SEQ ID NO: 388166 - RNA, 14 nt, Homo sapiens
gaaauagaagcaaa

SEQ ID NO: 388167 - RNA, 20 nt, Homo sapiens
gaaauauaacaaguggguga

SEQ ID NO: 388168 - RNA, 21 nt, Homo sapiens
gaaauauaacaagugggugaa

SEQ ID NO: 388169 - RNA, 22 nt, Homo sapiens
gaaauugaaguuucagagcuac

SEQ ID NO: 388170 - RNA, 14 nt, Homo sapiens
gaacacaucagcuu

SEQ ID NO: 388171 - RNA, 18 nt, Homo sapiens
gaacacucuacuacaugu

SEQ ID NO: 388172 - RNA, 21 nt, Homo sapiens
gaacacuggcaacaacaaagc

SEQ ID NO: 388173 - RNA, 17 nt, Homo sapiens
gaacagcuguaaucuau

SEQ ID NO: 388174 - RNA, 15 nt, Homo sapiens
gaacaguaacugcca

SEQ ID NO: 388175 - RNA, 16 nt, Homo sapiens
gaacaguaacugccau

SEQ ID NO: 388176 - RNA, 18 nt, Homo sapiens
gaacaucucgaauacaau

SEQ ID NO: 388177 - RNA, 12 nt, Homo sapiens
gaaccucagggc

SEQ ID NO: 388178 - RNA, 15 nt, Homo sapiens
gaacuagagaaggac

SEQ ID NO: 388179 - RNA, 23 nt, Homo sapiens
gaacucagagccagaucccuuau

SEQ ID NO: 388180 - RNA, 21 nt, Homo sapiens
gaacucuucaaucucuugcac

SEQ ID NO: 388181 - RNA, 18 nt, Homo sapiens
gaacugaaguuucacaug

SEQ ID NO: 388182 - RNA, 15 nt, Homo sapiens
gaacuggaccaucuc

SEQ ID NO: 388183 - RNA, 19 nt, Homo sapiens
gaacuggaggaguuccuug

SEQ ID NO: 388184 - RNA, 12 nt, Homo sapiens
gaacuugcacaa

SEQ ID NO: 388185 - RNA, 15 nt, Homo sapiens
gaacuuucacauagc

SEQ ID NO: 388186 - RNA, 12 nt, Homo sapiens
gaagaagcuaaa

SEQ ID NO: 388187 - RNA, 21 nt, Homo sapiens
gaagaagucuaagagugaagu

SEQ ID NO: 388188 - RNA, 13 nt, Homo sapiens
gaagacaauguga

SEQ ID NO: 388189 - RNA, 15 nt, Homo sapiens
gaagacagagggaaa

SEQ ID NO: 388190 - RNA, 12 nt, Homo sapiens
gaagacaggaug

SEQ ID NO: 388191 - RNA, 16 nt, Homo sapiens
gaagacauccugagca

SEQ ID NO: 388192 - RNA, 17 nt, Homo sapiens
gaagaccagcuuugcag

SEQ ID NO: 388193 - RNA, 21 nt, Homo sapiens
gaagacucuaccagacugugu

SEQ ID NO: 388194 - RNA, 12 nt, Homo sapiens
gaagacuguggc

SEQ ID NO: 388195 - RNA, 16 nt, Homo sapiens
gaagagaaugugacag

SEQ ID NO: 388196 - RNA, 17 nt, Homo sapiens
gaagagauccuucugua

SEQ ID NO: 388197 - RNA, 18 nt, Homo sapiens
gaagagauuuuucaugau

SEQ ID NO: 388198 - RNA, 23 nt, Homo sapiens
gaagagccuugcggaagguucua

SEQ ID NO: 388199 - RNA, 17 nt, Homo sapiens
gaagaugggaaaaccau

SEQ ID NO: 388200 - RNA, 18 nt, Homo sapiens
gaagauucuccugugcua

SEQ ID NO: 388201 - RNA, 17 nt, Homo sapiens
gaagcacagcagcaucu

SEQ ID NO: 388202 - RNA, 21 nt, Homo sapiens
gaagcaucacauaaaaaugau

SEQ ID NO: 388203 - RNA, 22 nt, Homo sapiens
gaagcucccugaaguaagcaaa

SEQ ID NO: 388204 - RNA, 12 nt, Homo sapiens
aaaaaaaauccc

SEQ ID NO: 388205 - RNA, 16 nt, Homo sapiens
aaaaaacacaucuggc

SEQ ID NO: 388206 - RNA, 18 nt, Homo sapiens
aaaaaaccuucagugaaa

SEQ ID NO: 388207 - RNA, 14 nt, Homo sapiens
aaaaaacucuugau

SEQ ID NO: 388208 - RNA, 13 nt, Homo sapiens
aaaaacacagaca

SEQ ID NO: 388209 - RNA, 19 nt, Homo sapiens
aaaaacacagacauucugc

SEQ ID NO: 388210 - RNA, 14 nt, Homo sapiens
aaaaagccugugaa

SEQ ID NO: 388211 - RNA, 21 nt, Homo sapiens
aaaaauagccugccucuucuc

SEQ ID NO: 388212 - RNA, 14 nt, Homo sapiens
aaaaaugacuaaaa

SEQ ID NO: 388213 - RNA, 16 nt, Homo sapiens
aaaacaagcauucaca

SEQ ID NO: 388214 - RNA, 20 nt, Homo sapiens
aaaacaauuguaauaaugcu

SEQ ID NO: 388215 - RNA, 13 nt, Homo sapiens
aaaacacugugca

SEQ ID NO: 388216 - RNA, 18 nt, Homo sapiens
aaaacagccucacagaag

SEQ ID NO: 388217 - RNA, 16 nt, Homo sapiens
aaaaccaauagcuuua

SEQ ID NO: 388218 - RNA, 18 nt, Homo sapiens
aaaaccacagcaguugaa

SEQ ID NO: 388219 - RNA, 19 nt, Homo sapiens
aaaacccacaaaaguacaa

SEQ ID NO: 388220 - RNA, 13 nt, Homo sapiens
aaaacccagagag

SEQ ID NO: 388221 - RNA, 23 nt, Homo sapiens
aaaaccccaucucuacaaaaagc

SEQ ID NO: 388222 - RNA, 18 nt, Homo sapiens
aaaaccuuucaaauuuca

SEQ ID NO: 388223 - RNA, 21 nt, Homo sapiens
aaaacucugguaaaugaucac

SEQ ID NO: 388224 - RNA, 20 nt, Homo sapiens
aaaacucuugauaugaccug

SEQ ID NO: 388225 - RNA, 20 nt, Homo sapiens
aaaacugauuuuuagcuuua

SEQ ID NO: 388226 - RNA, 22 nt, Homo sapiens
aaaacuguggguagagacuuug

SEQ ID NO: 388227 - RNA, 19 nt, Homo sapiens
aaaacuuuaugcuaaguga

SEQ ID NO: 388228 - RNA, 23 nt, Homo sapiens
aaaagaugcuucucacugccaug

SEQ ID NO: 388229 - RNA, 18 nt, Homo sapiens
aaaagauuuucagaaaau

SEQ ID NO: 388230 - RNA, 13 nt, Homo sapiens
aaaagcaccugcc

SEQ ID NO: 388231 - RNA, 13 nt, Homo sapiens
aaaagccaugagu

SEQ ID NO: 388232 - RNA, 15 nt, Homo sapiens
aaaaggauaugcagu

SEQ ID NO: 388233 - RNA, 16 nt, Homo sapiens
aaaaggauaugcagua

SEQ ID NO: 388234 - RNA, 18 nt, Homo sapiens
aaaagggaaguugugccu

SEQ ID NO: 388235 - RNA, 15 nt, Homo sapiens
aaaagguuauauacc

SEQ ID NO: 388236 - RNA, 18 nt, Homo sapiens
aaaagucuacgcucuccu

SEQ ID NO: 388237 - RNA, 13 nt, Homo sapiens
aaaagucuucacu

SEQ ID NO: 388238 - RNA, 18 nt, Homo sapiens
aaaauacaugacauuuau

SEQ ID NO: 388239 - RNA, 20 nt, Homo sapiens
aaaauaccuuuguaacggcu

SEQ ID NO: 388240 - RNA, 11 nt, Homo sapiens
aaaauaugcau

SEQ ID NO: 388241 - RNA, 22 nt, Homo sapiens
aaaaucacacagccaagccagu

SEQ ID NO: 388242 - RNA, 21 nt, Homo sapiens
aaaaucuauuuuguaacuuuc

SEQ ID NO: 388243 - RNA, 16 nt, Homo sapiens
aaaaugaaucuucaca

SEQ ID NO: 388244 - RNA, 18 nt, Homo sapiens
aaaaugccucaguguauu

SEQ ID NO: 388245 - RNA, 15 nt, Homo sapiens
aaaauguaaugauca

SEQ ID NO: 388246 - RNA, 18 nt, Homo sapiens
aaaauuauuugcauaaca

SEQ ID NO: 388247 - RNA, 13 nt, Homo sapiens
aaacaaacaugac

SEQ ID NO: 388248 - RNA, 14 nt, Homo sapiens
aaacaaauaugcaa

SEQ ID NO: 388249 - RNA, 20 nt, Homo sapiens
aaacaacuucaauauccaaa

SEQ ID NO: 388250 - RNA, 22 nt, Homo sapiens
aaacacaucuggccuaauguuc

SEQ ID NO: 388251 - RNA, 21 nt, Homo sapiens
aaacacgccugcaaacgcugc

SEQ ID NO: 388252 - RNA, 21 nt, Homo sapiens
aaacagccccucuggacacag

SEQ ID NO: 388253 - RNA, 14 nt, Homo sapiens
aaacagcugagggu

SEQ ID NO: 388254 - RNA, 14 nt, Homo sapiens
aaacaguagugaua

SEQ ID NO: 388255 - RNA, 20 nt, Homo sapiens
aaacaugguggguccauggg

SEQ ID NO: 388256 - RNA, 23 nt, Homo sapiens
aaacauguuccuuauauuuacuc

SEQ ID NO: 388257 - RNA, 18 nt, Homo sapiens
aaacccccacuccagcuc

SEQ ID NO: 388258 - RNA, 19 nt, Homo sapiens
aaaccuuucaaauuucaca

SEQ ID NO: 388259 - RNA, 13 nt, Homo sapiens
aaacgcugccugc

SEQ ID NO: 388260 - RNA, 12 nt, Homo sapiens
aaacgugcaugg

SEQ ID NO: 388261 - RNA, 23 nt, Homo sapiens
aaacgugcauggauaugugccag

SEQ ID NO: 388262 - RNA, 16 nt, Homo sapiens
aaacuaaaucucuaau

SEQ ID NO: 388263 - RNA, 16 nt, Homo sapiens
aaacuaacacccaguc

SEQ ID NO: 388264 - RNA, 17 nt, Homo sapiens
aaacuauguaacaugua

SEQ ID NO: 388265 - RNA, 19 nt, Homo sapiens
aaacugauuuuuagcuuua

SEQ ID NO: 388266 - RNA, 14 nt, Homo sapiens
aaacugcugugaau

SEQ ID NO: 388267 - RNA, 13 nt, Homo sapiens
aaacuucaagggu

SEQ ID NO: 388268 - RNA, 13 nt, Homo sapiens
aaacuucagggau

SEQ ID NO: 388269 - RNA, 17 nt, Homo sapiens
aaacuuuggcuuauaaa

SEQ ID NO: 388270 - RNA, 18 nt, Homo sapiens
aaagaaauuguauuauca

SEQ ID NO: 388271 - RNA, 13 nt, Homo sapiens
aaagaagguuuca

SEQ ID NO: 388272 - RNA, 14 nt, Homo sapiens
aaagaaguggggac

SEQ ID NO: 388273 - RNA, 13 nt, Homo sapiens
accuaggauuuca

SEQ ID NO: 388274 - RNA, 12 nt, Homo sapiens
accuaguacaag

SEQ ID NO: 388275 - RNA, 17 nt, Homo sapiens
accucaaccuaugguau

SEQ ID NO: 388276 - RNA, 17 nt, Homo sapiens
accucacgcaccuccca

SEQ ID NO: 388277 - RNA, 12 nt, Homo sapiens
accucacugggg

SEQ ID NO: 388278 - RNA, 11 nt, Homo sapiens
accucagggcu

SEQ ID NO: 388279 - RNA, 12 nt, Homo sapiens
accucaguuuua

SEQ ID NO: 388280 - RNA, 22 nt, Homo sapiens
accucaguuuuaucauuuucaa

SEQ ID NO: 388281 - RNA, 17 nt, Homo sapiens
accucccauccuaauca

SEQ ID NO: 388282 - RNA, 23 nt, Homo sapiens
accuccccagccccuagcccagg

SEQ ID NO: 388283 - RNA, 20 nt, Homo sapiens
accuccuccucuggacaaag

SEQ ID NO: 388284 - RNA, 17 nt, Homo sapiens
accucgcuggacucuca

SEQ ID NO: 388285 - RNA, 21 nt, Homo sapiens
accucuccaaccuaacuggcu

SEQ ID NO: 388286 - RNA, 14 nt, Homo sapiens
accucugcacuacu

SEQ ID NO: 388287 - RNA, 17 nt, Homo sapiens
accucugggucaucucu

SEQ ID NO: 388288 - RNA, 20 nt, Homo sapiens
accugaaaaaaaguuuacaa

SEQ ID NO: 388289 - RNA, 18 nt, Homo sapiens
accugaaaacacugugca

SEQ ID NO: 388290 - RNA, 18 nt, Homo sapiens
accugaaauaaaauucau

SEQ ID NO: 388291 - RNA, 11 nt, Homo sapiens
accugaugcug

SEQ ID NO: 388292 - RNA, 23 nt, Homo sapiens
accugcaccuccccccacugcag

SEQ ID NO: 388293 - RNA, 16 nt, Homo sapiens
accugcccugggccac

SEQ ID NO: 388294 - RNA, 23 nt, Homo sapiens
accugcccugggccacacugacc

SEQ ID NO: 388295 - RNA, 18 nt, Homo sapiens
accugcugagggaccagc

SEQ ID NO: 388296 - RNA, 19 nt, Homo sapiens
accugcugagggaccagcc

SEQ ID NO: 388297 - RNA, 11 nt, Homo sapiens
accugcugcug

SEQ ID NO: 388298 - RNA, 22 nt, Homo sapiens
accuguagucccagcuacucag

SEQ ID NO: 388299 - RNA, 16 nt, Homo sapiens
accuguccuugcacac

SEQ ID NO: 388300 - RNA, 15 nt, Homo sapiens
accuguucaaaaagg

SEQ ID NO: 388301 - RNA, 14 nt, Homo sapiens
accuuaaacaagcu

SEQ ID NO: 388302 - RNA, 15 nt, Homo sapiens
accuugaacacuggg

SEQ ID NO: 388303 - RNA, 12 nt, Homo sapiens
accuugugagag

SEQ ID NO: 388304 - RNA, 17 nt, Homo sapiens
accuuucaaauuucaca

SEQ ID NO: 388305 - RNA, 17 nt, Homo sapiens
accuuuggagcaaagcu

SEQ ID NO: 388306 - RNA, 15 nt, Homo sapiens
acgaacccaccugcu

SEQ ID NO: 388307 - RNA, 15 nt, Homo sapiens
acgccuguaauccca

SEQ ID NO: 388308 - RNA, 16 nt, Homo sapiens
acgccuguaauccuag

SEQ ID NO: 388309 - RNA, 17 nt, Homo sapiens
acgccuuguucuuggcc

SEQ ID NO: 388310 - RNA, 17 nt, Homo sapiens
acggacacucaaaagcu

SEQ ID NO: 388311 - RNA, 20 nt, Homo sapiens
acggagccacuccucugacu

SEQ ID NO: 388312 - RNA, 17 nt, Homo sapiens
acggcucaugccuguaa

SEQ ID NO: 388313 - RNA, 22 nt, Homo sapiens
acggggcuugcaacuuagcuca

SEQ ID NO: 388314 - RNA, 15 nt, Homo sapiens
acgugacuguggcac

SEQ ID NO: 388315 - RNA, 17 nt, Homo sapiens
acgugacuguggcacac

SEQ ID NO: 388316 - RNA, 22 nt, Homo sapiens
acgugcauggauaugugccagg

SEQ ID NO: 388317 - RNA, 12 nt, Homo sapiens
acguggccucuu

SEQ ID NO: 388318 - RNA, 17 nt, Homo sapiens
acguggccucuugagca

SEQ ID NO: 388319 - RNA, 17 nt, Homo sapiens
acguuagaccacaaaua

SEQ ID NO: 388320 - RNA, 22 nt, Homo sapiens
acguugaggacuuuucgaccaa

SEQ ID NO: 388321 - RNA, 14 nt, Homo sapiens
acuaaaaaucauga

SEQ ID NO: 388322 - RNA, 21 nt, Homo sapiens
acuaaauguacuacugagcuu

SEQ ID NO: 388323 - RNA, 20 nt, Homo sapiens
acuaagaugaucaucuccag

SEQ ID NO: 388324 - RNA, 16 nt, Homo sapiens
acuaauacagacuaug

SEQ ID NO: 388325 - RNA, 22 nt, Homo sapiens
acuacacauucaauaagcauca

SEQ ID NO: 388326 - RNA, 22 nt, Homo sapiens
acuacagcgccaacgagcagug

SEQ ID NO: 388327 - RNA, 14 nt, Homo sapiens
acuacaucacuuga

SEQ ID NO: 388328 - RNA, 23 nt, Homo sapiens
acuaccuugguucccccacugau

SEQ ID NO: 388329 - RNA, 15 nt, Homo sapiens
acuacgcuugcucau

SEQ ID NO: 388330 - RNA, 19 nt, Homo sapiens
acuacucccucaaagcaca

SEQ ID NO: 388331 - RNA, 18 nt, Homo sapiens
acuagagggauacacuga

SEQ ID NO: 388332 - RNA, 11 nt, Homo sapiens
acuagggccaa

SEQ ID NO: 388333 - RNA, 21 nt, Homo sapiens
acuauaagcagaagcacauau

SEQ ID NO: 388334 - RNA, 12 nt, Homo sapiens
acuauuacuggg

SEQ ID NO: 388335 - RNA, 14 nt, Homo sapiens
acuauucauaagau

SEQ ID NO: 388336 - RNA, 16 nt, Homo sapiens
acuauugaaaucaagc

SEQ ID NO: 388337 - RNA, 18 nt, Homo sapiens
acuauugaaguugcagau

SEQ ID NO: 388338 - RNA, 21 nt, Homo sapiens
acuauuuucauucucuuguua

SEQ ID NO: 388339 - RNA, 14 nt, Homo sapiens
acucaaacugccuu

SEQ ID NO: 388340 - RNA, 14 nt, Homo sapiens
acucaagugucuca

SEQ ID NO: 388341 - RNA, 13 nt, Homo sapiens
acucaaucucuga

SEQ ID NO: 388342 - RNA, 23 nt, Homo sapiens
acucaccaguguccccuccacug

SEQ ID NO: 388343 - RNA, 18 nt, Homo sapiens
acucagauggaaccgcag

SEQ ID NO: 388344 - RNA, 22 nt, Homo sapiens
acucagauggaaccgcaggaag

SEQ ID NO: 388345 - RNA, 22 nt, Homo sapiens
acucaggaugcccagggccacu

SEQ ID NO: 388346 - RNA, 18 nt, Homo sapiens
acucagggacagagccau

SEQ ID NO: 388347 - RNA, 19 nt, Homo sapiens
acucagggccccagcacua

SEQ ID NO: 388348 - RNA, 13 nt, Homo sapiens
acucagggcuccu

SEQ ID NO: 388349 - RNA, 21 nt, Homo sapiens
acucagucccuaaaaacacag

SEQ ID NO: 388350 - RNA, 12 nt, Homo sapiens
acucauuccugc

SEQ ID NO: 388351 - RNA, 23 nt, Homo sapiens
acucauuuuuguuuucauuaucu

SEQ ID NO: 388352 - RNA, 17 nt, Homo sapiens
acuccacagucaauauu

SEQ ID NO: 388353 - RNA, 20 nt, Homo sapiens
acuccagauuuuuuacagcu

SEQ ID NO: 388354 - RNA, 23 nt, Homo sapiens
acuccagccugagcgacagugag

SEQ ID NO: 388355 - RNA, 16 nt, Homo sapiens
acucccagcagguaug

SEQ ID NO: 388356 - RNA, 15 nt, Homo sapiens
acuccccugcacugg

SEQ ID NO: 388357 - RNA, 19 nt, Homo sapiens
acucccggccugucauuca

SEQ ID NO: 388358 - RNA, 17 nt, Homo sapiens
acucccuugguggcaag

SEQ ID NO: 388359 - RNA, 14 nt, Homo sapiens
acuccuccaaggca

SEQ ID NO: 388360 - RNA, 16 nt, Homo sapiens
acuccuccaaggcaca

SEQ ID NO: 388361 - RNA, 21 nt, Homo sapiens
acucgcuucccccauagccac

SEQ ID NO: 388362 - RNA, 20 nt, Homo sapiens
acucuauuaaaucuugcaac

SEQ ID NO: 388363 - RNA, 22 nt, Homo sapiens
acucuccagaaagcucaucuca

SEQ ID NO: 388364 - RNA, 19 nt, Homo sapiens
acucugccucugccugcau

SEQ ID NO: 388365 - RNA, 12 nt, Homo sapiens
acucugucuugu

SEQ ID NO: 388366 - RNA, 23 nt, Homo sapiens
acucuuaguuacucauucaggga

SEQ ID NO: 388367 - RNA, 19 nt, Homo sapiens
acucuuugaaugacaaaga

SEQ ID NO: 388368 - RNA, 14 nt, Homo sapiens
acugaaaugcuagc

SEQ ID NO: 388369 - RNA, 14 nt, Homo sapiens
acugaaguuucaca

SEQ ID NO: 388370 - RNA, 20 nt, Homo sapiens
acugacccugauacaggcau

SEQ ID NO: 388371 - RNA, 18 nt, Homo sapiens
acugacuuucucagccuc

SEQ ID NO: 388372 - RNA, 19 nt, Homo sapiens
acugagaugugaacacauc

SEQ ID NO: 388373 - RNA, 22 nt, Homo sapiens
acugagccccgcagaccucccc

SEQ ID NO: 388374 - RNA, 14 nt, Homo sapiens
acugaggcagacag

SEQ ID NO: 388375 - RNA, 14 nt, Homo sapiens
acugauaaccacuc

SEQ ID NO: 388376 - RNA, 15 nt, Homo sapiens
acugaucuuacucac

SEQ ID NO: 388377 - RNA, 12 nt, Homo sapiens
acugaugaaggc

SEQ ID NO: 388378 - RNA, 20 nt, Homo sapiens
acugauuucacaacagauca

SEQ ID NO: 388379 - RNA, 17 nt, Homo sapiens
acugauuuuuagcuuua

SEQ ID NO: 388380 - RNA, 13 nt, Homo sapiens
acugcaaauguca

SEQ ID NO: 388381 - RNA, 15 nt, Homo sapiens
acugcaagcacugca

SEQ ID NO: 388382 - RNA, 21 nt, Homo sapiens
cuggcagaaagcaaaugugac

SEQ ID NO: 388383 - RNA, 21 nt, Homo sapiens
cugggaacugugccuuugagu

SEQ ID NO: 388384 - RNA, 21 nt, Homo sapiens
cugggagacuuugaagaccag

SEQ ID NO: 388385 - RNA, 15 nt, Homo sapiens
cugggcaacacagcg

SEQ ID NO: 388386 - RNA, 13 nt, Homo sapiens
cugggccaaguca

SEQ ID NO: 388387 - RNA, 16 nt, Homo sapiens
cugggccaagucaaag

SEQ ID NO: 388388 - RNA, 16 nt, Homo sapiens
cugggccccaccaccu

SEQ ID NO: 388389 - RNA, 22 nt, Homo sapiens
cugggccccaccaccuaggcca

SEQ ID NO: 388390 - RNA, 15 nt, Homo sapiens
cugggccuucucacc

SEQ ID NO: 388391 - RNA, 22 nt, Homo sapiens
cuggggagccagggcuauggga

SEQ ID NO: 388392 - RNA, 20 nt, Homo sapiens
cugguagaaaggcaguucag

SEQ ID NO: 388393 - RNA, 15 nt, Homo sapiens
cuggucucaaacucc

SEQ ID NO: 388394 - RNA, 23 nt, Homo sapiens
cuggucucaaacuccugggcuca

SEQ ID NO: 388395 - RNA, 14 nt, Homo sapiens
cuggugacaccagc

SEQ ID NO: 388396 - RNA, 18 nt, Homo sapiens
cuggugacaccagccuuu

SEQ ID NO: 388397 - RNA, 13 nt, Homo sapiens
cugguuagguaga

SEQ ID NO: 388398 - RNA, 21 nt, Homo sapiens
cugguugguguugcagaaggu

SEQ ID NO: 388399 - RNA, 14 nt, Homo sapiens
cuguaaucacagcu

SEQ ID NO: 388400 - RNA, 21 nt, Homo sapiens
cuguaaucccagcuacuuggg

SEQ ID NO: 388401 - RNA, 16 nt, Homo sapiens
cuguaggggcaaaaau

SEQ ID NO: 388402 - RNA, 15 nt, Homo sapiens
cuguaguagcccuuu

SEQ ID NO: 388403 - RNA, 19 nt, Homo sapiens
cuguagucccagcuacuca

SEQ ID NO: 388404 - RNA, 22 nt, Homo sapiens
cuguagucccagcuacucagga

SEQ ID NO: 388405 - RNA, 14 nt, Homo sapiens
cuguagucucagga

SEQ ID NO: 388406 - RNA, 15 nt, Homo sapiens
cuguagucucaggac

SEQ ID NO: 388407 - RNA, 18 nt, Homo sapiens
cuguaugaaugucugugg

SEQ ID NO: 388408 - RNA, 14 nt, Homo sapiens
cuguauuagucaca

SEQ ID NO: 388409 - RNA, 17 nt, Homo sapiens
cuguauuagucacagag

SEQ ID NO: 388410 - RNA, 15 nt, Homo sapiens
cuguauuuauuuuag

SEQ ID NO: 388411 - RNA, 12 nt, Homo sapiens
cugucaaacaaa

SEQ ID NO: 388412 - RNA, 22 nt, Homo sapiens
cugucaaacaaagccagaagcu

SEQ ID NO: 388413 - RNA, 13 nt, Homo sapiens
cugucucauauga

SEQ ID NO: 388414 - RNA, 21 nt, Homo sapiens
cugucucauaugauugugcac

SEQ ID NO: 388415 - RNA, 17 nt, Homo sapiens
gaaacuguagucucagg

SEQ ID NO: 388416 - RNA, 19 nt, Homo sapiens
gaaacuguagucucaggac

SEQ ID NO: 388417 - RNA, 14 nt, Homo sapiens
gaaagaaaugccca

SEQ ID NO: 388418 - RNA, 18 nt, Homo sapiens
gaaagaguccuauuugca

SEQ ID NO: 388419 - RNA, 14 nt, Homo sapiens
gaaagcaggggcua

SEQ ID NO: 388420 - RNA, 17 nt, Homo sapiens
gaaagcauggcugagaa

SEQ ID NO: 388421 - RNA, 19 nt, Homo sapiens
gaaagcauuacauuuccaa

SEQ ID NO: 388422 - RNA, 10 nt, Homo sapiens
gaaagccagg

SEQ ID NO: 388423 - RNA, 18 nt, Homo sapiens
gaaagccugggugacauu

SEQ ID NO: 388424 - RNA, 20 nt, Homo sapiens
gaaagccugggugacauuug

SEQ ID NO: 388425 - RNA, 22 nt, Homo sapiens
gaaagcuguggccagcuuguua

SEQ ID NO: 388426 - RNA, 23 nt, Homo sapiens
gaaagcuugcccuggugccucac

SEQ ID NO: 388427 - RNA, 16 nt, Homo sapiens
gaaaguacagaacaaa

SEQ ID NO: 388428 - RNA, 15 nt, Homo sapiens
gaaagugaccauguu

SEQ ID NO: 388429 - RNA, 18 nt, Homo sapiens
gaaauaaaguuggugaca

SEQ ID NO: 388430 - RNA, 19 nt, Homo sapiens
gaaauaaaguuggugacag

SEQ ID NO: 388431 - RNA, 17 nt, Homo sapiens
gaaauaucaugcuccau

SEQ ID NO: 388432 - RNA, 22 nt, Homo sapiens
gaaaucuuguuggcaaaucaga

SEQ ID NO: 388433 - RNA, 23 nt, Homo sapiens
gaacagccgcuccugucugccag

SEQ ID NO: 388434 - RNA, 16 nt, Homo sapiens
gaaccaggcaacuugg

SEQ ID NO: 388435 - RNA, 12 nt, Homo sapiens
gaaccauaucaa

SEQ ID NO: 388436 - RNA, 23 nt, Homo sapiens
gaaccccgucgaggggcucucag

SEQ ID NO: 388437 - RNA, 15 nt, Homo sapiens
gaacgagaccugugu

SEQ ID NO: 388438 - RNA, 12 nt, Homo sapiens
gaacgcuuucau

SEQ ID NO: 388439 - RNA, 19 nt, Homo sapiens
gaacuagccaccaacucuu

SEQ ID NO: 388440 - RNA, 15 nt, Homo sapiens
gaacuggacucagga

SEQ ID NO: 388441 - RNA, 16 nt, Homo sapiens
gaacuggacucaggau

SEQ ID NO: 388442 - RNA, 15 nt, Homo sapiens
gaacuguccagagag

SEQ ID NO: 388443 - RNA, 16 nt, Homo sapiens
gaacuuucaccuucau

SEQ ID NO: 388444 - RNA, 13 nt, Homo sapiens
gaagaacaguaac

SEQ ID NO: 388445 - RNA, 21 nt, Homo sapiens
gaagaccaguccuguuugcag

SEQ ID NO: 388446 - RNA, 18 nt, Homo sapiens
gaagagauccuucuguaa

SEQ ID NO: 388447 - RNA, 15 nt, Homo sapiens
gaagaguuaaaacag

SEQ ID NO: 388448 - RNA, 18 nt, Homo sapiens
gaagaugaucauuugccc

SEQ ID NO: 388449 - RNA, 23 nt, Homo sapiens
gaagcagaaauacauauuuccaa

SEQ ID NO: 388450 - RNA, 21 nt, Homo sapiens
gaagccucacugcaagcacug

SEQ ID NO: 388451 - RNA, 12 nt, Homo sapiens
gaaggagggaga

SEQ ID NO: 388452 - RNA, 23 nt, Homo sapiens
gaaguaacaaaagaagugacauc

SEQ ID NO: 388453 - RNA, 19 nt, Homo sapiens
gaaguaagcaaagacuuuc

SEQ ID NO: 388454 - RNA, 19 nt, Homo sapiens
gaaguacucauacauguua

SEQ ID NO: 388455 - RNA, 22 nt, Homo sapiens
gaaguacucauacauguuacaa

SEQ ID NO: 388456 - RNA, 13 nt, Homo sapiens
gaaguagguguga

SEQ ID NO: 388457 - RNA, 14 nt, Homo sapiens
gaaguaugagggaa

SEQ ID NO: 388458 - RNA, 20 nt, Homo sapiens
gaagugaaugaaacacucag

SEQ ID NO: 388459 - RNA, 18 nt, Homo sapiens
gaaguguaagaaacacac

SEQ ID NO: 388460 - RNA, 16 nt, Homo sapiens
gaaguuccaguguucu

SEQ ID NO: 388461 - RNA, 19 nt, Homo sapiens
gaaguuccaguguucucuc

SEQ ID NO: 388462 - RNA, 19 nt, Homo sapiens
gaauaaacuagacucugaa

SEQ ID NO: 388463 - RNA, 15 nt, Homo sapiens
gaauaguaaguggug

SEQ ID NO: 388464 - RNA, 20 nt, Homo sapiens
gaauauauuauaaucuucca

SEQ ID NO: 388465 - RNA, 21 nt, Homo sapiens
gaauauauuauaaucuuccau

SEQ ID NO: 388466 - RNA, 18 nt, Homo sapiens
gaauaucugggauucuac

SEQ ID NO: 388467 - RNA, 21 nt, Homo sapiens
gaauauuuauuaccucugaua

SEQ ID NO: 388468 - RNA, 18 nt, Homo sapiens
gaaucagacuucacacug

SEQ ID NO: 388469 - RNA, 20 nt, Homo sapiens
gaaucagugaagaugccagu

SEQ ID NO: 388470 - RNA, 12 nt, Homo sapiens
gaauccaugcuu

SEQ ID NO: 388471 - RNA, 18 nt, Homo sapiens
gaauccccgaaggugcug

SEQ ID NO: 388472 - RNA, 19 nt, Homo sapiens
gaauccccgaaggugcugg

SEQ ID NO: 388473 - RNA, 20 nt, Homo sapiens
gaaucucuuuuugcuuucga

SEQ ID NO: 388474 - RNA, 22 nt, Homo sapiens
gaaugcaaaguagcaauuucca

SEQ ID NO: 388475 - RNA, 15 nt, Homo sapiens
gaaugcagggacaaa

SEQ ID NO: 388476 - RNA, 20 nt, Homo sapiens
gaaugcggccgcauucccug

SEQ ID NO: 388477 - RNA, 14 nt, Homo sapiens
gaaugcuguguuaa

SEQ ID NO: 388478 - RNA, 14 nt, Homo sapiens
gaauguacucuguu

SEQ ID NO: 388479 - RNA, 16 nt, Homo sapiens
gaauuaacacaugauc

SEQ ID NO: 388480 - RNA, 19 nt, Homo sapiens
gaauuaaggaagugacuca

SEQ ID NO: 388481 - RNA, 15 nt, Homo sapiens
gaauuaugucugcug

SEQ ID NO: 388482 - RNA, 18 nt, Homo sapiens
gaauucuaacaagucaua

SEQ ID NO: 388483 - RNA, 22 nt, Homo sapiens
gaauucugcuaccucacugggg

SEQ ID NO: 388484 - RNA, 17 nt, Homo sapiens
gaauuuauucaauuccu

SEQ ID NO: 388485 - RNA, 18 nt, Homo sapiens
gaauuucaguaaacaaug

SEQ ID NO: 388486 - RNA, 19 nt, Homo sapiens
gaauuuucucuaacuucaa

SEQ ID NO: 388487 - RNA, 20 nt, Homo sapiens
gaauuuucucuaacuucaag

SEQ ID NO: 388488 - RNA, 22 nt, Homo sapiens
gacaaaccagaagcaacagaaa

SEQ ID NO: 388489 - RNA, 13 nt, Homo sapiens
gacaaaugcugcg

SEQ ID NO: 388490 - RNA, 19 nt, Homo sapiens
gacaaucaugaaauaugca

SEQ ID NO: 388491 - RNA, 21 nt, Homo sapiens
gacacaacuauuuuuccaaaa

SEQ ID NO: 388492 - RNA, 22 nt, Homo sapiens
gacacagcuuuaucaccagaga

SEQ ID NO: 388493 - RNA, 19 nt, Homo sapiens
gacacaugugccgggccau

SEQ ID NO: 388494 - RNA, 21 nt, Homo sapiens
gacacuauuuaucugugcaaa

SEQ ID NO: 388495 - RNA, 21 nt, Homo sapiens
gacagaaagcagaacagugau

SEQ ID NO: 388496 - RNA, 23 nt, Homo sapiens
gacagaauaaugaauggacucaa

SEQ ID NO: 388497 - RNA, 19 nt, Homo sapiens
gacagagcagaacuuucac

SEQ ID NO: 388498 - RNA, 20 nt, Homo sapiens
gacagagccagacugucuca

SEQ ID NO: 388499 - RNA, 19 nt, Homo sapiens
gacagaggaugagcucuac

SEQ ID NO: 388500 - RNA, 23 nt, Homo sapiens
gacaggcacagaugaaugggagu

SEQ ID NO: 388501 - RNA, 13 nt, Homo sapiens
gacaggcucuuag

SEQ ID NO: 388502 - RNA, 13 nt, Homo sapiens
gacaggugccagg

SEQ ID NO: 388503 - RNA, 15 nt, Homo sapiens
gacaucaacagauaa

SEQ ID NO: 388504 - RNA, 20 nt, Homo sapiens
gacauccugagcagugccag

SEQ ID NO: 388505 - RNA, 13 nt, Homo sapiens
gacaugugacauu

SEQ ID NO: 388506 - RNA, 15 nt, Homo sapiens
gacaugugacauuua

SEQ ID NO: 388507 - RNA, 16 nt, Homo sapiens
gacauguggggccagg

SEQ ID NO: 388508 - RNA, 20 nt, Homo sapiens
gacauucuggaaaagcaaaa

SEQ ID NO: 388509 - RNA, 22 nt, Homo sapiens
gaccaagcaggaagcucagacu

SEQ ID NO: 388510 - RNA, 17 nt, Homo sapiens
gaccagaagcauuucac

SEQ ID NO: 388511 - RNA, 23 nt, Homo sapiens
gaccaguggucucacauggugcu

SEQ ID NO: 388512 - RNA, 15 nt, Homo sapiens
gacccaaaaggcaga

SEQ ID NO: 388513 - RNA, 20 nt, Homo sapiens
gacccaucacgccugugcag

SEQ ID NO: 388514 - RNA, 21 nt, Homo sapiens
gaccuccugagcgaugacuca

SEQ ID NO: 388515 - RNA, 17 nt, Homo sapiens
gaccuuuuauccacuua

SEQ ID NO: 388516 - RNA, 19 nt, Homo sapiens
gacuacuauacaaacuaca

SEQ ID NO: 388517 - RNA, 13 nt, Homo sapiens
gacucaaacugcc

SEQ ID NO: 388518 - RNA, 21 nt, Homo sapiens
gacucagggccccagcacuaa

SEQ ID NO: 388519 - RNA, 18 nt, Homo sapiens
gacucauacaccagguca

SEQ ID NO: 388520 - RNA, 23 nt, Homo sapiens
gacuccaaagaaauguaagggaa

SEQ ID NO: 388521 - RNA, 13 nt, Homo sapiens
gacuccugugcaa

SEQ ID NO: 388522 - RNA, 17 nt, Homo sapiens
gacuccugugcaacuuu

SEQ ID NO: 388523 - RNA, 15 nt, Homo sapiens
gacucucaaaucuuu

SEQ ID NO: 388524 - RNA, 10 nt, Homo sapiens
gacucuggaa

SEQ ID NO: 388525 - RNA, 16 nt, Homo sapiens
gacugagcagacuggu

SEQ ID NO: 388526 - RNA, 14 nt, Homo sapiens
gacugcugagucaa

SEQ ID NO: 388527 - RNA, 14 nt, Homo sapiens
gacuguaaaaccac

SEQ ID NO: 388528 - RNA, 17 nt, Homo sapiens
gacuguggcacacgccu

SEQ ID NO: 388529 - RNA, 19 nt, Homo sapiens
gacuuccauuugcuuuguc

SEQ ID NO: 388530 - RNA, 21 nt, Homo sapiens
gacuugaacuagauugcaugc

SEQ ID NO: 388531 - RNA, 15 nt, Homo sapiens
gacuuugaagaccag

SEQ ID NO: 388532 - RNA, 12 nt, Homo sapiens
gagaaaacaugc

SEQ ID NO: 388533 - RNA, 23 nt, Homo sapiens
gagaaaccagggagccccuuuga

SEQ ID NO: 388534 - RNA, 16 nt, Homo sapiens
gagaacaaugugcuau

SEQ ID NO: 388535 - RNA, 14 nt, Homo sapiens
gagaagcagugagc

SEQ ID NO: 388536 - RNA, 19 nt, Homo sapiens
gagaaggaaggagacucac

SEQ ID NO: 388537 - RNA, 21 nt, Homo sapiens
gagacaaaaucuuaaaugcca

SEQ ID NO: 388538 - RNA, 21 nt, Homo sapiens
gagacacaacuauuuuuccaa

SEQ ID NO: 388539 - RNA, 14 nt, Homo sapiens
gagacacaucuccu

SEQ ID NO: 388540 - RNA, 14 nt, Homo sapiens
gagacagauaacuc

SEQ ID NO: 388541 - RNA, 16 nt, Homo sapiens
gagacuccgucucaag

SEQ ID NO: 388542 - RNA, 16 nt, Homo sapiens
gagacucugucucagu

SEQ ID NO: 388543 - RNA, 15 nt, Homo sapiens
gagacugcugaguca

SEQ ID NO: 388544 - RNA, 21 nt, Homo sapiens
gagacugucucaagagggcac

SEQ ID NO: 388545 - RNA, 20 nt, Homo sapiens
gagagaaucccuagucuuca

SEQ ID NO: 388546 - RNA, 22 nt, Homo sapiens
gagagcagcuuuaaacucaggg

SEQ ID NO: 388547 - RNA, 16 nt, Homo sapiens
gagagcgccugccccu

SEQ ID NO: 388548 - RNA, 12 nt, Homo sapiens
gagagggggcca

SEQ ID NO: 388549 - RNA, 19 nt, Homo sapiens
gagagugucuucacggcag

SEQ ID NO: 388550 - RNA, 19 nt, Homo sapiens
gagaucuaaggaugucaca

SEQ ID NO: 388551 - RNA, 20 nt, Homo sapiens
gagaugcuggagaagagagg

SEQ ID NO: 388552 - RNA, 14 nt, Homo sapiens
gagaugugcaacac

SEQ ID NO: 388553 - RNA, 18 nt, Homo sapiens
gagcaaauguggcuccug

SEQ ID NO: 388554 - RNA, 22 nt, Homo sapiens
gagcacuguccaguauucuacc

SEQ ID NO: 388555 - RNA, 21 nt, Homo sapiens
gagcagcuuuaaacucaggga

SEQ ID NO: 388556 - RNA, 22 nt, Homo sapiens
gcuucacugguugaguguugcu

SEQ ID NO: 388557 - RNA, 12 nt, Homo sapiens
gcuuccuaacug

SEQ ID NO: 388558 - RNA, 15 nt, Homo sapiens
gcuucuccaugagac

SEQ ID NO: 388559 - RNA, 21 nt, Homo sapiens
gcuugcccuguuaaaagauga

SEQ ID NO: 388560 - RNA, 16 nt, Homo sapiens
gcuugggcuuccauuu

SEQ ID NO: 388561 - RNA, 22 nt, Homo sapiens
gcuuuaaacucagggacagagc

SEQ ID NO: 388562 - RNA, 19 nt, Homo sapiens
gcuuuaagcgcaacauuuc

SEQ ID NO: 388563 - RNA, 13 nt, Homo sapiens
gcuuuagggcaau

SEQ ID NO: 388564 - RNA, 21 nt, Homo sapiens
gcuuucauguaaacugugcac

SEQ ID NO: 388565 - RNA, 15 nt, Homo sapiens
gcuuugcagugacag

SEQ ID NO: 388566 - RNA, 19 nt, Homo sapiens
ggaaaaaccaauagcuuua

SEQ ID NO: 388567 - RNA, 21 nt, Homo sapiens
ggaaaaaucuuggauuaugaa

SEQ ID NO: 388568 - RNA, 22 nt, Homo sapiens
ggaaaaguguaauagcauacau

SEQ ID NO: 388569 - RNA, 15 nt, Homo sapiens
ggaaaaugucuuaaa

SEQ ID NO: 388570 - RNA, 16 nt, Homo sapiens
ggaaagaaaugcccau

SEQ ID NO: 388571 - RNA, 11 nt, Homo sapiens
ggaaaucacac

SEQ ID NO: 388572 - RNA, 16 nt, Homo sapiens
ggaacaagccuaaaaa

SEQ ID NO: 388573 - RNA, 12 nt, Homo sapiens
ggaacaaucuaa

SEQ ID NO: 388574 - RNA, 23 nt, Homo sapiens
ggaagaccagcuuugcagugaca

SEQ ID NO: 388575 - RNA, 23 nt, Homo sapiens
ggaagcgagcuuugcugggagag

SEQ ID NO: 388576 - RNA, 21 nt, Homo sapiens
ggaagcuuccaguccaaucuc

SEQ ID NO: 388577 - RNA, 22 nt, Homo sapiens
ggaauaaauugcuccuugacau

SEQ ID NO: 388578 - RNA, 14 nt, Homo sapiens
ggacaaagccuuug

SEQ ID NO: 388579 - RNA, 17 nt, Homo sapiens
ggacagaugaaugccgu

SEQ ID NO: 388580 - RNA, 20 nt, Homo sapiens
ggacagaugaaugccgugga

SEQ ID NO: 388581 - RNA, 18 nt, Homo sapiens
ggacaggauaagagggau

SEQ ID NO: 388582 - RNA, 18 nt, Homo sapiens
ggacauuuggcugugaug

SEQ ID NO: 388583 - RNA, 17 nt, Homo sapiens
ggaccauucauacccac

SEQ ID NO: 388584 - RNA, 21 nt, Homo sapiens
ggacuauggcucuacuuucag

SEQ ID NO: 388585 - RNA, 22 nt, Homo sapiens
ggacuauuauaauuuaaugcau

SEQ ID NO: 388586 - RNA, 14 nt, Homo sapiens
ggacucaaacugcc

SEQ ID NO: 388587 - RNA, 15 nt, Homo sapiens
ggacuuccauuugcu

SEQ ID NO: 388588 - RNA, 18 nt, Homo sapiens
ggagaaacccuugaaaag

SEQ ID NO: 388589 - RNA, 21 nt, Homo sapiens
ggagaaacuguagucucagga

SEQ ID NO: 388590 - RNA, 21 nt, Homo sapiens
ggagacagagcugguugggaa

SEQ ID NO: 388591 - RNA, 13 nt, Homo sapiens
ggagacugcugag

SEQ ID NO: 388592 - RNA, 20 nt, Homo sapiens
ggagagcuggggaagcuucu

SEQ ID NO: 388593 - RNA, 14 nt, Homo sapiens
ggagagugcaacag

SEQ ID NO: 388594 - RNA, 21 nt, Homo sapiens
ggagcaggagccugagccuug

SEQ ID NO: 388595 - RNA, 18 nt, Homo sapiens
ggagcugcucucucauga

SEQ ID NO: 388596 - RNA, 19 nt, Homo sapiens
ggaggccagccagugaccu

SEQ ID NO: 388597 - RNA, 18 nt, Homo sapiens
ggaggcugucuucucagg

SEQ ID NO: 388598 - RNA, 12 nt, Homo sapiens
ggauaugcagua

SEQ ID NO: 388599 - RNA, 13 nt, Homo sapiens
ggaucugggcaaa

SEQ ID NO: 388600 - RNA, 21 nt, Homo sapiens
ggauguuuuuucccuguuuaa

SEQ ID NO: 388601 - RNA, 17 nt, Homo sapiens
ggauuaaccucugcacu

SEQ ID NO: 388602 - RNA, 21 nt, Homo sapiens
ggauuaugaagugacucucac

SEQ ID NO: 388603 - RNA, 14 nt, Homo sapiens
ggauuauucauuua

SEQ ID NO: 388604 - RNA, 19 nt, Homo sapiens
ggauugcuaaucaccaaag

SEQ ID NO: 388605 - RNA, 18 nt, Homo sapiens
ggauuuaacagucauuua

SEQ ID NO: 388606 - RNA, 20 nt, Homo sapiens
ggcaacacagcgagacuccg

SEQ ID NO: 388607 - RNA, 22 nt, Homo sapiens
ggcaaggacggccuucaacuga

SEQ ID NO: 388608 - RNA, 19 nt, Homo sapiens
ggcacagggucugcucuuu

SEQ ID NO: 388609 - RNA, 20 nt, Homo sapiens
ggcacagggucugcucuuuc

SEQ ID NO: 388610 - RNA, 9 nt, Homo sapiens
ggcacauug

SEQ ID NO: 388611 - RNA, 22 nt, Homo sapiens
ggcagaagaauugaacccagga

SEQ ID NO: 388612 - RNA, 16 nt, Homo sapiens
ggcagcauuuagcaca

SEQ ID NO: 388613 - RNA, 16 nt, Homo sapiens
ggcaggaacuugcaca

SEQ ID NO: 388614 - RNA, 22 nt, Homo sapiens
ggcaggaguauaugagcauccu

SEQ ID NO: 388615 - RNA, 17 nt, Homo sapiens
ggcauauccaccaccuc

SEQ ID NO: 388616 - RNA, 19 nt, Homo sapiens
ggcaugccaaauguuccau

SEQ ID NO: 388617 - RNA, 14 nt, Homo sapiens
ggcaugguggccca

SEQ ID NO: 388618 - RNA, 15 nt, Homo sapiens
ggccaaccuccccaa

SEQ ID NO: 388619 - RNA, 15 nt, Homo sapiens
ggccagaagaucuac

SEQ ID NO: 388620 - RNA, 23 nt, Homo sapiens
ggccaguauuuuuauuucuuuaa

SEQ ID NO: 388621 - RNA, 17 nt, Homo sapiens
ggcccacuucaccguac

SEQ ID NO: 388622 - RNA, 22 nt, Homo sapiens
ggcccgugggagucaucucaac

SEQ ID NO: 388623 - RNA, 21 nt, Homo sapiens
ggcccuucuugccuacuaugc

SEQ ID NO: 388624 - RNA, 20 nt, Homo sapiens
ggccucaagggaugucucac

SEQ ID NO: 388625 - RNA, 23 nt, Homo sapiens
ggccucucuacaagcagcaggaa

SEQ ID NO: 388626 - RNA, 20 nt, Homo sapiens
ggccucuggcucucaugggg

SEQ ID NO: 388627 - RNA, 22 nt, Homo sapiens
ggccucuuccuugcugugucau

SEQ ID NO: 388628 - RNA, 17 nt, Homo sapiens
ggccuggucguuuucaa

SEQ ID NO: 388629 - RNA, 14 nt, Homo sapiens
ggccuuaaccauga

SEQ ID NO: 388630 - RNA, 11 nt, Homo sapiens
ggccuucucac

SEQ ID NO: 388631 - RNA, 15 nt, Homo sapiens
ggcuaaaaccaucau

SEQ ID NO: 388632 - RNA, 19 nt, Homo sapiens
ggcuaagcaaaaugugaua

SEQ ID NO: 388633 - RNA, 21 nt, Homo sapiens
ggcuccuuggauguagucagu

SEQ ID NO: 388634 - RNA, 21 nt, Homo sapiens
ggcucugcaaugggcacuggg

SEQ ID NO: 388635 - RNA, 19 nt, Homo sapiens
ggcucuucuaaucagagcg

SEQ ID NO: 388636 - RNA, 23 nt, Homo sapiens
ggcugacacguccaccccagugc

SEQ ID NO: 388637 - RNA, 21 nt, Homo sapiens
ggcugauuauuaaaguccuuu

SEQ ID NO: 388638 - RNA, 19 nt, Homo sapiens
ggcugcccacacaccccaa

SEQ ID NO: 388639 - RNA, 14 nt, Homo sapiens
ggcuggagugcagu

SEQ ID NO: 388640 - RNA, 19 nt, Homo sapiens
ggcuggaguggaguggcgu

SEQ ID NO: 388641 - RNA, 18 nt, Homo sapiens
ggcuguauuuaauggcau

SEQ ID NO: 388642 - RNA, 13 nt, Homo sapiens
ggcuucuccugac

SEQ ID NO: 388643 - RNA, 22 nt, Homo sapiens
gggaaaagcccaugaucuucaa

SEQ ID NO: 388644 - RNA, 15 nt, Homo sapiens
gggaaaucaggguua

SEQ ID NO: 388645 - RNA, 13 nt, Homo sapiens
gggaagaccagcu

SEQ ID NO: 388646 - RNA, 17 nt, Homo sapiens
gggacaauaaauuuugc

SEQ ID NO: 388647 - RNA, 15 nt, Homo sapiens
gggacaggugccagg

SEQ ID NO: 388648 - RNA, 21 nt, Homo sapiens
gggacaucaaaaacagcagaa

SEQ ID NO: 388649 - RNA, 21 nt, Homo sapiens
gggaccacagacucacauccu

SEQ ID NO: 388650 - RNA, 16 nt, Homo sapiens
gggacugagagacagg

SEQ ID NO: 388651 - RNA, 11 nt, Homo sapiens
gggacugcugc

SEQ ID NO: 388652 - RNA, 15 nt, Homo sapiens
gggagacaugugaca

SEQ ID NO: 388653 - RNA, 16 nt, Homo sapiens
gggauuggcugugagg

SEQ ID NO: 388654 - RNA, 13 nt, Homo sapiens
gggcagcacagag

SEQ ID NO: 388655 - RNA, 18 nt, Homo sapiens
gggccaggugcacagacg

SEQ ID NO: 388656 - RNA, 15 nt, Homo sapiens
gggcgacagagccag

SEQ ID NO: 388657 - RNA, 16 nt, Homo sapiens
gggcuagugacuugug

SEQ ID NO: 388658 - RNA, 14 nt, Homo sapiens
gggcucaagcugca

SEQ ID NO: 388659 - RNA, 15 nt, Homo sapiens
gggcuccauguagaa

SEQ ID NO: 388660 - RNA, 14 nt, Homo sapiens
gggcucgugcccug

SEQ ID NO: 388661 - RNA, 22 nt, Homo sapiens
ggggaaauaauaaagaugcucu

SEQ ID NO: 388662 - RNA, 14 nt, Homo sapiens
ggggcaggcaguga

SEQ ID NO: 388663 - RNA, 21 nt, Homo sapiens
ggggcugacuucaauccaugu

SEQ ID NO: 388664 - RNA, 22 nt, Homo sapiens
ggggcuggccucuggcucucau

SEQ ID NO: 388665 - RNA, 20 nt, Homo sapiens
ggggucccauagaggugagg

SEQ ID NO: 388666 - RNA, 18 nt, Homo sapiens
gggguggugggaaccaug

SEQ ID NO: 388667 - RNA, 19 nt, Homo sapiens
ggguaaccaaauguuggcc

SEQ ID NO: 388668 - RNA, 13 nt, Homo sapiens
gggucaacaucuu

SEQ ID NO: 388669 - RNA, 19 nt, Homo sapiens
gggugacagagcaagugag

SEQ ID NO: 388670 - RNA, 20 nt, Homo sapiens
ggguucaccaggucagggag

SEQ ID NO: 388671 - RNA, 20 nt, Homo sapiens
ggguuucaccaucuuggcca

SEQ ID NO: 388672 - RNA, 16 nt, Homo sapiens
gguacuacaaccaauu

SEQ ID NO: 388673 - RNA, 20 nt, Homo sapiens
gguauguuuuaccaucugca

SEQ ID NO: 388674 - RNA, 20 nt, Homo sapiens
ggucaauuuuguuauguaua

SEQ ID NO: 388675 - RNA, 15 nt, Homo sapiens
gguccuucccucucc

SEQ ID NO: 388676 - RNA, 15 nt, Homo sapiens
ggucguccaagcaaa

SEQ ID NO: 388677 - RNA, 20 nt, Homo sapiens
ggucucgcuuuguugcccag

SEQ ID NO: 388678 - RNA, 16 nt, Homo sapiens
ggucugcucuuucucu

SEQ ID NO: 388679 - RNA, 18 nt, Homo sapiens
ggugaccaguugcacuug

SEQ ID NO: 388680 - RNA, 18 nt, Homo sapiens
ggugacguagaauugagu

SEQ ID NO: 388681 - RNA, 23 nt, Homo sapiens
ggugcuacacccuuuuccagcug

SEQ ID NO: 388682 - RNA, 15 nt, Homo sapiens
gguggcgcgcaccug

SEQ ID NO: 388683 - RNA, 21 nt, Homo sapiens
gguguccuuucccuccacucc

SEQ ID NO: 388684 - RNA, 19 nt, Homo sapiens
gguuaccuuuguucccaaa

SEQ ID NO: 388685 - RNA, 22 nt, Homo sapiens
gguucacagaagcacagcaccc

SEQ ID NO: 388686 - RNA, 15 nt, Homo sapiens
gguuccggaauccug

SEQ ID NO: 388687 - RNA, 17 nt, Homo sapiens
gguugaccccuggucuc

SEQ ID NO: 388688 - RNA, 14 nt, Homo sapiens
gguuuaggucaaga

SEQ ID NO: 388689 - RNA, 12 nt, Homo sapiens
gguuucauucug

SEQ ID NO: 388690 - RNA, 14 nt, Homo sapiens
gguuucucuguaua

SEQ ID NO: 388691 - RNA, 21 nt, Homo sapiens
gguuucuggcagccaguaccu

SEQ ID NO: 388692 - RNA, 19 nt, Homo sapiens
gguuuguguuugaguuuua

SEQ ID NO: 388693 - RNA, 16 nt, Homo sapiens
gguuuuaacaauuucc

SEQ ID NO: 388694 - RNA, 15 nt, Homo sapiens
gguuuuacugcagcu

SEQ ID NO: 388695 - RNA, 13 nt, Homo sapiens
guaaacauaauuc

SEQ ID NO: 388696 - RNA, 13 nt, Homo sapiens
guaaacugugcac

SEQ ID NO: 388697 - RNA, 22 nt, Homo sapiens
cagaaaaaaauaaauguucuaa

SEQ ID NO: 388698 - RNA, 17 nt, Homo sapiens
cagaaaaacugugggua

SEQ ID NO: 388699 - RNA, 18 nt, Homo sapiens
cagaaagcagaacaguga

SEQ ID NO: 388700 - RNA, 13 nt, Homo sapiens
cagaaauacauau

SEQ ID NO: 388701 - RNA, 19 nt, Homo sapiens
cagaacacacuccaucagc

SEQ ID NO: 388702 - RNA, 17 nt, Homo sapiens
cagaacuggaccaucuc

SEQ ID NO: 388703 - RNA, 22 nt, Homo sapiens
cagaagauaacuugagcaccgu

SEQ ID NO: 388704 - RNA, 11 nt, Homo sapiens
cagaagaucug

SEQ ID NO: 388705 - RNA, 16 nt, Homo sapiens
cagaaguuugagauca

SEQ ID NO: 388706 - RNA, 17 nt, Homo sapiens
cagaaucaaaugcaauu

SEQ ID NO: 388707 - RNA, 15 nt, Homo sapiens
cagaaucagaucuga

SEQ ID NO: 388708 - RNA, 19 nt, Homo sapiens
cagaaucuguuaccagagg

SEQ ID NO: 388709 - RNA, 12 nt, Homo sapiens
cagaauggagcu

SEQ ID NO: 388710 - RNA, 21 nt, Homo sapiens
cagacaaaguaauuccucuca

SEQ ID NO: 388711 - RNA, 14 nt, Homo sapiens
cagacauucugcca

SEQ ID NO: 388712 - RNA, 20 nt, Homo sapiens
cagaccacugauaaaaccau

SEQ ID NO: 388713 - RNA, 18 nt, Homo sapiens
cagaccuuuuauccacuu

SEQ ID NO: 388714 - RNA, 20 nt, Homo sapiens
cagacgcacgugggucuuca

SEQ ID NO: 388715 - RNA, 21 nt, Homo sapiens
cagacuacuucuuccccagau

SEQ ID NO: 388716 - RNA, 16 nt, Homo sapiens
cagacugacaaaugug

SEQ ID NO: 388717 - RNA, 11 nt, Homo sapiens
cagacugucuc

SEQ ID NO: 388718 - RNA, 15 nt, Homo sapiens
cagacuguguauuca

SEQ ID NO: 388719 - RNA, 23 nt, Homo sapiens
cagacuguguauucauugaaguc

SEQ ID NO: 388720 - RNA, 21 nt, Homo sapiens
cagagaaguucuggcugaaca

SEQ ID NO: 388721 - RNA, 21 nt, Homo sapiens
cagagacccucugccaccaga

SEQ ID NO: 388722 - RNA, 15 nt, Homo sapiens
cagagaccguccuca

SEQ ID NO: 388723 - RNA, 17 nt, Homo sapiens
cagagacggaagccuuu

SEQ ID NO: 388724 - RNA, 19 nt, Homo sapiens
cagagagcggucucaggcu

SEQ ID NO: 388725 - RNA, 15 nt, Homo sapiens
cagagaggagucaga

SEQ ID NO: 388726 - RNA, 18 nt, Homo sapiens
cagagcaggaagcauuca

SEQ ID NO: 388727 - RNA, 23 nt, Homo sapiens
cagagcaggaagcauucagagag

SEQ ID NO: 388728 - RNA, 18 nt, Homo sapiens
cagagcccagcucaugca

SEQ ID NO: 388729 - RNA, 22 nt, Homo sapiens
cagagcugccucucgguggcca

SEQ ID NO: 388730 - RNA, 16 nt, Homo sapiens
cagagcuucuuccagg

SEQ ID NO: 388731 - RNA, 19 nt, Homo sapiens
cagaggaacuguccagaga

SEQ ID NO: 388732 - RNA, 16 nt, Homo sapiens
cagaggagccaugucc

SEQ ID NO: 388733 - RNA, 20 nt, Homo sapiens
cagagguugcagugagccga

SEQ ID NO: 388734 - RNA, 23 nt, Homo sapiens
cagagguuucuggcagccaguac

SEQ ID NO: 388735 - RNA, 23 nt, Homo sapiens
cagagugagacccagcccucauc

SEQ ID NO: 388736 - RNA, 13 nt, Homo sapiens
cagaguugugcac

SEQ ID NO: 388737 - RNA, 11 nt, Homo sapiens
cagauagucaa

SEQ ID NO: 388738 - RNA, 20 nt, Homo sapiens
cagaucccacuugcagccuc

SEQ ID NO: 388739 - RNA, 15 nt, Homo sapiens
cagauccccagccuc

SEQ ID NO: 388740 - RNA, 22 nt, Homo sapiens
cagaugguuuuauaaucugauu

SEQ ID NO: 388741 - RNA, 20 nt, Homo sapiens
cagauguccuugaugcucau

SEQ ID NO: 388742 - RNA, 20 nt, Homo sapiens
cagcaaugacaucucagggg

SEQ ID NO: 388743 - RNA, 21 nt, Homo sapiens
cagcaaugacaucucaggggc

SEQ ID NO: 388744 - RNA, 17 nt, Homo sapiens
cagcagaacuucugaaa

SEQ ID NO: 388745 - RNA, 21 nt, Homo sapiens
cagucauaacuaaauaaagcu

SEQ ID NO: 388746 - RNA, 21 nt, Homo sapiens
cagucauggcaccaaagccac

SEQ ID NO: 388747 - RNA, 19 nt, Homo sapiens
caguccugccucagccucc

SEQ ID NO: 388748 - RNA, 20 nt, Homo sapiens
cagucugacccuuacagccu

SEQ ID NO: 388749 - RNA, 22 nt, Homo sapiens
cagucuuccauuugcaagggaa

SEQ ID NO: 388750 - RNA, 14 nt, Homo sapiens
cagugaaagccaga

SEQ ID NO: 388751 - RNA, 21 nt, Homo sapiens
cagugaaugauucaguguuaa

SEQ ID NO: 388752 - RNA, 23 nt, Homo sapiens
cagugacagaacuaagaugauca

SEQ ID NO: 388753 - RNA, 22 nt, Homo sapiens
cagugagccgcaucuucuccau

SEQ ID NO: 388754 - RNA, 13 nt, Homo sapiens
caguggaagggaa

SEQ ID NO: 388755 - RNA, 12 nt, Homo sapiens
caguguguuucu

SEQ ID NO: 388756 - RNA, 18 nt, Homo sapiens
caguguuccccaucuggg

SEQ ID NO: 388757 - RNA, 16 nt, Homo sapiens
caguuacuccaguaua

SEQ ID NO: 388758 - RNA, 21 nt, Homo sapiens
caguuugauuguuguuuauaa

SEQ ID NO: 388759 - RNA, 14 nt, Homo sapiens
cauaaaauguuaag

SEQ ID NO: 388760 - RNA, 13 nt, Homo sapiens
cauaacaauuccu

SEQ ID NO: 388761 - RNA, 22 nt, Homo sapiens
cauaauguauuuaaccagucuu

SEQ ID NO: 388762 - RNA, 18 nt, Homo sapiens
cauaauguuacauuauua

SEQ ID NO: 388763 - RNA, 16 nt, Homo sapiens
cauaauuacuauguca

SEQ ID NO: 388764 - RNA, 18 nt, Homo sapiens
cauaauuucuucacucaa

SEQ ID NO: 388765 - RNA, 22 nt, Homo sapiens
cauaauuuguacauauguaaaa

SEQ ID NO: 388766 - RNA, 22 nt, Homo sapiens
cauacaagaggcucccucuuga

SEQ ID NO: 388767 - RNA, 13 nt, Homo sapiens
cauacauguuaca

SEQ ID NO: 388768 - RNA, 21 nt, Homo sapiens
cauagagaucauccuuuccag

SEQ ID NO: 388769 - RNA, 22 nt, Homo sapiens
cauagaggugagggaagccuga

SEQ ID NO: 388770 - RNA, 17 nt, Homo sapiens
cauagaguucagacuuu

SEQ ID NO: 388771 - RNA, 14 nt, Homo sapiens
cauagcagcagugc

SEQ ID NO: 388772 - RNA, 19 nt, Homo sapiens
cauagcagcagugcauggg

SEQ ID NO: 388773 - RNA, 23 nt, Homo sapiens
cauaguacagguaaggugaggga

SEQ ID NO: 388774 - RNA, 18 nt, Homo sapiens
cauauaacgucaugugca

SEQ ID NO: 388775 - RNA, 13 nt, Homo sapiens
cauauaauguugu

SEQ ID NO: 388776 - RNA, 23 nt, Homo sapiens
cauauauuugaaguggagccaua

SEQ ID NO: 388777 - RNA, 22 nt, Homo sapiens
cauaugagcuuccuucugugaa

SEQ ID NO: 388778 - RNA, 23 nt, Homo sapiens
cauauucuuauguaugugaaagu

SEQ ID NO: 388779 - RNA, 19 nt, Homo sapiens
cauauucuuuaaauuucau

SEQ ID NO: 388780 - RNA, 14 nt, Homo sapiens
caucacugaaaugc

SEQ ID NO: 388781 - RNA, 23 nt, Homo sapiens
caucacugaaaugcuagcugcaa

SEQ ID NO: 388782 - RNA, 18 nt, Homo sapiens
caucagacuccugugcaa

SEQ ID NO: 388783 - RNA, 20 nt, Homo sapiens
caucagcugcugaaacaaca

SEQ ID NO: 388784 - RNA, 18 nt, Homo sapiens
caucagggacaggaugac

SEQ ID NO: 388785 - RNA, 17 nt, Homo sapiens
caucaucuccugccuuc

SEQ ID NO: 388786 - RNA, 22 nt, Homo sapiens
cauccaaucuaaccacaucaau

SEQ ID NO: 388787 - RNA, 16 nt, Homo sapiens
cauccacuagugcaaa

SEQ ID NO: 388788 - RNA, 17 nt, Homo sapiens
caucccaggacaccaca

SEQ ID NO: 388789 - RNA, 14 nt, Homo sapiens
caucccauguauuu

SEQ ID NO: 388790 - RNA, 23 nt, Homo sapiens
caucgguucauauuaagacauaa

SEQ ID NO: 388791 - RNA, 22 nt, Homo sapiens
caucuaaccucaucuucuucac

SEQ ID NO: 388792 - RNA, 21 nt, Homo sapiens
caucucagaaaacucugguaa

SEQ ID NO: 388793 - RNA, 12 nt, Homo sapiens
caucucagccua

SEQ ID NO: 388794 - RNA, 12 nt, Homo sapiens
caucucuacuaa

SEQ ID NO: 388795 - RNA, 23 nt, Homo sapiens
caucucucccuccccugccauuu

SEQ ID NO: 388796 - RNA, 17 nt, Homo sapiens
caucucugaacauuucu

SEQ ID NO: 388797 - RNA, 17 nt, Homo sapiens
caucugugggcacgcug

SEQ ID NO: 388798 - RNA, 17 nt, Homo sapiens
caucuuaguauuugcau

SEQ ID NO: 388799 - RNA, 13 nt, Homo sapiens
uugaaugacaaag

SEQ ID NO: 388800 - RNA, 13 nt, Homo sapiens
uugacaggauuau

SEQ ID NO: 388801 - RNA, 19 nt, Homo sapiens
uugacaguucauauguacc

SEQ ID NO: 388802 - RNA, 18 nt, Homo sapiens
uugacauaauuucacuga

SEQ ID NO: 388803 - RNA, 14 nt, Homo sapiens
uugacaucagcauu

SEQ ID NO: 388804 - RNA, 11 nt, Homo sapiens
uugaccacaga

SEQ ID NO: 388805 - RNA, 20 nt, Homo sapiens
uugacguggcacuuacccac

SEQ ID NO: 388806 - RNA, 21 nt, Homo sapiens
uugacucuuguuuucaguuuc

SEQ ID NO: 388807 - RNA, 17 nt, Homo sapiens
uugagacaggaugguua

SEQ ID NO: 388808 - RNA, 18 nt, Homo sapiens
uugagaguugcuggugua

SEQ ID NO: 388809 - RNA, 17 nt, Homo sapiens
uugagccuuaaaaccca

SEQ ID NO: 388810 - RNA, 20 nt, Homo sapiens
uugagcucaggaguuugaga

SEQ ID NO: 388811 - RNA, 21 nt, Homo sapiens
uugagguuuccuucagacaga

SEQ ID NO: 388812 - RNA, 12 nt, Homo sapiens
uugauggugaua

SEQ ID NO: 388813 - RNA, 14 nt, Homo sapiens
uugauggugaugaa

SEQ ID NO: 388814 - RNA, 17 nt, Homo sapiens
uugauucacaaugaaau

SEQ ID NO: 388815 - RNA, 16 nt, Homo sapiens
uugcaaauacauggau

SEQ ID NO: 388816 - RNA, 22 nt, Homo sapiens
uugcaaccucgcuggacucuca

SEQ ID NO: 388817 - RNA, 13 nt, Homo sapiens
uugcaaggcauuu

SEQ ID NO: 388818 - RNA, 18 nt, Homo sapiens
uugcaggaccucagguga

SEQ ID NO: 388819 - RNA, 20 nt, Homo sapiens
uugcauaguaccaaucauuu

SEQ ID NO: 388820 - RNA, 14 nt, Homo sapiens
uugccaaacagcca

SEQ ID NO: 388821 - RNA, 20 nt, Homo sapiens
uugccaaacagccacacugu

SEQ ID NO: 388822 - RNA, 15 nt, Homo sapiens
uugccauuacucaau

SEQ ID NO: 388823 - RNA, 21 nt, Homo sapiens
uugccucugaagccuauguau

SEQ ID NO: 388824 - RNA, 12 nt, Homo sapiens
uugcugccacau

SEQ ID NO: 388825 - RNA, 17 nt, Homo sapiens
uugcuggucacugccau

SEQ ID NO: 388826 - RNA, 20 nt, Homo sapiens
uugcuucuucccaauugcuu

SEQ ID NO: 388827 - RNA, 17 nt, Homo sapiens
uuggaaaauaaaucaau

SEQ ID NO: 388828 - RNA, 23 nt, Homo sapiens
uuggaauuaugucugcugaauaa

SEQ ID NO: 388829 - RNA, 16 nt, Homo sapiens
uuggaccauccuauuu

SEQ ID NO: 388830 - RNA, 15 nt, Homo sapiens
uuggagcuacugcaa

SEQ ID NO: 388831 - RNA, 21 nt, Homo sapiens
uuggauuaugaagugacucuc

SEQ ID NO: 388832 - RNA, 17 nt, Homo sapiens
uuggcagagcuucuucc

SEQ ID NO: 388833 - RNA, 12 nt, Homo sapiens
uuggcaugccuu

SEQ ID NO: 388834 - RNA, 22 nt, Homo sapiens
uuggcuguagaaggagacagag

SEQ ID NO: 388835 - RNA, 12 nt, Homo sapiens
uugggaagacca

SEQ ID NO: 388836 - RNA, 17 nt, Homo sapiens
uugggagacaugugaca

SEQ ID NO: 388837 - RNA, 20 nt, Homo sapiens
uugggauugagucugugcca

SEQ ID NO: 388838 - RNA, 20 nt, Homo sapiens
uugggggauggcuaaaacca

SEQ ID NO: 388839 - RNA, 14 nt, Homo sapiens
uuggguucacagaa

SEQ ID NO: 388840 - RNA, 22 nt, Homo sapiens
uuggguucacagaagcacagca

SEQ ID NO: 388841 - RNA, 16 nt, Homo sapiens
uugguaacauccuuuc

SEQ ID NO: 388842 - RNA, 14 nt, Homo sapiens
uugguaugugacau

SEQ ID NO: 388843 - RNA, 14 nt, Homo sapiens
uuguaaaauggugu

SEQ ID NO: 388844 - RNA, 13 nt, Homo sapiens
uuguaacuccacc

SEQ ID NO: 388845 - RNA, 16 nt, Homo sapiens
uuguaaugucaccacc

SEQ ID NO: 388846 - RNA, 18 nt, Homo sapiens
cccaaugcacacaaaaca

SEQ ID NO: 388847 - RNA, 14 nt, Homo sapiens
cccacugcucauuu

SEQ ID NO: 388848 - RNA, 11 nt, Homo sapiens
cccacuugaag

SEQ ID NO: 388849 - RNA, 15 nt, Homo sapiens
cccagaaggaccucc

SEQ ID NO: 388850 - RNA, 15 nt, Homo sapiens
cccagagcagggugu

SEQ ID NO: 388851 - RNA, 12 nt, Homo sapiens
cccagcacccag

SEQ ID NO: 388852 - RNA, 22 nt, Homo sapiens
cccagcucaugcacaucagcug

SEQ ID NO: 388853 - RNA, 15 nt, Homo sapiens
cccaggacccaucac

SEQ ID NO: 388854 - RNA, 18 nt, Homo sapiens
cccaggcuggagugcagu

SEQ ID NO: 388855 - RNA, 19 nt, Homo sapiens
cccaggcuggagugcagua

SEQ ID NO: 388856 - RNA, 17 nt, Homo sapiens
cccagggaagccaaaag

SEQ ID NO: 388857 - RNA, 16 nt, Homo sapiens
cccagggcacugaggg

SEQ ID NO: 388858 - RNA, 18 nt, Homo sapiens
cccaggucccuuguccca

SEQ ID NO: 388859 - RNA, 19 nt, Homo sapiens
cccaguaagccacugccac

SEQ ID NO: 388860 - RNA, 23 nt, Homo sapiens
cccaguauucuagguagugcccu

SEQ ID NO: 388861 - RNA, 21 nt, Homo sapiens
cccaguguguuucugaucuga

SEQ ID NO: 388862 - RNA, 22 nt, Homo sapiens
cccaucauucaugcuacugcca

SEQ ID NO: 388863 - RNA, 22 nt, Homo sapiens
cccaugaucuucaagcagggaa

SEQ ID NO: 388864 - RNA, 22 nt, Homo sapiens
cccaugcuuuguaggugucuca

SEQ ID NO: 388865 - RNA, 13 nt, Homo sapiens
cccauggccacuu

SEQ ID NO: 388866 - RNA, 17 nt, Homo sapiens
cccaugggaagggucca

SEQ ID NO: 388867 - RNA, 23 nt, Homo sapiens
cccauguauuuaucucuauuuaa

SEQ ID NO: 388868 - RNA, 17 nt, Homo sapiens
cccauuccuauuucuua

SEQ ID NO: 388869 - RNA, 22 nt, Homo sapiens
cccauugaaacaaaacauugau

SEQ ID NO: 388870 - RNA, 13 nt, Homo sapiens
ccccaaagucuua

SEQ ID NO: 388871 - RNA, 23 nt, Homo sapiens
ccccagacgcacgugggucuuca

SEQ ID NO: 388872 - RNA, 19 nt, Homo sapiens
ccccauagcagcagugcau

SEQ ID NO: 388873 - RNA, 20 nt, Homo sapiens
cccccaaauaagaagggaug

SEQ ID NO: 388874 - RNA, 21 nt, Homo sapiens
cccccgugaggaugucacuca

SEQ ID NO: 388875 - RNA, 14 nt, Homo sapiens
cccccuucagugcc

SEQ ID NO: 388876 - RNA, 12 nt, Homo sapiens
cccccuugaggg

SEQ ID NO: 388877 - RNA, 13 nt, Homo sapiens
ccccggaacaagc

SEQ ID NO: 388878 - RNA, 17 nt, Homo sapiens
ccccucccagaacacac

SEQ ID NO: 388879 - RNA, 16 nt, Homo sapiens
ccccuccccugcugca

SEQ ID NO: 388880 - RNA, 17 nt, Homo sapiens
ccccuggacugggaggu

SEQ ID NO: 388881 - RNA, 18 nt, Homo sapiens
ccccuugccagacaugug

SEQ ID NO: 388882 - RNA, 16 nt, Homo sapiens
cccgccuggaggagau

SEQ ID NO: 388883 - RNA, 15 nt, Homo sapiens
cccgcuggaccaaag

SEQ ID NO: 388884 - RNA, 18 nt, Homo sapiens
cccgugggagucaucuca

SEQ ID NO: 388885 - RNA, 23 nt, Homo sapiens
cccguuucauuuagucaugugac

SEQ ID NO: 388886 - RNA, 12 nt, Homo sapiens
cccuaugcugcc

SEQ ID NO: 388887 - RNA, 22 nt, Homo sapiens
cccuaugugggugggaccacag

SEQ ID NO: 388888 - RNA, 23 nt, Homo sapiens
cccuaugugggugggaccacaga

SEQ ID NO: 388889 - RNA, 19 nt, Homo sapiens
cccuauugguaaagaaugg

SEQ ID NO: 388890 - RNA, 15 nt, Homo sapiens
cccucacuguugaau

SEQ ID NO: 388891 - RNA, 15 nt, Homo sapiens
cccucaguuucccua

SEQ ID NO: 388892 - RNA, 13 nt, Homo sapiens
cccuccaauccca

SEQ ID NO: 388893 - RNA, 14 nt, Homo sapiens
cccuccacguucac

SEQ ID NO: 388894 - RNA, 14 nt, Homo sapiens
cccuccacugucac

SEQ ID NO: 388895 - RNA, 14 nt, Homo sapiens
cccuccaggaagau

SEQ ID NO: 388896 - RNA, 15 nt, Homo sapiens
cccuccccugccauu

SEQ ID NO: 388897 - RNA, 20 nt, Homo sapiens
cccuccuccagaccauucag

SEQ ID NO: 388898 - RNA, 13 nt, Homo sapiens
cccuccuucaucc

SEQ ID NO: 388899 - RNA, 15 nt, Homo sapiens
cccucuaagggaccu

SEQ ID NO: 388900 - RNA, 13 nt, Homo sapiens
cccugaagccagc

SEQ ID NO: 388901 - RNA, 21 nt, Homo sapiens
cccugacugggaguugaucgc

SEQ ID NO: 388902 - RNA, 18 nt, Homo sapiens
cccugagcuuucugcuau

SEQ ID NO: 388903 - RNA, 15 nt, Homo sapiens
cccugcacuccagcc

SEQ ID NO: 388904 - RNA, 15 nt, Homo sapiens
cccugccagcucuuc

SEQ ID NO: 388905 - RNA, 17 nt, Homo sapiens
cccuggaccaguggucu

SEQ ID NO: 388906 - RNA, 16 nt, Homo sapiens
cccugggauguccaca

SEQ ID NO: 388907 - RNA, 22 nt, Homo sapiens
cccuggggcuucuccugaccca

SEQ ID NO: 388908 - RNA, 20 nt, Homo sapiens
cccugggggcugugauauua

SEQ ID NO: 388909 - RNA, 17 nt, Homo sapiens
cccuguaccugugcacg

SEQ ID NO: 388910 - RNA, 14 nt, Homo sapiens
cccuguuaccuaau

SEQ ID NO: 388911 - RNA, 21 nt, Homo sapiens
cccuuacagccucugacuuaa

SEQ ID NO: 388912 - RNA, 22 nt, Homo sapiens
cccuucaaccauuccccauggg

SEQ ID NO: 388913 - RNA, 21 nt, Homo sapiens
cccuuccaugucgccucugca

SEQ ID NO: 388914 - RNA, 19 nt, Homo sapiens
cccuuccuacagauaguca

SEQ ID NO: 388915 - RNA, 18 nt, Homo sapiens
ccgaaaaggauaugcagu

SEQ ID NO: 388916 - RNA, 18 nt, Homo sapiens
ccgaacuuuaauuucagg

SEQ ID NO: 388917 - RNA, 20 nt, Homo sapiens
ccgagucucuucuccacugg

SEQ ID NO: 388918 - RNA, 11 nt, Homo sapiens
ccgagugcaau

SEQ ID NO: 388919 - RNA, 18 nt, Homo sapiens
ccggaugcuucuccauga

SEQ ID NO: 388920 - RNA, 20 nt, Homo sapiens
ccgggaagagggugauugcu

SEQ ID NO: 388921 - RNA, 20 nt, Homo sapiens
ccgggcugggagcucugcag

SEQ ID NO: 388922 - RNA, 17 nt, Homo sapiens
ccguaacaacugugguc

SEQ ID NO: 388923 - RNA, 11 nt, Homo sapiens
ccgugccuuca

SEQ ID NO: 388924 - RNA, 22 nt, Homo sapiens
ccuaaaucugccuuuucaucua

SEQ ID NO: 388925 - RNA, 18 nt, Homo sapiens
ccuaagcagaccacugau

SEQ ID NO: 388926 - RNA, 23 nt, Homo sapiens
ccuacaguugaaaaacagcugag

SEQ ID NO: 388927 - RNA, 15 nt, Homo sapiens
ccuaccaucagggac

SEQ ID NO: 388928 - RNA, 21 nt, Homo sapiens
ccuaccucacagagugcauug

SEQ ID NO: 388929 - RNA, 16 nt, Homo sapiens
ccuagauucuacauau

SEQ ID NO: 388930 - RNA, 22 nt, Homo sapiens
ccuagcaucucaugagugccaa

SEQ ID NO: 388931 - RNA, 20 nt, Homo sapiens
ccuaggauuucaugauuuca

SEQ ID NO: 388932 - RNA, 11 nt, Homo sapiens
ccuaguacaag

SEQ ID NO: 388933 - RNA, 17 nt, Homo sapiens
ccuauaaaacaggucaa

SEQ ID NO: 388934 - RNA, 18 nt, Homo sapiens
ccuauauugcauuaauuu

SEQ ID NO: 388935 - RNA, 23 nt, Homo sapiens
ccuaucagaaguuucucagcucc

SEQ ID NO: 388936 - RNA, 22 nt, Homo sapiens
ccuaugugggugggaccacaga

SEQ ID NO: 388937 - RNA, 18 nt, Homo sapiens
ccuauuucuuauagucaa

SEQ ID NO: 388938 - RNA, 22 nt, Homo sapiens
ccucacagcacuaguauuucau

SEQ ID NO: 388939 - RNA, 14 nt, Homo sapiens
ccucagccaugagg

SEQ ID NO: 388940 - RNA, 17 nt, Homo sapiens
ccucagccauucacugc

SEQ ID NO: 388941 - RNA, 14 nt, Homo sapiens
ccucaggcaggugg

SEQ ID NO: 388942 - RNA, 15 nt, Homo sapiens
ccucagggacagaga

SEQ ID NO: 388943 - RNA, 19 nt, Homo sapiens
ccucaguuucccuaucucg

SEQ ID NO: 388944 - RNA, 20 nt, Homo sapiens
ccucaugauaugucagggcg

SEQ ID NO: 388945 - RNA, 20 nt, Homo sapiens
ccucauuccccaaccacuuc

SEQ ID NO: 388946 - RNA, 18 nt, Homo sapiens
ccucccagaacacacucc

SEQ ID NO: 388947 - RNA, 17 nt, Homo sapiens
ccuccuaaaguagacuu

SEQ ID NO: 388948 - RNA, 23 nt, Homo sapiens
ccuccuccagccgccaugcuccu

SEQ ID NO: 388949 - RNA, 19 nt, Homo sapiens
ccuccucggaucaccgaga

SEQ ID NO: 388950 - RNA, 21 nt, Homo sapiens
ccuccucuacaauuugccauu

SEQ ID NO: 388951 - RNA, 22 nt, Homo sapiens
ccucucucacauggaacgcuuu

SEQ ID NO: 388952 - RNA, 12 nt, Homo sapiens
ccucucugcucu

SEQ ID NO: 388953 - RNA, 14 nt, Homo sapiens
ccucugaaaaccaa

SEQ ID NO: 388954 - RNA, 21 nt, Homo sapiens
ccucuggcuggcuaacuggaa

SEQ ID NO: 388955 - RNA, 21 nt, Homo sapiens
ccucugggccaagucaaagac

SEQ ID NO: 388956 - RNA, 15 nt, Homo sapiens
ccucuuuucucugug

SEQ ID NO: 388957 - RNA, 20 nt, Homo sapiens
ccucuuuuucuagucuucau

SEQ ID NO: 388958 - RNA, 15 nt, Homo sapiens
ccugaaaauucugua

SEQ ID NO: 388959 - RNA, 21 nt, Homo sapiens
ccugaagaacaguaacugcca

SEQ ID NO: 388960 - RNA, 14 nt, Homo sapiens
ccugacaaccacug

SEQ ID NO: 388961 - RNA, 23 nt, Homo sapiens
ccugagaagagagaucaaaugga

SEQ ID NO: 388962 - RNA, 20 nt, Homo sapiens
ccugagcucgguggacccag

SEQ ID NO: 388963 - RNA, 15 nt, Homo sapiens
ccugauuacaccagc

SEQ ID NO: 388964 - RNA, 18 nt, Homo sapiens
ccugccagacggcaccca

SEQ ID NO: 388965 - RNA, 15 nt, Homo sapiens
ccugcccaccuguca

SEQ ID NO: 388966 - RNA, 16 nt, Homo sapiens
ccugcccagugcacac

SEQ ID NO: 388967 - RNA, 22 nt, Homo sapiens
ccugccccaaacaaauaugcaa

SEQ ID NO: 388968 - RNA, 19 nt, Homo sapiens
ccugcccuugucccacuca

SEQ ID NO: 388969 - RNA, 17 nt, Homo sapiens
ccugccgguaaacacgc

SEQ ID NO: 388970 - RNA, 10 nt, Homo sapiens
ccugccugua

SEQ ID NO: 388971 - RNA, 23 nt, Homo sapiens
ccugcugucgucuuagcaagaag

SEQ ID NO: 388972 - RNA, 14 nt, Homo sapiens
ccuggaaggugcug

SEQ ID NO: 388973 - RNA, 13 nt, Homo sapiens
ccuggacuuuccu

SEQ ID NO: 388974 - RNA, 15 nt, Homo sapiens
ccuggacuuuccugc

SEQ ID NO: 388975 - RNA, 20 nt, Homo sapiens
ccuggaggccgggugcucag

SEQ ID NO: 388976 - RNA, 20 nt, Homo sapiens
ccuggcccacugcaucguuu

SEQ ID NO: 388977 - RNA, 15 nt, Homo sapiens
ccuggcccucaguuu

SEQ ID NO: 388978 - RNA, 17 nt, Homo sapiens
ccuggcgaaaccccauc

SEQ ID NO: 388979 - RNA, 12 nt, Homo sapiens
ccuggcuggcau

SEQ ID NO: 388980 - RNA, 14 nt, Homo sapiens
ccugggcaaagccu

SEQ ID NO: 388981 - RNA, 19 nt, Homo sapiens
ccuggggagucugggcaca

SEQ ID NO: 388982 - RNA, 22 nt, Homo sapiens
ccugggugacauuugggagaca

SEQ ID NO: 388983 - RNA, 19 nt, Homo sapiens
ccuggucaacauggugaaa

SEQ ID NO: 388984 - RNA, 21 nt, Homo sapiens
ccugguuaaauuugaauuuca

SEQ ID NO: 388985 - RNA, 13 nt, Homo sapiens
ccuguaaucacag

SEQ ID NO: 388986 - RNA, 17 nt, Homo sapiens
ccugucuuccugcauuc

SEQ ID NO: 388987 - RNA, 14 nt, Homo sapiens
ccuguucacucuac

SEQ ID NO: 388988 - RNA, 22 nt, Homo sapiens
ccuguuuucgcaccuaccauca

SEQ ID NO: 388989 - RNA, 22 nt, Homo sapiens
ccuuagauguucuaagucuuuc

SEQ ID NO: 388990 - RNA, 23 nt, Homo sapiens
ccuuaguguuuggguauauucau

SEQ ID NO: 388991 - RNA, 16 nt, Homo sapiens
ccuuauuguaccucuc

SEQ ID NO: 388992 - RNA, 20 nt, Homo sapiens
ccuuccagcacccugcaaaa

SEQ ID NO: 388993 - RNA, 15 nt, Homo sapiens
ccuuccccagccucu

SEQ ID NO: 388994 - RNA, 19 nt, Homo sapiens
ccuucuccauccacauggg

SEQ ID NO: 388995 - RNA, 20 nt, Homo sapiens
ccuucucucaccuccuaaag

SEQ ID NO: 388996 - RNA, 14 nt, Homo sapiens
ccuucugucagcag

SEQ ID NO: 388997 - RNA, 14 nt, Homo sapiens
ccuugauucacaau

SEQ ID NO: 388998 - RNA, 15 nt, Homo sapiens
ccuugccagacaugu

SEQ ID NO: 388999 - RNA, 13 nt, Homo sapiens
ccuugcccagaga

SEQ ID NO: 389000 - RNA, 23 nt, Homo sapiens
ccuugcuggacggggacugggga

SEQ ID NO: 389001 - RNA, 17 nt, Homo sapiens
ccuuggcaugccuucca

SEQ ID NO: 389002 - RNA, 20 nt, Homo sapiens
ccuuggcaugccuuccagca

SEQ ID NO: 389003 - RNA, 19 nt, Homo sapiens
ccuugguucccccacugau

SEQ ID NO: 389004 - RNA, 19 nt, Homo sapiens
ccuuguaauucuaaaugaa

SEQ ID NO: 389005 - RNA, 16 nt, Homo sapiens
ccuugugcguggguga

SEQ ID NO: 389006 - RNA, 22 nt, Homo sapiens
ccuuuccaaaugcccagcuuaa

SEQ ID NO: 389007 - RNA, 15 nt, Homo sapiens
ccuuucuuacauuag

SEQ ID NO: 389008 - RNA, 15 nt, Homo sapiens
ccuuuggcucuggag

SEQ ID NO: 389009 - RNA, 21 nt, Homo sapiens
ccuuuggggugaacuaccuug

SEQ ID NO: 389010 - RNA, 18 nt, Homo sapiens
ccuuuguguauucaucuu

SEQ ID NO: 389011 - RNA, 17 nt, Homo sapiens
ccuuuuauagaugguca

SEQ ID NO: 389012 - RNA, 15 nt, Homo sapiens
cgaaaccccaucucu

SEQ ID NO: 389013 - RNA, 17 nt, Homo sapiens
cgacagagccagacugu

SEQ ID NO: 389014 - RNA, 16 nt, Homo sapiens
cgacugaugaaggcau

SEQ ID NO: 389015 - RNA, 20 nt, Homo sapiens
cgagauugcaccacugcacu

SEQ ID NO: 389016 - RNA, 16 nt, Homo sapiens
cgagcacuguccagua

SEQ ID NO: 389017 - RNA, 17 nt, Homo sapiens
cgagcaggcuacuguca

SEQ ID NO: 389018 - RNA, 18 nt, Homo sapiens
cgaguacagaguggcccu

SEQ ID NO: 389019 - RNA, 17 nt, Homo sapiens
cgauuuuguaucugcag

SEQ ID NO: 389020 - RNA, 14 nt, Homo sapiens
cgcaaaugaguauu

SEQ ID NO: 389021 - RNA, 13 nt, Homo sapiens
cgcagcgcaggac

SEQ ID NO: 389022 - RNA, 20 nt, Homo sapiens
cgccaccccuccuuccuuga

SEQ ID NO: 389023 - RNA, 21 nt, Homo sapiens
cgccccucauuuaucccucaa

SEQ ID NO: 389024 - RNA, 20 nt, Homo sapiens
cgcgcaccuguaaucccagc

SEQ ID NO: 389025 - RNA, 13 nt, Homo sapiens
cgcuaucuagcaa

SEQ ID NO: 389026 - RNA, 15 nt, Homo sapiens
cgcuuuguugcccag

SEQ ID NO: 389027 - RNA, 22 nt, Homo sapiens
cgcuuuugcuggucacugccau

SEQ ID NO: 389028 - RNA, 17 nt, Homo sapiens
cggagccuccucucuca

SEQ ID NO: 389029 - RNA, 13 nt, Homo sapiens
cggccaaccuccc

SEQ ID NO: 389030 - RNA, 15 nt, Homo sapiens
cggguuacuuucaca

SEQ ID NO: 389031 - RNA, 18 nt, Homo sapiens
cgguaaacacgccugcaa

SEQ ID NO: 389032 - RNA, 16 nt, Homo sapiens
cgguggacccagggau

SEQ ID NO: 389033 - RNA, 23 nt, Homo sapiens
cgguggccugggauuggcuguga

SEQ ID NO: 389034 - RNA, 13 nt, Homo sapiens
cgguucaccagcc

SEQ ID NO: 389035 - RNA, 19 nt, Homo sapiens
cguaaacacgccugcaaac

SEQ ID NO: 389036 - RNA, 14 nt, Homo sapiens
cguaacaacugugg

SEQ ID NO: 389037 - RNA, 15 nt, Homo sapiens
cguaacaacuguggu

SEQ ID NO: 389038 - RNA, 13 nt, Homo sapiens
cguaacccaacuc

SEQ ID NO: 389039 - RNA, 14 nt, Homo sapiens
cguaguucccugaa

SEQ ID NO: 389040 - RNA, 14 nt, Homo sapiens
cgucauguuucuuc

SEQ ID NO: 389041 - RNA, 12 nt, Homo sapiens
cgucccuaccuc

SEQ ID NO: 389042 - RNA, 13 nt, Homo sapiens
cgucccuaccucc

SEQ ID NO: 389043 - RNA, 18 nt, Homo sapiens
cgugaaggccgagaagca

SEQ ID NO: 389044 - RNA, 12 nt, Homo sapiens
cgugcccugcuc

SEQ ID NO: 389045 - RNA, 18 nt, Homo sapiens
cgugcuuguuugcucacc

SEQ ID NO: 389046 - RNA, 16 nt, Homo sapiens
cguggauugcacgugg

SEQ ID NO: 389047 - RNA, 15 nt, Homo sapiens
cgugugacuacuccc

SEQ ID NO: 389048 - RNA, 14 nt, Homo sapiens
cgugugcgugcaug

SEQ ID NO: 389049 - RNA, 23 nt, Homo sapiens
cguguggcucacgugugugacuc

SEQ ID NO: 389050 - RNA, 14 nt, Homo sapiens
cguguguccaugug

SEQ ID NO: 389051 - RNA, 13 nt, Homo sapiens
cgugugugcaagu

SEQ ID NO: 389052 - RNA, 23 nt, Homo sapiens
cguuaguguauuuuauguguggc

SEQ ID NO: 389053 - RNA, 13 nt, Homo sapiens
cguucacucccaa

SEQ ID NO: 389054 - RNA, 13 nt, Homo sapiens
cguuuaaucacau

SEQ ID NO: 389055 - RNA, 16 nt, Homo sapiens
cuaaaaguguaagaaa

SEQ ID NO: 389056 - RNA, 19 nt, Homo sapiens
cuaaagaaaaagucaucca

SEQ ID NO: 389057 - RNA, 15 nt, Homo sapiens
cuaaagaagguuuca

SEQ ID NO: 389058 - RNA, 18 nt, Homo sapiens
cuaaagagagaugaacca

SEQ ID NO: 389059 - RNA, 12 nt, Homo sapiens
cuaaaguagacu

SEQ ID NO: 389060 - RNA, 18 nt, Homo sapiens
cuaaaucugccuuuucau

SEQ ID NO: 389061 - RNA, 16 nt, Homo sapiens
cuaaaugaagugcaaa

SEQ ID NO: 389062 - RNA, 22 nt, Homo sapiens
cuaaaugugaaugaugauccua

SEQ ID NO: 389063 - RNA, 15 nt, Homo sapiens
cuaaauuugguucua

SEQ ID NO: 389064 - RNA, 17 nt, Homo sapiens
cuaaccagccuggucaa

SEQ ID NO: 389065 - RNA, 21 nt, Homo sapiens
cuaagaagugaaaaucuacac

SEQ ID NO: 389066 - RNA, 13 nt, Homo sapiens
cuaagaugaucau

SEQ ID NO: 389067 - RNA, 15 nt, Homo sapiens
cuaagaugggugggg

SEQ ID NO: 389068 - RNA, 20 nt, Homo sapiens
cuaagcucaaggcgugagga

SEQ ID NO: 389069 - RNA, 21 nt, Homo sapiens
cuaaggaugucacagggccaa

SEQ ID NO: 389070 - RNA, 23 nt, Homo sapiens
cuaagugaaauaagccagacauc

SEQ ID NO: 389071 - RNA, 19 nt, Homo sapiens
cuaauacagacuaugucac

SEQ ID NO: 389072 - RNA, 22 nt, Homo sapiens
cuaaucagcauucucacuccua

SEQ ID NO: 389073 - RNA, 19 nt, Homo sapiens
cuaaucauccaaugcucaa

SEQ ID NO: 389074 - RNA, 13 nt, Homo sapiens
cuaaucuucaggg

SEQ ID NO: 389075 - RNA, 23 nt, Homo sapiens
cuaaugccugcggaguugugcac

SEQ ID NO: 389076 - RNA, 15 nt, Homo sapiens
cuaauguaauaacug

SEQ ID NO: 389077 - RNA, 13 nt, Homo sapiens
cuacaaaaacaca

SEQ ID NO: 389078 - RNA, 17 nt, Homo sapiens
cuacaagcagcaggaaa

SEQ ID NO: 389079 - RNA, 22 nt, Homo sapiens
cuacacauucaauaagcaucaa

SEQ ID NO: 389080 - RNA, 19 nt, Homo sapiens
cuacagauagucaaaccau

SEQ ID NO: 389081 - RNA, 21 nt, Homo sapiens
cuacauauucuuuaaauuuca

SEQ ID NO: 389082 - RNA, 14 nt, Homo sapiens
cuacauguauugca

SEQ ID NO: 389083 - RNA, 15 nt, Homo sapiens
cuacauguauugcac

SEQ ID NO: 389084 - RNA, 18 nt, Homo sapiens
cuacgugacuguggcaca

SEQ ID NO: 389085 - RNA, 21 nt, Homo sapiens
cuacuuuaagcacuacauaaa

SEQ ID NO: 389086 - RNA, 16 nt, Homo sapiens
cuacuuucauacugaa

SEQ ID NO: 389087 - RNA, 23 nt, Homo sapiens
cuagacugacccugaucagucua

SEQ ID NO: 389088 - RNA, 18 nt, Homo sapiens
cuagagcacacuguagca

SEQ ID NO: 389089 - RNA, 16 nt, Homo sapiens
cuagcacuuggagcca

SEQ ID NO: 389090 - RNA, 22 nt, Homo sapiens
cuagccaugauaacugcaauuu

SEQ ID NO: 389091 - RNA, 14 nt, Homo sapiens
cuagccgaccucag

SEQ ID NO: 389092 - RNA, 17 nt, Homo sapiens
cuagcuagaaauaugau

SEQ ID NO: 389093 - RNA, 14 nt, Homo sapiens
cuagcugcaaguga

SEQ ID NO: 389094 - RNA, 18 nt, Homo sapiens
cuaggcuccgucaguauc

SEQ ID NO: 389095 - RNA, 14 nt, Homo sapiens
cuagggaugguaau

SEQ ID NO: 389096 - RNA, 17 nt, Homo sapiens
cuagguaggggcccacu

SEQ ID NO: 389097 - RNA, 13 nt, Homo sapiens
cuaggugcccuug

SEQ ID NO: 389098 - RNA, 20 nt, Homo sapiens
cuagguucuaaaaauuguga

SEQ ID NO: 389099 - RNA, 16 nt, Homo sapiens
cuaguccuuuacuaau

SEQ ID NO: 389100 - RNA, 12 nt, Homo sapiens
cuaguucagcug

SEQ ID NO: 389101 - RNA, 16 nt, Homo sapiens
cuauaaaguaaagcua

SEQ ID NO: 389102 - RNA, 19 nt, Homo sapiens
cuauaacuaugaccaugcu

SEQ ID NO: 389103 - RNA, 19 nt, Homo sapiens
cuauauaaaaaacauaaua

SEQ ID NO: 389104 - RNA, 23 nt, Homo sapiens
cuauauaguuuauugacaauaau

SEQ ID NO: 389105 - RNA, 14 nt, Homo sapiens
cuauauugcacugu

SEQ ID NO: 389106 - RNA, 17 nt, Homo sapiens
cuauauugcacugugac

SEQ ID NO: 389107 - RNA, 14 nt, Homo sapiens
cuaucaauagucaa

SEQ ID NO: 389108 - RNA, 18 nt, Homo sapiens
cuaucuucuuucacauau

SEQ ID NO: 389109 - RNA, 17 nt, Homo sapiens
cuaucuuuugcauccua

SEQ ID NO: 389110 - RNA, 15 nt, Homo sapiens
cuaugauaugcuaau

SEQ ID NO: 389111 - RNA, 16 nt, Homo sapiens
cuaugauaugcuaaua

SEQ ID NO: 389112 - RNA, 19 nt, Homo sapiens
cuaugcaacagcucucacc

SEQ ID NO: 389113 - RNA, 22 nt, Homo sapiens
cuaugcaacagcucucaccuac

SEQ ID NO: 389114 - RNA, 14 nt, Homo sapiens
cuauguaacaugua

SEQ ID NO: 389115 - RNA, 22 nt, Homo sapiens
cuauguauggaauacaguguua

SEQ ID NO: 389116 - RNA, 14 nt, Homo sapiens
cuauguuauauuga

SEQ ID NO: 389117 - RNA, 20 nt, Homo sapiens
cuauuaaaacagccaaaacu

SEQ ID NO: 389118 - RNA, 17 nt, Homo sapiens
cuauucaaacagucuca

SEQ ID NO: 389119 - RNA, 17 nt, Homo sapiens
cuauugcuggcaaagac

SEQ ID NO: 389120 - RNA, 16 nt, Homo sapiens
cucaaaacugcacugu

SEQ ID NO: 389121 - RNA, 21 nt, Homo sapiens
cucaaaagcugggcagguugg

SEQ ID NO: 389122 - RNA, 18 nt, Homo sapiens
cucaaaauaccaugccau

SEQ ID NO: 389123 - RNA, 13 nt, Homo sapiens
cucaaaucuccag

SEQ ID NO: 389124 - RNA, 14 nt, Homo sapiens
cucaagauucagua

SEQ ID NO: 389125 - RNA, 14 nt, Homo sapiens
cucaagcagucuac

SEQ ID NO: 389126 - RNA, 17 nt, Homo sapiens
cucaagccaagcagcca

SEQ ID NO: 389127 - RNA, 18 nt, Homo sapiens
cucaagugucucagucca

SEQ ID NO: 389128 - RNA, 19 nt, Homo sapiens
cucacagagugcauuguga

SEQ ID NO: 389129 - RNA, 20 nt, Homo sapiens
cucacagagugcauugugag

SEQ ID NO: 389130 - RNA, 12 nt, Homo sapiens
cucacgccugua

SEQ ID NO: 389131 - RNA, 21 nt, Homo sapiens
cucacucccuucccauaagcu

SEQ ID NO: 389132 - RNA, 17 nt, Homo sapiens
cucacuguugaauuuuc

SEQ ID NO: 389133 - RNA, 18 nt, Homo sapiens
cucacuugugcaguguug

SEQ ID NO: 389134 - RNA, 23 nt, Homo sapiens
cucacuuucuagauuaagauaug

SEQ ID NO: 389135 - RNA, 14 nt, Homo sapiens
cucagcauaccugc

SEQ ID NO: 389136 - RNA, 21 nt, Homo sapiens
cucagcauaccugcuggugca

SEQ ID NO: 389137 - RNA, 14 nt, Homo sapiens
cucagcuucuuaau

SEQ ID NO: 389138 - RNA, 23 nt, Homo sapiens
uuguacccuuccuacagauaguc

SEQ ID NO: 389139 - RNA, 20 nt, Homo sapiens
uuguaucaaaugugacauua

SEQ ID NO: 389140 - RNA, 18 nt, Homo sapiens
uuguaugauccuaaugaa

SEQ ID NO: 389141 - RNA, 17 nt, Homo sapiens
uuguauuaucaacagca

SEQ ID NO: 389142 - RNA, 19 nt, Homo sapiens
uugucagaguucugcucua

SEQ ID NO: 389143 - RNA, 19 nt, Homo sapiens
uugucccaaguuccacugc

SEQ ID NO: 389144 - RNA, 17 nt, Homo sapiens
uugugaguuuaccuugu

SEQ ID NO: 389145 - RNA, 20 nt, Homo sapiens
uugugaguuuaccuuguaua

SEQ ID NO: 389146 - RNA, 12 nt, Homo sapiens
uugugauugccu

SEQ ID NO: 389147 - RNA, 15 nt, Homo sapiens
uuguguccacuguga

SEQ ID NO: 389148 - RNA, 16 nt, Homo sapiens
uuguuccccacugaca

SEQ ID NO: 389149 - RNA, 15 nt, Homo sapiens
uuguucuaguuuuca

SEQ ID NO: 389150 - RNA, 19 nt, Homo sapiens
uuguuguuuauaaagggag

SEQ ID NO: 389151 - RNA, 15 nt, Homo sapiens
uuuaaaagcaucuca

SEQ ID NO: 389152 - RNA, 22 nt, Homo sapiens
uuuaaacacggggcuugcaacu

SEQ ID NO: 389153 - RNA, 14 nt, Homo sapiens
uuuaaacucaggga

SEQ ID NO: 389154 - RNA, 22 nt, Homo sapiens
uuuaaacucagggacagagcca

SEQ ID NO: 389155 - RNA, 21 nt, Homo sapiens
uuuaaagcuuauuaaaacuca

SEQ ID NO: 389156 - RNA, 21 nt, Homo sapiens
uuuaaaguauguuauugcaua

SEQ ID NO: 389157 - RNA, 23 nt, Homo sapiens
uuuaaauacagucuuccauuugc

SEQ ID NO: 389158 - RNA, 22 nt, Homo sapiens
uuuaaaucaacgaguacuucaa

SEQ ID NO: 389159 - RNA, 18 nt, Homo sapiens
uuuaacuggcuucagccu

SEQ ID NO: 389160 - RNA, 13 nt, Homo sapiens
uuuaagaaaucaa

SEQ ID NO: 389161 - RNA, 14 nt, Homo sapiens
uuuaagcuaccaau

SEQ ID NO: 389162 - RNA, 13 nt, Homo sapiens
uuuaagguacuua

SEQ ID NO: 389163 - RNA, 19 nt, Homo sapiens
uuuaaucauuuugccucuu

SEQ ID NO: 389164 - RNA, 17 nt, Homo sapiens
uuuacaaaguauuugcu

SEQ ID NO: 389165 - RNA, 15 nt, Homo sapiens
uuuacaaucugcacu

SEQ ID NO: 389166 - RNA, 17 nt, Homo sapiens
uuuacaauguucauccc

SEQ ID NO: 389167 - RNA, 18 nt, Homo sapiens
uuuacaauguucauccca

SEQ ID NO: 389168 - RNA, 14 nt, Homo sapiens
uuuaccaucugcau

SEQ ID NO: 389169 - RNA, 16 nt, Homo sapiens
uuuacuagaaaggcau

SEQ ID NO: 389170 - RNA, 22 nt, Homo sapiens
uuuagagugaaauauaugcuau

SEQ ID NO: 389171 - RNA, 19 nt, Homo sapiens
uuuagauuaaacaaacaaa

SEQ ID NO: 389172 - RNA, 15 nt, Homo sapiens
uuuagucaugugacc

SEQ ID NO: 389173 - RNA, 16 nt, Homo sapiens
uuuauaagagugccgu

SEQ ID NO: 389174 - RNA, 20 nt, Homo sapiens
uuuauagucgaacaauucau

SEQ ID NO: 389175 - RNA, 18 nt, Homo sapiens
uuuaucuauggcacccau

SEQ ID NO: 389176 - RNA, 19 nt, Homo sapiens
uuuaucugugaauucagau

SEQ ID NO: 389177 - RNA, 14 nt, Homo sapiens
uuuaucugugcaaa

SEQ ID NO: 389178 - RNA, 22 nt, Homo sapiens
uuuaugagacccauuccuauuu

SEQ ID NO: 389179 - RNA, 21 nt, Homo sapiens
uuuauuacaguuuaucuaugg

SEQ ID NO: 389180 - RNA, 22 nt, Homo sapiens
uuuauuaguuaauauaucccag

SEQ ID NO: 389181 - RNA, 13 nt, Homo sapiens
uuuauugugaucu

SEQ ID NO: 389182 - RNA, 16 nt, Homo sapiens
uuuauuuaacuauuca

SEQ ID NO: 389183 - RNA, 12 nt, Homo sapiens
uuucaauugcau

SEQ ID NO: 389184 - RNA, 18 nt, Homo sapiens
uuucagauaaacaacaaa

SEQ ID NO: 389185 - RNA, 16 nt, Homo sapiens
uuucaggccacauggc

SEQ ID NO: 389186 - RNA, 21 nt, Homo sapiens
uuucaggccacauggcuaaag

SEQ ID NO: 389187 - RNA, 18 nt, Homo sapiens
uuucagguuccaaucaga

SEQ ID NO: 389188 - RNA, 19 nt, Homo sapiens
uuucauaccuaucaucuua

SEQ ID NO: 389189 - RNA, 19 nt, Homo sapiens
uuucauccacuagugcaaa

SEQ ID NO: 389190 - RNA, 15 nt, Homo sapiens
uuucaucuaauguga

SEQ ID NO: 389191 - RNA, 15 nt, Homo sapiens
uuuccagauauucaa

SEQ ID NO: 389192 - RNA, 14 nt, Homo sapiens
uuuccauagucaca

SEQ ID NO: 389193 - RNA, 15 nt, Homo sapiens
uuuccuucagugcau

SEQ ID NO: 389194 - RNA, 15 nt, Homo sapiens
uuucucugccaguga

SEQ ID NO: 389195 - RNA, 15 nt, Homo sapiens
uuucucuguauagua

SEQ ID NO: 389196 - RNA, 16 nt, Homo sapiens
uuucugaucugaugca

SEQ ID NO: 389197 - RNA, 17 nt, Homo sapiens
uuucuggcagccaguac

SEQ ID NO: 389198 - RNA, 14 nt, Homo sapiens
uuucuuacauuagc

SEQ ID NO: 389199 - RNA, 17 nt, Homo sapiens
uuucuuuuguauguaaa

SEQ ID NO: 389200 - RNA, 13 nt, Homo sapiens
uuugaaacaguug

SEQ ID NO: 389201 - RNA, 24 nt, Homo sapiens
uuugaaauaauaaaucugguagaa

SEQ ID NO: 389202 - RNA, 16 nt, Homo sapiens
uuugaaucacaguaua

SEQ ID NO: 389203 - RNA, 13 nt, Homo sapiens
uuugaaugacaaa

SEQ ID NO: 389204 - RNA, 21 nt, Homo sapiens
uuugaauguuaagcagaugga

SEQ ID NO: 389205 - RNA, 16 nt, Homo sapiens
uuugaggggcugacuu

SEQ ID NO: 389206 - RNA, 15 nt, Homo sapiens
uuugauuauucagug

SEQ ID NO: 389207 - RNA, 21 nt, Homo sapiens
uuugcuaaaugugaaugauga

SEQ ID NO: 389208 - RNA, 17 nt, Homo sapiens
uuuggaauauuguccau

SEQ ID NO: 389209 - RNA, 21 nt, Homo sapiens
uuuggauaucaaaagcaaaua

SEQ ID NO: 389210 - RNA, 21 nt, Homo sapiens
uuuggcucuucuaaucagagc

SEQ ID NO: 389211 - RNA, 20 nt, Homo sapiens
uuugggaacugcaauaaccu

SEQ ID NO: 389212 - RNA, 18 nt, Homo sapiens
uuuggggggcgugcaugu

SEQ ID NO: 389213 - RNA, 17 nt, Homo sapiens
uuuggguuuugggucuu

SEQ ID NO: 389214 - RNA, 16 nt, Homo sapiens
uuugguaugugacaug

SEQ ID NO: 389215 - RNA, 16 nt, Homo sapiens
uuuguaucauuaugaa

SEQ ID NO: 389216 - RNA, 20 nt, Homo sapiens
uuuguaucauuaugaaguca

SEQ ID NO: 389217 - RNA, 14 nt, Homo sapiens
uuugucucauccca

SEQ ID NO: 389218 - RNA, 17 nt, Homo sapiens
uuugugugcgucacugu

SEQ ID NO: 389219 - RNA, 19 nt, Homo sapiens
uuugugugugugcaagugu

SEQ ID NO: 389220 - RNA, 20 nt, Homo sapiens
uuuguuuuguaucauuauga

SEQ ID NO: 389221 - RNA, 19 nt, Homo sapiens
uuuuauccacuuaccuaga

SEQ ID NO: 389222 - RNA, 20 nt, Homo sapiens
uuuuauggaggcuuugcaua

SEQ ID NO: 389223 - RNA, 22 nt, Homo sapiens
uuuucagaaaauauuauguguu

SEQ ID NO: 389224 - RNA, 13 nt, Homo sapiens
uuuuccacuuaga

SEQ ID NO: 389225 - RNA, 14 nt, Homo sapiens
uuuuccugccaggc

SEQ ID NO: 389226 - RNA, 15 nt, Homo sapiens
uuuucuagucuucau

SEQ ID NO: 389227 - RNA, 16 nt, Homo sapiens
uuuucucugugcuuca

SEQ ID NO: 389228 - RNA, 22 nt, Homo sapiens
uuuucugcuaaaaaguccuuga

SEQ ID NO: 389229 - RNA, 18 nt, Homo sapiens
uuuugacaucagcauuag

SEQ ID NO: 389230 - RNA, 18 nt, Homo sapiens
uuuuuaauauaaagccug

SEQ ID NO: 389231 - RNA, 12 nt, Homo sapiens
uuuuuagcuuua

SEQ ID NO: 389232 - RNA, 20 nt, Homo sapiens
uuuuuauggaggcuuugcau

SEQ ID NO: 389233 - RNA, 15 nt, Homo sapiens
uuuuuccuaacagga

SEQ ID NO: 389234 - RNA, 18 nt, Homo sapiens
uuuuuguucaaagccagc

SEQ ID NO: 389235 - RNA, 19 nt, Homo sapiens
cucaggccugcgagaagac

SEQ ID NO: 389236 - RNA, 19 nt, Homo sapiens
cucagggcugacacgucca

SEQ ID NO: 389237 - RNA, 17 nt, Homo sapiens
cucagguguugccaaau

SEQ ID NO: 389238 - RNA, 12 nt, Homo sapiens
cucaguccuccc

SEQ ID NO: 389239 - RNA, 13 nt, Homo sapiens
cucaguccucccc

SEQ ID NO: 389240 - RNA, 15 nt, Homo sapiens
cucagugaacuguga

SEQ ID NO: 389241 - RNA, 11 nt, Homo sapiens
cucagugcuuu

SEQ ID NO: 389242 - RNA, 21 nt, Homo sapiens
cucauauuuaaagacagggaa

SEQ ID NO: 389243 - RNA, 19 nt, Homo sapiens
cucaugagugccaagcaaa

SEQ ID NO: 389244 - RNA, 14 nt, Homo sapiens
cucaugauauguca

SEQ ID NO: 389245 - RNA, 15 nt, Homo sapiens
cucaugcuguuucac

SEQ ID NO: 389246 - RNA, 13 nt, Homo sapiens
cucauugacaaga

SEQ ID NO: 389247 - RNA, 22 nt, Homo sapiens
cuccaaagaaauguaagggaaa

SEQ ID NO: 389248 - RNA, 13 nt, Homo sapiens
cuccaagcuccau

SEQ ID NO: 389249 - RNA, 17 nt, Homo sapiens
cuccacagucaauauua

SEQ ID NO: 389250 - RNA, 14 nt, Homo sapiens
cuccaccucuucac

SEQ ID NO: 389251 - RNA, 15 nt, Homo sapiens
cuccacgccauuucc

SEQ ID NO: 389252 - RNA, 16 nt, Homo sapiens
cuccacugccuucgau

SEQ ID NO: 389253 - RNA, 12 nt, Homo sapiens
cuccacugucac

SEQ ID NO: 389254 - RNA, 19 nt, Homo sapiens
cuccagaaagcucaucuca

SEQ ID NO: 389255 - RNA, 17 nt, Homo sapiens
cuccagaccauucagga

SEQ ID NO: 389256 - RNA, 23 nt, Homo sapiens
cuccaguauaugcugauggacca

SEQ ID NO: 389257 - RNA, 20 nt, Homo sapiens
cuccauuguucagaugcuuc

SEQ ID NO: 389258 - RNA, 20 nt, Homo sapiens
cucccagaacacacuccauc

SEQ ID NO: 389259 - RNA, 17 nt, Homo sapiens
cucccagauaaugugaa

SEQ ID NO: 389260 - RNA, 20 nt, Homo sapiens
cucccaggcuggagugcagu

SEQ ID NO: 389261 - RNA, 13 nt, Homo sapiens
cuccccacugccu

SEQ ID NO: 389262 - RNA, 15 nt, Homo sapiens
cuccccacugcucau

SEQ ID NO: 389263 - RNA, 21 nt, Homo sapiens
cuccccagccuuugaucaggu

SEQ ID NO: 389264 - RNA, 23 nt, Homo sapiens
cuccccauggggcagcaucagga

SEQ ID NO: 389265 - RNA, 15 nt, Homo sapiens
cucccccaacacaaa

SEQ ID NO: 389266 - RNA, 13 nt, Homo sapiens
cucccuaccaccu

SEQ ID NO: 389267 - RNA, 15 nt, Homo sapiens
cucccucauuccacc

SEQ ID NO: 389268 - RNA, 16 nt, Homo sapiens
cuccuagacugacccu

SEQ ID NO: 389269 - RNA, 17 nt, Homo sapiens
cuccuccagaccauuca

SEQ ID NO: 389270 - RNA, 22 nt, Homo sapiens
cuccucguuccucuccuggaug

SEQ ID NO: 389271 - RNA, 19 nt, Homo sapiens
cuccucuacaauuugccau

SEQ ID NO: 389272 - RNA, 22 nt, Homo sapiens
cuccucuguccaggcacugcug

SEQ ID NO: 389273 - RNA, 22 nt, Homo sapiens
cuccucuucaaauaaacauguc

SEQ ID NO: 389274 - RNA, 14 nt, Homo sapiens
cuccucuugccacu

SEQ ID NO: 389275 - RNA, 16 nt, Homo sapiens
cuccugauagucuuuc

SEQ ID NO: 389276 - RNA, 19 nt, Homo sapiens
cuccuggaagcgagcuuug

SEQ ID NO: 389277 - RNA, 20 nt, Homo sapiens
cuccugugcuagaugugcaa

SEQ ID NO: 389278 - RNA, 13 nt, Homo sapiens
cuccuucgcuuaa

SEQ ID NO: 389279 - RNA, 17 nt, Homo sapiens
cuccuucuaccacuggg

SEQ ID NO: 389280 - RNA, 16 nt, Homo sapiens
cuccuuugcuuagccc

SEQ ID NO: 389281 - RNA, 20 nt, Homo sapiens
cucguauaugucucaggucc

SEQ ID NO: 389282 - RNA, 23 nt, Homo sapiens
cucuaauucuagagucucuguua

SEQ ID NO: 389283 - RNA, 14 nt, Homo sapiens
cucuacaaaaagca

SEQ ID NO: 389284 - RNA, 20 nt, Homo sapiens
cucuaccagacuguguauuc

SEQ ID NO: 389285 - RNA, 23 nt, Homo sapiens
cucuaucagaacuggaccaucuc

SEQ ID NO: 389286 - RNA, 13 nt, Homo sapiens
cucuauuaucuca

SEQ ID NO: 389287 - RNA, 16 nt, Homo sapiens
cucucaccuccuaaag

SEQ ID NO: 389288 - RNA, 17 nt, Homo sapiens
cucucacuauaccagua

SEQ ID NO: 389289 - RNA, 14 nt, Homo sapiens
cucuccucuugcca

SEQ ID NO: 389290 - RNA, 15 nt, Homo sapiens
cucucuaguuuccag

SEQ ID NO: 389291 - RNA, 15 nt, Homo sapiens
cucucuugcuuacaa

SEQ ID NO: 389292 - RNA, 15 nt, Homo sapiens
cucugaaaccagugu

SEQ ID NO: 389293 - RNA, 15 nt, Homo sapiens
cucugagaucuaagg

SEQ ID NO: 389294 - RNA, 12 nt, Homo sapiens
cucugauaccuc

SEQ ID NO: 389295 - RNA, 13 nt, Homo sapiens
cucugaucccucu

SEQ ID NO: 389296 - RNA, 21 nt, Homo sapiens
cucugcccauccugccccuga

SEQ ID NO: 389297 - RNA, 15 nt, Homo sapiens
cucugcccugcccua

SEQ ID NO: 389298 - RNA, 20 nt, Homo sapiens
cucugcccugcccuagcucc

SEQ ID NO: 389299 - RNA, 17 nt, Homo sapiens
cucugccuccucuucaa

SEQ ID NO: 389300 - RNA, 18 nt, Homo sapiens
cucugccugaaccuucca

SEQ ID NO: 389301 - RNA, 14 nt, Homo sapiens
cucugccugcauuc

SEQ ID NO: 389302 - RNA, 23 nt, Homo sapiens
cucuggccucagccgacugcaca

SEQ ID NO: 389303 - RNA, 14 nt, Homo sapiens
cucugggagacuuu

SEQ ID NO: 389304 - RNA, 17 nt, Homo sapiens
cucugggccuucucacc

SEQ ID NO: 389305 - RNA, 13 nt, Homo sapiens
cucuguauguacu

SEQ ID NO: 389306 - RNA, 18 nt, Homo sapiens
cucugucucaguccauga

SEQ ID NO: 389307 - RNA, 16 nt, Homo sapiens
cucuguuuucaugcua

SEQ ID NO: 389308 - RNA, 19 nt, Homo sapiens
cucuguuuuguaagcuuua

SEQ ID NO: 389309 - RNA, 18 nt, Homo sapiens
cucuuauagaaaguucaa

SEQ ID NO: 389310 - RNA, 15 nt, Homo sapiens
cucuucaacugacca

SEQ ID NO: 389311 - RNA, 18 nt, Homo sapiens
cucuucaacugaccagcc

SEQ ID NO: 389312 - RNA, 19 nt, Homo sapiens
cucuucaacugaccagccu

SEQ ID NO: 389313 - RNA, 16 nt, Homo sapiens
cucuucaaucucuugc

SEQ ID NO: 389314 - RNA, 16 nt, Homo sapiens
cucuugaagaugcuga

SEQ ID NO: 389315 - RNA, 20 nt, Homo sapiens
cucuugggaagaccagcuuu

SEQ ID NO: 389316 - RNA, 21 nt, Homo sapiens
cucuuguauaugaugaucugg

SEQ ID NO: 389317 - RNA, 17 nt, Homo sapiens
cucuuucucugccagug

SEQ ID NO: 389318 - RNA, 19 nt, Homo sapiens
cugaaaacacugugcacau

SEQ ID NO: 389319 - RNA, 11 nt, Homo sapiens
cugaaaaccaa

SEQ ID NO: 389320 - RNA, 14 nt, Homo sapiens
cugaaagaagacau

SEQ ID NO: 389321 - RNA, 18 nt, Homo sapiens
cugaaagaggaaugaagu

SEQ ID NO: 389322 - RNA, 20 nt, Homo sapiens
cugaagaacaguaacugcca

SEQ ID NO: 389323 - RNA, 22 nt, Homo sapiens
cugaagaacaguaacugccauc

SEQ ID NO: 389324 - RNA, 23 nt, Homo sapiens
cugaaucuuccuuuguugcacaa

SEQ ID NO: 389325 - RNA, 18 nt, Homo sapiens
cugaaugauuuccaaaga

SEQ ID NO: 389326 - RNA, 23 nt, Homo sapiens
cugaccucgugauccaccugccu

SEQ ID NO: 389327 - RNA, 21 nt, Homo sapiens
cugacuauugaaguugcagau

SEQ ID NO: 389328 - RNA, 20 nt, Homo sapiens
cugacuuaaguggcauuaaa

SEQ ID NO: 389329 - RNA, 15 nt, Homo sapiens
cugagagaaccucac

SEQ ID NO: 389330 - RNA, 14 nt, Homo sapiens
cugagagacaggac

SEQ ID NO: 389331 - RNA, 16 nt, Homo sapiens
cugagagacccaagga

SEQ ID NO: 389332 - RNA, 14 nt, Homo sapiens
cugagauaccagcg

SEQ ID NO: 389333 - RNA, 16 nt, Homo sapiens
cugagcagugccagcu

SEQ ID NO: 389334 - RNA, 21 nt, Homo sapiens
cugagcagugccagcuuucuu

SEQ ID NO: 389335 - RNA, 23 nt, Homo sapiens
cugagccccugggacugcugcuu

SEQ ID NO: 389336 - RNA, 13 nt, Homo sapiens
cugagcucaaggu

SEQ ID NO: 389337 - RNA, 13 nt, Homo sapiens
cugagcugugcag

SEQ ID NO: 389338 - RNA, 19 nt, Homo sapiens
cugaggccuggacuuuccu

SEQ ID NO: 389339 - RNA, 22 nt, Homo sapiens
cugaggguccccaccugggacc

SEQ ID NO: 389340 - RNA, 12 nt, Homo sapiens
cugaggugggag

SEQ ID NO: 389341 - RNA, 15 nt, Homo sapiens
cugagugcaccacuu

SEQ ID NO: 389342 - RNA, 15 nt, Homo sapiens
cugaguggugccaaa

SEQ ID NO: 389343 - RNA, 17 nt, Homo sapiens
cugauaauaauugauca

SEQ ID NO: 389344 - RNA, 13 nt, Homo sapiens
cugaucagucuaa

SEQ ID NO: 389345 - RNA, 13 nt, Homo sapiens
cugauuaaaccaa

SEQ ID NO: 389346 - RNA, 14 nt, Homo sapiens
cugcaaacgcugcc

SEQ ID NO: 389347 - RNA, 13 nt, Homo sapiens
cugcaagcacugc

SEQ ID NO: 389348 - RNA, 17 nt, Homo sapiens
cugcacagugcaucuca

SEQ ID NO: 389349 - RNA, 14 nt, Homo sapiens
cugcacuccagccu

SEQ ID NO: 389350 - RNA, 13 nt, Homo sapiens
cugcaggugcugc

SEQ ID NO: 389351 - RNA, 15 nt, Homo sapiens
cugcauaguauucca

SEQ ID NO: 389352 - RNA, 21 nt, Homo sapiens
cugcauaguauuccauugugu

SEQ ID NO: 389353 - RNA, 21 nt, Homo sapiens
cugcauccccuuggcugugag

SEQ ID NO: 389354 - RNA, 20 nt, Homo sapiens
cugccaacacgcccggcuaa

SEQ ID NO: 389355 - RNA, 22 nt, Homo sapiens
cugccaacacgcccggcuaauu

SEQ ID NO: 389356 - RNA, 20 nt, Homo sapiens
cugccagugccuuaccuccu

SEQ ID NO: 389357 - RNA, 19 nt, Homo sapiens
cugcccacacagguucacg

SEQ ID NO: 389358 - RNA, 21 nt, Homo sapiens
cugccccaaacaaauaugcaa

SEQ ID NO: 389359 - RNA, 16 nt, Homo sapiens
cugcccccaauccaug

SEQ ID NO: 389360 - RNA, 15 nt, Homo sapiens
cugcuaacuccuagc

SEQ ID NO: 389361 - RNA, 16 nt, Homo sapiens
cugcuaccucacuggg

SEQ ID NO: 389362 - RNA, 12 nt, Homo sapiens
cugcuauaacua

SEQ ID NO: 389363 - RNA, 12 nt, Homo sapiens
cugcuccagcug

SEQ ID NO: 389364 - RNA, 15 nt, Homo sapiens
cugcucuuucucugc

SEQ ID NO: 389365 - RNA, 13 nt, Homo sapiens
cugcugaccucca

SEQ ID NO: 389366 - RNA, 18 nt, Homo sapiens
cugcugaccuccacagcu

SEQ ID NO: 389367 - RNA, 11 nt, Homo sapiens
cugcugugaau

SEQ ID NO: 389368 - RNA, 21 nt, Homo sapiens
cugcuuacaauucccugcugu

SEQ ID NO: 389369 - RNA, 15 nt, Homo sapiens
cugcuugaacccagg

SEQ ID NO: 389370 - RNA, 22 nt, Homo sapiens
cugcuugaggaaaacaagcauu

SEQ ID NO: 389371 - RNA, 16 nt, Homo sapiens
cuggaaggugcuguua

SEQ ID NO: 389372 - RNA, 22 nt, Homo sapiens
cuggaaucacauucuuagcaca

SEQ ID NO: 389373 - RNA, 18 nt, Homo sapiens
cuggacacagccccaugu

SEQ ID NO: 389374 - RNA, 12 nt, Homo sapiens
cuggacucagga

SEQ ID NO: 389375 - RNA, 13 nt, Homo sapiens
cuggacucucagu

SEQ ID NO: 389376 - RNA, 13 nt, Homo sapiens
cuggagcucugcc

SEQ ID NO: 389377 - RNA, 16 nt, Homo sapiens
cuggaggucaggaguu

SEQ ID NO: 389378 - RNA, 21 nt, Homo sapiens
cuggauaacuuagguggcaag

SEQ ID NO: 389379 - RNA, 19 nt, Homo sapiens
cuggaugauggucuucagc

SEQ ID NO: 389380 - RNA, 22 nt, Homo sapiens
cuggauuuccuaggcugacuaa

SEQ ID NO: 389381 - RNA, 16 nt, Homo sapiens
cuggcagaaagcaaau

SEQ ID NO: 389382 - RNA, 14 nt, Homo sapiens
aaaaacaaauggga

SEQ ID NO: 389383 - RNA, 18 nt, Homo sapiens
aaaaagacauucuuccaa

SEQ ID NO: 389384 - RNA, 13 nt, Homo sapiens
aaaaauauuauaa

SEQ ID NO: 389385 - RNA, 15 nt, Homo sapiens
aaaaaucccuuaccu

SEQ ID NO: 389386 - RNA, 17 nt, Homo sapiens
aaaaaugaugggacaau

SEQ ID NO: 389387 - RNA, 20 nt, Homo sapiens
aaaaauguauuuuuccuaaa

SEQ ID NO: 389388 - RNA, 20 nt, Homo sapiens
aaaacaaaugggaaaauguc

SEQ ID NO: 389389 - RNA, 19 nt, Homo sapiens
aaaacaauuguaauaaugc

SEQ ID NO: 389390 - RNA, 13 nt, Homo sapiens
aaaacacacuccu

SEQ ID NO: 389391 - RNA, 14 nt, Homo sapiens
aaaacacacuccuu

SEQ ID NO: 389392 - RNA, 14 nt, Homo sapiens
aaaacacugugcac

SEQ ID NO: 389393 - RNA, 13 nt, Homo sapiens
aaaacacuuccau

SEQ ID NO: 389394 - RNA, 13 nt, Homo sapiens
aaaacagaaagca

SEQ ID NO: 389395 - RNA, 11 nt, Homo sapiens
aaaacaucacu

SEQ ID NO: 389396 - RNA, 17 nt, Homo sapiens
aaaaccagcgugugacu

SEQ ID NO: 389397 - RNA, 14 nt, Homo sapiens
aaaaccgaguugcc

SEQ ID NO: 389398 - RNA, 18 nt, Homo sapiens
aaaaccugugugccauuu

SEQ ID NO: 389399 - RNA, 21 nt, Homo sapiens
aaaacuccacagucaauauua

SEQ ID NO: 389400 - RNA, 11 nt, Homo sapiens
aaaacugacuc

SEQ ID NO: 389401 - RNA, 22 nt, Homo sapiens
aaaacuugauguguuaucucuu

SEQ ID NO: 389402 - RNA, 17 nt, Homo sapiens
aaaacuugcugccugaa

SEQ ID NO: 389403 - RNA, 18 nt, Homo sapiens
aaaacuuuucuaauacuc

SEQ ID NO: 389404 - RNA, 17 nt, Homo sapiens
aaaagacaagacuucag

SEQ ID NO: 389405 - RNA, 16 nt, Homo sapiens
aaaagacauucuucca

SEQ ID NO: 389406 - RNA, 15 nt, Homo sapiens
aaaagaccaguccau

SEQ ID NO: 389407 - RNA, 22 nt, Homo sapiens
aaaagaugcauuaucuaugaua

SEQ ID NO: 389408 - RNA, 19 nt, Homo sapiens
aaaagcccaugaucuucaa

SEQ ID NO: 389409 - RNA, 13 nt, Homo sapiens
aaaagcugggcag

SEQ ID NO: 389410 - RNA, 10 nt, Homo sapiens
aaaagcuuuu

SEQ ID NO: 389411 - RNA, 23 nt, Homo sapiens
aaaaggcaccuauaaaacagguc

SEQ ID NO: 389412 - RNA, 19 nt, Homo sapiens
aaaaguccuugauuuagca

SEQ ID NO: 389413 - RNA, 13 nt, Homo sapiens
aaaaguuacuuau

SEQ ID NO: 389414 - RNA, 15 nt, Homo sapiens
aaaaguuaugguacu

SEQ ID NO: 389415 - RNA, 12 nt, Homo sapiens
aaaauaacuuau

SEQ ID NO: 389416 - RNA, 13 nt, Homo sapiens
aaaauacaugaca

SEQ ID NO: 389417 - RNA, 14 nt, Homo sapiens
aaaauaccaugcca

SEQ ID NO: 389418 - RNA, 13 nt, Homo sapiens
aaaauagcaacac

SEQ ID NO: 389419 - RNA, 20 nt, Homo sapiens
aaaauauagcuguacaaaua

SEQ ID NO: 389420 - RNA, 19 nt, Homo sapiens
aaaauauuauguguuucca

SEQ ID NO: 389421 - RNA, 15 nt, Homo sapiens
aaaaucauuucugca

SEQ ID NO: 389422 - RNA, 12 nt, Homo sapiens
aaaaucuuggau

SEQ ID NO: 389423 - RNA, 19 nt, Homo sapiens
aaaaugaauaauacauuga

SEQ ID NO: 389424 - RNA, 18 nt, Homo sapiens
aaaaugcuuucuuggcca

SEQ ID NO: 389425 - RNA, 15 nt, Homo sapiens
aaaauguauuuuucc

SEQ ID NO: 389426 - RNA, 21 nt, Homo sapiens
aaaauuagccgggcauggugg

SEQ ID NO: 389427 - RNA, 15 nt, Homo sapiens
aaaauucuuggaaua

SEQ ID NO: 389428 - RNA, 19 nt, Homo sapiens
aaaauuuuuugugauuuca

SEQ ID NO: 389429 - RNA, 20 nt, Homo sapiens
aaaauuuuuugugauuucaa

SEQ ID NO: 389430 - RNA, 19 nt, Homo sapiens
aaacaauucuuauugacuc

SEQ ID NO: 389431 - RNA, 19 nt, Homo sapiens
aaacacagacauucugcca

SEQ ID NO: 389432 - RNA, 21 nt, Homo sapiens
aaacagcagauuucagaucau

SEQ ID NO: 389433 - RNA, 17 nt, Homo sapiens
aaacauuuaacuuguuu

SEQ ID NO: 389434 - RNA, 14 nt, Homo sapiens
aaaccaaggcuaga

SEQ ID NO: 389435 - RNA, 16 nt, Homo sapiens
aaaccaauagcuuuaa

SEQ ID NO: 389436 - RNA, 16 nt, Homo sapiens
aaaccgagugcaauga

SEQ ID NO: 389437 - RNA, 20 nt, Homo sapiens
aaaccucugggucaucucuc

SEQ ID NO: 389438 - RNA, 17 nt, Homo sapiens
aaaccugugugccauuu

SEQ ID NO: 389439 - RNA, 16 nt, Homo sapiens
aaacguccuacuguau

SEQ ID NO: 389440 - RNA, 18 nt, Homo sapiens
aaacuauguaacauguag

SEQ ID NO: 389441 - RNA, 17 nt, Homo sapiens
aaacugaaaaucuaaua

SEQ ID NO: 389442 - RNA, 22 nt, Homo sapiens
aaacugagaugugaacacauca

SEQ ID NO: 389443 - RNA, 20 nt, Homo sapiens
aaacugauuuaucuauuuaa

SEQ ID NO: 389444 - RNA, 19 nt, Homo sapiens
aaacugcacugucaagaug

SEQ ID NO: 389445 - RNA, 17 nt, Homo sapiens
aaacuguagucucagga

SEQ ID NO: 389446 - RNA, 19 nt, Homo sapiens
aaacuuguaaaugcuguca

SEQ ID NO: 389447 - RNA, 14 nt, Homo sapiens
aaagaaauagccaa

SEQ ID NO: 389448 - RNA, 20 nt, Homo sapiens
acagcgagacuccgucucaa

SEQ ID NO: 389449 - RNA, 20 nt, Homo sapiens
acagcucgggcccucuguga

SEQ ID NO: 389450 - RNA, 21 nt, Homo sapiens
acagcucugcauacucauuag

SEQ ID NO: 389451 - RNA, 15 nt, Homo sapiens
acagcugucccuguc

SEQ ID NO: 389452 - RNA, 21 nt, Homo sapiens
acagcuucacaaauucucaca

SEQ ID NO: 389453 - RNA, 21 nt, Homo sapiens
acagcuugaguggguucucug

SEQ ID NO: 389454 - RNA, 15 nt, Homo sapiens
acaggacuagcugga

SEQ ID NO: 389455 - RNA, 19 nt, Homo sapiens
acaggauuauuggaaauuu

SEQ ID NO: 389456 - RNA, 14 nt, Homo sapiens
acaggcagcauuua

SEQ ID NO: 389457 - RNA, 15 nt, Homo sapiens
acaggcagcauuuag

SEQ ID NO: 389458 - RNA, 21 nt, Homo sapiens
acaggcccuuccucuccacug

SEQ ID NO: 389459 - RNA, 21 nt, Homo sapiens
acaggcucuuagcagcuucca

SEQ ID NO: 389460 - RNA, 13 nt, Homo sapiens
acaguaaaucuca

SEQ ID NO: 389461 - RNA, 14 nt, Homo sapiens
acagucacauucca

SEQ ID NO: 389462 - RNA, 18 nt, Homo sapiens
acagugaaggcuguccuu

SEQ ID NO: 389463 - RNA, 13 nt, Homo sapiens
acaguuccuucag

SEQ ID NO: 389464 - RNA, 20 nt, Homo sapiens
acaguuccuucagcuuccau

SEQ ID NO: 389465 - RNA, 15 nt, Homo sapiens
acauaacaugcuuua

SEQ ID NO: 389466 - RNA, 20 nt, Homo sapiens
acauagaacucagagccaga

SEQ ID NO: 389467 - RNA, 12 nt, Homo sapiens
acauagcacaga

SEQ ID NO: 389468 - RNA, 12 nt, Homo sapiens
acauaugugcug

SEQ ID NO: 389469 - RNA, 13 nt, Homo sapiens
acaucaagcacag

SEQ ID NO: 389470 - RNA, 13 nt, Homo sapiens
acaucacuugaga

SEQ ID NO: 389471 - RNA, 18 nt, Homo sapiens
acaucuaguaggugcuug

SEQ ID NO: 389472 - RNA, 19 nt, Homo sapiens
acaucucagaaaacucugg

SEQ ID NO: 389473 - RNA, 17 nt, Homo sapiens
acaucucuuugauguca

SEQ ID NO: 389474 - RNA, 14 nt, Homo sapiens
acaugaaaacagaa

SEQ ID NO: 389475 - RNA, 17 nt, Homo sapiens
acaugagaucuagguga

SEQ ID NO: 389476 - RNA, 16 nt, Homo sapiens
acaugcaauuuugcau

SEQ ID NO: 389477 - RNA, 12 nt, Homo sapiens
acaugcaggcug

SEQ ID NO: 389478 - RNA, 18 nt, Homo sapiens
acaugcccuguucagcua

SEQ ID NO: 389479 - RNA, 20 nt, Homo sapiens
acaugccucugccaaaggau

SEQ ID NO: 389480 - RNA, 16 nt, Homo sapiens
acauggaacgcuuuca

SEQ ID NO: 389481 - RNA, 17 nt, Homo sapiens
acauggaacgcuuucau

SEQ ID NO: 389482 - RNA, 21 nt, Homo sapiens
acauggcuaaagaagguuuca

SEQ ID NO: 389483 - RNA, 13 nt, Homo sapiens
acaugugguggga

SEQ ID NO: 389484 - RNA, 21 nt, Homo sapiens
acauguuccuuauauuuacuc

SEQ ID NO: 389485 - RNA, 13 nt, Homo sapiens
acauucuuccaaa

SEQ ID NO: 389486 - RNA, 11 nt, Homo sapiens
acauugaacaa

SEQ ID NO: 389487 - RNA, 20 nt, Homo sapiens
acauugaauuagaaacauaa

SEQ ID NO: 389488 - RNA, 16 nt, Homo sapiens
acauugcuugugccac

SEQ ID NO: 389489 - RNA, 20 nt, Homo sapiens
acauugcuugugccacaccc

SEQ ID NO: 389490 - RNA, 16 nt, Homo sapiens
acauuuccaaaugaau

SEQ ID NO: 389491 - RNA, 22 nt, Homo sapiens
acauuugaaaucuaugaaauau

SEQ ID NO: 389492 - RNA, 13 nt, Homo sapiens
acauuugggagac

SEQ ID NO: 389493 - RNA, 12 nt, Homo sapiens
accaaaggugaa

SEQ ID NO: 389494 - RNA, 15 nt, Homo sapiens
accaaguggcuccca

SEQ ID NO: 389495 - RNA, 20 nt, Homo sapiens
accacacagccaaggggaug

SEQ ID NO: 389496 - RNA, 15 nt, Homo sapiens
accacaccaaaccuc

SEQ ID NO: 389497 - RNA, 18 nt, Homo sapiens
accacaggcagcauuuag

SEQ ID NO: 389498 - RNA, 23 nt, Homo sapiens
accacaggcagcauuuagcacau

SEQ ID NO: 389499 - RNA, 18 nt, Homo sapiens
accaccagaucagguaua

SEQ ID NO: 389500 - RNA, 19 nt, Homo sapiens
accaccucccucaccaaca

SEQ ID NO: 389501 - RNA, 20 nt, Homo sapiens
accaccuucccagcucuccc

SEQ ID NO: 389502 - RNA, 15 nt, Homo sapiens
accagaagcauuuca

SEQ ID NO: 389503 - RNA, 14 nt, Homo sapiens
accagacuguguau

SEQ ID NO: 389504 - RNA, 14 nt, Homo sapiens
accagaggacaaag

SEQ ID NO: 389505 - RNA, 18 nt, Homo sapiens
accagaggacaaagccuu

SEQ ID NO: 389506 - RNA, 19 nt, Homo sapiens
accagcagaucccagcuca

SEQ ID NO: 389507 - RNA, 15 nt, Homo sapiens
accagcagcuggaau

SEQ ID NO: 389508 - RNA, 22 nt, Homo sapiens
accagccaagagggcugcaaaa

SEQ ID NO: 389509 - RNA, 23 nt, Homo sapiens
accagccugcacuacucccucaa

SEQ ID NO: 389510 - RNA, 15 nt, Homo sapiens
accagcuuugcagug

SEQ ID NO: 389511 - RNA, 22 nt, Homo sapiens
accaggaaccuccuccacacca

SEQ ID NO: 389512 - RNA, 17 nt, Homo sapiens
accaggaggcggcagug

SEQ ID NO: 389513 - RNA, 23 nt, Homo sapiens
accaggaggcggcagugcaacaa

SEQ ID NO: 389514 - RNA, 13 nt, Homo sapiens
accaguccaugag

SEQ ID NO: 389515 - RNA, 22 nt, Homo sapiens
accaguccuguuugcagggaag

SEQ ID NO: 389516 - RNA, 17 nt, Homo sapiens
accagucugacccuuac

SEQ ID NO: 389517 - RNA, 13 nt, Homo sapiens
accauaauguuac

SEQ ID NO: 389518 - RNA, 11 nt, Homo sapiens
accaucugcau

SEQ ID NO: 389519 - RNA, 20 nt, Homo sapiens
accaugauuaaccacuucag

SEQ ID NO: 389520 - RNA, 14 nt, Homo sapiens
accaugccauuuaa

SEQ ID NO: 389521 - RNA, 13 nt, Homo sapiens
accaugguaauaa

SEQ ID NO: 389522 - RNA, 17 nt, Homo sapiens
accauguuagccaggau

SEQ ID NO: 389523 - RNA, 14 nt, Homo sapiens
acccaaaaggcaga

SEQ ID NO: 389524 - RNA, 17 nt, Homo sapiens
acccaaauguucaucaa

SEQ ID NO: 389525 - RNA, 19 nt, Homo sapiens
acccaauauuuaccagacc

SEQ ID NO: 389526 - RNA, 15 nt, Homo sapiens
acccaccucagccuc

SEQ ID NO: 389527 - RNA, 17 nt, Homo sapiens
acccacgugcuguucca

SEQ ID NO: 389528 - RNA, 13 nt, Homo sapiens
acccacucagcuc

SEQ ID NO: 389529 - RNA, 16 nt, Homo sapiens
acccagacagcucccu

SEQ ID NO: 389530 - RNA, 20 nt, Homo sapiens
acccaggacuuccauuugcu

SEQ ID NO: 389531 - RNA, 21 nt, Homo sapiens
acccagucagaguugugcaca

SEQ ID NO: 389532 - RNA, 23 nt, Homo sapiens
acccagucagaguugugcacaug

SEQ ID NO: 389533 - RNA, 15 nt, Homo sapiens
accccaguaagccac

SEQ ID NO: 389534 - RNA, 16 nt, Homo sapiens
accccaguaagccacu

SEQ ID NO: 389535 - RNA, 15 nt, Homo sapiens
accccccagaaccug

SEQ ID NO: 389536 - RNA, 22 nt, Homo sapiens
accccccagaaccuguccuugc

SEQ ID NO: 389537 - RNA, 19 nt, Homo sapiens
accccccugggcugagaga

SEQ ID NO: 389538 - RNA, 20 nt, Homo sapiens
acccccggaacaagccuaaa

SEQ ID NO: 389539 - RNA, 21 nt, Homo sapiens
accccgucgaggggcucucag

SEQ ID NO: 389540 - RNA, 16 nt, Homo sapiens
accccucaacaccucu

SEQ ID NO: 389541 - RNA, 16 nt, Homo sapiens
accccuccuuccuuga

SEQ ID NO: 389542 - RNA, 20 nt, Homo sapiens
accccugcuccccugagcug

SEQ ID NO: 389543 - RNA, 18 nt, Homo sapiens
acccgguguaugccaagu

SEQ ID NO: 389544 - RNA, 17 nt, Homo sapiens
acccuagucuuuuaaac

SEQ ID NO: 389545 - RNA, 16 nt, Homo sapiens
acccugagccugugug

SEQ ID NO: 389546 - RNA, 17 nt, Homo sapiens
acccugcaaaaugagac

SEQ ID NO: 389547 - RNA, 24 nt, Homo sapiens
acccugcaaaauuugaugccagga

SEQ ID NO: 389548 - RNA, 18 nt, Homo sapiens
acccugccuuaucuugca

SEQ ID NO: 389549 - RNA, 22 nt, Homo sapiens
acccuggaccaguggucucaca

SEQ ID NO: 389550 - RNA, 14 nt, Homo sapiens
acccugggaccaca

SEQ ID NO: 389551 - RNA, 16 nt, Homo sapiens
acccugggaccacaga

SEQ ID NO: 389552 - RNA, 16 nt, Homo sapiens
acccugugcagaaccu

SEQ ID NO: 389553 - RNA, 21 nt, Homo sapiens
acccuugacaccugcugagaa

SEQ ID NO: 389554 - RNA, 19 nt, Homo sapiens
acccuuggagccaauggag

SEQ ID NO: 389555 - RNA, 13 nt, Homo sapiens
accgagcaauuuu

SEQ ID NO: 389556 - RNA, 16 nt, Homo sapiens
accgaguggcugucau

SEQ ID NO: 389557 - RNA, 13 nt, Homo sapiens
accgcaaugugac

SEQ ID NO: 389558 - RNA, 22 nt, Homo sapiens
accguccucaccccuguccuca

SEQ ID NO: 389559 - RNA, 23 nt, Homo sapiens
accuaaaaggaaaucucacccca

SEQ ID NO: 389560 - RNA, 22 nt, Homo sapiens
accuacugauaaccacuccuaa

SEQ ID NO: 389561 - RNA, 17 nt, Homo sapiens
accuacuuucauacuga

SEQ ID NO: 389562 - RNA, 14 nt, Homo sapiens
accuagggauguuc

SEQ ID NO: 389563 - RNA, 17 nt, Homo sapiens
accuaguagucauuuca

SEQ ID NO: 389564 - RNA, 16 nt, Homo sapiens
accucaaaaugucuaa

SEQ ID NO: 389565 - RNA, 22 nt, Homo sapiens
accucagggcuguguguacuaa

SEQ ID NO: 389566 - RNA, 15 nt, Homo sapiens
accuccacagcuucc

SEQ ID NO: 389567 - RNA, 15 nt, Homo sapiens
accuccccaacagca

SEQ ID NO: 389568 - RNA, 21 nt, Homo sapiens
accucggugggcccagugggg

SEQ ID NO: 389569 - RNA, 19 nt, Homo sapiens
accucgugauccaccugcc

SEQ ID NO: 389570 - RNA, 22 nt, Homo sapiens
accucuccaaccuaacuggcuu

SEQ ID NO: 389571 - RNA, 15 nt, Homo sapiens
accucuugaaaauag

SEQ ID NO: 389572 - RNA, 15 nt, Homo sapiens
accugggcaaagccu

SEQ ID NO: 389573 - RNA, 16 nt, Homo sapiens
accuguaaucauauaa

SEQ ID NO: 389574 - RNA, 13 nt, Homo sapiens
accuguccuugca

SEQ ID NO: 389575 - RNA, 21 nt, Homo sapiens
accugugcacguuggaacuuu

SEQ ID NO: 389576 - RNA, 14 nt, Homo sapiens
accugugugccagg

SEQ ID NO: 389577 - RNA, 19 nt, Homo sapiens
accuguuuuuaagcuguuu

SEQ ID NO: 389578 - RNA, 22 nt, Homo sapiens
accuuacauuugaaaucuauga

SEQ ID NO: 389579 - RNA, 18 nt, Homo sapiens
accuuaccaacuuucugu

SEQ ID NO: 389580 - RNA, 20 nt, Homo sapiens
accuugcacaaacagccccu

SEQ ID NO: 389581 - RNA, 21 nt, Homo sapiens
accuuuauugugaucuaucaa

SEQ ID NO: 389582 - RNA, 15 nt, Homo sapiens
accuuuggagcaaag

SEQ ID NO: 389583 - RNA, 12 nt, Homo sapiens
acgagcagggau

SEQ ID NO: 389584 - RNA, 20 nt, Homo sapiens
acgccuccccuuugugacuu

SEQ ID NO: 389585 - RNA, 16 nt, Homo sapiens
acgcugguagagaugg

SEQ ID NO: 389586 - RNA, 16 nt, Homo sapiens
acggagucuugcucug

SEQ ID NO: 389587 - RNA, 23 nt, Homo sapiens
acggaugauuggauuauucauuu

SEQ ID NO: 389588 - RNA, 22 nt, Homo sapiens
acgggacccugagccugugugu

SEQ ID NO: 389589 - RNA, 17 nt, Homo sapiens
acgggagaauauacaaa

SEQ ID NO: 389590 - RNA, 19 nt, Homo sapiens
agacugucucaagagggca

SEQ ID NO: 389591 - RNA, 22 nt, Homo sapiens
agacuguggcugcuagcacuug

SEQ ID NO: 389592 - RNA, 17 nt, Homo sapiens
agacuucugcuuuccac

SEQ ID NO: 389593 - RNA, 18 nt, Homo sapiens
agacuuucuuaucacuua

SEQ ID NO: 389594 - RNA, 13 nt, Homo sapiens
agagaacuggagg

SEQ ID NO: 389595 - RNA, 20 nt, Homo sapiens
agagaauucucuuauccaac

SEQ ID NO: 389596 - RNA, 13 nt, Homo sapiens
agagacaccugca

SEQ ID NO: 389597 - RNA, 18 nt, Homo sapiens
agagacgcagacaugugc

SEQ ID NO: 389598 - RNA, 15 nt, Homo sapiens
agagagaaagccagg

SEQ ID NO: 389599 - RNA, 14 nt, Homo sapiens
agagagggggccac

SEQ ID NO: 389600 - RNA, 20 nt, Homo sapiens
agagauggggucucacagug

SEQ ID NO: 389601 - RNA, 19 nt, Homo sapiens
agagcaagacucugucuca

SEQ ID NO: 389602 - RNA, 19 nt, Homo sapiens
agagcacacuguagcauua

SEQ ID NO: 389603 - RNA, 13 nt, Homo sapiens
agagcagggauua

SEQ ID NO: 389604 - RNA, 18 nt, Homo sapiens
agagccagacugucucaa

SEQ ID NO: 389605 - RNA, 22 nt, Homo sapiens
agagccagacugucucaaauaa

SEQ ID NO: 389606 - RNA, 16 nt, Homo sapiens
agagcuacacaaacac

SEQ ID NO: 389607 - RNA, 15 nt, Homo sapiens
agagcucacuaaaau

SEQ ID NO: 389608 - RNA, 17 nt, Homo sapiens
agaggagaaacuggaac

SEQ ID NO: 389609 - RNA, 15 nt, Homo sapiens
agaggagaaggaggg

SEQ ID NO: 389610 - RNA, 21 nt, Homo sapiens
agaggagagagacuccagcug

SEQ ID NO: 389611 - RNA, 18 nt, Homo sapiens
agaggcucccucuugacg

SEQ ID NO: 389612 - RNA, 13 nt, Homo sapiens
agaggggaaaaug

SEQ ID NO: 389613 - RNA, 14 nt, Homo sapiens
agaggggggcugcc

SEQ ID NO: 389614 - RNA, 13 nt, Homo sapiens
agaggggguagcu

SEQ ID NO: 389615 - RNA, 21 nt, Homo sapiens
agaguccuauuugcacuguag

SEQ ID NO: 389616 - RNA, 23 nt, Homo sapiens
agagucuucuccaauguccaaaa

SEQ ID NO: 389617 - RNA, 13 nt, Homo sapiens
agagugucuuucc

SEQ ID NO: 389618 - RNA, 19 nt, Homo sapiens
agaguguuaucagucauaa

SEQ ID NO: 389619 - RNA, 15 nt, Homo sapiens
gugaaagaggcagcu

SEQ ID NO: 389620 - RNA, 14 nt, Homo sapiens
gugaaauaagccag

SEQ ID NO: 389621 - RNA, 20 nt, Homo sapiens
gugaaauaagccagacauca

SEQ ID NO: 389622 - RNA, 19 nt, Homo sapiens
gugaaaugcuggcauuugc

SEQ ID NO: 389623 - RNA, 17 nt, Homo sapiens
gugaaccuuaguaccua

SEQ ID NO: 389624 - RNA, 15 nt, Homo sapiens
gugaacugugagggu

SEQ ID NO: 389625 - RNA, 16 nt, Homo sapiens
gugaaugauucagugu

SEQ ID NO: 389626 - RNA, 20 nt, Homo sapiens
gugaauguggauucuuccca

SEQ ID NO: 389627 - RNA, 20 nt, Homo sapiens
gugacaucucuuugauguca

SEQ ID NO: 389628 - RNA, 19 nt, Homo sapiens
gugacauuuccaugcauaa

SEQ ID NO: 389629 - RNA, 21 nt, Homo sapiens
gugacuucuccaggucucacg

SEQ ID NO: 389630 - RNA, 20 nt, Homo sapiens
gugagaaucaaaacucuccu

SEQ ID NO: 389631 - RNA, 17 nt, Homo sapiens
gugagacagcucugcau

SEQ ID NO: 389632 - RNA, 15 nt, Homo sapiens
gugagccaagauugc

SEQ ID NO: 389633 - RNA, 18 nt, Homo sapiens
gugaggaugucacucaga

SEQ ID NO: 389634 - RNA, 15 nt, Homo sapiens
gugaguguguccaag

SEQ ID NO: 389635 - RNA, 23 nt, Homo sapiens
gugauacaacuucaagugcaugc

SEQ ID NO: 389636 - RNA, 13 nt, Homo sapiens
gugauugugccag

SEQ ID NO: 389637 - RNA, 13 nt, Homo sapiens
gugcaaguguaug

SEQ ID NO: 389638 - RNA, 15 nt, Homo sapiens
gugcaaguguguaug

SEQ ID NO: 389639 - RNA, 16 nt, Homo sapiens
gugcaagugugugcac

SEQ ID NO: 389640 - RNA, 17 nt, Homo sapiens
gugcaugcagcaucuaa

SEQ ID NO: 389641 - RNA, 15 nt, Homo sapiens
gugcaugugcacuug

SEQ ID NO: 389642 - RNA, 15 nt, Homo sapiens
gugcaugugugcgag

SEQ ID NO: 389643 - RNA, 15 nt, Homo sapiens
gugcauuucuaggac

SEQ ID NO: 389644 - RNA, 13 nt, Homo sapiens
gugccaagcacag

SEQ ID NO: 389645 - RNA, 15 nt, Homo sapiens
gugcccaccaacauc

SEQ ID NO: 389646 - RNA, 20 nt, Homo sapiens
gugcccccagacgcacgugg

SEQ ID NO: 389647 - RNA, 22 nt, Homo sapiens
gugccucugggacuggacaauu

SEQ ID NO: 389648 - RNA, 17 nt, Homo sapiens
gugcgugugcgugcaug

SEQ ID NO: 389649 - RNA, 15 nt, Homo sapiens
gugcgugugugcaag

SEQ ID NO: 389650 - RNA, 15 nt, Homo sapiens
gugcuagaugugcaa

SEQ ID NO: 389651 - RNA, 17 nt, Homo sapiens
gugcuaucgcaccacug

SEQ ID NO: 389652 - RNA, 16 nt, Homo sapiens
gugcucaggacucaga

SEQ ID NO: 389653 - RNA, 20 nt, Homo sapiens
guggagaaauuccuugauuc

SEQ ID NO: 389654 - RNA, 21 nt, Homo sapiens
guggauucuucccacacagaa

SEQ ID NO: 389655 - RNA, 21 nt, Homo sapiens
guggcacuuacccacgugcug

SEQ ID NO: 389656 - RNA, 21 nt, Homo sapiens
guggcagauaaucagccucuu

SEQ ID NO: 389657 - RNA, 21 nt, Homo sapiens
gugggagcuugauucucagca

SEQ ID NO: 389658 - RNA, 22 nt, Homo sapiens
gugggagcuuuugguaugugac

SEQ ID NO: 389659 - RNA, 11 nt, Homo sapiens
gugggccacag

SEQ ID NO: 389660 - RNA, 20 nt, Homo sapiens
guggguacucaauguguacu

SEQ ID NO: 389661 - RNA, 22 nt, Homo sapiens
gugggugccccccuugccagac

SEQ ID NO: 389662 - RNA, 14 nt, Homo sapiens
guguaagaaacaca

SEQ ID NO: 389663 - RNA, 20 nt, Homo sapiens
guguacagugaaaagucucc

SEQ ID NO: 389664 - RNA, 20 nt, Homo sapiens
guguacguggagagggauga

SEQ ID NO: 389665 - RNA, 23 nt, Homo sapiens
guguauauaguaugaaugcagug

SEQ ID NO: 389666 - RNA, 19 nt, Homo sapiens
guguaugcacgugugcaca

SEQ ID NO: 389667 - RNA, 22 nt, Homo sapiens
gugucagagcccagcucaugca

SEQ ID NO: 389668 - RNA, 16 nt, Homo sapiens
guguccccuccacugu

SEQ ID NO: 389669 - RNA, 17 nt, Homo sapiens
gugugagugugugcaag

SEQ ID NO: 389670 - RNA, 20 nt, Homo sapiens
gugugcaagugugugcaugu

SEQ ID NO: 389671 - RNA, 23 nt, Homo sapiens
gugugcuuauuuuaaauguuacu

SEQ ID NO: 389672 - RNA, 22 nt, Homo sapiens
guguggcccagggaagccaaaa

SEQ ID NO: 389673 - RNA, 20 nt, Homo sapiens
gugugguggggacaacagca

SEQ ID NO: 389674 - RNA, 16 nt, Homo sapiens
guguguaguaaaguau

SEQ ID NO: 389675 - RNA, 23 nt, Homo sapiens
guguguaugugcgugugugcaag

SEQ ID NO: 389676 - RNA, 20 nt, Homo sapiens
gugugugcaaguaugugagu

SEQ ID NO: 389677 - RNA, 14 nt, Homo sapiens
guguuaaaugugau

SEQ ID NO: 389678 - RNA, 21 nt, Homo sapiens
guguuaucagucauaacuaaa

SEQ ID NO: 389679 - RNA, 12 nt, Homo sapiens
guguuggugcug

SEQ ID NO: 389680 - RNA, 17 nt, Homo sapiens
guguuuccacagccugc

SEQ ID NO: 389681 - RNA, 13 nt, Homo sapiens
guguuuccuucag

SEQ ID NO: 389682 - RNA, 12 nt, Homo sapiens
guuaacaucuca

SEQ ID NO: 389683 - RNA, 18 nt, Homo sapiens
guuaaggguuaguuuaca

SEQ ID NO: 389684 - RNA, 12 nt, Homo sapiens
guuaagugcagg

SEQ ID NO: 389685 - RNA, 18 nt, Homo sapiens
guuaauaaguuucacuga

SEQ ID NO: 389686 - RNA, 13 nt, Homo sapiens
guuaaugccacaa

SEQ ID NO: 389687 - RNA, 10 nt, Homo sapiens
guuaccuaau

SEQ ID NO: 389688 - RNA, 18 nt, Homo sapiens
guuacugaucuuacucac

SEQ ID NO: 389689 - RNA, 14 nt, Homo sapiens
guuacugucuucag

SEQ ID NO: 389690 - RNA, 19 nt, Homo sapiens
guuacuguggccaguauuu

SEQ ID NO: 389691 - RNA, 21 nt, Homo sapiens
guuagaggccagccuggcgaa

SEQ ID NO: 389692 - RNA, 18 nt, Homo sapiens
guuaggaaauaaaaccuu

SEQ ID NO: 389693 - RNA, 14 nt, Homo sapiens
guuaguuccuucau

SEQ ID NO: 389694 - RNA, 19 nt, Homo sapiens
guuauuuaugccucuguau

SEQ ID NO: 389695 - RNA, 15 nt, Homo sapiens
guuauuuuaauuauc

SEQ ID NO: 389696 - RNA, 11 nt, Homo sapiens
guucacuccca

SEQ ID NO: 389697 - RNA, 24 nt, Homo sapiens
guucagcacugucccuugccucaa

SEQ ID NO: 389698 - RNA, 14 nt, Homo sapiens
guucagcugcccca

SEQ ID NO: 389699 - RNA, 24 nt, Homo sapiens
guuccauaugugggugucagucag

SEQ ID NO: 389700 - RNA, 20 nt, Homo sapiens
guuccccacugacagccucc

SEQ ID NO: 389701 - RNA, 14 nt, Homo sapiens
guucccccacugau

SEQ ID NO: 389702 - RNA, 16 nt, Homo sapiens
guucccuauuuugcca

SEQ ID NO: 389703 - RNA, 15 nt, Homo sapiens
guucuauuuguauau

SEQ ID NO: 389704 - RNA, 22 nt, Homo sapiens
guucucauuuuuaucccauuga

SEQ ID NO: 389705 - RNA, 19 nt, Homo sapiens
guucuccuagacugacccu

SEQ ID NO: 389706 - RNA, 16 nt, Homo sapiens
guucugucucauauga

SEQ ID NO: 389707 - RNA, 20 nt, Homo sapiens
guucuucuuggucucagugu

SEQ ID NO: 389708 - RNA, 20 nt, Homo sapiens
guugcaaauacauggauaac

SEQ ID NO: 389709 - RNA, 19 nt, Homo sapiens
guugcacacccacucagcu

SEQ ID NO: 389710 - RNA, 19 nt, Homo sapiens
guugcaggaccucagguga

SEQ ID NO: 389711 - RNA, 15 nt, Homo sapiens
guugcagugagccgu

SEQ ID NO: 389712 - RNA, 14 nt, Homo sapiens
guugcccagugugu

SEQ ID NO: 389713 - RNA, 20 nt, Homo sapiens
guuggacacccagugccagg

SEQ ID NO: 389714 - RNA, 19 nt, Homo sapiens
guugucucuagagcaggga

SEQ ID NO: 389715 - RNA, 21 nt, Homo sapiens
guugucugaagucacugcaca

SEQ ID NO: 389716 - RNA, 15 nt, Homo sapiens
guuuauagaccagaa

SEQ ID NO: 389717 - RNA, 20 nt, Homo sapiens
guuuaugucaucauacauga

SEQ ID NO: 389718 - RNA, 19 nt, Homo sapiens
guuucaaaauaaaaaccaa

SEQ ID NO: 389719 - RNA, 20 nt, Homo sapiens
guuucauuuagucaugugac

SEQ ID NO: 389720 - RNA, 16 nt, Homo sapiens
guuuccacagccugca

SEQ ID NO: 389721 - RNA, 17 nt, Homo sapiens
guuuguaagguggucac

SEQ ID NO: 389722 - RNA, 21 nt, Homo sapiens
guuuucccugaccucccucua

SEQ ID NO: 389723 - RNA, 20 nt, Homo sapiens
guuuuuagauuaaacaaaca

SEQ ID NO: 389724 - RNA, 22 nt, Homo sapiens
uaaaaaacauaaauuucuuuaa

SEQ ID NO: 389725 - RNA, 15 nt, Homo sapiens
uaaaaagucuucacu

SEQ ID NO: 389726 - RNA, 19 nt, Homo sapiens
uaaaaaucaugagauccuu

SEQ ID NO: 389727 - RNA, 15 nt, Homo sapiens
uaaaaaugcaacuuc

SEQ ID NO: 389728 - RNA, 15 nt, Homo sapiens
uaaaacauuaagaaa

SEQ ID NO: 389729 - RNA, 14 nt, Homo sapiens
uaaaaccacagcag

SEQ ID NO: 389730 - RNA, 15 nt, Homo sapiens
uaaaaccacagcagu

SEQ ID NO: 389731 - RNA, 18 nt, Homo sapiens
uaaaaccaucauaguaca

SEQ ID NO: 389732 - RNA, 18 nt, Homo sapiens
uaaaacccaagugccuua

SEQ ID NO: 389733 - RNA, 12 nt, Homo sapiens
uaaaaccuuuca

SEQ ID NO: 389734 - RNA, 12 nt, Homo sapiens
uaaaagccauga

SEQ ID NO: 389735 - RNA, 17 nt, Homo sapiens
uaaaauaaaugcaauug

SEQ ID NO: 389736 - RNA, 24 nt, Homo sapiens
uaaaauaacuuauaucaucagcau

SEQ ID NO: 389737 - RNA, 17 nt, Homo sapiens
uaaaauacacacucaaa

SEQ ID NO: 389738 - RNA, 19 nt, Homo sapiens
uaaaaucauuucugcauca

SEQ ID NO: 389739 - RNA, 15 nt, Homo sapiens
uaaaauuagcuugag

SEQ ID NO: 389740 - RNA, 14 nt, Homo sapiens
uaaaauugcacuuu

SEQ ID NO: 389741 - RNA, 21 nt, Homo sapiens
uaaacacggggcuugcaacuu

SEQ ID NO: 389742 - RNA, 13 nt, Homo sapiens
uaaacucagggac

SEQ ID NO: 389743 - RNA, 13 nt, Homo sapiens
uaaacugugcacc

SEQ ID NO: 389744 - RNA, 21 nt, Homo sapiens
uaaacuuaccugggcauucuu

SEQ ID NO: 389745 - RNA, 20 nt, Homo sapiens
uaaagaaauauauaugauau

SEQ ID NO: 389746 - RNA, 18 nt, Homo sapiens
uaaagagagaugaaccac

SEQ ID NO: 389747 - RNA, 23 nt, Homo sapiens
cuggccuguaaucccagcuacuu

SEQ ID NO: 389748 - RNA, 18 nt, Homo sapiens
cugggaaggugaccacau

SEQ ID NO: 389749 - RNA, 22 nt, Homo sapiens
cugggagacuuugaagaccagu

SEQ ID NO: 389750 - RNA, 18 nt, Homo sapiens
cugggagcacaggcacug

SEQ ID NO: 389751 - RNA, 21 nt, Homo sapiens
cugggauccuaagggcucacc

SEQ ID NO: 389752 - RNA, 17 nt, Homo sapiens
cugggauuggcugugag

SEQ ID NO: 389753 - RNA, 17 nt, Homo sapiens
cuggggaacuagaggga

SEQ ID NO: 389754 - RNA, 11 nt, Homo sapiens
cuggggaccau

SEQ ID NO: 389755 - RNA, 15 nt, Homo sapiens
cuggggcaaugggag

SEQ ID NO: 389756 - RNA, 22 nt, Homo sapiens
cuggguuuuguauucucugagc

SEQ ID NO: 389757 - RNA, 14 nt, Homo sapiens
cugguaauauugac

SEQ ID NO: 389758 - RNA, 19 nt, Homo sapiens
cugguccagggcuagugac

SEQ ID NO: 389759 - RNA, 13 nt, Homo sapiens
cuggucucagugc

SEQ ID NO: 389760 - RNA, 15 nt, Homo sapiens
cuggugacccaguca

SEQ ID NO: 389761 - RNA, 16 nt, Homo sapiens
cuggugacccagucag

SEQ ID NO: 389762 - RNA, 17 nt, Homo sapiens
cugguuagguagaggga

SEQ ID NO: 389763 - RNA, 22 nt, Homo sapiens
cugguuguugccaaacagccac

SEQ ID NO: 389764 - RNA, 21 nt, Homo sapiens
cugguuuugacaucagcauua

SEQ ID NO: 389765 - RNA, 21 nt, Homo sapiens
cuguaaucccagcacuuuggg

SEQ ID NO: 389766 - RNA, 23 nt, Homo sapiens
cuguaaucccagcacuuugggag

SEQ ID NO: 389767 - RNA, 21 nt, Homo sapiens
cuguaauccuagcacuuuggg

SEQ ID NO: 389768 - RNA, 16 nt, Homo sapiens
cuguaccugugcacgu

SEQ ID NO: 389769 - RNA, 19 nt, Homo sapiens
cuguaggcacacuuugcac

SEQ ID NO: 389770 - RNA, 12 nt, Homo sapiens
cuguagucccag

SEQ ID NO: 389771 - RNA, 16 nt, Homo sapiens
cuguauaguacuggca

SEQ ID NO: 389772 - RNA, 16 nt, Homo sapiens
cuguauauacaauaac

SEQ ID NO: 389773 - RNA, 19 nt, Homo sapiens
cuguaucacagacuggcaa

SEQ ID NO: 389774 - RNA, 18 nt, Homo sapiens
cugucaaacaaagccaga

SEQ ID NO: 389775 - RNA, 21 nt, Homo sapiens
cugucaaacaaagccagaagc

SEQ ID NO: 389776 - RNA, 15 nt, Homo sapiens
cugucaucagccugu

SEQ ID NO: 389777 - RNA, 13 nt, Homo sapiens
cugucuccauggc

SEQ ID NO: 389778 - RNA, 15 nt, Homo sapiens
cugucuccuuucacc

SEQ ID NO: 389779 - RNA, 14 nt, Homo sapiens
cugucuuucacuga

SEQ ID NO: 389780 - RNA, 18 nt, Homo sapiens
cugugacuucuccagguc

SEQ ID NO: 389781 - RNA, 18 nt, Homo sapiens
cugugaggccccuggaca

SEQ ID NO: 389782 - RNA, 18 nt, Homo sapiens
cugugcaaauccuugaua

SEQ ID NO: 389783 - RNA, 23 nt, Homo sapiens
cuguggugugucccccucugucc

SEQ ID NO: 389784 - RNA, 16 nt, Homo sapiens
cugugguuaacaucuc

SEQ ID NO: 389785 - RNA, 22 nt, Homo sapiens
cuguguacagaauucugcuacc

SEQ ID NO: 389786 - RNA, 14 nt, Homo sapiens
cuguguaucugaua

SEQ ID NO: 389787 - RNA, 21 nt, Homo sapiens
cuguguauuuaacugccuugu

SEQ ID NO: 389788 - RNA, 19 nt, Homo sapiens
cugugugaugaacuuucuc

SEQ ID NO: 389789 - RNA, 12 nt, Homo sapiens
cugugugccauu

SEQ ID NO: 389790 - RNA, 23 nt, Homo sapiens
cugugugccauuuuaagaguuac

SEQ ID NO: 389791 - RNA, 17 nt, Homo sapiens
cuguguguacuaauaca

SEQ ID NO: 389792 - RNA, 15 nt, Homo sapiens
cuguuaccagaggac

SEQ ID NO: 389793 - RNA, 17 nt, Homo sapiens
cuguuagcauaauguga

SEQ ID NO: 389794 - RNA, 14 nt, Homo sapiens
cuguuauagagggu

SEQ ID NO: 389795 - RNA, 20 nt, Homo sapiens
cuguuggacacccagugcca

SEQ ID NO: 389796 - RNA, 17 nt, Homo sapiens
cuguuggcaaggugaca

SEQ ID NO: 389797 - RNA, 13 nt, Homo sapiens
cuguuucaccuuu

SEQ ID NO: 389798 - RNA, 22 nt, Homo sapiens
cuguuucugggcugucuauucu

SEQ ID NO: 389799 - RNA, 20 nt, Homo sapiens
cuuaacguuagaccacaaau

SEQ ID NO: 389800 - RNA, 21 nt, Homo sapiens
cuuaagccagcacucacacca

SEQ ID NO: 389801 - RNA, 14 nt, Homo sapiens
cuuacaauucccug

SEQ ID NO: 389802 - RNA, 18 nt, Homo sapiens
cuuacacuuuaugcacaa

SEQ ID NO: 389803 - RNA, 19 nt, Homo sapiens
cuuaccuagauucuacaua

SEQ ID NO: 389804 - RNA, 15 nt, Homo sapiens
cuuacuuaggugugg

SEQ ID NO: 389805 - RNA, 18 nt, Homo sapiens
cuuagaaauugcauuucc

SEQ ID NO: 389806 - RNA, 14 nt, Homo sapiens
cuuagaaauuguaa

SEQ ID NO: 389807 - RNA, 13 nt, Homo sapiens
cuuagaccucagc

SEQ ID NO: 389808 - RNA, 21 nt, Homo sapiens
cuuagagugggaccaacuucc

SEQ ID NO: 389809 - RNA, 18 nt, Homo sapiens
cuuagcacacucacagau

SEQ ID NO: 389810 - RNA, 16 nt, Homo sapiens
cuuagcagcuaucucu

SEQ ID NO: 389811 - RNA, 22 nt, Homo sapiens
cuuagcagcuaucucucaguga

SEQ ID NO: 389812 - RNA, 17 nt, Homo sapiens
cuuagcagcuuccagau

SEQ ID NO: 389813 - RNA, 18 nt, Homo sapiens
cuuagcccacaguucucc

SEQ ID NO: 389814 - RNA, 21 nt, Homo sapiens
cuuagcucacaccugaccaau

SEQ ID NO: 389815 - RNA, 17 nt, Homo sapiens
cuuagcuuagaccucag

SEQ ID NO: 389816 - RNA, 17 nt, Homo sapiens
cuuagguuggcaaaaag

SEQ ID NO: 389817 - RNA, 14 nt, Homo sapiens
cuuaguauuugcau

SEQ ID NO: 389818 - RNA, 15 nt, Homo sapiens
cuuauaucaucagca

SEQ ID NO: 389819 - RNA, 16 nt, Homo sapiens
cuuauugacucauaca

SEQ ID NO: 389820 - RNA, 17 nt, Homo sapiens
cuucaaccucauugaca

SEQ ID NO: 389821 - RNA, 15 nt, Homo sapiens
cuucacaugcaucaa

SEQ ID NO: 389822 - RNA, 13 nt, Homo sapiens
cuucacuuuacaa

SEQ ID NO: 389823 - RNA, 21 nt, Homo sapiens
cuucagccuagccgaccucag

SEQ ID NO: 389824 - RNA, 22 nt, Homo sapiens
aaaaugaaaauuaggauuucau

SEQ ID NO: 389825 - RNA, 13 nt, Homo sapiens
aaaaugaacugaa

SEQ ID NO: 389826 - RNA, 24 nt, Homo sapiens
aaaaugaacugaaguuucacauga

SEQ ID NO: 389827 - RNA, 21 nt, Homo sapiens
aaaaugaaucuucacaaaaca

SEQ ID NO: 389828 - RNA, 23 nt, Homo sapiens
aaaaugucuaagauaguaacaau

SEQ ID NO: 389829 - RNA, 13 nt, Homo sapiens
aaacaaauaugca

SEQ ID NO: 389830 - RNA, 16 nt, Homo sapiens
aaacacagacauucug

SEQ ID NO: 389831 - RNA, 20 nt, Homo sapiens
aaacagaaagcauccuaaau

SEQ ID NO: 389832 - RNA, 23 nt, Homo sapiens
aaacagaacugcagucagcauga

SEQ ID NO: 389833 - RNA, 15 nt, Homo sapiens
aaacagagaugugau

SEQ ID NO: 389834 - RNA, 20 nt, Homo sapiens
aaacagcagauuucagauca

SEQ ID NO: 389835 - RNA, 12 nt, Homo sapiens
aaacaggucaau

SEQ ID NO: 389836 - RNA, 19 nt, Homo sapiens
aaacagguggagaaauucc

SEQ ID NO: 389837 - RNA, 21 nt, Homo sapiens
aaacauuuaacuuguuuccaa

SEQ ID NO: 389838 - RNA, 14 nt, Homo sapiens
aaacccccacucca

SEQ ID NO: 389839 - RNA, 14 nt, Homo sapiens
aaaccucaaaaugu

SEQ ID NO: 389840 - RNA, 15 nt, Homo sapiens
aaaccuggaugucac

SEQ ID NO: 389841 - RNA, 14 nt, Homo sapiens
aaaccugugugcca

SEQ ID NO: 389842 - RNA, 17 nt, Homo sapiens
aaacuaaaucucuaaua

SEQ ID NO: 389843 - RNA, 18 nt, Homo sapiens
aaacuacacaucccuaau

SEQ ID NO: 389844 - RNA, 20 nt, Homo sapiens
aaacucagggacagagccau

SEQ ID NO: 389845 - RNA, 16 nt, Homo sapiens
aaacugacuuuauccu

SEQ ID NO: 389846 - RNA, 21 nt, Homo sapiens
aaacugccuuggcuucagggg

SEQ ID NO: 389847 - RNA, 14 nt, Homo sapiens
aaacuggauucaca

SEQ ID NO: 389848 - RNA, 12 nt, Homo sapiens
aaacugugcacc

SEQ ID NO: 389849 - RNA, 20 nt, Homo sapiens
aaacuuuaugcuaagugaaa

SEQ ID NO: 389850 - RNA, 17 nt, Homo sapiens
aaagaaaacacacuccu

SEQ ID NO: 389851 - RNA, 16 nt, Homo sapiens
aaagaaaguacagaac

SEQ ID NO: 389852 - RNA, 16 nt, Homo sapiens
aaagaaaugcccaucu

SEQ ID NO: 389853 - RNA, 18 nt, Homo sapiens
aaagaacucagugcugcc

SEQ ID NO: 389854 - RNA, 18 nt, Homo sapiens
aaagaccaaauuccuugg

SEQ ID NO: 389855 - RNA, 18 nt, Homo sapiens
aaagacugagcucaaggu

SEQ ID NO: 389856 - RNA, 19 nt, Homo sapiens
aaagacuuuccucuuaguc

SEQ ID NO: 389857 - RNA, 15 nt, Homo sapiens
aaagauuuucagaaa

SEQ ID NO: 389858 - RNA, 21 nt, Homo sapiens
aaagcacccuguaucacagac

SEQ ID NO: 389859 - RNA, 15 nt, Homo sapiens
aaagcacugacuucu

SEQ ID NO: 389860 - RNA, 19 nt, Homo sapiens
aaagcagggacuugaaccc

SEQ ID NO: 389861 - RNA, 23 nt, Homo sapiens
aaagcagggacuugaacccauau

SEQ ID NO: 389862 - RNA, 17 nt, Homo sapiens
aaagcauggcugagaaa

SEQ ID NO: 389863 - RNA, 21 nt, Homo sapiens
aaagccucagccauucacugc

SEQ ID NO: 389864 - RNA, 13 nt, Homo sapiens
aaagcucaucuca

SEQ ID NO: 389865 - RNA, 15 nt, Homo sapiens
aaaggauaugcagua

SEQ ID NO: 389866 - RNA, 14 nt, Homo sapiens
aaaguagacuucau

SEQ ID NO: 389867 - RNA, 14 nt, Homo sapiens
aaaguagcaauuuc

SEQ ID NO: 389868 - RNA, 16 nt, Homo sapiens
aaagucaaaaggugcc

SEQ ID NO: 389869 - RNA, 23 nt, Homo sapiens
aaagucuuugaagugacuucaca

SEQ ID NO: 389870 - RNA, 17 nt, Homo sapiens
aaaguucugcagauaaa

SEQ ID NO: 389871 - RNA, 12 nt, Homo sapiens
aaaguuugcuca

SEQ ID NO: 389872 - RNA, 13 nt, Homo sapiens
aaaguuugcucaa

SEQ ID NO: 389873 - RNA, 14 nt, Homo sapiens
aaaguuugcucaag

SEQ ID NO: 389874 - RNA, 19 nt, Homo sapiens
aaauaaaaauauuguguug

SEQ ID NO: 389875 - RNA, 18 nt, Homo sapiens
aaauaaaggugacuggga

SEQ ID NO: 389876 - RNA, 22 nt, Homo sapiens
aaauaaaguauauauagaaucu

SEQ ID NO: 389877 - RNA, 15 nt, Homo sapiens
aaauacagucuucca

SEQ ID NO: 389878 - RNA, 20 nt, Homo sapiens
aaauacgguaaggauacuuu

SEQ ID NO: 389879 - RNA, 15 nt, Homo sapiens
aaauacuucuugaag

SEQ ID NO: 389880 - RNA, 21 nt, Homo sapiens
aaauaguuuggauuacuuaaa

SEQ ID NO: 389881 - RNA, 14 nt, Homo sapiens
aaauauaauugaca

SEQ ID NO: 389882 - RNA, 21 nt, Homo sapiens
aaauaugauuuuauuugacaa

SEQ ID NO: 389883 - RNA, 16 nt, Homo sapiens
aaauauuuuaaaggua

SEQ ID NO: 389884 - RNA, 15 nt, Homo sapiens
aaauauuuugucuaa

SEQ ID NO: 389885 - RNA, 16 nt, Homo sapiens
aaaucaaauauauguc

SEQ ID NO: 389886 - RNA, 19 nt, Homo sapiens
aaaucaaauaugcaaagca

SEQ ID NO: 389887 - RNA, 14 nt, Homo sapiens
aaaucauuucugca

SEQ ID NO: 389888 - RNA, 15 nt, Homo sapiens
aaaucccuccuucau

SEQ ID NO: 389889 - RNA, 17 nt, Homo sapiens
aaaucccuccuucaucc

SEQ ID NO: 389890 - RNA, 15 nt, Homo sapiens
aaauccuuccaugaa

SEQ ID NO: 389891 - RNA, 22 nt, Homo sapiens
aaaucuauuuuguaacuuucuc

SEQ ID NO: 389892 - RNA, 13 nt, Homo sapiens
aaaucucacaaau

SEQ ID NO: 389893 - RNA, 15 nt, Homo sapiens
aaaucuuaacuugaa

SEQ ID NO: 389894 - RNA, 15 nt, Homo sapiens
aaaucuugacuacag

SEQ ID NO: 389895 - RNA, 17 nt, Homo sapiens
aaaugaaaaugucuugu

SEQ ID NO: 389896 - RNA, 15 nt, Homo sapiens
aaaugaaucuucaca

SEQ ID NO: 389897 - RNA, 17 nt, Homo sapiens
aaaugaucgcuaucuag

SEQ ID NO: 389898 - RNA, 16 nt, Homo sapiens
aaaugauuuuaucugu

SEQ ID NO: 389899 - RNA, 11 nt, Homo sapiens
aaaugcaacuu

SEQ ID NO: 389900 - RNA, 14 nt, Homo sapiens
aaaugcuauauugc

SEQ ID NO: 389901 - RNA, 17 nt, Homo sapiens
aaaugguagcauacuuu

SEQ ID NO: 389902 - RNA, 19 nt, Homo sapiens
aaaugucaucagaacuuuu

SEQ ID NO: 389903 - RNA, 11 nt, Homo sapiens
aaaugucuugc

SEQ ID NO: 389904 - RNA, 23 nt, Homo sapiens
aaauuagcuugagcaaccuggcu

SEQ ID NO: 389905 - RNA, 17 nt, Homo sapiens
aaauuauguauguuuac

SEQ ID NO: 389906 - RNA, 20 nt, Homo sapiens
aaauugcacuuuuaaaccuc

SEQ ID NO: 389907 - RNA, 15 nt, Homo sapiens
aaauugcuccuugac

SEQ ID NO: 389908 - RNA, 20 nt, Homo sapiens
aaauuguaucaaaugugaca

SEQ ID NO: 389909 - RNA, 22 nt, Homo sapiens
aaauuguaucaaaugugacauu

SEQ ID NO: 389910 - RNA, 14 nt, Homo sapiens
aaauuguauuauca

SEQ ID NO: 389911 - RNA, 20 nt, Homo sapiens
aacaacaaagccaacaguca

SEQ ID NO: 389912 - RNA, 19 nt, Homo sapiens
aacaaccuggucacaggac

SEQ ID NO: 389913 - RNA, 12 nt, Homo sapiens
aacaacuguggu

SEQ ID NO: 389914 - RNA, 21 nt, Homo sapiens
aacaauacaugcugcuaauuc

SEQ ID NO: 389915 - RNA, 15 nt, Homo sapiens
aacaaugaagauaaa

SEQ ID NO: 389916 - RNA, 20 nt, Homo sapiens
aacacaaacgggcucagcaa

SEQ ID NO: 389917 - RNA, 19 nt, Homo sapiens
aacacacuccuuugcuuag

SEQ ID NO: 389918 - RNA, 14 nt, Homo sapiens
aacacacugaggca

SEQ ID NO: 389919 - RNA, 21 nt, Homo sapiens
aacacgagcaggcuacuguca

SEQ ID NO: 389920 - RNA, 15 nt, Homo sapiens
aacacgccugcaaac

SEQ ID NO: 389921 - RNA, 19 nt, Homo sapiens
aacacggggcuugcaacuu

SEQ ID NO: 389922 - RNA, 15 nt, Homo sapiens
aacagaacuaucuca

SEQ ID NO: 389923 - RNA, 14 nt, Homo sapiens
aacagauauuguca

SEQ ID NO: 389924 - RNA, 13 nt, Homo sapiens
aacagcagaacuu

SEQ ID NO: 389925 - RNA, 20 nt, Homo sapiens
aacagcuguggcucacguga

SEQ ID NO: 389926 - RNA, 19 nt, Homo sapiens
aacaggauuagacagucaa

SEQ ID NO: 389927 - RNA, 16 nt, Homo sapiens
aacaguaacugccauc

SEQ ID NO: 389928 - RNA, 14 nt, Homo sapiens
aacagugcgccagg

SEQ ID NO: 389929 - RNA, 14 nt, Homo sapiens
aacaguuacuccag

SEQ ID NO: 389930 - RNA, 20 nt, Homo sapiens
aacaguuccuucagcuucca

SEQ ID NO: 389931 - RNA, 21 nt, Homo sapiens
aacauaaauuucuuuaaucau

SEQ ID NO: 389932 - RNA, 21 nt, Homo sapiens
aacaucacugaaaugcuagcu

SEQ ID NO: 389933 - RNA, 21 nt, Homo sapiens
aacaucuuggucagauuugaa

SEQ ID NO: 389934 - RNA, 16 nt, Homo sapiens
aacaugugcucaggga

SEQ ID NO: 389935 - RNA, 15 nt, Homo sapiens
aaccaauagcuuuaa

SEQ ID NO: 389936 - RNA, 18 nt, Homo sapiens
aaccacaggcagcauuua

SEQ ID NO: 389937 - RNA, 22 nt, Homo sapiens
aacccaaauguucaucaaugaa

SEQ ID NO: 389938 - RNA, 20 nt, Homo sapiens
aacccaggagauggaaguug

SEQ ID NO: 389939 - RNA, 20 nt, Homo sapiens
aacccaggagguggagguug

SEQ ID NO: 389940 - RNA, 19 nt, Homo sapiens
aacccuuuugucugccucu

SEQ ID NO: 389941 - RNA, 21 nt, Homo sapiens
aaccuaacuggcuuacuuccu

SEQ ID NO: 389942 - RNA, 14 nt, Homo sapiens
aaccucauugacaa

SEQ ID NO: 389943 - RNA, 18 nt, Homo sapiens
aaccuccccaacagcacu

SEQ ID NO: 389944 - RNA, 18 nt, Homo sapiens
aaccucucuucuaccuua

SEQ ID NO: 389945 - RNA, 16 nt, Homo sapiens
aaccugaugcugacua

SEQ ID NO: 389946 - RNA, 13 nt, Homo sapiens
aaccugcucuccu

SEQ ID NO: 389947 - RNA, 20 nt, Homo sapiens
aaccugggagguggagguug

SEQ ID NO: 389948 - RNA, 19 nt, Homo sapiens
aaccuguccuugcacacuc

SEQ ID NO: 389949 - RNA, 14 nt, Homo sapiens
aaccugugugccau

SEQ ID NO: 389950 - RNA, 18 nt, Homo sapiens
aaccuuauuguaccucuc

SEQ ID NO: 389951 - RNA, 16 nt, Homo sapiens
aaccuuucaaauuuca

SEQ ID NO: 389952 - RNA, 17 nt, Homo sapiens
aacgcacacaguaucua

SEQ ID NO: 389953 - RNA, 21 nt, Homo sapiens
aacgcacacaguaucuaguca

SEQ ID NO: 389954 - RNA, 23 nt, Homo sapiens
aacguccagcucguucucugggc

SEQ ID NO: 389955 - RNA, 14 nt, Homo sapiens
aacguggggcagca

SEQ ID NO: 389956 - RNA, 17 nt, Homo sapiens
aacguuuugaacuaaua

SEQ ID NO: 389957 - RNA, 14 nt, Homo sapiens
aacuaaauaaagcu

SEQ ID NO: 389958 - RNA, 22 nt, Homo sapiens
aacuacagaguuuaugauuuaa

SEQ ID NO: 389959 - RNA, 12 nt, Homo sapiens
aacuacauguaa

SEQ ID NO: 389960 - RNA, 14 nt, Homo sapiens
aacuacucagggaa

SEQ ID NO: 389961 - RNA, 19 nt, Homo sapiens
aacuagggaagauaauauu

SEQ ID NO: 389962 - RNA, 16 nt, Homo sapiens
aacuaguguugcuugg

SEQ ID NO: 389963 - RNA, 16 nt, Homo sapiens
aacuaucucagcauca

SEQ ID NO: 389964 - RNA, 18 nt, Homo sapiens
aacuaucucagcaucaga

SEQ ID NO: 389965 - RNA, 16 nt, Homo sapiens
aacuauguaacaugua

SEQ ID NO: 389966 - RNA, 16 nt, Homo sapiens
aauaugcuuuacaauc

SEQ ID NO: 389967 - RNA, 19 nt, Homo sapiens
aauauggaaugggcucagu

SEQ ID NO: 389968 - RNA, 16 nt, Homo sapiens
aauauuauguguuucc

SEQ ID NO: 389969 - RNA, 23 nt, Homo sapiens
aauauuguucuauuuguauauau

SEQ ID NO: 389970 - RNA, 19 nt, Homo sapiens
aauauuuaaacagcagugu

SEQ ID NO: 389971 - RNA, 20 nt, Homo sapiens
aaucaaauaugcaaagcacu

SEQ ID NO: 389972 - RNA, 18 nt, Homo sapiens
aaucaaguuggcuucuaa

SEQ ID NO: 389973 - RNA, 15 nt, Homo sapiens
aaucaaugcuauaac

SEQ ID NO: 389974 - RNA, 14 nt, Homo sapiens
aaucacacugagga

SEQ ID NO: 389975 - RNA, 14 nt, Homo sapiens
aaucaccacaccaa

SEQ ID NO: 389976 - RNA, 20 nt, Homo sapiens
aaucagacuucacacugcaa

SEQ ID NO: 389977 - RNA, 18 nt, Homo sapiens
aaucagagagcucacuaa

SEQ ID NO: 389978 - RNA, 19 nt, Homo sapiens
aaucauaaaacuugaugug

SEQ ID NO: 389979 - RNA, 19 nt, Homo sapiens
aaucauauaauaaauguac

SEQ ID NO: 389980 - RNA, 13 nt, Homo sapiens
acaguuaaugcca

SEQ ID NO: 389981 - RNA, 16 nt, Homo sapiens
acaguuacuccaguau

SEQ ID NO: 389982 - RNA, 23 nt, Homo sapiens
acauaaauuacuuuuucauucuu

SEQ ID NO: 389983 - RNA, 22 nt, Homo sapiens
acauaacacuauaaagguugac

SEQ ID NO: 389984 - RNA, 14 nt, Homo sapiens
acauacuucagcuc

SEQ ID NO: 389985 - RNA, 20 nt, Homo sapiens
acauagaauuaacacaugau

SEQ ID NO: 389986 - RNA, 15 nt, Homo sapiens
acauaugugcuggaa

SEQ ID NO: 389987 - RNA, 18 nt, Homo sapiens
acauauucuuuaaauuuc

SEQ ID NO: 389988 - RNA, 15 nt, Homo sapiens
acaucaacagauaaa

SEQ ID NO: 389989 - RNA, 17 nt, Homo sapiens
acaucacugaaaugcua

SEQ ID NO: 389990 - RNA, 16 nt, Homo sapiens
acauccaagcuuccuu

SEQ ID NO: 389991 - RNA, 20 nt, Homo sapiens
acauccugaccuugcacaaa

SEQ ID NO: 389992 - RNA, 12 nt, Homo sapiens
acaucucagggg

SEQ ID NO: 389993 - RNA, 17 nt, Homo sapiens
acaucucaggggccaga

SEQ ID NO: 389994 - RNA, 18 nt, Homo sapiens
acaucuuggucagauuug

SEQ ID NO: 389995 - RNA, 17 nt, Homo sapiens
acaucuuuuacauucug

SEQ ID NO: 389996 - RNA, 19 nt, Homo sapiens
acaucuuuuacauucugca

SEQ ID NO: 389997 - RNA, 10 nt, Homo sapiens
acaugaauau

SEQ ID NO: 389998 - RNA, 23 nt, Homo sapiens
acaugaauugcauuuuacuuuaa

SEQ ID NO: 389999 - RNA, 14 nt, Homo sapiens
acaugauccugcaa

SEQ ID NO: 390000 - RNA, 20 nt, Homo sapiens
acaugauccugcaauuccac

SEQ ID NO: 390001 - RNA, 15 nt, Homo sapiens
acauguauugcacau

SEQ ID NO: 390002 - RNA, 17 nt, Homo sapiens
acauguauugcacauug

SEQ ID NO: 390003 - RNA, 15 nt, Homo sapiens
acaugugcacuugaa

SEQ ID NO: 390004 - RNA, 22 nt, Homo sapiens
acaugugugcgugugcgugcau

SEQ ID NO: 390005 - RNA, 23 nt, Homo sapiens
acaugugugcgugugcgugcaug

SEQ ID NO: 390006 - RNA, 17 nt, Homo sapiens
acauuaagaaaaucaua

SEQ ID NO: 390007 - RNA, 21 nt, Homo sapiens
acauucuuguuuuaagugccu

SEQ ID NO: 390008 - RNA, 22 nt, Homo sapiens
acauucuuguuuuaagugccuu

SEQ ID NO: 390009 - RNA, 12 nt, Homo sapiens
acauugugccuu

SEQ ID NO: 390010 - RNA, 20 nt, Homo sapiens
acauugugggauguucagca

SEQ ID NO: 390011 - RNA, 20 nt, Homo sapiens
acauuguuugucugucuuca

SEQ ID NO: 390012 - RNA, 22 nt, Homo sapiens
acauuuaauacagcagugucau

SEQ ID NO: 390013 - RNA, 19 nt, Homo sapiens
acauuugggagacauguga

SEQ ID NO: 390014 - RNA, 22 nt, Homo sapiens
acauuuguuccgugucuggcca

SEQ ID NO: 390015 - RNA, 16 nt, Homo sapiens
accaaauuccuuggca

SEQ ID NO: 390016 - RNA, 17 nt, Homo sapiens
accaacaguuccuucag

SEQ ID NO: 390017 - RNA, 15 nt, Homo sapiens
accaacccucagagc

SEQ ID NO: 390018 - RNA, 11 nt, Homo sapiens
accaaccuggg

SEQ ID NO: 390019 - RNA, 15 nt, Homo sapiens
accaagacucugaaa

SEQ ID NO: 390020 - RNA, 18 nt, Homo sapiens
accaagcaggaagcucag

SEQ ID NO: 390021 - RNA, 23 nt, Homo sapiens
accaaggggugggccacagccau

SEQ ID NO: 390022 - RNA, 12 nt, Homo sapiens
accaauguagaa

SEQ ID NO: 390023 - RNA, 13 nt, Homo sapiens
accaaugucuuga

SEQ ID NO: 390024 - RNA, 20 nt, Homo sapiens
accacaaaaauugacucaaa

SEQ ID NO: 390025 - RNA, 15 nt, Homo sapiens
accacacagccaagg

SEQ ID NO: 390026 - RNA, 12 nt, Homo sapiens
accacagacugu

SEQ ID NO: 390027 - RNA, 18 nt, Homo sapiens
accacagagccucgggac

SEQ ID NO: 390028 - RNA, 11 nt, Homo sapiens
accaccccagc

SEQ ID NO: 390029 - RNA, 20 nt, Homo sapiens
accacugcagaagacaguau

SEQ ID NO: 390030 - RNA, 16 nt, Homo sapiens
accacuguguauuuaa

SEQ ID NO: 390031 - RNA, 17 nt, Homo sapiens
accagaagcauuucacc

SEQ ID NO: 390032 - RNA, 19 nt, Homo sapiens
accagagaccguccucacc

SEQ ID NO: 390033 - RNA, 13 nt, Homo sapiens
accagagcucaga

SEQ ID NO: 390034 - RNA, 21 nt, Homo sapiens
accagcagaucccagcucacg

SEQ ID NO: 390035 - RNA, 18 nt, Homo sapiens
accagcgugugacuacuc

SEQ ID NO: 390036 - RNA, 19 nt, Homo sapiens
accaggccgccccagccuc

SEQ ID NO: 390037 - RNA, 14 nt, Homo sapiens
accaguaauuguga

SEQ ID NO: 390038 - RNA, 22 nt, Homo sapiens
accaguaucgcucauagaucag

SEQ ID NO: 390039 - RNA, 17 nt, Homo sapiens
accaucagggacaggau

SEQ ID NO: 390040 - RNA, 15 nt, Homo sapiens
accaucauaguacag

SEQ ID NO: 390041 - RNA, 22 nt, Homo sapiens
accaugagaccacuguuaucaa

SEQ ID NO: 390042 - RNA, 24 nt, Homo sapiens
accaugauuaaccacuucagcuga

SEQ ID NO: 390043 - RNA, 20 nt, Homo sapiens
accauguacaugaagaagcu

SEQ ID NO: 390044 - RNA, 17 nt, Homo sapiens
accaugucagcaaaaag

SEQ ID NO: 390045 - RNA, 18 nt, Homo sapiens
accauucaggacacaggg

SEQ ID NO: 390046 - RNA, 14 nt, Homo sapiens
acccacccagcacc

SEQ ID NO: 390047 - RNA, 23 nt, Homo sapiens
acccacucugcuuugacugagca

SEQ ID NO: 390048 - RNA, 20 nt, Homo sapiens
acccagcuugugccuguggu

SEQ ID NO: 390049 - RNA, 17 nt, Homo sapiens
acccaggagguggaggu

SEQ ID NO: 390050 - RNA, 15 nt, Homo sapiens
acccagggccugcag

SEQ ID NO: 390051 - RNA, 17 nt, Homo sapiens
acccaguuagcucucaa

SEQ ID NO: 390052 - RNA, 18 nt, Homo sapiens
accccaaggagggagaug

SEQ ID NO: 390053 - RNA, 19 nt, Homo sapiens
accccaauuuacuugccau

SEQ ID NO: 390054 - RNA, 22 nt, Homo sapiens
acccccauagcagcagugcaug

SEQ ID NO: 390055 - RNA, 22 nt, Homo sapiens
accccgaccaccugcccaaccu

SEQ ID NO: 390056 - RNA, 23 nt, Homo sapiens
accccugcccugggauguccaca

SEQ ID NO: 390057 - RNA, 18 nt, Homo sapiens
accccuguccucacugcu

SEQ ID NO: 390058 - RNA, 20 nt, Homo sapiens
acccuaugugggugggacca

SEQ ID NO: 390059 - RNA, 21 nt, Homo sapiens
acccuaugugggugggaccac

SEQ ID NO: 390060 - RNA, 19 nt, Homo sapiens
acccucccccgccacuccu

SEQ ID NO: 390061 - RNA, 14 nt, Homo sapiens
acccuguuuuacaa

SEQ ID NO: 390062 - RNA, 22 nt, Homo sapiens
acccuuccuacagauagucaaa

SEQ ID NO: 390063 - RNA, 17 nt, Homo sapiens
acccuugacaccugcug

SEQ ID NO: 390064 - RNA, 20 nt, Homo sapiens
acccuuguguccacugugac

SEQ ID NO: 390065 - RNA, 15 nt, Homo sapiens
acccuuugcugugag

SEQ ID NO: 390066 - RNA, 16 nt, Homo sapiens
accgagucucuucucc

SEQ ID NO: 390067 - RNA, 15 nt, Homo sapiens
accgggcugggagcu

SEQ ID NO: 390068 - RNA, 17 nt, Homo sapiens
accgugggcucccugac

SEQ ID NO: 390069 - RNA, 13 nt, Homo sapiens
accguucccucac

SEQ ID NO: 390070 - RNA, 13 nt, Homo sapiens
accuaccaucagg

SEQ ID NO: 390071 - RNA, 20 nt, Homo sapiens
accuagcaaagcuccugccu

SEQ ID NO: 390072 - RNA, 18 nt, Homo sapiens
accuaguagucauuucau

SEQ ID NO: 390073 - RNA, 14 nt, Homo sapiens
accucaaaggugau

SEQ ID NO: 390074 - RNA, 16 nt, Homo sapiens
accucaggcacuagcc

SEQ ID NO: 390075 - RNA, 18 nt, Homo sapiens
accucaggcacuagccuu

SEQ ID NO: 390076 - RNA, 16 nt, Homo sapiens
accuccuccucuggac

SEQ ID NO: 390077 - RNA, 15 nt, Homo sapiens
accucugcacaagcu

SEQ ID NO: 390078 - RNA, 19 nt, Homo sapiens
accucugggucaucucuca

SEQ ID NO: 390079 - RNA, 20 nt, Homo sapiens
accugaaaacacugugcaca

SEQ ID NO: 390080 - RNA, 19 nt, Homo sapiens
accugagcaggaccucuga

SEQ ID NO: 390081 - RNA, 14 nt, Homo sapiens
accugagcugccau

SEQ ID NO: 390082 - RNA, 20 nt, Homo sapiens
accugcugagggaccagcca

SEQ ID NO: 390083 - RNA, 14 nt, Homo sapiens
accuguccuugcac

SEQ ID NO: 390084 - RNA, 22 nt, Homo sapiens
accuguuuucgcaccuaccauc

SEQ ID NO: 390085 - RNA, 23 nt, Homo sapiens
accuuacauuugaaaucuaugaa

SEQ ID NO: 390086 - RNA, 16 nt, Homo sapiens
accuugaacacugggg

SEQ ID NO: 390087 - RNA, 17 nt, Homo sapiens
accuugacggcauugcu

SEQ ID NO: 390088 - RNA, 21 nt, Homo sapiens
acgaauggcagcauacacaga

SEQ ID NO: 390089 - RNA, 17 nt, Homo sapiens
acgacugucuccauggc

SEQ ID NO: 390090 - RNA, 19 nt, Homo sapiens
acgagaccugugugccagg

SEQ ID NO: 390091 - RNA, 15 nt, Homo sapiens
acgcaacuggcucaa

SEQ ID NO: 390092 - RNA, 18 nt, Homo sapiens
acgccuguaaucccagca

SEQ ID NO: 390093 - RNA, 21 nt, Homo sapiens
acgccuguaaucccagcacuu

SEQ ID NO: 390094 - RNA, 14 nt, Homo sapiens
acgcuuucaugaau

SEQ ID NO: 390095 - RNA, 20 nt, Homo sapiens
acggaauaaugaguuagaac

SEQ ID NO: 390096 - RNA, 12 nt, Homo sapiens
acggacacucaa

SEQ ID NO: 390097 - RNA, 22 nt, Homo sapiens
acggagccacuccucugacuca

SEQ ID NO: 390098 - RNA, 14 nt, Homo sapiens
acggcucuuagcac

SEQ ID NO: 390099 - RNA, 20 nt, Homo sapiens
acgggcccgugacaucccca

SEQ ID NO: 390100 - RNA, 13 nt, Homo sapiens
acggggacugggg

SEQ ID NO: 390101 - RNA, 21 nt, Homo sapiens
acgucccccaaaacgugcaug

SEQ ID NO: 390102 - RNA, 22 nt, Homo sapiens
acgucccccaaaacgugcaugg

SEQ ID NO: 390103 - RNA, 20 nt, Homo sapiens
acguggccucuugagcagug

SEQ ID NO: 390104 - RNA, 23 nt, Homo sapiens
acuaaaaauacaauuagccaggu

SEQ ID NO: 390105 - RNA, 22 nt, Homo sapiens
acuaaaauuguaucaaauguga

SEQ ID NO: 390106 - RNA, 18 nt, Homo sapiens
acuaaauugacacuuaaa

SEQ ID NO: 390107 - RNA, 15 nt, Homo sapiens
aucagagagcucacu

SEQ ID NO: 390108 - RNA, 17 nt, Homo sapiens
aucagccugcuccagcu

SEQ ID NO: 390109 - RNA, 21 nt, Homo sapiens
aucauauugguauucacuaau

SEQ ID NO: 390110 - RNA, 19 nt, Homo sapiens
aucaucagcauaccuuuau

SEQ ID NO: 390111 - RNA, 14 nt, Homo sapiens
aucaucauucucau

SEQ ID NO: 390112 - RNA, 17 nt, Homo sapiens
aucauccuuuccagcau

SEQ ID NO: 390113 - RNA, 15 nt, Homo sapiens
aucauguguguccac

SEQ ID NO: 390114 - RNA, 17 nt, Homo sapiens
auccaacaugugcucag

SEQ ID NO: 390115 - RNA, 20 nt, Homo sapiens
auccaacaugugcucaggga

SEQ ID NO: 390116 - RNA, 19 nt, Homo sapiens
auccagguaauccaagaua

SEQ ID NO: 390117 - RNA, 24 nt, Homo sapiens
auccaucugcuuacaauucccugc

SEQ ID NO: 390118 - RNA, 20 nt, Homo sapiens
aucccacuugccccuguuac

SEQ ID NO: 390119 - RNA, 17 nt, Homo sapiens
auccccuggacugggag

SEQ ID NO: 390120 - RNA, 16 nt, Homo sapiens
aucccguguugccaug

SEQ ID NO: 390121 - RNA, 13 nt, Homo sapiens
aucccuacaugua

SEQ ID NO: 390122 - RNA, 20 nt, Homo sapiens
aucccuacauguauugcaca

SEQ ID NO: 390123 - RNA, 16 nt, Homo sapiens
aucccuaugcugccua

SEQ ID NO: 390124 - RNA, 18 nt, Homo sapiens
aucccucgugguccccaa

SEQ ID NO: 390125 - RNA, 18 nt, Homo sapiens
aucccuuauccaacucuc

SEQ ID NO: 390126 - RNA, 15 nt, Homo sapiens
auccgaggcaggguc

SEQ ID NO: 390127 - RNA, 20 nt, Homo sapiens
auccuacaaggcuggcagug

SEQ ID NO: 390128 - RNA, 22 nt, Homo sapiens
auccuacaaggcuggcagugac

SEQ ID NO: 390129 - RNA, 14 nt, Homo sapiens
auccuagcacuuug

SEQ ID NO: 390130 - RNA, 15 nt, Homo sapiens
auccuagcacuuugg

SEQ ID NO: 390131 - RNA, 17 nt, Homo sapiens
auccugaccuugcacaa

SEQ ID NO: 390132 - RNA, 15 nt, Homo sapiens
aucgcugucaucuca

SEQ ID NO: 390133 - RNA, 16 nt, Homo sapiens
aucgcugucaucucag

SEQ ID NO: 390134 - RNA, 22 nt, Homo sapiens
aucgcugucaucucagcuggau

SEQ ID NO: 390135 - RNA, 17 nt, Homo sapiens
aucuaaggaugucacag

SEQ ID NO: 390136 - RNA, 12 nt, Homo sapiens
aucuacacucca

SEQ ID NO: 390137 - RNA, 17 nt, Homo sapiens
aucuaucaauagucaag

SEQ ID NO: 390138 - RNA, 22 nt, Homo sapiens
aucuaugaaauaucaugcucca

SEQ ID NO: 390139 - RNA, 21 nt, Homo sapiens
aucucacuggaugcaaagaaa

SEQ ID NO: 390140 - RNA, 18 nt, Homo sapiens
aucucaggccucccucaa

SEQ ID NO: 390141 - RNA, 22 nt, Homo sapiens
aucucauugcuuacaagccuaa

SEQ ID NO: 390142 - RNA, 20 nt, Homo sapiens
aucucauuggacccuuccau

SEQ ID NO: 390143 - RNA, 22 nt, Homo sapiens
aucucauuggacccuuccaugg

SEQ ID NO: 390144 - RNA, 20 nt, Homo sapiens
aucuccaguauucuugucaa

SEQ ID NO: 390145 - RNA, 20 nt, Homo sapiens
aucucggcucacugcaagcu

SEQ ID NO: 390146 - RNA, 16 nt, Homo sapiens
aucucuaauauggcaa

SEQ ID NO: 390147 - RNA, 15 nt, Homo sapiens
aucucugaacauuuc

SEQ ID NO: 390148 - RNA, 22 nt, Homo sapiens
aucugcauccagccuccugcua

SEQ ID NO: 390149 - RNA, 15 nt, Homo sapiens
aucugccacguguau

SEQ ID NO: 390150 - RNA, 14 nt, Homo sapiens
aucugggaaaauac

SEQ ID NO: 390151 - RNA, 17 nt, Homo sapiens
aucugggcaaaugaaaa

SEQ ID NO: 390152 - RNA, 22 nt, Homo sapiens
aucugugcaaauccuugauacu

SEQ ID NO: 390153 - RNA, 18 nt, Homo sapiens
aucugugcccagagaugg

SEQ ID NO: 390154 - RNA, 20 nt, Homo sapiens
aucuguuaccagaggacaaa

SEQ ID NO: 390155 - RNA, 20 nt, Homo sapiens
agaggacuucuggcagggaa

SEQ ID NO: 390156 - RNA, 22 nt, Homo sapiens
agagggacagaugaaugccgug

SEQ ID NO: 390157 - RNA, 15 nt, Homo sapiens
agagggacugacacc

SEQ ID NO: 390158 - RNA, 16 nt, Homo sapiens
agagguuaaugcaggg

SEQ ID NO: 390159 - RNA, 16 nt, Homo sapiens
agaguauaugcacuuu

SEQ ID NO: 390160 - RNA, 18 nt, Homo sapiens
agagugcccagaacugga

SEQ ID NO: 390161 - RNA, 21 nt, Homo sapiens
agagugcccagaacuggacuc

SEQ ID NO: 390162 - RNA, 23 nt, Homo sapiens
agagugccguaacaacugugguc

SEQ ID NO: 390163 - RNA, 22 nt, Homo sapiens
agagugguuaagacuacugaag

SEQ ID NO: 390164 - RNA, 23 nt, Homo sapiens
agagugucuucacggcaggacaa

SEQ ID NO: 390165 - RNA, 12 nt, Homo sapiens
agaguugugcac

SEQ ID NO: 390166 - RNA, 23 nt, Homo sapiens
agauaaaagaaccgagcaauuuu

SEQ ID NO: 390167 - RNA, 17 nt, Homo sapiens
agauaaacaacaaauaa

SEQ ID NO: 390168 - RNA, 18 nt, Homo sapiens
agauaagggugucuuccu

SEQ ID NO: 390169 - RNA, 17 nt, Homo sapiens
agauaauuauaauauac

SEQ ID NO: 390170 - RNA, 15 nt, Homo sapiens
agauagguaaauacc

SEQ ID NO: 390171 - RNA, 14 nt, Homo sapiens
agauauuucacauu

SEQ ID NO: 390172 - RNA, 14 nt, Homo sapiens
agaucccagcucac

SEQ ID NO: 390173 - RNA, 14 nt, Homo sapiens
agaucccccagacu

SEQ ID NO: 390174 - RNA, 17 nt, Homo sapiens
agauccgagucuaccca

SEQ ID NO: 390175 - RNA, 19 nt, Homo sapiens
agaugcauuaucuaugaua

SEQ ID NO: 390176 - RNA, 15 nt, Homo sapiens
agaugggaaaaccau

SEQ ID NO: 390177 - RNA, 13 nt, Homo sapiens
agauguagaggag

SEQ ID NO: 390178 - RNA, 14 nt, Homo sapiens
agaugugcaacacu

SEQ ID NO: 390179 - RNA, 17 nt, Homo sapiens
agaugugggcagugaug

SEQ ID NO: 390180 - RNA, 22 nt, Homo sapiens
agaugugggcagugaugucacu

SEQ ID NO: 390181 - RNA, 16 nt, Homo sapiens
agauuaaacaaacaaa

SEQ ID NO: 390182 - RNA, 22 nt, Homo sapiens
agauuccugguuaaauuugaau

SEQ ID NO: 390183 - RNA, 16 nt, Homo sapiens
agauucuccugugcua

SEQ ID NO: 390184 - RNA, 19 nt, Homo sapiens
agauugcgccauugcacuc

SEQ ID NO: 390185 - RNA, 14 nt, Homo sapiens
agauuucagaucau

SEQ ID NO: 390186 - RNA, 14 nt, Homo sapiens
agcaaaaugugaua

SEQ ID NO: 390187 - RNA, 19 nt, Homo sapiens
agcaaaauugauguguuua

SEQ ID NO: 390188 - RNA, 21 nt, Homo sapiens
agcaaagugaagacacuggcu

SEQ ID NO: 390189 - RNA, 16 nt, Homo sapiens
agcaaauguggcuccu

SEQ ID NO: 390190 - RNA, 21 nt, Homo sapiens
agcaacucugagaucuaagga

SEQ ID NO: 390191 - RNA, 18 nt, Homo sapiens
agcaagacucugucucaa

SEQ ID NO: 390192 - RNA, 15 nt, Homo sapiens
agcaauaaaaugcua

SEQ ID NO: 390193 - RNA, 16 nt, Homo sapiens
agcaauaugcauuuaa

SEQ ID NO: 390194 - RNA, 17 nt, Homo sapiens
agcaaugacaucucagg

SEQ ID NO: 390195 - RNA, 12 nt, Homo sapiens
agcacacgucau

SEQ ID NO: 390196 - RNA, 18 nt, Homo sapiens
agcacagcacccauggga

SEQ ID NO: 390197 - RNA, 20 nt, Homo sapiens
agcacagcagccccugcaca

SEQ ID NO: 390198 - RNA, 15 nt, Homo sapiens
agcacagugccugca

SEQ ID NO: 390199 - RNA, 16 nt, Homo sapiens
agcacccugcaaaaug

SEQ ID NO: 390200 - RNA, 15 nt, Homo sapiens
agcacuaaagcagug

SEQ ID NO: 390201 - RNA, 21 nt, Homo sapiens
agcacucccaagucuacagag

SEQ ID NO: 390202 - RNA, 17 nt, Homo sapiens
agcacugagcaaagcau

SEQ ID NO: 390203 - RNA, 14 nt, Homo sapiens
agcagaacuuucac

SEQ ID NO: 390204 - RNA, 20 nt, Homo sapiens
agcagaagcacauaugaacu

SEQ ID NO: 390205 - RNA, 19 nt, Homo sapiens
agcagaugcaaagaggcaa

SEQ ID NO: 390206 - RNA, 13 nt, Homo sapiens
agcagauuuaaca

SEQ ID NO: 390207 - RNA, 15 nt, Homo sapiens
agcagcaucuucaaa

SEQ ID NO: 390208 - RNA, 22 nt, Homo sapiens
agcagcucaaaggcacagugaa

SEQ ID NO: 390209 - RNA, 22 nt, Homo sapiens
agcaggaccucugaaacccugg

SEQ ID NO: 390210 - RNA, 21 nt, Homo sapiens
agcaggacucugcccagacca

SEQ ID NO: 390211 - RNA, 17 nt, Homo sapiens
agcaggagggacaauga

SEQ ID NO: 390212 - RNA, 19 nt, Homo sapiens
agcagggauuaaccucugc

SEQ ID NO: 390213 - RNA, 20 nt, Homo sapiens
agcaggggaguaugcaaaag

SEQ ID NO: 390214 - RNA, 17 nt, Homo sapiens
agcagguaguccaggau

SEQ ID NO: 390215 - RNA, 20 nt, Homo sapiens
agcagucuacccaccucagc

SEQ ID NO: 390216 - RNA, 18 nt, Homo sapiens
agcagugccgcguggccu

SEQ ID NO: 390217 - RNA, 21 nt, Homo sapiens
agcaguugaaacaagaagcca

SEQ ID NO: 390218 - RNA, 22 nt, Homo sapiens
agcaguuugcuuuguaugcacu

SEQ ID NO: 390219 - RNA, 15 nt, Homo sapiens
agcauggcugagaaa

SEQ ID NO: 390220 - RNA, 14 nt, Homo sapiens
agcauuacaguggg

SEQ ID NO: 390221 - RNA, 16 nt, Homo sapiens
agcauuccuauugaca

SEQ ID NO: 390222 - RNA, 17 nt, Homo sapiens
agcauugagcaaagggg

SEQ ID NO: 390223 - RNA, 18 nt, Homo sapiens
agcauuguaaaugugcuu

SEQ ID NO: 390224 - RNA, 16 nt, Homo sapiens
agcauuuagcacauac

SEQ ID NO: 390225 - RNA, 20 nt, Homo sapiens
agccaacacccugucuaaaa

SEQ ID NO: 390226 - RNA, 15 nt, Homo sapiens
agccacacuguggga

SEQ ID NO: 390227 - RNA, 15 nt, Homo sapiens
agccaccaagaggga

SEQ ID NO: 390228 - RNA, 23 nt, Homo sapiens
agccaccaugcccagcucagagg

SEQ ID NO: 390229 - RNA, 18 nt, Homo sapiens
agccagcagccagcucuc

SEQ ID NO: 390230 - RNA, 16 nt, Homo sapiens
agccagcucugcauua

SEQ ID NO: 390231 - RNA, 14 nt, Homo sapiens
agccagggggacua

SEQ ID NO: 390232 - RNA, 21 nt, Homo sapiens
agcccacaguucuccauuuca

SEQ ID NO: 390233 - RNA, 13 nt, Homo sapiens
agcccaccccuca

SEQ ID NO: 390234 - RNA, 14 nt, Homo sapiens
agcccaugaucuuc

SEQ ID NO: 390235 - RNA, 16 nt, Homo sapiens
agcccaugaucuucaa

SEQ ID NO: 390236 - RNA, 18 nt, Homo sapiens
agccccagagcagggugu

SEQ ID NO: 390237 - RNA, 20 nt, Homo sapiens
agccccagugccaagcacag

SEQ ID NO: 390238 - RNA, 15 nt, Homo sapiens
agccccugguccuga

SEQ ID NO: 390239 - RNA, 18 nt, Homo sapiens
agcccucaggucagggug

SEQ ID NO: 390240 - RNA, 13 nt, Homo sapiens
agcccucuuccau

SEQ ID NO: 390241 - RNA, 21 nt, Homo sapiens
agcccugggccccaccaccua

SEQ ID NO: 390242 - RNA, 23 nt, Homo sapiens
agcccuguggaugagcccucaga

SEQ ID NO: 390243 - RNA, 15 nt, Homo sapiens
agccgaaaagcuuuu

SEQ ID NO: 390244 - RNA, 12 nt, Homo sapiens
agccgcugugag

SEQ ID NO: 390245 - RNA, 15 nt, Homo sapiens
agccuccucucucaa

SEQ ID NO: 390246 - RNA, 16 nt, Homo sapiens
agccucugaaaaccaa

SEQ ID NO: 390247 - RNA, 19 nt, Homo sapiens
agccucugggucagugguc

SEQ ID NO: 390248 - RNA, 20 nt, Homo sapiens
agucaugcguuuaaucacau

SEQ ID NO: 390249 - RNA, 19 nt, Homo sapiens
agucauuugcugagcaugu

SEQ ID NO: 390250 - RNA, 19 nt, Homo sapiens
aguccuguuugcagggaag

SEQ ID NO: 390251 - RNA, 13 nt, Homo sapiens
agucugaacagcu

SEQ ID NO: 390252 - RNA, 15 nt, Homo sapiens
agucuuauuuauuca

SEQ ID NO: 390253 - RNA, 17 nt, Homo sapiens
agucuuauuuccucaac

SEQ ID NO: 390254 - RNA, 20 nt, Homo sapiens
agucuuuauuguguaucaua

SEQ ID NO: 390255 - RNA, 20 nt, Homo sapiens
agugaagaugccagugaaac

SEQ ID NO: 390256 - RNA, 17 nt, Homo sapiens
agugacuucacagagac

SEQ ID NO: 390257 - RNA, 22 nt, Homo sapiens
agugacuugugucccaugaucc

SEQ ID NO: 390258 - RNA, 13 nt, Homo sapiens
agugagacccugu

SEQ ID NO: 390259 - RNA, 15 nt, Homo sapiens
agugagcugauauca

SEQ ID NO: 390260 - RNA, 21 nt, Homo sapiens
agugauaucccccagccucaa

SEQ ID NO: 390261 - RNA, 23 nt, Homo sapiens
agugcaucugggaagauuucuac

SEQ ID NO: 390262 - RNA, 14 nt, Homo sapiens
agugccagcaauga

SEQ ID NO: 390263 - RNA, 16 nt, Homo sapiens
agugccagcaaugaca

SEQ ID NO: 390264 - RNA, 21 nt, Homo sapiens
agugccagcaaugacaucuca

SEQ ID NO: 390265 - RNA, 15 nt, Homo sapiens
agugcugaacagugg

SEQ ID NO: 390266 - RNA, 17 nt, Homo sapiens
agugcuuguuccucuca

SEQ ID NO: 390267 - RNA, 22 nt, Homo sapiens
agugcuuguuccucucaucucc

SEQ ID NO: 390268 - RNA, 20 nt, Homo sapiens
aguggcguaaucucggcuca

SEQ ID NO: 390269 - RNA, 20 nt, Homo sapiens
agugggagcugaguggggga

SEQ ID NO: 390270 - RNA, 13 nt, Homo sapiens
agugguuacccag

SEQ ID NO: 390271 - RNA, 20 nt, Homo sapiens
aguguacauaugugcuggaa

SEQ ID NO: 390272 - RNA, 17 nt, Homo sapiens
aguguaugcacgugugc

SEQ ID NO: 390273 - RNA, 21 nt, Homo sapiens
aguguauuuuauguguggccc

SEQ ID NO: 390274 - RNA, 19 nt, Homo sapiens
aguguccccuccacuguca

SEQ ID NO: 390275 - RNA, 22 nt, Homo sapiens
aguguuaucagucauaacuaaa

SEQ ID NO: 390276 - RNA, 21 nt, Homo sapiens
aguguugaugcuuucgucucc

SEQ ID NO: 390277 - RNA, 23 nt, Homo sapiens
aguguuuggguauauucauuuca

SEQ ID NO: 390278 - RNA, 13 nt, Homo sapiens
aguuacucauuca

SEQ ID NO: 390279 - RNA, 16 nt, Homo sapiens
aguuagguagcuuuag

SEQ ID NO: 390280 - RNA, 13 nt, Homo sapiens
aguuagugccaua

SEQ ID NO: 390281 - RNA, 19 nt, Homo sapiens
aguuauggcuauaggugcu

SEQ ID NO: 390282 - RNA, 13 nt, Homo sapiens
aguuauuuuuaca

SEQ ID NO: 390283 - RNA, 22 nt, Homo sapiens
aguucacuuuuuacagugcuau

SEQ ID NO: 390284 - RNA, 18 nt, Homo sapiens
aguucaugucgcaacagu

SEQ ID NO: 390285 - RNA, 13 nt, Homo sapiens
aguuccacugcug

SEQ ID NO: 390286 - RNA, 13 nt, Homo sapiens
aguugaaacaaga

SEQ ID NO: 390287 - RNA, 17 nt, Homo sapiens
aguugaaauucuauucu

SEQ ID NO: 390288 - RNA, 14 nt, Homo sapiens
aguugauucagcuc

SEQ ID NO: 390289 - RNA, 16 nt, Homo sapiens
aguugcugaugaacuc

SEQ ID NO: 390290 - RNA, 23 nt, Homo sapiens
aguuguaccgcaaugugacuuaa

SEQ ID NO: 390291 - RNA, 15 nt, Homo sapiens
aguuuaauaccacag

SEQ ID NO: 390292 - RNA, 15 nt, Homo sapiens
aguuuauacuucucu

SEQ ID NO: 390293 - RNA, 19 nt, Homo sapiens
aguuuauacuucucuauua

SEQ ID NO: 390294 - RNA, 14 nt, Homo sapiens
aguuuaugauuuaa

SEQ ID NO: 390295 - RNA, 23 nt, Homo sapiens
aguuugaguuacuaucaugucaa

SEQ ID NO: 390296 - RNA, 18 nt, Homo sapiens
aguuugauuauucagugu

SEQ ID NO: 390297 - RNA, 19 nt, Homo sapiens
aguuuuucagaaagcauua

SEQ ID NO: 390298 - RNA, 22 nt, Homo sapiens
aguuuuucagaaagcauuacau

SEQ ID NO: 390299 - RNA, 16 nt, Homo sapiens
auaaaacaggucaaua

SEQ ID NO: 390300 - RNA, 17 nt, Homo sapiens
auaaaaccccaucucua

SEQ ID NO: 390301 - RNA, 21 nt, Homo sapiens
auaaaagaaccgagcaauuuu

SEQ ID NO: 390302 - RNA, 21 nt, Homo sapiens
auaaaauuaaagcugaaaacu

SEQ ID NO: 390303 - RNA, 15 nt, Homo sapiens
auaaaauuaugccau

SEQ ID NO: 390304 - RNA, 16 nt, Homo sapiens
auaaaauuaugccaua

SEQ ID NO: 390305 - RNA, 16 nt, Homo sapiens
auaaaauucauuaguu

SEQ ID NO: 390306 - RNA, 12 nt, Homo sapiens
auaaacauuuaa

SEQ ID NO: 390307 - RNA, 23 nt, Homo sapiens
auaaacauuuaacuuguuuccaa

SEQ ID NO: 390308 - RNA, 16 nt, Homo sapiens
auaaacugauuuaucu

SEQ ID NO: 390309 - RNA, 19 nt, Homo sapiens
auucucuuguuauugcauc

SEQ ID NO: 390310 - RNA, 14 nt, Homo sapiens
auucugauuacaca

SEQ ID NO: 390311 - RNA, 16 nt, Homo sapiens
auucugauuacacaaa

SEQ ID NO: 390312 - RNA, 20 nt, Homo sapiens
auucugcuaccucacugggg

SEQ ID NO: 390313 - RNA, 22 nt, Homo sapiens
auucugucacucaccacuacau

SEQ ID NO: 390314 - RNA, 14 nt, Homo sapiens
auucugucauuuca

SEQ ID NO: 390315 - RNA, 20 nt, Homo sapiens
auucuucaaccucauugaca

SEQ ID NO: 390316 - RNA, 20 nt, Homo sapiens
auucuuuaaauuucaucuca

SEQ ID NO: 390317 - RNA, 20 nt, Homo sapiens
auucuuucccaauucacauc

SEQ ID NO: 390318 - RNA, 24 nt, Homo sapiens
auugaacuuucacauagcacagaa

SEQ ID NO: 390319 - RNA, 14 nt, Homo sapiens
auugauuaccaagu

SEQ ID NO: 390320 - RNA, 14 nt, Homo sapiens
auugauuauucuga

SEQ ID NO: 390321 - RNA, 19 nt, Homo sapiens
auugcccauccaucugcuu

SEQ ID NO: 390322 - RNA, 22 nt, Homo sapiens
auugcugccccaucagugcucc

SEQ ID NO: 390323 - RNA, 20 nt, Homo sapiens
auugcuuacaagccuaagaa

SEQ ID NO: 390324 - RNA, 20 nt, Homo sapiens
auuggaccuguucaaaaagg

SEQ ID NO: 390325 - RNA, 18 nt, Homo sapiens
auuggggaagacuguggc

SEQ ID NO: 390326 - RNA, 18 nt, Homo sapiens
auuguacaugguacgaau

SEQ ID NO: 390327 - RNA, 19 nt, Homo sapiens
auuguaucaaaugugacau

SEQ ID NO: 390328 - RNA, 20 nt, Homo sapiens
auuguaucaaaugugacauu

SEQ ID NO: 390329 - RNA, 14 nt, Homo sapiens
auuguauuuaguua

SEQ ID NO: 390330 - RNA, 11 nt, Homo sapiens
auugugcacau

SEQ ID NO: 390331 - RNA, 12 nt, Homo sapiens
auuguggcugca

SEQ ID NO: 390332 - RNA, 20 nt, Homo sapiens
auugugugaguguaccauaa

SEQ ID NO: 390333 - RNA, 15 nt, Homo sapiens
auuguuaauuaucua

SEQ ID NO: 390334 - RNA, 18 nt, Homo sapiens
auuuaaaaaaaaaccuga

SEQ ID NO: 390335 - RNA, 16 nt, Homo sapiens
auuuaacuuguuucca

SEQ ID NO: 390336 - RNA, 19 nt, Homo sapiens
auuuacaaaauuacacagu

SEQ ID NO: 390337 - RNA, 16 nt, Homo sapiens
auuuacaaagugugua

SEQ ID NO: 390338 - RNA, 13 nt, Homo sapiens
auuuagcacauac

SEQ ID NO: 390339 - RNA, 15 nt, Homo sapiens
auuuaucugugcaaa

SEQ ID NO: 390340 - RNA, 19 nt, Homo sapiens
auuuaugacagugaacauu

SEQ ID NO: 390341 - RNA, 23 nt, Homo sapiens
auuuaugaguuuuugauagcuuu

SEQ ID NO: 390342 - RNA, 20 nt, Homo sapiens
auuuaugccucuguauuuaa

SEQ ID NO: 390343 - RNA, 13 nt, Homo sapiens
auuuauugccugg

SEQ ID NO: 390344 - RNA, 20 nt, Homo sapiens
auuuauugccuggaguguga

SEQ ID NO: 390345 - RNA, 18 nt, Homo sapiens
auuuauuuaacuauucau

SEQ ID NO: 390346 - RNA, 16 nt, Homo sapiens
auuuauuuaagcauca

SEQ ID NO: 390347 - RNA, 14 nt, Homo sapiens
auuucacagugugu

SEQ ID NO: 390348 - RNA, 23 nt, Homo sapiens
auuucagguuuuguaaagaugcc

SEQ ID NO: 390349 - RNA, 21 nt, Homo sapiens
auuucauaccuaucaucuuaa

SEQ ID NO: 390350 - RNA, 20 nt, Homo sapiens
auuucuagcagugaugaaaa

SEQ ID NO: 390351 - RNA, 12 nt, Homo sapiens
auuucuauucaa

SEQ ID NO: 390352 - RNA, 16 nt, Homo sapiens
auuucuccuccauggg

SEQ ID NO: 390353 - RNA, 17 nt, Homo sapiens
auuucugaaaugugcag

SEQ ID NO: 390354 - RNA, 21 nt, Homo sapiens
auuucugauauaacaaacuac

SEQ ID NO: 390355 - RNA, 16 nt, Homo sapiens
auuucuuauagucaau

SEQ ID NO: 390356 - RNA, 13 nt, Homo sapiens
auuucuucacuca

SEQ ID NO: 390357 - RNA, 14 nt, Homo sapiens
auuucuucacucaa

SEQ ID NO: 390358 - RNA, 19 nt, Homo sapiens
auuucuucacucaaucucu

SEQ ID NO: 390359 - RNA, 19 nt, Homo sapiens
auuugaacucuucaaucuc

SEQ ID NO: 390360 - RNA, 14 nt, Homo sapiens
auuugcagagacag

SEQ ID NO: 390361 - RNA, 18 nt, Homo sapiens
auuuggaaaauaaaucaa

SEQ ID NO: 390362 - RNA, 15 nt, Homo sapiens
auuuggauugcuaau

SEQ ID NO: 390363 - RNA, 17 nt, Homo sapiens
auuuguaauugaacuua

SEQ ID NO: 390364 - RNA, 17 nt, Homo sapiens
auuugugugugugcaag

SEQ ID NO: 390365 - RNA, 20 nt, Homo sapiens
auuuguucguauuuagaaug

SEQ ID NO: 390366 - RNA, 14 nt, Homo sapiens
auuuuaauuaucuu

SEQ ID NO: 390367 - RNA, 20 nt, Homo sapiens
auuuuaauugauuauucuga

SEQ ID NO: 390368 - RNA, 15 nt, Homo sapiens
auuuugaguucuaca

SEQ ID NO: 390369 - RNA, 11 nt, Homo sapiens
auuuugcccag

SEQ ID NO: 390370 - RNA, 18 nt, Homo sapiens
auuuugggguaagacuuu

SEQ ID NO: 390371 - RNA, 18 nt, Homo sapiens
auuuuguucuaguuuuca

SEQ ID NO: 390372 - RNA, 16 nt, Homo sapiens
auuuuuaacaccaugg

SEQ ID NO: 390373 - RNA, 19 nt, Homo sapiens
auuuuuaguuuaaaaaccu

SEQ ID NO: 390374 - RNA, 13 nt, Homo sapiens
auuuuuccauuua

SEQ ID NO: 390375 - RNA, 13 nt, Homo sapiens
auuuuugaauaca

SEQ ID NO: 390376 - RNA, 22 nt, Homo sapiens
auuuuuguuuucauuaucucaa

SEQ ID NO: 390377 - RNA, 16 nt, Homo sapiens
caaaaaaagaaaaaga

SEQ ID NO: 390378 - RNA, 15 nt, Homo sapiens
caaaaaaaucugcag

SEQ ID NO: 390379 - RNA, 18 nt, Homo sapiens
caaaaagccuuuuccaga

SEQ ID NO: 390380 - RNA, 12 nt, Homo sapiens
caaaaaugaacu

SEQ ID NO: 390381 - RNA, 18 nt, Homo sapiens
caaaaauguaaugaucau

SEQ ID NO: 390382 - RNA, 18 nt, Homo sapiens
caaaacagagaugugaua

SEQ ID NO: 390383 - RNA, 16 nt, Homo sapiens
caaaacugacaguaaa

SEQ ID NO: 390384 - RNA, 17 nt, Homo sapiens
caaaacugcacugucaa

SEQ ID NO: 390385 - RNA, 22 nt, Homo sapiens
caaaagaucaaauguauucaga

SEQ ID NO: 390386 - RNA, 20 nt, Homo sapiens
caaaagcuuauucaucuguu

SEQ ID NO: 390387 - RNA, 18 nt, Homo sapiens
caaaagggugucugagcc

SEQ ID NO: 390388 - RNA, 19 nt, Homo sapiens
caaaauaccaugccauuua

SEQ ID NO: 390389 - RNA, 17 nt, Homo sapiens
caaaauuagugcuuuuu

SEQ ID NO: 390390 - RNA, 15 nt, Homo sapiens
aucauuaugaaguca

SEQ ID NO: 390391 - RNA, 13 nt, Homo sapiens
aucauuccuugag

SEQ ID NO: 390392 - RNA, 22 nt, Homo sapiens
aucauuucuauuucuccuccau

SEQ ID NO: 390393 - RNA, 18 nt, Homo sapiens
aucauuucugcaucagcu

SEQ ID NO: 390394 - RNA, 18 nt, Homo sapiens
aucauuuucugcauuuaa

SEQ ID NO: 390395 - RNA, 15 nt, Homo sapiens
auccaaugcucaaga

SEQ ID NO: 390396 - RNA, 14 nt, Homo sapiens
auccacaugggagc

SEQ ID NO: 390397 - RNA, 15 nt, Homo sapiens
auccaccaccucccu

SEQ ID NO: 390398 - RNA, 18 nt, Homo sapiens
auccacccaccuuggccu

SEQ ID NO: 390399 - RNA, 14 nt, Homo sapiens
auccacuucucuca

SEQ ID NO: 390400 - RNA, 15 nt, Homo sapiens
auccacuucucucag

SEQ ID NO: 390401 - RNA, 18 nt, Homo sapiens
auccacuucucucaggau

SEQ ID NO: 390402 - RNA, 17 nt, Homo sapiens
auccaugaaccaagacc

SEQ ID NO: 390403 - RNA, 20 nt, Homo sapiens
auccaugcuuggguguaaca

SEQ ID NO: 390404 - RNA, 11 nt, Homo sapiens
aucccaggaca

SEQ ID NO: 390405 - RNA, 17 nt, Homo sapiens
aucccauucugcgucau

SEQ ID NO: 390406 - RNA, 15 nt, Homo sapiens
aucccccagccucaa

SEQ ID NO: 390407 - RNA, 19 nt, Homo sapiens
aucccccagccucaagucu

SEQ ID NO: 390408 - RNA, 19 nt, Homo sapiens
aucccccgcugguggcaga

SEQ ID NO: 390409 - RNA, 15 nt, Homo sapiens
auccccucucuuccu

SEQ ID NO: 390410 - RNA, 16 nt, Homo sapiens
auccccuggacuggga

SEQ ID NO: 390411 - RNA, 17 nt, Homo sapiens
aucccgaaaaucucucg

SEQ ID NO: 390412 - RNA, 14 nt, Homo sapiens
aucccguguugcca

SEQ ID NO: 390413 - RNA, 16 nt, Homo sapiens
aucccugccuggucac

SEQ ID NO: 390414 - RNA, 16 nt, Homo sapiens
aucccuuaccucggug

SEQ ID NO: 390415 - RNA, 22 nt, Homo sapiens
auccgaggcagggucaggagag

SEQ ID NO: 390416 - RNA, 20 nt, Homo sapiens
auccggcagccuggauguuu

SEQ ID NO: 390417 - RNA, 22 nt, Homo sapiens
auccucugagugugaccaggca

SEQ ID NO: 390418 - RNA, 19 nt, Homo sapiens
auccugcaauuccacuuau

SEQ ID NO: 390419 - RNA, 22 nt, Homo sapiens
auccuucuuucuaguucagcug

SEQ ID NO: 390420 - RNA, 13 nt, Homo sapiens
auccuuuacuguu

SEQ ID NO: 390421 - RNA, 15 nt, Homo sapiens
auccuuucuauugaa

SEQ ID NO: 390422 - RNA, 18 nt, Homo sapiens
aucgcucauagaucagca

SEQ ID NO: 390423 - RNA, 14 nt, Homo sapiens
aucuaaggauguca

SEQ ID NO: 390424 - RNA, 20 nt, Homo sapiens
aucuaaggaugucacagggc

SEQ ID NO: 390425 - RNA, 14 nt, Homo sapiens
aucuacacuccagu

SEQ ID NO: 390426 - RNA, 16 nt, Homo sapiens
aucuaugauaugcuaa

SEQ ID NO: 390427 - RNA, 16 nt, Homo sapiens
aucuauuucugagaag

SEQ ID NO: 390428 - RNA, 23 nt, Homo sapiens
aucucagcuccugaaaaaugccu

SEQ ID NO: 390429 - RNA, 17 nt, Homo sapiens
aucucauagguugccaa

SEQ ID NO: 390430 - RNA, 20 nt, Homo sapiens
aucucaugagugccaagcaa

SEQ ID NO: 390431 - RNA, 20 nt, Homo sapiens
aucucauggagaagcagaaa

SEQ ID NO: 390432 - RNA, 15 nt, Homo sapiens
aucuccauucucuca

SEQ ID NO: 390433 - RNA, 16 nt, Homo sapiens
aucuccccuucacaug

SEQ ID NO: 390434 - RNA, 22 nt, Homo sapiens
aucucccugccgccucaaugug

SEQ ID NO: 390435 - RNA, 13 nt, Homo sapiens
aucuccugaccuc

SEQ ID NO: 390436 - RNA, 22 nt, Homo sapiens
aucucugauucugucaaugucu

SEQ ID NO: 390437 - RNA, 16 nt, Homo sapiens
aucucuuauuuuacaa

SEQ ID NO: 390438 - RNA, 19 nt, Homo sapiens
aucugaacagaaauaccaa

SEQ ID NO: 390439 - RNA, 18 nt, Homo sapiens
aucuggccuaauguucca

SEQ ID NO: 390440 - RNA, 19 nt, Homo sapiens
aucugggcaaaugaaaaug

SEQ ID NO: 390441 - RNA, 13 nt, Homo sapiens
aucuggugccucu

SEQ ID NO: 390442 - RNA, 15 nt, Homo sapiens
aucuuaaagcauucc

SEQ ID NO: 390443 - RNA, 14 nt, Homo sapiens
aucuuaaaugccag

SEQ ID NO: 390444 - RNA, 20 nt, Homo sapiens
aucuuauucuuuuguaauau

SEQ ID NO: 390445 - RNA, 12 nt, Homo sapiens
aucuucacaaaa

SEQ ID NO: 390446 - RNA, 19 nt, Homo sapiens
aucuucagggcacugcugc

SEQ ID NO: 390447 - RNA, 23 nt, Homo sapiens
aucuuccuuuguugcacaaauag

SEQ ID NO: 390448 - RNA, 16 nt, Homo sapiens
aucuucuucaccauuu

SEQ ID NO: 390449 - RNA, 19 nt, Homo sapiens
aucuuggauuaugaaguga

SEQ ID NO: 390450 - RNA, 23 nt, Homo sapiens
aucuuggccaggcuggucuugaa

SEQ ID NO: 390451 - RNA, 22 nt, Homo sapiens
aucuuucacacuuccaccagcc

SEQ ID NO: 390452 - RNA, 17 nt, Homo sapiens
augaaaaugaaucuuca

SEQ ID NO: 390453 - RNA, 16 nt, Homo sapiens
augaaacauuuuguca

SEQ ID NO: 390454 - RNA, 21 nt, Homo sapiens
augaaacuuucaaauccuuca

SEQ ID NO: 390455 - RNA, 16 nt, Homo sapiens
augaaagggcaaagac

SEQ ID NO: 390456 - RNA, 15 nt, Homo sapiens
augaaaugcucuccu

SEQ ID NO: 390457 - RNA, 12 nt, Homo sapiens
augaacuuucuc

SEQ ID NO: 390458 - RNA, 21 nt, Homo sapiens
augaagauucuccugugcuag

SEQ ID NO: 390459 - RNA, 13 nt, Homo sapiens
caaggaagucaaa

SEQ ID NO: 390460 - RNA, 22 nt, Homo sapiens
caaggcccauaucugugaaaug

SEQ ID NO: 390461 - RNA, 21 nt, Homo sapiens
caagggccagcuggaggugaa

SEQ ID NO: 390462 - RNA, 21 nt, Homo sapiens
caagggcuuuguuuugcacac

SEQ ID NO: 390463 - RNA, 16 nt, Homo sapiens
caaggggugggccaca

SEQ ID NO: 390464 - RNA, 17 nt, Homo sapiens
caaggugacauuuccau

SEQ ID NO: 390465 - RNA, 21 nt, Homo sapiens
caaguauguugagaguugcug

SEQ ID NO: 390466 - RNA, 21 nt, Homo sapiens
caaguccugugaauuucuuca

SEQ ID NO: 390467 - RNA, 18 nt, Homo sapiens
caagucuucucaagaucc

SEQ ID NO: 390468 - RNA, 14 nt, Homo sapiens
caagugggugaaug

SEQ ID NO: 390469 - RNA, 14 nt, Homo sapiens
caaguguacaguga

SEQ ID NO: 390470 - RNA, 22 nt, Homo sapiens
caaguguaugcacgugugcaca

SEQ ID NO: 390471 - RNA, 13 nt, Homo sapiens
caagugucugugu

SEQ ID NO: 390472 - RNA, 16 nt, Homo sapiens
caagugucugugugca

SEQ ID NO: 390473 - RNA, 16 nt, Homo sapiens
caagugugugcaugug

SEQ ID NO: 390474 - RNA, 18 nt, Homo sapiens
caagugugugcaugugug

SEQ ID NO: 390475 - RNA, 15 nt, Homo sapiens
caagugugugugcgu

SEQ ID NO: 390476 - RNA, 16 nt, Homo sapiens
caaguugcuaagugaa

SEQ ID NO: 390477 - RNA, 20 nt, Homo sapiens
caaguuguggugcugacaaa

SEQ ID NO: 390478 - RNA, 20 nt, Homo sapiens
caauaaagaugcccacugag

SEQ ID NO: 390479 - RNA, 21 nt, Homo sapiens
caauaauaaauauuuuugcca

SEQ ID NO: 390480 - RNA, 18 nt, Homo sapiens
caauacaugcugcuaauu

SEQ ID NO: 390481 - RNA, 13 nt, Homo sapiens
caauauugccaug

SEQ ID NO: 390482 - RNA, 17 nt, Homo sapiens
caaucagagagcucacu

SEQ ID NO: 390483 - RNA, 17 nt, Homo sapiens
caaucagccacauucua

SEQ ID NO: 390484 - RNA, 21 nt, Homo sapiens
caaucaggguuuuuagauuaa

SEQ ID NO: 390485 - RNA, 19 nt, Homo sapiens
caaucaucaucauucucau

SEQ ID NO: 390486 - RNA, 16 nt, Homo sapiens
caauccagcuauguua

SEQ ID NO: 390487 - RNA, 18 nt, Homo sapiens
caaucuccccuugcacua

SEQ ID NO: 390488 - RNA, 13 nt, Homo sapiens
caaugacaucuca

SEQ ID NO: 390489 - RNA, 17 nt, Homo sapiens
caaugacaucucagggg

SEQ ID NO: 390490 - RNA, 21 nt, Homo sapiens
caaugacaucucaggggccag

SEQ ID NO: 390491 - RNA, 22 nt, Homo sapiens
caaugacaucucaggggccaga

SEQ ID NO: 390492 - RNA, 15 nt, Homo sapiens
caaugcacacaaaac

SEQ ID NO: 390493 - RNA, 15 nt, Homo sapiens
caaugccaaucuuca

SEQ ID NO: 390494 - RNA, 22 nt, Homo sapiens
caaugcuauaacuauguugaua

SEQ ID NO: 390495 - RNA, 14 nt, Homo sapiens
caauguuagccaca

SEQ ID NO: 390496 - RNA, 20 nt, Homo sapiens
caauuccaaaggaaucucca

SEQ ID NO: 390497 - RNA, 15 nt, Homo sapiens
caauuccucugggaa

SEQ ID NO: 390498 - RNA, 14 nt, Homo sapiens
caauucgaacuuuu

SEQ ID NO: 390499 - RNA, 21 nt, Homo sapiens
caauuuacuugccauuacuca

SEQ ID NO: 390500 - RNA, 17 nt, Homo sapiens
cacaaaauguacccagu

SEQ ID NO: 390501 - RNA, 18 nt, Homo sapiens
cacaaagcccuuccaugu

SEQ ID NO: 390502 - RNA, 15 nt, Homo sapiens
cacaaguccugugaa

SEQ ID NO: 390503 - RNA, 13 nt, Homo sapiens
cacacacccagcu

SEQ ID NO: 390504 - RNA, 23 nt, Homo sapiens
cacacagacccgcuggaccaaag

SEQ ID NO: 390505 - RNA, 19 nt, Homo sapiens
cacacgucauguuucuuca

SEQ ID NO: 390506 - RNA, 22 nt, Homo sapiens
cacacuccccugcacuggaguc

SEQ ID NO: 390507 - RNA, 23 nt, Homo sapiens
cacacuccuuugcuuagcccaca

SEQ ID NO: 390508 - RNA, 18 nt, Homo sapiens
cacacugaggaacucaca

SEQ ID NO: 390509 - RNA, 18 nt, Homo sapiens
cacacugaggcagggaag

SEQ ID NO: 390510 - RNA, 13 nt, Homo sapiens
cacacuuugcacu

SEQ ID NO: 390511 - RNA, 17 nt, Homo sapiens
cacagaagguccuggug

SEQ ID NO: 390512 - RNA, 14 nt, Homo sapiens
cacagagugcauug

SEQ ID NO: 390513 - RNA, 22 nt, Homo sapiens
cacagauguuugaggcuuucag

SEQ ID NO: 390514 - RNA, 21 nt, Homo sapiens
cacagcugcagagacagagag

SEQ ID NO: 390515 - RNA, 24 nt, Homo sapiens
cacagguguguuucccaucccacu

SEQ ID NO: 390516 - RNA, 13 nt, Homo sapiens
cacagugcaucuc

SEQ ID NO: 390517 - RNA, 15 nt, Homo sapiens
cacagugcaucucag

SEQ ID NO: 390518 - RNA, 23 nt, Homo sapiens
cacagugugaaucuuggugucua

SEQ ID NO: 390519 - RNA, 18 nt, Homo sapiens
cacaguuagguagcuuua

SEQ ID NO: 390520 - RNA, 17 nt, Homo sapiens
cacauacuugagacugu

SEQ ID NO: 390521 - RNA, 16 nt, Homo sapiens
cacaucuaaccucauc

SEQ ID NO: 390522 - RNA, 14 nt, Homo sapiens
cacaugugugcgug

SEQ ID NO: 390523 - RNA, 16 nt, Homo sapiens
cacauucaauaagcau

SEQ ID NO: 390524 - RNA, 18 nt, Homo sapiens
cacauucccaucugucac

SEQ ID NO: 390525 - RNA, 17 nt, Homo sapiens
cacauucgaguguuuca

SEQ ID NO: 390526 - RNA, 19 nt, Homo sapiens
cacauucuaaaggcuugau

SEQ ID NO: 390527 - RNA, 22 nt, Homo sapiens
caccaacauugcuugugccaca

SEQ ID NO: 390528 - RNA, 13 nt, Homo sapiens
caccacacauaca

SEQ ID NO: 390529 - RNA, 18 nt, Homo sapiens
caccaggaggcggcagug

SEQ ID NO: 390530 - RNA, 15 nt, Homo sapiens
caccaggucagggag

SEQ ID NO: 390531 - RNA, 14 nt, Homo sapiens
caccaugcccagcu

SEQ ID NO: 390532 - RNA, 18 nt, Homo sapiens
caccauguuugagcucag

SEQ ID NO: 390533 - RNA, 15 nt, Homo sapiens
caccccuaaagagau

SEQ ID NO: 390534 - RNA, 19 nt, Homo sapiens
caccuacgcgagucuuacu

SEQ ID NO: 390535 - RNA, 19 nt, Homo sapiens
caccucugcacaagcugca

SEQ ID NO: 390536 - RNA, 18 nt, Homo sapiens
caccucugccucaaugug

SEQ ID NO: 390537 - RNA, 15 nt, Homo sapiens
caccugaccaaucag

SEQ ID NO: 390538 - RNA, 12 nt, Homo sapiens
caccugcugcug

SEQ ID NO: 390539 - RNA, 21 nt, Homo sapiens
caccugucaaacaaagccaga

SEQ ID NO: 390540 - RNA, 18 nt, Homo sapiens
caccuuuugcacauaaca

SEQ ID NO: 390541 - RNA, 16 nt, Homo sapiens
cacgaacccaccugcu

SEQ ID NO: 390542 - RNA, 16 nt, Homo sapiens
cacgccuguaauccca

SEQ ID NO: 390543 - RNA, 22 nt, Homo sapiens
cacgccuguaaucccagcacuu

SEQ ID NO: 390544 - RNA, 15 nt, Homo sapiens
cacgccugugcagug

SEQ ID NO: 390545 - RNA, 23 nt, Homo sapiens
cacggaagggcucuuucacagcu

SEQ ID NO: 390546 - RNA, 17 nt, Homo sapiens
cacggauccauguagca

SEQ ID NO: 390547 - RNA, 14 nt, Homo sapiens
cacgucauguuucu

SEQ ID NO: 390548 - RNA, 14 nt, Homo sapiens
cacgugcuguucca

SEQ ID NO: 390549 - RNA, 19 nt, Homo sapiens
cacuaaauugacacuuaaa

SEQ ID NO: 390550 - RNA, 21 nt, Homo sapiens
cacuagcaauaaaaugcuaau

SEQ ID NO: 390551 - RNA, 22 nt, Homo sapiens
cacuagccaugauaacugcaau

SEQ ID NO: 390552 - RNA, 14 nt, Homo sapiens
cacuauuuacauac

SEQ ID NO: 390553 - RNA, 21 nt, Homo sapiens
cacucacacggacacucaaaa

SEQ ID NO: 390554 - RNA, 22 nt, Homo sapiens
cacuccaccacccaaaagucaa

SEQ ID NO: 390555 - RNA, 13 nt, Homo sapiens
cacuccagccuga

SEQ ID NO: 390556 - RNA, 14 nt, Homo sapiens
cacuccagcuccuu

SEQ ID NO: 390557 - RNA, 13 nt, Homo sapiens
cacuccagugcca

SEQ ID NO: 390558 - RNA, 22 nt, Homo sapiens
cacuccuuccugccaccugcug

SEQ ID NO: 390559 - RNA, 13 nt, Homo sapiens
cacucuacuacau

SEQ ID NO: 390560 - RNA, 23 nt, Homo sapiens
cacugaaaaaucuaagugauaua

SEQ ID NO: 390561 - RNA, 19 nt, Homo sapiens
cacugagcaaagcauugag

SEQ ID NO: 390562 - RNA, 22 nt, Homo sapiens
cacugauguaaguguuguggaa

SEQ ID NO: 390563 - RNA, 12 nt, Homo sapiens
cacugcaagcac

SEQ ID NO: 390564 - RNA, 13 nt, Homo sapiens
cacugcacccucc

SEQ ID NO: 390565 - RNA, 21 nt, Homo sapiens
cacugcucauuuggaucccag

SEQ ID NO: 390566 - RNA, 15 nt, Homo sapiens
cacugcuugaggaaa

SEQ ID NO: 390567 - RNA, 17 nt, Homo sapiens
cacuggaaaaguguaau

SEQ ID NO: 390568 - RNA, 13 nt, Homo sapiens
cacuggucuguag

SEQ ID NO: 390569 - RNA, 19 nt, Homo sapiens
cacuucgagcacuguccag

SEQ ID NO: 390570 - RNA, 14 nt, Homo sapiens
cacuucucucagga

SEQ ID NO: 390571 - RNA, 15 nt, Homo sapiens
cacuucucucaggau

SEQ ID NO: 390572 - RNA, 14 nt, Homo sapiens
cacuugcagccucc

SEQ ID NO: 390573 - RNA, 21 nt, Homo sapiens
cacuugccccuguuaccuaau

SEQ ID NO: 390574 - RNA, 19 nt, Homo sapiens
cacuugggucuucccugua

SEQ ID NO: 390575 - RNA, 16 nt, Homo sapiens
cagaaaagcaccugcc

SEQ ID NO: 390576 - RNA, 22 nt, Homo sapiens
cagaaaauauuauguguuucca

SEQ ID NO: 390577 - RNA, 16 nt, Homo sapiens
cagaaagcauccuaaa

SEQ ID NO: 390578 - RNA, 15 nt, Homo sapiens
cagaaagcauuacau

SEQ ID NO: 390579 - RNA, 15 nt, Homo sapiens
cagaaaguuaugaaa

SEQ ID NO: 390580 - RNA, 19 nt, Homo sapiens
cagaaauacauauuuccaa

SEQ ID NO: 390581 - RNA, 16 nt, Homo sapiens
cagaacaaacccugug

SEQ ID NO: 390582 - RNA, 12 nt, Homo sapiens
cagaacacacuc

SEQ ID NO: 390583 - RNA, 14 nt, Homo sapiens
cagaacacacucca

SEQ ID NO: 390584 - RNA, 18 nt, Homo sapiens
cagaacacacuccaucag

SEQ ID NO: 390585 - RNA, 13 nt, Homo sapiens
cagaagaucugaa

SEQ ID NO: 390586 - RNA, 14 nt, Homo sapiens
cagaauaauaagag

SEQ ID NO: 390587 - RNA, 21 nt, Homo sapiens
cagaauaaugaauggacucaa

SEQ ID NO: 390588 - RNA, 22 nt, Homo sapiens
cagaaucagaucugagcuucau

SEQ ID NO: 390589 - RNA, 16 nt, Homo sapiens
cagaaugagaaagccu

SEQ ID NO: 390590 - RNA, 15 nt, Homo sapiens
cagaauugagaguga

SEQ ID NO: 390591 - RNA, 16 nt, Homo sapiens
cagaauugagagugau

SEQ ID NO: 390592 - RNA, 17 nt, Homo sapiens
cagacaaaguaauuccu

SEQ ID NO: 390593 - RNA, 15 nt, Homo sapiens
cagacaaaugugguu

SEQ ID NO: 390594 - RNA, 13 nt, Homo sapiens
cagacagauucca

SEQ ID NO: 390595 - RNA, 16 nt, Homo sapiens
cagacaucaacagaua

SEQ ID NO: 390596 - RNA, 15 nt, Homo sapiens
cagaccauucaggac

SEQ ID NO: 390597 - RNA, 16 nt, Homo sapiens
cagaccauucaggaca

SEQ ID NO: 390598 - RNA, 19 nt, Homo sapiens
cagaccauucaggacacag

SEQ ID NO: 390599 - RNA, 20 nt, Homo sapiens
cagacccccacucucauucc

SEQ ID NO: 390600 - RNA, 14 nt, Homo sapiens
cagacccgcuggac

SEQ ID NO: 390601 - RNA, 16 nt, Homo sapiens
cagacgguucaccagc

SEQ ID NO: 390602 - RNA, 23 nt, Homo sapiens
cagacuaugucacccaaugcaua

SEQ ID NO: 390603 - RNA, 16 nt, Homo sapiens
cagacucagacuccau

SEQ ID NO: 390604 - RNA, 21 nt, Homo sapiens
cagacuggaggggacgcuggu

SEQ ID NO: 390605 - RNA, 18 nt, Homo sapiens
augaaucauugauugaau

SEQ ID NO: 390606 - RNA, 21 nt, Homo sapiens
augaaucucaagauucaguag

SEQ ID NO: 390607 - RNA, 12 nt, Homo sapiens
augaaugcagug

SEQ ID NO: 390608 - RNA, 20 nt, Homo sapiens
augaauggacucaaacugcc

SEQ ID NO: 390609 - RNA, 23 nt, Homo sapiens
augaauguuuacacucuuuguaa

SEQ ID NO: 390610 - RNA, 19 nt, Homo sapiens
augaauucugucauuucaa

SEQ ID NO: 390611 - RNA, 11 nt, Homo sapiens
augacagugaa

SEQ ID NO: 390612 - RNA, 14 nt, Homo sapiens
augacaucagcaau

SEQ ID NO: 390613 - RNA, 22 nt, Homo sapiens
augaccuguuauuaccauuagc

SEQ ID NO: 390614 - RNA, 22 nt, Homo sapiens
augaccuuggacaaucaugaaa

SEQ ID NO: 390615 - RNA, 17 nt, Homo sapiens
augaccuuguugcauga

SEQ ID NO: 390616 - RNA, 22 nt, Homo sapiens
augacggcucaugccuguaauc

SEQ ID NO: 390617 - RNA, 13 nt, Homo sapiens
augacucacauga

SEQ ID NO: 390618 - RNA, 13 nt, Homo sapiens
augacucagcaua

SEQ ID NO: 390619 - RNA, 15 nt, Homo sapiens
augacucagcauacc

SEQ ID NO: 390620 - RNA, 13 nt, Homo sapiens
augagaacaugaa

SEQ ID NO: 390621 - RNA, 16 nt, Homo sapiens
augagccgcugugagc

SEQ ID NO: 390622 - RNA, 20 nt, Homo sapiens
augagccuggcaagaaugug

SEQ ID NO: 390623 - RNA, 20 nt, Homo sapiens
augaguuuuugauagcuuua

SEQ ID NO: 390624 - RNA, 21 nt, Homo sapiens
augaguuuuugauagcuuuau

SEQ ID NO: 390625 - RNA, 23 nt, Homo sapiens
augaucuagagccaguuacuuug

SEQ ID NO: 390626 - RNA, 17 nt, Homo sapiens
augaucuggauccacca

SEQ ID NO: 390627 - RNA, 19 nt, Homo sapiens
augaugagcuccucuuccu

SEQ ID NO: 390628 - RNA, 19 nt, Homo sapiens
augaugucguuugaaucac

SEQ ID NO: 390629 - RNA, 21 nt, Homo sapiens
augauuggauuauucauuuaa

SEQ ID NO: 390630 - RNA, 18 nt, Homo sapiens
augcaaaguagcaauuuc

SEQ ID NO: 390631 - RNA, 13 nt, Homo sapiens
augcacacaaaac

SEQ ID NO: 390632 - RNA, 23 nt, Homo sapiens
augcacgugugcacacacaccac

SEQ ID NO: 390633 - RNA, 16 nt, Homo sapiens
augcagcaucuaagua

SEQ ID NO: 390634 - RNA, 16 nt, Homo sapiens
augcauaaaugcgauc

SEQ ID NO: 390635 - RNA, 20 nt, Homo sapiens
augcaucaaguuauugacaa

SEQ ID NO: 390636 - RNA, 18 nt, Homo sapiens
augccagcuuaucucagg

SEQ ID NO: 390637 - RNA, 22 nt, Homo sapiens
augccagugaaacuucaagcaa

SEQ ID NO: 390638 - RNA, 15 nt, Homo sapiens
augccauagcaagau

SEQ ID NO: 390639 - RNA, 15 nt, Homo sapiens
augccuguaauccca

SEQ ID NO: 390640 - RNA, 22 nt, Homo sapiens
augccuuccagcacccugcaaa

SEQ ID NO: 390641 - RNA, 16 nt, Homo sapiens
augcguuuaaucacau

SEQ ID NO: 390642 - RNA, 18 nt, Homo sapiens
augcuauaacuauguuga

SEQ ID NO: 390643 - RNA, 13 nt, Homo sapiens
augcuauauugca

SEQ ID NO: 390644 - RNA, 12 nt, Homo sapiens
augcucaagaaa

SEQ ID NO: 390645 - RNA, 14 nt, Homo sapiens
augcucagggucaa

SEQ ID NO: 390646 - RNA, 17 nt, Homo sapiens
augcuccuuccaacagg

SEQ ID NO: 390647 - RNA, 14 nt, Homo sapiens
augcugaccugugu

SEQ ID NO: 390648 - RNA, 17 nt, Homo sapiens
augcugauaaacugauu

SEQ ID NO: 390649 - RNA, 23 nt, Homo sapiens
augcuuuugguccagguacugag

SEQ ID NO: 390650 - RNA, 13 nt, Homo sapiens
auggaacauaaaa

SEQ ID NO: 390651 - RNA, 17 nt, Homo sapiens
auggaagcuuccagucc

SEQ ID NO: 390652 - RNA, 15 nt, Homo sapiens
auggaauuacaugua

SEQ ID NO: 390653 - RNA, 21 nt, Homo sapiens
auggacacuccagugccagca

SEQ ID NO: 390654 - RNA, 15 nt, Homo sapiens
auggacucaguuuuc

SEQ ID NO: 390655 - RNA, 14 nt, Homo sapiens
auggaggcacacag

SEQ ID NO: 390656 - RNA, 14 nt, Homo sapiens
auggauuuccagcc

SEQ ID NO: 390657 - RNA, 17 nt, Homo sapiens
auggcaauuucacugau

SEQ ID NO: 390658 - RNA, 15 nt, Homo sapiens
auggcaccaaagcca

SEQ ID NO: 390659 - RNA, 17 nt, Homo sapiens
auggcagcuuuccucaa

SEQ ID NO: 390660 - RNA, 22 nt, Homo sapiens
auggcauaggcugacuuuugca

SEQ ID NO: 390661 - RNA, 23 nt, Homo sapiens
auggccgaaaaggauaugcagua

SEQ ID NO: 390662 - RNA, 16 nt, Homo sapiens
auggcuaccaaaaaga

SEQ ID NO: 390663 - RNA, 15 nt, Homo sapiens
auggcuauauggcaa

SEQ ID NO: 390664 - RNA, 17 nt, Homo sapiens
auggcugugccucugcc

SEQ ID NO: 390665 - RNA, 17 nt, Homo sapiens
augggaaccccuucauc

SEQ ID NO: 390666 - RNA, 18 nt, Homo sapiens
augggaaggguccaucuc

SEQ ID NO: 390667 - RNA, 20 nt, Homo sapiens
augggaaggguccaucucag

SEQ ID NO: 390668 - RNA, 17 nt, Homo sapiens
augggauucagugcuuc

SEQ ID NO: 390669 - RNA, 18 nt, Homo sapiens
auggggagaaaagacaug

SEQ ID NO: 390670 - RNA, 18 nt, Homo sapiens
augguacuauguuagccc

SEQ ID NO: 390671 - RNA, 18 nt, Homo sapiens
augguagcauacuuuaua

SEQ ID NO: 390672 - RNA, 20 nt, Homo sapiens
auggucuuggcagcaccugu

SEQ ID NO: 390673 - RNA, 20 nt, Homo sapiens
auggugcaaauccuacugaa

SEQ ID NO: 390674 - RNA, 12 nt, Homo sapiens
aaucuaagugau

SEQ ID NO: 390675 - RNA, 12 nt, Homo sapiens
aaucuacacucc

SEQ ID NO: 390676 - RNA, 15 nt, Homo sapiens
aaucuaugccacuca

SEQ ID NO: 390677 - RNA, 15 nt, Homo sapiens
aaucucaagcaaaca

SEQ ID NO: 390678 - RNA, 16 nt, Homo sapiens
aaucucacaaaugauc

SEQ ID NO: 390679 - RNA, 21 nt, Homo sapiens
aaucucauggagaagcagaaa

SEQ ID NO: 390680 - RNA, 14 nt, Homo sapiens
aaucuccaguuuuc

SEQ ID NO: 390681 - RNA, 17 nt, Homo sapiens
aaucuccuucuuuccug

SEQ ID NO: 390682 - RNA, 21 nt, Homo sapiens
aaucuucagggcacugcugcu

SEQ ID NO: 390683 - RNA, 12 nt, Homo sapiens
aaugaaagcaug

SEQ ID NO: 390684 - RNA, 15 nt, Homo sapiens
aaugaagaugucuaa

SEQ ID NO: 390685 - RNA, 21 nt, Homo sapiens
aaugaagguuaggauuuaaca

SEQ ID NO: 390686 - RNA, 18 nt, Homo sapiens
aaugaaucuucacaaaac

SEQ ID NO: 390687 - RNA, 13 nt, Homo sapiens
aaugaauggcuaa

SEQ ID NO: 390688 - RNA, 14 nt, Homo sapiens
aaugacaucucagg

SEQ ID NO: 390689 - RNA, 20 nt, Homo sapiens
aaugacaucucaggggccag

SEQ ID NO: 390690 - RNA, 13 nt, Homo sapiens
aaugacauuugua

SEQ ID NO: 390691 - RNA, 14 nt, Homo sapiens
aaugagaaagccug

SEQ ID NO: 390692 - RNA, 23 nt, Homo sapiens
aaugagacccucguggccuuccc

SEQ ID NO: 390693 - RNA, 15 nt, Homo sapiens
aaugagccuggcaag

SEQ ID NO: 390694 - RNA, 20 nt, Homo sapiens
aaugauccguuccauugcaa

SEQ ID NO: 390695 - RNA, 19 nt, Homo sapiens
aaugaugauccuaggcauu

SEQ ID NO: 390696 - RNA, 15 nt, Homo sapiens
aaugauuucauucaa

SEQ ID NO: 390697 - RNA, 20 nt, Homo sapiens
aaugcagggacaaaugccac

SEQ ID NO: 390698 - RNA, 16 nt, Homo sapiens
aaugcuggcauuugca

SEQ ID NO: 390699 - RNA, 20 nt, Homo sapiens
aaugcuuggcuucucauacg

SEQ ID NO: 390700 - RNA, 21 nt, Homo sapiens
aauguauuuguuugcaauuuu

SEQ ID NO: 390701 - RNA, 13 nt, Homo sapiens
aaugucuaagaua

SEQ ID NO: 390702 - RNA, 19 nt, Homo sapiens
aaugucuugaugcaugcac

SEQ ID NO: 390703 - RNA, 22 nt, Homo sapiens
aaugucuuuccuuuugcucuua

SEQ ID NO: 390704 - RNA, 12 nt, Homo sapiens
aaugugaacuua

SEQ ID NO: 390705 - RNA, 15 nt, Homo sapiens
aaugugaaugggaaa

SEQ ID NO: 390706 - RNA, 21 nt, Homo sapiens
aaugugauauuugaagcauca

SEQ ID NO: 390707 - RNA, 17 nt, Homo sapiens
aauguguuaagugcagg

SEQ ID NO: 390708 - RNA, 23 nt, Homo sapiens
aauguuaaguugauggugaugaa

SEQ ID NO: 390709 - RNA, 15 nt, Homo sapiens
aauguuguaauucau

SEQ ID NO: 390710 - RNA, 20 nt, Homo sapiens
aauguuuagcaaauacauau

SEQ ID NO: 390711 - RNA, 18 nt, Homo sapiens
aauguuugucucauccca

SEQ ID NO: 390712 - RNA, 19 nt, Homo sapiens
aauguuugucucaucccau

SEQ ID NO: 390713 - RNA, 21 nt, Homo sapiens
aauuaauaucccuacauguau

SEQ ID NO: 390714 - RNA, 17 nt, Homo sapiens
aauuacuuuuucauucu

SEQ ID NO: 390715 - RNA, 18 nt, Homo sapiens
aauuacuuuuucauucuu

SEQ ID NO: 390716 - RNA, 21 nt, Homo sapiens
aauuagcugugugaaauacca

SEQ ID NO: 390717 - RNA, 15 nt, Homo sapiens
aauuaguaacaugug

SEQ ID NO: 390718 - RNA, 21 nt, Homo sapiens
aauuaguuccucauuagcauu

SEQ ID NO: 390719 - RNA, 22 nt, Homo sapiens
aauuauuugcauaacaauuccu

SEQ ID NO: 390720 - RNA, 13 nt, Homo sapiens
aauucagcacuga

SEQ ID NO: 390721 - RNA, 23 nt, Homo sapiens
aauucauucucugugguauccaa

SEQ ID NO: 390722 - RNA, 23 nt, Homo sapiens
aauuccuuagcuuagaccucagc

SEQ ID NO: 390723 - RNA, 16 nt, Homo sapiens
aauucuaacaagucau

SEQ ID NO: 390724 - RNA, 20 nt, Homo sapiens
aauucuagcuuugagcuuaa

SEQ ID NO: 390725 - RNA, 17 nt, Homo sapiens
aauucuauucugaucuu

SEQ ID NO: 390726 - RNA, 22 nt, Homo sapiens
aauucucagucaguaauugcca

SEQ ID NO: 390727 - RNA, 16 nt, Homo sapiens
aauucucaugugaucc

SEQ ID NO: 390728 - RNA, 22 nt, Homo sapiens
aauucugucacucaccacuaca

SEQ ID NO: 390729 - RNA, 14 nt, Homo sapiens
aauugacacuuaaa

SEQ ID NO: 390730 - RNA, 21 nt, Homo sapiens
aauugauuauucugauuccac

SEQ ID NO: 390731 - RNA, 16 nt, Homo sapiens
aauugcuucaagcauu

SEQ ID NO: 390732 - RNA, 17 nt, Homo sapiens
aauuuaaucacuuucau

SEQ ID NO: 390733 - RNA, 15 nt, Homo sapiens
aauuucaguaaacaa

SEQ ID NO: 390734 - RNA, 14 nt, Homo sapiens
aauuucuacuuuga

SEQ ID NO: 390735 - RNA, 19 nt, Homo sapiens
aauuuguaauugcuuacau

SEQ ID NO: 390736 - RNA, 21 nt, Homo sapiens
aauuuuuuaguauaaguacau

SEQ ID NO: 390737 - RNA, 22 nt, Homo sapiens
aauuuuuuuaaccaaaggugaa

SEQ ID NO: 390738 - RNA, 21 nt, Homo sapiens
acaaaaauguaaugaucauaa

SEQ ID NO: 390739 - RNA, 20 nt, Homo sapiens
acaaacccccacuccagcuc

SEQ ID NO: 390740 - RNA, 16 nt, Homo sapiens
acaaaccgagugcaau

SEQ ID NO: 390741 - RNA, 21 nt, Homo sapiens
acaaaccgagugcaaugaaug

SEQ ID NO: 390742 - RNA, 19 nt, Homo sapiens
acaaacucucccuucacuc

SEQ ID NO: 390743 - RNA, 18 nt, Homo sapiens
acaaaugccacacaucac

SEQ ID NO: 390744 - RNA, 22 nt, Homo sapiens
acaaaugccacacggcucucac

SEQ ID NO: 390745 - RNA, 15 nt, Homo sapiens
acaaaugguagcaua

SEQ ID NO: 390746 - RNA, 14 nt, Homo sapiens
acaaauugaacucu

SEQ ID NO: 390747 - RNA, 13 nt, Homo sapiens
acaaauugcuuga

SEQ ID NO: 390748 - RNA, 17 nt, Homo sapiens
acaacagcccugucuca

SEQ ID NO: 390749 - RNA, 12 nt, Homo sapiens
acaacugugguc

SEQ ID NO: 390750 - RNA, 19 nt, Homo sapiens
acaagacccaaaaggcaga

SEQ ID NO: 390751 - RNA, 19 nt, Homo sapiens
acaagaggcucccucuuga

SEQ ID NO: 390752 - RNA, 19 nt, Homo sapiens
acaagauccuuaaugcaga

SEQ ID NO: 390753 - RNA, 18 nt, Homo sapiens
acaaguauguugagaguu

SEQ ID NO: 390754 - RNA, 15 nt, Homo sapiens
acaagugcugaacag

SEQ ID NO: 390755 - RNA, 15 nt, Homo sapiens
acaagugggugaaug

SEQ ID NO: 390756 - RNA, 18 nt, Homo sapiens
acaauagugauugauaga

SEQ ID NO: 390757 - RNA, 19 nt, Homo sapiens
acaaucaucaucauucuca

SEQ ID NO: 390758 - RNA, 15 nt, Homo sapiens
acaaugaaaugcucu

SEQ ID NO: 390759 - RNA, 15 nt, Homo sapiens
acaauguucauccca

SEQ ID NO: 390760 - RNA, 13 nt, Homo sapiens
acaauuuaccagc

SEQ ID NO: 390761 - RNA, 19 nt, Homo sapiens
acacaaaauguacccagua

SEQ ID NO: 390762 - RNA, 16 nt, Homo sapiens
acacacucaaaucaag

SEQ ID NO: 390763 - RNA, 14 nt, Homo sapiens
acacagaugaaggu

SEQ ID NO: 390764 - RNA, 15 nt, Homo sapiens
acacaguuacagagu

SEQ ID NO: 390765 - RNA, 15 nt, Homo sapiens
acacaugagaucuag

SEQ ID NO: 390766 - RNA, 21 nt, Homo sapiens
acacauuguacaugguacgaa

SEQ ID NO: 390767 - RNA, 17 nt, Homo sapiens
acaccaggagagcuucu

SEQ ID NO: 390768 - RNA, 17 nt, Homo sapiens
acaccauuuuccugccu

SEQ ID NO: 390769 - RNA, 19 nt, Homo sapiens
acaccauuuuccugccuca

SEQ ID NO: 390770 - RNA, 15 nt, Homo sapiens
acacccagugccagg

SEQ ID NO: 390771 - RNA, 19 nt, Homo sapiens
acaccguccuccacgccau

SEQ ID NO: 390772 - RNA, 21 nt, Homo sapiens
acaccuggcacugcugugcug

SEQ ID NO: 390773 - RNA, 19 nt, Homo sapiens
acaccuguagucccagcua

SEQ ID NO: 390774 - RNA, 21 nt, Homo sapiens
acacgcaacuggcucaaagac

SEQ ID NO: 390775 - RNA, 21 nt, Homo sapiens
acacgccugcaaacgcugccu

SEQ ID NO: 390776 - RNA, 22 nt, Homo sapiens
acacgccugcaaacgcugccug

SEQ ID NO: 390777 - RNA, 18 nt, Homo sapiens
acacuaacauauaauguu

SEQ ID NO: 390778 - RNA, 16 nt, Homo sapiens
acacucaaaagcuggg

SEQ ID NO: 390779 - RNA, 17 nt, Homo sapiens
acacucaaaucaagaaa

SEQ ID NO: 390780 - RNA, 15 nt, Homo sapiens
acacuccagugccag

SEQ ID NO: 390781 - RNA, 21 nt, Homo sapiens
acacugaaaaaucuaagugau

SEQ ID NO: 390782 - RNA, 15 nt, Homo sapiens
acacugaaguuaaca

SEQ ID NO: 390783 - RNA, 16 nt, Homo sapiens
acacugugggacucuu

SEQ ID NO: 390784 - RNA, 16 nt, Homo sapiens
acacuuccaccagccu

SEQ ID NO: 390785 - RNA, 16 nt, Homo sapiens
acacuuccauuaacuu

SEQ ID NO: 390786 - RNA, 20 nt, Homo sapiens
acacuucuaaaugaagugca

SEQ ID NO: 390787 - RNA, 18 nt, Homo sapiens
acagaagccucacugcaa

SEQ ID NO: 390788 - RNA, 15 nt, Homo sapiens
acagagaugugauaa

SEQ ID NO: 390789 - RNA, 16 nt, Homo sapiens
acagagcuucccugac

SEQ ID NO: 390790 - RNA, 19 nt, Homo sapiens
acagagcuucccugacuca

SEQ ID NO: 390791 - RNA, 23 nt, Homo sapiens
acagagggcaggaacuugcacaa

SEQ ID NO: 390792 - RNA, 17 nt, Homo sapiens
acagauagucaaaccau

SEQ ID NO: 390793 - RNA, 21 nt, Homo sapiens
acagauuccaggcgaugugca

SEQ ID NO: 390794 - RNA, 22 nt, Homo sapiens
acagauuccaggcgaugugcaa

SEQ ID NO: 390795 - RNA, 13 nt, Homo sapiens
acagcacuaugua

SEQ ID NO: 390796 - RNA, 18 nt, Homo sapiens
acagcagauuucagauca

SEQ ID NO: 390797 - RNA, 15 nt, Homo sapiens
acagcagcaucuuca

SEQ ID NO: 390798 - RNA, 19 nt, Homo sapiens
acagccccucuggacacag

SEQ ID NO: 390799 - RNA, 23 nt, Homo sapiens
acagccucccacccccaucucuc

SEQ ID NO: 390800 - RNA, 22 nt, Homo sapiens
acagccucugaccccuccucac

SEQ ID NO: 390801 - RNA, 18 nt, Homo sapiens
acagccuggcacagggca

SEQ ID NO: 390802 - RNA, 16 nt, Homo sapiens
acagcgacauagccca

SEQ ID NO: 390803 - RNA, 23 nt, Homo sapiens
acagcucgggcccucugugagau

SEQ ID NO: 390804 - RNA, 11 nt, Homo sapiens
acagcucugca

SEQ ID NO: 390805 - RNA, 16 nt, Homo sapiens
augaacucuuaaucaa

SEQ ID NO: 390806 - RNA, 20 nt, Homo sapiens
augaagacccuggaguucaa

SEQ ID NO: 390807 - RNA, 21 nt, Homo sapiens
augaagaugucuaauaguuau

SEQ ID NO: 390808 - RNA, 17 nt, Homo sapiens
augaagugacucucaca

SEQ ID NO: 390809 - RNA, 20 nt, Homo sapiens
augaaguguguuuccuucag

SEQ ID NO: 390810 - RNA, 18 nt, Homo sapiens
augaauaauacauugaau

SEQ ID NO: 390811 - RNA, 21 nt, Homo sapiens
augaaucuucacaaaacacuu

SEQ ID NO: 390812 - RNA, 14 nt, Homo sapiens
augaaugaauggcu

SEQ ID NO: 390813 - RNA, 19 nt, Homo sapiens
augaauugcauuuuacuuu

SEQ ID NO: 390814 - RNA, 12 nt, Homo sapiens
augacaaaaagc

SEQ ID NO: 390815 - RNA, 14 nt, Homo sapiens
augacaaagaguag

SEQ ID NO: 390816 - RNA, 17 nt, Homo sapiens
augacacagcuuuauca

SEQ ID NO: 390817 - RNA, 14 nt, Homo sapiens
augacaucucaggg

SEQ ID NO: 390818 - RNA, 18 nt, Homo sapiens
augaccaguaauugugaa

SEQ ID NO: 390819 - RNA, 16 nt, Homo sapiens
augacggcucaugccu

SEQ ID NO: 390820 - RNA, 16 nt, Homo sapiens
augacugaugacauau

SEQ ID NO: 390821 - RNA, 18 nt, Homo sapiens
augagaaagccugagaag

SEQ ID NO: 390822 - RNA, 14 nt, Homo sapiens
augagagaacugga

SEQ ID NO: 390823 - RNA, 15 nt, Homo sapiens
augagagaacuggag

SEQ ID NO: 390824 - RNA, 18 nt, Homo sapiens
augagagaauaagucaug

SEQ ID NO: 390825 - RNA, 18 nt, Homo sapiens
augagcauccucucucac

SEQ ID NO: 390826 - RNA, 24 nt, Homo sapiens
augagcauccucucucacauggaa

SEQ ID NO: 390827 - RNA, 12 nt, Homo sapiens
augagcauuuag

SEQ ID NO: 390828 - RNA, 15 nt, Homo sapiens
augagcccucagaac

SEQ ID NO: 390829 - RNA, 13 nt, Homo sapiens
augagcuuccuuc

SEQ ID NO: 390830 - RNA, 21 nt, Homo sapiens
augagggugacguagaauuga

SEQ ID NO: 390831 - RNA, 20 nt, Homo sapiens
augaguggagguuaaggcug

SEQ ID NO: 390832 - RNA, 16 nt, Homo sapiens
augauaacugcaauuu

SEQ ID NO: 390833 - RNA, 16 nt, Homo sapiens
augauacacaccuuuc

SEQ ID NO: 390834 - RNA, 18 nt, Homo sapiens
augauccuaaugaaugca

SEQ ID NO: 390835 - RNA, 22 nt, Homo sapiens
augauccuaaugaaugcauaaa

SEQ ID NO: 390836 - RNA, 22 nt, Homo sapiens
augauccuaggcauuugcugaa

SEQ ID NO: 390837 - RNA, 13 nt, Homo sapiens
augauccugcaau

SEQ ID NO: 390838 - RNA, 13 nt, Homo sapiens
augaucucccugc

SEQ ID NO: 390839 - RNA, 14 nt, Homo sapiens
augaugaugaucuu

SEQ ID NO: 390840 - RNA, 18 nt, Homo sapiens
augaugccucaugauaug

SEQ ID NO: 390841 - RNA, 14 nt, Homo sapiens
augauugugcacau

SEQ ID NO: 390842 - RNA, 16 nt, Homo sapiens
augcaaaguagcaauu

SEQ ID NO: 390843 - RNA, 16 nt, Homo sapiens
augcagcaaaauguga

SEQ ID NO: 390844 - RNA, 14 nt, Homo sapiens
augcagggacaaau

SEQ ID NO: 390845 - RNA, 23 nt, Homo sapiens
augcauauccaacaugugcucag

SEQ ID NO: 390846 - RNA, 16 nt, Homo sapiens
augccacaaaacugac

SEQ ID NO: 390847 - RNA, 17 nt, Homo sapiens
augccacucagaaucuc

SEQ ID NO: 390848 - RNA, 14 nt, Homo sapiens
augcccacugagga

SEQ ID NO: 390849 - RNA, 16 nt, Homo sapiens
augccccggccaccuc

SEQ ID NO: 390850 - RNA, 19 nt, Homo sapiens
augccucauuaccuugugc

SEQ ID NO: 390851 - RNA, 22 nt, Homo sapiens
augccucauuaccuugugcuaa

SEQ ID NO: 390852 - RNA, 16 nt, Homo sapiens
augccucuguauuuaa

SEQ ID NO: 390853 - RNA, 17 nt, Homo sapiens
augccuucacuuuacaa

SEQ ID NO: 390854 - RNA, 18 nt, Homo sapiens
augcgggcugggcagcug

SEQ ID NO: 390855 - RNA, 13 nt, Homo sapiens
augcuccuuccaa

SEQ ID NO: 390856 - RNA, 13 nt, Homo sapiens
augcugacaucca

SEQ ID NO: 390857 - RNA, 18 nt, Homo sapiens
augcugacauccaggugg

SEQ ID NO: 390858 - RNA, 14 nt, Homo sapiens
augcugccuaggcu

SEQ ID NO: 390859 - RNA, 15 nt, Homo sapiens
augcugcuaauucaa

SEQ ID NO: 390860 - RNA, 11 nt, Homo sapiens
augcuuuacaa

SEQ ID NO: 390861 - RNA, 19 nt, Homo sapiens
augcuuucgauaguguuaa

SEQ ID NO: 390862 - RNA, 16 nt, Homo sapiens
auggaaaaaucuugga

SEQ ID NO: 390863 - RNA, 20 nt, Homo sapiens
auggaaagaaucuaauagag

SEQ ID NO: 390864 - RNA, 21 nt, Homo sapiens
auggaaaucacauuuacaaaa

SEQ ID NO: 390865 - RNA, 16 nt, Homo sapiens
auggaacucauuccug

SEQ ID NO: 390866 - RNA, 20 nt, Homo sapiens
auggaauuucucccagucau

SEQ ID NO: 390867 - RNA, 23 nt, Homo sapiens
auggacagacagaggaugagcuc

SEQ ID NO: 390868 - RNA, 18 nt, Homo sapiens
auggagccagcucugcau

SEQ ID NO: 390869 - RNA, 23 nt, Homo sapiens
auggagcugcguuuccugugcau

SEQ ID NO: 390870 - RNA, 19 nt, Homo sapiens
auggagguucucucggagu

SEQ ID NO: 390871 - RNA, 17 nt, Homo sapiens
auggaucuuaaagcauu

SEQ ID NO: 390872 - RNA, 16 nt, Homo sapiens
auggcacccaugcacc

SEQ ID NO: 390873 - RNA, 16 nt, Homo sapiens
auggcaccuuuugcac

SEQ ID NO: 390874 - RNA, 16 nt, Homo sapiens
auggcuauaggugcua

SEQ ID NO: 390875 - RNA, 19 nt, Homo sapiens
augggcagagcccaaggga

SEQ ID NO: 390876 - RNA, 15 nt, Homo sapiens
augguacuacaacca

SEQ ID NO: 390877 - RNA, 14 nt, Homo sapiens
augguuuuacucau

SEQ ID NO: 390878 - RNA, 19 nt, Homo sapiens
augguuuuacucaugugca

SEQ ID NO: 390879 - RNA, 15 nt, Homo sapiens
auguaaacugugcac

SEQ ID NO: 390880 - RNA, 16 nt, Homo sapiens
auguaaacugugcacc

SEQ ID NO: 390881 - RNA, 21 nt, Homo sapiens
auguaacgaaugguacuacaa

SEQ ID NO: 390882 - RNA, 12 nt, Homo sapiens
auguacaaauag

SEQ ID NO: 390883 - RNA, 18 nt, Homo sapiens
auguacaugaagaagcua

SEQ ID NO: 390884 - RNA, 14 nt, Homo sapiens
auguauaugcacuu

SEQ ID NO: 390885 - RNA, 18 nt, Homo sapiens
augucacagggccaacuu

SEQ ID NO: 390886 - RNA, 17 nt, Homo sapiens
augucaguuccaaugag

SEQ ID NO: 390887 - RNA, 16 nt, Homo sapiens
augucaucauacauga

SEQ ID NO: 390888 - RNA, 17 nt, Homo sapiens
augucaucauacaugac

SEQ ID NO: 390889 - RNA, 12 nt, Homo sapiens
auguccacagau

SEQ ID NO: 390890 - RNA, 17 nt, Homo sapiens
augucguuugaaucaca

SEQ ID NO: 390891 - RNA, 20 nt, Homo sapiens
augucugaucuaaaugugga

SEQ ID NO: 390892 - RNA, 23 nt, Homo sapiens
augucugugggcaggaagugaag

SEQ ID NO: 390893 - RNA, 17 nt, Homo sapiens
augugaacacaucagcu

SEQ ID NO: 390894 - RNA, 19 nt, Homo sapiens
augugcagguuuugaaaau

SEQ ID NO: 390895 - RNA, 14 nt, Homo sapiens
augugcucagggaa

SEQ ID NO: 390896 - RNA, 16 nt, Homo sapiens
augugggugggaccac

SEQ ID NO: 390897 - RNA, 18 nt, Homo sapiens
augugggugggaccacag

SEQ ID NO: 390898 - RNA, 14 nt, Homo sapiens
auguguaaggugaa

SEQ ID NO: 390899 - RNA, 20 nt, Homo sapiens
augugugagaauaaacuaga

SEQ ID NO: 390900 - RNA, 16 nt, Homo sapiens
augugugauucacagu

SEQ ID NO: 390901 - RNA, 16 nt, Homo sapiens
augugugcgagugugu

SEQ ID NO: 390902 - RNA, 12 nt, Homo sapiens
augugugugcaa

SEQ ID NO: 390903 - RNA, 16 nt, Homo sapiens
augugugugcaagugu

SEQ ID NO: 390904 - RNA, 13 nt, Homo sapiens
augugugugcuca

SEQ ID NO: 390905 - RNA, 14 nt, Homo sapiens
auguucaacuggag

SEQ ID NO: 390906 - RNA, 15 nt, Homo sapiens
auguugaugaaaaau

SEQ ID NO: 390907 - RNA, 16 nt, Homo sapiens
auguuuagaguugcaa

SEQ ID NO: 390908 - RNA, 16 nt, Homo sapiens
auguuugucucauccc

SEQ ID NO: 390909 - RNA, 13 nt, Homo sapiens
aagacuccaaaga

SEQ ID NO: 390910 - RNA, 19 nt, Homo sapiens
aagagaaaaaauauuuucc

SEQ ID NO: 390911 - RNA, 14 nt, Homo sapiens
aagagaaugucuga

SEQ ID NO: 390912 - RNA, 21 nt, Homo sapiens
aagagagaacaacuacuguga

SEQ ID NO: 390913 - RNA, 13 nt, Homo sapiens
aagagagaucaaa

SEQ ID NO: 390914 - RNA, 16 nt, Homo sapiens
aagagauuuuucauga

SEQ ID NO: 390915 - RNA, 22 nt, Homo sapiens
aagagauuuuucaugauuuuga

SEQ ID NO: 390916 - RNA, 21 nt, Homo sapiens
aagaggaaggccucuguggca

SEQ ID NO: 390917 - RNA, 17 nt, Homo sapiens
aagagggaacuuagcag

SEQ ID NO: 390918 - RNA, 19 nt, Homo sapiens
aagagugccguaacaacug

SEQ ID NO: 390919 - RNA, 14 nt, Homo sapiens
aagaguggaaccaa

SEQ ID NO: 390920 - RNA, 14 nt, Homo sapiens
aagaguuacuuaau

SEQ ID NO: 390921 - RNA, 14 nt, Homo sapiens
caugaaaacagaaa

SEQ ID NO: 390922 - RNA, 20 nt, Homo sapiens
caugaaguguguuuccuuca

SEQ ID NO: 390923 - RNA, 12 nt, Homo sapiens
caugaauaugau

SEQ ID NO: 390924 - RNA, 20 nt, Homo sapiens
caugacauauuuuugcuuua

SEQ ID NO: 390925 - RNA, 14 nt, Homo sapiens
caugagaauaagag

SEQ ID NO: 390926 - RNA, 22 nt, Homo sapiens
caugagcuauuuccauuccaga

SEQ ID NO: 390927 - RNA, 15 nt, Homo sapiens
caugaggaccaggug

SEQ ID NO: 390928 - RNA, 18 nt, Homo sapiens
caugagugaauaaauguc

SEQ ID NO: 390929 - RNA, 14 nt, Homo sapiens
caugaugagaguuu

SEQ ID NO: 390930 - RNA, 16 nt, Homo sapiens
caugauuucauuucaa

SEQ ID NO: 390931 - RNA, 22 nt, Homo sapiens
caugauuucauuucaacuguuu

SEQ ID NO: 390932 - RNA, 18 nt, Homo sapiens
caugcaguugugggaccg

SEQ ID NO: 390933 - RNA, 13 nt, Homo sapiens
caugcuacugcca

SEQ ID NO: 390934 - RNA, 14 nt, Homo sapiens
caugcuacugccaa

SEQ ID NO: 390935 - RNA, 22 nt, Homo sapiens
caugcuccuggcccacugcauc

SEQ ID NO: 390936 - RNA, 21 nt, Homo sapiens
caugcuuccuccuuugcucuu

SEQ ID NO: 390937 - RNA, 18 nt, Homo sapiens
cauggaaacgcaaaugag

SEQ ID NO: 390938 - RNA, 21 nt, Homo sapiens
cauggaacucauuccugccug

SEQ ID NO: 390939 - RNA, 17 nt, Homo sapiens
cauggauaugugccagg

SEQ ID NO: 390940 - RNA, 16 nt, Homo sapiens
cauggcaccaaagcca

SEQ ID NO: 390941 - RNA, 21 nt, Homo sapiens
cauggccagguggccacucca

SEQ ID NO: 390942 - RNA, 12 nt, Homo sapiens
caugggagaccc

SEQ ID NO: 390943 - RNA, 14 nt, Homo sapiens
caugugugugcaag

SEQ ID NO: 390944 - RNA, 23 nt, Homo sapiens
caugugugugcaagugugugcau

SEQ ID NO: 390945 - RNA, 21 nt, Homo sapiens
cauguuaggaaaauuucacau

SEQ ID NO: 390946 - RNA, 14 nt, Homo sapiens
cauuaagcccucuu

SEQ ID NO: 390947 - RNA, 18 nt, Homo sapiens
cauuaagcccucuuccau

SEQ ID NO: 390948 - RNA, 16 nt, Homo sapiens
cauuaccuugugcuaa

SEQ ID NO: 390949 - RNA, 18 nt, Homo sapiens
cauuauaacugaaggaga

SEQ ID NO: 390950 - RNA, 14 nt, Homo sapiens
cauuauaugcacua

SEQ ID NO: 390951 - RNA, 17 nt, Homo sapiens
cauucagagagcagcuu

SEQ ID NO: 390952 - RNA, 9 nt, Homo sapiens
cauucaguc

SEQ ID NO: 390953 - RNA, 15 nt, Homo sapiens
cauucccaucuguca

SEQ ID NO: 390954 - RNA, 11 nt, Homo sapiens
cauucccugag

SEQ ID NO: 390955 - RNA, 21 nt, Homo sapiens
cauucccugagucaccaggaa

SEQ ID NO: 390956 - RNA, 17 nt, Homo sapiens
cauucuaguacuuggga

SEQ ID NO: 390957 - RNA, 15 nt, Homo sapiens
cauucuaucuauucc

SEQ ID NO: 390958 - RNA, 22 nt, Homo sapiens
cauucugguuuugacaucagca

SEQ ID NO: 390959 - RNA, 10 nt, Homo sapiens
cauugaacaa

SEQ ID NO: 390960 - RNA, 19 nt, Homo sapiens
cauuguucagaugcuucuu

SEQ ID NO: 390961 - RNA, 18 nt, Homo sapiens
cauuuaaaaaaaaucccu

SEQ ID NO: 390962 - RNA, 22 nt, Homo sapiens
cauuuagaggacauucuggaaa

SEQ ID NO: 390963 - RNA, 15 nt, Homo sapiens
cauuuauuauuucaa

SEQ ID NO: 390964 - RNA, 12 nt, Homo sapiens
cauuuccaugca

SEQ ID NO: 390965 - RNA, 15 nt, Homo sapiens
cauuuccaugcauaa

SEQ ID NO: 390966 - RNA, 17 nt, Homo sapiens
cauuuccaugcauaaau

SEQ ID NO: 390967 - RNA, 19 nt, Homo sapiens
cauuuccugacagaaggac

SEQ ID NO: 390968 - RNA, 15 nt, Homo sapiens
cauuucgccccucau

SEQ ID NO: 390969 - RNA, 15 nt, Homo sapiens
cauuucuagcaguga

SEQ ID NO: 390970 - RNA, 18 nt, Homo sapiens
cauuucuagcagugauga

SEQ ID NO: 390971 - RNA, 16 nt, Homo sapiens
cauuucugagaucaaa

SEQ ID NO: 390972 - RNA, 20 nt, Homo sapiens
cauuucugagaucaaaacgg

SEQ ID NO: 390973 - RNA, 16 nt, Homo sapiens
cauuugaaaucuauga

SEQ ID NO: 390974 - RNA, 20 nt, Homo sapiens
cauuugaguugcccaucuug

SEQ ID NO: 390975 - RNA, 15 nt, Homo sapiens
cauuugcaccuaccu

SEQ ID NO: 390976 - RNA, 16 nt, Homo sapiens
cauuugcaccuaccuc

SEQ ID NO: 390977 - RNA, 19 nt, Homo sapiens
cauuugggagacaugugac

SEQ ID NO: 390978 - RNA, 17 nt, Homo sapiens
cauuugugugugugcaa

SEQ ID NO: 390979 - RNA, 19 nt, Homo sapiens
cauuugugugugugcaagu

SEQ ID NO: 390980 - RNA, 23 nt, Homo sapiens
cauuugugugugugcaagugugu

SEQ ID NO: 390981 - RNA, 14 nt, Homo sapiens
cauuuucaccccac

SEQ ID NO: 390982 - RNA, 18 nt, Homo sapiens
cauuuuuaucccauugag

SEQ ID NO: 390983 - RNA, 18 nt, Homo sapiens
ccaaaggauaaguguccc

SEQ ID NO: 390984 - RNA, 18 nt, Homo sapiens
ccaaaggucauccuuaau

SEQ ID NO: 390985 - RNA, 14 nt, Homo sapiens
ccaaaguaaauguc

SEQ ID NO: 390986 - RNA, 15 nt, Homo sapiens
ccaaagugcugcgau

SEQ ID NO: 390987 - RNA, 13 nt, Homo sapiens
ccaaaguuugcuc

SEQ ID NO: 390988 - RNA, 23 nt, Homo sapiens
ccaaauaaacucuaaacauuaau

SEQ ID NO: 390989 - RNA, 21 nt, Homo sapiens
ccaacagaagcuuccauucca

SEQ ID NO: 390990 - RNA, 18 nt, Homo sapiens
ccaacagucaaaacagag

SEQ ID NO: 390991 - RNA, 20 nt, Homo sapiens
ccaacaucaacaucuugguc

SEQ ID NO: 390992 - RNA, 21 nt, Homo sapiens
ccaacaugaaaacaauucuua

SEQ ID NO: 390993 - RNA, 15 nt, Homo sapiens
ccaaccacaagcaca

SEQ ID NO: 390994 - RNA, 14 nt, Homo sapiens
ccaacccaucagaa

SEQ ID NO: 390995 - RNA, 18 nt, Homo sapiens
ccaaccugaccagugucu

SEQ ID NO: 390996 - RNA, 12 nt, Homo sapiens
ccauucaggaca

SEQ ID NO: 390997 - RNA, 21 nt, Homo sapiens
ccauucuacauacuauggaau

SEQ ID NO: 390998 - RNA, 16 nt, Homo sapiens
ccauugagacuauuua

SEQ ID NO: 390999 - RNA, 14 nt, Homo sapiens
ccauuguggucaca

SEQ ID NO: 391000 - RNA, 13 nt, Homo sapiens
cccaaaaggcaga

SEQ ID NO: 391001 - RNA, 19 nt, Homo sapiens
cccaaagugcuaguauuau

SEQ ID NO: 391002 - RNA, 23 nt, Homo sapiens
cccaagucuacagagugauagcc

SEQ ID NO: 391003 - RNA, 16 nt, Homo sapiens
cccaaguuccacugcu

SEQ ID NO: 391004 - RNA, 21 nt, Homo sapiens
cccacgacugcccggcagggu

SEQ ID NO: 391005 - RNA, 12 nt, Homo sapiens
cccacuucaggg

SEQ ID NO: 391006 - RNA, 16 nt, Homo sapiens
cccagaacuggacuca

SEQ ID NO: 391007 - RNA, 19 nt, Homo sapiens
cccagaacuggacucagga

SEQ ID NO: 391008 - RNA, 22 nt, Homo sapiens
cccagaccuuuuauccacuuac

SEQ ID NO: 391009 - RNA, 23 nt, Homo sapiens
cccagagauaagggugucuuccu

SEQ ID NO: 391010 - RNA, 11 nt, Homo sapiens
cccagcacugc

SEQ ID NO: 391011 - RNA, 15 nt, Homo sapiens
cccagcuacucagga

SEQ ID NO: 391012 - RNA, 23 nt, Homo sapiens
cccaggccaguaagggaaauaga

SEQ ID NO: 391013 - RNA, 23 nt, Homo sapiens
cccaggcuggagugcaguagcac

SEQ ID NO: 391014 - RNA, 19 nt, Homo sapiens
cccaggcuggagugcagug

SEQ ID NO: 391015 - RNA, 20 nt, Homo sapiens
cccagggccugcaggaccug

SEQ ID NO: 391016 - RNA, 13 nt, Homo sapiens
cccagggcuaccc

SEQ ID NO: 391017 - RNA, 22 nt, Homo sapiens
cccaggugguuauggagagggu

SEQ ID NO: 391018 - RNA, 22 nt, Homo sapiens
cccagucagaguugugcacaug

SEQ ID NO: 391019 - RNA, 15 nt, Homo sapiens
cccagugccaagcac

SEQ ID NO: 391020 - RNA, 14 nt, Homo sapiens
cccaguguguuucu

SEQ ID NO: 391021 - RNA, 15 nt, Homo sapiens
cccauaucugugaaa

SEQ ID NO: 391022 - RNA, 23 nt, Homo sapiens
cccaucuuguuucacacuaguca

SEQ ID NO: 391023 - RNA, 20 nt, Homo sapiens
cccaugcccuggauccauca

SEQ ID NO: 391024 - RNA, 15 nt, Homo sapiens
cccauggacacucca

SEQ ID NO: 391025 - RNA, 16 nt, Homo sapiens
cccauggacacuccag

SEQ ID NO: 391026 - RNA, 14 nt, Homo sapiens
cccaugugugagug

SEQ ID NO: 391027 - RNA, 15 nt, Homo sapiens
cccauuucuauuuau

SEQ ID NO: 391028 - RNA, 21 nt, Homo sapiens
ccccaacagcgacauagccca

SEQ ID NO: 391029 - RNA, 21 nt, Homo sapiens
ccccaccugggacccuugaga

SEQ ID NO: 391030 - RNA, 16 nt, Homo sapiens
ccccacuccagcuccu

SEQ ID NO: 391031 - RNA, 22 nt, Homo sapiens
ccccacuggggaaauaacagcu

SEQ ID NO: 391032 - RNA, 23 nt, Homo sapiens
ccccagaaccuguccuugcacac

SEQ ID NO: 391033 - RNA, 17 nt, Homo sapiens
ccccagccccuagccca

SEQ ID NO: 391034 - RNA, 16 nt, Homo sapiens
ccccagccucuucuag

SEQ ID NO: 391035 - RNA, 15 nt, Homo sapiens
ccccaggcauugcca

SEQ ID NO: 391036 - RNA, 16 nt, Homo sapiens
ccccaggccccaggaa

SEQ ID NO: 391037 - RNA, 15 nt, Homo sapiens
ccccauuccugggaa

SEQ ID NO: 391038 - RNA, 20 nt, Homo sapiens
cccccauagcagcagugcau

SEQ ID NO: 391039 - RNA, 21 nt, Homo sapiens
cccccauuguggucacaggaa

SEQ ID NO: 391040 - RNA, 20 nt, Homo sapiens
ccccgugaggaugucacuca

SEQ ID NO: 391041 - RNA, 17 nt, Homo sapiens
ccccugcccugggaugu

SEQ ID NO: 391042 - RNA, 14 nt, Homo sapiens
ccccuggcucugac

SEQ ID NO: 391043 - RNA, 14 nt, Homo sapiens
ccccuggcuuuuca

SEQ ID NO: 391044 - RNA, 13 nt, Homo sapiens
cccgacagccugg

SEQ ID NO: 391045 - RNA, 11 nt, Homo sapiens
cccgagcagaa

SEQ ID NO: 391046 - RNA, 18 nt, Homo sapiens
cccgucgaggggcucuca

SEQ ID NO: 391047 - RNA, 17 nt, Homo sapiens
cccuaaaucuugacuac

SEQ ID NO: 391048 - RNA, 18 nt, Homo sapiens
cccuaagcagaccacuga

SEQ ID NO: 391049 - RNA, 19 nt, Homo sapiens
cccuaugugggugggacca

SEQ ID NO: 391050 - RNA, 21 nt, Homo sapiens
cccuauugcugcuugaggcaa

SEQ ID NO: 391051 - RNA, 15 nt, Homo sapiens
cccuauuuuugcaau

SEQ ID NO: 391052 - RNA, 21 nt, Homo sapiens
cccucaccuguagcagccagu

SEQ ID NO: 391053 - RNA, 18 nt, Homo sapiens
cccucuccccacugcuca

SEQ ID NO: 391054 - RNA, 18 nt, Homo sapiens
cccucuugacguggcacu

SEQ ID NO: 391055 - RNA, 22 nt, Homo sapiens
cccugaaguaagcaaagacuuu

SEQ ID NO: 391056 - RNA, 16 nt, Homo sapiens
cccugagucaccagga

SEQ ID NO: 391057 - RNA, 17 nt, Homo sapiens
cccugauacaggcaugg

SEQ ID NO: 391058 - RNA, 12 nt, Homo sapiens
cccugcauuuau

SEQ ID NO: 391059 - RNA, 17 nt, Homo sapiens
cccugcauuucugaguu

SEQ ID NO: 391060 - RNA, 22 nt, Homo sapiens
cccuggcucugaccgaaacagc

SEQ ID NO: 391061 - RNA, 19 nt, Homo sapiens
cccugggccccaccaccua

SEQ ID NO: 391062 - RNA, 17 nt, Homo sapiens
cccugucuaaaaauuca

SEQ ID NO: 391063 - RNA, 20 nt, Homo sapiens
cccuguguauucuagugaau

SEQ ID NO: 391064 - RNA, 13 nt, Homo sapiens
cccuuaaggacaa

SEQ ID NO: 391065 - RNA, 22 nt, Homo sapiens
ccugggugacagagcaagugag

SEQ ID NO: 391066 - RNA, 18 nt, Homo sapiens
ccugguaccuagcaaagc

SEQ ID NO: 391067 - RNA, 18 nt, Homo sapiens
ccuggucccuuggagaca

SEQ ID NO: 391068 - RNA, 17 nt, Homo sapiens
ccuguagcagccagucc

SEQ ID NO: 391069 - RNA, 15 nt, Homo sapiens
ccuguagucccagcu

SEQ ID NO: 391070 - RNA, 15 nt, Homo sapiens
ccugugaggugcaga

SEQ ID NO: 391071 - RNA, 17 nt, Homo sapiens
ccuguguauucuaguga

SEQ ID NO: 391072 - RNA, 17 nt, Homo sapiens
ccugugugccauuuuaa

SEQ ID NO: 391073 - RNA, 21 nt, Homo sapiens
ccuguugaagcucuggugaca

SEQ ID NO: 391074 - RNA, 23 nt, Homo sapiens
ccuuaaugauccguuccauugca

SEQ ID NO: 391075 - RNA, 14 nt, Homo sapiens
ccuuacaguaggag

SEQ ID NO: 391076 - RNA, 22 nt, Homo sapiens
ccuuacauuugaaaucuaugaa

SEQ ID NO: 391077 - RNA, 18 nt, Homo sapiens
ccuuagcuuagaccucag

SEQ ID NO: 391078 - RNA, 14 nt, Homo sapiens
ccuuaucugugcuc

SEQ ID NO: 391079 - RNA, 21 nt, Homo sapiens
ccuuauuguaccucucuuaua

SEQ ID NO: 391080 - RNA, 12 nt, Homo sapiens
ccuucacuuuac

SEQ ID NO: 391081 - RNA, 18 nt, Homo sapiens
ccuuccuaauaugcuuua

SEQ ID NO: 391082 - RNA, 14 nt, Homo sapiens
ccuuccugucuucc

SEQ ID NO: 391083 - RNA, 18 nt, Homo sapiens
ccuucggguuggcaaaau

SEQ ID NO: 391084 - RNA, 21 nt, Homo sapiens
ccuucguuuacuaugccugug

SEQ ID NO: 391085 - RNA, 14 nt, Homo sapiens
ccuucuguggcuca

SEQ ID NO: 391086 - RNA, 23 nt, Homo sapiens
ccuugacauuguagagcuucugg

SEQ ID NO: 391087 - RNA, 17 nt, Homo sapiens
ccuugaccagcagaucc

SEQ ID NO: 391088 - RNA, 11 nt, Homo sapiens
ccuugagaaac

SEQ ID NO: 391089 - RNA, 14 nt, Homo sapiens
ccuugaugcucaua

SEQ ID NO: 391090 - RNA, 13 nt, Homo sapiens
ccuugcacacucc

SEQ ID NO: 391091 - RNA, 13 nt, Homo sapiens
ccuugcaccugca

SEQ ID NO: 391092 - RNA, 21 nt, Homo sapiens
ccuugcuggacggggacuggg

SEQ ID NO: 391093 - RNA, 21 nt, Homo sapiens
ccuuggaggcugucuucucag

SEQ ID NO: 391094 - RNA, 23 nt, Homo sapiens
ccuuggccucccaaagugcuagu

SEQ ID NO: 391095 - RNA, 20 nt, Homo sapiens
ccuuggccuccccugcugaa

SEQ ID NO: 391096 - RNA, 13 nt, Homo sapiens
ccuuggcugugag

SEQ ID NO: 391097 - RNA, 15 nt, Homo sapiens
ccuugggaugaucuu

SEQ ID NO: 391098 - RNA, 20 nt, Homo sapiens
ccuuuaaauccuuccaugaa

SEQ ID NO: 391099 - RNA, 12 nt, Homo sapiens
ccuuuuccagaa

SEQ ID NO: 391100 - RNA, 20 nt, Homo sapiens
cgaaaccccaucucuacuaa

SEQ ID NO: 391101 - RNA, 11 nt, Homo sapiens
cgaaggugcug

SEQ ID NO: 391102 - RNA, 18 nt, Homo sapiens
cgagaccugugugccagg

SEQ ID NO: 391103 - RNA, 15 nt, Homo sapiens
cgagacuccgucuca

SEQ ID NO: 391104 - RNA, 19 nt, Homo sapiens
cgagccaaguuaagaaugu

SEQ ID NO: 391105 - RNA, 18 nt, Homo sapiens
cgagggucaggacuguga

SEQ ID NO: 391106 - RNA, 22 nt, Homo sapiens
cgagucaauccccucauucagg

SEQ ID NO: 391107 - RNA, 14 nt, Homo sapiens
cgagucucuucucc

SEQ ID NO: 391108 - RNA, 22 nt, Homo sapiens
cgauuucacaguguguuuguga

SEQ ID NO: 391109 - RNA, 18 nt, Homo sapiens
cgcaccuaccaucaggga

SEQ ID NO: 391110 - RNA, 13 nt, Homo sapiens
cgcauucccugag

SEQ ID NO: 391111 - RNA, 15 nt, Homo sapiens
cgccugacaaccacu

SEQ ID NO: 391112 - RNA, 22 nt, Homo sapiens
cgcucuuggcagguacucagcg

SEQ ID NO: 391113 - RNA, 18 nt, Homo sapiens
cgcugugucagcauagaa

SEQ ID NO: 391114 - RNA, 15 nt, Homo sapiens
cggaaucagcuucua

SEQ ID NO: 391115 - RNA, 22 nt, Homo sapiens
cggagaagagcuguucacagcc

SEQ ID NO: 391116 - RNA, 13 nt, Homo sapiens
cggaguugugcac

SEQ ID NO: 391117 - RNA, 21 nt, Homo sapiens
cggaucuggggcucugggaua

SEQ ID NO: 391118 - RNA, 15 nt, Homo sapiens
cggcagccuggaugu

SEQ ID NO: 391119 - RNA, 15 nt, Homo sapiens
cggccagaagaucua

SEQ ID NO: 391120 - RNA, 19 nt, Homo sapiens
cggcgggaggucugccagg

SEQ ID NO: 391121 - RNA, 18 nt, Homo sapiens
cggcucaugccuguaauc

SEQ ID NO: 391122 - RNA, 23 nt, Homo sapiens
cggcucaugccuguaaucccagc

SEQ ID NO: 391123 - RNA, 17 nt, Homo sapiens
cggcucucaccaguggc

SEQ ID NO: 391124 - RNA, 15 nt, Homo sapiens
cgggaugucaugucc

SEQ ID NO: 391125 - RNA, 15 nt, Homo sapiens
cggggcuccacugaa

SEQ ID NO: 391126 - RNA, 20 nt, Homo sapiens
cggggcuugcaacuuagcuc

SEQ ID NO: 391127 - RNA, 19 nt, Homo sapiens
cggucaauccuguggguga

SEQ ID NO: 391128 - RNA, 12 nt, Homo sapiens
cggucucaggcu

SEQ ID NO: 391129 - RNA, 13 nt, Homo sapiens
cuauuuucauucu

SEQ ID NO: 391130 - RNA, 18 nt, Homo sapiens
cucaaaacuucagacaua

SEQ ID NO: 391131 - RNA, 12 nt, Homo sapiens
cucaaagcacac

SEQ ID NO: 391132 - RNA, 13 nt, Homo sapiens
cucaaaggcacag

SEQ ID NO: 391133 - RNA, 14 nt, Homo sapiens
cucaaccuauggua

SEQ ID NO: 391134 - RNA, 18 nt, Homo sapiens
cucaacguugcuccccau

SEQ ID NO: 391135 - RNA, 18 nt, Homo sapiens
cucaagaaacaacuucua

SEQ ID NO: 391136 - RNA, 17 nt, Homo sapiens
cucaaggaauuugcauu

SEQ ID NO: 391137 - RNA, 19 nt, Homo sapiens
cucaaggacuuugcagccg

SEQ ID NO: 391138 - RNA, 23 nt, Homo sapiens
cucaaguuuuucagaaagcauua

SEQ ID NO: 391139 - RNA, 15 nt, Homo sapiens
cucaauaaguuuauu

SEQ ID NO: 391140 - RNA, 15 nt, Homo sapiens
cucaaugccaguaac

SEQ ID NO: 391141 - RNA, 13 nt, Homo sapiens
cucacaccacuaa

SEQ ID NO: 391142 - RNA, 22 nt, Homo sapiens
cucacacggacacucaaaagcu

SEQ ID NO: 391143 - RNA, 16 nt, Homo sapiens
cucacgcaccucccau

SEQ ID NO: 391144 - RNA, 19 nt, Homo sapiens
cucagaggguuguucuccu

SEQ ID NO: 391145 - RNA, 13 nt, Homo sapiens
cucagcauaccug

SEQ ID NO: 391146 - RNA, 14 nt, Homo sapiens
cucaggucccugca

SEQ ID NO: 391147 - RNA, 15 nt, Homo sapiens
cucagguguugccaa

SEQ ID NO: 391148 - RNA, 16 nt, Homo sapiens
cucagguguugccaaa

SEQ ID NO: 391149 - RNA, 20 nt, Homo sapiens
cucauaugauugugcacaua

SEQ ID NO: 391150 - RNA, 14 nt, Homo sapiens
cucaucauuccuug

SEQ ID NO: 391151 - RNA, 15 nt, Homo sapiens
cucaugccuguaauc

SEQ ID NO: 391152 - RNA, 20 nt, Homo sapiens
cucaugccuguaaucccagc

SEQ ID NO: 391153 - RNA, 12 nt, Homo sapiens
cucaugugaucc

SEQ ID NO: 391154 - RNA, 19 nt, Homo sapiens
cucauucagggauagcacu

SEQ ID NO: 391155 - RNA, 10 nt, Homo sapiens
cucauuccac

SEQ ID NO: 391156 - RNA, 13 nt, Homo sapiens
cucauuccaccuu

SEQ ID NO: 391157 - RNA, 18 nt, Homo sapiens
cucauuccccaaccacuu

SEQ ID NO: 391158 - RNA, 16 nt, Homo sapiens
cucauuuaucccucaa

SEQ ID NO: 391159 - RNA, 17 nt, Homo sapiens
cucauuuuuguuuucau

SEQ ID NO: 391160 - RNA, 17 nt, Homo sapiens
cuccacccuuggacuuu

SEQ ID NO: 391161 - RNA, 16 nt, Homo sapiens
cuccaccuuccaaagg

SEQ ID NO: 391162 - RNA, 13 nt, Homo sapiens
cuccacuccagau

SEQ ID NO: 391163 - RNA, 20 nt, Homo sapiens
cuccacugaaagaaguggga

SEQ ID NO: 391164 - RNA, 16 nt, Homo sapiens
cuccaggaucuauuga

SEQ ID NO: 391165 - RNA, 12 nt, Homo sapiens
cuccagugccag

SEQ ID NO: 391166 - RNA, 17 nt, Homo sapiens
cuccaucuccacuccag

SEQ ID NO: 391167 - RNA, 16 nt, Homo sapiens
cuccaugagacacauc

SEQ ID NO: 391168 - RNA, 19 nt, Homo sapiens
cuccauguagaagccacua

SEQ ID NO: 391169 - RNA, 16 nt, Homo sapiens
cuccauguuugaugua

SEQ ID NO: 391170 - RNA, 16 nt, Homo sapiens
cucccaaagugcuagu

SEQ ID NO: 391171 - RNA, 15 nt, Homo sapiens
cucccaaggcucuga

SEQ ID NO: 391172 - RNA, 14 nt, Homo sapiens
cucccacaaaggag

SEQ ID NO: 391173 - RNA, 18 nt, Homo sapiens
cucccaccccacccccuu

SEQ ID NO: 391174 - RNA, 17 nt, Homo sapiens
cucccagaacacacucc

SEQ ID NO: 391175 - RNA, 17 nt, Homo sapiens
cucccauccuaaucauc

SEQ ID NO: 391176 - RNA, 19 nt, Homo sapiens
cuccccacugccuacugca

SEQ ID NO: 391177 - RNA, 17 nt, Homo sapiens
cucccugaaguaagcaa

SEQ ID NO: 391178 - RNA, 20 nt, Homo sapiens
cuccgucuaagucaugagcu

SEQ ID NO: 391179 - RNA, 19 nt, Homo sapiens
cuccguggcaucaccuuag

SEQ ID NO: 391180 - RNA, 20 nt, Homo sapiens
cuccuccugcccaccuguca

SEQ ID NO: 391181 - RNA, 12 nt, Homo sapiens
cuccucuucaaa

SEQ ID NO: 391182 - RNA, 14 nt, Homo sapiens
cuccugaagccaca

SEQ ID NO: 391183 - RNA, 18 nt, Homo sapiens
cuccugagcgaugacuca

SEQ ID NO: 391184 - RNA, 16 nt, Homo sapiens
cuccuggcccacugca

SEQ ID NO: 391185 - RNA, 19 nt, Homo sapiens
cuccuuccaacaggagcug

SEQ ID NO: 391186 - RNA, 18 nt, Homo sapiens
cuccuuccuugaccagca

SEQ ID NO: 391187 - RNA, 22 nt, Homo sapiens
cuccuuggauguagucaguuag

SEQ ID NO: 391188 - RNA, 22 nt, Homo sapiens
caggaucaaaccccgaccaccu

SEQ ID NO: 391189 - RNA, 18 nt, Homo sapiens
caggauuaaaagccauga

SEQ ID NO: 391190 - RNA, 19 nt, Homo sapiens
caggauuaaaagccaugag

SEQ ID NO: 391191 - RNA, 21 nt, Homo sapiens
caggauuaaaagccaugaguu

SEQ ID NO: 391192 - RNA, 14 nt, Homo sapiens
caggcaacugaggc

SEQ ID NO: 391193 - RNA, 14 nt, Homo sapiens
caggcaagugaaga

SEQ ID NO: 391194 - RNA, 12 nt, Homo sapiens
caggcaccugcc

SEQ ID NO: 391195 - RNA, 20 nt, Homo sapiens
caggcagaucccacuugcag

SEQ ID NO: 391196 - RNA, 17 nt, Homo sapiens
caggccccgcuugucca

SEQ ID NO: 391197 - RNA, 23 nt, Homo sapiens
caggcucugcccugcccuagcuc

SEQ ID NO: 391198 - RNA, 20 nt, Homo sapiens
cagggaagccccacuugaag

SEQ ID NO: 391199 - RNA, 14 nt, Homo sapiens
cagggaaugaaggu

SEQ ID NO: 391200 - RNA, 15 nt, Homo sapiens
cagggacagagccau

SEQ ID NO: 391201 - RNA, 17 nt, Homo sapiens
cagggacccacuucaca

SEQ ID NO: 391202 - RNA, 17 nt, Homo sapiens
cagggaccccugcccuu

SEQ ID NO: 391203 - RNA, 15 nt, Homo sapiens
cagggauagcacuga

SEQ ID NO: 391204 - RNA, 13 nt, Homo sapiens
cagggaugccauc

SEQ ID NO: 391205 - RNA, 18 nt, Homo sapiens
cagggauuaaccucugca

SEQ ID NO: 391206 - RNA, 18 nt, Homo sapiens
cagggcauuuugguccaa

SEQ ID NO: 391207 - RNA, 13 nt, Homo sapiens
cagggccugagcc

SEQ ID NO: 391208 - RNA, 16 nt, Homo sapiens
caggggaguaugcaaa

SEQ ID NO: 391209 - RNA, 18 nt, Homo sapiens
caggggaguaugcaaaag

SEQ ID NO: 391210 - RNA, 14 nt, Homo sapiens
cagggggacuagcc

SEQ ID NO: 391211 - RNA, 12 nt, Homo sapiens
cagggucugcuc

SEQ ID NO: 391212 - RNA, 23 nt, Homo sapiens
cagggucugcucuuucucugcca

SEQ ID NO: 391213 - RNA, 17 nt, Homo sapiens
caggucaauacaguaca

SEQ ID NO: 391214 - RNA, 19 nt, Homo sapiens
caggucacccuuugcugug

SEQ ID NO: 391215 - RNA, 13 nt, Homo sapiens
caggugcacagac

SEQ ID NO: 391216 - RNA, 11 nt, Homo sapiens
caggugcugcu

SEQ ID NO: 391217 - RNA, 14 nt, Homo sapiens
cagguguugccaaa

SEQ ID NO: 391218 - RNA, 14 nt, Homo sapiens
cagguguuuauaca

SEQ ID NO: 391219 - RNA, 16 nt, Homo sapiens
cagguuccaaucagaa

SEQ ID NO: 391220 - RNA, 15 nt, Homo sapiens
cagguuggugggggc

SEQ ID NO: 391221 - RNA, 16 nt, Homo sapiens
caguaaaucucacaaa

SEQ ID NO: 391222 - RNA, 17 nt, Homo sapiens
caguaaaucucacaaau

SEQ ID NO: 391223 - RNA, 19 nt, Homo sapiens
caguagaaauaauaugcau

SEQ ID NO: 391224 - RNA, 17 nt, Homo sapiens
caguagcagcagcaucu

SEQ ID NO: 391225 - RNA, 14 nt, Homo sapiens
caguauuaagugug

SEQ ID NO: 391226 - RNA, 13 nt, Homo sapiens
cagucaaccuggg

SEQ ID NO: 391227 - RNA, 18 nt, Homo sapiens
cagucaaggaguggcuua

SEQ ID NO: 391228 - RNA, 14 nt, Homo sapiens
cagucacauuccaa

SEQ ID NO: 391229 - RNA, 18 nt, Homo sapiens
cagucagaguugugcaca

SEQ ID NO: 391230 - RNA, 15 nt, Homo sapiens
cagucaucuugacca

SEQ ID NO: 391231 - RNA, 18 nt, Homo sapiens
cagucccuaaaaacacag

SEQ ID NO: 391232 - RNA, 20 nt, Homo sapiens
cagucuauauguuuguauaa

SEQ ID NO: 391233 - RNA, 19 nt, Homo sapiens
cagucucuucuaagcaaaa

SEQ ID NO: 391234 - RNA, 17 nt, Homo sapiens
cagucuuccauuugcaa

SEQ ID NO: 391235 - RNA, 17 nt, Homo sapiens
cagugaagaugccagug

SEQ ID NO: 391236 - RNA, 18 nt, Homo sapiens
cagugagaaaaagcuccu

SEQ ID NO: 391237 - RNA, 15 nt, Homo sapiens
cagugagccgucauc

SEQ ID NO: 391238 - RNA, 17 nt, Homo sapiens
cagugccagcaaugaca

SEQ ID NO: 391239 - RNA, 21 nt, Homo sapiens
cagugcccaccaacaucccau

SEQ ID NO: 391240 - RNA, 14 nt, Homo sapiens
caguggacaccagg

SEQ ID NO: 391241 - RNA, 15 nt, Homo sapiens
cagugggaccaauga

SEQ ID NO: 391242 - RNA, 20 nt, Homo sapiens
caguguccccuccacuguca

SEQ ID NO: 391243 - RNA, 20 nt, Homo sapiens
caguguguuucugaucugau

SEQ ID NO: 391244 - RNA, 11 nt, Homo sapiens
caguguugccc

SEQ ID NO: 391245 - RNA, 14 nt, Homo sapiens
caguuagcucucaa

SEQ ID NO: 391246 - RNA, 19 nt, Homo sapiens
caguuaugcagaauccaaa

SEQ ID NO: 391247 - RNA, 17 nt, Homo sapiens
caguucagguaugugug

SEQ ID NO: 391248 - RNA, 20 nt, Homo sapiens
caguuugcuuuguaugcacu

SEQ ID NO: 391249 - RNA, 13 nt, Homo sapiens
caguuuucuugca

SEQ ID NO: 391250 - RNA, 22 nt, Homo sapiens
cauaaauuacuuuuucauucuu

SEQ ID NO: 391251 - RNA, 18 nt, Homo sapiens
cauaaguuaacuuccaau

SEQ ID NO: 391252 - RNA, 20 nt, Homo sapiens
cauaaguuuaggauaaaaua

SEQ ID NO: 391253 - RNA, 18 nt, Homo sapiens
cauacaugacucagcaua

SEQ ID NO: 391254 - RNA, 21 nt, Homo sapiens
cauacaugacucagcauaccu

SEQ ID NO: 391255 - RNA, 17 nt, Homo sapiens
cauacccacacacccag

SEQ ID NO: 391256 - RNA, 22 nt, Homo sapiens
cauacgguaugauauugcagcu

SEQ ID NO: 391257 - RNA, 16 nt, Homo sapiens
cauacuacacauucaa

SEQ ID NO: 391258 - RNA, 18 nt, Homo sapiens
cauagcagcuuauucaca

SEQ ID NO: 391259 - RNA, 23 nt, Homo sapiens
cauaggcugacuuuugcagaugg

SEQ ID NO: 391260 - RNA, 15 nt, Homo sapiens
cauauauuuguauga

SEQ ID NO: 391261 - RNA, 14 nt, Homo sapiens
cauauccaacaugu

SEQ ID NO: 391262 - RNA, 21 nt, Homo sapiens
cauaugauugugcacauacuu

SEQ ID NO: 391263 - RNA, 15 nt, Homo sapiens
cauauuaagacauaa

SEQ ID NO: 391264 - RNA, 21 nt, Homo sapiens
caucaagaugagagaacugga

SEQ ID NO: 391265 - RNA, 22 nt, Homo sapiens
caucaagaugagagaacuggag

SEQ ID NO: 391266 - RNA, 12 nt, Homo sapiens
caucaagcacag

SEQ ID NO: 391267 - RNA, 19 nt, Homo sapiens
caucaaugcugaguuaaua

SEQ ID NO: 391268 - RNA, 15 nt, Homo sapiens
caucagaaugagaaa

SEQ ID NO: 391269 - RNA, 19 nt, Homo sapiens
auuggaccauccuauuuaa

SEQ ID NO: 391270 - RNA, 19 nt, Homo sapiens
auuggagaguaaaaacuga

SEQ ID NO: 391271 - RNA, 20 nt, Homo sapiens
auuggauaaaauaaaugcaa

SEQ ID NO: 391272 - RNA, 21 nt, Homo sapiens
auuggcaaacuuuguauuaau

SEQ ID NO: 391273 - RNA, 19 nt, Homo sapiens
auuggguacccaguuaaau

SEQ ID NO: 391274 - RNA, 16 nt, Homo sapiens
auugucagaguucugc

SEQ ID NO: 391275 - RNA, 19 nt, Homo sapiens
auugucagaguucugcucu

SEQ ID NO: 391276 - RNA, 18 nt, Homo sapiens
auugugaucagaccauaa

SEQ ID NO: 391277 - RNA, 22 nt, Homo sapiens
auugugcccgggcccaugggga

SEQ ID NO: 391278 - RNA, 15 nt, Homo sapiens
auuguuaaaauaacu

SEQ ID NO: 391279 - RNA, 21 nt, Homo sapiens
auuuaaaaaacuaacacccag

SEQ ID NO: 391280 - RNA, 14 nt, Homo sapiens
auuuaacuauucau

SEQ ID NO: 391281 - RNA, 18 nt, Homo sapiens
auuuagacccugcauuua

SEQ ID NO: 391282 - RNA, 13 nt, Homo sapiens
auuuauaacucau

SEQ ID NO: 391283 - RNA, 12 nt, Homo sapiens
auuuauauaugu

SEQ ID NO: 391284 - RNA, 13 nt, Homo sapiens
auuuaucccucaa

SEQ ID NO: 391285 - RNA, 14 nt, Homo sapiens
auuuaucugugcaa

SEQ ID NO: 391286 - RNA, 14 nt, Homo sapiens
auuuauuauuucaa

SEQ ID NO: 391287 - RNA, 13 nt, Homo sapiens
auuucacauuaau

SEQ ID NO: 391288 - RNA, 15 nt, Homo sapiens
auuuccggccaacag

SEQ ID NO: 391289 - RNA, 15 nt, Homo sapiens
auuucugcaucagcu

SEQ ID NO: 391290 - RNA, 18 nt, Homo sapiens
auuugaagaaugaacaaa

SEQ ID NO: 391291 - RNA, 18 nt, Homo sapiens
auuugaauuucaguaaac

SEQ ID NO: 391292 - RNA, 17 nt, Homo sapiens
auuugagagcuaacuau

SEQ ID NO: 391293 - RNA, 19 nt, Homo sapiens
auuugcccuuaaggacaaa

SEQ ID NO: 391294 - RNA, 19 nt, Homo sapiens
auuugcugagcauguacug

SEQ ID NO: 391295 - RNA, 13 nt, Homo sapiens
auuuggaaauuca

SEQ ID NO: 391296 - RNA, 14 nt, Homo sapiens
auuuggcugugaug

SEQ ID NO: 391297 - RNA, 17 nt, Homo sapiens
auuugggagacauguga

SEQ ID NO: 391298 - RNA, 20 nt, Homo sapiens
auuuguuuucuucuguaugu

SEQ ID NO: 391299 - RNA, 17 nt, Homo sapiens
auuuuaaaaagucuuca

SEQ ID NO: 391300 - RNA, 14 nt, Homo sapiens
auuuuauacugaca

SEQ ID NO: 391301 - RNA, 16 nt, Homo sapiens
auuuuaugaucuuggc

SEQ ID NO: 391302 - RNA, 18 nt, Homo sapiens
auuuugaaaccaugaaga

SEQ ID NO: 391303 - RNA, 20 nt, Homo sapiens
auuuugccauaaagucaaau

SEQ ID NO: 391304 - RNA, 20 nt, Homo sapiens
auuuugcccaggcaacagua

SEQ ID NO: 391305 - RNA, 17 nt, Homo sapiens
auuuuuauagacaaaua

SEQ ID NO: 391306 - RNA, 14 nt, Homo sapiens
auuuuuuugcaagu

SEQ ID NO: 391307 - RNA, 21 nt, Homo sapiens
caaaaagccuuuuccagaaga

SEQ ID NO: 391308 - RNA, 14 nt, Homo sapiens
caaaaaugaacuga

SEQ ID NO: 391309 - RNA, 21 nt, Homo sapiens
caaaaauugcucguguuauaa

SEQ ID NO: 391310 - RNA, 17 nt, Homo sapiens
caaaaauugucccuuaa

SEQ ID NO: 391311 - RNA, 12 nt, Homo sapiens
caaaacucuccu

SEQ ID NO: 391312 - RNA, 17 nt, Homo sapiens
caaaacuucagacauag

SEQ ID NO: 391313 - RNA, 15 nt, Homo sapiens
caaaagggugucuga

SEQ ID NO: 391314 - RNA, 21 nt, Homo sapiens
caaaaguuucuuacucaagga

SEQ ID NO: 391315 - RNA, 15 nt, Homo sapiens
caaaaucacacagcc

SEQ ID NO: 391316 - RNA, 21 nt, Homo sapiens
caaaaucauuuuauaugucaa

SEQ ID NO: 391317 - RNA, 19 nt, Homo sapiens
caaaaugucuaagauagua

SEQ ID NO: 391318 - RNA, 16 nt, Homo sapiens
caaaauuacacaguua

SEQ ID NO: 391319 - RNA, 18 nt, Homo sapiens
caaaauuacacaguuaau

SEQ ID NO: 391320 - RNA, 13 nt, Homo sapiens
caaaauugaugug

SEQ ID NO: 391321 - RNA, 20 nt, Homo sapiens
caaaauuugaugccaggaca

SEQ ID NO: 391322 - RNA, 20 nt, Homo sapiens
caaacaaagccagaagcuga

SEQ ID NO: 391323 - RNA, 14 nt, Homo sapiens
caaacaaauaugca

SEQ ID NO: 391324 - RNA, 16 nt, Homo sapiens
caaacagccacacugu

SEQ ID NO: 391325 - RNA, 19 nt, Homo sapiens
caaacagccccucuggaca

SEQ ID NO: 391326 - RNA, 18 nt, Homo sapiens
caaaccauaaacuucaug

SEQ ID NO: 391327 - RNA, 16 nt, Homo sapiens
caaaccccgaccaccu

SEQ ID NO: 391328 - RNA, 18 nt, Homo sapiens
caaacccugugucacugu

SEQ ID NO: 391329 - RNA, 14 nt, Homo sapiens
caaacuacauguaa

SEQ ID NO: 391330 - RNA, 15 nt, Homo sapiens
caaacuacauguaau

SEQ ID NO: 391331 - RNA, 21 nt, Homo sapiens
aaguaggugugacuugaacua

SEQ ID NO: 391332 - RNA, 13 nt, Homo sapiens
aaguaugagggaa

SEQ ID NO: 391333 - RNA, 17 nt, Homo sapiens
aaguaugagggaaaaug

SEQ ID NO: 391334 - RNA, 18 nt, Homo sapiens
aaguauguaaacaggaga

SEQ ID NO: 391335 - RNA, 14 nt, Homo sapiens
aagucaaagacauu

SEQ ID NO: 391336 - RNA, 16 nt, Homo sapiens
aagucauaccaaugaa

SEQ ID NO: 391337 - RNA, 17 nt, Homo sapiens
aagucaugugcauuucc

SEQ ID NO: 391338 - RNA, 19 nt, Homo sapiens
aagugaacagaacuaucuc

SEQ ID NO: 391339 - RNA, 18 nt, Homo sapiens
aagugacucucacaagau

SEQ ID NO: 391340 - RNA, 22 nt, Homo sapiens
aagugauuuuuuuccacaagau

SEQ ID NO: 391341 - RNA, 13 nt, Homo sapiens
aagugugugcaca

SEQ ID NO: 391342 - RNA, 18 nt, Homo sapiens
aaguuauacuguggcuau

SEQ ID NO: 391343 - RNA, 22 nt, Homo sapiens
aaguuccaguguucucucuuau

SEQ ID NO: 391344 - RNA, 17 nt, Homo sapiens
aaguugcugaugaacuc

SEQ ID NO: 391345 - RNA, 14 nt, Homo sapiens
aaguuggcuucuaa

SEQ ID NO: 391346 - RNA, 11 nt, Homo sapiens
aaguuucacau

SEQ ID NO: 391347 - RNA, 16 nt, Homo sapiens
aaguuucacugacuua

SEQ ID NO: 391348 - RNA, 18 nt, Homo sapiens
aaguuucugcagcagaug

SEQ ID NO: 391349 - RNA, 20 nt, Homo sapiens
aauaaaccaucaucuugcca

SEQ ID NO: 391350 - RNA, 20 nt, Homo sapiens
aauaaagaugcccacugagg

SEQ ID NO: 391351 - RNA, 15 nt, Homo sapiens
aauaaauaaucugua

SEQ ID NO: 391352 - RNA, 12 nt, Homo sapiens
aauaaaugugaa

SEQ ID NO: 391353 - RNA, 14 nt, Homo sapiens
aauaaaugugcuua

SEQ ID NO: 391354 - RNA, 13 nt, Homo sapiens
aauaauccagaaa

SEQ ID NO: 391355 - RNA, 20 nt, Homo sapiens
aauaauguuguaauucaugc

SEQ ID NO: 391356 - RNA, 22 nt, Homo sapiens
aauaauuuuaagaaaucaaaga

SEQ ID NO: 391357 - RNA, 11 nt, Homo sapiens
aauacauauuu

SEQ ID NO: 391358 - RNA, 20 nt, Homo sapiens
aauacaugcugcuaauucaa

SEQ ID NO: 391359 - RNA, 11 nt, Homo sapiens
aauacugaugu

SEQ ID NO: 391360 - RNA, 22 nt, Homo sapiens
aauacugauguuccuagugaaa

SEQ ID NO: 391361 - RNA, 23 nt, Homo sapiens
aauagcauacaucaauggugugu

SEQ ID NO: 391362 - RNA, 19 nt, Homo sapiens
aauaguuuugauccuaaau

SEQ ID NO: 391363 - RNA, 16 nt, Homo sapiens
aauauaacugccuuaa

SEQ ID NO: 391364 - RNA, 15 nt, Homo sapiens
aauauagcuguacaa

SEQ ID NO: 391365 - RNA, 17 nt, Homo sapiens
aauaucccuacauguau

SEQ ID NO: 391366 - RNA, 17 nt, Homo sapiens
aauauccgaacuuuaau

SEQ ID NO: 391367 - RNA, 18 nt, Homo sapiens
aauaugauuuuauuugac

SEQ ID NO: 391368 - RNA, 14 nt, Homo sapiens
aauaugucaguuug

SEQ ID NO: 391369 - RNA, 22 nt, Homo sapiens
aauauugcuuuggucauaugag

SEQ ID NO: 391370 - RNA, 23 nt, Homo sapiens
aauauuguccauuguccaauccu

SEQ ID NO: 391371 - RNA, 18 nt, Homo sapiens
aauauuguguugugaaug

SEQ ID NO: 391372 - RNA, 17 nt, Homo sapiens
aauauuuauuaccucug

SEQ ID NO: 391373 - RNA, 20 nt, Homo sapiens
aauauuuauuaccucugaua

SEQ ID NO: 391374 - RNA, 21 nt, Homo sapiens
aauauuuauuuaacuauucau

SEQ ID NO: 391375 - RNA, 18 nt, Homo sapiens
aauauuugcugacagcug

SEQ ID NO: 391376 - RNA, 22 nt, Homo sapiens
aaucaaguuggcuucuaaucaa

SEQ ID NO: 391377 - RNA, 18 nt, Homo sapiens
aaucacacagccaagcca

SEQ ID NO: 391378 - RNA, 12 nt, Homo sapiens
aaucacaguaua

SEQ ID NO: 391379 - RNA, 17 nt, Homo sapiens
aaucagaacuguuggca

SEQ ID NO: 391380 - RNA, 15 nt, Homo sapiens
aaucagccacauucu

SEQ ID NO: 391381 - RNA, 16 nt, Homo sapiens
aaucagccacauucua

SEQ ID NO: 391382 - RNA, 23 nt, Homo sapiens
aaucagugugucuaaauuugaau

SEQ ID NO: 391383 - RNA, 16 nt, Homo sapiens
aaucauuucugcauca

SEQ ID NO: 391384 - RNA, 16 nt, Homo sapiens
aaucauuuugccucuu

SEQ ID NO: 391385 - RNA, 21 nt, Homo sapiens
aauccaggcgugguggcacac

SEQ ID NO: 391386 - RNA, 22 nt, Homo sapiens
aauccaguccagauauuucaca

SEQ ID NO: 391387 - RNA, 23 nt, Homo sapiens
aauccaucacuagccaugauaac

SEQ ID NO: 391388 - RNA, 12 nt, Homo sapiens
aauccaugaacc

SEQ ID NO: 391389 - RNA, 20 nt, Homo sapiens
aaucccuagucuucaagcag

SEQ ID NO: 391390 - RNA, 18 nt, Homo sapiens
aauccuuuacuguuaguc

SEQ ID NO: 391391 - RNA, 18 nt, Homo sapiens
aaucucaccccaucccac

SEQ ID NO: 391392 - RNA, 21 nt, Homo sapiens
aaucuccuucuuuccuggacu

SEQ ID NO: 391393 - RNA, 16 nt, Homo sapiens
aaucucggcucacugc

SEQ ID NO: 391394 - RNA, 18 nt, Homo sapiens
aaucucggcucacugcaa

SEQ ID NO: 391395 - RNA, 16 nt, Homo sapiens
aaucucuugcacucaa

SEQ ID NO: 391396 - RNA, 21 nt, Homo sapiens
aaucuguuaccagaggacaaa

SEQ ID NO: 391397 - RNA, 18 nt, Homo sapiens
aaucuucagggcacugcu

SEQ ID NO: 391398 - RNA, 17 nt, Homo sapiens
aaugaaacugcugugaa

SEQ ID NO: 391399 - RNA, 14 nt, Homo sapiens
aaugaaguacucau

SEQ ID NO: 391400 - RNA, 17 nt, Homo sapiens
aaugaaugaauggcuaa

SEQ ID NO: 391401 - RNA, 23 nt, Homo sapiens
aaugaaugaccuuguugcaugau

SEQ ID NO: 391402 - RNA, 15 nt, Homo sapiens
aaugaauggacucaa

SEQ ID NO: 391403 - RNA, 14 nt, Homo sapiens
aaugaauguuuaca

SEQ ID NO: 391404 - RNA, 18 nt, Homo sapiens
aaugaccaguaauuguga

SEQ ID NO: 391405 - RNA, 21 nt, Homo sapiens
aaugagaaauuuuguugauau

SEQ ID NO: 391406 - RNA, 15 nt, Homo sapiens
aaugaggacauguuu

SEQ ID NO: 391407 - RNA, 13 nt, Homo sapiens
aaugaucacucca

SEQ ID NO: 391408 - RNA, 19 nt, Homo sapiens
aaugaugucguuugaauca

SEQ ID NO: 391409 - RNA, 21 nt, Homo sapiens
aaugaugucguuugaaucaca

SEQ ID NO: 391410 - RNA, 11 nt, Homo sapiens
aaugauuagaa

SEQ ID NO: 391411 - RNA, 14 nt, Homo sapiens
aaugauuuuaucug

SEQ ID NO: 391412 - RNA, 20 nt, Homo sapiens
aaugccaaucuucaguauuu

SEQ ID NO: 391413 - RNA, 13 nt, Homo sapiens
aaugccacaaaac

SEQ ID NO: 391414 - RNA, 17 nt, Homo sapiens
aaugccacaaaacugac

SEQ ID NO: 391415 - RNA, 21 nt, Homo sapiens
aaugcuagcugcaagugacau

SEQ ID NO: 391416 - RNA, 17 nt, Homo sapiens
aaugcuauaacuauguu

SEQ ID NO: 391417 - RNA, 18 nt, Homo sapiens
aaugcugugguugauauu

SEQ ID NO: 391418 - RNA, 17 nt, Homo sapiens
aaugcuucugacuucau

SEQ ID NO: 391419 - RNA, 20 nt, Homo sapiens
aauggagggaauaauaccua

SEQ ID NO: 391420 - RNA, 23 nt, Homo sapiens
aauggcauaggcugacuuuugca

SEQ ID NO: 391421 - RNA, 21 nt, Homo sapiens
aauggcuaagcaaaaugugau

SEQ ID NO: 391422 - RNA, 14 nt, Homo sapiens
aaugggcacuggga

SEQ ID NO: 391423 - RNA, 23 nt, Homo sapiens
aauggguuugcuagaaugugaua

SEQ ID NO: 391424 - RNA, 22 nt, Homo sapiens
aauggugcaaauccuacugaau

SEQ ID NO: 391425 - RNA, 17 nt, Homo sapiens
ccuggguggggcugcuc

SEQ ID NO: 391426 - RNA, 19 nt, Homo sapiens
ccuggucccuuggagacaa

SEQ ID NO: 391427 - RNA, 22 nt, Homo sapiens
ccuggugggccuccucugucca

SEQ ID NO: 391428 - RNA, 16 nt, Homo sapiens
ccuguaccugugcacg

SEQ ID NO: 391429 - RNA, 17 nt, Homo sapiens
ccugucaaacaaagcca

SEQ ID NO: 391430 - RNA, 21 nt, Homo sapiens
ccugucaaacaaagccagaag

SEQ ID NO: 391431 - RNA, 16 nt, Homo sapiens
ccugucuaaaaauuca

SEQ ID NO: 391432 - RNA, 21 nt, Homo sapiens
ccugucucuacuaaaaauaca

SEQ ID NO: 391433 - RNA, 22 nt, Homo sapiens
ccugucugccagccagcagcca

SEQ ID NO: 391434 - RNA, 13 nt, Homo sapiens
ccugugaggugca

SEQ ID NO: 391435 - RNA, 18 nt, Homo sapiens
ccugugcaacuuucccaa

SEQ ID NO: 391436 - RNA, 18 nt, Homo sapiens
ccugugguuaacaucuca

SEQ ID NO: 391437 - RNA, 21 nt, Homo sapiens
ccuguguugucucuagagcag

SEQ ID NO: 391438 - RNA, 14 nt, Homo sapiens
ccuguucaaaaagg

SEQ ID NO: 391439 - RNA, 16 nt, Homo sapiens
ccuguucagcuacucc

SEQ ID NO: 391440 - RNA, 12 nt, Homo sapiens
ccuguugaagcu

SEQ ID NO: 391441 - RNA, 22 nt, Homo sapiens
ccuucaugaucaucacaaucau

SEQ ID NO: 391442 - RNA, 17 nt, Homo sapiens
ccuuccuaauaugcuuu

SEQ ID NO: 391443 - RNA, 18 nt, Homo sapiens
ccuuccucaccacuuccc

SEQ ID NO: 391444 - RNA, 22 nt, Homo sapiens
ccuucgcuuaagccagcacuca

SEQ ID NO: 391445 - RNA, 13 nt, Homo sapiens
ccuugaaggguuc

SEQ ID NO: 391446 - RNA, 22 nt, Homo sapiens
ccuugauggagauauuuacaug

SEQ ID NO: 391447 - RNA, 19 nt, Homo sapiens
ccuugccucaaugccagua

SEQ ID NO: 391448 - RNA, 18 nt, Homo sapiens
ccuuggcaugccuuccag

SEQ ID NO: 391449 - RNA, 17 nt, Homo sapiens
ccuugugguuuauguca

SEQ ID NO: 391450 - RNA, 21 nt, Homo sapiens
ccuuguguacaguuauuuaug

SEQ ID NO: 391451 - RNA, 16 nt, Homo sapiens
ccuuucaaauuucaca

SEQ ID NO: 391452 - RNA, 18 nt, Homo sapiens
ccuuucuucagacacuga

SEQ ID NO: 391453 - RNA, 22 nt, Homo sapiens
ccuuucuuucuaacuccaguga

SEQ ID NO: 391454 - RNA, 16 nt, Homo sapiens
ccuuugaaaugaauau

SEQ ID NO: 391455 - RNA, 18 nt, Homo sapiens
ccuuugugguuacaguuu

SEQ ID NO: 391456 - RNA, 22 nt, Homo sapiens
ccuuuugcacauaacaugcuuu

SEQ ID NO: 391457 - RNA, 15 nt, Homo sapiens
cgaaaaggauaugca

SEQ ID NO: 391458 - RNA, 14 nt, Homo sapiens
cgaaaccccaucuc

SEQ ID NO: 391459 - RNA, 14 nt, Homo sapiens
cgaacaauucauau

SEQ ID NO: 391460 - RNA, 21 nt, Homo sapiens
cgaacaauucauauauuugaa

SEQ ID NO: 391461 - RNA, 14 nt, Homo sapiens
cgaauggcagcaua

SEQ ID NO: 391462 - RNA, 20 nt, Homo sapiens
cgacaagugcugaacagugg

SEQ ID NO: 391463 - RNA, 19 nt, Homo sapiens
cgagacuccgucucaagga

SEQ ID NO: 391464 - RNA, 23 nt, Homo sapiens
cgaggaaaagagaaggaaaguga

SEQ ID NO: 391465 - RNA, 14 nt, Homo sapiens
cgaggaaacucaga

SEQ ID NO: 391466 - RNA, 10 nt, Homo sapiens
cgaguacuuc

SEQ ID NO: 391467 - RNA, 19 nt, Homo sapiens
cgagucucuucuccacugg

SEQ ID NO: 391468 - RNA, 14 nt, Homo sapiens
cgagugugugcaug

SEQ ID NO: 391469 - RNA, 12 nt, Homo sapiens
cgaugugcaagu

SEQ ID NO: 391470 - RNA, 23 nt, Homo sapiens
cgaugugcaaguguaugcacgug

SEQ ID NO: 391471 - RNA, 13 nt, Homo sapiens
cgcaacaguuuuu

SEQ ID NO: 391472 - RNA, 17 nt, Homo sapiens
acacagccccauguaca

SEQ ID NO: 391473 - RNA, 22 nt, Homo sapiens
acacagcgagacuccgucucaa

SEQ ID NO: 391474 - RNA, 17 nt, Homo sapiens
acacagcugcagagaca

SEQ ID NO: 391475 - RNA, 21 nt, Homo sapiens
acacagcugcagagacagaga

SEQ ID NO: 391476 - RNA, 14 nt, Homo sapiens
acacaggaaggaaa

SEQ ID NO: 391477 - RNA, 17 nt, Homo sapiens
acaccaugauuaaccac

SEQ ID NO: 391478 - RNA, 13 nt, Homo sapiens
acacccagccuca

SEQ ID NO: 391479 - RNA, 18 nt, Homo sapiens
acacccagugccaggggc

SEQ ID NO: 391480 - RNA, 23 nt, Homo sapiens
acacccuauauuuugcauaguac

SEQ ID NO: 391481 - RNA, 15 nt, Homo sapiens
acaccuacucuauca

SEQ ID NO: 391482 - RNA, 18 nt, Homo sapiens
acaccuguagucccagcu

SEQ ID NO: 391483 - RNA, 20 nt, Homo sapiens
acacgagcaggcuacuguca

SEQ ID NO: 391484 - RNA, 20 nt, Homo sapiens
acacgagguaugaggucuag

SEQ ID NO: 391485 - RNA, 17 nt, Homo sapiens
acacgccugcaaacgcu

SEQ ID NO: 391486 - RNA, 14 nt, Homo sapiens
acacuaacauauaa

SEQ ID NO: 391487 - RNA, 19 nt, Homo sapiens
acacuauaaagguugacaa

SEQ ID NO: 391488 - RNA, 20 nt, Homo sapiens
acacuauuuaucugugcaaa

SEQ ID NO: 391489 - RNA, 23 nt, Homo sapiens
acacuccagugccagcaaugaca

SEQ ID NO: 391490 - RNA, 17 nt, Homo sapiens
acacugaaguuaacaga

SEQ ID NO: 391491 - RNA, 22 nt, Homo sapiens
acacugaggaacucacaauucc

SEQ ID NO: 391492 - RNA, 21 nt, Homo sapiens
acacugggcuucuagaaccag

SEQ ID NO: 391493 - RNA, 17 nt, Homo sapiens
acagaaagacugagcuc

SEQ ID NO: 391494 - RNA, 22 nt, Homo sapiens
acagaacuaagaugaucaucuc

SEQ ID NO: 391495 - RNA, 23 nt, Homo sapiens
acagaacuaucucagcaucagaa

SEQ ID NO: 391496 - RNA, 15 nt, Homo sapiens
acagaacugcaguca

SEQ ID NO: 391497 - RNA, 21 nt, Homo sapiens
acagaacugcagucagcauga

SEQ ID NO: 391498 - RNA, 22 nt, Homo sapiens
acagaagcacagcacccauggg

SEQ ID NO: 391499 - RNA, 12 nt, Homo sapiens
acagaagguccu

SEQ ID NO: 391500 - RNA, 21 nt, Homo sapiens
acagacgucccuccacguuca

SEQ ID NO: 391501 - RNA, 20 nt, Homo sapiens
acagagagggggccaccucc

SEQ ID NO: 391502 - RNA, 20 nt, Homo sapiens
acagagcaagacucugucuc

SEQ ID NO: 391503 - RNA, 18 nt, Homo sapiens
acagagcuucccugacuc

SEQ ID NO: 391504 - RNA, 22 nt, Homo sapiens
acagagggaaacacagcagcuu

SEQ ID NO: 391505 - RNA, 22 nt, Homo sapiens
acagagggcaggaacuugcaca

SEQ ID NO: 391506 - RNA, 17 nt, Homo sapiens
acagagugcauugugag

SEQ ID NO: 391507 - RNA, 14 nt, Homo sapiens
acagauagucaaac

SEQ ID NO: 391508 - RNA, 20 nt, Homo sapiens
acagcaagggugaugggaaa

SEQ ID NO: 391509 - RNA, 18 nt, Homo sapiens
acagcagcucaggcacac

SEQ ID NO: 391510 - RNA, 18 nt, Homo sapiens
acagccccucuggacaca

SEQ ID NO: 391511 - RNA, 18 nt, Homo sapiens
acagccucugaaaaccaa

SEQ ID NO: 391512 - RNA, 14 nt, Homo sapiens
acagccuggcacag

SEQ ID NO: 391513 - RNA, 18 nt, Homo sapiens
acagcgagacuccgucuc

SEQ ID NO: 391514 - RNA, 20 nt, Homo sapiens
acagcuucucaauuucuaca

SEQ ID NO: 391515 - RNA, 19 nt, Homo sapiens
acagcuuuaucaccagaga

SEQ ID NO: 391516 - RNA, 13 nt, Homo sapiens
acaggacucugcc

SEQ ID NO: 391517 - RNA, 14 nt, Homo sapiens
acaggagcugggau

SEQ ID NO: 391518 - RNA, 13 nt, Homo sapiens
acaggcacaaaau

SEQ ID NO: 391519 - RNA, 13 nt, Homo sapiens
acaggcaccugcc

SEQ ID NO: 391520 - RNA, 19 nt, Homo sapiens
acagggucugcucuuucuc

SEQ ID NO: 391521 - RNA, 19 nt, Homo sapiens
acaguacaggcagcacaga

SEQ ID NO: 391522 - RNA, 21 nt, Homo sapiens
acaguacaggcagcacagaga

SEQ ID NO: 391523 - RNA, 12 nt, Homo sapiens
acaguaucucag

SEQ ID NO: 391524 - RNA, 14 nt, Homo sapiens
acaguaucucaggg

SEQ ID NO: 391525 - RNA, 21 nt, Homo sapiens
acaguggaggaagagggacag

SEQ ID NO: 391526 - RNA, 14 nt, Homo sapiens
acaguuacagagug

SEQ ID NO: 391527 - RNA, 18 nt, Homo sapiens
acaguuagguagcuuuag

SEQ ID NO: 391528 - RNA, 13 nt, Homo sapiens
acaguuugagacu

SEQ ID NO: 391529 - RNA, 12 nt, Homo sapiens
acauaaacugac

SEQ ID NO: 391530 - RNA, 21 nt, Homo sapiens
acauaaauuacuuuuucauuc

SEQ ID NO: 391531 - RNA, 15 nt, Homo sapiens
acauaaguaauucaa

SEQ ID NO: 391532 - RNA, 19 nt, Homo sapiens
acauacaggccauacuuua

SEQ ID NO: 391533 - RNA, 22 nt, Homo sapiens
acauacaggccauacuuuacaa

SEQ ID NO: 391534 - RNA, 21 nt, Homo sapiens
acauacucugcuuagaauuug

SEQ ID NO: 391535 - RNA, 12 nt, Homo sapiens
acaucaagcaca

SEQ ID NO: 391536 - RNA, 22 nt, Homo sapiens
acaucacuugagacaaaucuau

SEQ ID NO: 391537 - RNA, 21 nt, Homo sapiens
acaucccgggacgcagcagga

SEQ ID NO: 391538 - RNA, 21 nt, Homo sapiens
acaucuccuccauacucagga

SEQ ID NO: 391539 - RNA, 22 nt, Homo sapiens
acaucuggccuugaaaccaccu

SEQ ID NO: 391540 - RNA, 15 nt, Homo sapiens
acaucuguauacccu

SEQ ID NO: 391541 - RNA, 15 nt, Homo sapiens
acaucugugucuugu

SEQ ID NO: 391542 - RNA, 23 nt, Homo sapiens
acaucuuggucagauuugaacuc

SEQ ID NO: 391543 - RNA, 16 nt, Homo sapiens
acaucuuucacacuuc

SEQ ID NO: 391544 - RNA, 18 nt, Homo sapiens
acaucuuucacacuucca

SEQ ID NO: 391545 - RNA, 21 nt, Homo sapiens
acaucuuucacacuuccacca

SEQ ID NO: 391546 - RNA, 13 nt, Homo sapiens
acaucuuuuacau

SEQ ID NO: 391547 - RNA, 14 nt, Homo sapiens
acaugaagaagcua

SEQ ID NO: 391548 - RNA, 15 nt, Homo sapiens
acaugacucagcaua

SEQ ID NO: 391549 - RNA, 16 nt, Homo sapiens
acaugagcuauuucca

SEQ ID NO: 391550 - RNA, 18 nt, Homo sapiens
acaugaucuucuuuauaa

SEQ ID NO: 391551 - RNA, 19 nt, Homo sapiens
acaugccucugccaaagga

SEQ ID NO: 391552 - RNA, 10 nt, Homo sapiens
acaugggagc

SEQ ID NO: 391553 - RNA, 22 nt, Homo sapiens
acaugguacgaauggcagcaua

SEQ ID NO: 391554 - RNA, 17 nt, Homo sapiens
acauggugaaacccugu

SEQ ID NO: 391555 - RNA, 12 nt, Homo sapiens
acaugugacauu

SEQ ID NO: 391556 - RNA, 16 nt, Homo sapiens
acauucgaguguuuca

SEQ ID NO: 391557 - RNA, 20 nt, Homo sapiens
acauucugcaagcacaucug

SEQ ID NO: 391558 - RNA, 23 nt, Homo sapiens
acauucugcaagcacaucugcau

SEQ ID NO: 391559 - RNA, 23 nt, Homo sapiens
acauucuuguuuuaagugccuuu

SEQ ID NO: 391560 - RNA, 16 nt, Homo sapiens
acauugguauucuggg

SEQ ID NO: 391561 - RNA, 13 nt, Homo sapiens
acauuguauauau

SEQ ID NO: 391562 - RNA, 13 nt, Homo sapiens
acauuuccaugca

SEQ ID NO: 391563 - RNA, 22 nt, Homo sapiens
accaaagccaccagacugacaa

SEQ ID NO: 391564 - RNA, 19 nt, Homo sapiens
accaacaguuccuucagcu

SEQ ID NO: 391565 - RNA, 14 nt, Homo sapiens
accaacauggagaa

SEQ ID NO: 391566 - RNA, 13 nt, Homo sapiens
accaagcaggaag

SEQ ID NO: 391567 - RNA, 13 nt, Homo sapiens
accaauguucucu

SEQ ID NO: 391568 - RNA, 17 nt, Homo sapiens
accacagguucaugcca

SEQ ID NO: 391569 - RNA, 13 nt, Homo sapiens
accacuccugcca

SEQ ID NO: 391570 - RNA, 17 nt, Homo sapiens
accacugauaaaaccau

SEQ ID NO: 391571 - RNA, 21 nt, Homo sapiens
accagagaccguccucacccc

SEQ ID NO: 391572 - RNA, 23 nt, Homo sapiens
accagcagcuggaaucugaaggc

SEQ ID NO: 391573 - RNA, 21 nt, Homo sapiens
cucaaguuuuucagaaagcau

SEQ ID NO: 391574 - RNA, 14 nt, Homo sapiens
cucaaugccaguaa

SEQ ID NO: 391575 - RNA, 19 nt, Homo sapiens
cucacaauuccaaacauac

SEQ ID NO: 391576 - RNA, 16 nt, Homo sapiens
cucacacaugagaucu

SEQ ID NO: 391577 - RNA, 16 nt, Homo sapiens
cucacagaacuaugua

SEQ ID NO: 391578 - RNA, 21 nt, Homo sapiens
cucacagagugcauugugagg

SEQ ID NO: 391579 - RNA, 14 nt, Homo sapiens
cucacaguguugcc

SEQ ID NO: 391580 - RNA, 19 nt, Homo sapiens
cucaccccugcccugggau

SEQ ID NO: 391581 - RNA, 13 nt, Homo sapiens
cucaccuccuaaa

SEQ ID NO: 391582 - RNA, 15 nt, Homo sapiens
cucacuccaccaccc

SEQ ID NO: 391583 - RNA, 13 nt, Homo sapiens
cucagcaaaagau

SEQ ID NO: 391584 - RNA, 23 nt, Homo sapiens
cucagcccugggccccaccaccu

SEQ ID NO: 391585 - RNA, 16 nt, Homo sapiens
cucagcuggaucucca

SEQ ID NO: 391586 - RNA, 17 nt, Homo sapiens
cucagcuggaucuccau

SEQ ID NO: 391587 - RNA, 16 nt, Homo sapiens
cucaggaccuagggau

SEQ ID NO: 391588 - RNA, 18 nt, Homo sapiens
cucaggaguuugagacca

SEQ ID NO: 391589 - RNA, 21 nt, Homo sapiens
cucagucccuaaaaacacaga

SEQ ID NO: 391590 - RNA, 19 nt, Homo sapiens
cucauaugauugugcacau

SEQ ID NO: 391591 - RNA, 13 nt, Homo sapiens
cucaucacuggau

SEQ ID NO: 391592 - RNA, 12 nt, Homo sapiens
cucaugccugua

SEQ ID NO: 391593 - RNA, 21 nt, Homo sapiens
cucauucagggauagcacuga

SEQ ID NO: 391594 - RNA, 24 nt, Homo sapiens
cucauucagggauagcacugagca

SEQ ID NO: 391595 - RNA, 18 nt, Homo sapiens
cuccaaauuuuuuuuacu

SEQ ID NO: 391596 - RNA, 15 nt, Homo sapiens
cuccaauguccaaaa

SEQ ID NO: 391597 - RNA, 15 nt, Homo sapiens
cuccaccacgcuggg

SEQ ID NO: 391598 - RNA, 17 nt, Homo sapiens
cuccaguauucuuguca

SEQ ID NO: 391599 - RNA, 18 nt, Homo sapiens
cuccagugccagcaauga

SEQ ID NO: 391600 - RNA, 19 nt, Homo sapiens
cuccaugcugccuccagaa

SEQ ID NO: 391601 - RNA, 21 nt, Homo sapiens
cuccauguagaagccacuauu

SEQ ID NO: 391602 - RNA, 19 nt, Homo sapiens
cucccaaggcucugagcaa

SEQ ID NO: 391603 - RNA, 20 nt, Homo sapiens
cucccaccucugugaccuca

SEQ ID NO: 391604 - RNA, 19 nt, Homo sapiens
cucccagaacacacuccau

SEQ ID NO: 391605 - RNA, 15 nt, Homo sapiens
cucccagucauuuaa

SEQ ID NO: 391606 - RNA, 23 nt, Homo sapiens
cuccccagcccuggcucugcaau

SEQ ID NO: 391607 - RNA, 17 nt, Homo sapiens
cuccccauggggcagca

SEQ ID NO: 391608 - RNA, 12 nt, Homo sapiens
cuccccuaucca

SEQ ID NO: 391609 - RNA, 15 nt, Homo sapiens
cuccccuucacaugc

SEQ ID NO: 391610 - RNA, 16 nt, Homo sapiens
cucccucaaagcacac

SEQ ID NO: 391611 - RNA, 20 nt, Homo sapiens
cucccucaaagcacacguca

SEQ ID NO: 391612 - RNA, 13 nt, Homo sapiens
cucccucauucca

SEQ ID NO: 391613 - RNA, 18 nt, Homo sapiens
guuagacuuaaacagcag

SEQ ID NO: 391614 - RNA, 22 nt, Homo sapiens
guuauaauaauguuaacaugga

SEQ ID NO: 391615 - RNA, 20 nt, Homo sapiens
guucaaaaaacucuugauau

SEQ ID NO: 391616 - RNA, 12 nt, Homo sapiens
guucaccagccu

SEQ ID NO: 391617 - RNA, 16 nt, Homo sapiens
guucacucccaaccug

SEQ ID NO: 391618 - RNA, 17 nt, Homo sapiens
guucacucuacuuagca

SEQ ID NO: 391619 - RNA, 17 nt, Homo sapiens
guucauauuaagacaua

SEQ ID NO: 391620 - RNA, 17 nt, Homo sapiens
guuccagauagcagggc

SEQ ID NO: 391621 - RNA, 13 nt, Homo sapiens
guuccccacugac

SEQ ID NO: 391622 - RNA, 15 nt, Homo sapiens
guucccucacagcaa

SEQ ID NO: 391623 - RNA, 16 nt, Homo sapiens
guuccuuacugcagaa

SEQ ID NO: 391624 - RNA, 21 nt, Homo sapiens
guucucauuuuuaucccauug

SEQ ID NO: 391625 - RNA, 19 nt, Homo sapiens
guucuccauuucacuugac

SEQ ID NO: 391626 - RNA, 21 nt, Homo sapiens
guucucuucuuuaaagggaug

SEQ ID NO: 391627 - RNA, 18 nt, Homo sapiens
guucuucuuggucucagu

SEQ ID NO: 391628 - RNA, 19 nt, Homo sapiens
guugagaguugcuggugua

SEQ ID NO: 391629 - RNA, 15 nt, Homo sapiens
guugcaugauguauu

SEQ ID NO: 391630 - RNA, 23 nt, Homo sapiens
guuggacaaaccgagugcaauga

SEQ ID NO: 391631 - RNA, 18 nt, Homo sapiens
guuggccugcacuggugu

SEQ ID NO: 391632 - RNA, 19 nt, Homo sapiens
guuuaccuuguauacugua

SEQ ID NO: 391633 - RNA, 18 nt, Homo sapiens
guuuauaaaagaugcauu

SEQ ID NO: 391634 - RNA, 18 nt, Homo sapiens
guuucacacuagucacau

SEQ ID NO: 391635 - RNA, 19 nt, Homo sapiens
guuuccaucagguuccauc

SEQ ID NO: 391636 - RNA, 22 nt, Homo sapiens
guuuccugccugcggaccagau

SEQ ID NO: 391637 - RNA, 22 nt, Homo sapiens
guuugaagaugccgcauuugga

SEQ ID NO: 391638 - RNA, 17 nt, Homo sapiens
guuugaaucacaguaua

SEQ ID NO: 391639 - RNA, 14 nt, Homo sapiens
guuugaguuacuau

SEQ ID NO: 391640 - RNA, 17 nt, Homo sapiens
guuugauuauucagugu

SEQ ID NO: 391641 - RNA, 17 nt, Homo sapiens
guuuuaacaguucacuu

SEQ ID NO: 391642 - RNA, 14 nt, Homo sapiens
guuuucauuaucuc

SEQ ID NO: 391643 - RNA, 23 nt, Homo sapiens
guuuuguagagauggggucucac

SEQ ID NO: 391644 - RNA, 15 nt, Homo sapiens
guuuuguauucucug

SEQ ID NO: 391645 - RNA, 16 nt, Homo sapiens
guuuuuaaaacccagu

SEQ ID NO: 391646 - RNA, 15 nt, Homo sapiens
guuuuuaagcuguuu

SEQ ID NO: 391647 - RNA, 21 nt, Homo sapiens
uaaaaaaugaaaaacauuauu

SEQ ID NO: 391648 - RNA, 20 nt, Homo sapiens
uaaaaagccugcaauuucau

SEQ ID NO: 391649 - RNA, 16 nt, Homo sapiens
uaaaaauaugcuucua

SEQ ID NO: 391650 - RNA, 23 nt, Homo sapiens
uaaaacagguggagaaauuccuu

SEQ ID NO: 391651 - RNA, 16 nt, Homo sapiens
uaaaacccaagugccu

SEQ ID NO: 391652 - RNA, 22 nt, Homo sapiens
uaaaacuuuaaucccacuugcc

SEQ ID NO: 391653 - RNA, 12 nt, Homo sapiens
uaaaacuuuccu

SEQ ID NO: 391654 - RNA, 23 nt, Homo sapiens
uaaaagaaccgagcaauuuucug

SEQ ID NO: 391655 - RNA, 21 nt, Homo sapiens
uaaaagaugcauuaucuauga

SEQ ID NO: 391656 - RNA, 23 nt, Homo sapiens
uaaaagaugcauuaucuaugaua

SEQ ID NO: 391657 - RNA, 23 nt, Homo sapiens
uaaaauaaaguauauauagaauc

SEQ ID NO: 391658 - RNA, 15 nt, Homo sapiens
uaaaauacacacuca

SEQ ID NO: 391659 - RNA, 14 nt, Homo sapiens
uaaaauauggcuau

SEQ ID NO: 391660 - RNA, 19 nt, Homo sapiens
uaaaaucuuggcacagaaa

SEQ ID NO: 391661 - RNA, 23 nt, Homo sapiens
uaaaaugaccaguaauugugaaa

SEQ ID NO: 391662 - RNA, 15 nt, Homo sapiens
uaaaauuaugccaua

SEQ ID NO: 391663 - RNA, 15 nt, Homo sapiens
uaaaauugcacuuuu

SEQ ID NO: 391664 - RNA, 14 nt, Homo sapiens
uaaacaaacaaaca

SEQ ID NO: 391665 - RNA, 23 nt, Homo sapiens
uaaacacgccugcaaacgcugcc

SEQ ID NO: 391666 - RNA, 11 nt, Homo sapiens
uaaacagugcc

SEQ ID NO: 391667 - RNA, 15 nt, Homo sapiens
uaaacauucuaucua

SEQ ID NO: 391668 - RNA, 17 nt, Homo sapiens
uaaacucaauaaguuua

SEQ ID NO: 391669 - RNA, 15 nt, Homo sapiens
uaaacugacuuuauc

SEQ ID NO: 391670 - RNA, 21 nt, Homo sapiens
uaaagacagggaagagcagaa

SEQ ID NO: 391671 - RNA, 17 nt, Homo sapiens
uaaagaugaucuacuca

SEQ ID NO: 391672 - RNA, 16 nt, Homo sapiens
uaaagcaggugcccag

SEQ ID NO: 391673 - RNA, 18 nt, Homo sapiens
uaaagcauuccccaaaga

SEQ ID NO: 391674 - RNA, 22 nt, Homo sapiens
uaaagcugccggcacagaacuu

SEQ ID NO: 391675 - RNA, 24 nt, Homo sapiens
uaaagguaaaacaugcuggugaac

SEQ ID NO: 391676 - RNA, 16 nt, Homo sapiens
uaaaguauauauuuau

SEQ ID NO: 391677 - RNA, 15 nt, Homo sapiens
uaaauaaaacaugca

SEQ ID NO: 391678 - RNA, 15 nt, Homo sapiens
uaaauacagucuucc

SEQ ID NO: 391679 - RNA, 21 nt, Homo sapiens
uaaauagaguauaugcacuuu

SEQ ID NO: 391680 - RNA, 15 nt, Homo sapiens
uaaaucaaugcuaua

SEQ ID NO: 391681 - RNA, 15 nt, Homo sapiens
uaaaugaagugcaaa

SEQ ID NO: 391682 - RNA, 16 nt, Homo sapiens
uaaaugauuucauuca

SEQ ID NO: 391683 - RNA, 14 nt, Homo sapiens
uaaauguacauuaa

SEQ ID NO: 391684 - RNA, 14 nt, Homo sapiens
uaaaugugaacuua

SEQ ID NO: 391685 - RNA, 21 nt, Homo sapiens
uaaaugugaaugaugauccua

SEQ ID NO: 391686 - RNA, 14 nt, Homo sapiens
uaaaugugcuuaug

SEQ ID NO: 391687 - RNA, 22 nt, Homo sapiens
uaaauuauuuuuguucauauaa

SEQ ID NO: 391688 - RNA, 13 nt, Homo sapiens
uaaauuuauuuca

SEQ ID NO: 391689 - RNA, 19 nt, Homo sapiens
uaacaccaugauuaaccac

SEQ ID NO: 391690 - RNA, 18 nt, Homo sapiens
uaacagcuguggcucacg

SEQ ID NO: 391691 - RNA, 19 nt, Homo sapiens
uaacaugcccuguucagcu

SEQ ID NO: 391692 - RNA, 15 nt, Homo sapiens
uaaccacaucaauau

SEQ ID NO: 391693 - RNA, 20 nt, Homo sapiens
uaacguuagaccacaaauag

SEQ ID NO: 391694 - RNA, 12 nt, Homo sapiens
uaacuagaauuu

SEQ ID NO: 391695 - RNA, 17 nt, Homo sapiens
uaacuagaauuuauuca

SEQ ID NO: 391696 - RNA, 11 nt, Homo sapiens
uaacuauucau

SEQ ID NO: 391697 - RNA, 18 nt, Homo sapiens
uaacuggcuuacuuccua

SEQ ID NO: 391698 - RNA, 15 nt, Homo sapiens
uaacuuguuuccaau

SEQ ID NO: 391699 - RNA, 17 nt, Homo sapiens
uaacuuguuuccaaugu

SEQ ID NO: 391700 - RNA, 18 nt, Homo sapiens
uaagaaaacaucacugaa

SEQ ID NO: 391701 - RNA, 22 nt, Homo sapiens
uaagaaucuuuagagaaguaua

SEQ ID NO: 391702 - RNA, 15 nt, Homo sapiens
uaagacggauuuauu

SEQ ID NO: 391703 - RNA, 13 nt, Homo sapiens
uaagacuacugaa

SEQ ID NO: 391704 - RNA, 21 nt, Homo sapiens
uaagaggauagaauacaugga

SEQ ID NO: 391705 - RNA, 17 nt, Homo sapiens
uaagauggaagcuucca

SEQ ID NO: 391706 - RNA, 13 nt, Homo sapiens
uaagauucaucca

SEQ ID NO: 391707 - RNA, 15 nt, Homo sapiens
uaagcagaagcacau

SEQ ID NO: 391708 - RNA, 16 nt, Homo sapiens
uaagcagaccacugau

SEQ ID NO: 391709 - RNA, 22 nt, Homo sapiens
uaagcaucaaauauuugugcaa

SEQ ID NO: 391710 - RNA, 16 nt, Homo sapiens
uaaggaugucacaggg

SEQ ID NO: 391711 - RNA, 18 nt, Homo sapiens
uaaggaugucacagggcc

SEQ ID NO: 391712 - RNA, 15 nt, Homo sapiens
uaaggauugugauau

SEQ ID NO: 391713 - RNA, 19 nt, Homo sapiens
uaaggcugaggaaaggcca

SEQ ID NO: 391714 - RNA, 14 nt, Homo sapiens
uaagggaaacugcc

SEQ ID NO: 391715 - RNA, 13 nt, Homo sapiens
uaagggaccucaa

SEQ ID NO: 391716 - RNA, 15 nt, Homo sapiens
uaagggugucuuccu

SEQ ID NO: 391717 - RNA, 13 nt, Homo sapiens
uaagguacuuaaa

SEQ ID NO: 391718 - RNA, 18 nt, Homo sapiens
uaaguaaguuugauuuca

SEQ ID NO: 391719 - RNA, 22 nt, Homo sapiens
uaagucaaccugccugacauuu

SEQ ID NO: 391720 - RNA, 20 nt, Homo sapiens
uaagugauauaaaucagauu

SEQ ID NO: 391721 - RNA, 14 nt, Homo sapiens
uaagugcaugacau

SEQ ID NO: 391722 - RNA, 19 nt, Homo sapiens
uaaguugauggugaugaaa

SEQ ID NO: 391723 - RNA, 14 nt, Homo sapiens
uaaguuucugggac

SEQ ID NO: 391724 - RNA, 15 nt, Homo sapiens
uaaguuugauuucau

SEQ ID NO: 391725 - RNA, 16 nt, Homo sapiens
uaauaaguuucacuga

SEQ ID NO: 391726 - RNA, 18 nt, Homo sapiens
uaauacagacuaugucac

SEQ ID NO: 391727 - RNA, 14 nt, Homo sapiens
uaauacagcagugu

SEQ ID NO: 391728 - RNA, 14 nt, Homo sapiens
uaauacugaaggac

SEQ ID NO: 391729 - RNA, 18 nt, Homo sapiens
uaauaguuuugauccuaa

SEQ ID NO: 391730 - RNA, 18 nt, Homo sapiens
uaauccagaaaaacugug

SEQ ID NO: 391731 - RNA, 19 nt, Homo sapiens
uaaucccagcuggccugua

SEQ ID NO: 391732 - RNA, 19 nt, Homo sapiens
uaauccucuuuuucuaguc

SEQ ID NO: 391733 - RNA, 13 nt, Homo sapiens
uaaugaacaugug

SEQ ID NO: 391734 - RNA, 14 nt, Homo sapiens
uaaugaacauguga

SEQ ID NO: 391735 - RNA, 22 nt, Homo sapiens
uaaugcuaaagaaaaagucauc

SEQ ID NO: 391736 - RNA, 16 nt, Homo sapiens
uaaugguugacugggu

SEQ ID NO: 391737 - RNA, 14 nt, Homo sapiens
uaauguacaucugg

SEQ ID NO: 391738 - RNA, 14 nt, Homo sapiens
uaaugucaccaccu

SEQ ID NO: 391739 - RNA, 23 nt, Homo sapiens
uaaugugaaguagaauccuaaau

SEQ ID NO: 391740 - RNA, 15 nt, Homo sapiens
uaauguuaauucagc

SEQ ID NO: 391741 - RNA, 16 nt, Homo sapiens
uaauguuauuuccacu

SEQ ID NO: 391742 - RNA, 20 nt, Homo sapiens
uaauguuguaauucaugcca

SEQ ID NO: 391743 - RNA, 14 nt, Homo sapiens
uaauucaaaagcac

SEQ ID NO: 391744 - RNA, 14 nt, Homo sapiens
uaauucuagagucu

SEQ ID NO: 391745 - RNA, 16 nt, Homo sapiens
uaauucucaugugauc

SEQ ID NO: 391746 - RNA, 15 nt, Homo sapiens
uaauugaacuaacaa

SEQ ID NO: 391747 - RNA, 16 nt, Homo sapiens
uaauugcuuacauuuu

SEQ ID NO: 391748 - RNA, 20 nt, Homo sapiens
uaauugugaaaauuacaguu

SEQ ID NO: 391749 - RNA, 21 nt, Homo sapiens
uaauuuaucuugucucugggc

SEQ ID NO: 391750 - RNA, 21 nt, Homo sapiens
uaauuuauuuaauauacuuua

SEQ ID NO: 391751 - RNA, 17 nt, Homo sapiens
uaauuucaggaauugaa

SEQ ID NO: 391752 - RNA, 14 nt, Homo sapiens
uacaaaaacacagc

SEQ ID NO: 391753 - RNA, 16 nt, Homo sapiens
uacaaaaacacagcaa

SEQ ID NO: 391754 - RNA, 17 nt, Homo sapiens
uacaacuucaagugcau

SEQ ID NO: 391755 - RNA, 20 nt, Homo sapiens
uauguuuacauaucaccuca

SEQ ID NO: 391756 - RNA, 16 nt, Homo sapiens
uauuaaaucuugcaac

SEQ ID NO: 391757 - RNA, 22 nt, Homo sapiens
uauuacaguuuaucuauggcac

SEQ ID NO: 391758 - RNA, 18 nt, Homo sapiens
uauuauucuucauaacaa

SEQ ID NO: 391759 - RNA, 13 nt, Homo sapiens
uauuccugcauuu

SEQ ID NO: 391760 - RNA, 19 nt, Homo sapiens
uauucucacuccaccaccc

SEQ ID NO: 391761 - RNA, 14 nt, Homo sapiens
uauucuugucaaaa

SEQ ID NO: 391762 - RNA, 22 nt, Homo sapiens
uauugaaaaaucaccacaccaa

SEQ ID NO: 391763 - RNA, 13 nt, Homo sapiens
uauuuaccagacc

SEQ ID NO: 391764 - RNA, 12 nt, Homo sapiens
uauuuaccugaa

SEQ ID NO: 391765 - RNA, 18 nt, Homo sapiens
uauuuauaagagugccgu

SEQ ID NO: 391766 - RNA, 21 nt, Homo sapiens
uauuugaagcaucacauaaaa

SEQ ID NO: 391767 - RNA, 17 nt, Homo sapiens
uauuuguuugcaauuuu

SEQ ID NO: 391768 - RNA, 17 nt, Homo sapiens
uauuuuauagagcagaa

SEQ ID NO: 391769 - RNA, 22 nt, Homo sapiens
uauuuugcauaguaccaaucau

SEQ ID NO: 391770 - RNA, 12 nt, Homo sapiens
uauuuugcccag

SEQ ID NO: 391771 - RNA, 13 nt, Homo sapiens
uauuuuucaugau

SEQ ID NO: 391772 - RNA, 14 nt, Homo sapiens
uauuuuugugcaca

SEQ ID NO: 391773 - RNA, 17 nt, Homo sapiens
uauuuuuuaaguauuua

SEQ ID NO: 391774 - RNA, 17 nt, Homo sapiens
ucaaaacaauuggcaaa

SEQ ID NO: 391775 - RNA, 17 nt, Homo sapiens
ucaaaacugcacuguca

SEQ ID NO: 391776 - RNA, 12 nt, Homo sapiens
ucaaaagaucaa

SEQ ID NO: 391777 - RNA, 12 nt, Homo sapiens
ucaaaaggugcc

SEQ ID NO: 391778 - RNA, 20 nt, Homo sapiens
ucaaaauaaaaaccaagaag

SEQ ID NO: 391779 - RNA, 22 nt, Homo sapiens
ucaaaauaccaugccauuuaaa

SEQ ID NO: 391780 - RNA, 24 nt, Homo sapiens
ucaaaaugucuaagauaguaacaa

SEQ ID NO: 391781 - RNA, 23 nt, Homo sapiens
ucaaacaugaaguguguuuccuu

SEQ ID NO: 391782 - RNA, 14 nt, Homo sapiens
ucaaacugccuugg

SEQ ID NO: 391783 - RNA, 23 nt, Homo sapiens
ucaaagauguguugcuauccuga

SEQ ID NO: 391784 - RNA, 15 nt, Homo sapiens
ucaaagcaaguuuca

SEQ ID NO: 391785 - RNA, 15 nt, Homo sapiens
ucaaagcacacguca

SEQ ID NO: 391786 - RNA, 10 nt, Homo sapiens
ucaaagccag

SEQ ID NO: 391787 - RNA, 23 nt, Homo sapiens
ucaaagcucuauuaagauuucca

SEQ ID NO: 391788 - RNA, 15 nt, Homo sapiens
ucaaaguaaaacuug

SEQ ID NO: 391789 - RNA, 13 nt, Homo sapiens
ucaaauagcauaa

SEQ ID NO: 391790 - RNA, 14 nt, Homo sapiens
ucaaauaugcaaag

SEQ ID NO: 391791 - RNA, 16 nt, Homo sapiens
ucaaauuggagcuuca

SEQ ID NO: 391792 - RNA, 12 nt, Homo sapiens
ucaacagaauug

SEQ ID NO: 391793 - RNA, 20 nt, Homo sapiens
ucaacaucuuuuacauucug

SEQ ID NO: 391794 - RNA, 23 nt, Homo sapiens
ucaacuggagacacuauuuaucu

SEQ ID NO: 391795 - RNA, 12 nt, Homo sapiens
ucaacuuugaca

SEQ ID NO: 391796 - RNA, 16 nt, Homo sapiens
ucaagaaaacaacuuc

SEQ ID NO: 391797 - RNA, 16 nt, Homo sapiens
ucaagaagaagaugga

SEQ ID NO: 391798 - RNA, 21 nt, Homo sapiens
ucaagauuuucauacuuuuac

SEQ ID NO: 391799 - RNA, 21 nt, Homo sapiens
ucaagccuagcccuucucuca

SEQ ID NO: 391800 - RNA, 21 nt, Homo sapiens
ucaaggcccauaucugugaaa

SEQ ID NO: 391801 - RNA, 16 nt, Homo sapiens
ucaaucucugauucug

SEQ ID NO: 391802 - RNA, 12 nt, Homo sapiens
ucaaugccagua

SEQ ID NO: 391803 - RNA, 12 nt, Homo sapiens
ucaaugcuauaa

SEQ ID NO: 391804 - RNA, 21 nt, Homo sapiens
ucaauguuucuuuuaucacga

SEQ ID NO: 391805 - RNA, 17 nt, Homo sapiens
ucaauucagugcuguac

SEQ ID NO: 391806 - RNA, 20 nt, Homo sapiens
ucaauuccaccugcaaucaa

SEQ ID NO: 391807 - RNA, 18 nt, Homo sapiens
ucacaaggcauucaagug

SEQ ID NO: 391808 - RNA, 23 nt, Homo sapiens
ucacaauccuguggaucugggca

SEQ ID NO: 391809 - RNA, 11 nt, Homo sapiens
ucacacacagg

SEQ ID NO: 391810 - RNA, 21 nt, Homo sapiens
ucacacagccaagccagucaa

SEQ ID NO: 391811 - RNA, 12 nt, Homo sapiens
ucacacauucca

SEQ ID NO: 391812 - RNA, 14 nt, Homo sapiens
ucacaccugaccaa

SEQ ID NO: 391813 - RNA, 12 nt, Homo sapiens
ucacacugagga

SEQ ID NO: 391814 - RNA, 19 nt, Homo sapiens
ucacagacuggcaacaaga

SEQ ID NO: 391815 - RNA, 18 nt, Homo sapiens
ucacagagugcauuguga

SEQ ID NO: 391816 - RNA, 16 nt, Homo sapiens
ucacagaugugugauu

SEQ ID NO: 391817 - RNA, 12 nt, Homo sapiens
ucacagggccaa

SEQ ID NO: 391818 - RNA, 19 nt, Homo sapiens
ucacaguguguuugugauu

SEQ ID NO: 391819 - RNA, 16 nt, Homo sapiens
ucacaucugcaucuua

SEQ ID NO: 391820 - RNA, 18 nt, Homo sapiens
ucacaugagcuauuucca

SEQ ID NO: 391821 - RNA, 18 nt, Homo sapiens
ucacauuaauauuugcug

SEQ ID NO: 391822 - RNA, 18 nt, Homo sapiens
ucaccacaccaaaccucu

SEQ ID NO: 391823 - RNA, 22 nt, Homo sapiens
ucaccaggaggcggcagugcaa

SEQ ID NO: 391824 - RNA, 18 nt, Homo sapiens
ucaccccugcuauaacua

SEQ ID NO: 391825 - RNA, 17 nt, Homo sapiens
ucaccugaggucaggag

SEQ ID NO: 391826 - RNA, 21 nt, Homo sapiens
ucaccuugggaugaugccuca

SEQ ID NO: 391827 - RNA, 19 nt, Homo sapiens
ucacgaaguuuguucauca

SEQ ID NO: 391828 - RNA, 21 nt, Homo sapiens
ucacgaggaaaagagaaggaa

SEQ ID NO: 391829 - RNA, 19 nt, Homo sapiens
ucacgccuguaaucccagc

SEQ ID NO: 391830 - RNA, 21 nt, Homo sapiens
ucacucuauuaaaucuugcaa

SEQ ID NO: 391831 - RNA, 16 nt, Homo sapiens
ucacuuuaauucucau

SEQ ID NO: 391832 - RNA, 20 nt, Homo sapiens
ucagaaacaggugcaucugg

SEQ ID NO: 391833 - RNA, 12 nt, Homo sapiens
ucagaaaccaaa

SEQ ID NO: 391834 - RNA, 22 nt, Homo sapiens
ucagaacccuuggcuugcccac

SEQ ID NO: 391835 - RNA, 16 nt, Homo sapiens
ucagacuccugugcaa

SEQ ID NO: 391836 - RNA, 17 nt, Homo sapiens
ucagacuccugugcaac

SEQ ID NO: 391837 - RNA, 14 nt, Homo sapiens
ucagaguugugcac

SEQ ID NO: 391838 - RNA, 16 nt, Homo sapiens
ucagaguugugcacau

SEQ ID NO: 391839 - RNA, 23 nt, Homo sapiens
ucagaugaauuguuaauuaucua

SEQ ID NO: 391840 - RNA, 13 nt, Homo sapiens
ucagaugucucug

SEQ ID NO: 391841 - RNA, 19 nt, Homo sapiens
ucagcaaaagaugcuucuc

SEQ ID NO: 391842 - RNA, 19 nt, Homo sapiens
ucagcaauacagacuacuu

SEQ ID NO: 391843 - RNA, 21 nt, Homo sapiens
ucagcacugucccuugccuca

SEQ ID NO: 391844 - RNA, 14 nt, Homo sapiens
ucagcauaccugcu

SEQ ID NO: 391845 - RNA, 18 nt, Homo sapiens
ucagcauucucacuccua

SEQ ID NO: 391846 - RNA, 14 nt, Homo sapiens
ucagccacauucua

SEQ ID NO: 391847 - RNA, 17 nt, Homo sapiens
ucagccugucucuucca

SEQ ID NO: 391848 - RNA, 21 nt, Homo sapiens
ucagcuggaucuccauucucu

SEQ ID NO: 391849 - RNA, 20 nt, Homo sapiens
ucaggaaaucaaauaugcaa

SEQ ID NO: 391850 - RNA, 22 nt, Homo sapiens
ucaggaaaucaaauaugcaaag

SEQ ID NO: 391851 - RNA, 18 nt, Homo sapiens
ucaggaguuugagaccag

SEQ ID NO: 391852 - RNA, 19 nt, Homo sapiens
ucaggaucaagaaaguguu

SEQ ID NO: 391853 - RNA, 14 nt, Homo sapiens
ucagggacagagcc

SEQ ID NO: 391854 - RNA, 19 nt, Homo sapiens
ucagggaccccugcccuug

SEQ ID NO: 391855 - RNA, 17 nt, Homo sapiens
ucagggcacugcugcug

SEQ ID NO: 391856 - RNA, 13 nt, Homo sapiens
ucaggugauccac

SEQ ID NO: 391857 - RNA, 20 nt, Homo sapiens
ucagucccuaaaaacacaga

SEQ ID NO: 391858 - RNA, 19 nt, Homo sapiens
ucagucucugagcagugaa

SEQ ID NO: 391859 - RNA, 14 nt, Homo sapiens
ucagugaaagccag

SEQ ID NO: 391860 - RNA, 18 nt, Homo sapiens
ucagugaauaaaccauca

SEQ ID NO: 391861 - RNA, 21 nt, Homo sapiens
ucagugcucccucacauguca

SEQ ID NO: 391862 - RNA, 18 nt, Homo sapiens
ucaguuacucagcccugg

SEQ ID NO: 391863 - RNA, 18 nt, Homo sapiens
ucaguucauccauucuau

SEQ ID NO: 391864 - RNA, 20 nt, Homo sapiens
ucaguuucaauucagugcug

SEQ ID NO: 391865 - RNA, 23 nt, Homo sapiens
ucauaaagucuuugaagugacuu

SEQ ID NO: 391866 - RNA, 14 nt, Homo sapiens
ucauacaugacuca

SEQ ID NO: 391867 - RNA, 16 nt, Homo sapiens
ucauaccuaucaucuu

SEQ ID NO: 391868 - RNA, 15 nt, Homo sapiens
ucauacguccaccau

SEQ ID NO: 391869 - RNA, 20 nt, Homo sapiens
ucauauuuuguauauaucug

SEQ ID NO: 391870 - RNA, 12 nt, Homo sapiens
ucaucacuggau

SEQ ID NO: 391871 - RNA, 19 nt, Homo sapiens
ucaucacuggaugaagauu

SEQ ID NO: 391872 - RNA, 16 nt, Homo sapiens
ucaucaugugugucca

SEQ ID NO: 391873 - RNA, 18 nt, Homo sapiens
ucaucauucucugucuca

SEQ ID NO: 391874 - RNA, 18 nt, Homo sapiens
ucauccaaugcucaagaa

SEQ ID NO: 391875 - RNA, 16 nt, Homo sapiens
ucaucuauaacaugca

SEQ ID NO: 391876 - RNA, 15 nt, Homo sapiens
ucaugaaauaugcau

SEQ ID NO: 391877 - RNA, 16 nt, Homo sapiens
ucaugauaugucaggg

SEQ ID NO: 391878 - RNA, 24 nt, Homo sapiens
ucauuauagaucccccagacuuua

SEQ ID NO: 391879 - RNA, 20 nt, Homo sapiens
ucauuaucucaaaacugcac

SEQ ID NO: 391880 - RNA, 12 nt, Homo sapiens
ucauucagggau

SEQ ID NO: 391881 - RNA, 13 nt, Homo sapiens
ucauuccaccuuc

SEQ ID NO: 391882 - RNA, 17 nt, Homo sapiens
ucauuccaccuucccau

SEQ ID NO: 391883 - RNA, 17 nt, Homo sapiens
ucauuccugccugucuc

SEQ ID NO: 391884 - RNA, 15 nt, Homo sapiens
ucauucucauucuca

SEQ ID NO: 391885 - RNA, 21 nt, Homo sapiens
ucauuuauucuucuuuuccaa

SEQ ID NO: 391886 - RNA, 17 nt, Homo sapiens
ucauuucagauaaacaa

SEQ ID NO: 391887 - RNA, 21 nt, Homo sapiens
ucauuuguaccucgaguuuua

SEQ ID NO: 391888 - RNA, 19 nt, Homo sapiens
uccaaacuaccuuccaguu

SEQ ID NO: 391889 - RNA, 23 nt, Homo sapiens
uccaacaugaaaacaauucuuau

SEQ ID NO: 391890 - RNA, 16 nt, Homo sapiens
uccaaccuaaccccuu

SEQ ID NO: 391891 - RNA, 20 nt, Homo sapiens
uccaagcaaaaacaaauggg

SEQ ID NO: 391892 - RNA, 18 nt, Homo sapiens
uccaagccucauguccac

SEQ ID NO: 391893 - RNA, 14 nt, Homo sapiens
uccaauaaauguga

SEQ ID NO: 391894 - RNA, 14 nt, Homo sapiens
uccaaugcucaaga

SEQ ID NO: 391895 - RNA, 22 nt, Homo sapiens
uccaauugaacuuucacauagc

SEQ ID NO: 391896 - RNA, 20 nt, Homo sapiens
uccacaagauucccagagac

SEQ ID NO: 391897 - RNA, 20 nt, Homo sapiens
ucucuacuaaaaauacaaaa

SEQ ID NO: 391898 - RNA, 12 nt, Homo sapiens
ucucuccacuga

SEQ ID NO: 391899 - RNA, 13 nt, Homo sapiens
ucucucuucucca

SEQ ID NO: 391900 - RNA, 18 nt, Homo sapiens
ucucucuugcuuacaaau

SEQ ID NO: 391901 - RNA, 14 nt, Homo sapiens
ucucugagcaguga

SEQ ID NO: 391902 - RNA, 19 nt, Homo sapiens
ucucugagcagugaaugau

SEQ ID NO: 391903 - RNA, 15 nt, Homo sapiens
agaugaucauuugcc

SEQ ID NO: 391904 - RNA, 20 nt, Homo sapiens
agaugcauuaucuaugauau

SEQ ID NO: 391905 - RNA, 20 nt, Homo sapiens
agaugcugacuguacuccuc

SEQ ID NO: 391906 - RNA, 19 nt, Homo sapiens
agauggaaugcuguguuaa

SEQ ID NO: 391907 - RNA, 21 nt, Homo sapiens
agauggagguucucucggagu

SEQ ID NO: 391908 - RNA, 15 nt, Homo sapiens
agauggcaauuucac

SEQ ID NO: 391909 - RNA, 16 nt, Homo sapiens
agauggcugugccucu

SEQ ID NO: 391910 - RNA, 15 nt, Homo sapiens
agaugggacugggag

SEQ ID NO: 391911 - RNA, 22 nt, Homo sapiens
agauguaagaaauguucuugca

SEQ ID NO: 391912 - RNA, 19 nt, Homo sapiens
agauguccuugaugcucau

SEQ ID NO: 391913 - RNA, 16 nt, Homo sapiens
agaugugcaacacuca

SEQ ID NO: 391914 - RNA, 19 nt, Homo sapiens
agaugugggcagugauguc

SEQ ID NO: 391915 - RNA, 19 nt, Homo sapiens
agauguucuaagucuuucc

SEQ ID NO: 391916 - RNA, 19 nt, Homo sapiens
agauguuugaggcuuucag

SEQ ID NO: 391917 - RNA, 18 nt, Homo sapiens
agauuauauauuauuucu

SEQ ID NO: 391918 - RNA, 21 nt, Homo sapiens
agauuccaggcgaugugcaag

SEQ ID NO: 391919 - RNA, 17 nt, Homo sapiens
agauugcgccauugcac

SEQ ID NO: 391920 - RNA, 16 nt, Homo sapiens
agcaaaaagcaaaauc

SEQ ID NO: 391921 - RNA, 18 nt, Homo sapiens
agcaaagggagcacuggg

SEQ ID NO: 391922 - RNA, 13 nt, Homo sapiens
agcaaagggcuca

SEQ ID NO: 391923 - RNA, 14 nt, Homo sapiens
agcaaauacauauu

SEQ ID NO: 391924 - RNA, 22 nt, Homo sapiens
agcaaaucuacuucaacacuuc

SEQ ID NO: 391925 - RNA, 12 nt, Homo sapiens
agcaaaugacaa

SEQ ID NO: 391926 - RNA, 13 nt, Homo sapiens
agcaaaugugacc

SEQ ID NO: 391927 - RNA, 15 nt, Homo sapiens
agcaaauguggcucc

SEQ ID NO: 391928 - RNA, 18 nt, Homo sapiens
agcaacccuaacaguaag

SEQ ID NO: 391929 - RNA, 14 nt, Homo sapiens
agcaagcuauucaa

SEQ ID NO: 391930 - RNA, 18 nt, Homo sapiens
agcaauacagacuacuuc

SEQ ID NO: 391931 - RNA, 18 nt, Homo sapiens
agcaaugacaucucaggg

SEQ ID NO: 391932 - RNA, 11 nt, Homo sapiens
agcacacugua

SEQ ID NO: 391933 - RNA, 14 nt, Homo sapiens
agcaccaggggaug

SEQ ID NO: 391934 - RNA, 16 nt, Homo sapiens
agcaccauaacuuugu

SEQ ID NO: 391935 - RNA, 17 nt, Homo sapiens
agcacuaaagcagugga

SEQ ID NO: 391936 - RNA, 18 nt, Homo sapiens
agcacuacauaaacugac

SEQ ID NO: 391937 - RNA, 19 nt, Homo sapiens
agcacugagcaaagcauug

SEQ ID NO: 391938 - RNA, 21 nt, Homo sapiens
agcacuguuggagcuacugca

SEQ ID NO: 391939 - RNA, 14 nt, Homo sapiens
agcagaacagugau

SEQ ID NO: 391940 - RNA, 15 nt, Homo sapiens
agcagaacagugauu

SEQ ID NO: 391941 - RNA, 17 nt, Homo sapiens
agcagaacuucugaaac

SEQ ID NO: 391942 - RNA, 18 nt, Homo sapiens
agcagauggaaugcugug

SEQ ID NO: 391943 - RNA, 13 nt, Homo sapiens
agcagcagugcau

SEQ ID NO: 391944 - RNA, 21 nt, Homo sapiens
agcagcgccccucccaagagg

SEQ ID NO: 391945 - RNA, 16 nt, Homo sapiens
agcaggcuacugucag

SEQ ID NO: 391946 - RNA, 15 nt, Homo sapiens
agcagggacuugaac

SEQ ID NO: 391947 - RNA, 18 nt, Homo sapiens
agcagggauuaaccucug

SEQ ID NO: 391948 - RNA, 23 nt, Homo sapiens
agcagguaugggacaggugccag

SEQ ID NO: 391949 - RNA, 13 nt, Homo sapiens
agcagugaugaaa

SEQ ID NO: 391950 - RNA, 16 nt, Homo sapiens
agcagugaugaaaaug

SEQ ID NO: 391951 - RNA, 20 nt, Homo sapiens
agcaguuaguuccuucauga

SEQ ID NO: 391952 - RNA, 12 nt, Homo sapiens
agcauaauguga

SEQ ID NO: 391953 - RNA, 21 nt, Homo sapiens
agcauacgguaugauauugca

SEQ ID NO: 391954 - RNA, 13 nt, Homo sapiens
agcauacuuuaua

SEQ ID NO: 391955 - RNA, 18 nt, Homo sapiens
agcauccucucucacaug

SEQ ID NO: 391956 - RNA, 18 nt, Homo sapiens
agcauuagucacuuugaa

SEQ ID NO: 391957 - RNA, 18 nt, Homo sapiens
agcauuuagcacauacua

SEQ ID NO: 391958 - RNA, 18 nt, Homo sapiens
agcauuucuagcagugau

SEQ ID NO: 391959 - RNA, 22 nt, Homo sapiens
agcauuucuagcagugaugaaa

SEQ ID NO: 391960 - RNA, 21 nt, Homo sapiens
agcauuuuacaagaucuugca

SEQ ID NO: 391961 - RNA, 23 nt, Homo sapiens
agccaaaggauaaguguccccua

SEQ ID NO: 391962 - RNA, 14 nt, Homo sapiens
agccaacuuuugca

SEQ ID NO: 391963 - RNA, 20 nt, Homo sapiens
agccaagaucgcgccacugc

SEQ ID NO: 391964 - RNA, 13 nt, Homo sapiens
agccacacugugg

SEQ ID NO: 391965 - RNA, 22 nt, Homo sapiens
agccaccaugcccagcucagag

SEQ ID NO: 391966 - RNA, 19 nt, Homo sapiens
agccagcagccagcucuca

SEQ ID NO: 391967 - RNA, 17 nt, Homo sapiens
agccagggggacuagcc

SEQ ID NO: 391968 - RNA, 19 nt, Homo sapiens
agccagggggacuagcccc

SEQ ID NO: 391969 - RNA, 19 nt, Homo sapiens
agcccaccccucaacaccu

SEQ ID NO: 391970 - RNA, 12 nt, Homo sapiens
agcccagggugg

SEQ ID NO: 391971 - RNA, 16 nt, Homo sapiens
agcccauggcacucua

SEQ ID NO: 391972 - RNA, 12 nt, Homo sapiens
agccccaaaagg

SEQ ID NO: 391973 - RNA, 15 nt, Homo sapiens
agccccagugccaag

SEQ ID NO: 391974 - RNA, 19 nt, Homo sapiens
agccccucuggacacagcc

SEQ ID NO: 391975 - RNA, 15 nt, Homo sapiens
agcccugagcuuucu

SEQ ID NO: 391976 - RNA, 13 nt, Homo sapiens
agccgaccucagc

SEQ ID NO: 391977 - RNA, 13 nt, Homo sapiens
agccgcugugagc

SEQ ID NO: 391978 - RNA, 14 nt, Homo sapiens
agccggcacagggu

SEQ ID NO: 391979 - RNA, 17 nt, Homo sapiens
agccguaguggaauuaa

SEQ ID NO: 391980 - RNA, 18 nt, Homo sapiens
agccuagccgaccucagc

SEQ ID NO: 391981 - RNA, 23 nt, Homo sapiens
agccucaagucuuauuuccucaa

SEQ ID NO: 391982 - RNA, 18 nt, Homo sapiens
agccucacugcaagcacu

SEQ ID NO: 391983 - RNA, 22 nt, Homo sapiens
agccucacugcaagcacugcau

SEQ ID NO: 391984 - RNA, 15 nt, Homo sapiens
agccuccuccugacc

SEQ ID NO: 391985 - RNA, 13 nt, Homo sapiens
agccucgucuuca

SEQ ID NO: 391986 - RNA, 20 nt, Homo sapiens
agccugggcgacagagccag

SEQ ID NO: 391987 - RNA, 23 nt, Homo sapiens
agccugucccauggacacuccag

SEQ ID NO: 391988 - RNA, 17 nt, Homo sapiens
agccuugggaacaugcg

SEQ ID NO: 391989 - RNA, 12 nt, Homo sapiens
agcgacagugag

SEQ ID NO: 391990 - RNA, 15 nt, Homo sapiens
agcgagacuccgucu

SEQ ID NO: 391991 - RNA, 16 nt, Homo sapiens
agcggaaagcagcuca

SEQ ID NO: 391992 - RNA, 17 nt, Homo sapiens
agcggaaagcagcucaa

SEQ ID NO: 391993 - RNA, 23 nt, Homo sapiens
agcggcuggcagcccaccccuca

SEQ ID NO: 391994 - RNA, 18 nt, Homo sapiens
agcgugagcugugggaga

SEQ ID NO: 391995 - RNA, 23 nt, Homo sapiens
agcuaaggucacauugugccuuu

SEQ ID NO: 391996 - RNA, 14 nt, Homo sapiens
agcuacugacuaug

SEQ ID NO: 391997 - RNA, 20 nt, Homo sapiens
agcuacuugggaggcugaga

SEQ ID NO: 391998 - RNA, 21 nt, Homo sapiens
agcuagaagugggccaggaca

SEQ ID NO: 391999 - RNA, 20 nt, Homo sapiens
agcuaucucucagugaacug

SEQ ID NO: 392000 - RNA, 17 nt, Homo sapiens
agcucacaccugaccaa

SEQ ID NO: 392001 - RNA, 16 nt, Homo sapiens
agcucacgucacacuu

SEQ ID NO: 392002 - RNA, 12 nt, Homo sapiens
agcucaucucag

SEQ ID NO: 392003 - RNA, 13 nt, Homo sapiens
agcuccacuguca

SEQ ID NO: 392004 - RNA, 15 nt, Homo sapiens
agcucgguggaccca

SEQ ID NO: 392005 - RNA, 23 nt, Homo sapiens
agcucguucucugggccuucuca

SEQ ID NO: 392006 - RNA, 18 nt, Homo sapiens
agcucuggugacaccagc

SEQ ID NO: 392007 - RNA, 21 nt, Homo sapiens
agcucuggugacaccagccuu

SEQ ID NO: 392008 - RNA, 13 nt, Homo sapiens
agcugcacccuca

SEQ ID NO: 392009 - RNA, 21 nt, Homo sapiens
agcugcugaaacaacaaauag

SEQ ID NO: 392010 - RNA, 16 nt, Homo sapiens
agcuggcggccugcag

SEQ ID NO: 392011 - RNA, 18 nt, Homo sapiens
agcugucaggcugauuau

SEQ ID NO: 392012 - RNA, 19 nt, Homo sapiens
agcugucccucacuguuga

SEQ ID NO: 392013 - RNA, 14 nt, Homo sapiens
agcuguuuccauag

SEQ ID NO: 392014 - RNA, 16 nt, Homo sapiens
agcuguuuucccugac

SEQ ID NO: 392015 - RNA, 13 nt, Homo sapiens
agcuuagaccuca

SEQ ID NO: 392016 - RNA, 22 nt, Homo sapiens
agcuuaggggcugcugaccucc

SEQ ID NO: 392017 - RNA, 12 nt, Homo sapiens
agcuuaucucag

SEQ ID NO: 392018 - RNA, 14 nt, Homo sapiens
agcuuaugucagac

SEQ ID NO: 392019 - RNA, 22 nt, Homo sapiens
agcuucuuaauauaacugccuu

SEQ ID NO: 392020 - RNA, 19 nt, Homo sapiens
agcuugauucucagcacuu

SEQ ID NO: 392021 - RNA, 22 nt, Homo sapiens
agcuuggauggagacuccauga

SEQ ID NO: 392022 - RNA, 22 nt, Homo sapiens
agcuuucauguaaacugugcac

SEQ ID NO: 392023 - RNA, 19 nt, Homo sapiens
agcuuucugcuaucaaaga

SEQ ID NO: 392024 - RNA, 16 nt, Homo sapiens
agcuuugaaaauucag

SEQ ID NO: 392025 - RNA, 20 nt, Homo sapiens
agcuuuugaggggcugacuu

SEQ ID NO: 392026 - RNA, 23 nt, Homo sapiens
agcuuuugaggggcugacuucaa

SEQ ID NO: 392027 - RNA, 21 nt, Homo sapiens
aggaaaacugagacucagaca

SEQ ID NO: 392028 - RNA, 12 nt, Homo sapiens
aggaaagugauu

SEQ ID NO: 392029 - RNA, 13 nt, Homo sapiens
aggaaagugauuu

SEQ ID NO: 392030 - RNA, 21 nt, Homo sapiens
aggaagaugcugacauccagg

SEQ ID NO: 392031 - RNA, 23 nt, Homo sapiens
aggaagcccuaagacgucccuuu

SEQ ID NO: 392032 - RNA, 14 nt, Homo sapiens
aggaagccgugccc

SEQ ID NO: 392033 - RNA, 19 nt, Homo sapiens
aggaagcuccacugucacc

SEQ ID NO: 392034 - RNA, 22 nt, Homo sapiens
aggaagcuccacugucacccuc

SEQ ID NO: 392035 - RNA, 15 nt, Homo sapiens
aggaauuguuuuuau

SEQ ID NO: 392036 - RNA, 17 nt, Homo sapiens
aggaauuugcauuuagu

SEQ ID NO: 392037 - RNA, 23 nt, Homo sapiens
aggaauuuuuuuaacuuaaggga

SEQ ID NO: 392038 - RNA, 14 nt, Homo sapiens
aggacacagcagug

SEQ ID NO: 392039 - RNA, 15 nt, Homo sapiens
ugaggaugucacuca

SEQ ID NO: 392040 - RNA, 17 nt, Homo sapiens
ugaggcaaccacaggca

SEQ ID NO: 392041 - RNA, 19 nt, Homo sapiens
ugaggcagguggaucacug

SEQ ID NO: 392042 - RNA, 18 nt, Homo sapiens
ugaggccuggacuuuccu

SEQ ID NO: 392043 - RNA, 14 nt, Homo sapiens
ugaggcugcaauca

SEQ ID NO: 392044 - RNA, 16 nt, Homo sapiens
ugagggaaaaugagua

SEQ ID NO: 392045 - RNA, 18 nt, Homo sapiens
ugaggggcugacuucaau

SEQ ID NO: 392046 - RNA, 15 nt, Homo sapiens
ugaggguuaaugaaa

SEQ ID NO: 392047 - RNA, 13 nt, Homo sapiens
ugaguaucuccuc

SEQ ID NO: 392048 - RNA, 19 nt, Homo sapiens
ugagugccuguaaucacag

SEQ ID NO: 392049 - RNA, 15 nt, Homo sapiens
ugagugggugaauaa

SEQ ID NO: 392050 - RNA, 22 nt, Homo sapiens
ugagugguguguguuaucagau

SEQ ID NO: 392051 - RNA, 14 nt, Homo sapiens
ugagugugugcaag

SEQ ID NO: 392052 - RNA, 15 nt, Homo sapiens
ugagugugugcaagu

SEQ ID NO: 392053 - RNA, 12 nt, Homo sapiens
ugauaaguaaau

SEQ ID NO: 392054 - RNA, 16 nt, Homo sapiens
ugauaauaauugauca

SEQ ID NO: 392055 - RNA, 14 nt, Homo sapiens
ugauacauauguga

SEQ ID NO: 392056 - RNA, 21 nt, Homo sapiens
ugauauauaaaugugauugca

SEQ ID NO: 392057 - RNA, 15 nt, Homo sapiens
ugauauuuuccaaau

SEQ ID NO: 392058 - RNA, 16 nt, Homo sapiens
ugauccacuucucuca

SEQ ID NO: 392059 - RNA, 16 nt, Homo sapiens
ugauccguuccauugc

SEQ ID NO: 392060 - RNA, 18 nt, Homo sapiens
ugauccugcaauuccacu

SEQ ID NO: 392061 - RNA, 23 nt, Homo sapiens
ugauccugcaauuccacuuauag

SEQ ID NO: 392062 - RNA, 23 nt, Homo sapiens
ugaucggagccuccucucucaaa

SEQ ID NO: 392063 - RNA, 14 nt, Homo sapiens
ugaugguugcaaaa

SEQ ID NO: 392064 - RNA, 21 nt, Homo sapiens
ugauuagaaggcaaguuucua

SEQ ID NO: 392065 - RNA, 20 nt, Homo sapiens
ugauuaguaaagaaaugaca

SEQ ID NO: 392066 - RNA, 15 nt, Homo sapiens
ugauuauuaaagucc

SEQ ID NO: 392067 - RNA, 21 nt, Homo sapiens
ugauucacaaugaaaugcucu

SEQ ID NO: 392068 - RNA, 17 nt, Homo sapiens
ugauucauuuucugccu

SEQ ID NO: 392069 - RNA, 18 nt, Homo sapiens
ugauuccaccuacaugag

SEQ ID NO: 392070 - RNA, 18 nt, Homo sapiens
ugauuuugaaaucaugaa

SEQ ID NO: 392071 - RNA, 15 nt, Homo sapiens
ugauuuuuuuccaca

SEQ ID NO: 392072 - RNA, 16 nt, Homo sapiens
ugcaaaaggacucuca

SEQ ID NO: 392073 - RNA, 21 nt, Homo sapiens
ugcaaauccuugauacugcuc

SEQ ID NO: 392074 - RNA, 17 nt, Homo sapiens
ugcaaaugcuauauugc

SEQ ID NO: 392075 - RNA, 16 nt, Homo sapiens
ugcaacuuagcucaca

SEQ ID NO: 392076 - RNA, 19 nt, Homo sapiens
ugcaagcaagaaacacugg

SEQ ID NO: 392077 - RNA, 19 nt, Homo sapiens
ugcaagcacaucugcauuu

SEQ ID NO: 392078 - RNA, 23 nt, Homo sapiens
ugcaagcuucuuuuaguuguauc

SEQ ID NO: 392079 - RNA, 20 nt, Homo sapiens
ugcaagugucugugugcaag

SEQ ID NO: 392080 - RNA, 19 nt, Homo sapiens
ugcaagugugugcacaugu

SEQ ID NO: 392081 - RNA, 23 nt, Homo sapiens
ugcaagugugugcacaugugugc

SEQ ID NO: 392082 - RNA, 17 nt, Homo sapiens
ugcacaaagcccuucca

SEQ ID NO: 392083 - RNA, 12 nt, Homo sapiens
ugcacacaaaac

SEQ ID NO: 392084 - RNA, 15 nt, Homo sapiens
ugcacacguguggac

SEQ ID NO: 392085 - RNA, 14 nt, Homo sapiens
ugcacacuuugcca

SEQ ID NO: 392086 - RNA, 24 nt, Homo sapiens
ugcacaugugugcgugugcgugca

SEQ ID NO: 392087 - RNA, 16 nt, Homo sapiens
ugcacuccagccuggg

SEQ ID NO: 392088 - RNA, 20 nt, Homo sapiens
ugcacuccagccugggcaac

SEQ ID NO: 392089 - RNA, 15 nt, Homo sapiens
ugcacuuggccucug

SEQ ID NO: 392090 - RNA, 16 nt, Homo sapiens
ugcagagcugaagauu

SEQ ID NO: 392091 - RNA, 18 nt, Homo sapiens
ugcagccuccccaggugu

SEQ ID NO: 392092 - RNA, 20 nt, Homo sapiens
ugcagggacuguaaaaccac

SEQ ID NO: 392093 - RNA, 22 nt, Homo sapiens
ugcauaaaugcgauccacagaa

SEQ ID NO: 392094 - RNA, 20 nt, Homo sapiens
ugcauauccaacaugugcuc

SEQ ID NO: 392095 - RNA, 21 nt, Homo sapiens
ugcauauccaacaugugcuca

SEQ ID NO: 392096 - RNA, 15 nt, Homo sapiens
ugcaucagcugcuga

SEQ ID NO: 392097 - RNA, 19 nt, Homo sapiens
ugcauccagccuccugcua

SEQ ID NO: 392098 - RNA, 21 nt, Homo sapiens
ugcaucuguauaaguaagaaa

SEQ ID NO: 392099 - RNA, 17 nt, Homo sapiens
ugcauguaaacacgccu

SEQ ID NO: 392100 - RNA, 21 nt, Homo sapiens
ugcauguauuuauccaauaaa

SEQ ID NO: 392101 - RNA, 17 nt, Homo sapiens
ugcaugugugugcucag

SEQ ID NO: 392102 - RNA, 20 nt, Homo sapiens
ugcaugugugugcucagggg

SEQ ID NO: 392103 - RNA, 14 nt, Homo sapiens
ugcauuaucuauga

SEQ ID NO: 392104 - RNA, 17 nt, Homo sapiens
ugcauuaucuaugauau

SEQ ID NO: 392105 - RNA, 16 nt, Homo sapiens
ugcauugugaggguua

SEQ ID NO: 392106 - RNA, 21 nt, Homo sapiens
ugcauuugugcccacucucca

SEQ ID NO: 392107 - RNA, 15 nt, Homo sapiens
ugccaaauguuccau

SEQ ID NO: 392108 - RNA, 14 nt, Homo sapiens
ugccacugccucuu

SEQ ID NO: 392109 - RNA, 16 nt, Homo sapiens
ugccagcuuaucucag

SEQ ID NO: 392110 - RNA, 19 nt, Homo sapiens
ugccagcuuaucucagggg

SEQ ID NO: 392111 - RNA, 20 nt, Homo sapiens
ugccagcuuaucucaggggu

SEQ ID NO: 392112 - RNA, 22 nt, Homo sapiens
ugccaggcccucuccugccaca

SEQ ID NO: 392113 - RNA, 11 nt, Homo sapiens
ugccagugaaa

SEQ ID NO: 392114 - RNA, 23 nt, Homo sapiens
ugccaugccagcuuaucucaggg

SEQ ID NO: 392115 - RNA, 23 nt, Homo sapiens
ugccauggaggcacacagcugca

SEQ ID NO: 392116 - RNA, 19 nt, Homo sapiens
ugcccagugaccagucacu

SEQ ID NO: 392117 - RNA, 22 nt, Homo sapiens
ugcccaucccuggaaggugcug

SEQ ID NO: 392118 - RNA, 17 nt, Homo sapiens
ugccccccuugccagac

SEQ ID NO: 392119 - RNA, 22 nt, Homo sapiens
ugccccucccagaacacacucc

SEQ ID NO: 392120 - RNA, 17 nt, Homo sapiens
ugccccugcacuccagc

SEQ ID NO: 392121 - RNA, 18 nt, Homo sapiens
ugcccggcaggguccuag

SEQ ID NO: 392122 - RNA, 23 nt, Homo sapiens
ugcccguaaacacgccugcaaac

SEQ ID NO: 392123 - RNA, 17 nt, Homo sapiens
ugcccuggauccaucag

SEQ ID NO: 392124 - RNA, 12 nt, Homo sapiens
ugccgcauuugg

SEQ ID NO: 392125 - RNA, 18 nt, Homo sapiens
ugccuaucuucuuucaca

SEQ ID NO: 392126 - RNA, 16 nt, Homo sapiens
ugccugaaccuuccau

SEQ ID NO: 392127 - RNA, 21 nt, Homo sapiens
ugccugccgguaaacacgccu

SEQ ID NO: 392128 - RNA, 20 nt, Homo sapiens
ugccugugguuaacaucuca

SEQ ID NO: 392129 - RNA, 17 nt, Homo sapiens
ugccuuuuuaaugaaca

SEQ ID NO: 392130 - RNA, 16 nt, Homo sapiens
ugcgagugugugcaug

SEQ ID NO: 392131 - RNA, 13 nt, Homo sapiens
ugcgucacuguga

SEQ ID NO: 392132 - RNA, 13 nt, Homo sapiens
ugcgugugugcaa

SEQ ID NO: 392133 - RNA, 18 nt, Homo sapiens
ugcuaauucaaagcucua

SEQ ID NO: 392134 - RNA, 17 nt, Homo sapiens
ugcuacaaaaacacagc

SEQ ID NO: 392135 - RNA, 18 nt, Homo sapiens
ugcuacaaaaacacagca

SEQ ID NO: 392136 - RNA, 17 nt, Homo sapiens
ugcuaccucacuggggu

SEQ ID NO: 392137 - RNA, 20 nt, Homo sapiens
ugcuauaacuaugaccaugc

SEQ ID NO: 392138 - RNA, 17 nt, Homo sapiens
ugcuauaacuauguuga

SEQ ID NO: 392139 - RNA, 14 nt, Homo sapiens
ugcuauaucaguuu

SEQ ID NO: 392140 - RNA, 12 nt, Homo sapiens
ugcuccuuccaa

SEQ ID NO: 392141 - RNA, 15 nt, Homo sapiens
ugcugcuguaccaca

SEQ ID NO: 392142 - RNA, 14 nt, Homo sapiens
ugcuggcagaaagc

SEQ ID NO: 392143 - RNA, 13 nt, Homo sapiens
ugcuggcauuugc

SEQ ID NO: 392144 - RNA, 22 nt, Homo sapiens
ugcuggcauuugcaccuaccuc

SEQ ID NO: 392145 - RNA, 23 nt, Homo sapiens
ugcugggaagacgccugagcuca

SEQ ID NO: 392146 - RNA, 16 nt, Homo sapiens
ugcuggucacugccau

SEQ ID NO: 392147 - RNA, 17 nt, Homo sapiens
ugcuguuauccaugggg

SEQ ID NO: 392148 - RNA, 14 nt, Homo sapiens
ugcuuaaaauagca

SEQ ID NO: 392149 - RNA, 18 nt, Homo sapiens
ugcuuaaugguagcaacu

SEQ ID NO: 392150 - RNA, 23 nt, Homo sapiens
ugcuucccggcgucccuaccucc

SEQ ID NO: 392151 - RNA, 18 nt, Homo sapiens
ugcuugggcuauaccugg

SEQ ID NO: 392152 - RNA, 14 nt, Homo sapiens
ugcuuggguguaac

SEQ ID NO: 392153 - RNA, 14 nt, Homo sapiens
ugcuuguuauuaga

SEQ ID NO: 392154 - RNA, 17 nt, Homo sapiens
ugcuuuaaaaaaauaca

SEQ ID NO: 392155 - RNA, 17 nt, Homo sapiens
ugcuuuguaugcacuuu

SEQ ID NO: 392156 - RNA, 13 nt, Homo sapiens
uggaaaaagccug

SEQ ID NO: 392157 - RNA, 19 nt, Homo sapiens
uggaaaagcaaaacuguag

SEQ ID NO: 392158 - RNA, 22 nt, Homo sapiens
uggaaaagcaaaacuguagggg

SEQ ID NO: 392159 - RNA, 14 nt, Homo sapiens
uggaaagcugcuuc

SEQ ID NO: 392160 - RNA, 18 nt, Homo sapiens
uggaagggaaaagcccau

SEQ ID NO: 392161 - RNA, 20 nt, Homo sapiens
uggaauaaagucacagaauu

SEQ ID NO: 392162 - RNA, 16 nt, Homo sapiens
uggaaugcuguguuaa

SEQ ID NO: 392163 - RNA, 13 nt, Homo sapiens
uggaauguaauca

SEQ ID NO: 392164 - RNA, 16 nt, Homo sapiens
uggaauguacucuguu

SEQ ID NO: 392165 - RNA, 19 nt, Homo sapiens
uggaauuaugucugcugaa

SEQ ID NO: 392166 - RNA, 19 nt, Homo sapiens
uggacaaaccgagugcaau

SEQ ID NO: 392167 - RNA, 20 nt, Homo sapiens
uggacaaaccgagugcaaug

SEQ ID NO: 392168 - RNA, 22 nt, Homo sapiens
uggacaaucaugaaauaugcau

SEQ ID NO: 392169 - RNA, 19 nt, Homo sapiens
uggacucaguuuucuugca

SEQ ID NO: 392170 - RNA, 20 nt, Homo sapiens
uggacuuuugaaaagcuuuu

SEQ ID NO: 392171 - RNA, 22 nt, Homo sapiens
uggagaaacuguagucucagga

SEQ ID NO: 392172 - RNA, 22 nt, Homo sapiens
uggagaaauuccuugauucaca

SEQ ID NO: 392173 - RNA, 21 nt, Homo sapiens
uggagcugcguuuccugugca

SEQ ID NO: 392174 - RNA, 18 nt, Homo sapiens
uggaggaaagugauaucc

SEQ ID NO: 392175 - RNA, 18 nt, Homo sapiens
uggaggccgggugcucag

SEQ ID NO: 392176 - RNA, 16 nt, Homo sapiens
uggaucaucuauugcu

SEQ ID NO: 392177 - RNA, 18 nt, Homo sapiens
uggaucuccauucucuca

SEQ ID NO: 392178 - RNA, 14 nt, Homo sapiens
uggauguagucagu

SEQ ID NO: 392179 - RNA, 15 nt, Homo sapiens
uggauuaugaaguga

SEQ ID NO: 392180 - RNA, 22 nt, Homo sapiens
uguuacugguagaaaggcaguu

SEQ ID NO: 392181 - RNA, 17 nt, Homo sapiens
uguuagugguuacccag

SEQ ID NO: 392182 - RNA, 20 nt, Homo sapiens
uguuaucuguguagcaagcu

SEQ ID NO: 392183 - RNA, 18 nt, Homo sapiens
uguuaucuuccacuggaa

SEQ ID NO: 392184 - RNA, 20 nt, Homo sapiens
uguuauuauaaaaguacuag

SEQ ID NO: 392185 - RNA, 12 nt, Homo sapiens
uguucaaaaagg

SEQ ID NO: 392186 - RNA, 20 nt, Homo sapiens
uguucacagccagacuggca

SEQ ID NO: 392187 - RNA, 13 nt, Homo sapiens
uguucagaugcuu

SEQ ID NO: 392188 - RNA, 17 nt, Homo sapiens
uguugacauccaagcuu

SEQ ID NO: 392189 - RNA, 11 nt, Homo sapiens
uguugccaaau

SEQ ID NO: 392190 - RNA, 20 nt, Homo sapiens
uguugcucucuaguuuccag

SEQ ID NO: 392191 - RNA, 13 nt, Homo sapiens
uguuggacaccca

SEQ ID NO: 392192 - RNA, 12 nt, Homo sapiens
uguuguguuucu

SEQ ID NO: 392193 - RNA, 21 nt, Homo sapiens
uguuuacuucucaccauuuga

SEQ ID NO: 392194 - RNA, 20 nt, Homo sapiens
uguuucaauugcaucuccca

SEQ ID NO: 392195 - RNA, 18 nt, Homo sapiens
uguuucugaucugaugca

SEQ ID NO: 392196 - RNA, 18 nt, Homo sapiens
uguuucuuuuguauguaa

SEQ ID NO: 392197 - RNA, 20 nt, Homo sapiens
uguuuucgcaccuaccauca

SEQ ID NO: 392198 - RNA, 21 nt, Homo sapiens
uuaaaaaaaaaccugagcccc

SEQ ID NO: 392199 - RNA, 22 nt, Homo sapiens
uuaaaaaaucucaaauuuggau

SEQ ID NO: 392200 - RNA, 22 nt, Homo sapiens
uuaaaagacaagacuucaguau

SEQ ID NO: 392201 - RNA, 19 nt, Homo sapiens
uuaaaaguugugauuccag

SEQ ID NO: 392202 - RNA, 13 nt, Homo sapiens
uuaaaaucuguca

SEQ ID NO: 392203 - RNA, 18 nt, Homo sapiens
uuaaaccucucuucuacc

SEQ ID NO: 392204 - RNA, 19 nt, Homo sapiens
uuaaagcugaaaacugcaa

SEQ ID NO: 392205 - RNA, 16 nt, Homo sapiens
uuaaagguagucaaga

SEQ ID NO: 392206 - RNA, 15 nt, Homo sapiens
uuaaaucuugcaacu

SEQ ID NO: 392207 - RNA, 15 nt, Homo sapiens
uuaaauugcugugua

SEQ ID NO: 392208 - RNA, 18 nt, Homo sapiens
uuaaauuuuauaugggcu

SEQ ID NO: 392209 - RNA, 20 nt, Homo sapiens
uuaacugacuuaaguggcau

SEQ ID NO: 392210 - RNA, 22 nt, Homo sapiens
uuaacuggcuucagccucccca

SEQ ID NO: 392211 - RNA, 18 nt, Homo sapiens
uuaacuuccaauuuacau

SEQ ID NO: 392212 - RNA, 14 nt, Homo sapiens
uuaagacuacugaa

SEQ ID NO: 392213 - RNA, 14 nt, Homo sapiens
uuaagcacuacaua

SEQ ID NO: 392214 - RNA, 13 nt, Homo sapiens
uuaagguacuuaa

SEQ ID NO: 392215 - RNA, 12 nt, Homo sapiens
uuaagugccuuu

SEQ ID NO: 392216 - RNA, 17 nt, Homo sapiens
uuaauaccacagcuuuu

SEQ ID NO: 392217 - RNA, 14 nt, Homo sapiens
uuaauauaucccag

SEQ ID NO: 392218 - RNA, 14 nt, Homo sapiens
uuaauauuccucag

SEQ ID NO: 392219 - RNA, 18 nt, Homo sapiens
uuaaugaagaaaguggaa

SEQ ID NO: 392220 - RNA, 21 nt, Homo sapiens
uuaaugguagcaacugaaaga

SEQ ID NO: 392221 - RNA, 21 nt, Homo sapiens
uuaauguauuuguuugcaauu

SEQ ID NO: 392222 - RNA, 17 nt, Homo sapiens
uuaaugucuggugcuuu

SEQ ID NO: 392223 - RNA, 20 nt, Homo sapiens
uuacaaucagccacauucua

SEQ ID NO: 392224 - RNA, 14 nt, Homo sapiens
uuacagagacagaa

SEQ ID NO: 392225 - RNA, 11 nt, Homo sapiens
uuacagcugcc

SEQ ID NO: 392226 - RNA, 24 nt, Homo sapiens
uuacagcugccugcaguacuuuac

SEQ ID NO: 392227 - RNA, 21 nt, Homo sapiens
uuaccagacgguucaccagcc

SEQ ID NO: 392228 - RNA, 15 nt, Homo sapiens
uuaccucacagugau

SEQ ID NO: 392229 - RNA, 12 nt, Homo sapiens
uuaccucugaua

SEQ ID NO: 392230 - RNA, 16 nt, Homo sapiens
uuaccuugugcuaauc

SEQ ID NO: 392231 - RNA, 16 nt, Homo sapiens
uuaccuuuguucccaa

SEQ ID NO: 392232 - RNA, 15 nt, Homo sapiens
uuacgagcagggaug

SEQ ID NO: 392233 - RNA, 20 nt, Homo sapiens
uuacgauggcacccagugag

SEQ ID NO: 392234 - RNA, 15 nt, Homo sapiens
uuacuaucaugucaa

SEQ ID NO: 392235 - RNA, 17 nt, Homo sapiens
uuacuaucaugucaaac

SEQ ID NO: 392236 - RNA, 12 nt, Homo sapiens
uuagaacuauua

SEQ ID NO: 392237 - RNA, 17 nt, Homo sapiens
uuagagucuucuccaau

SEQ ID NO: 392238 - RNA, 17 nt, Homo sapiens
uuagagugucuuuccac

SEQ ID NO: 392239 - RNA, 23 nt, Homo sapiens
uuagauguucuaagucuuuccau

SEQ ID NO: 392240 - RNA, 16 nt, Homo sapiens
uuagauuauauauucc

SEQ ID NO: 392241 - RNA, 13 nt, Homo sapiens
uuagccaaaggau

SEQ ID NO: 392242 - RNA, 13 nt, Homo sapiens
uuagguagcuuua

SEQ ID NO: 392243 - RNA, 15 nt, Homo sapiens
uuagucgagccaagu

SEQ ID NO: 392244 - RNA, 15 nt, Homo sapiens
uuagugauggagcuu

SEQ ID NO: 392245 - RNA, 15 nt, Homo sapiens
uuauaaaagaugcau

SEQ ID NO: 392246 - RNA, 16 nt, Homo sapiens
uuauaaaauuaagcaa

SEQ ID NO: 392247 - RNA, 23 nt, Homo sapiens
uuauaaagggagauaacaaucug

SEQ ID NO: 392248 - RNA, 14 nt, Homo sapiens
uuauaagcauguau

SEQ ID NO: 392249 - RNA, 14 nt, Homo sapiens
uuauaauauacuau

SEQ ID NO: 392250 - RNA, 20 nt, Homo sapiens
uuauaucaucagcauaccuu

SEQ ID NO: 392251 - RNA, 13 nt, Homo sapiens
uuauauucaucca

SEQ ID NO: 392252 - RNA, 14 nt, Homo sapiens
uuaucaccagagag

SEQ ID NO: 392253 - RNA, 22 nt, Homo sapiens
uuaucaccgugggcucccugac

SEQ ID NO: 392254 - RNA, 16 nt, Homo sapiens
uuaucucaaaacugca

SEQ ID NO: 392255 - RNA, 13 nt, Homo sapiens
uuaucucaggggu

SEQ ID NO: 392256 - RNA, 20 nt, Homo sapiens
uuaucuugcaccccaaagcu

SEQ ID NO: 392257 - RNA, 20 nt, Homo sapiens
uuauguauguauguauuuau

SEQ ID NO: 392258 - RNA, 22 nt, Homo sapiens
uuauguaugugaaaguuacaaa

SEQ ID NO: 392259 - RNA, 22 nt, Homo sapiens
uuaugucaucauacaugacuca

SEQ ID NO: 392260 - RNA, 14 nt, Homo sapiens
uuaugucugcugaa

SEQ ID NO: 392261 - RNA, 12 nt, Homo sapiens
uuauuaccucug

SEQ ID NO: 392262 - RNA, 21 nt, Homo sapiens
uuauuaccucugauaccucaa

SEQ ID NO: 392263 - RNA, 16 nt, Homo sapiens
uuauucugauuccacu

SEQ ID NO: 392264 - RNA, 16 nt, Homo sapiens
uuauugacucauacac

SEQ ID NO: 392265 - RNA, 12 nt, Homo sapiens
uuauugcauaau

SEQ ID NO: 392266 - RNA, 14 nt, Homo sapiens
uuauuguaccucuc

SEQ ID NO: 392267 - RNA, 23 nt, Homo sapiens
uuauuuaccugaaauaaaauuca

SEQ ID NO: 392268 - RNA, 17 nt, Homo sapiens
uuauuuuuguucauaua

SEQ ID NO: 392269 - RNA, 21 nt, Homo sapiens
uucaaaagcacuuugugcugu

SEQ ID NO: 392270 - RNA, 12 nt, Homo sapiens
uucaaacagaac

SEQ ID NO: 392271 - RNA, 11 nt, Homo sapiens
uucaacuggag

SEQ ID NO: 392272 - RNA, 12 nt, Homo sapiens
uucaaugugacu

SEQ ID NO: 392273 - RNA, 17 nt, Homo sapiens
uucaauugcaucuccca

SEQ ID NO: 392274 - RNA, 16 nt, Homo sapiens
uucacaagacccaaaa

SEQ ID NO: 392275 - RNA, 15 nt, Homo sapiens
uucacaaugaaaugc

SEQ ID NO: 392276 - RNA, 17 nt, Homo sapiens
uucacacuuccaccagc

SEQ ID NO: 392277 - RNA, 13 nt, Homo sapiens
uucacagccagac

SEQ ID NO: 392278 - RNA, 20 nt, Homo sapiens
uucacgccuguaaucccagc

SEQ ID NO: 392279 - RNA, 14 nt, Homo sapiens
uucagccccuccuc

SEQ ID NO: 392280 - RNA, 21 nt, Homo sapiens
uucagccuagccgaccucagc

SEQ ID NO: 392281 - RNA, 18 nt, Homo sapiens
uucagcucacacaugaga

SEQ ID NO: 392282 - RNA, 15 nt, Homo sapiens
uucagcugguugagg

SEQ ID NO: 392283 - RNA, 16 nt, Homo sapiens
uucagugcuucgcaga

SEQ ID NO: 392284 - RNA, 19 nt, Homo sapiens
uucaguugaucacuggcaa

SEQ ID NO: 392285 - RNA, 21 nt, Homo sapiens
uucaguuggcugacuuccaca

SEQ ID NO: 392286 - RNA, 16 nt, Homo sapiens
uucauaaguauuucaa

SEQ ID NO: 392287 - RNA, 19 nt, Homo sapiens
uucauaauuucuucacuca

SEQ ID NO: 392288 - RNA, 18 nt, Homo sapiens
uucauaugcuguauaucc

SEQ ID NO: 392289 - RNA, 22 nt, Homo sapiens
uucaucaugucaguuccaauga

SEQ ID NO: 392290 - RNA, 23 nt, Homo sapiens
uucauuaagcccucuuccaucau

SEQ ID NO: 392291 - RNA, 21 nt, Homo sapiens
uuccaaaauaauuuuaagaaa

SEQ ID NO: 392292 - RNA, 17 nt, Homo sapiens
uuccacaaguuaaauaa

SEQ ID NO: 392293 - RNA, 20 nt, Homo sapiens
uuccacaccuagcaucucau

SEQ ID NO: 392294 - RNA, 19 nt, Homo sapiens
uuccaccagccugcacuac

SEQ ID NO: 392295 - RNA, 14 nt, Homo sapiens
uuccaccuucccuc

SEQ ID NO: 392296 - RNA, 20 nt, Homo sapiens
uuccacuggaaaaguguaau

SEQ ID NO: 392297 - RNA, 23 nt, Homo sapiens
uuccacuuagaaauugcauuucc

SEQ ID NO: 392298 - RNA, 16 nt, Homo sapiens
uuccaggcgaugugca

SEQ ID NO: 392299 - RNA, 21 nt, Homo sapiens
uuccaggcgaugugcaagugu

SEQ ID NO: 392300 - RNA, 19 nt, Homo sapiens
uuccauaaucuggacuccu

SEQ ID NO: 392301 - RNA, 23 nt, Homo sapiens
uuccaugucgccucugcauucag

SEQ ID NO: 392302 - RNA, 20 nt, Homo sapiens
uuccauuugugugugugcaa

SEQ ID NO: 392303 - RNA, 20 nt, Homo sapiens
uucccaaauaaacucuaaac

SEQ ID NO: 392304 - RNA, 17 nt, Homo sapiens
uucccauucuacauacu

SEQ ID NO: 392305 - RNA, 16 nt, Homo sapiens
uuccccuuccacugag

SEQ ID NO: 392306 - RNA, 19 nt, Homo sapiens
uucccucacagcaaagcaa

SEQ ID NO: 392307 - RNA, 20 nt, Homo sapiens
uucccugaaaacccagagag

SEQ ID NO: 392308 - RNA, 13 nt, Homo sapiens
uucccugagucac

SEQ ID NO: 392309 - RNA, 22 nt, Homo sapiens
uuccucuaugaaaauuauaucu

SEQ ID NO: 392310 - RNA, 21 nt, Homo sapiens
uuccugcaacucaaggacuuu

SEQ ID NO: 392311 - RNA, 18 nt, Homo sapiens
uuccugcauucacccaga

SEQ ID NO: 392312 - RNA, 19 nt, Homo sapiens
uuccugccaccugcugcug

SEQ ID NO: 392313 - RNA, 22 nt, Homo sapiens
uuccuguggggggaaguccaug

SEQ ID NO: 392314 - RNA, 18 nt, Homo sapiens
uuccuucagacagauucc

SEQ ID NO: 392315 - RNA, 19 nt, Homo sapiens
uuccuucagacagauucca

SEQ ID NO: 392316 - RNA, 16 nt, Homo sapiens
uuccuugaccagcaga

SEQ ID NO: 392317 - RNA, 16 nt, Homo sapiens
uuccuugauucacaau

SEQ ID NO: 392318 - RNA, 16 nt, Homo sapiens
uucggacaacucaguc

SEQ ID NO: 392319 - RNA, 17 nt, Homo sapiens
uucuaaaugaagugcaa

SEQ ID NO: 392320 - RNA, 21 nt, Homo sapiens
uucuaaguggaaaaaguauua

SEQ ID NO: 392321 - RNA, 17 nt, Homo sapiens
uucuaauuuuuaagcaa

SEQ ID NO: 392322 - RNA, 21 nt, Homo sapiens
aguucaaaaaacucuugauau

SEQ ID NO: 392323 - RNA, 16 nt, Homo sapiens
aguucauauguaccau

SEQ ID NO: 392324 - RNA, 17 nt, Homo sapiens
aguucauauguaccaug

SEQ ID NO: 392325 - RNA, 18 nt, Homo sapiens
aguucauauguaccaugu

SEQ ID NO: 392326 - RNA, 21 nt, Homo sapiens
aguuccucauuagcauuuugc

SEQ ID NO: 392327 - RNA, 14 nt, Homo sapiens
aguucuccauuuca

SEQ ID NO: 392328 - RNA, 19 nt, Homo sapiens
aguucuggcugaacacugg

SEQ ID NO: 392329 - RNA, 23 nt, Homo sapiens
aguucuuuucaaccuacuuucau

SEQ ID NO: 392330 - RNA, 17 nt, Homo sapiens
aguugauggugaugaaa

SEQ ID NO: 392331 - RNA, 17 nt, Homo sapiens
aguugcugaugaacucu

SEQ ID NO: 392332 - RNA, 13 nt, Homo sapiens
aguuguauguggc

SEQ ID NO: 392333 - RNA, 20 nt, Homo sapiens
aguuuauaaaugugaacuua

SEQ ID NO: 392334 - RNA, 22 nt, Homo sapiens
aguuucacaugagcuauuucca

SEQ ID NO: 392335 - RNA, 14 nt, Homo sapiens
aguuucacugacuu

SEQ ID NO: 392336 - RNA, 13 nt, Homo sapiens
aguuugauuucau

SEQ ID NO: 392337 - RNA, 17 nt, Homo sapiens
aguuugcuuuguaugca

SEQ ID NO: 392338 - RNA, 19 nt, Homo sapiens
aguuugcuuuguaugcacu

SEQ ID NO: 392339 - RNA, 20 nt, Homo sapiens
auaaaaguacuagcuuacuu

SEQ ID NO: 392340 - RNA, 15 nt, Homo sapiens
auaaacaugucugcc

SEQ ID NO: 392341 - RNA, 14 nt, Homo sapiens
auaaagaugaucua

SEQ ID NO: 392342 - RNA, 13 nt, Homo sapiens
auaaagauguuau

SEQ ID NO: 392343 - RNA, 14 nt, Homo sapiens
auaaaugugaacuu

SEQ ID NO: 392344 - RNA, 21 nt, Homo sapiens
auaaauuauaucaauuuccuc

SEQ ID NO: 392345 - RNA, 20 nt, Homo sapiens
auaacagaaagccuggguga

SEQ ID NO: 392346 - RNA, 16 nt, Homo sapiens
auaacaguuacuccag

SEQ ID NO: 392347 - RNA, 21 nt, Homo sapiens
auaacuuaaaaaaaugacaga

SEQ ID NO: 392348 - RNA, 17 nt, Homo sapiens
auaacuuagguggcaag

SEQ ID NO: 392349 - RNA, 20 nt, Homo sapiens
auaacuuuguuuagcccaaa

SEQ ID NO: 392350 - RNA, 17 nt, Homo sapiens
uugaaaagacuccaaag

SEQ ID NO: 392351 - RNA, 13 nt, Homo sapiens
uugaaaucuauga

SEQ ID NO: 392352 - RNA, 21 nt, Homo sapiens
uugaacucuuugaaugacaaa

SEQ ID NO: 392353 - RNA, 22 nt, Homo sapiens
uugaagcucuggugacaccagc

SEQ ID NO: 392354 - RNA, 18 nt, Homo sapiens
uugaagucagauguggua

SEQ ID NO: 392355 - RNA, 15 nt, Homo sapiens
uugaauggguuugcu

SEQ ID NO: 392356 - RNA, 23 nt, Homo sapiens
uugacaaacucucccuucacucc

SEQ ID NO: 392357 - RNA, 14 nt, Homo sapiens
uugacauaacacua

SEQ ID NO: 392358 - RNA, 16 nt, Homo sapiens
uugacauaauuucacu

SEQ ID NO: 392359 - RNA, 11 nt, Homo sapiens
uugaccagcag

SEQ ID NO: 392360 - RNA, 15 nt, Homo sapiens
uugacucuccagaaa

SEQ ID NO: 392361 - RNA, 22 nt, Homo sapiens
uugacuggguuucucuguauag

SEQ ID NO: 392362 - RNA, 16 nt, Homo sapiens
uugagacuuccaaagg

SEQ ID NO: 392363 - RNA, 12 nt, Homo sapiens
uugaggcuuuca

SEQ ID NO: 392364 - RNA, 18 nt, Homo sapiens
uugagguaggagaauugc

SEQ ID NO: 392365 - RNA, 22 nt, Homo sapiens
uugauauacuauuuucauucuc

SEQ ID NO: 392366 - RNA, 17 nt, Homo sapiens
uugauauuuuccaaaug

SEQ ID NO: 392367 - RNA, 14 nt, Homo sapiens
uugaugcaugcacu

SEQ ID NO: 392368 - RNA, 16 nt, Homo sapiens
uugcaaccccaucauc

SEQ ID NO: 392369 - RNA, 15 nt, Homo sapiens
uugcaacuuagcuca

SEQ ID NO: 392370 - RNA, 19 nt, Homo sapiens
uugcacauaacaugcuuua

SEQ ID NO: 392371 - RNA, 16 nt, Homo sapiens
uugcacgcccaugugu

SEQ ID NO: 392372 - RNA, 20 nt, Homo sapiens
uugcagcuuauauucaucca

SEQ ID NO: 392373 - RNA, 22 nt, Homo sapiens
uugcagggaagccccacuugaa

SEQ ID NO: 392374 - RNA, 15 nt, Homo sapiens
uugcagugagccaag

SEQ ID NO: 392375 - RNA, 22 nt, Homo sapiens
uugccaaacagccacacugugg

SEQ ID NO: 392376 - RNA, 16 nt, Homo sapiens
uugccacuacccccuc

SEQ ID NO: 392377 - RNA, 18 nt, Homo sapiens
uugccagaugcaauacaa

SEQ ID NO: 392378 - RNA, 17 nt, Homo sapiens
uugcccagagaugccuc

SEQ ID NO: 392379 - RNA, 21 nt, Homo sapiens
uugcccaggcuggagugcagu

SEQ ID NO: 392380 - RNA, 20 nt, Homo sapiens
uugcgccauugcacuccagc

SEQ ID NO: 392381 - RNA, 23 nt, Homo sapiens
uugcuggggcucgugcccugcau

SEQ ID NO: 392382 - RNA, 13 nt, Homo sapiens
uugcugugagcaa

SEQ ID NO: 392383 - RNA, 14 nt, Homo sapiens
uugcuguguaucug

SEQ ID NO: 392384 - RNA, 21 nt, Homo sapiens
uuggaacuuuuauuacugggg

SEQ ID NO: 392385 - RNA, 23 nt, Homo sapiens
uuggaagagccugcaggugcugc

SEQ ID NO: 392386 - RNA, 14 nt, Homo sapiens
uuggaauacuaaaa

SEQ ID NO: 392387 - RNA, 20 nt, Homo sapiens
uuggaauuaugucugcugaa

SEQ ID NO: 392388 - RNA, 20 nt, Homo sapiens
uuggacacccagugccaggg

SEQ ID NO: 392389 - RNA, 19 nt, Homo sapiens
uuggaccuguucaaaaagg

SEQ ID NO: 392390 - RNA, 21 nt, Homo sapiens
uuggauaaaauaaaugcaauu

SEQ ID NO: 392391 - RNA, 20 nt, Homo sapiens
uuggcaacagaagcaguuga

SEQ ID NO: 392392 - RNA, 15 nt, Homo sapiens
uuggcuacacacaaa

SEQ ID NO: 392393 - RNA, 13 nt, Homo sapiens
uuggcuucagggg

SEQ ID NO: 392394 - RNA, 13 nt, Homo sapiens
uugggaagaccag

SEQ ID NO: 392395 - RNA, 22 nt, Homo sapiens
uugggaggcugaggcaagagaa

SEQ ID NO: 392396 - RNA, 15 nt, Homo sapiens
uugggcccuuugagu

SEQ ID NO: 392397 - RNA, 20 nt, Homo sapiens
uuguaagaguggaaccaaca

SEQ ID NO: 392398 - RNA, 18 nt, Homo sapiens
uuguaagguggucacugu

SEQ ID NO: 392399 - RNA, 16 nt, Homo sapiens
uuguaauaaugcuaaa

SEQ ID NO: 392400 - RNA, 19 nt, Homo sapiens
uuguagagauggggucuca

SEQ ID NO: 392401 - RNA, 21 nt, Homo sapiens
uuguagagauggggucucaca

SEQ ID NO: 392402 - RNA, 19 nt, Homo sapiens
uuguauauugucagauauu

SEQ ID NO: 392403 - RNA, 15 nt, Homo sapiens
uugugagccaccacg

SEQ ID NO: 392404 - RNA, 17 nt, Homo sapiens
uugugagggacugagau

SEQ ID NO: 392405 - RNA, 14 nt, Homo sapiens
uugugguuaaucug

SEQ ID NO: 392406 - RNA, 16 nt, Homo sapiens
uugugugugugcaagu

SEQ ID NO: 392407 - RNA, 20 nt, Homo sapiens
uuguguuuuguuuuguauca

SEQ ID NO: 392408 - RNA, 19 nt, Homo sapiens
uuguuaucuuccacuggaa

SEQ ID NO: 392409 - RNA, 23 nt, Homo sapiens
uuguucaucagacuccugugcaa

SEQ ID NO: 392410 - RNA, 19 nt, Homo sapiens
uuguuucaaccaagucaug

SEQ ID NO: 392411 - RNA, 19 nt, Homo sapiens
uuguuuugacggaugauug

SEQ ID NO: 392412 - RNA, 13 nt, Homo sapiens
uuuaaaaaaugga

SEQ ID NO: 392413 - RNA, 21 nt, Homo sapiens
uuuaaaaucauuucugcauca

SEQ ID NO: 392414 - RNA, 17 nt, Homo sapiens
uuuaaauguuacuggua

SEQ ID NO: 392415 - RNA, 18 nt, Homo sapiens
uuuaacuauucauaagau

SEQ ID NO: 392416 - RNA, 17 nt, Homo sapiens
uuuaagaguuacuuaau

SEQ ID NO: 392417 - RNA, 13 nt, Homo sapiens
uuuaagcaucaaa

SEQ ID NO: 392418 - RNA, 16 nt, Homo sapiens
uuuaauauacuuuaaa

SEQ ID NO: 392419 - RNA, 20 nt, Homo sapiens
uuuaaucuguauuuccccaa

SEQ ID NO: 392420 - RNA, 16 nt, Homo sapiens
uuuaauugauuauucu

SEQ ID NO: 392421 - RNA, 12 nt, Homo sapiens
uuuacaaaguau

SEQ ID NO: 392422 - RNA, 14 nt, Homo sapiens
uuuacauucugcaa

SEQ ID NO: 392423 - RNA, 18 nt, Homo sapiens
uuuagauuaaacaaacaa

SEQ ID NO: 392424 - RNA, 20 nt, Homo sapiens
uuuagcaauuuauacaauau

SEQ ID NO: 392425 - RNA, 13 nt, Homo sapiens
uuuaggaugcuuu

SEQ ID NO: 392426 - RNA, 23 nt, Homo sapiens
uuuauaaaagaauaaaauugcac

SEQ ID NO: 392427 - RNA, 23 nt, Homo sapiens
uuuauagagcagaacccuagucu

SEQ ID NO: 392428 - RNA, 14 nt, Homo sapiens
uuuaugauuccacc

SEQ ID NO: 392429 - RNA, 15 nt, Homo sapiens
uuuaugcuaagugaa

SEQ ID NO: 392430 - RNA, 21 nt, Homo sapiens
uuuaugucaucauacaugacu

SEQ ID NO: 392431 - RNA, 18 nt, Homo sapiens
uuuaugugcucuccaaau

SEQ ID NO: 392432 - RNA, 14 nt, Homo sapiens
uuuauugugaucua

SEQ ID NO: 392433 - RNA, 19 nt, Homo sapiens
uuuauuuuauagagcagaa

SEQ ID NO: 392434 - RNA, 19 nt, Homo sapiens
uuucaaguguaacuuauua

SEQ ID NO: 392435 - RNA, 18 nt, Homo sapiens
uuucacacuuccaccagc

SEQ ID NO: 392436 - RNA, 14 nt, Homo sapiens
uuucaccuucauau

SEQ ID NO: 392437 - RNA, 20 nt, Homo sapiens
uuucagaagcucuucuaaaa

SEQ ID NO: 392438 - RNA, 21 nt, Homo sapiens
uuucagaucauauuucacaau

SEQ ID NO: 392439 - RNA, 19 nt, Homo sapiens
uuucagguuccaaucagaa

SEQ ID NO: 392440 - RNA, 18 nt, Homo sapiens
uuucauaaacuucaggga

SEQ ID NO: 392441 - RNA, 17 nt, Homo sapiens
uuucaucauaacauaaa

SEQ ID NO: 392442 - RNA, 14 nt, Homo sapiens
uuucaugugugauu

SEQ ID NO: 392443 - RNA, 22 nt, Homo sapiens
uuuccacaagauucccagagac

SEQ ID NO: 392444 - RNA, 14 nt, Homo sapiens
uuuccugugcaugg

SEQ ID NO: 392445 - RNA, 21 nt, Homo sapiens
uuucuaguuucuugugggcua

SEQ ID NO: 392446 - RNA, 14 nt, Homo sapiens
uuucugagaaagac

SEQ ID NO: 392447 - RNA, 13 nt, Homo sapiens
uuucugccuaucu

SEQ ID NO: 392448 - RNA, 19 nt, Homo sapiens
uuucugcuaaaaaguccuu

SEQ ID NO: 392449 - RNA, 22 nt, Homo sapiens
uuucuuauagucaauguuucuu

SEQ ID NO: 392450 - RNA, 22 nt, Homo sapiens
uuucuuuaauaguuuugauccu

SEQ ID NO: 392451 - RNA, 18 nt, Homo sapiens
uuugaaauuaaccucuca

SEQ ID NO: 392452 - RNA, 19 nt, Homo sapiens
uuugaauacaggcauagag

SEQ ID NO: 392453 - RNA, 23 nt, Homo sapiens
uuugaauuucaguaaacaaugaa

SEQ ID NO: 392454 - RNA, 20 nt, Homo sapiens
uuugauacucccagucuugu

SEQ ID NO: 392455 - RNA, 21 nt, Homo sapiens
uuugauauacuauuuucauuc

SEQ ID NO: 392456 - RNA, 20 nt, Homo sapiens
uuugaugauuaauucaccuu

SEQ ID NO: 392457 - RNA, 17 nt, Homo sapiens
uuugauuaaagacucca

SEQ ID NO: 392458 - RNA, 20 nt, Homo sapiens
uuugcaagggaaaagucucu

SEQ ID NO: 392459 - RNA, 18 nt, Homo sapiens
uuugccagugggaacucc

SEQ ID NO: 392460 - RNA, 16 nt, Homo sapiens
uuugcuggucacugcc

SEQ ID NO: 392461 - RNA, 15 nt, Homo sapiens
uuuggccuccuccag

SEQ ID NO: 392462 - RNA, 21 nt, Homo sapiens
uuugguuugcagaugacaaaa

SEQ ID NO: 392463 - RNA, 14 nt, Homo sapiens
auccugcaauucca

SEQ ID NO: 392464 - RNA, 22 nt, Homo sapiens
auccuggguggucugcaggcag

SEQ ID NO: 392465 - RNA, 18 nt, Homo sapiens
auccuuaaugcagagcua

SEQ ID NO: 392466 - RNA, 23 nt, Homo sapiens
auccuucaucaugucaguuccaa

SEQ ID NO: 392467 - RNA, 22 nt, Homo sapiens
aucgagauguccauagucaaau

SEQ ID NO: 392468 - RNA, 18 nt, Homo sapiens
aucuacaaaaaacaacaa

SEQ ID NO: 392469 - RNA, 22 nt, Homo sapiens
aucuacaaaaaacaacaaauaa

SEQ ID NO: 392470 - RNA, 18 nt, Homo sapiens
aucuacuucaacacuuca

SEQ ID NO: 392471 - RNA, 16 nt, Homo sapiens
aucuaugccacucaga

SEQ ID NO: 392472 - RNA, 14 nt, Homo sapiens
aucucaaaacugca

SEQ ID NO: 392473 - RNA, 22 nt, Homo sapiens
aucucaaacuacuggcaauuug

SEQ ID NO: 392474 - RNA, 18 nt, Homo sapiens
aucucaagauucaguaga

SEQ ID NO: 392475 - RNA, 16 nt, Homo sapiens
aucucaccccauccca

SEQ ID NO: 392476 - RNA, 19 nt, Homo sapiens
aucucagcuggaucuccau

SEQ ID NO: 392477 - RNA, 15 nt, Homo sapiens
aucucauugcuuaca

SEQ ID NO: 392478 - RNA, 20 nt, Homo sapiens
aucucgccaccccuccuucc

SEQ ID NO: 392479 - RNA, 22 nt, Homo sapiens
aucucugcuuuggaaaucacac

SEQ ID NO: 392480 - RNA, 17 nt, Homo sapiens
aucucuuauuuuacaau

SEQ ID NO: 392481 - RNA, 23 nt, Homo sapiens
aucucuuguauaugaugaucugg

SEQ ID NO: 392482 - RNA, 16 nt, Homo sapiens
aucucuuugaugucau

SEQ ID NO: 392483 - RNA, 21 nt, Homo sapiens
aucucuuuugaauccaugcuu

SEQ ID NO: 392484 - RNA, 19 nt, Homo sapiens
aucugggaaaauaccccau

SEQ ID NO: 392485 - RNA, 16 nt, Homo sapiens
aucuguauauacaaua

SEQ ID NO: 392486 - RNA, 20 nt, Homo sapiens
aucugugcucaggacucaga

SEQ ID NO: 392487 - RNA, 23 nt, Homo sapiens
aucuuagggcaucgcuccuccuc

SEQ ID NO: 392488 - RNA, 18 nt, Homo sapiens
aucuuaguauuugcauau

SEQ ID NO: 392489 - RNA, 21 nt, Homo sapiens
aucuucagggcacugcugcug

SEQ ID NO: 392490 - RNA, 20 nt, Homo sapiens
aucuugcuucugcuucucau

SEQ ID NO: 392491 - RNA, 21 nt, Homo sapiens
aucuuuaaaauacacacucaa

SEQ ID NO: 392492 - RNA, 20 nt, Homo sapiens
augaaaaauaagucacuuau

SEQ ID NO: 392493 - RNA, 16 nt, Homo sapiens
augaaaauuaggauuu

SEQ ID NO: 392494 - RNA, 17 nt, Homo sapiens
augaaauaucaugcucc

SEQ ID NO: 392495 - RNA, 13 nt, Homo sapiens
augaaauaugcau

SEQ ID NO: 392496 - RNA, 18 nt, Homo sapiens
augaacaugugaaguuau

SEQ ID NO: 392497 - RNA, 11 nt, Homo sapiens
gcgaugugcaa

SEQ ID NO: 392498 - RNA, 16 nt, Homo sapiens
gcgauuacaggcauga

SEQ ID NO: 392499 - RNA, 17 nt, Homo sapiens
gcgauugaaagggcaau

SEQ ID NO: 392500 - RNA, 13 nt, Homo sapiens
gcgcaacauuucu

SEQ ID NO: 392501 - RNA, 15 nt, Homo sapiens
gcgcaagcugggagc

SEQ ID NO: 392502 - RNA, 13 nt, Homo sapiens
gcggccugcugga

SEQ ID NO: 392503 - RNA, 14 nt, Homo sapiens
gcgugcaugugcac

SEQ ID NO: 392504 - RNA, 23 nt, Homo sapiens
gcguguggcucacgugugugacu

SEQ ID NO: 392505 - RNA, 16 nt, Homo sapiens
gcguguguccaugugu

SEQ ID NO: 392506 - RNA, 20 nt, Homo sapiens
gcguguguccaugugugugc

SEQ ID NO: 392507 - RNA, 19 nt, Homo sapiens
ggcaagcaagccugggagc

SEQ ID NO: 392508 - RNA, 22 nt, Homo sapiens
ggcaccuccuacgucaaacaug

SEQ ID NO: 392509 - RNA, 23 nt, Homo sapiens
ggcacgaggccaggcagauccca

SEQ ID NO: 392510 - RNA, 11 nt, Homo sapiens
ggcacugggau

SEQ ID NO: 392511 - RNA, 15 nt, Homo sapiens
ggcagaaagcaaaug

SEQ ID NO: 392512 - RNA, 20 nt, Homo sapiens
ggcagacacagggacuugaa

SEQ ID NO: 392513 - RNA, 12 nt, Homo sapiens
ggcagcauuuag

SEQ ID NO: 392514 - RNA, 15 nt, Homo sapiens
ggcaguauuaagugu

SEQ ID NO: 392515 - RNA, 19 nt, Homo sapiens
ggcaguccuggaaucacau

SEQ ID NO: 392516 - RNA, 23 nt, Homo sapiens
ggcagugacagaacuaagaugau

SEQ ID NO: 392517 - RNA, 23 nt, Homo sapiens
ggcagugaugcuggaugcuccuu

SEQ ID NO: 392518 - RNA, 12 nt, Homo sapiens
ggcauacuaaua

SEQ ID NO: 392519 - RNA, 16 nt, Homo sapiens
ggcaugccccggccac

SEQ ID NO: 392520 - RNA, 20 nt, Homo sapiens
ggcauggcccugggguccca

SEQ ID NO: 392521 - RNA, 12 nt, Homo sapiens
ggcaugggagac

SEQ ID NO: 392522 - RNA, 20 nt, Homo sapiens
ggcauuugcaccuaccucac

SEQ ID NO: 392523 - RNA, 18 nt, Homo sapiens
ggccaagcaccuagccuc

SEQ ID NO: 392524 - RNA, 22 nt, Homo sapiens
ggccaagcauuucuagcaguga

SEQ ID NO: 392525 - RNA, 17 nt, Homo sapiens
ggcccagagcaggaagc

SEQ ID NO: 392526 - RNA, 16 nt, Homo sapiens
ggcccauaucugugaa

SEQ ID NO: 392527 - RNA, 15 nt, Homo sapiens
ggccccugcaucccc

SEQ ID NO: 392528 - RNA, 15 nt, Homo sapiens
ggcccugagcucggu

SEQ ID NO: 392529 - RNA, 19 nt, Homo sapiens
ggccgggcgcgguggcuca

SEQ ID NO: 392530 - RNA, 12 nt, Homo sapiens
ggccucaaggga

SEQ ID NO: 392531 - RNA, 15 nt, Homo sapiens
ggccugcacuggugu

SEQ ID NO: 392532 - RNA, 12 nt, Homo sapiens
ggccuucucacc

SEQ ID NO: 392533 - RNA, 16 nt, Homo sapiens
ggcgucccuaccuccu

SEQ ID NO: 392534 - RNA, 22 nt, Homo sapiens
ggcucugggagacuuugaagac

SEQ ID NO: 392535 - RNA, 19 nt, Homo sapiens
ggcucuuagcagcuuccag

SEQ ID NO: 392536 - RNA, 18 nt, Homo sapiens
ggcugcccacacacccca

SEQ ID NO: 392537 - RNA, 18 nt, Homo sapiens
ggcugucaucagccugug

SEQ ID NO: 392538 - RNA, 12 nt, Homo sapiens
gggaagccaaaa

SEQ ID NO: 392539 - RNA, 17 nt, Homo sapiens
gggaagccccacuugaa

SEQ ID NO: 392540 - RNA, 23 nt, Homo sapiens
gggaagcuggcuuucuggcugcu

SEQ ID NO: 392541 - RNA, 22 nt, Homo sapiens
gggaaggugaccacauccaccu

SEQ ID NO: 392542 - RNA, 11 nt, Homo sapiens
gggacaggaug

SEQ ID NO: 392543 - RNA, 20 nt, Homo sapiens
gggacaggaugaccuggaua

SEQ ID NO: 392544 - RNA, 18 nt, Homo sapiens
gggacuguaaaaccaccu

SEQ ID NO: 392545 - RNA, 20 nt, Homo sapiens
gggaguaggacauaccagcu

SEQ ID NO: 392546 - RNA, 21 nt, Homo sapiens
gggagucugaagcagaugcaa

SEQ ID NO: 392547 - RNA, 12 nt, Homo sapiens
gggagucugggc

SEQ ID NO: 392548 - RNA, 22 nt, Homo sapiens
gggauguucagcacugucccuu

SEQ ID NO: 392549 - RNA, 13 nt, Homo sapiens
gggcacugguggc

SEQ ID NO: 392550 - RNA, 13 nt, Homo sapiens
gggcagucaccug

SEQ ID NO: 392551 - RNA, 21 nt, Homo sapiens
gggcaugacggcucaugccug

SEQ ID NO: 392552 - RNA, 19 nt, Homo sapiens
gggccagaggaacugucca

SEQ ID NO: 392553 - RNA, 21 nt, Homo sapiens
gggcgugaaccaccaugccca

SEQ ID NO: 392554 - RNA, 14 nt, Homo sapiens
gggcucagccuggu

SEQ ID NO: 392555 - RNA, 15 nt, Homo sapiens
gggcugcccuggugc

SEQ ID NO: 392556 - RNA, 16 nt, Homo sapiens
ggggaugcucugugca

SEQ ID NO: 392557 - RNA, 16 nt, Homo sapiens
ggggccaggugcacag

SEQ ID NO: 392558 - RNA, 20 nt, Homo sapiens
ggggcccugcaccugugcag

SEQ ID NO: 392559 - RNA, 16 nt, Homo sapiens
ggggcucucagcucag

SEQ ID NO: 392560 - RNA, 13 nt, Homo sapiens
ggggguuccguga

SEQ ID NO: 392561 - RNA, 12 nt, Homo sapiens
ggggugggccac

SEQ ID NO: 392562 - RNA, 15 nt, Homo sapiens
gggguggggagcaug

SEQ ID NO: 392563 - RNA, 22 nt, Homo sapiens
ggguaggcgggaaggaggguua

SEQ ID NO: 392564 - RNA, 19 nt, Homo sapiens
gggucagagaggagucaga

SEQ ID NO: 392565 - RNA, 17 nt, Homo sapiens
ggguccaucucagagaa

SEQ ID NO: 392566 - RNA, 20 nt, Homo sapiens
gggucucacaguguugccca

SEQ ID NO: 392567 - RNA, 20 nt, Homo sapiens
gggucucgcuuuguugccca

SEQ ID NO: 392568 - RNA, 22 nt, Homo sapiens
gggugcucccuaccaccucccc

SEQ ID NO: 392569 - RNA, 23 nt, Homo sapiens
gggugcugcuguaccacacagcc

SEQ ID NO: 392570 - RNA, 21 nt, Homo sapiens
gguaauauugacuuguauauu

SEQ ID NO: 392571 - RNA, 19 nt, Homo sapiens
gguagagacuuugacucuc

SEQ ID NO: 392572 - RNA, 13 nt, Homo sapiens
gguagcaacugaa

SEQ ID NO: 392573 - RNA, 21 nt, Homo sapiens
gguauaaugguugacuggguu

SEQ ID NO: 392574 - RNA, 21 nt, Homo sapiens
gguauauucauuucaaaggga

SEQ ID NO: 392575 - RNA, 14 nt, Homo sapiens
gguauguuuuacca

SEQ ID NO: 392576 - RNA, 23 nt, Homo sapiens
gguccacaucccgggacgcagca

SEQ ID NO: 392577 - RNA, 15 nt, Homo sapiens
gguccaucucagaga

SEQ ID NO: 392578 - RNA, 15 nt, Homo sapiens
gguccccacugccug

SEQ ID NO: 392579 - RNA, 22 nt, Homo sapiens
gguccccacugccugcuggaaa

SEQ ID NO: 392580 - RNA, 20 nt, Homo sapiens
ggucucacaguguugcccag

SEQ ID NO: 392581 - RNA, 21 nt, Homo sapiens
ggucucuggcccuucuugccu

SEQ ID NO: 392582 - RNA, 16 nt, Homo sapiens
ggugaaagauggaacu

SEQ ID NO: 392583 - RNA, 18 nt, Homo sapiens
ggugcaaauccuacugaa

SEQ ID NO: 392584 - RNA, 17 nt, Homo sapiens
ggugccucucucuugcu

SEQ ID NO: 392585 - RNA, 17 nt, Homo sapiens
gguggcucacgccugua

SEQ ID NO: 392586 - RNA, 14 nt, Homo sapiens
ggugggacagggac

SEQ ID NO: 392587 - RNA, 19 nt, Homo sapiens
gguucaccaggucagggag

SEQ ID NO: 392588 - RNA, 17 nt, Homo sapiens
gguuuuccuguugagau

SEQ ID NO: 392589 - RNA, 18 nt, Homo sapiens
guaaaacaugcuggugaa

SEQ ID NO: 392590 - RNA, 16 nt, Homo sapiens
guaaaaccacagcagu

SEQ ID NO: 392591 - RNA, 18 nt, Homo sapiens
guaaaggcuauacuuguc

SEQ ID NO: 392592 - RNA, 22 nt, Homo sapiens
guaaagguuuuuggaauuaugu

SEQ ID NO: 392593 - RNA, 22 nt, Homo sapiens
guaaaugaucacuccaggauau

SEQ ID NO: 392594 - RNA, 19 nt, Homo sapiens
guaacuguuaaauugcugu

SEQ ID NO: 392595 - RNA, 13 nt, Homo sapiens
guaacuuacuuag

SEQ ID NO: 392596 - RNA, 16 nt, Homo sapiens
guaaucccagcacuuu

SEQ ID NO: 392597 - RNA, 15 nt, Homo sapiens
guaaucucggcucac

SEQ ID NO: 392598 - RNA, 17 nt, Homo sapiens
guaaucuuuggcuguaa

SEQ ID NO: 392599 - RNA, 22 nt, Homo sapiens
guaauuuuguucuaguuuucag

SEQ ID NO: 392600 - RNA, 17 nt, Homo sapiens
guacaaauauaagaaua

SEQ ID NO: 392601 - RNA, 17 nt, Homo sapiens
guacagaauucugcuac

SEQ ID NO: 392602 - RNA, 18 nt, Homo sapiens
guacaggcagcacagaga

SEQ ID NO: 392603 - RNA, 18 nt, Homo sapiens
guaccuugaacacugggg

SEQ ID NO: 392604 - RNA, 23 nt, Homo sapiens
guacuauucugauuacacaaaac

SEQ ID NO: 392605 - RNA, 16 nt, Homo sapiens
guacucagcgaaugaa

SEQ ID NO: 392606 - RNA, 20 nt, Homo sapiens
guacuccagccugggugaca

SEQ ID NO: 392607 - RNA, 15 nt, Homo sapiens
guacugagggacaag

SEQ ID NO: 392608 - RNA, 17 nt, Homo sapiens
guagaagccacuauuac

SEQ ID NO: 392609 - RNA, 15 nt, Homo sapiens
guagaauagauaucc

SEQ ID NO: 392610 - RNA, 14 nt, Homo sapiens
guaggggcaaaaau

SEQ ID NO: 392611 - RNA, 16 nt, Homo sapiens
guagguggaucaccug

SEQ ID NO: 392612 - RNA, 13 nt, Homo sapiens
guagucauuucau

SEQ ID NO: 392613 - RNA, 17 nt, Homo sapiens
guagucccagcuacuca

SEQ ID NO: 392614 - RNA, 19 nt, Homo sapiens
guagucccagcuacucagg

SEQ ID NO: 392615 - RNA, 13 nt, Homo sapiens
guagucucaggac

SEQ ID NO: 392616 - RNA, 17 nt, Homo sapiens
guauauaguaugaaugc

SEQ ID NO: 392617 - RNA, 13 nt, Homo sapiens
guauaugcaauau

SEQ ID NO: 392618 - RNA, 14 nt, Homo sapiens
guaucaaaugugac

SEQ ID NO: 392619 - RNA, 21 nt, Homo sapiens
guaucucuuuugaauccaugc

SEQ ID NO: 392620 - RNA, 17 nt, Homo sapiens
guaucugauagcucuuu

SEQ ID NO: 392621 - RNA, 17 nt, Homo sapiens
guaugcacgugugcaca

SEQ ID NO: 392622 - RNA, 15 nt, Homo sapiens
guaugggacaggugc

SEQ ID NO: 392623 - RNA, 13 nt, Homo sapiens
guauucauugaag

SEQ ID NO: 392624 - RNA, 18 nt, Homo sapiens
guauucauugaagucaga

SEQ ID NO: 392625 - RNA, 15 nt, Homo sapiens
guauucuucaaccuc

SEQ ID NO: 392626 - RNA, 15 nt, Homo sapiens
guauuuuaugaucuu

SEQ ID NO: 392627 - RNA, 16 nt, Homo sapiens
guauuuuuaguagaga

SEQ ID NO: 392628 - RNA, 18 nt, Homo sapiens
guauuuuuucacuuguac

SEQ ID NO: 392629 - RNA, 16 nt, Homo sapiens
gucaaagcaaguuuca

SEQ ID NO: 392630 - RNA, 21 nt, Homo sapiens
gucaacaucuuuuacauucug

SEQ ID NO: 392631 - RNA, 19 nt, Homo sapiens
gucaaccugccugacauuu

SEQ ID NO: 392632 - RNA, 14 nt, Homo sapiens
gucaacuaugauau

SEQ ID NO: 392633 - RNA, 17 nt, Homo sapiens
gucagcaaaaagcaaaa

SEQ ID NO: 392634 - RNA, 20 nt, Homo sapiens
gucagcaggaagcaacgaag

SEQ ID NO: 392635 - RNA, 14 nt, Homo sapiens
gucagucagggaca

SEQ ID NO: 392636 - RNA, 18 nt, Homo sapiens
gucaugcguuuaaucaca

SEQ ID NO: 392637 - RNA, 15 nt, Homo sapiens
gucauggcaccaaag

SEQ ID NO: 392638 - RNA, 16 nt, Homo sapiens
gucauguuccuucaag

SEQ ID NO: 392639 - RNA, 21 nt, Homo sapiens
guccaagucuucucaagaucc

SEQ ID NO: 392640 - RNA, 15 nt, Homo sapiens
guccagcucguucuc

SEQ ID NO: 392641 - RNA, 23 nt, Homo sapiens
guccaggccugugaggugcagag

SEQ ID NO: 392642 - RNA, 18 nt, Homo sapiens
guccagggcuagugacuu

SEQ ID NO: 392643 - RNA, 17 nt, Homo sapiens
guccaugugugugcaag

SEQ ID NO: 392644 - RNA, 18 nt, Homo sapiens
guccaugugugugcaagu

SEQ ID NO: 392645 - RNA, 14 nt, Homo sapiens
gucccagcuacuca

SEQ ID NO: 392646 - RNA, 17 nt, Homo sapiens
gucccagcuacucagga

SEQ ID NO: 392647 - RNA, 17 nt, Homo sapiens
gucccauggacacucca

SEQ ID NO: 392648 - RNA, 17 nt, Homo sapiens
guccccaguuugcagaa

SEQ ID NO: 392649 - RNA, 20 nt, Homo sapiens
uccucgacacgcaacuggcu

SEQ ID NO: 392650 - RNA, 20 nt, Homo sapiens
uccugagcagugccagcuuu

SEQ ID NO: 392651 - RNA, 20 nt, Homo sapiens
uccugaguaguugggauuac

SEQ ID NO: 392652 - RNA, 16 nt, Homo sapiens
uccugcaacucaagga

SEQ ID NO: 392653 - RNA, 20 nt, Homo sapiens
uccugcccaccugucaaaca

SEQ ID NO: 392654 - RNA, 19 nt, Homo sapiens
uccugccugcggaccagau

SEQ ID NO: 392655 - RNA, 13 nt, Homo sapiens
uccugggcccucu

SEQ ID NO: 392656 - RNA, 13 nt, Homo sapiens
uccugucugccag

SEQ ID NO: 392657 - RNA, 14 nt, Homo sapiens
uccugugaauuucu

SEQ ID NO: 392658 - RNA, 11 nt, Homo sapiens
uccugugcaac

SEQ ID NO: 392659 - RNA, 12 nt, Homo sapiens
uccugugcaugg

SEQ ID NO: 392660 - RNA, 18 nt, Homo sapiens
uccuuagcuuagaccuca

SEQ ID NO: 392661 - RNA, 20 nt, Homo sapiens
uccuuagcuuagaccucagc

SEQ ID NO: 392662 - RNA, 18 nt, Homo sapiens
uccuuauuguuaaaaaca

SEQ ID NO: 392663 - RNA, 18 nt, Homo sapiens
uccuucaagccuagcccu

SEQ ID NO: 392664 - RNA, 13 nt, Homo sapiens
uccuucagugcau

SEQ ID NO: 392665 - RNA, 14 nt, Homo sapiens
uccuucugugaaag

SEQ ID NO: 392666 - RNA, 20 nt, Homo sapiens
uccuucuuucuaguucagcu

SEQ ID NO: 392667 - RNA, 14 nt, Homo sapiens
uccuugaccagcag

SEQ ID NO: 392668 - RNA, 18 nt, Homo sapiens
uccuugggaugaucuuga

SEQ ID NO: 392669 - RNA, 20 nt, Homo sapiens
uccuuuaaauccuuccauga

SEQ ID NO: 392670 - RNA, 23 nt, Homo sapiens
uccuuuguuuuuuuuuccugucc

SEQ ID NO: 392671 - RNA, 16 nt, Homo sapiens
uccuuuucccuauuuc

SEQ ID NO: 392672 - RNA, 23 nt, Homo sapiens
ucgaacauggaacucauuccugc

SEQ ID NO: 392673 - RNA, 14 nt, Homo sapiens
ucgaggggcucuca

SEQ ID NO: 392674 - RNA, 15 nt, Homo sapiens
ucgcugucaucucag

SEQ ID NO: 392675 - RNA, 16 nt, Homo sapiens
ucgcuuuguugcccag

SEQ ID NO: 392676 - RNA, 14 nt, Homo sapiens
ucgggcagcugcag

SEQ ID NO: 392677 - RNA, 17 nt, Homo sapiens
ucgucuuagcaagaagu

SEQ ID NO: 392678 - RNA, 15 nt, Homo sapiens
ucguuugaaucacag

SEQ ID NO: 392679 - RNA, 12 nt, Homo sapiens
ucuaaaugaagu

SEQ ID NO: 392680 - RNA, 23 nt, Homo sapiens
ucuaaaugaagugcaaauuugau

SEQ ID NO: 392681 - RNA, 15 nt, Homo sapiens
ucuaagaaagaaauu

SEQ ID NO: 392682 - RNA, 20 nt, Homo sapiens
ucuaagagaacaaugugcua

SEQ ID NO: 392683 - RNA, 17 nt, Homo sapiens
ucuaagauaguaacaau

SEQ ID NO: 392684 - RNA, 20 nt, Homo sapiens
ucuaagauaguaacaaugaa

SEQ ID NO: 392685 - RNA, 14 nt, Homo sapiens
ucuacaaaggccau

SEQ ID NO: 392686 - RNA, 15 nt, Homo sapiens
ucuacccaaaggaua

SEQ ID NO: 392687 - RNA, 22 nt, Homo sapiens
ucuacgcucuccuuucuuucua

SEQ ID NO: 392688 - RNA, 13 nt, Homo sapiens
ucuagaacuugac

SEQ ID NO: 392689 - RNA, 16 nt, Homo sapiens
ucuagggaaaaaccag

SEQ ID NO: 392690 - RNA, 14 nt, Homo sapiens
ucuaucaauaguca

SEQ ID NO: 392691 - RNA, 17 nt, Homo sapiens
ucuaucaauagucaaga

SEQ ID NO: 392692 - RNA, 17 nt, Homo sapiens
ucuaugaaauaucaugc

SEQ ID NO: 392693 - RNA, 14 nt, Homo sapiens
ucuaugguugacau

SEQ ID NO: 392694 - RNA, 19 nt, Homo sapiens
ucucaaaaccgaguugcca

SEQ ID NO: 392695 - RNA, 15 nt, Homo sapiens
ucucacacauuccag

SEQ ID NO: 392696 - RNA, 15 nt, Homo sapiens
ucucacuauaccagu

SEQ ID NO: 392697 - RNA, 18 nt, Homo sapiens
ucucacuugugcaguguu

SEQ ID NO: 392698 - RNA, 18 nt, Homo sapiens
ucucagcuaccuaagaaa

SEQ ID NO: 392699 - RNA, 21 nt, Homo sapiens
ucucagcuggaucuccauucu

SEQ ID NO: 392700 - RNA, 18 nt, Homo sapiens
ucucagguguugccaaau

SEQ ID NO: 392701 - RNA, 15 nt, Homo sapiens
ucucaugagugccaa

SEQ ID NO: 392702 - RNA, 10 nt, Homo sapiens
ucucauuucu

SEQ ID NO: 392703 - RNA, 16 nt, Homo sapiens
ucuccaauguccaaaa

SEQ ID NO: 392704 - RNA, 19 nt, Homo sapiens
ucucccaggacccaucacg

SEQ ID NO: 392705 - RNA, 15 nt, Homo sapiens
ucuccccugauuaca

SEQ ID NO: 392706 - RNA, 17 nt, Homo sapiens
ucuccccugauuacacc

SEQ ID NO: 392707 - RNA, 16 nt, Homo sapiens
ucucccuggcccucag

SEQ ID NO: 392708 - RNA, 16 nt, Homo sapiens
ucuccuggacugccuu

SEQ ID NO: 392709 - RNA, 19 nt, Homo sapiens
ucucuaguuuccagaggcu

SEQ ID NO: 392710 - RNA, 18 nt, Homo sapiens
ucucucagugaacuguga

SEQ ID NO: 392711 - RNA, 12 nt, Homo sapiens
ucucugccagug

SEQ ID NO: 392712 - RNA, 13 nt, Homo sapiens
ucucugguaauau

SEQ ID NO: 392713 - RNA, 12 nt, Homo sapiens
ucugaaaaccaa

SEQ ID NO: 392714 - RNA, 20 nt, Homo sapiens
ucugaaauuuuaauugaacu

SEQ ID NO: 392715 - RNA, 16 nt, Homo sapiens
ucugaccccuccucac

SEQ ID NO: 392716 - RNA, 13 nt, Homo sapiens
ucugaugcaagca

SEQ ID NO: 392717 - RNA, 23 nt, Homo sapiens
ucugcagcccggcgccaccaucc

SEQ ID NO: 392718 - RNA, 19 nt, Homo sapiens
ucugccaaaggaugugaua

SEQ ID NO: 392719 - RNA, 18 nt, Homo sapiens
ucugccagccagcagcca

SEQ ID NO: 392720 - RNA, 21 nt, Homo sapiens
ucugcccuugccaacggagag

SEQ ID NO: 392721 - RNA, 18 nt, Homo sapiens
ucugcucaucauucucug

SEQ ID NO: 392722 - RNA, 22 nt, Homo sapiens
ucugcuuacaauucccugcugu

SEQ ID NO: 392723 - RNA, 16 nt, Homo sapiens
ucugcuuugacugagc

SEQ ID NO: 392724 - RNA, 22 nt, Homo sapiens
ucuggcaucucuuucugcaaag

SEQ ID NO: 392725 - RNA, 16 nt, Homo sapiens
ucuggcccuucuugcc

SEQ ID NO: 392726 - RNA, 20 nt, Homo sapiens
ucuggccuugaaaccaccuu

SEQ ID NO: 392727 - RNA, 18 nt, Homo sapiens
ucugggccaagucaaaga

SEQ ID NO: 392728 - RNA, 14 nt, Homo sapiens
ucuggguccuugca

SEQ ID NO: 392729 - RNA, 16 nt, Homo sapiens
ucugguaauauugacu

SEQ ID NO: 392730 - RNA, 15 nt, Homo sapiens
ucuggugacaccagc

SEQ ID NO: 392731 - RNA, 14 nt, Homo sapiens
ucugguuugcagag

SEQ ID NO: 392732 - RNA, 14 nt, Homo sapiens
ucuguaaacucaaa

SEQ ID NO: 392733 - RNA, 16 nt, Homo sapiens
ucugucucauaugauu

SEQ ID NO: 392734 - RNA, 16 nt, Homo sapiens
ucugugaccucaggca

SEQ ID NO: 392735 - RNA, 22 nt, Homo sapiens
ucugugcaaauccuugauacug

SEQ ID NO: 392736 - RNA, 21 nt, Homo sapiens
ucugugcucaggacucagaag

SEQ ID NO: 392737 - RNA, 19 nt, Homo sapiens
ucugugggcuccauguaga

SEQ ID NO: 392738 - RNA, 14 nt, Homo sapiens
ucuguuaccagagg

SEQ ID NO: 392739 - RNA, 20 nt, Homo sapiens
ucuguuuauaaacauuguau

SEQ ID NO: 392740 - RNA, 14 nt, Homo sapiens
ucuguuugagauuu

SEQ ID NO: 392741 - RNA, 16 nt, Homo sapiens
ucuuagaaguggacca

SEQ ID NO: 392742 - RNA, 20 nt, Homo sapiens
ucuuagacuucugcuuucca

SEQ ID NO: 392743 - RNA, 20 nt, Homo sapiens
ucuuagcacaccuacaccuc

SEQ ID NO: 392744 - RNA, 17 nt, Homo sapiens
ucuuauagaaaguucaa

SEQ ID NO: 392745 - RNA, 18 nt, Homo sapiens
ucuuauuagaacaggcaa

SEQ ID NO: 392746 - RNA, 16 nt, Homo sapiens
ucuuauugacucauac

SEQ ID NO: 392747 - RNA, 17 nt, Homo sapiens
ucuucaaccucauugac

SEQ ID NO: 392748 - RNA, 13 nt, Homo sapiens
ucuucacagucac

SEQ ID NO: 392749 - RNA, 14 nt, Homo sapiens
ucuucaccauuugg

SEQ ID NO: 392750 - RNA, 18 nt, Homo sapiens
ucuucacucaaucucuga

SEQ ID NO: 392751 - RNA, 15 nt, Homo sapiens
ucuucacucucugaa

SEQ ID NO: 392752 - RNA, 18 nt, Homo sapiens
ucuucagggcacugcugc

SEQ ID NO: 392753 - RNA, 20 nt, Homo sapiens
ucuucagggcacugcugcug

SEQ ID NO: 392754 - RNA, 15 nt, Homo sapiens
ucuucagggggccag

SEQ ID NO: 392755 - RNA, 13 nt, Homo sapiens
ugaacagaacuau

SEQ ID NO: 392756 - RNA, 11 nt, Homo sapiens
ugaacauuucu

SEQ ID NO: 392757 - RNA, 22 nt, Homo sapiens
ugaaccaagaccauugaauucu

SEQ ID NO: 392758 - RNA, 18 nt, Homo sapiens
ugaacucuuugaaugaca

SEQ ID NO: 392759 - RNA, 15 nt, Homo sapiens
ugaacuugugagaac

SEQ ID NO: 392760 - RNA, 18 nt, Homo sapiens
ugaacuuucacauagcac

SEQ ID NO: 392761 - RNA, 21 nt, Homo sapiens
ugaagaaaagugaaugcucaa

SEQ ID NO: 392762 - RNA, 22 nt, Homo sapiens
ugaagaacaguaacugccauca

SEQ ID NO: 392763 - RNA, 13 nt, Homo sapiens
ugaagacaggaug

SEQ ID NO: 392764 - RNA, 21 nt, Homo sapiens
ugaagagauccuucuguaaag

SEQ ID NO: 392765 - RNA, 13 nt, Homo sapiens
ugaagaugaucau

SEQ ID NO: 392766 - RNA, 21 nt, Homo sapiens
ugaagaugcugaaacaggaga

SEQ ID NO: 392767 - RNA, 19 nt, Homo sapiens
ugaagauucuccugugcua

SEQ ID NO: 392768 - RNA, 13 nt, Homo sapiens
ugaagccacagca

SEQ ID NO: 392769 - RNA, 18 nt, Homo sapiens
ugaagccuauguaugcca

SEQ ID NO: 392770 - RNA, 14 nt, Homo sapiens
ugaaggcaugccua

SEQ ID NO: 392771 - RNA, 14 nt, Homo sapiens
ugaaguaagcaaag

SEQ ID NO: 392772 - RNA, 16 nt, Homo sapiens
ugaaguagaauccuaa

SEQ ID NO: 392773 - RNA, 22 nt, Homo sapiens
ugaagucaugcguuuaaucaca

SEQ ID NO: 392774 - RNA, 20 nt, Homo sapiens
ugaauaauacaguaucucag

SEQ ID NO: 392775 - RNA, 20 nt, Homo sapiens
ugaauaugaacggugagcau

SEQ ID NO: 392776 - RNA, 12 nt, Homo sapiens
ugaaucacagua

SEQ ID NO: 392777 - RNA, 21 nt, Homo sapiens
ugaaugaccuuguugcaugau

SEQ ID NO: 392778 - RNA, 11 nt, Homo sapiens
ugaaugcucaa

SEQ ID NO: 392779 - RNA, 14 nt, Homo sapiens
ugaauuucaguaaa

SEQ ID NO: 392780 - RNA, 12 nt, Homo sapiens
ugacaaccucuu

SEQ ID NO: 392781 - RNA, 14 nt, Homo sapiens
ugacaccagccuuu

SEQ ID NO: 392782 - RNA, 20 nt, Homo sapiens
ugacacucccuugggcuccc

SEQ ID NO: 392783 - RNA, 10 nt, Homo sapiens
ugacacugaa

SEQ ID NO: 392784 - RNA, 12 nt, Homo sapiens
ugacagaucucu

SEQ ID NO: 392785 - RNA, 12 nt, Homo sapiens
ugacagccuccc

SEQ ID NO: 392786 - RNA, 17 nt, Homo sapiens
ugaccaguugcacuugg

SEQ ID NO: 392787 - RNA, 16 nt, Homo sapiens
ugacccagucagaguu

SEQ ID NO: 392788 - RNA, 18 nt, Homo sapiens
ugaccccugcccaccucu

SEQ ID NO: 392789 - RNA, 18 nt, Homo sapiens
ugacccucuccccacugc

SEQ ID NO: 392790 - RNA, 18 nt, Homo sapiens
ugaccugaggaagcguga

SEQ ID NO: 392791 - RNA, 21 nt, Homo sapiens
ugaccuuguugcaugauguau

SEQ ID NO: 392792 - RNA, 16 nt, Homo sapiens
ugacucagcauaccug

SEQ ID NO: 392793 - RNA, 18 nt, Homo sapiens
ugacucagcauaccugcu

SEQ ID NO: 392794 - RNA, 22 nt, Homo sapiens
ugacucagcauagauuguauaa

SEQ ID NO: 392795 - RNA, 15 nt, Homo sapiens
ugacucucacaagau

SEQ ID NO: 392796 - RNA, 20 nt, Homo sapiens
ugacucuccagaaagcucau

SEQ ID NO: 392797 - RNA, 15 nt, Homo sapiens
ugacuggcaguauua

SEQ ID NO: 392798 - RNA, 19 nt, Homo sapiens
ugacuucuccaggucucac

SEQ ID NO: 392799 - RNA, 23 nt, Homo sapiens
ugagaacacagccgauucaccug

SEQ ID NO: 392800 - RNA, 17 nt, Homo sapiens
ugagaacuacucaggga

SEQ ID NO: 392801 - RNA, 16 nt, Homo sapiens
ugagaauugugcucaa

SEQ ID NO: 392802 - RNA, 17 nt, Homo sapiens
ugagaccacuguuauca

SEQ ID NO: 392803 - RNA, 16 nt, Homo sapiens
ugagacccugucucaa

SEQ ID NO: 392804 - RNA, 15 nt, Homo sapiens
ugagagcacagcagg

SEQ ID NO: 392805 - RNA, 23 nt, Homo sapiens
ugagauccuuuaaauccuuccau

SEQ ID NO: 392806 - RNA, 23 nt, Homo sapiens
ugagaucgugccguuacucucca

SEQ ID NO: 392807 - RNA, 19 nt, Homo sapiens
ugagcagugccagcuuucu

SEQ ID NO: 392808 - RNA, 14 nt, Homo sapiens
ugagccgcugugag

SEQ ID NO: 392809 - RNA, 12 nt, Homo sapiens
ugagcugugcag

SEQ ID NO: 392810 - RNA, 21 nt, Homo sapiens
ugagcuuaagaauuuugagca

SEQ ID NO: 392811 - RNA, 15 nt, Homo sapiens
ugaggaacccuuaca

SEQ ID NO: 392812 - RNA, 14 nt, Homo sapiens
ugaggaauguauau

SEQ ID NO: 392813 - RNA, 21 nt, Homo sapiens
ugaggcggguggaucacuuga

SEQ ID NO: 392814 - RNA, 11 nt, Homo sapiens
ugagggucccc

SEQ ID NO: 392815 - RNA, 20 nt, Homo sapiens
ugagucaugaucucccugcc

SEQ ID NO: 392816 - RNA, 15 nt, Homo sapiens
ugaguggugccaaac

SEQ ID NO: 392817 - RNA, 17 nt, Homo sapiens
ugaguguugcucucuag

SEQ ID NO: 392818 - RNA, 19 nt, Homo sapiens
ugaguuacuaucaugucaa

SEQ ID NO: 392819 - RNA, 19 nt, Homo sapiens
ugaguugcccaucuuguuu

SEQ ID NO: 392820 - RNA, 15 nt, Homo sapiens
ugaguuuagugaucu

SEQ ID NO: 392821 - RNA, 14 nt, Homo sapiens
ugaguuuucagugg

SEQ ID NO: 392822 - RNA, 21 nt, Homo sapiens
ugaguuuuugauagcuuuauu

SEQ ID NO: 392823 - RNA, 19 nt, Homo sapiens
ugauacaagaaagcaaugc

SEQ ID NO: 392824 - RNA, 13 nt, Homo sapiens
ugauagccuuccg

SEQ ID NO: 392825 - RNA, 23 nt, Homo sapiens
ugauaugucagggcgugggacau

SEQ ID NO: 392826 - RNA, 15 nt, Homo sapiens
ugauauugcagcuua

SEQ ID NO: 392827 - RNA, 17 nt, Homo sapiens
ugauauuuuuacuugca

SEQ ID NO: 392828 - RNA, 13 nt, Homo sapiens
ugaucauuugccc

SEQ ID NO: 392829 - RNA, 20 nt, Homo sapiens
ugauccuaaugaaugcauaa

SEQ ID NO: 392830 - RNA, 19 nt, Homo sapiens
ugauccuaggcauuugcug

SEQ ID NO: 392831 - RNA, 17 nt, Homo sapiens
ugauccuuuuauguuau

SEQ ID NO: 392832 - RNA, 17 nt, Homo sapiens
ugaucuaucaauaguca

SEQ ID NO: 392833 - RNA, 13 nt, Homo sapiens
ugaucuuacucac

SEQ ID NO: 392834 - RNA, 17 nt, Homo sapiens
ugaucuugauugugggu

SEQ ID NO: 392835 - RNA, 17 nt, Homo sapiens
ugaugauuaauucaccu

SEQ ID NO: 392836 - RNA, 13 nt, Homo sapiens
ugauucacagugu

SEQ ID NO: 392837 - RNA, 15 nt, Homo sapiens
ugauucacaguguga

SEQ ID NO: 392838 - RNA, 24 nt, Homo sapiens
ugauuccuuuccuaaaaguguaag

SEQ ID NO: 392839 - RNA, 18 nt, Homo sapiens
ugauuucacaacagauca

SEQ ID NO: 392840 - RNA, 17 nt, Homo sapiens
ugauuuugaaaccauga

SEQ ID NO: 392841 - RNA, 14 nt, Homo sapiens
ugcaaacgcugccu

SEQ ID NO: 392842 - RNA, 18 nt, Homo sapiens
ugcaaaugcuauauugca

SEQ ID NO: 392843 - RNA, 22 nt, Homo sapiens
ugcaagaauugaagcaggacua

SEQ ID NO: 392844 - RNA, 19 nt, Homo sapiens
ugcaagugucugugugcaa

SEQ ID NO: 392845 - RNA, 16 nt, Homo sapiens
ugcaagugugugcaug

SEQ ID NO: 392846 - RNA, 19 nt, Homo sapiens
ugcaagugugugcaugugu

SEQ ID NO: 392847 - RNA, 21 nt, Homo sapiens
ugcaagugugugcaugugugc

SEQ ID NO: 392848 - RNA, 18 nt, Homo sapiens
ugcaaugggcacugggau

SEQ ID NO: 392849 - RNA, 18 nt, Homo sapiens
ugcacacccacucagcuc

SEQ ID NO: 392850 - RNA, 21 nt, Homo sapiens
ugcacacuccccugcacugga

SEQ ID NO: 392851 - RNA, 17 nt, Homo sapiens
ugcaccacuucaaguga

SEQ ID NO: 392852 - RNA, 14 nt, Homo sapiens
ugcacccacucugc

SEQ ID NO: 392853 - RNA, 20 nt, Homo sapiens
ugcaccccaaagcuuuccug

SEQ ID NO: 392854 - RNA, 19 nt, Homo sapiens
ugcacgggagaauauacaa

SEQ ID NO: 392855 - RNA, 17 nt, Homo sapiens
ugcacguggccucuuga

SEQ ID NO: 392856 - RNA, 23 nt, Homo sapiens
ugcacuacucccucaaagcacac

SEQ ID NO: 392857 - RNA, 13 nt, Homo sapiens
ugcacuacugaca

SEQ ID NO: 392858 - RNA, 20 nt, Homo sapiens
ugcacuccagccugagcgac

SEQ ID NO: 392859 - RNA, 23 nt, Homo sapiens
ugcacuugcacgcccauguguga

SEQ ID NO: 392860 - RNA, 19 nt, Homo sapiens
ugcagaauugagagugauu

SEQ ID NO: 392861 - RNA, 13 nt, Homo sapiens
ugcagacuggagg

SEQ ID NO: 392862 - RNA, 16 nt, Homo sapiens
ugcagagugcccagaa

SEQ ID NO: 392863 - RNA, 17 nt, Homo sapiens
ugcagagugcccagaac

SEQ ID NO: 392864 - RNA, 19 nt, Homo sapiens
ugcagcccagaauagcuuu

SEQ ID NO: 392865 - RNA, 22 nt, Homo sapiens
ugcagcccccauuguggucaca

SEQ ID NO: 392866 - RNA, 21 nt, Homo sapiens
ugcaggacauuuggcugugau

SEQ ID NO: 392867 - RNA, 22 nt, Homo sapiens
ugcagggaagccccacuugaag

SEQ ID NO: 392868 - RNA, 14 nt, Homo sapiens
ugcagggacugcca

SEQ ID NO: 392869 - RNA, 12 nt, Homo sapiens
ugcaggucucaa

SEQ ID NO: 392870 - RNA, 17 nt, Homo sapiens
ugcagugacagcuugag

SEQ ID NO: 392871 - RNA, 19 nt, Homo sapiens
ugcaguggcccccacagaa

SEQ ID NO: 392872 - RNA, 16 nt, Homo sapiens
ugcauaagugcaugac

SEQ ID NO: 392873 - RNA, 18 nt, Homo sapiens
ugcauaagugcaugacau

SEQ ID NO: 392874 - RNA, 20 nt, Homo sapiens
ugcauaagugcaugacauau

SEQ ID NO: 392875 - RNA, 16 nt, Homo sapiens
ugcauagucauguaag

SEQ ID NO: 392876 - RNA, 19 nt, Homo sapiens
ugcauccccuuggcuguga

SEQ ID NO: 392877 - RNA, 19 nt, Homo sapiens
ugcaucguuucaucuucca

SEQ ID NO: 392878 - RNA, 22 nt, Homo sapiens
ugcaugcuacucuuagauagaa

SEQ ID NO: 392879 - RNA, 17 nt, Homo sapiens
ugcauggauaugugcca

SEQ ID NO: 392880 - RNA, 12 nt, Homo sapiens
ugcauuaucuau

SEQ ID NO: 392881 - RNA, 16 nt, Homo sapiens
ugcauucacccagaca

SEQ ID NO: 392882 - RNA, 17 nt, Homo sapiens
ugcauuuuuaaauacaa

SEQ ID NO: 392883 - RNA, 16 nt, Homo sapiens
ugccaaauauguccug

SEQ ID NO: 392884 - RNA, 18 nt, Homo sapiens
ugccacacgucugacccu

SEQ ID NO: 392885 - RNA, 14 nt, Homo sapiens
ugccaccugcugcu

SEQ ID NO: 392886 - RNA, 15 nt, Homo sapiens
ugccaccugcugcug

SEQ ID NO: 392887 - RNA, 19 nt, Homo sapiens
ugccagcaaugacaucuca

SEQ ID NO: 392888 - RNA, 21 nt, Homo sapiens
ugccagcauuuagacccugca

SEQ ID NO: 392889 - RNA, 19 nt, Homo sapiens
ugccaggauuaaaagccau

SEQ ID NO: 392890 - RNA, 17 nt, Homo sapiens
ugccagugggaacuccu

SEQ ID NO: 392891 - RNA, 16 nt, Homo sapiens
ugccauaaaacauuaa

SEQ ID NO: 392892 - RNA, 23 nt, Homo sapiens
ugccaucaagaugagagaacugg

SEQ ID NO: 392893 - RNA, 17 nt, Homo sapiens
ugccauccagccagaac

SEQ ID NO: 392894 - RNA, 18 nt, Homo sapiens
ugcccaccugucaaacaa

SEQ ID NO: 392895 - RNA, 22 nt, Homo sapiens
ugcccagagaugggacugggag

SEQ ID NO: 392896 - RNA, 17 nt, Homo sapiens
ugcccaggcuggucuca

SEQ ID NO: 392897 - RNA, 15 nt, Homo sapiens
ugcccagggcucagc

SEQ ID NO: 392898 - RNA, 16 nt, Homo sapiens
ugcccagugaccaguc

SEQ ID NO: 392899 - RNA, 18 nt, Homo sapiens
ugcccagugaccagucac

SEQ ID NO: 392900 - RNA, 18 nt, Homo sapiens
ugccccgccuccccgaaa

SEQ ID NO: 392901 - RNA, 18 nt, Homo sapiens
uucuaaguauuuuauucc

SEQ ID NO: 392902 - RNA, 13 nt, Homo sapiens
uucuaaucaaagc

SEQ ID NO: 392903 - RNA, 15 nt, Homo sapiens
uucuaaugugugaau

SEQ ID NO: 392904 - RNA, 12 nt, Homo sapiens
uucuacuuuaag

SEQ ID NO: 392905 - RNA, 19 nt, Homo sapiens
uucuaguucagcugcccca

SEQ ID NO: 392906 - RNA, 14 nt, Homo sapiens
uucuaugaggcaac

SEQ ID NO: 392907 - RNA, 21 nt, Homo sapiens
uucuauugaaaaaucaccaca

SEQ ID NO: 392908 - RNA, 15 nt, Homo sapiens
uucucaccacagagc

SEQ ID NO: 392909 - RNA, 16 nt, Homo sapiens
uucucaccauuugagu

SEQ ID NO: 392910 - RNA, 14 nt, Homo sapiens
uucucaugugaucc

SEQ ID NO: 392911 - RNA, 15 nt, Homo sapiens
uucuccaauguccaa

SEQ ID NO: 392912 - RNA, 23 nt, Homo sapiens
uucucccaggccaggcuccuucc

SEQ ID NO: 392913 - RNA, 22 nt, Homo sapiens
uucucucugacccucuccccac

SEQ ID NO: 392914 - RNA, 15 nt, Homo sapiens
uucucucuucuccac

SEQ ID NO: 392915 - RNA, 15 nt, Homo sapiens
uucugagaaggugag

SEQ ID NO: 392916 - RNA, 11 nt, Homo sapiens
uucugagauca

SEQ ID NO: 392917 - RNA, 16 nt, Homo sapiens
uucugaucugaugcaa

SEQ ID NO: 392918 - RNA, 11 nt, Homo sapiens
uucugauuaca

SEQ ID NO: 392919 - RNA, 12 nt, Homo sapiens
uucugcauuuaa

SEQ ID NO: 392920 - RNA, 15 nt, Homo sapiens
uucugcuuuccacac

SEQ ID NO: 392921 - RNA, 19 nt, Homo sapiens
uucuggguggccucgggac

SEQ ID NO: 392922 - RNA, 23 nt, Homo sapiens
uucugguggagagaagugagaau

SEQ ID NO: 392923 - RNA, 15 nt, Homo sapiens
uucugguuacugugg

SEQ ID NO: 392924 - RNA, 19 nt, Homo sapiens
uucuuaauauaacugccuu

SEQ ID NO: 392925 - RNA, 15 nt, Homo sapiens
uucuuagacuuaucu

SEQ ID NO: 392926 - RNA, 16 nt, Homo sapiens
uucuucccuacaguug

SEQ ID NO: 392927 - RNA, 21 nt, Homo sapiens
uucuucuuggucucaguguca

SEQ ID NO: 392928 - RNA, 21 nt, Homo sapiens
uucuugaguuuagugaucuga

SEQ ID NO: 392929 - RNA, 14 nt, Homo sapiens
uucuugguuccaau

SEQ ID NO: 392930 - RNA, 20 nt, Homo sapiens
uucuuguauauuauggaaga

SEQ ID NO: 392931 - RNA, 19 nt, Homo sapiens
uucuuuaaauuucaucuca

SEQ ID NO: 392932 - RNA, 13 nt, Homo sapiens
uucuuugaaguuu

SEQ ID NO: 392933 - RNA, 16 nt, Homo sapiens
uugaaaacucacagaa

SEQ ID NO: 392934 - RNA, 13 nt, Homo sapiens
uugaaaagucaaa

SEQ ID NO: 392935 - RNA, 14 nt, Homo sapiens
uugaaauaguugau

SEQ ID NO: 392936 - RNA, 15 nt, Homo sapiens
uugaacccaggagau

SEQ ID NO: 392937 - RNA, 14 nt, Homo sapiens
uugaagaagauaug

SEQ ID NO: 392938 - RNA, 11 nt, Homo sapiens
uugaagaccag

SEQ ID NO: 392939 - RNA, 23 nt, Homo sapiens
uugaagcucuggugacaccagcc

SEQ ID NO: 392940 - RNA, 20 nt, Homo sapiens
uugaaggaguccuugcauca

SEQ ID NO: 392941 - RNA, 20 nt, Homo sapiens
uugaaucuacaaaaaacaac

SEQ ID NO: 392942 - RNA, 19 nt, Homo sapiens
uugacaaagaaacccaagu

SEQ ID NO: 392943 - RNA, 15 nt, Homo sapiens
uugacaauaauuuca

SEQ ID NO: 392944 - RNA, 11 nt, Homo sapiens
uugacaccugc

SEQ ID NO: 392945 - RNA, 15 nt, Homo sapiens
uugacaucagcauua

SEQ ID NO: 392946 - RNA, 18 nt, Homo sapiens
uugagcaccgucauggcu

SEQ ID NO: 392947 - RNA, 22 nt, Homo sapiens
uugagcaguggcugguccaggg

SEQ ID NO: 392948 - RNA, 18 nt, Homo sapiens
uugaggggcugacuucaa

SEQ ID NO: 392949 - RNA, 21 nt, Homo sapiens
uugauggcuccgaacacccuc

SEQ ID NO: 392950 - RNA, 15 nt, Homo sapiens
uugauuucauuaaua

SEQ ID NO: 392951 - RNA, 14 nt, Homo sapiens
uugcaaccucgcug

SEQ ID NO: 392952 - RNA, 21 nt, Homo sapiens
uugcacaaaaucacacagcca

SEQ ID NO: 392953 - RNA, 21 nt, Homo sapiens
uugcacacuccccugcacugg

SEQ ID NO: 392954 - RNA, 14 nt, Homo sapiens
uugcaccacugcac

SEQ ID NO: 392955 - RNA, 21 nt, Homo sapiens
uugcagcuuauauucauccau

SEQ ID NO: 392956 - RNA, 20 nt, Homo sapiens
uugcaggaccucaggugaga

SEQ ID NO: 392957 - RNA, 17 nt, Homo sapiens
uugcccuucacaguguu

SEQ ID NO: 392958 - RNA, 17 nt, Homo sapiens
uugccuggagugugaac

SEQ ID NO: 392959 - RNA, 23 nt, Homo sapiens
uugcuauggggagaaaagacaug

SEQ ID NO: 392960 - RNA, 15 nt, Homo sapiens
uugcuggcaaagaca

SEQ ID NO: 392961 - RNA, 13 nt, Homo sapiens
uugcuguuuccuu

SEQ ID NO: 392962 - RNA, 11 nt, Homo sapiens
uugcuuagccc

SEQ ID NO: 392963 - RNA, 23 nt, Homo sapiens
uugcuucccggcgucccuaccuc

SEQ ID NO: 392964 - RNA, 18 nt, Homo sapiens
uugcuugugccacacccu

SEQ ID NO: 392965 - RNA, 19 nt, Homo sapiens
uuggaaaaagccugugaaa

SEQ ID NO: 392966 - RNA, 12 nt, Homo sapiens
uuggaaaucaca

SEQ ID NO: 392967 - RNA, 19 nt, Homo sapiens
uuggaagugugugaucugu

SEQ ID NO: 392968 - RNA, 22 nt, Homo sapiens
uuggacaaaccgagugcaauga

SEQ ID NO: 392969 - RNA, 18 nt, Homo sapiens
uuggagugcgggugggcu

SEQ ID NO: 392970 - RNA, 16 nt, Homo sapiens
uuggauggagacucca

SEQ ID NO: 392971 - RNA, 15 nt, Homo sapiens
uuggcaaacuuugua

SEQ ID NO: 392972 - RNA, 13 nt, Homo sapiens
uuggcaacagaag

SEQ ID NO: 392973 - RNA, 13 nt, Homo sapiens
uuggcaaugccau

SEQ ID NO: 392974 - RNA, 19 nt, Homo sapiens
uuggccucccaaagugcua

SEQ ID NO: 392975 - RNA, 14 nt, Homo sapiens
uuggcuucagggga

SEQ ID NO: 392976 - RNA, 16 nt, Homo sapiens
uuggcuucuaaucaaa

SEQ ID NO: 392977 - RNA, 17 nt, Homo sapiens
aaaaaauuaauacugaa

SEQ ID NO: 392978 - RNA, 18 nt, Homo sapiens
aaaaaccaauagcuuuaa

SEQ ID NO: 392979 - RNA, 12 nt, Homo sapiens
aaaaaggcaccu

SEQ ID NO: 392980 - RNA, 14 nt, Homo sapiens
aaaaagucauccaa

SEQ ID NO: 392981 - RNA, 19 nt, Homo sapiens
aaaaauauauuuaaugaua

SEQ ID NO: 392982 - RNA, 23 nt, Homo sapiens
aaaaauauauuuaaugauaagua

SEQ ID NO: 392983 - RNA, 15 nt, Homo sapiens
aaaaauccuacaagg

SEQ ID NO: 392984 - RNA, 21 nt, Homo sapiens
aaaaaugguuuaaauggucaa

SEQ ID NO: 392985 - RNA, 20 nt, Homo sapiens
aaaaauguauaugcacuuau

SEQ ID NO: 392986 - RNA, 14 nt, Homo sapiens
aaaaauguaucaaa

SEQ ID NO: 392987 - RNA, 14 nt, Homo sapiens
aaaaauucaacuca

SEQ ID NO: 392988 - RNA, 20 nt, Homo sapiens
aaaacaacuucaauauccaa

SEQ ID NO: 392989 - RNA, 18 nt, Homo sapiens
aaaacagagaugugauaa

SEQ ID NO: 392990 - RNA, 13 nt, Homo sapiens
aaaacaucacuga

SEQ ID NO: 392991 - RNA, 19 nt, Homo sapiens
aaaacauugauuauaagca

SEQ ID NO: 392992 - RNA, 24 nt, Homo sapiens
aaaaccaauguucucucuucucca

SEQ ID NO: 392993 - RNA, 23 nt, Homo sapiens
aaaaccaccaccaucaccagaca

SEQ ID NO: 392994 - RNA, 22 nt, Homo sapiens
aaaaccaccuuuucugcuucaa

SEQ ID NO: 392995 - RNA, 11 nt, Homo sapiens
aaaacucuccu

SEQ ID NO: 392996 - RNA, 22 nt, Homo sapiens
aaaacucugggaaauaagagag

SEQ ID NO: 392997 - RNA, 14 nt, Homo sapiens
aaaacugacagagg

SEQ ID NO: 392998 - RNA, 19 nt, Homo sapiens
aaaacugacaguaaaucuc

SEQ ID NO: 392999 - RNA, 17 nt, Homo sapiens
aaaacugauuuuuagcu

SEQ ID NO: 393000 - RNA, 14 nt, Homo sapiens
aaaacugucccuuu

SEQ ID NO: 393001 - RNA, 23 nt, Homo sapiens
aaaacuuuucuaauacucuaccc

SEQ ID NO: 393002 - RNA, 16 nt, Homo sapiens
aaaagaauacagaaag

SEQ ID NO: 393003 - RNA, 15 nt, Homo sapiens
aaaagacuccaaaga

SEQ ID NO: 393004 - RNA, 13 nt, Homo sapiens
aaaagcaaaauca

SEQ ID NO: 393005 - RNA, 13 nt, Homo sapiens
aaaaguugugauu

SEQ ID NO: 393006 - RNA, 16 nt, Homo sapiens
aaaauagaaacuugcu

SEQ ID NO: 393007 - RNA, 18 nt, Homo sapiens
aaaauagagccugaggga

SEQ ID NO: 393008 - RNA, 22 nt, Homo sapiens
aaaauaguuuggauuacuuaaa

SEQ ID NO: 393009 - RNA, 14 nt, Homo sapiens
aaaauauggcuaua

SEQ ID NO: 393010 - RNA, 19 nt, Homo sapiens
aaaaucagccugcuccagc

SEQ ID NO: 393011 - RNA, 17 nt, Homo sapiens
aaaaugaaucuucacaa

SEQ ID NO: 393012 - RNA, 18 nt, Homo sapiens
aaaaugaugggacaauaa

SEQ ID NO: 393013 - RNA, 21 nt, Homo sapiens
aaaaugauuuuaucugugaau

SEQ ID NO: 393014 - RNA, 15 nt, Homo sapiens
aaaauuaauacugaa

SEQ ID NO: 393015 - RNA, 14 nt, Homo sapiens
aaaauuaugccaua

SEQ ID NO: 393016 - RNA, 17 nt, Homo sapiens
aaaauucagagaguuag

SEQ ID NO: 393017 - RNA, 15 nt, Homo sapiens
aaaauugcacuuuua

SEQ ID NO: 393018 - RNA, 17 nt, Homo sapiens
aaaauugugaucagacc

SEQ ID NO: 393019 - RNA, 18 nt, Homo sapiens
aaaauuuguuuugacgga

SEQ ID NO: 393020 - RNA, 13 nt, Homo sapiens
aaacaaagccaga

SEQ ID NO: 393021 - RNA, 17 nt, Homo sapiens
aaacaaauguauuucaa

SEQ ID NO: 393022 - RNA, 12 nt, Homo sapiens
aaacaacucuuu

SEQ ID NO: 393023 - RNA, 19 nt, Homo sapiens
aaacaauuggcaaacuuug

SEQ ID NO: 393024 - RNA, 20 nt, Homo sapiens
aaacaauuggcaaacuuugu

SEQ ID NO: 393025 - RNA, 20 nt, Homo sapiens
aaacacgccugcaaacgcug

SEQ ID NO: 393026 - RNA, 23 nt, Homo sapiens
aaacacgccugcaaacgcugccu

SEQ ID NO: 393027 - RNA, 17 nt, Homo sapiens
aaacagaacugcaguca

SEQ ID NO: 393028 - RNA, 17 nt, Homo sapiens
aaacagccccucuggac

SEQ ID NO: 393029 - RNA, 23 nt, Homo sapiens
aaacauugauuauaagcauguau

SEQ ID NO: 393030 - RNA, 19 nt, Homo sapiens
aaaccaagccguggcuucc

SEQ ID NO: 393031 - RNA, 22 nt, Homo sapiens
aaaccaucauaguacagguaag

SEQ ID NO: 393032 - RNA, 17 nt, Homo sapiens
aaacccaauucagucuc

SEQ ID NO: 393033 - RNA, 13 nt, Homo sapiens
aaaccccaucucu

SEQ ID NO: 393034 - RNA, 20 nt, Homo sapiens
aaacccccacccuucugccu

SEQ ID NO: 393035 - RNA, 17 nt, Homo sapiens
aaacccccacuccagcu

SEQ ID NO: 393036 - RNA, 15 nt, Homo sapiens
aaaccgagugcaaug

SEQ ID NO: 393037 - RNA, 12 nt, Homo sapiens
aaaccucugggu

SEQ ID NO: 393038 - RNA, 13 nt, Homo sapiens
aaaccuucaguga

SEQ ID NO: 393039 - RNA, 17 nt, Homo sapiens
aaacuaccuuccaguuc

SEQ ID NO: 393040 - RNA, 20 nt, Homo sapiens
aaacucacagaacuauguac

SEQ ID NO: 393041 - RNA, 11 nt, Homo sapiens
aaacucaggga

SEQ ID NO: 393042 - RNA, 12 nt, Homo sapiens
aaacucagggac

SEQ ID NO: 393043 - RNA, 18 nt, Homo sapiens
aaacuccugggcucaggc

SEQ ID NO: 393044 - RNA, 21 nt, Homo sapiens
aaacugacaguaaaucucaca

SEQ ID NO: 393045 - RNA, 21 nt, Homo sapiens
aaacugagaugugaacacauc

SEQ ID NO: 393046 - RNA, 13 nt, Homo sapiens
aaacugauuuauc

SEQ ID NO: 393047 - RNA, 20 nt, Homo sapiens
aaacugauuuuuagcuuuac

SEQ ID NO: 393048 - RNA, 15 nt, Homo sapiens
aaacuucauggucau

SEQ ID NO: 393049 - RNA, 15 nt, Homo sapiens
aaacuugcuuaucaa

SEQ ID NO: 393050 - RNA, 18 nt, Homo sapiens
aaacuuuaugcuaaguga

SEQ ID NO: 393051 - RNA, 20 nt, Homo sapiens
aaacuuuucuaauacucuac

SEQ ID NO: 393052 - RNA, 21 nt, Homo sapiens
aaagaaaaucaggcuggccaa

SEQ ID NO: 393053 - RNA, 18 nt, Homo sapiens
aaagaaagccucagagaa

SEQ ID NO: 393054 - RNA, 14 nt, Homo sapiens
aaagaaagcuuuag

SEQ ID NO: 393055 - RNA, 18 nt, Homo sapiens
aaagaaaucuucauuuau

SEQ ID NO: 393056 - RNA, 18 nt, Homo sapiens
aaagacaccuacugagug

SEQ ID NO: 393057 - RNA, 19 nt, Homo sapiens
aaagacauucuuccaaaaa

SEQ ID NO: 393058 - RNA, 21 nt, Homo sapiens
aaagacauucuuccaaaaaga

SEQ ID NO: 393059 - RNA, 15 nt, Homo sapiens
aaagagcacuuaaga

SEQ ID NO: 393060 - RNA, 20 nt, Homo sapiens
aaagaugaucuacucagaaa

SEQ ID NO: 393061 - RNA, 15 nt, Homo sapiens
aaagauggaugugcu

SEQ ID NO: 393062 - RNA, 21 nt, Homo sapiens
aaagauggcugugccucugcc

SEQ ID NO: 393063 - RNA, 19 nt, Homo sapiens
aaagauguuugucagauau

SEQ ID NO: 393064 - RNA, 20 nt, Homo sapiens
aaagcaaguuucaucaguca

SEQ ID NO: 393065 - RNA, 12 nt, Homo sapiens
aaagcaccugcc

SEQ ID NO: 393066 - RNA, 19 nt, Homo sapiens
aaagcagcccccauuuccu

SEQ ID NO: 393067 - RNA, 19 nt, Homo sapiens
aaagcagcucaaaggcaca

SEQ ID NO: 393068 - RNA, 16 nt, Homo sapiens
aaagcagggacuugaa

SEQ ID NO: 393069 - RNA, 18 nt, Homo sapiens
aaagcaggggaguaugca

SEQ ID NO: 393070 - RNA, 22 nt, Homo sapiens
aaagcauuacauuuccaaauga

SEQ ID NO: 393071 - RNA, 15 nt, Homo sapiens
aaagccaacagucaa

SEQ ID NO: 393072 - RNA, 15 nt, Homo sapiens
aaagcccuuccaugu

SEQ ID NO: 393073 - RNA, 18 nt, Homo sapiens
aaagccugagaagaaaga

SEQ ID NO: 393074 - RNA, 18 nt, Homo sapiens
aaagccugccucuuccag

SEQ ID NO: 393075 - RNA, 20 nt, Homo sapiens
aaagccugccucuuccagga

SEQ ID NO: 393076 - RNA, 19 nt, Homo sapiens
aaaggaagcuccacuguca

SEQ ID NO: 393077 - RNA, 20 nt, Homo sapiens
aaaggaagcuccacugucac

SEQ ID NO: 393078 - RNA, 21 nt, Homo sapiens
aaaggagccaauugauuucaa

SEQ ID NO: 393079 - RNA, 11 nt, Homo sapiens
aaaggcaguuc

SEQ ID NO: 393080 - RNA, 15 nt, Homo sapiens
aaagguucucaggug

SEQ ID NO: 393081 - RNA, 22 nt, Homo sapiens
aaagguugacaauaaaugugcu

SEQ ID NO: 393082 - RNA, 17 nt, Homo sapiens
aaaguaugguauugaaa

SEQ ID NO: 393083 - RNA, 16 nt, Homo sapiens
aaagucaagauuucca

SEQ ID NO: 393084 - RNA, 17 nt, Homo sapiens
aaaguguugaccacaga

SEQ ID NO: 393085 - RNA, 12 nt, Homo sapiens
aaaguuaugaaa

SEQ ID NO: 393086 - RNA, 23 nt, Homo sapiens
aaaguuaugguacuauguuagcc

SEQ ID NO: 393087 - RNA, 14 nt, Homo sapiens
aaaguuucagagaa

SEQ ID NO: 393088 - RNA, 15 nt, Homo sapiens
aaauaaaaaccaaga

SEQ ID NO: 393089 - RNA, 17 nt, Homo sapiens
aaauaaaaugcagacag

SEQ ID NO: 393090 - RNA, 23 nt, Homo sapiens
aaauaacagaaagccugggugac

SEQ ID NO: 393091 - RNA, 23 nt, Homo sapiens
aaauaagacggauuuauuuuucc

SEQ ID NO: 393092 - RNA, 21 nt, Homo sapiens
aaauacaauaaacuuacuaua

SEQ ID NO: 393093 - RNA, 19 nt, Homo sapiens
aaauacacacucaaaucaa

SEQ ID NO: 393094 - RNA, 16 nt, Homo sapiens
aaauacauauuuccaa

SEQ ID NO: 393095 - RNA, 16 nt, Homo sapiens
aaauaccaaguauuua

SEQ ID NO: 393096 - RNA, 19 nt, Homo sapiens
aaauacuucuugaagccga

SEQ ID NO: 393097 - RNA, 17 nt, Homo sapiens
aaauagagccugaggga

SEQ ID NO: 393098 - RNA, 19 nt, Homo sapiens
aaauaguuuaugauuccac

SEQ ID NO: 393099 - RNA, 20 nt, Homo sapiens
aaauauggaacuucuaauau

SEQ ID NO: 393100 - RNA, 13 nt, Homo sapiens
aaauauuccugca

SEQ ID NO: 393101 - RNA, 12 nt, Homo sapiens
aaauauuuugcu

SEQ ID NO: 393102 - RNA, 15 nt, Homo sapiens
aaauauuuuugccau

SEQ ID NO: 393103 - RNA, 20 nt, Homo sapiens
aaaucaccacaccaaaccuc

SEQ ID NO: 393104 - RNA, 19 nt, Homo sapiens
aaaucauuaauacucuucu

SEQ ID NO: 393105 - RNA, 16 nt, Homo sapiens
aaaucuaagugauaua

SEQ ID NO: 393106 - RNA, 13 nt, Homo sapiens
aaaucucuaauau

SEQ ID NO: 393107 - RNA, 19 nt, Homo sapiens
aaaucuuguuggcaaauca

SEQ ID NO: 393108 - RNA, 14 nt, Homo sapiens
aaaucuuuuaguca

SEQ ID NO: 393109 - RNA, 15 nt, Homo sapiens
aaaugaaaauguuuc

SEQ ID NO: 393110 - RNA, 14 nt, Homo sapiens
aaaugacaaaaagc

SEQ ID NO: 393111 - RNA, 15 nt, Homo sapiens
aaaugagaacaugaa

SEQ ID NO: 393112 - RNA, 18 nt, Homo sapiens
aaaugcauccauuccuca

SEQ ID NO: 393113 - RNA, 20 nt, Homo sapiens
aaaugccacacggcucucac

SEQ ID NO: 393114 - RNA, 16 nt, Homo sapiens
aaauggguuggugcuu

SEQ ID NO: 393115 - RNA, 16 nt, Homo sapiens
aaauguacauuaauua

SEQ ID NO: 393116 - RNA, 16 nt, Homo sapiens
aaaugugaagugaaug

SEQ ID NO: 393117 - RNA, 22 nt, Homo sapiens
aaauguuauuuuuuaauuauua

SEQ ID NO: 393118 - RNA, 23 nt, Homo sapiens
aaauguuccauauguggguguca

SEQ ID NO: 393119 - RNA, 17 nt, Homo sapiens
aaauuaacaguccuaac

SEQ ID NO: 393120 - RNA, 13 nt, Homo sapiens
aaauuagcuugag

SEQ ID NO: 393121 - RNA, 16 nt, Homo sapiens
aaauuauaucucagua

SEQ ID NO: 393122 - RNA, 14 nt, Homo sapiens
aaauucaaacugcc

SEQ ID NO: 393123 - RNA, 15 nt, Homo sapiens
aaauucaagccuuag

SEQ ID NO: 393124 - RNA, 22 nt, Homo sapiens
aaauucauuuuuuucacuggag

SEQ ID NO: 393125 - RNA, 23 nt, Homo sapiens
aaauuccuuagcuuagaccucag

SEQ ID NO: 393126 - RNA, 13 nt, Homo sapiens
aaauugaacucuu

SEQ ID NO: 393127 - RNA, 15 nt, Homo sapiens
aaauuguauuaucaa

SEQ ID NO: 393128 - RNA, 22 nt, Homo sapiens
aaauuguauuaucaacagcauu

SEQ ID NO: 393129 - RNA, 16 nt, Homo sapiens
aaauuuuuguuuauaa

SEQ ID NO: 393130 - RNA, 19 nt, Homo sapiens
aacaaaaauguaaugauca

SEQ ID NO: 393131 - RNA, 20 nt, Homo sapiens
aacaaaaauguaaugaucau

SEQ ID NO: 393132 - RNA, 20 nt, Homo sapiens
aacaaaaauuaaaauccuca

SEQ ID NO: 393133 - RNA, 15 nt, Homo sapiens
aacaaacaaacaauu

SEQ ID NO: 393134 - RNA, 23 nt, Homo sapiens
aacaaacuacauguaauccauca

SEQ ID NO: 393135 - RNA, 12 nt, Homo sapiens
aacaaagccaga

SEQ ID NO: 393136 - RNA, 15 nt, Homo sapiens
aacaaauuauguuac

SEQ ID NO: 393137 - RNA, 22 nt, Homo sapiens
aacaaccuggucacaggacucu

SEQ ID NO: 393138 - RNA, 14 nt, Homo sapiens
aacaacuacuguga

SEQ ID NO: 393139 - RNA, 22 nt, Homo sapiens
aacaauuccaaaggaaucucca

SEQ ID NO: 393140 - RNA, 22 nt, Homo sapiens
aacacagcgagacuccgucuca

SEQ ID NO: 393141 - RNA, 23 nt, Homo sapiens
aacacgccugcaaacgcugccug

SEQ ID NO: 393142 - RNA, 21 nt, Homo sapiens
aacacggggcuugcaacuuag

SEQ ID NO: 393143 - RNA, 22 nt, Homo sapiens
aacacuuuacaauguucauccc

SEQ ID NO: 393144 - RNA, 17 nt, Homo sapiens
aacagaacuaucucagc

SEQ ID NO: 393145 - RNA, 14 nt, Homo sapiens
aacagaagcaguug

SEQ ID NO: 393146 - RNA, 19 nt, Homo sapiens
aacagcagauuucagauca

SEQ ID NO: 393147 - RNA, 14 nt, Homo sapiens
aacagucucaggaa

SEQ ID NO: 393148 - RNA, 22 nt, Homo sapiens
aacaguuuuuuaugcuaaucag

SEQ ID NO: 393149 - RNA, 21 nt, Homo sapiens
aacauagaacucagagccaga

SEQ ID NO: 393150 - RNA, 20 nt, Homo sapiens
aacaucacugaaaugcuagc

SEQ ID NO: 393151 - RNA, 20 nt, Homo sapiens
aacaucccugccagcucuuc

SEQ ID NO: 393152 - RNA, 13 nt, Homo sapiens
aacaugcuuuaga

SEQ ID NO: 393153 - RNA, 13 nt, Homo sapiens
aacaugugcucag

SEQ ID NO: 393154 - RNA, 14 nt, Homo sapiens
aacaugugcucagg

SEQ ID NO: 393155 - RNA, 21 nt, Homo sapiens
aacauguuagaagcaaugaau

SEQ ID NO: 393156 - RNA, 22 nt, Homo sapiens
aacauguuccuuauauuuacuc

SEQ ID NO: 393157 - RNA, 11 nt, Homo sapiens
aaccacaucaa

SEQ ID NO: 393158 - RNA, 16 nt, Homo sapiens
aaccaucaucuugcca

SEQ ID NO: 393159 - RNA, 15 nt, Homo sapiens
aacccaaauguucau

SEQ ID NO: 393160 - RNA, 16 nt, Homo sapiens
aaccccaucucuacaa

SEQ ID NO: 393161 - RNA, 12 nt, Homo sapiens
aacccugucucu

SEQ ID NO: 393162 - RNA, 12 nt, Homo sapiens
aacccugucuga

SEQ ID NO: 393163 - RNA, 14 nt, Homo sapiens
aacccuugcuugca

SEQ ID NO: 393164 - RNA, 17 nt, Homo sapiens
aaccgcaggaagcugcu

SEQ ID NO: 393165 - RNA, 19 nt, Homo sapiens
aaccgcaggaagcugcucc

SEQ ID NO: 393166 - RNA, 20 nt, Homo sapiens
aaccuacuuucauacugaag

SEQ ID NO: 393167 - RNA, 11 nt, Homo sapiens
aaccucagggc

SEQ ID NO: 393168 - RNA, 20 nt, Homo sapiens
aaccuccccaacagcacuua

SEQ ID NO: 393169 - RNA, 22 nt, Homo sapiens
aaccucugggucaucucucaca

SEQ ID NO: 393170 - RNA, 13 nt, Homo sapiens
aaccugaccagug

SEQ ID NO: 393171 - RNA, 23 nt, Homo sapiens
aaccuguaaagcaggugcccagg

SEQ ID NO: 393172 - RNA, 14 nt, Homo sapiens
aaccuguccuugca

SEQ ID NO: 393173 - RNA, 15 nt, Homo sapiens
aaccuguccuugcac

SEQ ID NO: 393174 - RNA, 16 nt, Homo sapiens
aaccuguccuugcaca

SEQ ID NO: 393175 - RNA, 17 nt, Homo sapiens
aaccuuccaucucgcca

SEQ ID NO: 393176 - RNA, 11 nt, Homo sapiens
aaccuuucaaa

SEQ ID NO: 393177 - RNA, 19 nt, Homo sapiens
aacggagagcgccugcccc

SEQ ID NO: 393178 - RNA, 18 nt, Homo sapiens
aacggugagcauuguggc

SEQ ID NO: 393179 - RNA, 21 nt, Homo sapiens
aacguggggcagcacagagag

SEQ ID NO: 393180 - RNA, 19 nt, Homo sapiens
aacuaagaaauaugcacaa

SEQ ID NO: 393181 - RNA, 17 nt, Homo sapiens
aacuaauaaaagcauaa

SEQ ID NO: 393182 - RNA, 22 nt, Homo sapiens
aacuaauaaaagcauaaaugca

SEQ ID NO: 393183 - RNA, 16 nt, Homo sapiens
aacucaaacucuuaaa

SEQ ID NO: 393184 - RNA, 20 nt, Homo sapiens
aacucaaacucuuaaaaccc

SEQ ID NO: 393185 - RNA, 15 nt, Homo sapiens
aacucacaauuccaa

SEQ ID NO: 393186 - RNA, 22 nt, Homo sapiens
aacucagagucggaacggagaa

SEQ ID NO: 393187 - RNA, 21 nt, Homo sapiens
aacucuccuggacugccuuga

SEQ ID NO: 393188 - RNA, 21 nt, Homo sapiens
aacucugagaucuaaggaugu

SEQ ID NO: 393189 - RNA, 19 nt, Homo sapiens
aacucugguaaaugaucac

SEQ ID NO: 393190 - RNA, 14 nt, Homo sapiens
aacugaagccagaa

SEQ ID NO: 393191 - RNA, 14 nt, Homo sapiens
aacugauuuaucua

SEQ ID NO: 393192 - RNA, 18 nt, Homo sapiens
aacugauuuuuagcuuua

SEQ ID NO: 393193 - RNA, 21 nt, Homo sapiens
aacugauuuuuagcuuuacaa

SEQ ID NO: 393194 - RNA, 18 nt, Homo sapiens
aacugcuugaacccagga

SEQ ID NO: 393195 - RNA, 14 nt, Homo sapiens
aacuggacucagga

SEQ ID NO: 393196 - RNA, 19 nt, Homo sapiens
aacuggaggaguuccuuga

SEQ ID NO: 393197 - RNA, 20 nt, Homo sapiens
aacuggaggaguuccuugau

SEQ ID NO: 393198 - RNA, 16 nt, Homo sapiens
aacuguagucucagga

SEQ ID NO: 393199 - RNA, 14 nt, Homo sapiens
aacuguaugaaugu

SEQ ID NO: 393200 - RNA, 12 nt, Homo sapiens
aacuguauuuau

SEQ ID NO: 393201 - RNA, 21 nt, Homo sapiens
aacuguuggcaaggugacauu

SEQ ID NO: 393202 - RNA, 12 nt, Homo sapiens
aacuuagcucac

SEQ ID NO: 393203 - RNA, 22 nt, Homo sapiens
aacuuccuuggacucauuuuaa

SEQ ID NO: 393204 - RNA, 19 nt, Homo sapiens
aacuuggauguaccugccc

SEQ ID NO: 393205 - RNA, 12 nt, Homo sapiens
aacuugggccac

SEQ ID NO: 393206 - RNA, 18 nt, Homo sapiens
aacuugggggaggaggaa

SEQ ID NO: 393207 - RNA, 13 nt, Homo sapiens
aacuuuggcuuau

SEQ ID NO: 393208 - RNA, 14 nt, Homo sapiens
aagaaaacaacuuc

SEQ ID NO: 393209 - RNA, 18 nt, Homo sapiens
aagaaaauaugcaucuaa

SEQ ID NO: 393210 - RNA, 13 nt, Homo sapiens
aagaaagcuuuag

SEQ ID NO: 393211 - RNA, 17 nt, Homo sapiens
aagaaaguguuggcuaa

SEQ ID NO: 393212 - RNA, 14 nt, Homo sapiens
aagaaauuuuugcc

SEQ ID NO: 393213 - RNA, 17 nt, Homo sapiens
aagaagugggacuuccc

SEQ ID NO: 393214 - RNA, 13 nt, Homo sapiens
aagaaucuaauag

SEQ ID NO: 393215 - RNA, 14 nt, Homo sapiens
aagacauucuucca

SEQ ID NO: 393216 - RNA, 21 nt, Homo sapiens
aagaccagcuuugcagugaca

SEQ ID NO: 393217 - RNA, 22 nt, Homo sapiens
aagaccugcugagggaccagcc

SEQ ID NO: 393218 - RNA, 20 nt, Homo sapiens
aagacuucaguauguuguca

SEQ ID NO: 393219 - RNA, 16 nt, Homo sapiens
aagacuugguguccuu

SEQ ID NO: 393220 - RNA, 16 nt, Homo sapiens
aagagaaccauaucaa

SEQ ID NO: 393221 - RNA, 18 nt, Homo sapiens
aagagaccaagacucuga

SEQ ID NO: 393222 - RNA, 21 nt, Homo sapiens
aagagaggaaugccuguguga

SEQ ID NO: 393223 - RNA, 22 nt, Homo sapiens
aagagcccccuugacaccgggg

SEQ ID NO: 393224 - RNA, 15 nt, Homo sapiens
aagaggauagaauac

SEQ ID NO: 393225 - RNA, 23 nt, Homo sapiens
aagaggcagcuugaaacugagau

SEQ ID NO: 393226 - RNA, 23 nt, Homo sapiens
aagaggcccugucuguaccuaac

SEQ ID NO: 393227 - RNA, 20 nt, Homo sapiens
aagagggugauugcuggggc

SEQ ID NO: 393228 - RNA, 16 nt, Homo sapiens
aagauauuuuucauga

SEQ ID NO: 393229 - RNA, 17 nt, Homo sapiens
aagaugaucauuugccc

SEQ ID NO: 393230 - RNA, 16 nt, Homo sapiens
aagaugcccacugagg

SEQ ID NO: 393231 - RNA, 20 nt, Homo sapiens
aagaugcuucucacugccau

SEQ ID NO: 393232 - RNA, 17 nt, Homo sapiens
aagaugggaaaaccaug

SEQ ID NO: 393233 - RNA, 22 nt, Homo sapiens
aagaugugggcagugaugucac

SEQ ID NO: 393234 - RNA, 20 nt, Homo sapiens
aagauucauauuuacuucuu

SEQ ID NO: 393235 - RNA, 21 nt, Homo sapiens
aagauucauauuuacuucuua

SEQ ID NO: 393236 - RNA, 17 nt, Homo sapiens
aagauucuccugugcua

SEQ ID NO: 393237 - RNA, 20 nt, Homo sapiens
aagauugcgccauugcacuc

SEQ ID NO: 393238 - RNA, 16 nt, Homo sapiens
aagcaaaaugugauau

SEQ ID NO: 393239 - RNA, 12 nt, Homo sapiens
aagcaacaauac

SEQ ID NO: 393240 - RNA, 21 nt, Homo sapiens
aagcaaguuucaucagucaau

SEQ ID NO: 393241 - RNA, 19 nt, Homo sapiens
aagcacauaugaacuggac

SEQ ID NO: 393242 - RNA, 16 nt, Homo sapiens
aagcagaacagugauu

SEQ ID NO: 393243 - RNA, 16 nt, Homo sapiens
aagcaggaagcucaga

SEQ ID NO: 393244 - RNA, 15 nt, Homo sapiens
aagcaguuaguuccu

SEQ ID NO: 393245 - RNA, 23 nt, Homo sapiens
aagcaucucagccuaccaugaga

SEQ ID NO: 393246 - RNA, 19 nt, Homo sapiens
aagcauucacaacuuguuu

SEQ ID NO: 393247 - RNA, 13 nt, Homo sapiens
aagcauucuucaa

SEQ ID NO: 393248 - RNA, 18 nt, Homo sapiens
aagcauugagcaaagggg

SEQ ID NO: 393249 - RNA, 18 nt, Homo sapiens
aagcauuucuagcaguga

SEQ ID NO: 393250 - RNA, 22 nt, Homo sapiens
aagcauuucuagcagugaugaa

SEQ ID NO: 393251 - RNA, 17 nt, Homo sapiens
aagccagaagcugagca

SEQ ID NO: 393252 - RNA, 14 nt, Homo sapiens
aagccagacaucaa

SEQ ID NO: 393253 - RNA, 14 nt, Homo sapiens
aagcccuaagugac

SEQ ID NO: 393254 - RNA, 15 nt, Homo sapiens
aagccgugauuuuca

SEQ ID NO: 393255 - RNA, 18 nt, Homo sapiens
aagccuagcccuucucuc

SEQ ID NO: 393256 - RNA, 20 nt, Homo sapiens
aagccuagcccuucucucau

SEQ ID NO: 393257 - RNA, 14 nt, Homo sapiens
aagccugugaaagg

SEQ ID NO: 393258 - RNA, 18 nt, Homo sapiens
aagcucaucucagcuccu

SEQ ID NO: 393259 - RNA, 22 nt, Homo sapiens
aagcucaucucagcuccugaaa

SEQ ID NO: 393260 - RNA, 12 nt, Homo sapiens
aagcuccacugu

SEQ ID NO: 393261 - RNA, 19 nt, Homo sapiens
aagcuccugccucuuugug

SEQ ID NO: 393262 - RNA, 20 nt, Homo sapiens
aagcugagcaccaggggaug

SEQ ID NO: 393263 - RNA, 18 nt, Homo sapiens
aagcugccucaaggaauu

SEQ ID NO: 393264 - RNA, 14 nt, Homo sapiens
aagcugucuuagag

SEQ ID NO: 393265 - RNA, 22 nt, Homo sapiens
aagcuguguccuugcaccugca

SEQ ID NO: 393266 - RNA, 19 nt, Homo sapiens
aagcuguuuccauagggug

SEQ ID NO: 393267 - RNA, 16 nt, Homo sapiens
aaggaagcuccacugu

SEQ ID NO: 393268 - RNA, 18 nt, Homo sapiens
aaggacacuagaagauuu

SEQ ID NO: 393269 - RNA, 23 nt, Homo sapiens
aaggauacuguaacacuuuacaa

SEQ ID NO: 393270 - RNA, 14 nt, Homo sapiens
aaggauacuuuaca

SEQ ID NO: 393271 - RNA, 16 nt, Homo sapiens
aaggaugagcauuuag

SEQ ID NO: 393272 - RNA, 14 nt, Homo sapiens
aaggaugggaagga

SEQ ID NO: 393273 - RNA, 13 nt, Homo sapiens
aaggcacagugaa

SEQ ID NO: 393274 - RNA, 16 nt, Homo sapiens
aaggcauuuucaucuu

SEQ ID NO: 393275 - RNA, 18 nt, Homo sapiens
aaggcccauaucugugaa

SEQ ID NO: 393276 - RNA, 23 nt, Homo sapiens
aaggcucgauuuuguaucugcag

SEQ ID NO: 393277 - RNA, 13 nt, Homo sapiens
aagggaaacuauu

SEQ ID NO: 393278 - RNA, 16 nt, Homo sapiens
aagggacauauucauu

SEQ ID NO: 393279 - RNA, 18 nt, Homo sapiens
aagggaugucucacaucc

SEQ ID NO: 393280 - RNA, 22 nt, Homo sapiens
aaggguucaccaggucagggag

SEQ ID NO: 393281 - RNA, 20 nt, Homo sapiens
aaggguucagagacucaggg

SEQ ID NO: 393282 - RNA, 19 nt, Homo sapiens
aagguauuuuaaucaccaa

SEQ ID NO: 393283 - RNA, 18 nt, Homo sapiens
aaggucacauugugccuu

SEQ ID NO: 393284 - RNA, 16 nt, Homo sapiens
aaggugaagagaccaa

SEQ ID NO: 393285 - RNA, 17 nt, Homo sapiens
aaggugagcaaagggcu

SEQ ID NO: 393286 - RNA, 21 nt, Homo sapiens
aaggugggaaggaugguccag

SEQ ID NO: 393287 - RNA, 18 nt, Homo sapiens
aagguggggauugcccau

SEQ ID NO: 393288 - RNA, 21 nt, Homo sapiens
aagguggggauugcccaucca

SEQ ID NO: 393289 - RNA, 15 nt, Homo sapiens
aagguggucacuguu

SEQ ID NO: 393290 - RNA, 12 nt, Homo sapiens
aaguacucauac

SEQ ID NO: 393291 - RNA, 14 nt, Homo sapiens
aaguagggacuucu

SEQ ID NO: 393292 - RNA, 22 nt, Homo sapiens
aaguagggguugugggugacca

SEQ ID NO: 393293 - RNA, 19 nt, Homo sapiens
aaguaggugugacuugaac

SEQ ID NO: 393294 - RNA, 14 nt, Homo sapiens
aagucaaccugccu

SEQ ID NO: 393295 - RNA, 15 nt, Homo sapiens
aagucaccuccuuaa

SEQ ID NO: 393296 - RNA, 18 nt, Homo sapiens
aaguccaagcauaccaac

SEQ ID NO: 393297 - RNA, 17 nt, Homo sapiens
aagucuaaauaaaugaa

SEQ ID NO: 393298 - RNA, 23 nt, Homo sapiens
aagucuaaauaaaugaaguauuu

SEQ ID NO: 393299 - RNA, 17 nt, Homo sapiens
aagugaaauaagccaga

SEQ ID NO: 393300 - RNA, 18 nt, Homo sapiens
aagugaagagauccuucu

SEQ ID NO: 393301 - RNA, 19 nt, Homo sapiens
aaguggggaaguguuccag

SEQ ID NO: 393302 - RNA, 12 nt, Homo sapiens
aagugugugauc

SEQ ID NO: 393303 - RNA, 15 nt, Homo sapiens
aaguuaacuuccaau

SEQ ID NO: 393304 - RNA, 17 nt, Homo sapiens
aaguuguggugcugaca

SEQ ID NO: 393305 - RNA, 20 nt, Homo sapiens
aaguuguggugcugacaaag

SEQ ID NO: 393306 - RNA, 13 nt, Homo sapiens
aaguuugagauca

SEQ ID NO: 393307 - RNA, 17 nt, Homo sapiens
aauaaacuagacucuga

SEQ ID NO: 393308 - RNA, 14 nt, Homo sapiens
aauaaagcuugcaa

SEQ ID NO: 393309 - RNA, 16 nt, Homo sapiens
aauaaauguacauuaa

SEQ ID NO: 393310 - RNA, 14 nt, Homo sapiens
aauaaauugcuccu

SEQ ID NO: 393311 - RNA, 14 nt, Homo sapiens
aauaauaccuaagc

SEQ ID NO: 393312 - RNA, 18 nt, Homo sapiens
aauaaucauucuuauuuc

SEQ ID NO: 393313 - RNA, 22 nt, Homo sapiens
aauaaugaguuagaacuauuaa

SEQ ID NO: 393314 - RNA, 16 nt, Homo sapiens
aauaauguacaucugg

SEQ ID NO: 393315 - RNA, 17 nt, Homo sapiens
aauacaauuagccaggu

SEQ ID NO: 393316 - RNA, 16 nt, Homo sapiens
aauacacuaauuccuu

SEQ ID NO: 393317 - RNA, 19 nt, Homo sapiens
aauacaugcugcuaauuca

SEQ ID NO: 393318 - RNA, 20 nt, Homo sapiens
aauaccucaaccuaugguau

SEQ ID NO: 393319 - RNA, 18 nt, Homo sapiens
aauacgguaaggauacuu

SEQ ID NO: 393320 - RNA, 23 nt, Homo sapiens
aauacugaaggacacagcagugg

SEQ ID NO: 393321 - RNA, 22 nt, Homo sapiens
aauagacuuaaaucucauugcu

SEQ ID NO: 393322 - RNA, 23 nt, Homo sapiens
aauagaucaaaguccagcaggca

SEQ ID NO: 393323 - RNA, 19 nt, Homo sapiens
aauagcagguaguccagga

SEQ ID NO: 393324 - RNA, 18 nt, Homo sapiens
aauagccugcgcuguuuu

SEQ ID NO: 393325 - RNA, 21 nt, Homo sapiens
aauaguauuugagaguucuaa

SEQ ID NO: 393326 - RNA, 16 nt, Homo sapiens
aauauagaaugaaaga

SEQ ID NO: 393327 - RNA, 19 nt, Homo sapiens
aauaucugggauucuacuu

SEQ ID NO: 393328 - RNA, 19 nt, Homo sapiens
aauaugcacaauagcaguu

SEQ ID NO: 393329 - RNA, 20 nt, Homo sapiens
aauauuuauuauuuucaccu

SEQ ID NO: 393330 - RNA, 14 nt, Homo sapiens
aaucaaaugcaauu

SEQ ID NO: 393331 - RNA, 20 nt, Homo sapiens
aaucacacgucuggcuucac

SEQ ID NO: 393332 - RNA, 19 nt, Homo sapiens
aaucaccaaggcugauuaa

SEQ ID NO: 393333 - RNA, 20 nt, Homo sapiens
aaucagauucuucucucuca

SEQ ID NO: 393334 - RNA, 17 nt, Homo sapiens
aaucagcauucucacuc

SEQ ID NO: 393335 - RNA, 16 nt, Homo sapiens
aaucauaaaacuugau

SEQ ID NO: 393336 - RNA, 17 nt, Homo sapiens
aaucauuuuaauuauua

SEQ ID NO: 393337 - RNA, 20 nt, Homo sapiens
aauccaugaaccaagaccau

SEQ ID NO: 393338 - RNA, 14 nt, Homo sapiens
aaucccagcacuuu

SEQ ID NO: 393339 - RNA, 16 nt, Homo sapiens
aauccuguccucagcu

SEQ ID NO: 393340 - RNA, 22 nt, Homo sapiens
aauccuguccucagcuucuuaa

SEQ ID NO: 393341 - RNA, 19 nt, Homo sapiens
aauccuuuacuguuaguca

SEQ ID NO: 393342 - RNA, 11 nt, Homo sapiens
aaucucacaaa

SEQ ID NO: 393343 - RNA, 21 nt, Homo sapiens
aaucuuccuuuguugcacaaa

SEQ ID NO: 393344 - RNA, 18 nt, Homo sapiens
aaucuucuugauccacuu

SEQ ID NO: 393345 - RNA, 13 nt, Homo sapiens
aaugaagugcaaa

SEQ ID NO: 393346 - RNA, 14 nt, Homo sapiens
aaugaaucuucaca

SEQ ID NO: 393347 - RNA, 15 nt, Homo sapiens
aaugaaucuucacaa

SEQ ID NO: 393348 - RNA, 22 nt, Homo sapiens
aaugacaaagaguagacauuuc

SEQ ID NO: 393349 - RNA, 15 nt, Homo sapiens
aaugaugggacaaua

SEQ ID NO: 393350 - RNA, 18 nt, Homo sapiens
aaugauuuuaucugugaa

SEQ ID NO: 393351 - RNA, 11 nt, Homo sapiens
aaugcaacuuc

SEQ ID NO: 393352 - RNA, 14 nt, Homo sapiens
aaugcacacaaaac

SEQ ID NO: 393353 - RNA, 10 nt, Homo sapiens
aaugcagugg

SEQ ID NO: 393354 - RNA, 19 nt, Homo sapiens
aaugcauauccaacaugug

SEQ ID NO: 393355 - RNA, 20 nt, Homo sapiens
aaugcauauccaacaugugc

SEQ ID NO: 393356 - RNA, 23 nt, Homo sapiens
aaugccacaaaacugacaguaaa

SEQ ID NO: 393357 - RNA, 22 nt, Homo sapiens
aaugccagagacggaagccuuu

SEQ ID NO: 393358 - RNA, 23 nt, Homo sapiens
aaugcccagugaccagucacuga

SEQ ID NO: 393359 - RNA, 17 nt, Homo sapiens
aaugcuaauuaggcaaa

SEQ ID NO: 393360 - RNA, 23 nt, Homo sapiens
aaugcuaggaguagaaaaugguc

SEQ ID NO: 393361 - RNA, 23 nt, Homo sapiens
aaugcucaagaaacaacuucuac

SEQ ID NO: 393362 - RNA, 16 nt, Homo sapiens
aauggauaaguagaau

SEQ ID NO: 393363 - RNA, 19 nt, Homo sapiens
aauggaucuuaaagcauuc

SEQ ID NO: 393364 - RNA, 15 nt, Homo sapiens
aaugggaaaagagau

SEQ ID NO: 393365 - RNA, 18 nt, Homo sapiens
aaugguagcaacugaaag

SEQ ID NO: 393366 - RNA, 19 nt, Homo sapiens
aaugguaggauaucuuggc

SEQ ID NO: 393367 - RNA, 20 nt, Homo sapiens
aauguaagggaaacugccag

SEQ ID NO: 393368 - RNA, 22 nt, Homo sapiens
aauguaagggaaacugccagca

SEQ ID NO: 393369 - RNA, 13 nt, Homo sapiens
aauguauugaacu

SEQ ID NO: 393370 - RNA, 20 nt, Homo sapiens
aauguauuuguuugcaauuu

SEQ ID NO: 393371 - RNA, 19 nt, Homo sapiens
aaugucaucagaacuuuuu

SEQ ID NO: 393372 - RNA, 22 nt, Homo sapiens
aaugugaaaaugguccaggaga

SEQ ID NO: 393373 - RNA, 15 nt, Homo sapiens
aaugugauugcagcu

SEQ ID NO: 393374 - RNA, 18 nt, Homo sapiens
aaugugcagcucccauuu

SEQ ID NO: 393375 - RNA, 13 nt, Homo sapiens
aauguuaagcaga

SEQ ID NO: 393376 - RNA, 15 nt, Homo sapiens
aauguuacauuauua

SEQ ID NO: 393377 - RNA, 16 nt, Homo sapiens
aauguuacauuauuau

SEQ ID NO: 393378 - RNA, 22 nt, Homo sapiens
aauguuauuuuuuaauuauuau

SEQ ID NO: 393379 - RNA, 15 nt, Homo sapiens
aauguucacuuuuga

SEQ ID NO: 393380 - RNA, 19 nt, Homo sapiens
aauuaaugacagagccagu

SEQ ID NO: 393381 - RNA, 21 nt, Homo sapiens
aauuauuauuuauauauguau

SEQ ID NO: 393382 - RNA, 14 nt, Homo sapiens
aauucaagccuuag

SEQ ID NO: 393383 - RNA, 19 nt, Homo sapiens
aauucagcacugauuucac

SEQ ID NO: 393384 - RNA, 20 nt, Homo sapiens
aauucagugggaccaaugaa

SEQ ID NO: 393385 - RNA, 15 nt, Homo sapiens
aauucggugugcacc

SEQ ID NO: 393386 - RNA, 13 nt, Homo sapiens
aauucuacuuuga

SEQ ID NO: 393387 - RNA, 14 nt, Homo sapiens
aauucuacuuugag

SEQ ID NO: 393388 - RNA, 23 nt, Homo sapiens
aauucucaugugauccuuuuaug

SEQ ID NO: 393389 - RNA, 21 nt, Homo sapiens
aauucucuuauccaacaucaa

SEQ ID NO: 393390 - RNA, 13 nt, Homo sapiens
aauugacaggauu

SEQ ID NO: 393391 - RNA, 20 nt, Homo sapiens
aauugcacuuuuaaaccucu

SEQ ID NO: 393392 - RNA, 18 nt, Homo sapiens
aauuguaucaaaugugac

SEQ ID NO: 393393 - RNA, 19 nt, Homo sapiens
aauugugaucagaccauaa

SEQ ID NO: 393394 - RNA, 18 nt, Homo sapiens
aauuuacuugccauuacu

SEQ ID NO: 393395 - RNA, 20 nt, Homo sapiens
aauuuaucuugucucugggc

SEQ ID NO: 393396 - RNA, 18 nt, Homo sapiens
aauuuauuaaaaugauug

SEQ ID NO: 393397 - RNA, 15 nt, Homo sapiens
aauuuauuucaaaaa

SEQ ID NO: 393398 - RNA, 23 nt, Homo sapiens
aauuucacauuaauauuugcuga

SEQ ID NO: 393399 - RNA, 18 nt, Homo sapiens
aauuucacgucgucuucu

SEQ ID NO: 393400 - RNA, 20 nt, Homo sapiens
aauuucauaccuaucaucuu

SEQ ID NO: 393401 - RNA, 20 nt, Homo sapiens
aauuuccggccaacaguuaa

SEQ ID NO: 393402 - RNA, 20 nt, Homo sapiens
aauuucucccagucauuuaa

SEQ ID NO: 393403 - RNA, 15 nt, Homo sapiens
aauuugaugccagga

SEQ ID NO: 393404 - RNA, 12 nt, Homo sapiens
aauuuguacaua

SEQ ID NO: 393405 - RNA, 13 nt, Homo sapiens
aauuuuaauugaa

SEQ ID NO: 393406 - RNA, 13 nt, Homo sapiens
aauuuuaauugau

SEQ ID NO: 393407 - RNA, 21 nt, Homo sapiens
aauuuugccauaaagucaaau

SEQ ID NO: 393408 - RNA, 17 nt, Homo sapiens
aauuuuuugugauuuca

SEQ ID NO: 393409 - RNA, 20 nt, Homo sapiens
acaaaauaaccaauccugga

SEQ ID NO: 393410 - RNA, 12 nt, Homo sapiens
acaaaaucacac

SEQ ID NO: 393411 - RNA, 15 nt, Homo sapiens
acaaagcccuuccau

SEQ ID NO: 393412 - RNA, 17 nt, Homo sapiens
acaaaguguguauuaaa

SEQ ID NO: 393413 - RNA, 22 nt, Homo sapiens
acaaauaauuuuuaaauauaag

SEQ ID NO: 393414 - RNA, 15 nt, Homo sapiens
acaaauaugucaguu

SEQ ID NO: 393415 - RNA, 18 nt, Homo sapiens
acaaaugguagcauacuu

SEQ ID NO: 393416 - RNA, 21 nt, Homo sapiens
acaaauguuguauaaccaaua

SEQ ID NO: 393417 - RNA, 16 nt, Homo sapiens
acaaauucaagccuua

SEQ ID NO: 393418 - RNA, 16 nt, Homo sapiens
acaacuauuuuuccaa

SEQ ID NO: 393419 - RNA, 18 nt, Homo sapiens
acaacuguggucaauccg

SEQ ID NO: 393420 - RNA, 16 nt, Homo sapiens
acaacuucaauaucca

SEQ ID NO: 393421 - RNA, 22 nt, Homo sapiens
acaagaagccacagaccuagga

SEQ ID NO: 393422 - RNA, 22 nt, Homo sapiens
acaagacaggacccugggacca

SEQ ID NO: 393423 - RNA, 21 nt, Homo sapiens
acaagcagcaggaaacauaga

SEQ ID NO: 393424 - RNA, 16 nt, Homo sapiens
acaagcugcacccuca

SEQ ID NO: 393425 - RNA, 17 nt, Homo sapiens
acaauacaugcugcuaa

SEQ ID NO: 393426 - RNA, 15 nt, Homo sapiens
acaauagaaaccugu

SEQ ID NO: 393427 - RNA, 14 nt, Homo sapiens
acaaucagcuccuu

SEQ ID NO: 393428 - RNA, 15 nt, Homo sapiens
acaaucuguauauaa

SEQ ID NO: 393429 - RNA, 13 nt, Homo sapiens
acaaugugaaaag

SEQ ID NO: 393430 - RNA, 13 nt, Homo sapiens
acaauuagccagg

SEQ ID NO: 393431 - RNA, 17 nt, Homo sapiens
acacaaaacaaaugcca

SEQ ID NO: 393432 - RNA, 20 nt, Homo sapiens
acacaaacgggcucagcaaa

SEQ ID NO: 393433 - RNA, 10 nt, Homo sapiens
acacacucca

SEQ ID NO: 393434 - RNA, 13 nt, Homo sapiens
acacacuccauca

SEQ ID NO: 393435 - RNA, 18 nt, Homo sapiens
acacacugaggcagggaa

SEQ ID NO: 393436 - RNA, 15 nt, Homo sapiens
acacagcgagacucc

SEQ ID NO: 393437 - RNA, 20 nt, Homo sapiens
acacagcgagacuccgucuc

SEQ ID NO: 393438 - RNA, 22 nt, Homo sapiens
acacagcugcagagacagagag

SEQ ID NO: 393439 - RNA, 22 nt, Homo sapiens
acacaugauccugcaauuccac

SEQ ID NO: 393440 - RNA, 16 nt, Homo sapiens
acacauuguacauggu

SEQ ID NO: 393441 - RNA, 19 nt, Homo sapiens
acacccagucuguucccca

SEQ ID NO: 393442 - RNA, 14 nt, Homo sapiens
acaccugcugagaa

SEQ ID NO: 393443 - RNA, 22 nt, Homo sapiens
acaccuggcacugcugugcugu

SEQ ID NO: 393444 - RNA, 23 nt, Homo sapiens
acaccuggcacugcugugcugug

SEQ ID NO: 393445 - RNA, 18 nt, Homo sapiens
acacggggcuugcaacuu

SEQ ID NO: 393446 - RNA, 15 nt, Homo sapiens
acacuaacauauaau

SEQ ID NO: 393447 - RNA, 22 nt, Homo sapiens
acacuccagugccagcaaugac

SEQ ID NO: 393448 - RNA, 16 nt, Homo sapiens
acacuccccugcacug

SEQ ID NO: 393449 - RNA, 18 nt, Homo sapiens
acacucuacuacauguga

SEQ ID NO: 393450 - RNA, 15 nt, Homo sapiens
acacuuacacuuuau

SEQ ID NO: 393451 - RNA, 17 nt, Homo sapiens
acagaaaaaaucgucuc

SEQ ID NO: 393452 - RNA, 18 nt, Homo sapiens
acagaaagacugagcuca

SEQ ID NO: 393453 - RNA, 20 nt, Homo sapiens
acagaaagccugggugacau

SEQ ID NO: 393454 - RNA, 21 nt, Homo sapiens
acagaaagccugggugacauu

SEQ ID NO: 393455 - RNA, 16 nt, Homo sapiens
acagaacuaagaugau

SEQ ID NO: 393456 - RNA, 18 nt, Homo sapiens
acagaacuauguacuuua

SEQ ID NO: 393457 - RNA, 20 nt, Homo sapiens
acagacaccaaguuccguca

SEQ ID NO: 393458 - RNA, 14 nt, Homo sapiens
acagacaggcucuu

SEQ ID NO: 393459 - RNA, 20 nt, Homo sapiens
acagaccuaggauuucauga

SEQ ID NO: 393460 - RNA, 24 nt, Homo sapiens
acagacuaugucacccaaugcaua

SEQ ID NO: 393461 - RNA, 14 nt, Homo sapiens
acagacucacaucc

SEQ ID NO: 393462 - RNA, 20 nt, Homo sapiens
acagagauaauucuagcuuu

SEQ ID NO: 393463 - RNA, 17 nt, Homo sapiens
acagagcagaacuuuca

SEQ ID NO: 393464 - RNA, 18 nt, Homo sapiens
acagagcagaacuuucac

SEQ ID NO: 393465 - RNA, 23 nt, Homo sapiens
acagagcugccucucgguggcca

SEQ ID NO: 393466 - RNA, 23 nt, Homo sapiens
acagagcugguugggaagacaug

SEQ ID NO: 393467 - RNA, 12 nt, Homo sapiens
acagaugaaggu

SEQ ID NO: 393468 - RNA, 15 nt, Homo sapiens
acagcagaacuucug

SEQ ID NO: 393469 - RNA, 13 nt, Homo sapiens
acagcagauuuca

SEQ ID NO: 393470 - RNA, 17 nt, Homo sapiens
acagcagccccugcaca

SEQ ID NO: 393471 - RNA, 19 nt, Homo sapiens
acagcaggagggacaauga

SEQ ID NO: 393472 - RNA, 18 nt, Homo sapiens
acagccacacugugggac

SEQ ID NO: 393473 - RNA, 20 nt, Homo sapiens
acagccagacuggcacaguu

SEQ ID NO: 393474 - RNA, 19 nt, Homo sapiens
acagcgagacuccgucuca

SEQ ID NO: 393475 - RNA, 20 nt, Homo sapiens
acagcuacuugggaggcuga

SEQ ID NO: 393476 - RNA, 13 nt, Homo sapiens
acagcucucaccu

SEQ ID NO: 393477 - RNA, 18 nt, Homo sapiens
acaggacccugggaccac

SEQ ID NO: 393478 - RNA, 20 nt, Homo sapiens
acaggacccugggaccacag

SEQ ID NO: 393479 - RNA, 21 nt, Homo sapiens
acaggacccugggaccacaga

SEQ ID NO: 393480 - RNA, 23 nt, Homo sapiens
acaggagcugggauccuaagggc

SEQ ID NO: 393481 - RNA, 18 nt, Homo sapiens
acaggaggaaucauguca

SEQ ID NO: 393482 - RNA, 17 nt, Homo sapiens
acaggaugaccuggaua

SEQ ID NO: 393483 - RNA, 21 nt, Homo sapiens
acaggcaacugaggcagacag

SEQ ID NO: 393484 - RNA, 14 nt, Homo sapiens
acaggcaagugaag

SEQ ID NO: 393485 - RNA, 17 nt, Homo sapiens
acaggcaccugccaaca

SEQ ID NO: 393486 - RNA, 15 nt, Homo sapiens
acaggccauacuuua

SEQ ID NO: 393487 - RNA, 18 nt, Homo sapiens
acaggccauacuuuacaa

SEQ ID NO: 393488 - RNA, 15 nt, Homo sapiens
acagggcauggccag

SEQ ID NO: 393489 - RNA, 12 nt, Homo sapiens
acaggugccagg

SEQ ID NO: 393490 - RNA, 19 nt, Homo sapiens
acagguguuuauacagcuc

SEQ ID NO: 393491 - RNA, 14 nt, Homo sapiens
acaguaacugccau

SEQ ID NO: 393492 - RNA, 17 nt, Homo sapiens
acaguaacugccaucaa

SEQ ID NO: 393493 - RNA, 17 nt, Homo sapiens
acaguauacgcuccauc

SEQ ID NO: 393494 - RNA, 15 nt, Homo sapiens
acagucacauuccaa

SEQ ID NO: 393495 - RNA, 13 nt, Homo sapiens
acagucauuuaaa

SEQ ID NO: 393496 - RNA, 19 nt, Homo sapiens
acagugagacucugucuca

SEQ ID NO: 393497 - RNA, 14 nt, Homo sapiens
acaguguugcccag

SEQ ID NO: 393498 - RNA, 17 nt, Homo sapiens
acaguuagguagcuuua

SEQ ID NO: 393499 - RNA, 16 nt, Homo sapiens
acaguuccuucagcuu

SEQ ID NO: 393500 - RNA, 22 nt, Homo sapiens
acaguugaaaaacagcugaggg

SEQ ID NO: 393501 - RNA, 16 nt, Homo sapiens
acaguuuucugagaaa

SEQ ID NO: 393502 - RNA, 15 nt, Homo sapiens
acauacguacuuuuc

SEQ ID NO: 393503 - RNA, 14 nt, Homo sapiens
acauagaacucaga

SEQ ID NO: 393504 - RNA, 20 nt, Homo sapiens
acauaucaccucauggccua

SEQ ID NO: 393505 - RNA, 23 nt, Homo sapiens
acauauucuuuaaauuucaucuc

SEQ ID NO: 393506 - RNA, 18 nt, Homo sapiens
acaucagcuugcccuguu

SEQ ID NO: 393507 - RNA, 22 nt, Homo sapiens
acauccaggugggaggugucag

SEQ ID NO: 393508 - RNA, 16 nt, Homo sapiens
acaucccauugcccug

SEQ ID NO: 393509 - RNA, 22 nt, Homo sapiens
acauccucugucuauuugagac

SEQ ID NO: 393510 - RNA, 12 nt, Homo sapiens
acaucucagaaa

SEQ ID NO: 393511 - RNA, 15 nt, Homo sapiens
acaucugcauuuuca

SEQ ID NO: 393512 - RNA, 23 nt, Homo sapiens
acaugcagcccagaauagcuuug

SEQ ID NO: 393513 - RNA, 18 nt, Homo sapiens
acaugcugcuaauucaaa

SEQ ID NO: 393514 - RNA, 12 nt, Homo sapiens
acauguauugca

SEQ ID NO: 393515 - RNA, 18 nt, Homo sapiens
acauguauugcacauugu

SEQ ID NO: 393516 - RNA, 19 nt, Homo sapiens
acauguauugcacauugua

SEQ ID NO: 393517 - RNA, 15 nt, Homo sapiens
acaugugacuggcag

SEQ ID NO: 393518 - RNA, 17 nt, Homo sapiens
acauguggggccagguc

SEQ ID NO: 393519 - RNA, 23 nt, Homo sapiens
acauguggugggacagggaccca

SEQ ID NO: 393520 - RNA, 15 nt, Homo sapiens
acauuagccuaugug

SEQ ID NO: 393521 - RNA, 20 nt, Homo sapiens
acauucuaaaggcuugauau

SEQ ID NO: 393522 - RNA, 19 nt, Homo sapiens
acauucuggaaaagcaaaa

SEQ ID NO: 393523 - RNA, 20 nt, Homo sapiens
acauuucuugguuccaauaa

SEQ ID NO: 393524 - RNA, 20 nt, Homo sapiens
acauuugggagacaugugac

SEQ ID NO: 393525 - RNA, 15 nt, Homo sapiens
acauuuuuaguuuaa

SEQ ID NO: 393526 - RNA, 12 nt, Homo sapiens
accaacuuucug

SEQ ID NO: 393527 - RNA, 13 nt, Homo sapiens
accaauagcuuua

SEQ ID NO: 393528 - RNA, 18 nt, Homo sapiens
accaauuccaaguuuuaa

SEQ ID NO: 393529 - RNA, 16 nt, Homo sapiens
accacaaaacuuuucu

SEQ ID NO: 393530 - RNA, 15 nt, Homo sapiens
accaccaccaucacc

SEQ ID NO: 393531 - RNA, 12 nt, Homo sapiens
accacucugucu

SEQ ID NO: 393532 - RNA, 14 nt, Homo sapiens
accacuucagcuga

SEQ ID NO: 393533 - RNA, 19 nt, Homo sapiens
accagacgguucaccagcc

SEQ ID NO: 393534 - RNA, 13 nt, Homo sapiens
accagaggacaaa

SEQ ID NO: 393535 - RNA, 22 nt, Homo sapiens
accagccuggucaacaugguga

SEQ ID NO: 393536 - RNA, 20 nt, Homo sapiens
accaggaggcggcagugcaa

SEQ ID NO: 393537 - RNA, 22 nt, Homo sapiens
accaggaggcggcagugcaaca

SEQ ID NO: 393538 - RNA, 20 nt, Homo sapiens
accaggguugaccccagagg

SEQ ID NO: 393539 - RNA, 13 nt, Homo sapiens
accaggucaggga

SEQ ID NO: 393540 - RNA, 20 nt, Homo sapiens
accaguguccccuccacugu

SEQ ID NO: 393541 - RNA, 22 nt, Homo sapiens
accaguguccccuccacuguca

SEQ ID NO: 393542 - RNA, 14 nt, Homo sapiens
accauaauguuaca

SEQ ID NO: 393543 - RNA, 16 nt, Homo sapiens
accaugaagacaggau

SEQ ID NO: 393544 - RNA, 21 nt, Homo sapiens
accaugagaccacuguuauca

SEQ ID NO: 393545 - RNA, 23 nt, Homo sapiens
accaugauuaaccacuucagcug

SEQ ID NO: 393546 - RNA, 17 nt, Homo sapiens
accaugcccagcucaga

SEQ ID NO: 393547 - RNA, 13 nt, Homo sapiens
accauguacauga

SEQ ID NO: 393548 - RNA, 18 nt, Homo sapiens
acccaauaguuguugauu

SEQ ID NO: 393549 - RNA, 14 nt, Homo sapiens
acccaccccagugc

SEQ ID NO: 393550 - RNA, 21 nt, Homo sapiens
acccagcccuuguuagauuca

SEQ ID NO: 393551 - RNA, 19 nt, Homo sapiens
acccaguuuagaggggaaa

SEQ ID NO: 393552 - RNA, 14 nt, Homo sapiens
acccauauuacaga

SEQ ID NO: 393553 - RNA, 18 nt, Homo sapiens
acccaugagauucauuca

SEQ ID NO: 393554 - RNA, 18 nt, Homo sapiens
acccaugggaagggucca

SEQ ID NO: 393555 - RNA, 15 nt, Homo sapiens
accccaaagcuuucc

SEQ ID NO: 393556 - RNA, 22 nt, Homo sapiens
accccagugcuuguuccucuca

SEQ ID NO: 393557 - RNA, 15 nt, Homo sapiens
accccaucucuacua

SEQ ID NO: 393558 - RNA, 18 nt, Homo sapiens
accccccuauugcugcug

SEQ ID NO: 393559 - RNA, 14 nt, Homo sapiens
acccccuucagugc

SEQ ID NO: 393560 - RNA, 18 nt, Homo sapiens
accccuccccuaaugccu

SEQ ID NO: 393561 - RNA, 13 nt, Homo sapiens
accccuccucacu

SEQ ID NO: 393562 - RNA, 17 nt, Homo sapiens
accccugcuauauacua

SEQ ID NO: 393563 - RNA, 16 nt, Homo sapiens
acccuaaaucuugacu

SEQ ID NO: 393564 - RNA, 22 nt, Homo sapiens
acccuaugugggugggaccaca

SEQ ID NO: 393565 - RNA, 16 nt, Homo sapiens
acccucuaagggaccu

SEQ ID NO: 393566 - RNA, 18 nt, Homo sapiens
acccucuccccacugcuc

SEQ ID NO: 393567 - RNA, 19 nt, Homo sapiens
acccucugccaccagagac

SEQ ID NO: 393568 - RNA, 19 nt, Homo sapiens
acccucuuagaaaaaccac

SEQ ID NO: 393569 - RNA, 17 nt, Homo sapiens
acccuggaccagugguc

SEQ ID NO: 393570 - RNA, 15 nt, Homo sapiens
acccuuccucaccac

SEQ ID NO: 393571 - RNA, 19 nt, Homo sapiens
acccuuguguccacuguga

SEQ ID NO: 393572 - RNA, 14 nt, Homo sapiens
acccuuugcuguga

SEQ ID NO: 393573 - RNA, 12 nt, Homo sapiens
accgagugcaau

SEQ ID NO: 393574 - RNA, 16 nt, Homo sapiens
accuaaauuugguucu

SEQ ID NO: 393575 - RNA, 19 nt, Homo sapiens
accuacaugagguacugag

SEQ ID NO: 393576 - RNA, 16 nt, Homo sapiens
accuaccaucagggac

SEQ ID NO: 393577 - RNA, 15 nt, Homo sapiens
accucacgcaccucc

SEQ ID NO: 393578 - RNA, 20 nt, Homo sapiens
accucaggugagaagcagag

SEQ ID NO: 393579 - RNA, 20 nt, Homo sapiens
accuccccagccccuagccc

SEQ ID NO: 393580 - RNA, 21 nt, Homo sapiens
accuccuacgucaaacaugaa

SEQ ID NO: 393581 - RNA, 13 nt, Homo sapiens
accucguccuccc

SEQ ID NO: 393582 - RNA, 20 nt, Homo sapiens
accucgugauccaccugccu

SEQ ID NO: 393583 - RNA, 16 nt, Homo sapiens
accucugugaccucag

SEQ ID NO: 393584 - RNA, 21 nt, Homo sapiens
accucuugaaaauagaacaac

SEQ ID NO: 393585 - RNA, 19 nt, Homo sapiens
accugaaaacacugugcac

SEQ ID NO: 393586 - RNA, 22 nt, Homo sapiens
accugaaauaaaauucauuagu

SEQ ID NO: 393587 - RNA, 13 nt, Homo sapiens
accugaauguguc

SEQ ID NO: 393588 - RNA, 12 nt, Homo sapiens
accugagcugcc

SEQ ID NO: 393589 - RNA, 19 nt, Homo sapiens
accugcucuccucuugcca

SEQ ID NO: 393590 - RNA, 23 nt, Homo sapiens
accugcugagaaaacaugccucu

SEQ ID NO: 393591 - RNA, 14 nt, Homo sapiens
accuggguguuaca

SEQ ID NO: 393592 - RNA, 15 nt, Homo sapiens
accuguaaucccagc

SEQ ID NO: 393593 - RNA, 19 nt, Homo sapiens
accuguccuugcacacucc

SEQ ID NO: 393594 - RNA, 21 nt, Homo sapiens
accugugccucggcuuuucuc

SEQ ID NO: 393595 - RNA, 19 nt, Homo sapiens
accuguuuucgcaccuacc

SEQ ID NO: 393596 - RNA, 14 nt, Homo sapiens
accuuaaaauguaa

SEQ ID NO: 393597 - RNA, 16 nt, Homo sapiens
accuuaggcagggaag

SEQ ID NO: 393598 - RNA, 17 nt, Homo sapiens
accuuauuguaccucuc

SEQ ID NO: 393599 - RNA, 14 nt, Homo sapiens
accuucagugaaag

SEQ ID NO: 393600 - RNA, 16 nt, Homo sapiens
accuucccaugcccug

SEQ ID NO: 393601 - RNA, 22 nt, Homo sapiens
accuucguuuacuaugccugug

SEQ ID NO: 393602 - RNA, 20 nt, Homo sapiens
accuucuguggcucacagaa

SEQ ID NO: 393603 - RNA, 23 nt, Homo sapiens
accuuucacaagggcaaacuuuu

SEQ ID NO: 393604 - RNA, 13 nt, Homo sapiens
accuuuguuccca

SEQ ID NO: 393605 - RNA, 19 nt, Homo sapiens
accuuuuccugcggcauca

SEQ ID NO: 393606 - RNA, 18 nt, Homo sapiens
acgacaagugcugaacag

SEQ ID NO: 393607 - RNA, 22 nt, Homo sapiens
acgagcaggcuacugucagcuc

SEQ ID NO: 393608 - RNA, 18 nt, Homo sapiens
acgcaccuggguguuaca

SEQ ID NO: 393609 - RNA, 17 nt, Homo sapiens
acgccacaaaucuggug

SEQ ID NO: 393610 - RNA, 22 nt, Homo sapiens
acgccauuuccuuuuccuucaa

SEQ ID NO: 393611 - RNA, 20 nt, Homo sapiens
acgcccaugugugagugugu

SEQ ID NO: 393612 - RNA, 17 nt, Homo sapiens
acgccuccccuuuguga

SEQ ID NO: 393613 - RNA, 14 nt, Homo sapiens
acgccugagcucac

SEQ ID NO: 393614 - RNA, 15 nt, Homo sapiens
acggcucucaccagu

SEQ ID NO: 393615 - RNA, 18 nt, Homo sapiens
acgggcaugggcacuccc

SEQ ID NO: 393616 - RNA, 14 nt, Homo sapiens
acgggcucagcaaa

SEQ ID NO: 393617 - RNA, 18 nt, Homo sapiens
acguccagcucguucucu

SEQ ID NO: 393618 - RNA, 20 nt, Homo sapiens
acgugacuguggcacacgcc

SEQ ID NO: 393619 - RNA, 16 nt, Homo sapiens
acguggagagggauga

SEQ ID NO: 393620 - RNA, 14 nt, Homo sapiens
acuaaaaauauuau

SEQ ID NO: 393621 - RNA, 15 nt, Homo sapiens
acuaagaaauaugca

SEQ ID NO: 393622 - RNA, 23 nt, Homo sapiens
acuacaugugacuggcaguauua

SEQ ID NO: 393623 - RNA, 21 nt, Homo sapiens
acuaccccaaaguuugcucaa

SEQ ID NO: 393624 - RNA, 19 nt, Homo sapiens
acuacgugacuguggcaca

SEQ ID NO: 393625 - RNA, 19 nt, Homo sapiens
acuagagucugaacagcug

SEQ ID NO: 393626 - RNA, 21 nt, Homo sapiens
agacugcccagcuaaagcaau

SEQ ID NO: 393627 - RNA, 16 nt, Homo sapiens
agacugggcugaggga

SEQ ID NO: 393628 - RNA, 20 nt, Homo sapiens
agacugggucucgcuuuguu

SEQ ID NO: 393629 - RNA, 20 nt, Homo sapiens
agacuuagaaaaauccuaca

SEQ ID NO: 393630 - RNA, 12 nt, Homo sapiens
agacuuugacuc

SEQ ID NO: 393631 - RNA, 20 nt, Homo sapiens
agacuuugacucuccagaaa

SEQ ID NO: 393632 - RNA, 13 nt, Homo sapiens
agagaaagccagg

SEQ ID NO: 393633 - RNA, 12 nt, Homo sapiens
agagacaucaaa

SEQ ID NO: 393634 - RNA, 16 nt, Homo sapiens
agagacgcagacaugu

SEQ ID NO: 393635 - RNA, 21 nt, Homo sapiens
agagagcagcuuuaaacucag

SEQ ID NO: 393636 - RNA, 15 nt, Homo sapiens
agagaggacuguuga

SEQ ID NO: 393637 - RNA, 15 nt, Homo sapiens
agagaugaaccacau

SEQ ID NO: 393638 - RNA, 16 nt, Homo sapiens
agagaugggacuggga

SEQ ID NO: 393639 - RNA, 21 nt, Homo sapiens
agagcaacucugagaucuaag

SEQ ID NO: 393640 - RNA, 15 nt, Homo sapiens
agagcacacuguagc

SEQ ID NO: 393641 - RNA, 18 nt, Homo sapiens
agagcccagcucaugcac

SEQ ID NO: 393642 - RNA, 15 nt, Homo sapiens
agagcccccuugaca

SEQ ID NO: 393643 - RNA, 20 nt, Homo sapiens
agagcgcaagcugggagcac

SEQ ID NO: 393644 - RNA, 13 nt, Homo sapiens
agaggaugagcuc

SEQ ID NO: 393645 - RNA, 22 nt, Homo sapiens
agaguagaacagauaaucagug

SEQ ID NO: 393646 - RNA, 20 nt, Homo sapiens
agaguauaugcacuuuccaa

SEQ ID NO: 393647 - RNA, 21 nt, Homo sapiens
agagucauauugcccaguggu

SEQ ID NO: 393648 - RNA, 21 nt, Homo sapiens
agagugccguaacaacugugg

SEQ ID NO: 393649 - RNA, 15 nt, Homo sapiens
agaguucugcucuag

SEQ ID NO: 393650 - RNA, 14 nt, Homo sapiens
agaguugugcacau

SEQ ID NO: 393651 - RNA, 22 nt, Homo sapiens
agauaagggugucuuccuagaa

SEQ ID NO: 393652 - RNA, 13 nt, Homo sapiens
agauaaugcaguc

SEQ ID NO: 393653 - RNA, 13 nt, Homo sapiens
agauaugugaaga

SEQ ID NO: 393654 - RNA, 12 nt, Homo sapiens
agauauuucaca

SEQ ID NO: 393655 - RNA, 21 nt, Homo sapiens
agaucagccugggcaauguga

SEQ ID NO: 393656 - RNA, 15 nt, Homo sapiens
agaucauccuuucca

SEQ ID NO: 393657 - RNA, 19 nt, Homo sapiens
agaucgcgccacugcacuc

SEQ ID NO: 393658 - RNA, 13 nt, Homo sapiens
agaugaaccacau

SEQ ID NO: 393659 - RNA, 14 nt, Homo sapiens
agaugaucaucucc

SEQ ID NO: 393660 - RNA, 18 nt, Homo sapiens
agaugcugacauccaggu

SEQ ID NO: 393661 - RNA, 21 nt, Homo sapiens
agaugggaaaaccaugguaau

SEQ ID NO: 393662 - RNA, 12 nt, Homo sapiens
agaugggacugg

SEQ ID NO: 393663 - RNA, 22 nt, Homo sapiens
agaugggcaaauuaaggcauaa

SEQ ID NO: 393664 - RNA, 22 nt, Homo sapiens
agauuccaggcgaugugcaagu

SEQ ID NO: 393665 - RNA, 13 nt, Homo sapiens
agauugauacuuu

SEQ ID NO: 393666 - RNA, 17 nt, Homo sapiens
agauuuaacaauuccaa

SEQ ID NO: 393667 - RNA, 20 nt, Homo sapiens
agcaaaauacaugacauuua

SEQ ID NO: 393668 - RNA, 13 nt, Homo sapiens
agcaaaaugugau

SEQ ID NO: 393669 - RNA, 17 nt, Homo sapiens
agcaaacucugcugucu

SEQ ID NO: 393670 - RNA, 12 nt, Homo sapiens
agcaaagacuuu

SEQ ID NO: 393671 - RNA, 17 nt, Homo sapiens
agcaaagcuccugccuc

SEQ ID NO: 393672 - RNA, 21 nt, Homo sapiens
agcaaagcugaugacaacuuc

SEQ ID NO: 393673 - RNA, 20 nt, Homo sapiens
agcaaaugcuauuugauaac

SEQ ID NO: 393674 - RNA, 18 nt, Homo sapiens
agcaacccaaauguucau

SEQ ID NO: 393675 - RNA, 19 nt, Homo sapiens
agcaacucugagaucuaag

SEQ ID NO: 393676 - RNA, 21 nt, Homo sapiens
agcaagugcuggagucgggac

SEQ ID NO: 393677 - RNA, 13 nt, Homo sapiens
agcacacuguagc

SEQ ID NO: 393678 - RNA, 17 nt, Homo sapiens
agcacagcacccauggg

SEQ ID NO: 393679 - RNA, 15 nt, Homo sapiens
agcacagcagcaucu

SEQ ID NO: 393680 - RNA, 18 nt, Homo sapiens
agcacaggcacugcagga

SEQ ID NO: 393681 - RNA, 23 nt, Homo sapiens
agcacuacauaaacugacuuuau

SEQ ID NO: 393682 - RNA, 24 nt, Homo sapiens
agcacuaguauuucauguugcaca

SEQ ID NO: 393683 - RNA, 12 nt, Homo sapiens
agcacuggguug

SEQ ID NO: 393684 - RNA, 15 nt, Homo sapiens
agcacuguccaguau

SEQ ID NO: 393685 - RNA, 18 nt, Homo sapiens
agcacugucccuugccuc

SEQ ID NO: 393686 - RNA, 15 nt, Homo sapiens
agcagcccccauuuc

SEQ ID NO: 393687 - RNA, 15 nt, Homo sapiens
agcagcuaucucuca

SEQ ID NO: 393688 - RNA, 16 nt, Homo sapiens
agcagcuaucucucag

SEQ ID NO: 393689 - RNA, 19 nt, Homo sapiens
agcagcuuuaaacucaggg

SEQ ID NO: 393690 - RNA, 15 nt, Homo sapiens
agcaggaaaccugug

SEQ ID NO: 393691 - RNA, 20 nt, Homo sapiens
agcagggaagccccagugag

SEQ ID NO: 393692 - RNA, 18 nt, Homo sapiens
agcaggggaguaugcaaa

SEQ ID NO: 393693 - RNA, 20 nt, Homo sapiens
agcagugaaugauucagugu

SEQ ID NO: 393694 - RNA, 13 nt, Homo sapiens
agcagugccagcu

SEQ ID NO: 393695 - RNA, 17 nt, Homo sapiens
agcagugccagcuuucu

SEQ ID NO: 393696 - RNA, 18 nt, Homo sapiens
agcauaaguuucugggac

SEQ ID NO: 393697 - RNA, 18 nt, Homo sapiens
agcauaccaacacgagca

SEQ ID NO: 393698 - RNA, 18 nt, Homo sapiens
agcauacgguaugauauu

SEQ ID NO: 393699 - RNA, 16 nt, Homo sapiens
agcaugaauccagucc

SEQ ID NO: 393700 - RNA, 17 nt, Homo sapiens
agcauuagucacuuuga

SEQ ID NO: 393701 - RNA, 17 nt, Homo sapiens
agcauuguaaaugugcu

SEQ ID NO: 393702 - RNA, 17 nt, Homo sapiens
agcauuuagacccugca

SEQ ID NO: 393703 - RNA, 20 nt, Homo sapiens
agcauuuugcuaaaugugaa

SEQ ID NO: 393704 - RNA, 15 nt, Homo sapiens
agccaagccagucaa

SEQ ID NO: 393705 - RNA, 15 nt, Homo sapiens
agccaaguuaagaau

SEQ ID NO: 393706 - RNA, 14 nt, Homo sapiens
agccagaagcugag

SEQ ID NO: 393707 - RNA, 14 nt, Homo sapiens
agccagacuggcac

SEQ ID NO: 393708 - RNA, 22 nt, Homo sapiens
agccagcacucacaccacuaac

SEQ ID NO: 393709 - RNA, 13 nt, Homo sapiens
agccauaugaaug

SEQ ID NO: 393710 - RNA, 21 nt, Homo sapiens
agccauguccugcugcuucug

SEQ ID NO: 393711 - RNA, 21 nt, Homo sapiens
agcccagcucaugcacaucag

SEQ ID NO: 393712 - RNA, 17 nt, Homo sapiens
agcccaggaggacugcc

SEQ ID NO: 393713 - RNA, 14 nt, Homo sapiens
agccccacuugaag

SEQ ID NO: 393714 - RNA, 21 nt, Homo sapiens
agcccccauuguggucacagg

SEQ ID NO: 393715 - RNA, 21 nt, Homo sapiens
agccccugggacugcugcuuc

SEQ ID NO: 393716 - RNA, 19 nt, Homo sapiens
agcccggaugcuucuccau

SEQ ID NO: 393717 - RNA, 13 nt, Homo sapiens
agcccucaucccg

SEQ ID NO: 393718 - RNA, 12 nt, Homo sapiens
agccgaccucag

SEQ ID NO: 393719 - RNA, 17 nt, Homo sapiens
agccuagcccuucucuc

SEQ ID NO: 393720 - RNA, 17 nt, Homo sapiens
agccuagccgaccucag

SEQ ID NO: 393721 - RNA, 21 nt, Homo sapiens
agccuauguaugccauggagg

SEQ ID NO: 393722 - RNA, 12 nt, Homo sapiens
agccucaagucu

SEQ ID NO: 393723 - RNA, 19 nt, Homo sapiens
agccucagccauucacugc

SEQ ID NO: 393724 - RNA, 18 nt, Homo sapiens
agccucuccccugauuac

SEQ ID NO: 393725 - RNA, 21 nt, Homo sapiens
agccucugacuuaagcugccu

SEQ ID NO: 393726 - RNA, 20 nt, Homo sapiens
agccucugggucaguggucc

SEQ ID NO: 393727 - RNA, 13 nt, Homo sapiens
agccugcagucau

SEQ ID NO: 393728 - RNA, 15 nt, Homo sapiens
agccugggcaaugug

SEQ ID NO: 393729 - RNA, 22 nt, Homo sapiens
agccugggcgacagagccagac

SEQ ID NO: 393730 - RNA, 21 nt, Homo sapiens
agccuucuuccaucccaggac

SEQ ID NO: 393731 - RNA, 17 nt, Homo sapiens
agcgagagaauauguca

SEQ ID NO: 393732 - RNA, 16 nt, Homo sapiens
agcgugugacuacucc

SEQ ID NO: 393733 - RNA, 18 nt, Homo sapiens
agcuaaaaugauuuuauc

SEQ ID NO: 393734 - RNA, 22 nt, Homo sapiens
agcuaauguaauaacugugaag

SEQ ID NO: 393735 - RNA, 20 nt, Homo sapiens
agcuacucaggagguugagg

SEQ ID NO: 393736 - RNA, 23 nt, Homo sapiens
agcuagaggacuucuggcaggga

SEQ ID NO: 393737 - RNA, 16 nt, Homo sapiens
agcuaucucucaguga

SEQ ID NO: 393738 - RNA, 23 nt, Homo sapiens
agcuaucucucagugaacuguga

SEQ ID NO: 393739 - RNA, 14 nt, Homo sapiens
agcuauuuccauuc

SEQ ID NO: 393740 - RNA, 21 nt, Homo sapiens
agcucagagaggcuagaugau

SEQ ID NO: 393741 - RNA, 20 nt, Homo sapiens
agcucagaggguuguucucc

SEQ ID NO: 393742 - RNA, 16 nt, Homo sapiens
agcucaggcacacuuc

SEQ ID NO: 393743 - RNA, 21 nt, Homo sapiens
agcucccauguaccagcagcu

SEQ ID NO: 393744 - RNA, 13 nt, Homo sapiens
agcuccugccucu

SEQ ID NO: 393745 - RNA, 14 nt, Homo sapiens
agcuccuugacucc

SEQ ID NO: 393746 - RNA, 15 nt, Homo sapiens
agcucuguuuuacaa

SEQ ID NO: 393747 - RNA, 13 nt, Homo sapiens
agcugaaccuggg

SEQ ID NO: 393748 - RNA, 15 nt, Homo sapiens
agcugagagacuuuu

SEQ ID NO: 393749 - RNA, 18 nt, Homo sapiens
agcugccauccagggaug

SEQ ID NO: 393750 - RNA, 18 nt, Homo sapiens
agcugccccacaggugug

SEQ ID NO: 393751 - RNA, 18 nt, Homo sapiens
agcuggaaaaaguguccu

SEQ ID NO: 393752 - RNA, 23 nt, Homo sapiens
agcuggauuuccuaggcugacua

SEQ ID NO: 393753 - RNA, 13 nt, Homo sapiens
agcuggccuguaa

SEQ ID NO: 393754 - RNA, 22 nt, Homo sapiens
agcugggagcacaggcacugca

SEQ ID NO: 393755 - RNA, 14 nt, Homo sapiens
agcugguaaacuau

SEQ ID NO: 393756 - RNA, 19 nt, Homo sapiens
agcugguugggaagacaug

SEQ ID NO: 393757 - RNA, 21 nt, Homo sapiens
agcugucuccucuucaaauaa

SEQ ID NO: 393758 - RNA, 22 nt, Homo sapiens
agcugucuuagagugggaccaa

SEQ ID NO: 393759 - RNA, 16 nt, Homo sapiens
agcugugacuucucca

SEQ ID NO: 393760 - RNA, 13 nt, Homo sapiens
agcuguucagcug

SEQ ID NO: 393761 - RNA, 13 nt, Homo sapiens
agcuuaagaauuu

SEQ ID NO: 393762 - RNA, 16 nt, Homo sapiens
agcuuauuaaaacuca

SEQ ID NO: 393763 - RNA, 21 nt, Homo sapiens
agcuucagaaguuuggcaaua

SEQ ID NO: 393764 - RNA, 14 nt, Homo sapiens
agcuugcaacaaaa

SEQ ID NO: 393765 - RNA, 23 nt, Homo sapiens
agcuugcucuucagugggagaaa

SEQ ID NO: 393766 - RNA, 16 nt, Homo sapiens
agcuuuaaacucaggg

SEQ ID NO: 393767 - RNA, 18 nt, Homo sapiens
agcuuuacaaauauguca

SEQ ID NO: 393768 - RNA, 23 nt, Homo sapiens
auccugagcagugccagcuuucu

SEQ ID NO: 393769 - RNA, 21 nt, Homo sapiens
auccugguugguguugcagaa

SEQ ID NO: 393770 - RNA, 18 nt, Homo sapiens
auccuucuuucuaguuca

SEQ ID NO: 393771 - RNA, 15 nt, Homo sapiens
auccuuuacuguuag

SEQ ID NO: 393772 - RNA, 23 nt, Homo sapiens
aucggaucuggggcucugggaua

SEQ ID NO: 393773 - RNA, 18 nt, Homo sapiens
aucuaaggaugucacagg

SEQ ID NO: 393774 - RNA, 14 nt, Homo sapiens
aucuaagugauaua

SEQ ID NO: 393775 - RNA, 16 nt, Homo sapiens
aucuaaugugaaguag

SEQ ID NO: 393776 - RNA, 17 nt, Homo sapiens
aucuacacuccagugag

SEQ ID NO: 393777 - RNA, 22 nt, Homo sapiens
aucuacuucaacacuucaugua

SEQ ID NO: 393778 - RNA, 15 nt, Homo sapiens
aucucaaacuacugg

SEQ ID NO: 393779 - RNA, 21 nt, Homo sapiens
aucucaaacuacuggcaauuu

SEQ ID NO: 393780 - RNA, 17 nt, Homo sapiens
aucucaaccauccccuc

SEQ ID NO: 393781 - RNA, 15 nt, Homo sapiens
aucucagccuaccau

SEQ ID NO: 393782 - RNA, 23 nt, Homo sapiens
aucucauuggacccuuccauggu

SEQ ID NO: 393783 - RNA, 21 nt, Homo sapiens
aucuccaguuuauagaccaga

SEQ ID NO: 393784 - RNA, 19 nt, Homo sapiens
aucucucacacauuccagg

SEQ ID NO: 393785 - RNA, 22 nt, Homo sapiens
aucucucccuccccugccauuu

SEQ ID NO: 393786 - RNA, 19 nt, Homo sapiens
aucucuugcacucaaagcu

SEQ ID NO: 393787 - RNA, 15 nt, Homo sapiens
aucucuuugauguca

SEQ ID NO: 393788 - RNA, 18 nt, Homo sapiens
aucugcauuuucacccca

SEQ ID NO: 393789 - RNA, 17 nt, Homo sapiens
aucugguccaacaugaa

SEQ ID NO: 393790 - RNA, 23 nt, Homo sapiens
aucuguauauacaauaacauaau

SEQ ID NO: 393791 - RNA, 17 nt, Homo sapiens
aucugugcaaauccuug

SEQ ID NO: 393792 - RNA, 17 nt, Homo sapiens
aucuucacaaaacacuu

SEQ ID NO: 393793 - RNA, 19 nt, Homo sapiens
aucuugaccaagcaggaag

SEQ ID NO: 393794 - RNA, 18 nt, Homo sapiens
aucuuuaaaauacacacu

SEQ ID NO: 393795 - RNA, 15 nt, Homo sapiens
aucuuuuaagcccau

SEQ ID NO: 393796 - RNA, 16 nt, Homo sapiens
augaaauaucaugcuc

SEQ ID NO: 393797 - RNA, 20 nt, Homo sapiens
augaacaaauugaacucuuu

SEQ ID NO: 393798 - RNA, 13 nt, Homo sapiens
augaaccacauua

SEQ ID NO: 393799 - RNA, 14 nt, Homo sapiens
augaacggugagca

SEQ ID NO: 393800 - RNA, 17 nt, Homo sapiens
augaacuggaccugcac

SEQ ID NO: 393801 - RNA, 12 nt, Homo sapiens
augaagugcaaa

SEQ ID NO: 393802 - RNA, 22 nt, Homo sapiens
augaaucucaagauucaguaga

SEQ ID NO: 393803 - RNA, 17 nt, Homo sapiens
augaaugggagugaggg

SEQ ID NO: 393804 - RNA, 16 nt, Homo sapiens
augacaaaaagccuuu

SEQ ID NO: 393805 - RNA, 18 nt, Homo sapiens
augacaucucaggggcca

SEQ ID NO: 393806 - RNA, 22 nt, Homo sapiens
augaccccuccccuaaugccug

SEQ ID NO: 393807 - RNA, 17 nt, Homo sapiens
augacucagcauaccug

SEQ ID NO: 393808 - RNA, 19 nt, Homo sapiens
augagaaauuuuguugaua

SEQ ID NO: 393809 - RNA, 16 nt, Homo sapiens
augagaaggaauuuga

SEQ ID NO: 393810 - RNA, 22 nt, Homo sapiens
augagaauuugagugcucugau

SEQ ID NO: 393811 - RNA, 16 nt, Homo sapiens
augagaccacuguuau

SEQ ID NO: 393812 - RNA, 13 nt, Homo sapiens
augagggaaaaug

SEQ ID NO: 393813 - RNA, 14 nt, Homo sapiens
augaucauuugccc

SEQ ID NO: 393814 - RNA, 16 nt, Homo sapiens
augauccuaaugaaug

SEQ ID NO: 393815 - RNA, 12 nt, Homo sapiens
augaucuuggcu

SEQ ID NO: 393816 - RNA, 19 nt, Homo sapiens
augaugagaguuucuguua

SEQ ID NO: 393817 - RNA, 12 nt, Homo sapiens
augaugaucugg

SEQ ID NO: 393818 - RNA, 12 nt, Homo sapiens
augauuaguaaa

SEQ ID NO: 393819 - RNA, 19 nt, Homo sapiens
augauuccaccuacaugag

SEQ ID NO: 393820 - RNA, 13 nt, Homo sapiens
augauuucauuca

SEQ ID NO: 393821 - RNA, 14 nt, Homo sapiens
augauuuuauuuga

SEQ ID NO: 393822 - RNA, 21 nt, Homo sapiens
augcaaaaguucugacuugac

SEQ ID NO: 393823 - RNA, 14 nt, Homo sapiens
augcaaagcacuga

SEQ ID NO: 393824 - RNA, 14 nt, Homo sapiens
augcagcaucuaag

SEQ ID NO: 393825 - RNA, 15 nt, Homo sapiens
augcauaaaauguua

SEQ ID NO: 393826 - RNA, 15 nt, Homo sapiens
augccaaauguucca

SEQ ID NO: 393827 - RNA, 21 nt, Homo sapiens
augccagagacggaagccuuu

SEQ ID NO: 393828 - RNA, 16 nt, Homo sapiens
augccagcuuaucuca

SEQ ID NO: 393829 - RNA, 19 nt, Homo sapiens
augccagggacugacaaaa

SEQ ID NO: 393830 - RNA, 22 nt, Homo sapiens
augccaguaacgcgucuuccug

SEQ ID NO: 393831 - RNA, 23 nt, Homo sapiens
augccauagcaagauugcuuaaa

SEQ ID NO: 393832 - RNA, 19 nt, Homo sapiens
augcccuguaccugugcac

SEQ ID NO: 393833 - RNA, 17 nt, Homo sapiens
augccuguaaucccagc

SEQ ID NO: 393834 - RNA, 20 nt, Homo sapiens
augcuaaagaaaaagucauc

SEQ ID NO: 393835 - RNA, 22 nt, Homo sapiens
augcuaaagaaaaagucaucca

SEQ ID NO: 393836 - RNA, 15 nt, Homo sapiens
augcuggcauuugca

SEQ ID NO: 393837 - RNA, 22 nt, Homo sapiens
augcuguauauccuuucuaaca

SEQ ID NO: 393838 - RNA, 22 nt, Homo sapiens
augcuucugacuucauagauuu

SEQ ID NO: 393839 - RNA, 17 nt, Homo sapiens
auggaaaggagaggaaa

SEQ ID NO: 393840 - RNA, 23 nt, Homo sapiens
auggaaguugcagugagcugaua

SEQ ID NO: 393841 - RNA, 12 nt, Homo sapiens
auggacacucca

SEQ ID NO: 393842 - RNA, 18 nt, Homo sapiens
auggacaugaucuucuuu

SEQ ID NO: 393843 - RNA, 19 nt, Homo sapiens
auggaccaggaagcccuga

SEQ ID NO: 393844 - RNA, 21 nt, Homo sapiens
auggagauauuuacaugaauu

SEQ ID NO: 393845 - RNA, 18 nt, Homo sapiens
auggaggaaagugauauc

SEQ ID NO: 393846 - RNA, 17 nt, Homo sapiens
auggaggaauuucuuga

SEQ ID NO: 393847 - RNA, 17 nt, Homo sapiens
auggaggcaugccaaau

SEQ ID NO: 393848 - RNA, 17 nt, Homo sapiens
auggauaagcuugucua

SEQ ID NO: 393849 - RNA, 18 nt, Homo sapiens
auggaucuuaaagcauuc

SEQ ID NO: 393850 - RNA, 20 nt, Homo sapiens
auggcaccuuuugcacauaa

SEQ ID NO: 393851 - RNA, 17 nt, Homo sapiens
auggcccugcaaaagga

SEQ ID NO: 393852 - RNA, 16 nt, Homo sapiens
auggcuaguaucaaaa

SEQ ID NO: 393853 - RNA, 18 nt, Homo sapiens
auggcuaguaucaaaaga

SEQ ID NO: 393854 - RNA, 13 nt, Homo sapiens
augggaaaaccau

SEQ ID NO: 393855 - RNA, 19 nt, Homo sapiens
augggagaaucacuugaac

SEQ ID NO: 393856 - RNA, 20 nt, Homo sapiens
augggcaaauuaaggcauaa

SEQ ID NO: 393857 - RNA, 16 nt, Homo sapiens
augguaaaaguuacuu

SEQ ID NO: 393858 - RNA, 19 nt, Homo sapiens
auggugaggagauccuguu

SEQ ID NO: 393859 - RNA, 17 nt, Homo sapiens
auggugcuacgccugca

SEQ ID NO: 393860 - RNA, 20 nt, Homo sapiens
augguggcgcgcaccuguaa

SEQ ID NO: 393861 - RNA, 16 nt, Homo sapiens
augguuacucuuguca

SEQ ID NO: 393862 - RNA, 14 nt, Homo sapiens
auguaaaacaagaa

SEQ ID NO: 393863 - RNA, 19 nt, Homo sapiens
auguacaucuggccuugaa

SEQ ID NO: 393864 - RNA, 15 nt, Homo sapiens
auguauaugcaauau

SEQ ID NO: 393865 - RNA, 15 nt, Homo sapiens
auguauucagcuuua

SEQ ID NO: 393866 - RNA, 23 nt, Homo sapiens
augucaaagcaggggaguaugca

SEQ ID NO: 393867 - RNA, 19 nt, Homo sapiens
augucguuugaaucacagu

SEQ ID NO: 393868 - RNA, 21 nt, Homo sapiens
augucguuugaaucacaguau

SEQ ID NO: 393869 - RNA, 22 nt, Homo sapiens
augucuagguccccacugccug

SEQ ID NO: 393870 - RNA, 20 nt, Homo sapiens
augucuuuccuuuugcucuu

SEQ ID NO: 393871 - RNA, 15 nt, Homo sapiens
augugacuggcagua

SEQ ID NO: 393872 - RNA, 17 nt, Homo sapiens
augugauauguaccuaa

SEQ ID NO: 393873 - RNA, 15 nt, Homo sapiens
augugauccuuuuau

SEQ ID NO: 393874 - RNA, 15 nt, Homo sapiens
augugcccccagacg

SEQ ID NO: 393875 - RNA, 18 nt, Homo sapiens
augugggagggagcagac

SEQ ID NO: 393876 - RNA, 19 nt, Homo sapiens
augugggugggaccacaga

SEQ ID NO: 393877 - RNA, 17 nt, Homo sapiens
augugggugucagucag

SEQ ID NO: 393878 - RNA, 20 nt, Homo sapiens
augugggugucagucaggga

SEQ ID NO: 393879 - RNA, 21 nt, Homo sapiens
augugggugucagucagggac

SEQ ID NO: 393880 - RNA, 14 nt, Homo sapiens
augugugagugugu

SEQ ID NO: 393881 - RNA, 18 nt, Homo sapiens
augugugagugugugcaa

SEQ ID NO: 393882 - RNA, 13 nt, Homo sapiens
augugugauucac

SEQ ID NO: 393883 - RNA, 20 nt, Homo sapiens
auguugaugaaaaauagcaa

SEQ ID NO: 393884 - RNA, 20 nt, Homo sapiens
auguugcccaguguguuucu

SEQ ID NO: 393885 - RNA, 18 nt, Homo sapiens
auguuguaauucaugcca

SEQ ID NO: 393886 - RNA, 22 nt, Homo sapiens
auguuguguuucuguucaccuu

SEQ ID NO: 393887 - RNA, 12 nt, Homo sapiens
auguuuacuucu

SEQ ID NO: 393888 - RNA, 15 nt, Homo sapiens
auuaaauaaaucauu

SEQ ID NO: 393889 - RNA, 22 nt, Homo sapiens
auuaaccucugcacuacugaca

SEQ ID NO: 393890 - RNA, 16 nt, Homo sapiens
auuaagcccucuucca

SEQ ID NO: 393891 - RNA, 13 nt, Homo sapiens
auuaauacugaag

SEQ ID NO: 393892 - RNA, 23 nt, Homo sapiens
auuaauguuaauucagcacugau

SEQ ID NO: 393893 - RNA, 14 nt, Homo sapiens
auuacaauugugag

SEQ ID NO: 393894 - RNA, 13 nt, Homo sapiens
auuaccaguuuuc

SEQ ID NO: 393895 - RNA, 18 nt, Homo sapiens
auuagaggucuccaaaau

SEQ ID NO: 393896 - RNA, 23 nt, Homo sapiens
auuagagguuaaugcagggacug

SEQ ID NO: 393897 - RNA, 22 nt, Homo sapiens
auuagcauucugguuuugacau

SEQ ID NO: 393898 - RNA, 20 nt, Homo sapiens
auuauauauuccgcacucaa

SEQ ID NO: 393899 - RNA, 16 nt, Homo sapiens
auuaucaacagcauuu

SEQ ID NO: 393900 - RNA, 13 nt, Homo sapiens
auuaugaagucau

SEQ ID NO: 393901 - RNA, 14 nt, Homo sapiens
auuaugcuaccuac

SEQ ID NO: 393902 - RNA, 12 nt, Homo sapiens
auuauguacaaa

SEQ ID NO: 393903 - RNA, 11 nt, Homo sapiens
auuauucugau

SEQ ID NO: 393904 - RNA, 17 nt, Homo sapiens
auucaaacugccuauau

SEQ ID NO: 393905 - RNA, 16 nt, Homo sapiens
auucaacucagacuag

SEQ ID NO: 393906 - RNA, 16 nt, Homo sapiens
auucacaagacccaaa

SEQ ID NO: 393907 - RNA, 17 nt, Homo sapiens
auucacaagacccaaaa

SEQ ID NO: 393908 - RNA, 21 nt, Homo sapiens
auucacaauagaaacucacca

SEQ ID NO: 393909 - RNA, 17 nt, Homo sapiens
gccaagccagucaagga

SEQ ID NO: 393910 - RNA, 21 nt, Homo sapiens
gccaaggggaugcucugugca

SEQ ID NO: 393911 - RNA, 20 nt, Homo sapiens
gccacaaaacugacaguaaa

SEQ ID NO: 393912 - RNA, 19 nt, Homo sapiens
gccacacggcucucaccag

SEQ ID NO: 393913 - RNA, 18 nt, Homo sapiens
gccaccagacugacaaau

SEQ ID NO: 393914 - RNA, 15 nt, Homo sapiens
gccaccccuccuucc

SEQ ID NO: 393915 - RNA, 19 nt, Homo sapiens
gccaccuccccaggccgug

SEQ ID NO: 393916 - RNA, 20 nt, Homo sapiens
gccacuccagaccccuggcu

SEQ ID NO: 393917 - RNA, 23 nt, Homo sapiens
gccacugccacacgucugacccu

SEQ ID NO: 393918 - RNA, 18 nt, Homo sapiens
gccagacugucucaaaua

SEQ ID NO: 393919 - RNA, 21 nt, Homo sapiens
gccagcaaugacaucucaggg

SEQ ID NO: 393920 - RNA, 17 nt, Homo sapiens
gccagccagugaccuga

SEQ ID NO: 393921 - RNA, 19 nt, Homo sapiens
gccagcuuaucucaggggu

SEQ ID NO: 393922 - RNA, 21 nt, Homo sapiens
gccaggacaugcagcccagaa

SEQ ID NO: 393923 - RNA, 14 nt, Homo sapiens
gccaggacugagcc

SEQ ID NO: 393924 - RNA, 21 nt, Homo sapiens
gccaggcagaucccacuugca

SEQ ID NO: 393925 - RNA, 18 nt, Homo sapiens
gccaggcaugguggccca

SEQ ID NO: 393926 - RNA, 11 nt, Homo sapiens
gccaguauuuu

SEQ ID NO: 393927 - RNA, 14 nt, Homo sapiens
gccauaacagacca

SEQ ID NO: 393928 - RNA, 14 nt, Homo sapiens
gccauugcacucca

SEQ ID NO: 393929 - RNA, 14 nt, Homo sapiens
gcccaagaauagau

SEQ ID NO: 393930 - RNA, 20 nt, Homo sapiens
gcccaaguuguggugcugac

SEQ ID NO: 393931 - RNA, 22 nt, Homo sapiens
gcccacuucaccguacuaacca

SEQ ID NO: 393932 - RNA, 16 nt, Homo sapiens
gcccagcuaaagcaau

SEQ ID NO: 393933 - RNA, 21 nt, Homo sapiens
gcccagcucaugcacaucagc

SEQ ID NO: 393934 - RNA, 18 nt, Homo sapiens
gcccaggcaacaguacuu

SEQ ID NO: 393935 - RNA, 20 nt, Homo sapiens
gcccagggaagccaaaagau

SEQ ID NO: 393936 - RNA, 15 nt, Homo sapiens
gcccaguguguuucu

SEQ ID NO: 393937 - RNA, 14 nt, Homo sapiens
gcccauaucuguga

SEQ ID NO: 393938 - RNA, 18 nt, Homo sapiens
gcccauaucugugaaaug

SEQ ID NO: 393939 - RNA, 23 nt, Homo sapiens
gcccaucccuggaaggugcuguu

SEQ ID NO: 393940 - RNA, 13 nt, Homo sapiens
gccccacuugaag

SEQ ID NO: 393941 - RNA, 15 nt, Homo sapiens
gccccaggaagccgu

SEQ ID NO: 393942 - RNA, 12 nt, Homo sapiens
gcccccagcugu

SEQ ID NO: 393943 - RNA, 18 nt, Homo sapiens
gcccccauuuccucgggu

SEQ ID NO: 393944 - RNA, 20 nt, Homo sapiens
gccccccuugccagacaugu

SEQ ID NO: 393945 - RNA, 18 nt, Homo sapiens
gccccuggcucugaccga

SEQ ID NO: 393946 - RNA, 16 nt, Homo sapiens
gcccugcaccugugca

SEQ ID NO: 393947 - RNA, 17 nt, Homo sapiens
gcccugcaccugugcag

SEQ ID NO: 393948 - RNA, 15 nt, Homo sapiens
gcccuggugcugcca

SEQ ID NO: 393949 - RNA, 14 nt, Homo sapiens
gcccuuaaggacaa

SEQ ID NO: 393950 - RNA, 16 nt, Homo sapiens
gcccuuaaggacaaaa

SEQ ID NO: 393951 - RNA, 18 nt, Homo sapiens
gcccuuaaggacaaaaau

SEQ ID NO: 393952 - RNA, 21 nt, Homo sapiens
gcccuucccacaggacauuuc

SEQ ID NO: 393953 - RNA, 20 nt, Homo sapiens
gccgaaaaggauaugcagua

SEQ ID NO: 393954 - RNA, 23 nt, Homo sapiens
gccuaaaaguuacuuaccacaga

SEQ ID NO: 393955 - RNA, 16 nt, Homo sapiens
gccuagccgaccucag

SEQ ID NO: 393956 - RNA, 22 nt, Homo sapiens
gccuagcugggaaggugaccac

SEQ ID NO: 393957 - RNA, 14 nt, Homo sapiens
gccuaugugcaugc

SEQ ID NO: 393958 - RNA, 15 nt, Homo sapiens
gccucaaugccagua

SEQ ID NO: 393959 - RNA, 17 nt, Homo sapiens
gccucagugaaggacua

SEQ ID NO: 393960 - RNA, 16 nt, Homo sapiens
gccuccaagcuccauc

SEQ ID NO: 393961 - RNA, 20 nt, Homo sapiens
gccuccuccagaauggagcu

SEQ ID NO: 393962 - RNA, 14 nt, Homo sapiens
gccucugaagccua

SEQ ID NO: 393963 - RNA, 21 nt, Homo sapiens
gccucugccccgucucaugag

SEQ ID NO: 393964 - RNA, 15 nt, Homo sapiens
gccucuggcucucau

SEQ ID NO: 393965 - RNA, 18 nt, Homo sapiens
gccucuggcucucauggg

SEQ ID NO: 393966 - RNA, 20 nt, Homo sapiens
gccucuggcucucauggggu

SEQ ID NO: 393967 - RNA, 17 nt, Homo sapiens
gccugaagaacaguaac

SEQ ID NO: 393968 - RNA, 16 nt, Homo sapiens
gccugacaaccacugg

SEQ ID NO: 393969 - RNA, 17 nt, Homo sapiens
gccugagguuugccagc

SEQ ID NO: 393970 - RNA, 21 nt, Homo sapiens
gccugagguuugccagcauuu

SEQ ID NO: 393971 - RNA, 18 nt, Homo sapiens
gccugcauguaaacacgc

SEQ ID NO: 393972 - RNA, 23 nt, Homo sapiens
gccugccccaaacaaauaugcaa

SEQ ID NO: 393973 - RNA, 12 nt, Homo sapiens
gccugccccuga

SEQ ID NO: 393974 - RNA, 20 nt, Homo sapiens
gccugccgguaaacacgccu

SEQ ID NO: 393975 - RNA, 14 nt, Homo sapiens
gccuggacccugug

SEQ ID NO: 393976 - RNA, 17 nt, Homo sapiens
gccuggggucugacaau

SEQ ID NO: 393977 - RNA, 23 nt, Homo sapiens
gccuggggucugacaauaccucg

SEQ ID NO: 393978 - RNA, 20 nt, Homo sapiens
gccuguaaucccagcacuuu

SEQ ID NO: 393979 - RNA, 19 nt, Homo sapiens
gccugucccauggacacuc

SEQ ID NO: 393980 - RNA, 14 nt, Homo sapiens
gccugucuccuuug

SEQ ID NO: 393981 - RNA, 14 nt, Homo sapiens
gccugugacuuuca

SEQ ID NO: 393982 - RNA, 19 nt, Homo sapiens
gccugugguuaacaucuca

SEQ ID NO: 393983 - RNA, 23 nt, Homo sapiens
gccuucuccagacaaaccagaag

SEQ ID NO: 393984 - RNA, 22 nt, Homo sapiens
gccuuggagaacgagaccugug

SEQ ID NO: 393985 - RNA, 17 nt, Homo sapiens
gcgagucuuacuuugag

SEQ ID NO: 393986 - RNA, 22 nt, Homo sapiens
gcgauccaccugucucagccuc

SEQ ID NO: 393987 - RNA, 14 nt, Homo sapiens
gcgaugugcaagug

SEQ ID NO: 393988 - RNA, 17 nt, Homo sapiens
gcgggaggucugccagg

SEQ ID NO: 393989 - RNA, 17 nt, Homo sapiens
gcguaguccgcuuucuc

SEQ ID NO: 393990 - RNA, 18 nt, Homo sapiens
gcgucaugcuuguguuau

SEQ ID NO: 393991 - RNA, 22 nt, Homo sapiens
gcgugaaggccgagaagcaaga

SEQ ID NO: 393992 - RNA, 17 nt, Homo sapiens
gcgugacucacccaagc

SEQ ID NO: 393993 - RNA, 12 nt, Homo sapiens
gcgugcaugugc

SEQ ID NO: 393994 - RNA, 15 nt, Homo sapiens
gcgugugugcaagug

SEQ ID NO: 393995 - RNA, 20 nt, Homo sapiens
gcuaagugaaauaagccaga

SEQ ID NO: 393996 - RNA, 14 nt, Homo sapiens
gcuaauguaauaac

SEQ ID NO: 393997 - RNA, 21 nt, Homo sapiens
gcuaauugcuggcuggcugcc

SEQ ID NO: 393998 - RNA, 14 nt, Homo sapiens
gcuaccucuucuau

SEQ ID NO: 393999 - RNA, 21 nt, Homo sapiens
gcuagcugcaagugacaucuc

SEQ ID NO: 394000 - RNA, 13 nt, Homo sapiens
gcuauauugcacu

SEQ ID NO: 394001 - RNA, 14 nt, Homo sapiens
gcuauuacugucug

SEQ ID NO: 394002 - RNA, 17 nt, Homo sapiens
gcucaaaggcacaguga

SEQ ID NO: 394003 - RNA, 15 nt, Homo sapiens
gcucaagcagucuac

SEQ ID NO: 394004 - RNA, 17 nt, Homo sapiens
gcucacacaugagaucu

SEQ ID NO: 394005 - RNA, 12 nt, Homo sapiens
gcucacgugugu

SEQ ID NO: 394006 - RNA, 14 nt, Homo sapiens
gcucagcgccagcc

SEQ ID NO: 394007 - RNA, 17 nt, Homo sapiens
gcucauagaucagcaaa

SEQ ID NO: 394008 - RNA, 17 nt, Homo sapiens
gcucauagggaagaccu

SEQ ID NO: 394009 - RNA, 14 nt, Homo sapiens
gcucaucacuggau

SEQ ID NO: 394010 - RNA, 21 nt, Homo sapiens
gcucaugcacaucagcuggug

SEQ ID NO: 394011 - RNA, 17 nt, Homo sapiens
gcucauuuuuucuuaca

SEQ ID NO: 394012 - RNA, 21 nt, Homo sapiens
gcuccacacccucucccagga

SEQ ID NO: 394013 - RNA, 21 nt, Homo sapiens
gcuccaccuuccaaaggaccu

SEQ ID NO: 394014 - RNA, 20 nt, Homo sapiens
gcuccaucgcugucaucuca

SEQ ID NO: 394015 - RNA, 20 nt, Homo sapiens
gcuccauguagaagccacua

SEQ ID NO: 394016 - RNA, 13 nt, Homo sapiens
gcuccccaagaaa

SEQ ID NO: 394017 - RNA, 23 nt, Homo sapiens
gcucccccucccccacugccaua

SEQ ID NO: 394018 - RNA, 20 nt, Homo sapiens
gcuccugcggaggaggugug

SEQ ID NO: 394019 - RNA, 16 nt, Homo sapiens
gcucgcuuugagugac

SEQ ID NO: 394020 - RNA, 16 nt, Homo sapiens
gcucuauuaagauuuc

SEQ ID NO: 394021 - RNA, 16 nt, Homo sapiens
gcucucauggggucca

SEQ ID NO: 394022 - RNA, 22 nt, Homo sapiens
gcucugcaaugggcacugggau

SEQ ID NO: 394023 - RNA, 19 nt, Homo sapiens
gcucugggagacuuugaag

SEQ ID NO: 394024 - RNA, 16 nt, Homo sapiens
gcucuuucucugccag

SEQ ID NO: 394025 - RNA, 22 nt, Homo sapiens
gcucuuucucugccagugacag

SEQ ID NO: 394026 - RNA, 16 nt, Homo sapiens
gcugagagaaccucac

SEQ ID NO: 394027 - RNA, 16 nt, Homo sapiens
gcugagcaccagggga

SEQ ID NO: 394028 - RNA, 16 nt, Homo sapiens
gcugaggcaagagaau

SEQ ID NO: 394029 - RNA, 17 nt, Homo sapiens
gcugaggcagaacugcu

SEQ ID NO: 394030 - RNA, 21 nt, Homo sapiens
gcugauggaccaggaagcccu

SEQ ID NO: 394031 - RNA, 15 nt, Homo sapiens
gcugcauaguauucc

SEQ ID NO: 394032 - RNA, 23 nt, Homo sapiens
gcugcauuccuagaaauugaagu

SEQ ID NO: 394033 - RNA, 20 nt, Homo sapiens
gcugccauccagggaugcca

SEQ ID NO: 394034 - RNA, 20 nt, Homo sapiens
gcugccucuugaaugcaggg

SEQ ID NO: 394035 - RNA, 21 nt, Homo sapiens
gcugccugccgguaaacacgc

SEQ ID NO: 394036 - RNA, 14 nt, Homo sapiens
gcugcugcugcuaa

SEQ ID NO: 394037 - RNA, 21 nt, Homo sapiens
gcugcuggaggaaaacugaga

SEQ ID NO: 394038 - RNA, 15 nt, Homo sapiens
gcuggaugauggucu

SEQ ID NO: 394039 - RNA, 13 nt, Homo sapiens
gcuggcagugaca

SEQ ID NO: 394040 - RNA, 18 nt, Homo sapiens
gcuggccucuggcucuca

SEQ ID NO: 394041 - RNA, 15 nt, Homo sapiens
gcuggguccagggga

SEQ ID NO: 394042 - RNA, 18 nt, Homo sapiens
gcugugacuucuccaggu

SEQ ID NO: 394043 - RNA, 22 nt, Homo sapiens
gcugugagccccugguccugag

SEQ ID NO: 394044 - RNA, 18 nt, Homo sapiens
gcuuacauuuuuacaaua

SEQ ID NO: 394045 - RNA, 22 nt, Homo sapiens
gcuuacuuccuagucuacuuga

SEQ ID NO: 394046 - RNA, 21 nt, Homo sapiens
gcuuagacuaaggccauuauu

SEQ ID NO: 394047 - RNA, 21 nt, Homo sapiens
gcuuauucacaagacccaaaa

SEQ ID NO: 394048 - RNA, 14 nt, Homo sapiens
gcuuccuaacugcu

SEQ ID NO: 394049 - RNA, 13 nt, Homo sapiens
gcuucuccugacc

SEQ ID NO: 394050 - RNA, 20 nt, Homo sapiens
uaauuaggcaaagacaggag

SEQ ID NO: 394051 - RNA, 19 nt, Homo sapiens
uaauucaagaaaacaacuu

SEQ ID NO: 394052 - RNA, 14 nt, Homo sapiens
uaauucagcacuga

SEQ ID NO: 394053 - RNA, 19 nt, Homo sapiens
uaauucagcacugauuuca

SEQ ID NO: 394054 - RNA, 19 nt, Homo sapiens
uaauuccaauuauaugaga

SEQ ID NO: 394055 - RNA, 23 nt, Homo sapiens
uaauuccuguguagcuuuguuca

SEQ ID NO: 394056 - RNA, 18 nt, Homo sapiens
uaauucucaugugauccu

SEQ ID NO: 394057 - RNA, 19 nt, Homo sapiens
uaauuuaaaaaauaacuac

SEQ ID NO: 394058 - RNA, 19 nt, Homo sapiens
uaauuuuuccuauauugca

SEQ ID NO: 394059 - RNA, 22 nt, Homo sapiens
uaauuuuuccuauauugcauua

SEQ ID NO: 394060 - RNA, 18 nt, Homo sapiens
uaauuuuuuuaaccaaag

SEQ ID NO: 394061 - RNA, 17 nt, Homo sapiens
uacaaaaacacagcaag

SEQ ID NO: 394062 - RNA, 11 nt, Homo sapiens
uacaauuguga

SEQ ID NO: 394063 - RNA, 17 nt, Homo sapiens
uacaauuuacaaagugu

SEQ ID NO: 394064 - RNA, 19 nt, Homo sapiens
uacacgagguaugaggucu

SEQ ID NO: 394065 - RNA, 23 nt, Homo sapiens
uacacucuuauagaaaguucaaa

SEQ ID NO: 394066 - RNA, 14 nt, Homo sapiens
uacagaacucuuuc

SEQ ID NO: 394067 - RNA, 19 nt, Homo sapiens
uacagaaucaaaugcaauu

SEQ ID NO: 394068 - RNA, 13 nt, Homo sapiens
uacagauagucaa

SEQ ID NO: 394069 - RNA, 14 nt, Homo sapiens
uacaggcacaaaau

SEQ ID NO: 394070 - RNA, 15 nt, Homo sapiens
uacaggcagcacaga

SEQ ID NO: 394071 - RNA, 14 nt, Homo sapiens
uacaggcuagggau

SEQ ID NO: 394072 - RNA, 13 nt, Homo sapiens
uacagugcuauuu

SEQ ID NO: 394073 - RNA, 14 nt, Homo sapiens
uacaguuuaucuau

SEQ ID NO: 394074 - RNA, 13 nt, Homo sapiens
uacauaaacugac

SEQ ID NO: 394075 - RNA, 15 nt, Homo sapiens
uacauaacacauauc

SEQ ID NO: 394076 - RNA, 20 nt, Homo sapiens
uacauacaggccauacuuua

SEQ ID NO: 394077 - RNA, 13 nt, Homo sapiens
uacaugacauuua

SEQ ID NO: 394078 - RNA, 13 nt, Homo sapiens
uacauguaaucca

SEQ ID NO: 394079 - RNA, 22 nt, Homo sapiens
uacauucugcaagcacaucugc

SEQ ID NO: 394080 - RNA, 14 nt, Homo sapiens
uacauuguaaauag

SEQ ID NO: 394081 - RNA, 19 nt, Homo sapiens
uacauugugggauguucag

SEQ ID NO: 394082 - RNA, 23 nt, Homo sapiens
uacauuguuugucugucuucaua

SEQ ID NO: 394083 - RNA, 15 nt, Homo sapiens
uacauuuaauacagc

SEQ ID NO: 394084 - RNA, 19 nt, Homo sapiens
uaccacugauuuggagaua

SEQ ID NO: 394085 - RNA, 15 nt, Homo sapiens
uaccagacuguguau

SEQ ID NO: 394086 - RNA, 22 nt, Homo sapiens
uaccagacuguguauucauuga

SEQ ID NO: 394087 - RNA, 13 nt, Homo sapiens
uaccaucagggac

SEQ ID NO: 394088 - RNA, 19 nt, Homo sapiens
uaccccaauuuacuugcca

SEQ ID NO: 394089 - RNA, 23 nt, Homo sapiens
uacccuuccuacagauagucaaa

SEQ ID NO: 394090 - RNA, 17 nt, Homo sapiens
uaccgcugcauaguauu

SEQ ID NO: 394091 - RNA, 15 nt, Homo sapiens
uaccuaguagucauu

SEQ ID NO: 394092 - RNA, 18 nt, Homo sapiens
uaccuaguagucauuuca

SEQ ID NO: 394093 - RNA, 14 nt, Homo sapiens
uaccugacacuccc

SEQ ID NO: 394094 - RNA, 16 nt, Homo sapiens
uaccugggcauacuaa

SEQ ID NO: 394095 - RNA, 13 nt, Homo sapiens
uaccuugugcuaa

SEQ ID NO: 394096 - RNA, 17 nt, Homo sapiens
uacuaaaaaucaugaga

SEQ ID NO: 394097 - RNA, 23 nt, Homo sapiens
uacuaagccacaagaaauuugau

SEQ ID NO: 394098 - RNA, 21 nt, Homo sapiens
uacugaaagguuacccuguaa

SEQ ID NO: 394099 - RNA, 13 nt, Homo sapiens
uacugaucuuacu

SEQ ID NO: 394100 - RNA, 17 nt, Homo sapiens
uacugauuuuugugauu

SEQ ID NO: 394101 - RNA, 22 nt, Homo sapiens
uacugcucaucauuccuugaga

SEQ ID NO: 394102 - RNA, 14 nt, Homo sapiens
uacugcuguaaaua

SEQ ID NO: 394103 - RNA, 23 nt, Homo sapiens
uacuguaggcacacuuugcacug

SEQ ID NO: 394104 - RNA, 20 nt, Homo sapiens
uacuuauauguaaaguauua

SEQ ID NO: 394105 - RNA, 19 nt, Homo sapiens
uacuugggagaccuguaau

SEQ ID NO: 394106 - RNA, 20 nt, Homo sapiens
uacuugggaggcugaggcag

SEQ ID NO: 394107 - RNA, 13 nt, Homo sapiens
uagaaaaaccacc

SEQ ID NO: 394108 - RNA, 20 nt, Homo sapiens
uagaaacucaggauggucau

SEQ ID NO: 394109 - RNA, 20 nt, Homo sapiens
uagaaaggcaguucagguau

SEQ ID NO: 394110 - RNA, 21 nt, Homo sapiens
uagaagccacuauuacuggga

SEQ ID NO: 394111 - RNA, 15 nt, Homo sapiens
uagaaggagacagag

SEQ ID NO: 394112 - RNA, 20 nt, Homo sapiens
uagaaggguaccuugaacac

SEQ ID NO: 394113 - RNA, 23 nt, Homo sapiens
uagacuauaagcagaagcacaua

SEQ ID NO: 394114 - RNA, 22 nt, Homo sapiens
uagacugacccugaucagucua

SEQ ID NO: 394115 - RNA, 17 nt, Homo sapiens
uagacuuaaacagcaga

SEQ ID NO: 394116 - RNA, 15 nt, Homo sapiens
uagacuuaaaucuca

SEQ ID NO: 394117 - RNA, 14 nt, Homo sapiens
uagaggugagggaa

SEQ ID NO: 394118 - RNA, 18 nt, Homo sapiens
uagagucugaacagcugu

SEQ ID NO: 394119 - RNA, 15 nt, Homo sapiens
uagauaaauuucaau

SEQ ID NO: 394120 - RNA, 20 nt, Homo sapiens
uagaucccccagacuuuaca

SEQ ID NO: 394121 - RNA, 14 nt, Homo sapiens
uagcaaaauugagg

SEQ ID NO: 394122 - RNA, 14 nt, Homo sapiens
uagcacuauuuaca

SEQ ID NO: 394123 - RNA, 14 nt, Homo sapiens
uagcagacaguguu

SEQ ID NO: 394124 - RNA, 20 nt, Homo sapiens
uagcagaggagccauguccu

SEQ ID NO: 394125 - RNA, 14 nt, Homo sapiens
uagcagcagugcau

SEQ ID NO: 394126 - RNA, 17 nt, Homo sapiens
uagcagcuaucucucag

SEQ ID NO: 394127 - RNA, 13 nt, Homo sapiens
uagcauacgguau

SEQ ID NO: 394128 - RNA, 16 nt, Homo sapiens
uagcauugagugcuuu

SEQ ID NO: 394129 - RNA, 22 nt, Homo sapiens
uagccaauauuuuucuuacuga

SEQ ID NO: 394130 - RNA, 14 nt, Homo sapiens
uagcccaaaaccaa

SEQ ID NO: 394131 - RNA, 13 nt, Homo sapiens
uagcccaggagag

SEQ ID NO: 394132 - RNA, 22 nt, Homo sapiens
uagccucgccgucugugaauug

SEQ ID NO: 394133 - RNA, 20 nt, Homo sapiens
uagcgcugccgcaccccaga

SEQ ID NO: 394134 - RNA, 18 nt, Homo sapiens
uagcugcauuccuagaaa

SEQ ID NO: 394135 - RNA, 19 nt, Homo sapiens
uagcuuagaccucagccug

SEQ ID NO: 394136 - RNA, 18 nt, Homo sapiens
uagcuugggacaaaucaa

SEQ ID NO: 394137 - RNA, 23 nt, Homo sapiens
uagcuuuagggcaauauugccau

SEQ ID NO: 394138 - RNA, 16 nt, Homo sapiens
uaggaagagaaaccag

SEQ ID NO: 394139 - RNA, 13 nt, Homo sapiens
uaggaaguaggaa

SEQ ID NO: 394140 - RNA, 12 nt, Homo sapiens
uaggcagggaag

SEQ ID NO: 394141 - RNA, 18 nt, Homo sapiens
uaggcuccgucaguauca

SEQ ID NO: 394142 - RNA, 19 nt, Homo sapiens
uagggcaauauugccaugg

SEQ ID NO: 394143 - RNA, 13 nt, Homo sapiens
uaggggcaaaaau

SEQ ID NO: 394144 - RNA, 16 nt, Homo sapiens
uagguggcaagcugug

SEQ ID NO: 394145 - RNA, 23 nt, Homo sapiens
uaguacuugggagaccuguaauc

SEQ ID NO: 394146 - RNA, 13 nt, Homo sapiens
uagucaaaccaua

SEQ ID NO: 394147 - RNA, 20 nt, Homo sapiens
uagucaagugcguccacgag

SEQ ID NO: 394148 - RNA, 22 nt, Homo sapiens
uagucacagagauaauucuagc

SEQ ID NO: 394149 - RNA, 13 nt, Homo sapiens
uagucaugugacc

SEQ ID NO: 394150 - RNA, 13 nt, Homo sapiens
uaguuaaaguaau

SEQ ID NO: 394151 - RNA, 21 nt, Homo sapiens
uaguugaucuacaaaggccau

SEQ ID NO: 394152 - RNA, 20 nt, Homo sapiens
uaguuucccuugcaugguuu

SEQ ID NO: 394153 - RNA, 22 nt, Homo sapiens
uaguuugauacucccagucuug

SEQ ID NO: 394154 - RNA, 13 nt, Homo sapiens
uaguuuucauaca

SEQ ID NO: 394155 - RNA, 23 nt, Homo sapiens
uaguuuugauccuaaaucugccu

SEQ ID NO: 394156 - RNA, 23 nt, Homo sapiens
uauaaagauacagaacucuuuca

SEQ ID NO: 394157 - RNA, 15 nt, Homo sapiens
uauaaagauggcuga

SEQ ID NO: 394158 - RNA, 23 nt, Homo sapiens
uauaacuacuccggagacagggu

SEQ ID NO: 394159 - RNA, 15 nt, Homo sapiens
uauaagacuacuaua

SEQ ID NO: 394160 - RNA, 22 nt, Homo sapiens
uauaaucuuccauacuucuuca

SEQ ID NO: 394161 - RNA, 11 nt, Homo sapiens
uauacagcuca

SEQ ID NO: 394162 - RNA, 20 nt, Homo sapiens
uauaccugggcauacuaaua

SEQ ID NO: 394163 - RNA, 21 nt, Homo sapiens
uauagcgauugaaagggcaau

SEQ ID NO: 394164 - RNA, 21 nt, Homo sapiens
uauaggugcuacaaaaacaca

SEQ ID NO: 394165 - RNA, 19 nt, Homo sapiens
uauaguaugaaugcagugg

SEQ ID NO: 394166 - RNA, 22 nt, Homo sapiens
uauagucgaacaauucauauau

SEQ ID NO: 394167 - RNA, 18 nt, Homo sapiens
uauauaaaugugauugca

SEQ ID NO: 394168 - RNA, 21 nt, Homo sapiens
uauauaaaugugauugcagcu

SEQ ID NO: 394169 - RNA, 20 nt, Homo sapiens
uauauacccguacaacgugu

SEQ ID NO: 394170 - RNA, 12 nt, Homo sapiens
uauauauugaau

SEQ ID NO: 394171 - RNA, 19 nt, Homo sapiens
uauauauuuauaacucauc

SEQ ID NO: 394172 - RNA, 16 nt, Homo sapiens
uauauguauaugcaau

SEQ ID NO: 394173 - RNA, 13 nt, Homo sapiens
uauauuauggaag

SEQ ID NO: 394174 - RNA, 14 nt, Homo sapiens
uaucagucauaacu

SEQ ID NO: 394175 - RNA, 24 nt, Homo sapiens
uauccacuuaccuagauucuacau

SEQ ID NO: 394176 - RNA, 18 nt, Homo sapiens
uaucccauugaaacaaaa

SEQ ID NO: 394177 - RNA, 21 nt, Homo sapiens
uaucccuacauguauugcaca

SEQ ID NO: 394178 - RNA, 14 nt, Homo sapiens
uaucccuaugcugc

SEQ ID NO: 394179 - RNA, 17 nt, Homo sapiens
uaucucucagugaacug

SEQ ID NO: 394180 - RNA, 18 nt, Homo sapiens
uaucugugaauucagauu

SEQ ID NO: 394181 - RNA, 22 nt, Homo sapiens
uaucuugcuuuuuuucaccaau

SEQ ID NO: 394182 - RNA, 21 nt, Homo sapiens
uaugaagugacucucacaaga

SEQ ID NO: 394183 - RNA, 13 nt, Homo sapiens
uaugaaugcagug

SEQ ID NO: 394184 - RNA, 15 nt, Homo sapiens
uaugacaucagcaau

SEQ ID NO: 394185 - RNA, 18 nt, Homo sapiens
uaugagggaaaaugagua

SEQ ID NO: 394186 - RNA, 21 nt, Homo sapiens
uaugaguuuuugauagcuuua

SEQ ID NO: 394187 - RNA, 13 nt, Homo sapiens
uaugaucuuggcu

SEQ ID NO: 394188 - RNA, 17 nt, Homo sapiens
uaugauuccaccuacau

SEQ ID NO: 394189 - RNA, 15 nt, Homo sapiens
uaugauugugcacau

SEQ ID NO: 394190 - RNA, 20 nt, Homo sapiens
uaugauuuaagguacuuaaa

SEQ ID NO: 394191 - RNA, 16 nt, Homo sapiens
ugaccaguaauuguga

SEQ ID NO: 394192 - RNA, 21 nt, Homo sapiens
ugaccagugucuacauugcca

SEQ ID NO: 394193 - RNA, 18 nt, Homo sapiens
ugacccugauacaggcau

SEQ ID NO: 394194 - RNA, 17 nt, Homo sapiens
ugaccgagaacuuuuaa

SEQ ID NO: 394195 - RNA, 16 nt, Homo sapiens
ugaccugugucacuac

SEQ ID NO: 394196 - RNA, 23 nt, Homo sapiens
ugaccuguuauuaccauuagcau

SEQ ID NO: 394197 - RNA, 22 nt, Homo sapiens
ugaccuuguugcaugauguauu

SEQ ID NO: 394198 - RNA, 15 nt, Homo sapiens
ugacgacaagugcug

SEQ ID NO: 394199 - RNA, 22 nt, Homo sapiens
ugacguagaauugagucuucca

SEQ ID NO: 394200 - RNA, 23 nt, Homo sapiens
ugacucuccagaaagcucaucuc

SEQ ID NO: 394201 - RNA, 14 nt, Homo sapiens
ugacuugacuuuag

SEQ ID NO: 394202 - RNA, 23 nt, Homo sapiens
ugagaaaccuuauuguaccucuc

SEQ ID NO: 394203 - RNA, 18 nt, Homo sapiens
ugagaaagacuauucaaa

SEQ ID NO: 394204 - RNA, 17 nt, Homo sapiens
ugagaaagagcacuuaa

SEQ ID NO: 394205 - RNA, 22 nt, Homo sapiens
ugagaaagagcacuuaagagaa

SEQ ID NO: 394206 - RNA, 20 nt, Homo sapiens
ugagaagaaagaaccaacca

SEQ ID NO: 394207 - RNA, 15 nt, Homo sapiens
ugagaccaaccuggg

SEQ ID NO: 394208 - RNA, 15 nt, Homo sapiens
ugagagacaggacua

SEQ ID NO: 394209 - RNA, 19 nt, Homo sapiens
ugagagacaggacuagcug

SEQ ID NO: 394210 - RNA, 15 nt, Homo sapiens
ugagauccuuuaaau

SEQ ID NO: 394211 - RNA, 23 nt, Homo sapiens
ugagaucuaaggaugucacaggg

SEQ ID NO: 394212 - RNA, 22 nt, Homo sapiens
ugagaugggagaaucacuugaa

SEQ ID NO: 394213 - RNA, 23 nt, Homo sapiens
ugagaugggagaaucacuugaac

SEQ ID NO: 394214 - RNA, 17 nt, Homo sapiens
ugagcaccgucauggcu

SEQ ID NO: 394215 - RNA, 23 nt, Homo sapiens
ugagcauccucucucacauggaa

SEQ ID NO: 394216 - RNA, 22 nt, Homo sapiens
ugagccagccuugcaguaggca

SEQ ID NO: 394217 - RNA, 18 nt, Homo sapiens
ugagcccggaugcuucuc

SEQ ID NO: 394218 - RNA, 13 nt, Homo sapiens
ugagcgacaguga

SEQ ID NO: 394219 - RNA, 14 nt, Homo sapiens
ugagcgacagugag

SEQ ID NO: 394220 - RNA, 24 nt, Homo sapiens
ugagcgaugacucaagugucucag

SEQ ID NO: 394221 - RNA, 22 nt, Homo sapiens
ugagcuauuuccauuccagaau

SEQ ID NO: 394222 - RNA, 16 nt, Homo sapiens
ugaggaugcagaguca

SEQ ID NO: 394223 - RNA, 21 nt, Homo sapiens
ugaggcacgagcaaagugaag

SEQ ID NO: 394224 - RNA, 14 nt, Homo sapiens
ugagucaugaucuc

SEQ ID NO: 394225 - RNA, 19 nt, Homo sapiens
ugaguccucuuaaugcuag

SEQ ID NO: 394226 - RNA, 14 nt, Homo sapiens
ugaguucuacauaa

SEQ ID NO: 394227 - RNA, 15 nt, Homo sapiens
ugauacauaugugaa

SEQ ID NO: 394228 - RNA, 19 nt, Homo sapiens
ugauacgcaacauaauuaa

SEQ ID NO: 394229 - RNA, 12 nt, Homo sapiens
ugauacuuuuaa

SEQ ID NO: 394230 - RNA, 13 nt, Homo sapiens
ugauagcuuuauu

SEQ ID NO: 394231 - RNA, 17 nt, Homo sapiens
ugauauauaaaugugau

SEQ ID NO: 394232 - RNA, 18 nt, Homo sapiens
ugauauguaaacauaauu

SEQ ID NO: 394233 - RNA, 19 nt, Homo sapiens
ugauauguucaacuggaga

SEQ ID NO: 394234 - RNA, 13 nt, Homo sapiens
ugauauugcagcu

SEQ ID NO: 394235 - RNA, 20 nt, Homo sapiens
ugaucagcgccgcaccagcc

SEQ ID NO: 394236 - RNA, 17 nt, Homo sapiens
ugauccacuucucucag

SEQ ID NO: 394237 - RNA, 18 nt, Homo sapiens
ugauccuaaugaaugcau

SEQ ID NO: 394238 - RNA, 12 nt, Homo sapiens
ugaucugaugca

SEQ ID NO: 394239 - RNA, 21 nt, Homo sapiens
ugauggagauauuuacaugaa

SEQ ID NO: 394240 - RNA, 14 nt, Homo sapiens
ugauuucauuucaa

SEQ ID NO: 394241 - RNA, 15 nt, Homo sapiens
ugauuuugaaaucau

SEQ ID NO: 394242 - RNA, 14 nt, Homo sapiens
ugauuuuuuuccac

SEQ ID NO: 394243 - RNA, 16 nt, Homo sapiens
ugcaaaaaacucagag

SEQ ID NO: 394244 - RNA, 22 nt, Homo sapiens
ugcaaaaggacucucaggacca

SEQ ID NO: 394245 - RNA, 13 nt, Homo sapiens
ugcaaacgcugcc

SEQ ID NO: 394246 - RNA, 13 nt, Homo sapiens
ugcaaagcacuga

SEQ ID NO: 394247 - RNA, 20 nt, Homo sapiens
ugcaaaguucccuacuuccu

SEQ ID NO: 394248 - RNA, 15 nt, Homo sapiens
ugcaagagugacagu

SEQ ID NO: 394249 - RNA, 15 nt, Homo sapiens
ugcaagcacaucugc

SEQ ID NO: 394250 - RNA, 16 nt, Homo sapiens
ugcaagugacaucucu

SEQ ID NO: 394251 - RNA, 14 nt, Homo sapiens
ugcaagugugugca

SEQ ID NO: 394252 - RNA, 18 nt, Homo sapiens
ugcaauaggugugcguca

SEQ ID NO: 394253 - RNA, 12 nt, Homo sapiens
ugcaauuccacu

SEQ ID NO: 394254 - RNA, 15 nt, Homo sapiens
ugcacaaagcccuuc

SEQ ID NO: 394255 - RNA, 14 nt, Homo sapiens
ugcacacaaaacaa

SEQ ID NO: 394256 - RNA, 13 nt, Homo sapiens
ugcacacuuugcc

SEQ ID NO: 394257 - RNA, 19 nt, Homo sapiens
ugcacauacuugagacugu

SEQ ID NO: 394258 - RNA, 11 nt, Homo sapiens
ugcacauugua

SEQ ID NO: 394259 - RNA, 14 nt, Homo sapiens
ugcaccacugcacu

SEQ ID NO: 394260 - RNA, 15 nt, Homo sapiens
ugcacgcccaugugu

SEQ ID NO: 394261 - RNA, 21 nt, Homo sapiens
ugcacuguucccccugugcag

SEQ ID NO: 394262 - RNA, 21 nt, Homo sapiens
ugcacuugcacgcccaugugu

SEQ ID NO: 394263 - RNA, 11 nt, Homo sapiens
ugcacuuuuaa

SEQ ID NO: 394264 - RNA, 17 nt, Homo sapiens
ugcacuuuuaaaccucu

SEQ ID NO: 394265 - RNA, 18 nt, Homo sapiens
ugcacuuuuaaaccucuc

SEQ ID NO: 394266 - RNA, 13 nt, Homo sapiens
ugcagagacagag

SEQ ID NO: 394267 - RNA, 15 nt, Homo sapiens
ugcagauaaacagua

SEQ ID NO: 394268 - RNA, 22 nt, Homo sapiens
ugcagauaaacaguagugauag

SEQ ID NO: 394269 - RNA, 15 nt, Homo sapiens
ugcagcuuauauuca

SEQ ID NO: 394270 - RNA, 22 nt, Homo sapiens
ugcaggacauuuggcugugaug

SEQ ID NO: 394271 - RNA, 16 nt, Homo sapiens
ugcaggaccucaggug

SEQ ID NO: 394272 - RNA, 17 nt, Homo sapiens
ugcaguagcacgaucuc

SEQ ID NO: 394273 - RNA, 18 nt, Homo sapiens
ugcagucaucuugaccaa

SEQ ID NO: 394274 - RNA, 19 nt, Homo sapiens
ugcagucaucuugaccaag

SEQ ID NO: 394275 - RNA, 20 nt, Homo sapiens
ugcaguggcccccacagaaa

SEQ ID NO: 394276 - RNA, 21 nt, Homo sapiens
ugcauguaaacacgccugcaa

SEQ ID NO: 394277 - RNA, 21 nt, Homo sapiens
ugcaugucaucuucuaggcca

SEQ ID NO: 394278 - RNA, 16 nt, Homo sapiens
ugcaugugugugcuca

SEQ ID NO: 394279 - RNA, 15 nt, Homo sapiens
ugcauucacccagac

SEQ ID NO: 394280 - RNA, 23 nt, Homo sapiens
ugcauuuaaauacagucuuccau

SEQ ID NO: 394281 - RNA, 13 nt, Homo sapiens
ugcauuuauagca

SEQ ID NO: 394282 - RNA, 18 nt, Homo sapiens
ugccaaagggaaauauca

SEQ ID NO: 394283 - RNA, 17 nt, Homo sapiens
ugccaagcacagugccu

SEQ ID NO: 394284 - RNA, 23 nt, Homo sapiens
ugccacagccuccccugccaggg

SEQ ID NO: 394285 - RNA, 12 nt, Homo sapiens
ugccagacaugu

SEQ ID NO: 394286 - RNA, 18 nt, Homo sapiens
ugccagcaaugacaucuc

SEQ ID NO: 394287 - RNA, 18 nt, Homo sapiens
ugccagggacugacaaaa

SEQ ID NO: 394288 - RNA, 23 nt, Homo sapiens
ugccauggaggcaugccaaaugu

SEQ ID NO: 394289 - RNA, 14 nt, Homo sapiens
ugcccacucuccac

SEQ ID NO: 394290 - RNA, 19 nt, Homo sapiens
ugcccaggaaccucagggc

SEQ ID NO: 394291 - RNA, 20 nt, Homo sapiens
ugcccaggcuggagugcagu

SEQ ID NO: 394292 - RNA, 20 nt, Homo sapiens
ugcccagggcucagccuggu

SEQ ID NO: 394293 - RNA, 12 nt, Homo sapiens
ugcccagugugu

SEQ ID NO: 394294 - RNA, 16 nt, Homo sapiens
ugcccaguguguuucu

SEQ ID NO: 394295 - RNA, 18 nt, Homo sapiens
ugccccagaaaaauaacu

SEQ ID NO: 394296 - RNA, 18 nt, Homo sapiens
ugccccaggccugaaaga

SEQ ID NO: 394297 - RNA, 16 nt, Homo sapiens
ugccccccuugccaga

SEQ ID NO: 394298 - RNA, 16 nt, Homo sapiens
ugccccuggcucugac

SEQ ID NO: 394299 - RNA, 19 nt, Homo sapiens
ugcccucgggcgagucacu

SEQ ID NO: 394300 - RNA, 20 nt, Homo sapiens
ugcccugggauguccacaga

SEQ ID NO: 394301 - RNA, 21 nt, Homo sapiens
ugcccuuggaggccagccagu

SEQ ID NO: 394302 - RNA, 22 nt, Homo sapiens
ugccucauuaccuugugcuaau

SEQ ID NO: 394303 - RNA, 17 nt, Homo sapiens
ugccuccaccccccaga

SEQ ID NO: 394304 - RNA, 18 nt, Homo sapiens
ugccuccaccccccagaa

SEQ ID NO: 394305 - RNA, 17 nt, Homo sapiens
ugccucucgguggccag

SEQ ID NO: 394306 - RNA, 15 nt, Homo sapiens
ugccucuguauuuaa

SEQ ID NO: 394307 - RNA, 16 nt, Homo sapiens
ugccuuggcuucaggg

SEQ ID NO: 394308 - RNA, 18 nt, Homo sapiens
ugcggccuuuggcuucac

SEQ ID NO: 394309 - RNA, 15 nt, Homo sapiens
ugcgugcaugugcac

SEQ ID NO: 394310 - RNA, 15 nt, Homo sapiens
ugcgugugugcaagu

SEQ ID NO: 394311 - RNA, 19 nt, Homo sapiens
ugcguuuccugugcaugga

SEQ ID NO: 394312 - RNA, 23 nt, Homo sapiens
ugcuaaacgcacacaguaucuag

SEQ ID NO: 394313 - RNA, 23 nt, Homo sapiens
ugcuaauauauguauaugcaaua

SEQ ID NO: 394314 - RNA, 17 nt, Homo sapiens
ugcuaauucaaagcucu

SEQ ID NO: 394315 - RNA, 15 nt, Homo sapiens
ugcuaucgcaccacu

SEQ ID NO: 394316 - RNA, 12 nt, Homo sapiens
ugcuauuugccu

SEQ ID NO: 394317 - RNA, 22 nt, Homo sapiens
ugcucagggaauaauccagaaa

SEQ ID NO: 394318 - RNA, 17 nt, Homo sapiens
ugcucccugaagccagc

SEQ ID NO: 394319 - RNA, 18 nt, Homo sapiens
ugcucgccuuagcacuac

SEQ ID NO: 394320 - RNA, 23 nt, Homo sapiens
ugcucuuuaugaaugaaaaaaca

SEQ ID NO: 394321 - RNA, 16 nt, Homo sapiens
ugcucuuucucugcca

SEQ ID NO: 394322 - RNA, 23 nt, Homo sapiens
ugcugagugcaccacuucaagug

SEQ ID NO: 394323 - RNA, 15 nt, Homo sapiens
ugcugcugccuuuag

SEQ ID NO: 394324 - RNA, 19 nt, Homo sapiens
ugcugcuugaggcaacuca

SEQ ID NO: 394325 - RNA, 22 nt, Homo sapiens
ugcuggaaagaaaacacacucc

SEQ ID NO: 394326 - RNA, 18 nt, Homo sapiens
ugcuggaggaaaacugag

SEQ ID NO: 394327 - RNA, 17 nt, Homo sapiens
ugcuggagucgggacua

SEQ ID NO: 394328 - RNA, 17 nt, Homo sapiens
ugcuggcagaaagcaaa

SEQ ID NO: 394329 - RNA, 22 nt, Homo sapiens
ugcuggcagaaagcaaauguga

SEQ ID NO: 394330 - RNA, 15 nt, Homo sapiens
ugcuggcauuugcac

SEQ ID NO: 394331 - RNA, 17 nt, Homo sapiens
ugcuggccggagcaaac

SEQ ID NO: 394332 - RNA, 23 nt, Homo sapiens
uuuacaauaaaacuuugcugcca

SEQ ID NO: 394333 - RNA, 23 nt, Homo sapiens
uuuacagaaucaaaugcaauuuu

SEQ ID NO: 394334 - RNA, 18 nt, Homo sapiens
uuuacagugcuauuuacu

SEQ ID NO: 394335 - RNA, 21 nt, Homo sapiens
uuuacauaucaccucauggcc

SEQ ID NO: 394336 - RNA, 17 nt, Homo sapiens
uuuacauuauuaagaaa

SEQ ID NO: 394337 - RNA, 21 nt, Homo sapiens
uuuaccugaaauaaaauucau

SEQ ID NO: 394338 - RNA, 20 nt, Homo sapiens
uuuacuaauccaacccauga

SEQ ID NO: 394339 - RNA, 18 nt, Homo sapiens
uuuacuugccauuacuca

SEQ ID NO: 394340 - RNA, 14 nt, Homo sapiens
uuuagagaaguaua

SEQ ID NO: 394341 - RNA, 16 nt, Homo sapiens
uuuagcagaggagcca

SEQ ID NO: 394342 - RNA, 18 nt, Homo sapiens
uuuagcagaggagccaug

SEQ ID NO: 394343 - RNA, 23 nt, Homo sapiens
uuuauaaagggagauaacaaucu

SEQ ID NO: 394344 - RNA, 21 nt, Homo sapiens
uuuauagaccagaaccagagc

SEQ ID NO: 394345 - RNA, 21 nt, Homo sapiens
uuuaucuauggcacccaugca

SEQ ID NO: 394346 - RNA, 13 nt, Homo sapiens
uuuaucugugcaa

SEQ ID NO: 394347 - RNA, 17 nt, Homo sapiens
uuuaucuugucucuggg

SEQ ID NO: 394348 - RNA, 13 nt, Homo sapiens
uuuaugaguacuu

SEQ ID NO: 394349 - RNA, 19 nt, Homo sapiens
uuuaugaucuuggcuguau

SEQ ID NO: 394350 - RNA, 12 nt, Homo sapiens
uuuaugcuccua

SEQ ID NO: 394351 - RNA, 17 nt, Homo sapiens
uuuauuauuuucaccug

SEQ ID NO: 394352 - RNA, 18 nt, Homo sapiens
uuuauuuaagcaucaaau

SEQ ID NO: 394353 - RNA, 19 nt, Homo sapiens
uuucaaagauguguugcua

SEQ ID NO: 394354 - RNA, 23 nt, Homo sapiens
uuucaaugaugggcgagcgugca

SEQ ID NO: 394355 - RNA, 21 nt, Homo sapiens
uuucaccuguuuuuaagcugu

SEQ ID NO: 394356 - RNA, 14 nt, Homo sapiens
uuucacuaccuauc

SEQ ID NO: 394357 - RNA, 19 nt, Homo sapiens
uuucauaaacuucagggau

SEQ ID NO: 394358 - RNA, 20 nt, Homo sapiens
uuucauaaacuucagggauc

SEQ ID NO: 394359 - RNA, 14 nt, Homo sapiens
uuucaucagucaau

SEQ ID NO: 394360 - RNA, 16 nt, Homo sapiens
uuuccaauugaacuuu

SEQ ID NO: 394361 - RNA, 15 nt, Homo sapiens
uuuccuaaaagugua

SEQ ID NO: 394362 - RNA, 15 nt, Homo sapiens
uuuccuuuuaugaga

SEQ ID NO: 394363 - RNA, 22 nt, Homo sapiens
uuucgcaccuaccaucagggac

SEQ ID NO: 394364 - RNA, 22 nt, Homo sapiens
uuucuacuuugaagucauacca

SEQ ID NO: 394365 - RNA, 21 nt, Homo sapiens
uuucucagcucccaaggcucu

SEQ ID NO: 394366 - RNA, 14 nt, Homo sapiens
uuucugaguuucau

SEQ ID NO: 394367 - RNA, 13 nt, Homo sapiens
uuucuguaaacuc

SEQ ID NO: 394368 - RNA, 14 nt, Homo sapiens
uuucuguucaccuu

SEQ ID NO: 394369 - RNA, 17 nt, Homo sapiens
uuucuuggccaggguag

SEQ ID NO: 394370 - RNA, 16 nt, Homo sapiens
uuucuuuuaucacgau

SEQ ID NO: 394371 - RNA, 14 nt, Homo sapiens
uuugaaaucuauga

SEQ ID NO: 394372 - RNA, 15 nt, Homo sapiens
uuugaaaucuaugaa

SEQ ID NO: 394373 - RNA, 19 nt, Homo sapiens
uuugaacccuugcuugcaa

SEQ ID NO: 394374 - RNA, 14 nt, Homo sapiens
uuugaagaccaguc

SEQ ID NO: 394375 - RNA, 14 nt, Homo sapiens
uuugagacuuagaa

SEQ ID NO: 394376 - RNA, 22 nt, Homo sapiens
uuugaugaacaaaauuuccuaa

SEQ ID NO: 394377 - RNA, 14 nt, Homo sapiens
uuugcagaugacaa

SEQ ID NO: 394378 - RNA, 19 nt, Homo sapiens
uuugcaggcucauagggaa

SEQ ID NO: 394379 - RNA, 15 nt, Homo sapiens
uuugcauguuuugua

SEQ ID NO: 394380 - RNA, 22 nt, Homo sapiens
uuuggaaaucacacgucuggcu

SEQ ID NO: 394381 - RNA, 14 nt, Homo sapiens
uuuggaauuauguc

SEQ ID NO: 394382 - RNA, 18 nt, Homo sapiens
uuuggaauuaugucugcu

SEQ ID NO: 394383 - RNA, 15 nt, Homo sapiens
uuuggauuacuuaaa

SEQ ID NO: 394384 - RNA, 21 nt, Homo sapiens
uuuggcagagcuucuuccagg

SEQ ID NO: 394385 - RNA, 23 nt, Homo sapiens
uuuggguggaauggacuacucca

SEQ ID NO: 394386 - RNA, 21 nt, Homo sapiens
uuugucauauaagauucauau

SEQ ID NO: 394387 - RNA, 22 nt, Homo sapiens
uuugucccggggcuccacugaa

SEQ ID NO: 394388 - RNA, 14 nt, Homo sapiens
uuuguguauucuuc

SEQ ID NO: 394389 - RNA, 21 nt, Homo sapiens
uuuuaaaaaaaucccauuuaa

SEQ ID NO: 394390 - RNA, 23 nt, Homo sapiens
uuuuaaauaaaaauaaguguaca

SEQ ID NO: 394391 - RNA, 23 nt, Homo sapiens
uuuuacaauaaaacuuugcugcc

SEQ ID NO: 394392 - RNA, 17 nt, Homo sapiens
uuuuacagugcuauuua

SEQ ID NO: 394393 - RNA, 22 nt, Homo sapiens
uuuuaguauaaguacauuauug

SEQ ID NO: 394394 - RNA, 20 nt, Homo sapiens
uuuuauaagacuacuauaca

SEQ ID NO: 394395 - RNA, 21 nt, Homo sapiens
uuuuauaccgcugcauaguau

SEQ ID NO: 394396 - RNA, 21 nt, Homo sapiens
uuuuaugccuucacuuuacaa

SEQ ID NO: 394397 - RNA, 23 nt, Homo sapiens
uuuuauggaggcuuugcauagau

SEQ ID NO: 394398 - RNA, 18 nt, Homo sapiens
uuuucaaagauguguugc

SEQ ID NO: 394399 - RNA, 21 nt, Homo sapiens
uuuucaaagauguguugcuau

SEQ ID NO: 394400 - RNA, 22 nt, Homo sapiens
uuuucgcaccuaccaucaggga

SEQ ID NO: 394401 - RNA, 21 nt, Homo sapiens
uuuucuaagaaagaaauugua

SEQ ID NO: 394402 - RNA, 21 nt, Homo sapiens
uuuucuaagguucucauagga

SEQ ID NO: 394403 - RNA, 16 nt, Homo sapiens
uuuucuauauggggau

SEQ ID NO: 394404 - RNA, 20 nt, Homo sapiens
uuuucuauuguuguacacag

SEQ ID NO: 394405 - RNA, 22 nt, Homo sapiens
uuuugcacauaacaugcuuuag

SEQ ID NO: 394406 - RNA, 22 nt, Homo sapiens
uuuugcauuugaauaaagccug

SEQ ID NO: 394407 - RNA, 13 nt, Homo sapiens
uuuugugauugcc

SEQ ID NO: 394408 - RNA, 22 nt, Homo sapiens
uuuuuaucuccccuucacaugc

SEQ ID NO: 394409 - RNA, 15 nt, Homo sapiens
uuuuuccccaaaguc

SEQ ID NO: 394410 - RNA, 23 nt, Homo sapiens
uuuuuggaauuaugucugcugaa

SEQ ID NO: 394411 - RNA, 12 nt, Homo sapiens
uuuuuuccacaa

SEQ ID NO: 394412 - RNA, 23 nt, Homo sapiens
gacugcugcuucuuaaccccagu

SEQ ID NO: 394413 - RNA, 14 nt, Homo sapiens
gacuguacuccucc

SEQ ID NO: 394414 - RNA, 22 nt, Homo sapiens
gacuuaaaauauuccugcauuu

SEQ ID NO: 394415 - RNA, 20 nt, Homo sapiens
gacuuaaacagcagauuuca

SEQ ID NO: 394416 - RNA, 13 nt, Homo sapiens
gacuuaacucuaa

SEQ ID NO: 394417 - RNA, 16 nt, Homo sapiens
gacuuagaaaaauccu

SEQ ID NO: 394418 - RNA, 20 nt, Homo sapiens
gacuucauuuuuccuaacag

SEQ ID NO: 394419 - RNA, 16 nt, Homo sapiens
gacuucuggcagggaa

SEQ ID NO: 394420 - RNA, 17 nt, Homo sapiens
gacuucugucuucacaa

SEQ ID NO: 394421 - RNA, 20 nt, Homo sapiens
gacuuguuuuaugcucaggg

SEQ ID NO: 394422 - RNA, 20 nt, Homo sapiens
gacuuuuuuuaaauaguaaa

SEQ ID NO: 394423 - RNA, 22 nt, Homo sapiens
gagaaaccuuauuguaccucuc

SEQ ID NO: 394424 - RNA, 15 nt, Homo sapiens
gagaaagccugagaa

SEQ ID NO: 394425 - RNA, 19 nt, Homo sapiens
gagaaagguggacuggaag

SEQ ID NO: 394426 - RNA, 13 nt, Homo sapiens
gagaacuacucag

SEQ ID NO: 394427 - RNA, 18 nt, Homo sapiens
gagaagaaagaaccaacc

SEQ ID NO: 394428 - RNA, 14 nt, Homo sapiens
gagaagacccagcu

SEQ ID NO: 394429 - RNA, 16 nt, Homo sapiens
gagaaggaaagugauu

SEQ ID NO: 394430 - RNA, 13 nt, Homo sapiens
gagaaguauacau

SEQ ID NO: 394431 - RNA, 21 nt, Homo sapiens
gagaauuuacgagcagggaug

SEQ ID NO: 394432 - RNA, 23 nt, Homo sapiens
gagacaaaucuaugccacucaga

SEQ ID NO: 394433 - RNA, 20 nt, Homo sapiens
gagacaacagcccugucuca

SEQ ID NO: 394434 - RNA, 22 nt, Homo sapiens
gagacacuauuuaucugugcaa

SEQ ID NO: 394435 - RNA, 23 nt, Homo sapiens
gagacacuauuuaucugugcaaa

SEQ ID NO: 394436 - RNA, 22 nt, Homo sapiens
gagaccaagacucugaaaucuc

SEQ ID NO: 394437 - RNA, 20 nt, Homo sapiens
gagacccucguggccuuccc

SEQ ID NO: 394438 - RNA, 13 nt, Homo sapiens
gagacuccgucuc

SEQ ID NO: 394439 - RNA, 17 nt, Homo sapiens
gagacuccgucucaagg

SEQ ID NO: 394440 - RNA, 13 nt, Homo sapiens
gagagaacuggag

SEQ ID NO: 394441 - RNA, 20 nt, Homo sapiens
gagagaugaaccacauuaua

SEQ ID NO: 394442 - RNA, 16 nt, Homo sapiens
gagagccaccaagagg

SEQ ID NO: 394443 - RNA, 13 nt, Homo sapiens
gagagggggccac

SEQ ID NO: 394444 - RNA, 14 nt, Homo sapiens
gagaguuucuguua

SEQ ID NO: 394445 - RNA, 20 nt, Homo sapiens
gagauaagggugucuuccua

SEQ ID NO: 394446 - RNA, 14 nt, Homo sapiens
gagauaaugcaguc

SEQ ID NO: 394447 - RNA, 18 nt, Homo sapiens
gagauaauucuagcuuug

SEQ ID NO: 394448 - RNA, 13 nt, Homo sapiens
gagauauuuacau

SEQ ID NO: 394449 - RNA, 21 nt, Homo sapiens
gagaucuaaggaugucacagg

SEQ ID NO: 394450 - RNA, 15 nt, Homo sapiens
gagaucuaggugagg

SEQ ID NO: 394451 - RNA, 18 nt, Homo sapiens
gagaugaaccacauuaua

SEQ ID NO: 394452 - RNA, 14 nt, Homo sapiens
gagaugcuggagaa

SEQ ID NO: 394453 - RNA, 14 nt, Homo sapiens
gagauggccugaga

SEQ ID NO: 394454 - RNA, 18 nt, Homo sapiens
gagauguccauagucaaa

SEQ ID NO: 394455 - RNA, 17 nt, Homo sapiens
gagauuaccuccugaga

SEQ ID NO: 394456 - RNA, 21 nt, Homo sapiens
gagauugugccccugcacucc

SEQ ID NO: 394457 - RNA, 15 nt, Homo sapiens
gagauuuuucaugau

SEQ ID NO: 394458 - RNA, 20 nt, Homo sapiens
gagcaaacucugcugucuaa

SEQ ID NO: 394459 - RNA, 18 nt, Homo sapiens
gagcaagugagacccugu

SEQ ID NO: 394460 - RNA, 11 nt, Homo sapiens
gagcacacugu

SEQ ID NO: 394461 - RNA, 22 nt, Homo sapiens
gagcagcuuuaaacucagggac

SEQ ID NO: 394462 - RNA, 23 nt, Homo sapiens
gagcaguagcagcagcaucucug

SEQ ID NO: 394463 - RNA, 22 nt, Homo sapiens
gagcauccucucucacauggaa

SEQ ID NO: 394464 - RNA, 13 nt, Homo sapiens
gagccauaugaau

SEQ ID NO: 394465 - RNA, 15 nt, Homo sapiens
gagccaugcugggaa

SEQ ID NO: 394466 - RNA, 15 nt, Homo sapiens
gagccgugaugccuc

SEQ ID NO: 394467 - RNA, 17 nt, Homo sapiens
gagccucgggacaucaa

SEQ ID NO: 394468 - RNA, 21 nt, Homo sapiens
gagccuuaaaacccacaaaag

SEQ ID NO: 394469 - RNA, 20 nt, Homo sapiens
gagccuuggcuguuggcagu

SEQ ID NO: 394470 - RNA, 17 nt, Homo sapiens
gagcuagaaacucagga

SEQ ID NO: 394471 - RNA, 12 nt, Homo sapiens
gagcucagagag

SEQ ID NO: 394472 - RNA, 20 nt, Homo sapiens
gagcuccccaccaccccagc

SEQ ID NO: 394473 - RNA, 21 nt, Homo sapiens
gagcucuguuuucaugcuauu

SEQ ID NO: 394474 - RNA, 20 nt, Homo sapiens
gagcugccauccagggaugc

SEQ ID NO: 394475 - RNA, 17 nt, Homo sapiens
gagcugcucucucauga

SEQ ID NO: 394476 - RNA, 21 nt, Homo sapiens
gagcuucccugacucauucug

SEQ ID NO: 394477 - RNA, 18 nt, Homo sapiens
gagcuuccuucugugaaa

SEQ ID NO: 394478 - RNA, 14 nt, Homo sapiens
gagcuuucugcuau

SEQ ID NO: 394479 - RNA, 19 nt, Homo sapiens
gaggacuguugacauccaa

SEQ ID NO: 394480 - RNA, 19 nt, Homo sapiens
gaggacuucuggcagggaa

SEQ ID NO: 394481 - RNA, 16 nt, Homo sapiens
gaggagaaacuggaac

SEQ ID NO: 394482 - RNA, 13 nt, Homo sapiens
gaggauccuguau

SEQ ID NO: 394483 - RNA, 14 nt, Homo sapiens
gaggaugagcucua

SEQ ID NO: 394484 - RNA, 19 nt, Homo sapiens
gaggauugcuugagcucag

SEQ ID NO: 394485 - RNA, 13 nt, Homo sapiens
gaggcacacagcu

SEQ ID NO: 394486 - RNA, 18 nt, Homo sapiens
gaggcagacagcagcuca

SEQ ID NO: 394487 - RNA, 17 nt, Homo sapiens
gaggcggcagugcaaca

SEQ ID NO: 394488 - RNA, 17 nt, Homo sapiens
gagggccacaugggagg

SEQ ID NO: 394489 - RNA, 20 nt, Homo sapiens
gagguaggagaauugcuuga

SEQ ID NO: 394490 - RNA, 20 nt, Homo sapiens
gaggucaaggcugcagugag

SEQ ID NO: 394491 - RNA, 18 nt, Homo sapiens
gagguggagguugcagug

SEQ ID NO: 394492 - RNA, 12 nt, Homo sapiens
gaguauaugcac

SEQ ID NO: 394493 - RNA, 13 nt, Homo sapiens
gagucaccaggaa

SEQ ID NO: 394494 - RNA, 18 nt, Homo sapiens
gagucugaacagcuguaa

SEQ ID NO: 394495 - RNA, 22 nt, Homo sapiens
gagucuucuccaauguccaaaa

SEQ ID NO: 394496 - RNA, 20 nt, Homo sapiens
gagugcaccacuucaaguga

SEQ ID NO: 394497 - RNA, 22 nt, Homo sapiens
gagugccguaacaacugugguc

SEQ ID NO: 394498 - RNA, 22 nt, Homo sapiens
gaguguuccccuuccacugagg

SEQ ID NO: 394499 - RNA, 21 nt, Homo sapiens
gaguuauuuuuauuuauuuaa

SEQ ID NO: 394500 - RNA, 13 nt, Homo sapiens
gaguuuucagugg

SEQ ID NO: 394501 - RNA, 12 nt, Homo sapiens
gauaaagcaccc

SEQ ID NO: 394502 - RNA, 15 nt, Homo sapiens
gauaaagcacccugu

SEQ ID NO: 394503 - RNA, 14 nt, Homo sapiens
gauaacugcaauuu

SEQ ID NO: 394504 - RNA, 16 nt, Homo sapiens
gauaacuuagguggca

SEQ ID NO: 394505 - RNA, 18 nt, Homo sapiens
gauaagggugucuuccua

SEQ ID NO: 394506 - RNA, 19 nt, Homo sapiens
gauaagguaccuuucacau

SEQ ID NO: 394507 - RNA, 20 nt, Homo sapiens
gauaaguaaguuugauuuca

SEQ ID NO: 394508 - RNA, 15 nt, Homo sapiens
gauaaguguccccua

SEQ ID NO: 394509 - RNA, 15 nt, Homo sapiens
gauaaucagccucuu

SEQ ID NO: 394510 - RNA, 15 nt, Homo sapiens
gauacagaacucuuu

SEQ ID NO: 394511 - RNA, 19 nt, Homo sapiens
gauacugaguaaauccaug

SEQ ID NO: 394512 - RNA, 22 nt, Homo sapiens
gauacugcucaucauuccuuga

SEQ ID NO: 394513 - RNA, 12 nt, Homo sapiens
gauaucuuggcu

SEQ ID NO: 394514 - RNA, 18 nt, Homo sapiens
gauaucuuggcuuugcca

SEQ ID NO: 394515 - RNA, 14 nt, Homo sapiens
gauaugcaguaugc

SEQ ID NO: 394516 - RNA, 14 nt, Homo sapiens
gauaugugccaggc

SEQ ID NO: 394517 - RNA, 19 nt, Homo sapiens
gauauuugaagcaucacau

SEQ ID NO: 394518 - RNA, 16 nt, Homo sapiens
gaucacuggcaaugaa

SEQ ID NO: 394519 - RNA, 19 nt, Homo sapiens
gaucagcaaaccggggccu

SEQ ID NO: 394520 - RNA, 21 nt, Homo sapiens
gauccaccugucucagccucc

SEQ ID NO: 394521 - RNA, 14 nt, Homo sapiens
gauccacuucucuc

SEQ ID NO: 394522 - RNA, 23 nt, Homo sapiens
gaucccccagacuuuacaugaca

SEQ ID NO: 394523 - RNA, 18 nt, Homo sapiens
gauccuguuggacaccca

SEQ ID NO: 394524 - RNA, 17 nt, Homo sapiens
gauccuguugggaaaga

SEQ ID NO: 394525 - RNA, 19 nt, Homo sapiens
gaucucccugccgccucaa

SEQ ID NO: 394526 - RNA, 17 nt, Homo sapiens
gaucugaugcaagcaag

SEQ ID NO: 394527 - RNA, 15 nt, Homo sapiens
gaucuuugacucuuu

SEQ ID NO: 394528 - RNA, 15 nt, Homo sapiens
gaugcaauacaagau

SEQ ID NO: 394529 - RNA, 16 nt, Homo sapiens
gaugccuucuccagac

SEQ ID NO: 394530 - RNA, 21 nt, Homo sapiens
gauggacccaaugcacacaaa

SEQ ID NO: 394531 - RNA, 18 nt, Homo sapiens
gauggagccagcucugca

SEQ ID NO: 394532 - RNA, 21 nt, Homo sapiens
gauggcugacuuugcucuuuc

SEQ ID NO: 394533 - RNA, 15 nt, Homo sapiens
gauguagucaguuag

SEQ ID NO: 394534 - RNA, 14 nt, Homo sapiens
gauguagugccucu

SEQ ID NO: 394535 - RNA, 18 nt, Homo sapiens
gaugucguuugaaucaca

SEQ ID NO: 394536 - RNA, 15 nt, Homo sapiens
gaugucucacauccu

SEQ ID NO: 394537 - RNA, 18 nt, Homo sapiens
gauguuugaggcuuucag

SEQ ID NO: 394538 - RNA, 16 nt, Homo sapiens
gauuaugaagugacuc

SEQ ID NO: 394539 - RNA, 22 nt, Homo sapiens
gauuaugaagugacucucacaa

SEQ ID NO: 394540 - RNA, 21 nt, Homo sapiens
gauuauuggaaauuuguuaua

SEQ ID NO: 394541 - RNA, 21 nt, Homo sapiens
gauucauauuuacuucuuaua

SEQ ID NO: 394542 - RNA, 13 nt, Homo sapiens
gauucccagagac

SEQ ID NO: 394543 - RNA, 14 nt, Homo sapiens
gauucuucccacac

SEQ ID NO: 394544 - RNA, 19 nt, Homo sapiens
gauugauagaguguuauca

SEQ ID NO: 394545 - RNA, 15 nt, Homo sapiens
gauugauuaccaagu

SEQ ID NO: 394546 - RNA, 19 nt, Homo sapiens
gauugcgccauugcacucc

SEQ ID NO: 394547 - RNA, 16 nt, Homo sapiens
gauuuuaucugugaau

SEQ ID NO: 394548 - RNA, 19 nt, Homo sapiens
gcaaaauacaugacauuua

SEQ ID NO: 394549 - RNA, 20 nt, Homo sapiens
gcaaaauuugaugccaggac

SEQ ID NO: 394550 - RNA, 17 nt, Homo sapiens
gcaaacuuuguauuaau

SEQ ID NO: 394551 - RNA, 17 nt, Homo sapiens
gcaaagggagcacuggg

SEQ ID NO: 394552 - RNA, 21 nt, Homo sapiens
gcaaauccuugauacugcuca

SEQ ID NO: 394553 - RNA, 14 nt, Homo sapiens
gcaaauuugauaca

SEQ ID NO: 394554 - RNA, 17 nt, Homo sapiens
gcaacccuaacaguaag

SEQ ID NO: 394555 - RNA, 14 nt, Homo sapiens
gcaacuggcucaaa

SEQ ID NO: 394556 - RNA, 18 nt, Homo sapiens
gcaacuggcucaaagaca

SEQ ID NO: 394557 - RNA, 20 nt, Homo sapiens
ucagccucuuaaagcugccu

SEQ ID NO: 394558 - RNA, 20 nt, Homo sapiens
ucagcuccgugaacuuguga

SEQ ID NO: 394559 - RNA, 14 nt, Homo sapiens
ucagcuggaucucc

SEQ ID NO: 394560 - RNA, 20 nt, Homo sapiens
ucagcuuuaguagauauuac

SEQ ID NO: 394561 - RNA, 21 nt, Homo sapiens
ucaggaaggaugagcauuuag

SEQ ID NO: 394562 - RNA, 23 nt, Homo sapiens
ucaggcgauccaccugucucagc

SEQ ID NO: 394563 - RNA, 16 nt, Homo sapiens
ucagggauagcacuga

SEQ ID NO: 394564 - RNA, 23 nt, Homo sapiens
ucagggauagcacugagcaaagc

SEQ ID NO: 394565 - RNA, 14 nt, Homo sapiens
ucagggcugugauc

SEQ ID NO: 394566 - RNA, 21 nt, Homo sapiens
ucaggguuuuuagauuaaaca

SEQ ID NO: 394567 - RNA, 16 nt, Homo sapiens
ucagguguugccaaau

SEQ ID NO: 394568 - RNA, 14 nt, Homo sapiens
ucaguaaacaauga

SEQ ID NO: 394569 - RNA, 16 nt, Homo sapiens
ucaguccaagucuucu

SEQ ID NO: 394570 - RNA, 15 nt, Homo sapiens
ucagugaaagccaga

SEQ ID NO: 394571 - RNA, 15 nt, Homo sapiens
ucagugaacugugag

SEQ ID NO: 394572 - RNA, 21 nt, Homo sapiens
ucagugcuucgcagauguccu

SEQ ID NO: 394573 - RNA, 14 nt, Homo sapiens
ucaguguauuugua

SEQ ID NO: 394574 - RNA, 13 nt, Homo sapiens
ucagugugucuaa

SEQ ID NO: 394575 - RNA, 16 nt, Homo sapiens
ucaguuucccuaucuc

SEQ ID NO: 394576 - RNA, 13 nt, Homo sapiens
ucauaagauauuu

SEQ ID NO: 394577 - RNA, 19 nt, Homo sapiens
ucauaauuucuucacucaa

SEQ ID NO: 394578 - RNA, 14 nt, Homo sapiens
ucauacauguuaca

SEQ ID NO: 394579 - RNA, 20 nt, Homo sapiens
ucauaggaaaaguacauuua

SEQ ID NO: 394580 - RNA, 16 nt, Homo sapiens
ucauaugauugugcac

SEQ ID NO: 394581 - RNA, 21 nt, Homo sapiens
ucauaugauugugcacauacu

SEQ ID NO: 394582 - RNA, 12 nt, Homo sapiens
ucauauuccugc

SEQ ID NO: 394583 - RNA, 15 nt, Homo sapiens
ucaucaaugaaugaa

SEQ ID NO: 394584 - RNA, 22 nt, Homo sapiens
ucaucagaagauaacuugagca

SEQ ID NO: 394585 - RNA, 23 nt, Homo sapiens
ucaucagcuaucguuaguguauu

SEQ ID NO: 394586 - RNA, 20 nt, Homo sapiens
ucaucaugaagcguggagac

SEQ ID NO: 394587 - RNA, 19 nt, Homo sapiens
ucaucaugucaguuccaau

SEQ ID NO: 394588 - RNA, 13 nt, Homo sapiens
ucauccaaucuaa

SEQ ID NO: 394589 - RNA, 16 nt, Homo sapiens
ucauccacuagugcaa

SEQ ID NO: 394590 - RNA, 21 nt, Homo sapiens
ucaucccgagcaccuccacau

SEQ ID NO: 394591 - RNA, 13 nt, Homo sapiens
ucauccuuuccag

SEQ ID NO: 394592 - RNA, 17 nt, Homo sapiens
ucaucuauaacaugcau

SEQ ID NO: 394593 - RNA, 20 nt, Homo sapiens
ucaucucaggccucccucaa

SEQ ID NO: 394594 - RNA, 20 nt, Homo sapiens
ucaucucucacacauuccag

SEQ ID NO: 394595 - RNA, 23 nt, Homo sapiens
ucaugaagaaccuugacggcauu

SEQ ID NO: 394596 - RNA, 22 nt, Homo sapiens
ucaugaagcguggagacagcuu

SEQ ID NO: 394597 - RNA, 16 nt, Homo sapiens
ucaugacauguuauau

SEQ ID NO: 394598 - RNA, 16 nt, Homo sapiens
ucaugauuucauuuca

SEQ ID NO: 394599 - RNA, 13 nt, Homo sapiens
ucaugcaucucca

SEQ ID NO: 394600 - RNA, 19 nt, Homo sapiens
ucaugcaucuccaccugcu

SEQ ID NO: 394601 - RNA, 17 nt, Homo sapiens
ucauggcaccaaagcca

SEQ ID NO: 394602 - RNA, 14 nt, Homo sapiens
ucauguaacuagaa

SEQ ID NO: 394603 - RNA, 15 nt, Homo sapiens
ucaugugauccuuuu

SEQ ID NO: 394604 - RNA, 23 nt, Homo sapiens
ucauguguguccacgacugucuc

SEQ ID NO: 394605 - RNA, 22 nt, Homo sapiens
ucauuaagcccucuuccaucau

SEQ ID NO: 394606 - RNA, 17 nt, Homo sapiens
ucauuagcauuuugcua

SEQ ID NO: 394607 - RNA, 20 nt, Homo sapiens
ucauuauagaucccccagac

SEQ ID NO: 394608 - RNA, 15 nt, Homo sapiens
ucauuauuugcagag

SEQ ID NO: 394609 - RNA, 18 nt, Homo sapiens
ucauugacaagaacugaa

SEQ ID NO: 394610 - RNA, 14 nt, Homo sapiens
ucauugauugaaua

SEQ ID NO: 394611 - RNA, 17 nt, Homo sapiens
ucauuuucugcauuuaa

SEQ ID NO: 394612 - RNA, 17 nt, Homo sapiens
ucauuuuuuucacugga

SEQ ID NO: 394613 - RNA, 21 nt, Homo sapiens
uccaaagaaauguaagggaaa

SEQ ID NO: 394614 - RNA, 17 nt, Homo sapiens
uccaacuguacuuuuaa

SEQ ID NO: 394615 - RNA, 14 nt, Homo sapiens
uccaagcauaccaa

SEQ ID NO: 394616 - RNA, 16 nt, Homo sapiens
uccaagccucaugucc

SEQ ID NO: 394617 - RNA, 19 nt, Homo sapiens
uccaaguuuuaauuuuuaa

SEQ ID NO: 394618 - RNA, 17 nt, Homo sapiens
uccaauaaagcauuuua

SEQ ID NO: 394619 - RNA, 12 nt, Homo sapiens
uccaaucagaac

SEQ ID NO: 394620 - RNA, 20 nt, Homo sapiens
uccacaccuagcaucucaug

SEQ ID NO: 394621 - RNA, 19 nt, Homo sapiens
uccacccuuggacuuucuu

SEQ ID NO: 394622 - RNA, 16 nt, Homo sapiens
uccaccuuccaaagga

SEQ ID NO: 394623 - RNA, 14 nt, Homo sapiens
uccacuagugcaaa

SEQ ID NO: 394624 - RNA, 15 nt, Homo sapiens
uccacugucaagaaa

SEQ ID NO: 394625 - RNA, 22 nt, Homo sapiens
uccacuuaccuagauucuacau

SEQ ID NO: 394626 - RNA, 11 nt, Homo sapiens
uccacuuagaa

SEQ ID NO: 394627 - RNA, 19 nt, Homo sapiens
uccacuucuuguuccccac

SEQ ID NO: 394628 - RNA, 11 nt, Homo sapiens
uccacuuuuau

SEQ ID NO: 394629 - RNA, 12 nt, Homo sapiens
uccagaauucac

SEQ ID NO: 394630 - RNA, 17 nt, Homo sapiens
uccagauagcagggcau

SEQ ID NO: 394631 - RNA, 19 nt, Homo sapiens
uccagauccuucaaagagu

SEQ ID NO: 394632 - RNA, 12 nt, Homo sapiens
uccagauggcaa

SEQ ID NO: 394633 - RNA, 20 nt, Homo sapiens
uccagccugagcgacaguga

SEQ ID NO: 394634 - RNA, 20 nt, Homo sapiens
uccaggauagucuaagggag

SEQ ID NO: 394635 - RNA, 17 nt, Homo sapiens
uccaggcgaugugcaag

SEQ ID NO: 394636 - RNA, 19 nt, Homo sapiens
uccaggcgaugugcaagug

SEQ ID NO: 394637 - RNA, 20 nt, Homo sapiens
uccaggcgaugugcaagugu

SEQ ID NO: 394638 - RNA, 18 nt, Homo sapiens
uccaggcgugguggcaca

SEQ ID NO: 394639 - RNA, 19 nt, Homo sapiens
uccaguauucuugucaaaa

SEQ ID NO: 394640 - RNA, 22 nt, Homo sapiens
uccaucagguuccaucccgaaa

SEQ ID NO: 394641 - RNA, 12 nt, Homo sapiens
uccaucccgaaa

SEQ ID NO: 394642 - RNA, 15 nt, Homo sapiens
uccaucccgaaaauc

SEQ ID NO: 394643 - RNA, 16 nt, Homo sapiens
uccaugagacacaucu

SEQ ID NO: 394644 - RNA, 16 nt, Homo sapiens
uccaugugugugcaag

SEQ ID NO: 394645 - RNA, 15 nt, Homo sapiens
ucccaaagugcuagu

SEQ ID NO: 394646 - RNA, 21 nt, Homo sapiens
ucccaaauuucauaccuauca

SEQ ID NO: 394647 - RNA, 23 nt, Homo sapiens
ucccacacagaauauacauuguc

SEQ ID NO: 394648 - RNA, 18 nt, Homo sapiens
ucccacacccuguuuuac

SEQ ID NO: 394649 - RNA, 16 nt, Homo sapiens
ucccacaggcccuucc

SEQ ID NO: 394650 - RNA, 20 nt, Homo sapiens
ucccaccucugugaccucag

SEQ ID NO: 394651 - RNA, 21 nt, Homo sapiens
ucccagcugaaauacugaggg

SEQ ID NO: 394652 - RNA, 20 nt, Homo sapiens
ucccaggcuggagugcagug

SEQ ID NO: 394653 - RNA, 16 nt, Homo sapiens
ucccauagccaggaaa

SEQ ID NO: 394654 - RNA, 15 nt, Homo sapiens
ucccaucccacugcu

SEQ ID NO: 394655 - RNA, 16 nt, Homo sapiens
ucccaucccagcugaa

SEQ ID NO: 394656 - RNA, 23 nt, Homo sapiens
ucccaugcuuuguaggugucuca

SEQ ID NO: 394657 - RNA, 17 nt, Homo sapiens
ucccauggacacuccag

SEQ ID NO: 394658 - RNA, 14 nt, Homo sapiens
ucccauguauuuau

SEQ ID NO: 394659 - RNA, 16 nt, Homo sapiens
uccccaaccacuucau

SEQ ID NO: 394660 - RNA, 19 nt, Homo sapiens
uccccacugccuacugcau

SEQ ID NO: 394661 - RNA, 23 nt, Homo sapiens
uccccagcccuggcucugcaaug

SEQ ID NO: 394662 - RNA, 12 nt, Homo sapiens
uccccauugccu

SEQ ID NO: 394663 - RNA, 17 nt, Homo sapiens
uccccauuugcuuacuu

SEQ ID NO: 394664 - RNA, 14 nt, Homo sapiens
ucccccauagccac

SEQ ID NO: 394665 - RNA, 15 nt, Homo sapiens
uccccuggacuggga

SEQ ID NO: 394666 - RNA, 16 nt, Homo sapiens
uccccuggacugggag

SEQ ID NO: 394667 - RNA, 22 nt, Homo sapiens
uccccuugcccagggcucagcc

SEQ ID NO: 394668 - RNA, 19 nt, Homo sapiens
ucccggcgucccuaccucc

SEQ ID NO: 394669 - RNA, 20 nt, Homo sapiens
ucccuaaaaacacagacauu

SEQ ID NO: 394670 - RNA, 13 nt, Homo sapiens
ucccuacauguau

SEQ ID NO: 394671 - RNA, 18 nt, Homo sapiens
ucccucacuguugaauuu

SEQ ID NO: 394672 - RNA, 14 nt, Homo sapiens
ucccucuggcccug

SEQ ID NO: 394673 - RNA, 19 nt, Homo sapiens
ucccugaaaacccagagag

SEQ ID NO: 394674 - RNA, 14 nt, Homo sapiens
ucccugguggagcu

SEQ ID NO: 394675 - RNA, 21 nt, Homo sapiens
ucccuguguauucuagugaau

SEQ ID NO: 394676 - RNA, 18 nt, Homo sapiens
ucccuguguugucucuag

SEQ ID NO: 394677 - RNA, 18 nt, Homo sapiens
ucccuguuuaaugauuga

SEQ ID NO: 394678 - RNA, 19 nt, Homo sapiens
ucccuucucuucacaguca

SEQ ID NO: 394679 - RNA, 19 nt, Homo sapiens
ucccuugccucaaugccag

SEQ ID NO: 394680 - RNA, 18 nt, Homo sapiens
uccuacuguaugugggaa

SEQ ID NO: 394681 - RNA, 14 nt, Homo sapiens
uccuagugaaagag

SEQ ID NO: 394682 - RNA, 24 nt, Homo sapiens
uccucagggacagagacaccugca

SEQ ID NO: 394683 - RNA, 15 nt, Homo sapiens
uccucaguucaucca

SEQ ID NO: 394684 - RNA, 17 nt, Homo sapiens
uccuccacaauagcaga

SEQ ID NO: 394685 - RNA, 18 nt, Homo sapiens
uccuccagaauggagcug

SEQ ID NO: 394686 - RNA, 15 nt, Homo sapiens
uccucccucauucca

SEQ ID NO: 394687 - RNA, 16 nt, Homo sapiens
uccucggguaccaaua

SEQ ID NO: 394688 - RNA, 13 nt, Homo sapiens
uccucugacucag

SEQ ID NO: 394689 - RNA, 15 nt, Homo sapiens
uccucugccaccucc

SEQ ID NO: 394690 - RNA, 19 nt, Homo sapiens
uccucugugaccaaugucu

SEQ ID NO: 394691 - RNA, 14 nt, Homo sapiens
uccucuugccacug

SEQ ID NO: 394692 - RNA, 19 nt, Homo sapiens
uccugaccucgugauccac

SEQ ID NO: 394693 - RNA, 13 nt, Homo sapiens
uccugcaacucaa

SEQ ID NO: 394694 - RNA, 21 nt, Homo sapiens
uccugcagccuccuccugacc

SEQ ID NO: 394695 - RNA, 19 nt, Homo sapiens
uccugcauucacccagaca

SEQ ID NO: 394696 - RNA, 10 nt, Homo sapiens
uccugccacc

SEQ ID NO: 394697 - RNA, 17 nt, Homo sapiens
uccugccgcaacaguuu

SEQ ID NO: 394698 - RNA, 20 nt, Homo sapiens
uccugccucagccuccugag

SEQ ID NO: 394699 - RNA, 22 nt, Homo sapiens
uccugcuacaacuucagcagua

SEQ ID NO: 394700 - RNA, 18 nt, Homo sapiens
uccuggguggacuuuuga

SEQ ID NO: 394701 - RNA, 23 nt, Homo sapiens
uccugguuaaauuugaauuucag

SEQ ID NO: 394702 - RNA, 19 nt, Homo sapiens
uccuguacauugugggaug

SEQ ID NO: 394703 - RNA, 20 nt, Homo sapiens
cuuugugugcgucacuguga

SEQ ID NO: 394704 - RNA, 22 nt, Homo sapiens
cuuuuaauguauuuguuugcaa

SEQ ID NO: 394705 - RNA, 16 nt, Homo sapiens
cuuuuaguuguaucuc

SEQ ID NO: 394706 - RNA, 23 nt, Homo sapiens
cuuuucacugcuggcugccuuag

SEQ ID NO: 394707 - RNA, 12 nt, Homo sapiens
cuuuuccagaag

SEQ ID NO: 394708 - RNA, 16 nt, Homo sapiens
cuuuucccuaagccaa

SEQ ID NO: 394709 - RNA, 16 nt, Homo sapiens
cuuuugaaaagcuuuu

SEQ ID NO: 394710 - RNA, 21 nt, Homo sapiens
cuuuugaggggcugacuucaa

SEQ ID NO: 394711 - RNA, 21 nt, Homo sapiens
cuuuugcauaagugcaugaca

SEQ ID NO: 394712 - RNA, 20 nt, Homo sapiens
cuuuugcuggucacugccau

SEQ ID NO: 394713 - RNA, 18 nt, Homo sapiens
cuuuuguuuugaguuacu

SEQ ID NO: 394714 - RNA, 17 nt, Homo sapiens
cuuuuugguuugcagau

SEQ ID NO: 394715 - RNA, 16 nt, Homo sapiens
gaaaaagccugugaaa

SEQ ID NO: 394716 - RNA, 16 nt, Homo sapiens
gaaaaauaagucacuu

SEQ ID NO: 394717 - RNA, 23 nt, Homo sapiens
gaaaacaauuguaauaaugcuaa

SEQ ID NO: 394718 - RNA, 18 nt, Homo sapiens
gaaaacacacuccuuugc

SEQ ID NO: 394719 - RNA, 22 nt, Homo sapiens
gaaaacacacuccuuugcuuag

SEQ ID NO: 394720 - RNA, 19 nt, Homo sapiens
gaaaagaccaguccaugag

SEQ ID NO: 394721 - RNA, 20 nt, Homo sapiens
gaaaagauuauauauuauuu

SEQ ID NO: 394722 - RNA, 19 nt, Homo sapiens
gaaaauagaaacuugcuua

SEQ ID NO: 394723 - RNA, 20 nt, Homo sapiens
gaaaaucuacacuccaguga

SEQ ID NO: 394724 - RNA, 16 nt, Homo sapiens
gaaaaugaaucuucac

SEQ ID NO: 394725 - RNA, 17 nt, Homo sapiens
gaaaaugaaucuucaca

SEQ ID NO: 394726 - RNA, 14 nt, Homo sapiens
gaaaauguacaaua

SEQ ID NO: 394727 - RNA, 11 nt, Homo sapiens
gaaaauuacag

SEQ ID NO: 394728 - RNA, 13 nt, Homo sapiens
gaaacaacuucua

SEQ ID NO: 394729 - RNA, 18 nt, Homo sapiens
gaaacacugggcuucuag

SEQ ID NO: 394730 - RNA, 19 nt, Homo sapiens
gaaaccucugggucaucuc

SEQ ID NO: 394731 - RNA, 21 nt, Homo sapiens
gaaacguuuggaacaaucuaa

SEQ ID NO: 394732 - RNA, 13 nt, Homo sapiens
gaaacuguaugaa

SEQ ID NO: 394733 - RNA, 20 nt, Homo sapiens
gaaacuuucaaauccuucau

SEQ ID NO: 394734 - RNA, 17 nt, Homo sapiens
gaaagacugagcucaag

SEQ ID NO: 394735 - RNA, 18 nt, Homo sapiens
gaaagacugagcucaagg

SEQ ID NO: 394736 - RNA, 17 nt, Homo sapiens
gaaagcagggacuugaa

SEQ ID NO: 394737 - RNA, 18 nt, Homo sapiens
gaaagcagggacuugaac

SEQ ID NO: 394738 - RNA, 19 nt, Homo sapiens
gaaagccugggugacauuu

SEQ ID NO: 394739 - RNA, 16 nt, Homo sapiens
gaaagguuauguuagc

SEQ ID NO: 394740 - RNA, 20 nt, Homo sapiens
gaaauaaaaaaugaaaaaca

SEQ ID NO: 394741 - RNA, 13 nt, Homo sapiens
gaaauaagccaga

SEQ ID NO: 394742 - RNA, 20 nt, Homo sapiens
gaaauacugaggggucucca

SEQ ID NO: 394743 - RNA, 20 nt, Homo sapiens
gaaauaugugguuuccacga

SEQ ID NO: 394744 - RNA, 14 nt, Homo sapiens
gaaauauuuggaaa

SEQ ID NO: 394745 - RNA, 12 nt, Homo sapiens
gaaaucaagggc

SEQ ID NO: 394746 - RNA, 14 nt, Homo sapiens
gaaaucaugagggu

SEQ ID NO: 394747 - RNA, 21 nt, Homo sapiens
gaaaugcccaucuaugucccu

SEQ ID NO: 394748 - RNA, 23 nt, Homo sapiens
gaaaugcccaucuaugucccuug

SEQ ID NO: 394749 - RNA, 19 nt, Homo sapiens
gaaauugcauuuccugaca

SEQ ID NO: 394750 - RNA, 18 nt, Homo sapiens
gaacaaaaaaaucugcag

SEQ ID NO: 394751 - RNA, 12 nt, Homo sapiens
gaacacuggggg

SEQ ID NO: 394752 - RNA, 22 nt, Homo sapiens
gaacagauaaucagugugucua

SEQ ID NO: 394753 - RNA, 21 nt, Homo sapiens
gaacauuagccguaguggaau

SEQ ID NO: 394754 - RNA, 21 nt, Homo sapiens
gaaccacgucugcuaacuugg

SEQ ID NO: 394755 - RNA, 15 nt, Homo sapiens
gaaccaggcaacuug

SEQ ID NO: 394756 - RNA, 20 nt, Homo sapiens
gaaccuguccuugcacacuc

SEQ ID NO: 394757 - RNA, 22 nt, Homo sapiens
gaaccuguccuugcacacuccc

SEQ ID NO: 394758 - RNA, 11 nt, Homo sapiens
gaaccuuccau

SEQ ID NO: 394759 - RNA, 13 nt, Homo sapiens
gaacuagacuccc

SEQ ID NO: 394760 - RNA, 14 nt, Homo sapiens
gaacuauguacuuu

SEQ ID NO: 394761 - RNA, 16 nt, Homo sapiens
gaacugcagucagcau

SEQ ID NO: 394762 - RNA, 18 nt, Homo sapiens
gaacuggaccaucuccaa

SEQ ID NO: 394763 - RNA, 13 nt, Homo sapiens
gaacuugcacaaa

SEQ ID NO: 394764 - RNA, 20 nt, Homo sapiens
gaacuugcugcugagugcac

SEQ ID NO: 394765 - RNA, 15 nt, Homo sapiens
gaagaaugaacaaau

SEQ ID NO: 394766 - RNA, 20 nt, Homo sapiens
gaagaccagcuuugcaguga

SEQ ID NO: 394767 - RNA, 14 nt, Homo sapiens
gaagagaccaagac

SEQ ID NO: 394768 - RNA, 17 nt, Homo sapiens
gaagagggacagaugaa

SEQ ID NO: 394769 - RNA, 20 nt, Homo sapiens
gaagauaacuugagcaccgu

SEQ ID NO: 394770 - RNA, 19 nt, Homo sapiens
gaagcaacccaaauguuca

SEQ ID NO: 394771 - RNA, 14 nt, Homo sapiens
gaagccgugcccug

SEQ ID NO: 394772 - RNA, 15 nt, Homo sapiens
gaagcuccacuguca

SEQ ID NO: 394773 - RNA, 16 nt, Homo sapiens
gaagcuccacugucac

SEQ ID NO: 394774 - RNA, 21 nt, Homo sapiens
gaagcucuggugacaccagcc

SEQ ID NO: 394775 - RNA, 21 nt, Homo sapiens
gaagcuguguccuugcaccug

SEQ ID NO: 394776 - RNA, 23 nt, Homo sapiens
gaaggaccuccugagcgaugacu

SEQ ID NO: 394777 - RNA, 14 nt, Homo sapiens
gaaggcaaacccau

SEQ ID NO: 394778 - RNA, 18 nt, Homo sapiens
gaaggccgagaagcaaga

SEQ ID NO: 394779 - RNA, 18 nt, Homo sapiens
gaaggcgugagucuucau

SEQ ID NO: 394780 - RNA, 19 nt, Homo sapiens
gaagguuuguauauuguca

SEQ ID NO: 394781 - RNA, 21 nt, Homo sapiens
gaaguaagcaaagacuuuccu

SEQ ID NO: 394782 - RNA, 15 nt, Homo sapiens
gaagucaugcguuua

SEQ ID NO: 394783 - RNA, 17 nt, Homo sapiens
gaagucuaagagugaag

SEQ ID NO: 394784 - RNA, 13 nt, Homo sapiens
gaaguuuggcaau

SEQ ID NO: 394785 - RNA, 15 nt, Homo sapiens
gaauaaaauugcacu

SEQ ID NO: 394786 - RNA, 17 nt, Homo sapiens
gaauaaaauugcacuuu

SEQ ID NO: 394787 - RNA, 18 nt, Homo sapiens
gaauaaagccugcuuuuu

SEQ ID NO: 394788 - RNA, 14 nt, Homo sapiens
gaauaauccagaaa

SEQ ID NO: 394789 - RNA, 19 nt, Homo sapiens
gaauauacuaaauuaacuu

SEQ ID NO: 394790 - RNA, 21 nt, Homo sapiens
gaauauugcuuuggucauaug

SEQ ID NO: 394791 - RNA, 18 nt, Homo sapiens
gaauauuuauuaccucug

SEQ ID NO: 394792 - RNA, 13 nt, Homo sapiens
gaaucacauucuu

SEQ ID NO: 394793 - RNA, 22 nt, Homo sapiens
gaauccaguccagauauuucac

SEQ ID NO: 394794 - RNA, 19 nt, Homo sapiens
gaaucccuaagccuagcug

SEQ ID NO: 394795 - RNA, 19 nt, Homo sapiens
gaaucuguaaagaaauaua

SEQ ID NO: 394796 - RNA, 15 nt, Homo sapiens
gaaucuguuaccaga

SEQ ID NO: 394797 - RNA, 22 nt, Homo sapiens
gaaucuguuaccagaggacaaa

SEQ ID NO: 394798 - RNA, 15 nt, Homo sapiens
gaaugaaagacugaa

SEQ ID NO: 394799 - RNA, 23 nt, Homo sapiens
gaaugaaucucaagauucaguag

SEQ ID NO: 394800 - RNA, 11 nt, Homo sapiens
gaaugacaaag

SEQ ID NO: 394801 - RNA, 14 nt, Homo sapiens
gaaugauucagugu

SEQ ID NO: 394802 - RNA, 20 nt, Homo sapiens
gaauguauugaacuuggaaa

SEQ ID NO: 394803 - RNA, 17 nt, Homo sapiens
gaaugugauauuugaag

SEQ ID NO: 394804 - RNA, 18 nt, Homo sapiens
gaauguggauucuuccca

SEQ ID NO: 394805 - RNA, 17 nt, Homo sapiens
gaauuaugucugcugaa

SEQ ID NO: 394806 - RNA, 14 nt, Homo sapiens
gaauucuaagugaa

SEQ ID NO: 394807 - RNA, 17 nt, Homo sapiens
gaauucugucauuucaa

SEQ ID NO: 394808 - RNA, 15 nt, Homo sapiens
gaauugagucuucca

SEQ ID NO: 394809 - RNA, 16 nt, Homo sapiens
gacaaaccgagugcaa

SEQ ID NO: 394810 - RNA, 17 nt, Homo sapiens
gacaaagaaacccaagu

SEQ ID NO: 394811 - RNA, 16 nt, Homo sapiens
gacaaauaauaagcaa

SEQ ID NO: 394812 - RNA, 18 nt, Homo sapiens
gacaaaugccacacggcu

SEQ ID NO: 394813 - RNA, 17 nt, Homo sapiens
gacacgcaacuggcuca

SEQ ID NO: 394814 - RNA, 21 nt, Homo sapiens
gacacucacacggacacucaa

SEQ ID NO: 394815 - RNA, 22 nt, Homo sapiens
gacacuucuaaaugaagugcaa

SEQ ID NO: 394816 - RNA, 13 nt, Homo sapiens
gacagaaagcaga

SEQ ID NO: 394817 - RNA, 14 nt, Homo sapiens
gacagaacuaagau

SEQ ID NO: 394818 - RNA, 13 nt, Homo sapiens
gacagccuggcac

SEQ ID NO: 394819 - RNA, 21 nt, Homo sapiens
gacagcucccucugccugaac

SEQ ID NO: 394820 - RNA, 23 nt, Homo sapiens
gacagcuuccucgaugggacccg

SEQ ID NO: 394821 - RNA, 22 nt, Homo sapiens
gacaggacccugggaccacaga

SEQ ID NO: 394822 - RNA, 16 nt, Homo sapiens
gacagugaacauucug

SEQ ID NO: 394823 - RNA, 18 nt, Homo sapiens
gacauaauuucacugaau

SEQ ID NO: 394824 - RNA, 20 nt, Homo sapiens
gacauagaauuaacacauga

SEQ ID NO: 394825 - RNA, 18 nt, Homo sapiens
gacaucucaggggccaga

SEQ ID NO: 394826 - RNA, 21 nt, Homo sapiens
gacaugcgggcugggcagcug

SEQ ID NO: 394827 - RNA, 14 nt, Homo sapiens
gaccaacuuccugu

SEQ ID NO: 394828 - RNA, 22 nt, Homo sapiens
gaccaauucaacccuuugcccc

SEQ ID NO: 394829 - RNA, 22 nt, Homo sapiens
gaccaguccuguuugcagggaa

SEQ ID NO: 394830 - RNA, 15 nt, Homo sapiens
gaccauaaagggaaa

SEQ ID NO: 394831 - RNA, 16 nt, Homo sapiens
gacccagggaugacau

SEQ ID NO: 394832 - RNA, 16 nt, Homo sapiens
gaccccuggucucagu

SEQ ID NO: 394833 - RNA, 14 nt, Homo sapiens
gacccuauugcugc

SEQ ID NO: 394834 - RNA, 17 nt, Homo sapiens
gacccugauacaggcau

SEQ ID NO: 394835 - RNA, 20 nt, Homo sapiens
gaccuacuguucggacaaaa

SEQ ID NO: 394836 - RNA, 23 nt, Homo sapiens
gaccuccccagccccuagcccag

SEQ ID NO: 394837 - RNA, 12 nt, Homo sapiens
gaccugagcucc

SEQ ID NO: 394838 - RNA, 17 nt, Homo sapiens
gaccuggugcugccucu

SEQ ID NO: 394839 - RNA, 17 nt, Homo sapiens
gaccuguaaucauauaa

SEQ ID NO: 394840 - RNA, 14 nt, Homo sapiens
gaccugugugccag

SEQ ID NO: 394841 - RNA, 19 nt, Homo sapiens
gaccuguucaaaaaggaaa

SEQ ID NO: 394842 - RNA, 13 nt, Homo sapiens
gaccuugaacucc

SEQ ID NO: 394843 - RNA, 17 nt, Homo sapiens
gacgacaagugcugaac

SEQ ID NO: 394844 - RNA, 15 nt, Homo sapiens
gacggggacugggga

SEQ ID NO: 394845 - RNA, 23 nt, Homo sapiens
gacucuccagaaagcucaucuca

SEQ ID NO: 394846 - RNA, 20 nt, Homo sapiens
gacucuuguuuucaguuuca

SEQ ID NO: 394847 - RNA, 16 nt, Homo sapiens
gacugacccugaucag

SEQ ID NO: 394848 - RNA, 14 nt, Homo sapiens
gaugggagguugug

SEQ ID NO: 394849 - RNA, 22 nt, Homo sapiens
gaugggguuucaccaucuuggc

SEQ ID NO: 394850 - RNA, 18 nt, Homo sapiens
gauguaggguaaggugcc

SEQ ID NO: 394851 - RNA, 19 nt, Homo sapiens
gauguaggguaaggugccu

SEQ ID NO: 394852 - RNA, 14 nt, Homo sapiens
gaugugaacacauc

SEQ ID NO: 394853 - RNA, 23 nt, Homo sapiens
gauguuguguuucuguucaccuu

SEQ ID NO: 394854 - RNA, 19 nt, Homo sapiens
gauuacaggcaugagccac

SEQ ID NO: 394855 - RNA, 20 nt, Homo sapiens
gauuaugaagugacucucac

SEQ ID NO: 394856 - RNA, 14 nt, Homo sapiens
gauucaguguuaaa

SEQ ID NO: 394857 - RNA, 17 nt, Homo sapiens
gauucuuucccaauuca

SEQ ID NO: 394858 - RNA, 23 nt, Homo sapiens
gauugccucugaagccuauguau

SEQ ID NO: 394859 - RNA, 20 nt, Homo sapiens
gauugcgccauugcacucca

SEQ ID NO: 394860 - RNA, 18 nt, Homo sapiens
gauugcuuaaaauagcaa

SEQ ID NO: 394861 - RNA, 20 nt, Homo sapiens
gauuggauuauucauuuaaa

SEQ ID NO: 394862 - RNA, 20 nt, Homo sapiens
gauuuuaaaaagucuucacu

SEQ ID NO: 394863 - RNA, 23 nt, Homo sapiens
gcaaaaacaaaugggaaaauguc

SEQ ID NO: 394864 - RNA, 19 nt, Homo sapiens
gcaaaaagcaaaaucauuu

SEQ ID NO: 394865 - RNA, 23 nt, Homo sapiens
gcaaaacugccgcaagucugcag

SEQ ID NO: 394866 - RNA, 21 nt, Homo sapiens
gcaaaagugagggcuugucau

SEQ ID NO: 394867 - RNA, 22 nt, Homo sapiens
gcaaaauuugaugccaggacac

SEQ ID NO: 394868 - RNA, 21 nt, Homo sapiens
gcaaagcauugagcaaagggg

SEQ ID NO: 394869 - RNA, 20 nt, Homo sapiens
gcaaagcugaugacaacuuc

SEQ ID NO: 394870 - RNA, 22 nt, Homo sapiens
gcaaagugaagacacuggcuca

SEQ ID NO: 394871 - RNA, 16 nt, Homo sapiens
gcaaaugacaaaaagc

SEQ ID NO: 394872 - RNA, 22 nt, Homo sapiens
gcaacaguacuucaaacagaac

SEQ ID NO: 394873 - RNA, 11 nt, Homo sapiens
gcaacccaaau

SEQ ID NO: 394874 - RNA, 19 nt, Homo sapiens
gcaacccaaauguucauca

SEQ ID NO: 394875 - RNA, 23 nt, Homo sapiens
gcaacgcaggcccccaggugcca

SEQ ID NO: 394876 - RNA, 15 nt, Homo sapiens
gcaacugaggcagac

SEQ ID NO: 394877 - RNA, 22 nt, Homo sapiens
gcaacugaggcagacagcagcu

SEQ ID NO: 394878 - RNA, 16 nt, Homo sapiens
gcaacuggcucaaaga

SEQ ID NO: 394879 - RNA, 14 nt, Homo sapiens
gcaagaaacacugg

SEQ ID NO: 394880 - RNA, 21 nt, Homo sapiens
gcaagcaagaaacacugggcu

SEQ ID NO: 394881 - RNA, 15 nt, Homo sapiens
gcaagcacaucugca

SEQ ID NO: 394882 - RNA, 13 nt, Homo sapiens
gcaaggugacauu

SEQ ID NO: 394883 - RNA, 16 nt, Homo sapiens
gcaaguguaugcacgu

SEQ ID NO: 394884 - RNA, 23 nt, Homo sapiens
gcaaguguaugcacgugugcaca

SEQ ID NO: 394885 - RNA, 19 nt, Homo sapiens
gcaagugucugugugcaag

SEQ ID NO: 394886 - RNA, 17 nt, Homo sapiens
gcaaugggcacugggau

SEQ ID NO: 394887 - RNA, 23 nt, Homo sapiens
gcaaugugcccccagacgcacgu

SEQ ID NO: 394888 - RNA, 22 nt, Homo sapiens
gcaauuucauaugcuguauauc

SEQ ID NO: 394889 - RNA, 18 nt, Homo sapiens
gcaauuuccggccaacag

SEQ ID NO: 394890 - RNA, 17 nt, Homo sapiens
gcaauuuugcauuugaa

SEQ ID NO: 394891 - RNA, 15 nt, Homo sapiens
gcacauaacaugcuu

SEQ ID NO: 394892 - RNA, 22 nt, Homo sapiens
gcacaucugcauuuucacccca

SEQ ID NO: 394893 - RNA, 22 nt, Homo sapiens
gcacauuagccuaugugcaugc

SEQ ID NO: 394894 - RNA, 21 nt, Homo sapiens
gcaccaggcacgaacccaccu

SEQ ID NO: 394895 - RNA, 22 nt, Homo sapiens
gcacccaggacuuccauuugcu

SEQ ID NO: 394896 - RNA, 17 nt, Homo sapiens
gcaccccaaagcuuucc

SEQ ID NO: 394897 - RNA, 19 nt, Homo sapiens
gcacccuguaucacagacu

SEQ ID NO: 394898 - RNA, 14 nt, Homo sapiens
gcacccuugcgcuu

SEQ ID NO: 394899 - RNA, 18 nt, Homo sapiens
gcaccuaccaucagggac

SEQ ID NO: 394900 - RNA, 19 nt, Homo sapiens
gcaccuaccaucagggaca

SEQ ID NO: 394901 - RNA, 13 nt, Homo sapiens
gcaccuaccucac

SEQ ID NO: 394902 - RNA, 12 nt, Homo sapiens
gcaccugugcag

SEQ ID NO: 394903 - RNA, 15 nt, Homo sapiens
gcacgcccaugugug

SEQ ID NO: 394904 - RNA, 22 nt, Homo sapiens
gcacuaccacgccaagcuaauu

SEQ ID NO: 394905 - RNA, 23 nt, Homo sapiens
gcacucacaccacuaacaugccc

SEQ ID NO: 394906 - RNA, 17 nt, Homo sapiens
gcacugaggaccagcca

SEQ ID NO: 394907 - RNA, 15 nt, Homo sapiens
gcacuuuaacugacu

SEQ ID NO: 394908 - RNA, 17 nt, Homo sapiens
gcacuuugggaggccaa

SEQ ID NO: 394909 - RNA, 22 nt, Homo sapiens
gcacuuugggaggcugaggcag

SEQ ID NO: 394910 - RNA, 16 nt, Homo sapiens
gcagaaccuccuggaa

SEQ ID NO: 394911 - RNA, 13 nt, Homo sapiens
gcagaacuuucac

SEQ ID NO: 394912 - RNA, 20 nt, Homo sapiens
gcagaaucuguuaccagagg

SEQ ID NO: 394913 - RNA, 23 nt, Homo sapiens
gcagaauugagagugauuccuuu

SEQ ID NO: 394914 - RNA, 16 nt, Homo sapiens
gcagacuggugagcag

SEQ ID NO: 394915 - RNA, 21 nt, Homo sapiens
gcagacuggugagcagacugg

SEQ ID NO: 394916 - RNA, 14 nt, Homo sapiens
gcagaggagccaug

SEQ ID NO: 394917 - RNA, 22 nt, Homo sapiens
gcagcagggagggcuucugcca

SEQ ID NO: 394918 - RNA, 15 nt, Homo sapiens
gcagcauacacagau

SEQ ID NO: 394919 - RNA, 18 nt, Homo sapiens
gcagccuggggucugaca

SEQ ID NO: 394920 - RNA, 18 nt, Homo sapiens
gcagcucaggcacacuuc

SEQ ID NO: 394921 - RNA, 21 nt, Homo sapiens
gcaggaacuugcacaaaauca

SEQ ID NO: 394922 - RNA, 21 nt, Homo sapiens
gcaggaagcaacgaagggaaa

SEQ ID NO: 394923 - RNA, 19 nt, Homo sapiens
gcaggaagcucagacuggu

SEQ ID NO: 394924 - RNA, 23 nt, Homo sapiens
gcaggagagaaugcccagugacc

SEQ ID NO: 394925 - RNA, 15 nt, Homo sapiens
gcaggcuacugucag

SEQ ID NO: 394926 - RNA, 20 nt, Homo sapiens
gcaguagaaauaauaugcau

SEQ ID NO: 394927 - RNA, 20 nt, Homo sapiens
gcaguagacuauaagcagaa

SEQ ID NO: 394928 - RNA, 19 nt, Homo sapiens
gcaguagcagcagcaucuc

SEQ ID NO: 394929 - RNA, 17 nt, Homo sapiens
gcagucagcaugaaucc

SEQ ID NO: 394930 - RNA, 21 nt, Homo sapiens
gcagugagcugauaucaugcc

SEQ ID NO: 394931 - RNA, 21 nt, Homo sapiens
gcagugaugcuggaugcuccu

SEQ ID NO: 394932 - RNA, 13 nt, Homo sapiens
gcagugaugucac

SEQ ID NO: 394933 - RNA, 19 nt, Homo sapiens
gcaguucugggugcucccu

SEQ ID NO: 394934 - RNA, 18 nt, Homo sapiens
gcauaaguuaacuuccaa

SEQ ID NO: 394935 - RNA, 16 nt, Homo sapiens
gcauaaguuucuggga

SEQ ID NO: 394936 - RNA, 12 nt, Homo sapiens
gcauaccuuuau

SEQ ID NO: 394937 - RNA, 20 nt, Homo sapiens
gcauacgguaugauauugca

SEQ ID NO: 394938 - RNA, 23 nt, Homo sapiens
gcauacgguaugauauugcagcu

SEQ ID NO: 394939 - RNA, 16 nt, Homo sapiens
gcauaguauuccauug

SEQ ID NO: 394940 - RNA, 14 nt, Homo sapiens
gcaucagaugaauu

SEQ ID NO: 394941 - RNA, 19 nt, Homo sapiens
gcauccccuuggcugugag

SEQ ID NO: 394942 - RNA, 18 nt, Homo sapiens
gcauggauaugugccagg

SEQ ID NO: 394943 - RNA, 17 nt, Homo sapiens
gcauuguaaaugugcuu

SEQ ID NO: 394944 - RNA, 20 nt, Homo sapiens
gcauuuagacccugcauuua

SEQ ID NO: 394945 - RNA, 19 nt, Homo sapiens
gcauuugugcccacucucc

SEQ ID NO: 394946 - RNA, 15 nt, Homo sapiens
gcauuuuuaaauaca

SEQ ID NO: 394947 - RNA, 15 nt, Homo sapiens
gcauuuuuugcaagu

SEQ ID NO: 394948 - RNA, 15 nt, Homo sapiens
gccaagggccucuug

SEQ ID NO: 394949 - RNA, 18 nt, Homo sapiens
gccaauggagacugucuc

SEQ ID NO: 394950 - RNA, 21 nt, Homo sapiens
gccacagaccuaggauuucau

SEQ ID NO: 394951 - RNA, 13 nt, Homo sapiens
gccacggcagccu

SEQ ID NO: 394952 - RNA, 14 nt, Homo sapiens
gccacuaagccaag

SEQ ID NO: 394953 - RNA, 23 nt, Homo sapiens
gccagaacguggcucugcuggcc

SEQ ID NO: 394954 - RNA, 14 nt, Homo sapiens
gccagcaaugacau

SEQ ID NO: 394955 - RNA, 21 nt, Homo sapiens
gccagccugucccauggacac

SEQ ID NO: 394956 - RNA, 21 nt, Homo sapiens
gccagccuucuuccaucccag

SEQ ID NO: 394957 - RNA, 20 nt, Homo sapiens
gccaggauuaaaagccauga

SEQ ID NO: 394958 - RNA, 14 nt, Homo sapiens
gccaggcuccuucc

SEQ ID NO: 394959 - RNA, 23 nt, Homo sapiens
gccaggucacccuuugcugugag

SEQ ID NO: 394960 - RNA, 15 nt, Homo sapiens
gccaggugcacagac

SEQ ID NO: 394961 - RNA, 15 nt, Homo sapiens
gccaguuauggcuau

SEQ ID NO: 394962 - RNA, 16 nt, Homo sapiens
gccauaaugacucaga

SEQ ID NO: 394963 - RNA, 18 nt, Homo sapiens
gccauaauuacuauguca

SEQ ID NO: 394964 - RNA, 14 nt, Homo sapiens
gccauacuuuacaa

SEQ ID NO: 394965 - RNA, 18 nt, Homo sapiens
gccauuguuucuccuggg

SEQ ID NO: 394966 - RNA, 22 nt, Homo sapiens
gccauuuuggguuuugggucuu

SEQ ID NO: 394967 - RNA, 23 nt, Homo sapiens
gcccacccuuguguccacuguga

SEQ ID NO: 394968 - RNA, 20 nt, Homo sapiens
gcccagaacuggacucagga

SEQ ID NO: 394969 - RNA, 21 nt, Homo sapiens
gcccagaacuggacucaggau

SEQ ID NO: 394970 - RNA, 21 nt, Homo sapiens
gcccagagcaggaagcauuca

SEQ ID NO: 394971 - RNA, 22 nt, Homo sapiens
gcccaggagagagaaagccagg

SEQ ID NO: 394972 - RNA, 20 nt, Homo sapiens
gcccaggcuggagugcagua

SEQ ID NO: 394973 - RNA, 16 nt, Homo sapiens
gcccagggaagccaaa

SEQ ID NO: 394974 - RNA, 13 nt, Homo sapiens
gcccagugcacac

SEQ ID NO: 394975 - RNA, 15 nt, Homo sapiens
gcccaugugugagug

SEQ ID NO: 394976 - RNA, 23 nt, Homo sapiens
gcccaugugugagugugugcaag

SEQ ID NO: 394977 - RNA, 16 nt, Homo sapiens
gccccaggcauugcca

SEQ ID NO: 394978 - RNA, 13 nt, Homo sapiens
gccccucauuuau

SEQ ID NO: 394979 - RNA, 16 nt, Homo sapiens
gccccugcacaaagcc

SEQ ID NO: 394980 - RNA, 13 nt, Homo sapiens
gccccugcacucc

SEQ ID NO: 394981 - RNA, 16 nt, Homo sapiens
gcccggaaccccagga

SEQ ID NO: 394982 - RNA, 17 nt, Homo sapiens
gcccuagagcacacugu

SEQ ID NO: 394983 - RNA, 22 nt, Homo sapiens
gcccuaggcuccgucaguauca

SEQ ID NO: 394984 - RNA, 19 nt, Homo sapiens
gcccuccccaucccaugua

SEQ ID NO: 394985 - RNA, 19 nt, Homo sapiens
gcccucccccagcaguuga

SEQ ID NO: 394986 - RNA, 12 nt, Homo sapiens
gcccucuuccau

SEQ ID NO: 394987 - RNA, 19 nt, Homo sapiens
gcccugggccccaccaccu

SEQ ID NO: 394988 - RNA, 22 nt, Homo sapiens
gcccuucucucauuauuucucu

SEQ ID NO: 394989 - RNA, 19 nt, Homo sapiens
gccgaaaaggauaugcagu

SEQ ID NO: 394990 - RNA, 14 nt, Homo sapiens
gccgcucccuggug

SEQ ID NO: 394991 - RNA, 23 nt, Homo sapiens
uagggcaacaauacaugcugcua

SEQ ID NO: 394992 - RNA, 20 nt, Homo sapiens
uagguaggggcccacuucac

SEQ ID NO: 394993 - RNA, 13 nt, Homo sapiens
uaggucaagaaga

SEQ ID NO: 394994 - RNA, 14 nt, Homo sapiens
uagguugugcaaau

SEQ ID NO: 394995 - RNA, 19 nt, Homo sapiens
uaguaaagugauaauuucu

SEQ ID NO: 394996 - RNA, 14 nt, Homo sapiens
uagugauggagcuu

SEQ ID NO: 394997 - RNA, 16 nt, Homo sapiens
uagugcagaaucucau

SEQ ID NO: 394998 - RNA, 16 nt, Homo sapiens
uaguggggucagggcu

SEQ ID NO: 394999 - RNA, 18 nt, Homo sapiens
uaguuacucauucaggga

SEQ ID NO: 395000 - RNA, 21 nt, Homo sapiens
uauaaaagaauaaaauugcac

SEQ ID NO: 395001 - RNA, 13 nt, Homo sapiens
uauaaaugugauu

SEQ ID NO: 395002 - RNA, 20 nt, Homo sapiens
uauaacuaguccuuuacuaa

SEQ ID NO: 395003 - RNA, 18 nt, Homo sapiens
uauaacuauguugauaaa

SEQ ID NO: 395004 - RNA, 17 nt, Homo sapiens
uauaagcagaagcacau

SEQ ID NO: 395005 - RNA, 20 nt, Homo sapiens
uauaagcagauuuaacaauu

SEQ ID NO: 395006 - RNA, 18 nt, Homo sapiens
uauacuguggcuaugcaa

SEQ ID NO: 395007 - RNA, 20 nt, Homo sapiens
uauacuucucuauuaucuca

SEQ ID NO: 395008 - RNA, 15 nt, Homo sapiens
uauagacaaauaaua

SEQ ID NO: 395009 - RNA, 17 nt, Homo sapiens
uauagcagauuguguaa

SEQ ID NO: 395010 - RNA, 17 nt, Homo sapiens
uauaguaugaaugcagu

SEQ ID NO: 395011 - RNA, 15 nt, Homo sapiens
uauaguccagcuuug

SEQ ID NO: 395012 - RNA, 16 nt, Homo sapiens
uauaguuuauugacaa

SEQ ID NO: 395013 - RNA, 18 nt, Homo sapiens
uauauauuuuugugcaca

SEQ ID NO: 395014 - RNA, 13 nt, Homo sapiens
uauaucaucagca

SEQ ID NO: 395015 - RNA, 14 nt, Homo sapiens
uauaucgaucucuu

SEQ ID NO: 395016 - RNA, 12 nt, Homo sapiens
uauaugcaauau

SEQ ID NO: 395017 - RNA, 17 nt, Homo sapiens
uauauuauaaucuucca

SEQ ID NO: 395018 - RNA, 18 nt, Homo sapiens
uauauuuuuauaagacua

SEQ ID NO: 395019 - RNA, 14 nt, Homo sapiens
uaucaauagucaag

SEQ ID NO: 395020 - RNA, 22 nt, Homo sapiens
uaucaccagagagggacugaca

SEQ ID NO: 395021 - RNA, 14 nt, Homo sapiens
uaucaggauacuau

SEQ ID NO: 395022 - RNA, 14 nt, Homo sapiens
uauccaccaccucc

SEQ ID NO: 395023 - RNA, 22 nt, Homo sapiens
uauccacccagcccauucucuc

SEQ ID NO: 395024 - RNA, 17 nt, Homo sapiens
uauccacuuaccuagau

SEQ ID NO: 395025 - RNA, 14 nt, Homo sapiens
uaucccuacaugua

SEQ ID NO: 395026 - RNA, 15 nt, Homo sapiens
uauccgaacuuuaau

SEQ ID NO: 395027 - RNA, 15 nt, Homo sapiens
uauccuuucuaacaa

SEQ ID NO: 395028 - RNA, 18 nt, Homo sapiens
uauccuuucuaacaaaaa

SEQ ID NO: 395029 - RNA, 21 nt, Homo sapiens
uaucuauggcacccaugcacc

SEQ ID NO: 395030 - RNA, 16 nt, Homo sapiens
uaucucaaacuacugg

SEQ ID NO: 395031 - RNA, 23 nt, Homo sapiens
uaucucaaacuacuggcaauuug

SEQ ID NO: 395032 - RNA, 20 nt, Homo sapiens
uaucucucagugaacuguga

SEQ ID NO: 395033 - RNA, 14 nt, Homo sapiens
uaucugaggucaca

SEQ ID NO: 395034 - RNA, 15 nt, Homo sapiens
uaucugggauucuac

SEQ ID NO: 395035 - RNA, 22 nt, Homo sapiens
uaucugugaaaugcuggcauuu

SEQ ID NO: 395036 - RNA, 15 nt, Homo sapiens
uaucuuggcuuugcc

SEQ ID NO: 395037 - RNA, 12 nt, Homo sapiens
uaugaucuuggc

SEQ ID NO: 395038 - RNA, 12 nt, Homo sapiens
uaugcaguaugc

SEQ ID NO: 395039 - RNA, 14 nt, Homo sapiens
uaugcaguaugcuu

SEQ ID NO: 395040 - RNA, 15 nt, Homo sapiens
uaugccucuguauuu

SEQ ID NO: 395041 - RNA, 21 nt, Homo sapiens
uauggacucaguuuucuugca

SEQ ID NO: 395042 - RNA, 17 nt, Homo sapiens
uauggcucuacuuucag

SEQ ID NO: 395043 - RNA, 22 nt, Homo sapiens
uaugguuaauaaguuucacuga

SEQ ID NO: 395044 - RNA, 20 nt, Homo sapiens
uauguggacguaaucuccac

SEQ ID NO: 395045 - RNA, 16 nt, Homo sapiens
uaugugggugggacca

SEQ ID NO: 395046 - RNA, 16 nt, Homo sapiens
uauuaagugugcuuau

SEQ ID NO: 395047 - RNA, 20 nt, Homo sapiens
uauuacaguuuaucuauggc

SEQ ID NO: 395048 - RNA, 20 nt, Homo sapiens
uauuacugggacugugcuca

SEQ ID NO: 395049 - RNA, 15 nt, Homo sapiens
uauuagaacaggcaa

SEQ ID NO: 395050 - RNA, 17 nt, Homo sapiens
uauuagauaaauuucaa

SEQ ID NO: 395051 - RNA, 15 nt, Homo sapiens
uauuauuucaaugug

SEQ ID NO: 395052 - RNA, 20 nt, Homo sapiens
uauucaauggaaagcugcuu

SEQ ID NO: 395053 - RNA, 16 nt, Homo sapiens
uauuccauugugugag

SEQ ID NO: 395054 - RNA, 17 nt, Homo sapiens
uauucucacuccaccac

SEQ ID NO: 395055 - RNA, 19 nt, Homo sapiens
uauucugauuacacaaaac

SEQ ID NO: 395056 - RNA, 17 nt, Homo sapiens
uauucugauuccacuuu

SEQ ID NO: 395057 - RNA, 15 nt, Homo sapiens
uauucuucauaacaa

SEQ ID NO: 395058 - RNA, 16 nt, Homo sapiens
uauucuuuaaauuuca

SEQ ID NO: 395059 - RNA, 21 nt, Homo sapiens
uauugagauaauuuauuuaau

SEQ ID NO: 395060 - RNA, 22 nt, Homo sapiens
uauugguccagcuugcucuuca

SEQ ID NO: 395061 - RNA, 15 nt, Homo sapiens
uauuguauaaacuau

SEQ ID NO: 395062 - RNA, 16 nt, Homo sapiens
uauuguuucaauugca

SEQ ID NO: 395063 - RNA, 18 nt, Homo sapiens
uauuuacauacaggccau

SEQ ID NO: 395064 - RNA, 17 nt, Homo sapiens
uauuuaccagaccacaa

SEQ ID NO: 395065 - RNA, 13 nt, Homo sapiens
uauuuauaacuca

SEQ ID NO: 395066 - RNA, 14 nt, Homo sapiens
uauuuaugccucug

SEQ ID NO: 395067 - RNA, 21 nt, Homo sapiens
uauuuccacuuauaaaggaaa

SEQ ID NO: 395068 - RNA, 12 nt, Homo sapiens
uauuuccuugcc

SEQ ID NO: 395069 - RNA, 15 nt, Homo sapiens
uauuuggauaucaaa

SEQ ID NO: 395070 - RNA, 20 nt, Homo sapiens
uauuuguacaccaauauuca

SEQ ID NO: 395071 - RNA, 16 nt, Homo sapiens
uauuuuaaguauugca

SEQ ID NO: 395072 - RNA, 13 nt, Homo sapiens
uauuuuaaucacc

SEQ ID NO: 395073 - RNA, 17 nt, Homo sapiens
uauuuuauaucaauuua

SEQ ID NO: 395074 - RNA, 19 nt, Homo sapiens
ucaaaacagagaugugaua

SEQ ID NO: 395075 - RNA, 15 nt, Homo sapiens
ucaaaagcacuuugu

SEQ ID NO: 395076 - RNA, 11 nt, Homo sapiens
ucaaacaaagc

SEQ ID NO: 395077 - RNA, 19 nt, Homo sapiens
ucaaaccccagggcacuga

SEQ ID NO: 395078 - RNA, 18 nt, Homo sapiens
ucaaaccccgaccaccug

SEQ ID NO: 395079 - RNA, 22 nt, Homo sapiens
ucaaacgugaaaaugcuguauu

SEQ ID NO: 395080 - RNA, 13 nt, Homo sapiens
ucaaagacauucu

SEQ ID NO: 395081 - RNA, 15 nt, Homo sapiens
ucaaaggcacaguga

SEQ ID NO: 395082 - RNA, 15 nt, Homo sapiens
ucaaauaaacauguc

SEQ ID NO: 395083 - RNA, 18 nt, Homo sapiens
ucaaaugugacauuauau

SEQ ID NO: 395084 - RNA, 16 nt, Homo sapiens
ucaacaccucugcaca

SEQ ID NO: 395085 - RNA, 18 nt, Homo sapiens
ucaaccugggcaaagccu

SEQ ID NO: 395086 - RNA, 13 nt, Homo sapiens
ucaacuaugauau

SEQ ID NO: 395087 - RNA, 17 nt, Homo sapiens
ucaacugaaaagacuca

SEQ ID NO: 395088 - RNA, 18 nt, Homo sapiens
ucaagaugagagaacugg

SEQ ID NO: 395089 - RNA, 19 nt, Homo sapiens
ucaagaugaugaugaucuu

SEQ ID NO: 395090 - RNA, 18 nt, Homo sapiens
ucaagcaauugucugccu

SEQ ID NO: 395091 - RNA, 22 nt, Homo sapiens
ucaagccuagcccuucucucau

SEQ ID NO: 395092 - RNA, 16 nt, Homo sapiens
ucaaggcugcagugag

SEQ ID NO: 395093 - RNA, 19 nt, Homo sapiens
ucaaguccuacaagcuaaa

SEQ ID NO: 395094 - RNA, 20 nt, Homo sapiens
ucaaguuggcuucuaaucaa

SEQ ID NO: 395095 - RNA, 13 nt, Homo sapiens
ucaauaggcaaag

SEQ ID NO: 395096 - RNA, 16 nt, Homo sapiens
ucaauccgaaguauga

SEQ ID NO: 395097 - RNA, 18 nt, Homo sapiens
ucaaucucugauucuguc

SEQ ID NO: 395098 - RNA, 22 nt, Homo sapiens
ucaaugcuauaacuauguugau

SEQ ID NO: 395099 - RNA, 16 nt, Homo sapiens
ucaauucagugcugua

SEQ ID NO: 395100 - RNA, 21 nt, Homo sapiens
ucaauuuaaaaaaaaaccuga

SEQ ID NO: 395101 - RNA, 13 nt, Homo sapiens
ucaauuucuacaa

SEQ ID NO: 395102 - RNA, 18 nt, Homo sapiens
ucaauuuguaauugcuua

SEQ ID NO: 395103 - RNA, 22 nt, Homo sapiens
ucaauuuuaucccucaccugua

SEQ ID NO: 395104 - RNA, 21 nt, Homo sapiens
ucacaaucaucaucauucuca

SEQ ID NO: 395105 - RNA, 16 nt, Homo sapiens
ucacacuuccaccagc

SEQ ID NO: 395106 - RNA, 17 nt, Homo sapiens
ucacacuuccaccagcc

SEQ ID NO: 395107 - RNA, 13 nt, Homo sapiens
ucacagacuggca

SEQ ID NO: 395108 - RNA, 19 nt, Homo sapiens
ucacaggacucugccuccu

SEQ ID NO: 395109 - RNA, 19 nt, Homo sapiens
ucacaguuagguagcuuua

SEQ ID NO: 395110 - RNA, 15 nt, Homo sapiens
ucacauagcacagaa

SEQ ID NO: 395111 - RNA, 23 nt, Homo sapiens
ucacauuccaagccucaugucca

SEQ ID NO: 395112 - RNA, 13 nt, Homo sapiens
ucaccaaggcuga

SEQ ID NO: 395113 - RNA, 17 nt, Homo sapiens
ucaccacaccaaaccuc

SEQ ID NO: 395114 - RNA, 16 nt, Homo sapiens
ucaccaggucagggag

SEQ ID NO: 395115 - RNA, 12 nt, Homo sapiens
ucaccagugucc

SEQ ID NO: 395116 - RNA, 19 nt, Homo sapiens
ucaccaguguccccuccac

SEQ ID NO: 395117 - RNA, 19 nt, Homo sapiens
ucaccauuuggcaaugcca

SEQ ID NO: 395118 - RNA, 14 nt, Homo sapiens
ucacccaaugcaua

SEQ ID NO: 395119 - RNA, 15 nt, Homo sapiens
ucacccagcucacgu

SEQ ID NO: 395120 - RNA, 20 nt, Homo sapiens
ucacccugccuuaucuugca

SEQ ID NO: 395121 - RNA, 21 nt, Homo sapiens
ucaccugagcaggaccucuga

SEQ ID NO: 395122 - RNA, 22 nt, Homo sapiens
ucaccuucguuuacuaugccug

SEQ ID NO: 395123 - RNA, 14 nt, Homo sapiens
ucacgccacaaauc

SEQ ID NO: 395124 - RNA, 20 nt, Homo sapiens
ucacgucgucuucuguauac

SEQ ID NO: 395125 - RNA, 23 nt, Homo sapiens
ucacuagccaugauaacugcaau

SEQ ID NO: 395126 - RNA, 18 nt, Homo sapiens
ucacucaaucucugauuc

SEQ ID NO: 395127 - RNA, 23 nt, Homo sapiens
ucacucucugaagaugaucauuu

SEQ ID NO: 395128 - RNA, 14 nt, Homo sapiens
ucagaaauguacaa

SEQ ID NO: 395129 - RNA, 19 nt, Homo sapiens
ucagaaguuucucagcucc

SEQ ID NO: 395130 - RNA, 16 nt, Homo sapiens
ucagacaggaaaggga

SEQ ID NO: 395131 - RNA, 14 nt, Homo sapiens
ucagagagcucacu

SEQ ID NO: 395132 - RNA, 14 nt, Homo sapiens
ucagagcacagcag

SEQ ID NO: 395133 - RNA, 13 nt, Homo sapiens
ucagauaugauau

SEQ ID NO: 395134 - RNA, 17 nt, Homo sapiens
ucagaucauauuucaca

SEQ ID NO: 395135 - RNA, 15 nt, Homo sapiens
ucagcagcccuccuc

SEQ ID NO: 395136 - RNA, 12 nt, Homo sapiens
ucagccaugagg

SEQ ID NO: 395137 - RNA, 18 nt, Homo sapiens
ucagccucccgaguagcu

SEQ ID NO: 395138 - RNA, 20 nt, Homo sapiens
uccuguccaaccuaaccccu

SEQ ID NO: 395139 - RNA, 18 nt, Homo sapiens
uccuguugagauggggga

SEQ ID NO: 395140 - RNA, 17 nt, Homo sapiens
uccuguuuuucugggug

SEQ ID NO: 395141 - RNA, 22 nt, Homo sapiens
uccuucccucuccccaagacuu

SEQ ID NO: 395142 - RNA, 20 nt, Homo sapiens
uccuuccugccaccugcugc

SEQ ID NO: 395143 - RNA, 18 nt, Homo sapiens
uccuuccuugaccagcag

SEQ ID NO: 395144 - RNA, 21 nt, Homo sapiens
uccuucuaccacuggggugcu

SEQ ID NO: 395145 - RNA, 17 nt, Homo sapiens
uccuugauacugcucau

SEQ ID NO: 395146 - RNA, 13 nt, Homo sapiens
uccuugauucaca

SEQ ID NO: 395147 - RNA, 14 nt, Homo sapiens
uccuugcaccugca

SEQ ID NO: 395148 - RNA, 17 nt, Homo sapiens
uccuuggucuccagugg

SEQ ID NO: 395149 - RNA, 18 nt, Homo sapiens
uccuugugguuuauguca

SEQ ID NO: 395150 - RNA, 15 nt, Homo sapiens
uccuuucacaaccuu

SEQ ID NO: 395151 - RNA, 17 nt, Homo sapiens
ucgaaauacaagccauu

SEQ ID NO: 395152 - RNA, 15 nt, Homo sapiens
ucgaacaauucauau

SEQ ID NO: 395153 - RNA, 13 nt, Homo sapiens
ucgagguggauca

SEQ ID NO: 395154 - RNA, 12 nt, Homo sapiens
ucgaguguuuca

SEQ ID NO: 395155 - RNA, 12 nt, Homo sapiens
ucgcaccuacca

SEQ ID NO: 395156 - RNA, 20 nt, Homo sapiens
ucgcaccuaccaucagggac

SEQ ID NO: 395157 - RNA, 16 nt, Homo sapiens
ucgccaccccuccuuc

SEQ ID NO: 395158 - RNA, 14 nt, Homo sapiens
ucgccguggcugcg

SEQ ID NO: 395159 - RNA, 16 nt, Homo sapiens
ucgcuuaagccagcac

SEQ ID NO: 395160 - RNA, 18 nt, Homo sapiens
ucgggcgagucacugccu

SEQ ID NO: 395161 - RNA, 20 nt, Homo sapiens
ucgguagaggauuucuaguu

SEQ ID NO: 395162 - RNA, 13 nt, Homo sapiens
ucguggccuuccc

SEQ ID NO: 395163 - RNA, 19 nt, Homo sapiens
ucguuugaaucacaguaua

SEQ ID NO: 395164 - RNA, 16 nt, Homo sapiens
ucuaaacuuuaauuca

SEQ ID NO: 395165 - RNA, 21 nt, Homo sapiens
ucuaaauguggagaaacugua

SEQ ID NO: 395166 - RNA, 14 nt, Homo sapiens
ucuaacaagucaua

SEQ ID NO: 395167 - RNA, 12 nt, Homo sapiens
ucuaacucuccc

SEQ ID NO: 395168 - RNA, 17 nt, Homo sapiens
ucuaaguaaugaugucg

SEQ ID NO: 395169 - RNA, 20 nt, Homo sapiens
ucuaaguggaaaaaguauua

SEQ ID NO: 395170 - RNA, 17 nt, Homo sapiens
ucuacaauuugccauug

SEQ ID NO: 395171 - RNA, 21 nt, Homo sapiens
ucuacauaaguaauucaagaa

SEQ ID NO: 395172 - RNA, 21 nt, Homo sapiens
ucuacccaaaggauacuguaa

SEQ ID NO: 395173 - RNA, 21 nt, Homo sapiens
ucuacuaacaaucagcuccuu

SEQ ID NO: 395174 - RNA, 16 nt, Homo sapiens
ucuagagcagggauua

SEQ ID NO: 395175 - RNA, 22 nt, Homo sapiens
ucuagguaggggcccacuucac

SEQ ID NO: 395176 - RNA, 14 nt, Homo sapiens
ucuaggugcccuug

SEQ ID NO: 395177 - RNA, 20 nt, Homo sapiens
ucuaguuucuugugggcuaa

SEQ ID NO: 395178 - RNA, 16 nt, Homo sapiens
ucuauggcacccaugc

SEQ ID NO: 395179 - RNA, 18 nt, Homo sapiens
ucuauggcacccaugcac

SEQ ID NO: 395180 - RNA, 21 nt, Homo sapiens
ucucaaaacugcacugucaag

SEQ ID NO: 395181 - RNA, 16 nt, Homo sapiens
ucucaaacuacuggca

SEQ ID NO: 395182 - RNA, 18 nt, Homo sapiens
ucucaaguuaucagggua

SEQ ID NO: 395183 - RNA, 12 nt, Homo sapiens
ucucacaaauga

SEQ ID NO: 395184 - RNA, 14 nt, Homo sapiens
ucucagaauucuuc

SEQ ID NO: 395185 - RNA, 9 nt, Homo sapiens
ucucagcug

SEQ ID NO: 395186 - RNA, 14 nt, Homo sapiens
ucucaggaccaaag

SEQ ID NO: 395187 - RNA, 19 nt, Homo sapiens
ucucaggaccaaagcuuuc

SEQ ID NO: 395188 - RNA, 20 nt, Homo sapiens
ucucagucaguaauugccaa

SEQ ID NO: 395189 - RNA, 22 nt, Homo sapiens
ucucauaugauugugcacauac

SEQ ID NO: 395190 - RNA, 12 nt, Homo sapiens
ucuccauuucac

SEQ ID NO: 395191 - RNA, 18 nt, Homo sapiens
ucucccaggacccaucac

SEQ ID NO: 395192 - RNA, 22 nt, Homo sapiens
ucuccccacugcucauuuggau

SEQ ID NO: 395193 - RNA, 22 nt, Homo sapiens
ucucggaguaucugggaacugu

SEQ ID NO: 395194 - RNA, 21 nt, Homo sapiens
ucucucagugaacugugaggg

SEQ ID NO: 395195 - RNA, 23 nt, Homo sapiens
ucucugaagaugaucauuugccc

SEQ ID NO: 395196 - RNA, 15 nt, Homo sapiens
ucucugccagugaca

SEQ ID NO: 395197 - RNA, 12 nt, Homo sapiens
ucucugcucugc

SEQ ID NO: 395198 - RNA, 21 nt, Homo sapiens
ucucuguuuuguaagcuuuaa

SEQ ID NO: 395199 - RNA, 16 nt, Homo sapiens
ucucuuauagaauauu

SEQ ID NO: 395200 - RNA, 14 nt, Homo sapiens
ucucuucuuuaaag

SEQ ID NO: 395201 - RNA, 15 nt, Homo sapiens
ucucuugcugccaca

SEQ ID NO: 395202 - RNA, 16 nt, Homo sapiens
ucucuuguuauugcau

SEQ ID NO: 395203 - RNA, 21 nt, Homo sapiens
ucugaaggagccccauuccug

SEQ ID NO: 395204 - RNA, 17 nt, Homo sapiens
ucugaagucacugcaca

SEQ ID NO: 395205 - RNA, 19 nt, Homo sapiens
ucugagcagugaaugauuc

SEQ ID NO: 395206 - RNA, 22 nt, Homo sapiens
ucugagccccugggacugcugc

SEQ ID NO: 395207 - RNA, 13 nt, Homo sapiens
ucugagcugugca

SEQ ID NO: 395208 - RNA, 16 nt, Homo sapiens
ucugaucugaugcaag

SEQ ID NO: 395209 - RNA, 16 nt, Homo sapiens
ucugaugcaagcaaga

SEQ ID NO: 395210 - RNA, 21 nt, Homo sapiens
ucugcaaaggcaccugaaugu

SEQ ID NO: 395211 - RNA, 21 nt, Homo sapiens
ucugcaagcacaucugcauuu

SEQ ID NO: 395212 - RNA, 20 nt, Homo sapiens
ucugccaaaggaugugauau

SEQ ID NO: 395213 - RNA, 10 nt, Homo sapiens
ucugccaggc

SEQ ID NO: 395214 - RNA, 13 nt, Homo sapiens
ucugcccuugcca

SEQ ID NO: 395215 - RNA, 18 nt, Homo sapiens
ucugcuaccucacugggg

SEQ ID NO: 395216 - RNA, 23 nt, Homo sapiens
ucugcucuuucucugccagugac

SEQ ID NO: 395217 - RNA, 20 nt, Homo sapiens
ucugcugucuaaccugugac

SEQ ID NO: 395218 - RNA, 11 nt, Homo sapiens
ucuggacacag

SEQ ID NO: 395219 - RNA, 14 nt, Homo sapiens
ucuggacacagccc

SEQ ID NO: 395220 - RNA, 19 nt, Homo sapiens
ucuggacacagccccaugu

SEQ ID NO: 395221 - RNA, 16 nt, Homo sapiens
ucuggaucuccugacc

SEQ ID NO: 395222 - RNA, 21 nt, Homo sapiens
ucugggagacuuugaagacca

SEQ ID NO: 395223 - RNA, 21 nt, Homo sapiens
ucugggccuucucaccacaga

SEQ ID NO: 395224 - RNA, 20 nt, Homo sapiens
ucugggcuuggggcuuccua

SEQ ID NO: 395225 - RNA, 19 nt, Homo sapiens
ucugggucagugguccaca

SEQ ID NO: 395226 - RNA, 22 nt, Homo sapiens
ucugguaauauugacuuguaua

SEQ ID NO: 395227 - RNA, 16 nt, Homo sapiens
ucuggugacaccagcc

SEQ ID NO: 395228 - RNA, 22 nt, Homo sapiens
ucuguauuuccccaacauguaa

SEQ ID NO: 395229 - RNA, 14 nt, Homo sapiens
ucugugaaaguaca

SEQ ID NO: 395230 - RNA, 16 nt, Homo sapiens
ucuuaaaauaacuuau

SEQ ID NO: 395231 - RNA, 22 nt, Homo sapiens
ucuuaaguuguggagagugcaa

SEQ ID NO: 395232 - RNA, 18 nt, Homo sapiens
ucuuaauauaacugccuu

SEQ ID NO: 395233 - RNA, 16 nt, Homo sapiens
ucuuagaaaaaccacc

SEQ ID NO: 395234 - RNA, 21 nt, Homo sapiens
ucuuagcagcuuccagauuga

SEQ ID NO: 395235 - RNA, 22 nt, Homo sapiens
ucuuagggcaucgcuccuccuc

SEQ ID NO: 395236 - RNA, 18 nt, Homo sapiens
ucuuauucucacuccacc

SEQ ID NO: 395237 - RNA, 19 nt, Homo sapiens
ucuuauucuuuuguaauau

SEQ ID NO: 395238 - RNA, 16 nt, Homo sapiens
ucuucaaccucauuga

SEQ ID NO: 395239 - RNA, 13 nt, Homo sapiens
ucuucaagcagau

SEQ ID NO: 395240 - RNA, 16 nt, Homo sapiens
ucuucacucucugaag

SEQ ID NO: 395241 - RNA, 12 nt, Homo sapiens
ucuucagccuag

SEQ ID NO: 395242 - RNA, 23 nt, Homo sapiens
ucuuccacuggaaaaguguaaua

SEQ ID NO: 395243 - RNA, 22 nt, Homo sapiens
ucuucccacacagaauauacau

SEQ ID NO: 395244 - RNA, 14 nt, Homo sapiens
ucuucuaagcaaaa

SEQ ID NO: 395245 - RNA, 14 nt, Homo sapiens
ucuucucaagaucc

SEQ ID NO: 395246 - RNA, 23 nt, Homo sapiens
ucuucugcuggcagaaagcaaau

SEQ ID NO: 395247 - RNA, 19 nt, Homo sapiens
ucuucuuuuuuugugaugu

SEQ ID NO: 395248 - RNA, 19 nt, Homo sapiens
ucuugacuacagucaggaa

SEQ ID NO: 395249 - RNA, 16 nt, Homo sapiens
ucuuggcuuugccaca

SEQ ID NO: 395250 - RNA, 17 nt, Homo sapiens
ucuuggucucaguguca

SEQ ID NO: 395251 - RNA, 20 nt, Homo sapiens
ucuuucucugccagugacag

SEQ ID NO: 395252 - RNA, 16 nt, Homo sapiens
ucuuuggacaaccaug

SEQ ID NO: 395253 - RNA, 21 nt, Homo sapiens
ucuuuguaagaguggaaccaa

SEQ ID NO: 395254 - RNA, 19 nt, Homo sapiens
ucuuuguaaugucaccacc

SEQ ID NO: 395255 - RNA, 17 nt, Homo sapiens
ucuuuuaagcccaucaa

SEQ ID NO: 395256 - RNA, 16 nt, Homo sapiens
ucuuuuacauucugca

SEQ ID NO: 395257 - RNA, 19 nt, Homo sapiens
ucuuuuggggaagcuuucu

SEQ ID NO: 395258 - RNA, 19 nt, Homo sapiens
ugaaaaacagaaagcaucc

SEQ ID NO: 395259 - RNA, 18 nt, Homo sapiens
ugaaaaaucuaagugaua

SEQ ID NO: 395260 - RNA, 21 nt, Homo sapiens
ugaaaacuuagagagguacaa

SEQ ID NO: 395261 - RNA, 14 nt, Homo sapiens
ugaaaaucuaauau

SEQ ID NO: 395262 - RNA, 20 nt, Homo sapiens
ugaaaaugcuuucuuggcca

SEQ ID NO: 395263 - RNA, 19 nt, Homo sapiens
ugaaagcagggacuugaac

SEQ ID NO: 395264 - RNA, 22 nt, Homo sapiens
ugaaaggaagcuccacugucac

SEQ ID NO: 395265 - RNA, 19 nt, Homo sapiens
ugaaauaauguacaucugg

SEQ ID NO: 395266 - RNA, 14 nt, Homo sapiens
ugaaauaugcaucu

SEQ ID NO: 395267 - RNA, 15 nt, Homo sapiens
ugaaaucucagaauu

SEQ ID NO: 395268 - RNA, 11 nt, Homo sapiens
ugaaaugcuag

SEQ ID NO: 395269 - RNA, 15 nt, Homo sapiens
ugaaaugcuggcauu

SEQ ID NO: 395270 - RNA, 21 nt, Homo sapiens
ugaaauuuucuagacuuucug

SEQ ID NO: 395271 - RNA, 19 nt, Homo sapiens
ugaacaaauuuacagagac

SEQ ID NO: 395272 - RNA, 23 nt, Homo sapiens
ugaacaaauuuacagagacagaa

SEQ ID NO: 395273 - RNA, 15 nt, Homo sapiens
ugaacacaucagcuu

SEQ ID NO: 395274 - RNA, 19 nt, Homo sapiens
ugaacacucuacuacaugu

SEQ ID NO: 395275 - RNA, 12 nt, Homo sapiens
ugaacacugggg

SEQ ID NO: 395276 - RNA, 23 nt, Homo sapiens
ugaacauaggaaaauagaaacuu

SEQ ID NO: 395277 - RNA, 19 nt, Homo sapiens
ugaacuagauugcaugcuu

SEQ ID NO: 395278 - RNA, 22 nt, Homo sapiens
ugaacuagauugcaugcuuccu

SEQ ID NO: 395279 - RNA, 24 nt, Homo sapiens
ugaacuuggaaagaaaugcccauc

SEQ ID NO: 395280 - RNA, 17 nt, Homo sapiens
ugaacuuucacauagca

SEQ ID NO: 395281 - RNA, 18 nt, Homo sapiens
ugaagagaccaagacucu

SEQ ID NO: 395282 - RNA, 20 nt, Homo sapiens
ugaagauucuccugugcuag

SEQ ID NO: 395283 - RNA, 22 nt, Homo sapiens
caaucaugaaauaugcaucuca

SEQ ID NO: 395284 - RNA, 18 nt, Homo sapiens
caauccagcuauguuaua

SEQ ID NO: 395285 - RNA, 16 nt, Homo sapiens
caauggagacugucuc

SEQ ID NO: 395286 - RNA, 18 nt, Homo sapiens
caauuauagaaagccaaa

SEQ ID NO: 395287 - RNA, 23 nt, Homo sapiens
caauuauuccuaaauaaauggau

SEQ ID NO: 395288 - RNA, 22 nt, Homo sapiens
caauucauauauuugaagugga

SEQ ID NO: 395289 - RNA, 11 nt, Homo sapiens
caauuuaguuc

SEQ ID NO: 395290 - RNA, 23 nt, Homo sapiens
caauuuuaauugauuauucugau

SEQ ID NO: 395291 - RNA, 13 nt, Homo sapiens
cacaaaccaguau

SEQ ID NO: 395292 - RNA, 14 nt, Homo sapiens
cacaaauagaguuu

SEQ ID NO: 395293 - RNA, 18 nt, Homo sapiens
cacaaaucuggugccucu

SEQ ID NO: 395294 - RNA, 18 nt, Homo sapiens
cacaaauuuguaaacuuu

SEQ ID NO: 395295 - RNA, 22 nt, Homo sapiens
cacaagauggaaaucacauuua

SEQ ID NO: 395296 - RNA, 14 nt, Homo sapiens
cacaaguccuguga

SEQ ID NO: 395297 - RNA, 20 nt, Homo sapiens
cacaauagcaguugaaacaa

SEQ ID NO: 395298 - RNA, 23 nt, Homo sapiens
cacaauccuguggaucugggcaa

SEQ ID NO: 395299 - RNA, 22 nt, Homo sapiens
cacacaagcuuuuuuacacaaa

SEQ ID NO: 395300 - RNA, 15 nt, Homo sapiens
cacacaccacacaua

SEQ ID NO: 395301 - RNA, 15 nt, Homo sapiens
cacacaccuguaguc

SEQ ID NO: 395302 - RNA, 13 nt, Homo sapiens
cacacccagccuc

SEQ ID NO: 395303 - RNA, 19 nt, Homo sapiens
cacaccuacaccucuugaa

SEQ ID NO: 395304 - RNA, 18 nt, Homo sapiens
cacacuccccugcacugg

SEQ ID NO: 395305 - RNA, 20 nt, Homo sapiens
cacacuccuccaaggcacaa

SEQ ID NO: 395306 - RNA, 15 nt, Homo sapiens
cacacuuugcacuga

SEQ ID NO: 395307 - RNA, 12 nt, Homo sapiens
cacacuuugcca

SEQ ID NO: 395308 - RNA, 21 nt, Homo sapiens
cacagcaagggugaugggaaa

SEQ ID NO: 395309 - RNA, 13 nt, Homo sapiens
cacagcacccaug

SEQ ID NO: 395310 - RNA, 20 nt, Homo sapiens
cacagcgagacuccgucuca

SEQ ID NO: 395311 - RNA, 16 nt, Homo sapiens
cacaggcacugcagga

SEQ ID NO: 395312 - RNA, 15 nt, Homo sapiens
cacaggcagcauuua

SEQ ID NO: 395313 - RNA, 16 nt, Homo sapiens
cacaggcagcauuuag

SEQ ID NO: 395314 - RNA, 17 nt, Homo sapiens
cacagggccaacuugag

SEQ ID NO: 395315 - RNA, 15 nt, Homo sapiens
cacagggucugcucu

SEQ ID NO: 395316 - RNA, 12 nt, Homo sapiens
cacagugugaau

SEQ ID NO: 395317 - RNA, 17 nt, Homo sapiens
cacaguucuccauuuca

SEQ ID NO: 395318 - RNA, 18 nt, Homo sapiens
cacaguucuccauuucac

SEQ ID NO: 395319 - RNA, 19 nt, Homo sapiens
cacaguucuccauuucacu

SEQ ID NO: 395320 - RNA, 22 nt, Homo sapiens
cacaguucuccauuucacuuga

SEQ ID NO: 395321 - RNA, 16 nt, Homo sapiens
cacauaacaugcuuua

SEQ ID NO: 395322 - RNA, 21 nt, Homo sapiens
cacauccucugucuauuugag

SEQ ID NO: 395323 - RNA, 17 nt, Homo sapiens
cacauucccaucuguca

SEQ ID NO: 395324 - RNA, 13 nt, Homo sapiens
caccaaagccacc

SEQ ID NO: 395325 - RNA, 23 nt, Homo sapiens
caccacacccagccucaguccuc

SEQ ID NO: 395326 - RNA, 17 nt, Homo sapiens
caccacuaacaugcccu

SEQ ID NO: 395327 - RNA, 22 nt, Homo sapiens
caccaguguccccuccacuguc

SEQ ID NO: 395328 - RNA, 23 nt, Homo sapiens
cacccaaaagucaaaaggugccu

SEQ ID NO: 395329 - RNA, 14 nt, Homo sapiens
cacccagugccagg

SEQ ID NO: 395330 - RNA, 13 nt, Homo sapiens
cacccaugcaccu

SEQ ID NO: 395331 - RNA, 17 nt, Homo sapiens
caccccuccuuccuuga

SEQ ID NO: 395332 - RNA, 22 nt, Homo sapiens
cacccucccccgccacuccuga

SEQ ID NO: 395333 - RNA, 21 nt, Homo sapiens
cacccuggaggauuucaucuc

SEQ ID NO: 395334 - RNA, 22 nt, Homo sapiens
caccuaccaucagggacaggau

SEQ ID NO: 395335 - RNA, 21 nt, Homo sapiens
caccuccccagccuuugauca

SEQ ID NO: 395336 - RNA, 16 nt, Homo sapiens
caccucugcacaagcu

SEQ ID NO: 395337 - RNA, 20 nt, Homo sapiens
caccucugccucaaugugaa

SEQ ID NO: 395338 - RNA, 14 nt, Homo sapiens
caccugugaguuua

SEQ ID NO: 395339 - RNA, 22 nt, Homo sapiens
caccuucccucaugcuguuuca

SEQ ID NO: 395340 - RNA, 20 nt, Homo sapiens
caccuuccuaauaugcuuua

SEQ ID NO: 395341 - RNA, 13 nt, Homo sapiens
caccuugggauga

SEQ ID NO: 395342 - RNA, 12 nt, Homo sapiens
cacgccugcaaa

SEQ ID NO: 395343 - RNA, 18 nt, Homo sapiens
cacgggcaugggcacucc

SEQ ID NO: 395344 - RNA, 13 nt, Homo sapiens
cacgucugcuaac

SEQ ID NO: 395345 - RNA, 18 nt, Homo sapiens
cacgucuggcuucacaga

SEQ ID NO: 395346 - RNA, 15 nt, Homo sapiens
cacguucugcucauc

SEQ ID NO: 395347 - RNA, 16 nt, Homo sapiens
cacuaacaaacucuga

SEQ ID NO: 395348 - RNA, 17 nt, Homo sapiens
cacuagucacauucuug

SEQ ID NO: 395349 - RNA, 23 nt, Homo sapiens
cacuccagccugagcgacaguga

SEQ ID NO: 395350 - RNA, 13 nt, Homo sapiens
cacuccugaaccc

SEQ ID NO: 395351 - RNA, 14 nt, Homo sapiens
cacuccugaacccc

SEQ ID NO: 395352 - RNA, 23 nt, Homo sapiens
cacugacuucuaaguaaaaccac

SEQ ID NO: 395353 - RNA, 13 nt, Homo sapiens
cacugcaagcacu

SEQ ID NO: 395354 - RNA, 20 nt, Homo sapiens
cacugcacagugcaucucag

SEQ ID NO: 395355 - RNA, 15 nt, Homo sapiens
cacugccuacugcau

SEQ ID NO: 395356 - RNA, 22 nt, Homo sapiens
cacugccucucccuggcccuca

SEQ ID NO: 395357 - RNA, 16 nt, Homo sapiens
cacugcugccucuuga

SEQ ID NO: 395358 - RNA, 23 nt, Homo sapiens
cacugcuugaggaaaacaagcau

SEQ ID NO: 395359 - RNA, 22 nt, Homo sapiens
cacugggaugagccgcugugag

SEQ ID NO: 395360 - RNA, 14 nt, Homo sapiens
cacugggcuucuag

SEQ ID NO: 395361 - RNA, 13 nt, Homo sapiens
cacuggguugacu

SEQ ID NO: 395362 - RNA, 12 nt, Homo sapiens
cacuguccagua

SEQ ID NO: 395363 - RNA, 23 nt, Homo sapiens
cacugugaagagaaccauaucaa

SEQ ID NO: 395364 - RNA, 20 nt, Homo sapiens
cacuuauaggaauugaccca

SEQ ID NO: 395365 - RNA, 21 nt, Homo sapiens
cacuuccaccagccugcacua

SEQ ID NO: 395366 - RNA, 19 nt, Homo sapiens
cacuucuaaaugaagugca

SEQ ID NO: 395367 - RNA, 12 nt, Homo sapiens
cacuucucucag

SEQ ID NO: 395368 - RNA, 19 nt, Homo sapiens
cacuugcacgcccaugugu

SEQ ID NO: 395369 - RNA, 17 nt, Homo sapiens
cacuuuaacugacuuaa

SEQ ID NO: 395370 - RNA, 20 nt, Homo sapiens
cacuuuaauucucaugugau

SEQ ID NO: 395371 - RNA, 22 nt, Homo sapiens
cacuuugcacugauauaucaug

SEQ ID NO: 395372 - RNA, 19 nt, Homo sapiens
cacuuugggaggcugaggc

SEQ ID NO: 395373 - RNA, 20 nt, Homo sapiens
cagaaaaacucugggaaaua

SEQ ID NO: 395374 - RNA, 14 nt, Homo sapiens
cagaaaaacugugg

SEQ ID NO: 395375 - RNA, 20 nt, Homo sapiens
cagaaaauauuauguguuuc

SEQ ID NO: 395376 - RNA, 17 nt, Homo sapiens
cagaaagcauccuaaau

SEQ ID NO: 395377 - RNA, 12 nt, Homo sapiens
cagaaagcauua

SEQ ID NO: 395378 - RNA, 18 nt, Homo sapiens
cagaaauacauauuucca

SEQ ID NO: 395379 - RNA, 12 nt, Homo sapiens
cagaacagugau

SEQ ID NO: 395380 - RNA, 22 nt, Homo sapiens
cagaaccuguccuugcacacuc

SEQ ID NO: 395381 - RNA, 14 nt, Homo sapiens
cagaacuaucucag

SEQ ID NO: 395382 - RNA, 22 nt, Homo sapiens
cagaacugcagucagcaugaau

SEQ ID NO: 395383 - RNA, 20 nt, Homo sapiens
cagaacugcuugaacccagg

SEQ ID NO: 395384 - RNA, 13 nt, Homo sapiens
cagaacuucugaa

SEQ ID NO: 395385 - RNA, 15 nt, Homo sapiens
cagaagcacauauga

SEQ ID NO: 395386 - RNA, 23 nt, Homo sapiens
cagaagcaguugagucgucauca

SEQ ID NO: 395387 - RNA, 15 nt, Homo sapiens
cagaagcauuucacc

SEQ ID NO: 395388 - RNA, 12 nt, Homo sapiens
cagaagccucac

SEQ ID NO: 395389 - RNA, 19 nt, Homo sapiens
cagaaggaaaaauguguaa

SEQ ID NO: 395390 - RNA, 13 nt, Homo sapiens
cagaaggacucag

SEQ ID NO: 395391 - RNA, 23 nt, Homo sapiens
cagaauagcuuugaauguggccc

SEQ ID NO: 395392 - RNA, 23 nt, Homo sapiens
cagaaucucauagguugccaaua

SEQ ID NO: 395393 - RNA, 22 nt, Homo sapiens
cagacaggaggaaucaugucag

SEQ ID NO: 395394 - RNA, 17 nt, Homo sapiens
cagacauguggugggac

SEQ ID NO: 395395 - RNA, 12 nt, Homo sapiens
cagaccacugau

SEQ ID NO: 395396 - RNA, 23 nt, Homo sapiens
cagaccauucaggacacagggaa

SEQ ID NO: 395397 - RNA, 15 nt, Homo sapiens
cagacuccugugcaa

SEQ ID NO: 395398 - RNA, 16 nt, Homo sapiens
cagacuccugugcaac

SEQ ID NO: 395399 - RNA, 18 nt, Homo sapiens
cagacuccugugcaacuu

SEQ ID NO: 395400 - RNA, 14 nt, Homo sapiens
cagacuucccugaa

SEQ ID NO: 395401 - RNA, 20 nt, Homo sapiens
cagacuucccugaauguauu

SEQ ID NO: 395402 - RNA, 15 nt, Homo sapiens
cagagagcggucuca

SEQ ID NO: 395403 - RNA, 23 nt, Homo sapiens
cagagaggacuguugacauccaa

SEQ ID NO: 395404 - RNA, 19 nt, Homo sapiens
cagagaugccuccaccgcu

SEQ ID NO: 395405 - RNA, 20 nt, Homo sapiens
cagagcaagacucugucuca

SEQ ID NO: 395406 - RNA, 16 nt, Homo sapiens
cagagcagaacuuuca

SEQ ID NO: 395407 - RNA, 17 nt, Homo sapiens
cagagcagaacuuucac

SEQ ID NO: 395408 - RNA, 20 nt, Homo sapiens
cagagcgagagaauauguca

SEQ ID NO: 395409 - RNA, 20 nt, Homo sapiens
cagagcuugaacacagucuc

SEQ ID NO: 395410 - RNA, 13 nt, Homo sapiens
cagaggagccaug

SEQ ID NO: 395411 - RNA, 16 nt, Homo sapiens
cagaggaugagcucua

SEQ ID NO: 395412 - RNA, 15 nt, Homo sapiens
cagaggcuucuucag

SEQ ID NO: 395413 - RNA, 18 nt, Homo sapiens
cagauaaacaacaaauaa

SEQ ID NO: 395414 - RNA, 13 nt, Homo sapiens
cagauaaugugaa

SEQ ID NO: 395415 - RNA, 13 nt, Homo sapiens
cagauauuucaca

SEQ ID NO: 395416 - RNA, 15 nt, Homo sapiens
cagaucauauuucac

SEQ ID NO: 395417 - RNA, 16 nt, Homo sapiens
cagaucauauuucaca

SEQ ID NO: 395418 - RNA, 21 nt, Homo sapiens
cagaugacaaaaauucaacuc

SEQ ID NO: 395419 - RNA, 23 nt, Homo sapiens
cagauuccaggcgaugugcaagu

SEQ ID NO: 395420 - RNA, 16 nt, Homo sapiens
cagauuucagaucaua

SEQ ID NO: 395421 - RNA, 20 nt, Homo sapiens
cagcaaaaugugaaugggaa

SEQ ID NO: 395422 - RNA, 16 nt, Homo sapiens
cagcaaugacaucuca

SEQ ID NO: 395423 - RNA, 18 nt, Homo sapiens
cagcacuuagguuuuccu

SEQ ID NO: 395424 - RNA, 17 nt, Homo sapiens
cagcauacacagaugaa

SEQ ID NO: 395425 - RNA, 14 nt, Homo sapiens
cagcaucuaaguaa

SEQ ID NO: 395426 - RNA, 22 nt, Homo sapiens
cagccacacugugggacucuuc

SEQ ID NO: 395427 - RNA, 14 nt, Homo sapiens
cagccagacuggca

SEQ ID NO: 395428 - RNA, 10 nt, Homo sapiens
ugaagccagc

SEQ ID NO: 395429 - RNA, 16 nt, Homo sapiens
ugaaggagaaggugcc

SEQ ID NO: 395430 - RNA, 17 nt, Homo sapiens
ugaaguuuacauuguaa

SEQ ID NO: 395431 - RNA, 21 nt, Homo sapiens
ugaauaaagccugcuuuuuaa

SEQ ID NO: 395432 - RNA, 13 nt, Homo sapiens
ugaauaauacagu

SEQ ID NO: 395433 - RNA, 16 nt, Homo sapiens
ugaauaauacaguauc

SEQ ID NO: 395434 - RNA, 23 nt, Homo sapiens
ugaauacacgagguaugaggucu

SEQ ID NO: 395435 - RNA, 17 nt, Homo sapiens
ugaauauccccucccag

SEQ ID NO: 395436 - RNA, 17 nt, Homo sapiens
ugaauaugauuaguaaa

SEQ ID NO: 395437 - RNA, 17 nt, Homo sapiens
ugaaucagacccuaccc

SEQ ID NO: 395438 - RNA, 12 nt, Homo sapiens
ugaaucuucaca

SEQ ID NO: 395439 - RNA, 17 nt, Homo sapiens
ugaaucuuggugucuac

SEQ ID NO: 395440 - RNA, 17 nt, Homo sapiens
ugacacuuuucaugugu

SEQ ID NO: 395441 - RNA, 19 nt, Homo sapiens
ugacagacaggcucuuagc

SEQ ID NO: 395442 - RNA, 12 nt, Homo sapiens
ugacagagccag

SEQ ID NO: 395443 - RNA, 22 nt, Homo sapiens
ugacagcugaccuuugucaucu

SEQ ID NO: 395444 - RNA, 14 nt, Homo sapiens
ugacauccaagcuu

SEQ ID NO: 395445 - RNA, 19 nt, Homo sapiens
ugacaucucaggggccaga

SEQ ID NO: 395446 - RNA, 15 nt, Homo sapiens
ugacauuauaugcac

SEQ ID NO: 395447 - RNA, 18 nt, Homo sapiens
ugacauuuauauauugaa

SEQ ID NO: 395448 - RNA, 17 nt, Homo sapiens
ugaccagcagaucccag

SEQ ID NO: 395449 - RNA, 22 nt, Homo sapiens
ugaccaggcauccuccacaaua

SEQ ID NO: 395450 - RNA, 13 nt, Homo sapiens
ugacccacaagaa

SEQ ID NO: 395451 - RNA, 14 nt, Homo sapiens
ugaccccuccucac

SEQ ID NO: 395452 - RNA, 14 nt, Homo sapiens
ugaccggcugcuuu

SEQ ID NO: 395453 - RNA, 13 nt, Homo sapiens
ugaccuccacagc

SEQ ID NO: 395454 - RNA, 19 nt, Homo sapiens
ugaccugaggaagcgugaa

SEQ ID NO: 395455 - RNA, 16 nt, Homo sapiens
ugaccuguuauuacca

SEQ ID NO: 395456 - RNA, 20 nt, Homo sapiens
ugaccuugcacaaacagccc

SEQ ID NO: 395457 - RNA, 14 nt, Homo sapiens
ugacucagaauauu

SEQ ID NO: 395458 - RNA, 19 nt, Homo sapiens
ugacugagcagacugguga

SEQ ID NO: 395459 - RNA, 15 nt, Homo sapiens
ugacuuaagcugccu

SEQ ID NO: 395460 - RNA, 15 nt, Homo sapiens
ugacuuccacaccua

SEQ ID NO: 395461 - RNA, 17 nt, Homo sapiens
ugacuugugucccauga

SEQ ID NO: 395462 - RNA, 18 nt, Homo sapiens
ugagaaagagcacuuaag

SEQ ID NO: 395463 - RNA, 22 nt, Homo sapiens
ugagacagcucugcauacucau

SEQ ID NO: 395464 - RNA, 23 nt, Homo sapiens
ugagacucagacaggaaagggaa

SEQ ID NO: 395465 - RNA, 13 nt, Homo sapiens
ugagagaaccuca

SEQ ID NO: 395466 - RNA, 19 nt, Homo sapiens
ugagaggagagagacucca

SEQ ID NO: 395467 - RNA, 23 nt, Homo sapiens
ugagaggagagagacuccagcug

SEQ ID NO: 395468 - RNA, 22 nt, Homo sapiens
ugagaguaucaggucucccacg

SEQ ID NO: 395469 - RNA, 13 nt, Homo sapiens
ugagaugcuggag

SEQ ID NO: 395470 - RNA, 14 nt, Homo sapiens
ugagcaaaggugau

SEQ ID NO: 395471 - RNA, 15 nt, Homo sapiens
ugagcaccaggggau

SEQ ID NO: 395472 - RNA, 11 nt, Homo sapiens
ugagcauuuag

SEQ ID NO: 395473 - RNA, 17 nt, Homo sapiens
ugaggaaagcauguauu

SEQ ID NO: 395474 - RNA, 23 nt, Homo sapiens
ugaggacuuaaaauauuccugca

SEQ ID NO: 395475 - RNA, 20 nt, Homo sapiens
ugaggcaaccacaggcagca

SEQ ID NO: 395476 - RNA, 22 nt, Homo sapiens
ugaggcagacagcagcucaggc

SEQ ID NO: 395477 - RNA, 20 nt, Homo sapiens
ugaggcugcaaucacacuga

SEQ ID NO: 395478 - RNA, 15 nt, Homo sapiens
ugagggaaaaugagu

SEQ ID NO: 395479 - RNA, 19 nt, Homo sapiens
ugagggagccuggccccau

SEQ ID NO: 395480 - RNA, 16 nt, Homo sapiens
ugagggcccagagcag

SEQ ID NO: 395481 - RNA, 13 nt, Homo sapiens
ugagggucagaga

SEQ ID NO: 395482 - RNA, 14 nt, Homo sapiens
ugagucugugccac

SEQ ID NO: 395483 - RNA, 18 nt, Homo sapiens
ugagucuucaucuuaggg

SEQ ID NO: 395484 - RNA, 16 nt, Homo sapiens
ugagugccuguaauca

SEQ ID NO: 395485 - RNA, 13 nt, Homo sapiens
ugaguggugccaa

SEQ ID NO: 395486 - RNA, 23 nt, Homo sapiens
ugagugguguguguuaucagaua

SEQ ID NO: 395487 - RNA, 19 nt, Homo sapiens
ugaguguguccaagugugu

SEQ ID NO: 395488 - RNA, 16 nt, Homo sapiens
ugaguuauuuugcuaa

SEQ ID NO: 395489 - RNA, 20 nt, Homo sapiens
ugaguuuuugauagcuuuau

SEQ ID NO: 395490 - RNA, 16 nt, Homo sapiens
ugauagaguguuauca

SEQ ID NO: 395491 - RNA, 11 nt, Homo sapiens
ugauagcuuua

SEQ ID NO: 395492 - RNA, 19 nt, Homo sapiens
ugauauaucaugagugaau

SEQ ID NO: 395493 - RNA, 18 nt, Homo sapiens
ugauaucccccagccuca

SEQ ID NO: 395494 - RNA, 14 nt, Homo sapiens
ugauaugucagggc

SEQ ID NO: 395495 - RNA, 12 nt, Homo sapiens
ugauauugcagc

SEQ ID NO: 395496 - RNA, 21 nt, Homo sapiens
ugaucaggcuauguauggaau

SEQ ID NO: 395497 - RNA, 17 nt, Homo sapiens
ugauccguuccauugca

SEQ ID NO: 395498 - RNA, 18 nt, Homo sapiens
ugaugaaauguaaauacu

SEQ ID NO: 395499 - RNA, 19 nt, Homo sapiens
ugaugacagacacuucuaa

SEQ ID NO: 395500 - RNA, 20 nt, Homo sapiens
ugaugcaagcaagaaacacu

SEQ ID NO: 395501 - RNA, 17 nt, Homo sapiens
ugaugucguuugaauca

SEQ ID NO: 395502 - RNA, 13 nt, Homo sapiens
ugauucacaauga

SEQ ID NO: 395503 - RNA, 17 nt, Homo sapiens
ugauucucagcacuugg

SEQ ID NO: 395504 - RNA, 16 nt, Homo sapiens
ugauucugucaauguc

SEQ ID NO: 395505 - RNA, 14 nt, Homo sapiens
ugauuuaaaucagc

SEQ ID NO: 395506 - RNA, 16 nt, Homo sapiens
ugauuuuaucugugaa

SEQ ID NO: 395507 - RNA, 20 nt, Homo sapiens
ugcaaaaguucugacuugac

SEQ ID NO: 395508 - RNA, 16 nt, Homo sapiens
ugcaacaguagcauag

SEQ ID NO: 395509 - RNA, 21 nt, Homo sapiens
ugcaacucaaggacuuugcag

SEQ ID NO: 395510 - RNA, 21 nt, Homo sapiens
ugcaacuuagcucacaccuga

SEQ ID NO: 395511 - RNA, 13 nt, Homo sapiens
ugcaacuuguaaa

SEQ ID NO: 395512 - RNA, 18 nt, Homo sapiens
ugcaagugucugugugca

SEQ ID NO: 395513 - RNA, 17 nt, Homo sapiens
ugcaagugugugcaugu

SEQ ID NO: 395514 - RNA, 16 nt, Homo sapiens
ugcacaaagcccuucc

SEQ ID NO: 395515 - RNA, 16 nt, Homo sapiens
ugcaccaagcaggaaa

SEQ ID NO: 395516 - RNA, 20 nt, Homo sapiens
ugcaccuuaccaacuuucug

SEQ ID NO: 395517 - RNA, 12 nt, Homo sapiens
ugcacgugugca

SEQ ID NO: 395518 - RNA, 14 nt, Homo sapiens
ugcagaagacagua

SEQ ID NO: 395519 - RNA, 17 nt, Homo sapiens
ugcagaauccaaaguaa

SEQ ID NO: 395520 - RNA, 18 nt, Homo sapiens
ugcagaauccaaaguaaa

SEQ ID NO: 395521 - RNA, 18 nt, Homo sapiens
ugcagagugcccagaacu

SEQ ID NO: 395522 - RNA, 14 nt, Homo sapiens
ugcagaugacaaaa

SEQ ID NO: 395523 - RNA, 17 nt, Homo sapiens
ugcagccuuugccuccc

SEQ ID NO: 395524 - RNA, 19 nt, Homo sapiens
ugcagcuuauauucaucca

SEQ ID NO: 395525 - RNA, 20 nt, Homo sapiens
ugcaggacauuuggcuguga

SEQ ID NO: 395526 - RNA, 11 nt, Homo sapiens
ugcaguagcac

SEQ ID NO: 395527 - RNA, 20 nt, Homo sapiens
ugcauaaaauguuaaguuga

SEQ ID NO: 395528 - RNA, 14 nt, Homo sapiens
ugcauaguauucca

SEQ ID NO: 395529 - RNA, 15 nt, Homo sapiens
ugcauauucuuaugu

SEQ ID NO: 395530 - RNA, 18 nt, Homo sapiens
ugcauccguaguucccug

SEQ ID NO: 395531 - RNA, 16 nt, Homo sapiens
ugcaugcagcaucuaa

SEQ ID NO: 395532 - RNA, 20 nt, Homo sapiens
ugcauggauaugugccaggc

SEQ ID NO: 395533 - RNA, 22 nt, Homo sapiens
ugcaugugugcgagugugugca

SEQ ID NO: 395534 - RNA, 15 nt, Homo sapiens
ugccaaacagccaca

SEQ ID NO: 395535 - RNA, 18 nt, Homo sapiens
ugccaaaggaugugauau

SEQ ID NO: 395536 - RNA, 19 nt, Homo sapiens
ugccaaaggaugugauaua

SEQ ID NO: 395537 - RNA, 16 nt, Homo sapiens
ugccacacggcucuca

SEQ ID NO: 395538 - RNA, 20 nt, Homo sapiens
ugccaccauggccagccaac

SEQ ID NO: 395539 - RNA, 14 nt, Homo sapiens
ugccagacaugugg

SEQ ID NO: 395540 - RNA, 17 nt, Homo sapiens
ugccagaugcaauacaa

SEQ ID NO: 395541 - RNA, 15 nt, Homo sapiens
ugccaggccuggcaa

SEQ ID NO: 395542 - RNA, 15 nt, Homo sapiens
ugccagugacagaca

SEQ ID NO: 395543 - RNA, 22 nt, Homo sapiens
ugccagugccuuaccuccugcc

SEQ ID NO: 395544 - RNA, 21 nt, Homo sapiens
ugccauaaugacucagaauau

SEQ ID NO: 395545 - RNA, 14 nt, Homo sapiens
ugccauagcaagau

SEQ ID NO: 395546 - RNA, 15 nt, Homo sapiens
ugccaugccagcuua

SEQ ID NO: 395547 - RNA, 21 nt, Homo sapiens
ugcccaaccugcucuccucuu

SEQ ID NO: 395548 - RNA, 20 nt, Homo sapiens
ugcccaaguuguggugcuga

SEQ ID NO: 395549 - RNA, 20 nt, Homo sapiens
ugcccaggcuggaguggagu

SEQ ID NO: 395550 - RNA, 18 nt, Homo sapiens
ugcccagggccacucugc

SEQ ID NO: 395551 - RNA, 20 nt, Homo sapiens
ugccccaaacaaauaugcaa

SEQ ID NO: 395552 - RNA, 14 nt, Homo sapiens
ugccccaccuuuau

SEQ ID NO: 395553 - RNA, 17 nt, Homo sapiens
ugcccccaauccaugaa

SEQ ID NO: 395554 - RNA, 21 nt, Homo sapiens
ugcccguaaacacgccugcaa

SEQ ID NO: 395555 - RNA, 16 nt, Homo sapiens
ugcccugggaugucca

SEQ ID NO: 395556 - RNA, 18 nt, Homo sapiens
ugcccugggauguccaca

SEQ ID NO: 395557 - RNA, 19 nt, Homo sapiens
ugcccuguaccugugcacg

SEQ ID NO: 395558 - RNA, 21 nt, Homo sapiens
ugccgguaaacacgccugcaa

SEQ ID NO: 395559 - RNA, 21 nt, Homo sapiens
ugccguaacaacuguggucaa

SEQ ID NO: 395560 - RNA, 15 nt, Homo sapiens
ugccucaaugccagu

SEQ ID NO: 395561 - RNA, 21 nt, Homo sapiens
ugccucauuaccuugugcuaa

SEQ ID NO: 395562 - RNA, 20 nt, Homo sapiens
ugccuccaccccccagaacc

SEQ ID NO: 395563 - RNA, 15 nt, Homo sapiens
ugccugaaccuucca

SEQ ID NO: 395564 - RNA, 13 nt, Homo sapiens
ugccugacauuug

SEQ ID NO: 395565 - RNA, 23 nt, Homo sapiens
ugccugccccaaacaaauaugca

SEQ ID NO: 395566 - RNA, 13 nt, Homo sapiens
ugccugcuggaaa

SEQ ID NO: 395567 - RNA, 14 nt, Homo sapiens
ugccuguaaucaca

SEQ ID NO: 395568 - RNA, 14 nt, Homo sapiens
ugccuuaucuugca

SEQ ID NO: 395569 - RNA, 16 nt, Homo sapiens
ugccuucacuuuacaa

SEQ ID NO: 395570 - RNA, 20 nt, Homo sapiens
ugccuuuucaucuaauguga

SEQ ID NO: 395571 - RNA, 13 nt, Homo sapiens
ugcgacugaugaa

SEQ ID NO: 395572 - RNA, 16 nt, Homo sapiens
ugcgggcgaggucuga

SEQ ID NO: 395573 - RNA, 17 nt, Homo sapiens
ugcgugugcgugcaugu

SEQ ID NO: 395574 - RNA, 15 nt, Homo sapiens
ugcgugugggacccg

SEQ ID NO: 395575 - RNA, 12 nt, Homo sapiens
cagccagugacc

SEQ ID NO: 395576 - RNA, 19 nt, Homo sapiens
cagccccagagcagggugu

SEQ ID NO: 395577 - RNA, 14 nt, Homo sapiens
cagccccuagccca

SEQ ID NO: 395578 - RNA, 16 nt, Homo sapiens
cagccgaaaagcuuuu

SEQ ID NO: 395579 - RNA, 20 nt, Homo sapiens
cagccuccccaccuucuuca

SEQ ID NO: 395580 - RNA, 22 nt, Homo sapiens
cagccucuucuagagccgugau

SEQ ID NO: 395581 - RNA, 21 nt, Homo sapiens
cagccuggucaacauggugaa

SEQ ID NO: 395582 - RNA, 18 nt, Homo sapiens
cagcgaccucggugggcc

SEQ ID NO: 395583 - RNA, 19 nt, Homo sapiens
cagcgccaacgagcagugc

SEQ ID NO: 395584 - RNA, 13 nt, Homo sapiens
cagcuaaagcaau

SEQ ID NO: 395585 - RNA, 14 nt, Homo sapiens
cagcuacucaggag

SEQ ID NO: 395586 - RNA, 14 nt, Homo sapiens
cagcucacacauga

SEQ ID NO: 395587 - RNA, 15 nt, Homo sapiens
cagcucacgucacac

SEQ ID NO: 395588 - RNA, 17 nt, Homo sapiens
cagcucccucugccuga

SEQ ID NO: 395589 - RNA, 14 nt, Homo sapiens
cagcucguucucug

SEQ ID NO: 395590 - RNA, 15 nt, Homo sapiens
cagcucugcaagaau

SEQ ID NO: 395591 - RNA, 18 nt, Homo sapiens
cagcuggaguucaugucg

SEQ ID NO: 395592 - RNA, 16 nt, Homo sapiens
cagcuggccuguaauc

SEQ ID NO: 395593 - RNA, 16 nt, Homo sapiens
cagcuguuagagucca

SEQ ID NO: 395594 - RNA, 20 nt, Homo sapiens
cagcuuaggggcugcugacc

SEQ ID NO: 395595 - RNA, 13 nt, Homo sapiens
cagcuuauauuca

SEQ ID NO: 395596 - RNA, 13 nt, Homo sapiens
cagcuuaucucag

SEQ ID NO: 395597 - RNA, 13 nt, Homo sapiens
cagcuuauucaca

SEQ ID NO: 395598 - RNA, 14 nt, Homo sapiens
cagcuuugcaguga

SEQ ID NO: 395599 - RNA, 16 nt, Homo sapiens
caggacccugggacca

SEQ ID NO: 395600 - RNA, 12 nt, Homo sapiens
caggaccugccu

SEQ ID NO: 395601 - RNA, 12 nt, Homo sapiens
caggacuagcug

SEQ ID NO: 395602 - RNA, 19 nt, Homo sapiens
caggagagagaaagccagg

SEQ ID NO: 395603 - RNA, 21 nt, Homo sapiens
caggagguaaagaaauagcca

SEQ ID NO: 395604 - RNA, 23 nt, Homo sapiens
caggagguggagguugcagugag

SEQ ID NO: 395605 - RNA, 17 nt, Homo sapiens
caggauagucuaaggga

SEQ ID NO: 395606 - RNA, 14 nt, Homo sapiens
caggaucugaguua

SEQ ID NO: 395607 - RNA, 17 nt, Homo sapiens
caggauuaaaagccaug

SEQ ID NO: 395608 - RNA, 19 nt, Homo sapiens
caggcagaucccacuugca

SEQ ID NO: 395609 - RNA, 22 nt, Homo sapiens
caggcagcauuuagcacauacu

SEQ ID NO: 395610 - RNA, 13 nt, Homo sapiens
caggcauugccaa

SEQ ID NO: 395611 - RNA, 14 nt, Homo sapiens
caggccucccucaa

SEQ ID NO: 395612 - RNA, 14 nt, Homo sapiens
caggcgaugugcaa

SEQ ID NO: 395613 - RNA, 15 nt, Homo sapiens
caggcgaugugcaag

SEQ ID NO: 395614 - RNA, 16 nt, Homo sapiens
caggcgugguggcaca

SEQ ID NO: 395615 - RNA, 16 nt, Homo sapiens
caggcuggagugcagu

SEQ ID NO: 395616 - RNA, 17 nt, Homo sapiens
caggcuggagugcagua

SEQ ID NO: 395617 - RNA, 20 nt, Homo sapiens
cagggaaaucaggguuacaa

SEQ ID NO: 395618 - RNA, 13 nt, Homo sapiens
cagggaagccaaa

SEQ ID NO: 395619 - RNA, 17 nt, Homo sapiens
cagggaagugcucugau

SEQ ID NO: 395620 - RNA, 12 nt, Homo sapiens
cagggacuugaa

SEQ ID NO: 395621 - RNA, 13 nt, Homo sapiens
cagggacuugaac

SEQ ID NO: 395622 - RNA, 15 nt, Homo sapiens
cagggacuugaaguu

SEQ ID NO: 395623 - RNA, 16 nt, Homo sapiens
cagggcacugcugcug

SEQ ID NO: 395624 - RNA, 17 nt, Homo sapiens
cagggcaugccccggcc

SEQ ID NO: 395625 - RNA, 17 nt, Homo sapiens
cagggccaggacugagc

SEQ ID NO: 395626 - RNA, 13 nt, Homo sapiens
cagggcgugggac

SEQ ID NO: 395627 - RNA, 13 nt, Homo sapiens
cagggcuagugac

SEQ ID NO: 395628 - RNA, 12 nt, Homo sapiens
cagggcugugau

SEQ ID NO: 395629 - RNA, 15 nt, Homo sapiens
cagggcuguguguac

SEQ ID NO: 395630 - RNA, 14 nt, Homo sapiens
caggggcucuggag

SEQ ID NO: 395631 - RNA, 21 nt, Homo sapiens
caggguuacaaaucuucuuga

SEQ ID NO: 395632 - RNA, 21 nt, Homo sapiens
caggucucacgggcaugggca

SEQ ID NO: 395633 - RNA, 22 nt, Homo sapiens
caggugauccacccaccuuggc

SEQ ID NO: 395634 - RNA, 22 nt, Homo sapiens
caggugggaggugucagagccc

SEQ ID NO: 395635 - RNA, 17 nt, Homo sapiens
cagguuccaucccgaaa

SEQ ID NO: 395636 - RNA, 17 nt, Homo sapiens
caguauucuugucaaaa

SEQ ID NO: 395637 - RNA, 22 nt, Homo sapiens
caguauuuuccaaacuaccuuc

SEQ ID NO: 395638 - RNA, 19 nt, Homo sapiens
cagucaaggaguggcuuac

SEQ ID NO: 395639 - RNA, 15 nt, Homo sapiens
cagucaaggauggau

SEQ ID NO: 395640 - RNA, 18 nt, Homo sapiens
cagucaaggauggaugca

SEQ ID NO: 395641 - RNA, 19 nt, Homo sapiens
cagucaaugaggaagauuu

SEQ ID NO: 395642 - RNA, 20 nt, Homo sapiens
cagucagaguugugcacaug

SEQ ID NO: 395643 - RNA, 11 nt, Homo sapiens
cagucagggac

SEQ ID NO: 395644 - RNA, 13 nt, Homo sapiens
caguccaaucuca

SEQ ID NO: 395645 - RNA, 22 nt, Homo sapiens
caguccaggaugcuaacaucua

SEQ ID NO: 395646 - RNA, 20 nt, Homo sapiens
cagugaaggcuguccuuacc

SEQ ID NO: 395647 - RNA, 14 nt, Homo sapiens
cagugagccaagau

SEQ ID NO: 395648 - RNA, 19 nt, Homo sapiens
cagugagccgagauugugc

SEQ ID NO: 395649 - RNA, 22 nt, Homo sapiens
cagugccagcaaugacaucuca

SEQ ID NO: 395650 - RNA, 15 nt, Homo sapiens
cagugcuguacuuga

SEQ ID NO: 395651 - RNA, 17 nt, Homo sapiens
cagugcuguacuugaug

SEQ ID NO: 395652 - RNA, 17 nt, Homo sapiens
caguggauugcauuucu

SEQ ID NO: 395653 - RNA, 21 nt, Homo sapiens
cagugggugccccccuugcca

SEQ ID NO: 395654 - RNA, 18 nt, Homo sapiens
caguguccccuccacugu

SEQ ID NO: 395655 - RNA, 21 nt, Homo sapiens
caguguccccuccacugucac

SEQ ID NO: 395656 - RNA, 22 nt, Homo sapiens
caguguggcccagggaagccaa

SEQ ID NO: 395657 - RNA, 22 nt, Homo sapiens
caguuacagagugaacacucua

SEQ ID NO: 395658 - RNA, 16 nt, Homo sapiens
caguuagguagcuuua

SEQ ID NO: 395659 - RNA, 12 nt, Homo sapiens
caguuccaauga

SEQ ID NO: 395660 - RNA, 16 nt, Homo sapiens
caguuuucuugcagau

SEQ ID NO: 395661 - RNA, 17 nt, Homo sapiens
cauaaacuucaugguca

SEQ ID NO: 395662 - RNA, 21 nt, Homo sapiens
cauaaagucuuugaagugacu

SEQ ID NO: 395663 - RNA, 22 nt, Homo sapiens
cauaaauuagaggucuccaaaa

SEQ ID NO: 395664 - RNA, 16 nt, Homo sapiens
cauaacaugcuuuaga

SEQ ID NO: 395665 - RNA, 16 nt, Homo sapiens
cauaagaaaacuaaga

SEQ ID NO: 395666 - RNA, 15 nt, Homo sapiens
cauaagaaaagauua

SEQ ID NO: 395667 - RNA, 19 nt, Homo sapiens
cauaagucuaaauaaauga

SEQ ID NO: 395668 - RNA, 16 nt, Homo sapiens
cauaauguuacauuau

SEQ ID NO: 395669 - RNA, 23 nt, Homo sapiens
cauaauuucuucacucaaucucu

SEQ ID NO: 395670 - RNA, 19 nt, Homo sapiens
cauaauuuguacauaugua

SEQ ID NO: 395671 - RNA, 22 nt, Homo sapiens
cauaccaaugaaaaaauguaua

SEQ ID NO: 395672 - RNA, 21 nt, Homo sapiens
cauacugaagaugcagcaaaa

SEQ ID NO: 395673 - RNA, 16 nt, Homo sapiens
cauacuucuucauuca

SEQ ID NO: 395674 - RNA, 15 nt, Homo sapiens
cauagaggugaggga

SEQ ID NO: 395675 - RNA, 23 nt, Homo sapiens
cauagaggugagggaagccugaa

SEQ ID NO: 395676 - RNA, 17 nt, Homo sapiens
cauagcaagauugcuua

SEQ ID NO: 395677 - RNA, 16 nt, Homo sapiens
cauagcagcagugcau

SEQ ID NO: 395678 - RNA, 19 nt, Homo sapiens
cauauaauguuguuauuua

SEQ ID NO: 395679 - RNA, 18 nt, Homo sapiens
cauauccaacaugugcuc

SEQ ID NO: 395680 - RNA, 22 nt, Homo sapiens
cauaugaccucaugcaucucca

SEQ ID NO: 395681 - RNA, 16 nt, Homo sapiens
cauaugauugugcaca

SEQ ID NO: 395682 - RNA, 13 nt, Homo sapiens
cauauuuacuucu

SEQ ID NO: 395683 - RNA, 21 nt, Homo sapiens
caucagacuccugugcaacuu

SEQ ID NO: 395684 - RNA, 15 nt, Homo sapiens
caucagcauaccuuu

SEQ ID NO: 395685 - RNA, 15 nt, Homo sapiens
caucagggacaggau

SEQ ID NO: 395686 - RNA, 19 nt, Homo sapiens
cauccaaugcucaagaaac

SEQ ID NO: 395687 - RNA, 21 nt, Homo sapiens
cauccauuuauuuggcaucug

SEQ ID NO: 395688 - RNA, 17 nt, Homo sapiens
cauccccuggacuggga

SEQ ID NO: 395689 - RNA, 18 nt, Homo sapiens
caucccucguggucccca

SEQ ID NO: 395690 - RNA, 15 nt, Homo sapiens
cauccggcagccugg

SEQ ID NO: 395691 - RNA, 22 nt, Homo sapiens
cauccugagcagugccagcuuu

SEQ ID NO: 395692 - RNA, 14 nt, Homo sapiens
caucucaggggcca

SEQ ID NO: 395693 - RNA, 21 nt, Homo sapiens
caucucccagauaaugugaaa

SEQ ID NO: 395694 - RNA, 13 nt, Homo sapiens
caucucuacuaaa

SEQ ID NO: 395695 - RNA, 14 nt, Homo sapiens
caucucuuguauau

SEQ ID NO: 395696 - RNA, 12 nt, Homo sapiens
caucucuuugau

SEQ ID NO: 395697 - RNA, 19 nt, Homo sapiens
caucugagcccagagauaa

SEQ ID NO: 395698 - RNA, 23 nt, Homo sapiens
caucugggaaaauaccccaucau

SEQ ID NO: 395699 - RNA, 20 nt, Homo sapiens
caucuucuaggccaagcauu

SEQ ID NO: 395700 - RNA, 23 nt, Homo sapiens
caucuuggucagauuugaacucu

SEQ ID NO: 395701 - RNA, 23 nt, Homo sapiens
caucuuuccuucggguuggcaaa

SEQ ID NO: 395702 - RNA, 21 nt, Homo sapiens
caucuuucuucuauuuuauuc

SEQ ID NO: 395703 - RNA, 13 nt, Homo sapiens
caugaauaugauu

SEQ ID NO: 395704 - RNA, 17 nt, Homo sapiens
caugaauccaguccaga

SEQ ID NO: 395705 - RNA, 14 nt, Homo sapiens
caugaauucuguca

SEQ ID NO: 395706 - RNA, 19 nt, Homo sapiens
caugacucagcauaccugc

SEQ ID NO: 395707 - RNA, 19 nt, Homo sapiens
caugagaucuaggugagga

SEQ ID NO: 395708 - RNA, 14 nt, Homo sapiens
caugaucaucacaa

SEQ ID NO: 395709 - RNA, 18 nt, Homo sapiens
caugaucaucacaaucau

SEQ ID NO: 395710 - RNA, 22 nt, Homo sapiens
caugauuuuuuuuuuucagucc

SEQ ID NO: 395711 - RNA, 23 nt, Homo sapiens
caugcccuggauccaucaggcca

SEQ ID NO: 395712 - RNA, 13 nt, Homo sapiens
caugcccuguuca

SEQ ID NO: 395713 - RNA, 15 nt, Homo sapiens
caugccucagugaag

SEQ ID NO: 395714 - RNA, 17 nt, Homo sapiens
caugcguuuaaucacau

SEQ ID NO: 395715 - RNA, 12 nt, Homo sapiens
caugcuggugaa

SEQ ID NO: 395716 - RNA, 13 nt, Homo sapiens
cauggacacucca

SEQ ID NO: 395717 - RNA, 16 nt, Homo sapiens
cauggagcaugggacu

SEQ ID NO: 395718 - RNA, 16 nt, Homo sapiens
cauggaggcaugccaa

SEQ ID NO: 395719 - RNA, 21 nt, Homo sapiens
cauggcagaaggcaaacccau

SEQ ID NO: 395720 - RNA, 21 nt, Homo sapiens
caugggaaggguccaucucag

SEQ ID NO: 395721 - RNA, 16 nt, Homo sapiens
ugcguuuccugugcau

SEQ ID NO: 395722 - RNA, 21 nt, Homo sapiens
ugcuaaucagggaggucauuu

SEQ ID NO: 395723 - RNA, 22 nt, Homo sapiens
ugcuaauccucuuuuucuaguc

SEQ ID NO: 395724 - RNA, 15 nt, Homo sapiens
ugcuaaucuucaggg

SEQ ID NO: 395725 - RNA, 15 nt, Homo sapiens
ugcuaauucaaagcu

SEQ ID NO: 395726 - RNA, 20 nt, Homo sapiens
ugcuacaaauacucuuagga

SEQ ID NO: 395727 - RNA, 20 nt, Homo sapiens
ugcuagaugugcaaaugcaa

SEQ ID NO: 395728 - RNA, 16 nt, Homo sapiens
ugcuagcugcaaguga

SEQ ID NO: 395729 - RNA, 21 nt, Homo sapiens
ugcuauaacuauguugauaaa

SEQ ID NO: 395730 - RNA, 14 nt, Homo sapiens
ugcucugugcagac

SEQ ID NO: 395731 - RNA, 17 nt, Homo sapiens
ugcucuuaaguugugga

SEQ ID NO: 395732 - RNA, 15 nt, Homo sapiens
ugcugaaacaacaaa

SEQ ID NO: 395733 - RNA, 13 nt, Homo sapiens
ugcugaacagugg

SEQ ID NO: 395734 - RNA, 11 nt, Homo sapiens
ugcugacaaag

SEQ ID NO: 395735 - RNA, 17 nt, Homo sapiens
ugcugaggcucugaccc

SEQ ID NO: 395736 - RNA, 23 nt, Homo sapiens
ugcugcugagugcaccacuucaa

SEQ ID NO: 395737 - RNA, 14 nt, Homo sapiens
ugcuggcauuugca

SEQ ID NO: 395738 - RNA, 18 nt, Homo sapiens
ugcugggcucuccaccuc

SEQ ID NO: 395739 - RNA, 18 nt, Homo sapiens
ugcuggggaucuagggaa

SEQ ID NO: 395740 - RNA, 16 nt, Homo sapiens
ugcuguacuugaugac

SEQ ID NO: 395741 - RNA, 20 nt, Homo sapiens
ugcuuacaauucccugcugu

SEQ ID NO: 395742 - RNA, 12 nt, Homo sapiens
ugcuuacauuuu

SEQ ID NO: 395743 - RNA, 13 nt, Homo sapiens
ugcuuacuuugca

SEQ ID NO: 395744 - RNA, 21 nt, Homo sapiens
ugcuuaugaaagaaagcuuua

SEQ ID NO: 395745 - RNA, 13 nt, Homo sapiens
ugcuucuccauga

SEQ ID NO: 395746 - RNA, 16 nt, Homo sapiens
ugcuugagcucaggag

SEQ ID NO: 395747 - RNA, 12 nt, Homo sapiens
ugcuugugccac

SEQ ID NO: 395748 - RNA, 19 nt, Homo sapiens
ugcuugugccacacccucc

SEQ ID NO: 395749 - RNA, 12 nt, Homo sapiens
ugcuuguucccu

SEQ ID NO: 395750 - RNA, 16 nt, Homo sapiens
ugcuuuagaaguaaca

SEQ ID NO: 395751 - RNA, 12 nt, Homo sapiens
ugcuuucuuggc

SEQ ID NO: 395752 - RNA, 19 nt, Homo sapiens
uggaaaacaguauuuucca

SEQ ID NO: 395753 - RNA, 14 nt, Homo sapiens
uggaaaauaaauca

SEQ ID NO: 395754 - RNA, 18 nt, Homo sapiens
uggaaacuguugccagag

SEQ ID NO: 395755 - RNA, 17 nt, Homo sapiens
uggaaagaaucuaauag

SEQ ID NO: 395756 - RNA, 23 nt, Homo sapiens
uggaaccaacacuaacauauaau

SEQ ID NO: 395757 - RNA, 22 nt, Homo sapiens
uggaagggaaaagcccaugauc

SEQ ID NO: 395758 - RNA, 12 nt, Homo sapiens
uggaagggucaa

SEQ ID NO: 395759 - RNA, 15 nt, Homo sapiens
uggaagugugugauc

SEQ ID NO: 395760 - RNA, 15 nt, Homo sapiens
uggaauaacucugug

SEQ ID NO: 395761 - RNA, 19 nt, Homo sapiens
uggacaccccugcuauaua

SEQ ID NO: 395762 - RNA, 22 nt, Homo sapiens
uggaccaggaagcccugaaucc

SEQ ID NO: 395763 - RNA, 17 nt, Homo sapiens
uggaccugcaccaaagc

SEQ ID NO: 395764 - RNA, 21 nt, Homo sapiens
uggaccugcccugggccacac

SEQ ID NO: 395765 - RNA, 21 nt, Homo sapiens
uggacuauggcucuacuuuca

SEQ ID NO: 395766 - RNA, 16 nt, Homo sapiens
uggacucaguuuucuu

SEQ ID NO: 395767 - RNA, 20 nt, Homo sapiens
uggagaacgagaccugugug

SEQ ID NO: 395768 - RNA, 17 nt, Homo sapiens
uggagccccagugccaa

SEQ ID NO: 395769 - RNA, 22 nt, Homo sapiens
uggagccccagugccaagcaca

SEQ ID NO: 395770 - RNA, 18 nt, Homo sapiens
uggaggcugucuucucag

SEQ ID NO: 395771 - RNA, 23 nt, Homo sapiens
uggaggucaggaguuugagacca

SEQ ID NO: 395772 - RNA, 20 nt, Homo sapiens
uggagguugcagugagccaa

SEQ ID NO: 395773 - RNA, 19 nt, Homo sapiens
uggauaaaauaaaugcaau

SEQ ID NO: 395774 - RNA, 14 nt, Homo sapiens
uggauaaguagaau

SEQ ID NO: 395775 - RNA, 19 nt, Homo sapiens
uggaucuccauucucucag

SEQ ID NO: 395776 - RNA, 13 nt, Homo sapiens
uggauucagaaua

SEQ ID NO: 395777 - RNA, 22 nt, Homo sapiens
uggauugugggaauuaaggaag

SEQ ID NO: 395778 - RNA, 12 nt, Homo sapiens
uggcaagagccc

SEQ ID NO: 395779 - RNA, 19 nt, Homo sapiens
uggcaauuucacugaugua

SEQ ID NO: 395780 - RNA, 19 nt, Homo sapiens
uggcacacaccuguagucc

SEQ ID NO: 395781 - RNA, 17 nt, Homo sapiens
uggcagccgugccuuca

SEQ ID NO: 395782 - RNA, 15 nt, Homo sapiens
uggcaugccuuccag

SEQ ID NO: 395783 - RNA, 17 nt, Homo sapiens
uggcaugccuuccagca

SEQ ID NO: 395784 - RNA, 16 nt, Homo sapiens
uggcccacgcacuucg

SEQ ID NO: 395785 - RNA, 13 nt, Homo sapiens
uggcccagccaaa

SEQ ID NO: 395786 - RNA, 21 nt, Homo sapiens
uggccgaaaaggauaugcagu

SEQ ID NO: 395787 - RNA, 16 nt, Homo sapiens
uggccucuggcucuca

SEQ ID NO: 395788 - RNA, 23 nt, Homo sapiens
uggccugcugggcucuccaccuc

SEQ ID NO: 395789 - RNA, 17 nt, Homo sapiens
uggccuugaaaccaccu

SEQ ID NO: 395790 - RNA, 17 nt, Homo sapiens
uggcuacacacaaacca

SEQ ID NO: 395791 - RNA, 15 nt, Homo sapiens
uggcuauaaauauau

SEQ ID NO: 395792 - RNA, 14 nt, Homo sapiens
uggcucugaccgaa

SEQ ID NO: 395793 - RNA, 11 nt, Homo sapiens
uggcugugagg

SEQ ID NO: 395794 - RNA, 12 nt, Homo sapiens
uggcuuacuucc

SEQ ID NO: 395795 - RNA, 21 nt, Homo sapiens
uggcuucacagaugugugauu

SEQ ID NO: 395796 - RNA, 22 nt, Homo sapiens
ugggaaaaauucagagaguuag

SEQ ID NO: 395797 - RNA, 18 nt, Homo sapiens
ugggaacuagacucccaa

SEQ ID NO: 395798 - RNA, 17 nt, Homo sapiens
ugggaacuccuaaauca

SEQ ID NO: 395799 - RNA, 15 nt, Homo sapiens
ugggaacugcaauaa

SEQ ID NO: 395800 - RNA, 15 nt, Homo sapiens
ugggaacugugccuu

SEQ ID NO: 395801 - RNA, 18 nt, Homo sapiens
ugggaagaccagcuuugc

SEQ ID NO: 395802 - RNA, 22 nt, Homo sapiens
ugggaccaacuuccuguugaug

SEQ ID NO: 395803 - RNA, 12 nt, Homo sapiens
ugggaccacaga

SEQ ID NO: 395804 - RNA, 13 nt, Homo sapiens
ugggaccacagac

SEQ ID NO: 395805 - RNA, 14 nt, Homo sapiens
ugggacugcugcuu

SEQ ID NO: 395806 - RNA, 15 nt, Homo sapiens
ugggacugcugcuuc

SEQ ID NO: 395807 - RNA, 19 nt, Homo sapiens
ugggacugcugcuucuuaa

SEQ ID NO: 395808 - RNA, 14 nt, Homo sapiens
ugggagacuuugaa

SEQ ID NO: 395809 - RNA, 16 nt, Homo sapiens
ugggaggccaaggugg

SEQ ID NO: 395810 - RNA, 18 nt, Homo sapiens
ugggagguugugggcauu

SEQ ID NO: 395811 - RNA, 14 nt, Homo sapiens
ugggagucaucuca

SEQ ID NO: 395812 - RNA, 23 nt, Homo sapiens
ugggaucacgaggaaaagagaag

SEQ ID NO: 395813 - RNA, 16 nt, Homo sapiens
ugggaucugugcccag

SEQ ID NO: 395814 - RNA, 14 nt, Homo sapiens
ugggaugaugccuc

SEQ ID NO: 395815 - RNA, 17 nt, Homo sapiens
ugggauguucagcacug

SEQ ID NO: 395816 - RNA, 14 nt, Homo sapiens
ugggcaaugugaua

SEQ ID NO: 395817 - RNA, 22 nt, Homo sapiens
ugggcacucccuugguggcaag

SEQ ID NO: 395818 - RNA, 14 nt, Homo sapiens
ugggcagagcccaa

SEQ ID NO: 395819 - RNA, 15 nt, Homo sapiens
uggggaaguguucca

SEQ ID NO: 395820 - RNA, 20 nt, Homo sapiens
uggggaaguguuccagauag

SEQ ID NO: 395821 - RNA, 18 nt, Homo sapiens
uggggauggagaagacaa

SEQ ID NO: 395822 - RNA, 19 nt, Homo sapiens
uggggaugguccacuguca

SEQ ID NO: 395823 - RNA, 20 nt, Homo sapiens
uggggcaggcagugaugcug

SEQ ID NO: 395824 - RNA, 22 nt, Homo sapiens
ugggggaucacagccucugaaa

SEQ ID NO: 395825 - RNA, 16 nt, Homo sapiens
ugggggcugugauauu

SEQ ID NO: 395826 - RNA, 19 nt, Homo sapiens
uggguacuauucugauuac

SEQ ID NO: 395827 - RNA, 20 nt, Homo sapiens
ugggugaauaauacaguauc

SEQ ID NO: 395828 - RNA, 12 nt, Homo sapiens
ugggugggacca

SEQ ID NO: 395829 - RNA, 21 nt, Homo sapiens
uggguggggcugcuccuccag

SEQ ID NO: 395830 - RNA, 18 nt, Homo sapiens
ugggugucagucagggac

SEQ ID NO: 395831 - RNA, 14 nt, Homo sapiens
ugguaaaugaucac

SEQ ID NO: 395832 - RNA, 14 nt, Homo sapiens
ugguacagcacugu

SEQ ID NO: 395833 - RNA, 15 nt, Homo sapiens
ugguagaaaggcagu

SEQ ID NO: 395834 - RNA, 19 nt, Homo sapiens
ugguagaaaggcaguucag

SEQ ID NO: 395835 - RNA, 20 nt, Homo sapiens
uggucaauccgaaguaugag

SEQ ID NO: 395836 - RNA, 22 nt, Homo sapiens
uggucugcaggcagggcugacu

SEQ ID NO: 395837 - RNA, 14 nt, Homo sapiens
uggugccaaacaaa

SEQ ID NO: 395838 - RNA, 21 nt, Homo sapiens
uggugccucucucuugcuuac

SEQ ID NO: 395839 - RNA, 20 nt, Homo sapiens
ugguggagagaagugagaau

SEQ ID NO: 395840 - RNA, 14 nt, Homo sapiens
ugguuaacaucuca

SEQ ID NO: 395841 - RNA, 20 nt, Homo sapiens
ugguuaauaaguuucacuga

SEQ ID NO: 395842 - RNA, 19 nt, Homo sapiens
ugguucccccacugaucac

SEQ ID NO: 395843 - RNA, 23 nt, Homo sapiens
ugguuccggaauccuguccucag

SEQ ID NO: 395844 - RNA, 14 nt, Homo sapiens
ugguugacauugua

SEQ ID NO: 395845 - RNA, 15 nt, Homo sapiens
ugguuuaugucauca

SEQ ID NO: 395846 - RNA, 17 nt, Homo sapiens
ugguuuuauaaucugau

SEQ ID NO: 395847 - RNA, 19 nt, Homo sapiens
uguaaacacgccugcaaac

SEQ ID NO: 395848 - RNA, 13 nt, Homo sapiens
uguaaaugugcuu

SEQ ID NO: 395849 - RNA, 19 nt, Homo sapiens
uguaacaugcaauuuugca

SEQ ID NO: 395850 - RNA, 17 nt, Homo sapiens
uguaagguggucacugu

SEQ ID NO: 395851 - RNA, 18 nt, Homo sapiens
uguaagguggucacuguu

SEQ ID NO: 395852 - RNA, 17 nt, Homo sapiens
uguaauaaaacauguuc

SEQ ID NO: 395853 - RNA, 19 nt, Homo sapiens
uguaaucacagcuacuugg

SEQ ID NO: 395854 - RNA, 19 nt, Homo sapiens
uguaaucccagcacuuugg

SEQ ID NO: 395855 - RNA, 19 nt, Homo sapiens
uguacaaaaguuucauccu

SEQ ID NO: 395856 - RNA, 20 nt, Homo sapiens
uguacaacuuuuuaccuagu

SEQ ID NO: 395857 - RNA, 20 nt, Homo sapiens
uguacacagaaauacaguua

SEQ ID NO: 395858 - RNA, 16 nt, Homo sapiens
uguacaccaauauuca

SEQ ID NO: 395859 - RNA, 19 nt, Homo sapiens
uguacagugaaaagucucc

SEQ ID NO: 395860 - RNA, 20 nt, Homo sapiens
uguagagauggggucucaca

SEQ ID NO: 395861 - RNA, 20 nt, Homo sapiens
uguagccucgccgucuguga

SEQ ID NO: 395862 - RNA, 15 nt, Homo sapiens
uguagguaauauugu

SEQ ID NO: 395863 - RNA, 21 nt, Homo sapiens
uguauauuuuauaucaauuua

SEQ ID NO: 395864 - RNA, 16 nt, Homo sapiens
uguaucaaaugugaca

SEQ ID NO: 395865 - RNA, 18 nt, Homo sapiens
uguaucauuaugaaguca

SEQ ID NO: 395866 - RNA, 15 nt, Homo sapiens
uguaugcacgugugc

SEQ ID NO: 395867 - RNA, 20 nt, Homo sapiens
uguaugugcgugugugcaag

SEQ ID NO: 395868 - RNA, 17 nt, Homo sapiens
uguauguuccucuauga

SEQ ID NO: 395869 - RNA, 23 nt, Homo sapiens
uguauguuuacauaucaccucau

SEQ ID NO: 395870 - RNA, 23 nt, Homo sapiens
uguauuaauguguuaagugcagg

SEQ ID NO: 395871 - RNA, 19 nt, Homo sapiens
uguauucuagcuaauguaa

SEQ ID NO: 395872 - RNA, 22 nt, Homo sapiens
ugucacuacgugacuguggcac

SEQ ID NO: 395873 - RNA, 19 nt, Homo sapiens
ugucacucaccacuacauc

SEQ ID NO: 395874 - RNA, 16 nt, Homo sapiens
ugucagucagggacaa

SEQ ID NO: 395875 - RNA, 17 nt, Homo sapiens
ugucauauaagauucau

SEQ ID NO: 395876 - RNA, 16 nt, Homo sapiens
ugucaucauacaugac

SEQ ID NO: 395877 - RNA, 15 nt, Homo sapiens
ugucccaaguuccac

SEQ ID NO: 395878 - RNA, 19 nt, Homo sapiens
uguccggucccugucccag

SEQ ID NO: 395879 - RNA, 13 nt, Homo sapiens
uguccugggguau

SEQ ID NO: 395880 - RNA, 21 nt, Homo sapiens
uguccuguacauugugggaug

SEQ ID NO: 395881 - RNA, 17 nt, Homo sapiens
ugucuaaaaucccuccu

SEQ ID NO: 395882 - RNA, 22 nt, Homo sapiens
ugucucuguuuuguaagcuuua

SEQ ID NO: 395883 - RNA, 14 nt, Homo sapiens
ugucugacaaccuc

SEQ ID NO: 395884 - RNA, 15 nt, Homo sapiens
ugucugugugcaagu

SEQ ID NO: 395885 - RNA, 15 nt, Homo sapiens
ugucuuguucaccuu

SEQ ID NO: 395886 - RNA, 15 nt, Homo sapiens
ugugaacacaucagc

SEQ ID NO: 395887 - RNA, 17 nt, Homo sapiens
ugugaauguggauucuu

SEQ ID NO: 395888 - RNA, 22 nt, Homo sapiens
ugugacauuauaugcacuagca

SEQ ID NO: 395889 - RNA, 21 nt, Homo sapiens
ugugaccaaugucuugaugca

SEQ ID NO: 395890 - RNA, 15 nt, Homo sapiens
ugugacuggcaguau

SEQ ID NO: 395891 - RNA, 22 nt, Homo sapiens
ugugacuugaacuagauugcau

SEQ ID NO: 395892 - RNA, 15 nt, Homo sapiens
ugugagugugugcaa

SEQ ID NO: 395893 - RNA, 19 nt, Homo sapiens
ugugagugugugcaaguau

SEQ ID NO: 395894 - RNA, 20 nt, Homo sapiens
ugugauauauaaguguacau

SEQ ID NO: 395895 - RNA, 16 nt, Homo sapiens
ugugauuucaauguag

SEQ ID NO: 395896 - RNA, 20 nt, Homo sapiens
ugugcaaguguguaugugcg

SEQ ID NO: 395897 - RNA, 18 nt, Homo sapiens
ugugcacacacaccacac

SEQ ID NO: 395898 - RNA, 18 nt, Homo sapiens
ugugcagacacaugugcc

SEQ ID NO: 395899 - RNA, 13 nt, Homo sapiens
ugugcccagagau

SEQ ID NO: 395900 - RNA, 17 nt, Homo sapiens
ugugccugaagucccag

SEQ ID NO: 395901 - RNA, 23 nt, Homo sapiens
ugugccugugguuaacaucucag

SEQ ID NO: 395902 - RNA, 20 nt, Homo sapiens
uguggaugagcccucagaac

SEQ ID NO: 395903 - RNA, 21 nt, Homo sapiens
uguggauucuucccacacaga

SEQ ID NO: 395904 - RNA, 16 nt, Homo sapiens
uguggccccaacacaa

SEQ ID NO: 395905 - RNA, 22 nt, Homo sapiens
ugugggugggaccacagacuca

SEQ ID NO: 395906 - RNA, 16 nt, Homo sapiens
ugugggugucagucag

SEQ ID NO: 395907 - RNA, 20 nt, Homo sapiens
uguggucaauccgaaguaug

SEQ ID NO: 395908 - RNA, 16 nt, Homo sapiens
ugugguuacaguuuga

SEQ ID NO: 395909 - RNA, 13 nt, Homo sapiens
uguguaugugcgu

SEQ ID NO: 395910 - RNA, 17 nt, Homo sapiens
uguguauuuaacugccu

SEQ ID NO: 395911 - RNA, 21 nt, Homo sapiens
ugugucaaacaguacacuauc

SEQ ID NO: 395912 - RNA, 20 nt, Homo sapiens
uguguccaugugugugcaag

SEQ ID NO: 395913 - RNA, 17 nt, Homo sapiens
ugugugagaauaaacua

SEQ ID NO: 395914 - RNA, 17 nt, Homo sapiens
ugugugagugugugcaa

SEQ ID NO: 395915 - RNA, 13 nt, Homo sapiens
ugugugcaagugu

SEQ ID NO: 395916 - RNA, 17 nt, Homo sapiens
ugugugcaagugugugc

SEQ ID NO: 395917 - RNA, 22 nt, Homo sapiens
uguguguauauaguaugaaugc

SEQ ID NO: 395918 - RNA, 14 nt, Homo sapiens
ugugugugugcaag

SEQ ID NO: 395919 - RNA, 14 nt, Homo sapiens
uguguuuccuucag

SEQ ID NO: 395920 - RNA, 14 nt, Homo sapiens
uguuaaagcuauuu

SEQ ID NO: 395921 - RNA, 18 nt, Homo sapiens
uguuaacauggacaugau

SEQ ID NO: 395922 - RNA, 13 nt, Homo sapiens
uguuaaguugaug

SEQ ID NO: 395923 - RNA, 18 nt, Homo sapiens
uguuaauucagcacugau

SEQ ID NO: 395924 - RNA, 23 nt, Homo sapiens
uguuaccugaaaacacugugcac

SEQ ID NO: 395925 - RNA, 20 nt, Homo sapiens
uguuaucagucauaacuaaa

SEQ ID NO: 395926 - RNA, 18 nt, Homo sapiens
uguuauggaaacuguugc

SEQ ID NO: 395927 - RNA, 18 nt, Homo sapiens
uguucagaauggauuuau

SEQ ID NO: 395928 - RNA, 16 nt, Homo sapiens
uguucagggcugugau

SEQ ID NO: 395929 - RNA, 18 nt, Homo sapiens
uguuccaccuucccucau

SEQ ID NO: 395930 - RNA, 22 nt, Homo sapiens
uguuccagauccuucaaagagu

SEQ ID NO: 395931 - RNA, 14 nt, Homo sapiens
uguuccccacugac

SEQ ID NO: 395932 - RNA, 13 nt, Homo sapiens
uguugaacaauag

SEQ ID NO: 395933 - RNA, 13 nt, Homo sapiens
uguugccagagau

SEQ ID NO: 395934 - RNA, 17 nt, Homo sapiens
uguuggcaaaucagaug

SEQ ID NO: 395935 - RNA, 21 nt, Homo sapiens
uguuguugagaauugugcuca

SEQ ID NO: 395936 - RNA, 21 nt, Homo sapiens
uguuuaaaaucauuucugcau

SEQ ID NO: 395937 - RNA, 19 nt, Homo sapiens
uguuuaagaaaaaauaaca

SEQ ID NO: 395938 - RNA, 14 nt, Homo sapiens
uguuucugaucuga

SEQ ID NO: 395939 - RNA, 21 nt, Homo sapiens
uguuuggguauauucauuuca

SEQ ID NO: 395940 - RNA, 17 nt, Homo sapiens
uguuuuagcuccuugac

SEQ ID NO: 395941 - RNA, 14 nt, Homo sapiens
uguuuucucuugag

SEQ ID NO: 395942 - RNA, 20 nt, Homo sapiens
uguuuuuguucaaagccagc

SEQ ID NO: 395943 - RNA, 23 nt, Homo sapiens
uuaaaaaaaacaaaaagaacaaa

SEQ ID NO: 395944 - RNA, 17 nt, Homo sapiens
uuaaaaagucuucacuc

SEQ ID NO: 395945 - RNA, 21 nt, Homo sapiens
uuaaaaauuguuaauuuuucc

SEQ ID NO: 395946 - RNA, 22 nt, Homo sapiens
uuaaaacccacaaaaguacaau

SEQ ID NO: 395947 - RNA, 12 nt, Homo sapiens
uuaaaaugauug

SEQ ID NO: 395948 - RNA, 13 nt, Homo sapiens
uuaaacagcagau

SEQ ID NO: 395949 - RNA, 12 nt, Homo sapiens
uuaaacucaggg

SEQ ID NO: 395950 - RNA, 14 nt, Homo sapiens
uuaaacucagggac

SEQ ID NO: 395951 - RNA, 16 nt, Homo sapiens
uuaaacucagggacag

SEQ ID NO: 395952 - RNA, 21 nt, Homo sapiens
uuaaacucagggacagagcca

SEQ ID NO: 395953 - RNA, 20 nt, Homo sapiens
uuaaagaaagucgaauuaau

SEQ ID NO: 395954 - RNA, 17 nt, Homo sapiens
uuaaaggaauaaggugu

SEQ ID NO: 395955 - RNA, 19 nt, Homo sapiens
uuaaaguaaugagcaugau

SEQ ID NO: 395956 - RNA, 17 nt, Homo sapiens
uuaaauaaaucauaaaa

SEQ ID NO: 395957 - RNA, 23 nt, Homo sapiens
uuaaauaaaucauaaaacuugau

SEQ ID NO: 395958 - RNA, 17 nt, Homo sapiens
uuaaauacagucuucca

SEQ ID NO: 395959 - RNA, 21 nt, Homo sapiens
uuaaaucaacgaguacuucaa

SEQ ID NO: 395960 - RNA, 24 nt, Homo sapiens
uuaaaucagccguguaaccaugga

SEQ ID NO: 395961 - RNA, 15 nt, Homo sapiens
uuaaauuucaucuca

SEQ ID NO: 395962 - RNA, 13 nt, Homo sapiens
uuaacauaagaaa

SEQ ID NO: 395963 - RNA, 11 nt, Homo sapiens
uuaacaucuca

SEQ ID NO: 395964 - RNA, 13 nt, Homo sapiens
uuaacaucucaga

SEQ ID NO: 395965 - RNA, 18 nt, Homo sapiens
uuaacauggacaugaucu

SEQ ID NO: 395966 - RNA, 21 nt, Homo sapiens
uuaacuuccaauuuacauacu

SEQ ID NO: 395967 - RNA, 13 nt, Homo sapiens
uuaagugugcuua

SEQ ID NO: 395968 - RNA, 22 nt, Homo sapiens
uuaauaaaccauuuuuacuugg

SEQ ID NO: 395969 - RNA, 16 nt, Homo sapiens
uuaauacacacaguua

SEQ ID NO: 395970 - RNA, 20 nt, Homo sapiens
uuaauacagggcauuuuggu

SEQ ID NO: 395971 - RNA, 14 nt, Homo sapiens
uuaauauaacugcc

SEQ ID NO: 395972 - RNA, 19 nt, Homo sapiens
uuaauaucccuacauguau

SEQ ID NO: 395973 - RNA, 15 nt, Homo sapiens
uuaaucccacuugcc

SEQ ID NO: 395974 - RNA, 20 nt, Homo sapiens
uuaaugaacaugugaaguua

SEQ ID NO: 395975 - RNA, 22 nt, Homo sapiens
uuaaugcagagcuagaggacuu

SEQ ID NO: 395976 - RNA, 12 nt, Homo sapiens
uuacaagccuaa

SEQ ID NO: 395977 - RNA, 19 nt, Homo sapiens
uuacacaguugcugucaua

SEQ ID NO: 395978 - RNA, 16 nt, Homo sapiens
uuacaguuugagacuu

SEQ ID NO: 395979 - RNA, 14 nt, Homo sapiens
uuacauaucaccuc

SEQ ID NO: 395980 - RNA, 21 nt, Homo sapiens
uuacauuuccaaaugaaugac

SEQ ID NO: 395981 - RNA, 20 nt, Homo sapiens
uuaccagacgguucaccagc

SEQ ID NO: 395982 - RNA, 14 nt, Homo sapiens
uuaccuaguacaag

SEQ ID NO: 395983 - RNA, 22 nt, Homo sapiens
uuaccugaaauaaaauucauua

SEQ ID NO: 395984 - RNA, 20 nt, Homo sapiens
uuaccuguuuucgcaccuac

SEQ ID NO: 395985 - RNA, 14 nt, Homo sapiens
uuaccuuguauacu

SEQ ID NO: 395986 - RNA, 16 nt, Homo sapiens
uuacuaacuaaacucu

SEQ ID NO: 395987 - RNA, 14 nt, Homo sapiens
uuacuaucauguca

SEQ ID NO: 395988 - RNA, 19 nt, Homo sapiens
uuacuaugacugcucccca

SEQ ID NO: 395989 - RNA, 21 nt, Homo sapiens
uuacucaugugcagguuuuga

SEQ ID NO: 395990 - RNA, 12 nt, Homo sapiens
uuacugaaguua

SEQ ID NO: 395991 - RNA, 15 nt, Homo sapiens
uuacuucacuuuaau

SEQ ID NO: 395992 - RNA, 21 nt, Homo sapiens
uuacuucacuuuaauucucau

SEQ ID NO: 395993 - RNA, 23 nt, Homo sapiens
uuagacagucaaggaguggcuua

SEQ ID NO: 395994 - RNA, 22 nt, Homo sapiens
uuagacaugacugaugacauau

SEQ ID NO: 395995 - RNA, 13 nt, Homo sapiens
uuagaggggaaaa

SEQ ID NO: 395996 - RNA, 14 nt, Homo sapiens
uuagcuuuacaaau

SEQ ID NO: 395997 - RNA, 12 nt, Homo sapiens
uuaguaauuucu

SEQ ID NO: 395998 - RNA, 14 nt, Homo sapiens
uuaguauaaguaca

SEQ ID NO: 395999 - RNA, 18 nt, Homo sapiens
uuaguauuugcauauucu

SEQ ID NO: 396000 - RNA, 13 nt, Homo sapiens
uuagucaugugac

SEQ ID NO: 396001 - RNA, 23 nt, Homo sapiens
uuauaaaagaauaaaauugcacu

SEQ ID NO: 396002 - RNA, 17 nt, Homo sapiens
uuauaagacuacuauac

SEQ ID NO: 396003 - RNA, 18 nt, Homo sapiens
uuauacauaacacauauc

SEQ ID NO: 396004 - RNA, 22 nt, Homo sapiens
uuauaguuucagauauauauca

SEQ ID NO: 396005 - RNA, 16 nt, Homo sapiens
uuauauuaaaauaugg

SEQ ID NO: 396006 - RNA, 14 nt, Homo sapiens
uuaucagucauaac

SEQ ID NO: 396007 - RNA, 21 nt, Homo sapiens
uuaugaaaaauaagucacuua

SEQ ID NO: 396008 - RNA, 16 nt, Homo sapiens
uuaugacagugaacau

SEQ ID NO: 396009 - RNA, 13 nt, Homo sapiens
uuaugaucuuggc

SEQ ID NO: 396010 - RNA, 23 nt, Homo sapiens
uuaugccauagcaagauugcuua

SEQ ID NO: 396011 - RNA, 15 nt, Homo sapiens
uuaugccuucacuuu

SEQ ID NO: 396012 - RNA, 19 nt, Homo sapiens
caugguaauaaaauaugaa

SEQ ID NO: 396013 - RNA, 19 nt, Homo sapiens
cauggugaaacccugucuc

SEQ ID NO: 396014 - RNA, 17 nt, Homo sapiens
caugguggguccauggg

SEQ ID NO: 396015 - RNA, 22 nt, Homo sapiens
cauguacacggccucaagggau

SEQ ID NO: 396016 - RNA, 12 nt, Homo sapiens
cauguacaugaa

SEQ ID NO: 396017 - RNA, 14 nt, Homo sapiens
cauguauugcacau

SEQ ID NO: 396018 - RNA, 15 nt, Homo sapiens
cauguauugcacauu

SEQ ID NO: 396019 - RNA, 14 nt, Homo sapiens
caugucagcaaaaa

SEQ ID NO: 396020 - RNA, 21 nt, Homo sapiens
caugugugcgagugugugcau

SEQ ID NO: 396021 - RNA, 22 nt, Homo sapiens
caugugugcgagugugugcaug

SEQ ID NO: 396022 - RNA, 17 nt, Homo sapiens
caugugugcgugugcgu

SEQ ID NO: 396023 - RNA, 23 nt, Homo sapiens
caugugugcgugugcgugcaugu

SEQ ID NO: 396024 - RNA, 19 nt, Homo sapiens
caugugugugcaagugugu

SEQ ID NO: 396025 - RNA, 15 nt, Homo sapiens
cauuaauguuaauuc

SEQ ID NO: 396026 - RNA, 15 nt, Homo sapiens
cauuagucacuuuga

SEQ ID NO: 396027 - RNA, 20 nt, Homo sapiens
cauuauaugcacuagcaaua

SEQ ID NO: 396028 - RNA, 12 nt, Homo sapiens
cauuaucuauga

SEQ ID NO: 396029 - RNA, 22 nt, Homo sapiens
cauuaucucaaaacugcacugu

SEQ ID NO: 396030 - RNA, 18 nt, Homo sapiens
cauuauuucucucugacc

SEQ ID NO: 396031 - RNA, 17 nt, Homo sapiens
cauucacccagacagcu

SEQ ID NO: 396032 - RNA, 14 nt, Homo sapiens
cauuccuguauuca

SEQ ID NO: 396033 - RNA, 15 nt, Homo sapiens
cauucgaguguuuca

SEQ ID NO: 396034 - RNA, 17 nt, Homo sapiens
cauucuggaaaagcaaa

SEQ ID NO: 396035 - RNA, 12 nt, Homo sapiens
cauucuuuuaua

SEQ ID NO: 396036 - RNA, 16 nt, Homo sapiens
cauugauggggaagga

SEQ ID NO: 396037 - RNA, 18 nt, Homo sapiens
cauugcacuccagccugg

SEQ ID NO: 396038 - RNA, 17 nt, Homo sapiens
cauugcuugugccacac

SEQ ID NO: 396039 - RNA, 16 nt, Homo sapiens
cauuguggucacagga

SEQ ID NO: 396040 - RNA, 17 nt, Homo sapiens
cauuuagucaugugacc

SEQ ID NO: 396041 - RNA, 13 nt, Homo sapiens
cauuuauagcaua

SEQ ID NO: 396042 - RNA, 13 nt, Homo sapiens
cauuucaaaggga

SEQ ID NO: 396043 - RNA, 18 nt, Homo sapiens
cauuucuugguuccaaua

SEQ ID NO: 396044 - RNA, 23 nt, Homo sapiens
cauuugaaaucuaugaaauauca

SEQ ID NO: 396045 - RNA, 19 nt, Homo sapiens
cauuugcuggagcucugcc

SEQ ID NO: 396046 - RNA, 14 nt, Homo sapiens
cauuugcuuugucc

SEQ ID NO: 396047 - RNA, 20 nt, Homo sapiens
cauuugggagacaugugaca

SEQ ID NO: 396048 - RNA, 16 nt, Homo sapiens
cauuuguaccucgagu

SEQ ID NO: 396049 - RNA, 16 nt, Homo sapiens
cauuugugugugugca

SEQ ID NO: 396050 - RNA, 18 nt, Homo sapiens
cauuuuaaaaaauggaac

SEQ ID NO: 396051 - RNA, 15 nt, Homo sapiens
cauuuucugcauuua

SEQ ID NO: 396052 - RNA, 14 nt, Homo sapiens
cauuuucugccuau

SEQ ID NO: 396053 - RNA, 17 nt, Homo sapiens
cauuuuuuucacuggag

SEQ ID NO: 396054 - RNA, 13 nt, Homo sapiens
ccaaaaacuaaau

SEQ ID NO: 396055 - RNA, 21 nt, Homo sapiens
ccaaaagguauuuuaaucacc

SEQ ID NO: 396056 - RNA, 18 nt, Homo sapiens
ccaaaaucggaucugggg

SEQ ID NO: 396057 - RNA, 19 nt, Homo sapiens
ccaaaguuugcucaaggag

SEQ ID NO: 396058 - RNA, 15 nt, Homo sapiens
ccaacacccugucua

SEQ ID NO: 396059 - RNA, 18 nt, Homo sapiens
ccaaccguucccucacag

SEQ ID NO: 396060 - RNA, 20 nt, Homo sapiens
ccaacguggggcagcacaga

SEQ ID NO: 396061 - RNA, 21 nt, Homo sapiens
ccaacguggggcagcacagag

SEQ ID NO: 396062 - RNA, 13 nt, Homo sapiens
ccaacucuugcag

SEQ ID NO: 396063 - RNA, 17 nt, Homo sapiens
ccaagacuugguguccu

SEQ ID NO: 396064 - RNA, 21 nt, Homo sapiens
ccaagcaaaaacaaaugggaa

SEQ ID NO: 396065 - RNA, 19 nt, Homo sapiens
ccaagcaggaagcucagac

SEQ ID NO: 396066 - RNA, 22 nt, Homo sapiens
ccaagcuccuugggaggcccca

SEQ ID NO: 396067 - RNA, 15 nt, Homo sapiens
ccaaggggcagucug

SEQ ID NO: 396068 - RNA, 12 nt, Homo sapiens
ccaaggugggag

SEQ ID NO: 396069 - RNA, 17 nt, Homo sapiens
ccaaguuguggugcuga

SEQ ID NO: 396070 - RNA, 20 nt, Homo sapiens
ccaauauuucucagacaucg

SEQ ID NO: 396071 - RNA, 19 nt, Homo sapiens
ccaaucccaccaacccuca

SEQ ID NO: 396072 - RNA, 19 nt, Homo sapiens
ccaauguuuagcaaauaca

SEQ ID NO: 396073 - RNA, 13 nt, Homo sapiens
ccacaaaacugac

SEQ ID NO: 396074 - RNA, 14 nt, Homo sapiens
ccacaaaaguacaa

SEQ ID NO: 396075 - RNA, 15 nt, Homo sapiens
ccacaaaaguacaau

SEQ ID NO: 396076 - RNA, 18 nt, Homo sapiens
ccacaaauagugcucgcu

SEQ ID NO: 396077 - RNA, 12 nt, Homo sapiens
ccacaagcacac

SEQ ID NO: 396078 - RNA, 15 nt, Homo sapiens
ccacagacaagguag

SEQ ID NO: 396079 - RNA, 11 nt, Homo sapiens
ccacagacuca

SEQ ID NO: 396080 - RNA, 15 nt, Homo sapiens
ccacagaugccucca

SEQ ID NO: 396081 - RNA, 23 nt, Homo sapiens
ccacagcaguugaaaagacucca

SEQ ID NO: 396082 - RNA, 19 nt, Homo sapiens
ccacagccugcaagucagu

SEQ ID NO: 396083 - RNA, 14 nt, Homo sapiens
ccacaggacauuuc

SEQ ID NO: 396084 - RNA, 16 nt, Homo sapiens
ccaccagccugcacua

SEQ ID NO: 396085 - RNA, 22 nt, Homo sapiens
ccacccuuggaggcugucuucu

SEQ ID NO: 396086 - RNA, 18 nt, Homo sapiens
ccaccucugcaggggaga

SEQ ID NO: 396087 - RNA, 16 nt, Homo sapiens
ccacgucaacagaauu

SEQ ID NO: 396088 - RNA, 15 nt, Homo sapiens
ccacgugcuguucca

SEQ ID NO: 396089 - RNA, 12 nt, Homo sapiens
ccacuaagccaa

SEQ ID NO: 396090 - RNA, 18 nt, Homo sapiens
ccacuagugcaaaucaua

SEQ ID NO: 396091 - RNA, 15 nt, Homo sapiens
ccacuccagcuccuu

SEQ ID NO: 396092 - RNA, 23 nt, Homo sapiens
ccacucugccucugccugcauuc

SEQ ID NO: 396093 - RNA, 16 nt, Homo sapiens
ccacuucucucaggau

SEQ ID NO: 396094 - RNA, 15 nt, Homo sapiens
ccagaacacacucca

SEQ ID NO: 396095 - RNA, 17 nt, Homo sapiens
ccagaaccuguccuugc

SEQ ID NO: 396096 - RNA, 18 nt, Homo sapiens
ccagaacuggacucagga

SEQ ID NO: 396097 - RNA, 19 nt, Homo sapiens
ccagaacuggacucaggau

SEQ ID NO: 396098 - RNA, 13 nt, Homo sapiens
ccagaauagcuuu

SEQ ID NO: 396099 - RNA, 17 nt, Homo sapiens
ccagaauaucugggauu

SEQ ID NO: 396100 - RNA, 13 nt, Homo sapiens
ccagacacagaag

SEQ ID NO: 396101 - RNA, 20 nt, Homo sapiens
ccagaccauucaggacacag

SEQ ID NO: 396102 - RNA, 16 nt, Homo sapiens
ccagacuggcacaguu

SEQ ID NO: 396103 - RNA, 16 nt, Homo sapiens
ccagacuguguauuca

SEQ ID NO: 396104 - RNA, 18 nt, Homo sapiens
ccagagacggaagccuuu

SEQ ID NO: 396105 - RNA, 13 nt, Homo sapiens
ccagaggacaaag

SEQ ID NO: 396106 - RNA, 19 nt, Homo sapiens
ccagauauucaagucaccu

SEQ ID NO: 396107 - RNA, 15 nt, Homo sapiens
ccagauauuucacau

SEQ ID NO: 396108 - RNA, 23 nt, Homo sapiens
ccagauugacgacaagugcugaa

SEQ ID NO: 396109 - RNA, 22 nt, Homo sapiens
ccagcaaugacaucucaggggc

SEQ ID NO: 396110 - RNA, 16 nt, Homo sapiens
ccagcacuuugggagg

SEQ ID NO: 396111 - RNA, 21 nt, Homo sapiens
ccagcacuuugggaggcugag

SEQ ID NO: 396112 - RNA, 15 nt, Homo sapiens
ccagcagaucccagc

SEQ ID NO: 396113 - RNA, 17 nt, Homo sapiens
ccagcagaucccagcuc

SEQ ID NO: 396114 - RNA, 14 nt, Homo sapiens
ccagccuccaugcu

SEQ ID NO: 396115 - RNA, 13 nt, Homo sapiens
gcacugcugcugc

SEQ ID NO: 396116 - RNA, 20 nt, Homo sapiens
gcacuguucccccugugcag

SEQ ID NO: 396117 - RNA, 23 nt, Homo sapiens
gcacuuacccacgugcuguucca

SEQ ID NO: 396118 - RNA, 20 nt, Homo sapiens
gcacuugcacgcccaugugu

SEQ ID NO: 396119 - RNA, 17 nt, Homo sapiens
gcagaagcaacccaaau

SEQ ID NO: 396120 - RNA, 21 nt, Homo sapiens
gcagaccacugauaaaaccau

SEQ ID NO: 396121 - RNA, 22 nt, Homo sapiens
gcagagcuugaacacagucuca

SEQ ID NO: 396122 - RNA, 15 nt, Homo sapiens
gcagauaaacaguag

SEQ ID NO: 396123 - RNA, 13 nt, Homo sapiens
gcagaugacaaaa

SEQ ID NO: 396124 - RNA, 17 nt, Homo sapiens
gcagcauacacagauga

SEQ ID NO: 396125 - RNA, 21 nt, Homo sapiens
gcagcaucuucaaacauguac

SEQ ID NO: 396126 - RNA, 18 nt, Homo sapiens
gcagcuuauucacaagac

SEQ ID NO: 396127 - RNA, 21 nt, Homo sapiens
gcagcuuuaaacucagggaca

SEQ ID NO: 396128 - RNA, 18 nt, Homo sapiens
gcaggaaaugaaaauguc

SEQ ID NO: 396129 - RNA, 18 nt, Homo sapiens
gcaggaagcauucagaga

SEQ ID NO: 396130 - RNA, 15 nt, Homo sapiens
gcaggaagcucagac

SEQ ID NO: 396131 - RNA, 20 nt, Homo sapiens
gcaggacauuuggcugugau

SEQ ID NO: 396132 - RNA, 16 nt, Homo sapiens
gcaggaguauaugagc

SEQ ID NO: 396133 - RNA, 21 nt, Homo sapiens
gcagggaagccccacuugaag

SEQ ID NO: 396134 - RNA, 16 nt, Homo sapiens
gcagggacugccaguc

SEQ ID NO: 396135 - RNA, 13 nt, Homo sapiens
gcagggcaugacu

SEQ ID NO: 396136 - RNA, 20 nt, Homo sapiens
gcagggccuugcccagagau

SEQ ID NO: 396137 - RNA, 23 nt, Homo sapiens
gcagguuggugggggccucggug

SEQ ID NO: 396138 - RNA, 17 nt, Homo sapiens
gcaguacuuuaccuccu

SEQ ID NO: 396139 - RNA, 15 nt, Homo sapiens
gcagugaugcuggau

SEQ ID NO: 396140 - RNA, 11 nt, Homo sapiens
gcagugcaaca

SEQ ID NO: 396141 - RNA, 17 nt, Homo sapiens
gcaguuccugucccuuc

SEQ ID NO: 396142 - RNA, 21 nt, Homo sapiens
gcaguuugcuuuguaugcacu

SEQ ID NO: 396143 - RNA, 19 nt, Homo sapiens
gcauaagaaaacuaagaaa

SEQ ID NO: 396144 - RNA, 14 nt, Homo sapiens
gcauaccugcuggu

SEQ ID NO: 396145 - RNA, 17 nt, Homo sapiens
gcaucauuaguacaucu

SEQ ID NO: 396146 - RNA, 20 nt, Homo sapiens
gcauccccuuggcugugagg

SEQ ID NO: 396147 - RNA, 18 nt, Homo sapiens
gcaucucugaacauuucu

SEQ ID NO: 396148 - RNA, 15 nt, Homo sapiens
gcauggagcauggga

SEQ ID NO: 396149 - RNA, 23 nt, Homo sapiens
gcauggaggcugcgacugaugaa

SEQ ID NO: 396150 - RNA, 13 nt, Homo sapiens
gcaugggcacucc

SEQ ID NO: 396151 - RNA, 22 nt, Homo sapiens
gcauuaucuaugauaugcuaau

SEQ ID NO: 396152 - RNA, 16 nt, Homo sapiens
gcauucagccaggaga

SEQ ID NO: 396153 - RNA, 23 nt, Homo sapiens
gcauuuaaccgucaauaggcaaa

SEQ ID NO: 396154 - RNA, 14 nt, Homo sapiens
gcauuuaggagaua

SEQ ID NO: 396155 - RNA, 20 nt, Homo sapiens
gcauuugugcccacucucca

SEQ ID NO: 396156 - RNA, 17 nt, Homo sapiens
gcauuuucaagcaguua

SEQ ID NO: 396157 - RNA, 18 nt, Homo sapiens
gccaaaggaugugauaua

SEQ ID NO: 396158 - RNA, 22 nt, Homo sapiens
gccaagauugcgccauugcacu

SEQ ID NO: 396159 - RNA, 19 nt, Homo sapiens
gccaagcagccaagcuccu

SEQ ID NO: 396160 - RNA, 18 nt, Homo sapiens
gccaaucuucaguauuuu

SEQ ID NO: 396161 - RNA, 20 nt, Homo sapiens
gccacacacaguuacagagu

SEQ ID NO: 396162 - RNA, 11 nt, Homo sapiens
gccacagccau

SEQ ID NO: 396163 - RNA, 15 nt, Homo sapiens
gccaccauccugcag

SEQ ID NO: 396164 - RNA, 17 nt, Homo sapiens
gccagacaucaacagau

SEQ ID NO: 396165 - RNA, 18 nt, Homo sapiens
gccagacuggcacaguuu

SEQ ID NO: 396166 - RNA, 17 nt, Homo sapiens
gccagaggaacugucca

SEQ ID NO: 396167 - RNA, 20 nt, Homo sapiens
gccagccuucuuccauccca

SEQ ID NO: 396168 - RNA, 17 nt, Homo sapiens
gccagcuuaucucaggg

SEQ ID NO: 396169 - RNA, 17 nt, Homo sapiens
gccaggauuaaaagcca

SEQ ID NO: 396170 - RNA, 12 nt, Homo sapiens
gccagguggcca

SEQ ID NO: 396171 - RNA, 22 nt, Homo sapiens
gccaguaccuccugccccaugc

SEQ ID NO: 396172 - RNA, 11 nt, Homo sapiens
gccagugacag

SEQ ID NO: 396173 - RNA, 12 nt, Homo sapiens
gccagugacaga

SEQ ID NO: 396174 - RNA, 20 nt, Homo sapiens
gccauaaaacauuaagaaaa

SEQ ID NO: 396175 - RNA, 20 nt, Homo sapiens
gccauaauuacuaugucauu

SEQ ID NO: 396176 - RNA, 14 nt, Homo sapiens
gccauucacugccc

SEQ ID NO: 396177 - RNA, 21 nt, Homo sapiens
gcccagccuccaagcuccauc

SEQ ID NO: 396178 - RNA, 19 nt, Homo sapiens
gcccaggcuggagugcagu

SEQ ID NO: 396179 - RNA, 20 nt, Homo sapiens
gcccaggcuggaguggagug

SEQ ID NO: 396180 - RNA, 19 nt, Homo sapiens
gcccagggccacucugccu

SEQ ID NO: 396181 - RNA, 20 nt, Homo sapiens
gcccagggccacucugccuc

SEQ ID NO: 396182 - RNA, 18 nt, Homo sapiens
gcccaucaauuauagaaa

SEQ ID NO: 396183 - RNA, 20 nt, Homo sapiens
gcccaugugugagugugugc

SEQ ID NO: 396184 - RNA, 17 nt, Homo sapiens
gccccagagcagggugu

SEQ ID NO: 396185 - RNA, 23 nt, Homo sapiens
gccccagcacuaaagcaguggac

SEQ ID NO: 396186 - RNA, 19 nt, Homo sapiens
gccccaggcauugccaagg

SEQ ID NO: 396187 - RNA, 22 nt, Homo sapiens
gccccagugccaagcacagugc

SEQ ID NO: 396188 - RNA, 16 nt, Homo sapiens
gccccgugcagacugg

SEQ ID NO: 396189 - RNA, 15 nt, Homo sapiens
gccccuguuaccuaa

SEQ ID NO: 396190 - RNA, 18 nt, Homo sapiens
gcccgacagccuggcaca

SEQ ID NO: 396191 - RNA, 14 nt, Homo sapiens
gcccguaaacacgc

SEQ ID NO: 396192 - RNA, 22 nt, Homo sapiens
gcccucgggcgagucacugccu

SEQ ID NO: 396193 - RNA, 12 nt, Homo sapiens
gcccugggaugu

SEQ ID NO: 396194 - RNA, 16 nt, Homo sapiens
gcccuguucagcuacu

SEQ ID NO: 396195 - RNA, 18 nt, Homo sapiens
gccgaaaaggauaugcag

SEQ ID NO: 396196 - RNA, 21 nt, Homo sapiens
gccgagauugcaccacugcac

SEQ ID NO: 396197 - RNA, 19 nt, Homo sapiens
gccgugccuucagcucuac

SEQ ID NO: 396198 - RNA, 19 nt, Homo sapiens
gccucaagaugaaggcaaa

SEQ ID NO: 396199 - RNA, 21 nt, Homo sapiens
gccucaguccuccccucacag

SEQ ID NO: 396200 - RNA, 19 nt, Homo sapiens
gccuccucuacaauuugcc

SEQ ID NO: 396201 - RNA, 21 nt, Homo sapiens
gccuccucuguccagggcccu

SEQ ID NO: 396202 - RNA, 9 nt, Homo sapiens
gccucggga

SEQ ID NO: 396203 - RNA, 20 nt, Homo sapiens
gccucgggacaucaaaaaca

SEQ ID NO: 396204 - RNA, 16 nt, Homo sapiens
gccucugccugcauuc

SEQ ID NO: 396205 - RNA, 14 nt, Homo sapiens
gccucuuccaggaa

SEQ ID NO: 396206 - RNA, 23 nt, Homo sapiens
gccucuuugugugcgucacugug

SEQ ID NO: 396207 - RNA, 19 nt, Homo sapiens
gccucuuuucucugugcuu

SEQ ID NO: 396208 - RNA, 22 nt, Homo sapiens
gccugagacagcugucuuguga

SEQ ID NO: 396209 - RNA, 18 nt, Homo sapiens
gccugccgguaaacacgc

SEQ ID NO: 396210 - RNA, 14 nt, Homo sapiens
gccugccucuucca

SEQ ID NO: 396211 - RNA, 24 nt, Homo sapiens
gccugcgcagcuuggauggagacu

SEQ ID NO: 396212 - RNA, 14 nt, Homo sapiens
gccugcggaccaga

SEQ ID NO: 396213 - RNA, 20 nt, Homo sapiens
gccugcggaccagaugaaug

SEQ ID NO: 396214 - RNA, 15 nt, Homo sapiens
gccuggacuuuccug

SEQ ID NO: 396215 - RNA, 16 nt, Homo sapiens
gccuggacuuuccugc

SEQ ID NO: 396216 - RNA, 13 nt, Homo sapiens
gccuguaauccca

SEQ ID NO: 396217 - RNA, 19 nt, Homo sapiens
gccuguaaucccagcacuu

SEQ ID NO: 396218 - RNA, 13 nt, Homo sapiens
gccuguccaggaa

SEQ ID NO: 396219 - RNA, 21 nt, Homo sapiens
gccugucccauggacacucca

SEQ ID NO: 396220 - RNA, 15 nt, Homo sapiens
gccugugguuaacau

SEQ ID NO: 396221 - RNA, 21 nt, Homo sapiens
gccugugguuaacaucucaga

SEQ ID NO: 396222 - RNA, 22 nt, Homo sapiens
gccuuaccuccugcccaggaga

SEQ ID NO: 396223 - RNA, 12 nt, Homo sapiens
gccuucucacca

SEQ ID NO: 396224 - RNA, 18 nt, Homo sapiens
gccuucugucagcaguga

SEQ ID NO: 396225 - RNA, 16 nt, Homo sapiens
gccuugaaaccaccuu

SEQ ID NO: 396226 - RNA, 21 nt, Homo sapiens
gccuuuaguuuuaacaguuca

SEQ ID NO: 396227 - RNA, 23 nt, Homo sapiens
gccuuucucccaggccaggcucc

SEQ ID NO: 396228 - RNA, 17 nt, Homo sapiens
gcgaaaaaaucagugaa

SEQ ID NO: 396229 - RNA, 14 nt, Homo sapiens
gcgacagagccaga

SEQ ID NO: 396230 - RNA, 15 nt, Homo sapiens
gcgagacuccgucuc

SEQ ID NO: 396231 - RNA, 16 nt, Homo sapiens
gcgagacuccgucuca

SEQ ID NO: 396232 - RNA, 14 nt, Homo sapiens
gcgagucacugccu

SEQ ID NO: 396233 - RNA, 13 nt, Homo sapiens
gcgugugugcaag

SEQ ID NO: 396234 - RNA, 20 nt, Homo sapiens
gcuaaaauuagaugaacuca

SEQ ID NO: 396235 - RNA, 21 nt, Homo sapiens
gcuaagauagaggggcucugg

SEQ ID NO: 396236 - RNA, 14 nt, Homo sapiens
gcuaaucuucaggg

SEQ ID NO: 396237 - RNA, 21 nt, Homo sapiens
gcuaauguaauaacugugaag

SEQ ID NO: 396238 - RNA, 16 nt, Homo sapiens
gcuacaaaaacacagc

SEQ ID NO: 396239 - RNA, 15 nt, Homo sapiens
gcuaccuacugauaa

SEQ ID NO: 396240 - RNA, 22 nt, Homo sapiens
gcuacugacuauggcuaccaaa

SEQ ID NO: 396241 - RNA, 19 nt, Homo sapiens
gcuacugcaaaugcuauau

SEQ ID NO: 396242 - RNA, 18 nt, Homo sapiens
gcuagaggacuucuggca

SEQ ID NO: 396243 - RNA, 23 nt, Homo sapiens
gcuauaccugggcauacuaauaa

SEQ ID NO: 396244 - RNA, 22 nt, Homo sapiens
gcuauagacccgaggaaacuca

SEQ ID NO: 396245 - RNA, 23 nt, Homo sapiens
gcuaucucucagugaacugugag

SEQ ID NO: 396246 - RNA, 20 nt, Homo sapiens
gcuauggggagaaaagacau

SEQ ID NO: 396247 - RNA, 11 nt, Homo sapiens
gcuauuugccu

SEQ ID NO: 396248 - RNA, 22 nt, Homo sapiens
gcucagcaaaagaugcuucuca

SEQ ID NO: 396249 - RNA, 12 nt, Homo sapiens
gcucagggcuga

SEQ ID NO: 396250 - RNA, 13 nt, Homo sapiens
gcuccauguagaa

SEQ ID NO: 396251 - RNA, 14 nt, Homo sapiens
gcuccuugacuccu

SEQ ID NO: 396252 - RNA, 18 nt, Homo sapiens
gcucuggugacaccagcc

SEQ ID NO: 396253 - RNA, 16 nt, Homo sapiens
gcucuuagcagcuucc

SEQ ID NO: 396254 - RNA, 18 nt, Homo sapiens
gcucuuucucugccagug

SEQ ID NO: 396255 - RNA, 20 nt, Homo sapiens
gcugaaaacugcaacuugua

SEQ ID NO: 396256 - RNA, 13 nt, Homo sapiens
gcugacccccaua

SEQ ID NO: 396257 - RNA, 15 nt, Homo sapiens
gcugaccuccacagc

SEQ ID NO: 396258 - RNA, 21 nt, Homo sapiens
gcugaugaacucuuaaucaaa

SEQ ID NO: 396259 - RNA, 12 nt, Homo sapiens
gcugcauaguau

SEQ ID NO: 396260 - RNA, 17 nt, Homo sapiens
gcugccuaggcugaccu

SEQ ID NO: 396261 - RNA, 19 nt, Homo sapiens
gcugccucuaccugacacu

SEQ ID NO: 396262 - RNA, 22 nt, Homo sapiens
gcugccucuugaaugcagggac

SEQ ID NO: 396263 - RNA, 21 nt, Homo sapiens
gcugccugcccguaaacacgc

SEQ ID NO: 396264 - RNA, 13 nt, Homo sapiens
gcugcuagcacuu

SEQ ID NO: 396265 - RNA, 20 nt, Homo sapiens
gcugcuuuucccuaagccaa

SEQ ID NO: 396266 - RNA, 18 nt, Homo sapiens
gcuggacggggacugggg

SEQ ID NO: 396267 - RNA, 17 nt, Homo sapiens
gcuggagucgggacuaa

SEQ ID NO: 396268 - RNA, 15 nt, Homo sapiens
gcuggcccagccaaa

SEQ ID NO: 396269 - RNA, 16 nt, Homo sapiens
gcuguccuuacccauc

SEQ ID NO: 396270 - RNA, 15 nt, Homo sapiens
gcugucuuucacuga

SEQ ID NO: 396271 - RNA, 22 nt, Homo sapiens
gcugugcccaaguuguggugcu

SEQ ID NO: 396272 - RNA, 23 nt, Homo sapiens
gcuguucacagccagacuggcac

SEQ ID NO: 396273 - RNA, 13 nt, Homo sapiens
gcuguugccucau

SEQ ID NO: 396274 - RNA, 20 nt, Homo sapiens
gcuguuuccauagggugaca

SEQ ID NO: 396275 - RNA, 14 nt, Homo sapiens
gcuuaauguuuauu

SEQ ID NO: 396276 - RNA, 12 nt, Homo sapiens
gcuuagcauucc

SEQ ID NO: 396277 - RNA, 12 nt, Homo sapiens
gcuuauauucau

SEQ ID NO: 396278 - RNA, 11 nt, Homo sapiens
gcuucacuggu

SEQ ID NO: 396279 - RNA, 19 nt, Homo sapiens
gcuuccaguccaaucucau

SEQ ID NO: 396280 - RNA, 22 nt, Homo sapiens
gcuuccauuugugugugugcaa

SEQ ID NO: 396281 - RNA, 23 nt, Homo sapiens
gcuuccauuugugugugugcaag

SEQ ID NO: 396282 - RNA, 23 nt, Homo sapiens
gcuucccggcgucccuaccuccu

SEQ ID NO: 396283 - RNA, 15 nt, Homo sapiens
gcuucccugacucau

SEQ ID NO: 396284 - RNA, 17 nt, Homo sapiens
gcuucuagaaccaggca

SEQ ID NO: 396285 - RNA, 17 nt, Homo sapiens
gcuucuaugguugacau

SEQ ID NO: 396286 - RNA, 22 nt, Homo sapiens
gcuucucacugccaugccagcu

SEQ ID NO: 396287 - RNA, 16 nt, Homo sapiens
gcuucucuccacugaa

SEQ ID NO: 396288 - RNA, 21 nt, Homo sapiens
gcuugagcaaccuggcuaaga

SEQ ID NO: 396289 - RNA, 22 nt, Homo sapiens
gcuuguaacuccaccaacccau

SEQ ID NO: 396290 - RNA, 11 nt, Homo sapiens
gcuuguguuaa

SEQ ID NO: 396291 - RNA, 20 nt, Homo sapiens
gcuuuaaacacccuucacau

SEQ ID NO: 396292 - RNA, 17 nt, Homo sapiens
gcuuuaaacucagggac

SEQ ID NO: 396293 - RNA, 20 nt, Homo sapiens
gcuuuaagcgcaacauuucu

SEQ ID NO: 396294 - RNA, 20 nt, Homo sapiens
gcuuuauuuuuuaaguauuu

SEQ ID NO: 396295 - RNA, 21 nt, Homo sapiens
gcuuuauuuuuuaaguauuua

SEQ ID NO: 396296 - RNA, 20 nt, Homo sapiens
gcuuucauaaacuucaggga

SEQ ID NO: 396297 - RNA, 20 nt, Homo sapiens
gcuuucauguaaacugugca

SEQ ID NO: 396298 - RNA, 12 nt, Homo sapiens
gcuuugcaguga

SEQ ID NO: 396299 - RNA, 14 nt, Homo sapiens
gcuuuguugcccag

SEQ ID NO: 396300 - RNA, 14 nt, Homo sapiens
gcuuuuuuacacaa

SEQ ID NO: 396301 - RNA, 15 nt, Homo sapiens
ggaaaacaagcauuc

SEQ ID NO: 396302 - RNA, 19 nt, Homo sapiens
ggaaaagcaaaacuguagg

SEQ ID NO: 396303 - RNA, 20 nt, Homo sapiens
ggaaaauaaaucaaugcuau

SEQ ID NO: 396304 - RNA, 15 nt, Homo sapiens
ggaaaauaccccauc

SEQ ID NO: 396305 - RNA, 18 nt, Homo sapiens
ggaaaaugaauaauacau

SEQ ID NO: 396306 - RNA, 18 nt, Homo sapiens
ggaaacuguugccagaga

SEQ ID NO: 396307 - RNA, 15 nt, Homo sapiens
ggaaagcagcucaaa

SEQ ID NO: 396308 - RNA, 20 nt, Homo sapiens
ggaaagugauuuuuuuccac

SEQ ID NO: 396309 - RNA, 23 nt, Homo sapiens
ggaaccgcaggaagcugcuccgu

SEQ ID NO: 396310 - RNA, 18 nt, Homo sapiens
ggaacuagccaccaacuc

SEQ ID NO: 396311 - RNA, 19 nt, Homo sapiens
ggaacuuuuauuacugggg

SEQ ID NO: 396312 - RNA, 17 nt, Homo sapiens
ggaagccccacuugaag

SEQ ID NO: 396313 - RNA, 11 nt, Homo sapiens
ggaagggucaa

SEQ ID NO: 396314 - RNA, 17 nt, Homo sapiens
ggaagguucuacgccag

SEQ ID NO: 396315 - RNA, 17 nt, Homo sapiens
ggaauaaacuccauuua

SEQ ID NO: 396316 - RNA, 18 nt, Homo sapiens
ggaauuaugucugcugaa

SEQ ID NO: 396317 - RNA, 21 nt, Homo sapiens
ggacaaaccgagugcaaugaa

SEQ ID NO: 396318 - RNA, 21 nt, Homo sapiens
ggacaacucagucccuaaaaa

SEQ ID NO: 396319 - RNA, 14 nt, Homo sapiens
ggacacuccagugc

SEQ ID NO: 396320 - RNA, 15 nt, Homo sapiens
ggacaggaugaccug

SEQ ID NO: 396321 - RNA, 22 nt, Homo sapiens
ggacaucuaguaggugcuugac

SEQ ID NO: 396322 - RNA, 17 nt, Homo sapiens
ggacaugaagauucuuu

SEQ ID NO: 396323 - RNA, 20 nt, Homo sapiens
ggaccaaagcagcugcagcc

SEQ ID NO: 396324 - RNA, 18 nt, Homo sapiens
ggaccaaggggugggcca

SEQ ID NO: 396325 - RNA, 16 nt, Homo sapiens
ggaccagaagcauuuc

SEQ ID NO: 396326 - RNA, 19 nt, Homo sapiens
ggaccagaagcauuucacc

SEQ ID NO: 396327 - RNA, 17 nt, Homo sapiens
ggaccaguggucucaca

SEQ ID NO: 396328 - RNA, 15 nt, Homo sapiens
ggaccccagcuguga

SEQ ID NO: 396329 - RNA, 14 nt, Homo sapiens
ggaccccugcccuu

SEQ ID NO: 396330 - RNA, 14 nt, Homo sapiens
ggaccucaguuuua

SEQ ID NO: 396331 - RNA, 17 nt, Homo sapiens
ggaccugcccugggcca

SEQ ID NO: 396332 - RNA, 13 nt, Homo sapiens
ggacuagcuggau

SEQ ID NO: 396333 - RNA, 10 nt, Homo sapiens
ggacuauuau

SEQ ID NO: 396334 - RNA, 23 nt, Homo sapiens
ggacucagguugucugaagucac

SEQ ID NO: 396335 - RNA, 17 nt, Homo sapiens
ggacuucuggcagggaa

SEQ ID NO: 396336 - RNA, 19 nt, Homo sapiens
ggagaacgagaccugugug

SEQ ID NO: 396337 - RNA, 14 nt, Homo sapiens
ggagaacuagagaa

SEQ ID NO: 396338 - RNA, 24 nt, Homo sapiens
ggagaauuauauagguugugcaaa

SEQ ID NO: 396339 - RNA, 16 nt, Homo sapiens
ggagacaugugacauu

SEQ ID NO: 396340 - RNA, 13 nt, Homo sapiens
ggagaggggcaca

SEQ ID NO: 396341 - RNA, 17 nt, Homo sapiens
ggagccccagugccaag

SEQ ID NO: 396342 - RNA, 20 nt, Homo sapiens
ggagcuuuugguaugugaca

SEQ ID NO: 396343 - RNA, 15 nt, Homo sapiens
ggaggacgggacccu

SEQ ID NO: 396344 - RNA, 21 nt, Homo sapiens
ggaggcuccagagggcacucu

SEQ ID NO: 396345 - RNA, 15 nt, Homo sapiens
ggaggcugaggcaag

SEQ ID NO: 396346 - RNA, 19 nt, Homo sapiens
ggaggcugucuucucaggc

SEQ ID NO: 396347 - RNA, 17 nt, Homo sapiens
ggagggagagaauuuua

SEQ ID NO: 396348 - RNA, 22 nt, Homo sapiens
ggagggcgcuaugucguggcug

SEQ ID NO: 396349 - RNA, 19 nt, Homo sapiens
ggagguggagguugcagug

SEQ ID NO: 396350 - RNA, 20 nt, Homo sapiens
ggagguggagguugcaguga

SEQ ID NO: 396351 - RNA, 14 nt, Homo sapiens
ggagguugcaguga

SEQ ID NO: 396352 - RNA, 13 nt, Homo sapiens
ggagucaucucaa

SEQ ID NO: 396353 - RNA, 14 nt, Homo sapiens
ggauaaguagaauu

SEQ ID NO: 396354 - RNA, 20 nt, Homo sapiens
ggauaaugcuguugccucau

SEQ ID NO: 396355 - RNA, 11 nt, Homo sapiens
ggauagcacug

SEQ ID NO: 396356 - RNA, 13 nt, Homo sapiens
ggauauugacaag

SEQ ID NO: 396357 - RNA, 15 nt, Homo sapiens
ggauauuuucuucca

SEQ ID NO: 396358 - RNA, 22 nt, Homo sapiens
ggaugaaggccucccugucuaa

SEQ ID NO: 396359 - RNA, 12 nt, Homo sapiens
ggaugaugccuc

SEQ ID NO: 396360 - RNA, 16 nt, Homo sapiens
ggaugaugguugcaaa

SEQ ID NO: 396361 - RNA, 15 nt, Homo sapiens
ggaugcagagucagc

SEQ ID NO: 396362 - RNA, 22 nt, Homo sapiens
ggaugggacagaauguggcgug

SEQ ID NO: 396363 - RNA, 14 nt, Homo sapiens
ggauguccacagau

SEQ ID NO: 396364 - RNA, 15 nt, Homo sapiens
ggauuaaaagccaug

SEQ ID NO: 396365 - RNA, 16 nt, Homo sapiens
ggauuaccaguagaug

SEQ ID NO: 396366 - RNA, 19 nt, Homo sapiens
ggauuuauuuuuccauuua

SEQ ID NO: 396367 - RNA, 20 nt, Homo sapiens
ggcaacaguacuucaaacag

SEQ ID NO: 396368 - RNA, 22 nt, Homo sapiens
ggcaaccacaggcagcauuuag

SEQ ID NO: 396369 - RNA, 23 nt, Homo sapiens
ggcaacuugggaacuagacuccc

SEQ ID NO: 396370 - RNA, 17 nt, Homo sapiens
guccucacaucuuucac

SEQ ID NO: 396371 - RNA, 19 nt, Homo sapiens
guccuccacgccauuuccu

SEQ ID NO: 396372 - RNA, 14 nt, Homo sapiens
guccuccccucaca

SEQ ID NO: 396373 - RNA, 17 nt, Homo sapiens
guccugccaggauuaaa

SEQ ID NO: 396374 - RNA, 23 nt, Homo sapiens
guccugggguauaaaacuuuccu

SEQ ID NO: 396375 - RNA, 14 nt, Homo sapiens
guccuugaugcuca

SEQ ID NO: 396376 - RNA, 16 nt, Homo sapiens
gucgaacaauucauau

SEQ ID NO: 396377 - RNA, 22 nt, Homo sapiens
gucuaaauaaaugaaguauuuc

SEQ ID NO: 396378 - RNA, 18 nt, Homo sapiens
gucuaggaacauacuuca

SEQ ID NO: 396379 - RNA, 19 nt, Homo sapiens
gucuauuugagacuuagaa

SEQ ID NO: 396380 - RNA, 19 nt, Homo sapiens
gucucaagagggcacuggu

SEQ ID NO: 396381 - RNA, 17 nt, Homo sapiens
gucucacaguguugccc

SEQ ID NO: 396382 - RNA, 23 nt, Homo sapiens
gucucacgggcaugggcacuccc

SEQ ID NO: 396383 - RNA, 15 nt, Homo sapiens
gucucaguccaccug

SEQ ID NO: 396384 - RNA, 15 nt, Homo sapiens
gucucaguccaugaa

SEQ ID NO: 396385 - RNA, 19 nt, Homo sapiens
gucuccuuugcaggcucau

SEQ ID NO: 396386 - RNA, 13 nt, Homo sapiens
gucucgcuuuguu

SEQ ID NO: 396387 - RNA, 17 nt, Homo sapiens
gucucgcuuuguugccc

SEQ ID NO: 396388 - RNA, 21 nt, Homo sapiens
gucucucggguucaagcaauu

SEQ ID NO: 396389 - RNA, 22 nt, Homo sapiens
gucucuuguaauccgaaucucu

SEQ ID NO: 396390 - RNA, 16 nt, Homo sapiens
gucugcuagccaggau

SEQ ID NO: 396391 - RNA, 20 nt, Homo sapiens
gucugugugcaagugugugc

SEQ ID NO: 396392 - RNA, 20 nt, Homo sapiens
gucuucagggggccaggugc

SEQ ID NO: 396393 - RNA, 13 nt, Homo sapiens
gucuucccuguau

SEQ ID NO: 396394 - RNA, 13 nt, Homo sapiens
gucuuuaacucau

SEQ ID NO: 396395 - RNA, 21 nt, Homo sapiens
gugaaaggaagcuccacuguc

SEQ ID NO: 396396 - RNA, 18 nt, Homo sapiens
gugaaauauaugcuauau

SEQ ID NO: 396397 - RNA, 21 nt, Homo sapiens
gugaagaucacguuccuuccc

SEQ ID NO: 396398 - RNA, 15 nt, Homo sapiens
gugaauaaaccauca

SEQ ID NO: 396399 - RNA, 23 nt, Homo sapiens
gugaauaaaccaucaucuugcca

SEQ ID NO: 396400 - RNA, 15 nt, Homo sapiens
gugaaugaaucucaa

SEQ ID NO: 396401 - RNA, 15 nt, Homo sapiens
gugaauuucuucacu

SEQ ID NO: 396402 - RNA, 16 nt, Homo sapiens
gugacauuuccaugca

SEQ ID NO: 396403 - RNA, 15 nt, Homo sapiens
gugacauuugggaga

SEQ ID NO: 396404 - RNA, 23 nt, Homo sapiens
gugacauuugggagacaugugac

SEQ ID NO: 396405 - RNA, 14 nt, Homo sapiens
gugaccuccacagc

SEQ ID NO: 396406 - RNA, 14 nt, Homo sapiens
gugacuguggcaca

SEQ ID NO: 396407 - RNA, 19 nt, Homo sapiens
gugacuucuccaggucuca

SEQ ID NO: 396408 - RNA, 13 nt, Homo sapiens
gugagaacacagc

SEQ ID NO: 396409 - RNA, 23 nt, Homo sapiens
gugaggaaagauuuuuguuguua

SEQ ID NO: 396410 - RNA, 23 nt, Homo sapiens
gugagggauaguggggucagggc

SEQ ID NO: 396411 - RNA, 19 nt, Homo sapiens
gugaguuuaccuuguauac

SEQ ID NO: 396412 - RNA, 17 nt, Homo sapiens
gugauuuucauugcugg

SEQ ID NO: 396413 - RNA, 19 nt, Homo sapiens
gugcaaaguucccuacuuc

SEQ ID NO: 396414 - RNA, 20 nt, Homo sapiens
gugcaagugucugugugcaa

SEQ ID NO: 396415 - RNA, 19 nt, Homo sapiens
gugcaagugugugcacaug

SEQ ID NO: 396416 - RNA, 12 nt, Homo sapiens
gugcaugcucuc

SEQ ID NO: 396417 - RNA, 16 nt, Homo sapiens
gugcaugugcacuugc

SEQ ID NO: 396418 - RNA, 18 nt, Homo sapiens
gugccaauauuucugaua

SEQ ID NO: 396419 - RNA, 21 nt, Homo sapiens
gugccagcaaugacaucucag

SEQ ID NO: 396420 - RNA, 17 nt, Homo sapiens
gugccaguuauggcuau

SEQ ID NO: 396421 - RNA, 21 nt, Homo sapiens
gugccauuuuaagaguuacuu

SEQ ID NO: 396422 - RNA, 19 nt, Homo sapiens
gugcccugcaucccucucc

SEQ ID NO: 396423 - RNA, 18 nt, Homo sapiens
gugccguaacaacugugg

SEQ ID NO: 396424 - RNA, 16 nt, Homo sapiens
gugccuguaaucacag

SEQ ID NO: 396425 - RNA, 15 nt, Homo sapiens
gugcgagugugugca

SEQ ID NO: 396426 - RNA, 17 nt, Homo sapiens
gugcgagugugugcaug

SEQ ID NO: 396427 - RNA, 16 nt, Homo sapiens
gugcgugcaugugcac

SEQ ID NO: 396428 - RNA, 14 nt, Homo sapiens
gugcgugugugcaa

SEQ ID NO: 396429 - RNA, 18 nt, Homo sapiens
gugcuacaaaaacacagc

SEQ ID NO: 396430 - RNA, 18 nt, Homo sapiens
guggacuuagaaagcagg

SEQ ID NO: 396431 - RNA, 17 nt, Homo sapiens
guggagaaacuguaguc

SEQ ID NO: 396432 - RNA, 16 nt, Homo sapiens
guggagguugcaguga

SEQ ID NO: 396433 - RNA, 23 nt, Homo sapiens
guggaucaccugaggucaggagu

SEQ ID NO: 396434 - RNA, 22 nt, Homo sapiens
guggcaagcugugacuucucca

SEQ ID NO: 396435 - RNA, 13 nt, Homo sapiens
guggccaguauuu

SEQ ID NO: 396436 - RNA, 19 nt, Homo sapiens
guggcccagggaagccaaa

SEQ ID NO: 396437 - RNA, 22 nt, Homo sapiens
guggcccugucccucccaccuc

SEQ ID NO: 396438 - RNA, 14 nt, Homo sapiens
guggcgacucuaua

SEQ ID NO: 396439 - RNA, 18 nt, Homo sapiens
guggcuucccgcucagcc

SEQ ID NO: 396440 - RNA, 17 nt, Homo sapiens
gugggaccacagacuca

SEQ ID NO: 396441 - RNA, 20 nt, Homo sapiens
gugggaggggcgcccaccuc

SEQ ID NO: 396442 - RNA, 15 nt, Homo sapiens
gugggccacagccau

SEQ ID NO: 396443 - RNA, 16 nt, Homo sapiens
guggggcagcacagag

SEQ ID NO: 396444 - RNA, 21 nt, Homo sapiens
gugggguaaccaaauguuggc

SEQ ID NO: 396445 - RNA, 17 nt, Homo sapiens
guguaauuuuguucuag

SEQ ID NO: 396446 - RNA, 16 nt, Homo sapiens
guguaguaaaguauca

SEQ ID NO: 396447 - RNA, 21 nt, Homo sapiens
guguaugugcgugugugcaag

SEQ ID NO: 396448 - RNA, 15 nt, Homo sapiens
gugucaccugugcuu

SEQ ID NO: 396449 - RNA, 15 nt, Homo sapiens
gugugagugugugca

SEQ ID NO: 396450 - RNA, 20 nt, Homo sapiens
gugugcaagugugugcacau

SEQ ID NO: 396451 - RNA, 18 nt, Homo sapiens
gugugcaagugugugcau

SEQ ID NO: 396452 - RNA, 20 nt, Homo sapiens
gugugccauagaguuuaaca

SEQ ID NO: 396453 - RNA, 15 nt, Homo sapiens
gugugcgucacugug

SEQ ID NO: 396454 - RNA, 14 nt, Homo sapiens
gugugcgugcaugu

SEQ ID NO: 396455 - RNA, 21 nt, Homo sapiens
guguguaugugcgugugugca

SEQ ID NO: 396456 - RNA, 22 nt, Homo sapiens
guguguccaccugggcauaucc

SEQ ID NO: 396457 - RNA, 20 nt, Homo sapiens
guguguccaugugugugcaa

SEQ ID NO: 396458 - RNA, 17 nt, Homo sapiens
gugugugcgugugucca

SEQ ID NO: 396459 - RNA, 22 nt, Homo sapiens
gugugugguggggacaacagca

SEQ ID NO: 396460 - RNA, 21 nt, Homo sapiens
guguuauuguauuagguguca

SEQ ID NO: 396461 - RNA, 21 nt, Homo sapiens
guuaagcagauggaaugcugu

SEQ ID NO: 396462 - RNA, 20 nt, Homo sapiens
guuacuguggccaguauuuu

SEQ ID NO: 396463 - RNA, 17 nt, Homo sapiens
guuaggaaaauuucaca

SEQ ID NO: 396464 - RNA, 15 nt, Homo sapiens
guuagugauggagcu

SEQ ID NO: 396465 - RNA, 18 nt, Homo sapiens
guuaugccgcuagauaca

SEQ ID NO: 396466 - RNA, 19 nt, Homo sapiens
guuauuuugcuauuugccu

SEQ ID NO: 396467 - RNA, 13 nt, Homo sapiens
guucaccagguca

SEQ ID NO: 396468 - RNA, 16 nt, Homo sapiens
guucaccuugggauga

SEQ ID NO: 396469 - RNA, 14 nt, Homo sapiens
guuccccacugaca

SEQ ID NO: 396470 - RNA, 21 nt, Homo sapiens
guucuauauaaaaaacauaau

SEQ ID NO: 396471 - RNA, 17 nt, Homo sapiens
guucuauuuguauauau

SEQ ID NO: 396472 - RNA, 20 nt, Homo sapiens
guucucagguguugccaaau

SEQ ID NO: 396473 - RNA, 20 nt, Homo sapiens
guucucuucuuuaaagggau

SEQ ID NO: 396474 - RNA, 14 nt, Homo sapiens
guucugaguguuuu

SEQ ID NO: 396475 - RNA, 19 nt, Homo sapiens
guugaaaaaguucugcaga

SEQ ID NO: 396476 - RNA, 19 nt, Homo sapiens
guugagucgucaucacuuu

SEQ ID NO: 396477 - RNA, 19 nt, Homo sapiens
guugauucagcucugcaag

SEQ ID NO: 396478 - RNA, 20 nt, Homo sapiens
guuggaagugagggucagag

SEQ ID NO: 396479 - RNA, 21 nt, Homo sapiens
guuggacacccagugccaggg

SEQ ID NO: 396480 - RNA, 16 nt, Homo sapiens
guuggagcuacugcaa

SEQ ID NO: 396481 - RNA, 12 nt, Homo sapiens
guuggcuucuaa

SEQ ID NO: 396482 - RNA, 23 nt, Homo sapiens
guuguucucuucuuuaaagggau

SEQ ID NO: 396483 - RNA, 21 nt, Homo sapiens
guuuacuucucaccauuugag

SEQ ID NO: 396484 - RNA, 18 nt, Homo sapiens
guuuagcccaaaaccaag

SEQ ID NO: 396485 - RNA, 13 nt, Homo sapiens
guuuaugucauca

SEQ ID NO: 396486 - RNA, 15 nt, Homo sapiens
guuuaugucaucaua

SEQ ID NO: 396487 - RNA, 17 nt, Homo sapiens
guuucacacuagucaca

SEQ ID NO: 396488 - RNA, 21 nt, Homo sapiens
guuucauuuagucaugugacc

SEQ ID NO: 396489 - RNA, 15 nt, Homo sapiens
guuucccuaucucga

SEQ ID NO: 396490 - RNA, 20 nt, Homo sapiens
guuucugaucugaugcaagc

SEQ ID NO: 396491 - RNA, 23 nt, Homo sapiens
guuucuggcagccaguaccuccu

SEQ ID NO: 396492 - RNA, 18 nt, Homo sapiens
guuugcagaaaagcaccu

SEQ ID NO: 396493 - RNA, 17 nt, Homo sapiens
guuugcagaugacaaaa

SEQ ID NO: 396494 - RNA, 16 nt, Homo sapiens
guuugcuuagcauucc

SEQ ID NO: 396495 - RNA, 17 nt, Homo sapiens
guuuuaaaaaaucucaa

SEQ ID NO: 396496 - RNA, 14 nt, Homo sapiens
guuuuacugcagcu

SEQ ID NO: 396497 - RNA, 19 nt, Homo sapiens
guuuuuaaaaaacugcuga

SEQ ID NO: 396498 - RNA, 13 nt, Homo sapiens
guuuuuacuguga

SEQ ID NO: 396499 - RNA, 20 nt, Homo sapiens
guuuuuaugaggugggauau

SEQ ID NO: 396500 - RNA, 20 nt, Homo sapiens
guuuuuucaucauaacauaa

SEQ ID NO: 396501 - RNA, 23 nt, Homo sapiens
guuuuuuuuuuccacuuagaaau

SEQ ID NO: 396502 - RNA, 22 nt, Homo sapiens
uaaaaaaaacaaaaagaacaaa

SEQ ID NO: 396503 - RNA, 19 nt, Homo sapiens
uaaaaaaauacaugcaucu

SEQ ID NO: 396504 - RNA, 19 nt, Homo sapiens
uaaaaaccaagaagauguc

SEQ ID NO: 396505 - RNA, 11 nt, Homo sapiens
uaaaacaaaca

SEQ ID NO: 396506 - RNA, 22 nt, Homo sapiens
uaaaacagccaaaacuccacag

SEQ ID NO: 396507 - RNA, 22 nt, Homo sapiens
uaaaacagguggagaaauuccu

SEQ ID NO: 396508 - RNA, 17 nt, Homo sapiens
uaaaaccugugugccau

SEQ ID NO: 396509 - RNA, 18 nt, Homo sapiens
uaaaaccugugugccauu

SEQ ID NO: 396510 - RNA, 16 nt, Homo sapiens
uaaaagaaaucuucau

SEQ ID NO: 396511 - RNA, 19 nt, Homo sapiens
uaaaagaaccgagcaauuu

SEQ ID NO: 396512 - RNA, 21 nt, Homo sapiens
uaaaagaauaaaauugcacuu

SEQ ID NO: 396513 - RNA, 14 nt, Homo sapiens
uaaaauaaaugcaa

SEQ ID NO: 396514 - RNA, 19 nt, Homo sapiens
ugccccgugcagacuggag

SEQ ID NO: 396515 - RNA, 17 nt, Homo sapiens
ugcccguaaacacgccu

SEQ ID NO: 396516 - RNA, 19 nt, Homo sapiens
ugcccugggauguccacag

SEQ ID NO: 396517 - RNA, 17 nt, Homo sapiens
ugccguaacaacugugg

SEQ ID NO: 396518 - RNA, 22 nt, Homo sapiens
ugccucagccuccugaguaguu

SEQ ID NO: 396519 - RNA, 23 nt, Homo sapiens
ugccucuugaaugcagggacaaa

SEQ ID NO: 396520 - RNA, 22 nt, Homo sapiens
ugccugcggaguugugcacgua

SEQ ID NO: 396521 - RNA, 20 nt, Homo sapiens
ugccuguucccauucuugca

SEQ ID NO: 396522 - RNA, 15 nt, Homo sapiens
ugccuucaccuccuc

SEQ ID NO: 396523 - RNA, 18 nt, Homo sapiens
ugccuuccagcacccugc

SEQ ID NO: 396524 - RNA, 18 nt, Homo sapiens
ugccuucuccagacaaac

SEQ ID NO: 396525 - RNA, 15 nt, Homo sapiens
ugcgccauugcacuc

SEQ ID NO: 396526 - RNA, 16 nt, Homo sapiens
ugcggaguugugcacg

SEQ ID NO: 396527 - RNA, 13 nt, Homo sapiens
ugcggcaucagau

SEQ ID NO: 396528 - RNA, 16 nt, Homo sapiens
ugcggucccuucuuac

SEQ ID NO: 396529 - RNA, 11 nt, Homo sapiens
ugcgucacugu

SEQ ID NO: 396530 - RNA, 13 nt, Homo sapiens
ugcgugcaugugc

SEQ ID NO: 396531 - RNA, 14 nt, Homo sapiens
ugcgugcaugugca

SEQ ID NO: 396532 - RNA, 14 nt, Homo sapiens
ugcgugugugcaag

SEQ ID NO: 396533 - RNA, 16 nt, Homo sapiens
ugcguuagaaugagga

SEQ ID NO: 396534 - RNA, 13 nt, Homo sapiens
ugcuaaaugugaa

SEQ ID NO: 396535 - RNA, 13 nt, Homo sapiens
ugcuaagugaaau

SEQ ID NO: 396536 - RNA, 16 nt, Homo sapiens
ugcuaccucacugggg

SEQ ID NO: 396537 - RNA, 18 nt, Homo sapiens
ugcuauauugcacuguga

SEQ ID NO: 396538 - RNA, 15 nt, Homo sapiens
ugcuauuucacucua

SEQ ID NO: 396539 - RNA, 22 nt, Homo sapiens
ugcuccgucuaagucaugagcu

SEQ ID NO: 396540 - RNA, 19 nt, Homo sapiens
ugcuccuugggcccuuuga

SEQ ID NO: 396541 - RNA, 18 nt, Homo sapiens
ugcucuugggaagaccag

SEQ ID NO: 396542 - RNA, 20 nt, Homo sapiens
ugcucuugggaagaccagcu

SEQ ID NO: 396543 - RNA, 15 nt, Homo sapiens
ugcucuuucuugacu

SEQ ID NO: 396544 - RNA, 18 nt, Homo sapiens
ugcugaccuccacagcuu

SEQ ID NO: 396545 - RNA, 15 nt, Homo sapiens
ugcugagcauguacu

SEQ ID NO: 396546 - RNA, 19 nt, Homo sapiens
ugcugcugagugcaccacu

SEQ ID NO: 396547 - RNA, 16 nt, Homo sapiens
ugcuggcaaagacaga

SEQ ID NO: 396548 - RNA, 14 nt, Homo sapiens
ugcuggcugccuua

SEQ ID NO: 396549 - RNA, 14 nt, Homo sapiens
ugcuuaaucuugcu

SEQ ID NO: 396550 - RNA, 15 nt, Homo sapiens
ugcuuacaaaugucu

SEQ ID NO: 396551 - RNA, 14 nt, Homo sapiens
ugcuugaaccuggg

SEQ ID NO: 396552 - RNA, 21 nt, Homo sapiens
ugcuuguuugcucaccugggg

SEQ ID NO: 396553 - RNA, 16 nt, Homo sapiens
ugcuuuggaaaucaca

SEQ ID NO: 396554 - RNA, 19 nt, Homo sapiens
ugcuuuucccuaagccaag

SEQ ID NO: 396555 - RNA, 20 nt, Homo sapiens
uggaaacgcaaaugaguauu

SEQ ID NO: 396556 - RNA, 19 nt, Homo sapiens
uggaaagaaaacacacucc

SEQ ID NO: 396557 - RNA, 23 nt, Homo sapiens
uggaaaugaaacugcugugaaug

SEQ ID NO: 396558 - RNA, 14 nt, Homo sapiens
uggaagaguaguaa

SEQ ID NO: 396559 - RNA, 17 nt, Homo sapiens
uggaagaguaguaauag

SEQ ID NO: 396560 - RNA, 18 nt, Homo sapiens
uggaagcuguguccuugc

SEQ ID NO: 396561 - RNA, 16 nt, Homo sapiens
uggaaugguaggauau

SEQ ID NO: 396562 - RNA, 20 nt, Homo sapiens
uggaauucuaacaagucaua

SEQ ID NO: 396563 - RNA, 14 nt, Homo sapiens
uggacauuugccuu

SEQ ID NO: 396564 - RNA, 15 nt, Homo sapiens
uggaccuguucaaaa

SEQ ID NO: 396565 - RNA, 23 nt, Homo sapiens
uggagaaacccuugaaaagacau

SEQ ID NO: 396566 - RNA, 19 nt, Homo sapiens
uggagaaacuguagucuca

SEQ ID NO: 396567 - RNA, 12 nt, Homo sapiens
uggagagccacc

SEQ ID NO: 396568 - RNA, 22 nt, Homo sapiens
uggagccaccaugcccagcuca

SEQ ID NO: 396569 - RNA, 23 nt, Homo sapiens
uggagcugcguuuccugugcaug

SEQ ID NO: 396570 - RNA, 15 nt, Homo sapiens
uggaggaaaacugag

SEQ ID NO: 396571 - RNA, 16 nt, Homo sapiens
uggaggcacacagcug

SEQ ID NO: 396572 - RNA, 23 nt, Homo sapiens
uggaggguugaccccuggucuca

SEQ ID NO: 396573 - RNA, 18 nt, Homo sapiens
uggaggucaggaguuuga

SEQ ID NO: 396574 - RNA, 15 nt, Homo sapiens
uggaguccagucucu

SEQ ID NO: 396575 - RNA, 18 nt, Homo sapiens
uggaguccgaugauucuc

SEQ ID NO: 396576 - RNA, 17 nt, Homo sapiens
uggauaaaauaaaugca

SEQ ID NO: 396577 - RNA, 13 nt, Homo sapiens
uggauaaguagaa

SEQ ID NO: 396578 - RNA, 18 nt, Homo sapiens
uggauaucaaaagcaaau

SEQ ID NO: 396579 - RNA, 14 nt, Homo sapiens
uggaugcagaucca

SEQ ID NO: 396580 - RNA, 13 nt, Homo sapiens
uggaugcuccuuc

SEQ ID NO: 396581 - RNA, 14 nt, Homo sapiens
uggauuauucauuu

SEQ ID NO: 396582 - RNA, 20 nt, Homo sapiens
uggauucuucccacacagaa

SEQ ID NO: 396583 - RNA, 20 nt, Homo sapiens
uggauugugggaauuaagga

SEQ ID NO: 396584 - RNA, 23 nt, Homo sapiens
uggauuuggguuggaagugaggg

SEQ ID NO: 396585 - RNA, 20 nt, Homo sapiens
uggcaaugaaaaauucucag

SEQ ID NO: 396586 - RNA, 14 nt, Homo sapiens
uggcagaaagcaaa

SEQ ID NO: 396587 - RNA, 16 nt, Homo sapiens
uggcagcauacacaga

SEQ ID NO: 396588 - RNA, 17 nt, Homo sapiens
uggcagcauacacagau

SEQ ID NO: 396589 - RNA, 14 nt, Homo sapiens
uggcagccaguacc

SEQ ID NO: 396590 - RNA, 12 nt, Homo sapiens
uggcaugccuuc

SEQ ID NO: 396591 - RNA, 14 nt, Homo sapiens
uggccaaagaccaa

SEQ ID NO: 396592 - RNA, 21 nt, Homo sapiens
uggccagcccuggaggguuga

SEQ ID NO: 396593 - RNA, 22 nt, Homo sapiens
uggccaggguaguaagaauuag

SEQ ID NO: 396594 - RNA, 13 nt, Homo sapiens
uggcccacgcacu

SEQ ID NO: 396595 - RNA, 14 nt, Homo sapiens
uggccccaugucuc

SEQ ID NO: 396596 - RNA, 23 nt, Homo sapiens
uggcccucaguuucccuaucucg

SEQ ID NO: 396597 - RNA, 14 nt, Homo sapiens
uggcccuucuugcc

SEQ ID NO: 396598 - RNA, 17 nt, Homo sapiens
uggccuccccugcugaa

SEQ ID NO: 396599 - RNA, 19 nt, Homo sapiens
uggccugcugggcucucca

SEQ ID NO: 396600 - RNA, 22 nt, Homo sapiens
uggccuguaaucccagcuacuu

SEQ ID NO: 396601 - RNA, 19 nt, Homo sapiens
uggcuaaaaccaucauagu

SEQ ID NO: 396602 - RNA, 16 nt, Homo sapiens
uggcuaagaguguccu

SEQ ID NO: 396603 - RNA, 15 nt, Homo sapiens
uguaauggaucuuaa

SEQ ID NO: 396604 - RNA, 17 nt, Homo sapiens
uguaauguuauuuccac

SEQ ID NO: 396605 - RNA, 13 nt, Homo sapiens
uguaccauguaca

SEQ ID NO: 396606 - RNA, 19 nt, Homo sapiens
uguacuuuaaaaagaugua

SEQ ID NO: 396607 - RNA, 17 nt, Homo sapiens
uguagaagccacuauua

SEQ ID NO: 396608 - RNA, 17 nt, Homo sapiens
uguagauggcggugaug

SEQ ID NO: 396609 - RNA, 22 nt, Homo sapiens
uguagccucgccgucugugaau

SEQ ID NO: 396610 - RNA, 19 nt, Homo sapiens
uguagguaauauuguucua

SEQ ID NO: 396611 - RNA, 22 nt, Homo sapiens
uguagucccagcuacucaggag

SEQ ID NO: 396612 - RNA, 14 nt, Homo sapiens
uguagucucaggac

SEQ ID NO: 396613 - RNA, 15 nt, Homo sapiens
uguauaaacuaucag

SEQ ID NO: 396614 - RNA, 12 nt, Homo sapiens
uguauacugugg

SEQ ID NO: 396615 - RNA, 23 nt, Homo sapiens
uguauccccccccuguauaguua

SEQ ID NO: 396616 - RNA, 21 nt, Homo sapiens
uguaugauccuaaugaaugca

SEQ ID NO: 396617 - RNA, 18 nt, Homo sapiens
uguaugcacgugugcaca

SEQ ID NO: 396618 - RNA, 12 nt, Homo sapiens
uguaugcacuuu

SEQ ID NO: 396619 - RNA, 16 nt, Homo sapiens
uguaugugcgugugug

SEQ ID NO: 396620 - RNA, 17 nt, Homo sapiens
uguauuagucacagaga

SEQ ID NO: 396621 - RNA, 17 nt, Homo sapiens
uguauucacccguccag

SEQ ID NO: 396622 - RNA, 21 nt, Homo sapiens
uguauucucugagcugugcag

SEQ ID NO: 396623 - RNA, 17 nt, Homo sapiens
uguauucuucaaccuca

SEQ ID NO: 396624 - RNA, 19 nt, Homo sapiens
ugucacuacgugacugugg

SEQ ID NO: 396625 - RNA, 18 nt, Homo sapiens
uguccaugugugugcaag

SEQ ID NO: 396626 - RNA, 22 nt, Homo sapiens
ugucccacucaagccaagcagc

SEQ ID NO: 396627 - RNA, 16 nt, Homo sapiens
uguccccuccacuguc

SEQ ID NO: 396628 - RNA, 21 nt, Homo sapiens
uguccccuuuuauugcugcuu

SEQ ID NO: 396629 - RNA, 20 nt, Homo sapiens
ugucccggggcuccacugaa

SEQ ID NO: 396630 - RNA, 18 nt, Homo sapiens
ugucccucacagcacuag

SEQ ID NO: 396631 - RNA, 15 nt, Homo sapiens
ugucccucccaccuc

SEQ ID NO: 396632 - RNA, 22 nt, Homo sapiens
ugucccuugccucaaugccagu

SEQ ID NO: 396633 - RNA, 17 nt, Homo sapiens
ugucgucuuagcaagaa

SEQ ID NO: 396634 - RNA, 18 nt, Homo sapiens
ugucgucuuagcaagaag

SEQ ID NO: 396635 - RNA, 16 nt, Homo sapiens
ugucuaauaguuauuc

SEQ ID NO: 396636 - RNA, 18 nt, Homo sapiens
ugucuacguuaccaggca

SEQ ID NO: 396637 - RNA, 19 nt, Homo sapiens
ugucuagguccccacugcc

SEQ ID NO: 396638 - RNA, 14 nt, Homo sapiens
ugucucagccuccc

SEQ ID NO: 396639 - RNA, 12 nt, Homo sapiens
ugucucauauga

SEQ ID NO: 396640 - RNA, 19 nt, Homo sapiens
ugucugccagccagcagcc

SEQ ID NO: 396641 - RNA, 14 nt, Homo sapiens
ugucugugugcaag

SEQ ID NO: 396642 - RNA, 18 nt, Homo sapiens
ugucuuguguuuccacag

SEQ ID NO: 396643 - RNA, 22 nt, Homo sapiens
ugucuuuaaaaguauccagaga

SEQ ID NO: 396644 - RNA, 13 nt, Homo sapiens
ugucuuucacuga

SEQ ID NO: 396645 - RNA, 20 nt, Homo sapiens
ugugaccaaugucuugaugc

SEQ ID NO: 396646 - RNA, 20 nt, Homo sapiens
ugugaccagucugacccuua

SEQ ID NO: 396647 - RNA, 16 nt, Homo sapiens
ugugaccugugucacu

SEQ ID NO: 396648 - RNA, 20 nt, Homo sapiens
ugugacuugaacuagauugc

SEQ ID NO: 396649 - RNA, 18 nt, Homo sapiens
ugugagaauaaacuagac

SEQ ID NO: 396650 - RNA, 12 nt, Homo sapiens
ugugagcaagaa

SEQ ID NO: 396651 - RNA, 18 nt, Homo sapiens
ugugaucggccuggggaa

SEQ ID NO: 396652 - RNA, 17 nt, Homo sapiens
ugugauucacaguguga

SEQ ID NO: 396653 - RNA, 22 nt, Homo sapiens
ugugauuccuuugaagaggaaa

SEQ ID NO: 396654 - RNA, 21 nt, Homo sapiens
ugugcaagugucugugugcaa

SEQ ID NO: 396655 - RNA, 14 nt, Homo sapiens
ugugcacaugugug

SEQ ID NO: 396656 - RNA, 18 nt, Homo sapiens
ugugcagcucccauuugg

SEQ ID NO: 396657 - RNA, 20 nt, Homo sapiens
ugugcccagagaugggacug

SEQ ID NO: 396658 - RNA, 12 nt, Homo sapiens
ugugcucaggga

SEQ ID NO: 396659 - RNA, 14 nt, Homo sapiens
uguggcccaagaca

SEQ ID NO: 396660 - RNA, 23 nt, Homo sapiens
uguggcccagggaagccaaaaga

SEQ ID NO: 396661 - RNA, 15 nt, Homo sapiens
uguggccccaacaca

SEQ ID NO: 396662 - RNA, 17 nt, Homo sapiens
uguggcucacgugagag

SEQ ID NO: 396663 - RNA, 17 nt, Homo sapiens
uguggcugcuagcacuu

SEQ ID NO: 396664 - RNA, 21 nt, Homo sapiens
uguggcugcuagcacuuggag

SEQ ID NO: 396665 - RNA, 13 nt, Homo sapiens
ugugggacccgcc

SEQ ID NO: 396666 - RNA, 15 nt, Homo sapiens
ugugggcuccaugua

SEQ ID NO: 396667 - RNA, 21 nt, Homo sapiens
uguggucaauccgaaguauga

SEQ ID NO: 396668 - RNA, 14 nt, Homo sapiens
ugugguuuauguca

SEQ ID NO: 396669 - RNA, 19 nt, Homo sapiens
uguguccaagugugugugc

SEQ ID NO: 396670 - RNA, 19 nt, Homo sapiens
uguguccaugugugugcaa

SEQ ID NO: 396671 - RNA, 21 nt, Homo sapiens
ugugugaucugugggcacauu

SEQ ID NO: 396672 - RNA, 12 nt, Homo sapiens
ugugugccaggg

SEQ ID NO: 396673 - RNA, 15 nt, Homo sapiens
ugugugcgucacugu

SEQ ID NO: 396674 - RNA, 17 nt, Homo sapiens
uguguggggugggcaca

SEQ ID NO: 396675 - RNA, 15 nt, Homo sapiens
ugugugugcaagugu

SEQ ID NO: 396676 - RNA, 21 nt, Homo sapiens
uguguuuccuucagugcaucu

SEQ ID NO: 396677 - RNA, 15 nt, Homo sapiens
uguuacugucuucag

SEQ ID NO: 396678 - RNA, 15 nt, Homo sapiens
uguucagggcuguga

SEQ ID NO: 396679 - RNA, 18 nt, Homo sapiens
uguuccccuuccacugag

SEQ ID NO: 396680 - RNA, 22 nt, Homo sapiens
uguucuaagucuuuccauugga

SEQ ID NO: 396681 - RNA, 13 nt, Homo sapiens
uguugacauccaa

SEQ ID NO: 396682 - RNA, 23 nt, Homo sapiens
uguuuacauaucaccucauggcc

SEQ ID NO: 396683 - RNA, 18 nt, Homo sapiens
uguuuagcccaaaaccaa

SEQ ID NO: 396684 - RNA, 19 nt, Homo sapiens
uacuuaacuauucaggaga

SEQ ID NO: 396685 - RNA, 13 nt, Homo sapiens
uacuuagcagcua

SEQ ID NO: 396686 - RNA, 18 nt, Homo sapiens
uacuuagcagcuaucucu

SEQ ID NO: 396687 - RNA, 21 nt, Homo sapiens
uacuucagcucacacaugaga

SEQ ID NO: 396688 - RNA, 18 nt, Homo sapiens
uacuucuuauacauuuga

SEQ ID NO: 396689 - RNA, 13 nt, Homo sapiens
uacuugagacugu

SEQ ID NO: 396690 - RNA, 18 nt, Homo sapiens
uacuugggaggcugaggc

SEQ ID NO: 396691 - RNA, 14 nt, Homo sapiens
uacuuucauacuga

SEQ ID NO: 396692 - RNA, 19 nt, Homo sapiens
uacuuugaguuagugccau

SEQ ID NO: 396693 - RNA, 14 nt, Homo sapiens
uagaaauuccccac

SEQ ID NO: 396694 - RNA, 19 nt, Homo sapiens
uagaagaugggaaaaccau

SEQ ID NO: 396695 - RNA, 17 nt, Homo sapiens
uagaauauuuauuaccu

SEQ ID NO: 396696 - RNA, 15 nt, Homo sapiens
uagaaugaaagacug

SEQ ID NO: 396697 - RNA, 17 nt, Homo sapiens
uagaauuggagaguaaa

SEQ ID NO: 396698 - RNA, 23 nt, Homo sapiens
uagacacccauuuucacauuccc

SEQ ID NO: 396699 - RNA, 19 nt, Homo sapiens
uagacuuaucugcauauug

SEQ ID NO: 396700 - RNA, 22 nt, Homo sapiens
uagagacgggguuucaccaugu

SEQ ID NO: 396701 - RNA, 13 nt, Homo sapiens
uagagauggagga

SEQ ID NO: 396702 - RNA, 22 nt, Homo sapiens
uagagauggggucucacagugu

SEQ ID NO: 396703 - RNA, 14 nt, Homo sapiens
uagagcacacugua

SEQ ID NO: 396704 - RNA, 21 nt, Homo sapiens
uagaggacuucuggcagggaa

SEQ ID NO: 396705 - RNA, 18 nt, Homo sapiens
uagaguguuaucagucau

SEQ ID NO: 396706 - RNA, 23 nt, Homo sapiens
uagauaaaagaaccgagcaauuu

SEQ ID NO: 396707 - RNA, 17 nt, Homo sapiens
uagaugcugacuguacu

SEQ ID NO: 396708 - RNA, 20 nt, Homo sapiens
uagcaaaauacaugacauuu

SEQ ID NO: 396709 - RNA, 12 nt, Homo sapiens
uagcacauacua

SEQ ID NO: 396710 - RNA, 13 nt, Homo sapiens
uagccaccccaga

SEQ ID NO: 396711 - RNA, 17 nt, Homo sapiens
uagccgaccucagccuu

SEQ ID NO: 396712 - RNA, 17 nt, Homo sapiens
uagcggucaauuugccu

SEQ ID NO: 396713 - RNA, 17 nt, Homo sapiens
uagcuagaagugggcca

SEQ ID NO: 396714 - RNA, 14 nt, Homo sapiens
uagcuuagaccuca

SEQ ID NO: 396715 - RNA, 15 nt, Homo sapiens
uagcuuagaccucag

SEQ ID NO: 396716 - RNA, 13 nt, Homo sapiens
uagcuuuacaaau

SEQ ID NO: 396717 - RNA, 17 nt, Homo sapiens
uaggaaaaguacauuua

SEQ ID NO: 396718 - RNA, 12 nt, Homo sapiens
uaggaacauacu

SEQ ID NO: 396719 - RNA, 14 nt, Homo sapiens
uaggauaucuuggc

SEQ ID NO: 396720 - RNA, 16 nt, Homo sapiens
uaggcagacacaggga

SEQ ID NO: 396721 - RNA, 15 nt, Homo sapiens
uaggcauuugcugaa

SEQ ID NO: 396722 - RNA, 15 nt, Homo sapiens
uagggaugugugaga

SEQ ID NO: 396723 - RNA, 12 nt, Homo sapiens
uagguagcuuua

SEQ ID NO: 396724 - RNA, 11 nt, Homo sapiens
uagguggcaag

SEQ ID NO: 396725 - RNA, 16 nt, Homo sapiens
uaggugugacuugaac

SEQ ID NO: 396726 - RNA, 12 nt, Homo sapiens
uaguaacaugug

SEQ ID NO: 396727 - RNA, 19 nt, Homo sapiens
uaguccgcuuucucuugcu

SEQ ID NO: 396728 - RNA, 14 nt, Homo sapiens
uaguuaaaguaaug

SEQ ID NO: 396729 - RNA, 22 nt, Homo sapiens
uaguucccugaaaacccagaga

SEQ ID NO: 396730 - RNA, 15 nt, Homo sapiens
uaguuguaucucuuu

SEQ ID NO: 396731 - RNA, 17 nt, Homo sapiens
uaguuuaugauuccacc

SEQ ID NO: 396732 - RNA, 13 nt, Homo sapiens
uauaaaaguacua

SEQ ID NO: 396733 - RNA, 19 nt, Homo sapiens
uauaaaccuaaaaaagaua

SEQ ID NO: 396734 - RNA, 21 nt, Homo sapiens
uauaaaugugauugcagcuuu

SEQ ID NO: 396735 - RNA, 21 nt, Homo sapiens
uauaacuaguccuuuacuaau

SEQ ID NO: 396736 - RNA, 19 nt, Homo sapiens
uauaagauucauauuuacu

SEQ ID NO: 396737 - RNA, 18 nt, Homo sapiens
uauaagcauguauauucu

SEQ ID NO: 396738 - RNA, 16 nt, Homo sapiens
uauaauugaguuuuca

SEQ ID NO: 396739 - RNA, 14 nt, Homo sapiens
uauaguacuggcau

SEQ ID NO: 396740 - RNA, 16 nt, Homo sapiens
uauauaacaacaaacu

SEQ ID NO: 396741 - RNA, 22 nt, Homo sapiens
uauauaagauggaagcuuccag

SEQ ID NO: 396742 - RNA, 15 nt, Homo sapiens
uauauaaguguacau

SEQ ID NO: 396743 - RNA, 17 nt, Homo sapiens
uauauaguaugaaugca

SEQ ID NO: 396744 - RNA, 21 nt, Homo sapiens
uauauauuuuugugcacauuu

SEQ ID NO: 396745 - RNA, 15 nt, Homo sapiens
uauaucccauugaaa

SEQ ID NO: 396746 - RNA, 17 nt, Homo sapiens
uauaucgcuuaaucuua

SEQ ID NO: 396747 - RNA, 16 nt, Homo sapiens
uauauucauccaugcc

SEQ ID NO: 396748 - RNA, 13 nt, Homo sapiens
uauauucauuuca

SEQ ID NO: 396749 - RNA, 15 nt, Homo sapiens
uaucaauuuccucau

SEQ ID NO: 396750 - RNA, 15 nt, Homo sapiens
uaucaccucauggcc

SEQ ID NO: 396751 - RNA, 14 nt, Homo sapiens
uaucacgauauuau

SEQ ID NO: 396752 - RNA, 22 nt, Homo sapiens
uaucagccugucucuuccauau

SEQ ID NO: 396753 - RNA, 15 nt, Homo sapiens
uaucaggguauucca

SEQ ID NO: 396754 - RNA, 19 nt, Homo sapiens
uaucauuuucugcauuuaa

SEQ ID NO: 396755 - RNA, 14 nt, Homo sapiens
uauccaacaugugc

SEQ ID NO: 396756 - RNA, 19 nt, Homo sapiens
uauccaagaaucagugaag

SEQ ID NO: 396757 - RNA, 13 nt, Homo sapiens
uauccaccaccuc

SEQ ID NO: 396758 - RNA, 15 nt, Homo sapiens
uaucccuaugcugcc

SEQ ID NO: 396759 - RNA, 20 nt, Homo sapiens
uauccgaacuuuaauuucag

SEQ ID NO: 396760 - RNA, 12 nt, Homo sapiens
uaucuacuuuag

SEQ ID NO: 396761 - RNA, 24 nt, Homo sapiens
uaucuacuuuagagucuucuccaa

SEQ ID NO: 396762 - RNA, 16 nt, Homo sapiens
uaucuugcaccccaaa

SEQ ID NO: 396763 - RNA, 19 nt, Homo sapiens
uaucuugcaccccaaagcu

SEQ ID NO: 396764 - RNA, 23 nt, Homo sapiens
uaugagacguuuuuggaagagua

SEQ ID NO: 396765 - RNA, 23 nt, Homo sapiens
uaugaggaugcagagucagcaga

SEQ ID NO: 396766 - RNA, 23 nt, Homo sapiens
uaugaguuuuugauagcuuuauu

SEQ ID NO: 396767 - RNA, 14 nt, Homo sapiens
uaugauugugcaca

SEQ ID NO: 396768 - RNA, 12 nt, Homo sapiens
uaugccauagca

SEQ ID NO: 396769 - RNA, 18 nt, Homo sapiens
uaugccauagcaagauug

SEQ ID NO: 396770 - RNA, 15 nt, Homo sapiens
uaugcuaagugaaau

SEQ ID NO: 396771 - RNA, 18 nt, Homo sapiens
uaugcucagggucaauuu

SEQ ID NO: 396772 - RNA, 13 nt, Homo sapiens
uauguaacaugua

SEQ ID NO: 396773 - RNA, 19 nt, Homo sapiens
uauguaccauguacaugaa

SEQ ID NO: 396774 - RNA, 22 nt, Homo sapiens
uauguagcaaaauacaugacau

SEQ ID NO: 396775 - RNA, 13 nt, Homo sapiens
uauguauggaaua

SEQ ID NO: 396776 - RNA, 20 nt, Homo sapiens
uaugucacccaaugcauauc

SEQ ID NO: 396777 - RNA, 13 nt, Homo sapiens
uaugucaucauac

SEQ ID NO: 396778 - RNA, 23 nt, Homo sapiens
uaugugaguguguccaagugugu

SEQ ID NO: 396779 - RNA, 19 nt, Homo sapiens
uaugugggugggaccacag

SEQ ID NO: 396780 - RNA, 12 nt, Homo sapiens
uauguguaaaau

SEQ ID NO: 396781 - RNA, 13 nt, Homo sapiens
uauguguguauau

SEQ ID NO: 396782 - RNA, 22 nt, Homo sapiens
uauguucaacuggagacacuau

SEQ ID NO: 396783 - RNA, 17 nt, Homo sapiens
uauguuuacuucucacc

SEQ ID NO: 396784 - RNA, 15 nt, Homo sapiens
uauuaagauuuccaa

SEQ ID NO: 396785 - RNA, 15 nt, Homo sapiens
uauuaagccacuuaa

SEQ ID NO: 396786 - RNA, 20 nt, Homo sapiens
uauuaaggaagacaauguga

SEQ ID NO: 396787 - RNA, 16 nt, Homo sapiens
uauuauaaaaguacua

SEQ ID NO: 396788 - RNA, 13 nt, Homo sapiens
uauucaauggaaa

SEQ ID NO: 396789 - RNA, 19 nt, Homo sapiens
uauucaauggaaagcugcu

SEQ ID NO: 396790 - RNA, 12 nt, Homo sapiens
uauucagcuuua

SEQ ID NO: 396791 - RNA, 22 nt, Homo sapiens
uauuccuaaauaaauggauaag

SEQ ID NO: 396792 - RNA, 15 nt, Homo sapiens
uauucugauuccacu

SEQ ID NO: 396793 - RNA, 21 nt, Homo sapiens
uauucuuuaaauuucaucuca

SEQ ID NO: 396794 - RNA, 15 nt, Homo sapiens
uauugcagcuuauau

SEQ ID NO: 396795 - RNA, 16 nt, Homo sapiens
uauugcauaauuuaua

SEQ ID NO: 396796 - RNA, 21 nt, Homo sapiens
uauugcugcuggggcucccca

SEQ ID NO: 396797 - RNA, 19 nt, Homo sapiens
uauuuaacuggcuucagcc

SEQ ID NO: 396798 - RNA, 14 nt, Homo sapiens
uauuuaaguucaua

SEQ ID NO: 396799 - RNA, 21 nt, Homo sapiens
uauuuauagucgaacaauuca

SEQ ID NO: 396800 - RNA, 21 nt, Homo sapiens
uauuuauauauuuauaacuca

SEQ ID NO: 396801 - RNA, 16 nt, Homo sapiens
uauuuaucugugcaaa

SEQ ID NO: 396802 - RNA, 17 nt, Homo sapiens
uauuuaugccucuguau

SEQ ID NO: 396803 - RNA, 13 nt, Homo sapiens
uauuuauuuacug

SEQ ID NO: 396804 - RNA, 16 nt, Homo sapiens
uauuucugaaucgaga

SEQ ID NO: 396805 - RNA, 20 nt, Homo sapiens
uauuucuuacaggcacaaaa

SEQ ID NO: 396806 - RNA, 16 nt, Homo sapiens
uauuugauaacaguua

SEQ ID NO: 396807 - RNA, 19 nt, Homo sapiens
uauuuuauucccuuucaca

SEQ ID NO: 396808 - RNA, 22 nt, Homo sapiens
uauuuugccagugggaacuccu

SEQ ID NO: 396809 - RNA, 23 nt, Homo sapiens
uauuuuucaaagauguguugcua

SEQ ID NO: 396810 - RNA, 14 nt, Homo sapiens
ucaaaaacagcaga

SEQ ID NO: 396811 - RNA, 20 nt, Homo sapiens
ucaaaacuucagacauagaa

SEQ ID NO: 396812 - RNA, 15 nt, Homo sapiens
ucaaacaaagccaga

SEQ ID NO: 396813 - RNA, 18 nt, Homo sapiens
ucaaaccauaaacuucau

SEQ ID NO: 396814 - RNA, 14 nt, Homo sapiens
ucaaacuacuggca

SEQ ID NO: 396815 - RNA, 22 nt, Homo sapiens
ucaaaggugauugugccaggcu

SEQ ID NO: 396816 - RNA, 16 nt, Homo sapiens
ucaaaguaaaacuugc

SEQ ID NO: 396817 - RNA, 12 nt, Homo sapiens
ucaaaucuccag

SEQ ID NO: 396818 - RNA, 16 nt, Homo sapiens
ucaaauguuguucucu

SEQ ID NO: 396819 - RNA, 19 nt, Homo sapiens
ucaacaucuuuuacauucu

SEQ ID NO: 396820 - RNA, 15 nt, Homo sapiens
ucaaccaauguagaa

SEQ ID NO: 396821 - RNA, 23 nt, Homo sapiens
ucaaccauccccuccguggcauc

SEQ ID NO: 396822 - RNA, 22 nt, Homo sapiens
ucaacugaaaagacucaguguu

SEQ ID NO: 396823 - RNA, 18 nt, Homo sapiens
ucaagcagggaagcccca

SEQ ID NO: 396824 - RNA, 18 nt, Homo sapiens
ucaagcccuuuacuugac

SEQ ID NO: 396825 - RNA, 11 nt, Homo sapiens
ucaagcugcac

SEQ ID NO: 396826 - RNA, 15 nt, Homo sapiens
ucaaggcugcaguga

SEQ ID NO: 396827 - RNA, 16 nt, Homo sapiens
ucaaguuggcuucuaa

SEQ ID NO: 396828 - RNA, 20 nt, Homo sapiens
ucaaguuuuucagaaagcau

SEQ ID NO: 396829 - RNA, 19 nt, Homo sapiens
ucaaucaucugugugaaaa

SEQ ID NO: 396830 - RNA, 12 nt, Homo sapiens
ucaauccagcua

SEQ ID NO: 396831 - RNA, 19 nt, Homo sapiens
ucccagcuauuccuacucu

SEQ ID NO: 396832 - RNA, 9 nt, Homo sapiens
ucccagugc

SEQ ID NO: 396833 - RNA, 18 nt, Homo sapiens
ucccaucugucaccaauu

SEQ ID NO: 396834 - RNA, 12 nt, Homo sapiens
uccccacugcuc

SEQ ID NO: 396835 - RNA, 15 nt, Homo sapiens
uccccacugcucauu

SEQ ID NO: 396836 - RNA, 16 nt, Homo sapiens
uccccagguguguugg

SEQ ID NO: 396837 - RNA, 22 nt, Homo sapiens
uccccagguguguuggggccuu

SEQ ID NO: 396838 - RNA, 17 nt, Homo sapiens
ucccccagcagccuggg

SEQ ID NO: 396839 - RNA, 13 nt, Homo sapiens
uccccuccacugu

SEQ ID NO: 396840 - RNA, 22 nt, Homo sapiens
uccccugcugaagguggggauu

SEQ ID NO: 396841 - RNA, 15 nt, Homo sapiens
uccccuuggcuguga

SEQ ID NO: 396842 - RNA, 20 nt, Homo sapiens
ucccggcgucccuaccuccu

SEQ ID NO: 396843 - RNA, 14 nt, Homo sapiens
ucccuaaaaacaca

SEQ ID NO: 396844 - RNA, 15 nt, Homo sapiens
ucccucaaagcacac

SEQ ID NO: 396845 - RNA, 13 nt, Homo sapiens
ucccucaacccca

SEQ ID NO: 396846 - RNA, 16 nt, Homo sapiens
ucccucacagcacuag

SEQ ID NO: 396847 - RNA, 15 nt, Homo sapiens
ucccucaucuguccc

SEQ ID NO: 396848 - RNA, 19 nt, Homo sapiens
ucccucuaauuuaucuugu

SEQ ID NO: 396849 - RNA, 23 nt, Homo sapiens
ucccugaaguaagcaaagacuuu

SEQ ID NO: 396850 - RNA, 14 nt, Homo sapiens
ucccuguaaccucu

SEQ ID NO: 396851 - RNA, 19 nt, Homo sapiens
ucccuucucuuaauuuaau

SEQ ID NO: 396852 - RNA, 15 nt, Homo sapiens
ucccuugguggcaag

SEQ ID NO: 396853 - RNA, 22 nt, Homo sapiens
ucccuuuccagauauucaaguc

SEQ ID NO: 396854 - RNA, 13 nt, Homo sapiens
ucccuuucuuccc

SEQ ID NO: 396855 - RNA, 17 nt, Homo sapiens
ucccuuuuuauauccca

SEQ ID NO: 396856 - RNA, 23 nt, Homo sapiens
ucccuuuuuauaucccauuuuua

SEQ ID NO: 396857 - RNA, 20 nt, Homo sapiens
uccgcaguuccugucccuuc

SEQ ID NO: 396858 - RNA, 15 nt, Homo sapiens
uccggcagccuggau

SEQ ID NO: 396859 - RNA, 19 nt, Homo sapiens
uccgugaacuugugagaac

SEQ ID NO: 396860 - RNA, 17 nt, Homo sapiens
uccuaaaguagacuuca

SEQ ID NO: 396861 - RNA, 13 nt, Homo sapiens
uccuaaucaucca

SEQ ID NO: 396862 - RNA, 14 nt, Homo sapiens
uccuacaagcuaaa

SEQ ID NO: 396863 - RNA, 22 nt, Homo sapiens
uccucauuuuugaauacaggca

SEQ ID NO: 396864 - RNA, 14 nt, Homo sapiens
uccuccaugggaga

SEQ ID NO: 396865 - RNA, 17 nt, Homo sapiens
guccccuccacugucac

SEQ ID NO: 396866 - RNA, 20 nt, Homo sapiens
gucccggggcuccacugaac

SEQ ID NO: 396867 - RNA, 13 nt, Homo sapiens
gucccuuggagac

SEQ ID NO: 396868 - RNA, 21 nt, Homo sapiens
agcuuugagcuuaagaauuuu

SEQ ID NO: 396869 - RNA, 15 nt, Homo sapiens
aggaaaaaaaugacu

SEQ ID NO: 396870 - RNA, 17 nt, Homo sapiens
aggaaaaaauuaauacu

SEQ ID NO: 396871 - RNA, 20 nt, Homo sapiens
aggaaaaaccaauagcuuua

SEQ ID NO: 396872 - RNA, 15 nt, Homo sapiens
aggaaaauuucacau

SEQ ID NO: 396873 - RNA, 15 nt, Homo sapiens
aggaaagcauguauu

SEQ ID NO: 396874 - RNA, 21 nt, Homo sapiens
aggaaagugauuuuuuuccac

SEQ ID NO: 396875 - RNA, 14 nt, Homo sapiens
aggaaccucagggc

SEQ ID NO: 396876 - RNA, 23 nt, Homo sapiens
aggaagaagucuaagagugaagu

SEQ ID NO: 396877 - RNA, 20 nt, Homo sapiens
aggaagccucccacgacugc

SEQ ID NO: 396878 - RNA, 20 nt, Homo sapiens
aggaagcucagacugguuga

SEQ ID NO: 396879 - RNA, 14 nt, Homo sapiens
aggaaggaugagca

SEQ ID NO: 396880 - RNA, 15 nt, Homo sapiens
aggaagguggugcuu

SEQ ID NO: 396881 - RNA, 20 nt, Homo sapiens
aggaauauagaaugaaagac

SEQ ID NO: 396882 - RNA, 22 nt, Homo sapiens
aggacauucuggaaaagcaaaa

SEQ ID NO: 396883 - RNA, 15 nt, Homo sapiens
aggaccuagggaugu

SEQ ID NO: 396884 - RNA, 14 nt, Homo sapiens
aggaccugccugua

SEQ ID NO: 396885 - RNA, 17 nt, Homo sapiens
aggacgucuucuaggga

SEQ ID NO: 396886 - RNA, 14 nt, Homo sapiens
aggagacauuggua

SEQ ID NO: 396887 - RNA, 18 nt, Homo sapiens
aggagagagaaagccagg

SEQ ID NO: 396888 - RNA, 20 nt, Homo sapiens
aggagagcuagcagcaggga

SEQ ID NO: 396889 - RNA, 18 nt, Homo sapiens
aggagaggggcacagggu

SEQ ID NO: 396890 - RNA, 22 nt, Homo sapiens
aggagaggggcagaacagccgc

SEQ ID NO: 396891 - RNA, 13 nt, Homo sapiens
aggaggccugcag

SEQ ID NO: 396892 - RNA, 19 nt, Homo sapiens
aggaggcggcagugcaaca

SEQ ID NO: 396893 - RNA, 23 nt, Homo sapiens
aggaggugcuaucgcaccacugu

SEQ ID NO: 396894 - RNA, 15 nt, Homo sapiens
aggauaagagggauu

SEQ ID NO: 396895 - RNA, 14 nt, Homo sapiens
aggauaucuuggcu

SEQ ID NO: 396896 - RNA, 16 nt, Homo sapiens
aggauauuuucuucca

SEQ ID NO: 396897 - RNA, 17 nt, Homo sapiens
aggauauuuucuuccaa

SEQ ID NO: 396898 - RNA, 20 nt, Homo sapiens
aggauccccucucuuccuac

SEQ ID NO: 396899 - RNA, 15 nt, Homo sapiens
aggauuaaaagccau

SEQ ID NO: 396900 - RNA, 15 nt, Homo sapiens
aggauuagacaguca

SEQ ID NO: 396901 - RNA, 15 nt, Homo sapiens
aggauuucaugauuu

SEQ ID NO: 396902 - RNA, 15 nt, Homo sapiens
aggcaaccacaggca

SEQ ID NO: 396903 - RNA, 13 nt, Homo sapiens
aggcacagaugaa

SEQ ID NO: 396904 - RNA, 18 nt, Homo sapiens
aggcagaucccacuugca

SEQ ID NO: 396905 - RNA, 12 nt, Homo sapiens
aggcagcacaga

SEQ ID NO: 396906 - RNA, 20 nt, Homo sapiens
aggcaggaggaucacuugag

SEQ ID NO: 396907 - RNA, 19 nt, Homo sapiens
aggcauaagaaaacuaaga

SEQ ID NO: 396908 - RNA, 16 nt, Homo sapiens
aggcaugauguuaacc

SEQ ID NO: 396909 - RNA, 13 nt, Homo sapiens
aggcauggcagaa

SEQ ID NO: 396910 - RNA, 23 nt, Homo sapiens
aggccaagcauuucuagcaguga

SEQ ID NO: 396911 - RNA, 19 nt, Homo sapiens
aggccaagggccaagagaa

SEQ ID NO: 396912 - RNA, 20 nt, Homo sapiens
aggccacuugaugaccccca

SEQ ID NO: 396913 - RNA, 18 nt, Homo sapiens
aggccgagaagcaagaaa

SEQ ID NO: 396914 - RNA, 16 nt, Homo sapiens
aggccgagaugugcaa

SEQ ID NO: 396915 - RNA, 21 nt, Homo sapiens
aggccgccccagccucugagc

SEQ ID NO: 396916 - RNA, 13 nt, Homo sapiens
aggccucccucaa

SEQ ID NO: 396917 - RNA, 14 nt, Homo sapiens
aggccuggacuuuc

SEQ ID NO: 396918 - RNA, 20 nt, Homo sapiens
aggccuggacuuuccugcaa

SEQ ID NO: 396919 - RNA, 14 nt, Homo sapiens
aggcgaugugcaag

SEQ ID NO: 396920 - RNA, 17 nt, Homo sapiens
aggcuagaaccaccugc

SEQ ID NO: 396921 - RNA, 12 nt, Homo sapiens
aggcuagaugau

SEQ ID NO: 396922 - RNA, 22 nt, Homo sapiens
aggcuccagagggcacucugcu

SEQ ID NO: 396923 - RNA, 21 nt, Homo sapiens
aggcucccuccccauggggca

SEQ ID NO: 396924 - RNA, 17 nt, Homo sapiens
aggcucguugacuggcu

SEQ ID NO: 396925 - RNA, 23 nt, Homo sapiens
aggcucugcccugcccuagcucc

SEQ ID NO: 396926 - RNA, 13 nt, Homo sapiens
aggcucuuagcag

SEQ ID NO: 396927 - RNA, 14 nt, Homo sapiens
aggcugaggacuua

SEQ ID NO: 396928 - RNA, 18 nt, Homo sapiens
aggcugaggcagaacugc

SEQ ID NO: 396929 - RNA, 22 nt, Homo sapiens
aggcugaggccuggacuuuccu

SEQ ID NO: 396930 - RNA, 19 nt, Homo sapiens
aggcugcgacugaugaagg

SEQ ID NO: 396931 - RNA, 15 nt, Homo sapiens
aggcuggcagugaca

SEQ ID NO: 396932 - RNA, 15 nt, Homo sapiens
aggcuggcuuguccc

SEQ ID NO: 396933 - RNA, 15 nt, Homo sapiens
aggcugucuucucag

SEQ ID NO: 396934 - RNA, 14 nt, Homo sapiens
agggaaaaugagua

SEQ ID NO: 396935 - RNA, 18 nt, Homo sapiens
agggaaaauuauuugcau

SEQ ID NO: 396936 - RNA, 15 nt, Homo sapiens
agggaaacacagcag

SEQ ID NO: 396937 - RNA, 16 nt, Homo sapiens
agggaaacacagcagc

SEQ ID NO: 396938 - RNA, 21 nt, Homo sapiens
agggaacccucuaagggaccu

SEQ ID NO: 396939 - RNA, 22 nt, Homo sapiens
agggaagcugucccucacuguu

SEQ ID NO: 396940 - RNA, 17 nt, Homo sapiens
agggaauaauccagaaa

SEQ ID NO: 396941 - RNA, 16 nt, Homo sapiens
agggacgccugggggu

SEQ ID NO: 396942 - RNA, 14 nt, Homo sapiens
agggagcuggaaaa

SEQ ID NO: 396943 - RNA, 18 nt, Homo sapiens
agggaugugugagaauaa

SEQ ID NO: 396944 - RNA, 23 nt, Homo sapiens
agggcaacaauacaugcugcuaa

SEQ ID NO: 396945 - RNA, 17 nt, Homo sapiens
agggcauggccaggugg

SEQ ID NO: 396946 - RNA, 16 nt, Homo sapiens
agggccaggacugagc

SEQ ID NO: 396947 - RNA, 19 nt, Homo sapiens
agggcucuuucacagcugg

SEQ ID NO: 396948 - RNA, 14 nt, Homo sapiens
agggcugcaaaagu

SEQ ID NO: 396949 - RNA, 19 nt, Homo sapiens
aggggcugcugaccuccac

SEQ ID NO: 396950 - RNA, 23 nt, Homo sapiens
agggugggguaaccaaauguugg

SEQ ID NO: 396951 - RNA, 18 nt, Homo sapiens
agguacugagagugaaca

SEQ ID NO: 396952 - RNA, 20 nt, Homo sapiens
agguagcugccccuggcucu

SEQ ID NO: 396953 - RNA, 21 nt, Homo sapiens
agguaugguuaauaaguuuca

SEQ ID NO: 396954 - RNA, 18 nt, Homo sapiens
aggucacauugugccuuu

SEQ ID NO: 396955 - RNA, 23 nt, Homo sapiens
aggucccuugucccaaguuccac

SEQ ID NO: 396956 - RNA, 21 nt, Homo sapiens
aggucgaccccaaagccccuu

SEQ ID NO: 396957 - RNA, 13 nt, Homo sapiens
aggucuccaaaau

SEQ ID NO: 396958 - RNA, 15 nt, Homo sapiens
aggucucugaacuca

SEQ ID NO: 396959 - RNA, 23 nt, Homo sapiens
aggugauccacccaccuuggccu

SEQ ID NO: 396960 - RNA, 22 nt, Homo sapiens
aggugcccaggaaccucagggc

SEQ ID NO: 396961 - RNA, 15 nt, Homo sapiens
aggugcuacugacuu

SEQ ID NO: 396962 - RNA, 19 nt, Homo sapiens
aggugcuaucgcaccacug

SEQ ID NO: 396963 - RNA, 21 nt, Homo sapiens
aggugcuugacauaauuucac

SEQ ID NO: 396964 - RNA, 20 nt, Homo sapiens
aggugggaggaucucuugag

SEQ ID NO: 396965 - RNA, 20 nt, Homo sapiens
aggugucuucuuugacuuaa

SEQ ID NO: 396966 - RNA, 21 nt, Homo sapiens
agguugucugaagucacugca

SEQ ID NO: 396967 - RNA, 15 nt, Homo sapiens
agguuuacauuguca

SEQ ID NO: 396968 - RNA, 17 nt, Homo sapiens
agguuuaggucaagaag

SEQ ID NO: 396969 - RNA, 15 nt, Homo sapiens
agguuugccagcauu

SEQ ID NO: 396970 - RNA, 16 nt, Homo sapiens
agguuugccagcauuu

SEQ ID NO: 396971 - RNA, 23 nt, Homo sapiens
aguaaaugcuagguuaauuccaa

SEQ ID NO: 396972 - RNA, 17 nt, Homo sapiens
aguaacgcgucuuccug

SEQ ID NO: 396973 - RNA, 20 nt, Homo sapiens
aguaagaaaacaucacugaa

SEQ ID NO: 396974 - RNA, 17 nt, Homo sapiens
aguaagcaaagacuuuc

SEQ ID NO: 396975 - RNA, 15 nt, Homo sapiens
aguaauagagcaaaa

SEQ ID NO: 396976 - RNA, 22 nt, Homo sapiens
aguaauagagcaaaauugaugu

SEQ ID NO: 396977 - RNA, 15 nt, Homo sapiens
aguaaugagcaugau

SEQ ID NO: 396978 - RNA, 15 nt, Homo sapiens
aguacuuuaccuccu

SEQ ID NO: 396979 - RNA, 18 nt, Homo sapiens
aguagacuauaagcagaa

SEQ ID NO: 396980 - RNA, 21 nt, Homo sapiens
aguaucaggucucccacgugg

SEQ ID NO: 396981 - RNA, 15 nt, Homo sapiens
aguaugaaugcagug

SEQ ID NO: 396982 - RNA, 21 nt, Homo sapiens
aguaugugaguguguccaagu

SEQ ID NO: 396983 - RNA, 15 nt, Homo sapiens
agucaaauuuguaaa

SEQ ID NO: 396984 - RNA, 15 nt, Homo sapiens
agucaagauuuccau

SEQ ID NO: 396985 - RNA, 23 nt, Homo sapiens
agucaauccccucauucaggaaa

SEQ ID NO: 396986 - RNA, 19 nt, Homo sapiens
agucacugacccugugcag

SEQ ID NO: 396987 - RNA, 18 nt, Homo sapiens
agucaucuugaccaagca

SEQ ID NO: 396988 - RNA, 20 nt, Homo sapiens
agucaugagcugagcaggga

SEQ ID NO: 396989 - RNA, 16 nt, Homo sapiens
aguccagauauuucac

SEQ ID NO: 396990 - RNA, 17 nt, Homo sapiens
aguccagauauuucaca

SEQ ID NO: 396991 - RNA, 18 nt, Homo sapiens
agucccagcuacucagga

SEQ ID NO: 396992 - RNA, 20 nt, Homo sapiens
agucccuaaaaacacagaca

SEQ ID NO: 396993 - RNA, 14 nt, Homo sapiens
aguccuauuugcac

SEQ ID NO: 396994 - RNA, 16 nt, Homo sapiens
aguccuggaaucacau

SEQ ID NO: 396995 - RNA, 16 nt, Homo sapiens
agucucaggaaaucaa

SEQ ID NO: 396996 - RNA, 13 nt, Homo sapiens
agucuggcucugu

SEQ ID NO: 396997 - RNA, 15 nt, Homo sapiens
agucuucuccaaugu

SEQ ID NO: 396998 - RNA, 19 nt, Homo sapiens
agucuugucauugccagcu

SEQ ID NO: 396999 - RNA, 20 nt, Homo sapiens
agugaaaaucuacacuccag

SEQ ID NO: 397000 - RNA, 19 nt, Homo sapiens
agugaacaaauuuacagag

SEQ ID NO: 397001 - RNA, 20 nt, Homo sapiens
agugaacaaauuuacagaga

SEQ ID NO: 397002 - RNA, 19 nt, Homo sapiens
agugaauaaaccaucaucu

SEQ ID NO: 397003 - RNA, 19 nt, Homo sapiens
agugaaugaaacacucagu

SEQ ID NO: 397004 - RNA, 14 nt, Homo sapiens
agugacagcuugag

SEQ ID NO: 397005 - RNA, 20 nt, Homo sapiens
agugacaucucuuugauguc

SEQ ID NO: 397006 - RNA, 17 nt, Homo sapiens
agugagaaaaagcuccu

SEQ ID NO: 397007 - RNA, 13 nt, Homo sapiens
agugccaagcaca

SEQ ID NO: 397008 - RNA, 21 nt, Homo sapiens
agugccaagcacagugccugc

SEQ ID NO: 397009 - RNA, 16 nt, Homo sapiens
auucaggauuacaugc

SEQ ID NO: 397010 - RNA, 23 nt, Homo sapiens
auucagugcuguacuugaugaca

SEQ ID NO: 397011 - RNA, 17 nt, Homo sapiens
auucauauuuacuucuu

SEQ ID NO: 397012 - RNA, 15 nt, Homo sapiens
auucauguggaauau

SEQ ID NO: 397013 - RNA, 16 nt, Homo sapiens
auucauuucaaaggga

SEQ ID NO: 397014 - RNA, 13 nt, Homo sapiens
auuccaaacauac

SEQ ID NO: 397015 - RNA, 14 nt, Homo sapiens
auuccaaacauaca

SEQ ID NO: 397016 - RNA, 18 nt, Homo sapiens
auuccacuuuuauucauu

SEQ ID NO: 397017 - RNA, 17 nt, Homo sapiens
auuccaggcgaugugca

SEQ ID NO: 397018 - RNA, 20 nt, Homo sapiens
auuccaggcgaugugcaagu

SEQ ID NO: 397019 - RNA, 19 nt, Homo sapiens
auuccuauauaguuuauug

SEQ ID NO: 397020 - RNA, 20 nt, Homo sapiens
auuccuauauaguuuauuga

SEQ ID NO: 397021 - RNA, 20 nt, Homo sapiens
auuccugauaauaauugauc

SEQ ID NO: 397022 - RNA, 14 nt, Homo sapiens
auuccuugauucac

SEQ ID NO: 397023 - RNA, 17 nt, Homo sapiens
auucgcugugucagcau

SEQ ID NO: 397024 - RNA, 18 nt, Homo sapiens
auucucugagcugugcag

SEQ ID NO: 397025 - RNA, 22 nt, Homo sapiens
auucucugugguauccaagaau

SEQ ID NO: 397026 - RNA, 19 nt, Homo sapiens
auucugauuuuacauguaa

SEQ ID NO: 397027 - RNA, 17 nt, Homo sapiens
auucugccgugugcccu

SEQ ID NO: 397028 - RNA, 18 nt, Homo sapiens
auucugguuuugacauca

SEQ ID NO: 397029 - RNA, 15 nt, Homo sapiens
auucugucacucacc

SEQ ID NO: 397030 - RNA, 13 nt, Homo sapiens
auucuuggaauac

SEQ ID NO: 397031 - RNA, 17 nt, Homo sapiens
auugaaaucaagcuuau

SEQ ID NO: 397032 - RNA, 23 nt, Homo sapiens
auugaacucuuugaaugacaaag

SEQ ID NO: 397033 - RNA, 18 nt, Homo sapiens
auugaacuuucacauagc

SEQ ID NO: 397034 - RNA, 22 nt, Homo sapiens
auugaacuuucacauagcacag

SEQ ID NO: 397035 - RNA, 14 nt, Homo sapiens
auugagacuauuua

SEQ ID NO: 397036 - RNA, 13 nt, Homo sapiens
auugagucuucca

SEQ ID NO: 397037 - RNA, 17 nt, Homo sapiens
auugauaugcuuauaca

SEQ ID NO: 397038 - RNA, 19 nt, Homo sapiens
auugauuauaagcauguau

SEQ ID NO: 397039 - RNA, 15 nt, Homo sapiens
auugcuugugccaca

SEQ ID NO: 397040 - RNA, 17 nt, Homo sapiens
auuggaccauccuauuu

SEQ ID NO: 397041 - RNA, 22 nt, Homo sapiens
auugguccagcuugcucuucag

SEQ ID NO: 397042 - RNA, 21 nt, Homo sapiens
auugguccgaucuuugacucu

SEQ ID NO: 397043 - RNA, 14 nt, Homo sapiens
auuguaccaugaaa

SEQ ID NO: 397044 - RNA, 15 nt, Homo sapiens
auugugagccaccac

SEQ ID NO: 397045 - RNA, 23 nt, Homo sapiens
auugugccgagaaaagcauuuua

SEQ ID NO: 397046 - RNA, 17 nt, Homo sapiens
auuuaacagucauuuaa

SEQ ID NO: 397047 - RNA, 15 nt, Homo sapiens
auuuaagguacuuaa

SEQ ID NO: 397048 - RNA, 16 nt, Homo sapiens
auuuaagguacuuaaa

SEQ ID NO: 397049 - RNA, 21 nt, Homo sapiens
auuuacaugaauugcauuuua

SEQ ID NO: 397050 - RNA, 18 nt, Homo sapiens
auuuagaacuguauguca

SEQ ID NO: 397051 - RNA, 15 nt, Homo sapiens
auuuagucaugugac

SEQ ID NO: 397052 - RNA, 22 nt, Homo sapiens
auuuaguuugauuauucagugu

SEQ ID NO: 397053 - RNA, 15 nt, Homo sapiens
auuuauaacucauca

SEQ ID NO: 397054 - RNA, 23 nt, Homo sapiens
auuuaucagaaauuauacuauau

SEQ ID NO: 397055 - RNA, 19 nt, Homo sapiens
auuuaucugugcaaauccu

SEQ ID NO: 397056 - RNA, 13 nt, Homo sapiens
auuuauguuuauu

SEQ ID NO: 397057 - RNA, 19 nt, Homo sapiens
auuuauucuucuuuuccaa

SEQ ID NO: 397058 - RNA, 13 nt, Homo sapiens
auuucacugaugu

SEQ ID NO: 397059 - RNA, 18 nt, Homo sapiens
auuucagauaaacaacaa

SEQ ID NO: 397060 - RNA, 22 nt, Homo sapiens
auuucagauaaacaacaaauaa

SEQ ID NO: 397061 - RNA, 22 nt, Homo sapiens
auuucagaucauauuucacaau

SEQ ID NO: 397062 - RNA, 18 nt, Homo sapiens
auuucauaccuaucaucu

SEQ ID NO: 397063 - RNA, 12 nt, Homo sapiens
auuucaucucuu

SEQ ID NO: 397064 - RNA, 17 nt, Homo sapiens
auuuccaaaugaaugac

SEQ ID NO: 397065 - RNA, 21 nt, Homo sapiens
auuuccuaggcugacuaagaa

SEQ ID NO: 397066 - RNA, 13 nt, Homo sapiens
auuuccugacaga

SEQ ID NO: 397067 - RNA, 21 nt, Homo sapiens
auuuccugacagaaggacuca

SEQ ID NO: 397068 - RNA, 13 nt, Homo sapiens
auuuccuugccuu

SEQ ID NO: 397069 - RNA, 15 nt, Homo sapiens
auuucggagcaugaa

SEQ ID NO: 397070 - RNA, 19 nt, Homo sapiens
auuucuccuccaugggaga

SEQ ID NO: 397071 - RNA, 16 nt, Homo sapiens
auuucucucugacccu

SEQ ID NO: 397072 - RNA, 18 nt, Homo sapiens
auuucuuacaggcacaaa

SEQ ID NO: 397073 - RNA, 16 nt, Homo sapiens
auuuggcaaugccauc

SEQ ID NO: 397074 - RNA, 18 nt, Homo sapiens
auuugggagacaugugac

SEQ ID NO: 397075 - RNA, 16 nt, Homo sapiens
auuuguuugcaauuuu

SEQ ID NO: 397076 - RNA, 22 nt, Homo sapiens
auuuuaacuuccuuggacucau

SEQ ID NO: 397077 - RNA, 15 nt, Homo sapiens
auuuuaucugugaau

SEQ ID NO: 397078 - RNA, 18 nt, Homo sapiens
auuuuauucccuuucaca

SEQ ID NO: 397079 - RNA, 15 nt, Homo sapiens
auuuucuagacuuuc

SEQ ID NO: 397080 - RNA, 16 nt, Homo sapiens
auuuucuauuuaugua

SEQ ID NO: 397081 - RNA, 17 nt, Homo sapiens
auuuugcauaguaccaa

SEQ ID NO: 397082 - RNA, 18 nt, Homo sapiens
auuuugccauaaagucaa

SEQ ID NO: 397083 - RNA, 19 nt, Homo sapiens
auuuugcuaaaugugaaug

SEQ ID NO: 397084 - RNA, 13 nt, Homo sapiens
auuuuuccauuuu

SEQ ID NO: 397085 - RNA, 12 nt, Homo sapiens
auuuuugcaaug

SEQ ID NO: 397086 - RNA, 13 nt, Homo sapiens
auuuuugugcaca

SEQ ID NO: 397087 - RNA, 21 nt, Homo sapiens
caaaaacagcagaacuucuga

SEQ ID NO: 397088 - RNA, 22 nt, Homo sapiens
caaaaaugaacugaaguuucac

SEQ ID NO: 397089 - RNA, 12 nt, Homo sapiens
caaaaauguaau

SEQ ID NO: 397090 - RNA, 13 nt, Homo sapiens
caaaaauguaaug

SEQ ID NO: 397091 - RNA, 19 nt, Homo sapiens
caaaaauguaaugaucaua

SEQ ID NO: 397092 - RNA, 16 nt, Homo sapiens
caaaacagagauguga

SEQ ID NO: 397093 - RNA, 23 nt, Homo sapiens
caaaaccgaguugccagcuccca

SEQ ID NO: 397094 - RNA, 22 nt, Homo sapiens
caaaacucuccuacacuuccau

SEQ ID NO: 397095 - RNA, 15 nt, Homo sapiens
caaaacugacaguaa

SEQ ID NO: 397096 - RNA, 17 nt, Homo sapiens
caaaacugacaguaaau

SEQ ID NO: 397097 - RNA, 15 nt, Homo sapiens
caaaaggacucucag

SEQ ID NO: 397098 - RNA, 20 nt, Homo sapiens
caaaauaaaaaccaagaaga

SEQ ID NO: 397099 - RNA, 19 nt, Homo sapiens
caaaauagagaaucccacu

SEQ ID NO: 397100 - RNA, 14 nt, Homo sapiens
caaaaucacacagc

SEQ ID NO: 397101 - RNA, 12 nt, Homo sapiens
caaaauugcuaa

SEQ ID NO: 397102 - RNA, 21 nt, Homo sapiens
caaacagccccucuggacaca

SEQ ID NO: 397103 - RNA, 16 nt, Homo sapiens
caaacagucucaggaa

SEQ ID NO: 397104 - RNA, 19 nt, Homo sapiens
caaaccccagggcacugag

SEQ ID NO: 397105 - RNA, 16 nt, Homo sapiens
caaaccgagugcaaug

SEQ ID NO: 397106 - RNA, 15 nt, Homo sapiens
caaacucucccuuca

SEQ ID NO: 397107 - RNA, 22 nt, Homo sapiens
caaacucuuaguuacucauuca

SEQ ID NO: 397108 - RNA, 20 nt, Homo sapiens
caaacugccuauauugauaa

SEQ ID NO: 397109 - RNA, 14 nt, Homo sapiens
caaacuucaagggu

SEQ ID NO: 397110 - RNA, 23 nt, Homo sapiens
caaagcaaguuucaucagucaau

SEQ ID NO: 397111 - RNA, 23 nt, Homo sapiens
caaagcaggggaguaugcaaaag

SEQ ID NO: 397112 - RNA, 18 nt, Homo sapiens
caaagccuugugucuaca

SEQ ID NO: 397113 - RNA, 20 nt, Homo sapiens
caaagccuuuggcucuucua

SEQ ID NO: 397114 - RNA, 22 nt, Homo sapiens
caaagcuuucauguaaacugug

SEQ ID NO: 397115 - RNA, 15 nt, Homo sapiens
caaagcuuuccugcc

SEQ ID NO: 397116 - RNA, 17 nt, Homo sapiens
caaaggugauugugcca

SEQ ID NO: 397117 - RNA, 15 nt, Homo sapiens
caaaguagcaauuuc

SEQ ID NO: 397118 - RNA, 17 nt, Homo sapiens
caaauaaacucuaaaca

SEQ ID NO: 397119 - RNA, 22 nt, Homo sapiens
caaauacauggauaacacauuu

SEQ ID NO: 397120 - RNA, 16 nt, Homo sapiens
caaaugcuauuugaua

SEQ ID NO: 397121 - RNA, 13 nt, Homo sapiens
caaaugucaucag

SEQ ID NO: 397122 - RNA, 13 nt, Homo sapiens
caaaugugacauu

SEQ ID NO: 397123 - RNA, 15 nt, Homo sapiens
caaauuaaggcauaa

SEQ ID NO: 397124 - RNA, 17 nt, Homo sapiens
caacaauacaugcugcu

SEQ ID NO: 397125 - RNA, 22 nt, Homo sapiens
caacacgagcaggcuacuguca

SEQ ID NO: 397126 - RNA, 15 nt, Homo sapiens
caacagcauuuucaa

SEQ ID NO: 397127 - RNA, 22 nt, Homo sapiens
caacagcccucaggucagggug

SEQ ID NO: 397128 - RNA, 17 nt, Homo sapiens
caacagcccugucucaa

SEQ ID NO: 397129 - RNA, 17 nt, Homo sapiens
caacagugagucuguca

SEQ ID NO: 397130 - RNA, 18 nt, Homo sapiens
caacagugagucugucag

SEQ ID NO: 397131 - RNA, 18 nt, Homo sapiens
caacaguuuuuuaugcua

SEQ ID NO: 397132 - RNA, 18 nt, Homo sapiens
caaccaagucaugugcau

SEQ ID NO: 397133 - RNA, 14 nt, Homo sapiens
caaccccaacucca

SEQ ID NO: 397134 - RNA, 14 nt, Homo sapiens
caaccccaccacuu

SEQ ID NO: 397135 - RNA, 20 nt, Homo sapiens
caaccucgcuggacucucag

SEQ ID NO: 397136 - RNA, 18 nt, Homo sapiens
caaccugccugacauuug

SEQ ID NO: 397137 - RNA, 14 nt, Homo sapiens
caacgaguacuuca

SEQ ID NO: 397138 - RNA, 20 nt, Homo sapiens
caacuauuuuuccaaaauaa

SEQ ID NO: 397139 - RNA, 12 nt, Homo sapiens
caacuccuggaa

SEQ ID NO: 397140 - RNA, 14 nt, Homo sapiens
caacuucagcagua

SEQ ID NO: 397141 - RNA, 16 nt, Homo sapiens
caacuugagggcccag

SEQ ID NO: 397142 - RNA, 15 nt, Homo sapiens
caagaacugaaacca

SEQ ID NO: 397143 - RNA, 23 nt, Homo sapiens
caagaauagaugcugacuguacu

SEQ ID NO: 397144 - RNA, 20 nt, Homo sapiens
caagacucuuuggacacuca

SEQ ID NO: 397145 - RNA, 13 nt, Homo sapiens
caagaggcucccu

SEQ ID NO: 397146 - RNA, 13 nt, Homo sapiens
caagauccuuaau

SEQ ID NO: 397147 - RNA, 14 nt, Homo sapiens
caagaucugaauuu

SEQ ID NO: 397148 - RNA, 20 nt, Homo sapiens
caagauugcgccauugcacu

SEQ ID NO: 397149 - RNA, 20 nt, Homo sapiens
caagcacagugccugcaugu

SEQ ID NO: 397150 - RNA, 23 nt, Homo sapiens
caagcaguuaguuccuucaugau

SEQ ID NO: 397151 - RNA, 11 nt, Homo sapiens
gcuucugccau

SEQ ID NO: 397152 - RNA, 21 nt, Homo sapiens
gcuucuuaauauaacugccuu

SEQ ID NO: 397153 - RNA, 22 nt, Homo sapiens
gcuugauauuuuccaaauggau

SEQ ID NO: 397154 - RNA, 21 nt, Homo sapiens
gcuuggauggagacuccauga

SEQ ID NO: 397155 - RNA, 22 nt, Homo sapiens
gcuuguccccuccucacucccu

SEQ ID NO: 397156 - RNA, 21 nt, Homo sapiens
gcuuuaauaagcgagaccuaa

SEQ ID NO: 397157 - RNA, 12 nt, Homo sapiens
gcuuucuaugua

SEQ ID NO: 397158 - RNA, 15 nt, Homo sapiens
gcuuugaaaauucag

SEQ ID NO: 397159 - RNA, 20 nt, Homo sapiens
gcuuuugcuggucacugcca

SEQ ID NO: 397160 - RNA, 20 nt, Homo sapiens
ggaaaacugagacucagaca

SEQ ID NO: 397161 - RNA, 13 nt, Homo sapiens
ggaaaagcaaaac

SEQ ID NO: 397162 - RNA, 12 nt, Homo sapiens
ggaaaaugagua

SEQ ID NO: 397163 - RNA, 17 nt, Homo sapiens
ggaaaauuucacauuaa

SEQ ID NO: 397164 - RNA, 12 nt, Homo sapiens
ggaaacauagaa

SEQ ID NO: 397165 - RNA, 20 nt, Homo sapiens
ggaaacuguaugaaugucug

SEQ ID NO: 397166 - RNA, 14 nt, Homo sapiens
ggaaaggauucaug

SEQ ID NO: 397167 - RNA, 23 nt, Homo sapiens
ggaaauucaaaacaauuggcaaa

SEQ ID NO: 397168 - RNA, 22 nt, Homo sapiens
ggaaccacgucugcuaacuugg

SEQ ID NO: 397169 - RNA, 13 nt, Homo sapiens
ggaaccaugaaga

SEQ ID NO: 397170 - RNA, 23 nt, Homo sapiens
ggaaccccaggaggccugcagcc

SEQ ID NO: 397171 - RNA, 16 nt, Homo sapiens
ggaacccucuaaggga

SEQ ID NO: 397172 - RNA, 22 nt, Homo sapiens
ggaacuagagggauacacugaa

SEQ ID NO: 397173 - RNA, 13 nt, Homo sapiens
ggaacugcaauaa

SEQ ID NO: 397174 - RNA, 15 nt, Homo sapiens
ggaagacaaugugaa

SEQ ID NO: 397175 - RNA, 20 nt, Homo sapiens
ggaagaccagcuuugcagug

SEQ ID NO: 397176 - RNA, 14 nt, Homo sapiens
ggaagagcugugug

SEQ ID NO: 397177 - RNA, 19 nt, Homo sapiens
ggaagagcuguguggccug

SEQ ID NO: 397178 - RNA, 17 nt, Homo sapiens
ggaagagggugauugcu

SEQ ID NO: 397179 - RNA, 24 nt, Homo sapiens
ggaagagugguuaagacuacugaa

SEQ ID NO: 397180 - RNA, 16 nt, Homo sapiens
ggaagccccacuugaa

SEQ ID NO: 397181 - RNA, 22 nt, Homo sapiens
ggaagccucccacgacugcccg

SEQ ID NO: 397182 - RNA, 14 nt, Homo sapiens
ggaagcgagcuuug

SEQ ID NO: 397183 - RNA, 16 nt, Homo sapiens
ggaagcuccacuguca

SEQ ID NO: 397184 - RNA, 16 nt, Homo sapiens
ggaagcugucccucac

SEQ ID NO: 397185 - RNA, 22 nt, Homo sapiens
ggaaggagaggagaggggcaca

SEQ ID NO: 397186 - RNA, 14 nt, Homo sapiens
ggaauaauccagaa

SEQ ID NO: 397187 - RNA, 18 nt, Homo sapiens
ggacaaaccgagugcaau

SEQ ID NO: 397188 - RNA, 15 nt, Homo sapiens
ggacaccacacccag

SEQ ID NO: 397189 - RNA, 23 nt, Homo sapiens
ggacaggugccagguguguggug

SEQ ID NO: 397190 - RNA, 12 nt, Homo sapiens
ggaccucaaagg

SEQ ID NO: 397191 - RNA, 12 nt, Homo sapiens
ggacuacuccaa

SEQ ID NO: 397192 - RNA, 18 nt, Homo sapiens
ggacuucuggcagggaag

SEQ ID NO: 397193 - RNA, 13 nt, Homo sapiens
ggagaaacuggaa

SEQ ID NO: 397194 - RNA, 13 nt, Homo sapiens
ggagaacuagaga

SEQ ID NO: 397195 - RNA, 13 nt, Homo sapiens
ggagaagacaauu

SEQ ID NO: 397196 - RNA, 18 nt, Homo sapiens
ggagaagagcuguucaca

SEQ ID NO: 397197 - RNA, 16 nt, Homo sapiens
ggagaaucacuugaac

SEQ ID NO: 397198 - RNA, 16 nt, Homo sapiens
ggagaauugcuugaac

SEQ ID NO: 397199 - RNA, 23 nt, Homo sapiens
ggagacacaacuauuuuuccaaa

SEQ ID NO: 397200 - RNA, 23 nt, Homo sapiens
ggagacacuauuuaucugugcaa

SEQ ID NO: 397201 - RNA, 15 nt, Homo sapiens
ggagacuagauuuau

SEQ ID NO: 397202 - RNA, 21 nt, Homo sapiens
ggagacucaccucugccucaa

SEQ ID NO: 397203 - RNA, 17 nt, Homo sapiens
ggagagagaaagccagg

SEQ ID NO: 397204 - RNA, 14 nt, Homo sapiens
ggagagagacucca

SEQ ID NO: 397205 - RNA, 23 nt, Homo sapiens
ggagauccgcaucuggggacccc

SEQ ID NO: 397206 - RNA, 13 nt, Homo sapiens
ggagcacuggguu

SEQ ID NO: 397207 - RNA, 22 nt, Homo sapiens
ggagcugcguuuccugugcaug

SEQ ID NO: 397208 - RNA, 16 nt, Homo sapiens
ggagcuggcccucucc

SEQ ID NO: 397209 - RNA, 20 nt, Homo sapiens
ggaggcagagguugcaguga

SEQ ID NO: 397210 - RNA, 16 nt, Homo sapiens
ggaggccagccaguga

SEQ ID NO: 397211 - RNA, 21 nt, Homo sapiens
ggaggccagccagugaccuga

SEQ ID NO: 397212 - RNA, 22 nt, Homo sapiens
ggagggcgugacucacccaagc

SEQ ID NO: 397213 - RNA, 20 nt, Homo sapiens
ggagguugcagugagccaag

SEQ ID NO: 397214 - RNA, 13 nt, Homo sapiens
ggaguaugcaaaa

SEQ ID NO: 397215 - RNA, 21 nt, Homo sapiens
ggaguguucagggccagcccu

SEQ ID NO: 397216 - RNA, 16 nt, Homo sapiens
ggauaacacauuugau

SEQ ID NO: 397217 - RNA, 17 nt, Homo sapiens
ggauaucaaaagcaaau

SEQ ID NO: 397218 - RNA, 17 nt, Homo sapiens
ggaucccguguugccau

SEQ ID NO: 397219 - RNA, 19 nt, Homo sapiens
ggaugaucuugauuguggg

SEQ ID NO: 397220 - RNA, 17 nt, Homo sapiens
ggauggaugcagaucca

SEQ ID NO: 397221 - RNA, 17 nt, Homo sapiens
ggaugucacagggccaa

SEQ ID NO: 397222 - RNA, 15 nt, Homo sapiens
ggauuuggguuggaa

SEQ ID NO: 397223 - RNA, 15 nt, Homo sapiens
ggcaaagccuaguga

SEQ ID NO: 397224 - RNA, 23 nt, Homo sapiens
ggcaacaauacaugcugcuaauu

SEQ ID NO: 397225 - RNA, 21 nt, Homo sapiens
ggcaagcugugacuucuccag

SEQ ID NO: 397226 - RNA, 21 nt, Homo sapiens
ggcacaauuuuaauucaaaag

SEQ ID NO: 397227 - RNA, 17 nt, Homo sapiens
ggcagaacugcuugaac

SEQ ID NO: 397228 - RNA, 13 nt, Homo sapiens
ggcagaagggaac

SEQ ID NO: 397229 - RNA, 13 nt, Homo sapiens
ggcagagcuucuu

SEQ ID NO: 397230 - RNA, 19 nt, Homo sapiens
ggcagaucccacuugcagc

SEQ ID NO: 397231 - RNA, 18 nt, Homo sapiens
ggcagguagccaggggga

SEQ ID NO: 397232 - RNA, 21 nt, Homo sapiens
ggcaguagacuauaagcagaa

SEQ ID NO: 397233 - RNA, 24 nt, Homo sapiens
ggcauaggcugacuuuugcagaug

SEQ ID NO: 397234 - RNA, 18 nt, Homo sapiens
ggcaugacuuugucccau

SEQ ID NO: 397235 - RNA, 18 nt, Homo sapiens
ggcauggccagguggcca

SEQ ID NO: 397236 - RNA, 13 nt, Homo sapiens
ggccagguggcca

SEQ ID NO: 397237 - RNA, 13 nt, Homo sapiens
ggccccacugggg

SEQ ID NO: 397238 - RNA, 23 nt, Homo sapiens
ggcccguccggcaguucugggug

SEQ ID NO: 397239 - RNA, 23 nt, Homo sapiens
ggcccgugacauccccacccuug

SEQ ID NO: 397240 - RNA, 22 nt, Homo sapiens
ggccggggcccugcaccugugc

SEQ ID NO: 397241 - RNA, 16 nt, Homo sapiens
ggccucuggcucucau

SEQ ID NO: 397242 - RNA, 14 nt, Homo sapiens
ggccugugugugaa

SEQ ID NO: 397243 - RNA, 17 nt, Homo sapiens
ggcgaaaccccaucucu

SEQ ID NO: 397244 - RNA, 20 nt, Homo sapiens
ggcgaugugcaaguguaugc

SEQ ID NO: 397245 - RNA, 16 nt, Homo sapiens
ggcuaagaguguccua

SEQ ID NO: 397246 - RNA, 17 nt, Homo sapiens
ggcuacacacaaaccag

SEQ ID NO: 397247 - RNA, 13 nt, Homo sapiens
ggcuagaucauga

SEQ ID NO: 397248 - RNA, 21 nt, Homo sapiens
ggcuauaccugggcauacuaa

SEQ ID NO: 397249 - RNA, 17 nt, Homo sapiens
ggcuccgucaguaucag

SEQ ID NO: 397250 - RNA, 16 nt, Homo sapiens
ggcuccuggggcaaug

SEQ ID NO: 397251 - RNA, 19 nt, Homo sapiens
ggcugacucuaggugcccu

SEQ ID NO: 397252 - RNA, 15 nt, Homo sapiens
ggcugcugaccucca

SEQ ID NO: 397253 - RNA, 19 nt, Homo sapiens
ggcuggagugcaguggcgu

SEQ ID NO: 397254 - RNA, 14 nt, Homo sapiens
ggcuggguggcacc

SEQ ID NO: 397255 - RNA, 16 nt, Homo sapiens
ggcuugauauuuucca

SEQ ID NO: 397256 - RNA, 21 nt, Homo sapiens
gggaaaggauauuuucuucca

SEQ ID NO: 397257 - RNA, 21 nt, Homo sapiens
gggaagaccagcuuugcagug

SEQ ID NO: 397258 - RNA, 14 nt, Homo sapiens
gggaagacuguggc

SEQ ID NO: 397259 - RNA, 21 nt, Homo sapiens
gggaaggguccaucucagaga

SEQ ID NO: 397260 - RNA, 14 nt, Homo sapiens
gggacagagccaug

SEQ ID NO: 397261 - RNA, 18 nt, Homo sapiens
gggacuucugucuucaca

SEQ ID NO: 397262 - RNA, 19 nt, Homo sapiens
gggagacugggcugaggga

SEQ ID NO: 397263 - RNA, 14 nt, Homo sapiens
gggagcauguucau

SEQ ID NO: 397264 - RNA, 18 nt, Homo sapiens
gggagguauucgugcagc

SEQ ID NO: 397265 - RNA, 20 nt, Homo sapiens
gggaggucaaggcugcagug

SEQ ID NO: 397266 - RNA, 20 nt, Homo sapiens
gggagguggagguugcagug

SEQ ID NO: 397267 - RNA, 23 nt, Homo sapiens
gggauaaguaaguuugauuucau

SEQ ID NO: 397268 - RNA, 23 nt, Homo sapiens
gggaucuuccuugggaugaucuu

SEQ ID NO: 397269 - RNA, 19 nt, Homo sapiens
gggaugagccgcugugagc

SEQ ID NO: 397270 - RNA, 19 nt, Homo sapiens
gggauggcuaaaaccauca

SEQ ID NO: 397271 - RNA, 23 nt, Homo sapiens
gggauuuuuggcuacacacaaac

SEQ ID NO: 397272 - RNA, 18 nt, Homo sapiens
gggcacugaggaccagcc

SEQ ID NO: 397273 - RNA, 20 nt, Homo sapiens
gggcaugccccggccaccuc

SEQ ID NO: 397274 - RNA, 17 nt, Homo sapiens
gggcgagucacugccuc

SEQ ID NO: 397275 - RNA, 20 nt, Homo sapiens
gggcggggggcaccuacuac

SEQ ID NO: 397276 - RNA, 17 nt, Homo sapiens
ggggagucugaagcaga

SEQ ID NO: 397277 - RNA, 12 nt, Homo sapiens
ggggcacccgcc

SEQ ID NO: 397278 - RNA, 23 nt, Homo sapiens
ggggccaggucacccuuugcugu

SEQ ID NO: 397279 - RNA, 12 nt, Homo sapiens
ggggcgugcaug

SEQ ID NO: 397280 - RNA, 18 nt, Homo sapiens
gggguauaaaacuuuccu

SEQ ID NO: 397281 - RNA, 22 nt, Homo sapiens
gggucccauagaggugagggaa

SEQ ID NO: 397282 - RNA, 15 nt, Homo sapiens
ggguccccaccuggg

SEQ ID NO: 397283 - RNA, 19 nt, Homo sapiens
gggucucacaguguugccc

SEQ ID NO: 397284 - RNA, 20 nt, Homo sapiens
gggucuuugugagagugagc

SEQ ID NO: 397285 - RNA, 21 nt, Homo sapiens
ggguuaguuuacaaucagcca

SEQ ID NO: 397286 - RNA, 23 nt, Homo sapiens
gguaacuuuuuuuuaaagcucau

SEQ ID NO: 397287 - RNA, 18 nt, Homo sapiens
gguaauuaguaacaugug

SEQ ID NO: 397288 - RNA, 14 nt, Homo sapiens
gguacuuaaagcuu

SEQ ID NO: 397289 - RNA, 14 nt, Homo sapiens
gguaugauauugca

SEQ ID NO: 397290 - RNA, 17 nt, Homo sapiens
ggucacauugugccuuu

SEQ ID NO: 397291 - RNA, 23 nt, Homo sapiens
ggucaggaaggaugagcauuuag

SEQ ID NO: 397292 - RNA, 10 nt, Homo sapiens
uaugcaaaag

SEQ ID NO: 397293 - RNA, 17 nt, Homo sapiens
uaugcaguaugcuuaau

SEQ ID NO: 397294 - RNA, 16 nt, Homo sapiens
uaugcuaccuacugau

SEQ ID NO: 397295 - RNA, 22 nt, Homo sapiens
uaugcucagggucaauuucuuu

SEQ ID NO: 397296 - RNA, 16 nt, Homo sapiens
uauggaauacaguguu

SEQ ID NO: 397297 - RNA, 16 nt, Homo sapiens
uauggacucaguuuuc

SEQ ID NO: 397298 - RNA, 23 nt, Homo sapiens
uauggauucagaauauacuaaau

SEQ ID NO: 397299 - RNA, 18 nt, Homo sapiens
uauggcacccaugcaccu

SEQ ID NO: 397300 - RNA, 21 nt, Homo sapiens
uauggcuauaggugcuacaaa

SEQ ID NO: 397301 - RNA, 20 nt, Homo sapiens
uaugggggcacugaggacca

SEQ ID NO: 397302 - RNA, 20 nt, Homo sapiens
uaugguaaaaguuacuuauu

SEQ ID NO: 397303 - RNA, 19 nt, Homo sapiens
uaugucacccaaugcauau

SEQ ID NO: 397304 - RNA, 16 nt, Homo sapiens
uaugucaguuugcagu

SEQ ID NO: 397305 - RNA, 19 nt, Homo sapiens
uaugugcgugugugcaagu

SEQ ID NO: 397306 - RNA, 13 nt, Homo sapiens
uauguuauugcau

SEQ ID NO: 397307 - RNA, 15 nt, Homo sapiens
uauguuuacauauca

SEQ ID NO: 397308 - RNA, 18 nt, Homo sapiens
uauuaacauaagaaaaga

SEQ ID NO: 397309 - RNA, 23 nt, Homo sapiens
uauuaagauuuccaagugccaau

SEQ ID NO: 397310 - RNA, 14 nt, Homo sapiens
uauuauguguuucc

SEQ ID NO: 397311 - RNA, 17 nt, Homo sapiens
uauuauucuucauaaca

SEQ ID NO: 397312 - RNA, 14 nt, Homo sapiens
uauucaggagagua

SEQ ID NO: 397313 - RNA, 13 nt, Homo sapiens
uauucgugcagca

SEQ ID NO: 397314 - RNA, 17 nt, Homo sapiens
uauucugguuacugugg

SEQ ID NO: 397315 - RNA, 12 nt, Homo sapiens
uauucuugucaa

SEQ ID NO: 397316 - RNA, 18 nt, Homo sapiens
uauugacaauaauuucag

SEQ ID NO: 397317 - RNA, 19 nt, Homo sapiens
uauugcagcuuauauucau

SEQ ID NO: 397318 - RNA, 18 nt, Homo sapiens
uauugccuggagugugaa

SEQ ID NO: 397319 - RNA, 14 nt, Homo sapiens
uauugugaucuauc

SEQ ID NO: 397320 - RNA, 13 nt, Homo sapiens
uauuguggcacaa

SEQ ID NO: 397321 - RNA, 16 nt, Homo sapiens
uauuuaccagaccaca

SEQ ID NO: 397322 - RNA, 21 nt, Homo sapiens
uauuuacugagcuucucugug

SEQ ID NO: 397323 - RNA, 15 nt, Homo sapiens
uauuuagugaacuac

SEQ ID NO: 397324 - RNA, 12 nt, Homo sapiens
uauuuauagucg

SEQ ID NO: 397325 - RNA, 17 nt, Homo sapiens
uauuuccuucuccuccu

SEQ ID NO: 397326 - RNA, 16 nt, Homo sapiens
uauuugaaucuacaaa

SEQ ID NO: 397327 - RNA, 21 nt, Homo sapiens
uauuugauaacaguuacucca

SEQ ID NO: 397328 - RNA, 14 nt, Homo sapiens
uauuugcauaacaa

SEQ ID NO: 397329 - RNA, 14 nt, Homo sapiens
uauuuguaucacaa

SEQ ID NO: 397330 - RNA, 24 nt, Homo sapiens
uauuuuaggucuuaauacacacag

SEQ ID NO: 397331 - RNA, 18 nt, Homo sapiens
uauuuuaugaucuuggcu

SEQ ID NO: 397332 - RNA, 20 nt, Homo sapiens
uauuuuauucccuuucacaa

SEQ ID NO: 397333 - RNA, 18 nt, Homo sapiens
uauuuugcauaguaccaa

SEQ ID NO: 397334 - RNA, 17 nt, Homo sapiens
ucaaaacagagauguga

SEQ ID NO: 397335 - RNA, 18 nt, Homo sapiens
ucaaaaccgaguugccag

SEQ ID NO: 397336 - RNA, 13 nt, Homo sapiens
ucaaaagaucaaa

SEQ ID NO: 397337 - RNA, 22 nt, Homo sapiens
ucaaaagcacuuugugcugugu

SEQ ID NO: 397338 - RNA, 18 nt, Homo sapiens
ucaaaauaaaaaccaaga

SEQ ID NO: 397339 - RNA, 13 nt, Homo sapiens
ucaaacaaagcca

SEQ ID NO: 397340 - RNA, 20 nt, Homo sapiens
ucaaaggugauugugccagg

SEQ ID NO: 397341 - RNA, 18 nt, Homo sapiens
ucaaaguaaaacuugcug

SEQ ID NO: 397342 - RNA, 14 nt, Homo sapiens
ucaaauagcauaag

SEQ ID NO: 397343 - RNA, 21 nt, Homo sapiens
ucaaauaugcaaagcacugac

SEQ ID NO: 397344 - RNA, 16 nt, Homo sapiens
ucaaauguauucagau

SEQ ID NO: 397345 - RNA, 20 nt, Homo sapiens
ucaacaccaggagagcuucu

SEQ ID NO: 397346 - RNA, 22 nt, Homo sapiens
ucaacagcauuuucaagcaguu

SEQ ID NO: 397347 - RNA, 22 nt, Homo sapiens
ucaacaucuuggucagauuuga

SEQ ID NO: 397348 - RNA, 22 nt, Homo sapiens
ucaagcagggaagccccaguga

SEQ ID NO: 397349 - RNA, 19 nt, Homo sapiens
ucaaggaaaggccugaaag

SEQ ID NO: 397350 - RNA, 14 nt, Homo sapiens
ucaaggaauuugca

SEQ ID NO: 397351 - RNA, 22 nt, Homo sapiens
ucaaguuggcuucuaaucaaag

SEQ ID NO: 397352 - RNA, 16 nt, Homo sapiens
ucaaguuuuucagaaa

SEQ ID NO: 397353 - RNA, 16 nt, Homo sapiens
ucaauggaaagcugcu

SEQ ID NO: 397354 - RNA, 19 nt, Homo sapiens
ucacaaaucuuaacuugaa

SEQ ID NO: 397355 - RNA, 23 nt, Homo sapiens
ucacaaaugaucgcuaucuagca

SEQ ID NO: 397356 - RNA, 23 nt, Homo sapiens
ucacaacagauuauuaccuuaca

SEQ ID NO: 397357 - RNA, 19 nt, Homo sapiens
ucacaccgcgucuggugac

SEQ ID NO: 397358 - RNA, 23 nt, Homo sapiens
ucacacugaggaacucacaauuc

SEQ ID NO: 397359 - RNA, 18 nt, Homo sapiens
ucacagaagcacagcacc

SEQ ID NO: 397360 - RNA, 15 nt, Homo sapiens
ucacagagugcauug

SEQ ID NO: 397361 - RNA, 18 nt, Homo sapiens
ucacagaugugugauuca

SEQ ID NO: 397362 - RNA, 12 nt, Homo sapiens
ucacagcacuag

SEQ ID NO: 397363 - RNA, 15 nt, Homo sapiens
ucacaguuccucgcc

SEQ ID NO: 397364 - RNA, 15 nt, Homo sapiens
ucacaugaugcauac

SEQ ID NO: 397365 - RNA, 17 nt, Homo sapiens
ucacaugucaguaccuu

SEQ ID NO: 397366 - RNA, 18 nt, Homo sapiens
ucacauucgaguguuuca

SEQ ID NO: 397367 - RNA, 19 nt, Homo sapiens
ucaccaagcucacaguucc

SEQ ID NO: 397368 - RNA, 21 nt, Homo sapiens
ucaccaggaggcggcagugca

SEQ ID NO: 397369 - RNA, 18 nt, Homo sapiens
ucaccccugcccugggau

SEQ ID NO: 397370 - RNA, 22 nt, Homo sapiens
ucaccccuguccucacugcucc

SEQ ID NO: 397371 - RNA, 13 nt, Homo sapiens
ucacccugccuua

SEQ ID NO: 397372 - RNA, 17 nt, Homo sapiens
ucaccuuaggcagggaa

SEQ ID NO: 397373 - RNA, 14 nt, Homo sapiens
ucaccuuccagugu

SEQ ID NO: 397374 - RNA, 14 nt, Homo sapiens
ucacgauauuauua

SEQ ID NO: 397375 - RNA, 23 nt, Homo sapiens
ucacuaaagcaguagaaauaaua

SEQ ID NO: 397376 - RNA, 22 nt, Homo sapiens
ucacucaaucucugauucuguc

SEQ ID NO: 397377 - RNA, 20 nt, Homo sapiens
ucacuccaggauauugacaa

SEQ ID NO: 397378 - RNA, 17 nt, Homo sapiens
ucacugcccccagcucu

SEQ ID NO: 397379 - RNA, 18 nt, Homo sapiens
ucacugcuggcugccuua

SEQ ID NO: 397380 - RNA, 18 nt, Homo sapiens
ucacuggcaugggagacc

SEQ ID NO: 397381 - RNA, 20 nt, Homo sapiens
ucacuuuacaaauucaagcc

SEQ ID NO: 397382 - RNA, 17 nt, Homo sapiens
ucacuuuuacuacccca

SEQ ID NO: 397383 - RNA, 14 nt, Homo sapiens
ucagaaaacucugg

SEQ ID NO: 397384 - RNA, 15 nt, Homo sapiens
ucagaagcucuucua

SEQ ID NO: 397385 - RNA, 17 nt, Homo sapiens
ucagaaugagaaagccu

SEQ ID NO: 397386 - RNA, 17 nt, Homo sapiens
ucagaauggauuuauca

SEQ ID NO: 397387 - RNA, 19 nt, Homo sapiens
ucagacuccugugcaacuu

SEQ ID NO: 397388 - RNA, 15 nt, Homo sapiens
ucagagccaccccua

SEQ ID NO: 397389 - RNA, 15 nt, Homo sapiens
ucagagcccagcuca

SEQ ID NO: 397390 - RNA, 20 nt, Homo sapiens
ucagaggagcggccagaaga

SEQ ID NO: 397391 - RNA, 23 nt, Homo sapiens
ucagagugggguggggagcaugu

SEQ ID NO: 397392 - RNA, 18 nt, Homo sapiens
ucagauaaacaacaaaua

SEQ ID NO: 397393 - RNA, 22 nt, Homo sapiens
ucagauaaagcacccuguauca

SEQ ID NO: 397394 - RNA, 18 nt, Homo sapiens
ucagauaccgacuggggc

SEQ ID NO: 397395 - RNA, 19 nt, Homo sapiens
ucagauggaaccgcaggaa

SEQ ID NO: 397396 - RNA, 15 nt, Homo sapiens
ucagcugaaccuggg

SEQ ID NO: 397397 - RNA, 18 nt, Homo sapiens
ucagcuggaucuccauuc

SEQ ID NO: 397398 - RNA, 20 nt, Homo sapiens
ucaggaaggaugagcauuua

SEQ ID NO: 397399 - RNA, 15 nt, Homo sapiens
ucaggaauacauuug

SEQ ID NO: 397400 - RNA, 17 nt, Homo sapiens
ucaggaauacauuugga

SEQ ID NO: 397401 - RNA, 19 nt, Homo sapiens
ucaggaauacauuuggaaa

SEQ ID NO: 397402 - RNA, 23 nt, Homo sapiens
ucaggccacauggcuaaagaagg

SEQ ID NO: 397403 - RNA, 20 nt, Homo sapiens
ucagggagaguuugggaacu

SEQ ID NO: 397404 - RNA, 18 nt, Homo sapiens
ucagggcugagaggagaa

SEQ ID NO: 397405 - RNA, 14 nt, Homo sapiens
ucagguggaaaaac

SEQ ID NO: 397406 - RNA, 12 nt, Homo sapiens
ucagucagggac

SEQ ID NO: 397407 - RNA, 13 nt, Homo sapiens
ucagucucugagc

SEQ ID NO: 397408 - RNA, 15 nt, Homo sapiens
ucaguguuaaaugug

SEQ ID NO: 397409 - RNA, 17 nt, Homo sapiens
ucauaaacuucagggau

SEQ ID NO: 397410 - RNA, 12 nt, Homo sapiens
ucauaagauauu

SEQ ID NO: 397411 - RNA, 18 nt, Homo sapiens
ucauaauuucuucacuca

SEQ ID NO: 397412 - RNA, 18 nt, Homo sapiens
ucauaugauugugcacau

SEQ ID NO: 397413 - RNA, 23 nt, Homo sapiens
ucauauugguauucacuaaucug

SEQ ID NO: 397414 - RNA, 16 nt, Homo sapiens
ucauauuuucuuucaa

SEQ ID NO: 397415 - RNA, 12 nt, Homo sapiens
ucaucaaugaau

SEQ ID NO: 397416 - RNA, 15 nt, Homo sapiens
ucaucagcauaccuu

SEQ ID NO: 397417 - RNA, 18 nt, Homo sapiens
ucaucagcauaccuuuau

SEQ ID NO: 397418 - RNA, 21 nt, Homo sapiens
ucaucauaaaauaaaguauau

SEQ ID NO: 397419 - RNA, 15 nt, Homo sapiens
ucaucccuaugggau

SEQ ID NO: 397420 - RNA, 20 nt, Homo sapiens
ucaucgcgccacuaagccaa

SEQ ID NO: 397421 - RNA, 13 nt, Homo sapiens
ucaucuguuguuu

SEQ ID NO: 397422 - RNA, 20 nt, Homo sapiens
ucaucuugaccaagcaggaa

SEQ ID NO: 397423 - RNA, 12 nt, Homo sapiens
ucaucuugccac

SEQ ID NO: 397424 - RNA, 14 nt, Homo sapiens
ucaugaaauaugca

SEQ ID NO: 397425 - RNA, 13 nt, Homo sapiens
ucaugaagauauu

SEQ ID NO: 397426 - RNA, 14 nt, Homo sapiens
ucaugagugaauaa

SEQ ID NO: 397427 - RNA, 14 nt, Homo sapiens
ucaugaucaucaca

SEQ ID NO: 397428 - RNA, 14 nt, Homo sapiens
ucaugucaugugua

SEQ ID NO: 397429 - RNA, 20 nt, Homo sapiens
ucauguccccaaaccugcaa

SEQ ID NO: 397430 - RNA, 18 nt, Homo sapiens
ucaugugaccacucuguc

SEQ ID NO: 397431 - RNA, 11 nt, Homo sapiens
ucauuaucuca

SEQ ID NO: 397432 - RNA, 19 nt, Homo sapiens
ucauuaucucaaaacugca

SEQ ID NO: 397433 - RNA, 20 nt, Homo sapiens
ucauucagggauagcacuga

SEQ ID NO: 397434 - RNA, 21 nt, Homo sapiens
ugcugggagaggggguagcua

SEQ ID NO: 397435 - RNA, 14 nt, Homo sapiens
ugcuggugaaccag

SEQ ID NO: 397436 - RNA, 22 nt, Homo sapiens
ugcugugaggcuguccuguaca

SEQ ID NO: 397437 - RNA, 15 nt, Homo sapiens
ugcuguguaucugau

SEQ ID NO: 397438 - RNA, 16 nt, Homo sapiens
ugcuguuccaccuucc

SEQ ID NO: 397439 - RNA, 23 nt, Homo sapiens
ugcuuccuccuuugcucuuggga

SEQ ID NO: 397440 - RNA, 16 nt, Homo sapiens
ugcuucgcagaugucc

SEQ ID NO: 397441 - RNA, 18 nt, Homo sapiens
ugcuuuguaggugucuca

SEQ ID NO: 397442 - RNA, 17 nt, Homo sapiens
uggaaaaagccugugaa

SEQ ID NO: 397443 - RNA, 16 nt, Homo sapiens
uggaaaaagucacauu

SEQ ID NO: 397444 - RNA, 17 nt, Homo sapiens
uggaaaagaaaguacag

SEQ ID NO: 397445 - RNA, 13 nt, Homo sapiens
uggaaaagcaaaa

SEQ ID NO: 397446 - RNA, 21 nt, Homo sapiens
uggaaaugaaacugcugugaa

SEQ ID NO: 397447 - RNA, 15 nt, Homo sapiens
uggaacuucuaauau

SEQ ID NO: 397448 - RNA, 21 nt, Homo sapiens
uggaacuuuuauuacuggggu

SEQ ID NO: 397449 - RNA, 21 nt, Homo sapiens
uggaagagccugcaggugcug

SEQ ID NO: 397450 - RNA, 16 nt, Homo sapiens
uggaagcccuccuucc

SEQ ID NO: 397451 - RNA, 13 nt, Homo sapiens
uggaaggugcugu

SEQ ID NO: 397452 - RNA, 20 nt, Homo sapiens
uggaauaacucuguggcauu

SEQ ID NO: 397453 - RNA, 21 nt, Homo sapiens
uggaauauuguccauugucca

SEQ ID NO: 397454 - RNA, 12 nt, Homo sapiens
uggacacagccc

SEQ ID NO: 397455 - RNA, 17 nt, Homo sapiens
uggacacgucggacagc

SEQ ID NO: 397456 - RNA, 11 nt, Homo sapiens
uggacugggag

SEQ ID NO: 397457 - RNA, 17 nt, Homo sapiens
uggacuuaacucuaauu

SEQ ID NO: 397458 - RNA, 17 nt, Homo sapiens
uggagaaacuguagucu

SEQ ID NO: 397459 - RNA, 13 nt, Homo sapiens
uggagaagcuccc

SEQ ID NO: 397460 - RNA, 14 nt, Homo sapiens
uggagacacaacua

SEQ ID NO: 397461 - RNA, 22 nt, Homo sapiens
uggagacacaacuauuuuucca

SEQ ID NO: 397462 - RNA, 17 nt, Homo sapiens
uggagagaagugagaau

SEQ ID NO: 397463 - RNA, 23 nt, Homo sapiens
uggagccccagugccaagcacag

SEQ ID NO: 397464 - RNA, 16 nt, Homo sapiens
uggaggaaaacugaga

SEQ ID NO: 397465 - RNA, 20 nt, Homo sapiens
uggaggcugucuucucaggc

SEQ ID NO: 397466 - RNA, 14 nt, Homo sapiens
uggauaugugccag

SEQ ID NO: 397467 - RNA, 22 nt, Homo sapiens
uggauugcacguggccucuuga

SEQ ID NO: 397468 - RNA, 16 nt, Homo sapiens
uggcacugcugugcug

SEQ ID NO: 397469 - RNA, 23 nt, Homo sapiens
uggcacugcugugcugugcccaa

SEQ ID NO: 397470 - RNA, 20 nt, Homo sapiens
uggcagcagaguguggccuu

SEQ ID NO: 397471 - RNA, 20 nt, Homo sapiens
uggcagcauacacagaugaa

SEQ ID NO: 397472 - RNA, 16 nt, Homo sapiens
uggcagccgugccuuc

SEQ ID NO: 397473 - RNA, 14 nt, Homo sapiens
uggcaugccuucca

SEQ ID NO: 397474 - RNA, 13 nt, Homo sapiens
uggcccacugcau

SEQ ID NO: 397475 - RNA, 17 nt, Homo sapiens
uggcccccacagaaaga

SEQ ID NO: 397476 - RNA, 19 nt, Homo sapiens
uggccuaaaaaugcaacuu

SEQ ID NO: 397477 - RNA, 17 nt, Homo sapiens
uggccucuggcucucau

SEQ ID NO: 397478 - RNA, 14 nt, Homo sapiens
uggccuguaauccc

SEQ ID NO: 397479 - RNA, 21 nt, Homo sapiens
uggcuacacacaaaccaguau

SEQ ID NO: 397480 - RNA, 14 nt, Homo sapiens
uggcugccuuagaa

SEQ ID NO: 397481 - RNA, 12 nt, Homo sapiens
uggcuggcugcc

SEQ ID NO: 397482 - RNA, 23 nt, Homo sapiens
uggcuucacagaugugugauuca

SEQ ID NO: 397483 - RNA, 21 nt, Homo sapiens
ugggaagaccagcuuugcagu

SEQ ID NO: 397484 - RNA, 17 nt, Homo sapiens
ugggacaggugccaggu

SEQ ID NO: 397485 - RNA, 18 nt, Homo sapiens
ugggagaaucacuugaac

SEQ ID NO: 397486 - RNA, 15 nt, Homo sapiens
ugggagacaugugac

SEQ ID NO: 397487 - RNA, 18 nt, Homo sapiens
ugggagacaugugacauu

SEQ ID NO: 397488 - RNA, 18 nt, Homo sapiens
ugggagacugcugaguca

SEQ ID NO: 397489 - RNA, 14 nt, Homo sapiens
ugggagcacaggca

SEQ ID NO: 397490 - RNA, 14 nt, Homo sapiens
ugggagcaggagau

SEQ ID NO: 397491 - RNA, 22 nt, Homo sapiens
ugggagcucuguuuucaugcua

SEQ ID NO: 397492 - RNA, 15 nt, Homo sapiens
ugggauggauuucca

SEQ ID NO: 397493 - RNA, 16 nt, Homo sapiens
ugggauuggcugugag

SEQ ID NO: 397494 - RNA, 23 nt, Homo sapiens
ugggcacucccuugguggcaaga

SEQ ID NO: 397495 - RNA, 13 nt, Homo sapiens
ugggcagagccca

SEQ ID NO: 397496 - RNA, 14 nt, Homo sapiens
ugggccacagccau

SEQ ID NO: 397497 - RNA, 14 nt, Homo sapiens
ugggccacugugaa

SEQ ID NO: 397498 - RNA, 23 nt, Homo sapiens
uggggacagagcagaacuuucac

SEQ ID NO: 397499 - RNA, 16 nt, Homo sapiens
uggggacucuggaaaa

SEQ ID NO: 397500 - RNA, 16 nt, Homo sapiens
uggggagaaaagacau

SEQ ID NO: 397501 - RNA, 18 nt, Homo sapiens
uggggagaaaagacauga

SEQ ID NO: 397502 - RNA, 19 nt, Homo sapiens
uggggagaaaagacaugaa

SEQ ID NO: 397503 - RNA, 19 nt, Homo sapiens
uggggaguaggacauacca

SEQ ID NO: 397504 - RNA, 20 nt, Homo sapiens
uggggauugcccauccaucu

SEQ ID NO: 397505 - RNA, 23 nt, Homo sapiens
ugggggaaaguguugaccacaga

SEQ ID NO: 397506 - RNA, 19 nt, Homo sapiens
ugggucuucagggggccag

SEQ ID NO: 397507 - RNA, 15 nt, Homo sapiens
ugggucuucccugua

SEQ ID NO: 397508 - RNA, 14 nt, Homo sapiens
ugggugaagacaga

SEQ ID NO: 397509 - RNA, 13 nt, Homo sapiens
ugggugacauuug

SEQ ID NO: 397510 - RNA, 16 nt, Homo sapiens
ugggugggaccacaga

SEQ ID NO: 397511 - RNA, 23 nt, Homo sapiens
uggguugcaggaccucaggugag

SEQ ID NO: 397512 - RNA, 18 nt, Homo sapiens
ugguaauauugacuugua

SEQ ID NO: 397513 - RNA, 22 nt, Homo sapiens
ugguaauccuuuaaacauacaa

SEQ ID NO: 397514 - RNA, 22 nt, Homo sapiens
ugguauaaacguccuacuguau

SEQ ID NO: 397515 - RNA, 12 nt, Homo sapiens
ugguaugugaca

SEQ ID NO: 397516 - RNA, 11 nt, Homo sapiens
ugguccagaau

SEQ ID NO: 397517 - RNA, 23 nt, Homo sapiens
uggugaaagaaaauucuuggaau

SEQ ID NO: 397518 - RNA, 17 nt, Homo sapiens
uggugacaccagccuuu

SEQ ID NO: 397519 - RNA, 17 nt, Homo sapiens
uggugccaaacaaaaag

SEQ ID NO: 397520 - RNA, 14 nt, Homo sapiens
uggugcugacaaag

SEQ ID NO: 397521 - RNA, 15 nt, Homo sapiens
uggugcugaccucca

SEQ ID NO: 397522 - RNA, 22 nt, Homo sapiens
ugguguaaagccaacacccugu

SEQ ID NO: 397523 - RNA, 15 nt, Homo sapiens
ugguuaacaucucag

SEQ ID NO: 397524 - RNA, 22 nt, Homo sapiens
ugguuauggccgaaaaggauau

SEQ ID NO: 397525 - RNA, 15 nt, Homo sapiens
ugguuggguccucac

SEQ ID NO: 397526 - RNA, 22 nt, Homo sapiens
ugguuuuuaaaaaacugcugac

SEQ ID NO: 397527 - RNA, 18 nt, Homo sapiens
uguaaaagagucaucugg

SEQ ID NO: 397528 - RNA, 21 nt, Homo sapiens
uguaaagcaggugcccaggaa

SEQ ID NO: 397529 - RNA, 18 nt, Homo sapiens
uguaaagugauauuuccc

SEQ ID NO: 397530 - RNA, 13 nt, Homo sapiens
uguaaaugugcau

SEQ ID NO: 397531 - RNA, 23 nt, Homo sapiens
uguaacacagcugagagacuuuu

SEQ ID NO: 397532 - RNA, 17 nt, Homo sapiens
uguaagaaacacacuga

SEQ ID NO: 397533 - RNA, 12 nt, Homo sapiens
uguaagcuuuaa

SEQ ID NO: 397534 - RNA, 15 nt, Homo sapiens
uguaauagcauacau

SEQ ID NO: 397535 - RNA, 19 nt, Homo sapiens
uguaaucccagcuacuugg

SEQ ID NO: 397536 - RNA, 12 nt, Homo sapiens
uguaaugaucau

SEQ ID NO: 397537 - RNA, 18 nt, Homo sapiens
uguacaaauauaagaaua

SEQ ID NO: 397538 - RNA, 15 nt, Homo sapiens
uguacauugugggau

SEQ ID NO: 397539 - RNA, 14 nt, Homo sapiens
uguacccuuccuac

SEQ ID NO: 397540 - RNA, 18 nt, Homo sapiens
uguacuugccuuauuaga

SEQ ID NO: 397541 - RNA, 16 nt, Homo sapiens
uguagagcuucuggca

SEQ ID NO: 397542 - RNA, 10 nt, Homo sapiens
uguagagugg

SEQ ID NO: 397543 - RNA, 13 nt, Homo sapiens
uguagcagugaga

SEQ ID NO: 397544 - RNA, 21 nt, Homo sapiens
uguagucccagcuacucagga

SEQ ID NO: 397545 - RNA, 14 nt, Homo sapiens
uguauauaguauga

SEQ ID NO: 397546 - RNA, 16 nt, Homo sapiens
uguaucuuauucacau

SEQ ID NO: 397547 - RNA, 22 nt, Homo sapiens
uguaugcacgugugcacacaca

SEQ ID NO: 397548 - RNA, 18 nt, Homo sapiens
uguauguuccucuaugaa

SEQ ID NO: 397549 - RNA, 18 nt, Homo sapiens
uguauucuucaaccucau

SEQ ID NO: 397550 - RNA, 16 nt, Homo sapiens
uguauuuuaugaucuu

SEQ ID NO: 397551 - RNA, 17 nt, Homo sapiens
uguauuuuuguacccuu

SEQ ID NO: 397552 - RNA, 17 nt, Homo sapiens
ugucaaacaaagccaga

SEQ ID NO: 397553 - RNA, 21 nt, Homo sapiens
ugucaagaugaugaugaucuu

SEQ ID NO: 397554 - RNA, 12 nt, Homo sapiens
ugucaaugucuu

SEQ ID NO: 397555 - RNA, 15 nt, Homo sapiens
ugucacccaaugcau

SEQ ID NO: 397556 - RNA, 21 nt, Homo sapiens
ugucauauggaagaguuaaaa

SEQ ID NO: 397557 - RNA, 17 nt, Homo sapiens
uguccaugugugugcaa

SEQ ID NO: 397558 - RNA, 21 nt, Homo sapiens
uguccaugugugugcaagugu

SEQ ID NO: 397559 - RNA, 17 nt, Homo sapiens
uguccccuccacuguca

SEQ ID NO: 397560 - RNA, 18 nt, Homo sapiens
uguccccuccacugucac

SEQ ID NO: 397561 - RNA, 16 nt, Homo sapiens
ugucccucacuguuga

SEQ ID NO: 397562 - RNA, 13 nt, Homo sapiens
uguccuugcacac

SEQ ID NO: 397563 - RNA, 15 nt, Homo sapiens
uguccuugcacacuc

SEQ ID NO: 397564 - RNA, 16 nt, Homo sapiens
ugucgccucugcauuc

SEQ ID NO: 397565 - RNA, 17 nt, Homo sapiens
ugucuaaaaugccucag

SEQ ID NO: 397566 - RNA, 16 nt, Homo sapiens
ugucucaguccaugaa

SEQ ID NO: 397567 - RNA, 21 nt, Homo sapiens
ugucucggagggauuccccua

SEQ ID NO: 397568 - RNA, 17 nt, Homo sapiens
ugucugugugcaagugu

SEQ ID NO: 397569 - RNA, 21 nt, Homo sapiens
ugucuuaauuaaaagaauauu

SEQ ID NO: 397570 - RNA, 20 nt, Homo sapiens
ugucuuccugcauucaccca

SEQ ID NO: 397571 - RNA, 19 nt, Homo sapiens
ugucuucuccaccacgcug

SEQ ID NO: 397572 - RNA, 23 nt, Homo sapiens
ugugaaaggaagcuccacuguca

SEQ ID NO: 397573 - RNA, 19 nt, Homo sapiens
ugugaacacaucagcuugc

SEQ ID NO: 397574 - RNA, 23 nt, Homo sapiens
ugugaaugaugauccuaggcauu

SEQ ID NO: 397575 - RNA, 11 nt, Homo sapiens
ugugacauuua

SEQ ID NO: 397576 - RNA, 20 nt, Homo sapiens
aaagacauucugacaucuua

SEQ ID NO: 397577 - RNA, 17 nt, Homo sapiens
aaagacauucuuccaaa

SEQ ID NO: 397578 - RNA, 21 nt, Homo sapiens
aaagaccaaauuccuuggcau

SEQ ID NO: 397579 - RNA, 14 nt, Homo sapiens
aaagaccuugcuua

SEQ ID NO: 397580 - RNA, 14 nt, Homo sapiens
aaagacugcauuua

SEQ ID NO: 397581 - RNA, 18 nt, Homo sapiens
aaagagagaugaaccaca

SEQ ID NO: 397582 - RNA, 17 nt, Homo sapiens
aaagagagggcuuuaau

SEQ ID NO: 397583 - RNA, 15 nt, Homo sapiens
aaagaggcagcuuga

SEQ ID NO: 397584 - RNA, 14 nt, Homo sapiens
aaagaguccuauuu

SEQ ID NO: 397585 - RNA, 22 nt, Homo sapiens
aaagaguccuauuugcacugua

SEQ ID NO: 397586 - RNA, 21 nt, Homo sapiens
aaagaugaucuacucagaaau

SEQ ID NO: 397587 - RNA, 23 nt, Homo sapiens
aaagauuggacaccccugcuaua

SEQ ID NO: 397588 - RNA, 17 nt, Homo sapiens
aaagcagggacuugaac

SEQ ID NO: 397589 - RNA, 19 nt, Homo sapiens
aaagcaguggacaccagga

SEQ ID NO: 397590 - RNA, 21 nt, Homo sapiens
aaagccaccagacugacaaau

SEQ ID NO: 397591 - RNA, 17 nt, Homo sapiens
aaagccucagccauuca

SEQ ID NO: 397592 - RNA, 22 nt, Homo sapiens
aaagccugagaagaaagaacca

SEQ ID NO: 397593 - RNA, 16 nt, Homo sapiens
aaagccugcaauuuca

SEQ ID NO: 397594 - RNA, 17 nt, Homo sapiens
aaagccugccucuucca

SEQ ID NO: 397595 - RNA, 13 nt, Homo sapiens
aaagcugccugua

SEQ ID NO: 397596 - RNA, 23 nt, Homo sapiens
aaagcuuucauguaaacugugca

SEQ ID NO: 397597 - RNA, 21 nt, Homo sapiens
aaaggaagcuccacugucacc

SEQ ID NO: 397598 - RNA, 13 nt, Homo sapiens
aaaggaaucucca

SEQ ID NO: 397599 - RNA, 17 nt, Homo sapiens
aaaggacuccacccauc

SEQ ID NO: 397600 - RNA, 15 nt, Homo sapiens
aaaggaugugauaua

SEQ ID NO: 397601 - RNA, 17 nt, Homo sapiens
aaagggagcacuggguu

SEQ ID NO: 397602 - RNA, 10 nt, Homo sapiens
aaagggaugg

SEQ ID NO: 397603 - RNA, 13 nt, Homo sapiens
aaaggugacuggg

SEQ ID NO: 397604 - RNA, 15 nt, Homo sapiens
aaagguggacuggaa

SEQ ID NO: 397605 - RNA, 22 nt, Homo sapiens
aaaggugucuucuuugacuuaa

SEQ ID NO: 397606 - RNA, 22 nt, Homo sapiens
aaagucuuugaagugacuucac

SEQ ID NO: 397607 - RNA, 12 nt, Homo sapiens
aaaguguguauu

SEQ ID NO: 397608 - RNA, 22 nt, Homo sapiens
aaaguucugacuugacuuuagu

SEQ ID NO: 397609 - RNA, 14 nt, Homo sapiens
aaauaaaaacccaa

SEQ ID NO: 397610 - RNA, 15 nt, Homo sapiens
aaauaagaaugauuu

SEQ ID NO: 397611 - RNA, 16 nt, Homo sapiens
aaauaauaaaucuggu

SEQ ID NO: 397612 - RNA, 21 nt, Homo sapiens
aaauacagucuuccauuugca

SEQ ID NO: 397613 - RNA, 16 nt, Homo sapiens
aaauauuuugucuaaa

SEQ ID NO: 397614 - RNA, 22 nt, Homo sapiens
aaaucacacagccaagccaguc

SEQ ID NO: 397615 - RNA, 13 nt, Homo sapiens
aaaucauagcugg

SEQ ID NO: 397616 - RNA, 21 nt, Homo sapiens
aaaucaugaagauauuuuucc

SEQ ID NO: 397617 - RNA, 12 nt, Homo sapiens
aaauccuugaua

SEQ ID NO: 397618 - RNA, 12 nt, Homo sapiens
aaaucuaugaaa

SEQ ID NO: 397619 - RNA, 18 nt, Homo sapiens
aaaucuaugaaauaucau

SEQ ID NO: 397620 - RNA, 22 nt, Homo sapiens
aaaucuuaaaagcccuaaguga

SEQ ID NO: 397621 - RNA, 13 nt, Homo sapiens
aaaugaacugaag

SEQ ID NO: 397622 - RNA, 21 nt, Homo sapiens
aaaugaagguuaggauuuaac

SEQ ID NO: 397623 - RNA, 17 nt, Homo sapiens
aaaugacagauguugaa

SEQ ID NO: 397624 - RNA, 14 nt, Homo sapiens
aaaugagaacauga

SEQ ID NO: 397625 - RNA, 21 nt, Homo sapiens
aaaugcccaucuaugucccuu

SEQ ID NO: 397626 - RNA, 19 nt, Homo sapiens
aaaugcuagguuaauucca

SEQ ID NO: 397627 - RNA, 21 nt, Homo sapiens
aaaugcuagguuaauuccaau

SEQ ID NO: 397628 - RNA, 20 nt, Homo sapiens
aaaugcuguauuagucacag

SEQ ID NO: 397629 - RNA, 20 nt, Homo sapiens
aaaugcuuucuuggccaggg

SEQ ID NO: 397630 - RNA, 20 nt, Homo sapiens
aaauguaauacuccuaagac

SEQ ID NO: 397631 - RNA, 16 nt, Homo sapiens
aaauguacuacugagc

SEQ ID NO: 397632 - RNA, 19 nt, Homo sapiens
aaaugugcagcucccauuu

SEQ ID NO: 397633 - RNA, 14 nt, Homo sapiens
aaaugugccuucau

SEQ ID NO: 397634 - RNA, 17 nt, Homo sapiens
aaauguuguauaaccaa

SEQ ID NO: 397635 - RNA, 13 nt, Homo sapiens
aaauuaaagcuga

SEQ ID NO: 397636 - RNA, 19 nt, Homo sapiens
aaauuagcuugagcaaccu

SEQ ID NO: 397637 - RNA, 18 nt, Homo sapiens
aaauuauguauguuuaca

SEQ ID NO: 397638 - RNA, 21 nt, Homo sapiens
aaauucauuaguuguuaguga

SEQ ID NO: 397639 - RNA, 17 nt, Homo sapiens
aaauuccuugauucaca

SEQ ID NO: 397640 - RNA, 16 nt, Homo sapiens
aaauuugaauuucagu

SEQ ID NO: 397641 - RNA, 20 nt, Homo sapiens
aaauuuguaaaucuuauucu

SEQ ID NO: 397642 - RNA, 12 nt, Homo sapiens
aacaaauaugca

SEQ ID NO: 397643 - RNA, 14 nt, Homo sapiens
aacaaauaugcaaa

SEQ ID NO: 397644 - RNA, 15 nt, Homo sapiens
aacaaauguauuuca

SEQ ID NO: 397645 - RNA, 16 nt, Homo sapiens
aacaaauguauuucaa

SEQ ID NO: 397646 - RNA, 14 nt, Homo sapiens
aacaacaaauaauu

SEQ ID NO: 397647 - RNA, 16 nt, Homo sapiens
aacaacagaucugcag

SEQ ID NO: 397648 - RNA, 15 nt, Homo sapiens
aacaaccuggucaca

SEQ ID NO: 397649 - RNA, 19 nt, Homo sapiens
aacaacuguggucaauccg

SEQ ID NO: 397650 - RNA, 18 nt, Homo sapiens
aacaagcuccaccuucca

SEQ ID NO: 397651 - RNA, 21 nt, Homo sapiens
aacaauucuuauugacucaua

SEQ ID NO: 397652 - RNA, 20 nt, Homo sapiens
aacaccaggagagcuucucc

SEQ ID NO: 397653 - RNA, 20 nt, Homo sapiens
aacacggggcuugcaacuua

SEQ ID NO: 397654 - RNA, 16 nt, Homo sapiens
aacacuucgagcacug

SEQ ID NO: 397655 - RNA, 18 nt, Homo sapiens
aacagaaagcauccuaaa

SEQ ID NO: 397656 - RNA, 14 nt, Homo sapiens
aacagaagcuucca

SEQ ID NO: 397657 - RNA, 20 nt, Homo sapiens
aacagccccucuggacacag

SEQ ID NO: 397658 - RNA, 17 nt, Homo sapiens
aacagcccucaggucag

SEQ ID NO: 397659 - RNA, 20 nt, Homo sapiens
aacagcgcuggguccacccc

SEQ ID NO: 397660 - RNA, 20 nt, Homo sapiens
aacagcuguaaucuaugaau

SEQ ID NO: 397661 - RNA, 15 nt, Homo sapiens
aacaguaacugccau

SEQ ID NO: 397662 - RNA, 15 nt, Homo sapiens
aacaugaaaacaauu

SEQ ID NO: 397663 - RNA, 20 nt, Homo sapiens
aacauuauuuggauaucaaa

SEQ ID NO: 397664 - RNA, 22 nt, Homo sapiens
aacauuucuugguuccaauaaa

SEQ ID NO: 397665 - RNA, 19 nt, Homo sapiens
aaccaaguggcucccacac

SEQ ID NO: 397666 - RNA, 15 nt, Homo sapiens
aaccacaagcacaca

SEQ ID NO: 397667 - RNA, 19 nt, Homo sapiens
aaccacaggcagcauuuag

SEQ ID NO: 397668 - RNA, 15 nt, Homo sapiens
aaccacaucaauauu

SEQ ID NO: 397669 - RNA, 12 nt, Homo sapiens
aaccacauuaua

SEQ ID NO: 397670 - RNA, 23 nt, Homo sapiens
aaccaccuuuucugcuucaauau

SEQ ID NO: 397671 - RNA, 22 nt, Homo sapiens
aaccacuucagcugacuuuucu

SEQ ID NO: 397672 - RNA, 16 nt, Homo sapiens
aaccaggaaccuccuc

SEQ ID NO: 397673 - RNA, 16 nt, Homo sapiens
aaccagggccugagcc

SEQ ID NO: 397674 - RNA, 13 nt, Homo sapiens
aaccauaaacuuc

SEQ ID NO: 397675 - RNA, 22 nt, Homo sapiens
aaccaugagaccacuguuauca

SEQ ID NO: 397676 - RNA, 12 nt, Homo sapiens
aacccaccugcu

SEQ ID NO: 397677 - RNA, 19 nt, Homo sapiens
aacccuauugguaaagaau

SEQ ID NO: 397678 - RNA, 19 nt, Homo sapiens
aacccucuaagggaccuca

SEQ ID NO: 397679 - RNA, 19 nt, Homo sapiens
aaccuacuuucauacugaa

SEQ ID NO: 397680 - RNA, 23 nt, Homo sapiens
aaccucagugauuggcucugugg

SEQ ID NO: 397681 - RNA, 15 nt, Homo sapiens
aaccucauuccccaa

SEQ ID NO: 397682 - RNA, 21 nt, Homo sapiens
aaccucauuccccaaccacuu

SEQ ID NO: 397683 - RNA, 13 nt, Homo sapiens
aaccuuccaucuc

SEQ ID NO: 397684 - RNA, 16 nt, Homo sapiens
aacgaaugguacuaca

SEQ ID NO: 397685 - RNA, 21 nt, Homo sapiens
aacuacagaguuuaugauuua

SEQ ID NO: 397686 - RNA, 17 nt, Homo sapiens
aacuagaauuuauucaa

SEQ ID NO: 397687 - RNA, 16 nt, Homo sapiens
aacuauguacuuuaaa

SEQ ID NO: 397688 - RNA, 16 nt, Homo sapiens
aacucaacuuugacaa

SEQ ID NO: 397689 - RNA, 12 nt, Homo sapiens
aacucagggaca

SEQ ID NO: 397690 - RNA, 15 nt, Homo sapiens
aacucauuccugccu

SEQ ID NO: 397691 - RNA, 20 nt, Homo sapiens
aacucauuccugccugucuc

SEQ ID NO: 397692 - RNA, 12 nt, Homo sapiens
aacuccagugaa

SEQ ID NO: 397693 - RNA, 17 nt, Homo sapiens
aacuccuagcugacuca

SEQ ID NO: 397694 - RNA, 19 nt, Homo sapiens
aacucuguuuucuuucuaa

SEQ ID NO: 397695 - RNA, 14 nt, Homo sapiens
aacugcacugucaa

SEQ ID NO: 397696 - RNA, 21 nt, Homo sapiens
aacugccuuggcuucagggga

SEQ ID NO: 397697 - RNA, 16 nt, Homo sapiens
aacuuagcucacaccu

SEQ ID NO: 397698 - RNA, 14 nt, Homo sapiens
aacuuauaucauca

SEQ ID NO: 397699 - RNA, 19 nt, Homo sapiens
aacuuauaucaucagcaua

SEQ ID NO: 397700 - RNA, 13 nt, Homo sapiens
aacuucaagcaaa

SEQ ID NO: 397701 - RNA, 16 nt, Homo sapiens
aacuucccagugaauu

SEQ ID NO: 397702 - RNA, 14 nt, Homo sapiens
aacuugacccccuu

SEQ ID NO: 397703 - RNA, 16 nt, Homo sapiens
aacuugagggcccaga

SEQ ID NO: 397704 - RNA, 18 nt, Homo sapiens
aacuuuguauuaaugugu

SEQ ID NO: 397705 - RNA, 19 nt, Homo sapiens
aacuuuuugcaaggcauuu

SEQ ID NO: 397706 - RNA, 16 nt, Homo sapiens
aagaaaacaucacuga

SEQ ID NO: 397707 - RNA, 22 nt, Homo sapiens
aagaaagcaaugccaaucuuca

SEQ ID NO: 397708 - RNA, 17 nt, Homo sapiens
aagaaaguacagaacaa

SEQ ID NO: 397709 - RNA, 14 nt, Homo sapiens
aagaagauggauug

SEQ ID NO: 397710 - RNA, 21 nt, Homo sapiens
aagaaucagaaacaggugcau

SEQ ID NO: 397711 - RNA, 17 nt, Homo sapiens
aagaauugaacccagga

SEQ ID NO: 397712 - RNA, 15 nt, Homo sapiens
aagacaucaagcaca

SEQ ID NO: 397713 - RNA, 21 nt, Homo sapiens
aagacauccugagcagugcca

SEQ ID NO: 397714 - RNA, 22 nt, Homo sapiens
aagacauggggaggaaggacaa

SEQ ID NO: 397715 - RNA, 15 nt, Homo sapiens
aagacuacuauacaa

SEQ ID NO: 397716 - RNA, 18 nt, Homo sapiens
aagacuacuauacaaacu

SEQ ID NO: 397717 - RNA, 14 nt, Homo sapiens
aagacuauucaaac

SEQ ID NO: 397718 - RNA, 16 nt, Homo sapiens
acggggcuugcaacuu

SEQ ID NO: 397719 - RNA, 14 nt, Homo sapiens
acgguucaccagcc

SEQ ID NO: 397720 - RNA, 16 nt, Homo sapiens
acgucaaacaugaagu

SEQ ID NO: 397721 - RNA, 12 nt, Homo sapiens
acgucacacuug

SEQ ID NO: 397722 - RNA, 16 nt, Homo sapiens
acguccaccccagugc

SEQ ID NO: 397723 - RNA, 19 nt, Homo sapiens
acgugcauggauaugugcc

SEQ ID NO: 397724 - RNA, 17 nt, Homo sapiens
acgugggcggcagagag

SEQ ID NO: 397725 - RNA, 15 nt, Homo sapiens
acguggggcagcaca

SEQ ID NO: 397726 - RNA, 18 nt, Homo sapiens
acguggggcagcacagag

SEQ ID NO: 397727 - RNA, 16 nt, Homo sapiens
acuaaaaauacaaaaa

SEQ ID NO: 397728 - RNA, 21 nt, Homo sapiens
acuaacuccuaggaaaauacu

SEQ ID NO: 397729 - RNA, 21 nt, Homo sapiens
acuacaugugacuggcaguau

SEQ ID NO: 397730 - RNA, 21 nt, Homo sapiens
acuacugacauguggggccag

SEQ ID NO: 397731 - RNA, 16 nt, Homo sapiens
acuagagucugaacag

SEQ ID NO: 397732 - RNA, 23 nt, Homo sapiens
acuagagucugaacagcuguaau

SEQ ID NO: 397733 - RNA, 20 nt, Homo sapiens
acuagccuuuggcucuggag

SEQ ID NO: 397734 - RNA, 19 nt, Homo sapiens
acuaguaguuccugcuaca

SEQ ID NO: 397735 - RNA, 19 nt, Homo sapiens
acuagucacauucuuguuu

SEQ ID NO: 397736 - RNA, 19 nt, Homo sapiens
acuagugacacauuguaca

SEQ ID NO: 397737 - RNA, 19 nt, Homo sapiens
acuaucucagcaucagaau

SEQ ID NO: 397738 - RNA, 11 nt, Homo sapiens
acuaugcacaa

SEQ ID NO: 397739 - RNA, 15 nt, Homo sapiens
acuauucaaacaguc

SEQ ID NO: 397740 - RNA, 13 nt, Homo sapiens
acuauucugauua

SEQ ID NO: 397741 - RNA, 19 nt, Homo sapiens
acuauucugauuacacaaa

SEQ ID NO: 397742 - RNA, 20 nt, Homo sapiens
acuauugaaaucaagcuuau

SEQ ID NO: 397743 - RNA, 21 nt, Homo sapiens
acuauugaaguugcagauuca

SEQ ID NO: 397744 - RNA, 12 nt, Homo sapiens
acuauuuuccag

SEQ ID NO: 397745 - RNA, 13 nt, Homo sapiens
acucaaacugccu

SEQ ID NO: 397746 - RNA, 21 nt, Homo sapiens
acucaaucucugauucuguca

SEQ ID NO: 397747 - RNA, 23 nt, Homo sapiens
acucacacggacacucaaaagcu

SEQ ID NO: 397748 - RNA, 17 nt, Homo sapiens
acucaccucugccucaa

SEQ ID NO: 397749 - RNA, 15 nt, Homo sapiens
acucaggaugcccag

SEQ ID NO: 397750 - RNA, 13 nt, Homo sapiens
acucauucaggga

SEQ ID NO: 397751 - RNA, 22 nt, Homo sapiens
acuccaaagaaauguaagggaa

SEQ ID NO: 397752 - RNA, 21 nt, Homo sapiens
acuccagauuuuuuacagcug

SEQ ID NO: 397753 - RNA, 20 nt, Homo sapiens
acuccgagagcaugcuuaau

SEQ ID NO: 397754 - RNA, 13 nt, Homo sapiens
acuccuaaaucaa

SEQ ID NO: 397755 - RNA, 14 nt, Homo sapiens
acuccuaaaucaag

SEQ ID NO: 397756 - RNA, 14 nt, Homo sapiens
acuccuagcugacu

SEQ ID NO: 397757 - RNA, 20 nt, Homo sapiens
acuccucuccgcaguuccug

SEQ ID NO: 397758 - RNA, 17 nt, Homo sapiens
acuccuuagagacauca

SEQ ID NO: 397759 - RNA, 13 nt, Homo sapiens
acucuaucagaac

SEQ ID NO: 397760 - RNA, 23 nt, Homo sapiens
acucucacaagauggaaaucaca

SEQ ID NO: 397761 - RNA, 18 nt, Homo sapiens
acucugaaaucucagaau

SEQ ID NO: 397762 - RNA, 14 nt, Homo sapiens
acucugcugucuaa

SEQ ID NO: 397763 - RNA, 22 nt, Homo sapiens
acucugcuuugacugagcagac

SEQ ID NO: 397764 - RNA, 18 nt, Homo sapiens
acucugguaaaugaucac

SEQ ID NO: 397765 - RNA, 21 nt, Homo sapiens
acucuuauagaaaguucaaaa

SEQ ID NO: 397766 - RNA, 15 nt, Homo sapiens
acugaaagaagacau

SEQ ID NO: 397767 - RNA, 16 nt, Homo sapiens
acugaaggacacagca

SEQ ID NO: 397768 - RNA, 11 nt, Homo sapiens
acugaccagcc

SEQ ID NO: 397769 - RNA, 17 nt, Homo sapiens
acugagcagacugguga

SEQ ID NO: 397770 - RNA, 20 nt, Homo sapiens
acugagcagacuggugagca

SEQ ID NO: 397771 - RNA, 17 nt, Homo sapiens
acugaggggguuggggu

SEQ ID NO: 397772 - RNA, 14 nt, Homo sapiens
acugauuucacaac

SEQ ID NO: 397773 - RNA, 19 nt, Homo sapiens
acugauuucacaacagauc

SEQ ID NO: 397774 - RNA, 10 nt, Homo sapiens
acugcaauaa

SEQ ID NO: 397775 - RNA, 19 nt, Homo sapiens
acugcacagugcaucucag

SEQ ID NO: 397776 - RNA, 20 nt, Homo sapiens
acugcagggacugccagucc

SEQ ID NO: 397777 - RNA, 18 nt, Homo sapiens
acugccauggaggcacac

SEQ ID NO: 397778 - RNA, 20 nt, Homo sapiens
acugccucuuccucccucau

SEQ ID NO: 397779 - RNA, 19 nt, Homo sapiens
acugcucccugaagccagc

SEQ ID NO: 397780 - RNA, 21 nt, Homo sapiens
acugcugcuucuuaaccccag

SEQ ID NO: 397781 - RNA, 15 nt, Homo sapiens
acugcugugaaugug

SEQ ID NO: 397782 - RNA, 15 nt, Homo sapiens
acuggcaugggagac

SEQ ID NO: 397783 - RNA, 22 nt, Homo sapiens
acugggaugagccgcugugagc

SEQ ID NO: 397784 - RNA, 13 nt, Homo sapiens
acuguacuccucc

SEQ ID NO: 397785 - RNA, 19 nt, Homo sapiens
acuguaggcacacuuugca

SEQ ID NO: 397786 - RNA, 22 nt, Homo sapiens
acuguauguuuacuucucacca

SEQ ID NO: 397787 - RNA, 22 nt, Homo sapiens
acugugaagagaaccauaucaa

SEQ ID NO: 397788 - RNA, 19 nt, Homo sapiens
acuguuaaauugcugugua

SEQ ID NO: 397789 - RNA, 18 nt, Homo sapiens
acuguugacauccaagcu

SEQ ID NO: 397790 - RNA, 16 nt, Homo sapiens
acuuaaguggcauuaa

SEQ ID NO: 397791 - RNA, 23 nt, Homo sapiens
acuuagcagcuaucucucaguga

SEQ ID NO: 397792 - RNA, 12 nt, Homo sapiens
acuuagcucaca

SEQ ID NO: 397793 - RNA, 16 nt, Homo sapiens
acuuauaucaucagca

SEQ ID NO: 397794 - RNA, 13 nt, Homo sapiens
acuucaagugcau

SEQ ID NO: 397795 - RNA, 12 nt, Homo sapiens
acuucagcagua

SEQ ID NO: 397796 - RNA, 20 nt, Homo sapiens
acuucagcucacacaugaga

SEQ ID NO: 397797 - RNA, 18 nt, Homo sapiens
acuucaguauguugucaa

SEQ ID NO: 397798 - RNA, 19 nt, Homo sapiens
acuucaguauguugucaaa

SEQ ID NO: 397799 - RNA, 18 nt, Homo sapiens
acuuccaccagccugcac

SEQ ID NO: 397800 - RNA, 16 nt, Homo sapiens
acuuccauuaacuuag

SEQ ID NO: 397801 - RNA, 21 nt, Homo sapiens
acuuccuuggacucauuuuaa

SEQ ID NO: 397802 - RNA, 15 nt, Homo sapiens
acuucuaaaugaagu

SEQ ID NO: 397803 - RNA, 20 nt, Homo sapiens
acuucuaaguaaaaccacag

SEQ ID NO: 397804 - RNA, 11 nt, Homo sapiens
acuucucacca

SEQ ID NO: 397805 - RNA, 13 nt, Homo sapiens
acuucucucagga

SEQ ID NO: 397806 - RNA, 22 nt, Homo sapiens
acuucugucuucacaacagauu

SEQ ID NO: 397807 - RNA, 21 nt, Homo sapiens
acuugaugacagacacuucua

SEQ ID NO: 397808 - RNA, 18 nt, Homo sapiens
acuugucuuguucaccuu

SEQ ID NO: 397809 - RNA, 19 nt, Homo sapiens
acuuuaaucccacuugccc

SEQ ID NO: 397810 - RNA, 11 nt, Homo sapiens
acuuuccugca

SEQ ID NO: 397811 - RNA, 14 nt, Homo sapiens
acuuugcacugaua

SEQ ID NO: 397812 - RNA, 17 nt, Homo sapiens
acuuuuuaaaacacaac

SEQ ID NO: 397813 - RNA, 12 nt, Homo sapiens
agaaaagauuau

SEQ ID NO: 397814 - RNA, 19 nt, Homo sapiens
agaaaagauuauauauuau

SEQ ID NO: 397815 - RNA, 21 nt, Homo sapiens
agaaacaacuucuacuucugc

SEQ ID NO: 397816 - RNA, 19 nt, Homo sapiens
agaaacguuuggaacaauc

SEQ ID NO: 397817 - RNA, 20 nt, Homo sapiens
agaaacguuuggaacaaucu

SEQ ID NO: 397818 - RNA, 17 nt, Homo sapiens
agaaacuguagucucag

SEQ ID NO: 397819 - RNA, 16 nt, Homo sapiens
agaaacuugcuuauca

SEQ ID NO: 397820 - RNA, 14 nt, Homo sapiens
agaaagacuauuca

SEQ ID NO: 397821 - RNA, 12 nt, Homo sapiens
agaaagccucag

SEQ ID NO: 397822 - RNA, 14 nt, Homo sapiens
agaaagcucaucuc

SEQ ID NO: 397823 - RNA, 17 nt, Homo sapiens
agaaagcucaucucagc

SEQ ID NO: 397824 - RNA, 15 nt, Homo sapiens
agaaauaauaugcau

SEQ ID NO: 397825 - RNA, 23 nt, Homo sapiens
agaaauacaauucuacauuguca

SEQ ID NO: 397826 - RNA, 15 nt, Homo sapiens
agaacaacuacugug

SEQ ID NO: 397827 - RNA, 18 nt, Homo sapiens
agaaccagagcucagaga

SEQ ID NO: 397828 - RNA, 14 nt, Homo sapiens
agaacugcagucag

SEQ ID NO: 397829 - RNA, 23 nt, Homo sapiens
agaacuucugaaaccucuggguc

SEQ ID NO: 397830 - RNA, 18 nt, Homo sapiens
agaagauggcccagcucc

SEQ ID NO: 397831 - RNA, 13 nt, Homo sapiens
agaaggaaaaaug

SEQ ID NO: 397832 - RNA, 13 nt, Homo sapiens
agaaggagggaga

SEQ ID NO: 397833 - RNA, 18 nt, Homo sapiens
agaaggagggagacauga

SEQ ID NO: 397834 - RNA, 22 nt, Homo sapiens
agaaggauggcauuuuuugcaa

SEQ ID NO: 397835 - RNA, 14 nt, Homo sapiens
agaagguccuuaau

SEQ ID NO: 397836 - RNA, 19 nt, Homo sapiens
agaauauacaaauagcaaa

SEQ ID NO: 397837 - RNA, 19 nt, Homo sapiens
agaauauuuauuaccucug

SEQ ID NO: 397838 - RNA, 18 nt, Homo sapiens
agaaucccuagucuucaa

SEQ ID NO: 397839 - RNA, 20 nt, Homo sapiens
agaaugaacaaauugaacuc

SEQ ID NO: 397840 - RNA, 16 nt, Homo sapiens
agaaugcccagugacc

SEQ ID NO: 397841 - RNA, 12 nt, Homo sapiens
agaauggagcug

SEQ ID NO: 397842 - RNA, 16 nt, Homo sapiens
agaaugucugaucuaa

SEQ ID NO: 397843 - RNA, 15 nt, Homo sapiens
agaaugugacaggca

SEQ ID NO: 397844 - RNA, 23 nt, Homo sapiens
agaauguucuuauguugcccagu

SEQ ID NO: 397845 - RNA, 21 nt, Homo sapiens
agaauuuauucaauuccucug

SEQ ID NO: 397846 - RNA, 15 nt, Homo sapiens
agacacuauuuaucu

SEQ ID NO: 397847 - RNA, 14 nt, Homo sapiens
agacagaagccuca

SEQ ID NO: 397848 - RNA, 19 nt, Homo sapiens
agacaggaagguggugcuu

SEQ ID NO: 397849 - RNA, 20 nt, Homo sapiens
agacaggaugguuacucuug

SEQ ID NO: 397850 - RNA, 16 nt, Homo sapiens
agacaggcucuuagca

SEQ ID NO: 397851 - RNA, 23 nt, Homo sapiens
agacauagaauuaacacaugauc

SEQ ID NO: 397852 - RNA, 18 nt, Homo sapiens
agacaugagcauggcuga

SEQ ID NO: 397853 - RNA, 12 nt, Homo sapiens
agaccagcuuug

SEQ ID NO: 397854 - RNA, 13 nt, Homo sapiens
agaccaguccaug

SEQ ID NO: 397855 - RNA, 20 nt, Homo sapiens
agaccccucucccagcuauu

SEQ ID NO: 397856 - RNA, 21 nt, Homo sapiens
agaccugcugagggaccagcc

SEQ ID NO: 397857 - RNA, 19 nt, Homo sapiens
agaccuguaaucauauaau

SEQ ID NO: 397858 - RNA, 21 nt, Homo sapiens
agacucagggccccagcacua

SEQ ID NO: 397859 - RNA, 13 nt, Homo sapiens
agacuccaaagaa

SEQ ID NO: 397860 - RNA, 14 nt, Homo sapiens
aaagaauacagaaa

SEQ ID NO: 397861 - RNA, 15 nt, Homo sapiens
aaagacaggagguaa

SEQ ID NO: 397862 - RNA, 15 nt, Homo sapiens
aaagaccauuuuucc

SEQ ID NO: 397863 - RNA, 14 nt, Homo sapiens
aaagacuccaaaga

SEQ ID NO: 397864 - RNA, 22 nt, Homo sapiens
aaagaugcauuaucuaugauau

SEQ ID NO: 397865 - RNA, 15 nt, Homo sapiens
aaagaugcccacuga

SEQ ID NO: 397866 - RNA, 16 nt, Homo sapiens
aaagauguuugucaga

SEQ ID NO: 397867 - RNA, 13 nt, Homo sapiens
aaagcaaauguga

SEQ ID NO: 397868 - RNA, 16 nt, Homo sapiens
aaagcagaacagugau

SEQ ID NO: 397869 - RNA, 15 nt, Homo sapiens
aaagcaggugcccag

SEQ ID NO: 397870 - RNA, 20 nt, Homo sapiens
aaagcauuacauuuccaaau

SEQ ID NO: 397871 - RNA, 13 nt, Homo sapiens
aaagcccuuccau

SEQ ID NO: 397872 - RNA, 17 nt, Homo sapiens
aaagccuuuuccagaag

SEQ ID NO: 397873 - RNA, 23 nt, Homo sapiens
aaagccuuuuccagaagaucuga

SEQ ID NO: 397874 - RNA, 20 nt, Homo sapiens
aaagcucuauuaagauuucc

SEQ ID NO: 397875 - RNA, 16 nt, Homo sapiens
aaaggagggucaggaa

SEQ ID NO: 397876 - RNA, 13 nt, Homo sapiens
aaaggcacaguga

SEQ ID NO: 397877 - RNA, 23 nt, Homo sapiens
aaaggcucgauuuuguaucugca

SEQ ID NO: 397878 - RNA, 23 nt, Homo sapiens
aaagguaaaacaugcuggugaac

SEQ ID NO: 397879 - RNA, 16 nt, Homo sapiens
aaagguuacccuguaa

SEQ ID NO: 397880 - RNA, 19 nt, Homo sapiens
aaagugcuaguauuauggg

SEQ ID NO: 397881 - RNA, 19 nt, Homo sapiens
aaaguguaauagcauacau

SEQ ID NO: 397882 - RNA, 23 nt, Homo sapiens
aaaguucccuacuuccugugacu

SEQ ID NO: 397883 - RNA, 14 nt, Homo sapiens
aaauaaauggauaa

SEQ ID NO: 397884 - RNA, 21 nt, Homo sapiens
aaauaaauggauaaguagaau

SEQ ID NO: 397885 - RNA, 17 nt, Homo sapiens
aaauaagccagacauca

SEQ ID NO: 397886 - RNA, 14 nt, Homo sapiens
aaauaagucacuua

SEQ ID NO: 397887 - RNA, 12 nt, Homo sapiens
aaauaauaugca

SEQ ID NO: 397888 - RNA, 15 nt, Homo sapiens
aaauagaaacuugcu

SEQ ID NO: 397889 - RNA, 15 nt, Homo sapiens
aaauagagaauccca

SEQ ID NO: 397890 - RNA, 19 nt, Homo sapiens
aaauagcagguaguccagg

SEQ ID NO: 397891 - RNA, 16 nt, Homo sapiens
aaauaguuuggauuac

SEQ ID NO: 397892 - RNA, 22 nt, Homo sapiens
agaguguuuggggguuccguga

SEQ ID NO: 397893 - RNA, 20 nt, Homo sapiens
agauaacaaucuguauauaa

SEQ ID NO: 397894 - RNA, 13 nt, Homo sapiens
agauaacucuccu

SEQ ID NO: 397895 - RNA, 12 nt, Homo sapiens
agauaaucagug

SEQ ID NO: 397896 - RNA, 18 nt, Homo sapiens
agauaaucagugugucua

SEQ ID NO: 397897 - RNA, 11 nt, Homo sapiens
agauaugauau

SEQ ID NO: 397898 - RNA, 15 nt, Homo sapiens
agaucauauuucaca

SEQ ID NO: 397899 - RNA, 16 nt, Homo sapiens
agaucauccuuuccag

SEQ ID NO: 397900 - RNA, 19 nt, Homo sapiens
agaucauccuuuccagcau

SEQ ID NO: 397901 - RNA, 18 nt, Homo sapiens
agaucccagcucacguca

SEQ ID NO: 397902 - RNA, 18 nt, Homo sapiens
agaucccccagacuuuac

SEQ ID NO: 397903 - RNA, 15 nt, Homo sapiens
agauccugguuggug

SEQ ID NO: 397904 - RNA, 17 nt, Homo sapiens
agauccuuaaugcagag

SEQ ID NO: 397905 - RNA, 18 nt, Homo sapiens
agaucuaaggaugucaca

SEQ ID NO: 397906 - RNA, 21 nt, Homo sapiens
agaucuaaggaugucacaggg

SEQ ID NO: 397907 - RNA, 14 nt, Homo sapiens
agaugaaugggagu

SEQ ID NO: 397908 - RNA, 14 nt, Homo sapiens
agaugaugaugauc

SEQ ID NO: 397909 - RNA, 10 nt, Homo sapiens
agaugcauua

SEQ ID NO: 397910 - RNA, 20 nt, Homo sapiens
agaugccuucuccagacaaa

SEQ ID NO: 397911 - RNA, 15 nt, Homo sapiens
agauggaaugcugug

SEQ ID NO: 397912 - RNA, 21 nt, Homo sapiens
agauggagucuggcucugucu

SEQ ID NO: 397913 - RNA, 22 nt, Homo sapiens
agauggcugugccucugccugu

SEQ ID NO: 397914 - RNA, 16 nt, Homo sapiens
agaugggggacugaga

SEQ ID NO: 397915 - RNA, 21 nt, Homo sapiens
agauggggucucacaguguug

SEQ ID NO: 397916 - RNA, 21 nt, Homo sapiens
agaugguaccgugcaucgcac

SEQ ID NO: 397917 - RNA, 19 nt, Homo sapiens
agaugugaacacaucagcu

SEQ ID NO: 397918 - RNA, 12 nt, Homo sapiens
agaugugcaaca

SEQ ID NO: 397919 - RNA, 22 nt, Homo sapiens
agaugugugauucacaguguga

SEQ ID NO: 397920 - RNA, 16 nt, Homo sapiens
agauguguuaggaaug

SEQ ID NO: 397921 - RNA, 19 nt, Homo sapiens
agauguguuaggaauguca

SEQ ID NO: 397922 - RNA, 16 nt, Homo sapiens
agauuccccauugccu

SEQ ID NO: 397923 - RNA, 16 nt, Homo sapiens
agauuguuaaaauaac

SEQ ID NO: 397924 - RNA, 16 nt, Homo sapiens
agcaaagcugaugaca

SEQ ID NO: 397925 - RNA, 21 nt, Homo sapiens
agcaacacucuauauuuagau

SEQ ID NO: 397926 - RNA, 17 nt, Homo sapiens
agcaacccuaacaguaa

SEQ ID NO: 397927 - RNA, 19 nt, Homo sapiens
agcaaguuucaucagucaa

SEQ ID NO: 397928 - RNA, 14 nt, Homo sapiens
agcaaugacaucuc

SEQ ID NO: 397929 - RNA, 19 nt, Homo sapiens
agcaaugacaucucagggg

SEQ ID NO: 397930 - RNA, 17 nt, Homo sapiens
agcacuacauaaacuga

SEQ ID NO: 397931 - RNA, 20 nt, Homo sapiens
agcacugagcaaagcauuga

SEQ ID NO: 397932 - RNA, 15 nt, Homo sapiens
agcagaacuucugaa

SEQ ID NO: 397933 - RNA, 15 nt, Homo sapiens
agcagaagcacauau

SEQ ID NO: 397934 - RNA, 21 nt, Homo sapiens
agcagaugaccccuccccuaa

SEQ ID NO: 397935 - RNA, 16 nt, Homo sapiens
agcagauuguguaaca

SEQ ID NO: 397936 - RNA, 17 nt, Homo sapiens
agcagcagcaucucuga

SEQ ID NO: 397937 - RNA, 19 nt, Homo sapiens
agcagcuaucucucaguga

SEQ ID NO: 397938 - RNA, 23 nt, Homo sapiens
agcagcuaucucucagugaacug

SEQ ID NO: 397939 - RNA, 15 nt, Homo sapiens
agcaggaagcucaga

SEQ ID NO: 397940 - RNA, 16 nt, Homo sapiens
agcaggagauugagaa

SEQ ID NO: 397941 - RNA, 14 nt, Homo sapiens
agcagggacuugaa

SEQ ID NO: 397942 - RNA, 14 nt, Homo sapiens
agcagggaugaagg

SEQ ID NO: 397943 - RNA, 13 nt, Homo sapiens
agcauaaugugag

SEQ ID NO: 397944 - RNA, 20 nt, Homo sapiens
agcauccucucucacaugga

SEQ ID NO: 397945 - RNA, 17 nt, Homo sapiens
agcaugaagacccugga

SEQ ID NO: 397946 - RNA, 15 nt, Homo sapiens
agcaugaugagaguu

SEQ ID NO: 397947 - RNA, 16 nt, Homo sapiens
agcauggagcauggga

SEQ ID NO: 397948 - RNA, 15 nt, Homo sapiens
agcaugggaagugac

SEQ ID NO: 397949 - RNA, 15 nt, Homo sapiens
agcauuacagugggu

SEQ ID NO: 397950 - RNA, 16 nt, Homo sapiens
agcauuucuagcagug

SEQ ID NO: 397951 - RNA, 17 nt, Homo sapiens
agccaacacccugucua

SEQ ID NO: 397952 - RNA, 23 nt, Homo sapiens
agccaacuuuugcauguuuugua

SEQ ID NO: 397953 - RNA, 19 nt, Homo sapiens
agccaagauugcgccauug

SEQ ID NO: 397954 - RNA, 13 nt, Homo sapiens
agccagauucaaa

SEQ ID NO: 397955 - RNA, 15 nt, Homo sapiens
agccagcagccagcu

SEQ ID NO: 397956 - RNA, 17 nt, Homo sapiens
agccauaugaaugucag

SEQ ID NO: 397957 - RNA, 18 nt, Homo sapiens
agcccagaauagcuuuga

SEQ ID NO: 397958 - RNA, 15 nt, Homo sapiens
agcccauggcacucu

SEQ ID NO: 397959 - RNA, 19 nt, Homo sapiens
agccccaggccucuguguc

SEQ ID NO: 397960 - RNA, 16 nt, Homo sapiens
agcccuaagacguccc

SEQ ID NO: 397961 - RNA, 17 nt, Homo sapiens
agcccucaggucagggu

SEQ ID NO: 397962 - RNA, 19 nt, Homo sapiens
agcccucccccagcaguug

SEQ ID NO: 397963 - RNA, 14 nt, Homo sapiens
agcccuuuacuuga

SEQ ID NO: 397964 - RNA, 15 nt, Homo sapiens
agcccuuuacuugac

SEQ ID NO: 397965 - RNA, 20 nt, Homo sapiens
agccgagauugcaccacugc

SEQ ID NO: 397966 - RNA, 18 nt, Homo sapiens
agccggcgggaggucugc

SEQ ID NO: 397967 - RNA, 13 nt, Homo sapiens
agccgggcaugac

SEQ ID NO: 397968 - RNA, 13 nt, Homo sapiens
agccgugaugccu

SEQ ID NO: 397969 - RNA, 19 nt, Homo sapiens
agccuagcccuucucucau

SEQ ID NO: 397970 - RNA, 16 nt, Homo sapiens
agccuagccgaccuca

SEQ ID NO: 397971 - RNA, 23 nt, Homo sapiens
agccuauguaugccauggaggca

SEQ ID NO: 397972 - RNA, 16 nt, Homo sapiens
agccucaagaugaagg

SEQ ID NO: 397973 - RNA, 19 nt, Homo sapiens
agccuccccaccuucuuca

SEQ ID NO: 397974 - RNA, 17 nt, Homo sapiens
agccucuccccugauua

SEQ ID NO: 397975 - RNA, 20 nt, Homo sapiens
agccucuccccugauuacac

SEQ ID NO: 397976 - RNA, 14 nt, Homo sapiens
agccucugaauaug

SEQ ID NO: 397977 - RNA, 17 nt, Homo sapiens
agccucugaauaugaac

SEQ ID NO: 397978 - RNA, 15 nt, Homo sapiens
agccucugaccccuc

SEQ ID NO: 397979 - RNA, 21 nt, Homo sapiens
agccucugaccccuccucacu

SEQ ID NO: 397980 - RNA, 23 nt, Homo sapiens
agccucugagccccugggacugc

SEQ ID NO: 397981 - RNA, 14 nt, Homo sapiens
agccugcagucauc

SEQ ID NO: 397982 - RNA, 18 nt, Homo sapiens
agccugccucuuccagga

SEQ ID NO: 397983 - RNA, 21 nt, Homo sapiens
agccugcucccccacccccuc

SEQ ID NO: 397984 - RNA, 14 nt, Homo sapiens
agccuggacccugu

SEQ ID NO: 397985 - RNA, 22 nt, Homo sapiens
agccuggccagccuacaauggg

SEQ ID NO: 397986 - RNA, 12 nt, Homo sapiens
agccuggcucuu

SEQ ID NO: 397987 - RNA, 16 nt, Homo sapiens
agccugucucuuccau

SEQ ID NO: 397988 - RNA, 14 nt, Homo sapiens
agccuuugccuccc

SEQ ID NO: 397989 - RNA, 18 nt, Homo sapiens
agcgaggaggcuccagag

SEQ ID NO: 397990 - RNA, 19 nt, Homo sapiens
agcgaggaggcuccagagg

SEQ ID NO: 397991 - RNA, 22 nt, Homo sapiens
agcgcagguuuaguuuacucaa

SEQ ID NO: 397992 - RNA, 15 nt, Homo sapiens
agcuaauguaauaac

SEQ ID NO: 397993 - RNA, 19 nt, Homo sapiens
agcuagaggaaccaacccc

SEQ ID NO: 397994 - RNA, 19 nt, Homo sapiens
agcuagaggacuucuggca

SEQ ID NO: 397995 - RNA, 23 nt, Homo sapiens
agcucagcgccagccugucccau

SEQ ID NO: 397996 - RNA, 13 nt, Homo sapiens
agcucaucucagc

SEQ ID NO: 397997 - RNA, 19 nt, Homo sapiens
agcuccacacccucuccca

SEQ ID NO: 397998 - RNA, 17 nt, Homo sapiens
agcucccucugccugaa

SEQ ID NO: 397999 - RNA, 13 nt, Homo sapiens
agcuccuugacuc

SEQ ID NO: 398000 - RNA, 13 nt, Homo sapiens
agcucgaaaacaa

SEQ ID NO: 398001 - RNA, 20 nt, Homo sapiens
agcucugaaaccaguguuag

SEQ ID NO: 398002 - RNA, 19 nt, Homo sapiens
agcucuggugacaccagcc

SEQ ID NO: 398003 - RNA, 19 nt, Homo sapiens
agcucuguuuuacaauaaa

SEQ ID NO: 398004 - RNA, 22 nt, Homo sapiens
agcuggaagggucaacaucuuu

SEQ ID NO: 398005 - RNA, 22 nt, Homo sapiens
agcuggcagcagaguguggccu

SEQ ID NO: 398006 - RNA, 15 nt, Homo sapiens
agcuggccuguaauc

SEQ ID NO: 398007 - RNA, 21 nt, Homo sapiens
agcuggguuggaaaacaguau

SEQ ID NO: 398008 - RNA, 22 nt, Homo sapiens
agcuggguuggaaaacaguauu

SEQ ID NO: 398009 - RNA, 18 nt, Homo sapiens
agcugguaaacuauuugu

SEQ ID NO: 398010 - RNA, 17 nt, Homo sapiens
agcugucaggcugauua

SEQ ID NO: 398011 - RNA, 19 nt, Homo sapiens
agcugugacuucuccaggu

SEQ ID NO: 398012 - RNA, 12 nt, Homo sapiens
agcuguggcuca

SEQ ID NO: 398013 - RNA, 18 nt, Homo sapiens
agcuuagacuaaggccau

SEQ ID NO: 398014 - RNA, 14 nt, Homo sapiens
agcuucucaauuuc

SEQ ID NO: 398015 - RNA, 14 nt, Homo sapiens
agcuucucugugaa

SEQ ID NO: 398016 - RNA, 21 nt, Homo sapiens
agcuucuuaauauaacugccu

SEQ ID NO: 398017 - RNA, 23 nt, Homo sapiens
agcuucuuccaggugcccagcua

SEQ ID NO: 398018 - RNA, 17 nt, Homo sapiens
agcuugcucuucagugg

SEQ ID NO: 398019 - RNA, 23 nt, Homo sapiens
agcuuggauggagacuccaugag

SEQ ID NO: 398020 - RNA, 19 nt, Homo sapiens
agcuuggcuguagaaggag

SEQ ID NO: 398021 - RNA, 21 nt, Homo sapiens
agcuuuaaacucagggacaga

SEQ ID NO: 398022 - RNA, 22 nt, Homo sapiens
agcuuuauuuuuuaaguauuua

SEQ ID NO: 398023 - RNA, 16 nt, Homo sapiens
agcuuugcugggagag

SEQ ID NO: 398024 - RNA, 13 nt, Homo sapiens
agcuuuuuuacac

SEQ ID NO: 398025 - RNA, 15 nt, Homo sapiens
aggaaaaauguguaa

SEQ ID NO: 398026 - RNA, 15 nt, Homo sapiens
aggaaaaugaauaau

SEQ ID NO: 398027 - RNA, 14 nt, Homo sapiens
aggaagcucagacu

SEQ ID NO: 398028 - RNA, 14 nt, Homo sapiens
aggaagugacucau

SEQ ID NO: 398029 - RNA, 14 nt, Homo sapiens
aggaauacauuugg

SEQ ID NO: 398030 - RNA, 13 nt, Homo sapiens
aggaaucauguca

SEQ ID NO: 398031 - RNA, 16 nt, Homo sapiens
aggaauuugcauuuag

SEQ ID NO: 398032 - RNA, 21 nt, Homo sapiens
aggacacuagaagauuuugaa

SEQ ID NO: 398033 - RNA, 19 nt, Homo sapiens
aggaccagaagcauuucac

SEQ ID NO: 398034 - RNA, 23 nt, Homo sapiens
aggacucagaagccucuggguca

SEQ ID NO: 398035 - RNA, 18 nt, Homo sapiens
aggacuguugacauccaa

SEQ ID NO: 398036 - RNA, 21 nt, Homo sapiens
aggacuuccauuugcuuuguc

SEQ ID NO: 398037 - RNA, 13 nt, Homo sapiens
aggacuucuggca

SEQ ID NO: 398038 - RNA, 20 nt, Homo sapiens
aaauauaaaacugcguuaaa

SEQ ID NO: 398039 - RNA, 15 nt, Homo sapiens
aaauauauaugauau

SEQ ID NO: 398040 - RNA, 20 nt, Homo sapiens
aaauaugauuuuauuugaca

SEQ ID NO: 398041 - RNA, 14 nt, Homo sapiens
aaauauguccuggg

SEQ ID NO: 398042 - RNA, 14 nt, Homo sapiens
aaauauuuuugcca

SEQ ID NO: 398043 - RNA, 21 nt, Homo sapiens
aaaucaaguuggcuucuaauc

SEQ ID NO: 398044 - RNA, 21 nt, Homo sapiens
aaauccugaugagguuucuac

SEQ ID NO: 398045 - RNA, 11 nt, Homo sapiens
aaauccuugau

SEQ ID NO: 398046 - RNA, 23 nt, Homo sapiens
aaaucggaucuggggcucuggga

SEQ ID NO: 398047 - RNA, 18 nt, Homo sapiens
aaaucuacacuccaguga

SEQ ID NO: 398048 - RNA, 15 nt, Homo sapiens
aaaucucacaaauga

SEQ ID NO: 398049 - RNA, 14 nt, Homo sapiens
aaaucuugcaacug

SEQ ID NO: 398050 - RNA, 17 nt, Homo sapiens
aaaugaaguauuucuca

SEQ ID NO: 398051 - RNA, 18 nt, Homo sapiens
aaaugaggguggugaaua

SEQ ID NO: 398052 - RNA, 13 nt, Homo sapiens
aaaugaguauuuc

SEQ ID NO: 398053 - RNA, 23 nt, Homo sapiens
aaaugcccagcuuaaaggggcua

SEQ ID NO: 398054 - RNA, 22 nt, Homo sapiens
aaaugcuguauuagucacagag

SEQ ID NO: 398055 - RNA, 22 nt, Homo sapiens
aaaugguccaggagaaggccaa

SEQ ID NO: 398056 - RNA, 11 nt, Homo sapiens
aaauguacaau

SEQ ID NO: 398057 - RNA, 18 nt, Homo sapiens
aaaugucuagguccccac

SEQ ID NO: 398058 - RNA, 23 nt, Homo sapiens
aaaugucuuuccuuuugcucuua

SEQ ID NO: 398059 - RNA, 18 nt, Homo sapiens
aaaugugaccugugucac

SEQ ID NO: 398060 - RNA, 13 nt, Homo sapiens
aaaugugaugaau

SEQ ID NO: 398061 - RNA, 14 nt, Homo sapiens
aaaugugcuuaugu

SEQ ID NO: 398062 - RNA, 23 nt, Homo sapiens
aaauguggagaaacuguagucuc

SEQ ID NO: 398063 - RNA, 19 nt, Homo sapiens
aaaugugguuacacacuuu

SEQ ID NO: 398064 - RNA, 17 nt, Homo sapiens
aaauuaauacugaagga

SEQ ID NO: 398065 - RNA, 20 nt, Homo sapiens
aaauuacacaguuaaugcca

SEQ ID NO: 398066 - RNA, 22 nt, Homo sapiens
aaauuacacaguuaaugccaca

SEQ ID NO: 398067 - RNA, 13 nt, Homo sapiens
aaauuacccaguu

SEQ ID NO: 398068 - RNA, 17 nt, Homo sapiens
aaauuagcugugugaaa

SEQ ID NO: 398069 - RNA, 14 nt, Homo sapiens
aaauuauaucucag

SEQ ID NO: 398070 - RNA, 14 nt, Homo sapiens
aaauuaugccauag

SEQ ID NO: 398071 - RNA, 21 nt, Homo sapiens
aaauuauuuuuguucauauaa

SEQ ID NO: 398072 - RNA, 23 nt, Homo sapiens
aaauuccuuggcaugccuuccag

SEQ ID NO: 398073 - RNA, 24 nt, Homo sapiens
aaauucucagucaguaauugccaa

SEQ ID NO: 398074 - RNA, 21 nt, Homo sapiens
aaauucuguuuuucuaggccu

SEQ ID NO: 398075 - RNA, 21 nt, Homo sapiens
aaauuuugaguucuacauaag

SEQ ID NO: 398076 - RNA, 23 nt, Homo sapiens
aaauuuugucuuuaacucauaaa

SEQ ID NO: 398077 - RNA, 19 nt, Homo sapiens
aaauuuuuugugauuucaa

SEQ ID NO: 398078 - RNA, 15 nt, Homo sapiens
aacaaacuacaugua

SEQ ID NO: 398079 - RNA, 13 nt, Homo sapiens
aacaaauaugcaa

SEQ ID NO: 398080 - RNA, 19 nt, Homo sapiens
aacaaaugccacacaucac

SEQ ID NO: 398081 - RNA, 17 nt, Homo sapiens
aacaacuguggucaauc

SEQ ID NO: 398082 - RNA, 13 nt, Homo sapiens
aacaagccuaaaa

SEQ ID NO: 398083 - RNA, 13 nt, Homo sapiens
aacaaugaagaua

SEQ ID NO: 398084 - RNA, 23 nt, Homo sapiens
aacaauuuuaggaggaccagagc

SEQ ID NO: 398085 - RNA, 19 nt, Homo sapiens
aacacagacauucugccag

SEQ ID NO: 398086 - RNA, 13 nt, Homo sapiens
aacaccucugcac

SEQ ID NO: 398087 - RNA, 17 nt, Homo sapiens
aacacucaguuguucaa

SEQ ID NO: 398088 - RNA, 23 nt, Homo sapiens
aacacuuuacaauguucauccca

SEQ ID NO: 398089 - RNA, 17 nt, Homo sapiens
aacagaaagcauccuaa

SEQ ID NO: 398090 - RNA, 22 nt, Homo sapiens
aacagaaagccugggugacauu

SEQ ID NO: 398091 - RNA, 16 nt, Homo sapiens
aacagaagcuuccauu

SEQ ID NO: 398092 - RNA, 18 nt, Homo sapiens
aacagcagaacuucugaa

SEQ ID NO: 398093 - RNA, 19 nt, Homo sapiens
aacagccaaaaaggacuuu

SEQ ID NO: 398094 - RNA, 23 nt, Homo sapiens
aacagccaaaacuccacagucaa

SEQ ID NO: 398095 - RNA, 14 nt, Homo sapiens
aacagcucucaccu

SEQ ID NO: 398096 - RNA, 16 nt, Homo sapiens
aacauacuucagcuca

SEQ ID NO: 398097 - RNA, 17 nt, Homo sapiens
aacaucuuuuacauucu

SEQ ID NO: 398098 - RNA, 18 nt, Homo sapiens
aacaucuuuuacauucug

SEQ ID NO: 398099 - RNA, 18 nt, Homo sapiens
aacauugauuauaagcau

SEQ ID NO: 398100 - RNA, 15 nt, Homo sapiens
aacauuucucuggau

SEQ ID NO: 398101 - RNA, 13 nt, Homo sapiens
aacauuucuuggu

SEQ ID NO: 398102 - RNA, 23 nt, Homo sapiens
aacauuuguuccgugucuggcca

SEQ ID NO: 398103 - RNA, 18 nt, Homo sapiens
aaccaaaggugaaggaau

SEQ ID NO: 398104 - RNA, 14 nt, Homo sapiens
aaccaacacuaaca

SEQ ID NO: 398105 - RNA, 14 nt, Homo sapiens
aaccacuucagcug

SEQ ID NO: 398106 - RNA, 18 nt, Homo sapiens
aaccacuucauucuugaa

SEQ ID NO: 398107 - RNA, 15 nt, Homo sapiens
aaccauaaacuucau

SEQ ID NO: 398108 - RNA, 19 nt, Homo sapiens
aaccaugguaauaaaauau

SEQ ID NO: 398109 - RNA, 13 nt, Homo sapiens
aaccccaggaggc

SEQ ID NO: 398110 - RNA, 14 nt, Homo sapiens
aaccccaucucuac

SEQ ID NO: 398111 - RNA, 19 nt, Homo sapiens
aacccuggaccaguggucu

SEQ ID NO: 398112 - RNA, 14 nt, Homo sapiens
aaccgagcaauuuu

SEQ ID NO: 398113 - RNA, 17 nt, Homo sapiens
aaccggggccuacuaga

SEQ ID NO: 398114 - RNA, 13 nt, Homo sapiens
aaccucaaaaugu

SEQ ID NO: 398115 - RNA, 17 nt, Homo sapiens
aaccucacgcaccuccc

SEQ ID NO: 398116 - RNA, 15 nt, Homo sapiens
aaccucugcacuacu

SEQ ID NO: 398117 - RNA, 20 nt, Homo sapiens
aaccuggguaacuagggaag

SEQ ID NO: 398118 - RNA, 14 nt, Homo sapiens
aaccuuccaucucg

SEQ ID NO: 398119 - RNA, 12 nt, Homo sapiens
aacgcugccugc

SEQ ID NO: 398120 - RNA, 23 nt, Homo sapiens
aacgugcauggauaugugccagg

SEQ ID NO: 398121 - RNA, 17 nt, Homo sapiens
aacuaagaaauaugcac

SEQ ID NO: 398122 - RNA, 17 nt, Homo sapiens
aacuaagaugcugccug

SEQ ID NO: 398123 - RNA, 16 nt, Homo sapiens
aacuacauguaaucca

SEQ ID NO: 398124 - RNA, 15 nt, Homo sapiens
aacuacuggcaauuu

SEQ ID NO: 398125 - RNA, 13 nt, Homo sapiens
aacuacugugauc

SEQ ID NO: 398126 - RNA, 19 nt, Homo sapiens
aacucagggacagagccau

SEQ ID NO: 398127 - RNA, 19 nt, Homo sapiens
aacucuccuacacuuccau

SEQ ID NO: 398128 - RNA, 13 nt, Homo sapiens
aacugacaguaaa

SEQ ID NO: 398129 - RNA, 19 nt, Homo sapiens
aacugacaguaaaucucac

SEQ ID NO: 398130 - RNA, 20 nt, Homo sapiens
aacugaccagccuccaugcu

SEQ ID NO: 398131 - RNA, 18 nt, Homo sapiens
aacugacuuaaguggcau

SEQ ID NO: 398132 - RNA, 12 nt, Homo sapiens
aacugccagcaa

SEQ ID NO: 398133 - RNA, 21 nt, Homo sapiens
aacuggaggaguuccuugauc

SEQ ID NO: 398134 - RNA, 15 nt, Homo sapiens
aacugggguggauuu

SEQ ID NO: 398135 - RNA, 23 nt, Homo sapiens
aacugguuccuagggauguguga

SEQ ID NO: 398136 - RNA, 13 nt, Homo sapiens
aacuguagucuca

SEQ ID NO: 398137 - RNA, 22 nt, Homo sapiens
aacugugaaguuuacauuguaa

SEQ ID NO: 398138 - RNA, 15 nt, Homo sapiens
aacuguggucaaucc

SEQ ID NO: 398139 - RNA, 17 nt, Homo sapiens
aacuuaaaaaaaugaca

SEQ ID NO: 398140 - RNA, 14 nt, Homo sapiens
aacuuagagaggua

SEQ ID NO: 398141 - RNA, 13 nt, Homo sapiens
aacuucagggauc

SEQ ID NO: 398142 - RNA, 24 nt, Homo sapiens
aacuucuacuucugcccuugccaa

SEQ ID NO: 398143 - RNA, 23 nt, Homo sapiens
aacuugcacaaaaucacacagcc

SEQ ID NO: 398144 - RNA, 22 nt, Homo sapiens
aacuugcagaauugagagugau

SEQ ID NO: 398145 - RNA, 22 nt, Homo sapiens
aacuuuccucgccugacaacca

SEQ ID NO: 398146 - RNA, 16 nt, Homo sapiens
aacuuuuauuacuggg

SEQ ID NO: 398147 - RNA, 18 nt, Homo sapiens
aacuuuuuccaaucuuag

SEQ ID NO: 398148 - RNA, 14 nt, Homo sapiens
aagaaaaucauauu

SEQ ID NO: 398149 - RNA, 13 nt, Homo sapiens
aagaaacccaagu

SEQ ID NO: 398150 - RNA, 13 nt, Homo sapiens
aagaaagaaccaa

SEQ ID NO: 398151 - RNA, 13 nt, Homo sapiens
aagaaaguacaga

SEQ ID NO: 398152 - RNA, 13 nt, Homo sapiens
aagaaaucaaaga

SEQ ID NO: 398153 - RNA, 23 nt, Homo sapiens
aagaaauguaagggaaacugcca

SEQ ID NO: 398154 - RNA, 17 nt, Homo sapiens
aagaacaguaacugcca

SEQ ID NO: 398155 - RNA, 16 nt, Homo sapiens
aagaaccgagcaauuu

SEQ ID NO: 398156 - RNA, 18 nt, Homo sapiens
aagaagagacucuuugca

SEQ ID NO: 398157 - RNA, 21 nt, Homo sapiens
aagaauaaaauugcacuuuua

SEQ ID NO: 398158 - RNA, 17 nt, Homo sapiens
aagaaugaauaauaauu

SEQ ID NO: 398159 - RNA, 18 nt, Homo sapiens
aagaauguguuuaaacuu

SEQ ID NO: 398160 - RNA, 19 nt, Homo sapiens
aagacagggaagagcagaa

SEQ ID NO: 398161 - RNA, 11 nt, Homo sapiens
aagaccagcuu

SEQ ID NO: 398162 - RNA, 19 nt, Homo sapiens
aagaccagcuuugcaguga

SEQ ID NO: 398163 - RNA, 20 nt, Homo sapiens
aagaccaguccuguuugcag

SEQ ID NO: 398164 - RNA, 13 nt, Homo sapiens
aagacuacuauac

SEQ ID NO: 398165 - RNA, 13 nt, Homo sapiens
aagacuacugaag

SEQ ID NO: 398166 - RNA, 20 nt, Homo sapiens
aagacuauucaaacagucuc

SEQ ID NO: 398167 - RNA, 23 nt, Homo sapiens
aagacugagcucaaggugggaac

SEQ ID NO: 398168 - RNA, 22 nt, Homo sapiens
aagacuguggcugcuagcacuu

SEQ ID NO: 398169 - RNA, 22 nt, Homo sapiens
aagagauccuucuguaaagguu

SEQ ID NO: 398170 - RNA, 16 nt, Homo sapiens
aagaggcagcuugaaa

SEQ ID NO: 398171 - RNA, 21 nt, Homo sapiens
aagagguuuuaaaaaaauccc

SEQ ID NO: 398172 - RNA, 23 nt, Homo sapiens
aagaucaaaagcuuauucaucug

SEQ ID NO: 398173 - RNA, 20 nt, Homo sapiens
aagaugcauuaucuaugaua

SEQ ID NO: 398174 - RNA, 22 nt, Homo sapiens
aagaugcuucucacugccaugc

SEQ ID NO: 398175 - RNA, 17 nt, Homo sapiens
aagauggaaaucacauu

SEQ ID NO: 398176 - RNA, 18 nt, Homo sapiens
aagauggcugacuuugcu

SEQ ID NO: 398177 - RNA, 16 nt, Homo sapiens
aagaugggaacacugg

SEQ ID NO: 398178 - RNA, 15 nt, Homo sapiens
aagauucauccauuu

SEQ ID NO: 398179 - RNA, 23 nt, Homo sapiens
aagauuccugguuaaauuugaau

SEQ ID NO: 398180 - RNA, 21 nt, Homo sapiens
aagauugcgccauugcacucc

SEQ ID NO: 398181 - RNA, 14 nt, Homo sapiens
aagcaacaauacag

SEQ ID NO: 398182 - RNA, 17 nt, Homo sapiens
aagcaccugccgaccuc

SEQ ID NO: 398183 - RNA, 22 nt, Homo sapiens
aggagacucaccucugccucaa

SEQ ID NO: 398184 - RNA, 20 nt, Homo sapiens
aggagauggaaguugcagug

SEQ ID NO: 398185 - RNA, 21 nt, Homo sapiens
aggagggucaggaaggaugag

SEQ ID NO: 398186 - RNA, 20 nt, Homo sapiens
aggagguggagguugcagug

SEQ ID NO: 398187 - RNA, 18 nt, Homo sapiens
aggauacuuuacaugguu

SEQ ID NO: 398188 - RNA, 13 nt, Homo sapiens
aggauaugcagua

SEQ ID NO: 398189 - RNA, 17 nt, Homo sapiens
aggaugggaaggaggga

SEQ ID NO: 398190 - RNA, 19 nt, Homo sapiens
aggaugguccagaauucac

SEQ ID NO: 398191 - RNA, 18 nt, Homo sapiens
aggaugucacagggccaa

SEQ ID NO: 398192 - RNA, 12 nt, Homo sapiens
aggaugugauau

SEQ ID NO: 398193 - RNA, 15 nt, Homo sapiens
aggcacacuuugcac

SEQ ID NO: 398194 - RNA, 22 nt, Homo sapiens
aggcacugcugcccagccucca

SEQ ID NO: 398195 - RNA, 23 nt, Homo sapiens
aggcagaacugcuugaacccagg

SEQ ID NO: 398196 - RNA, 23 nt, Homo sapiens
aggcagugaugcuggaugcuccu

SEQ ID NO: 398197 - RNA, 20 nt, Homo sapiens
aggcaugagccaccgcgccu

SEQ ID NO: 398198 - RNA, 19 nt, Homo sapiens
aggccagcuggcagcagag

SEQ ID NO: 398199 - RNA, 23 nt, Homo sapiens
aggcccuuccucuccacugccuu

SEQ ID NO: 398200 - RNA, 15 nt, Homo sapiens
aggccucuguggcac

SEQ ID NO: 398201 - RNA, 17 nt, Homo sapiens
aggcgaugugcaagugu

SEQ ID NO: 398202 - RNA, 16 nt, Homo sapiens
aggcggcagugcaaca

SEQ ID NO: 398203 - RNA, 15 nt, Homo sapiens
aggcuauguauggaa

SEQ ID NO: 398204 - RNA, 21 nt, Homo sapiens
aggcuccuuccugucuuccug

SEQ ID NO: 398205 - RNA, 14 nt, Homo sapiens
aggcugaggcagaa

SEQ ID NO: 398206 - RNA, 17 nt, Homo sapiens
aggcugaggcaggugga

SEQ ID NO: 398207 - RNA, 17 nt, Homo sapiens
aggcugcgacugaugaa

SEQ ID NO: 398208 - RNA, 18 nt, Homo sapiens
aggcugcgacugaugaag

SEQ ID NO: 398209 - RNA, 20 nt, Homo sapiens
aggcugcgacugaugaaggc

SEQ ID NO: 398210 - RNA, 15 nt, Homo sapiens
aggcuggagugcagu

SEQ ID NO: 398211 - RNA, 22 nt, Homo sapiens
aggcuggcagugacagaacuaa

SEQ ID NO: 398212 - RNA, 12 nt, Homo sapiens
aggcuggcuugu

SEQ ID NO: 398213 - RNA, 14 nt, Homo sapiens
aggcugucuucuca

SEQ ID NO: 398214 - RNA, 17 nt, Homo sapiens
aggcugucuucucaggc

SEQ ID NO: 398215 - RNA, 12 nt, Homo sapiens
aggcuucuucag

SEQ ID NO: 398216 - RNA, 23 nt, Homo sapiens
aggcuuucagaagcucuucuaaa

SEQ ID NO: 398217 - RNA, 18 nt, Homo sapiens
agggaagcugucccucac

SEQ ID NO: 398218 - RNA, 15 nt, Homo sapiens
agggaauaauccaga

SEQ ID NO: 398219 - RNA, 20 nt, Homo sapiens
agggacugacaaaagacuug

SEQ ID NO: 398220 - RNA, 22 nt, Homo sapiens
agggacuucugucuucacaaca

SEQ ID NO: 398221 - RNA, 18 nt, Homo sapiens
agggacuugaaguuguua

SEQ ID NO: 398222 - RNA, 22 nt, Homo sapiens
agggagacaacagcccugucuc

SEQ ID NO: 398223 - RNA, 14 nt, Homo sapiens
agggagcacugggu

SEQ ID NO: 398224 - RNA, 21 nt, Homo sapiens
agggauagaggggggcugccu

SEQ ID NO: 398225 - RNA, 19 nt, Homo sapiens
agggaugguaauccuuuaa

SEQ ID NO: 398226 - RNA, 16 nt, Homo sapiens
agggauuccccuaacc

SEQ ID NO: 398227 - RNA, 15 nt, Homo sapiens
agggcacugcugcug

SEQ ID NO: 398228 - RNA, 19 nt, Homo sapiens
agggcacugcugcugccuu

SEQ ID NO: 398229 - RNA, 16 nt, Homo sapiens
agggcaggaacuugca

SEQ ID NO: 398230 - RNA, 16 nt, Homo sapiens
agggccacaugggagg

SEQ ID NO: 398231 - RNA, 12 nt, Homo sapiens
agggccaggacu

SEQ ID NO: 398232 - RNA, 16 nt, Homo sapiens
agggccccagcacuaa

SEQ ID NO: 398233 - RNA, 15 nt, Homo sapiens
agggcuagugacuug

SEQ ID NO: 398234 - RNA, 23 nt, Homo sapiens
agggcugacucuaggugcccuug

SEQ ID NO: 398235 - RNA, 13 nt, Homo sapiens
aggggcacagggu

SEQ ID NO: 398236 - RNA, 19 nt, Homo sapiens
agggggccaggugcacaga

SEQ ID NO: 398237 - RNA, 14 nt, Homo sapiens
agggucgugcuccg

SEQ ID NO: 398238 - RNA, 19 nt, Homo sapiens
agguaggggcccacuucac

SEQ ID NO: 398239 - RNA, 21 nt, Homo sapiens
aggucaaagcaaguuucauca

SEQ ID NO: 398240 - RNA, 15 nt, Homo sapiens
aggucaagcccagga

SEQ ID NO: 398241 - RNA, 15 nt, Homo sapiens
aggucagggugagga

SEQ ID NO: 398242 - RNA, 16 nt, Homo sapiens
agguccuggugguauu

SEQ ID NO: 398243 - RNA, 21 nt, Homo sapiens
aggugaggauugauuaccuag

SEQ ID NO: 398244 - RNA, 17 nt, Homo sapiens
aggugcuacaaaaacac

SEQ ID NO: 398245 - RNA, 21 nt, Homo sapiens
aggugcuacaaaaacacagca

SEQ ID NO: 398246 - RNA, 23 nt, Homo sapiens
aggugggauaucccuaugcugcc

SEQ ID NO: 398247 - RNA, 16 nt, Homo sapiens
agguguugccaaauau

SEQ ID NO: 398248 - RNA, 18 nt, Homo sapiens
agguugucugaagucacu

SEQ ID NO: 398249 - RNA, 18 nt, Homo sapiens
aguaaaaccacagcaguu

SEQ ID NO: 398250 - RNA, 13 nt, Homo sapiens
aguaaacaaugaa

SEQ ID NO: 398251 - RNA, 22 nt, Homo sapiens
aguaaaugcuagguuaauucca

SEQ ID NO: 398252 - RNA, 11 nt, Homo sapiens
aguaacaugug

SEQ ID NO: 398253 - RNA, 13 nt, Homo sapiens
aguaaugaugucg

SEQ ID NO: 398254 - RNA, 13 nt, Homo sapiens
aguaauugugaaa

SEQ ID NO: 398255 - RNA, 17 nt, Homo sapiens
aguacaggcagcacaga

SEQ ID NO: 398256 - RNA, 14 nt, Homo sapiens
aguagaauccuaaa

SEQ ID NO: 398257 - RNA, 12 nt, Homo sapiens
aguagcaauuuc

SEQ ID NO: 398258 - RNA, 18 nt, Homo sapiens
aguagcuugggacaaauc

SEQ ID NO: 398259 - RNA, 18 nt, Homo sapiens
aguaggugugacuugaac

SEQ ID NO: 398260 - RNA, 13 nt, Homo sapiens
aguagucauuuca

SEQ ID NO: 398261 - RNA, 12 nt, Homo sapiens
aguaugcaaaag

SEQ ID NO: 398262 - RNA, 22 nt, Homo sapiens
aguaugcuuaaugguagcaacu

SEQ ID NO: 398263 - RNA, 16 nt, Homo sapiens
aguauucuugucaaaa

SEQ ID NO: 398264 - RNA, 16 nt, Homo sapiens
aguauuugcauauucu

SEQ ID NO: 398265 - RNA, 22 nt, Homo sapiens
aguauuugcugaauggggaccu

SEQ ID NO: 398266 - RNA, 22 nt, Homo sapiens
agucaaaacagagaugugauaa

SEQ ID NO: 398267 - RNA, 21 nt, Homo sapiens
agucaaauuuguaaaucuuau

SEQ ID NO: 398268 - RNA, 20 nt, Homo sapiens
agucacagagauaauucuag

SEQ ID NO: 398269 - RNA, 21 nt, Homo sapiens
agucacaguuagguagcuuua

SEQ ID NO: 398270 - RNA, 13 nt, Homo sapiens
agucaccaggaau

SEQ ID NO: 398271 - RNA, 13 nt, Homo sapiens
agucaccugccca

SEQ ID NO: 398272 - RNA, 13 nt, Homo sapiens
agucacugacccu

SEQ ID NO: 398273 - RNA, 23 nt, Homo sapiens
agucacugcacagugcaucucag

SEQ ID NO: 398274 - RNA, 17 nt, Homo sapiens
agucagaguugugcaca

SEQ ID NO: 398275 - RNA, 16 nt, Homo sapiens
agucaguaauugccaa

SEQ ID NO: 398276 - RNA, 14 nt, Homo sapiens
agucaguccaggau

SEQ ID NO: 398277 - RNA, 21 nt, Homo sapiens
agucauccaaucuaaccacau

SEQ ID NO: 398278 - RNA, 14 nt, Homo sapiens
agucaucucaacca

SEQ ID NO: 398279 - RNA, 17 nt, Homo sapiens
agucauggcaccaaagc

SEQ ID NO: 398280 - RNA, 12 nt, Homo sapiens
aguccagucucu

SEQ ID NO: 398281 - RNA, 21 nt, Homo sapiens
agucccuaaaaacacagacau

SEQ ID NO: 398282 - RNA, 17 nt, Homo sapiens
aguccuguuugcaggga

SEQ ID NO: 398283 - RNA, 17 nt, Homo sapiens
agucuaggagcugggag

SEQ ID NO: 398284 - RNA, 14 nt, Homo sapiens
agucucaggaccua

SEQ ID NO: 398285 - RNA, 17 nt, Homo sapiens
agucucuucuaagcaaa

SEQ ID NO: 398286 - RNA, 17 nt, Homo sapiens
agucucuucugcuggca

SEQ ID NO: 398287 - RNA, 21 nt, Homo sapiens
agucugacccuuacagccucu

SEQ ID NO: 398288 - RNA, 23 nt, Homo sapiens
agucuuaaaauaacuuauaucau

SEQ ID NO: 398289 - RNA, 16 nt, Homo sapiens
agugaaagccagauuc

SEQ ID NO: 398290 - RNA, 16 nt, Homo sapiens
agugaaauauaugcua

SEQ ID NO: 398291 - RNA, 14 nt, Homo sapiens
agugaacauucuga

SEQ ID NO: 398292 - RNA, 16 nt, Homo sapiens
agugaagacacuggcu

SEQ ID NO: 398293 - RNA, 17 nt, Homo sapiens
agugaaggcuguccuua

SEQ ID NO: 398294 - RNA, 16 nt, Homo sapiens
agugaccggcugcuuu

SEQ ID NO: 398295 - RNA, 12 nt, Homo sapiens
agugauguaauc

SEQ ID NO: 398296 - RNA, 17 nt, Homo sapiens
agugauugauagagugu

SEQ ID NO: 398297 - RNA, 22 nt, Homo sapiens
agugauugauagaguguuauca

SEQ ID NO: 398298 - RNA, 16 nt, Homo sapiens
agugauuggcucugug

SEQ ID NO: 398299 - RNA, 17 nt, Homo sapiens
agugcaaauuugauaca

SEQ ID NO: 398300 - RNA, 12 nt, Homo sapiens
agugcaccacuu

SEQ ID NO: 398301 - RNA, 17 nt, Homo sapiens
agugcacccacucugcu

SEQ ID NO: 398302 - RNA, 17 nt, Homo sapiens
agugccaauauuucuga

SEQ ID NO: 398303 - RNA, 18 nt, Homo sapiens
agugccaauauuucugau

SEQ ID NO: 398304 - RNA, 20 nt, Homo sapiens
agugccaauauuucugauau

SEQ ID NO: 398305 - RNA, 14 nt, Homo sapiens
agugccuuuaguuu

SEQ ID NO: 398306 - RNA, 14 nt, Homo sapiens
agugcuaguauuau

SEQ ID NO: 398307 - RNA, 17 nt, Homo sapiens
agugcugggauuacaau

SEQ ID NO: 398308 - RNA, 15 nt, Homo sapiens
agugcuuuccaauuc

SEQ ID NO: 398309 - RNA, 16 nt, Homo sapiens
aguggauugcauuucu

SEQ ID NO: 398310 - RNA, 19 nt, Homo sapiens
aguggcauuaaacauuuga

SEQ ID NO: 398311 - RNA, 13 nt, Homo sapiens
agugggugaauaa

SEQ ID NO: 398312 - RNA, 19 nt, Homo sapiens
agugggugaauaauacagu

SEQ ID NO: 398313 - RNA, 21 nt, Homo sapiens
agugguguguguuaucagaua

SEQ ID NO: 398314 - RNA, 10 nt, Homo sapiens
aguguaagaa

SEQ ID NO: 398315 - RNA, 21 nt, Homo sapiens
aguguccccuccacugucaca

SEQ ID NO: 398316 - RNA, 22 nt, Homo sapiens
aguguggcccagggaagccaaa

SEQ ID NO: 398317 - RNA, 23 nt, Homo sapiens
aguguggcccagggaagccaaaa

SEQ ID NO: 398318 - RNA, 13 nt, Homo sapiens
agugugugcaagu

SEQ ID NO: 398319 - RNA, 13 nt, Homo sapiens
agugugugcacau

SEQ ID NO: 398320 - RNA, 15 nt, Homo sapiens
aguguugcucucuag

SEQ ID NO: 398321 - RNA, 19 nt, Homo sapiens
aguguuuggguauauucau

SEQ ID NO: 398322 - RNA, 18 nt, Homo sapiens
aguuacucauucagggau

SEQ ID NO: 398323 - RNA, 15 nt, Homo sapiens
aguuagguagcuuua

SEQ ID NO: 398324 - RNA, 13 nt, Homo sapiens
aguucagacuuuu

SEQ ID NO: 398325 - RNA, 23 nt, Homo sapiens
aguucagcugccccacaggugug

SEQ ID NO: 398326 - RNA, 23 nt, Homo sapiens
aguuccucauuuuugaauacagg

SEQ ID NO: 398327 - RNA, 23 nt, Homo sapiens
aguugaaagaguccuauuugcac

SEQ ID NO: 398328 - RNA, 15 nt, Homo sapiens
aguugauucagcucu

SEQ ID NO: 398329 - RNA, 14 nt, Homo sapiens
acuccucuuuacac

SEQ ID NO: 398330 - RNA, 20 nt, Homo sapiens
acuccuuccugccaccugcu

SEQ ID NO: 398331 - RNA, 21 nt, Homo sapiens
acuccuugugguuuaugucau

SEQ ID NO: 398332 - RNA, 18 nt, Homo sapiens
acucuagggaaaaaccag

SEQ ID NO: 398333 - RNA, 23 nt, Homo sapiens
acucucauuccccagguggcuga

SEQ ID NO: 398334 - RNA, 22 nt, Homo sapiens
acucugcccagaccacacguag

SEQ ID NO: 398335 - RNA, 21 nt, Homo sapiens
acucugcccucagggugccug

SEQ ID NO: 398336 - RNA, 19 nt, Homo sapiens
acucuuaguuacucauuca

SEQ ID NO: 398337 - RNA, 17 nt, Homo sapiens
acucuugcaggucucaa

SEQ ID NO: 398338 - RNA, 17 nt, Homo sapiens
acucuuugaaugacaaa

SEQ ID NO: 398339 - RNA, 14 nt, Homo sapiens
acugaaacuucccu

SEQ ID NO: 398340 - RNA, 18 nt, Homo sapiens
acugaagaugcagcaaaa

SEQ ID NO: 398341 - RNA, 19 nt, Homo sapiens
acugaaggagaaggugccc

SEQ ID NO: 398342 - RNA, 18 nt, Homo sapiens
acugacaguaaaucucac

SEQ ID NO: 398343 - RNA, 19 nt, Homo sapiens
acugaccagccuccaugcu

SEQ ID NO: 398344 - RNA, 12 nt, Homo sapiens
acugacuccuua

SEQ ID NO: 398345 - RNA, 13 nt, Homo sapiens
acugacuccuuag

SEQ ID NO: 398346 - RNA, 20 nt, Homo sapiens
acugagcuucgcugaguuaa

SEQ ID NO: 398347 - RNA, 14 nt, Homo sapiens
acugaggaccagcc

SEQ ID NO: 398348 - RNA, 20 nt, Homo sapiens
acugaggcagacagcagcuc

SEQ ID NO: 398349 - RNA, 15 nt, Homo sapiens
acugaggcagggaag

SEQ ID NO: 398350 - RNA, 19 nt, Homo sapiens
acugaugaaggcaugccua

SEQ ID NO: 398351 - RNA, 14 nt, Homo sapiens
acugauuuaucuau

SEQ ID NO: 398352 - RNA, 18 nt, Homo sapiens
acugcacagugcaucuca

SEQ ID NO: 398353 - RNA, 15 nt, Homo sapiens
acugcagcuuuacau

SEQ ID NO: 398354 - RNA, 21 nt, Homo sapiens
acugcauaugaaaggacacua

SEQ ID NO: 398355 - RNA, 22 nt, Homo sapiens
acugcaucguuucaucuuccaa

SEQ ID NO: 398356 - RNA, 22 nt, Homo sapiens
acugccauggaggcacacagcu

SEQ ID NO: 398357 - RNA, 20 nt, Homo sapiens
acugcucauuuggaucccag

SEQ ID NO: 398358 - RNA, 23 nt, Homo sapiens
acugcugccucuugaaugcaggg

SEQ ID NO: 398359 - RNA, 19 nt, Homo sapiens
acugcugugcugugcccaa

SEQ ID NO: 398360 - RNA, 18 nt, Homo sapiens
acuggaaaaguguaauag

SEQ ID NO: 398361 - RNA, 13 nt, Homo sapiens
acuggacucagga

SEQ ID NO: 398362 - RNA, 17 nt, Homo sapiens
acuggaguccagucucu

SEQ ID NO: 398363 - RNA, 17 nt, Homo sapiens
acuggcucaaagacaau

SEQ ID NO: 398364 - RNA, 16 nt, Homo sapiens
acuguaacacuuuaca

SEQ ID NO: 398365 - RNA, 18 nt, Homo sapiens
acugucacuguuucucug

SEQ ID NO: 398366 - RNA, 22 nt, Homo sapiens
acuguccagagagcaacucuga

SEQ ID NO: 398367 - RNA, 22 nt, Homo sapiens
acugucccaaguugcuaaguga

SEQ ID NO: 398368 - RNA, 14 nt, Homo sapiens
acugucccuugccu

SEQ ID NO: 398369 - RNA, 12 nt, Homo sapiens
acugucucaaga

SEQ ID NO: 398370 - RNA, 13 nt, Homo sapiens
acugucuccaugg

SEQ ID NO: 398371 - RNA, 18 nt, Homo sapiens
acugugaggguaaaggcu

SEQ ID NO: 398372 - RNA, 20 nt, Homo sapiens
acuguuaaauugcuguguau

SEQ ID NO: 398373 - RNA, 20 nt, Homo sapiens
acuguuagucauuugcugag

SEQ ID NO: 398374 - RNA, 18 nt, Homo sapiens
acuguucccccugugcag

SEQ ID NO: 398375 - RNA, 19 nt, Homo sapiens
acuguuggcaaggugacau

SEQ ID NO: 398376 - RNA, 17 nt, Homo sapiens
acuuagcaugucccuac

SEQ ID NO: 398377 - RNA, 22 nt, Homo sapiens
acuuauaauuaugcuaccuacu

SEQ ID NO: 398378 - RNA, 19 nt, Homo sapiens
acuucaagaucugaauuug

SEQ ID NO: 398379 - RNA, 13 nt, Homo sapiens
acuucaaggguuu

SEQ ID NO: 398380 - RNA, 22 nt, Homo sapiens
acuucaaggguuuguugaacaa

SEQ ID NO: 398381 - RNA, 19 nt, Homo sapiens
acuucaauccauguaggaa

SEQ ID NO: 398382 - RNA, 19 nt, Homo sapiens
acuucagcaguaccuauaa

SEQ ID NO: 398383 - RNA, 19 nt, Homo sapiens
acuuccugugacuucagcu

SEQ ID NO: 398384 - RNA, 14 nt, Homo sapiens
acuucgagcacugu

SEQ ID NO: 398385 - RNA, 20 nt, Homo sapiens
acuucgugcggaaucagcuu

SEQ ID NO: 398386 - RNA, 15 nt, Homo sapiens
acuucugucuucaca

SEQ ID NO: 398387 - RNA, 17 nt, Homo sapiens
acuucuuauacauuuga

SEQ ID NO: 398388 - RNA, 18 nt, Homo sapiens
acuucuuauacauuugau

SEQ ID NO: 398389 - RNA, 19 nt, Homo sapiens
acuucuuauacauuugaua

SEQ ID NO: 398390 - RNA, 20 nt, Homo sapiens
acuugaccccugcccaccuc

SEQ ID NO: 398391 - RNA, 20 nt, Homo sapiens
acuugagacagcacuaugua

SEQ ID NO: 398392 - RNA, 20 nt, Homo sapiens
acuugaugacccccaaccaa

SEQ ID NO: 398393 - RNA, 19 nt, Homo sapiens
acuugauguguuaucucuu

SEQ ID NO: 398394 - RNA, 20 nt, Homo sapiens
acuugcacaaaaucacacag

SEQ ID NO: 398395 - RNA, 19 nt, Homo sapiens
acuugcacgcccaugugug

SEQ ID NO: 398396 - RNA, 14 nt, Homo sapiens
acuugcugccugaa

SEQ ID NO: 398397 - RNA, 20 nt, Homo sapiens
acuuggagccccagugccaa

SEQ ID NO: 398398 - RNA, 20 nt, Homo sapiens
acuugggccacugugaagag

SEQ ID NO: 398399 - RNA, 16 nt, Homo sapiens
acuugugucccaugau

SEQ ID NO: 398400 - RNA, 13 nt, Homo sapiens
acuuuaagcacua

SEQ ID NO: 398401 - RNA, 13 nt, Homo sapiens
acuuuaauucuca

SEQ ID NO: 398402 - RNA, 14 nt, Homo sapiens
acuuuaauucucau

SEQ ID NO: 398403 - RNA, 18 nt, Homo sapiens
acuuucagguacuaaaua

SEQ ID NO: 398404 - RNA, 17 nt, Homo sapiens
acuuuccucgccugaca

SEQ ID NO: 398405 - RNA, 18 nt, Homo sapiens
acuuucuuaucacuuaua

SEQ ID NO: 398406 - RNA, 19 nt, Homo sapiens
acuuuguauuaauguguua

SEQ ID NO: 398407 - RNA, 22 nt, Homo sapiens
acuuuguuuagcccaaaaccaa

SEQ ID NO: 398408 - RNA, 23 nt, Homo sapiens
acuuuuaaguugcugaugaacuc

SEQ ID NO: 398409 - RNA, 17 nt, Homo sapiens
acuuuucuaacauaugu

SEQ ID NO: 398410 - RNA, 18 nt, Homo sapiens
acuuuuuacagugcuauu

SEQ ID NO: 398411 - RNA, 14 nt, Homo sapiens
acuuuuuccaaucu

SEQ ID NO: 398412 - RNA, 11 nt, Homo sapiens
agaaaaaccac

SEQ ID NO: 398413 - RNA, 12 nt, Homo sapiens
agaaaaauuauu

SEQ ID NO: 398414 - RNA, 12 nt, Homo sapiens
agaaaagacaug

SEQ ID NO: 398415 - RNA, 21 nt, Homo sapiens
agaaaauaguuuggauuacuu

SEQ ID NO: 398416 - RNA, 13 nt, Homo sapiens
agaaacacugggc

SEQ ID NO: 398417 - RNA, 12 nt, Homo sapiens
agaaacccaagu

SEQ ID NO: 398418 - RNA, 23 nt, Homo sapiens
agaaagccgggcaugacggcuca

SEQ ID NO: 398419 - RNA, 13 nt, Homo sapiens
agaaaguuaugaa

SEQ ID NO: 398420 - RNA, 14 nt, Homo sapiens
agaaauaauaugca

SEQ ID NO: 398421 - RNA, 22 nt, Homo sapiens
agaaaucuuguuggcaaaucag

SEQ ID NO: 398422 - RNA, 12 nt, Homo sapiens
agaaauguacaa

SEQ ID NO: 398423 - RNA, 12 nt, Homo sapiens
agaacagccgcu

SEQ ID NO: 398424 - RNA, 15 nt, Homo sapiens
agaacaggcaaguga

SEQ ID NO: 398425 - RNA, 18 nt, Homo sapiens
agaacccuuggagccaau

SEQ ID NO: 398426 - RNA, 22 nt, Homo sapiens
agaacuggaggaguuccuugau

SEQ ID NO: 398427 - RNA, 14 nt, Homo sapiens
agaagagcuguuca

SEQ ID NO: 398428 - RNA, 16 nt, Homo sapiens
agaagcacauaugaac

SEQ ID NO: 398429 - RNA, 18 nt, Homo sapiens
cagcagcaucucugaaca

SEQ ID NO: 398430 - RNA, 17 nt, Homo sapiens
cagcagccagcucucag

SEQ ID NO: 398431 - RNA, 21 nt, Homo sapiens
cagcagcucaggcacacuucu

SEQ ID NO: 398432 - RNA, 21 nt, Homo sapiens
cagcaguugaaaagacuccaa

SEQ ID NO: 398433 - RNA, 21 nt, Homo sapiens
cagcauaccugcuggugcaga

SEQ ID NO: 398434 - RNA, 17 nt, Homo sapiens
cagcauucucacuccua

SEQ ID NO: 398435 - RNA, 21 nt, Homo sapiens
cagcauuuagacccugcauuu

SEQ ID NO: 398436 - RNA, 13 nt, Homo sapiens
cagccacauucua

SEQ ID NO: 398437 - RNA, 13 nt, Homo sapiens
cagcccagggugg

SEQ ID NO: 398438 - RNA, 15 nt, Homo sapiens
cagcccugucucaaa

SEQ ID NO: 398439 - RNA, 17 nt, Homo sapiens
cagccuccuccugacca

SEQ ID NO: 398440 - RNA, 20 nt, Homo sapiens
cagccuccuguguagcuggg

SEQ ID NO: 398441 - RNA, 22 nt, Homo sapiens
cagccucugaccccuccucacu

SEQ ID NO: 398442 - RNA, 15 nt, Homo sapiens
cagccugcuccagcu

SEQ ID NO: 398443 - RNA, 23 nt, Homo sapiens
cagccuggaggccgggugcucag

SEQ ID NO: 398444 - RNA, 21 nt, Homo sapiens
cagccuggccaacauggugaa

SEQ ID NO: 398445 - RNA, 18 nt, Homo sapiens
cagccugggcaaugugau

SEQ ID NO: 398446 - RNA, 20 nt, Homo sapiens
cagccugggcgacagagcca

SEQ ID NO: 398447 - RNA, 22 nt, Homo sapiens
cagccuggggggucguggcaga

SEQ ID NO: 398448 - RNA, 18 nt, Homo sapiens
cagcgaaugaaugcugua

SEQ ID NO: 398449 - RNA, 14 nt, Homo sapiens
cagcucaaaggcac

SEQ ID NO: 398450 - RNA, 13 nt, Homo sapiens
cagcucccaugua

SEQ ID NO: 398451 - RNA, 11 nt, Homo sapiens
cagcucugcaa

SEQ ID NO: 398452 - RNA, 21 nt, Homo sapiens
cagcucugcauuaucugaggu

SEQ ID NO: 398453 - RNA, 19 nt, Homo sapiens
cagcugaagaacaucucga

SEQ ID NO: 398454 - RNA, 20 nt, Homo sapiens
cagcugaccuuugucaucuu

SEQ ID NO: 398455 - RNA, 24 nt, Homo sapiens
cagcugacuuuucuguccgagcuu

SEQ ID NO: 398456 - RNA, 21 nt, Homo sapiens
cagcuggaagggucaacaucu

SEQ ID NO: 398457 - RNA, 23 nt, Homo sapiens
cagcuggguuggaaaacaguauu

SEQ ID NO: 398458 - RNA, 14 nt, Homo sapiens
cagcugguggagca

SEQ ID NO: 398459 - RNA, 17 nt, Homo sapiens
cagcuuauauucaucca

SEQ ID NO: 398460 - RNA, 22 nt, Homo sapiens
cagcuuaucucaggggugugcg

SEQ ID NO: 398461 - RNA, 17 nt, Homo sapiens
cagcuucucuccacuga

SEQ ID NO: 398462 - RNA, 23 nt, Homo sapiens
cagcuuuguuuguugucagcuga

SEQ ID NO: 398463 - RNA, 19 nt, Homo sapiens
caggaaaucaaauaugcaa

SEQ ID NO: 398464 - RNA, 15 nt, Homo sapiens
caggaaccucagggc

SEQ ID NO: 398465 - RNA, 15 nt, Homo sapiens
caggaacuugcacaa

SEQ ID NO: 398466 - RNA, 14 nt, Homo sapiens
caggaauacauuug

SEQ ID NO: 398467 - RNA, 19 nt, Homo sapiens
caggacauuuggcugugau

SEQ ID NO: 398468 - RNA, 20 nt, Homo sapiens
caggacccugggaccacaga

SEQ ID NO: 398469 - RNA, 15 nt, Homo sapiens
caggaccugccugua

SEQ ID NO: 398470 - RNA, 13 nt, Homo sapiens
caggacucagaag

SEQ ID NO: 398471 - RNA, 22 nt, Homo sapiens
caggacucugccuccucuucaa

SEQ ID NO: 398472 - RNA, 20 nt, Homo sapiens
caggacuuccauuugcuuug

SEQ ID NO: 398473 - RNA, 21 nt, Homo sapiens
caggagagaaugcccagugac

SEQ ID NO: 398474 - RNA, 22 nt, Homo sapiens
caggagaggggcagaacagccg

SEQ ID NO: 398475 - RNA, 19 nt, Homo sapiens
caggagcugggauccuaag

SEQ ID NO: 398476 - RNA, 19 nt, Homo sapiens
caggagguaaagaaauagc

SEQ ID NO: 398477 - RNA, 17 nt, Homo sapiens
caggaguuagaggccag

SEQ ID NO: 398478 - RNA, 12 nt, Homo sapiens
caggauggucau

SEQ ID NO: 398479 - RNA, 17 nt, Homo sapiens
caggauuagacagucaa

SEQ ID NO: 398480 - RNA, 12 nt, Homo sapiens
caggcacaaaau

SEQ ID NO: 398481 - RNA, 13 nt, Homo sapiens
caggcaccugcca

SEQ ID NO: 398482 - RNA, 14 nt, Homo sapiens
caggcagcauuuag

SEQ ID NO: 398483 - RNA, 23 nt, Homo sapiens
caggcccuccuugucuuuuuacu

SEQ ID NO: 398484 - RNA, 18 nt, Homo sapiens
caggcccuuccucuccac

SEQ ID NO: 398485 - RNA, 19 nt, Homo sapiens
caggccgagaugugcaaca

SEQ ID NO: 398486 - RNA, 20 nt, Homo sapiens
caggcgauccaccugucuca

SEQ ID NO: 398487 - RNA, 16 nt, Homo sapiens
caggcgaugugcaagu

SEQ ID NO: 398488 - RNA, 17 nt, Homo sapiens
caggcuacugucagcuc

SEQ ID NO: 398489 - RNA, 23 nt, Homo sapiens
caggcuagggaugguaauccuuu

SEQ ID NO: 398490 - RNA, 13 nt, Homo sapiens
caggcuggucuca

SEQ ID NO: 398491 - RNA, 19 nt, Homo sapiens
cagggaaaauuauuugcau

SEQ ID NO: 398492 - RNA, 18 nt, Homo sapiens
cagggaagccccagugag

SEQ ID NO: 398493 - RNA, 20 nt, Homo sapiens
cagggaagccccagugagua

SEQ ID NO: 398494 - RNA, 23 nt, Homo sapiens
cagggaaguggggaaguguucca

SEQ ID NO: 398495 - RNA, 15 nt, Homo sapiens
cagggacccacuuca

SEQ ID NO: 398496 - RNA, 18 nt, Homo sapiens
cagggacuguaaaaccac

SEQ ID NO: 398497 - RNA, 23 nt, Homo sapiens
cagggacuugaaguuguuacuaa

SEQ ID NO: 398498 - RNA, 21 nt, Homo sapiens
cagggauuaaccucugcacua

SEQ ID NO: 398499 - RNA, 18 nt, Homo sapiens
cagggcucagccuggugg

SEQ ID NO: 398500 - RNA, 21 nt, Homo sapiens
cagggcucagccuggugggcc

SEQ ID NO: 398501 - RNA, 22 nt, Homo sapiens
cagggcucagccuggugggccu

SEQ ID NO: 398502 - RNA, 13 nt, Homo sapiens
cagggcugugauc

SEQ ID NO: 398503 - RNA, 14 nt, Homo sapiens
cagggcugugaucg

SEQ ID NO: 398504 - RNA, 18 nt, Homo sapiens
caggggaaaaugaagguu

SEQ ID NO: 398505 - RNA, 20 nt, Homo sapiens
cagggucugcucuuucucug

SEQ ID NO: 398506 - RNA, 13 nt, Homo sapiens
cagguaaggugag

SEQ ID NO: 398507 - RNA, 22 nt, Homo sapiens
cagguaugggacaggugccagg

SEQ ID NO: 398508 - RNA, 17 nt, Homo sapiens
caggugcgcacuaccac

SEQ ID NO: 398509 - RNA, 10 nt, Homo sapiens
caggugggag

SEQ ID NO: 398510 - RNA, 19 nt, Homo sapiens
cagguuuugaaaauguaca

SEQ ID NO: 398511 - RNA, 18 nt, Homo sapiens
caguacaggcagcacaga

SEQ ID NO: 398512 - RNA, 16 nt, Homo sapiens
caguagcuguggugag

SEQ ID NO: 398513 - RNA, 20 nt, Homo sapiens
caguaggcaguagacuauaa

SEQ ID NO: 398514 - RNA, 17 nt, Homo sapiens
cagucacauuccaagcc

SEQ ID NO: 398515 - RNA, 12 nt, Homo sapiens
cagucaccugcc

SEQ ID NO: 398516 - RNA, 17 nt, Homo sapiens
cagucagaguugugcac

SEQ ID NO: 398517 - RNA, 19 nt, Homo sapiens
cagucagaguugugcacau

SEQ ID NO: 398518 - RNA, 20 nt, Homo sapiens
caaaggagggucaggaagga

SEQ ID NO: 398519 - RNA, 15 nt, Homo sapiens
caaaggauacuguaa

SEQ ID NO: 398520 - RNA, 17 nt, Homo sapiens
caaagugcugcgauuac

SEQ ID NO: 398521 - RNA, 20 nt, Homo sapiens
caaaguuguauguggcauga

SEQ ID NO: 398522 - RNA, 20 nt, Homo sapiens
caaaguuugcucaaggagaa

SEQ ID NO: 398523 - RNA, 21 nt, Homo sapiens
caaauaugcaaagcacugacu

SEQ ID NO: 398524 - RNA, 16 nt, Homo sapiens
caaaucuuaacuugaa

SEQ ID NO: 398525 - RNA, 18 nt, Homo sapiens
caaaucuuaacuugaagg

SEQ ID NO: 398526 - RNA, 15 nt, Homo sapiens
caaaugccacacggc

SEQ ID NO: 398527 - RNA, 16 nt, Homo sapiens
caaaugcuauauugca

SEQ ID NO: 398528 - RNA, 11 nt, Homo sapiens
caaauuucaca

SEQ ID NO: 398529 - RNA, 22 nt, Homo sapiens
caacaccucugcacaagcugca

SEQ ID NO: 398530 - RNA, 17 nt, Homo sapiens
caacacuguacacauaa

SEQ ID NO: 398531 - RNA, 14 nt, Homo sapiens
caacagaucugcag

SEQ ID NO: 398532 - RNA, 19 nt, Homo sapiens
caacagcccugucucaaaa

SEQ ID NO: 398533 - RNA, 22 nt, Homo sapiens
caacauaauuaaauuuugaguu

SEQ ID NO: 398534 - RNA, 20 nt, Homo sapiens
caaccaauuccaaguuuuaa

SEQ ID NO: 398535 - RNA, 15 nt, Homo sapiens
caacccuuugcccca

SEQ ID NO: 398536 - RNA, 22 nt, Homo sapiens
caacccuuugccccaccuuuau

SEQ ID NO: 398537 - RNA, 15 nt, Homo sapiens
caaccuacuuucaua

SEQ ID NO: 398538 - RNA, 15 nt, Homo sapiens
caacgagcagugccg

SEQ ID NO: 398539 - RNA, 18 nt, Homo sapiens
caacucugagaucuaagg

SEQ ID NO: 398540 - RNA, 13 nt, Homo sapiens
caacugaccagcc

SEQ ID NO: 398541 - RNA, 13 nt, Homo sapiens
caacuuagcucac

SEQ ID NO: 398542 - RNA, 20 nt, Homo sapiens
caacuucagcaguaccuaua

SEQ ID NO: 398543 - RNA, 17 nt, Homo sapiens
caacuugggaacuagac

SEQ ID NO: 398544 - RNA, 20 nt, Homo sapiens
caacuuuuuaccuaguacaa

SEQ ID NO: 398545 - RNA, 19 nt, Homo sapiens
caagaaagccucagccauu

SEQ ID NO: 398546 - RNA, 22 nt, Homo sapiens
caagacaauucuucuucuucca

SEQ ID NO: 398547 - RNA, 19 nt, Homo sapiens
caagacucugucucaaaaa

SEQ ID NO: 398548 - RNA, 20 nt, Homo sapiens
caagacuuggcaacagaagc

SEQ ID NO: 398549 - RNA, 18 nt, Homo sapiens
caagauccuuaaugcaga

SEQ ID NO: 398550 - RNA, 18 nt, Homo sapiens
caagaugugggcagugau

SEQ ID NO: 398551 - RNA, 21 nt, Homo sapiens
caagauugcgccauugcacuc

SEQ ID NO: 398552 - RNA, 21 nt, Homo sapiens
caagcaaaaacaaaugggaaa

SEQ ID NO: 398553 - RNA, 15 nt, Homo sapiens
caagcacagaaggag

SEQ ID NO: 398554 - RNA, 18 nt, Homo sapiens
caagcacugcaugggcaa

SEQ ID NO: 398555 - RNA, 18 nt, Homo sapiens
caagcagccaagcuccuu

SEQ ID NO: 398556 - RNA, 15 nt, Homo sapiens
caagcaggaagcuca

SEQ ID NO: 398557 - RNA, 20 nt, Homo sapiens
caagcagggaagccccagug

SEQ ID NO: 398558 - RNA, 20 nt, Homo sapiens
caagcauaccaacacgagca

SEQ ID NO: 398559 - RNA, 12 nt, Homo sapiens
caagcuauucaa

SEQ ID NO: 398560 - RNA, 21 nt, Homo sapiens
caagcugugacuucuccaggu

SEQ ID NO: 398561 - RNA, 14 nt, Homo sapiens
caaggacuuugcag

SEQ ID NO: 398562 - RNA, 15 nt, Homo sapiens
caaggcugcagugag

SEQ ID NO: 398563 - RNA, 19 nt, Homo sapiens
caaggcuggcagugacaga

SEQ ID NO: 398564 - RNA, 19 nt, Homo sapiens
caaggcuuuauauuuuuaa

SEQ ID NO: 398565 - RNA, 15 nt, Homo sapiens
caaguagcacccugg

SEQ ID NO: 398566 - RNA, 18 nt, Homo sapiens
caagucaugugcauuucc

SEQ ID NO: 398567 - RNA, 20 nt, Homo sapiens
caagucuuuacagaaucaaa

SEQ ID NO: 398568 - RNA, 18 nt, Homo sapiens
caaguguagguaucauuu

SEQ ID NO: 398569 - RNA, 15 nt, Homo sapiens
caagugucucagucc

SEQ ID NO: 398570 - RNA, 16 nt, Homo sapiens
caaguguguaugugcg

SEQ ID NO: 398571 - RNA, 17 nt, Homo sapiens
caaguguguaugugcgu

SEQ ID NO: 398572 - RNA, 14 nt, Homo sapiens
caagugugugcaca

SEQ ID NO: 398573 - RNA, 22 nt, Homo sapiens
caagugugugcaugugugcgag

SEQ ID NO: 398574 - RNA, 18 nt, Homo sapiens
caaguuccgucaguccaa

SEQ ID NO: 398575 - RNA, 18 nt, Homo sapiens
caaguuucuagcuagaaa

SEQ ID NO: 398576 - RNA, 17 nt, Homo sapiens
caauacaugcugcuaau

SEQ ID NO: 398577 - RNA, 21 nt, Homo sapiens
caauacaugcugcuaauucaa

SEQ ID NO: 398578 - RNA, 15 nt, Homo sapiens
caauaguuguugauu

SEQ ID NO: 398579 - RNA, 14 nt, Homo sapiens
caauaguuugcaua

SEQ ID NO: 398580 - RNA, 12 nt, Homo sapiens
caauaugcauuu

SEQ ID NO: 398581 - RNA, 12 nt, Homo sapiens
caaucacacuga

SEQ ID NO: 398582 - RNA, 16 nt, Homo sapiens
caaucacacugaggaa

SEQ ID NO: 398583 - RNA, 20 nt, Homo sapiens
gccugugguuaacaucucag

SEQ ID NO: 398584 - RNA, 22 nt, Homo sapiens
gccuguuugcuuagcauuccua

SEQ ID NO: 398585 - RNA, 15 nt, Homo sapiens
gccuuaaccaugagg

SEQ ID NO: 398586 - RNA, 15 nt, Homo sapiens
gccuucacuuuacaa

SEQ ID NO: 398587 - RNA, 17 nt, Homo sapiens
gccuucucaccacagag

SEQ ID NO: 398588 - RNA, 15 nt, Homo sapiens
gccuugcaguaggca

SEQ ID NO: 398589 - RNA, 15 nt, Homo sapiens
gccuugugucuacag

SEQ ID NO: 398590 - RNA, 16 nt, Homo sapiens
gccuuuagucgcugag

SEQ ID NO: 398591 - RNA, 20 nt, Homo sapiens
gcgaaaccccaucucuacua

SEQ ID NO: 398592 - RNA, 14 nt, Homo sapiens
gcgacauagcccau

SEQ ID NO: 398593 - RNA, 15 nt, Homo sapiens
gcgagucacugccuc

SEQ ID NO: 398594 - RNA, 12 nt, Homo sapiens
gcgcaacauuuc

SEQ ID NO: 398595 - RNA, 14 nt, Homo sapiens
gcgcgguggcucac

SEQ ID NO: 398596 - RNA, 16 nt, Homo sapiens
gcggaaucagcuucua

SEQ ID NO: 398597 - RNA, 12 nt, Homo sapiens
gcgucacuguga

SEQ ID NO: 398598 - RNA, 19 nt, Homo sapiens
gcguggagaaguggugcuc

SEQ ID NO: 398599 - RNA, 17 nt, Homo sapiens
gcguggcauagcccaga

SEQ ID NO: 398600 - RNA, 21 nt, Homo sapiens
gcgugugcgugcaugugcacu

SEQ ID NO: 398601 - RNA, 23 nt, Homo sapiens
gcguguguccaugugugugcaag

SEQ ID NO: 398602 - RNA, 16 nt, Homo sapiens
gcuaccucacuggggu

SEQ ID NO: 398603 - RNA, 13 nt, Homo sapiens
gcuacuugggagg

SEQ ID NO: 398604 - RNA, 18 nt, Homo sapiens
gcuaguucguagcuuucc

SEQ ID NO: 398605 - RNA, 17 nt, Homo sapiens
gcuauaacuauguugau

SEQ ID NO: 398606 - RNA, 17 nt, Homo sapiens
gcuaucgcaccacugug

SEQ ID NO: 398607 - RNA, 15 nt, Homo sapiens
gcuaucucucaguga

SEQ ID NO: 398608 - RNA, 22 nt, Homo sapiens
gcuaugugaagaguaagucaac

SEQ ID NO: 398609 - RNA, 21 nt, Homo sapiens
gcucaagcagucuacccaccu

SEQ ID NO: 398610 - RNA, 17 nt, Homo sapiens
gcucacaccugaccaau

SEQ ID NO: 398611 - RNA, 19 nt, Homo sapiens
gcucacuaaaaugcuaauu

SEQ ID NO: 398612 - RNA, 14 nt, Homo sapiens
gcucagacugguug

SEQ ID NO: 398613 - RNA, 22 nt, Homo sapiens
gcucaggacucagaagccucug

SEQ ID NO: 398614 - RNA, 19 nt, Homo sapiens
gcucagggaauaauccaga

SEQ ID NO: 398615 - RNA, 16 nt, Homo sapiens
gcucagggcugacacg

SEQ ID NO: 398616 - RNA, 20 nt, Homo sapiens
gcucaggggcguguggcuca

SEQ ID NO: 398617 - RNA, 13 nt, Homo sapiens
gcucaucacugga

SEQ ID NO: 398618 - RNA, 13 nt, Homo sapiens
gcuccacugaaca

SEQ ID NO: 398619 - RNA, 17 nt, Homo sapiens
gcucugggauagcugac

SEQ ID NO: 398620 - RNA, 21 nt, Homo sapiens
gcucuuagcagcuuccagauu

SEQ ID NO: 398621 - RNA, 19 nt, Homo sapiens
gcucuugggaagaccagcu

SEQ ID NO: 398622 - RNA, 15 nt, Homo sapiens
gcucuuucucugcca

SEQ ID NO: 398623 - RNA, 17 nt, Homo sapiens
gcugaaauaaaaauaca

SEQ ID NO: 398624 - RNA, 15 nt, Homo sapiens
gcugagagaaccuca

SEQ ID NO: 398625 - RNA, 16 nt, Homo sapiens
gcugagggaccagcca

SEQ ID NO: 398626 - RNA, 23 nt, Homo sapiens
gcugagggugagugggugaauaa

SEQ ID NO: 398627 - RNA, 16 nt, Homo sapiens
gcugagugcaccacuu

SEQ ID NO: 398628 - RNA, 11 nt, Homo sapiens
gcugccucuug

SEQ ID NO: 398629 - RNA, 14 nt, Homo sapiens
gcugcgacugauga

SEQ ID NO: 398630 - RNA, 23 nt, Homo sapiens
gcugcuggaggaaaacugagacu

SEQ ID NO: 398631 - RNA, 14 nt, Homo sapiens
gcugcuucugcaaa

SEQ ID NO: 398632 - RNA, 19 nt, Homo sapiens
gcugcuucugcaaaaaacu

SEQ ID NO: 398633 - RNA, 14 nt, Homo sapiens
gcuggagugcagua

SEQ ID NO: 398634 - RNA, 20 nt, Homo sapiens
gcuggagugcaguagcacga

SEQ ID NO: 398635 - RNA, 22 nt, Homo sapiens
gcugggaagacgccugagcuca

SEQ ID NO: 398636 - RNA, 14 nt, Homo sapiens
gcugggcagcuguu

SEQ ID NO: 398637 - RNA, 17 nt, Homo sapiens
gcugguugagguuucaa

SEQ ID NO: 398638 - RNA, 16 nt, Homo sapiens
gcuguacuugaugaca

SEQ ID NO: 398639 - RNA, 16 nt, Homo sapiens
gcuguuccaccuuccc

SEQ ID NO: 398640 - RNA, 16 nt, Homo sapiens
gcuguuucaccuuucu

SEQ ID NO: 398641 - RNA, 20 nt, Homo sapiens
gcuuaaaggggcuagaguga

SEQ ID NO: 398642 - RNA, 15 nt, Homo sapiens
gcuuacaaaugucua

SEQ ID NO: 398643 - RNA, 13 nt, Homo sapiens
gcuuagaccucag

SEQ ID NO: 398644 - RNA, 20 nt, Homo sapiens
gcuuauucaucuguuuuucu

SEQ ID NO: 398645 - RNA, 16 nt, Homo sapiens
gcuuccuucugugaaa

SEQ ID NO: 398646 - RNA, 14 nt, Homo sapiens
gcuugaacccagga

SEQ ID NO: 398647 - RNA, 20 nt, Homo sapiens
gcuugacauaauuucacuga

SEQ ID NO: 398648 - RNA, 22 nt, Homo sapiens
gcuugcaacuuagcucacaccu

SEQ ID NO: 398649 - RNA, 21 nt, Homo sapiens
gcuuuaauuuuuuuaaccaaa

SEQ ID NO: 398650 - RNA, 23 nt, Homo sapiens
gcuuuguuaucuuccacuggaaa

SEQ ID NO: 398651 - RNA, 13 nt, Homo sapiens
ggaaaacaguauu

SEQ ID NO: 398652 - RNA, 15 nt, Homo sapiens
ggaacaugcguguga

SEQ ID NO: 398653 - RNA, 17 nt, Homo sapiens
ggaaccacgucugcuaa

SEQ ID NO: 398654 - RNA, 21 nt, Homo sapiens
ggaacuagagggauacacuga

SEQ ID NO: 398655 - RNA, 14 nt, Homo sapiens
ggaagcuccacugu

SEQ ID NO: 398656 - RNA, 15 nt, Homo sapiens
ggaagcuccacuguc

SEQ ID NO: 398657 - RNA, 17 nt, Homo sapiens
ggaagcuccacugucac

SEQ ID NO: 398658 - RNA, 17 nt, Homo sapiens
ggaagugugugaucugu

SEQ ID NO: 398659 - RNA, 17 nt, Homo sapiens
ggacaaggcuagaucau

SEQ ID NO: 398660 - RNA, 12 nt, Homo sapiens
ggacagagccau

SEQ ID NO: 398661 - RNA, 15 nt, Homo sapiens
ggaccccuccaggaa

SEQ ID NO: 398662 - RNA, 18 nt, Homo sapiens
ggacccugagccugugug

SEQ ID NO: 398663 - RNA, 10 nt, Homo sapiens
ggacugggag

SEQ ID NO: 398664 - RNA, 16 nt, Homo sapiens
ggacuuuccugcaacu

SEQ ID NO: 398665 - RNA, 16 nt, Homo sapiens
ggacuuuucgaccaau

SEQ ID NO: 398666 - RNA, 17 nt, Homo sapiens
ggacuuuugaaaagcuu

SEQ ID NO: 398667 - RNA, 15 nt, Homo sapiens
ggagaaucacuugaa

SEQ ID NO: 398668 - RNA, 21 nt, Homo sapiens
ggagacuagauuuaugaauac

SEQ ID NO: 398669 - RNA, 13 nt, Homo sapiens
ggagacuccauga

SEQ ID NO: 398670 - RNA, 16 nt, Homo sapiens
ggagacugucucaaga

SEQ ID NO: 398671 - RNA, 12 nt, Homo sapiens
ggagacuuguau

SEQ ID NO: 398672 - RNA, 13 nt, Homo sapiens
ggagagcccuuca

SEQ ID NO: 398673 - RNA, 13 nt, Homo sapiens
ggagcaccuggug

SEQ ID NO: 398674 - RNA, 12 nt, Homo sapiens
ggagcacugggu

SEQ ID NO: 398675 - RNA, 15 nt, Homo sapiens
ggaggaccagagcua

SEQ ID NO: 398676 - RNA, 16 nt, Homo sapiens
ggaggcggcagugcaa

SEQ ID NO: 398677 - RNA, 14 nt, Homo sapiens
ggaggucgacccca

SEQ ID NO: 398678 - RNA, 16 nt, Homo sapiens
ggaguaggacauacca

SEQ ID NO: 398679 - RNA, 15 nt, Homo sapiens
ggaguuagaggccag

SEQ ID NO: 398680 - RNA, 19 nt, Homo sapiens
ggauaacuuagguggcaag

SEQ ID NO: 398681 - RNA, 18 nt, Homo sapiens
ggauacuguaacacuuua

SEQ ID NO: 398682 - RNA, 14 nt, Homo sapiens
ggauaucaaaagca

SEQ ID NO: 398683 - RNA, 20 nt, Homo sapiens
ggaucaucuauugcuggcaa

SEQ ID NO: 398684 - RNA, 20 nt, Homo sapiens
ggaugaagauucuccugugc

SEQ ID NO: 398685 - RNA, 20 nt, Homo sapiens
ggauggggugggcuuagggg

SEQ ID NO: 398686 - RNA, 17 nt, Homo sapiens
ggaugguggagggccac

SEQ ID NO: 398687 - RNA, 19 nt, Homo sapiens
ggauguccacagaugccuc

SEQ ID NO: 398688 - RNA, 13 nt, Homo sapiens
ggauuaugaagug

SEQ ID NO: 398689 - RNA, 23 nt, Homo sapiens
ggauuuuguauaugcauagucau

SEQ ID NO: 398690 - RNA, 18 nt, Homo sapiens
ggcaaaucagaugcagcu

SEQ ID NO: 398691 - RNA, 21 nt, Homo sapiens
ggcaccuccuacgucaaacau

SEQ ID NO: 398692 - RNA, 17 nt, Homo sapiens
ggcagagaggacuguug

SEQ ID NO: 398693 - RNA, 20 nt, Homo sapiens
ggcagagaggacuguugaca

SEQ ID NO: 398694 - RNA, 17 nt, Homo sapiens
ggcagcauuuagcacau

SEQ ID NO: 398695 - RNA, 13 nt, Homo sapiens
ggcagugcaacaa

SEQ ID NO: 398696 - RNA, 17 nt, Homo sapiens
ggccaagacuuggcaac

SEQ ID NO: 398697 - RNA, 13 nt, Homo sapiens
ggccagccaguga

SEQ ID NO: 398698 - RNA, 19 nt, Homo sapiens
ggcccgacagccuggcaca

SEQ ID NO: 398699 - RNA, 23 nt, Homo sapiens
ggcccuucccacaggacauuucu

SEQ ID NO: 398700 - RNA, 23 nt, Homo sapiens
ggcccuuccucuccacugccuuc

SEQ ID NO: 398701 - RNA, 16 nt, Homo sapiens
cugucuccucuucaaa

SEQ ID NO: 398702 - RNA, 22 nt, Homo sapiens
cugugaaaugcuggcauuugca

SEQ ID NO: 398703 - RNA, 20 nt, Homo sapiens
cuguggaugaugguugcaaa

SEQ ID NO: 398704 - RNA, 15 nt, Homo sapiens
cuguggcucacguga

SEQ ID NO: 398705 - RNA, 15 nt, Homo sapiens
cuguguauucuagug

SEQ ID NO: 398706 - RNA, 16 nt, Homo sapiens
cugugucuucuccacc

SEQ ID NO: 398707 - RNA, 20 nt, Homo sapiens
cugugugcaagugugugcac

SEQ ID NO: 398708 - RNA, 23 nt, Homo sapiens
cugugugcaagugugugcacaug

SEQ ID NO: 398709 - RNA, 12 nt, Homo sapiens
cugugugccagg

SEQ ID NO: 398710 - RNA, 22 nt, Homo sapiens
cugugugugaaaggaagcucca

SEQ ID NO: 398711 - RNA, 16 nt, Homo sapiens
cuguuagucauuugcu

SEQ ID NO: 398712 - RNA, 13 nt, Homo sapiens
cuguucacagcca

SEQ ID NO: 398713 - RNA, 22 nt, Homo sapiens
cuguugaaaauuauuuuaaaca

SEQ ID NO: 398714 - RNA, 13 nt, Homo sapiens
cuguugacaucca

SEQ ID NO: 398715 - RNA, 23 nt, Homo sapiens
cuguugagaugggggacugagag

SEQ ID NO: 398716 - RNA, 22 nt, Homo sapiens
cuguuggacacccagugccagg

SEQ ID NO: 398717 - RNA, 20 nt, Homo sapiens
cuuaaagcauuccccaaaga

SEQ ID NO: 398718 - RNA, 12 nt, Homo sapiens
cuuaagauuugg

SEQ ID NO: 398719 - RNA, 11 nt, Homo sapiens
cuuaaucacac

SEQ ID NO: 398720 - RNA, 21 nt, Homo sapiens
cuuaaugauccguuccauugc

SEQ ID NO: 398721 - RNA, 15 nt, Homo sapiens
cuuaauguuuauucc

SEQ ID NO: 398722 - RNA, 18 nt, Homo sapiens
cuuacaaaugucuagguc

SEQ ID NO: 398723 - RNA, 15 nt, Homo sapiens
cuuacaauucccugc

SEQ ID NO: 398724 - RNA, 18 nt, Homo sapiens
cuuacccuccuccagacc

SEQ ID NO: 398725 - RNA, 14 nt, Homo sapiens
cuuacuuugaguua

SEQ ID NO: 398726 - RNA, 21 nt, Homo sapiens
cuuagauagaagaugggaaaa

SEQ ID NO: 398727 - RNA, 18 nt, Homo sapiens
cuuagcagcuaucucuca

SEQ ID NO: 398728 - RNA, 22 nt, Homo sapiens
cuuaguguuuggguauauucau

SEQ ID NO: 398729 - RNA, 14 nt, Homo sapiens
cuuauacauuugau

SEQ ID NO: 398730 - RNA, 16 nt, Homo sapiens
cuuauagaaaguucaa

SEQ ID NO: 398731 - RNA, 16 nt, Homo sapiens
cuuauaggaauugacc

SEQ ID NO: 398732 - RNA, 20 nt, Homo sapiens
cuuauaucaucagcauaccu

SEQ ID NO: 398733 - RNA, 21 nt, Homo sapiens
cuuauaucaucagcauaccuu

SEQ ID NO: 398734 - RNA, 14 nt, Homo sapiens
cuuauauucaucca

SEQ ID NO: 398735 - RNA, 12 nt, Homo sapiens
cuuaucuugcac

SEQ ID NO: 398736 - RNA, 14 nt, Homo sapiens
cuuauuguaccucu

SEQ ID NO: 398737 - RNA, 23 nt, Homo sapiens
cuucaagccuagcccuucucuca

SEQ ID NO: 398738 - RNA, 21 nt, Homo sapiens
cuucaaucucuugcacucaaa

SEQ ID NO: 398739 - RNA, 14 nt, Homo sapiens
cuucacaacagauu

SEQ ID NO: 398740 - RNA, 13 nt, Homo sapiens
cuucacaguguuu

SEQ ID NO: 398741 - RNA, 14 nt, Homo sapiens
cuucacaguguuuc

SEQ ID NO: 398742 - RNA, 21 nt, Homo sapiens
cuucacgccuccccuuuguga

SEQ ID NO: 398743 - RNA, 23 nt, Homo sapiens
cuucagggggccaggugcacaga

SEQ ID NO: 398744 - RNA, 16 nt, Homo sapiens
cuucaguauguuguca

SEQ ID NO: 398745 - RNA, 17 nt, Homo sapiens
cuuccacaccuagcauc

SEQ ID NO: 398746 - RNA, 19 nt, Homo sapiens
cuuccagcacccugcaaaa

SEQ ID NO: 398747 - RNA, 20 nt, Homo sapiens
cuuccaucccaggacaccac

SEQ ID NO: 398748 - RNA, 24 nt, Homo sapiens
cuuccauuaacuuagcauguguug

SEQ ID NO: 398749 - RNA, 18 nt, Homo sapiens
cuuccauuugcaagggaa

SEQ ID NO: 398750 - RNA, 12 nt, Homo sapiens
cuuccauuugcu

SEQ ID NO: 398751 - RNA, 21 nt, Homo sapiens
cuuccauuugugugugugcaa

SEQ ID NO: 398752 - RNA, 14 nt, Homo sapiens
cuucccagugaauu

SEQ ID NO: 398753 - RNA, 22 nt, Homo sapiens
cuucccggcgucccuaccuccu

SEQ ID NO: 398754 - RNA, 13 nt, Homo sapiens
cuucccugcauuu

SEQ ID NO: 398755 - RNA, 15 nt, Homo sapiens
cuuccucuccacugc

SEQ ID NO: 398756 - RNA, 18 nt, Homo sapiens
cuucuaaaugaagugcaa

SEQ ID NO: 398757 - RNA, 19 nt, Homo sapiens
cuucuaccuuaaaauguaa

SEQ ID NO: 398758 - RNA, 18 nt, Homo sapiens
cuucuccauccacauggg

SEQ ID NO: 398759 - RNA, 19 nt, Homo sapiens
cuucucucaccuccuaaag

SEQ ID NO: 398760 - RNA, 19 nt, Homo sapiens
cuucugacacugaaacuuc

SEQ ID NO: 398761 - RNA, 10 nt, Homo sapiens
cuucugccau

SEQ ID NO: 398762 - RNA, 21 nt, Homo sapiens
cuucuggcagggaagugggga

SEQ ID NO: 398763 - RNA, 20 nt, Homo sapiens
cuucuuuuaguuguaucucu

SEQ ID NO: 398764 - RNA, 15 nt, Homo sapiens
cuugaaaauagaaca

SEQ ID NO: 398765 - RNA, 19 nt, Homo sapiens
cuugaaagaaaauaugcau

SEQ ID NO: 398766 - RNA, 13 nt, Homo sapiens
cuugaacacuggg

SEQ ID NO: 398767 - RNA, 21 nt, Homo sapiens
cuugagaaaccuuauuguacc

SEQ ID NO: 398768 - RNA, 21 nt, Homo sapiens
cuugagcaaccuggcuaagau

SEQ ID NO: 398769 - RNA, 20 nt, Homo sapiens
cuugagccaguaauuggucc

SEQ ID NO: 398770 - RNA, 21 nt, Homo sapiens
cuugauccacuucucucagga

SEQ ID NO: 398771 - RNA, 16 nt, Homo sapiens
cuugauucacaaugaa

SEQ ID NO: 398772 - RNA, 20 nt, Homo sapiens
cuugauuuagcacuauuuac

SEQ ID NO: 398773 - RNA, 20 nt, Homo sapiens
cuugcaccccaaagcuuucc

SEQ ID NO: 398774 - RNA, 18 nt, Homo sapiens
cuugcaguuaaggguuag

SEQ ID NO: 398775 - RNA, 12 nt, Homo sapiens
cuugcugccaaa

SEQ ID NO: 398776 - RNA, 13 nt, Homo sapiens
cuugcugccugaa

SEQ ID NO: 398777 - RNA, 16 nt, Homo sapiens
cuugcuugcaauaggu

SEQ ID NO: 398778 - RNA, 23 nt, Homo sapiens
cuuggaagagaaugucugaucua

SEQ ID NO: 398779 - RNA, 19 nt, Homo sapiens
cuuggagccccagugccaa

SEQ ID NO: 398780 - RNA, 19 nt, Homo sapiens
cuuggcaugccuuccagca

SEQ ID NO: 398781 - RNA, 22 nt, Homo sapiens
cuuggccucccaaagugcuagu

SEQ ID NO: 398782 - RNA, 20 nt, Homo sapiens
cuuggccuccccugcugaag

SEQ ID NO: 398783 - RNA, 13 nt, Homo sapiens
cuuggcugugagg

SEQ ID NO: 398784 - RNA, 13 nt, Homo sapiens
cuugggacaaauc

SEQ ID NO: 398785 - RNA, 14 nt, Homo sapiens
cuugggaugaucuu

SEQ ID NO: 398786 - RNA, 23 nt, Homo sapiens
cuugggggaggaggaacaaauaa

SEQ ID NO: 398787 - RNA, 14 nt, Homo sapiens
cuuggucucagugu

SEQ ID NO: 398788 - RNA, 17 nt, Homo sapiens
cuuguaaaugugguaaa

SEQ ID NO: 398789 - RNA, 23 nt, Homo sapiens
cuuguaaaugugguaaagaguua

SEQ ID NO: 398790 - RNA, 16 nt, Homo sapiens
cuuguauaguguaaaa

SEQ ID NO: 398791 - RNA, 23 nt, Homo sapiens
cuugucccacucaagccaagcag

SEQ ID NO: 398792 - RNA, 13 nt, Homo sapiens
cuuguuagauuca

SEQ ID NO: 398793 - RNA, 16 nt, Homo sapiens
cuuguuuuaugcucag

SEQ ID NO: 398794 - RNA, 15 nt, Homo sapiens
cuuuacaaauauguc

SEQ ID NO: 398795 - RNA, 19 nt, Homo sapiens
cuuuagucugcaaaaugag

SEQ ID NO: 398796 - RNA, 21 nt, Homo sapiens
cuuuauauuuuuaacuuuaag

SEQ ID NO: 398797 - RNA, 22 nt, Homo sapiens
cuuuauuacaguuuaucuaugg

SEQ ID NO: 398798 - RNA, 16 nt, Homo sapiens
cuuucaaccucaguga

SEQ ID NO: 398799 - RNA, 21 nt, Homo sapiens
cuuucacacuuccaccagccu

SEQ ID NO: 398800 - RNA, 20 nt, Homo sapiens
cuuucauaaacuucagggau

SEQ ID NO: 398801 - RNA, 22 nt, Homo sapiens
cuuucaugaauucugucauuuc

SEQ ID NO: 398802 - RNA, 13 nt, Homo sapiens
cuuucccaaauaa

SEQ ID NO: 398803 - RNA, 13 nt, Homo sapiens
cuuucuaacaaaa

SEQ ID NO: 398804 - RNA, 22 nt, Homo sapiens
cuuucucccaggccaggcuccu

SEQ ID NO: 398805 - RNA, 20 nt, Homo sapiens
cuuucugcaaaggcaccuga

SEQ ID NO: 398806 - RNA, 20 nt, Homo sapiens
cuuucuucccuacaguugaa

SEQ ID NO: 398807 - RNA, 13 nt, Homo sapiens
cuuucuugacucu

SEQ ID NO: 398808 - RNA, 18 nt, Homo sapiens
cuuucuuucuaacuccag

SEQ ID NO: 398809 - RNA, 11 nt, Homo sapiens
cuuugcacuga

SEQ ID NO: 398810 - RNA, 19 nt, Homo sapiens
cuuugccacacacaguuac

SEQ ID NO: 398811 - RNA, 23 nt, Homo sapiens
cuuugcugugaggcuguccugua

SEQ ID NO: 398812 - RNA, 14 nt, Homo sapiens
cuuuguaggugucu

SEQ ID NO: 398813 - RNA, 15 nt, Homo sapiens
cuuuguaugcacuuu

SEQ ID NO: 398814 - RNA, 23 nt, Homo sapiens
cuuugucccggggcuccacugaa

SEQ ID NO: 398815 - RNA, 16 nt, Homo sapiens
cuuuguuaucuuccac

SEQ ID NO: 398816 - RNA, 21 nt, Homo sapiens
cuuuguuuguugucagcugaa

SEQ ID NO: 398817 - RNA, 18 nt, Homo sapiens
cuuuuaaaaaaaaauacu

SEQ ID NO: 398818 - RNA, 19 nt, Homo sapiens
cuuuucaauguuagccaca

SEQ ID NO: 398819 - RNA, 17 nt, Homo sapiens
cuuuucaucuaauguga

SEQ ID NO: 398820 - RNA, 16 nt, Homo sapiens
cuuuucuaacucuccc

SEQ ID NO: 398821 - RNA, 19 nt, Homo sapiens
cuuuucuggaauguaauca

SEQ ID NO: 398822 - RNA, 21 nt, Homo sapiens
cuuuucuguccgagcuuugaa

SEQ ID NO: 398823 - RNA, 17 nt, Homo sapiens
cuuuugacaaaggcaag

SEQ ID NO: 398824 - RNA, 20 nt, Homo sapiens
cuuuugaggggcugacuuca

SEQ ID NO: 398825 - RNA, 11 nt, Homo sapiens
cuuuugcacau

SEQ ID NO: 398826 - RNA, 15 nt, Homo sapiens
cuuuugguaugugac

SEQ ID NO: 398827 - RNA, 19 nt, Homo sapiens
cuuuuguucagggcuguga

SEQ ID NO: 398828 - RNA, 20 nt, Homo sapiens
cuuuuuaauauugauaugcu

SEQ ID NO: 398829 - RNA, 20 nt, Homo sapiens
gaaaaagucauccaaucuaa

SEQ ID NO: 398830 - RNA, 19 nt, Homo sapiens
gaaaaaguucugcagauaa

SEQ ID NO: 398831 - RNA, 20 nt, Homo sapiens
gaaaaaucaccacaccaaac

SEQ ID NO: 398832 - RNA, 14 nt, Homo sapiens
gaaaacacugugca

SEQ ID NO: 398833 - RNA, 15 nt, Homo sapiens
gaaaacacugugcac

SEQ ID NO: 398834 - RNA, 17 nt, Homo sapiens
gaaaacaguauuuucca

SEQ ID NO: 398835 - RNA, 20 nt, Homo sapiens
gaaaagagauggccugagaa

SEQ ID NO: 398836 - RNA, 16 nt, Homo sapiens
gaaaaggauaugcagu

SEQ ID NO: 398837 - RNA, 16 nt, Homo sapiens
gaaaaguguaauagca

SEQ ID NO: 398838 - RNA, 20 nt, Homo sapiens
gaaaauaguuuggauuacuu

SEQ ID NO: 398839 - RNA, 20 nt, Homo sapiens
gaaacaaauaagaccauaaa

SEQ ID NO: 398840 - RNA, 15 nt, Homo sapiens
gaaacagcgcugggu

SEQ ID NO: 398841 - RNA, 17 nt, Homo sapiens
gaaaccuuauuguaccu

SEQ ID NO: 398842 - RNA, 14 nt, Homo sapiens
gagcaggcuacugu

SEQ ID NO: 398843 - RNA, 17 nt, Homo sapiens
gagcaggcuacugucag

SEQ ID NO: 398844 - RNA, 17 nt, Homo sapiens
gagcaguccugccucag

SEQ ID NO: 398845 - RNA, 21 nt, Homo sapiens
gagcagugaaugauucagugu

SEQ ID NO: 398846 - RNA, 19 nt, Homo sapiens
gagcaguggcugguccagg

SEQ ID NO: 398847 - RNA, 21 nt, Homo sapiens
gagcauuguggcugucagcag

SEQ ID NO: 398848 - RNA, 20 nt, Homo sapiens
gagccaccacguccagcugg

SEQ ID NO: 398849 - RNA, 17 nt, Homo sapiens
gagccaccccuaaagag

SEQ ID NO: 398850 - RNA, 14 nt, Homo sapiens
gagcccuuaugaca

SEQ ID NO: 398851 - RNA, 12 nt, Homo sapiens
gagccgcuguga

SEQ ID NO: 398852 - RNA, 18 nt, Homo sapiens
gagcucagagaggcuaga

SEQ ID NO: 398853 - RNA, 21 nt, Homo sapiens
gagcucgguggacccagggau

SEQ ID NO: 398854 - RNA, 14 nt, Homo sapiens
gagcugugggagag

SEQ ID NO: 398855 - RNA, 19 nt, Homo sapiens
gagcuguguggccuggcaa

SEQ ID NO: 398856 - RNA, 23 nt, Homo sapiens
gaggaaaagagaaggaaagugau

SEQ ID NO: 398857 - RNA, 17 nt, Homo sapiens
gaggaacuguccagaga

SEQ ID NO: 398858 - RNA, 22 nt, Homo sapiens
gaggacauucuggaaaagcaaa

SEQ ID NO: 398859 - RNA, 15 nt, Homo sapiens
gaggagaaacuggaa

SEQ ID NO: 398860 - RNA, 14 nt, Homo sapiens
gaggaguuccuuga

SEQ ID NO: 398861 - RNA, 13 nt, Homo sapiens
gaggcugucuucu

SEQ ID NO: 398862 - RNA, 18 nt, Homo sapiens
gaggcugucuucucaggc

SEQ ID NO: 398863 - RNA, 20 nt, Homo sapiens
gaggcugucuucucaggcuc

SEQ ID NO: 398864 - RNA, 14 nt, Homo sapiens
gagggaaaaugagu

SEQ ID NO: 398865 - RNA, 22 nt, Homo sapiens
gagggauaguggggucagggcu

SEQ ID NO: 398866 - RNA, 17 nt, Homo sapiens
gaggggcucucagcuca

SEQ ID NO: 398867 - RNA, 18 nt, Homo sapiens
gagggugggguaaccaaa

SEQ ID NO: 398868 - RNA, 20 nt, Homo sapiens
gaggguuguucuccuagacu

SEQ ID NO: 398869 - RNA, 13 nt, Homo sapiens
gagguacacucuu

SEQ ID NO: 398870 - RNA, 22 nt, Homo sapiens
gagguaccagcaauauguaaau

SEQ ID NO: 398871 - RNA, 20 nt, Homo sapiens
gaggucugauggagcugcgu

SEQ ID NO: 398872 - RNA, 13 nt, Homo sapiens
gagucacugccuc

SEQ ID NO: 398873 - RNA, 20 nt, Homo sapiens
gagucaucucaaccaucccc

SEQ ID NO: 398874 - RNA, 14 nt, Homo sapiens
gagucugaagcaga

SEQ ID NO: 398875 - RNA, 18 nt, Homo sapiens
gagucuucaucuuagggc

SEQ ID NO: 398876 - RNA, 20 nt, Homo sapiens
gagucuucuccaauguccaa

SEQ ID NO: 398877 - RNA, 21 nt, Homo sapiens
gagugccguaacaacuguggu

SEQ ID NO: 398878 - RNA, 13 nt, Homo sapiens
gagugggaccaac

SEQ ID NO: 398879 - RNA, 14 nt, Homo sapiens
gagugugugcaugu

SEQ ID NO: 398880 - RNA, 21 nt, Homo sapiens
gaguuaauauauagaagggua

SEQ ID NO: 398881 - RNA, 13 nt, Homo sapiens
gaguuagugccau

SEQ ID NO: 398882 - RNA, 21 nt, Homo sapiens
gaguuugggaacugcaauaac

SEQ ID NO: 398883 - RNA, 23 nt, Homo sapiens
gauaaacugauuuaucuauuuaa

SEQ ID NO: 398884 - RNA, 18 nt, Homo sapiens
gauaacaguuacuccagu

SEQ ID NO: 398885 - RNA, 22 nt, Homo sapiens
gauaacaugcuuuggguggaau

SEQ ID NO: 398886 - RNA, 21 nt, Homo sapiens
gauaagcuugucuaugguaca

SEQ ID NO: 398887 - RNA, 17 nt, Homo sapiens
gauacacaccuuucaca

SEQ ID NO: 398888 - RNA, 15 nt, Homo sapiens
gauauuuuucaugau

SEQ ID NO: 398889 - RNA, 16 nt, Homo sapiens
gauauuuuuccauuuu

SEQ ID NO: 398890 - RNA, 20 nt, Homo sapiens
gaucagccugggcaauguga

SEQ ID NO: 398891 - RNA, 21 nt, Homo sapiens
gaucauauuucacaauccugu

SEQ ID NO: 398892 - RNA, 23 nt, Homo sapiens
gaucauuugcccuuaaggacaaa

SEQ ID NO: 398893 - RNA, 18 nt, Homo sapiens
gauccacuucucucagga

SEQ ID NO: 398894 - RNA, 13 nt, Homo sapiens
gaucccagcucac

SEQ ID NO: 398895 - RNA, 19 nt, Homo sapiens
gaucccaggggaguguuca

SEQ ID NO: 398896 - RNA, 16 nt, Homo sapiens
gauccccucucuuccu

SEQ ID NO: 398897 - RNA, 21 nt, Homo sapiens
gauccgucuuuggccuccucc

SEQ ID NO: 398898 - RNA, 15 nt, Homo sapiens
gauccuguuggacac

SEQ ID NO: 398899 - RNA, 14 nt, Homo sapiens
gauccuucaaagag

SEQ ID NO: 398900 - RNA, 20 nt, Homo sapiens
gaucggagccuccucucuca

SEQ ID NO: 398901 - RNA, 17 nt, Homo sapiens
gaucuaucaauagucaa

SEQ ID NO: 398902 - RNA, 18 nt, Homo sapiens
gaucuaucaauagucaag

SEQ ID NO: 398903 - RNA, 14 nt, Homo sapiens
gaucugaaaucauu

SEQ ID NO: 398904 - RNA, 23 nt, Homo sapiens
gaucugaacagaaauaccaaaau

SEQ ID NO: 398905 - RNA, 18 nt, Homo sapiens
gaucuuaaagcauucccc

SEQ ID NO: 398906 - RNA, 17 nt, Homo sapiens
gaucuucaagcagggaa

SEQ ID NO: 398907 - RNA, 18 nt, Homo sapiens
gaucuucaagcagggaag

SEQ ID NO: 398908 - RNA, 20 nt, Homo sapiens
gaugaaaaugaaucuucaca

SEQ ID NO: 398909 - RNA, 18 nt, Homo sapiens
gaugacaaaaauucaacu

SEQ ID NO: 398910 - RNA, 13 nt, Homo sapiens
gaugaucaucucc

SEQ ID NO: 398911 - RNA, 15 nt, Homo sapiens
gaugaugccucauga

SEQ ID NO: 398912 - RNA, 13 nt, Homo sapiens
gaugcaagcaaga

SEQ ID NO: 398913 - RNA, 18 nt, Homo sapiens
gaugccguucccugaaca

SEQ ID NO: 398914 - RNA, 14 nt, Homo sapiens
gaugcugacaucca

SEQ ID NO: 398915 - RNA, 21 nt, Homo sapiens
gaugcugccugcccagugcac

SEQ ID NO: 398916 - RNA, 15 nt, Homo sapiens
gauggauaagcuugu

SEQ ID NO: 398917 - RNA, 13 nt, Homo sapiens
gauggauuuccag

SEQ ID NO: 398918 - RNA, 21 nt, Homo sapiens
gauggcauuuuuugcaaguua

SEQ ID NO: 398919 - RNA, 17 nt, Homo sapiens
gauggucacgcaccugg

SEQ ID NO: 398920 - RNA, 13 nt, Homo sapiens
gaugguccacugu

SEQ ID NO: 398921 - RNA, 17 nt, Homo sapiens
gauguccacagaugccu

SEQ ID NO: 398922 - RNA, 11 nt, Homo sapiens
gaugugcaaca

SEQ ID NO: 398923 - RNA, 16 nt, Homo sapiens
gaugugcaaguguaug

SEQ ID NO: 398924 - RNA, 19 nt, Homo sapiens
gauguguuaggaaugucaa

SEQ ID NO: 398925 - RNA, 20 nt, Homo sapiens
gauguuugaggcuuucagaa

SEQ ID NO: 398926 - RNA, 23 nt, Homo sapiens
gauuaaccucugcacuacugaca

SEQ ID NO: 398927 - RNA, 20 nt, Homo sapiens
gauuacaggugcgcacuacc

SEQ ID NO: 398928 - RNA, 20 nt, Homo sapiens
gauucacaaugaaaugcucu

SEQ ID NO: 398929 - RNA, 19 nt, Homo sapiens
gauucaccugagcaggacc

SEQ ID NO: 398930 - RNA, 12 nt, Homo sapiens
gauuccagagag

SEQ ID NO: 398931 - RNA, 18 nt, Homo sapiens
gauuccaggcgaugugca

SEQ ID NO: 398932 - RNA, 18 nt, Homo sapiens
gauuggcaggaguuggaa

SEQ ID NO: 398933 - RNA, 12 nt, Homo sapiens
gauuggcuguga

SEQ ID NO: 398934 - RNA, 21 nt, Homo sapiens
gauuucagaucauauuucaca

SEQ ID NO: 398935 - RNA, 15 nt, Homo sapiens
gauuucaugauuuca

SEQ ID NO: 398936 - RNA, 12 nt, Homo sapiens
gauuucauucaa

SEQ ID NO: 398937 - RNA, 18 nt, Homo sapiens
gauuuuaaaaagucuuca

SEQ ID NO: 398938 - RNA, 19 nt, Homo sapiens
gauuuuaaaaagucuucac

SEQ ID NO: 398939 - RNA, 16 nt, Homo sapiens
gauuuuauuugacaaa

SEQ ID NO: 398940 - RNA, 15 nt, Homo sapiens
gauuuucuauuuaug

SEQ ID NO: 398941 - RNA, 20 nt, Homo sapiens
gauuuugaaauuuuuauuaa

SEQ ID NO: 398942 - RNA, 18 nt, Homo sapiens
gcaaaauacaugacauuu

SEQ ID NO: 398943 - RNA, 16 nt, Homo sapiens
gcaaaauucccaggga

SEQ ID NO: 398944 - RNA, 23 nt, Homo sapiens
gcaaaauucccagggaagugcuc

SEQ ID NO: 398945 - RNA, 17 nt, Homo sapiens
gcaaaauuuaugcaaau

SEQ ID NO: 398946 - RNA, 14 nt, Homo sapiens
gcaaagacaggagg

SEQ ID NO: 398947 - RNA, 20 nt, Homo sapiens
gcaaaggggggaagggacau

SEQ ID NO: 398948 - RNA, 14 nt, Homo sapiens
gcaacaguagcaua

SEQ ID NO: 398949 - RNA, 12 nt, Homo sapiens
gcaacaguuuuu

SEQ ID NO: 398950 - RNA, 19 nt, Homo sapiens
gcaagagcccccuugacac

SEQ ID NO: 398951 - RNA, 15 nt, Homo sapiens
gcaagcuauucaaug

SEQ ID NO: 398952 - RNA, 17 nt, Homo sapiens
gcaaggacggccuucaa

SEQ ID NO: 398953 - RNA, 17 nt, Homo sapiens
gcaagugagacccuguc

SEQ ID NO: 398954 - RNA, 17 nt, Homo sapiens
gcaagugucugugugca

SEQ ID NO: 398955 - RNA, 19 nt, Homo sapiens
gcaaguguguaugugcgug

SEQ ID NO: 398956 - RNA, 17 nt, Homo sapiens
gcaagugugugcacaug

SEQ ID NO: 398957 - RNA, 15 nt, Homo sapiens
gcaagugugugcaug

SEQ ID NO: 398958 - RNA, 19 nt, Homo sapiens
gcaaguuucaucagucaau

SEQ ID NO: 398959 - RNA, 22 nt, Homo sapiens
gcaauacagacuacuucuuccc

SEQ ID NO: 398960 - RNA, 13 nt, Homo sapiens
gcaaucacacuga

SEQ ID NO: 398961 - RNA, 21 nt, Homo sapiens
gcaaugaaugaugcuuuucug

SEQ ID NO: 398962 - RNA, 22 nt, Homo sapiens
gcaauuccgcauuuaauucaug

SEQ ID NO: 398963 - RNA, 19 nt, Homo sapiens
gcacacuccccugcacugg

SEQ ID NO: 398964 - RNA, 11 nt, Homo sapiens
gcacacuuugc

SEQ ID NO: 398965 - RNA, 23 nt, Homo sapiens
gcacagagagggggccaccuccc

SEQ ID NO: 398966 - RNA, 19 nt, Homo sapiens
gcaccacuguguauuuaac

SEQ ID NO: 398967 - RNA, 14 nt, Homo sapiens
gcacccacccagca

SEQ ID NO: 398968 - RNA, 21 nt, Homo sapiens
gcacccuggauugaucggagc

SEQ ID NO: 398969 - RNA, 19 nt, Homo sapiens
gcacugagcaaagcauuga

SEQ ID NO: 398970 - RNA, 16 nt, Homo sapiens
gcacugaggaccagcc

SEQ ID NO: 398971 - RNA, 12 nt, Homo sapiens
gcacugggauga

SEQ ID NO: 398972 - RNA, 22 nt, Homo sapiens
gcacuggguugacuuucaggua

SEQ ID NO: 398973 - RNA, 20 nt, Homo sapiens
gcacugugaccgagaacuuu

SEQ ID NO: 398974 - RNA, 15 nt, Homo sapiens
gcagaaaaacucugg

SEQ ID NO: 398975 - RNA, 20 nt, Homo sapiens
gcagaaauacauauuuccaa

SEQ ID NO: 398976 - RNA, 21 nt, Homo sapiens
gcagaacugcuugaacccagg

SEQ ID NO: 398977 - RNA, 16 nt, Homo sapiens
gcagaagcacauauga

SEQ ID NO: 398978 - RNA, 13 nt, Homo sapiens
gcagaccacugau

SEQ ID NO: 398979 - RNA, 19 nt, Homo sapiens
gcagccuggggucugacaa

SEQ ID NO: 398980 - RNA, 18 nt, Homo sapiens
gcagcuaucucucaguga

SEQ ID NO: 398981 - RNA, 19 nt, Homo sapiens
gcagcuaucucucagugaa

SEQ ID NO: 398982 - RNA, 18 nt, Homo sapiens
gcagcuucucuccacuga

SEQ ID NO: 398983 - RNA, 19 nt, Homo sapiens
gcagcuuuaaacucaggga

SEQ ID NO: 398984 - RNA, 18 nt, Homo sapiens
guaaagaguuaguuugag

SEQ ID NO: 398985 - RNA, 22 nt, Homo sapiens
guaaaguauuauuuauuugaau

SEQ ID NO: 398986 - RNA, 11 nt, Homo sapiens
guaaaucucac

SEQ ID NO: 398987 - RNA, 14 nt, Homo sapiens
guaacaacuguggu

SEQ ID NO: 398988 - RNA, 19 nt, Homo sapiens
guaacaacuguggucaauc

SEQ ID NO: 398989 - RNA, 19 nt, Homo sapiens
guaacgaaugguacuacaa

SEQ ID NO: 398990 - RNA, 16 nt, Homo sapiens
guaagaaacacacuga

SEQ ID NO: 398991 - RNA, 18 nt, Homo sapiens
guaagcaaagacuuuccu

SEQ ID NO: 398992 - RNA, 11 nt, Homo sapiens
guaagcuuuaa

SEQ ID NO: 398993 - RNA, 15 nt, Homo sapiens
guaagggaaacugcc

SEQ ID NO: 398994 - RNA, 17 nt, Homo sapiens
guaagggaaacugccag

SEQ ID NO: 398995 - RNA, 20 nt, Homo sapiens
guaaucccagcuacuuggga

SEQ ID NO: 398996 - RNA, 15 nt, Homo sapiens
guaaugucaccaccu

SEQ ID NO: 398997 - RNA, 22 nt, Homo sapiens
guacagaauucugcuaccucac

SEQ ID NO: 398998 - RNA, 23 nt, Homo sapiens
guacccuuccuacagauagucaa

SEQ ID NO: 398999 - RNA, 18 nt, Homo sapiens
guaccugcccccaaucca

SEQ ID NO: 399000 - RNA, 21 nt, Homo sapiens
guaccuucaaacuagggccaa

SEQ ID NO: 399001 - RNA, 19 nt, Homo sapiens
guacuuagcagcuaucucu

SEQ ID NO: 399002 - RNA, 22 nt, Homo sapiens
guagaaaauuuguuauuuugca

SEQ ID NO: 399003 - RNA, 18 nt, Homo sapiens
guagaauugagucuucca

SEQ ID NO: 399004 - RNA, 12 nt, Homo sapiens
guagcuagccug

SEQ ID NO: 399005 - RNA, 20 nt, Homo sapiens
guagcugccccuggcucuga

SEQ ID NO: 399006 - RNA, 17 nt, Homo sapiens
guaggggcccacuucac

SEQ ID NO: 399007 - RNA, 14 nt, Homo sapiens
guaggguugccaga

SEQ ID NO: 399008 - RNA, 16 nt, Homo sapiens
guaggugugacuugaa

SEQ ID NO: 399009 - RNA, 17 nt, Homo sapiens
guaggugugacuugaac

SEQ ID NO: 399010 - RNA, 20 nt, Homo sapiens
guauacauaaguuuaggaua

SEQ ID NO: 399011 - RNA, 15 nt, Homo sapiens
guauauucauuucaa

SEQ ID NO: 399012 - RNA, 20 nt, Homo sapiens
guauauucugguuacugugg

SEQ ID NO: 399013 - RNA, 14 nt, Homo sapiens
guauauugucagau

SEQ ID NO: 399014 - RNA, 15 nt, Homo sapiens
guaucaggacccaga

SEQ ID NO: 399015 - RNA, 19 nt, Homo sapiens
guaugauccuaaugaaugc

SEQ ID NO: 399016 - RNA, 15 nt, Homo sapiens
guauguuugggagac

SEQ ID NO: 399017 - RNA, 21 nt, Homo sapiens
guauguuugggagacugcuga

SEQ ID NO: 399018 - RNA, 20 nt, Homo sapiens
guauuaaaaaaaacaaaaag

SEQ ID NO: 399019 - RNA, 23 nt, Homo sapiens
guauucagcuuuaguagauauua

SEQ ID NO: 399020 - RNA, 21 nt, Homo sapiens
guauucuagugaaugaaucuc

SEQ ID NO: 399021 - RNA, 19 nt, Homo sapiens
guauuugaaaacucacaga

SEQ ID NO: 399022 - RNA, 13 nt, Homo sapiens
gucacagggccaa

SEQ ID NO: 399023 - RNA, 13 nt, Homo sapiens
gucacgcaccugg

SEQ ID NO: 399024 - RNA, 13 nt, Homo sapiens
gucagaguucugc

SEQ ID NO: 399025 - RNA, 15 nt, Homo sapiens
gucagaguucugcuc

SEQ ID NO: 399026 - RNA, 20 nt, Homo sapiens
gucagauuugaacucuucaa

SEQ ID NO: 399027 - RNA, 14 nt, Homo sapiens
gucaggacugugac

SEQ ID NO: 399028 - RNA, 20 nt, Homo sapiens
gucagggaccccugcccuug

SEQ ID NO: 399029 - RNA, 12 nt, Homo sapiens
gucagucaggga

SEQ ID NO: 399030 - RNA, 15 nt, Homo sapiens
gucaguuagcaucau

SEQ ID NO: 399031 - RNA, 14 nt, Homo sapiens
gucauuucaaagac

SEQ ID NO: 399032 - RNA, 13 nt, Homo sapiens
guccaagucuucu

SEQ ID NO: 399033 - RNA, 19 nt, Homo sapiens
guccaagugugugugcgug

SEQ ID NO: 399034 - RNA, 24 nt, Homo sapiens
guccacgagcuguuuacuagggau

SEQ ID NO: 399035 - RNA, 12 nt, Homo sapiens
guccacugugac

SEQ ID NO: 399036 - RNA, 16 nt, Homo sapiens
guccagcucguucucu

SEQ ID NO: 399037 - RNA, 18 nt, Homo sapiens
guccagcuugcucuucag

SEQ ID NO: 399038 - RNA, 16 nt, Homo sapiens
guccaggcacugagau

SEQ ID NO: 399039 - RNA, 15 nt, Homo sapiens
guccccuccacuguc

SEQ ID NO: 399040 - RNA, 23 nt, Homo sapiens
guccccuccacugucacauugua

SEQ ID NO: 399041 - RNA, 17 nt, Homo sapiens
gucccuaaaaacacaga

SEQ ID NO: 399042 - RNA, 11 nt, Homo sapiens
gucccuaccuc

SEQ ID NO: 399043 - RNA, 19 nt, Homo sapiens
gucccucccaccucuguga

SEQ ID NO: 399044 - RNA, 17 nt, Homo sapiens
guccugccucagccucc

SEQ ID NO: 399045 - RNA, 17 nt, Homo sapiens
guccuggggaccauuca

SEQ ID NO: 399046 - RNA, 16 nt, Homo sapiens
gucgaggggcucucag

SEQ ID NO: 399047 - RNA, 15 nt, Homo sapiens
gucuaagagugaagu

SEQ ID NO: 399048 - RNA, 13 nt, Homo sapiens
gucuaagucauga

SEQ ID NO: 399049 - RNA, 18 nt, Homo sapiens
gucucagugcuuuccaau

SEQ ID NO: 399050 - RNA, 21 nt, Homo sapiens
gucucauaugauugugcacau

SEQ ID NO: 399051 - RNA, 14 nt, Homo sapiens
gucuccaguggaag

SEQ ID NO: 399052 - RNA, 20 nt, Homo sapiens
gucucucggguucaagcaau

SEQ ID NO: 399053 - RNA, 13 nt, Homo sapiens
gucuuagcaagaa

SEQ ID NO: 399054 - RNA, 23 nt, Homo sapiens
gucuucagccuagccgaccucag

SEQ ID NO: 399055 - RNA, 22 nt, Homo sapiens
gucuucauaauuucuucacuca

SEQ ID NO: 399056 - RNA, 17 nt, Homo sapiens
gucuuggcagcaccugu

SEQ ID NO: 399057 - RNA, 12 nt, Homo sapiens
gucuuucacuga

SEQ ID NO: 399058 - RNA, 21 nt, Homo sapiens
gucuuuguaaugucaccaccu

SEQ ID NO: 399059 - RNA, 19 nt, Homo sapiens
gugaaagaaaauucuugga

SEQ ID NO: 399060 - RNA, 14 nt, Homo sapiens
gugaaaugcuggca

SEQ ID NO: 399061 - RNA, 15 nt, Homo sapiens
gugaacacaucagcu

SEQ ID NO: 399062 - RNA, 11 nt, Homo sapiens
gugaaggaaua

SEQ ID NO: 399063 - RNA, 17 nt, Homo sapiens
gugaaugaaacacucag

SEQ ID NO: 399064 - RNA, 23 nt, Homo sapiens
gugacaaccgaguggcugucauc

SEQ ID NO: 399065 - RNA, 18 nt, Homo sapiens
gugacauuuauauauuga

SEQ ID NO: 399066 - RNA, 17 nt, Homo sapiens
gugacauuuccaugcau

SEQ ID NO: 399067 - RNA, 16 nt, Homo sapiens
gugacauuugggagac

SEQ ID NO: 399068 - RNA, 21 nt, Homo sapiens
gugacauuugggagacaugug

SEQ ID NO: 399069 - RNA, 20 nt, Homo sapiens
gugacuuucaagcuacucac

SEQ ID NO: 399070 - RNA, 23 nt, Homo sapiens
gugagaauaaacuagacucugaa

SEQ ID NO: 399071 - RNA, 18 nt, Homo sapiens
gugagacagcucugcaua

SEQ ID NO: 399072 - RNA, 15 nt, Homo sapiens
gugagaugcuggaga

SEQ ID NO: 399073 - RNA, 19 nt, Homo sapiens
gugaggcuguccuguacau

SEQ ID NO: 399074 - RNA, 14 nt, Homo sapiens
gugagugugugcaa

SEQ ID NO: 399075 - RNA, 22 nt, Homo sapiens
gugaucagaccauaauguuaca

SEQ ID NO: 399076 - RNA, 20 nt, Homo sapiens
gugaucuaucaauagucaag

SEQ ID NO: 399077 - RNA, 16 nt, Homo sapiens
gugaucugaacagaaa

SEQ ID NO: 399078 - RNA, 17 nt, Homo sapiens
gugcaagugugugcaca

SEQ ID NO: 399079 - RNA, 17 nt, Homo sapiens
gugcaagugugugcaug

SEQ ID NO: 399080 - RNA, 16 nt, Homo sapiens
gugcacaucugugucu

SEQ ID NO: 399081 - RNA, 20 nt, Homo sapiens
gugcaugcagcaucuaagua

SEQ ID NO: 399082 - RNA, 17 nt, Homo sapiens
gugccagcaaugacauc

SEQ ID NO: 399083 - RNA, 20 nt, Homo sapiens
gugccagcaaugacaucuca

SEQ ID NO: 399084 - RNA, 22 nt, Homo sapiens
gugccaggugugugguggggac

SEQ ID NO: 399085 - RNA, 17 nt, Homo sapiens
gugccucucucuugcuu

SEQ ID NO: 399086 - RNA, 16 nt, Homo sapiens
gugcgugugugcaagu

SEQ ID NO: 399087 - RNA, 18 nt, Homo sapiens
gugcuaaacgcacacagu

SEQ ID NO: 399088 - RNA, 13 nt, Homo sapiens
gugcuacaaaaac

SEQ ID NO: 399089 - RNA, 20 nt, Homo sapiens
gugcuuuuaaaaaaaaauac

SEQ ID NO: 399090 - RNA, 18 nt, Homo sapiens
guggaaccaacacuaaca

SEQ ID NO: 399091 - RNA, 21 nt, Homo sapiens
guggagaaauuccuugauuca

SEQ ID NO: 399092 - RNA, 12 nt, Homo sapiens
guggagaacucc

SEQ ID NO: 399093 - RNA, 16 nt, Homo sapiens
guggauguaaagugau

SEQ ID NO: 399094 - RNA, 17 nt, Homo sapiens
guggcauuaaacauuug

SEQ ID NO: 399095 - RNA, 14 nt, Homo sapiens
guggcccaagacaa

SEQ ID NO: 399096 - RNA, 22 nt, Homo sapiens
guggguacuauucugauuacac

SEQ ID NO: 399097 - RNA, 14 nt, Homo sapiens
gugguacagcacug

SEQ ID NO: 399098 - RNA, 20 nt, Homo sapiens
gugguggcacacaccuguag

SEQ ID NO: 399099 - RNA, 21 nt, Homo sapiens
gugguuuaugucaucauacau

SEQ ID NO: 399100 - RNA, 18 nt, Homo sapiens
guguaaaauacguuugaa

SEQ ID NO: 399101 - RNA, 14 nt, Homo sapiens
guguaacaggucuc

SEQ ID NO: 399102 - RNA, 22 nt, Homo sapiens
guguaugugcgugugugcaagu

SEQ ID NO: 399103 - RNA, 20 nt, Homo sapiens
guguauucuagugaaugaau

SEQ ID NO: 399104 - RNA, 13 nt, Homo sapiens
guguccaugugug

SEQ ID NO: 399105 - RNA, 19 nt, Homo sapiens
guguccaugugugugcaag

SEQ ID NO: 399106 - RNA, 17 nt, Homo sapiens
guguccccuccacuguc

SEQ ID NO: 399107 - RNA, 15 nt, Homo sapiens
gugugaagaucacgu

SEQ ID NO: 399108 - RNA, 22 nt, Homo sapiens
gugugaccacugcagaagacag

SEQ ID NO: 399109 - RNA, 12 nt, Homo sapiens
gugugcaagugu

SEQ ID NO: 399110 - RNA, 16 nt, Homo sapiens
gugugcaaguguguau

SEQ ID NO: 399111 - RNA, 17 nt, Homo sapiens
gugugcaagugugugca

SEQ ID NO: 399112 - RNA, 21 nt, Homo sapiens
gugugcaugugugugcucagg

SEQ ID NO: 399113 - RNA, 14 nt, Homo sapiens
gugugccauuuuaa

SEQ ID NO: 399114 - RNA, 21 nt, Homo sapiens
acugcaagcacugcaugggca

SEQ ID NO: 399115 - RNA, 20 nt, Homo sapiens
acugcacuccagccugggug

SEQ ID NO: 399116 - RNA, 13 nt, Homo sapiens
acugcagcuuugu

SEQ ID NO: 399117 - RNA, 23 nt, Homo sapiens
acugcagggaaaauuauuugcau

SEQ ID NO: 399118 - RNA, 19 nt, Homo sapiens
acugcauuuuuaaauacaa

SEQ ID NO: 399119 - RNA, 17 nt, Homo sapiens
acugcucaucauuccuu

SEQ ID NO: 399120 - RNA, 19 nt, Homo sapiens
acugcugcccagccuccaa

SEQ ID NO: 399121 - RNA, 22 nt, Homo sapiens
acugcugcccagccuccaagcu

SEQ ID NO: 399122 - RNA, 19 nt, Homo sapiens
acugcuggggaucuaggga

SEQ ID NO: 399123 - RNA, 12 nt, Homo sapiens
acugcugugaau

SEQ ID NO: 399124 - RNA, 14 nt, Homo sapiens
acugcuugaggaaa

SEQ ID NO: 399125 - RNA, 13 nt, Homo sapiens
acuggaguccagu

SEQ ID NO: 399126 - RNA, 14 nt, Homo sapiens
acuggugagcagac

SEQ ID NO: 399127 - RNA, 15 nt, Homo sapiens
acuguagucucagga

SEQ ID NO: 399128 - RNA, 18 nt, Homo sapiens
acuguaugugggaauuua

SEQ ID NO: 399129 - RNA, 24 nt, Homo sapiens
acuguccagagagcaacucugaga

SEQ ID NO: 399130 - RNA, 16 nt, Homo sapiens
acugucccuugccuca

SEQ ID NO: 399131 - RNA, 15 nt, Homo sapiens
acugugccuuugagu

SEQ ID NO: 399132 - RNA, 20 nt, Homo sapiens
acuguggcugcuagcacuug

SEQ ID NO: 399133 - RNA, 22 nt, Homo sapiens
acuguggcugcuagcacuugga

SEQ ID NO: 399134 - RNA, 20 nt, Homo sapiens
acuguuggagcuacugcaaa

SEQ ID NO: 399135 - RNA, 19 nt, Homo sapiens
acuuaaggauggagccagc

SEQ ID NO: 399136 - RNA, 17 nt, Homo sapiens
acuuaaguggcauuaaa

SEQ ID NO: 399137 - RNA, 11 nt, Homo sapiens
acuuaaugucu

SEQ ID NO: 399138 - RNA, 21 nt, Homo sapiens
acuuaauguuugguaacuuuu

SEQ ID NO: 399139 - RNA, 17 nt, Homo sapiens
acuuaccuagauucuac

SEQ ID NO: 399140 - RNA, 13 nt, Homo sapiens
acuucaauaucca

SEQ ID NO: 399141 - RNA, 14 nt, Homo sapiens
acuucacacacagg

SEQ ID NO: 399142 - RNA, 12 nt, Homo sapiens
acuucagggauc

SEQ ID NO: 399143 - RNA, 13 nt, Homo sapiens
acuuccauuugcu

SEQ ID NO: 399144 - RNA, 19 nt, Homo sapiens
acuucuaaguaaaaccaca

SEQ ID NO: 399145 - RNA, 18 nt, Homo sapiens
acuucucuauuaucucaa

SEQ ID NO: 399146 - RNA, 15 nt, Homo sapiens
acuucugcuuuccac

SEQ ID NO: 399147 - RNA, 12 nt, Homo sapiens
acuugagacaaa

SEQ ID NO: 399148 - RNA, 23 nt, Homo sapiens
acuugaggcugcaaucacacuga

SEQ ID NO: 399149 - RNA, 23 nt, Homo sapiens
acuugcugcugagugcaccacuu

SEQ ID NO: 399150 - RNA, 21 nt, Homo sapiens
acuuggagccccagugccaag

SEQ ID NO: 399151 - RNA, 22 nt, Homo sapiens
acuugggggaggaggaacaaau

SEQ ID NO: 399152 - RNA, 15 nt, Homo sapiens
acuuguuuuaugcuc

SEQ ID NO: 399153 - RNA, 19 nt, Homo sapiens
acuuucucuucauacuuuu

SEQ ID NO: 399154 - RNA, 22 nt, Homo sapiens
acuuuggaauguacucuguuca

SEQ ID NO: 399155 - RNA, 15 nt, Homo sapiens
acuuugggaggccaa

SEQ ID NO: 399156 - RNA, 22 nt, Homo sapiens
acuuuuaaguugcugaugaacu

SEQ ID NO: 399157 - RNA, 20 nt, Homo sapiens
acuuuucuaacauaugucua

SEQ ID NO: 399158 - RNA, 17 nt, Homo sapiens
acuuuugaaaagcuuuu

SEQ ID NO: 399159 - RNA, 18 nt, Homo sapiens
acuuuuuaccuaguacaa

SEQ ID NO: 399160 - RNA, 15 nt, Homo sapiens
agaaaaaaagggauc

SEQ ID NO: 399161 - RNA, 20 nt, Homo sapiens
agaaaaaauaacacacauau

SEQ ID NO: 399162 - RNA, 13 nt, Homo sapiens
agaaaacaacuuc

SEQ ID NO: 399163 - RNA, 13 nt, Homo sapiens
agaaaacacacuc

SEQ ID NO: 399164 - RNA, 23 nt, Homo sapiens
agaaaacucugguaaaugaucac

SEQ ID NO: 399165 - RNA, 22 nt, Homo sapiens
agaaaauauuauguguuuccau

SEQ ID NO: 399166 - RNA, 13 nt, Homo sapiens
agaaacucaccau

SEQ ID NO: 399167 - RNA, 23 nt, Homo sapiens
agaaagcaaaugugaccuguguc

SEQ ID NO: 399168 - RNA, 21 nt, Homo sapiens
agaaagcauccuaaauauauc

SEQ ID NO: 399169 - RNA, 14 nt, Homo sapiens
agaaagccugagaa

SEQ ID NO: 399170 - RNA, 20 nt, Homo sapiens
agaaagugggugagaugcug

SEQ ID NO: 399171 - RNA, 13 nt, Homo sapiens
agaaauacauauu

SEQ ID NO: 399172 - RNA, 16 nt, Homo sapiens
agaacaacuacuguga

SEQ ID NO: 399173 - RNA, 18 nt, Homo sapiens
agaaccaaccacaagcac

SEQ ID NO: 399174 - RNA, 16 nt, Homo sapiens
agaacguggcucugcu

SEQ ID NO: 399175 - RNA, 16 nt, Homo sapiens
agaacuauguacuuua

SEQ ID NO: 399176 - RNA, 16 nt, Homo sapiens
agaacuggaccaucuc

SEQ ID NO: 399177 - RNA, 14 nt, Homo sapiens
agaacuugaccccc

SEQ ID NO: 399178 - RNA, 20 nt, Homo sapiens
agaagacauccugagcagug

SEQ ID NO: 399179 - RNA, 18 nt, Homo sapiens
agaagacucuaccagacu

SEQ ID NO: 399180 - RNA, 20 nt, Homo sapiens
agaagcacccaggacuucca

SEQ ID NO: 399181 - RNA, 22 nt, Homo sapiens
agaaggguaccuugaacacugg

SEQ ID NO: 399182 - RNA, 22 nt, Homo sapiens
agaaguucuggcugaacacugg

SEQ ID NO: 399183 - RNA, 14 nt, Homo sapiens
agaauagcuuugaa

SEQ ID NO: 399184 - RNA, 13 nt, Homo sapiens
agaauauacuaaa

SEQ ID NO: 399185 - RNA, 14 nt, Homo sapiens
agaauaucugggau

SEQ ID NO: 399186 - RNA, 20 nt, Homo sapiens
agaauauuuuaaguauugca

SEQ ID NO: 399187 - RNA, 21 nt, Homo sapiens
agaauauuuuaaguauugcau

SEQ ID NO: 399188 - RNA, 18 nt, Homo sapiens
agaaucuguuaccagagg

SEQ ID NO: 399189 - RNA, 22 nt, Homo sapiens
agaaucuguuaccagaggacaa

SEQ ID NO: 399190 - RNA, 22 nt, Homo sapiens
agaaugaaagacugaaucuucc

SEQ ID NO: 399191 - RNA, 17 nt, Homo sapiens
agaaugugauauuugaa

SEQ ID NO: 399192 - RNA, 23 nt, Homo sapiens
agaauuccuuuucuaacucuccc

SEQ ID NO: 399193 - RNA, 14 nt, Homo sapiens
agacaaaugcugcg

SEQ ID NO: 399194 - RNA, 18 nt, Homo sapiens
agacaacagcccugucuc

SEQ ID NO: 399195 - RNA, 17 nt, Homo sapiens
agacacaucuccuccau

SEQ ID NO: 399196 - RNA, 22 nt, Homo sapiens
agacacaucuccuccauacuca

SEQ ID NO: 399197 - RNA, 20 nt, Homo sapiens
agacagccccagagcagggu

SEQ ID NO: 399198 - RNA, 14 nt, Homo sapiens
agacagcugucuug

SEQ ID NO: 399199 - RNA, 19 nt, Homo sapiens
agacaguguuuucugggau

SEQ ID NO: 399200 - RNA, 18 nt, Homo sapiens
agacauaaauuacuuuuu

SEQ ID NO: 399201 - RNA, 15 nt, Homo sapiens
agacaucaacagaua

SEQ ID NO: 399202 - RNA, 15 nt, Homo sapiens
agacauccugagcag

SEQ ID NO: 399203 - RNA, 14 nt, Homo sapiens
agacaugugacauu

SEQ ID NO: 399204 - RNA, 16 nt, Homo sapiens
agacaugugcacuuga

SEQ ID NO: 399205 - RNA, 14 nt, Homo sapiens
agacauucuuccaa

SEQ ID NO: 399206 - RNA, 13 nt, Homo sapiens
agaccagaaccag

SEQ ID NO: 399207 - RNA, 14 nt, Homo sapiens
agaccauaauguua

SEQ ID NO: 399208 - RNA, 21 nt, Homo sapiens
agaccauucaggacacaggga

SEQ ID NO: 399209 - RNA, 15 nt, Homo sapiens
agacggagucuugcu

SEQ ID NO: 399210 - RNA, 13 nt, Homo sapiens
agacuaaggccau

SEQ ID NO: 399211 - RNA, 22 nt, Homo sapiens
agacuauaagcagaagcacaua

SEQ ID NO: 399212 - RNA, 23 nt, Homo sapiens
agacuauuaauaaauaagacugu

SEQ ID NO: 399213 - RNA, 17 nt, Homo sapiens
agacuauucaaacaguc

SEQ ID NO: 399214 - RNA, 16 nt, Homo sapiens
agacucccaagcugga

SEQ ID NO: 399215 - RNA, 17 nt, Homo sapiens
agacucccaagcuggac

SEQ ID NO: 399216 - RNA, 12 nt, Homo sapiens
agacucuaccag

SEQ ID NO: 399217 - RNA, 13 nt, Homo sapiens
agacucugucuca

SEQ ID NO: 399218 - RNA, 21 nt, Homo sapiens
agacugggucucgcuuuguug

SEQ ID NO: 399219 - RNA, 21 nt, Homo sapiens
agacugguugaguucagguag

SEQ ID NO: 399220 - RNA, 21 nt, Homo sapiens
agacuuagaaaaauccuacaa

SEQ ID NO: 399221 - RNA, 17 nt, Homo sapiens
agacuuauguauuagcu

SEQ ID NO: 399222 - RNA, 22 nt, Homo sapiens
agagaacaaugugcuaugugaa

SEQ ID NO: 399223 - RNA, 20 nt, Homo sapiens
agagaaccucacgcaccucc

SEQ ID NO: 399224 - RNA, 9 nt, Homo sapiens
agagaagau

SEQ ID NO: 399225 - RNA, 17 nt, Homo sapiens
agagaaugcccagugac

SEQ ID NO: 399226 - RNA, 19 nt, Homo sapiens
agagacagauaacucuccu

SEQ ID NO: 399227 - RNA, 12 nt, Homo sapiens
agagacccaagg

SEQ ID NO: 399228 - RNA, 19 nt, Homo sapiens
agagacuuugacucuccag

SEQ ID NO: 399229 - RNA, 13 nt, Homo sapiens
agagaguggcucc

SEQ ID NO: 399230 - RNA, 13 nt, Homo sapiens
agagcaaaugcua

SEQ ID NO: 399231 - RNA, 20 nt, Homo sapiens
agagcaagacucugucucaa

SEQ ID NO: 399232 - RNA, 13 nt, Homo sapiens
agagcacacugua

SEQ ID NO: 399233 - RNA, 18 nt, Homo sapiens
agagcagaacccuagucu

SEQ ID NO: 399234 - RNA, 20 nt, Homo sapiens
agagcaggaagcauucagag

SEQ ID NO: 399235 - RNA, 20 nt, Homo sapiens
agagcgagagaauaugucac

SEQ ID NO: 399236 - RNA, 16 nt, Homo sapiens
agagcggucucaggcu

SEQ ID NO: 399237 - RNA, 13 nt, Homo sapiens
agagcugguuggg

SEQ ID NO: 399238 - RNA, 16 nt, Homo sapiens
agagcuucucccaaac

SEQ ID NO: 399239 - RNA, 19 nt, Homo sapiens
agaggggguagcuagccug

SEQ ID NO: 399240 - RNA, 21 nt, Homo sapiens
agagguuucuggcagccagua

SEQ ID NO: 399241 - RNA, 16 nt, Homo sapiens
agaguaaaaacugaau

SEQ ID NO: 399242 - RNA, 17 nt, Homo sapiens
agaguagaacagauaau

SEQ ID NO: 399243 - RNA, 22 nt, Homo sapiens
agagugccguaacaacuguggu

SEQ ID NO: 399244 - RNA, 22 nt, Homo sapiens
agaguggaaccaacacuaacau

SEQ ID NO: 399245 - RNA, 13 nt, Homo sapiens
agauaaacaguag

SEQ ID NO: 399246 - RNA, 21 nt, Homo sapiens
agauaacuugagcaccgucau

SEQ ID NO: 399247 - RNA, 16 nt, Homo sapiens
agauaagggugucuuc

SEQ ID NO: 399248 - RNA, 19 nt, Homo sapiens
agauaaucagugugucuaa

SEQ ID NO: 399249 - RNA, 17 nt, Homo sapiens
agauaauucuagcuuug

SEQ ID NO: 399250 - RNA, 14 nt, Homo sapiens
agauagcagggcau

SEQ ID NO: 399251 - RNA, 18 nt, Homo sapiens
agauauuaaaugauguuu

SEQ ID NO: 399252 - RNA, 22 nt, Homo sapiens
agauauugucagaguucugcuc

SEQ ID NO: 399253 - RNA, 21 nt, Homo sapiens
agauauuuuucaugauuuuga

SEQ ID NO: 399254 - RNA, 14 nt, Homo sapiens
agaucaaauggaaa

SEQ ID NO: 399255 - RNA, 21 nt, Homo sapiens
agaucccagcucacgucacac

SEQ ID NO: 399256 - RNA, 17 nt, Homo sapiens
agaucuaaggaugucac

SEQ ID NO: 399257 - RNA, 19 nt, Homo sapiens
agaugaaucauugauugaa

SEQ ID NO: 399258 - RNA, 20 nt, Homo sapiens
agaugaauguagcagauccc

SEQ ID NO: 399259 - RNA, 21 nt, Homo sapiens
guguguauauaguaugaaugc

SEQ ID NO: 399260 - RNA, 14 nt, Homo sapiens
gugugugugcaagu

SEQ ID NO: 399261 - RNA, 15 nt, Homo sapiens
gugugugugcaagug

SEQ ID NO: 399262 - RNA, 20 nt, Homo sapiens
guuaaauagaguauaugcac

SEQ ID NO: 399263 - RNA, 17 nt, Homo sapiens
guuaaucauguauuaaa

SEQ ID NO: 399264 - RNA, 14 nt, Homo sapiens
guuaaugcagggac

SEQ ID NO: 399265 - RNA, 16 nt, Homo sapiens
guuaauucagcacuga

SEQ ID NO: 399266 - RNA, 21 nt, Homo sapiens
guuaccugaaaacacugugca

SEQ ID NO: 399267 - RNA, 15 nt, Homo sapiens
guuacuucacuuuaa

SEQ ID NO: 399268 - RNA, 23 nt, Homo sapiens
ucacaaaacacuucgagcacugu

SEQ ID NO: 399269 - RNA, 23 nt, Homo sapiens
ucacaaaucuuaacuugaaggag

SEQ ID NO: 399270 - RNA, 14 nt, Homo sapiens
ucacaacagaucaa

SEQ ID NO: 399271 - RNA, 22 nt, Homo sapiens
ucacaaucaucaucauucucau

SEQ ID NO: 399272 - RNA, 13 nt, Homo sapiens
ucacaaugaaaug

SEQ ID NO: 399273 - RNA, 19 nt, Homo sapiens
ucacacuuccaccagccug

SEQ ID NO: 399274 - RNA, 21 nt, Homo sapiens
ucacacuuccaccagccugca

SEQ ID NO: 399275 - RNA, 19 nt, Homo sapiens
ucacagaacuauguacuuu

SEQ ID NO: 399276 - RNA, 21 nt, Homo sapiens
ucacagagauaauucuagcuu

SEQ ID NO: 399277 - RNA, 16 nt, Homo sapiens
ucacagagugcauugu

SEQ ID NO: 399278 - RNA, 18 nt, Homo sapiens
ucacagcaaagcaacaau

SEQ ID NO: 399279 - RNA, 14 nt, Homo sapiens
ucacagccucugaa

SEQ ID NO: 399280 - RNA, 23 nt, Homo sapiens
ucacaggaaguagaggaggccac

SEQ ID NO: 399281 - RNA, 16 nt, Homo sapiens
ucacaguguugcccag

SEQ ID NO: 399282 - RNA, 21 nt, Homo sapiens
ucacauggugcuacgccugca

SEQ ID NO: 399283 - RNA, 17 nt, Homo sapiens
ucacauuccaagccuca

SEQ ID NO: 399284 - RNA, 19 nt, Homo sapiens
ucacauucgaguguuucag

SEQ ID NO: 399285 - RNA, 14 nt, Homo sapiens
ucacauugugccuu

SEQ ID NO: 399286 - RNA, 14 nt, Homo sapiens
ucaccacuacauca

SEQ ID NO: 399287 - RNA, 13 nt, Homo sapiens
ucaccacuucccu

SEQ ID NO: 399288 - RNA, 23 nt, Homo sapiens
ucaccaggaggcggcagugcaac

SEQ ID NO: 399289 - RNA, 20 nt, Homo sapiens
ucaccauuuggcaaugccau

SEQ ID NO: 399290 - RNA, 23 nt, Homo sapiens
ucaccauuuggcaaugccaucau

SEQ ID NO: 399291 - RNA, 18 nt, Homo sapiens
ucaccucacacuccucca

SEQ ID NO: 399292 - RNA, 15 nt, Homo sapiens
ucaccucugccucaa

SEQ ID NO: 399293 - RNA, 19 nt, Homo sapiens
ucaccuugggaugaugccu

SEQ ID NO: 399294 - RNA, 15 nt, Homo sapiens
ucacgucacacuugg

SEQ ID NO: 399295 - RNA, 22 nt, Homo sapiens
ucacuagccaugauaacugcaa

SEQ ID NO: 399296 - RNA, 16 nt, Homo sapiens
ucacuguuucucugcu

SEQ ID NO: 399297 - RNA, 20 nt, Homo sapiens
ucacuugugcaguguugaca

SEQ ID NO: 399298 - RNA, 19 nt, Homo sapiens
ucacuuuuuacagugcuau

SEQ ID NO: 399299 - RNA, 18 nt, Homo sapiens
ucagaaggauggcauuuu

SEQ ID NO: 399300 - RNA, 20 nt, Homo sapiens
ucagacccuaccccaccacg

SEQ ID NO: 399301 - RNA, 21 nt, Homo sapiens
ucagacuccugugcaacuuuc

SEQ ID NO: 399302 - RNA, 21 nt, Homo sapiens
ucagagcccagcucaugcaca

SEQ ID NO: 399303 - RNA, 14 nt, Homo sapiens
ucagagcuacacaa

SEQ ID NO: 399304 - RNA, 15 nt, Homo sapiens
ucagaguugugcaca

SEQ ID NO: 399305 - RNA, 20 nt, Homo sapiens
ucagauauuuuuucagaaau

SEQ ID NO: 399306 - RNA, 21 nt, Homo sapiens
ucagauauuuuuucagaaaua

SEQ ID NO: 399307 - RNA, 21 nt, Homo sapiens
ucagauuuuaaaaagucuuca

SEQ ID NO: 399308 - RNA, 23 nt, Homo sapiens
ucagauuuuaaaaagucuucacu

SEQ ID NO: 399309 - RNA, 20 nt, Homo sapiens
ucagcaaaaagcaaaaucau

SEQ ID NO: 399310 - RNA, 19 nt, Homo sapiens
ucagcacugucccuugccu

SEQ ID NO: 399311 - RNA, 12 nt, Homo sapiens
ucagcauaccuu

SEQ ID NO: 399312 - RNA, 14 nt, Homo sapiens
ucagccauucacug

SEQ ID NO: 399313 - RNA, 18 nt, Homo sapiens
ucagccuagccgaccuca

SEQ ID NO: 399314 - RNA, 20 nt, Homo sapiens
ucagccuagccgaccucagc

SEQ ID NO: 399315 - RNA, 15 nt, Homo sapiens
ucagcuggaucucca

SEQ ID NO: 399316 - RNA, 17 nt, Homo sapiens
ucagcuucuuaauauaa

SEQ ID NO: 399317 - RNA, 14 nt, Homo sapiens
ucaggaaaacugac

SEQ ID NO: 399318 - RNA, 23 nt, Homo sapiens
ucaggagaggggcagaacagccg

SEQ ID NO: 399319 - RNA, 18 nt, Homo sapiens
ucaggaguuccuaaccag

SEQ ID NO: 399320 - RNA, 19 nt, Homo sapiens
ucagggggccaggugcaca

SEQ ID NO: 399321 - RNA, 18 nt, Homo sapiens
ucaguaaacaaugaauag

SEQ ID NO: 399322 - RNA, 16 nt, Homo sapiens
ucaguagaccuaauga

SEQ ID NO: 399323 - RNA, 15 nt, Homo sapiens
ucaguccaccugagc

SEQ ID NO: 399324 - RNA, 18 nt, Homo sapiens
ucaguccaugaagaugua

SEQ ID NO: 399325 - RNA, 20 nt, Homo sapiens
ucagugaaagccagauucaa

SEQ ID NO: 399326 - RNA, 20 nt, Homo sapiens
ucagugaagaugccagugaa

SEQ ID NO: 399327 - RNA, 12 nt, Homo sapiens
ucagugaaggac

SEQ ID NO: 399328 - RNA, 17 nt, Homo sapiens
ucaguuucccuaucucg

SEQ ID NO: 399329 - RNA, 21 nt, Homo sapiens
ucauaagaaugaauaauaauu

SEQ ID NO: 399330 - RNA, 22 nt, Homo sapiens
ucauaugauugugcacauacuu

SEQ ID NO: 399331 - RNA, 14 nt, Homo sapiens
ucauauuuuguaua

SEQ ID NO: 399332 - RNA, 21 nt, Homo sapiens
ucaucagccuguguaggcagu

SEQ ID NO: 399333 - RNA, 17 nt, Homo sapiens
ucaucauacaugacuca

SEQ ID NO: 399334 - RNA, 18 nt, Homo sapiens
ucaucauacaugacucag

SEQ ID NO: 399335 - RNA, 12 nt, Homo sapiens
ucaucauguauc

SEQ ID NO: 399336 - RNA, 16 nt, Homo sapiens
ucauccuuuccagcau

SEQ ID NO: 399337 - RNA, 14 nt, Homo sapiens
ucaugaagauauuu

SEQ ID NO: 399338 - RNA, 21 nt, Homo sapiens
ucaugauuuugaaaccaugaa

SEQ ID NO: 399339 - RNA, 23 nt, Homo sapiens
ucaugccaccauggccagccaac

SEQ ID NO: 399340 - RNA, 17 nt, Homo sapiens
ucauguaaacugugcac

SEQ ID NO: 399341 - RNA, 21 nt, Homo sapiens
ucauguaucgcuucauguaac

SEQ ID NO: 399342 - RNA, 18 nt, Homo sapiens
ucaugucaguuccaauga

SEQ ID NO: 399343 - RNA, 16 nt, Homo sapiens
ucauuccaccuuccca

SEQ ID NO: 399344 - RNA, 14 nt, Homo sapiens
ucauugacuaucaa

SEQ ID NO: 399345 - RNA, 20 nt, Homo sapiens
ucauuguuuauuaacaaauu

SEQ ID NO: 399346 - RNA, 17 nt, Homo sapiens
ucauuuagucaugugac

SEQ ID NO: 399347 - RNA, 15 nt, Homo sapiens
ucauuuaucccucaa

SEQ ID NO: 399348 - RNA, 21 nt, Homo sapiens
ucauuuauuauuucaauguga

SEQ ID NO: 399349 - RNA, 20 nt, Homo sapiens
ucauuuuaaaaaauggaaca

SEQ ID NO: 399350 - RNA, 18 nt, Homo sapiens
ucauuuuuuucacuggag

SEQ ID NO: 399351 - RNA, 23 nt, Homo sapiens
ucauuuuuuucacuggaguuaca

SEQ ID NO: 399352 - RNA, 16 nt, Homo sapiens
uccaacaugugcucag

SEQ ID NO: 399353 - RNA, 21 nt, Homo sapiens
uccaacuaacaagaaacucac

SEQ ID NO: 399354 - RNA, 14 nt, Homo sapiens
uccaagucuucuca

SEQ ID NO: 399355 - RNA, 13 nt, Homo sapiens
uccaagugccaau

SEQ ID NO: 399356 - RNA, 13 nt, Homo sapiens
uccaaugcucaag

SEQ ID NO: 399357 - RNA, 14 nt, Homo sapiens
uccaauguccaaaa

SEQ ID NO: 399358 - RNA, 16 nt, Homo sapiens
uccacaauaaggucaa

SEQ ID NO: 399359 - RNA, 12 nt, Homo sapiens
uccaccaagaaa

SEQ ID NO: 399360 - RNA, 14 nt, Homo sapiens
uccaccccccagaa

SEQ ID NO: 399361 - RNA, 21 nt, Homo sapiens
uccacuccagauuuuuuacag

SEQ ID NO: 399362 - RNA, 21 nt, Homo sapiens
uccacuuaccuagauucuaca

SEQ ID NO: 399363 - RNA, 20 nt, Homo sapiens
uccacuuagaaauugcauuu

SEQ ID NO: 399364 - RNA, 16 nt, Homo sapiens
uccacuuauaaaggaa

SEQ ID NO: 399365 - RNA, 23 nt, Homo sapiens
uccacuucuuguuccccacugac

SEQ ID NO: 399366 - RNA, 15 nt, Homo sapiens
uccagaagaucugaa

SEQ ID NO: 399367 - RNA, 15 nt, Homo sapiens
uccagagaguggcuc

SEQ ID NO: 399368 - RNA, 16 nt, Homo sapiens
uccagccuucugucag

SEQ ID NO: 399369 - RNA, 19 nt, Homo sapiens
uccaggccgagaugugcaa

SEQ ID NO: 399370 - RNA, 23 nt, Homo sapiens
uccagucucuucugcuggcagaa

SEQ ID NO: 399371 - RNA, 23 nt, Homo sapiens
uccaugggggcagggcaugacuu

SEQ ID NO: 399372 - RNA, 20 nt, Homo sapiens
uccauguuugauguaucuga

SEQ ID NO: 399373 - RNA, 14 nt, Homo sapiens
uccauuauuuauau

SEQ ID NO: 399374 - RNA, 15 nt, Homo sapiens
uccauuugcuuuguc

SEQ ID NO: 399375 - RNA, 22 nt, Homo sapiens
uccauuugugugugugcaagug

SEQ ID NO: 399376 - RNA, 15 nt, Homo sapiens
ucccacucaagccaa

SEQ ID NO: 399377 - RNA, 18 nt, Homo sapiens
ucccagaacacacuccau

SEQ ID NO: 399378 - RNA, 22 nt, Homo sapiens
ucccagcacuuugggaggccaa

SEQ ID NO: 399379 - RNA, 20 nt, Homo sapiens
ggccgaaaaggauaugcagu

SEQ ID NO: 399380 - RNA, 15 nt, Homo sapiens
ggccgagaugugcaa

SEQ ID NO: 399381 - RNA, 19 nt, Homo sapiens
ggccucccaaagugcuagu

SEQ ID NO: 399382 - RNA, 16 nt, Homo sapiens
ggccuccccugcugaa

SEQ ID NO: 399383 - RNA, 12 nt, Homo sapiens
ggccucccucaa

SEQ ID NO: 399384 - RNA, 22 nt, Homo sapiens
ggccugagaagagagaucaaau

SEQ ID NO: 399385 - RNA, 16 nt, Homo sapiens
ggccugagccaagcua

SEQ ID NO: 399386 - RNA, 23 nt, Homo sapiens
ggccuggaccugcccugggccac

SEQ ID NO: 399387 - RNA, 17 nt, Homo sapiens
ggccuggcaagugggug

SEQ ID NO: 399388 - RNA, 14 nt, Homo sapiens
ggcgucccuaccuc

SEQ ID NO: 399389 - RNA, 12 nt, Homo sapiens
ggcgugaucuug

SEQ ID NO: 399390 - RNA, 14 nt, Homo sapiens
ggcgugguggcaca

SEQ ID NO: 399391 - RNA, 21 nt, Homo sapiens
ggcuagacacccauuuucaca

SEQ ID NO: 399392 - RNA, 21 nt, Homo sapiens
ggcucauauuccugcagccug

SEQ ID NO: 399393 - RNA, 20 nt, Homo sapiens
ggcucucagcucagcgccag

SEQ ID NO: 399394 - RNA, 17 nt, Homo sapiens
ggcucucauggggucca

SEQ ID NO: 399395 - RNA, 12 nt, Homo sapiens
ggcucuggagac

SEQ ID NO: 399396 - RNA, 17 nt, Homo sapiens
ggcugcaaucacacuga

SEQ ID NO: 399397 - RNA, 16 nt, Homo sapiens
ggcuggagcccaggga

SEQ ID NO: 399398 - RNA, 22 nt, Homo sapiens
ggcugguccagggcuagugacu

SEQ ID NO: 399399 - RNA, 10 nt, Homo sapiens
ggcugugagg

SEQ ID NO: 399400 - RNA, 21 nt, Homo sapiens
ggcuuccauuugugugugugc

SEQ ID NO: 399401 - RNA, 13 nt, Homo sapiens
ggcuugcugccaa

SEQ ID NO: 399402 - RNA, 13 nt, Homo sapiens
guccuguuugcag

SEQ ID NO: 399403 - RNA, 21 nt, Homo sapiens
guccuucucucaccuccuaaa

SEQ ID NO: 399404 - RNA, 18 nt, Homo sapiens
guccuuucuaaguauuuu

SEQ ID NO: 399405 - RNA, 15 nt, Homo sapiens
gucuaaaaugccuca

SEQ ID NO: 399406 - RNA, 17 nt, Homo sapiens
gucuacguuaccaggca

SEQ ID NO: 399407 - RNA, 15 nt, Homo sapiens
gucucacauggugcu

SEQ ID NO: 399408 - RNA, 16 nt, Homo sapiens
gucucaguccaugaag

SEQ ID NO: 399409 - RNA, 22 nt, Homo sapiens
gucuccucuuaaaaaauaaaaa

SEQ ID NO: 399410 - RNA, 13 nt, Homo sapiens
gucuccucuucaa

SEQ ID NO: 399411 - RNA, 20 nt, Homo sapiens
gucuccucuucaaauaaaca

SEQ ID NO: 399412 - RNA, 24 nt, Homo sapiens
gucuccucuucaaauaaacauguc

SEQ ID NO: 399413 - RNA, 19 nt, Homo sapiens
gucucuacuaaaaauacaa

SEQ ID NO: 399414 - RNA, 17 nt, Homo sapiens
gucucuucuaagcaaaa

SEQ ID NO: 399415 - RNA, 15 nt, Homo sapiens
gucuuccugcauuca

SEQ ID NO: 399416 - RNA, 12 nt, Homo sapiens
gucuucucaggc

SEQ ID NO: 399417 - RNA, 14 nt, Homo sapiens
gucuuugaacccuu

SEQ ID NO: 399418 - RNA, 23 nt, Homo sapiens
gucuuugaagugacuucacagag

SEQ ID NO: 399419 - RNA, 18 nt, Homo sapiens
aacucaaggacuuugcag

SEQ ID NO: 399420 - RNA, 20 nt, Homo sapiens
aacucagggacagagccaug

SEQ ID NO: 399421 - RNA, 17 nt, Homo sapiens
aacucauuccugccugu

SEQ ID NO: 399422 - RNA, 18 nt, Homo sapiens
aacucugagaucuaagga

SEQ ID NO: 399423 - RNA, 14 nt, Homo sapiens
aacucuuaaaaccc

SEQ ID NO: 399424 - RNA, 14 nt, Homo sapiens
aacugacuuuaucc

SEQ ID NO: 399425 - RNA, 18 nt, Homo sapiens
aacuguugccagagaugg

SEQ ID NO: 399426 - RNA, 15 nt, Homo sapiens
aacuuccaauuuaca

SEQ ID NO: 399427 - RNA, 17 nt, Homo sapiens
aacuucuacuucugccc

SEQ ID NO: 399428 - RNA, 20 nt, Homo sapiens
aacuucuacuucugcccuug

SEQ ID NO: 399429 - RNA, 20 nt, Homo sapiens
aacuugauguguuaucucuu

SEQ ID NO: 399430 - RNA, 15 nt, Homo sapiens
aacuugcugcugagu

SEQ ID NO: 399431 - RNA, 13 nt, Homo sapiens
cauucuuccaaaa

SEQ ID NO: 399432 - RNA, 14 nt, Homo sapiens
cauucuuccaaaaa

SEQ ID NO: 399433 - RNA, 23 nt, Homo sapiens
cauucuuguuuuaagugccuuua

SEQ ID NO: 399434 - RNA, 16 nt, Homo sapiens
cauugacaagaacuga

SEQ ID NO: 399435 - RNA, 14 nt, Homo sapiens
cauugaucugggau

SEQ ID NO: 399436 - RNA, 22 nt, Homo sapiens
cauugcaagcuucuuuuaguug

SEQ ID NO: 399437 - RNA, 20 nt, Homo sapiens
cauuuaauacagcaguguca

SEQ ID NO: 399438 - RNA, 22 nt, Homo sapiens
cauuuaguuugauuauucagug

SEQ ID NO: 399439 - RNA, 15 nt, Homo sapiens
cauuuauauauugaa

SEQ ID NO: 399440 - RNA, 14 nt, Homo sapiens
cauuuaucccucaa

SEQ ID NO: 399441 - RNA, 22 nt, Homo sapiens
cauuuccuuuuccuucaagccu

SEQ ID NO: 399442 - RNA, 13 nt, Homo sapiens
cauuugcaccuac

SEQ ID NO: 399443 - RNA, 18 nt, Homo sapiens
cauuugcuuacuuugcau

SEQ ID NO: 399444 - RNA, 18 nt, Homo sapiens
cauuuggcagagcuucuu

SEQ ID NO: 399445 - RNA, 18 nt, Homo sapiens
cauuuggccuugugcggu

SEQ ID NO: 399446 - RNA, 11 nt, Homo sapiens
cauuugugccc

SEQ ID NO: 399447 - RNA, 18 nt, Homo sapiens
cauuugugugugugcaag

SEQ ID NO: 399448 - RNA, 16 nt, Homo sapiens
cauuuucugcauuuaa

SEQ ID NO: 399449 - RNA, 22 nt, Homo sapiens
cauuuuuuucacuggaguuaca

SEQ ID NO: 399450 - RNA, 14 nt, Homo sapiens
ccaaaacgugcaug

SEQ ID NO: 399451 - RNA, 17 nt, Homo sapiens
ccaaagccuugugucua

SEQ ID NO: 399452 - RNA, 17 nt, Homo sapiens
ccaaagcuuucauguaa

SEQ ID NO: 399453 - RNA, 20 nt, Homo sapiens
ccaaaguaaauguccugcua

SEQ ID NO: 399454 - RNA, 18 nt, Homo sapiens
ccaaaguuugcucaagga

SEQ ID NO: 399455 - RNA, 16 nt, Homo sapiens
ccaaauaagaagggau

SEQ ID NO: 399456 - RNA, 22 nt, Homo sapiens
ccaacaggagcugggauccuaa

SEQ ID NO: 399457 - RNA, 18 nt, Homo sapiens
ccaacaugugcucaggga

SEQ ID NO: 399458 - RNA, 18 nt, Homo sapiens
ccaaccacaagcacacag

SEQ ID NO: 399459 - RNA, 21 nt, Homo sapiens
ccaacuugagggcccagagca

SEQ ID NO: 399460 - RNA, 18 nt, Homo sapiens
ccaagagggcugcaaaag

SEQ ID NO: 399461 - RNA, 16 nt, Homo sapiens
ccaagcaggaagcuca

SEQ ID NO: 399462 - RNA, 16 nt, Homo sapiens
ccaaggcucugagcaa

SEQ ID NO: 399463 - RNA, 16 nt, Homo sapiens
ccaagucaaagacauu

SEQ ID NO: 399464 - RNA, 17 nt, Homo sapiens
ccaagugccggacuagc

SEQ ID NO: 399465 - RNA, 14 nt, Homo sapiens
ccaaguuccacugc

SEQ ID NO: 399466 - RNA, 13 nt, Homo sapiens
ccaaguuccguca

SEQ ID NO: 399467 - RNA, 21 nt, Homo sapiens
ccaauauuuaccagaccacaa

SEQ ID NO: 399468 - RNA, 14 nt, Homo sapiens
ccaaucauuuuaau

SEQ ID NO: 399469 - RNA, 11 nt, Homo sapiens
ccacaaauagu

SEQ ID NO: 399470 - RNA, 18 nt, Homo sapiens
ccacaaccgaccagaugc

SEQ ID NO: 399471 - RNA, 12 nt, Homo sapiens
ccacagcaguug

SEQ ID NO: 399472 - RNA, 16 nt, Homo sapiens
ccacaggcagcauuua

SEQ ID NO: 399473 - RNA, 17 nt, Homo sapiens
ccacaggcagcauuuag

SEQ ID NO: 399474 - RNA, 20 nt, Homo sapiens
ccaccaacagcccucagguc

SEQ ID NO: 399475 - RNA, 18 nt, Homo sapiens
ccaccaccaucaccagac

SEQ ID NO: 399476 - RNA, 20 nt, Homo sapiens
ccaccccagaaauggugaaa

SEQ ID NO: 399477 - RNA, 17 nt, Homo sapiens
ccacccccuucagugcc

SEQ ID NO: 399478 - RNA, 12 nt, Homo sapiens
ccacccuugugu

SEQ ID NO: 399479 - RNA, 17 nt, Homo sapiens
ccaccuccccagccuuu

SEQ ID NO: 399480 - RNA, 13 nt, Homo sapiens
ccaccugcugcug

SEQ ID NO: 399481 - RNA, 18 nt, Homo sapiens
ccaccuucccucaugcug

SEQ ID NO: 399482 - RNA, 21 nt, Homo sapiens
ccacgagggucaggacuguga

SEQ ID NO: 399483 - RNA, 20 nt, Homo sapiens
ccacgucugcuaacuuggag

SEQ ID NO: 399484 - RNA, 13 nt, Homo sapiens
ccacuccuaauau

SEQ ID NO: 399485 - RNA, 16 nt, Homo sapiens
ccacuccucugacuca

SEQ ID NO: 399486 - RNA, 18 nt, Homo sapiens
ccacuggaaaaguguaau

SEQ ID NO: 399487 - RNA, 13 nt, Homo sapiens
ccacuggucugua

SEQ ID NO: 399488 - RNA, 19 nt, Homo sapiens
ccacugugaagagaaccau

SEQ ID NO: 399489 - RNA, 23 nt, Homo sapiens
ccacuuaccuagauucuacauau

SEQ ID NO: 399490 - RNA, 19 nt, Homo sapiens
ccacuuagaaauugcauuu

SEQ ID NO: 399491 - RNA, 17 nt, Homo sapiens
ccacuugccccuguuac

SEQ ID NO: 399492 - RNA, 17 nt, Homo sapiens
ccagaaagcucaucuca

SEQ ID NO: 399493 - RNA, 14 nt, Homo sapiens
ccagacugucucaa

SEQ ID NO: 399494 - RNA, 18 nt, Homo sapiens
ccagagagcaacucugag

SEQ ID NO: 399495 - RNA, 15 nt, Homo sapiens
ccagagaguggcucc

SEQ ID NO: 399496 - RNA, 11 nt, Homo sapiens
ccagagcucag

SEQ ID NO: 399497 - RNA, 16 nt, Homo sapiens
ccagaggaacugucca

SEQ ID NO: 399498 - RNA, 15 nt, Homo sapiens
ccagagggcacucug

SEQ ID NO: 399499 - RNA, 17 nt, Homo sapiens
ccagaucccuuauccaa

SEQ ID NO: 399500 - RNA, 22 nt, Homo sapiens
ccagauccuucaaagagucaua

SEQ ID NO: 399501 - RNA, 22 nt, Homo sapiens
ccagaugccuucuccagacaaa

SEQ ID NO: 399502 - RNA, 18 nt, Homo sapiens
ccagauugacgacaagug

SEQ ID NO: 399503 - RNA, 17 nt, Homo sapiens
ccagcaaugacaucuca

SEQ ID NO: 399504 - RNA, 12 nt, Homo sapiens
ccagcacuuugg

SEQ ID NO: 399505 - RNA, 20 nt, Homo sapiens
ccagccaagagggcugcaaa

SEQ ID NO: 399506 - RNA, 15 nt, Homo sapiens
ccagccuccugcuaa

SEQ ID NO: 399507 - RNA, 22 nt, Homo sapiens
ccagccuucugucagcagugaa

SEQ ID NO: 399508 - RNA, 12 nt, Homo sapiens
ccagcuacucag

SEQ ID NO: 399509 - RNA, 15 nt, Homo sapiens
ccagcuuugcaguga

SEQ ID NO: 399510 - RNA, 12 nt, Homo sapiens
ccaggacugagc

SEQ ID NO: 399511 - RNA, 21 nt, Homo sapiens
ccaggagauggaaguugcagu

SEQ ID NO: 399512 - RNA, 16 nt, Homo sapiens
ccaggaggcggcagug

SEQ ID NO: 399513 - RNA, 23 nt, Homo sapiens
ccaggauauugacaagaauacac

SEQ ID NO: 399514 - RNA, 21 nt, Homo sapiens
ccaggccgagaugugcaacac

SEQ ID NO: 399515 - RNA, 15 nt, Homo sapiens
ccaggccugccuguu

SEQ ID NO: 399516 - RNA, 17 nt, Homo sapiens
ccaggcgugguggcaca

SEQ ID NO: 399517 - RNA, 15 nt, Homo sapiens
ccagggaugacaugu

SEQ ID NO: 399518 - RNA, 13 nt, Homo sapiens
ccagggcacugag

SEQ ID NO: 399519 - RNA, 18 nt, Homo sapiens
ccagggccacucugccuc

SEQ ID NO: 399520 - RNA, 13 nt, Homo sapiens
ccaggucagggag

SEQ ID NO: 399521 - RNA, 12 nt, Homo sapiens
ccaggugcacag

SEQ ID NO: 399522 - RNA, 19 nt, Homo sapiens
ccaguauaugcugauggac

SEQ ID NO: 399523 - RNA, 13 nt, Homo sapiens
ccaguaucgcuca

SEQ ID NO: 399524 - RNA, 22 nt, Homo sapiens
ccaguauuuuuauuucuuuaau

SEQ ID NO: 399525 - RNA, 12 nt, Homo sapiens
ccaguccaugag

SEQ ID NO: 399526 - RNA, 20 nt, Homo sapiens
ccagucuugucauugccagc

SEQ ID NO: 399527 - RNA, 13 nt, Homo sapiens
ccauaaaggcaua

SEQ ID NO: 399528 - RNA, 12 nt, Homo sapiens
ccauauuuucac

SEQ ID NO: 399529 - RNA, 14 nt, Homo sapiens
ccaucagugcuccc

SEQ ID NO: 399530 - RNA, 23 nt, Homo sapiens
ccaucagugcucccucacauguc

SEQ ID NO: 399531 - RNA, 19 nt, Homo sapiens
ccauccccuggacugggag

SEQ ID NO: 399532 - RNA, 15 nt, Homo sapiens
ccaugaagacaggau

SEQ ID NO: 399533 - RNA, 19 nt, Homo sapiens
ccaugcugcccgcuucuca

SEQ ID NO: 399534 - RNA, 16 nt, Homo sapiens
ccauggaggcaugcca

SEQ ID NO: 399535 - RNA, 22 nt, Homo sapiens
ccauggcaccuuuugcacauaa

SEQ ID NO: 399536 - RNA, 15 nt, Homo sapiens
ccauggggaagggau

SEQ ID NO: 399537 - RNA, 21 nt, Homo sapiens
ccaugggggcagggcaugacu

SEQ ID NO: 399538 - RNA, 21 nt, Homo sapiens
ccauucauacccacacaccca

SEQ ID NO: 399539 - RNA, 17 nt, Homo sapiens
ccauuucugagaucaaa

SEQ ID NO: 399540 - RNA, 18 nt, Homo sapiens
ccauuugugugugugcaa

SEQ ID NO: 399541 - RNA, 20 nt, Homo sapiens
ccauuugugugugugcaagu

SEQ ID NO: 399542 - RNA, 14 nt, Homo sapiens
cccaaagugcuagu

SEQ ID NO: 399543 - RNA, 16 nt, Homo sapiens
cccaaauuucauaccu

SEQ ID NO: 399544 - RNA, 20 nt, Homo sapiens
cccaaauuucauaccuauca

SEQ ID NO: 399545 - RNA, 16 nt, Homo sapiens
cccacaaaaguacaau

SEQ ID NO: 399546 - RNA, 22 nt, Homo sapiens
cccacacccuggaggauuucau

SEQ ID NO: 399547 - RNA, 22 nt, Homo sapiens
cccaccuucuucagccaccucu

SEQ ID NO: 399548 - RNA, 18 nt, Homo sapiens
cccagacuuuacaugaca

SEQ ID NO: 399549 - RNA, 13 nt, Homo sapiens
cccagcacuuugg

SEQ ID NO: 399550 - RNA, 20 nt, Homo sapiens
cccagccaaacccugucuga

SEQ ID NO: 399551 - RNA, 18 nt, Homo sapiens
cccagccgaaaagcuuuu

SEQ ID NO: 399552 - RNA, 13 nt, Homo sapiens
cccagcuacucag

SEQ ID NO: 399553 - RNA, 21 nt, Homo sapiens
cccaggagagagaaagccagg

SEQ ID NO: 399554 - RNA, 19 nt, Homo sapiens
cccauagcagcagugcaug

SEQ ID NO: 399555 - RNA, 14 nt, Homo sapiens
cccauaucugugaa

SEQ ID NO: 399556 - RNA, 20 nt, Homo sapiens
cccaucacgccugugcagug

SEQ ID NO: 399557 - RNA, 23 nt, Homo sapiens
cccaucauucaugcuacugccaa

SEQ ID NO: 399558 - RNA, 22 nt, Homo sapiens
cccaucccacacccuggaggau

SEQ ID NO: 399559 - RNA, 18 nt, Homo sapiens
cccaucccugccugguca

SEQ ID NO: 399560 - RNA, 13 nt, Homo sapiens
cccaucucuacaa

SEQ ID NO: 399561 - RNA, 16 nt, Homo sapiens
cccauggggguaauaa

SEQ ID NO: 399562 - RNA, 14 nt, Homo sapiens
ccccaccaccccag

SEQ ID NO: 399563 - RNA, 11 nt, Homo sapiens
ccccacugaca

SEQ ID NO: 399564 - RNA, 21 nt, Homo sapiens
ccccagcuguggguacagaga

SEQ ID NO: 399565 - RNA, 20 nt, Homo sapiens
ccccaucugccacguguauu

SEQ ID NO: 399566 - RNA, 19 nt, Homo sapiens
cccccauagcagcagugca

SEQ ID NO: 399567 - RNA, 15 nt, Homo sapiens
cccccugccagugcc

SEQ ID NO: 399568 - RNA, 21 nt, Homo sapiens
ccccgucgaggggcucucagc

SEQ ID NO: 399569 - RNA, 18 nt, Homo sapiens
ccccucaacaccucugca

SEQ ID NO: 399570 - RNA, 20 nt, Homo sapiens
ccccucauuguuuauuaaca

SEQ ID NO: 399571 - RNA, 12 nt, Homo sapiens
ccccuccacugu

SEQ ID NO: 399572 - RNA, 15 nt, Homo sapiens
ccccuccacugucac

SEQ ID NO: 399573 - RNA, 15 nt, Homo sapiens
ccccucggagaagag

SEQ ID NO: 399574 - RNA, 23 nt, Homo sapiens
ucuucagggggccaggugcacag

SEQ ID NO: 399575 - RNA, 21 nt, Homo sapiens
ucuucauaauuucuucacuca

SEQ ID NO: 399576 - RNA, 13 nt, Homo sapiens
ucuuccaaaaaga

SEQ ID NO: 399577 - RNA, 17 nt, Homo sapiens
ucuuccauuugcaaggg

SEQ ID NO: 399578 - RNA, 13 nt, Homo sapiens
ucuuccccagaua

SEQ ID NO: 399579 - RNA, 21 nt, Homo sapiens
ucuuccucccucauuccaccu

SEQ ID NO: 399580 - RNA, 19 nt, Homo sapiens
ucuuccugaguggugccaa

SEQ ID NO: 399581 - RNA, 20 nt, Homo sapiens
ucuuccugaguggugccaaa

SEQ ID NO: 399582 - RNA, 20 nt, Homo sapiens
ucuucgagccggcaacggca

SEQ ID NO: 399583 - RNA, 13 nt, Homo sapiens
ucuucuaagcaaa

SEQ ID NO: 399584 - RNA, 16 nt, Homo sapiens
ucuugaguuuagugau

SEQ ID NO: 399585 - RNA, 18 nt, Homo sapiens
ucuugauaugaccuguua

SEQ ID NO: 399586 - RNA, 17 nt, Homo sapiens
ucuugaugcaugcacug

SEQ ID NO: 399587 - RNA, 22 nt, Homo sapiens
ucuugguugaggaaacaaacau

SEQ ID NO: 399588 - RNA, 14 nt, Homo sapiens
ucuuuaagaugugu

SEQ ID NO: 399589 - RNA, 18 nt, Homo sapiens
ucuuucuaacuccaguga

SEQ ID NO: 399590 - RNA, 22 nt, Homo sapiens
ucuuucuaacuccagugaagua

SEQ ID NO: 399591 - RNA, 17 nt, Homo sapiens
ucuuucucugccaguga

SEQ ID NO: 399592 - RNA, 21 nt, Homo sapiens
ucuuuguaaugucaccaccuu

SEQ ID NO: 399593 - RNA, 17 nt, Homo sapiens
ucuuuucgccguggcug

SEQ ID NO: 399594 - RNA, 20 nt, Homo sapiens
ucuuuuuuuuaauaaaccau

SEQ ID NO: 399595 - RNA, 17 nt, Homo sapiens
ugaaaaacagaaagcau

SEQ ID NO: 399596 - RNA, 22 nt, Homo sapiens
ugaaaaacagaaagcauccuaa

SEQ ID NO: 399597 - RNA, 16 nt, Homo sapiens
ugaaaacacugugcac

SEQ ID NO: 399598 - RNA, 17 nt, Homo sapiens
ugaaaagacucaguguu

SEQ ID NO: 399599 - RNA, 16 nt, Homo sapiens
ugaaaagacuccaaag

SEQ ID NO: 399600 - RNA, 12 nt, Homo sapiens
ugaaaagucaaa

SEQ ID NO: 399601 - RNA, 16 nt, Homo sapiens
ugaaaauaauguugua

SEQ ID NO: 399602 - RNA, 17 nt, Homo sapiens
ugaaaauauuuguauca

SEQ ID NO: 399603 - RNA, 17 nt, Homo sapiens
ugaaaaucuacacucca

SEQ ID NO: 399604 - RNA, 23 nt, Homo sapiens
ugaaaaucuacacuccagugaga

SEQ ID NO: 399605 - RNA, 14 nt, Homo sapiens
ugaaaaugaaucuu

SEQ ID NO: 399606 - RNA, 16 nt, Homo sapiens
ugaaaaugaaucuuca

SEQ ID NO: 399607 - RNA, 20 nt, Homo sapiens
ugaaaaugcuguauuaguca

SEQ ID NO: 399608 - RNA, 22 nt, Homo sapiens
ugaaaaugcuguauuagucaca

SEQ ID NO: 399609 - RNA, 15 nt, Homo sapiens
ugaaacugcugugaa

SEQ ID NO: 399610 - RNA, 18 nt, Homo sapiens
ugaaagaggcagcuugaa

SEQ ID NO: 399611 - RNA, 23 nt, Homo sapiens
ugaaaggaagcuccacugucacc

SEQ ID NO: 399612 - RNA, 13 nt, Homo sapiens
ugaaagggcaaua

SEQ ID NO: 399613 - RNA, 20 nt, Homo sapiens
ugaaauuauguauguuuaca

SEQ ID NO: 399614 - RNA, 21 nt, Homo sapiens
uuaugcagaauccaaaguaaa

SEQ ID NO: 399615 - RNA, 17 nt, Homo sapiens
uuaugcuaccuacugau

SEQ ID NO: 399616 - RNA, 16 nt, Homo sapiens
uuauugugaucuauca

SEQ ID NO: 399617 - RNA, 14 nt, Homo sapiens
uuauuuauguaugu

SEQ ID NO: 399618 - RNA, 18 nt, Homo sapiens
uucaaaagguuauauacc

SEQ ID NO: 399619 - RNA, 19 nt, Homo sapiens
uucaaacagucucaggaaa

SEQ ID NO: 399620 - RNA, 15 nt, Homo sapiens
uucaaagagucauau

SEQ ID NO: 399621 - RNA, 15 nt, Homo sapiens
uucaaccucauugac

SEQ ID NO: 399622 - RNA, 12 nt, Homo sapiens
uucaaguguaca

SEQ ID NO: 399623 - RNA, 12 nt, Homo sapiens
uucaaucucuug

SEQ ID NO: 399624 - RNA, 11 nt, Homo sapiens
uucacacugca

SEQ ID NO: 399625 - RNA, 19 nt, Homo sapiens
uucacacuuccaccagccu

SEQ ID NO: 399626 - RNA, 17 nt, Homo sapiens
uucacagaugugugauu

SEQ ID NO: 399627 - RNA, 19 nt, Homo sapiens
uucacagccagacuggcac

SEQ ID NO: 399628 - RNA, 19 nt, Homo sapiens
uucacauucccaucuguca

SEQ ID NO: 399629 - RNA, 20 nt, Homo sapiens
uucaccuuccagugucucgg

SEQ ID NO: 399630 - RNA, 22 nt, Homo sapiens
uucacgccuguaaucccagcac

SEQ ID NO: 399631 - RNA, 15 nt, Homo sapiens
uucacggcaggacaa

SEQ ID NO: 399632 - RNA, 14 nt, Homo sapiens
uucacuguugaaaa

SEQ ID NO: 399633 - RNA, 13 nt, Homo sapiens
uucacuuuacaaa

SEQ ID NO: 399634 - RNA, 23 nt, Homo sapiens
uucagagagcagcuuuaaacuca

SEQ ID NO: 399635 - RNA, 17 nt, Homo sapiens
uucagaucauauuucac

SEQ ID NO: 399636 - RNA, 19 nt, Homo sapiens
uucagaucauauuucacaa

SEQ ID NO: 399637 - RNA, 18 nt, Homo sapiens
uucagauggcaauuucac

SEQ ID NO: 399638 - RNA, 21 nt, Homo sapiens
uucagauggcaauuucacuga

SEQ ID NO: 399639 - RNA, 22 nt, Homo sapiens
uucagauuuuaaaaagucuuca

SEQ ID NO: 399640 - RNA, 13 nt, Homo sapiens
uucagccaccucu

SEQ ID NO: 399641 - RNA, 16 nt, Homo sapiens
uucagcucuguuuuac

SEQ ID NO: 399642 - RNA, 16 nt, Homo sapiens
uucagggcacugcugc

SEQ ID NO: 399643 - RNA, 13 nt, Homo sapiens
uucagggggccag

SEQ ID NO: 399644 - RNA, 18 nt, Homo sapiens
uucagguacuaaauaccu

SEQ ID NO: 399645 - RNA, 21 nt, Homo sapiens
uucaguauguugucaaagaga

SEQ ID NO: 399646 - RNA, 13 nt, Homo sapiens
uucauauaacguc

SEQ ID NO: 399647 - RNA, 15 nt, Homo sapiens
uucauaugcuguaua

SEQ ID NO: 399648 - RNA, 22 nt, Homo sapiens
uucauauuguggcacaagcaaa

SEQ ID NO: 399649 - RNA, 23 nt, Homo sapiens
uucauauuguggcacaagcaaaa

SEQ ID NO: 399650 - RNA, 20 nt, Homo sapiens
uucaucagacuccugugcaa

SEQ ID NO: 399651 - RNA, 22 nt, Homo sapiens
uucaucagacuccugugcaacu

SEQ ID NO: 399652 - RNA, 18 nt, Homo sapiens
uucaucaugucaguucca

SEQ ID NO: 399653 - RNA, 15 nt, Homo sapiens
uucauccguguaacc

SEQ ID NO: 399654 - RNA, 19 nt, Homo sapiens
uucauuucagauaaacaac

SEQ ID NO: 399655 - RNA, 17 nt, Homo sapiens
uucauuuuuuucacugg

SEQ ID NO: 399656 - RNA, 14 nt, Homo sapiens
uuccaagugccaau

SEQ ID NO: 399657 - RNA, 14 nt, Homo sapiens
uuccaauuuacaua

SEQ ID NO: 399658 - RNA, 18 nt, Homo sapiens
uuccacaccuagcaucuc

SEQ ID NO: 399659 - RNA, 10 nt, Homo sapiens
uuccacugag

SEQ ID NO: 399660 - RNA, 20 nt, Homo sapiens
uuccaggaccagaagcauuu

SEQ ID NO: 399661 - RNA, 19 nt, Homo sapiens
uuccaggcgaugugcaagu

SEQ ID NO: 399662 - RNA, 23 nt, Homo sapiens
uuccauaugugggugucagucag

SEQ ID NO: 399663 - RNA, 16 nt, Homo sapiens
uuccauuugcaaggga

SEQ ID NO: 399664 - RNA, 14 nt, Homo sapiens
uucccagcucuccc

SEQ ID NO: 399665 - RNA, 14 nt, Homo sapiens
uucccauucuugca

SEQ ID NO: 399666 - RNA, 12 nt, Homo sapiens
uuccccacugac

SEQ ID NO: 399667 - RNA, 13 nt, Homo sapiens
uucccccacugau

SEQ ID NO: 399668 - RNA, 15 nt, Homo sapiens
uucccccgcaaugug

SEQ ID NO: 399669 - RNA, 22 nt, Homo sapiens
uucccuacaguugaaaaacagc

SEQ ID NO: 399670 - RNA, 20 nt, Homo sapiens
uucccuguaugauuccuuga

SEQ ID NO: 399671 - RNA, 22 nt, Homo sapiens
uuccuaacaggauuagacaguc

SEQ ID NO: 399672 - RNA, 16 nt, Homo sapiens
uuccuacagauaguca

SEQ ID NO: 399673 - RNA, 17 nt, Homo sapiens
uuccuacccuuccucac

SEQ ID NO: 399674 - RNA, 17 nt, Homo sapiens
uuccucaaaacuucaga

SEQ ID NO: 399675 - RNA, 20 nt, Homo sapiens
uuccucagggacagagacac

SEQ ID NO: 399676 - RNA, 16 nt, Homo sapiens
uuccuggucuguagaa

SEQ ID NO: 399677 - RNA, 22 nt, Homo sapiens
uuccuuagcuuagaccucagcc

SEQ ID NO: 399678 - RNA, 20 nt, Homo sapiens
uuccuucagacagauuccag

SEQ ID NO: 399679 - RNA, 20 nt, Homo sapiens
uuccuucagugcaucuggga

SEQ ID NO: 399680 - RNA, 21 nt, Homo sapiens
uuccuucaugaucaucacaau

SEQ ID NO: 399681 - RNA, 13 nt, Homo sapiens
uuccuugaccagc

SEQ ID NO: 399682 - RNA, 20 nt, Homo sapiens
uuccuuggggcaggcaguga

SEQ ID NO: 399683 - RNA, 15 nt, Homo sapiens
uucgagguggaucac

SEQ ID NO: 399684 - RNA, 23 nt, Homo sapiens
uucgcaccuaccaucagggacag

SEQ ID NO: 399685 - RNA, 23 nt, Homo sapiens
acuacacauucaauaagcaucaa

SEQ ID NO: 399686 - RNA, 16 nt, Homo sapiens
acuacaggcaccugcc

SEQ ID NO: 399687 - RNA, 17 nt, Homo sapiens
acuacaggcaccugcca

SEQ ID NO: 399688 - RNA, 15 nt, Homo sapiens
acuacugacaugugg

SEQ ID NO: 399689 - RNA, 15 nt, Homo sapiens
acuacuggcaauuug

SEQ ID NO: 399690 - RNA, 14 nt, Homo sapiens
acuacugugaucag

SEQ ID NO: 399691 - RNA, 15 nt, Homo sapiens
acuagggaucccuca

SEQ ID NO: 399692 - RNA, 18 nt, Homo sapiens
acuaucaaacugaagcca

SEQ ID NO: 399693 - RNA, 17 nt, Homo sapiens
acuauuuaucugugcaa

SEQ ID NO: 399694 - RNA, 14 nt, Homo sapiens
acuauuuuccagcc

SEQ ID NO: 399695 - RNA, 14 nt, Homo sapiens
acuauuuuuccaaa

SEQ ID NO: 399696 - RNA, 21 nt, Homo sapiens
acucacacggacacucaaaag

SEQ ID NO: 399697 - RNA, 18 nt, Homo sapiens
acucacuuucuagauuaa

SEQ ID NO: 399698 - RNA, 16 nt, Homo sapiens
acucaguuuucuugca

SEQ ID NO: 399699 - RNA, 17 nt, Homo sapiens
acucauuuuuguuuuca

SEQ ID NO: 399700 - RNA, 21 nt, Homo sapiens
acuccagccugggcaacacag

SEQ ID NO: 399701 - RNA, 13 nt, Homo sapiens
acuccagugccag

SEQ ID NO: 399702 - RNA, 18 nt, Homo sapiens
acuccuaagacuuaugua

SEQ ID NO: 399703 - RNA, 22 nt, Homo sapiens
aaucaugagauccuuuaaaucc

SEQ ID NO: 399704 - RNA, 16 nt, Homo sapiens
aaucauuaauacucuu

SEQ ID NO: 399705 - RNA, 20 nt, Homo sapiens
aaucauuucugcaucagcug

SEQ ID NO: 399706 - RNA, 19 nt, Homo sapiens
aaucauuuuauaugucaaa

SEQ ID NO: 399707 - RNA, 20 nt, Homo sapiens
aauccaggcgugguggcaca

SEQ ID NO: 399708 - RNA, 15 nt, Homo sapiens
aaucccagcuacuug

SEQ ID NO: 399709 - RNA, 20 nt, Homo sapiens
aaucccuguuuaauauuuaa

SEQ ID NO: 399710 - RNA, 14 nt, Homo sapiens
aauccgaaguauga

SEQ ID NO: 399711 - RNA, 15 nt, Homo sapiens
aauccuuccaugaaa

SEQ ID NO: 399712 - RNA, 14 nt, Homo sapiens
aaucucggcucacu

SEQ ID NO: 399713 - RNA, 14 nt, Homo sapiens
aaucucuugcacuc

SEQ ID NO: 399714 - RNA, 23 nt, Homo sapiens
aaucugaaggcgugagucuucau

SEQ ID NO: 399715 - RNA, 22 nt, Homo sapiens
aaucuggugccucucucuugcu

SEQ ID NO: 399716 - RNA, 20 nt, Homo sapiens
aaucuucuugauccacuucu

SEQ ID NO: 399717 - RNA, 22 nt, Homo sapiens
aaucuucuugauccacuucucu

SEQ ID NO: 399718 - RNA, 13 nt, Homo sapiens
aaucuugcaacug

SEQ ID NO: 399719 - RNA, 12 nt, Homo sapiens
aaugaaucuuca

SEQ ID NO: 399720 - RNA, 15 nt, Homo sapiens
aaugacaucucaggg

SEQ ID NO: 399721 - RNA, 19 nt, Homo sapiens
aaugaguuagaacuauuaa

SEQ ID NO: 399722 - RNA, 16 nt, Homo sapiens
aaugaucauaagucua

SEQ ID NO: 399723 - RNA, 16 nt, Homo sapiens
aaugaucgggauauaa

SEQ ID NO: 399724 - RNA, 16 nt, Homo sapiens
aaugaugaagcuuccu

SEQ ID NO: 399725 - RNA, 16 nt, Homo sapiens
aaugaugggacaauaa

SEQ ID NO: 399726 - RNA, 20 nt, Homo sapiens
aaugcaagauaguuuaucua

SEQ ID NO: 399727 - RNA, 19 nt, Homo sapiens
aaugcagggacaaaugcca

SEQ ID NO: 399728 - RNA, 23 nt, Homo sapiens
aaugcauauccaacaugugcuca

SEQ ID NO: 399729 - RNA, 19 nt, Homo sapiens
aaugccacacggcucucac

SEQ ID NO: 399730 - RNA, 14 nt, Homo sapiens
aaugcccagugacc

SEQ ID NO: 399731 - RNA, 15 nt, Homo sapiens
aaugcucaagaaaca

SEQ ID NO: 399732 - RNA, 17 nt, Homo sapiens
aaugcuggcauuugcac

SEQ ID NO: 399733 - RNA, 19 nt, Homo sapiens
aaugcuuuuugaauguuau

SEQ ID NO: 399734 - RNA, 18 nt, Homo sapiens
aauggcagcauacacaga

SEQ ID NO: 399735 - RNA, 24 nt, Homo sapiens
aaugggaauauuuuauacugacag

SEQ ID NO: 399736 - RNA, 20 nt, Homo sapiens
aaugguaggauaucuuggcu

SEQ ID NO: 399737 - RNA, 23 nt, Homo sapiens
aauguaauacuccuaagacuuau

SEQ ID NO: 399738 - RNA, 18 nt, Homo sapiens
aauguacuacugagcuuc

SEQ ID NO: 399739 - RNA, 16 nt, Homo sapiens
aauguagcugucuccu

SEQ ID NO: 399740 - RNA, 17 nt, Homo sapiens
aauguauuuguuugcaa

SEQ ID NO: 399741 - RNA, 14 nt, Homo sapiens
aaugucaccaccuu

SEQ ID NO: 399742 - RNA, 20 nt, Homo sapiens
aaugugacauuauaugcacu

SEQ ID NO: 399743 - RNA, 18 nt, Homo sapiens
aauguuacauuauuauca

SEQ ID NO: 399744 - RNA, 21 nt, Homo sapiens
aauguuauuuuuuaauuauua

SEQ ID NO: 399745 - RNA, 16 nt, Homo sapiens
aauguucaucaaugaa

SEQ ID NO: 399746 - RNA, 14 nt, Homo sapiens
aauguuuacacucu

SEQ ID NO: 399747 - RNA, 14 nt, Homo sapiens
aauuaacacaugau

SEQ ID NO: 399748 - RNA, 20 nt, Homo sapiens
aauuaaugguugaggcagga

SEQ ID NO: 399749 - RNA, 16 nt, Homo sapiens
aauuaauuuacuagaa

SEQ ID NO: 399750 - RNA, 15 nt, Homo sapiens
aauuagaaacauaaa

SEQ ID NO: 399751 - RNA, 12 nt, Homo sapiens
aauuaugccaua

SEQ ID NO: 399752 - RNA, 16 nt, Homo sapiens
aauuaugucugcugaa

SEQ ID NO: 399753 - RNA, 17 nt, Homo sapiens
aauuauuuuuguucaua

SEQ ID NO: 399754 - RNA, 20 nt, Homo sapiens
aauucauuuuuuucacugga

SEQ ID NO: 399755 - RNA, 13 nt, Homo sapiens
aauuccgcauuua

SEQ ID NO: 399756 - RNA, 22 nt, Homo sapiens
aauuccuuagcuuagaccucag

SEQ ID NO: 399757 - RNA, 14 nt, Homo sapiens
aauuccuugauuca

SEQ ID NO: 399758 - RNA, 20 nt, Homo sapiens
aauucuuauugacucauaca

SEQ ID NO: 399759 - RNA, 21 nt, Homo sapiens
aauucuuauugacucauacac

SEQ ID NO: 399760 - RNA, 14 nt, Homo sapiens
aauugaacuaacaa

SEQ ID NO: 399761 - RNA, 13 nt, Homo sapiens
aauugacacuuaa

SEQ ID NO: 399762 - RNA, 14 nt, Homo sapiens
aauugagucuucca

SEQ ID NO: 399763 - RNA, 13 nt, Homo sapiens
aauugauuauucu

SEQ ID NO: 399764 - RNA, 12 nt, Homo sapiens
aauugcauuucc

SEQ ID NO: 399765 - RNA, 18 nt, Homo sapiens
aauuuauucaauuccucu

SEQ ID NO: 399766 - RNA, 20 nt, Homo sapiens
aauuucaguaaacaaugaau

SEQ ID NO: 399767 - RNA, 19 nt, Homo sapiens
aauuucauaccuaucaucu

SEQ ID NO: 399768 - RNA, 21 nt, Homo sapiens
aauuucauaccuaucaucuua

SEQ ID NO: 399769 - RNA, 15 nt, Homo sapiens
aauuucucccaguca

SEQ ID NO: 399770 - RNA, 19 nt, Homo sapiens
aauuuuaaauuauaacuua

SEQ ID NO: 399771 - RNA, 14 nt, Homo sapiens
aauuuuguugauau

SEQ ID NO: 399772 - RNA, 23 nt, Homo sapiens
aauuuuuuaguauaaguacauua

SEQ ID NO: 399773 - RNA, 23 nt, Homo sapiens
acaaaaaaauauauuuaaugaua

SEQ ID NO: 399774 - RNA, 18 nt, Homo sapiens
acaaaaaacaacaaauaa

SEQ ID NO: 399775 - RNA, 13 nt, Homo sapiens
acaaaaacacagc

SEQ ID NO: 399776 - RNA, 19 nt, Homo sapiens
acaaaaagccuuuuccaga

SEQ ID NO: 399777 - RNA, 16 nt, Homo sapiens
acaaaaaugaacugaa

SEQ ID NO: 399778 - RNA, 18 nt, Homo sapiens
acaaaccgagugcaauga

SEQ ID NO: 399779 - RNA, 18 nt, Homo sapiens
acaaagcccuuccauguc

SEQ ID NO: 399780 - RNA, 14 nt, Homo sapiens
acaaaguauuugcu

SEQ ID NO: 399781 - RNA, 12 nt, Homo sapiens
acaaauaugcaa

SEQ ID NO: 399782 - RNA, 21 nt, Homo sapiens
acaaaugaucgcuaucuagca

SEQ ID NO: 399783 - RNA, 16 nt, Homo sapiens
acaaaugccacacauc

SEQ ID NO: 399784 - RNA, 22 nt, Homo sapiens
acaaauguuguauaaccaauac

SEQ ID NO: 399785 - RNA, 17 nt, Homo sapiens
acaaauuauguuacauc

SEQ ID NO: 399786 - RNA, 17 nt, Homo sapiens
acaacaaccuggucaca

SEQ ID NO: 399787 - RNA, 21 nt, Homo sapiens
acaacagcccugucucaaaac

SEQ ID NO: 399788 - RNA, 21 nt, Homo sapiens
acaaccaugagaccacuguua

SEQ ID NO: 399789 - RNA, 18 nt, Homo sapiens
acaacgaggaagcccuaa

SEQ ID NO: 399790 - RNA, 16 nt, Homo sapiens
acaacuaugauuugga

SEQ ID NO: 399791 - RNA, 12 nt, Homo sapiens
acaacucagucc

SEQ ID NO: 399792 - RNA, 23 nt, Homo sapiens
acaagaaaaguugaagaagauau

SEQ ID NO: 399793 - RNA, 18 nt, Homo sapiens
acaagauccuuaaugcag

SEQ ID NO: 399794 - RNA, 20 nt, Homo sapiens
acaagauccuuaaugcagag

SEQ ID NO: 399795 - RNA, 16 nt, Homo sapiens
acaagcagcaggaaac

SEQ ID NO: 399796 - RNA, 23 nt, Homo sapiens
acaaggcauucaaguguacagug

SEQ ID NO: 399797 - RNA, 18 nt, Homo sapiens
acaaggcuggcagugaca

SEQ ID NO: 399798 - RNA, 18 nt, Homo sapiens
acaagugggugaaugugg

SEQ ID NO: 399799 - RNA, 16 nt, Homo sapiens
acaauaaggucaaugc

SEQ ID NO: 399800 - RNA, 18 nt, Homo sapiens
acaauaaggucaaugcca

SEQ ID NO: 399801 - RNA, 19 nt, Homo sapiens
acaaucaugaaauaugcau

SEQ ID NO: 399802 - RNA, 12 nt, Homo sapiens
acaaucuaaaag

SEQ ID NO: 399803 - RNA, 16 nt, Homo sapiens
acaaugaaaugcucuc

SEQ ID NO: 399804 - RNA, 14 nt, Homo sapiens
acaauguucauccc

SEQ ID NO: 399805 - RNA, 14 nt, Homo sapiens
acaauuccaaacau

SEQ ID NO: 399806 - RNA, 17 nt, Homo sapiens
acacagccaagccaguc

SEQ ID NO: 399807 - RNA, 18 nt, Homo sapiens
acacagccaagccaguca

SEQ ID NO: 399808 - RNA, 13 nt, Homo sapiens
acaccacacauac

SEQ ID NO: 399809 - RNA, 21 nt, Homo sapiens
acacccagccucaguccuccc

SEQ ID NO: 399810 - RNA, 14 nt, Homo sapiens
acacccagugccag

SEQ ID NO: 399811 - RNA, 15 nt, Homo sapiens
acaccugaccaauca

SEQ ID NO: 399812 - RNA, 15 nt, Homo sapiens
acacgcaacuggcuc

SEQ ID NO: 399813 - RNA, 12 nt, Homo sapiens
acacuccagugc

SEQ ID NO: 399814 - RNA, 21 nt, Homo sapiens
acacuccagugccagcaauga

SEQ ID NO: 399815 - RNA, 15 nt, Homo sapiens
acagaaaacgguuaa

SEQ ID NO: 399816 - RNA, 19 nt, Homo sapiens
acagaaagacugagcucaa

SEQ ID NO: 399817 - RNA, 17 nt, Homo sapiens
acagacuaugucaccca

SEQ ID NO: 399818 - RNA, 15 nt, Homo sapiens
acagagcagaacuuu

SEQ ID NO: 399819 - RNA, 18 nt, Homo sapiens
acagagccagacugucuc

SEQ ID NO: 399820 - RNA, 19 nt, Homo sapiens
acagagugaacacucuacu

SEQ ID NO: 399821 - RNA, 13 nt, Homo sapiens
acagagugcauug

SEQ ID NO: 399822 - RNA, 13 nt, Homo sapiens
acagauagucaaa

SEQ ID NO: 399823 - RNA, 22 nt, Homo sapiens
acagaugugugauucacagugu

SEQ ID NO: 399824 - RNA, 18 nt, Homo sapiens
acagcccugucucaaaac

SEQ ID NO: 399825 - RNA, 20 nt, Homo sapiens
acagccgcuccugucugcca

SEQ ID NO: 399826 - RNA, 21 nt, Homo sapiens
acagccucccacccccaucuc

SEQ ID NO: 399827 - RNA, 19 nt, Homo sapiens
agccugcacuacucccuca

SEQ ID NO: 399828 - RNA, 16 nt, Homo sapiens
agccugccucuuccag

SEQ ID NO: 399829 - RNA, 17 nt, Homo sapiens
agccugcuccagcuguu

SEQ ID NO: 399830 - RNA, 21 nt, Homo sapiens
agccuggcacagggcaguggg

SEQ ID NO: 399831 - RNA, 12 nt, Homo sapiens
agccuggugggc

SEQ ID NO: 399832 - RNA, 15 nt, Homo sapiens
agccugucccaugga

SEQ ID NO: 399833 - RNA, 17 nt, Homo sapiens
agccuuuggcucuggag

SEQ ID NO: 399834 - RNA, 20 nt, Homo sapiens
agccuuuuccagaagaucug

SEQ ID NO: 399835 - RNA, 13 nt, Homo sapiens
agcgcaacauuuc

SEQ ID NO: 399836 - RNA, 19 nt, Homo sapiens
agcgcagguuuaguuuacu

SEQ ID NO: 399837 - RNA, 24 nt, Homo sapiens
agcgugcauaaguuaacuuccaau

SEQ ID NO: 399838 - RNA, 17 nt, Homo sapiens
agcuaguggcuucaaaa

SEQ ID NO: 399839 - RNA, 12 nt, Homo sapiens
agcucacgucac

SEQ ID NO: 399840 - RNA, 16 nt, Homo sapiens
agcucagcgccagccu

SEQ ID NO: 399841 - RNA, 15 nt, Homo sapiens
agcucaggcacacuu

SEQ ID NO: 399842 - RNA, 18 nt, Homo sapiens
agcucaugcacaucagcu

SEQ ID NO: 399843 - RNA, 22 nt, Homo sapiens
agcuccacacccucucccagga

SEQ ID NO: 399844 - RNA, 14 nt, Homo sapiens
agcuccacugucac

SEQ ID NO: 399845 - RNA, 12 nt, Homo sapiens
agcucccaugua

SEQ ID NO: 399846 - RNA, 21 nt, Homo sapiens
agcuccgugaacuugugagaa

SEQ ID NO: 399847 - RNA, 20 nt, Homo sapiens
agcucgggcccucugugaga

SEQ ID NO: 399848 - RNA, 23 nt, Homo sapiens
agcucugaaaccaguguuaggga

SEQ ID NO: 399849 - RNA, 14 nt, Homo sapiens
agcucuguuuucau

SEQ ID NO: 399850 - RNA, 13 nt, Homo sapiens
agcugagcaggga

SEQ ID NO: 399851 - RNA, 14 nt, Homo sapiens
agcugcuccgugcu

SEQ ID NO: 399852 - RNA, 23 nt, Homo sapiens
agcuggaagggucaacaucuuuu

SEQ ID NO: 399853 - RNA, 17 nt, Homo sapiens
agcuggaguucaugucg

SEQ ID NO: 399854 - RNA, 15 nt, Homo sapiens
agcuggaugaugguc

SEQ ID NO: 399855 - RNA, 13 nt, Homo sapiens
agcuggauuuccu

SEQ ID NO: 399856 - RNA, 14 nt, Homo sapiens
agcugggagcacag

SEQ ID NO: 399857 - RNA, 21 nt, Homo sapiens
agcuguaguagcccuuucugu

SEQ ID NO: 399858 - RNA, 15 nt, Homo sapiens
agcugugacuucucc

SEQ ID NO: 399859 - RNA, 19 nt, Homo sapiens
agcuguggccagcuuguua

SEQ ID NO: 399860 - RNA, 14 nt, Homo sapiens
agcuuaucucaggg

SEQ ID NO: 399861 - RNA, 17 nt, Homo sapiens
agcuuccuucugugaaa

SEQ ID NO: 399862 - RNA, 17 nt, Homo sapiens
agcuucucuccacugaa

SEQ ID NO: 399863 - RNA, 21 nt, Homo sapiens
agcuucuuaaaugagaaggaa

SEQ ID NO: 399864 - RNA, 17 nt, Homo sapiens
agcuuuaaacucaggga

SEQ ID NO: 399865 - RNA, 16 nt, Homo sapiens
aggaaaaugauacgca

SEQ ID NO: 399866 - RNA, 22 nt, Homo sapiens
aggaaaucaaauaugcaaagca

SEQ ID NO: 399867 - RNA, 15 nt, Homo sapiens
aggaacauacuucag

SEQ ID NO: 399868 - RNA, 20 nt, Homo sapiens
aggaaccuccuccacaccag

SEQ ID NO: 399869 - RNA, 15 nt, Homo sapiens
aggaagacaauguga

SEQ ID NO: 399870 - RNA, 14 nt, Homo sapiens
aggaagcauucaga

SEQ ID NO: 399871 - RNA, 17 nt, Homo sapiens
aggaagcuccacuguca

SEQ ID NO: 399872 - RNA, 22 nt, Homo sapiens
aggaagguggugcuuacauccu

SEQ ID NO: 399873 - RNA, 22 nt, Homo sapiens
aggaauauauggcagaguugua

SEQ ID NO: 399874 - RNA, 12 nt, Homo sapiens
aggacaaagccu

SEQ ID NO: 399875 - RNA, 22 nt, Homo sapiens
aggaccuacuguucggacaaaa

SEQ ID NO: 399876 - RNA, 23 nt, Homo sapiens
aggacugccccgugcagacugga

SEQ ID NO: 399877 - RNA, 16 nt, Homo sapiens
aggacuuccauuugcu

SEQ ID NO: 399878 - RNA, 13 nt, Homo sapiens
aggagaaggugcc

SEQ ID NO: 399879 - RNA, 15 nt, Homo sapiens
aggagacucaccucu

SEQ ID NO: 399880 - RNA, 16 nt, Homo sapiens
aucuuagggcaucgcu

SEQ ID NO: 399881 - RNA, 22 nt, Homo sapiens
aucuucaaacauguacaaaauc

SEQ ID NO: 399882 - RNA, 22 nt, Homo sapiens
aucuucuuuauaauucuacuuu

SEQ ID NO: 399883 - RNA, 14 nt, Homo sapiens
aucuugcaccccaa

SEQ ID NO: 399884 - RNA, 17 nt, Homo sapiens
aucuugcuuuuuuucac

SEQ ID NO: 399885 - RNA, 18 nt, Homo sapiens
aucuuggagggaccaagg

SEQ ID NO: 399886 - RNA, 18 nt, Homo sapiens
aucuuggcuuugccacac

SEQ ID NO: 399887 - RNA, 17 nt, Homo sapiens
aucuuuagagaaguaua

SEQ ID NO: 399888 - RNA, 13 nt, Homo sapiens
augaaaacaauuc

SEQ ID NO: 399889 - RNA, 14 nt, Homo sapiens
augaaaaugaaucu

SEQ ID NO: 399890 - RNA, 16 nt, Homo sapiens
augaaauguaaauacu

SEQ ID NO: 399891 - RNA, 15 nt, Homo sapiens
augaacucuuaauca

SEQ ID NO: 399892 - RNA, 17 nt, Homo sapiens
augaaguacucauacau

SEQ ID NO: 399893 - RNA, 16 nt, Homo sapiens
augaauaauacauuga

SEQ ID NO: 399894 - RNA, 18 nt, Homo sapiens
augacagcugucccuguc

SEQ ID NO: 399895 - RNA, 19 nt, Homo sapiens
augacaucagcaauacaga

SEQ ID NO: 399896 - RNA, 15 nt, Homo sapiens
augacaucucagggg

SEQ ID NO: 399897 - RNA, 12 nt, Homo sapiens
augacauguuau

SEQ ID NO: 399898 - RNA, 15 nt, Homo sapiens
augaccaugcugaua

SEQ ID NO: 399899 - RNA, 23 nt, Homo sapiens
augacccccaaccaaguggcucc

SEQ ID NO: 399900 - RNA, 23 nt, Homo sapiens
augaccuguuauuaccauuagca

SEQ ID NO: 399901 - RNA, 17 nt, Homo sapiens
augagaaggaauuugag

SEQ ID NO: 399902 - RNA, 17 nt, Homo sapiens
augagaccacuguuauc

SEQ ID NO: 399903 - RNA, 23 nt, Homo sapiens
augagaguuucuguuaaucaugu

SEQ ID NO: 399904 - RNA, 18 nt, Homo sapiens
augagaucuaggugagga

SEQ ID NO: 399905 - RNA, 11 nt, Homo sapiens
augagcauuua

SEQ ID NO: 399906 - RNA, 14 nt, Homo sapiens
augagcuauuucca

SEQ ID NO: 399907 - RNA, 16 nt, Homo sapiens
augagggaaaaugagu

SEQ ID NO: 399908 - RNA, 22 nt, Homo sapiens
augaguuuuugauagcuuuauu

SEQ ID NO: 399909 - RNA, 22 nt, Homo sapiens
augaucaucacaaucaucauca

SEQ ID NO: 399910 - RNA, 20 nt, Homo sapiens
augaucccuguguugucucu

SEQ ID NO: 399911 - RNA, 15 nt, Homo sapiens
augaucgcuaucuag

SEQ ID NO: 399912 - RNA, 19 nt, Homo sapiens
augaugaucuuuaaaauac

SEQ ID NO: 399913 - RNA, 16 nt, Homo sapiens
augauugugcacauac

SEQ ID NO: 399914 - RNA, 15 nt, Homo sapiens
augcaaaguagcaau

SEQ ID NO: 399915 - RNA, 21 nt, Homo sapiens
augcaagcaagaaacacuggg

SEQ ID NO: 399916 - RNA, 22 nt, Homo sapiens
augcacuguucccccugugcag

SEQ ID NO: 399917 - RNA, 17 nt, Homo sapiens
augcagcaaaaugugaa

SEQ ID NO: 399918 - RNA, 13 nt, Homo sapiens
augcagcaucuaa

SEQ ID NO: 399919 - RNA, 13 nt, Homo sapiens
augcagggacaaa

SEQ ID NO: 399920 - RNA, 14 nt, Homo sapiens
augcauaaaugcga

SEQ ID NO: 399921 - RNA, 22 nt, Homo sapiens
augcaucaaguuauugacaaac

SEQ ID NO: 399922 - RNA, 22 nt, Homo sapiens
augccacacggcucucaccagu

SEQ ID NO: 399923 - RNA, 17 nt, Homo sapiens
augccagcuuaucucag

SEQ ID NO: 399924 - RNA, 19 nt, Homo sapiens
augccagcuuaucucaggg

SEQ ID NO: 399925 - RNA, 17 nt, Homo sapiens
augccagugaaacuuca

SEQ ID NO: 399926 - RNA, 23 nt, Homo sapiens
augccagugaaacuucaagcaaa

SEQ ID NO: 399927 - RNA, 13 nt, Homo sapiens
augccguggauug

SEQ ID NO: 399928 - RNA, 12 nt, Homo sapiens
augccugugucu

SEQ ID NO: 399929 - RNA, 19 nt, Homo sapiens
augccuucacuuuacaaau

SEQ ID NO: 399930 - RNA, 15 nt, Homo sapiens
augcguuuaaucaca

SEQ ID NO: 399931 - RNA, 16 nt, Homo sapiens
augcuauuucacucua

SEQ ID NO: 399932 - RNA, 14 nt, Homo sapiens
augcucugugcaga

SEQ ID NO: 399933 - RNA, 13 nt, Homo sapiens
augcugacuguac

SEQ ID NO: 399934 - RNA, 23 nt, Homo sapiens
augcuggcauuugcaccuaccuc

SEQ ID NO: 399935 - RNA, 15 nt, Homo sapiens
augcuguugccucau

SEQ ID NO: 399936 - RNA, 16 nt, Homo sapiens
augcuucugacuucau

SEQ ID NO: 399937 - RNA, 13 nt, Homo sapiens
auggaagcuucca

SEQ ID NO: 399938 - RNA, 19 nt, Homo sapiens
auggaauaaacuccauuua

SEQ ID NO: 399939 - RNA, 17 nt, Homo sapiens
auggaaugcuguguuaa

SEQ ID NO: 399940 - RNA, 14 nt, Homo sapiens
auggaauuacaugu

SEQ ID NO: 399941 - RNA, 18 nt, Homo sapiens
auggacacuccagugcca

SEQ ID NO: 399942 - RNA, 17 nt, Homo sapiens
auggagacuccaugaga

SEQ ID NO: 399943 - RNA, 17 nt, Homo sapiens
auggagcaugaauggua

SEQ ID NO: 399944 - RNA, 16 nt, Homo sapiens
auggaggcacacagcu

SEQ ID NO: 399945 - RNA, 17 nt, Homo sapiens
auggcacccaugcaccu

SEQ ID NO: 399946 - RNA, 15 nt, Homo sapiens
auggcaccuuuugca

SEQ ID NO: 399947 - RNA, 13 nt, Homo sapiens
auggccagccaac

SEQ ID NO: 399948 - RNA, 16 nt, Homo sapiens
auggcucuacuuucag

SEQ ID NO: 399949 - RNA, 22 nt, Homo sapiens
auggcuuaauguuuauuccuga

SEQ ID NO: 399950 - RNA, 15 nt, Homo sapiens
augggaaggguccau

SEQ ID NO: 399951 - RNA, 17 nt, Homo sapiens
augggacaggugccagg

SEQ ID NO: 399952 - RNA, 22 nt, Homo sapiens
augggacccgguguaugccaag

SEQ ID NO: 399953 - RNA, 20 nt, Homo sapiens
augguaggauaucuuggcuu

SEQ ID NO: 399954 - RNA, 14 nt, Homo sapiens
auggugauaaggga

SEQ ID NO: 399955 - RNA, 14 nt, Homo sapiens
auggugaugaaaug

SEQ ID NO: 399956 - RNA, 19 nt, Homo sapiens
auggugcacuaauuucacu

SEQ ID NO: 399957 - RNA, 14 nt, Homo sapiens
augguguguuaaag

SEQ ID NO: 399958 - RNA, 20 nt, Homo sapiens
auguaaugaucauaagucua

SEQ ID NO: 399959 - RNA, 21 nt, Homo sapiens
auguacaugaagaagcuaaau

SEQ ID NO: 399960 - RNA, 17 nt, Homo sapiens
auguagcagauccccag

SEQ ID NO: 399961 - RNA, 19 nt, Homo sapiens
auguauuuaaccagucuuc

SEQ ID NO: 399962 - RNA, 18 nt, Homo sapiens
augucaacagagcaagga

SEQ ID NO: 399963 - RNA, 20 nt, Homo sapiens
augucaacagagcaaggaga

SEQ ID NO: 399964 - RNA, 22 nt, Homo sapiens
augucacagggccaacuugagg

SEQ ID NO: 399965 - RNA, 14 nt, Homo sapiens
augucacucagaug

SEQ ID NO: 399966 - RNA, 15 nt, Homo sapiens
augucccaacuugua

SEQ ID NO: 399967 - RNA, 23 nt, Homo sapiens
augucccuugcugugagcaagaa

SEQ ID NO: 399968 - RNA, 14 nt, Homo sapiens
augucuagcuuuca

SEQ ID NO: 399969 - RNA, 21 nt, Homo sapiens
augucucucagaauucuucag

SEQ ID NO: 399970 - RNA, 15 nt, Homo sapiens
augugaaaguuacaa

SEQ ID NO: 399971 - RNA, 17 nt, Homo sapiens
augugaaaguuacaaau

SEQ ID NO: 399972 - RNA, 19 nt, Homo sapiens
augugacauuauaugcacu

SEQ ID NO: 399973 - RNA, 14 nt, Homo sapiens
augugauugcagcu

SEQ ID NO: 399974 - RNA, 14 nt, Homo sapiens
augugcaacacuca

SEQ ID NO: 399975 - RNA, 23 nt, Homo sapiens
augugcuuuuaaaaaaaaauacu

SEQ ID NO: 399976 - RNA, 15 nt, Homo sapiens
auguguugcuauccu

SEQ ID NO: 399977 - RNA, 18 nt, Homo sapiens
auguuagccacaguguau

SEQ ID NO: 399978 - RNA, 19 nt, Homo sapiens
auguuagggugcucuggaa

SEQ ID NO: 399979 - RNA, 22 nt, Homo sapiens
auguucacuuuugacaaaggca

SEQ ID NO: 399980 - RNA, 14 nt, Homo sapiens
auguucauuuguac

SEQ ID NO: 399981 - RNA, 22 nt, Homo sapiens
auguugaaaaaguucugcagau

SEQ ID NO: 399982 - RNA, 12 nt, Homo sapiens
auguugaugaaa

SEQ ID NO: 399983 - RNA, 14 nt, Homo sapiens
auguugcccagugu

SEQ ID NO: 399984 - RNA, 13 nt, Homo sapiens
auguuugucagau

SEQ ID NO: 399985 - RNA, 21 nt, Homo sapiens
auuaacuuuuuaaaacacaac

SEQ ID NO: 399986 - RNA, 13 nt, Homo sapiens
auuaauauuugcu

SEQ ID NO: 399987 - RNA, 13 nt, Homo sapiens
auuaauguuaauu

SEQ ID NO: 399988 - RNA, 18 nt, Homo sapiens
auuaauuaucuaguuuaa

SEQ ID NO: 399989 - RNA, 12 nt, Homo sapiens
auuaauucaccu

SEQ ID NO: 399990 - RNA, 17 nt, Homo sapiens
auuaccgcguuguaaaa

SEQ ID NO: 399991 - RNA, 22 nt, Homo sapiens
auuaccuugugcuaauccucuu

SEQ ID NO: 399992 - RNA, 13 nt, Homo sapiens
auuagacagucaa

SEQ ID NO: 399993 - RNA, 13 nt, Homo sapiens
auuagaugaacuc

SEQ ID NO: 399994 - RNA, 20 nt, Homo sapiens
auuagcauucugguuuugac

SEQ ID NO: 399995 - RNA, 23 nt, Homo sapiens
auuagccaagugugguagagugu

SEQ ID NO: 399996 - RNA, 17 nt, Homo sapiens
auuagccguaguggaau

SEQ ID NO: 399997 - RNA, 17 nt, Homo sapiens
auuauaauauacuauau

SEQ ID NO: 399998 - RNA, 18 nt, Homo sapiens
auuauaauuaguuccuca

SEQ ID NO: 399999 - RNA, 16 nt, Homo sapiens
auuauaugcacuagca

SEQ ID NO: 400000 - RNA, 17 nt, Homo sapiens
auuauaugcacuagcaa

SEQ ID NO: 400001 - RNA, 13 nt, Homo sapiens
auuaucaacagca

SEQ ID NO: 400002 - RNA, 18 nt, Homo sapiens
auuaugccauagcaagau

SEQ ID NO: 400003 - RNA, 15 nt, Homo sapiens
auuauguauguuuac

SEQ ID NO: 400004 - RNA, 14 nt, Homo sapiens
auucaaaagaucaa

SEQ ID NO: 400005 - RNA, 20 nt, Homo sapiens
auucaaaagguuauauacca

SEQ ID NO: 400006 - RNA, 13 nt, Homo sapiens
auucaaagcucua

SEQ ID NO: 400007 - RNA, 19 nt, Homo sapiens
auucaagucaccuccuuaa

SEQ ID NO: 400008 - RNA, 19 nt, Homo sapiens
auucacaagacccaaaagg

SEQ ID NO: 400009 - RNA, 20 nt, Homo sapiens
auucagauggcaauuucacu

SEQ ID NO: 400010 - RNA, 13 nt, Homo sapiens
auucaggacacag

SEQ ID NO: 400011 - RNA, 12 nt, Homo sapiens
auucaguguuaa

SEQ ID NO: 400012 - RNA, 20 nt, Homo sapiens
auucauacccacacacccag

SEQ ID NO: 400013 - RNA, 22 nt, Homo sapiens
auucauauuuacuucuuauaca

SEQ ID NO: 400014 - RNA, 17 nt, Homo sapiens
auucauuuucugccuau

SEQ ID NO: 400015 - RNA, 20 nt, Homo sapiens
auucauuuuuuucacuggag

SEQ ID NO: 400016 - RNA, 13 nt, Homo sapiens
auuccaaccccaa

SEQ ID NO: 400017 - RNA, 16 nt, Homo sapiens
auuccaccuucccaug

SEQ ID NO: 400018 - RNA, 17 nt, Homo sapiens
auuccccauugccuccu

SEQ ID NO: 400019 - RNA, 16 nt, Homo sapiens
auucuaaaggcuugau

SEQ ID NO: 400020 - RNA, 20 nt, Homo sapiens
auucuagugaaugaaucuca

SEQ ID NO: 400021 - RNA, 11 nt, Homo sapiens
auucuaugagg

SEQ ID NO: 400022 - RNA, 21 nt, Homo sapiens
auucucacuccaccacccaaa

SEQ ID NO: 400023 - RNA, 14 nt, Homo sapiens
auucucacuccuac

SEQ ID NO: 400024 - RNA, 14 nt, Homo sapiens
auucucaugugauc

SEQ ID NO: 400025 - RNA, 21 nt, Homo sapiens
auucucucaggcuugcugcca

SEQ ID NO: 400026 - RNA, 17 nt, Homo sapiens
auucucugucucaucca

SEQ ID NO: 400027 - RNA, 20 nt, Homo sapiens
aggagcggccagaagaucua

SEQ ID NO: 400028 - RNA, 23 nt, Homo sapiens
aggagggcgugacucacccaagc

SEQ ID NO: 400029 - RNA, 19 nt, Homo sapiens
aggagggguuaaagcugcc

SEQ ID NO: 400030 - RNA, 22 nt, Homo sapiens
aggaggugcuaucgcaccacug

SEQ ID NO: 400031 - RNA, 17 nt, Homo sapiens
aggagguuuaggucaag

SEQ ID NO: 400032 - RNA, 17 nt, Homo sapiens
aggauagaauacaugga

SEQ ID NO: 400033 - RNA, 12 nt, Homo sapiens
aggauaugcagu

SEQ ID NO: 400034 - RNA, 11 nt, Homo sapiens
aggaugugaua

SEQ ID NO: 400035 - RNA, 23 nt, Homo sapiens
aggcaacugaggcagacagcagc

SEQ ID NO: 400036 - RNA, 13 nt, Homo sapiens
aggcaacugcauu

SEQ ID NO: 400037 - RNA, 21 nt, Homo sapiens
aggcacuagccuuuggcucug

SEQ ID NO: 400038 - RNA, 15 nt, Homo sapiens
aggcagcagugugag

SEQ ID NO: 400039 - RNA, 21 nt, Homo sapiens
aggcagggccuugcccagaga

SEQ ID NO: 400040 - RNA, 13 nt, Homo sapiens
aggccaagcauuu

SEQ ID NO: 400041 - RNA, 16 nt, Homo sapiens
aggccaggcagauccc

SEQ ID NO: 400042 - RNA, 12 nt, Homo sapiens
aggcccucgcug

SEQ ID NO: 400043 - RNA, 14 nt, Homo sapiens
aggccgggugcuca

SEQ ID NO: 400044 - RNA, 14 nt, Homo sapiens
aggccguggcugcc

SEQ ID NO: 400045 - RNA, 15 nt, Homo sapiens
aggcgauccaccugu

SEQ ID NO: 400046 - RNA, 22 nt, Homo sapiens
aggcgauccaccugucucagcc

SEQ ID NO: 400047 - RNA, 18 nt, Homo sapiens
aggcuauacuugucuugu

SEQ ID NO: 400048 - RNA, 12 nt, Homo sapiens
aggcucuucucc

SEQ ID NO: 400049 - RNA, 14 nt, Homo sapiens
aggcugacuaagaa

SEQ ID NO: 400050 - RNA, 22 nt, Homo sapiens
aggcugaggcagaacugcuuga

SEQ ID NO: 400051 - RNA, 13 nt, Homo sapiens
agggaaaaaccag

SEQ ID NO: 400052 - RNA, 13 nt, Homo sapiens
agggaagccaaaa

SEQ ID NO: 400053 - RNA, 16 nt, Homo sapiens
agggacagaugaaugc

SEQ ID NO: 400054 - RNA, 12 nt, Homo sapiens
agggcacugagg

SEQ ID NO: 400055 - RNA, 18 nt, Homo sapiens
agggccaagcaccuagcc

SEQ ID NO: 400056 - RNA, 14 nt, Homo sapiens
agggccacauggga

SEQ ID NO: 400057 - RNA, 21 nt, Homo sapiens
agggcuugucauuaccagacg

SEQ ID NO: 400058 - RNA, 12 nt, Homo sapiens
aggggcucucag

SEQ ID NO: 400059 - RNA, 14 nt, Homo sapiens
aggggcucuggaga

SEQ ID NO: 400060 - RNA, 20 nt, Homo sapiens
aggggucccauagaggugag

SEQ ID NO: 400061 - RNA, 21 nt, Homo sapiens
aggguaccuugaacacugggg

SEQ ID NO: 400062 - RNA, 17 nt, Homo sapiens
aggguaguaagaauuag

SEQ ID NO: 400063 - RNA, 23 nt, Homo sapiens
agggucugcucuuucucugccag

SEQ ID NO: 400064 - RNA, 15 nt, Homo sapiens
aggguggacuuagaa

SEQ ID NO: 400065 - RNA, 23 nt, Homo sapiens
aggguggacuuagaaagcagggg

SEQ ID NO: 400066 - RNA, 23 nt, Homo sapiens
aggguggcuggguccaggggaug

SEQ ID NO: 400067 - RNA, 13 nt, Homo sapiens
aggguuacuaugc

SEQ ID NO: 400068 - RNA, 22 nt, Homo sapiens
aggguucaccaggucagggaga

SEQ ID NO: 400069 - RNA, 15 nt, Homo sapiens
agguaaggugaggga

SEQ ID NO: 400070 - RNA, 14 nt, Homo sapiens
agguacaaguggcu

SEQ ID NO: 400071 - RNA, 15 nt, Homo sapiens
agguacaaguggcug

SEQ ID NO: 400072 - RNA, 18 nt, Homo sapiens
agguagcuuuagggcaau

SEQ ID NO: 400073 - RNA, 22 nt, Homo sapiens
agguauucguaaggaugggaag

SEQ ID NO: 400074 - RNA, 14 nt, Homo sapiens
aggucaaugccaga

SEQ ID NO: 400075 - RNA, 21 nt, Homo sapiens
aggucuaggaacauacuucag

SEQ ID NO: 400076 - RNA, 20 nt, Homo sapiens
aggucucacgggcaugggca

SEQ ID NO: 400077 - RNA, 13 nt, Homo sapiens
aggucugccaggc

SEQ ID NO: 400078 - RNA, 19 nt, Homo sapiens
aggugcagagugcccagaa

SEQ ID NO: 400079 - RNA, 14 nt, Homo sapiens
aggugccaggugug

SEQ ID NO: 400080 - RNA, 18 nt, Homo sapiens
aggugcuacaaaaacaca

SEQ ID NO: 400081 - RNA, 20 nt, Homo sapiens
aggugcuacaaaaacacagc

SEQ ID NO: 400082 - RNA, 20 nt, Homo sapiens
aggugcuggaggugggagca

SEQ ID NO: 400083 - RNA, 15 nt, Homo sapiens
agguggaucacugga

SEQ ID NO: 400084 - RNA, 11 nt, Homo sapiens
agguggcaagc

SEQ ID NO: 400085 - RNA, 20 nt, Homo sapiens
aggugggaggauugcuugag

SEQ ID NO: 400086 - RNA, 20 nt, Homo sapiens
aggugguauguuugggagac

SEQ ID NO: 400087 - RNA, 14 nt, Homo sapiens
aggugugacuugaa

SEQ ID NO: 400088 - RNA, 15 nt, Homo sapiens
aggugugacuugaac

SEQ ID NO: 400089 - RNA, 20 nt, Homo sapiens
agguuaaugcagggacugua

SEQ ID NO: 400090 - RNA, 20 nt, Homo sapiens
agguucucagguguugccaa

SEQ ID NO: 400091 - RNA, 17 nt, Homo sapiens
agguugcagugagccaa

SEQ ID NO: 400092 - RNA, 23 nt, Homo sapiens
agguugucugaagucacugcaca

SEQ ID NO: 400093 - RNA, 13 nt, Homo sapiens
agguuuccuucag

SEQ ID NO: 400094 - RNA, 19 nt, Homo sapiens
agguuucuggcagccagua

SEQ ID NO: 400095 - RNA, 13 nt, Homo sapiens
aguaaaucucaca

SEQ ID NO: 400096 - RNA, 10 nt, Homo sapiens
aguaagccac

SEQ ID NO: 400097 - RNA, 14 nt, Homo sapiens
aguaaguggugaga

SEQ ID NO: 400098 - RNA, 16 nt, Homo sapiens
aguaaguggugagaac

SEQ ID NO: 400099 - RNA, 22 nt, Homo sapiens
aguaaguuugauuucauuaaua

SEQ ID NO: 400100 - RNA, 21 nt, Homo sapiens
aguaaucuuuggcuguaaggc

SEQ ID NO: 400101 - RNA, 17 nt, Homo sapiens
aguacucauacauguua

SEQ ID NO: 400102 - RNA, 14 nt, Homo sapiens
aguauauauagaau

SEQ ID NO: 400103 - RNA, 14 nt, Homo sapiens
aguaugagggaaaa

SEQ ID NO: 400104 - RNA, 15 nt, Homo sapiens
agucaaaacagagau

SEQ ID NO: 400105 - RNA, 13 nt, Homo sapiens
agucaaagacauu

SEQ ID NO: 400106 - RNA, 17 nt, Homo sapiens
agucaaccaauguagaa

SEQ ID NO: 400107 - RNA, 23 nt, Homo sapiens
agucaaggauggaugcagaucca

SEQ ID NO: 400108 - RNA, 13 nt, Homo sapiens
agucacagagaua

SEQ ID NO: 400109 - RNA, 14 nt, Homo sapiens
agucacugcacagu

SEQ ID NO: 400110 - RNA, 20 nt, Homo sapiens
agucacuuauaauuaugcua

SEQ ID NO: 400111 - RNA, 13 nt, Homo sapiens
agucauauugccc

SEQ ID NO: 400112 - RNA, 17 nt, Homo sapiens
caaacagaacugcaguc

SEQ ID NO: 400113 - RNA, 17 nt, Homo sapiens
caaacagccacacugug

SEQ ID NO: 400114 - RNA, 23 nt, Homo sapiens
caaacagccccucuggacacagc

SEQ ID NO: 400115 - RNA, 15 nt, Homo sapiens
caaacaugaagugug

SEQ ID NO: 400116 - RNA, 20 nt, Homo sapiens
caaaccccagggcacugagg

SEQ ID NO: 400117 - RNA, 15 nt, Homo sapiens
caaaccgagugcaau

SEQ ID NO: 400118 - RNA, 21 nt, Homo sapiens
caaacuacuggcaauuuguaa

SEQ ID NO: 400119 - RNA, 18 nt, Homo sapiens
caaagaaaugcugaugga

SEQ ID NO: 400120 - RNA, 16 nt, Homo sapiens
caaagacaaaggugag

SEQ ID NO: 400121 - RNA, 11 nt, Homo sapiens
caaagacagaa

SEQ ID NO: 400122 - RNA, 13 nt, Homo sapiens
caaagacuuuccu

SEQ ID NO: 400123 - RNA, 16 nt, Homo sapiens
caaagauaacaugcuu

SEQ ID NO: 400124 - RNA, 23 nt, Homo sapiens
caaagcaaggaaacuauguaaca

SEQ ID NO: 400125 - RNA, 18 nt, Homo sapiens
caaagcacgaaauguuau

SEQ ID NO: 400126 - RNA, 20 nt, Homo sapiens
caaagcaggggaguaugcaa

SEQ ID NO: 400127 - RNA, 20 nt, Homo sapiens
caaagcauugagcaaagggg

SEQ ID NO: 400128 - RNA, 17 nt, Homo sapiens
caaagcuuucauguaaa

SEQ ID NO: 400129 - RNA, 18 nt, Homo sapiens
caaaggcacagugaaggc

SEQ ID NO: 400130 - RNA, 19 nt, Homo sapiens
caaaggcaccugaaugugu

SEQ ID NO: 400131 - RNA, 14 nt, Homo sapiens
caaaguauuugcug

SEQ ID NO: 400132 - RNA, 18 nt, Homo sapiens
caaagucugugugaugaa

SEQ ID NO: 400133 - RNA, 22 nt, Homo sapiens
caaagugaggggaaaccagggc

SEQ ID NO: 400134 - RNA, 15 nt, Homo sapiens
caaauaaaaacccaa

SEQ ID NO: 400135 - RNA, 20 nt, Homo sapiens
caaauaagaagggauggauu

SEQ ID NO: 400136 - RNA, 22 nt, Homo sapiens
caaaucuccaguauucuuguca

SEQ ID NO: 400137 - RNA, 22 nt, Homo sapiens
caaaucuucuugauccacuucu

SEQ ID NO: 400138 - RNA, 15 nt, Homo sapiens
caaaugacaaaaagc

SEQ ID NO: 400139 - RNA, 13 nt, Homo sapiens
caaaugcaauuuu

SEQ ID NO: 400140 - RNA, 16 nt, Homo sapiens
caaaugccacacauca

SEQ ID NO: 400141 - RNA, 14 nt, Homo sapiens
caaaugcccagcuu

SEQ ID NO: 400142 - RNA, 22 nt, Homo sapiens
caaaugucuagguccccacugc

SEQ ID NO: 400143 - RNA, 17 nt, Homo sapiens
caaauguucaucaauga

SEQ ID NO: 400144 - RNA, 14 nt, Homo sapiens
caaauguuguauaa

SEQ ID NO: 400145 - RNA, 19 nt, Homo sapiens
caacaaagccaacagucaa

SEQ ID NO: 400146 - RNA, 21 nt, Homo sapiens
caacaagauccuuaaugcaga

SEQ ID NO: 400147 - RNA, 20 nt, Homo sapiens
caacacaugucuagcuuuca

SEQ ID NO: 400148 - RNA, 23 nt, Homo sapiens
caacacgagcaggcuacugucag

SEQ ID NO: 400149 - RNA, 18 nt, Homo sapiens
caacagaagcuuccauuc

SEQ ID NO: 400150 - RNA, 16 nt, Homo sapiens
caacagauuauuaccu

SEQ ID NO: 400151 - RNA, 11 nt, Homo sapiens
caacagcacuu

SEQ ID NO: 400152 - RNA, 14 nt, Homo sapiens
caacaguuccuuca

SEQ ID NO: 400153 - RNA, 12 nt, Homo sapiens
caaccaauucca

SEQ ID NO: 400154 - RNA, 14 nt, Homo sapiens
caaccacaagcaca

SEQ ID NO: 400155 - RNA, 13 nt, Homo sapiens
caaccacaugcag

SEQ ID NO: 400156 - RNA, 20 nt, Homo sapiens
caacccaauaguuguugauu

SEQ ID NO: 400157 - RNA, 14 nt, Homo sapiens
caaccccaucaucc

SEQ ID NO: 400158 - RNA, 17 nt, Homo sapiens
caaccuaaccccuuucc

SEQ ID NO: 400159 - RNA, 21 nt, Homo sapiens
caaccugcucuccucuugcca

SEQ ID NO: 400160 - RNA, 23 nt, Homo sapiens
caaccuggucacaggacucugcc

SEQ ID NO: 400161 - RNA, 19 nt, Homo sapiens
caacguggggcagcacaga

SEQ ID NO: 400162 - RNA, 14 nt, Homo sapiens
caacuauuuuucca

SEQ ID NO: 400163 - RNA, 20 nt, Homo sapiens
caacucugagaucuaaggau

SEQ ID NO: 400164 - RNA, 20 nt, Homo sapiens
caacugaaaagacucagugu

SEQ ID NO: 400165 - RNA, 16 nt, Homo sapiens
caacuguggucaaucc

SEQ ID NO: 400166 - RNA, 20 nt, Homo sapiens
caacuugggaacuagacucc

SEQ ID NO: 400167 - RNA, 12 nt, Homo sapiens
caacuuucugua

SEQ ID NO: 400168 - RNA, 13 nt, Homo sapiens
caacuuucuguaa

SEQ ID NO: 400169 - RNA, 19 nt, Homo sapiens
caagaaaaguugaagaaga

SEQ ID NO: 400170 - RNA, 16 nt, Homo sapiens
caagacuugguguccu

SEQ ID NO: 400171 - RNA, 20 nt, Homo sapiens
caagauccgagucuacccag

SEQ ID NO: 400172 - RNA, 17 nt, Homo sapiens
caagauccuuaaugcag

SEQ ID NO: 400173 - RNA, 20 nt, Homo sapiens
caagaucgcgccacugcacu

SEQ ID NO: 400174 - RNA, 19 nt, Homo sapiens
caagcacagugccugcaug

SEQ ID NO: 400175 - RNA, 14 nt, Homo sapiens
caagccccugccca

SEQ ID NO: 400176 - RNA, 16 nt, Homo sapiens
caagcuggacuauggc

SEQ ID NO: 400177 - RNA, 18 nt, Homo sapiens
auaaagacaaaugcugcg

SEQ ID NO: 400178 - RNA, 21 nt, Homo sapiens
auaaaguaugguauugaaacu

SEQ ID NO: 400179 - RNA, 21 nt, Homo sapiens
auaaauaguuuaugauuccac

SEQ ID NO: 400180 - RNA, 13 nt, Homo sapiens
auaaaucauaaaa

SEQ ID NO: 400181 - RNA, 20 nt, Homo sapiens
auaaaugaaguauuucucac

SEQ ID NO: 400182 - RNA, 21 nt, Homo sapiens
auaaauuacuuuuucauucuu

SEQ ID NO: 400183 - RNA, 18 nt, Homo sapiens
auaaauugcuccuugaca

SEQ ID NO: 400184 - RNA, 18 nt, Homo sapiens
auaacaguuacuccagua

SEQ ID NO: 400185 - RNA, 15 nt, Homo sapiens
auaacuauguugaua

SEQ ID NO: 400186 - RNA, 12 nt, Homo sapiens
auaacugugaag

SEQ ID NO: 400187 - RNA, 13 nt, Homo sapiens
auaagacuacuau

SEQ ID NO: 400188 - RNA, 17 nt, Homo sapiens
auaagaggugcuacuga

SEQ ID NO: 400189 - RNA, 14 nt, Homo sapiens
auaaguuucacuga

SEQ ID NO: 400190 - RNA, 17 nt, Homo sapiens
auaauaaagaugcucuu

SEQ ID NO: 400191 - RNA, 15 nt, Homo sapiens
auaauaauugaucaa

SEQ ID NO: 400192 - RNA, 16 nt, Homo sapiens
auaauacaguaucuca

SEQ ID NO: 400193 - RNA, 13 nt, Homo sapiens
auaaucagugugu

SEQ ID NO: 400194 - RNA, 19 nt, Homo sapiens
auaauguuaacauggacau

SEQ ID NO: 400195 - RNA, 17 nt, Homo sapiens
auaauguuacauuauua

SEQ ID NO: 400196 - RNA, 16 nt, Homo sapiens
auaauucuacuuugag

SEQ ID NO: 400197 - RNA, 12 nt, Homo sapiens
auacacacucaa

SEQ ID NO: 400198 - RNA, 13 nt, Homo sapiens
auacaugcugcua

SEQ ID NO: 400199 - RNA, 18 nt, Homo sapiens
auacaugcugcuaauuca

SEQ ID NO: 400200 - RNA, 14 nt, Homo sapiens
auacguccaccaug

SEQ ID NO: 400201 - RNA, 18 nt, Homo sapiens
auacuaaaaaucaugaga

SEQ ID NO: 400202 - RNA, 14 nt, Homo sapiens
auacuacacauuca

SEQ ID NO: 400203 - RNA, 22 nt, Homo sapiens
auacucaggacuccucuccgca

SEQ ID NO: 400204 - RNA, 19 nt, Homo sapiens
auacugcucaucauuccuu

SEQ ID NO: 400205 - RNA, 19 nt, Homo sapiens
auacuucucuauuaucuca

SEQ ID NO: 400206 - RNA, 18 nt, Homo sapiens
auacuuuuuuucacaguu

SEQ ID NO: 400207 - RNA, 19 nt, Homo sapiens
auagaagaugggaaaacca

SEQ ID NO: 400208 - RNA, 18 nt, Homo sapiens
auagaagcaaaugacaaa

SEQ ID NO: 400209 - RNA, 14 nt, Homo sapiens
auagaauacaugga

SEQ ID NO: 400210 - RNA, 22 nt, Homo sapiens
auagaauacauggaaacgcaaa

SEQ ID NO: 400211 - RNA, 13 nt, Homo sapiens
auagagccugagg

SEQ ID NO: 400212 - RNA, 18 nt, Homo sapiens
auagcagauuguguaaca

SEQ ID NO: 400213 - RNA, 17 nt, Homo sapiens
auaguaugaaugcagug

SEQ ID NO: 400214 - RNA, 22 nt, Homo sapiens
auagucaaaccauaaacuucau

SEQ ID NO: 400215 - RNA, 11 nt, Homo sapiens
auagucuuuca

SEQ ID NO: 400216 - RNA, 19 nt, Homo sapiens
auaguuuuucauuguacca

SEQ ID NO: 400217 - RNA, 21 nt, Homo sapiens
auauaaaugugauugcagcuu

SEQ ID NO: 400218 - RNA, 15 nt, Homo sapiens
auauacaauaacaua

SEQ ID NO: 400219 - RNA, 17 nt, Homo sapiens
auauacaauaacauaau

SEQ ID NO: 400220 - RNA, 20 nt, Homo sapiens
auauacuauuuucauucucu

SEQ ID NO: 400221 - RNA, 16 nt, Homo sapiens
auauagguugugcaaa

SEQ ID NO: 400222 - RNA, 16 nt, Homo sapiens
auauauaaguguacau

SEQ ID NO: 400223 - RNA, 19 nt, Homo sapiens
auauauauuuuugugcaca

SEQ ID NO: 400224 - RNA, 16 nt, Homo sapiens
auauauuuauaacuca

SEQ ID NO: 400225 - RNA, 22 nt, Homo sapiens
auauauuuauuuaagcuuaugu

SEQ ID NO: 400226 - RNA, 20 nt, Homo sapiens
auauauuuuugugcacauuu

SEQ ID NO: 400227 - RNA, 13 nt, Homo sapiens
auaucaugaguga

SEQ ID NO: 400228 - RNA, 23 nt, Homo sapiens
auaucaugccccuguacuccagc

SEQ ID NO: 400229 - RNA, 22 nt, Homo sapiens
auaucauuuauuuuuuacauua

SEQ ID NO: 400230 - RNA, 18 nt, Homo sapiens
auauccccucccagucac

SEQ ID NO: 400231 - RNA, 13 nt, Homo sapiens
auaucgaucucuu

SEQ ID NO: 400232 - RNA, 16 nt, Homo sapiens
auaugaacggugagca

SEQ ID NO: 400233 - RNA, 16 nt, Homo sapiens
auaugauugugcacau

SEQ ID NO: 400234 - RNA, 12 nt, Homo sapiens
auauucauuuca

SEQ ID NO: 400235 - RNA, 18 nt, Homo sapiens
auauuccugcauuuguga

SEQ ID NO: 400236 - RNA, 14 nt, Homo sapiens
auauugacuuguau

SEQ ID NO: 400237 - RNA, 19 nt, Homo sapiens
auauugauaaaaccauaca

SEQ ID NO: 400238 - RNA, 19 nt, Homo sapiens
auauuuauggggggagaac

SEQ ID NO: 400239 - RNA, 20 nt, Homo sapiens
aucaaauaugcaaagcacug

SEQ ID NO: 400240 - RNA, 18 nt, Homo sapiens
aucaacaucuuggucaga

SEQ ID NO: 400241 - RNA, 17 nt, Homo sapiens
aucaagcccuuuacuug

SEQ ID NO: 400242 - RNA, 23 nt, Homo sapiens
aucacaaggcauucaaguguaca

SEQ ID NO: 400243 - RNA, 16 nt, Homo sapiens
aucacagccucugaaa

SEQ ID NO: 400244 - RNA, 19 nt, Homo sapiens
aucacauucgaguguuuca

SEQ ID NO: 400245 - RNA, 11 nt, Homo sapiens
aucaccagaca

SEQ ID NO: 400246 - RNA, 13 nt, Homo sapiens
aucacccagcuca

SEQ ID NO: 400247 - RNA, 14 nt, Homo sapiens
aucacccuuaccau

SEQ ID NO: 400248 - RNA, 23 nt, Homo sapiens
aucacuagccaugauaacugcaa

SEQ ID NO: 400249 - RNA, 16 nt, Homo sapiens
aucagagagcucacua

SEQ ID NO: 400250 - RNA, 16 nt, Homo sapiens
aucagcuuaggggcug

SEQ ID NO: 400251 - RNA, 17 nt, Homo sapiens
aucagugaagaugccag

SEQ ID NO: 400252 - RNA, 16 nt, Homo sapiens
aucauacaugacucag

SEQ ID NO: 400253 - RNA, 21 nt, Homo sapiens
aucauacaugacucagcauac

SEQ ID NO: 400254 - RNA, 23 nt, Homo sapiens
augguggagggccacaugggagg

SEQ ID NO: 400255 - RNA, 17 nt, Homo sapiens
auguaaacagugccugc

SEQ ID NO: 400256 - RNA, 20 nt, Homo sapiens
auguaaacauaauucuugua

SEQ ID NO: 400257 - RNA, 14 nt, Homo sapiens
auguaaacugugca

SEQ ID NO: 400258 - RNA, 13 nt, Homo sapiens
auguaaauacugu

SEQ ID NO: 400259 - RNA, 14 nt, Homo sapiens
auguaaaugugcau

SEQ ID NO: 400260 - RNA, 23 nt, Homo sapiens
auguaacauguaggaaguaggaa

SEQ ID NO: 400261 - RNA, 15 nt, Homo sapiens
auguaacgaauggua

SEQ ID NO: 400262 - RNA, 14 nt, Homo sapiens
auguaccagcagcu

SEQ ID NO: 400263 - RNA, 16 nt, Homo sapiens
auguaccccaauuuac

SEQ ID NO: 400264 - RNA, 18 nt, Homo sapiens
auguaggguaaggugccu

SEQ ID NO: 400265 - RNA, 14 nt, Homo sapiens
auguauguauuuau

SEQ ID NO: 400266 - RNA, 18 nt, Homo sapiens
auguauguuuacauauca

SEQ ID NO: 400267 - RNA, 20 nt, Homo sapiens
auguauuuguuugcaauuuu

SEQ ID NO: 400268 - RNA, 16 nt, Homo sapiens
augucaacagagcaag

SEQ ID NO: 400269 - RNA, 13 nt, Homo sapiens
augucaccaccuu

SEQ ID NO: 400270 - RNA, 19 nt, Homo sapiens
augucaguuccaaugaggu

SEQ ID NO: 400271 - RNA, 17 nt, Homo sapiens
augugaccugugucacu

SEQ ID NO: 400272 - RNA, 12 nt, Homo sapiens
augugagugugu

SEQ ID NO: 400273 - RNA, 22 nt, Homo sapiens
augugauaaaaccccaucucua

SEQ ID NO: 400274 - RNA, 11 nt, Homo sapiens
augugaugaau

SEQ ID NO: 400275 - RNA, 17 nt, Homo sapiens
augugcaaguguaugca

SEQ ID NO: 400276 - RNA, 21 nt, Homo sapiens
augugcucagggaauaaucca

SEQ ID NO: 400277 - RNA, 22 nt, Homo sapiens
auguggccuaaaaaugcaacuu

SEQ ID NO: 400278 - RNA, 12 nt, Homo sapiens
augugugauuca

SEQ ID NO: 400279 - RNA, 17 nt, Homo sapiens
augugugugcaagugug

SEQ ID NO: 400280 - RNA, 16 nt, Homo sapiens
auguguuaagugcagg

SEQ ID NO: 400281 - RNA, 16 nt, Homo sapiens
auguguuuuuuuacau

SEQ ID NO: 400282 - RNA, 19 nt, Homo sapiens
auguuaggaaaauuucaca

SEQ ID NO: 400283 - RNA, 23 nt, Homo sapiens
auguuaggaaaauuucacauuaa

SEQ ID NO: 400284 - RNA, 14 nt, Homo sapiens
auguucagcacugu

SEQ ID NO: 400285 - RNA, 22 nt, Homo sapiens
auguugcacacccacucagcuc

SEQ ID NO: 400286 - RNA, 16 nt, Homo sapiens
auguugcccagugugu

SEQ ID NO: 400287 - RNA, 21 nt, Homo sapiens
auguugugauguauucuagcu

SEQ ID NO: 400288 - RNA, 17 nt, Homo sapiens
auguuugucucauccca

SEQ ID NO: 400289 - RNA, 16 nt, Homo sapiens
auuaaccacuucagcu

SEQ ID NO: 400290 - RNA, 19 nt, Homo sapiens
auuaauuccaacuguacuu

SEQ ID NO: 400291 - RNA, 18 nt, Homo sapiens
auuacauggggucuagaa

SEQ ID NO: 400292 - RNA, 21 nt, Homo sapiens
auuacccccucauuguuuauu

SEQ ID NO: 400293 - RNA, 16 nt, Homo sapiens
auuaccuaguagucau

SEQ ID NO: 400294 - RNA, 19 nt, Homo sapiens
auuaccuaguagucauuuc

SEQ ID NO: 400295 - RNA, 16 nt, Homo sapiens
auuaccuccugagaaa

SEQ ID NO: 400296 - RNA, 14 nt, Homo sapiens
auuaccuugugcua

SEQ ID NO: 400297 - RNA, 18 nt, Homo sapiens
auuagccgggcauggugg

SEQ ID NO: 400298 - RNA, 12 nt, Homo sapiens
auuauaacuuaa

SEQ ID NO: 400299 - RNA, 23 nt, Homo sapiens
auuaucucaaaacugcacuguca

SEQ ID NO: 400300 - RNA, 22 nt, Homo sapiens
auuaugaagugacucucacaag

SEQ ID NO: 400301 - RNA, 20 nt, Homo sapiens
auuaugggcgugaaccacca

SEQ ID NO: 400302 - RNA, 18 nt, Homo sapiens
auuauuauucuucauaac

SEQ ID NO: 400303 - RNA, 23 nt, Homo sapiens
auucaaaagcacuuugugcugug

SEQ ID NO: 400304 - RNA, 12 nt, Homo sapiens
auucacaaugaa

SEQ ID NO: 400305 - RNA, 13 nt, Homo sapiens
auucacaguguga

SEQ ID NO: 400306 - RNA, 16 nt, Homo sapiens
auucacuugcauuucu

SEQ ID NO: 400307 - RNA, 16 nt, Homo sapiens
auucagccaggagaug

SEQ ID NO: 400308 - RNA, 14 nt, Homo sapiens
auucauguggaaua

SEQ ID NO: 400309 - RNA, 23 nt, Homo sapiens
auucauuuuucuuucugauguca

SEQ ID NO: 400310 - RNA, 17 nt, Homo sapiens
auuccaccugcaaucaa

SEQ ID NO: 400311 - RNA, 16 nt, Homo sapiens
auuccaggcgaugugc

SEQ ID NO: 400312 - RNA, 16 nt, Homo sapiens
auuccccacccugaaa

SEQ ID NO: 400313 - RNA, 13 nt, Homo sapiens
auuccugauaaua

SEQ ID NO: 400314 - RNA, 12 nt, Homo sapiens
auucgugcagca

SEQ ID NO: 400315 - RNA, 20 nt, Homo sapiens
auucuaaaugaauguuuaca

SEQ ID NO: 400316 - RNA, 16 nt, Homo sapiens
auucuaacaagucaua

SEQ ID NO: 400317 - RNA, 13 nt, Homo sapiens
auucuaagugaaa

SEQ ID NO: 400318 - RNA, 20 nt, Homo sapiens
auucuaccgugguacacagu

SEQ ID NO: 400319 - RNA, 13 nt, Homo sapiens
auucuagagucuc

SEQ ID NO: 400320 - RNA, 17 nt, Homo sapiens
auucucacacacauaca

SEQ ID NO: 400321 - RNA, 22 nt, Homo sapiens
auucucacacacauacauaccu

SEQ ID NO: 400322 - RNA, 17 nt, Homo sapiens
auucuggaaaagcaaaa

SEQ ID NO: 400323 - RNA, 16 nt, Homo sapiens
auucugucaaugucuu

SEQ ID NO: 400324 - RNA, 19 nt, Homo sapiens
auucuucaaccucauugac

SEQ ID NO: 400325 - RNA, 17 nt, Homo sapiens
auugaaagcuuuuguua

SEQ ID NO: 400326 - RNA, 15 nt, Homo sapiens
auugaauuagaaaca

SEQ ID NO: 400327 - RNA, 18 nt, Homo sapiens
auugacgacaagugcuga

SEQ ID NO: 400328 - RNA, 14 nt, Homo sapiens
auugagcaaagggg

SEQ ID NO: 400329 - RNA, 21 nt, Homo sapiens
auugcacgggagaauauacaa

SEQ ID NO: 400330 - RNA, 13 nt, Homo sapiens
auugcuuugguca

SEQ ID NO: 400331 - RNA, 14 nt, Homo sapiens
cagacuggugggau

SEQ ID NO: 400332 - RNA, 17 nt, Homo sapiens
cagacuucacacugcaa

SEQ ID NO: 400333 - RNA, 14 nt, Homo sapiens
cagagacaccugca

SEQ ID NO: 400334 - RNA, 16 nt, Homo sapiens
cagagacaggaaaauc

SEQ ID NO: 400335 - RNA, 15 nt, Homo sapiens
cagagagcaacucug

SEQ ID NO: 400336 - RNA, 16 nt, Homo sapiens
cagagagcaacucuga

SEQ ID NO: 400337 - RNA, 21 nt, Homo sapiens
cagagagcagcuuuaaacuca

SEQ ID NO: 400338 - RNA, 19 nt, Homo sapiens
cagagauaauucuagcuuu

SEQ ID NO: 400339 - RNA, 21 nt, Homo sapiens
cagagauaauucuagcuuuga

SEQ ID NO: 400340 - RNA, 13 nt, Homo sapiens
cagagcagggugu

SEQ ID NO: 400341 - RNA, 15 nt, Homo sapiens
cagagcccaagggaa

SEQ ID NO: 400342 - RNA, 13 nt, Homo sapiens
cagagcccagcuc

SEQ ID NO: 400343 - RNA, 20 nt, Homo sapiens
cagaggagggcgugacucac

SEQ ID NO: 400344 - RNA, 15 nt, Homo sapiens
cagaguucugcucua

SEQ ID NO: 400345 - RNA, 15 nt, Homo sapiens
cagauaaacaacaaa

SEQ ID NO: 400346 - RNA, 14 nt, Homo sapiens
cagauaacucuccu

SEQ ID NO: 400347 - RNA, 12 nt, Homo sapiens
cagauacuuggg

SEQ ID NO: 400348 - RNA, 14 nt, Homo sapiens
cagaucaaauuuca

SEQ ID NO: 400349 - RNA, 15 nt, Homo sapiens
cagaucaauuuguaa

SEQ ID NO: 400350 - RNA, 18 nt, Homo sapiens
cagaucccacuugcagcc

SEQ ID NO: 400351 - RNA, 14 nt, Homo sapiens
cagaucccagcuca

SEQ ID NO: 400352 - RNA, 14 nt, Homo sapiens
cagaugaaugggag

SEQ ID NO: 400353 - RNA, 22 nt, Homo sapiens
cagaugacaaaaauucaacuca

SEQ ID NO: 400354 - RNA, 20 nt, Homo sapiens
cagauggaaugcuguguuaa

SEQ ID NO: 400355 - RNA, 17 nt, Homo sapiens
cagauggcaauuucacu

SEQ ID NO: 400356 - RNA, 12 nt, Homo sapiens
cagaugugguaa

SEQ ID NO: 400357 - RNA, 13 nt, Homo sapiens
cagaugugugauu

SEQ ID NO: 400358 - RNA, 18 nt, Homo sapiens
cagauuauuuuuccucug

SEQ ID NO: 400359 - RNA, 18 nt, Homo sapiens
cagauucuucucucucaa

SEQ ID NO: 400360 - RNA, 18 nt, Homo sapiens
cagcaaugacaucucagg

SEQ ID NO: 400361 - RNA, 15 nt, Homo sapiens
cagcacccaugggaa

SEQ ID NO: 400362 - RNA, 15 nt, Homo sapiens
cagcacccugcaaaa

SEQ ID NO: 400363 - RNA, 14 nt, Homo sapiens
cagcacgugcagcc

SEQ ID NO: 400364 - RNA, 21 nt, Homo sapiens
cagcacuaaagcaguggacac

SEQ ID NO: 400365 - RNA, 17 nt, Homo sapiens
cagcagaucccagcuca

SEQ ID NO: 400366 - RNA, 18 nt, Homo sapiens
cagcagaucccagcucac

SEQ ID NO: 400367 - RNA, 20 nt, Homo sapiens
cagcagccagcucucagcca

SEQ ID NO: 400368 - RNA, 17 nt, Homo sapiens
cagccaaaaaggacuuu

SEQ ID NO: 400369 - RNA, 15 nt, Homo sapiens
cagccaacuuuugca

SEQ ID NO: 400370 - RNA, 20 nt, Homo sapiens
cagccaagagggcugcaaaa

SEQ ID NO: 400371 - RNA, 20 nt, Homo sapiens
cagccaagccagucaaggau

SEQ ID NO: 400372 - RNA, 11 nt, Homo sapiens
cagcccauucu

SEQ ID NO: 400373 - RNA, 15 nt, Homo sapiens
cagccgauucaccug

SEQ ID NO: 400374 - RNA, 13 nt, Homo sapiens
cagccucaagucu

SEQ ID NO: 400375 - RNA, 15 nt, Homo sapiens
cagccucaguccucc

SEQ ID NO: 400376 - RNA, 16 nt, Homo sapiens
cagccuccuccugacc

SEQ ID NO: 400377 - RNA, 19 nt, Homo sapiens
cagccugggugacagagca

SEQ ID NO: 400378 - RNA, 18 nt, Homo sapiens
cagccugucccauggaca

SEQ ID NO: 400379 - RNA, 23 nt, Homo sapiens
cagccugucccauggacacucca

SEQ ID NO: 400380 - RNA, 17 nt, Homo sapiens
cagcgaaaggauguaaa

SEQ ID NO: 400381 - RNA, 15 nt, Homo sapiens
cagcuauaccugugc

SEQ ID NO: 400382 - RNA, 15 nt, Homo sapiens
cagcuaucucucagu

SEQ ID NO: 400383 - RNA, 15 nt, Homo sapiens
cagcucaaaggcaca

SEQ ID NO: 400384 - RNA, 17 nt, Homo sapiens
cagcucagcgccagccu

SEQ ID NO: 400385 - RNA, 19 nt, Homo sapiens
cagcucgggcccucuguga

SEQ ID NO: 400386 - RNA, 19 nt, Homo sapiens
cagcuggaagggucaacau

SEQ ID NO: 400387 - RNA, 23 nt, Homo sapiens
cagcuggaguucaugucgcaaca

SEQ ID NO: 400388 - RNA, 14 nt, Homo sapiens
caggaaaucaugag

SEQ ID NO: 400389 - RNA, 23 nt, Homo sapiens
caggaaccucagggcugugugua

SEQ ID NO: 400390 - RNA, 20 nt, Homo sapiens
caggaagagcuguguggccu

SEQ ID NO: 400391 - RNA, 14 nt, Homo sapiens
caggagacauuggu

SEQ ID NO: 400392 - RNA, 18 nt, Homo sapiens
caggaggcggcagugcaa

SEQ ID NO: 400393 - RNA, 21 nt, Homo sapiens
caggagggguuaaagcugccg

SEQ ID NO: 400394 - RNA, 21 nt, Homo sapiens
caggagguugagguaggagaa

SEQ ID NO: 400395 - RNA, 18 nt, Homo sapiens
caggaguuggaagugugu

SEQ ID NO: 400396 - RNA, 13 nt, Homo sapiens
caggauauugaca

SEQ ID NO: 400397 - RNA, 21 nt, Homo sapiens
aagaguucuuaaggauuguga

SEQ ID NO: 400398 - RNA, 15 nt, Homo sapiens
aagauagcagggcau

SEQ ID NO: 400399 - RNA, 14 nt, Homo sapiens
aagauaguaacaau

SEQ ID NO: 400400 - RNA, 20 nt, Homo sapiens
aagaucgcgccacugcacuc

SEQ ID NO: 400401 - RNA, 16 nt, Homo sapiens
aagaugaugaugaucu

SEQ ID NO: 400402 - RNA, 17 nt, Homo sapiens
aagaugaugaugaucuu

SEQ ID NO: 400403 - RNA, 21 nt, Homo sapiens
aagauggaagcuuccagucca

SEQ ID NO: 400404 - RNA, 21 nt, Homo sapiens
aagauggcugugccucugccu

SEQ ID NO: 400405 - RNA, 22 nt, Homo sapiens
aagauguagaggagaaacugga

SEQ ID NO: 400406 - RNA, 22 nt, Homo sapiens
aagauguguugcuauccugaaa

SEQ ID NO: 400407 - RNA, 15 nt, Homo sapiens
aagcaaggcuuuaaa

SEQ ID NO: 400408 - RNA, 18 nt, Homo sapiens
aagcaaggcuuuaaauga

SEQ ID NO: 400409 - RNA, 13 nt, Homo sapiens
aagcacagcaccc

SEQ ID NO: 400410 - RNA, 13 nt, Homo sapiens
aagcacagugccu

SEQ ID NO: 400411 - RNA, 13 nt, Homo sapiens
aagcacaucugca

SEQ ID NO: 400412 - RNA, 23 nt, Homo sapiens
aagcaccuagccucgcucuuggc

SEQ ID NO: 400413 - RNA, 12 nt, Homo sapiens
aagcacuuugug

SEQ ID NO: 400414 - RNA, 16 nt, Homo sapiens
aagcacuuugugcugu

SEQ ID NO: 400415 - RNA, 15 nt, Homo sapiens
aagcagaacagugau

SEQ ID NO: 400416 - RNA, 16 nt, Homo sapiens
aagcagccaagcuccu

SEQ ID NO: 400417 - RNA, 18 nt, Homo sapiens
aagcagccaagcuccuug

SEQ ID NO: 400418 - RNA, 20 nt, Homo sapiens
aagcaggaaaugaaaauguc

SEQ ID NO: 400419 - RNA, 20 nt, Homo sapiens
aagcaucauuauuugcagag

SEQ ID NO: 400420 - RNA, 15 nt, Homo sapiens
aagcccaauauuaua

SEQ ID NO: 400421 - RNA, 18 nt, Homo sapiens
aagcccuccccaucccau

SEQ ID NO: 400422 - RNA, 14 nt, Homo sapiens
aagcccucuuccau

SEQ ID NO: 400423 - RNA, 19 nt, Homo sapiens
aagccuagcccuucucuca

SEQ ID NO: 400424 - RNA, 18 nt, Homo sapiens
aagccuauguaugccaug

SEQ ID NO: 400425 - RNA, 21 nt, Homo sapiens
aagccucagagaauugcugau

SEQ ID NO: 400426 - RNA, 22 nt, Homo sapiens
aagccugcagucaucuugacca

SEQ ID NO: 400427 - RNA, 14 nt, Homo sapiens
aagcuccacuguca

SEQ ID NO: 400428 - RNA, 16 nt, Homo sapiens
aagcuccacugucacc

SEQ ID NO: 400429 - RNA, 17 nt, Homo sapiens
aagcucuauuaagauuu

SEQ ID NO: 400430 - RNA, 22 nt, Homo sapiens
aagcucuggugacaccagccuu

SEQ ID NO: 400431 - RNA, 20 nt, Homo sapiens
aagcugaugacaacuuccca

SEQ ID NO: 400432 - RNA, 16 nt, Homo sapiens
aagcugggagcacagg

SEQ ID NO: 400433 - RNA, 22 nt, Homo sapiens
aagcugggagcacaggcacugc

SEQ ID NO: 400434 - RNA, 15 nt, Homo sapiens
aagcugugacuucuc

SEQ ID NO: 400435 - RNA, 12 nt, Homo sapiens
aagcuuauguca

SEQ ID NO: 400436 - RNA, 19 nt, Homo sapiens
aagcuuccaguccaaucuc

SEQ ID NO: 400437 - RNA, 21 nt, Homo sapiens
aagcuuccaguccaaucucau

SEQ ID NO: 400438 - RNA, 22 nt, Homo sapiens
aagcuuccauuccaagccugac

SEQ ID NO: 400439 - RNA, 12 nt, Homo sapiens
aaggaaagugau

SEQ ID NO: 400440 - RNA, 12 nt, Homo sapiens
aaggaagcucca

SEQ ID NO: 400441 - RNA, 18 nt, Homo sapiens
aaggaagcuccacuguca

SEQ ID NO: 400442 - RNA, 23 nt, Homo sapiens
aaggagacucaccucugccucaa

SEQ ID NO: 400443 - RNA, 24 nt, Homo sapiens
aaggagccaauugauuucaacaga

SEQ ID NO: 400444 - RNA, 23 nt, Homo sapiens
aaggauggagccagcucugcauu

SEQ ID NO: 400445 - RNA, 15 nt, Homo sapiens
aaggauggaugcaga

SEQ ID NO: 400446 - RNA, 17 nt, Homo sapiens
aaggaugggaaggaggg

SEQ ID NO: 400447 - RNA, 19 nt, Homo sapiens
aaggaugucacagggccaa

SEQ ID NO: 400448 - RNA, 14 nt, Homo sapiens
aaggcacagugaag

SEQ ID NO: 400449 - RNA, 17 nt, Homo sapiens
aaggcaccugaaugugu

SEQ ID NO: 400450 - RNA, 17 nt, Homo sapiens
aaggccgagaagcaaga

SEQ ID NO: 400451 - RNA, 23 nt, Homo sapiens
aaggccucccugucuaaaauccc

SEQ ID NO: 400452 - RNA, 13 nt, Homo sapiens
aaggccucugugg

SEQ ID NO: 400453 - RNA, 17 nt, Homo sapiens
aaggcuagaucaugaag

SEQ ID NO: 400454 - RNA, 22 nt, Homo sapiens
aaggcucugagcaaauguggcu

SEQ ID NO: 400455 - RNA, 18 nt, Homo sapiens
aaggcuggcagugacaga

SEQ ID NO: 400456 - RNA, 20 nt, Homo sapiens
aagggaauucggugugcacc

SEQ ID NO: 400457 - RNA, 17 nt, Homo sapiens
aagggacauauucauuu

SEQ ID NO: 400458 - RNA, 18 nt, Homo sapiens
aagggcucacgcauucag

SEQ ID NO: 400459 - RNA, 23 nt, Homo sapiens
aaggguaccuugaacacuggggg

SEQ ID NO: 400460 - RNA, 22 nt, Homo sapiens
aagguucucagguguugccaaa

SEQ ID NO: 400461 - RNA, 13 nt, Homo sapiens
aaguaaaaccaca

SEQ ID NO: 400462 - RNA, 16 nt, Homo sapiens
aaguagaauccuaaau

SEQ ID NO: 400463 - RNA, 23 nt, Homo sapiens
aaguagacuucauuuuuccuaac

SEQ ID NO: 400464 - RNA, 12 nt, Homo sapiens
aaguagcaauuu

SEQ ID NO: 400465 - RNA, 18 nt, Homo sapiens
aaguagggacuucugucu

SEQ ID NO: 400466 - RNA, 19 nt, Homo sapiens
aaguauccuucagccugaa

SEQ ID NO: 400467 - RNA, 16 nt, Homo sapiens
aaguaugagggaaaau

SEQ ID NO: 400468 - RNA, 12 nt, Homo sapiens
aaguauuagcca

SEQ ID NO: 400469 - RNA, 18 nt, Homo sapiens
aaguauuauuuauuugaa

SEQ ID NO: 400470 - RNA, 19 nt, Homo sapiens
aaguauugcaucuguauaa

SEQ ID NO: 400471 - RNA, 13 nt, Homo sapiens
aagucacugcaca

SEQ ID NO: 400472 - RNA, 17 nt, Homo sapiens
aaguccuuucuaaguau

SEQ ID NO: 400473 - RNA, 17 nt, Homo sapiens
aagucuuauuuccucaa

SEQ ID NO: 400474 - RNA, 18 nt, Homo sapiens
aagucuuugaagugacuu

SEQ ID NO: 400475 - RNA, 23 nt, Homo sapiens
aagugaagaaaagugaaugcuca

SEQ ID NO: 400476 - RNA, 13 nt, Homo sapiens
aagugacucucac

SEQ ID NO: 400477 - RNA, 15 nt, Homo sapiens
aagugacuucacaga

SEQ ID NO: 400478 - RNA, 19 nt, Homo sapiens
aagugagacccugucucaa

SEQ ID NO: 400479 - RNA, 22 nt, Homo sapiens
aagugagacccugucucaaaaa

SEQ ID NO: 400480 - RNA, 20 nt, Homo sapiens
aagugcugcgauuacaggca

SEQ ID NO: 400481 - RNA, 13 nt, Homo sapiens
aagugggugaaug

SEQ ID NO: 400482 - RNA, 21 nt, Homo sapiens
aaguggugagaacuacucagg

SEQ ID NO: 400483 - RNA, 14 nt, Homo sapiens
aaguggugcuccaa

SEQ ID NO: 400484 - RNA, 22 nt, Homo sapiens
aaguguaagaaacacacugagg

SEQ ID NO: 400485 - RNA, 14 nt, Homo sapiens
aaguguacauaugu

SEQ ID NO: 400486 - RNA, 21 nt, Homo sapiens
aaguguccccuauggggaugg

SEQ ID NO: 400487 - RNA, 21 nt, Homo sapiens
aagugucugugugcaagugug

SEQ ID NO: 400488 - RNA, 13 nt, Homo sapiens
aagugugugcaug

SEQ ID NO: 400489 - RNA, 13 nt, Homo sapiens
aaguguguuuccu

SEQ ID NO: 400490 - RNA, 11 nt, Homo sapiens
aaguguuccag

SEQ ID NO: 400491 - RNA, 14 nt, Homo sapiens
aaguuacuucacuu

SEQ ID NO: 400492 - RNA, 15 nt, Homo sapiens
aauaaaugucuugcc

SEQ ID NO: 400493 - RNA, 16 nt, Homo sapiens
aauaaaugucuugccu

SEQ ID NO: 400494 - RNA, 16 nt, Homo sapiens
aauaaaugugccuuca

SEQ ID NO: 400495 - RNA, 13 nt, Homo sapiens
aauaaccaauccu

SEQ ID NO: 400496 - RNA, 13 nt, Homo sapiens
aauaacugugaag

SEQ ID NO: 400497 - RNA, 17 nt, Homo sapiens
aauaacuuauaucauca

SEQ ID NO: 400498 - RNA, 15 nt, Homo sapiens
aauaaguacugugua

SEQ ID NO: 400499 - RNA, 19 nt, Homo sapiens
aauaaguacuguguacaga

SEQ ID NO: 400500 - RNA, 20 nt, Homo sapiens
aauaauaagaggugcuacug

SEQ ID NO: 400501 - RNA, 12 nt, Homo sapiens
aauaauaugcau

SEQ ID NO: 400502 - RNA, 21 nt, Homo sapiens
aauaaugaguuagaacuauua

SEQ ID NO: 400503 - RNA, 14 nt, Homo sapiens
aauaauguacaucu

SEQ ID NO: 400504 - RNA, 14 nt, Homo sapiens
aauacacacaagua

SEQ ID NO: 400505 - RNA, 17 nt, Homo sapiens
aauacacacucaaauca

SEQ ID NO: 400506 - RNA, 24 nt, Homo sapiens
aauacagcagugucaucagaagau

SEQ ID NO: 400507 - RNA, 14 nt, Homo sapiens
aauacaguaucuca

SEQ ID NO: 400508 - RNA, 17 nt, Homo sapiens
aauacaguaucucaggg

SEQ ID NO: 400509 - RNA, 20 nt, Homo sapiens
aauacagucuuccauuugca

SEQ ID NO: 400510 - RNA, 21 nt, Homo sapiens
aauacagucuuccauuugcaa

SEQ ID NO: 400511 - RNA, 15 nt, Homo sapiens
aauacauauuuccaa

SEQ ID NO: 400512 - RNA, 14 nt, Homo sapiens
aauacuccuaagac

SEQ ID NO: 400513 - RNA, 20 nt, Homo sapiens
aauagcaaccuuuuuaucuc

SEQ ID NO: 400514 - RNA, 13 nt, Homo sapiens
aauagccaaucau

SEQ ID NO: 400515 - RNA, 18 nt, Homo sapiens
aauaguuuugauccuaaa

SEQ ID NO: 400516 - RNA, 14 nt, Homo sapiens
aauauaacugccuu

SEQ ID NO: 400517 - RNA, 16 nt, Homo sapiens
aauauagcuguacaaa

SEQ ID NO: 400518 - RNA, 22 nt, Homo sapiens
aauaucccuacauguauugcac

SEQ ID NO: 400519 - RNA, 16 nt, Homo sapiens
aauauuaacauaagaa

SEQ ID NO: 400520 - RNA, 15 nt, Homo sapiens
aauauugucauuccu

SEQ ID NO: 400521 - RNA, 18 nt, Homo sapiens
aauauuuaaacagcagug

SEQ ID NO: 400522 - RNA, 20 nt, Homo sapiens
aauauuuaagacacugaaaa

SEQ ID NO: 400523 - RNA, 14 nt, Homo sapiens
aauauuuaccagac

SEQ ID NO: 400524 - RNA, 15 nt, Homo sapiens
aauauuuauuuaacu

SEQ ID NO: 400525 - RNA, 13 nt, Homo sapiens
aaucaaauagcau

SEQ ID NO: 400526 - RNA, 20 nt, Homo sapiens
aaucacacagccaagccagu

SEQ ID NO: 400527 - RNA, 23 nt, Homo sapiens
aaucacacgucuggcuucacaga

SEQ ID NO: 400528 - RNA, 22 nt, Homo sapiens
aaucacacugaggaacucacaa

SEQ ID NO: 400529 - RNA, 19 nt, Homo sapiens
ugggguucgagacuccauc

SEQ ID NO: 400530 - RNA, 18 nt, Homo sapiens
ugggucuucagggggcca

SEQ ID NO: 400531 - RNA, 19 nt, Homo sapiens
ugggucuucagggggccag

SEQ ID NO: 400532 - RNA, 21 nt, Homo sapiens
ugggucuucccuguaugauuc

SEQ ID NO: 400533 - RNA, 14 nt, Homo sapiens
ugggugaagacaga

SEQ ID NO: 400534 - RNA, 15 nt, Homo sapiens
ugggugauuucuaga

SEQ ID NO: 400535 - RNA, 22 nt, Homo sapiens
ugggugggcaggaaaaggugau

SEQ ID NO: 400536 - RNA, 18 nt, Homo sapiens
ugggugucagucagggac

SEQ ID NO: 400537 - RNA, 14 nt, Homo sapiens
ugggugucugcuaa

SEQ ID NO: 400538 - RNA, 21 nt, Homo sapiens
uggguguuucaguuugaaaau

SEQ ID NO: 400539 - RNA, 14 nt, Homo sapiens
ugguaaaauacuuc

SEQ ID NO: 400540 - RNA, 19 nt, Homo sapiens
ugguaaagccucagcaaca

SEQ ID NO: 400541 - RNA, 15 nt, Homo sapiens
ugguaaccuguggug

SEQ ID NO: 400542 - RNA, 16 nt, Homo sapiens
ugguaacugcacacau

SEQ ID NO: 400543 - RNA, 16 nt, Homo sapiens
ugguaaggaggacaau

SEQ ID NO: 400544 - RNA, 24 nt, Homo sapiens
ugguacaucgaggcucuugcucaa

SEQ ID NO: 400545 - RNA, 19 nt, Homo sapiens
ugguaccagaggaugguga

SEQ ID NO: 400546 - RNA, 18 nt, Homo sapiens
ugguacguggguacccag

SEQ ID NO: 400547 - RNA, 23 nt, Homo sapiens
ugguagaaauacccaacgcacaa

SEQ ID NO: 400548 - RNA, 14 nt, Homo sapiens
ugguagacugugac

SEQ ID NO: 400549 - RNA, 17 nt, Homo sapiens
ugguagcucuuguugcu

SEQ ID NO: 400550 - RNA, 15 nt, Homo sapiens
ugguauaauaaagua

SEQ ID NO: 400551 - RNA, 18 nt, Homo sapiens
ugguauuauauaauucaa

SEQ ID NO: 400552 - RNA, 15 nt, Homo sapiens
uggucaacacuuaag

SEQ ID NO: 400553 - RNA, 19 nt, Homo sapiens
uggucacgacuucuucgga

SEQ ID NO: 400554 - RNA, 18 nt, Homo sapiens
ugguccaaauucuuuauu

SEQ ID NO: 400555 - RNA, 11 nt, Homo sapiens
ugguccagaau

SEQ ID NO: 400556 - RNA, 11 nt, Homo sapiens
ugguccagauu

SEQ ID NO: 400557 - RNA, 13 nt, Homo sapiens
ugguccauuccau

SEQ ID NO: 400558 - RNA, 21 nt, Homo sapiens
uggucccaggaagcagggaga

SEQ ID NO: 400559 - RNA, 19 nt, Homo sapiens
ugguccuggggaccauuca

SEQ ID NO: 400560 - RNA, 23 nt, Homo sapiens
uggucucaaacccccagccucaa

SEQ ID NO: 400561 - RNA, 22 nt, Homo sapiens
uggucucaaacuccugaccuca

SEQ ID NO: 400562 - RNA, 19 nt, Homo sapiens
uggucuccucugauuauca

SEQ ID NO: 400563 - RNA, 17 nt, Homo sapiens
uggucucgaacuccuga

SEQ ID NO: 400564 - RNA, 22 nt, Homo sapiens
uggucugacuccuugggguccu

SEQ ID NO: 400565 - RNA, 15 nt, Homo sapiens
uggucugagccaaag

SEQ ID NO: 400566 - RNA, 17 nt, Homo sapiens
uggucuugaucuccuga

SEQ ID NO: 400567 - RNA, 16 nt, Homo sapiens
uggugaccaaugcauu

SEQ ID NO: 400568 - RNA, 14 nt, Homo sapiens
uggugauccucuau

SEQ ID NO: 400569 - RNA, 17 nt, Homo sapiens
uggugccaaacaaaaag

SEQ ID NO: 400570 - RNA, 12 nt, Homo sapiens
uggugcugagaa

SEQ ID NO: 400571 - RNA, 19 nt, Homo sapiens
uggugcugcgcccagggag

SEQ ID NO: 400572 - RNA, 19 nt, Homo sapiens
uggugcugcuuucuuguug

SEQ ID NO: 400573 - RNA, 16 nt, Homo sapiens
ugguggacaugcacag

SEQ ID NO: 400574 - RNA, 19 nt, Homo sapiens
ugguggcagauuuuacaaa

SEQ ID NO: 400575 - RNA, 18 nt, Homo sapiens
uggugguuaugucccaug

SEQ ID NO: 400576 - RNA, 22 nt, Homo sapiens
ugguguaaagccaacacccugu

SEQ ID NO: 400577 - RNA, 14 nt, Homo sapiens
ugguuacaguuuga

SEQ ID NO: 400578 - RNA, 21 nt, Homo sapiens
ugguuacaugaaugaaugaac

SEQ ID NO: 400579 - RNA, 15 nt, Homo sapiens
ugguuaguagacacu

SEQ ID NO: 400580 - RNA, 17 nt, Homo sapiens
ugguuauccugugcuac

SEQ ID NO: 400581 - RNA, 22 nt, Homo sapiens
ugguuauggccgaaaaggauau

SEQ ID NO: 400582 - RNA, 16 nt, Homo sapiens
ugguucaccuguguac

SEQ ID NO: 400583 - RNA, 24 nt, Homo sapiens
ugguuccagaacgucucucaccua

SEQ ID NO: 400584 - RNA, 23 nt, Homo sapiens
ugguuccggaauccuguccucag

SEQ ID NO: 400585 - RNA, 23 nt, Homo sapiens
ugguucuuuuaccccacgaagac

SEQ ID NO: 400586 - RNA, 14 nt, Homo sapiens
ugguugacauugua

SEQ ID NO: 400587 - RNA, 15 nt, Homo sapiens
ugguuuauaaucuga

SEQ ID NO: 400588 - RNA, 14 nt, Homo sapiens
ugguuuuaccccag

SEQ ID NO: 400589 - RNA, 19 nt, Homo sapiens
ugguuuuaccccagcucca

SEQ ID NO: 400590 - RNA, 21 nt, Homo sapiens
ugguuuuaccuguagacugug

SEQ ID NO: 400591 - RNA, 12 nt, Homo sapiens
ugguuuuacuac

SEQ ID NO: 400592 - RNA, 14 nt, Homo sapiens
ugguuuuccucaau

SEQ ID NO: 400593 - RNA, 17 nt, Homo sapiens
ugguuuucuuuugccau

SEQ ID NO: 400594 - RNA, 17 nt, Homo sapiens
ugguuuuuguugagucu

SEQ ID NO: 400595 - RNA, 22 nt, Homo sapiens
uguaaaacugugacauuccaca

SEQ ID NO: 400596 - RNA, 19 nt, Homo sapiens
uguaaaauacuauuggaca

SEQ ID NO: 400597 - RNA, 22 nt, Homo sapiens
uguaaaauauuuauucaucugc

SEQ ID NO: 400598 - RNA, 22 nt, Homo sapiens
uguaaaauuagaggauugcacu

SEQ ID NO: 400599 - RNA, 22 nt, Homo sapiens
uguaaaccacuugucacuacaa

SEQ ID NO: 400600 - RNA, 19 nt, Homo sapiens
uguaaacguuucaguaaua

SEQ ID NO: 400601 - RNA, 14 nt, Homo sapiens
uguaaacuaguacu

SEQ ID NO: 400602 - RNA, 20 nt, Homo sapiens
uguaaagacaaaaaacuaua

SEQ ID NO: 400603 - RNA, 21 nt, Homo sapiens
uguaaaggaacaacugauaua

SEQ ID NO: 400604 - RNA, 21 nt, Homo sapiens
uguaaauauuaugauggugga

SEQ ID NO: 400605 - RNA, 12 nt, Homo sapiens
uguaaauggaac

SEQ ID NO: 400606 - RNA, 13 nt, Homo sapiens
uguaaauguuaug

SEQ ID NO: 400607 - RNA, 16 nt, Homo sapiens
uguaaauuaauacuuc

SEQ ID NO: 400608 - RNA, 16 nt, Homo sapiens
uguaaauuuguacuau

SEQ ID NO: 400609 - RNA, 21 nt, Homo sapiens
uguaacacuguauaacauuua

SEQ ID NO: 400610 - RNA, 11 nt, Homo sapiens
uguaacugccc

SEQ ID NO: 400611 - RNA, 12 nt, Homo sapiens
uguaacugccua

SEQ ID NO: 400612 - RNA, 23 nt, Homo sapiens
uguaagaaauaacacugugaaug

SEQ ID NO: 400613 - RNA, 20 nt, Homo sapiens
uguaagacacacagccuuuc

SEQ ID NO: 400614 - RNA, 24 nt, Homo sapiens
uguaagcucuuugaaacaacuuuc

SEQ ID NO: 400615 - RNA, 14 nt, Homo sapiens
uguaauauacaguu

SEQ ID NO: 400616 - RNA, 22 nt, Homo sapiens
uguaauauuacuuuaacaugcc

SEQ ID NO: 400617 - RNA, 11 nt, Homo sapiens
uguaaucucag

SEQ ID NO: 400618 - RNA, 20 nt, Homo sapiens
uguaaugcuuguacaguuga

SEQ ID NO: 400619 - RNA, 15 nt, Homo sapiens
uguaauggaucuuaa

SEQ ID NO: 400620 - RNA, 23 nt, Homo sapiens
uguaauuuuaaauaaaagugauc

SEQ ID NO: 400621 - RNA, 17 nt, Homo sapiens
uguacaaagauacuuga

SEQ ID NO: 400622 - RNA, 20 nt, Homo sapiens
uguacaaauguuagagccau

SEQ ID NO: 400623 - RNA, 23 nt, Homo sapiens
uguacaagguauguacaguucau

SEQ ID NO: 400624 - RNA, 22 nt, Homo sapiens
uguacacugacuugagaccagu

SEQ ID NO: 400625 - RNA, 15 nt, Homo sapiens
uguacaggcagauga

SEQ ID NO: 400626 - RNA, 24 nt, Homo sapiens
uccuguuucugaaccauuacugua

SEQ ID NO: 400627 - RNA, 19 nt, Homo sapiens
uccuguuucuugcucugag

SEQ ID NO: 400628 - RNA, 13 nt, Homo sapiens
uccuuaaugcaga

SEQ ID NO: 400629 - RNA, 20 nt, Homo sapiens
uccuuacaacugcucuagau

SEQ ID NO: 400630 - RNA, 16 nt, Homo sapiens
uccuuaccgugggcac

SEQ ID NO: 400631 - RNA, 15 nt, Homo sapiens
uccuuagcaacagcc

SEQ ID NO: 400632 - RNA, 17 nt, Homo sapiens
uccuuaggagaugucau

SEQ ID NO: 400633 - RNA, 19 nt, Homo sapiens
uccuuaggagaugucauga

SEQ ID NO: 400634 - RNA, 18 nt, Homo sapiens
uccuuaugauauucucau

SEQ ID NO: 400635 - RNA, 22 nt, Homo sapiens
uccuuauuuaucaacaucuuuu

SEQ ID NO: 400636 - RNA, 12 nt, Homo sapiens
uccuucaucacc

SEQ ID NO: 400637 - RNA, 12 nt, Homo sapiens
uccuuccauccc

SEQ ID NO: 400638 - RNA, 13 nt, Homo sapiens
uccuucccacugu

SEQ ID NO: 400639 - RNA, 23 nt, Homo sapiens
uccuucccgcagcaccagccuga

SEQ ID NO: 400640 - RNA, 15 nt, Homo sapiens
uccuucccugggaag

SEQ ID NO: 400641 - RNA, 15 nt, Homo sapiens
uccuuccugagaaac

SEQ ID NO: 400642 - RNA, 11 nt, Homo sapiens
uccuucuuccc

SEQ ID NO: 400643 - RNA, 21 nt, Homo sapiens
uccuucuuguaguagucucau

SEQ ID NO: 400644 - RNA, 22 nt, Homo sapiens
uccuugauuuaucacacaaagc

SEQ ID NO: 400645 - RNA, 16 nt, Homo sapiens
uccuugcaucacuggg

SEQ ID NO: 400646 - RNA, 16 nt, Homo sapiens
uccuugcucagugcaa

SEQ ID NO: 400647 - RNA, 15 nt, Homo sapiens
uccuuggcagaggca

SEQ ID NO: 400648 - RNA, 15 nt, Homo sapiens
uccuuggccuaguca

SEQ ID NO: 400649 - RNA, 16 nt, Homo sapiens
uccuuguaaauuacau

SEQ ID NO: 400650 - RNA, 14 nt, Homo sapiens
uccuuguuccuaga

SEQ ID NO: 400651 - RNA, 13 nt, Homo sapiens
uccuuuaauccca

SEQ ID NO: 400652 - RNA, 15 nt, Homo sapiens
uccuuucacaaccuu

SEQ ID NO: 400653 - RNA, 22 nt, Homo sapiens
uccuuucuuuugaaaugccacg

SEQ ID NO: 400654 - RNA, 16 nt, Homo sapiens
uccuuuuguauccucc

SEQ ID NO: 400655 - RNA, 20 nt, Homo sapiens
ucgaacuccugacaucaggu

SEQ ID NO: 400656 - RNA, 18 nt, Homo sapiens
ucgacugugaccuguggg

SEQ ID NO: 400657 - RNA, 21 nt, Homo sapiens
ucgagcauguuguuuuuucau

SEQ ID NO: 400658 - RNA, 20 nt, Homo sapiens
ucgagugccccugcagggga

SEQ ID NO: 400659 - RNA, 17 nt, Homo sapiens
ucgaguuuuaaacuggu

SEQ ID NO: 400660 - RNA, 16 nt, Homo sapiens
ucgauuuucaauaaua

SEQ ID NO: 400661 - RNA, 13 nt, Homo sapiens
ucgcaucucagcc

SEQ ID NO: 400662 - RNA, 19 nt, Homo sapiens
ucgcaucucagugcaggag

SEQ ID NO: 400663 - RNA, 21 nt, Homo sapiens
ucgcccaggcuggagggcagu

SEQ ID NO: 400664 - RNA, 14 nt, Homo sapiens
ucgccguggcugcg

SEQ ID NO: 400665 - RNA, 12 nt, Homo sapiens
ucgcgcuggaau

SEQ ID NO: 400666 - RNA, 17 nt, Homo sapiens
ucgcugaacaauuaccu

SEQ ID NO: 400667 - RNA, 14 nt, Homo sapiens
ucgcugagucccag

SEQ ID NO: 400668 - RNA, 19 nt, Homo sapiens
ucgcugggcucaacauaga

SEQ ID NO: 400669 - RNA, 17 nt, Homo sapiens
ucggagccaaugaacag

SEQ ID NO: 400670 - RNA, 17 nt, Homo sapiens
ucggaggcuugggaccg

SEQ ID NO: 400671 - RNA, 23 nt, Homo sapiens
ucggcaccuuccccugaggaccu

SEQ ID NO: 400672 - RNA, 20 nt, Homo sapiens
ucggcauucacacacagccu

SEQ ID NO: 400673 - RNA, 13 nt, Homo sapiens
ucggcucacugca

SEQ ID NO: 400674 - RNA, 20 nt, Homo sapiens
ucgggaagagaggaguucaa

SEQ ID NO: 400675 - RNA, 17 nt, Homo sapiens
ucgggacuucaaaauca

SEQ ID NO: 400676 - RNA, 20 nt, Homo sapiens
ucggggcaggaagucccuga

SEQ ID NO: 400677 - RNA, 13 nt, Homo sapiens
ucguacaguucuu

SEQ ID NO: 400678 - RNA, 21 nt, Homo sapiens
ucguagguugugaugauagca

SEQ ID NO: 400679 - RNA, 19 nt, Homo sapiens
ucguagugguacauuccau

SEQ ID NO: 400680 - RNA, 20 nt, Homo sapiens
ucguccuuagaauacuguau

SEQ ID NO: 400681 - RNA, 22 nt, Homo sapiens
ucgucugcgauuuuaucuguua

SEQ ID NO: 400682 - RNA, 17 nt, Homo sapiens
ucgucuuagcaagaagu

SEQ ID NO: 400683 - RNA, 13 nt, Homo sapiens
ucgugaaacccug

SEQ ID NO: 400684 - RNA, 22 nt, Homo sapiens
ucgugaauaaguugauucuguc

SEQ ID NO: 400685 - RNA, 12 nt, Homo sapiens
ucguuucauuca

SEQ ID NO: 400686 - RNA, 23 nt, Homo sapiens
ucguuuuucagcacccccaccca

SEQ ID NO: 400687 - RNA, 17 nt, Homo sapiens
ucguuuuuuucauucca

SEQ ID NO: 400688 - RNA, 20 nt, Homo sapiens
ucuaaaagggggcuauuccc

SEQ ID NO: 400689 - RNA, 22 nt, Homo sapiens
ucuaaagauggaaaaaccaccc

SEQ ID NO: 400690 - RNA, 17 nt, Homo sapiens
ucuaaaggggacagauc

SEQ ID NO: 400691 - RNA, 22 nt, Homo sapiens
ucuaaauuuugucuuuaacuca

SEQ ID NO: 400692 - RNA, 23 nt, Homo sapiens
ucuaaauuuuuacuuaacuuaau

SEQ ID NO: 400693 - RNA, 13 nt, Homo sapiens
ucuaacagcucag

SEQ ID NO: 400694 - RNA, 16 nt, Homo sapiens
ucuaacauguuaucaa

SEQ ID NO: 400695 - RNA, 15 nt, Homo sapiens
ucuaaccuuucuaac

SEQ ID NO: 400696 - RNA, 15 nt, Homo sapiens
ucuaagacauucacc

SEQ ID NO: 400697 - RNA, 22 nt, Homo sapiens
ucuaagacauucaccaacaaca

SEQ ID NO: 400698 - RNA, 14 nt, Homo sapiens
ucuaagagaucugg

SEQ ID NO: 400699 - RNA, 23 nt, Homo sapiens
ucuaaggccaaggccucaggaga

SEQ ID NO: 400700 - RNA, 17 nt, Homo sapiens
ucuaaguucauguuugu

SEQ ID NO: 400701 - RNA, 23 nt, Homo sapiens
ucuaauggcuguggcauuguuga

SEQ ID NO: 400702 - RNA, 14 nt, Homo sapiens
ucuaauuucugaaa

SEQ ID NO: 400703 - RNA, 22 nt, Homo sapiens
ucuaauuuuggauggaguccag

SEQ ID NO: 400704 - RNA, 22 nt, Homo sapiens
ucuacaaguaauuuugcacaga

SEQ ID NO: 400705 - RNA, 14 nt, Homo sapiens
ucuacacaacaugu

SEQ ID NO: 400706 - RNA, 21 nt, Homo sapiens
ucuacaccuguugcaccucag

SEQ ID NO: 400707 - RNA, 12 nt, Homo sapiens
ucuacacuguau

SEQ ID NO: 400708 - RNA, 16 nt, Homo sapiens
ucuacaggccuuucag

SEQ ID NO: 400709 - RNA, 13 nt, Homo sapiens
ucuacaggucucu

SEQ ID NO: 400710 - RNA, 22 nt, Homo sapiens
ucuacauaauuuagaguguaug

SEQ ID NO: 400711 - RNA, 16 nt, Homo sapiens
ucuacauccaauguau

SEQ ID NO: 400712 - RNA, 19 nt, Homo sapiens
ucuacccuugagucauauu

SEQ ID NO: 400713 - RNA, 12 nt, Homo sapiens
ucuacuagucaa

SEQ ID NO: 400714 - RNA, 22 nt, Homo sapiens
ucuacuucuggaagucaucuca

SEQ ID NO: 400715 - RNA, 18 nt, Homo sapiens
ucuacuuggugguuugcu

SEQ ID NO: 400716 - RNA, 15 nt, Homo sapiens
ucuacuuuaucaauu

SEQ ID NO: 400717 - RNA, 15 nt, Homo sapiens
ucuacuuuccaggcu

SEQ ID NO: 400718 - RNA, 13 nt, Homo sapiens
ucuagaacagcca

SEQ ID NO: 400719 - RNA, 17 nt, Homo sapiens
ucuagaauccugcuuua

SEQ ID NO: 400720 - RNA, 24 nt, Homo sapiens
ucuagaauuauaagucacaaagag

SEQ ID NO: 400721 - RNA, 18 nt, Homo sapiens
ucuagauuuucuacuuua

SEQ ID NO: 400722 - RNA, 17 nt, Homo sapiens
ucuagcacaucauggca

SEQ ID NO: 400723 - RNA, 11 nt, Homo sapiens
ucuagccaaau

SEQ ID NO: 400724 - RNA, 22 nt, Homo sapiens
ucuaggauaagcacuagaucuc

SEQ ID NO: 400725 - RNA, 18 nt, Homo sapiens
ucuagucucugauuugca

SEQ ID NO: 400726 - RNA, 14 nt, Homo sapiens
ucuagugacuuccu

SEQ ID NO: 400727 - RNA, 14 nt, Homo sapiens
ucuauacuguugau

SEQ ID NO: 400728 - RNA, 16 nt, Homo sapiens
ucuauaggaacauaug

SEQ ID NO: 400729 - RNA, 17 nt, Homo sapiens
ucuauauuaaggcagua

SEQ ID NO: 400730 - RNA, 14 nt, Homo sapiens
ucuauauuucauau

SEQ ID NO: 400731 - RNA, 15 nt, Homo sapiens
ucuaucaaagcacau

SEQ ID NO: 400732 - RNA, 19 nt, Homo sapiens
ucuauccaaagaacuugau

SEQ ID NO: 400733 - RNA, 12 nt, Homo sapiens
ucuaucucucaa

SEQ ID NO: 400734 - RNA, 23 nt, Homo sapiens
ucuaucucucuuuacauuuuggu

SEQ ID NO: 400735 - RNA, 18 nt, Homo sapiens
ucuaucuugcaucuaccu

SEQ ID NO: 400736 - RNA, 12 nt, Homo sapiens
ucuaugacucac

SEQ ID NO: 400737 - RNA, 22 nt, Homo sapiens
ucuaugcaaagucucucauuuc

SEQ ID NO: 400738 - RNA, 13 nt, Homo sapiens
ucuauggauucac

SEQ ID NO: 400739 - RNA, 22 nt, Homo sapiens
ucuaugggguucguuaugccaa

SEQ ID NO: 400740 - RNA, 23 nt, Homo sapiens
ucuaugggguucguuaugccaaa

SEQ ID NO: 400741 - RNA, 23 nt, Homo sapiens
ucuaugugaccagacugcacagg

SEQ ID NO: 400742 - RNA, 14 nt, Homo sapiens
ucuauucucaaagu

SEQ ID NO: 400743 - RNA, 20 nt, Homo sapiens
ucuauugagugaacagaauu

SEQ ID NO: 400744 - RNA, 15 nt, Homo sapiens
ucuauuucaacuuca

SEQ ID NO: 400745 - RNA, 13 nt, Homo sapiens
ucuauuugagauu

SEQ ID NO: 400746 - RNA, 16 nt, Homo sapiens
ucuauuuucaaguaca

SEQ ID NO: 400747 - RNA, 18 nt, Homo sapiens
ucuauuuuuaguuugcua

SEQ ID NO: 400748 - RNA, 16 nt, Homo sapiens
ucucaaacccuguuua

SEQ ID NO: 400749 - RNA, 14 nt, Homo sapiens
ucucaaacuccuga

SEQ ID NO: 400750 - RNA, 20 nt, Homo sapiens
ucucaaacuccugaccucag

SEQ ID NO: 400751 - RNA, 17 nt, Homo sapiens
aaauaauuuuacauguc

SEQ ID NO: 400752 - RNA, 12 nt, Homo sapiens
aaauacacuaca

SEQ ID NO: 400753 - RNA, 20 nt, Homo sapiens
aaauacgguaaggauacuuu

SEQ ID NO: 400754 - RNA, 11 nt, Homo sapiens
aaauacuucuu

SEQ ID NO: 400755 - RNA, 19 nt, Homo sapiens
aaauacuucuuuuucauua

SEQ ID NO: 400756 - RNA, 17 nt, Homo sapiens
aaauacuuuaacuucca

SEQ ID NO: 400757 - RNA, 23 nt, Homo sapiens
aaauagagcuuuuaaaaaugucc

SEQ ID NO: 400758 - RNA, 20 nt, Homo sapiens
aaauaguccuccaaaacaca

SEQ ID NO: 400759 - RNA, 13 nt, Homo sapiens
aaauagucuucca

SEQ ID NO: 400760 - RNA, 22 nt, Homo sapiens
aaauaguguugaucagaucuua

SEQ ID NO: 400761 - RNA, 14 nt, Homo sapiens
aaauauaacaggug

SEQ ID NO: 400762 - RNA, 14 nt, Homo sapiens
aaauauacaacuuu

SEQ ID NO: 400763 - RNA, 13 nt, Homo sapiens
aaauauacauuca

SEQ ID NO: 400764 - RNA, 15 nt, Homo sapiens
aaauauauauugcau

SEQ ID NO: 400765 - RNA, 14 nt, Homo sapiens
aaauauauuugaua

SEQ ID NO: 400766 - RNA, 14 nt, Homo sapiens
aaauaucaaaaagg

SEQ ID NO: 400767 - RNA, 20 nt, Homo sapiens
aaauaugauuuuauuugaca

SEQ ID NO: 400768 - RNA, 13 nt, Homo sapiens
aaauaugcaugua

SEQ ID NO: 400769 - RNA, 20 nt, Homo sapiens
aaauauggaacuucuaauau

SEQ ID NO: 400770 - RNA, 14 nt, Homo sapiens
aaauauguccuggg

SEQ ID NO: 400771 - RNA, 17 nt, Homo sapiens
aaauauguggaguucau

SEQ ID NO: 400772 - RNA, 17 nt, Homo sapiens
aaauauuuaugaccuca

SEQ ID NO: 400773 - RNA, 20 nt, Homo sapiens
aaauauuuauucaucugcaa

SEQ ID NO: 400774 - RNA, 14 nt, Homo sapiens
aaauauuuuugcca

SEQ ID NO: 400775 - RNA, 12 nt, Homo sapiens
aaaucaaagcag

SEQ ID NO: 400776 - RNA, 21 nt, Homo sapiens
uuuucuuccuauuuccuugua

SEQ ID NO: 400777 - RNA, 19 nt, Homo sapiens
uuuucuucuuuuugcuuca

SEQ ID NO: 400778 - RNA, 13 nt, Homo sapiens
uuuugacugugau

SEQ ID NO: 400779 - RNA, 24 nt, Homo sapiens
uuuugauaauagauaacugcucuu

SEQ ID NO: 400780 - RNA, 19 nt, Homo sapiens
uuuugauccuguaaucaca

SEQ ID NO: 400781 - RNA, 17 nt, Homo sapiens
uuuugcaaaacauaucu

SEQ ID NO: 400782 - RNA, 22 nt, Homo sapiens
uuuugcacauaacaugcuuuag

SEQ ID NO: 400783 - RNA, 15 nt, Homo sapiens
uuuugcucaguucca

SEQ ID NO: 400784 - RNA, 21 nt, Homo sapiens
aagaucaggucauacuaucua

SEQ ID NO: 400785 - RNA, 17 nt, Homo sapiens
aagaucguucucugccu

SEQ ID NO: 400786 - RNA, 17 nt, Homo sapiens
aagaugaucauuugccc

SEQ ID NO: 400787 - RNA, 16 nt, Homo sapiens
aagaugcccacugagg

SEQ ID NO: 400788 - RNA, 20 nt, Homo sapiens
aagauggaggggcugacuca

SEQ ID NO: 400789 - RNA, 21 nt, Homo sapiens
aagauggcugugccucugccu

SEQ ID NO: 400790 - RNA, 15 nt, Homo sapiens
aagauguacugagag

SEQ ID NO: 400791 - RNA, 17 nt, Homo sapiens
aagauguauccuuccaa

SEQ ID NO: 400792 - RNA, 16 nt, Homo sapiens
aagauucuacuuggug

SEQ ID NO: 400793 - RNA, 12 nt, Homo sapiens
aagauucuuggu

SEQ ID NO: 400794 - RNA, 19 nt, Homo sapiens
aagauugauuaaugaacua

SEQ ID NO: 400795 - RNA, 23 nt, Homo sapiens
aagauuuagaaaaaaguuuacaa

SEQ ID NO: 400796 - RNA, 19 nt, Homo sapiens
aagauuuugaaugcuuccu

SEQ ID NO: 400797 - RNA, 20 nt, Homo sapiens
aagcaaaaaaugaaugucua

SEQ ID NO: 400798 - RNA, 16 nt, Homo sapiens
aagcaaaacugcaaau

SEQ ID NO: 400799 - RNA, 15 nt, Homo sapiens
aagcaacaucagcuu

SEQ ID NO: 400800 - RNA, 14 nt, Homo sapiens
aagcaaccaugaac

SEQ ID NO: 400801 - RNA, 16 nt, Homo sapiens
aagcaacgacuacuuu

SEQ ID NO: 400802 - RNA, 20 nt, Homo sapiens
aagcaagacuguugcucaaa

SEQ ID NO: 400803 - RNA, 12 nt, Homo sapiens
aagcaagcucac

SEQ ID NO: 400804 - RNA, 13 nt, Homo sapiens
aagcaagcucucu

SEQ ID NO: 400805 - RNA, 22 nt, Homo sapiens
aagcaaggaagcagagcacugu

SEQ ID NO: 400806 - RNA, 23 nt, Homo sapiens
aacucugcauagacaaaggccuu

SEQ ID NO: 400807 - RNA, 19 nt, Homo sapiens
aacucugguaaaugaucac

SEQ ID NO: 400808 - RNA, 23 nt, Homo sapiens
aacucuguuuugcuaugcuauaa

SEQ ID NO: 400809 - RNA, 21 nt, Homo sapiens
aacucuuguauugcuccauuu

SEQ ID NO: 400810 - RNA, 20 nt, Homo sapiens
aacucuuucuggccugccuu

SEQ ID NO: 400811 - RNA, 20 nt, Homo sapiens
aacugaaaaccagucuucuc

SEQ ID NO: 400812 - RNA, 14 nt, Homo sapiens
aacugacuaaccau

SEQ ID NO: 400813 - RNA, 13 nt, Homo sapiens
aacugacuuccaa

SEQ ID NO: 400814 - RNA, 14 nt, Homo sapiens
aacugacuuuaucc

SEQ ID NO: 400815 - RNA, 13 nt, Homo sapiens
aacugacuuucuc

SEQ ID NO: 400816 - RNA, 14 nt, Homo sapiens
aacugagccaaaaa

SEQ ID NO: 400817 - RNA, 22 nt, Homo sapiens
aacugagccgugcagcugggau

SEQ ID NO: 400818 - RNA, 17 nt, Homo sapiens
aacugagucuguggaca

SEQ ID NO: 400819 - RNA, 20 nt, Homo sapiens
aacugaguuagaauguugaa

SEQ ID NO: 400820 - RNA, 21 nt, Homo sapiens
aacugcauggaccuaacauuc

SEQ ID NO: 400821 - RNA, 22 nt, Homo sapiens
aacugcccugucuaggucagua

SEQ ID NO: 400822 - RNA, 17 nt, Homo sapiens
aacugccugaaagcaac

SEQ ID NO: 400823 - RNA, 18 nt, Homo sapiens
aacugggaaaacagugaa

SEQ ID NO: 400824 - RNA, 20 nt, Homo sapiens
aacugggggcucuguauaua

SEQ ID NO: 400825 - RNA, 17 nt, Homo sapiens
aacuggguucaaaaaga

SEQ ID NO: 400826 - RNA, 17 nt, Homo sapiens
aauauccaaagacugua

SEQ ID NO: 400827 - RNA, 12 nt, Homo sapiens
aauaucuuucag

SEQ ID NO: 400828 - RNA, 15 nt, Homo sapiens
aauaugaauggagug

SEQ ID NO: 400829 - RNA, 19 nt, Homo sapiens
aauaugcacaauagcaguu

SEQ ID NO: 400830 - RNA, 21 nt, Homo sapiens
aauaugcacuuucccuagaaa

SEQ ID NO: 400831 - RNA, 16 nt, Homo sapiens
aauaugcuuuacaauc

SEQ ID NO: 400832 - RNA, 20 nt, Homo sapiens
aauauggaacauaugcacag

SEQ ID NO: 400833 - RNA, 18 nt, Homo sapiens
aauauggguugcauuugg

SEQ ID NO: 400834 - RNA, 14 nt, Homo sapiens
aauauguagcaaug

SEQ ID NO: 400835 - RNA, 11 nt, Homo sapiens
aauaugugcuu

SEQ ID NO: 400836 - RNA, 22 nt, Homo sapiens
aauauguucaccaggagauuac

SEQ ID NO: 400837 - RNA, 17 nt, Homo sapiens
aauauguugaguguuca

SEQ ID NO: 400838 - RNA, 16 nt, Homo sapiens
aauauuauacuucuuu

SEQ ID NO: 400839 - RNA, 23 nt, Homo sapiens
aauauucaauaaagcugcugaga

SEQ ID NO: 400840 - RNA, 19 nt, Homo sapiens
aauauucuauaugaauuua

SEQ ID NO: 400841 - RNA, 20 nt, Homo sapiens
aauauugucacaacacugaa

SEQ ID NO: 400842 - RNA, 17 nt, Homo sapiens
aauauuuauuaccucug

SEQ ID NO: 400843 - RNA, 17 nt, Homo sapiens
aauauuuauugaauuau

SEQ ID NO: 400844 - RNA, 19 nt, Homo sapiens
aauauuuauuguauuuuag

SEQ ID NO: 400845 - RNA, 12 nt, Homo sapiens
aauauuucacuu

SEQ ID NO: 400846 - RNA, 20 nt, Homo sapiens
aauauuuuguaacuauuaca

SEQ ID NO: 400847 - RNA, 12 nt, Homo sapiens
aaucaacucuaa

SEQ ID NO: 400848 - RNA, 16 nt, Homo sapiens
aaucaagagugaguga

SEQ ID NO: 400849 - RNA, 20 nt, Homo sapiens
aaucaagucagcaacagagc

SEQ ID NO: 400850 - RNA, 23 nt, Homo sapiens
aaucaagucugugaaagucuccu

SEQ ID NO: 400851 - RNA, 18 nt, Homo sapiens
aaucaauaaacugugucu

SEQ ID NO: 400852 - RNA, 23 nt, Homo sapiens
aaucaaucuggcuucugcauuac

SEQ ID NO: 400853 - RNA, 14 nt, Homo sapiens
aaucaaugaauauu

SEQ ID NO: 400854 - RNA, 19 nt, Homo sapiens
aaucacaaccacaaccaac

SEQ ID NO: 400855 - RNA, 18 nt, Homo sapiens
aaucacacucucuucuua

SEQ ID NO: 400856 - RNA, 23 nt, Homo sapiens
aaucacacucucuucuuacugua

SEQ ID NO: 400857 - RNA, 13 nt, Homo sapiens
aaucaccaaagua

SEQ ID NO: 400858 - RNA, 11 nt, Homo sapiens
aaucacuggaa

SEQ ID NO: 400859 - RNA, 16 nt, Homo sapiens
aaucagacacaauuag

SEQ ID NO: 400860 - RNA, 15 nt, Homo sapiens
aaucagagagcucac

SEQ ID NO: 400861 - RNA, 18 nt, Homo sapiens
aaucagagagcucacuaa

SEQ ID NO: 400862 - RNA, 14 nt, Homo sapiens
aaucagagcaguga

SEQ ID NO: 400863 - RNA, 16 nt, Homo sapiens
aaucagauuauggaag

SEQ ID NO: 400864 - RNA, 16 nt, Homo sapiens
aaucagccacauucua

SEQ ID NO: 400865 - RNA, 23 nt, Homo sapiens
aaucaguaugaagacacugucaa

SEQ ID NO: 400866 - RNA, 18 nt, Homo sapiens
aaucaguuaauggcucau

SEQ ID NO: 400867 - RNA, 16 nt, Homo sapiens
aaucauaaaacuugau

SEQ ID NO: 400868 - RNA, 19 nt, Homo sapiens
aaucauaaaacuugaugug

SEQ ID NO: 400869 - RNA, 20 nt, Homo sapiens
aaucauacuuugccaaauag

SEQ ID NO: 400870 - RNA, 13 nt, Homo sapiens
aaucaucuucucu

SEQ ID NO: 400871 - RNA, 19 nt, Homo sapiens
aaucauggcuaagcuuaaa

SEQ ID NO: 400872 - RNA, 23 nt, Homo sapiens
aaucauguuggauagucagcugu

SEQ ID NO: 400873 - RNA, 16 nt, Homo sapiens
aaucauuaauacucuu

SEQ ID NO: 400874 - RNA, 23 nt, Homo sapiens
aaucauuauaaauaauguucauu

SEQ ID NO: 400875 - RNA, 12 nt, Homo sapiens
aaucauucaaua

SEQ ID NO: 400876 - RNA, 21 nt, Homo sapiens
aaucauugcuuaugacaugau

SEQ ID NO: 400877 - RNA, 20 nt, Homo sapiens
aaucauuguagaaacacagu

SEQ ID NO: 400878 - RNA, 23 nt, Homo sapiens
aaucauuuauuuacaugugauug

SEQ ID NO: 400879 - RNA, 17 nt, Homo sapiens
aaucauuuuaauuauua

SEQ ID NO: 400880 - RNA, 15 nt, Homo sapiens
aauccaaaccacagu

SEQ ID NO: 400881 - RNA, 15 nt, Homo sapiens
aauccacaagccauu

SEQ ID NO: 400882 - RNA, 19 nt, Homo sapiens
aauccagagagcagugugg

SEQ ID NO: 400883 - RNA, 22 nt, Homo sapiens
aauccaguccagauauuucaca

SEQ ID NO: 400884 - RNA, 15 nt, Homo sapiens
aauccaugugcugcu

SEQ ID NO: 400885 - RNA, 13 nt, Homo sapiens
aauccauuuucua

SEQ ID NO: 400886 - RNA, 17 nt, Homo sapiens
aaucccaaucuuucuau

SEQ ID NO: 400887 - RNA, 14 nt, Homo sapiens
aaucccacuuauca

SEQ ID NO: 400888 - RNA, 15 nt, Homo sapiens
aaucccagcuacuug

SEQ ID NO: 400889 - RNA, 21 nt, Homo sapiens
aaucccagggaaggacuugga

SEQ ID NO: 400890 - RNA, 18 nt, Homo sapiens
aauccccucccugugacc

SEQ ID NO: 400891 - RNA, 17 nt, Homo sapiens
aauccucucagagucau

SEQ ID NO: 400892 - RNA, 18 nt, Homo sapiens
aauccuggcccucugugu

SEQ ID NO: 400893 - RNA, 17 nt, Homo sapiens
aauccuucuaacuaaac

SEQ ID NO: 400894 - RNA, 20 nt, Homo sapiens
aauccuucuaacuaaacuaa

SEQ ID NO: 400895 - RNA, 22 nt, Homo sapiens
aauccuucuaacuaaacuaaaa

SEQ ID NO: 400896 - RNA, 18 nt, Homo sapiens
aauccuuuguacugauga

SEQ ID NO: 400897 - RNA, 18 nt, Homo sapiens
aaucggcauguauacuua

SEQ ID NO: 400898 - RNA, 13 nt, Homo sapiens
aaucuaaucucuu

SEQ ID NO: 400899 - RNA, 20 nt, Homo sapiens
aaucuaccugcccuaaggga

SEQ ID NO: 400900 - RNA, 21 nt, Homo sapiens
aaucucaagauucuacuuggu

SEQ ID NO: 400901 - RNA, 18 nt, Homo sapiens
aaucucagccagccucca

SEQ ID NO: 400902 - RNA, 17 nt, Homo sapiens
aaucuccccuccucaca

SEQ ID NO: 400903 - RNA, 12 nt, Homo sapiens
aaucucuaguug

SEQ ID NO: 400904 - RNA, 22 nt, Homo sapiens
aaucucuucuuugcugcaguca

SEQ ID NO: 400905 - RNA, 14 nt, Homo sapiens
aaucugaacucuca

SEQ ID NO: 400906 - RNA, 15 nt, Homo sapiens
aaucugaguauauau

SEQ ID NO: 400907 - RNA, 20 nt, Homo sapiens
aaucugcugcauagcucuau

SEQ ID NO: 400908 - RNA, 19 nt, Homo sapiens
aaucuggguaucuuuccag

SEQ ID NO: 400909 - RNA, 17 nt, Homo sapiens
aaucuguaagcucuuug

SEQ ID NO: 400910 - RNA, 17 nt, Homo sapiens
aaucuguaauugcuuau

SEQ ID NO: 400911 - RNA, 15 nt, Homo sapiens
aaucuguagucacuu

SEQ ID NO: 400912 - RNA, 20 nt, Homo sapiens
aaucuguauauguuguaaua

SEQ ID NO: 400913 - RNA, 17 nt, Homo sapiens
aaucuuaccagaugcua

SEQ ID NO: 400914 - RNA, 19 nt, Homo sapiens
aaucuuaccagaugcuacu

SEQ ID NO: 400915 - RNA, 16 nt, Homo sapiens
aaucuucccugucagg

SEQ ID NO: 400916 - RNA, 19 nt, Homo sapiens
aaucuucucuuugacaauu

SEQ ID NO: 400917 - RNA, 23 nt, Homo sapiens
aaucuucucuuugacaauuccua

SEQ ID NO: 400918 - RNA, 21 nt, Homo sapiens
aaucuuuccaucucauuacag

SEQ ID NO: 400919 - RNA, 16 nt, Homo sapiens
aaucuuuuacugugga

SEQ ID NO: 400920 - RNA, 20 nt, Homo sapiens
aaugaaaccuuccucuugag

SEQ ID NO: 400921 - RNA, 15 nt, Homo sapiens
aaugaaauacuugac

SEQ ID NO: 400922 - RNA, 13 nt, Homo sapiens
aaugaaauaguua

SEQ ID NO: 400923 - RNA, 14 nt, Homo sapiens
aaugaacauguuaa

SEQ ID NO: 400924 - RNA, 15 nt, Homo sapiens
aaugaagacacucaa

SEQ ID NO: 400925 - RNA, 17 nt, Homo sapiens
aaugaaggugugcuaca

SEQ ID NO: 400926 - RNA, 18 nt, Homo sapiens
aaugaaucuucacaaaac

SEQ ID NO: 400927 - RNA, 15 nt, Homo sapiens
aaugaaugacauuga

SEQ ID NO: 400928 - RNA, 19 nt, Homo sapiens
aaugaauuuuuuccuacca

SEQ ID NO: 400929 - RNA, 15 nt, Homo sapiens
aaugacaaugaugau

SEQ ID NO: 400930 - RNA, 13 nt, Homo sapiens
aaugacauuugua

SEQ ID NO: 400931 - RNA, 14 nt, Homo sapiens
aaugaccaauauua

SEQ ID NO: 400932 - RNA, 18 nt, Homo sapiens
aaugaccaguuuaccuga

SEQ ID NO: 400933 - RNA, 23 nt, Homo sapiens
aaugaccuuuagggaguuuuccu

SEQ ID NO: 400934 - RNA, 11 nt, Homo sapiens
aaugacugcuu

SEQ ID NO: 400935 - RNA, 11 nt, Homo sapiens
aaugacuguga

SEQ ID NO: 400936 - RNA, 16 nt, Homo sapiens
aaugacuuaagcacac

SEQ ID NO: 400937 - RNA, 23 nt, Homo sapiens
aaugagauauaucuuuauacuua

SEQ ID NO: 400938 - RNA, 17 nt, Homo sapiens
aaugagcaaauggaaca

SEQ ID NO: 400939 - RNA, 17 nt, Homo sapiens
aaugaggaaacugcacu

SEQ ID NO: 400940 - RNA, 22 nt, Homo sapiens
aaugaguaaauaaacucuucaa

SEQ ID NO: 400941 - RNA, 22 nt, Homo sapiens
aaugaguaaugcagacauuuac

SEQ ID NO: 400942 - RNA, 22 nt, Homo sapiens
aaugaguguguuggcuugugau

SEQ ID NO: 400943 - RNA, 17 nt, Homo sapiens
aaugaguuuuacauuac

SEQ ID NO: 400944 - RNA, 17 nt, Homo sapiens
aaugauaugucuuuaaa

SEQ ID NO: 400945 - RNA, 19 nt, Homo sapiens
aaugaugccccagagcucu

SEQ ID NO: 400946 - RNA, 20 nt, Homo sapiens
auccuguuaacacuguaaua

SEQ ID NO: 400947 - RNA, 16 nt, Homo sapiens
auccuguuaggggaaa

SEQ ID NO: 400948 - RNA, 16 nt, Homo sapiens
auccuuagcaacagcc

SEQ ID NO: 400949 - RNA, 14 nt, Homo sapiens
auccuuccaaaaau

SEQ ID NO: 400950 - RNA, 19 nt, Homo sapiens
auccuucuaacuaaacuaa

SEQ ID NO: 400951 - RNA, 20 nt, Homo sapiens
auccuugggagggugccauc

SEQ ID NO: 400952 - RNA, 13 nt, Homo sapiens
auccuuuacuguu

SEQ ID NO: 400953 - RNA, 13 nt, Homo sapiens
auccuuuuaucuc

SEQ ID NO: 400954 - RNA, 14 nt, Homo sapiens
aucgaaaguaaaaa

SEQ ID NO: 400955 - RNA, 22 nt, Homo sapiens
aucgaggaaccagagccaugga

SEQ ID NO: 400956 - RNA, 15 nt, Homo sapiens
aucgaggggugcuua

SEQ ID NO: 400957 - RNA, 21 nt, Homo sapiens
aucgcaccauugcacuccagc

SEQ ID NO: 400958 - RNA, 16 nt, Homo sapiens
aucggaagcagugccu

SEQ ID NO: 400959 - RNA, 23 nt, Homo sapiens
aucggaucuggggcucugggaua

SEQ ID NO: 400960 - RNA, 19 nt, Homo sapiens
aucggguaagaugcuccug

SEQ ID NO: 400961 - RNA, 12 nt, Homo sapiens
aucgugcuaaau

SEQ ID NO: 400962 - RNA, 21 nt, Homo sapiens
aucguucugggucagcuugaa

SEQ ID NO: 400963 - RNA, 15 nt, Homo sapiens
aucuaacugugcuca

SEQ ID NO: 400964 - RNA, 14 nt, Homo sapiens
aucuaagacauuca

SEQ ID NO: 400965 - RNA, 19 nt, Homo sapiens
aucuaagacauucaccaac

SEQ ID NO: 400966 - RNA, 11 nt, Homo sapiens
aucuaccagca

SEQ ID NO: 400967 - RNA, 15 nt, Homo sapiens
aucuaccugccucag

SEQ ID NO: 400968 - RNA, 12 nt, Homo sapiens
aucuaccugugu

SEQ ID NO: 400969 - RNA, 15 nt, Homo sapiens
aucuagguucaggaa

SEQ ID NO: 400970 - RNA, 14 nt, Homo sapiens
aucuaguucucaau

SEQ ID NO: 400971 - RNA, 19 nt, Homo sapiens
aucuaguucucaaucacug

SEQ ID NO: 400972 - RNA, 19 nt, Homo sapiens
aucuaugagcugacaucuc

SEQ ID NO: 400973 - RNA, 22 nt, Homo sapiens
aucuauuuggaaagcacuggaa

SEQ ID NO: 400974 - RNA, 23 nt, Homo sapiens
aucuauuuggaaagcacuggaau

SEQ ID NO: 400975 - RNA, 18 nt, Homo sapiens
aucucaagauucaguaga

SEQ ID NO: 400976 - RNA, 13 nt, Homo sapiens
aucucacaaauaa

SEQ ID NO: 400977 - RNA, 23 nt, Homo sapiens
aucucaggauaaaguuugcuaag

SEQ ID NO: 400978 - RNA, 18 nt, Homo sapiens
aucucaggccaccugccc

SEQ ID NO: 400979 - RNA, 16 nt, Homo sapiens
aucucaucccuagucu

SEQ ID NO: 400980 - RNA, 17 nt, Homo sapiens
aucuccagacucuacca

SEQ ID NO: 400981 - RNA, 20 nt, Homo sapiens
aucuccaucauaugccugac

SEQ ID NO: 400982 - RNA, 17 nt, Homo sapiens
aucuccccaggccucca

SEQ ID NO: 400983 - RNA, 17 nt, Homo sapiens
aucuccccucagauucc

SEQ ID NO: 400984 - RNA, 19 nt, Homo sapiens
aucucccuuaauaaacuca

SEQ ID NO: 400985 - RNA, 15 nt, Homo sapiens
aucuccucuccccaa

SEQ ID NO: 400986 - RNA, 22 nt, Homo sapiens
aucucggcucacugcaaccucu

SEQ ID NO: 400987 - RNA, 21 nt, Homo sapiens
aucucuacuaaaaauacaaaa

SEQ ID NO: 400988 - RNA, 20 nt, Homo sapiens
aucucuacuaccacaaggaa

SEQ ID NO: 400989 - RNA, 16 nt, Homo sapiens
aucucuagagugagaa

SEQ ID NO: 400990 - RNA, 19 nt, Homo sapiens
aucucuagagugagaaucu

SEQ ID NO: 400991 - RNA, 18 nt, Homo sapiens
aucucugcccucuucuca

SEQ ID NO: 400992 - RNA, 15 nt, Homo sapiens
aucucuggagugugu

SEQ ID NO: 400993 - RNA, 16 nt, Homo sapiens
aucucuuauuuuacaa

SEQ ID NO: 400994 - RNA, 17 nt, Homo sapiens
aucucuuauuuuacaau

SEQ ID NO: 400995 - RNA, 13 nt, Homo sapiens
aucugaacacagu

SEQ ID NO: 400996 - RNA, 13 nt, Homo sapiens
aucugaacucuca

SEQ ID NO: 400997 - RNA, 21 nt, Homo sapiens
aucugacacaaaaaaaguuga

SEQ ID NO: 400998 - RNA, 15 nt, Homo sapiens
aucugaggaguccaa

SEQ ID NO: 400999 - RNA, 14 nt, Homo sapiens
aucugauaucuguu

SEQ ID NO: 401000 - RNA, 21 nt, Homo sapiens
aucugcacaacugacuuccaa

SEQ ID NO: 401001 - RNA, 18 nt, Homo sapiens
aucugcauuuagcacaaa

SEQ ID NO: 401002 - RNA, 16 nt, Homo sapiens
aucugccgcuaccugg

SEQ ID NO: 401003 - RNA, 18 nt, Homo sapiens
aucugccgcuaccuggac

SEQ ID NO: 401004 - RNA, 15 nt, Homo sapiens
aucugcugcauagcu

SEQ ID NO: 401005 - RNA, 16 nt, Homo sapiens
aucugcugccaugaga

SEQ ID NO: 401006 - RNA, 14 nt, Homo sapiens
aucugcuuaccaca

SEQ ID NO: 401007 - RNA, 17 nt, Homo sapiens
aucuggaaggacaucua

SEQ ID NO: 401008 - RNA, 16 nt, Homo sapiens
aucugggaacucccaa

SEQ ID NO: 401009 - RNA, 13 nt, Homo sapiens
aucuguaagcucu

SEQ ID NO: 401010 - RNA, 17 nt, Homo sapiens
aucugucccacugggac

SEQ ID NO: 401011 - RNA, 20 nt, Homo sapiens
aucugucuagaauccugcuu

SEQ ID NO: 401012 - RNA, 13 nt, Homo sapiens
aucugucuuguca

SEQ ID NO: 401013 - RNA, 20 nt, Homo sapiens
aucugucuugucauuccagg

SEQ ID NO: 401014 - RNA, 14 nt, Homo sapiens
aucugugcagucau

SEQ ID NO: 401015 - RNA, 23 nt, Homo sapiens
aucuguggagaauguacacaguu

SEQ ID NO: 401016 - RNA, 19 nt, Homo sapiens
aucuguucuaacauguaau

SEQ ID NO: 401017 - RNA, 14 nt, Homo sapiens
aucuguuugauaca

SEQ ID NO: 401018 - RNA, 20 nt, Homo sapiens
aucuguuugauacaguauua

SEQ ID NO: 401019 - RNA, 14 nt, Homo sapiens
aucuuaagauucca

SEQ ID NO: 401020 - RNA, 17 nt, Homo sapiens
aucuuaagauuccauuu

SEQ ID NO: 401021 - RNA, 14 nt, Homo sapiens
aucuuaauuccuua

SEQ ID NO: 401022 - RNA, 19 nt, Homo sapiens
aucuuacaaaaacaagaca

SEQ ID NO: 401023 - RNA, 13 nt, Homo sapiens
aucuuacuugagc

SEQ ID NO: 401024 - RNA, 23 nt, Homo sapiens
aucuuagaacagauggcugugaa

SEQ ID NO: 401025 - RNA, 18 nt, Homo sapiens
aucuucaaacuuucacuu

SEQ ID NO: 401026 - RNA, 16 nt, Homo sapiens
aaacucauuuuugcca

SEQ ID NO: 401027 - RNA, 23 nt, Homo sapiens
aaacuccugauuuuguaguuaau

SEQ ID NO: 401028 - RNA, 18 nt, Homo sapiens
aaacuccugggcucaggc

SEQ ID NO: 401029 - RNA, 23 nt, Homo sapiens
aaacucuuugcccaguucauccc

SEQ ID NO: 401030 - RNA, 14 nt, Homo sapiens
aaacugaacauauu

SEQ ID NO: 401031 - RNA, 16 nt, Homo sapiens
aaacugacuuuauccu

SEQ ID NO: 401032 - RNA, 19 nt, Homo sapiens
aaacugauggauaucccua

SEQ ID NO: 401033 - RNA, 19 nt, Homo sapiens
aaacugcucuguaggucau

SEQ ID NO: 401034 - RNA, 23 nt, Homo sapiens
aaacugcuuuuuuuuuuccagca

SEQ ID NO: 401035 - RNA, 23 nt, Homo sapiens
aaacuggaaaguacguuaugaua

SEQ ID NO: 401036 - RNA, 11 nt, Homo sapiens
aaacuguacag

SEQ ID NO: 401037 - RNA, 23 nt, Homo sapiens
aaacuguucucuauuagacuuua

SEQ ID NO: 401038 - RNA, 15 nt, Homo sapiens
aaacuuaacauucau

SEQ ID NO: 401039 - RNA, 21 nt, Homo sapiens
aaacuuaccuaagugacauuu

SEQ ID NO: 401040 - RNA, 16 nt, Homo sapiens
aaacuucaaagcugaa

SEQ ID NO: 401041 - RNA, 19 nt, Homo sapiens
aaacuuccacuaccuuuaa

SEQ ID NO: 401042 - RNA, 13 nt, Homo sapiens
aaacuuccaguca

SEQ ID NO: 401043 - RNA, 17 nt, Homo sapiens
aaacuugaugccagugg

SEQ ID NO: 401044 - RNA, 22 nt, Homo sapiens
aaacuuguguucaaucugugaa

SEQ ID NO: 401045 - RNA, 14 nt, Homo sapiens
aaacuuucaccuca

SEQ ID NO: 401046 - RNA, 17 nt, Homo sapiens
aaacuuucaccucagau

SEQ ID NO: 401047 - RNA, 22 nt, Homo sapiens
aaacuuuccaugacaguagcau

SEQ ID NO: 401048 - RNA, 18 nt, Homo sapiens
aaagaaaaagaccuauga

SEQ ID NO: 401049 - RNA, 13 nt, Homo sapiens
aaagaaaacauuc

SEQ ID NO: 401050 - RNA, 20 nt, Homo sapiens
aaagaaaacuuguguucaau

SEQ ID NO: 401051 - RNA, 19 nt, Homo sapiens
aaagaaaaugugucugcaa

SEQ ID NO: 401052 - RNA, 22 nt, Homo sapiens
aaagaaacguacuuaacugugu

SEQ ID NO: 401053 - RNA, 14 nt, Homo sapiens
aaagaaauagccaa

SEQ ID NO: 401054 - RNA, 17 nt, Homo sapiens
aaagaaaugcauaaaag

SEQ ID NO: 401055 - RNA, 17 nt, Homo sapiens
aaagaaauugcaugcag

SEQ ID NO: 401056 - RNA, 13 nt, Homo sapiens
aaagaaccagaga

SEQ ID NO: 401057 - RNA, 17 nt, Homo sapiens
aaagaacgugaucuccu

SEQ ID NO: 401058 - RNA, 17 nt, Homo sapiens
aaagaacugcuuaguau

SEQ ID NO: 401059 - RNA, 20 nt, Homo sapiens
aaagaacuguauuuagugau

SEQ ID NO: 401060 - RNA, 16 nt, Homo sapiens
aaagaagacuggaagc

SEQ ID NO: 401061 - RNA, 22 nt, Homo sapiens
aaagacaaaugggccugccaaa

SEQ ID NO: 401062 - RNA, 18 nt, Homo sapiens
aaagacaggguuucacca

SEQ ID NO: 401063 - RNA, 17 nt, Homo sapiens
aaagacauccucaaaag

SEQ ID NO: 401064 - RNA, 23 nt, Homo sapiens
aaagaccgugugugaaauucucu

SEQ ID NO: 401065 - RNA, 12 nt, Homo sapiens
aaagacugaguc

SEQ ID NO: 401066 - RNA, 15 nt, Homo sapiens
aaagacuguacuggc

SEQ ID NO: 401067 - RNA, 16 nt, Homo sapiens
aaagacuugaugaaua

SEQ ID NO: 401068 - RNA, 18 nt, Homo sapiens
aaagagagucgcaucuca

SEQ ID NO: 401069 - RNA, 20 nt, Homo sapiens
aaagagcgucauguccuugg

SEQ ID NO: 401070 - RNA, 13 nt, Homo sapiens
aaagagcucucca

SEQ ID NO: 401071 - RNA, 17 nt, Homo sapiens
aaagaggcuaugugagc

SEQ ID NO: 401072 - RNA, 12 nt, Homo sapiens
aaagaggugcug

SEQ ID NO: 401073 - RNA, 12 nt, Homo sapiens
aaagaguaugua

SEQ ID NO: 401074 - RNA, 16 nt, Homo sapiens
aaagauaucagagcuc

SEQ ID NO: 401075 - RNA, 21 nt, Homo sapiens
aaagaugaucuacucagaaau

SEQ ID NO: 401076 - RNA, 18 nt, Homo sapiens
augaauuugacugguuca

SEQ ID NO: 401077 - RNA, 12 nt, Homo sapiens
augacaaaaagc

SEQ ID NO: 401078 - RNA, 16 nt, Homo sapiens
augacaaaaagccuuu

SEQ ID NO: 401079 - RNA, 18 nt, Homo sapiens
augacaaugaugaugaua

SEQ ID NO: 401080 - RNA, 23 nt, Homo sapiens
augacagggaugccaacaccuuc

SEQ ID NO: 401081 - RNA, 12 nt, Homo sapiens
augacauguuau

SEQ ID NO: 401082 - RNA, 17 nt, Homo sapiens
augaccaguuuaccuga

SEQ ID NO: 401083 - RNA, 16 nt, Homo sapiens
augaccauaaaauuag

SEQ ID NO: 401084 - RNA, 17 nt, Homo sapiens
augacccggggcagcug

SEQ ID NO: 401085 - RNA, 18 nt, Homo sapiens
augaccuguauuuugcca

SEQ ID NO: 401086 - RNA, 22 nt, Homo sapiens
augaccuguuauuaccauuagc

SEQ ID NO: 401087 - RNA, 23 nt, Homo sapiens
augacuaaagagagaauguagau

SEQ ID NO: 401088 - RNA, 23 nt, Homo sapiens
augacuccagaauuucccaaagc

SEQ ID NO: 401089 - RNA, 15 nt, Homo sapiens
augacugcauuuuac

SEQ ID NO: 401090 - RNA, 10 nt, Homo sapiens
augacugggc

SEQ ID NO: 401091 - RNA, 22 nt, Homo sapiens
augacuucacccacgcauauac

SEQ ID NO: 401092 - RNA, 14 nt, Homo sapiens
augacuugacaagu

SEQ ID NO: 401093 - RNA, 19 nt, Homo sapiens
augacuugggccaaucacu

SEQ ID NO: 401094 - RNA, 13 nt, Homo sapiens
augacuuuuccau

SEQ ID NO: 401095 - RNA, 22 nt, Homo sapiens
augagaaacuuugaucucugcu

SEQ ID NO: 401096 - RNA, 13 nt, Homo sapiens
augagaacaugaa

SEQ ID NO: 401097 - RNA, 18 nt, Homo sapiens
augagaaugucauuugcu

SEQ ID NO: 401098 - RNA, 16 nt, Homo sapiens
augagaccacuguuau

SEQ ID NO: 401099 - RNA, 13 nt, Homo sapiens
augagaugaugcc

SEQ ID NO: 401100 - RNA, 15 nt, Homo sapiens
augagauguaugccc

SEQ ID NO: 401101 - RNA, 14 nt, Homo sapiens
augagcaccuacuu

SEQ ID NO: 401102 - RNA, 14 nt, Homo sapiens
augagccuuugcac

SEQ ID NO: 401103 - RNA, 16 nt, Homo sapiens
augagcugacaucuca

SEQ ID NO: 401104 - RNA, 18 nt, Homo sapiens
augagcugacaucucagu

SEQ ID NO: 401105 - RNA, 16 nt, Homo sapiens
augaggaaacugcacu

SEQ ID NO: 401106 - RNA, 14 nt, Homo sapiens
augaggggccucag

SEQ ID NO: 401107 - RNA, 15 nt, Homo sapiens
augagucaaugugca

SEQ ID NO: 401108 - RNA, 20 nt, Homo sapiens
augaguuuuugauagcuuua

SEQ ID NO: 401109 - RNA, 18 nt, Homo sapiens
augauaaauaaccaggaa

SEQ ID NO: 401110 - RNA, 20 nt, Homo sapiens
augauaaauuugacuguuau

SEQ ID NO: 401111 - RNA, 20 nt, Homo sapiens
augaucagcuguuugucaua

SEQ ID NO: 401112 - RNA, 19 nt, Homo sapiens
augauccuuaugaugucca

SEQ ID NO: 401113 - RNA, 20 nt, Homo sapiens
augaucucuuaggaagccuu

SEQ ID NO: 401114 - RNA, 17 nt, Homo sapiens
augaucuggauccacca

SEQ ID NO: 401115 - RNA, 14 nt, Homo sapiens
augaugacuccucu

SEQ ID NO: 401116 - RNA, 19 nt, Homo sapiens
augaugugaguacccagga

SEQ ID NO: 401117 - RNA, 22 nt, Homo sapiens
augauuaggcccgccaaacuuc

SEQ ID NO: 401118 - RNA, 21 nt, Homo sapiens
augauuccuuccuguucugaa

SEQ ID NO: 401119 - RNA, 14 nt, Homo sapiens
augauucuaugucu

SEQ ID NO: 401120 - RNA, 13 nt, Homo sapiens
augauuuacucau

SEQ ID NO: 401121 - RNA, 13 nt, Homo sapiens
augauuucuagca

SEQ ID NO: 401122 - RNA, 21 nt, Homo sapiens
augcaaaauaaauguuuuuau

SEQ ID NO: 401123 - RNA, 21 nt, Homo sapiens
augcaagagaacaauguuucu

SEQ ID NO: 401124 - RNA, 15 nt, Homo sapiens
augcaauccuuccaa

SEQ ID NO: 401125 - RNA, 22 nt, Homo sapiens
augcacagauuaaacuucaccu

SEQ ID NO: 401126 - RNA, 13 nt, Homo sapiens
augcacagcucaa

SEQ ID NO: 401127 - RNA, 16 nt, Homo sapiens
augcaccaaguacagc

SEQ ID NO: 401128 - RNA, 21 nt, Homo sapiens
augcaccaaguacagccuuca

SEQ ID NO: 401129 - RNA, 15 nt, Homo sapiens
augcacgaucucagu

SEQ ID NO: 401130 - RNA, 15 nt, Homo sapiens
augcacugcaaauac

SEQ ID NO: 401131 - RNA, 12 nt, Homo sapiens
augcacuggccu

SEQ ID NO: 401132 - RNA, 17 nt, Homo sapiens
augcacuuucccuagaa

SEQ ID NO: 401133 - RNA, 15 nt, Homo sapiens
augcagcccaugccc

SEQ ID NO: 401134 - RNA, 21 nt, Homo sapiens
augcaggcaugcuggcuccca

SEQ ID NO: 401135 - RNA, 20 nt, Homo sapiens
augcagugcugcuuugccaa

SEQ ID NO: 401136 - RNA, 13 nt, Homo sapiens
augcauacuacaa

SEQ ID NO: 401137 - RNA, 16 nt, Homo sapiens
augcaugagcucccuc

SEQ ID NO: 401138 - RNA, 20 nt, Homo sapiens
augcaugauauuguauguac

SEQ ID NO: 401139 - RNA, 13 nt, Homo sapiens
augcaugcugauu

SEQ ID NO: 401140 - RNA, 11 nt, Homo sapiens
augcauuuuaa

SEQ ID NO: 401141 - RNA, 15 nt, Homo sapiens
augccaaauguucca

SEQ ID NO: 401142 - RNA, 17 nt, Homo sapiens
augccaauuucucuuaa

SEQ ID NO: 401143 - RNA, 16 nt, Homo sapiens
augccacaaaacugac

SEQ ID NO: 401144 - RNA, 23 nt, Homo sapiens
augccacacgggguuugucugua

SEQ ID NO: 401145 - RNA, 12 nt, Homo sapiens
augccacagcca

SEQ ID NO: 401146 - RNA, 14 nt, Homo sapiens
augccacagccaag

SEQ ID NO: 401147 - RNA, 15 nt, Homo sapiens
augccaccacccacc

SEQ ID NO: 401148 - RNA, 14 nt, Homo sapiens
augccagcccaaag

SEQ ID NO: 401149 - RNA, 12 nt, Homo sapiens
augccagugugc

SEQ ID NO: 401150 - RNA, 18 nt, Homo sapiens
augccauuccgaccuuca

SEQ ID NO: 401151 - RNA, 21 nt, Homo sapiens
augcccucaggggacuugaau

SEQ ID NO: 401152 - RNA, 18 nt, Homo sapiens
augccuauuuacuggaaa

SEQ ID NO: 401153 - RNA, 16 nt, Homo sapiens
augccucuguauuuaa

SEQ ID NO: 401154 - RNA, 21 nt, Homo sapiens
augccugccccccucaucuca

SEQ ID NO: 401155 - RNA, 21 nt, Homo sapiens
augccugggucucugggcaca

SEQ ID NO: 401156 - RNA, 13 nt, Homo sapiens
augccugguacca

SEQ ID NO: 401157 - RNA, 17 nt, Homo sapiens
augccugguaccagagg

SEQ ID NO: 401158 - RNA, 22 nt, Homo sapiens
augccuuguugaugaagcacau

SEQ ID NO: 401159 - RNA, 22 nt, Homo sapiens
augccuuucuaguccuauucua

SEQ ID NO: 401160 - RNA, 20 nt, Homo sapiens
augcuaaauaguucuaucag

SEQ ID NO: 401161 - RNA, 19 nt, Homo sapiens
aaauacuguaacacuguau

SEQ ID NO: 401162 - RNA, 20 nt, Homo sapiens
aaauacuguaacacuguaua

SEQ ID NO: 401163 - RNA, 11 nt, Homo sapiens
aaauacuucua

SEQ ID NO: 401164 - RNA, 15 nt, Homo sapiens
aaauagaacauucca

SEQ ID NO: 401165 - RNA, 17 nt, Homo sapiens
aaauagaaccacuauga

SEQ ID NO: 401166 - RNA, 15 nt, Homo sapiens
aaauagagaauccca

SEQ ID NO: 401167 - RNA, 23 nt, Homo sapiens
aaauagcaucugcucuucucuua

SEQ ID NO: 401168 - RNA, 19 nt, Homo sapiens
aaauagcuauauccaugua

SEQ ID NO: 401169 - RNA, 17 nt, Homo sapiens
aaauagucuuccacaaa

SEQ ID NO: 401170 - RNA, 14 nt, Homo sapiens
aaauaguggccaga

SEQ ID NO: 401171 - RNA, 16 nt, Homo sapiens
aaauauaaacugugag

SEQ ID NO: 401172 - RNA, 18 nt, Homo sapiens
aaauauaaacugugagau

SEQ ID NO: 401173 - RNA, 16 nt, Homo sapiens
aaauauaagagcaaga

SEQ ID NO: 401174 - RNA, 14 nt, Homo sapiens
aaauauaauugaca

SEQ ID NO: 401175 - RNA, 15 nt, Homo sapiens
aaauaucccagagaa

SEQ ID NO: 401176 - RNA, 19 nt, Homo sapiens
aaauaucucaauuaccaau

SEQ ID NO: 401177 - RNA, 23 nt, Homo sapiens
aaauaucuuagguuggagaugac

SEQ ID NO: 401178 - RNA, 18 nt, Homo sapiens
aaauaugauucuccucuc

SEQ ID NO: 401179 - RNA, 22 nt, Homo sapiens
aaauaugugcuugaaaugagaa

SEQ ID NO: 401180 - RNA, 22 nt, Homo sapiens
aaauauucaauaagaagucaaa

SEQ ID NO: 401181 - RNA, 13 nt, Homo sapiens
aaauauuccugca

SEQ ID NO: 401182 - RNA, 16 nt, Homo sapiens
aaauauugacaaguuu

SEQ ID NO: 401183 - RNA, 22 nt, Homo sapiens
aaauauuuaaaaaaaaacauuc

SEQ ID NO: 401184 - RNA, 23 nt, Homo sapiens
aaauauuuaugaccucaacaaag

SEQ ID NO: 401185 - RNA, 16 nt, Homo sapiens
aaauauuuccuuaaac

SEQ ID NO: 401186 - RNA, 15 nt, Homo sapiens
aaaucaaugucacuu

SEQ ID NO: 401187 - RNA, 19 nt, Homo sapiens
aaaucacgccgcaugcaca

SEQ ID NO: 401188 - RNA, 15 nt, Homo sapiens
aaaucauuguagaaa

SEQ ID NO: 401189 - RNA, 21 nt, Homo sapiens
aaaucauuucaguaucaucuc

SEQ ID NO: 401190 - RNA, 22 nt, Homo sapiens
aaaucauuucaguaucaucucc

SEQ ID NO: 401191 - RNA, 16 nt, Homo sapiens
aaaucccaacauuucu

SEQ ID NO: 401192 - RNA, 13 nt, Homo sapiens
aaauccuuccaaa

SEQ ID NO: 401193 - RNA, 21 nt, Homo sapiens
aaaucucagaacagucugaaa

SEQ ID NO: 401194 - RNA, 16 nt, Homo sapiens
aaaucuccaauccaca

SEQ ID NO: 401195 - RNA, 12 nt, Homo sapiens
aaaucuccagug

SEQ ID NO: 401196 - RNA, 20 nt, Homo sapiens
aaaucuguauugcuaagaua

SEQ ID NO: 401197 - RNA, 16 nt, Homo sapiens
aaaucuuuccaucuca

SEQ ID NO: 401198 - RNA, 15 nt, Homo sapiens
aaaugaaaauguuuc

SEQ ID NO: 401199 - RNA, 19 nt, Homo sapiens
aaaugaaacaaauaaucac

SEQ ID NO: 401200 - RNA, 15 nt, Homo sapiens
aaaugaaagcaugug

SEQ ID NO: 401201 - RNA, 15 nt, Homo sapiens
aaaugaaucuucaca

SEQ ID NO: 401202 - RNA, 13 nt, Homo sapiens
aaaugaccaguuu

SEQ ID NO: 401203 - RNA, 15 nt, Homo sapiens
aaaugagaacaugaa

SEQ ID NO: 401204 - RNA, 12 nt, Homo sapiens
aaaugagacaaa

SEQ ID NO: 401205 - RNA, 11 nt, Homo sapiens
aaaugagccac

SEQ ID NO: 401206 - RNA, 20 nt, Homo sapiens
aaaugagccuuucugccuca

SEQ ID NO: 401207 - RNA, 17 nt, Homo sapiens
aaaugagugccacaaaa

SEQ ID NO: 401208 - RNA, 17 nt, Homo sapiens
aaaugaucgcuaucuag

SEQ ID NO: 401209 - RNA, 18 nt, Homo sapiens
aaaugcacauuugucacu

SEQ ID NO: 401210 - RNA, 19 nt, Homo sapiens
aaaugccaggacagcugca

SEQ ID NO: 401211 - RNA, 19 nt, Homo sapiens
aaaugccucugccuugaug

SEQ ID NO: 401212 - RNA, 19 nt, Homo sapiens
aaaugccugguaccagagg

SEQ ID NO: 401213 - RNA, 13 nt, Homo sapiens
aaaugcugugcaa

SEQ ID NO: 401214 - RNA, 20 nt, Homo sapiens
aaaugcugugcaaacagugu

SEQ ID NO: 401215 - RNA, 10 nt, Homo sapiens
aaauggaaca

SEQ ID NO: 401216 - RNA, 12 nt, Homo sapiens
aaauggaacaau

SEQ ID NO: 401217 - RNA, 16 nt, Homo sapiens
aaauggaggaauauga

SEQ ID NO: 401218 - RNA, 15 nt, Homo sapiens
aaauggcagaaccaa

SEQ ID NO: 401219 - RNA, 20 nt, Homo sapiens
aaauggcuuuccacaucccc

SEQ ID NO: 401220 - RNA, 23 nt, Homo sapiens
aaaugggcacaguaugcuccuua

SEQ ID NO: 401221 - RNA, 20 nt, Homo sapiens
aaaugggguggaauagggaa

SEQ ID NO: 401222 - RNA, 15 nt, Homo sapiens
aaauguaaagacaaa

SEQ ID NO: 401223 - RNA, 15 nt, Homo sapiens
aaauguaauugaaua

SEQ ID NO: 401224 - RNA, 22 nt, Homo sapiens
aaauguacucagcuaucagcuc

SEQ ID NO: 401225 - RNA, 22 nt, Homo sapiens
aaauguagcccugcauccucca

SEQ ID NO: 401226 - RNA, 17 nt, Homo sapiens
aaauguagguaugaaua

SEQ ID NO: 401227 - RNA, 19 nt, Homo sapiens
aaauguauucaaauaccaa

SEQ ID NO: 401228 - RNA, 21 nt, Homo sapiens
aaaugugucugcaacauggau

SEQ ID NO: 401229 - RNA, 19 nt, Homo sapiens
aaauguuaaagaacugcuu

SEQ ID NO: 401230 - RNA, 19 nt, Homo sapiens
aaauguuaacagaguuuga

SEQ ID NO: 401231 - RNA, 22 nt, Homo sapiens
aaauguuauuuuuuaauuauua

SEQ ID NO: 401232 - RNA, 23 nt, Homo sapiens
aaauguuccauauguggguguca

SEQ ID NO: 401233 - RNA, 12 nt, Homo sapiens
aaauguuugaua

SEQ ID NO: 401234 - RNA, 19 nt, Homo sapiens
aaauuaaaccaagcagcuu

SEQ ID NO: 401235 - RNA, 22 nt, Homo sapiens
aaauuaccccggggcacccuua

SEQ ID NO: 401236 - RNA, 13 nt, Homo sapiens
aaauuagcuugag

SEQ ID NO: 401237 - RNA, 14 nt, Homo sapiens
aaauuauaguuuca

SEQ ID NO: 401238 - RNA, 14 nt, Homo sapiens
aaauuaucuuuaaa

SEQ ID NO: 401239 - RNA, 13 nt, Homo sapiens
aaauucacaaagu

SEQ ID NO: 401240 - RNA, 22 nt, Homo sapiens
aaauucauuuuuuucacuggag

SEQ ID NO: 401241 - RNA, 20 nt, Homo sapiens
aaauuccacacuaccacauu

SEQ ID NO: 401242 - RNA, 15 nt, Homo sapiens
aaauuccucuguaga

SEQ ID NO: 401243 - RNA, 18 nt, Homo sapiens
aaauuccuguugucugac

SEQ ID NO: 401244 - RNA, 20 nt, Homo sapiens
aaauucuauaggaacauaug

SEQ ID NO: 401245 - RNA, 23 nt, Homo sapiens
aaauucucagucaugcacucaca

SEQ ID NO: 401246 - RNA, 19 nt, Homo sapiens
aaauucuccaacccaaagu

SEQ ID NO: 401247 - RNA, 21 nt, Homo sapiens
aaauucucuuuccuguagucc

SEQ ID NO: 401248 - RNA, 17 nt, Homo sapiens
aaauucuugaaguucau

SEQ ID NO: 401249 - RNA, 16 nt, Homo sapiens
aaauugcagaagcagg

SEQ ID NO: 401250 - RNA, 15 nt, Homo sapiens
aaauugcuccuugac

SEQ ID NO: 401251 - RNA, 18 nt, Homo sapiens
aaauuuacguauauuuca

SEQ ID NO: 401252 - RNA, 23 nt, Homo sapiens
aaauuuccaggggccucccaagg

SEQ ID NO: 401253 - RNA, 23 nt, Homo sapiens
aaauuuccaguaccuuugucaca

SEQ ID NO: 401254 - RNA, 23 nt, Homo sapiens
aaauuuguaccucuaaguacaua

SEQ ID NO: 401255 - RNA, 21 nt, Homo sapiens
aaauuuuaauguaaaauucau

SEQ ID NO: 401256 - RNA, 21 nt, Homo sapiens
aaauuuuagcguuaaagucag

SEQ ID NO: 401257 - RNA, 23 nt, Homo sapiens
aaauuuucuuuuuauacuauuaa

SEQ ID NO: 401258 - RNA, 13 nt, Homo sapiens
aaauuuugugaua

SEQ ID NO: 401259 - RNA, 17 nt, Homo sapiens
aaauuuuugaaauucaa

SEQ ID NO: 401260 - RNA, 20 nt, Homo sapiens
aaauuuuuuaaaaagcaaaa

SEQ ID NO: 401261 - RNA, 14 nt, Homo sapiens
aacaaaacagcagc

SEQ ID NO: 401262 - RNA, 19 nt, Homo sapiens
aacaaagaaauaauggucu

SEQ ID NO: 401263 - RNA, 14 nt, Homo sapiens
aacaaagacaacca

SEQ ID NO: 401264 - RNA, 17 nt, Homo sapiens
aacaaagccuuauccag

SEQ ID NO: 401265 - RNA, 12 nt, Homo sapiens
aacaaaguaaua

SEQ ID NO: 401266 - RNA, 12 nt, Homo sapiens
aacaaauaugca

SEQ ID NO: 401267 - RNA, 19 nt, Homo sapiens
aacaaaugauuuacacuga

SEQ ID NO: 401268 - RNA, 21 nt, Homo sapiens
aacaacacgauuuacauaaaa

SEQ ID NO: 401269 - RNA, 19 nt, Homo sapiens
aacaaccuggucacaggac

SEQ ID NO: 401270 - RNA, 13 nt, Homo sapiens
aacaacucuaguc

SEQ ID NO: 401271 - RNA, 18 nt, Homo sapiens
aacaacucuccagugccu

SEQ ID NO: 401272 - RNA, 18 nt, Homo sapiens
aacaagcuccaccuucca

SEQ ID NO: 401273 - RNA, 17 nt, Homo sapiens
aacaaguagcacacuga

SEQ ID NO: 401274 - RNA, 22 nt, Homo sapiens
aacaauaaacgaaacacagaac

SEQ ID NO: 401275 - RNA, 14 nt, Homo sapiens
aacaauaacacugc

SEQ ID NO: 401276 - RNA, 18 nt, Homo sapiens
aacaauccaaaugcauuc

SEQ ID NO: 401277 - RNA, 19 nt, Homo sapiens
aacaaucuuagacauuuau

SEQ ID NO: 401278 - RNA, 13 nt, Homo sapiens
aacaaugaagaua

SEQ ID NO: 401279 - RNA, 15 nt, Homo sapiens
aacaaugaauugaau

SEQ ID NO: 401280 - RNA, 21 nt, Homo sapiens
aacaaugccuuguuguauucc

SEQ ID NO: 401281 - RNA, 22 nt, Homo sapiens
aacaaugccuuguuguauuccu

SEQ ID NO: 401282 - RNA, 15 nt, Homo sapiens
aacaauuuggucuua

SEQ ID NO: 401283 - RNA, 23 nt, Homo sapiens
aacaauuuggucuuagcuuuaca

SEQ ID NO: 401284 - RNA, 23 nt, Homo sapiens
aacaauuuuaggaggaccagagc

SEQ ID NO: 401285 - RNA, 13 nt, Homo sapiens
aacacaaauccaa

SEQ ID NO: 401286 - RNA, 13 nt, Homo sapiens
aacacaacaucuu

SEQ ID NO: 401287 - RNA, 14 nt, Homo sapiens
aacacaaccacuca

SEQ ID NO: 401288 - RNA, 22 nt, Homo sapiens
aacacaagagacuuaaaggaca

SEQ ID NO: 401289 - RNA, 15 nt, Homo sapiens
aacacaauguuauuc

SEQ ID NO: 401290 - RNA, 22 nt, Homo sapiens
aacacacagacccaagauucau

SEQ ID NO: 401291 - RNA, 12 nt, Homo sapiens
aacacacaugca

SEQ ID NO: 401292 - RNA, 21 nt, Homo sapiens
aacacaguuuagugcuuuaca

SEQ ID NO: 401293 - RNA, 13 nt, Homo sapiens
augcuauauugca

SEQ ID NO: 401294 - RNA, 13 nt, Homo sapiens
augcucaguauug

SEQ ID NO: 401295 - RNA, 21 nt, Homo sapiens
augcucaguuggugcugcuuu

SEQ ID NO: 401296 - RNA, 16 nt, Homo sapiens
augcugcaauacauua

SEQ ID NO: 401297 - RNA, 15 nt, Homo sapiens
augcugccuaggguu

SEQ ID NO: 401298 - RNA, 18 nt, Homo sapiens
augcugccuucucugggc

SEQ ID NO: 401299 - RNA, 15 nt, Homo sapiens
augcugucccuuacg

SEQ ID NO: 401300 - RNA, 18 nt, Homo sapiens
augcugugcaaacagugu

SEQ ID NO: 401301 - RNA, 15 nt, Homo sapiens
augcugugcucuuug

SEQ ID NO: 401302 - RNA, 15 nt, Homo sapiens
augcuguuggccuca

SEQ ID NO: 401303 - RNA, 16 nt, Homo sapiens
augcuuauaagcaaca

SEQ ID NO: 401304 - RNA, 20 nt, Homo sapiens
augcuucaguuguacuucca

SEQ ID NO: 401305 - RNA, 13 nt, Homo sapiens
augcuucugagag

SEQ ID NO: 401306 - RNA, 22 nt, Homo sapiens
augcuucugagagcaaagggaa

SEQ ID NO: 401307 - RNA, 17 nt, Homo sapiens
augcuuggcuaacuaua

SEQ ID NO: 401308 - RNA, 11 nt, Homo sapiens
augcuuuacaa

SEQ ID NO: 401309 - RNA, 14 nt, Homo sapiens
augcuuuucuaauc

SEQ ID NO: 401310 - RNA, 23 nt, Homo sapiens
augcuuuugguccagguacugag

SEQ ID NO: 401311 - RNA, 17 nt, Homo sapiens
auggaaaacugccuguu

SEQ ID NO: 401312 - RNA, 17 nt, Homo sapiens
auggaaagguccugcug

SEQ ID NO: 401313 - RNA, 23 nt, Homo sapiens
auggaaagguccugcuguggaaa

SEQ ID NO: 401314 - RNA, 15 nt, Homo sapiens
auggaaggccagcuu

SEQ ID NO: 401315 - RNA, 15 nt, Homo sapiens
auggaaggccuuuug

SEQ ID NO: 401316 - RNA, 18 nt, Homo sapiens
auggaagggccuucucca

SEQ ID NO: 401317 - RNA, 23 nt, Homo sapiens
auggaaguugcagugagcugaua

SEQ ID NO: 401318 - RNA, 16 nt, Homo sapiens
auggaauagcaccugg

SEQ ID NO: 401319 - RNA, 15 nt, Homo sapiens
auggaaucauauagu

SEQ ID NO: 401320 - RNA, 14 nt, Homo sapiens
auggaauuacaugu

SEQ ID NO: 401321 - RNA, 18 nt, Homo sapiens
auggacaugaucuucuuu

SEQ ID NO: 401322 - RNA, 20 nt, Homo sapiens
auggacucgcuagugauuaa

SEQ ID NO: 401323 - RNA, 14 nt, Homo sapiens
auggacucuucccc

SEQ ID NO: 401324 - RNA, 15 nt, Homo sapiens
auggacugcacaaaa

SEQ ID NO: 401325 - RNA, 16 nt, Homo sapiens
auggacugcuucaucu

SEQ ID NO: 401326 - RNA, 17 nt, Homo sapiens
auggagacuccaugaga

SEQ ID NO: 401327 - RNA, 17 nt, Homo sapiens
auggagagagccuuaua

SEQ ID NO: 401328 - RNA, 18 nt, Homo sapiens
auggagaguuacauguua

SEQ ID NO: 401329 - RNA, 21 nt, Homo sapiens
auggagauauuuacaugaauu

SEQ ID NO: 401330 - RNA, 17 nt, Homo sapiens
auggagcaaaacaaagc

SEQ ID NO: 401331 - RNA, 17 nt, Homo sapiens
auggagcaugaauggua

SEQ ID NO: 401332 - RNA, 21 nt, Homo sapiens
auggagcuguauaacugugca

SEQ ID NO: 401333 - RNA, 21 nt, Homo sapiens
auggagcuugacuucaugcca

SEQ ID NO: 401334 - RNA, 14 nt, Homo sapiens
auggaggcacacag

SEQ ID NO: 401335 - RNA, 16 nt, Homo sapiens
auggaggcacacagcu

SEQ ID NO: 401336 - RNA, 16 nt, Homo sapiens
auggaguggcugccau

SEQ ID NO: 401337 - RNA, 19 nt, Homo sapiens
auguucuuggaacauggaa

SEQ ID NO: 401338 - RNA, 19 nt, Homo sapiens
auguucuuuaaaggcaucu

SEQ ID NO: 401339 - RNA, 17 nt, Homo sapiens
auguucuuucacccuuu

SEQ ID NO: 401340 - RNA, 17 nt, Homo sapiens
auguugcacaacacaga

SEQ ID NO: 401341 - RNA, 12 nt, Homo sapiens
auguugcuuaga

SEQ ID NO: 401342 - RNA, 23 nt, Homo sapiens
auguugcuuucuuaucccaguga

SEQ ID NO: 401343 - RNA, 17 nt, Homo sapiens
auguugcuuuugcaccu

SEQ ID NO: 401344 - RNA, 17 nt, Homo sapiens
auguugggaagcuauuu

SEQ ID NO: 401345 - RNA, 19 nt, Homo sapiens
auguugguuacaugaauga

SEQ ID NO: 401346 - RNA, 13 nt, Homo sapiens
auguuguguuguu

SEQ ID NO: 401347 - RNA, 20 nt, Homo sapiens
auguuuaauaucugacugaa

SEQ ID NO: 401348 - RNA, 12 nt, Homo sapiens
auguuugcacac

SEQ ID NO: 401349 - RNA, 17 nt, Homo sapiens
auguuugcuauugacaa

SEQ ID NO: 401350 - RNA, 19 nt, Homo sapiens
auguuuuacuuuucacagu

SEQ ID NO: 401351 - RNA, 22 nt, Homo sapiens
auguuuuaugguagcuuuuacu

SEQ ID NO: 401352 - RNA, 18 nt, Homo sapiens
auguuuugaaauguacca

SEQ ID NO: 401353 - RNA, 14 nt, Homo sapiens
auguuuuucuucau

SEQ ID NO: 401354 - RNA, 16 nt, Homo sapiens
auuaaaacacuuucaa

SEQ ID NO: 401355 - RNA, 14 nt, Homo sapiens
auuaaaaccagaga

SEQ ID NO: 401356 - RNA, 13 nt, Homo sapiens
auuaaaagaaucc

SEQ ID NO: 401357 - RNA, 20 nt, Homo sapiens
auuaaaccaaggagucugau

SEQ ID NO: 401358 - RNA, 19 nt, Homo sapiens
auuaaacuugucagaauuu

SEQ ID NO: 401359 - RNA, 20 nt, Homo sapiens
auuaaacuugucagaauuuc

SEQ ID NO: 401360 - RNA, 17 nt, Homo sapiens
auuaaauacagacacua

SEQ ID NO: 401361 - RNA, 19 nt, Homo sapiens
auuaacaacaauaacacug

SEQ ID NO: 401362 - RNA, 20 nt, Homo sapiens
auuaacaacaauaacacugu

SEQ ID NO: 401363 - RNA, 19 nt, Homo sapiens
auuaacaguuuuccaugaa

SEQ ID NO: 401364 - RNA, 22 nt, Homo sapiens
auuaaccucugcacuacugaca

SEQ ID NO: 401365 - RNA, 17 nt, Homo sapiens
auuaacuaauaugggca

SEQ ID NO: 401366 - RNA, 18 nt, Homo sapiens
auuaacucugcauagaca

SEQ ID NO: 401367 - RNA, 16 nt, Homo sapiens
auuaacugaauucuga

SEQ ID NO: 401368 - RNA, 13 nt, Homo sapiens
auuaagacuuuaa

SEQ ID NO: 401369 - RNA, 17 nt, Homo sapiens
auuaaguaugauugaca

SEQ ID NO: 401370 - RNA, 18 nt, Homo sapiens
auuaauacauaaguuaau

SEQ ID NO: 401371 - RNA, 13 nt, Homo sapiens
auuaauacugaag

SEQ ID NO: 401372 - RNA, 18 nt, Homo sapiens
auuaaucaaggcauaaaa

SEQ ID NO: 401373 - RNA, 14 nt, Homo sapiens
auuaaucaccucuc

SEQ ID NO: 401374 - RNA, 19 nt, Homo sapiens
auuaauccacaaauaugcu

SEQ ID NO: 401375 - RNA, 13 nt, Homo sapiens
auuaauucacaug

SEQ ID NO: 401376 - RNA, 19 nt, Homo sapiens
auuaauuccaacuguacuu

SEQ ID NO: 401377 - RNA, 21 nt, Homo sapiens
auuacaacugcuacagagcag

SEQ ID NO: 401378 - RNA, 23 nt, Homo sapiens
auuacaggcgugagccacugcgc

SEQ ID NO: 401379 - RNA, 17 nt, Homo sapiens
auuacaggcgugaucca

SEQ ID NO: 401380 - RNA, 19 nt, Homo sapiens
auuacaguggauugcucau

SEQ ID NO: 401381 - RNA, 20 nt, Homo sapiens
auuacaucuuuauuaaccuc

SEQ ID NO: 401382 - RNA, 18 nt, Homo sapiens
auuacauggggucuagaa

SEQ ID NO: 401383 - RNA, 17 nt, Homo sapiens
auuaccaucuuaaucuu

SEQ ID NO: 401384 - RNA, 13 nt, Homo sapiens
auuaccuauucaa

SEQ ID NO: 401385 - RNA, 15 nt, Homo sapiens
auuacucuacuguuc

SEQ ID NO: 401386 - RNA, 18 nt, Homo sapiens
auuacugaugugugcaac

SEQ ID NO: 401387 - RNA, 20 nt, Homo sapiens
auuacuguugcauuuacuuu

SEQ ID NO: 401388 - RNA, 23 nt, Homo sapiens
auuagaagaaaauggaugacaaa

SEQ ID NO: 401389 - RNA, 22 nt, Homo sapiens
auuagaagccugcagaauccag

SEQ ID NO: 401390 - RNA, 13 nt, Homo sapiens
auuagaaugcaug

SEQ ID NO: 401391 - RNA, 14 nt, Homo sapiens
auuagaaugcaugu

SEQ ID NO: 401392 - RNA, 16 nt, Homo sapiens
auuagacauaccucuc

SEQ ID NO: 401393 - RNA, 16 nt, Homo sapiens
auuagaggauugcacu

SEQ ID NO: 401394 - RNA, 21 nt, Homo sapiens
auuagauuuuaaaacuucauc

SEQ ID NO: 401395 - RNA, 17 nt, Homo sapiens
auuagcaacgccugccu

SEQ ID NO: 401396 - RNA, 11 nt, Homo sapiens
auuagcacuac

SEQ ID NO: 401397 - RNA, 14 nt, Homo sapiens
auuagcacuaccau

SEQ ID NO: 401398 - RNA, 22 nt, Homo sapiens
auuagcauucugguuuugacau

SEQ ID NO: 401399 - RNA, 16 nt, Homo sapiens
auuagcccacugccug

SEQ ID NO: 401400 - RNA, 18 nt, Homo sapiens
auuagccggguguggcac

SEQ ID NO: 401401 - RNA, 18 nt, Homo sapiens
auuagcucucaucuaguu

SEQ ID NO: 401402 - RNA, 23 nt, Homo sapiens
auuagcuguaaauacaugugugg

SEQ ID NO: 401403 - RNA, 17 nt, Homo sapiens
auuauacagaccuaaua

SEQ ID NO: 401404 - RNA, 17 nt, Homo sapiens
auuauagaaguuuagau

SEQ ID NO: 401405 - RNA, 15 nt, Homo sapiens
auuauagauacuuaa

SEQ ID NO: 401406 - RNA, 17 nt, Homo sapiens
auuauagauacuuaaag

SEQ ID NO: 401407 - RNA, 17 nt, Homo sapiens
auuauauugagacaaaa

SEQ ID NO: 401408 - RNA, 12 nt, Homo sapiens
auuaucauccca

SEQ ID NO: 401409 - RNA, 21 nt, Homo sapiens
auuaucgggagcagugucuuc

SEQ ID NO: 401410 - RNA, 19 nt, Homo sapiens
auuaucuaaaaucugcuag

SEQ ID NO: 401411 - RNA, 17 nt, Homo sapiens
auuaucuauacauaaaa

SEQ ID NO: 401412 - RNA, 17 nt, Homo sapiens
auuaucugugauggaug

SEQ ID NO: 401413 - RNA, 13 nt, Homo sapiens
auuaugcuaacaa

SEQ ID NO: 401414 - RNA, 21 nt, Homo sapiens
auuauggaaguuuucuucuau

SEQ ID NO: 401415 - RNA, 21 nt, Homo sapiens
auuauggaauuacucuacugu

SEQ ID NO: 401416 - RNA, 19 nt, Homo sapiens
auuauggcuuugugcuugu

SEQ ID NO: 401417 - RNA, 13 nt, Homo sapiens
auuauguauaaca

SEQ ID NO: 401418 - RNA, 18 nt, Homo sapiens
auuauguauuggcauuua

SEQ ID NO: 401419 - RNA, 19 nt, Homo sapiens
auuauguggaagaagcaaa

SEQ ID NO: 401420 - RNA, 17 nt, Homo sapiens
auuauuacuccuugcca

SEQ ID NO: 401421 - RNA, 18 nt, Homo sapiens
auuauuacuccuugccau

SEQ ID NO: 401422 - RNA, 18 nt, Homo sapiens
auuauucagaauuauaca

SEQ ID NO: 401423 - RNA, 15 nt, Homo sapiens
auuauuccuccagga

SEQ ID NO: 401424 - RNA, 23 nt, Homo sapiens
auuauuccuccaggaaggagcaa

SEQ ID NO: 401425 - RNA, 19 nt, Homo sapiens
auuauuuauucagcuucau

SEQ ID NO: 401426 - RNA, 15 nt, Homo sapiens
auuauuucaauguga

SEQ ID NO: 401427 - RNA, 23 nt, Homo sapiens
auuauuugguauguguuuugcuu

SEQ ID NO: 401428 - RNA, 23 nt, Homo sapiens
auuauuuuuuuaaagaaaacuug

SEQ ID NO: 401429 - RNA, 15 nt, Homo sapiens
auucaaaacuuucag

SEQ ID NO: 401430 - RNA, 13 nt, Homo sapiens
aacucacugugcu

SEQ ID NO: 401431 - RNA, 16 nt, Homo sapiens
aacucagacauuccaa

SEQ ID NO: 401432 - RNA, 17 nt, Homo sapiens
aacucagaucacuacug

SEQ ID NO: 401433 - RNA, 13 nt, Homo sapiens
aacucagccuuaa

SEQ ID NO: 401434 - RNA, 20 nt, Homo sapiens
aacucagcgugaguuacccu

SEQ ID NO: 401435 - RNA, 15 nt, Homo sapiens
aacucaguccugaca

SEQ ID NO: 401436 - RNA, 13 nt, Homo sapiens
aacuccaggguua

SEQ ID NO: 401437 - RNA, 12 nt, Homo sapiens
aacuccaugccu

SEQ ID NO: 401438 - RNA, 15 nt, Homo sapiens
aacucccacccugac

SEQ ID NO: 401439 - RNA, 19 nt, Homo sapiens
aacucccagccaucuguau

SEQ ID NO: 401440 - RNA, 21 nt, Homo sapiens
aacuccugaccucaggugauc

SEQ ID NO: 401441 - RNA, 12 nt, Homo sapiens
aacuccuuccau

SEQ ID NO: 401442 - RNA, 19 nt, Homo sapiens
aacuccuuccauccuugac

SEQ ID NO: 401443 - RNA, 16 nt, Homo sapiens
aacuccuuggccuagc

SEQ ID NO: 401444 - RNA, 23 nt, Homo sapiens
aacuccuuguuucagaugauucu

SEQ ID NO: 401445 - RNA, 13 nt, Homo sapiens
aacucuccccagu

SEQ ID NO: 401446 - RNA, 23 nt, Homo sapiens
aacucucugucuucucuccacuu

SEQ ID NO: 401447 - RNA, 15 nt, Homo sapiens
aacucugggcacuuu

SEQ ID NO: 401448 - RNA, 20 nt, Homo sapiens
aacucugugucccagcaccu

SEQ ID NO: 401449 - RNA, 21 nt, Homo sapiens
aacucuguugguuuacugugu

SEQ ID NO: 401450 - RNA, 17 nt, Homo sapiens
aacucuucaaggccaag

SEQ ID NO: 401451 - RNA, 22 nt, Homo sapiens
aacucuucagccucauucacug

SEQ ID NO: 401452 - RNA, 13 nt, Homo sapiens
aacucuugcucac

SEQ ID NO: 401453 - RNA, 22 nt, Homo sapiens
aacucuuucuggccugccuucg

SEQ ID NO: 401454 - RNA, 22 nt, Homo sapiens
aacucuuugcccaguucauccc

SEQ ID NO: 401455 - RNA, 23 nt, Homo sapiens
aacucuuugcccaguucauccca

SEQ ID NO: 401456 - RNA, 14 nt, Homo sapiens
aacugaaaaccagu

SEQ ID NO: 401457 - RNA, 17 nt, Homo sapiens
aacugaacgacaaagca

SEQ ID NO: 401458 - RNA, 12 nt, Homo sapiens
aacugaagccca

SEQ ID NO: 401459 - RNA, 18 nt, Homo sapiens
aacugagauuacaggcac

SEQ ID NO: 401460 - RNA, 18 nt, Homo sapiens
aacugaucauuugcagcu

SEQ ID NO: 401461 - RNA, 20 nt, Homo sapiens
aacugcuuuaucccacggaa

SEQ ID NO: 401462 - RNA, 22 nt, Homo sapiens
aacuggaaaguacguuaugaua

SEQ ID NO: 401463 - RNA, 16 nt, Homo sapiens
aacuggaauuucgcuc

SEQ ID NO: 401464 - RNA, 20 nt, Homo sapiens
aacuggcuucugcuugucau

SEQ ID NO: 401465 - RNA, 21 nt, Homo sapiens
aacugggggcucuguauauag

SEQ ID NO: 401466 - RNA, 13 nt, Homo sapiens
aacugguccaggc

SEQ ID NO: 401467 - RNA, 22 nt, Homo sapiens
aagauguguugcuauccugaaa

SEQ ID NO: 401468 - RNA, 17 nt, Homo sapiens
aagauuauuuuuuauga

SEQ ID NO: 401469 - RNA, 20 nt, Homo sapiens
aagauuuaccauaagggacu

SEQ ID NO: 401470 - RNA, 14 nt, Homo sapiens
aagauuuucuauua

SEQ ID NO: 401471 - RNA, 19 nt, Homo sapiens
aagcaaacacacagacucu

SEQ ID NO: 401472 - RNA, 17 nt, Homo sapiens
aagcaaaccugauacaa

SEQ ID NO: 401473 - RNA, 23 nt, Homo sapiens
aagcaaauauuuaugaccucaac

SEQ ID NO: 401474 - RNA, 12 nt, Homo sapiens
aagcaacaaaga

SEQ ID NO: 401475 - RNA, 11 nt, Homo sapiens
aagcaaccucc

SEQ ID NO: 401476 - RNA, 17 nt, Homo sapiens
aagcaagcccuggccag

SEQ ID NO: 401477 - RNA, 17 nt, Homo sapiens
aagcaaugcaauuccuc

SEQ ID NO: 401478 - RNA, 21 nt, Homo sapiens
aagcacacggagacgugauga

SEQ ID NO: 401479 - RNA, 19 nt, Homo sapiens
aagcacauaugaacuggac

SEQ ID NO: 401480 - RNA, 22 nt, Homo sapiens
aagcacuggaauucagaugcaa

SEQ ID NO: 401481 - RNA, 14 nt, Homo sapiens
aagcacuguguuua

SEQ ID NO: 401482 - RNA, 18 nt, Homo sapiens
aagcagaguucuuugcaa

SEQ ID NO: 401483 - RNA, 13 nt, Homo sapiens
aagcagccauaaa

SEQ ID NO: 401484 - RNA, 13 nt, Homo sapiens
aagcagccuccac

SEQ ID NO: 401485 - RNA, 15 nt, Homo sapiens
aagcaggccuuuuga

SEQ ID NO: 401486 - RNA, 16 nt, Homo sapiens
aagcaguagacaaucc

SEQ ID NO: 401487 - RNA, 17 nt, Homo sapiens
aagcagucuuuuucuac

SEQ ID NO: 401488 - RNA, 21 nt, Homo sapiens
aagcagugccucgaggcaccg

SEQ ID NO: 401489 - RNA, 18 nt, Homo sapiens
aagcagugccuuccauaa

SEQ ID NO: 401490 - RNA, 22 nt, Homo sapiens
aagcauaauguugaacauucau

SEQ ID NO: 401491 - RNA, 17 nt, Homo sapiens
aagcaucacacaguggc

SEQ ID NO: 401492 - RNA, 21 nt, Homo sapiens
aagcaucucauuuugaguaga

SEQ ID NO: 401493 - RNA, 15 nt, Homo sapiens
aagcaugaaaaagca

SEQ ID NO: 401494 - RNA, 15 nt, Homo sapiens
aagcaugaguggccu

SEQ ID NO: 401495 - RNA, 20 nt, Homo sapiens
aagcauugccagcucuucca

SEQ ID NO: 401496 - RNA, 22 nt, Homo sapiens
aagcauuucuagcagugaugaa

SEQ ID NO: 401497 - RNA, 17 nt, Homo sapiens
aagcauuuuugaucaaa

SEQ ID NO: 401498 - RNA, 20 nt, Homo sapiens
aagcauuuuuucauauucug

SEQ ID NO: 401499 - RNA, 11 nt, Homo sapiens
aagccaagaca

SEQ ID NO: 401500 - RNA, 20 nt, Homo sapiens
aagccagacagcaacgggga

SEQ ID NO: 401501 - RNA, 20 nt, Homo sapiens
aagccagcugcagcugggcu

SEQ ID NO: 401502 - RNA, 22 nt, Homo sapiens
aagccauagagccccuccuggu

SEQ ID NO: 401503 - RNA, 15 nt, Homo sapiens
aagcccaauauuaua

SEQ ID NO: 401504 - RNA, 14 nt, Homo sapiens
aagcccaguagcca

SEQ ID NO: 401505 - RNA, 19 nt, Homo sapiens
aagcccuccaaaagcacuu

SEQ ID NO: 401506 - RNA, 23 nt, Homo sapiens
aagccgccaggaccgccaaagaa

SEQ ID NO: 401507 - RNA, 14 nt, Homo sapiens
aagccguuggcacc

SEQ ID NO: 401508 - RNA, 16 nt, Homo sapiens
aagccuaugugccuuu

SEQ ID NO: 401509 - RNA, 23 nt, Homo sapiens
aagccucagcaacagccagugga

SEQ ID NO: 401510 - RNA, 24 nt, Homo sapiens
aagccuccugcccccugccaguga

SEQ ID NO: 401511 - RNA, 16 nt, Homo sapiens
aagccucugugcugca

SEQ ID NO: 401512 - RNA, 12 nt, Homo sapiens
aagccugagucc

SEQ ID NO: 401513 - RNA, 16 nt, Homo sapiens
aagccugaguccaguu

SEQ ID NO: 401514 - RNA, 18 nt, Homo sapiens
aagccugcugauuucuac

SEQ ID NO: 401515 - RNA, 22 nt, Homo sapiens
aagccugggcagaaaugugcug

SEQ ID NO: 401516 - RNA, 14 nt, Homo sapiens
aagccuguccucac

SEQ ID NO: 401517 - RNA, 23 nt, Homo sapiens
aagccugucucuuuccacuuugu

SEQ ID NO: 401518 - RNA, 15 nt, Homo sapiens
aagccuguugcugaa

SEQ ID NO: 401519 - RNA, 18 nt, Homo sapiens
aagccuuaaaaugcauug

SEQ ID NO: 401520 - RNA, 13 nt, Homo sapiens
aagcgagcacagu

SEQ ID NO: 401521 - RNA, 17 nt, Homo sapiens
aagcgauucucaugccu

SEQ ID NO: 401522 - RNA, 19 nt, Homo sapiens
aagcguaauuuugccaaau

SEQ ID NO: 401523 - RNA, 17 nt, Homo sapiens
aagcuaguggcuucaaa

SEQ ID NO: 401524 - RNA, 14 nt, Homo sapiens
aagcuauauaugaa

SEQ ID NO: 401525 - RNA, 18 nt, Homo sapiens
aagcucagagcagccucu

SEQ ID NO: 401526 - RNA, 21 nt, Homo sapiens
aagcucaguuaaaucccccac

SEQ ID NO: 401527 - RNA, 14 nt, Homo sapiens
aagcuggagugcug

SEQ ID NO: 401528 - RNA, 14 nt, Homo sapiens
aagcugucuuagag

SEQ ID NO: 401529 - RNA, 15 nt, Homo sapiens
aagcuuaaauugcuu

SEQ ID NO: 401530 - RNA, 19 nt, Homo sapiens
aagcuuccuagcuuaucuc

SEQ ID NO: 401531 - RNA, 20 nt, Homo sapiens
aagcuuggugcuaaaccaca

SEQ ID NO: 401532 - RNA, 15 nt, Homo sapiens
aagcuuuaggaugac

SEQ ID NO: 401533 - RNA, 20 nt, Homo sapiens
aaggaaaagacugaaucuac

SEQ ID NO: 401534 - RNA, 14 nt, Homo sapiens
aaggaaagcagugu

SEQ ID NO: 401535 - RNA, 14 nt, Homo sapiens
aaggaaaguuauuu

SEQ ID NO: 401536 - RNA, 15 nt, Homo sapiens
aaggaaaucucaccc

SEQ ID NO: 401537 - RNA, 21 nt, Homo sapiens
aaggacccuauauguggcauu

SEQ ID NO: 401538 - RNA, 23 nt, Homo sapiens
aaggacccuauauguggcauucc

SEQ ID NO: 401539 - RNA, 20 nt, Homo sapiens
aaggacucugcuucagucca

SEQ ID NO: 401540 - RNA, 22 nt, Homo sapiens
aaggacugccgaccgaggcugg

SEQ ID NO: 401541 - RNA, 15 nt, Homo sapiens
aaggacuuugcagcc

SEQ ID NO: 401542 - RNA, 15 nt, Homo sapiens
aaggagaaaggcaug

SEQ ID NO: 401543 - RNA, 23 nt, Homo sapiens
aaggagagcccaggccugcccuc

SEQ ID NO: 401544 - RNA, 17 nt, Homo sapiens
aaggaguaaguacaaau

SEQ ID NO: 401545 - RNA, 18 nt, Homo sapiens
aaggagugcccgccuuga

SEQ ID NO: 401546 - RNA, 19 nt, Homo sapiens
aaggauaugagccuuugca

SEQ ID NO: 401547 - RNA, 17 nt, Homo sapiens
aaggauaugcaguaugc

SEQ ID NO: 401548 - RNA, 23 nt, Homo sapiens
aaggauauuuaagaaaauacaau

SEQ ID NO: 401549 - RNA, 18 nt, Homo sapiens
aaggauccucuccacucc

SEQ ID NO: 401550 - RNA, 20 nt, Homo sapiens
aaggauccucuccacuccau

SEQ ID NO: 401551 - RNA, 20 nt, Homo sapiens
aaggaucucuauaacagauc

SEQ ID NO: 401552 - RNA, 22 nt, Homo sapiens
aaggaucuucccacuuugccac

SEQ ID NO: 401553 - RNA, 23 nt, Homo sapiens
aaggauggagccagcucugcauu

SEQ ID NO: 401554 - RNA, 23 nt, Homo sapiens
aaggauuauauguauuaauacuu

SEQ ID NO: 401555 - RNA, 15 nt, Homo sapiens
aaggcacacugagca

SEQ ID NO: 401556 - RNA, 23 nt, Homo sapiens
aaggcacccgcccuuuccuugcc

SEQ ID NO: 401557 - RNA, 19 nt, Homo sapiens
aaggcaggaggaucacuug

SEQ ID NO: 401558 - RNA, 20 nt, Homo sapiens
aaggcaggaggaucacuuga

SEQ ID NO: 401559 - RNA, 15 nt, Homo sapiens
aaggcaguaugccaa

SEQ ID NO: 401560 - RNA, 13 nt, Homo sapiens
aaggcaguccaga

SEQ ID NO: 401561 - RNA, 20 nt, Homo sapiens
aaggcaucuaagacauucac

SEQ ID NO: 401562 - RNA, 19 nt, Homo sapiens
aaggcaucuacacaauuua

SEQ ID NO: 401563 - RNA, 15 nt, Homo sapiens
aaggcauuucuauca

SEQ ID NO: 401564 - RNA, 19 nt, Homo sapiens
aaggcuugaaguaaccuua

SEQ ID NO: 401565 - RNA, 16 nt, Homo sapiens
auuuaauauacugcau

SEQ ID NO: 401566 - RNA, 19 nt, Homo sapiens
auuuacaaaauuacacagu

SEQ ID NO: 401567 - RNA, 14 nt, Homo sapiens
auuuacacugacug

SEQ ID NO: 401568 - RNA, 16 nt, Homo sapiens
auuuacagugccugua

SEQ ID NO: 401569 - RNA, 20 nt, Homo sapiens
auuuacauacucugcuuaga

SEQ ID NO: 401570 - RNA, 14 nt, Homo sapiens
auuuacaugugauu

SEQ ID NO: 401571 - RNA, 17 nt, Homo sapiens
auuuaccugaagucuuu

SEQ ID NO: 401572 - RNA, 13 nt, Homo sapiens
auuuacuacuuau

SEQ ID NO: 401573 - RNA, 19 nt, Homo sapiens
auuuagaaaaaaguuuaca

SEQ ID NO: 401574 - RNA, 20 nt, Homo sapiens
auuuagaaaaaaguuuacaa

SEQ ID NO: 401575 - RNA, 22 nt, Homo sapiens
auuuaggccagggucucacuga

SEQ ID NO: 401576 - RNA, 22 nt, Homo sapiens
auuuagguugcacauucacuga

SEQ ID NO: 401577 - RNA, 15 nt, Homo sapiens
auuuaguuggaauau

SEQ ID NO: 401578 - RNA, 23 nt, Homo sapiens
auuuauaaaugagcaaauggaac

SEQ ID NO: 401579 - RNA, 21 nt, Homo sapiens
auuuauaaauuugaaauccaa

SEQ ID NO: 401580 - RNA, 14 nt, Homo sapiens
auuuaucacacaaa

SEQ ID NO: 401581 - RNA, 21 nt, Homo sapiens
auuuaucuuccauaugcucuu

SEQ ID NO: 401582 - RNA, 13 nt, Homo sapiens
auuuaugaccuca

SEQ ID NO: 401583 - RNA, 19 nt, Homo sapiens
auuuauggucaacacuuaa

SEQ ID NO: 401584 - RNA, 16 nt, Homo sapiens
auuucaaaacuucaga

SEQ ID NO: 401585 - RNA, 21 nt, Homo sapiens
auuucaccccacagacacuua

SEQ ID NO: 401586 - RNA, 17 nt, Homo sapiens
auuucaccugugacaaa

SEQ ID NO: 401587 - RNA, 15 nt, Homo sapiens
auuucacugacacug

SEQ ID NO: 401588 - RNA, 20 nt, Homo sapiens
auuucagaucauauuucaca

SEQ ID NO: 401589 - RNA, 15 nt, Homo sapiens
auuucagcuaguuaa

SEQ ID NO: 401590 - RNA, 16 nt, Homo sapiens
auuucagggcugggcu

SEQ ID NO: 401591 - RNA, 23 nt, Homo sapiens
auuucagguuaaauuaaaccaag

SEQ ID NO: 401592 - RNA, 18 nt, Homo sapiens
auuucagucaucaucuca

SEQ ID NO: 401593 - RNA, 15 nt, Homo sapiens
auuucauaaacaacu

SEQ ID NO: 401594 - RNA, 15 nt, Homo sapiens
auuucaucaugacug

SEQ ID NO: 401595 - RNA, 18 nt, Homo sapiens
auuucauccuguuggcug

SEQ ID NO: 401596 - RNA, 20 nt, Homo sapiens
cacuugugugugggcuguga

SEQ ID NO: 401597 - RNA, 15 nt, Homo sapiens
cacuuuaaaaccucu

SEQ ID NO: 401598 - RNA, 20 nt, Homo sapiens
cacuuuaccuucagcaguua

SEQ ID NO: 401599 - RNA, 17 nt, Homo sapiens
cacuuuauaaauaucaa

SEQ ID NO: 401600 - RNA, 23 nt, Homo sapiens
cacuuucccuagaaagccauauu

SEQ ID NO: 401601 - RNA, 18 nt, Homo sapiens
cacuuuguuucauauucu

SEQ ID NO: 401602 - RNA, 16 nt, Homo sapiens
cagaaaacaagaugag

SEQ ID NO: 401603 - RNA, 19 nt, Homo sapiens
cagaaaacuggcagugcac

SEQ ID NO: 401604 - RNA, 13 nt, Homo sapiens
cagaaaagacacu

SEQ ID NO: 401605 - RNA, 20 nt, Homo sapiens
cagaaaauaaucugguguuc

SEQ ID NO: 401606 - RNA, 22 nt, Homo sapiens
cagaaaauauuauguguuucca

SEQ ID NO: 401607 - RNA, 18 nt, Homo sapiens
cagaaaaucgaccacagu

SEQ ID NO: 401608 - RNA, 17 nt, Homo sapiens
cagaaaccauuguucag

SEQ ID NO: 401609 - RNA, 19 nt, Homo sapiens
cagaaacuaccagauuuga

SEQ ID NO: 401610 - RNA, 22 nt, Homo sapiens
cagaaagaacgugaucuccuga

SEQ ID NO: 401611 - RNA, 19 nt, Homo sapiens
cagaaagagcucuccagaa

SEQ ID NO: 401612 - RNA, 16 nt, Homo sapiens
cagaaagaguucagua

SEQ ID NO: 401613 - RNA, 18 nt, Homo sapiens
cagaaagcaaaucagaca

SEQ ID NO: 401614 - RNA, 18 nt, Homo sapiens
cagaaagggcagcuucag

SEQ ID NO: 401615 - RNA, 21 nt, Homo sapiens
cagaaagugugcuuuaugcug

SEQ ID NO: 401616 - RNA, 17 nt, Homo sapiens
cagaaaucccaguucau

SEQ ID NO: 401617 - RNA, 12 nt, Homo sapiens
cagaaaugugua

SEQ ID NO: 401618 - RNA, 20 nt, Homo sapiens
cagaaauuuuaagccaaaaa

SEQ ID NO: 401619 - RNA, 14 nt, Homo sapiens
cagaacacuguaau

SEQ ID NO: 401620 - RNA, 12 nt, Homo sapiens
cagaacaggaau

SEQ ID NO: 401621 - RNA, 13 nt, Homo sapiens
cagaacagucuga

SEQ ID NO: 401622 - RNA, 15 nt, Homo sapiens
cagaaccccaacucc

SEQ ID NO: 401623 - RNA, 17 nt, Homo sapiens
cagaacucagccuuaag

SEQ ID NO: 401624 - RNA, 21 nt, Homo sapiens
cagaacugggaaaacagugaa

SEQ ID NO: 401625 - RNA, 17 nt, Homo sapiens
cagaacuguuggcugcu

SEQ ID NO: 401626 - RNA, 20 nt, Homo sapiens
cagaacuuaaggauggagcc

SEQ ID NO: 401627 - RNA, 22 nt, Homo sapiens
cagaagacccgcucuccaucuu

SEQ ID NO: 401628 - RNA, 11 nt, Homo sapiens
cagaagaucug

SEQ ID NO: 401629 - RNA, 14 nt, Homo sapiens
cagaagaucugaaa

SEQ ID NO: 401630 - RNA, 23 nt, Homo sapiens
cagaagcaguugagucgucauca

SEQ ID NO: 401631 - RNA, 15 nt, Homo sapiens
cagaagccuccaagc

SEQ ID NO: 401632 - RNA, 13 nt, Homo sapiens
cagaaggacucag

SEQ ID NO: 401633 - RNA, 22 nt, Homo sapiens
cagaaggagggcagagccaugg

SEQ ID NO: 401634 - RNA, 23 nt, Homo sapiens
cagaaggcagagguugcagugag

SEQ ID NO: 401635 - RNA, 18 nt, Homo sapiens
cagaagggggccaugagg

SEQ ID NO: 401636 - RNA, 21 nt, Homo sapiens
cagaauaaauggguaacacug

SEQ ID NO: 401637 - RNA, 19 nt, Homo sapiens
cagaauacaguaagcugcu

SEQ ID NO: 401638 - RNA, 12 nt, Homo sapiens
cagaauccagcu

SEQ ID NO: 401639 - RNA, 20 nt, Homo sapiens
cagaauccucucagagucau

SEQ ID NO: 401640 - RNA, 18 nt, Homo sapiens
cagaaucugcuguugcca

SEQ ID NO: 401641 - RNA, 19 nt, Homo sapiens
cagaauguguuauuuguca

SEQ ID NO: 401642 - RNA, 15 nt, Homo sapiens
cagaauuaguccuca

SEQ ID NO: 401643 - RNA, 12 nt, Homo sapiens
cagaauucauua

SEQ ID NO: 401644 - RNA, 16 nt, Homo sapiens
cagaauugugcaaaug

SEQ ID NO: 401645 - RNA, 18 nt, Homo sapiens
cagaauuuggaagcuaga

SEQ ID NO: 401646 - RNA, 17 nt, Homo sapiens
cagacaaaguaauuccu

SEQ ID NO: 401647 - RNA, 17 nt, Homo sapiens
cagacaauaaaauggaa

SEQ ID NO: 401648 - RNA, 12 nt, Homo sapiens
cagacacacaac

SEQ ID NO: 401649 - RNA, 19 nt, Homo sapiens
cagacacacacacacacaa

SEQ ID NO: 401650 - RNA, 22 nt, Homo sapiens
cagacacacacacgcacgcaca

SEQ ID NO: 401651 - RNA, 16 nt, Homo sapiens
cagacauagacugcaa

SEQ ID NO: 401652 - RNA, 17 nt, Homo sapiens
cagacauagacugcaaa

SEQ ID NO: 401653 - RNA, 12 nt, Homo sapiens
cagacauuccaa

SEQ ID NO: 401654 - RNA, 16 nt, Homo sapiens
cagaccaguacuggga

SEQ ID NO: 401655 - RNA, 20 nt, Homo sapiens
cagaccuagugcucccuucc

SEQ ID NO: 401656 - RNA, 16 nt, Homo sapiens
cagaccucggcugugu

SEQ ID NO: 401657 - RNA, 16 nt, Homo sapiens
cagaccuguucugacc

SEQ ID NO: 401658 - RNA, 19 nt, Homo sapiens
cagaccuguucugaccuca

SEQ ID NO: 401659 - RNA, 15 nt, Homo sapiens
cagaccuucuuccac

SEQ ID NO: 401660 - RNA, 15 nt, Homo sapiens
cagacggacgggaca

SEQ ID NO: 401661 - RNA, 18 nt, Homo sapiens
cagacugcaagugagcaa

SEQ ID NO: 401662 - RNA, 13 nt, Homo sapiens
cagacuuaaauca

SEQ ID NO: 401663 - RNA, 13 nt, Homo sapiens
cagacuucagcug

SEQ ID NO: 401664 - RNA, 19 nt, Homo sapiens
cagagaaauacuuucaggc

SEQ ID NO: 401665 - RNA, 20 nt, Homo sapiens
cagagacuggcagccaggga

SEQ ID NO: 401666 - RNA, 21 nt, Homo sapiens
cagagacuggcagccagggag

SEQ ID NO: 401667 - RNA, 20 nt, Homo sapiens
cagagaggccuuuuguuuaa

SEQ ID NO: 401668 - RNA, 21 nt, Homo sapiens
cagagagggcaccaucacaau

SEQ ID NO: 401669 - RNA, 19 nt, Homo sapiens
cagagaugccaugauauca

SEQ ID NO: 401670 - RNA, 20 nt, Homo sapiens
cagagaugccaugauaucac

SEQ ID NO: 401671 - RNA, 18 nt, Homo sapiens
cagagcaagcacuggacu

SEQ ID NO: 401672 - RNA, 12 nt, Homo sapiens
cagagcacagau

SEQ ID NO: 401673 - RNA, 16 nt, Homo sapiens
cagagcagaaccaaag

SEQ ID NO: 401674 - RNA, 12 nt, Homo sapiens
cagagccaguga

SEQ ID NO: 401675 - RNA, 15 nt, Homo sapiens
cagagccccacuccc

SEQ ID NO: 401676 - RNA, 20 nt, Homo sapiens
cagagcgagacucugucuca

SEQ ID NO: 401677 - RNA, 20 nt, Homo sapiens
cagagcgagauuccgucuca

SEQ ID NO: 401678 - RNA, 11 nt, Homo sapiens
cagagcuccac

SEQ ID NO: 401679 - RNA, 17 nt, Homo sapiens
cagagcucuggagccac

SEQ ID NO: 401680 - RNA, 22 nt, Homo sapiens
cagagcugccucucgguggcca

SEQ ID NO: 401681 - RNA, 15 nt, Homo sapiens
cagagcuggaccagu

SEQ ID NO: 401682 - RNA, 16 nt, Homo sapiens
cagaggagccaugucc

SEQ ID NO: 401683 - RNA, 23 nt, Homo sapiens
cagaggagcggccagaagaucua

SEQ ID NO: 401684 - RNA, 21 nt, Homo sapiens
cagaggaugcugaaguacagu

SEQ ID NO: 401685 - RNA, 17 nt, Homo sapiens
cagaggggcggggccag

SEQ ID NO: 401686 - RNA, 19 nt, Homo sapiens
cagagguugcagugagcug

SEQ ID NO: 401687 - RNA, 12 nt, Homo sapiens
cagaguaaaaua

SEQ ID NO: 401688 - RNA, 16 nt, Homo sapiens
cagagucucauucugu

SEQ ID NO: 401689 - RNA, 21 nt, Homo sapiens
cagaguggccccucaccuggg

SEQ ID NO: 401690 - RNA, 18 nt, Homo sapiens
cagagugguuucauugcc

SEQ ID NO: 401691 - RNA, 11 nt, Homo sapiens
cagaguuuuca

SEQ ID NO: 401692 - RNA, 21 nt, Homo sapiens
cagauaacaaccccggacaaa

SEQ ID NO: 401693 - RNA, 17 nt, Homo sapiens
cagauaaugauaguguu

SEQ ID NO: 401694 - RNA, 23 nt, Homo sapiens
cagauaaugcuuuuacuaagcac

SEQ ID NO: 401695 - RNA, 19 nt, Homo sapiens
cagauagucccagcagccu

SEQ ID NO: 401696 - RNA, 16 nt, Homo sapiens
cagaucaaaugugaaa

SEQ ID NO: 401697 - RNA, 15 nt, Homo sapiens
cagaucaauuuguaa

SEQ ID NO: 401698 - RNA, 14 nt, Homo sapiens
cagaucacuacugc

SEQ ID NO: 401699 - RNA, 15 nt, Homo sapiens
cagaucacuacugca

SEQ ID NO: 401700 - RNA, 18 nt, Homo sapiens
cagaucccauccaucagc

SEQ ID NO: 401701 - RNA, 17 nt, Homo sapiens
cagauccgcaugugucu

SEQ ID NO: 401702 - RNA, 17 nt, Homo sapiens
cagaucuuugcugccag

SEQ ID NO: 401703 - RNA, 22 nt, Homo sapiens
cagaugagaagacuagcagcua

SEQ ID NO: 401704 - RNA, 19 nt, Homo sapiens
cagaugauucuaugucuca

SEQ ID NO: 401705 - RNA, 16 nt, Homo sapiens
cagaugccaaaaaaga

SEQ ID NO: 401706 - RNA, 20 nt, Homo sapiens
cagaugccaaaaaagaugcc

SEQ ID NO: 401707 - RNA, 21 nt, Homo sapiens
cagaugccucagccuacuuuc

SEQ ID NO: 401708 - RNA, 23 nt, Homo sapiens
cagaugccuccucuguccucauu

SEQ ID NO: 401709 - RNA, 19 nt, Homo sapiens
cagaugcugaaagagaaaa

SEQ ID NO: 401710 - RNA, 13 nt, Homo sapiens
cagauggagacau

SEQ ID NO: 401711 - RNA, 22 nt, Homo sapiens
cagauggagguucucagagcca

SEQ ID NO: 401712 - RNA, 17 nt, Homo sapiens
cagauggcaccuguggc

SEQ ID NO: 401713 - RNA, 13 nt, Homo sapiens
cagaugucccuga

SEQ ID NO: 401714 - RNA, 23 nt, Homo sapiens
cagauguuuguuuucaaaauacu

SEQ ID NO: 401715 - RNA, 18 nt, Homo sapiens
cagauuauuuuuccucug

SEQ ID NO: 401716 - RNA, 23 nt, Homo sapiens
cagauuccaggcgaugugcaagu

SEQ ID NO: 401717 - RNA, 17 nt, Homo sapiens
cagauugcggugugaga

SEQ ID NO: 401718 - RNA, 19 nt, Homo sapiens
acaggccacacgcugccca

SEQ ID NO: 401719 - RNA, 22 nt, Homo sapiens
acaggcgugauccaccacaccu

SEQ ID NO: 401720 - RNA, 15 nt, Homo sapiens
acagggaacugggaa

SEQ ID NO: 401721 - RNA, 16 nt, Homo sapiens
acagggacacagucug

SEQ ID NO: 401722 - RNA, 17 nt, Homo sapiens
acagggccugacuuuua

SEQ ID NO: 401723 - RNA, 24 nt, Homo sapiens
acagggucugcucuuucucugcca

SEQ ID NO: 401724 - RNA, 19 nt, Homo sapiens
acaggguuucaccauguua

SEQ ID NO: 401725 - RNA, 22 nt, Homo sapiens
cagcaagucccagacaaggaga

SEQ ID NO: 401726 - RNA, 15 nt, Homo sapiens
cagcaauacaaagac

SEQ ID NO: 401727 - RNA, 14 nt, Homo sapiens
cagcaauagcaucc

SEQ ID NO: 401728 - RNA, 22 nt, Homo sapiens
cagcacuacuuacuuagagaug

SEQ ID NO: 401729 - RNA, 17 nt, Homo sapiens
cagcacucuuaucuaca

SEQ ID NO: 401730 - RNA, 19 nt, Homo sapiens
cagcacucuuaucuacaua

SEQ ID NO: 401731 - RNA, 21 nt, Homo sapiens
cagcacugaaauauccuaacc

SEQ ID NO: 401732 - RNA, 16 nt, Homo sapiens
cagcacugaaguccag

SEQ ID NO: 401733 - RNA, 12 nt, Homo sapiens
cagcacuuugac

SEQ ID NO: 401734 - RNA, 16 nt, Homo sapiens
cagcacuuuguuucau

SEQ ID NO: 401735 - RNA, 16 nt, Homo sapiens
cagcagcccuaaggau

SEQ ID NO: 401736 - RNA, 15 nt, Homo sapiens
cagcagccucugucg

SEQ ID NO: 401737 - RNA, 14 nt, Homo sapiens
cagcagccugugag

SEQ ID NO: 401738 - RNA, 17 nt, Homo sapiens
cagcagcuagagcucag

SEQ ID NO: 401739 - RNA, 13 nt, Homo sapiens
cagcagcucugag

SEQ ID NO: 401740 - RNA, 14 nt, Homo sapiens
cagcagcuugacgc

SEQ ID NO: 401741 - RNA, 18 nt, Homo sapiens
cagcagggccacugagua

SEQ ID NO: 401742 - RNA, 15 nt, Homo sapiens
cagcagggcugugau

SEQ ID NO: 401743 - RNA, 21 nt, Homo sapiens
cagcagguucucuccugugag

SEQ ID NO: 401744 - RNA, 17 nt, Homo sapiens
cagcaguuuucuuuuaa

SEQ ID NO: 401745 - RNA, 17 nt, Homo sapiens
cagcauacacagaugaa

SEQ ID NO: 401746 - RNA, 18 nt, Homo sapiens
cagcauccucaguuccug

SEQ ID NO: 401747 - RNA, 15 nt, Homo sapiens
cagcaucugcuaaua

SEQ ID NO: 401748 - RNA, 21 nt, Homo sapiens
cagcaugaccugugaccagca

SEQ ID NO: 401749 - RNA, 13 nt, Homo sapiens
cagcaugccccuu

SEQ ID NO: 401750 - RNA, 15 nt, Homo sapiens
cagccaaaccuuucc

SEQ ID NO: 401751 - RNA, 16 nt, Homo sapiens
cagccaaaugcaggga

SEQ ID NO: 401752 - RNA, 16 nt, Homo sapiens
cagccaccaccuggau

SEQ ID NO: 401753 - RNA, 23 nt, Homo sapiens
cagccacccuaacugagcugcca

SEQ ID NO: 401754 - RNA, 14 nt, Homo sapiens
cagccaggacaucu

SEQ ID NO: 401755 - RNA, 16 nt, Homo sapiens
cagccaugauucuuuu

SEQ ID NO: 401756 - RNA, 19 nt, Homo sapiens
cagcccaaagcuggagcca

SEQ ID NO: 401757 - RNA, 19 nt, Homo sapiens
cagcccaacgggaagcaac

SEQ ID NO: 401758 - RNA, 13 nt, Homo sapiens
cagcccacuggau

SEQ ID NO: 401759 - RNA, 21 nt, Homo sapiens
cagcccagcuccacucagggc

SEQ ID NO: 401760 - RNA, 19 nt, Homo sapiens
cagccccacuccacaguua

SEQ ID NO: 401761 - RNA, 15 nt, Homo sapiens
cagccccaggaccaa

SEQ ID NO: 401762 - RNA, 22 nt, Homo sapiens
cagccccuccuccucgggcaca

SEQ ID NO: 401763 - RNA, 12 nt, Homo sapiens
cagcccuaggcu

SEQ ID NO: 401764 - RNA, 21 nt, Homo sapiens
cagcccucccuggcugugagc

SEQ ID NO: 401765 - RNA, 12 nt, Homo sapiens
cagcccugugga

SEQ ID NO: 401766 - RNA, 14 nt, Homo sapiens
cagccggcugcaag

SEQ ID NO: 401767 - RNA, 17 nt, Homo sapiens
cagccuaggcagaggcu

SEQ ID NO: 401768 - RNA, 15 nt, Homo sapiens
cagccuccaagaaac

SEQ ID NO: 401769 - RNA, 23 nt, Homo sapiens
cagccucccaaagugcugagauu

SEQ ID NO: 401770 - RNA, 20 nt, Homo sapiens
cagccuccugaguagcugga

SEQ ID NO: 401771 - RNA, 15 nt, Homo sapiens
cagccucucugcuau

SEQ ID NO: 401772 - RNA, 15 nt, Homo sapiens
cagccucugaaguug

SEQ ID NO: 401773 - RNA, 18 nt, Homo sapiens
cagccuggccaucuggau

SEQ ID NO: 401774 - RNA, 21 nt, Homo sapiens
cagccuggcuaacauggugaa

SEQ ID NO: 401775 - RNA, 22 nt, Homo sapiens
cagccuggcucccaggacacga

SEQ ID NO: 401776 - RNA, 19 nt, Homo sapiens
cagccugggcaacagagca

SEQ ID NO: 401777 - RNA, 15 nt, Homo sapiens
cagccugucuucaga

SEQ ID NO: 401778 - RNA, 19 nt, Homo sapiens
cagccuucacuggagaccg

SEQ ID NO: 401779 - RNA, 17 nt, Homo sapiens
cagccuugcaucaaggg

SEQ ID NO: 401780 - RNA, 21 nt, Homo sapiens
cagcgagcugugcaacguggg

SEQ ID NO: 401781 - RNA, 21 nt, Homo sapiens
cagcgauucccuguguagcuc

SEQ ID NO: 401782 - RNA, 13 nt, Homo sapiens
cagcuaaauuuuc

SEQ ID NO: 401783 - RNA, 19 nt, Homo sapiens
cagcuaacaaguagcacac

SEQ ID NO: 401784 - RNA, 19 nt, Homo sapiens
cagcuaacauggaaguacu

SEQ ID NO: 401785 - RNA, 13 nt, Homo sapiens
cagcuacauuccu

SEQ ID NO: 401786 - RNA, 16 nt, Homo sapiens
cagcuaggcugagaug

SEQ ID NO: 401787 - RNA, 14 nt, Homo sapiens
cagcuaugcaaauc

SEQ ID NO: 401788 - RNA, 23 nt, Homo sapiens
cagcucaacggaagaggcugcug

SEQ ID NO: 401789 - RNA, 19 nt, Homo sapiens
cagcuccacaguguugcca

SEQ ID NO: 401790 - RNA, 17 nt, Homo sapiens
cagcuccuuccaccaca

SEQ ID NO: 401791 - RNA, 21 nt, Homo sapiens
cagcucugcauuaucugaggu

SEQ ID NO: 401792 - RNA, 22 nt, Homo sapiens
cagcucuucagguuugcaaggg

SEQ ID NO: 401793 - RNA, 20 nt, Homo sapiens
cagcucuuccccacccuggg

SEQ ID NO: 401794 - RNA, 23 nt, Homo sapiens
cagcucuuggcuaagaccaggag

SEQ ID NO: 401795 - RNA, 19 nt, Homo sapiens
cagcucuuucaaacuuggg

SEQ ID NO: 401796 - RNA, 16 nt, Homo sapiens
cagcucuuuggugcca

SEQ ID NO: 401797 - RNA, 23 nt, Homo sapiens
cagcugaacacaagcaaaccuuc

SEQ ID NO: 401798 - RNA, 15 nt, Homo sapiens
cagcugaggacacac

SEQ ID NO: 401799 - RNA, 13 nt, Homo sapiens
cagcugagucuau

SEQ ID NO: 401800 - RNA, 16 nt, Homo sapiens
cagcugcaccagcagg

SEQ ID NO: 401801 - RNA, 19 nt, Homo sapiens
cagcugcugguuuugguuu

SEQ ID NO: 401802 - RNA, 13 nt, Homo sapiens
cagcugcuucugu

SEQ ID NO: 401803 - RNA, 18 nt, Homo sapiens
cagcugcuucugugcauu

SEQ ID NO: 401804 - RNA, 19 nt, Homo sapiens
cagcuggaagggucaacau

SEQ ID NO: 401805 - RNA, 22 nt, Homo sapiens
cagcugggagacacagcaagac

SEQ ID NO: 401806 - RNA, 11 nt, Homo sapiens
cagcugggcuc

SEQ ID NO: 401807 - RNA, 18 nt, Homo sapiens
cagcuggggccggagccu

SEQ ID NO: 401808 - RNA, 15 nt, Homo sapiens
cagcuggugucacuc

SEQ ID NO: 401809 - RNA, 19 nt, Homo sapiens
cagcuguacuagugccauu

SEQ ID NO: 401810 - RNA, 23 nt, Homo sapiens
cagcugugcugcaccccaugugg

SEQ ID NO: 401811 - RNA, 20 nt, Homo sapiens
cagcuguguucacacuguaa

SEQ ID NO: 401812 - RNA, 19 nt, Homo sapiens
cagcuucaccagagcauuu

SEQ ID NO: 401813 - RNA, 17 nt, Homo sapiens
cagcuucucuccacuga

SEQ ID NO: 401814 - RNA, 20 nt, Homo sapiens
cagcuuucccuggcucaggg

SEQ ID NO: 401815 - RNA, 22 nt, Homo sapiens
cagcuuucccuggcucagggau

SEQ ID NO: 401816 - RNA, 18 nt, Homo sapiens
caggaaagaucccaaguc

SEQ ID NO: 401817 - RNA, 14 nt, Homo sapiens
caggaaauaguguu

SEQ ID NO: 401818 - RNA, 22 nt, Homo sapiens
caggaaccuccuccacaccagc

SEQ ID NO: 401819 - RNA, 23 nt, Homo sapiens
caggaaccucuucagaaagugug

SEQ ID NO: 401820 - RNA, 14 nt, Homo sapiens
caggaagccucuca

SEQ ID NO: 401821 - RNA, 14 nt, Homo sapiens
caggaaguacugga

SEQ ID NO: 401822 - RNA, 13 nt, Homo sapiens
caggacagcauua

SEQ ID NO: 401823 - RNA, 22 nt, Homo sapiens
caggaccccagagggaccagcu

SEQ ID NO: 401824 - RNA, 23 nt, Homo sapiens
caggaccccagagggaccagcug

SEQ ID NO: 401825 - RNA, 15 nt, Homo sapiens
caggaccuacuagga

SEQ ID NO: 401826 - RNA, 22 nt, Homo sapiens
caggacucugccuccucuucaa

SEQ ID NO: 401827 - RNA, 12 nt, Homo sapiens
caggagaaggac

SEQ ID NO: 401828 - RNA, 22 nt, Homo sapiens
caggagaaugugcagugucuug

SEQ ID NO: 401829 - RNA, 17 nt, Homo sapiens
caggagaccuggcacug

SEQ ID NO: 401830 - RNA, 16 nt, Homo sapiens
caggagaccuuccaca

SEQ ID NO: 401831 - RNA, 21 nt, Homo sapiens
caggagacuuuacauggaugc

SEQ ID NO: 401832 - RNA, 19 nt, Homo sapiens
caggagaggagcgggaccu

SEQ ID NO: 401833 - RNA, 19 nt, Homo sapiens
caggagcagcugugcugca

SEQ ID NO: 401834 - RNA, 23 nt, Homo sapiens
caggagcggcgaugcacucgcac

SEQ ID NO: 401835 - RNA, 11 nt, Homo sapiens
caggagcucag

SEQ ID NO: 401836 - RNA, 11 nt, Homo sapiens
caggagcucuu

SEQ ID NO: 401837 - RNA, 21 nt, Homo sapiens
caggagcugcggccacucuac

SEQ ID NO: 401838 - RNA, 18 nt, Homo sapiens
caggaggaggaaagguag

SEQ ID NO: 401839 - RNA, 15 nt, Homo sapiens
caggaggauggcaaa

SEQ ID NO: 401840 - RNA, 13 nt, Homo sapiens
caggaggcugcaa

SEQ ID NO: 401841 - RNA, 19 nt, Homo sapiens
caggagguaaagaaauagc

SEQ ID NO: 401842 - RNA, 21 nt, Homo sapiens
caggagguaaagaaauagcca

SEQ ID NO: 401843 - RNA, 20 nt, Homo sapiens
caggagguugagaaugcagu

SEQ ID NO: 401844 - RNA, 18 nt, Homo sapiens
caggagguuggugacuga

SEQ ID NO: 401845 - RNA, 20 nt, Homo sapiens
caggagucucugccacccac

SEQ ID NO: 401846 - RNA, 20 nt, Homo sapiens
caggaucauguaaaugcuca

SEQ ID NO: 401847 - RNA, 23 nt, Homo sapiens
caggaucugaguuauuuugcuaa

SEQ ID NO: 401848 - RNA, 20 nt, Homo sapiens
caggauggcuggaacacugu

SEQ ID NO: 401849 - RNA, 17 nt, Homo sapiens
caggauuagacagucaa

SEQ ID NO: 401850 - RNA, 21 nt, Homo sapiens
caggcaacuucaguccuggga

SEQ ID NO: 401851 - RNA, 14 nt, Homo sapiens
accaagaacugcau

SEQ ID NO: 401852 - RNA, 23 nt, Homo sapiens
accaagaauucuccaaaacaauu

SEQ ID NO: 401853 - RNA, 14 nt, Homo sapiens
accaagaguaugag

SEQ ID NO: 401854 - RNA, 16 nt, Homo sapiens
cagugucuuccauaau

SEQ ID NO: 401855 - RNA, 19 nt, Homo sapiens
accccuuccccauuuccuc

SEQ ID NO: 401856 - RNA, 22 nt, Homo sapiens
acccgagcccagcuacauuccu

SEQ ID NO: 401857 - RNA, 14 nt, Homo sapiens
acccggggcagcug

SEQ ID NO: 401858 - RNA, 21 nt, Homo sapiens
acccguggagaugggaugcuu

SEQ ID NO: 401859 - RNA, 23 nt, Homo sapiens
acccuaauguggcagcugucuca

SEQ ID NO: 401860 - RNA, 21 nt, Homo sapiens
acccuacaagaugccaaggag

SEQ ID NO: 401861 - RNA, 18 nt, Homo sapiens
acccuacaccucugggcc

SEQ ID NO: 401862 - RNA, 16 nt, Homo sapiens
acccuacaguauauaa

SEQ ID NO: 401863 - RNA, 17 nt, Homo sapiens
acccuacgaaagcacag

SEQ ID NO: 401864 - RNA, 17 nt, Homo sapiens
acccuacuuucauuccu

SEQ ID NO: 401865 - RNA, 18 nt, Homo sapiens
acccuacuuucauuccuc

SEQ ID NO: 401866 - RNA, 13 nt, Homo sapiens
acccuagucccuu

SEQ ID NO: 401867 - RNA, 20 nt, Homo sapiens
acccuauuuagaaauggauu

SEQ ID NO: 401868 - RNA, 17 nt, Homo sapiens
acccucacgaggugucu

SEQ ID NO: 401869 - RNA, 23 nt, Homo sapiens
acccuccccauuaguauccuguu

SEQ ID NO: 401870 - RNA, 17 nt, Homo sapiens
acccuccuaucaccucc

SEQ ID NO: 401871 - RNA, 20 nt, Homo sapiens
acccucggccucuacuuugu

SEQ ID NO: 401872 - RNA, 22 nt, Homo sapiens
acccucugcuaugucugugaug

SEQ ID NO: 401873 - RNA, 22 nt, Homo sapiens
acccucuggagaaggugggcac

SEQ ID NO: 401874 - RNA, 16 nt, Homo sapiens
acccugaggguuucca

SEQ ID NO: 401875 - RNA, 18 nt, Homo sapiens
acccuggaauucagcacc

SEQ ID NO: 401876 - RNA, 19 nt, Homo sapiens
acccugucuaaaaaacaua

SEQ ID NO: 401877 - RNA, 21 nt, Homo sapiens
acccugucuaaugaaaccugu

SEQ ID NO: 401878 - RNA, 22 nt, Homo sapiens
acccuguuuuauugaguucuga

SEQ ID NO: 401879 - RNA, 18 nt, Homo sapiens
acccuuagcgggacaaag

SEQ ID NO: 401880 - RNA, 22 nt, Homo sapiens
acccuucugucuguaagauuuu

SEQ ID NO: 401881 - RNA, 15 nt, Homo sapiens
acccuugauuauacu

SEQ ID NO: 401882 - RNA, 19 nt, Homo sapiens
acccuuggagccaauggag

SEQ ID NO: 401883 - RNA, 21 nt, Homo sapiens
acccuuggcacugaugggcac

SEQ ID NO: 401884 - RNA, 14 nt, Homo sapiens
acccuuugcuguga

SEQ ID NO: 401885 - RNA, 15 nt, Homo sapiens
acccuuugcugugag

SEQ ID NO: 401886 - RNA, 21 nt, Homo sapiens
accgagucucuucuccacugg

SEQ ID NO: 401887 - RNA, 12 nt, Homo sapiens
accgagugcaau

SEQ ID NO: 401888 - RNA, 15 nt, Homo sapiens
accgaugguccucac

SEQ ID NO: 401889 - RNA, 16 nt, Homo sapiens
accgauuucagcacau

SEQ ID NO: 401890 - RNA, 16 nt, Homo sapiens
accgcaaggagcaaac

SEQ ID NO: 401891 - RNA, 17 nt, Homo sapiens
accgccaaagaaugccu

SEQ ID NO: 401892 - RNA, 23 nt, Homo sapiens
accgcuucugccuuuucacugug

SEQ ID NO: 401893 - RNA, 15 nt, Homo sapiens
accgggaaaggcauc

SEQ ID NO: 401894 - RNA, 15 nt, Homo sapiens
accgggcugggagcu

SEQ ID NO: 401895 - RNA, 16 nt, Homo sapiens
accgugcaacguguaa

SEQ ID NO: 401896 - RNA, 18 nt, Homo sapiens
accguuguuguuuuacau

SEQ ID NO: 401897 - RNA, 16 nt, Homo sapiens
accuaaaccaccagug

SEQ ID NO: 401898 - RNA, 14 nt, Homo sapiens
accuaaccacuuag

SEQ ID NO: 401899 - RNA, 15 nt, Homo sapiens
accuaccacaguguc

SEQ ID NO: 401900 - RNA, 14 nt, Homo sapiens
accuaccuauucau

SEQ ID NO: 401901 - RNA, 13 nt, Homo sapiens
accuacuagacaa

SEQ ID NO: 401902 - RNA, 12 nt, Homo sapiens
accuacuuccuc

SEQ ID NO: 401903 - RNA, 12 nt, Homo sapiens
accuacuuugua

SEQ ID NO: 401904 - RNA, 19 nt, Homo sapiens
accuagaaguauuuuuguc

SEQ ID NO: 401905 - RNA, 19 nt, Homo sapiens
accuagagcuagauguguc

SEQ ID NO: 401906 - RNA, 15 nt, Homo sapiens
accuagcaucuuaca

SEQ ID NO: 401907 - RNA, 23 nt, Homo sapiens
accuaugugugugcuuugccacu

SEQ ID NO: 401908 - RNA, 15 nt, Homo sapiens
accuauguuugcuca

SEQ ID NO: 401909 - RNA, 13 nt, Homo sapiens
accuauugcugua

SEQ ID NO: 401910 - RNA, 22 nt, Homo sapiens
accucaaaauauuuuuuuuaac

SEQ ID NO: 401911 - RNA, 16 nt, Homo sapiens
accucaaaaugucuaa

SEQ ID NO: 401912 - RNA, 13 nt, Homo sapiens
accucaacaaaga

SEQ ID NO: 401913 - RNA, 22 nt, Homo sapiens
accucaagcaaccaugaacuca

SEQ ID NO: 401914 - RNA, 13 nt, Homo sapiens
accucacugugac

SEQ ID NO: 401915 - RNA, 24 nt, Homo sapiens
accucacuuuuaauuagugaugca

SEQ ID NO: 401916 - RNA, 18 nt, Homo sapiens
accucagguuccaaauuc

SEQ ID NO: 401917 - RNA, 12 nt, Homo sapiens
accucaguuuua

SEQ ID NO: 401918 - RNA, 23 nt, Homo sapiens
accuccagcuguacuagugccau

SEQ ID NO: 401919 - RNA, 16 nt, Homo sapiens
accucccaaacccagc

SEQ ID NO: 401920 - RNA, 15 nt, Homo sapiens
accuccccaacagca

SEQ ID NO: 401921 - RNA, 17 nt, Homo sapiens
accucccccuccugucc

SEQ ID NO: 401922 - RNA, 18 nt, Homo sapiens
accuccccuccuugccuc

SEQ ID NO: 401923 - RNA, 15 nt, Homo sapiens
accucccugugagag

SEQ ID NO: 401924 - RNA, 22 nt, Homo sapiens
accuccuagaggugggcagcug

SEQ ID NO: 401925 - RNA, 20 nt, Homo sapiens
accuccuccacucacuccag

SEQ ID NO: 401926 - RNA, 13 nt, Homo sapiens
accuccucuccac

SEQ ID NO: 401927 - RNA, 12 nt, Homo sapiens
accuccugccuc

SEQ ID NO: 401928 - RNA, 15 nt, Homo sapiens
accuccuuagcccug

SEQ ID NO: 401929 - RNA, 13 nt, Homo sapiens
accucuauauguu

SEQ ID NO: 401930 - RNA, 19 nt, Homo sapiens
accucucuccuuugcugag

SEQ ID NO: 401931 - RNA, 17 nt, Homo sapiens
accucugggucaucucu

SEQ ID NO: 401932 - RNA, 15 nt, Homo sapiens
accucuuaugcacac

SEQ ID NO: 401933 - RNA, 18 nt, Homo sapiens
accucuucccaugacugc

SEQ ID NO: 401934 - RNA, 15 nt, Homo sapiens
accucuugugcugag

SEQ ID NO: 401935 - RNA, 22 nt, Homo sapiens
accucuuuggauguuuucccca

SEQ ID NO: 401936 - RNA, 23 nt, Homo sapiens
accucuuuggauguuuuccccaa

SEQ ID NO: 401937 - RNA, 20 nt, Homo sapiens
accugaaaaaaaguuuacaa

SEQ ID NO: 401938 - RNA, 15 nt, Homo sapiens
accugaaacaaccca

SEQ ID NO: 401939 - RNA, 14 nt, Homo sapiens
accugaaacacuuu

SEQ ID NO: 401940 - RNA, 13 nt, Homo sapiens
accugaaagaagc

SEQ ID NO: 401941 - RNA, 14 nt, Homo sapiens
accugaacucugca

SEQ ID NO: 401942 - RNA, 16 nt, Homo sapiens
accugaacucugcaac

SEQ ID NO: 401943 - RNA, 20 nt, Homo sapiens
accugaaggacgagggaugg

SEQ ID NO: 401944 - RNA, 13 nt, Homo sapiens
accugaauguguc

SEQ ID NO: 401945 - RNA, 19 nt, Homo sapiens
accugauacaauuugccca

SEQ ID NO: 401946 - RNA, 14 nt, Homo sapiens
accugaucauuaca

SEQ ID NO: 401947 - RNA, 18 nt, Homo sapiens
accugcaguuccugagua

SEQ ID NO: 401948 - RNA, 23 nt, Homo sapiens
accugcaugcagcaacacccaag

SEQ ID NO: 401949 - RNA, 15 nt, Homo sapiens
accugccugugugcu

SEQ ID NO: 401950 - RNA, 22 nt, Homo sapiens
accugcgccuggcucugucacc

SEQ ID NO: 401951 - RNA, 20 nt, Homo sapiens
accugcgugguccauuccau

SEQ ID NO: 401952 - RNA, 16 nt, Homo sapiens
accugcugaagggcag

SEQ ID NO: 401953 - RNA, 23 nt, Homo sapiens
accuggagcaucauaauggacuc

SEQ ID NO: 401954 - RNA, 17 nt, Homo sapiens
accuggagccaucuucc

SEQ ID NO: 401955 - RNA, 21 nt, Homo sapiens
accuggagcccacagagucug

SEQ ID NO: 401956 - RNA, 17 nt, Homo sapiens
accuggauguacuuaag

SEQ ID NO: 401957 - RNA, 23 nt, Homo sapiens
accuggccgggucacccugugac

SEQ ID NO: 401958 - RNA, 15 nt, Homo sapiens
accuguaauagccuc

SEQ ID NO: 401959 - RNA, 16 nt, Homo sapiens
accuguaaucauauaa

SEQ ID NO: 401960 - RNA, 15 nt, Homo sapiens
accuguaaucccagc

SEQ ID NO: 401961 - RNA, 20 nt, Homo sapiens
accuguacacugacuugaga

SEQ ID NO: 401962 - RNA, 22 nt, Homo sapiens
accuguagucccagcuacucag

SEQ ID NO: 401963 - RNA, 13 nt, Homo sapiens
accuguagugaga

SEQ ID NO: 401964 - RNA, 20 nt, Homo sapiens
accuguagugagaaacugau

SEQ ID NO: 401965 - RNA, 14 nt, Homo sapiens
accugugaccagca

SEQ ID NO: 401966 - RNA, 15 nt, Homo sapiens
accugugcauucucc

SEQ ID NO: 401967 - RNA, 13 nt, Homo sapiens
accugugcugcug

SEQ ID NO: 401968 - RNA, 20 nt, Homo sapiens
accuguguucuugcugagca

SEQ ID NO: 401969 - RNA, 17 nt, Homo sapiens
accuguuguacacuugg

SEQ ID NO: 401970 - RNA, 15 nt, Homo sapiens
accuuaaaugaaaaa

SEQ ID NO: 401971 - RNA, 19 nt, Homo sapiens
accuuaaauuaaacaauuu

SEQ ID NO: 401972 - RNA, 18 nt, Homo sapiens
accuuaccaacuuucugu

SEQ ID NO: 401973 - RNA, 22 nt, Homo sapiens
accuuauagguuacucauaagg

SEQ ID NO: 401974 - RNA, 16 nt, Homo sapiens
accuuaucugugcgug

SEQ ID NO: 401975 - RNA, 16 nt, Homo sapiens
accuuauuagcuaaaa

SEQ ID NO: 401976 - RNA, 11 nt, Homo sapiens
accuuccacaa

SEQ ID NO: 401977 - RNA, 18 nt, Homo sapiens
accuuccccagcguccca

SEQ ID NO: 401978 - RNA, 13 nt, Homo sapiens
accuuccuccuca

SEQ ID NO: 401979 - RNA, 23 nt, Homo sapiens
accuuccugggcagcccagagag

SEQ ID NO: 401980 - RNA, 12 nt, Homo sapiens
accuucuguucc

SEQ ID NO: 401981 - RNA, 21 nt, Homo sapiens
accuugacuugauuagugccu

SEQ ID NO: 401982 - RNA, 11 nt, Homo sapiens
accuugcccau

SEQ ID NO: 401983 - RNA, 20 nt, Homo sapiens
accuuggaggaaugacaaua

SEQ ID NO: 401984 - RNA, 21 nt, Homo sapiens
acucuagccugggccagagaa

SEQ ID NO: 401985 - RNA, 20 nt, Homo sapiens
acucuaggggucaggcucca

SEQ ID NO: 401986 - RNA, 12 nt, Homo sapiens
acucuagugcca

SEQ ID NO: 401987 - RNA, 14 nt, Homo sapiens
acucucacaugugg

SEQ ID NO: 401988 - RNA, 16 nt, Homo sapiens
acucuccucaucucua

SEQ ID NO: 401989 - RNA, 13 nt, Homo sapiens
acucucugagaug

SEQ ID NO: 401990 - RNA, 18 nt, Homo sapiens
acucucuucuuacuguau

SEQ ID NO: 401991 - RNA, 22 nt, Homo sapiens
acucugaaaaacauuccaggaa

SEQ ID NO: 401992 - RNA, 13 nt, Homo sapiens
caucugcuuacaa

SEQ ID NO: 401993 - RNA, 22 nt, Homo sapiens
caucuggccuaauguuccagau

SEQ ID NO: 401994 - RNA, 23 nt, Homo sapiens
caucuguagauacuagcuaucua

SEQ ID NO: 401995 - RNA, 17 nt, Homo sapiens
caucuguauaaacacaa

SEQ ID NO: 401996 - RNA, 12 nt, Homo sapiens
caucugucacau

SEQ ID NO: 401997 - RNA, 18 nt, Homo sapiens
caucugucugucccaguu

SEQ ID NO: 401998 - RNA, 18 nt, Homo sapiens
caucugucuguccuaccc

SEQ ID NO: 401999 - RNA, 17 nt, Homo sapiens
caucugucuugucauuc

SEQ ID NO: 402000 - RNA, 21 nt, Homo sapiens
caucugucuugucauuccagg

SEQ ID NO: 402001 - RNA, 17 nt, Homo sapiens
caucugugggcacgcug

SEQ ID NO: 402002 - RNA, 19 nt, Homo sapiens
caucuucaaagcuugaaga

SEQ ID NO: 402003 - RNA, 18 nt, Homo sapiens
caucuucccuucacucaa

SEQ ID NO: 402004 - RNA, 21 nt, Homo sapiens
caucuuucauaguucuguuaa

SEQ ID NO: 402005 - RNA, 11 nt, Homo sapiens
caucuuucuaa

SEQ ID NO: 402006 - RNA, 21 nt, Homo sapiens
caucuuugcugaaugucauua

SEQ ID NO: 402007 - RNA, 18 nt, Homo sapiens
caucuuuuacauucugca

SEQ ID NO: 402008 - RNA, 15 nt, Homo sapiens
caucuuuucuacuuc

SEQ ID NO: 402009 - RNA, 21 nt, Homo sapiens
caucuuuuuaaccugcaaaau

SEQ ID NO: 402010 - RNA, 15 nt, Homo sapiens
caugaaaaacacggc

SEQ ID NO: 402011 - RNA, 14 nt, Homo sapiens
caugaaaacagaaa

SEQ ID NO: 402012 - RNA, 14 nt, Homo sapiens
caugaaaauuacaa

SEQ ID NO: 402013 - RNA, 15 nt, Homo sapiens
caugaaaauuacaac

SEQ ID NO: 402014 - RNA, 14 nt, Homo sapiens
caugaaauaugcau

SEQ ID NO: 402015 - RNA, 19 nt, Homo sapiens
caugaagaaugcauucaaa

SEQ ID NO: 402016 - RNA, 18 nt, Homo sapiens
caugaagccuugcugaac

SEQ ID NO: 402017 - RNA, 17 nt, Homo sapiens
caugaaggcagagccau

SEQ ID NO: 402018 - RNA, 19 nt, Homo sapiens
caugaaucacugcaccucu

SEQ ID NO: 402019 - RNA, 19 nt, Homo sapiens
caugacaaacacacaucca

SEQ ID NO: 402020 - RNA, 15 nt, Homo sapiens
caugaccacuuuccc

SEQ ID NO: 402021 - RNA, 16 nt, Homo sapiens
caugagagcccagaaa

SEQ ID NO: 402022 - RNA, 19 nt, Homo sapiens
caugagcaaguuuccuuga

SEQ ID NO: 402023 - RNA, 22 nt, Homo sapiens
caugagcuauuuccauuccaga

SEQ ID NO: 402024 - RNA, 13 nt, Homo sapiens
caugagguaaaag

SEQ ID NO: 402025 - RNA, 14 nt, Homo sapiens
caugauucuuuaau

SEQ ID NO: 402026 - RNA, 16 nt, Homo sapiens
caugauuucauuucaa

SEQ ID NO: 402027 - RNA, 19 nt, Homo sapiens
caugcacagcuaacaugga

SEQ ID NO: 402028 - RNA, 19 nt, Homo sapiens
caugcacaguuugcaaucu

SEQ ID NO: 402029 - RNA, 10 nt, Homo sapiens
caugcacauc

SEQ ID NO: 402030 - RNA, 13 nt, Homo sapiens
caugcacuacuga

SEQ ID NO: 402031 - RNA, 23 nt, Homo sapiens
caugcacuacugaaauuuacaca

SEQ ID NO: 402032 - RNA, 16 nt, Homo sapiens
caugcacucacaaaga

SEQ ID NO: 402033 - RNA, 22 nt, Homo sapiens
caugcacugcaaauacuuccaa

SEQ ID NO: 402034 - RNA, 18 nt, Homo sapiens
caugcagacccucagacc

SEQ ID NO: 402035 - RNA, 15 nt, Homo sapiens
caugcagugcccuca

SEQ ID NO: 402036 - RNA, 16 nt, Homo sapiens
caugccccuggaccag

SEQ ID NO: 402037 - RNA, 18 nt, Homo sapiens
caugccccuggaccagua

SEQ ID NO: 402038 - RNA, 16 nt, Homo sapiens
caugcguccacuuucc

SEQ ID NO: 402039 - RNA, 20 nt, Homo sapiens
caugcugcuuuuuggcacag

SEQ ID NO: 402040 - RNA, 11 nt, Homo sapiens
caugcuuucuc

SEQ ID NO: 402041 - RNA, 20 nt, Homo sapiens
caugcuuugcugcuaugaaa

SEQ ID NO: 402042 - RNA, 16 nt, Homo sapiens
cauggaauaaaccauu

SEQ ID NO: 402043 - RNA, 19 nt, Homo sapiens
cauggacuccaggauccuc

SEQ ID NO: 402044 - RNA, 20 nt, Homo sapiens
cauggagaaucugcugcaua

SEQ ID NO: 402045 - RNA, 23 nt, Homo sapiens
cauggagcuugacuucaugccag

SEQ ID NO: 402046 - RNA, 12 nt, Homo sapiens
cauggaugccaa

SEQ ID NO: 402047 - RNA, 23 nt, Homo sapiens
cauggcaccuuuugcacauaaca

SEQ ID NO: 402048 - RNA, 14 nt, Homo sapiens
cauggccacagcca

SEQ ID NO: 402049 - RNA, 23 nt, Homo sapiens
cauggccgggcccucuguagcuc

SEQ ID NO: 402050 - RNA, 23 nt, Homo sapiens
cauggcucuggcacaguguaauc

SEQ ID NO: 402051 - RNA, 14 nt, Homo sapiens
cauggcuggcagag

SEQ ID NO: 402052 - RNA, 17 nt, Homo sapiens
caugguagacugugaca

SEQ ID NO: 402053 - RNA, 16 nt, Homo sapiens
caugguaggcuacuuu

SEQ ID NO: 402054 - RNA, 21 nt, Homo sapiens
caugguauaaggaaauaucau

SEQ ID NO: 402055 - RNA, 16 nt, Homo sapiens
cauggugaaaauguac

SEQ ID NO: 402056 - RNA, 13 nt, Homo sapiens
cauggugaugcaa

SEQ ID NO: 402057 - RNA, 13 nt, Homo sapiens
cauggugcaugcc

SEQ ID NO: 402058 - RNA, 20 nt, Homo sapiens
caugguggggcaugccugua

SEQ ID NO: 402059 - RNA, 16 nt, Homo sapiens
caugguuuugaaaugc

SEQ ID NO: 402060 - RNA, 15 nt, Homo sapiens
cauguaacauucuuc

SEQ ID NO: 402061 - RNA, 13 nt, Homo sapiens
cauguaaccaaga

SEQ ID NO: 402062 - RNA, 22 nt, Homo sapiens
cauguaaggucuucuugugucc

SEQ ID NO: 402063 - RNA, 12 nt, Homo sapiens
cauguacaugaa

SEQ ID NO: 402064 - RNA, 20 nt, Homo sapiens
cauguaccugaaacauuugg

SEQ ID NO: 402065 - RNA, 13 nt, Homo sapiens
cauguagcauaua

SEQ ID NO: 402066 - RNA, 13 nt, Homo sapiens
cauguauacuuaa

SEQ ID NO: 402067 - RNA, 14 nt, Homo sapiens
cauguauacuuaau

SEQ ID NO: 402068 - RNA, 19 nt, Homo sapiens
cauguauagcuagcuauuu

SEQ ID NO: 402069 - RNA, 14 nt, Homo sapiens
cauguauguggaag

SEQ ID NO: 402070 - RNA, 22 nt, Homo sapiens
cauguauguggauacagucauu

SEQ ID NO: 402071 - RNA, 12 nt, Homo sapiens
caugucacugug

SEQ ID NO: 402072 - RNA, 23 nt, Homo sapiens
caugucuacugcuuggauccaua

SEQ ID NO: 402073 - RNA, 17 nt, Homo sapiens
caugugagccaccgcug

SEQ ID NO: 402074 - RNA, 22 nt, Homo sapiens
caugugauauuuucacaucuua

SEQ ID NO: 402075 - RNA, 18 nt, Homo sapiens
caugugccgaaugugcag

SEQ ID NO: 402076 - RNA, 15 nt, Homo sapiens
caugugcugugacca

SEQ ID NO: 402077 - RNA, 15 nt, Homo sapiens
cauguggaaaacuca

SEQ ID NO: 402078 - RNA, 20 nt, Homo sapiens
cauguggaaaacucacagau

SEQ ID NO: 402079 - RNA, 13 nt, Homo sapiens
cauguguauuucc

SEQ ID NO: 402080 - RNA, 22 nt, Homo sapiens
caugugucuguauucauacagc

SEQ ID NO: 402081 - RNA, 20 nt, Homo sapiens
caugugugagugugugcaag

SEQ ID NO: 402082 - RNA, 21 nt, Homo sapiens
caugugugagugugugcaagu

SEQ ID NO: 402083 - RNA, 17 nt, Homo sapiens
caugugugcgagugugu

SEQ ID NO: 402084 - RNA, 20 nt, Homo sapiens
caugugugcgagugugugca

SEQ ID NO: 402085 - RNA, 23 nt, Homo sapiens
caugugugcgugugcgugcaugu

SEQ ID NO: 402086 - RNA, 14 nt, Homo sapiens
caugugugugcaag

SEQ ID NO: 402087 - RNA, 19 nt, Homo sapiens
caugugugugcaagugugu

SEQ ID NO: 402088 - RNA, 22 nt, Homo sapiens
caugugugugcaagugugugca

SEQ ID NO: 402089 - RNA, 19 nt, Homo sapiens
cauguguuuuaauuccaau

SEQ ID NO: 402090 - RNA, 21 nt, Homo sapiens
cauguucuuguuuuguuauau

SEQ ID NO: 402091 - RNA, 23 nt, Homo sapiens
cauguugacauaugucuaugucc

SEQ ID NO: 402092 - RNA, 21 nt, Homo sapiens
cauguugggaaaaacuggcuu

SEQ ID NO: 402093 - RNA, 14 nt, Homo sapiens
cauguuuugcuaau

SEQ ID NO: 402094 - RNA, 19 nt, Homo sapiens
cauguuuuugauauuugau

SEQ ID NO: 402095 - RNA, 22 nt, Homo sapiens
cauuaaaaaaauuagaaaguag

SEQ ID NO: 402096 - RNA, 18 nt, Homo sapiens
cauuaaacagaagguaau

SEQ ID NO: 402097 - RNA, 15 nt, Homo sapiens
cauuaacuucucugg

SEQ ID NO: 402098 - RNA, 19 nt, Homo sapiens
cauuacacgccacaacucc

SEQ ID NO: 402099 - RNA, 13 nt, Homo sapiens
cauuacaguuugg

SEQ ID NO: 402100 - RNA, 16 nt, Homo sapiens
cauuaccgucugugau

SEQ ID NO: 402101 - RNA, 12 nt, Homo sapiens
cauuacucugca

SEQ ID NO: 402102 - RNA, 17 nt, Homo sapiens
cauuacuuuaauacuca

SEQ ID NO: 402103 - RNA, 19 nt, Homo sapiens
cauuagaagaaaacauaua

SEQ ID NO: 402104 - RNA, 12 nt, Homo sapiens
cauuaguuucag

SEQ ID NO: 402105 - RNA, 16 nt, Homo sapiens
cauuaguuucaggcaa

SEQ ID NO: 402106 - RNA, 23 nt, Homo sapiens
cauuauaaaaucuuuccaucuca

SEQ ID NO: 402107 - RNA, 17 nt, Homo sapiens
cauuauaaacgugauga

SEQ ID NO: 402108 - RNA, 18 nt, Homo sapiens
cauuauaaauaauguuca

SEQ ID NO: 402109 - RNA, 20 nt, Homo sapiens
cauuauccuuuuaucucaca

SEQ ID NO: 402110 - RNA, 14 nt, Homo sapiens
cauuauuacuccuu

SEQ ID NO: 402111 - RNA, 20 nt, Homo sapiens
cauuauuacuccuugccauu

SEQ ID NO: 402112 - RNA, 17 nt, Homo sapiens
cauuauuugaaaacacu

SEQ ID NO: 402113 - RNA, 16 nt, Homo sapiens
cauuauuugauaacau

SEQ ID NO: 402114 - RNA, 11 nt, Homo sapiens
ccaagguccug

SEQ ID NO: 402115 - RNA, 17 nt, Homo sapiens
ccaaggugcacauuuuc

SEQ ID NO: 402116 - RNA, 19 nt, Homo sapiens
ccaagguuuuggagucagu

SEQ ID NO: 402117 - RNA, 16 nt, Homo sapiens
ccaaguauuuugccac

SEQ ID NO: 402118 - RNA, 13 nt, Homo sapiens
ccaagucauggag

SEQ ID NO: 402119 - RNA, 15 nt, Homo sapiens
ccaagucaugugcau

SEQ ID NO: 402120 - RNA, 19 nt, Homo sapiens
ccaaguccaccccaauuaa

SEQ ID NO: 402121 - RNA, 23 nt, Homo sapiens
ccaaucggcuuucauuuugcauu

SEQ ID NO: 402122 - RNA, 23 nt, Homo sapiens
ccaaucucuucuaaaaaaaaaca

SEQ ID NO: 402123 - RNA, 13 nt, Homo sapiens
ccaaucuuucuau

SEQ ID NO: 402124 - RNA, 22 nt, Homo sapiens
ccaaugaggucugaaauggagg

SEQ ID NO: 402125 - RNA, 23 nt, Homo sapiens
ccaaugcauugcuaaaauauuau

SEQ ID NO: 402126 - RNA, 18 nt, Homo sapiens
ccaaugcuuuguccauga

SEQ ID NO: 402127 - RNA, 16 nt, Homo sapiens
ccaauggcuuccagcu

SEQ ID NO: 402128 - RNA, 19 nt, Homo sapiens
acuucaaguuaaagugaau

SEQ ID NO: 402129 - RNA, 20 nt, Homo sapiens
acuucaaguuaaagugaaua

SEQ ID NO: 402130 - RNA, 13 nt, Homo sapiens
acuucaauaucca

SEQ ID NO: 402131 - RNA, 19 nt, Homo sapiens
acuucacccacgcauauac

SEQ ID NO: 402132 - RNA, 16 nt, Homo sapiens
acuucacccccaacuu

SEQ ID NO: 402133 - RNA, 17 nt, Homo sapiens
acuucagaguacaucca

SEQ ID NO: 402134 - RNA, 16 nt, Homo sapiens
acuucagcaggggugg

SEQ ID NO: 402135 - RNA, 12 nt, Homo sapiens
acuucagcagua

SEQ ID NO: 402136 - RNA, 15 nt, Homo sapiens
acuucagcugccuga

SEQ ID NO: 402137 - RNA, 16 nt, Homo sapiens
acuucauuucugaugu

SEQ ID NO: 402138 - RNA, 19 nt, Homo sapiens
acuuccaagaccugacuca

SEQ ID NO: 402139 - RNA, 14 nt, Homo sapiens
acuucccucaggcc

SEQ ID NO: 402140 - RNA, 16 nt, Homo sapiens
acuuccgucacccuug

SEQ ID NO: 402141 - RNA, 14 nt, Homo sapiens
acuuccuacuguag

SEQ ID NO: 402142 - RNA, 14 nt, Homo sapiens
acuuccucagucug

SEQ ID NO: 402143 - RNA, 13 nt, Homo sapiens
acuuccucaugaa

SEQ ID NO: 402144 - RNA, 13 nt, Homo sapiens
acuuccugcagua

SEQ ID NO: 402145 - RNA, 16 nt, Homo sapiens
acuuccuguccagaga

SEQ ID NO: 402146 - RNA, 13 nt, Homo sapiens
acuuccuugcucu

SEQ ID NO: 402147 - RNA, 14 nt, Homo sapiens
acuuccuugcucuc

SEQ ID NO: 402148 - RNA, 14 nt, Homo sapiens
acuucgagcacugu

SEQ ID NO: 402149 - RNA, 18 nt, Homo sapiens
acuucuauccuguuaaca

SEQ ID NO: 402150 - RNA, 18 nt, Homo sapiens
acuucucucuaaggagaa

SEQ ID NO: 402151 - RNA, 19 nt, Homo sapiens
acuucugaaaccucugggu

SEQ ID NO: 402152 - RNA, 23 nt, Homo sapiens
acuucugaagggccccuugcaaa

SEQ ID NO: 402153 - RNA, 17 nt, Homo sapiens
acuucugaccacacuuc

SEQ ID NO: 402154 - RNA, 18 nt, Homo sapiens
acuucugcaacucaugaa

SEQ ID NO: 402155 - RNA, 20 nt, Homo sapiens
acuucugcuguacagauauc

SEQ ID NO: 402156 - RNA, 19 nt, Homo sapiens
acuucuggaagucaucuca

SEQ ID NO: 402157 - RNA, 17 nt, Homo sapiens
acuucuuauacauuuga

SEQ ID NO: 402158 - RNA, 20 nt, Homo sapiens
acuucuuuauucacaguauc

SEQ ID NO: 402159 - RNA, 22 nt, Homo sapiens
acuucuuuuuggcauuaucucu

SEQ ID NO: 402160 - RNA, 18 nt, Homo sapiens
acuugaaagcauccaugu

SEQ ID NO: 402161 - RNA, 20 nt, Homo sapiens
acuugaaagcauccaugugu

SEQ ID NO: 402162 - RNA, 19 nt, Homo sapiens
acuugaaaguuuuccagua

SEQ ID NO: 402163 - RNA, 16 nt, Homo sapiens
acuugaaugguuaaua

SEQ ID NO: 402164 - RNA, 16 nt, Homo sapiens
acuugacaagucagga

SEQ ID NO: 402165 - RNA, 13 nt, Homo sapiens
acuugacuuugcc

SEQ ID NO: 402166 - RNA, 14 nt, Homo sapiens
acuugacuuugcca

SEQ ID NO: 402167 - RNA, 15 nt, Homo sapiens
acuugacuuugccac

SEQ ID NO: 402168 - RNA, 17 nt, Homo sapiens
acuugagggaccaauau

SEQ ID NO: 402169 - RNA, 20 nt, Homo sapiens
acuugagguaccaguuguau

SEQ ID NO: 402170 - RNA, 16 nt, Homo sapiens
acuugaucauucucag

SEQ ID NO: 402171 - RNA, 18 nt, Homo sapiens
acuugauuugcauggauu

SEQ ID NO: 402172 - RNA, 15 nt, Homo sapiens
acuugcaagucccau

SEQ ID NO: 402173 - RNA, 19 nt, Homo sapiens
acuugcacgcccaugugug

SEQ ID NO: 402174 - RNA, 14 nt, Homo sapiens
acuugcguccugca

SEQ ID NO: 402175 - RNA, 17 nt, Homo sapiens
acuugcuuccaagcccu

SEQ ID NO: 402176 - RNA, 17 nt, Homo sapiens
acuuggacucuugcucu

SEQ ID NO: 402177 - RNA, 20 nt, Homo sapiens
acuugggacggaaguggccu

SEQ ID NO: 402178 - RNA, 22 nt, Homo sapiens
acuugguuuuuggcucuuucag

SEQ ID NO: 402179 - RNA, 22 nt, Homo sapiens
acuugugugugggcugugagug

SEQ ID NO: 402180 - RNA, 16 nt, Homo sapiens
acuuguuccagcucuu

SEQ ID NO: 402181 - RNA, 15 nt, Homo sapiens
acuuguuuuaugcuc

SEQ ID NO: 402182 - RNA, 21 nt, Homo sapiens
acuuuaaauccuaccaaagua

SEQ ID NO: 402183 - RNA, 13 nt, Homo sapiens
acuuuaacuucca

SEQ ID NO: 402184 - RNA, 16 nt, Homo sapiens
acuuuaccugaaacaa

SEQ ID NO: 402185 - RNA, 13 nt, Homo sapiens
acuuuagaaauaa

SEQ ID NO: 402186 - RNA, 16 nt, Homo sapiens
acuuuauaaauaucaa

SEQ ID NO: 402187 - RNA, 15 nt, Homo sapiens
acuuuauguacugcu

SEQ ID NO: 402188 - RNA, 13 nt, Homo sapiens
acuuucauuugaa

SEQ ID NO: 402189 - RNA, 22 nt, Homo sapiens
acuuuccccgugggccauggca

SEQ ID NO: 402190 - RNA, 20 nt, Homo sapiens
acuuucccuagaaagccaua

SEQ ID NO: 402191 - RNA, 17 nt, Homo sapiens
acuuuccucgccugaca

SEQ ID NO: 402192 - RNA, 16 nt, Homo sapiens
acuuucugacugcaac

SEQ ID NO: 402193 - RNA, 15 nt, Homo sapiens
acuuucuucugaaua

SEQ ID NO: 402194 - RNA, 16 nt, Homo sapiens
acuuucuugagcacca

SEQ ID NO: 402195 - RNA, 13 nt, Homo sapiens
acuuugaagacca

SEQ ID NO: 402196 - RNA, 13 nt, Homo sapiens
acuuugacuuucu

SEQ ID NO: 402197 - RNA, 23 nt, Homo sapiens
acuuugacuuucuucugaauauu

SEQ ID NO: 402198 - RNA, 17 nt, Homo sapiens
acuuugaucucugcuua

SEQ ID NO: 402199 - RNA, 18 nt, Homo sapiens
acuuugauuuacagugcc

SEQ ID NO: 402200 - RNA, 18 nt, Homo sapiens
acuuugcccuucacuguu

SEQ ID NO: 402201 - RNA, 15 nt, Homo sapiens
acuuuggaucaggaa

SEQ ID NO: 402202 - RNA, 15 nt, Homo sapiens
acuuuguacuugugu

SEQ ID NO: 402203 - RNA, 19 nt, Homo sapiens
acuuuguuucauauucuca

SEQ ID NO: 402204 - RNA, 13 nt, Homo sapiens
acuuuuaauguca

SEQ ID NO: 402205 - RNA, 17 nt, Homo sapiens
acuuuucaagcugcuga

SEQ ID NO: 402206 - RNA, 23 nt, Homo sapiens
acuuuucugugucauaccacaau

SEQ ID NO: 402207 - RNA, 23 nt, Homo sapiens
acuuuugguaucuacuucuacau

SEQ ID NO: 402208 - RNA, 19 nt, Homo sapiens
acuuuuucucgaguccaaa

SEQ ID NO: 402209 - RNA, 23 nt, Homo sapiens
acuuuuucucgaguccaaaauca

SEQ ID NO: 402210 - RNA, 19 nt, Homo sapiens
acuuuuucugagcuuuuca

SEQ ID NO: 402211 - RNA, 18 nt, Homo sapiens
agaaaaaaguacagaaca

SEQ ID NO: 402212 - RNA, 24 nt, Homo sapiens
agaaaaaaguuuacaacauaaucu

SEQ ID NO: 402213 - RNA, 19 nt, Homo sapiens
agaaaaaggagcuuaccuc

SEQ ID NO: 402214 - RNA, 13 nt, Homo sapiens
agaaaacaacuuc

SEQ ID NO: 402215 - RNA, 20 nt, Homo sapiens
agaaaacaggcucacagaga

SEQ ID NO: 402216 - RNA, 12 nt, Homo sapiens
agaaaacauaua

SEQ ID NO: 402217 - RNA, 20 nt, Homo sapiens
agaaaacccaacuccucucc

SEQ ID NO: 402218 - RNA, 17 nt, Homo sapiens
agaaaaccucaagggcu

SEQ ID NO: 402219 - RNA, 13 nt, Homo sapiens
agaaaagaaugua

SEQ ID NO: 402220 - RNA, 14 nt, Homo sapiens
agaaaagacacuuc

SEQ ID NO: 402221 - RNA, 12 nt, Homo sapiens
agaaaagcagac

SEQ ID NO: 402222 - RNA, 13 nt, Homo sapiens
agaaaagccagau

SEQ ID NO: 402223 - RNA, 16 nt, Homo sapiens
agaaaagcugccauuu

SEQ ID NO: 402224 - RNA, 17 nt, Homo sapiens
agaaaaggaaugcaaga

SEQ ID NO: 402225 - RNA, 16 nt, Homo sapiens
agaaaagugggccagu

SEQ ID NO: 402226 - RNA, 18 nt, Homo sapiens
agaaaagugggccagugu

SEQ ID NO: 402227 - RNA, 21 nt, Homo sapiens
agaaaauccauucauucaauc

SEQ ID NO: 402228 - RNA, 13 nt, Homo sapiens
agaaaaugaauuu

SEQ ID NO: 402229 - RNA, 17 nt, Homo sapiens
agaaaaugaauuugacu

SEQ ID NO: 402230 - RNA, 19 nt, Homo sapiens
agaaacacaaccacucacc

SEQ ID NO: 402231 - RNA, 18 nt, Homo sapiens
agaaaccacugggcauaa

SEQ ID NO: 402232 - RNA, 16 nt, Homo sapiens
agaaaccccacuucca

SEQ ID NO: 402233 - RNA, 18 nt, Homo sapiens
agaaacuucugcuuuuaa

SEQ ID NO: 402234 - RNA, 18 nt, Homo sapiens
agaaacuugugaagugga

SEQ ID NO: 402235 - RNA, 13 nt, Homo sapiens
agaaagcauugcc

SEQ ID NO: 402236 - RNA, 19 nt, Homo sapiens
agaaagcucugcaugugug

SEQ ID NO: 402237 - RNA, 21 nt, Homo sapiens
agaaaggggcaggagcucaga

SEQ ID NO: 402238 - RNA, 15 nt, Homo sapiens
agaaauaaagcacau

SEQ ID NO: 402239 - RNA, 19 nt, Homo sapiens
agaaauaaagcaucucauu

SEQ ID NO: 402240 - RNA, 18 nt, Homo sapiens
agaaauaacacugugaau

SEQ ID NO: 402241 - RNA, 15 nt, Homo sapiens
agaaauaauacccug

SEQ ID NO: 402242 - RNA, 20 nt, Homo sapiens
agaaauaauaugcauuguca

SEQ ID NO: 402243 - RNA, 18 nt, Homo sapiens
agaaauaauugugucaug

SEQ ID NO: 402244 - RNA, 15 nt, Homo sapiens
agaaauggcuuucca

SEQ ID NO: 402245 - RNA, 23 nt, Homo sapiens
ccuucucuguagggaacucuggg

SEQ ID NO: 402246 - RNA, 21 nt, Homo sapiens
ccuucugaacaugagugucaa

SEQ ID NO: 402247 - RNA, 23 nt, Homo sapiens
ccuucugauugauggugcuauuu

SEQ ID NO: 402248 - RNA, 20 nt, Homo sapiens
ccuucugcuguauacuguac

SEQ ID NO: 402249 - RNA, 19 nt, Homo sapiens
ccuucuuggcuucugggac

SEQ ID NO: 402250 - RNA, 18 nt, Homo sapiens
ccuucuuuaccuucauuu

SEQ ID NO: 402251 - RNA, 22 nt, Homo sapiens
ccuucuuuugaaggacuccuua

SEQ ID NO: 402252 - RNA, 17 nt, Homo sapiens
ccuugagcaaauuaccc

SEQ ID NO: 402253 - RNA, 21 nt, Homo sapiens
ccuugagcaagucccaucuca

SEQ ID NO: 402254 - RNA, 21 nt, Homo sapiens
ccuugagcugccugcucugca

SEQ ID NO: 402255 - RNA, 22 nt, Homo sapiens
ccuugauggagauauuuacaug

SEQ ID NO: 402256 - RNA, 19 nt, Homo sapiens
ccuugauuuaucacacaaa

SEQ ID NO: 402257 - RNA, 18 nt, Homo sapiens
ccuugcaacuucauguca

SEQ ID NO: 402258 - RNA, 21 nt, Homo sapiens
ccuugcaaucuucuacuuuaa

SEQ ID NO: 402259 - RNA, 17 nt, Homo sapiens
ccuugcacaggccacuu

SEQ ID NO: 402260 - RNA, 15 nt, Homo sapiens
ccuugccauuuucaa

SEQ ID NO: 402261 - RNA, 20 nt, Homo sapiens
ccuugcccaaccaaugcaca

SEQ ID NO: 402262 - RNA, 21 nt, Homo sapiens
ccuugcccaacucccagccac

SEQ ID NO: 402263 - RNA, 16 nt, Homo sapiens
ccuugcucagugcaaa

SEQ ID NO: 402264 - RNA, 12 nt, Homo sapiens
ccuugcugcacc

SEQ ID NO: 402265 - RNA, 11 nt, Homo sapiens
ccuugcugcua

SEQ ID NO: 402266 - RNA, 11 nt, Homo sapiens
ccuuggaccaa

SEQ ID NO: 402267 - RNA, 14 nt, Homo sapiens
ccuuggcagaggca

SEQ ID NO: 402268 - RNA, 20 nt, Homo sapiens
ccuuggcgcgcagcccggga

SEQ ID NO: 402269 - RNA, 17 nt, Homo sapiens
ccuugggaugggcacag

SEQ ID NO: 402270 - RNA, 12 nt, Homo sapiens
ccuuggggccug

SEQ ID NO: 402271 - RNA, 15 nt, Homo sapiens
ccuuguaaaagccua

SEQ ID NO: 402272 - RNA, 19 nt, Homo sapiens
ccuuguaauucuaaaugaa

SEQ ID NO: 402273 - RNA, 22 nt, Homo sapiens
ccuuguccugaugcugugcuca

SEQ ID NO: 402274 - RNA, 12 nt, Homo sapiens
ccuugugucugu

SEQ ID NO: 402275 - RNA, 21 nt, Homo sapiens
ccuuguuauuuuauugccuuu

SEQ ID NO: 402276 - RNA, 19 nt, Homo sapiens
ccuuguugacacggccaug

SEQ ID NO: 402277 - RNA, 14 nt, Homo sapiens
ccuuguuguauucc

SEQ ID NO: 402278 - RNA, 11 nt, Homo sapiens
ccuuguuguug

SEQ ID NO: 402279 - RNA, 21 nt, Homo sapiens
ccuuguuguuguuaaauauca

SEQ ID NO: 402280 - RNA, 13 nt, Homo sapiens
ccuuuaaaaaaca

SEQ ID NO: 402281 - RNA, 23 nt, Homo sapiens
ccuuuaaaauaauaauaguacua

SEQ ID NO: 402282 - RNA, 17 nt, Homo sapiens
ccuuuaaauaucauucu

SEQ ID NO: 402283 - RNA, 14 nt, Homo sapiens
aggaucucucagga

SEQ ID NO: 402284 - RNA, 22 nt, Homo sapiens
aggaucuucccacuuugccacu

SEQ ID NO: 402285 - RNA, 17 nt, Homo sapiens
aggaugacccggggcag

SEQ ID NO: 402286 - RNA, 16 nt, Homo sapiens
aggaugacuacagaca

SEQ ID NO: 402287 - RNA, 22 nt, Homo sapiens
aggaugauggccacaacaugaa

SEQ ID NO: 402288 - RNA, 15 nt, Homo sapiens
aggaugcacuggccu

SEQ ID NO: 402289 - RNA, 12 nt, Homo sapiens
aggaugcuucug

SEQ ID NO: 402290 - RNA, 14 nt, Homo sapiens
aggauggcaaagag

SEQ ID NO: 402291 - RNA, 22 nt, Homo sapiens
aggauuauauguauuaauacuu

SEQ ID NO: 402292 - RNA, 13 nt, Homo sapiens
aggcaaagacagg

SEQ ID NO: 402293 - RNA, 17 nt, Homo sapiens
aggcaagccccucagcc

SEQ ID NO: 402294 - RNA, 15 nt, Homo sapiens
aggcaaugacuguga

SEQ ID NO: 402295 - RNA, 21 nt, Homo sapiens
aggcacagccggggccugccu

SEQ ID NO: 402296 - RNA, 22 nt, Homo sapiens
aggcacaggcuccuguauuuga

SEQ ID NO: 402297 - RNA, 15 nt, Homo sapiens
aggcaccugcuggaa

SEQ ID NO: 402298 - RNA, 22 nt, Homo sapiens
aggcaccuggccugcugggaac

SEQ ID NO: 402299 - RNA, 21 nt, Homo sapiens
aggcacgcuggcuugugaucu

SEQ ID NO: 402300 - RNA, 22 nt, Homo sapiens
aggcacugcugcccagccucca

SEQ ID NO: 402301 - RNA, 22 nt, Homo sapiens
aggcagaaacacaaccacucac

SEQ ID NO: 402302 - RNA, 16 nt, Homo sapiens
aggcagaggacagauc

SEQ ID NO: 402303 - RNA, 14 nt, Homo sapiens
aggcagagucucau

SEQ ID NO: 402304 - RNA, 23 nt, Homo sapiens
aggcagaucugugccccaugccu

SEQ ID NO: 402305 - RNA, 20 nt, Homo sapiens
aggcagcagaauugcuugaa

SEQ ID NO: 402306 - RNA, 19 nt, Homo sapiens
aggcagcuggaugagacuu

SEQ ID NO: 402307 - RNA, 15 nt, Homo sapiens
aggcagggaagcucu

SEQ ID NO: 402308 - RNA, 12 nt, Homo sapiens
aggcaguggcuu

SEQ ID NO: 402309 - RNA, 13 nt, Homo sapiens
aggcaguguuccu

SEQ ID NO: 402310 - RNA, 19 nt, Homo sapiens
aggcauaggccugggugcu

SEQ ID NO: 402311 - RNA, 14 nt, Homo sapiens
aggcauaguuuuua

SEQ ID NO: 402312 - RNA, 21 nt, Homo sapiens
aggcaucauuccaccauggcu

SEQ ID NO: 402313 - RNA, 13 nt, Homo sapiens
aggcaucauuuuc

SEQ ID NO: 402314 - RNA, 22 nt, Homo sapiens
aggcauccaguaucuugaagac

SEQ ID NO: 402315 - RNA, 21 nt, Homo sapiens
aggcaucuaagacauucacca

SEQ ID NO: 402316 - RNA, 12 nt, Homo sapiens
aggcaucuuccc

SEQ ID NO: 402317 - RNA, 13 nt, Homo sapiens
aggcaucuucccu

SEQ ID NO: 402318 - RNA, 18 nt, Homo sapiens
aggcaugcgaaugagcug

SEQ ID NO: 402319 - RNA, 14 nt, Homo sapiens
aggcauuccagggu

SEQ ID NO: 402320 - RNA, 13 nt, Homo sapiens
aggccaagcauuu

SEQ ID NO: 402321 - RNA, 23 nt, Homo sapiens
aggccaagcauuucuagcaguga

SEQ ID NO: 402322 - RNA, 13 nt, Homo sapiens
aggccaaggcagg

SEQ ID NO: 402323 - RNA, 21 nt, Homo sapiens
aggccacacacucugcauccg

SEQ ID NO: 402324 - RNA, 12 nt, Homo sapiens
aggccaccaucu

SEQ ID NO: 402325 - RNA, 20 nt, Homo sapiens
aggccacccccuauccucug

SEQ ID NO: 402326 - RNA, 15 nt, Homo sapiens
aggccacuugcucag

SEQ ID NO: 402327 - RNA, 12 nt, Homo sapiens
aggccagcagca

SEQ ID NO: 402328 - RNA, 15 nt, Homo sapiens
aggccaggaguucaa

SEQ ID NO: 402329 - RNA, 22 nt, Homo sapiens
aggccagucugaaccugagguu

SEQ ID NO: 402330 - RNA, 19 nt, Homo sapiens
aggccaguggacagaggga

SEQ ID NO: 402331 - RNA, 17 nt, Homo sapiens
aggccauggugcacaaa

SEQ ID NO: 402332 - RNA, 15 nt, Homo sapiens
aggcccaaauuauca

SEQ ID NO: 402333 - RNA, 17 nt, Homo sapiens
aggcccaccuaccuuca

SEQ ID NO: 402334 - RNA, 23 nt, Homo sapiens
aggcccacucuguuccuacugga

SEQ ID NO: 402335 - RNA, 16 nt, Homo sapiens
aggcccuggucagcuu

SEQ ID NO: 402336 - RNA, 14 nt, Homo sapiens
aggcccuguccuaa

SEQ ID NO: 402337 - RNA, 22 nt, Homo sapiens
aggcccuuccucuccacugccu

SEQ ID NO: 402338 - RNA, 20 nt, Homo sapiens
aggccggaugcgguggcuca

SEQ ID NO: 402339 - RNA, 20 nt, Homo sapiens
aggccgggcacgguggcuca

SEQ ID NO: 402340 - RNA, 19 nt, Homo sapiens
aggccgggcgcaguggcuc

SEQ ID NO: 402341 - RNA, 23 nt, Homo sapiens
aggccuccagccacuuauuucca

SEQ ID NO: 402342 - RNA, 12 nt, Homo sapiens
aggccugccugu

SEQ ID NO: 402343 - RNA, 16 nt, Homo sapiens
aggccugggagggcaa

SEQ ID NO: 402344 - RNA, 19 nt, Homo sapiens
aggccuuggugcccugaac

SEQ ID NO: 402345 - RNA, 12 nt, Homo sapiens
aggcggagcgcc

SEQ ID NO: 402346 - RNA, 19 nt, Homo sapiens
aggcggagcgccaguggaa

SEQ ID NO: 402347 - RNA, 18 nt, Homo sapiens
aggcgggcggcacgccaa

SEQ ID NO: 402348 - RNA, 16 nt, Homo sapiens
aggcgggggagccugg

SEQ ID NO: 402349 - RNA, 18 nt, Homo sapiens
aggcgugagccaccucac

SEQ ID NO: 402350 - RNA, 23 nt, Homo sapiens
aggcuaguccggacccaccucac

SEQ ID NO: 402351 - RNA, 17 nt, Homo sapiens
aggcuaugugagcacaa

SEQ ID NO: 402352 - RNA, 20 nt, Homo sapiens
aggcuauuccuaggccucag

SEQ ID NO: 402353 - RNA, 17 nt, Homo sapiens
aggcucuuacagccaca

SEQ ID NO: 402354 - RNA, 20 nt, Homo sapiens
aggcucuuagcagcuuccag

SEQ ID NO: 402355 - RNA, 12 nt, Homo sapiens
aggcucuucucc

SEQ ID NO: 402356 - RNA, 15 nt, Homo sapiens
aggcucuugcucaag

SEQ ID NO: 402357 - RNA, 14 nt, Homo sapiens
aggcugaacauaaa

SEQ ID NO: 402358 - RNA, 14 nt, Homo sapiens
aggcugacuaagaa

SEQ ID NO: 402359 - RNA, 15 nt, Homo sapiens
aggcugacuuuugca

SEQ ID NO: 402360 - RNA, 22 nt, Homo sapiens
aggcugaggccuggacuuuccu

SEQ ID NO: 402361 - RNA, 16 nt, Homo sapiens
aggcuggagugcaaug

SEQ ID NO: 402362 - RNA, 15 nt, Homo sapiens
aggcuggcugaaaau

SEQ ID NO: 402363 - RNA, 13 nt, Homo sapiens
aggcuggucucaa

SEQ ID NO: 402364 - RNA, 16 nt, Homo sapiens
aggcuguccuguacau

SEQ ID NO: 402365 - RNA, 23 nt, Homo sapiens
aggcuucccaaaccaagugccuu

SEQ ID NO: 402366 - RNA, 21 nt, Homo sapiens
aggcuucuuccccccaaaacu

SEQ ID NO: 402367 - RNA, 20 nt, Homo sapiens
aggcuuuuaagaaacacagg

SEQ ID NO: 402368 - RNA, 16 nt, Homo sapiens
agggaaacacagcagc

SEQ ID NO: 402369 - RNA, 13 nt, Homo sapiens
agggaagaacucu

SEQ ID NO: 402370 - RNA, 13 nt, Homo sapiens
agggaagcaggga

SEQ ID NO: 402371 - RNA, 19 nt, Homo sapiens
agggaagccccacuugaag

SEQ ID NO: 402372 - RNA, 19 nt, Homo sapiens
agggaagccgccuuugcaa

SEQ ID NO: 402373 - RNA, 18 nt, Homo sapiens
agggaagcugucccucac

SEQ ID NO: 402374 - RNA, 14 nt, Homo sapiens
agggaauaguggga

SEQ ID NO: 402375 - RNA, 12 nt, Homo sapiens
agguuucaccuc

SEQ ID NO: 402376 - RNA, 21 nt, Homo sapiens
agguuuuccugaagaauugaa

SEQ ID NO: 402377 - RNA, 15 nt, Homo sapiens
aguaaaaucuugccu

SEQ ID NO: 402378 - RNA, 18 nt, Homo sapiens
aguaaauaaaaguacaaa

SEQ ID NO: 402379 - RNA, 23 nt, Homo sapiens
aguaaauauugucacaacacuga

SEQ ID NO: 402380 - RNA, 11 nt, Homo sapiens
aguaacacuga

SEQ ID NO: 402381 - RNA, 20 nt, Homo sapiens
aguaacccugucuaaugaaa

SEQ ID NO: 402382 - RNA, 13 nt, Homo sapiens
aguaacugagauu

SEQ ID NO: 402383 - RNA, 19 nt, Homo sapiens
aguaagauuaaguuaggca

SEQ ID NO: 402384 - RNA, 14 nt, Homo sapiens
aguaagcugcugaa

SEQ ID NO: 402385 - RNA, 18 nt, Homo sapiens
aguaaguacaaauauucc

SEQ ID NO: 402386 - RNA, 22 nt, Homo sapiens
aguaaguuugauuucauuaaua

SEQ ID NO: 402387 - RNA, 23 nt, Homo sapiens
aguaauaaaacaucuuuccaguc

SEQ ID NO: 402388 - RNA, 21 nt, Homo sapiens
aguaauaucuuucaguuauua

SEQ ID NO: 402389 - RNA, 17 nt, Homo sapiens
aguaaucucacacuuca

SEQ ID NO: 402390 - RNA, 21 nt, Homo sapiens
aguaaugaauuuuuaugauau

SEQ ID NO: 402391 - RNA, 15 nt, Homo sapiens
aguaaugauauuuau

SEQ ID NO: 402392 - RNA, 15 nt, Homo sapiens
aguacacagauaccu

SEQ ID NO: 402393 - RNA, 13 nt, Homo sapiens
aguacacagguag

SEQ ID NO: 402394 - RNA, 20 nt, Homo sapiens
aguacacuugguguacuggg

SEQ ID NO: 402395 - RNA, 22 nt, Homo sapiens
aguacagagaaauucuguggug

SEQ ID NO: 402396 - RNA, 20 nt, Homo sapiens
aguacccaccugagcuuugg

SEQ ID NO: 402397 - RNA, 21 nt, Homo sapiens
aguacccaccugagcuuugga

SEQ ID NO: 402398 - RNA, 15 nt, Homo sapiens
aguaccuagugguga

SEQ ID NO: 402399 - RNA, 11 nt, Homo sapiens
aguaccugcug

SEQ ID NO: 402400 - RNA, 13 nt, Homo sapiens
aguaccuggaccu

SEQ ID NO: 402401 - RNA, 14 nt, Homo sapiens
aguaccuguaguga

SEQ ID NO: 402402 - RNA, 14 nt, Homo sapiens
aguaccuucaauac

SEQ ID NO: 402403 - RNA, 21 nt, Homo sapiens
aguacuaugacacuguuaaua

SEQ ID NO: 402404 - RNA, 16 nt, Homo sapiens
aguacuauuacuagua

SEQ ID NO: 402405 - RNA, 17 nt, Homo sapiens
aguacuucccaacaacu

SEQ ID NO: 402406 - RNA, 11 nt, Homo sapiens
aguacuugaaa

SEQ ID NO: 402407 - RNA, 16 nt, Homo sapiens
aguagaaauuuuacaa

SEQ ID NO: 402408 - RNA, 18 nt, Homo sapiens
aguagacuauaagcagaa

SEQ ID NO: 402409 - RNA, 21 nt, Homo sapiens
aguagacuucauuuuuccuaa

SEQ ID NO: 402410 - RNA, 18 nt, Homo sapiens
aguagagcaaaucuauga

SEQ ID NO: 402411 - RNA, 20 nt, Homo sapiens
aguagaugcaucuaagcagg

SEQ ID NO: 402412 - RNA, 18 nt, Homo sapiens
aguagggcuuggugaaug

SEQ ID NO: 402413 - RNA, 15 nt, Homo sapiens
aguaggggcauggua

SEQ ID NO: 402414 - RNA, 12 nt, Homo sapiens
aguauccacaau

SEQ ID NO: 402415 - RNA, 22 nt, Homo sapiens
aguauccaugcaugugcauaua

SEQ ID NO: 402416 - RNA, 11 nt, Homo sapiens
aguaucuguaa

SEQ ID NO: 402417 - RNA, 13 nt, Homo sapiens
aguaucuuaccug

SEQ ID NO: 402418 - RNA, 14 nt, Homo sapiens
aguaugaagacacu

SEQ ID NO: 402419 - RNA, 13 nt, Homo sapiens
cgugcaugugcac

SEQ ID NO: 402420 - RNA, 20 nt, Homo sapiens
cgugcauuuuuggaucauuu

SEQ ID NO: 402421 - RNA, 19 nt, Homo sapiens
cgugccaaauccugggcau

SEQ ID NO: 402422 - RNA, 9 nt, Homo sapiens
cgugcccuc

SEQ ID NO: 402423 - RNA, 17 nt, Homo sapiens
cgugccuguuugcuuag

SEQ ID NO: 402424 - RNA, 17 nt, Homo sapiens
cgugccuuccccgugcg

SEQ ID NO: 402425 - RNA, 16 nt, Homo sapiens
cguggacucugugcuc

SEQ ID NO: 402426 - RNA, 15 nt, Homo sapiens
cguggagaugucuuc

SEQ ID NO: 402427 - RNA, 14 nt, Homo sapiens
cguggaugaccucc

SEQ ID NO: 402428 - RNA, 21 nt, Homo sapiens
cgugggacccugccagacuga

SEQ ID NO: 402429 - RNA, 16 nt, Homo sapiens
cgugguacauucacag

SEQ ID NO: 402430 - RNA, 19 nt, Homo sapiens
cguguauucaggaccccau

SEQ ID NO: 402431 - RNA, 16 nt, Homo sapiens
cgugugcgugcaugug

SEQ ID NO: 402432 - RNA, 14 nt, Homo sapiens
cguguguccaugug

SEQ ID NO: 402433 - RNA, 12 nt, Homo sapiens
cgugugugcaag

SEQ ID NO: 402434 - RNA, 22 nt, Homo sapiens
cguguuuaauuaaauuucacaa

SEQ ID NO: 402435 - RNA, 13 nt, Homo sapiens
cguucacucccaa

SEQ ID NO: 402436 - RNA, 14 nt, Homo sapiens
cguucccacugccc

SEQ ID NO: 402437 - RNA, 23 nt, Homo sapiens
cguuccugggacugucagauaau

SEQ ID NO: 402438 - RNA, 23 nt, Homo sapiens
cguucucugccccguuucuugcc

SEQ ID NO: 402439 - RNA, 16 nt, Homo sapiens
cguugcgggguggagu

SEQ ID NO: 402440 - RNA, 11 nt, Homo sapiens
cguuucuugcc

SEQ ID NO: 402441 - RNA, 17 nt, Homo sapiens
cguuuuuuucauuccau

SEQ ID NO: 402442 - RNA, 21 nt, Homo sapiens
cuaaaaaguggcuaauucaau

SEQ ID NO: 402443 - RNA, 18 nt, Homo sapiens
cuaaaacuaugguuccca

SEQ ID NO: 402444 - RNA, 12 nt, Homo sapiens
cuaaaacugcuc

SEQ ID NO: 402445 - RNA, 17 nt, Homo sapiens
cuaaaacuuaacauuca

SEQ ID NO: 402446 - RNA, 18 nt, Homo sapiens
cuaaaacuuaacauucau

SEQ ID NO: 402447 - RNA, 17 nt, Homo sapiens
cuaaaagugaugugauu

SEQ ID NO: 402448 - RNA, 21 nt, Homo sapiens
cuaaaaguuacuuaccacaga

SEQ ID NO: 402449 - RNA, 19 nt, Homo sapiens
cuaaaaguuuuaaccucag

SEQ ID NO: 402450 - RNA, 16 nt, Homo sapiens
cuaaacguauuucacu

SEQ ID NO: 402451 - RNA, 15 nt, Homo sapiens
cuaaacuguuuucau

SEQ ID NO: 402452 - RNA, 22 nt, Homo sapiens
cuaaagauaauauuacuguuua

SEQ ID NO: 402453 - RNA, 12 nt, Homo sapiens
cuaaagauauca

SEQ ID NO: 402454 - RNA, 23 nt, Homo sapiens
cuaaagcaguguuuucaccucau

SEQ ID NO: 402455 - RNA, 22 nt, Homo sapiens
cuaaagcaucacacaguggcac

SEQ ID NO: 402456 - RNA, 22 nt, Homo sapiens
cuaaaggcagcaaccauucauc

SEQ ID NO: 402457 - RNA, 15 nt, Homo sapiens
cuaaaggucccaagg

SEQ ID NO: 402458 - RNA, 12 nt, Homo sapiens
cuaaaguuuuag

SEQ ID NO: 402459 - RNA, 21 nt, Homo sapiens
cuaaaguuuuauugaugugaa

SEQ ID NO: 402460 - RNA, 16 nt, Homo sapiens
cuaaaucuacucuuaa

SEQ ID NO: 402461 - RNA, 12 nt, Homo sapiens
cuaaaugaugcc

SEQ ID NO: 402462 - RNA, 11 nt, Homo sapiens
cuaaauuugaa

SEQ ID NO: 402463 - RNA, 21 nt, Homo sapiens
cuaaauuuucugaaacugcau

SEQ ID NO: 402464 - RNA, 17 nt, Homo sapiens
cuaaauuuuuacuuaac

SEQ ID NO: 402465 - RNA, 20 nt, Homo sapiens
cuaacaagccuuggaccaaa

SEQ ID NO: 402466 - RNA, 11 nt, Homo sapiens
cuaacacuagu

SEQ ID NO: 402467 - RNA, 12 nt, Homo sapiens
cuaacagcauaa

SEQ ID NO: 402468 - RNA, 16 nt, Homo sapiens
cuaacauguaauugca

SEQ ID NO: 402469 - RNA, 15 nt, Homo sapiens
cuaacccuacaugca

SEQ ID NO: 402470 - RNA, 15 nt, Homo sapiens
cuaacucauucuuca

SEQ ID NO: 402471 - RNA, 14 nt, Homo sapiens
cuaacucuugcuca

SEQ ID NO: 402472 - RNA, 20 nt, Homo sapiens
cuaacuuauuuuauuuccau

SEQ ID NO: 402473 - RNA, 20 nt, Homo sapiens
cuaagaagugguguuccaug

SEQ ID NO: 402474 - RNA, 23 nt, Homo sapiens
cuaagacaggaggaucacaagag

SEQ ID NO: 402475 - RNA, 11 nt, Homo sapiens
cuaagagccag

SEQ ID NO: 402476 - RNA, 16 nt, Homo sapiens
cuaagagucucuauua

SEQ ID NO: 402477 - RNA, 20 nt, Homo sapiens
cuaagauacugcugaugcug

SEQ ID NO: 402478 - RNA, 19 nt, Homo sapiens
cuaagaugaaauugccaaa

SEQ ID NO: 402479 - RNA, 17 nt, Homo sapiens
cuaagcaaguauauuua

SEQ ID NO: 402480 - RNA, 21 nt, Homo sapiens
cuaagcacuuuauaaauauca

SEQ ID NO: 402481 - RNA, 16 nt, Homo sapiens
cuaagccuguugcuga

SEQ ID NO: 402482 - RNA, 12 nt, Homo sapiens
cuaagcuuucuc

SEQ ID NO: 402483 - RNA, 17 nt, Homo sapiens
cuaagucaguuucacau

SEQ ID NO: 402484 - RNA, 14 nt, Homo sapiens
cuaaguguaaaaaa

SEQ ID NO: 402485 - RNA, 21 nt, Homo sapiens
cuaaguguacuucauaagaua

SEQ ID NO: 402486 - RNA, 17 nt, Homo sapiens
cuaaguguuuucaaaua

SEQ ID NO: 402487 - RNA, 16 nt, Homo sapiens
cuaaguuaccuuucua

SEQ ID NO: 402488 - RNA, 17 nt, Homo sapiens
cuaaguuauuuacuuuu

SEQ ID NO: 402489 - RNA, 19 nt, Homo sapiens
cuaauaauaguacuauuac

SEQ ID NO: 402490 - RNA, 14 nt, Homo sapiens
cuaauauggcaaaa

SEQ ID NO: 402491 - RNA, 13 nt, Homo sapiens
cuaaucauaacau

SEQ ID NO: 402492 - RNA, 19 nt, Homo sapiens
cuaauccuccaagucuuca

SEQ ID NO: 402493 - RNA, 13 nt, Homo sapiens
cuaaucuucaggg

SEQ ID NO: 402494 - RNA, 11 nt, Homo sapiens
cuaaugcauua

SEQ ID NO: 402495 - RNA, 23 nt, Homo sapiens
cuaaugccugcggaguugugcac

SEQ ID NO: 402496 - RNA, 20 nt, Homo sapiens
cuaauggaauaugcguaguu

SEQ ID NO: 402497 - RNA, 18 nt, Homo sapiens
cuaauguaggacuguaua

SEQ ID NO: 402498 - RNA, 23 nt, Homo sapiens
cuaaugugccccauguccaaguc

SEQ ID NO: 402499 - RNA, 20 nt, Homo sapiens
cuaauuccccuuccauuccc

SEQ ID NO: 402500 - RNA, 22 nt, Homo sapiens
cuaauuccuggcaugacacucu

SEQ ID NO: 402501 - RNA, 23 nt, Homo sapiens
cuaauuccuggcaugacacucua

SEQ ID NO: 402502 - RNA, 17 nt, Homo sapiens
cuaauuuacaagcacga

SEQ ID NO: 402503 - RNA, 18 nt, Homo sapiens
cuaauuuacaagcacgau

SEQ ID NO: 402504 - RNA, 15 nt, Homo sapiens
cuaauuuucucaaaa

SEQ ID NO: 402505 - RNA, 14 nt, Homo sapiens
cuacaaaaugacua

SEQ ID NO: 402506 - RNA, 12 nt, Homo sapiens
aguuucccugaa

SEQ ID NO: 402507 - RNA, 20 nt, Homo sapiens
aguuucuauggauucacuuc

SEQ ID NO: 402508 - RNA, 21 nt, Homo sapiens
aguuucucagcucccaaggcu

SEQ ID NO: 402509 - RNA, 21 nt, Homo sapiens
aguuucugagcuaacgugcug

SEQ ID NO: 402510 - RNA, 15 nt, Homo sapiens
aguuucugauucacu

SEQ ID NO: 402511 - RNA, 19 nt, Homo sapiens
aguuucuuccccaagagcu

SEQ ID NO: 402512 - RNA, 15 nt, Homo sapiens
aguuugaucauagaa

SEQ ID NO: 402513 - RNA, 21 nt, Homo sapiens
aguuugcccaccacaacuaac

SEQ ID NO: 402514 - RNA, 19 nt, Homo sapiens
aguuugcccugguuucacu

SEQ ID NO: 402515 - RNA, 11 nt, Homo sapiens
aguuugcuaag

SEQ ID NO: 402516 - RNA, 13 nt, Homo sapiens
aguuugcuuucaa

SEQ ID NO: 402517 - RNA, 20 nt, Homo sapiens
aguuugcuuugcugaccaaa

SEQ ID NO: 402518 - RNA, 23 nt, Homo sapiens
aguuuggaaguguuaacuauuua

SEQ ID NO: 402519 - RNA, 21 nt, Homo sapiens
aguuuuaaagaagucucuuaa

SEQ ID NO: 402520 - RNA, 22 nt, Homo sapiens
aguuuucgugcuuccuccugac

SEQ ID NO: 402521 - RNA, 23 nt, Homo sapiens
aguuuucgugcuuccuccugaca

SEQ ID NO: 402522 - RNA, 14 nt, Homo sapiens
aguuuucugugaga

SEQ ID NO: 402523 - RNA, 15 nt, Homo sapiens
aguuuucugugagaa

SEQ ID NO: 402524 - RNA, 18 nt, Homo sapiens
aguuuucugugagaauaa

SEQ ID NO: 402525 - RNA, 15 nt, Homo sapiens
aguuuugauacaaac

SEQ ID NO: 402526 - RNA, 13 nt, Homo sapiens
aguuuugaugaaa

SEQ ID NO: 402527 - RNA, 19 nt, Homo sapiens
auaaaaaaguguccuauaa

SEQ ID NO: 402528 - RNA, 21 nt, Homo sapiens
auaaaaacccuguauggcacu

SEQ ID NO: 402529 - RNA, 15 nt, Homo sapiens
auaaaagacaugaaa

SEQ ID NO: 402530 - RNA, 17 nt, Homo sapiens
auaaaaguccugucacc

SEQ ID NO: 402531 - RNA, 22 nt, Homo sapiens
auaaaaguccugucaccaagga

SEQ ID NO: 402532 - RNA, 17 nt, Homo sapiens
auaaaauaaauauacua

SEQ ID NO: 402533 - RNA, 15 nt, Homo sapiens
auaaaaucagaguug

SEQ ID NO: 402534 - RNA, 22 nt, Homo sapiens
auaaaaugguguuuucauguaa

SEQ ID NO: 402535 - RNA, 16 nt, Homo sapiens
auaaacaacauugucu

SEQ ID NO: 402536 - RNA, 17 nt, Homo sapiens
auaaacacuagacugua

SEQ ID NO: 402537 - RNA, 14 nt, Homo sapiens
auaaacagcuucau

SEQ ID NO: 402538 - RNA, 13 nt, Homo sapiens
auaaacauuuuau

SEQ ID NO: 402539 - RNA, 16 nt, Homo sapiens
auaaacccaucuguaa

SEQ ID NO: 402540 - RNA, 15 nt, Homo sapiens
auaaacuagaucucc

SEQ ID NO: 402541 - RNA, 19 nt, Homo sapiens
auaaacucacaacucucug

SEQ ID NO: 402542 - RNA, 20 nt, Homo sapiens
auaaacugugucugucccag

SEQ ID NO: 402543 - RNA, 15 nt, Homo sapiens
auaaacuuugaauuu

SEQ ID NO: 402544 - RNA, 16 nt, Homo sapiens
auaaagaaauaauacc

SEQ ID NO: 402545 - RNA, 15 nt, Homo sapiens
auaaagaugucugcu

SEQ ID NO: 402546 - RNA, 14 nt, Homo sapiens
auaaagcauuauaa

SEQ ID NO: 402547 - RNA, 14 nt, Homo sapiens
auaaagcccuugaa

SEQ ID NO: 402548 - RNA, 19 nt, Homo sapiens
auaaagccucugugcugca

SEQ ID NO: 402549 - RNA, 17 nt, Homo sapiens
auaaagcgaauggacca

SEQ ID NO: 402550 - RNA, 22 nt, Homo sapiens
auaaagggaaaaaauugcuuga

SEQ ID NO: 402551 - RNA, 14 nt, Homo sapiens
auaaaggucccuua

SEQ ID NO: 402552 - RNA, 15 nt, Homo sapiens
auaaaguacuacugu

SEQ ID NO: 402553 - RNA, 18 nt, Homo sapiens
auaaaguuauuacucuga

SEQ ID NO: 402554 - RNA, 18 nt, Homo sapiens
auaaaguuuuaugagaaa

SEQ ID NO: 402555 - RNA, 15 nt, Homo sapiens
auaaauaauguucau

SEQ ID NO: 402556 - RNA, 11 nt, Homo sapiens
auaaauaucaa

SEQ ID NO: 402557 - RNA, 14 nt, Homo sapiens
cucaagucuugaca

SEQ ID NO: 402558 - RNA, 18 nt, Homo sapiens
cucaauaaaggucauauu

SEQ ID NO: 402559 - RNA, 20 nt, Homo sapiens
cucaauaccccuaguaucug

SEQ ID NO: 402560 - RNA, 14 nt, Homo sapiens
cucaaugccaguaa

SEQ ID NO: 402561 - RNA, 21 nt, Homo sapiens
cucaauggaagaggccaggac

SEQ ID NO: 402562 - RNA, 14 nt, Homo sapiens
cucaauuugcagua

SEQ ID NO: 402563 - RNA, 15 nt, Homo sapiens
cucacacacacagcu

SEQ ID NO: 402564 - RNA, 15 nt, Homo sapiens
cucacagaugggcaa

SEQ ID NO: 402565 - RNA, 21 nt, Homo sapiens
cucacagccguccaacuuaaa

SEQ ID NO: 402566 - RNA, 16 nt, Homo sapiens
cucacaugcacagggg

SEQ ID NO: 402567 - RNA, 12 nt, Homo sapiens
cucacauucaca

SEQ ID NO: 402568 - RNA, 17 nt, Homo sapiens
cucaccaaaaagcuuua

SEQ ID NO: 402569 - RNA, 12 nt, Homo sapiens
cucaccauuuca

SEQ ID NO: 402570 - RNA, 17 nt, Homo sapiens
cucaccugcuggccccu

SEQ ID NO: 402571 - RNA, 16 nt, Homo sapiens
cucaccuggacuccag

SEQ ID NO: 402572 - RNA, 23 nt, Homo sapiens
cucaccugucuaggucuccucag

SEQ ID NO: 402573 - RNA, 12 nt, Homo sapiens
cucacgccugua

SEQ ID NO: 402574 - RNA, 17 nt, Homo sapiens
cucacuaaaaugcuaau

SEQ ID NO: 402575 - RNA, 19 nt, Homo sapiens
cucacuauucaaguauuag

SEQ ID NO: 402576 - RNA, 23 nt, Homo sapiens
cucacuauucaaguauuaggggu

SEQ ID NO: 402577 - RNA, 13 nt, Homo sapiens
cucacuccuagga

SEQ ID NO: 402578 - RNA, 14 nt, Homo sapiens
cucacuccuguuac

SEQ ID NO: 402579 - RNA, 15 nt, Homo sapiens
cucacugguuuucaa

SEQ ID NO: 402580 - RNA, 20 nt, Homo sapiens
cucacugguuuucaauacca

SEQ ID NO: 402581 - RNA, 21 nt, Homo sapiens
cucacuugcuuuaguuguuaa

SEQ ID NO: 402582 - RNA, 16 nt, Homo sapiens
cucacuuuguugccca

SEQ ID NO: 402583 - RNA, 19 nt, Homo sapiens
cucacuuuucuccaugagu

SEQ ID NO: 402584 - RNA, 18 nt, Homo sapiens
cucagaagucaguugcaa

SEQ ID NO: 402585 - RNA, 15 nt, Homo sapiens
cucagaauauaccca

SEQ ID NO: 402586 - RNA, 14 nt, Homo sapiens
cucagacauuccaa

SEQ ID NO: 402587 - RNA, 20 nt, Homo sapiens
cucagacgacaccuggagac

SEQ ID NO: 402588 - RNA, 19 nt, Homo sapiens
cucagagcuccacagaaga

SEQ ID NO: 402589 - RNA, 16 nt, Homo sapiens
cucagaggacuuggca

SEQ ID NO: 402590 - RNA, 17 nt, Homo sapiens
cucagaucacuacugca

SEQ ID NO: 402591 - RNA, 18 nt, Homo sapiens
cucagaucugaacacagu

SEQ ID NO: 402592 - RNA, 13 nt, Homo sapiens
cucagcaacaagg

SEQ ID NO: 402593 - RNA, 12 nt, Homo sapiens
cucagcacuuug

SEQ ID NO: 402594 - RNA, 18 nt, Homo sapiens
cucagcaggggaggguag

SEQ ID NO: 402595 - RNA, 19 nt, Homo sapiens
cucagcaguucacuuccua

SEQ ID NO: 402596 - RNA, 13 nt, Homo sapiens
cucagcauccacu

SEQ ID NO: 402597 - RNA, 14 nt, Homo sapiens
cucagcauccacua

SEQ ID NO: 402598 - RNA, 18 nt, Homo sapiens
cucagcugaaaacccgaa

SEQ ID NO: 402599 - RNA, 15 nt, Homo sapiens
cucagcugcacauuc

SEQ ID NO: 402600 - RNA, 14 nt, Homo sapiens
cucagcuucuuaau

SEQ ID NO: 402601 - RNA, 16 nt, Homo sapiens
cucaggagaaggccug

SEQ ID NO: 402602 - RNA, 16 nt, Homo sapiens
cucaggagacugaguu

SEQ ID NO: 402603 - RNA, 21 nt, Homo sapiens
cucaggcugagcucccucccc

SEQ ID NO: 402604 - RNA, 16 nt, Homo sapiens
cucaggggacuugaau

SEQ ID NO: 402605 - RNA, 14 nt, Homo sapiens
cucagggugggggg

SEQ ID NO: 402606 - RNA, 18 nt, Homo sapiens
cucagguagccaccaccg

SEQ ID NO: 402607 - RNA, 14 nt, Homo sapiens
cucagguaguacug

SEQ ID NO: 402608 - RNA, 18 nt, Homo sapiens
cucagguaguacugggaa

SEQ ID NO: 402609 - RNA, 21 nt, Homo sapiens
cucaggugaaaauccaucuca

SEQ ID NO: 402610 - RNA, 16 nt, Homo sapiens
cucaggugaccaaaac

SEQ ID NO: 402611 - RNA, 18 nt, Homo sapiens
cucagucauaaucauuag

SEQ ID NO: 402612 - RNA, 22 nt, Homo sapiens
cucagucaugcacucacaaaga

SEQ ID NO: 402613 - RNA, 21 nt, Homo sapiens
cucagugccaccuaugccugu

SEQ ID NO: 402614 - RNA, 12 nt, Homo sapiens
cucagugccacu

SEQ ID NO: 402615 - RNA, 15 nt, Homo sapiens
cucaguggaucacac

SEQ ID NO: 402616 - RNA, 16 nt, Homo sapiens
cucaguuggugcugcu

SEQ ID NO: 402617 - RNA, 14 nt, Homo sapiens
cucauacaaugaua

SEQ ID NO: 402618 - RNA, 19 nt, Homo sapiens
cucauauuuuuacaaauaa

SEQ ID NO: 402619 - RNA, 15 nt, Homo sapiens
cucaucaacaaucac

SEQ ID NO: 402620 - RNA, 21 nt, Homo sapiens
cucaucacauuuguaaauguc

SEQ ID NO: 402621 - RNA, 14 nt, Homo sapiens
cucaucccaaaagc

SEQ ID NO: 402622 - RNA, 15 nt, Homo sapiens
cucaucugacuugaa

SEQ ID NO: 402623 - RNA, 20 nt, Homo sapiens
cucaugauguauuguugcuu

SEQ ID NO: 402624 - RNA, 18 nt, Homo sapiens
cucaugccagcagcacgu

SEQ ID NO: 402625 - RNA, 21 nt, Homo sapiens
cucaugcugcagaggguacuu

SEQ ID NO: 402626 - RNA, 19 nt, Homo sapiens
cucauguucucauguuugu

SEQ ID NO: 402627 - RNA, 17 nt, Homo sapiens
cucauguuucuguagga

SEQ ID NO: 402628 - RNA, 21 nt, Homo sapiens
cucauguuugugcauguauau

SEQ ID NO: 402629 - RNA, 10 nt, Homo sapiens
cucauuccac

SEQ ID NO: 402630 - RNA, 16 nt, Homo sapiens
cucauuccaccuuccc

SEQ ID NO: 402631 - RNA, 15 nt, Homo sapiens
cucauucuagcaccu

SEQ ID NO: 402632 - RNA, 21 nt, Homo sapiens
cuccaaaacaauuuucugcag

SEQ ID NO: 402633 - RNA, 12 nt, Homo sapiens
cuccaaaacaca

SEQ ID NO: 402634 - RNA, 14 nt, Homo sapiens
cuccaaaagcacuu

SEQ ID NO: 402635 - RNA, 18 nt, Homo sapiens
cuccaaaggcacugaccc

SEQ ID NO: 402636 - RNA, 22 nt, Homo sapiens
cuccaaaguuuuaaaccuguua

SEQ ID NO: 402637 - RNA, 15 nt, Homo sapiens
cuccaacacuuugag

SEQ ID NO: 402638 - RNA, 18 nt, Homo sapiens
cuccaagguaacccggcu

SEQ ID NO: 402639 - RNA, 16 nt, Homo sapiens
cuccacagugcugcuu

SEQ ID NO: 402640 - RNA, 15 nt, Homo sapiens
cuccaccugcuggug

SEQ ID NO: 402641 - RNA, 21 nt, Homo sapiens
cuccaccuuguuacacauuau

SEQ ID NO: 402642 - RNA, 15 nt, Homo sapiens
cuccacgaagccuua

SEQ ID NO: 402643 - RNA, 13 nt, Homo sapiens
cuccacuccagau

SEQ ID NO: 402644 - RNA, 12 nt, Homo sapiens
cuccacuccucc

SEQ ID NO: 402645 - RNA, 15 nt, Homo sapiens
cuccacucugaaguc

SEQ ID NO: 402646 - RNA, 17 nt, Homo sapiens
cuccagaacaaaccucu

SEQ ID NO: 402647 - RNA, 20 nt, Homo sapiens
cuccagaacaaaccucuaua

SEQ ID NO: 402648 - RNA, 12 nt, Homo sapiens
cuccagaccacc

SEQ ID NO: 402649 - RNA, 14 nt, Homo sapiens
cuccagagcccuga

SEQ ID NO: 402650 - RNA, 16 nt, Homo sapiens
cuccagccagcaauga

SEQ ID NO: 402651 - RNA, 12 nt, Homo sapiens
cuccagugcagg

SEQ ID NO: 402652 - RNA, 18 nt, Homo sapiens
cuccaucauaugccugac

SEQ ID NO: 402653 - RNA, 17 nt, Homo sapiens
cuccaucuccacuccag

SEQ ID NO: 402654 - RNA, 14 nt, Homo sapiens
cuccauguuugaug

SEQ ID NO: 402655 - RNA, 20 nt, Homo sapiens
cucccaaagugcugagauua

SEQ ID NO: 402656 - RNA, 19 nt, Homo sapiens
cucccaaauaaacuccuua

SEQ ID NO: 402657 - RNA, 23 nt, Homo sapiens
cucccaagguccucucaguucuc

SEQ ID NO: 402658 - RNA, 14 nt, Homo sapiens
cucccaaucagcuu

SEQ ID NO: 402659 - RNA, 22 nt, Homo sapiens
cucccaccccggccuccacucc

SEQ ID NO: 402660 - RNA, 20 nt, Homo sapiens
cucccaggcccgagauguga

SEQ ID NO: 402661 - RNA, 15 nt, Homo sapiens
cucccagggccauga

SEQ ID NO: 402662 - RNA, 16 nt, Homo sapiens
cucccagggccaugaa

SEQ ID NO: 402663 - RNA, 17 nt, Homo sapiens
cucccagguggauuuug

SEQ ID NO: 402664 - RNA, 22 nt, Homo sapiens
cucccaguccaaauguccucca

SEQ ID NO: 402665 - RNA, 18 nt, Homo sapiens
cuccccaccccaaccacu

SEQ ID NO: 402666 - RNA, 14 nt, Homo sapiens
cuccccagagcacu

SEQ ID NO: 402667 - RNA, 16 nt, Homo sapiens
cuccccagagcacugg

SEQ ID NO: 402668 - RNA, 14 nt, Homo sapiens
cuccccgcuccuaa

SEQ ID NO: 402669 - RNA, 16 nt, Homo sapiens
cuccccucagauucca

SEQ ID NO: 402670 - RNA, 17 nt, Homo sapiens
cuccccucagauuccac

SEQ ID NO: 402671 - RNA, 15 nt, Homo sapiens
cuccccucccagucc

SEQ ID NO: 402672 - RNA, 14 nt, Homo sapiens
cucccuaaccacua

SEQ ID NO: 402673 - RNA, 15 nt, Homo sapiens
cucccucagcucucu

SEQ ID NO: 402674 - RNA, 13 nt, Homo sapiens
cucccucauucca

SEQ ID NO: 402675 - RNA, 16 nt, Homo sapiens
cucccuccagccaaua

SEQ ID NO: 402676 - RNA, 20 nt, Homo sapiens
cucccucgaacccacacugc

SEQ ID NO: 402677 - RNA, 15 nt, Homo sapiens
cucccuggcugugag

SEQ ID NO: 402678 - RNA, 20 nt, Homo sapiens
cucccuguuaucugcuagau

SEQ ID NO: 402679 - RNA, 16 nt, Homo sapiens
cucccuucccaguggg

SEQ ID NO: 402680 - RNA, 14 nt, Homo sapiens
cucccuuccugucc

SEQ ID NO: 402681 - RNA, 23 nt, Homo sapiens
cucccuuuuaaaaggagcacauu

SEQ ID NO: 402682 - RNA, 16 nt, Homo sapiens
cuccgucucaaaagaa

SEQ ID NO: 402683 - RNA, 18 nt, Homo sapiens
cuccguuuggcagugcaa

SEQ ID NO: 402684 - RNA, 14 nt, Homo sapiens
cuccuaaaacacac

SEQ ID NO: 402685 - RNA, 15 nt, Homo sapiens
cuccuaagacaccug

SEQ ID NO: 402686 - RNA, 13 nt, Homo sapiens
cuccuaagcaaaa

SEQ ID NO: 402687 - RNA, 16 nt, Homo sapiens
cuccuaccucugcucu

SEQ ID NO: 402688 - RNA, 20 nt, Homo sapiens
cuccucacaguugccaugua

SEQ ID NO: 402689 - RNA, 21 nt, Homo sapiens
cuccucagaucugaacacagu

SEQ ID NO: 402690 - RNA, 19 nt, Homo sapiens
cuccucgguggcauuugcu

SEQ ID NO: 402691 - RNA, 15 nt, Homo sapiens
auaaauauuagcaaa

SEQ ID NO: 402692 - RNA, 11 nt, Homo sapiens
auaaauccaac

SEQ ID NO: 402693 - RNA, 12 nt, Homo sapiens
auaaauggacuu

SEQ ID NO: 402694 - RNA, 14 nt, Homo sapiens
auaaauguauucaa

SEQ ID NO: 402695 - RNA, 16 nt, Homo sapiens
auaaauuaacauuaua

SEQ ID NO: 402696 - RNA, 15 nt, Homo sapiens
auaaauuauuuaacu

SEQ ID NO: 402697 - RNA, 21 nt, Homo sapiens
auaaauuggaacaccuccuca

SEQ ID NO: 402698 - RNA, 23 nt, Homo sapiens
auaaauuucugggauauuuaacu

SEQ ID NO: 402699 - RNA, 15 nt, Homo sapiens
auaacaacacuaaua

SEQ ID NO: 402700 - RNA, 13 nt, Homo sapiens
auaacaagccaaa

SEQ ID NO: 402701 - RNA, 18 nt, Homo sapiens
auaacaagccaaacauuc

SEQ ID NO: 402702 - RNA, 22 nt, Homo sapiens
auaacacagagagacagacuug

SEQ ID NO: 402703 - RNA, 19 nt, Homo sapiens
auaacacuguacugcaaua

SEQ ID NO: 402704 - RNA, 23 nt, Homo sapiens
auaacauugcacuuuauaaacac

SEQ ID NO: 402705 - RNA, 12 nt, Homo sapiens
auaaccacuuaa

SEQ ID NO: 402706 - RNA, 19 nt, Homo sapiens
auaacuuggggaggcaaga

SEQ ID NO: 402707 - RNA, 15 nt, Homo sapiens
auaagaaacaugaug

SEQ ID NO: 402708 - RNA, 23 nt, Homo sapiens
auaagaaccuuuugagugccuua

SEQ ID NO: 402709 - RNA, 13 nt, Homo sapiens
auaagacuggaaa

SEQ ID NO: 402710 - RNA, 13 nt, Homo sapiens
auaagagauuugg

SEQ ID NO: 402711 - RNA, 11 nt, Homo sapiens
auaagcaagag

SEQ ID NO: 402712 - RNA, 19 nt, Homo sapiens
auaagcagaagcacauaug

SEQ ID NO: 402713 - RNA, 21 nt, Homo sapiens
auaagcucuaguucuuaacaa

SEQ ID NO: 402714 - RNA, 22 nt, Homo sapiens
auaagcucuccccaaacuugcu

SEQ ID NO: 402715 - RNA, 22 nt, Homo sapiens
auaaggaucuucccacuuugcc

SEQ ID NO: 402716 - RNA, 19 nt, Homo sapiens
auaaggggaagacuuuaaa

SEQ ID NO: 402717 - RNA, 18 nt, Homo sapiens
auaaguaaaugagccuuu

SEQ ID NO: 402718 - RNA, 20 nt, Homo sapiens
auaaguccuuguguagcaaa

SEQ ID NO: 402719 - RNA, 16 nt, Homo sapiens
auaaguuaacuuccaa

SEQ ID NO: 402720 - RNA, 19 nt, Homo sapiens
auaauaaauuaacauuaua

SEQ ID NO: 402721 - RNA, 15 nt, Homo sapiens
auaauaauugaucaa

SEQ ID NO: 402722 - RNA, 22 nt, Homo sapiens
auaauccacgcucaucuugcaa

SEQ ID NO: 402723 - RNA, 15 nt, Homo sapiens
auaaucgaaguaauu

SEQ ID NO: 402724 - RNA, 15 nt, Homo sapiens
auaaugacucagaau

SEQ ID NO: 402725 - RNA, 21 nt, Homo sapiens
auaaugaguuuuacauuacaa

SEQ ID NO: 402726 - RNA, 22 nt, Homo sapiens
auaaugcacugggguaccacau

SEQ ID NO: 402727 - RNA, 17 nt, Homo sapiens
auaauguuacauuauua

SEQ ID NO: 402728 - RNA, 19 nt, Homo sapiens
auaauguuaguagcacuga

SEQ ID NO: 402729 - RNA, 19 nt, Homo sapiens
auaauguuccuuaguggua

SEQ ID NO: 402730 - RNA, 17 nt, Homo sapiens
auaauguuuauaaguca

SEQ ID NO: 402731 - RNA, 17 nt, Homo sapiens
auaauuagcuuguuaca

SEQ ID NO: 402732 - RNA, 20 nt, Homo sapiens
auaauuagcuuguuacaauu

SEQ ID NO: 402733 - RNA, 19 nt, Homo sapiens
auaauucuauacuguugau

SEQ ID NO: 402734 - RNA, 16 nt, Homo sapiens
auaauucuguauuaac

SEQ ID NO: 402735 - RNA, 16 nt, Homo sapiens
auaauugacuggugga

SEQ ID NO: 402736 - RNA, 11 nt, Homo sapiens
auaauugucaa

SEQ ID NO: 402737 - RNA, 13 nt, Homo sapiens
auaauuugaucuu

SEQ ID NO: 402738 - RNA, 19 nt, Homo sapiens
auaauuuuacaugucucau

SEQ ID NO: 402739 - RNA, 12 nt, Homo sapiens
auaauuuugcca

SEQ ID NO: 402740 - RNA, 20 nt, Homo sapiens
auacaaacuacagaguuuau

SEQ ID NO: 402741 - RNA, 20 nt, Homo sapiens
auacaaauacuaucucugua

SEQ ID NO: 402742 - RNA, 14 nt, Homo sapiens
auacaauauaacac

SEQ ID NO: 402743 - RNA, 22 nt, Homo sapiens
auacaauauuuuaacaaugugc

SEQ ID NO: 402744 - RNA, 13 nt, Homo sapiens
auacaaucagcug

SEQ ID NO: 402745 - RNA, 15 nt, Homo sapiens
auacaauuugcccaa

SEQ ID NO: 402746 - RNA, 16 nt, Homo sapiens
auacaauuugcccaag

SEQ ID NO: 402747 - RNA, 20 nt, Homo sapiens
auacagacagagauggccau

SEQ ID NO: 402748 - RNA, 20 nt, Homo sapiens
auacagcucuacguggcaaa

SEQ ID NO: 402749 - RNA, 18 nt, Homo sapiens
auacaguaagcugcucua

SEQ ID NO: 402750 - RNA, 12 nt, Homo sapiens
auacaguauuau

SEQ ID NO: 402751 - RNA, 19 nt, Homo sapiens
auacaugaaucauagccaa

SEQ ID NO: 402752 - RNA, 14 nt, Homo sapiens
auacaugaugauuu

SEQ ID NO: 402753 - RNA, 21 nt, Homo sapiens
auacaugugccgaaugugcag

SEQ ID NO: 402754 - RNA, 18 nt, Homo sapiens
auaccacugcacuccagc

SEQ ID NO: 402755 - RNA, 12 nt, Homo sapiens
auaccagcaaua

SEQ ID NO: 402756 - RNA, 21 nt, Homo sapiens
auacccacagguucuaugauu

SEQ ID NO: 402757 - RNA, 14 nt, Homo sapiens
auacccagucccag

SEQ ID NO: 402758 - RNA, 20 nt, Homo sapiens
auacccagucccagaaccac

SEQ ID NO: 402759 - RNA, 20 nt, Homo sapiens
auacggcucuaacagauuag

SEQ ID NO: 402760 - RNA, 14 nt, Homo sapiens
auacuaaauaugaa

SEQ ID NO: 402761 - RNA, 13 nt, Homo sapiens
auacuaaccauuu

SEQ ID NO: 402762 - RNA, 19 nt, Homo sapiens
auacuaauagaguacuuaa

SEQ ID NO: 402763 - RNA, 12 nt, Homo sapiens
auacuaccaagu

SEQ ID NO: 402764 - RNA, 22 nt, Homo sapiens
auacuagaaagcucugcaugug

SEQ ID NO: 402765 - RNA, 23 nt, Homo sapiens
auacuauauugcuguaugguaua

SEQ ID NO: 402766 - RNA, 17 nt, Homo sapiens
auacuaucuacucuccu

SEQ ID NO: 402767 - RNA, 17 nt, Homo sapiens
auacuauuuucauucuc

SEQ ID NO: 402768 - RNA, 14 nt, Homo sapiens
auacucaccaaaau

SEQ ID NO: 402769 - RNA, 18 nt, Homo sapiens
auacucucaccauuugga

SEQ ID NO: 402770 - RNA, 14 nt, Homo sapiens
auacugaguaugug

SEQ ID NO: 402771 - RNA, 22 nt, Homo sapiens
auacugcuugaccguacucuca

SEQ ID NO: 402772 - RNA, 18 nt, Homo sapiens
auacugguuauaguugau

SEQ ID NO: 402773 - RNA, 17 nt, Homo sapiens
auacuguaacacuguau

SEQ ID NO: 402774 - RNA, 18 nt, Homo sapiens
auacuguaacacuguaua

SEQ ID NO: 402775 - RNA, 13 nt, Homo sapiens
auacuguacugag

SEQ ID NO: 402776 - RNA, 21 nt, Homo sapiens
auacuguacugagacauuaca

SEQ ID NO: 402777 - RNA, 13 nt, Homo sapiens
auacuuaauacug

SEQ ID NO: 402778 - RNA, 13 nt, Homo sapiens
auacuuucaggca

SEQ ID NO: 402779 - RNA, 18 nt, Homo sapiens
auacuuuggggacuugua

SEQ ID NO: 402780 - RNA, 17 nt, Homo sapiens
auagaaacuugcuuauc

SEQ ID NO: 402781 - RNA, 15 nt, Homo sapiens
auagaaccacuauga

SEQ ID NO: 402782 - RNA, 23 nt, Homo sapiens
auagaauauacugucuugucuca

SEQ ID NO: 402783 - RNA, 15 nt, Homo sapiens
auagacacaguauug

SEQ ID NO: 402784 - RNA, 19 nt, Homo sapiens
auagacacaguauugacuu

SEQ ID NO: 402785 - RNA, 13 nt, Homo sapiens
auagaguacugca

SEQ ID NO: 402786 - RNA, 20 nt, Homo sapiens
auagagucaaccaccacaga

SEQ ID NO: 402787 - RNA, 21 nt, Homo sapiens
auagagucaaccaccacagau

SEQ ID NO: 402788 - RNA, 21 nt, Homo sapiens
auagauauccuuggcacaucc

SEQ ID NO: 402789 - RNA, 23 nt, Homo sapiens
auagaucagcaaaccggggccua

SEQ ID NO: 402790 - RNA, 14 nt, Homo sapiens
auagcaacaugcuu

SEQ ID NO: 402791 - RNA, 18 nt, Homo sapiens
auagcagggcugggcucu

SEQ ID NO: 402792 - RNA, 18 nt, Homo sapiens
auagcauugcuuucgugu

SEQ ID NO: 402793 - RNA, 18 nt, Homo sapiens
auagcccgaagucucaug

SEQ ID NO: 402794 - RNA, 22 nt, Homo sapiens
auagcgugcaguagagagcaaa

SEQ ID NO: 402795 - RNA, 16 nt, Homo sapiens
auagcuauuaagauac

SEQ ID NO: 402796 - RNA, 20 nt, Homo sapiens
auagcuggggcuucaccagu

SEQ ID NO: 402797 - RNA, 18 nt, Homo sapiens
auagcuuccagauuacaa

SEQ ID NO: 402798 - RNA, 13 nt, Homo sapiens
auaggcagcuuuc

SEQ ID NO: 402799 - RNA, 16 nt, Homo sapiens
auaggccaucuguaaa

SEQ ID NO: 402800 - RNA, 22 nt, Homo sapiens
auagguaauuaaggcagcugaa

SEQ ID NO: 402801 - RNA, 17 nt, Homo sapiens
auagguauauauaugcc

SEQ ID NO: 402802 - RNA, 12 nt, Homo sapiens
auagguguuacc

SEQ ID NO: 402803 - RNA, 17 nt, Homo sapiens
auaguauucaucugugu

SEQ ID NO: 402804 - RNA, 21 nt, Homo sapiens
auagucauuccaaauaugaga

SEQ ID NO: 402805 - RNA, 16 nt, Homo sapiens
auaguccuccaaaaca

SEQ ID NO: 402806 - RNA, 17 nt, Homo sapiens
auagugcacuagcauuu

SEQ ID NO: 402807 - RNA, 18 nt, Homo sapiens
auagugccagguggcuca

SEQ ID NO: 402808 - RNA, 14 nt, Homo sapiens
auaguguguccaug

SEQ ID NO: 402809 - RNA, 18 nt, Homo sapiens
auaguucuaucaggaaaa

SEQ ID NO: 402810 - RNA, 13 nt, Homo sapiens
auaguucuguuaa

SEQ ID NO: 402811 - RNA, 17 nt, Homo sapiens
auaguugauauguaaca

SEQ ID NO: 402812 - RNA, 19 nt, Homo sapiens
auaguuggagguauccugu

SEQ ID NO: 402813 - RNA, 20 nt, Homo sapiens
auaguuggagguauccugug

SEQ ID NO: 402814 - RNA, 20 nt, Homo sapiens
auauaaaauauauauugcau

SEQ ID NO: 402815 - RNA, 14 nt, Homo sapiens
auauaaacugugag

SEQ ID NO: 402816 - RNA, 18 nt, Homo sapiens
auauaaauucuaagccau

SEQ ID NO: 402817 - RNA, 14 nt, Homo sapiens
auauaagagcaaga

SEQ ID NO: 402818 - RNA, 16 nt, Homo sapiens
auauaauaugucuuca

SEQ ID NO: 402819 - RNA, 22 nt, Homo sapiens
auauacauagucuuuguuuaca

SEQ ID NO: 402820 - RNA, 23 nt, Homo sapiens
auauacauauguuaauucuaguc

SEQ ID NO: 402821 - RNA, 12 nt, Homo sapiens
auauacuaauau

SEQ ID NO: 402822 - RNA, 13 nt, Homo sapiens
auauacuaugaaa

SEQ ID NO: 402823 - RNA, 16 nt, Homo sapiens
cuccucugaagcauuu

SEQ ID NO: 402824 - RNA, 16 nt, Homo sapiens
cuccucuucagaggag

SEQ ID NO: 402825 - RNA, 13 nt, Homo sapiens
cuccugcuggaug

SEQ ID NO: 402826 - RNA, 20 nt, Homo sapiens
cuccuggaggcccuggucag

SEQ ID NO: 402827 - RNA, 18 nt, Homo sapiens
cuccuggcucacagccac

SEQ ID NO: 402828 - RNA, 21 nt, Homo sapiens
cuccuguauuugagacuagga

SEQ ID NO: 402829 - RNA, 20 nt, Homo sapiens
cuccugugcuagaugugcaa

SEQ ID NO: 402830 - RNA, 14 nt, Homo sapiens
cuccuguugccaca

SEQ ID NO: 402831 - RNA, 13 nt, Homo sapiens
cuccuguuugcag

SEQ ID NO: 402832 - RNA, 22 nt, Homo sapiens
cuccuuaaacugacgcuaguca

SEQ ID NO: 402833 - RNA, 17 nt, Homo sapiens
cuccuucuccauaaagc

SEQ ID NO: 402834 - RNA, 16 nt, Homo sapiens
cuccuugaggucuuga

SEQ ID NO: 402835 - RNA, 12 nt, Homo sapiens
cuccuugccacc

SEQ ID NO: 402836 - RNA, 14 nt, Homo sapiens
cuccuugcccuggg

SEQ ID NO: 402837 - RNA, 17 nt, Homo sapiens
cuccuuguaaaagccua

SEQ ID NO: 402838 - RNA, 18 nt, Homo sapiens
cuccuugucuuaaucguc

SEQ ID NO: 402839 - RNA, 14 nt, Homo sapiens
cuccuuuccugcaa

SEQ ID NO: 402840 - RNA, 21 nt, Homo sapiens
cuccuuucuugcacuauucca

SEQ ID NO: 402841 - RNA, 14 nt, Homo sapiens
cuccuuugcacuga

SEQ ID NO: 402842 - RNA, 14 nt, Homo sapiens
cucgaauaucuuaa

SEQ ID NO: 402843 - RNA, 19 nt, Homo sapiens
cucgcagcacccacagcac

SEQ ID NO: 402844 - RNA, 21 nt, Homo sapiens
cucgcuggugaagacccagag

SEQ ID NO: 402845 - RNA, 21 nt, Homo sapiens
cucggaacuuacuguguaaau

SEQ ID NO: 402846 - RNA, 23 nt, Homo sapiens
cucggccuccucccacaagcacc

SEQ ID NO: 402847 - RNA, 20 nt, Homo sapiens
cucguagugguacauuccau

SEQ ID NO: 402848 - RNA, 20 nt, Homo sapiens
cucguauaugucucaggucc

SEQ ID NO: 402849 - RNA, 14 nt, Homo sapiens
cucguccacagggg

SEQ ID NO: 402850 - RNA, 19 nt, Homo sapiens
cucgucuuccucucucuca

SEQ ID NO: 402851 - RNA, 20 nt, Homo sapiens
cucgucuuggcacaaucuca

SEQ ID NO: 402852 - RNA, 20 nt, Homo sapiens
cucuaaaaauaaaaugaugu

SEQ ID NO: 402853 - RNA, 12 nt, Homo sapiens
cucuaacuucaa

SEQ ID NO: 402854 - RNA, 14 nt, Homo sapiens
cucuacgccaaagu

SEQ ID NO: 402855 - RNA, 14 nt, Homo sapiens
cucuacgugcuccu

SEQ ID NO: 402856 - RNA, 16 nt, Homo sapiens
cucuacuacaugugac

SEQ ID NO: 402857 - RNA, 14 nt, Homo sapiens
cucuagaacagcca

SEQ ID NO: 402858 - RNA, 23 nt, Homo sapiens
cucuagacaucuagucucagugc

SEQ ID NO: 402859 - RNA, 20 nt, Homo sapiens
cucuagccugggccacaggg

SEQ ID NO: 402860 - RNA, 22 nt, Homo sapiens
cucuagccugggccacagggcg

SEQ ID NO: 402861 - RNA, 18 nt, Homo sapiens
cucuagugucuuuugccu

SEQ ID NO: 402862 - RNA, 21 nt, Homo sapiens
cucuagugucuuuugccuuua

SEQ ID NO: 402863 - RNA, 20 nt, Homo sapiens
cucuauggguaucaaacagc

SEQ ID NO: 402864 - RNA, 13 nt, Homo sapiens
cucuauucucaaa

SEQ ID NO: 402865 - RNA, 17 nt, Homo sapiens
cucuauucucugcaauu

SEQ ID NO: 402866 - RNA, 19 nt, Homo sapiens
cucuauugauguacagucu

SEQ ID NO: 402867 - RNA, 13 nt, Homo sapiens
cucucacaugcac

SEQ ID NO: 402868 - RNA, 22 nt, Homo sapiens
cucucagugcuucuuacuauua

SEQ ID NO: 402869 - RNA, 20 nt, Homo sapiens
cucucaguugcagcccugcu

SEQ ID NO: 402870 - RNA, 18 nt, Homo sapiens
cucuccaucuuccacgaa

SEQ ID NO: 402871 - RNA, 13 nt, Homo sapiens
cucucccaaauaa

SEQ ID NO: 402872 - RNA, 19 nt, Homo sapiens
cucucccucuucucaagug

SEQ ID NO: 402873 - RNA, 16 nt, Homo sapiens
cucuccugacuuuuaa

SEQ ID NO: 402874 - RNA, 16 nt, Homo sapiens
cucucgacaguaucca

SEQ ID NO: 402875 - RNA, 20 nt, Homo sapiens
cucucgagggaagcagugug

SEQ ID NO: 402876 - RNA, 15 nt, Homo sapiens
cucucucucaccuac

SEQ ID NO: 402877 - RNA, 19 nt, Homo sapiens
cucucugcaccugucucau

SEQ ID NO: 402878 - RNA, 13 nt, Homo sapiens
cucucugcuccuc

SEQ ID NO: 402879 - RNA, 15 nt, Homo sapiens
cucucuucugcucca

SEQ ID NO: 402880 - RNA, 17 nt, Homo sapiens
cucugaagagcugagua

SEQ ID NO: 402881 - RNA, 20 nt, Homo sapiens
cucugaauuggauccagggg

SEQ ID NO: 402882 - RNA, 18 nt, Homo sapiens
cucugaccuucacaggga

SEQ ID NO: 402883 - RNA, 22 nt, Homo sapiens
cucugagauacuaauaggugug

SEQ ID NO: 402884 - RNA, 21 nt, Homo sapiens
cucugagcccgggucucuuca

SEQ ID NO: 402885 - RNA, 15 nt, Homo sapiens
cucugagcugcaguu

SEQ ID NO: 402886 - RNA, 14 nt, Homo sapiens
cucugaugcacugu

SEQ ID NO: 402887 - RNA, 22 nt, Homo sapiens
cucugcaagcccacuggccagc

SEQ ID NO: 402888 - RNA, 16 nt, Homo sapiens
cucugcaccugucuca

SEQ ID NO: 402889 - RNA, 18 nt, Homo sapiens
cucugcacuccauggcca

SEQ ID NO: 402890 - RNA, 18 nt, Homo sapiens
cucugcagcccacagagg

SEQ ID NO: 402891 - RNA, 16 nt, Homo sapiens
cucugcaguugaucuc

SEQ ID NO: 402892 - RNA, 14 nt, Homo sapiens
cucugcauagacaa

SEQ ID NO: 402893 - RNA, 19 nt, Homo sapiens
cucugcaucuccugucuuu

SEQ ID NO: 402894 - RNA, 13 nt, Homo sapiens
cucugccagugac

SEQ ID NO: 402895 - RNA, 13 nt, Homo sapiens
cucugccaugugg

SEQ ID NO: 402896 - RNA, 19 nt, Homo sapiens
cucugcuccgugugucuca

SEQ ID NO: 402897 - RNA, 17 nt, Homo sapiens
cucuggauacaccgaau

SEQ ID NO: 402898 - RNA, 12 nt, Homo sapiens
aucaauguuucu

SEQ ID NO: 402899 - RNA, 17 nt, Homo sapiens
aucaauuuguaauugcu

SEQ ID NO: 402900 - RNA, 15 nt, Homo sapiens
aucacaccucugggc

SEQ ID NO: 402901 - RNA, 21 nt, Homo sapiens
aucacauuauuugcauguuac

SEQ ID NO: 402902 - RNA, 20 nt, Homo sapiens
aucaccugccaaaugaauaa

SEQ ID NO: 402903 - RNA, 17 nt, Homo sapiens
aucacuauaaccaucag

SEQ ID NO: 402904 - RNA, 20 nt, Homo sapiens
aucacucaaccauaacacuu

SEQ ID NO: 402905 - RNA, 13 nt, Homo sapiens
aucacuccagugc

SEQ ID NO: 402906 - RNA, 14 nt, Homo sapiens
aucacuugagguca

SEQ ID NO: 402907 - RNA, 14 nt, Homo sapiens
aucagacucaucua

SEQ ID NO: 402908 - RNA, 15 nt, Homo sapiens
aucagagaguguaca

SEQ ID NO: 402909 - RNA, 15 nt, Homo sapiens
aucagaucugacaug

SEQ ID NO: 402910 - RNA, 13 nt, Homo sapiens
aucagaucuuaca

SEQ ID NO: 402911 - RNA, 13 nt, Homo sapiens
aucagcauuaguc

SEQ ID NO: 402912 - RNA, 15 nt, Homo sapiens
aucagccacauucua

SEQ ID NO: 402913 - RNA, 21 nt, Homo sapiens
aucagccagacgagguccuca

SEQ ID NO: 402914 - RNA, 21 nt, Homo sapiens
aucagccuccgccauuccaag

SEQ ID NO: 402915 - RNA, 15 nt, Homo sapiens
aucagcucucugcaa

SEQ ID NO: 402916 - RNA, 19 nt, Homo sapiens
aucagcucucugcaaagau

SEQ ID NO: 402917 - RNA, 23 nt, Homo sapiens
aucagcuuucccuggcucaggga

SEQ ID NO: 402918 - RNA, 20 nt, Homo sapiens
aucaggaaaacaaaucacug

SEQ ID NO: 402919 - RNA, 16 nt, Homo sapiens
aucaggcacugcgcca

SEQ ID NO: 402920 - RNA, 14 nt, Homo sapiens
aucagggaauccag

SEQ ID NO: 402921 - RNA, 17 nt, Homo sapiens
aucagggaggucauuuu

SEQ ID NO: 402922 - RNA, 21 nt, Homo sapiens
aucagggggcaugaagcacau

SEQ ID NO: 402923 - RNA, 22 nt, Homo sapiens
aucaggucauacuaucuacucu

SEQ ID NO: 402924 - RNA, 20 nt, Homo sapiens
aucaguguccucuugcucaa

SEQ ID NO: 402925 - RNA, 20 nt, Homo sapiens
aucaguucccccaguaccuc

SEQ ID NO: 402926 - RNA, 21 nt, Homo sapiens
aucaguuuuccuagucuuugg

SEQ ID NO: 402927 - RNA, 16 nt, Homo sapiens
aucauaaaacuugaug

SEQ ID NO: 402928 - RNA, 19 nt, Homo sapiens
aucaugaguggacuuugca

SEQ ID NO: 402929 - RNA, 14 nt, Homo sapiens
aucaugcaugcacu

SEQ ID NO: 402930 - RNA, 14 nt, Homo sapiens
aucaugcauuguug

SEQ ID NO: 402931 - RNA, 17 nt, Homo sapiens
aucauggcucacugcag

SEQ ID NO: 402932 - RNA, 16 nt, Homo sapiens
aucaugggcuggacau

SEQ ID NO: 402933 - RNA, 15 nt, Homo sapiens
aucauuaauucacau

SEQ ID NO: 402934 - RNA, 15 nt, Homo sapiens
aucauuggaauuccu

SEQ ID NO: 402935 - RNA, 17 nt, Homo sapiens
aucauuggaauuccuug

SEQ ID NO: 402936 - RNA, 19 nt, Homo sapiens
aucauuguagaaacacagu

SEQ ID NO: 402937 - RNA, 21 nt, Homo sapiens
auccaaagaacuugauuugca

SEQ ID NO: 402938 - RNA, 14 nt, Homo sapiens
auccaaagacugua

SEQ ID NO: 402939 - RNA, 15 nt, Homo sapiens
auccaaagacuguac

SEQ ID NO: 402940 - RNA, 19 nt, Homo sapiens
auccaaaugcugugcaaac

SEQ ID NO: 402941 - RNA, 16 nt, Homo sapiens
auccaaauuaaaggaa

SEQ ID NO: 402942 - RNA, 19 nt, Homo sapiens
auccaaauucucugagaug

SEQ ID NO: 402943 - RNA, 12 nt, Homo sapiens
auccaacgugaa

SEQ ID NO: 402944 - RNA, 18 nt, Homo sapiens
auccaauccucacugggu

SEQ ID NO: 402945 - RNA, 21 nt, Homo sapiens
auccacaccguacaucugcaa

SEQ ID NO: 402946 - RNA, 22 nt, Homo sapiens
auccacauuuuaacaguaccug

SEQ ID NO: 402947 - RNA, 16 nt, Homo sapiens
auccagagagaagcac

SEQ ID NO: 402948 - RNA, 18 nt, Homo sapiens
auccagagagcagugugg

SEQ ID NO: 402949 - RNA, 15 nt, Homo sapiens
auccagcccaggacu

SEQ ID NO: 402950 - RNA, 23 nt, Homo sapiens
auccagggacugaagccaaaguu

SEQ ID NO: 402951 - RNA, 13 nt, Homo sapiens
auccauaaccucu

SEQ ID NO: 402952 - RNA, 23 nt, Homo sapiens
auccaugcaccccaccagcaaua

SEQ ID NO: 402953 - RNA, 18 nt, Homo sapiens
auccauguguggacucaa

SEQ ID NO: 402954 - RNA, 20 nt, Homo sapiens
aucccaagucaaacagugug

SEQ ID NO: 402955 - RNA, 18 nt, Homo sapiens
aucccaauccuuauccca

SEQ ID NO: 402956 - RNA, 12 nt, Homo sapiens
aucccagcacuu

SEQ ID NO: 402957 - RNA, 13 nt, Homo sapiens
cugaaacuauaga

SEQ ID NO: 402958 - RNA, 14 nt, Homo sapiens
cugaaagaagacau

SEQ ID NO: 402959 - RNA, 21 nt, Homo sapiens
cugaaagacaguaaagaccau

SEQ ID NO: 402960 - RNA, 23 nt, Homo sapiens
cugaacauaggaaaauagaaacu

SEQ ID NO: 402961 - RNA, 14 nt, Homo sapiens
cugaacuugaauua

SEQ ID NO: 402962 - RNA, 19 nt, Homo sapiens
cugaagaagcaaacaugac

SEQ ID NO: 402963 - RNA, 13 nt, Homo sapiens
cugaagaccucca

SEQ ID NO: 402964 - RNA, 14 nt, Homo sapiens
cugaagaccuccac

SEQ ID NO: 402965 - RNA, 16 nt, Homo sapiens
cugaagagauacccac

SEQ ID NO: 402966 - RNA, 15 nt, Homo sapiens
cugaagcaaauacca

SEQ ID NO: 402967 - RNA, 12 nt, Homo sapiens
cugaagccaaag

SEQ ID NO: 402968 - RNA, 22 nt, Homo sapiens
cugaagccaaaguuaugcaagg

SEQ ID NO: 402969 - RNA, 20 nt, Homo sapiens
cugaaggaauagccagagag

SEQ ID NO: 402970 - RNA, 20 nt, Homo sapiens
cugaagucacguagcacaga

SEQ ID NO: 402971 - RNA, 20 nt, Homo sapiens
cugaagucucuucucucuua

SEQ ID NO: 402972 - RNA, 21 nt, Homo sapiens
cugaagucuuuguacagacaa

SEQ ID NO: 402973 - RNA, 15 nt, Homo sapiens
cugaauaacuugaag

SEQ ID NO: 402974 - RNA, 24 nt, Homo sapiens
cugaauauuuuuuauuucuaagua

SEQ ID NO: 402975 - RNA, 21 nt, Homo sapiens
cugaaucauuaacagugcugu

SEQ ID NO: 402976 - RNA, 18 nt, Homo sapiens
cugaaugcauucagggga

SEQ ID NO: 402977 - RNA, 13 nt, Homo sapiens
cugaaugcuccau

SEQ ID NO: 402978 - RNA, 17 nt, Homo sapiens
cugaaugcugcuacuua

SEQ ID NO: 402979 - RNA, 18 nt, Homo sapiens
cugaaugcugcuacuuaa

SEQ ID NO: 402980 - RNA, 15 nt, Homo sapiens
cugaauucuuuucaa

SEQ ID NO: 402981 - RNA, 18 nt, Homo sapiens
cugaauuggauccagggg

SEQ ID NO: 402982 - RNA, 14 nt, Homo sapiens
cugaccaaaaguga

SEQ ID NO: 402983 - RNA, 11 nt, Homo sapiens
cugaccacaga

SEQ ID NO: 402984 - RNA, 21 nt, Homo sapiens
cugaccccacuuaugcugcug

SEQ ID NO: 402985 - RNA, 15 nt, Homo sapiens
cugacccggccccua

SEQ ID NO: 402986 - RNA, 23 nt, Homo sapiens
cugacccggccccuaccagccac

SEQ ID NO: 402987 - RNA, 19 nt, Homo sapiens
cugaccucaggugauccac

SEQ ID NO: 402988 - RNA, 19 nt, Homo sapiens
cugaccucaggugauccgc

SEQ ID NO: 402989 - RNA, 21 nt, Homo sapiens
cugaccuccuggacuguagga

SEQ ID NO: 402990 - RNA, 18 nt, Homo sapiens
cugaccuggcuggugaca

SEQ ID NO: 402991 - RNA, 17 nt, Homo sapiens
cugaccuugcacaaacu

SEQ ID NO: 402992 - RNA, 16 nt, Homo sapiens
cugacgcaaaaccacu

SEQ ID NO: 402993 - RNA, 18 nt, Homo sapiens
cugacguagcugcaaagg

SEQ ID NO: 402994 - RNA, 20 nt, Homo sapiens
cugacuagaagggccagucc

SEQ ID NO: 402995 - RNA, 16 nt, Homo sapiens
cugacuguacuccucc

SEQ ID NO: 402996 - RNA, 16 nt, Homo sapiens
cugacuguugcuguaa

SEQ ID NO: 402997 - RNA, 18 nt, Homo sapiens
cugacuuccaagauccuu

SEQ ID NO: 402998 - RNA, 13 nt, Homo sapiens
cugacuugaacuc

SEQ ID NO: 402999 - RNA, 16 nt, Homo sapiens
cugacuuggugcaagg

SEQ ID NO: 403000 - RNA, 16 nt, Homo sapiens
cugacuuuuaauguca

SEQ ID NO: 403001 - RNA, 20 nt, Homo sapiens
cugagaaaugggguggaaua

SEQ ID NO: 403002 - RNA, 21 nt, Homo sapiens
cugagaacaaauacaauucag

SEQ ID NO: 403003 - RNA, 14 nt, Homo sapiens
cugagaagaucuga

SEQ ID NO: 403004 - RNA, 11 nt, Homo sapiens
cugagaaggaa

SEQ ID NO: 403005 - RNA, 14 nt, Homo sapiens
cugagaaggcuaaa

SEQ ID NO: 403006 - RNA, 14 nt, Homo sapiens
cugagaaucuagcc

SEQ ID NO: 403007 - RNA, 18 nt, Homo sapiens
cugagagacaggacuagc

SEQ ID NO: 403008 - RNA, 14 nt, Homo sapiens
cugagagaccaucu

SEQ ID NO: 403009 - RNA, 21 nt, Homo sapiens
cugagagugaaaccaugacug

SEQ ID NO: 403010 - RNA, 16 nt, Homo sapiens
cugagaucagugccua

SEQ ID NO: 403011 - RNA, 16 nt, Homo sapiens
cugagaucagugccuc

SEQ ID NO: 403012 - RNA, 17 nt, Homo sapiens
cugagcacccgcugaca

SEQ ID NO: 403013 - RNA, 21 nt, Homo sapiens
cugagcagugccagcuuucuu

SEQ ID NO: 403014 - RNA, 12 nt, Homo sapiens
cugagccaguca

SEQ ID NO: 403015 - RNA, 17 nt, Homo sapiens
cugagccccuaccccac

SEQ ID NO: 403016 - RNA, 20 nt, Homo sapiens
cugagcccuugcacaggcca

SEQ ID NO: 403017 - RNA, 20 nt, Homo sapiens
cugagcgggucuaguggaaa

SEQ ID NO: 403018 - RNA, 19 nt, Homo sapiens
cugagcuaacgugcuguca

SEQ ID NO: 403019 - RNA, 20 nt, Homo sapiens
cugagcugccuguaacuuga

SEQ ID NO: 403020 - RNA, 15 nt, Homo sapiens
cugagcuuuccagcc

SEQ ID NO: 403021 - RNA, 22 nt, Homo sapiens
cugagcuuuggacacacacagc

SEQ ID NO: 403022 - RNA, 21 nt, Homo sapiens
cugaggaaugcgguucagggc

SEQ ID NO: 403023 - RNA, 22 nt, Homo sapiens
cugaggcaagagaauugcuuga

SEQ ID NO: 403024 - RNA, 17 nt, Homo sapiens
cugagggucuggugcca

SEQ ID NO: 403025 - RNA, 22 nt, Homo sapiens
cugaguccacucggagugcccu

SEQ ID NO: 403026 - RNA, 12 nt, Homo sapiens
cugaguccuguu

SEQ ID NO: 403027 - RNA, 21 nt, Homo sapiens
cugagucugugaauaaagcca

SEQ ID NO: 403028 - RNA, 15 nt, Homo sapiens
cugagugaaaacauc

SEQ ID NO: 403029 - RNA, 22 nt, Homo sapiens
cugagugggagcugucaggcag

SEQ ID NO: 403030 - RNA, 18 nt, Homo sapiens
cugaguggugaggggcca

SEQ ID NO: 403031 - RNA, 14 nt, Homo sapiens
cugaguggugccaa

SEQ ID NO: 403032 - RNA, 17 nt, Homo sapiens
cugaguuugaacacaga

SEQ ID NO: 403033 - RNA, 15 nt, Homo sapiens
cugauaaacauuaaa

SEQ ID NO: 403034 - RNA, 22 nt, Homo sapiens
cugauaaacauuaaacacugua

SEQ ID NO: 403035 - RNA, 12 nt, Homo sapiens
cugauaccucaa

SEQ ID NO: 403036 - RNA, 13 nt, Homo sapiens
cugaucagucuaa

SEQ ID NO: 403037 - RNA, 14 nt, Homo sapiens
cugaucaugcauug

SEQ ID NO: 403038 - RNA, 19 nt, Homo sapiens
cugaucauugguuucuuaa

SEQ ID NO: 403039 - RNA, 14 nt, Homo sapiens
cugauccugaacaa

SEQ ID NO: 403040 - RNA, 14 nt, Homo sapiens
cugaucgugcuaaa

SEQ ID NO: 403041 - RNA, 17 nt, Homo sapiens
cugaugaaacucacaaa

SEQ ID NO: 403042 - RNA, 16 nt, Homo sapiens
cugaugacacugagaa

SEQ ID NO: 403043 - RNA, 13 nt, Homo sapiens
cugaugacuccuc

SEQ ID NO: 403044 - RNA, 12 nt, Homo sapiens
cugaugaucaaa

SEQ ID NO: 403045 - RNA, 22 nt, Homo sapiens
cugaugggaaugauuaagggag

SEQ ID NO: 403046 - RNA, 21 nt, Homo sapiens
cugauguccuaccacuuugaa

SEQ ID NO: 403047 - RNA, 20 nt, Homo sapiens
cugauucuuaugauuacuau

SEQ ID NO: 403048 - RNA, 23 nt, Homo sapiens
cugauuucucuucagcuuugaaa

SEQ ID NO: 403049 - RNA, 13 nt, Homo sapiens
cugcaaauucagu

SEQ ID NO: 403050 - RNA, 16 nt, Homo sapiens
cugcaacuucuguccc

SEQ ID NO: 403051 - RNA, 21 nt, Homo sapiens
cugcacaaaagucucaauguu

SEQ ID NO: 403052 - RNA, 16 nt, Homo sapiens
cugcacacaaucuagc

SEQ ID NO: 403053 - RNA, 14 nt, Homo sapiens
cugcacacauaaca

SEQ ID NO: 403054 - RNA, 21 nt, Homo sapiens
cugcacaccaguuacuguuca

SEQ ID NO: 403055 - RNA, 21 nt, Homo sapiens
cugcacagauggauuugccug

SEQ ID NO: 403056 - RNA, 13 nt, Homo sapiens
cugcacagcccaa

SEQ ID NO: 403057 - RNA, 17 nt, Homo sapiens
cugcacagugcaucuca

SEQ ID NO: 403058 - RNA, 18 nt, Homo sapiens
cugcacagugcaucucag

SEQ ID NO: 403059 - RNA, 20 nt, Homo sapiens
cugcacccuguauggagcua

SEQ ID NO: 403060 - RNA, 20 nt, Homo sapiens
cugcaccgagagagauggaa

SEQ ID NO: 403061 - RNA, 23 nt, Homo sapiens
cugcacucuuauuucacuaaaga

SEQ ID NO: 403062 - RNA, 16 nt, Homo sapiens
cugcagaauccagcua

SEQ ID NO: 403063 - RNA, 15 nt, Homo sapiens
cugcagacaaaaaga

SEQ ID NO: 403064 - RNA, 18 nt, Homo sapiens
cugcagacaaaaagaaca

SEQ ID NO: 403065 - RNA, 22 nt, Homo sapiens
cugcagcaggcagaggagagua

SEQ ID NO: 403066 - RNA, 17 nt, Homo sapiens
cugcaggacacagaucu

SEQ ID NO: 403067 - RNA, 15 nt, Homo sapiens
cugcaggcugcaguc

SEQ ID NO: 403068 - RNA, 14 nt, Homo sapiens
cugcaguccuggug

SEQ ID NO: 403069 - RNA, 16 nt, Homo sapiens
cugcaguuccugagua

SEQ ID NO: 403070 - RNA, 15 nt, Homo sapiens
cugcauacccgggca

SEQ ID NO: 403071 - RNA, 21 nt, Homo sapiens
cugcauaguauuccauugugu

SEQ ID NO: 403072 - RNA, 12 nt, Homo sapiens
cugcaucccucc

SEQ ID NO: 403073 - RNA, 18 nt, Homo sapiens
cugcaucuccccucagau

SEQ ID NO: 403074 - RNA, 23 nt, Homo sapiens
cugcaugcugcuggacaguauca

SEQ ID NO: 403075 - RNA, 19 nt, Homo sapiens
cugcauggaccuaacauuc

SEQ ID NO: 403076 - RNA, 17 nt, Homo sapiens
cugccaagacagugaag

SEQ ID NO: 403077 - RNA, 13 nt, Homo sapiens
cugccaagcccuc

SEQ ID NO: 403078 - RNA, 19 nt, Homo sapiens
cugccaaguccugccuuug

SEQ ID NO: 403079 - RNA, 16 nt, Homo sapiens
cugccaccucccugac

SEQ ID NO: 403080 - RNA, 22 nt, Homo sapiens
cugccacuaggcugggugccca

SEQ ID NO: 403081 - RNA, 15 nt, Homo sapiens
cugccacugacugca

SEQ ID NO: 403082 - RNA, 17 nt, Homo sapiens
cugccaucaugccugac

SEQ ID NO: 403083 - RNA, 22 nt, Homo sapiens
cugccaucgccuccaucagcca

SEQ ID NO: 403084 - RNA, 13 nt, Homo sapiens
cugccaugauagc

SEQ ID NO: 403085 - RNA, 23 nt, Homo sapiens
cugccauuaaauccgcaaacagc

SEQ ID NO: 403086 - RNA, 15 nt, Homo sapiens
cugccauuuuugcaa

SEQ ID NO: 403087 - RNA, 12 nt, Homo sapiens
cugcccaaagca

SEQ ID NO: 403088 - RNA, 17 nt, Homo sapiens
cugcccagaugcccuuu

SEQ ID NO: 403089 - RNA, 15 nt, Homo sapiens
aucccagcacuuugg

SEQ ID NO: 403090 - RNA, 22 nt, Homo sapiens
aucccaggaggggccucugaaa

SEQ ID NO: 403091 - RNA, 22 nt, Homo sapiens
aucccaggcgggcggcacgcca

SEQ ID NO: 403092 - RNA, 22 nt, Homo sapiens
aucccaguucauguugcucaga

SEQ ID NO: 403093 - RNA, 19 nt, Homo sapiens
aucccccagccucaagucu

SEQ ID NO: 403094 - RNA, 19 nt, Homo sapiens
auccccuuuggcuaccuga

SEQ ID NO: 403095 - RNA, 20 nt, Homo sapiens
auccccuuugguuuuacuac

SEQ ID NO: 403096 - RNA, 17 nt, Homo sapiens
auccccuuuguguagaa

SEQ ID NO: 403097 - RNA, 17 nt, Homo sapiens
aucccgaaaaucucucg

SEQ ID NO: 403098 - RNA, 14 nt, Homo sapiens
aucccguguugcca

SEQ ID NO: 403099 - RNA, 18 nt, Homo sapiens
aucccuagucuauugcag

SEQ ID NO: 403100 - RNA, 15 nt, Homo sapiens
aucccugauuccugu

SEQ ID NO: 403101 - RNA, 17 nt, Homo sapiens
auccgucaccagaauua

SEQ ID NO: 403102 - RNA, 16 nt, Homo sapiens
auccuaacaagccuug

SEQ ID NO: 403103 - RNA, 18 nt, Homo sapiens
auccuacccuaaugccag

SEQ ID NO: 403104 - RNA, 19 nt, Homo sapiens
auccuacuccuaccugguc

SEQ ID NO: 403105 - RNA, 13 nt, Homo sapiens
auccuagcacuuu

SEQ ID NO: 403106 - RNA, 18 nt, Homo sapiens
auccucacccagcaccca

SEQ ID NO: 403107 - RNA, 22 nt, Homo sapiens
auccucaugaggcuucucagcc

SEQ ID NO: 403108 - RNA, 23 nt, Homo sapiens
auccugaaaaggguguugcuaag

SEQ ID NO: 403109 - RNA, 23 nt, Homo sapiens
auccugagcagugccagcuuucu

SEQ ID NO: 403110 - RNA, 21 nt, Homo sapiens
auccugaguaguaaucucaca

SEQ ID NO: 403111 - RNA, 22 nt, Homo sapiens
auccugauaaacauuaaacacu

SEQ ID NO: 403112 - RNA, 14 nt, Homo sapiens
auccugcccagugu

SEQ ID NO: 403113 - RNA, 17 nt, Homo sapiens
auccugccucuccccaa

SEQ ID NO: 403114 - RNA, 18 nt, Homo sapiens
auccuguuucuugcucug

SEQ ID NO: 403115 - RNA, 14 nt, Homo sapiens
auccuuccaaagaa

SEQ ID NO: 403116 - RNA, 18 nt, Homo sapiens
auccuucccgcagcacca

SEQ ID NO: 403117 - RNA, 18 nt, Homo sapiens
auccuugcuaaguuuuca

SEQ ID NO: 403118 - RNA, 12 nt, Homo sapiens
aucgaccacagu

SEQ ID NO: 403119 - RNA, 18 nt, Homo sapiens
aucgcaaggccugugcug

SEQ ID NO: 403120 - RNA, 20 nt, Homo sapiens
aucgcaggagucucugccac

SEQ ID NO: 403121 - RNA, 20 nt, Homo sapiens
aucgccuccaucagccagac

SEQ ID NO: 403122 - RNA, 16 nt, Homo sapiens
aucgcuggaaaacagc

SEQ ID NO: 403123 - RNA, 19 nt, Homo sapiens
aucguggccuugaccucca

SEQ ID NO: 403124 - RNA, 15 nt, Homo sapiens
aucuaaaaaauaucu

SEQ ID NO: 403125 - RNA, 15 nt, Homo sapiens
aucuaaaaucugcua

SEQ ID NO: 403126 - RNA, 15 nt, Homo sapiens
aucuaacaaagucaa

SEQ ID NO: 403127 - RNA, 14 nt, Homo sapiens
aucuacaacuccaa

SEQ ID NO: 403128 - RNA, 17 nt, Homo sapiens
aucuaccucacuauuca

SEQ ID NO: 403129 - RNA, 23 nt, Homo sapiens
aucuagcuccauaauugcaaggg

SEQ ID NO: 403130 - RNA, 22 nt, Homo sapiens
aucuagguucaggaagaccaca

SEQ ID NO: 403131 - RNA, 20 nt, Homo sapiens
aucuaguucucaaucacugc

SEQ ID NO: 403132 - RNA, 13 nt, Homo sapiens
aucuaguuuacag

SEQ ID NO: 403133 - RNA, 14 nt, Homo sapiens
aucuaucaacuaua

SEQ ID NO: 403134 - RNA, 15 nt, Homo sapiens
aucuaucaacuauaa

SEQ ID NO: 403135 - RNA, 18 nt, Homo sapiens
aucuaucaccugucauca

SEQ ID NO: 403136 - RNA, 16 nt, Homo sapiens
aucucaccccauccca

SEQ ID NO: 403137 - RNA, 21 nt, Homo sapiens
aucucacuggaugcaaagaaa

SEQ ID NO: 403138 - RNA, 15 nt, Homo sapiens
aucucagccuaccau

SEQ ID NO: 403139 - RNA, 17 nt, Homo sapiens
aucucagcucacugcaa

SEQ ID NO: 403140 - RNA, 18 nt, Homo sapiens
aucucaguccucaaagcu

SEQ ID NO: 403141 - RNA, 12 nt, Homo sapiens
aucucagugcag

SEQ ID NO: 403142 - RNA, 12 nt, Homo sapiens
aucucauuacag

SEQ ID NO: 403143 - RNA, 15 nt, Homo sapiens
aucucauuccacugu

SEQ ID NO: 403144 - RNA, 22 nt, Homo sapiens
aucuccagggaguccccucccc

SEQ ID NO: 403145 - RNA, 16 nt, Homo sapiens
aucuccccucagauuc

SEQ ID NO: 403146 - RNA, 19 nt, Homo sapiens
aucuccugugcauggguga

SEQ ID NO: 403147 - RNA, 16 nt, Homo sapiens
aucuccuugauuacau

SEQ ID NO: 403148 - RNA, 16 nt, Homo sapiens
aucucggucacaggga

SEQ ID NO: 403149 - RNA, 19 nt, Homo sapiens
aucucucacacauuccagg

SEQ ID NO: 403150 - RNA, 22 nt, Homo sapiens
aucucucccuccccugccauuu

SEQ ID NO: 403151 - RNA, 15 nt, Homo sapiens
aucucugcugaacau

SEQ ID NO: 403152 - RNA, 16 nt, Homo sapiens
aucucuuccuacccaa

SEQ ID NO: 403153 - RNA, 15 nt, Homo sapiens
aucucuucuuccuuu

SEQ ID NO: 403154 - RNA, 22 nt, Homo sapiens
aucucuucuuugcugcagucau

SEQ ID NO: 403155 - RNA, 20 nt, Homo sapiens
aucucuuucaucuagcucca

SEQ ID NO: 403156 - RNA, 16 nt, Homo sapiens
aucugaacacauacua

SEQ ID NO: 403157 - RNA, 18 nt, Homo sapiens
aucugacaugauuccuuc

SEQ ID NO: 403158 - RNA, 21 nt, Homo sapiens
gaaaauucuguagguucugug

SEQ ID NO: 403159 - RNA, 16 nt, Homo sapiens
gaaaauuuuacuucca

SEQ ID NO: 403160 - RNA, 18 nt, Homo sapiens
gaaacaaaaaaguguucc

SEQ ID NO: 403161 - RNA, 16 nt, Homo sapiens
gaaacacagaacucag

SEQ ID NO: 403162 - RNA, 17 nt, Homo sapiens
gaaacauacguucuuuu

SEQ ID NO: 403163 - RNA, 16 nt, Homo sapiens
gaaacauuccgaagag

SEQ ID NO: 403164 - RNA, 13 nt, Homo sapiens
gaaacauuugcca

SEQ ID NO: 403165 - RNA, 21 nt, Homo sapiens
gaaacauuuuguggucauuaa

SEQ ID NO: 403166 - RNA, 21 nt, Homo sapiens
gaaaccagaaugauuuugaca

SEQ ID NO: 403167 - RNA, 10 nt, Homo sapiens
gaaaccagag

SEQ ID NO: 403168 - RNA, 17 nt, Homo sapiens
gaaacccuauuucccca

SEQ ID NO: 403169 - RNA, 18 nt, Homo sapiens
gaaaccugcccugccuga

SEQ ID NO: 403170 - RNA, 21 nt, Homo sapiens
gaaaccuguuaugccaaacag

SEQ ID NO: 403171 - RNA, 17 nt, Homo sapiens
gaaaccuuauuguaccu

SEQ ID NO: 403172 - RNA, 17 nt, Homo sapiens
gaaacgaaaaccacaaa

SEQ ID NO: 403173 - RNA, 18 nt, Homo sapiens
gaaacugaaaacuguaaa

SEQ ID NO: 403174 - RNA, 11 nt, Homo sapiens
gaaacugaguc

SEQ ID NO: 403175 - RNA, 16 nt, Homo sapiens
gaaacugaguccuguu

SEQ ID NO: 403176 - RNA, 18 nt, Homo sapiens
gaaacugagucuguggac

SEQ ID NO: 403177 - RNA, 17 nt, Homo sapiens
gaaacugcuaauuacac

SEQ ID NO: 403178 - RNA, 19 nt, Homo sapiens
gaaacuugugaaguggaaa

SEQ ID NO: 403179 - RNA, 18 nt, Homo sapiens
gaaagaaagcaccuguuu

SEQ ID NO: 403180 - RNA, 23 nt, Homo sapiens
gaaagaauuauuuuuguguuucu

SEQ ID NO: 403181 - RNA, 19 nt, Homo sapiens
gaaagacaguaaagaccau

SEQ ID NO: 403182 - RNA, 22 nt, Homo sapiens
gaaagagcgucauguccuuggc

SEQ ID NO: 403183 - RNA, 23 nt, Homo sapiens
gaaagagcucuccagaagccaau

SEQ ID NO: 403184 - RNA, 22 nt, Homo sapiens
gaaagagcuggcaaacugugaa

SEQ ID NO: 403185 - RNA, 15 nt, Homo sapiens
gaaagaguugcagua

SEQ ID NO: 403186 - RNA, 21 nt, Homo sapiens
gaaagaucccaagucaaacag

SEQ ID NO: 403187 - RNA, 20 nt, Homo sapiens
gaaagauugguaagagccaa

SEQ ID NO: 403188 - RNA, 18 nt, Homo sapiens
gaaagcaggcaagcaugu

SEQ ID NO: 403189 - RNA, 16 nt, Homo sapiens
gaaagccagugacucc

SEQ ID NO: 403190 - RNA, 14 nt, Homo sapiens
gaaagccauugacc

SEQ ID NO: 403191 - RNA, 20 nt, Homo sapiens
gaaagccucagccauucacu

SEQ ID NO: 403192 - RNA, 15 nt, Homo sapiens
gaaagccucuggaaa

SEQ ID NO: 403193 - RNA, 19 nt, Homo sapiens
gaaagcugauuacugucaa

SEQ ID NO: 403194 - RNA, 12 nt, Homo sapiens
gaaagcuguaua

SEQ ID NO: 403195 - RNA, 12 nt, Homo sapiens
gaaagcugugaa

SEQ ID NO: 403196 - RNA, 13 nt, Homo sapiens
gaaagcugugaaa

SEQ ID NO: 403197 - RNA, 20 nt, Homo sapiens
gaaagcuuugaacaauugug

SEQ ID NO: 403198 - RNA, 14 nt, Homo sapiens
gaaaggaaagaaga

SEQ ID NO: 403199 - RNA, 16 nt, Homo sapiens
gaaaggaacacgcggg

SEQ ID NO: 403200 - RNA, 17 nt, Homo sapiens
gaaaggcaucuaagaca

SEQ ID NO: 403201 - RNA, 20 nt, Homo sapiens
gaaaggcaugaaucuucccu

SEQ ID NO: 403202 - RNA, 17 nt, Homo sapiens
gaaagggaaaagggaga

SEQ ID NO: 403203 - RNA, 17 nt, Homo sapiens
gaaaguacguuaugaua

SEQ ID NO: 403204 - RNA, 15 nt, Homo sapiens
gaaaguaugugauau

SEQ ID NO: 403205 - RNA, 16 nt, Homo sapiens
gaaagucaccaggacu

SEQ ID NO: 403206 - RNA, 13 nt, Homo sapiens
gaaagugcugacu

SEQ ID NO: 403207 - RNA, 15 nt, Homo sapiens
gaaauaacauggccu

SEQ ID NO: 403208 - RNA, 16 nt, Homo sapiens
gaaauaacauggccuu

SEQ ID NO: 403209 - RNA, 15 nt, Homo sapiens
gaaauaacauugcac

SEQ ID NO: 403210 - RNA, 16 nt, Homo sapiens
gaaauaacauugcacu

SEQ ID NO: 403211 - RNA, 14 nt, Homo sapiens
gaaauacacuacaa

SEQ ID NO: 403212 - RNA, 16 nt, Homo sapiens
gaaauacuauaacaua

SEQ ID NO: 403213 - RNA, 22 nt, Homo sapiens
gaaauaguuauuuuaauaccuu

SEQ ID NO: 403214 - RNA, 15 nt, Homo sapiens
gaaauccaaacuacu

SEQ ID NO: 403215 - RNA, 17 nt, Homo sapiens
gaaauccauaucuuaaa

SEQ ID NO: 403216 - RNA, 20 nt, Homo sapiens
gaaauccuaguggccuccca

SEQ ID NO: 403217 - RNA, 22 nt, Homo sapiens
gaaaucuuguuggcaaaucaga

SEQ ID NO: 403218 - RNA, 21 nt, Homo sapiens
gaaaugaaacaaauaaucaca

SEQ ID NO: 403219 - RNA, 22 nt, Homo sapiens
gaaaugccacgugccauugucu

SEQ ID NO: 403220 - RNA, 21 nt, Homo sapiens
gaaaugcugauuuaaacuucu

SEQ ID NO: 403221 - RNA, 15 nt, Homo sapiens
gaaauguauccugau

SEQ ID NO: 403222 - RNA, 17 nt, Homo sapiens
gaaauugcaaagaaaau

SEQ ID NO: 403223 - RNA, 19 nt, Homo sapiens
gaaauugcauuuccugaca

SEQ ID NO: 403224 - RNA, 20 nt, Homo sapiens
gaaauuuuuuuccagaauug

SEQ ID NO: 403225 - RNA, 21 nt, Homo sapiens
gaaauuuuuuuccagaauuga

SEQ ID NO: 403226 - RNA, 15 nt, Homo sapiens
gaacaaaaaugacag

SEQ ID NO: 403227 - RNA, 17 nt, Homo sapiens
gaacaaacuaagccagg

SEQ ID NO: 403228 - RNA, 17 nt, Homo sapiens
gaacaaauacaauucag

SEQ ID NO: 403229 - RNA, 18 nt, Homo sapiens
gaacaagcaauuacaaua

SEQ ID NO: 403230 - RNA, 16 nt, Homo sapiens
gaacaaucaaggcaac

SEQ ID NO: 403231 - RNA, 14 nt, Homo sapiens
gaacaaugcuauaa

SEQ ID NO: 403232 - RNA, 16 nt, Homo sapiens
gaacaauuuggucuua

SEQ ID NO: 403233 - RNA, 15 nt, Homo sapiens
gaacacacauuauua

SEQ ID NO: 403234 - RNA, 12 nt, Homo sapiens
gaacacacuugg

SEQ ID NO: 403235 - RNA, 15 nt, Homo sapiens
gaacacagcaugugc

SEQ ID NO: 403236 - RNA, 14 nt, Homo sapiens
gaacaccuccucaa

SEQ ID NO: 403237 - RNA, 23 nt, Homo sapiens
gaacacuaaugaggaaacugcac

SEQ ID NO: 403238 - RNA, 11 nt, Homo sapiens
gaacacuggcc

SEQ ID NO: 403239 - RNA, 19 nt, Homo sapiens
gaacagaauugcuccugca

SEQ ID NO: 403240 - RNA, 17 nt, Homo sapiens
gaacagauggcugugaa

SEQ ID NO: 403241 - RNA, 18 nt, Homo sapiens
gaacagauggcugugaaa

SEQ ID NO: 403242 - RNA, 22 nt, Homo sapiens
caaaagcaagacuguugcucaa

SEQ ID NO: 403243 - RNA, 18 nt, Homo sapiens
caaaaggagaacugugcu

SEQ ID NO: 403244 - RNA, 17 nt, Homo sapiens
caaaagguuaagccaua

SEQ ID NO: 403245 - RNA, 17 nt, Homo sapiens
caaaagugauguuauag

SEQ ID NO: 403246 - RNA, 17 nt, Homo sapiens
caaaauaaagaauagca

SEQ ID NO: 403247 - RNA, 22 nt, Homo sapiens
caaaauaguucuauuucuaucu

SEQ ID NO: 403248 - RNA, 17 nt, Homo sapiens
caaaauauuuauuuguu

SEQ ID NO: 403249 - RNA, 14 nt, Homo sapiens
caaaauccuugccu

SEQ ID NO: 403250 - RNA, 16 nt, Homo sapiens
caaaaucuucacugaa

SEQ ID NO: 403251 - RNA, 18 nt, Homo sapiens
caaaaugacaaugaugau

SEQ ID NO: 403252 - RNA, 21 nt, Homo sapiens
caaaauggacguacugguuua

SEQ ID NO: 403253 - RNA, 14 nt, Homo sapiens
caaaauuccauccc

SEQ ID NO: 403254 - RNA, 22 nt, Homo sapiens
caaaauuuugcuccccagugaa

SEQ ID NO: 403255 - RNA, 23 nt, Homo sapiens
caaaauuuugcuccccagugaag

SEQ ID NO: 403256 - RNA, 14 nt, Homo sapiens
caaacaaauaugca

SEQ ID NO: 403257 - RNA, 13 nt, Homo sapiens
caaacagcucagg

SEQ ID NO: 403258 - RNA, 13 nt, Homo sapiens
caaacaggcaguu

SEQ ID NO: 403259 - RNA, 16 nt, Homo sapiens
caaacaggugcuaaca

SEQ ID NO: 403260 - RNA, 14 nt, Homo sapiens
caaacauacccauc

SEQ ID NO: 403261 - RNA, 18 nt, Homo sapiens
caaacccacccauaccag

SEQ ID NO: 403262 - RNA, 16 nt, Homo sapiens
caaaccccgaccaccu

SEQ ID NO: 403263 - RNA, 15 nt, Homo sapiens
caaaccgagugcaau

SEQ ID NO: 403264 - RNA, 17 nt, Homo sapiens
caaaccgagugcaauga

SEQ ID NO: 403265 - RNA, 22 nt, Homo sapiens
caaaccuggcgucuauaccaac

SEQ ID NO: 403266 - RNA, 14 nt, Homo sapiens
caaacuacaaagcu

SEQ ID NO: 403267 - RNA, 17 nt, Homo sapiens
caaacuccugaccucaa

SEQ ID NO: 403268 - RNA, 14 nt, Homo sapiens
caaacuuccaguca

SEQ ID NO: 403269 - RNA, 16 nt, Homo sapiens
caaacuucuggcuuca

SEQ ID NO: 403270 - RNA, 15 nt, Homo sapiens
caaacuugcuuuaug

SEQ ID NO: 403271 - RNA, 15 nt, Homo sapiens
caaacuuucacuuug

SEQ ID NO: 403272 - RNA, 20 nt, Homo sapiens
caaagaaacagccuuacacu

SEQ ID NO: 403273 - RNA, 13 nt, Homo sapiens
caaagaaauagca

SEQ ID NO: 403274 - RNA, 18 nt, Homo sapiens
caaagaaaugcugaugga

SEQ ID NO: 403275 - RNA, 21 nt, Homo sapiens
caaagaacucaccacaagcca

SEQ ID NO: 403276 - RNA, 23 nt, Homo sapiens
caaagaauuucaauuuguucagu

SEQ ID NO: 403277 - RNA, 20 nt, Homo sapiens
caaagaauuuuuuuuaacau

SEQ ID NO: 403278 - RNA, 11 nt, Homo sapiens
caaagacugua

SEQ ID NO: 403279 - RNA, 14 nt, Homo sapiens
caaagacuguacug

SEQ ID NO: 403280 - RNA, 14 nt, Homo sapiens
caaagacuuaauca

SEQ ID NO: 403281 - RNA, 16 nt, Homo sapiens
caaagagaaaagccac

SEQ ID NO: 403282 - RNA, 19 nt, Homo sapiens
caaagagaaaucacagggg

SEQ ID NO: 403283 - RNA, 16 nt, Homo sapiens
caaagagaaugccauu

SEQ ID NO: 403284 - RNA, 15 nt, Homo sapiens
caaagaguuauauga

SEQ ID NO: 403285 - RNA, 23 nt, Homo sapiens
caaagaucaaaauaaaaagugac

SEQ ID NO: 403286 - RNA, 16 nt, Homo sapiens
caaagcaacgacuacu

SEQ ID NO: 403287 - RNA, 23 nt, Homo sapiens
caaagcaaguuucaucagucaau

SEQ ID NO: 403288 - RNA, 14 nt, Homo sapiens
cacaaaugguagca

SEQ ID NO: 403289 - RNA, 17 nt, Homo sapiens
cacaacaaaaauuugaa

SEQ ID NO: 403290 - RNA, 20 nt, Homo sapiens
cacaacucuccaaaacacuu

SEQ ID NO: 403291 - RNA, 13 nt, Homo sapiens
cacaacuuuucaa

SEQ ID NO: 403292 - RNA, 22 nt, Homo sapiens
cacaagaagugggagugggaga

SEQ ID NO: 403293 - RNA, 22 nt, Homo sapiens
cacaagaccccugcuccugacu

SEQ ID NO: 403294 - RNA, 22 nt, Homo sapiens
cacaagauggaaaucacauuua

SEQ ID NO: 403295 - RNA, 20 nt, Homo sapiens
cacaagcuuuuuuacacaaa

SEQ ID NO: 403296 - RNA, 18 nt, Homo sapiens
cacaaggaaggcauuugg

SEQ ID NO: 403297 - RNA, 15 nt, Homo sapiens
cacaagguccacucc

SEQ ID NO: 403298 - RNA, 16 nt, Homo sapiens
cacaagguccacuccc

SEQ ID NO: 403299 - RNA, 19 nt, Homo sapiens
cacaauaagccacugguau

SEQ ID NO: 403300 - RNA, 13 nt, Homo sapiens
cacaauaugaaua

SEQ ID NO: 403301 - RNA, 13 nt, Homo sapiens
cacaauauuccua

SEQ ID NO: 403302 - RNA, 15 nt, Homo sapiens
cacaauccuccccac

SEQ ID NO: 403303 - RNA, 17 nt, Homo sapiens
cacaaucucacacagcu

SEQ ID NO: 403304 - RNA, 16 nt, Homo sapiens
cacaauguacuauaug

SEQ ID NO: 403305 - RNA, 12 nt, Homo sapiens
cacaauguugca

SEQ ID NO: 403306 - RNA, 20 nt, Homo sapiens
cacaauuuuaauucaaaaga

SEQ ID NO: 403307 - RNA, 16 nt, Homo sapiens
cacacaaacaccuccu

SEQ ID NO: 403308 - RNA, 22 nt, Homo sapiens
cacacaagcuuuuuuacacaaa

SEQ ID NO: 403309 - RNA, 13 nt, Homo sapiens
cacacaaguagau

SEQ ID NO: 403310 - RNA, 13 nt, Homo sapiens
cacacacacagcc

SEQ ID NO: 403311 - RNA, 11 nt, Homo sapiens
cacacacagcc

SEQ ID NO: 403312 - RNA, 16 nt, Homo sapiens
cacacacgcagacaca

SEQ ID NO: 403313 - RNA, 15 nt, Homo sapiens
cacacagugccugua

SEQ ID NO: 403314 - RNA, 14 nt, Homo sapiens
cacacauaguuucu

SEQ ID NO: 403315 - RNA, 14 nt, Homo sapiens
cacacaucucauuu

SEQ ID NO: 403316 - RNA, 21 nt, Homo sapiens
cacacauuuaaaacauuugaa

SEQ ID NO: 403317 - RNA, 17 nt, Homo sapiens
cacaccauucgucauca

SEQ ID NO: 403318 - RNA, 15 nt, Homo sapiens
cacacccaggaaggg

SEQ ID NO: 403319 - RNA, 22 nt, Homo sapiens
cacaccccucagcgcucccugu

SEQ ID NO: 403320 - RNA, 18 nt, Homo sapiens
cacacccucacucugcca

SEQ ID NO: 403321 - RNA, 22 nt, Homo sapiens
cacacccuccagcacagacugu

SEQ ID NO: 403322 - RNA, 15 nt, Homo sapiens
cacacucuacaaaau

SEQ ID NO: 403323 - RNA, 21 nt, Homo sapiens
cacacucucuucuuacuguau

SEQ ID NO: 403324 - RNA, 20 nt, Homo sapiens
cacacugagacuugaaucaa

SEQ ID NO: 403325 - RNA, 14 nt, Homo sapiens
cacacugcuagcaa

SEQ ID NO: 403326 - RNA, 16 nt, Homo sapiens
cacacuggcuccagac

SEQ ID NO: 403327 - RNA, 11 nt, Homo sapiens
cacacuguaaa

SEQ ID NO: 403328 - RNA, 15 nt, Homo sapiens
cacacuugugugugg

SEQ ID NO: 403329 - RNA, 17 nt, Homo sapiens
cacacuuucacugggga

SEQ ID NO: 403330 - RNA, 22 nt, Homo sapiens
cacagaaccuuugucaacuuca

SEQ ID NO: 403331 - RNA, 15 nt, Homo sapiens
cacagaagacccgcu

SEQ ID NO: 403332 - RNA, 15 nt, Homo sapiens
cacagacagauccca

SEQ ID NO: 403333 - RNA, 21 nt, Homo sapiens
cacagagacacagggcaucca

SEQ ID NO: 403334 - RNA, 13 nt, Homo sapiens
cacagaggacagu

SEQ ID NO: 403335 - RNA, 14 nt, Homo sapiens
cacagagguuuuaa

SEQ ID NO: 403336 - RNA, 19 nt, Homo sapiens
cacagaguuuguaguaaau

SEQ ID NO: 403337 - RNA, 17 nt, Homo sapiens
cacagauauuguuauaa

SEQ ID NO: 403338 - RNA, 21 nt, Homo sapiens
cacagauggaaucuuguuuaa

SEQ ID NO: 403339 - RNA, 21 nt, Homo sapiens
cacagauggcaccuguggcca

SEQ ID NO: 403340 - RNA, 16 nt, Homo sapiens
cacagcagcuguucaa

SEQ ID NO: 403341 - RNA, 15 nt, Homo sapiens
cacagcaguacuugc

SEQ ID NO: 403342 - RNA, 11 nt, Homo sapiens
cacagccagaa

SEQ ID NO: 403343 - RNA, 23 nt, Homo sapiens
cacagccagaaccccgagcccua

SEQ ID NO: 403344 - RNA, 15 nt, Homo sapiens
cacagcuaacaugga

SEQ ID NO: 403345 - RNA, 23 nt, Homo sapiens
cacagcuaacauggaaguacuau

SEQ ID NO: 403346 - RNA, 17 nt, Homo sapiens
cacagcucuguguugcc

SEQ ID NO: 403347 - RNA, 12 nt, Homo sapiens
cacagcugugag

SEQ ID NO: 403348 - RNA, 19 nt, Homo sapiens
cacaggacgauuucacuga

SEQ ID NO: 403349 - RNA, 15 nt, Homo sapiens
cacaggaguccuuuc

SEQ ID NO: 403350 - RNA, 21 nt, Homo sapiens
cacaggaguugguuagaauuu

SEQ ID NO: 403351 - RNA, 18 nt, Homo sapiens
cacaggauucucuucuca

SEQ ID NO: 403352 - RNA, 22 nt, Homo sapiens
cacaggcagcuggaugagacuu

SEQ ID NO: 403353 - RNA, 21 nt, Homo sapiens
cacaggcuggcugcguguucu

SEQ ID NO: 403354 - RNA, 20 nt, Homo sapiens
cacagggcauccaacugaga

SEQ ID NO: 403355 - RNA, 16 nt, Homo sapiens
cacaguaaaauauuca

SEQ ID NO: 403356 - RNA, 20 nt, Homo sapiens
cacaguacaauguuucagaa

SEQ ID NO: 403357 - RNA, 15 nt, Homo sapiens
cacagucauguguca

SEQ ID NO: 403358 - RNA, 20 nt, Homo sapiens
cacagugaacauaacuguaa

SEQ ID NO: 403359 - RNA, 12 nt, Homo sapiens
cacaguggcacu

SEQ ID NO: 403360 - RNA, 21 nt, Homo sapiens
cacaguguugccagagccuua

SEQ ID NO: 403361 - RNA, 19 nt, Homo sapiens
cacaguucacaaacaguaa

SEQ ID NO: 403362 - RNA, 18 nt, Homo sapiens
cacaguuggcuggaugaa

SEQ ID NO: 403363 - RNA, 13 nt, Homo sapiens
cacaguuugcaau

SEQ ID NO: 403364 - RNA, 16 nt, Homo sapiens
cacaguuugcaaucuu

SEQ ID NO: 403365 - RNA, 17 nt, Homo sapiens
cacaucaauaaauacuu

SEQ ID NO: 403366 - RNA, 14 nt, Homo sapiens
cacaucagcccugu

SEQ ID NO: 403367 - RNA, 18 nt, Homo sapiens
cacaucuaacaaagucaa

SEQ ID NO: 403368 - RNA, 17 nt, Homo sapiens
cacaucucugccuggaa

SEQ ID NO: 403369 - RNA, 15 nt, Homo sapiens
cacaugcacacacac

SEQ ID NO: 403370 - RNA, 23 nt, Homo sapiens
cacaugguccauuucaugugauc

SEQ ID NO: 403371 - RNA, 21 nt, Homo sapiens
cacauguccuauuacugaugu

SEQ ID NO: 403372 - RNA, 18 nt, Homo sapiens
cacauguugcuaaugaca

SEQ ID NO: 403373 - RNA, 17 nt, Homo sapiens
cacauuaaguggcuuuu

SEQ ID NO: 403374 - RNA, 18 nt, Homo sapiens
cacauucccaucugucac

SEQ ID NO: 403375 - RNA, 19 nt, Homo sapiens
cacauucuaaaggcuugau

SEQ ID NO: 403376 - RNA, 23 nt, Homo sapiens
cacauucuacuucagcuuuggau

SEQ ID NO: 403377 - RNA, 15 nt, Homo sapiens
cacauugccagugac

SEQ ID NO: 403378 - RNA, 22 nt, Homo sapiens
cacauugggggauccugaggga

SEQ ID NO: 403379 - RNA, 14 nt, Homo sapiens
cacauuugauucug

SEQ ID NO: 403380 - RNA, 23 nt, Homo sapiens
cacauuuuggggcuagacuuccc

SEQ ID NO: 403381 - RNA, 13 nt, Homo sapiens
caccaaagcuggc

SEQ ID NO: 403382 - RNA, 16 nt, Homo sapiens
caccaaauucugaauu

SEQ ID NO: 403383 - RNA, 23 nt, Homo sapiens
gaccuuguuguuguuaaauauca

SEQ ID NO: 403384 - RNA, 17 nt, Homo sapiens
gaccuuucagcugugaa

SEQ ID NO: 403385 - RNA, 17 nt, Homo sapiens
gacgauuucacugacac

SEQ ID NO: 403386 - RNA, 14 nt, Homo sapiens
gacggaaguggccu

SEQ ID NO: 403387 - RNA, 20 nt, Homo sapiens
gacgugcacuuggugcugcg

SEQ ID NO: 403388 - RNA, 22 nt, Homo sapiens
gacguuugacaccagggccagu

SEQ ID NO: 403389 - RNA, 21 nt, Homo sapiens
gacuaacuuccauggugcccu

SEQ ID NO: 403390 - RNA, 19 nt, Homo sapiens
gacuacuauacaaacuaca

SEQ ID NO: 403391 - RNA, 17 nt, Homo sapiens
gacuacuccaagggaau

SEQ ID NO: 403392 - RNA, 16 nt, Homo sapiens
gacuaggauaacagaa

SEQ ID NO: 403393 - RNA, 13 nt, Homo sapiens
gacuagugcugaa

SEQ ID NO: 403394 - RNA, 14 nt, Homo sapiens
gacuagugcuuuac

SEQ ID NO: 403395 - RNA, 17 nt, Homo sapiens
gacuauggcuaccaaaa

SEQ ID NO: 403396 - RNA, 18 nt, Homo sapiens
gacucaaguccuuaccuc

SEQ ID NO: 403397 - RNA, 15 nt, Homo sapiens
gacucaauguggaaa

SEQ ID NO: 403398 - RNA, 15 nt, Homo sapiens
gacucauucccagua

SEQ ID NO: 403399 - RNA, 14 nt, Homo sapiens
gacucccuccccac

SEQ ID NO: 403400 - RNA, 22 nt, Homo sapiens
gacucgauagugguggugaaca

SEQ ID NO: 403401 - RNA, 15 nt, Homo sapiens
gacucgcagcaccca

SEQ ID NO: 403402 - RNA, 21 nt, Homo sapiens
gacucucacgauaugcaaguu

SEQ ID NO: 403403 - RNA, 15 nt, Homo sapiens
gacucugccuuccag

SEQ ID NO: 403404 - RNA, 16 nt, Homo sapiens
gacucugcuucagucc

SEQ ID NO: 403405 - RNA, 22 nt, Homo sapiens
gacucuguaacaucacuaucca

SEQ ID NO: 403406 - RNA, 18 nt, Homo sapiens
gacucuugaauaaaaaua

SEQ ID NO: 403407 - RNA, 13 nt, Homo sapiens
gacucuugcucuu

SEQ ID NO: 403408 - RNA, 15 nt, Homo sapiens
gacucuugcucuuuc

SEQ ID NO: 403409 - RNA, 18 nt, Homo sapiens
gacugaaggggcacacca

SEQ ID NO: 403410 - RNA, 13 nt, Homo sapiens
gacugacauuuag

SEQ ID NO: 403411 - RNA, 16 nt, Homo sapiens
gacugacccugaucag

SEQ ID NO: 403412 - RNA, 15 nt, Homo sapiens
gacugaccugccccu

SEQ ID NO: 403413 - RNA, 15 nt, Homo sapiens
gacugagcagacugg

SEQ ID NO: 403414 - RNA, 23 nt, Homo sapiens
gacugcagaggagccaccugggc

SEQ ID NO: 403415 - RNA, 15 nt, Homo sapiens
gacugccccuugcuu

SEQ ID NO: 403416 - RNA, 23 nt, Homo sapiens
gacugcugcuucuuaaccccagu

SEQ ID NO: 403417 - RNA, 14 nt, Homo sapiens
gacuggcugugaga

SEQ ID NO: 403418 - RNA, 21 nt, Homo sapiens
cacuuuuuuccugucaauaua

SEQ ID NO: 403419 - RNA, 20 nt, Homo sapiens
cagaaaaaugaaagagaauu

SEQ ID NO: 403420 - RNA, 20 nt, Homo sapiens
cagaaaagaaaauauaguuu

SEQ ID NO: 403421 - RNA, 20 nt, Homo sapiens
cagaaaauauuauguguuuc

SEQ ID NO: 403422 - RNA, 22 nt, Homo sapiens
cagaaacagaggagagucccag

SEQ ID NO: 403423 - RNA, 19 nt, Homo sapiens
cagaaagaacgugaucucc

SEQ ID NO: 403424 - RNA, 20 nt, Homo sapiens
cagaaagaacgugaucuccu

SEQ ID NO: 403425 - RNA, 19 nt, Homo sapiens
cagaaagaccgugugugaa

SEQ ID NO: 403426 - RNA, 20 nt, Homo sapiens
cagaaagagagaaccaagcu

SEQ ID NO: 403427 - RNA, 20 nt, Homo sapiens
cagaaagcaaaucagacaca

SEQ ID NO: 403428 - RNA, 16 nt, Homo sapiens
cagaaaucccaguuca

SEQ ID NO: 403429 - RNA, 16 nt, Homo sapiens
cagaaaugugcugcaa

SEQ ID NO: 403430 - RNA, 12 nt, Homo sapiens
cagaacauaucc

SEQ ID NO: 403431 - RNA, 12 nt, Homo sapiens
cagaaccaaagc

SEQ ID NO: 403432 - RNA, 13 nt, Homo sapiens
cagaaccaaagca

SEQ ID NO: 403433 - RNA, 16 nt, Homo sapiens
cagaaccaaagcucaa

SEQ ID NO: 403434 - RNA, 18 nt, Homo sapiens
cagaacccagacccugag

SEQ ID NO: 403435 - RNA, 14 nt, Homo sapiens
cagaacgucucuca

SEQ ID NO: 403436 - RNA, 22 nt, Homo sapiens
cagaacucgaugcacugaccug

SEQ ID NO: 403437 - RNA, 22 nt, Homo sapiens
cagaacugcagucagcaugaau

SEQ ID NO: 403438 - RNA, 16 nt, Homo sapiens
cagaacugcccccacu

SEQ ID NO: 403439 - RNA, 23 nt, Homo sapiens
cagaagaaagaaauaaaccucau

SEQ ID NO: 403440 - RNA, 20 nt, Homo sapiens
cagaagaccucccugugaga

SEQ ID NO: 403441 - RNA, 22 nt, Homo sapiens
cagaagauaacuugagcaccgu

SEQ ID NO: 403442 - RNA, 21 nt, Homo sapiens
cagaagcacauaugaacugga

SEQ ID NO: 403443 - RNA, 19 nt, Homo sapiens
cagaaggcaaaguuuccau

SEQ ID NO: 403444 - RNA, 16 nt, Homo sapiens
cagaagggggucucuu

SEQ ID NO: 403445 - RNA, 22 nt, Homo sapiens
cagaaguggaguuuucugugag

SEQ ID NO: 403446 - RNA, 11 nt, Homo sapiens
cagaagugugu

SEQ ID NO: 403447 - RNA, 16 nt, Homo sapiens
cagaauacaagccacu

SEQ ID NO: 403448 - RNA, 21 nt, Homo sapiens
cagaauacaagccacuaccuu

SEQ ID NO: 403449 - RNA, 23 nt, Homo sapiens
cagaauauuaauaaaacuuuaug

SEQ ID NO: 403450 - RNA, 18 nt, Homo sapiens
cagaauauugacaagcua

SEQ ID NO: 403451 - RNA, 13 nt, Homo sapiens
cagaauccucuca

SEQ ID NO: 403452 - RNA, 17 nt, Homo sapiens
cagaaugccgcaugaca

SEQ ID NO: 403453 - RNA, 18 nt, Homo sapiens
cagaauggggaauggaga

SEQ ID NO: 403454 - RNA, 17 nt, Homo sapiens
cagaauggggacaucuu

SEQ ID NO: 403455 - RNA, 18 nt, Homo sapiens
cagaauggggacaucuug

SEQ ID NO: 403456 - RNA, 19 nt, Homo sapiens
cagaauguagcaucugaga

SEQ ID NO: 403457 - RNA, 20 nt, Homo sapiens
cagaauguagcaucugagaa

SEQ ID NO: 403458 - RNA, 13 nt, Homo sapiens
cagaauguguuau

SEQ ID NO: 403459 - RNA, 20 nt, Homo sapiens
cagaauuccaccggugcaag

SEQ ID NO: 403460 - RNA, 19 nt, Homo sapiens
cagaauugcuuguuugcuu

SEQ ID NO: 403461 - RNA, 14 nt, Homo sapiens
cagaauuguagcca

SEQ ID NO: 403462 - RNA, 12 nt, Homo sapiens
cagaauugugca

SEQ ID NO: 403463 - RNA, 15 nt, Homo sapiens
cagacaaagugacau

SEQ ID NO: 403464 - RNA, 13 nt, Homo sapiens
cagacagauucca

SEQ ID NO: 403465 - RNA, 12 nt, Homo sapiens
cagacagggugg

SEQ ID NO: 403466 - RNA, 18 nt, Homo sapiens
cagacauagacugcaaaa

SEQ ID NO: 403467 - RNA, 16 nt, Homo sapiens
cagacauccugugaug

SEQ ID NO: 403468 - RNA, 17 nt, Homo sapiens
cagaccaguacugggaa

SEQ ID NO: 403469 - RNA, 14 nt, Homo sapiens
cagaccuguucuga

SEQ ID NO: 403470 - RNA, 18 nt, Homo sapiens
cagaccuguuucuuguaa

SEQ ID NO: 403471 - RNA, 20 nt, Homo sapiens
cagacgcacgugggucuuca

SEQ ID NO: 403472 - RNA, 21 nt, Homo sapiens
cagacuauuuaacuugagggu

SEQ ID NO: 403473 - RNA, 19 nt, Homo sapiens
cagacucaaggccuccagc

SEQ ID NO: 403474 - RNA, 14 nt, Homo sapiens
cagacuggagacaa

SEQ ID NO: 403475 - RNA, 23 nt, Homo sapiens
cagacuguaagauguuguuuuag

SEQ ID NO: 403476 - RNA, 22 nt, Homo sapiens
cagacuuuuuaaauuccugcuu

SEQ ID NO: 403477 - RNA, 15 nt, Homo sapiens
cagagaaaguuccau

SEQ ID NO: 403478 - RNA, 21 nt, Homo sapiens
cagagaaggaaaagacugaau

SEQ ID NO: 403479 - RNA, 20 nt, Homo sapiens
cagagaauucucuuauccaa

SEQ ID NO: 403480 - RNA, 22 nt, Homo sapiens
cagagacacuaacgacuucagg

SEQ ID NO: 403481 - RNA, 19 nt, Homo sapiens
cagagaccacaccacuaac

SEQ ID NO: 403482 - RNA, 15 nt, Homo sapiens
cagagaccugaggca

SEQ ID NO: 403483 - RNA, 21 nt, Homo sapiens
cagagacugggaugggaacac

SEQ ID NO: 403484 - RNA, 13 nt, Homo sapiens
cagagagaaaaag

SEQ ID NO: 403485 - RNA, 16 nt, Homo sapiens
cagagagaaaaagaga

SEQ ID NO: 403486 - RNA, 17 nt, Homo sapiens
cagagagacagacuuga

SEQ ID NO: 403487 - RNA, 21 nt, Homo sapiens
cagagagacagacuugagaac

SEQ ID NO: 403488 - RNA, 22 nt, Homo sapiens
cagagagagaagugccccugcu

SEQ ID NO: 403489 - RNA, 16 nt, Homo sapiens
cagagagagcucugca

SEQ ID NO: 403490 - RNA, 16 nt, Homo sapiens
cagagagcagugugga

SEQ ID NO: 403491 - RNA, 19 nt, Homo sapiens
cagagagccuggugcugcu

SEQ ID NO: 403492 - RNA, 21 nt, Homo sapiens
cagagaguguacaucauguua

SEQ ID NO: 403493 - RNA, 14 nt, Homo sapiens
cagagauggccaug

SEQ ID NO: 403494 - RNA, 21 nt, Homo sapiens
cagagauuugguuaagcucac

SEQ ID NO: 403495 - RNA, 20 nt, Homo sapiens
cagagcaagacucugucuca

SEQ ID NO: 403496 - RNA, 14 nt, Homo sapiens
cagagcagaaccaa

SEQ ID NO: 403497 - RNA, 13 nt, Homo sapiens
cagagcagaucag

SEQ ID NO: 403498 - RNA, 13 nt, Homo sapiens
cagagcaucccag

SEQ ID NO: 403499 - RNA, 23 nt, Homo sapiens
cagagcauuuccaacaccacaga

SEQ ID NO: 403500 - RNA, 15 nt, Homo sapiens
cagagccacuaccuu

SEQ ID NO: 403501 - RNA, 20 nt, Homo sapiens
cagagcccuucacugccaug

SEQ ID NO: 403502 - RNA, 15 nt, Homo sapiens
cagagccuuguucua

SEQ ID NO: 403503 - RNA, 20 nt, Homo sapiens
cagagcucagcacagccuca

SEQ ID NO: 403504 - RNA, 22 nt, Homo sapiens
cagagcugacccccugcugcca

SEQ ID NO: 403505 - RNA, 16 nt, Homo sapiens
cagagcuggaaggcag

SEQ ID NO: 403506 - RNA, 22 nt, Homo sapiens
cagagcuggguggggacaguga

SEQ ID NO: 403507 - RNA, 18 nt, Homo sapiens
cagaggaaaaacagagga

SEQ ID NO: 403508 - RNA, 13 nt, Homo sapiens
cagaggagccaug

SEQ ID NO: 403509 - RNA, 14 nt, Homo sapiens
cagaggauggugag

SEQ ID NO: 403510 - RNA, 15 nt, Homo sapiens
cagaggaugucacaa

SEQ ID NO: 403511 - RNA, 21 nt, Homo sapiens
cagaggauuuaacugugaacc

SEQ ID NO: 403512 - RNA, 20 nt, Homo sapiens
cagaggcugcaaggauucag

SEQ ID NO: 403513 - RNA, 15 nt, Homo sapiens
cagaggguacuuuaa

SEQ ID NO: 403514 - RNA, 22 nt, Homo sapiens
cagaguagcccaggucacuguu

SEQ ID NO: 403515 - RNA, 21 nt, Homo sapiens
cagagucucauucuguugccc

SEQ ID NO: 403516 - RNA, 21 nt, Homo sapiens
cagagucucgcucuguugccc

SEQ ID NO: 403517 - RNA, 20 nt, Homo sapiens
cagagugaagcaucaaccua

SEQ ID NO: 403518 - RNA, 17 nt, Homo sapiens
cagagugagugagacuc

SEQ ID NO: 403519 - RNA, 17 nt, Homo sapiens
cagaguggauucuugaa

SEQ ID NO: 403520 - RNA, 20 nt, Homo sapiens
gaggugggauccucccucau

SEQ ID NO: 403521 - RNA, 21 nt, Homo sapiens
gaggugggcaugccacccuca

SEQ ID NO: 403522 - RNA, 21 nt, Homo sapiens
gagguguuuaacggcacugug

SEQ ID NO: 403523 - RNA, 17 nt, Homo sapiens
gaguaaagauaaaagga

SEQ ID NO: 403524 - RNA, 17 nt, Homo sapiens
gaguaauuuucugaugg

SEQ ID NO: 403525 - RNA, 12 nt, Homo sapiens
gaguaccuggac

SEQ ID NO: 403526 - RNA, 16 nt, Homo sapiens
gaguagggaguucauc

SEQ ID NO: 403527 - RNA, 12 nt, Homo sapiens
gaguauaugcac

SEQ ID NO: 403528 - RNA, 21 nt, Homo sapiens
gagucauuuuuuaagugacuu

SEQ ID NO: 403529 - RNA, 20 nt, Homo sapiens
gaguccacugcuccauuuau

SEQ ID NO: 403530 - RNA, 13 nt, Homo sapiens
gagucccuuccag

SEQ ID NO: 403531 - RNA, 18 nt, Homo sapiens
gagucccuuccaggccau

SEQ ID NO: 403532 - RNA, 13 nt, Homo sapiens
gaguccuguucuc

SEQ ID NO: 403533 - RNA, 14 nt, Homo sapiens
gagugaaaguacuu

SEQ ID NO: 403534 - RNA, 22 nt, Homo sapiens
gagugagaggguuugagucaaa

SEQ ID NO: 403535 - RNA, 11 nt, Homo sapiens
gagugagcucu

SEQ ID NO: 403536 - RNA, 14 nt, Homo sapiens
gagugauccuccaa

SEQ ID NO: 403537 - RNA, 19 nt, Homo sapiens
gagugcaguggcgugaucu

SEQ ID NO: 403538 - RNA, 14 nt, Homo sapiens
gagugccaauccaa

SEQ ID NO: 403539 - RNA, 23 nt, Homo sapiens
gagugcuagcuagccagcugugu

SEQ ID NO: 403540 - RNA, 13 nt, Homo sapiens
gaguggaaacaaa

SEQ ID NO: 403541 - RNA, 19 nt, Homo sapiens
gaguggacuuugcauuuua

SEQ ID NO: 403542 - RNA, 19 nt, Homo sapiens
gaguggccccucaccuggg

SEQ ID NO: 403543 - RNA, 19 nt, Homo sapiens
gaguggucaggcaucuucc

SEQ ID NO: 403544 - RNA, 12 nt, Homo sapiens
gaguguacuuaa

SEQ ID NO: 403545 - RNA, 17 nt, Homo sapiens
gagugugugcaugugug

SEQ ID NO: 403546 - RNA, 16 nt, Homo sapiens
gaguuacagacaaagc

SEQ ID NO: 403547 - RNA, 21 nt, Homo sapiens
caggaggcagaggguugcagu

SEQ ID NO: 403548 - RNA, 16 nt, Homo sapiens
caggagggcccuaccu

SEQ ID NO: 403549 - RNA, 16 nt, Homo sapiens
caggagguacugugag

SEQ ID NO: 403550 - RNA, 23 nt, Homo sapiens
caggaguuggaauguuguaguua

SEQ ID NO: 403551 - RNA, 13 nt, Homo sapiens
caggauauugaca

SEQ ID NO: 403552 - RNA, 22 nt, Homo sapiens
caggaucaaaccccgaccaccu

SEQ ID NO: 403553 - RNA, 23 nt, Homo sapiens
caggauggcuggaacacuguacu

SEQ ID NO: 403554 - RNA, 18 nt, Homo sapiens
caggaugggggcaauggg

SEQ ID NO: 403555 - RNA, 16 nt, Homo sapiens
caggauguuauucuuc

SEQ ID NO: 403556 - RNA, 16 nt, Homo sapiens
caggauucucuucuca

SEQ ID NO: 403557 - RNA, 18 nt, Homo sapiens
caggauuuuguauugcca

SEQ ID NO: 403558 - RNA, 21 nt, Homo sapiens
caggcaaggaugauccaggga

SEQ ID NO: 403559 - RNA, 15 nt, Homo sapiens
caggcagaaaacugg

SEQ ID NO: 403560 - RNA, 15 nt, Homo sapiens
caggcagacacagcu

SEQ ID NO: 403561 - RNA, 21 nt, Homo sapiens
caggcagaggagaguaccccc

SEQ ID NO: 403562 - RNA, 17 nt, Homo sapiens
caggcaguucccagaaa

SEQ ID NO: 403563 - RNA, 14 nt, Homo sapiens
caggccacugaccu

SEQ ID NO: 403564 - RNA, 14 nt, Homo sapiens
caggccagcuccac

SEQ ID NO: 403565 - RNA, 21 nt, Homo sapiens
caggccaggagacuguuaaag

SEQ ID NO: 403566 - RNA, 22 nt, Homo sapiens
caggcccaauucugccacuucu

SEQ ID NO: 403567 - RNA, 20 nt, Homo sapiens
caggcccaccuaccuucaaa

SEQ ID NO: 403568 - RNA, 22 nt, Homo sapiens
caggcccuguccuaagcacuuu

SEQ ID NO: 403569 - RNA, 23 nt, Homo sapiens
caggcccuguccuaagcacuuua

SEQ ID NO: 403570 - RNA, 22 nt, Homo sapiens
caggccgccccagccucugagc

SEQ ID NO: 403571 - RNA, 18 nt, Homo sapiens
caggccgggguggagcau

SEQ ID NO: 403572 - RNA, 13 nt, Homo sapiens
caggccgggugca

SEQ ID NO: 403573 - RNA, 16 nt, Homo sapiens
caggcgaugugcaagu

SEQ ID NO: 403574 - RNA, 15 nt, Homo sapiens
caggcucacagagau

SEQ ID NO: 403575 - RNA, 20 nt, Homo sapiens
caggcucucccucucugcac

SEQ ID NO: 403576 - RNA, 13 nt, Homo sapiens
caggcucuucucc

SEQ ID NO: 403577 - RNA, 17 nt, Homo sapiens
caggcugcggugggcag

SEQ ID NO: 403578 - RNA, 19 nt, Homo sapiens
caggcuggagugcaaugca

SEQ ID NO: 403579 - RNA, 17 nt, Homo sapiens
caggcuggcuguuggcc

SEQ ID NO: 403580 - RNA, 13 nt, Homo sapiens
caggcuggucuca

SEQ ID NO: 403581 - RNA, 16 nt, Homo sapiens
caggcugucucauuua

SEQ ID NO: 403582 - RNA, 17 nt, Homo sapiens
caggcuuaugaauauau

SEQ ID NO: 403583 - RNA, 21 nt, Homo sapiens
caggcuuuuuuccagacucua

SEQ ID NO: 403584 - RNA, 13 nt, Homo sapiens
cagggaaaauaua

SEQ ID NO: 403585 - RNA, 14 nt, Homo sapiens
cagggaaaauauag

SEQ ID NO: 403586 - RNA, 16 nt, Homo sapiens
cagggacagaucugau

SEQ ID NO: 403587 - RNA, 16 nt, Homo sapiens
cagggaucauagcuga

SEQ ID NO: 403588 - RNA, 16 nt, Homo sapiens
cagggcacugcugcug

SEQ ID NO: 403589 - RNA, 17 nt, Homo sapiens
cagggcagggcucugau

SEQ ID NO: 403590 - RNA, 17 nt, Homo sapiens
cagggcagugcuaguga

SEQ ID NO: 403591 - RNA, 18 nt, Homo sapiens
cagggcccuccaccgcca

SEQ ID NO: 403592 - RNA, 17 nt, Homo sapiens
cagggcgcuccggcaga

SEQ ID NO: 403593 - RNA, 22 nt, Homo sapiens
caggggcaaagaacugccccau

SEQ ID NO: 403594 - RNA, 22 nt, Homo sapiens
caggggccccuccucugugcuc

SEQ ID NO: 403595 - RNA, 20 nt, Homo sapiens
caggggcuggggaguggaca

SEQ ID NO: 403596 - RNA, 18 nt, Homo sapiens
caggggggagaaguucuu

SEQ ID NO: 403597 - RNA, 18 nt, Homo sapiens
caggggucucccugagcc

SEQ ID NO: 403598 - RNA, 18 nt, Homo sapiens
caggguccgcaccagcug

SEQ ID NO: 403599 - RNA, 16 nt, Homo sapiens
cagggucuugcuguaa

SEQ ID NO: 403600 - RNA, 22 nt, Homo sapiens
cagggugcucccuccucagucu

SEQ ID NO: 403601 - RNA, 23 nt, Homo sapiens
cagggugugagggauggggagca

SEQ ID NO: 403602 - RNA, 18 nt, Homo sapiens
caggguugaaucuugucc

SEQ ID NO: 403603 - RNA, 21 nt, Homo sapiens
caggguuucaccauguuggcc

SEQ ID NO: 403604 - RNA, 15 nt, Homo sapiens
cagguaacaucauca

SEQ ID NO: 403605 - RNA, 21 nt, Homo sapiens
cagguacugauccuguuucuu

SEQ ID NO: 403606 - RNA, 19 nt, Homo sapiens
cagguacuuccucagucug

SEQ ID NO: 403607 - RNA, 16 nt, Homo sapiens
cagguaguacugggaa

SEQ ID NO: 403608 - RNA, 22 nt, Homo sapiens
cagguccucuacuuaaugagau

SEQ ID NO: 403609 - RNA, 14 nt, Homo sapiens
caggugaauggagg

SEQ ID NO: 403610 - RNA, 19 nt, Homo sapiens
caggugccaaguuccacuu

SEQ ID NO: 403611 - RNA, 22 nt, Homo sapiens
caggugccaucacgcuugugau

SEQ ID NO: 403612 - RNA, 22 nt, Homo sapiens
caggugccccgugguacauuca

SEQ ID NO: 403613 - RNA, 20 nt, Homo sapiens
caggugcccgccaccgugcc

SEQ ID NO: 403614 - RNA, 11 nt, Homo sapiens
caggugcugcc

SEQ ID NO: 403615 - RNA, 22 nt, Homo sapiens
cagguggccccaguucaaucuc

SEQ ID NO: 403616 - RNA, 22 nt, Homo sapiens
cagguguucuacacucaucuua

SEQ ID NO: 403617 - RNA, 13 nt, Homo sapiens
cagguuaccucac

SEQ ID NO: 403618 - RNA, 16 nt, Homo sapiens
cagguuaccucacuuu

SEQ ID NO: 403619 - RNA, 16 nt, Homo sapiens
cagguuauacuccucc

SEQ ID NO: 403620 - RNA, 17 nt, Homo sapiens
cagguucagacugagcu

SEQ ID NO: 403621 - RNA, 19 nt, Homo sapiens
cagguucucuccugugagc

SEQ ID NO: 403622 - RNA, 20 nt, Homo sapiens
cagguucugguuagcucagc

SEQ ID NO: 403623 - RNA, 21 nt, Homo sapiens
cagguuggaugggagugggca

SEQ ID NO: 403624 - RNA, 14 nt, Homo sapiens
cagguuuguuacau

SEQ ID NO: 403625 - RNA, 17 nt, Homo sapiens
caguaaagagauuaauu

SEQ ID NO: 403626 - RNA, 21 nt, Homo sapiens
caguaaauguauauugaugua

SEQ ID NO: 403627 - RNA, 17 nt, Homo sapiens
caguaacauuucauuaa

SEQ ID NO: 403628 - RNA, 15 nt, Homo sapiens
caguaaccaugcccg

SEQ ID NO: 403629 - RNA, 14 nt, Homo sapiens
caguaauagcugaa

SEQ ID NO: 403630 - RNA, 20 nt, Homo sapiens
caguaauguauucuaucucu

SEQ ID NO: 403631 - RNA, 19 nt, Homo sapiens
caguagaaauaauaugcau

SEQ ID NO: 403632 - RNA, 14 nt, Homo sapiens
caguagaugugcuu

SEQ ID NO: 403633 - RNA, 18 nt, Homo sapiens
caguagcugccaaaaaga

SEQ ID NO: 403634 - RNA, 20 nt, Homo sapiens
caguaggcaguagacuauaa

SEQ ID NO: 403635 - RNA, 17 nt, Homo sapiens
caguauagguguuugcu

SEQ ID NO: 403636 - RNA, 15 nt, Homo sapiens
caguaugagucaaug

SEQ ID NO: 403637 - RNA, 17 nt, Homo sapiens
caguauggcggaggcca

SEQ ID NO: 403638 - RNA, 18 nt, Homo sapiens
caguauggcggaggccau

SEQ ID NO: 403639 - RNA, 16 nt, Homo sapiens
caguauucucagagca

SEQ ID NO: 403640 - RNA, 17 nt, Homo sapiens
caguauucuugucaaaa

SEQ ID NO: 403641 - RNA, 15 nt, Homo sapiens
cagucacagccauuu

SEQ ID NO: 403642 - RNA, 17 nt, Homo sapiens
cagucacccuucugggc

SEQ ID NO: 403643 - RNA, 12 nt, Homo sapiens
cagucaccugcc

SEQ ID NO: 403644 - RNA, 22 nt, Homo sapiens
cagucagauuuccagucuccac

SEQ ID NO: 403645 - RNA, 14 nt, Homo sapiens
cagucaucaucuuu

SEQ ID NO: 403646 - RNA, 21 nt, Homo sapiens
caguccaccugagcugccauc

SEQ ID NO: 403647 - RNA, 15 nt, Homo sapiens
cagucccagcacauu

SEQ ID NO: 403648 - RNA, 16 nt, Homo sapiens
cagucccucacaccug

SEQ ID NO: 403649 - RNA, 18 nt, Homo sapiens
cagucccucacaccuggg

SEQ ID NO: 403650 - RNA, 19 nt, Homo sapiens
cagucccucccuccuggcu

SEQ ID NO: 403651 - RNA, 18 nt, Homo sapiens
cagucccuccuguugcca

SEQ ID NO: 403652 - RNA, 23 nt, Homo sapiens
cagucccuuacacguaccucuca

SEQ ID NO: 403653 - RNA, 23 nt, Homo sapiens
caguccuggagggaguggguuaa

SEQ ID NO: 403654 - RNA, 20 nt, Homo sapiens
cagucucaauuuuguauuua

SEQ ID NO: 403655 - RNA, 22 nt, Homo sapiens
cagucucacaauagcgugagcu

SEQ ID NO: 403656 - RNA, 14 nt, Homo sapiens
cagucugaaccuga

SEQ ID NO: 403657 - RNA, 12 nt, Homo sapiens
cagucugaguca

SEQ ID NO: 403658 - RNA, 15 nt, Homo sapiens
cagucuguucucaca

SEQ ID NO: 403659 - RNA, 11 nt, Homo sapiens
cagucuucuca

SEQ ID NO: 403660 - RNA, 14 nt, Homo sapiens
cagucuugccuagg

SEQ ID NO: 403661 - RNA, 19 nt, Homo sapiens
cagucuuggcucacugcaa

SEQ ID NO: 403662 - RNA, 21 nt, Homo sapiens
cagugaaagcuuucaugacca

SEQ ID NO: 403663 - RNA, 14 nt, Homo sapiens
cagugaacaguuug

SEQ ID NO: 403664 - RNA, 12 nt, Homo sapiens
cagugacaguau

SEQ ID NO: 403665 - RNA, 18 nt, Homo sapiens
cagugaccccugaccuca

SEQ ID NO: 403666 - RNA, 21 nt, Homo sapiens
cagugagaguacucacuuuuc

SEQ ID NO: 403667 - RNA, 14 nt, Homo sapiens
cagugagccaagau

SEQ ID NO: 403668 - RNA, 15 nt, Homo sapiens
cagugagccauguuc

SEQ ID NO: 403669 - RNA, 20 nt, Homo sapiens
cagugagcugauaucaugcc

SEQ ID NO: 403670 - RNA, 15 nt, Homo sapiens
cagugaucuccauau

SEQ ID NO: 403671 - RNA, 17 nt, Homo sapiens
cagugaugcugugcuau

SEQ ID NO: 403672 - RNA, 18 nt, Homo sapiens
cagugauugaaguaucug

SEQ ID NO: 403673 - RNA, 16 nt, Homo sapiens
cagugccaaaaacaac

SEQ ID NO: 403674 - RNA, 14 nt, Homo sapiens
cagugcccucacag

SEQ ID NO: 403675 - RNA, 18 nt, Homo sapiens
caguggcccugagcagua

SEQ ID NO: 403676 - RNA, 15 nt, Homo sapiens
ggaugcacagcucaa

SEQ ID NO: 403677 - RNA, 22 nt, Homo sapiens
ggaugcacagcucaaguauuua

SEQ ID NO: 403678 - RNA, 14 nt, Homo sapiens
ggaugcagugccuu

SEQ ID NO: 403679 - RNA, 21 nt, Homo sapiens
ggaugccaaccggucacccag

SEQ ID NO: 403680 - RNA, 22 nt, Homo sapiens
ggaugccaaccggucacccagg

SEQ ID NO: 403681 - RNA, 14 nt, Homo sapiens
ggauggaagugucu

SEQ ID NO: 403682 - RNA, 14 nt, Homo sapiens
cccaucccgugcaa

SEQ ID NO: 403683 - RNA, 21 nt, Homo sapiens
cccaucccugaaacauugcau

SEQ ID NO: 403684 - RNA, 21 nt, Homo sapiens
cccaucggguaagaugcuccu

SEQ ID NO: 403685 - RNA, 12 nt, Homo sapiens
cccaucuaugag

SEQ ID NO: 403686 - RNA, 20 nt, Homo sapiens
cccaugcccuggauccauca

SEQ ID NO: 403687 - RNA, 23 nt, Homo sapiens
cccauggauguuucuucuuugac

SEQ ID NO: 403688 - RNA, 13 nt, Homo sapiens
cccauggccacuu

SEQ ID NO: 403689 - RNA, 19 nt, Homo sapiens
cccauuagcccacugccug

SEQ ID NO: 403690 - RNA, 22 nt, Homo sapiens
cccauucuccacucacugcauu

SEQ ID NO: 403691 - RNA, 17 nt, Homo sapiens
cccauuggucugcaugu

SEQ ID NO: 403692 - RNA, 15 nt, Homo sapiens
cccauuuguguuuca

SEQ ID NO: 403693 - RNA, 17 nt, Homo sapiens
ccccaacccuuccacac

SEQ ID NO: 403694 - RNA, 20 nt, Homo sapiens
ccccacaacacaccuugccc

SEQ ID NO: 403695 - RNA, 11 nt, Homo sapiens
ccccacaccca

SEQ ID NO: 403696 - RNA, 20 nt, Homo sapiens
ccccacagaucaguuuuccu

SEQ ID NO: 403697 - RNA, 21 nt, Homo sapiens
ccccaccuucccccaacuacc

SEQ ID NO: 403698 - RNA, 22 nt, Homo sapiens
ccccacguugccucuacuuuau

SEQ ID NO: 403699 - RNA, 21 nt, Homo sapiens
ccccacuccuccuccagccca

SEQ ID NO: 403700 - RNA, 10 nt, Homo sapiens
ccccagagau

SEQ ID NO: 403701 - RNA, 24 nt, Homo sapiens
ccccagagccacuaccuuugucca

SEQ ID NO: 403702 - RNA, 20 nt, Homo sapiens
ccccagagcucuaaccaaag

SEQ ID NO: 403703 - RNA, 14 nt, Homo sapiens
ccccagagcuguuu

SEQ ID NO: 403704 - RNA, 17 nt, Homo sapiens
ccccagcaagagcacaa

SEQ ID NO: 403705 - RNA, 14 nt, Homo sapiens
ccccagcauuccag

SEQ ID NO: 403706 - RNA, 15 nt, Homo sapiens
ccccagcccugugga

SEQ ID NO: 403707 - RNA, 15 nt, Homo sapiens
ccccagcccuuugca

SEQ ID NO: 403708 - RNA, 22 nt, Homo sapiens
ccccagccucccaaagugcuaa

SEQ ID NO: 403709 - RNA, 15 nt, Homo sapiens
ccccagcugggcugu

SEQ ID NO: 403710 - RNA, 17 nt, Homo sapiens
ccccauccccaccagcu

SEQ ID NO: 403711 - RNA, 15 nt, Homo sapiens
ccccaugugccugca

SEQ ID NO: 403712 - RNA, 16 nt, Homo sapiens
ccccauucauuccuga

SEQ ID NO: 403713 - RNA, 17 nt, Homo sapiens
cccccaaaguucacaau

SEQ ID NO: 403714 - RNA, 17 nt, Homo sapiens
cccccaaauugccuuca

SEQ ID NO: 403715 - RNA, 16 nt, Homo sapiens
cccccacccaccucca

SEQ ID NO: 403716 - RNA, 13 nt, Homo sapiens
cccccagccaucu

SEQ ID NO: 403717 - RNA, 12 nt, Homo sapiens
cccccauguccu

SEQ ID NO: 403718 - RNA, 18 nt, Homo sapiens
cccccaugugccugucac

SEQ ID NO: 403719 - RNA, 18 nt, Homo sapiens
cccccgcggguucuagac

SEQ ID NO: 403720 - RNA, 15 nt, Homo sapiens
cccccuaacuuucuu

SEQ ID NO: 403721 - RNA, 20 nt, Homo sapiens
cccccuccaaagucuugaua

SEQ ID NO: 403722 - RNA, 22 nt, Homo sapiens
cccccuuuccaucuguuugaua

SEQ ID NO: 403723 - RNA, 22 nt, Homo sapiens
ccccgagcugggggccaugagc

SEQ ID NO: 403724 - RNA, 12 nt, Homo sapiens
ccccggggacuc

SEQ ID NO: 403725 - RNA, 14 nt, Homo sapiens
ccccgugaacucac

SEQ ID NO: 403726 - RNA, 14 nt, Homo sapiens
ccccuaacuuucuu

SEQ ID NO: 403727 - RNA, 15 nt, Homo sapiens
ccccuaauagccuuu

SEQ ID NO: 403728 - RNA, 22 nt, Homo sapiens
ccccuauccuuggcaccaaaga

SEQ ID NO: 403729 - RNA, 17 nt, Homo sapiens
ccccuccgugcuuuucu

SEQ ID NO: 403730 - RNA, 18 nt, Homo sapiens
ccccuggaucuaccagca

SEQ ID NO: 403731 - RNA, 18 nt, Homo sapiens
ccccugggacugcugcuu

SEQ ID NO: 403732 - RNA, 23 nt, Homo sapiens
ccccuggggcuucuccugaccca

SEQ ID NO: 403733 - RNA, 20 nt, Homo sapiens
ccccuguagacuagugccgu

SEQ ID NO: 403734 - RNA, 13 nt, Homo sapiens
ccccugucuggaa

SEQ ID NO: 403735 - RNA, 17 nt, Homo sapiens
ccccugugcccacccag

SEQ ID NO: 403736 - RNA, 23 nt, Homo sapiens
ccccuuagccaguuguauauuau

SEQ ID NO: 403737 - RNA, 17 nt, Homo sapiens
ccccuugcaaaguaaua

SEQ ID NO: 403738 - RNA, 17 nt, Homo sapiens
ccccuuuccaauuccaa

SEQ ID NO: 403739 - RNA, 15 nt, Homo sapiens
cccgaaugccuguca

SEQ ID NO: 403740 - RNA, 19 nt, Homo sapiens
cccgaguggucuccucuca

SEQ ID NO: 403741 - RNA, 20 nt, Homo sapiens
cccgauccccgacaguggcu

SEQ ID NO: 403742 - RNA, 13 nt, Homo sapiens
cccgccccagaga

SEQ ID NO: 403743 - RNA, 22 nt, Homo sapiens
cccgccgccuccugcaccgaga

SEQ ID NO: 403744 - RNA, 16 nt, Homo sapiens
cccgcucagguagcca

SEQ ID NO: 403745 - RNA, 17 nt, Homo sapiens
cccggaaugcuuccagu

SEQ ID NO: 403746 - RNA, 17 nt, Homo sapiens
cccggagcuaacacugg

SEQ ID NO: 403747 - RNA, 19 nt, Homo sapiens
cccggaugugaauggcaug

SEQ ID NO: 403748 - RNA, 15 nt, Homo sapiens
cccggcaaccagauu

SEQ ID NO: 403749 - RNA, 23 nt, Homo sapiens
cccgggacgcagggguugcagug

SEQ ID NO: 403750 - RNA, 22 nt, Homo sapiens
cccguggaucugggcacaauca

SEQ ID NO: 403751 - RNA, 16 nt, Homo sapiens
cccuaaagaacauacc

SEQ ID NO: 403752 - RNA, 13 nt, Homo sapiens
cccuaaagcccuc

SEQ ID NO: 403753 - RNA, 18 nt, Homo sapiens
cccuaagcgcacauucau

SEQ ID NO: 403754 - RNA, 13 nt, Homo sapiens
cccuaagugccca

SEQ ID NO: 403755 - RNA, 15 nt, Homo sapiens
cccuacaugcauguu

SEQ ID NO: 403756 - RNA, 18 nt, Homo sapiens
cccuaccagcgcccgcug

SEQ ID NO: 403757 - RNA, 16 nt, Homo sapiens
cccuauggaagucuca

SEQ ID NO: 403758 - RNA, 15 nt, Homo sapiens
cccuauuuuugcaau

SEQ ID NO: 403759 - RNA, 19 nt, Homo sapiens
cccucacgcucuccaucau

SEQ ID NO: 403760 - RNA, 14 nt, Homo sapiens
cccucagacauccc

SEQ ID NO: 403761 - RNA, 19 nt, Homo sapiens
cccucauccuuuuacuuuu

SEQ ID NO: 403762 - RNA, 13 nt, Homo sapiens
cccucaucuugaa

SEQ ID NO: 403763 - RNA, 20 nt, Homo sapiens
cccucauuacugccaacagu

SEQ ID NO: 403764 - RNA, 14 nt, Homo sapiens
cccucauugcauuu

SEQ ID NO: 403765 - RNA, 22 nt, Homo sapiens
cccucauugcauuuauugcagu

SEQ ID NO: 403766 - RNA, 14 nt, Homo sapiens
cccuccacauccca

SEQ ID NO: 403767 - RNA, 13 nt, Homo sapiens
cccucccauggca

SEQ ID NO: 403768 - RNA, 13 nt, Homo sapiens
cccuccuccagua

SEQ ID NO: 403769 - RNA, 15 nt, Homo sapiens
cccuccucgcugugc

SEQ ID NO: 403770 - RNA, 12 nt, Homo sapiens
cccucggagccu

SEQ ID NO: 403771 - RNA, 17 nt, Homo sapiens
cccucucccaugcacac

SEQ ID NO: 403772 - RNA, 17 nt, Homo sapiens
cccucucccgccagacu

SEQ ID NO: 403773 - RNA, 14 nt, Homo sapiens
cccucucucugggc

SEQ ID NO: 403774 - RNA, 18 nt, Homo sapiens
cccucuggcacuccagaa

SEQ ID NO: 403775 - RNA, 23 nt, Homo sapiens
cccucuuucagggguccuaagcc

SEQ ID NO: 403776 - RNA, 21 nt, Homo sapiens
cccugaaacugagucugugga

SEQ ID NO: 403777 - RNA, 17 nt, Homo sapiens
cccugaaccucugaugc

SEQ ID NO: 403778 - RNA, 14 nt, Homo sapiens
cccugacaaaaagg

SEQ ID NO: 403779 - RNA, 22 nt, Homo sapiens
cccugagccugccccagcuggg

SEQ ID NO: 403780 - RNA, 22 nt, Homo sapiens
cccugagggacuuggcaguaga

SEQ ID NO: 403781 - RNA, 23 nt, Homo sapiens
cccugagggacuuggcaguagaa

SEQ ID NO: 403782 - RNA, 16 nt, Homo sapiens
cccugaggucaugcau

SEQ ID NO: 403783 - RNA, 19 nt, Homo sapiens
cccugauuguguauauuca

SEQ ID NO: 403784 - RNA, 12 nt, Homo sapiens
cccugauuucuu

SEQ ID NO: 403785 - RNA, 18 nt, Homo sapiens
cccugccagcaacgcuca

SEQ ID NO: 403786 - RNA, 24 nt, Homo sapiens
cccugcccgaccccaucucauuca

SEQ ID NO: 403787 - RNA, 15 nt, Homo sapiens
cccugcccuggucca

SEQ ID NO: 403788 - RNA, 16 nt, Homo sapiens
cccugccucacaucuc

SEQ ID NO: 403789 - RNA, 15 nt, Homo sapiens
cccugcuacuccacu

SEQ ID NO: 403790 - RNA, 16 nt, Homo sapiens
cccugcucccauuccu

SEQ ID NO: 403791 - RNA, 17 nt, Homo sapiens
cccugcucuucagcacc

SEQ ID NO: 403792 - RNA, 13 nt, Homo sapiens
cccugcugaccuc

SEQ ID NO: 403793 - RNA, 20 nt, Homo sapiens
cccuggaucuaccagcauaa

SEQ ID NO: 403794 - RNA, 17 nt, Homo sapiens
cccuggcggagggaugc

SEQ ID NO: 403795 - RNA, 14 nt, Homo sapiens
cccuggcucaggga

SEQ ID NO: 403796 - RNA, 21 nt, Homo sapiens
cccuggggcuucuccugaccc

SEQ ID NO: 403797 - RNA, 22 nt, Homo sapiens
cccuggggcuucuccugaccca

SEQ ID NO: 403798 - RNA, 18 nt, Homo sapiens
cccuggggggcacagcca

SEQ ID NO: 403799 - RNA, 18 nt, Homo sapiens
cccuggggucucugagca

SEQ ID NO: 403800 - RNA, 22 nt, Homo sapiens
cccugggguuuuuuucaucccu

SEQ ID NO: 403801 - RNA, 19 nt, Homo sapiens
cccugguggggugugcaug

SEQ ID NO: 403802 - RNA, 14 nt, Homo sapiens
cccuguaugauucc

SEQ ID NO: 403803 - RNA, 16 nt, Homo sapiens
cccuguccugaugguc

SEQ ID NO: 403804 - RNA, 18 nt, Homo sapiens
cccuguggggccugaugg

SEQ ID NO: 403805 - RNA, 11 nt, Homo sapiens
cccuguuugcc

SEQ ID NO: 403806 - RNA, 20 nt, Homo sapiens
gggucucacaguguugccca

SEQ ID NO: 403807 - RNA, 19 nt, Homo sapiens
gggucucgcuuuguugccc

SEQ ID NO: 403808 - RNA, 11 nt, Homo sapiens
gggugccauuc

SEQ ID NO: 403809 - RNA, 17 nt, Homo sapiens
ggguggagcaugggccu

SEQ ID NO: 403810 - RNA, 20 nt, Homo sapiens
ggguggaucaccugugguca

SEQ ID NO: 403811 - RNA, 21 nt, Homo sapiens
ggguggcccuugcaguucagc

SEQ ID NO: 403812 - RNA, 13 nt, Homo sapiens
gggugucuugucu

SEQ ID NO: 403813 - RNA, 11 nt, Homo sapiens
ggguguugcua

SEQ ID NO: 403814 - RNA, 16 nt, Homo sapiens
ggguucugauauugcc

SEQ ID NO: 403815 - RNA, 16 nt, Homo sapiens
gguaaaugauguggug

SEQ ID NO: 403816 - RNA, 22 nt, Homo sapiens
gguaacuaagaagugguguucc

SEQ ID NO: 403817 - RNA, 11 nt, Homo sapiens
gguaaucagca

SEQ ID NO: 403818 - RNA, 14 nt, Homo sapiens
gguaaucagcauua

SEQ ID NO: 403819 - RNA, 20 nt, Homo sapiens
gguaccaagaucacaaauag

SEQ ID NO: 403820 - RNA, 14 nt, Homo sapiens
ccuccaccagugug

SEQ ID NO: 403821 - RNA, 19 nt, Homo sapiens
ccuccacucuaguucuaga

SEQ ID NO: 403822 - RNA, 15 nt, Homo sapiens
ccuccagaggaugac

SEQ ID NO: 403823 - RNA, 19 nt, Homo sapiens
ccuccagccaauaggcagc

SEQ ID NO: 403824 - RNA, 20 nt, Homo sapiens
ccucccaaagugcugagauu

SEQ ID NO: 403825 - RNA, 20 nt, Homo sapiens
ccucccaaaguguugggauu

SEQ ID NO: 403826 - RNA, 20 nt, Homo sapiens
ccucccauagugcugggauu

SEQ ID NO: 403827 - RNA, 14 nt, Homo sapiens
ccucccucauucca

SEQ ID NO: 403828 - RNA, 23 nt, Homo sapiens
ccucccuccugauguuuuuccca

SEQ ID NO: 403829 - RNA, 22 nt, Homo sapiens
ccucccucucucuucugcucca

SEQ ID NO: 403830 - RNA, 17 nt, Homo sapiens
ccucccugccugcuccu

SEQ ID NO: 403831 - RNA, 16 nt, Homo sapiens
ccucccuuucugggag

SEQ ID NO: 403832 - RNA, 13 nt, Homo sapiens
ccuccgacuucuc

SEQ ID NO: 403833 - RNA, 13 nt, Homo sapiens
ccuccguccagcc

SEQ ID NO: 403834 - RNA, 20 nt, Homo sapiens
ccuccguguagugucuguaa

SEQ ID NO: 403835 - RNA, 11 nt, Homo sapiens
ccuccuacccu

SEQ ID NO: 403836 - RNA, 13 nt, Homo sapiens
ccuccucaccucu

SEQ ID NO: 403837 - RNA, 19 nt, Homo sapiens
ccuccucccagacuuucua

SEQ ID NO: 403838 - RNA, 16 nt, Homo sapiens
ccuccucccaucuccu

SEQ ID NO: 403839 - RNA, 21 nt, Homo sapiens
ccuccucuccuacuuugggac

SEQ ID NO: 403840 - RNA, 22 nt, Homo sapiens
ccuccucuucccuuagccucuc

SEQ ID NO: 403841 - RNA, 16 nt, Homo sapiens
ccuccuggguuuacuc

SEQ ID NO: 403842 - RNA, 23 nt, Homo sapiens
ccuccuggguuuacuccuugagu

SEQ ID NO: 403843 - RNA, 15 nt, Homo sapiens
ccuccuuccauggaa

SEQ ID NO: 403844 - RNA, 14 nt, Homo sapiens
ccuccuucgggaca

SEQ ID NO: 403845 - RNA, 12 nt, Homo sapiens
ccuccuuuccca

SEQ ID NO: 403846 - RNA, 19 nt, Homo sapiens
ccucgaacccacacugcaa

SEQ ID NO: 403847 - RNA, 18 nt, Homo sapiens
ccucuagaacagccagac

SEQ ID NO: 403848 - RNA, 19 nt, Homo sapiens
ccucucauagaaauugccu

SEQ ID NO: 403849 - RNA, 21 nt, Homo sapiens
ccucuccuccccccaagcuca

SEQ ID NO: 403850 - RNA, 22 nt, Homo sapiens
ccucucgucuuucgcacauucu

SEQ ID NO: 403851 - RNA, 21 nt, Homo sapiens
ccucucuaggccuguugccuc

SEQ ID NO: 403852 - RNA, 12 nt, Homo sapiens
ccucucucagga

SEQ ID NO: 403853 - RNA, 24 nt, Homo sapiens
ccucucucccugccucacaucucc

SEQ ID NO: 403854 - RNA, 19 nt, Homo sapiens
ccucucucucccuccacuc

SEQ ID NO: 403855 - RNA, 16 nt, Homo sapiens
ccucucuuauagaaua

SEQ ID NO: 403856 - RNA, 12 nt, Homo sapiens
ccucucuugccg

SEQ ID NO: 403857 - RNA, 14 nt, Homo sapiens
ccucugccacugac

SEQ ID NO: 403858 - RNA, 13 nt, Homo sapiens
ccucugcccucau

SEQ ID NO: 403859 - RNA, 23 nt, Homo sapiens
ccucugcuguauugauaucacua

SEQ ID NO: 403860 - RNA, 16 nt, Homo sapiens
ccucuggacaagucau

SEQ ID NO: 403861 - RNA, 21 nt, Homo sapiens
ccucuggacaagucaucugca

SEQ ID NO: 403862 - RNA, 23 nt, Homo sapiens
ccucuggguuguuaauacuguau

SEQ ID NO: 403863 - RNA, 20 nt, Homo sapiens
ccucugguuccacucagcuu

SEQ ID NO: 403864 - RNA, 14 nt, Homo sapiens
ccucuuaagacacu

SEQ ID NO: 403865 - RNA, 24 nt, Homo sapiens
ccucuuauuguuccucuuacgcuc

SEQ ID NO: 403866 - RNA, 14 nt, Homo sapiens
ccucuuauuugcuc

SEQ ID NO: 403867 - RNA, 22 nt, Homo sapiens
ccucuucacgguuucacuuuua

SEQ ID NO: 403868 - RNA, 21 nt, Homo sapiens
ccucuucaggggucaccuccu

SEQ ID NO: 403869 - RNA, 14 nt, Homo sapiens
ccucuuccccagaa

SEQ ID NO: 403870 - RNA, 22 nt, Homo sapiens
ccucuuccccagaaaggagacu

SEQ ID NO: 403871 - RNA, 13 nt, Homo sapiens
ccucuugcuauug

SEQ ID NO: 403872 - RNA, 18 nt, Homo sapiens
ccucuuuaccuguucaaa

SEQ ID NO: 403873 - RNA, 16 nt, Homo sapiens
ccucuuucacuucuua

SEQ ID NO: 403874 - RNA, 17 nt, Homo sapiens
ccucuuugagugaagcu

SEQ ID NO: 403875 - RNA, 14 nt, Homo sapiens
ccucuuugucccag

SEQ ID NO: 403876 - RNA, 23 nt, Homo sapiens
ccucuuuucugcaucaucuguag

SEQ ID NO: 403877 - RNA, 18 nt, Homo sapiens
ccugaaaaggguguugcu

SEQ ID NO: 403878 - RNA, 19 nt, Homo sapiens
ccugaaaaggguguugcua

SEQ ID NO: 403879 - RNA, 15 nt, Homo sapiens
ccugaaaauucugua

SEQ ID NO: 403880 - RNA, 17 nt, Homo sapiens
ccugaaacugagucugu

SEQ ID NO: 403881 - RNA, 16 nt, Homo sapiens
ccugaaauguuuccag

SEQ ID NO: 403882 - RNA, 22 nt, Homo sapiens
ccugaagucuuuguacagacaa

SEQ ID NO: 403883 - RNA, 18 nt, Homo sapiens
ccugaaugguuccaugcc

SEQ ID NO: 403884 - RNA, 23 nt, Homo sapiens
ccugaaugugucugcgucccugu

SEQ ID NO: 403885 - RNA, 15 nt, Homo sapiens
ccugacagaugucag

SEQ ID NO: 403886 - RNA, 20 nt, Homo sapiens
ccugacccuccuccacucca

SEQ ID NO: 403887 - RNA, 22 nt, Homo sapiens
ccugaccucaaguaauccaccu

SEQ ID NO: 403888 - RNA, 16 nt, Homo sapiens
ccugaccucacuguga

SEQ ID NO: 403889 - RNA, 22 nt, Homo sapiens
ccugaccucaggugauccaccc

SEQ ID NO: 403890 - RNA, 20 nt, Homo sapiens
ccugacguagcugcaaagga

SEQ ID NO: 403891 - RNA, 17 nt, Homo sapiens
ccugacuacagaaauua

SEQ ID NO: 403892 - RNA, 20 nt, Homo sapiens
ccugacuguccuacaauauc

SEQ ID NO: 403893 - RNA, 22 nt, Homo sapiens
ccugacuguccuacaauaucau

SEQ ID NO: 403894 - RNA, 16 nt, Homo sapiens
ccugagaaacguccau

SEQ ID NO: 403895 - RNA, 13 nt, Homo sapiens
ccugagaauauua

SEQ ID NO: 403896 - RNA, 16 nt, Homo sapiens
ccugagggaagcccac

SEQ ID NO: 403897 - RNA, 14 nt, Homo sapiens
ccugaggucaugca

SEQ ID NO: 403898 - RNA, 17 nt, Homo sapiens
ccugaguaguaaucuca

SEQ ID NO: 403899 - RNA, 17 nt, Homo sapiens
ccugaguggugccaaac

SEQ ID NO: 403900 - RNA, 21 nt, Homo sapiens
ccugaguuggcguugugggca

SEQ ID NO: 403901 - RNA, 12 nt, Homo sapiens
ccugaguuucaa

SEQ ID NO: 403902 - RNA, 18 nt, Homo sapiens
ccugaugcgucuacccag

SEQ ID NO: 403903 - RNA, 12 nt, Homo sapiens
ccugauguuaaa

SEQ ID NO: 403904 - RNA, 17 nt, Homo sapiens
ccugcaaagggaacuga

SEQ ID NO: 403905 - RNA, 13 nt, Homo sapiens
ccugcacaagcca

SEQ ID NO: 403906 - RNA, 21 nt, Homo sapiens
ccugcaccccugcaguuugag

SEQ ID NO: 403907 - RNA, 24 nt, Homo sapiens
ccugcaccgagagagauggaauaa

SEQ ID NO: 403908 - RNA, 14 nt, Homo sapiens
ccugcaccugugca

SEQ ID NO: 403909 - RNA, 19 nt, Homo sapiens
ccugcacucuuauuucacu

SEQ ID NO: 403910 - RNA, 16 nt, Homo sapiens
ccugcagaauccagcu

SEQ ID NO: 403911 - RNA, 17 nt, Homo sapiens
ccugcagaauccagcua

SEQ ID NO: 403912 - RNA, 18 nt, Homo sapiens
ccugcaggccccagccaa

SEQ ID NO: 403913 - RNA, 22 nt, Homo sapiens
ccugcaggucacugaaacuuca

SEQ ID NO: 403914 - RNA, 15 nt, Homo sapiens
ccugcaucugugaaa

SEQ ID NO: 403915 - RNA, 22 nt, Homo sapiens
ccugcauucgcagcagcuccgc

SEQ ID NO: 403916 - RNA, 23 nt, Homo sapiens
ccugccaaaugaauaagacaaca

SEQ ID NO: 403917 - RNA, 15 nt, Homo sapiens
ccugccauguguaag

SEQ ID NO: 403918 - RNA, 21 nt, Homo sapiens
ccugcccacuuagccguccau

SEQ ID NO: 403919 - RNA, 18 nt, Homo sapiens
ccugccccccucaucuca

SEQ ID NO: 403920 - RNA, 17 nt, Homo sapiens
ccugccccucucccgcc

SEQ ID NO: 403921 - RNA, 19 nt, Homo sapiens
ccugcccgagagcucuuag

SEQ ID NO: 403922 - RNA, 14 nt, Homo sapiens
ccugcccuccccca

SEQ ID NO: 403923 - RNA, 19 nt, Homo sapiens
ccugccucccuuucuggga

SEQ ID NO: 403924 - RNA, 17 nt, Homo sapiens
ccugccuuuucauugcc

SEQ ID NO: 403925 - RNA, 21 nt, Homo sapiens
ccugcgaccacagcagggauu

SEQ ID NO: 403926 - RNA, 19 nt, Homo sapiens
ccugcggaguugugcacgu

SEQ ID NO: 403927 - RNA, 22 nt, Homo sapiens
ccugcuacaguagcugugggga

SEQ ID NO: 403928 - RNA, 22 nt, Homo sapiens
ccugcucuuucuacaugacugg

SEQ ID NO: 403929 - RNA, 22 nt, Homo sapiens
ccugcugaccucccagugaccc

SEQ ID NO: 403930 - RNA, 17 nt, Homo sapiens
ccugcugcuucugcaaa

SEQ ID NO: 403931 - RNA, 19 nt, Homo sapiens
ccugcuggugagaggugca

SEQ ID NO: 403932 - RNA, 15 nt, Homo sapiens
ccugcuucauaucuc

SEQ ID NO: 403933 - RNA, 20 nt, Homo sapiens
ccuggaaugcauucacucag

SEQ ID NO: 403934 - RNA, 14 nt, Homo sapiens
ccuggacuccagua

SEQ ID NO: 403935 - RNA, 11 nt, Homo sapiens
ccuuugaucuu

SEQ ID NO: 403936 - RNA, 22 nt, Homo sapiens
ccuuugcaggcccagcagacuu

SEQ ID NO: 403937 - RNA, 22 nt, Homo sapiens
ccuuugcuagggggcaaauaca

SEQ ID NO: 403938 - RNA, 21 nt, Homo sapiens
ccuuugcucuuauaaaaucaa

SEQ ID NO: 403939 - RNA, 14 nt, Homo sapiens
ccuuuggaaagcca

SEQ ID NO: 403940 - RNA, 16 nt, Homo sapiens
ccuuuggaaagccauu

SEQ ID NO: 403941 - RNA, 15 nt, Homo sapiens
ccuuuguacugauga

SEQ ID NO: 403942 - RNA, 13 nt, Homo sapiens
ccuuuguaguuaa

SEQ ID NO: 403943 - RNA, 19 nt, Homo sapiens
ccuuuguguagaaagccaa

SEQ ID NO: 403944 - RNA, 13 nt, Homo sapiens
ccuuuguugcaca

SEQ ID NO: 403945 - RNA, 18 nt, Homo sapiens
ccuuuuaaaaggagcaca

SEQ ID NO: 403946 - RNA, 21 nt, Homo sapiens
ccuuuuacagcucuuggcauu

SEQ ID NO: 403947 - RNA, 19 nt, Homo sapiens
ccuuuuauuuauuccuuau

SEQ ID NO: 403948 - RNA, 12 nt, Homo sapiens
ccuuuuccagaa

SEQ ID NO: 403949 - RNA, 16 nt, Homo sapiens
ccuuuugagugccuua

SEQ ID NO: 403950 - RNA, 22 nt, Homo sapiens
ccuuuugcacauaacaugcuuu

SEQ ID NO: 403951 - RNA, 19 nt, Homo sapiens
ccuuuuggguuugccuuaa

SEQ ID NO: 403952 - RNA, 16 nt, Homo sapiens
gguacuacaaccaauu

SEQ ID NO: 403953 - RNA, 21 nt, Homo sapiens
gguacuauuuagauauaacac

SEQ ID NO: 403954 - RNA, 14 nt, Homo sapiens
gguacuuaaagcuu

SEQ ID NO: 403955 - RNA, 14 nt, Homo sapiens
gguagaaguggcau

SEQ ID NO: 403956 - RNA, 15 nt, Homo sapiens
gguagaaguggcaua

SEQ ID NO: 403957 - RNA, 14 nt, Homo sapiens
gguagacugugaca

SEQ ID NO: 403958 - RNA, 13 nt, Homo sapiens
gguagcaacugaa

SEQ ID NO: 403959 - RNA, 14 nt, Homo sapiens
gguagcgagcugcu

SEQ ID NO: 403960 - RNA, 15 nt, Homo sapiens
gguagguagugauua

SEQ ID NO: 403961 - RNA, 14 nt, Homo sapiens
gguaguacugggaa

SEQ ID NO: 403962 - RNA, 23 nt, Homo sapiens
gguaguagaaucucagcacuuug

SEQ ID NO: 403963 - RNA, 15 nt, Homo sapiens
gguaguggggaccaa

SEQ ID NO: 403964 - RNA, 15 nt, Homo sapiens
gguaucuacuucuac

SEQ ID NO: 403965 - RNA, 22 nt, Homo sapiens
gguauguguggaugaugcugcc

SEQ ID NO: 403966 - RNA, 20 nt, Homo sapiens
gguauguuuuaccaucugca

SEQ ID NO: 403967 - RNA, 23 nt, Homo sapiens
gguauucaccacccugggacccc

SEQ ID NO: 403968 - RNA, 11 nt, Homo sapiens
gguauuugaau

SEQ ID NO: 403969 - RNA, 15 nt, Homo sapiens
ggucaaaggcucaaa

SEQ ID NO: 403970 - RNA, 17 nt, Homo sapiens
ggucaagaguucaagac

SEQ ID NO: 403971 - RNA, 16 nt, Homo sapiens
ggucaaguaagaagac

SEQ ID NO: 403972 - RNA, 18 nt, Homo sapiens
ggucaggaacaguggcug

SEQ ID NO: 403973 - RNA, 23 nt, Homo sapiens
ggucaucgugacagcagcagcuc

SEQ ID NO: 403974 - RNA, 15 nt, Homo sapiens
ggucaugaugucugc

SEQ ID NO: 403975 - RNA, 21 nt, Homo sapiens
ggucauucuuuucuccuccuc

SEQ ID NO: 403976 - RNA, 21 nt, Homo sapiens
ggucauuggccacugucucca

SEQ ID NO: 403977 - RNA, 20 nt, Homo sapiens
gguccacucccugcuccacg

SEQ ID NO: 403978 - RNA, 16 nt, Homo sapiens
ggucccagcuaaagag

SEQ ID NO: 403979 - RNA, 20 nt, Homo sapiens
ggucccauuucucacugaga

SEQ ID NO: 403980 - RNA, 21 nt, Homo sapiens
ggucccauuucucacugagaa

SEQ ID NO: 403981 - RNA, 15 nt, Homo sapiens
gguccccauccccac

SEQ ID NO: 403982 - RNA, 18 nt, Homo sapiens
ggucccgaauggagucca

SEQ ID NO: 403983 - RNA, 21 nt, Homo sapiens
ggucccuucccccugcuccau

SEQ ID NO: 403984 - RNA, 21 nt, Homo sapiens
gguccucugcaugucucaggc

SEQ ID NO: 403985 - RNA, 15 nt, Homo sapiens
gguccuggcuccuga

SEQ ID NO: 403986 - RNA, 20 nt, Homo sapiens
ggucucaaacuccugaccuc

SEQ ID NO: 403987 - RNA, 20 nt, Homo sapiens
ggucucgcuuuguugcccag

SEQ ID NO: 403988 - RNA, 21 nt, Homo sapiens
ggucucgucaggaggugccug

SEQ ID NO: 403989 - RNA, 21 nt, Homo sapiens
ggucucuuuccaaagcauuuu

SEQ ID NO: 403990 - RNA, 16 nt, Homo sapiens
ggucugcucuuucucu

SEQ ID NO: 403991 - RNA, 17 nt, Homo sapiens
ggucugggacuuccuug

SEQ ID NO: 403992 - RNA, 15 nt, Homo sapiens
ggucuguagggauuu

SEQ ID NO: 403993 - RNA, 18 nt, Homo sapiens
ggucuuacuuugugcaaa

SEQ ID NO: 403994 - RNA, 21 nt, Homo sapiens
ggucuuuuacauacagugaua

SEQ ID NO: 403995 - RNA, 21 nt, Homo sapiens
ggugacagugccuucucuauu

SEQ ID NO: 403996 - RNA, 15 nt, Homo sapiens
ggugaccaaugcauu

SEQ ID NO: 403997 - RNA, 18 nt, Homo sapiens
ggugaccaguugcacuug

SEQ ID NO: 403998 - RNA, 15 nt, Homo sapiens
ggugagugcuuguca

SEQ ID NO: 403999 - RNA, 19 nt, Homo sapiens
ggugagugcuugucaugga

SEQ ID NO: 404000 - RNA, 17 nt, Homo sapiens
ggugauccgccuaccuc

SEQ ID NO: 404001 - RNA, 19 nt, Homo sapiens
ggugaucuaccugccucag

SEQ ID NO: 404002 - RNA, 14 nt, Homo sapiens
ggugaucugggauu

SEQ ID NO: 404003 - RNA, 17 nt, Homo sapiens
ggugauguaaaacagaa

SEQ ID NO: 404004 - RNA, 23 nt, Homo sapiens
ggugauguaaaacagaauauucu

SEQ ID NO: 404005 - RNA, 14 nt, Homo sapiens
ggugauucugaucc

SEQ ID NO: 404006 - RNA, 14 nt, Homo sapiens
ggugauuucuugcu

SEQ ID NO: 404007 - RNA, 20 nt, Homo sapiens
ggugcacuuuucugugucau

SEQ ID NO: 404008 - RNA, 21 nt, Homo sapiens
ggugccaggcuguaagcauuc

SEQ ID NO: 404009 - RNA, 21 nt, Homo sapiens
ggugccugugaccgggguccu

SEQ ID NO: 404010 - RNA, 17 nt, Homo sapiens
ggugcuaauccaggaca

SEQ ID NO: 404011 - RNA, 20 nt, Homo sapiens
ggugcuaucgcaccacugug

SEQ ID NO: 404012 - RNA, 13 nt, Homo sapiens
ggugcucaaagau

SEQ ID NO: 404013 - RNA, 23 nt, Homo sapiens
ggugcugcuuucuuguugcugca

SEQ ID NO: 404014 - RNA, 22 nt, Homo sapiens
ggugcugguuuauguucuagga

SEQ ID NO: 404015 - RNA, 12 nt, Homo sapiens
gguggaaggccu

SEQ ID NO: 404016 - RNA, 15 nt, Homo sapiens
gguggacagaagcuu

SEQ ID NO: 404017 - RNA, 20 nt, Homo sapiens
gguggaggguggggggcgcu

SEQ ID NO: 404018 - RNA, 15 nt, Homo sapiens
gguggcagcucaaaa

SEQ ID NO: 404019 - RNA, 16 nt, Homo sapiens
gguggccagggcucca

SEQ ID NO: 404020 - RNA, 21 nt, Homo sapiens
gguggccccagcugugacuga

SEQ ID NO: 404021 - RNA, 17 nt, Homo sapiens
gguggcccuugcaguuc

SEQ ID NO: 404022 - RNA, 15 nt, Homo sapiens
gguggucugaauguu

SEQ ID NO: 404023 - RNA, 16 nt, Homo sapiens
ggugguuuuugcucuc

SEQ ID NO: 404024 - RNA, 22 nt, Homo sapiens
gguguagcuguccucucagaac

SEQ ID NO: 404025 - RNA, 17 nt, Homo sapiens
ggugucagucagggaca

SEQ ID NO: 404026 - RNA, 13 nt, Homo sapiens
ggugucuguaauc

SEQ ID NO: 404027 - RNA, 16 nt, Homo sapiens
ggugugggucagggag

SEQ ID NO: 404028 - RNA, 11 nt, Homo sapiens
gguuaccucug

SEQ ID NO: 404029 - RNA, 20 nt, Homo sapiens
gguuagaaaaaggacucugc

SEQ ID NO: 404030 - RNA, 20 nt, Homo sapiens
gguuaggauuuaacagucau

SEQ ID NO: 404031 - RNA, 15 nt, Homo sapiens
gguuaugacagggag

SEQ ID NO: 404032 - RNA, 17 nt, Homo sapiens
gguuaugucccaugacc

SEQ ID NO: 404033 - RNA, 16 nt, Homo sapiens
gguucagaaaugcugc

SEQ ID NO: 404034 - RNA, 22 nt, Homo sapiens
gguucccguguuguaccugacu

SEQ ID NO: 404035 - RNA, 15 nt, Homo sapiens
gguuccggaauccug

SEQ ID NO: 404036 - RNA, 15 nt, Homo sapiens
gguucgagacuccau

SEQ ID NO: 404037 - RNA, 12 nt, Homo sapiens
gguucuaugauu

SEQ ID NO: 404038 - RNA, 14 nt, Homo sapiens
gguuggguuccaga

SEQ ID NO: 404039 - RNA, 23 nt, Homo sapiens
gguuuacaacaaacacugugaug

SEQ ID NO: 404040 - RNA, 12 nt, Homo sapiens
gguuuacugcug

SEQ ID NO: 404041 - RNA, 22 nt, Homo sapiens
gguuucuaacccacccucacga

SEQ ID NO: 404042 - RNA, 22 nt, Homo sapiens
gguuugagaauguuuuuagcug

SEQ ID NO: 404043 - RNA, 19 nt, Homo sapiens
gguuuguuauaucagggaa

SEQ ID NO: 404044 - RNA, 18 nt, Homo sapiens
gguuuuauaaaagccuug

SEQ ID NO: 404045 - RNA, 20 nt, Homo sapiens
gguuuuuugcuaagagccag

SEQ ID NO: 404046 - RNA, 15 nt, Homo sapiens
guaaaaacuguucuc

SEQ ID NO: 404047 - RNA, 19 nt, Homo sapiens
guaaaacagauuuguucau

SEQ ID NO: 404048 - RNA, 13 nt, Homo sapiens
guaaaacugugac

SEQ ID NO: 404049 - RNA, 17 nt, Homo sapiens
guaaaacuuauauuaaa

SEQ ID NO: 404050 - RNA, 14 nt, Homo sapiens
guaaaagugacaug

SEQ ID NO: 404051 - RNA, 13 nt, Homo sapiens
guaaaaugaaauu

SEQ ID NO: 404052 - RNA, 12 nt, Homo sapiens
guaaacaguuug

SEQ ID NO: 404053 - RNA, 12 nt, Homo sapiens
guaaaccuggag

SEQ ID NO: 404054 - RNA, 16 nt, Homo sapiens
guaaagauaaaaggau

SEQ ID NO: 404055 - RNA, 21 nt, Homo sapiens
guaaauacacauagcauguaa

SEQ ID NO: 404056 - RNA, 18 nt, Homo sapiens
guaaauccuagacuugaa

SEQ ID NO: 404057 - RNA, 20 nt, Homo sapiens
guaaaugcuagguuaauucc

SEQ ID NO: 404058 - RNA, 13 nt, Homo sapiens
guaaauggaacaa

SEQ ID NO: 404059 - RNA, 15 nt, Homo sapiens
guaaauuauuucaua

SEQ ID NO: 404060 - RNA, 15 nt, Homo sapiens
guaaauucaaccacu

SEQ ID NO: 404061 - RNA, 13 nt, Homo sapiens
guaacacuguaua

SEQ ID NO: 404062 - RNA, 19 nt, Homo sapiens
guaacacuguauaacauuu

SEQ ID NO: 404063 - RNA, 17 nt, Homo sapiens
guaaccaagaguauucc

SEQ ID NO: 404064 - RNA, 18 nt, Homo sapiens
guaaccaagaguauucca

SEQ ID NO: 404065 - RNA, 20 nt, Homo sapiens
guggccugccuucaccccac

SEQ ID NO: 404066 - RNA, 14 nt, Homo sapiens
guggcuccuaucug

SEQ ID NO: 404067 - RNA, 17 nt, Homo sapiens
guggcugcuucauauga

SEQ ID NO: 404068 - RNA, 17 nt, Homo sapiens
gugggagagacugugag

SEQ ID NO: 404069 - RNA, 12 nt, Homo sapiens
gugggaguccac

SEQ ID NO: 404070 - RNA, 18 nt, Homo sapiens
gugggaguccacuuuccu

SEQ ID NO: 404071 - RNA, 17 nt, Homo sapiens
gugggcaaacaggcagu

SEQ ID NO: 404072 - RNA, 11 nt, Homo sapiens
gugggccaugg

SEQ ID NO: 404073 - RNA, 22 nt, Homo sapiens
guggggcaagccugagugguga

SEQ ID NO: 404074 - RNA, 15 nt, Homo sapiens
guggggcauguccuc

SEQ ID NO: 404075 - RNA, 14 nt, Homo sapiens
gugguaacugccag

SEQ ID NO: 404076 - RNA, 14 nt, Homo sapiens
gugguaaguggagg

SEQ ID NO: 404077 - RNA, 14 nt, Homo sapiens
gugguacagcacug

SEQ ID NO: 404078 - RNA, 19 nt, Homo sapiens
guggucagagggacuguca

SEQ ID NO: 404079 - RNA, 15 nt, Homo sapiens
guggucagcagaaac

SEQ ID NO: 404080 - RNA, 17 nt, Homo sapiens
guggugagaggcaucca

SEQ ID NO: 404081 - RNA, 17 nt, Homo sapiens
gugguggcaaaagacau

SEQ ID NO: 404082 - RNA, 16 nt, Homo sapiens
gugguuaacaucucag

SEQ ID NO: 404083 - RNA, 19 nt, Homo sapiens
gugguuacuuccuacugua

SEQ ID NO: 404084 - RNA, 20 nt, Homo sapiens
gugguuuccacaugcucuga

SEQ ID NO: 404085 - RNA, 16 nt, Homo sapiens
gugguuugauaguguu

SEQ ID NO: 404086 - RNA, 14 nt, Homo sapiens
gugguuuguuauca

SEQ ID NO: 404087 - RNA, 17 nt, Homo sapiens
gugguuuuugagccaug

SEQ ID NO: 404088 - RNA, 17 nt, Homo sapiens
gugguuuuuugguguuu

SEQ ID NO: 404089 - RNA, 14 nt, Homo sapiens
guguaaguaauuau

SEQ ID NO: 404090 - RNA, 21 nt, Homo sapiens
guguauauauaguagcauuuc

SEQ ID NO: 404091 - RNA, 19 nt, Homo sapiens
guguaugcacgugugcaca

SEQ ID NO: 404092 - RNA, 21 nt, Homo sapiens
guguaugugcgugugugcaag

SEQ ID NO: 404093 - RNA, 15 nt, Homo sapiens
guguauuagauauca

SEQ ID NO: 404094 - RNA, 20 nt, Homo sapiens
guguauucuagugaaugaau

SEQ ID NO: 404095 - RNA, 21 nt, Homo sapiens
gugucacuacucacagucucu

SEQ ID NO: 404096 - RNA, 14 nt, Homo sapiens
cucaguuggugcug

SEQ ID NO: 404097 - RNA, 20 nt, Homo sapiens
cucaguuggugcugcuuucu

SEQ ID NO: 404098 - RNA, 21 nt, Homo sapiens
cucaguuggugcugcuuucuu

SEQ ID NO: 404099 - RNA, 16 nt, Homo sapiens
cucaguuuuugcugau

SEQ ID NO: 404100 - RNA, 22 nt, Homo sapiens
cucaucacacgucacaaugucc

SEQ ID NO: 404101 - RNA, 12 nt, Homo sapiens
cucaucagaaac

SEQ ID NO: 404102 - RNA, 23 nt, Homo sapiens
cucaucaguguccucuugcucaa

SEQ ID NO: 404103 - RNA, 19 nt, Homo sapiens
cucaucccacgcacuccau

SEQ ID NO: 404104 - RNA, 16 nt, Homo sapiens
cucauccuccacugaa

SEQ ID NO: 404105 - RNA, 14 nt, Homo sapiens
cucaugauguauug

SEQ ID NO: 404106 - RNA, 15 nt, Homo sapiens
cucaugccuguaauc

SEQ ID NO: 404107 - RNA, 15 nt, Homo sapiens
cucaugcgcaaugag

SEQ ID NO: 404108 - RNA, 13 nt, Homo sapiens
cucauuccaccuu

SEQ ID NO: 404109 - RNA, 18 nt, Homo sapiens
cucauuccccaaccacuu

SEQ ID NO: 404110 - RNA, 15 nt, Homo sapiens
cucauucuucuuggc

SEQ ID NO: 404111 - RNA, 12 nt, Homo sapiens
cucauucuugcc

SEQ ID NO: 404112 - RNA, 19 nt, Homo sapiens
cucauucuuuucagcuugu

SEQ ID NO: 404113 - RNA, 16 nt, Homo sapiens
cucauuuagcauugaa

SEQ ID NO: 404114 - RNA, 14 nt, Homo sapiens
cuccaaaacacuua

SEQ ID NO: 404115 - RNA, 13 nt, Homo sapiens
cuccaaaagcacu

SEQ ID NO: 404116 - RNA, 20 nt, Homo sapiens
cuccaacuuucccuccacca

SEQ ID NO: 404117 - RNA, 16 nt, Homo sapiens
cuccaaggaguggaaa

SEQ ID NO: 404118 - RNA, 17 nt, Homo sapiens
cuccaaggcaaaugucc

SEQ ID NO: 404119 - RNA, 22 nt, Homo sapiens
cuccaaggcaaauguccaagca

SEQ ID NO: 404120 - RNA, 20 nt, Homo sapiens
cuccaagguagaauuugcaa

SEQ ID NO: 404121 - RNA, 15 nt, Homo sapiens
cuccacagugcugcu

SEQ ID NO: 404122 - RNA, 23 nt, Homo sapiens
cuccacauuaggucaccugugca

SEQ ID NO: 404123 - RNA, 16 nt, Homo sapiens
cuccacccaccaguca

SEQ ID NO: 404124 - RNA, 18 nt, Homo sapiens
cuccacccccuccuguca

SEQ ID NO: 404125 - RNA, 17 nt, Homo sapiens
cuccacccuuggacuuu

SEQ ID NO: 404126 - RNA, 16 nt, Homo sapiens
cuccaccuuccaaagg

SEQ ID NO: 404127 - RNA, 16 nt, Homo sapiens
cuccacuaauacuggu

SEQ ID NO: 404128 - RNA, 15 nt, Homo sapiens
cuccacucacuccag

SEQ ID NO: 404129 - RNA, 16 nt, Homo sapiens
cuccacugccuucgau

SEQ ID NO: 404130 - RNA, 16 nt, Homo sapiens
cuccagaacaaaccuc

SEQ ID NO: 404131 - RNA, 23 nt, Homo sapiens
cuccagaauggucuuucuaaugu

SEQ ID NO: 404132 - RNA, 14 nt, Homo sapiens
cuccagcccuaugg

SEQ ID NO: 404133 - RNA, 17 nt, Homo sapiens
cuccagccucagcucuc

SEQ ID NO: 404134 - RNA, 22 nt, Homo sapiens
cuccagcugggagacacagcaa

SEQ ID NO: 404135 - RNA, 16 nt, Homo sapiens
cuccaggaucuauuga

SEQ ID NO: 404136 - RNA, 16 nt, Homo sapiens
cuccaggauuguccac

SEQ ID NO: 404137 - RNA, 23 nt, Homo sapiens
cuccaguauaugcugauggacca

SEQ ID NO: 404138 - RNA, 18 nt, Homo sapiens
cuccagucccccuauccu

SEQ ID NO: 404139 - RNA, 15 nt, Homo sapiens
cuccaguucugauga

SEQ ID NO: 404140 - RNA, 14 nt, Homo sapiens
cuccauaauugcaa

SEQ ID NO: 404141 - RNA, 16 nt, Homo sapiens
cuccauccuugcauca

SEQ ID NO: 404142 - RNA, 17 nt, Homo sapiens
cuccauccuugcaucac

SEQ ID NO: 404143 - RNA, 20 nt, Homo sapiens
cuccaucuuucuacagagau

SEQ ID NO: 404144 - RNA, 17 nt, Homo sapiens
cuccaugagugcagcuc

SEQ ID NO: 404145 - RNA, 19 nt, Homo sapiens
cuccaugcugccuccagaa

SEQ ID NO: 404146 - RNA, 23 nt, Homo sapiens
cuccauggccaccccgugccacc

SEQ ID NO: 404147 - RNA, 20 nt, Homo sapiens
cuccauuaaauggucuaaaa

SEQ ID NO: 404148 - RNA, 20 nt, Homo sapiens
cucccaaagugcuaagauua

SEQ ID NO: 404149 - RNA, 18 nt, Homo sapiens
cucccaaagugcugagau

SEQ ID NO: 404150 - RNA, 19 nt, Homo sapiens
cucccaaagugcugggauu

SEQ ID NO: 404151 - RNA, 14 nt, Homo sapiens
cucccaaccucaau

SEQ ID NO: 404152 - RNA, 19 nt, Homo sapiens
cucccaaggcucugagcaa

SEQ ID NO: 404153 - RNA, 13 nt, Homo sapiens
cucccacagcuuc

SEQ ID NO: 404154 - RNA, 17 nt, Homo sapiens
cucccacaucccacugg

SEQ ID NO: 404155 - RNA, 18 nt, Homo sapiens
cucccacccuucucaggg

SEQ ID NO: 404156 - RNA, 20 nt, Homo sapiens
cucccacccuucucagggac

SEQ ID NO: 404157 - RNA, 18 nt, Homo sapiens
cucccaggaccuggagac

SEQ ID NO: 404158 - RNA, 20 nt, Homo sapiens
cucccaggcucaagcacuuu

SEQ ID NO: 404159 - RNA, 11 nt, Homo sapiens
cucccagugac

SEQ ID NO: 404160 - RNA, 13 nt, Homo sapiens
cucccaugcacac

SEQ ID NO: 404161 - RNA, 16 nt, Homo sapiens
cucccaugcacacaaa

SEQ ID NO: 404162 - RNA, 15 nt, Homo sapiens
cuccccacucuaggg

SEQ ID NO: 404163 - RNA, 16 nt, Homo sapiens
cuccccagccaggugc

SEQ ID NO: 404164 - RNA, 12 nt, Homo sapiens
cuccccagugaa

SEQ ID NO: 404165 - RNA, 11 nt, Homo sapiens
cuccccagugu

SEQ ID NO: 404166 - RNA, 20 nt, Homo sapiens
cuccccauggugcagugaag

SEQ ID NO: 404167 - RNA, 15 nt, Homo sapiens
cuccccccagacccc

SEQ ID NO: 404168 - RNA, 20 nt, Homo sapiens
cuccccuuugacccuauuca

SEQ ID NO: 404169 - RNA, 15 nt, Homo sapiens
cucccgaauccugag

SEQ ID NO: 404170 - RNA, 18 nt, Homo sapiens
cucccggguucacgccau

SEQ ID NO: 404171 - RNA, 15 nt, Homo sapiens
cucccucauuccacc

SEQ ID NO: 404172 - RNA, 23 nt, Homo sapiens
cucccuccauccucgucugucaa

SEQ ID NO: 404173 - RNA, 15 nt, Homo sapiens
cucccucgcuguaug

SEQ ID NO: 404174 - RNA, 22 nt, Homo sapiens
cucccucucucuucugcuccac

SEQ ID NO: 404175 - RNA, 15 nt, Homo sapiens
cucccucugcucuca

SEQ ID NO: 404176 - RNA, 23 nt, Homo sapiens
cucccugaccuuagcguucugga

SEQ ID NO: 404177 - RNA, 16 nt, Homo sapiens
cucccugccaacucca

SEQ ID NO: 404178 - RNA, 18 nt, Homo sapiens
cucccugccucacaucuc

SEQ ID NO: 404179 - RNA, 14 nt, Homo sapiens
cucccuggcuguga

SEQ ID NO: 404180 - RNA, 15 nt, Homo sapiens
cucccuggggaccag

SEQ ID NO: 404181 - RNA, 15 nt, Homo sapiens
cucccuguccauccc

SEQ ID NO: 404182 - RNA, 18 nt, Homo sapiens
cucccuguuaucugcuag

SEQ ID NO: 404183 - RNA, 22 nt, Homo sapiens
cucccuuaauaaacucacaacu

SEQ ID NO: 404184 - RNA, 13 nt, Homo sapiens
cuccgccauucca

SEQ ID NO: 404185 - RNA, 16 nt, Homo sapiens
cuccgcgccuugccuc

SEQ ID NO: 404186 - RNA, 23 nt, Homo sapiens
cuccggagaugaauaugagcuca

SEQ ID NO: 404187 - RNA, 16 nt, Homo sapiens
cuccgugcguccuccc

SEQ ID NO: 404188 - RNA, 19 nt, Homo sapiens
cuccgugugucucaugcca

SEQ ID NO: 404189 - RNA, 21 nt, Homo sapiens
cuccguugcggcugugcuccu

SEQ ID NO: 404190 - RNA, 20 nt, Homo sapiens
cuccuaaguuuaauuacaac

SEQ ID NO: 404191 - RNA, 22 nt, Homo sapiens
cuccucacaguugccauguaga

SEQ ID NO: 404192 - RNA, 21 nt, Homo sapiens
cuccucaucucuaacagcuca

SEQ ID NO: 404193 - RNA, 13 nt, Homo sapiens
cuccucggaggau

SEQ ID NO: 404194 - RNA, 14 nt, Homo sapiens
cuccucucuggacu

SEQ ID NO: 404195 - RNA, 22 nt, Homo sapiens
cuccucuguccaggcacugcug

SEQ ID NO: 404196 - RNA, 15 nt, Homo sapiens
uagaggcgagccagg

SEQ ID NO: 404197 - RNA, 18 nt, Homo sapiens
uagaggcuugaucaugaa

SEQ ID NO: 404198 - RNA, 21 nt, Homo sapiens
uagagguagguaggaucaucc

SEQ ID NO: 404199 - RNA, 20 nt, Homo sapiens
uagaguuuuaucaacuuugg

SEQ ID NO: 404200 - RNA, 23 nt, Homo sapiens
uagauaaccuguacuucaaguua

SEQ ID NO: 404201 - RNA, 22 nt, Homo sapiens
uagauauaacacuauguuuauu

SEQ ID NO: 404202 - RNA, 16 nt, Homo sapiens
uagauauccuuggcac

SEQ ID NO: 404203 - RNA, 21 nt, Homo sapiens
uagauauugugaaguacauau

SEQ ID NO: 404204 - RNA, 15 nt, Homo sapiens
uagaucaaagucaaa

SEQ ID NO: 404205 - RNA, 19 nt, Homo sapiens
uagauccucugauauacaa

SEQ ID NO: 404206 - RNA, 22 nt, Homo sapiens
uagaucuaguucucaaucacug

SEQ ID NO: 404207 - RNA, 14 nt, Homo sapiens
uagaugaacucuuc

SEQ ID NO: 404208 - RNA, 16 nt, Homo sapiens
uagaugauuucuagca

SEQ ID NO: 404209 - RNA, 17 nt, Homo sapiens
uagaugcugacuguacu

SEQ ID NO: 404210 - RNA, 11 nt, Homo sapiens
uagaugggcau

SEQ ID NO: 404211 - RNA, 22 nt, Homo sapiens
uagauuaaaggaauuaaacuaa

SEQ ID NO: 404212 - RNA, 17 nt, Homo sapiens
uagauuuccacacgcca

SEQ ID NO: 404213 - RNA, 17 nt, Homo sapiens
uagcaaggggcucagaa

SEQ ID NO: 404214 - RNA, 14 nt, Homo sapiens
uagcaccauugcac

SEQ ID NO: 404215 - RNA, 23 nt, Homo sapiens
uagcacccccagccaucuacugg

SEQ ID NO: 404216 - RNA, 14 nt, Homo sapiens
uagcacucacaugc

SEQ ID NO: 404217 - RNA, 18 nt, Homo sapiens
uagcacuuuauaagccaa

SEQ ID NO: 404218 - RNA, 20 nt, Homo sapiens
uagcagccuguacuagcuuu

SEQ ID NO: 404219 - RNA, 17 nt, Homo sapiens
uagcauacugaugagac

SEQ ID NO: 404220 - RNA, 15 nt, Homo sapiens
uagcaugcacaaagu

SEQ ID NO: 404221 - RNA, 17 nt, Homo sapiens
uagccagcauuccauau

SEQ ID NO: 404222 - RNA, 23 nt, Homo sapiens
uagccaggguggucuugaucucc

SEQ ID NO: 404223 - RNA, 13 nt, Homo sapiens
uagccauuugccc

SEQ ID NO: 404224 - RNA, 23 nt, Homo sapiens
uagcccucccccucaaccucacc

SEQ ID NO: 404225 - RNA, 21 nt, Homo sapiens
uagcccucuuucucucugugu

SEQ ID NO: 404226 - RNA, 22 nt, Homo sapiens
uagccgggauggucuugaucuc

SEQ ID NO: 404227 - RNA, 13 nt, Homo sapiens
uagccuugcugua

SEQ ID NO: 404228 - RNA, 15 nt, Homo sapiens
uagcgauccauguaa

SEQ ID NO: 404229 - RNA, 18 nt, Homo sapiens
uagcguuuccgugagcuc

SEQ ID NO: 404230 - RNA, 17 nt, Homo sapiens
uagcuagccagcugugu

SEQ ID NO: 404231 - RNA, 17 nt, Homo sapiens
uagcuauauccauguac

SEQ ID NO: 404232 - RNA, 23 nt, Homo sapiens
uagcuauauccauguacuguagu

SEQ ID NO: 404233 - RNA, 21 nt, Homo sapiens
uagcuccuuggagcaggcaaa

SEQ ID NO: 404234 - RNA, 18 nt, Homo sapiens
uagcugggacuacagggg

SEQ ID NO: 404235 - RNA, 14 nt, Homo sapiens
uagcuuaacuaauu

SEQ ID NO: 404236 - RNA, 13 nt, Homo sapiens
uagcuuagcuguc

SEQ ID NO: 404237 - RNA, 18 nt, Homo sapiens
uagcuuagcugucucaga

SEQ ID NO: 404238 - RNA, 16 nt, Homo sapiens
uagcuugaaacauaga

SEQ ID NO: 404239 - RNA, 15 nt, Homo sapiens
uagcuugauugcuca

SEQ ID NO: 404240 - RNA, 19 nt, Homo sapiens
uagcuugauugcucagaga

SEQ ID NO: 404241 - RNA, 20 nt, Homo sapiens
uagcuuguauaguguaaaau

SEQ ID NO: 404242 - RNA, 22 nt, Homo sapiens
uagcuuuccacauuugucacag

SEQ ID NO: 404243 - RNA, 19 nt, Homo sapiens
uagcuuuuuaccguucacu

SEQ ID NO: 404244 - RNA, 14 nt, Homo sapiens
uaggaaaaauccau

SEQ ID NO: 404245 - RNA, 16 nt, Homo sapiens
uaggaaaagcuguucc

SEQ ID NO: 404246 - RNA, 16 nt, Homo sapiens
uaggaaauugcucaua

SEQ ID NO: 404247 - RNA, 14 nt, Homo sapiens
uaggaacccggcau

SEQ ID NO: 404248 - RNA, 23 nt, Homo sapiens
uaggaacucuucaugagcacuuu

SEQ ID NO: 404249 - RNA, 23 nt, Homo sapiens
uaggaauaagcucuaguucuuaa

SEQ ID NO: 404250 - RNA, 13 nt, Homo sapiens
uaggaaucccaga

SEQ ID NO: 404251 - RNA, 20 nt, Homo sapiens
cuucauaagauauucuuuac

SEQ ID NO: 404252 - RNA, 13 nt, Homo sapiens
cuucauaggcaga

SEQ ID NO: 404253 - RNA, 13 nt, Homo sapiens
cuucauccacuga

SEQ ID NO: 404254 - RNA, 22 nt, Homo sapiens
cuucauccauagacacaguauu

SEQ ID NO: 404255 - RNA, 21 nt, Homo sapiens
cuucauccucugagugugacc

SEQ ID NO: 404256 - RNA, 16 nt, Homo sapiens
cuucauucuaaaccaa

SEQ ID NO: 404257 - RNA, 19 nt, Homo sapiens
cuucauuucauccuguugg

SEQ ID NO: 404258 - RNA, 19 nt, Homo sapiens
cuucauuucaucuaccauu

SEQ ID NO: 404259 - RNA, 18 nt, Homo sapiens
cuucauuugaugcuaaau

SEQ ID NO: 404260 - RNA, 22 nt, Homo sapiens
cuuccaaagugcugggauuaca

SEQ ID NO: 404261 - RNA, 21 nt, Homo sapiens
cuuccaaauuugaauggauua

SEQ ID NO: 404262 - RNA, 14 nt, Homo sapiens
cuuccaacuauguc

SEQ ID NO: 404263 - RNA, 21 nt, Homo sapiens
cuuccaacugcugccccaaag

SEQ ID NO: 404264 - RNA, 16 nt, Homo sapiens
cuuccaccaugugcau

SEQ ID NO: 404265 - RNA, 21 nt, Homo sapiens
cuuccacgcugucuccagacc

SEQ ID NO: 404266 - RNA, 13 nt, Homo sapiens
cuuccacugccuc

SEQ ID NO: 404267 - RNA, 16 nt, Homo sapiens
cuuccacuucaggguu

SEQ ID NO: 404268 - RNA, 17 nt, Homo sapiens
cuuccacuucaggguuc

SEQ ID NO: 404269 - RNA, 13 nt, Homo sapiens
cuuccacuuugag

SEQ ID NO: 404270 - RNA, 22 nt, Homo sapiens
cuuccagagccuaagaaaauca

SEQ ID NO: 404271 - RNA, 15 nt, Homo sapiens
cuuccagguacugau

SEQ ID NO: 404272 - RNA, 16 nt, Homo sapiens
cuuccagguaugggac

SEQ ID NO: 404273 - RNA, 16 nt, Homo sapiens
cuuccauaauguauaa

SEQ ID NO: 404274 - RNA, 21 nt, Homo sapiens
cuuccauaauuaugacaguua

SEQ ID NO: 404275 - RNA, 22 nt, Homo sapiens
cuuccauagcuucauccacuga

SEQ ID NO: 404276 - RNA, 21 nt, Homo sapiens
cuuccauaggacauacugcau

SEQ ID NO: 404277 - RNA, 20 nt, Homo sapiens
cuuccaucagcucucugcaa

SEQ ID NO: 404278 - RNA, 12 nt, Homo sapiens
cuuccaugagaa

SEQ ID NO: 404279 - RNA, 11 nt, Homo sapiens
cuuccauuugc

SEQ ID NO: 404280 - RNA, 14 nt, Homo sapiens
cuucccaacuuccc

SEQ ID NO: 404281 - RNA, 21 nt, Homo sapiens
cuucccaagcagcugggauua

SEQ ID NO: 404282 - RNA, 15 nt, Homo sapiens
cuucccauuucucua

SEQ ID NO: 404283 - RNA, 18 nt, Homo sapiens
cuucccauuucucuacac

SEQ ID NO: 404284 - RNA, 15 nt, Homo sapiens
cuuccccccaaaacu

SEQ ID NO: 404285 - RNA, 13 nt, Homo sapiens
cuucccuaccuca

SEQ ID NO: 404286 - RNA, 16 nt, Homo sapiens
cuucccucauguucuc

SEQ ID NO: 404287 - RNA, 16 nt, Homo sapiens
cuucccucccuaucua

SEQ ID NO: 404288 - RNA, 12 nt, Homo sapiens
cuucccuuccac

SEQ ID NO: 404289 - RNA, 22 nt, Homo sapiens
cuucccuucucucucucucaaa

SEQ ID NO: 404290 - RNA, 20 nt, Homo sapiens
cuuccgaguagcugggauua

SEQ ID NO: 404291 - RNA, 20 nt, Homo sapiens
cuuccuaauaugcuuuacaa

SEQ ID NO: 404292 - RNA, 17 nt, Homo sapiens
cuuccuacccucucuaa

SEQ ID NO: 404293 - RNA, 20 nt, Homo sapiens
cuuccucgugccguccuccc

SEQ ID NO: 404294 - RNA, 13 nt, Homo sapiens
cuuccucugguaa

SEQ ID NO: 404295 - RNA, 14 nt, Homo sapiens
cuuccucuuaccug

SEQ ID NO: 404296 - RNA, 15 nt, Homo sapiens
cuuccugagcuuucu

SEQ ID NO: 404297 - RNA, 17 nt, Homo sapiens
cuuccugaguggugcca

SEQ ID NO: 404298 - RNA, 22 nt, Homo sapiens
cuuccuggacuggcccuugccc

SEQ ID NO: 404299 - RNA, 22 nt, Homo sapiens
cuuccuuuuuucuuucuuuacu

SEQ ID NO: 404300 - RNA, 20 nt, Homo sapiens
cuucgauagcaagucccauc

SEQ ID NO: 404301 - RNA, 21 nt, Homo sapiens
cuucgcgcuggaauccagaag

SEQ ID NO: 404302 - RNA, 15 nt, Homo sapiens
cuucguacaguucuu

SEQ ID NO: 404303 - RNA, 22 nt, Homo sapiens
cuucgugugcagcuagagcuuu

SEQ ID NO: 404304 - RNA, 15 nt, Homo sapiens
cuucuagaaagcccc

SEQ ID NO: 404305 - RNA, 23 nt, Homo sapiens
cuucuagaguaauuaucugugau

SEQ ID NO: 404306 - RNA, 16 nt, Homo sapiens
cuucuauccugcaauu

SEQ ID NO: 404307 - RNA, 17 nt, Homo sapiens
cuucucaagcacugaca

SEQ ID NO: 404308 - RNA, 19 nt, Homo sapiens
cuucucaagcacugacacu

SEQ ID NO: 404309 - RNA, 11 nt, Homo sapiens
cuucucagaaa

SEQ ID NO: 404310 - RNA, 17 nt, Homo sapiens
cuucuccccuccaagug

SEQ ID NO: 404311 - RNA, 17 nt, Homo sapiens
cuucuccccuccagacc

SEQ ID NO: 404312 - RNA, 21 nt, Homo sapiens
cuucuccccugcacuguaaaa

SEQ ID NO: 404313 - RNA, 20 nt, Homo sapiens
cuucuccucucugggccuuu

SEQ ID NO: 404314 - RNA, 12 nt, Homo sapiens
cuucuccugacc

SEQ ID NO: 404315 - RNA, 18 nt, Homo sapiens
cuucucgugacaccacca

SEQ ID NO: 404316 - RNA, 19 nt, Homo sapiens
cuucucgugacaccaccaa

SEQ ID NO: 404317 - RNA, 16 nt, Homo sapiens
cuucucguuaaggaga

SEQ ID NO: 404318 - RNA, 10 nt, Homo sapiens
cuucucucac

SEQ ID NO: 404319 - RNA, 13 nt, Homo sapiens
cuucucucuucaa

SEQ ID NO: 404320 - RNA, 18 nt, Homo sapiens
cuucucugggcccagaga

SEQ ID NO: 404321 - RNA, 19 nt, Homo sapiens
cuucucuuauucuuuacaa

SEQ ID NO: 404322 - RNA, 16 nt, Homo sapiens
cuucucuugagucaca

SEQ ID NO: 404323 - RNA, 22 nt, Homo sapiens
cuucucuugggaacuccacucu

SEQ ID NO: 404324 - RNA, 17 nt, Homo sapiens
cuucugaaaaaguaucc

SEQ ID NO: 404325 - RNA, 19 nt, Homo sapiens
cuucugaagaucucagaua

SEQ ID NO: 404326 - RNA, 18 nt, Homo sapiens
uauaauuuuaaaauugca

SEQ ID NO: 404327 - RNA, 20 nt, Homo sapiens
uauaauuuuauugcuggaau

SEQ ID NO: 404328 - RNA, 13 nt, Homo sapiens
uauacaaacaggu

SEQ ID NO: 404329 - RNA, 14 nt, Homo sapiens
uauacaaacaggug

SEQ ID NO: 404330 - RNA, 16 nt, Homo sapiens
uauacacacaaaaagg

SEQ ID NO: 404331 - RNA, 14 nt, Homo sapiens
uauacaguacacag

SEQ ID NO: 404332 - RNA, 21 nt, Homo sapiens
uauacauucuuuaucuugaca

SEQ ID NO: 404333 - RNA, 16 nt, Homo sapiens
uauaccagguuaccuc

SEQ ID NO: 404334 - RNA, 17 nt, Homo sapiens
uauacuguacugagaca

SEQ ID NO: 404335 - RNA, 16 nt, Homo sapiens
uauacuguuauuucac

SEQ ID NO: 404336 - RNA, 16 nt, Homo sapiens
uauacuugaauauuau

SEQ ID NO: 404337 - RNA, 11 nt, Homo sapiens
uauacuuucag

SEQ ID NO: 404338 - RNA, 17 nt, Homo sapiens
uauagaccccaagcauu

SEQ ID NO: 404339 - RNA, 16 nt, Homo sapiens
uauagaguagaagauu

SEQ ID NO: 404340 - RNA, 17 nt, Homo sapiens
uauagcuuccagauuac

SEQ ID NO: 404341 - RNA, 16 nt, Homo sapiens
uauaggccaucuguaa

SEQ ID NO: 404342 - RNA, 15 nt, Homo sapiens
uauaggucacuccug

SEQ ID NO: 404343 - RNA, 13 nt, Homo sapiens
uauagguguuugc

SEQ ID NO: 404344 - RNA, 17 nt, Homo sapiens
uauaguaugaaugcagu

SEQ ID NO: 404345 - RNA, 21 nt, Homo sapiens
uauaguggccaaauagcacau

SEQ ID NO: 404346 - RNA, 23 nt, Homo sapiens
uauaguuucaagccaacugugga

SEQ ID NO: 404347 - RNA, 20 nt, Homo sapiens
uauauaaaauauauauugca

SEQ ID NO: 404348 - RNA, 13 nt, Homo sapiens
uauauaagccaaa

SEQ ID NO: 404349 - RNA, 13 nt, Homo sapiens
uauauaagcuguu

SEQ ID NO: 404350 - RNA, 18 nt, Homo sapiens
uauauaauuuuauugcug

SEQ ID NO: 404351 - RNA, 13 nt, Homo sapiens
uauauacauucuu

SEQ ID NO: 404352 - RNA, 23 nt, Homo sapiens
uauauagcucuacacaacaugua

SEQ ID NO: 404353 - RNA, 13 nt, Homo sapiens
uauauaguagcau

SEQ ID NO: 404354 - RNA, 19 nt, Homo sapiens
uauauauaguagcauuuca

SEQ ID NO: 404355 - RNA, 14 nt, Homo sapiens
uauauaucaaggau

SEQ ID NO: 404356 - RNA, 20 nt, Homo sapiens
uauauauuucuuuguuauca

SEQ ID NO: 404357 - RNA, 22 nt, Homo sapiens
uauauauuugaaagaagucaaa

SEQ ID NO: 404358 - RNA, 19 nt, Homo sapiens
uauaucagcagacacucca

SEQ ID NO: 404359 - RNA, 12 nt, Homo sapiens
uauauccaugua

SEQ ID NO: 404360 - RNA, 15 nt, Homo sapiens
uauauccauguacug

SEQ ID NO: 404361 - RNA, 12 nt, Homo sapiens
uauaucuauuac

SEQ ID NO: 404362 - RNA, 16 nt, Homo sapiens
uauaugaaaacuaagu

SEQ ID NO: 404363 - RNA, 19 nt, Homo sapiens
uauauguauaucuuugcac

SEQ ID NO: 404364 - RNA, 16 nt, Homo sapiens
uauauguuuauauacu

SEQ ID NO: 404365 - RNA, 18 nt, Homo sapiens
uauauuuuuauaagacua

SEQ ID NO: 404366 - RNA, 19 nt, Homo sapiens
uaucaaaauguuguccuuu

SEQ ID NO: 404367 - RNA, 19 nt, Homo sapiens
uaucaaacuagugcaugaa

SEQ ID NO: 404368 - RNA, 16 nt, Homo sapiens
uaucacaauguacuau

SEQ ID NO: 404369 - RNA, 19 nt, Homo sapiens
uaucaccucuuaugcacac

SEQ ID NO: 404370 - RNA, 16 nt, Homo sapiens
uaucagagcucuuaau

SEQ ID NO: 404371 - RNA, 23 nt, Homo sapiens
uaucagcagacacuccaguuugc

SEQ ID NO: 404372 - RNA, 22 nt, Homo sapiens
uaucagugaauauaaauguacu

SEQ ID NO: 404373 - RNA, 18 nt, Homo sapiens
uaucagugcucugcuuuu

SEQ ID NO: 404374 - RNA, 21 nt, Homo sapiens
uaucaguugagcuucauauac

SEQ ID NO: 404375 - RNA, 18 nt, Homo sapiens
uaucauaauguaaugagg

SEQ ID NO: 404376 - RNA, 19 nt, Homo sapiens
uaucauucuuuguaucuua

SEQ ID NO: 404377 - RNA, 15 nt, Homo sapiens
uauccaaagacugua

SEQ ID NO: 404378 - RNA, 16 nt, Homo sapiens
uauccaaagacuguac

SEQ ID NO: 404379 - RNA, 17 nt, Homo sapiens
uauccaaagcauugcag

SEQ ID NO: 404380 - RNA, 17 nt, Homo sapiens
uauccacaacuuuucaa

SEQ ID NO: 404381 - RNA, 15 nt, Homo sapiens
uauccacuggcauuu

SEQ ID NO: 404382 - RNA, 14 nt, Homo sapiens
uauccagucaaaga

SEQ ID NO: 404383 - RNA, 16 nt, Homo sapiens
uauccauaaccucuau

SEQ ID NO: 404384 - RNA, 19 nt, Homo sapiens
uaucccacggaaaaugcca

SEQ ID NO: 404385 - RNA, 15 nt, Homo sapiens
uauccuauacugguu

SEQ ID NO: 404386 - RNA, 15 nt, Homo sapiens
cuugcccugagcuuu

SEQ ID NO: 404387 - RNA, 15 nt, Homo sapiens
cuugcgugcugggac

SEQ ID NO: 404388 - RNA, 15 nt, Homo sapiens
cuugcuaaguuuuca

SEQ ID NO: 404389 - RNA, 16 nt, Homo sapiens
cuugcuaccugugagc

SEQ ID NO: 404390 - RNA, 15 nt, Homo sapiens
cuugcucacucccua

SEQ ID NO: 404391 - RNA, 20 nt, Homo sapiens
cuugcucugagugcuagcua

SEQ ID NO: 404392 - RNA, 19 nt, Homo sapiens
cuugcugccccacaacaca

SEQ ID NO: 404393 - RNA, 15 nt, Homo sapiens
cuugcugugaaauga

SEQ ID NO: 404394 - RNA, 21 nt, Homo sapiens
cuugcuuccccuuuugccaau

SEQ ID NO: 404395 - RNA, 17 nt, Homo sapiens
cuuggaaagcugaugau

SEQ ID NO: 404396 - RNA, 14 nt, Homo sapiens
cuuggaacauggaa

SEQ ID NO: 404397 - RNA, 18 nt, Homo sapiens
cuuggaaugaauucucuc

SEQ ID NO: 404398 - RNA, 21 nt, Homo sapiens
cuuggaauuggaauuacugua

SEQ ID NO: 404399 - RNA, 21 nt, Homo sapiens
cuuggacuguguuuuuccucc

SEQ ID NO: 404400 - RNA, 13 nt, Homo sapiens
cuuggacuugagg

SEQ ID NO: 404401 - RNA, 15 nt, Homo sapiens
cuuggagcaggcaaa

SEQ ID NO: 404402 - RNA, 17 nt, Homo sapiens
cuuggagcccgugcagu

SEQ ID NO: 404403 - RNA, 18 nt, Homo sapiens
cuuggagcccgugcagua

SEQ ID NO: 404404 - RNA, 18 nt, Homo sapiens
cuuggcacacugccagug

SEQ ID NO: 404405 - RNA, 13 nt, Homo sapiens
cuuggcacauccg

SEQ ID NO: 404406 - RNA, 13 nt, Homo sapiens
cuuggcaccaaag

SEQ ID NO: 404407 - RNA, 20 nt, Homo sapiens
cuuggcacuguuagugacag

SEQ ID NO: 404408 - RNA, 12 nt, Homo sapiens
cuuggccagaag

SEQ ID NO: 404409 - RNA, 21 nt, Homo sapiens
cuuggccagaagggggccaug

SEQ ID NO: 404410 - RNA, 22 nt, Homo sapiens
cuuggccucccaaagugcuagu

SEQ ID NO: 404411 - RNA, 16 nt, Homo sapiens
cuuggccuuggggcca

SEQ ID NO: 404412 - RNA, 19 nt, Homo sapiens
cuuggcuagucacauauca

SEQ ID NO: 404413 - RNA, 22 nt, Homo sapiens
cuuggcuuacugcagccuuugc

SEQ ID NO: 404414 - RNA, 18 nt, Homo sapiens
cuugggaggaagcccagu

SEQ ID NO: 404415 - RNA, 17 nt, Homo sapiens
cuugggagggugccauc

SEQ ID NO: 404416 - RNA, 15 nt, Homo sapiens
cuugggauugucuua

SEQ ID NO: 404417 - RNA, 16 nt, Homo sapiens
cuugggcuccauuccc

SEQ ID NO: 404418 - RNA, 19 nt, Homo sapiens
cuuggggccagacuggcug

SEQ ID NO: 404419 - RNA, 11 nt, Homo sapiens
cuuggggccau

SEQ ID NO: 404420 - RNA, 15 nt, Homo sapiens
cuugggggucagggg

SEQ ID NO: 404421 - RNA, 21 nt, Homo sapiens
cuugggguacucuugauguga

SEQ ID NO: 404422 - RNA, 21 nt, Homo sapiens
cuuggugcaaggccaucugcu

SEQ ID NO: 404423 - RNA, 19 nt, Homo sapiens
cuuggugcgguaggugcug

SEQ ID NO: 404424 - RNA, 18 nt, Homo sapiens
cuuggugcuaaaccacaa

SEQ ID NO: 404425 - RNA, 22 nt, Homo sapiens
cuugguggccgggggugggggc

SEQ ID NO: 404426 - RNA, 19 nt, Homo sapiens
cuugguguuguuauggcaa

SEQ ID NO: 404427 - RNA, 20 nt, Homo sapiens
cuugguguuucuuuuuccac

SEQ ID NO: 404428 - RNA, 21 nt, Homo sapiens
cuugguucaucaguguuaaaa

SEQ ID NO: 404429 - RNA, 15 nt, Homo sapiens
cuuguaaaacuguga

SEQ ID NO: 404430 - RNA, 23 nt, Homo sapiens
cuuguaaaccaucgcgugcaaug

SEQ ID NO: 404431 - RNA, 23 nt, Homo sapiens
cuuguaacaagaaaacauaagag

SEQ ID NO: 404432 - RNA, 22 nt, Homo sapiens
cuuguacagugucugugccaug

SEQ ID NO: 404433 - RNA, 19 nt, Homo sapiens
cuugucauggaaaaugucc

SEQ ID NO: 404434 - RNA, 17 nt, Homo sapiens
cuugucauguguauaaa

SEQ ID NO: 404435 - RNA, 22 nt, Homo sapiens
cuugucauuccaggugccagaa

SEQ ID NO: 404436 - RNA, 21 nt, Homo sapiens
cuuguccccgggguauuagca

SEQ ID NO: 404437 - RNA, 20 nt, Homo sapiens
cuugucccucucacucccca

SEQ ID NO: 404438 - RNA, 16 nt, Homo sapiens
cuugucccuuucccua

SEQ ID NO: 404439 - RNA, 16 nt, Homo sapiens
cuuguccugaugcugu

SEQ ID NO: 404440 - RNA, 22 nt, Homo sapiens
cuugucgggagauugaaccacu

SEQ ID NO: 404441 - RNA, 20 nt, Homo sapiens
cuugucugagaacaaauaca

SEQ ID NO: 404442 - RNA, 17 nt, Homo sapiens
cuugugaaguggaaaug

SEQ ID NO: 404443 - RNA, 17 nt, Homo sapiens
cuugugacauucacuca

SEQ ID NO: 404444 - RNA, 17 nt, Homo sapiens
cuugugagggacugaga

SEQ ID NO: 404445 - RNA, 16 nt, Homo sapiens
cuuguggauaagggag

SEQ ID NO: 404446 - RNA, 15 nt, Homo sapiens
cuuguggcacuccaa

SEQ ID NO: 404447 - RNA, 19 nt, Homo sapiens
cuugugugugggcugugag

SEQ ID NO: 404448 - RNA, 13 nt, Homo sapiens
cuuguuagauuca

SEQ ID NO: 404449 - RNA, 16 nt, Homo sapiens
cuuguucacacuuugc

SEQ ID NO: 404450 - RNA, 14 nt, Homo sapiens
cuuguugcugcauc

SEQ ID NO: 404451 - RNA, 14 nt, Homo sapiens
cuuguuuacagcac

SEQ ID NO: 404452 - RNA, 22 nt, Homo sapiens
cuuguuucccugcuggccaaag

SEQ ID NO: 404453 - RNA, 20 nt, Homo sapiens
cuuguuuuauauaccuggcu

SEQ ID NO: 404454 - RNA, 20 nt, Homo sapiens
cuuguuuucuacuuugccac

SEQ ID NO: 404455 - RNA, 16 nt, Homo sapiens
cuuuaaaggcaucuac

SEQ ID NO: 404456 - RNA, 22 nt, Homo sapiens
cuuuugggccuccuucccaugc

SEQ ID NO: 404457 - RNA, 15 nt, Homo sapiens
cuuuugguaugugac

SEQ ID NO: 404458 - RNA, 23 nt, Homo sapiens
cuuuuguaaauauucuuguccac

SEQ ID NO: 404459 - RNA, 13 nt, Homo sapiens
cuuuuguaucuua

SEQ ID NO: 404460 - RNA, 15 nt, Homo sapiens
cuuuugugucccuga

SEQ ID NO: 404461 - RNA, 18 nt, Homo sapiens
cuuuuuaaccugcaaaau

SEQ ID NO: 404462 - RNA, 20 nt, Homo sapiens
cuuuuuaauauugauaugcu

SEQ ID NO: 404463 - RNA, 13 nt, Homo sapiens
cuuuuucauucuu

SEQ ID NO: 404464 - RNA, 13 nt, Homo sapiens
cuuuuucuacuau

SEQ ID NO: 404465 - RNA, 16 nt, Homo sapiens
cuuuuugugugcaggc

SEQ ID NO: 404466 - RNA, 16 nt, Homo sapiens
cuuuuuucuaguuuca

SEQ ID NO: 404467 - RNA, 13 nt, Homo sapiens
cuuuuuucucuga

SEQ ID NO: 404468 - RNA, 16 nt, Homo sapiens
cuuuuuuuuguagcca

SEQ ID NO: 404469 - RNA, 23 nt, Homo sapiens
cuuuuuuuuucaccugaaacacu

SEQ ID NO: 404470 - RNA, 23 nt, Homo sapiens
cuuuuuuuuuuuuuaaagacaga

SEQ ID NO: 404471 - RNA, 23 nt, Homo sapiens
cuuuuuuuuuuuuuucaguuuuu

SEQ ID NO: 404472 - RNA, 17 nt, Homo sapiens
gaaaaaaaaauguucau

SEQ ID NO: 404473 - RNA, 17 nt, Homo sapiens
gaaaaacagaacauuuc

SEQ ID NO: 404474 - RNA, 17 nt, Homo sapiens
gaaaaauaugugcuuga

SEQ ID NO: 404475 - RNA, 16 nt, Homo sapiens
gaaaacagacccuccc

SEQ ID NO: 404476 - RNA, 16 nt, Homo sapiens
gaaaacaucugcacaa

SEQ ID NO: 404477 - RNA, 18 nt, Homo sapiens
gaaaacauuccagaugca

SEQ ID NO: 404478 - RNA, 16 nt, Homo sapiens
gaaaaccaacaccauc

SEQ ID NO: 404479 - RNA, 23 nt, Homo sapiens
gaaaaccaacaccaucacagcuu

SEQ ID NO: 404480 - RNA, 23 nt, Homo sapiens
gaaaacccaacuccucuccuccc

SEQ ID NO: 404481 - RNA, 23 nt, Homo sapiens
gaaaacgauuuaauuuauucuaa

SEQ ID NO: 404482 - RNA, 14 nt, Homo sapiens
gaaaacuuaguuug

SEQ ID NO: 404483 - RNA, 17 nt, Homo sapiens
gaaaagauuuaagcaca

SEQ ID NO: 404484 - RNA, 12 nt, Homo sapiens
gaaaagccagau

SEQ ID NO: 404485 - RNA, 15 nt, Homo sapiens
gaaaagccagaugac

SEQ ID NO: 404486 - RNA, 14 nt, Homo sapiens
gaaaagcugccauu

SEQ ID NO: 404487 - RNA, 18 nt, Homo sapiens
gaaaagcugccauuuccc

SEQ ID NO: 404488 - RNA, 16 nt, Homo sapiens
gaaaaggcacgcuggc

SEQ ID NO: 404489 - RNA, 15 nt, Homo sapiens
gaaaagucuuugcua

SEQ ID NO: 404490 - RNA, 20 nt, Homo sapiens
gaaaaguugccgaagaugag

SEQ ID NO: 404491 - RNA, 20 nt, Homo sapiens
gaaaauaguccuccaaaaca

SEQ ID NO: 404492 - RNA, 13 nt, Homo sapiens
gaaaauaugauau

SEQ ID NO: 404493 - RNA, 19 nt, Homo sapiens
gaaaauaugauauauaugu

SEQ ID NO: 404494 - RNA, 16 nt, Homo sapiens
gaaaaucaccauuccg

SEQ ID NO: 404495 - RNA, 18 nt, Homo sapiens
gaaaauccuaacuuucag

SEQ ID NO: 404496 - RNA, 13 nt, Homo sapiens
gaaaaugugaagc

SEQ ID NO: 404497 - RNA, 15 nt, Homo sapiens
gaaaauuacaacaga

SEQ ID NO: 404498 - RNA, 20 nt, Homo sapiens
gaaaauucaaaaaguguuua

SEQ ID NO: 404499 - RNA, 18 nt, Homo sapiens
gaaacacacaggccauuu

SEQ ID NO: 404500 - RNA, 13 nt, Homo sapiens
gaaacaccacuua

SEQ ID NO: 404501 - RNA, 21 nt, Homo sapiens
gaaacaccacuuaaucuucuc

SEQ ID NO: 404502 - RNA, 19 nt, Homo sapiens
gaaacaggggcagaguaau

SEQ ID NO: 404503 - RNA, 22 nt, Homo sapiens
gaaacaguacagcuauuucuca

SEQ ID NO: 404504 - RNA, 17 nt, Homo sapiens
gaaacauauguucuccc

SEQ ID NO: 404505 - RNA, 16 nt, Homo sapiens
gaaacaugaugugaga

SEQ ID NO: 404506 - RNA, 15 nt, Homo sapiens
gaaacauugcaugua

SEQ ID NO: 404507 - RNA, 14 nt, Homo sapiens
gaaaccccgucucu

SEQ ID NO: 404508 - RNA, 22 nt, Homo sapiens
gaaacccuguuuuauugaguuc

SEQ ID NO: 404509 - RNA, 19 nt, Homo sapiens
gaaaccuaaggcaacauuu

SEQ ID NO: 404510 - RNA, 18 nt, Homo sapiens
gaaaccuguuaugccaaa

SEQ ID NO: 404511 - RNA, 14 nt, Homo sapiens
gaaaccuuccucuu

SEQ ID NO: 404512 - RNA, 17 nt, Homo sapiens
gaaacucagauguccaa

SEQ ID NO: 404513 - RNA, 21 nt, Homo sapiens
gaaacucuuuggaacaacagc

SEQ ID NO: 404514 - RNA, 19 nt, Homo sapiens
gaaacugacuugcugugac

SEQ ID NO: 404515 - RNA, 13 nt, Homo sapiens
gaaacugcacugu

SEQ ID NO: 404516 - RNA, 16 nt, Homo sapiens
gaaacuugcuuaucaa

SEQ ID NO: 404517 - RNA, 13 nt, Homo sapiens
gaaagaaagggaa

SEQ ID NO: 404518 - RNA, 13 nt, Homo sapiens
gaaagaaccagag

SEQ ID NO: 404519 - RNA, 13 nt, Homo sapiens
gaaagacauuuca

SEQ ID NO: 404520 - RNA, 18 nt, Homo sapiens
gaaagaccgugugugaaa

SEQ ID NO: 404521 - RNA, 23 nt, Homo sapiens
gaaagagcuggcaaacugugaau

SEQ ID NO: 404522 - RNA, 19 nt, Homo sapiens
uauuugcauguuaccuccu

SEQ ID NO: 404523 - RNA, 16 nt, Homo sapiens
uauuugcuuuuugcua

SEQ ID NO: 404524 - RNA, 19 nt, Homo sapiens
uauuuguguucaguuccag

SEQ ID NO: 404525 - RNA, 18 nt, Homo sapiens
uauuuuaacaaugugccc

SEQ ID NO: 404526 - RNA, 13 nt, Homo sapiens
uauuuuaagcacu

SEQ ID NO: 404527 - RNA, 22 nt, Homo sapiens
uauuuuauacugcacuuuagug

SEQ ID NO: 404528 - RNA, 18 nt, Homo sapiens
uauuuuaugaucuuggcu

SEQ ID NO: 404529 - RNA, 15 nt, Homo sapiens
uauuuucaguauacu

SEQ ID NO: 404530 - RNA, 16 nt, Homo sapiens
uauuuucaguauacug

SEQ ID NO: 404531 - RNA, 19 nt, Homo sapiens
uauuuuccccuagcuuucc

SEQ ID NO: 404532 - RNA, 12 nt, Homo sapiens
uauuuugagauu

SEQ ID NO: 404533 - RNA, 16 nt, Homo sapiens
uauuuuggacguguga

SEQ ID NO: 404534 - RNA, 17 nt, Homo sapiens
uauuuuuuaaguauuua

SEQ ID NO: 404535 - RNA, 21 nt, Homo sapiens
ucaaaaaaauccuagagauuc

SEQ ID NO: 404536 - RNA, 14 nt, Homo sapiens
ucaaaaaguacaau

SEQ ID NO: 404537 - RNA, 13 nt, Homo sapiens
ucaaaaaugccac

SEQ ID NO: 404538 - RNA, 17 nt, Homo sapiens
ucaaaacaauuggcaaa

SEQ ID NO: 404539 - RNA, 13 nt, Homo sapiens
ucaaaacuuucag

SEQ ID NO: 404540 - RNA, 21 nt, Homo sapiens
ucaaaagaaggguaagugcuu

SEQ ID NO: 404541 - RNA, 13 nt, Homo sapiens
ucaaaagaucaaa

SEQ ID NO: 404542 - RNA, 18 nt, Homo sapiens
ucaaaaggagaacugugc

SEQ ID NO: 404543 - RNA, 12 nt, Homo sapiens
ucaaaauacuuc

SEQ ID NO: 404544 - RNA, 18 nt, Homo sapiens
ucaaaauccuuccaaaga

SEQ ID NO: 404545 - RNA, 24 nt, Homo sapiens
ucaaaauuccauuuacuugaucau

SEQ ID NO: 404546 - RNA, 20 nt, Homo sapiens
ucaaacagggacacuacaaa

SEQ ID NO: 404547 - RNA, 22 nt, Homo sapiens
ucaaaccccuacugaccuggcu

SEQ ID NO: 404548 - RNA, 12 nt, Homo sapiens
ucaaaccuacca

SEQ ID NO: 404549 - RNA, 23 nt, Homo sapiens
ucaaacuuccauagcuucaucca

SEQ ID NO: 404550 - RNA, 17 nt, Homo sapiens
ucaaacuuucaccucag

SEQ ID NO: 404551 - RNA, 15 nt, Homo sapiens
ucaaagacacacagg

SEQ ID NO: 404552 - RNA, 17 nt, Homo sapiens
ucaaagauguacugaga

SEQ ID NO: 404553 - RNA, 18 nt, Homo sapiens
ucaaagcacuuggacucu

SEQ ID NO: 404554 - RNA, 15 nt, Homo sapiens
ucaaagggacugccg

SEQ ID NO: 404555 - RNA, 21 nt, Homo sapiens
ucaaaguagguauacaaaaga

SEQ ID NO: 404556 - RNA, 21 nt, Homo sapiens
ucaaaguuuggauuguaucaa

SEQ ID NO: 404557 - RNA, 20 nt, Homo sapiens
ucaaauagaaccacuaugaa

SEQ ID NO: 404558 - RNA, 14 nt, Homo sapiens
ucaaauccuuccaa

SEQ ID NO: 404559 - RNA, 12 nt, Homo sapiens
ucaaaucuccag

SEQ ID NO: 404560 - RNA, 22 nt, Homo sapiens
ucaaaugauacagucaggacac

SEQ ID NO: 404561 - RNA, 19 nt, Homo sapiens
ucaaaugcccuuccagugg

SEQ ID NO: 404562 - RNA, 20 nt, Homo sapiens
ucaaauuuugcauuguguga

SEQ ID NO: 404563 - RNA, 14 nt, Homo sapiens
ucaacaaaagggag

SEQ ID NO: 404564 - RNA, 22 nt, Homo sapiens
ucaacacccgccccccccaugu

SEQ ID NO: 404565 - RNA, 18 nt, Homo sapiens
ucaaccaggaacauguaa

SEQ ID NO: 404566 - RNA, 16 nt, Homo sapiens
ucaaccauaacacuug

SEQ ID NO: 404567 - RNA, 20 nt, Homo sapiens
ucaaccugcacuucauaucu

SEQ ID NO: 404568 - RNA, 23 nt, Homo sapiens
ucaacucuucagccucauucacu

SEQ ID NO: 404569 - RNA, 10 nt, Homo sapiens
ucaacugagu

SEQ ID NO: 404570 - RNA, 16 nt, Homo sapiens
ucaacugaguucagga

SEQ ID NO: 404571 - RNA, 18 nt, Homo sapiens
ucaacugaguucaggagu

SEQ ID NO: 404572 - RNA, 18 nt, Homo sapiens
ucaacugucuccuaccuc

SEQ ID NO: 404573 - RNA, 20 nt, Homo sapiens
ucaacuguugauugcaggaa

SEQ ID NO: 404574 - RNA, 14 nt, Homo sapiens
ucaacuucaggaaa

SEQ ID NO: 404575 - RNA, 12 nt, Homo sapiens
ucaacuuugaca

SEQ ID NO: 404576 - RNA, 18 nt, Homo sapiens
ucaagacuuccucaugaa

SEQ ID NO: 404577 - RNA, 14 nt, Homo sapiens
ucaagauacacuug

SEQ ID NO: 404578 - RNA, 13 nt, Homo sapiens
ucaagaugugaca

SEQ ID NO: 404579 - RNA, 22 nt, Homo sapiens
ucaagcacuuuuccugucucag

SEQ ID NO: 404580 - RNA, 13 nt, Homo sapiens
ucaagcagguuuc

SEQ ID NO: 404581 - RNA, 19 nt, Homo sapiens
ucaagccaguacgugcuaa

SEQ ID NO: 404582 - RNA, 20 nt, Homo sapiens
ucaagccccacgaugacugc

SEQ ID NO: 404583 - RNA, 22 nt, Homo sapiens
ucaagcuaauaaaauaucauuc

SEQ ID NO: 404584 - RNA, 20 nt, Homo sapiens
ucaagcuuucaaauccuccc

SEQ ID NO: 404585 - RNA, 21 nt, Homo sapiens
ucaaggcccauaucugugaaa

SEQ ID NO: 404586 - RNA, 21 nt, Homo sapiens
gaauaauuagcuuguuacaau

SEQ ID NO: 404587 - RNA, 21 nt, Homo sapiens
gaauaauuguguacaaaguag

SEQ ID NO: 404588 - RNA, 17 nt, Homo sapiens
gaauagaaaggcuucca

SEQ ID NO: 404589 - RNA, 13 nt, Homo sapiens
gaauaggcauuug

SEQ ID NO: 404590 - RNA, 19 nt, Homo sapiens
gaauagugggaucaaagcu

SEQ ID NO: 404591 - RNA, 18 nt, Homo sapiens
gaauauaacuuuuuccaa

SEQ ID NO: 404592 - RNA, 18 nt, Homo sapiens
gaauauaaggaaagcaau

SEQ ID NO: 404593 - RNA, 14 nt, Homo sapiens
gaauauacauaguc

SEQ ID NO: 404594 - RNA, 14 nt, Homo sapiens
gaauauacauuguc

SEQ ID NO: 404595 - RNA, 23 nt, Homo sapiens
gaauauauggggggagugagcuc

SEQ ID NO: 404596 - RNA, 14 nt, Homo sapiens
gaauaucauaugua

SEQ ID NO: 404597 - RNA, 15 nt, Homo sapiens
gaauaugaauggauu

SEQ ID NO: 404598 - RNA, 21 nt, Homo sapiens
gaauauuaauaaaacuuuaug

SEQ ID NO: 404599 - RNA, 15 nt, Homo sapiens
gaauauuauacuucu

SEQ ID NO: 404600 - RNA, 12 nt, Homo sapiens
gaaucacuggaa

SEQ ID NO: 404601 - RNA, 21 nt, Homo sapiens
gaaucagaauuguagccaguu

SEQ ID NO: 404602 - RNA, 19 nt, Homo sapiens
gaaucagcucaaucuucaa

SEQ ID NO: 404603 - RNA, 19 nt, Homo sapiens
gaaucaguaugaagacacu

SEQ ID NO: 404604 - RNA, 19 nt, Homo sapiens
gaaucauauguuguaggaa

SEQ ID NO: 404605 - RNA, 18 nt, Homo sapiens
gaaucauuaauacaaaga

SEQ ID NO: 404606 - RNA, 20 nt, Homo sapiens
gaaucauugcuuaugacaug

SEQ ID NO: 404607 - RNA, 23 nt, Homo sapiens
gaauccagagagcaguguggaaa

SEQ ID NO: 404608 - RNA, 15 nt, Homo sapiens
gaauccagugcuucc

SEQ ID NO: 404609 - RNA, 19 nt, Homo sapiens
gaaucccauggauguuucu

SEQ ID NO: 404610 - RNA, 19 nt, Homo sapiens
gaaucccuaagccuagcug

SEQ ID NO: 404611 - RNA, 17 nt, Homo sapiens
gaauccucucagaguca

SEQ ID NO: 404612 - RNA, 19 nt, Homo sapiens
gaaucgcuugaaccuggga

SEQ ID NO: 404613 - RNA, 20 nt, Homo sapiens
gaaucugcauuuagcacaaa

SEQ ID NO: 404614 - RNA, 11 nt, Homo sapiens
gaaucuucucu

SEQ ID NO: 404615 - RNA, 13 nt, Homo sapiens
gaaugaagcaugu

SEQ ID NO: 404616 - RNA, 12 nt, Homo sapiens
gaaugcagggaa

SEQ ID NO: 404617 - RNA, 16 nt, Homo sapiens
gaaugcaguggggaca

SEQ ID NO: 404618 - RNA, 16 nt, Homo sapiens
gaaugcggaaccauag

SEQ ID NO: 404619 - RNA, 15 nt, Homo sapiens
gaaugcgguucaggg

SEQ ID NO: 404620 - RNA, 18 nt, Homo sapiens
gaaugcuccauuaaucca

SEQ ID NO: 404621 - RNA, 19 nt, Homo sapiens
gaaugguuaauaaaacugc

SEQ ID NO: 404622 - RNA, 19 nt, Homo sapiens
gaauguaaaacagagccau

SEQ ID NO: 404623 - RNA, 23 nt, Homo sapiens
gaauguaaaacagagccauuccc

SEQ ID NO: 404624 - RNA, 13 nt, Homo sapiens
gaauguacauuac

SEQ ID NO: 404625 - RNA, 11 nt, Homo sapiens
gaaugugauuu

SEQ ID NO: 404626 - RNA, 19 nt, Homo sapiens
gaaugugguccagacguca

SEQ ID NO: 404627 - RNA, 19 nt, Homo sapiens
gaauguguuauuugucaca

SEQ ID NO: 404628 - RNA, 19 nt, Homo sapiens
gaauguuguccugugucau

SEQ ID NO: 404629 - RNA, 17 nt, Homo sapiens
gaauguuuacacucuuu

SEQ ID NO: 404630 - RNA, 21 nt, Homo sapiens
gaauguuuugcuagagcuaac

SEQ ID NO: 404631 - RNA, 14 nt, Homo sapiens
gaauuaaacuaaaa

SEQ ID NO: 404632 - RNA, 19 nt, Homo sapiens
gaauuaaccuggugcugga

SEQ ID NO: 404633 - RNA, 13 nt, Homo sapiens
gaauuacauaaca

SEQ ID NO: 404634 - RNA, 17 nt, Homo sapiens
gaauuacauaacaggca

SEQ ID NO: 404635 - RNA, 19 nt, Homo sapiens
gaauuauaggcgugcacca

SEQ ID NO: 404636 - RNA, 20 nt, Homo sapiens
gaauucauuaugcugugguc

SEQ ID NO: 404637 - RNA, 14 nt, Homo sapiens
gaauucuaagugaa

SEQ ID NO: 404638 - RNA, 19 nt, Homo sapiens
gaauucugaauguacacuu

SEQ ID NO: 404639 - RNA, 22 nt, Homo sapiens
gaauugcuccugcaugcaacua

SEQ ID NO: 404640 - RNA, 21 nt, Homo sapiens
gaauuguuuggcaaugcacug

SEQ ID NO: 404641 - RNA, 20 nt, Homo sapiens
gaauuguuuuuugcucuuuu

SEQ ID NO: 404642 - RNA, 17 nt, Homo sapiens
gaauuuauucaauuccu

SEQ ID NO: 404643 - RNA, 11 nt, Homo sapiens
gaauuuccucu

SEQ ID NO: 404644 - RNA, 15 nt, Homo sapiens
gaauuucuuugucau

SEQ ID NO: 404645 - RNA, 18 nt, Homo sapiens
gaauuuuguuuguugaug

SEQ ID NO: 404646 - RNA, 18 nt, Homo sapiens
gaauuuuugcacauucua

SEQ ID NO: 404647 - RNA, 20 nt, Homo sapiens
gacaaagaaggaaaagagua

SEQ ID NO: 404648 - RNA, 20 nt, Homo sapiens
gacaaagccuuaaaaugcau

SEQ ID NO: 404649 - RNA, 22 nt, Homo sapiens
gacaaagugacauuccugaguc

SEQ ID NO: 404650 - RNA, 20 nt, Homo sapiens
gacaaauaaguuacccucaa

SEQ ID NO: 404651 - RNA, 15 nt, Homo sapiens
gacaaauaguaggcu

SEQ ID NO: 404652 - RNA, 18 nt, Homo sapiens
gacaaaucuuuaagaaua

SEQ ID NO: 404653 - RNA, 23 nt, Homo sapiens
gacaaccaacggccgacugccug

SEQ ID NO: 404654 - RNA, 21 nt, Homo sapiens
gacaagauacauaugaggaca

SEQ ID NO: 404655 - RNA, 14 nt, Homo sapiens
gacaagcacuuugg

SEQ ID NO: 404656 - RNA, 18 nt, Homo sapiens
gacacaacuauuuuucca

SEQ ID NO: 404657 - RNA, 15 nt, Homo sapiens
gacacacacagcuuc

SEQ ID NO: 404658 - RNA, 12 nt, Homo sapiens
gacacacuuguc

SEQ ID NO: 404659 - RNA, 21 nt, Homo sapiens
gacacagcagcuucaccagag

SEQ ID NO: 404660 - RNA, 22 nt, Homo sapiens
gacacagggcauccaacugaga

SEQ ID NO: 404661 - RNA, 22 nt, Homo sapiens
ucauaaugacuuaagcacacuu

SEQ ID NO: 404662 - RNA, 22 nt, Homo sapiens
ucauaauugucaaaaaccagaa

SEQ ID NO: 404663 - RNA, 24 nt, Homo sapiens
ucauacaaaggacaguacacacuu

SEQ ID NO: 404664 - RNA, 12 nt, Homo sapiens
ucauaccacaau

SEQ ID NO: 404665 - RNA, 14 nt, Homo sapiens
ucauaccagucagu

SEQ ID NO: 404666 - RNA, 23 nt, Homo sapiens
ucauacucuguguaaucucugau

SEQ ID NO: 404667 - RNA, 22 nt, Homo sapiens
ucauagaagaaaauccauucau

SEQ ID NO: 404668 - RNA, 20 nt, Homo sapiens
ucauaggaaaaguacauuua

SEQ ID NO: 404669 - RNA, 15 nt, Homo sapiens
ucauagggucucuuc

SEQ ID NO: 404670 - RNA, 13 nt, Homo sapiens
ucauagugccuuu

SEQ ID NO: 404671 - RNA, 20 nt, Homo sapiens
ucauagugccuuuuuccuua

SEQ ID NO: 404672 - RNA, 13 nt, Homo sapiens
ucauauaccagca

SEQ ID NO: 404673 - RNA, 14 nt, Homo sapiens
ucauauaccagcaa

SEQ ID NO: 404674 - RNA, 12 nt, Homo sapiens
ucauauuccugc

SEQ ID NO: 404675 - RNA, 15 nt, Homo sapiens
ucauauugugccaau

SEQ ID NO: 404676 - RNA, 14 nt, Homo sapiens
ucauauuuuguaua

SEQ ID NO: 404677 - RNA, 15 nt, Homo sapiens
ucaucaaaacaaaac

SEQ ID NO: 404678 - RNA, 14 nt, Homo sapiens
ucaucaacaaucac

SEQ ID NO: 404679 - RNA, 20 nt, Homo sapiens
ucaucaauuuaaaaucauuc

SEQ ID NO: 404680 - RNA, 19 nt, Homo sapiens
ucaucacuggaugaagauu

SEQ ID NO: 404681 - RNA, 13 nt, Homo sapiens
ucaucagcccagg

SEQ ID NO: 404682 - RNA, 13 nt, Homo sapiens
ucaucaggaugaa

SEQ ID NO: 404683 - RNA, 14 nt, Homo sapiens
ucaucaggucauua

SEQ ID NO: 404684 - RNA, 13 nt, Homo sapiens
ucaucaucuaccc

SEQ ID NO: 404685 - RNA, 13 nt, Homo sapiens
ucauccaacguga

SEQ ID NO: 404686 - RNA, 23 nt, Homo sapiens
ucauccaugcagauaacagcugg

SEQ ID NO: 404687 - RNA, 19 nt, Homo sapiens
ucauccccaggggucccag

SEQ ID NO: 404688 - RNA, 17 nt, Homo sapiens
ucauccccucguccugu

SEQ ID NO: 404689 - RNA, 21 nt, Homo sapiens
ucauccugcuucucuuuuccu

SEQ ID NO: 404690 - RNA, 17 nt, Homo sapiens
ucaucgcucuacaccug

SEQ ID NO: 404691 - RNA, 16 nt, Homo sapiens
ucaucuacccugcuga

SEQ ID NO: 404692 - RNA, 13 nt, Homo sapiens
ucaucucauucca

SEQ ID NO: 404693 - RNA, 20 nt, Homo sapiens
ucaucuccaucauaugccug

SEQ ID NO: 404694 - RNA, 20 nt, Homo sapiens
ucaucucucacacauuccag

SEQ ID NO: 404695 - RNA, 23 nt, Homo sapiens
ucaucuguagauacuagcuaucu

SEQ ID NO: 404696 - RNA, 12 nt, Homo sapiens
ucaucugucagc

SEQ ID NO: 404697 - RNA, 18 nt, Homo sapiens
ucaucuucacugcaauuu

SEQ ID NO: 404698 - RNA, 11 nt, Homo sapiens
ucaucuuugag

SEQ ID NO: 404699 - RNA, 14 nt, Homo sapiens
ucaugaaauaugca

SEQ ID NO: 404700 - RNA, 15 nt, Homo sapiens
ucaugaaauaugcau

SEQ ID NO: 404701 - RNA, 12 nt, Homo sapiens
ucaugacaaagu

SEQ ID NO: 404702 - RNA, 21 nt, Homo sapiens
ucaugagccguugcuaaugcc

SEQ ID NO: 404703 - RNA, 16 nt, Homo sapiens
ucaugauggagacuuc

SEQ ID NO: 404704 - RNA, 20 nt, Homo sapiens
ucaugauguauuguugcuuu

SEQ ID NO: 404705 - RNA, 11 nt, Homo sapiens
ucaugaugucu

SEQ ID NO: 404706 - RNA, 16 nt, Homo sapiens
ucaugauuucauuuca

SEQ ID NO: 404707 - RNA, 17 nt, Homo sapiens
ucaugcaauccuuccaa

SEQ ID NO: 404708 - RNA, 20 nt, Homo sapiens
ucaugcauuguaaucaucau

SEQ ID NO: 404709 - RNA, 17 nt, Homo sapiens
ucaugcguguguguugu

SEQ ID NO: 404710 - RNA, 21 nt, Homo sapiens
ucauguaaauaaauacauucu

SEQ ID NO: 404711 - RNA, 23 nt, Homo sapiens
ucaugucauugaugaacugccaa

SEQ ID NO: 404712 - RNA, 15 nt, Homo sapiens
ucauguuugugcaug

SEQ ID NO: 404713 - RNA, 15 nt, Homo sapiens
ucauguuuugcuaau

SEQ ID NO: 404714 - RNA, 14 nt, Homo sapiens
ucauuaaccaaaga

SEQ ID NO: 404715 - RNA, 14 nt, Homo sapiens
ucauuaauucacau

SEQ ID NO: 404716 - RNA, 18 nt, Homo sapiens
gcagcuuuuucaaagugu

SEQ ID NO: 404717 - RNA, 19 nt, Homo sapiens
gcaggaacugaaaaccagu

SEQ ID NO: 404718 - RNA, 16 nt, Homo sapiens
gcaggaagucccugag

SEQ ID NO: 404719 - RNA, 21 nt, Homo sapiens
gcaggcagccccacacccgcc

SEQ ID NO: 404720 - RNA, 21 nt, Homo sapiens
gcaggcccuccgcgggggaca

SEQ ID NO: 404721 - RNA, 17 nt, Homo sapiens
gcaggccucaucuuucc

SEQ ID NO: 404722 - RNA, 21 nt, Homo sapiens
gcagggaagccccacuugaag

SEQ ID NO: 404723 - RNA, 16 nt, Homo sapiens
gcagggacugccaguc

SEQ ID NO: 404724 - RNA, 20 nt, Homo sapiens
gcagggcagccugugggaga

SEQ ID NO: 404725 - RNA, 17 nt, Homo sapiens
gcagggcccaucugccg

SEQ ID NO: 404726 - RNA, 14 nt, Homo sapiens
gcagggccugagga

SEQ ID NO: 404727 - RNA, 16 nt, Homo sapiens
gcagggguugcaguga

SEQ ID NO: 404728 - RNA, 22 nt, Homo sapiens
gcaggguuuuaucucugucuac

SEQ ID NO: 404729 - RNA, 18 nt, Homo sapiens
gcagguacuuccucaguc

SEQ ID NO: 404730 - RNA, 17 nt, Homo sapiens
gcaggucugcaggccac

SEQ ID NO: 404731 - RNA, 12 nt, Homo sapiens
gcaggugccaac

SEQ ID NO: 404732 - RNA, 15 nt, Homo sapiens
gcagucacccugugg

SEQ ID NO: 404733 - RNA, 22 nt, Homo sapiens
gcagucauuaugagaggcaaug

SEQ ID NO: 404734 - RNA, 20 nt, Homo sapiens
gcagucggugguaccugaga

SEQ ID NO: 404735 - RNA, 22 nt, Homo sapiens
gcagugcccagugauggcauua

SEQ ID NO: 404736 - RNA, 13 nt, Homo sapiens
gcagugggaccaa

SEQ ID NO: 404737 - RNA, 20 nt, Homo sapiens
gcaguggggagcgggggcua

SEQ ID NO: 404738 - RNA, 18 nt, Homo sapiens
gcaguguuuucaccucau

SEQ ID NO: 404739 - RNA, 14 nt, Homo sapiens
gcaguucacuuccu

SEQ ID NO: 404740 - RNA, 19 nt, Homo sapiens
gcaguucccccaaccucag

SEQ ID NO: 404741 - RNA, 12 nt, Homo sapiens
gcaguuggucua

SEQ ID NO: 404742 - RNA, 17 nt, Homo sapiens
gcaguuuccucaucugu

SEQ ID NO: 404743 - RNA, 15 nt, Homo sapiens
gcauacaguuugcac

SEQ ID NO: 404744 - RNA, 16 nt, Homo sapiens
gcaucaaagaugagaa

SEQ ID NO: 404745 - RNA, 18 nt, Homo sapiens
gcaucaaccuacuuagaa

SEQ ID NO: 404746 - RNA, 16 nt, Homo sapiens
gcaucaagaugugaca

SEQ ID NO: 404747 - RNA, 15 nt, Homo sapiens
gcaucaaugcugagu

SEQ ID NO: 404748 - RNA, 21 nt, Homo sapiens
gcaucaauguaaggaccuuca

SEQ ID NO: 404749 - RNA, 11 nt, Homo sapiens
gcaucagagau

SEQ ID NO: 404750 - RNA, 17 nt, Homo sapiens
gcaucagccucuggcca

SEQ ID NO: 404751 - RNA, 15 nt, Homo sapiens
gcaucaguugcuaua

SEQ ID NO: 404752 - RNA, 17 nt, Homo sapiens
gcaucauuaguacaucu

SEQ ID NO: 404753 - RNA, 19 nt, Homo sapiens
gcauccaaggggccuggaa

SEQ ID NO: 404754 - RNA, 11 nt, Homo sapiens
gcauccuccag

SEQ ID NO: 404755 - RNA, 17 nt, Homo sapiens
gcauccuccaguguuac

SEQ ID NO: 404756 - RNA, 23 nt, Homo sapiens
gcaucuacuacucugucuucacu

SEQ ID NO: 404757 - RNA, 13 nt, Homo sapiens
gcaucucagccua

SEQ ID NO: 404758 - RNA, 14 nt, Homo sapiens
gcaucuccaggaag

SEQ ID NO: 404759 - RNA, 9 nt, Homo sapiens
gcaucuccc

SEQ ID NO: 404760 - RNA, 20 nt, Homo sapiens
gcaucuuccccaacgaaaag

SEQ ID NO: 404761 - RNA, 15 nt, Homo sapiens
gcaucuuggaaauca

SEQ ID NO: 404762 - RNA, 13 nt, Homo sapiens
gcaugaagcacau

SEQ ID NO: 404763 - RNA, 20 nt, Homo sapiens
gcaugaccugugaccagcac

SEQ ID NO: 404764 - RNA, 23 nt, Homo sapiens
gcaugaccugugaccagcacugu

SEQ ID NO: 404765 - RNA, 15 nt, Homo sapiens
gcaugagaaugucau

SEQ ID NO: 404766 - RNA, 11 nt, Homo sapiens
gcaugcacaaa

SEQ ID NO: 404767 - RNA, 21 nt, Homo sapiens
gcaugcauuuugcagcaguga

SEQ ID NO: 404768 - RNA, 21 nt, Homo sapiens
gcaugcucaguuggugcugcu

SEQ ID NO: 404769 - RNA, 16 nt, Homo sapiens
gcaugcuuugcugcua

SEQ ID NO: 404770 - RNA, 16 nt, Homo sapiens
gcauggccacagccac

SEQ ID NO: 404771 - RNA, 19 nt, Homo sapiens
gcauggccccuccaggaac

SEQ ID NO: 404772 - RNA, 18 nt, Homo sapiens
gcauguaagccaagucau

SEQ ID NO: 404773 - RNA, 20 nt, Homo sapiens
gcaugugugcgagugugugc

SEQ ID NO: 404774 - RNA, 20 nt, Homo sapiens
gcauuacacgccacaacucc

SEQ ID NO: 404775 - RNA, 17 nt, Homo sapiens
gcauuagaaacugaaaa

SEQ ID NO: 404776 - RNA, 16 nt, Homo sapiens
gcauuaucagccuguu

SEQ ID NO: 404777 - RNA, 17 nt, Homo sapiens
gcauucuacaccuggac

SEQ ID NO: 404778 - RNA, 19 nt, Homo sapiens
gcauucucaauacuugaau

SEQ ID NO: 404779 - RNA, 15 nt, Homo sapiens
gcauugaaagaauua

SEQ ID NO: 404780 - RNA, 15 nt, Homo sapiens
gcauugccagcucuu

SEQ ID NO: 404781 - RNA, 19 nt, Homo sapiens
gcauugucccugugccuaa

SEQ ID NO: 404782 - RNA, 22 nt, Homo sapiens
gcauuuauggucaacacuuaag

SEQ ID NO: 404783 - RNA, 19 nt, Homo sapiens
gcauuuccaacaccacaga

SEQ ID NO: 404784 - RNA, 18 nt, Homo sapiens
gcauuugcugcauuucaa

SEQ ID NO: 404785 - RNA, 21 nt, Homo sapiens
gcauuuggggccuuucccauu

SEQ ID NO: 404786 - RNA, 15 nt, Homo sapiens
gcauuuguccaccca

SEQ ID NO: 404787 - RNA, 14 nt, Homo sapiens
gcauuugugucugc

SEQ ID NO: 404788 - RNA, 15 nt, Homo sapiens
gcauuuuucugggag

SEQ ID NO: 404789 - RNA, 18 nt, Homo sapiens
gccaaaaaaugcuugcuu

SEQ ID NO: 404790 - RNA, 17 nt, Homo sapiens
gccaaacuguacaguuu

SEQ ID NO: 404791 - RNA, 19 nt, Homo sapiens
gccaaccggucacccagga

SEQ ID NO: 404792 - RNA, 23 nt, Homo sapiens
gccaacuuuuagugggugagaaa

SEQ ID NO: 404793 - RNA, 18 nt, Homo sapiens
gccaagacaguggcagca

SEQ ID NO: 404794 - RNA, 23 nt, Homo sapiens
gccaagcuuucuucuacaaccag

SEQ ID NO: 404795 - RNA, 22 nt, Homo sapiens
gccaaguaacaaugcaugcuuu

SEQ ID NO: 404796 - RNA, 21 nt, Homo sapiens
gccaaguggaagccacuggac

SEQ ID NO: 404797 - RNA, 15 nt, Homo sapiens
gccaauagucauaug

SEQ ID NO: 404798 - RNA, 19 nt, Homo sapiens
gccaaugccccacuggcag

SEQ ID NO: 404799 - RNA, 18 nt, Homo sapiens
gccaauggagacugucuc

SEQ ID NO: 404800 - RNA, 19 nt, Homo sapiens
gccacaaaacugacaguaa

SEQ ID NO: 404801 - RNA, 15 nt, Homo sapiens
gccacaacacccagc

SEQ ID NO: 404802 - RNA, 14 nt, Homo sapiens
gccacaacugcccc

SEQ ID NO: 404803 - RNA, 19 nt, Homo sapiens
gccacaauaagccacuggu

SEQ ID NO: 404804 - RNA, 12 nt, Homo sapiens
gccacaauguga

SEQ ID NO: 404805 - RNA, 19 nt, Homo sapiens
gccacacaaacguuuacuu

SEQ ID NO: 404806 - RNA, 16 nt, Homo sapiens
gccacaggcacugugu

SEQ ID NO: 404807 - RNA, 13 nt, Homo sapiens
gccacaguggcca

SEQ ID NO: 404808 - RNA, 18 nt, Homo sapiens
gccacauccaacauuucc

SEQ ID NO: 404809 - RNA, 20 nt, Homo sapiens
gccaccagcuccacuggccu

SEQ ID NO: 404810 - RNA, 15 nt, Homo sapiens
gccaccauccugcag

SEQ ID NO: 404811 - RNA, 14 nt, Homo sapiens
gccaccaugcacuc

SEQ ID NO: 404812 - RNA, 20 nt, Homo sapiens
gccaccccuaaucacuauug

SEQ ID NO: 404813 - RNA, 13 nt, Homo sapiens
gccacccuaccug

SEQ ID NO: 404814 - RNA, 14 nt, Homo sapiens
gccacccucugcag

SEQ ID NO: 404815 - RNA, 11 nt, Homo sapiens
gccaccucucc

SEQ ID NO: 404816 - RNA, 23 nt, Homo sapiens
gccaccucucuccuuugcugagg

SEQ ID NO: 404817 - RNA, 15 nt, Homo sapiens
gccaccuuugaagaa

SEQ ID NO: 404818 - RNA, 17 nt, Homo sapiens
gccacgggcacaagacc

SEQ ID NO: 404819 - RNA, 24 nt, Homo sapiens
gccacguaugguggcucaugucua

SEQ ID NO: 404820 - RNA, 14 nt, Homo sapiens
gccacgugggcaaa

SEQ ID NO: 404821 - RNA, 21 nt, Homo sapiens
gccacugagcccagccuacuu

SEQ ID NO: 404822 - RNA, 23 nt, Homo sapiens
gccacugccacacgucugacccu

SEQ ID NO: 404823 - RNA, 16 nt, Homo sapiens
gccacuguggccagag

SEQ ID NO: 404824 - RNA, 23 nt, Homo sapiens
gccacuugguuuuuggcucuuuc

SEQ ID NO: 404825 - RNA, 23 nt, Homo sapiens
gccagagaauagaucaguauuuc

SEQ ID NO: 404826 - RNA, 18 nt, Homo sapiens
gccagagcaaagggccag

SEQ ID NO: 404827 - RNA, 22 nt, Homo sapiens
gccagagcccuucacugccaug

SEQ ID NO: 404828 - RNA, 17 nt, Homo sapiens
gccagcauauacugaag

SEQ ID NO: 404829 - RNA, 14 nt, Homo sapiens
gccagccgugagug

SEQ ID NO: 404830 - RNA, 18 nt, Homo sapiens
gccagccgugagugcaga

SEQ ID NO: 404831 - RNA, 13 nt, Homo sapiens
gccagccucagug

SEQ ID NO: 404832 - RNA, 17 nt, Homo sapiens
gccagccucagugccac

SEQ ID NO: 404833 - RNA, 18 nt, Homo sapiens
gccagcucagcaguucac

SEQ ID NO: 404834 - RNA, 15 nt, Homo sapiens
gccaggaaagcguuu

SEQ ID NO: 404835 - RNA, 13 nt, Homo sapiens
gccaggcucaggc

SEQ ID NO: 404836 - RNA, 21 nt, Homo sapiens
gccaggcugaauuacagugaa

SEQ ID NO: 404837 - RNA, 21 nt, Homo sapiens
gccaggcuggucucaaacucc

SEQ ID NO: 404838 - RNA, 18 nt, Homo sapiens
gccagggcccgaccuggg

SEQ ID NO: 404839 - RNA, 18 nt, Homo sapiens
gccagggucucgucagga

SEQ ID NO: 404840 - RNA, 21 nt, Homo sapiens
gccaggguggucuugaucucc

SEQ ID NO: 404841 - RNA, 12 nt, Homo sapiens
gccagguggcca

SEQ ID NO: 404842 - RNA, 19 nt, Homo sapiens
gccagguugcagcugcucu

SEQ ID NO: 404843 - RNA, 15 nt, Homo sapiens
gccaguaaaaguaua

SEQ ID NO: 404844 - RNA, 16 nt, Homo sapiens
gccaguaaggcagcuc

SEQ ID NO: 404845 - RNA, 16 nt, Homo sapiens
gccagucuugccuagg

SEQ ID NO: 404846 - RNA, 15 nt, Homo sapiens
ugagcagagacauga

SEQ ID NO: 404847 - RNA, 21 nt, Homo sapiens
ugagcagggcccucagaggaa

SEQ ID NO: 404848 - RNA, 17 nt, Homo sapiens
ugagcaguagaagccug

SEQ ID NO: 404849 - RNA, 20 nt, Homo sapiens
ugagcauuuagacucucgac

SEQ ID NO: 404850 - RNA, 17 nt, Homo sapiens
ugagccaaccagaauaa

SEQ ID NO: 404851 - RNA, 22 nt, Homo sapiens
ugagccagccuugcaguaggca

SEQ ID NO: 404852 - RNA, 23 nt, Homo sapiens
ugagcccaauguauuaugaucuc

SEQ ID NO: 404853 - RNA, 21 nt, Homo sapiens
ugagcccagccuacuuuucag

SEQ ID NO: 404854 - RNA, 14 nt, Homo sapiens
ugagccccuacccc

SEQ ID NO: 404855 - RNA, 18 nt, Homo sapiens
ugagcccggaugcuucuc

SEQ ID NO: 404856 - RNA, 21 nt, Homo sapiens
ugagcuauaauguuucccuca

SEQ ID NO: 404857 - RNA, 16 nt, Homo sapiens
ugagcucaaaguacua

SEQ ID NO: 404858 - RNA, 19 nt, Homo sapiens
ugagcucccucgcuguaug

SEQ ID NO: 404859 - RNA, 16 nt, Homo sapiens
ugagcuggacauaaca

SEQ ID NO: 404860 - RNA, 12 nt, Homo sapiens
ugagcugggaag

SEQ ID NO: 404861 - RNA, 17 nt, Homo sapiens
ugagcugguuugacuca

SEQ ID NO: 404862 - RNA, 14 nt, Homo sapiens
ugagcuucaguaua

SEQ ID NO: 404863 - RNA, 20 nt, Homo sapiens
ugagcuucauauaccagcaa

SEQ ID NO: 404864 - RNA, 15 nt, Homo sapiens
ugaggaccacuccug

SEQ ID NO: 404865 - RNA, 18 nt, Homo sapiens
ugaggacuuaauuuacuu

SEQ ID NO: 404866 - RNA, 15 nt, Homo sapiens
ugaggaugagcugga

SEQ ID NO: 404867 - RNA, 15 nt, Homo sapiens
ugaggcaaaggccag

SEQ ID NO: 404868 - RNA, 14 nt, Homo sapiens
ugaggcaauaaaaa

SEQ ID NO: 404869 - RNA, 17 nt, Homo sapiens
ugaggcauuuuuacuac

SEQ ID NO: 404870 - RNA, 15 nt, Homo sapiens
ugaggcccacucugu

SEQ ID NO: 404871 - RNA, 19 nt, Homo sapiens
ugaggcuauggaggguccu

SEQ ID NO: 404872 - RNA, 17 nt, Homo sapiens
ugagggaaacaaaauau

SEQ ID NO: 404873 - RNA, 23 nt, Homo sapiens
ugagggaccaauauuaccaucuu

SEQ ID NO: 404874 - RNA, 14 nt, Homo sapiens
ugagggacugccuc

SEQ ID NO: 404875 - RNA, 14 nt, Homo sapiens
ugagggggagcuga

SEQ ID NO: 404876 - RNA, 15 nt, Homo sapiens
ugagguggugccuuc

SEQ ID NO: 404877 - RNA, 24 nt, Homo sapiens
ugagguuaaggggaucuaaaagga

SEQ ID NO: 404878 - RNA, 18 nt, Homo sapiens
ugagguuaguucugugug

SEQ ID NO: 404879 - RNA, 18 nt, Homo sapiens
ugaguaauuuucugaugg

SEQ ID NO: 404880 - RNA, 23 nt, Homo sapiens
ugaguagcucuccugacuuuuaa

SEQ ID NO: 404881 - RNA, 11 nt, Homo sapiens
ugaguaugugu

SEQ ID NO: 404882 - RNA, 12 nt, Homo sapiens
ugagucaaguca

SEQ ID NO: 404883 - RNA, 17 nt, Homo sapiens
ugagucaaugugcagug

SEQ ID NO: 404884 - RNA, 17 nt, Homo sapiens
ugagucauauugaggca

SEQ ID NO: 404885 - RNA, 16 nt, Homo sapiens
ugagucaucaaaaaga

SEQ ID NO: 404886 - RNA, 17 nt, Homo sapiens
ugagugaucccauuucu

SEQ ID NO: 404887 - RNA, 15 nt, Homo sapiens
ugaguggucaggcau

SEQ ID NO: 404888 - RNA, 22 nt, Homo sapiens
ugagugguguguguuaucagau

SEQ ID NO: 404889 - RNA, 14 nt, Homo sapiens
ugagugugugcaag

SEQ ID NO: 404890 - RNA, 14 nt, Homo sapiens
ugaguuaaaguaua

SEQ ID NO: 404891 - RNA, 22 nt, Homo sapiens
ugaguuacuuccuaucaagcca

SEQ ID NO: 404892 - RNA, 19 nt, Homo sapiens
ugaguucucauccacagag

SEQ ID NO: 404893 - RNA, 22 nt, Homo sapiens
ugaguuucauuuuucauuuucu

SEQ ID NO: 404894 - RNA, 17 nt, Homo sapiens
ugaguuugaacacagau

SEQ ID NO: 404895 - RNA, 15 nt, Homo sapiens
ugauaaaacacugcc

SEQ ID NO: 404896 - RNA, 21 nt, Homo sapiens
ugauaaaacagaauauugaca

SEQ ID NO: 404897 - RNA, 17 nt, Homo sapiens
ugauaaaauaaguaaca

SEQ ID NO: 404898 - RNA, 14 nt, Homo sapiens
ugauaaacauuaaa

SEQ ID NO: 404899 - RNA, 21 nt, Homo sapiens
ugauaaacauuaaacacugua

SEQ ID NO: 404900 - RNA, 16 nt, Homo sapiens
ugauaauaauugauca

SEQ ID NO: 404901 - RNA, 14 nt, Homo sapiens
ugauacaaauguua

SEQ ID NO: 404902 - RNA, 15 nt, Homo sapiens
ugauacuuccucaua

SEQ ID NO: 404903 - RNA, 18 nt, Homo sapiens
ugauacuuguuccagaug

SEQ ID NO: 404904 - RNA, 11 nt, Homo sapiens
ugauagcuuua

SEQ ID NO: 404905 - RNA, 16 nt, Homo sapiens
ugauaggaaaaaucca

SEQ ID NO: 404906 - RNA, 13 nt, Homo sapiens
ugauagucaauau

SEQ ID NO: 404907 - RNA, 14 nt, Homo sapiens
ugauauauauaugc

SEQ ID NO: 404908 - RNA, 17 nt, Homo sapiens
ugauauguguaauauca

SEQ ID NO: 404909 - RNA, 12 nt, Homo sapiens
ugauauucucau

SEQ ID NO: 404910 - RNA, 16 nt, Homo sapiens
ugauauugcaguaaug

SEQ ID NO: 404911 - RNA, 19 nt, Homo sapiens
ugaucaaaaccugugccag

SEQ ID NO: 404912 - RNA, 17 nt, Homo sapiens
ugaucaauaaaauguga

SEQ ID NO: 404913 - RNA, 18 nt, Homo sapiens
ugaucagaucugacauga

SEQ ID NO: 404914 - RNA, 19 nt, Homo sapiens
ugaucagugcaauugaccu

SEQ ID NO: 404915 - RNA, 17 nt, Homo sapiens
ugaucauugguuucuua

SEQ ID NO: 404916 - RNA, 23 nt, Homo sapiens
ugaucauuuuccccccacucucc

SEQ ID NO: 404917 - RNA, 16 nt, Homo sapiens
ugauccagagcacaga

SEQ ID NO: 404918 - RNA, 11 nt, Homo sapiens
ugauccagugg

SEQ ID NO: 404919 - RNA, 13 nt, Homo sapiens
ugauccgccuacc

SEQ ID NO: 404920 - RNA, 15 nt, Homo sapiens
ugaucgcuuucuaca

SEQ ID NO: 404921 - RNA, 17 nt, Homo sapiens
ugaucuaccugccucag

SEQ ID NO: 404922 - RNA, 12 nt, Homo sapiens
ugaucuauugca

SEQ ID NO: 404923 - RNA, 16 nt, Homo sapiens
ugaucuauugcagaua

SEQ ID NO: 404924 - RNA, 19 nt, Homo sapiens
ugaucucggcucacugcaa

SEQ ID NO: 404925 - RNA, 14 nt, Homo sapiens
ugaucuguaccuau

SEQ ID NO: 404926 - RNA, 13 nt, Homo sapiens
ugaucuuacucac

SEQ ID NO: 404927 - RNA, 15 nt, Homo sapiens
ugaugaaaaccaccc

SEQ ID NO: 404928 - RNA, 17 nt, Homo sapiens
ugaugaaagcugauuac

SEQ ID NO: 404929 - RNA, 13 nt, Homo sapiens
ugaugaagcacau

SEQ ID NO: 404930 - RNA, 10 nt, Homo sapiens
ugaugaauaa

SEQ ID NO: 404931 - RNA, 20 nt, Homo sapiens
ugaugacuccuccccagaaa

SEQ ID NO: 404932 - RNA, 16 nt, Homo sapiens
ugaugaguugauuuau

SEQ ID NO: 404933 - RNA, 24 nt, Homo sapiens
ugaugauucuacuugcuguagaug

SEQ ID NO: 404934 - RNA, 13 nt, Homo sapiens
ugaugcaugagcu

SEQ ID NO: 404935 - RNA, 21 nt, Homo sapiens
ugaugccaugggcccucucag

SEQ ID NO: 404936 - RNA, 17 nt, Homo sapiens
ugaugccccuuccccaa

SEQ ID NO: 404937 - RNA, 18 nt, Homo sapiens
ugaugccccuuccccaag

SEQ ID NO: 404938 - RNA, 16 nt, Homo sapiens
ugaugcugagauucuu

SEQ ID NO: 404939 - RNA, 17 nt, Homo sapiens
ugauggagucagguuug

SEQ ID NO: 404940 - RNA, 19 nt, Homo sapiens
ugauggauaucccuaccuu

SEQ ID NO: 404941 - RNA, 21 nt, Homo sapiens
ugauggcuuaaaaauacuuaa

SEQ ID NO: 404942 - RNA, 14 nt, Homo sapiens
ugaugguugcaaaa

SEQ ID NO: 404943 - RNA, 18 nt, Homo sapiens
ugaugucaugaaagcacc

SEQ ID NO: 404944 - RNA, 15 nt, Homo sapiens
ugaugucuuuguuaa

SEQ ID NO: 404945 - RNA, 15 nt, Homo sapiens
ugaugugaaacauua

SEQ ID NO: 404946 - RNA, 18 nt, Homo sapiens
ugaugugcucaucagaaa

SEQ ID NO: 404947 - RNA, 14 nt, Homo sapiens
ugauguggaugaaa

SEQ ID NO: 404948 - RNA, 22 nt, Homo sapiens
ugauguuuuacuuuucacagua

SEQ ID NO: 404949 - RNA, 19 nt, Homo sapiens
ugauuacuaucauggcaua

SEQ ID NO: 404950 - RNA, 19 nt, Homo sapiens
ugauucaauaaaaugcacu

SEQ ID NO: 404951 - RNA, 14 nt, Homo sapiens
ugauucacuauuag

SEQ ID NO: 404952 - RNA, 21 nt, Homo sapiens
ugauucccauaacauaaaagu

SEQ ID NO: 404953 - RNA, 23 nt, Homo sapiens
ugauucgucugcgauuuuaucug

SEQ ID NO: 404954 - RNA, 15 nt, Homo sapiens
ugauucuaugucuca

SEQ ID NO: 404955 - RNA, 17 nt, Homo sapiens
ugauucucagcacuugg

SEQ ID NO: 404956 - RNA, 17 nt, Homo sapiens
ugauucucaugcacugc

SEQ ID NO: 404957 - RNA, 18 nt, Homo sapiens
gccgggucacccugugac

SEQ ID NO: 404958 - RNA, 16 nt, Homo sapiens
gccggugcucuggaag

SEQ ID NO: 404959 - RNA, 18 nt, Homo sapiens
gccguccauggcaccagc

SEQ ID NO: 404960 - RNA, 19 nt, Homo sapiens
gccgucgaguugaccuucu

SEQ ID NO: 404961 - RNA, 16 nt, Homo sapiens
gccgugccugcauucg

SEQ ID NO: 404962 - RNA, 23 nt, Homo sapiens
gccuaaaaguuacuuaccacaga

SEQ ID NO: 404963 - RNA, 16 nt, Homo sapiens
gccuaaaucuccagug

SEQ ID NO: 404964 - RNA, 23 nt, Homo sapiens
gccuacagauaauuuauuuugua

SEQ ID NO: 404965 - RNA, 20 nt, Homo sapiens
gccuaggggucagggaccaa

SEQ ID NO: 404966 - RNA, 14 nt, Homo sapiens
gccucaaguucaau

SEQ ID NO: 404967 - RNA, 15 nt, Homo sapiens
gccucaaugccagua

SEQ ID NO: 404968 - RNA, 17 nt, Homo sapiens
gccucacucaccaucug

SEQ ID NO: 404969 - RNA, 14 nt, Homo sapiens
gccucccagccacc

SEQ ID NO: 404970 - RNA, 17 nt, Homo sapiens
gccucccgcaugcugcc

SEQ ID NO: 404971 - RNA, 19 nt, Homo sapiens
gccucccgccgccucgggc

SEQ ID NO: 404972 - RNA, 15 nt, Homo sapiens
gccucccguccgucc

SEQ ID NO: 404973 - RNA, 17 nt, Homo sapiens
gccucccuuucugggag

SEQ ID NO: 404974 - RNA, 19 nt, Homo sapiens
gccuccucccacaagcacc

SEQ ID NO: 404975 - RNA, 19 nt, Homo sapiens
gccuccucccauccagcgu

SEQ ID NO: 404976 - RNA, 22 nt, Homo sapiens
gccuccucucucccugccucac

SEQ ID NO: 404977 - RNA, 19 nt, Homo sapiens
uuguaaguuuaugucuaaa

SEQ ID NO: 404978 - RNA, 16 nt, Homo sapiens
uuguaaucaucauaga

SEQ ID NO: 404979 - RNA, 20 nt, Homo sapiens
uuguacagugucugugccau

SEQ ID NO: 404980 - RNA, 12 nt, Homo sapiens
uuguacauauug

SEQ ID NO: 404981 - RNA, 16 nt, Homo sapiens
uuguacauuccugaua

SEQ ID NO: 404982 - RNA, 19 nt, Homo sapiens
uuguacauuccugauacug

SEQ ID NO: 404983 - RNA, 18 nt, Homo sapiens
uuguaccagggcucugua

SEQ ID NO: 404984 - RNA, 17 nt, Homo sapiens
uuguaccugacuuccac

SEQ ID NO: 404985 - RNA, 21 nt, Homo sapiens
uuguacuuuguuuuuccaugu

SEQ ID NO: 404986 - RNA, 15 nt, Homo sapiens
uuguagcguuuccuu

SEQ ID NO: 404987 - RNA, 21 nt, Homo sapiens
uuguagugguauagaguacug

SEQ ID NO: 404988 - RNA, 23 nt, Homo sapiens
uuguaucuuaaaucugugaagua

SEQ ID NO: 404989 - RNA, 21 nt, Homo sapiens
uuguaucuuuaaagacuugau

SEQ ID NO: 404990 - RNA, 15 nt, Homo sapiens
uuguauguaucuauu

SEQ ID NO: 404991 - RNA, 21 nt, Homo sapiens
uuguauguuaaagcaucagag

SEQ ID NO: 404992 - RNA, 14 nt, Homo sapiens
uuguauugacuauu

SEQ ID NO: 404993 - RNA, 13 nt, Homo sapiens
uugucaaacugua

SEQ ID NO: 404994 - RNA, 22 nt, Homo sapiens
uugucacuugggugccaaacau

SEQ ID NO: 404995 - RNA, 18 nt, Homo sapiens
uugucacuuuccucuucc

SEQ ID NO: 404996 - RNA, 15 nt, Homo sapiens
uugucagaauccacu

SEQ ID NO: 404997 - RNA, 20 nt, Homo sapiens
uugucagaauuucuuuguca

SEQ ID NO: 404998 - RNA, 22 nt, Homo sapiens
uugucauggaaaauguccugug

SEQ ID NO: 404999 - RNA, 18 nt, Homo sapiens
uugucccccaacuugaga

SEQ ID NO: 405000 - RNA, 18 nt, Homo sapiens
uugucccuaugcauauca

SEQ ID NO: 405001 - RNA, 16 nt, Homo sapiens
uugucugagaacaaau

SEQ ID NO: 405002 - RNA, 14 nt, Homo sapiens
uugucuggcugugg

SEQ ID NO: 405003 - RNA, 19 nt, Homo sapiens
uugucuuaaucguccugcu

SEQ ID NO: 405004 - RNA, 21 nt, Homo sapiens
gugccaggcuguaagcauucu

SEQ ID NO: 405005 - RNA, 18 nt, Homo sapiens
gugccauuguacuccagc

SEQ ID NO: 405006 - RNA, 15 nt, Homo sapiens
gugccgaaugugcag

SEQ ID NO: 405007 - RNA, 20 nt, Homo sapiens
gugccucccaagcucagagc

SEQ ID NO: 405008 - RNA, 20 nt, Homo sapiens
gugccuccuuccaccucccu

SEQ ID NO: 405009 - RNA, 22 nt, Homo sapiens
gugccucucccaaguccagugu

SEQ ID NO: 405010 - RNA, 23 nt, Homo sapiens
gugccugucuggagcucacccaa

SEQ ID NO: 405011 - RNA, 14 nt, Homo sapiens
gugccuuacacaau

SEQ ID NO: 405012 - RNA, 15 nt, Homo sapiens
gugccuugagcugcc

SEQ ID NO: 405013 - RNA, 17 nt, Homo sapiens
gugccuuugaccaucuc

SEQ ID NO: 405014 - RNA, 17 nt, Homo sapiens
gugcgagugugugcaug

SEQ ID NO: 405015 - RNA, 13 nt, Homo sapiens
gugcggugcauac

SEQ ID NO: 405016 - RNA, 16 nt, Homo sapiens
gugcgugcaugugcac

SEQ ID NO: 405017 - RNA, 14 nt, Homo sapiens
gugcgugugugcaa

SEQ ID NO: 405018 - RNA, 15 nt, Homo sapiens
gugcgugugugcaag

SEQ ID NO: 405019 - RNA, 24 nt, Homo sapiens
gugcuaaccacgucugucuucaca

SEQ ID NO: 405020 - RNA, 15 nt, Homo sapiens
gugcuagaugugcaa

SEQ ID NO: 405021 - RNA, 15 nt, Homo sapiens
gugcugcagguguaa

SEQ ID NO: 405022 - RNA, 23 nt, Homo sapiens
gugcugcauggagugagcaguag

SEQ ID NO: 405023 - RNA, 21 nt, Homo sapiens
gugcugcuguggcaucaggaa

SEQ ID NO: 405024 - RNA, 20 nt, Homo sapiens
gugcuggccucaaacagcca

SEQ ID NO: 405025 - RNA, 21 nt, Homo sapiens
gugcugggauuacagguguga

SEQ ID NO: 405026 - RNA, 21 nt, Homo sapiens
gugcuuccuugcucagugcaa

SEQ ID NO: 405027 - RNA, 19 nt, Homo sapiens
gugcuugccaccaccagau

SEQ ID NO: 405028 - RNA, 19 nt, Homo sapiens
gugcuugcuccuaagcaaa

SEQ ID NO: 405029 - RNA, 21 nt, Homo sapiens
gugcuuuauaccccauuugau

SEQ ID NO: 405030 - RNA, 18 nt, Homo sapiens
guggaaaaaaaaagaaua

SEQ ID NO: 405031 - RNA, 15 nt, Homo sapiens
guggaaaaugcaaug

SEQ ID NO: 405032 - RNA, 18 nt, Homo sapiens
guggaaagugaauuugaa

SEQ ID NO: 405033 - RNA, 18 nt, Homo sapiens
guggaagaagaaaacacu

SEQ ID NO: 405034 - RNA, 12 nt, Homo sapiens
guggaaggugag

SEQ ID NO: 405035 - RNA, 23 nt, Homo sapiens
guggaauauaaggaaagcaauaa

SEQ ID NO: 405036 - RNA, 21 nt, Homo sapiens
guggagcacaaaagccucuca

SEQ ID NO: 405037 - RNA, 16 nt, Homo sapiens
guggagcuccugcugg

SEQ ID NO: 405038 - RNA, 22 nt, Homo sapiens
guggaggguggggggcgcugag

SEQ ID NO: 405039 - RNA, 13 nt, Homo sapiens
guggagugucaca

SEQ ID NO: 405040 - RNA, 23 nt, Homo sapiens
guggauuauguguguuuugcuaa

SEQ ID NO: 405041 - RNA, 20 nt, Homo sapiens
guggauuggcuuugugcuug

SEQ ID NO: 405042 - RNA, 23 nt, Homo sapiens
guggcaaaagacauccucaaaag

SEQ ID NO: 405043 - RNA, 20 nt, Homo sapiens
guggcauguggguugugaua

SEQ ID NO: 405044 - RNA, 16 nt, Homo sapiens
guggccccagcuguga

SEQ ID NO: 405045 - RNA, 21 nt, Homo sapiens
guggccucaacccucccucag

SEQ ID NO: 405046 - RNA, 12 nt, Homo sapiens
guggccucagaa

SEQ ID NO: 405047 - RNA, 14 nt, Homo sapiens
guggccugccuuca

SEQ ID NO: 405048 - RNA, 14 nt, Homo sapiens
guggccuuccccuu

SEQ ID NO: 405049 - RNA, 22 nt, Homo sapiens
guggccuuccccuuuugccugg

SEQ ID NO: 405050 - RNA, 17 nt, Homo sapiens
guggccuugaccuccaa

SEQ ID NO: 405051 - RNA, 15 nt, Homo sapiens
guggcugggugguca

SEQ ID NO: 405052 - RNA, 18 nt, Homo sapiens
guggcuucccgcucagcc

SEQ ID NO: 405053 - RNA, 18 nt, Homo sapiens
guggcuuuuuaacaugaa

SEQ ID NO: 405054 - RNA, 21 nt, Homo sapiens
gugggaagaacuugucccuca

SEQ ID NO: 405055 - RNA, 15 nt, Homo sapiens
gugggaaugcagugg

SEQ ID NO: 405056 - RNA, 22 nt, Homo sapiens
gugggacccugccagacugaag

SEQ ID NO: 405057 - RNA, 21 nt, Homo sapiens
gugggagcagcgguuugggga

SEQ ID NO: 405058 - RNA, 21 nt, Homo sapiens
gugggcuguguugacugcugc

SEQ ID NO: 405059 - RNA, 16 nt, Homo sapiens
guggggcagcacagag

SEQ ID NO: 405060 - RNA, 13 nt, Homo sapiens
guggggugccuga

SEQ ID NO: 405061 - RNA, 23 nt, Homo sapiens
guggguaacgugagaagauagaa

SEQ ID NO: 405062 - RNA, 13 nt, Homo sapiens
gugguacaggaag

SEQ ID NO: 405063 - RNA, 23 nt, Homo sapiens
gugguagaagccaguacagagaa

SEQ ID NO: 405064 - RNA, 17 nt, Homo sapiens
guggucugagccaaaga

SEQ ID NO: 405065 - RNA, 18 nt, Homo sapiens
guggucugcugccucagg

SEQ ID NO: 405066 - RNA, 15 nt, Homo sapiens
guggucuugaucucc

SEQ ID NO: 405067 - RNA, 18 nt, Homo sapiens
guggugaucgcacaagga

SEQ ID NO: 405068 - RNA, 23 nt, Homo sapiens
guggugucauagaauagcauguu

SEQ ID NO: 405069 - RNA, 20 nt, Homo sapiens
gugguugggaaacucauuua

SEQ ID NO: 405070 - RNA, 16 nt, Homo sapiens
gugguuugcuccagaa

SEQ ID NO: 405071 - RNA, 17 nt, Homo sapiens
gugguuuucuguuucua

SEQ ID NO: 405072 - RNA, 18 nt, Homo sapiens
gugguuuucuuuugccau

SEQ ID NO: 405073 - RNA, 21 nt, Homo sapiens
guguaacuugugcuuuugcaa

SEQ ID NO: 405074 - RNA, 17 nt, Homo sapiens
guguaauuccucccuaa

SEQ ID NO: 405075 - RNA, 20 nt, Homo sapiens
guguacagugaaaagucucc

SEQ ID NO: 405076 - RNA, 23 nt, Homo sapiens
guguacuucuucauccauagaca

SEQ ID NO: 405077 - RNA, 20 nt, Homo sapiens
guguagcuguccucucagaa

SEQ ID NO: 405078 - RNA, 13 nt, Homo sapiens
guguagugucugu

SEQ ID NO: 405079 - RNA, 17 nt, Homo sapiens
guguaucucagcauuuu

SEQ ID NO: 405080 - RNA, 13 nt, Homo sapiens
guguaugcugaug

SEQ ID NO: 405081 - RNA, 21 nt, Homo sapiens
gugucaccaugagcaccucca

SEQ ID NO: 405082 - RNA, 14 nt, Homo sapiens
gugucacccugcag

SEQ ID NO: 405083 - RNA, 22 nt, Homo sapiens
gugucacuacucacagucucuu

SEQ ID NO: 405084 - RNA, 14 nt, Homo sapiens
gugucagagcuggg

SEQ ID NO: 405085 - RNA, 19 nt, Homo sapiens
guguccaugugugugcaag

SEQ ID NO: 405086 - RNA, 21 nt, Homo sapiens
guguccuguuuuuauucccuu

SEQ ID NO: 405087 - RNA, 20 nt, Homo sapiens
gugucucuaucuugcaucua

SEQ ID NO: 405088 - RNA, 16 nt, Homo sapiens
gugugacaucaguggc

SEQ ID NO: 405089 - RNA, 17 nt, Homo sapiens
gugugagugugugcaag

SEQ ID NO: 405090 - RNA, 16 nt, Homo sapiens
gugugcaaguguguau

SEQ ID NO: 405091 - RNA, 20 nt, Homo sapiens
gugugcaagugugugcacau

SEQ ID NO: 405092 - RNA, 20 nt, Homo sapiens
gugugcaagugugugcaugu

SEQ ID NO: 405093 - RNA, 14 nt, Homo sapiens
guguggagcacgug

SEQ ID NO: 405094 - RNA, 19 nt, Homo sapiens
gugugggcugugaguguaa

SEQ ID NO: 405095 - RNA, 21 nt, Homo sapiens
guguggggcgggggucuauac

SEQ ID NO: 405096 - RNA, 16 nt, Homo sapiens
gugugggggucuggga

SEQ ID NO: 405097 - RNA, 21 nt, Homo sapiens
guguguauauaguaugaaugc

SEQ ID NO: 405098 - RNA, 21 nt, Homo sapiens
guguguaugugcgugugugca

SEQ ID NO: 405099 - RNA, 13 nt, Homo sapiens
gugugugcaugug

SEQ ID NO: 405100 - RNA, 14 nt, Homo sapiens
gugugugugcaagu

SEQ ID NO: 405101 - RNA, 16 nt, Homo sapiens
gugugugugcaauguu

SEQ ID NO: 405102 - RNA, 10 nt, Homo sapiens
guguguuuca

SEQ ID NO: 405103 - RNA, 21 nt, Homo sapiens
guguuauuguauuagguguca

SEQ ID NO: 405104 - RNA, 21 nt, Homo sapiens
guguucccucucucccuccag

SEQ ID NO: 405105 - RNA, 12 nt, Homo sapiens
guguugcaaauu

SEQ ID NO: 405106 - RNA, 13 nt, Homo sapiens
uuucagguggaac

SEQ ID NO: 405107 - RNA, 11 nt, Homo sapiens
uuucaguaaua

SEQ ID NO: 405108 - RNA, 17 nt, Homo sapiens
uuucaguugacaaaaua

SEQ ID NO: 405109 - RNA, 18 nt, Homo sapiens
uuucauaaacuucaggga

SEQ ID NO: 405110 - RNA, 18 nt, Homo sapiens
uuucaucaccagacuuug

SEQ ID NO: 405111 - RNA, 14 nt, Homo sapiens
uuucaucagucaau

SEQ ID NO: 405112 - RNA, 20 nt, Homo sapiens
uuucauggguuauguguaug

SEQ ID NO: 405113 - RNA, 12 nt, Homo sapiens
uuucaugugauc

SEQ ID NO: 405114 - RNA, 19 nt, Homo sapiens
uuucauguuuugugacuau

SEQ ID NO: 405115 - RNA, 19 nt, Homo sapiens
uuucauuaguagcuaggug

SEQ ID NO: 405116 - RNA, 21 nt, Homo sapiens
uuucauucaaucaaccugcac

SEQ ID NO: 405117 - RNA, 21 nt, Homo sapiens
uuucauugcccgaaaccagag

SEQ ID NO: 405118 - RNA, 22 nt, Homo sapiens
uuucauugcugugucacacucu

SEQ ID NO: 405119 - RNA, 22 nt, Homo sapiens
uuucauuuugccaaaaaggggu

SEQ ID NO: 405120 - RNA, 16 nt, Homo sapiens
uuuccaauugaacuuu

SEQ ID NO: 405121 - RNA, 17 nt, Homo sapiens
uuuccaauuuuguugca

SEQ ID NO: 405122 - RNA, 17 nt, Homo sapiens
uuuccacauuugucaca

SEQ ID NO: 405123 - RNA, 12 nt, Homo sapiens
uuuccagaauug

SEQ ID NO: 405124 - RNA, 18 nt, Homo sapiens
uuuccagcugccaagugc

SEQ ID NO: 405125 - RNA, 22 nt, Homo sapiens
uuuccagggucuuuacugggaa

SEQ ID NO: 405126 - RNA, 18 nt, Homo sapiens
uuuccauauggauuuucu

SEQ ID NO: 405127 - RNA, 20 nt, Homo sapiens
uuuccauguaucuaccucac

SEQ ID NO: 405128 - RNA, 23 nt, Homo sapiens
uuuccauugcuuauucuugagca

SEQ ID NO: 405129 - RNA, 18 nt, Homo sapiens
uuuccgccagaccucaac

SEQ ID NO: 405130 - RNA, 20 nt, Homo sapiens
uuuccucgccuaggccugug

SEQ ID NO: 405131 - RNA, 15 nt, Homo sapiens
uuuccucuaacucau

SEQ ID NO: 405132 - RNA, 14 nt, Homo sapiens
uuuccucuauugau

SEQ ID NO: 405133 - RNA, 13 nt, Homo sapiens
uuuccucuugggc

SEQ ID NO: 405134 - RNA, 23 nt, Homo sapiens
uuuccuuuggcuauuaaaaaagu

SEQ ID NO: 405135 - RNA, 16 nt, Homo sapiens
uuucgugcacucugcu

SEQ ID NO: 405136 - RNA, 17 nt, Homo sapiens
uuucgugcacucugcua

SEQ ID NO: 405137 - RNA, 17 nt, Homo sapiens
guuagauguccucagaa

SEQ ID NO: 405138 - RNA, 14 nt, Homo sapiens
guuagccuggugac

SEQ ID NO: 405139 - RNA, 18 nt, Homo sapiens
guuaggaaauaaaaccuu

SEQ ID NO: 405140 - RNA, 23 nt, Homo sapiens
guuaguaauaaacgucuugccac

SEQ ID NO: 405141 - RNA, 20 nt, Homo sapiens
guuauaaaucaaugucacuu

SEQ ID NO: 405142 - RNA, 22 nt, Homo sapiens
guuauaaaucaaugucacuuaa

SEQ ID NO: 405143 - RNA, 23 nt, Homo sapiens
guuauccaacuauuaagauaucu

SEQ ID NO: 405144 - RNA, 17 nt, Homo sapiens
guuauccucuugcuaua

SEQ ID NO: 405145 - RNA, 11 nt, Homo sapiens
guuaugacucc

SEQ ID NO: 405146 - RNA, 15 nt, Homo sapiens
guuauuuuauugccu

SEQ ID NO: 405147 - RNA, 20 nt, Homo sapiens
guucaaaaaacucuugauau

SEQ ID NO: 405148 - RNA, 20 nt, Homo sapiens
guucaaaugcccuuccagug

SEQ ID NO: 405149 - RNA, 18 nt, Homo sapiens
guucaauuggacaauuau

SEQ ID NO: 405150 - RNA, 13 nt, Homo sapiens
guucacacuguaa

SEQ ID NO: 405151 - RNA, 22 nt, Homo sapiens
guucacaguagaguaggguaga

SEQ ID NO: 405152 - RNA, 20 nt, Homo sapiens
guucaccuguguacugagua

SEQ ID NO: 405153 - RNA, 16 nt, Homo sapiens
guucagagacuggcag

SEQ ID NO: 405154 - RNA, 23 nt, Homo sapiens
guucagagacuggcagccaggga

SEQ ID NO: 405155 - RNA, 20 nt, Homo sapiens
guucagcgucacaucugcag

SEQ ID NO: 405156 - RNA, 22 nt, Homo sapiens
guucagugggaaugcagugggu

SEQ ID NO: 405157 - RNA, 17 nt, Homo sapiens
guucauauuaagacaua

SEQ ID NO: 405158 - RNA, 20 nt, Homo sapiens
guucauguuuguaaauuaau

SEQ ID NO: 405159 - RNA, 17 nt, Homo sapiens
guucauguuuugcuaau

SEQ ID NO: 405160 - RNA, 13 nt, Homo sapiens
guucauuaccucc

SEQ ID NO: 405161 - RNA, 20 nt, Homo sapiens
guuccagcuucaucuacccu

SEQ ID NO: 405162 - RNA, 21 nt, Homo sapiens
guuccauccaccaccuugcca

SEQ ID NO: 405163 - RNA, 17 nt, Homo sapiens
guuccaugaagacaaau

SEQ ID NO: 405164 - RNA, 13 nt, Homo sapiens
guuccccacugac

SEQ ID NO: 405165 - RNA, 21 nt, Homo sapiens
guuccuaagccuguugcugaa

SEQ ID NO: 405166 - RNA, 16 nt, Homo sapiens
guuccucuuuguuuau

SEQ ID NO: 405167 - RNA, 22 nt, Homo sapiens
guuccugccaggcucucccucu

SEQ ID NO: 405168 - RNA, 13 nt, Homo sapiens
guucgaagcuccg

SEQ ID NO: 405169 - RNA, 12 nt, Homo sapiens
guucgugcuugu

SEQ ID NO: 405170 - RNA, 13 nt, Homo sapiens
guucuacuugaua

SEQ ID NO: 405171 - RNA, 17 nt, Homo sapiens
guucuagacuuccccau

SEQ ID NO: 405172 - RNA, 13 nt, Homo sapiens
guucuccacuaau

SEQ ID NO: 405173 - RNA, 19 nt, Homo sapiens
guucucuccccuugcacug

SEQ ID NO: 405174 - RNA, 24 nt, Homo sapiens
guucugcuucaauaaaucuuugga

SEQ ID NO: 405175 - RNA, 12 nt, Homo sapiens
guucuguucauc

SEQ ID NO: 405176 - RNA, 14 nt, Homo sapiens
guucuuacugcuug

SEQ ID NO: 405177 - RNA, 22 nt, Homo sapiens
guucuuguuuuauauaccuggc

SEQ ID NO: 405178 - RNA, 17 nt, Homo sapiens
guucuuuuuucuuuuga

SEQ ID NO: 405179 - RNA, 14 nt, Homo sapiens
guugacugcugcuc

SEQ ID NO: 405180 - RNA, 14 nt, Homo sapiens
guugagaacaaaaa

SEQ ID NO: 405181 - RNA, 22 nt, Homo sapiens
guugagcuucauauaccagcaa

SEQ ID NO: 405182 - RNA, 15 nt, Homo sapiens
guugauacuuguucc

SEQ ID NO: 405183 - RNA, 23 nt, Homo sapiens
guugauauauucuuuccaugcag

SEQ ID NO: 405184 - RNA, 11 nt, Homo sapiens
guugauuuucu

SEQ ID NO: 405185 - RNA, 12 nt, Homo sapiens
guugcacaaaaa

SEQ ID NO: 405186 - RNA, 18 nt, Homo sapiens
guugcagcugcucuugca

SEQ ID NO: 405187 - RNA, 17 nt, Homo sapiens
guugccaugugugcuga

SEQ ID NO: 405188 - RNA, 14 nt, Homo sapiens
guugcuaaugacag

SEQ ID NO: 405189 - RNA, 18 nt, Homo sapiens
guugcucaaaucuauuca

SEQ ID NO: 405190 - RNA, 22 nt, Homo sapiens
guugcucaaaucuauucagaca

SEQ ID NO: 405191 - RNA, 15 nt, Homo sapiens
guugcugaaacacac

SEQ ID NO: 405192 - RNA, 17 nt, Homo sapiens
guugcuguaagcaccug

SEQ ID NO: 405193 - RNA, 12 nt, Homo sapiens
guugcuuuuacg

SEQ ID NO: 405194 - RNA, 15 nt, Homo sapiens
guugcuuuuuuucca

SEQ ID NO: 405195 - RNA, 16 nt, Homo sapiens
guugcuuuuuuuccaa

SEQ ID NO: 405196 - RNA, 16 nt, Homo sapiens
guuggaccuauugcca

SEQ ID NO: 405197 - RNA, 19 nt, Homo sapiens
guuggaccuauugccagga

SEQ ID NO: 405198 - RNA, 21 nt, Homo sapiens
guuggggcugcgaccgccaga

SEQ ID NO: 405199 - RNA, 23 nt, Homo sapiens
guugggggcaguguuguggcccu

SEQ ID NO: 405200 - RNA, 15 nt, Homo sapiens
guuggguuccagaca

SEQ ID NO: 405201 - RNA, 23 nt, Homo sapiens
guuggugcugcuuucuuguugcu

SEQ ID NO: 405202 - RNA, 23 nt, Homo sapiens
guuguaauguguaugucugguaa

SEQ ID NO: 405203 - RNA, 16 nt, Homo sapiens
guuguacuacaguaua

SEQ ID NO: 405204 - RNA, 21 nt, Homo sapiens
guuguaguuaccuacugagua

SEQ ID NO: 405205 - RNA, 20 nt, Homo sapiens
guuguuaaugaaaaugucag

SEQ ID NO: 405206 - RNA, 10 nt, Homo sapiens
guuguucaua

SEQ ID NO: 405207 - RNA, 21 nt, Homo sapiens
guuguuuauauacaguacaca

SEQ ID NO: 405208 - RNA, 14 nt, Homo sapiens
guuuaaaagcaaaa

SEQ ID NO: 405209 - RNA, 17 nt, Homo sapiens
guuuaacucagaucacu

SEQ ID NO: 405210 - RNA, 12 nt, Homo sapiens
guuuaaggccac

SEQ ID NO: 405211 - RNA, 15 nt, Homo sapiens
guuuaagguucuugc

SEQ ID NO: 405212 - RNA, 20 nt, Homo sapiens
guuuacaaccuugugagcaa

SEQ ID NO: 405213 - RNA, 17 nt, Homo sapiens
guuuacagcacuacucu

SEQ ID NO: 405214 - RNA, 20 nt, Homo sapiens
guuuaccuaccguagcuuuu

SEQ ID NO: 405215 - RNA, 20 nt, Homo sapiens
guuuaccucacuggugcauu

SEQ ID NO: 405216 - RNA, 18 nt, Homo sapiens
guuuacgguacuugguaa

SEQ ID NO: 405217 - RNA, 19 nt, Homo sapiens
guuuagaaauuacaaguuu

SEQ ID NO: 405218 - RNA, 21 nt, Homo sapiens
guuuagacaguaugagucaau

SEQ ID NO: 405219 - RNA, 16 nt, Homo sapiens
guuuagcaacuuugau

SEQ ID NO: 405220 - RNA, 23 nt, Homo sapiens
guuuagccaaaggauaagugucc

SEQ ID NO: 405221 - RNA, 18 nt, Homo sapiens
guuuaguaauacagccug

SEQ ID NO: 405222 - RNA, 18 nt, Homo sapiens
guuuagugugauugugaa

SEQ ID NO: 405223 - RNA, 23 nt, Homo sapiens
guuuaugagaacugguucuugcc

SEQ ID NO: 405224 - RNA, 14 nt, Homo sapiens
guuuaugagccaga

SEQ ID NO: 405225 - RNA, 17 nt, Homo sapiens
guuuauugaaugugauu

SEQ ID NO: 405226 - RNA, 19 nt, Homo sapiens
guuuauugucaaaguggug

SEQ ID NO: 405227 - RNA, 19 nt, Homo sapiens
guuuauuuuuauacuuuca

SEQ ID NO: 405228 - RNA, 13 nt, Homo sapiens
guuucaguaauag

SEQ ID NO: 405229 - RNA, 18 nt, Homo sapiens
guuuccaaguuuauugcc

SEQ ID NO: 405230 - RNA, 17 nt, Homo sapiens
guuuccccaccagugaa

SEQ ID NO: 405231 - RNA, 23 nt, Homo sapiens
guuucccgcuccaagagaauuca

SEQ ID NO: 405232 - RNA, 13 nt, Homo sapiens
guuucuauacugu

SEQ ID NO: 405233 - RNA, 22 nt, Homo sapiens
guuucugagagagugccaugau

SEQ ID NO: 405234 - RNA, 14 nt, Homo sapiens
guuucuguuugaau

SEQ ID NO: 405235 - RNA, 14 nt, Homo sapiens
uuuuauaauacaaa

SEQ ID NO: 405236 - RNA, 14 nt, Homo sapiens
uuuuauacuuucag

SEQ ID NO: 405237 - RNA, 18 nt, Homo sapiens
uuuuaucuagaacauuca

SEQ ID NO: 405238 - RNA, 12 nt, Homo sapiens
uuuuaucucaca

SEQ ID NO: 405239 - RNA, 16 nt, Homo sapiens
uuuuaucucacaaaua

SEQ ID NO: 405240 - RNA, 18 nt, Homo sapiens
uuuucaaagauguguugc

SEQ ID NO: 405241 - RNA, 17 nt, Homo sapiens
uuuucagaguugcuuua

SEQ ID NO: 405242 - RNA, 19 nt, Homo sapiens
uuuucagcucuuugacaac

SEQ ID NO: 405243 - RNA, 14 nt, Homo sapiens
uuuucaguaccaaa

SEQ ID NO: 405244 - RNA, 21 nt, Homo sapiens
uuuucaugaccaauccuaugu

SEQ ID NO: 405245 - RNA, 11 nt, Homo sapiens
uuuucauucau

SEQ ID NO: 405246 - RNA, 23 nt, Homo sapiens
uuuucauugcccgaaaccagagc

SEQ ID NO: 405247 - RNA, 20 nt, Homo sapiens
uuuuccacggaaacagaacu

SEQ ID NO: 405248 - RNA, 18 nt, Homo sapiens
uuuuccaugacugcauuu

SEQ ID NO: 405249 - RNA, 19 nt, Homo sapiens
uuuucccagcccuuuccag

SEQ ID NO: 405250 - RNA, 20 nt, Homo sapiens
uuuuccccucauugcauuua

SEQ ID NO: 405251 - RNA, 21 nt, Homo sapiens
uuuucccgagcaaagucuaaa

SEQ ID NO: 405252 - RNA, 18 nt, Homo sapiens
uuuuccuaugcaguguca

SEQ ID NO: 405253 - RNA, 16 nt, Homo sapiens
uuuucuauauggggau

SEQ ID NO: 405254 - RNA, 19 nt, Homo sapiens
uuuucuguaaauggaacaa

SEQ ID NO: 405255 - RNA, 22 nt, Homo sapiens
uuuucugugagaauaaagcauu

SEQ ID NO: 405256 - RNA, 17 nt, Homo sapiens
uuuucugugcacuguag

SEQ ID NO: 405257 - RNA, 15 nt, Homo sapiens
uuuucuugccaauga

SEQ ID NO: 405258 - RNA, 13 nt, Homo sapiens
uuuucuugguguu

SEQ ID NO: 405259 - RNA, 18 nt, Homo sapiens
uuuucuuuccuccccacc

SEQ ID NO: 405260 - RNA, 15 nt, Homo sapiens
uuuugaaaacacuua

SEQ ID NO: 405261 - RNA, 13 nt, Homo sapiens
uuuugaacauacu

SEQ ID NO: 405262 - RNA, 18 nt, Homo sapiens
uuuugacaucagcauuag

SEQ ID NO: 405263 - RNA, 14 nt, Homo sapiens
uuuugaguaucucg

SEQ ID NO: 405264 - RNA, 14 nt, Homo sapiens
uuuugauagcuuua

SEQ ID NO: 405265 - RNA, 22 nt, Homo sapiens
uuuugcacagacaucuccucac

SEQ ID NO: 405266 - RNA, 14 nt, Homo sapiens
uuuugcacauucua

SEQ ID NO: 405267 - RNA, 15 nt, Homo sapiens
uuuugccacauuagc

SEQ ID NO: 405268 - RNA, 21 nt, Homo sapiens
uuuugccagugaagccuccaa

SEQ ID NO: 405269 - RNA, 15 nt, Homo sapiens
uuuugcucugcucug

SEQ ID NO: 405270 - RNA, 20 nt, Homo sapiens
uuuugcuggucacugccaug

SEQ ID NO: 405271 - RNA, 14 nt, Homo sapiens
uaaaaaacugugaa

SEQ ID NO: 405272 - RNA, 13 nt, Homo sapiens
uaaaaaauaucuu

SEQ ID NO: 405273 - RNA, 19 nt, Homo sapiens
uaaaaaccccaaacuguug

SEQ ID NO: 405274 - RNA, 18 nt, Homo sapiens
uaaaaagcagcugcauuu

SEQ ID NO: 405275 - RNA, 20 nt, Homo sapiens
uaaaaagccugcaauuucau

SEQ ID NO: 405276 - RNA, 20 nt, Homo sapiens
uaaaaagugacacagcagcu

SEQ ID NO: 405277 - RNA, 13 nt, Homo sapiens
uaaaaaguuauaa

SEQ ID NO: 405278 - RNA, 12 nt, Homo sapiens
uaaaaaguugca

SEQ ID NO: 405279 - RNA, 18 nt, Homo sapiens
uaaaaaucauaguacucu

SEQ ID NO: 405280 - RNA, 18 nt, Homo sapiens
uaaaaauggauacuggug

SEQ ID NO: 405281 - RNA, 13 nt, Homo sapiens
uaaaaauguccug

SEQ ID NO: 405282 - RNA, 15 nt, Homo sapiens
uaaaaauucauauaa

SEQ ID NO: 405283 - RNA, 15 nt, Homo sapiens
uaaaaauugugauca

SEQ ID NO: 405284 - RNA, 21 nt, Homo sapiens
uaaaacaaaacaaacaaccug

SEQ ID NO: 405285 - RNA, 11 nt, Homo sapiens
uaaaaccacua

SEQ ID NO: 405286 - RNA, 21 nt, Homo sapiens
uaaaacucaaccccuucgaua

SEQ ID NO: 405287 - RNA, 14 nt, Homo sapiens
uaaaacugugacau

SEQ ID NO: 405288 - RNA, 20 nt, Homo sapiens
uaaaacuuaccuaagugaca

SEQ ID NO: 405289 - RNA, 23 nt, Homo sapiens
uaaaacuucugauuucucuucag

SEQ ID NO: 405290 - RNA, 18 nt, Homo sapiens
uaaaacuuuauguacugc

SEQ ID NO: 405291 - RNA, 12 nt, Homo sapiens
uaaaacuuuccu

SEQ ID NO: 405292 - RNA, 17 nt, Homo sapiens
uaaaagacaagcacuuu

SEQ ID NO: 405293 - RNA, 11 nt, Homo sapiens
uaaaagacagc

SEQ ID NO: 405294 - RNA, 19 nt, Homo sapiens
uaaaagacaugaaauugag

SEQ ID NO: 405295 - RNA, 16 nt, Homo sapiens
uaaaagcccuuuccaa

SEQ ID NO: 405296 - RNA, 22 nt, Homo sapiens
uaaaagccuaugugccuuucac

SEQ ID NO: 405297 - RNA, 18 nt, Homo sapiens
uaaaagggaaagaaggcc

SEQ ID NO: 405298 - RNA, 14 nt, Homo sapiens
uaaaaguauaacuu

SEQ ID NO: 405299 - RNA, 13 nt, Homo sapiens
uaaaagucuacca

SEQ ID NO: 405300 - RNA, 17 nt, Homo sapiens
uaaaagugcuacuugag

SEQ ID NO: 405301 - RNA, 13 nt, Homo sapiens
uaaaaguugcaaa

SEQ ID NO: 405302 - RNA, 17 nt, Homo sapiens
uaaaauaaaaugcagac

SEQ ID NO: 405303 - RNA, 14 nt, Homo sapiens
uaaaauaaaccaga

SEQ ID NO: 405304 - RNA, 15 nt, Homo sapiens
uaaaauaacuaagca

SEQ ID NO: 405305 - RNA, 14 nt, Homo sapiens
uaaaauaagcacag

SEQ ID NO: 405306 - RNA, 15 nt, Homo sapiens
uaaaauaagcuauau

SEQ ID NO: 405307 - RNA, 14 nt, Homo sapiens
uaaaauaguagcau

SEQ ID NO: 405308 - RNA, 14 nt, Homo sapiens
uaaaaucagacucu

SEQ ID NO: 405309 - RNA, 16 nt, Homo sapiens
uaaaaucaggauuuua

SEQ ID NO: 405310 - RNA, 20 nt, Homo sapiens
uaaaauccaagcugcucauu

SEQ ID NO: 405311 - RNA, 18 nt, Homo sapiens
uaaaaucuuuccaucuca

SEQ ID NO: 405312 - RNA, 15 nt, Homo sapiens
uaaaaugcauugaaa

SEQ ID NO: 405313 - RNA, 22 nt, Homo sapiens
uaaaauuacaguggauugcuca

SEQ ID NO: 405314 - RNA, 16 nt, Homo sapiens
uaaaauuacugaugca

SEQ ID NO: 405315 - RNA, 20 nt, Homo sapiens
uaaaauuagaggauugcacu

SEQ ID NO: 405316 - RNA, 23 nt, Homo sapiens
uaaaauuagaggauugcacuaga

SEQ ID NO: 405317 - RNA, 15 nt, Homo sapiens
uaaaauuagcuugag

SEQ ID NO: 405318 - RNA, 18 nt, Homo sapiens
uaaaauugcagcaguugc

SEQ ID NO: 405319 - RNA, 14 nt, Homo sapiens
uaaaauuggcacca

SEQ ID NO: 405320 - RNA, 22 nt, Homo sapiens
uaaacaaacuguguaacugccc

SEQ ID NO: 405321 - RNA, 21 nt, Homo sapiens
uaaacaaucuuagacauuuau

SEQ ID NO: 405322 - RNA, 22 nt, Homo sapiens
uaaacacaauccuuuguucucc

SEQ ID NO: 405323 - RNA, 15 nt, Homo sapiens
uaaacacuagacugu

SEQ ID NO: 405324 - RNA, 16 nt, Homo sapiens
uaaacacuagacugua

SEQ ID NO: 405325 - RNA, 18 nt, Homo sapiens
uaaacacuagacuguauc

SEQ ID NO: 405326 - RNA, 17 nt, Homo sapiens
uaaacacuguauuguaa

SEQ ID NO: 405327 - RNA, 17 nt, Homo sapiens
uaaacagcuucaugccu

SEQ ID NO: 405328 - RNA, 21 nt, Homo sapiens
uaaacauucaucaagcuguac

SEQ ID NO: 405329 - RNA, 17 nt, Homo sapiens
uaaacauugaaguaaug

SEQ ID NO: 405330 - RNA, 19 nt, Homo sapiens
uaaaccaguccuuagcaag

SEQ ID NO: 405331 - RNA, 19 nt, Homo sapiens
uaaaccuagaguuuuauca

SEQ ID NO: 405332 - RNA, 20 nt, Homo sapiens
uaaaccuagaguuuuaucaa

SEQ ID NO: 405333 - RNA, 14 nt, Homo sapiens
uaaaccugggcaag

SEQ ID NO: 405334 - RNA, 16 nt, Homo sapiens
uaaacgugaugugcuc

SEQ ID NO: 405335 - RNA, 13 nt, Homo sapiens
uaaacuacugauu

SEQ ID NO: 405336 - RNA, 16 nt, Homo sapiens
uaaacucacaacucuc

SEQ ID NO: 405337 - RNA, 21 nt, Homo sapiens
uaaacucagaauauacccauc

SEQ ID NO: 405338 - RNA, 16 nt, Homo sapiens
uaaacucugcacuuau

SEQ ID NO: 405339 - RNA, 14 nt, Homo sapiens
uaaacugaacauau

SEQ ID NO: 405340 - RNA, 20 nt, Homo sapiens
uaaacugugguccaucucca

SEQ ID NO: 405341 - RNA, 21 nt, Homo sapiens
uaaacuuaccugggcauucuu

SEQ ID NO: 405342 - RNA, 14 nt, Homo sapiens
uaaacuucagggau

SEQ ID NO: 405343 - RNA, 15 nt, Homo sapiens
uaaacuugaugccag

SEQ ID NO: 405344 - RNA, 15 nt, Homo sapiens
uaaagaaacacuuuc

SEQ ID NO: 405345 - RNA, 14 nt, Homo sapiens
uaaagaaugcaauc

SEQ ID NO: 405346 - RNA, 23 nt, Homo sapiens
uaaagaaugcaauccaugccaua

SEQ ID NO: 405347 - RNA, 10 nt, Homo sapiens
uaaagacaga

SEQ ID NO: 405348 - RNA, 20 nt, Homo sapiens
uaaagacauaggaacaugua

SEQ ID NO: 405349 - RNA, 10 nt, Homo sapiens
uaaagacuua

SEQ ID NO: 405350 - RNA, 16 nt, Homo sapiens
uaaagacuugaugaau

SEQ ID NO: 405351 - RNA, 19 nt, Homo sapiens
uaaagagagaauguagaua

SEQ ID NO: 405352 - RNA, 20 nt, Homo sapiens
uaaagagagaauguagauau

SEQ ID NO: 405353 - RNA, 16 nt, Homo sapiens
uaaagaggcgucuugu

SEQ ID NO: 405354 - RNA, 18 nt, Homo sapiens
uaaagaugaucuacucag

SEQ ID NO: 405355 - RNA, 19 nt, Homo sapiens
uaaagcaguagacaauccc

SEQ ID NO: 405356 - RNA, 14 nt, Homo sapiens
uaaagcuauuuccu

SEQ ID NO: 405357 - RNA, 13 nt, Homo sapiens
uaaagcugcugag

SEQ ID NO: 405358 - RNA, 14 nt, Homo sapiens
uaaaggacaaacag

SEQ ID NO: 405359 - RNA, 17 nt, Homo sapiens
uaaaggacaaacaguga

SEQ ID NO: 405360 - RNA, 16 nt, Homo sapiens
uaaaggcauuucaaag

SEQ ID NO: 405361 - RNA, 12 nt, Homo sapiens
uaaaggccucuu

SEQ ID NO: 405362 - RNA, 20 nt, Homo sapiens
uaaaggcuuaggacuucaaa

SEQ ID NO: 405363 - RNA, 20 nt, Homo sapiens
uaaaggggcugucucccaau

SEQ ID NO: 405364 - RNA, 14 nt, Homo sapiens
uaaaggucccuuag

SEQ ID NO: 405365 - RNA, 19 nt, Homo sapiens
uaaagguuucacuguucau

SEQ ID NO: 405366 - RNA, 17 nt, Homo sapiens
uaaugacuuaagcacac

SEQ ID NO: 405367 - RNA, 19 nt, Homo sapiens
uaaugagcguuaacacagu

SEQ ID NO: 405368 - RNA, 21 nt, Homo sapiens
uaaugaggugguacuaugauu

SEQ ID NO: 405369 - RNA, 22 nt, Homo sapiens
uaaugcuuccccacgggaacau

SEQ ID NO: 405370 - RNA, 15 nt, Homo sapiens
uaauggaugcucauu

SEQ ID NO: 405371 - RNA, 16 nt, Homo sapiens
uaauggaugcucauuc

SEQ ID NO: 405372 - RNA, 12 nt, Homo sapiens
uaauggcauuuu

SEQ ID NO: 405373 - RNA, 19 nt, Homo sapiens
uaauggccccuccauuuau

SEQ ID NO: 405374 - RNA, 16 nt, Homo sapiens
uaauguaaaauucaua

SEQ ID NO: 405375 - RNA, 21 nt, Homo sapiens
uaauguaggacuguauaggua

SEQ ID NO: 405376 - RNA, 15 nt, Homo sapiens
uaaugucagucuaca

SEQ ID NO: 405377 - RNA, 23 nt, Homo sapiens
uaauguguaugucugguaaauag

SEQ ID NO: 405378 - RNA, 20 nt, Homo sapiens
uaauguuaauucagcacuga

SEQ ID NO: 405379 - RNA, 22 nt, Homo sapiens
uaauguuacugaucaugcauug

SEQ ID NO: 405380 - RNA, 13 nt, Homo sapiens
uaauguugcuuag

SEQ ID NO: 405381 - RNA, 20 nt, Homo sapiens
uaauguuuuguaauuuugca

SEQ ID NO: 405382 - RNA, 20 nt, Homo sapiens
uaauuaucgggaacaguguu

SEQ ID NO: 405383 - RNA, 22 nt, Homo sapiens
uaauuaugggaacaaguguaca

SEQ ID NO: 405384 - RNA, 14 nt, Homo sapiens
uaauucagcacuga

SEQ ID NO: 405385 - RNA, 19 nt, Homo sapiens
uaauucagcacugauuuca

SEQ ID NO: 405386 - RNA, 15 nt, Homo sapiens
uaauuccccuuccau

SEQ ID NO: 405387 - RNA, 17 nt, Homo sapiens
uaauuccgaaacauaca

SEQ ID NO: 405388 - RNA, 14 nt, Homo sapiens
uaauucuauacugu

SEQ ID NO: 405389 - RNA, 14 nt, Homo sapiens
uaauucugaugcua

SEQ ID NO: 405390 - RNA, 19 nt, Homo sapiens
uaauucuguauuaacugaa

SEQ ID NO: 405391 - RNA, 19 nt, Homo sapiens
uaauugucaaaaaccagaa

SEQ ID NO: 405392 - RNA, 19 nt, Homo sapiens
uaauuuaaaaaauaacuac

SEQ ID NO: 405393 - RNA, 16 nt, Homo sapiens
uaauuuacagcuuuca

SEQ ID NO: 405394 - RNA, 19 nt, Homo sapiens
uaauuuaccugaagucuuu

SEQ ID NO: 405395 - RNA, 23 nt, Homo sapiens
uaauuuacuguugcccauugcac

SEQ ID NO: 405396 - RNA, 14 nt, Homo sapiens
uaauuuaucagauu

SEQ ID NO: 405397 - RNA, 17 nt, Homo sapiens
uaauuucauugucucua

SEQ ID NO: 405398 - RNA, 21 nt, Homo sapiens
uaauuucugaaaugugcagcu

SEQ ID NO: 405399 - RNA, 14 nt, Homo sapiens
uaauuucuguccag

SEQ ID NO: 405400 - RNA, 13 nt, Homo sapiens
uaauuucuucaca

SEQ ID NO: 405401 - RNA, 14 nt, Homo sapiens
uaauuuguaucuga

SEQ ID NO: 405402 - RNA, 16 nt, Homo sapiens
uaauuugucacuggaa

SEQ ID NO: 405403 - RNA, 20 nt, Homo sapiens
uaauuuugugcucuuuccug

SEQ ID NO: 405404 - RNA, 19 nt, Homo sapiens
uacaaaaacauggccuuug

SEQ ID NO: 405405 - RNA, 21 nt, Homo sapiens
uacaaaaauuguucaaccuaa

SEQ ID NO: 405406 - RNA, 18 nt, Homo sapiens
uacaaaagauguauccuu

SEQ ID NO: 405407 - RNA, 16 nt, Homo sapiens
uacaaaagcaaaguga

SEQ ID NO: 405408 - RNA, 21 nt, Homo sapiens
uacaaauacuaucucuguauu

SEQ ID NO: 405409 - RNA, 21 nt, Homo sapiens
uacaaauagaagcuucuugcu

SEQ ID NO: 405410 - RNA, 22 nt, Homo sapiens
uacaaaugccaaaauucauuca

SEQ ID NO: 405411 - RNA, 18 nt, Homo sapiens
uacaaauguuagagccau

SEQ ID NO: 405412 - RNA, 15 nt, Homo sapiens
uacaacaaacacugu

SEQ ID NO: 405413 - RNA, 15 nt, Homo sapiens
uacaaccaauuccaa

SEQ ID NO: 405414 - RNA, 23 nt, Homo sapiens
uacaacugaucauuugcagcugc

SEQ ID NO: 405415 - RNA, 22 nt, Homo sapiens
uacaagaagagaaagaccagug

SEQ ID NO: 405416 - RNA, 15 nt, Homo sapiens
uacaagagccaugua

SEQ ID NO: 405417 - RNA, 13 nt, Homo sapiens
uacaaguguauau

SEQ ID NO: 405418 - RNA, 17 nt, Homo sapiens
uacaaguuucagacagg

SEQ ID NO: 405419 - RNA, 17 nt, Homo sapiens
uacaaguuucaguaaua

SEQ ID NO: 405420 - RNA, 20 nt, Homo sapiens
uacaauaggugcuuauucuc

SEQ ID NO: 405421 - RNA, 23 nt, Homo sapiens
uacaaucaggagugguggaaccu

SEQ ID NO: 405422 - RNA, 18 nt, Homo sapiens
uacaauguaucaacauau

SEQ ID NO: 405423 - RNA, 17 nt, Homo sapiens
uacaauucagucuucuc

SEQ ID NO: 405424 - RNA, 20 nt, Homo sapiens
uacaauucuuuguugcuuaa

SEQ ID NO: 405425 - RNA, 21 nt, Homo sapiens
uacaauucuuuguugcuuaau

SEQ ID NO: 405426 - RNA, 11 nt, Homo sapiens
uacaauuguga

SEQ ID NO: 405427 - RNA, 16 nt, Homo sapiens
uacaauuuucauccca

SEQ ID NO: 405428 - RNA, 16 nt, Homo sapiens
uacacaaaccugaaaa

SEQ ID NO: 405429 - RNA, 14 nt, Homo sapiens
uacacaacauguau

SEQ ID NO: 405430 - RNA, 15 nt, Homo sapiens
uacacaaggaaggca

SEQ ID NO: 405431 - RNA, 23 nt, Homo sapiens
uacacaaggaaggcauuuggacc

SEQ ID NO: 405432 - RNA, 15 nt, Homo sapiens
uacacccaccagagu

SEQ ID NO: 405433 - RNA, 16 nt, Homo sapiens
uacacguggaggaaug

SEQ ID NO: 405434 - RNA, 13 nt, Homo sapiens
uacacuacaaaug

SEQ ID NO: 405435 - RNA, 22 nt, Homo sapiens
uacacugaaucauuaacagugc

SEQ ID NO: 405436 - RNA, 16 nt, Homo sapiens
uacacugacuugagac

SEQ ID NO: 405437 - RNA, 21 nt, Homo sapiens
uacacuuggagcccgugcagu

SEQ ID NO: 405438 - RNA, 23 nt, Homo sapiens
uacagacaaagcgugguggacau

SEQ ID NO: 405439 - RNA, 16 nt, Homo sapiens
uacagacaugaaccac

SEQ ID NO: 405440 - RNA, 17 nt, Homo sapiens
uacagauccgcaugugu

SEQ ID NO: 405441 - RNA, 18 nt, Homo sapiens
uacagauugcugcuucug

SEQ ID NO: 405442 - RNA, 18 nt, Homo sapiens
uacagauuuaguuuacca

SEQ ID NO: 405443 - RNA, 17 nt, Homo sapiens
uacagcaaauguuauag

SEQ ID NO: 405444 - RNA, 22 nt, Homo sapiens
uacagcuaaucagcauucucac

SEQ ID NO: 405445 - RNA, 21 nt, Homo sapiens
uacagcucuuggcauuuuccu

SEQ ID NO: 405446 - RNA, 23 nt, Homo sapiens
uacaggaagcaccccaugccaaa

SEQ ID NO: 405447 - RNA, 14 nt, Homo sapiens
uacaggcacccacc

SEQ ID NO: 405448 - RNA, 14 nt, Homo sapiens
uacaggcgugagcc

SEQ ID NO: 405449 - RNA, 19 nt, Homo sapiens
uacaggugaaggcucucac

SEQ ID NO: 405450 - RNA, 17 nt, Homo sapiens
uacaguaaauaaauugu

SEQ ID NO: 405451 - RNA, 12 nt, Homo sapiens
uacaguaugugu

SEQ ID NO: 405452 - RNA, 15 nt, Homo sapiens
uacagucugucauga

SEQ ID NO: 405453 - RNA, 18 nt, Homo sapiens
uacagucugucaugaaca

SEQ ID NO: 405454 - RNA, 23 nt, Homo sapiens
uacaguuaauuaugugcauauua

SEQ ID NO: 405455 - RNA, 16 nt, Homo sapiens
uacaguucugucauau

SEQ ID NO: 405456 - RNA, 16 nt, Homo sapiens
uacaguugaugucgau

SEQ ID NO: 405457 - RNA, 20 nt, Homo sapiens
uacaguuugagacuuccaaa

SEQ ID NO: 405458 - RNA, 19 nt, Homo sapiens
uacauaaaguauccaugca

SEQ ID NO: 405459 - RNA, 22 nt, Homo sapiens
uacauaaaguauccaugcaugu

SEQ ID NO: 405460 - RNA, 15 nt, Homo sapiens
uacauaugaggacaa

SEQ ID NO: 405461 - RNA, 18 nt, Homo sapiens
uacaucaaugguguguua

SEQ ID NO: 405462 - RNA, 18 nt, Homo sapiens
uacauccagucacuuugc

SEQ ID NO: 405463 - RNA, 20 nt, Homo sapiens
uacaucuagcacagcuguga

SEQ ID NO: 405464 - RNA, 21 nt, Homo sapiens
uacaucugcaauaugaauuca

SEQ ID NO: 405465 - RNA, 19 nt, Homo sapiens
uacaucuguguucuaugca

SEQ ID NO: 405466 - RNA, 15 nt, Homo sapiens
uacaugaauugcauu

SEQ ID NO: 405467 - RNA, 20 nt, Homo sapiens
uacaugaugauuucagaaac

SEQ ID NO: 405468 - RNA, 19 nt, Homo sapiens
uacaugcaaggcacuguac

SEQ ID NO: 405469 - RNA, 16 nt, Homo sapiens
uacaugugauugugau

SEQ ID NO: 405470 - RNA, 19 nt, Homo sapiens
uacaugugccgaaugugca

SEQ ID NO: 405471 - RNA, 17 nt, Homo sapiens
uacauuguauaggccau

SEQ ID NO: 405472 - RNA, 19 nt, Homo sapiens
uacauugugggauguucag

SEQ ID NO: 405473 - RNA, 15 nt, Homo sapiens
uacauuuaauacagc

SEQ ID NO: 405474 - RNA, 18 nt, Homo sapiens
uacauuuagcuuguucac

SEQ ID NO: 405475 - RNA, 21 nt, Homo sapiens
uacauuucauaaggccugccc

SEQ ID NO: 405476 - RNA, 15 nt, Homo sapiens
uacauuuggugcacu

SEQ ID NO: 405477 - RNA, 20 nt, Homo sapiens
uacauuuucaguaccaaaga

SEQ ID NO: 405478 - RNA, 22 nt, Homo sapiens
uacauuuuugucuuuaucucaa

SEQ ID NO: 405479 - RNA, 18 nt, Homo sapiens
uaccaaagaagaguuuac

SEQ ID NO: 405480 - RNA, 13 nt, Homo sapiens
uaccaaaugccuu

SEQ ID NO: 405481 - RNA, 14 nt, Homo sapiens
uaccaaugcaugca

SEQ ID NO: 405482 - RNA, 22 nt, Homo sapiens
uaccacaauucauuuacccauu

SEQ ID NO: 405483 - RNA, 22 nt, Homo sapiens
uaccaccaagaggaaaauauug

SEQ ID NO: 405484 - RNA, 12 nt, Homo sapiens
uaccacugcuaa

SEQ ID NO: 405485 - RNA, 14 nt, Homo sapiens
uaccagaugcugac

SEQ ID NO: 405486 - RNA, 16 nt, Homo sapiens
uaccagcgcucuaaaa

SEQ ID NO: 405487 - RNA, 22 nt, Homo sapiens
uaccaggccgccccagccucug

SEQ ID NO: 405488 - RNA, 12 nt, Homo sapiens
uaccaguacuug

SEQ ID NO: 405489 - RNA, 14 nt, Homo sapiens
uaccaguacuugag

SEQ ID NO: 405490 - RNA, 14 nt, Homo sapiens
uaccauacaauaua

SEQ ID NO: 405491 - RNA, 20 nt, Homo sapiens
uaccauguggccauuaacaa

SEQ ID NO: 405492 - RNA, 12 nt, Homo sapiens
uacccacauuac

SEQ ID NO: 405493 - RNA, 21 nt, Homo sapiens
uacccacccuaauuugcccuu

SEQ ID NO: 405494 - RNA, 14 nt, Homo sapiens
uacccagacucaga

SEQ ID NO: 405495 - RNA, 20 nt, Homo sapiens
uacccagagaauauauacau

SEQ ID NO: 405496 - RNA, 19 nt, Homo sapiens
uacccauagcuuccaugag

SEQ ID NO: 405497 - RNA, 20 nt, Homo sapiens
uaaauucuauaggaacauau

SEQ ID NO: 405498 - RNA, 22 nt, Homo sapiens
uaaauucucucuaacauaacaa

SEQ ID NO: 405499 - RNA, 19 nt, Homo sapiens
uaaauugacccuagccaga

SEQ ID NO: 405500 - RNA, 19 nt, Homo sapiens
uaaauugcuccuugacauu

SEQ ID NO: 405501 - RNA, 20 nt, Homo sapiens
uaaauuggugauaaguggaa

SEQ ID NO: 405502 - RNA, 16 nt, Homo sapiens
uaaauuugacuguuau

SEQ ID NO: 405503 - RNA, 17 nt, Homo sapiens
uaaauuugguucuaggc

SEQ ID NO: 405504 - RNA, 21 nt, Homo sapiens
uaaauuuguacuauuuaacug

SEQ ID NO: 405505 - RNA, 19 nt, Homo sapiens
uaaauuuuaaguaucccau

SEQ ID NO: 405506 - RNA, 14 nt, Homo sapiens
uaaauuuugugaua

SEQ ID NO: 405507 - RNA, 16 nt, Homo sapiens
uaacaaaagcaauugu

SEQ ID NO: 405508 - RNA, 17 nt, Homo sapiens
uaacaaagugagaccuc

SEQ ID NO: 405509 - RNA, 18 nt, Homo sapiens
uaacaacaauaacacugu

SEQ ID NO: 405510 - RNA, 14 nt, Homo sapiens
uaacaacucuaguc

SEQ ID NO: 405511 - RNA, 18 nt, Homo sapiens
uaacaacuugaauuacaa

SEQ ID NO: 405512 - RNA, 20 nt, Homo sapiens
uaacaaguagcacccuggau

SEQ ID NO: 405513 - RNA, 11 nt, Homo sapiens
uaacaaugaag

SEQ ID NO: 405514 - RNA, 19 nt, Homo sapiens
uaacacagagagacagacu

SEQ ID NO: 405515 - RNA, 20 nt, Homo sapiens
uaacacaugaauuucugcca

SEQ ID NO: 405516 - RNA, 14 nt, Homo sapiens
uaacacuguacugc

SEQ ID NO: 405517 - RNA, 21 nt, Homo sapiens
uaacaggcauugcacuaaaag

SEQ ID NO: 405518 - RNA, 17 nt, Homo sapiens
uaacagguuuucuucua

SEQ ID NO: 405519 - RNA, 15 nt, Homo sapiens
uaacauauauuguua

SEQ ID NO: 405520 - RNA, 15 nt, Homo sapiens
uaacaucaaagacuc

SEQ ID NO: 405521 - RNA, 20 nt, Homo sapiens
uaacaucccaauaaaguccu

SEQ ID NO: 405522 - RNA, 20 nt, Homo sapiens
uaacaugucuuucagcauua

SEQ ID NO: 405523 - RNA, 20 nt, Homo sapiens
uaacccgcucaucacuggau

SEQ ID NO: 405524 - RNA, 14 nt, Homo sapiens
uaacccuacaugca

SEQ ID NO: 405525 - RNA, 16 nt, Homo sapiens
uaaccuagaaguauuu

SEQ ID NO: 405526 - RNA, 15 nt, Homo sapiens
uaaccuagauguuua

SEQ ID NO: 405527 - RNA, 14 nt, Homo sapiens
uaaccucaguguca

SEQ ID NO: 405528 - RNA, 18 nt, Homo sapiens
uaaccucugcacuacuga

SEQ ID NO: 405529 - RNA, 22 nt, Homo sapiens
uaaccugcaaaaucuguucuaa

SEQ ID NO: 405530 - RNA, 12 nt, Homo sapiens
uaaccuggugcu

SEQ ID NO: 405531 - RNA, 17 nt, Homo sapiens
uaaccuuuaagucuuac

SEQ ID NO: 405532 - RNA, 18 nt, Homo sapiens
uaacgaaugguacuacaa

SEQ ID NO: 405533 - RNA, 14 nt, Homo sapiens
uaacgacuucaggg

SEQ ID NO: 405534 - RNA, 14 nt, Homo sapiens
uaacgcgucuuccu

SEQ ID NO: 405535 - RNA, 12 nt, Homo sapiens
uaacuacugugu

SEQ ID NO: 405536 - RNA, 12 nt, Homo sapiens
uaacuagaauuu

SEQ ID NO: 405537 - RNA, 19 nt, Homo sapiens
uaacuaguauuguccauau

SEQ ID NO: 405538 - RNA, 19 nt, Homo sapiens
uaacuaguguuucugcaga

SEQ ID NO: 405539 - RNA, 18 nt, Homo sapiens
uaacucaccucucaaggu

SEQ ID NO: 405540 - RNA, 19 nt, Homo sapiens
uaacuccuagcugacucag

SEQ ID NO: 405541 - RNA, 11 nt, Homo sapiens
uaacugagauu

SEQ ID NO: 405542 - RNA, 14 nt, Homo sapiens
uaacugagauuaca

SEQ ID NO: 405543 - RNA, 22 nt, Homo sapiens
uaacuggcuucugcuugucauc

SEQ ID NO: 405544 - RNA, 18 nt, Homo sapiens
uaacuuauuuuauuucca

SEQ ID NO: 405545 - RNA, 12 nt, Homo sapiens
uaacuugagggu

SEQ ID NO: 405546 - RNA, 14 nt, Homo sapiens
uaacuugugcuuuu

SEQ ID NO: 405547 - RNA, 22 nt, Homo sapiens
uaacuuguuugguaguuagcca

SEQ ID NO: 405548 - RNA, 14 nt, Homo sapiens
uaacuuugcccuuc

SEQ ID NO: 405549 - RNA, 16 nt, Homo sapiens
uaagaaaaacauguca

SEQ ID NO: 405550 - RNA, 16 nt, Homo sapiens
uaagaaaacaaucaca

SEQ ID NO: 405551 - RNA, 15 nt, Homo sapiens
uaagaaaacauguaa

SEQ ID NO: 405552 - RNA, 22 nt, Homo sapiens
uaagaaccuuuugagugccuua

SEQ ID NO: 405553 - RNA, 13 nt, Homo sapiens
uaagaaguagcaa

SEQ ID NO: 405554 - RNA, 16 nt, Homo sapiens
uaagaaguuccacuua

SEQ ID NO: 405555 - RNA, 18 nt, Homo sapiens
uaagacacacagccuuuc

SEQ ID NO: 405556 - RNA, 15 nt, Homo sapiens
uaagacagagucuca

SEQ ID NO: 405557 - RNA, 19 nt, Homo sapiens
uaagacugugacaacuguc

SEQ ID NO: 405558 - RNA, 18 nt, Homo sapiens
uaagagaacucuccucuu

SEQ ID NO: 405559 - RNA, 14 nt, Homo sapiens
uaagagauaauugu

SEQ ID NO: 405560 - RNA, 14 nt, Homo sapiens
uaagauacacuccu

SEQ ID NO: 405561 - RNA, 14 nt, Homo sapiens
uaagauuacaagau

SEQ ID NO: 405562 - RNA, 23 nt, Homo sapiens
uaagauuguccagugcaaccaca

SEQ ID NO: 405563 - RNA, 16 nt, Homo sapiens
uaagcacuagaucucc

SEQ ID NO: 405564 - RNA, 15 nt, Homo sapiens
uaagcacuugcuuag

SEQ ID NO: 405565 - RNA, 15 nt, Homo sapiens
uaagccacugccaca

SEQ ID NO: 405566 - RNA, 19 nt, Homo sapiens
uaagccauaggcccaggau

SEQ ID NO: 405567 - RNA, 14 nt, Homo sapiens
uaagcccacuguua

SEQ ID NO: 405568 - RNA, 15 nt, Homo sapiens
uaagccuuuccauaa

SEQ ID NO: 405569 - RNA, 14 nt, Homo sapiens
uaagcucacacagc

SEQ ID NO: 405570 - RNA, 19 nt, Homo sapiens
uaagcuccuucaguuugaa

SEQ ID NO: 405571 - RNA, 17 nt, Homo sapiens
uaagcucuuuaugacug

SEQ ID NO: 405572 - RNA, 22 nt, Homo sapiens
uaagcuguaaccgauaugcacu

SEQ ID NO: 405573 - RNA, 14 nt, Homo sapiens
uaaggaaagcaaua

SEQ ID NO: 405574 - RNA, 14 nt, Homo sapiens
uaaggaaauaucau

SEQ ID NO: 405575 - RNA, 22 nt, Homo sapiens
uaaggauaugagccuuugcaca

SEQ ID NO: 405576 - RNA, 23 nt, Homo sapiens
uaaggaucuucccacuuugccac

SEQ ID NO: 405577 - RNA, 13 nt, Homo sapiens
uaaggaugaaggu

SEQ ID NO: 405578 - RNA, 20 nt, Homo sapiens
uaaggcaucauuuucaccuc

SEQ ID NO: 405579 - RNA, 21 nt, Homo sapiens
uaaggcaugcucccagcauuu

SEQ ID NO: 405580 - RNA, 16 nt, Homo sapiens
uaaggcuuaggugcca

SEQ ID NO: 405581 - RNA, 16 nt, Homo sapiens
uaagggaagcuggaau

SEQ ID NO: 405582 - RNA, 21 nt, Homo sapiens
uaagggcuggucucugcugaa

SEQ ID NO: 405583 - RNA, 18 nt, Homo sapiens
uaaggggaauuaacaauu

SEQ ID NO: 405584 - RNA, 23 nt, Homo sapiens
uaaggggggcagggagugaugau

SEQ ID NO: 405585 - RNA, 19 nt, Homo sapiens
uaaggugcaauaagaauuu

SEQ ID NO: 405586 - RNA, 19 nt, Homo sapiens
uaaggugcaguucccccaa

SEQ ID NO: 405587 - RNA, 13 nt, Homo sapiens
uaaguaacauaua

SEQ ID NO: 405588 - RNA, 17 nt, Homo sapiens
uaccccaccucaugccu

SEQ ID NO: 405589 - RNA, 19 nt, Homo sapiens
uaccccagccacuccucaa

SEQ ID NO: 405590 - RNA, 17 nt, Homo sapiens
uacccccaccacuaaga

SEQ ID NO: 405591 - RNA, 21 nt, Homo sapiens
uaccccccugagagcaugugg

SEQ ID NO: 405592 - RNA, 18 nt, Homo sapiens
uacccccugccccagaga

SEQ ID NO: 405593 - RNA, 12 nt, Homo sapiens
uaccccucauuu

SEQ ID NO: 405594 - RNA, 21 nt, Homo sapiens
uacccgggcagggcucccaca

SEQ ID NO: 405595 - RNA, 15 nt, Homo sapiens
uacccucccaccaga

SEQ ID NO: 405596 - RNA, 17 nt, Homo sapiens
uacccuccucuauuucu

SEQ ID NO: 405597 - RNA, 13 nt, Homo sapiens
uacccuccuguaa

SEQ ID NO: 405598 - RNA, 17 nt, Homo sapiens
uaccgcugcauaguauu

SEQ ID NO: 405599 - RNA, 17 nt, Homo sapiens
uaccgggcuggccugug

SEQ ID NO: 405600 - RNA, 17 nt, Homo sapiens
uaccuaccacagugucu

SEQ ID NO: 405601 - RNA, 13 nt, Homo sapiens
uaccuauuguaga

SEQ ID NO: 405602 - RNA, 13 nt, Homo sapiens
uaccucacuuuua

SEQ ID NO: 405603 - RNA, 13 nt, Homo sapiens
uaccuccaugagc

SEQ ID NO: 405604 - RNA, 15 nt, Homo sapiens
uaccucgaguuuuaa

SEQ ID NO: 405605 - RNA, 17 nt, Homo sapiens
uaccucuaaguacauau

SEQ ID NO: 405606 - RNA, 17 nt, Homo sapiens
uaccucugauaccucaa

SEQ ID NO: 405607 - RNA, 18 nt, Homo sapiens
uaccugaaaauucaacau

SEQ ID NO: 405608 - RNA, 14 nt, Homo sapiens
uaccugauggaccu

SEQ ID NO: 405609 - RNA, 15 nt, Homo sapiens
uaccuggaccugucc

SEQ ID NO: 405610 - RNA, 17 nt, Homo sapiens
uaccuguaauagccuca

SEQ ID NO: 405611 - RNA, 16 nt, Homo sapiens
uaccuguagugagaaa

SEQ ID NO: 405612 - RNA, 18 nt, Homo sapiens
uaccuguuguacacuugg

SEQ ID NO: 405613 - RNA, 15 nt, Homo sapiens
uaccuuccuccucaa

SEQ ID NO: 405614 - RNA, 16 nt, Homo sapiens
uaccuugaacaaucaa

SEQ ID NO: 405615 - RNA, 14 nt, Homo sapiens
uaccuuucuucacu

SEQ ID NO: 405616 - RNA, 17 nt, Homo sapiens
uacgcauggcuuccucc

SEQ ID NO: 405617 - RNA, 18 nt, Homo sapiens
uacgugaguccuggcaug

SEQ ID NO: 405618 - RNA, 15 nt, Homo sapiens
uacuaaagugccuac

SEQ ID NO: 405619 - RNA, 20 nt, Homo sapiens
uacuaauaugccuagcacaa

SEQ ID NO: 405620 - RNA, 18 nt, Homo sapiens
uacuaauuuccaugugua

SEQ ID NO: 405621 - RNA, 21 nt, Homo sapiens
uacuaauuuucuagauuuucu

SEQ ID NO: 405622 - RNA, 16 nt, Homo sapiens
uacuacagaaagcaaa

SEQ ID NO: 405623 - RNA, 19 nt, Homo sapiens
uacuagaucuuacaucugc

SEQ ID NO: 405624 - RNA, 13 nt, Homo sapiens
uacuagguuuauc

SEQ ID NO: 405625 - RNA, 17 nt, Homo sapiens
uacuaguacuaugacac

SEQ ID NO: 405626 - RNA, 20 nt, Homo sapiens
uacuaguacuauugcuauua

SEQ ID NO: 405627 - RNA, 18 nt, Homo sapiens
uacuaguucagacacuuu

SEQ ID NO: 405628 - RNA, 18 nt, Homo sapiens
uacuaugacacuguuaau

SEQ ID NO: 405629 - RNA, 21 nt, Homo sapiens
uacuauuuuuacuaaucuuuc

SEQ ID NO: 405630 - RNA, 14 nt, Homo sapiens
uacucaaccaaauu

SEQ ID NO: 405631 - RNA, 18 nt, Homo sapiens
uacuccuugccauuuuca

SEQ ID NO: 405632 - RNA, 18 nt, Homo sapiens
uacucgaguuacagacaa

SEQ ID NO: 405633 - RNA, 15 nt, Homo sapiens
uacucucaugcugca

SEQ ID NO: 405634 - RNA, 14 nt, Homo sapiens
uacucuguccaggc

SEQ ID NO: 405635 - RNA, 16 nt, Homo sapiens
uacucuugaugugaag

SEQ ID NO: 405636 - RNA, 17 nt, Homo sapiens
uacucuugucauuuuua

SEQ ID NO: 405637 - RNA, 19 nt, Homo sapiens
uacucuuuguaugaugaaa

SEQ ID NO: 405638 - RNA, 13 nt, Homo sapiens
uacugaccagcaa

SEQ ID NO: 405639 - RNA, 21 nt, Homo sapiens
uacugaugcagaaagaccgug

SEQ ID NO: 405640 - RNA, 22 nt, Homo sapiens
uacugaugugugcaaccuuuua

SEQ ID NO: 405641 - RNA, 20 nt, Homo sapiens
uacugcaaaaaguacauagu

SEQ ID NO: 405642 - RNA, 23 nt, Homo sapiens
uacugcuuucaacuuaaaucacu

SEQ ID NO: 405643 - RNA, 19 nt, Homo sapiens
uacuggagaaaauggacgu

SEQ ID NO: 405644 - RNA, 16 nt, Homo sapiens
uacuguaacacuguau

SEQ ID NO: 405645 - RNA, 16 nt, Homo sapiens
uacuguacugagacau

SEQ ID NO: 405646 - RNA, 23 nt, Homo sapiens
uacuguagaacugcaauuuccau

SEQ ID NO: 405647 - RNA, 17 nt, Homo sapiens
uacuguagcugaugaaa

SEQ ID NO: 405648 - RNA, 21 nt, Homo sapiens
uacuguaugccggcuccuuca

SEQ ID NO: 405649 - RNA, 15 nt, Homo sapiens
uacuguauuguuaca

SEQ ID NO: 405650 - RNA, 15 nt, Homo sapiens
uacuuaaucaagaua

SEQ ID NO: 405651 - RNA, 21 nt, Homo sapiens
uacuuagagaugcuacuguca

SEQ ID NO: 405652 - RNA, 17 nt, Homo sapiens
uacuuaucuauauccau

SEQ ID NO: 405653 - RNA, 20 nt, Homo sapiens
uacuuaucuauauccauaac

SEQ ID NO: 405654 - RNA, 17 nt, Homo sapiens
uacuucaaaagccauaa

SEQ ID NO: 405655 - RNA, 20 nt, Homo sapiens
uacuucuggaagucaucuca

SEQ ID NO: 405656 - RNA, 21 nt, Homo sapiens
uacuucuguguugugauuccc

SEQ ID NO: 405657 - RNA, 18 nt, Homo sapiens
uacuucuuauacauuuga

SEQ ID NO: 405658 - RNA, 12 nt, Homo sapiens
uacuucuuuauu

SEQ ID NO: 405659 - RNA, 23 nt, Homo sapiens
uacuugagugguguguguuauca

SEQ ID NO: 405660 - RNA, 14 nt, Homo sapiens
uacuugccaagaaa

SEQ ID NO: 405661 - RNA, 21 nt, Homo sapiens
uacuuuaaauccuaccaaagu

SEQ ID NO: 405662 - RNA, 15 nt, Homo sapiens
uacuuuaccuccuau

SEQ ID NO: 405663 - RNA, 21 nt, Homo sapiens
uacuuuauguauggagcucua

SEQ ID NO: 405664 - RNA, 19 nt, Homo sapiens
uacuuugauuuacagugcc

SEQ ID NO: 405665 - RNA, 23 nt, Homo sapiens
uacuuuucaguuuuuaacauaau

SEQ ID NO: 405666 - RNA, 12 nt, Homo sapiens
uacuuuuugccc

SEQ ID NO: 405667 - RNA, 17 nt, Homo sapiens
uagaaaacgauuuugaa

SEQ ID NO: 405668 - RNA, 16 nt, Homo sapiens
uagaaaauaaggaaca

SEQ ID NO: 405669 - RNA, 20 nt, Homo sapiens
uagaaacacacuuuugcaca

SEQ ID NO: 405670 - RNA, 12 nt, Homo sapiens
uagaaacacagu

SEQ ID NO: 405671 - RNA, 20 nt, Homo sapiens
uagaaagcuggcaacaugaa

SEQ ID NO: 405672 - RNA, 15 nt, Homo sapiens
ucacuccauucucag

SEQ ID NO: 405673 - RNA, 18 nt, Homo sapiens
ucacucccuaaagcccuc

SEQ ID NO: 405674 - RNA, 16 nt, Homo sapiens
ucacuccucugucaua

SEQ ID NO: 405675 - RNA, 17 nt, Homo sapiens
ucacucugacaguauua

SEQ ID NO: 405676 - RNA, 22 nt, Homo sapiens
ucacugacucaagacacugaga

SEQ ID NO: 405677 - RNA, 22 nt, Homo sapiens
ucacugagaagauugugaauau

SEQ ID NO: 405678 - RNA, 23 nt, Homo sapiens
ucacugaggcauuuuuacuacua

SEQ ID NO: 405679 - RNA, 12 nt, Homo sapiens
ucacugcaauuu

SEQ ID NO: 405680 - RNA, 17 nt, Homo sapiens
ucacugcaccucuuugu

SEQ ID NO: 405681 - RNA, 20 nt, Homo sapiens
ucacugcucccccgugugua

SEQ ID NO: 405682 - RNA, 13 nt, Homo sapiens
ucacuggaugaaa

SEQ ID NO: 405683 - RNA, 16 nt, Homo sapiens
ucacugucuuuccuag

SEQ ID NO: 405684 - RNA, 23 nt, Homo sapiens
ucacuguugcuuaauugugaaca

SEQ ID NO: 405685 - RNA, 21 nt, Homo sapiens
ucacuuaaacuuugucacuuc

SEQ ID NO: 405686 - RNA, 16 nt, Homo sapiens
ucacuugacucuugaa

SEQ ID NO: 405687 - RNA, 15 nt, Homo sapiens
ucacuugaucuccgu

SEQ ID NO: 405688 - RNA, 15 nt, Homo sapiens
ucacuugcacugggg

SEQ ID NO: 405689 - RNA, 16 nt, Homo sapiens
ucacuuuguugcccag

SEQ ID NO: 405690 - RNA, 15 nt, Homo sapiens
ucacuuuuauugaua

SEQ ID NO: 405691 - RNA, 14 nt, Homo sapiens
ucagaaaacagaaa

SEQ ID NO: 405692 - RNA, 21 nt, Homo sapiens
ucagaaacaaagcauuugacu

SEQ ID NO: 405693 - RNA, 18 nt, Homo sapiens
ucagaaaccauuguucag

SEQ ID NO: 405694 - RNA, 22 nt, Homo sapiens
ucagaacagcugaaacauuccg

SEQ ID NO: 405695 - RNA, 13 nt, Homo sapiens
ucagaagauaucu

SEQ ID NO: 405696 - RNA, 18 nt, Homo sapiens
ucagaaggauggcauuuu

SEQ ID NO: 405697 - RNA, 18 nt, Homo sapiens
ucagaagucaguugcaaa

SEQ ID NO: 405698 - RNA, 23 nt, Homo sapiens
ucagaauaaauggguaacacuga

SEQ ID NO: 405699 - RNA, 19 nt, Homo sapiens
ucagaauuucuuugucauu

SEQ ID NO: 405700 - RNA, 22 nt, Homo sapiens
ucagaauuucuuugucauucaa

SEQ ID NO: 405701 - RNA, 13 nt, Homo sapiens
ucagacacuuugg

SEQ ID NO: 405702 - RNA, 16 nt, Homo sapiens
ucagacaggaaaggga

SEQ ID NO: 405703 - RNA, 13 nt, Homo sapiens
ucagacauuccaa

SEQ ID NO: 405704 - RNA, 15 nt, Homo sapiens
ucagaccaguacugg

SEQ ID NO: 405705 - RNA, 15 nt, Homo sapiens
ucagaccuucuucca

SEQ ID NO: 405706 - RNA, 23 nt, Homo sapiens
ucagacgggcugagaggaugaac

SEQ ID NO: 405707 - RNA, 21 nt, Homo sapiens
ucagacucuaaacacacaagu

SEQ ID NO: 405708 - RNA, 14 nt, Homo sapiens
ucagacuuaccagg

SEQ ID NO: 405709 - RNA, 14 nt, Homo sapiens
ucagagaaaacacu

SEQ ID NO: 405710 - RNA, 21 nt, Homo sapiens
ucagagaaaguuccauuuccg

SEQ ID NO: 405711 - RNA, 17 nt, Homo sapiens
ucagagaaauacuuuca

SEQ ID NO: 405712 - RNA, 16 nt, Homo sapiens
ucagagcaagcacugg

SEQ ID NO: 405713 - RNA, 18 nt, Homo sapiens
ucagagcaagcacuggac

SEQ ID NO: 405714 - RNA, 14 nt, Homo sapiens
ucagagcacagcag

SEQ ID NO: 405715 - RNA, 14 nt, Homo sapiens
ucagagccagugaa

SEQ ID NO: 405716 - RNA, 22 nt, Homo sapiens
ucagaguggccaaucccugugu

SEQ ID NO: 405717 - RNA, 23 nt, Homo sapiens
ucagagugggguggggagcaugu

SEQ ID NO: 405718 - RNA, 17 nt, Homo sapiens
ucagaucacuacugcag

SEQ ID NO: 405719 - RNA, 21 nt, Homo sapiens
ucagaucccucggucagcacc

SEQ ID NO: 405720 - RNA, 17 nt, Homo sapiens
ucagaucugaacacagu

SEQ ID NO: 405721 - RNA, 20 nt, Homo sapiens
ucagaugauucuaugucuca

SEQ ID NO: 405722 - RNA, 18 nt, Homo sapiens
ucagaugcaagagaacaa

SEQ ID NO: 405723 - RNA, 13 nt, Homo sapiens
ucagaugucucug

SEQ ID NO: 405724 - RNA, 21 nt, Homo sapiens
ucagauuuuaaaaagucuuca

SEQ ID NO: 405725 - RNA, 23 nt, Homo sapiens
ucagauuuuaaaaagucuucacu

SEQ ID NO: 405726 - RNA, 15 nt, Homo sapiens
ucagauuuucuggac

SEQ ID NO: 405727 - RNA, 13 nt, Homo sapiens
ucagcaacagagc

SEQ ID NO: 405728 - RNA, 20 nt, Homo sapiens
ucagcaacuguuagcuggga

SEQ ID NO: 405729 - RNA, 18 nt, Homo sapiens
ucagcaagacaaugacac

SEQ ID NO: 405730 - RNA, 21 nt, Homo sapiens
ucagcacugucccuugccuca

SEQ ID NO: 405731 - RNA, 18 nt, Homo sapiens
ucagcacuuuguuucaua

SEQ ID NO: 405732 - RNA, 18 nt, Homo sapiens
ucagcagcucugagacag

SEQ ID NO: 405733 - RNA, 23 nt, Homo sapiens
ucagcaugauguguuguguauaa

SEQ ID NO: 405734 - RNA, 20 nt, Homo sapiens
ucagcauuauuccuccagga

SEQ ID NO: 405735 - RNA, 11 nt, Homo sapiens
ucccuaauccu

SEQ ID NO: 405736 - RNA, 22 nt, Homo sapiens
ucccuaauucucuucgcuguga

SEQ ID NO: 405737 - RNA, 21 nt, Homo sapiens
ucccucaggcuuguugcccuc

SEQ ID NO: 405738 - RNA, 18 nt, Homo sapiens
ucccuccaccagugugcu

SEQ ID NO: 405739 - RNA, 19 nt, Homo sapiens
ucccucuaauuuaucuugu

SEQ ID NO: 405740 - RNA, 14 nt, Homo sapiens
ucccucucuugccg

SEQ ID NO: 405741 - RNA, 16 nt, Homo sapiens
ucccugaaacauugca

SEQ ID NO: 405742 - RNA, 22 nt, Homo sapiens
ucccugagaagccucaugggag

SEQ ID NO: 405743 - RNA, 22 nt, Homo sapiens
ucccugagagcucacaguacaa

SEQ ID NO: 405744 - RNA, 16 nt, Homo sapiens
ucccugcaaacauggg

SEQ ID NO: 405745 - RNA, 14 nt, Homo sapiens
ucccugccaccagg

SEQ ID NO: 405746 - RNA, 17 nt, Homo sapiens
ucccugccaccaggcac

SEQ ID NO: 405747 - RNA, 12 nt, Homo sapiens
ucccugccucac

SEQ ID NO: 405748 - RNA, 17 nt, Homo sapiens
ucccuggaaagcaggca

SEQ ID NO: 405749 - RNA, 14 nt, Homo sapiens
ucccuguuugccua

SEQ ID NO: 405750 - RNA, 18 nt, Homo sapiens
ucccuuaauaaacucaca

SEQ ID NO: 405751 - RNA, 23 nt, Homo sapiens
ucccuuacuauucccacuuucau

SEQ ID NO: 405752 - RNA, 14 nt, Homo sapiens
ucccuuaggaauau

SEQ ID NO: 405753 - RNA, 21 nt, Homo sapiens
ucccuucugauaagacuggaa

SEQ ID NO: 405754 - RNA, 15 nt, Homo sapiens
ucccuucuuacuuaa

SEQ ID NO: 405755 - RNA, 21 nt, Homo sapiens
ucccuugcuggaaaacccaaa

SEQ ID NO: 405756 - RNA, 17 nt, Homo sapiens
ucccuuuguugcacacu

SEQ ID NO: 405757 - RNA, 22 nt, Homo sapiens
uccgacaaccgaugcuccagcc

SEQ ID NO: 405758 - RNA, 13 nt, Homo sapiens
uccgaggccaaag

SEQ ID NO: 405759 - RNA, 20 nt, Homo sapiens
uccgaggcuccccgccucca

SEQ ID NO: 405760 - RNA, 16 nt, Homo sapiens
uccgagucaagugauu

SEQ ID NO: 405761 - RNA, 15 nt, Homo sapiens
uccgcaugugucugu

SEQ ID NO: 405762 - RNA, 13 nt, Homo sapiens
uccgccuaccuca

SEQ ID NO: 405763 - RNA, 18 nt, Homo sapiens
uccgcuccccuuucccau

SEQ ID NO: 405764 - RNA, 21 nt, Homo sapiens
uccggaagcugucgacuucau

SEQ ID NO: 405765 - RNA, 20 nt, Homo sapiens
uccggagugagcaauggagu

SEQ ID NO: 405766 - RNA, 22 nt, Homo sapiens
uccgggagcggcuguugggcug

SEQ ID NO: 405767 - RNA, 14 nt, Homo sapiens
uccgugagccucag

SEQ ID NO: 405768 - RNA, 15 nt, Homo sapiens
uccgugguucacuuu

SEQ ID NO: 405769 - RNA, 16 nt, Homo sapiens
uccguuuccaaauaca

SEQ ID NO: 405770 - RNA, 16 nt, Homo sapiens
uccuaaaacaccugga

SEQ ID NO: 405771 - RNA, 17 nt, Homo sapiens
uccuaaaguagacuuca

SEQ ID NO: 405772 - RNA, 15 nt, Homo sapiens
uccuaaauaucucaa

SEQ ID NO: 405773 - RNA, 16 nt, Homo sapiens
uccuaaaugcagugaa

SEQ ID NO: 405774 - RNA, 20 nt, Homo sapiens
uccuaaauuugaaauaguga

SEQ ID NO: 405775 - RNA, 13 nt, Homo sapiens
uccuaacaaaaga

SEQ ID NO: 405776 - RNA, 14 nt, Homo sapiens
uccuaacaaaagau

SEQ ID NO: 405777 - RNA, 12 nt, Homo sapiens
uccuaagcacuu

SEQ ID NO: 405778 - RNA, 14 nt, Homo sapiens
uccuaagcucagag

SEQ ID NO: 405779 - RNA, 22 nt, Homo sapiens
uccuaaguuuaauuacaacagc

SEQ ID NO: 405780 - RNA, 19 nt, Homo sapiens
uccuagaggugggcagcug

SEQ ID NO: 405781 - RNA, 20 nt, Homo sapiens
uccuagauggcagucacuga

SEQ ID NO: 405782 - RNA, 22 nt, Homo sapiens
uccuagcugugugcagucucuc

SEQ ID NO: 405783 - RNA, 16 nt, Homo sapiens
uccuaggggugcgcuc

SEQ ID NO: 405784 - RNA, 17 nt, Homo sapiens
uccuagugucuauuccc

SEQ ID NO: 405785 - RNA, 15 nt, Homo sapiens
uccuaugcugcaaua

SEQ ID NO: 405786 - RNA, 14 nt, Homo sapiens
uccuauuacugaug

SEQ ID NO: 405787 - RNA, 17 nt, Homo sapiens
uccuauucuauugcagu

SEQ ID NO: 405788 - RNA, 23 nt, Homo sapiens
uccucaaaccuaccacucaggaa

SEQ ID NO: 405789 - RNA, 14 nt, Homo sapiens
uccucacauucaca

SEQ ID NO: 405790 - RNA, 13 nt, Homo sapiens
uccucacuuccau

SEQ ID NO: 405791 - RNA, 13 nt, Homo sapiens
uccucagcugaca

SEQ ID NO: 405792 - RNA, 21 nt, Homo sapiens
uccucagcugccaagcacucg

SEQ ID NO: 405793 - RNA, 21 nt, Homo sapiens
uccucaggguggggggugaca

SEQ ID NO: 405794 - RNA, 20 nt, Homo sapiens
uccucagucuuugggggauu

SEQ ID NO: 405795 - RNA, 16 nt, Homo sapiens
uccucaguuuuuccua

SEQ ID NO: 405796 - RNA, 18 nt, Homo sapiens
uccucauauacuugaaua

SEQ ID NO: 405797 - RNA, 22 nt, Homo sapiens
uccucauauacuugaauauuau

SEQ ID NO: 405798 - RNA, 16 nt, Homo sapiens
uccucaugaauguaaa

SEQ ID NO: 405799 - RNA, 17 nt, Homo sapiens
uccucauuguaaacaaa

SEQ ID NO: 405800 - RNA, 20 nt, Homo sapiens
uccuccaaagccugggcaga

SEQ ID NO: 405801 - RNA, 16 nt, Homo sapiens
uccuccacucacucca

SEQ ID NO: 405802 - RNA, 13 nt, Homo sapiens
uccuccacuccac

SEQ ID NO: 405803 - RNA, 20 nt, Homo sapiens
uccuccagaagccucuggcu

SEQ ID NO: 405804 - RNA, 18 nt, Homo sapiens
uccuccaguucugaugag

SEQ ID NO: 405805 - RNA, 15 nt, Homo sapiens
aguccagugugacuu

SEQ ID NO: 405806 - RNA, 14 nt, Homo sapiens
agucccaguauucu

SEQ ID NO: 405807 - RNA, 16 nt, Homo sapiens
agucccauugauguac

SEQ ID NO: 405808 - RNA, 13 nt, Homo sapiens
agucccggagccc

SEQ ID NO: 405809 - RNA, 23 nt, Homo sapiens
agucccuccgacuucucuagaca

SEQ ID NO: 405810 - RNA, 23 nt, Homo sapiens
agucccuggaaaaacagucacug

SEQ ID NO: 405811 - RNA, 15 nt, Homo sapiens
aguccucacaugccc

SEQ ID NO: 405812 - RNA, 16 nt, Homo sapiens
aguccuccaaaacaca

SEQ ID NO: 405813 - RNA, 17 nt, Homo sapiens
aguccugauguacuuua

SEQ ID NO: 405814 - RNA, 18 nt, Homo sapiens
aguccugauguacuuuaa

SEQ ID NO: 405815 - RNA, 13 nt, Homo sapiens
aguccuguucuca

SEQ ID NO: 405816 - RNA, 22 nt, Homo sapiens
aguccuuucuuuugaaaugcca

SEQ ID NO: 405817 - RNA, 17 nt, Homo sapiens
agucgaucaagggaugu

SEQ ID NO: 405818 - RNA, 21 nt, Homo sapiens
agucgcaggauccgcugccac

SEQ ID NO: 405819 - RNA, 23 nt, Homo sapiens
agucggauacccuggagcaagac

SEQ ID NO: 405820 - RNA, 18 nt, Homo sapiens
agucggaucuagccaugg

SEQ ID NO: 405821 - RNA, 18 nt, Homo sapiens
agucucaaaaauacaaaa

SEQ ID NO: 405822 - RNA, 23 nt, Homo sapiens
agucucaauguuccauucagucu

SEQ ID NO: 405823 - RNA, 16 nt, Homo sapiens
agucucuugauucaua

SEQ ID NO: 405824 - RNA, 21 nt, Homo sapiens
agucugaggccccuuaacuca

SEQ ID NO: 405825 - RNA, 11 nt, Homo sapiens
agucugaguca

SEQ ID NO: 405826 - RNA, 14 nt, Homo sapiens
agucugcauuacau

SEQ ID NO: 405827 - RNA, 19 nt, Homo sapiens
agucugcuuaccaaaacau

SEQ ID NO: 405828 - RNA, 18 nt, Homo sapiens
agucugcuucauuuccuc

SEQ ID NO: 405829 - RNA, 22 nt, Homo sapiens
aguuggcucugagauacuaaua

SEQ ID NO: 405830 - RNA, 15 nt, Homo sapiens
aguuguaucacaaag

SEQ ID NO: 405831 - RNA, 23 nt, Homo sapiens
aguugucccgauuguaacucaaa

SEQ ID NO: 405832 - RNA, 21 nt, Homo sapiens
aguugugucagcuacugcgga

SEQ ID NO: 405833 - RNA, 19 nt, Homo sapiens
aguuguuuucccgagcaaa

SEQ ID NO: 405834 - RNA, 17 nt, Homo sapiens
aguuuaauuacaacagc

SEQ ID NO: 405835 - RNA, 18 nt, Homo sapiens
aguuuaauuacaacagca

SEQ ID NO: 405836 - RNA, 13 nt, Homo sapiens
aguuuaucuuuca

SEQ ID NO: 405837 - RNA, 13 nt, Homo sapiens
aguuuaugcagug

SEQ ID NO: 405838 - RNA, 19 nt, Homo sapiens
aguuuauuggaaguguuca

SEQ ID NO: 405839 - RNA, 21 nt, Homo sapiens
aguuuauuuuuauacuuucag

SEQ ID NO: 405840 - RNA, 22 nt, Homo sapiens
aguuucacaugagcuauuucca

SEQ ID NO: 405841 - RNA, 21 nt, Homo sapiens
aguuucagagaaauacuuuca

SEQ ID NO: 405842 - RNA, 22 nt, Homo sapiens
aguuuccagcuaagccugauga

SEQ ID NO: 405843 - RNA, 11 nt, Homo sapiens
aguuucccaaa

SEQ ID NO: 405844 - RNA, 14 nt, Homo sapiens
aguuugaaccaaga

SEQ ID NO: 405845 - RNA, 23 nt, Homo sapiens
aguuugaacucuguaaaaccuca

SEQ ID NO: 405846 - RNA, 17 nt, Homo sapiens
aguuugcaaugucacaa

SEQ ID NO: 405847 - RNA, 17 nt, Homo sapiens
aguuuggaacucuaccc

SEQ ID NO: 405848 - RNA, 18 nt, Homo sapiens
aguuuggaaguguuaacu

SEQ ID NO: 405849 - RNA, 18 nt, Homo sapiens
aguuugggugucugcuaa

SEQ ID NO: 405850 - RNA, 12 nt, Homo sapiens
aguuuguauuaa

SEQ ID NO: 405851 - RNA, 17 nt, Homo sapiens
aguuugucagacuuuaa

SEQ ID NO: 405852 - RNA, 23 nt, Homo sapiens
aguuugucuuccucuuguuuacg

SEQ ID NO: 405853 - RNA, 17 nt, Homo sapiens
aguuugugcaagacacc

SEQ ID NO: 405854 - RNA, 14 nt, Homo sapiens
aguuuuaaacuggu

SEQ ID NO: 405855 - RNA, 15 nt, Homo sapiens
aguuuuaaauaagcu

SEQ ID NO: 405856 - RNA, 14 nt, Homo sapiens
aguuuuaacuguaa

SEQ ID NO: 405857 - RNA, 13 nt, Homo sapiens
aguuuuaguugca

SEQ ID NO: 405858 - RNA, 12 nt, Homo sapiens
aguuuuaugaga

SEQ ID NO: 405859 - RNA, 13 nt, Homo sapiens
aguuuuccaugaa

SEQ ID NO: 405860 - RNA, 20 nt, Homo sapiens
aguuuucuggagugagcacu

SEQ ID NO: 405861 - RNA, 15 nt, Homo sapiens
aguuuuggcauaaua

SEQ ID NO: 405862 - RNA, 14 nt, Homo sapiens
aguuuuucucucaa

SEQ ID NO: 405863 - RNA, 19 nt, Homo sapiens
auaaaaaaauuuuaauucc

SEQ ID NO: 405864 - RNA, 14 nt, Homo sapiens
auaaaaacccugua

SEQ ID NO: 405865 - RNA, 22 nt, Homo sapiens
auaaaaacugcccauuguaacu

SEQ ID NO: 405866 - RNA, 15 nt, Homo sapiens
auaaaaagugacaca

SEQ ID NO: 405867 - RNA, 21 nt, Homo sapiens
auaaaaaucccucuuccucca

SEQ ID NO: 405868 - RNA, 16 nt, Homo sapiens
auaaaacaaaaccaag

SEQ ID NO: 405869 - RNA, 21 nt, Homo sapiens
auaaaacaucuuuccaguccu

SEQ ID NO: 405870 - RNA, 18 nt, Homo sapiens
auaaaagacaagcacuuu

SEQ ID NO: 405871 - RNA, 12 nt, Homo sapiens
auaaaagcuaug

SEQ ID NO: 405872 - RNA, 15 nt, Homo sapiens
auaaaagcuaugaca

SEQ ID NO: 405873 - RNA, 21 nt, Homo sapiens
auaaaagguuuaaugucaggg

SEQ ID NO: 405874 - RNA, 14 nt, Homo sapiens
auaaaaguugcaaa

SEQ ID NO: 405875 - RNA, 17 nt, Homo sapiens
auaaaaucagugugcuu

SEQ ID NO: 405876 - RNA, 19 nt, Homo sapiens
auaaaaucugugaauuaaa

SEQ ID NO: 405877 - RNA, 20 nt, Homo sapiens
auaaaaucuuuccaucucau

SEQ ID NO: 405878 - RNA, 12 nt, Homo sapiens
auaaaaugaggg

SEQ ID NO: 405879 - RNA, 20 nt, Homo sapiens
auaaaaugcauuuaaacuca

SEQ ID NO: 405880 - RNA, 13 nt, Homo sapiens
auaaaaugugauu

SEQ ID NO: 405881 - RNA, 20 nt, Homo sapiens
auaaaauuguaaaauuguau

SEQ ID NO: 405882 - RNA, 21 nt, Homo sapiens
auaaacaacuuaauguucuga

SEQ ID NO: 405883 - RNA, 22 nt, Homo sapiens
auaaacaacuuaauguucugaa

SEQ ID NO: 405884 - RNA, 23 nt, Homo sapiens
auaaacaaucuuagacauuuauc

SEQ ID NO: 405885 - RNA, 16 nt, Homo sapiens
auaaacagauaaugcu

SEQ ID NO: 405886 - RNA, 14 nt, Homo sapiens
auaaacauaugcaa

SEQ ID NO: 405887 - RNA, 15 nt, Homo sapiens
auaaacucacaacuc

SEQ ID NO: 405888 - RNA, 16 nt, Homo sapiens
auaaacugugagauaa

SEQ ID NO: 405889 - RNA, 17 nt, Homo sapiens
auaaagaagaaaauaac

SEQ ID NO: 405890 - RNA, 18 nt, Homo sapiens
auaaagacaaaugcugcg

SEQ ID NO: 405891 - RNA, 11 nt, Homo sapiens
auaaagacagg

SEQ ID NO: 405892 - RNA, 22 nt, Homo sapiens
auaaagauuuuuguuaagcuca

SEQ ID NO: 405893 - RNA, 17 nt, Homo sapiens
auaaagcccuugaacca

SEQ ID NO: 405894 - RNA, 20 nt, Homo sapiens
auaaaggcauuucaaagucu

SEQ ID NO: 405895 - RNA, 19 nt, Homo sapiens
auaaaguauuccaccuuaa

SEQ ID NO: 405896 - RNA, 15 nt, Homo sapiens
auaaaguuacuugaa

SEQ ID NO: 405897 - RNA, 16 nt, Homo sapiens
auaaaguuacuugaau

SEQ ID NO: 405898 - RNA, 14 nt, Homo sapiens
auaaauaauguuca

SEQ ID NO: 405899 - RNA, 19 nt, Homo sapiens
auaaauagaugaguccugu

SEQ ID NO: 405900 - RNA, 17 nt, Homo sapiens
auaaauauacuaauaaa

SEQ ID NO: 405901 - RNA, 17 nt, Homo sapiens
auaaauauagagaugug

SEQ ID NO: 405902 - RNA, 18 nt, Homo sapiens
auaaauauuuguuugggu

SEQ ID NO: 405903 - RNA, 13 nt, Homo sapiens
auaaaucauaaaa

SEQ ID NO: 405904 - RNA, 16 nt, Homo sapiens
auaaauccaacucuga

SEQ ID NO: 405905 - RNA, 22 nt, Homo sapiens
auaaaucucuucuuugcugcag

SEQ ID NO: 405906 - RNA, 18 nt, Homo sapiens
auaaaucugccauuucaa

SEQ ID NO: 405907 - RNA, 16 nt, Homo sapiens
auaaaucuuccaaagu

SEQ ID NO: 405908 - RNA, 18 nt, Homo sapiens
auaaauggugagaauuaa

SEQ ID NO: 405909 - RNA, 17 nt, Homo sapiens
auaaauguacauuaauu

SEQ ID NO: 405910 - RNA, 15 nt, Homo sapiens
auaaauguacuacau

SEQ ID NO: 405911 - RNA, 20 nt, Homo sapiens
auaaauguacuacauuugca

SEQ ID NO: 405912 - RNA, 18 nt, Homo sapiens
auaaaugucuaaagcagg

SEQ ID NO: 405913 - RNA, 14 nt, Homo sapiens
auaaauuauggcau

SEQ ID NO: 405914 - RNA, 21 nt, Homo sapiens
auaaauuauuuaacuaauuaa

SEQ ID NO: 405915 - RNA, 22 nt, Homo sapiens
auaaauucuauaggaacauaug

SEQ ID NO: 405916 - RNA, 19 nt, Homo sapiens
auaaauugccucccuuccu

SEQ ID NO: 405917 - RNA, 14 nt, Homo sapiens
auaaauuugguucu

SEQ ID NO: 405918 - RNA, 19 nt, Homo sapiens
auaacaaccccggacaaau

SEQ ID NO: 405919 - RNA, 19 nt, Homo sapiens
auaacaagugggugaaugu

SEQ ID NO: 405920 - RNA, 12 nt, Homo sapiens
auaacacugucu

SEQ ID NO: 405921 - RNA, 13 nt, Homo sapiens
auaacagcauucu

SEQ ID NO: 405922 - RNA, 11 nt, Homo sapiens
auaacagcuaa

SEQ ID NO: 405923 - RNA, 15 nt, Homo sapiens
auaacaggcauugca

SEQ ID NO: 405924 - RNA, 18 nt, Homo sapiens
auaacaguuacuccagua

SEQ ID NO: 405925 - RNA, 22 nt, Homo sapiens
auaacauggccuuggagggcau

SEQ ID NO: 405926 - RNA, 14 nt, Homo sapiens
auaaccccugccug

SEQ ID NO: 405927 - RNA, 14 nt, Homo sapiens
auaacuagaucucc

SEQ ID NO: 405928 - RNA, 17 nt, Homo sapiens
auaacucauugucugug

SEQ ID NO: 405929 - RNA, 22 nt, Homo sapiens
auaacuccuuguuucagaugau

SEQ ID NO: 405930 - RNA, 17 nt, Homo sapiens
auaacucugcacuacuc

SEQ ID NO: 405931 - RNA, 17 nt, Homo sapiens
auaacuugaagaacagg

SEQ ID NO: 405932 - RNA, 20 nt, Homo sapiens
auaagaaacaugaugugaga

SEQ ID NO: 405933 - RNA, 18 nt, Homo sapiens
auaagacugucauguaag

SEQ ID NO: 405934 - RNA, 17 nt, Homo sapiens
auaagcacuagaucucc

SEQ ID NO: 405935 - RNA, 16 nt, Homo sapiens
auaaggaaagcaauaa

SEQ ID NO: 405936 - RNA, 22 nt, Homo sapiens
auaaggaguugccgcauauuau

SEQ ID NO: 405937 - RNA, 18 nt, Homo sapiens
auaauaaaaggaguucag

SEQ ID NO: 405938 - RNA, 17 nt, Homo sapiens
auaauaaaggcauuuca

SEQ ID NO: 405939 - RNA, 18 nt, Homo sapiens
auaauaaaggcauuucaa

SEQ ID NO: 405940 - RNA, 16 nt, Homo sapiens
auaauaaauacacaau

SEQ ID NO: 405941 - RNA, 19 nt, Homo sapiens
auaauaaggggaagacuuu

SEQ ID NO: 405942 - RNA, 22 nt, Homo sapiens
auaauucuaaguuauuuacuuu

SEQ ID NO: 405943 - RNA, 17 nt, Homo sapiens
auaauugacugguggaa

SEQ ID NO: 405944 - RNA, 21 nt, Homo sapiens
auaauugccuuuuccuaugua

SEQ ID NO: 405945 - RNA, 14 nt, Homo sapiens
auaauuuacuuauu

SEQ ID NO: 405946 - RNA, 15 nt, Homo sapiens
auacaacaaucccag

SEQ ID NO: 405947 - RNA, 18 nt, Homo sapiens
auacaauaaacaugucaa

SEQ ID NO: 405948 - RNA, 17 nt, Homo sapiens
auacaauucagucuucu

SEQ ID NO: 405949 - RNA, 13 nt, Homo sapiens
auacaauuugccc

SEQ ID NO: 405950 - RNA, 19 nt, Homo sapiens
auacaccaccucacuccug

SEQ ID NO: 405951 - RNA, 23 nt, Homo sapiens
auacaccaccuuauuagcuaaaa

SEQ ID NO: 405952 - RNA, 23 nt, Homo sapiens
auacacuguaucuaaaaaauaac

SEQ ID NO: 405953 - RNA, 12 nt, Homo sapiens
auacacugugac

SEQ ID NO: 405954 - RNA, 17 nt, Homo sapiens
auacagaaaaaccacau

SEQ ID NO: 405955 - RNA, 16 nt, Homo sapiens
auacagaaaaugcuuu

SEQ ID NO: 405956 - RNA, 15 nt, Homo sapiens
auacagauguaucau

SEQ ID NO: 405957 - RNA, 22 nt, Homo sapiens
auacagcccucccccagcaguu

SEQ ID NO: 405958 - RNA, 15 nt, Homo sapiens
auacauauacacaaa

SEQ ID NO: 405959 - RNA, 13 nt, Homo sapiens
auacauauguuaa

SEQ ID NO: 405960 - RNA, 23 nt, Homo sapiens
auacauuccugagauucugggaa

SEQ ID NO: 405961 - RNA, 17 nt, Homo sapiens
auacauuguauaggcca

SEQ ID NO: 405962 - RNA, 17 nt, Homo sapiens
auacauuucuacuuuau

SEQ ID NO: 405963 - RNA, 22 nt, Homo sapiens
auaccaauauucuuuuguucua

SEQ ID NO: 405964 - RNA, 17 nt, Homo sapiens
auaccagagacucugaa

SEQ ID NO: 405965 - RNA, 23 nt, Homo sapiens
auaccagcuagaaucacuugacu

SEQ ID NO: 405966 - RNA, 18 nt, Homo sapiens
auaccagcuuaugagcuc

SEQ ID NO: 405967 - RNA, 11 nt, Homo sapiens
auaccaggugc

SEQ ID NO: 405968 - RNA, 20 nt, Homo sapiens
auaccagguuaccucacuuu

SEQ ID NO: 405969 - RNA, 23 nt, Homo sapiens
auaccgcugcauaguauuccauu

SEQ ID NO: 405970 - RNA, 22 nt, Homo sapiens
auaccucucaacuuacauaugu

SEQ ID NO: 405971 - RNA, 13 nt, Homo sapiens
auaccuggcuuuu

SEQ ID NO: 405972 - RNA, 19 nt, Homo sapiens
auaccuggcuuuuacuuua

SEQ ID NO: 405973 - RNA, 19 nt, Homo sapiens
auaccuucuuaaguuuuca

SEQ ID NO: 405974 - RNA, 23 nt, Homo sapiens
auacgugaaagaugcaagcaccu

SEQ ID NO: 405975 - RNA, 20 nt, Homo sapiens
auacuaaugcccuaucuuag

SEQ ID NO: 405976 - RNA, 17 nt, Homo sapiens
auacuaccaagugacca

SEQ ID NO: 405977 - RNA, 22 nt, Homo sapiens
auacucaggacuccucuccgca

SEQ ID NO: 405978 - RNA, 14 nt, Homo sapiens
auacucauggucau

SEQ ID NO: 405979 - RNA, 17 nt, Homo sapiens
auacucuguugccuccu

SEQ ID NO: 405980 - RNA, 14 nt, Homo sapiens
auacugaaacauuu

SEQ ID NO: 405981 - RNA, 16 nt, Homo sapiens
auacugagugccugca

SEQ ID NO: 405982 - RNA, 14 nt, Homo sapiens
auacuggguacaag

SEQ ID NO: 405983 - RNA, 16 nt, Homo sapiens
auacuguacugagaca

SEQ ID NO: 405984 - RNA, 23 nt, Homo sapiens
auacuguauugcuguaugguaua

SEQ ID NO: 405985 - RNA, 20 nt, Homo sapiens
auacuucuuuuucauuauug

SEQ ID NO: 405986 - RNA, 13 nt, Homo sapiens
auacuuuacaugg

SEQ ID NO: 405987 - RNA, 22 nt, Homo sapiens
auacuuuuuuuuuugaggcaga

SEQ ID NO: 405988 - RNA, 14 nt, Homo sapiens
auagaaaaagcaca

SEQ ID NO: 405989 - RNA, 14 nt, Homo sapiens
auagaaaauuaugc

SEQ ID NO: 405990 - RNA, 22 nt, Homo sapiens
auagaacuggucuuccauuuug

SEQ ID NO: 405991 - RNA, 18 nt, Homo sapiens
auagaagcaaaugacaaa

SEQ ID NO: 405992 - RNA, 19 nt, Homo sapiens
auagaagcaaaugacaaaa

SEQ ID NO: 405993 - RNA, 14 nt, Homo sapiens
auagaauacaugga

SEQ ID NO: 405994 - RNA, 12 nt, Homo sapiens
auagaauccaaa

SEQ ID NO: 405995 - RNA, 20 nt, Homo sapiens
auagaauugugcuggucaua

SEQ ID NO: 405996 - RNA, 19 nt, Homo sapiens
auagacuuagccccaugag

SEQ ID NO: 405997 - RNA, 22 nt, Homo sapiens
auagagccccuccugguugaua

SEQ ID NO: 405998 - RNA, 21 nt, Homo sapiens
auagaggcaagaaagagauac

SEQ ID NO: 405999 - RNA, 18 nt, Homo sapiens
auagauaccauuuugaaa

SEQ ID NO: 406000 - RNA, 19 nt, Homo sapiens
auagaucaaagucaaaaau

SEQ ID NO: 406001 - RNA, 16 nt, Homo sapiens
auagaugaguccuguu

SEQ ID NO: 406002 - RNA, 18 nt, Homo sapiens
auagcagauuguguaaca

SEQ ID NO: 406003 - RNA, 18 nt, Homo sapiens
auagcaguugaaacaaga

SEQ ID NO: 406004 - RNA, 23 nt, Homo sapiens
auagcaguugaaacaagaagcca

SEQ ID NO: 406005 - RNA, 15 nt, Homo sapiens
auagcauguaauggu

SEQ ID NO: 406006 - RNA, 21 nt, Homo sapiens
auagcgugagcuaacugagag

SEQ ID NO: 406007 - RNA, 15 nt, Homo sapiens
auagcuaaauggcaa

SEQ ID NO: 406008 - RNA, 17 nt, Homo sapiens
auagcuauauccaugua

SEQ ID NO: 406009 - RNA, 16 nt, Homo sapiens
auagcugggauuugaa

SEQ ID NO: 406010 - RNA, 19 nt, Homo sapiens
auagcugggauuugaacug

SEQ ID NO: 406011 - RNA, 13 nt, Homo sapiens
auagcuucaucca

SEQ ID NO: 406012 - RNA, 12 nt, Homo sapiens
auaggacauacu

SEQ ID NO: 406013 - RNA, 13 nt, Homo sapiens
auaggacuggaag

SEQ ID NO: 406014 - RNA, 14 nt, Homo sapiens
auaggagacuugua

SEQ ID NO: 406015 - RNA, 13 nt, Homo sapiens
auaggagccacaa

SEQ ID NO: 406016 - RNA, 18 nt, Homo sapiens
auaggaggacagaaccaa

SEQ ID NO: 406017 - RNA, 15 nt, Homo sapiens
auaggauauacugua

SEQ ID NO: 406018 - RNA, 18 nt, Homo sapiens
auaggauuauagauacuu

SEQ ID NO: 406019 - RNA, 18 nt, Homo sapiens
auaggccugcucagccuc

SEQ ID NO: 406020 - RNA, 17 nt, Homo sapiens
auagggcuucugccuaa

SEQ ID NO: 406021 - RNA, 12 nt, Homo sapiens
auaggugcuuau

SEQ ID NO: 406022 - RNA, 18 nt, Homo sapiens
auaguaagccucccuccu

SEQ ID NO: 406023 - RNA, 19 nt, Homo sapiens
auaguaccuucaauacuua

SEQ ID NO: 406024 - RNA, 13 nt, Homo sapiens
auaguagcauuuc

SEQ ID NO: 406025 - RNA, 18 nt, Homo sapiens
auagucaauuucuacuuc

SEQ ID NO: 406026 - RNA, 11 nt, Homo sapiens
auagucuuuca

SEQ ID NO: 406027 - RNA, 13 nt, Homo sapiens
auagugauauuau

SEQ ID NO: 406028 - RNA, 21 nt, Homo sapiens
auagugccucagcgcugccca

SEQ ID NO: 406029 - RNA, 23 nt, Homo sapiens
auagugguggugaacagaacaaa

SEQ ID NO: 406030 - RNA, 17 nt, Homo sapiens
auagugucugcugcugc

SEQ ID NO: 406031 - RNA, 22 nt, Homo sapiens
auaguuuaggagaaaccagcuu

SEQ ID NO: 406032 - RNA, 15 nt, Homo sapiens
auauaaacugugaga

SEQ ID NO: 406033 - RNA, 18 nt, Homo sapiens
auauaacaauauaugaua

SEQ ID NO: 406034 - RNA, 13 nt, Homo sapiens
auauaacuuuuuc

SEQ ID NO: 406035 - RNA, 15 nt, Homo sapiens
auauaaugguuuacu

SEQ ID NO: 406036 - RNA, 19 nt, Homo sapiens
auauaaugguuuacugcug

SEQ ID NO: 406037 - RNA, 22 nt, Homo sapiens
auauaccuggcuuuuacuuuau

SEQ ID NO: 406038 - RNA, 12 nt, Homo sapiens
auauacuaugaa

SEQ ID NO: 406039 - RNA, 21 nt, Homo sapiens
auauacuauuuucauucucuu

SEQ ID NO: 406040 - RNA, 13 nt, Homo sapiens
auauacugcauau

SEQ ID NO: 406041 - RNA, 12 nt, Homo sapiens
auauacuguuau

SEQ ID NO: 406042 - RNA, 19 nt, Homo sapiens
auauacuguuauuucacuu

SEQ ID NO: 406043 - RNA, 22 nt, Homo sapiens
auauagagggcuuaugauucag

SEQ ID NO: 406044 - RNA, 22 nt, Homo sapiens
auauagcucuacacaacaugua

SEQ ID NO: 406045 - RNA, 19 nt, Homo sapiens
auauagcuugaaacauaga

SEQ ID NO: 406046 - RNA, 16 nt, Homo sapiens
auauagguugugcaaa

SEQ ID NO: 406047 - RNA, 15 nt, Homo sapiens
auauauaaaccuuaa

SEQ ID NO: 406048 - RNA, 15 nt, Homo sapiens
auauauaagccaaaa

SEQ ID NO: 406049 - RNA, 20 nt, Homo sapiens
auauauaauguggggugaaa

SEQ ID NO: 406050 - RNA, 15 nt, Homo sapiens
auauauuaauaugca

SEQ ID NO: 406051 - RNA, 19 nt, Homo sapiens
auauauuccgcacucaagg

SEQ ID NO: 406052 - RNA, 23 nt, Homo sapiens
auauauuuuugguugucaauauu

SEQ ID NO: 406053 - RNA, 13 nt, Homo sapiens
auaucagagcucu

SEQ ID NO: 406054 - RNA, 23 nt, Homo sapiens
auaucaugccccuguacuccagc

SEQ ID NO: 406055 - RNA, 22 nt, Homo sapiens
auaucauuuauuuuuuacauua

SEQ ID NO: 406056 - RNA, 16 nt, Homo sapiens
auauccaaaccaaaua

SEQ ID NO: 406057 - RNA, 21 nt, Homo sapiens
auaucccuuucucucuugucc

SEQ ID NO: 406058 - RNA, 19 nt, Homo sapiens
auauccuuucuaacaaaaa

SEQ ID NO: 406059 - RNA, 13 nt, Homo sapiens
auaucgaucucuu

SEQ ID NO: 406060 - RNA, 12 nt, Homo sapiens
auaucuaugacu

SEQ ID NO: 406061 - RNA, 17 nt, Homo sapiens
auaucucaauuaccaau

SEQ ID NO: 406062 - RNA, 21 nt, Homo sapiens
auucaauaaagcugcugagaa

SEQ ID NO: 406063 - RNA, 23 nt, Homo sapiens
auucaaucaaccugcacuucaua

SEQ ID NO: 406064 - RNA, 13 nt, Homo sapiens
auucaauuucuca

SEQ ID NO: 406065 - RNA, 13 nt, Homo sapiens
auucacacacagc

SEQ ID NO: 406066 - RNA, 13 nt, Homo sapiens
auucacaguaucu

SEQ ID NO: 406067 - RNA, 16 nt, Homo sapiens
auucaccacccuggga

SEQ ID NO: 406068 - RNA, 22 nt, Homo sapiens
auucaccuuccagugucucgga

SEQ ID NO: 406069 - RNA, 21 nt, Homo sapiens
auucacuagguucgaauccag

SEQ ID NO: 406070 - RNA, 16 nt, Homo sapiens
auucacuugcauuucu

SEQ ID NO: 406071 - RNA, 15 nt, Homo sapiens
auucacuuuaccuuc

SEQ ID NO: 406072 - RNA, 15 nt, Homo sapiens
auucagaauuauaca

SEQ ID NO: 406073 - RNA, 22 nt, Homo sapiens
cagauagucccagcagccuccc

SEQ ID NO: 406074 - RNA, 12 nt, Homo sapiens
cagauauuucac

SEQ ID NO: 406075 - RNA, 18 nt, Homo sapiens
cagaucacuacugcaguc

SEQ ID NO: 406076 - RNA, 22 nt, Homo sapiens
cagaucuggucuaguuaaccua

SEQ ID NO: 406077 - RNA, 16 nt, Homo sapiens
cagaucugugccccau

SEQ ID NO: 406078 - RNA, 21 nt, Homo sapiens
cagaugaaauuuauuuccauc

SEQ ID NO: 406079 - RNA, 22 nt, Homo sapiens
cagaugcccuuuggaaagccau

SEQ ID NO: 406080 - RNA, 22 nt, Homo sapiens
ccagauugacgacaagugcuga

SEQ ID NO: 406081 - RNA, 23 nt, Homo sapiens
ccagauugacgacaagugcugaa

SEQ ID NO: 406082 - RNA, 21 nt, Homo sapiens
ccagauuggcaccccuuucua

SEQ ID NO: 406083 - RNA, 13 nt, Homo sapiens
ccagcaaggcagg

SEQ ID NO: 406084 - RNA, 12 nt, Homo sapiens
ccagcacuggaa

SEQ ID NO: 406085 - RNA, 22 nt, Homo sapiens
ccagcacuuuagaucacuugag

SEQ ID NO: 406086 - RNA, 17 nt, Homo sapiens
ccagcagcccaagcuua

SEQ ID NO: 406087 - RNA, 21 nt, Homo sapiens
ccagcauauacugaagucuuu

SEQ ID NO: 406088 - RNA, 12 nt, Homo sapiens
ccagcccaaagc

SEQ ID NO: 406089 - RNA, 15 nt, Homo sapiens
ccagcccagcuccac

SEQ ID NO: 406090 - RNA, 15 nt, Homo sapiens
ccagccccuaccuug

SEQ ID NO: 406091 - RNA, 17 nt, Homo sapiens
ccagcccucaguuuuca

SEQ ID NO: 406092 - RNA, 17 nt, Homo sapiens
ccagccgaaaagcuuuu

SEQ ID NO: 406093 - RNA, 22 nt, Homo sapiens
ccagccgggguggggugccuga

SEQ ID NO: 406094 - RNA, 14 nt, Homo sapiens
ccagccucaucucu

SEQ ID NO: 406095 - RNA, 19 nt, Homo sapiens
ccagccucuagaacagcca

SEQ ID NO: 406096 - RNA, 20 nt, Homo sapiens
ccagccucuagaacagccag

SEQ ID NO: 406097 - RNA, 21 nt, Homo sapiens
ccagccucuagaacagccaga

SEQ ID NO: 406098 - RNA, 21 nt, Homo sapiens
ccagccuuccucugcagcuga

SEQ ID NO: 406099 - RNA, 15 nt, Homo sapiens
ccagcgucccagucu

SEQ ID NO: 406100 - RNA, 13 nt, Homo sapiens
ccagcguggcgca

SEQ ID NO: 406101 - RNA, 14 nt, Homo sapiens
ccagcuacauuccu

SEQ ID NO: 406102 - RNA, 14 nt, Homo sapiens
ccagcuaugccaaa

SEQ ID NO: 406103 - RNA, 17 nt, Homo sapiens
ccagcucccuagacugc

SEQ ID NO: 406104 - RNA, 19 nt, Homo sapiens
ccagcuccuaguagcuuuc

SEQ ID NO: 406105 - RNA, 22 nt, Homo sapiens
ccagcucuucuccccaggugug

SEQ ID NO: 406106 - RNA, 13 nt, Homo sapiens
ccagcugcagcug

SEQ ID NO: 406107 - RNA, 23 nt, Homo sapiens
ccagcugugguuuucuuuugcca

SEQ ID NO: 406108 - RNA, 22 nt, Homo sapiens
ccagcuguguucacacuguaaa

SEQ ID NO: 406109 - RNA, 18 nt, Homo sapiens
ccagcuucugguacucuc

SEQ ID NO: 406110 - RNA, 17 nt, Homo sapiens
ccagcuugggcccagcu

SEQ ID NO: 406111 - RNA, 21 nt, Homo sapiens
ccagcuuguuugugaaacaaa

SEQ ID NO: 406112 - RNA, 14 nt, Homo sapiens
ccagcuuugcagug

SEQ ID NO: 406113 - RNA, 23 nt, Homo sapiens
ccagcuuuucuugccagcucagc

SEQ ID NO: 406114 - RNA, 16 nt, Homo sapiens
ccaggaauaggcauuu

SEQ ID NO: 406115 - RNA, 20 nt, Homo sapiens
ccaggacucucuuucuucca

SEQ ID NO: 406116 - RNA, 13 nt, Homo sapiens
ccaggagcucuuc

SEQ ID NO: 406117 - RNA, 13 nt, Homo sapiens
ccaggaggcugca

SEQ ID NO: 406118 - RNA, 21 nt, Homo sapiens
ccaggaggggcuguccaauca

SEQ ID NO: 406119 - RNA, 18 nt, Homo sapiens
ccaggauaaggagacuga

SEQ ID NO: 406120 - RNA, 14 nt, Homo sapiens
ccaggauucagcua

SEQ ID NO: 406121 - RNA, 11 nt, Homo sapiens
ccaggauuuug

SEQ ID NO: 406122 - RNA, 19 nt, Homo sapiens
ccaggauuuuguauugcca

SEQ ID NO: 406123 - RNA, 14 nt, Homo sapiens
ccaggcaggcaccu

SEQ ID NO: 406124 - RNA, 16 nt, Homo sapiens
ccaggccacugaccuc

SEQ ID NO: 406125 - RNA, 15 nt, Homo sapiens
ccaggccguccuccc

SEQ ID NO: 406126 - RNA, 15 nt, Homo sapiens
ccaggccugccuguu

SEQ ID NO: 406127 - RNA, 15 nt, Homo sapiens
ccaggcgaugugcaa

SEQ ID NO: 406128 - RNA, 20 nt, Homo sapiens
ccaggcgggcggcacgccaa

SEQ ID NO: 406129 - RNA, 19 nt, Homo sapiens
ccaggcuaguccggaccca

SEQ ID NO: 406130 - RNA, 19 nt, Homo sapiens
ccaggcugcacugcaguga

SEQ ID NO: 406131 - RNA, 18 nt, Homo sapiens
ccaggcuggagggcagug

SEQ ID NO: 406132 - RNA, 20 nt, Homo sapiens
ccaggcuggagugcaaugac

SEQ ID NO: 406133 - RNA, 20 nt, Homo sapiens
ccaggcuggagugcaguggu

SEQ ID NO: 406134 - RNA, 22 nt, Homo sapiens
ccagggacugaagccaaaguua

SEQ ID NO: 406135 - RNA, 14 nt, Homo sapiens
ccagggcaucacau

SEQ ID NO: 406136 - RNA, 17 nt, Homo sapiens
ccagggcucuguauucu

SEQ ID NO: 406137 - RNA, 19 nt, Homo sapiens
ccaggggucucccugagcc

SEQ ID NO: 406138 - RNA, 14 nt, Homo sapiens
ccagggucuuuacu

SEQ ID NO: 406139 - RNA, 18 nt, Homo sapiens
ccaggguucuguauugca

SEQ ID NO: 406140 - RNA, 17 nt, Homo sapiens
ccagguaugcaaauauc

SEQ ID NO: 406141 - RNA, 13 nt, Homo sapiens
ccagguccuguga

SEQ ID NO: 406142 - RNA, 13 nt, Homo sapiens
ccaggugcuaggg

SEQ ID NO: 406143 - RNA, 14 nt, Homo sapiens
ccagguguucuaca

SEQ ID NO: 406144 - RNA, 22 nt, Homo sapiens
ccagguguucuacacucaucuu

SEQ ID NO: 406145 - RNA, 13 nt, Homo sapiens
ccaguacugggaa

SEQ ID NO: 406146 - RNA, 13 nt, Homo sapiens
ccaguagcugcca

SEQ ID NO: 406147 - RNA, 19 nt, Homo sapiens
ccaguauaugcugauggac

SEQ ID NO: 406148 - RNA, 12 nt, Homo sapiens
ccagucccucag

SEQ ID NO: 406149 - RNA, 17 nt, Homo sapiens
ccagucccucagccacu

SEQ ID NO: 406150 - RNA, 17 nt, Homo sapiens
ccaguccucacaugccc

SEQ ID NO: 406151 - RNA, 14 nt, Homo sapiens
ccaguccuccagac

SEQ ID NO: 406152 - RNA, 20 nt, Homo sapiens
ccaguccuguuugcagggaa

SEQ ID NO: 406153 - RNA, 14 nt, Homo sapiens
ccagucucuggcag

SEQ ID NO: 406154 - RNA, 17 nt, Homo sapiens
ccagucuuaccaaacaa

SEQ ID NO: 406155 - RNA, 20 nt, Homo sapiens
ccagugaccccugaccucac

SEQ ID NO: 406156 - RNA, 23 nt, Homo sapiens
ccagugauggcauuacucugcac

SEQ ID NO: 406157 - RNA, 19 nt, Homo sapiens
ccagugccuucugucugcu

SEQ ID NO: 406158 - RNA, 15 nt, Homo sapiens
ccaguggaaccaaaa

SEQ ID NO: 406159 - RNA, 16 nt, Homo sapiens
ccaguggggauuugua

SEQ ID NO: 406160 - RNA, 23 nt, Homo sapiens
ccaguguauuuucuguguuguuc

SEQ ID NO: 406161 - RNA, 21 nt, Homo sapiens
ccaguguccccaggggcacac

SEQ ID NO: 406162 - RNA, 22 nt, Homo sapiens
ccagugugcuugggaucuucaa

SEQ ID NO: 406163 - RNA, 12 nt, Homo sapiens
ccaguuaacugu

SEQ ID NO: 406164 - RNA, 14 nt, Homo sapiens
ccaguuaugaauca

SEQ ID NO: 406165 - RNA, 23 nt, Homo sapiens
ccaguuucagagaaauacuuuca

SEQ ID NO: 406166 - RNA, 13 nt, Homo sapiens
ccauaaaguguaa

SEQ ID NO: 406167 - RNA, 14 nt, Homo sapiens
ccauaacacuugau

SEQ ID NO: 406168 - RNA, 17 nt, Homo sapiens
ccauaauguuccuuagu

SEQ ID NO: 406169 - RNA, 12 nt, Homo sapiens
ccauaauuguuc

SEQ ID NO: 406170 - RNA, 15 nt, Homo sapiens
ccauauucacaccuc

SEQ ID NO: 406171 - RNA, 18 nt, Homo sapiens
ccauauuuguguucaguu

SEQ ID NO: 406172 - RNA, 12 nt, Homo sapiens
ccauccauguga

SEQ ID NO: 406173 - RNA, 19 nt, Homo sapiens
ccauccuaccaaugcaugc

SEQ ID NO: 406174 - RNA, 20 nt, Homo sapiens
ccauccuaccaaugcaugca

SEQ ID NO: 406175 - RNA, 11 nt, Homo sapiens
ccauccucacc

SEQ ID NO: 406176 - RNA, 14 nt, Homo sapiens
ccaucgucuuuaac

SEQ ID NO: 406177 - RNA, 14 nt, Homo sapiens
ccaucuaugagcug

SEQ ID NO: 406178 - RNA, 13 nt, Homo sapiens
ccaucucauuaca

SEQ ID NO: 406179 - RNA, 12 nt, Homo sapiens
ccaucugcugag

SEQ ID NO: 406180 - RNA, 23 nt, Homo sapiens
ccaucugugaggugauaggcaag

SEQ ID NO: 406181 - RNA, 23 nt, Homo sapiens
ccaucuguuugauacaguauuau

SEQ ID NO: 406182 - RNA, 13 nt, Homo sapiens
ccaucuuaaucuu

SEQ ID NO: 406183 - RNA, 22 nt, Homo sapiens
ccaugacaacuucuaauugcca

SEQ ID NO: 406184 - RNA, 14 nt, Homo sapiens
ccaugaccuugacg

SEQ ID NO: 406185 - RNA, 21 nt, Homo sapiens
ccaugaggccucaguggacuu

SEQ ID NO: 406186 - RNA, 11 nt, Homo sapiens
ccaugcaguua

SEQ ID NO: 406187 - RNA, 21 nt, Homo sapiens
ccaugccacugccaggcaccu

SEQ ID NO: 406188 - RNA, 14 nt, Homo sapiens
ccaugccugagggu

SEQ ID NO: 406189 - RNA, 11 nt, Homo sapiens
ccaugccuguc

SEQ ID NO: 406190 - RNA, 19 nt, Homo sapiens
ccauggaagucucaaagau

SEQ ID NO: 406191 - RNA, 14 nt, Homo sapiens
ccauggaugcaugc

SEQ ID NO: 406192 - RNA, 15 nt, Homo sapiens
ccauggccugugcug

SEQ ID NO: 406193 - RNA, 17 nt, Homo sapiens
cauuaauauauccuaaa

SEQ ID NO: 406194 - RNA, 12 nt, Homo sapiens
cauuacugccuu

SEQ ID NO: 406195 - RNA, 23 nt, Homo sapiens
cauuacuuuaauacucaccuccu

SEQ ID NO: 406196 - RNA, 22 nt, Homo sapiens
cauuagaaacugaaaacuguaa

SEQ ID NO: 406197 - RNA, 20 nt, Homo sapiens
cauuagcauucugguuuuga

SEQ ID NO: 406198 - RNA, 23 nt, Homo sapiens
cauuagcauucugguuuugacau

SEQ ID NO: 406199 - RNA, 18 nt, Homo sapiens
cauuaggaacagaguaua

SEQ ID NO: 406200 - RNA, 12 nt, Homo sapiens
cuguagucccag

SEQ ID NO: 406201 - RNA, 19 nt, Homo sapiens
cuguagucccagcuacuca

SEQ ID NO: 406202 - RNA, 22 nt, Homo sapiens
cuguauaauaaacaaucuuaga

SEQ ID NO: 406203 - RNA, 15 nt, Homo sapiens
cuguauacaaacagg

SEQ ID NO: 406204 - RNA, 21 nt, Homo sapiens
cuggaaaccuguuaugccaaa

SEQ ID NO: 406205 - RNA, 19 nt, Homo sapiens
cuggaaaggaugcuucugc

SEQ ID NO: 406206 - RNA, 14 nt, Homo sapiens
cuggaaggacaucu

SEQ ID NO: 406207 - RNA, 15 nt, Homo sapiens
cuggaaggacaucua

SEQ ID NO: 406208 - RNA, 20 nt, Homo sapiens
cuggaauccagaaggaagcu

SEQ ID NO: 406209 - RNA, 23 nt, Homo sapiens
cuggaauuaagggagcugagcca

SEQ ID NO: 406210 - RNA, 13 nt, Homo sapiens
cuggaauugauau

SEQ ID NO: 406211 - RNA, 13 nt, Homo sapiens
cuggacaagccaa

SEQ ID NO: 406212 - RNA, 20 nt, Homo sapiens
cuggaccagaugcugaaaga

SEQ ID NO: 406213 - RNA, 19 nt, Homo sapiens
cuggacuggcccuugccca

SEQ ID NO: 406214 - RNA, 19 nt, Homo sapiens
cuggagacaguaacauuuc

SEQ ID NO: 406215 - RNA, 16 nt, Homo sapiens
cuggagauugugcucu

SEQ ID NO: 406216 - RNA, 16 nt, Homo sapiens
cuggaggacguggacu

SEQ ID NO: 406217 - RNA, 12 nt, Homo sapiens
cuggagugcagu

SEQ ID NO: 406218 - RNA, 13 nt, Homo sapiens
cuggauccaucag

SEQ ID NO: 406219 - RNA, 22 nt, Homo sapiens
cuggauccccucugucuacaaa

SEQ ID NO: 406220 - RNA, 12 nt, Homo sapiens
cuggaugcgugc

SEQ ID NO: 406221 - RNA, 18 nt, Homo sapiens
cuggauguacuuaagagu

SEQ ID NO: 406222 - RNA, 20 nt, Homo sapiens
cuggauuugggagcucugcu

SEQ ID NO: 406223 - RNA, 23 nt, Homo sapiens
cuggcaacaugaagaaugcauuc

SEQ ID NO: 406224 - RNA, 16 nt, Homo sapiens
cuggcaagcagggaaa

SEQ ID NO: 406225 - RNA, 22 nt, Homo sapiens
cuggcacaccagaagugccaug

SEQ ID NO: 406226 - RNA, 23 nt, Homo sapiens
cuggcacacuagauuaguaguaa

SEQ ID NO: 406227 - RNA, 22 nt, Homo sapiens
cuggcacaguguaauccagggg

SEQ ID NO: 406228 - RNA, 16 nt, Homo sapiens
cuggcacccaauguuu

SEQ ID NO: 406229 - RNA, 12 nt, Homo sapiens
cuggcacugacu

SEQ ID NO: 406230 - RNA, 13 nt, Homo sapiens
cuggcagaguuag

SEQ ID NO: 406231 - RNA, 15 nt, Homo sapiens
cuggcagcucuccag

SEQ ID NO: 406232 - RNA, 19 nt, Homo sapiens
cuggcaguacagagugcag

SEQ ID NO: 406233 - RNA, 20 nt, Homo sapiens
cuggcaguacagagugcagc

SEQ ID NO: 406234 - RNA, 22 nt, Homo sapiens
cuggcauagcccuccugagcac

SEQ ID NO: 406235 - RNA, 15 nt, Homo sapiens
cuggcaugacacucu

SEQ ID NO: 406236 - RNA, 17 nt, Homo sapiens
cuggccaaauaugcacu

SEQ ID NO: 406237 - RNA, 12 nt, Homo sapiens
cuggccagagag

SEQ ID NO: 406238 - RNA, 22 nt, Homo sapiens
cuggccauuuaacuagcacuuu

SEQ ID NO: 406239 - RNA, 22 nt, Homo sapiens
cuggcccaagugguuugugcua

SEQ ID NO: 406240 - RNA, 14 nt, Homo sapiens
cuggcccagccaaa

SEQ ID NO: 406241 - RNA, 19 nt, Homo sapiens
cuggcccuguugugggggu

SEQ ID NO: 406242 - RNA, 13 nt, Homo sapiens
cuggcccuugcaa

SEQ ID NO: 406243 - RNA, 16 nt, Homo sapiens
cuggccucagacucau

SEQ ID NO: 406244 - RNA, 16 nt, Homo sapiens
cuggcucagccucaaa

SEQ ID NO: 406245 - RNA, 20 nt, Homo sapiens
cuggcucccagggccaugaa

SEQ ID NO: 406246 - RNA, 21 nt, Homo sapiens
cuggcucccagggccaugaac

SEQ ID NO: 406247 - RNA, 12 nt, Homo sapiens
cuggcucuguca

SEQ ID NO: 406248 - RNA, 13 nt, Homo sapiens
cuggcugcugcca

SEQ ID NO: 406249 - RNA, 17 nt, Homo sapiens
cuggcugguuccagaac

SEQ ID NO: 406250 - RNA, 20 nt, Homo sapiens
cuggcugucaguaugacauu

SEQ ID NO: 406251 - RNA, 19 nt, Homo sapiens
cuggcugugcacauucucc

SEQ ID NO: 406252 - RNA, 20 nt, Homo sapiens
cuggcuucucuugagucaca

SEQ ID NO: 406253 - RNA, 16 nt, Homo sapiens
cuggcuucugcauuac

SEQ ID NO: 406254 - RNA, 17 nt, Homo sapiens
cuggcuuuacauggguu

SEQ ID NO: 406255 - RNA, 16 nt, Homo sapiens
cugggaaaggugcuca

SEQ ID NO: 406256 - RNA, 17 nt, Homo sapiens
cugggaaaggugcucaa

SEQ ID NO: 406257 - RNA, 18 nt, Homo sapiens
cugggaaaggugcucaaa

SEQ ID NO: 406258 - RNA, 16 nt, Homo sapiens
cugggaacucccaaga

SEQ ID NO: 406259 - RNA, 21 nt, Homo sapiens
cugggaacucccaagaacagc

SEQ ID NO: 406260 - RNA, 18 nt, Homo sapiens
cugggaagaauguauucg

SEQ ID NO: 406261 - RNA, 15 nt, Homo sapiens
cugggaagaugcugg

SEQ ID NO: 406262 - RNA, 17 nt, Homo sapiens
cugggaaggacauaaaa

SEQ ID NO: 406263 - RNA, 15 nt, Homo sapiens
cugggaaguggcuua

SEQ ID NO: 406264 - RNA, 15 nt, Homo sapiens
cugggaccuccuuag

SEQ ID NO: 406265 - RNA, 17 nt, Homo sapiens
cugggagaaccaaaaag

SEQ ID NO: 406266 - RNA, 16 nt, Homo sapiens
cugggagaaggugcuu

SEQ ID NO: 406267 - RNA, 21 nt, Homo sapiens
cugggagacuuugaagaccag

SEQ ID NO: 406268 - RNA, 18 nt, Homo sapiens
cugggaugggaacacugg

SEQ ID NO: 406269 - RNA, 15 nt, Homo sapiens
cugggauguuuugag

SEQ ID NO: 406270 - RNA, 21 nt, Homo sapiens
cugggauguuuugagggucuu

SEQ ID NO: 406271 - RNA, 22 nt, Homo sapiens
cugggauuacaauugugagcca

SEQ ID NO: 406272 - RNA, 15 nt, Homo sapiens
cugggauuacaggug

SEQ ID NO: 406273 - RNA, 16 nt, Homo sapiens
cugggcaaagccacaa

SEQ ID NO: 406274 - RNA, 15 nt, Homo sapiens
cugggcagagccugu

SEQ ID NO: 406275 - RNA, 13 nt, Homo sapiens
cugggccaagcca

SEQ ID NO: 406276 - RNA, 19 nt, Homo sapiens
cugggccccaugcucugcc

SEQ ID NO: 406277 - RNA, 21 nt, Homo sapiens
cugggccugcuagucugucag

SEQ ID NO: 406278 - RNA, 16 nt, Homo sapiens
cugggccugugcagca

SEQ ID NO: 406279 - RNA, 21 nt, Homo sapiens
cugggccuuuccugugccaac

SEQ ID NO: 406280 - RNA, 18 nt, Homo sapiens
cugggcucccuugugcgu

SEQ ID NO: 406281 - RNA, 12 nt, Homo sapiens
cugggcugagga

SEQ ID NO: 406282 - RNA, 12 nt, Homo sapiens
cugggcuuugau

SEQ ID NO: 406283 - RNA, 11 nt, Homo sapiens
cuggggaccau

SEQ ID NO: 406284 - RNA, 17 nt, Homo sapiens
cuggggaggcugagacu

SEQ ID NO: 406285 - RNA, 16 nt, Homo sapiens
cuggggagugagcuug

SEQ ID NO: 406286 - RNA, 19 nt, Homo sapiens
cuggggcugagggcauuaa

SEQ ID NO: 406287 - RNA, 17 nt, Homo sapiens
cugggggccucugccuc

SEQ ID NO: 406288 - RNA, 23 nt, Homo sapiens
cuggggggcguggagagcccggc

SEQ ID NO: 406289 - RNA, 17 nt, Homo sapiens
cugggggugaggggcca

SEQ ID NO: 406290 - RNA, 19 nt, Homo sapiens
cugggguccccacucccug

SEQ ID NO: 406291 - RNA, 20 nt, Homo sapiens
cuggguccaggguaggcaag

SEQ ID NO: 406292 - RNA, 16 nt, Homo sapiens
cugggucucacuccug

SEQ ID NO: 406293 - RNA, 23 nt, Homo sapiens
cugggucucgcuuuguugcccag

SEQ ID NO: 406294 - RNA, 20 nt, Homo sapiens
cuggguucccuuuccuucca

SEQ ID NO: 406295 - RNA, 17 nt, Homo sapiens
cugguaauuuguaucug

SEQ ID NO: 406296 - RNA, 16 nt, Homo sapiens
cugguauguguggaug

SEQ ID NO: 406297 - RNA, 13 nt, Homo sapiens
cuggucaccacaa

SEQ ID NO: 406298 - RNA, 15 nt, Homo sapiens
cuggucccuugcagc

SEQ ID NO: 406299 - RNA, 15 nt, Homo sapiens
cuggucucaaacucc

SEQ ID NO: 406300 - RNA, 14 nt, Homo sapiens
cuggucuucaauua

SEQ ID NO: 406301 - RNA, 15 nt, Homo sapiens
cuggugacagccuug

SEQ ID NO: 406302 - RNA, 22 nt, Homo sapiens
cuggugaggagcacagcucagg

SEQ ID NO: 406303 - RNA, 17 nt, Homo sapiens
cuggugcacaugacauu

SEQ ID NO: 406304 - RNA, 14 nt, Homo sapiens
cugguguucuugcu

SEQ ID NO: 406305 - RNA, 23 nt, Homo sapiens
cugguuaaaucaauucugauaca

SEQ ID NO: 406306 - RNA, 23 nt, Homo sapiens
cugguuagaaaaaggacucugcu

SEQ ID NO: 406307 - RNA, 17 nt, Homo sapiens
cugguuagguagaggga

SEQ ID NO: 406308 - RNA, 19 nt, Homo sapiens
cugguuauccugugcuaca

SEQ ID NO: 406309 - RNA, 15 nt, Homo sapiens
cugguuuaaccuccu

SEQ ID NO: 406310 - RNA, 16 nt, Homo sapiens
cugguuuuacagagcu

SEQ ID NO: 406311 - RNA, 20 nt, Homo sapiens
cuguaaaauuagaggauugc

SEQ ID NO: 406312 - RNA, 19 nt, Homo sapiens
cuguaaauggaacaaacaa

SEQ ID NO: 406313 - RNA, 18 nt, Homo sapiens
cuguaagauaauguugcu

SEQ ID NO: 406314 - RNA, 22 nt, Homo sapiens
cuguaagcaccugggcugagga

SEQ ID NO: 406315 - RNA, 20 nt, Homo sapiens
cuguaaucccagcacuuuag

SEQ ID NO: 406316 - RNA, 23 nt, Homo sapiens
cuguaaucccagcacuuugggag

SEQ ID NO: 406317 - RNA, 21 nt, Homo sapiens
cuguaaucccagcuacuuggg

SEQ ID NO: 406318 - RNA, 13 nt, Homo sapiens
cuguacacacccu

SEQ ID NO: 406319 - RNA, 22 nt, Homo sapiens
cuguacccuugagaccuggaac

SEQ ID NO: 406320 - RNA, 21 nt, Homo sapiens
cuguaccucucucugcuccuc

SEQ ID NO: 406321 - RNA, 17 nt, Homo sapiens
cuguaccuggugcccug

SEQ ID NO: 406322 - RNA, 16 nt, Homo sapiens
cuguacugacuugagg

SEQ ID NO: 406323 - RNA, 18 nt, Homo sapiens
cuguacugagacauuaca

SEQ ID NO: 406324 - RNA, 14 nt, Homo sapiens
cuguagaaaugaug

SEQ ID NO: 406325 - RNA, 18 nt, Homo sapiens
cuguagacuagugccgua

SEQ ID NO: 406326 - RNA, 15 nt, Homo sapiens
cuguagccacuggca

SEQ ID NO: 406327 - RNA, 23 nt, Homo sapiens
cuguaguagucaaggugcucaau

SEQ ID NO: 406328 - RNA, 13 nt, Homo sapiens
gcagaaccaaagc

SEQ ID NO: 406329 - RNA, 16 nt, Homo sapiens
gcagaauccucaguug

SEQ ID NO: 406330 - RNA, 16 nt, Homo sapiens
gcagaaucuuugcaag

SEQ ID NO: 406331 - RNA, 18 nt, Homo sapiens
gcagacaguuaagagaaa

SEQ ID NO: 406332 - RNA, 16 nt, Homo sapiens
gcagacuggugagcag

SEQ ID NO: 406333 - RNA, 22 nt, Homo sapiens
gcagacuugaccccgacgccac

SEQ ID NO: 406334 - RNA, 20 nt, Homo sapiens
gcagagauugggggggcuug

SEQ ID NO: 406335 - RNA, 16 nt, Homo sapiens
gcagagcaacugagga

SEQ ID NO: 406336 - RNA, 21 nt, Homo sapiens
gcagagcccucaugugacaug

SEQ ID NO: 406337 - RNA, 19 nt, Homo sapiens
gcagaggagcaaauugagg

SEQ ID NO: 406338 - RNA, 23 nt, Homo sapiens
gcagaggauguucuggaccuccc

SEQ ID NO: 406339 - RNA, 23 nt, Homo sapiens
gcagaggcuccgcggcaggagga

SEQ ID NO: 406340 - RNA, 14 nt, Homo sapiens
gcagauacauauga

SEQ ID NO: 406341 - RNA, 16 nt, Homo sapiens
gcagaucauuucccaa

SEQ ID NO: 406342 - RNA, 22 nt, Homo sapiens
gcagaucauuucccaaaauucu

SEQ ID NO: 406343 - RNA, 13 nt, Homo sapiens
gcagauucuagca

SEQ ID NO: 406344 - RNA, 14 nt, Homo sapiens
gcagcaaugcaaug

SEQ ID NO: 406345 - RNA, 19 nt, Homo sapiens
gcagcaucuacuacucugu

SEQ ID NO: 406346 - RNA, 16 nt, Homo sapiens
gcagccacugugcuga

SEQ ID NO: 406347 - RNA, 13 nt, Homo sapiens
gcagccaggacac

SEQ ID NO: 406348 - RNA, 18 nt, Homo sapiens
gcagcccacagaggacag

SEQ ID NO: 406349 - RNA, 20 nt, Homo sapiens
gcagccccaggaccaagcuu

SEQ ID NO: 406350 - RNA, 20 nt, Homo sapiens
gcagcccggcgccaccaucc

SEQ ID NO: 406351 - RNA, 15 nt, Homo sapiens
gcagccgccuuccuu

SEQ ID NO: 406352 - RNA, 23 nt, Homo sapiens
gcagccucugucgcccuuaguca

SEQ ID NO: 406353 - RNA, 21 nt, Homo sapiens
gcagcgacgugaggguccuga

SEQ ID NO: 406354 - RNA, 20 nt, Homo sapiens
gcagcgccugccgccccggg

SEQ ID NO: 406355 - RNA, 12 nt, Homo sapiens
gcagcuagacac

SEQ ID NO: 406356 - RNA, 12 nt, Homo sapiens
gcagcucaaaau

SEQ ID NO: 406357 - RNA, 23 nt, Homo sapiens
gcagcuccccaggagcucaggug

SEQ ID NO: 406358 - RNA, 14 nt, Homo sapiens
gcagcugaacagug

SEQ ID NO: 406359 - RNA, 23 nt, Homo sapiens
gcagcugcaccagcaggugccau

SEQ ID NO: 406360 - RNA, 17 nt, Homo sapiens
gcagcuggagaucuuaa

SEQ ID NO: 406361 - RNA, 13 nt, Homo sapiens
gcagcugugcugc
